United States Patent 7,691,997 (FUNCTIONAL AND HYPERFUNCTIONAL SIRNA) - sequence listing, part 30

SEQ ID NO: 1213372 - RNA, 19 nt, Homo sapiens
aaaggaagauacaacaugu

SEQ ID NO: 1213373 - RNA, 19 nt, Homo sapiens
gaaacugauguaagaguaa

SEQ ID NO: 1213374 - RNA, 19 nt, Homo sapiens
aggcagaggccaugaauaa

SEQ ID NO: 1213375 - RNA, 19 nt, Homo sapiens
aaacagaaccaugacuuaa

SEQ ID NO: 1213376 - RNA, 19 nt, Homo sapiens
ccaguaaugccuuuagaaa

SEQ ID NO: 1213377 - RNA, 19 nt, Homo sapiens
gacagagaauggagauaau

SEQ ID NO: 1213378 - RNA, 19 nt, Homo sapiens
guagauggguuaaggaaaa

SEQ ID NO: 1213379 - RNA, 19 nt, Homo sapiens
gaagauacaacauguuacu

SEQ ID NO: 1213380 - RNA, 19 nt, Homo sapiens
ugacuuaacgcauaggaaa

SEQ ID NO: 1213381 - RNA, 19 nt, Homo sapiens
uguugaaacugauguaaga

SEQ ID NO: 1213382 - RNA, 19 nt, Homo sapiens
ggaauuuucuuaagagguu

SEQ ID NO: 1213383 - RNA, 19 nt, Homo sapiens
ccaauuugccugugaacaa

SEQ ID NO: 1213384 - RNA, 19 nt, Homo sapiens
agacagagaauggagauaa

SEQ ID NO: 1213385 - RNA, 19 nt, Homo sapiens
uaagagguuucaaauaggu

SEQ ID NO: 1213386 - RNA, 19 nt, Homo sapiens
aggaagauacaacauguua

SEQ ID NO: 1213387 - RNA, 19 nt, Homo sapiens
cuacuccagugaaguuaaa

SEQ ID NO: 1213388 - RNA, 19 nt, Homo sapiens
acauagcuguugaaacuga

SEQ ID NO: 1213389 - RNA, 19 nt, Homo sapiens
ggagauaaugaucgacuga

SEQ ID NO: 1213390 - RNA, 19 nt, Homo sapiens
caauuugccugugaacaau

SEQ ID NO: 1213391 - RNA, 19 nt, Homo sapiens
gggauuugccgaagaauag

SEQ ID NO: 1213392 - RNA, 19 nt, Homo sapiens
gauguaagaguaaacaaag

SEQ ID NO: 1213393 - RNA, 19 nt, Homo sapiens
caacaaguacaagcauaaa

SEQ ID NO: 1213394 - RNA, 19 nt, Homo sapiens
ucaacaaguacaagcauaa

SEQ ID NO: 1213395 - RNA, 19 nt, Homo sapiens
agagggauuugccgaagaa

SEQ ID NO: 1213396 - RNA, 19 nt, Homo sapiens
cggaacacaauaauaauga

SEQ ID NO: 1213397 - RNA, 19 nt, Homo sapiens
gagaauggagauaaugauc

SEQ ID NO: 1213398 - RNA, 19 nt, Homo sapiens
cagagaauggagauaauga

SEQ ID NO: 1213399 - RNA, 19 nt, Homo sapiens
uaaugacgcuaaacagaac

SEQ ID NO: 1213400 - RNA, 19 nt, Homo sapiens
ggaaguucaacaaguacaa

SEQ ID NO: 1213401 - RNA, 19 nt, Homo sapiens
ugauggaaguucaacaagu

SEQ ID NO: 1213402 - RNA, 19 nt, Homo sapiens
gaaaagagaacaacaugag

SEQ ID NO: 1213403 - RNA, 19 nt, Homo sapiens
ggaacacaauaauaaugac

SEQ ID NO: 1213404 - RNA, 19 nt, Homo sapiens
caaauuccucuucgagugu

SEQ ID NO: 1213405 - RNA, 19 nt, Homo sapiens
uuacuuggcccugaagaaa

SEQ ID NO: 1213406 - RNA, 19 nt, Homo sapiens
aauaaugacgcuaaacaga

SEQ ID NO: 1213407 - RNA, 19 nt, Homo sapiens
cagagggauuugccgaaga

SEQ ID NO: 1213408 - RNA, 19 nt, Homo sapiens
uaaaaggaguagcacugua

SEQ ID NO: 1213409 - RNA, 19 nt, Homo sapiens
cauguuacuuggcccugaa

SEQ ID NO: 1213410 - RNA, 19 nt, Homo sapiens
cuaaacagaaccaugacuu

SEQ ID NO: 1213411 - RNA, 19 nt, Homo sapiens
auaaugacgcuaaacagaa

SEQ ID NO: 1213412 - RNA, 19 nt, Homo sapiens
cguauuugauggaaguuca

SEQ ID NO: 1213413 - RNA, 19 nt, Homo sapiens
agagaacaacaugagauua

SEQ ID NO: 1213414 - RNA, 19 nt, Homo sapiens
aaagagaacaacaugagau

SEQ ID NO: 1213415 - RNA, 19 nt, Homo sapiens
agauacaacauguuacuug

SEQ ID NO: 1213416 - RNA, 19 nt, Homo sapiens
ccugauuauuguggaauuu

SEQ ID NO: 1213417 - RNA, 19 nt, Homo sapiens
ggccaugaauaaccugaag

SEQ ID NO: 1213418 - RNA, 19 nt, Homo sapiens
uaccaguaaugccuuuaga

SEQ ID NO: 1213419 - RNA, 19 nt, Homo sapiens
guacaagcauaaaagugaa

SEQ ID NO: 1213420 - RNA, 19 nt, Homo sapiens
uuaagagguuucaaauagg

SEQ ID NO: 1213421 - RNA, 19 nt, Homo sapiens
gaggcagaggccaugaaua

SEQ ID NO: 1213422 - RNA, 19 nt, Homo sapiens
aagagaacaacaugagauu

SEQ ID NO: 1213423 - RNA, 19 nt, Homo sapiens
gaagaggcagaggccauga

SEQ ID NO: 1213424 - RNA, 19 nt, Homo sapiens
gagguuucaaauagguuua

SEQ ID NO: 1213425 - RNA, 19 nt, Homo sapiens
acgcuaaacagaaccauga

SEQ ID NO: 1213426 - RNA, 19 nt, Homo sapiens
gagauaaugaucgacugaa

SEQ ID NO: 1213427 - RNA, 19 nt, Homo sapiens
uucaacaaguacaagcaua

SEQ ID NO: 1213428 - RNA, 19 nt, Homo sapiens
acagaaccaugacuuaacg

SEQ ID NO: 1213429 - RNA, 19 nt, Homo sapiens
agauaaugaucgacugaag

SEQ ID NO: 1213430 - RNA, 19 nt, Homo sapiens
gcagaggccaugaauaacc

SEQ ID NO: 1213431 - RNA, 19 nt, Homo sapiens
gaaguucaacaaguacaag

SEQ ID NO: 1213432 - RNA, 19 nt, Homo sapiens
aaagaccccucaucguauu

SEQ ID NO: 1213433 - RNA, 19 nt, Homo sapiens
ugaagucgccaccauuguc

SEQ ID NO: 1213434 - RNA, 19 nt, Homo sapiens
guaagaguaaacaaagaca

SEQ ID NO: 1213435 - RNA, 19 nt, Homo sapiens
caauaaaacggaacacaau

SEQ ID NO: 1213436 - RNA, 19 nt, Homo sapiens
gcuguugaaacugauguaa

SEQ ID NO: 1213437 - RNA, 19 nt, Homo sapiens
ggaagauacaacauguuac

SEQ ID NO: 1213438 - RNA, 19 nt, Homo sapiens
ggaaaagaaaagagaacaa

SEQ ID NO: 1213439 - RNA, 19 nt, Homo sapiens
cagaggccaugaauaaccu

SEQ ID NO: 1213440 - RNA, 19 nt, Homo sapiens
ggacucaaguugcuuuaua

SEQ ID NO: 1213441 - RNA, 19 nt, Homo sapiens
gaaggaagauucacacugu

SEQ ID NO: 1213442 - RNA, 19 nt, Homo sapiens
gugcauuacucacuaaaua

SEQ ID NO: 1213443 - RNA, 19 nt, Homo sapiens
gaaaguagaugauuuaccu

SEQ ID NO: 1213444 - RNA, 19 nt, Homo sapiens
uaacucagcuuguggauuc

SEQ ID NO: 1213445 - RNA, 19 nt, Homo sapiens
guuauaggauguagcuuua

SEQ ID NO: 1213446 - RNA, 19 nt, Homo sapiens
cuaaaugccuguaagauug

SEQ ID NO: 1213447 - RNA, 19 nt, Homo sapiens
gauucacacuguaacauua

SEQ ID NO: 1213448 - RNA, 19 nt, Homo sapiens
acacugagaucuuugguuu

SEQ ID NO: 1213449 - RNA, 19 nt, Homo sapiens
uaacuuagcuaaugaacuc

SEQ ID NO: 1213450 - RNA, 19 nt, Homo sapiens
aagaagauauugcuccaua

SEQ ID NO: 1213451 - RNA, 19 nt, Homo sapiens
gaacacaugccuucaggaa

SEQ ID NO: 1213452 - RNA, 19 nt, Homo sapiens
gcagacacuuccaauaugu

SEQ ID NO: 1213453 - RNA, 19 nt, Homo sapiens
gcugaaaguagaugauuua

SEQ ID NO: 1213454 - RNA, 19 nt, Homo sapiens
gauagaacacugucuuaaa

SEQ ID NO: 1213455 - RNA, 19 nt, Homo sapiens
caaacacgauggcuucgaa

SEQ ID NO: 1213456 - RNA, 19 nt, Homo sapiens
gaacaacagucuuuucuuc

SEQ ID NO: 1213457 - RNA, 19 nt, Homo sapiens
gcacgaaugcuacuucaga

SEQ ID NO: 1213458 - RNA, 19 nt, Homo sapiens
ccaugaaauuggcugaaua

SEQ ID NO: 1213459 - RNA, 19 nt, Homo sapiens
gacucaaguugcuuuauaa

SEQ ID NO: 1213460 - RNA, 19 nt, Homo sapiens
ugaguuggaugcugauaaa

SEQ ID NO: 1213461 - RNA, 19 nt, Homo sapiens
ucugaggucucuaugauuu

SEQ ID NO: 1213462 - RNA, 19 nt, Homo sapiens
uaaaguugcuggauacaag

SEQ ID NO: 1213463 - RNA, 19 nt, Homo sapiens
gcaaaaugguguuaaaguu

SEQ ID NO: 1213464 - RNA, 19 nt, Homo sapiens
ggaagaaauauguagauga

SEQ ID NO: 1213465 - RNA, 19 nt, Homo sapiens
agaugaaacuucugaauca

SEQ ID NO: 1213466 - RNA, 19 nt, Homo sapiens
gaagaaauaaugacccaau

SEQ ID NO: 1213467 - RNA, 19 nt, Homo sapiens
gcaaaccauaggugcauua

SEQ ID NO: 1213468 - RNA, 19 nt, Homo sapiens
ccuguaagauuggagguua

SEQ ID NO: 1213469 - RNA, 19 nt, Homo sapiens
guaacauuauucacacuga

SEQ ID NO: 1213470 - RNA, 19 nt, Homo sapiens
cagaggaaaugauagaaca

SEQ ID NO: 1213471 - RNA, 19 nt, Homo sapiens
gaaguggacagaagaagau

SEQ ID NO: 1213472 - RNA, 19 nt, Homo sapiens
uugaucagcuuaaggguuu

SEQ ID NO: 1213473 - RNA, 19 nt, Homo sapiens
ggaaugguaacuagucuug

SEQ ID NO: 1213474 - RNA, 19 nt, Homo sapiens
gggaagaaauauguagaug

SEQ ID NO: 1213475 - RNA, 19 nt, Homo sapiens
caacugaagauuugcuuga

SEQ ID NO: 1213476 - RNA, 19 nt, Homo sapiens
agacguagacccaaguuaa

SEQ ID NO: 1213477 - RNA, 19 nt, Homo sapiens
uagcagacacuuccaauau

SEQ ID NO: 1213478 - RNA, 19 nt, Homo sapiens
ggagccagaggaaaugaua

SEQ ID NO: 1213479 - RNA, 19 nt, Homo sapiens
ugaaacuucugaaucaugu

SEQ ID NO: 1213480 - RNA, 19 nt, Homo sapiens
gagaugaaacuucugaauc

SEQ ID NO: 1213481 - RNA, 19 nt, Homo sapiens
cuugggaacuucuuucuug

SEQ ID NO: 1213482 - RNA, 19 nt, Homo sapiens
gaaggaaugguaacuaguc

SEQ ID NO: 1213483 - RNA, 19 nt, Homo sapiens
caaguaauuucuaguuggu

SEQ ID NO: 1213484 - RNA, 19 nt, Homo sapiens
caugaaauuggcugaauaa

SEQ ID NO: 1213485 - RNA, 19 nt, Homo sapiens
ggagagaagcaaaccauag

SEQ ID NO: 1213486 - RNA, 19 nt, Homo sapiens
cuccucaucuuaagcauuu

SEQ ID NO: 1213487 - RNA, 19 nt, Homo sapiens
ggcaagugaggaagaaaua

SEQ ID NO: 1213488 - RNA, 19 nt, Homo sapiens
gagaaggauucaaauagcu

SEQ ID NO: 1213489 - RNA, 19 nt, Homo sapiens
guuuagcgcugguggauag

SEQ ID NO: 1213490 - RNA, 19 nt, Homo sapiens
gcaagugaggaagaaauaa

SEQ ID NO: 1213491 - RNA, 19 nt, Homo sapiens
aaacauacgacuugaagau

SEQ ID NO: 1213492 - RNA, 19 nt, Homo sapiens
cacgauggcuucgaaaugu

SEQ ID NO: 1213493 - RNA, 19 nt, Homo sapiens
uggaaugcuugauaaaguu

SEQ ID NO: 1213494 - RNA, 19 nt, Homo sapiens
gaggauggacacagucuug

SEQ ID NO: 1213495 - RNA, 19 nt, Homo sapiens
gcugugcaguaaagacaaa

SEQ ID NO: 1213496 - RNA, 19 nt, Homo sapiens
uagaugaaggcgaaguuua

SEQ ID NO: 1213497 - RNA, 19 nt, Homo sapiens
agaacacugucuuaaaugu

SEQ ID NO: 1213498 - RNA, 19 nt, Homo sapiens
ggaaaugauagaacacugu

SEQ ID NO: 1213499 - RNA, 19 nt, Homo sapiens
gaacaugaaauacaaacac

SEQ ID NO: 1213500 - RNA, 19 nt, Homo sapiens
gcagcagaguguuccugaa

SEQ ID NO: 1213501 - RNA, 19 nt, Homo sapiens
guuggaugcugauaaaaua

SEQ ID NO: 1213502 - RNA, 19 nt, Homo sapiens
gacguagacccaaguuaaa

SEQ ID NO: 1213503 - RNA, 19 nt, Homo sapiens
guuaaaugguccacguuuc

SEQ ID NO: 1213504 - RNA, 19 nt, Homo sapiens
gaaugcuacuucagaaugc

SEQ ID NO: 1213505 - RNA, 19 nt, Homo sapiens
acacaugccuucaggaacu

SEQ ID NO: 1213506 - RNA, 19 nt, Homo sapiens
ucuaaaugccuguaagauu

SEQ ID NO: 1213507 - RNA, 19 nt, Homo sapiens
ggaauuaagaagacguaga

SEQ ID NO: 1213508 - RNA, 19 nt, Homo sapiens
aggcaaugcucacucgaaa

SEQ ID NO: 1213509 - RNA, 19 nt, Homo sapiens
ggaagccucuaggugcuau

SEQ ID NO: 1213510 - RNA, 19 nt, Homo sapiens
ugucugaggucucuaugau

SEQ ID NO: 1213511 - RNA, 19 nt, Homo sapiens
caagauuuguguggagaga

SEQ ID NO: 1213512 - RNA, 19 nt, Homo sapiens
ugauuuaccugaggauaau

SEQ ID NO: 1213513 - RNA, 19 nt, Homo sapiens
ggagguuauuggaggauuc

SEQ ID NO: 1213514 - RNA, 19 nt, Homo sapiens
gaagauucacacuguaaca

SEQ ID NO: 1213515 - RNA, 19 nt, Homo sapiens
gcagaucgccaagcugaau

SEQ ID NO: 1213516 - RNA, 19 nt, Homo sapiens
gcaguaaagacaaaacaua

SEQ ID NO: 1213517 - RNA, 19 nt, Homo sapiens
ggagaaguggacagaagaa

SEQ ID NO: 1213518 - RNA, 19 nt, Homo sapiens
gaugaaggcgaaguuuauu

SEQ ID NO: 1213519 - RNA, 19 nt, Homo sapiens
aagcugugcugugcaguaa

SEQ ID NO: 1213520 - RNA, 19 nt, Homo sapiens
caagugaggaagaaauaau

SEQ ID NO: 1213521 - RNA, 19 nt, Homo sapiens
cugaagauuugcuugauca

SEQ ID NO: 1213522 - RNA, 19 nt, Homo sapiens
gaauuaagaagacguagac

SEQ ID NO: 1213523 - RNA, 19 nt, Homo sapiens
ucuaggugcuaucaauuau

SEQ ID NO: 1213524 - RNA, 19 nt, Homo sapiens
gaguuccccucuacuuuua

SEQ ID NO: 1213525 - RNA, 19 nt, Homo sapiens
cuuaggauuugauguucua

SEQ ID NO: 1213526 - RNA, 19 nt, Homo sapiens
gaaaccuagucuucuaagg

SEQ ID NO: 1213527 - RNA, 19 nt, Homo sapiens
cgaaugcuacuucagaaug

SEQ ID NO: 1213528 - RNA, 19 nt, Homo sapiens
ugaggucucuaugauuuau

SEQ ID NO: 1213529 - RNA, 19 nt, Homo sapiens
aaccauaggugcauuacuc

SEQ ID NO: 1213530 - RNA, 19 nt, Homo sapiens
gcuggaggauggacacagu

SEQ ID NO: 1213531 - RNA, 19 nt, Homo sapiens
gaugcaaaaugguguuaaa

SEQ ID NO: 1213532 - RNA, 19 nt, Homo sapiens
caaucucgcugaguuucaa

SEQ ID NO: 1213533 - RNA, 19 nt, Homo sapiens
cacgaaugcuacuucagaa

SEQ ID NO: 1213534 - RNA, 19 nt, Homo sapiens
gcugugcugugcaguaaag

SEQ ID NO: 1213535 - RNA, 19 nt, Homo sapiens
gaagacguagacccaaguu

SEQ ID NO: 1213536 - RNA, 19 nt, Homo sapiens
uuauaaaguugcuggauac

SEQ ID NO: 1213537 - RNA, 19 nt, Homo sapiens
ggacagaagaagauauugc

SEQ ID NO: 1213538 - RNA, 19 nt, Homo sapiens
acauacgacuugaagauag

SEQ ID NO: 1213539 - RNA, 19 nt, Homo sapiens
gguuaaaugguccacguuu

SEQ ID NO: 1213540 - RNA, 19 nt, Homo sapiens
ggcgauaacuucuagauua

SEQ ID NO: 1213541 - RNA, 19 nt, Homo sapiens
ccaguaggaugucauguaa

SEQ ID NO: 1213542 - RNA, 19 nt, Homo sapiens
ccacaggacuugcaacuca

SEQ ID NO: 1213543 - RNA, 19 nt, Homo sapiens
agagagaucugguuucuag

SEQ ID NO: 1213544 - RNA, 19 nt, Homo sapiens
ggccagaccucaaccuaga

SEQ ID NO: 1213545 - RNA, 19 nt, Homo sapiens
ggagcuggcagaacucuuu

SEQ ID NO: 1213546 - RNA, 19 nt, Homo sapiens
gaucugguuucuagcaaau

SEQ ID NO: 1213547 - RNA, 19 nt, Homo sapiens
ccgcaaguauacagaauug

SEQ ID NO: 1213548 - RNA, 19 nt, Homo sapiens
ggguucaaaugccaucuuu

SEQ ID NO: 1213549 - RNA, 19 nt, Homo sapiens
caaauucccaguaggaugu

SEQ ID NO: 1213550 - RNA, 19 nt, Homo sapiens
uuagugacguccucaucua

SEQ ID NO: 1213551 - RNA, 19 nt, Homo sapiens
gagaucugguuucuagcaa

SEQ ID NO: 1213552 - RNA, 19 nt, Homo sapiens
gagauugaaggcuguaaga

SEQ ID NO: 1213553 - RNA, 19 nt, Homo sapiens
gguguuuguucucccagua

SEQ ID NO: 1213554 - RNA, 19 nt, Homo sapiens
ucaucuaccugguggcauu

SEQ ID NO: 1213555 - RNA, 19 nt, Homo sapiens
cugcggacauucccuguga

SEQ ID NO: 1213556 - RNA, 19 nt, Homo sapiens
ucagcuuccuugucuauca

SEQ ID NO: 1213557 - RNA, 19 nt, Homo sapiens
gcagugcucuccaaaaugg

SEQ ID NO: 1213558 - RNA, 19 nt, Homo sapiens
aguaggaugucauguaagu

SEQ ID NO: 1213559 - RNA, 19 nt, Homo sapiens
gauugaaggcuguaagagu

SEQ ID NO: 1213560 - RNA, 19 nt, Homo sapiens
gcacuucagcuuccuuguc

SEQ ID NO: 1213561 - RNA, 19 nt, Homo sapiens
acacuugcaagcuaaauga

SEQ ID NO: 1213562 - RNA, 19 nt, Homo sapiens
ccugaggccuccacuucuu

SEQ ID NO: 1213563 - RNA, 19 nt, Homo sapiens
aaagauggccacaggacuu

SEQ ID NO: 1213564 - RNA, 19 nt, Homo sapiens
ccgccuccaugcugaguuu

SEQ ID NO: 1213565 - RNA, 19 nt, Homo sapiens
cagcuuccuugucuaucaa

SEQ ID NO: 1213566 - RNA, 19 nt, Homo sapiens
uagcaaauucccaguagga

SEQ ID NO: 1213567 - RNA, 19 nt, Homo sapiens
ccagcagccucuagaaggu

SEQ ID NO: 1213568 - RNA, 19 nt, Homo sapiens
ucuagcaaauucccaguag

SEQ ID NO: 1213569 - RNA, 19 nt, Homo sapiens
gggcgauaacuucuagauu

SEQ ID NO: 1213570 - RNA, 19 nt, Homo sapiens
gcucuucccgcaaguauac

SEQ ID NO: 1213571 - RNA, 19 nt, Homo sapiens
gaauaguaccugcccaaaa

SEQ ID NO: 1213572 - RNA, 19 nt, Homo sapiens
caggcugucuggguucaaa

SEQ ID NO: 1213573 - RNA, 19 nt, Homo sapiens
cccaguaggaugucaugua

SEQ ID NO: 1213574 - RNA, 19 nt, Homo sapiens
gaugucauguaaguuccuu

SEQ ID NO: 1213575 - RNA, 19 nt, Homo sapiens
uaggaugucauguaaguuc

SEQ ID NO: 1213576 - RNA, 19 nt, Homo sapiens
gaccucaaccuagaaagau

SEQ ID NO: 1213577 - RNA, 19 nt, Homo sapiens
cagaacucuuucaguggaa

SEQ ID NO: 1213578 - RNA, 19 nt, Homo sapiens
cuuugacacuugcaagcua

SEQ ID NO: 1213579 - RNA, 19 nt, Homo sapiens
ccagggaggcucucugucu

SEQ ID NO: 1213580 - RNA, 19 nt, Homo sapiens
cacuucagcuuccuugucu

SEQ ID NO: 1213581 - RNA, 19 nt, Homo sapiens
aagguagccuccugguguu

SEQ ID NO: 1213582 - RNA, 19 nt, Homo sapiens
ccagaccucaaccuagaaa

SEQ ID NO: 1213583 - RNA, 19 nt, Homo sapiens
ugaguuugcugcggaacga

SEQ ID NO: 1213584 - RNA, 19 nt, Homo sapiens
uuugacacuugcaagcuaa

SEQ ID NO: 1213585 - RNA, 19 nt, Homo sapiens
ucugguuucuagcaaauuc

SEQ ID NO: 1213586 - RNA, 19 nt, Homo sapiens
guagccuccugguguuugu

SEQ ID NO: 1213587 - RNA, 19 nt, Homo sapiens
agaccucaaccuagaaaga

SEQ ID NO: 1213588 - RNA, 19 nt, Homo sapiens
ggaacgagacugggaacag

SEQ ID NO: 1213589 - RNA, 19 nt, Homo sapiens
agaucugguuucuagcaaa

SEQ ID NO: 1213590 - RNA, 19 nt, Homo sapiens
gcagcucuucccgcaagua

SEQ ID NO: 1213591 - RNA, 19 nt, Homo sapiens
ccacaggccagaccucaac

SEQ ID NO: 1213592 - RNA, 19 nt, Homo sapiens
gacacuugcaagcuaaaug

SEQ ID NO: 1213593 - RNA, 19 nt, Homo sapiens
uucaagaggagcuuaguga

SEQ ID NO: 1213594 - RNA, 19 nt, Homo sapiens
caucuaccugguggcauua

SEQ ID NO: 1213595 - RNA, 19 nt, Homo sapiens
cagcagccucuagaaggua

SEQ ID NO: 1213596 - RNA, 19 nt, Homo sapiens
gcagaaggcugaugaauuc

SEQ ID NO: 1213597 - RNA, 19 nt, Homo sapiens
ccauguagcuuguaauaua

SEQ ID NO: 1213598 - RNA, 19 nt, Homo sapiens
ggaaagagacccuguguga

SEQ ID NO: 1213599 - RNA, 19 nt, Homo sapiens
ggaagaugcucacagagau

SEQ ID NO: 1213600 - RNA, 19 nt, Homo sapiens
gaauaaucauugagacaga

SEQ ID NO: 1213601 - RNA, 19 nt, Homo sapiens
caucauuucuccaaaggaa

SEQ ID NO: 1213602 - RNA, 19 nt, Homo sapiens
gagcaaaugccaccaacaa

SEQ ID NO: 1213603 - RNA, 19 nt, Homo sapiens
ggaugggaauaaucauuga

SEQ ID NO: 1213604 - RNA, 19 nt, Homo sapiens
ucacaaacuucuuggaaag

SEQ ID NO: 1213605 - RNA, 19 nt, Homo sapiens
ggagaguggucagcaguau

SEQ ID NO: 1213606 - RNA, 19 nt, Homo sapiens
aaagagacccugugugaau

SEQ ID NO: 1213607 - RNA, 19 nt, Homo sapiens
gaaagagacccugugugaa

SEQ ID NO: 1213608 - RNA, 19 nt, Homo sapiens
agucauagcugagcaaauc

SEQ ID NO: 1213609 - RNA, 19 nt, Homo sapiens
aaagguugguggaucguuu

SEQ ID NO: 1213610 - RNA, 19 nt, Homo sapiens
ucagucaguuucagaguau

SEQ ID NO: 1213611 - RNA, 19 nt, Homo sapiens
gaccacagauacccaaguc

SEQ ID NO: 1213612 - RNA, 19 nt, Homo sapiens
gcacugaacccaacuucca

SEQ ID NO: 1213613 - RNA, 19 nt, Homo sapiens
gaauucauccgagcaaaug

SEQ ID NO: 1213614 - RNA, 19 nt, Homo sapiens
caaacuacagcaugacuug

SEQ ID NO: 1213615 - RNA, 19 nt, Homo sapiens
guuaaaguguuagagaaga

SEQ ID NO: 1213616 - RNA, 19 nt, Homo sapiens
gucagucaguuucagagua

SEQ ID NO: 1213617 - RNA, 19 nt, Homo sapiens
caccauguagcuuguaaua

SEQ ID NO: 1213618 - RNA, 19 nt, Homo sapiens
gggaugggaauaaucauug

SEQ ID NO: 1213619 - RNA, 19 nt, Homo sapiens
gacccugugugaauguaaa

SEQ ID NO: 1213620 - RNA, 19 nt, Homo sapiens
acuguugccuugagaauug

SEQ ID NO: 1213621 - RNA, 19 nt, Homo sapiens
ccaguguacuuuccuucuu

SEQ ID NO: 1213622 - RNA, 19 nt, Homo sapiens
gauaaggcgcugucaugga

SEQ ID NO: 1213623 - RNA, 19 nt, Homo sapiens
gagaauugaagacauguag

SEQ ID NO: 1213624 - RNA, 19 nt, Homo sapiens
cauguagcuuguaauauag

SEQ ID NO: 1213625 - RNA, 19 nt, Homo sapiens
gaagaugcucacagagaug

SEQ ID NO: 1213626 - RNA, 19 nt, Homo sapiens
agaguggucagcaguauuu

SEQ ID NO: 1213627 - RNA, 19 nt, Homo sapiens
gaauugaagacauguaggu

SEQ ID NO: 1213628 - RNA, 19 nt, Homo sapiens
uaauugggaugggaauaau

SEQ ID NO: 1213629 - RNA, 19 nt, Homo sapiens
gagacccugugugaaugua

SEQ ID NO: 1213630 - RNA, 19 nt, Homo sapiens
acuggaagaugcucacaga

SEQ ID NO: 1213631 - RNA, 19 nt, Homo sapiens
ucgcagagcaggugcagaa

SEQ ID NO: 1213632 - RNA, 19 nt, Homo sapiens
caucacuucuucccuuaag

SEQ ID NO: 1213633 - RNA, 19 nt, Homo sapiens
cucacaaacuucuuggaaa

SEQ ID NO: 1213634 - RNA, 19 nt, Homo sapiens
aauccaacauuugcaagaa

SEQ ID NO: 1213635 - RNA, 19 nt, Homo sapiens
uuaauugggaugggaauaa

SEQ ID NO: 1213636 - RNA, 19 nt, Homo sapiens
gcugagcaaauccaacauu

SEQ ID NO: 1213637 - RNA, 19 nt, Homo sapiens
cuugagaauugaagacaug

SEQ ID NO: 1213638 - RNA, 19 nt, Homo sapiens
uccaucacuucuucccuua

SEQ ID NO: 1213639 - RNA, 19 nt, Homo sapiens
cguaugaggacauugagaa

SEQ ID NO: 1213640 - RNA, 19 nt, Homo sapiens
caguguacuuuccuucuuc

SEQ ID NO: 1213641 - RNA, 19 nt, Homo sapiens
caagucagucaguuucaga

SEQ ID NO: 1213642 - RNA, 19 nt, Homo sapiens
agaacaagccaggaaggua

SEQ ID NO: 1213643 - RNA, 19 nt, Homo sapiens
gggaauaaucauugagaca

SEQ ID NO: 1213644 - RNA, 19 nt, Homo sapiens
gagaguggucagcaguauu

SEQ ID NO: 1213645 - RNA, 19 nt, Homo sapiens
gggagaguggucagcagua

SEQ ID NO: 1213646 - RNA, 19 nt, Homo sapiens
uggaagaugcucacagaga

SEQ ID NO: 1213647 - RNA, 19 nt, Homo sapiens
ugcagaaggcugaugaauu

SEQ ID NO: 1213648 - RNA, 19 nt, Homo sapiens
aagagacccugugugaaug

SEQ ID NO: 1213649 - RNA, 19 nt, Homo sapiens
guauuggccaguguacuuu

SEQ ID NO: 1213650 - RNA, 19 nt, Homo sapiens
ugauggacauguugcuaag

SEQ ID NO: 1213651 - RNA, 19 nt, Homo sapiens
caaaugccaccaacaagcu

SEQ ID NO: 1213652 - RNA, 19 nt, Homo sapiens
uagcugagcaaauccaaca

SEQ ID NO: 1213653 - RNA, 19 nt, Homo sapiens
ggcaacauuuacuaucucu

SEQ ID NO: 1213654 - RNA, 19 nt, Homo sapiens
ucagaguauuggccagugu

SEQ ID NO: 1213655 - RNA, 19 nt, Homo sapiens
cagaguauuggccagugua

SEQ ID NO: 1213656 - RNA, 19 nt, Homo sapiens
ccucuuuggaccacagaua

SEQ ID NO: 1213657 - RNA, 19 nt, Homo sapiens
ggacauugagaagcaagau

SEQ ID NO: 1213658 - RNA, 19 nt, Homo sapiens
ugaauucauccgagcaaau

SEQ ID NO: 1213659 - RNA, 19 nt, Homo sapiens
aggauaaggcgcugucaug

SEQ ID NO: 1213660 - RNA, 19 nt, Homo sapiens
acucacaaacuucuuggaa

SEQ ID NO: 1213661 - RNA, 19 nt, Homo sapiens
ccacuguugccuugagaau

SEQ ID NO: 1213662 - RNA, 19 nt, Homo sapiens
ggaccacagauacccaagu

SEQ ID NO: 1213663 - RNA, 19 nt, Homo sapiens
ccaagaaguugaauaaaga

SEQ ID NO: 1213664 - RNA, 19 nt, Homo sapiens
ggaaggaccgcuccaagaa

SEQ ID NO: 1213665 - RNA, 19 nt, Homo sapiens
ccaagugccuucaaaccaa

SEQ ID NO: 1213666 - RNA, 19 nt, Homo sapiens
cagcugcgcuccauugaga

SEQ ID NO: 1213667 - RNA, 19 nt, Homo sapiens
agaggaagcuggccaagga

SEQ ID NO: 1213668 - RNA, 19 nt, Homo sapiens
gcagaggucguccaaguga

SEQ ID NO: 1213669 - RNA, 19 nt, Homo sapiens
gaaggaccgcuccaagaaa

SEQ ID NO: 1213670 - RNA, 19 nt, Homo sapiens
gaagacaagcccaggauca

SEQ ID NO: 1213671 - RNA, 19 nt, Homo sapiens
gcagggguguggaaacuua

SEQ ID NO: 1213672 - RNA, 19 nt, Homo sapiens
gaagcuggccaaggacuuu

SEQ ID NO: 1213673 - RNA, 19 nt, Homo sapiens
cgaggagcuuucauucuga

SEQ ID NO: 1213674 - RNA, 19 nt, Homo sapiens
ucgaggagcuuucauucug

SEQ ID NO: 1213675 - RNA, 19 nt, Homo sapiens
gagcuuucauucugaugga

SEQ ID NO: 1213676 - RNA, 19 nt, Homo sapiens
gcauacaggcacaauccua

SEQ ID NO: 1213677 - RNA, 19 nt, Homo sapiens
cguccaagaaguugaauaa

SEQ ID NO: 1213678 - RNA, 19 nt, Homo sapiens
caagugaggaggcaccaaa

SEQ ID NO: 1213679 - RNA, 19 nt, Homo sapiens
gagagccucaccucaguuu

SEQ ID NO: 1213680 - RNA, 19 nt, Homo sapiens
uccaagaaguugaauaaag

SEQ ID NO: 1213681 - RNA, 19 nt, Homo sapiens
gcaaagaagcgaaaagguu

SEQ ID NO: 1213682 - RNA, 19 nt, Homo sapiens
caggaucaccagagccuua

SEQ ID NO: 1213683 - RNA, 19 nt, Homo sapiens
gaaaagauucucccagaug

SEQ ID NO: 1213684 - RNA, 19 nt, Homo sapiens
gcaaauacagacaauagac

SEQ ID NO: 1213685 - RNA, 19 nt, Homo sapiens
ccagagaaucuaacucaug

SEQ ID NO: 1213686 - RNA, 19 nt, Homo sapiens
gaaggcagaggucguccaa

SEQ ID NO: 1213687 - RNA, 19 nt, Homo sapiens
agccauggauacaccguua

SEQ ID NO: 1213688 - RNA, 19 nt, Homo sapiens
ccucggaguuggcccagaa

SEQ ID NO: 1213689 - RNA, 19 nt, Homo sapiens
gaggagcuuucauucugau

SEQ ID NO: 1213690 - RNA, 19 nt, Homo sapiens
caccuggagucgccucaaa

SEQ ID NO: 1213691 - RNA, 19 nt, Homo sapiens
caaaccagucucugcagaa

SEQ ID NO: 1213692 - RNA, 19 nt, Homo sapiens
ggccaacgaccaugucaga

SEQ ID NO: 1213693 - RNA, 19 nt, Homo sapiens
aggcagaggucguccaagu

SEQ ID NO: 1213694 - RNA, 19 nt, Homo sapiens
ggaguuggcccagaauaag

SEQ ID NO: 1213695 - RNA, 19 nt, Homo sapiens
ggagcccucucagccacua

SEQ ID NO: 1213696 - RNA, 19 nt, Homo sapiens
cggcaaauacagacaauag

SEQ ID NO: 1213697 - RNA, 19 nt, Homo sapiens
aaaccaagaacuguacauu

SEQ ID NO: 1213698 - RNA, 19 nt, Homo sapiens
cggaguuggcccagaauaa

SEQ ID NO: 1213699 - RNA, 19 nt, Homo sapiens
ccugggaccuggcagagau

SEQ ID NO: 1213700 - RNA, 19 nt, Homo sapiens
gaggaggcaccaaaguguu

SEQ ID NO: 1213701 - RNA, 19 nt, Homo sapiens
ccgagagccucaccucagu

SEQ ID NO: 1213702 - RNA, 19 nt, Homo sapiens
ucaaagacagccagaguac

SEQ ID NO: 1213703 - RNA, 19 nt, Homo sapiens
acucaugccuguccagucu

SEQ ID NO: 1213704 - RNA, 19 nt, Homo sapiens
ggcaaauacagacaauaga

SEQ ID NO: 1213705 - RNA, 19 nt, Homo sapiens
aaaccagucucugcagaag

SEQ ID NO: 1213706 - RNA, 19 nt, Homo sapiens
cuucaaaccaagaacugua

SEQ ID NO: 1213707 - RNA, 19 nt, Homo sapiens
gagucgaacccagaagaaa

SEQ ID NO: 1213708 - RNA, 19 nt, Homo sapiens
cccagaugcuucaggacaa

SEQ ID NO: 1213709 - RNA, 19 nt, Homo sapiens
ugaggaggcaccaaagugu

SEQ ID NO: 1213710 - RNA, 19 nt, Homo sapiens
agaagcagcugcgcuccau

SEQ ID NO: 1213711 - RNA, 19 nt, Homo sapiens
ucaagcgggcaaagaagaa

SEQ ID NO: 1213712 - RNA, 19 nt, Homo sapiens
ggaagcuggccaaggacuu

SEQ ID NO: 1213713 - RNA, 19 nt, Homo sapiens
gugaggaggcaccaaagug

SEQ ID NO: 1213714 - RNA, 19 nt, Homo sapiens
aaagacagccagaguacag

SEQ ID NO: 1213715 - RNA, 19 nt, Homo sapiens
ccagaguacaguccugaau

SEQ ID NO: 1213716 - RNA, 19 nt, Homo sapiens
ccucaaagacagccagagu

SEQ ID NO: 1213717 - RNA, 19 nt, Homo sapiens
aagcagcugcgcuccauug

SEQ ID NO: 1213718 - RNA, 19 nt, Homo sapiens
cgagucgaacccagaagaa

SEQ ID NO: 1213719 - RNA, 19 nt, Homo sapiens
uccgguuccucuccacuuu

SEQ ID NO: 1213720 - RNA, 19 nt, Homo sapiens
cagaguacaguccugaauc

SEQ ID NO: 1213721 - RNA, 19 nt, Homo sapiens
uugagugccuguugcauac

SEQ ID NO: 1213722 - RNA, 19 nt, Homo sapiens
gcagagcuuuucccuagca

SEQ ID NO: 1213723 - RNA, 19 nt, Homo sapiens
uggagucgccucaaagaca

SEQ ID NO: 1213724 - RNA, 19 nt, Homo sapiens
ccuaggcaccggcaaauac

SEQ ID NO: 1213725 - RNA, 19 nt, Homo sapiens
gcacccacuuucccaaacc

SEQ ID NO: 1213726 - RNA, 19 nt, Homo sapiens
gugacucccucagcagugu

SEQ ID NO: 1213727 - RNA, 19 nt, Homo sapiens
ccagaugcuucaggacaag

SEQ ID NO: 1213728 - RNA, 19 nt, Homo sapiens
aaggaccgcuccaagaaaa

SEQ ID NO: 1213729 - RNA, 19 nt, Homo sapiens
ggaagaagguacagaagaa

SEQ ID NO: 1213730 - RNA, 19 nt, Homo sapiens
gcagucaacuccauuugua

SEQ ID NO: 1213731 - RNA, 19 nt, Homo sapiens
gaacaaacacucaaaguca

SEQ ID NO: 1213732 - RNA, 19 nt, Homo sapiens
gaaguggcuuuguggaaua

SEQ ID NO: 1213733 - RNA, 19 nt, Homo sapiens
gauccuaucucaccucuug

SEQ ID NO: 1213734 - RNA, 19 nt, Homo sapiens
ugagggagcugaagaagaa

SEQ ID NO: 1213735 - RNA, 19 nt, Homo sapiens
ggagaguccuggcauggua

SEQ ID NO: 1213736 - RNA, 19 nt, Homo sapiens
gaagaugcuuguuggauuc

SEQ ID NO: 1213737 - RNA, 19 nt, Homo sapiens
gagaaauggguaauaguua

SEQ ID NO: 1213738 - RNA, 19 nt, Homo sapiens
gagggcaucuacacacaua

SEQ ID NO: 1213739 - RNA, 19 nt, Homo sapiens
ccagugaggugaaugaaga

SEQ ID NO: 1213740 - RNA, 19 nt, Homo sapiens
gggaguaaguagaaauaaa

SEQ ID NO: 1213741 - RNA, 19 nt, Homo sapiens
ggaccaggaugaagaagau

SEQ ID NO: 1213742 - RNA, 19 nt, Homo sapiens
caacaguacuugucucaca

SEQ ID NO: 1213743 - RNA, 19 nt, Homo sapiens
ggagaaauggguaauaguu

SEQ ID NO: 1213744 - RNA, 19 nt, Homo sapiens
gcgcuuggaucucagguuu

SEQ ID NO: 1213745 - RNA, 19 nt, Homo sapiens
gcuucuaccuuuagcauuu

SEQ ID NO: 1213746 - RNA, 19 nt, Homo sapiens
guacacacuugguauuguu

SEQ ID NO: 1213747 - RNA, 19 nt, Homo sapiens
ucaaucaucuugcacucua

SEQ ID NO: 1213748 - RNA, 19 nt, Homo sapiens
gcauaggagucaggaaauu

SEQ ID NO: 1213749 - RNA, 19 nt, Homo sapiens
cauacugaauucugcuuua

SEQ ID NO: 1213750 - RNA, 19 nt, Homo sapiens
uagcagaaaccauagauaa

SEQ ID NO: 1213751 - RNA, 19 nt, Homo sapiens
uaaaacagcuccugccaaa

SEQ ID NO: 1213752 - RNA, 19 nt, Homo sapiens
acaaacaaccuauuccuuu

SEQ ID NO: 1213753 - RNA, 19 nt, Homo sapiens
ccaguugcuucuaccuuua

SEQ ID NO: 1213754 - RNA, 19 nt, Homo sapiens
cagcaguacucuccucuga

SEQ ID NO: 1213755 - RNA, 19 nt, Homo sapiens
aaacagcuccugccaaaga

SEQ ID NO: 1213756 - RNA, 19 nt, Homo sapiens
gagagugcgugucuucaug

SEQ ID NO: 1213757 - RNA, 19 nt, Homo sapiens
ggguugagguguccaagaa

SEQ ID NO: 1213758 - RNA, 19 nt, Homo sapiens
agaagaagcuguucaaacg

SEQ ID NO: 1213759 - RNA, 19 nt, Homo sapiens
agaagaugcuuguuggauu

SEQ ID NO: 1213760 - RNA, 19 nt, Homo sapiens
cagauuuccuccuaccuaa

SEQ ID NO: 1213761 - RNA, 19 nt, Homo sapiens
ccaaagaagauuaaaggaa

SEQ ID NO: 1213762 - RNA, 19 nt, Homo sapiens
gagccagccuucagacuca

SEQ ID NO: 1213763 - RNA, 19 nt, Homo sapiens
gaagacagccauggaagug

SEQ ID NO: 1213764 - RNA, 19 nt, Homo sapiens
ccaaagaguaaacaccaua

SEQ ID NO: 1213765 - RNA, 19 nt, Homo sapiens
guacuugucucacaguuuu

SEQ ID NO: 1213766 - RNA, 19 nt, Homo sapiens
gaggaugggcuuuggacua

SEQ ID NO: 1213767 - RNA, 19 nt, Homo sapiens
cuaaaccucuuccacuaga

SEQ ID NO: 1213768 - RNA, 19 nt, Homo sapiens
gaagaagaagcuguucaaa

SEQ ID NO: 1213769 - RNA, 19 nt, Homo sapiens
gaugggcuuuggacuagaa

SEQ ID NO: 1213770 - RNA, 19 nt, Homo sapiens
gaagaagguacagaagaaa

SEQ ID NO: 1213771 - RNA, 19 nt, Homo sapiens
gaaggucaccagcacauuc

SEQ ID NO: 1213772 - RNA, 19 nt, Homo sapiens
ggaguaaguagaaauaaag

SEQ ID NO: 1213773 - RNA, 19 nt, Homo sapiens
uuagcugugugacugauua

SEQ ID NO: 1213774 - RNA, 19 nt, Homo sapiens
caaacaaccuauuccuuuu

SEQ ID NO: 1213775 - RNA, 19 nt, Homo sapiens
ggaacaaacacucaaaguc

SEQ ID NO: 1213776 - RNA, 19 nt, Homo sapiens
uauaaucgcuuagcacagu

SEQ ID NO: 1213777 - RNA, 19 nt, Homo sapiens
ccaaagugcugggauuaca

SEQ ID NO: 1213778 - RNA, 19 nt, Homo sapiens
gacccuagaaguccuuuaa

SEQ ID NO: 1213779 - RNA, 19 nt, Homo sapiens
gggcuuuggacuagaaaua

SEQ ID NO: 1213780 - RNA, 19 nt, Homo sapiens
gaagauuaaaggaacaguu

SEQ ID NO: 1213781 - RNA, 19 nt, Homo sapiens
uagaaguccuuuaagaaca

SEQ ID NO: 1213782 - RNA, 19 nt, Homo sapiens
caggugcccuugucuccua

SEQ ID NO: 1213783 - RNA, 19 nt, Homo sapiens
ggagugcaguggcgugauc

SEQ ID NO: 1213784 - RNA, 19 nt, Homo sapiens
gggaagaagguacagaaga

SEQ ID NO: 1213785 - RNA, 19 nt, Homo sapiens
gagggaagaagguacagaa

SEQ ID NO: 1213786 - RNA, 19 nt, Homo sapiens
gggccaggcuccaaagaag

SEQ ID NO: 1213787 - RNA, 19 nt, Homo sapiens
cgacguuucccgaucagua

SEQ ID NO: 1213788 - RNA, 19 nt, Homo sapiens
gacccuguguccucaauuc

SEQ ID NO: 1213789 - RNA, 19 nt, Homo sapiens
gauccggcuugcccagaaa

SEQ ID NO: 1213790 - RNA, 19 nt, Homo sapiens
gaaguccuuuaagaacauu

SEQ ID NO: 1213791 - RNA, 19 nt, Homo sapiens
ccacaggacccuagaaguc

SEQ ID NO: 1213792 - RNA, 19 nt, Homo sapiens
ggaauccagugaggugaau

SEQ ID NO: 1213793 - RNA, 19 nt, Homo sapiens
agaaguggcuuuguggaau

SEQ ID NO: 1213794 - RNA, 19 nt, Homo sapiens
ccuagaaguccuuuaagaa

SEQ ID NO: 1213795 - RNA, 19 nt, Homo sapiens
gcaaggaggaugggcuuug

SEQ ID NO: 1213796 - RNA, 19 nt, Homo sapiens
cguguaacauacugaauuc

SEQ ID NO: 1213797 - RNA, 19 nt, Homo sapiens
ccggauagcugggauuaca

SEQ ID NO: 1213798 - RNA, 19 nt, Homo sapiens
aaagucaaguauacugguu

SEQ ID NO: 1213799 - RNA, 19 nt, Homo sapiens
gaugcuuguuggauucuug

SEQ ID NO: 1213800 - RNA, 19 nt, Homo sapiens
uauacugguuggagaaaug

SEQ ID NO: 1213801 - RNA, 19 nt, Homo sapiens
ccagauuuccuccuaccua

SEQ ID NO: 1213802 - RNA, 19 nt, Homo sapiens
caucuccugccuccuaaua

SEQ ID NO: 1213803 - RNA, 19 nt, Homo sapiens
gaagaagaugcuuguugga

SEQ ID NO: 1213804 - RNA, 19 nt, Homo sapiens
gcaggaccaggaugaagaa

SEQ ID NO: 1213805 - RNA, 19 nt, Homo sapiens
ccucaacucuggaacaaac

SEQ ID NO: 1213806 - RNA, 19 nt, Homo sapiens
ccucugaguucaaucaucu

SEQ ID NO: 1213807 - RNA, 19 nt, Homo sapiens
ucucaccucuugggcauuu

SEQ ID NO: 1213808 - RNA, 19 nt, Homo sapiens
cagggaguaaguagaaaua

SEQ ID NO: 1213809 - RNA, 19 nt, Homo sapiens
ggaggcaaguccggucuca

SEQ ID NO: 1213810 - RNA, 19 nt, Homo sapiens
gguacacacuugguauugu

SEQ ID NO: 1213811 - RNA, 19 nt, Homo sapiens
cccuagaaguccuuuaaga

SEQ ID NO: 1213812 - RNA, 19 nt, Homo sapiens
caaagaguaaacaccauau

SEQ ID NO: 1213813 - RNA, 19 nt, Homo sapiens
aacaaacacucaaagucaa

SEQ ID NO: 1213814 - RNA, 19 nt, Homo sapiens
gcuuggaucucagguuuag

SEQ ID NO: 1213815 - RNA, 19 nt, Homo sapiens
gaggaaacguuuggaaucc

SEQ ID NO: 1213816 - RNA, 19 nt, Homo sapiens
ggaugaagaagaugcuugu

SEQ ID NO: 1213817 - RNA, 19 nt, Homo sapiens
gauuaaaggaacaguuugu

SEQ ID NO: 1213818 - RNA, 19 nt, Homo sapiens
gcuggauucguguaacaua

SEQ ID NO: 1213819 - RNA, 19 nt, Homo sapiens
ccuugaagaugagagcuaa

SEQ ID NO: 1213820 - RNA, 19 nt, Homo sapiens
gaaaacuccuccagcagau

SEQ ID NO: 1213821 - RNA, 19 nt, Homo sapiens
aagcauaggagucaggaaa

SEQ ID NO: 1213822 - RNA, 19 nt, Homo sapiens
gcagaaaccauagauaagc

SEQ ID NO: 1213823 - RNA, 19 nt, Homo sapiens
caaggaggaugggcuuugg

SEQ ID NO: 1213824 - RNA, 19 nt, Homo sapiens
caaucaucuugcacucuaa

SEQ ID NO: 1213825 - RNA, 19 nt, Homo sapiens
cauacaaacauaccagguu

SEQ ID NO: 1213826 - RNA, 19 nt, Homo sapiens
acacucaaagucaaguaua

SEQ ID NO: 1213827 - RNA, 19 nt, Homo sapiens
cgaggaaacguuuggaauc

SEQ ID NO: 1213828 - RNA, 19 nt, Homo sapiens
cagaagaaagauuggagaa

SEQ ID NO: 1213829 - RNA, 19 nt, Homo sapiens
cuaaugaucugcugaauaa

SEQ ID NO: 1213830 - RNA, 19 nt, Homo sapiens
gaagaaaguucaguaauuc

SEQ ID NO: 1213831 - RNA, 19 nt, Homo sapiens
gaacugauaucugaagaga

SEQ ID NO: 1213832 - RNA, 19 nt, Homo sapiens
ggccugaacugauaucuga

SEQ ID NO: 1213833 - RNA, 19 nt, Homo sapiens
ggaagaggcuugguucuag

SEQ ID NO: 1213834 - RNA, 19 nt, Homo sapiens
gagcagauguuugcguauu

SEQ ID NO: 1213835 - RNA, 19 nt, Homo sapiens
ccgaagaccuuuauacugu

SEQ ID NO: 1213836 - RNA, 19 nt, Homo sapiens
gagcgagguuucagacauu

SEQ ID NO: 1213837 - RNA, 19 nt, Homo sapiens
acaagugacugaacuaaug

SEQ ID NO: 1213838 - RNA, 19 nt, Homo sapiens
caagugagcauuugauaga

SEQ ID NO: 1213839 - RNA, 19 nt, Homo sapiens
gaauaaugaaggaggaaua

SEQ ID NO: 1213840 - RNA, 19 nt, Homo sapiens
gaagaccuuuauacuguga

SEQ ID NO: 1213841 - RNA, 19 nt, Homo sapiens
gcucugugcuuuccacuau

SEQ ID NO: 1213842 - RNA, 19 nt, Homo sapiens
ggucgaaugucaucaggaa

SEQ ID NO: 1213843 - RNA, 19 nt, Homo sapiens
ucagaguuauuuccuagua

SEQ ID NO: 1213844 - RNA, 19 nt, Homo sapiens
gaagucaaaccucccgaua

SEQ ID NO: 1213845 - RNA, 19 nt, Homo sapiens
gcacucgggucgaauguca

SEQ ID NO: 1213846 - RNA, 19 nt, Homo sapiens
ugagaggaguggcuucuuu

SEQ ID NO: 1213847 - RNA, 19 nt, Homo sapiens
gauagaugcucagaugcua

SEQ ID NO: 1213848 - RNA, 19 nt, Homo sapiens
agucaaaccucccgauauu

SEQ ID NO: 1213849 - RNA, 19 nt, Homo sapiens
uaacaguaaucacaucuca

SEQ ID NO: 1213850 - RNA, 19 nt, Homo sapiens
gaacuaaugaucugcugaa

SEQ ID NO: 1213851 - RNA, 19 nt, Homo sapiens
gaaauuacacugcggucaa

SEQ ID NO: 1213852 - RNA, 19 nt, Homo sapiens
cagcaugucuuggaaguug

SEQ ID NO: 1213853 - RNA, 19 nt, Homo sapiens
ugacuucccuuuaggacaa

SEQ ID NO: 1213854 - RNA, 19 nt, Homo sapiens
gcacggaggccgauguaga

SEQ ID NO: 1213855 - RNA, 19 nt, Homo sapiens
cauccucucugaucuguga

SEQ ID NO: 1213856 - RNA, 19 nt, Homo sapiens
gcacugcucaccuggguuu

SEQ ID NO: 1213857 - RNA, 19 nt, Homo sapiens
caacagggacaaaucaguu

SEQ ID NO: 1213858 - RNA, 19 nt, Homo sapiens
ggacaagugacugaacuaa

SEQ ID NO: 1213859 - RNA, 19 nt, Homo sapiens
acucuuggcuuucuuaugu

SEQ ID NO: 1213860 - RNA, 19 nt, Homo sapiens
gcaaguggacagcgacauu

SEQ ID NO: 1213861 - RNA, 19 nt, Homo sapiens
acugauaucugaagagaga

SEQ ID NO: 1213862 - RNA, 19 nt, Homo sapiens
cauauaauucccagccuua

SEQ ID NO: 1213863 - RNA, 19 nt, Homo sapiens
cuccagagcugccuuugaa

SEQ ID NO: 1213864 - RNA, 19 nt, Homo sapiens
ugacugaacuaaugaucug

SEQ ID NO: 1213865 - RNA, 19 nt, Homo sapiens
cacagucccucacagauga

SEQ ID NO: 1213866 - RNA, 19 nt, Homo sapiens
gacagagggucacaaccaa

SEQ ID NO: 1213867 - RNA, 19 nt, Homo sapiens
gcugugcccuaucuucuga

SEQ ID NO: 1213868 - RNA, 19 nt, Homo sapiens
uggaaugccugcugaccua

SEQ ID NO: 1213869 - RNA, 19 nt, Homo sapiens
uuuccaagcucacugauga

SEQ ID NO: 1213870 - RNA, 19 nt, Homo sapiens
cagccuuacuuauaaauuc

SEQ ID NO: 1213871 - RNA, 19 nt, Homo sapiens
ggacagagggucacaacca

SEQ ID NO: 1213872 - RNA, 19 nt, Homo sapiens
gcagauguuugcguauuuc

SEQ ID NO: 1213873 - RNA, 19 nt, Homo sapiens
gagaagaaaguucaguaau

SEQ ID NO: 1213874 - RNA, 19 nt, Homo sapiens
ucaccuggguuuacugaug

SEQ ID NO: 1213875 - RNA, 19 nt, Homo sapiens
gaagagagaaguggagaca

SEQ ID NO: 1213876 - RNA, 19 nt, Homo sapiens
uuuccaaucucucacuuaa

SEQ ID NO: 1213877 - RNA, 19 nt, Homo sapiens
gcccauugguuacauagau

SEQ ID NO: 1213878 - RNA, 19 nt, Homo sapiens
gauguuugcguauuucuug

SEQ ID NO: 1213879 - RNA, 19 nt, Homo sapiens
gcaccagccauauguguau

SEQ ID NO: 1213880 - RNA, 19 nt, Homo sapiens
caagcucacugaugaagag

SEQ ID NO: 1213881 - RNA, 19 nt, Homo sapiens
gccacucgcccauugguua

SEQ ID NO: 1213882 - RNA, 19 nt, Homo sapiens
ugacagcaagugagcauuu

SEQ ID NO: 1213883 - RNA, 19 nt, Homo sapiens
agccauauguguauucuug

SEQ ID NO: 1213884 - RNA, 19 nt, Homo sapiens
guaauucccugaaaaguca

SEQ ID NO: 1213885 - RNA, 19 nt, Homo sapiens
uccaggagcuuuccaaucu

SEQ ID NO: 1213886 - RNA, 19 nt, Homo sapiens
gaacauccuaacaguaauc

SEQ ID NO: 1213887 - RNA, 19 nt, Homo sapiens
uuugauagaugcucagaug

SEQ ID NO: 1213888 - RNA, 19 nt, Homo sapiens
ggaggaagccaaggacgaa

SEQ ID NO: 1213889 - RNA, 19 nt, Homo sapiens
aaagaugacucaguuaagg

SEQ ID NO: 1213890 - RNA, 19 nt, Homo sapiens
caccuggguuuacugauga

SEQ ID NO: 1213891 - RNA, 19 nt, Homo sapiens
ugagaagaaaguucaguaa

SEQ ID NO: 1213892 - RNA, 19 nt, Homo sapiens
uugaacauccuaacaguaa

SEQ ID NO: 1213893 - RNA, 19 nt, Homo sapiens
gacagcaagugagcauuug

SEQ ID NO: 1213894 - RNA, 19 nt, Homo sapiens
ggacacaccgaagaccuuu

SEQ ID NO: 1213895 - RNA, 19 nt, Homo sapiens
caagugaggccaaggcaau

SEQ ID NO: 1213896 - RNA, 19 nt, Homo sapiens
guacuaugagcaugugaaa

SEQ ID NO: 1213897 - RNA, 19 nt, Homo sapiens
gaagaggcccagcaugucu

SEQ ID NO: 1213898 - RNA, 19 nt, Homo sapiens
gaaucaaacaguagagaca

SEQ ID NO: 1213899 - RNA, 19 nt, Homo sapiens
gcaagugagcauuugauag

SEQ ID NO: 1213900 - RNA, 19 nt, Homo sapiens
gggugugacuggauauuag

SEQ ID NO: 1213901 - RNA, 19 nt, Homo sapiens
ccagacagaugaggaugga

SEQ ID NO: 1213902 - RNA, 19 nt, Homo sapiens
gcguugaagggcaagauua

SEQ ID NO: 1213903 - RNA, 19 nt, Homo sapiens
uuccuucccucucucaaua

SEQ ID NO: 1213904 - RNA, 19 nt, Homo sapiens
ugcgggagcucuucugcua

SEQ ID NO: 1213905 - RNA, 19 nt, Homo sapiens
ucaaaccucccgauauuuc

SEQ ID NO: 1213906 - RNA, 19 nt, Homo sapiens
caaaccaacagacaggaaa

SEQ ID NO: 1213907 - RNA, 19 nt, Homo sapiens
ucuuugagcugaauaagca

SEQ ID NO: 1213908 - RNA, 19 nt, Homo sapiens
uauaaucccagcccuuuga

SEQ ID NO: 1213909 - RNA, 19 nt, Homo sapiens
uagguaagguggcucauac

SEQ ID NO: 1213910 - RNA, 19 nt, Homo sapiens
caagugacugaacuaauga

SEQ ID NO: 1213911 - RNA, 19 nt, Homo sapiens
gcauugaccaaguuaagug

SEQ ID NO: 1213912 - RNA, 19 nt, Homo sapiens
caccaggacucggaagcua

SEQ ID NO: 1213913 - RNA, 19 nt, Homo sapiens
gcuaagcugcugugacuuc

SEQ ID NO: 1213914 - RNA, 19 nt, Homo sapiens
gagcugggccugaacugau

SEQ ID NO: 1213915 - RNA, 19 nt, Homo sapiens
ccuaccagcugcuugugaa

SEQ ID NO: 1213916 - RNA, 19 nt, Homo sapiens
uuucaugaauggaauggaa

SEQ ID NO: 1213917 - RNA, 19 nt, Homo sapiens
uaacgggacaggacagaga

SEQ ID NO: 1213918 - RNA, 19 nt, Homo sapiens
ccacagucccucacagaug

SEQ ID NO: 1213919 - RNA, 19 nt, Homo sapiens
uucccagccuuacuuauaa

SEQ ID NO: 1213920 - RNA, 19 nt, Homo sapiens
gguauucggcgcugaguuc

SEQ ID NO: 1213921 - RNA, 19 nt, Homo sapiens
cagaguuauuuccuaguau

SEQ ID NO: 1213922 - RNA, 19 nt, Homo sapiens
caauggcugugcccuaucu

SEQ ID NO: 1213923 - RNA, 19 nt, Homo sapiens
ucccugagguucacuuuag

SEQ ID NO: 1213924 - RNA, 19 nt, Homo sapiens
gcaggcagagcuccagaug

SEQ ID NO: 1213925 - RNA, 19 nt, Homo sapiens
gcauauuucagcuguggaa

SEQ ID NO: 1213926 - RNA, 19 nt, Homo sapiens
gcacacauuagcagcuguu

SEQ ID NO: 1213927 - RNA, 19 nt, Homo sapiens
augaucugcugaauaauga

SEQ ID NO: 1213928 - RNA, 19 nt, Homo sapiens
uaaggcaccagccauaugu

SEQ ID NO: 1213929 - RNA, 19 nt, Homo sapiens
ggacauauaugagagagaa

SEQ ID NO: 1213930 - RNA, 19 nt, Homo sapiens
gaguggauauugccaguua

SEQ ID NO: 1213931 - RNA, 19 nt, Homo sapiens
ggagagagguauucuagug

SEQ ID NO: 1213932 - RNA, 19 nt, Homo sapiens
gagaugggauugacuuuau

SEQ ID NO: 1213933 - RNA, 19 nt, Homo sapiens
gcuuaaagguguuucaauu

SEQ ID NO: 1213934 - RNA, 19 nt, Homo sapiens
caaaguagcuaguuagaac

SEQ ID NO: 1213935 - RNA, 19 nt, Homo sapiens
acacaacuccuuaccauua

SEQ ID NO: 1213936 - RNA, 19 nt, Homo sapiens
gaguguguguguagauuua

SEQ ID NO: 1213937 - RNA, 19 nt, Homo sapiens
gcaaagacaucugcaucaa

SEQ ID NO: 1213938 - RNA, 19 nt, Homo sapiens
gagaauucuuugccacuuu

SEQ ID NO: 1213939 - RNA, 19 nt, Homo sapiens
acaggagccuucuauagua

SEQ ID NO: 1213940 - RNA, 19 nt, Homo sapiens
gcaaguaugagcaugauga

SEQ ID NO: 1213941 - RNA, 19 nt, Homo sapiens
gaagaagcaggacuuggua

SEQ ID NO: 1213942 - RNA, 19 nt, Homo sapiens
gagaaugagacacuuauug

SEQ ID NO: 1213943 - RNA, 19 nt, Homo sapiens
cauccuacaucuucccuaa

SEQ ID NO: 1213944 - RNA, 19 nt, Homo sapiens
gugcuggacucaagccuuu

SEQ ID NO: 1213945 - RNA, 19 nt, Homo sapiens
gggcaucccuggguucuug

SEQ ID NO: 1213946 - RNA, 19 nt, Homo sapiens
caacacaggagccuucuau

SEQ ID NO: 1213947 - RNA, 19 nt, Homo sapiens
aauacugguuggugaaaua

SEQ ID NO: 1213948 - RNA, 19 nt, Homo sapiens
gaugagaaugagacacuua

SEQ ID NO: 1213949 - RNA, 19 nt, Homo sapiens
cugaguagauuggauuuaa

SEQ ID NO: 1213950 - RNA, 19 nt, Homo sapiens
cucaaucacucccugcuua

SEQ ID NO: 1213951 - RNA, 19 nt, Homo sapiens
guaugagcaugaugacauu

SEQ ID NO: 1213952 - RNA, 19 nt, Homo sapiens
gcauguguguuauguguag

SEQ ID NO: 1213953 - RNA, 19 nt, Homo sapiens
ggaagaagcaggacuuggu

SEQ ID NO: 1213954 - RNA, 19 nt, Homo sapiens
cacaacuccuuaccauuaa

SEQ ID NO: 1213955 - RNA, 19 nt, Homo sapiens
ggaacuagaugagaaugag

SEQ ID NO: 1213956 - RNA, 19 nt, Homo sapiens
ggcaaaauauuucucagua

SEQ ID NO: 1213957 - RNA, 19 nt, Homo sapiens
gaaauacugguuggugaaa

SEQ ID NO: 1213958 - RNA, 19 nt, Homo sapiens
gagcuuugcagguucaauu

SEQ ID NO: 1213959 - RNA, 19 nt, Homo sapiens
uaauaggcaucgucucuca

SEQ ID NO: 1213960 - RNA, 19 nt, Homo sapiens
acagagacuuugugagaga

SEQ ID NO: 1213961 - RNA, 19 nt, Homo sapiens
gcgccuggcuaccuuccua

SEQ ID NO: 1213962 - RNA, 19 nt, Homo sapiens
caaggacucuguguuucuu

SEQ ID NO: 1213963 - RNA, 19 nt, Homo sapiens
gcucaggucacuuguguug

SEQ ID NO: 1213964 - RNA, 19 nt, Homo sapiens
ucagcaaguucugcaagua

SEQ ID NO: 1213965 - RNA, 19 nt, Homo sapiens
uuacacaacuccuuaccau

SEQ ID NO: 1213966 - RNA, 19 nt, Homo sapiens
gaaggaauaugggcaaaau

SEQ ID NO: 1213967 - RNA, 19 nt, Homo sapiens
gaugggauugacuuuauuu

SEQ ID NO: 1213968 - RNA, 19 nt, Homo sapiens
aagcauguguguuaugugu

SEQ ID NO: 1213969 - RNA, 19 nt, Homo sapiens
ugaagcauguguguuaugu

SEQ ID NO: 1213970 - RNA, 19 nt, Homo sapiens
caagccagcaucacagauu

SEQ ID NO: 1213971 - RNA, 19 nt, Homo sapiens
cuagaucugugccguuaau

SEQ ID NO: 1213972 - RNA, 19 nt, Homo sapiens
caggagccuucuauaguau

SEQ ID NO: 1213973 - RNA, 19 nt, Homo sapiens
uguguuauguguaguuaga

SEQ ID NO: 1213974 - RNA, 19 nt, Homo sapiens
ugagaaaugcuuccaguca

SEQ ID NO: 1213975 - RNA, 19 nt, Homo sapiens
ucacugggcugguguucuc

SEQ ID NO: 1213976 - RNA, 19 nt, Homo sapiens
agucauggaucaauuacug

SEQ ID NO: 1213977 - RNA, 19 nt, Homo sapiens
gaguagauuggauuuaaga

SEQ ID NO: 1213978 - RNA, 19 nt, Homo sapiens
caaguugacgaaaggguuu

SEQ ID NO: 1213979 - RNA, 19 nt, Homo sapiens
gaacuagaugagaaugaga

SEQ ID NO: 1213980 - RNA, 19 nt, Homo sapiens
cgaggacaauagaauuuua

SEQ ID NO: 1213981 - RNA, 19 nt, Homo sapiens
gcagcgaggacaauagaau

SEQ ID NO: 1213982 - RNA, 19 nt, Homo sapiens
gcaaguucugcaaguauga

SEQ ID NO: 1213983 - RNA, 19 nt, Homo sapiens
uaggagucauggaucaauu

SEQ ID NO: 1213984 - RNA, 19 nt, Homo sapiens
aauccaguaucaagaagaa

SEQ ID NO: 1213985 - RNA, 19 nt, Homo sapiens
ggaugaaggagagcuuaaa

SEQ ID NO: 1213986 - RNA, 19 nt, Homo sapiens
uuauguagcugucuaugag

SEQ ID NO: 1213987 - RNA, 19 nt, Homo sapiens
guguguguguagauuuaua

SEQ ID NO: 1213988 - RNA, 19 nt, Homo sapiens
agaaugagacacuuauugu

SEQ ID NO: 1213989 - RNA, 19 nt, Homo sapiens
caaaacaaguugacgaaag

SEQ ID NO: 1213990 - RNA, 19 nt, Homo sapiens
ggagccuucuauaguaugu

SEQ ID NO: 1213991 - RNA, 19 nt, Homo sapiens
ugugggaacuagaugagaa

SEQ ID NO: 1213992 - RNA, 19 nt, Homo sapiens
gcagguucaauuuagguaa

SEQ ID NO: 1213993 - RNA, 19 nt, Homo sapiens
gcuuugcagguucaauuua

SEQ ID NO: 1213994 - RNA, 19 nt, Homo sapiens
agaaaugcuuccagucaca

SEQ ID NO: 1213995 - RNA, 19 nt, Homo sapiens
gugaguguguguguagauu

SEQ ID NO: 1213996 - RNA, 19 nt, Homo sapiens
gaagccaagcccacagaga

SEQ ID NO: 1213997 - RNA, 19 nt, Homo sapiens
gaaagucugaaugcaguau

SEQ ID NO: 1213998 - RNA, 19 nt, Homo sapiens
ugcuagaucugugccguua

SEQ ID NO: 1213999 - RNA, 19 nt, Homo sapiens
cacaggagccuucuauagu

SEQ ID NO: 1214000 - RNA, 19 nt, Homo sapiens
gcauggaacggcaguugga

SEQ ID NO: 1214001 - RNA, 19 nt, Homo sapiens
ggaaagucugaaugcagua

SEQ ID NO: 1214002 - RNA, 19 nt, Homo sapiens
cuagugaugggacauauau

SEQ ID NO: 1214003 - RNA, 19 nt, Homo sapiens
acacaggagccuucuauag

SEQ ID NO: 1214004 - RNA, 19 nt, Homo sapiens
cagcgaggacaauagaauu

SEQ ID NO: 1214005 - RNA, 19 nt, Homo sapiens
ggucuuguagcccauuauu

SEQ ID NO: 1214006 - RNA, 19 nt, Homo sapiens
ugaaggagagcuuaaaggu

SEQ ID NO: 1214007 - RNA, 19 nt, Homo sapiens
gaaaugcuuccagucacaa

SEQ ID NO: 1214008 - RNA, 19 nt, Homo sapiens
aagucugaaugcaguauuu

SEQ ID NO: 1214009 - RNA, 19 nt, Homo sapiens
ugagaauucuuugccacuu

SEQ ID NO: 1214010 - RNA, 19 nt, Homo sapiens
gggaugaaggagagcuuaa

SEQ ID NO: 1214011 - RNA, 19 nt, Homo sapiens
agagaugggauugacuuua

SEQ ID NO: 1214012 - RNA, 19 nt, Homo sapiens
gaucugugccguuaauagg

SEQ ID NO: 1214013 - RNA, 19 nt, Homo sapiens
ccaaaguagcuaguuagaa

SEQ ID NO: 1214014 - RNA, 19 nt, Homo sapiens
ucaugguguuggucuugua

SEQ ID NO: 1214015 - RNA, 19 nt, Homo sapiens
gaugaaggagagcuuaaag

SEQ ID NO: 1214016 - RNA, 19 nt, Homo sapiens
aaguuuggcuugccugugu

SEQ ID NO: 1214017 - RNA, 19 nt, Homo sapiens
cagcaaguucugcaaguau

SEQ ID NO: 1214018 - RNA, 19 nt, Homo sapiens
gaccugcaaguguuacuga

SEQ ID NO: 1214019 - RNA, 19 nt, Homo sapiens
gcaggacuugguacgguuu

SEQ ID NO: 1214020 - RNA, 19 nt, Homo sapiens
gguaguggcaggaauaaaa

SEQ ID NO: 1214021 - RNA, 19 nt, Homo sapiens
guuaauaggcaucgucucu

SEQ ID NO: 1214022 - RNA, 19 nt, Homo sapiens
guggagaugcggaaggaaa

SEQ ID NO: 1214023 - RNA, 19 nt, Homo sapiens
caggugcuguugaauugug

SEQ ID NO: 1214024 - RNA, 19 nt, Homo sapiens
gacaucugcaucaagguuu

SEQ ID NO: 1214025 - RNA, 19 nt, Homo sapiens
uucccaaaguagcuaguua

SEQ ID NO: 1214026 - RNA, 19 nt, Homo sapiens
uguguguuauguguaguua

SEQ ID NO: 1214027 - RNA, 19 nt, Homo sapiens
agaugggauugacuuuauu

SEQ ID NO: 1214028 - RNA, 19 nt, Homo sapiens
guagauuggauuuaagaca

SEQ ID NO: 1214029 - RNA, 19 nt, Homo sapiens
gaacauggaugagaugaua

SEQ ID NO: 1214030 - RNA, 19 nt, Homo sapiens
guaaggaacucagccaaua

SEQ ID NO: 1214031 - RNA, 19 nt, Homo sapiens
gcacaaggcuggaguacag

SEQ ID NO: 1214032 - RNA, 19 nt, Homo sapiens
ucgaggagcuggacaguaa

SEQ ID NO: 1214033 - RNA, 19 nt, Homo sapiens
cagaguagcugguauuaca

SEQ ID NO: 1214034 - RNA, 19 nt, Homo sapiens
ggcaacagcuggcuaauac

SEQ ID NO: 1214035 - RNA, 19 nt, Homo sapiens
uggaugagaugauaaaugu

SEQ ID NO: 1214036 - RNA, 19 nt, Homo sapiens
ggaguacaguggcucgauu

SEQ ID NO: 1214037 - RNA, 19 nt, Homo sapiens
uggaggacgugcuguauuu

SEQ ID NO: 1214038 - RNA, 19 nt, Homo sapiens
cgagucagcuaucaaguuc

SEQ ID NO: 1214039 - RNA, 19 nt, Homo sapiens
gcaaugguauuaauguacu

SEQ ID NO: 1214040 - RNA, 19 nt, Homo sapiens
gccaacaucucacugcaau

SEQ ID NO: 1214041 - RNA, 19 nt, Homo sapiens
gcggccagauagccaguua

SEQ ID NO: 1214042 - RNA, 19 nt, Homo sapiens
gcaucgaccuggccgucua

SEQ ID NO: 1214043 - RNA, 19 nt, Homo sapiens
ggaccgagacggcacaaug

SEQ ID NO: 1214044 - RNA, 19 nt, Homo sapiens
caacaucucacugcaauuc

SEQ ID NO: 1214045 - RNA, 19 nt, Homo sapiens
ccaauagccauguaacuga

SEQ ID NO: 1214046 - RNA, 19 nt, Homo sapiens
cggcaaugguauuaaugua

SEQ ID NO: 1214047 - RNA, 19 nt, Homo sapiens
guguuaagcugccaaccuu

SEQ ID NO: 1214048 - RNA, 19 nt, Homo sapiens
guaccugaauccugaaucu

SEQ ID NO: 1214049 - RNA, 19 nt, Homo sapiens
gcagguccaugccucaaag

SEQ ID NO: 1214050 - RNA, 19 nt, Homo sapiens
uagcugguauuacaggauu

SEQ ID NO: 1214051 - RNA, 19 nt, Homo sapiens
acagcuggcuaauacauau

SEQ ID NO: 1214052 - RNA, 19 nt, Homo sapiens
caguugaauucccuggaua

SEQ ID NO: 1214053 - RNA, 19 nt, Homo sapiens
uuacaggauuucaucaugu

SEQ ID NO: 1214054 - RNA, 19 nt, Homo sapiens
cagcccaaaccaucauuua

SEQ ID NO: 1214055 - RNA, 19 nt, Homo sapiens
gaccgagacggcacaauga

SEQ ID NO: 1214056 - RNA, 19 nt, Homo sapiens
uggguucucugccuggaua

SEQ ID NO: 1214057 - RNA, 19 nt, Homo sapiens
ggagcaggcugagaaaauu

SEQ ID NO: 1214058 - RNA, 19 nt, Homo sapiens
ugacagugccggacgaguu

SEQ ID NO: 1214059 - RNA, 19 nt, Homo sapiens
cuuagacucuuauacuuca

SEQ ID NO: 1214060 - RNA, 19 nt, Homo sapiens
ccauguaacugagcuugga

SEQ ID NO: 1214061 - RNA, 19 nt, Homo sapiens
ccugaaaucccagcacuuu

SEQ ID NO: 1214062 - RNA, 19 nt, Homo sapiens
gcuggcuaauacauauaua

SEQ ID NO: 1214063 - RNA, 19 nt, Homo sapiens
uacaggauuucaucauguu

SEQ ID NO: 1214064 - RNA, 19 nt, Homo sapiens
caacagcuggcuaauacau

SEQ ID NO: 1214065 - RNA, 19 nt, Homo sapiens
ccugaaucuuagacucuua

SEQ ID NO: 1214066 - RNA, 19 nt, Homo sapiens
gaguacaguggcucgauuu

SEQ ID NO: 1214067 - RNA, 19 nt, Homo sapiens
gguauuaauguacucaaga

SEQ ID NO: 1214068 - RNA, 19 nt, Homo sapiens
ggacgaguucucaaagcaa

SEQ ID NO: 1214069 - RNA, 19 nt, Homo sapiens
ggcucgaccuggaggaauu

SEQ ID NO: 1214070 - RNA, 19 nt, Homo sapiens
acaucucacugcaauucua

SEQ ID NO: 1214071 - RNA, 19 nt, Homo sapiens
gguauuacaggauuucauc

SEQ ID NO: 1214072 - RNA, 19 nt, Homo sapiens
aaaccaucauuuacccuau

SEQ ID NO: 1214073 - RNA, 19 nt, Homo sapiens
ucaguugaauucccuggau

SEQ ID NO: 1214074 - RNA, 19 nt, Homo sapiens
ccaggauggucacauugau

SEQ ID NO: 1214075 - RNA, 19 nt, Homo sapiens
cagcaccugcggccagaua

SEQ ID NO: 1214076 - RNA, 19 nt, Homo sapiens
gguaaggaacucagccaau

SEQ ID NO: 1214077 - RNA, 19 nt, Homo sapiens
ggaauucgccagccuucag

SEQ ID NO: 1214078 - RNA, 19 nt, Homo sapiens
guggcucgauuucagauca

SEQ ID NO: 1214079 - RNA, 19 nt, Homo sapiens
gcgcgaccacuuccuguug

SEQ ID NO: 1214080 - RNA, 19 nt, Homo sapiens
guuaagcugccaaccuuug

SEQ ID NO: 1214081 - RNA, 19 nt, Homo sapiens
cugcaauucuaucaguuga

SEQ ID NO: 1214082 - RNA, 19 nt, Homo sapiens
gccaauagccauguaacug

SEQ ID NO: 1214083 - RNA, 19 nt, Homo sapiens
ucuacgagacucugaagaa

SEQ ID NO: 1214084 - RNA, 19 nt, Homo sapiens
aacaggguaucuccucuga

SEQ ID NO: 1214085 - RNA, 19 nt, Homo sapiens
gcuccugaguuccuaaugc

SEQ ID NO: 1214086 - RNA, 19 nt, Homo sapiens
ccugaauccugaaucuuag

SEQ ID NO: 1214087 - RNA, 19 nt, Homo sapiens
guacaguggcucgauuuca

SEQ ID NO: 1214088 - RNA, 19 nt, Homo sapiens
gaccauugacuggcaagaa

SEQ ID NO: 1214089 - RNA, 19 nt, Homo sapiens
ugacgggcaugugguggaa

SEQ ID NO: 1214090 - RNA, 19 nt, Homo sapiens
ugaaaucccagcacuuugg

SEQ ID NO: 1214091 - RNA, 19 nt, Homo sapiens
gcucugggcauuuccaucu

SEQ ID NO: 1214092 - RNA, 19 nt, Homo sapiens
uggcaacagcuggcuaaua

SEQ ID NO: 1214093 - RNA, 19 nt, Homo sapiens
gaccacuuccuguugcauu

SEQ ID NO: 1214094 - RNA, 19 nt, Homo sapiens
accugaauccugaaucuua

SEQ ID NO: 1214095 - RNA, 19 nt, Homo sapiens
acgagacucugaagaacug

SEQ ID NO: 1214096 - RNA, 19 nt, Homo sapiens
ugaagacgcggcugaccuu

SEQ ID NO: 1214097 - RNA, 19 nt, Homo sapiens
uuaauguacucaagauugc

SEQ ID NO: 1214098 - RNA, 19 nt, Homo sapiens
ccaacgugcugggauuaca

SEQ ID NO: 1214099 - RNA, 19 nt, Homo sapiens
gccggacgggccaguauaa

SEQ ID NO: 1214100 - RNA, 19 nt, Homo sapiens
uaaggaacucagccaauag

SEQ ID NO: 1214101 - RNA, 19 nt, Homo sapiens
ugccucagccuccagagua

SEQ ID NO: 1214102 - RNA, 19 nt, Homo sapiens
cggacgaguucucaaagca

SEQ ID NO: 1214103 - RNA, 19 nt, Homo sapiens
cauggcaacagcuggcuaa

SEQ ID NO: 1214104 - RNA, 19 nt, Homo sapiens
ugcccaggcucaucucgaa

SEQ ID NO: 1214105 - RNA, 19 nt, Homo sapiens
cuauggaggugcugaagac

SEQ ID NO: 1214106 - RNA, 19 nt, Homo sapiens
gacagugccggacgaguuc

SEQ ID NO: 1214107 - RNA, 19 nt, Homo sapiens
cuaaugcucagaacaugga

SEQ ID NO: 1214108 - RNA, 19 nt, Homo sapiens
gauuacagccgguggucau

SEQ ID NO: 1214109 - RNA, 19 nt, Homo sapiens
uacaguggcucgauuucag

SEQ ID NO: 1214110 - RNA, 19 nt, Homo sapiens
cuacgagacucugaagaac

SEQ ID NO: 1214111 - RNA, 19 nt, Homo sapiens
ccgagucagcuaucaaguu

SEQ ID NO: 1214112 - RNA, 19 nt, Homo sapiens
accauugacuggcaagaau

SEQ ID NO: 1214113 - RNA, 19 nt, Homo sapiens
gcuggacaguaacaaggau

SEQ ID NO: 1214114 - RNA, 19 nt, Homo sapiens
aagaauggcgcgaccacuu

SEQ ID NO: 1214115 - RNA, 19 nt, Homo sapiens
ccuaugaacagaucaagag

SEQ ID NO: 1214116 - RNA, 19 nt, Homo sapiens
gcggcaaugguauuaaugu

SEQ ID NO: 1214117 - RNA, 19 nt, Homo sapiens
uuuccgagcucugggcauu

SEQ ID NO: 1214118 - RNA, 19 nt, Homo sapiens
acauggaugagaugauaaa

SEQ ID NO: 1214119 - RNA, 19 nt, Homo sapiens
cuguauuucuggaagcauu

SEQ ID NO: 1214120 - RNA, 19 nt, Homo sapiens
auuacaggauuucaucaug

SEQ ID NO: 1214121 - RNA, 19 nt, Homo sapiens
guggaggacgugcuguauu

SEQ ID NO: 1214122 - RNA, 19 nt, Homo sapiens
cagcuggcuaauacauaua

SEQ ID NO: 1214123 - RNA, 19 nt, Homo sapiens
aaccaucauuuacccuaug

SEQ ID NO: 1214124 - RNA, 19 nt, Homo sapiens
cauggccuaugaacagauc

SEQ ID NO: 1214125 - RNA, 19 nt, Homo sapiens
agucagcuaucaaguucau

SEQ ID NO: 1214126 - RNA, 19 nt, Homo sapiens
ggagcuggacaguaacaag

SEQ ID NO: 1214127 - RNA, 19 nt, Homo sapiens
gaaaugcugucuacugaaa

SEQ ID NO: 1214128 - RNA, 19 nt, Homo sapiens
gaagacauguggagcaguu

SEQ ID NO: 1214129 - RNA, 19 nt, Homo sapiens
cagaaggauuggcuuguua

SEQ ID NO: 1214130 - RNA, 19 nt, Homo sapiens
ggauuggcuuguuaguuua

SEQ ID NO: 1214131 - RNA, 19 nt, Homo sapiens
gaauugaaaugcugucuac

SEQ ID NO: 1214132 - RNA, 19 nt, Homo sapiens
gcagaaggauuggcuuguu

SEQ ID NO: 1214133 - RNA, 19 nt, Homo sapiens
agaaugagccugaauguug

SEQ ID NO: 1214134 - RNA, 19 nt, Homo sapiens
aggauuggcuuguuaguuu

SEQ ID NO: 1214135 - RNA, 19 nt, Homo sapiens
cagcugcgauuaacccuaa

SEQ ID NO: 1214136 - RNA, 19 nt, Homo sapiens
ggacugaguagccuugaaa

SEQ ID NO: 1214137 - RNA, 19 nt, Homo sapiens
gaaagggaauccugguuuu

SEQ ID NO: 1214138 - RNA, 19 nt, Homo sapiens
ucacuuuggucucugaauu

SEQ ID NO: 1214139 - RNA, 19 nt, Homo sapiens
gugauuugcuuguugaguu

SEQ ID NO: 1214140 - RNA, 19 nt, Homo sapiens
gaaaccaggaacucacuuu

SEQ ID NO: 1214141 - RNA, 19 nt, Homo sapiens
ggugaaguguuuccacaga

SEQ ID NO: 1214142 - RNA, 19 nt, Homo sapiens
gcaagaguguugagcuagu

SEQ ID NO: 1214143 - RNA, 19 nt, Homo sapiens
acaccagccuuccuguaua

SEQ ID NO: 1214144 - RNA, 19 nt, Homo sapiens
gaacgggccaccuguaaca

SEQ ID NO: 1214145 - RNA, 19 nt, Homo sapiens
ccgacaaccuucccagaaa

SEQ ID NO: 1214146 - RNA, 19 nt, Homo sapiens
ccugaugacuucaagaaug

SEQ ID NO: 1214147 - RNA, 19 nt, Homo sapiens
ugaguagccuugaaaauaa

SEQ ID NO: 1214148 - RNA, 19 nt, Homo sapiens
uuaacaaacugcuuucaca

SEQ ID NO: 1214149 - RNA, 19 nt, Homo sapiens
ggacauucaguguuacuug

SEQ ID NO: 1214150 - RNA, 19 nt, Homo sapiens
uugaaaugcugucuacuga

SEQ ID NO: 1214151 - RNA, 19 nt, Homo sapiens
aaguaaauaugcaggcuuu

SEQ ID NO: 1214152 - RNA, 19 nt, Homo sapiens
gcuaguuccuggugaagug

SEQ ID NO: 1214153 - RNA, 19 nt, Homo sapiens
gaaauugcauuccccauag

SEQ ID NO: 1214154 - RNA, 19 nt, Homo sapiens
ugaaagggaauccugguuu

SEQ ID NO: 1214155 - RNA, 19 nt, Homo sapiens
gcaggaaugagagugauuu

SEQ ID NO: 1214156 - RNA, 19 nt, Homo sapiens
caagaguguugagcuaguu

SEQ ID NO: 1214157 - RNA, 19 nt, Homo sapiens
ugauuugcuuguugaguuu

SEQ ID NO: 1214158 - RNA, 19 nt, Homo sapiens
ggaaugagagugauuuuau

SEQ ID NO: 1214159 - RNA, 19 nt, Homo sapiens
gccauucauuguacaguug

SEQ ID NO: 1214160 - RNA, 19 nt, Homo sapiens
ggauauuaagggaaacuuu

SEQ ID NO: 1214161 - RNA, 19 nt, Homo sapiens
ccacgucccuguuuucaaa

SEQ ID NO: 1214162 - RNA, 19 nt, Homo sapiens
gccgaggugugcaugguuu

SEQ ID NO: 1214163 - RNA, 19 nt, Homo sapiens
guaaggggcugugaugaaa

SEQ ID NO: 1214164 - RNA, 19 nt, Homo sapiens
gugaaguguuuccacagaa

SEQ ID NO: 1214165 - RNA, 19 nt, Homo sapiens
gacaccagccuuccuguau

SEQ ID NO: 1214166 - RNA, 19 nt, Homo sapiens
cgacaaccuucccagaaag

SEQ ID NO: 1214167 - RNA, 19 nt, Homo sapiens
caauaagaaugagccugaa

SEQ ID NO: 1214168 - RNA, 19 nt, Homo sapiens
aaacuuuccucugccuuga

SEQ ID NO: 1214169 - RNA, 19 nt, Homo sapiens
guuuaacacagccguauuu

SEQ ID NO: 1214170 - RNA, 19 nt, Homo sapiens
aaucauuucuauccagaga

SEQ ID NO: 1214171 - RNA, 19 nt, Homo sapiens
gaaugagagugauuuuaug

SEQ ID NO: 1214172 - RNA, 19 nt, Homo sapiens
uuuggucucugaauugaaa

SEQ ID NO: 1214173 - RNA, 19 nt, Homo sapiens
cugaugacuucaagaaugu

SEQ ID NO: 1214174 - RNA, 19 nt, Homo sapiens
uaagaaugagccugaaugu

SEQ ID NO: 1214175 - RNA, 19 nt, Homo sapiens
caggagcguuuauguaagg

SEQ ID NO: 1214176 - RNA, 19 nt, Homo sapiens
gaaguguuuccacagaaga

SEQ ID NO: 1214177 - RNA, 19 nt, Homo sapiens
ugagcuaguuccuggugaa

SEQ ID NO: 1214178 - RNA, 19 nt, Homo sapiens
caccagccuuccuguauag

SEQ ID NO: 1214179 - RNA, 19 nt, Homo sapiens
ucagugcagcugcgauuaa

SEQ ID NO: 1214180 - RNA, 19 nt, Homo sapiens
gggcugugaugaaauugca

SEQ ID NO: 1214181 - RNA, 19 nt, Homo sapiens
gaugacuucaagaauguuu

SEQ ID NO: 1214182 - RNA, 19 nt, Homo sapiens
ugaaguguuuccacagaag

SEQ ID NO: 1214183 - RNA, 19 nt, Homo sapiens
uucaggagcguuuauguaa

SEQ ID NO: 1214184 - RNA, 19 nt, Homo sapiens
gagucuccauuccuccauu

SEQ ID NO: 1214185 - RNA, 19 nt, Homo sapiens
acaacugugugauuugcuu

SEQ ID NO: 1214186 - RNA, 19 nt, Homo sapiens
aauccugacuuggagguaa

SEQ ID NO: 1214187 - RNA, 19 nt, Homo sapiens
ugugugauuugcuuguuga

SEQ ID NO: 1214188 - RNA, 19 nt, Homo sapiens
uaacaaacugcuuucacau

SEQ ID NO: 1214189 - RNA, 19 nt, Homo sapiens
ccccauagauaaaagaaaa

SEQ ID NO: 1214190 - RNA, 19 nt, Homo sapiens
ucauuucuauccagagauc

SEQ ID NO: 1214191 - RNA, 19 nt, Homo sapiens
cuguauagacacuaaauug

SEQ ID NO: 1214192 - RNA, 19 nt, Homo sapiens
gauuggcuuguuaguuuaa

SEQ ID NO: 1214193 - RNA, 19 nt, Homo sapiens
gccugaauguuggugguuu

SEQ ID NO: 1214194 - RNA, 19 nt, Homo sapiens
gagagugauuuuaugaugu

SEQ ID NO: 1214195 - RNA, 19 nt, Homo sapiens
gaguagccuugaaaauaaa

SEQ ID NO: 1214196 - RNA, 19 nt, Homo sapiens
ggccuucaucuaggaaaua

SEQ ID NO: 1214197 - RNA, 19 nt, Homo sapiens
gggccuucaucuaggaaau

SEQ ID NO: 1214198 - RNA, 19 nt, Homo sapiens
cuuccuguauagacacuaa

SEQ ID NO: 1214199 - RNA, 19 nt, Homo sapiens
cagccuuccuguauagaca

SEQ ID NO: 1214200 - RNA, 19 nt, Homo sapiens
ucaggagcguuuauguaag

SEQ ID NO: 1214201 - RNA, 19 nt, Homo sapiens
ugaauugaaaugcugucua

SEQ ID NO: 1214202 - RNA, 19 nt, Homo sapiens
augauguucugcaugauug

SEQ ID NO: 1214203 - RNA, 19 nt, Homo sapiens
ccuguuaacaaacugcuuu

SEQ ID NO: 1214204 - RNA, 19 nt, Homo sapiens
ugagagugauuuuaugaug

SEQ ID NO: 1214205 - RNA, 19 nt, Homo sapiens
gcuguucggcucuugaauc

SEQ ID NO: 1214206 - RNA, 19 nt, Homo sapiens
uuucaggagcguuuaugua

SEQ ID NO: 1214207 - RNA, 19 nt, Homo sapiens
cuccauuccugaugacuuc

SEQ ID NO: 1214208 - RNA, 19 nt, Homo sapiens
gaggggaacaucuucauga

SEQ ID NO: 1214209 - RNA, 19 nt, Homo sapiens
gaaggauuggcuuguuagu

SEQ ID NO: 1214210 - RNA, 19 nt, Homo sapiens
ugaaauugcauuccccaua

SEQ ID NO: 1214211 - RNA, 19 nt, Homo sapiens
cugaguagccuugaaaaua

SEQ ID NO: 1214212 - RNA, 19 nt, Homo sapiens
agacaccagccuuccugua

SEQ ID NO: 1214213 - RNA, 19 nt, Homo sapiens
gcugugaugaaauugcauu

SEQ ID NO: 1214214 - RNA, 19 nt, Homo sapiens
uuugaaauccugacuugga

SEQ ID NO: 1214215 - RNA, 19 nt, Homo sapiens
gcgcugaaucccacaacug

SEQ ID NO: 1214216 - RNA, 19 nt, Homo sapiens
gcaguuguggggauauuaa

SEQ ID NO: 1214217 - RNA, 19 nt, Homo sapiens
ugggagccauucauuguac

SEQ ID NO: 1214218 - RNA, 19 nt, Homo sapiens
aggaacgggccaccuguaa

SEQ ID NO: 1214219 - RNA, 19 nt, Homo sapiens
ccagaaaaccgacaaccuu

SEQ ID NO: 1214220 - RNA, 19 nt, Homo sapiens
ugaaaugcugucuacugaa

SEQ ID NO: 1214221 - RNA, 19 nt, Homo sapiens
auaagaaugagccugaaug

SEQ ID NO: 1214222 - RNA, 19 nt, Homo sapiens
gugauuuuaugauguggua

SEQ ID NO: 1214223 - RNA, 19 nt, Homo sapiens
gcuccuaccugcugaauaa

SEQ ID NO: 1214224 - RNA, 19 nt, Homo sapiens
ggcaagaccuggagcagua

SEQ ID NO: 1214225 - RNA, 19 nt, Homo sapiens
gaagguacgugaagcugaa

SEQ ID NO: 1214226 - RNA, 19 nt, Homo sapiens
gagcuacgcuucaucaucu

SEQ ID NO: 1214227 - RNA, 19 nt, Homo sapiens
ggagauaaacacauucaaa

SEQ ID NO: 1214228 - RNA, 19 nt, Homo sapiens
gguagccacuuuagauuug

SEQ ID NO: 1214229 - RNA, 19 nt, Homo sapiens
guacaacacuguccugaac

SEQ ID NO: 1214230 - RNA, 19 nt, Homo sapiens
cggcagggauccucuguuu

SEQ ID NO: 1214231 - RNA, 19 nt, Homo sapiens
guacgaccaucuugaguuc

SEQ ID NO: 1214232 - RNA, 19 nt, Homo sapiens
gcagggauccucuguuuag

SEQ ID NO: 1214233 - RNA, 19 nt, Homo sapiens
cuuaggagauaaacacauu

SEQ ID NO: 1214234 - RNA, 19 nt, Homo sapiens
gggcaaggacuuuagauuc

SEQ ID NO: 1214235 - RNA, 19 nt, Homo sapiens
ucacuuggccggaaggaaa

SEQ ID NO: 1214236 - RNA, 19 nt, Homo sapiens
uguuagaaauguccaaguu

SEQ ID NO: 1214237 - RNA, 19 nt, Homo sapiens
gaccaggugccauucauga

SEQ ID NO: 1214238 - RNA, 19 nt, Homo sapiens
acacacacauccucaugga

SEQ ID NO: 1214239 - RNA, 19 nt, Homo sapiens
gcuggugucucgcacuguu

SEQ ID NO: 1214240 - RNA, 19 nt, Homo sapiens
ggcaaggacuuuagauucg

SEQ ID NO: 1214241 - RNA, 19 nt, Homo sapiens
caggugccauucaugacua

SEQ ID NO: 1214242 - RNA, 19 nt, Homo sapiens
uuacgugcuuucgcuguua

SEQ ID NO: 1214243 - RNA, 19 nt, Homo sapiens
cgguugcuguggacucuua

SEQ ID NO: 1214244 - RNA, 19 nt, Homo sapiens
ccagcacaauuaugacaau

SEQ ID NO: 1214245 - RNA, 19 nt, Homo sapiens
ccuaccugcugaauaacua

SEQ ID NO: 1214246 - RNA, 19 nt, Homo sapiens
cacaugaccugcucuacca

SEQ ID NO: 1214247 - RNA, 19 nt, Homo sapiens
guuagaaauguccaaguuu

SEQ ID NO: 1214248 - RNA, 19 nt, Homo sapiens
ggacucuggacguuacaaa

SEQ ID NO: 1214249 - RNA, 19 nt, Homo sapiens
acaacacuguccugaacaa

SEQ ID NO: 1214250 - RNA, 19 nt, Homo sapiens
gcccagaccaggugccauu

SEQ ID NO: 1214251 - RNA, 19 nt, Homo sapiens
ggugaaugccgccuacuca

SEQ ID NO: 1214252 - RNA, 19 nt, Homo sapiens
ggguggagcugugccuguu

SEQ ID NO: 1214253 - RNA, 19 nt, Homo sapiens
gagcaguacgaccaucuug

SEQ ID NO: 1214254 - RNA, 19 nt, Homo sapiens
gcgguagccacuuuagauu

SEQ ID NO: 1214255 - RNA, 19 nt, Homo sapiens
ggagcuacgcuucaucauc

SEQ ID NO: 1214256 - RNA, 19 nt, Homo sapiens
cccuguaugugucccauuu

SEQ ID NO: 1214257 - RNA, 19 nt, Homo sapiens
gauucgggcucuguucugu

SEQ ID NO: 1214258 - RNA, 19 nt, Homo sapiens
gcaguacgaccaucuugag

SEQ ID NO: 1214259 - RNA, 19 nt, Homo sapiens
gauuugggcaaggacuuua

SEQ ID NO: 1214260 - RNA, 19 nt, Homo sapiens
acaaggagcuacgcuucau

SEQ ID NO: 1214261 - RNA, 19 nt, Homo sapiens
ccacacaugaccugcucua

SEQ ID NO: 1214262 - RNA, 19 nt, Homo sapiens
ggcagggauccucuguuua

SEQ ID NO: 1214263 - RNA, 19 nt, Homo sapiens
ugccauucaugacuaauca

SEQ ID NO: 1214264 - RNA, 19 nt, Homo sapiens
cagagaagcaagucaaagg

SEQ ID NO: 1214265 - RNA, 19 nt, Homo sapiens
agucuuggcuguacaaagc

SEQ ID NO: 1214266 - RNA, 19 nt, Homo sapiens
gguacaacacuguccugaa

SEQ ID NO: 1214267 - RNA, 19 nt, Homo sapiens
caacacuguccugaacaaa

SEQ ID NO: 1214268 - RNA, 19 nt, Homo sapiens
gcaguuccaccugauguuc

SEQ ID NO: 1214269 - RNA, 19 nt, Homo sapiens
caucugucccuacaccaaa

SEQ ID NO: 1214270 - RNA, 19 nt, Homo sapiens
agacguccuucugcacauu

SEQ ID NO: 1214271 - RNA, 19 nt, Homo sapiens
uucgggcucuguucuguuu

SEQ ID NO: 1214272 - RNA, 19 nt, Homo sapiens
cgguagccacuuuagauuu

SEQ ID NO: 1214273 - RNA, 19 nt, Homo sapiens
gcucucagcaccaaagaac

SEQ ID NO: 1214274 - RNA, 19 nt, Homo sapiens
acaggugugucucgguuuc

SEQ ID NO: 1214275 - RNA, 19 nt, Homo sapiens
ccugcugaauaacuauaaa

SEQ ID NO: 1214276 - RNA, 19 nt, Homo sapiens
gcugugguacuucuacuca

SEQ ID NO: 1214277 - RNA, 19 nt, Homo sapiens
cgcggacacugcccaaugu

SEQ ID NO: 1214278 - RNA, 19 nt, Homo sapiens
cagaccaggugccauucau

SEQ ID NO: 1214279 - RNA, 19 nt, Homo sapiens
uggcacaauuccagcacaa

SEQ ID NO: 1214280 - RNA, 19 nt, Homo sapiens
gugccaccacugcaacuuu

SEQ ID NO: 1214281 - RNA, 19 nt, Homo sapiens
ccacugcccagggugauug

SEQ ID NO: 1214282 - RNA, 19 nt, Homo sapiens
gaagcugaaagccuggaau

SEQ ID NO: 1214283 - RNA, 19 nt, Homo sapiens
guuuuacucucagcuaaua

SEQ ID NO: 1214284 - RNA, 19 nt, Homo sapiens
ggagcaguacgaccaucuu

SEQ ID NO: 1214285 - RNA, 19 nt, Homo sapiens
ccaaaguggaggagagcuu

SEQ ID NO: 1214286 - RNA, 19 nt, Homo sapiens
ugacggccaugcaguucca

SEQ ID NO: 1214287 - RNA, 19 nt, Homo sapiens
ggccuuccaggagcuguua

SEQ ID NO: 1214288 - RNA, 19 nt, Homo sapiens
guaugugucccauuucaac

SEQ ID NO: 1214289 - RNA, 19 nt, Homo sapiens
cagccacggcccuguaugu

SEQ ID NO: 1214290 - RNA, 19 nt, Homo sapiens
ggaaaggccuucagucauu

SEQ ID NO: 1214291 - RNA, 19 nt, Homo sapiens
ggaaagcucucauuuguuc

SEQ ID NO: 1214292 - RNA, 19 nt, Homo sapiens
gcaguuuccucaaaucuua

SEQ ID NO: 1214293 - RNA, 19 nt, Homo sapiens
gggaaagccuucaauuauu

SEQ ID NO: 1214294 - RNA, 19 nt, Homo sapiens
ggaaagccuucaauuauuc

SEQ ID NO: 1214295 - RNA, 19 nt, Homo sapiens
gaagagaaacccuauaaau

SEQ ID NO: 1214296 - RNA, 19 nt, Homo sapiens
ggaaagccuucacucagua

SEQ ID NO: 1214297 - RNA, 19 nt, Homo sapiens
caauaacccuguuuaaaga

SEQ ID NO: 1214298 - RNA, 19 nt, Homo sapiens
uaagauaugugggaaagua

SEQ ID NO: 1214299 - RNA, 19 nt, Homo sapiens
ggguaucccucaugucuua

SEQ ID NO: 1214300 - RNA, 19 nt, Homo sapiens
gaauggagauugccacugu

SEQ ID NO: 1214301 - RNA, 19 nt, Homo sapiens
gugagaaacuguccaugua

SEQ ID NO: 1214302 - RNA, 19 nt, Homo sapiens
gaacacucaugccuuaaga

SEQ ID NO: 1214303 - RNA, 19 nt, Homo sapiens
gaaaauaauugcugccuuu

SEQ ID NO: 1214304 - RNA, 19 nt, Homo sapiens
ggagaaaccauaugaaugu

SEQ ID NO: 1214305 - RNA, 19 nt, Homo sapiens
gagaaacccuauguaugua

SEQ ID NO: 1214306 - RNA, 19 nt, Homo sapiens
ccucaugucuuaauaauca

SEQ ID NO: 1214307 - RNA, 19 nt, Homo sapiens
gagaagaagcugcaugaaa

SEQ ID NO: 1214308 - RNA, 19 nt, Homo sapiens
ucgaagacaugaacaaauu

SEQ ID NO: 1214309 - RNA, 19 nt, Homo sapiens
gauugccacuguccauuua

SEQ ID NO: 1214310 - RNA, 19 nt, Homo sapiens
ggagagaaacccuauguau

SEQ ID NO: 1214311 - RNA, 19 nt, Homo sapiens
ggaaagccuucacguguuc

SEQ ID NO: 1214312 - RNA, 19 nt, Homo sapiens
gagaaggccugugagugua

SEQ ID NO: 1214313 - RNA, 19 nt, Homo sapiens
gaaacuguccauguaauaa

SEQ ID NO: 1214314 - RNA, 19 nt, Homo sapiens
gagagaaacccuaugaaug

SEQ ID NO: 1214315 - RNA, 19 nt, Homo sapiens
uagaaacccucaaugcaaa

SEQ ID NO: 1214316 - RNA, 19 nt, Homo sapiens
ggugaaaccuugucucuac

SEQ ID NO: 1214317 - RNA, 19 nt, Homo sapiens
gagaaacuguccauguaau

SEQ ID NO: 1214318 - RNA, 19 nt, Homo sapiens
gaacucacacugaagagaa

SEQ ID NO: 1214319 - RNA, 19 nt, Homo sapiens
gagaaaccauaugaaugua

SEQ ID NO: 1214320 - RNA, 19 nt, Homo sapiens
ggaaaauccuucauuaaug

SEQ ID NO: 1214321 - RNA, 19 nt, Homo sapiens
gagaaacccuauaaauguc

SEQ ID NO: 1214322 - RNA, 19 nt, Homo sapiens
gggaaagccuucacguguu

SEQ ID NO: 1214323 - RNA, 19 nt, Homo sapiens
gagacaagcccuaugaaug

SEQ ID NO: 1214324 - RNA, 19 nt, Homo sapiens
cagaagagaaacccuauaa

SEQ ID NO: 1214325 - RNA, 19 nt, Homo sapiens
ggagagaaacccuaugaau

SEQ ID NO: 1214326 - RNA, 19 nt, Homo sapiens
gaaaccauaugaauguaag

SEQ ID NO: 1214327 - RNA, 19 nt, Homo sapiens
ggaauuaugggccagguuu

SEQ ID NO: 1214328 - RNA, 19 nt, Homo sapiens
ccagagaacuagcacacaa

SEQ ID NO: 1214329 - RNA, 19 nt, Homo sapiens
ggaacacucaugacuguaa

SEQ ID NO: 1214330 - RNA, 19 nt, Homo sapiens
gagagaagaagcugcauga

SEQ ID NO: 1214331 - RNA, 19 nt, Homo sapiens
ugggaaagcucucauuugu

SEQ ID NO: 1214332 - RNA, 19 nt, Homo sapiens
gaacacucaugacuguaau

SEQ ID NO: 1214333 - RNA, 19 nt, Homo sapiens
ccaauaacccuguuuaaag

SEQ ID NO: 1214334 - RNA, 19 nt, Homo sapiens
gacaagcccuaugaaugua

SEQ ID NO: 1214335 - RNA, 19 nt, Homo sapiens
gggaaagccuucacucagu

SEQ ID NO: 1214336 - RNA, 19 nt, Homo sapiens
gagagaaacccuauguaug

SEQ ID NO: 1214337 - RNA, 19 nt, Homo sapiens
ggauacaauuggaaggaaa

SEQ ID NO: 1214338 - RNA, 19 nt, Homo sapiens
gaaaccuugucucuacuga

SEQ ID NO: 1214339 - RNA, 19 nt, Homo sapiens
gugggaaagccuucaauua

SEQ ID NO: 1214340 - RNA, 19 nt, Homo sapiens
ccaguucacuuuaaagaca

SEQ ID NO: 1214341 - RNA, 19 nt, Homo sapiens
agagaaacccuauaaaugu

SEQ ID NO: 1214342 - RNA, 19 nt, Homo sapiens
guacagggaacacucauga

SEQ ID NO: 1214343 - RNA, 19 nt, Homo sapiens
ccacuguccauuuagauua

SEQ ID NO: 1214344 - RNA, 19 nt, Homo sapiens
agaagaagcugcaugaaaa

SEQ ID NO: 1214345 - RNA, 19 nt, Homo sapiens
gaaaggccuucagucauuc

SEQ ID NO: 1214346 - RNA, 19 nt, Homo sapiens
caacauauaagaacucaca

SEQ ID NO: 1214347 - RNA, 19 nt, Homo sapiens
gaaacccaguggucuauac

SEQ ID NO: 1214348 - RNA, 19 nt, Homo sapiens
gaaccuggccacaguagga

SEQ ID NO: 1214349 - RNA, 19 nt, Homo sapiens
agagaaacccuauguaugu

SEQ ID NO: 1214350 - RNA, 19 nt, Homo sapiens
gaacaagaagagucaagga

SEQ ID NO: 1214351 - RNA, 19 nt, Homo sapiens
uuacuggacucaacucaga

SEQ ID NO: 1214352 - RNA, 19 nt, Homo sapiens
ggacuuuacuggacucaac

SEQ ID NO: 1214353 - RNA, 19 nt, Homo sapiens
acaagaaccuggccacagu

SEQ ID NO: 1214354 - RNA, 19 nt, Homo sapiens
aagagaaacccuauaaaug

SEQ ID NO: 1214355 - RNA, 19 nt, Homo sapiens
ugggaaagccuucaauuau

SEQ ID NO: 1214356 - RNA, 19 nt, Homo sapiens
gaugggaaaugcgacuuga

SEQ ID NO: 1214357 - RNA, 19 nt, Homo sapiens
gacaccagcaggaagaaua

SEQ ID NO: 1214358 - RNA, 19 nt, Homo sapiens
uuaaugagguguccugaag

SEQ ID NO: 1214359 - RNA, 19 nt, Homo sapiens
gauaugugggaaaguauuu

SEQ ID NO: 1214360 - RNA, 19 nt, Homo sapiens
gaagagaaggccugugagu

SEQ ID NO: 1214361 - RNA, 19 nt, Homo sapiens
agacaagcccuaugaaugu

SEQ ID NO: 1214362 - RNA, 19 nt, Homo sapiens
gagguguccugaagugaug

SEQ ID NO: 1214363 - RNA, 19 nt, Homo sapiens
gcagugagcagagaucaug

SEQ ID NO: 1214364 - RNA, 19 nt, Homo sapiens
ggagacaagcccuaugaau

SEQ ID NO: 1214365 - RNA, 19 nt, Homo sapiens
gaaacccuauguauguaag

SEQ ID NO: 1214366 - RNA, 19 nt, Homo sapiens
gggagaaaccauaugaaug

SEQ ID NO: 1214367 - RNA, 19 nt, Homo sapiens
agaacuagcacacaagaaa

SEQ ID NO: 1214368 - RNA, 19 nt, Homo sapiens
caccaaauauuguauacca

SEQ ID NO: 1214369 - RNA, 19 nt, Homo sapiens
caucaaacccagucuaauc

SEQ ID NO: 1214370 - RNA, 19 nt, Homo sapiens
aaccuugucucuacugaaa

SEQ ID NO: 1214371 - RNA, 19 nt, Homo sapiens
gcucucauuuguuccaguu

SEQ ID NO: 1214372 - RNA, 19 nt, Homo sapiens
gaacucacacuggagagaa

SEQ ID NO: 1214373 - RNA, 19 nt, Homo sapiens
gaacucacacuggagagaa

SEQ ID NO: 1214374 - RNA, 19 nt, Homo sapiens
ucagauacauggaagaacu

SEQ ID NO: 1214375 - RNA, 19 nt, Homo sapiens
gaauguagucacuguggaa

SEQ ID NO: 1214376 - RNA, 19 nt, Homo sapiens
ccauaugaauguaaggaau

SEQ ID NO: 1214377 - RNA, 19 nt, Homo sapiens
cgggaaagcuuacagucau

SEQ ID NO: 1214378 - RNA, 19 nt, Homo sapiens
gagaaacccuaugaaugca

SEQ ID NO: 1214379 - RNA, 19 nt, Homo sapiens
ggaaggcuuuuaacuauuc

SEQ ID NO: 1214380 - RNA, 19 nt, Homo sapiens
ugagaaacuguccauguaa

SEQ ID NO: 1214381 - RNA, 19 nt, Homo sapiens
gggauacaauuggaaggaa

SEQ ID NO: 1214382 - RNA, 19 nt, Homo sapiens
ucuaaucucuugguuggaa

SEQ ID NO: 1214383 - RNA, 19 nt, Homo sapiens
agaaacuguccauguaaua

SEQ ID NO: 1214384 - RNA, 19 nt, Homo sapiens
ccauggacauuaucuuucu

SEQ ID NO: 1214385 - RNA, 19 nt, Homo sapiens
gacucacacuggagagaaa

SEQ ID NO: 1214386 - RNA, 19 nt, Homo sapiens
cagccuaccucaguauuca

SEQ ID NO: 1214387 - RNA, 19 nt, Homo sapiens
gaucaucaaacccagucua

SEQ ID NO: 1214388 - RNA, 19 nt, Homo sapiens
ugagguggguggaucacuu

SEQ ID NO: 1214389 - RNA, 19 nt, Homo sapiens
ggacccaguuugccuucau

SEQ ID NO: 1214390 - RNA, 19 nt, Homo sapiens
gaaaggaugugauggaaau

SEQ ID NO: 1214391 - RNA, 19 nt, Homo sapiens
gcacuuugcuugcauuuua

SEQ ID NO: 1214392 - RNA, 19 nt, Homo sapiens
gagcacaacucagguagaa

SEQ ID NO: 1214393 - RNA, 19 nt, Homo sapiens
gaacauuaccgacaacugu

SEQ ID NO: 1214394 - RNA, 19 nt, Homo sapiens
uagcuuggcucucuaccua

SEQ ID NO: 1214395 - RNA, 19 nt, Homo sapiens
ccauggagcucucugaugu

SEQ ID NO: 1214396 - RNA, 19 nt, Homo sapiens
gcacaacucagguagaaau

SEQ ID NO: 1214397 - RNA, 19 nt, Homo sapiens
ggcauggucuuucuccuuu

SEQ ID NO: 1214398 - RNA, 19 nt, Homo sapiens
ggacacaggaggcaaguau

SEQ ID NO: 1214399 - RNA, 19 nt, Homo sapiens
ggacaagaaagccagauga

SEQ ID NO: 1214400 - RNA, 19 nt, Homo sapiens
auacuucccuggacaagaa

SEQ ID NO: 1214401 - RNA, 19 nt, Homo sapiens
ggaguauccuuccauuucu

SEQ ID NO: 1214402 - RNA, 19 nt, Homo sapiens
gcauggucuuucuccuuua

SEQ ID NO: 1214403 - RNA, 19 nt, Homo sapiens
gaaagccagaugaaacuga

SEQ ID NO: 1214404 - RNA, 19 nt, Homo sapiens
gauaaggacauaggaagaa

SEQ ID NO: 1214405 - RNA, 19 nt, Homo sapiens
caagaaagccagaugaaac

SEQ ID NO: 1214406 - RNA, 19 nt, Homo sapiens
ggacauaggaagaaaauga

SEQ ID NO: 1214407 - RNA, 19 nt, Homo sapiens
ugggauguauggacgauaa

SEQ ID NO: 1214408 - RNA, 19 nt, Homo sapiens
ggaaaggaugugauggaaa

SEQ ID NO: 1214409 - RNA, 19 nt, Homo sapiens
caucagaggcaaauacuuc

SEQ ID NO: 1214410 - RNA, 19 nt, Homo sapiens
caugagggcugggucaguu

SEQ ID NO: 1214411 - RNA, 19 nt, Homo sapiens
gaaccuaaacaaacuagag

SEQ ID NO: 1214412 - RNA, 19 nt, Homo sapiens
gacaagaaagccagaugaa

SEQ ID NO: 1214413 - RNA, 19 nt, Homo sapiens
uguccucccuucuuucaaa

SEQ ID NO: 1214414 - RNA, 19 nt, Homo sapiens
gauuucacgucaucuucaa

SEQ ID NO: 1214415 - RNA, 19 nt, Homo sapiens
gguacuuccgaaucaauua

SEQ ID NO: 1214416 - RNA, 19 nt, Homo sapiens
gcacacugcguucucugaa

SEQ ID NO: 1214417 - RNA, 19 nt, Homo sapiens
gguccuagcuuggcucucu

SEQ ID NO: 1214418 - RNA, 19 nt, Homo sapiens
gugccagccuucucuuaug

SEQ ID NO: 1214419 - RNA, 19 nt, Homo sapiens
gggagucaccgucuucuuc

SEQ ID NO: 1214420 - RNA, 19 nt, Homo sapiens
cauggugccugucuuugug

SEQ ID NO: 1214421 - RNA, 19 nt, Homo sapiens
gcccuaggcucuugcuucu

SEQ ID NO: 1214422 - RNA, 19 nt, Homo sapiens
uggaaaggaugugauggaa

SEQ ID NO: 1214423 - RNA, 19 nt, Homo sapiens
ccacaggaguacagauguc

SEQ ID NO: 1214424 - RNA, 19 nt, Homo sapiens
cauggucuuucuccuuuau

SEQ ID NO: 1214425 - RNA, 19 nt, Homo sapiens
ggagucaccgucuucuuca

SEQ ID NO: 1214426 - RNA, 19 nt, Homo sapiens
auaaggacauaggaagaaa

SEQ ID NO: 1214427 - RNA, 19 nt, Homo sapiens
ccuaguauuugggauguau

SEQ ID NO: 1214428 - RNA, 19 nt, Homo sapiens
gauucuagccuugguccua

SEQ ID NO: 1214429 - RNA, 19 nt, Homo sapiens
ggacgauaaggacauagga

SEQ ID NO: 1214430 - RNA, 19 nt, Homo sapiens
acaagaaagccagaugaaa

SEQ ID NO: 1214431 - RNA, 19 nt, Homo sapiens
caaauacuucccuggacaa

SEQ ID NO: 1214432 - RNA, 19 nt, Homo sapiens
ccugggcgcuauuguguca

SEQ ID NO: 1214433 - RNA, 19 nt, Homo sapiens
cuucagcuuccuaguauuu

SEQ ID NO: 1214434 - RNA, 19 nt, Homo sapiens
aaagccagaugaaacugau

SEQ ID NO: 1214435 - RNA, 19 nt, Homo sapiens
ucauugaggguguggguaa

SEQ ID NO: 1214436 - RNA, 19 nt, Homo sapiens
ugucaucuuccuucacuuu

SEQ ID NO: 1214437 - RNA, 19 nt, Homo sapiens
cgauaaggacauaggaaga

SEQ ID NO: 1214438 - RNA, 19 nt, Homo sapiens
cgaaucaauuaccgccaau

SEQ ID NO: 1214439 - RNA, 19 nt, Homo sapiens
gcuauuggagggucagugu

SEQ ID NO: 1214440 - RNA, 19 nt, Homo sapiens
guagggagccuggaguauc

SEQ ID NO: 1214441 - RNA, 19 nt, Homo sapiens
ccucauggugccugucuuu

SEQ ID NO: 1214442 - RNA, 19 nt, Homo sapiens
uuuaagaguccuucauaga

SEQ ID NO: 1214443 - RNA, 19 nt, Homo sapiens
cagccaaauacucaucuuu

SEQ ID NO: 1214444 - RNA, 19 nt, Homo sapiens
gacgauaaggacauaggaa

SEQ ID NO: 1214445 - RNA, 19 nt, Homo sapiens
cuucuucagcuuccuagua

SEQ ID NO: 1214446 - RNA, 19 nt, Homo sapiens
gucugugacugaauaaagu

SEQ ID NO: 1214447 - RNA, 19 nt, Homo sapiens
uggcgggaaugaagauugu

SEQ ID NO: 1214448 - RNA, 19 nt, Homo sapiens
guggaaaggaugugaugga

SEQ ID NO: 1214449 - RNA, 19 nt, Homo sapiens
ggagggucagugucuguga

SEQ ID NO: 1214450 - RNA, 19 nt, Homo sapiens
uuaagaguccuucauagag

SEQ ID NO: 1214451 - RNA, 19 nt, Homo sapiens
gauguauggacgauaagga

SEQ ID NO: 1214452 - RNA, 19 nt, Homo sapiens
aaaucacacuggcgggaau

SEQ ID NO: 1214453 - RNA, 19 nt, Homo sapiens
gaguauccuuccauuucuc

SEQ ID NO: 1214454 - RNA, 19 nt, Homo sapiens
ggucugguacuuccgaauc

SEQ ID NO: 1214455 - RNA, 19 nt, Homo sapiens
cagccuuggugucaaugug

SEQ ID NO: 1214456 - RNA, 19 nt, Homo sapiens
gguguccucccuucuuuca

SEQ ID NO: 1214457 - RNA, 19 nt, Homo sapiens
ucaucuuccuucacuuuua

SEQ ID NO: 1214458 - RNA, 19 nt, Homo sapiens
guauuuugcuucgaugauu

SEQ ID NO: 1214459 - RNA, 19 nt, Homo sapiens
ucugaugucacccucauug

SEQ ID NO: 1214460 - RNA, 19 nt, Homo sapiens
uucuucagcuuccuaguau

SEQ ID NO: 1214461 - RNA, 19 nt, Homo sapiens
uguuggguguggucuggua

SEQ ID NO: 1214462 - RNA, 19 nt, Homo sapiens
guccuacccugcccaacuc

SEQ ID NO: 1214463 - RNA, 19 nt, Homo sapiens
cuucucauccacaggagua

SEQ ID NO: 1214464 - RNA, 19 nt, Homo sapiens
uugaggguguggguaauga

SEQ ID NO: 1214465 - RNA, 19 nt, Homo sapiens
caaugugggcagccucaug

SEQ ID NO: 1214466 - RNA, 19 nt, Homo sapiens
ggaaguggguaucaaauug

SEQ ID NO: 1214467 - RNA, 19 nt, Homo sapiens
cccaguagcugcucaauaa

SEQ ID NO: 1214468 - RNA, 19 nt, Homo sapiens
ggaggaagcacccaaguuc

SEQ ID NO: 1214469 - RNA, 19 nt, Homo sapiens
caauaaaggcugugugugu

SEQ ID NO: 1214470 - RNA, 19 nt, Homo sapiens
ggucacauuugcucaggaa

SEQ ID NO: 1214471 - RNA, 19 nt, Homo sapiens
cggauacuguguuguuuga

SEQ ID NO: 1214472 - RNA, 19 nt, Homo sapiens
gauacuguguuguuugagu

SEQ ID NO: 1214473 - RNA, 19 nt, Homo sapiens
ggagcuggauguccucaag

SEQ ID NO: 1214474 - RNA, 19 nt, Homo sapiens
ucaggacuguggugggauu

SEQ ID NO: 1214475 - RNA, 19 nt, Homo sapiens
ccucuggccugcaguaucu

SEQ ID NO: 1214476 - RNA, 19 nt, Homo sapiens
ggguggcgguguuccagaa

SEQ ID NO: 1214477 - RNA, 19 nt, Homo sapiens
ucuauacccugggcauuga

SEQ ID NO: 1214478 - RNA, 19 nt, Homo sapiens
gcccaguagcugcucaaua

SEQ ID NO: 1214479 - RNA, 19 nt, Homo sapiens
ucaggaaguggguaucaaa

SEQ ID NO: 1214480 - RNA, 19 nt, Homo sapiens
ggcggauacuguguuguuu

SEQ ID NO: 1214481 - RNA, 19 nt, Homo sapiens
cauggcggauacuguguug

SEQ ID NO: 1214482 - RNA, 19 nt, Homo sapiens
cacauuugcucaggaagug

SEQ ID NO: 1214483 - RNA, 19 nt, Homo sapiens
cagcugcggucaggacugu

SEQ ID NO: 1214484 - RNA, 19 nt, Homo sapiens
auacuguguuguuugaguu

SEQ ID NO: 1214485 - RNA, 19 nt, Homo sapiens
gcggauacuguguuguuug

SEQ ID NO: 1214486 - RNA, 19 nt, Homo sapiens
uggauguccucaaguucuu

SEQ ID NO: 1214487 - RNA, 19 nt, Homo sapiens
gcauggcggauacuguguu

SEQ ID NO: 1214488 - RNA, 19 nt, Homo sapiens
ggacagccugcgcaccaau

SEQ ID NO: 1214489 - RNA, 19 nt, Homo sapiens
ucagggaggagcuggaugu

SEQ ID NO: 1214490 - RNA, 19 nt, Homo sapiens
gcucaggaaguggguauca

SEQ ID NO: 1214491 - RNA, 19 nt, Homo sapiens
ccaguagcugcucaauaaa

SEQ ID NO: 1214492 - RNA, 19 nt, Homo sapiens
uggcggauacuguguuguu

SEQ ID NO: 1214493 - RNA, 19 nt, Homo sapiens
ccaccaagggacagaagau

SEQ ID NO: 1214494 - RNA, 19 nt, Homo sapiens
aggaaguggguaucaaauu

SEQ ID NO: 1214495 - RNA, 19 nt, Homo sapiens
ugucgguccuggaggguau

SEQ ID NO: 1214496 - RNA, 19 nt, Homo sapiens
cagcccugcccgucuguaa

SEQ ID NO: 1214497 - RNA, 19 nt, Homo sapiens
gcagaucucuuguccaugu

SEQ ID NO: 1214498 - RNA, 19 nt, Homo sapiens
caagguacaucccaugauu

SEQ ID NO: 1214499 - RNA, 19 nt, Homo sapiens
gaucaucgcagaaccagua

SEQ ID NO: 1214500 - RNA, 19 nt, Homo sapiens
ggaaauuucugaccuguac

SEQ ID NO: 1214501 - RNA, 19 nt, Homo sapiens
ucacagagauguucacaca

SEQ ID NO: 1214502 - RNA, 19 nt, Homo sapiens
acagagauguucacacaaa

SEQ ID NO: 1214503 - RNA, 19 nt, Homo sapiens
ucccacagcuccugguuua

SEQ ID NO: 1214504 - RNA, 19 nt, Homo sapiens
ggaccugucugcaguaucu

SEQ ID NO: 1214505 - RNA, 19 nt, Homo sapiens
ugacugaugcuguguuuaa

SEQ ID NO: 1214506 - RNA, 19 nt, Homo sapiens
caaggcagcccgcacgaua

SEQ ID NO: 1214507 - RNA, 19 nt, Homo sapiens
ccagggcgaugcaaagcua

SEQ ID NO: 1214508 - RNA, 19 nt, Homo sapiens
gugcagaucucuuguccau

SEQ ID NO: 1214509 - RNA, 19 nt, Homo sapiens
gaaguggccaugguaauga

SEQ ID NO: 1214510 - RNA, 19 nt, Homo sapiens
ugacaccacuggccaggaa

SEQ ID NO: 1214511 - RNA, 19 nt, Homo sapiens
guacaucccaugauucuag

SEQ ID NO: 1214512 - RNA, 19 nt, Homo sapiens
ggaaguggccaugguaaug

SEQ ID NO: 1214513 - RNA, 19 nt, Homo sapiens
gacgacgacuugacugaug

SEQ ID NO: 1214514 - RNA, 19 nt, Homo sapiens
cgacuguucuuagagugua

SEQ ID NO: 1214515 - RNA, 19 nt, Homo sapiens
acacugugcugucagaugu

SEQ ID NO: 1214516 - RNA, 19 nt, Homo sapiens
ugucagauguccaccucua

SEQ ID NO: 1214517 - RNA, 19 nt, Homo sapiens
gcgcagaccgccuguuaug

SEQ ID NO: 1214518 - RNA, 19 nt, Homo sapiens
gacccauucucaccucuga

SEQ ID NO: 1214519 - RNA, 19 nt, Homo sapiens
aggcucaacuucacacuga

SEQ ID NO: 1214520 - RNA, 19 nt, Homo sapiens
gcacgauaucaucagaaua

SEQ ID NO: 1214521 - RNA, 19 nt, Homo sapiens
ucagauguccaccucuaua

SEQ ID NO: 1214522 - RNA, 19 nt, Homo sapiens
uuucugaccuguacgauca

SEQ ID NO: 1214523 - RNA, 19 nt, Homo sapiens
cacuggaggugguauaguu

SEQ ID NO: 1214524 - RNA, 19 nt, Homo sapiens
ucacaccaccauccuguuu

SEQ ID NO: 1214525 - RNA, 19 nt, Homo sapiens
cgucucgacuguucuuaga

SEQ ID NO: 1214526 - RNA, 19 nt, Homo sapiens
gacugaugcuguguuuaaa

SEQ ID NO: 1214527 - RNA, 19 nt, Homo sapiens
cacaagaggaaauuucuga

SEQ ID NO: 1214528 - RNA, 19 nt, Homo sapiens
guuugcagccgaaguguuu

SEQ ID NO: 1214529 - RNA, 19 nt, Homo sapiens
cacgauaucaucagaauag

SEQ ID NO: 1214530 - RNA, 19 nt, Homo sapiens
gacaagguacaucccauga

SEQ ID NO: 1214531 - RNA, 19 nt, Homo sapiens
ccacgagccgccucugauu

SEQ ID NO: 1214532 - RNA, 19 nt, Homo sapiens
gaagaucaucgcagaacca

SEQ ID NO: 1214533 - RNA, 19 nt, Homo sapiens
ccaggaaguggccauggua

SEQ ID NO: 1214534 - RNA, 19 nt, Homo sapiens
gagauguucacacaaagga

SEQ ID NO: 1214535 - RNA, 19 nt, Homo sapiens
ggucacaagaggaaauuuc

SEQ ID NO: 1214536 - RNA, 19 nt, Homo sapiens
gaccguuuauuguacagau

SEQ ID NO: 1214537 - RNA, 19 nt, Homo sapiens
cuggagcucuggaagauca

SEQ ID NO: 1214538 - RNA, 19 nt, Homo sapiens
gcgaaacauugcccucaac

SEQ ID NO: 1214539 - RNA, 19 nt, Homo sapiens
gaaccauagacaucucaug

SEQ ID NO: 1214540 - RNA, 19 nt, Homo sapiens
cagaagcucaccaaagcaa

SEQ ID NO: 1214541 - RNA, 19 nt, Homo sapiens
ucgcagaaccaguaacaug

SEQ ID NO: 1214542 - RNA, 19 nt, Homo sapiens
guucuuagaguguauuucu

SEQ ID NO: 1214543 - RNA, 19 nt, Homo sapiens
acacuuggacgucacaugu

SEQ ID NO: 1214544 - RNA, 19 nt, Homo sapiens
cuugacugaugcuguguuu

SEQ ID NO: 1214545 - RNA, 19 nt, Homo sapiens
cgcagaaccaguaacauga

SEQ ID NO: 1214546 - RNA, 19 nt, Homo sapiens
ucucuucccuggccaaguc

SEQ ID NO: 1214547 - RNA, 19 nt, Homo sapiens
cgacucgcccacagauuga

SEQ ID NO: 1214548 - RNA, 19 nt, Homo sapiens
ccaauucaagcuucuaugg

SEQ ID NO: 1214549 - RNA, 19 nt, Homo sapiens
gcaaagcuacucgcuacca

SEQ ID NO: 1214550 - RNA, 19 nt, Homo sapiens
caugugaagccuacgauca

SEQ ID NO: 1214551 - RNA, 19 nt, Homo sapiens
ccgacucgcccacagauug

SEQ ID NO: 1214552 - RNA, 19 nt, Homo sapiens
cgcacgauaucaucagaau

SEQ ID NO: 1214553 - RNA, 19 nt, Homo sapiens
ggauuuggacguggugaga

SEQ ID NO: 1214554 - RNA, 19 nt, Homo sapiens
cagagauguucacacaaag

SEQ ID NO: 1214555 - RNA, 19 nt, Homo sapiens
caauucaagcuucuaugga

SEQ ID NO: 1214556 - RNA, 19 nt, Homo sapiens
aaucagaagcucaccaaag

SEQ ID NO: 1214557 - RNA, 19 nt, Homo sapiens
caucgcagaaccaguaaca

SEQ ID NO: 1214558 - RNA, 19 nt, Homo sapiens
ucucgacuguucuuagagu

SEQ ID NO: 1214559 - RNA, 19 nt, Homo sapiens
guauaguuagggucaaaga

SEQ ID NO: 1214560 - RNA, 19 nt, Homo sapiens
caggaaguggccaugguaa

SEQ ID NO: 1214561 - RNA, 19 nt, Homo sapiens
gaagcucaccaaagcaaaa

SEQ ID NO: 1214562 - RNA, 19 nt, Homo sapiens
gagccuccuucugcugaga

SEQ ID NO: 1214563 - RNA, 19 nt, Homo sapiens
uggagaagaggcucaacuu

SEQ ID NO: 1214564 - RNA, 19 nt, Homo sapiens
gcuccuggcagacuacauc

SEQ ID NO: 1214565 - RNA, 19 nt, Homo sapiens
gccaugguaaugaggguuu

SEQ ID NO: 1214566 - RNA, 19 nt, Homo sapiens
gaaacauugcccucaacag

SEQ ID NO: 1214567 - RNA, 19 nt, Homo sapiens
ggaugaggauggggauuug

SEQ ID NO: 1214568 - RNA, 19 nt, Homo sapiens
gcagaaccaguaacaugac

SEQ ID NO: 1214569 - RNA, 19 nt, Homo sapiens
ugguauaguuagggucaaa

SEQ ID NO: 1214570 - RNA, 19 nt, Homo sapiens
cgaaacauugcccucaaca

SEQ ID NO: 1214571 - RNA, 19 nt, Homo sapiens
ggaaacaucuucacccuuu

SEQ ID NO: 1214572 - RNA, 19 nt, Homo sapiens
gcaaugcgcugcaggagaa

SEQ ID NO: 1214573 - RNA, 19 nt, Homo sapiens
gcacggagcuccugcaaaa

SEQ ID NO: 1214574 - RNA, 19 nt, Homo sapiens
gcacuucccuuuuacauuu

SEQ ID NO: 1214575 - RNA, 19 nt, Homo sapiens
gaaacaucuucacccuuua

SEQ ID NO: 1214576 - RNA, 19 nt, Homo sapiens
gaauguuucugcaguagga

SEQ ID NO: 1214577 - RNA, 19 nt, Homo sapiens
aaacugcgcucgcugacuu

SEQ ID NO: 1214578 - RNA, 19 nt, Homo sapiens
gaggagcuguaucuacuga

SEQ ID NO: 1214579 - RNA, 19 nt, Homo sapiens
ccacaacccugacgucuac

SEQ ID NO: 1214580 - RNA, 19 nt, Homo sapiens
gauguugacuucaguaacu

SEQ ID NO: 1214581 - RNA, 19 nt, Homo sapiens
agauugugaugguugauua

SEQ ID NO: 1214582 - RNA, 19 nt, Homo sapiens
gggcugcacuucccuuuua

SEQ ID NO: 1214583 - RNA, 19 nt, Homo sapiens
acgagaagauggcaaagaa

SEQ ID NO: 1214584 - RNA, 19 nt, Homo sapiens
ggaagauccugagcgagaa

SEQ ID NO: 1214585 - RNA, 19 nt, Homo sapiens
gaaggaggagaaugagaaa

SEQ ID NO: 1214586 - RNA, 19 nt, Homo sapiens
gaacuggaaacccugagaa

SEQ ID NO: 1214587 - RNA, 19 nt, Homo sapiens
ggcauggucugaacuggaa

SEQ ID NO: 1214588 - RNA, 19 nt, Homo sapiens
gagcaguacugggaagaga

SEQ ID NO: 1214589 - RNA, 19 nt, Homo sapiens
gcacccagauugugauggu

SEQ ID NO: 1214590 - RNA, 19 nt, Homo sapiens
acccacaccuggauuauga

SEQ ID NO: 1214591 - RNA, 19 nt, Homo sapiens
gcagcgagccaacaugguu

SEQ ID NO: 1214592 - RNA, 19 nt, Homo sapiens
acuuguaacugcacacuuu

SEQ ID NO: 1214593 - RNA, 19 nt, Homo sapiens
ccucagagcccuuguucaa

SEQ ID NO: 1214594 - RNA, 19 nt, Homo sapiens
gaaccucacgggcaucuuc

SEQ ID NO: 1214595 - RNA, 19 nt, Homo sapiens
ggacaggagggacaucuuc

SEQ ID NO: 1214596 - RNA, 19 nt, Homo sapiens
ucccaugccuucccuagaa

SEQ ID NO: 1214597 - RNA, 19 nt, Homo sapiens
ugaaggaggagaaugagaa

SEQ ID NO: 1214598 - RNA, 19 nt, Homo sapiens
aagcaaaccugagaaccuu

SEQ ID NO: 1214599 - RNA, 19 nt, Homo sapiens
agaccaguguguuuacuug

SEQ ID NO: 1214600 - RNA, 19 nt, Homo sapiens
ggagcuguaucuacugaag

SEQ ID NO: 1214601 - RNA, 19 nt, Homo sapiens
gcaugaagcgugagguuag

SEQ ID NO: 1214602 - RNA, 19 nt, Homo sapiens
acagagaccaguguguuua

SEQ ID NO: 1214603 - RNA, 19 nt, Homo sapiens
ggaggagaaugagaaacug

SEQ ID NO: 1214604 - RNA, 19 nt, Homo sapiens
ccugugagcuggaauugca

SEQ ID NO: 1214605 - RNA, 19 nt, Homo sapiens
gagacacugugggagauga

SEQ ID NO: 1214606 - RNA, 19 nt, Homo sapiens
gaaacugugccuccuccaa

SEQ ID NO: 1214607 - RNA, 19 nt, Homo sapiens
caacacggacgguuauaag

SEQ ID NO: 1214608 - RNA, 19 nt, Homo sapiens
uggcaaagaagcucaagaa

SEQ ID NO: 1214609 - RNA, 19 nt, Homo sapiens
gaagauccugagcgagaaa

SEQ ID NO: 1214610 - RNA, 19 nt, Homo sapiens
gcaccacacugggcuuugg

SEQ ID NO: 1214611 - RNA, 19 nt, Homo sapiens
uggaaacccugagaauguu

SEQ ID NO: 1214612 - RNA, 19 nt, Homo sapiens
ggucaacacggacgguuau

SEQ ID NO: 1214613 - RNA, 19 nt, Homo sapiens
ugugaugguugauuacgaa

SEQ ID NO: 1214614 - RNA, 19 nt, Homo sapiens
ugugcgagcugcagaagga

SEQ ID NO: 1214615 - RNA, 19 nt, Homo sapiens
acacugggcuuuggagaca

SEQ ID NO: 1214616 - RNA, 19 nt, Homo sapiens
gcagccugauguugacuuc

SEQ ID NO: 1214617 - RNA, 19 nt, Homo sapiens
ccucugcguuuguccuuug

SEQ ID NO: 1214618 - RNA, 19 nt, Homo sapiens
ucaacgagaagauggcaaa

SEQ ID NO: 1214619 - RNA, 19 nt, Homo sapiens
ggaccuggaggccaaagug

SEQ ID NO: 1214620 - RNA, 19 nt, Homo sapiens
gcgacccacaccuggauua

SEQ ID NO: 1214621 - RNA, 19 nt, Homo sapiens
cuggaaacccugagaaugu

SEQ ID NO: 1214622 - RNA, 19 nt, Homo sapiens
gcuucugugugccuguuaa

SEQ ID NO: 1214623 - RNA, 19 nt, Homo sapiens
uccaaggguuuaagaagug

SEQ ID NO: 1214624 - RNA, 19 nt, Homo sapiens
caucgucaguauggacaaa

SEQ ID NO: 1214625 - RNA, 19 nt, Homo sapiens
ucgcugcacuauagcaaug

SEQ ID NO: 1214626 - RNA, 19 nt, Homo sapiens
gccucucgcugcacuauag

SEQ ID NO: 1214627 - RNA, 19 nt, Homo sapiens
accaguguguuuacuugua

SEQ ID NO: 1214628 - RNA, 19 nt, Homo sapiens
gggucaaccuggccaugga

SEQ ID NO: 1214629 - RNA, 19 nt, Homo sapiens
gcaggaggagcuguaucua

SEQ ID NO: 1214630 - RNA, 19 nt, Homo sapiens
ccagggcgguugggaagau

SEQ ID NO: 1214631 - RNA, 19 nt, Homo sapiens
ucaacacggacgguuauaa

SEQ ID NO: 1214632 - RNA, 19 nt, Homo sapiens
aggaggagcuguaucuacu

SEQ ID NO: 1214633 - RNA, 19 nt, Homo sapiens
uaacuuuagcggucucaug

SEQ ID NO: 1214634 - RNA, 19 nt, Homo sapiens
guugacuucaguaacuuua

SEQ ID NO: 1214635 - RNA, 19 nt, Homo sapiens
uuacagagaccaguguguu

SEQ ID NO: 1214636 - RNA, 19 nt, Homo sapiens
ccagcagcccgcagagaaa

SEQ ID NO: 1214637 - RNA, 19 nt, Homo sapiens
ccgggcacuugcuggauuu

SEQ ID NO: 1214638 - RNA, 19 nt, Homo sapiens
guacugggaagagaaggaa

SEQ ID NO: 1214639 - RNA, 19 nt, Homo sapiens
uacagagaccaguguguuu

SEQ ID NO: 1214640 - RNA, 19 nt, Homo sapiens
cuccaaggguuuaagaagu

SEQ ID NO: 1214641 - RNA, 19 nt, Homo sapiens
gauuaugagcuccuagaca

SEQ ID NO: 1214642 - RNA, 19 nt, Homo sapiens
gccugaaggaggagaauga

SEQ ID NO: 1214643 - RNA, 19 nt, Homo sapiens
gagaccaguguguuuacuu

SEQ ID NO: 1214644 - RNA, 19 nt, Homo sapiens
gggcuucugugugccuguu

SEQ ID NO: 1214645 - RNA, 19 nt, Homo sapiens
cccaccgcgugaacucuua

SEQ ID NO: 1214646 - RNA, 19 nt, Homo sapiens
ccagccagcagucccugua

SEQ ID NO: 1214647 - RNA, 19 nt, Homo sapiens
gguggagacgguacuuuca

SEQ ID NO: 1214648 - RNA, 19 nt, Homo sapiens
ucacgggcaucuucaucca

SEQ ID NO: 1214649 - RNA, 19 nt, Homo sapiens
ugagccaggaggaguauga

SEQ ID NO: 1214650 - RNA, 19 nt, Homo sapiens
gcucagcagcagcucauag

SEQ ID NO: 1214651 - RNA, 19 nt, Homo sapiens
gcaguacugggaagagaag

SEQ ID NO: 1214652 - RNA, 19 nt, Homo sapiens
agaggcagcgagagcagua

SEQ ID NO: 1214653 - RNA, 19 nt, Homo sapiens
cagcgagccaacaugguuu

SEQ ID NO: 1214654 - RNA, 19 nt, Homo sapiens
ucuuacaccaugaaggaua

SEQ ID NO: 1214655 - RNA, 19 nt, Homo sapiens
gaacucuuacaccaugaag

SEQ ID NO: 1214656 - RNA, 19 nt, Homo sapiens
ugacuucaguaacuuuagc

SEQ ID NO: 1214657 - RNA, 19 nt, Homo sapiens
gcucuugucggaccugagu

SEQ ID NO: 1214658 - RNA, 19 nt, Homo sapiens
gaggagcugaaccaggaaa

SEQ ID NO: 1214659 - RNA, 19 nt, Homo sapiens
uggagacgguacuuucagu

SEQ ID NO: 1214660 - RNA, 19 nt, Homo sapiens
cugcaggcccgauucaaau

SEQ ID NO: 1214661 - RNA, 19 nt, Homo sapiens
guggagucccucauggaaa

SEQ ID NO: 1214662 - RNA, 19 nt, Homo sapiens
acucuuacaccaugaagga

SEQ ID NO: 1214663 - RNA, 19 nt, Homo sapiens
gugaacucuuacaccauga

SEQ ID NO: 1214664 - RNA, 19 nt, Homo sapiens
gugcucagagggagauuuc

SEQ ID NO: 1214665 - RNA, 19 nt, Homo sapiens
cgcaugaagcgugagguua

SEQ ID NO: 1214666 - RNA, 19 nt, Homo sapiens
guaaagcguucugcucauu

SEQ ID NO: 1214667 - RNA, 19 nt, Homo sapiens
aaagcguucugcucauuua

SEQ ID NO: 1214668 - RNA, 19 nt, Homo sapiens
aaacugcgcucgcugacuu

SEQ ID NO: 1214669 - RNA, 19 nt, Homo sapiens
gagcuuugcugucugaaca

SEQ ID NO: 1214670 - RNA, 19 nt, Homo sapiens
gaaggaggagaaugagaaa

SEQ ID NO: 1214671 - RNA, 19 nt, Homo sapiens
gagcaguacugggaagaga

SEQ ID NO: 1214672 - RNA, 19 nt, Homo sapiens
gcacccagauugugauggu

SEQ ID NO: 1214673 - RNA, 19 nt, Homo sapiens
acccacaccuggauuauga

SEQ ID NO: 1214674 - RNA, 19 nt, Homo sapiens
gcagcgagccaacaugguu

SEQ ID NO: 1214675 - RNA, 19 nt, Homo sapiens
gaaccucacgggcaucuuc

SEQ ID NO: 1214676 - RNA, 19 nt, Homo sapiens
ugaaggaggagaaugagaa

SEQ ID NO: 1214677 - RNA, 19 nt, Homo sapiens
caggagcuuugcugucuga

SEQ ID NO: 1214678 - RNA, 19 nt, Homo sapiens
ggaggagaaugagaaacug

SEQ ID NO: 1214679 - RNA, 19 nt, Homo sapiens
ccugugagcuggaauugca

SEQ ID NO: 1214680 - RNA, 19 nt, Homo sapiens
gcguucugcucauuuauag

SEQ ID NO: 1214681 - RNA, 19 nt, Homo sapiens
uaaagcguucugcucauuu

SEQ ID NO: 1214682 - RNA, 19 nt, Homo sapiens
ugugcgagcugcagaagga

SEQ ID NO: 1214683 - RNA, 19 nt, Homo sapiens
guaaaauacacgugacaua

SEQ ID NO: 1214684 - RNA, 19 nt, Homo sapiens
gcgacccacaccuggauua

SEQ ID NO: 1214685 - RNA, 19 nt, Homo sapiens
guucugcucauuuauagau

SEQ ID NO: 1214686 - RNA, 19 nt, Homo sapiens
guacugggaagagaaggaa

SEQ ID NO: 1214687 - RNA, 19 nt, Homo sapiens
ccagcuguaucuacugaag

SEQ ID NO: 1214688 - RNA, 19 nt, Homo sapiens
ucccagcuguaucuacuga

SEQ ID NO: 1214689 - RNA, 19 nt, Homo sapiens
gauuaugagcuccuagaca

SEQ ID NO: 1214690 - RNA, 19 nt, Homo sapiens
gccugaaggaggagaauga

SEQ ID NO: 1214691 - RNA, 19 nt, Homo sapiens
guucccagcuguaucuacu

SEQ ID NO: 1214692 - RNA, 19 nt, Homo sapiens
cuuuggguguguacaguaa

SEQ ID NO: 1214693 - RNA, 19 nt, Homo sapiens
ggcugggccucugcucuuu

SEQ ID NO: 1214694 - RNA, 19 nt, Homo sapiens
ccagccagcagucccugua

SEQ ID NO: 1214695 - RNA, 19 nt, Homo sapiens
ucacgggcaucuucaucca

SEQ ID NO: 1214696 - RNA, 19 nt, Homo sapiens
uuccugggcugacguaaag

SEQ ID NO: 1214697 - RNA, 19 nt, Homo sapiens
cagcgagccaacaugguuu

SEQ ID NO: 1214698 - RNA, 19 nt, Homo sapiens
gcaguacugggaagagaag

SEQ ID NO: 1214699 - RNA, 19 nt, Homo sapiens
agaggcagcgagagcagua

SEQ ID NO: 1214700 - RNA, 19 nt, Homo sapiens
cguaaagcguucugcucau

SEQ ID NO: 1214701 - RNA, 19 nt, Homo sapiens
gcucuugucggaccugagu

SEQ ID NO: 1214702 - RNA, 19 nt, Homo sapiens
gcucuggguggucacuuug

SEQ ID NO: 1214703 - RNA, 19 nt, Homo sapiens
gugcucagagggagauuuc

SEQ ID NO: 1214704 - RNA, 19 nt, Homo sapiens
ccacaaccuugaauacuug

SEQ ID NO: 1214705 - RNA, 19 nt, Homo sapiens
gacacugacuuacuacuug

SEQ ID NO: 1214706 - RNA, 19 nt, Homo sapiens
gcuugacacugacuuacua

SEQ ID NO: 1214707 - RNA, 19 nt, Homo sapiens
gccacaaccuugaauacuu

SEQ ID NO: 1214708 - RNA, 19 nt, Homo sapiens
uaagcaaggcccugaagua

SEQ ID NO: 1214709 - RNA, 19 nt, Homo sapiens
ccaagaugcuccugaccaa

SEQ ID NO: 1214710 - RNA, 19 nt, Homo sapiens
gcaaggcccugaaguaccu

SEQ ID NO: 1214711 - RNA, 19 nt, Homo sapiens
gcuggaggcuucucuuucu

SEQ ID NO: 1214712 - RNA, 19 nt, Homo sapiens
cccauacuguuacccauaa

SEQ ID NO: 1214713 - RNA, 19 nt, Homo sapiens
gaauuccaccugccaagga

SEQ ID NO: 1214714 - RNA, 19 nt, Homo sapiens
acacugacuuacuacuuga

SEQ ID NO: 1214715 - RNA, 19 nt, Homo sapiens
gcccugaaguaccugaaug

SEQ ID NO: 1214716 - RNA, 19 nt, Homo sapiens
agaaggagcccuguaagga

SEQ ID NO: 1214717 - RNA, 19 nt, Homo sapiens
ugacgcuccuugaagauca

SEQ ID NO: 1214718 - RNA, 19 nt, Homo sapiens
ccucaagcgcuguggauuu

SEQ ID NO: 1214719 - RNA, 19 nt, Homo sapiens
cugggaagcucaucacuac

SEQ ID NO: 1214720 - RNA, 19 nt, Homo sapiens
ccacuugguuguuuucuug

SEQ ID NO: 1214721 - RNA, 19 nt, Homo sapiens
gcaccauguugcccugcuu

SEQ ID NO: 1214722 - RNA, 19 nt, Homo sapiens
gggcguggcauaccaagug

SEQ ID NO: 1214723 - RNA, 19 nt, Homo sapiens
gagaaggagcccuguaagg

SEQ ID NO: 1214724 - RNA, 19 nt, Homo sapiens
gaggagaaggagcccugua

SEQ ID NO: 1214725 - RNA, 19 nt, Homo sapiens
ugagcccacugagcagaua

SEQ ID NO: 1214726 - RNA, 19 nt, Homo sapiens
gaucaugagggcugcacuu

SEQ ID NO: 1214727 - RNA, 19 nt, Homo sapiens
uggugacgcuccuugaaga

SEQ ID NO: 1214728 - RNA, 19 nt, Homo sapiens
ggagaaggagcccuguaag

SEQ ID NO: 1214729 - RNA, 19 nt, Homo sapiens
ugacacugacuuacuacuu

SEQ ID NO: 1214730 - RNA, 19 nt, Homo sapiens
gcagggagacaccuuccau

SEQ ID NO: 1214731 - RNA, 19 nt, Homo sapiens
ucgauccucugcucacuca

SEQ ID NO: 1214732 - RNA, 19 nt, Homo sapiens
aggagaaggagcccuguaa

SEQ ID NO: 1214733 - RNA, 19 nt, Homo sapiens
gcaggcuggaugagggaua

SEQ ID NO: 1214734 - RNA, 19 nt, Homo sapiens
gcuccugaccaaccacuga

SEQ ID NO: 1214735 - RNA, 19 nt, Homo sapiens
ccauacuguuacccauaaa

SEQ ID NO: 1214736 - RNA, 19 nt, Homo sapiens
gcacuuggggcguggcaua

SEQ ID NO: 1214737 - RNA, 19 nt, Homo sapiens
gggaagcucaucacuacag

SEQ ID NO: 1214738 - RNA, 19 nt, Homo sapiens
ccuguguguuggucuauuc

SEQ ID NO: 1214739 - RNA, 19 nt, Homo sapiens
gagcugaugccuggacaca

SEQ ID NO: 1214740 - RNA, 19 nt, Homo sapiens
accaaccacugaaggcauu

SEQ ID NO: 1214741 - RNA, 19 nt, Homo sapiens
gugcuugguggcuacgaua

SEQ ID NO: 1214742 - RNA, 19 nt, Homo sapiens
agucugucccauacuguua

SEQ ID NO: 1214743 - RNA, 19 nt, Homo sapiens
ccugggaagcucaucacua

SEQ ID NO: 1214744 - RNA, 19 nt, Homo sapiens
uaguagggcaugaggagaa

SEQ ID NO: 1214745 - RNA, 19 nt, Homo sapiens
gagggauaguagggcauga

SEQ ID NO: 1214746 - RNA, 19 nt, Homo sapiens
aaacgacggcgacccucaa

SEQ ID NO: 1214747 - RNA, 19 nt, Homo sapiens
ggagcccuguaaggacuga

SEQ ID NO: 1214748 - RNA, 19 nt, Homo sapiens
cuuacccacuugguuguuu

SEQ ID NO: 1214749 - RNA, 19 nt, Homo sapiens
guaagcaaggcccugaagu

SEQ ID NO: 1214750 - RNA, 19 nt, Homo sapiens
ggccuugaguguccacauu

SEQ ID NO: 1214751 - RNA, 19 nt, Homo sapiens
agaauacgcugccaucaac

SEQ ID NO: 1214752 - RNA, 19 nt, Homo sapiens
cagaauacgcugccaucaa

SEQ ID NO: 1214753 - RNA, 19 nt, Homo sapiens
ccuugaguguccacauuaa

SEQ ID NO: 1214754 - RNA, 19 nt, Homo sapiens
gccuugaguguccacauua

SEQ ID NO: 1214755 - RNA, 19 nt, Homo sapiens
gcagacacgccuggaguuc

SEQ ID NO: 1214756 - RNA, 19 nt, Homo sapiens
uggaccaccuggaggagaa

SEQ ID NO: 1214757 - RNA, 19 nt, Homo sapiens
gcuuagacaccuucucaag

SEQ ID NO: 1214758 - RNA, 19 nt, Homo sapiens
uggcuuagacaccuucuca

SEQ ID NO: 1214759 - RNA, 19 nt, Homo sapiens
gaaagaauaucacuguuug

SEQ ID NO: 1214760 - RNA, 19 nt, Homo sapiens
gccaguagccuugguaaua

SEQ ID NO: 1214761 - RNA, 19 nt, Homo sapiens
gaagaugauuucacuugca

SEQ ID NO: 1214762 - RNA, 19 nt, Homo sapiens
gcgauuugcugaccaugaa

SEQ ID NO: 1214763 - RNA, 19 nt, Homo sapiens
aaacaaacaugugaaacga

SEQ ID NO: 1214764 - RNA, 19 nt, Homo sapiens
caauuacuguguccugauu

SEQ ID NO: 1214765 - RNA, 19 nt, Homo sapiens
ccaguagccuugguaauau

SEQ ID NO: 1214766 - RNA, 19 nt, Homo sapiens
agacugaccuucuauggau

SEQ ID NO: 1214767 - RNA, 19 nt, Homo sapiens
gaaaacagggaagauauua

SEQ ID NO: 1214768 - RNA, 19 nt, Homo sapiens
ccucauggcucucucaaag

SEQ ID NO: 1214769 - RNA, 19 nt, Homo sapiens
ccucacagcaacuccauua

SEQ ID NO: 1214770 - RNA, 19 nt, Homo sapiens
gcuguggccuguuggagaa

SEQ ID NO: 1214771 - RNA, 19 nt, Homo sapiens
ucagaaagcagccaggauu

SEQ ID NO: 1214772 - RNA, 19 nt, Homo sapiens
acaaacaugugaaacgaau

SEQ ID NO: 1214773 - RNA, 19 nt, Homo sapiens
cagaauuccuggacagugu

SEQ ID NO: 1214774 - RNA, 19 nt, Homo sapiens
gcuaaacaaacaugugaaa

SEQ ID NO: 1214775 - RNA, 19 nt, Homo sapiens
cagaagaugauuucacuug

SEQ ID NO: 1214776 - RNA, 19 nt, Homo sapiens
uaaccgcuguggccuguug

SEQ ID NO: 1214777 - RNA, 19 nt, Homo sapiens
gccauggacugcuugaugu

SEQ ID NO: 1214778 - RNA, 19 nt, Homo sapiens
gggaacacacauucucuuu

SEQ ID NO: 1214779 - RNA, 19 nt, Homo sapiens
ccucagcaauguucagaga

SEQ ID NO: 1214780 - RNA, 19 nt, Homo sapiens
gccagaagaugauuucacu

SEQ ID NO: 1214781 - RNA, 19 nt, Homo sapiens
gaaagcagccaggauugug

SEQ ID NO: 1214782 - RNA, 19 nt, Homo sapiens
ggaauugccagguucuuca

SEQ ID NO: 1214783 - RNA, 19 nt, Homo sapiens
gcaaguaccaggaggacau

SEQ ID NO: 1214784 - RNA, 19 nt, Homo sapiens
gcagggccuugcaccauca

SEQ ID NO: 1214785 - RNA, 19 nt, Homo sapiens
ccacaauaggguaucauuu

SEQ ID NO: 1214786 - RNA, 19 nt, Homo sapiens
caugaaagaauaucacugu

SEQ ID NO: 1214787 - RNA, 19 nt, Homo sapiens
ggagaugcuuccgaacugu

SEQ ID NO: 1214788 - RNA, 19 nt, Homo sapiens
ucaaagcaccguggaauca

SEQ ID NO: 1214789 - RNA, 19 nt, Homo sapiens
uagcuaaacaaacauguga

SEQ ID NO: 1214790 - RNA, 19 nt, Homo sapiens
ggagcucacucagaaagca

SEQ ID NO: 1214791 - RNA, 19 nt, Homo sapiens
aauauggaauugccagguu

SEQ ID NO: 1214792 - RNA, 19 nt, Homo sapiens
cgacauguccucaccuaca

SEQ ID NO: 1214793 - RNA, 19 nt, Homo sapiens
ccuaucagccugugaacuu

SEQ ID NO: 1214794 - RNA, 19 nt, Homo sapiens
gcacgacccagcaauggau

SEQ ID NO: 1214795 - RNA, 19 nt, Homo sapiens
aagaugauuucacuugcaa

SEQ ID NO: 1214796 - RNA, 19 nt, Homo sapiens
cacagcaacuccauuaagg

SEQ ID NO: 1214797 - RNA, 19 nt, Homo sapiens
gagacugaccuucuaugga

SEQ ID NO: 1214798 - RNA, 19 nt, Homo sapiens
guucaucuccucacagcaa

SEQ ID NO: 1214799 - RNA, 19 nt, Homo sapiens
uuacgggccuucuggagau

SEQ ID NO: 1214800 - RNA, 19 nt, Homo sapiens
cgcuggagcucacucagaa

SEQ ID NO: 1214801 - RNA, 19 nt, Homo sapiens
ucauggcucucucaaagca

SEQ ID NO: 1214802 - RNA, 19 nt, Homo sapiens
uaugaagggugggccagaa

SEQ ID NO: 1214803 - RNA, 19 nt, Homo sapiens
caaguaccaggaggacaua

SEQ ID NO: 1214804 - RNA, 19 nt, Homo sapiens
uaagguucaucuccucaca

SEQ ID NO: 1214805 - RNA, 19 nt, Homo sapiens
cugcugacaaggugaauaa

SEQ ID NO: 1214806 - RNA, 19 nt, Homo sapiens
caaacaugugaaacgaaua

SEQ ID NO: 1214807 - RNA, 19 nt, Homo sapiens
gaagggugggccagaagau

SEQ ID NO: 1214808 - RNA, 19 nt, Homo sapiens
cagaaagcagccaggauug

SEQ ID NO: 1214809 - RNA, 19 nt, Homo sapiens
gcaauuacuguguccugau

SEQ ID NO: 1214810 - RNA, 19 nt, Homo sapiens
uaaacaaacaugugaaacg

SEQ ID NO: 1214811 - RNA, 19 nt, Homo sapiens
ucacagcaacuccauuaag

SEQ ID NO: 1214812 - RNA, 19 nt, Homo sapiens
gucacgccguagccuguua

SEQ ID NO: 1214813 - RNA, 19 nt, Homo sapiens
gcaagaaccccaacacagu

SEQ ID NO: 1214814 - RNA, 19 nt, Homo sapiens
gccuagcccuaccggacua

SEQ ID NO: 1214815 - RNA, 19 nt, Homo sapiens
caguagccuugguaauaug

SEQ ID NO: 1214816 - RNA, 19 nt, Homo sapiens
uggagaugcuuccgaacug

SEQ ID NO: 1214817 - RNA, 19 nt, Homo sapiens
uggacugcuugaugucuuu

SEQ ID NO: 1214818 - RNA, 19 nt, Homo sapiens
cuuugugucuaauagcuaa

SEQ ID NO: 1214819 - RNA, 19 nt, Homo sapiens
gcugacaaggugaauaaca

SEQ ID NO: 1214820 - RNA, 19 nt, Homo sapiens
gaugcacgacccagcaaug

SEQ ID NO: 1214821 - RNA, 19 nt, Homo sapiens
caaagcaccguggaaucaa

SEQ ID NO: 1214822 - RNA, 19 nt, Homo sapiens
cacaauaggguaucauuuu

SEQ ID NO: 1214823 - RNA, 19 nt, Homo sapiens
gacugaccuucuauggauu

SEQ ID NO: 1214824 - RNA, 19 nt, Homo sapiens
ccaggauugugcucaugga

SEQ ID NO: 1214825 - RNA, 19 nt, Homo sapiens
ugcugaccaugaaagaaua

SEQ ID NO: 1214826 - RNA, 19 nt, Homo sapiens
ucagcaauguucagagacu

SEQ ID NO: 1214827 - RNA, 19 nt, Homo sapiens
acccagcaauggaugaaga

SEQ ID NO: 1214828 - RNA, 19 nt, Homo sapiens
aggcgucgcuguucuacca

SEQ ID NO: 1214829 - RNA, 19 nt, Homo sapiens
aaaaguggauggagagagu

SEQ ID NO: 1214830 - RNA, 19 nt, Homo sapiens
cugacaaggugaauaacag

SEQ ID NO: 1214831 - RNA, 19 nt, Homo sapiens
gcccucugcugcugacaag

SEQ ID NO: 1214832 - RNA, 19 nt, Homo sapiens
cuuccgaacugugggcaaa

SEQ ID NO: 1214833 - RNA, 19 nt, Homo sapiens
aaacagggaagauauuagc

SEQ ID NO: 1214834 - RNA, 19 nt, Homo sapiens
uggcuccacugaagagaca

SEQ ID NO: 1214835 - RNA, 19 nt, Homo sapiens
ccccagcacuugucaaaga

SEQ ID NO: 1214836 - RNA, 19 nt, Homo sapiens
agaauucagcuucguccaa

SEQ ID NO: 1214837 - RNA, 19 nt, Homo sapiens
gggagaagcuguuaaagaa

SEQ ID NO: 1214838 - RNA, 19 nt, Homo sapiens
uaccaaccauguagaauua

SEQ ID NO: 1214839 - RNA, 19 nt, Homo sapiens
gaaucagaauggcaauaua

SEQ ID NO: 1214840 - RNA, 19 nt, Homo sapiens
cgaaugagcuccugaccuu

SEQ ID NO: 1214841 - RNA, 19 nt, Homo sapiens
ggacaaauagguucgguuu

SEQ ID NO: 1214842 - RNA, 19 nt, Homo sapiens
agaauuaugucucgaagaa

SEQ ID NO: 1214843 - RNA, 19 nt, Homo sapiens
caauuacacugcaguaugu

SEQ ID NO: 1214844 - RNA, 19 nt, Homo sapiens
gggacaggcucaaccaauu

SEQ ID NO: 1214845 - RNA, 19 nt, Homo sapiens
ggaaagggaagaaucagaa

SEQ ID NO: 1214846 - RNA, 19 nt, Homo sapiens
gaggaguacuuaacagaau

SEQ ID NO: 1214847 - RNA, 19 nt, Homo sapiens
gagaagcauuuguauugga

SEQ ID NO: 1214848 - RNA, 19 nt, Homo sapiens
acaaauagguucgguuuua

SEQ ID NO: 1214849 - RNA, 19 nt, Homo sapiens
ccagaaagcccucuuccuu

SEQ ID NO: 1214850 - RNA, 19 nt, Homo sapiens
agagaaaccucaaaacuaa

SEQ ID NO: 1214851 - RNA, 19 nt, Homo sapiens
ugagugggcugcugaggaa

SEQ ID NO: 1214852 - RNA, 19 nt, Homo sapiens
gagaagcuguuaaagaaaa

SEQ ID NO: 1214853 - RNA, 19 nt, Homo sapiens
ggaguacuuaacagaauua

SEQ ID NO: 1214854 - RNA, 19 nt, Homo sapiens
gaauggcaauauauaugga

SEQ ID NO: 1214855 - RNA, 19 nt, Homo sapiens
gaagauguucugugaagug

SEQ ID NO: 1214856 - RNA, 19 nt, Homo sapiens
caaagaacccagcgaaaca

SEQ ID NO: 1214857 - RNA, 19 nt, Homo sapiens
gaccagagacaaaucagaa

SEQ ID NO: 1214858 - RNA, 19 nt, Homo sapiens
gagcuucguugauguuagu

SEQ ID NO: 1214859 - RNA, 19 nt, Homo sapiens
gcauuuguauuggauguga

SEQ ID NO: 1214860 - RNA, 19 nt, Homo sapiens
gauuugagaagcauuugua

SEQ ID NO: 1214861 - RNA, 19 nt, Homo sapiens
agaaagcccucuuccuugu

SEQ ID NO: 1214862 - RNA, 19 nt, Homo sapiens
gaacccagcgaaacaugaa

SEQ ID NO: 1214863 - RNA, 19 nt, Homo sapiens
agacaaaucagaaaugugu

SEQ ID NO: 1214864 - RNA, 19 nt, Homo sapiens
gaacugugagcuucguuga

SEQ ID NO: 1214865 - RNA, 19 nt, Homo sapiens
ccaaccauguagaauuauu

SEQ ID NO: 1214866 - RNA, 19 nt, Homo sapiens
ggagauuugagaagcauuu

SEQ ID NO: 1214867 - RNA, 19 nt, Homo sapiens
agucauaucuuccgaugug

SEQ ID NO: 1214868 - RNA, 19 nt, Homo sapiens
ucagugcuuugaaugcaua

SEQ ID NO: 1214869 - RNA, 19 nt, Homo sapiens
uauacaccaucccuaauug

SEQ ID NO: 1214870 - RNA, 19 nt, Homo sapiens
ucaccucuggcaaauauua

SEQ ID NO: 1214871 - RNA, 19 nt, Homo sapiens
ggagaagcuguuaaagaaa

SEQ ID NO: 1214872 - RNA, 19 nt, Homo sapiens
ggcaagacaucccaauucu

SEQ ID NO: 1214873 - RNA, 19 nt, Homo sapiens
agucaaagcuccccuauau

SEQ ID NO: 1214874 - RNA, 19 nt, Homo sapiens
cagaauggcaauauauaug

SEQ ID NO: 1214875 - RNA, 19 nt, Homo sapiens
gaaagggaagaaucagaau

SEQ ID NO: 1214876 - RNA, 19 nt, Homo sapiens
uuucaccucuggcaaauau

SEQ ID NO: 1214877 - RNA, 19 nt, Homo sapiens
uugagaagcauuuguauug

SEQ ID NO: 1214878 - RNA, 19 nt, Homo sapiens
ggacaggcucaaccaauuc

SEQ ID NO: 1214879 - RNA, 19 nt, Homo sapiens
ccaauuacacugcaguaug

SEQ ID NO: 1214880 - RNA, 19 nt, Homo sapiens
cugcaacaccuacaaguuu

SEQ ID NO: 1214881 - RNA, 19 nt, Homo sapiens
gugggaacccuucaaagaa

SEQ ID NO: 1214882 - RNA, 19 nt, Homo sapiens
uaucaaacaggacaaauag

SEQ ID NO: 1214883 - RNA, 19 nt, Homo sapiens
aacauucgauugaagaaga

SEQ ID NO: 1214884 - RNA, 19 nt, Homo sapiens
gaacucaccugccccaucu

SEQ ID NO: 1214885 - RNA, 19 nt, Homo sapiens
agagacaaaucagaaaugu

SEQ ID NO: 1214886 - RNA, 19 nt, Homo sapiens
gaagccaacagucauaucu

SEQ ID NO: 1214887 - RNA, 19 nt, Homo sapiens
gauauuacucugcaucaca

SEQ ID NO: 1214888 - RNA, 19 nt, Homo sapiens
caaacaggacaaauagguu

SEQ ID NO: 1214889 - RNA, 19 nt, Homo sapiens
cuauauacaccaucccuaa

SEQ ID NO: 1214890 - RNA, 19 nt, Homo sapiens
aaucagaaauguguucauc

SEQ ID NO: 1214891 - RNA, 19 nt, Homo sapiens
aauuauuccuggauuguga

SEQ ID NO: 1214892 - RNA, 19 nt, Homo sapiens
gacauucagugcagucucu

SEQ ID NO: 1214893 - RNA, 19 nt, Homo sapiens
gguuuuaugucuugaauug

SEQ ID NO: 1214894 - RNA, 19 nt, Homo sapiens
cuucucaccuccucucaga

SEQ ID NO: 1214895 - RNA, 19 nt, Homo sapiens
aauuaugucucgaagaauc

SEQ ID NO: 1214896 - RNA, 19 nt, Homo sapiens
acaaugaagccaacaguca

SEQ ID NO: 1214897 - RNA, 19 nt, Homo sapiens
agacaauacagcagagaaa

SEQ ID NO: 1214898 - RNA, 19 nt, Homo sapiens
ucaaacaggacaaauaggu

SEQ ID NO: 1214899 - RNA, 19 nt, Homo sapiens
cagagaaaccucaaaacua

SEQ ID NO: 1214900 - RNA, 19 nt, Homo sapiens
acugugagcuucguugaug

SEQ ID NO: 1214901 - RNA, 19 nt, Homo sapiens
cgaaacaugaauucuggaa

SEQ ID NO: 1214902 - RNA, 19 nt, Homo sapiens
agaagcauuuguauuggau

SEQ ID NO: 1214903 - RNA, 19 nt, Homo sapiens
cuuccgauguggagauuug

SEQ ID NO: 1214904 - RNA, 19 nt, Homo sapiens
aaccaauucugaguggaua

SEQ ID NO: 1214905 - RNA, 19 nt, Homo sapiens
gaaaaugcagucuuuaugg

SEQ ID NO: 1214906 - RNA, 19 nt, Homo sapiens
gcauucacagggagacaaa

SEQ ID NO: 1214907 - RNA, 19 nt, Homo sapiens
ccuugugccuuaucaaaca

SEQ ID NO: 1214908 - RNA, 19 nt, Homo sapiens
ugugggaacccuucaaaga

SEQ ID NO: 1214909 - RNA, 19 nt, Homo sapiens
caagaccuaccaaccaugu

SEQ ID NO: 1214910 - RNA, 19 nt, Homo sapiens
caguaugucccaagaccua

SEQ ID NO: 1214911 - RNA, 19 nt, Homo sapiens
ucuggaaucucgcaagucu

SEQ ID NO: 1214912 - RNA, 19 nt, Homo sapiens
ugggagaagcuguuaaaga

SEQ ID NO: 1214913 - RNA, 19 nt, Homo sapiens
uaccucaacuggcaagaca

SEQ ID NO: 1214914 - RNA, 19 nt, Homo sapiens
caaauagguucgguuuuau

SEQ ID NO: 1214915 - RNA, 19 nt, Homo sapiens
gaaagcccucuuccuugug

SEQ ID NO: 1214916 - RNA, 19 nt, Homo sapiens
ugagaagcauuuguauugg

SEQ ID NO: 1214917 - RNA, 19 nt, Homo sapiens
caauucugaguggauauua

SEQ ID NO: 1214918 - RNA, 19 nt, Homo sapiens
aggaguacuuaacagaauu

SEQ ID NO: 1214919 - RNA, 19 nt, Homo sapiens
cagagacaaaucagaaaug

SEQ ID NO: 1214920 - RNA, 19 nt, Homo sapiens
ccagagacaaaucagaaau

SEQ ID NO: 1214921 - RNA, 19 nt, Homo sapiens
guuaagaacgacauucagu

SEQ ID NO: 1214922 - RNA, 19 nt, Homo sapiens
ccaucugcaugaacuacuu

SEQ ID NO: 1214923 - RNA, 19 nt, Homo sapiens
gaaggcuuuuggagacaua

SEQ ID NO: 1214924 - RNA, 19 nt, Homo sapiens
ugaggaguacuuaacagaa

SEQ ID NO: 1214925 - RNA, 19 nt, Homo sapiens
caaccaauucugaguggau

SEQ ID NO: 1214926 - RNA, 19 nt, Homo sapiens
ucaaagaacccagcgaaac

SEQ ID NO: 1214927 - RNA, 19 nt, Homo sapiens
agaaucagaauggcaauau

SEQ ID NO: 1214928 - RNA, 19 nt, Homo sapiens
uuuggugucuguaauaagu

SEQ ID NO: 1214929 - RNA, 19 nt, Homo sapiens
uuacucugcaucacaauga

SEQ ID NO: 1214930 - RNA, 19 nt, Homo sapiens
auauuacucugcaucacaa

SEQ ID NO: 1214931 - RNA, 19 nt, Homo sapiens
uggcaagacaucccaauuc

SEQ ID NO: 1214932 - RNA, 19 nt, Homo sapiens
cagcgaaacaugaauucug

SEQ ID NO: 1214933 - RNA, 19 nt, Homo sapiens
gaaugcauaaagacaauac

SEQ ID NO: 1214934 - RNA, 19 nt, Homo sapiens
cccaagaccuaccaaccau

SEQ ID NO: 1214935 - RNA, 19 nt, Homo sapiens
gagaaaccugaauguggaa

SEQ ID NO: 1214936 - RNA, 19 nt, Homo sapiens
gggagacaaagaagauguu

SEQ ID NO: 1214937 - RNA, 19 nt, Homo sapiens
gggaauagcuauaaaguaa

SEQ ID NO: 1214938 - RNA, 19 nt, Homo sapiens
gaacacaucuaggcucuuu

SEQ ID NO: 1214939 - RNA, 19 nt, Homo sapiens
gaagaaugaucaccuuauu

SEQ ID NO: 1214940 - RNA, 19 nt, Homo sapiens
ccacauaggauuucucuua

SEQ ID NO: 1214941 - RNA, 19 nt, Homo sapiens
gugcaaagcuguaaucuca

SEQ ID NO: 1214942 - RNA, 19 nt, Homo sapiens
gccaaguuaugucuuauua

SEQ ID NO: 1214943 - RNA, 19 nt, Homo sapiens
caguguagcuacucaauaa

SEQ ID NO: 1214944 - RNA, 19 nt, Homo sapiens
gcuguaaucucauggacua

SEQ ID NO: 1214945 - RNA, 19 nt, Homo sapiens
agacagagcugaggucauu

SEQ ID NO: 1214946 - RNA, 19 nt, Homo sapiens
gcaaagcuguaaucucaug

SEQ ID NO: 1214947 - RNA, 19 nt, Homo sapiens
gggaugggcugcuguguga

SEQ ID NO: 1214948 - RNA, 19 nt, Homo sapiens
cagcugcucuucugaauug

SEQ ID NO: 1214949 - RNA, 19 nt, Homo sapiens
gagcugaggucauuguauc

SEQ ID NO: 1214950 - RNA, 19 nt, Homo sapiens
gaguacagccuauuauauu

SEQ ID NO: 1214951 - RNA, 19 nt, Homo sapiens
cccauaaccugaagaauga

SEQ ID NO: 1214952 - RNA, 19 nt, Homo sapiens
guaaaggccauucauuuga

SEQ ID NO: 1214953 - RNA, 19 nt, Homo sapiens
gaagucaugcagaaucuaa

SEQ ID NO: 1214954 - RNA, 19 nt, Homo sapiens
cacauaggauuucucuuaa

SEQ ID NO: 1214955 - RNA, 19 nt, Homo sapiens
cgauaucacuuuaacuuuc

SEQ ID NO: 1214956 - RNA, 19 nt, Homo sapiens
ggccuuagaucucugcuau

SEQ ID NO: 1214957 - RNA, 19 nt, Homo sapiens
ggaguacagccuauuauau

SEQ ID NO: 1214958 - RNA, 19 nt, Homo sapiens
gagacucccuucccuuguu

SEQ ID NO: 1214959 - RNA, 19 nt, Homo sapiens
caggagaagucaugcagaa

SEQ ID NO: 1214960 - RNA, 19 nt, Homo sapiens
gcacaagccaccugccaaa

SEQ ID NO: 1214961 - RNA, 19 nt, Homo sapiens
ggacugauuccacaugcua

SEQ ID NO: 1214962 - RNA, 19 nt, Homo sapiens
gguuguauguguaggcuaa

SEQ ID NO: 1214963 - RNA, 19 nt, Homo sapiens
cagcugaguugauuucugu

SEQ ID NO: 1214964 - RNA, 19 nt, Homo sapiens
uaaaggccauucauuugau

SEQ ID NO: 1214965 - RNA, 19 nt, Homo sapiens
ucagagucuucaccuauaa

SEQ ID NO: 1214966 - RNA, 19 nt, Homo sapiens
gagaagucaugcagaaucu

SEQ ID NO: 1214967 - RNA, 19 nt, Homo sapiens
cuacugacaugcccauuuc

SEQ ID NO: 1214968 - RNA, 19 nt, Homo sapiens
gaaaguggugcuagacaga

SEQ ID NO: 1214969 - RNA, 19 nt, Homo sapiens
caucaaagcccagaauuuc

SEQ ID NO: 1214970 - RNA, 19 nt, Homo sapiens
ggaauucugugcucugacu

SEQ ID NO: 1214971 - RNA, 19 nt, Homo sapiens
aagaguagggucagaguua

SEQ ID NO: 1214972 - RNA, 19 nt, Homo sapiens
augaucaccuuauuccuua

SEQ ID NO: 1214973 - RNA, 19 nt, Homo sapiens
guaaucucauggacuagaa

SEQ ID NO: 1214974 - RNA, 19 nt, Homo sapiens
gcagaugaagggaauguug

SEQ ID NO: 1214975 - RNA, 19 nt, Homo sapiens
caagccaccugccaaauac

SEQ ID NO: 1214976 - RNA, 19 nt, Homo sapiens
gaaugcagauagaacacau

SEQ ID NO: 1214977 - RNA, 19 nt, Homo sapiens
acaagccaccugccaaaua

SEQ ID NO: 1214978 - RNA, 19 nt, Homo sapiens
ggagaagucaugcagaauc

SEQ ID NO: 1214979 - RNA, 19 nt, Homo sapiens
ccuauuauauucccacauc

SEQ ID NO: 1214980 - RNA, 19 nt, Homo sapiens
ggacgcagcaccaucaaag

SEQ ID NO: 1214981 - RNA, 19 nt, Homo sapiens
gaaaauaauaccacccuuu

SEQ ID NO: 1214982 - RNA, 19 nt, Homo sapiens
gugacaagguuaacauaag

SEQ ID NO: 1214983 - RNA, 19 nt, Homo sapiens
ggugacaagguuaacauaa

SEQ ID NO: 1214984 - RNA, 19 nt, Homo sapiens
auaccacccuuucaagauu

SEQ ID NO: 1214985 - RNA, 19 nt, Homo sapiens
gacagcugcucuucugaau

SEQ ID NO: 1214986 - RNA, 19 nt, Homo sapiens
guugacagcugcucuucug

SEQ ID NO: 1214987 - RNA, 19 nt, Homo sapiens
ggacauccgccucccugaa

SEQ ID NO: 1214988 - RNA, 19 nt, Homo sapiens
ucaggaguacagccuauua

SEQ ID NO: 1214989 - RNA, 19 nt, Homo sapiens
gauuccacaugcuauauuc

SEQ ID NO: 1214990 - RNA, 19 nt, Homo sapiens
caaauacuccacccuguca

SEQ ID NO: 1214991 - RNA, 19 nt, Homo sapiens
gcgauaucacuuuaacuuu

SEQ ID NO: 1214992 - RNA, 19 nt, Homo sapiens
aagcaggaaugcagauaga

SEQ ID NO: 1214993 - RNA, 19 nt, Homo sapiens
uuaaggcugcugagaauuu

SEQ ID NO: 1214994 - RNA, 19 nt, Homo sapiens
uagggaaacuugggaauag

SEQ ID NO: 1214995 - RNA, 19 nt, Homo sapiens
ccggccaaguuaugucuua

SEQ ID NO: 1214996 - RNA, 19 nt, Homo sapiens
ggccaugggugaggacuug

SEQ ID NO: 1214997 - RNA, 19 nt, Homo sapiens
gacauccgccucccugaaa

SEQ ID NO: 1214998 - RNA, 19 nt, Homo sapiens
ugacaagguuaacauaagg

SEQ ID NO: 1214999 - RNA, 19 nt, Homo sapiens
uguaaaggccauucauuug

SEQ ID NO: 1215000 - RNA, 19 nt, Homo sapiens
cucagagucuucaccuaua

SEQ ID NO: 1215001 - RNA, 19 nt, Homo sapiens
ggcgauaucacuuuaacuu

SEQ ID NO: 1215002 - RNA, 19 nt, Homo sapiens
ccaucaaagcccagaauuu

SEQ ID NO: 1215003 - RNA, 19 nt, Homo sapiens
caucaggaguacagccuau

SEQ ID NO: 1215004 - RNA, 19 nt, Homo sapiens
aaacuugggaauagcuaua

SEQ ID NO: 1215005 - RNA, 19 nt, Homo sapiens
ugaaaacggugacaagguu

SEQ ID NO: 1215006 - RNA, 19 nt, Homo sapiens
ccaggagagugaugaugga

SEQ ID NO: 1215007 - RNA, 19 nt, Homo sapiens
ggaggugaaagauugaaga

SEQ ID NO: 1215008 - RNA, 19 nt, Homo sapiens
aaaggccauucauuugauu

SEQ ID NO: 1215009 - RNA, 19 nt, Homo sapiens
aagggaauguugcuggaaa

SEQ ID NO: 1215010 - RNA, 19 nt, Homo sapiens
ugauuucugugucuauuuc

SEQ ID NO: 1215011 - RNA, 19 nt, Homo sapiens
gugaggacuuggucuguca

SEQ ID NO: 1215012 - RNA, 19 nt, Homo sapiens
gagcuggagguguagauug

SEQ ID NO: 1215013 - RNA, 19 nt, Homo sapiens
cgacaaagucacagacauc

SEQ ID NO: 1215014 - RNA, 19 nt, Homo sapiens
guagcuacucaauaaauga

SEQ ID NO: 1215015 - RNA, 19 nt, Homo sapiens
agacucccuucccuuguuu

SEQ ID NO: 1215016 - RNA, 19 nt, Homo sapiens
ggaaacuugggaauagcua

SEQ ID NO: 1215017 - RNA, 19 nt, Homo sapiens
uaauaccacccuuucaaga

SEQ ID NO: 1215018 - RNA, 19 nt, Homo sapiens
aauaauaccacccuuucaa

SEQ ID NO: 1215019 - RNA, 19 nt, Homo sapiens
gaacccuuccauccuuuga

SEQ ID NO: 1215020 - RNA, 19 nt, Homo sapiens
gcugcugugugaauguuga

SEQ ID NO: 1215021 - RNA, 19 nt, Homo sapiens
caaagcgacagcucuacuu

SEQ ID NO: 1215022 - RNA, 19 nt, Homo sapiens
gaucaccuuauuccuuauu

SEQ ID NO: 1215023 - RNA, 19 nt, Homo sapiens
ugaagaaugaucaccuuau

SEQ ID NO: 1215024 - RNA, 19 nt, Homo sapiens
caacccauaaccugaagaa

SEQ ID NO: 1215025 - RNA, 19 nt, Homo sapiens
uguagcuacucaauaaaug

SEQ ID NO: 1215026 - RNA, 19 nt, Homo sapiens
cuccaucacuuaccaguca

SEQ ID NO: 1215027 - RNA, 19 nt, Homo sapiens
gaauguugacguucguuuc

SEQ ID NO: 1215028 - RNA, 19 nt, Homo sapiens
gggcugcugugugaauguu

SEQ ID NO: 1215029 - RNA, 19 nt, Homo sapiens
acucguacaugccuucuuc

SEQ ID NO: 1215030 - RNA, 19 nt, Homo sapiens
uaaggcugcugagaauuuc

SEQ ID NO: 1215031 - RNA, 19 nt, Homo sapiens
guugauuucugugucuauu

SEQ ID NO: 1215032 - RNA, 19 nt, Homo sapiens
auauucagcugaguugauu

SEQ ID NO: 1215033 - RNA, 19 nt, Homo sapiens
guguggcgguuucugugua

SEQ ID NO: 1215034 - RNA, 19 nt, Homo sapiens
ccucagagucuucaccuau

SEQ ID NO: 1215035 - RNA, 19 nt, Homo sapiens
ccuuaggaaguaaaucuua

SEQ ID NO: 1215036 - RNA, 19 nt, Homo sapiens
ccuuagaucucugcuauac

SEQ ID NO: 1215037 - RNA, 19 nt, Homo sapiens
gaucaaagccuuauaagaa

SEQ ID NO: 1215038 - RNA, 19 nt, Homo sapiens
gaacuagagugucauccua

SEQ ID NO: 1215039 - RNA, 19 nt, Homo sapiens
caucugauauuccagcuua

SEQ ID NO: 1215040 - RNA, 19 nt, Homo sapiens
gaagaauacuuugcugaaa

SEQ ID NO: 1215041 - RNA, 19 nt, Homo sapiens
gaacuauccuaacucaaga

SEQ ID NO: 1215042 - RNA, 19 nt, Homo sapiens
uugcugagcugcugaguua

SEQ ID NO: 1215043 - RNA, 19 nt, Homo sapiens
caacagaauucucaacauc

SEQ ID NO: 1215044 - RNA, 19 nt, Homo sapiens
gcaggaggagaaaguauua

SEQ ID NO: 1215045 - RNA, 19 nt, Homo sapiens
caacuggcaugaagaauac

SEQ ID NO: 1215046 - RNA, 19 nt, Homo sapiens
ggaggagaaaguauuauuu

SEQ ID NO: 1215047 - RNA, 19 nt, Homo sapiens
gcaaccaacuggcaugaag

SEQ ID NO: 1215048 - RNA, 19 nt, Homo sapiens
gaagagaugggcacagaau

SEQ ID NO: 1215049 - RNA, 19 nt, Homo sapiens
gcagagauuguaaagguuu

SEQ ID NO: 1215050 - RNA, 19 nt, Homo sapiens
ccaacuggcaugaagaaua

SEQ ID NO: 1215051 - RNA, 19 nt, Homo sapiens
uauccuaacucaagauuuc

SEQ ID NO: 1215052 - RNA, 19 nt, Homo sapiens
cacaagaacuagaguguca

SEQ ID NO: 1215053 - RNA, 19 nt, Homo sapiens
uaagaaagaaugacugguu

SEQ ID NO: 1215054 - RNA, 19 nt, Homo sapiens
acaggcauguggagaauuu

SEQ ID NO: 1215055 - RNA, 19 nt, Homo sapiens
gagaagagucacccuaaga

SEQ ID NO: 1215056 - RNA, 19 nt, Homo sapiens
gaacucugugggauaauaa

SEQ ID NO: 1215057 - RNA, 19 nt, Homo sapiens
uaaccuagaacuauccuaa

SEQ ID NO: 1215058 - RNA, 19 nt, Homo sapiens
ggagguaguaguccagaaa

SEQ ID NO: 1215059 - RNA, 19 nt, Homo sapiens
gagggaagucugcuugaaa

SEQ ID NO: 1215060 - RNA, 19 nt, Homo sapiens
cuagaacuauccuaacuca

SEQ ID NO: 1215061 - RNA, 19 nt, Homo sapiens
gucuuuagauuuaccauga

SEQ ID NO: 1215062 - RNA, 19 nt, Homo sapiens
acaaacaucugauauucca

SEQ ID NO: 1215063 - RNA, 19 nt, Homo sapiens
cgaaagggcccaacucuac

SEQ ID NO: 1215064 - RNA, 19 nt, Homo sapiens
cuaauucggucucuaugau

SEQ ID NO: 1215065 - RNA, 19 nt, Homo sapiens
gaagagucacccuaagaga

SEQ ID NO: 1215066 - RNA, 19 nt, Homo sapiens
agaacucugugggauaaua

SEQ ID NO: 1215067 - RNA, 19 nt, Homo sapiens
aagaagagaugggcacaga

SEQ ID NO: 1215068 - RNA, 19 nt, Homo sapiens
gaagcaggaggagaaagua

SEQ ID NO: 1215069 - RNA, 19 nt, Homo sapiens
aaaggaagcaggaggagaa

SEQ ID NO: 1215070 - RNA, 19 nt, Homo sapiens
ggaagcaggaggagaaagu

SEQ ID NO: 1215071 - RNA, 19 nt, Homo sapiens
uugcagagauuguaaaggu

SEQ ID NO: 1215072 - RNA, 19 nt, Homo sapiens
ugaagaauacuuugcugaa

SEQ ID NO: 1215073 - RNA, 19 nt, Homo sapiens
gcgaaagggcccaacucua

SEQ ID NO: 1215074 - RNA, 19 nt, Homo sapiens
cgagggaagucugcuugaa

SEQ ID NO: 1215075 - RNA, 19 nt, Homo sapiens
agaauacuuugcugaaaca

SEQ ID NO: 1215076 - RNA, 19 nt, Homo sapiens
ugacuaauucggucucuau

SEQ ID NO: 1215077 - RNA, 19 nt, Homo sapiens
uaacaccaugugacuaauu

SEQ ID NO: 1215078 - RNA, 19 nt, Homo sapiens
ggaagucugcuugaaagga

SEQ ID NO: 1215079 - RNA, 19 nt, Homo sapiens
cuuaacaccaugugacuaa

SEQ ID NO: 1215080 - RNA, 19 nt, Homo sapiens
ccaguggucuagucaacau

SEQ ID NO: 1215081 - RNA, 19 nt, Homo sapiens
uuagacuccuccacaagaa

SEQ ID NO: 1215082 - RNA, 19 nt, Homo sapiens
gucagccauuggucacuua

SEQ ID NO: 1215083 - RNA, 19 nt, Homo sapiens
agagaugggcacagaauga

SEQ ID NO: 1215084 - RNA, 19 nt, Homo sapiens
ucaaagccuuauaagaaag

SEQ ID NO: 1215085 - RNA, 19 nt, Homo sapiens
cugcugaguuaaccuagaa

SEQ ID NO: 1215086 - RNA, 19 nt, Homo sapiens
gagcugcugaguuaaccua

SEQ ID NO: 1215087 - RNA, 19 nt, Homo sapiens
gacccgacauggaccaagu

SEQ ID NO: 1215088 - RNA, 19 nt, Homo sapiens
uagucaacauuuccucuug

SEQ ID NO: 1215089 - RNA, 19 nt, Homo sapiens
aagaauacuuugcugaaac

SEQ ID NO: 1215090 - RNA, 19 nt, Homo sapiens
acagaauucucaacaucau

SEQ ID NO: 1215091 - RNA, 19 nt, Homo sapiens
caaagccuuauaagaaaga

SEQ ID NO: 1215092 - RNA, 19 nt, Homo sapiens
gcagcccacagcucucuuu

SEQ ID NO: 1215093 - RNA, 19 nt, Homo sapiens
ugagaagagucacccuaag

SEQ ID NO: 1215094 - RNA, 19 nt, Homo sapiens
acaacagaauucucaacau

SEQ ID NO: 1215095 - RNA, 19 nt, Homo sapiens
guugugggcuaagaagaga

SEQ ID NO: 1215096 - RNA, 19 nt, Homo sapiens
agaacuauccuaacucaag

SEQ ID NO: 1215097 - RNA, 19 nt, Homo sapiens
acuagagugucauccuauu

SEQ ID NO: 1215098 - RNA, 19 nt, Homo sapiens
agccauuggucacuuaaga

SEQ ID NO: 1215099 - RNA, 19 nt, Homo sapiens
cuagagugucauccuauuu

SEQ ID NO: 1215100 - RNA, 19 nt, Homo sapiens
gcugcugaguuaaccuaga

SEQ ID NO: 1215101 - RNA, 19 nt, Homo sapiens
aagagucacccuaagagaa

SEQ ID NO: 1215102 - RNA, 19 nt, Homo sapiens
caaccaacuggcaugaaga

SEQ ID NO: 1215103 - RNA, 19 nt, Homo sapiens
gagaugggcacagaaugau

SEQ ID NO: 1215104 - RNA, 19 nt, Homo sapiens
ugaucaaagccuuauaaga

SEQ ID NO: 1215105 - RNA, 19 nt, Homo sapiens
cugagaagagucacccuaa

SEQ ID NO: 1215106 - RNA, 19 nt, Homo sapiens
ccaguguguugugggcuaa

SEQ ID NO: 1215107 - RNA, 19 nt, Homo sapiens
guuucaaucuuaacaccau

SEQ ID NO: 1215108 - RNA, 19 nt, Homo sapiens
cagaguauuuccgcagcaa

SEQ ID NO: 1215109 - RNA, 19 nt, Homo sapiens
gaaagaaugacugguugac

SEQ ID NO: 1215110 - RNA, 19 nt, Homo sapiens
uuucggaccucugaaguca

SEQ ID NO: 1215111 - RNA, 19 nt, Homo sapiens
agggaagucugcuugaaag

SEQ ID NO: 1215112 - RNA, 19 nt, Homo sapiens
cagcucagucccucugcua

SEQ ID NO: 1215113 - RNA, 19 nt, Homo sapiens
aacaccaugugacuaauuc

SEQ ID NO: 1215114 - RNA, 19 nt, Homo sapiens
gcaugaagaauacuuugcu

SEQ ID NO: 1215115 - RNA, 19 nt, Homo sapiens
caagaacuagagugucauc

SEQ ID NO: 1215116 - RNA, 19 nt, Homo sapiens
ggaccaagugaccguucuu

SEQ ID NO: 1215117 - RNA, 19 nt, Homo sapiens
cagagauuguaaagguuuc

SEQ ID NO: 1215118 - RNA, 19 nt, Homo sapiens
agaaagaaugacugguuga

SEQ ID NO: 1215119 - RNA, 19 nt, Homo sapiens
gagucacccuaagagaaga

SEQ ID NO: 1215120 - RNA, 19 nt, Homo sapiens
gagcgaaagggcccaacuc

SEQ ID NO: 1215121 - RNA, 19 nt, Homo sapiens
aauucggucucuaugauca

SEQ ID NO: 1215122 - RNA, 19 nt, Homo sapiens
ucggaccucugaagucaca

SEQ ID NO: 1215123 - RNA, 19 nt, Homo sapiens
gcucagucccucugcuaca

SEQ ID NO: 1215124 - RNA, 19 nt, Homo sapiens
cuuagacuccuccacaaga

SEQ ID NO: 1215125 - RNA, 19 nt, Homo sapiens
aggaggagaaaguauuauu

SEQ ID NO: 1215126 - RNA, 19 nt, Homo sapiens
uacggcagccaucuuggua

SEQ ID NO: 1215127 - RNA, 19 nt, Homo sapiens
gggccuggaugacauugcu

SEQ ID NO: 1215128 - RNA, 19 nt, Homo sapiens
gaaauuagaucccaaagau

SEQ ID NO: 1215129 - RNA, 19 nt, Homo sapiens
gaauguuggugaagauuua

SEQ ID NO: 1215130 - RNA, 19 nt, Homo sapiens
gaagauaacgaaugugaua

SEQ ID NO: 1215131 - RNA, 19 nt, Homo sapiens
gcaaaugaauguuggugaa

SEQ ID NO: 1215132 - RNA, 19 nt, Homo sapiens
ccacacaucuguaccauuc

SEQ ID NO: 1215133 - RNA, 19 nt, Homo sapiens
cgaaguuucucuaguguuu

SEQ ID NO: 1215134 - RNA, 19 nt, Homo sapiens
gggcaaacuugaagauaaa

SEQ ID NO: 1215135 - RNA, 19 nt, Homo sapiens
gaagaaaucacaacaugga

SEQ ID NO: 1215136 - RNA, 19 nt, Homo sapiens
agugauaacucuucugaua

SEQ ID NO: 1215137 - RNA, 19 nt, Homo sapiens
cauaguaaguucugaauuc

SEQ ID NO: 1215138 - RNA, 19 nt, Homo sapiens
aaagagcaauugauggaua

SEQ ID NO: 1215139 - RNA, 19 nt, Homo sapiens
gacagaagccaaaguaauu

SEQ ID NO: 1215140 - RNA, 19 nt, Homo sapiens
gaacaccaccugaaagaau

SEQ ID NO: 1215141 - RNA, 19 nt, Homo sapiens
gaaaucacaacauggaauu

SEQ ID NO: 1215142 - RNA, 19 nt, Homo sapiens
gaucuaaagugaccuugau

SEQ ID NO: 1215143 - RNA, 19 nt, Homo sapiens
gagaaauccuauauacuca

SEQ ID NO: 1215144 - RNA, 19 nt, Homo sapiens
cgaaugugauaucaaauug

SEQ ID NO: 1215145 - RNA, 19 nt, Homo sapiens
ggagaaauccuauauacuc

SEQ ID NO: 1215146 - RNA, 19 nt, Homo sapiens
ucugauagcagcuuauuua

SEQ ID NO: 1215147 - RNA, 19 nt, Homo sapiens
gcucgaaguuucucuagug

SEQ ID NO: 1215148 - RNA, 19 nt, Homo sapiens
gaaugaaugugauuugaac

SEQ ID NO: 1215149 - RNA, 19 nt, Homo sapiens
gaccaaagauggaaguucu

SEQ ID NO: 1215150 - RNA, 19 nt, Homo sapiens
cuagaucucuugaaucaug

SEQ ID NO: 1215151 - RNA, 19 nt, Homo sapiens
gaugacagaagccaaagua

SEQ ID NO: 1215152 - RNA, 19 nt, Homo sapiens
gaagaaauuagaucccaaa

SEQ ID NO: 1215153 - RNA, 19 nt, Homo sapiens
gaaagaaucauugaagcaa

SEQ ID NO: 1215154 - RNA, 19 nt, Homo sapiens
acucaucucuggaaaugua

SEQ ID NO: 1215155 - RNA, 19 nt, Homo sapiens
gaacauggugucuggaguu

SEQ ID NO: 1215156 - RNA, 19 nt, Homo sapiens
aaacaaagagcaauugaug

SEQ ID NO: 1215157 - RNA, 19 nt, Homo sapiens
ccauagcacuccuaauguu

SEQ ID NO: 1215158 - RNA, 19 nt, Homo sapiens
ggauaaaucaggaauagau

SEQ ID NO: 1215159 - RNA, 19 nt, Homo sapiens
gcuaauaaccaagcaguuu

SEQ ID NO: 1215160 - RNA, 19 nt, Homo sapiens
cauggugucuggaguuaaa

SEQ ID NO: 1215161 - RNA, 19 nt, Homo sapiens
caacauggaauuccucgaa

SEQ ID NO: 1215162 - RNA, 19 nt, Homo sapiens
aagacugaguguauacuua

SEQ ID NO: 1215163 - RNA, 19 nt, Homo sapiens
uggaagaaaucacaacaug

SEQ ID NO: 1215164 - RNA, 19 nt, Homo sapiens
aaaggacccuaaaguaaau

SEQ ID NO: 1215165 - RNA, 19 nt, Homo sapiens
ggaaugaaugugauuugaa

SEQ ID NO: 1215166 - RNA, 19 nt, Homo sapiens
gcaguuuguaguagaguua

SEQ ID NO: 1215167 - RNA, 19 nt, Homo sapiens
ccaagcaguuuguaguaga

SEQ ID NO: 1215168 - RNA, 19 nt, Homo sapiens
aagaggauauuacugaaga

SEQ ID NO: 1215169 - RNA, 19 nt, Homo sapiens
ggggauaguuucauaguaa

SEQ ID NO: 1215170 - RNA, 19 nt, Homo sapiens
ggaggaggucggcugguua

SEQ ID NO: 1215171 - RNA, 19 nt, Homo sapiens
uagauucucuugaccaugu

SEQ ID NO: 1215172 - RNA, 19 nt, Homo sapiens
gauggacaguggaagaaau

SEQ ID NO: 1215173 - RNA, 19 nt, Homo sapiens
ccuuguggguugcuaauaa

SEQ ID NO: 1215174 - RNA, 19 nt, Homo sapiens
uugaaaagcugaaguauga

SEQ ID NO: 1215175 - RNA, 19 nt, Homo sapiens
guacacucaucucuggaaa

SEQ ID NO: 1215176 - RNA, 19 nt, Homo sapiens
gaguguauacuuagaagaa

SEQ ID NO: 1215177 - RNA, 19 nt, Homo sapiens
ggauccauuucuccuauug

SEQ ID NO: 1215178 - RNA, 19 nt, Homo sapiens
gauggaaguucucuauagg

SEQ ID NO: 1215179 - RNA, 19 nt, Homo sapiens
acacucaucucuggaaaug

SEQ ID NO: 1215180 - RNA, 19 nt, Homo sapiens
aagaagaggauauuacuga

SEQ ID NO: 1215181 - RNA, 19 nt, Homo sapiens
gaaauccuauauacucacu

SEQ ID NO: 1215182 - RNA, 19 nt, Homo sapiens
agggcaaacuugaagauaa

SEQ ID NO: 1215183 - RNA, 19 nt, Homo sapiens
gaggagauauaaaacguaa

SEQ ID NO: 1215184 - RNA, 19 nt, Homo sapiens
agugaucgcuuaggaauga

SEQ ID NO: 1215185 - RNA, 19 nt, Homo sapiens
ugacagucguagauacaaa

SEQ ID NO: 1215186 - RNA, 19 nt, Homo sapiens
aaacucaguguaucccuua

SEQ ID NO: 1215187 - RNA, 19 nt, Homo sapiens
aagagcaauugauggauaa

SEQ ID NO: 1215188 - RNA, 19 nt, Homo sapiens
gugacaggaucaugaaugu

SEQ ID NO: 1215189 - RNA, 19 nt, Homo sapiens
ggauauuacugaagaagcu

SEQ ID NO: 1215190 - RNA, 19 nt, Homo sapiens
uggaaguucucuauaggaa

SEQ ID NO: 1215191 - RNA, 19 nt, Homo sapiens
gcuuugccuuuauauugua

SEQ ID NO: 1215192 - RNA, 19 nt, Homo sapiens
guaccauucuugagugauc

SEQ ID NO: 1215193 - RNA, 19 nt, Homo sapiens
ggacagagaggccugaaaa

SEQ ID NO: 1215194 - RNA, 19 nt, Homo sapiens
agaagaggauauuacugaa

SEQ ID NO: 1215195 - RNA, 19 nt, Homo sapiens
ggaugaggaugcaacacau

SEQ ID NO: 1215196 - RNA, 19 nt, Homo sapiens
ggaucuggcuucccauuuu

SEQ ID NO: 1215197 - RNA, 19 nt, Homo sapiens
caucaagugacucaucuuu

SEQ ID NO: 1215198 - RNA, 19 nt, Homo sapiens
aauguuuggugcuauguuu

SEQ ID NO: 1215199 - RNA, 19 nt, Homo sapiens
agauggaaguucucuauag

SEQ ID NO: 1215200 - RNA, 19 nt, Homo sapiens
aaagauggaaguucucuau

SEQ ID NO: 1215201 - RNA, 19 nt, Homo sapiens
aguuaaagguauuggcaua

SEQ ID NO: 1215202 - RNA, 19 nt, Homo sapiens
ucuagaaagucagcaugua

SEQ ID NO: 1215203 - RNA, 19 nt, Homo sapiens
gugaaacccagagcucuua

SEQ ID NO: 1215204 - RNA, 19 nt, Homo sapiens
uccuagaucucuugaauca

SEQ ID NO: 1215205 - RNA, 19 nt, Homo sapiens
ugacagaagccaaaguaau

SEQ ID NO: 1215206 - RNA, 19 nt, Homo sapiens
acaaagagcaauugaugga

SEQ ID NO: 1215207 - RNA, 19 nt, Homo sapiens
guaugaacaccaccugaaa

SEQ ID NO: 1215208 - RNA, 19 nt, Homo sapiens
ccaggccagucgcggauuu

SEQ ID NO: 1215209 - RNA, 19 nt, Homo sapiens
gaagccauagcacuccuaa

SEQ ID NO: 1215210 - RNA, 19 nt, Homo sapiens
cuggaucaguuucauuaaa

SEQ ID NO: 1215211 - RNA, 19 nt, Homo sapiens
ucuagggacucauucaugu

SEQ ID NO: 1215212 - RNA, 19 nt, Homo sapiens
ucuccuagaucucuugaau

SEQ ID NO: 1215213 - RNA, 19 nt, Homo sapiens
gcuguggacaugaccauaa

SEQ ID NO: 1215214 - RNA, 19 nt, Homo sapiens
ucaagugacucaucuuuug

SEQ ID NO: 1215215 - RNA, 19 nt, Homo sapiens
ggagggugguguguacaga

SEQ ID NO: 1215216 - RNA, 19 nt, Homo sapiens
acagaagccaaaguaauua

SEQ ID NO: 1215217 - RNA, 19 nt, Homo sapiens
gaagaagaggauauuacug

SEQ ID NO: 1215218 - RNA, 19 nt, Homo sapiens
agaaagucagcauguauuu

SEQ ID NO: 1215219 - RNA, 19 nt, Homo sapiens
uuucaaagagggcuuauga

SEQ ID NO: 1215220 - RNA, 19 nt, Homo sapiens
caaaguaauuauggcaagu

SEQ ID NO: 1215221 - RNA, 19 nt, Homo sapiens
cgagaugacagaagccaaa

SEQ ID NO: 1215222 - RNA, 19 nt, Homo sapiens
ugaaugugauuugaacuca

SEQ ID NO: 1215223 - RNA, 19 nt, Homo sapiens
acacaucuguaccauucuu

SEQ ID NO: 1215224 - RNA, 19 nt, Homo sapiens
gcaaaucgaagugauaacu

SEQ ID NO: 1215225 - RNA, 19 nt, Homo sapiens
gauggauaaaucaggaaua

SEQ ID NO: 1215226 - RNA, 19 nt, Homo sapiens
aaaugaauguuggugaaga

SEQ ID NO: 1215227 - RNA, 19 nt, Homo sapiens
uagaaagucagcauguauu

SEQ ID NO: 1215228 - RNA, 19 nt, Homo sapiens
gaauaaaguucucuugaca

SEQ ID NO: 1215229 - RNA, 19 nt, Homo sapiens
uaacauggcuucucuuuac

SEQ ID NO: 1215230 - RNA, 19 nt, Homo sapiens
cggaugaucuuaaaccuuu

SEQ ID NO: 1215231 - RNA, 19 nt, Homo sapiens
gauaacauggcuucucuuu

SEQ ID NO: 1215232 - RNA, 19 nt, Homo sapiens
gcaagggcccugagacuau

SEQ ID NO: 1215233 - RNA, 19 nt, Homo sapiens
ccaaacagcccaucuucaa

SEQ ID NO: 1215234 - RNA, 19 nt, Homo sapiens
ggagaucuauagguccuuu

SEQ ID NO: 1215235 - RNA, 19 nt, Homo sapiens
cguaguggcugccuuccua

SEQ ID NO: 1215236 - RNA, 19 nt, Homo sapiens
ugacuagucuucugcacuu

SEQ ID NO: 1215237 - RNA, 19 nt, Homo sapiens
gaucuuaaaccuuuguguu

SEQ ID NO: 1215238 - RNA, 19 nt, Homo sapiens
caagggcccugagacuauu

SEQ ID NO: 1215239 - RNA, 19 nt, Homo sapiens
gguuggagacugcucauuu

SEQ ID NO: 1215240 - RNA, 19 nt, Homo sapiens
caaacagcccaucuucaaa

SEQ ID NO: 1215241 - RNA, 19 nt, Homo sapiens
gggcagacugugcacauuu

SEQ ID NO: 1215242 - RNA, 19 nt, Homo sapiens
acauugaguuggaagacua

SEQ ID NO: 1215243 - RNA, 19 nt, Homo sapiens
gaccagagcaagacagugu

SEQ ID NO: 1215244 - RNA, 19 nt, Homo sapiens
cgccuucgcuuuagagaug

SEQ ID NO: 1215245 - RNA, 19 nt, Homo sapiens
ugaauaaaguucucuugac

SEQ ID NO: 1215246 - RNA, 19 nt, Homo sapiens
gccgagagaggcucaauga

SEQ ID NO: 1215247 - RNA, 19 nt, Homo sapiens
caggagggauaaccggauu

SEQ ID NO: 1215248 - RNA, 19 nt, Homo sapiens
gggagucucaggagggaua

SEQ ID NO: 1215249 - RNA, 19 nt, Homo sapiens
ugccaggccugcacugaaa

SEQ ID NO: 1215250 - RNA, 19 nt, Homo sapiens
gcagaucagaggcagaaga

SEQ ID NO: 1215251 - RNA, 19 nt, Homo sapiens
gaggaugacagacguagug

SEQ ID NO: 1215252 - RNA, 19 nt, Homo sapiens
ggaagaagugugucaucug

SEQ ID NO: 1215253 - RNA, 19 nt, Homo sapiens
gcuuugugcuugucaaucu

SEQ ID NO: 1215254 - RNA, 19 nt, Homo sapiens
ccugguggcuuaugugauc

SEQ ID NO: 1215255 - RNA, 19 nt, Homo sapiens
uguguacucugcuguauag

SEQ ID NO: 1215256 - RNA, 19 nt, Homo sapiens
ggcagacugugcacauuuc

SEQ ID NO: 1215257 - RNA, 19 nt, Homo sapiens
ucaacagccuggucaacau

SEQ ID NO: 1215258 - RNA, 19 nt, Homo sapiens
gccaggaccaucagaguga

SEQ ID NO: 1215259 - RNA, 19 nt, Homo sapiens
gcggagucuugcuuucauu

SEQ ID NO: 1215260 - RNA, 19 nt, Homo sapiens
gaggagccagacuuuguuu

SEQ ID NO: 1215261 - RNA, 19 nt, Homo sapiens
gcgcagaucagaggcagaa

SEQ ID NO: 1215262 - RNA, 19 nt, Homo sapiens
ugugacaucugugccauug

SEQ ID NO: 1215263 - RNA, 19 nt, Homo sapiens
gaggaggccaggaccauca

SEQ ID NO: 1215264 - RNA, 19 nt, Homo sapiens
aagccagucucaggaguuu

SEQ ID NO: 1215265 - RNA, 19 nt, Homo sapiens
gccuucggaugaucuuaaa

SEQ ID NO: 1215266 - RNA, 19 nt, Homo sapiens
aagaggagcggaagaagug

SEQ ID NO: 1215267 - RNA, 19 nt, Homo sapiens
caagaggagcggaagaagu

SEQ ID NO: 1215268 - RNA, 19 nt, Homo sapiens
gucugcagcuggcgaguug

SEQ ID NO: 1215269 - RNA, 19 nt, Homo sapiens
ccauggccauccuccuuug

SEQ ID NO: 1215270 - RNA, 19 nt, Homo sapiens
caaccgaggagccagacuu

SEQ ID NO: 1215271 - RNA, 19 nt, Homo sapiens
gcccaguuuccaaugaaua

SEQ ID NO: 1215272 - RNA, 19 nt, Homo sapiens
ggccuucggaugaucuuaa

SEQ ID NO: 1215273 - RNA, 19 nt, Homo sapiens
cggaagaagugugucaucu

SEQ ID NO: 1215274 - RNA, 19 nt, Homo sapiens
gguacugacuagucuucug

SEQ ID NO: 1215275 - RNA, 19 nt, Homo sapiens
acacgguacugacuagucu

SEQ ID NO: 1215276 - RNA, 19 nt, Homo sapiens
guuggagacugcucauuuu

SEQ ID NO: 1215277 - RNA, 19 nt, Homo sapiens
ucuuaaaccuuuguguuca

SEQ ID NO: 1215278 - RNA, 19 nt, Homo sapiens
gagcggaagaaguguguca

SEQ ID NO: 1215279 - RNA, 19 nt, Homo sapiens
ccaggccugugacaucugu

SEQ ID NO: 1215280 - RNA, 19 nt, Homo sapiens
ccgaggagccagacuuugu

SEQ ID NO: 1215281 - RNA, 19 nt, Homo sapiens
ggaugaucuuaaaccuuug

SEQ ID NO: 1215282 - RNA, 19 nt, Homo sapiens
uuucauugcuggccuugau

SEQ ID NO: 1215283 - RNA, 19 nt, Homo sapiens
ccacuucuuccucagauuc

SEQ ID NO: 1215284 - RNA, 19 nt, Homo sapiens
uaaccggauuucugcucuu

SEQ ID NO: 1215285 - RNA, 19 nt, Homo sapiens
ggagggauaaccggauuuc

SEQ ID NO: 1215286 - RNA, 19 nt, Homo sapiens
gggcucgccuucgcuuuag

SEQ ID NO: 1215287 - RNA, 19 nt, Homo sapiens
gagcaagaggagcggaaga

SEQ ID NO: 1215288 - RNA, 19 nt, Homo sapiens
gccauggccauccuccuuu

SEQ ID NO: 1215289 - RNA, 19 nt, Homo sapiens
uggcuuaugugaucaacag

SEQ ID NO: 1215290 - RNA, 19 nt, Homo sapiens
cgaggagccagacuuuguu

SEQ ID NO: 1215291 - RNA, 19 nt, Homo sapiens
aaccggauuucugcucuuu

SEQ ID NO: 1215292 - RNA, 19 nt, Homo sapiens
auaacauggcuucucuuua

SEQ ID NO: 1215293 - RNA, 19 nt, Homo sapiens
aggauaacauggcuucucu

SEQ ID NO: 1215294 - RNA, 19 nt, Homo sapiens
ccaggacauugaguuggaa

SEQ ID NO: 1215295 - RNA, 19 nt, Homo sapiens
ccucuucccucccaaacag

SEQ ID NO: 1215296 - RNA, 19 nt, Homo sapiens
caacagccuggucaacauc

SEQ ID NO: 1215297 - RNA, 19 nt, Homo sapiens
caucugcaccugacuuugg

SEQ ID NO: 1215298 - RNA, 19 nt, Homo sapiens
ugggcucgccuucgcuuua

SEQ ID NO: 1215299 - RNA, 19 nt, Homo sapiens
aaacagcccaucuucaaaa

SEQ ID NO: 1215300 - RNA, 19 nt, Homo sapiens
gcuccuggccuucgucuac

SEQ ID NO: 1215301 - RNA, 19 nt, Homo sapiens
cccaguuuccaaugaauaa

SEQ ID NO: 1215302 - RNA, 19 nt, Homo sapiens
cuuggaaauugcugaagga

SEQ ID NO: 1215303 - RNA, 19 nt, Homo sapiens
guuggaagacuaugaucug

SEQ ID NO: 1215304 - RNA, 19 nt, Homo sapiens
cauccaggacauugaguug

SEQ ID NO: 1215305 - RNA, 19 nt, Homo sapiens
cucaaugucuaccucugaa

SEQ ID NO: 1215306 - RNA, 19 nt, Homo sapiens
ccucaaugucuaccucuga

SEQ ID NO: 1215307 - RNA, 19 nt, Homo sapiens
ccagagcaagacaguguug

SEQ ID NO: 1215308 - RNA, 19 nt, Homo sapiens
gcaagaggagcggaagaag

SEQ ID NO: 1215309 - RNA, 19 nt, Homo sapiens
uggacacccugccaacuag

SEQ ID NO: 1215310 - RNA, 19 nt, Homo sapiens
ggucaacaucugccucauc

SEQ ID NO: 1215311 - RNA, 19 nt, Homo sapiens
gagccaccucugccuguga

SEQ ID NO: 1215312 - RNA, 19 nt, Homo sapiens
ucucucgggugcccucaga

SEQ ID NO: 1215313 - RNA, 19 nt, Homo sapiens
ugccauacauccaggacau

SEQ ID NO: 1215314 - RNA, 19 nt, Homo sapiens
gccuagcacugggcucaga

SEQ ID NO: 1215315 - RNA, 19 nt, Homo sapiens
uugcaggccuuguguacuc

SEQ ID NO: 1215316 - RNA, 19 nt, Homo sapiens
uggcccaguuuccaaugaa

SEQ ID NO: 1215317 - RNA, 19 nt, Homo sapiens
cagugucauuuggguguuu

SEQ ID NO: 1215318 - RNA, 19 nt, Homo sapiens
gacauugaguuggaagacu

SEQ ID NO: 1215319 - RNA, 19 nt, Homo sapiens
ccauacauccaggacauug

SEQ ID NO: 1215320 - RNA, 19 nt, Homo sapiens
gcacucagaaccucuuuuc

SEQ ID NO: 1215321 - RNA, 19 nt, Homo sapiens
ggcccaguuuccaaugaau

SEQ ID NO: 1215322 - RNA, 19 nt, Homo sapiens
gcagacugugcacauuuca

SEQ ID NO: 1215323 - RNA, 19 nt, Homo sapiens
gagggcagacugugcacau

SEQ ID NO: 1215324 - RNA, 19 nt, Homo sapiens
gacggugacuguguugcau

SEQ ID NO: 1215325 - RNA, 19 nt, Homo sapiens
gugguccgguucacaugug

SEQ ID NO: 1215326 - RNA, 19 nt, Homo sapiens
aaacacagcucaaagauua

SEQ ID NO: 1215327 - RNA, 19 nt, Homo sapiens
gcucauggauucucccuua

SEQ ID NO: 1215328 - RNA, 19 nt, Homo sapiens
gaaauugugcucaagguua

SEQ ID NO: 1215329 - RNA, 19 nt, Homo sapiens
gcaaucagcccaggaguua

SEQ ID NO: 1215330 - RNA, 19 nt, Homo sapiens
acacaaagguuaccaugaa

SEQ ID NO: 1215331 - RNA, 19 nt, Homo sapiens
ccaagaagaucgaugucua

SEQ ID NO: 1215332 - RNA, 19 nt, Homo sapiens
aaacagguguacucuuuaa

SEQ ID NO: 1215333 - RNA, 19 nt, Homo sapiens
auaaacagguguacucuuu

SEQ ID NO: 1215334 - RNA, 19 nt, Homo sapiens
gaaauuggcccacagaaag

SEQ ID NO: 1215335 - RNA, 19 nt, Homo sapiens
auaaacaccucuacuuuga

SEQ ID NO: 1215336 - RNA, 19 nt, Homo sapiens
aaagagaagccuccaauuu

SEQ ID NO: 1215337 - RNA, 19 nt, Homo sapiens
gggaagcagucgauauuau

SEQ ID NO: 1215338 - RNA, 19 nt, Homo sapiens
gauagacccuguuacgaau

SEQ ID NO: 1215339 - RNA, 19 nt, Homo sapiens
gaggaggauucgcaaauug

SEQ ID NO: 1215340 - RNA, 19 nt, Homo sapiens
ggaguuaaagucacuguuu

SEQ ID NO: 1215341 - RNA, 19 nt, Homo sapiens
ggacuuugguauuagaaga

SEQ ID NO: 1215342 - RNA, 19 nt, Homo sapiens
ggaaauuggcccacagaaa

SEQ ID NO: 1215343 - RNA, 19 nt, Homo sapiens
ugaaggaaaucuuacugaa

SEQ ID NO: 1215344 - RNA, 19 nt, Homo sapiens
uaagcaaucacgacuauaa

SEQ ID NO: 1215345 - RNA, 19 nt, Homo sapiens
guagagauagacccuguua

SEQ ID NO: 1215346 - RNA, 19 nt, Homo sapiens
gcacuaaguuuuggauuaa

SEQ ID NO: 1215347 - RNA, 19 nt, Homo sapiens
uaggugagcucgugaaaca

SEQ ID NO: 1215348 - RNA, 19 nt, Homo sapiens
gaguuaaagucacuguuug

SEQ ID NO: 1215349 - RNA, 19 nt, Homo sapiens
aaacccaucucaaucgauu

SEQ ID NO: 1215350 - RNA, 19 nt, Homo sapiens
aaauugugcucaagguuaa

SEQ ID NO: 1215351 - RNA, 19 nt, Homo sapiens
ucacguaucuaagcaauca

SEQ ID NO: 1215352 - RNA, 19 nt, Homo sapiens
ugaccuugcugaagagaaa

SEQ ID NO: 1215353 - RNA, 19 nt, Homo sapiens
gagacaaaguagagauaga

SEQ ID NO: 1215354 - RNA, 19 nt, Homo sapiens
gcagaaacccaucucaauc

SEQ ID NO: 1215355 - RNA, 19 nt, Homo sapiens
gaaagccagcacuaaguuu

SEQ ID NO: 1215356 - RNA, 19 nt, Homo sapiens
aaacaccucuacuuugaau

SEQ ID NO: 1215357 - RNA, 19 nt, Homo sapiens
gaaauucagggaagcaaug

SEQ ID NO: 1215358 - RNA, 19 nt, Homo sapiens
gcaacuugaucaaauuucu

SEQ ID NO: 1215359 - RNA, 19 nt, Homo sapiens
ggucugacauccaaagagu

SEQ ID NO: 1215360 - RNA, 19 nt, Homo sapiens
caacagcaaccaagaagau

SEQ ID NO: 1215361 - RNA, 19 nt, Homo sapiens
gacagugggucagaaauuc

SEQ ID NO: 1215362 - RNA, 19 nt, Homo sapiens
ggacaauccaacuaucauu

SEQ ID NO: 1215363 - RNA, 19 nt, Homo sapiens
ugaggaggauucgcaaauu

SEQ ID NO: 1215364 - RNA, 19 nt, Homo sapiens
ccugugaccuugcugaaga

SEQ ID NO: 1215365 - RNA, 19 nt, Homo sapiens
gaaggaaaucuuacugaag

SEQ ID NO: 1215366 - RNA, 19 nt, Homo sapiens
aauaaaugcugcucaugga

SEQ ID NO: 1215367 - RNA, 19 nt, Homo sapiens
guacaacagcaaccaagaa

SEQ ID NO: 1215368 - RNA, 19 nt, Homo sapiens
caauccaacuaucauucua

SEQ ID NO: 1215369 - RNA, 19 nt, Homo sapiens
uauaaacaccucuacuuug

SEQ ID NO: 1215370 - RNA, 19 nt, Homo sapiens
cuauaaacaccucuacuuu

SEQ ID NO: 1215371 - RNA, 19 nt, Homo sapiens
ucuaagcaaucacgacuau

SEQ ID NO: 1215372 - RNA, 19 nt, Homo sapiens
ggagacagugggucagaaa

SEQ ID NO: 1215373 - RNA, 19 nt, Homo sapiens
gagccgugcccacacauuu

SEQ ID NO: 1215374 - RNA, 19 nt, Homo sapiens
gcucaagguuaacuacauc

SEQ ID NO: 1215375 - RNA, 19 nt, Homo sapiens
gcaaucacgacuauaaaca

SEQ ID NO: 1215376 - RNA, 19 nt, Homo sapiens
gcauauugcugaggaugau

SEQ ID NO: 1215377 - RNA, 19 nt, Homo sapiens
caaacacagcucaaagauu

SEQ ID NO: 1215378 - RNA, 19 nt, Homo sapiens
gggaaugugugagaugguu

SEQ ID NO: 1215379 - RNA, 19 nt, Homo sapiens
guggacaacacaaagguua

SEQ ID NO: 1215380 - RNA, 19 nt, Homo sapiens
cauggauucucccuuauuc

SEQ ID NO: 1215381 - RNA, 19 nt, Homo sapiens
aagagaagccuccaauuuc

SEQ ID NO: 1215382 - RNA, 19 nt, Homo sapiens
caaagagaagccuccaauu

SEQ ID NO: 1215383 - RNA, 19 nt, Homo sapiens
cacauuuccuugcaacuug

SEQ ID NO: 1215384 - RNA, 19 nt, Homo sapiens
caaccaagaagaucgaugu

SEQ ID NO: 1215385 - RNA, 19 nt, Homo sapiens
uaaaugcugcucauggauu

SEQ ID NO: 1215386 - RNA, 19 nt, Homo sapiens
uaccaugaaggaaaucuua

SEQ ID NO: 1215387 - RNA, 19 nt, Homo sapiens
gacagacugcugccaauga

SEQ ID NO: 1215388 - RNA, 19 nt, Homo sapiens
caaugaccguggugacaau

SEQ ID NO: 1215389 - RNA, 19 nt, Homo sapiens
gaacgacuccgaaaagaga

SEQ ID NO: 1215390 - RNA, 19 nt, Homo sapiens
aaacugaacagacguacga

SEQ ID NO: 1215391 - RNA, 19 nt, Homo sapiens
cauucuagcucauauucga

SEQ ID NO: 1215392 - RNA, 19 nt, Homo sapiens
ugacauagccacaguacag

SEQ ID NO: 1215393 - RNA, 19 nt, Homo sapiens
ucaaagagaagccuccaau

SEQ ID NO: 1215394 - RNA, 19 nt, Homo sapiens
gugagcucgugaaacaaua

SEQ ID NO: 1215395 - RNA, 19 nt, Homo sapiens
aguugggacuuugguauua

SEQ ID NO: 1215396 - RNA, 19 nt, Homo sapiens
gaaauccgggcagcaguga

SEQ ID NO: 1215397 - RNA, 19 nt, Homo sapiens
aaacucacguaucuaagca

SEQ ID NO: 1215398 - RNA, 19 nt, Homo sapiens
agauagacccuguuacgaa

SEQ ID NO: 1215399 - RNA, 19 nt, Homo sapiens
agccgaagcucaaugacaa

SEQ ID NO: 1215400 - RNA, 19 nt, Homo sapiens
gauuagaacgacuccgaaa

SEQ ID NO: 1215401 - RNA, 19 nt, Homo sapiens
cuauguauaugcccaguca

SEQ ID NO: 1215402 - RNA, 19 nt, Homo sapiens
gggaagcaauggugagacu

SEQ ID NO: 1215403 - RNA, 19 nt, Homo sapiens
ccagucacgcaauauuuaa

SEQ ID NO: 1215404 - RNA, 19 nt, Homo sapiens
cccagucacgcaauauuua

SEQ ID NO: 1215405 - RNA, 19 nt, Homo sapiens
agacucagggcuauguaua

SEQ ID NO: 1215406 - RNA, 19 nt, Homo sapiens
uuaacuacauccuggaauc

SEQ ID NO: 1215407 - RNA, 19 nt, Homo sapiens
gacaauccaacuaucauuc

SEQ ID NO: 1215408 - RNA, 19 nt, Homo sapiens
caaagguuaccaugaagga

SEQ ID NO: 1215409 - RNA, 19 nt, Homo sapiens
gagaagauucauccuccuu

SEQ ID NO: 1215410 - RNA, 19 nt, Homo sapiens
gcugcuaccgucaaugaaa

SEQ ID NO: 1215411 - RNA, 19 nt, Homo sapiens
cacgcaauauuuaaacuca

SEQ ID NO: 1215412 - RNA, 19 nt, Homo sapiens
gucacucuuuguucgaaua

SEQ ID NO: 1215413 - RNA, 19 nt, Homo sapiens
guacuuuggcccugguuga

SEQ ID NO: 1215414 - RNA, 19 nt, Homo sapiens
agacagugggucagaaauu

SEQ ID NO: 1215415 - RNA, 19 nt, Homo sapiens
gauguugaccuagagaaga

SEQ ID NO: 1215416 - RNA, 19 nt, Homo sapiens
gauucauccuccuucaaug

SEQ ID NO: 1215417 - RNA, 19 nt, Homo sapiens
cauuacaagucauucaaag

SEQ ID NO: 1215418 - RNA, 19 nt, Homo sapiens
cagccaccauuacaaguca

SEQ ID NO: 1215419 - RNA, 19 nt, Homo sapiens
ggauggccuucuuggacaa

SEQ ID NO: 1215420 - RNA, 19 nt, Homo sapiens
uggcaagggucauguaggu

SEQ ID NO: 1215421 - RNA, 19 nt, Homo sapiens
gcgauucacaaccgacgua

SEQ ID NO: 1215422 - RNA, 19 nt, Homo sapiens
aaaugcugcucauggauuc

SEQ ID NO: 1215423 - RNA, 19 nt, Homo sapiens
gacaaaaccagaucaaaug

SEQ ID NO: 1215424 - RNA, 19 nt, Homo sapiens
gguauuagaagacgcucaa

SEQ ID NO: 1215425 - RNA, 19 nt, Homo sapiens
ccuugcaacuugaucaaau

SEQ ID NO: 1215426 - RNA, 19 nt, Homo sapiens
gcaaugugguggugcguua

SEQ ID NO: 1215427 - RNA, 19 nt, Homo sapiens
gaauggagcuucgguccua

SEQ ID NO: 1215428 - RNA, 19 nt, Homo sapiens
gcaagaauaucaucaucug

SEQ ID NO: 1215429 - RNA, 19 nt, Homo sapiens
gagccaaggugguuguauu

SEQ ID NO: 1215430 - RNA, 19 nt, Homo sapiens
gcacauagacauuuucaua

SEQ ID NO: 1215431 - RNA, 19 nt, Homo sapiens
gccaguaccuagaacuuaa

SEQ ID NO: 1215432 - RNA, 19 nt, Homo sapiens
agaaugagcuggcccacuu

SEQ ID NO: 1215433 - RNA, 19 nt, Homo sapiens
gggcagaccuaccuacuag

SEQ ID NO: 1215434 - RNA, 19 nt, Homo sapiens
gaguugagccggaaauuug

SEQ ID NO: 1215435 - RNA, 19 nt, Homo sapiens
gcaccaggcugaguuaagu

SEQ ID NO: 1215436 - RNA, 19 nt, Homo sapiens
gcaaggcgcaguuucaguu

SEQ ID NO: 1215437 - RNA, 19 nt, Homo sapiens
gagcuucgguccuaccaau

SEQ ID NO: 1215438 - RNA, 19 nt, Homo sapiens
ucaacaaagucuucaagga

SEQ ID NO: 1215439 - RNA, 19 nt, Homo sapiens
guuaugggcucuugaccaa

SEQ ID NO: 1215440 - RNA, 19 nt, Homo sapiens
gcagcucugugccaacuug

SEQ ID NO: 1215441 - RNA, 19 nt, Homo sapiens
caacagccuugcaaacagu

SEQ ID NO: 1215442 - RNA, 19 nt, Homo sapiens
ccaaugaaaucuccauggu

SEQ ID NO: 1215443 - RNA, 19 nt, Homo sapiens
ggacaucccacauugcaau

SEQ ID NO: 1215444 - RNA, 19 nt, Homo sapiens
caguuuccauuucugauuu

SEQ ID NO: 1215445 - RNA, 19 nt, Homo sapiens
aagaagugauccagaaguu

SEQ ID NO: 1215446 - RNA, 19 nt, Homo sapiens
acagggagcacgucacuaa

SEQ ID NO: 1215447 - RNA, 19 nt, Homo sapiens
caacuucucgaacuacuau

SEQ ID NO: 1215448 - RNA, 19 nt, Homo sapiens
gggcaagaauaucaucauc

SEQ ID NO: 1215449 - RNA, 19 nt, Homo sapiens
cgacauuccuucccuacca

SEQ ID NO: 1215450 - RNA, 19 nt, Homo sapiens
caaaggcaguucaguagcu

SEQ ID NO: 1215451 - RNA, 19 nt, Homo sapiens
gcacccaccaugucaaugu

SEQ ID NO: 1215452 - RNA, 19 nt, Homo sapiens
gcacaaggacaccgucuac

SEQ ID NO: 1215453 - RNA, 19 nt, Homo sapiens
uaugggcucuugaccaaug

SEQ ID NO: 1215454 - RNA, 19 nt, Homo sapiens
ugagugaggcugcggcuuu

SEQ ID NO: 1215455 - RNA, 19 nt, Homo sapiens
ggacugaccaccucauugc

SEQ ID NO: 1215456 - RNA, 19 nt, Homo sapiens
gggaccacgugcuggcuuu

SEQ ID NO: 1215457 - RNA, 19 nt, Homo sapiens
gcaccaggcugagcuaagc

SEQ ID NO: 1215458 - RNA, 19 nt, Homo sapiens
gagugaggcugcggcuuug

SEQ ID NO: 1215459 - RNA, 19 nt, Homo sapiens
ucgaugaccgcaagaauga

SEQ ID NO: 1215460 - RNA, 19 nt, Homo sapiens
cuaccaaggccacuucuau

SEQ ID NO: 1215461 - RNA, 19 nt, Homo sapiens
guacgcacauagacauuuu

SEQ ID NO: 1215462 - RNA, 19 nt, Homo sapiens
guccagaccuaccuuguac

SEQ ID NO: 1215463 - RNA, 19 nt, Homo sapiens
ggaccucucccuggacuga

SEQ ID NO: 1215464 - RNA, 19 nt, Homo sapiens
cagcuacucugcaucaacu

SEQ ID NO: 1215465 - RNA, 19 nt, Homo sapiens
gcucuugaccaaugaaauc

SEQ ID NO: 1215466 - RNA, 19 nt, Homo sapiens
agcaagaagugauccagaa

SEQ ID NO: 1215467 - RNA, 19 nt, Homo sapiens
ccaacagccuugcaaacag

SEQ ID NO: 1215468 - RNA, 19 nt, Homo sapiens
gacauuccuucccuaccaa

SEQ ID NO: 1215469 - RNA, 19 nt, Homo sapiens
ggcuuaggcucccgcaaug

SEQ ID NO: 1215470 - RNA, 19 nt, Homo sapiens
ggcuggacaucccacauug

SEQ ID NO: 1215471 - RNA, 19 nt, Homo sapiens
gggcuggacaucccacauu

SEQ ID NO: 1215472 - RNA, 19 nt, Homo sapiens
ggacacguggugcaucaug

SEQ ID NO: 1215473 - RNA, 19 nt, Homo sapiens
ggucaucaacaaagucuuc

SEQ ID NO: 1215474 - RNA, 19 nt, Homo sapiens
caacucauggcccagagaa

SEQ ID NO: 1215475 - RNA, 19 nt, Homo sapiens
gaagcugccagugcucaaa

SEQ ID NO: 1215476 - RNA, 19 nt, Homo sapiens
aaauggaccaggccgagua

SEQ ID NO: 1215477 - RNA, 19 nt, Homo sapiens
gcaagaagugauccagaag

SEQ ID NO: 1215478 - RNA, 19 nt, Homo sapiens
gggcccagcuacugauugg

SEQ ID NO: 1215479 - RNA, 19 nt, Homo sapiens
acaaggacaccgucuacaa

SEQ ID NO: 1215480 - RNA, 19 nt, Homo sapiens
ggauggagccaaggugguu

SEQ ID NO: 1215481 - RNA, 19 nt, Homo sapiens
gggauccuguggucaucaa

SEQ ID NO: 1215482 - RNA, 19 nt, Homo sapiens
gaguguauacgcguuugua

SEQ ID NO: 1215483 - RNA, 19 nt, Homo sapiens
ccagagggaccagcaagaa

SEQ ID NO: 1215484 - RNA, 19 nt, Homo sapiens
gccaacagccuugcaaaca

SEQ ID NO: 1215485 - RNA, 19 nt, Homo sapiens
guaccuagaacuuaaacuc

SEQ ID NO: 1215486 - RNA, 19 nt, Homo sapiens
gccauacuguacucagaau

SEQ ID NO: 1215487 - RNA, 19 nt, Homo sapiens
gcauugugccgagaacuug

SEQ ID NO: 1215488 - RNA, 19 nt, Homo sapiens
gcgcagccaggauccguuu

SEQ ID NO: 1215489 - RNA, 19 nt, Homo sapiens
caaggcgcaguuucaguuu

SEQ ID NO: 1215490 - RNA, 19 nt, Homo sapiens
gacacguggugcaucaugu

SEQ ID NO: 1215491 - RNA, 19 nt, Homo sapiens
ccagcauggugaagaguuc

SEQ ID NO: 1215492 - RNA, 19 nt, Homo sapiens
gagccaguaccuagaacuu

SEQ ID NO: 1215493 - RNA, 19 nt, Homo sapiens
uaccaaggccacuucuauu

SEQ ID NO: 1215494 - RNA, 19 nt, Homo sapiens
gucaucagcugcaggaacu

SEQ ID NO: 1215495 - RNA, 19 nt, Homo sapiens
caccugaggcgcuacaaug

SEQ ID NO: 1215496 - RNA, 19 nt, Homo sapiens
gcaccuagagacuguggau

SEQ ID NO: 1215497 - RNA, 19 nt, Homo sapiens
ugaguugagccggaaauuu

SEQ ID NO: 1215498 - RNA, 19 nt, Homo sapiens
gcagaccuaccuacuagag

SEQ ID NO: 1215499 - RNA, 19 nt, Homo sapiens
gggccgaucagaguguaua

SEQ ID NO: 1215500 - RNA, 19 nt, Homo sapiens
caagaagugauccagaagu

SEQ ID NO: 1215501 - RNA, 19 nt, Homo sapiens
gcaguucaguagcucuaac

SEQ ID NO: 1215502 - RNA, 19 nt, Homo sapiens
gggacuugcugaagaagcu

SEQ ID NO: 1215503 - RNA, 19 nt, Homo sapiens
accaaggccacuucuauuu

SEQ ID NO: 1215504 - RNA, 19 nt, Homo sapiens
cauacuguacucagaauca

SEQ ID NO: 1215505 - RNA, 19 nt, Homo sapiens
caaggacaccgucuacaac

SEQ ID NO: 1215506 - RNA, 19 nt, Homo sapiens
guacucagaaucacgacau

SEQ ID NO: 1215507 - RNA, 19 nt, Homo sapiens
gaucuacaagucagugaag

SEQ ID NO: 1215508 - RNA, 19 nt, Homo sapiens
agccagagcacccacauga

SEQ ID NO: 1215509 - RNA, 19 nt, Homo sapiens
aaacuggagaugcuggaaa

SEQ ID NO: 1215510 - RNA, 19 nt, Homo sapiens
aaacugaggcaaaagaauu

SEQ ID NO: 1215511 - RNA, 19 nt, Homo sapiens
ccuccuuccugaaucauca

SEQ ID NO: 1215512 - RNA, 19 nt, Homo sapiens
caguuucaguuuccaucuu

SEQ ID NO: 1215513 - RNA, 19 nt, Homo sapiens
gaaugagcuggcccacuug

SEQ ID NO: 1215514 - RNA, 19 nt, Homo sapiens
ccuagagacuguggaugga

SEQ ID NO: 1215515 - RNA, 19 nt, Homo sapiens
caugagccaguaccuagaa

SEQ ID NO: 1215516 - RNA, 19 nt, Homo sapiens
uuagggaaacugaggcaaa

SEQ ID NO: 1215517 - RNA, 19 nt, Homo sapiens
gagggcacccaccauguca

SEQ ID NO: 1215518 - RNA, 19 nt, Homo sapiens
agcgggagcugaucaacga

SEQ ID NO: 1215519 - RNA, 19 nt, Homo sapiens
auccagaaguuccaagaug

SEQ ID NO: 1215520 - RNA, 19 nt, Homo sapiens
gacccagcauggugaagag

SEQ ID NO: 1215521 - RNA, 19 nt, Homo sapiens
caucaugagccaguaccua

SEQ ID NO: 1215522 - RNA, 19 nt, Homo sapiens
gaauuugccauacuguacu

SEQ ID NO: 1215523 - RNA, 19 nt, Homo sapiens
aaaagaauuugccauacug

SEQ ID NO: 1215524 - RNA, 19 nt, Homo sapiens
gaagcucauggaccaaauc

SEQ ID NO: 1215525 - RNA, 19 nt, Homo sapiens
aagaauuugccauacugua

SEQ ID NO: 1215526 - RNA, 19 nt, Homo sapiens
uaaauuggcuuucuucuuc

SEQ ID NO: 1215527 - RNA, 19 nt, Homo sapiens
gaaacguacucccaaacua

SEQ ID NO: 1215528 - RNA, 19 nt, Homo sapiens
gaaaucauccuacaagcaa

SEQ ID NO: 1215529 - RNA, 19 nt, Homo sapiens
gcauagaagucaguauuga

SEQ ID NO: 1215530 - RNA, 19 nt, Homo sapiens
gaggauauauagucauaga

SEQ ID NO: 1215531 - RNA, 19 nt, Homo sapiens
caggaaaugugaagaauuc

SEQ ID NO: 1215532 - RNA, 19 nt, Homo sapiens
uaaagaagcuaguguaucc

SEQ ID NO: 1215533 - RNA, 19 nt, Homo sapiens
caagcaaacuaaccuggaa

SEQ ID NO: 1215534 - RNA, 19 nt, Homo sapiens
ucuguuaucuucugugaaa

SEQ ID NO: 1215535 - RNA, 19 nt, Homo sapiens
ggagccagcuugaagaaag

SEQ ID NO: 1215536 - RNA, 19 nt, Homo sapiens
gaauucaccuggaacuaag

SEQ ID NO: 1215537 - RNA, 19 nt, Homo sapiens
uccaugcucugccaucuua

SEQ ID NO: 1215538 - RNA, 19 nt, Homo sapiens
gaagguugaugagcuuuca

SEQ ID NO: 1215539 - RNA, 19 nt, Homo sapiens
guagucaccucucuauagu

SEQ ID NO: 1215540 - RNA, 19 nt, Homo sapiens
aaacguacucccaaacuaa

SEQ ID NO: 1215541 - RNA, 19 nt, Homo sapiens
uugaugagcuuucacucua

SEQ ID NO: 1215542 - RNA, 19 nt, Homo sapiens
gaacuccucauucucaugu

SEQ ID NO: 1215543 - RNA, 19 nt, Homo sapiens
acgaggauauauagucaua

SEQ ID NO: 1215544 - RNA, 19 nt, Homo sapiens
aaacuaagcccaagaugca

SEQ ID NO: 1215545 - RNA, 19 nt, Homo sapiens
gaagucaguauugaaugua

SEQ ID NO: 1215546 - RNA, 19 nt, Homo sapiens
ucacagcuccgacacuauu

SEQ ID NO: 1215547 - RNA, 19 nt, Homo sapiens
caggaaacguacucccaaa

SEQ ID NO: 1215548 - RNA, 19 nt, Homo sapiens
gacuugguguuauugguuu

SEQ ID NO: 1215549 - RNA, 19 nt, Homo sapiens
ucucacagcuccgacacua

SEQ ID NO: 1215550 - RNA, 19 nt, Homo sapiens
gagggucaaucgaaguaug

SEQ ID NO: 1215551 - RNA, 19 nt, Homo sapiens
agaagucaguauugaaugu

SEQ ID NO: 1215552 - RNA, 19 nt, Homo sapiens
ggaaggagaacuuucaaaa

SEQ ID NO: 1215553 - RNA, 19 nt, Homo sapiens
uuacgaggauauauaguca

SEQ ID NO: 1215554 - RNA, 19 nt, Homo sapiens
uggaaucccuucaccuaga

SEQ ID NO: 1215555 - RNA, 19 nt, Homo sapiens
ggauauauagucauagaag

SEQ ID NO: 1215556 - RNA, 19 nt, Homo sapiens
gaaccgggugauugaacua

SEQ ID NO: 1215557 - RNA, 19 nt, Homo sapiens
uaucuucugugaaaucauc

SEQ ID NO: 1215558 - RNA, 19 nt, Homo sapiens
ggaaacuccauagaauaaa

SEQ ID NO: 1215559 - RNA, 19 nt, Homo sapiens
agaauucaccuggaacuaa

SEQ ID NO: 1215560 - RNA, 19 nt, Homo sapiens
uagaagauuuguggaagga

SEQ ID NO: 1215561 - RNA, 19 nt, Homo sapiens
uagcugccucccucuauua

SEQ ID NO: 1215562 - RNA, 19 nt, Homo sapiens
agcccaagaugcaaaguuu

SEQ ID NO: 1215563 - RNA, 19 nt, Homo sapiens
ggaaucccuucaccuagag

SEQ ID NO: 1215564 - RNA, 19 nt, Homo sapiens
ggguuuacgaggauauaua

SEQ ID NO: 1215565 - RNA, 19 nt, Homo sapiens
cauccuacaagcaaacuaa

SEQ ID NO: 1215566 - RNA, 19 nt, Homo sapiens
gccaggaaaugugaagaau

SEQ ID NO: 1215567 - RNA, 19 nt, Homo sapiens
uaauguacaagccuuagaa

SEQ ID NO: 1215568 - RNA, 19 nt, Homo sapiens
ccucuguuaucuucuguga

SEQ ID NO: 1215569 - RNA, 19 nt, Homo sapiens
ggaaacguacucccaaacu

SEQ ID NO: 1215570 - RNA, 19 nt, Homo sapiens
cauagaagucaguauugaa

SEQ ID NO: 1215571 - RNA, 19 nt, Homo sapiens
uggcauagaagucaguauu

SEQ ID NO: 1215572 - RNA, 19 nt, Homo sapiens
ccagcgacauguucaaggu

SEQ ID NO: 1215573 - RNA, 19 nt, Homo sapiens
gaagaauucaccuggaacu

SEQ ID NO: 1215574 - RNA, 19 nt, Homo sapiens
ccaggaaaugugaagaauu

SEQ ID NO: 1215575 - RNA, 19 nt, Homo sapiens
gagacuugguguuauuggu

SEQ ID NO: 1215576 - RNA, 19 nt, Homo sapiens
ccuggaaucccuucaccua

SEQ ID NO: 1215577 - RNA, 19 nt, Homo sapiens
cguagucaccucucuauag

SEQ ID NO: 1215578 - RNA, 19 nt, Homo sapiens
agacagcuaugacuaucuc

SEQ ID NO: 1215579 - RNA, 19 nt, Homo sapiens
gguuagacagcuaugacua

SEQ ID NO: 1215580 - RNA, 19 nt, Homo sapiens
ucuagaaccgggugauuga

SEQ ID NO: 1215581 - RNA, 19 nt, Homo sapiens
ggcauagaagucaguauug

SEQ ID NO: 1215582 - RNA, 19 nt, Homo sapiens
ccucuauuauccacaacaa

SEQ ID NO: 1215583 - RNA, 19 nt, Homo sapiens
guuagacagcuaugacuau

SEQ ID NO: 1215584 - RNA, 19 nt, Homo sapiens
guuaucuucugugaaauca

SEQ ID NO: 1215585 - RNA, 19 nt, Homo sapiens
ucauagaagauuuguggaa

SEQ ID NO: 1215586 - RNA, 19 nt, Homo sapiens
cgugaagguugaugagcuu

SEQ ID NO: 1215587 - RNA, 19 nt, Homo sapiens
ucugccaucuuaaucaguu

SEQ ID NO: 1215588 - RNA, 19 nt, Homo sapiens
cgacauguucaagguaauu

SEQ ID NO: 1215589 - RNA, 19 nt, Homo sapiens
uuagcugccucccucuauu

SEQ ID NO: 1215590 - RNA, 19 nt, Homo sapiens
guauccgccugguuucaug

SEQ ID NO: 1215591 - RNA, 19 nt, Homo sapiens
uaguguauccgccugguuu

SEQ ID NO: 1215592 - RNA, 19 nt, Homo sapiens
uccgagacuugguguuauu

SEQ ID NO: 1215593 - RNA, 19 nt, Homo sapiens
gcucugccaucuuaaucag

SEQ ID NO: 1215594 - RNA, 19 nt, Homo sapiens
gaugagcuuucacucuacu

SEQ ID NO: 1215595 - RNA, 19 nt, Homo sapiens
aaaauuccgugaagguuga

SEQ ID NO: 1215596 - RNA, 19 nt, Homo sapiens
ugaaaucauccuacaagca

SEQ ID NO: 1215597 - RNA, 19 nt, Homo sapiens
caccuggaacuaaguagaa

SEQ ID NO: 1215598 - RNA, 19 nt, Homo sapiens
aaaggacucaccucccaaa

SEQ ID NO: 1215599 - RNA, 19 nt, Homo sapiens
agcgacauguucaagguaa

SEQ ID NO: 1215600 - RNA, 19 nt, Homo sapiens
caaaagccaggaaauguga

SEQ ID NO: 1215601 - RNA, 19 nt, Homo sapiens
gguuuacgaggauauauag

SEQ ID NO: 1215602 - RNA, 19 nt, Homo sapiens
ggggagagauuauaugacu

SEQ ID NO: 1215603 - RNA, 19 nt, Homo sapiens
gauuagcugccucccucua

SEQ ID NO: 1215604 - RNA, 19 nt, Homo sapiens
uuagacagcuaugacuauc

SEQ ID NO: 1215605 - RNA, 19 nt, Homo sapiens
gacacuauugcgagccaua

SEQ ID NO: 1215606 - RNA, 19 nt, Homo sapiens
aaauuggcuuucuucuuca

SEQ ID NO: 1215607 - RNA, 19 nt, Homo sapiens
cagcgacgcggcuucuaga

SEQ ID NO: 1215608 - RNA, 19 nt, Homo sapiens
ucugugaaaucauccuaca

SEQ ID NO: 1215609 - RNA, 19 nt, Homo sapiens
ggccuuauuggacuccuuu

SEQ ID NO: 1215610 - RNA, 19 nt, Homo sapiens
accuagagauaauguacaa

SEQ ID NO: 1215611 - RNA, 19 nt, Homo sapiens
aguuauagguaaacauugg

SEQ ID NO: 1215612 - RNA, 19 nt, Homo sapiens
ggaacuaaguagaaaacuc

SEQ ID NO: 1215613 - RNA, 19 nt, Homo sapiens
uuuccgagacuugguguua

SEQ ID NO: 1215614 - RNA, 19 nt, Homo sapiens
gcgacauguucaagguaau

SEQ ID NO: 1215615 - RNA, 19 nt, Homo sapiens
ccgcaccgaguuugcagua

SEQ ID NO: 1215616 - RNA, 19 nt, Homo sapiens
gauaauguacaagccuuag

SEQ ID NO: 1215617 - RNA, 19 nt, Homo sapiens
aaaucauccuacaagcaaa

SEQ ID NO: 1215618 - RNA, 19 nt, Homo sapiens
agaccucuguuaucuucug

SEQ ID NO: 1215619 - RNA, 19 nt, Homo sapiens
uugcucaccuucaaagucu

SEQ ID NO: 1215620 - RNA, 19 nt, Homo sapiens
agacuugguguuauugguu

SEQ ID NO: 1215621 - RNA, 19 nt, Homo sapiens
uguacaagccuuagaacuc

SEQ ID NO: 1215622 - RNA, 19 nt, Homo sapiens
cagcgacauguucaaggua

SEQ ID NO: 1215623 - RNA, 19 nt, Homo sapiens
gcuugcgguuggagaaauc

SEQ ID NO: 1215624 - RNA, 19 nt, Homo sapiens
cagcuaugacuaucuccaa

SEQ ID NO: 1215625 - RNA, 19 nt, Homo sapiens
ggugauugaacuaaaccuu

SEQ ID NO: 1215626 - RNA, 19 nt, Homo sapiens
ccuacuggcugcacuccua

SEQ ID NO: 1215627 - RNA, 19 nt, Homo sapiens
gcacugggucucaccaugu

SEQ ID NO: 1215628 - RNA, 19 nt, Homo sapiens
gcuuguggcaucaguauug

SEQ ID NO: 1215629 - RNA, 19 nt, Homo sapiens
ggaaggcuccgcugcuaca

SEQ ID NO: 1215630 - RNA, 19 nt, Homo sapiens
gaagcuuguggcaucagua

SEQ ID NO: 1215631 - RNA, 19 nt, Homo sapiens
gcaucaguauuggcacuuc

SEQ ID NO: 1215632 - RNA, 19 nt, Homo sapiens
caucaguauuggcacuuca

SEQ ID NO: 1215633 - RNA, 19 nt, Homo sapiens
guauuggcacuucaggaaa

SEQ ID NO: 1215634 - RNA, 19 nt, Homo sapiens
caucuguggcuucaccaaa

SEQ ID NO: 1215635 - RNA, 19 nt, Homo sapiens
gggcaccuccagcaucuuc

SEQ ID NO: 1215636 - RNA, 19 nt, Homo sapiens
aguauuggcacuucaggaa

SEQ ID NO: 1215637 - RNA, 19 nt, Homo sapiens
gagcagggaucccgcagua

SEQ ID NO: 1215638 - RNA, 19 nt, Homo sapiens
cgacauccauucucuggua

SEQ ID NO: 1215639 - RNA, 19 nt, Homo sapiens
acucagagcugucagauga

SEQ ID NO: 1215640 - RNA, 19 nt, Homo sapiens
gccaguaguuacacucuua

SEQ ID NO: 1215641 - RNA, 19 nt, Homo sapiens
gaacagggcuagggaaguc

SEQ ID NO: 1215642 - RNA, 19 nt, Homo sapiens
ugaggaggcuucuaucuug

SEQ ID NO: 1215643 - RNA, 19 nt, Homo sapiens
ccacuugguuguuuaguug

SEQ ID NO: 1215644 - RNA, 19 nt, Homo sapiens
uacauugucuuguugagua

SEQ ID NO: 1215645 - RNA, 19 nt, Homo sapiens
guuccuuucugcuuuauuu

SEQ ID NO: 1215646 - RNA, 19 nt, Homo sapiens
ccucaucucuauucucauu

SEQ ID NO: 1215647 - RNA, 19 nt, Homo sapiens
ggucugagccuaggcauga

SEQ ID NO: 1215648 - RNA, 19 nt, Homo sapiens
aagaggauguggcagcuaa

SEQ ID NO: 1215649 - RNA, 19 nt, Homo sapiens
gcagagacagagagugaaa

SEQ ID NO: 1215650 - RNA, 19 nt, Homo sapiens
cuacucagcgucucacuuu

SEQ ID NO: 1215651 - RNA, 19 nt, Homo sapiens
gugcagguguugacuugaa

SEQ ID NO: 1215652 - RNA, 19 nt, Homo sapiens
aagaggcacucaccacuga

SEQ ID NO: 1215653 - RNA, 19 nt, Homo sapiens
caacuccgcagcugacuga

SEQ ID NO: 1215654 - RNA, 19 nt, Homo sapiens
ggauuaugauuuccuacau

SEQ ID NO: 1215655 - RNA, 19 nt, Homo sapiens
ucaacggccucuucugguu

SEQ ID NO: 1215656 - RNA, 19 nt, Homo sapiens
ccacugaggacuuugaguu

SEQ ID NO: 1215657 - RNA, 19 nt, Homo sapiens
guugaggcacuuuauaauu

SEQ ID NO: 1215658 - RNA, 19 nt, Homo sapiens
gugcugcucugcccucaug

SEQ ID NO: 1215659 - RNA, 19 nt, Homo sapiens
ucugggaaguaaagaguaa

SEQ ID NO: 1215660 - RNA, 19 nt, Homo sapiens
ugagugaggccaccaguga

SEQ ID NO: 1215661 - RNA, 19 nt, Homo sapiens
ggauguggcagcuaaggaa

SEQ ID NO: 1215662 - RNA, 19 nt, Homo sapiens
ggaggaagaggaagaggau

SEQ ID NO: 1215663 - RNA, 19 nt, Homo sapiens
gcagggaucccgcaguaca

SEQ ID NO: 1215664 - RNA, 19 nt, Homo sapiens
uuaggucacuguagucugu

SEQ ID NO: 1215665 - RNA, 19 nt, Homo sapiens
cuacuaggguuaggaagug

SEQ ID NO: 1215666 - RNA, 19 nt, Homo sapiens
gggcacuggccaagcuuua

SEQ ID NO: 1215667 - RNA, 19 nt, Homo sapiens
uaguugaggcacuuuauaa

SEQ ID NO: 1215668 - RNA, 19 nt, Homo sapiens
ccuccacucugccuuguug

SEQ ID NO: 1215669 - RNA, 19 nt, Homo sapiens
cagaugaggaggcuucuau

SEQ ID NO: 1215670 - RNA, 19 nt, Homo sapiens
gcagaauccagcucaguuc

SEQ ID NO: 1215671 - RNA, 19 nt, Homo sapiens
uggcucaccuuccagauuc

SEQ ID NO: 1215672 - RNA, 19 nt, Homo sapiens
gcugucggaugguagcuau

SEQ ID NO: 1215673 - RNA, 19 nt, Homo sapiens
ggacucggaggaagaggaa

SEQ ID NO: 1215674 - RNA, 19 nt, Homo sapiens
uguguuccuuucugcuuua

SEQ ID NO: 1215675 - RNA, 19 nt, Homo sapiens
gaaccagaggagacccuaa

SEQ ID NO: 1215676 - RNA, 19 nt, Homo sapiens
gccaugagccagccguuga

SEQ ID NO: 1215677 - RNA, 19 nt, Homo sapiens
cagggauuaugauuuccua

SEQ ID NO: 1215678 - RNA, 19 nt, Homo sapiens
ccucaugucccacuugguu

SEQ ID NO: 1215679 - RNA, 19 nt, Homo sapiens
guaccugugccuaggauug

SEQ ID NO: 1215680 - RNA, 19 nt, Homo sapiens
gcuaggaguguugcuguuu

SEQ ID NO: 1215681 - RNA, 19 nt, Homo sapiens
ugccucaucucuauucuca

SEQ ID NO: 1215682 - RNA, 19 nt, Homo sapiens
uggcagagacagagaguga

SEQ ID NO: 1215683 - RNA, 19 nt, Homo sapiens
acacuauguuccagggauu

SEQ ID NO: 1215684 - RNA, 19 nt, Homo sapiens
gguacagucagaccaagaa

SEQ ID NO: 1215685 - RNA, 19 nt, Homo sapiens
ggucaggccaguaguuaca

SEQ ID NO: 1215686 - RNA, 19 nt, Homo sapiens
ugucccacuugguuguuua

SEQ ID NO: 1215687 - RNA, 19 nt, Homo sapiens
uuccagggauuaugauuuc

SEQ ID NO: 1215688 - RNA, 19 nt, Homo sapiens
guuccagggauuaugauuu

SEQ ID NO: 1215689 - RNA, 19 nt, Homo sapiens
ggcagaauccagcucaguu

SEQ ID NO: 1215690 - RNA, 19 nt, Homo sapiens
agugguggcuucuccguau

SEQ ID NO: 1215691 - RNA, 19 nt, Homo sapiens
ucaugcagcuggacuacag

SEQ ID NO: 1215692 - RNA, 19 nt, Homo sapiens
uguguaaccuucacugcau

SEQ ID NO: 1215693 - RNA, 19 nt, Homo sapiens
acucuuaggucacuguagu

SEQ ID NO: 1215694 - RNA, 19 nt, Homo sapiens
cuaggaguguugcuguuuc

SEQ ID NO: 1215695 - RNA, 19 nt, Homo sapiens
gaagaggauguggcagcua

SEQ ID NO: 1215696 - RNA, 19 nt, Homo sapiens
cuacuaggccguccucaag

SEQ ID NO: 1215697 - RNA, 19 nt, Homo sapiens
uuaguugaggcacuuuaua

SEQ ID NO: 1215698 - RNA, 19 nt, Homo sapiens
ggaagaggaagaggaugug

SEQ ID NO: 1215699 - RNA, 19 nt, Homo sapiens
cuccgcagcugacugaugu

SEQ ID NO: 1215700 - RNA, 19 nt, Homo sapiens
gaugaggaggcuucuaucu

SEQ ID NO: 1215701 - RNA, 19 nt, Homo sapiens
caugaaggcagaagccaau

SEQ ID NO: 1215702 - RNA, 19 nt, Homo sapiens
uuuccuacauugucuuguu

SEQ ID NO: 1215703 - RNA, 19 nt, Homo sapiens
ugagccagccguugaggaa

SEQ ID NO: 1215704 - RNA, 19 nt, Homo sapiens
gauguggcagcuaaggaaa

SEQ ID NO: 1215705 - RNA, 19 nt, Homo sapiens
acaaacacgacaagaggaa

SEQ ID NO: 1215706 - RNA, 19 nt, Homo sapiens
ucuauucucauuccacuau

SEQ ID NO: 1215707 - RNA, 19 nt, Homo sapiens
augcagagcugggcuugga

SEQ ID NO: 1215708 - RNA, 19 nt, Homo sapiens
gggauuaugauuuccuaca

SEQ ID NO: 1215709 - RNA, 19 nt, Homo sapiens
ggccaguaguuacacucuu

SEQ ID NO: 1215710 - RNA, 19 nt, Homo sapiens
cuccuggucugggaaguaa

SEQ ID NO: 1215711 - RNA, 19 nt, Homo sapiens
ggcccgacauccauucucu

SEQ ID NO: 1215712 - RNA, 19 nt, Homo sapiens
ucugggugauccaagugua

SEQ ID NO: 1215713 - RNA, 19 nt, Homo sapiens
ggaaguaaagaguaaaccu

SEQ ID NO: 1215714 - RNA, 19 nt, Homo sapiens
ggucugggaaguaaagagu

SEQ ID NO: 1215715 - RNA, 19 nt, Homo sapiens
cccacuugguuguuuaguu

SEQ ID NO: 1215716 - RNA, 19 nt, Homo sapiens
uauguuccagggauuauga

SEQ ID NO: 1215717 - RNA, 19 nt, Homo sapiens
ggcuaggaguguugcuguu

SEQ ID NO: 1215718 - RNA, 19 nt, Homo sapiens
caagauggagugaaaugcu

SEQ ID NO: 1215719 - RNA, 19 nt, Homo sapiens
cugugcagguguugacuug

SEQ ID NO: 1215720 - RNA, 19 nt, Homo sapiens
gcagugggucaggccagua

SEQ ID NO: 1215721 - RNA, 19 nt, Homo sapiens
gcaguaccugugccuagga

SEQ ID NO: 1215722 - RNA, 19 nt, Homo sapiens
agugguggaugugaagaaa

SEQ ID NO: 1215723 - RNA, 19 nt, Homo sapiens
ugcccgaguugugcagaua

SEQ ID NO: 1215724 - RNA, 19 nt, Homo sapiens
gcuccuggucugggaagua

SEQ ID NO: 1215725 - RNA, 19 nt, Homo sapiens
gcacuggccaagcuuuagg

SEQ ID NO: 1215726 - RNA, 19 nt, Homo sapiens
gugcuguguuggcuguguu

SEQ ID NO: 1215727 - RNA, 19 nt, Homo sapiens
ugggucaggccaguaguua

SEQ ID NO: 1215728 - RNA, 19 nt, Homo sapiens
ugucuuguguuccuuucug

SEQ ID NO: 1215729 - RNA, 19 nt, Homo sapiens
gcaaacaacuuaucaguag

SEQ ID NO: 1215730 - RNA, 19 nt, Homo sapiens
gcaauuggcgccuauuaug

SEQ ID NO: 1215731 - RNA, 19 nt, Homo sapiens
ggagguggguggacuuuua

SEQ ID NO: 1215732 - RNA, 19 nt, Homo sapiens
cuacaggacucuacuaugg

SEQ ID NO: 1215733 - RNA, 19 nt, Homo sapiens
gaaccuacaagcagcaauu

SEQ ID NO: 1215734 - RNA, 19 nt, Homo sapiens
cagcagagcaggaauguau

SEQ ID NO: 1215735 - RNA, 19 nt, Homo sapiens
ggguuugucuuaaauaugu

SEQ ID NO: 1215736 - RNA, 19 nt, Homo sapiens
acacacagccgcaucguaa

SEQ ID NO: 1215737 - RNA, 19 nt, Homo sapiens
aaacggaguucaacacaca

SEQ ID NO: 1215738 - RNA, 19 nt, Homo sapiens
gaaccgacaaucagaugaa

SEQ ID NO: 1215739 - RNA, 19 nt, Homo sapiens
aaacauggcggauccagaa

SEQ ID NO: 1215740 - RNA, 19 nt, Homo sapiens
cccaagagauugcagaugu

SEQ ID NO: 1215741 - RNA, 19 nt, Homo sapiens
uuaaacgggugucagcaaa

SEQ ID NO: 1215742 - RNA, 19 nt, Homo sapiens
uguugaagaugucaccaua

SEQ ID NO: 1215743 - RNA, 19 nt, Homo sapiens
aaacugagcaagaccagaa

SEQ ID NO: 1215744 - RNA, 19 nt, Homo sapiens
cagcaauuggcgccuauua

SEQ ID NO: 1215745 - RNA, 19 nt, Homo sapiens
caacuuaucaguagugacu

SEQ ID NO: 1215746 - RNA, 19 nt, Homo sapiens
caauuggcgccuauuauga

SEQ ID NO: 1215747 - RNA, 19 nt, Homo sapiens
gaugucagcguccagaugu

SEQ ID NO: 1215748 - RNA, 19 nt, Homo sapiens
acccggagcugaugcagaa

SEQ ID NO: 1215749 - RNA, 19 nt, Homo sapiens
cauggcggauccagaauuc

SEQ ID NO: 1215750 - RNA, 19 nt, Homo sapiens
uggcggaugugcacugcua

SEQ ID NO: 1215751 - RNA, 19 nt, Homo sapiens
gcagagcaggaauguauca

SEQ ID NO: 1215752 - RNA, 19 nt, Homo sapiens
acuuaucaguagugacuua

SEQ ID NO: 1215753 - RNA, 19 nt, Homo sapiens
caaacaacuuaucaguagu

SEQ ID NO: 1215754 - RNA, 19 nt, Homo sapiens
gaacauggugauggugaga

SEQ ID NO: 1215755 - RNA, 19 nt, Homo sapiens
uggcgccuauuaugacuuu

SEQ ID NO: 1215756 - RNA, 19 nt, Homo sapiens
caacuggaaccuacaagca

SEQ ID NO: 1215757 - RNA, 19 nt, Homo sapiens
ggacucuacuauggagaug

SEQ ID NO: 1215758 - RNA, 19 nt, Homo sapiens
caauaccuccggauacuca

SEQ ID NO: 1215759 - RNA, 19 nt, Homo sapiens
gagucaauaccuccggaua

SEQ ID NO: 1215760 - RNA, 19 nt, Homo sapiens
gagcugaugcagaaguuca

SEQ ID NO: 1215761 - RNA, 19 nt, Homo sapiens
cgcaaacaacuuaucagua

SEQ ID NO: 1215762 - RNA, 19 nt, Homo sapiens
gagcaagaccagaauagac

SEQ ID NO: 1215763 - RNA, 19 nt, Homo sapiens
gcagucacgcaaacaacuu

SEQ ID NO: 1215764 - RNA, 19 nt, Homo sapiens
ccaagagauugcagauguc

SEQ ID NO: 1215765 - RNA, 19 nt, Homo sapiens
aaacaacuuaucaguagug

SEQ ID NO: 1215766 - RNA, 19 nt, Homo sapiens
ucacgcaaacaacuuauca

SEQ ID NO: 1215767 - RNA, 19 nt, Homo sapiens
ucaguagugacuuacagua

SEQ ID NO: 1215768 - RNA, 19 nt, Homo sapiens
ugaccaaacugagcaagac

SEQ ID NO: 1215769 - RNA, 19 nt, Homo sapiens
acaaggacgugcucaucuc

SEQ ID NO: 1215770 - RNA, 19 nt, Homo sapiens
cggagcugaugcagaaguu

SEQ ID NO: 1215771 - RNA, 19 nt, Homo sapiens
gacaaggacgugcucaucu

SEQ ID NO: 1215772 - RNA, 19 nt, Homo sapiens
cagucacgcaaacaacuua

SEQ ID NO: 1215773 - RNA, 19 nt, Homo sapiens
cgacaaggacgugcucauc

SEQ ID NO: 1215774 - RNA, 19 nt, Homo sapiens
cggauacucaguuuguaaa

SEQ ID NO: 1215775 - RNA, 19 nt, Homo sapiens
ccggauacucaguuuguaa

SEQ ID NO: 1215776 - RNA, 19 nt, Homo sapiens
gucaauaccuccggauacu

SEQ ID NO: 1215777 - RNA, 19 nt, Homo sapiens
gcuacaggacucuacuaug

SEQ ID NO: 1215778 - RNA, 19 nt, Homo sapiens
cagggacaguggcggaugu

SEQ ID NO: 1215779 - RNA, 19 nt, Homo sapiens
caagagauugcagauguca

SEQ ID NO: 1215780 - RNA, 19 nt, Homo sapiens
gcgccuauuaugacuuuga

SEQ ID NO: 1215781 - RNA, 19 nt, Homo sapiens
agaccagaauagacuguca

SEQ ID NO: 1215782 - RNA, 19 nt, Homo sapiens
cuauguccuuuguugaaga

SEQ ID NO: 1215783 - RNA, 19 nt, Homo sapiens
uaucaguagugacuuacag

SEQ ID NO: 1215784 - RNA, 19 nt, Homo sapiens
uugaagaugucaccauagg

SEQ ID NO: 1215785 - RNA, 19 nt, Homo sapiens
caaaagaaccgacaaucag

SEQ ID NO: 1215786 - RNA, 19 nt, Homo sapiens
ccaaaagaaccgacaauca

SEQ ID NO: 1215787 - RNA, 19 nt, Homo sapiens
acagccgcaucguaaggua

SEQ ID NO: 1215788 - RNA, 19 nt, Homo sapiens
aaccgacaaucagaugaaa

SEQ ID NO: 1215789 - RNA, 19 nt, Homo sapiens
gcacugcuacaggacucua

SEQ ID NO: 1215790 - RNA, 19 nt, Homo sapiens
gaccaacuggaaccuacaa

SEQ ID NO: 1215791 - RNA, 19 nt, Homo sapiens
ugagcaagaccagaauaga

SEQ ID NO: 1215792 - RNA, 19 nt, Homo sapiens
ggaacuggauuucuuuauu

SEQ ID NO: 1215793 - RNA, 19 nt, Homo sapiens
gaacagagacaugauugua

SEQ ID NO: 1215794 - RNA, 19 nt, Homo sapiens
gauaugcaguugcugauga

SEQ ID NO: 1215795 - RNA, 19 nt, Homo sapiens
ggccagggcuuucgacuug

SEQ ID NO: 1215796 - RNA, 19 nt, Homo sapiens
gccaaucacugccaccuuu

SEQ ID NO: 1215797 - RNA, 19 nt, Homo sapiens
gaucaugucaguacuuuau

SEQ ID NO: 1215798 - RNA, 19 nt, Homo sapiens
gguaaucaaugagcuuauu

SEQ ID NO: 1215799 - RNA, 19 nt, Homo sapiens
cuuuaucgcuuucagauuu

SEQ ID NO: 1215800 - RNA, 19 nt, Homo sapiens
gaggccagcagacuauuua

SEQ ID NO: 1215801 - RNA, 19 nt, Homo sapiens
gaggcucgguaaucaauga

SEQ ID NO: 1215802 - RNA, 19 nt, Homo sapiens
ggaggaguaucaggauuug

SEQ ID NO: 1215803 - RNA, 19 nt, Homo sapiens
gggcccagcugaacagaga

SEQ ID NO: 1215804 - RNA, 19 nt, Homo sapiens
gauuuaaggccugcuauuu

SEQ ID NO: 1215805 - RNA, 19 nt, Homo sapiens
gaggaggaguaucaggauu

SEQ ID NO: 1215806 - RNA, 19 nt, Homo sapiens
gaagaacaaauaccaacug

SEQ ID NO: 1215807 - RNA, 19 nt, Homo sapiens
uauaaguguuccacaaguu

SEQ ID NO: 1215808 - RNA, 19 nt, Homo sapiens
gaauguagucuuucaguac

SEQ ID NO: 1215809 - RNA, 19 nt, Homo sapiens
ggacuugggaggaagaaau

SEQ ID NO: 1215810 - RNA, 19 nt, Homo sapiens
caucgugauuacuggcuua

SEQ ID NO: 1215811 - RNA, 19 nt, Homo sapiens
cacacugaauguagucuuu

SEQ ID NO: 1215812 - RNA, 19 nt, Homo sapiens
acagagacaugauuguauc

SEQ ID NO: 1215813 - RNA, 19 nt, Homo sapiens
ggauuugcaucgugauuac

SEQ ID NO: 1215814 - RNA, 19 nt, Homo sapiens
uuacugcugugaagaacaa

SEQ ID NO: 1215815 - RNA, 19 nt, Homo sapiens
gcgagcugcugaucagaau

SEQ ID NO: 1215816 - RNA, 19 nt, Homo sapiens
gaaaucugguuggacaucu

SEQ ID NO: 1215817 - RNA, 19 nt, Homo sapiens
ccagcagacuauuuauuca

SEQ ID NO: 1215818 - RNA, 19 nt, Homo sapiens
gccagcagacuauuuauuc

SEQ ID NO: 1215819 - RNA, 19 nt, Homo sapiens
aauaccaacugugcaaauu

SEQ ID NO: 1215820 - RNA, 19 nt, Homo sapiens
ggaccugacccacacugaa

SEQ ID NO: 1215821 - RNA, 19 nt, Homo sapiens
acaacugcguucuggcuaa

SEQ ID NO: 1215822 - RNA, 19 nt, Homo sapiens
uauucaugcuccucuuuaa

SEQ ID NO: 1215823 - RNA, 19 nt, Homo sapiens
gacaaaguuucuuaaaucc

SEQ ID NO: 1215824 - RNA, 19 nt, Homo sapiens
gaggcgagcugcugaucag

SEQ ID NO: 1215825 - RNA, 19 nt, Homo sapiens
ggaggccagcagacuauuu

SEQ ID NO: 1215826 - RNA, 19 nt, Homo sapiens
aagaacaaauaccaacugu

SEQ ID NO: 1215827 - RNA, 19 nt, Homo sapiens
ucagauacccaauggacuu

SEQ ID NO: 1215828 - RNA, 19 nt, Homo sapiens
auuuaaggccugcuauuua

SEQ ID NO: 1215829 - RNA, 19 nt, Homo sapiens
gcugaugauuccucugauc

SEQ ID NO: 1215830 - RNA, 19 nt, Homo sapiens
gaccugacccacacugaau

SEQ ID NO: 1215831 - RNA, 19 nt, Homo sapiens
gguuggacaucuuuauuuu

SEQ ID NO: 1215832 - RNA, 19 nt, Homo sapiens
gacccacacugaauguagu

SEQ ID NO: 1215833 - RNA, 19 nt, Homo sapiens
uaggagaggaggaguauca

SEQ ID NO: 1215834 - RNA, 19 nt, Homo sapiens
acaaauaccaacugugcaa

SEQ ID NO: 1215835 - RNA, 19 nt, Homo sapiens
uuuaaggccugcuauuuac

SEQ ID NO: 1215836 - RNA, 19 nt, Homo sapiens
gcugaacagagacaugauu

SEQ ID NO: 1215837 - RNA, 19 nt, Homo sapiens
cagcugaacagagacauga

SEQ ID NO: 1215838 - RNA, 19 nt, Homo sapiens
ucaugucaguacuuuaugu

SEQ ID NO: 1215839 - RNA, 19 nt, Homo sapiens
caauggauaugcaguugcu

SEQ ID NO: 1215840 - RNA, 19 nt, Homo sapiens
caggaacuggauuucuuua

SEQ ID NO: 1215841 - RNA, 19 nt, Homo sapiens
ggaaaucugguuggacauc

SEQ ID NO: 1215842 - RNA, 19 nt, Homo sapiens
gcuuagcaauggauaugca

SEQ ID NO: 1215843 - RNA, 19 nt, Homo sapiens
ggccagcagacuauuuauu

SEQ ID NO: 1215844 - RNA, 19 nt, Homo sapiens
gacuugggaggaagaaauu

SEQ ID NO: 1215845 - RNA, 19 nt, Homo sapiens
caaauaccaacugugcaaa

SEQ ID NO: 1215846 - RNA, 19 nt, Homo sapiens
cgugauuacuggcuuagca

SEQ ID NO: 1215847 - RNA, 19 nt, Homo sapiens
ggcaaacucggccucauca

SEQ ID NO: 1215848 - RNA, 19 nt, Homo sapiens
ccagggcuuucgacuugga

SEQ ID NO: 1215849 - RNA, 19 nt, Homo sapiens
gagcugcugaucagaaugg

SEQ ID NO: 1215850 - RNA, 19 nt, Homo sapiens
gcuuccaccuagacaccua

SEQ ID NO: 1215851 - RNA, 19 nt, Homo sapiens
uggauuugcaucgugauua

SEQ ID NO: 1215852 - RNA, 19 nt, Homo sapiens
gcuccucuuuaacuggauu

SEQ ID NO: 1215853 - RNA, 19 nt, Homo sapiens
uuauucaugcuccucuuua

SEQ ID NO: 1215854 - RNA, 19 nt, Homo sapiens
auaaguguuccacaaguuu

SEQ ID NO: 1215855 - RNA, 19 nt, Homo sapiens
cugcugugaagaacaaaua

SEQ ID NO: 1215856 - RNA, 19 nt, Homo sapiens
caucggaggcucgguaauc

SEQ ID NO: 1215857 - RNA, 19 nt, Homo sapiens
ucacugccaccuuuuauuu

SEQ ID NO: 1215858 - RNA, 19 nt, Homo sapiens
ugguuggacaucuuuauuu

SEQ ID NO: 1215859 - RNA, 19 nt, Homo sapiens
agcagacuauuuauucaug

SEQ ID NO: 1215860 - RNA, 19 nt, Homo sapiens
gaaacaggagcuuuugaug

SEQ ID NO: 1215861 - RNA, 19 nt, Homo sapiens
caacugcguucuggcuaac

SEQ ID NO: 1215862 - RNA, 19 nt, Homo sapiens
aggaggaguaucaggauuu

SEQ ID NO: 1215863 - RNA, 19 nt, Homo sapiens
cgauuuaaggccugcuauu

SEQ ID NO: 1215864 - RNA, 19 nt, Homo sapiens
ugguuuggaacacgauuua

SEQ ID NO: 1215865 - RNA, 19 nt, Homo sapiens
uagcaauggauaugcaguu

SEQ ID NO: 1215866 - RNA, 19 nt, Homo sapiens
gauuacuggcuuagcaaug

SEQ ID NO: 1215867 - RNA, 19 nt, Homo sapiens
auauaaguguuccacaagu

SEQ ID NO: 1215868 - RNA, 19 nt, Homo sapiens
aaaucugguuggacaucuu

SEQ ID NO: 1215869 - RNA, 19 nt, Homo sapiens
ucuauccacaccucaguuu

SEQ ID NO: 1215870 - RNA, 19 nt, Homo sapiens
ggauaugcaguugcugaug

SEQ ID NO: 1215871 - RNA, 19 nt, Homo sapiens
gaacuaaaccugugcaaga

SEQ ID NO: 1215872 - RNA, 19 nt, Homo sapiens
ggaggacgaugaagaggaa

SEQ ID NO: 1215873 - RNA, 19 nt, Homo sapiens
ugacaucaaucauagcaaa

SEQ ID NO: 1215874 - RNA, 19 nt, Homo sapiens
ggaauuaaaccagaaagaa

SEQ ID NO: 1215875 - RNA, 19 nt, Homo sapiens
gaauggaauuaaaccagaa

SEQ ID NO: 1215876 - RNA, 19 nt, Homo sapiens
cgaggugacugaugucuau

SEQ ID NO: 1215877 - RNA, 19 nt, Homo sapiens
gaagaccucaguaauucua

SEQ ID NO: 1215878 - RNA, 19 nt, Homo sapiens
ccaaggaacccgucuaugu

SEQ ID NO: 1215879 - RNA, 19 nt, Homo sapiens
ugaaccugcucaaugauuu

SEQ ID NO: 1215880 - RNA, 19 nt, Homo sapiens
uggaagaccucaguaauuc

SEQ ID NO: 1215881 - RNA, 19 nt, Homo sapiens
ugacugaugucuaugagau

SEQ ID NO: 1215882 - RNA, 19 nt, Homo sapiens
uagcugacaucaaucauag

SEQ ID NO: 1215883 - RNA, 19 nt, Homo sapiens
gacaauggcugaccguaac

SEQ ID NO: 1215884 - RNA, 19 nt, Homo sapiens
ugaccgaggugacugaugu

SEQ ID NO: 1215885 - RNA, 19 nt, Homo sapiens
aaacccagguacaggaauu

SEQ ID NO: 1215886 - RNA, 19 nt, Homo sapiens
gcucaaugauuuccacucu

SEQ ID NO: 1215887 - RNA, 19 nt, Homo sapiens
gcacaggugagggaacuaa

SEQ ID NO: 1215888 - RNA, 19 nt, Homo sapiens
caaggaacccgucuaugug

SEQ ID NO: 1215889 - RNA, 19 nt, Homo sapiens
ggcguugaauggaauuaaa

SEQ ID NO: 1215890 - RNA, 19 nt, Homo sapiens
uacuuuagcugacaucaau

SEQ ID NO: 1215891 - RNA, 19 nt, Homo sapiens
ccucaguaauucuauguau

SEQ ID NO: 1215892 - RNA, 19 nt, Homo sapiens
uugcaguccugucagauuu

SEQ ID NO: 1215893 - RNA, 19 nt, Homo sapiens
gggaggaggaggacgauga

SEQ ID NO: 1215894 - RNA, 19 nt, Homo sapiens
gagaguaggcaaagagaag

SEQ ID NO: 1215895 - RNA, 19 nt, Homo sapiens
ccaggaguauucacacaca

SEQ ID NO: 1215896 - RNA, 19 nt, Homo sapiens
gggccaaguucaagagagu

SEQ ID NO: 1215897 - RNA, 19 nt, Homo sapiens
ggaggaggaggacgaugaa

SEQ ID NO: 1215898 - RNA, 19 nt, Homo sapiens
cgaucuggaugaagagaga

SEQ ID NO: 1215899 - RNA, 19 nt, Homo sapiens
gagcagaagaagacaaugg

SEQ ID NO: 1215900 - RNA, 19 nt, Homo sapiens
uccugaaccugcucaauga

SEQ ID NO: 1215901 - RNA, 19 nt, Homo sapiens
ugucugaccugcacgaucu

SEQ ID NO: 1215902 - RNA, 19 nt, Homo sapiens
agacaauggcugaccguaa

SEQ ID NO: 1215903 - RNA, 19 nt, Homo sapiens
ggaggaggacgaugaagag

SEQ ID NO: 1215904 - RNA, 19 nt, Homo sapiens
caagagaguaggcaaagag

SEQ ID NO: 1215905 - RNA, 19 nt, Homo sapiens
gcaguccugucagauuuag

SEQ ID NO: 1215906 - RNA, 19 nt, Homo sapiens
ucaagagaguaggcaaaga

SEQ ID NO: 1215907 - RNA, 19 nt, Homo sapiens
ccagguacaggaauuuaga

SEQ ID NO: 1215908 - RNA, 19 nt, Homo sapiens
ugucagauuuagccacaga

SEQ ID NO: 1215909 - RNA, 19 nt, Homo sapiens
cuggaagaccucaguaauu

SEQ ID NO: 1215910 - RNA, 19 nt, Homo sapiens
ugcacgaucuggaugaaga

SEQ ID NO: 1215911 - RNA, 19 nt, Homo sapiens
gaaccugcucaaugauuuc

SEQ ID NO: 1215912 - RNA, 19 nt, Homo sapiens
ggagaugcaggagaagcua

SEQ ID NO: 1215913 - RNA, 19 nt, Homo sapiens
ggagcacguucgggagaug

SEQ ID NO: 1215914 - RNA, 19 nt, Homo sapiens
uuagcugacaucaaucaua

SEQ ID NO: 1215915 - RNA, 19 nt, Homo sapiens
ccaaagcgccacgauccuu

SEQ ID NO: 1215916 - RNA, 19 nt, Homo sapiens
gauguccuccuauccuuuc

SEQ ID NO: 1215917 - RNA, 19 nt, Homo sapiens
guacuuuagcugacaucaa

SEQ ID NO: 1215918 - RNA, 19 nt, Homo sapiens
cagaggagcagaagaagac

SEQ ID NO: 1215919 - RNA, 19 nt, Homo sapiens
ccgauguccuccuauccuu

SEQ ID NO: 1215920 - RNA, 19 nt, Homo sapiens
gcaaagcuuguccgauguc

SEQ ID NO: 1215921 - RNA, 19 nt, Homo sapiens
uguaggggauguuuuacua

SEQ ID NO: 1215922 - RNA, 19 nt, Homo sapiens
ggaacccgucuaugugugu

SEQ ID NO: 1215923 - RNA, 19 nt, Homo sapiens
guucaagagaguaggcaaa

SEQ ID NO: 1215924 - RNA, 19 nt, Homo sapiens
ggggauguuuuacuacuga

SEQ ID NO: 1215925 - RNA, 19 nt, Homo sapiens
ccaaacccagguacaggaa

SEQ ID NO: 1215926 - RNA, 19 nt, Homo sapiens
ccagaggagcagaagaaga

SEQ ID NO: 1215927 - RNA, 19 nt, Homo sapiens
gcacuucagccuggaugug

SEQ ID NO: 1215928 - RNA, 19 nt, Homo sapiens
gggcguugaauggaauuaa

SEQ ID NO: 1215929 - RNA, 19 nt, Homo sapiens
gugaguacuuuagcugaca

SEQ ID NO: 1215930 - RNA, 19 nt, Homo sapiens
ugccagaggagcagaagaa

SEQ ID NO: 1215931 - RNA, 19 nt, Homo sapiens
aaaccagaaagaaagcaaa

SEQ ID NO: 1215932 - RNA, 19 nt, Homo sapiens
ggugacugaugucuaugag

SEQ ID NO: 1215933 - RNA, 19 nt, Homo sapiens
caccugguccucagucaga

SEQ ID NO: 1215934 - RNA, 19 nt, Homo sapiens
gguuguaggggauguuuua

SEQ ID NO: 1215935 - RNA, 19 nt, Homo sapiens
ggaagaccucaguaauucu

SEQ ID NO: 1215936 - RNA, 19 nt, Homo sapiens
aacuaaaccugugcaagau

SEQ ID NO: 1215937 - RNA, 19 nt, Homo sapiens
caggaguauucacacacaa

SEQ ID NO: 1215938 - RNA, 19 nt, Homo sapiens
gaccucaguaauucuaugu

SEQ ID NO: 1215939 - RNA, 19 nt, Homo sapiens
agaccucaguaauucuaug

SEQ ID NO: 1215940 - RNA, 19 nt, Homo sapiens
uaaaccagaaagaaagcaa

SEQ ID NO: 1215941 - RNA, 19 nt, Homo sapiens
gcugacaucaaucauagca

SEQ ID NO: 1215942 - RNA, 19 nt, Homo sapiens
cgaugaagaggaagaggau

SEQ ID NO: 1215943 - RNA, 19 nt, Homo sapiens
gcucaaagguggaguacua

SEQ ID NO: 1215944 - RNA, 19 nt, Homo sapiens
ggagaacaauugaggauuu

SEQ ID NO: 1215945 - RNA, 19 nt, Homo sapiens
gaaaagagaucucgaauca

SEQ ID NO: 1215946 - RNA, 19 nt, Homo sapiens
gcaagaagcggaaguuaaa

SEQ ID NO: 1215947 - RNA, 19 nt, Homo sapiens
gcaaagucauccaagagaa

SEQ ID NO: 1215948 - RNA, 19 nt, Homo sapiens
aaagagaucucgaaucaag

SEQ ID NO: 1215949 - RNA, 19 nt, Homo sapiens
gaaagaaggaccgaaagaa

SEQ ID NO: 1215950 - RNA, 19 nt, Homo sapiens
ggaagaagaagaagagaug

SEQ ID NO: 1215951 - RNA, 19 nt, Homo sapiens
gcucaaggacucucucuuu

SEQ ID NO: 1215952 - RNA, 19 nt, Homo sapiens
ggaagaggaagaagaagaa

SEQ ID NO: 1215953 - RNA, 19 nt, Homo sapiens
ggaggaagaggaagaagaa

SEQ ID NO: 1215954 - RNA, 19 nt, Homo sapiens
ccacaucccugacacauac

SEQ ID NO: 1215955 - RNA, 19 nt, Homo sapiens
gauucucacucaccucuuu

SEQ ID NO: 1215956 - RNA, 19 nt, Homo sapiens
ggcauaugcugguuacauu

SEQ ID NO: 1215957 - RNA, 19 nt, Homo sapiens
ggacgaggacaucauggua

SEQ ID NO: 1215958 - RNA, 19 nt, Homo sapiens
caaggacucucucuuugau

SEQ ID NO: 1215959 - RNA, 19 nt, Homo sapiens
gauacugucugcacuucaa

SEQ ID NO: 1215960 - RNA, 19 nt, Homo sapiens
gagaaacggcggagaacaa

SEQ ID NO: 1215961 - RNA, 19 nt, Homo sapiens
aagaagagauggcaacagu

SEQ ID NO: 1215962 - RNA, 19 nt, Homo sapiens
gagcaagaagcggaaguua

SEQ ID NO: 1215963 - RNA, 19 nt, Homo sapiens
cgacagugcuaccuugcuu

SEQ ID NO: 1215964 - RNA, 19 nt, Homo sapiens
ggacaucaugguagaauca

SEQ ID NO: 1215965 - RNA, 19 nt, Homo sapiens
ggaagaggaggaagaggaa

SEQ ID NO: 1215966 - RNA, 19 nt, Homo sapiens
gagaacaauugaggauuuc

SEQ ID NO: 1215967 - RNA, 19 nt, Homo sapiens
gcacuucaaggcaggaauu

SEQ ID NO: 1215968 - RNA, 19 nt, Homo sapiens
gugcuaagauuaagaagac

SEQ ID NO: 1215969 - RNA, 19 nt, Homo sapiens
aaagcaaagucauccaaga

SEQ ID NO: 1215970 - RNA, 19 nt, Homo sapiens
ucacucaccucuuuuguuu

SEQ ID NO: 1215971 - RNA, 19 nt, Homo sapiens
aagggagacuuguuugaaa

SEQ ID NO: 1215972 - RNA, 19 nt, Homo sapiens
ucaacaaauucugcaguuu

SEQ ID NO: 1215973 - RNA, 19 nt, Homo sapiens
ucuguggacuugaaauuga

SEQ ID NO: 1215974 - RNA, 19 nt, Homo sapiens
ccugauggcaccaacuuua

SEQ ID NO: 1215975 - RNA, 19 nt, Homo sapiens
gaugccagcuccagugaag

SEQ ID NO: 1215976 - RNA, 19 nt, Homo sapiens
gagaagggcagcucaagca

SEQ ID NO: 1215977 - RNA, 19 nt, Homo sapiens
gaggugggcagcacugaaa

SEQ ID NO: 1215978 - RNA, 19 nt, Homo sapiens
acagacagccugcguguug

SEQ ID NO: 1215979 - RNA, 19 nt, Homo sapiens
aaacggcggagaacaauug

SEQ ID NO: 1215980 - RNA, 19 nt, Homo sapiens
caacaugauuugggaacug

SEQ ID NO: 1215981 - RNA, 19 nt, Homo sapiens
gaugggaggcugucugugu

SEQ ID NO: 1215982 - RNA, 19 nt, Homo sapiens
gaucucgaaucaagaagag

SEQ ID NO: 1215983 - RNA, 19 nt, Homo sapiens
cgaaagaaggaccgaaaga

SEQ ID NO: 1215984 - RNA, 19 nt, Homo sapiens
gaccugccaccaucacuuu

SEQ ID NO: 1215985 - RNA, 19 nt, Homo sapiens
ccagagaaacggcggagaa

SEQ ID NO: 1215986 - RNA, 19 nt, Homo sapiens
cuaccuugcuugagaagau

SEQ ID NO: 1215987 - RNA, 19 nt, Homo sapiens
gaaucaagaagagcaagaa

SEQ ID NO: 1215988 - RNA, 19 nt, Homo sapiens
gcacugaaacaagccaaga

SEQ ID NO: 1215989 - RNA, 19 nt, Homo sapiens
caacaaauucugcaguuuu

SEQ ID NO: 1215990 - RNA, 19 nt, Homo sapiens
gccugcguguuguaaauaa

SEQ ID NO: 1215991 - RNA, 19 nt, Homo sapiens
cagccugcguguuguaaau

SEQ ID NO: 1215992 - RNA, 19 nt, Homo sapiens
gaaacggcggagaacaauu

SEQ ID NO: 1215993 - RNA, 19 nt, Homo sapiens
gcaguuuuguuuuggcaua

SEQ ID NO: 1215994 - RNA, 19 nt, Homo sapiens
cuauuucacuccccauuua

SEQ ID NO: 1215995 - RNA, 19 nt, Homo sapiens
gcagggugggcucuuuaaa

SEQ ID NO: 1215996 - RNA, 19 nt, Homo sapiens
gggauggaaugggacaguu

SEQ ID NO: 1215997 - RNA, 19 nt, Homo sapiens
caacguccccgacuucuuu

SEQ ID NO: 1215998 - RNA, 19 nt, Homo sapiens
gagaugccagcuccaguga

SEQ ID NO: 1215999 - RNA, 19 nt, Homo sapiens
agagauggcaacaguggua

SEQ ID NO: 1216000 - RNA, 19 nt, Homo sapiens
cucaaggacucucucuuug

SEQ ID NO: 1216001 - RNA, 19 nt, Homo sapiens
ccucagaucuucgaaccau

SEQ ID NO: 1216002 - RNA, 19 nt, Homo sapiens
gauccaccuccgacccuua

SEQ ID NO: 1216003 - RNA, 19 nt, Homo sapiens
cacauaaucucugucucuu

SEQ ID NO: 1216004 - RNA, 19 nt, Homo sapiens
gacuugaaauugaauccau

SEQ ID NO: 1216005 - RNA, 19 nt, Homo sapiens
ugaaacaagccaagaugga

SEQ ID NO: 1216006 - RNA, 19 nt, Homo sapiens
gggcauggcagcucaaagg

SEQ ID NO: 1216007 - RNA, 19 nt, Homo sapiens
gauuggaauugggauggaa

SEQ ID NO: 1216008 - RNA, 19 nt, Homo sapiens
ccucuccugugcuaagauu

SEQ ID NO: 1216009 - RNA, 19 nt, Homo sapiens
ccgaaagaaccgaaaguug

SEQ ID NO: 1216010 - RNA, 19 nt, Homo sapiens
gugcuaccuugcuugagaa

SEQ ID NO: 1216011 - RNA, 19 nt, Homo sapiens
gcagcucaaagguggagua

SEQ ID NO: 1216012 - RNA, 19 nt, Homo sapiens
ggauuggaauugggaugga

SEQ ID NO: 1216013 - RNA, 19 nt, Homo sapiens
gagacuuguuugaaaauga

SEQ ID NO: 1216014 - RNA, 19 nt, Homo sapiens
gugggagcaucgagcacua

SEQ ID NO: 1216015 - RNA, 19 nt, Homo sapiens
agacucagccaccagagaa

SEQ ID NO: 1216016 - RNA, 19 nt, Homo sapiens
ggauggaaugggacaguug

SEQ ID NO: 1216017 - RNA, 19 nt, Homo sapiens
ggaccugccaccaucacuu

SEQ ID NO: 1216018 - RNA, 19 nt, Homo sapiens
caagagaagggcagcucaa

SEQ ID NO: 1216019 - RNA, 19 nt, Homo sapiens
ggaaggaaagcagaaaggu

SEQ ID NO: 1216020 - RNA, 19 nt, Homo sapiens
acuagagccuggccaagug

SEQ ID NO: 1216021 - RNA, 19 nt, Homo sapiens
ggagcccagucccgaagau

SEQ ID NO: 1216022 - RNA, 19 nt, Homo sapiens
agagaucucgaaucaagaa

SEQ ID NO: 1216023 - RNA, 19 nt, Homo sapiens
gaggacaucaugguagaau

SEQ ID NO: 1216024 - RNA, 19 nt, Homo sapiens
acgaggacaucaugguaga

SEQ ID NO: 1216025 - RNA, 19 nt, Homo sapiens
agugcuaccuugcuugaga

SEQ ID NO: 1216026 - RNA, 19 nt, Homo sapiens
caaagucauccaagagaag

SEQ ID NO: 1216027 - RNA, 19 nt, Homo sapiens
aagcagggugggcucuuua

SEQ ID NO: 1216028 - RNA, 19 nt, Homo sapiens
gcauaugcugguuacauuc

SEQ ID NO: 1216029 - RNA, 19 nt, Homo sapiens
ggaggugggcagcacugaa

SEQ ID NO: 1216030 - RNA, 19 nt, Homo sapiens
acacauaaucucugucucu

SEQ ID NO: 1216031 - RNA, 19 nt, Homo sapiens
uucaacaaauucugcaguu

SEQ ID NO: 1216032 - RNA, 19 nt, Homo sapiens
gagacucagccaccagaga

SEQ ID NO: 1216033 - RNA, 19 nt, Homo sapiens
aaagaaggaccgaaagaac

SEQ ID NO: 1216034 - RNA, 19 nt, Homo sapiens
gauggaaugggacaguugu

SEQ ID NO: 1216035 - RNA, 19 nt, Homo sapiens
uucgaaccauccagacuuu

SEQ ID NO: 1216036 - RNA, 19 nt, Homo sapiens
caccaacuuuagccuggaa

SEQ ID NO: 1216037 - RNA, 19 nt, Homo sapiens
gcggagaacaauugaggau

SEQ ID NO: 1216038 - RNA, 19 nt, Homo sapiens
gaacuuccaaaugacaaca

SEQ ID NO: 1216039 - RNA, 19 nt, Homo sapiens
ggaggaagaggaggaagag

SEQ ID NO: 1216040 - RNA, 19 nt, Homo sapiens
ggaggaggaagaggaggaa

SEQ ID NO: 1216041 - RNA, 19 nt, Homo sapiens
aacaugauuugggaacuga

SEQ ID NO: 1216042 - RNA, 19 nt, Homo sapiens
ggucauggacgaggacauc

SEQ ID NO: 1216043 - RNA, 19 nt, Homo sapiens
guguaaaucuuucccaaua

SEQ ID NO: 1216044 - RNA, 19 nt, Homo sapiens
gaagugagccgaaguuugu

SEQ ID NO: 1216045 - RNA, 19 nt, Homo sapiens
gcaccaauauugcagacuu

SEQ ID NO: 1216046 - RNA, 19 nt, Homo sapiens
ccaauaaaguguugcacaa

SEQ ID NO: 1216047 - RNA, 19 nt, Homo sapiens
gcucaucgcaccaauauug

SEQ ID NO: 1216048 - RNA, 19 nt, Homo sapiens
gaacucaagcucccgauug

SEQ ID NO: 1216049 - RNA, 19 nt, Homo sapiens
ggacguaucuagugguucu

SEQ ID NO: 1216050 - RNA, 19 nt, Homo sapiens
gggcaaauucccuuucuuu

SEQ ID NO: 1216051 - RNA, 19 nt, Homo sapiens
gcacugcacuuccccaaaa

SEQ ID NO: 1216052 - RNA, 19 nt, Homo sapiens
gcauaagcuucccauuuca

SEQ ID NO: 1216053 - RNA, 19 nt, Homo sapiens
cccaucggcuuccucuuua

SEQ ID NO: 1216054 - RNA, 19 nt, Homo sapiens
cagaaagaguccuuaccuu

SEQ ID NO: 1216055 - RNA, 19 nt, Homo sapiens
cuaaauacccugccugcaa

SEQ ID NO: 1216056 - RNA, 19 nt, Homo sapiens
gcucuccucucaccucuuc

SEQ ID NO: 1216057 - RNA, 19 nt, Homo sapiens
ggccuggacuuucuccuau

SEQ ID NO: 1216058 - RNA, 19 nt, Homo sapiens
gaagaauggacguaucuag

SEQ ID NO: 1216059 - RNA, 19 nt, Homo sapiens
agcauaagcuucccauuuc

SEQ ID NO: 1216060 - RNA, 19 nt, Homo sapiens
aaagaguccuuaccuugga

SEQ ID NO: 1216061 - RNA, 19 nt, Homo sapiens
gaccaugucgccugaagaa

SEQ ID NO: 1216062 - RNA, 19 nt, Homo sapiens
guccugggcugaagagaug

SEQ ID NO: 1216063 - RNA, 19 nt, Homo sapiens
guacugggccuccaucuac

SEQ ID NO: 1216064 - RNA, 19 nt, Homo sapiens
gcucuggccuggacuuucu

SEQ ID NO: 1216065 - RNA, 19 nt, Homo sapiens
uaucuagugguucuucuua

SEQ ID NO: 1216066 - RNA, 19 nt, Homo sapiens
gggacugggugcacugguu

SEQ ID NO: 1216067 - RNA, 19 nt, Homo sapiens
caauauugcagacuuggaa

SEQ ID NO: 1216068 - RNA, 19 nt, Homo sapiens
aauaaaguguugcacaaag

SEQ ID NO: 1216069 - RNA, 19 nt, Homo sapiens
cggcuuccuuggaguauga

SEQ ID NO: 1216070 - RNA, 19 nt, Homo sapiens
ggaccugggcccucauuca

SEQ ID NO: 1216071 - RNA, 19 nt, Homo sapiens
guguggaccuggacucgaa

SEQ ID NO: 1216072 - RNA, 19 nt, Homo sapiens
caauaaaguguugcacaaa

SEQ ID NO: 1216073 - RNA, 19 nt, Homo sapiens
agugguggcuggcgcagua

SEQ ID NO: 1216074 - RNA, 19 nt, Homo sapiens
agacuuggaaggaagcaua

SEQ ID NO: 1216075 - RNA, 19 nt, Homo sapiens
ccagagagcacugcacuuc

SEQ ID NO: 1216076 - RNA, 19 nt, Homo sapiens
cuacuucuguauccacuuc

SEQ ID NO: 1216077 - RNA, 19 nt, Homo sapiens
gcaccugcccguuccuaug

SEQ ID NO: 1216078 - RNA, 19 nt, Homo sapiens
ucuccuaucuccuguucuu

SEQ ID NO: 1216079 - RNA, 19 nt, Homo sapiens
ccaugucgccugaagaaug

SEQ ID NO: 1216080 - RNA, 19 nt, Homo sapiens
uagcucaucgcaccaauau

SEQ ID NO: 1216081 - RNA, 19 nt, Homo sapiens
gugcacugguuccugaaga

SEQ ID NO: 1216082 - RNA, 19 nt, Homo sapiens
gagaggguccuggagagaa

SEQ ID NO: 1216083 - RNA, 19 nt, Homo sapiens
cgaagugagccgaaguuug

SEQ ID NO: 1216084 - RNA, 19 nt, Homo sapiens
caccaauauugcagacuug

SEQ ID NO: 1216085 - RNA, 19 nt, Homo sapiens
caugucgccugaagaaugg

SEQ ID NO: 1216086 - RNA, 19 nt, Homo sapiens
ccaucggcuuccucuuuaa

SEQ ID NO: 1216087 - RNA, 19 nt, Homo sapiens
gacaggucaccguguguaa

SEQ ID NO: 1216088 - RNA, 19 nt, Homo sapiens
ccaccuccacuccuacaaa

SEQ ID NO: 1216089 - RNA, 19 nt, Homo sapiens
cgcaguauaucuacaagag

SEQ ID NO: 1216090 - RNA, 19 nt, Homo sapiens
gucuuucgcuccacuuuua

SEQ ID NO: 1216091 - RNA, 19 nt, Homo sapiens
ggagaggguccuggagaga

SEQ ID NO: 1216092 - RNA, 19 nt, Homo sapiens
gguacugggccuccaucua

SEQ ID NO: 1216093 - RNA, 19 nt, Homo sapiens
agaauggacguaucuagug

SEQ ID NO: 1216094 - RNA, 19 nt, Homo sapiens
aagcuucccauuucacaaa

SEQ ID NO: 1216095 - RNA, 19 nt, Homo sapiens
ucuagugguucuucuuauc

SEQ ID NO: 1216096 - RNA, 19 nt, Homo sapiens
ggcaugcgguacuggaaca

SEQ ID NO: 1216097 - RNA, 19 nt, Homo sapiens
gccucuuccuugugucuuu

SEQ ID NO: 1216098 - RNA, 19 nt, Homo sapiens
agaggguccuggagagaau

SEQ ID NO: 1216099 - RNA, 19 nt, Homo sapiens
gcacugguuccugaagaug

SEQ ID NO: 1216100 - RNA, 19 nt, Homo sapiens
gagccuggccagugaaguc

SEQ ID NO: 1216101 - RNA, 19 nt, Homo sapiens
ugauggagacacucagcua

SEQ ID NO: 1216102 - RNA, 19 nt, Homo sapiens
caggucaccguguguaaau

SEQ ID NO: 1216103 - RNA, 19 nt, Homo sapiens
ccugaagaauggacguauc

SEQ ID NO: 1216104 - RNA, 19 nt, Homo sapiens
uaugagaccauccgcaaca

SEQ ID NO: 1216105 - RNA, 19 nt, Homo sapiens
gacuuggaaggaagcauaa

SEQ ID NO: 1216106 - RNA, 19 nt, Homo sapiens
gggccuccaucuacuucug

SEQ ID NO: 1216107 - RNA, 19 nt, Homo sapiens
gcgauggcaugcgguacug

SEQ ID NO: 1216108 - RNA, 19 nt, Homo sapiens
uggugagccuggccaguga

SEQ ID NO: 1216109 - RNA, 19 nt, Homo sapiens
caccguguguaaaucuuuc

SEQ ID NO: 1216110 - RNA, 19 nt, Homo sapiens
ggagcucggaucccagugu

SEQ ID NO: 1216111 - RNA, 19 nt, Homo sapiens
ccagaaagaguccuuaccu

SEQ ID NO: 1216112 - RNA, 19 nt, Homo sapiens
ucucgacuauugccgaagu

SEQ ID NO: 1216113 - RNA, 19 nt, Homo sapiens
aacucaagcucccgauugu

SEQ ID NO: 1216114 - RNA, 19 nt, Homo sapiens
uacccugccugcaacugaa

SEQ ID NO: 1216115 - RNA, 19 nt, Homo sapiens
cagcuggucccgggaauuc

SEQ ID NO: 1216116 - RNA, 19 nt, Homo sapiens
augcgguacuggaacauga

SEQ ID NO: 1216117 - RNA, 19 nt, Homo sapiens
aagaauggacguaucuagu

SEQ ID NO: 1216118 - RNA, 19 nt, Homo sapiens
cagaccaugucgccugaag

SEQ ID NO: 1216119 - RNA, 19 nt, Homo sapiens
gccuccaucuacuucugua

SEQ ID NO: 1216120 - RNA, 19 nt, Homo sapiens
gcuucgugcugcucuccuu

SEQ ID NO: 1216121 - RNA, 19 nt, Homo sapiens
gcucuucggccugcuguuc

SEQ ID NO: 1216122 - RNA, 19 nt, Homo sapiens
cccacgcccuucaccaaug

SEQ ID NO: 1216123 - RNA, 19 nt, Homo sapiens
caacacagcagacaccaaa

SEQ ID NO: 1216124 - RNA, 19 nt, Homo sapiens
guccugaccugagcgguua

SEQ ID NO: 1216125 - RNA, 19 nt, Homo sapiens
gcaccaagcggaaaauaaa

SEQ ID NO: 1216126 - RNA, 19 nt, Homo sapiens
aagcagaccuucgcaucaa

SEQ ID NO: 1216127 - RNA, 19 nt, Homo sapiens
caagcagaccuucgcauca

SEQ ID NO: 1216128 - RNA, 19 nt, Homo sapiens
ccaccagccagcaagcuaa

SEQ ID NO: 1216129 - RNA, 19 nt, Homo sapiens
guucauggccacgguguug

SEQ ID NO: 1216130 - RNA, 19 nt, Homo sapiens
gcggucuucucugcaaaug

SEQ ID NO: 1216131 - RNA, 19 nt, Homo sapiens
gcagaccuucgcaucaaca

SEQ ID NO: 1216132 - RNA, 19 nt, Homo sapiens
ggagaagacuggaaaggua

SEQ ID NO: 1216133 - RNA, 19 nt, Homo sapiens
gcugagagauccugacaua

SEQ ID NO: 1216134 - RNA, 19 nt, Homo sapiens
cacaugaccuugauuguua

SEQ ID NO: 1216135 - RNA, 19 nt, Homo sapiens
gaagaaagacaaauggauu

SEQ ID NO: 1216136 - RNA, 19 nt, Homo sapiens
ucaaaucacuucuuacuuc

SEQ ID NO: 1216137 - RNA, 19 nt, Homo sapiens
uaagaagacuguuagaaug

SEQ ID NO: 1216138 - RNA, 19 nt, Homo sapiens
ugacauaaauccuuguuug

SEQ ID NO: 1216139 - RNA, 19 nt, Homo sapiens
gacuagaacuucacuuuau

SEQ ID NO: 1216140 - RNA, 19 nt, Homo sapiens
gagaguauccuguagauug

SEQ ID NO: 1216141 - RNA, 19 nt, Homo sapiens
ccacuuacuucuugaggua

SEQ ID NO: 1216142 - RNA, 19 nt, Homo sapiens
aaagguaaguugaagguaa

SEQ ID NO: 1216143 - RNA, 19 nt, Homo sapiens
gaaagaagaguaugaugug

SEQ ID NO: 1216144 - RNA, 19 nt, Homo sapiens
agacagaccuuaaguucuu

SEQ ID NO: 1216145 - RNA, 19 nt, Homo sapiens
ccaaggaaaggaaauguua

SEQ ID NO: 1216146 - RNA, 19 nt, Homo sapiens
caaauggauucccuuagaa

SEQ ID NO: 1216147 - RNA, 19 nt, Homo sapiens
gagagauccugacauaaau

SEQ ID NO: 1216148 - RNA, 19 nt, Homo sapiens
ggaaaugaaaugugaagaa

SEQ ID NO: 1216149 - RNA, 19 nt, Homo sapiens
acaaauggauucccuuaga

SEQ ID NO: 1216150 - RNA, 19 nt, Homo sapiens
guaagaagacuguuagaau

SEQ ID NO: 1216151 - RNA, 19 nt, Homo sapiens
ugagagauccugacauaaa

SEQ ID NO: 1216152 - RNA, 19 nt, Homo sapiens
gaacugguugucuuucuuu

SEQ ID NO: 1216153 - RNA, 19 nt, Homo sapiens
guagauugcuccaccuaga

SEQ ID NO: 1216154 - RNA, 19 nt, Homo sapiens
gagacuagaacuucacuuu

SEQ ID NO: 1216155 - RNA, 19 nt, Homo sapiens
aguaugaugugaacaagua

SEQ ID NO: 1216156 - RNA, 19 nt, Homo sapiens
gaaccacauucagagagua

SEQ ID NO: 1216157 - RNA, 19 nt, Homo sapiens
agaagcagaugaauauuuc

SEQ ID NO: 1216158 - RNA, 19 nt, Homo sapiens
aaacuuagagugccuugua

SEQ ID NO: 1216159 - RNA, 19 nt, Homo sapiens
gggcugagaugaaggcaau

SEQ ID NO: 1216160 - RNA, 19 nt, Homo sapiens
ggaauucuaucgugaugca

SEQ ID NO: 1216161 - RNA, 19 nt, Homo sapiens
gaccuuaaguucuucaagu

SEQ ID NO: 1216162 - RNA, 19 nt, Homo sapiens
uaacuuagaagcagaugaa

SEQ ID NO: 1216163 - RNA, 19 nt, Homo sapiens
gaacucaacacugggauga

SEQ ID NO: 1216164 - RNA, 19 nt, Homo sapiens
gcaagagugugaggcaaga

SEQ ID NO: 1216165 - RNA, 19 nt, Homo sapiens
gaccuugauuguuaaaugu

SEQ ID NO: 1216166 - RNA, 19 nt, Homo sapiens
gagaagacuggaaagguaa

SEQ ID NO: 1216167 - RNA, 19 nt, Homo sapiens
gaacaaguaaagacugaau

SEQ ID NO: 1216168 - RNA, 19 nt, Homo sapiens
gugaacaaguaaagacuga

SEQ ID NO: 1216169 - RNA, 19 nt, Homo sapiens
gaagaaagaacggagugaa

SEQ ID NO: 1216170 - RNA, 19 nt, Homo sapiens
uagagugccuuguauuuag

SEQ ID NO: 1216171 - RNA, 19 nt, Homo sapiens
ugaccuugauuguuaaaug

SEQ ID NO: 1216172 - RNA, 19 nt, Homo sapiens
ggaaccacauucagagagu

SEQ ID NO: 1216173 - RNA, 19 nt, Homo sapiens
gaacggagugaagccauuu

SEQ ID NO: 1216174 - RNA, 19 nt, Homo sapiens
gaacugguaagaagacugu

SEQ ID NO: 1216175 - RNA, 19 nt, Homo sapiens
agacuagaacuucacuuua

SEQ ID NO: 1216176 - RNA, 19 nt, Homo sapiens
ccucacuuaucuuuguuua

SEQ ID NO: 1216177 - RNA, 19 nt, Homo sapiens
gaaagguguuccacuuacu

SEQ ID NO: 1216178 - RNA, 19 nt, Homo sapiens
ggaugagacuagaacuuca

SEQ ID NO: 1216179 - RNA, 19 nt, Homo sapiens
ggaagaaagacaaauggau

SEQ ID NO: 1216180 - RNA, 19 nt, Homo sapiens
uuacuucccucacuuaucu

SEQ ID NO: 1216181 - RNA, 19 nt, Homo sapiens
gaaauguuaugagcaagag

SEQ ID NO: 1216182 - RNA, 19 nt, Homo sapiens
ggaaauguuaugagcaaga

SEQ ID NO: 1216183 - RNA, 19 nt, Homo sapiens
uggauucccuuagaaguaa

SEQ ID NO: 1216184 - RNA, 19 nt, Homo sapiens
agacaaauggauucccuua

SEQ ID NO: 1216185 - RNA, 19 nt, Homo sapiens
ccacaguaaugggaagaaa

SEQ ID NO: 1216186 - RNA, 19 nt, Homo sapiens
uaacacagaggcugagaga

SEQ ID NO: 1216187 - RNA, 19 nt, Homo sapiens
uuuaauggcugccgacaau

SEQ ID NO: 1216188 - RNA, 19 nt, Homo sapiens
gagcaguggugggagaaga

SEQ ID NO: 1216189 - RNA, 19 nt, Homo sapiens
cuuagaagcagaugaauau

SEQ ID NO: 1216190 - RNA, 19 nt, Homo sapiens
ugagagcagugggaaauau

SEQ ID NO: 1216191 - RNA, 19 nt, Homo sapiens
ugaagcagcccuccuuaug

SEQ ID NO: 1216192 - RNA, 19 nt, Homo sapiens
aaggaaauguuaugagcaa

SEQ ID NO: 1216193 - RNA, 19 nt, Homo sapiens
ccagacagaccuuaaguuc

SEQ ID NO: 1216194 - RNA, 19 nt, Homo sapiens
gaggaacucaugcaaagga

SEQ ID NO: 1216195 - RNA, 19 nt, Homo sapiens
cugguugucuuucuuuaaa

SEQ ID NO: 1216196 - RNA, 19 nt, Homo sapiens
cagagaguauccuguagau

SEQ ID NO: 1216197 - RNA, 19 nt, Homo sapiens
guuaugagcaagaguguga

SEQ ID NO: 1216198 - RNA, 19 nt, Homo sapiens
ugaaagaagaguaugaugu

SEQ ID NO: 1216199 - RNA, 19 nt, Homo sapiens
uuagagugccuuguauuua

SEQ ID NO: 1216200 - RNA, 19 nt, Homo sapiens
ccacaugaccuugauuguu

SEQ ID NO: 1216201 - RNA, 19 nt, Homo sapiens
gcucauuccucaaaucacu

SEQ ID NO: 1216202 - RNA, 19 nt, Homo sapiens
ggaaagguaaguugaaggu

SEQ ID NO: 1216203 - RNA, 19 nt, Homo sapiens
aaagaagaguaugauguga

SEQ ID NO: 1216204 - RNA, 19 nt, Homo sapiens
ggagugaagccauuuaugc

SEQ ID NO: 1216205 - RNA, 19 nt, Homo sapiens
uuccucaaaucacuucuua

SEQ ID NO: 1216206 - RNA, 19 nt, Homo sapiens
gaaagguaaguugaaggua

SEQ ID NO: 1216207 - RNA, 19 nt, Homo sapiens
ggaguuagguaaggcuaca

SEQ ID NO: 1216208 - RNA, 19 nt, Homo sapiens
gcagcuguaguaucaguuu

SEQ ID NO: 1216209 - RNA, 19 nt, Homo sapiens
gguaagaagacuguuagaa

SEQ ID NO: 1216210 - RNA, 19 nt, Homo sapiens
guaaugggaagaaagacaa

SEQ ID NO: 1216211 - RNA, 19 nt, Homo sapiens
ugagaugaaggcaauguuu

SEQ ID NO: 1216212 - RNA, 19 nt, Homo sapiens
caugagaaauugagcuuuu

SEQ ID NO: 1216213 - RNA, 19 nt, Homo sapiens
acacagaggcugagagauc

SEQ ID NO: 1216214 - RNA, 19 nt, Homo sapiens
guuagaaugcccucgguaa

SEQ ID NO: 1216215 - RNA, 19 nt, Homo sapiens
ggaguuaauacacgaggaa

SEQ ID NO: 1216216 - RNA, 19 nt, Homo sapiens
gcggaggccggaguuaaua

SEQ ID NO: 1216217 - RNA, 19 nt, Homo sapiens
gaaggaaaaggaaaugaaa

SEQ ID NO: 1216218 - RNA, 19 nt, Homo sapiens
gaagcuggaaccacauuca

SEQ ID NO: 1216219 - RNA, 19 nt, Homo sapiens
ggaaaggaaauguuaugag

SEQ ID NO: 1216220 - RNA, 19 nt, Homo sapiens
gagaugaaggcaauguuuc

SEQ ID NO: 1216221 - RNA, 19 nt, Homo sapiens
gggaugagacuagaacuuc

SEQ ID NO: 1216222 - RNA, 19 nt, Homo sapiens
gagaagcuggaaccacauu

SEQ ID NO: 1216223 - RNA, 19 nt, Homo sapiens
gacauaaauccuuguuugu

SEQ ID NO: 1216224 - RNA, 19 nt, Homo sapiens
gaagcagcccuccuuaugc

SEQ ID NO: 1216225 - RNA, 19 nt, Homo sapiens
ggaaauccaaacuuagagu

SEQ ID NO: 1216226 - RNA, 19 nt, Homo sapiens
guaaguugaagguaaggaa

SEQ ID NO: 1216227 - RNA, 19 nt, Homo sapiens
acgaggaacucaugcaaag

SEQ ID NO: 1216228 - RNA, 19 nt, Homo sapiens
gaagcggaggccggaguua

SEQ ID NO: 1216229 - RNA, 19 nt, Homo sapiens
uagguaaggcuacaugaga

SEQ ID NO: 1216230 - RNA, 19 nt, Homo sapiens
guguuccacuuacuucuug

SEQ ID NO: 1216231 - RNA, 19 nt, Homo sapiens
uaauggcugccgacaauga

SEQ ID NO: 1216232 - RNA, 19 nt, Homo sapiens
gaagcgaccuccagauuua

SEQ ID NO: 1216233 - RNA, 19 nt, Homo sapiens
gaacugcccuccuggaacu

SEQ ID NO: 1216234 - RNA, 19 nt, Homo sapiens
ggaagcgaccuccagauuu

SEQ ID NO: 1216235 - RNA, 19 nt, Homo sapiens
gcaauggcgucaugaccaa

SEQ ID NO: 1216236 - RNA, 19 nt, Homo sapiens
acucuuaacuguucuauuc

SEQ ID NO: 1216237 - RNA, 19 nt, Homo sapiens
gauaaccucgccuuuguuu

SEQ ID NO: 1216238 - RNA, 19 nt, Homo sapiens
ggaaacugaccaagaaaga

SEQ ID NO: 1216239 - RNA, 19 nt, Homo sapiens
ggacuggagagacaaguaa

SEQ ID NO: 1216240 - RNA, 19 nt, Homo sapiens
ugacuaccauuucuaagga

SEQ ID NO: 1216241 - RNA, 19 nt, Homo sapiens
ggauucauuuaccuuguuu

SEQ ID NO: 1216242 - RNA, 19 nt, Homo sapiens
gggaagcgaccuccagauu

SEQ ID NO: 1216243 - RNA, 19 nt, Homo sapiens
aaacugaccaagaaagaaa

SEQ ID NO: 1216244 - RNA, 19 nt, Homo sapiens
gaaacugaccaagaaagaa

SEQ ID NO: 1216245 - RNA, 19 nt, Homo sapiens
cugauaaccucgccuuugu

SEQ ID NO: 1216246 - RNA, 19 nt, Homo sapiens
cuacguggccaccgaguuu

SEQ ID NO: 1216247 - RNA, 19 nt, Homo sapiens
ggccaaaucgcaacucaga

SEQ ID NO: 1216248 - RNA, 19 nt, Homo sapiens
uagaaguauuucagucuug

SEQ ID NO: 1216249 - RNA, 19 nt, Homo sapiens
gcaugcuacucuuaacugu

SEQ ID NO: 1216250 - RNA, 19 nt, Homo sapiens
ucuacucucuugagccuuu

SEQ ID NO: 1216251 - RNA, 19 nt, Homo sapiens
ggaccugggcaucuacuug

SEQ ID NO: 1216252 - RNA, 19 nt, Homo sapiens
aaaguguucugcccaagau

SEQ ID NO: 1216253 - RNA, 19 nt, Homo sapiens
cccaaggccugaagagaau

SEQ ID NO: 1216254 - RNA, 19 nt, Homo sapiens
gaaauucuaaggagagcau

SEQ ID NO: 1216255 - RNA, 19 nt, Homo sapiens
gaccugcaugcuacucuua

SEQ ID NO: 1216256 - RNA, 19 nt, Homo sapiens
uaacuguucuauucaagac

SEQ ID NO: 1216257 - RNA, 19 nt, Homo sapiens
cuaaggagagcaugagaga

SEQ ID NO: 1216258 - RNA, 19 nt, Homo sapiens
guggagaagcucuguguga

SEQ ID NO: 1216259 - RNA, 19 nt, Homo sapiens
gcaggcgccuaacaacuac

SEQ ID NO: 1216260 - RNA, 19 nt, Homo sapiens
ucaagacugaauagaagua

SEQ ID NO: 1216261 - RNA, 19 nt, Homo sapiens
gugcggcuguggucgagaa

SEQ ID NO: 1216262 - RNA, 19 nt, Homo sapiens
ccauagccaucuacucucu

SEQ ID NO: 1216263 - RNA, 19 nt, Homo sapiens
caacucagacccagugaac

SEQ ID NO: 1216264 - RNA, 19 nt, Homo sapiens
cgcaggcgccuaacaacua

SEQ ID NO: 1216265 - RNA, 19 nt, Homo sapiens
cauccugggucaucucagu

SEQ ID NO: 1216266 - RNA, 19 nt, Homo sapiens
ccuguaaucccagcacuuu

SEQ ID NO: 1216267 - RNA, 19 nt, Homo sapiens
augcuacucuuaacuguuc

SEQ ID NO: 1216268 - RNA, 19 nt, Homo sapiens
gagagaaggcuggcauugg

SEQ ID NO: 1216269 - RNA, 19 nt, Homo sapiens
cagcgaaagcaaccacuug

SEQ ID NO: 1216270 - RNA, 19 nt, Homo sapiens
uggauucauuuaccuuguu

SEQ ID NO: 1216271 - RNA, 19 nt, Homo sapiens
caaggccugaagagaauuu

SEQ ID NO: 1216272 - RNA, 19 nt, Homo sapiens
gggacuggagagacaagua

SEQ ID NO: 1216273 - RNA, 19 nt, Homo sapiens
cagcaccagccuaggaauu

SEQ ID NO: 1216274 - RNA, 19 nt, Homo sapiens
cagacuggcgagauucaaa

SEQ ID NO: 1216275 - RNA, 19 nt, Homo sapiens
gaccuccagauuuaucaaa

SEQ ID NO: 1216276 - RNA, 19 nt, Homo sapiens
gaacccaaggccugaagag

SEQ ID NO: 1216277 - RNA, 19 nt, Homo sapiens
gaguaacuguccccucuga

SEQ ID NO: 1216278 - RNA, 19 nt, Homo sapiens
ugaccugcaugcuacucuu

SEQ ID NO: 1216279 - RNA, 19 nt, Homo sapiens
auagccaucuacucucuug

SEQ ID NO: 1216280 - RNA, 19 nt, Homo sapiens
aaggagagcaugagagaag

SEQ ID NO: 1216281 - RNA, 19 nt, Homo sapiens
ucauuuaccuuguuuugug

SEQ ID NO: 1216282 - RNA, 19 nt, Homo sapiens
caggccaaaucgcaacuca

SEQ ID NO: 1216283 - RNA, 19 nt, Homo sapiens
gcaacucagacccagugaa

SEQ ID NO: 1216284 - RNA, 19 nt, Homo sapiens
gggaaacugaccaagaaag

SEQ ID NO: 1216285 - RNA, 19 nt, Homo sapiens
ccugauaaccucgccuuug

SEQ ID NO: 1216286 - RNA, 19 nt, Homo sapiens
ggaguuucccgagcacuuc

SEQ ID NO: 1216287 - RNA, 19 nt, Homo sapiens
cgaguuuguggcccuagua

SEQ ID NO: 1216288 - RNA, 19 nt, Homo sapiens
gaccagccucggcaacaug

SEQ ID NO: 1216289 - RNA, 19 nt, Homo sapiens
acccaaggccugaagagaa

SEQ ID NO: 1216290 - RNA, 19 nt, Homo sapiens
ugagagaaggcuggcauug

SEQ ID NO: 1216291 - RNA, 19 nt, Homo sapiens
ccggcaggauguggaguuu

SEQ ID NO: 1216292 - RNA, 19 nt, Homo sapiens
gagaccagccucggcaaca

SEQ ID NO: 1216293 - RNA, 19 nt, Homo sapiens
caagacugaauagaaguau

SEQ ID NO: 1216294 - RNA, 19 nt, Homo sapiens
ggcaggauguggaguuucc

SEQ ID NO: 1216295 - RNA, 19 nt, Homo sapiens
agacaaguaaacucucaga

SEQ ID NO: 1216296 - RNA, 19 nt, Homo sapiens
caggaaagcuguucacuga

SEQ ID NO: 1216297 - RNA, 19 nt, Homo sapiens
gaggaucagugacuuguuu

SEQ ID NO: 1216298 - RNA, 19 nt, Homo sapiens
uuacagauaccaacaguua

SEQ ID NO: 1216299 - RNA, 19 nt, Homo sapiens
gcaaggaggcggaggcauu

SEQ ID NO: 1216300 - RNA, 19 nt, Homo sapiens
guaagaaacgcuuugcaaa

SEQ ID NO: 1216301 - RNA, 19 nt, Homo sapiens
ggaaagcuguucacugacu

SEQ ID NO: 1216302 - RNA, 19 nt, Homo sapiens
ggagauuucuacuucuuca

SEQ ID NO: 1216303 - RNA, 19 nt, Homo sapiens
uaacagcacugggauccaa

SEQ ID NO: 1216304 - RNA, 19 nt, Homo sapiens
ugauggagauuucuacuuc

SEQ ID NO: 1216305 - RNA, 19 nt, Homo sapiens
aaacgcagggcccuaaaua

SEQ ID NO: 1216306 - RNA, 19 nt, Homo sapiens
gaacuggccugagcaucug

SEQ ID NO: 1216307 - RNA, 19 nt, Homo sapiens
ccagaucccuuggcccuuu

SEQ ID NO: 1216308 - RNA, 19 nt, Homo sapiens
ggaagucugucugccuuug

SEQ ID NO: 1216309 - RNA, 19 nt, Homo sapiens
gcaaagcaagguaacaaau

SEQ ID NO: 1216310 - RNA, 19 nt, Homo sapiens
guacggauaccucaaugaa

SEQ ID NO: 1216311 - RNA, 19 nt, Homo sapiens
gaaagcuguucacugacuu

SEQ ID NO: 1216312 - RNA, 19 nt, Homo sapiens
ggugucauauuuagucaga

SEQ ID NO: 1216313 - RNA, 19 nt, Homo sapiens
gaaguacggauaccucaau

SEQ ID NO: 1216314 - RNA, 19 nt, Homo sapiens
caaagcaagguaacaaaug

SEQ ID NO: 1216315 - RNA, 19 nt, Homo sapiens
gcggaggcauuccuagaga

SEQ ID NO: 1216316 - RNA, 19 nt, Homo sapiens
ggagcgcccuguucugaag

SEQ ID NO: 1216317 - RNA, 19 nt, Homo sapiens
aaagcaagguaacaaaugg

SEQ ID NO: 1216318 - RNA, 19 nt, Homo sapiens
gcaagacugugcccuucuc

SEQ ID NO: 1216319 - RNA, 19 nt, Homo sapiens
cagaagaccgggcagcaaa

SEQ ID NO: 1216320 - RNA, 19 nt, Homo sapiens
aggcauuccuagagaagua

SEQ ID NO: 1216321 - RNA, 19 nt, Homo sapiens
aaacucagcagagaaauuc

SEQ ID NO: 1216322 - RNA, 19 nt, Homo sapiens
guacaguuccuuucaagag

SEQ ID NO: 1216323 - RNA, 19 nt, Homo sapiens
acggauaccucaaugaaca

SEQ ID NO: 1216324 - RNA, 19 nt, Homo sapiens
gaaacgcagggcccuaaau

SEQ ID NO: 1216325 - RNA, 19 nt, Homo sapiens
gcacuucgaccaagaugag

SEQ ID NO: 1216326 - RNA, 19 nt, Homo sapiens
gcuguucacugacuuugag

SEQ ID NO: 1216327 - RNA, 19 nt, Homo sapiens
ucucagcgcuggaguucug

SEQ ID NO: 1216328 - RNA, 19 nt, Homo sapiens
ugggaucaaucuuaggaaa

SEQ ID NO: 1216329 - RNA, 19 nt, Homo sapiens
gcaaguggagcccuacuac

SEQ ID NO: 1216330 - RNA, 19 nt, Homo sapiens
acaagcagcaccucuccua

SEQ ID NO: 1216331 - RNA, 19 nt, Homo sapiens
gcucccaccuccacucgau

SEQ ID NO: 1216332 - RNA, 19 nt, Homo sapiens
ggaccaaaaugaggcguaa

SEQ ID NO: 1216333 - RNA, 19 nt, Homo sapiens
gguuacagauaccaacagu

SEQ ID NO: 1216334 - RNA, 19 nt, Homo sapiens
gcagaagaccgggcagcaa

SEQ ID NO: 1216335 - RNA, 19 nt, Homo sapiens
ugaaugauggagauuucua

SEQ ID NO: 1216336 - RNA, 19 nt, Homo sapiens
ccuaaauacugccacucuu

SEQ ID NO: 1216337 - RNA, 19 nt, Homo sapiens
cguaagaaacgcuuugcaa

SEQ ID NO: 1216338 - RNA, 19 nt, Homo sapiens
cagagaaauucgagaccau

SEQ ID NO: 1216339 - RNA, 19 nt, Homo sapiens
gauuucuacuucuucaaag

SEQ ID NO: 1216340 - RNA, 19 nt, Homo sapiens
gauggagauuucuacuucu

SEQ ID NO: 1216341 - RNA, 19 nt, Homo sapiens
acagauaccaacaguuaug

SEQ ID NO: 1216342 - RNA, 19 nt, Homo sapiens
ggaggcggaggcauuccua

SEQ ID NO: 1216343 - RNA, 19 nt, Homo sapiens
cuaaauacugccacucuuc

SEQ ID NO: 1216344 - RNA, 19 nt, Homo sapiens
caagguaacaaaugguaca

SEQ ID NO: 1216345 - RNA, 19 nt, Homo sapiens
gagaggaucagugacuugu

SEQ ID NO: 1216346 - RNA, 19 nt, Homo sapiens
ggugggaucaaucuuagga

SEQ ID NO: 1216347 - RNA, 19 nt, Homo sapiens
caaaaugaggcguaagaaa

SEQ ID NO: 1216348 - RNA, 19 nt, Homo sapiens
cggaggcauuccuagagaa

SEQ ID NO: 1216349 - RNA, 19 nt, Homo sapiens
gggcagaaccccucuuaga

SEQ ID NO: 1216350 - RNA, 19 nt, Homo sapiens
gaagucugucugccuuugu

SEQ ID NO: 1216351 - RNA, 19 nt, Homo sapiens
guggugcucucagggcaaa

SEQ ID NO: 1216352 - RNA, 19 nt, Homo sapiens
caagggugcccgcuacuac

SEQ ID NO: 1216353 - RNA, 19 nt, Homo sapiens
gaaugauggagauuucuac

SEQ ID NO: 1216354 - RNA, 19 nt, Homo sapiens
caaggaggcggaggcauuc

SEQ ID NO: 1216355 - RNA, 19 nt, Homo sapiens
ugaacuggccugagcaucu

SEQ ID NO: 1216356 - RNA, 19 nt, Homo sapiens
aucagugacuuguuugcua

SEQ ID NO: 1216357 - RNA, 19 nt, Homo sapiens
gcagcaaagccuccaucug

SEQ ID NO: 1216358 - RNA, 19 nt, Homo sapiens
gaaacugguggugcucuca

SEQ ID NO: 1216359 - RNA, 19 nt, Homo sapiens
caguuccuuucaagaggua

SEQ ID NO: 1216360 - RNA, 19 nt, Homo sapiens
cagcauugucuuugucugu

SEQ ID NO: 1216361 - RNA, 19 nt, Homo sapiens
ggaucaaucuuaggaaaag

SEQ ID NO: 1216362 - RNA, 19 nt, Homo sapiens
ggaggcauuccuagagaag

SEQ ID NO: 1216363 - RNA, 19 nt, Homo sapiens
ccguccagcucccaggaaa

SEQ ID NO: 1216364 - RNA, 19 nt, Homo sapiens
aagcgcacuucgaccaaga

SEQ ID NO: 1216365 - RNA, 19 nt, Homo sapiens
guaacaaaugguacaagca

SEQ ID NO: 1216366 - RNA, 19 nt, Homo sapiens
gcagaaccccucuuagaag

SEQ ID NO: 1216367 - RNA, 19 nt, Homo sapiens
gggagcgcccuguucugaa

SEQ ID NO: 1216368 - RNA, 19 nt, Homo sapiens
ucaagggugcccgcuacua

SEQ ID NO: 1216369 - RNA, 19 nt, Homo sapiens
caggaaagcuguucacuga

SEQ ID NO: 1216370 - RNA, 19 nt, Homo sapiens
gaggaucagugacuuguuu

SEQ ID NO: 1216371 - RNA, 19 nt, Homo sapiens
uuacagauaccaacaguua

SEQ ID NO: 1216372 - RNA, 19 nt, Homo sapiens
gcaaggaggcggaggcauu

SEQ ID NO: 1216373 - RNA, 19 nt, Homo sapiens
guaagaaacgcuuugcaaa

SEQ ID NO: 1216374 - RNA, 19 nt, Homo sapiens
ggaaagcuguucacugacu

SEQ ID NO: 1216375 - RNA, 19 nt, Homo sapiens
ggagauuucuacuucuuca

SEQ ID NO: 1216376 - RNA, 19 nt, Homo sapiens
uaacagcacugggauccaa

SEQ ID NO: 1216377 - RNA, 19 nt, Homo sapiens
ugauggagauuucuacuuc

SEQ ID NO: 1216378 - RNA, 19 nt, Homo sapiens
aaacgcagggcccuaaaua

SEQ ID NO: 1216379 - RNA, 19 nt, Homo sapiens
gaacuggccugagcaucug

SEQ ID NO: 1216380 - RNA, 19 nt, Homo sapiens
ccagaucccuuggcccuuu

SEQ ID NO: 1216381 - RNA, 19 nt, Homo sapiens
ggaagucugucugccuuug

SEQ ID NO: 1216382 - RNA, 19 nt, Homo sapiens
gcaaagcaagguaacaaau

SEQ ID NO: 1216383 - RNA, 19 nt, Homo sapiens
guacggauaccucaaugaa

SEQ ID NO: 1216384 - RNA, 19 nt, Homo sapiens
gaaagcuguucacugacuu

SEQ ID NO: 1216385 - RNA, 19 nt, Homo sapiens
ggugucauauuuagucaga

SEQ ID NO: 1216386 - RNA, 19 nt, Homo sapiens
gaaguacggauaccucaau

SEQ ID NO: 1216387 - RNA, 19 nt, Homo sapiens
caaagcaagguaacaaaug

SEQ ID NO: 1216388 - RNA, 19 nt, Homo sapiens
caucgugggcuccagcuua

SEQ ID NO: 1216389 - RNA, 19 nt, Homo sapiens
gcggaggcauuccuagaga

SEQ ID NO: 1216390 - RNA, 19 nt, Homo sapiens
ggagcgcccuguucugaag

SEQ ID NO: 1216391 - RNA, 19 nt, Homo sapiens
aaagcaagguaacaaaugg

SEQ ID NO: 1216392 - RNA, 19 nt, Homo sapiens
gcaagacugugcccuucuc

SEQ ID NO: 1216393 - RNA, 19 nt, Homo sapiens
cagaagaccgggcagcaaa

SEQ ID NO: 1216394 - RNA, 19 nt, Homo sapiens
aggcauuccuagagaagua

SEQ ID NO: 1216395 - RNA, 19 nt, Homo sapiens
aaacucagcagagaaauuc

SEQ ID NO: 1216396 - RNA, 19 nt, Homo sapiens
acggauaccucaaugaaca

SEQ ID NO: 1216397 - RNA, 19 nt, Homo sapiens
guacaguuccuuucaagag

SEQ ID NO: 1216398 - RNA, 19 nt, Homo sapiens
gaaacgcagggcccuaaau

SEQ ID NO: 1216399 - RNA, 19 nt, Homo sapiens
gcacuucgaccaagaugag

SEQ ID NO: 1216400 - RNA, 19 nt, Homo sapiens
gcuguucacugacuuugag

SEQ ID NO: 1216401 - RNA, 19 nt, Homo sapiens
ucucagcgcuggaguucug

SEQ ID NO: 1216402 - RNA, 19 nt, Homo sapiens
ugggaucaaucuuaggaaa

SEQ ID NO: 1216403 - RNA, 19 nt, Homo sapiens
gcaaguggagcccuacuac

SEQ ID NO: 1216404 - RNA, 19 nt, Homo sapiens
acaagcagcaccucuccua

SEQ ID NO: 1216405 - RNA, 19 nt, Homo sapiens
gcucccaccuccacucgau

SEQ ID NO: 1216406 - RNA, 19 nt, Homo sapiens
ggaccaaaaugaggcguaa

SEQ ID NO: 1216407 - RNA, 19 nt, Homo sapiens
gguuacagauaccaacagu

SEQ ID NO: 1216408 - RNA, 19 nt, Homo sapiens
gcagaagaccgggcagcaa

SEQ ID NO: 1216409 - RNA, 19 nt, Homo sapiens
ugaaugauggagauuucua

SEQ ID NO: 1216410 - RNA, 19 nt, Homo sapiens
ccuaaauacugccacucuu

SEQ ID NO: 1216411 - RNA, 19 nt, Homo sapiens
cguaagaaacgcuuugcaa

SEQ ID NO: 1216412 - RNA, 19 nt, Homo sapiens
cagagaaauucgagaccau

SEQ ID NO: 1216413 - RNA, 19 nt, Homo sapiens
gauuucuacuucuucaaag

SEQ ID NO: 1216414 - RNA, 19 nt, Homo sapiens
gauggagauuucuacuucu

SEQ ID NO: 1216415 - RNA, 19 nt, Homo sapiens
acagauaccaacaguuaug

SEQ ID NO: 1216416 - RNA, 19 nt, Homo sapiens
ggaggcggaggcauuccua

SEQ ID NO: 1216417 - RNA, 19 nt, Homo sapiens
cuaaauacugccacucuuc

SEQ ID NO: 1216418 - RNA, 19 nt, Homo sapiens
caagguaacaaaugguaca

SEQ ID NO: 1216419 - RNA, 19 nt, Homo sapiens
gagaggaucagugacuugu

SEQ ID NO: 1216420 - RNA, 19 nt, Homo sapiens
ggugggaucaaucuuagga

SEQ ID NO: 1216421 - RNA, 19 nt, Homo sapiens
caaaaugaggcguaagaaa

SEQ ID NO: 1216422 - RNA, 19 nt, Homo sapiens
cggaggcauuccuagagaa

SEQ ID NO: 1216423 - RNA, 19 nt, Homo sapiens
gggcagaaccccucuuaga

SEQ ID NO: 1216424 - RNA, 19 nt, Homo sapiens
gaagucugucugccuuugu

SEQ ID NO: 1216425 - RNA, 19 nt, Homo sapiens
guggugcucucagggcaaa

SEQ ID NO: 1216426 - RNA, 19 nt, Homo sapiens
caagggugcccgcuacuac

SEQ ID NO: 1216427 - RNA, 19 nt, Homo sapiens
gaaugauggagauuucuac

SEQ ID NO: 1216428 - RNA, 19 nt, Homo sapiens
caaggaggcggaggcauuc

SEQ ID NO: 1216429 - RNA, 19 nt, Homo sapiens
ugaacuggccugagcaucu

SEQ ID NO: 1216430 - RNA, 19 nt, Homo sapiens
aucagugacuuguuugcua

SEQ ID NO: 1216431 - RNA, 19 nt, Homo sapiens
gcagcaaagccuccaucug

SEQ ID NO: 1216432 - RNA, 19 nt, Homo sapiens
gaaacugguggugcucuca

SEQ ID NO: 1216433 - RNA, 19 nt, Homo sapiens
aaagugcaauccguuugau

SEQ ID NO: 1216434 - RNA, 19 nt, Homo sapiens
caguuccuuucaagaggua

SEQ ID NO: 1216435 - RNA, 19 nt, Homo sapiens
cagcauugucuuugucugu

SEQ ID NO: 1216436 - RNA, 19 nt, Homo sapiens
ggaucaaucuuaggaaaag

SEQ ID NO: 1216437 - RNA, 19 nt, Homo sapiens
ggaggcauuccuagagaag

SEQ ID NO: 1216438 - RNA, 19 nt, Homo sapiens
ccguccagcucccaggaaa

SEQ ID NO: 1216439 - RNA, 19 nt, Homo sapiens
aagcgcacuucgaccaaga

SEQ ID NO: 1216440 - RNA, 19 nt, Homo sapiens
guaacaaaugguacaagca

SEQ ID NO: 1216441 - RNA, 19 nt, Homo sapiens
ugauaugaauaccaaccau

SEQ ID NO: 1216442 - RNA, 19 nt, Homo sapiens
gcagaaccccucuuagaag

SEQ ID NO: 1216443 - RNA, 19 nt, Homo sapiens
gggagcgcccuguucugaa

SEQ ID NO: 1216444 - RNA, 19 nt, Homo sapiens
ucaagggugcccgcuacua

SEQ ID NO: 1216445 - RNA, 19 nt, Homo sapiens
aucgugggcuccagcuuaa

SEQ ID NO: 1216446 - RNA, 19 nt, Homo sapiens
gagaagagguuuacgugua

SEQ ID NO: 1216447 - RNA, 19 nt, Homo sapiens
ccagaugccuccuccauuu

SEQ ID NO: 1216448 - RNA, 19 nt, Homo sapiens
gagaaacccuacaaauguu

SEQ ID NO: 1216449 - RNA, 19 nt, Homo sapiens
gaggaagccuguguagaua

SEQ ID NO: 1216450 - RNA, 19 nt, Homo sapiens
ccaauaaacgaucaucuua

SEQ ID NO: 1216451 - RNA, 19 nt, Homo sapiens
gagagaaacccuacaaaug

SEQ ID NO: 1216452 - RNA, 19 nt, Homo sapiens
gaagagaacccaggacuga

SEQ ID NO: 1216453 - RNA, 19 nt, Homo sapiens
ggacucagauaucgagaug

SEQ ID NO: 1216454 - RNA, 19 nt, Homo sapiens
guuaucagaugacauuuga

SEQ ID NO: 1216455 - RNA, 19 nt, Homo sapiens
ggagaaggaucugaaggaa

SEQ ID NO: 1216456 - RNA, 19 nt, Homo sapiens
cuacaaauguuccaagugu

SEQ ID NO: 1216457 - RNA, 19 nt, Homo sapiens
ggagugcccuagauaugaa

SEQ ID NO: 1216458 - RNA, 19 nt, Homo sapiens
caagaagaagugaaugaua

SEQ ID NO: 1216459 - RNA, 19 nt, Homo sapiens
aaacucaacuuggaaauca

SEQ ID NO: 1216460 - RNA, 19 nt, Homo sapiens
ggagagaaacccuacaaau

SEQ ID NO: 1216461 - RNA, 19 nt, Homo sapiens
uaacagaagacccaagaaa

SEQ ID NO: 1216462 - RNA, 19 nt, Homo sapiens
acacaagaguauugacgua

SEQ ID NO: 1216463 - RNA, 19 nt, Homo sapiens
gaaugaacagugaaucuau

SEQ ID NO: 1216464 - RNA, 19 nt, Homo sapiens
caggauguuugaguaaaua

SEQ ID NO: 1216465 - RNA, 19 nt, Homo sapiens
agaagagccucaaggagaa

SEQ ID NO: 1216466 - RNA, 19 nt, Homo sapiens
ggagacuucugaaugaaca

SEQ ID NO: 1216467 - RNA, 19 nt, Homo sapiens
gaggaccugcuacgaaaua

SEQ ID NO: 1216468 - RNA, 19 nt, Homo sapiens
agagaaacccuacaaaugu

SEQ ID NO: 1216469 - RNA, 19 nt, Homo sapiens
gggacaagcugggaugaau

SEQ ID NO: 1216470 - RNA, 19 nt, Homo sapiens
gcaccaagaagaagugaau

SEQ ID NO: 1216471 - RNA, 19 nt, Homo sapiens
ccacggaaaggaauauauu

SEQ ID NO: 1216472 - RNA, 19 nt, Homo sapiens
gcuacgaaauaacagaaga

SEQ ID NO: 1216473 - RNA, 19 nt, Homo sapiens
uggaggaccugcuacgaaa

SEQ ID NO: 1216474 - RNA, 19 nt, Homo sapiens
ucacugagcugugccaucu

SEQ ID NO: 1216475 - RNA, 19 nt, Homo sapiens
ggacaagcugggaugaauu

SEQ ID NO: 1216476 - RNA, 19 nt, Homo sapiens
guuaagacgccaccagaaa

SEQ ID NO: 1216477 - RNA, 19 nt, Homo sapiens
agaaggaucugaaggaaaa

SEQ ID NO: 1216478 - RNA, 19 nt, Homo sapiens
caagaguauugacguaaca

SEQ ID NO: 1216479 - RNA, 19 nt, Homo sapiens
gagaggacuuucugcuaca

SEQ ID NO: 1216480 - RNA, 19 nt, Homo sapiens
uguaaagacugcaagaaag

SEQ ID NO: 1216481 - RNA, 19 nt, Homo sapiens
ccaagaagagccucaagga

SEQ ID NO: 1216482 - RNA, 19 nt, Homo sapiens
cgacguggacccugagauu

SEQ ID NO: 1216483 - RNA, 19 nt, Homo sapiens
gaacagugaaucuauuacu

SEQ ID NO: 1216484 - RNA, 19 nt, Homo sapiens
ccaaagagucccacagauc

SEQ ID NO: 1216485 - RNA, 19 nt, Homo sapiens
gagaaggaucugaaggaaa

SEQ ID NO: 1216486 - RNA, 19 nt, Homo sapiens
ccaggauguuugaguaaau

SEQ ID NO: 1216487 - RNA, 19 nt, Homo sapiens
gaauugccaggauguuuga

SEQ ID NO: 1216488 - RNA, 19 nt, Homo sapiens
guaaagacugcaagaaagu

SEQ ID NO: 1216489 - RNA, 19 nt, Homo sapiens
agaagcaguucacccagaa

SEQ ID NO: 1216490 - RNA, 19 nt, Homo sapiens
aagcugggaugaauucaau

SEQ ID NO: 1216491 - RNA, 19 nt, Homo sapiens
caaagagucccacagaucu

SEQ ID NO: 1216492 - RNA, 19 nt, Homo sapiens
gggagaggacuuucugcua

SEQ ID NO: 1216493 - RNA, 19 nt, Homo sapiens
acagaagacccaagaaaug

SEQ ID NO: 1216494 - RNA, 19 nt, Homo sapiens
cuuauuagccuccaauuuc

SEQ ID NO: 1216495 - RNA, 19 nt, Homo sapiens
gaggagacgcucugaaucu

SEQ ID NO: 1216496 - RNA, 19 nt, Homo sapiens
gccaggauguuugaguaaa

SEQ ID NO: 1216497 - RNA, 19 nt, Homo sapiens
gggagugcccuagauauga

SEQ ID NO: 1216498 - RNA, 19 nt, Homo sapiens
agaggaagccuguguagau

SEQ ID NO: 1216499 - RNA, 19 nt, Homo sapiens
cguaacaggugacccaaag

SEQ ID NO: 1216500 - RNA, 19 nt, Homo sapiens
gaaaacacauccagaagcu

SEQ ID NO: 1216501 - RNA, 19 nt, Homo sapiens
gaauguaaagacugcaaga

SEQ ID NO: 1216502 - RNA, 19 nt, Homo sapiens
ggaagccuguguagauagg

SEQ ID NO: 1216503 - RNA, 19 nt, Homo sapiens
gaaacucaacuuggaaauc

SEQ ID NO: 1216504 - RNA, 19 nt, Homo sapiens
ucuauggcauccucagaaa

SEQ ID NO: 1216505 - RNA, 19 nt, Homo sapiens
gagacucuuucaauguaau

SEQ ID NO: 1216506 - RNA, 19 nt, Homo sapiens
cacuagauauggcugcaaa

SEQ ID NO: 1216507 - RNA, 19 nt, Homo sapiens
ugaaugaacagugaaucua

SEQ ID NO: 1216508 - RNA, 19 nt, Homo sapiens
cauccaggcucugaggaaa

SEQ ID NO: 1216509 - RNA, 19 nt, Homo sapiens
ucacccggauggccaagaa

SEQ ID NO: 1216510 - RNA, 19 nt, Homo sapiens
caaauugcacauccucaug

SEQ ID NO: 1216511 - RNA, 19 nt, Homo sapiens
uuauuagccuccaauuuca

SEQ ID NO: 1216512 - RNA, 19 nt, Homo sapiens
gacaagcugggaugaauuc

SEQ ID NO: 1216513 - RNA, 19 nt, Homo sapiens
ggagacgcucugaaucuga

SEQ ID NO: 1216514 - RNA, 19 nt, Homo sapiens
gcuuauuagccuccaauuu

SEQ ID NO: 1216515 - RNA, 19 nt, Homo sapiens
uagauauggcugcaaauug

SEQ ID NO: 1216516 - RNA, 19 nt, Homo sapiens
gagccucagcuuccaaaga

SEQ ID NO: 1216517 - RNA, 19 nt, Homo sapiens
ugaauugccaggauguuug

SEQ ID NO: 1216518 - RNA, 19 nt, Homo sapiens
gcagggagaggacuuucug

SEQ ID NO: 1216519 - RNA, 19 nt, Homo sapiens
cccaggagcuccaggucuu

SEQ ID NO: 1216520 - RNA, 19 nt, Homo sapiens
cucagaaacucaacuugga

SEQ ID NO: 1216521 - RNA, 19 nt, Homo sapiens
uugcuguucuuccaauaaa

SEQ ID NO: 1216522 - RNA, 19 nt, Homo sapiens
cggcugaaauuguuaagac

SEQ ID NO: 1216523 - RNA, 19 nt, Homo sapiens
gagaaggucggaggcagaa

SEQ ID NO: 1216524 - RNA, 19 nt, Homo sapiens
cagaaacucaacuuggaaa

SEQ ID NO: 1216525 - RNA, 19 nt, Homo sapiens
uugccaggauguuugagua

SEQ ID NO: 1216526 - RNA, 19 nt, Homo sapiens
aaagacugcaagaaaguuu

SEQ ID NO: 1216527 - RNA, 19 nt, Homo sapiens
agagagaagcuucgacuca

SEQ ID NO: 1216528 - RNA, 19 nt, Homo sapiens
gaccugcuacgaaauaaca

SEQ ID NO: 1216529 - RNA, 19 nt, Homo sapiens
ccacugagcuuuguuuucu

SEQ ID NO: 1216530 - RNA, 19 nt, Homo sapiens
cauccacuccggagagaaa

SEQ ID NO: 1216531 - RNA, 19 nt, Homo sapiens
cuagauauggcugcaaauu

SEQ ID NO: 1216532 - RNA, 19 nt, Homo sapiens
caugugacgugugcgagaa

SEQ ID NO: 1216533 - RNA, 19 nt, Homo sapiens
gugcaggacucagauaucg

SEQ ID NO: 1216534 - RNA, 19 nt, Homo sapiens
cagaugacauuugacacau

SEQ ID NO: 1216535 - RNA, 19 nt, Homo sapiens
gacguggacccugagauuu

SEQ ID NO: 1216536 - RNA, 19 nt, Homo sapiens
ucagaugacauuugacaca

SEQ ID NO: 1216537 - RNA, 19 nt, Homo sapiens
uaucagaugacauuugaca

SEQ ID NO: 1216538 - RNA, 19 nt, Homo sapiens
uaacaggugacccaaaguc

SEQ ID NO: 1216539 - RNA, 19 nt, Homo sapiens
cuccaggucuuagucauga

SEQ ID NO: 1216540 - RNA, 19 nt, Homo sapiens
gagcugccacggucuaugg

SEQ ID NO: 1216541 - RNA, 19 nt, Homo sapiens
agauaugaauugccaggau

SEQ ID NO: 1216542 - RNA, 19 nt, Homo sapiens
uaaagacugcaagaaaguu

SEQ ID NO: 1216543 - RNA, 19 nt, Homo sapiens
cagaagacccaagaaaugg

SEQ ID NO: 1216544 - RNA, 19 nt, Homo sapiens
aauaacagaagacccaaga

SEQ ID NO: 1216545 - RNA, 19 nt, Homo sapiens
ccaagaagaagugaaugau

SEQ ID NO: 1216546 - RNA, 19 nt, Homo sapiens
aaacuacgguugugaaaua

SEQ ID NO: 1216547 - RNA, 19 nt, Homo sapiens
gcacuaaauugugggauua

SEQ ID NO: 1216548 - RNA, 19 nt, Homo sapiens
acaaagagcucucgcaaga

SEQ ID NO: 1216549 - RNA, 19 nt, Homo sapiens
gaagacagauccugcuaug

SEQ ID NO: 1216550 - RNA, 19 nt, Homo sapiens
ugacggaccuugugauuug

SEQ ID NO: 1216551 - RNA, 19 nt, Homo sapiens
gcucugagguggacaaaga

SEQ ID NO: 1216552 - RNA, 19 nt, Homo sapiens
ucuaugacaugacccauua

SEQ ID NO: 1216553 - RNA, 19 nt, Homo sapiens
gcggagcuauuuaaagauu

SEQ ID NO: 1216554 - RNA, 19 nt, Homo sapiens
ccacaaaccauuacuacuu

SEQ ID NO: 1216555 - RNA, 19 nt, Homo sapiens
ccaggacggucuuauuuau

SEQ ID NO: 1216556 - RNA, 19 nt, Homo sapiens
ccagauacauguucuuagu

SEQ ID NO: 1216557 - RNA, 19 nt, Homo sapiens
caucagaagucaggauuug

SEQ ID NO: 1216558 - RNA, 19 nt, Homo sapiens
cugcggagcuauuuaaaga

SEQ ID NO: 1216559 - RNA, 19 nt, Homo sapiens
cuaaagagaagcaguuuga

SEQ ID NO: 1216560 - RNA, 19 nt, Homo sapiens
cacaaaccauuacuacuug

SEQ ID NO: 1216561 - RNA, 19 nt, Homo sapiens
cgacagcuauuaccucauc

SEQ ID NO: 1216562 - RNA, 19 nt, Homo sapiens
aaagagcucucgcaagaag

SEQ ID NO: 1216563 - RNA, 19 nt, Homo sapiens
gcacggcacagcucgcuuu

SEQ ID NO: 1216564 - RNA, 19 nt, Homo sapiens
gcuauuaccucaucaugcu

SEQ ID NO: 1216565 - RNA, 19 nt, Homo sapiens
gacagauccugcuauggaa

SEQ ID NO: 1216566 - RNA, 19 nt, Homo sapiens
gauuugguaucagcacuaa

SEQ ID NO: 1216567 - RNA, 19 nt, Homo sapiens
uuuaggaccucgcagcuuu

SEQ ID NO: 1216568 - RNA, 19 nt, Homo sapiens
gguaucagcacuaaauugu

SEQ ID NO: 1216569 - RNA, 19 nt, Homo sapiens
ucacgucauuuacaacaga

SEQ ID NO: 1216570 - RNA, 19 nt, Homo sapiens
agacagauccugcuaugga

SEQ ID NO: 1216571 - RNA, 19 nt, Homo sapiens
ggagagaaguacgaugagu

SEQ ID NO: 1216572 - RNA, 19 nt, Homo sapiens
gaucggcgucuucuacuug

SEQ ID NO: 1216573 - RNA, 19 nt, Homo sapiens
uguaaaggcuaaagagaag

SEQ ID NO: 1216574 - RNA, 19 nt, Homo sapiens
cgacucuucacgucauuua

SEQ ID NO: 1216575 - RNA, 19 nt, Homo sapiens
cuugugauuuguacuguuu

SEQ ID NO: 1216576 - RNA, 19 nt, Homo sapiens
ugacaugacccauuacuac

SEQ ID NO: 1216577 - RNA, 19 nt, Homo sapiens
ucuggagccucaucgagua

SEQ ID NO: 1216578 - RNA, 19 nt, Homo sapiens
gguucaaagugguggauug

SEQ ID NO: 1216579 - RNA, 19 nt, Homo sapiens
ggucagacggcccuuucua

SEQ ID NO: 1216580 - RNA, 19 nt, Homo sapiens
cacccucacuccagagaaa

SEQ ID NO: 1216581 - RNA, 19 nt, Homo sapiens
gaagucaggauuugguauc

SEQ ID NO: 1216582 - RNA, 19 nt, Homo sapiens
gugucacccuugugccuua

SEQ ID NO: 1216583 - RNA, 19 nt, Homo sapiens
guguaaaggcuaaagagaa

SEQ ID NO: 1216584 - RNA, 19 nt, Homo sapiens
caggacggucuuauuuaua

SEQ ID NO: 1216585 - RNA, 19 nt, Homo sapiens
agucccagcugcuugcuuu

SEQ ID NO: 1216586 - RNA, 19 nt, Homo sapiens
ccacgucaagcaccacuuu

SEQ ID NO: 1216587 - RNA, 19 nt, Homo sapiens
uuucuaauccuacauguug

SEQ ID NO: 1216588 - RNA, 19 nt, Homo sapiens
gaaggagccaccucucagu

SEQ ID NO: 1216589 - RNA, 19 nt, Homo sapiens
uaaaccagauacauguucu

SEQ ID NO: 1216590 - RNA, 19 nt, Homo sapiens
uaaauugugggauuacugu

SEQ ID NO: 1216591 - RNA, 19 nt, Homo sapiens
cgccaaguguaaaggcuaa

SEQ ID NO: 1216592 - RNA, 19 nt, Homo sapiens
cccaggacggucuuauuua

SEQ ID NO: 1216593 - RNA, 19 nt, Homo sapiens
ugggcuacguccucuauga

SEQ ID NO: 1216594 - RNA, 19 nt, Homo sapiens
gucagacggcccuuucuaa

SEQ ID NO: 1216595 - RNA, 19 nt, Homo sapiens
gggcaacguccgacucuuc

SEQ ID NO: 1216596 - RNA, 19 nt, Homo sapiens
uaucucagcugguccuacu

SEQ ID NO: 1216597 - RNA, 19 nt, Homo sapiens
ucuacgaccucuccagcuu

SEQ ID NO: 1216598 - RNA, 19 nt, Homo sapiens
acaaaccauuacuacuuga

SEQ ID NO: 1216599 - RNA, 19 nt, Homo sapiens
aauccuacauguugagcuu

SEQ ID NO: 1216600 - RNA, 19 nt, Homo sapiens
agacggcccuuucuaaucc

SEQ ID NO: 1216601 - RNA, 19 nt, Homo sapiens
ucccaggacggucuuauuu

SEQ ID NO: 1216602 - RNA, 19 nt, Homo sapiens
ggauuugguaucagcacua

SEQ ID NO: 1216603 - RNA, 19 nt, Homo sapiens
caagggcuccuaccuguac

SEQ ID NO: 1216604 - RNA, 19 nt, Homo sapiens
gccuguagcccuugaggaa

SEQ ID NO: 1216605 - RNA, 19 nt, Homo sapiens
aaccagauacauguucuua

SEQ ID NO: 1216606 - RNA, 19 nt, Homo sapiens
aagaagagacagcgugaug

SEQ ID NO: 1216607 - RNA, 19 nt, Homo sapiens
gcacaucagaagucaggau

SEQ ID NO: 1216608 - RNA, 19 nt, Homo sapiens
cagaagacagauccugcua

SEQ ID NO: 1216609 - RNA, 19 nt, Homo sapiens
agauacauguucuuagucu

SEQ ID NO: 1216610 - RNA, 19 nt, Homo sapiens
ugggagagaaguacgauga

SEQ ID NO: 1216611 - RNA, 19 nt, Homo sapiens
ccaccugugucacccuugu

SEQ ID NO: 1216612 - RNA, 19 nt, Homo sapiens
cggagcuauuuaaagauuu

SEQ ID NO: 1216613 - RNA, 19 nt, Homo sapiens
caaguguaaaggcuaaaga

SEQ ID NO: 1216614 - RNA, 19 nt, Homo sapiens
ucagacggcccuuucuaau

SEQ ID NO: 1216615 - RNA, 19 nt, Homo sapiens
caaagagcucucgcaagaa

SEQ ID NO: 1216616 - RNA, 19 nt, Homo sapiens
cagaagucaggauuuggua

SEQ ID NO: 1216617 - RNA, 19 nt, Homo sapiens
gcaguuugacggaccuugu

SEQ ID NO: 1216618 - RNA, 19 nt, Homo sapiens
guuccuuucuuacccacaa

SEQ ID NO: 1216619 - RNA, 19 nt, Homo sapiens
cauguugagcuuauguaaa

SEQ ID NO: 1216620 - RNA, 19 nt, Homo sapiens
cagaaggagccaccucuca

SEQ ID NO: 1216621 - RNA, 19 nt, Homo sapiens
ccucaugggcugccuagga

SEQ ID NO: 1216622 - RNA, 19 nt, Homo sapiens
ccagcugcuugcuuuagga

SEQ ID NO: 1216623 - RNA, 19 nt, Homo sapiens
gaaacucagaagacagauc

SEQ ID NO: 1216624 - RNA, 19 nt, Homo sapiens
ggugaucggcgucuucuac

SEQ ID NO: 1216625 - RNA, 19 nt, Homo sapiens
gcagugcccaaguccaugu

SEQ ID NO: 1216626 - RNA, 19 nt, Homo sapiens
gcuaaagagaagcaguuug

SEQ ID NO: 1216627 - RNA, 19 nt, Homo sapiens
caaaccauuacuacuugaa

SEQ ID NO: 1216628 - RNA, 19 nt, Homo sapiens
cggcacagcucgcuuucac

SEQ ID NO: 1216629 - RNA, 19 nt, Homo sapiens
ccacuuugcacaucagaag

SEQ ID NO: 1216630 - RNA, 19 nt, Homo sapiens
cuacgguugugaaauaaaa

SEQ ID NO: 1216631 - RNA, 19 nt, Homo sapiens
gaagacgcagugacaacuc

SEQ ID NO: 1216632 - RNA, 19 nt, Homo sapiens
gcaccacuuugcacaucag

SEQ ID NO: 1216633 - RNA, 19 nt, Homo sapiens
gcuacguccucuaugacau

SEQ ID NO: 1216634 - RNA, 19 nt, Homo sapiens
cagacggcccuuucuaauc

SEQ ID NO: 1216635 - RNA, 19 nt, Homo sapiens
cagcucgcuuucacaguca

SEQ ID NO: 1216636 - RNA, 19 nt, Homo sapiens
ggagggucacauccacuug

SEQ ID NO: 1216637 - RNA, 19 nt, Homo sapiens
gaaggcccaccacgucaag

SEQ ID NO: 1216638 - RNA, 19 nt, Homo sapiens
cgucauuuacaacagagua

SEQ ID NO: 1216639 - RNA, 19 nt, Homo sapiens
agcacuaaauugugggauu

SEQ ID NO: 1216640 - RNA, 19 nt, Homo sapiens
aagcaccacuuugcacauc

SEQ ID NO: 1216641 - RNA, 19 nt, Homo sapiens
ccauuacuaccugcacuuu

SEQ ID NO: 1216642 - RNA, 19 nt, Homo sapiens
guccuacuaccgaaccuuu

SEQ ID NO: 1216643 - RNA, 19 nt, Homo sapiens
cacaucagaagucaggauu

SEQ ID NO: 1216644 - RNA, 19 nt, Homo sapiens
ugaucggcgucuucuacuu

SEQ ID NO: 1216645 - RNA, 19 nt, Homo sapiens
aggaaacucagaagacaga

SEQ ID NO: 1216646 - RNA, 19 nt, Homo sapiens
gagaagagcucggucauga

SEQ ID NO: 1216647 - RNA, 19 nt, Homo sapiens
gaacuccgcucucacauuc

SEQ ID NO: 1216648 - RNA, 19 nt, Homo sapiens
aggagaagcuggagguuua

SEQ ID NO: 1216649 - RNA, 19 nt, Homo sapiens
cgaaauggcugaucaugag

SEQ ID NO: 1216650 - RNA, 19 nt, Homo sapiens
guaaugaaaucaccaucug

SEQ ID NO: 1216651 - RNA, 19 nt, Homo sapiens
gcucuugccugaaccaguu

SEQ ID NO: 1216652 - RNA, 19 nt, Homo sapiens
ggacgccauucacuuccua

SEQ ID NO: 1216653 - RNA, 19 nt, Homo sapiens
caggaccuauuucccauuu

SEQ ID NO: 1216654 - RNA, 19 nt, Homo sapiens
cuggagagcugcuggagaa

SEQ ID NO: 1216655 - RNA, 19 nt, Homo sapiens
gaagagcucggucaugaag

SEQ ID NO: 1216656 - RNA, 19 nt, Homo sapiens
gcuaugaccguaaugaaau

SEQ ID NO: 1216657 - RNA, 19 nt, Homo sapiens
ccagaagccucgaggucuu

SEQ ID NO: 1216658 - RNA, 19 nt, Homo sapiens
gcucggucaugaagaaaug

SEQ ID NO: 1216659 - RNA, 19 nt, Homo sapiens
gccucgaggucuucuguuu

SEQ ID NO: 1216660 - RNA, 19 nt, Homo sapiens
ggacacccaugagcguaga

SEQ ID NO: 1216661 - RNA, 19 nt, Homo sapiens
uuaaugaagagucggauuu

SEQ ID NO: 1216662 - RNA, 19 nt, Homo sapiens
ucaaagggaagaacgaaga

SEQ ID NO: 1216663 - RNA, 19 nt, Homo sapiens
agagcucggucaugaagaa

SEQ ID NO: 1216664 - RNA, 19 nt, Homo sapiens
gaucaaagggaagaacgaa

SEQ ID NO: 1216665 - RNA, 19 nt, Homo sapiens
gggugcugcuuuccuacua

SEQ ID NO: 1216666 - RNA, 19 nt, Homo sapiens
gagacgcuaugaccguaau

SEQ ID NO: 1216667 - RNA, 19 nt, Homo sapiens
gaagaacgaagagcucauc

SEQ ID NO: 1216668 - RNA, 19 nt, Homo sapiens
uuccagagguuuccaagga

SEQ ID NO: 1216669 - RNA, 19 nt, Homo sapiens
caagggacgccauucacuu

SEQ ID NO: 1216670 - RNA, 19 nt, Homo sapiens
cacaauaagccgaggauuc

SEQ ID NO: 1216671 - RNA, 19 nt, Homo sapiens
gauagcaggcuuggugaga

SEQ ID NO: 1216672 - RNA, 19 nt, Homo sapiens
gcacaucccgccacgaacu

SEQ ID NO: 1216673 - RNA, 19 nt, Homo sapiens
uggcugugguuucgaaaug

SEQ ID NO: 1216674 - RNA, 19 nt, Homo sapiens
ggaccuauuucccauuuuc

SEQ ID NO: 1216675 - RNA, 19 nt, Homo sapiens
ggcacuaccuggacaacca

SEQ ID NO: 1216676 - RNA, 19 nt, Homo sapiens
guagagaucaaagggaaga

SEQ ID NO: 1216677 - RNA, 19 nt, Homo sapiens
gcuaugccaugcucuccau

SEQ ID NO: 1216678 - RNA, 19 nt, Homo sapiens
gcuggagguuuacuucucu

SEQ ID NO: 1216679 - RNA, 19 nt, Homo sapiens
ucugggugcugcuuuccua

SEQ ID NO: 1216680 - RNA, 19 nt, Homo sapiens
gauucugggugcugcuuuc

SEQ ID NO: 1216681 - RNA, 19 nt, Homo sapiens
ggagaagagcucggucaug

SEQ ID NO: 1216682 - RNA, 19 nt, Homo sapiens
gccaugcucuccaucuucu

SEQ ID NO: 1216683 - RNA, 19 nt, Homo sapiens
gaggucuucuguuucucuu

SEQ ID NO: 1216684 - RNA, 19 nt, Homo sapiens
gugguggugucacaugaug

SEQ ID NO: 1216685 - RNA, 19 nt, Homo sapiens
aauauuugccuuucgauca

SEQ ID NO: 1216686 - RNA, 19 nt, Homo sapiens
uuuggugccuuaaugaaga

SEQ ID NO: 1216687 - RNA, 19 nt, Homo sapiens
cccaaucccugagaaguuc

SEQ ID NO: 1216688 - RNA, 19 nt, Homo sapiens
acaauaagccgaggauucu

SEQ ID NO: 1216689 - RNA, 19 nt, Homo sapiens
cgaacuccgcucucacauu

SEQ ID NO: 1216690 - RNA, 19 nt, Homo sapiens
gccacgaacuccgcucuca

SEQ ID NO: 1216691 - RNA, 19 nt, Homo sapiens
gcaagggacgccauucacu

SEQ ID NO: 1216692 - RNA, 19 nt, Homo sapiens
ugcccaggcugccauguga

SEQ ID NO: 1216693 - RNA, 19 nt, Homo sapiens
guuauuggcugugguuucg

SEQ ID NO: 1216694 - RNA, 19 nt, Homo sapiens
ucaucaacaggaccuauuu

SEQ ID NO: 1216695 - RNA, 19 nt, Homo sapiens
ggucguggacugcaucaca

SEQ ID NO: 1216696 - RNA, 19 nt, Homo sapiens
gagagcugcuggagaacac

SEQ ID NO: 1216697 - RNA, 19 nt, Homo sapiens
ucgaaauggcugaucauga

SEQ ID NO: 1216698 - RNA, 19 nt, Homo sapiens
ggugucacaugaugagaac

SEQ ID NO: 1216699 - RNA, 19 nt, Homo sapiens
auauuugccuuucgaucaa

SEQ ID NO: 1216700 - RNA, 19 nt, Homo sapiens
cagcaagggacgccauuca

SEQ ID NO: 1216701 - RNA, 19 nt, Homo sapiens
guuucgaaauggcugauca

SEQ ID NO: 1216702 - RNA, 19 nt, Homo sapiens
gaguggugguggugucaca

SEQ ID NO: 1216703 - RNA, 19 nt, Homo sapiens
uccuggagcucgacuguca

SEQ ID NO: 1216704 - RNA, 19 nt, Homo sapiens
uggcugaucaugaggaaga

SEQ ID NO: 1216705 - RNA, 19 nt, Homo sapiens
uauuggcugugguuucgaa

SEQ ID NO: 1216706 - RNA, 19 nt, Homo sapiens
uggaggccauggagaagug

SEQ ID NO: 1216707 - RNA, 19 nt, Homo sapiens
ggagagcugcuggagaaca

SEQ ID NO: 1216708 - RNA, 19 nt, Homo sapiens
ccaguuauuggcugugguu

SEQ ID NO: 1216709 - RNA, 19 nt, Homo sapiens
cuaugaccguaaugaaauc

SEQ ID NO: 1216710 - RNA, 19 nt, Homo sapiens
ccaugagcguagagaucaa

SEQ ID NO: 1216711 - RNA, 19 nt, Homo sapiens
cgcuaugaccguaaugaaa

SEQ ID NO: 1216712 - RNA, 19 nt, Homo sapiens
ucaaauugcuucaguugua

SEQ ID NO: 1216713 - RNA, 19 nt, Homo sapiens
gaugugaccuaucaaauga

SEQ ID NO: 1216714 - RNA, 19 nt, Homo sapiens
gaaaggaguuguggccaaa

SEQ ID NO: 1216715 - RNA, 19 nt, Homo sapiens
gcacagcgguguagacauc

SEQ ID NO: 1216716 - RNA, 19 nt, Homo sapiens
ggucaucccuccacucuga

SEQ ID NO: 1216717 - RNA, 19 nt, Homo sapiens
cuacagaugugaccuauca

SEQ ID NO: 1216718 - RNA, 19 nt, Homo sapiens
ggagcuggcugcugaaugu

SEQ ID NO: 1216719 - RNA, 19 nt, Homo sapiens
ccuuauaucuguguuguua

SEQ ID NO: 1216720 - RNA, 19 nt, Homo sapiens
gagggaggccuucaccuua

SEQ ID NO: 1216721 - RNA, 19 nt, Homo sapiens
guagacaucugcaucaaca

SEQ ID NO: 1216722 - RNA, 19 nt, Homo sapiens
gcaaaugaagugucucaaa

SEQ ID NO: 1216723 - RNA, 19 nt, Homo sapiens
gcacaucauuaacaucaau

SEQ ID NO: 1216724 - RNA, 19 nt, Homo sapiens
caaauugcuucaguuguaa

SEQ ID NO: 1216725 - RNA, 19 nt, Homo sapiens
gagguggugucccuaauug

SEQ ID NO: 1216726 - RNA, 19 nt, Homo sapiens
caaaugaagugucucaaac

SEQ ID NO: 1216727 - RNA, 19 nt, Homo sapiens
gggaggccuucaccuuaua

SEQ ID NO: 1216728 - RNA, 19 nt, Homo sapiens
gauuucauggugaucauua

SEQ ID NO: 1216729 - RNA, 19 nt, Homo sapiens
ggccgaggcuguuaucuac

SEQ ID NO: 1216730 - RNA, 19 nt, Homo sapiens
gggcacaucauuaacauca

SEQ ID NO: 1216731 - RNA, 19 nt, Homo sapiens
ggagguggugucccuaauu

SEQ ID NO: 1216732 - RNA, 19 nt, Homo sapiens
gagcaaaugaagugucuca

SEQ ID NO: 1216733 - RNA, 19 nt, Homo sapiens
gauuuuagguguugauuuc

SEQ ID NO: 1216734 - RNA, 19 nt, Homo sapiens
cuuguuaacuuguucuugu

SEQ ID NO: 1216735 - RNA, 19 nt, Homo sapiens
cgacaaggacccugagaag

SEQ ID NO: 1216736 - RNA, 19 nt, Homo sapiens
agacacaauucgccuucaa

SEQ ID NO: 1216737 - RNA, 19 nt, Homo sapiens
cagagggacugaggcaaga

SEQ ID NO: 1216738 - RNA, 19 nt, Homo sapiens
gaucacgggauaccacuuc

SEQ ID NO: 1216739 - RNA, 19 nt, Homo sapiens
gccuucaccuuauaucugu

SEQ ID NO: 1216740 - RNA, 19 nt, Homo sapiens
gguggugucccuaauuguu

SEQ ID NO: 1216741 - RNA, 19 nt, Homo sapiens
cucagugucuucccuuuga

SEQ ID NO: 1216742 - RNA, 19 nt, Homo sapiens
caaaauccccaucuucuug

SEQ ID NO: 1216743 - RNA, 19 nt, Homo sapiens
ccuaugagcaaaugaagug

SEQ ID NO: 1216744 - RNA, 19 nt, Homo sapiens
acaauucgccuucaaacuc

SEQ ID NO: 1216745 - RNA, 19 nt, Homo sapiens
gacacaauucgccuucaaa

SEQ ID NO: 1216746 - RNA, 19 nt, Homo sapiens
guucucagcuauccguucu

SEQ ID NO: 1216747 - RNA, 19 nt, Homo sapiens
uugcuucaguuguaaaugu

SEQ ID NO: 1216748 - RNA, 19 nt, Homo sapiens
ucuauagugccaccaagua

SEQ ID NO: 1216749 - RNA, 19 nt, Homo sapiens
gcccagucuuggcuucuug

SEQ ID NO: 1216750 - RNA, 19 nt, Homo sapiens
gauguggccgaggcuguua

SEQ ID NO: 1216751 - RNA, 19 nt, Homo sapiens
ccaccuaugagcaaaugaa

SEQ ID NO: 1216752 - RNA, 19 nt, Homo sapiens
guggugucccuaauuguuu

SEQ ID NO: 1216753 - RNA, 19 nt, Homo sapiens
ccgcacacauccagauugg

SEQ ID NO: 1216754 - RNA, 19 nt, Homo sapiens
agggaggccuucaccuuau

SEQ ID NO: 1216755 - RNA, 19 nt, Homo sapiens
agaugugaccuaucaaaug

SEQ ID NO: 1216756 - RNA, 19 nt, Homo sapiens
gagacacaauucgccuuca

SEQ ID NO: 1216757 - RNA, 19 nt, Homo sapiens
caccuuauaucuguguugu

SEQ ID NO: 1216758 - RNA, 19 nt, Homo sapiens
acagaugugaccuaucaaa

SEQ ID NO: 1216759 - RNA, 19 nt, Homo sapiens
ucugugacccacuucuaua

SEQ ID NO: 1216760 - RNA, 19 nt, Homo sapiens
ccacucugacucugacuau

SEQ ID NO: 1216761 - RNA, 19 nt, Homo sapiens
gguguagacaucugcauca

SEQ ID NO: 1216762 - RNA, 19 nt, Homo sapiens
auccagggcuccagacuuc

SEQ ID NO: 1216763 - RNA, 19 nt, Homo sapiens
cagaugugaccuaucaaau

SEQ ID NO: 1216764 - RNA, 19 nt, Homo sapiens
ugucaaauugcuucaguug

SEQ ID NO: 1216765 - RNA, 19 nt, Homo sapiens
gaagccuaccaguccauga

SEQ ID NO: 1216766 - RNA, 19 nt, Homo sapiens
ccuucaaacuccacgacaa

SEQ ID NO: 1216767 - RNA, 19 nt, Homo sapiens
uggaaggacauguucaaug

SEQ ID NO: 1216768 - RNA, 19 nt, Homo sapiens
ggaggccuucaccuuauau

SEQ ID NO: 1216769 - RNA, 19 nt, Homo sapiens
ucucagcuauccguucuca

SEQ ID NO: 1216770 - RNA, 19 nt, Homo sapiens
ggauguggccgaggcuguu

SEQ ID NO: 1216771 - RNA, 19 nt, Homo sapiens
guguagacaucugcaucaa

SEQ ID NO: 1216772 - RNA, 19 nt, Homo sapiens
agacaucugcaucaacaau

SEQ ID NO: 1216773 - RNA, 19 nt, Homo sapiens
gacaucugcaucaacaaug

SEQ ID NO: 1216774 - RNA, 19 nt, Homo sapiens
gccuuugucugcucucagu

SEQ ID NO: 1216775 - RNA, 19 nt, Homo sapiens
gcuggcugcugaauguaag

SEQ ID NO: 1216776 - RNA, 19 nt, Homo sapiens
ggagcggaauguggacgau

SEQ ID NO: 1216777 - RNA, 19 nt, Homo sapiens
gcacugugggcaacaucga

SEQ ID NO: 1216778 - RNA, 19 nt, Homo sapiens
agagggaggccuucaccuu

SEQ ID NO: 1216779 - RNA, 19 nt, Homo sapiens
caccaaguaugccgucacu

SEQ ID NO: 1216780 - RNA, 19 nt, Homo sapiens
ggccuucaccuuauaucug

SEQ ID NO: 1216781 - RNA, 19 nt, Homo sapiens
guuggaaggacauguucaa

SEQ ID NO: 1216782 - RNA, 19 nt, Homo sapiens
ugacaugggaaaggaguug

SEQ ID NO: 1216783 - RNA, 19 nt, Homo sapiens
uggccgaggcuguuaucua

SEQ ID NO: 1216784 - RNA, 19 nt, Homo sapiens
gcugccaccuaugagcaaa

SEQ ID NO: 1216785 - RNA, 19 nt, Homo sapiens
cuauagugccaccaaguau

SEQ ID NO: 1216786 - RNA, 19 nt, Homo sapiens
ggcacaucauuaacaucaa

SEQ ID NO: 1216787 - RNA, 19 nt, Homo sapiens
ggaagaaaaucgacuguua

SEQ ID NO: 1216788 - RNA, 19 nt, Homo sapiens
ccacaugucugcacugaga

SEQ ID NO: 1216789 - RNA, 19 nt, Homo sapiens
gcacugagaaacugcauuu

SEQ ID NO: 1216790 - RNA, 19 nt, Homo sapiens
gagcaaaacugccaaguau

SEQ ID NO: 1216791 - RNA, 19 nt, Homo sapiens
ccagucaaauggaguauug

SEQ ID NO: 1216792 - RNA, 19 nt, Homo sapiens
ggguugagcucuacugaga

SEQ ID NO: 1216793 - RNA, 19 nt, Homo sapiens
gaaccagucaaauggagua

SEQ ID NO: 1216794 - RNA, 19 nt, Homo sapiens
gcaaaacugccaaguauuu

SEQ ID NO: 1216795 - RNA, 19 nt, Homo sapiens
aacagcagauucucgcuua

SEQ ID NO: 1216796 - RNA, 19 nt, Homo sapiens
gcacucugaucguucacuu

SEQ ID NO: 1216797 - RNA, 19 nt, Homo sapiens
acagacaguuggaagagaa

SEQ ID NO: 1216798 - RNA, 19 nt, Homo sapiens
gaagaaaaucgacuguuaa

SEQ ID NO: 1216799 - RNA, 19 nt, Homo sapiens
gauucucgcuuacaaggau

SEQ ID NO: 1216800 - RNA, 19 nt, Homo sapiens
gcauuucaguagcauuugu

SEQ ID NO: 1216801 - RNA, 19 nt, Homo sapiens
gaaaaucgacuguuaaaac

SEQ ID NO: 1216802 - RNA, 19 nt, Homo sapiens
caaaguaggauucaagaac

SEQ ID NO: 1216803 - RNA, 19 nt, Homo sapiens
ugacugagcgacuagaaga

SEQ ID NO: 1216804 - RNA, 19 nt, Homo sapiens
gaacgacagcaugcacaaa

SEQ ID NO: 1216805 - RNA, 19 nt, Homo sapiens
aaaguaggauucaagaacu

SEQ ID NO: 1216806 - RNA, 19 nt, Homo sapiens
cagggugggugcucucaga

SEQ ID NO: 1216807 - RNA, 19 nt, Homo sapiens
gaacgggcucaaaguagga

SEQ ID NO: 1216808 - RNA, 19 nt, Homo sapiens
gaggcugacugagcgacua

SEQ ID NO: 1216809 - RNA, 19 nt, Homo sapiens
agaguguuauugagaaguu

SEQ ID NO: 1216810 - RNA, 19 nt, Homo sapiens
aagcacacuuacuuuauuc

SEQ ID NO: 1216811 - RNA, 19 nt, Homo sapiens
gauucacgcugggagcaaa

SEQ ID NO: 1216812 - RNA, 19 nt, Homo sapiens
gucagcaucuggccaagug

SEQ ID NO: 1216813 - RNA, 19 nt, Homo sapiens
aaauugagaggcugacuga

SEQ ID NO: 1216814 - RNA, 19 nt, Homo sapiens
gcucaaaguaggauucaag

SEQ ID NO: 1216815 - RNA, 19 nt, Homo sapiens
gcccagaugcgccaggaaa

SEQ ID NO: 1216816 - RNA, 19 nt, Homo sapiens
gccgacgcauuagagcuua

SEQ ID NO: 1216817 - RNA, 19 nt, Homo sapiens
uugagaaguugcaggaaga

SEQ ID NO: 1216818 - RNA, 19 nt, Homo sapiens
ggccaagugucuggaugaa

SEQ ID NO: 1216819 - RNA, 19 nt, Homo sapiens
cagaugcgccaggaaauug

SEQ ID NO: 1216820 - RNA, 19 nt, Homo sapiens
aaaugacugugccgaagug

SEQ ID NO: 1216821 - RNA, 19 nt, Homo sapiens
ccacaugugucagcaucug

SEQ ID NO: 1216822 - RNA, 19 nt, Homo sapiens
ccuguucuauggaauaaag

SEQ ID NO: 1216823 - RNA, 19 nt, Homo sapiens
ugccauggguugagcucua

SEQ ID NO: 1216824 - RNA, 19 nt, Homo sapiens
ccagaugcgccaggaaauu

SEQ ID NO: 1216825 - RNA, 19 nt, Homo sapiens
gggaacgggcucaaaguag

SEQ ID NO: 1216826 - RNA, 19 nt, Homo sapiens
cauccuguucuauggaaua

SEQ ID NO: 1216827 - RNA, 19 nt, Homo sapiens
ggagcaaaacugccaagua

SEQ ID NO: 1216828 - RNA, 19 nt, Homo sapiens
cgggaacgggcucaaagua

SEQ ID NO: 1216829 - RNA, 19 nt, Homo sapiens
gagggagucacuuguaugg

SEQ ID NO: 1216830 - RNA, 19 nt, Homo sapiens
cugagggagucacuuguau

SEQ ID NO: 1216831 - RNA, 19 nt, Homo sapiens
gggugcagaugcuggaaca

SEQ ID NO: 1216832 - RNA, 19 nt, Homo sapiens
agcccgagcugaugaggaa

SEQ ID NO: 1216833 - RNA, 19 nt, Homo sapiens
ucauccagccggaaguuaa

SEQ ID NO: 1216834 - RNA, 19 nt, Homo sapiens
aauaaagcgucgccucucu

SEQ ID NO: 1216835 - RNA, 19 nt, Homo sapiens
gaucgggaacgggcucaaa

SEQ ID NO: 1216836 - RNA, 19 nt, Homo sapiens
ccaaguggcagcgcuacaa

SEQ ID NO: 1216837 - RNA, 19 nt, Homo sapiens
uccagaguguuauugagaa

SEQ ID NO: 1216838 - RNA, 19 nt, Homo sapiens
ccugagggagucacuugua

SEQ ID NO: 1216839 - RNA, 19 nt, Homo sapiens
ccagaguguuauugagaag

SEQ ID NO: 1216840 - RNA, 19 nt, Homo sapiens
guccagaguguuauugaga

SEQ ID NO: 1216841 - RNA, 19 nt, Homo sapiens
cauccagccggaaguuaaa

SEQ ID NO: 1216842 - RNA, 19 nt, Homo sapiens
cgacagcaugcacaaagga

SEQ ID NO: 1216843 - RNA, 19 nt, Homo sapiens
aguuaaagcacacuuacuu

SEQ ID NO: 1216844 - RNA, 19 nt, Homo sapiens
cugcauuucaguagcauuu

SEQ ID NO: 1216845 - RNA, 19 nt, Homo sapiens
ccucgaaccagucaaaugg

SEQ ID NO: 1216846 - RNA, 19 nt, Homo sapiens
ugacugugccgaagugaag

SEQ ID NO: 1216847 - RNA, 19 nt, Homo sapiens
cagcaugcacaaaggaaug

SEQ ID NO: 1216848 - RNA, 19 nt, Homo sapiens
ucaaaguaggauucaagaa

SEQ ID NO: 1216849 - RNA, 19 nt, Homo sapiens
uaaaugacugugccgaagu

SEQ ID NO: 1216850 - RNA, 19 nt, Homo sapiens
gagaaguugcaggaagaaa

SEQ ID NO: 1216851 - RNA, 19 nt, Homo sapiens
gacagcaugcacaaaggaa

SEQ ID NO: 1216852 - RNA, 19 nt, Homo sapiens
caaggccccuagaauaguu

SEQ ID NO: 1216853 - RNA, 19 nt, Homo sapiens
acucugaucguucacuuug

SEQ ID NO: 1216854 - RNA, 19 nt, Homo sapiens
uucaagaacuggaggaaaa

SEQ ID NO: 1216855 - RNA, 19 nt, Homo sapiens
gaaguugcaggaagaaaau

SEQ ID NO: 1216856 - RNA, 19 nt, Homo sapiens
ugucugcacugagaaacug

SEQ ID NO: 1216857 - RNA, 19 nt, Homo sapiens
gaguguuauugagaaguug

SEQ ID NO: 1216858 - RNA, 19 nt, Homo sapiens
gcagauucucgcuuacaag

SEQ ID NO: 1216859 - RNA, 19 nt, Homo sapiens
uaaaacagaaggugacuca

SEQ ID NO: 1216860 - RNA, 19 nt, Homo sapiens
gguaaugccuuucccuuca

SEQ ID NO: 1216861 - RNA, 19 nt, Homo sapiens
ggacucaguugcaagaaca

SEQ ID NO: 1216862 - RNA, 19 nt, Homo sapiens
ccacaggucuugguaacaa

SEQ ID NO: 1216863 - RNA, 19 nt, Homo sapiens
gguaacaaacgccaccuua

SEQ ID NO: 1216864 - RNA, 19 nt, Homo sapiens
gccaagaaccgcuggauga

SEQ ID NO: 1216865 - RNA, 19 nt, Homo sapiens
ccagcugucucaugccuuu

SEQ ID NO: 1216866 - RNA, 19 nt, Homo sapiens
gagggugacugugcuguga

SEQ ID NO: 1216867 - RNA, 19 nt, Homo sapiens
caagagggcagcuccagaa

SEQ ID NO: 1216868 - RNA, 19 nt, Homo sapiens
uaacaaacgccaccuuaca

SEQ ID NO: 1216869 - RNA, 19 nt, Homo sapiens
aagaaccgcuggaugauca

SEQ ID NO: 1216870 - RNA, 19 nt, Homo sapiens
gcgcaucuucuuccucuuu

SEQ ID NO: 1216871 - RNA, 19 nt, Homo sapiens
ggaauggauuagccacauc

SEQ ID NO: 1216872 - RNA, 19 nt, Homo sapiens
uuaacgacauccuggugua

SEQ ID NO: 1216873 - RNA, 19 nt, Homo sapiens
gcaucuucuuccucuuuaa

SEQ ID NO: 1216874 - RNA, 19 nt, Homo sapiens
gaagacaggaugggagugu

SEQ ID NO: 1216875 - RNA, 19 nt, Homo sapiens
gaucaagacggccaagaag

SEQ ID NO: 1216876 - RNA, 19 nt, Homo sapiens
cuacggagcgccaggaaug

SEQ ID NO: 1216877 - RNA, 19 nt, Homo sapiens
cgcaucuucuuccucuuua

SEQ ID NO: 1216878 - RNA, 19 nt, Homo sapiens
ccaaagagugccgcaagaa

SEQ ID NO: 1216879 - RNA, 19 nt, Homo sapiens
gagcagguuugggaacaca

SEQ ID NO: 1216880 - RNA, 19 nt, Homo sapiens
ccagcagcguggaguucua

SEQ ID NO: 1216881 - RNA, 19 nt, Homo sapiens
gagcgccaggaauggauua

SEQ ID NO: 1216882 - RNA, 19 nt, Homo sapiens
caaagagugccgcaagaag

SEQ ID NO: 1216883 - RNA, 19 nt, Homo sapiens
ggucagcgaaaccauuguu

SEQ ID NO: 1216884 - RNA, 19 nt, Homo sapiens
uggcuucacugcagguaau

SEQ ID NO: 1216885 - RNA, 19 nt, Homo sapiens
cagagcagguuugggaaca

SEQ ID NO: 1216886 - RNA, 19 nt, Homo sapiens
ucaagacggccaagaaguc

SEQ ID NO: 1216887 - RNA, 19 nt, Homo sapiens
ugaucaagacggccaagaa

SEQ ID NO: 1216888 - RNA, 19 nt, Homo sapiens
guaaugccuuucccuucag

SEQ ID NO: 1216889 - RNA, 19 nt, Homo sapiens
ucaguugcaagaacagaaa

SEQ ID NO: 1216890 - RNA, 19 nt, Homo sapiens
cacaggucuugguaacaaa

SEQ ID NO: 1216891 - RNA, 19 nt, Homo sapiens
ccaguggagaugacgauga

SEQ ID NO: 1216892 - RNA, 19 nt, Homo sapiens
cgacaaggccacggacauc

SEQ ID NO: 1216893 - RNA, 19 nt, Homo sapiens
cacugcagguaaugccuuu

SEQ ID NO: 1216894 - RNA, 19 nt, Homo sapiens
aagacaggaugggagugua

SEQ ID NO: 1216895 - RNA, 19 nt, Homo sapiens
gcagguuugggaacacaga

SEQ ID NO: 1216896 - RNA, 19 nt, Homo sapiens
ccaagaaccgcuggaugau

SEQ ID NO: 1216897 - RNA, 19 nt, Homo sapiens
accaaagagugccgcaaga

SEQ ID NO: 1216898 - RNA, 19 nt, Homo sapiens
aaacgccaccuuacacucu

SEQ ID NO: 1216899 - RNA, 19 nt, Homo sapiens
uaacgacauccugguguau

SEQ ID NO: 1216900 - RNA, 19 nt, Homo sapiens
caagaaccgcuggaugauc

SEQ ID NO: 1216901 - RNA, 19 nt, Homo sapiens
gcucaacaagcgcaaguac

SEQ ID NO: 1216902 - RNA, 19 nt, Homo sapiens
caguggagaugacgaugac

SEQ ID NO: 1216903 - RNA, 19 nt, Homo sapiens
ggagcgccaggaauggauu

SEQ ID NO: 1216904 - RNA, 19 nt, Homo sapiens
ggagacagcugcuuuaaua

SEQ ID NO: 1216905 - RNA, 19 nt, Homo sapiens
ggaguugccuuuauguuua

SEQ ID NO: 1216906 - RNA, 19 nt, Homo sapiens
ggaauuaacuuucuucucu

SEQ ID NO: 1216907 - RNA, 19 nt, Homo sapiens
gcagagauguguuggguuu

SEQ ID NO: 1216908 - RNA, 19 nt, Homo sapiens
aaacacagcuggacacaga

SEQ ID NO: 1216909 - RNA, 19 nt, Homo sapiens
ggaagauccugccuugauu

SEQ ID NO: 1216910 - RNA, 19 nt, Homo sapiens
gaaacugccugacaaucaa

SEQ ID NO: 1216911 - RNA, 19 nt, Homo sapiens
gcaacuaccuucuccuuca

SEQ ID NO: 1216912 - RNA, 19 nt, Homo sapiens
gagaugcuccuucuuagua

SEQ ID NO: 1216913 - RNA, 19 nt, Homo sapiens
cagcauggcuauuaucuau

SEQ ID NO: 1216914 - RNA, 19 nt, Homo sapiens
caaggaaacugccugacaa

SEQ ID NO: 1216915 - RNA, 19 nt, Homo sapiens
gcaaguagaauaagggaaa

SEQ ID NO: 1216916 - RNA, 19 nt, Homo sapiens
ggacacguaugaccucaga

SEQ ID NO: 1216917 - RNA, 19 nt, Homo sapiens
gaguugguguucaaguuua

SEQ ID NO: 1216918 - RNA, 19 nt, Homo sapiens
gauccugccuugauuuaga

SEQ ID NO: 1216919 - RNA, 19 nt, Homo sapiens
gaaauccaguugugcuguu

SEQ ID NO: 1216920 - RNA, 19 nt, Homo sapiens
gagccgagaucgugccauu

SEQ ID NO: 1216921 - RNA, 19 nt, Homo sapiens
gaccucaacucucuauguu

SEQ ID NO: 1216922 - RNA, 19 nt, Homo sapiens
ggaacaauuucuuucuuca

SEQ ID NO: 1216923 - RNA, 19 nt, Homo sapiens
ggaaacugccugacaauca

SEQ ID NO: 1216924 - RNA, 19 nt, Homo sapiens
gcuguucugucaacuguaa

SEQ ID NO: 1216925 - RNA, 19 nt, Homo sapiens
ggaaagcuguucugucaac

SEQ ID NO: 1216926 - RNA, 19 nt, Homo sapiens
uuauacaggucuggaauua

SEQ ID NO: 1216927 - RNA, 19 nt, Homo sapiens
gaucuucacuauauauugg

SEQ ID NO: 1216928 - RNA, 19 nt, Homo sapiens
ggacaguucuauucuuucu

SEQ ID NO: 1216929 - RNA, 19 nt, Homo sapiens
ccucaacucucuauguuug

SEQ ID NO: 1216930 - RNA, 19 nt, Homo sapiens
gaagauccugccuugauuu

SEQ ID NO: 1216931 - RNA, 19 nt, Homo sapiens
ccuuugaucuucacuauau

SEQ ID NO: 1216932 - RNA, 19 nt, Homo sapiens
caucaaauccagcaaagaa

SEQ ID NO: 1216933 - RNA, 19 nt, Homo sapiens
gaagaagucgccuuugauc

SEQ ID NO: 1216934 - RNA, 19 nt, Homo sapiens
uggaagaagucgccuuuga

SEQ ID NO: 1216935 - RNA, 19 nt, Homo sapiens
guaauaaugggaagcauau

SEQ ID NO: 1216936 - RNA, 19 nt, Homo sapiens
cauauguguuggagaauga

SEQ ID NO: 1216937 - RNA, 19 nt, Homo sapiens
agggaaagcuguucuguca

SEQ ID NO: 1216938 - RNA, 19 nt, Homo sapiens
ggaagcugccgccuuugua

SEQ ID NO: 1216939 - RNA, 19 nt, Homo sapiens
gaaauguggcgcaaacugu

SEQ ID NO: 1216940 - RNA, 19 nt, Homo sapiens
gcuauuaucuauggagugu

SEQ ID NO: 1216941 - RNA, 19 nt, Homo sapiens
gcauggcuauuaucuaugg

SEQ ID NO: 1216942 - RNA, 19 nt, Homo sapiens
cagaguugguguucaaguu

SEQ ID NO: 1216943 - RNA, 19 nt, Homo sapiens
caucggcauuggagaaauu

SEQ ID NO: 1216944 - RNA, 19 nt, Homo sapiens
guucucugcuucaaauuug

SEQ ID NO: 1216945 - RNA, 19 nt, Homo sapiens
caacuguaauuguucaaag

SEQ ID NO: 1216946 - RNA, 19 nt, Homo sapiens
ggaagaagucgccuuugau

SEQ ID NO: 1216947 - RNA, 19 nt, Homo sapiens
cagucuagcuuguucuuug

SEQ ID NO: 1216948 - RNA, 19 nt, Homo sapiens
guguucaaguuuacagaua

SEQ ID NO: 1216949 - RNA, 19 nt, Homo sapiens
gaagagaaaagccuuauug

SEQ ID NO: 1216950 - RNA, 19 nt, Homo sapiens
guauauggaaccuguauug

SEQ ID NO: 1216951 - RNA, 19 nt, Homo sapiens
guucuauucuuucucauuc

SEQ ID NO: 1216952 - RNA, 19 nt, Homo sapiens
ucacugccuuucaaacuug

SEQ ID NO: 1216953 - RNA, 19 nt, Homo sapiens
caagggauuaagacuguua

SEQ ID NO: 1216954 - RNA, 19 nt, Homo sapiens
ucaaguuuguucagucuau

SEQ ID NO: 1216955 - RNA, 19 nt, Homo sapiens
uuucuucucugguguauau

SEQ ID NO: 1216956 - RNA, 19 nt, Homo sapiens
gugcaugccugugauccua

SEQ ID NO: 1216957 - RNA, 19 nt, Homo sapiens
gacccugucuugaaaauaa

SEQ ID NO: 1216958 - RNA, 19 nt, Homo sapiens
uaaagcaaguagaauaagg

SEQ ID NO: 1216959 - RNA, 19 nt, Homo sapiens
ggucuggaauuaacuuucu

SEQ ID NO: 1216960 - RNA, 19 nt, Homo sapiens
gguaggagaauucgcuuga

SEQ ID NO: 1216961 - RNA, 19 nt, Homo sapiens
gaguugccuuuauguuuau

SEQ ID NO: 1216962 - RNA, 19 nt, Homo sapiens
gaacaaucguuuugguaga

SEQ ID NO: 1216963 - RNA, 19 nt, Homo sapiens
cuuuggaaaucucuacaua

SEQ ID NO: 1216964 - RNA, 19 nt, Homo sapiens
gggagaaacagugggauuu

SEQ ID NO: 1216965 - RNA, 19 nt, Homo sapiens
gagcacagcauugggagaa

SEQ ID NO: 1216966 - RNA, 19 nt, Homo sapiens
ggaccucaacucucuaugu

SEQ ID NO: 1216967 - RNA, 19 nt, Homo sapiens
uuuaauacccagcugcuua

SEQ ID NO: 1216968 - RNA, 19 nt, Homo sapiens
ggcaguagaugcuuuuaaa

SEQ ID NO: 1216969 - RNA, 19 nt, Homo sapiens
caauuucuuucuucacugu

SEQ ID NO: 1216970 - RNA, 19 nt, Homo sapiens
acaguucuauucuuucuca

SEQ ID NO: 1216971 - RNA, 19 nt, Homo sapiens
uauaccagcauggcuauua

SEQ ID NO: 1216972 - RNA, 19 nt, Homo sapiens
gagcuuaaauaggacagau

SEQ ID NO: 1216973 - RNA, 19 nt, Homo sapiens
ucugucaacuguaauuguu

SEQ ID NO: 1216974 - RNA, 19 nt, Homo sapiens
ggaaauguggcgcaaacug

SEQ ID NO: 1216975 - RNA, 19 nt, Homo sapiens
cccgauugcuccuguuaaa

SEQ ID NO: 1216976 - RNA, 19 nt, Homo sapiens
gcauguacauugccguuuu

SEQ ID NO: 1216977 - RNA, 19 nt, Homo sapiens
gucagugguugccauugua

SEQ ID NO: 1216978 - RNA, 19 nt, Homo sapiens
gucaucaggagcuuaaaua

SEQ ID NO: 1216979 - RNA, 19 nt, Homo sapiens
uauguucacugccuuucaa

SEQ ID NO: 1216980 - RNA, 19 nt, Homo sapiens
gggcacuucugcagucuag

SEQ ID NO: 1216981 - RNA, 19 nt, Homo sapiens
ggaguguucucugcuucaa

SEQ ID NO: 1216982 - RNA, 19 nt, Homo sapiens
aucaggagcuuaaauagga

SEQ ID NO: 1216983 - RNA, 19 nt, Homo sapiens
gguggaagaagucgccuuu

SEQ ID NO: 1216984 - RNA, 19 nt, Homo sapiens
cauuugccaucuucaaguu

SEQ ID NO: 1216985 - RNA, 19 nt, Homo sapiens
uguaggaccucaacucucu

SEQ ID NO: 1216986 - RNA, 19 nt, Homo sapiens
guucaaguuuacagauaug

SEQ ID NO: 1216987 - RNA, 19 nt, Homo sapiens
agaagucgccuuugaucuu

SEQ ID NO: 1216988 - RNA, 19 nt, Homo sapiens
uggaacaauuucuuucuuc

SEQ ID NO: 1216989 - RNA, 19 nt, Homo sapiens
auacaggucuggaauuaac

SEQ ID NO: 1216990 - RNA, 19 nt, Homo sapiens
gaugcuccuucuuaguauu

SEQ ID NO: 1216991 - RNA, 19 nt, Homo sapiens
ggggacaguucuauucuuu

SEQ ID NO: 1216992 - RNA, 19 nt, Homo sapiens
ggaaaacucagauaucaga

SEQ ID NO: 1216993 - RNA, 19 nt, Homo sapiens
guuugccagugguuuauuu

SEQ ID NO: 1216994 - RNA, 19 nt, Homo sapiens
caaguuuguucagucuauu

SEQ ID NO: 1216995 - RNA, 19 nt, Homo sapiens
uaucuugggcuuucuguau

SEQ ID NO: 1216996 - RNA, 19 nt, Homo sapiens
uauuaucuauggaguguuc

SEQ ID NO: 1216997 - RNA, 19 nt, Homo sapiens
augggaagcugccgccuuu

SEQ ID NO: 1216998 - RNA, 19 nt, Homo sapiens
caaauccagcaaagaaguu

SEQ ID NO: 1216999 - RNA, 19 nt, Homo sapiens
gaaaagccuuauuggacuu

SEQ ID NO: 1217000 - RNA, 19 nt, Homo sapiens
gaagcugccgccuuuguag

SEQ ID NO: 1217001 - RNA, 19 nt, Homo sapiens
gccuuuauguuuauguuca

SEQ ID NO: 1217002 - RNA, 19 nt, Homo sapiens
gcacagcauugggagaaac

SEQ ID NO: 1217003 - RNA, 19 nt, Homo sapiens
cgucagugguugccauugu

SEQ ID NO: 1217004 - RNA, 19 nt, Homo sapiens
gagacaauauugcuggaaa

SEQ ID NO: 1217005 - RNA, 19 nt, Homo sapiens
ccucauaccucauuagugu

SEQ ID NO: 1217006 - RNA, 19 nt, Homo sapiens
gaaaccagguggcuacuac

SEQ ID NO: 1217007 - RNA, 19 nt, Homo sapiens
cgagaucaauaccauguuu

SEQ ID NO: 1217008 - RNA, 19 nt, Homo sapiens
gaacgcagucuucaccauu

SEQ ID NO: 1217009 - RNA, 19 nt, Homo sapiens
gaaucggucugugagguaa

SEQ ID NO: 1217010 - RNA, 19 nt, Homo sapiens
cuacagagacagaccuaua

SEQ ID NO: 1217011 - RNA, 19 nt, Homo sapiens
gagaggugguucuggaaug

SEQ ID NO: 1217012 - RNA, 19 nt, Homo sapiens
caagacagaccucagaaug

SEQ ID NO: 1217013 - RNA, 19 nt, Homo sapiens
gaauggagccgagaucaau

SEQ ID NO: 1217014 - RNA, 19 nt, Homo sapiens
gagccgagaucaauaccau

SEQ ID NO: 1217015 - RNA, 19 nt, Homo sapiens
agacagaccucagaaugga

SEQ ID NO: 1217016 - RNA, 19 nt, Homo sapiens
ggaauggagccgagaucaa

SEQ ID NO: 1217017 - RNA, 19 nt, Homo sapiens
ucacaagacagaccucaga

SEQ ID NO: 1217018 - RNA, 19 nt, Homo sapiens
ggaacgcagucuucaccau

SEQ ID NO: 1217019 - RNA, 19 nt, Homo sapiens
caacacccuccuucccuuu

SEQ ID NO: 1217020 - RNA, 19 nt, Homo sapiens
caccauuucuugucuuugg

SEQ ID NO: 1217021 - RNA, 19 nt, Homo sapiens
ggaaaccagguggcuacua

SEQ ID NO: 1217022 - RNA, 19 nt, Homo sapiens
ccacagguaugggcucuac

SEQ ID NO: 1217023 - RNA, 19 nt, Homo sapiens
ggagcaaacagccucauac

SEQ ID NO: 1217024 - RNA, 19 nt, Homo sapiens
ccucagaauggaaacaauu

SEQ ID NO: 1217025 - RNA, 19 nt, Homo sapiens
aacgcagucuucaccauuu

SEQ ID NO: 1217026 - RNA, 19 nt, Homo sapiens
uggucacucuugcugcuua

SEQ ID NO: 1217027 - RNA, 19 nt, Homo sapiens
ggagaggugguucuggaau

SEQ ID NO: 1217028 - RNA, 19 nt, Homo sapiens
gcucuacgugugcuucuug

SEQ ID NO: 1217029 - RNA, 19 nt, Homo sapiens
ucuugcugcuuaccuauga

SEQ ID NO: 1217030 - RNA, 19 nt, Homo sapiens
ugagguaaagggaauuuca

SEQ ID NO: 1217031 - RNA, 19 nt, Homo sapiens
agacaauauugcuggaaag

SEQ ID NO: 1217032 - RNA, 19 nt, Homo sapiens
ucugugagguaaagggaau

SEQ ID NO: 1217033 - RNA, 19 nt, Homo sapiens
agaaucggucugugaggua

SEQ ID NO: 1217034 - RNA, 19 nt, Homo sapiens
gcagauaaaaugaaucaca

SEQ ID NO: 1217035 - RNA, 19 nt, Homo sapiens
gagguaaagggaauuucau

SEQ ID NO: 1217036 - RNA, 19 nt, Homo sapiens
guucaagcuccuacagaga

SEQ ID NO: 1217037 - RNA, 19 nt, Homo sapiens
ucugagcccuggccggaau

SEQ ID NO: 1217038 - RNA, 19 nt, Homo sapiens
gccgagaucaauaccaugu

SEQ ID NO: 1217039 - RNA, 19 nt, Homo sapiens
ccacuccauuggucacucu

SEQ ID NO: 1217040 - RNA, 19 nt, Homo sapiens
gaccucagaauggaaacaa

SEQ ID NO: 1217041 - RNA, 19 nt, Homo sapiens
gacaauauugcuggaaagu

SEQ ID NO: 1217042 - RNA, 19 nt, Homo sapiens
gggugaugcuguucaagcu

SEQ ID NO: 1217043 - RNA, 19 nt, Homo sapiens
cgucuccgccuuccaguuc

SEQ ID NO: 1217044 - RNA, 19 nt, Homo sapiens
acagaccucagaauggaaa

SEQ ID NO: 1217045 - RNA, 19 nt, Homo sapiens
ucaagcuccuacagagaca

SEQ ID NO: 1217046 - RNA, 19 nt, Homo sapiens
acagccucauaccucauua

SEQ ID NO: 1217047 - RNA, 19 nt, Homo sapiens
cacucuugcugcuuaccua

SEQ ID NO: 1217048 - RNA, 19 nt, Homo sapiens
caaggucauuuacaacuua

SEQ ID NO: 1217049 - RNA, 19 nt, Homo sapiens
gaaagaaggcagccauuga

SEQ ID NO: 1217050 - RNA, 19 nt, Homo sapiens
cggagucggugcaguauga

SEQ ID NO: 1217051 - RNA, 19 nt, Homo sapiens
ggagugagaccgagaacga

SEQ ID NO: 1217052 - RNA, 19 nt, Homo sapiens
ccaaagccuugcccaggaa

SEQ ID NO: 1217053 - RNA, 19 nt, Homo sapiens
ugaaagaggagcagaggaa

SEQ ID NO: 1217054 - RNA, 19 nt, Homo sapiens
gaagaugcuggcagagaga

SEQ ID NO: 1217055 - RNA, 19 nt, Homo sapiens
gaaggucgagcgaaagaag

SEQ ID NO: 1217056 - RNA, 19 nt, Homo sapiens
acaaggucauuuacaacuu

SEQ ID NO: 1217057 - RNA, 19 nt, Homo sapiens
agacggagucggugcagua

SEQ ID NO: 1217058 - RNA, 19 nt, Homo sapiens
caccaggaauacuugaaga

SEQ ID NO: 1217059 - RNA, 19 nt, Homo sapiens
ggacgucugacuccaguuc

SEQ ID NO: 1217060 - RNA, 19 nt, Homo sapiens
cgaaagaaggcagccauug

SEQ ID NO: 1217061 - RNA, 19 nt, Homo sapiens
gaagaagaagcgagauggu

SEQ ID NO: 1217062 - RNA, 19 nt, Homo sapiens
uaaauucucagccacucaa

SEQ ID NO: 1217063 - RNA, 19 nt, Homo sapiens
gaggagcgccaccaggaau

SEQ ID NO: 1217064 - RNA, 19 nt, Homo sapiens
gcgaaagaaggcagccauu

SEQ ID NO: 1217065 - RNA, 19 nt, Homo sapiens
gacaaggucauuuacaacu

SEQ ID NO: 1217066 - RNA, 19 nt, Homo sapiens
gcauguugccgcugcuguu

SEQ ID NO: 1217067 - RNA, 19 nt, Homo sapiens
gcggaucuccucccucaca

SEQ ID NO: 1217068 - RNA, 19 nt, Homo sapiens
ccacggagaaaccaaccaa

SEQ ID NO: 1217069 - RNA, 19 nt, Homo sapiens
ccaggaauacuugaagaug

SEQ ID NO: 1217070 - RNA, 19 nt, Homo sapiens
ccucacagcaucacuacau

SEQ ID NO: 1217071 - RNA, 19 nt, Homo sapiens
aaagaaggcagccauugag

SEQ ID NO: 1217072 - RNA, 19 nt, Homo sapiens
ccauugaggagauuaagca

SEQ ID NO: 1217073 - RNA, 19 nt, Homo sapiens
cggaaggucgagcgaaaga

SEQ ID NO: 1217074 - RNA, 19 nt, Homo sapiens
agcggaaggucgagcgaaa

SEQ ID NO: 1217075 - RNA, 19 nt, Homo sapiens
ggaaggucgagcgaaagaa

SEQ ID NO: 1217076 - RNA, 19 nt, Homo sapiens
aggcagccauugaggagau

SEQ ID NO: 1217077 - RNA, 19 nt, Homo sapiens
gcaaacggcuuacucaaag

SEQ ID NO: 1217078 - RNA, 19 nt, Homo sapiens
gaggagagcuuucuuaacg

SEQ ID NO: 1217079 - RNA, 19 nt, Homo sapiens
caaacaaacugacaaaucg

SEQ ID NO: 1217080 - RNA, 19 nt, Homo sapiens
gggaacaccuggccaaguc

SEQ ID NO: 1217081 - RNA, 19 nt, Homo sapiens
uuugauggguggccuguua

SEQ ID NO: 1217082 - RNA, 19 nt, Homo sapiens
ccaagucuggguucaauuu

SEQ ID NO: 1217083 - RNA, 19 nt, Homo sapiens
ccaaacaaacugacaaauc

SEQ ID NO: 1217084 - RNA, 19 nt, Homo sapiens
ggcaaacggcuuacucaaa

SEQ ID NO: 1217085 - RNA, 19 nt, Homo sapiens
guuacacguuuggaaauaa

SEQ ID NO: 1217086 - RNA, 19 nt, Homo sapiens
uagaggagagcuuucuuaa

SEQ ID NO: 1217087 - RNA, 19 nt, Homo sapiens
uggcggaucugcuccaugu

SEQ ID NO: 1217088 - RNA, 19 nt, Homo sapiens
cgagugggcaaacggcuua

SEQ ID NO: 1217089 - RNA, 19 nt, Homo sapiens
gcuggaaacacucacacua

SEQ ID NO: 1217090 - RNA, 19 nt, Homo sapiens
ggccaagucuggguucaau

SEQ ID NO: 1217091 - RNA, 19 nt, Homo sapiens
uguuacacguuuggaaaua

SEQ ID NO: 1217092 - RNA, 19 nt, Homo sapiens
gguggccuguuacacguuu

SEQ ID NO: 1217093 - RNA, 19 nt, Homo sapiens
ggccauacccaccacaguu

SEQ ID NO: 1217094 - RNA, 19 nt, Homo sapiens
aggagcagcuacccgauga

SEQ ID NO: 1217095 - RNA, 19 nt, Homo sapiens
cugcaccucugcugccuuu

SEQ ID NO: 1217096 - RNA, 19 nt, Homo sapiens
ccugauggcuggaaacacu

SEQ ID NO: 1217097 - RNA, 19 nt, Homo sapiens
cgaccucucucuucucacu

SEQ ID NO: 1217098 - RNA, 19 nt, Homo sapiens
ucugcugccuuucugagua

SEQ ID NO: 1217099 - RNA, 19 nt, Homo sapiens
ggaaacacucacacuacug

SEQ ID NO: 1217100 - RNA, 19 nt, Homo sapiens
auagaggagagcuuucuua

SEQ ID NO: 1217101 - RNA, 19 nt, Homo sapiens
ggccaaacaaacugacaaa

SEQ ID NO: 1217102 - RNA, 19 nt, Homo sapiens
cugcugccuuucugaguaa

SEQ ID NO: 1217103 - RNA, 19 nt, Homo sapiens
gggcaaacggcuuacucaa

SEQ ID NO: 1217104 - RNA, 19 nt, Homo sapiens
uggaaacacucacacuacu

SEQ ID NO: 1217105 - RNA, 19 nt, Homo sapiens
ccuguuacacguuuggaaa

SEQ ID NO: 1217106 - RNA, 19 nt, Homo sapiens
caaacggcuuacucaaagg

SEQ ID NO: 1217107 - RNA, 19 nt, Homo sapiens
ucacuagacauccuacagu

SEQ ID NO: 1217108 - RNA, 19 nt, Homo sapiens
ccaucgagggccaaacaaa

SEQ ID NO: 1217109 - RNA, 19 nt, Homo sapiens
gcaccucugcugccuuucu

SEQ ID NO: 1217110 - RNA, 19 nt, Homo sapiens
aagucaaggucaggccaua

SEQ ID NO: 1217111 - RNA, 19 nt, Homo sapiens
caaaggccaggagcagcua

SEQ ID NO: 1217112 - RNA, 19 nt, Homo sapiens
cuggagccguuucucucua

SEQ ID NO: 1217113 - RNA, 19 nt, Homo sapiens
agaaccugauggcuggaaa

SEQ ID NO: 1217114 - RNA, 19 nt, Homo sapiens
gccauacccaccacaguuc

SEQ ID NO: 1217115 - RNA, 19 nt, Homo sapiens
gggccaaacaaacugacaa

SEQ ID NO: 1217116 - RNA, 19 nt, Homo sapiens
gauaagguaugcugaagaa

SEQ ID NO: 1217117 - RNA, 19 nt, Homo sapiens
gagcugauguugcaccuaa

SEQ ID NO: 1217118 - RNA, 19 nt, Homo sapiens
ugaagaaucuccugcagaa

SEQ ID NO: 1217119 - RNA, 19 nt, Homo sapiens
ggagacauauccuagauca

SEQ ID NO: 1217120 - RNA, 19 nt, Homo sapiens
gaagucugauacaugauuu

SEQ ID NO: 1217121 - RNA, 19 nt, Homo sapiens
gaaccgaaauuuagaaagc

SEQ ID NO: 1217122 - RNA, 19 nt, Homo sapiens
gaucgaaucaucaauuuag

SEQ ID NO: 1217123 - RNA, 19 nt, Homo sapiens
cagcuuaacauccuuauug

SEQ ID NO: 1217124 - RNA, 19 nt, Homo sapiens
uuaaggagcugauguugca

SEQ ID NO: 1217125 - RNA, 19 nt, Homo sapiens
gcauacuuaucuacuggua

SEQ ID NO: 1217126 - RNA, 19 nt, Homo sapiens
gauaagugcuuuuguuuuc

SEQ ID NO: 1217127 - RNA, 19 nt, Homo sapiens
guacuuaccaggacucuuc

SEQ ID NO: 1217128 - RNA, 19 nt, Homo sapiens
ccaaaaccguugaauauau

SEQ ID NO: 1217129 - RNA, 19 nt, Homo sapiens
cuaaacauuccaacccuua

SEQ ID NO: 1217130 - RNA, 19 nt, Homo sapiens
gugcaaaccuguacuucca

SEQ ID NO: 1217131 - RNA, 19 nt, Homo sapiens
agacuuagaaccgaaauuu

SEQ ID NO: 1217132 - RNA, 19 nt, Homo sapiens
gaagaaaccccaaaaugga

SEQ ID NO: 1217133 - RNA, 19 nt, Homo sapiens
gcaagggagacauauccua

SEQ ID NO: 1217134 - RNA, 19 nt, Homo sapiens
ggaucgaaucaucaauuua

SEQ ID NO: 1217135 - RNA, 19 nt, Homo sapiens
ccaggacucuucaaaauga

SEQ ID NO: 1217136 - RNA, 19 nt, Homo sapiens
gacuuagaaccgaaauuua

SEQ ID NO: 1217137 - RNA, 19 nt, Homo sapiens
cuacugguaucgacaagga

SEQ ID NO: 1217138 - RNA, 19 nt, Homo sapiens
auuacugccugcauacuua

SEQ ID NO: 1217139 - RNA, 19 nt, Homo sapiens
cgaaucaucaauuuaguug

SEQ ID NO: 1217140 - RNA, 19 nt, Homo sapiens
uuaggacagugaguaauuu

SEQ ID NO: 1217141 - RNA, 19 nt, Homo sapiens
uuccaacccuuaaagcuaa

SEQ ID NO: 1217142 - RNA, 19 nt, Homo sapiens
aggaucgaaucaucaauuu

SEQ ID NO: 1217143 - RNA, 19 nt, Homo sapiens
gggaggucaugcugucuug

SEQ ID NO: 1217144 - RNA, 19 nt, Homo sapiens
guaucgacaaggagacuua

SEQ ID NO: 1217145 - RNA, 19 nt, Homo sapiens
ggcaaaaggcuauguaaaa

SEQ ID NO: 1217146 - RNA, 19 nt, Homo sapiens
gacauauccuagaucacuu

SEQ ID NO: 1217147 - RNA, 19 nt, Homo sapiens
uaagguaugcugaagaauc

SEQ ID NO: 1217148 - RNA, 19 nt, Homo sapiens
gucugcaucucuuugagua

SEQ ID NO: 1217149 - RNA, 19 nt, Homo sapiens
gcugauaagugcuuuuguu

SEQ ID NO: 1217150 - RNA, 19 nt, Homo sapiens
aaauguuaauucccucuug

SEQ ID NO: 1217151 - RNA, 19 nt, Homo sapiens
ggauaagguaugcugaaga

SEQ ID NO: 1217152 - RNA, 19 nt, Homo sapiens
caaccaacuuuugcuuaua

SEQ ID NO: 1217153 - RNA, 19 nt, Homo sapiens
ccaaggaucgaaucaucaa

SEQ ID NO: 1217154 - RNA, 19 nt, Homo sapiens
aaacauuccaacccuuaaa

SEQ ID NO: 1217155 - RNA, 19 nt, Homo sapiens
cgccaaggaucgaaucauc

SEQ ID NO: 1217156 - RNA, 19 nt, Homo sapiens
ggagacguccgccaaggau

SEQ ID NO: 1217157 - RNA, 19 nt, Homo sapiens
uaaacauuccaacccuuaa

SEQ ID NO: 1217158 - RNA, 19 nt, Homo sapiens
aagguaugcugaagaaucu

SEQ ID NO: 1217159 - RNA, 19 nt, Homo sapiens
uaacgcugauaagugcuuu

SEQ ID NO: 1217160 - RNA, 19 nt, Homo sapiens
ggucaugcugucuugcuuu

SEQ ID NO: 1217161 - RNA, 19 nt, Homo sapiens
uuuaguuguuggcagcuua

SEQ ID NO: 1217162 - RNA, 19 nt, Homo sapiens
guauaugugcaaaccugua

SEQ ID NO: 1217163 - RNA, 19 nt, Homo sapiens
cuaguaacgcugauaagug

SEQ ID NO: 1217164 - RNA, 19 nt, Homo sapiens
agaagucugauacaugauu

SEQ ID NO: 1217165 - RNA, 19 nt, Homo sapiens
caucauguuguguauaugu

SEQ ID NO: 1217166 - RNA, 19 nt, Homo sapiens
gcaucucuuugaguaguau

SEQ ID NO: 1217167 - RNA, 19 nt, Homo sapiens
aaggaucgaaucaucaauu

SEQ ID NO: 1217168 - RNA, 19 nt, Homo sapiens
caugcugucuugcuuuuaa

SEQ ID NO: 1217169 - RNA, 19 nt, Homo sapiens
uauccuagaucacuuugcu

SEQ ID NO: 1217170 - RNA, 19 nt, Homo sapiens
ucuaucaucauguugugua

SEQ ID NO: 1217171 - RNA, 19 nt, Homo sapiens
agacauauccuagaucacu

SEQ ID NO: 1217172 - RNA, 19 nt, Homo sapiens
aagaaucuccugcagaagu

SEQ ID NO: 1217173 - RNA, 19 nt, Homo sapiens
uaccaggacucuucaaaau

SEQ ID NO: 1217174 - RNA, 19 nt, Homo sapiens
ccacucggguucggcuaug

SEQ ID NO: 1217175 - RNA, 19 nt, Homo sapiens
agaaucuccugcagaaguc

SEQ ID NO: 1217176 - RNA, 19 nt, Homo sapiens
acauuaggacagugaguaa

SEQ ID NO: 1217177 - RNA, 19 nt, Homo sapiens
aaccuguacuuccaugaug

SEQ ID NO: 1217178 - RNA, 19 nt, Homo sapiens
caacuuugugaagaucuaa

SEQ ID NO: 1217179 - RNA, 19 nt, Homo sapiens
agggagacauauccuagau

SEQ ID NO: 1217180 - RNA, 19 nt, Homo sapiens
uacauuaggacagugagua

SEQ ID NO: 1217181 - RNA, 19 nt, Homo sapiens
ucccucaacuaccuccaaa

SEQ ID NO: 1217182 - RNA, 19 nt, Homo sapiens
gcagcuuaacauccuuauu

SEQ ID NO: 1217183 - RNA, 19 nt, Homo sapiens
agcuuaacauccuuauuga

SEQ ID NO: 1217184 - RNA, 19 nt, Homo sapiens
ugacaaaacacagugaaaa

SEQ ID NO: 1217185 - RNA, 19 nt, Homo sapiens
gccaaggaucgaaucauca

SEQ ID NO: 1217186 - RNA, 19 nt, Homo sapiens
acuuagaaccgaaauuuag

SEQ ID NO: 1217187 - RNA, 19 nt, Homo sapiens
ucgacaaggagacuuagaa

SEQ ID NO: 1217188 - RNA, 19 nt, Homo sapiens
gcugucugcaucucuuuga

SEQ ID NO: 1217189 - RNA, 19 nt, Homo sapiens
guuggcagcuuaacauccu

SEQ ID NO: 1217190 - RNA, 19 nt, Homo sapiens
ugaagaaaccccaaaaugg

SEQ ID NO: 1217191 - RNA, 19 nt, Homo sapiens
aaggugaggcugccaagga

SEQ ID NO: 1217192 - RNA, 19 nt, Homo sapiens
cuuagaaccgaaauuuaga

SEQ ID NO: 1217193 - RNA, 19 nt, Homo sapiens
gugaagaaaccccaaaaug

SEQ ID NO: 1217194 - RNA, 19 nt, Homo sapiens
gcaagaggcccguacagaa

SEQ ID NO: 1217195 - RNA, 19 nt, Homo sapiens
gaaagagaggcaagagaaa

SEQ ID NO: 1217196 - RNA, 19 nt, Homo sapiens
ggagugaucagaggcaaua

SEQ ID NO: 1217197 - RNA, 19 nt, Homo sapiens
cagcaggacccucaccuua

SEQ ID NO: 1217198 - RNA, 19 nt, Homo sapiens
gaagaaagccagacaucag

SEQ ID NO: 1217199 - RNA, 19 nt, Homo sapiens
caauaaagaguacgaggaa

SEQ ID NO: 1217200 - RNA, 19 nt, Homo sapiens
gaucagaggcaauaaagag

SEQ ID NO: 1217201 - RNA, 19 nt, Homo sapiens
caagaggcccguacagaau

SEQ ID NO: 1217202 - RNA, 19 nt, Homo sapiens
gcaggacccucaccuuacu

SEQ ID NO: 1217203 - RNA, 19 nt, Homo sapiens
gaaggcagucgcagcagaa

SEQ ID NO: 1217204 - RNA, 19 nt, Homo sapiens
agaaagagaggcaagagaa

SEQ ID NO: 1217205 - RNA, 19 nt, Homo sapiens
ggaagaaagccagacauca

SEQ ID NO: 1217206 - RNA, 19 nt, Homo sapiens
guacaacucccaauucaac

SEQ ID NO: 1217207 - RNA, 19 nt, Homo sapiens
gcuacgacgccaugaauau

SEQ ID NO: 1217208 - RNA, 19 nt, Homo sapiens
gagaaagagaggcaagaga

SEQ ID NO: 1217209 - RNA, 19 nt, Homo sapiens
gaagggaaaggagugauca

SEQ ID NO: 1217210 - RNA, 19 nt, Homo sapiens
ucagaggcaauaaagagua

SEQ ID NO: 1217211 - RNA, 19 nt, Homo sapiens
cgguacaacucccaauuca

SEQ ID NO: 1217212 - RNA, 19 nt, Homo sapiens
uaaagaguacgaggaagaa

SEQ ID NO: 1217213 - RNA, 19 nt, Homo sapiens
ggaagggaaaggagugauc

SEQ ID NO: 1217214 - RNA, 19 nt, Homo sapiens
aagaagacgagacggauga

SEQ ID NO: 1217215 - RNA, 19 nt, Homo sapiens
cagaugagaagaucaagag

SEQ ID NO: 1217216 - RNA, 19 nt, Homo sapiens
gcgguacaacucccaauuc

SEQ ID NO: 1217217 - RNA, 19 nt, Homo sapiens
auaaagaguacgaggaaga

SEQ ID NO: 1217218 - RNA, 19 nt, Homo sapiens
cagaggcaauaaagaguac

SEQ ID NO: 1217219 - RNA, 19 nt, Homo sapiens
gaaaaggaggggucugaga

SEQ ID NO: 1217220 - RNA, 19 nt, Homo sapiens
aagaaagccagacaucaga

SEQ ID NO: 1217221 - RNA, 19 nt, Homo sapiens
cagcggaggcacagacuca

SEQ ID NO: 1217222 - RNA, 19 nt, Homo sapiens
ggagaaagagaggcaagag

SEQ ID NO: 1217223 - RNA, 19 nt, Homo sapiens
gaaagccagacaucagaac

SEQ ID NO: 1217224 - RNA, 19 nt, Homo sapiens
gugaucagaggcaauaaag

SEQ ID NO: 1217225 - RNA, 19 nt, Homo sapiens
aagaggcccguacagaauu

SEQ ID NO: 1217226 - RNA, 19 nt, Homo sapiens
gaggaagggaaaggaguga

SEQ ID NO: 1217227 - RNA, 19 nt, Homo sapiens
ccagaugagaagaucaaga

SEQ ID NO: 1217228 - RNA, 19 nt, Homo sapiens
gcucugggcauccugacau

SEQ ID NO: 1217229 - RNA, 19 nt, Homo sapiens
gcuggcacguccggaacaa

SEQ ID NO: 1217230 - RNA, 19 nt, Homo sapiens
gguacaacucccaauucaa

SEQ ID NO: 1217231 - RNA, 19 nt, Homo sapiens
agaagcagcgacccaagga

SEQ ID NO: 1217232 - RNA, 19 nt, Homo sapiens
ggcgguacaacucccaauu

SEQ ID NO: 1217233 - RNA, 19 nt, Homo sapiens
aaagagaggcaagagaaag

SEQ ID NO: 1217234 - RNA, 19 nt, Homo sapiens
ccagacaucagaacucacu

SEQ ID NO: 1217235 - RNA, 19 nt, Homo sapiens
gaauaugacccuccaaugu

SEQ ID NO: 1217236 - RNA, 19 nt, Homo sapiens
gauuuguucuguauaagga

SEQ ID NO: 1217237 - RNA, 19 nt, Homo sapiens
ggaauaugacccuccaaug

SEQ ID NO: 1217238 - RNA, 19 nt, Homo sapiens
ggagauaccgcugccacua

SEQ ID NO: 1217239 - RNA, 19 nt, Homo sapiens
ccucacacgccaaggauua

SEQ ID NO: 1217240 - RNA, 19 nt, Homo sapiens
gguggagguucacaugcua

SEQ ID NO: 1217241 - RNA, 19 nt, Homo sapiens
ucaccaauuuguucugaug

SEQ ID NO: 1217242 - RNA, 19 nt, Homo sapiens
ccaagaacaaggccagauu

SEQ ID NO: 1217243 - RNA, 19 nt, Homo sapiens
guucacaugcuauuacuau

SEQ ID NO: 1217244 - RNA, 19 nt, Homo sapiens
agauaccgcugccacuauu

SEQ ID NO: 1217245 - RNA, 19 nt, Homo sapiens
gagauaccgcugccacuau

SEQ ID NO: 1217246 - RNA, 19 nt, Homo sapiens
ggagguucacaugcuauua

SEQ ID NO: 1217247 - RNA, 19 nt, Homo sapiens
uaucaccaauuuguucuga

SEQ ID NO: 1217248 - RNA, 19 nt, Homo sapiens
gcucagcacagccagagaa

SEQ ID NO: 1217249 - RNA, 19 nt, Homo sapiens
acacuuuccuucugaccaa

SEQ ID NO: 1217250 - RNA, 19 nt, Homo sapiens
ccucgggauucuguuauuu

SEQ ID NO: 1217251 - RNA, 19 nt, Homo sapiens
auaaguaccaggcugaauu

SEQ ID NO: 1217252 - RNA, 19 nt, Homo sapiens
gcucugaugucggcuacga

SEQ ID NO: 1217253 - RNA, 19 nt, Homo sapiens
caagaacaaggccagauuc

SEQ ID NO: 1217254 - RNA, 19 nt, Homo sapiens
caauguacggagcucauaa

SEQ ID NO: 1217255 - RNA, 19 nt, Homo sapiens
ucgggauucuguuauuuga

SEQ ID NO: 1217256 - RNA, 19 nt, Homo sapiens
gauaccgcugccacuauua

SEQ ID NO: 1217257 - RNA, 19 nt, Homo sapiens
caggaguaccgacuggaua

SEQ ID NO: 1217258 - RNA, 19 nt, Homo sapiens
ucacgguccugaucugucu

SEQ ID NO: 1217259 - RNA, 19 nt, Homo sapiens
gggaauaugacccuccaau

SEQ ID NO: 1217260 - RNA, 19 nt, Homo sapiens
uaaguaccaggcugaauuc

SEQ ID NO: 1217261 - RNA, 19 nt, Homo sapiens
gagccugacccuccagugu

SEQ ID NO: 1217262 - RNA, 19 nt, Homo sapiens
aauaugacccuccaaugug

SEQ ID NO: 1217263 - RNA, 19 nt, Homo sapiens
guuccucgggauucuguua

SEQ ID NO: 1217264 - RNA, 19 nt, Homo sapiens
gagguucacaugcuauuac

SEQ ID NO: 1217265 - RNA, 19 nt, Homo sapiens
cagaaauaacccacuggaa

SEQ ID NO: 1217266 - RNA, 19 nt, Homo sapiens
ucaauguacggagcucaua

SEQ ID NO: 1217267 - RNA, 19 nt, Homo sapiens
acaguggccucaggagaga

SEQ ID NO: 1217268 - RNA, 19 nt, Homo sapiens
ggaguaccgacuggauaaa

SEQ ID NO: 1217269 - RNA, 19 nt, Homo sapiens
ccaauuuguucugaugaag

SEQ ID NO: 1217270 - RNA, 19 nt, Homo sapiens
aguaccgacuggauaaaga

SEQ ID NO: 1217271 - RNA, 19 nt, Homo sapiens
ccacuggaacccaagaaca

SEQ ID NO: 1217272 - RNA, 19 nt, Homo sapiens
uuugacacuuuccuucuga

SEQ ID NO: 1217273 - RNA, 19 nt, Homo sapiens
guuugacacuuuccuucug

SEQ ID NO: 1217274 - RNA, 19 nt, Homo sapiens
aauuuguucugaugaagga

SEQ ID NO: 1217275 - RNA, 19 nt, Homo sapiens
gauaucaccaauuuguucu

SEQ ID NO: 1217276 - RNA, 19 nt, Homo sapiens
aggaguaccgacuggauaa

SEQ ID NO: 1217277 - RNA, 19 nt, Homo sapiens
uguacggagcucauaagua

SEQ ID NO: 1217278 - RNA, 19 nt, Homo sapiens
ggauuacacaguggagaau

SEQ ID NO: 1217279 - RNA, 19 nt, Homo sapiens
gagcccugggacagaaaua

SEQ ID NO: 1217280 - RNA, 19 nt, Homo sapiens
cacuggaacccaagaacaa

SEQ ID NO: 1217281 - RNA, 19 nt, Homo sapiens
ccucaggggugucuaggaa

SEQ ID NO: 1217282 - RNA, 19 nt, Homo sapiens
accaauuuguucugaugaa

SEQ ID NO: 1217283 - RNA, 19 nt, Homo sapiens
gcuaaagacuugacagcua

SEQ ID NO: 1217284 - RNA, 19 nt, Homo sapiens
gcaagaaggagaagaagaa

SEQ ID NO: 1217285 - RNA, 19 nt, Homo sapiens
gggaggacgugaagacuga

SEQ ID NO: 1217286 - RNA, 19 nt, Homo sapiens
caaguauggugaccucuau

SEQ ID NO: 1217287 - RNA, 19 nt, Homo sapiens
acaagaacgugaagaagca

SEQ ID NO: 1217288 - RNA, 19 nt, Homo sapiens
gaagaagaaagacaaagag

SEQ ID NO: 1217289 - RNA, 19 nt, Homo sapiens
gugaaccugcccagauuua

SEQ ID NO: 1217290 - RNA, 19 nt, Homo sapiens
gcuacaagaacgugaagaa

SEQ ID NO: 1217291 - RNA, 19 nt, Homo sapiens
gaaccugcccagauuuauc

SEQ ID NO: 1217292 - RNA, 19 nt, Homo sapiens
acaagcagcgggagaacua

SEQ ID NO: 1217293 - RNA, 19 nt, Homo sapiens
gaucagacggaaagcaguu

SEQ ID NO: 1217294 - RNA, 19 nt, Homo sapiens
agaggaaacacaagaaaga

SEQ ID NO: 1217295 - RNA, 19 nt, Homo sapiens
cugcccagauuuaucagua

SEQ ID NO: 1217296 - RNA, 19 nt, Homo sapiens
agaagaagaaagacaaaga

SEQ ID NO: 1217297 - RNA, 19 nt, Homo sapiens
gucuaacuguggccaagua

SEQ ID NO: 1217298 - RNA, 19 nt, Homo sapiens
gcccagauuuaucaguaga

SEQ ID NO: 1217299 - RNA, 19 nt, Homo sapiens
aaagaggaaacacaagaaa

SEQ ID NO: 1217300 - RNA, 19 nt, Homo sapiens
cgaggcugcuccuguggaa

SEQ ID NO: 1217301 - RNA, 19 nt, Homo sapiens
aaagcaagaaggagaagaa

SEQ ID NO: 1217302 - RNA, 19 nt, Homo sapiens
ccaaguauggugaccucua

SEQ ID NO: 1217303 - RNA, 19 nt, Homo sapiens
caagaaggagaagaagaaa

SEQ ID NO: 1217304 - RNA, 19 nt, Homo sapiens
uaacuguggccaaguaugg

SEQ ID NO: 1217305 - RNA, 19 nt, Homo sapiens
ccuaugagcggucuaacug

SEQ ID NO: 1217306 - RNA, 19 nt, Homo sapiens
ccaggcaccaccaccauga

SEQ ID NO: 1217307 - RNA, 19 nt, Homo sapiens
caacugggaggacgugaag

SEQ ID NO: 1217308 - RNA, 19 nt, Homo sapiens
acggaaagcaguugugaga

SEQ ID NO: 1217309 - RNA, 19 nt, Homo sapiens
ggugaaccugcccagauuu

SEQ ID NO: 1217310 - RNA, 19 nt, Homo sapiens
ucucgcagguggcaugaca

SEQ ID NO: 1217311 - RNA, 19 nt, Homo sapiens
ggaaaagcaagaaggagaa

SEQ ID NO: 1217312 - RNA, 19 nt, Homo sapiens
cagcagccaugggccuaug

SEQ ID NO: 1217313 - RNA, 19 nt, Homo sapiens
agaacuaccugggcaacuc

SEQ ID NO: 1217314 - RNA, 19 nt, Homo sapiens
aguauggugaccucuauuu

SEQ ID NO: 1217315 - RNA, 19 nt, Homo sapiens
ggacgugaagacugacaag

SEQ ID NO: 1217316 - RNA, 19 nt, Homo sapiens
agacggaaagcaguuguga

SEQ ID NO: 1217317 - RNA, 19 nt, Homo sapiens
gcucaugucuugcauuuau

SEQ ID NO: 1217318 - RNA, 19 nt, Homo sapiens
gaaggacggucaucaaagu

SEQ ID NO: 1217319 - RNA, 19 nt, Homo sapiens
caaaggcacucuaguucaa

SEQ ID NO: 1217320 - RNA, 19 nt, Homo sapiens
guagaagacuagauugaug

SEQ ID NO: 1217321 - RNA, 19 nt, Homo sapiens
cauaucagcuccagagaug

SEQ ID NO: 1217322 - RNA, 19 nt, Homo sapiens
ccaaagugcuguaugagau

SEQ ID NO: 1217323 - RNA, 19 nt, Homo sapiens
gcagagacacugaacuuga

SEQ ID NO: 1217324 - RNA, 19 nt, Homo sapiens
ugagaucccugacaccuau

SEQ ID NO: 1217325 - RNA, 19 nt, Homo sapiens
acacucaacugcuucucua

SEQ ID NO: 1217326 - RNA, 19 nt, Homo sapiens
ggacggucaucaaagugaa

SEQ ID NO: 1217327 - RNA, 19 nt, Homo sapiens
ggagcgccaugacgacuga

SEQ ID NO: 1217328 - RNA, 19 nt, Homo sapiens
caagggcgaguuucaauug

SEQ ID NO: 1217329 - RNA, 19 nt, Homo sapiens
aaagaaauccacucccaaa

SEQ ID NO: 1217330 - RNA, 19 nt, Homo sapiens
guaauaacaacgcuggaaa

SEQ ID NO: 1217331 - RNA, 19 nt, Homo sapiens
cuagauugaugguaguuug

SEQ ID NO: 1217332 - RNA, 19 nt, Homo sapiens
acccuaaccucuuugauga

SEQ ID NO: 1217333 - RNA, 19 nt, Homo sapiens
guagguuucucucuguaau

SEQ ID NO: 1217334 - RNA, 19 nt, Homo sapiens
gauaggggcugguuucugu

SEQ ID NO: 1217335 - RNA, 19 nt, Homo sapiens
agacagacuucaccuccuu

SEQ ID NO: 1217336 - RNA, 19 nt, Homo sapiens
ugacaccuaugcccaaaca

SEQ ID NO: 1217337 - RNA, 19 nt, Homo sapiens
gacuguuucucaugccuuu

SEQ ID NO: 1217338 - RNA, 19 nt, Homo sapiens
ucccuuuccuacuauaaua

SEQ ID NO: 1217339 - RNA, 19 nt, Homo sapiens
gcagauggcaagucacaca

SEQ ID NO: 1217340 - RNA, 19 nt, Homo sapiens
gaugguaguuuggccuguu

SEQ ID NO: 1217341 - RNA, 19 nt, Homo sapiens
auacaaaggcacucuaguu

SEQ ID NO: 1217342 - RNA, 19 nt, Homo sapiens
ucaaggagaagaagaaagu

SEQ ID NO: 1217343 - RNA, 19 nt, Homo sapiens
uuauugagaugacuguuuc

SEQ ID NO: 1217344 - RNA, 19 nt, Homo sapiens
ugucuugcauuuauugaga

SEQ ID NO: 1217345 - RNA, 19 nt, Homo sapiens
ggaaggacggucaucaaag

SEQ ID NO: 1217346 - RNA, 19 nt, Homo sapiens
gcagucgggauuacagaaa

SEQ ID NO: 1217347 - RNA, 19 nt, Homo sapiens
gaggaaggacggucaucaa

SEQ ID NO: 1217348 - RNA, 19 nt, Homo sapiens
caacugcuucucuaggaaa

SEQ ID NO: 1217349 - RNA, 19 nt, Homo sapiens
cagagacacugaacuugag

SEQ ID NO: 1217350 - RNA, 19 nt, Homo sapiens
aacuugagcucaccuccua

SEQ ID NO: 1217351 - RNA, 19 nt, Homo sapiens
gccuuuauguuccuucaug

SEQ ID NO: 1217352 - RNA, 19 nt, Homo sapiens
gcaagucacacacccucaa

SEQ ID NO: 1217353 - RNA, 19 nt, Homo sapiens
ggagaagaagaaagugaga

SEQ ID NO: 1217354 - RNA, 19 nt, Homo sapiens
ggacccuggcacucuguua

SEQ ID NO: 1217355 - RNA, 19 nt, Homo sapiens
uaacaccggcaguaaacuu

SEQ ID NO: 1217356 - RNA, 19 nt, Homo sapiens
ggaacagcccuccuugaag

SEQ ID NO: 1217357 - RNA, 19 nt, Homo sapiens
uucaauugcugcucccuuu

SEQ ID NO: 1217358 - RNA, 19 nt, Homo sapiens
gaaaggccgagaaccucuu

SEQ ID NO: 1217359 - RNA, 19 nt, Homo sapiens
caagucacacacccucaaa

SEQ ID NO: 1217360 - RNA, 19 nt, Homo sapiens
ucaacugcuucucuaggaa

SEQ ID NO: 1217361 - RNA, 19 nt, Homo sapiens
agguuucucucuguaauaa

SEQ ID NO: 1217362 - RNA, 19 nt, Homo sapiens
gcugcucccuuuacuuucu

SEQ ID NO: 1217363 - RNA, 19 nt, Homo sapiens
ucaauugcugcucccuuua

SEQ ID NO: 1217364 - RNA, 19 nt, Homo sapiens
caugacgacugaaauuggu

SEQ ID NO: 1217365 - RNA, 19 nt, Homo sapiens
guuucucucuguaauaaca

SEQ ID NO: 1217366 - RNA, 19 nt, Homo sapiens
guccuggagccuugaauuu

SEQ ID NO: 1217367 - RNA, 19 nt, Homo sapiens
gaagacuagauugauggua

SEQ ID NO: 1217368 - RNA, 19 nt, Homo sapiens
uacaaaggcacucuaguuc

SEQ ID NO: 1217369 - RNA, 19 nt, Homo sapiens
caacucaggacgcuucaag

SEQ ID NO: 1217370 - RNA, 19 nt, Homo sapiens
gggaguggguggggaauuu

SEQ ID NO: 1217371 - RNA, 19 nt, Homo sapiens
gaagcuacacgggccaaau

SEQ ID NO: 1217372 - RNA, 19 nt, Homo sapiens
agaaauccacucccaaagu

SEQ ID NO: 1217373 - RNA, 19 nt, Homo sapiens
gacagacuucaccuccuua

SEQ ID NO: 1217374 - RNA, 19 nt, Homo sapiens
cucccaaagugcuguauga

SEQ ID NO: 1217375 - RNA, 19 nt, Homo sapiens
ucaagggcgaguuucaauu

SEQ ID NO: 1217376 - RNA, 19 nt, Homo sapiens
guuccuucauguaaguaaa

SEQ ID NO: 1217377 - RNA, 19 nt, Homo sapiens
ggcaggaaauggcuguuuu

SEQ ID NO: 1217378 - RNA, 19 nt, Homo sapiens
ccuaaccucuuugaugauc

SEQ ID NO: 1217379 - RNA, 19 nt, Homo sapiens
gagcagucgggauuacaga

SEQ ID NO: 1217380 - RNA, 19 nt, Homo sapiens
guugguggaagcugacuuu

SEQ ID NO: 1217381 - RNA, 19 nt, Homo sapiens
uugcugcucccuuuacuuu

SEQ ID NO: 1217382 - RNA, 19 nt, Homo sapiens
agacuucaccuccuuacug

SEQ ID NO: 1217383 - RNA, 19 nt, Homo sapiens
ccaaacagagggagaugca

SEQ ID NO: 1217384 - RNA, 19 nt, Homo sapiens
uauguuccuucauguaagu

SEQ ID NO: 1217385 - RNA, 19 nt, Homo sapiens
ggucaagggcgaguuucaa

SEQ ID NO: 1217386 - RNA, 19 nt, Homo sapiens
acaaaggcacucuaguuca

SEQ ID NO: 1217387 - RNA, 19 nt, Homo sapiens
uuccagaagccacgugaua

SEQ ID NO: 1217388 - RNA, 19 nt, Homo sapiens
uaguuuggccuguuaguuc

SEQ ID NO: 1217389 - RNA, 19 nt, Homo sapiens
guaguuuggccuguuaguu

SEQ ID NO: 1217390 - RNA, 19 nt, Homo sapiens
cuguuagggugcuguagaa

SEQ ID NO: 1217391 - RNA, 19 nt, Homo sapiens
acaccuaugcccaaacaga

SEQ ID NO: 1217392 - RNA, 19 nt, Homo sapiens
caggacgcuucaaggagaa

SEQ ID NO: 1217393 - RNA, 19 nt, Homo sapiens
gccaugacgacugaaauug

SEQ ID NO: 1217394 - RNA, 19 nt, Homo sapiens
uaauaacaacgcuggaaag

SEQ ID NO: 1217395 - RNA, 19 nt, Homo sapiens
augguaguuuggccuguua

SEQ ID NO: 1217396 - RNA, 19 nt, Homo sapiens
cucaacugcuucucuagga

SEQ ID NO: 1217397 - RNA, 19 nt, Homo sapiens
guuagggugcuguagaaga

SEQ ID NO: 1217398 - RNA, 19 nt, Homo sapiens
gagggcacauuuuccagaa

SEQ ID NO: 1217399 - RNA, 19 nt, Homo sapiens
gggcauggcagggaaugga

SEQ ID NO: 1217400 - RNA, 19 nt, Homo sapiens
caaagugcuguaugagauc

SEQ ID NO: 1217401 - RNA, 19 nt, Homo sapiens
aggaaggacggucaucaaa

SEQ ID NO: 1217402 - RNA, 19 nt, Homo sapiens
acacccgccuggagaagau

SEQ ID NO: 1217403 - RNA, 19 nt, Homo sapiens
uagguuucucucuguaaua

SEQ ID NO: 1217404 - RNA, 19 nt, Homo sapiens
ccugacaccuaugcccaaa

SEQ ID NO: 1217405 - RNA, 19 nt, Homo sapiens
cgucaaggucuccaacuca

SEQ ID NO: 1217406 - RNA, 19 nt, Homo sapiens
ccucucccuuuccuacuau

SEQ ID NO: 1217407 - RNA, 19 nt, Homo sapiens
ggccaugacuuuugcagau

SEQ ID NO: 1217408 - RNA, 19 nt, Homo sapiens
aggcagagacacugaacuu

SEQ ID NO: 1217409 - RNA, 19 nt, Homo sapiens
cgccaugacgacugaaauu

SEQ ID NO: 1217410 - RNA, 19 nt, Homo sapiens
uuagggugcuguagaagac

SEQ ID NO: 1217411 - RNA, 19 nt, Homo sapiens
ccagaggcagagacacuga

SEQ ID NO: 1217412 - RNA, 19 nt, Homo sapiens
cuccuacacucaacugcuu

SEQ ID NO: 1217413 - RNA, 19 nt, Homo sapiens
caaagggcaagcacgucaa

SEQ ID NO: 1217414 - RNA, 19 nt, Homo sapiens
gaacccuaaccucuuugau

SEQ ID NO: 1217415 - RNA, 19 nt, Homo sapiens
gcaaugaggugaacgauga

SEQ ID NO: 1217416 - RNA, 19 nt, Homo sapiens
gaggaacgcuugaaggaaa

SEQ ID NO: 1217417 - RNA, 19 nt, Homo sapiens
ccugugauccgcccaauua

SEQ ID NO: 1217418 - RNA, 19 nt, Homo sapiens
gcaagagcauguggaagga

SEQ ID NO: 1217419 - RNA, 19 nt, Homo sapiens
gcaagaagcagaaggaaaa

SEQ ID NO: 1217420 - RNA, 19 nt, Homo sapiens
ccucaguucucuuuggaaa

SEQ ID NO: 1217421 - RNA, 19 nt, Homo sapiens
gaagccagagaaauugaaa

SEQ ID NO: 1217422 - RNA, 19 nt, Homo sapiens
uguaggcccuguuggcuuu

SEQ ID NO: 1217423 - RNA, 19 nt, Homo sapiens
ugagaugaaugggaaguau

SEQ ID NO: 1217424 - RNA, 19 nt, Homo sapiens
gguugggccugaaagagaa

SEQ ID NO: 1217425 - RNA, 19 nt, Homo sapiens
gaaauugaaacggugcauu

SEQ ID NO: 1217426 - RNA, 19 nt, Homo sapiens
ggagugggaugcagaugac

SEQ ID NO: 1217427 - RNA, 19 nt, Homo sapiens
ccaauuaucgcgaccaaca

SEQ ID NO: 1217428 - RNA, 19 nt, Homo sapiens
gcgaggaacgcuugaagga

SEQ ID NO: 1217429 - RNA, 19 nt, Homo sapiens
ggaaauggaggcggagaug

SEQ ID NO: 1217430 - RNA, 19 nt, Homo sapiens
gaagaagcugggccugaga

SEQ ID NO: 1217431 - RNA, 19 nt, Homo sapiens
cuaagcagagacuguagua

SEQ ID NO: 1217432 - RNA, 19 nt, Homo sapiens
ggaagccagagaaauugaa

SEQ ID NO: 1217433 - RNA, 19 nt, Homo sapiens
ggagauggcccuguuugag

SEQ ID NO: 1217434 - RNA, 19 nt, Homo sapiens
ccaugaugcugccaccaau

SEQ ID NO: 1217435 - RNA, 19 nt, Homo sapiens
gacaagcgcacaggcaaga

SEQ ID NO: 1217436 - RNA, 19 nt, Homo sapiens
ccaucaagcuucgcaagag

SEQ ID NO: 1217437 - RNA, 19 nt, Homo sapiens
gagaugaaugggaaguaug

SEQ ID NO: 1217438 - RNA, 19 nt, Homo sapiens
gggaagccagagaaauuga

SEQ ID NO: 1217439 - RNA, 19 nt, Homo sapiens
ggguugggccugaaagaga

SEQ ID NO: 1217440 - RNA, 19 nt, Homo sapiens
ccaaggugauccgugacaa

SEQ ID NO: 1217441 - RNA, 19 nt, Homo sapiens
aaauugaaacggugcauuc

SEQ ID NO: 1217442 - RNA, 19 nt, Homo sapiens
gcccaauuaucgcgaccaa

SEQ ID NO: 1217443 - RNA, 19 nt, Homo sapiens
ggccugagauagggucugu

SEQ ID NO: 1217444 - RNA, 19 nt, Homo sapiens
gaagcugggccugagauag

SEQ ID NO: 1217445 - RNA, 19 nt, Homo sapiens
aggcggagauggcccuguu

SEQ ID NO: 1217446 - RNA, 19 nt, Homo sapiens
cggcuaagcagagacugua

SEQ ID NO: 1217447 - RNA, 19 nt, Homo sapiens
gcggagauggcccuguuug

SEQ ID NO: 1217448 - RNA, 19 nt, Homo sapiens
gcuggcuccucccucaguu

SEQ ID NO: 1217449 - RNA, 19 nt, Homo sapiens
cgaggaacgcuugaaggaa

SEQ ID NO: 1217450 - RNA, 19 nt, Homo sapiens
gcuccucccucaguucucu

SEQ ID NO: 1217451 - RNA, 19 nt, Homo sapiens
guaccuggaaucccaacug

SEQ ID NO: 1217452 - RNA, 19 nt, Homo sapiens
gcuacggcuucgucagcuu

SEQ ID NO: 1217453 - RNA, 19 nt, Homo sapiens
ggguggcccuccuuuugua

SEQ ID NO: 1217454 - RNA, 19 nt, Homo sapiens
uuaucgcgaccaacacaua

SEQ ID NO: 1217455 - RNA, 19 nt, Homo sapiens
gcgaguaccugaaugcuua

SEQ ID NO: 1217456 - RNA, 19 nt, Homo sapiens
gaagaaccuuucaagauga

SEQ ID NO: 1217457 - RNA, 19 nt, Homo sapiens
gaaccaagauucauaaacu

SEQ ID NO: 1217458 - RNA, 19 nt, Homo sapiens
gaaaggaaauauugcacuu

SEQ ID NO: 1217459 - RNA, 19 nt, Homo sapiens
ggacaggaguuccagaaga

SEQ ID NO: 1217460 - RNA, 19 nt, Homo sapiens
caacgagcaucucaugaaa

SEQ ID NO: 1217461 - RNA, 19 nt, Homo sapiens
agaagaaccuuucaagaug

SEQ ID NO: 1217462 - RNA, 19 nt, Homo sapiens
cagcaacucuucccacuga

SEQ ID NO: 1217463 - RNA, 19 nt, Homo sapiens
gacaggaguuccagaagaa

SEQ ID NO: 1217464 - RNA, 19 nt, Homo sapiens
ucaaggaguggaaguauua

SEQ ID NO: 1217465 - RNA, 19 nt, Homo sapiens
guacgaagcccuugcauca

SEQ ID NO: 1217466 - RNA, 19 nt, Homo sapiens
ggagaucaaugagcaagaa

SEQ ID NO: 1217467 - RNA, 19 nt, Homo sapiens
gaaacucuguucuguacga

SEQ ID NO: 1217468 - RNA, 19 nt, Homo sapiens
gagcacaucagagaaauaa

SEQ ID NO: 1217469 - RNA, 19 nt, Homo sapiens
gcaacgagcaucucaugaa

SEQ ID NO: 1217470 - RNA, 19 nt, Homo sapiens
gcacaucagagaaauaaau

SEQ ID NO: 1217471 - RNA, 19 nt, Homo sapiens
agagauagcugcaaaauau

SEQ ID NO: 1217472 - RNA, 19 nt, Homo sapiens
cuagauugcuguauaagga

SEQ ID NO: 1217473 - RNA, 19 nt, Homo sapiens
gaagagaaauuggaaaaug

SEQ ID NO: 1217474 - RNA, 19 nt, Homo sapiens
ucaaguguuugccucauuu

SEQ ID NO: 1217475 - RNA, 19 nt, Homo sapiens
gugcuagauugcuguauaa

SEQ ID NO: 1217476 - RNA, 19 nt, Homo sapiens
cagaagaaccuuucaagau

SEQ ID NO: 1217477 - RNA, 19 nt, Homo sapiens
gaaacccacuguguaacuu

SEQ ID NO: 1217478 - RNA, 19 nt, Homo sapiens
ggagaaaaguuggauauga

SEQ ID NO: 1217479 - RNA, 19 nt, Homo sapiens
gcagagaaacccacugugu

SEQ ID NO: 1217480 - RNA, 19 nt, Homo sapiens
ccaggaaggugcucuugga

SEQ ID NO: 1217481 - RNA, 19 nt, Homo sapiens
ugagucuggucuccuaaua

SEQ ID NO: 1217482 - RNA, 19 nt, Homo sapiens
caagaagcauuggaagaga

SEQ ID NO: 1217483 - RNA, 19 nt, Homo sapiens
agagaaacccacuguguaa

SEQ ID NO: 1217484 - RNA, 19 nt, Homo sapiens
cagagaaacccacugugua

SEQ ID NO: 1217485 - RNA, 19 nt, Homo sapiens
uggaagagauagcugcaaa

SEQ ID NO: 1217486 - RNA, 19 nt, Homo sapiens
gagcagaucccguaaacag

SEQ ID NO: 1217487 - RNA, 19 nt, Homo sapiens
gcucacacauccacgaaca

SEQ ID NO: 1217488 - RNA, 19 nt, Homo sapiens
guuugugucugcaucagua

SEQ ID NO: 1217489 - RNA, 19 nt, Homo sapiens
gcaagaagcauuggaagag

SEQ ID NO: 1217490 - RNA, 19 nt, Homo sapiens
ggucgggacuuccuucagu

SEQ ID NO: 1217491 - RNA, 19 nt, Homo sapiens
gcacugggagcacaucaga

SEQ ID NO: 1217492 - RNA, 19 nt, Homo sapiens
gagcaacgagcaucucaug

SEQ ID NO: 1217493 - RNA, 19 nt, Homo sapiens
ugugcuagauugcuguaua

SEQ ID NO: 1217494 - RNA, 19 nt, Homo sapiens
cagaccggcuucagaguga

SEQ ID NO: 1217495 - RNA, 19 nt, Homo sapiens
aaacaguggagaucaauga

SEQ ID NO: 1217496 - RNA, 19 nt, Homo sapiens
ggagcaggcgaacccuuua

SEQ ID NO: 1217497 - RNA, 19 nt, Homo sapiens
acagaaaccacuccggaua

SEQ ID NO: 1217498 - RNA, 19 nt, Homo sapiens
ccggauacaucaccauuca

SEQ ID NO: 1217499 - RNA, 19 nt, Homo sapiens
gaaccuauuggauuccuau

SEQ ID NO: 1217500 - RNA, 19 nt, Homo sapiens
ggacuuccuucaguuucaa

SEQ ID NO: 1217501 - RNA, 19 nt, Homo sapiens
gagcaucucaugaaacucu

SEQ ID NO: 1217502 - RNA, 19 nt, Homo sapiens
uuucuguucucaugacuaa

SEQ ID NO: 1217503 - RNA, 19 nt, Homo sapiens
gucaaggaguggaaguauu

SEQ ID NO: 1217504 - RNA, 19 nt, Homo sapiens
gcugucauuuacuuacaaa

SEQ ID NO: 1217505 - RNA, 19 nt, Homo sapiens
acacauccacgaacaaaug

SEQ ID NO: 1217506 - RNA, 19 nt, Homo sapiens
ccagaagaaccuuucaaga

SEQ ID NO: 1217507 - RNA, 19 nt, Homo sapiens
ggagcacaucagagaaaua

SEQ ID NO: 1217508 - RNA, 19 nt, Homo sapiens
guguuugccucauuuacaa

SEQ ID NO: 1217509 - RNA, 19 nt, Homo sapiens
ucaugaaacucuguucugu

SEQ ID NO: 1217510 - RNA, 19 nt, Homo sapiens
guaccugaaugcuuacucu

SEQ ID NO: 1217511 - RNA, 19 nt, Homo sapiens
uaaggcgucugcgagauga

SEQ ID NO: 1217512 - RNA, 19 nt, Homo sapiens
caagauucauaaacuaagg

SEQ ID NO: 1217513 - RNA, 19 nt, Homo sapiens
gggacuuccuucaguuuca

SEQ ID NO: 1217514 - RNA, 19 nt, Homo sapiens
caggugaaaggaaauauug

SEQ ID NO: 1217515 - RNA, 19 nt, Homo sapiens
aaugaaggcugaggagguu

SEQ ID NO: 1217516 - RNA, 19 nt, Homo sapiens
agucuggucuccuaauaga

SEQ ID NO: 1217517 - RNA, 19 nt, Homo sapiens
aagaagcauuggaagagaa

SEQ ID NO: 1217518 - RNA, 19 nt, Homo sapiens
gcaaggacggcagggauug

SEQ ID NO: 1217519 - RNA, 19 nt, Homo sapiens
gacauuggagucccuauca

SEQ ID NO: 1217520 - RNA, 19 nt, Homo sapiens
gagaaaaguuggauaugag

SEQ ID NO: 1217521 - RNA, 19 nt, Homo sapiens
caugaaacucuguucugua

SEQ ID NO: 1217522 - RNA, 19 nt, Homo sapiens
ccuauuggauuccuauuuu

SEQ ID NO: 1217523 - RNA, 19 nt, Homo sapiens
caaaggagguguuuuagcu

SEQ ID NO: 1217524 - RNA, 19 nt, Homo sapiens
caaguguuugccucauuua

SEQ ID NO: 1217525 - RNA, 19 nt, Homo sapiens
gugagcagaucccguaaac

SEQ ID NO: 1217526 - RNA, 19 nt, Homo sapiens
ggauacaucaccauucagu

SEQ ID NO: 1217527 - RNA, 19 nt, Homo sapiens
uauaaggaccucacagcaa

SEQ ID NO: 1217528 - RNA, 19 nt, Homo sapiens
gagaagcaaggacauugga

SEQ ID NO: 1217529 - RNA, 19 nt, Homo sapiens
uguguaacuugcugucauu

SEQ ID NO: 1217530 - RNA, 19 nt, Homo sapiens
agacguggauggcgggaau

SEQ ID NO: 1217531 - RNA, 19 nt, Homo sapiens
agaccaacauccagcacuu

SEQ ID NO: 1217532 - RNA, 19 nt, Homo sapiens
ucacacauccacgaacaaa

SEQ ID NO: 1217533 - RNA, 19 nt, Homo sapiens
gaaccuuucaagaugauca

SEQ ID NO: 1217534 - RNA, 19 nt, Homo sapiens
gggagcacaucagagaaau

SEQ ID NO: 1217535 - RNA, 19 nt, Homo sapiens
gggagaagcaaggacauug

SEQ ID NO: 1217536 - RNA, 19 nt, Homo sapiens
gcacuuucuguucucauga

SEQ ID NO: 1217537 - RNA, 19 nt, Homo sapiens
gaucaaugagcaagaagca

SEQ ID NO: 1217538 - RNA, 19 nt, Homo sapiens
caauguagaacccaaccaa

SEQ ID NO: 1217539 - RNA, 19 nt, Homo sapiens
gucauuuacuuacaaacug

SEQ ID NO: 1217540 - RNA, 19 nt, Homo sapiens
aagccauucugcaggcaua

SEQ ID NO: 1217541 - RNA, 19 nt, Homo sapiens
cuuccgguuuggacuguua

SEQ ID NO: 1217542 - RNA, 19 nt, Homo sapiens
auaugagucuggucuccua

SEQ ID NO: 1217543 - RNA, 19 nt, Homo sapiens
ccaccaagcccugucugaa

SEQ ID NO: 1217544 - RNA, 19 nt, Homo sapiens
ccaggugaaaggaaauauu

SEQ ID NO: 1217545 - RNA, 19 nt, Homo sapiens
aggcugaggagguuucuaa

SEQ ID NO: 1217546 - RNA, 19 nt, Homo sapiens
gagcucacacauccacgaa

SEQ ID NO: 1217547 - RNA, 19 nt, Homo sapiens
ggagaagcaaggacauugg

SEQ ID NO: 1217548 - RNA, 19 nt, Homo sapiens
uguaacuugcugucauuua

SEQ ID NO: 1217549 - RNA, 19 nt, Homo sapiens
ggaccuugucauacagaaa

SEQ ID NO: 1217550 - RNA, 19 nt, Homo sapiens
gcaggcauaucauuuuaca

SEQ ID NO: 1217551 - RNA, 19 nt, Homo sapiens
ggaaagcccagcggcaaag

SEQ ID NO: 1217552 - RNA, 19 nt, Homo sapiens
augaaacucuguucuguac

SEQ ID NO: 1217553 - RNA, 19 nt, Homo sapiens
agaaaccacuccggauaca

SEQ ID NO: 1217554 - RNA, 19 nt, Homo sapiens
ggaaccaagauucauaaac

SEQ ID NO: 1217555 - RNA, 19 nt, Homo sapiens
gaagagagcucccuuuguu

SEQ ID NO: 1217556 - RNA, 19 nt, Homo sapiens
gaagacccauaauaaauga

SEQ ID NO: 1217557 - RNA, 19 nt, Homo sapiens
ggaagacagugacaagaaa

SEQ ID NO: 1217558 - RNA, 19 nt, Homo sapiens
aagaagagaugaaggauga

SEQ ID NO: 1217559 - RNA, 19 nt, Homo sapiens
ggacgccucugacuucgaa

SEQ ID NO: 1217560 - RNA, 19 nt, Homo sapiens
ggaagacccauaauaaaug

SEQ ID NO: 1217561 - RNA, 19 nt, Homo sapiens
gaacaccuaccaagcauug

SEQ ID NO: 1217562 - RNA, 19 nt, Homo sapiens
cuacaaaccucccuucagu

SEQ ID NO: 1217563 - RNA, 19 nt, Homo sapiens
gggaagacccauaauaaau

SEQ ID NO: 1217564 - RNA, 19 nt, Homo sapiens
ccgcagaccuccuccaaga

SEQ ID NO: 1217565 - RNA, 19 nt, Homo sapiens
gagaagagagcucccuuug

SEQ ID NO: 1217566 - RNA, 19 nt, Homo sapiens
uauggaugguucagaauuu

SEQ ID NO: 1217567 - RNA, 19 nt, Homo sapiens
gagaccaccugccucauuc

SEQ ID NO: 1217568 - RNA, 19 nt, Homo sapiens
ucaagaggaagccgaguua

SEQ ID NO: 1217569 - RNA, 19 nt, Homo sapiens
gcuggaacacagagaaaua

SEQ ID NO: 1217570 - RNA, 19 nt, Homo sapiens
gcaggccagugccauauca

SEQ ID NO: 1217571 - RNA, 19 nt, Homo sapiens
ugaggucuguguuuccuuu

SEQ ID NO: 1217572 - RNA, 19 nt, Homo sapiens
uaccaagcauugauucuga

SEQ ID NO: 1217573 - RNA, 19 nt, Homo sapiens
gcaccugggcagacucuuu

SEQ ID NO: 1217574 - RNA, 19 nt, Homo sapiens
ggaaaccacaggagaaagu

SEQ ID NO: 1217575 - RNA, 19 nt, Homo sapiens
gcagaccuccuccaagaug

SEQ ID NO: 1217576 - RNA, 19 nt, Homo sapiens
gagcggagaguccaugaug

SEQ ID NO: 1217577 - RNA, 19 nt, Homo sapiens
gaggaaggccgcugaugga

SEQ ID NO: 1217578 - RNA, 19 nt, Homo sapiens
gaaaagaagagaugaagga

SEQ ID NO: 1217579 - RNA, 19 nt, Homo sapiens
cgaguuagguggccagaac

SEQ ID NO: 1217580 - RNA, 19 nt, Homo sapiens
guccaugugucaaucagaa

SEQ ID NO: 1217581 - RNA, 19 nt, Homo sapiens
gaacucauucgggagguuu

SEQ ID NO: 1217582 - RNA, 19 nt, Homo sapiens
caccugggcagacucuuua

SEQ ID NO: 1217583 - RNA, 19 nt, Homo sapiens
caugaugggugcuggagau

SEQ ID NO: 1217584 - RNA, 19 nt, Homo sapiens
ggagccagagggcaaauug

SEQ ID NO: 1217585 - RNA, 19 nt, Homo sapiens
ucgcagaccugagcacaga

SEQ ID NO: 1217586 - RNA, 19 nt, Homo sapiens
gaugacagcaagccugaga

SEQ ID NO: 1217587 - RNA, 19 nt, Homo sapiens
acaaaccucccuucaguug

SEQ ID NO: 1217588 - RNA, 19 nt, Homo sapiens
aaguauggaugguucagaa

SEQ ID NO: 1217589 - RNA, 19 nt, Homo sapiens
gccaagaccaccugucaga

SEQ ID NO: 1217590 - RNA, 19 nt, Homo sapiens
ggaagcuggccaccucuga

SEQ ID NO: 1217591 - RNA, 19 nt, Homo sapiens
cgagaccaccugccucauu

SEQ ID NO: 1217592 - RNA, 19 nt, Homo sapiens
gcuccuccgucaaccagaa

SEQ ID NO: 1217593 - RNA, 19 nt, Homo sapiens
guauggaugguucagaauu

SEQ ID NO: 1217594 - RNA, 19 nt, Homo sapiens
cgccuuaacuaccggaaga

SEQ ID NO: 1217595 - RNA, 19 nt, Homo sapiens
cagcucacaugccaaugga

SEQ ID NO: 1217596 - RNA, 19 nt, Homo sapiens
uuaacuaccggaagacaaa

SEQ ID NO: 1217597 - RNA, 19 nt, Homo sapiens
acagcaagccugagacaga

SEQ ID NO: 1217598 - RNA, 19 nt, Homo sapiens
ggaguuguaggccacuuug

SEQ ID NO: 1217599 - RNA, 19 nt, Homo sapiens
cagcagggcauuccagaca

SEQ ID NO: 1217600 - RNA, 19 nt, Homo sapiens
ccuuuagccuggaaacaau

SEQ ID NO: 1217601 - RNA, 19 nt, Homo sapiens
ggaugguucagaauuuguu

SEQ ID NO: 1217602 - RNA, 19 nt, Homo sapiens
ggaccuggaagcuuucaag

SEQ ID NO: 1217603 - RNA, 19 nt, Homo sapiens
accgggaccuggaagcuuu

SEQ ID NO: 1217604 - RNA, 19 nt, Homo sapiens
ggacagccagauacaggau

SEQ ID NO: 1217605 - RNA, 19 nt, Homo sapiens
gaugggugcuggagauucc

SEQ ID NO: 1217606 - RNA, 19 nt, Homo sapiens
cagccaagaccaccuguca

SEQ ID NO: 1217607 - RNA, 19 nt, Homo sapiens
gacccauaauaaaugauuc

SEQ ID NO: 1217608 - RNA, 19 nt, Homo sapiens
caauggagacccuguugca

SEQ ID NO: 1217609 - RNA, 19 nt, Homo sapiens
ggaacacagagaaauagca

SEQ ID NO: 1217610 - RNA, 19 nt, Homo sapiens
gaaaccacaggagaaagug

SEQ ID NO: 1217611 - RNA, 19 nt, Homo sapiens
gaaggggaagggacucaua

SEQ ID NO: 1217612 - RNA, 19 nt, Homo sapiens
gaugguucagaauuuguuu

SEQ ID NO: 1217613 - RNA, 19 nt, Homo sapiens
ggucuuccauggacaacac

SEQ ID NO: 1217614 - RNA, 19 nt, Homo sapiens
gggaagauaaaaugacuaa

SEQ ID NO: 1217615 - RNA, 19 nt, Homo sapiens
aagaccaccugucagaaca

SEQ ID NO: 1217616 - RNA, 19 nt, Homo sapiens
caagaccaccugucagaac

SEQ ID NO: 1217617 - RNA, 19 nt, Homo sapiens
aggaagacagugacaagaa

SEQ ID NO: 1217618 - RNA, 19 nt, Homo sapiens
gggcaaauugggaccuguu

SEQ ID NO: 1217619 - RNA, 19 nt, Homo sapiens
ugacuaagaggaagaagcu

SEQ ID NO: 1217620 - RNA, 19 nt, Homo sapiens
gaagacagugacaagaaaa

SEQ ID NO: 1217621 - RNA, 19 nt, Homo sapiens
ccaggaagacagugacaag

SEQ ID NO: 1217622 - RNA, 19 nt, Homo sapiens
gccaauggagacccuguug

SEQ ID NO: 1217623 - RNA, 19 nt, Homo sapiens
ggaacaccuaccaagcauu

SEQ ID NO: 1217624 - RNA, 19 nt, Homo sapiens
gagguuuguuccccaguuu

SEQ ID NO: 1217625 - RNA, 19 nt, Homo sapiens
gggaguuguaggccacuuu

SEQ ID NO: 1217626 - RNA, 19 nt, Homo sapiens
ggagauuccggucaugcau

SEQ ID NO: 1217627 - RNA, 19 nt, Homo sapiens
ccuggacgccucugacuuc

SEQ ID NO: 1217628 - RNA, 19 nt, Homo sapiens
gaccaccugucagaacaag

SEQ ID NO: 1217629 - RNA, 19 nt, Homo sapiens
gccuuuagccuggaaacaa

SEQ ID NO: 1217630 - RNA, 19 nt, Homo sapiens
aagagagcucccuuuguuu

SEQ ID NO: 1217631 - RNA, 19 nt, Homo sapiens
ccauggacaacacaaagga

SEQ ID NO: 1217632 - RNA, 19 nt, Homo sapiens
gacaaagcugggaggcaaa

SEQ ID NO: 1217633 - RNA, 19 nt, Homo sapiens
ccaagaccaccugucagaa

SEQ ID NO: 1217634 - RNA, 19 nt, Homo sapiens
agaagagagcucccuuugu

SEQ ID NO: 1217635 - RNA, 19 nt, Homo sapiens
gaccuguucccucuacaca

SEQ ID NO: 1217636 - RNA, 19 nt, Homo sapiens
gugcuggaacacagagaaa

SEQ ID NO: 1217637 - RNA, 19 nt, Homo sapiens
ggacuuacccuuuaaauua

SEQ ID NO: 1217638 - RNA, 19 nt, Homo sapiens
gagcgaauauccugacuua

SEQ ID NO: 1217639 - RNA, 19 nt, Homo sapiens
gaacacggcuugggaggaa

SEQ ID NO: 1217640 - RNA, 19 nt, Homo sapiens
uuaaacagcugcauuucuu

SEQ ID NO: 1217641 - RNA, 19 nt, Homo sapiens
ccaggaaacuguaaagagu

SEQ ID NO: 1217642 - RNA, 19 nt, Homo sapiens
aaaagacgcuguccaagua

SEQ ID NO: 1217643 - RNA, 19 nt, Homo sapiens
gugccggacuuacccuuua

SEQ ID NO: 1217644 - RNA, 19 nt, Homo sapiens
gaacggaagaugccugugu

SEQ ID NO: 1217645 - RNA, 19 nt, Homo sapiens
agaaggaugucccguggaa

SEQ ID NO: 1217646 - RNA, 19 nt, Homo sapiens
gauucucauuugucccuua

SEQ ID NO: 1217647 - RNA, 19 nt, Homo sapiens
ggaaggcccaggaaacugu

SEQ ID NO: 1217648 - RNA, 19 nt, Homo sapiens
gcagcgacuucgaaugcaa

SEQ ID NO: 1217649 - RNA, 19 nt, Homo sapiens
guacgaguccagcgagauu

SEQ ID NO: 1217650 - RNA, 19 nt, Homo sapiens
gaaacuguaaagaguguau

SEQ ID NO: 1217651 - RNA, 19 nt, Homo sapiens
gagcagcgacuucgaaugc

SEQ ID NO: 1217652 - RNA, 19 nt, Homo sapiens
guucuuaaacagacuugua

SEQ ID NO: 1217653 - RNA, 19 nt, Homo sapiens
aacgaaaacugcuacaaua

SEQ ID NO: 1217654 - RNA, 19 nt, Homo sapiens
uaacgguugauucucauuu

SEQ ID NO: 1217655 - RNA, 19 nt, Homo sapiens
gcugcgcaguucuguaaga

SEQ ID NO: 1217656 - RNA, 19 nt, Homo sapiens
ggaacgagacccacagcau

SEQ ID NO: 1217657 - RNA, 19 nt, Homo sapiens
gaaaagacgcuguccaagu

SEQ ID NO: 1217658 - RNA, 19 nt, Homo sapiens
gaaaacugcuacaauacuc

SEQ ID NO: 1217659 - RNA, 19 nt, Homo sapiens
gagcuacgucugugugugu

SEQ ID NO: 1217660 - RNA, 19 nt, Homo sapiens
gaaggcccaggaaacugua

SEQ ID NO: 1217661 - RNA, 19 nt, Homo sapiens
ccugguggcugcagcugaa

SEQ ID NO: 1217662 - RNA, 19 nt, Homo sapiens
aauugaccauuguagguaa

SEQ ID NO: 1217663 - RNA, 19 nt, Homo sapiens
aaauugaccauuguaggua

SEQ ID NO: 1217664 - RNA, 19 nt, Homo sapiens
cgagagcagcgacuucgaa

SEQ ID NO: 1217665 - RNA, 19 nt, Homo sapiens
gagagcagcgacuucgaau

SEQ ID NO: 1217666 - RNA, 19 nt, Homo sapiens
gggcugguggacaaguuua

SEQ ID NO: 1217667 - RNA, 19 nt, Homo sapiens
ccuguaaugugccggacuu

SEQ ID NO: 1217668 - RNA, 19 nt, Homo sapiens
ugacuuauucgagugguuu

SEQ ID NO: 1217669 - RNA, 19 nt, Homo sapiens
ccugacggcuucgaaggaa

SEQ ID NO: 1217670 - RNA, 19 nt, Homo sapiens
acagcugcauuucuugguu

SEQ ID NO: 1217671 - RNA, 19 nt, Homo sapiens
cgaaugcaaccagaugcua

SEQ ID NO: 1217672 - RNA, 19 nt, Homo sapiens
cggacuuacccuuuaaauu

SEQ ID NO: 1217673 - RNA, 19 nt, Homo sapiens
aggaaacuguaaagagugu

SEQ ID NO: 1217674 - RNA, 19 nt, Homo sapiens
ugccggacuuacccuuuaa

SEQ ID NO: 1217675 - RNA, 19 nt, Homo sapiens
gcagcugaagagcgaauau

SEQ ID NO: 1217676 - RNA, 19 nt, Homo sapiens
uaaacagcugcauuucuug

SEQ ID NO: 1217677 - RNA, 19 nt, Homo sapiens
aacgguugauucucauuug

SEQ ID NO: 1217678 - RNA, 19 nt, Homo sapiens
gaaggaugucccguggaaa

SEQ ID NO: 1217679 - RNA, 19 nt, Homo sapiens
ccgcgaagaccuguaaugu

SEQ ID NO: 1217680 - RNA, 19 nt, Homo sapiens
guggacaccgcaaagaaga

SEQ ID NO: 1217681 - RNA, 19 nt, Homo sapiens
cugcauuucuugguuguuc

SEQ ID NO: 1217682 - RNA, 19 nt, Homo sapiens
ugaagccacagaaggagaa

SEQ ID NO: 1217683 - RNA, 19 nt, Homo sapiens
gagacugcggcgaguguga

SEQ ID NO: 1217684 - RNA, 19 nt, Homo sapiens
aaccuacggucccgacugu

SEQ ID NO: 1217685 - RNA, 19 nt, Homo sapiens
ucucauuugucccuuaaac

SEQ ID NO: 1217686 - RNA, 19 nt, Homo sapiens
gagggagcacggacagugu

SEQ ID NO: 1217687 - RNA, 19 nt, Homo sapiens
ucagcucgcuccggaacga

SEQ ID NO: 1217688 - RNA, 19 nt, Homo sapiens
auucucauuugucccuuaa

SEQ ID NO: 1217689 - RNA, 19 nt, Homo sapiens
gggcaaagcuuuagaagua

SEQ ID NO: 1217690 - RNA, 19 nt, Homo sapiens
gggcgaagcuuuaaagaua

SEQ ID NO: 1217691 - RNA, 19 nt, Homo sapiens
gaacucagaucucaucaaa

SEQ ID NO: 1217692 - RNA, 19 nt, Homo sapiens
ggagagaaguuuaugugua

SEQ ID NO: 1217693 - RNA, 19 nt, Homo sapiens
ggacgaagcuuuugugaua

SEQ ID NO: 1217694 - RNA, 19 nt, Homo sapiens
ggaaggaggucuuuguuug

SEQ ID NO: 1217695 - RNA, 19 nt, Homo sapiens
ggaagaagcccuacauuug

SEQ ID NO: 1217696 - RNA, 19 nt, Homo sapiens
gggcgaggcuuuagucaua

SEQ ID NO: 1217697 - RNA, 19 nt, Homo sapiens
gcagaggaaucuauacaaa

SEQ ID NO: 1217698 - RNA, 19 nt, Homo sapiens
gagaggagccuuaugagua

SEQ ID NO: 1217699 - RNA, 19 nt, Homo sapiens
ggaaaucacuccuccuugu

SEQ ID NO: 1217700 - RNA, 19 nt, Homo sapiens
ggaaaucacuccuccuugu

SEQ ID NO: 1217701 - RNA, 19 nt, Homo sapiens
gaagucaaaucucaucaga

SEQ ID NO: 1217702 - RNA, 19 nt, Homo sapiens
cagcagaacuccaucuuga

SEQ ID NO: 1217703 - RNA, 19 nt, Homo sapiens
gcaaucaacuguagagagu

SEQ ID NO: 1217704 - RNA, 19 nt, Homo sapiens
gagagaaguuuauguguag

SEQ ID NO: 1217705 - RNA, 19 nt, Homo sapiens
uuagaaaccuugagauuug

SEQ ID NO: 1217706 - RNA, 19 nt, Homo sapiens
ggagaagcauuauguuugu

SEQ ID NO: 1217707 - RNA, 19 nt, Homo sapiens
caaaugagaagccuuauau

SEQ ID NO: 1217708 - RNA, 19 nt, Homo sapiens
gaagagaagccuuauuugu

SEQ ID NO: 1217709 - RNA, 19 nt, Homo sapiens
gaucaacccucaucagaca

SEQ ID NO: 1217710 - RNA, 19 nt, Homo sapiens
gacaaaggcuugaaggaau

SEQ ID NO: 1217711 - RNA, 19 nt, Homo sapiens
ccagaaaucuacacuuguu

SEQ ID NO: 1217712 - RNA, 19 nt, Homo sapiens
ugggaaggcuuuagcaaua

SEQ ID NO: 1217713 - RNA, 19 nt, Homo sapiens
gaugagaagccuuauguuu

SEQ ID NO: 1217714 - RNA, 19 nt, Homo sapiens
ggacacacuuggaugagaa

SEQ ID NO: 1217715 - RNA, 19 nt, Homo sapiens
cauguaagcuguugguuug

SEQ ID NO: 1217716 - RNA, 19 nt, Homo sapiens
cagaagagaagccuuauuu

SEQ ID NO: 1217717 - RNA, 19 nt, Homo sapiens
caagucaacccucaucaua

SEQ ID NO: 1217718 - RNA, 19 nt, Homo sapiens
acaggaaucuucucucauu

SEQ ID NO: 1217719 - RNA, 19 nt, Homo sapiens
caaauagugguaccaguua

SEQ ID NO: 1217720 - RNA, 19 nt, Homo sapiens
guaaguccauccucaauag

SEQ ID NO: 1217721 - RNA, 19 nt, Homo sapiens
ggagggaaaggcccaaaua

SEQ ID NO: 1217722 - RNA, 19 nt, Homo sapiens
ggagaagccuuauguuugc

SEQ ID NO: 1217723 - RNA, 19 nt, Homo sapiens
gaggagaagcccuauguuu

SEQ ID NO: 1217724 - RNA, 19 nt, Homo sapiens
gggaagaagcccuacauuu

SEQ ID NO: 1217725 - RNA, 19 nt, Homo sapiens
gggagaagccuuauguuug

SEQ ID NO: 1217726 - RNA, 19 nt, Homo sapiens
ggagaaaccuguguaugca

SEQ ID NO: 1217727 - RNA, 19 nt, Homo sapiens
gcagcaguauucccaugua

SEQ ID NO: 1217728 - RNA, 19 nt, Homo sapiens
gagaauggacaaggacuua

SEQ ID NO: 1217729 - RNA, 19 nt, Homo sapiens
gagaacacauucagaagag

SEQ ID NO: 1217730 - RNA, 19 nt, Homo sapiens
agaggaaucuauacaaaga

SEQ ID NO: 1217731 - RNA, 19 nt, Homo sapiens
gggaaggcuuuagcaauaa

SEQ ID NO: 1217732 - RNA, 19 nt, Homo sapiens
caagucaacccucauugua

SEQ ID NO: 1217733 - RNA, 19 nt, Homo sapiens
gugaaacacauuagcaaua

SEQ ID NO: 1217734 - RNA, 19 nt, Homo sapiens
gcgaggauguugggaauug

SEQ ID NO: 1217735 - RNA, 19 nt, Homo sapiens
uaagucaaaucucaucaga

SEQ ID NO: 1217736 - RNA, 19 nt, Homo sapiens
ggagagaagccuuaugugu

SEQ ID NO: 1217737 - RNA, 19 nt, Homo sapiens
ggaauuagaaaccuugaga

SEQ ID NO: 1217738 - RNA, 19 nt, Homo sapiens
aagugaugcuggagaauua

SEQ ID NO: 1217739 - RNA, 19 nt, Homo sapiens
gggaaaggcccaaauagug

SEQ ID NO: 1217740 - RNA, 19 nt, Homo sapiens
gauguugccuuauccuuca

SEQ ID NO: 1217741 - RNA, 19 nt, Homo sapiens
gggagaagcauuauguuug

SEQ ID NO: 1217742 - RNA, 19 nt, Homo sapiens
acucagaucucaucaaaca

SEQ ID NO: 1217743 - RNA, 19 nt, Homo sapiens
caucagacaccaucguaua

SEQ ID NO: 1217744 - RNA, 19 nt, Homo sapiens
gaucaauacugggaagaga

SEQ ID NO: 1217745 - RNA, 19 nt, Homo sapiens
cauguuagguauauaagga

SEQ ID NO: 1217746 - RNA, 19 nt, Homo sapiens
caacauggguauuuuaaga

SEQ ID NO: 1217747 - RNA, 19 nt, Homo sapiens
gaagugaugcuggagaauu

SEQ ID NO: 1217748 - RNA, 19 nt, Homo sapiens
uaaguuaaaccucaucuug

SEQ ID NO: 1217749 - RNA, 19 nt, Homo sapiens
gcaauaaguuaaaccucau

SEQ ID NO: 1217750 - RNA, 19 nt, Homo sapiens
gaacacauucagaagagaa

SEQ ID NO: 1217751 - RNA, 19 nt, Homo sapiens
aguuaaaccucaucuugua

SEQ ID NO: 1217752 - RNA, 19 nt, Homo sapiens
gagaagcauuauguuugua

SEQ ID NO: 1217753 - RNA, 19 nt, Homo sapiens
gcgccaugauguugccuua

SEQ ID NO: 1217754 - RNA, 19 nt, Homo sapiens
agagaagccuuaugugugu

SEQ ID NO: 1217755 - RNA, 19 nt, Homo sapiens
gaagaagcccuacauuugc

SEQ ID NO: 1217756 - RNA, 19 nt, Homo sapiens
acaaaggcuugaaggaauu

SEQ ID NO: 1217757 - RNA, 19 nt, Homo sapiens
gcagaacuccaucuugaga

SEQ ID NO: 1217758 - RNA, 19 nt, Homo sapiens
gagcgaagauggcaguaac

SEQ ID NO: 1217759 - RNA, 19 nt, Homo sapiens
ggaaggcuuuagcaauaau

SEQ ID NO: 1217760 - RNA, 19 nt, Homo sapiens
gagugaaguuccagagaug

SEQ ID NO: 1217761 - RNA, 19 nt, Homo sapiens
ccagucaagccucauguua

SEQ ID NO: 1217762 - RNA, 19 nt, Homo sapiens
ccagagaacacauucagaa

SEQ ID NO: 1217763 - RNA, 19 nt, Homo sapiens
gagaugcauuccagagaug

SEQ ID NO: 1217764 - RNA, 19 nt, Homo sapiens
agaggagccuuaugaguau

SEQ ID NO: 1217765 - RNA, 19 nt, Homo sapiens
agucaaaucucaucagaca

SEQ ID NO: 1217766 - RNA, 19 nt, Homo sapiens
agucaaaucucaucagaca

SEQ ID NO: 1217767 - RNA, 19 nt, Homo sapiens
gaaguaaguccauccucaa

SEQ ID NO: 1217768 - RNA, 19 nt, Homo sapiens
cuaccucacucaccucuga

SEQ ID NO: 1217769 - RNA, 19 nt, Homo sapiens
gaaggaggucuuuguuugu

SEQ ID NO: 1217770 - RNA, 19 nt, Homo sapiens
agucauaagucaaaucuca

SEQ ID NO: 1217771 - RNA, 19 nt, Homo sapiens
guaagcuguugguuugaaa

SEQ ID NO: 1217772 - RNA, 19 nt, Homo sapiens
uuacaggaaucuucucuca

SEQ ID NO: 1217773 - RNA, 19 nt, Homo sapiens
cccagugaauccucaauuu

SEQ ID NO: 1217774 - RNA, 19 nt, Homo sapiens
gauugugggcgaagcuuua

SEQ ID NO: 1217775 - RNA, 19 nt, Homo sapiens
uaaccuggaaucaaacuuu

SEQ ID NO: 1217776 - RNA, 19 nt, Homo sapiens
cagcaguauucccauguaa

SEQ ID NO: 1217777 - RNA, 19 nt, Homo sapiens
ggaugugacugugaucuuc

SEQ ID NO: 1217778 - RNA, 19 nt, Homo sapiens
ccaaauagugguaccaguu

SEQ ID NO: 1217779 - RNA, 19 nt, Homo sapiens
ggacaaggacuuaggaaaa

SEQ ID NO: 1217780 - RNA, 19 nt, Homo sapiens
ccagauaauugauucuaag

SEQ ID NO: 1217781 - RNA, 19 nt, Homo sapiens
gcacaaaaggacacacuua

SEQ ID NO: 1217782 - RNA, 19 nt, Homo sapiens
ugagaagccuuauauuugc

SEQ ID NO: 1217783 - RNA, 19 nt, Homo sapiens
gcaaagcuuuagaaguaag

SEQ ID NO: 1217784 - RNA, 19 nt, Homo sapiens
aaccuggaaucaaacuuua

SEQ ID NO: 1217785 - RNA, 19 nt, Homo sapiens
accauaaccuggaaucaaa

SEQ ID NO: 1217786 - RNA, 19 nt, Homo sapiens
gaaacacauuagcaauaag

SEQ ID NO: 1217787 - RNA, 19 nt, Homo sapiens
ccaucgaacugaaggauca

SEQ ID NO: 1217788 - RNA, 19 nt, Homo sapiens
caggagaggagccuuauga

SEQ ID NO: 1217789 - RNA, 19 nt, Homo sapiens
gaaaucccaucucuacuaa

SEQ ID NO: 1217790 - RNA, 19 nt, Homo sapiens
gcagaggaaucuauacaaa

SEQ ID NO: 1217791 - RNA, 19 nt, Homo sapiens
cagcagaacuccaucuuga

SEQ ID NO: 1217792 - RNA, 19 nt, Homo sapiens
acaggaaucuucucucauu

SEQ ID NO: 1217793 - RNA, 19 nt, Homo sapiens
caaauagugguaccaguua

SEQ ID NO: 1217794 - RNA, 19 nt, Homo sapiens
ggagggaaaggcccaaaua

SEQ ID NO: 1217795 - RNA, 19 nt, Homo sapiens
gcaugugccuguaaucuca

SEQ ID NO: 1217796 - RNA, 19 nt, Homo sapiens
agaggaaucuauacaaaga

SEQ ID NO: 1217797 - RNA, 19 nt, Homo sapiens
aagugaugcuggagaauua

SEQ ID NO: 1217798 - RNA, 19 nt, Homo sapiens
gggaaaggcccaaauagug

SEQ ID NO: 1217799 - RNA, 19 nt, Homo sapiens
gauguugccuuauccuuca

SEQ ID NO: 1217800 - RNA, 19 nt, Homo sapiens
gaucaauacugggaagaga

SEQ ID NO: 1217801 - RNA, 19 nt, Homo sapiens
gaagugaugcuggagaauu

SEQ ID NO: 1217802 - RNA, 19 nt, Homo sapiens
ugaaaucccaucucuacua

SEQ ID NO: 1217803 - RNA, 19 nt, Homo sapiens
gcgccaugauguugccuua

SEQ ID NO: 1217804 - RNA, 19 nt, Homo sapiens
gcagaacuccaucuugaga

SEQ ID NO: 1217805 - RNA, 19 nt, Homo sapiens
uuacaggaaucuucucuca

SEQ ID NO: 1217806 - RNA, 19 nt, Homo sapiens
ggaugugacugugaucuuc

SEQ ID NO: 1217807 - RNA, 19 nt, Homo sapiens
ccaaauagugguaccaguu

SEQ ID NO: 1217808 - RNA, 19 nt, Homo sapiens
gcagugagccgagauugug

SEQ ID NO: 1217809 - RNA, 19 nt, Homo sapiens
gcaggagaaucacuugaac

SEQ ID NO: 1217810 - RNA, 19 nt, Homo sapiens
gagaauuacaggaaucuuc

SEQ ID NO: 1217811 - RNA, 19 nt, Homo sapiens
gccaugauguugccuuauc

SEQ ID NO: 1217812 - RNA, 19 nt, Homo sapiens
gagcagaggaaucuauaca

SEQ ID NO: 1217813 - RNA, 19 nt, Homo sapiens
uaauuaagguuggaagaag

SEQ ID NO: 1217814 - RNA, 19 nt, Homo sapiens
gaaaauguagagacuauga

SEQ ID NO: 1217815 - RNA, 19 nt, Homo sapiens
aagaagugaugcuggagaa

SEQ ID NO: 1217816 - RNA, 19 nt, Homo sapiens
ucacagaagcagaauggaa

SEQ ID NO: 1217817 - RNA, 19 nt, Homo sapiens
augaagaaauugacccaaa

SEQ ID NO: 1217818 - RNA, 19 nt, Homo sapiens
gaaucuauacaaagaagug

SEQ ID NO: 1217819 - RNA, 19 nt, Homo sapiens
cagagcagaggaaucuaua

SEQ ID NO: 1217820 - RNA, 19 nt, Homo sapiens
gggaaaauguagagacuau

SEQ ID NO: 1217821 - RNA, 19 nt, Homo sapiens
ccuguaaucucagcuacuu

SEQ ID NO: 1217822 - RNA, 19 nt, Homo sapiens
gagacuaugaagaaauuga

SEQ ID NO: 1217823 - RNA, 19 nt, Homo sapiens
gcagcagaacuccaucuug

SEQ ID NO: 1217824 - RNA, 19 nt, Homo sapiens
gcuggagaauuacaggaau

SEQ ID NO: 1217825 - RNA, 19 nt, Homo sapiens
gcagaauggaagagacuga

SEQ ID NO: 1217826 - RNA, 19 nt, Homo sapiens
guagagacuaugaagaaau

SEQ ID NO: 1217827 - RNA, 19 nt, Homo sapiens
gaccauccuggccaacaua

SEQ ID NO: 1217828 - RNA, 19 nt, Homo sapiens
gagggaaaggcccaaauag

SEQ ID NO: 1217829 - RNA, 19 nt, Homo sapiens
ggcuugccuucuaaugaua

SEQ ID NO: 1217830 - RNA, 19 nt, Homo sapiens
ugaagaaauugacccaaaa

SEQ ID NO: 1217831 - RNA, 19 nt, Homo sapiens
caggaaucuucucucauug

SEQ ID NO: 1217832 - RNA, 19 nt, Homo sapiens
ggcaggagaaucacuugaa

SEQ ID NO: 1217833 - RNA, 19 nt, Homo sapiens
ucagggaugugacugugau

SEQ ID NO: 1217834 - RNA, 19 nt, Homo sapiens
uguagagacuaugaagaaa

SEQ ID NO: 1217835 - RNA, 19 nt, Homo sapiens
ucaauacugggaagagauu

SEQ ID NO: 1217836 - RNA, 19 nt, Homo sapiens
gaaauugacccaaaaucau

SEQ ID NO: 1217837 - RNA, 19 nt, Homo sapiens
gucaggagaucgagaccau

SEQ ID NO: 1217838 - RNA, 19 nt, Homo sapiens
ccagagcagaggaaucuau

SEQ ID NO: 1217839 - RNA, 19 nt, Homo sapiens
auagugaaaucccaucucu

SEQ ID NO: 1217840 - RNA, 19 nt, Homo sapiens
gaggaaucuauacaaagaa

SEQ ID NO: 1217841 - RNA, 19 nt, Homo sapiens
cuucagcacugggagauca

SEQ ID NO: 1217842 - RNA, 19 nt, Homo sapiens
aaaauuagcugagcauggu

SEQ ID NO: 1217843 - RNA, 19 nt, Homo sapiens
aaucccaucucuacuaaaa

SEQ ID NO: 1217844 - RNA, 19 nt, Homo sapiens
caaagaauggggaaaaugu

SEQ ID NO: 1217845 - RNA, 19 nt, Homo sapiens
cauccuggccaacauagug

SEQ ID NO: 1217846 - RNA, 19 nt, Homo sapiens
cagaggaaucuauacaaag

SEQ ID NO: 1217847 - RNA, 19 nt, Homo sapiens
gaagaaauugacccaaaau

SEQ ID NO: 1217848 - RNA, 19 nt, Homo sapiens
uggccaacauagugaaauc

SEQ ID NO: 1217849 - RNA, 19 nt, Homo sapiens
gggaugugacugugaucuu

SEQ ID NO: 1217850 - RNA, 19 nt, Homo sapiens
gcacugggagaucaauacu

SEQ ID NO: 1217851 - RNA, 19 nt, Homo sapiens
aauuaagguuggaagaagu

SEQ ID NO: 1217852 - RNA, 19 nt, Homo sapiens
aggaaucuauacaaagaag

SEQ ID NO: 1217853 - RNA, 19 nt, Homo sapiens
gaugugacugugaucuuca

SEQ ID NO: 1217854 - RNA, 19 nt, Homo sapiens
cccgagaacuuccuaucag

SEQ ID NO: 1217855 - RNA, 19 nt, Homo sapiens
ccaaaaucauaaagcgaaa

SEQ ID NO: 1217856 - RNA, 19 nt, Homo sapiens
cagcacugggagaucaaua

SEQ ID NO: 1217857 - RNA, 19 nt, Homo sapiens
agugaaaucccaucucuac

SEQ ID NO: 1217858 - RNA, 19 nt, Homo sapiens
auguagagacuaugaagaa

SEQ ID NO: 1217859 - RNA, 19 nt, Homo sapiens
acacugagcuguagggaaa

SEQ ID NO: 1217860 - RNA, 19 nt, Homo sapiens
uagggaaacugaacuguga

SEQ ID NO: 1217861 - RNA, 19 nt, Homo sapiens
cccuggagcuucaaauaaa

SEQ ID NO: 1217862 - RNA, 19 nt, Homo sapiens
gcucggaacugcccagaac

SEQ ID NO: 1217863 - RNA, 19 nt, Homo sapiens
gcaauagacagccgaugga

SEQ ID NO: 1217864 - RNA, 19 nt, Homo sapiens
ggacauuggccgaguacug

SEQ ID NO: 1217865 - RNA, 19 nt, Homo sapiens
ucaggacauuggccgagua

SEQ ID NO: 1217866 - RNA, 19 nt, Homo sapiens
ccaaagcgagaaaaucuua

SEQ ID NO: 1217867 - RNA, 19 nt, Homo sapiens
ggccugacacugagcugua

SEQ ID NO: 1217868 - RNA, 19 nt, Homo sapiens
cacccuggagcuucaaaua

SEQ ID NO: 1217869 - RNA, 19 nt, Homo sapiens
agaccuaggaggcggguuu

SEQ ID NO: 1217870 - RNA, 19 nt, Homo sapiens
cgauggagccaccgaugga

SEQ ID NO: 1217871 - RNA, 19 nt, Homo sapiens
ccaaggccaaagcgagaaa

SEQ ID NO: 1217872 - RNA, 19 nt, Homo sapiens
ccuggagcuucaaauaaag

SEQ ID NO: 1217873 - RNA, 19 nt, Homo sapiens
ggagagaaaugguuugugu

SEQ ID NO: 1217874 - RNA, 19 nt, Homo sapiens
gaaaugguaugaauaagcu

SEQ ID NO: 1217875 - RNA, 19 nt, Homo sapiens
ugaauaagcuaacaggaau

SEQ ID NO: 1217876 - RNA, 19 nt, Homo sapiens
ggugaaaugguaugaauaa

SEQ ID NO: 1217877 - RNA, 19 nt, Homo sapiens
uaagcuaacaggaauagua

SEQ ID NO: 1217878 - RNA, 19 nt, Homo sapiens
auuuagagcuucagucuuu

SEQ ID NO: 1217879 - RNA, 19 nt, Homo sapiens
caggaaaggugagguguug

SEQ ID NO: 1217880 - RNA, 19 nt, Homo sapiens
guaggacucacccaugaua

SEQ ID NO: 1217881 - RNA, 19 nt, Homo sapiens
auaccuagcugcagauugu

SEQ ID NO: 1217882 - RNA, 19 nt, Homo sapiens
gcaauuggaguccuugugu

SEQ ID NO: 1217883 - RNA, 19 nt, Homo sapiens
gaauaagcuaacaggaaua

SEQ ID NO: 1217884 - RNA, 19 nt, Homo sapiens
acacagggccuucgugaga

SEQ ID NO: 1217885 - RNA, 19 nt, Homo sapiens
uaggugaaaugguaugaau

SEQ ID NO: 1217886 - RNA, 19 nt, Homo sapiens
gugagacagugaaaucaga

SEQ ID NO: 1217887 - RNA, 19 nt, Homo sapiens
uaaagaggacccagaagau

SEQ ID NO: 1217888 - RNA, 19 nt, Homo sapiens
uaauaaagaggacccagaa

SEQ ID NO: 1217889 - RNA, 19 nt, Homo sapiens
gagacugaguggucccuau

SEQ ID NO: 1217890 - RNA, 19 nt, Homo sapiens
guuugugucucccuuauuc

SEQ ID NO: 1217891 - RNA, 19 nt, Homo sapiens
gagaggcucaucuggcaaa

SEQ ID NO: 1217892 - RNA, 19 nt, Homo sapiens
ccaggugaguuccagaugu

SEQ ID NO: 1217893 - RNA, 19 nt, Homo sapiens
ucauucuaguccugaaaua

SEQ ID NO: 1217894 - RNA, 19 nt, Homo sapiens
agagugcggucaggacuuu

SEQ ID NO: 1217895 - RNA, 19 nt, Homo sapiens
ccaucacccuucauucuuc

SEQ ID NO: 1217896 - RNA, 19 nt, Homo sapiens
caggugaguuccagaugug

SEQ ID NO: 1217897 - RNA, 19 nt, Homo sapiens
aaagaggacccagaagauu

SEQ ID NO: 1217898 - RNA, 19 nt, Homo sapiens
gguagcaauuggaguccuu

SEQ ID NO: 1217899 - RNA, 19 nt, Homo sapiens
ugguaggacucacccauga

SEQ ID NO: 1217900 - RNA, 19 nt, Homo sapiens
gcaggaaaggugagguguu

SEQ ID NO: 1217901 - RNA, 19 nt, Homo sapiens
gagacagugaaaucagaua

SEQ ID NO: 1217902 - RNA, 19 nt, Homo sapiens
cuucgcagauuccaaguuc

SEQ ID NO: 1217903 - RNA, 19 nt, Homo sapiens
gaacaugaagcagcaggau

SEQ ID NO: 1217904 - RNA, 19 nt, Homo sapiens
ggagugcgggagagaaaug

SEQ ID NO: 1217905 - RNA, 19 nt, Homo sapiens
auaaagaggacccagaaga

SEQ ID NO: 1217906 - RNA, 19 nt, Homo sapiens
agacagugaaaucagauaa

SEQ ID NO: 1217907 - RNA, 19 nt, Homo sapiens
ucaggacuuugcucaggaa

SEQ ID NO: 1217908 - RNA, 19 nt, Homo sapiens
gcuaacaggaauaguaucu

SEQ ID NO: 1217909 - RNA, 19 nt, Homo sapiens
auguguaggugaaauggua

SEQ ID NO: 1217910 - RNA, 19 nt, Homo sapiens
gaagggagugcgggagaga

SEQ ID NO: 1217911 - RNA, 19 nt, Homo sapiens
ccaggagcgucacaugaag

SEQ ID NO: 1217912 - RNA, 19 nt, Homo sapiens
ggaguccuugugucucuuu

SEQ ID NO: 1217913 - RNA, 19 nt, Homo sapiens
aagcuaacaggaauaguau

SEQ ID NO: 1217914 - RNA, 19 nt, Homo sapiens
gccaucacccuucauucuu

SEQ ID NO: 1217915 - RNA, 19 nt, Homo sapiens
acaugaagcagcaggauuc

SEQ ID NO: 1217916 - RNA, 19 nt, Homo sapiens
gacagugaaaucagauaau

SEQ ID NO: 1217917 - RNA, 19 nt, Homo sapiens
gggcaggcuguuucucuga

SEQ ID NO: 1217918 - RNA, 19 nt, Homo sapiens
agguguugcuggccuguaa

SEQ ID NO: 1217919 - RNA, 19 nt, Homo sapiens
ucucccuuauucccaguua

SEQ ID NO: 1217920 - RNA, 19 nt, Homo sapiens
aagaggacccagaagauuc

SEQ ID NO: 1217921 - RNA, 19 nt, Homo sapiens
ccucaucaccuucgcagau

SEQ ID NO: 1217922 - RNA, 19 nt, Homo sapiens
cagcccaccuucccuuguc

SEQ ID NO: 1217923 - RNA, 19 nt, Homo sapiens
gacccgaacccugaagaga

SEQ ID NO: 1217924 - RNA, 19 nt, Homo sapiens
augaauaagcuaacaggaa

SEQ ID NO: 1217925 - RNA, 19 nt, Homo sapiens
ccagauguggagcaacuug

SEQ ID NO: 1217926 - RNA, 19 nt, Homo sapiens
gggcuaugggagcaaauug

SEQ ID NO: 1217927 - RNA, 19 nt, Homo sapiens
ggaggacccgaacccugaa

SEQ ID NO: 1217928 - RNA, 19 nt, Homo sapiens
ggaaaggugagguguugcu

SEQ ID NO: 1217929 - RNA, 19 nt, Homo sapiens
caugggcuaugggagcaaa

SEQ ID NO: 1217930 - RNA, 19 nt, Homo sapiens
ugaaaugguaugaauaagc

SEQ ID NO: 1217931 - RNA, 19 nt, Homo sapiens
gugaaaugguaugaauaag

SEQ ID NO: 1217932 - RNA, 19 nt, Homo sapiens
cugaagagaacaugaagca

SEQ ID NO: 1217933 - RNA, 19 nt, Homo sapiens
uccaggagcgucacaugaa

SEQ ID NO: 1217934 - RNA, 19 nt, Homo sapiens
cucaucaccuucgcagauu

SEQ ID NO: 1217935 - RNA, 19 nt, Homo sapiens
ucauauguguaggugaaau

SEQ ID NO: 1217936 - RNA, 19 nt, Homo sapiens
agagaaaugguuugugucu

SEQ ID NO: 1217937 - RNA, 19 nt, Homo sapiens
aaauauggcuuuccucaaa

SEQ ID NO: 1217938 - RNA, 19 nt, Homo sapiens
gaagggaacucugggucua

SEQ ID NO: 1217939 - RNA, 19 nt, Homo sapiens
gaagaugcauaccuccuau

SEQ ID NO: 1217940 - RNA, 19 nt, Homo sapiens
gugaacagcuccagagaga

SEQ ID NO: 1217941 - RNA, 19 nt, Homo sapiens
gaagaaaaguugaggaaau

SEQ ID NO: 1217942 - RNA, 19 nt, Homo sapiens
gagcugagcaccaggcuuu

SEQ ID NO: 1217943 - RNA, 19 nt, Homo sapiens
gggaaucgcuguuagaacu

SEQ ID NO: 1217944 - RNA, 19 nt, Homo sapiens
caacugcccuagagaagau

SEQ ID NO: 1217945 - RNA, 19 nt, Homo sapiens
gcucuucccuugcuguuau

SEQ ID NO: 1217946 - RNA, 19 nt, Homo sapiens
uaagcagccuccauugauu

SEQ ID NO: 1217947 - RNA, 19 nt, Homo sapiens
gauuuccgcucguguuuau

SEQ ID NO: 1217948 - RNA, 19 nt, Homo sapiens
cagcugaguuagaagauga

SEQ ID NO: 1217949 - RNA, 19 nt, Homo sapiens
ggaaguagcuaguuuugug

SEQ ID NO: 1217950 - RNA, 19 nt, Homo sapiens
ggaagaugcauaccuccua

SEQ ID NO: 1217951 - RNA, 19 nt, Homo sapiens
ucaccgagguagagagaaa

SEQ ID NO: 1217952 - RNA, 19 nt, Homo sapiens
gcucguguuuauaggauuu

SEQ ID NO: 1217953 - RNA, 19 nt, Homo sapiens
uagaggcccuggugcauga

SEQ ID NO: 1217954 - RNA, 19 nt, Homo sapiens
ugauugagguggagcgaaa

SEQ ID NO: 1217955 - RNA, 19 nt, Homo sapiens
gcaugaggaggcugaagua

SEQ ID NO: 1217956 - RNA, 19 nt, Homo sapiens
cgagacaccuacuaugaca

SEQ ID NO: 1217957 - RNA, 19 nt, Homo sapiens
uagagugccuccuguggaa

SEQ ID NO: 1217958 - RNA, 19 nt, Homo sapiens
gacagugacuccucucucu

SEQ ID NO: 1217959 - RNA, 19 nt, Homo sapiens
gcuaagcagccuccauuga

SEQ ID NO: 1217960 - RNA, 19 nt, Homo sapiens
ggagaggguuagaaagaac

SEQ ID NO: 1217961 - RNA, 19 nt, Homo sapiens
ccuuacagcugaguuagaa

SEQ ID NO: 1217962 - RNA, 19 nt, Homo sapiens
cagcggaaccuacaauugu

SEQ ID NO: 1217963 - RNA, 19 nt, Homo sapiens
uggagcagcaggugucuua

SEQ ID NO: 1217964 - RNA, 19 nt, Homo sapiens
ggaaacagaagaaaaguug

SEQ ID NO: 1217965 - RNA, 19 nt, Homo sapiens
ugaggaggcugaaguacca

SEQ ID NO: 1217966 - RNA, 19 nt, Homo sapiens
gcaguagcccuagagacua

SEQ ID NO: 1217967 - RNA, 19 nt, Homo sapiens
gacaucagcagcaguggaa

SEQ ID NO: 1217968 - RNA, 19 nt, Homo sapiens
ccacuuagccgugaucagu

SEQ ID NO: 1217969 - RNA, 19 nt, Homo sapiens
ccaagcugauuguguaucu

SEQ ID NO: 1217970 - RNA, 19 nt, Homo sapiens
ccuggaagcuggugcucuu

SEQ ID NO: 1217971 - RNA, 19 nt, Homo sapiens
caguagcccuagagacuau

SEQ ID NO: 1217972 - RNA, 19 nt, Homo sapiens
uagccgugaucaguaguua

SEQ ID NO: 1217973 - RNA, 19 nt, Homo sapiens
gaacucacagcggaaccua

SEQ ID NO: 1217974 - RNA, 19 nt, Homo sapiens
cuaagcuacucuuccuuga

SEQ ID NO: 1217975 - RNA, 19 nt, Homo sapiens
ugucagagccuuaaaauau

SEQ ID NO: 1217976 - RNA, 19 nt, Homo sapiens
ggagaggcagcagggauuu

SEQ ID NO: 1217977 - RNA, 19 nt, Homo sapiens
ugcaggaaguagcuaguuu

SEQ ID NO: 1217978 - RNA, 19 nt, Homo sapiens
ccacacggaguauaaggaa

SEQ ID NO: 1217979 - RNA, 19 nt, Homo sapiens
uggagaggguuagaaagaa

SEQ ID NO: 1217980 - RNA, 19 nt, Homo sapiens
cuugggagcugaugaagag

SEQ ID NO: 1217981 - RNA, 19 nt, Homo sapiens
caaauauggcuuuccucaa

SEQ ID NO: 1217982 - RNA, 19 nt, Homo sapiens
cuaagcagccuccauugau

SEQ ID NO: 1217983 - RNA, 19 nt, Homo sapiens
uaucagcgccugcuagaag

SEQ ID NO: 1217984 - RNA, 19 nt, Homo sapiens
aaacguuuguucagccaau

SEQ ID NO: 1217985 - RNA, 19 nt, Homo sapiens
aaucugacuuugccacugu

SEQ ID NO: 1217986 - RNA, 19 nt, Homo sapiens
gaugugggaaacagaagaa

SEQ ID NO: 1217987 - RNA, 19 nt, Homo sapiens
ccgcuaagcagccuccauu

SEQ ID NO: 1217988 - RNA, 19 nt, Homo sapiens
uagagacuauugcgacaca

SEQ ID NO: 1217989 - RNA, 19 nt, Homo sapiens
caagcugauuguguaucua

SEQ ID NO: 1217990 - RNA, 19 nt, Homo sapiens
aagcagccuccauugauuu

SEQ ID NO: 1217991 - RNA, 19 nt, Homo sapiens
cuccagcgcugccuguuuc

SEQ ID NO: 1217992 - RNA, 19 nt, Homo sapiens
ggcaguagcccuagagacu

SEQ ID NO: 1217993 - RNA, 19 nt, Homo sapiens
agaaugcucuucccuugcu

SEQ ID NO: 1217994 - RNA, 19 nt, Homo sapiens
ugccuccuguggaaguuua

SEQ ID NO: 1217995 - RNA, 19 nt, Homo sapiens
gaaucgcuguuagaacucu

SEQ ID NO: 1217996 - RNA, 19 nt, Homo sapiens
gcaccaggcuuugcauccu

SEQ ID NO: 1217997 - RNA, 19 nt, Homo sapiens
gaaguuuaggggcaaauuu

SEQ ID NO: 1217998 - RNA, 19 nt, Homo sapiens
ggccacaggagacugaaga

SEQ ID NO: 1217999 - RNA, 19 nt, Homo sapiens
cuggagaggguuagaaaga

SEQ ID NO: 1218000 - RNA, 19 nt, Homo sapiens
guggaugggagcucaaaug

SEQ ID NO: 1218001 - RNA, 19 nt, Homo sapiens
uccgagacaccuacuauga

SEQ ID NO: 1218002 - RNA, 19 nt, Homo sapiens
aggagcggcugcaggaguu

SEQ ID NO: 1218003 - RNA, 19 nt, Homo sapiens
uaccuccuauguaagaaug

SEQ ID NO: 1218004 - RNA, 19 nt, Homo sapiens
ggaugugggaaacagaaga

SEQ ID NO: 1218005 - RNA, 19 nt, Homo sapiens
uuacagcugaguuagaaga

SEQ ID NO: 1218006 - RNA, 19 nt, Homo sapiens
guuuauaggauuuccacuu

SEQ ID NO: 1218007 - RNA, 19 nt, Homo sapiens
ccucuaagcuacucuuccu

SEQ ID NO: 1218008 - RNA, 19 nt, Homo sapiens
caccaggcuuugcauccuu

SEQ ID NO: 1218009 - RNA, 19 nt, Homo sapiens
uuuccggccucaagacuau

SEQ ID NO: 1218010 - RNA, 19 nt, Homo sapiens
gcaggaaguagcuaguuuu

SEQ ID NO: 1218011 - RNA, 19 nt, Homo sapiens
ucacagcggaaccuacaau

SEQ ID NO: 1218012 - RNA, 19 nt, Homo sapiens
cgggucaccuuccgagaca

SEQ ID NO: 1218013 - RNA, 19 nt, Homo sapiens
gaggaaaugguugggaauc

SEQ ID NO: 1218014 - RNA, 19 nt, Homo sapiens
cgugaucaguaguuaagca

SEQ ID NO: 1218015 - RNA, 19 nt, Homo sapiens
gguugggaaucgcuguuag

SEQ ID NO: 1218016 - RNA, 19 nt, Homo sapiens
aagaaaaguugaggaaaug

SEQ ID NO: 1218017 - RNA, 19 nt, Homo sapiens
gcuccuaaaccgccuuaca

SEQ ID NO: 1218018 - RNA, 19 nt, Homo sapiens
uauaggauuuccacuuagc

SEQ ID NO: 1218019 - RNA, 19 nt, Homo sapiens
ccaacugcccuagagaaga

SEQ ID NO: 1218020 - RNA, 19 nt, Homo sapiens
guaccaacugcccuagaga

SEQ ID NO: 1218021 - RNA, 19 nt, Homo sapiens
cuacaauuguggcccaacu

SEQ ID NO: 1218022 - RNA, 19 nt, Homo sapiens
agcagcaggugucuuagga

SEQ ID NO: 1218023 - RNA, 19 nt, Homo sapiens
ccgccuuacagcugaguua

SEQ ID NO: 1218024 - RNA, 19 nt, Homo sapiens
ugagguggagcgaaaguuc

SEQ ID NO: 1218025 - RNA, 19 nt, Homo sapiens
ggagacagcagaagagaua

SEQ ID NO: 1218026 - RNA, 19 nt, Homo sapiens
gagcugcaguccaccuuua

SEQ ID NO: 1218027 - RNA, 19 nt, Homo sapiens
gcggauauguuuauacaga

SEQ ID NO: 1218028 - RNA, 19 nt, Homo sapiens
cuuagaaucugcagaaauu

SEQ ID NO: 1218029 - RNA, 19 nt, Homo sapiens
ggagguggaugaggacuuu

SEQ ID NO: 1218030 - RNA, 19 nt, Homo sapiens
ggaagcagaucaaggacau

SEQ ID NO: 1218031 - RNA, 19 nt, Homo sapiens
ucaaggacauggagaagau

SEQ ID NO: 1218032 - RNA, 19 nt, Homo sapiens
gaccaucacucaguccaaa

SEQ ID NO: 1218033 - RNA, 19 nt, Homo sapiens
gagcuucuguucuggugaa

SEQ ID NO: 1218034 - RNA, 19 nt, Homo sapiens
ggauauguuuauacagaug

SEQ ID NO: 1218035 - RNA, 19 nt, Homo sapiens
uagcggauauguuuauaca

SEQ ID NO: 1218036 - RNA, 19 nt, Homo sapiens
gacgagcgcuucgccuuga

SEQ ID NO: 1218037 - RNA, 19 nt, Homo sapiens
cgucuuccaucuacugaaa

SEQ ID NO: 1218038 - RNA, 19 nt, Homo sapiens
agaagauguucaagcagua

SEQ ID NO: 1218039 - RNA, 19 nt, Homo sapiens
ccaggaagcagaucaagga

SEQ ID NO: 1218040 - RNA, 19 nt, Homo sapiens
uggagaagauguucaagca

SEQ ID NO: 1218041 - RNA, 19 nt, Homo sapiens
acaccgaguucaaggaguu

SEQ ID NO: 1218042 - RNA, 19 nt, Homo sapiens
auaacgacgucacugcuuu

SEQ ID NO: 1218043 - RNA, 19 nt, Homo sapiens
gcaguccaccuuuaaguag

SEQ ID NO: 1218044 - RNA, 19 nt, Homo sapiens
ccacgugcuugcugacaug

SEQ ID NO: 1218045 - RNA, 19 nt, Homo sapiens
ugccuuagcggauauguuu

SEQ ID NO: 1218046 - RNA, 19 nt, Homo sapiens
gcguuugccuuagcggaua

SEQ ID NO: 1218047 - RNA, 19 nt, Homo sapiens
gaggaagaauuggcaccuu

SEQ ID NO: 1218048 - RNA, 19 nt, Homo sapiens
gacguccacugccuuguca

SEQ ID NO: 1218049 - RNA, 19 nt, Homo sapiens
gaagugcuuuaaguguguu

SEQ ID NO: 1218050 - RNA, 19 nt, Homo sapiens
agaagugcuuuaagugugu

SEQ ID NO: 1218051 - RNA, 19 nt, Homo sapiens
cgagaagugcuuuaagugu

SEQ ID NO: 1218052 - RNA, 19 nt, Homo sapiens
cgagaagccuccgagaagu

SEQ ID NO: 1218053 - RNA, 19 nt, Homo sapiens
gcggaaagcggccuucaag

SEQ ID NO: 1218054 - RNA, 19 nt, Homo sapiens
gaagauguucaagcaguau

SEQ ID NO: 1218055 - RNA, 19 nt, Homo sapiens
ggccuuagaaucugcagaa

SEQ ID NO: 1218056 - RNA, 19 nt, Homo sapiens
gagaagccuccgagaagug

SEQ ID NO: 1218057 - RNA, 19 nt, Homo sapiens
ccggauugcguuugccuua

SEQ ID NO: 1218058 - RNA, 19 nt, Homo sapiens
ggacccggauugcguuugc

SEQ ID NO: 1218059 - RNA, 19 nt, Homo sapiens
ucggagacaccgcugcuua

SEQ ID NO: 1218060 - RNA, 19 nt, Homo sapiens
cagcagaagagauagaauc

SEQ ID NO: 1218061 - RNA, 19 nt, Homo sapiens
gaagcuacgcggacuugca

SEQ ID NO: 1218062 - RNA, 19 nt, Homo sapiens
ugacgggaccacuacuaaa

SEQ ID NO: 1218063 - RNA, 19 nt, Homo sapiens
ccugaauccuugccugugu

SEQ ID NO: 1218064 - RNA, 19 nt, Homo sapiens
gaagcaggcggaggagaug

SEQ ID NO: 1218065 - RNA, 19 nt, Homo sapiens
uccgagaagugcuuuaagu

SEQ ID NO: 1218066 - RNA, 19 nt, Homo sapiens
ccgagaagccuccgagaag

SEQ ID NO: 1218067 - RNA, 19 nt, Homo sapiens
gagcaggaggaaaggaaga

SEQ ID NO: 1218068 - RNA, 19 nt, Homo sapiens
agaucgacgucuccaguga

SEQ ID NO: 1218069 - RNA, 19 nt, Homo sapiens
gagaugaagcagcggaaag

SEQ ID NO: 1218070 - RNA, 19 nt, Homo sapiens
gacagcagaagagauagaa

SEQ ID NO: 1218071 - RNA, 19 nt, Homo sapiens
ggagaugaagcagcggaaa

SEQ ID NO: 1218072 - RNA, 19 nt, Homo sapiens
cuuagcggauauguuuaua

SEQ ID NO: 1218073 - RNA, 19 nt, Homo sapiens
caacuuucaguguguguca

SEQ ID NO: 1218074 - RNA, 19 nt, Homo sapiens
ggcaaucccugggcucucu

SEQ ID NO: 1218075 - RNA, 19 nt, Homo sapiens
ggagcugcaguccaccuuu

SEQ ID NO: 1218076 - RNA, 19 nt, Homo sapiens
ggauugcguuugccuuagc

SEQ ID NO: 1218077 - RNA, 19 nt, Homo sapiens
guuaugcaacuuucagugu

SEQ ID NO: 1218078 - RNA, 19 nt, Homo sapiens
ccagcgaccugccugucau

SEQ ID NO: 1218079 - RNA, 19 nt, Homo sapiens
cggauauguuuauacagau

SEQ ID NO: 1218080 - RNA, 19 nt, Homo sapiens
uaugcaacuuucagugugu

SEQ ID NO: 1218081 - RNA, 19 nt, Homo sapiens
gaucaaggacauggagaag

SEQ ID NO: 1218082 - RNA, 19 nt, Homo sapiens
cagagcaggaggaaaggaa

SEQ ID NO: 1218083 - RNA, 19 nt, Homo sapiens
uagaaucugcagaaauuag

SEQ ID NO: 1218084 - RNA, 19 nt, Homo sapiens
uaaaacucaugauggagaa

SEQ ID NO: 1218085 - RNA, 19 nt, Homo sapiens
ucacucaguccaaacaagu

SEQ ID NO: 1218086 - RNA, 19 nt, Homo sapiens
ccucgaggccacaguuaug

SEQ ID NO: 1218087 - RNA, 19 nt, Homo sapiens
ugcaguccaccuuuaagua

SEQ ID NO: 1218088 - RNA, 19 nt, Homo sapiens
gaaucugcagaaauuagga

SEQ ID NO: 1218089 - RNA, 19 nt, Homo sapiens
gccuuagaaucugcagaaa

SEQ ID NO: 1218090 - RNA, 19 nt, Homo sapiens
cauaacgacgucacugcuu

SEQ ID NO: 1218091 - RNA, 19 nt, Homo sapiens
gcccucgaggccacaguua

SEQ ID NO: 1218092 - RNA, 19 nt, Homo sapiens
ccgagaagugcuuuaagug

SEQ ID NO: 1218093 - RNA, 19 nt, Homo sapiens
acgcggacuugcagagguu

SEQ ID NO: 1218094 - RNA, 19 nt, Homo sapiens
ugaucaaggagguggauga

SEQ ID NO: 1218095 - RNA, 19 nt, Homo sapiens
aauccuugccugugucuga

SEQ ID NO: 1218096 - RNA, 19 nt, Homo sapiens
gaaugaaccucgaauauuu

SEQ ID NO: 1218097 - RNA, 19 nt, Homo sapiens
ccaagcaacuauccaauua

SEQ ID NO: 1218098 - RNA, 19 nt, Homo sapiens
gaaagcaccuuaacugaau

SEQ ID NO: 1218099 - RNA, 19 nt, Homo sapiens
agagaugugucaccaauua

SEQ ID NO: 1218100 - RNA, 19 nt, Homo sapiens
ccaaauccauaaagccuua

SEQ ID NO: 1218101 - RNA, 19 nt, Homo sapiens
ggccaaaccuucaguguga

SEQ ID NO: 1218102 - RNA, 19 nt, Homo sapiens
gaaacuuacuggagaugaa

SEQ ID NO: 1218103 - RNA, 19 nt, Homo sapiens
gagaacuacuuguaugaaa

SEQ ID NO: 1218104 - RNA, 19 nt, Homo sapiens
ggaacagccugagauauga

SEQ ID NO: 1218105 - RNA, 19 nt, Homo sapiens
guacaacuauggacaagau

SEQ ID NO: 1218106 - RNA, 19 nt, Homo sapiens
gaucccagguguacaacua

SEQ ID NO: 1218107 - RNA, 19 nt, Homo sapiens
ggaaagcaccuuaacugaa

SEQ ID NO: 1218108 - RNA, 19 nt, Homo sapiens
gcaacuauccaauuacuga

SEQ ID NO: 1218109 - RNA, 19 nt, Homo sapiens
uaccacagcuguagaagaa

SEQ ID NO: 1218110 - RNA, 19 nt, Homo sapiens
gggaagagcugcaggaaaa

SEQ ID NO: 1218111 - RNA, 19 nt, Homo sapiens
gaagaaagugacucucuga

SEQ ID NO: 1218112 - RNA, 19 nt, Homo sapiens
ccaggugaauggaauugua

SEQ ID NO: 1218113 - RNA, 19 nt, Homo sapiens
gaauggagacuucgagaug

SEQ ID NO: 1218114 - RNA, 19 nt, Homo sapiens
ggacauaagcagcacuuug

SEQ ID NO: 1218115 - RNA, 19 nt, Homo sapiens
caccuuaacugaaucaugu

SEQ ID NO: 1218116 - RNA, 19 nt, Homo sapiens
ggaggaacagccugagaua

SEQ ID NO: 1218117 - RNA, 19 nt, Homo sapiens
ugaacucucuccacacaaa

SEQ ID NO: 1218118 - RNA, 19 nt, Homo sapiens
ccagacagauggauaccaa

SEQ ID NO: 1218119 - RNA, 19 nt, Homo sapiens
gaaaauguccccacugauu

SEQ ID NO: 1218120 - RNA, 19 nt, Homo sapiens
gaaaauagcaaacagauuc

SEQ ID NO: 1218121 - RNA, 19 nt, Homo sapiens
gaagaaacccaggugaaug

SEQ ID NO: 1218122 - RNA, 19 nt, Homo sapiens
guccauggauucagucuug

SEQ ID NO: 1218123 - RNA, 19 nt, Homo sapiens
aaaugaggcuggaugaaau

SEQ ID NO: 1218124 - RNA, 19 nt, Homo sapiens
gauaugggccucuacuuuc

SEQ ID NO: 1218125 - RNA, 19 nt, Homo sapiens
gaaccucgaauauuuaaag

SEQ ID NO: 1218126 - RNA, 19 nt, Homo sapiens
gaccucagaugcacagugu

SEQ ID NO: 1218127 - RNA, 19 nt, Homo sapiens
ccacugauucuuaaacauu

SEQ ID NO: 1218128 - RNA, 19 nt, Homo sapiens
cuacaaaggagugaguuua

SEQ ID NO: 1218129 - RNA, 19 nt, Homo sapiens
ccauauacuugaccuuaga

SEQ ID NO: 1218130 - RNA, 19 nt, Homo sapiens
gacaagauaugggccucua

SEQ ID NO: 1218131 - RNA, 19 nt, Homo sapiens
ccguguagcuauaagaauu

SEQ ID NO: 1218132 - RNA, 19 nt, Homo sapiens
ggaccuagcaggaaaugau

SEQ ID NO: 1218133 - RNA, 19 nt, Homo sapiens
gacauaagcagcacuuugu

SEQ ID NO: 1218134 - RNA, 19 nt, Homo sapiens
ccagugagaacuacuugua

SEQ ID NO: 1218135 - RNA, 19 nt, Homo sapiens
gcuaauguccgaagaaagu

SEQ ID NO: 1218136 - RNA, 19 nt, Homo sapiens
gaggcuggaugaaauguca

SEQ ID NO: 1218137 - RNA, 19 nt, Homo sapiens
gguugaaguuugcaauaga

SEQ ID NO: 1218138 - RNA, 19 nt, Homo sapiens
ggaccuugguagcuaaugu

SEQ ID NO: 1218139 - RNA, 19 nt, Homo sapiens
cacaggaacccuaaguaua

SEQ ID NO: 1218140 - RNA, 19 nt, Homo sapiens
cuauuaaucuggaggcuau

SEQ ID NO: 1218141 - RNA, 19 nt, Homo sapiens
ugaaugaaccucgaauauu

SEQ ID NO: 1218142 - RNA, 19 nt, Homo sapiens
ucagggaccuagcaggaaa

SEQ ID NO: 1218143 - RNA, 19 nt, Homo sapiens
ucuacuuucuccucuauaa

SEQ ID NO: 1218144 - RNA, 19 nt, Homo sapiens
uaagaauucuggccuggau

SEQ ID NO: 1218145 - RNA, 19 nt, Homo sapiens
guugaaguuugcaauagaa

SEQ ID NO: 1218146 - RNA, 19 nt, Homo sapiens
caaaggagugaguuuauca

SEQ ID NO: 1218147 - RNA, 19 nt, Homo sapiens
uagcuaauguccgaagaaa

SEQ ID NO: 1218148 - RNA, 19 nt, Homo sapiens
gaacaaucaggaccaaagu

SEQ ID NO: 1218149 - RNA, 19 nt, Homo sapiens
caagaacaaucaggaccaa

SEQ ID NO: 1218150 - RNA, 19 nt, Homo sapiens
agagagaugugucaccaau

SEQ ID NO: 1218151 - RNA, 19 nt, Homo sapiens
ccacacaaaccuuccaaga

SEQ ID NO: 1218152 - RNA, 19 nt, Homo sapiens
gugaaugaaccucgaauau

SEQ ID NO: 1218153 - RNA, 19 nt, Homo sapiens
ggagugaguuuaucaaaag

SEQ ID NO: 1218154 - RNA, 19 nt, Homo sapiens
gagcacaucccucgacgau

SEQ ID NO: 1218155 - RNA, 19 nt, Homo sapiens
gcucugggauuugguuuag

SEQ ID NO: 1218156 - RNA, 19 nt, Homo sapiens
ucacaggaacccuaaguau

SEQ ID NO: 1218157 - RNA, 19 nt, Homo sapiens
gcacaaggagaauuuaagg

SEQ ID NO: 1218158 - RNA, 19 nt, Homo sapiens
cauccgagccauauacuug

SEQ ID NO: 1218159 - RNA, 19 nt, Homo sapiens
acaggaacccuaaguauag

SEQ ID NO: 1218160 - RNA, 19 nt, Homo sapiens
uuacacaucuuggaagcaa

SEQ ID NO: 1218161 - RNA, 19 nt, Homo sapiens
aaacccaggugaauggaau

SEQ ID NO: 1218162 - RNA, 19 nt, Homo sapiens
ccuccgagcccgcaaguuu

SEQ ID NO: 1218163 - RNA, 19 nt, Homo sapiens
ccaggcccguguagcuaua

SEQ ID NO: 1218164 - RNA, 19 nt, Homo sapiens
ggucugacuugaacucucu

SEQ ID NO: 1218165 - RNA, 19 nt, Homo sapiens
ggugaaugaaccucgaaua

SEQ ID NO: 1218166 - RNA, 19 nt, Homo sapiens
gaagcuggcccgaagucuu

SEQ ID NO: 1218167 - RNA, 19 nt, Homo sapiens
gauuugguuuaguuacuga

SEQ ID NO: 1218168 - RNA, 19 nt, Homo sapiens
agacugggaguuuguguuu

SEQ ID NO: 1218169 - RNA, 19 nt, Homo sapiens
gaauuuaaggguccaugga

SEQ ID NO: 1218170 - RNA, 19 nt, Homo sapiens
gaaaacauccgagccauau

SEQ ID NO: 1218171 - RNA, 19 nt, Homo sapiens
gagaugugucaccaauuaa

SEQ ID NO: 1218172 - RNA, 19 nt, Homo sapiens
agauaugggccucuacuuu

SEQ ID NO: 1218173 - RNA, 19 nt, Homo sapiens
acagauggauaccaagcaa

SEQ ID NO: 1218174 - RNA, 19 nt, Homo sapiens
ggauuugguuuaguuacug

SEQ ID NO: 1218175 - RNA, 19 nt, Homo sapiens
caacuauggacaagauaug

SEQ ID NO: 1218176 - RNA, 19 nt, Homo sapiens
ggcuaugugugcucacuga

SEQ ID NO: 1218177 - RNA, 19 nt, Homo sapiens
guggugaucugguucuuac

SEQ ID NO: 1218178 - RNA, 19 nt, Homo sapiens
ucuggaggcuauaucuauu

SEQ ID NO: 1218179 - RNA, 19 nt, Homo sapiens
agaagacgauuuugugaaa

SEQ ID NO: 1218180 - RNA, 19 nt, Homo sapiens
cacacaaaccuuccaagaa

SEQ ID NO: 1218181 - RNA, 19 nt, Homo sapiens
cugcucaucaggaaacuua

SEQ ID NO: 1218182 - RNA, 19 nt, Homo sapiens
gaaucccagucugcaacua

SEQ ID NO: 1218183 - RNA, 19 nt, Homo sapiens
gggccguucuguuccaaga

SEQ ID NO: 1218184 - RNA, 19 nt, Homo sapiens
gagcccgcaaguuugauua

SEQ ID NO: 1218185 - RNA, 19 nt, Homo sapiens
gauaaaagcaguccaugug

SEQ ID NO: 1218186 - RNA, 19 nt, Homo sapiens
gggauuugguuuaguuacu

SEQ ID NO: 1218187 - RNA, 19 nt, Homo sapiens
ucugggauuugguuuaguu

SEQ ID NO: 1218188 - RNA, 19 nt, Homo sapiens
caggaacccuaaguauaga

SEQ ID NO: 1218189 - RNA, 19 nt, Homo sapiens
gccuuugguuacuuuaauu

SEQ ID NO: 1218190 - RNA, 19 nt, Homo sapiens
ugaagaaacccaggugaau

SEQ ID NO: 1218191 - RNA, 19 nt, Homo sapiens
ccucuacuuucuccucuau

SEQ ID NO: 1218192 - RNA, 19 nt, Homo sapiens
guaagcaucaggacauaag

SEQ ID NO: 1218193 - RNA, 19 nt, Homo sapiens
ggaaacuuacuggagauga

SEQ ID NO: 1218194 - RNA, 19 nt, Homo sapiens
gugagaacuacuuguauga

SEQ ID NO: 1218195 - RNA, 19 nt, Homo sapiens
agugagaacuacuuguaug

SEQ ID NO: 1218196 - RNA, 19 nt, Homo sapiens
cauaggagcuuuauuugua

SEQ ID NO: 1218197 - RNA, 19 nt, Homo sapiens
ccacaaaacucaacaauaa

SEQ ID NO: 1218198 - RNA, 19 nt, Homo sapiens
cauaauggcucaguguuua

SEQ ID NO: 1218199 - RNA, 19 nt, Homo sapiens
ggaacuaacuguugauaca

SEQ ID NO: 1218200 - RNA, 19 nt, Homo sapiens
gaauaaaucaggagacaaa

SEQ ID NO: 1218201 - RNA, 19 nt, Homo sapiens
gggaaagaguuuaugaauu

SEQ ID NO: 1218202 - RNA, 19 nt, Homo sapiens
gcaauucaauggaggaaga

SEQ ID NO: 1218203 - RNA, 19 nt, Homo sapiens
gaauagccuuucugacaaa

SEQ ID NO: 1218204 - RNA, 19 nt, Homo sapiens
ggaccuacauacacacaaa

SEQ ID NO: 1218205 - RNA, 19 nt, Homo sapiens
ggacauucauuccagagaa

SEQ ID NO: 1218206 - RNA, 19 nt, Homo sapiens
gaauacugcucuggaauga

SEQ ID NO: 1218207 - RNA, 19 nt, Homo sapiens
aagauaagcuacagauuga

SEQ ID NO: 1218208 - RNA, 19 nt, Homo sapiens
acuuaaaccucacaucuua

SEQ ID NO: 1218209 - RNA, 19 nt, Homo sapiens
gaaagugugccuugaauca

SEQ ID NO: 1218210 - RNA, 19 nt, Homo sapiens
uagccuuucugacaaauua

SEQ ID NO: 1218211 - RNA, 19 nt, Homo sapiens
aggaagagcuuaugcaaga

SEQ ID NO: 1218212 - RNA, 19 nt, Homo sapiens
gaagauaagaacacaaaga

SEQ ID NO: 1218213 - RNA, 19 nt, Homo sapiens
gaauaaagucuguagucua

SEQ ID NO: 1218214 - RNA, 19 nt, Homo sapiens
uaaauaugcucagcugauu

SEQ ID NO: 1218215 - RNA, 19 nt, Homo sapiens
gagagaacccagaaauaaa

SEQ ID NO: 1218216 - RNA, 19 nt, Homo sapiens
caacccagauguccuacaa

SEQ ID NO: 1218217 - RNA, 19 nt, Homo sapiens
ugagagaacccagaaauaa

SEQ ID NO: 1218218 - RNA, 19 nt, Homo sapiens
gaaggaagaggaaagguau

SEQ ID NO: 1218219 - RNA, 19 nt, Homo sapiens
ccaagaaucugugcaguca

SEQ ID NO: 1218220 - RNA, 19 nt, Homo sapiens
gagguuggcugaacugaca

SEQ ID NO: 1218221 - RNA, 19 nt, Homo sapiens
caaaagacaugaauagaug

SEQ ID NO: 1218222 - RNA, 19 nt, Homo sapiens
ggaaagguaugagagaauc

SEQ ID NO: 1218223 - RNA, 19 nt, Homo sapiens
gaagaacagauuaaugguu

SEQ ID NO: 1218224 - RNA, 19 nt, Homo sapiens
uacaacagguacaugguua

SEQ ID NO: 1218225 - RNA, 19 nt, Homo sapiens
uaccugacuucaagacuua

SEQ ID NO: 1218226 - RNA, 19 nt, Homo sapiens
gaggaaagguaugagagaa

SEQ ID NO: 1218227 - RNA, 19 nt, Homo sapiens
guugugggcugguaucauu

SEQ ID NO: 1218228 - RNA, 19 nt, Homo sapiens
cuuguaaucucaccacuuu

SEQ ID NO: 1218229 - RNA, 19 nt, Homo sapiens
gcagaggaacagacacaua

SEQ ID NO: 1218230 - RNA, 19 nt, Homo sapiens
gcucaguguuuaccaagaa

SEQ ID NO: 1218231 - RNA, 19 nt, Homo sapiens
caguagagcugcccaagau

SEQ ID NO: 1218232 - RNA, 19 nt, Homo sapiens
caacagaggcagagagguu

SEQ ID NO: 1218233 - RNA, 19 nt, Homo sapiens
cgucagaauuguucacauu

SEQ ID NO: 1218234 - RNA, 19 nt, Homo sapiens
aauaaagucuguagucuag

SEQ ID NO: 1218235 - RNA, 19 nt, Homo sapiens
ggguauguaugacuauaaa

SEQ ID NO: 1218236 - RNA, 19 nt, Homo sapiens
aaagauaagcuacagauug

SEQ ID NO: 1218237 - RNA, 19 nt, Homo sapiens
gaacagacacauacgucaa

SEQ ID NO: 1218238 - RNA, 19 nt, Homo sapiens
gaaggaccgaguagaaauu

SEQ ID NO: 1218239 - RNA, 19 nt, Homo sapiens
caaauggucacauacugua

SEQ ID NO: 1218240 - RNA, 19 nt, Homo sapiens
gcacagagaaggaggaagu

SEQ ID NO: 1218241 - RNA, 19 nt, Homo sapiens
gggaaagugugccuugaau

SEQ ID NO: 1218242 - RNA, 19 nt, Homo sapiens
auacugcucuggaaugaaa

SEQ ID NO: 1218243 - RNA, 19 nt, Homo sapiens
ggauacaaacuggauauuu

SEQ ID NO: 1218244 - RNA, 19 nt, Homo sapiens
gaggagugcuugagguuag

SEQ ID NO: 1218245 - RNA, 19 nt, Homo sapiens
caacagcauuugcaggaau

SEQ ID NO: 1218246 - RNA, 19 nt, Homo sapiens
guuaagcacaugaaucuuu

SEQ ID NO: 1218247 - RNA, 19 nt, Homo sapiens
gacauucauuccagagaaa

SEQ ID NO: 1218248 - RNA, 19 nt, Homo sapiens
caacauagugagacucuug

SEQ ID NO: 1218249 - RNA, 19 nt, Homo sapiens
gaagaggaaagguaugaga

SEQ ID NO: 1218250 - RNA, 19 nt, Homo sapiens
gaggaaggaccgaguagaa

SEQ ID NO: 1218251 - RNA, 19 nt, Homo sapiens
gcucaugcuuguaaucuca

SEQ ID NO: 1218252 - RNA, 19 nt, Homo sapiens
gaaaauauccaguguaaag

SEQ ID NO: 1218253 - RNA, 19 nt, Homo sapiens
gagaugaauuugcaaacca

SEQ ID NO: 1218254 - RNA, 19 nt, Homo sapiens
ccagaaauaaacccauaua

SEQ ID NO: 1218255 - RNA, 19 nt, Homo sapiens
gcagagagguuggcugaac

SEQ ID NO: 1218256 - RNA, 19 nt, Homo sapiens
uaaagucuguagucuagau

SEQ ID NO: 1218257 - RNA, 19 nt, Homo sapiens
ggaauacugcucuggaaug

SEQ ID NO: 1218258 - RNA, 19 nt, Homo sapiens
gcgaggcuaugacuuacuu

SEQ ID NO: 1218259 - RNA, 19 nt, Homo sapiens
caaacaguccaauuagaaa

SEQ ID NO: 1218260 - RNA, 19 nt, Homo sapiens
caaaccauauaucugauca

SEQ ID NO: 1218261 - RNA, 19 nt, Homo sapiens
aaacuuggaggacucauuu

SEQ ID NO: 1218262 - RNA, 19 nt, Homo sapiens
gaaaaggaacuaacuguug

SEQ ID NO: 1218263 - RNA, 19 nt, Homo sapiens
caucagggaaugcaaauug

SEQ ID NO: 1218264 - RNA, 19 nt, Homo sapiens
gaaagcacauccauaaaag

SEQ ID NO: 1218265 - RNA, 19 nt, Homo sapiens
gaugagagaacccagaaau

SEQ ID NO: 1218266 - RNA, 19 nt, Homo sapiens
ggaaggaccgaguagaaau

SEQ ID NO: 1218267 - RNA, 19 nt, Homo sapiens
uaccugugcugaaguugua

SEQ ID NO: 1218268 - RNA, 19 nt, Homo sapiens
auaacggacuuaaauguga

SEQ ID NO: 1218269 - RNA, 19 nt, Homo sapiens
uuacacaucuggacucagu

SEQ ID NO: 1218270 - RNA, 19 nt, Homo sapiens
acagguacaugguuaaaca

SEQ ID NO: 1218271 - RNA, 19 nt, Homo sapiens
aaacaacccagauguccua

SEQ ID NO: 1218272 - RNA, 19 nt, Homo sapiens
ugacuuacuuaucucaaug

SEQ ID NO: 1218273 - RNA, 19 nt, Homo sapiens
acagcgaggcuaugacuua

SEQ ID NO: 1218274 - RNA, 19 nt, Homo sapiens
agucucaaauggucacaua

SEQ ID NO: 1218275 - RNA, 19 nt, Homo sapiens
gaacuaacuguugauacaa

SEQ ID NO: 1218276 - RNA, 19 nt, Homo sapiens
aaacaaaccauccauaacu

SEQ ID NO: 1218277 - RNA, 19 nt, Homo sapiens
acaaacaguccaauuagaa

SEQ ID NO: 1218278 - RNA, 19 nt, Homo sapiens
gcauauacuggaacugaaa

SEQ ID NO: 1218279 - RNA, 19 nt, Homo sapiens
ggaagagcuuaugcaagaa

SEQ ID NO: 1218280 - RNA, 19 nt, Homo sapiens
cgaaaucccaauccauauu

SEQ ID NO: 1218281 - RNA, 19 nt, Homo sapiens
gauacugaauaaagucugu

SEQ ID NO: 1218282 - RNA, 19 nt, Homo sapiens
guacagccacucugggaaa

SEQ ID NO: 1218283 - RNA, 19 nt, Homo sapiens
ucacugaagaggaucuaua

SEQ ID NO: 1218284 - RNA, 19 nt, Homo sapiens
aaacaaacaguccaauuag

SEQ ID NO: 1218285 - RNA, 19 nt, Homo sapiens
gauaagcuacagauugaga

SEQ ID NO: 1218286 - RNA, 19 nt, Homo sapiens
gagcuuaugcaagaacuuu

SEQ ID NO: 1218287 - RNA, 19 nt, Homo sapiens
gccagcacaucuccauuga

SEQ ID NO: 1218288 - RNA, 19 nt, Homo sapiens
ccagagaaaugaaaaccua

SEQ ID NO: 1218289 - RNA, 19 nt, Homo sapiens
gucaucaucuuacgacguu

SEQ ID NO: 1218290 - RNA, 19 nt, Homo sapiens
ggaggagugcuugagguua

SEQ ID NO: 1218291 - RNA, 19 nt, Homo sapiens
auacauugcugacaggaau

SEQ ID NO: 1218292 - RNA, 19 nt, Homo sapiens
ggcuaugacuuacuuaucu

SEQ ID NO: 1218293 - RNA, 19 nt, Homo sapiens
cccgaaagcacauccauaa

SEQ ID NO: 1218294 - RNA, 19 nt, Homo sapiens
uagaauaaaucaggagaca

SEQ ID NO: 1218295 - RNA, 19 nt, Homo sapiens
ucacauucauucugucauc

SEQ ID NO: 1218296 - RNA, 19 nt, Homo sapiens
gaagaaauucagagcuuua

SEQ ID NO: 1218297 - RNA, 19 nt, Homo sapiens
uaucaaggcucgcgagaaa

SEQ ID NO: 1218298 - RNA, 19 nt, Homo sapiens
aaagaaggcaugcuuauga

SEQ ID NO: 1218299 - RNA, 19 nt, Homo sapiens
ugaaacagaugcugcugaa

SEQ ID NO: 1218300 - RNA, 19 nt, Homo sapiens
ccaccucaccucuuaauaa

SEQ ID NO: 1218301 - RNA, 19 nt, Homo sapiens
gcgggaaggugcaggauau

SEQ ID NO: 1218302 - RNA, 19 nt, Homo sapiens
uacaugaacuuccguguga

SEQ ID NO: 1218303 - RNA, 19 nt, Homo sapiens
caccucaccucuuaauaaa

SEQ ID NO: 1218304 - RNA, 19 nt, Homo sapiens
gcugugcgcugccugcaaa

SEQ ID NO: 1218305 - RNA, 19 nt, Homo sapiens
gaaagaaggcaugcuuaug

SEQ ID NO: 1218306 - RNA, 19 nt, Homo sapiens
gaaggcaugcuuaugaaga

SEQ ID NO: 1218307 - RNA, 19 nt, Homo sapiens
gaaauucagagcuuuaucu

SEQ ID NO: 1218308 - RNA, 19 nt, Homo sapiens
acagcaagauugaccacua

SEQ ID NO: 1218309 - RNA, 19 nt, Homo sapiens
gaugaggacagcaagauug

SEQ ID NO: 1218310 - RNA, 19 nt, Homo sapiens
aagaaggcaugcuuaugaa

SEQ ID NO: 1218311 - RNA, 19 nt, Homo sapiens
ugaaagcgaaggucaguga

SEQ ID NO: 1218312 - RNA, 19 nt, Homo sapiens
ggaaggugcaggauaucaa

SEQ ID NO: 1218313 - RNA, 19 nt, Homo sapiens
ugaaagaaggcaugcuuau

SEQ ID NO: 1218314 - RNA, 19 nt, Homo sapiens
gguacuccaucucccaaga

SEQ ID NO: 1218315 - RNA, 19 nt, Homo sapiens
ccucaccucuuaauaaagg

SEQ ID NO: 1218316 - RNA, 19 nt, Homo sapiens
cuacaaugcccgcaccaaa

SEQ ID NO: 1218317 - RNA, 19 nt, Homo sapiens
gcacugugacuuccaccaa

SEQ ID NO: 1218318 - RNA, 19 nt, Homo sapiens
gcuacgagccggacagcaa

SEQ ID NO: 1218319 - RNA, 19 nt, Homo sapiens
gcugaguccuacacaguuc

SEQ ID NO: 1218320 - RNA, 19 nt, Homo sapiens
ggaugaggacagcaagauu

SEQ ID NO: 1218321 - RNA, 19 nt, Homo sapiens
gcaccuacgagcugcagaa

SEQ ID NO: 1218322 - RNA, 19 nt, Homo sapiens
gggaggcccugaggaagau

SEQ ID NO: 1218323 - RNA, 19 nt, Homo sapiens
aaacacuggcugugaagaa

SEQ ID NO: 1218324 - RNA, 19 nt, Homo sapiens
ucaaggcucgcgagaaaga

SEQ ID NO: 1218325 - RNA, 19 nt, Homo sapiens
ggagacagccaaccagacu

SEQ ID NO: 1218326 - RNA, 19 nt, Homo sapiens
ccuacgagcugcagaacca

SEQ ID NO: 1218327 - RNA, 19 nt, Homo sapiens
gcugaaagaaggcaugcuu

SEQ ID NO: 1218328 - RNA, 19 nt, Homo sapiens
ggaccucgaagcagaguuc

SEQ ID NO: 1218329 - RNA, 19 nt, Homo sapiens
gccugcacgucaacaauug

SEQ ID NO: 1218330 - RNA, 19 nt, Homo sapiens
ucaaaacacuggcugugaa

SEQ ID NO: 1218331 - RNA, 19 nt, Homo sapiens
cagcaagauugaccacuac

SEQ ID NO: 1218332 - RNA, 19 nt, Homo sapiens
auucagagcuuuaucuacu

SEQ ID NO: 1218333 - RNA, 19 nt, Homo sapiens
gaaggugcaggauaucaag

SEQ ID NO: 1218334 - RNA, 19 nt, Homo sapiens
ggagacaccagcguucaug

SEQ ID NO: 1218335 - RNA, 19 nt, Homo sapiens
cacuggcugugaagaauga

SEQ ID NO: 1218336 - RNA, 19 nt, Homo sapiens
gcuacaggcacucaaguuc

SEQ ID NO: 1218337 - RNA, 19 nt, Homo sapiens
gacaccagcguucauguuc

SEQ ID NO: 1218338 - RNA, 19 nt, Homo sapiens
gcauccggcagacagagua

SEQ ID NO: 1218339 - RNA, 19 nt, Homo sapiens
caggcacccuccucuguca

SEQ ID NO: 1218340 - RNA, 19 nt, Homo sapiens
cugaaagaaggcaugcuua

SEQ ID NO: 1218341 - RNA, 19 nt, Homo sapiens
gcaagagcggcagaugcua

SEQ ID NO: 1218342 - RNA, 19 nt, Homo sapiens
caaaucaaagauggaguga

SEQ ID NO: 1218343 - RNA, 19 nt, Homo sapiens
gccaagcaaaucaaagaug

SEQ ID NO: 1218344 - RNA, 19 nt, Homo sapiens
ucuacucccugaaacagau

SEQ ID NO: 1218345 - RNA, 19 nt, Homo sapiens
caaaagcgaggcagugcua

SEQ ID NO: 1218346 - RNA, 19 nt, Homo sapiens
ugaggaagaucaucaaaac

SEQ ID NO: 1218347 - RNA, 19 nt, Homo sapiens
aaggcaugcuuaugaagau

SEQ ID NO: 1218348 - RNA, 19 nt, Homo sapiens
gccugggugugcacuguga

SEQ ID NO: 1218349 - RNA, 19 nt, Homo sapiens
cugcagccauggaagaaca

SEQ ID NO: 1218350 - RNA, 19 nt, Homo sapiens
ucucugagccggugacucu

SEQ ID NO: 1218351 - RNA, 19 nt, Homo sapiens
gcacccuccucugucacuu

SEQ ID NO: 1218352 - RNA, 19 nt, Homo sapiens
accacuacgugcuggagua

SEQ ID NO: 1218353 - RNA, 19 nt, Homo sapiens
aggcaugcuuaugaagaua

SEQ ID NO: 1218354 - RNA, 19 nt, Homo sapiens
acaaugcccgcaccaaaca

SEQ ID NO: 1218355 - RNA, 19 nt, Homo sapiens
ugugaaggccuguaacaag

SEQ ID NO: 1218356 - RNA, 19 nt, Homo sapiens
gcuaccagcagcuccaaca

SEQ ID NO: 1218357 - RNA, 19 nt, Homo sapiens
ccaagcacgccaacaaggu

SEQ ID NO: 1218358 - RNA, 19 nt, Homo sapiens
cggccaagcacgccaacaa

SEQ ID NO: 1218359 - RNA, 19 nt, Homo sapiens
agacaccagcguucauguu

SEQ ID NO: 1218360 - RNA, 19 nt, Homo sapiens
gggaaggugcaggauauca

SEQ ID NO: 1218361 - RNA, 19 nt, Homo sapiens
ggcgggaaggugcaggaua

SEQ ID NO: 1218362 - RNA, 19 nt, Homo sapiens
gcccugaggaagaucauca

SEQ ID NO: 1218363 - RNA, 19 nt, Homo sapiens
gagaaaagcuggacauaua

SEQ ID NO: 1218364 - RNA, 19 nt, Homo sapiens
guuggaagcuuuauacuaa

SEQ ID NO: 1218365 - RNA, 19 nt, Homo sapiens
gcacaucauuggcgccuua

SEQ ID NO: 1218366 - RNA, 19 nt, Homo sapiens
gagaacaugucaaaguuaa

SEQ ID NO: 1218367 - RNA, 19 nt, Homo sapiens
gagagaacaugucaaaguu

SEQ ID NO: 1218368 - RNA, 19 nt, Homo sapiens
gaaacacccuuuagucugu

SEQ ID NO: 1218369 - RNA, 19 nt, Homo sapiens
auacugggcuucacacuua

SEQ ID NO: 1218370 - RNA, 19 nt, Homo sapiens
gaauggaggucagaaauca

SEQ ID NO: 1218371 - RNA, 19 nt, Homo sapiens
uuaaauaacugccgacuuc

SEQ ID NO: 1218372 - RNA, 19 nt, Homo sapiens
guccauagcuuuagucuuc

SEQ ID NO: 1218373 - RNA, 19 nt, Homo sapiens
gaagaaacacugaagaugu

SEQ ID NO: 1218374 - RNA, 19 nt, Homo sapiens
gaugaugacuaaaugcaaa

SEQ ID NO: 1218375 - RNA, 19 nt, Homo sapiens
ucaaaucuccaaacucuua

SEQ ID NO: 1218376 - RNA, 19 nt, Homo sapiens
caggaugucuuaaaugauu

SEQ ID NO: 1218377 - RNA, 19 nt, Homo sapiens
aaaguuaccucucaguauu

SEQ ID NO: 1218378 - RNA, 19 nt, Homo sapiens
gguuuaggauucaauagua

SEQ ID NO: 1218379 - RNA, 19 nt, Homo sapiens
caucaaaucuccaaacucu

SEQ ID NO: 1218380 - RNA, 19 nt, Homo sapiens
guaugugguuugauugaua

SEQ ID NO: 1218381 - RNA, 19 nt, Homo sapiens
uaaccaggaugucuuaaau

SEQ ID NO: 1218382 - RNA, 19 nt, Homo sapiens
ggaggcacguggagaugua

SEQ ID NO: 1218383 - RNA, 19 nt, Homo sapiens
acugaaagguguuaaauug

SEQ ID NO: 1218384 - RNA, 19 nt, Homo sapiens
auaccuagaugaugacuaa

SEQ ID NO: 1218385 - RNA, 19 nt, Homo sapiens
gggcuucacacuuaucuua

SEQ ID NO: 1218386 - RNA, 19 nt, Homo sapiens
ggagagaacaugucaaagu

SEQ ID NO: 1218387 - RNA, 19 nt, Homo sapiens
ugaaggcccuauuuaaguu

SEQ ID NO: 1218388 - RNA, 19 nt, Homo sapiens
cagaggagguguuucauag

SEQ ID NO: 1218389 - RNA, 19 nt, Homo sapiens
gaucuguaaucaucucuau

SEQ ID NO: 1218390 - RNA, 19 nt, Homo sapiens
gcagaggagguguuucaua

SEQ ID NO: 1218391 - RNA, 19 nt, Homo sapiens
ggucaacauuggccugaaa

SEQ ID NO: 1218392 - RNA, 19 nt, Homo sapiens
ggagguguuucauagagaa

SEQ ID NO: 1218393 - RNA, 19 nt, Homo sapiens
uuacggacauccaagcuuu

SEQ ID NO: 1218394 - RNA, 19 nt, Homo sapiens
ugaaacaaguaucagcaaa

SEQ ID NO: 1218395 - RNA, 19 nt, Homo sapiens
cugagaagcuuuacaaugg

SEQ ID NO: 1218396 - RNA, 19 nt, Homo sapiens
ggucagaaaucaucaacag

SEQ ID NO: 1218397 - RNA, 19 nt, Homo sapiens
gguccucucucaccucuga

SEQ ID NO: 1218398 - RNA, 19 nt, Homo sapiens
acaccuaagucacagaauu

SEQ ID NO: 1218399 - RNA, 19 nt, Homo sapiens
gaagacggcaaccucauug

SEQ ID NO: 1218400 - RNA, 19 nt, Homo sapiens
aguauucacuaacugcuua

SEQ ID NO: 1218401 - RNA, 19 nt, Homo sapiens
gauaaaguauguuguaacc

SEQ ID NO: 1218402 - RNA, 19 nt, Homo sapiens
gagaagaaacacugaagau

SEQ ID NO: 1218403 - RNA, 19 nt, Homo sapiens
aaccugaugugguguuuaa

SEQ ID NO: 1218404 - RNA, 19 nt, Homo sapiens
gaggagguguuucauagag

SEQ ID NO: 1218405 - RNA, 19 nt, Homo sapiens
ugaagaaggagacgaggua

SEQ ID NO: 1218406 - RNA, 19 nt, Homo sapiens
caaccacaaucaagaacug

SEQ ID NO: 1218407 - RNA, 19 nt, Homo sapiens
ggcagaaucuuuguagugu

SEQ ID NO: 1218408 - RNA, 19 nt, Homo sapiens
aaacuucgaccgagagauu

SEQ ID NO: 1218409 - RNA, 19 nt, Homo sapiens
ucuccaaacucuuaaagga

SEQ ID NO: 1218410 - RNA, 19 nt, Homo sapiens
gggaguaauuccuuuagca

SEQ ID NO: 1218411 - RNA, 19 nt, Homo sapiens
uuacuuugcugcuucaugu

SEQ ID NO: 1218412 - RNA, 19 nt, Homo sapiens
gaugacuuaucuggguuua

SEQ ID NO: 1218413 - RNA, 19 nt, Homo sapiens
aaacacagccagcccaaga

SEQ ID NO: 1218414 - RNA, 19 nt, Homo sapiens
gcuuuacaauggaugcuuu

SEQ ID NO: 1218415 - RNA, 19 nt, Homo sapiens
gcacugaaagguguuaaau

SEQ ID NO: 1218416 - RNA, 19 nt, Homo sapiens
cagaaucuuuguagugugu

SEQ ID NO: 1218417 - RNA, 19 nt, Homo sapiens
ggacauauacugggcuuca

SEQ ID NO: 1218418 - RNA, 19 nt, Homo sapiens
ccuagaugaugacuaaaug

SEQ ID NO: 1218419 - RNA, 19 nt, Homo sapiens
cauccaagcuuuugucuga

SEQ ID NO: 1218420 - RNA, 19 nt, Homo sapiens
gagaagcuuuacaauggau

SEQ ID NO: 1218421 - RNA, 19 nt, Homo sapiens
ucacugagaagcuuuacaa

SEQ ID NO: 1218422 - RNA, 19 nt, Homo sapiens
ggaguaauuccuuuagcaa

SEQ ID NO: 1218423 - RNA, 19 nt, Homo sapiens
accaggaugucuuaaauga

SEQ ID NO: 1218424 - RNA, 19 nt, Homo sapiens
ggauccagguccucucuca

SEQ ID NO: 1218425 - RNA, 19 nt, Homo sapiens
cgucaggccucaucgacaa

SEQ ID NO: 1218426 - RNA, 19 nt, Homo sapiens
gagacgagguauuccuaca

SEQ ID NO: 1218427 - RNA, 19 nt, Homo sapiens
aagaaacacugaagauguc

SEQ ID NO: 1218428 - RNA, 19 nt, Homo sapiens
guaaccaggaugucuuaaa

SEQ ID NO: 1218429 - RNA, 19 nt, Homo sapiens
gaccucgggugggauguuu

SEQ ID NO: 1218430 - RNA, 19 nt, Homo sapiens
cuaaaugggcuccuucaug

SEQ ID NO: 1218431 - RNA, 19 nt, Homo sapiens
gaaggcccuauuuaaguuu

SEQ ID NO: 1218432 - RNA, 19 nt, Homo sapiens
cuguauaccuagaugauga

SEQ ID NO: 1218433 - RNA, 19 nt, Homo sapiens
ugacuuaucuggguuuagg

SEQ ID NO: 1218434 - RNA, 19 nt, Homo sapiens
caccuaagucacagaauuu

SEQ ID NO: 1218435 - RNA, 19 nt, Homo sapiens
uaagauccacccacaccua

SEQ ID NO: 1218436 - RNA, 19 nt, Homo sapiens
gguuggaagcuuuauacua

SEQ ID NO: 1218437 - RNA, 19 nt, Homo sapiens
caaagcaggcacacccaaa

SEQ ID NO: 1218438 - RNA, 19 nt, Homo sapiens
cuacggaggccugcugaua

SEQ ID NO: 1218439 - RNA, 19 nt, Homo sapiens
guggacugguuuccuguuu

SEQ ID NO: 1218440 - RNA, 19 nt, Homo sapiens
cagaaaucaucaacagcaa

SEQ ID NO: 1218441 - RNA, 19 nt, Homo sapiens
aaaacacgcuguauaccua

SEQ ID NO: 1218442 - RNA, 19 nt, Homo sapiens
uuacaggaaacacccuuua

SEQ ID NO: 1218443 - RNA, 19 nt, Homo sapiens
gcuucacacuuaucuuaug

SEQ ID NO: 1218444 - RNA, 19 nt, Homo sapiens
ccauggcaguggagucauu

SEQ ID NO: 1218445 - RNA, 19 nt, Homo sapiens
acuaacugcuuauuacaug

SEQ ID NO: 1218446 - RNA, 19 nt, Homo sapiens
gagaaaagguuggaagcuu

SEQ ID NO: 1218447 - RNA, 19 nt, Homo sapiens
ugagaagcuuuacaaugga

SEQ ID NO: 1218448 - RNA, 19 nt, Homo sapiens
ucucugaaggcccuauuua

SEQ ID NO: 1218449 - RNA, 19 nt, Homo sapiens
ucucaucacugcacacaag

SEQ ID NO: 1218450 - RNA, 19 nt, Homo sapiens
cagcagaggagguguuuca

SEQ ID NO: 1218451 - RNA, 19 nt, Homo sapiens
agagaacaugucaaaguua

SEQ ID NO: 1218452 - RNA, 19 nt, Homo sapiens
gcacuugaagaugguuuaa

SEQ ID NO: 1218453 - RNA, 19 nt, Homo sapiens
gaaccugaugugguguuua

SEQ ID NO: 1218454 - RNA, 19 nt, Homo sapiens
acggaggccugcugauaaa

SEQ ID NO: 1218455 - RNA, 19 nt, Homo sapiens
gguguuucauagagaacua

SEQ ID NO: 1218456 - RNA, 19 nt, Homo sapiens
gugaccagcuagucccauu

SEQ ID NO: 1218457 - RNA, 19 nt, Homo sapiens
ucuguaaucaucucuauug

SEQ ID NO: 1218458 - RNA, 19 nt, Homo sapiens
ucaugggccucaaccuuau

SEQ ID NO: 1218459 - RNA, 19 nt, Homo sapiens
gaaaucaucaacagcaaaa

SEQ ID NO: 1218460 - RNA, 19 nt, Homo sapiens
ggaaggcuggugcacauca

SEQ ID NO: 1218461 - RNA, 19 nt, Homo sapiens
gcugggaguaauuccuuua

SEQ ID NO: 1218462 - RNA, 19 nt, Homo sapiens
gaaggcuggugcacaucau

SEQ ID NO: 1218463 - RNA, 19 nt, Homo sapiens
ggacaccacuucuuaaugu

SEQ ID NO: 1218464 - RNA, 19 nt, Homo sapiens
ggauggagcuguucgacuu

SEQ ID NO: 1218465 - RNA, 19 nt, Homo sapiens
gggcggagaugcucaagaa

SEQ ID NO: 1218466 - RNA, 19 nt, Homo sapiens
gaaccgcucuaggcacgua

SEQ ID NO: 1218467 - RNA, 19 nt, Homo sapiens
ccaaggagguccagacgau

SEQ ID NO: 1218468 - RNA, 19 nt, Homo sapiens
agaagccgguggugacuuu

SEQ ID NO: 1218469 - RNA, 19 nt, Homo sapiens
caaggagaauucccucauc

SEQ ID NO: 1218470 - RNA, 19 nt, Homo sapiens
ggaagugccugagaucaac

SEQ ID NO: 1218471 - RNA, 19 nt, Homo sapiens
ugccugagaucaacgcuuu

SEQ ID NO: 1218472 - RNA, 19 nt, Homo sapiens
ccaaagaggaaaguaagaa

SEQ ID NO: 1218473 - RNA, 19 nt, Homo sapiens
gcgcuggauuggauguuug

SEQ ID NO: 1218474 - RNA, 19 nt, Homo sapiens
gggaggguauccggcuuaa

SEQ ID NO: 1218475 - RNA, 19 nt, Homo sapiens
cgaucgaggucuauaagca

SEQ ID NO: 1218476 - RNA, 19 nt, Homo sapiens
gaggguauccggcuuaagg

SEQ ID NO: 1218477 - RNA, 19 nt, Homo sapiens
gaggugaaggccuggcuuu

SEQ ID NO: 1218478 - RNA, 19 nt, Homo sapiens
caacugauuccgacuggau

SEQ ID NO: 1218479 - RNA, 19 nt, Homo sapiens
caacaauuacgggcagauu

SEQ ID NO: 1218480 - RNA, 19 nt, Homo sapiens
gcugucagguggcgaggau

SEQ ID NO: 1218481 - RNA, 19 nt, Homo sapiens
cagcuuguccucugcuuug

SEQ ID NO: 1218482 - RNA, 19 nt, Homo sapiens
gcggagcacucugggacuu

SEQ ID NO: 1218483 - RNA, 19 nt, Homo sapiens
ggagcacucugggacuugu

SEQ ID NO: 1218484 - RNA, 19 nt, Homo sapiens
cagagcgucucaccaugug

SEQ ID NO: 1218485 - RNA, 19 nt, Homo sapiens
gaucgacaucugcuuagug

SEQ ID NO: 1218486 - RNA, 19 nt, Homo sapiens
aaugggcgcuggauuggau

SEQ ID NO: 1218487 - RNA, 19 nt, Homo sapiens
caaagaggaaaguaagaag

SEQ ID NO: 1218488 - RNA, 19 nt, Homo sapiens
uggcggcuggcaacaauua

SEQ ID NO: 1218489 - RNA, 19 nt, Homo sapiens
ggcgcuggauuggauguuu

SEQ ID NO: 1218490 - RNA, 19 nt, Homo sapiens
gauggagcuguucgacuuu

SEQ ID NO: 1218491 - RNA, 19 nt, Homo sapiens
gcccgucuauagcaugguu

SEQ ID NO: 1218492 - RNA, 19 nt, Homo sapiens
gaagccaaagaggaaagua

SEQ ID NO: 1218493 - RNA, 19 nt, Homo sapiens
gagcucagaagccaaagag

SEQ ID NO: 1218494 - RNA, 19 nt, Homo sapiens
uugcagcggcuccauauga

SEQ ID NO: 1218495 - RNA, 19 nt, Homo sapiens
gcucaggguuuuagagugu

SEQ ID NO: 1218496 - RNA, 19 nt, Homo sapiens
cacagaagcacgucaccuu

SEQ ID NO: 1218497 - RNA, 19 nt, Homo sapiens
ccacaaugggcgcuggauu

SEQ ID NO: 1218498 - RNA, 19 nt, Homo sapiens
ucaagaagggcuguaagga

SEQ ID NO: 1218499 - RNA, 19 nt, Homo sapiens
ccagagcgucucaccaugu

SEQ ID NO: 1218500 - RNA, 19 nt, Homo sapiens
uggcgaggauggagcuguu

SEQ ID NO: 1218501 - RNA, 19 nt, Homo sapiens
aagccaaagaggaaaguaa

SEQ ID NO: 1218502 - RNA, 19 nt, Homo sapiens
gauguuuggcaacugauuc

SEQ ID NO: 1218503 - RNA, 19 nt, Homo sapiens
gccaaagaggaaaguaaga

SEQ ID NO: 1218504 - RNA, 19 nt, Homo sapiens
ggauguuuggcaacugauu

SEQ ID NO: 1218505 - RNA, 19 nt, Homo sapiens
gauuggauguuuggcaacu

SEQ ID NO: 1218506 - RNA, 19 nt, Homo sapiens
ccaaggagaauucccucau

SEQ ID NO: 1218507 - RNA, 19 nt, Homo sapiens
ucuggcggcuggcaacaau

SEQ ID NO: 1218508 - RNA, 19 nt, Homo sapiens
uuggauguuuggcaacuga

SEQ ID NO: 1218509 - RNA, 19 nt, Homo sapiens
gacgaucgaggucuauaag

SEQ ID NO: 1218510 - RNA, 19 nt, Homo sapiens
ccacacccaccaccaucuu

SEQ ID NO: 1218511 - RNA, 19 nt, Homo sapiens
gcacacuauggaccuugaa

SEQ ID NO: 1218512 - RNA, 19 nt, Homo sapiens
uggaagugccugagaucaa

SEQ ID NO: 1218513 - RNA, 19 nt, Homo sapiens
ggugaaggccuggcuuugg

SEQ ID NO: 1218514 - RNA, 19 nt, Homo sapiens
caacagcugccggguggau

SEQ ID NO: 1218515 - RNA, 19 nt, Homo sapiens
gcggagagcugguuaauga

SEQ ID NO: 1218516 - RNA, 19 nt, Homo sapiens
gcaagaagauaaagugaug

SEQ ID NO: 1218517 - RNA, 19 nt, Homo sapiens
gggaaauccuuuaccaaua

SEQ ID NO: 1218518 - RNA, 19 nt, Homo sapiens
gaucuuaccuuacuguuca

SEQ ID NO: 1218519 - RNA, 19 nt, Homo sapiens
gagcaacacucaacgaaug

SEQ ID NO: 1218520 - RNA, 19 nt, Homo sapiens
ggaaauccuuuaccaauag

SEQ ID NO: 1218521 - RNA, 19 nt, Homo sapiens
gaucuuaccuugcuguuca

SEQ ID NO: 1218522 - RNA, 19 nt, Homo sapiens
caacgaauguaaucagugu

SEQ ID NO: 1218523 - RNA, 19 nt, Homo sapiens
ggagaggaaucaucuugga

SEQ ID NO: 1218524 - RNA, 19 nt, Homo sapiens
ccaaaggguuaacuccuaa

SEQ ID NO: 1218525 - RNA, 19 nt, Homo sapiens
gaagauucauacuggagaa

SEQ ID NO: 1218526 - RNA, 19 nt, Homo sapiens
gccaaaggguuaacuccua

SEQ ID NO: 1218527 - RNA, 19 nt, Homo sapiens
ggagaaacccuaugaaugc

SEQ ID NO: 1218528 - RNA, 19 nt, Homo sapiens
ugagagcgcugcgggauaa

SEQ ID NO: 1218529 - RNA, 19 nt, Homo sapiens
ggcacgaggucaucucuuu

SEQ ID NO: 1218530 - RNA, 19 nt, Homo sapiens
ggaguacccuuacgaaugc

SEQ ID NO: 1218531 - RNA, 19 nt, Homo sapiens
gggaaaaccuucagcaauu

SEQ ID NO: 1218532 - RNA, 19 nt, Homo sapiens
gggaaauccuacagcagua

SEQ ID NO: 1218533 - RNA, 19 nt, Homo sapiens
gcucagauuuguguugaaa

SEQ ID NO: 1218534 - RNA, 19 nt, Homo sapiens
ggagaaacccuacgaaugc

SEQ ID NO: 1218535 - RNA, 19 nt, Homo sapiens
gaaccaaguugauaaaccu

SEQ ID NO: 1218536 - RNA, 19 nt, Homo sapiens
cagcagaucuuaccuuacu

SEQ ID NO: 1218537 - RNA, 19 nt, Homo sapiens
ggagggucauuauguaugu

SEQ ID NO: 1218538 - RNA, 19 nt, Homo sapiens
accaauagcuuuucucuua

SEQ ID NO: 1218539 - RNA, 19 nt, Homo sapiens
gaaacccuaugaaugcaau

SEQ ID NO: 1218540 - RNA, 19 nt, Homo sapiens
gggagaaacccuaugaaug

SEQ ID NO: 1218541 - RNA, 19 nt, Homo sapiens
aagauaaagugaugacaga

SEQ ID NO: 1218542 - RNA, 19 nt, Homo sapiens
gggaguacccuuacgaaug

SEQ ID NO: 1218543 - RNA, 19 nt, Homo sapiens
gggagaaacccuacgaaug

SEQ ID NO: 1218544 - RNA, 19 nt, Homo sapiens
cauaagagaauccacaaug

SEQ ID NO: 1218545 - RNA, 19 nt, Homo sapiens
cauaagagaauccacaaug

SEQ ID NO: 1218546 - RNA, 19 nt, Homo sapiens
agaccgcacuugagaauuc

SEQ ID NO: 1218547 - RNA, 19 nt, Homo sapiens
cagcacauaagaacucaua

SEQ ID NO: 1218548 - RNA, 19 nt, Homo sapiens
aggaggaggucgaaucuga

SEQ ID NO: 1218549 - RNA, 19 nt, Homo sapiens
auaaagugaugacagaaga

SEQ ID NO: 1218550 - RNA, 19 nt, Homo sapiens
ggagcaagaagauaaagug

SEQ ID NO: 1218551 - RNA, 19 nt, Homo sapiens
gagcaagaagauaaaguga

SEQ ID NO: 1218552 - RNA, 19 nt, Homo sapiens
acaaauguaaccaguguuu

SEQ ID NO: 1218553 - RNA, 19 nt, Homo sapiens
agcagcagaucuuaccuua

SEQ ID NO: 1218554 - RNA, 19 nt, Homo sapiens
gauucauacuggagaaaga

SEQ ID NO: 1218555 - RNA, 19 nt, Homo sapiens
gagaaacccuaugaaugca

SEQ ID NO: 1218556 - RNA, 19 nt, Homo sapiens
uuuaaagucuucagcacaa

SEQ ID NO: 1218557 - RNA, 19 nt, Homo sapiens
caacacucaacgaauguaa

SEQ ID NO: 1218558 - RNA, 19 nt, Homo sapiens
gaauccauuuaaagccaaa

SEQ ID NO: 1218559 - RNA, 19 nt, Homo sapiens
ggaauucucucagguaccu

SEQ ID NO: 1218560 - RNA, 19 nt, Homo sapiens
gacagaagagagaggaauu

SEQ ID NO: 1218561 - RNA, 19 nt, Homo sapiens
gagaaacccuacgaaugca

SEQ ID NO: 1218562 - RNA, 19 nt, Homo sapiens
cgcgagaggugcuucauuc

SEQ ID NO: 1218563 - RNA, 19 nt, Homo sapiens
gaaucugacacagcacaua

SEQ ID NO: 1218564 - RNA, 19 nt, Homo sapiens
uuaaugagcuccugaaaag

SEQ ID NO: 1218565 - RNA, 19 nt, Homo sapiens
cacaggagaauacauaaug

SEQ ID NO: 1218566 - RNA, 19 nt, Homo sapiens
ucacaaggcacaagagagu

SEQ ID NO: 1218567 - RNA, 19 nt, Homo sapiens
caacugccgcucugucuuc

SEQ ID NO: 1218568 - RNA, 19 nt, Homo sapiens
uaauggagagaaauccuaa

SEQ ID NO: 1218569 - RNA, 19 nt, Homo sapiens
ggaaccaaguugauaaacc

SEQ ID NO: 1218570 - RNA, 19 nt, Homo sapiens
uccguggacuucuguauga

SEQ ID NO: 1218571 - RNA, 19 nt, Homo sapiens
gaauacauaauggagagaa

SEQ ID NO: 1218572 - RNA, 19 nt, Homo sapiens
gcacauaagaacucauacu

SEQ ID NO: 1218573 - RNA, 19 nt, Homo sapiens
gauaaagugaugacagaag

SEQ ID NO: 1218574 - RNA, 19 nt, Homo sapiens
gagggucauuauguaugua

SEQ ID NO: 1218575 - RNA, 19 nt, Homo sapiens
ugacacagcacauaagaac

SEQ ID NO: 1218576 - RNA, 19 nt, Homo sapiens
ggaaaaccuucagcaauuc

SEQ ID NO: 1218577 - RNA, 19 nt, Homo sapiens
uaauucaagcucagauuug

SEQ ID NO: 1218578 - RNA, 19 nt, Homo sapiens
auaagagaauccacaaugg

SEQ ID NO: 1218579 - RNA, 19 nt, Homo sapiens
aagcucagauuuguguuga

SEQ ID NO: 1218580 - RNA, 19 nt, Homo sapiens
auaagagaauccacaaugg

SEQ ID NO: 1218581 - RNA, 19 nt, Homo sapiens
gggacgugaugcuggagaa

SEQ ID NO: 1218582 - RNA, 19 nt, Homo sapiens
gagugugggaaauccuuua

SEQ ID NO: 1218583 - RNA, 19 nt, Homo sapiens
aaucugacacagcacauaa

SEQ ID NO: 1218584 - RNA, 19 nt, Homo sapiens
gcagaucuuaccuuacugu

SEQ ID NO: 1218585 - RNA, 19 nt, Homo sapiens
ucaccuauccucacugauc

SEQ ID NO: 1218586 - RNA, 19 nt, Homo sapiens
caguagaucuuaccuugcu

SEQ ID NO: 1218587 - RNA, 19 nt, Homo sapiens
cggcacaggaagauucaua

SEQ ID NO: 1218588 - RNA, 19 nt, Homo sapiens
ucacugauccguggacuuc

SEQ ID NO: 1218589 - RNA, 19 nt, Homo sapiens
ggagcaacacucaacgaau

SEQ ID NO: 1218590 - RNA, 19 nt, Homo sapiens
ggaggucgaaucugacaca

SEQ ID NO: 1218591 - RNA, 19 nt, Homo sapiens
guggacuucuguaugauca

SEQ ID NO: 1218592 - RNA, 19 nt, Homo sapiens
gcaacacucaacgaaugua

SEQ ID NO: 1218593 - RNA, 19 nt, Homo sapiens
gaaauccuuuaccaauagc

SEQ ID NO: 1218594 - RNA, 19 nt, Homo sapiens
gcacgaggucaucucuuuc

SEQ ID NO: 1218595 - RNA, 19 nt, Homo sapiens
gagaauucacacuggagaa

SEQ ID NO: 1218596 - RNA, 19 nt, Homo sapiens
cacaaaaucuucccuuaca

SEQ ID NO: 1218597 - RNA, 19 nt, Homo sapiens
auuuaaagccaaaggguua

SEQ ID NO: 1218598 - RNA, 19 nt, Homo sapiens
ugauaaaccuaggcugauc

SEQ ID NO: 1218599 - RNA, 19 nt, Homo sapiens
guaaugagugugggaaauc

SEQ ID NO: 1218600 - RNA, 19 nt, Homo sapiens
uuaccuugcuguucauaag

SEQ ID NO: 1218601 - RNA, 19 nt, Homo sapiens
cccuauggcugcagugaau

SEQ ID NO: 1218602 - RNA, 19 nt, Homo sapiens
ggauguggccguggaguuc

SEQ ID NO: 1218603 - RNA, 19 nt, Homo sapiens
gugaaugugggaaauccua

SEQ ID NO: 1218604 - RNA, 19 nt, Homo sapiens
ugggaaauccuuuaccaau

SEQ ID NO: 1218605 - RNA, 19 nt, Homo sapiens
gaacucauacuggagaaaa

SEQ ID NO: 1218606 - RNA, 19 nt, Homo sapiens
gggagggucauuauguaug

SEQ ID NO: 1218607 - RNA, 19 nt, Homo sapiens
uuucaccuauccucacuga

SEQ ID NO: 1218608 - RNA, 19 nt, Homo sapiens
acaggagaauacauaaugg

SEQ ID NO: 1218609 - RNA, 19 nt, Homo sapiens
uuacgaaugccacgauugu

SEQ ID NO: 1218610 - RNA, 19 nt, Homo sapiens
cuucagcaauuccucauac

SEQ ID NO: 1218611 - RNA, 19 nt, Homo sapiens
caagcucagauuuguguug

SEQ ID NO: 1218612 - RNA, 19 nt, Homo sapiens
uguaaugagugugggaaau

SEQ ID NO: 1218613 - RNA, 19 nt, Homo sapiens
gcacuauagcauucauaca

SEQ ID NO: 1218614 - RNA, 19 nt, Homo sapiens
ucagaccgcacuugagaau

SEQ ID NO: 1218615 - RNA, 19 nt, Homo sapiens
uaacuggacucuguucaua

SEQ ID NO: 1218616 - RNA, 19 nt, Homo sapiens
cagaggaccuguacuuuga

SEQ ID NO: 1218617 - RNA, 19 nt, Homo sapiens
ggauuuaacuggacucugu

SEQ ID NO: 1218618 - RNA, 19 nt, Homo sapiens
ccacaggccuugaacuuug

SEQ ID NO: 1218619 - RNA, 19 nt, Homo sapiens
ucagagaacucauugacaa

SEQ ID NO: 1218620 - RNA, 19 nt, Homo sapiens
gcaagagcauggucagaga

SEQ ID NO: 1218621 - RNA, 19 nt, Homo sapiens
gaggagaggaccuuuguaa

SEQ ID NO: 1218622 - RNA, 19 nt, Homo sapiens
cgacaagaauggcaacaug

SEQ ID NO: 1218623 - RNA, 19 nt, Homo sapiens
ucaaagcggugcuggagaa

SEQ ID NO: 1218624 - RNA, 19 nt, Homo sapiens
gaggugcgcuggcgugaau

SEQ ID NO: 1218625 - RNA, 19 nt, Homo sapiens
gagaccaacucaagauaca

SEQ ID NO: 1218626 - RNA, 19 nt, Homo sapiens
gcacggcuuugacgacaau

SEQ ID NO: 1218627 - RNA, 19 nt, Homo sapiens
ucaagcugcugccagauga

SEQ ID NO: 1218628 - RNA, 19 nt, Homo sapiens
gacgaggaguccaagaaga

SEQ ID NO: 1218629 - RNA, 19 nt, Homo sapiens
aaacugugcuauccucugu

SEQ ID NO: 1218630 - RNA, 19 nt, Homo sapiens
ggagagacacgacgucauc

SEQ ID NO: 1218631 - RNA, 19 nt, Homo sapiens
ggagaggaccuuuguaaaa

SEQ ID NO: 1218632 - RNA, 19 nt, Homo sapiens
gccuggaucucacccauga

SEQ ID NO: 1218633 - RNA, 19 nt, Homo sapiens
gggaaaagguggacccaaa

SEQ ID NO: 1218634 - RNA, 19 nt, Homo sapiens
ccaggaccauacagaacua

SEQ ID NO: 1218635 - RNA, 19 nt, Homo sapiens
ugagcuaaguaaaugcuuu

SEQ ID NO: 1218636 - RNA, 19 nt, Homo sapiens
ggccggaacuucgacaaga

SEQ ID NO: 1218637 - RNA, 19 nt, Homo sapiens
gaaccagagugugauagag

SEQ ID NO: 1218638 - RNA, 19 nt, Homo sapiens
ggaaccgugugacgacuuc

SEQ ID NO: 1218639 - RNA, 19 nt, Homo sapiens
gacaagaauggcaacauga

SEQ ID NO: 1218640 - RNA, 19 nt, Homo sapiens
aagcggugcuggagaauuc

SEQ ID NO: 1218641 - RNA, 19 nt, Homo sapiens
cuucagaacuugagcuaag

SEQ ID NO: 1218642 - RNA, 19 nt, Homo sapiens
uagagacaaucaacugugu

SEQ ID NO: 1218643 - RNA, 19 nt, Homo sapiens
gaggaccuguacuuugaga

SEQ ID NO: 1218644 - RNA, 19 nt, Homo sapiens
gaagaaggcgcaggagaag

SEQ ID NO: 1218645 - RNA, 19 nt, Homo sapiens
caagacagacguccacagu

SEQ ID NO: 1218646 - RNA, 19 nt, Homo sapiens
uauaaggccuaccucaagu

SEQ ID NO: 1218647 - RNA, 19 nt, Homo sapiens
cgagaucacgcacggcuuu

SEQ ID NO: 1218648 - RNA, 19 nt, Homo sapiens
ucagaggaccuguacuuug

SEQ ID NO: 1218649 - RNA, 19 nt, Homo sapiens
agaagaaggcgcaggagaa

SEQ ID NO: 1218650 - RNA, 19 nt, Homo sapiens
gccggaacuucgacaagaa

SEQ ID NO: 1218651 - RNA, 19 nt, Homo sapiens
gagaacucauugacaaggu

SEQ ID NO: 1218652 - RNA, 19 nt, Homo sapiens
gcgacgagcuggaggucau

SEQ ID NO: 1218653 - RNA, 19 nt, Homo sapiens
guacuccaaucugaacuuc

SEQ ID NO: 1218654 - RNA, 19 nt, Homo sapiens
gugcuggaccgcauuggua

SEQ ID NO: 1218655 - RNA, 19 nt, Homo sapiens
gggaaaacauugcugacaa

SEQ ID NO: 1218656 - RNA, 19 nt, Homo sapiens
caacaggcgcguccucauc

SEQ ID NO: 1218657 - RNA, 19 nt, Homo sapiens
ugacgacuucuaccaguuu

SEQ ID NO: 1218658 - RNA, 19 nt, Homo sapiens
aacagaacgugaacggauu

SEQ ID NO: 1218659 - RNA, 19 nt, Homo sapiens
gcagucagagugcaugauc

SEQ ID NO: 1218660 - RNA, 19 nt, Homo sapiens
caagaauggcaacaugaug

SEQ ID NO: 1218661 - RNA, 19 nt, Homo sapiens
ggacucuguucauacaaac

SEQ ID NO: 1218662 - RNA, 19 nt, Homo sapiens
ggugcauugucuuccagua

SEQ ID NO: 1218663 - RNA, 19 nt, Homo sapiens
caaggugcauugucuucca

SEQ ID NO: 1218664 - RNA, 19 nt, Homo sapiens
gccauccaauccaucaaga

SEQ ID NO: 1218665 - RNA, 19 nt, Homo sapiens
aaaccgaaaccagauugua

SEQ ID NO: 1218666 - RNA, 19 nt, Homo sapiens
ucaggaagcuucgggaaaa

SEQ ID NO: 1218667 - RNA, 19 nt, Homo sapiens
uggacucuguucauacaaa

SEQ ID NO: 1218668 - RNA, 19 nt, Homo sapiens
agaauucgacugccaagga

SEQ ID NO: 1218669 - RNA, 19 nt, Homo sapiens
gugacgacuucuaccaguu

SEQ ID NO: 1218670 - RNA, 19 nt, Homo sapiens
uccaauccaucaagacaga

SEQ ID NO: 1218671 - RNA, 19 nt, Homo sapiens
ggaggagaggaccuuugua

SEQ ID NO: 1218672 - RNA, 19 nt, Homo sapiens
ggccuuggguguccucuac

SEQ ID NO: 1218673 - RNA, 19 nt, Homo sapiens
ccaggauccuccagaacau

SEQ ID NO: 1218674 - RNA, 19 nt, Homo sapiens
caucaucgacaccuacuca

SEQ ID NO: 1218675 - RNA, 19 nt, Homo sapiens
gagcuaaguaaaugcuuuc

SEQ ID NO: 1218676 - RNA, 19 nt, Homo sapiens
ccaaaccgaaaccagauug

SEQ ID NO: 1218677 - RNA, 19 nt, Homo sapiens
guucauacaaacugugcua

SEQ ID NO: 1218678 - RNA, 19 nt, Homo sapiens
cagagugcaugaucuacca

SEQ ID NO: 1218679 - RNA, 19 nt, Homo sapiens
gaccuguacuuugagaaca

SEQ ID NO: 1218680 - RNA, 19 nt, Homo sapiens
gccaggauccuccagaaca

SEQ ID NO: 1218681 - RNA, 19 nt, Homo sapiens
gacaaggugcggacagugu

SEQ ID NO: 1218682 - RNA, 19 nt, Homo sapiens
gacgacuucuaccaguuug

SEQ ID NO: 1218683 - RNA, 19 nt, Homo sapiens
gagaggaccuuuguaaaac

SEQ ID NO: 1218684 - RNA, 19 nt, Homo sapiens
gccacaggccuugaacuuu

SEQ ID NO: 1218685 - RNA, 19 nt, Homo sapiens
cuacucagccaggaccaua

SEQ ID NO: 1218686 - RNA, 19 nt, Homo sapiens
gcauugucuuccaguaucu

SEQ ID NO: 1218687 - RNA, 19 nt, Homo sapiens
ucucagaggaccuguacuu

SEQ ID NO: 1218688 - RNA, 19 nt, Homo sapiens
caaggugcggacaguguuu

SEQ ID NO: 1218689 - RNA, 19 nt, Homo sapiens
cuguaccgcuccugcauga

SEQ ID NO: 1218690 - RNA, 19 nt, Homo sapiens
ccgccaggauccuccagaa

SEQ ID NO: 1218691 - RNA, 19 nt, Homo sapiens
caagagcauggucagagaa

SEQ ID NO: 1218692 - RNA, 19 nt, Homo sapiens
ggacuggaggagcugcaaa

SEQ ID NO: 1218693 - RNA, 19 nt, Homo sapiens
caugaaccagagugugaua

SEQ ID NO: 1218694 - RNA, 19 nt, Homo sapiens
guccagagcccugcugaug

SEQ ID NO: 1218695 - RNA, 19 nt, Homo sapiens
gcagaaccuugaaaacauc

SEQ ID NO: 1218696 - RNA, 19 nt, Homo sapiens
ucaucgaccucuucaucug

SEQ ID NO: 1218697 - RNA, 19 nt, Homo sapiens
uccaguaucuacagcuuca

SEQ ID NO: 1218698 - RNA, 19 nt, Homo sapiens
ggaccuggcagacgaacag

SEQ ID NO: 1218699 - RNA, 19 nt, Homo sapiens
cauacaaacugugcuaucc

SEQ ID NO: 1218700 - RNA, 19 nt, Homo sapiens
cuauaaggccuaccucaag

SEQ ID NO: 1218701 - RNA, 19 nt, Homo sapiens
ggaaaacauugcugacaac

SEQ ID NO: 1218702 - RNA, 19 nt, Homo sapiens
gcuauccucugucaaaauc

SEQ ID NO: 1218703 - RNA, 19 nt, Homo sapiens
aagccuaccugcaguucau

SEQ ID NO: 1218704 - RNA, 19 nt, Homo sapiens
cggcacaucaucuacauag

SEQ ID NO: 1218705 - RNA, 19 nt, Homo sapiens
ccucaucgaccucuucauc

SEQ ID NO: 1218706 - RNA, 19 nt, Homo sapiens
gugcauugucuuccaguau

SEQ ID NO: 1218707 - RNA, 19 nt, Homo sapiens
ccuauaaggccuaccucaa

SEQ ID NO: 1218708 - RNA, 19 nt, Homo sapiens
gagcagucagagugcauga

SEQ ID NO: 1218709 - RNA, 19 nt, Homo sapiens
ggaccuguacuuugagaac

SEQ ID NO: 1218710 - RNA, 19 nt, Homo sapiens
ugugcuauccucugucaaa

SEQ ID NO: 1218711 - RNA, 19 nt, Homo sapiens
ggagcugcaaagccaguuu

SEQ ID NO: 1218712 - RNA, 19 nt, Homo sapiens
gcucuucuucaucaacuau

SEQ ID NO: 1218713 - RNA, 19 nt, Homo sapiens
ugaaccagagugugauaga

SEQ ID NO: 1218714 - RNA, 19 nt, Homo sapiens
aaccgaaaccagauuguau

SEQ ID NO: 1218715 - RNA, 19 nt, Homo sapiens
gaagaggaaucaagaguaa

SEQ ID NO: 1218716 - RNA, 19 nt, Homo sapiens
gaaguuggauauuggcaua

SEQ ID NO: 1218717 - RNA, 19 nt, Homo sapiens
gaaacgccaucucuacuaa

SEQ ID NO: 1218718 - RNA, 19 nt, Homo sapiens
gaacucuucugguguuuga

SEQ ID NO: 1218719 - RNA, 19 nt, Homo sapiens
gcacaaggcugacuguucu

SEQ ID NO: 1218720 - RNA, 19 nt, Homo sapiens
uauaauaucuggccauaga

SEQ ID NO: 1218721 - RNA, 19 nt, Homo sapiens
ggagaaacccaugacauua

SEQ ID NO: 1218722 - RNA, 19 nt, Homo sapiens
guacuugugucuaugaauu

SEQ ID NO: 1218723 - RNA, 19 nt, Homo sapiens
guaggcagcuaucccauuu

SEQ ID NO: 1218724 - RNA, 19 nt, Homo sapiens
gcacaacuuacaucaaaua

SEQ ID NO: 1218725 - RNA, 19 nt, Homo sapiens
gaugauguguuaacaguau

SEQ ID NO: 1218726 - RNA, 19 nt, Homo sapiens
agaaugagcuuugguuauu

SEQ ID NO: 1218727 - RNA, 19 nt, Homo sapiens
gagcuuugguuauuucuau

SEQ ID NO: 1218728 - RNA, 19 nt, Homo sapiens
ccaccucucuuuguaauuu

SEQ ID NO: 1218729 - RNA, 19 nt, Homo sapiens
ggaguguacuugugucuau

SEQ ID NO: 1218730 - RNA, 19 nt, Homo sapiens
ggaagaggaaucaagagua

SEQ ID NO: 1218731 - RNA, 19 nt, Homo sapiens
gaaugagcuuugguuauuu

SEQ ID NO: 1218732 - RNA, 19 nt, Homo sapiens
gcacuagccuugcccucuu

SEQ ID NO: 1218733 - RNA, 19 nt, Homo sapiens
gugcugauaugaagacuug

SEQ ID NO: 1218734 - RNA, 19 nt, Homo sapiens
gaaacugcaucacguccuu

SEQ ID NO: 1218735 - RNA, 19 nt, Homo sapiens
gcaguaaauucuucucuac

SEQ ID NO: 1218736 - RNA, 19 nt, Homo sapiens
caacagcauuagaaaggaa

SEQ ID NO: 1218737 - RNA, 19 nt, Homo sapiens
uagcauguauccuuacuug

SEQ ID NO: 1218738 - RNA, 19 nt, Homo sapiens
ucuucaagcuguuaucaua

SEQ ID NO: 1218739 - RNA, 19 nt, Homo sapiens
aggcacaacuuacaucaaa

SEQ ID NO: 1218740 - RNA, 19 nt, Homo sapiens
ccacauggcuaugggauuc

SEQ ID NO: 1218741 - RNA, 19 nt, Homo sapiens
gauaugaagacuugccuuu

SEQ ID NO: 1218742 - RNA, 19 nt, Homo sapiens
ucucuagcauguauccuua

SEQ ID NO: 1218743 - RNA, 19 nt, Homo sapiens
gaauuuaacaucucuagca

SEQ ID NO: 1218744 - RNA, 19 nt, Homo sapiens
gaccuugacuuaacuaacu

SEQ ID NO: 1218745 - RNA, 19 nt, Homo sapiens
gaugaggaguguacuugug

SEQ ID NO: 1218746 - RNA, 19 nt, Homo sapiens
caaccucaaguaaucuuua

SEQ ID NO: 1218747 - RNA, 19 nt, Homo sapiens
cuuaugagauucugauuca

SEQ ID NO: 1218748 - RNA, 19 nt, Homo sapiens
gcauaaagcaggacucaag

SEQ ID NO: 1218749 - RNA, 19 nt, Homo sapiens
ggccauagagugauaagaa

SEQ ID NO: 1218750 - RNA, 19 nt, Homo sapiens
gauuuaagcuaugcacuag

SEQ ID NO: 1218751 - RNA, 19 nt, Homo sapiens
uaugaagacuugccuuugu

SEQ ID NO: 1218752 - RNA, 19 nt, Homo sapiens
ggagacagaaugagcuuug

SEQ ID NO: 1218753 - RNA, 19 nt, Homo sapiens
gaaaggaaaggagacagaa

SEQ ID NO: 1218754 - RNA, 19 nt, Homo sapiens
acauuagggugcacuguaa

SEQ ID NO: 1218755 - RNA, 19 nt, Homo sapiens
aaucaagaguaaagaggua

SEQ ID NO: 1218756 - RNA, 19 nt, Homo sapiens
gaguauacuuggccuuuua

SEQ ID NO: 1218757 - RNA, 19 nt, Homo sapiens
gagaaacccaugacauuag

SEQ ID NO: 1218758 - RNA, 19 nt, Homo sapiens
guggacggguuucuuugua

SEQ ID NO: 1218759 - RNA, 19 nt, Homo sapiens
caaaggcuggagcgauuua

SEQ ID NO: 1218760 - RNA, 19 nt, Homo sapiens
gaaacacgcaagcauaaag

SEQ ID NO: 1218761 - RNA, 19 nt, Homo sapiens
gcauguauccuuacuugau

SEQ ID NO: 1218762 - RNA, 19 nt, Homo sapiens
uagaagggauuaccaaagg

SEQ ID NO: 1218763 - RNA, 19 nt, Homo sapiens
uaaguacaguagucagcua

SEQ ID NO: 1218764 - RNA, 19 nt, Homo sapiens
uaucauaaguacaguaguc

SEQ ID NO: 1218765 - RNA, 19 nt, Homo sapiens
auacaggcaucuccaaguu

SEQ ID NO: 1218766 - RNA, 19 nt, Homo sapiens
caaccuuaaucagcaguaa

SEQ ID NO: 1218767 - RNA, 19 nt, Homo sapiens
uuacagagcuugugaaaag

SEQ ID NO: 1218768 - RNA, 19 nt, Homo sapiens
aauauuaccaccucucuuu

SEQ ID NO: 1218769 - RNA, 19 nt, Homo sapiens
ggacggguuucuuuguauc

SEQ ID NO: 1218770 - RNA, 19 nt, Homo sapiens
ggaggcagagggugcagua

SEQ ID NO: 1218771 - RNA, 19 nt, Homo sapiens
cacugguucucaaacauua

SEQ ID NO: 1218772 - RNA, 19 nt, Homo sapiens
ucacuuaugaguauacuug

SEQ ID NO: 1218773 - RNA, 19 nt, Homo sapiens
agaaacccaugacauuaga

SEQ ID NO: 1218774 - RNA, 19 nt, Homo sapiens
ccaacacauugucagauug

SEQ ID NO: 1218775 - RNA, 19 nt, Homo sapiens
gcuaugggauucgcuuguu

SEQ ID NO: 1218776 - RNA, 19 nt, Homo sapiens
ccaggaggcugaggcaaga

SEQ ID NO: 1218777 - RNA, 19 nt, Homo sapiens
aagcaggacucaagcacaa

SEQ ID NO: 1218778 - RNA, 19 nt, Homo sapiens
ucaccucgcuguucucuac

SEQ ID NO: 1218779 - RNA, 19 nt, Homo sapiens
ccuuacagcugcacccaaa

SEQ ID NO: 1218780 - RNA, 19 nt, Homo sapiens
cgagguggguggaucacaa

SEQ ID NO: 1218781 - RNA, 19 nt, Homo sapiens
guuccuaucaacagcauua

SEQ ID NO: 1218782 - RNA, 19 nt, Homo sapiens
gagguuaacaccagauugu

SEQ ID NO: 1218783 - RNA, 19 nt, Homo sapiens
gcauauugguuguugaaaa

SEQ ID NO: 1218784 - RNA, 19 nt, Homo sapiens
aaaccuagaaguuggauau

SEQ ID NO: 1218785 - RNA, 19 nt, Homo sapiens
gcugaucugugccacugaa

SEQ ID NO: 1218786 - RNA, 19 nt, Homo sapiens
ugaaacgccaucucuacua

SEQ ID NO: 1218787 - RNA, 19 nt, Homo sapiens
ugacuguucuacuuugaau

SEQ ID NO: 1218788 - RNA, 19 nt, Homo sapiens
gaauaaaaccuagaaguug

SEQ ID NO: 1218789 - RNA, 19 nt, Homo sapiens
aaaguucucuccaacacau

SEQ ID NO: 1218790 - RNA, 19 nt, Homo sapiens
acaacaaaguucucuccaa

SEQ ID NO: 1218791 - RNA, 19 nt, Homo sapiens
gcaguaagccgagauugca

SEQ ID NO: 1218792 - RNA, 19 nt, Homo sapiens
gaucacaaggucaggaguu

SEQ ID NO: 1218793 - RNA, 19 nt, Homo sapiens
ucucuguacucucauaaug

SEQ ID NO: 1218794 - RNA, 19 nt, Homo sapiens
gacaaacagugcagugaac

SEQ ID NO: 1218795 - RNA, 19 nt, Homo sapiens
gcugacuguucuacuuuga

SEQ ID NO: 1218796 - RNA, 19 nt, Homo sapiens
aguauaauaucuggccaua

SEQ ID NO: 1218797 - RNA, 19 nt, Homo sapiens
ccuagaaguuggauauugg

SEQ ID NO: 1218798 - RNA, 19 nt, Homo sapiens
gaagaucuuauaaguuugg

SEQ ID NO: 1218799 - RNA, 19 nt, Homo sapiens
uccaacacauugucagauu

SEQ ID NO: 1218800 - RNA, 19 nt, Homo sapiens
aaucagcaguaaauucuuc

SEQ ID NO: 1218801 - RNA, 19 nt, Homo sapiens
auagcaaccucaaguaauc

SEQ ID NO: 1218802 - RNA, 19 nt, Homo sapiens
ucauagcaaccucaaguaa

SEQ ID NO: 1218803 - RNA, 19 nt, Homo sapiens
accaaaggcuggagcgauu

SEQ ID NO: 1218804 - RNA, 19 nt, Homo sapiens
guguuugacuuaggaauug

SEQ ID NO: 1218805 - RNA, 19 nt, Homo sapiens
aaggaacucuucugguguu

SEQ ID NO: 1218806 - RNA, 19 nt, Homo sapiens
ggugauccguucucuguac

SEQ ID NO: 1218807 - RNA, 19 nt, Homo sapiens
aaauagucuugaagucgua

SEQ ID NO: 1218808 - RNA, 19 nt, Homo sapiens
caagcaacagugaugauga

SEQ ID NO: 1218809 - RNA, 19 nt, Homo sapiens
cgauuuaagcuaugcacua

SEQ ID NO: 1218810 - RNA, 19 nt, Homo sapiens
gguagggguuuacucauuu

SEQ ID NO: 1218811 - RNA, 19 nt, Homo sapiens
ggacauuuggcaggaguuu

SEQ ID NO: 1218812 - RNA, 19 nt, Homo sapiens
gagaccagccugaccaaca

SEQ ID NO: 1218813 - RNA, 19 nt, Homo sapiens
cacuagccuugcccucuua

SEQ ID NO: 1218814 - RNA, 19 nt, Homo sapiens
caugggugguacuguguuu

SEQ ID NO: 1218815 - RNA, 19 nt, Homo sapiens
ucagguaucuugcuuguuu

SEQ ID NO: 1218816 - RNA, 19 nt, Homo sapiens
ggaaauggcacucuucuug

SEQ ID NO: 1218817 - RNA, 19 nt, Homo sapiens
cuaaaucucucaacacuug

SEQ ID NO: 1218818 - RNA, 19 nt, Homo sapiens
gugcugauaucacguuuaa

SEQ ID NO: 1218819 - RNA, 19 nt, Homo sapiens
gaagcuaaaucucucaaca

SEQ ID NO: 1218820 - RNA, 19 nt, Homo sapiens
gggaugacauucacuacaa

SEQ ID NO: 1218821 - RNA, 19 nt, Homo sapiens
gcacaccacugagguacaa

SEQ ID NO: 1218822 - RNA, 19 nt, Homo sapiens
gauaucacguuuaaucaca

SEQ ID NO: 1218823 - RNA, 19 nt, Homo sapiens
ccaagcagauucaaagaag

SEQ ID NO: 1218824 - RNA, 19 nt, Homo sapiens
agguacaacugcauucuua

SEQ ID NO: 1218825 - RNA, 19 nt, Homo sapiens
aaacucgccugugcugaua

SEQ ID NO: 1218826 - RNA, 19 nt, Homo sapiens
ggacugucauucauucaca

SEQ ID NO: 1218827 - RNA, 19 nt, Homo sapiens
acuugugucucccauauua

SEQ ID NO: 1218828 - RNA, 19 nt, Homo sapiens
gaaauggcacucuucuugu

SEQ ID NO: 1218829 - RNA, 19 nt, Homo sapiens
uauuagcuguguccuagua

SEQ ID NO: 1218830 - RNA, 19 nt, Homo sapiens
gcucagaggcaguucacua

SEQ ID NO: 1218831 - RNA, 19 nt, Homo sapiens
cagauucaaagaagcauua

SEQ ID NO: 1218832 - RNA, 19 nt, Homo sapiens
gcugauaucacguuuaauc

SEQ ID NO: 1218833 - RNA, 19 nt, Homo sapiens
ccauaauucuuucacucua

SEQ ID NO: 1218834 - RNA, 19 nt, Homo sapiens
caacugcauucuuaccaau

SEQ ID NO: 1218835 - RNA, 19 nt, Homo sapiens
gcaguucacuaccggaucu

SEQ ID NO: 1218836 - RNA, 19 nt, Homo sapiens
aagcauuauucgccuauuu

SEQ ID NO: 1218837 - RNA, 19 nt, Homo sapiens
ucgugaauccuaucauuua

SEQ ID NO: 1218838 - RNA, 19 nt, Homo sapiens
ggaugacauucacuacaau

SEQ ID NO: 1218839 - RNA, 19 nt, Homo sapiens
gacaagaggaagcuaaauc

SEQ ID NO: 1218840 - RNA, 19 nt, Homo sapiens
agaaucagguaucuugcuu

SEQ ID NO: 1218841 - RNA, 19 nt, Homo sapiens
gaagcauuauucgccuauu

SEQ ID NO: 1218842 - RNA, 19 nt, Homo sapiens
ucacuacaaugcccacagu

SEQ ID NO: 1218843 - RNA, 19 nt, Homo sapiens
ggaucucuauguccuucuu

SEQ ID NO: 1218844 - RNA, 19 nt, Homo sapiens
cgugaauccuaucauuuau

SEQ ID NO: 1218845 - RNA, 19 nt, Homo sapiens
guccuaguauuucacauca

SEQ ID NO: 1218846 - RNA, 19 nt, Homo sapiens
aaucagguaucuugcuugu

SEQ ID NO: 1218847 - RNA, 19 nt, Homo sapiens
uguagaaucagguaucuug

SEQ ID NO: 1218848 - RNA, 19 nt, Homo sapiens
gucauucauucacagguuu

SEQ ID NO: 1218849 - RNA, 19 nt, Homo sapiens
gaugggacugucauucauu

SEQ ID NO: 1218850 - RNA, 19 nt, Homo sapiens
gcacucuucuuguccucau

SEQ ID NO: 1218851 - RNA, 19 nt, Homo sapiens
gcuguguccuaguauuuca

SEQ ID NO: 1218852 - RNA, 19 nt, Homo sapiens
ucuauguccuucuuuguca

SEQ ID NO: 1218853 - RNA, 19 nt, Homo sapiens
caugagcuauguccauuuu

SEQ ID NO: 1218854 - RNA, 19 nt, Homo sapiens
acccaauccuucauucauu

SEQ ID NO: 1218855 - RNA, 19 nt, Homo sapiens
gcaucaagaccaagcagau

SEQ ID NO: 1218856 - RNA, 19 nt, Homo sapiens
ugucauucauucacagguu

SEQ ID NO: 1218857 - RNA, 19 nt, Homo sapiens
uagcuguguccuaguauuu

SEQ ID NO: 1218858 - RNA, 19 nt, Homo sapiens
ggacaagaggaagcuaaau

SEQ ID NO: 1218859 - RNA, 19 nt, Homo sapiens
acaacugcauucuuaccaa

SEQ ID NO: 1218860 - RNA, 19 nt, Homo sapiens
aaauggcacucuucuuguc

SEQ ID NO: 1218861 - RNA, 19 nt, Homo sapiens
gaccaagcagauucaaaga

SEQ ID NO: 1218862 - RNA, 19 nt, Homo sapiens
cauaauucuuucacucuac

SEQ ID NO: 1218863 - RNA, 19 nt, Homo sapiens
gagguuuuauguccauuuu

SEQ ID NO: 1218864 - RNA, 19 nt, Homo sapiens
caucaagaccaagcagauu

SEQ ID NO: 1218865 - RNA, 19 nt, Homo sapiens
gcucuaaucaucaucuuuu

SEQ ID NO: 1218866 - RNA, 19 nt, Homo sapiens
ccauuaccaugagcuaugu

SEQ ID NO: 1218867 - RNA, 19 nt, Homo sapiens
gugaugggacugucauuca

SEQ ID NO: 1218868 - RNA, 19 nt, Homo sapiens
gggcauugcgucuggacaa

SEQ ID NO: 1218869 - RNA, 19 nt, Homo sapiens
ccaauucccgagugaugaa

SEQ ID NO: 1218870 - RNA, 19 nt, Homo sapiens
cccaauccuucauucauuc

SEQ ID NO: 1218871 - RNA, 19 nt, Homo sapiens
gaccuugggaugacauuca

SEQ ID NO: 1218872 - RNA, 19 nt, Homo sapiens
ccaauuauucagacuucuu

SEQ ID NO: 1218873 - RNA, 19 nt, Homo sapiens
gagguacaacugcauucuu

SEQ ID NO: 1218874 - RNA, 19 nt, Homo sapiens
agaccaagcagauucaaag

SEQ ID NO: 1218875 - RNA, 19 nt, Homo sapiens
gcagauucaaagaagcauu

SEQ ID NO: 1218876 - RNA, 19 nt, Homo sapiens
ugaugggacugucauucau

SEQ ID NO: 1218877 - RNA, 19 nt, Homo sapiens
guacugaugagagguuuua

SEQ ID NO: 1218878 - RNA, 19 nt, Homo sapiens
ccuaguauuucacaucacu

SEQ ID NO: 1218879 - RNA, 19 nt, Homo sapiens
uuagcuguguccuaguauu

SEQ ID NO: 1218880 - RNA, 19 nt, Homo sapiens
cuacugcuacccauauugu

SEQ ID NO: 1218881 - RNA, 19 nt, Homo sapiens
accaugagcuauguccauu

SEQ ID NO: 1218882 - RNA, 19 nt, Homo sapiens
acaagaggaagcuaaaucu

SEQ ID NO: 1218883 - RNA, 19 nt, Homo sapiens
cuugcugacuggcuucuug

SEQ ID NO: 1218884 - RNA, 19 nt, Homo sapiens
gccauccgcacaccacuga

SEQ ID NO: 1218885 - RNA, 19 nt, Homo sapiens
uuuauagcaucaagaccaa

SEQ ID NO: 1218886 - RNA, 19 nt, Homo sapiens
gcacacauuuugccuccau

SEQ ID NO: 1218887 - RNA, 19 nt, Homo sapiens
ggguacugaugagagguuu

SEQ ID NO: 1218888 - RNA, 19 nt, Homo sapiens
ucaagaccaagcagauuca

SEQ ID NO: 1218889 - RNA, 19 nt, Homo sapiens
ccauauuagcuguguccua

SEQ ID NO: 1218890 - RNA, 19 nt, Homo sapiens
uguacuacuuccuggcuau

SEQ ID NO: 1218891 - RNA, 19 nt, Homo sapiens
gaucucuauguccuucuuu

SEQ ID NO: 1218892 - RNA, 19 nt, Homo sapiens
gacacggaccuugggauga

SEQ ID NO: 1218893 - RNA, 19 nt, Homo sapiens
gcuaaaucucucaacacuu

SEQ ID NO: 1218894 - RNA, 19 nt, Homo sapiens
acacggaccuugggaugac

SEQ ID NO: 1218895 - RNA, 19 nt, Homo sapiens
gccauuguagaaucaggua

SEQ ID NO: 1218896 - RNA, 19 nt, Homo sapiens
uucauucacuggccauugu

SEQ ID NO: 1218897 - RNA, 19 nt, Homo sapiens
gcaaauacaauauggcauu

SEQ ID NO: 1218898 - RNA, 19 nt, Homo sapiens
guacaucuacuuccucuuu

SEQ ID NO: 1218899 - RNA, 19 nt, Homo sapiens
caauagacuuuacccugua

SEQ ID NO: 1218900 - RNA, 19 nt, Homo sapiens
gcaauggcaugcuccucua

SEQ ID NO: 1218901 - RNA, 19 nt, Homo sapiens
ggagugggaguguuucuaa

SEQ ID NO: 1218902 - RNA, 19 nt, Homo sapiens
ccuacaggcuuacuuuauu

SEQ ID NO: 1218903 - RNA, 19 nt, Homo sapiens
caccaauacuagagucaua

SEQ ID NO: 1218904 - RNA, 19 nt, Homo sapiens
gcugacauaacuuucaaua

SEQ ID NO: 1218905 - RNA, 19 nt, Homo sapiens
uugcaaaucucauguuauc

SEQ ID NO: 1218906 - RNA, 19 nt, Homo sapiens
gcaauggcauaugaucguu

SEQ ID NO: 1218907 - RNA, 19 nt, Homo sapiens
ccaagcaaauacaauaugg

SEQ ID NO: 1218908 - RNA, 19 nt, Homo sapiens
ggugauggguuugacauuc

SEQ ID NO: 1218909 - RNA, 19 nt, Homo sapiens
ccucuuuccuccuuuaaug

SEQ ID NO: 1218910 - RNA, 19 nt, Homo sapiens
gccagagguuguccacauu

SEQ ID NO: 1218911 - RNA, 19 nt, Homo sapiens
cuacaggcuuacuuuauuc

SEQ ID NO: 1218912 - RNA, 19 nt, Homo sapiens
gguuugacauucauuuaca

SEQ ID NO: 1218913 - RNA, 19 nt, Homo sapiens
guuguguucuuaucuucua

SEQ ID NO: 1218914 - RNA, 19 nt, Homo sapiens
accuguaucucccacauua

SEQ ID NO: 1218915 - RNA, 19 nt, Homo sapiens
ccagagguuguccacauua

SEQ ID NO: 1218916 - RNA, 19 nt, Homo sapiens
gacauaacuuucaauagac

SEQ ID NO: 1218917 - RNA, 19 nt, Homo sapiens
gagauaugcuuccauuuuc

SEQ ID NO: 1218918 - RNA, 19 nt, Homo sapiens
caucaagcaugaccacagu

SEQ ID NO: 1218919 - RNA, 19 nt, Homo sapiens
gagguuguccacauuauca

SEQ ID NO: 1218920 - RNA, 19 nt, Homo sapiens
gugauggguuugacauuca

SEQ ID NO: 1218921 - RNA, 19 nt, Homo sapiens
caaaucucauguuaucaca

SEQ ID NO: 1218922 - RNA, 19 nt, Homo sapiens
cacgaugccuacuguaaug

SEQ ID NO: 1218923 - RNA, 19 nt, Homo sapiens
ugaccacgaugccuacugu

SEQ ID NO: 1218924 - RNA, 19 nt, Homo sapiens
gaucauccucuucuccuau

SEQ ID NO: 1218925 - RNA, 19 nt, Homo sapiens
gugcugacauaacuuucaa

SEQ ID NO: 1218926 - RNA, 19 nt, Homo sapiens
gaagaaugugccagagguu

SEQ ID NO: 1218927 - RNA, 19 nt, Homo sapiens
cagagguuguccacauuau

SEQ ID NO: 1218928 - RNA, 19 nt, Homo sapiens
ccucuucuccuauauucua

SEQ ID NO: 1218929 - RNA, 19 nt, Homo sapiens
uuaacaaucuuccuagacu

SEQ ID NO: 1218930 - RNA, 19 nt, Homo sapiens
uuugagauaugcuuccauu

SEQ ID NO: 1218931 - RNA, 19 nt, Homo sapiens
gcugcuuccuacaggcuua

SEQ ID NO: 1218932 - RNA, 19 nt, Homo sapiens
uuacagauuugggaagaau

SEQ ID NO: 1218933 - RNA, 19 nt, Homo sapiens
guauccauccugccuguaa

SEQ ID NO: 1218934 - RNA, 19 nt, Homo sapiens
guuaggagugggaguguuu

SEQ ID NO: 1218935 - RNA, 19 nt, Homo sapiens
gcaaaucucauguuaucac

SEQ ID NO: 1218936 - RNA, 19 nt, Homo sapiens
ccgcaauccuuugagauau

SEQ ID NO: 1218937 - RNA, 19 nt, Homo sapiens
cauccgcaauccuuugaga

SEQ ID NO: 1218938 - RNA, 19 nt, Homo sapiens
acagggagauuagcagugu

SEQ ID NO: 1218939 - RNA, 19 nt, Homo sapiens
gagccaaagcccucaauac

SEQ ID NO: 1218940 - RNA, 19 nt, Homo sapiens
caucaaaaccaagcaaaua

SEQ ID NO: 1218941 - RNA, 19 nt, Homo sapiens
cuucuuugcuguuuaugug

SEQ ID NO: 1218942 - RNA, 19 nt, Homo sapiens
ccacgaugccuacuguaau

SEQ ID NO: 1218943 - RNA, 19 nt, Homo sapiens
acauagguuuaguagguaa

SEQ ID NO: 1218944 - RNA, 19 nt, Homo sapiens
ccaccaagaaaucaugaga

SEQ ID NO: 1218945 - RNA, 19 nt, Homo sapiens
ugagauaugcuuccauuuu

SEQ ID NO: 1218946 - RNA, 19 nt, Homo sapiens
gcaauccuuugagauaugc

SEQ ID NO: 1218947 - RNA, 19 nt, Homo sapiens
gaccucauggugacauuga

SEQ ID NO: 1218948 - RNA, 19 nt, Homo sapiens
aacauagguuuaguaggua

SEQ ID NO: 1218949 - RNA, 19 nt, Homo sapiens
cgcaauccuuugagauaug

SEQ ID NO: 1218950 - RNA, 19 nt, Homo sapiens
cuuccucuuuccuccuuua

SEQ ID NO: 1218951 - RNA, 19 nt, Homo sapiens
ugccagagguuguccacau

SEQ ID NO: 1218952 - RNA, 19 nt, Homo sapiens
ccuagacucucugaucauc

SEQ ID NO: 1218953 - RNA, 19 nt, Homo sapiens
cacauuaucaugaguacau

SEQ ID NO: 1218954 - RNA, 19 nt, Homo sapiens
ugaucauccucuucuccua

SEQ ID NO: 1218955 - RNA, 19 nt, Homo sapiens
cauguuaucacacgugcuu

SEQ ID NO: 1218956 - RNA, 19 nt, Homo sapiens
cauccugccuguaauuuug

SEQ ID NO: 1218957 - RNA, 19 nt, Homo sapiens
gagugggaguguuucuaag

SEQ ID NO: 1218958 - RNA, 19 nt, Homo sapiens
cauuaguuguguucuuauc

SEQ ID NO: 1218959 - RNA, 19 nt, Homo sapiens
guaucucccacauuaguug

SEQ ID NO: 1218960 - RNA, 19 nt, Homo sapiens
uccgcaauccuuugagaua

SEQ ID NO: 1218961 - RNA, 19 nt, Homo sapiens
uacuagagucauagcguua

SEQ ID NO: 1218962 - RNA, 19 nt, Homo sapiens
aauggcauaugaucguuuc

SEQ ID NO: 1218963 - RNA, 19 nt, Homo sapiens
ugucaucuacagcaucaaa

SEQ ID NO: 1218964 - RNA, 19 nt, Homo sapiens
uggguuugacauucauuua

SEQ ID NO: 1218965 - RNA, 19 nt, Homo sapiens
aagcaugaccacagucuuc

SEQ ID NO: 1218966 - RNA, 19 nt, Homo sapiens
uuccuagacucucugauca

SEQ ID NO: 1218967 - RNA, 19 nt, Homo sapiens
ucacucccuuucuguugug

SEQ ID NO: 1218968 - RNA, 19 nt, Homo sapiens
uuuauucacucccuuucug

SEQ ID NO: 1218969 - RNA, 19 nt, Homo sapiens
ugaccacagucuucaugag

SEQ ID NO: 1218970 - RNA, 19 nt, Homo sapiens
caauggcauaugaucguuu

SEQ ID NO: 1218971 - RNA, 19 nt, Homo sapiens
guuguccacauuaucauga

SEQ ID NO: 1218972 - RNA, 19 nt, Homo sapiens
aucauccucuucuccuaua

SEQ ID NO: 1218973 - RNA, 19 nt, Homo sapiens
ggcauuauccgccuuuuau

SEQ ID NO: 1218974 - RNA, 19 nt, Homo sapiens
cagaccucauggugacauu

SEQ ID NO: 1218975 - RNA, 19 nt, Homo sapiens
guccacauuaucaugagua

SEQ ID NO: 1218976 - RNA, 19 nt, Homo sapiens
cuuuaacaaucuuccuaga

SEQ ID NO: 1218977 - RNA, 19 nt, Homo sapiens
ggcuugugcugacauaacu

SEQ ID NO: 1218978 - RNA, 19 nt, Homo sapiens
accaagaaaucaugagacu

SEQ ID NO: 1218979 - RNA, 19 nt, Homo sapiens
ccuguaauuuugcgucuuu

SEQ ID NO: 1218980 - RNA, 19 nt, Homo sapiens
uauccauccugccuguaau

SEQ ID NO: 1218981 - RNA, 19 nt, Homo sapiens
ggucaucggcuccaaauuu

SEQ ID NO: 1218982 - RNA, 19 nt, Homo sapiens
gagcagcgcuuuccuugca

SEQ ID NO: 1218983 - RNA, 19 nt, Homo sapiens
agagagugcuccugaauga

SEQ ID NO: 1218984 - RNA, 19 nt, Homo sapiens
gcgcuuuccuugcagaauu

SEQ ID NO: 1218985 - RNA, 19 nt, Homo sapiens
gcuccaaauuugaccagua

SEQ ID NO: 1218986 - RNA, 19 nt, Homo sapiens
cagcaccgauggaggauga

SEQ ID NO: 1218987 - RNA, 19 nt, Homo sapiens
gcccugagcucgaacaucu

SEQ ID NO: 1218988 - RNA, 19 nt, Homo sapiens
gggaggauguggccagaga

SEQ ID NO: 1218989 - RNA, 19 nt, Homo sapiens
guaccuggcuugcauucug

SEQ ID NO: 1218990 - RNA, 19 nt, Homo sapiens
gcaguaaugggaugacuau

SEQ ID NO: 1218991 - RNA, 19 nt, Homo sapiens
ggccgacguugcccacaua

SEQ ID NO: 1218992 - RNA, 19 nt, Homo sapiens
gucaucggcuccaaauuug

SEQ ID NO: 1218993 - RNA, 19 nt, Homo sapiens
gaccgugccuccuuugaag

SEQ ID NO: 1218994 - RNA, 19 nt, Homo sapiens
ccaaggcccugagcucgaa

SEQ ID NO: 1218995 - RNA, 19 nt, Homo sapiens
cagcagccgugucgucaug

SEQ ID NO: 1218996 - RNA, 19 nt, Homo sapiens
gagagucagagggcaguua

SEQ ID NO: 1218997 - RNA, 19 nt, Homo sapiens
acccucaggucucgacaua

SEQ ID NO: 1218998 - RNA, 19 nt, Homo sapiens
guucggugguugucccaaa

SEQ ID NO: 1218999 - RNA, 19 nt, Homo sapiens
gcagccgugucgucauguu

SEQ ID NO: 1219000 - RNA, 19 nt, Homo sapiens
gugacaccaucuguuguaa

SEQ ID NO: 1219001 - RNA, 19 nt, Homo sapiens
ccucaggucucgacauagg

SEQ ID NO: 1219002 - RNA, 19 nt, Homo sapiens
caaauuugaccaguacaug

SEQ ID NO: 1219003 - RNA, 19 nt, Homo sapiens
cagggagcauugcgaagga

SEQ ID NO: 1219004 - RNA, 19 nt, Homo sapiens
ccagagagugcuccugaau

SEQ ID NO: 1219005 - RNA, 19 nt, Homo sapiens
ucacugaccgugccuccuu

SEQ ID NO: 1219006 - RNA, 19 nt, Homo sapiens
gcugagggacugcacuuuc

SEQ ID NO: 1219007 - RNA, 19 nt, Homo sapiens
ccauugacacugccagcua

SEQ ID NO: 1219008 - RNA, 19 nt, Homo sapiens
acacagaugccuuccucuu

SEQ ID NO: 1219009 - RNA, 19 nt, Homo sapiens
aggaguaccuggcuugcau

SEQ ID NO: 1219010 - RNA, 19 nt, Homo sapiens
cgacguugcccacauacuc

SEQ ID NO: 1219011 - RNA, 19 nt, Homo sapiens
ugaccgugccuccuuugaa

SEQ ID NO: 1219012 - RNA, 19 nt, Homo sapiens
agagucagagggcaguuaa

SEQ ID NO: 1219013 - RNA, 19 nt, Homo sapiens
cagagagugcuccugaaug

SEQ ID NO: 1219014 - RNA, 19 nt, Homo sapiens
gagcauugcgaaggagaga

SEQ ID NO: 1219015 - RNA, 19 nt, Homo sapiens
ggaguaccuggcuugcauu

SEQ ID NO: 1219016 - RNA, 19 nt, Homo sapiens
gcaguuaagagggaucaca

SEQ ID NO: 1219017 - RNA, 19 nt, Homo sapiens
cacagaugccuuccucuuc

SEQ ID NO: 1219018 - RNA, 19 nt, Homo sapiens
cugagggacugcacuuucu

SEQ ID NO: 1219019 - RNA, 19 nt, Homo sapiens
gacacugccagcuacaaga

SEQ ID NO: 1219020 - RNA, 19 nt, Homo sapiens
uuacuucaaucaagaaccu

SEQ ID NO: 1219021 - RNA, 19 nt, Homo sapiens
ggcaguaaugggaugacua

SEQ ID NO: 1219022 - RNA, 19 nt, Homo sapiens
gacguugcccacauacuca

SEQ ID NO: 1219023 - RNA, 19 nt, Homo sapiens
ggaccucaguggccuauua

SEQ ID NO: 1219024 - RNA, 19 nt, Homo sapiens
ggacacaccuucccugaga

SEQ ID NO: 1219025 - RNA, 19 nt, Homo sapiens
gaaagaccauuuauuugug

SEQ ID NO: 1219026 - RNA, 19 nt, Homo sapiens
ggugaaagaccauuuauuu

SEQ ID NO: 1219027 - RNA, 19 nt, Homo sapiens
gaaccucccugcuaauaau

SEQ ID NO: 1219028 - RNA, 19 nt, Homo sapiens
ggaaugaguucgggcuaua

SEQ ID NO: 1219029 - RNA, 19 nt, Homo sapiens
gcuuugaccuccaauagua

SEQ ID NO: 1219030 - RNA, 19 nt, Homo sapiens
gaaggaaacaugacgauga

SEQ ID NO: 1219031 - RNA, 19 nt, Homo sapiens
cgaggaagcaguaugauaa

SEQ ID NO: 1219032 - RNA, 19 nt, Homo sapiens
gcaggagccucacagucua

SEQ ID NO: 1219033 - RNA, 19 nt, Homo sapiens
gcacuggcaacuucuauuu

SEQ ID NO: 1219034 - RNA, 19 nt, Homo sapiens
gaaauaggguagagaacag

SEQ ID NO: 1219035 - RNA, 19 nt, Homo sapiens
gaccuccaauaguaacuua

SEQ ID NO: 1219036 - RNA, 19 nt, Homo sapiens
gcaacaguuuauaaaguga

SEQ ID NO: 1219037 - RNA, 19 nt, Homo sapiens
aaagugauguucugaauac

SEQ ID NO: 1219038 - RNA, 19 nt, Homo sapiens
ggauauuaguguuuaagug

SEQ ID NO: 1219039 - RNA, 19 nt, Homo sapiens
ggcaacaguuuauaaagug

SEQ ID NO: 1219040 - RNA, 19 nt, Homo sapiens
uaacuuagcagcacauauc

SEQ ID NO: 1219041 - RNA, 19 nt, Homo sapiens
gaagcuccgaguucucuua

SEQ ID NO: 1219042 - RNA, 19 nt, Homo sapiens
ggaugugggugcuccgaaa

SEQ ID NO: 1219043 - RNA, 19 nt, Homo sapiens
gacgaugaccggagguuua

SEQ ID NO: 1219044 - RNA, 19 nt, Homo sapiens
guaauuuggcaacaguuua

SEQ ID NO: 1219045 - RNA, 19 nt, Homo sapiens
gaacugcuggcuccaauca

SEQ ID NO: 1219046 - RNA, 19 nt, Homo sapiens
gaaaagccguugcccaguu

SEQ ID NO: 1219047 - RNA, 19 nt, Homo sapiens
guagcagucuguacauuca

SEQ ID NO: 1219048 - RNA, 19 nt, Homo sapiens
guacauucacucuaagaaa

SEQ ID NO: 1219049 - RNA, 19 nt, Homo sapiens
ggaaauaggguagagaaca

SEQ ID NO: 1219050 - RNA, 19 nt, Homo sapiens
uguagcacuuguugcauua

SEQ ID NO: 1219051 - RNA, 19 nt, Homo sapiens
ggaaccucccugcuaauaa

SEQ ID NO: 1219052 - RNA, 19 nt, Homo sapiens
guguuuaagugguaauuug

SEQ ID NO: 1219053 - RNA, 19 nt, Homo sapiens
gcuauacucuuugaaacug

SEQ ID NO: 1219054 - RNA, 19 nt, Homo sapiens
ggaucuugcugcacucuuc

SEQ ID NO: 1219055 - RNA, 19 nt, Homo sapiens
ucucuuaccucagcuagaa

SEQ ID NO: 1219056 - RNA, 19 nt, Homo sapiens
agaaacacgugcaggaugu

SEQ ID NO: 1219057 - RNA, 19 nt, Homo sapiens
cuagucagaugcagcuuga

SEQ ID NO: 1219058 - RNA, 19 nt, Homo sapiens
gugaaagaccauuuauuug

SEQ ID NO: 1219059 - RNA, 19 nt, Homo sapiens
guguagcacuuguugcauu

SEQ ID NO: 1219060 - RNA, 19 nt, Homo sapiens
gaggaagcaguaugauaaa

SEQ ID NO: 1219061 - RNA, 19 nt, Homo sapiens
ggacagcccucugguucuc

SEQ ID NO: 1219062 - RNA, 19 nt, Homo sapiens
uggcaacaguuuauaaagu

SEQ ID NO: 1219063 - RNA, 19 nt, Homo sapiens
ccggaauccugacuauuga

SEQ ID NO: 1219064 - RNA, 19 nt, Homo sapiens
gucuguacauucacucuaa

SEQ ID NO: 1219065 - RNA, 19 nt, Homo sapiens
aaagacuucugcaggaaau

SEQ ID NO: 1219066 - RNA, 19 nt, Homo sapiens
uuaccgagccauucaacua

SEQ ID NO: 1219067 - RNA, 19 nt, Homo sapiens
cagcauguccaaacuucua

SEQ ID NO: 1219068 - RNA, 19 nt, Homo sapiens
ucugaaaggccacagcaua

SEQ ID NO: 1219069 - RNA, 19 nt, Homo sapiens
gguaauuuggcaacaguuu

SEQ ID NO: 1219070 - RNA, 19 nt, Homo sapiens
ggggagaccucauuugguu

SEQ ID NO: 1219071 - RNA, 19 nt, Homo sapiens
uaacccaccuaggcacaaa

SEQ ID NO: 1219072 - RNA, 19 nt, Homo sapiens
gcagucgggcagcuaguuu

SEQ ID NO: 1219073 - RNA, 19 nt, Homo sapiens
ccauucaacuagccaagga

SEQ ID NO: 1219074 - RNA, 19 nt, Homo sapiens
ccaugaagaacuugaguga

SEQ ID NO: 1219075 - RNA, 19 nt, Homo sapiens
guucgaguguccuguggaa

SEQ ID NO: 1219076 - RNA, 19 nt, Homo sapiens
cugaaaggccacagcauaa

SEQ ID NO: 1219077 - RNA, 19 nt, Homo sapiens
aaacugccuuugugagcaa

SEQ ID NO: 1219078 - RNA, 19 nt, Homo sapiens
ccagaacaguugguugugu

SEQ ID NO: 1219079 - RNA, 19 nt, Homo sapiens
ugacacaccugccaaugcu

SEQ ID NO: 1219080 - RNA, 19 nt, Homo sapiens
uugcugcacucuucucuga

SEQ ID NO: 1219081 - RNA, 19 nt, Homo sapiens
gauguucugaauaccauaa

SEQ ID NO: 1219082 - RNA, 19 nt, Homo sapiens
gggcuauacucuuugaaac

SEQ ID NO: 1219083 - RNA, 19 nt, Homo sapiens
ggagaccucauuugguuuc

SEQ ID NO: 1219084 - RNA, 19 nt, Homo sapiens
ggcaacuucuauuuggaaa

SEQ ID NO: 1219085 - RNA, 19 nt, Homo sapiens
cuauugacgucacuucugu

SEQ ID NO: 1219086 - RNA, 19 nt, Homo sapiens
gcucguagcagucuguaca

SEQ ID NO: 1219087 - RNA, 19 nt, Homo sapiens
ccucuucccagacuaaauu

SEQ ID NO: 1219088 - RNA, 19 nt, Homo sapiens
acaggugaaagaccauuua

SEQ ID NO: 1219089 - RNA, 19 nt, Homo sapiens
ugugagugcaggagcauua

SEQ ID NO: 1219090 - RNA, 19 nt, Homo sapiens
uggaugacgugcagacugu

SEQ ID NO: 1219091 - RNA, 19 nt, Homo sapiens
gcucugaacuccggaaucc

SEQ ID NO: 1219092 - RNA, 19 nt, Homo sapiens
gcugcacucuucucugaca

SEQ ID NO: 1219093 - RNA, 19 nt, Homo sapiens
ucuuucagcuucagugugu

SEQ ID NO: 1219094 - RNA, 19 nt, Homo sapiens
caggaaauaggguagagaa

SEQ ID NO: 1219095 - RNA, 19 nt, Homo sapiens
cgagggcugugggaaauca

SEQ ID NO: 1219096 - RNA, 19 nt, Homo sapiens
ggacagcagccacgguucu

SEQ ID NO: 1219097 - RNA, 19 nt, Homo sapiens
uacauucacucuaagaaac

SEQ ID NO: 1219098 - RNA, 19 nt, Homo sapiens
gcggagccauacaggugaa

SEQ ID NO: 1219099 - RNA, 19 nt, Homo sapiens
gugauguucugaauaccau

SEQ ID NO: 1219100 - RNA, 19 nt, Homo sapiens
gccaaauucuagcccaagu

SEQ ID NO: 1219101 - RNA, 19 nt, Homo sapiens
gagccucacagucuacuca

SEQ ID NO: 1219102 - RNA, 19 nt, Homo sapiens
gagccauacaggugaaaga

SEQ ID NO: 1219103 - RNA, 19 nt, Homo sapiens
ggaagcaguaugauaaagc

SEQ ID NO: 1219104 - RNA, 19 nt, Homo sapiens
ccaaggccacggucuagga

SEQ ID NO: 1219105 - RNA, 19 nt, Homo sapiens
caugcaagccagaacaguu

SEQ ID NO: 1219106 - RNA, 19 nt, Homo sapiens
gugguaauuuggcaacagu

SEQ ID NO: 1219107 - RNA, 19 nt, Homo sapiens
caaauucuagcccaagucu

SEQ ID NO: 1219108 - RNA, 19 nt, Homo sapiens
gucgagggcugugggaaau

SEQ ID NO: 1219109 - RNA, 19 nt, Homo sapiens
cggaacugcuggcuccaau

SEQ ID NO: 1219110 - RNA, 19 nt, Homo sapiens
gcacagaaggaaacaugac

SEQ ID NO: 1219111 - RNA, 19 nt, Homo sapiens
uccggaauccugacuauug

SEQ ID NO: 1219112 - RNA, 19 nt, Homo sapiens
uucccagacuaaauucaua

SEQ ID NO: 1219113 - RNA, 19 nt, Homo sapiens
cacagucuacucagagaaa

SEQ ID NO: 1219114 - RNA, 19 nt, Homo sapiens
gaugacgugcagacuguga

SEQ ID NO: 1219115 - RNA, 19 nt, Homo sapiens
uaagaaacacgugcaggau

SEQ ID NO: 1219116 - RNA, 19 nt, Homo sapiens
ggagcccucuucccagacu

SEQ ID NO: 1219117 - RNA, 19 nt, Homo sapiens
caggcugucuagucagaug

SEQ ID NO: 1219118 - RNA, 19 nt, Homo sapiens
ucaccagcauguccaaacu

SEQ ID NO: 1219119 - RNA, 19 nt, Homo sapiens
cuuugaaacugccuuugug

SEQ ID NO: 1219120 - RNA, 19 nt, Homo sapiens
acgaggaagcaguaugaua

SEQ ID NO: 1219121 - RNA, 19 nt, Homo sapiens
cuaucaaccugcaggaucu

SEQ ID NO: 1219122 - RNA, 19 nt, Homo sapiens
ugcaggcacuggcaacuuc

SEQ ID NO: 1219123 - RNA, 19 nt, Homo sapiens
ggagaaagcuguagucuug

SEQ ID NO: 1219124 - RNA, 19 nt, Homo sapiens
ggaaggagauggaugagaa

SEQ ID NO: 1219125 - RNA, 19 nt, Homo sapiens
ggaaagauguuaacaccuu

SEQ ID NO: 1219126 - RNA, 19 nt, Homo sapiens
caaauuaccgcacagauua

SEQ ID NO: 1219127 - RNA, 19 nt, Homo sapiens
gaacauggacgaaggaauu

SEQ ID NO: 1219128 - RNA, 19 nt, Homo sapiens
ggacucaucuuaauuucuu

SEQ ID NO: 1219129 - RNA, 19 nt, Homo sapiens
gaagagaccgaauuaauga

SEQ ID NO: 1219130 - RNA, 19 nt, Homo sapiens
ucacuuggauguuauguaa

SEQ ID NO: 1219131 - RNA, 19 nt, Homo sapiens
caaggauaccuacaaauua

SEQ ID NO: 1219132 - RNA, 19 nt, Homo sapiens
gaaccuaauucgagaggaa

SEQ ID NO: 1219133 - RNA, 19 nt, Homo sapiens
caaaccagauaccagauaa

SEQ ID NO: 1219134 - RNA, 19 nt, Homo sapiens
gcagguaguuguuauguag

SEQ ID NO: 1219135 - RNA, 19 nt, Homo sapiens
gaagauaauugcuuuacag

SEQ ID NO: 1219136 - RNA, 19 nt, Homo sapiens
cauguuccauuaucucuua

SEQ ID NO: 1219137 - RNA, 19 nt, Homo sapiens
ugaagugguuuaaauggua

SEQ ID NO: 1219138 - RNA, 19 nt, Homo sapiens
ccgcacagauuaauagaaa

SEQ ID NO: 1219139 - RNA, 19 nt, Homo sapiens
aaacaaguccaaacugaua

SEQ ID NO: 1219140 - RNA, 19 nt, Homo sapiens
gcaacagcaucagaagaua

SEQ ID NO: 1219141 - RNA, 19 nt, Homo sapiens
caagguggcucuuauguac

SEQ ID NO: 1219142 - RNA, 19 nt, Homo sapiens
gauaccagauaaucacaaa

SEQ ID NO: 1219143 - RNA, 19 nt, Homo sapiens
aaaggaagcucccugaauc

SEQ ID NO: 1219144 - RNA, 19 nt, Homo sapiens
gaaaggaagcucccugaau

SEQ ID NO: 1219145 - RNA, 19 nt, Homo sapiens
uaacaccuuugacgucuuu

SEQ ID NO: 1219146 - RNA, 19 nt, Homo sapiens
ccaaggauaccuacaaauu

SEQ ID NO: 1219147 - RNA, 19 nt, Homo sapiens
gaaacgaacagcaguugaa

SEQ ID NO: 1219148 - RNA, 19 nt, Homo sapiens
cgacaggcauaaacaagaa

SEQ ID NO: 1219149 - RNA, 19 nt, Homo sapiens
ugcaaaugcuguaaagaua

SEQ ID NO: 1219150 - RNA, 19 nt, Homo sapiens
ggaauuaacuuugaaacac

SEQ ID NO: 1219151 - RNA, 19 nt, Homo sapiens
gcuaacacuuuauugagaa

SEQ ID NO: 1219152 - RNA, 19 nt, Homo sapiens
gggaggaaguguaauagau

SEQ ID NO: 1219153 - RNA, 19 nt, Homo sapiens
ucacuacaguucucagauu

SEQ ID NO: 1219154 - RNA, 19 nt, Homo sapiens
gcuguagucuuggaauuaa

SEQ ID NO: 1219155 - RNA, 19 nt, Homo sapiens
uuucagcacuccauaaauu

SEQ ID NO: 1219156 - RNA, 19 nt, Homo sapiens
ggacuauuccucuuuguau

SEQ ID NO: 1219157 - RNA, 19 nt, Homo sapiens
gaacgaaagcauuuaacug

SEQ ID NO: 1219158 - RNA, 19 nt, Homo sapiens
guacauuugcuaacacuuu

SEQ ID NO: 1219159 - RNA, 19 nt, Homo sapiens
uaagggaggaaguguaaua

SEQ ID NO: 1219160 - RNA, 19 nt, Homo sapiens
caagcagagugagaaguua

SEQ ID NO: 1219161 - RNA, 19 nt, Homo sapiens
caagcagagugagaaguua

SEQ ID NO: 1219162 - RNA, 19 nt, Homo sapiens
uugcucagcugaaagauuu

SEQ ID NO: 1219163 - RNA, 19 nt, Homo sapiens
gacuauuccucuuuguaua

SEQ ID NO: 1219164 - RNA, 19 nt, Homo sapiens
gaagugguuuaaaugguau

SEQ ID NO: 1219165 - RNA, 19 nt, Homo sapiens
ggacuggacuauuccucuu

SEQ ID NO: 1219166 - RNA, 19 nt, Homo sapiens
ggauacaaaucacuacagu

SEQ ID NO: 1219167 - RNA, 19 nt, Homo sapiens
gcaaaugcuguaaagauau

SEQ ID NO: 1219168 - RNA, 19 nt, Homo sapiens
gaagugaggaugcaguuuc

SEQ ID NO: 1219169 - RNA, 19 nt, Homo sapiens
caacagcaucagaagauaa

SEQ ID NO: 1219170 - RNA, 19 nt, Homo sapiens
uaaauacugucugugagaa

SEQ ID NO: 1219171 - RNA, 19 nt, Homo sapiens
aaaucucacuuggauguua

SEQ ID NO: 1219172 - RNA, 19 nt, Homo sapiens
ggaugcaguuucucacguu

SEQ ID NO: 1219173 - RNA, 19 nt, Homo sapiens
caccaaggauaccuacaaa

SEQ ID NO: 1219174 - RNA, 19 nt, Homo sapiens
gcauaaacaagaacaacaa

SEQ ID NO: 1219175 - RNA, 19 nt, Homo sapiens
caauaccucucccgguuug

SEQ ID NO: 1219176 - RNA, 19 nt, Homo sapiens
gaacaucugaaauugacaa

SEQ ID NO: 1219177 - RNA, 19 nt, Homo sapiens
acaagcuuaugcugucuua

SEQ ID NO: 1219178 - RNA, 19 nt, Homo sapiens
caucucaagugcaucuauu

SEQ ID NO: 1219179 - RNA, 19 nt, Homo sapiens
acacuaacaucccuuucuu

SEQ ID NO: 1219180 - RNA, 19 nt, Homo sapiens
gaaaagaagagaccgaauu

SEQ ID NO: 1219181 - RNA, 19 nt, Homo sapiens
gagaaaauaugugcuaaug

SEQ ID NO: 1219182 - RNA, 19 nt, Homo sapiens
uuuaggccauguuccauua

SEQ ID NO: 1219183 - RNA, 19 nt, Homo sapiens
guauauguguaaacccaaa

SEQ ID NO: 1219184 - RNA, 19 nt, Homo sapiens
aaagugaacgaaagcauuu

SEQ ID NO: 1219185 - RNA, 19 nt, Homo sapiens
ugagaaggccagaaucauu

SEQ ID NO: 1219186 - RNA, 19 nt, Homo sapiens
gaugagaaggccagaauca

SEQ ID NO: 1219187 - RNA, 19 nt, Homo sapiens
ggaggaaguguaauagaug

SEQ ID NO: 1219188 - RNA, 19 nt, Homo sapiens
aauggaugcucaauuaguu

SEQ ID NO: 1219189 - RNA, 19 nt, Homo sapiens
ucaaacaugcgccaaagaa

SEQ ID NO: 1219190 - RNA, 19 nt, Homo sapiens
caucugaaauugacaacuc

SEQ ID NO: 1219191 - RNA, 19 nt, Homo sapiens
ccaaacugauauauccuau

SEQ ID NO: 1219192 - RNA, 19 nt, Homo sapiens
gaacuaagucagggaagga

SEQ ID NO: 1219193 - RNA, 19 nt, Homo sapiens
uaaaagauccuaugcgaaa

SEQ ID NO: 1219194 - RNA, 19 nt, Homo sapiens
agagcggccuggagaagua

SEQ ID NO: 1219195 - RNA, 19 nt, Homo sapiens
gcaauaccucucccgguuu

SEQ ID NO: 1219196 - RNA, 19 nt, Homo sapiens
gagaccgaauuaaugaaug

SEQ ID NO: 1219197 - RNA, 19 nt, Homo sapiens
agaagagaccgaauuaaug

SEQ ID NO: 1219198 - RNA, 19 nt, Homo sapiens
ccaaaccagauaccagaua

SEQ ID NO: 1219199 - RNA, 19 nt, Homo sapiens
gaagagggagagcgagaga

SEQ ID NO: 1219200 - RNA, 19 nt, Homo sapiens
cccaauguaucuuaaugaa

SEQ ID NO: 1219201 - RNA, 19 nt, Homo sapiens
cacuacaguucucagauuu

SEQ ID NO: 1219202 - RNA, 19 nt, Homo sapiens
caagguagcacugugagaa

SEQ ID NO: 1219203 - RNA, 19 nt, Homo sapiens
gauugcaaaugcuguaaag

SEQ ID NO: 1219204 - RNA, 19 nt, Homo sapiens
aagaagagaccgaauuaau

SEQ ID NO: 1219205 - RNA, 19 nt, Homo sapiens
ccagauaaucacaaagaaa

SEQ ID NO: 1219206 - RNA, 19 nt, Homo sapiens
ccaucauguuccuaaauuu

SEQ ID NO: 1219207 - RNA, 19 nt, Homo sapiens
ucuauucccacucucauua

SEQ ID NO: 1219208 - RNA, 19 nt, Homo sapiens
gagcugggccaucgucaga

SEQ ID NO: 1219209 - RNA, 19 nt, Homo sapiens
gaaguaagaagggucuguu

SEQ ID NO: 1219210 - RNA, 19 nt, Homo sapiens
gcacgacaggcauaaacaa

SEQ ID NO: 1219211 - RNA, 19 nt, Homo sapiens
ccuacaagguggcucuuau

SEQ ID NO: 1219212 - RNA, 19 nt, Homo sapiens
gaccuugucuagauauuuu

SEQ ID NO: 1219213 - RNA, 19 nt, Homo sapiens
ggaaaggaagcucccugaa

SEQ ID NO: 1219214 - RNA, 19 nt, Homo sapiens
gcauugcucagcugaaaga

SEQ ID NO: 1219215 - RNA, 19 nt, Homo sapiens
acaaauuaccgcacagauu

SEQ ID NO: 1219216 - RNA, 19 nt, Homo sapiens
ucacacauuuccaaucucu

SEQ ID NO: 1219217 - RNA, 19 nt, Homo sapiens
auacaaaucacuacaguuc

SEQ ID NO: 1219218 - RNA, 19 nt, Homo sapiens
uccaucauguuccuaaauu

SEQ ID NO: 1219219 - RNA, 19 nt, Homo sapiens
ugacaacucugggacaucu

SEQ ID NO: 1219220 - RNA, 19 nt, Homo sapiens
aaaagaagagaccgaauua

SEQ ID NO: 1219221 - RNA, 19 nt, Homo sapiens
aaggauaccuacaaauuac

SEQ ID NO: 1219222 - RNA, 19 nt, Homo sapiens
auugagaaauugaccauga

SEQ ID NO: 1219223 - RNA, 19 nt, Homo sapiens
gaaagaagaugaagaagau

SEQ ID NO: 1219224 - RNA, 19 nt, Homo sapiens
gaagaagacuacaaugaaa

SEQ ID NO: 1219225 - RNA, 19 nt, Homo sapiens
ccacuaaucugccuucuau

SEQ ID NO: 1219226 - RNA, 19 nt, Homo sapiens
cagaacaucuucauauuga

SEQ ID NO: 1219227 - RNA, 19 nt, Homo sapiens
ugacuaagaucuccuauag

SEQ ID NO: 1219228 - RNA, 19 nt, Homo sapiens
gcaagaagcaguuguugaa

SEQ ID NO: 1219229 - RNA, 19 nt, Homo sapiens
caaagaagaugauggaaaa

SEQ ID NO: 1219230 - RNA, 19 nt, Homo sapiens
ccauaaaguuucuaacaug

SEQ ID NO: 1219231 - RNA, 19 nt, Homo sapiens
agaagaagaucagaaagaa

SEQ ID NO: 1219232 - RNA, 19 nt, Homo sapiens
agaaacaaagcaccaauua

SEQ ID NO: 1219233 - RNA, 19 nt, Homo sapiens
gagagaagauggaaaagaa

SEQ ID NO: 1219234 - RNA, 19 nt, Homo sapiens
aaagugauaugauggaaga

SEQ ID NO: 1219235 - RNA, 19 nt, Homo sapiens
aaacacagccuuucuuuag

SEQ ID NO: 1219236 - RNA, 19 nt, Homo sapiens
aagaugagaucaaagaaga

SEQ ID NO: 1219237 - RNA, 19 nt, Homo sapiens
ggaagaagcuggaaaagag

SEQ ID NO: 1219238 - RNA, 19 nt, Homo sapiens
ugaauuucguguuguguaa

SEQ ID NO: 1219239 - RNA, 19 nt, Homo sapiens
guaguggaauacauagaaa

SEQ ID NO: 1219240 - RNA, 19 nt, Homo sapiens
auagagagcuacaacaaug

SEQ ID NO: 1219241 - RNA, 19 nt, Homo sapiens
ugaagaagacuacaaugaa

SEQ ID NO: 1219242 - RNA, 19 nt, Homo sapiens
gaaaagaagacaaagauga

SEQ ID NO: 1219243 - RNA, 19 nt, Homo sapiens
ucagaaagaagaugaagaa

SEQ ID NO: 1219244 - RNA, 19 nt, Homo sapiens
ugaagaagaagaucagaaa

SEQ ID NO: 1219245 - RNA, 19 nt, Homo sapiens
agaagcaguuguugaagaa

SEQ ID NO: 1219246 - RNA, 19 nt, Homo sapiens
gucaguauauucacaaugu

SEQ ID NO: 1219247 - RNA, 19 nt, Homo sapiens
gaaaagagaagggagauaa

SEQ ID NO: 1219248 - RNA, 19 nt, Homo sapiens
agaggaagaugagaucaaa

SEQ ID NO: 1219249 - RNA, 19 nt, Homo sapiens
gaaaggagaagaugcaaaa

SEQ ID NO: 1219250 - RNA, 19 nt, Homo sapiens
gaaaugagaaaggagaaga

SEQ ID NO: 1219251 - RNA, 19 nt, Homo sapiens
ggaagaagauggaaaagag

SEQ ID NO: 1219252 - RNA, 19 nt, Homo sapiens
ugccuauucugaacauuua

SEQ ID NO: 1219253 - RNA, 19 nt, Homo sapiens
gaaacaaagcaccaauuag

SEQ ID NO: 1219254 - RNA, 19 nt, Homo sapiens
gugagugaauuucguguug

SEQ ID NO: 1219255 - RNA, 19 nt, Homo sapiens
caaggaaaaugaagacaaa

SEQ ID NO: 1219256 - RNA, 19 nt, Homo sapiens
gccauaaaguuucuaacau

SEQ ID NO: 1219257 - RNA, 19 nt, Homo sapiens
acuaagaucuccuauagag

SEQ ID NO: 1219258 - RNA, 19 nt, Homo sapiens
gaagggcaguuuugauuau

SEQ ID NO: 1219259 - RNA, 19 nt, Homo sapiens
ucaaagaagaugauggaaa

SEQ ID NO: 1219260 - RNA, 19 nt, Homo sapiens
gaagaagacagaaaagaaa

SEQ ID NO: 1219261 - RNA, 19 nt, Homo sapiens
gaaauggagaagauggaaa

SEQ ID NO: 1219262 - RNA, 19 nt, Homo sapiens
aagaaaggcugcaggucaa

SEQ ID NO: 1219263 - RNA, 19 nt, Homo sapiens
ugaagaagaucaaaacgaa

SEQ ID NO: 1219264 - RNA, 19 nt, Homo sapiens
aagaagcaguuguugaaga

SEQ ID NO: 1219265 - RNA, 19 nt, Homo sapiens
ccacagaguauuguuuaaa

SEQ ID NO: 1219266 - RNA, 19 nt, Homo sapiens
gaagaugagaucaaagaag

SEQ ID NO: 1219267 - RNA, 19 nt, Homo sapiens
gaagaugaagguggaaaug

SEQ ID NO: 1219268 - RNA, 19 nt, Homo sapiens
uauugaagaugccacagaa

SEQ ID NO: 1219269 - RNA, 19 nt, Homo sapiens
gaaugaagauggaaaagag

SEQ ID NO: 1219270 - RNA, 19 nt, Homo sapiens
cagccuuucuuuagcauug

SEQ ID NO: 1219271 - RNA, 19 nt, Homo sapiens
ggaaagauguaaaagucaa

SEQ ID NO: 1219272 - RNA, 19 nt, Homo sapiens
aauguuguguccacuguuu

SEQ ID NO: 1219273 - RNA, 19 nt, Homo sapiens
caacaaugcccaaaagaaa

SEQ ID NO: 1219274 - RNA, 19 nt, Homo sapiens
ggaagaugagaucaaagaa

SEQ ID NO: 1219275 - RNA, 19 nt, Homo sapiens
ggaagaagacagaaaagaa

SEQ ID NO: 1219276 - RNA, 19 nt, Homo sapiens
gaagaugaagaagaucaaa

SEQ ID NO: 1219277 - RNA, 19 nt, Homo sapiens
aagaagaucagaaagaaga

SEQ ID NO: 1219278 - RNA, 19 nt, Homo sapiens
aaacaaagcaccaauuagc

SEQ ID NO: 1219279 - RNA, 19 nt, Homo sapiens
caacuuugugagugaauuu

SEQ ID NO: 1219280 - RNA, 19 nt, Homo sapiens
ucagaacaucuucauauug

SEQ ID NO: 1219281 - RNA, 19 nt, Homo sapiens
aaagaggagccacagagua

SEQ ID NO: 1219282 - RNA, 19 nt, Homo sapiens
agaaagaagaugaagaaga

SEQ ID NO: 1219283 - RNA, 19 nt, Homo sapiens
cagguugucugcuaugcuu

SEQ ID NO: 1219284 - RNA, 19 nt, Homo sapiens
gccacagaguauuguuuaa

SEQ ID NO: 1219285 - RNA, 19 nt, Homo sapiens
gaggagccacagaguauug

SEQ ID NO: 1219286 - RNA, 19 nt, Homo sapiens
gcuaugcuugugccaguua

SEQ ID NO: 1219287 - RNA, 19 nt, Homo sapiens
ggaaauggagaagauggaa

SEQ ID NO: 1219288 - RNA, 19 nt, Homo sapiens
ggauuugccuauucugaac

SEQ ID NO: 1219289 - RNA, 19 nt, Homo sapiens
gagugaauuucguguugug

SEQ ID NO: 1219290 - RNA, 19 nt, Homo sapiens
guaccuucauguuguaaag

SEQ ID NO: 1219291 - RNA, 19 nt, Homo sapiens
gagaaaggagaagaugaaa

SEQ ID NO: 1219292 - RNA, 19 nt, Homo sapiens
agagaaaggagaagaugaa

SEQ ID NO: 1219293 - RNA, 19 nt, Homo sapiens
cuagugaaauauugugcuu

SEQ ID NO: 1219294 - RNA, 19 nt, Homo sapiens
gagccacagaguauuguuu

SEQ ID NO: 1219295 - RNA, 19 nt, Homo sapiens
aaauggaaaugagaaagga

SEQ ID NO: 1219296 - RNA, 19 nt, Homo sapiens
aagaagaagaucagaaaga

SEQ ID NO: 1219297 - RNA, 19 nt, Homo sapiens
caagcaagaagcaguuguu

SEQ ID NO: 1219298 - RNA, 19 nt, Homo sapiens
ggggaaagauguaaaaguc

SEQ ID NO: 1219299 - RNA, 19 nt, Homo sapiens
gaagaagaagaucagaaag

SEQ ID NO: 1219300 - RNA, 19 nt, Homo sapiens
ccuucuaucucuauggauu

SEQ ID NO: 1219301 - RNA, 19 nt, Homo sapiens
ccaaauaagaaacaaagca

SEQ ID NO: 1219302 - RNA, 19 nt, Homo sapiens
uucaaugguugucaguaua

SEQ ID NO: 1219303 - RNA, 19 nt, Homo sapiens
acacagccuuucuuuagca

SEQ ID NO: 1219304 - RNA, 19 nt, Homo sapiens
aagaggagccacagaguau

SEQ ID NO: 1219305 - RNA, 19 nt, Homo sapiens
gaaaggggaagcuggaaaa

SEQ ID NO: 1219306 - RNA, 19 nt, Homo sapiens
gaagaagaucagaaagaag

SEQ ID NO: 1219307 - RNA, 19 nt, Homo sapiens
uguguccacuguuuaauuc

SEQ ID NO: 1219308 - RNA, 19 nt, Homo sapiens
gcaggucaaggugauauga

SEQ ID NO: 1219309 - RNA, 19 nt, Homo sapiens
gaugagaucaaagaagaug

SEQ ID NO: 1219310 - RNA, 19 nt, Homo sapiens
aaaaggaaauggagaagau

SEQ ID NO: 1219311 - RNA, 19 nt, Homo sapiens
aagcaguuguugaagaaga

SEQ ID NO: 1219312 - RNA, 19 nt, Homo sapiens
auaaacacagccuuucuuu

SEQ ID NO: 1219313 - RNA, 19 nt, Homo sapiens
gaaaagggaggagaaaaga

SEQ ID NO: 1219314 - RNA, 19 nt, Homo sapiens
ucuauggauuugccuauuc

SEQ ID NO: 1219315 - RNA, 19 nt, Homo sapiens
uaaucugccuucuaucucu

SEQ ID NO: 1219316 - RNA, 19 nt, Homo sapiens
uuagcagucucuucccauu

SEQ ID NO: 1219317 - RNA, 19 nt, Homo sapiens
caaugguugucaguauauu

SEQ ID NO: 1219318 - RNA, 19 nt, Homo sapiens
uaaagugagggaucccaaa

SEQ ID NO: 1219319 - RNA, 19 nt, Homo sapiens
gaaaagaggaagaugagau

SEQ ID NO: 1219320 - RNA, 19 nt, Homo sapiens
aacaucaaguucaaggaaa

SEQ ID NO: 1219321 - RNA, 19 nt, Homo sapiens
cuauagagagcuacaacaa

SEQ ID NO: 1219322 - RNA, 19 nt, Homo sapiens
gaagaucagaaagaagaug

SEQ ID NO: 1219323 - RNA, 19 nt, Homo sapiens
gaacagaacuggaaaauuc

SEQ ID NO: 1219324 - RNA, 19 nt, Homo sapiens
gaagaaaucauaacacuug

SEQ ID NO: 1219325 - RNA, 19 nt, Homo sapiens
ucaaauagcuggauuaggu

SEQ ID NO: 1219326 - RNA, 19 nt, Homo sapiens
cgacuugaguguaaacaua

SEQ ID NO: 1219327 - RNA, 19 nt, Homo sapiens
ggauacaguuugcuaauau

SEQ ID NO: 1219328 - RNA, 19 nt, Homo sapiens
gaauaucccugugagaauu

SEQ ID NO: 1219329 - RNA, 19 nt, Homo sapiens
gaacugaaccugcaauauc

SEQ ID NO: 1219330 - RNA, 19 nt, Homo sapiens
ccagaaagcucagcaaaca

SEQ ID NO: 1219331 - RNA, 19 nt, Homo sapiens
ccacagagguuggauguuc

SEQ ID NO: 1219332 - RNA, 19 nt, Homo sapiens
gaaccaguaugggaaagaa

SEQ ID NO: 1219333 - RNA, 19 nt, Homo sapiens
gaugcuggcuucauagaau

SEQ ID NO: 1219334 - RNA, 19 nt, Homo sapiens
guaaagauuugagggaaga

SEQ ID NO: 1219335 - RNA, 19 nt, Homo sapiens
gcaaacaucaggacacuuc

SEQ ID NO: 1219336 - RNA, 19 nt, Homo sapiens
caaaguaugcauauaguug

SEQ ID NO: 1219337 - RNA, 19 nt, Homo sapiens
gaauauuggccugaaauuu

SEQ ID NO: 1219338 - RNA, 19 nt, Homo sapiens
ggucauugcuggucaucuu

SEQ ID NO: 1219339 - RNA, 19 nt, Homo sapiens
ugaaaaugcuugaggcuua

SEQ ID NO: 1219340 - RNA, 19 nt, Homo sapiens
caagauaucaggagaaagu

SEQ ID NO: 1219341 - RNA, 19 nt, Homo sapiens
ggagaucccagcugugaaa

SEQ ID NO: 1219342 - RNA, 19 nt, Homo sapiens
gagggaagaaugaauaaga

SEQ ID NO: 1219343 - RNA, 19 nt, Homo sapiens
ugauguuucuucuccaaua

SEQ ID NO: 1219344 - RNA, 19 nt, Homo sapiens
agagcaagguggugaauau

SEQ ID NO: 1219345 - RNA, 19 nt, Homo sapiens
cggcaaauauuacuguaga

SEQ ID NO: 1219346 - RNA, 19 nt, Homo sapiens
cuugggagauuguguguuu

SEQ ID NO: 1219347 - RNA, 19 nt, Homo sapiens
ggagacagcaucguucuga

SEQ ID NO: 1219348 - RNA, 19 nt, Homo sapiens
ggccaaauccucaagaguu

SEQ ID NO: 1219349 - RNA, 19 nt, Homo sapiens
cacaagauaucaggagaaa

SEQ ID NO: 1219350 - RNA, 19 nt, Homo sapiens
cagauucgcugacccuugu

SEQ ID NO: 1219351 - RNA, 19 nt, Homo sapiens
gaugauguuucuucuccaa

SEQ ID NO: 1219352 - RNA, 19 nt, Homo sapiens
caacuucagcgcuugauau

SEQ ID NO: 1219353 - RNA, 19 nt, Homo sapiens
ucaccaaaguaugcauaua

SEQ ID NO: 1219354 - RNA, 19 nt, Homo sapiens
ggaauauuggccugaaauu

SEQ ID NO: 1219355 - RNA, 19 nt, Homo sapiens
gauguuucuucuccaauau

SEQ ID NO: 1219356 - RNA, 19 nt, Homo sapiens
gugaagaaaucauaacacu

SEQ ID NO: 1219357 - RNA, 19 nt, Homo sapiens
gccaaauccucaagaguuc

SEQ ID NO: 1219358 - RNA, 19 nt, Homo sapiens
uggauacaguuugcuaaua

SEQ ID NO: 1219359 - RNA, 19 nt, Homo sapiens
ccagugagccugaaaugug

SEQ ID NO: 1219360 - RNA, 19 nt, Homo sapiens
ugacagugguaacuauuuc

SEQ ID NO: 1219361 - RNA, 19 nt, Homo sapiens
gcaggauugguaccaguua

SEQ ID NO: 1219362 - RNA, 19 nt, Homo sapiens
cagacacugugcaaauaaa

SEQ ID NO: 1219363 - RNA, 19 nt, Homo sapiens
ccucaagaguucaccuauu

SEQ ID NO: 1219364 - RNA, 19 nt, Homo sapiens
gugaugccggcaaauauua

SEQ ID NO: 1219365 - RNA, 19 nt, Homo sapiens
gaguacaucucuuuucaaa

SEQ ID NO: 1219366 - RNA, 19 nt, Homo sapiens
ggcugaugcuggcuucaua

SEQ ID NO: 1219367 - RNA, 19 nt, Homo sapiens
cagugagccugaaauguga

SEQ ID NO: 1219368 - RNA, 19 nt, Homo sapiens
gaugagaacaggacuugau

SEQ ID NO: 1219369 - RNA, 19 nt, Homo sapiens
gcaaucaguguguaaagau

SEQ ID NO: 1219370 - RNA, 19 nt, Homo sapiens
caagucaucuacucuucug

SEQ ID NO: 1219371 - RNA, 19 nt, Homo sapiens
cuucagcgcuugauauugg

SEQ ID NO: 1219372 - RNA, 19 nt, Homo sapiens
gagacagcaucguucugaa

SEQ ID NO: 1219373 - RNA, 19 nt, Homo sapiens
gcuguuguaugccuuguuc

SEQ ID NO: 1219374 - RNA, 19 nt, Homo sapiens
uccagacacugugcaaaua

SEQ ID NO: 1219375 - RNA, 19 nt, Homo sapiens
cucaagaguucaccuauuc

SEQ ID NO: 1219376 - RNA, 19 nt, Homo sapiens
aaaguucugccacuaauga

SEQ ID NO: 1219377 - RNA, 19 nt, Homo sapiens
gaucccagcugugaaagag

SEQ ID NO: 1219378 - RNA, 19 nt, Homo sapiens
ugugugacuugcuuuauug

SEQ ID NO: 1219379 - RNA, 19 nt, Homo sapiens
ccagacacugugcaaauaa

SEQ ID NO: 1219380 - RNA, 19 nt, Homo sapiens
gaagaucaacagcaaggau

SEQ ID NO: 1219381 - RNA, 19 nt, Homo sapiens
cgaaggagacagcaucguu

SEQ ID NO: 1219382 - RNA, 19 nt, Homo sapiens
uguguugguugguaaguuu

SEQ ID NO: 1219383 - RNA, 19 nt, Homo sapiens
gauagugguguauuaacuu

SEQ ID NO: 1219384 - RNA, 19 nt, Homo sapiens
gagaacaggacuugauagu

SEQ ID NO: 1219385 - RNA, 19 nt, Homo sapiens
ggaagaaugaauaagagau

SEQ ID NO: 1219386 - RNA, 19 nt, Homo sapiens
ucacugaacaggcagauuc

SEQ ID NO: 1219387 - RNA, 19 nt, Homo sapiens
caugacagcuggaguucuc

SEQ ID NO: 1219388 - RNA, 19 nt, Homo sapiens
uagaagagaccucaugaca

SEQ ID NO: 1219389 - RNA, 19 nt, Homo sapiens
gugaauaucccugugagaa

SEQ ID NO: 1219390 - RNA, 19 nt, Homo sapiens
aagggaagaucaacagcaa

SEQ ID NO: 1219391 - RNA, 19 nt, Homo sapiens
cauaacacuuggaggaauc

SEQ ID NO: 1219392 - RNA, 19 nt, Homo sapiens
aaauucagaagauggcuua

SEQ ID NO: 1219393 - RNA, 19 nt, Homo sapiens
gagugaugccggcaaauau

SEQ ID NO: 1219394 - RNA, 19 nt, Homo sapiens
agugguaacuauuucugua

SEQ ID NO: 1219395 - RNA, 19 nt, Homo sapiens
ccauaaggauaacaaagag

SEQ ID NO: 1219396 - RNA, 19 nt, Homo sapiens
uauccaaagugcaguuuua

SEQ ID NO: 1219397 - RNA, 19 nt, Homo sapiens
cagauuuccuuauccaaag

SEQ ID NO: 1219398 - RNA, 19 nt, Homo sapiens
ggaacugaaccugcaauau

SEQ ID NO: 1219399 - RNA, 19 nt, Homo sapiens
ucauugaacugcugcuaca

SEQ ID NO: 1219400 - RNA, 19 nt, Homo sapiens
gaaaguucugccacuaaug

SEQ ID NO: 1219401 - RNA, 19 nt, Homo sapiens
acaggugacugaaggacaa

SEQ ID NO: 1219402 - RNA, 19 nt, Homo sapiens
cuccggagcuccagauuuc

SEQ ID NO: 1219403 - RNA, 19 nt, Homo sapiens
gcaauaucaccaaaguaug

SEQ ID NO: 1219404 - RNA, 19 nt, Homo sapiens
gacuugaguguaaacauaa

SEQ ID NO: 1219405 - RNA, 19 nt, Homo sapiens
ugcaucgacuugaguguaa

SEQ ID NO: 1219406 - RNA, 19 nt, Homo sapiens
uaccuucucuuaagcaauc

SEQ ID NO: 1219407 - RNA, 19 nt, Homo sapiens
ucagauuuccuuauccaaa

SEQ ID NO: 1219408 - RNA, 19 nt, Homo sapiens
gaaccugcaauaucaccaa

SEQ ID NO: 1219409 - RNA, 19 nt, Homo sapiens
ggucucaccuucaucuacu

SEQ ID NO: 1219410 - RNA, 19 nt, Homo sapiens
ccugauggcuauagaagag

SEQ ID NO: 1219411 - RNA, 19 nt, Homo sapiens
agagagugaugccggcaaa

SEQ ID NO: 1219412 - RNA, 19 nt, Homo sapiens
aacugaaccugcaauauca

SEQ ID NO: 1219413 - RNA, 19 nt, Homo sapiens
uugcaaauauguucauugg

SEQ ID NO: 1219414 - RNA, 19 nt, Homo sapiens
gaaaaugcuugaggcuuau

SEQ ID NO: 1219415 - RNA, 19 nt, Homo sapiens
gccaguguaugucaaugug

SEQ ID NO: 1219416 - RNA, 19 nt, Homo sapiens
caccaaaguaugcauauag

SEQ ID NO: 1219417 - RNA, 19 nt, Homo sapiens
uauagaagagaccucauga

SEQ ID NO: 1219418 - RNA, 19 nt, Homo sapiens
agagugaugccggcaaaua

SEQ ID NO: 1219419 - RNA, 19 nt, Homo sapiens
ugcaauaucaccaaaguau

SEQ ID NO: 1219420 - RNA, 19 nt, Homo sapiens
gggaauauuggccugaaau

SEQ ID NO: 1219421 - RNA, 19 nt, Homo sapiens
uaagugacagugguaacua

SEQ ID NO: 1219422 - RNA, 19 nt, Homo sapiens
acuugauagugguguauua

SEQ ID NO: 1219423 - RNA, 19 nt, Homo sapiens
gaacugggcugaauaaaca

SEQ ID NO: 1219424 - RNA, 19 nt, Homo sapiens
gaagaaaucauaacacuug

SEQ ID NO: 1219425 - RNA, 19 nt, Homo sapiens
gaaaugcuccuauguauca

SEQ ID NO: 1219426 - RNA, 19 nt, Homo sapiens
ccucaaacgucuaaauaua

SEQ ID NO: 1219427 - RNA, 19 nt, Homo sapiens
ccagaaagcucagcaaaca

SEQ ID NO: 1219428 - RNA, 19 nt, Homo sapiens
uagaaaugcuccuauguau

SEQ ID NO: 1219429 - RNA, 19 nt, Homo sapiens
gcaaacaucaggacacuuc

SEQ ID NO: 1219430 - RNA, 19 nt, Homo sapiens
ugaaaaugcuugaggcuua

SEQ ID NO: 1219431 - RNA, 19 nt, Homo sapiens
caagauaucaggagaaagu

SEQ ID NO: 1219432 - RNA, 19 nt, Homo sapiens
ugauguuucuucuccaaua

SEQ ID NO: 1219433 - RNA, 19 nt, Homo sapiens
ggccaaauccucaagaguu

SEQ ID NO: 1219434 - RNA, 19 nt, Homo sapiens
cacaagauaucaggagaaa

SEQ ID NO: 1219435 - RNA, 19 nt, Homo sapiens
gaugauguuucuucuccaa

SEQ ID NO: 1219436 - RNA, 19 nt, Homo sapiens
gauguuucuucuccaauau

SEQ ID NO: 1219437 - RNA, 19 nt, Homo sapiens
gugaagaaaucauaacacu

SEQ ID NO: 1219438 - RNA, 19 nt, Homo sapiens
gccaaauccucaagaguuc

SEQ ID NO: 1219439 - RNA, 19 nt, Homo sapiens
gcagcacccagaacugaua

SEQ ID NO: 1219440 - RNA, 19 nt, Homo sapiens
gaacugauauuccccucaa

SEQ ID NO: 1219441 - RNA, 19 nt, Homo sapiens
cagacacugugcaaauaaa

SEQ ID NO: 1219442 - RNA, 19 nt, Homo sapiens
ccucaagaguucaccuauu

SEQ ID NO: 1219443 - RNA, 19 nt, Homo sapiens
uuagaaaugcuccuaugua

SEQ ID NO: 1219444 - RNA, 19 nt, Homo sapiens
ccaggaacaacuauaauau

SEQ ID NO: 1219445 - RNA, 19 nt, Homo sapiens
caagucaucuacucuucug

SEQ ID NO: 1219446 - RNA, 19 nt, Homo sapiens
gggaguuugugaaucuauu

SEQ ID NO: 1219447 - RNA, 19 nt, Homo sapiens
gcuguuguaugccuuguuc

SEQ ID NO: 1219448 - RNA, 19 nt, Homo sapiens
uccagacacugugcaaaua

SEQ ID NO: 1219449 - RNA, 19 nt, Homo sapiens
cucaagaguucaccuauuc

SEQ ID NO: 1219450 - RNA, 19 nt, Homo sapiens
aaaguucugccacuaauga

SEQ ID NO: 1219451 - RNA, 19 nt, Homo sapiens
ccagacacugugcaaauaa

SEQ ID NO: 1219452 - RNA, 19 nt, Homo sapiens
gaagaucaacagcaaggau

SEQ ID NO: 1219453 - RNA, 19 nt, Homo sapiens
ugaggcaucacaaaucuuu

SEQ ID NO: 1219454 - RNA, 19 nt, Homo sapiens
caugacagcuggaguucuc

SEQ ID NO: 1219455 - RNA, 19 nt, Homo sapiens
uagaagagaccucaugaca

SEQ ID NO: 1219456 - RNA, 19 nt, Homo sapiens
uaacuguucuagugggaau

SEQ ID NO: 1219457 - RNA, 19 nt, Homo sapiens
ggaaaacaaucagaugaga

SEQ ID NO: 1219458 - RNA, 19 nt, Homo sapiens
aagggaagaucaacagcaa

SEQ ID NO: 1219459 - RNA, 19 nt, Homo sapiens
cauaacacuuggaggaauc

SEQ ID NO: 1219460 - RNA, 19 nt, Homo sapiens
caucacaaaucuuuucuga

SEQ ID NO: 1219461 - RNA, 19 nt, Homo sapiens
guugggaguuugugaaucu

SEQ ID NO: 1219462 - RNA, 19 nt, Homo sapiens
guuuagaaaugcuccuaug

SEQ ID NO: 1219463 - RNA, 19 nt, Homo sapiens
ucauugaacugcugcuaca

SEQ ID NO: 1219464 - RNA, 19 nt, Homo sapiens
gaaaguucugccacuaaug

SEQ ID NO: 1219465 - RNA, 19 nt, Homo sapiens
cccaggaacaacuauaaua

SEQ ID NO: 1219466 - RNA, 19 nt, Homo sapiens
cagaugagaacaacagaug

SEQ ID NO: 1219467 - RNA, 19 nt, Homo sapiens
ccugauggcuauagaagag

SEQ ID NO: 1219468 - RNA, 19 nt, Homo sapiens
gaaaaugcuugaggcuuau

SEQ ID NO: 1219469 - RNA, 19 nt, Homo sapiens
gccaguguaugucaaugug

SEQ ID NO: 1219470 - RNA, 19 nt, Homo sapiens
uauagaagagaccucauga

SEQ ID NO: 1219471 - RNA, 19 nt, Homo sapiens
gggaaugugggaauggaaa

SEQ ID NO: 1219472 - RNA, 19 nt, Homo sapiens
caagaguucaccuauucaa

SEQ ID NO: 1219473 - RNA, 19 nt, Homo sapiens
gcacccagaacugauauuc

SEQ ID NO: 1219474 - RNA, 19 nt, Homo sapiens
gacacugugcaaauaaauu

SEQ ID NO: 1219475 - RNA, 19 nt, Homo sapiens
uggaugugguuuauucuca

SEQ ID NO: 1219476 - RNA, 19 nt, Homo sapiens
ggaguuugugaaucuauug

SEQ ID NO: 1219477 - RNA, 19 nt, Homo sapiens
ucauaacacuuggaggaau

SEQ ID NO: 1219478 - RNA, 19 nt, Homo sapiens
gucaucuacucuucuguga

SEQ ID NO: 1219479 - RNA, 19 nt, Homo sapiens
guccugaacugggcugaau

SEQ ID NO: 1219480 - RNA, 19 nt, Homo sapiens
gaaagcucagcaaacauca

SEQ ID NO: 1219481 - RNA, 19 nt, Homo sapiens
caaugugggcucuguagau

SEQ ID NO: 1219482 - RNA, 19 nt, Homo sapiens
ggaccugauggcuauagaa

SEQ ID NO: 1219483 - RNA, 19 nt, Homo sapiens
ggaaucagaagggaagauc

SEQ ID NO: 1219484 - RNA, 19 nt, Homo sapiens
cagcaaacaucaggacacu

SEQ ID NO: 1219485 - RNA, 19 nt, Homo sapiens
ccugaacugggcugaauaa

SEQ ID NO: 1219486 - RNA, 19 nt, Homo sapiens
uagauguggaugugguuua

SEQ ID NO: 1219487 - RNA, 19 nt, Homo sapiens
aaugugggcucuguagaug

SEQ ID NO: 1219488 - RNA, 19 nt, Homo sapiens
ccacaagauaucaggagaa

SEQ ID NO: 1219489 - RNA, 19 nt, Homo sapiens
gcugaauaaacauaccuaa

SEQ ID NO: 1219490 - RNA, 19 nt, Homo sapiens
agaaagcucagcaaacauc

SEQ ID NO: 1219491 - RNA, 19 nt, Homo sapiens
cuucuccaauaucuucuuu

SEQ ID NO: 1219492 - RNA, 19 nt, Homo sapiens
acacuuggaggaaucagaa

SEQ ID NO: 1219493 - RNA, 19 nt, Homo sapiens
gcaugcagcagccagaaag

SEQ ID NO: 1219494 - RNA, 19 nt, Homo sapiens
gaaaacaaucagaugagaa

SEQ ID NO: 1219495 - RNA, 19 nt, Homo sapiens
agauguggaugugguuuau

SEQ ID NO: 1219496 - RNA, 19 nt, Homo sapiens
guguugcuuugcuguugua

SEQ ID NO: 1219497 - RNA, 19 nt, Homo sapiens
gcagguugggaguuuguga

SEQ ID NO: 1219498 - RNA, 19 nt, Homo sapiens
acaaucagaugagaacaac

SEQ ID NO: 1219499 - RNA, 19 nt, Homo sapiens
gcaggcagcacccagaacu

SEQ ID NO: 1219500 - RNA, 19 nt, Homo sapiens
gccugcagguugggaguuu

SEQ ID NO: 1219501 - RNA, 19 nt, Homo sapiens
gaaucagaagggaagauca

SEQ ID NO: 1219502 - RNA, 19 nt, Homo sapiens
gguguugcuuugcuguugu

SEQ ID NO: 1219503 - RNA, 19 nt, Homo sapiens
ccucaugacagcuggaguu

SEQ ID NO: 1219504 - RNA, 19 nt, Homo sapiens
gcuccuauguaucaguuuu

SEQ ID NO: 1219505 - RNA, 19 nt, Homo sapiens
cccaaucuuguaccaauuu

SEQ ID NO: 1219506 - RNA, 19 nt, Homo sapiens
cccaagucaucuacucuuc

SEQ ID NO: 1219507 - RNA, 19 nt, Homo sapiens
ugugggcucuguagaugug

SEQ ID NO: 1219508 - RNA, 19 nt, Homo sapiens
gaccugauggcuauagaag

SEQ ID NO: 1219509 - RNA, 19 nt, Homo sapiens
gggaccugcuggagcuuca

SEQ ID NO: 1219510 - RNA, 19 nt, Homo sapiens
gcugcuacauccagacacu

SEQ ID NO: 1219511 - RNA, 19 nt, Homo sapiens
aaucagaagggaagaucaa

SEQ ID NO: 1219512 - RNA, 19 nt, Homo sapiens
gaugagaacaacagaugac

SEQ ID NO: 1219513 - RNA, 19 nt, Homo sapiens
gagcaugcagcagccagaa

SEQ ID NO: 1219514 - RNA, 19 nt, Homo sapiens
ggagcugcagccaguguau

SEQ ID NO: 1219515 - RNA, 19 nt, Homo sapiens
ucacugguguugcuuugcu

SEQ ID NO: 1219516 - RNA, 19 nt, Homo sapiens
uguuugguguccuugguuu

SEQ ID NO: 1219517 - RNA, 19 nt, Homo sapiens
gcagccaguguaugucaau

SEQ ID NO: 1219518 - RNA, 19 nt, Homo sapiens
ugaacugggcugaauaaac

SEQ ID NO: 1219519 - RNA, 19 nt, Homo sapiens
gugggaaugugggaaugga

SEQ ID NO: 1219520 - RNA, 19 nt, Homo sapiens
uugcuuugcuguuguaugc

SEQ ID NO: 1219521 - RNA, 19 nt, Homo sapiens
ggaguucucuggggacugu

SEQ ID NO: 1219522 - RNA, 19 nt, Homo sapiens
gaguuugugaaucuauuga

SEQ ID NO: 1219523 - RNA, 19 nt, Homo sapiens
gaacugggcugaauaaaca

SEQ ID NO: 1219524 - RNA, 19 nt, Homo sapiens
gaaaugcuccuauguauca

SEQ ID NO: 1219525 - RNA, 19 nt, Homo sapiens
ccucaaacgucuaaauaua

SEQ ID NO: 1219526 - RNA, 19 nt, Homo sapiens
acacuucaaugaucucuua

SEQ ID NO: 1219527 - RNA, 19 nt, Homo sapiens
ggagaugucugcugugugu

SEQ ID NO: 1219528 - RNA, 19 nt, Homo sapiens
gguguuaccuggauacaga

SEQ ID NO: 1219529 - RNA, 19 nt, Homo sapiens
uagaaaugcuccuauguau

SEQ ID NO: 1219530 - RNA, 19 nt, Homo sapiens
uaacaucccuauauagcau

SEQ ID NO: 1219531 - RNA, 19 nt, Homo sapiens
acacuaaccugaagaguac

SEQ ID NO: 1219532 - RNA, 19 nt, Homo sapiens
agacuacacuucaaugauc

SEQ ID NO: 1219533 - RNA, 19 nt, Homo sapiens
gaagggcccaagucuuaaa

SEQ ID NO: 1219534 - RNA, 19 nt, Homo sapiens
gcagcacccagaacugaua

SEQ ID NO: 1219535 - RNA, 19 nt, Homo sapiens
gaacugauauuccccucaa

SEQ ID NO: 1219536 - RNA, 19 nt, Homo sapiens
ccaggaacaacuauaauau

SEQ ID NO: 1219537 - RNA, 19 nt, Homo sapiens
uuagaaaugcuccuaugua

SEQ ID NO: 1219538 - RNA, 19 nt, Homo sapiens
uuaccuggauacagaguuu

SEQ ID NO: 1219539 - RNA, 19 nt, Homo sapiens
gggaguuugugaaucuauu

SEQ ID NO: 1219540 - RNA, 19 nt, Homo sapiens
guacagacuacacuucaau

SEQ ID NO: 1219541 - RNA, 19 nt, Homo sapiens
ugaggcaucacaaaucuuu

SEQ ID NO: 1219542 - RNA, 19 nt, Homo sapiens
caugacagcuggaguucuc

SEQ ID NO: 1219543 - RNA, 19 nt, Homo sapiens
uagaagagaccucaugaca

SEQ ID NO: 1219544 - RNA, 19 nt, Homo sapiens
cacacuaaccugaagagua

SEQ ID NO: 1219545 - RNA, 19 nt, Homo sapiens
gauacagaguuugauguca

SEQ ID NO: 1219546 - RNA, 19 nt, Homo sapiens
uaacuguucuagugggaau

SEQ ID NO: 1219547 - RNA, 19 nt, Homo sapiens
ggaaaacaaucagaugaga

SEQ ID NO: 1219548 - RNA, 19 nt, Homo sapiens
caucacaaaucuuuucuga

SEQ ID NO: 1219549 - RNA, 19 nt, Homo sapiens
guugggaguuugugaaucu

SEQ ID NO: 1219550 - RNA, 19 nt, Homo sapiens
guuuagaaaugcuccuaug

SEQ ID NO: 1219551 - RNA, 19 nt, Homo sapiens
cuucaaugaucucuuacuu

SEQ ID NO: 1219552 - RNA, 19 nt, Homo sapiens
cccaggaacaacuauaaua

SEQ ID NO: 1219553 - RNA, 19 nt, Homo sapiens
cagaugagaacaacagaug

SEQ ID NO: 1219554 - RNA, 19 nt, Homo sapiens
gguguugcuuugcuguaaa

SEQ ID NO: 1219555 - RNA, 19 nt, Homo sapiens
ccugauggcuauagaagag

SEQ ID NO: 1219556 - RNA, 19 nt, Homo sapiens
gaguacagacuacacuuca

SEQ ID NO: 1219557 - RNA, 19 nt, Homo sapiens
uauagaagagaccucauga

SEQ ID NO: 1219558 - RNA, 19 nt, Homo sapiens
gggaaugugggaauggaaa

SEQ ID NO: 1219559 - RNA, 19 nt, Homo sapiens
gaagaguacagacuacacu

SEQ ID NO: 1219560 - RNA, 19 nt, Homo sapiens
gcacccagaacugauauuc

SEQ ID NO: 1219561 - RNA, 19 nt, Homo sapiens
ggaguuugugaaucuauug

SEQ ID NO: 1219562 - RNA, 19 nt, Homo sapiens
ggaccugauggcuauagaa

SEQ ID NO: 1219563 - RNA, 19 nt, Homo sapiens
ggauacagaguuugauguc

SEQ ID NO: 1219564 - RNA, 19 nt, Homo sapiens
gaugucugcugugugugaa

SEQ ID NO: 1219565 - RNA, 19 nt, Homo sapiens
gguggguguuaccuggaua

SEQ ID NO: 1219566 - RNA, 19 nt, Homo sapiens
gcugaauaaacauaccuaa

SEQ ID NO: 1219567 - RNA, 19 nt, Homo sapiens
gaaaacaaucagaugagaa

SEQ ID NO: 1219568 - RNA, 19 nt, Homo sapiens
gcagguugggaguuuguga

SEQ ID NO: 1219569 - RNA, 19 nt, Homo sapiens
gggaaggugaucucagugu

SEQ ID NO: 1219570 - RNA, 19 nt, Homo sapiens
gccugcagguugggaguuu

SEQ ID NO: 1219571 - RNA, 19 nt, Homo sapiens
gcaggcagcacccagaacu

SEQ ID NO: 1219572 - RNA, 19 nt, Homo sapiens
acaaucagaugagaacaac

SEQ ID NO: 1219573 - RNA, 19 nt, Homo sapiens
ccucaugacagcuggaguu

SEQ ID NO: 1219574 - RNA, 19 nt, Homo sapiens
gacuacacuucaaugaucu

SEQ ID NO: 1219575 - RNA, 19 nt, Homo sapiens
gcuccuauguaucaguuuu

SEQ ID NO: 1219576 - RNA, 19 nt, Homo sapiens
cccaaucuuguaccaauuu

SEQ ID NO: 1219577 - RNA, 19 nt, Homo sapiens
ugguguugcuuugcuguaa

SEQ ID NO: 1219578 - RNA, 19 nt, Homo sapiens
gaccugauggcuauagaag

SEQ ID NO: 1219579 - RNA, 19 nt, Homo sapiens
acagacuacacuucaauga

SEQ ID NO: 1219580 - RNA, 19 nt, Homo sapiens
gggaccugcuggagcuuca

SEQ ID NO: 1219581 - RNA, 19 nt, Homo sapiens
ucacugguguugcuuugcu

SEQ ID NO: 1219582 - RNA, 19 nt, Homo sapiens
uguuugguguccuugguuu

SEQ ID NO: 1219583 - RNA, 19 nt, Homo sapiens
uauaagaagggcccaaguc

SEQ ID NO: 1219584 - RNA, 19 nt, Homo sapiens
gaugagaacaacagaugac

SEQ ID NO: 1219585 - RNA, 19 nt, Homo sapiens
cagacuacacuucaaugau

SEQ ID NO: 1219586 - RNA, 19 nt, Homo sapiens
ggaguucucuggggacugu

SEQ ID NO: 1219587 - RNA, 19 nt, Homo sapiens
gaucucuuacuugaauuug

SEQ ID NO: 1219588 - RNA, 19 nt, Homo sapiens
ugaacugggcugaauaaac

SEQ ID NO: 1219589 - RNA, 19 nt, Homo sapiens
gaguuugugaaucuauuga

SEQ ID NO: 1219590 - RNA, 19 nt, Homo sapiens
gugggaaugugggaaugga

SEQ ID NO: 1219591 - RNA, 19 nt, Homo sapiens
cuauagaagagaccucaug

SEQ ID NO: 1219592 - RNA, 19 nt, Homo sapiens
gaugucacccuugggaaca

SEQ ID NO: 1219593 - RNA, 19 nt, Homo sapiens
acacuaaggucaaauacuu

SEQ ID NO: 1219594 - RNA, 19 nt, Homo sapiens
ggacuucacugaggacuuc

SEQ ID NO: 1219595 - RNA, 19 nt, Homo sapiens
uaucgucacugccgaaauu

SEQ ID NO: 1219596 - RNA, 19 nt, Homo sapiens
ggaacacuaaggucaaaua

SEQ ID NO: 1219597 - RNA, 19 nt, Homo sapiens
gcaccaugcuggcuucaag

SEQ ID NO: 1219598 - RNA, 19 nt, Homo sapiens
gggcacuggugacagauga

SEQ ID NO: 1219599 - RNA, 19 nt, Homo sapiens
aaagggagaugacgauguc

SEQ ID NO: 1219600 - RNA, 19 nt, Homo sapiens
guagggaguuugaugacau

SEQ ID NO: 1219601 - RNA, 19 nt, Homo sapiens
ggaguggccuuuuaccaaa

SEQ ID NO: 1219602 - RNA, 19 nt, Homo sapiens
gggagaugacgaugucuuu

SEQ ID NO: 1219603 - RNA, 19 nt, Homo sapiens
cauggaagaugcugaacuc

SEQ ID NO: 1219604 - RNA, 19 nt, Homo sapiens
caggaacacuaaggucaaa

SEQ ID NO: 1219605 - RNA, 19 nt, Homo sapiens
gagaguagggaguuugaug

SEQ ID NO: 1219606 - RNA, 19 nt, Homo sapiens
gagaugacgaugucuuugu

SEQ ID NO: 1219607 - RNA, 19 nt, Homo sapiens
gccgaaauuucucuaucuu

SEQ ID NO: 1219608 - RNA, 19 nt, Homo sapiens
guacagggccacccacuac

SEQ ID NO: 1219609 - RNA, 19 nt, Homo sapiens
gaacacuaaggucaaauac

SEQ ID NO: 1219610 - RNA, 19 nt, Homo sapiens
ccaggcccauuucaugcua

SEQ ID NO: 1219611 - RNA, 19 nt, Homo sapiens
gcugaacucuuccccauug

SEQ ID NO: 1219612 - RNA, 19 nt, Homo sapiens
ugugcuggcuggucucgua

SEQ ID NO: 1219613 - RNA, 19 nt, Homo sapiens
ucacugaggacuucuucaa

SEQ ID NO: 1219614 - RNA, 19 nt, Homo sapiens
gaagcugguguuccuccua

SEQ ID NO: 1219615 - RNA, 19 nt, Homo sapiens
gcuaaagggagaugacgau

SEQ ID NO: 1219616 - RNA, 19 nt, Homo sapiens
caugcuggcuucaagacau

SEQ ID NO: 1219617 - RNA, 19 nt, Homo sapiens
ggagaugacgaugucuuug

SEQ ID NO: 1219618 - RNA, 19 nt, Homo sapiens
ucaggcuguuccaaggaua

SEQ ID NO: 1219619 - RNA, 19 nt, Homo sapiens
ugugggcacuggugacaga

SEQ ID NO: 1219620 - RNA, 19 nt, Homo sapiens
uaaagggagaugacgaugu

SEQ ID NO: 1219621 - RNA, 19 nt, Homo sapiens
uaucauggaagaugcugaa

SEQ ID NO: 1219622 - RNA, 19 nt, Homo sapiens
uugauucucuaucgugaug

SEQ ID NO: 1219623 - RNA, 19 nt, Homo sapiens
agaguagggaguuugauga

SEQ ID NO: 1219624 - RNA, 19 nt, Homo sapiens
gcuccuggccaucaaguca

SEQ ID NO: 1219625 - RNA, 19 nt, Homo sapiens
acucaguguugauucucua

SEQ ID NO: 1219626 - RNA, 19 nt, Homo sapiens
cauugaugaugucuuugug

SEQ ID NO: 1219627 - RNA, 19 nt, Homo sapiens
ucucuaucgugaugcgaaa

SEQ ID NO: 1219628 - RNA, 19 nt, Homo sapiens
uaaggucaaauacuucauc

SEQ ID NO: 1219629 - RNA, 19 nt, Homo sapiens
agaugacgaugucuuuguc

SEQ ID NO: 1219630 - RNA, 19 nt, Homo sapiens
ccauugaugaugucuuugu

SEQ ID NO: 1219631 - RNA, 19 nt, Homo sapiens
cugcuggccuaugagagua

SEQ ID NO: 1219632 - RNA, 19 nt, Homo sapiens
gaaauuucucuaucuugcu

SEQ ID NO: 1219633 - RNA, 19 nt, Homo sapiens
ugccgaaauuucucuaucu

SEQ ID NO: 1219634 - RNA, 19 nt, Homo sapiens
cucgagauguggaccaugu

SEQ ID NO: 1219635 - RNA, 19 nt, Homo sapiens
caaagggaccggcgaugcu

SEQ ID NO: 1219636 - RNA, 19 nt, Homo sapiens
gcugcuggccuaugagagu

SEQ ID NO: 1219637 - RNA, 19 nt, Homo sapiens
guacacagcugaagaaaga

SEQ ID NO: 1219638 - RNA, 19 nt, Homo sapiens
gaaguagacugaaauauca

SEQ ID NO: 1219639 - RNA, 19 nt, Homo sapiens
gagaauuccuugagucuaa

SEQ ID NO: 1219640 - RNA, 19 nt, Homo sapiens
gauaucacaugaagaagua

SEQ ID NO: 1219641 - RNA, 19 nt, Homo sapiens
ccaaguaccugaaagagaa

SEQ ID NO: 1219642 - RNA, 19 nt, Homo sapiens
gaaagugcguuacagaugu

SEQ ID NO: 1219643 - RNA, 19 nt, Homo sapiens
gaagaaguagacugaaaua

SEQ ID NO: 1219644 - RNA, 19 nt, Homo sapiens
gagaucaguuggaaagaaa

SEQ ID NO: 1219645 - RNA, 19 nt, Homo sapiens
gauaaguggugauguuguu

SEQ ID NO: 1219646 - RNA, 19 nt, Homo sapiens
ccgaguagcugaaauuguu

SEQ ID NO: 1219647 - RNA, 19 nt, Homo sapiens
aaagauaaguggugauguu

SEQ ID NO: 1219648 - RNA, 19 nt, Homo sapiens
caaggcagauggagcauug

SEQ ID NO: 1219649 - RNA, 19 nt, Homo sapiens
gauaaacugugcauguguu

SEQ ID NO: 1219650 - RNA, 19 nt, Homo sapiens
ggagaucaguuggaaagaa

SEQ ID NO: 1219651 - RNA, 19 nt, Homo sapiens
uacaggagauuacaacgua

SEQ ID NO: 1219652 - RNA, 19 nt, Homo sapiens
uagaaagacuacugucaaa

SEQ ID NO: 1219653 - RNA, 19 nt, Homo sapiens
gaaauucccaauccaguga

SEQ ID NO: 1219654 - RNA, 19 nt, Homo sapiens
ggugugaccuggaagaaau

SEQ ID NO: 1219655 - RNA, 19 nt, Homo sapiens
cuaggaagauguugcuauu

SEQ ID NO: 1219656 - RNA, 19 nt, Homo sapiens
gagccaagcuacuguacug

SEQ ID NO: 1219657 - RNA, 19 nt, Homo sapiens
uuguugagcugcugaaaua

SEQ ID NO: 1219658 - RNA, 19 nt, Homo sapiens
gggaauuccugguuugaga

SEQ ID NO: 1219659 - RNA, 19 nt, Homo sapiens
ggaaagugcguuacagaug

SEQ ID NO: 1219660 - RNA, 19 nt, Homo sapiens
gcaugggaauuccugguuu

SEQ ID NO: 1219661 - RNA, 19 nt, Homo sapiens
guaaacagccuaaagaaac

SEQ ID NO: 1219662 - RNA, 19 nt, Homo sapiens
guggugauguuguuucaaa

SEQ ID NO: 1219663 - RNA, 19 nt, Homo sapiens
gaaagaugaagaagaacaa

SEQ ID NO: 1219664 - RNA, 19 nt, Homo sapiens
agagguaacuguugucugu

SEQ ID NO: 1219665 - RNA, 19 nt, Homo sapiens
gaagaagaacaaauacuag

SEQ ID NO: 1219666 - RNA, 19 nt, Homo sapiens
acucuuagguuuacugcua

SEQ ID NO: 1219667 - RNA, 19 nt, Homo sapiens
gcucacagcuauugacaac

SEQ ID NO: 1219668 - RNA, 19 nt, Homo sapiens
caccaaagcugcugagaac

SEQ ID NO: 1219669 - RNA, 19 nt, Homo sapiens
ccacgugccuguagcuuca

SEQ ID NO: 1219670 - RNA, 19 nt, Homo sapiens
ggaauuguucagcaaauga

SEQ ID NO: 1219671 - RNA, 19 nt, Homo sapiens
gggcuguccuacucuguuu

SEQ ID NO: 1219672 - RNA, 19 nt, Homo sapiens
ggacaccacugcccaagcu

SEQ ID NO: 1219673 - RNA, 19 nt, Homo sapiens
cuacuguacugagugcuua

SEQ ID NO: 1219674 - RNA, 19 nt, Homo sapiens
caaccgaguagcugaaauu

SEQ ID NO: 1219675 - RNA, 19 nt, Homo sapiens
gugcauguguuuccacuuc

SEQ ID NO: 1219676 - RNA, 19 nt, Homo sapiens
gcaucauccuugacaguga

SEQ ID NO: 1219677 - RNA, 19 nt, Homo sapiens
gcaccaaguaccugaaaga

SEQ ID NO: 1219678 - RNA, 19 nt, Homo sapiens
gaacaaauacuagccaaaa

SEQ ID NO: 1219679 - RNA, 19 nt, Homo sapiens
gucaaaggacguuggaaua

SEQ ID NO: 1219680 - RNA, 19 nt, Homo sapiens
cagaacagauaccaucauc

SEQ ID NO: 1219681 - RNA, 19 nt, Homo sapiens
aaagauaaacugugcaugu

SEQ ID NO: 1219682 - RNA, 19 nt, Homo sapiens
gaacagauaccaucauccu

SEQ ID NO: 1219683 - RNA, 19 nt, Homo sapiens
ggaauacucuuugucuacu

SEQ ID NO: 1219684 - RNA, 19 nt, Homo sapiens
caggaauacucuuugucua

SEQ ID NO: 1219685 - RNA, 19 nt, Homo sapiens
aggaagauguugcuauuca

SEQ ID NO: 1219686 - RNA, 19 nt, Homo sapiens
aaacuuccauuugguacaa

SEQ ID NO: 1219687 - RNA, 19 nt, Homo sapiens
ccacuuccguuucuaguac

SEQ ID NO: 1219688 - RNA, 19 nt, Homo sapiens
caucaggaauacucuuugu

SEQ ID NO: 1219689 - RNA, 19 nt, Homo sapiens
gaccuaaacaccauagaau

SEQ ID NO: 1219690 - RNA, 19 nt, Homo sapiens
caucauccugccuuuguua

SEQ ID NO: 1219691 - RNA, 19 nt, Homo sapiens
ucacagcuauugacaacca

SEQ ID NO: 1219692 - RNA, 19 nt, Homo sapiens
ccagugagaaggccauaaa

SEQ ID NO: 1219693 - RNA, 19 nt, Homo sapiens
ccaaagcugcugagaacaa

SEQ ID NO: 1219694 - RNA, 19 nt, Homo sapiens
uaaacagccuaaagaaacu

SEQ ID NO: 1219695 - RNA, 19 nt, Homo sapiens
ucagauuugucaucaggaa

SEQ ID NO: 1219696 - RNA, 19 nt, Homo sapiens
agaaguagacugaaauauc

SEQ ID NO: 1219697 - RNA, 19 nt, Homo sapiens
uagcugaaauuguuuacuc

SEQ ID NO: 1219698 - RNA, 19 nt, Homo sapiens
gggaauuguucagcaaaug

SEQ ID NO: 1219699 - RNA, 19 nt, Homo sapiens
ccauuuguuuggagaggua

SEQ ID NO: 1219700 - RNA, 19 nt, Homo sapiens
guagcagcaucauccuuga

SEQ ID NO: 1219701 - RNA, 19 nt, Homo sapiens
gggacuuccucauucuuug

SEQ ID NO: 1219702 - RNA, 19 nt, Homo sapiens
ccuagaugaugaugaccua

SEQ ID NO: 1219703 - RNA, 19 nt, Homo sapiens
guaaagauaaguggugaug

SEQ ID NO: 1219704 - RNA, 19 nt, Homo sapiens
uaacugagggucucuccuu

SEQ ID NO: 1219705 - RNA, 19 nt, Homo sapiens
gaagccagcaugggaauuc

SEQ ID NO: 1219706 - RNA, 19 nt, Homo sapiens
ggucaaaggacguuggaau

SEQ ID NO: 1219707 - RNA, 19 nt, Homo sapiens
guuagcugcuguagggaaa

SEQ ID NO: 1219708 - RNA, 19 nt, Homo sapiens
guacugagugcuuauucuu

SEQ ID NO: 1219709 - RNA, 19 nt, Homo sapiens
ccuaaacaccauagaauuc

SEQ ID NO: 1219710 - RNA, 19 nt, Homo sapiens
gauguugcuauucacguua

SEQ ID NO: 1219711 - RNA, 19 nt, Homo sapiens
gaugucugcugaccucaca

SEQ ID NO: 1219712 - RNA, 19 nt, Homo sapiens
ggauaucacaugaagaagu

SEQ ID NO: 1219713 - RNA, 19 nt, Homo sapiens
aagauaaacugugcaugug

SEQ ID NO: 1219714 - RNA, 19 nt, Homo sapiens
gaaccugaggaaaucugua

SEQ ID NO: 1219715 - RNA, 19 nt, Homo sapiens
caugggaauuccugguuug

SEQ ID NO: 1219716 - RNA, 19 nt, Homo sapiens
gggagaaucagaggucaaa

SEQ ID NO: 1219717 - RNA, 19 nt, Homo sapiens
gaguagcugaaauuguuua

SEQ ID NO: 1219718 - RNA, 19 nt, Homo sapiens
ucaaaauccucgccuacua

SEQ ID NO: 1219719 - RNA, 19 nt, Homo sapiens
gucauggccuugcagaaau

SEQ ID NO: 1219720 - RNA, 19 nt, Homo sapiens
gcugagaacaagaaguuug

SEQ ID NO: 1219721 - RNA, 19 nt, Homo sapiens
guucgucuccagcucauaa

SEQ ID NO: 1219722 - RNA, 19 nt, Homo sapiens
augaagaaguagacugaaa

SEQ ID NO: 1219723 - RNA, 19 nt, Homo sapiens
ccaaagucauuuccauugc

SEQ ID NO: 1219724 - RNA, 19 nt, Homo sapiens
caaagcugcugagaacaag

SEQ ID NO: 1219725 - RNA, 19 nt, Homo sapiens
ggacuacaggagauuacaa

SEQ ID NO: 1219726 - RNA, 19 nt, Homo sapiens
gauggacuacaggagauua

SEQ ID NO: 1219727 - RNA, 19 nt, Homo sapiens
cagauggacuacaggagau

SEQ ID NO: 1219728 - RNA, 19 nt, Homo sapiens
gaauacucuuugucuacug

SEQ ID NO: 1219729 - RNA, 19 nt, Homo sapiens
ugggauaucacaugaagaa

SEQ ID NO: 1219730 - RNA, 19 nt, Homo sapiens
acaccagcauccaggguuu

SEQ ID NO: 1219731 - RNA, 19 nt, Homo sapiens
cuaagaaagaugaagaaga

SEQ ID NO: 1219732 - RNA, 19 nt, Homo sapiens
ucauggccuugcagaaauu

SEQ ID NO: 1219733 - RNA, 19 nt, Homo sapiens
cugaggaaaucuguaaaga

SEQ ID NO: 1219734 - RNA, 19 nt, Homo sapiens
ugaagaaguagacugaaau

SEQ ID NO: 1219735 - RNA, 19 nt, Homo sapiens
aggcugcccuuguaauaga

SEQ ID NO: 1219736 - RNA, 19 nt, Homo sapiens
acacagcugaagaaagaua

SEQ ID NO: 1219737 - RNA, 19 nt, Homo sapiens
aaagaaagcugaagaaaga

SEQ ID NO: 1219738 - RNA, 19 nt, Homo sapiens
gaaguagacugaaauauca

SEQ ID NO: 1219739 - RNA, 19 nt, Homo sapiens
gagaauuccuugagucuaa

SEQ ID NO: 1219740 - RNA, 19 nt, Homo sapiens
gauaucacaugaagaagua

SEQ ID NO: 1219741 - RNA, 19 nt, Homo sapiens
ccaaguaccugaaagagaa

SEQ ID NO: 1219742 - RNA, 19 nt, Homo sapiens
gaaagugcguuacagaugu

SEQ ID NO: 1219743 - RNA, 19 nt, Homo sapiens
gaagaaguagacugaaaua

SEQ ID NO: 1219744 - RNA, 19 nt, Homo sapiens
gagaucaguuggaaagaaa

SEQ ID NO: 1219745 - RNA, 19 nt, Homo sapiens
gauaaguggugauguuguu

SEQ ID NO: 1219746 - RNA, 19 nt, Homo sapiens
ccgaguagcugaaauuguu

SEQ ID NO: 1219747 - RNA, 19 nt, Homo sapiens
aaagauaaguggugauguu

SEQ ID NO: 1219748 - RNA, 19 nt, Homo sapiens
caaggcagauggagcauug

SEQ ID NO: 1219749 - RNA, 19 nt, Homo sapiens
gauaaacugugcauguguu

SEQ ID NO: 1219750 - RNA, 19 nt, Homo sapiens
ggagaucaguuggaaagaa

SEQ ID NO: 1219751 - RNA, 19 nt, Homo sapiens
gaaagaaagcugaagaaag

SEQ ID NO: 1219752 - RNA, 19 nt, Homo sapiens
uacaggagauuacaacgua

SEQ ID NO: 1219753 - RNA, 19 nt, Homo sapiens
uagaaagacuacugucaaa

SEQ ID NO: 1219754 - RNA, 19 nt, Homo sapiens
gaaauucccaauccaguga

SEQ ID NO: 1219755 - RNA, 19 nt, Homo sapiens
ggugugaccuggaagaaau

SEQ ID NO: 1219756 - RNA, 19 nt, Homo sapiens
cuaggaagauguugcuauu

SEQ ID NO: 1219757 - RNA, 19 nt, Homo sapiens
gaaagcugaagaaagauaa

SEQ ID NO: 1219758 - RNA, 19 nt, Homo sapiens
ggaaagaaagcugaagaaa

SEQ ID NO: 1219759 - RNA, 19 nt, Homo sapiens
uuguugagcugcugaaaua

SEQ ID NO: 1219760 - RNA, 19 nt, Homo sapiens
gggaauuccugguuugaga

SEQ ID NO: 1219761 - RNA, 19 nt, Homo sapiens
ggaaagugcguuacagaug

SEQ ID NO: 1219762 - RNA, 19 nt, Homo sapiens
gcaugggaauuccugguuu

SEQ ID NO: 1219763 - RNA, 19 nt, Homo sapiens
guaaacagccuaaagaaac

SEQ ID NO: 1219764 - RNA, 19 nt, Homo sapiens
guggugauguuguuucaaa

SEQ ID NO: 1219765 - RNA, 19 nt, Homo sapiens
gaaagaugaagaagaacaa

SEQ ID NO: 1219766 - RNA, 19 nt, Homo sapiens
agagguaacuguugucugu

SEQ ID NO: 1219767 - RNA, 19 nt, Homo sapiens
gaagaagaacaaauacuag

SEQ ID NO: 1219768 - RNA, 19 nt, Homo sapiens
acucuuagguuuacugcua

SEQ ID NO: 1219769 - RNA, 19 nt, Homo sapiens
gcucacagcuauugacaac

SEQ ID NO: 1219770 - RNA, 19 nt, Homo sapiens
caccaaagcugcugagaac

SEQ ID NO: 1219771 - RNA, 19 nt, Homo sapiens
ccacgugccuguagcuuca

SEQ ID NO: 1219772 - RNA, 19 nt, Homo sapiens
ggaauuguucagcaaauga

SEQ ID NO: 1219773 - RNA, 19 nt, Homo sapiens
gggcuguccuacucuguuu

SEQ ID NO: 1219774 - RNA, 19 nt, Homo sapiens
ggacaccacugcccaagcu

SEQ ID NO: 1219775 - RNA, 19 nt, Homo sapiens
caaccgaguagcugaaauu

SEQ ID NO: 1219776 - RNA, 19 nt, Homo sapiens
gugcauguguuuccacuuc

SEQ ID NO: 1219777 - RNA, 19 nt, Homo sapiens
gcaucauccuugacaguga

SEQ ID NO: 1219778 - RNA, 19 nt, Homo sapiens
gcaccaaguaccugaaaga

SEQ ID NO: 1219779 - RNA, 19 nt, Homo sapiens
gaacaaauacuagccaaaa

SEQ ID NO: 1219780 - RNA, 19 nt, Homo sapiens
gucaaaggacguuggaaua

SEQ ID NO: 1219781 - RNA, 19 nt, Homo sapiens
cagaacagauaccaucauc

SEQ ID NO: 1219782 - RNA, 19 nt, Homo sapiens
aaagauaaacugugcaugu

SEQ ID NO: 1219783 - RNA, 19 nt, Homo sapiens
gaacagauaccaucauccu

SEQ ID NO: 1219784 - RNA, 19 nt, Homo sapiens
ggaauacucuuugucuacu

SEQ ID NO: 1219785 - RNA, 19 nt, Homo sapiens
caggaauacucuuugucua

SEQ ID NO: 1219786 - RNA, 19 nt, Homo sapiens
aggaagauguugcuauuca

SEQ ID NO: 1219787 - RNA, 19 nt, Homo sapiens
aaacuuccauuugguacaa

SEQ ID NO: 1219788 - RNA, 19 nt, Homo sapiens
ccacuuccguuucuaguac

SEQ ID NO: 1219789 - RNA, 19 nt, Homo sapiens
caucaggaauacucuuugu

SEQ ID NO: 1219790 - RNA, 19 nt, Homo sapiens
gaccuaaacaccauagaau

SEQ ID NO: 1219791 - RNA, 19 nt, Homo sapiens
caucauccugccuuuguua

SEQ ID NO: 1219792 - RNA, 19 nt, Homo sapiens
ucacagcuauugacaacca

SEQ ID NO: 1219793 - RNA, 19 nt, Homo sapiens
ccagugagaaggccauaaa

SEQ ID NO: 1219794 - RNA, 19 nt, Homo sapiens
ccaaagcugcugagaacaa

SEQ ID NO: 1219795 - RNA, 19 nt, Homo sapiens
uaaacagccuaaagaaacu

SEQ ID NO: 1219796 - RNA, 19 nt, Homo sapiens
ucagauuugucaucaggaa

SEQ ID NO: 1219797 - RNA, 19 nt, Homo sapiens
agaaguagacugaaauauc

SEQ ID NO: 1219798 - RNA, 19 nt, Homo sapiens
uagcugaaauuguuuacuc

SEQ ID NO: 1219799 - RNA, 19 nt, Homo sapiens
gggaauuguucagcaaaug

SEQ ID NO: 1219800 - RNA, 19 nt, Homo sapiens
ccauuuguuuggagaggua

SEQ ID NO: 1219801 - RNA, 19 nt, Homo sapiens
guagcagcaucauccuuga

SEQ ID NO: 1219802 - RNA, 19 nt, Homo sapiens
gggacuuccucauucuuug

SEQ ID NO: 1219803 - RNA, 19 nt, Homo sapiens
ccuagaugaugaugaccua

SEQ ID NO: 1219804 - RNA, 19 nt, Homo sapiens
guaaagauaaguggugaug

SEQ ID NO: 1219805 - RNA, 19 nt, Homo sapiens
uaacugagggucucuccuu

SEQ ID NO: 1219806 - RNA, 19 nt, Homo sapiens
gaagccagcaugggaauuc

SEQ ID NO: 1219807 - RNA, 19 nt, Homo sapiens
ggucaaaggacguuggaau

SEQ ID NO: 1219808 - RNA, 19 nt, Homo sapiens
guuagcugcuguagggaaa

SEQ ID NO: 1219809 - RNA, 19 nt, Homo sapiens
gauguugcuauucacguua

SEQ ID NO: 1219810 - RNA, 19 nt, Homo sapiens
gaugucugcugaccucaca

SEQ ID NO: 1219811 - RNA, 19 nt, Homo sapiens
ggauaucacaugaagaagu

SEQ ID NO: 1219812 - RNA, 19 nt, Homo sapiens
ccuaaacaccauagaauuc

SEQ ID NO: 1219813 - RNA, 19 nt, Homo sapiens
aagauaaacugugcaugug

SEQ ID NO: 1219814 - RNA, 19 nt, Homo sapiens
gaaccugaggaaaucugua

SEQ ID NO: 1219815 - RNA, 19 nt, Homo sapiens
gggagaaucagaggucaaa

SEQ ID NO: 1219816 - RNA, 19 nt, Homo sapiens
agaaagcugaagaaagaua

SEQ ID NO: 1219817 - RNA, 19 nt, Homo sapiens
caugggaauuccugguuug

SEQ ID NO: 1219818 - RNA, 19 nt, Homo sapiens
ucaaaauccucgccuacua

SEQ ID NO: 1219819 - RNA, 19 nt, Homo sapiens
gaguagcugaaauuguuua

SEQ ID NO: 1219820 - RNA, 19 nt, Homo sapiens
gucauggccuugcagaaau

SEQ ID NO: 1219821 - RNA, 19 nt, Homo sapiens
gcugagaacaagaaguuug

SEQ ID NO: 1219822 - RNA, 19 nt, Homo sapiens
guucgucuccagcucauaa

SEQ ID NO: 1219823 - RNA, 19 nt, Homo sapiens
augaagaaguagacugaaa

SEQ ID NO: 1219824 - RNA, 19 nt, Homo sapiens
ccaaagucauuuccauugc

SEQ ID NO: 1219825 - RNA, 19 nt, Homo sapiens
caaagcugcugagaacaag

SEQ ID NO: 1219826 - RNA, 19 nt, Homo sapiens
ggacuacaggagauuacaa

SEQ ID NO: 1219827 - RNA, 19 nt, Homo sapiens
gauggacuacaggagauua

SEQ ID NO: 1219828 - RNA, 19 nt, Homo sapiens
cagauggacuacaggagau

SEQ ID NO: 1219829 - RNA, 19 nt, Homo sapiens
gaauacucuuugucuacug

SEQ ID NO: 1219830 - RNA, 19 nt, Homo sapiens
ugggauaucacaugaagaa

SEQ ID NO: 1219831 - RNA, 19 nt, Homo sapiens
cuaagaaagaugaagaaga

SEQ ID NO: 1219832 - RNA, 19 nt, Homo sapiens
ucauggccuugcagaaauu

SEQ ID NO: 1219833 - RNA, 19 nt, Homo sapiens
cugaggaaaucuguaaaga

SEQ ID NO: 1219834 - RNA, 19 nt, Homo sapiens
ugaagaaguagacugaaau

SEQ ID NO: 1219835 - RNA, 19 nt, Homo sapiens
aggcugcccuuguaauaga

SEQ ID NO: 1219836 - RNA, 19 nt, Homo sapiens
gccuguagcuucaaguucu

SEQ ID NO: 1219837 - RNA, 19 nt, Homo sapiens
aaagaaagcugaagaaaga

SEQ ID NO: 1219838 - RNA, 19 nt, Homo sapiens
gaaguagacugaaauauca

SEQ ID NO: 1219839 - RNA, 19 nt, Homo sapiens
gaagaccuguugaaaguuu

SEQ ID NO: 1219840 - RNA, 19 nt, Homo sapiens
gauaucacaugaagaagua

SEQ ID NO: 1219841 - RNA, 19 nt, Homo sapiens
ccaaguaccugaaagagaa

SEQ ID NO: 1219842 - RNA, 19 nt, Homo sapiens
ggagagagacucagguaua

SEQ ID NO: 1219843 - RNA, 19 nt, Homo sapiens
gaaagugcguuacagaugu

SEQ ID NO: 1219844 - RNA, 19 nt, Homo sapiens
gaagaaguagacugaaaua

SEQ ID NO: 1219845 - RNA, 19 nt, Homo sapiens
gagaucaguuggaaagaaa

SEQ ID NO: 1219846 - RNA, 19 nt, Homo sapiens
agacucagguauagaaaua

SEQ ID NO: 1219847 - RNA, 19 nt, Homo sapiens
gauaaguggugauguuguu

SEQ ID NO: 1219848 - RNA, 19 nt, Homo sapiens
ccgaguagcugaaauuguu

SEQ ID NO: 1219849 - RNA, 19 nt, Homo sapiens
aaagauaaguggugauguu

SEQ ID NO: 1219850 - RNA, 19 nt, Homo sapiens
caaggcagauggagcauug

SEQ ID NO: 1219851 - RNA, 19 nt, Homo sapiens
gauaaacugugcauguguu

SEQ ID NO: 1219852 - RNA, 19 nt, Homo sapiens
ggagaucaguuggaaagaa

SEQ ID NO: 1219853 - RNA, 19 nt, Homo sapiens
gaaagaaagcugaagaaag

SEQ ID NO: 1219854 - RNA, 19 nt, Homo sapiens
uacaggagauuacaacgua

SEQ ID NO: 1219855 - RNA, 19 nt, Homo sapiens
uagaaagacuacugucaaa

SEQ ID NO: 1219856 - RNA, 19 nt, Homo sapiens
aagaagaccuguugaaagu

SEQ ID NO: 1219857 - RNA, 19 nt, Homo sapiens
gaaauucccaauccaguga

SEQ ID NO: 1219858 - RNA, 19 nt, Homo sapiens
ggugugaccuggaagaaau

SEQ ID NO: 1219859 - RNA, 19 nt, Homo sapiens
cuaggaagauguugcuauu

SEQ ID NO: 1219860 - RNA, 19 nt, Homo sapiens
gaaagcugaagaaagauaa

SEQ ID NO: 1219861 - RNA, 19 nt, Homo sapiens
ggaaagaaagcugaagaaa

SEQ ID NO: 1219862 - RNA, 19 nt, Homo sapiens
uuguugagcugcugaaaua

SEQ ID NO: 1219863 - RNA, 19 nt, Homo sapiens
gagagagacucagguauag

SEQ ID NO: 1219864 - RNA, 19 nt, Homo sapiens
ggaaagugcguuacagaug

SEQ ID NO: 1219865 - RNA, 19 nt, Homo sapiens
guaaacagccuaaagaaac

SEQ ID NO: 1219866 - RNA, 19 nt, Homo sapiens
guggugauguuguuucaaa

SEQ ID NO: 1219867 - RNA, 19 nt, Homo sapiens
gaaagaugaagaagaacaa

SEQ ID NO: 1219868 - RNA, 19 nt, Homo sapiens
agagguaacuguugucugu

SEQ ID NO: 1219869 - RNA, 19 nt, Homo sapiens
gaagaagaacaaauacuag

SEQ ID NO: 1219870 - RNA, 19 nt, Homo sapiens
caccugaccugaagcagaa

SEQ ID NO: 1219871 - RNA, 19 nt, Homo sapiens
acucuuagguuuacugcua

SEQ ID NO: 1219872 - RNA, 19 nt, Homo sapiens
gcucacagcuauugacaac

SEQ ID NO: 1219873 - RNA, 19 nt, Homo sapiens
caccaaagcugcugagaac

SEQ ID NO: 1219874 - RNA, 19 nt, Homo sapiens
gagagacucagguauagaa

SEQ ID NO: 1219875 - RNA, 19 nt, Homo sapiens
uaaacuaccugagucuuuc

SEQ ID NO: 1219876 - RNA, 19 nt, Homo sapiens
ccacgugccuguagcuuca

SEQ ID NO: 1219877 - RNA, 19 nt, Homo sapiens
ggaauuguucagcaaauga

SEQ ID NO: 1219878 - RNA, 19 nt, Homo sapiens
gggcuguccuacucuguuu

SEQ ID NO: 1219879 - RNA, 19 nt, Homo sapiens
ccaagaagaccuguugaaa

SEQ ID NO: 1219880 - RNA, 19 nt, Homo sapiens
caaccgaguagcugaaauu

SEQ ID NO: 1219881 - RNA, 19 nt, Homo sapiens
gugcauguguuuccacuuc

SEQ ID NO: 1219882 - RNA, 19 nt, Homo sapiens
gcaucauccuugacaguga

SEQ ID NO: 1219883 - RNA, 19 nt, Homo sapiens
gcaccaaguaccugaaaga

SEQ ID NO: 1219884 - RNA, 19 nt, Homo sapiens
gaacaaauacuagccaaaa

SEQ ID NO: 1219885 - RNA, 19 nt, Homo sapiens
gucaaaggacguuggaaua

SEQ ID NO: 1219886 - RNA, 19 nt, Homo sapiens
cagaacagauaccaucauc

SEQ ID NO: 1219887 - RNA, 19 nt, Homo sapiens
caagaagaccuguugaaag

SEQ ID NO: 1219888 - RNA, 19 nt, Homo sapiens
aaagauaaacugugcaugu

SEQ ID NO: 1219889 - RNA, 19 nt, Homo sapiens
gaacagauaccaucauccu

SEQ ID NO: 1219890 - RNA, 19 nt, Homo sapiens
ggaauacucuuugucuacu

SEQ ID NO: 1219891 - RNA, 19 nt, Homo sapiens
caggaauacucuuugucua

SEQ ID NO: 1219892 - RNA, 19 nt, Homo sapiens
aggaagauguugcuauuca

SEQ ID NO: 1219893 - RNA, 19 nt, Homo sapiens
aaacuuccauuugguacaa

SEQ ID NO: 1219894 - RNA, 19 nt, Homo sapiens
ccacuuccguuucuaguac

SEQ ID NO: 1219895 - RNA, 19 nt, Homo sapiens
caucaggaauacucuuugu

SEQ ID NO: 1219896 - RNA, 19 nt, Homo sapiens
gaccuaaacaccauagaau

SEQ ID NO: 1219897 - RNA, 19 nt, Homo sapiens
caucauccugccuuuguua

SEQ ID NO: 1219898 - RNA, 19 nt, Homo sapiens
ucacagcuauugacaacca

SEQ ID NO: 1219899 - RNA, 19 nt, Homo sapiens
ccagugagaaggccauaaa

SEQ ID NO: 1219900 - RNA, 19 nt, Homo sapiens
ccaaagcugcugagaacaa

SEQ ID NO: 1219901 - RNA, 19 nt, Homo sapiens
uaaacagccuaaagaaacu

SEQ ID NO: 1219902 - RNA, 19 nt, Homo sapiens
ucagauuugucaucaggaa

SEQ ID NO: 1219903 - RNA, 19 nt, Homo sapiens
agaaguagacugaaauauc

SEQ ID NO: 1219904 - RNA, 19 nt, Homo sapiens
uagcugaaauuguuuacuc

SEQ ID NO: 1219905 - RNA, 19 nt, Homo sapiens
gggaauuguucagcaaaug

SEQ ID NO: 1219906 - RNA, 19 nt, Homo sapiens
ccauuuguuuggagaggua

SEQ ID NO: 1219907 - RNA, 19 nt, Homo sapiens
guagcagcaucauccuuga

SEQ ID NO: 1219908 - RNA, 19 nt, Homo sapiens
gggacuuccucauucuuug

SEQ ID NO: 1219909 - RNA, 19 nt, Homo sapiens
guaaagauaaguggugaug

SEQ ID NO: 1219910 - RNA, 19 nt, Homo sapiens
cuaaacuaccugagucuuu

SEQ ID NO: 1219911 - RNA, 19 nt, Homo sapiens
uaacugagggucucuccuu

SEQ ID NO: 1219912 - RNA, 19 nt, Homo sapiens
ggucaaaggacguuggaau

SEQ ID NO: 1219913 - RNA, 19 nt, Homo sapiens
ccuagaugaugaugaccua

SEQ ID NO: 1219914 - RNA, 19 nt, Homo sapiens
guuagcugcuguagggaaa

SEQ ID NO: 1219915 - RNA, 19 nt, Homo sapiens
uaaguuucguggagagaga

SEQ ID NO: 1219916 - RNA, 19 nt, Homo sapiens
gauguugcuauucacguua

SEQ ID NO: 1219917 - RNA, 19 nt, Homo sapiens
gaugucugcugaccucaca

SEQ ID NO: 1219918 - RNA, 19 nt, Homo sapiens
ggauaucacaugaagaagu

SEQ ID NO: 1219919 - RNA, 19 nt, Homo sapiens
ccuaaacaccauagaauuc

SEQ ID NO: 1219920 - RNA, 19 nt, Homo sapiens
aagauaaacugugcaugug

SEQ ID NO: 1219921 - RNA, 19 nt, Homo sapiens
gaaccugaggaaaucugua

SEQ ID NO: 1219922 - RNA, 19 nt, Homo sapiens
gggagaaucagaggucaaa

SEQ ID NO: 1219923 - RNA, 19 nt, Homo sapiens
agaaagcugaagaaagaua

SEQ ID NO: 1219924 - RNA, 19 nt, Homo sapiens
gaguagcugaaauuguuua

SEQ ID NO: 1219925 - RNA, 19 nt, Homo sapiens
gucauggccuugcagaaau

SEQ ID NO: 1219926 - RNA, 19 nt, Homo sapiens
gcugagaacaagaaguuug

SEQ ID NO: 1219927 - RNA, 19 nt, Homo sapiens
ucaaaauccucgccuacua

SEQ ID NO: 1219928 - RNA, 19 nt, Homo sapiens
cuaccugagucuuuccaaa

SEQ ID NO: 1219929 - RNA, 19 nt, Homo sapiens
gcagaagaaaucacagaca

SEQ ID NO: 1219930 - RNA, 19 nt, Homo sapiens
guucgucuccagcucauaa

SEQ ID NO: 1219931 - RNA, 19 nt, Homo sapiens
augaagaaguagacugaaa

SEQ ID NO: 1219932 - RNA, 19 nt, Homo sapiens
ccaaagucauuuccauugc

SEQ ID NO: 1219933 - RNA, 19 nt, Homo sapiens
caaagcugcugagaacaag

SEQ ID NO: 1219934 - RNA, 19 nt, Homo sapiens
ggacuacaggagauuacaa

SEQ ID NO: 1219935 - RNA, 19 nt, Homo sapiens
gauggacuacaggagauua

SEQ ID NO: 1219936 - RNA, 19 nt, Homo sapiens
cagauggacuacaggagau

SEQ ID NO: 1219937 - RNA, 19 nt, Homo sapiens
gaagaaaucggaccuacuu

SEQ ID NO: 1219938 - RNA, 19 nt, Homo sapiens
gcacugcugucaaauccua

SEQ ID NO: 1219939 - RNA, 19 nt, Homo sapiens
gaguauaccugaggcauuu

SEQ ID NO: 1219940 - RNA, 19 nt, Homo sapiens
gagaucaguuggaaagaaa

SEQ ID NO: 1219941 - RNA, 19 nt, Homo sapiens
aaacaagcauuugggaaua

SEQ ID NO: 1219942 - RNA, 19 nt, Homo sapiens
ccgaguagcugaaauuguu

SEQ ID NO: 1219943 - RNA, 19 nt, Homo sapiens
gaagaggaguuugaagaau

SEQ ID NO: 1219944 - RNA, 19 nt, Homo sapiens
ggagaucaguuggaaagaa

SEQ ID NO: 1219945 - RNA, 19 nt, Homo sapiens
cagcaaagaccaagauaaa

SEQ ID NO: 1219946 - RNA, 19 nt, Homo sapiens
agacagagaaaguagauua

SEQ ID NO: 1219947 - RNA, 19 nt, Homo sapiens
ggauuucugcuuccuaaua

SEQ ID NO: 1219948 - RNA, 19 nt, Homo sapiens
aagaacagcuucacucuca

SEQ ID NO: 1219949 - RNA, 19 nt, Homo sapiens
gaaauucccaauccaguga

SEQ ID NO: 1219950 - RNA, 19 nt, Homo sapiens
ggugugaccuggaagaaau

SEQ ID NO: 1219951 - RNA, 19 nt, Homo sapiens
uuguugagcugcugaaaua

SEQ ID NO: 1219952 - RNA, 19 nt, Homo sapiens
aagaggaguuugaagaauu

SEQ ID NO: 1219953 - RNA, 19 nt, Homo sapiens
gaaagaugaagaagaacaa

SEQ ID NO: 1219954 - RNA, 19 nt, Homo sapiens
uagauuaggcuuuaaguga

SEQ ID NO: 1219955 - RNA, 19 nt, Homo sapiens
gaagaagaacaaauacuag

SEQ ID NO: 1219956 - RNA, 19 nt, Homo sapiens
agaggaguuugaagaauuu

SEQ ID NO: 1219957 - RNA, 19 nt, Homo sapiens
caccaaagcugcugagaac

SEQ ID NO: 1219958 - RNA, 19 nt, Homo sapiens
ccacgugccuguagcuuca

SEQ ID NO: 1219959 - RNA, 19 nt, Homo sapiens
ggaauuguucagcaaauga

SEQ ID NO: 1219960 - RNA, 19 nt, Homo sapiens
caaccgaguagcugaaauu

SEQ ID NO: 1219961 - RNA, 19 nt, Homo sapiens
gauuucugcuuccuaauag

SEQ ID NO: 1219962 - RNA, 19 nt, Homo sapiens
gaacaaauacuagccaaaa

SEQ ID NO: 1219963 - RNA, 19 nt, Homo sapiens
gucaaaggacguuggaaua

SEQ ID NO: 1219964 - RNA, 19 nt, Homo sapiens
agauuaggcuuuaagugaa

SEQ ID NO: 1219965 - RNA, 19 nt, Homo sapiens
ucucagaacacaauuagaa

SEQ ID NO: 1219966 - RNA, 19 nt, Homo sapiens
ucacacaauucaugucauc

SEQ ID NO: 1219967 - RNA, 19 nt, Homo sapiens
gaccuaaacaccauagaau

SEQ ID NO: 1219968 - RNA, 19 nt, Homo sapiens
ggaccuacuucugcacuuc

SEQ ID NO: 1219969 - RNA, 19 nt, Homo sapiens
gaaaucggaccuacuucug

SEQ ID NO: 1219970 - RNA, 19 nt, Homo sapiens
gugaagaggaguuugaaga

SEQ ID NO: 1219971 - RNA, 19 nt, Homo sapiens
ccagugagaaggccauaaa

SEQ ID NO: 1219972 - RNA, 19 nt, Homo sapiens
ccaaagcugcugagaacaa

SEQ ID NO: 1219973 - RNA, 19 nt, Homo sapiens
ugaagaggaguuugaagaa

SEQ ID NO: 1219974 - RNA, 19 nt, Homo sapiens
uaagugaagaggaguuuga

SEQ ID NO: 1219975 - RNA, 19 nt, Homo sapiens
uagcugaaauuguuuacuc

SEQ ID NO: 1219976 - RNA, 19 nt, Homo sapiens
gggaauuguucagcaaaug

SEQ ID NO: 1219977 - RNA, 19 nt, Homo sapiens
caaguucaguacaagauac

SEQ ID NO: 1219978 - RNA, 19 nt, Homo sapiens
ccugaggcauuuaugaaga

SEQ ID NO: 1219979 - RNA, 19 nt, Homo sapiens
ccuagaugaugaugaccua

SEQ ID NO: 1219980 - RNA, 19 nt, Homo sapiens
uaacugagggucucuccuu

SEQ ID NO: 1219981 - RNA, 19 nt, Homo sapiens
ggucaaaggacguuggaau

SEQ ID NO: 1219982 - RNA, 19 nt, Homo sapiens
uaccaucucuggacucaca

SEQ ID NO: 1219983 - RNA, 19 nt, Homo sapiens
ccuaaacaccauagaauuc

SEQ ID NO: 1219984 - RNA, 19 nt, Homo sapiens
cacaauucaugucaucaga

SEQ ID NO: 1219985 - RNA, 19 nt, Homo sapiens
ugucaaauccuacucuuca

SEQ ID NO: 1219986 - RNA, 19 nt, Homo sapiens
gaguagcugaaauuguuua

SEQ ID NO: 1219987 - RNA, 19 nt, Homo sapiens
ucaaaauccucgccuacua

SEQ ID NO: 1219988 - RNA, 19 nt, Homo sapiens
gucauggccuugcagaaau

SEQ ID NO: 1219989 - RNA, 19 nt, Homo sapiens
gcugagaacaagaaguuug

SEQ ID NO: 1219990 - RNA, 19 nt, Homo sapiens
gauuaggcuuuaagugaag

SEQ ID NO: 1219991 - RNA, 19 nt, Homo sapiens
caaagcugcugagaacaag

SEQ ID NO: 1219992 - RNA, 19 nt, Homo sapiens
ccaaagucauuuccauugc

SEQ ID NO: 1219993 - RNA, 19 nt, Homo sapiens
cuaagaaagaugaagaaga

SEQ ID NO: 1219994 - RNA, 19 nt, Homo sapiens
ucauggccuugcagaaauu

SEQ ID NO: 1219995 - RNA, 19 nt, Homo sapiens
ucaaguucaguacaagaua

SEQ ID NO: 1219996 - RNA, 19 nt, Homo sapiens
gccuguagcuucaaguucu

SEQ ID NO: 1219997 - RNA, 19 nt, Homo sapiens
acggauuucugcuuccuaa

SEQ ID NO: 1219998 - RNA, 19 nt, Homo sapiens
ugaagaauuuacggauuuc

SEQ ID NO: 1219999 - RNA, 19 nt, Homo sapiens
gcugucaaauccuacucuu

SEQ ID NO: 1220000 - RNA, 19 nt, Homo sapiens
gcagcagccucaaguucag

SEQ ID NO: 1220001 - RNA, 19 nt, Homo sapiens
guugagcugcugaaauauu

SEQ ID NO: 1220002 - RNA, 19 nt, Homo sapiens
ugaccuaaacaccauagaa

SEQ ID NO: 1220003 - RNA, 19 nt, Homo sapiens
ucagcaaagaccaagauaa

SEQ ID NO: 1220004 - RNA, 19 nt, Homo sapiens
ugucauggccuugcagaaa

SEQ ID NO: 1220005 - RNA, 19 nt, Homo sapiens
gaaauauucaggagaucag

SEQ ID NO: 1220006 - RNA, 19 nt, Homo sapiens
aaauccuacucuucaacua

SEQ ID NO: 1220007 - RNA, 19 nt, Homo sapiens
cugaggcauuuaugaagaa

SEQ ID NO: 1220008 - RNA, 19 nt, Homo sapiens
ucaccaaagcugcugagaa

SEQ ID NO: 1220009 - RNA, 19 nt, Homo sapiens
aaaggacguuggaauacca

SEQ ID NO: 1220010 - RNA, 19 nt, Homo sapiens
uagaugaugaugaccuaaa

SEQ ID NO: 1220011 - RNA, 19 nt, Homo sapiens
ggcagcagccucaaguuca

SEQ ID NO: 1220012 - RNA, 19 nt, Homo sapiens
uugagcugcugaaauauuc

SEQ ID NO: 1220013 - RNA, 19 nt, Homo sapiens
caggagaucaguuggaaag

SEQ ID NO: 1220014 - RNA, 19 nt, Homo sapiens
caaauacuagccaaaauug

SEQ ID NO: 1220015 - RNA, 19 nt, Homo sapiens
gaugaagaagaacaaauac

SEQ ID NO: 1220016 - RNA, 19 nt, Homo sapiens
cuaaacaccauagaauuca

SEQ ID NO: 1220017 - RNA, 19 nt, Homo sapiens
cuucaaguccaaagagauu

SEQ ID NO: 1220018 - RNA, 19 nt, Homo sapiens
cccaaagucauuuccauug

SEQ ID NO: 1220019 - RNA, 19 nt, Homo sapiens
gucaaauccuacucuucaa

SEQ ID NO: 1220020 - RNA, 19 nt, Homo sapiens
caggaggcuucaaguccaa

SEQ ID NO: 1220021 - RNA, 19 nt, Homo sapiens
guagauuaggcuuuaagug

SEQ ID NO: 1220022 - RNA, 19 nt, Homo sapiens
caucagacagagaaaguag

SEQ ID NO: 1220023 - RNA, 19 nt, Homo sapiens
cugcugagaacaagaaguu

SEQ ID NO: 1220024 - RNA, 19 nt, Homo sapiens
ccuguagcuucaaguucua

SEQ ID NO: 1220025 - RNA, 19 nt, Homo sapiens
caaaggacguuggaauacc

SEQ ID NO: 1220026 - RNA, 19 nt, Homo sapiens
ggugguggacccagaguuc

SEQ ID NO: 1220027 - RNA, 19 nt, Homo sapiens
ggcuucaaguccaaagaga

SEQ ID NO: 1220028 - RNA, 19 nt, Homo sapiens
ucaaaggacguuggaauac

SEQ ID NO: 1220029 - RNA, 19 nt, Homo sapiens
gacagagaaaguagauuag

SEQ ID NO: 1220030 - RNA, 19 nt, Homo sapiens
uaccugaggcauuuaugaa

SEQ ID NO: 1220031 - RNA, 19 nt, Homo sapiens
ugaguauaccugaggcauu

SEQ ID NO: 1220032 - RNA, 19 nt, Homo sapiens
agaaagaugaagaagaaca

SEQ ID NO: 1220033 - RNA, 19 nt, Homo sapiens
cagugggugugaccuggaa

SEQ ID NO: 1220034 - RNA, 19 nt, Homo sapiens
ucagacagagaaaguagau

SEQ ID NO: 1220035 - RNA, 19 nt, Homo sapiens
cuuccacccuuucacacaa

SEQ ID NO: 1220036 - RNA, 19 nt, Homo sapiens
caaauccuacucuucaacu

SEQ ID NO: 1220037 - RNA, 19 nt, Homo sapiens
gaaaguggcugcugagaag

SEQ ID NO: 1220038 - RNA, 19 nt, Homo sapiens
ggagcaagguguuccagaa

SEQ ID NO: 1220039 - RNA, 19 nt, Homo sapiens
ucacugacuucaagaauga

SEQ ID NO: 1220040 - RNA, 19 nt, Homo sapiens
ugacuaaacuggagaugga

SEQ ID NO: 1220041 - RNA, 19 nt, Homo sapiens
gcgauucuuugcccuauuu

SEQ ID NO: 1220042 - RNA, 19 nt, Homo sapiens
gguaugcagucauguugua

SEQ ID NO: 1220043 - RNA, 19 nt, Homo sapiens
gaucgaagguguccaagac

SEQ ID NO: 1220044 - RNA, 19 nt, Homo sapiens
gaagggccauugugagaag

SEQ ID NO: 1220045 - RNA, 19 nt, Homo sapiens
gagaucagccugcaagaau

SEQ ID NO: 1220046 - RNA, 19 nt, Homo sapiens
gcuggugccuggaaucuug

SEQ ID NO: 1220047 - RNA, 19 nt, Homo sapiens
ccacguggcuggcucaagu

SEQ ID NO: 1220048 - RNA, 19 nt, Homo sapiens
ucacucaucuccucaucaa

SEQ ID NO: 1220049 - RNA, 19 nt, Homo sapiens
gcaagguguuccagaaagu

SEQ ID NO: 1220050 - RNA, 19 nt, Homo sapiens
caaauucuguaacaucaag

SEQ ID NO: 1220051 - RNA, 19 nt, Homo sapiens
ggugacuacuuguaucuga

SEQ ID NO: 1220052 - RNA, 19 nt, Homo sapiens
ggccagcccuuuccaguuc

SEQ ID NO: 1220053 - RNA, 19 nt, Homo sapiens
gacuuuaucuggaucaaca

SEQ ID NO: 1220054 - RNA, 19 nt, Homo sapiens
caagggcucugagauacuu

SEQ ID NO: 1220055 - RNA, 19 nt, Homo sapiens
gggcaagaaugacaugaag

SEQ ID NO: 1220056 - RNA, 19 nt, Homo sapiens
cacaaauucuguaacauca

SEQ ID NO: 1220057 - RNA, 19 nt, Homo sapiens
gagcaagguguuccagaaa

SEQ ID NO: 1220058 - RNA, 19 nt, Homo sapiens
acaugaagcuccauaaggu

SEQ ID NO: 1220059 - RNA, 19 nt, Homo sapiens
ccaacaaggagaagaaaga

SEQ ID NO: 1220060 - RNA, 19 nt, Homo sapiens
caucugcacugggcaagaa

SEQ ID NO: 1220061 - RNA, 19 nt, Homo sapiens
gcaggaucuuugccucuga

SEQ ID NO: 1220062 - RNA, 19 nt, Homo sapiens
cuauagaccuggugacuac

SEQ ID NO: 1220063 - RNA, 19 nt, Homo sapiens
acuuugagguguucuauug

SEQ ID NO: 1220064 - RNA, 19 nt, Homo sapiens
gacaggcaguggcuccauu

SEQ ID NO: 1220065 - RNA, 19 nt, Homo sapiens
gagaagaaagacuccauca

SEQ ID NO: 1220066 - RNA, 19 nt, Homo sapiens
cuacaucgaugggccuuau

SEQ ID NO: 1220067 - RNA, 19 nt, Homo sapiens
guccaagggcucugagaua

SEQ ID NO: 1220068 - RNA, 19 nt, Homo sapiens
uccuggagcugcauaugua

SEQ ID NO: 1220069 - RNA, 19 nt, Homo sapiens
ucuguaacaucaagugcua

SEQ ID NO: 1220070 - RNA, 19 nt, Homo sapiens
gauagaaguggcaccauca

SEQ ID NO: 1220071 - RNA, 19 nt, Homo sapiens
gagcgauucuuugcccuau

SEQ ID NO: 1220072 - RNA, 19 nt, Homo sapiens
cauguuguaucuggaauug

SEQ ID NO: 1220073 - RNA, 19 nt, Homo sapiens
gcacugggcaagaaugaca

SEQ ID NO: 1220074 - RNA, 19 nt, Homo sapiens
guggcuggcucaaguccua

SEQ ID NO: 1220075 - RNA, 19 nt, Homo sapiens
cggaugagcugcgcacugu

SEQ ID NO: 1220076 - RNA, 19 nt, Homo sapiens
ggagaucagccugcaagaa

SEQ ID NO: 1220077 - RNA, 19 nt, Homo sapiens
uaagaccauugcaggagaa

SEQ ID NO: 1220078 - RNA, 19 nt, Homo sapiens
ggagugugacaaugagaaa

SEQ ID NO: 1220079 - RNA, 19 nt, Homo sapiens
caaggccaguggacaaaca

SEQ ID NO: 1220080 - RNA, 19 nt, Homo sapiens
gcuuaugggcuacguggua

SEQ ID NO: 1220081 - RNA, 19 nt, Homo sapiens
gugggugacucagcaguuu

SEQ ID NO: 1220082 - RNA, 19 nt, Homo sapiens
gcaaggugcaggucuucuu

SEQ ID NO: 1220083 - RNA, 19 nt, Homo sapiens
gcccuuaguccuucuaguu

SEQ ID NO: 1220084 - RNA, 19 nt, Homo sapiens
acaaugagaaagagucaaa

SEQ ID NO: 1220085 - RNA, 19 nt, Homo sapiens
ggacgguacuccgcugaca

SEQ ID NO: 1220086 - RNA, 19 nt, Homo sapiens
cuucgucugugccggcuua

SEQ ID NO: 1220087 - RNA, 19 nt, Homo sapiens
gagcagaaagacacuaucu

SEQ ID NO: 1220088 - RNA, 19 nt, Homo sapiens
gaucagccugcaagaauuc

SEQ ID NO: 1220089 - RNA, 19 nt, Homo sapiens
gcugacaccuucccuuucg

SEQ ID NO: 1220090 - RNA, 19 nt, Homo sapiens
ccagguguaugacaucgau

SEQ ID NO: 1220091 - RNA, 19 nt, Homo sapiens
caacaugaagcuccauaag

SEQ ID NO: 1220092 - RNA, 19 nt, Homo sapiens
uaacaucaagugcuacauc

SEQ ID NO: 1220093 - RNA, 19 nt, Homo sapiens
gagcugcauauguacauga

SEQ ID NO: 1220094 - RNA, 19 nt, Homo sapiens
gacaacaugaagcuccaua

SEQ ID NO: 1220095 - RNA, 19 nt, Homo sapiens
cuacggacgacgccuauga

SEQ ID NO: 1220096 - RNA, 19 nt, Homo sapiens
acacaaauucuguaacauc

SEQ ID NO: 1220097 - RNA, 19 nt, Homo sapiens
gccagugccucaacuucga

SEQ ID NO: 1220098 - RNA, 19 nt, Homo sapiens
agaucagccugcaagaauu

SEQ ID NO: 1220099 - RNA, 19 nt, Homo sapiens
gaccauugcaggagaagau

SEQ ID NO: 1220100 - RNA, 19 nt, Homo sapiens
gaucuuugccucugagcau

SEQ ID NO: 1220101 - RNA, 19 nt, Homo sapiens
gugacuacuuguaucugaa

SEQ ID NO: 1220102 - RNA, 19 nt, Homo sapiens
gaccuggugacuacuugua

SEQ ID NO: 1220103 - RNA, 19 nt, Homo sapiens
uccgaggucucaauccauu

SEQ ID NO: 1220104 - RNA, 19 nt, Homo sapiens
caccauugcucgcuaugag

SEQ ID NO: 1220105 - RNA, 19 nt, Homo sapiens
ccuccaaggucacucaucu

SEQ ID NO: 1220106 - RNA, 19 nt, Homo sapiens
caaacucaaauuccucuuc

SEQ ID NO: 1220107 - RNA, 19 nt, Homo sapiens
gggugacucagcaguuuaa

SEQ ID NO: 1220108 - RNA, 19 nt, Homo sapiens
agaaaguggcugcugagaa

SEQ ID NO: 1220109 - RNA, 19 nt, Homo sapiens
ccgcugacaccuucccuuu

SEQ ID NO: 1220110 - RNA, 19 nt, Homo sapiens
cuacuuguaucugaacauc

SEQ ID NO: 1220111 - RNA, 19 nt, Homo sapiens
ggagcugcauauguacaug

SEQ ID NO: 1220112 - RNA, 19 nt, Homo sapiens
gcucugagauacuuuugga

SEQ ID NO: 1220113 - RNA, 19 nt, Homo sapiens
uggaauugguggguucuug

SEQ ID NO: 1220114 - RNA, 19 nt, Homo sapiens
ggucacucaucuccucauc

SEQ ID NO: 1220115 - RNA, 19 nt, Homo sapiens
caucaagugcuacaucgau

SEQ ID NO: 1220116 - RNA, 19 nt, Homo sapiens
cgaggagugugacaaugag

SEQ ID NO: 1220117 - RNA, 19 nt, Homo sapiens
ucgaggagugugacaauga

SEQ ID NO: 1220118 - RNA, 19 nt, Homo sapiens
ccauggacaaacucaaauu

SEQ ID NO: 1220119 - RNA, 19 nt, Homo sapiens
uaugaagcccuuaguccuu

SEQ ID NO: 1220120 - RNA, 19 nt, Homo sapiens
uugugagccugcugacuaa

SEQ ID NO: 1220121 - RNA, 19 nt, Homo sapiens
uuugugagccugcugacua

SEQ ID NO: 1220122 - RNA, 19 nt, Homo sapiens
ugacucagcaguuuaagac

SEQ ID NO: 1220123 - RNA, 19 nt, Homo sapiens
caaggugcaggucuucuuc

SEQ ID NO: 1220124 - RNA, 19 nt, Homo sapiens
uauccgaggucucaaucca

SEQ ID NO: 1220125 - RNA, 19 nt, Homo sapiens
gccugcagauggcccuuga

SEQ ID NO: 1220126 - RNA, 19 nt, Homo sapiens
gaaacacaaauucuguaac

SEQ ID NO: 1220127 - RNA, 19 nt, Homo sapiens
gcugguaugcagucauguu

SEQ ID NO: 1220128 - RNA, 19 nt, Homo sapiens
cugaagggccauugugaga

SEQ ID NO: 1220129 - RNA, 19 nt, Homo sapiens
ggaucgaagguguccaaga

SEQ ID NO: 1220130 - RNA, 19 nt, Homo sapiens
uguuguaucuggaauuggu

SEQ ID NO: 1220131 - RNA, 19 nt, Homo sapiens
uagaccuggugacuacuug

SEQ ID NO: 1220132 - RNA, 19 nt, Homo sapiens
cagcucugcaugugaaaga

SEQ ID NO: 1220133 - RNA, 19 nt, Homo sapiens
aggcugguaugcagucaug

SEQ ID NO: 1220134 - RNA, 19 nt, Homo sapiens
acaacaugaagcuccauaa

SEQ ID NO: 1220135 - RNA, 19 nt, Homo sapiens
cuuccauucugcagaguau

SEQ ID NO: 1220136 - RNA, 19 nt, Homo sapiens
ugagauacuuuuggagaaa

SEQ ID NO: 1220137 - RNA, 19 nt, Homo sapiens
ggacacauuucuauaucua

SEQ ID NO: 1220138 - RNA, 19 nt, Homo sapiens
gcaccugguugggcauuua

SEQ ID NO: 1220139 - RNA, 19 nt, Homo sapiens
gcaggagaauugcuugaau

SEQ ID NO: 1220140 - RNA, 19 nt, Homo sapiens
ugacuaugaugcaccuaua

SEQ ID NO: 1220141 - RNA, 19 nt, Homo sapiens
ggacgcuuccuuccgauua

SEQ ID NO: 1220142 - RNA, 19 nt, Homo sapiens
gcacaggacacauaucaau

SEQ ID NO: 1220143 - RNA, 19 nt, Homo sapiens
caauagcacuaguacuuug

SEQ ID NO: 1220144 - RNA, 19 nt, Homo sapiens
gagccagugugaacaugua

SEQ ID NO: 1220145 - RNA, 19 nt, Homo sapiens
uagagaacaugcucaaguu

SEQ ID NO: 1220146 - RNA, 19 nt, Homo sapiens
ccauggagguaccaacuuu

SEQ ID NO: 1220147 - RNA, 19 nt, Homo sapiens
ggccaagucuggaucaaug

SEQ ID NO: 1220148 - RNA, 19 nt, Homo sapiens
ggaauggugccgauaagaa

SEQ ID NO: 1220149 - RNA, 19 nt, Homo sapiens
uaacagcagugacuucaag

SEQ ID NO: 1220150 - RNA, 19 nt, Homo sapiens
ccaaaggacuagagaacau

SEQ ID NO: 1220151 - RNA, 19 nt, Homo sapiens
uuacauugcuggaacuaga

SEQ ID NO: 1220152 - RNA, 19 nt, Homo sapiens
gcugagggcaggagaauug

SEQ ID NO: 1220153 - RNA, 19 nt, Homo sapiens
gaucaauggguuuaacuug

SEQ ID NO: 1220154 - RNA, 19 nt, Homo sapiens
acacauaucaauucccuuu

SEQ ID NO: 1220155 - RNA, 19 nt, Homo sapiens
cauucugggugccaaauaa

SEQ ID NO: 1220156 - RNA, 19 nt, Homo sapiens
uggaugauguucccucuga

SEQ ID NO: 1220157 - RNA, 19 nt, Homo sapiens
gcccauucauucaaucuug

SEQ ID NO: 1220158 - RNA, 19 nt, Homo sapiens
uugauaaccuugugaagug

SEQ ID NO: 1220159 - RNA, 19 nt, Homo sapiens
ugugucagcuguaaccaaa

SEQ ID NO: 1220160 - RNA, 19 nt, Homo sapiens
gaaaauugauaaccuugug

SEQ ID NO: 1220161 - RNA, 19 nt, Homo sapiens
ggccauugguaaacucuga

SEQ ID NO: 1220162 - RNA, 19 nt, Homo sapiens
caacaugaccaaaaucuuu

SEQ ID NO: 1220163 - RNA, 19 nt, Homo sapiens
gaaccaauggaguuaagug

SEQ ID NO: 1220164 - RNA, 19 nt, Homo sapiens
caggagaauugcuugaauc

SEQ ID NO: 1220165 - RNA, 19 nt, Homo sapiens
gaugauguucccucugaaa

SEQ ID NO: 1220166 - RNA, 19 nt, Homo sapiens
gagugccucugaaccaaug

SEQ ID NO: 1220167 - RNA, 19 nt, Homo sapiens
gaaguuccuuugggaccuu

SEQ ID NO: 1220168 - RNA, 19 nt, Homo sapiens
gaaaccccgucuccacuaa

SEQ ID NO: 1220169 - RNA, 19 nt, Homo sapiens
acauaucaauucccuuuca

SEQ ID NO: 1220170 - RNA, 19 nt, Homo sapiens
gaauggugccgauaagaag

SEQ ID NO: 1220171 - RNA, 19 nt, Homo sapiens
gcagugaguggagguugua

SEQ ID NO: 1220172 - RNA, 19 nt, Homo sapiens
ucaauagcacuaguacuuu

SEQ ID NO: 1220173 - RNA, 19 nt, Homo sapiens
gauguucccucugaaaauu

SEQ ID NO: 1220174 - RNA, 19 nt, Homo sapiens
caagauuccugcuguuucc

SEQ ID NO: 1220175 - RNA, 19 nt, Homo sapiens
cauccugguugcuucgaaa

SEQ ID NO: 1220176 - RNA, 19 nt, Homo sapiens
uagcgaaccuguuggucau

SEQ ID NO: 1220177 - RNA, 19 nt, Homo sapiens
acacaggcuggcuggauua

SEQ ID NO: 1220178 - RNA, 19 nt, Homo sapiens
uacacaggcuggcuggauu

SEQ ID NO: 1220179 - RNA, 19 nt, Homo sapiens
ggaccucauugccuuucug

SEQ ID NO: 1220180 - RNA, 19 nt, Homo sapiens
ggaugauguucccucugaa

SEQ ID NO: 1220181 - RNA, 19 nt, Homo sapiens
gaaauaugagagacaaacu

SEQ ID NO: 1220182 - RNA, 19 nt, Homo sapiens
caggcuggcuggauuacug

SEQ ID NO: 1220183 - RNA, 19 nt, Homo sapiens
agauccagcugacaacaug

SEQ ID NO: 1220184 - RNA, 19 nt, Homo sapiens
gcaccucuaaucccagcua

SEQ ID NO: 1220185 - RNA, 19 nt, Homo sapiens
gaccaggaccuuacaucug

SEQ ID NO: 1220186 - RNA, 19 nt, Homo sapiens
gggacacauuucuauaucu

SEQ ID NO: 1220187 - RNA, 19 nt, Homo sapiens
gcauuuacuggcuuuccua

SEQ ID NO: 1220188 - RNA, 19 nt, Homo sapiens
ccucauugccuuucugaau

SEQ ID NO: 1220189 - RNA, 19 nt, Homo sapiens
gaaauucaucuaagaaccu

SEQ ID NO: 1220190 - RNA, 19 nt, Homo sapiens
ggggagcccucaacaaaau

SEQ ID NO: 1220191 - RNA, 19 nt, Homo sapiens
accaggaccuuacaucugu

SEQ ID NO: 1220192 - RNA, 19 nt, Homo sapiens
cucaauagcacuaguacuu

SEQ ID NO: 1220193 - RNA, 19 nt, Homo sapiens
gccaagauuccugcuguuu

SEQ ID NO: 1220194 - RNA, 19 nt, Homo sapiens
guuguggagcgaaauauga

SEQ ID NO: 1220195 - RNA, 19 nt, Homo sapiens
ugaugcaccuauaucugaa

SEQ ID NO: 1220196 - RNA, 19 nt, Homo sapiens
uaccagcuaugacuaugau

SEQ ID NO: 1220197 - RNA, 19 nt, Homo sapiens
caacuuuggauauuggaau

SEQ ID NO: 1220198 - RNA, 19 nt, Homo sapiens
ccuguaaucccagcacuuu

SEQ ID NO: 1220199 - RNA, 19 nt, Homo sapiens
gcuggaacuagaagaugua

SEQ ID NO: 1220200 - RNA, 19 nt, Homo sapiens
ggaucaauggguuuaacuu

SEQ ID NO: 1220201 - RNA, 19 nt, Homo sapiens
gguguuguggagcgaaaua

SEQ ID NO: 1220202 - RNA, 19 nt, Homo sapiens
cuagagaacaugcucaagu

SEQ ID NO: 1220203 - RNA, 19 nt, Homo sapiens
ccucugaaccaauggaguu

SEQ ID NO: 1220204 - RNA, 19 nt, Homo sapiens
acaggacacauaucaauuc

SEQ ID NO: 1220205 - RNA, 19 nt, Homo sapiens
cacaggacacauaucaauu

SEQ ID NO: 1220206 - RNA, 19 nt, Homo sapiens
ggaacuagaagauguaccu

SEQ ID NO: 1220207 - RNA, 19 nt, Homo sapiens
ccaagauuccugcuguuuc

SEQ ID NO: 1220208 - RNA, 19 nt, Homo sapiens
gagcgaaauaugagagaca

SEQ ID NO: 1220209 - RNA, 19 nt, Homo sapiens
ggcagagguugcagugagu

SEQ ID NO: 1220210 - RNA, 19 nt, Homo sapiens
ggcugagacggguggauua

SEQ ID NO: 1220211 - RNA, 19 nt, Homo sapiens
uaaccaaaggacuagagaa

SEQ ID NO: 1220212 - RNA, 19 nt, Homo sapiens
guaaccaaaggacuagaga

SEQ ID NO: 1220213 - RNA, 19 nt, Homo sapiens
gaaccuguuggucauacug

SEQ ID NO: 1220214 - RNA, 19 nt, Homo sapiens
ugacuucaagggccuguug

SEQ ID NO: 1220215 - RNA, 19 nt, Homo sapiens
caaaggacuagagaacaug

SEQ ID NO: 1220216 - RNA, 19 nt, Homo sapiens
ccucuaaucccagcuacuu

SEQ ID NO: 1220217 - RNA, 19 nt, Homo sapiens
ggccacaacagacccucua

SEQ ID NO: 1220218 - RNA, 19 nt, Homo sapiens
aggcucagcuuugggucua

SEQ ID NO: 1220219 - RNA, 19 nt, Homo sapiens
ugaccgugccuaugugaug

SEQ ID NO: 1220220 - RNA, 19 nt, Homo sapiens
ccaugaccgugccuaugug

SEQ ID NO: 1220221 - RNA, 19 nt, Homo sapiens
gagggcaggagaauugcuu

SEQ ID NO: 1220222 - RNA, 19 nt, Homo sapiens
gcgaaccuguuggucauac

SEQ ID NO: 1220223 - RNA, 19 nt, Homo sapiens
gaccucauugccuuucuga

SEQ ID NO: 1220224 - RNA, 19 nt, Homo sapiens
gggagccagugugaacaug

SEQ ID NO: 1220225 - RNA, 19 nt, Homo sapiens
gagaccaggaccuuacauc

SEQ ID NO: 1220226 - RNA, 19 nt, Homo sapiens
ucuaagaaccucagaucca

SEQ ID NO: 1220227 - RNA, 19 nt, Homo sapiens
caaaaucuuuacccugcuu

SEQ ID NO: 1220228 - RNA, 19 nt, Homo sapiens
cagcugacaacaugaccaa

SEQ ID NO: 1220229 - RNA, 19 nt, Homo sapiens
cuugugaaguggugguuuc

SEQ ID NO: 1220230 - RNA, 19 nt, Homo sapiens
cgauuacuaccagcuauga

SEQ ID NO: 1220231 - RNA, 19 nt, Homo sapiens
gacuagagaacaugcucaa

SEQ ID NO: 1220232 - RNA, 19 nt, Homo sapiens
gggcaggagaauugcuuga

SEQ ID NO: 1220233 - RNA, 19 nt, Homo sapiens
cgaaauaugagagacaaac

SEQ ID NO: 1220234 - RNA, 19 nt, Homo sapiens
ccauucugggugccaaaua

SEQ ID NO: 1220235 - RNA, 19 nt, Homo sapiens
uuacuaccagcuaugacua

SEQ ID NO: 1220236 - RNA, 19 nt, Homo sapiens
ggcaggagaauugcuugaa

SEQ ID NO: 1220237 - RNA, 19 nt, Homo sapiens
ggaaacaucuggugcuauu

SEQ ID NO: 1220238 - RNA, 19 nt, Homo sapiens
gaagcugggcuguguggua

SEQ ID NO: 1220239 - RNA, 19 nt, Homo sapiens
gcucaucuccgcucucuga

SEQ ID NO: 1220240 - RNA, 19 nt, Homo sapiens
caggaaacaucuggugcua

SEQ ID NO: 1220241 - RNA, 19 nt, Homo sapiens
aaacaucuggugcuauuau

SEQ ID NO: 1220242 - RNA, 19 nt, Homo sapiens
gaaacaucuggugcuauua

SEQ ID NO: 1220243 - RNA, 19 nt, Homo sapiens
guccaggccuguccgaaug

SEQ ID NO: 1220244 - RNA, 19 nt, Homo sapiens
cugcagggcuuccucuuuc

SEQ ID NO: 1220245 - RNA, 19 nt, Homo sapiens
ccccacagauuuugaauaa

SEQ ID NO: 1220246 - RNA, 19 nt, Homo sapiens
gagauggacaccugagaug

SEQ ID NO: 1220247 - RNA, 19 nt, Homo sapiens
ccacagauuuugaauaaag

SEQ ID NO: 1220248 - RNA, 19 nt, Homo sapiens
gaccuauccuugguugaga

SEQ ID NO: 1220249 - RNA, 19 nt, Homo sapiens
ggacuucccggacgaguac

SEQ ID NO: 1220250 - RNA, 19 nt, Homo sapiens
cuacgcuucugccgcauga

SEQ ID NO: 1220251 - RNA, 19 nt, Homo sapiens
aggagaagcugggcugugu

SEQ ID NO: 1220252 - RNA, 19 nt, Homo sapiens
guagggacagggacagaga

SEQ ID NO: 1220253 - RNA, 19 nt, Homo sapiens
agacagaggagggcaucua

SEQ ID NO: 1220254 - RNA, 19 nt, Homo sapiens
ccgaaugcuuccaggugaa

SEQ ID NO: 1220255 - RNA, 19 nt, Homo sapiens
ucgcugagacagagacuga

SEQ ID NO: 1220256 - RNA, 19 nt, Homo sapiens
acugugaccagaucuguuu

SEQ ID NO: 1220257 - RNA, 19 nt, Homo sapiens
gggaugcuuuguggacuca

SEQ ID NO: 1220258 - RNA, 19 nt, Homo sapiens
agacgcagcaacacagcua

SEQ ID NO: 1220259 - RNA, 19 nt, Homo sapiens
gaccagacgcagcaacaca

SEQ ID NO: 1220260 - RNA, 19 nt, Homo sapiens
cagaggagggcaucuacug

SEQ ID NO: 1220261 - RNA, 19 nt, Homo sapiens
gaggucacaggucagcaaa

SEQ ID NO: 1220262 - RNA, 19 nt, Homo sapiens
gcugagacagagacugaga

SEQ ID NO: 1220263 - RNA, 19 nt, Homo sapiens
gcacaacuucugccguaac

SEQ ID NO: 1220264 - RNA, 19 nt, Homo sapiens
aaggaucuacuuugguaaa

SEQ ID NO: 1220265 - RNA, 19 nt, Homo sapiens
cgagauggacaccugagau

SEQ ID NO: 1220266 - RNA, 19 nt, Homo sapiens
caccgacugugaccagauc

SEQ ID NO: 1220267 - RNA, 19 nt, Homo sapiens
ucccugcgcucgcucaucu

SEQ ID NO: 1220268 - RNA, 19 nt, Homo sapiens
gcugggcgucuaugaagug

SEQ ID NO: 1220269 - RNA, 19 nt, Homo sapiens
gaacagagcuaggaaggaa

SEQ ID NO: 1220270 - RNA, 19 nt, Homo sapiens
ggaaacaucuggugcuauu

SEQ ID NO: 1220271 - RNA, 19 nt, Homo sapiens
gaagcugggcuguguggua

SEQ ID NO: 1220272 - RNA, 19 nt, Homo sapiens
gcucaucuccgcucucuga

SEQ ID NO: 1220273 - RNA, 19 nt, Homo sapiens
gaagggaacagagcuagga

SEQ ID NO: 1220274 - RNA, 19 nt, Homo sapiens
caggaaacaucuggugcua

SEQ ID NO: 1220275 - RNA, 19 nt, Homo sapiens
gaugucugcucccucucua

SEQ ID NO: 1220276 - RNA, 19 nt, Homo sapiens
aaacaucuggugcuauuau

SEQ ID NO: 1220277 - RNA, 19 nt, Homo sapiens
gaaacaucuggugcuauua

SEQ ID NO: 1220278 - RNA, 19 nt, Homo sapiens
guccaggccuguccgaaug

SEQ ID NO: 1220279 - RNA, 19 nt, Homo sapiens
cugcagggcuuccucuuuc

SEQ ID NO: 1220280 - RNA, 19 nt, Homo sapiens
ccccacagauuuugaauaa

SEQ ID NO: 1220281 - RNA, 19 nt, Homo sapiens
gagauggacaccugagaug

SEQ ID NO: 1220282 - RNA, 19 nt, Homo sapiens
ccacagauuuugaauaaag

SEQ ID NO: 1220283 - RNA, 19 nt, Homo sapiens
gaccuauccuugguugaga

SEQ ID NO: 1220284 - RNA, 19 nt, Homo sapiens
ggacuucccggacgaguac

SEQ ID NO: 1220285 - RNA, 19 nt, Homo sapiens
cuacgcuucugccgcauga

SEQ ID NO: 1220286 - RNA, 19 nt, Homo sapiens
aggagaagcugggcugugu

SEQ ID NO: 1220287 - RNA, 19 nt, Homo sapiens
guagggacagggacagaga

SEQ ID NO: 1220288 - RNA, 19 nt, Homo sapiens
ccagaagggaacagagcua

SEQ ID NO: 1220289 - RNA, 19 nt, Homo sapiens
agacagaggagggcaucua

SEQ ID NO: 1220290 - RNA, 19 nt, Homo sapiens
ccgaaugcuuccaggugaa

SEQ ID NO: 1220291 - RNA, 19 nt, Homo sapiens
ggaacagagcuaggaagga

SEQ ID NO: 1220292 - RNA, 19 nt, Homo sapiens
ucgcugagacagagacuga

SEQ ID NO: 1220293 - RNA, 19 nt, Homo sapiens
acugugaccagaucuguuu

SEQ ID NO: 1220294 - RNA, 19 nt, Homo sapiens
gggaugcuuuguggacuca

SEQ ID NO: 1220295 - RNA, 19 nt, Homo sapiens
agacgcagcaacacagcua

SEQ ID NO: 1220296 - RNA, 19 nt, Homo sapiens
gaccagacgcagcaacaca

SEQ ID NO: 1220297 - RNA, 19 nt, Homo sapiens
cagaggagggcaucuacug

SEQ ID NO: 1220298 - RNA, 19 nt, Homo sapiens
gaggucacaggucagcaaa

SEQ ID NO: 1220299 - RNA, 19 nt, Homo sapiens
gcugagacagagacugaga

SEQ ID NO: 1220300 - RNA, 19 nt, Homo sapiens
gcacaacuucugccguaac

SEQ ID NO: 1220301 - RNA, 19 nt, Homo sapiens
aaggaucuacuuugguaaa

SEQ ID NO: 1220302 - RNA, 19 nt, Homo sapiens
cgagauggacaccugagau

SEQ ID NO: 1220303 - RNA, 19 nt, Homo sapiens
caccgacugugaccagauc

SEQ ID NO: 1220304 - RNA, 19 nt, Homo sapiens
cuuaagggagcgaggcuuu

SEQ ID NO: 1220305 - RNA, 19 nt, Homo sapiens
ucccugcgcucgcucaucu

SEQ ID NO: 1220306 - RNA, 19 nt, Homo sapiens
gcugggcgucuaugaagug

SEQ ID NO: 1220307 - RNA, 19 nt, Homo sapiens
gaacagagcuaggaaggaa

SEQ ID NO: 1220308 - RNA, 19 nt, Homo sapiens
ggaaacaucuggugcuauu

SEQ ID NO: 1220309 - RNA, 19 nt, Homo sapiens
gaagcugggcuguguggua

SEQ ID NO: 1220310 - RNA, 19 nt, Homo sapiens
gcucaucuccgcucucuga

SEQ ID NO: 1220311 - RNA, 19 nt, Homo sapiens
gaagggaacagagcuagga

SEQ ID NO: 1220312 - RNA, 19 nt, Homo sapiens
caggaaacaucuggugcua

SEQ ID NO: 1220313 - RNA, 19 nt, Homo sapiens
gaugucugcucccucucua

SEQ ID NO: 1220314 - RNA, 19 nt, Homo sapiens
aaacaucuggugcuauuau

SEQ ID NO: 1220315 - RNA, 19 nt, Homo sapiens
gaaacaucuggugcuauua

SEQ ID NO: 1220316 - RNA, 19 nt, Homo sapiens
guccaggccuguccgaaug

SEQ ID NO: 1220317 - RNA, 19 nt, Homo sapiens
cugcagggcuuccucuuuc

SEQ ID NO: 1220318 - RNA, 19 nt, Homo sapiens
ccccacagauuuugaauaa

SEQ ID NO: 1220319 - RNA, 19 nt, Homo sapiens
gagauggacaccugagaug

SEQ ID NO: 1220320 - RNA, 19 nt, Homo sapiens
ccacagauuuugaauaaag

SEQ ID NO: 1220321 - RNA, 19 nt, Homo sapiens
gaccuauccuugguugaga

SEQ ID NO: 1220322 - RNA, 19 nt, Homo sapiens
ggacuucccggacgaguac

SEQ ID NO: 1220323 - RNA, 19 nt, Homo sapiens
cuacgcuucugccgcauga

SEQ ID NO: 1220324 - RNA, 19 nt, Homo sapiens
aggagaagcugggcugugu

SEQ ID NO: 1220325 - RNA, 19 nt, Homo sapiens
guagggacagggacagaga

SEQ ID NO: 1220326 - RNA, 19 nt, Homo sapiens
ccagaagggaacagagcua

SEQ ID NO: 1220327 - RNA, 19 nt, Homo sapiens
agacagaggagggcaucua

SEQ ID NO: 1220328 - RNA, 19 nt, Homo sapiens
ccgaaugcuuccaggugaa

SEQ ID NO: 1220329 - RNA, 19 nt, Homo sapiens
ggaacagagcuaggaagga

SEQ ID NO: 1220330 - RNA, 19 nt, Homo sapiens
ucgcugagacagagacuga

SEQ ID NO: 1220331 - RNA, 19 nt, Homo sapiens
acugugaccagaucuguuu

SEQ ID NO: 1220332 - RNA, 19 nt, Homo sapiens
gggaugcuuuguggacuca

SEQ ID NO: 1220333 - RNA, 19 nt, Homo sapiens
agacgcagcaacacagcua

SEQ ID NO: 1220334 - RNA, 19 nt, Homo sapiens
gaccagacgcagcaacaca

SEQ ID NO: 1220335 - RNA, 19 nt, Homo sapiens
cagaggagggcaucuacug

SEQ ID NO: 1220336 - RNA, 19 nt, Homo sapiens
gaggucacaggucagcaaa

SEQ ID NO: 1220337 - RNA, 19 nt, Homo sapiens
gcugagacagagacugaga

SEQ ID NO: 1220338 - RNA, 19 nt, Homo sapiens
gcacaacuucugccguaac

SEQ ID NO: 1220339 - RNA, 19 nt, Homo sapiens
aaggaucuacuuugguaaa

SEQ ID NO: 1220340 - RNA, 19 nt, Homo sapiens
cgagauggacaccugagau

SEQ ID NO: 1220341 - RNA, 19 nt, Homo sapiens
caccgacugugaccagauc

SEQ ID NO: 1220342 - RNA, 19 nt, Homo sapiens
cuuaagggagcgaggcuuu

SEQ ID NO: 1220343 - RNA, 19 nt, Homo sapiens
ucccugcgcucgcucaucu

SEQ ID NO: 1220344 - RNA, 19 nt, Homo sapiens
gcugggcgucuaugaagug

SEQ ID NO: 1220345 - RNA, 19 nt, Homo sapiens
ggaaacaucuggugcuauu

SEQ ID NO: 1220346 - RNA, 19 nt, Homo sapiens
gaagcugggcuguguggua

SEQ ID NO: 1220347 - RNA, 19 nt, Homo sapiens
gcucaucuccgcucucuga

SEQ ID NO: 1220348 - RNA, 19 nt, Homo sapiens
caggaaacaucuggugcua

SEQ ID NO: 1220349 - RNA, 19 nt, Homo sapiens
aaacaucuggugcuauuau

SEQ ID NO: 1220350 - RNA, 19 nt, Homo sapiens
gaaacaucuggugcuauua

SEQ ID NO: 1220351 - RNA, 19 nt, Homo sapiens
guccaggccuguccgaaug

SEQ ID NO: 1220352 - RNA, 19 nt, Homo sapiens
cugcagggcuuccucuuuc

SEQ ID NO: 1220353 - RNA, 19 nt, Homo sapiens
ccccacagauuuugaauaa

SEQ ID NO: 1220354 - RNA, 19 nt, Homo sapiens
gagauggacaccugagaug

SEQ ID NO: 1220355 - RNA, 19 nt, Homo sapiens
ccacagauuuugaauaaag

SEQ ID NO: 1220356 - RNA, 19 nt, Homo sapiens
gaccuauccuugguugaga

SEQ ID NO: 1220357 - RNA, 19 nt, Homo sapiens
ggacuucccggacgaguac

SEQ ID NO: 1220358 - RNA, 19 nt, Homo sapiens
cuacgcuucugccgcauga

SEQ ID NO: 1220359 - RNA, 19 nt, Homo sapiens
aggagaagcugggcugugu

SEQ ID NO: 1220360 - RNA, 19 nt, Homo sapiens
guagggacagggacagaga

SEQ ID NO: 1220361 - RNA, 19 nt, Homo sapiens
agacagaggagggcaucua

SEQ ID NO: 1220362 - RNA, 19 nt, Homo sapiens
ccgaaugcuuccaggugaa

SEQ ID NO: 1220363 - RNA, 19 nt, Homo sapiens
ucgcugagacagagacuga

SEQ ID NO: 1220364 - RNA, 19 nt, Homo sapiens
acugugaccagaucuguuu

SEQ ID NO: 1220365 - RNA, 19 nt, Homo sapiens
gggaugcuuuguggacuca

SEQ ID NO: 1220366 - RNA, 19 nt, Homo sapiens
agacgcagcaacacagcua

SEQ ID NO: 1220367 - RNA, 19 nt, Homo sapiens
gaccagacgcagcaacaca

SEQ ID NO: 1220368 - RNA, 19 nt, Homo sapiens
cagaggagggcaucuacug

SEQ ID NO: 1220369 - RNA, 19 nt, Homo sapiens
gaggucacaggucagcaaa

SEQ ID NO: 1220370 - RNA, 19 nt, Homo sapiens
gcugagacagagacugaga

SEQ ID NO: 1220371 - RNA, 19 nt, Homo sapiens
gcacaacuucugccguaac

SEQ ID NO: 1220372 - RNA, 19 nt, Homo sapiens
aaggaucuacuuugguaaa

SEQ ID NO: 1220373 - RNA, 19 nt, Homo sapiens
cgagauggacaccugagau

SEQ ID NO: 1220374 - RNA, 19 nt, Homo sapiens
caccgacugugaccagauc

SEQ ID NO: 1220375 - RNA, 19 nt, Homo sapiens
ucccugcgcucgcucaucu

SEQ ID NO: 1220376 - RNA, 19 nt, Homo sapiens
gcugggcgucuaugaagug

SEQ ID NO: 1220377 - RNA, 19 nt, Homo sapiens
gaacaaugaugaaggcaaa

SEQ ID NO: 1220378 - RNA, 19 nt, Homo sapiens
gauaaaugcuucuaccaaa

SEQ ID NO: 1220379 - RNA, 19 nt, Homo sapiens
gagaggagcuggagaagag

SEQ ID NO: 1220380 - RNA, 19 nt, Homo sapiens
gaaauagugcacaguauga

SEQ ID NO: 1220381 - RNA, 19 nt, Homo sapiens
ccacaggcauugaggguaa

SEQ ID NO: 1220382 - RNA, 19 nt, Homo sapiens
uagaagaggugacaugaug

SEQ ID NO: 1220383 - RNA, 19 nt, Homo sapiens
caacucaaauguaaagcaa

SEQ ID NO: 1220384 - RNA, 19 nt, Homo sapiens
gaagaggagggaacaauga

SEQ ID NO: 1220385 - RNA, 19 nt, Homo sapiens
aaagaacgcuguagaagag

SEQ ID NO: 1220386 - RNA, 19 nt, Homo sapiens
caucuaagcacaucauaaa

SEQ ID NO: 1220387 - RNA, 19 nt, Homo sapiens
cuaagcacaucauaaagaa

SEQ ID NO: 1220388 - RNA, 19 nt, Homo sapiens
gcaaguggaaggacaaaga

SEQ ID NO: 1220389 - RNA, 19 nt, Homo sapiens
gaaggaggaggaagagauu

SEQ ID NO: 1220390 - RNA, 19 nt, Homo sapiens
ugaauugaccaaaugcuua

SEQ ID NO: 1220391 - RNA, 19 nt, Homo sapiens
guacaucccuuccauuuug

SEQ ID NO: 1220392 - RNA, 19 nt, Homo sapiens
uaaagaacgcuguagaaga

SEQ ID NO: 1220393 - RNA, 19 nt, Homo sapiens
gaaggacaaagaacuguga

SEQ ID NO: 1220394 - RNA, 19 nt, Homo sapiens
ggcugaggcugguuaggua

SEQ ID NO: 1220395 - RNA, 19 nt, Homo sapiens
gaggagggaacaaugauga

SEQ ID NO: 1220396 - RNA, 19 nt, Homo sapiens
ggaagaggagggaacaaug

SEQ ID NO: 1220397 - RNA, 19 nt, Homo sapiens
gaauugaccaaaugcuuau

SEQ ID NO: 1220398 - RNA, 19 nt, Homo sapiens
aaaguaguuuggugacauu

SEQ ID NO: 1220399 - RNA, 19 nt, Homo sapiens
ggucuuagcacauguacug

SEQ ID NO: 1220400 - RNA, 19 nt, Homo sapiens
ggaaagggcaguggaaugg

SEQ ID NO: 1220401 - RNA, 19 nt, Homo sapiens
ggagaagaguggccauggu

SEQ ID NO: 1220402 - RNA, 19 nt, Homo sapiens
cauaaagaacgcuguagaa

SEQ ID NO: 1220403 - RNA, 19 nt, Homo sapiens
gagcuuaaucuuccuagga

SEQ ID NO: 1220404 - RNA, 19 nt, Homo sapiens
gugaaauagugcacaguau

SEQ ID NO: 1220405 - RNA, 19 nt, Homo sapiens
aacauugacucuagacuug

SEQ ID NO: 1220406 - RNA, 19 nt, Homo sapiens
ggaagagauuagugagaca

SEQ ID NO: 1220407 - RNA, 19 nt, Homo sapiens
ccucagaucuuuggaccuu

SEQ ID NO: 1220408 - RNA, 19 nt, Homo sapiens
gagaacugguuggcccuuu

SEQ ID NO: 1220409 - RNA, 19 nt, Homo sapiens
gcuggaaugugccuaugug

SEQ ID NO: 1220410 - RNA, 19 nt, Homo sapiens
cauugacucuagacuugua

SEQ ID NO: 1220411 - RNA, 19 nt, Homo sapiens
caguacaucccuuccauuu

SEQ ID NO: 1220412 - RNA, 19 nt, Homo sapiens
gcuuuuggcucacaucuaa

SEQ ID NO: 1220413 - RNA, 19 nt, Homo sapiens
gcucacaucuaagcacauc

SEQ ID NO: 1220414 - RNA, 19 nt, Homo sapiens
gcgucucuuucuccuguua

SEQ ID NO: 1220415 - RNA, 19 nt, Homo sapiens
ggccgaaacucuaaaaugu

SEQ ID NO: 1220416 - RNA, 19 nt, Homo sapiens
caaguggaaggacaaagaa

SEQ ID NO: 1220417 - RNA, 19 nt, Homo sapiens
cagaccaccaguaugaaua

SEQ ID NO: 1220418 - RNA, 19 nt, Homo sapiens
ugaaauagugcacaguaug

SEQ ID NO: 1220419 - RNA, 19 nt, Homo sapiens
aaacauugacucuagacuu

SEQ ID NO: 1220420 - RNA, 19 nt, Homo sapiens
aaaugcuucuaccaaagua

SEQ ID NO: 1220421 - RNA, 19 nt, Homo sapiens
ucuaagcacaucauaaaga

SEQ ID NO: 1220422 - RNA, 19 nt, Homo sapiens
ggaagcaucugaaaagcau

SEQ ID NO: 1220423 - RNA, 19 nt, Homo sapiens
gaccaccaguaugaauaaa

SEQ ID NO: 1220424 - RNA, 19 nt, Homo sapiens
caucauaaagaacgcugua

SEQ ID NO: 1220425 - RNA, 19 nt, Homo sapiens
gccagucagcguuguuuaa

SEQ ID NO: 1220426 - RNA, 19 nt, Homo sapiens
gaggaagagauuagugaga

SEQ ID NO: 1220427 - RNA, 19 nt, Homo sapiens
ucagaucuuuggaccuuuc

SEQ ID NO: 1220428 - RNA, 19 nt, Homo sapiens
ggaaggugagggcugagaa

SEQ ID NO: 1220429 - RNA, 19 nt, Homo sapiens
cacauguacugguggaguu

SEQ ID NO: 1220430 - RNA, 19 nt, Homo sapiens
aaauugggcuuggagaauc

SEQ ID NO: 1220431 - RNA, 19 nt, Homo sapiens
uaaauugggcuuggagaau

SEQ ID NO: 1220432 - RNA, 19 nt, Homo sapiens
gcaguacaucccuuccauu

SEQ ID NO: 1220433 - RNA, 19 nt, Homo sapiens
gggaaagggcaguggaaug

SEQ ID NO: 1220434 - RNA, 19 nt, Homo sapiens
gcacuguggaagcaucuga

SEQ ID NO: 1220435 - RNA, 19 nt, Homo sapiens
gaagaggugacaugaugag

SEQ ID NO: 1220436 - RNA, 19 nt, Homo sapiens
uaaaugcuucuaccaaagu

SEQ ID NO: 1220437 - RNA, 19 nt, Homo sapiens
aaucugagcaggucugaau

SEQ ID NO: 1220438 - RNA, 19 nt, Homo sapiens
agaccaccaguaugaauaa

SEQ ID NO: 1220439 - RNA, 19 nt, Homo sapiens
uccuaggacugaggucuua

SEQ ID NO: 1220440 - RNA, 19 nt, Homo sapiens
acucaaauguaaagcaaag

SEQ ID NO: 1220441 - RNA, 19 nt, Homo sapiens
acagagaggagcuggagaa

SEQ ID NO: 1220442 - RNA, 19 nt, Homo sapiens
gcagagcuuaaucuuccua

SEQ ID NO: 1220443 - RNA, 19 nt, Homo sapiens
accaaaugcuuaucuacga

SEQ ID NO: 1220444 - RNA, 19 nt, Homo sapiens
guaguuuggugacauuuug

SEQ ID NO: 1220445 - RNA, 19 nt, Homo sapiens
gagggaaagggcaguggaa

SEQ ID NO: 1220446 - RNA, 19 nt, Homo sapiens
gaaaaggaggugcuuagga

SEQ ID NO: 1220447 - RNA, 19 nt, Homo sapiens
ugaaaagcaugcacagaga

SEQ ID NO: 1220448 - RNA, 19 nt, Homo sapiens
gcaccaucccaaccaguau

SEQ ID NO: 1220449 - RNA, 19 nt, Homo sapiens
auaaaugcuucuaccaaag

SEQ ID NO: 1220450 - RNA, 19 nt, Homo sapiens
caaauguaaagcaaaguag

SEQ ID NO: 1220451 - RNA, 19 nt, Homo sapiens
ucauaaagaacgcuguaga

SEQ ID NO: 1220452 - RNA, 19 nt, Homo sapiens
aaagggccauccuggagau

SEQ ID NO: 1220453 - RNA, 19 nt, Homo sapiens
ggcaccaucccaaccagua

SEQ ID NO: 1220454 - RNA, 19 nt, Homo sapiens
ugaaggaggaggaagagau

SEQ ID NO: 1220455 - RNA, 19 nt, Homo sapiens
ugagacaggagaacugguu

SEQ ID NO: 1220456 - RNA, 19 nt, Homo sapiens
cugagcaggucugaauuga

SEQ ID NO: 1220457 - RNA, 19 nt, Homo sapiens
gaaggugagggcugagaag

SEQ ID NO: 1220458 - RNA, 19 nt, Homo sapiens
agauaaaugcuucuaccaa

SEQ ID NO: 1220459 - RNA, 19 nt, Homo sapiens
guagaagaggugacaugau

SEQ ID NO: 1220460 - RNA, 19 nt, Homo sapiens
uuccagaccaccaguauga

SEQ ID NO: 1220461 - RNA, 19 nt, Homo sapiens
ugagggcugaggcugguua

SEQ ID NO: 1220462 - RNA, 19 nt, Homo sapiens
ugguggagcugacgauuuu

SEQ ID NO: 1220463 - RNA, 19 nt, Homo sapiens
ggugacauuuugcuuuuau

SEQ ID NO: 1220464 - RNA, 19 nt, Homo sapiens
ucugaggcaugggaauauu

SEQ ID NO: 1220465 - RNA, 19 nt, Homo sapiens
ccagaccaccaguaugaau

SEQ ID NO: 1220466 - RNA, 19 nt, Homo sapiens
gaggaggaagagauuagug

SEQ ID NO: 1220467 - RNA, 19 nt, Homo sapiens
uagugcacaguaugaguua

SEQ ID NO: 1220468 - RNA, 19 nt, Homo sapiens
gcuuuuaugugaaauagug

SEQ ID NO: 1220469 - RNA, 19 nt, Homo sapiens
ucucugaggcaugggaaua

SEQ ID NO: 1220470 - RNA, 19 nt, Homo sapiens
gaaggcaaaaggggacuua

SEQ ID NO: 1220471 - RNA, 19 nt, Homo sapiens
gugcacaguaugaguuaau

SEQ ID NO: 1220472 - RNA, 19 nt, Homo sapiens
aaagagccauuuuaguuuc

SEQ ID NO: 1220473 - RNA, 19 nt, Homo sapiens
uuaaauugggcuuggagaa

SEQ ID NO: 1220474 - RNA, 19 nt, Homo sapiens
uccuggagaugaaguggaa

SEQ ID NO: 1220475 - RNA, 19 nt, Homo sapiens
gaauaaaagcuuguucugu

SEQ ID NO: 1220476 - RNA, 19 nt, Homo sapiens
acugaggucuuagcacaug

SEQ ID NO: 1220477 - RNA, 19 nt, Homo sapiens
ccuagaggcccaauauuua

SEQ ID NO: 1220478 - RNA, 19 nt, Homo sapiens
ccaaaucgcucaugguuuu

SEQ ID NO: 1220479 - RNA, 19 nt, Homo sapiens
gcauguaccagauccagua

SEQ ID NO: 1220480 - RNA, 19 nt, Homo sapiens
cugcagaccugagugcuua

SEQ ID NO: 1220481 - RNA, 19 nt, Homo sapiens
ggaccuggccucaaacuca

SEQ ID NO: 1220482 - RNA, 19 nt, Homo sapiens
ugacaggccugcugcaucu

SEQ ID NO: 1220483 - RNA, 19 nt, Homo sapiens
ggaaaagcaugaccagaug

SEQ ID NO: 1220484 - RNA, 19 nt, Homo sapiens
gggagacccugacccugaa

SEQ ID NO: 1220485 - RNA, 19 nt, Homo sapiens
ggccacagcugcucuuguc

SEQ ID NO: 1220486 - RNA, 19 nt, Homo sapiens
gagacuccguugccacaga

SEQ ID NO: 1220487 - RNA, 19 nt, Homo sapiens
ugugggaccuggccucaaa

SEQ ID NO: 1220488 - RNA, 19 nt, Homo sapiens
gcaaccggcugaccucacu

SEQ ID NO: 1220489 - RNA, 19 nt, Homo sapiens
cuugagaccucccaaucuu

SEQ ID NO: 1220490 - RNA, 19 nt, Homo sapiens
gacccuagaggcccaauau

SEQ ID NO: 1220491 - RNA, 19 nt, Homo sapiens
ccaaccgccugaccacaau

SEQ ID NO: 1220492 - RNA, 19 nt, Homo sapiens
cccuagaggcccaauauuu

SEQ ID NO: 1220493 - RNA, 19 nt, Homo sapiens
gccucaaacucaccaaauc

SEQ ID NO: 1220494 - RNA, 19 nt, Homo sapiens
agaccugagugcuuaaauc

SEQ ID NO: 1220495 - RNA, 19 nt, Homo sapiens
cacagucccucuacagaag

SEQ ID NO: 1220496 - RNA, 19 nt, Homo sapiens
caacuugcgccaccucauc

SEQ ID NO: 1220497 - RNA, 19 nt, Homo sapiens
acacagucccucuacagaa

SEQ ID NO: 1220498 - RNA, 19 nt, Homo sapiens
ugagaccucccaaucuuga

SEQ ID NO: 1220499 - RNA, 19 nt, Homo sapiens
gaccugagugcuuaaaucu

SEQ ID NO: 1220500 - RNA, 19 nt, Homo sapiens
gacacagucccucuacaga

SEQ ID NO: 1220501 - RNA, 19 nt, Homo sapiens
caucguagccucgguacug

SEQ ID NO: 1220502 - RNA, 19 nt, Homo sapiens
ggccggaccuacgaucugu

SEQ ID NO: 1220503 - RNA, 19 nt, Homo sapiens
ggccugaacccgaguuugg

SEQ ID NO: 1220504 - RNA, 19 nt, Homo sapiens
cuagaggcccaauauuuag

SEQ ID NO: 1220505 - RNA, 19 nt, Homo sapiens
guuugggccugaaguccuu

SEQ ID NO: 1220506 - RNA, 19 nt, Homo sapiens
gcagaccugagugcuuaaa

SEQ ID NO: 1220507 - RNA, 19 nt, Homo sapiens
acaaccugcuggcuucugu

SEQ ID NO: 1220508 - RNA, 19 nt, Homo sapiens
ucuggaaccccgaguauua

SEQ ID NO: 1220509 - RNA, 19 nt, Homo sapiens
gguacuggucuucaucuuc

SEQ ID NO: 1220510 - RNA, 19 nt, Homo sapiens
uaccagauccaguacaaca

SEQ ID NO: 1220511 - RNA, 19 nt, Homo sapiens
cccaccaccuccucagcua

SEQ ID NO: 1220512 - RNA, 19 nt, Homo sapiens
cgaccuggccaacaugaca

SEQ ID NO: 1220513 - RNA, 19 nt, Homo sapiens
gcaaaacaagaaaguccua

SEQ ID NO: 1220514 - RNA, 19 nt, Homo sapiens
ggacccuagaggcccaaua

SEQ ID NO: 1220515 - RNA, 19 nt, Homo sapiens
gcuuaaaucuggggcuuga

SEQ ID NO: 1220516 - RNA, 19 nt, Homo sapiens
ggccucaaacucaccaaau

SEQ ID NO: 1220517 - RNA, 19 nt, Homo sapiens
ugacucagcaccccaauau

SEQ ID NO: 1220518 - RNA, 19 nt, Homo sapiens
gcauccgcauguaccagau

SEQ ID NO: 1220519 - RNA, 19 nt, Homo sapiens
agacuccguugccacagau

SEQ ID NO: 1220520 - RNA, 19 nt, Homo sapiens
acacucagcuucagcauaa

SEQ ID NO: 1220521 - RNA, 19 nt, Homo sapiens
gaggaacagugcaguguaa

SEQ ID NO: 1220522 - RNA, 19 nt, Homo sapiens
aaggucagcucuucuagua

SEQ ID NO: 1220523 - RNA, 19 nt, Homo sapiens
gaacagugcaguguaaaga

SEQ ID NO: 1220524 - RNA, 19 nt, Homo sapiens
ggucagcucuucuaguauc

SEQ ID NO: 1220525 - RNA, 19 nt, Homo sapiens
cagccgaguuggccuauug

SEQ ID NO: 1220526 - RNA, 19 nt, Homo sapiens
gccaggaucucggcgcaua

SEQ ID NO: 1220527 - RNA, 19 nt, Homo sapiens
gcaggacagggucaucaua

SEQ ID NO: 1220528 - RNA, 19 nt, Homo sapiens
ccaguaaucccagcacuuu

SEQ ID NO: 1220529 - RNA, 19 nt, Homo sapiens
gcucucggcuacagacuuc

SEQ ID NO: 1220530 - RNA, 19 nt, Homo sapiens
ggaggaacagugcagugua

SEQ ID NO: 1220531 - RNA, 19 nt, Homo sapiens
gcugggcagucuuggguuu

SEQ ID NO: 1220532 - RNA, 19 nt, Homo sapiens
gcccuggacuccugcuuug

SEQ ID NO: 1220533 - RNA, 19 nt, Homo sapiens
aaacuaaccaaacaggaaa

SEQ ID NO: 1220534 - RNA, 19 nt, Homo sapiens
caggacagggucaucauaa

SEQ ID NO: 1220535 - RNA, 19 nt, Homo sapiens
ggccuuggcuucaguuggu

SEQ ID NO: 1220536 - RNA, 19 nt, Homo sapiens
accaggacauccagacuuu

SEQ ID NO: 1220537 - RNA, 19 nt, Homo sapiens
caaguguggcugucgcuuu

SEQ ID NO: 1220538 - RNA, 19 nt, Homo sapiens
acagugcaguguaaagaug

SEQ ID NO: 1220539 - RNA, 19 nt, Homo sapiens
ggacagggaacaccuuugc

SEQ ID NO: 1220540 - RNA, 19 nt, Homo sapiens
cugaugcccuggccuguga

SEQ ID NO: 1220541 - RNA, 19 nt, Homo sapiens
gcugugaccucggugaaag

SEQ ID NO: 1220542 - RNA, 19 nt, Homo sapiens
agagguggcugcccugagu

SEQ ID NO: 1220543 - RNA, 19 nt, Homo sapiens
ccgcaaugcugcacuucug

SEQ ID NO: 1220544 - RNA, 19 nt, Homo sapiens
aaccauaaauaacccuuca

SEQ ID NO: 1220545 - RNA, 19 nt, Homo sapiens
gaccaggacauccagacuu

SEQ ID NO: 1220546 - RNA, 19 nt, Homo sapiens
caugauguccgugauguga

SEQ ID NO: 1220547 - RNA, 19 nt, Homo sapiens
ggcugucgcuuucgaugau

SEQ ID NO: 1220548 - RNA, 19 nt, Homo sapiens
caggacccauggcacauuc

SEQ ID NO: 1220549 - RNA, 19 nt, Homo sapiens
gaacauccagggccuaccu

SEQ ID NO: 1220550 - RNA, 19 nt, Homo sapiens
ggaacagugcaguguaaag

SEQ ID NO: 1220551 - RNA, 19 nt, Homo sapiens
caggacccguggcacauuc

SEQ ID NO: 1220552 - RNA, 19 nt, Homo sapiens
caggacccguggcacauuc

SEQ ID NO: 1220553 - RNA, 19 nt, Homo sapiens
caggacccguggcacauuc

SEQ ID NO: 1220554 - RNA, 19 nt, Homo sapiens
ggggagaccuggaggaaca

SEQ ID NO: 1220555 - RNA, 19 nt, Homo sapiens
cugcagaaauugaguucca

SEQ ID NO: 1220556 - RNA, 19 nt, Homo sapiens
aggagaagguccgguacuu

SEQ ID NO: 1220557 - RNA, 19 nt, Homo sapiens
ggucaucauaaccauaaau

SEQ ID NO: 1220558 - RNA, 19 nt, Homo sapiens
aaguguggcugucgcuuuc

SEQ ID NO: 1220559 - RNA, 19 nt, Homo sapiens
aauaacccuucacguguca

SEQ ID NO: 1220560 - RNA, 19 nt, Homo sapiens
ccagcggucgucacagaaa

SEQ ID NO: 1220561 - RNA, 19 nt, Homo sapiens
cagaguugcugggcagucu

SEQ ID NO: 1220562 - RNA, 19 nt, Homo sapiens
ggacagggucaucauaacc

SEQ ID NO: 1220563 - RNA, 19 nt, Homo sapiens
gcuuugggccacagcaaga

SEQ ID NO: 1220564 - RNA, 19 nt, Homo sapiens
agggucaucauaaccauaa

SEQ ID NO: 1220565 - RNA, 19 nt, Homo sapiens
ccuauugccugcucaugcu

SEQ ID NO: 1220566 - RNA, 19 nt, Homo sapiens
gcuccaugauguccgugau

SEQ ID NO: 1220567 - RNA, 19 nt, Homo sapiens
ggaauaccauugauacuaa

SEQ ID NO: 1220568 - RNA, 19 nt, Homo sapiens
ggacauauaucgucaacuu

SEQ ID NO: 1220569 - RNA, 19 nt, Homo sapiens
gaagaugaaucguuucuga

SEQ ID NO: 1220570 - RNA, 19 nt, Homo sapiens
ccacaaaucucugagguua

SEQ ID NO: 1220571 - RNA, 19 nt, Homo sapiens
auaaagagcuggagaaauu

SEQ ID NO: 1220572 - RNA, 19 nt, Homo sapiens
uaacagagcaguuucauaa

SEQ ID NO: 1220573 - RNA, 19 nt, Homo sapiens
ggaaguggcugagaaauug

SEQ ID NO: 1220574 - RNA, 19 nt, Homo sapiens
ggaaagagaauucuaugua

SEQ ID NO: 1220575 - RNA, 19 nt, Homo sapiens
gcaaagcacagcagcauua

SEQ ID NO: 1220576 - RNA, 19 nt, Homo sapiens
gcaaguaauucgagcauga

SEQ ID NO: 1220577 - RNA, 19 nt, Homo sapiens
uaaaucaucuccucacuga

SEQ ID NO: 1220578 - RNA, 19 nt, Homo sapiens
gaaagcaucgggacauaua

SEQ ID NO: 1220579 - RNA, 19 nt, Homo sapiens
gagguuaaaugcuaaagaa

SEQ ID NO: 1220580 - RNA, 19 nt, Homo sapiens
ugaaagauauuguggagaa

SEQ ID NO: 1220581 - RNA, 19 nt, Homo sapiens
ucacuaagaucaguaauga

SEQ ID NO: 1220582 - RNA, 19 nt, Homo sapiens
gaaauuagaggaugagguu

SEQ ID NO: 1220583 - RNA, 19 nt, Homo sapiens
gcaaggcuguggacaaaga

SEQ ID NO: 1220584 - RNA, 19 nt, Homo sapiens
ggacaaauccacugguauu

SEQ ID NO: 1220585 - RNA, 19 nt, Homo sapiens
gagaagacuuugacugguu

SEQ ID NO: 1220586 - RNA, 19 nt, Homo sapiens
gaacauucuuucuuucugu

SEQ ID NO: 1220587 - RNA, 19 nt, Homo sapiens
ggaaaugaguuuguggaaa

SEQ ID NO: 1220588 - RNA, 19 nt, Homo sapiens
gcagauugcuaaacaagau

SEQ ID NO: 1220589 - RNA, 19 nt, Homo sapiens
gcugagaaauugaaacaga

SEQ ID NO: 1220590 - RNA, 19 nt, Homo sapiens
gaagcagagucaaggaauu

SEQ ID NO: 1220591 - RNA, 19 nt, Homo sapiens
gaagacaccuagacuggau

SEQ ID NO: 1220592 - RNA, 19 nt, Homo sapiens
gaaguuacacaauugauga

SEQ ID NO: 1220593 - RNA, 19 nt, Homo sapiens
gaggaggaaucauuauaga

SEQ ID NO: 1220594 - RNA, 19 nt, Homo sapiens
gcacagcagcauuaacuuu

SEQ ID NO: 1220595 - RNA, 19 nt, Homo sapiens
gaaaucagcuuuugcuuag

SEQ ID NO: 1220596 - RNA, 19 nt, Homo sapiens
guuaacagauccaucaguu

SEQ ID NO: 1220597 - RNA, 19 nt, Homo sapiens
ggguauacaugaaguaguu

SEQ ID NO: 1220598 - RNA, 19 nt, Homo sapiens
caccuagacuggaugauaa

SEQ ID NO: 1220599 - RNA, 19 nt, Homo sapiens
gaaagagaauuggaagcuu

SEQ ID NO: 1220600 - RNA, 19 nt, Homo sapiens
gauuaaggcuguuagucuu

SEQ ID NO: 1220601 - RNA, 19 nt, Homo sapiens
aaagaggucacucaaauaa

SEQ ID NO: 1220602 - RNA, 19 nt, Homo sapiens
acaaaucucugagguuaaa

SEQ ID NO: 1220603 - RNA, 19 nt, Homo sapiens
ccauugauacuaaggauua

SEQ ID NO: 1220604 - RNA, 19 nt, Homo sapiens
caacaucaguuaauucacu

SEQ ID NO: 1220605 - RNA, 19 nt, Homo sapiens
gagaaugcccaguuauuga

SEQ ID NO: 1220606 - RNA, 19 nt, Homo sapiens
gagagaaugcccaguuauu

SEQ ID NO: 1220607 - RNA, 19 nt, Homo sapiens
aagagagaaugcccaguua

SEQ ID NO: 1220608 - RNA, 19 nt, Homo sapiens
ccagugagauuaugaaacu

SEQ ID NO: 1220609 - RNA, 19 nt, Homo sapiens
ucucugagguuaaaugcua

SEQ ID NO: 1220610 - RNA, 19 nt, Homo sapiens
aaaguaacaugaugcucua

SEQ ID NO: 1220611 - RNA, 19 nt, Homo sapiens
gaggagagacgacuagaga

SEQ ID NO: 1220612 - RNA, 19 nt, Homo sapiens
auacagacaccaucuauuu

SEQ ID NO: 1220613 - RNA, 19 nt, Homo sapiens
ggaguuaacagagcaguuu

SEQ ID NO: 1220614 - RNA, 19 nt, Homo sapiens
gagcaugaagucaaguaua

SEQ ID NO: 1220615 - RNA, 19 nt, Homo sapiens
ucccaaagcugauaaucuu

SEQ ID NO: 1220616 - RNA, 19 nt, Homo sapiens
caagaucaguuggcaguau

SEQ ID NO: 1220617 - RNA, 19 nt, Homo sapiens
uaacagauccaucaguuuc

SEQ ID NO: 1220618 - RNA, 19 nt, Homo sapiens
ggagggagagaauaagaaa

SEQ ID NO: 1220619 - RNA, 19 nt, Homo sapiens
ggaaaucagcuuuugcuua

SEQ ID NO: 1220620 - RNA, 19 nt, Homo sapiens
cagauaaauccaaggaaua

SEQ ID NO: 1220621 - RNA, 19 nt, Homo sapiens
agcaugaagucaaguauaa

SEQ ID NO: 1220622 - RNA, 19 nt, Homo sapiens
gcccgaagcacccuuaauu

SEQ ID NO: 1220623 - RNA, 19 nt, Homo sapiens
gcuuagugaucaggaguua

SEQ ID NO: 1220624 - RNA, 19 nt, Homo sapiens
ggacaugcuuugugauacu

SEQ ID NO: 1220625 - RNA, 19 nt, Homo sapiens
guaacaugaugcucuacaa

SEQ ID NO: 1220626 - RNA, 19 nt, Homo sapiens
gcaagacaagaguuaguuu

SEQ ID NO: 1220627 - RNA, 19 nt, Homo sapiens
caccaucuauuugugauaa

SEQ ID NO: 1220628 - RNA, 19 nt, Homo sapiens
ugaugaaguuacacaauug

SEQ ID NO: 1220629 - RNA, 19 nt, Homo sapiens
ggaugagguucaaacucua

SEQ ID NO: 1220630 - RNA, 19 nt, Homo sapiens
gaacguguugucugaaaga

SEQ ID NO: 1220631 - RNA, 19 nt, Homo sapiens
uuuauuacguguccucuuu

SEQ ID NO: 1220632 - RNA, 19 nt, Homo sapiens
ccaaggaauaccauugaua

SEQ ID NO: 1220633 - RNA, 19 nt, Homo sapiens
acagauaaauccaaggaau

SEQ ID NO: 1220634 - RNA, 19 nt, Homo sapiens
cugaugaaguuacacaauu

SEQ ID NO: 1220635 - RNA, 19 nt, Homo sapiens
cguugaagaugaaucguuu

SEQ ID NO: 1220636 - RNA, 19 nt, Homo sapiens
ccaaagcugauaaucuuaa

SEQ ID NO: 1220637 - RNA, 19 nt, Homo sapiens
caacagauaaauccaagga

SEQ ID NO: 1220638 - RNA, 19 nt, Homo sapiens
uaagagagaaugcccaguu

SEQ ID NO: 1220639 - RNA, 19 nt, Homo sapiens
cagcagcauuaacuuugua

SEQ ID NO: 1220640 - RNA, 19 nt, Homo sapiens
ggagagacgacuagagaug

SEQ ID NO: 1220641 - RNA, 19 nt, Homo sapiens
gaaugugaaugaacagaac

SEQ ID NO: 1220642 - RNA, 19 nt, Homo sapiens
gaaagauauuguggagaau

SEQ ID NO: 1220643 - RNA, 19 nt, Homo sapiens
caauugauggcuucaguaa

SEQ ID NO: 1220644 - RNA, 19 nt, Homo sapiens
cagagcaguuucauaaagu

SEQ ID NO: 1220645 - RNA, 19 nt, Homo sapiens
gcauuaacuuuguauacca

SEQ ID NO: 1220646 - RNA, 19 nt, Homo sapiens
aagaaagcaucgggacaua

SEQ ID NO: 1220647 - RNA, 19 nt, Homo sapiens
ggaaugugaaugaacagaa

SEQ ID NO: 1220648 - RNA, 19 nt, Homo sapiens
gacuuugacugguuguuug

SEQ ID NO: 1220649 - RNA, 19 nt, Homo sapiens
cauaggcuuuaccaaguuu

SEQ ID NO: 1220650 - RNA, 19 nt, Homo sapiens
uaaagagcuggagaaauua

SEQ ID NO: 1220651 - RNA, 19 nt, Homo sapiens
acagagcaguuucauaaag

SEQ ID NO: 1220652 - RNA, 19 nt, Homo sapiens
gaacuucaggcucuuacug

SEQ ID NO: 1220653 - RNA, 19 nt, Homo sapiens
cguguugucugaaagagaa

SEQ ID NO: 1220654 - RNA, 19 nt, Homo sapiens
gaugaaucguuucugaagu

SEQ ID NO: 1220655 - RNA, 19 nt, Homo sapiens
ucaaggaauucuaaaugca

SEQ ID NO: 1220656 - RNA, 19 nt, Homo sapiens
gguuaaaugcuaaagaaga

SEQ ID NO: 1220657 - RNA, 19 nt, Homo sapiens
ucaaauggaaagagaauuc

SEQ ID NO: 1220658 - RNA, 19 nt, Homo sapiens
uugcugaugugaagacaaa

SEQ ID NO: 1220659 - RNA, 19 nt, Homo sapiens
guggacaugcuuugugaua

SEQ ID NO: 1220660 - RNA, 19 nt, Homo sapiens
caaggaauaccauugauac

SEQ ID NO: 1220661 - RNA, 19 nt, Homo sapiens
ggcaucauuugaacuucua

SEQ ID NO: 1220662 - RNA, 19 nt, Homo sapiens
ucaacaccguaaacccaua

SEQ ID NO: 1220663 - RNA, 19 nt, Homo sapiens
ucauaggcuuuaccaaguu

SEQ ID NO: 1220664 - RNA, 19 nt, Homo sapiens
gaauaccauugauacuaag

SEQ ID NO: 1220665 - RNA, 19 nt, Homo sapiens
gauauacagacaccaucua

SEQ ID NO: 1220666 - RNA, 19 nt, Homo sapiens
cacaauugaugauguucuu

SEQ ID NO: 1220667 - RNA, 19 nt, Homo sapiens
gaacaggucuagcuaguua

SEQ ID NO: 1220668 - RNA, 19 nt, Homo sapiens
gcaaauagacugauacaua

SEQ ID NO: 1220669 - RNA, 19 nt, Homo sapiens
gaaguuaagugcauuguuu

SEQ ID NO: 1220670 - RNA, 19 nt, Homo sapiens
gcagaaagauuccaaagga

SEQ ID NO: 1220671 - RNA, 19 nt, Homo sapiens
ggacggagcucccagauuc

SEQ ID NO: 1220672 - RNA, 19 nt, Homo sapiens
gaacccaucuuucaauuca

SEQ ID NO: 1220673 - RNA, 19 nt, Homo sapiens
ggacacaccucaguaaaga

SEQ ID NO: 1220674 - RNA, 19 nt, Homo sapiens
gcacaaagcuuggcagaag

SEQ ID NO: 1220675 - RNA, 19 nt, Homo sapiens
caacacggcugaucuuuca

SEQ ID NO: 1220676 - RNA, 19 nt, Homo sapiens
gaaaucaccuucguugaau

SEQ ID NO: 1220677 - RNA, 19 nt, Homo sapiens
gaaacccugucucuauuaa

SEQ ID NO: 1220678 - RNA, 19 nt, Homo sapiens
gcaguugccuguaauccua

SEQ ID NO: 1220679 - RNA, 19 nt, Homo sapiens
gaagauggcaaugaaauaa

SEQ ID NO: 1220680 - RNA, 19 nt, Homo sapiens
uaauggagcugcccuuuga

SEQ ID NO: 1220681 - RNA, 19 nt, Homo sapiens
gaaaucgguuguuugaaga

SEQ ID NO: 1220682 - RNA, 19 nt, Homo sapiens
ugaagaagcucacucuguu

SEQ ID NO: 1220683 - RNA, 19 nt, Homo sapiens
ggagcugcccuuugaauua

SEQ ID NO: 1220684 - RNA, 19 nt, Homo sapiens
gcagaaaucgguuguuuga

SEQ ID NO: 1220685 - RNA, 19 nt, Homo sapiens
gagaacagcuuggacauca

SEQ ID NO: 1220686 - RNA, 19 nt, Homo sapiens
aagaauggcuugugcuuaa

SEQ ID NO: 1220687 - RNA, 19 nt, Homo sapiens
gagcugcccuuugaauuaa

SEQ ID NO: 1220688 - RNA, 19 nt, Homo sapiens
cgagaugggugaaucauga

SEQ ID NO: 1220689 - RNA, 19 nt, Homo sapiens
gagaaucuguucccagcua

SEQ ID NO: 1220690 - RNA, 19 nt, Homo sapiens
gaaacaaacucugagaagu

SEQ ID NO: 1220691 - RNA, 19 nt, Homo sapiens
gaaguaggcuaagagaaga

SEQ ID NO: 1220692 - RNA, 19 nt, Homo sapiens
guagauaucucagcaaaca

SEQ ID NO: 1220693 - RNA, 19 nt, Homo sapiens
gaagagcauuccuccagaa

SEQ ID NO: 1220694 - RNA, 19 nt, Homo sapiens
gcaaugaaauaauggaaag

SEQ ID NO: 1220695 - RNA, 19 nt, Homo sapiens
gcagugcguuuguguuuga

SEQ ID NO: 1220696 - RNA, 19 nt, Homo sapiens
guucagaccugcagaggaa

SEQ ID NO: 1220697 - RNA, 19 nt, Homo sapiens
gaaaggaacacucucacaa

SEQ ID NO: 1220698 - RNA, 19 nt, Homo sapiens
ugacggaaauguucuguau

SEQ ID NO: 1220699 - RNA, 19 nt, Homo sapiens
ggagaggugggauucauua

SEQ ID NO: 1220700 - RNA, 19 nt, Homo sapiens
gaagaagcucacucuguua

SEQ ID NO: 1220701 - RNA, 19 nt, Homo sapiens
aaacaaacucugagaagua

SEQ ID NO: 1220702 - RNA, 19 nt, Homo sapiens
ugacugaugugauugaaga

SEQ ID NO: 1220703 - RNA, 19 nt, Homo sapiens
gaaauuagacacaaucucu

SEQ ID NO: 1220704 - RNA, 19 nt, Homo sapiens
gaccaaauacugaaguuaa

SEQ ID NO: 1220705 - RNA, 19 nt, Homo sapiens
ugaccuaccuucccuauuc

SEQ ID NO: 1220706 - RNA, 19 nt, Homo sapiens
cagcagaaaucgguuguuu

SEQ ID NO: 1220707 - RNA, 19 nt, Homo sapiens
ggaggacugcuuccacuua

SEQ ID NO: 1220708 - RNA, 19 nt, Homo sapiens
gaggugggauucauuacaa

SEQ ID NO: 1220709 - RNA, 19 nt, Homo sapiens
gaagaauggcuugugcuua

SEQ ID NO: 1220710 - RNA, 19 nt, Homo sapiens
caauguggguuucaacuau

SEQ ID NO: 1220711 - RNA, 19 nt, Homo sapiens
gugaaacccugucucuauu

SEQ ID NO: 1220712 - RNA, 19 nt, Homo sapiens
agaauaaucuuccuugagu

SEQ ID NO: 1220713 - RNA, 19 nt, Homo sapiens
gagcagugcguuuguguuu

SEQ ID NO: 1220714 - RNA, 19 nt, Homo sapiens
gaaaagaguaggaaaauga

SEQ ID NO: 1220715 - RNA, 19 nt, Homo sapiens
ggaagcagagguugcagua

SEQ ID NO: 1220716 - RNA, 19 nt, Homo sapiens
guagaaauguauggugauu

SEQ ID NO: 1220717 - RNA, 19 nt, Homo sapiens
ggacaacucugcccauagc

SEQ ID NO: 1220718 - RNA, 19 nt, Homo sapiens
gaauaucugcccaugcuuu

SEQ ID NO: 1220719 - RNA, 19 nt, Homo sapiens
gagcauuuauauuggacua

SEQ ID NO: 1220720 - RNA, 19 nt, Homo sapiens
aaacugcuauuuccauaug

SEQ ID NO: 1220721 - RNA, 19 nt, Homo sapiens
cauaagcaauaccuugauu

SEQ ID NO: 1220722 - RNA, 19 nt, Homo sapiens
aagaauggcuucauagaca

SEQ ID NO: 1220723 - RNA, 19 nt, Homo sapiens
acucauaaguccaaacauu

SEQ ID NO: 1220724 - RNA, 19 nt, Homo sapiens
agacacaugugauucuuga

SEQ ID NO: 1220725 - RNA, 19 nt, Homo sapiens
aaccaaaucucacaucuuc

SEQ ID NO: 1220726 - RNA, 19 nt, Homo sapiens
gaaugguacauaagcaaua

SEQ ID NO: 1220727 - RNA, 19 nt, Homo sapiens
ucaccuucguugaaucuua

SEQ ID NO: 1220728 - RNA, 19 nt, Homo sapiens
aacaaugacugaugugauu

SEQ ID NO: 1220729 - RNA, 19 nt, Homo sapiens
gaauaaucuuccuugaguu

SEQ ID NO: 1220730 - RNA, 19 nt, Homo sapiens
ggacuaaucagaugagagu

SEQ ID NO: 1220731 - RNA, 19 nt, Homo sapiens
ugaagaaccugaaagaacu

SEQ ID NO: 1220732 - RNA, 19 nt, Homo sapiens
gcaagaauggcuucauaga

SEQ ID NO: 1220733 - RNA, 19 nt, Homo sapiens
gaaagauuccaaaggagaa

SEQ ID NO: 1220734 - RNA, 19 nt, Homo sapiens
gcaaaucucacuauucucu

SEQ ID NO: 1220735 - RNA, 19 nt, Homo sapiens
agaaaucgguuguuugaag

SEQ ID NO: 1220736 - RNA, 19 nt, Homo sapiens
guaauuucaugcucccaaa

SEQ ID NO: 1220737 - RNA, 19 nt, Homo sapiens
cugcaagaauggcuucaua

SEQ ID NO: 1220738 - RNA, 19 nt, Homo sapiens
gaacaaugacugaugugau

SEQ ID NO: 1220739 - RNA, 19 nt, Homo sapiens
cccaugggcuguuugaauu

SEQ ID NO: 1220740 - RNA, 19 nt, Homo sapiens
ccuccaagauggccaugua

SEQ ID NO: 1220741 - RNA, 19 nt, Homo sapiens
gcagugagccgagaucaug

SEQ ID NO: 1220742 - RNA, 19 nt, Homo sapiens
gauauuuccagguucauuu

SEQ ID NO: 1220743 - RNA, 19 nt, Homo sapiens
gaacgggaucgccaacauu

SEQ ID NO: 1220744 - RNA, 19 nt, Homo sapiens
ugaagcaaguuacauuugu

SEQ ID NO: 1220745 - RNA, 19 nt, Homo sapiens
gcacuugaacaaugacuga

SEQ ID NO: 1220746 - RNA, 19 nt, Homo sapiens
gaaacaaaggcuggaauau

SEQ ID NO: 1220747 - RNA, 19 nt, Homo sapiens
uagagagacuggauuguuc

SEQ ID NO: 1220748 - RNA, 19 nt, Homo sapiens
aagcugagaucccaccauu

SEQ ID NO: 1220749 - RNA, 19 nt, Homo sapiens
gggaaacucgugucaagaa

SEQ ID NO: 1220750 - RNA, 19 nt, Homo sapiens
acuauucucuggagcuaua

SEQ ID NO: 1220751 - RNA, 19 nt, Homo sapiens
ugaccgaccugccgcaaga

SEQ ID NO: 1220752 - RNA, 19 nt, Homo sapiens
gaacagcuuggacaucaug

SEQ ID NO: 1220753 - RNA, 19 nt, Homo sapiens
caggacaacucugcccaua

SEQ ID NO: 1220754 - RNA, 19 nt, Homo sapiens
aacaaaggcuggaauaucu

SEQ ID NO: 1220755 - RNA, 19 nt, Homo sapiens
aaagauaaagggauuguga

SEQ ID NO: 1220756 - RNA, 19 nt, Homo sapiens
ugacucauccacaccuuua

SEQ ID NO: 1220757 - RNA, 19 nt, Homo sapiens
gaagcucacucuguuaguc

SEQ ID NO: 1220758 - RNA, 19 nt, Homo sapiens
ucaguuauuucaagagaug

SEQ ID NO: 1220759 - RNA, 19 nt, Homo sapiens
gaagagcgccuuggagaag

SEQ ID NO: 1220760 - RNA, 19 nt, Homo sapiens
ggacugcuuccacuuagaa

SEQ ID NO: 1220761 - RNA, 19 nt, Homo sapiens
uggaaaggcuugagaagag

SEQ ID NO: 1220762 - RNA, 19 nt, Homo sapiens
caccuucguugaaucuuaa

SEQ ID NO: 1220763 - RNA, 19 nt, Homo sapiens
agaaaucaccuucguugaa

SEQ ID NO: 1220764 - RNA, 19 nt, Homo sapiens
uuggugggcuuacucauaa

SEQ ID NO: 1220765 - RNA, 19 nt, Homo sapiens
ucuagaaaccacuaucaua

SEQ ID NO: 1220766 - RNA, 19 nt, Homo sapiens
cugcaaaucucacuauucu

SEQ ID NO: 1220767 - RNA, 19 nt, Homo sapiens
gaaguuaagugcauuguuu

SEQ ID NO: 1220768 - RNA, 19 nt, Homo sapiens
ggacggagcucccagauuc

SEQ ID NO: 1220769 - RNA, 19 nt, Homo sapiens
gcacaaagcuuggcagaag

SEQ ID NO: 1220770 - RNA, 19 nt, Homo sapiens
gcaguugccuguaauccua

SEQ ID NO: 1220771 - RNA, 19 nt, Homo sapiens
gaagauggcaaugaaauaa

SEQ ID NO: 1220772 - RNA, 19 nt, Homo sapiens
uaauggagcugcccuuuga

SEQ ID NO: 1220773 - RNA, 19 nt, Homo sapiens
gaaaucgguuguuugaaga

SEQ ID NO: 1220774 - RNA, 19 nt, Homo sapiens
ugaagaagcucacucuguu

SEQ ID NO: 1220775 - RNA, 19 nt, Homo sapiens
ggagcugcccuuugaauua

SEQ ID NO: 1220776 - RNA, 19 nt, Homo sapiens
gcagaaaucgguuguuuga

SEQ ID NO: 1220777 - RNA, 19 nt, Homo sapiens
aagaauggcuugugcuuaa

SEQ ID NO: 1220778 - RNA, 19 nt, Homo sapiens
gagcugcccuuugaauuaa

SEQ ID NO: 1220779 - RNA, 19 nt, Homo sapiens
gagaaucuguucccagcua

SEQ ID NO: 1220780 - RNA, 19 nt, Homo sapiens
guagauaucucagcaaaca

SEQ ID NO: 1220781 - RNA, 19 nt, Homo sapiens
gaagagcauuccuccagaa

SEQ ID NO: 1220782 - RNA, 19 nt, Homo sapiens
gcaaugaaauaauggaaag

SEQ ID NO: 1220783 - RNA, 19 nt, Homo sapiens
gcagugcguuuguguuuga

SEQ ID NO: 1220784 - RNA, 19 nt, Homo sapiens
gaaaggaacacucucacaa

SEQ ID NO: 1220785 - RNA, 19 nt, Homo sapiens
gaagaagcucacucuguua

SEQ ID NO: 1220786 - RNA, 19 nt, Homo sapiens
ugaccuaccuucccuauuc

SEQ ID NO: 1220787 - RNA, 19 nt, Homo sapiens
cagcagaaaucgguuguuu

SEQ ID NO: 1220788 - RNA, 19 nt, Homo sapiens
gaagaauggcuugugcuua

SEQ ID NO: 1220789 - RNA, 19 nt, Homo sapiens
caauguggguuucaacuau

SEQ ID NO: 1220790 - RNA, 19 nt, Homo sapiens
gagcagugcguuuguguuu

SEQ ID NO: 1220791 - RNA, 19 nt, Homo sapiens
cauaagcaauaccuugauu

SEQ ID NO: 1220792 - RNA, 19 nt, Homo sapiens
aagaauggcuucauagaca

SEQ ID NO: 1220793 - RNA, 19 nt, Homo sapiens
aaccaaaucucacaucuuc

SEQ ID NO: 1220794 - RNA, 19 nt, Homo sapiens
gaaugguacauaagcaaua

SEQ ID NO: 1220795 - RNA, 19 nt, Homo sapiens
ccacaguuccugagaauga

SEQ ID NO: 1220796 - RNA, 19 nt, Homo sapiens
ugaagaaccugaaagaacu

SEQ ID NO: 1220797 - RNA, 19 nt, Homo sapiens
gcaagaauggcuucauaga

SEQ ID NO: 1220798 - RNA, 19 nt, Homo sapiens
gcaaaucucacuauucucu

SEQ ID NO: 1220799 - RNA, 19 nt, Homo sapiens
agaaaucgguuguuugaag

SEQ ID NO: 1220800 - RNA, 19 nt, Homo sapiens
gcccaaauacugaaguuaa

SEQ ID NO: 1220801 - RNA, 19 nt, Homo sapiens
cugcaagaauggcuucaua

SEQ ID NO: 1220802 - RNA, 19 nt, Homo sapiens
guaauuucaugcucccaaa

SEQ ID NO: 1220803 - RNA, 19 nt, Homo sapiens
gcagugagccgagaucaug

SEQ ID NO: 1220804 - RNA, 19 nt, Homo sapiens
gagaaugaacagguaauuu

SEQ ID NO: 1220805 - RNA, 19 nt, Homo sapiens
gauauuuccagguucauuu

SEQ ID NO: 1220806 - RNA, 19 nt, Homo sapiens
gaacgggaucgccaacauu

SEQ ID NO: 1220807 - RNA, 19 nt, Homo sapiens
ugaagcaaguuacauuugu

SEQ ID NO: 1220808 - RNA, 19 nt, Homo sapiens
uagagagacuggauuguuc

SEQ ID NO: 1220809 - RNA, 19 nt, Homo sapiens
acuauucucuggagcuaua

SEQ ID NO: 1220810 - RNA, 19 nt, Homo sapiens
ugaccgaccugccgcaaga

SEQ ID NO: 1220811 - RNA, 19 nt, Homo sapiens
gggaaacucgugucaagaa

SEQ ID NO: 1220812 - RNA, 19 nt, Homo sapiens
ugacucauccacaccuuua

SEQ ID NO: 1220813 - RNA, 19 nt, Homo sapiens
gaagcucacucuguuaguc

SEQ ID NO: 1220814 - RNA, 19 nt, Homo sapiens
gaagagcgccuuggagaag

SEQ ID NO: 1220815 - RNA, 19 nt, Homo sapiens
ucuagaaaccacuaucaua

SEQ ID NO: 1220816 - RNA, 19 nt, Homo sapiens
cugcaaaucucacuauucu

SEQ ID NO: 1220817 - RNA, 19 nt, Homo sapiens
ugaagauggcaaugaaaua

SEQ ID NO: 1220818 - RNA, 19 nt, Homo sapiens
ucaacuaucugaagagcau

SEQ ID NO: 1220819 - RNA, 19 nt, Homo sapiens
uggaaaggcuugagaagag

SEQ ID NO: 1220820 - RNA, 19 nt, Homo sapiens
uugaagaccuuaaagaaag

SEQ ID NO: 1220821 - RNA, 19 nt, Homo sapiens
gaaagccuauauugaagac

SEQ ID NO: 1220822 - RNA, 19 nt, Homo sapiens
gaaguuaugaaagccuaua

SEQ ID NO: 1220823 - RNA, 19 nt, Homo sapiens
ggaaaucuagaauuaaugg

SEQ ID NO: 1220824 - RNA, 19 nt, Homo sapiens
agacacaccugagagaaug

SEQ ID NO: 1220825 - RNA, 19 nt, Homo sapiens
ggaagaauggcuugugcuu

SEQ ID NO: 1220826 - RNA, 19 nt, Homo sapiens
ggaaacucgugucaagaag

SEQ ID NO: 1220827 - RNA, 19 nt, Homo sapiens
guuaugaaagccuauauug

SEQ ID NO: 1220828 - RNA, 19 nt, Homo sapiens
cugagagaaugguacauaa

SEQ ID NO: 1220829 - RNA, 19 nt, Homo sapiens
agaguucacuucccaagga

SEQ ID NO: 1220830 - RNA, 19 nt, Homo sapiens
uggacaagauugaaaggaa

SEQ ID NO: 1220831 - RNA, 19 nt, Homo sapiens
gcuguauacugcaagaaug

SEQ ID NO: 1220832 - RNA, 19 nt, Homo sapiens
gaaaccccaucucuacuaa

SEQ ID NO: 1220833 - RNA, 19 nt, Homo sapiens
ugaagaccuuaaagaaaga

SEQ ID NO: 1220834 - RNA, 19 nt, Homo sapiens
gaauugggagauugugaaa

SEQ ID NO: 1220835 - RNA, 19 nt, Homo sapiens
ggaacuuuguggccgaaug

SEQ ID NO: 1220836 - RNA, 19 nt, Homo sapiens
agaaugaacagguaauuuc

SEQ ID NO: 1220837 - RNA, 19 nt, Homo sapiens
ccagguucauuugcauaua

SEQ ID NO: 1220838 - RNA, 19 nt, Homo sapiens
ggacaaagucuagaaacca

SEQ ID NO: 1220839 - RNA, 19 nt, Homo sapiens
gaaauaauggaaagugaac

SEQ ID NO: 1220840 - RNA, 19 nt, Homo sapiens
gauaaugcccaaugugaag

SEQ ID NO: 1220841 - RNA, 19 nt, Homo sapiens
gcucccaacugcccuuugu

SEQ ID NO: 1220842 - RNA, 19 nt, Homo sapiens
gcaggagaaucgcuugaac

SEQ ID NO: 1220843 - RNA, 19 nt, Homo sapiens
cgaccugccgcaagauaua

SEQ ID NO: 1220844 - RNA, 19 nt, Homo sapiens
gaaccugaaagaacucaau

SEQ ID NO: 1220845 - RNA, 19 nt, Homo sapiens
ucagaagacugcaaaucuc

SEQ ID NO: 1220846 - RNA, 19 nt, Homo sapiens
aaagaaagagaaucuguuc

SEQ ID NO: 1220847 - RNA, 19 nt, Homo sapiens
gugggaaacucgugucaag

SEQ ID NO: 1220848 - RNA, 19 nt, Homo sapiens
gggcacagacccacaguuc

SEQ ID NO: 1220849 - RNA, 19 nt, Homo sapiens
ucucuggagcuauauauaa

SEQ ID NO: 1220850 - RNA, 19 nt, Homo sapiens
ucacuauucucuggagcua

SEQ ID NO: 1220851 - RNA, 19 nt, Homo sapiens
guagaaaugccugaggaaa

SEQ ID NO: 1220852 - RNA, 19 nt, Homo sapiens
gagaaugguacauaagcaa

SEQ ID NO: 1220853 - RNA, 19 nt, Homo sapiens
agauggcaaugaaauaaug

SEQ ID NO: 1220854 - RNA, 19 nt, Homo sapiens
ggagcucccagauucauug

SEQ ID NO: 1220855 - RNA, 19 nt, Homo sapiens
gcguuuguguuugaacuuu

SEQ ID NO: 1220856 - RNA, 19 nt, Homo sapiens
ggaguucgaggcugguuug

SEQ ID NO: 1220857 - RNA, 19 nt, Homo sapiens
gaacagguaauuucaugcu

SEQ ID NO: 1220858 - RNA, 19 nt, Homo sapiens
gacccacaguuccugagaa

SEQ ID NO: 1220859 - RNA, 19 nt, Homo sapiens
acacagggaacacuucuug

SEQ ID NO: 1220860 - RNA, 19 nt, Homo sapiens
gacugcaaaucucacuauu

SEQ ID NO: 1220861 - RNA, 19 nt, Homo sapiens
agacuggauuguucuggaa

SEQ ID NO: 1220862 - RNA, 19 nt, Homo sapiens
caaagucuagaaaccacua

SEQ ID NO: 1220863 - RNA, 19 nt, Homo sapiens
uaaggacaaagucuagaaa

SEQ ID NO: 1220864 - RNA, 19 nt, Homo sapiens
gaugagaauucuggaucug

SEQ ID NO: 1220865 - RNA, 19 nt, Homo sapiens
uaagcaauaccuugauuca

SEQ ID NO: 1220866 - RNA, 19 nt, Homo sapiens
ccacagccggguagaaaug

SEQ ID NO: 1220867 - RNA, 19 nt, Homo sapiens
gaaaggaaaucgccaguug

SEQ ID NO: 1220868 - RNA, 19 nt, Homo sapiens
gaacaaaucaugcuaacuu

SEQ ID NO: 1220869 - RNA, 19 nt, Homo sapiens
gcaaauagcaauugaagaa

SEQ ID NO: 1220870 - RNA, 19 nt, Homo sapiens
gaaccaaaguaacagagua

SEQ ID NO: 1220871 - RNA, 19 nt, Homo sapiens
gcagacauguuuacuaaug

SEQ ID NO: 1220872 - RNA, 19 nt, Homo sapiens
gaagucagaugcccuggaa

SEQ ID NO: 1220873 - RNA, 19 nt, Homo sapiens
gaaugaagcccuuaacaga

SEQ ID NO: 1220874 - RNA, 19 nt, Homo sapiens
ugaaggagcugcagacaug

SEQ ID NO: 1220875 - RNA, 19 nt, Homo sapiens
ggaauggacucagaccuuu

SEQ ID NO: 1220876 - RNA, 19 nt, Homo sapiens
gaaaggaagagcauuuauu

SEQ ID NO: 1220877 - RNA, 19 nt, Homo sapiens
gcacuugggugaccagaug

SEQ ID NO: 1220878 - RNA, 19 nt, Homo sapiens
gaaccacuuucaaacauug

SEQ ID NO: 1220879 - RNA, 19 nt, Homo sapiens
gauguccacugaugaaauu

SEQ ID NO: 1220880 - RNA, 19 nt, Homo sapiens
gaggaccgguugcagcuua

SEQ ID NO: 1220881 - RNA, 19 nt, Homo sapiens
ccaagaguauuacaacaaa

SEQ ID NO: 1220882 - RNA, 19 nt, Homo sapiens
agaaggagcuacagaaugu

SEQ ID NO: 1220883 - RNA, 19 nt, Homo sapiens
aggagagacugaauuaaua

SEQ ID NO: 1220884 - RNA, 19 nt, Homo sapiens
ucagagguguugggaauua

SEQ ID NO: 1220885 - RNA, 19 nt, Homo sapiens
gccaaagaauuaucuagaa

SEQ ID NO: 1220886 - RNA, 19 nt, Homo sapiens
gcucagagguguugggaau

SEQ ID NO: 1220887 - RNA, 19 nt, Homo sapiens
ccacaggguuuggagaaua

SEQ ID NO: 1220888 - RNA, 19 nt, Homo sapiens
acagauagcucaccuugga

SEQ ID NO: 1220889 - RNA, 19 nt, Homo sapiens
gcaccagcuugcauaaauu

SEQ ID NO: 1220890 - RNA, 19 nt, Homo sapiens
ugacagaacuaagcaaaga

SEQ ID NO: 1220891 - RNA, 19 nt, Homo sapiens
ucuagaagcacaucaaaua

SEQ ID NO: 1220892 - RNA, 19 nt, Homo sapiens
ugaggugacuuccuaacua

SEQ ID NO: 1220893 - RNA, 19 nt, Homo sapiens
gggaauagaaccuuucaaa

SEQ ID NO: 1220894 - RNA, 19 nt, Homo sapiens
cugcagacauguuuacuaa

SEQ ID NO: 1220895 - RNA, 19 nt, Homo sapiens
gaacuaagcaaagaauuuc

SEQ ID NO: 1220896 - RNA, 19 nt, Homo sapiens
ggagagacugaauuaauaa

SEQ ID NO: 1220897 - RNA, 19 nt, Homo sapiens
gaaaagccacgucauauaa

SEQ ID NO: 1220898 - RNA, 19 nt, Homo sapiens
agacggccauucuuguuua

SEQ ID NO: 1220899 - RNA, 19 nt, Homo sapiens
gcucugaccaugcuuagua

SEQ ID NO: 1220900 - RNA, 19 nt, Homo sapiens
ggacgacgcuguguuugau

SEQ ID NO: 1220901 - RNA, 19 nt, Homo sapiens
uggcucaucucucugaaua

SEQ ID NO: 1220902 - RNA, 19 nt, Homo sapiens
caaagagguugcccagaga

SEQ ID NO: 1220903 - RNA, 19 nt, Homo sapiens
ggacucagaccuuuaaaca

SEQ ID NO: 1220904 - RNA, 19 nt, Homo sapiens
gcaaagacacgggaacuga

SEQ ID NO: 1220905 - RNA, 19 nt, Homo sapiens
gcugagugcugaaaucaug

SEQ ID NO: 1220906 - RNA, 19 nt, Homo sapiens
gagaugguguccaacuuug

SEQ ID NO: 1220907 - RNA, 19 nt, Homo sapiens
gauaccagaugccuucuuc

SEQ ID NO: 1220908 - RNA, 19 nt, Homo sapiens
cuaacuaugugguuucauu

SEQ ID NO: 1220909 - RNA, 19 nt, Homo sapiens
gaggugacuuccuaacuau

SEQ ID NO: 1220910 - RNA, 19 nt, Homo sapiens
gcccugaggugacuuccua

SEQ ID NO: 1220911 - RNA, 19 nt, Homo sapiens
ucacacauuucccaaaguu

SEQ ID NO: 1220912 - RNA, 19 nt, Homo sapiens
acagggagcuggagaagga

SEQ ID NO: 1220913 - RNA, 19 nt, Homo sapiens
gauuaauccucaauucaug

SEQ ID NO: 1220914 - RNA, 19 nt, Homo sapiens
gaagguggugaaacuauuu

SEQ ID NO: 1220915 - RNA, 19 nt, Homo sapiens
gaaaugcaaauagcaauug

SEQ ID NO: 1220916 - RNA, 19 nt, Homo sapiens
gaaccaccauucacugagu

SEQ ID NO: 1220917 - RNA, 19 nt, Homo sapiens
gauuagaaccacuuucaaa

SEQ ID NO: 1220918 - RNA, 19 nt, Homo sapiens
gaucauagccaggauuaga

SEQ ID NO: 1220919 - RNA, 19 nt, Homo sapiens
ucucaagguuugucucuaa

SEQ ID NO: 1220920 - RNA, 19 nt, Homo sapiens
caacagaaccaagaaguau

SEQ ID NO: 1220921 - RNA, 19 nt, Homo sapiens
gugcugaaaucauggacua

SEQ ID NO: 1220922 - RNA, 19 nt, Homo sapiens
gggagcaacugcagacaga

SEQ ID NO: 1220923 - RNA, 19 nt, Homo sapiens
agagcaaucuagaaucuuu

SEQ ID NO: 1220924 - RNA, 19 nt, Homo sapiens
uaaguccagucacacauuu

SEQ ID NO: 1220925 - RNA, 19 nt, Homo sapiens
cagcuacccuugugaccua

SEQ ID NO: 1220926 - RNA, 19 nt, Homo sapiens
ucaaagcauugcccuaaga

SEQ ID NO: 1220927 - RNA, 19 nt, Homo sapiens
uaagaaugcuggugaagag

SEQ ID NO: 1220928 - RNA, 19 nt, Homo sapiens
gggacucacuggacaagaa

SEQ ID NO: 1220929 - RNA, 19 nt, Homo sapiens
uuuguuagguugcuguuua

SEQ ID NO: 1220930 - RNA, 19 nt, Homo sapiens
cugaguagcuaauggguuu

SEQ ID NO: 1220931 - RNA, 19 nt, Homo sapiens
gagauccuguucccuauuc

SEQ ID NO: 1220932 - RNA, 19 nt, Homo sapiens
gagagauccuguucccuau

SEQ ID NO: 1220933 - RNA, 19 nt, Homo sapiens
gcucaaagcauugcccuaa

SEQ ID NO: 1220934 - RNA, 19 nt, Homo sapiens
aaauaaagcccuucacuca

SEQ ID NO: 1220935 - RNA, 19 nt, Homo sapiens
uggaacagcuggucaagga

SEQ ID NO: 1220936 - RNA, 19 nt, Homo sapiens
gaagugauuuccuguagcu

SEQ ID NO: 1220937 - RNA, 19 nt, Homo sapiens
gaucuacgauggaagugau

SEQ ID NO: 1220938 - RNA, 19 nt, Homo sapiens
cgaagguggugaaacuauu

SEQ ID NO: 1220939 - RNA, 19 nt, Homo sapiens
agacucagcuguugucaca

SEQ ID NO: 1220940 - RNA, 19 nt, Homo sapiens
ugacaaaucgugagaggaa

SEQ ID NO: 1220941 - RNA, 19 nt, Homo sapiens
gcagagugcccaacuggaa

SEQ ID NO: 1220942 - RNA, 19 nt, Homo sapiens
ccaaagaauuaucuagaag

SEQ ID NO: 1220943 - RNA, 19 nt, Homo sapiens
cauuuggaauugcacuuua

SEQ ID NO: 1220944 - RNA, 19 nt, Homo sapiens
gcgcaugauucuacauaug

SEQ ID NO: 1220945 - RNA, 19 nt, Homo sapiens
cagauucacuuacccacaa

SEQ ID NO: 1220946 - RNA, 19 nt, Homo sapiens
ccaacuuuacugagaauua

SEQ ID NO: 1220947 - RNA, 19 nt, Homo sapiens
caacaagaaccaccauuca

SEQ ID NO: 1220948 - RNA, 19 nt, Homo sapiens
gccaucaggugcucaauca

SEQ ID NO: 1220949 - RNA, 19 nt, Homo sapiens
gcccuaagaaucagaagua

SEQ ID NO: 1220950 - RNA, 19 nt, Homo sapiens
gcugaagucuggagaacug

SEQ ID NO: 1220951 - RNA, 19 nt, Homo sapiens
ggacaacguucgccucacu

SEQ ID NO: 1220952 - RNA, 19 nt, Homo sapiens
gggaaaggaagagcauuua

SEQ ID NO: 1220953 - RNA, 19 nt, Homo sapiens
gaugggauccgauuuguca

SEQ ID NO: 1220954 - RNA, 19 nt, Homo sapiens
cuacugggauuacuucugu

SEQ ID NO: 1220955 - RNA, 19 nt, Homo sapiens
caaaacaucuuggcauauu

SEQ ID NO: 1220956 - RNA, 19 nt, Homo sapiens
gguugcagcuuacccagaa

SEQ ID NO: 1220957 - RNA, 19 nt, Homo sapiens
ccagagcaaucuagaaucu

SEQ ID NO: 1220958 - RNA, 19 nt, Homo sapiens
gaauggacucagaccuuua

SEQ ID NO: 1220959 - RNA, 19 nt, Homo sapiens
ccucuaagcugcacucucu

SEQ ID NO: 1220960 - RNA, 19 nt, Homo sapiens
uugaguaucuccugcaauu

SEQ ID NO: 1220961 - RNA, 19 nt, Homo sapiens
gcaaggagggcgaguguca

SEQ ID NO: 1220962 - RNA, 19 nt, Homo sapiens
caucgaagguggugaaacu

SEQ ID NO: 1220963 - RNA, 19 nt, Homo sapiens
caggagagcuggauguuuu

SEQ ID NO: 1220964 - RNA, 19 nt, Homo sapiens
gcaacaagaaccaccauuc

SEQ ID NO: 1220965 - RNA, 19 nt, Homo sapiens
ggagacauacagacaagaa

SEQ ID NO: 1220966 - RNA, 19 nt, Homo sapiens
ugaggacacugaagacaug

SEQ ID NO: 1220967 - RNA, 19 nt, Homo sapiens
ggagagagguccagucuga

SEQ ID NO: 1220968 - RNA, 19 nt, Homo sapiens
gcacugaccagcccugauu

SEQ ID NO: 1220969 - RNA, 19 nt, Homo sapiens
ggacggagcaugccaagug

SEQ ID NO: 1220970 - RNA, 19 nt, Homo sapiens
uggcuuaacuguaccuguu

SEQ ID NO: 1220971 - RNA, 19 nt, Homo sapiens
uggcagagcugguguccau

SEQ ID NO: 1220972 - RNA, 19 nt, Homo sapiens
caugggaccuaaagacagu

SEQ ID NO: 1220973 - RNA, 19 nt, Homo sapiens
guuuggaugcuucugaaua

SEQ ID NO: 1220974 - RNA, 19 nt, Homo sapiens
gcuuaacuguaccuguuug

SEQ ID NO: 1220975 - RNA, 19 nt, Homo sapiens
gagacuuuguccacagugu

SEQ ID NO: 1220976 - RNA, 19 nt, Homo sapiens
ugaggugcuucuucugcua

SEQ ID NO: 1220977 - RNA, 19 nt, Homo sapiens
cgucuggccuccuucuaug

SEQ ID NO: 1220978 - RNA, 19 nt, Homo sapiens
caugggcucugaggaguug

SEQ ID NO: 1220979 - RNA, 19 nt, Homo sapiens
cuaaagacagugccaagug

SEQ ID NO: 1220980 - RNA, 19 nt, Homo sapiens
ccacguggaugggcagauc

SEQ ID NO: 1220981 - RNA, 19 nt, Homo sapiens
uaacuguaccuguuuggau

SEQ ID NO: 1220982 - RNA, 19 nt, Homo sapiens
gggcauauucugagauugg

SEQ ID NO: 1220983 - RNA, 19 nt, Homo sapiens
agagagguccagucugaaa

SEQ ID NO: 1220984 - RNA, 19 nt, Homo sapiens
gaagggccagcugggcaua

SEQ ID NO: 1220985 - RNA, 19 nt, Homo sapiens
ggggauggcuuaacuguac

SEQ ID NO: 1220986 - RNA, 19 nt, Homo sapiens
uuuggaugcuucugaauag

SEQ ID NO: 1220987 - RNA, 19 nt, Homo sapiens
gagccaguguucccuccau

SEQ ID NO: 1220988 - RNA, 19 nt, Homo sapiens
cugggcauauucugagauu

SEQ ID NO: 1220989 - RNA, 19 nt, Homo sapiens
gagguccagucugaaagug

SEQ ID NO: 1220990 - RNA, 19 nt, Homo sapiens
caaggugaggugcuucuuc

SEQ ID NO: 1220991 - RNA, 19 nt, Homo sapiens
aaggugaggugcuucuucu

SEQ ID NO: 1220992 - RNA, 19 nt, Homo sapiens
acacaggccaucaggacaa

SEQ ID NO: 1220993 - RNA, 19 nt, Homo sapiens
ccagcugggcauauucuga

SEQ ID NO: 1220994 - RNA, 19 nt, Homo sapiens
gcgucuggccuccuucuau

SEQ ID NO: 1220995 - RNA, 19 nt, Homo sapiens
gaggugcuucuucugcuau

SEQ ID NO: 1220996 - RNA, 19 nt, Homo sapiens
auucugagauuggccauca

SEQ ID NO: 1220997 - RNA, 19 nt, Homo sapiens
ccuggucugugcugagugu

SEQ ID NO: 1220998 - RNA, 19 nt, Homo sapiens
caggagagagguccagucu

SEQ ID NO: 1220999 - RNA, 19 nt, Homo sapiens
ggagagagguccagucuga

SEQ ID NO: 1221000 - RNA, 19 nt, Homo sapiens
gcacugaccagcccugauu

SEQ ID NO: 1221001 - RNA, 19 nt, Homo sapiens
ggacggagcaugccaagug

SEQ ID NO: 1221002 - RNA, 19 nt, Homo sapiens
uggcuuaacuguaccuguu

SEQ ID NO: 1221003 - RNA, 19 nt, Homo sapiens
uggcagagcugguguccau

SEQ ID NO: 1221004 - RNA, 19 nt, Homo sapiens
caugggaccuaaagacagu

SEQ ID NO: 1221005 - RNA, 19 nt, Homo sapiens
guuuggaugcuucugaaua

SEQ ID NO: 1221006 - RNA, 19 nt, Homo sapiens
gcuuaacuguaccuguuug

SEQ ID NO: 1221007 - RNA, 19 nt, Homo sapiens
gagacuuuguccacagugu

SEQ ID NO: 1221008 - RNA, 19 nt, Homo sapiens
ugaggugcuucuucugcua

SEQ ID NO: 1221009 - RNA, 19 nt, Homo sapiens
cgucuggccuccuucuaug

SEQ ID NO: 1221010 - RNA, 19 nt, Homo sapiens
caugggcucugaggaguug

SEQ ID NO: 1221011 - RNA, 19 nt, Homo sapiens
cuaaagacagugccaagug

SEQ ID NO: 1221012 - RNA, 19 nt, Homo sapiens
ccacguggaugggcagauc

SEQ ID NO: 1221013 - RNA, 19 nt, Homo sapiens
uaacuguaccuguuuggau

SEQ ID NO: 1221014 - RNA, 19 nt, Homo sapiens
gggcauauucugagauugg

SEQ ID NO: 1221015 - RNA, 19 nt, Homo sapiens
agagagguccagucugaaa

SEQ ID NO: 1221016 - RNA, 19 nt, Homo sapiens
gaagggccagcugggcaua

SEQ ID NO: 1221017 - RNA, 19 nt, Homo sapiens
ggggauggcuuaacuguac

SEQ ID NO: 1221018 - RNA, 19 nt, Homo sapiens
uuuggaugcuucugaauag

SEQ ID NO: 1221019 - RNA, 19 nt, Homo sapiens
gagccaguguucccuccau

SEQ ID NO: 1221020 - RNA, 19 nt, Homo sapiens
cugggcauauucugagauu

SEQ ID NO: 1221021 - RNA, 19 nt, Homo sapiens
gagguccagucugaaagug

SEQ ID NO: 1221022 - RNA, 19 nt, Homo sapiens
caaggugaggugcuucuuc

SEQ ID NO: 1221023 - RNA, 19 nt, Homo sapiens
aaggugaggugcuucuucu

SEQ ID NO: 1221024 - RNA, 19 nt, Homo sapiens
acacaggccaucaggacaa

SEQ ID NO: 1221025 - RNA, 19 nt, Homo sapiens
ccagcugggcauauucuga

SEQ ID NO: 1221026 - RNA, 19 nt, Homo sapiens
gcgucuggccuccuucuau

SEQ ID NO: 1221027 - RNA, 19 nt, Homo sapiens
gaggugcuucuucugcuau

SEQ ID NO: 1221028 - RNA, 19 nt, Homo sapiens
auucugagauuggccauca

SEQ ID NO: 1221029 - RNA, 19 nt, Homo sapiens
ccuggucugugcugagugu

SEQ ID NO: 1221030 - RNA, 19 nt, Homo sapiens
caggagagagguccagucu

SEQ ID NO: 1221031 - RNA, 19 nt, Homo sapiens
gaccuuaaauccuuacuua

SEQ ID NO: 1221032 - RNA, 19 nt, Homo sapiens
gcacggaaaugcccuguga

SEQ ID NO: 1221033 - RNA, 19 nt, Homo sapiens
gcacgcggcuugucggaaa

SEQ ID NO: 1221034 - RNA, 19 nt, Homo sapiens
gugaaugaauugaugacua

SEQ ID NO: 1221035 - RNA, 19 nt, Homo sapiens
uuaaggaguuggcagauga

SEQ ID NO: 1221036 - RNA, 19 nt, Homo sapiens
gagcucaccuguuuuguuu

SEQ ID NO: 1221037 - RNA, 19 nt, Homo sapiens
gaacggcaccuuagcagau

SEQ ID NO: 1221038 - RNA, 19 nt, Homo sapiens
caacuuggugacucauuua

SEQ ID NO: 1221039 - RNA, 19 nt, Homo sapiens
gguuugaccuuaaauccuu

SEQ ID NO: 1221040 - RNA, 19 nt, Homo sapiens
guacuucgcuccuccucau

SEQ ID NO: 1221041 - RNA, 19 nt, Homo sapiens
caccuuagcagauacuuaa

SEQ ID NO: 1221042 - RNA, 19 nt, Homo sapiens
gugaacgcgugaaugaauu

SEQ ID NO: 1221043 - RNA, 19 nt, Homo sapiens
gcaccuuagcagauacuua

SEQ ID NO: 1221044 - RNA, 19 nt, Homo sapiens
gaaaccccaucucuacuaa

SEQ ID NO: 1221045 - RNA, 19 nt, Homo sapiens
gaacgccccugacugagaa

SEQ ID NO: 1221046 - RNA, 19 nt, Homo sapiens
gaaagcagcacggaaaugc

SEQ ID NO: 1221047 - RNA, 19 nt, Homo sapiens
ucugaguucuagaugguua

SEQ ID NO: 1221048 - RNA, 19 nt, Homo sapiens
ccuauaaucccagcacuuu

SEQ ID NO: 1221049 - RNA, 19 nt, Homo sapiens
gcaggagaauggcgugaac

SEQ ID NO: 1221050 - RNA, 19 nt, Homo sapiens
uggcaacugugguauuuca

SEQ ID NO: 1221051 - RNA, 19 nt, Homo sapiens
ggaaagcagcacggaaaug

SEQ ID NO: 1221052 - RNA, 19 nt, Homo sapiens
guucugaguucuagauggu

SEQ ID NO: 1221053 - RNA, 19 nt, Homo sapiens
aaucaaggcguucugaguu

SEQ ID NO: 1221054 - RNA, 19 nt, Homo sapiens
uuuggcaacugugguauuu

SEQ ID NO: 1221055 - RNA, 19 nt, Homo sapiens
cuacagcgcagaugguaau

SEQ ID NO: 1221056 - RNA, 19 nt, Homo sapiens
ucgagaccgucguggcuaa

SEQ ID NO: 1221057 - RNA, 19 nt, Homo sapiens
gaaaaguacagggauguuu

SEQ ID NO: 1221058 - RNA, 19 nt, Homo sapiens
cacugucacugccaacuug

SEQ ID NO: 1221059 - RNA, 19 nt, Homo sapiens
gcaccuguagucccagcua

SEQ ID NO: 1221060 - RNA, 19 nt, Homo sapiens
uauaaucccagcacuuuag

SEQ ID NO: 1221061 - RNA, 19 nt, Homo sapiens
guuugaccuuaaauccuua

SEQ ID NO: 1221062 - RNA, 19 nt, Homo sapiens
guaggcguuugcugugaga

SEQ ID NO: 1221063 - RNA, 19 nt, Homo sapiens
acugugguauuucagguuu

SEQ ID NO: 1221064 - RNA, 19 nt, Homo sapiens
gcucaccuguuuuguuuug

SEQ ID NO: 1221065 - RNA, 19 nt, Homo sapiens
aacggcaccuuagcagaua

SEQ ID NO: 1221066 - RNA, 19 nt, Homo sapiens
aguucuagaugguuaauag

SEQ ID NO: 1221067 - RNA, 19 nt, Homo sapiens
cuauaaucccagcacuuua

SEQ ID NO: 1221068 - RNA, 19 nt, Homo sapiens
gaugagugggagagagaaa

SEQ ID NO: 1221069 - RNA, 19 nt, Homo sapiens
acgcgugaaugaauugaug

SEQ ID NO: 1221070 - RNA, 19 nt, Homo sapiens
cagaugagugggagagaga

SEQ ID NO: 1221071 - RNA, 19 nt, Homo sapiens
gggaaagcagcacggaaau

SEQ ID NO: 1221072 - RNA, 19 nt, Homo sapiens
gaaaaucaaggcguucuga

SEQ ID NO: 1221073 - RNA, 19 nt, Homo sapiens
gaacgcgugaaugaauuga

SEQ ID NO: 1221074 - RNA, 19 nt, Homo sapiens
gaggcggagcuuucaguga

SEQ ID NO: 1221075 - RNA, 19 nt, Homo sapiens
ccggugaggucgguacuuc

SEQ ID NO: 1221076 - RNA, 19 nt, Homo sapiens
cgacugguguaggcguuug

SEQ ID NO: 1221077 - RNA, 19 nt, Homo sapiens
ggcguuugcugugagaaug

SEQ ID NO: 1221078 - RNA, 19 nt, Homo sapiens
gaucacgaaaucaggagau

SEQ ID NO: 1221079 - RNA, 19 nt, Homo sapiens
ugugguauuucagguuuga

SEQ ID NO: 1221080 - RNA, 19 nt, Homo sapiens
guguaggcguuugcuguga

SEQ ID NO: 1221081 - RNA, 19 nt, Homo sapiens
ugugaacgcgugaaugaau

SEQ ID NO: 1221082 - RNA, 19 nt, Homo sapiens
ggagagagaaaacuaaucu

SEQ ID NO: 1221083 - RNA, 19 nt, Homo sapiens
cuuggugacucauuuaaaa

SEQ ID NO: 1221084 - RNA, 19 nt, Homo sapiens
gcugugagaauggagaaug

SEQ ID NO: 1221085 - RNA, 19 nt, Homo sapiens
uacaaggauuggucuaggu

SEQ ID NO: 1221086 - RNA, 19 nt, Homo sapiens
caaggcguucugaguucua

SEQ ID NO: 1221087 - RNA, 19 nt, Homo sapiens
ccacugucacugccaacuu

SEQ ID NO: 1221088 - RNA, 19 nt, Homo sapiens
gaugguaaugccguucuga

SEQ ID NO: 1221089 - RNA, 19 nt, Homo sapiens
gccugacgcuagcggugaa

SEQ ID NO: 1221090 - RNA, 19 nt, Homo sapiens
ggggaaagcagcacggaaa

SEQ ID NO: 1221091 - RNA, 19 nt, Homo sapiens
gcugggaacggcaccuuag

SEQ ID NO: 1221092 - RNA, 19 nt, Homo sapiens
gaaaugaaagcuugggaua

SEQ ID NO: 1221093 - RNA, 19 nt, Homo sapiens
aaugaaagcuugggauaua

SEQ ID NO: 1221094 - RNA, 19 nt, Homo sapiens
uagaaucacuaccuugaaa

SEQ ID NO: 1221095 - RNA, 19 nt, Homo sapiens
ucaguuuccucaucuguaa

SEQ ID NO: 1221096 - RNA, 19 nt, Homo sapiens
gcaaggugaugagaagcua

SEQ ID NO: 1221097 - RNA, 19 nt, Homo sapiens
gcaacuaccuggcccuuuu

SEQ ID NO: 1221098 - RNA, 19 nt, Homo sapiens
gcaccuaacagaccuugaa

SEQ ID NO: 1221099 - RNA, 19 nt, Homo sapiens
gaaucacuaccuugaaauu

SEQ ID NO: 1221100 - RNA, 19 nt, Homo sapiens
acaggaacccagcuauuua

SEQ ID NO: 1221101 - RNA, 19 nt, Homo sapiens
gaugccagcugggcucuug

SEQ ID NO: 1221102 - RNA, 19 nt, Homo sapiens
gaaacaggaacccagcuau

SEQ ID NO: 1221103 - RNA, 19 nt, Homo sapiens
gcugaccgcaccauuauug

SEQ ID NO: 1221104 - RNA, 19 nt, Homo sapiens
gaggugagagugauuagug

SEQ ID NO: 1221105 - RNA, 19 nt, Homo sapiens
ucagcugaccgcaccauua

SEQ ID NO: 1221106 - RNA, 19 nt, Homo sapiens
gaggaggugagagugauua

SEQ ID NO: 1221107 - RNA, 19 nt, Homo sapiens
aaacaggaacccagcuauu

SEQ ID NO: 1221108 - RNA, 19 nt, Homo sapiens
gagccucaguuuccucauc

SEQ ID NO: 1221109 - RNA, 19 nt, Homo sapiens
cauccucagugguggcuuu

SEQ ID NO: 1221110 - RNA, 19 nt, Homo sapiens
cagcugaccgcaccauuau

SEQ ID NO: 1221111 - RNA, 19 nt, Homo sapiens
gaaauuccauccaaaagac

SEQ ID NO: 1221112 - RNA, 19 nt, Homo sapiens
ccuaacagaccuugaaaca

SEQ ID NO: 1221113 - RNA, 19 nt, Homo sapiens
gugcugugcugguuucaag

SEQ ID NO: 1221114 - RNA, 19 nt, Homo sapiens
gggaggaggugagagugau

SEQ ID NO: 1221115 - RNA, 19 nt, Homo sapiens
ggagggaggaggugagagu

SEQ ID NO: 1221116 - RNA, 19 nt, Homo sapiens
gugauuagugggagaagaa

SEQ ID NO: 1221117 - RNA, 19 nt, Homo sapiens
gcuauuuaguggucgaagu

SEQ ID NO: 1221118 - RNA, 19 nt, Homo sapiens
ccuacucccugcacacaga

SEQ ID NO: 1221119 - RNA, 19 nt, Homo sapiens
aacaggaacccagcuauuu

SEQ ID NO: 1221120 - RNA, 19 nt, Homo sapiens
ggaacccagcuauuuagug

SEQ ID NO: 1221121 - RNA, 19 nt, Homo sapiens
ugaaacaggaacccagcua

SEQ ID NO: 1221122 - RNA, 19 nt, Homo sapiens
caagguggagggcuacuca

SEQ ID NO: 1221123 - RNA, 19 nt, Homo sapiens
gcccaauaaauguguguuu

SEQ ID NO: 1221124 - RNA, 19 nt, Homo sapiens
cggcgaugcccaauaaaug

SEQ ID NO: 1221125 - RNA, 19 nt, Homo sapiens
ggaggaggugagagugauu

SEQ ID NO: 1221126 - RNA, 19 nt, Homo sapiens
ggcgaugcccaauaaaugu

SEQ ID NO: 1221127 - RNA, 19 nt, Homo sapiens
gaccuuggacauccuguuc

SEQ ID NO: 1221128 - RNA, 19 nt, Homo sapiens
augaaagcuugggauauaa

SEQ ID NO: 1221129 - RNA, 19 nt, Homo sapiens
ccuugaaauuccauccaaa

SEQ ID NO: 1221130 - RNA, 19 nt, Homo sapiens
gcacagaccaauggcaacu

SEQ ID NO: 1221131 - RNA, 19 nt, Homo sapiens
ugacuucgcgcugcaccua

SEQ ID NO: 1221132 - RNA, 19 nt, Homo sapiens
cgagagagcccguguuccu

SEQ ID NO: 1221133 - RNA, 19 nt, Homo sapiens
caggaacccagcuauuuag

SEQ ID NO: 1221134 - RNA, 19 nt, Homo sapiens
guguggcccuaccggauga

SEQ ID NO: 1221135 - RNA, 19 nt, Homo sapiens
ucacuaccuugaaauucca

SEQ ID NO: 1221136 - RNA, 19 nt, Homo sapiens
gugacccuguggagcauug

SEQ ID NO: 1221137 - RNA, 19 nt, Homo sapiens
ggacuccccucuuccucaa

SEQ ID NO: 1221138 - RNA, 19 nt, Homo sapiens
gcuaugaagggcacaaggu

SEQ ID NO: 1221139 - RNA, 19 nt, Homo sapiens
acagaccaauggcaacuac

SEQ ID NO: 1221140 - RNA, 19 nt, Homo sapiens
gaagcuacaaggcgaccau

SEQ ID NO: 1221141 - RNA, 19 nt, Homo sapiens
gaaagcuugggauauaagg

SEQ ID NO: 1221142 - RNA, 19 nt, Homo sapiens
uuuagaaucacuaccuuga

SEQ ID NO: 1221143 - RNA, 19 nt, Homo sapiens
aaaugaaagcuugggauau

SEQ ID NO: 1221144 - RNA, 19 nt, Homo sapiens
ggacuggcaaggugaugag

SEQ ID NO: 1221145 - RNA, 19 nt, Homo sapiens
ccaaaggacucccugauug

SEQ ID NO: 1221146 - RNA, 19 nt, Homo sapiens
gaagagagagugugagugu

SEQ ID NO: 1221147 - RNA, 19 nt, Homo sapiens
gaacaccuauagagagagu

SEQ ID NO: 1221148 - RNA, 19 nt, Homo sapiens
caaagaagaggaagaggaa

SEQ ID NO: 1221149 - RNA, 19 nt, Homo sapiens
caaaggacucccugauuga

SEQ ID NO: 1221150 - RNA, 19 nt, Homo sapiens
ggaaagaggaagagagagu

SEQ ID NO: 1221151 - RNA, 19 nt, Homo sapiens
gcccagacauugagaaacu

SEQ ID NO: 1221152 - RNA, 19 nt, Homo sapiens
aauaaaagaugcagagcua

SEQ ID NO: 1221153 - RNA, 19 nt, Homo sapiens
agagagaguguguguguuu

SEQ ID NO: 1221154 - RNA, 19 nt, Homo sapiens
gagcuaucaucucuuaaaa

SEQ ID NO: 1221155 - RNA, 19 nt, Homo sapiens
uugagaaacuugggaagaa

SEQ ID NO: 1221156 - RNA, 19 nt, Homo sapiens
ccacggaauuugauuuuga

SEQ ID NO: 1221157 - RNA, 19 nt, Homo sapiens
gaaauccagcggcucuaug

SEQ ID NO: 1221158 - RNA, 19 nt, Homo sapiens
acacaugcccacggaauuu

SEQ ID NO: 1221159 - RNA, 19 nt, Homo sapiens
gagaaacuugggaagaaga

SEQ ID NO: 1221160 - RNA, 19 nt, Homo sapiens
gacaugaagagacacaaga

SEQ ID NO: 1221161 - RNA, 19 nt, Homo sapiens
uugaacaccuauagagaga

SEQ ID NO: 1221162 - RNA, 19 nt, Homo sapiens
ccacugcuccugccucuag

SEQ ID NO: 1221163 - RNA, 19 nt, Homo sapiens
gaguguguguuuucuauug

SEQ ID NO: 1221164 - RNA, 19 nt, Homo sapiens
ggacaugaagagacacaag

SEQ ID NO: 1221165 - RNA, 19 nt, Homo sapiens
aaauccagcggcucuauga

SEQ ID NO: 1221166 - RNA, 19 nt, Homo sapiens
ugagaaacuugggaagaag

SEQ ID NO: 1221167 - RNA, 19 nt, Homo sapiens
ccacacaugcccacggaau

SEQ ID NO: 1221168 - RNA, 19 nt, Homo sapiens
cgggaaagaggaagagaga

SEQ ID NO: 1221169 - RNA, 19 nt, Homo sapiens
gagagaguguguguguuuu

SEQ ID NO: 1221170 - RNA, 19 nt, Homo sapiens
agaggaagagagaguguga

SEQ ID NO: 1221171 - RNA, 19 nt, Homo sapiens
gcucuggccguggaggaua

SEQ ID NO: 1221172 - RNA, 19 nt, Homo sapiens
gcagcggaaauacugauuc

SEQ ID NO: 1221173 - RNA, 19 nt, Homo sapiens
gaugagccagugacaccaa

SEQ ID NO: 1221174 - RNA, 19 nt, Homo sapiens
auagagagagugugugugu

SEQ ID NO: 1221175 - RNA, 19 nt, Homo sapiens
agagagagugugugagugu

SEQ ID NO: 1221176 - RNA, 19 nt, Homo sapiens
aagaggagagauccgauga

SEQ ID NO: 1221177 - RNA, 19 nt, Homo sapiens
agagagagugugagugugu

SEQ ID NO: 1221178 - RNA, 19 nt, Homo sapiens
cagcccagacauugagaaa

SEQ ID NO: 1221179 - RNA, 19 nt, Homo sapiens
cgaaauccagcggcucuau

SEQ ID NO: 1221180 - RNA, 19 nt, Homo sapiens
ggagccggaggccaaagaa

SEQ ID NO: 1221181 - RNA, 19 nt, Homo sapiens
ggaggccaaagaagaggaa

SEQ ID NO: 1221182 - RNA, 19 nt, Homo sapiens
gaccuggacugaauuuucu

SEQ ID NO: 1221183 - RNA, 19 nt, Homo sapiens
gaguguguguguuuucuau

SEQ ID NO: 1221184 - RNA, 19 nt, Homo sapiens
uauugaacaccuauagaga

SEQ ID NO: 1221185 - RNA, 19 nt, Homo sapiens
gugaguguguguuuucuau

SEQ ID NO: 1221186 - RNA, 19 nt, Homo sapiens
uagagagaguguguguguu

SEQ ID NO: 1221187 - RNA, 19 nt, Homo sapiens
uagaguguguguguguguu

SEQ ID NO: 1221188 - RNA, 19 nt, Homo sapiens
gugaguguguguguguguu

SEQ ID NO: 1221189 - RNA, 19 nt, Homo sapiens
aacagcacguugcgggaaa

SEQ ID NO: 1221190 - RNA, 19 nt, Homo sapiens
cuauauagagagagugugu

SEQ ID NO: 1221191 - RNA, 19 nt, Homo sapiens
gaaaccucaagcucccaaa

SEQ ID NO: 1221192 - RNA, 19 nt, Homo sapiens
ccagacauugagaaacuug

SEQ ID NO: 1221193 - RNA, 19 nt, Homo sapiens
acaugaagagacacaagaa

SEQ ID NO: 1221194 - RNA, 19 nt, Homo sapiens
acacugagcuggaggauuu

SEQ ID NO: 1221195 - RNA, 19 nt, Homo sapiens
gacaaggucuuaucuaugg

SEQ ID NO: 1221196 - RNA, 19 nt, Homo sapiens
gugacaaggucuuaucuau

SEQ ID NO: 1221197 - RNA, 19 nt, Homo sapiens
aggcuuagcucaacccaaa

SEQ ID NO: 1221198 - RNA, 19 nt, Homo sapiens
caggaugucuugugagugu

SEQ ID NO: 1221199 - RNA, 19 nt, Homo sapiens
ggacugaccaccuucuuca

SEQ ID NO: 1221200 - RNA, 19 nt, Homo sapiens
gaaaguggacagugguuca

SEQ ID NO: 1221201 - RNA, 19 nt, Homo sapiens
cauccucccuggcaucuga

SEQ ID NO: 1221202 - RNA, 19 nt, Homo sapiens
gaaaacaacuggaaaugcu

SEQ ID NO: 1221203 - RNA, 19 nt, Homo sapiens
gaucuuggcaguucagcuu

SEQ ID NO: 1221204 - RNA, 19 nt, Homo sapiens
ccaggcggaugaaagagaa

SEQ ID NO: 1221205 - RNA, 19 nt, Homo sapiens
gagccaggcggaugaaaga

SEQ ID NO: 1221206 - RNA, 19 nt, Homo sapiens
gguauaacuucaccaucau

SEQ ID NO: 1221207 - RNA, 19 nt, Homo sapiens
gagaagugggagaaggaua

SEQ ID NO: 1221208 - RNA, 19 nt, Homo sapiens
uagaagagcagcuguaugc

SEQ ID NO: 1221209 - RNA, 19 nt, Homo sapiens
ccagguggaucagaagaau

SEQ ID NO: 1221210 - RNA, 19 nt, Homo sapiens
ugaaagagaagugggagaa

SEQ ID NO: 1221211 - RNA, 19 nt, Homo sapiens
ugacaaggucuuaucuaug

SEQ ID NO: 1221212 - RNA, 19 nt, Homo sapiens
gcagugacaaggucuuauc

SEQ ID NO: 1221213 - RNA, 19 nt, Homo sapiens
ucaaugagagacugcaaga

SEQ ID NO: 1221214 - RNA, 19 nt, Homo sapiens
gcaguucagcuucgaugga

SEQ ID NO: 1221215 - RNA, 19 nt, Homo sapiens
cccuggagcuuccucauca

SEQ ID NO: 1221216 - RNA, 19 nt, Homo sapiens
gucaggaugucuugugagu

SEQ ID NO: 1221217 - RNA, 19 nt, Homo sapiens
agagccagguggaucagaa

SEQ ID NO: 1221218 - RNA, 19 nt, Homo sapiens
gcuuagggacuuccugaug

SEQ ID NO: 1221219 - RNA, 19 nt, Homo sapiens
uaacuucaccaucauucau

SEQ ID NO: 1221220 - RNA, 19 nt, Homo sapiens
gaaagagaagugggagaag

SEQ ID NO: 1221221 - RNA, 19 nt, Homo sapiens
gcagaggcucagacuggaa

SEQ ID NO: 1221222 - RNA, 19 nt, Homo sapiens
guauaacuucaccaucauu

SEQ ID NO: 1221223 - RNA, 19 nt, Homo sapiens
cucacucucucugguauaa

SEQ ID NO: 1221224 - RNA, 19 nt, Homo sapiens
ggaugucuugugaguguga

SEQ ID NO: 1221225 - RNA, 19 nt, Homo sapiens
agguggaucagaagaauuu

SEQ ID NO: 1221226 - RNA, 19 nt, Homo sapiens
caccauggccccaggcuua

SEQ ID NO: 1221227 - RNA, 19 nt, Homo sapiens
ggagccaggcggaugaaag

SEQ ID NO: 1221228 - RNA, 19 nt, Homo sapiens
gagaaggauagcggacuga

SEQ ID NO: 1221229 - RNA, 19 nt, Homo sapiens
gagcuggcuuagggacuuc

SEQ ID NO: 1221230 - RNA, 19 nt, Homo sapiens
gugugaagccgauggauac

SEQ ID NO: 1221231 - RNA, 19 nt, Homo sapiens
agagcuggcuuagggacuu

SEQ ID NO: 1221232 - RNA, 19 nt, Homo sapiens
uucaagauggucucaauga

SEQ ID NO: 1221233 - RNA, 19 nt, Homo sapiens
agaagugggagaaggauag

SEQ ID NO: 1221234 - RNA, 19 nt, Homo sapiens
gcucacucucucugguaua

SEQ ID NO: 1221235 - RNA, 19 nt, Homo sapiens
ccguggaucuuggcaguuc

SEQ ID NO: 1221236 - RNA, 19 nt, Homo sapiens
ccacagcaccacccaccau

SEQ ID NO: 1221237 - RNA, 19 nt, Homo sapiens
gacugcaagagcuggcuua

SEQ ID NO: 1221238 - RNA, 19 nt, Homo sapiens
gaacaggcuuucuauaaca

SEQ ID NO: 1221239 - RNA, 19 nt, Homo sapiens
gcacagcauucuaaacuau

SEQ ID NO: 1221240 - RNA, 19 nt, Homo sapiens
gggaacaggcuuucuauaa

SEQ ID NO: 1221241 - RNA, 19 nt, Homo sapiens
cccauaaucucuacccuua

SEQ ID NO: 1221242 - RNA, 19 nt, Homo sapiens
cggaauuucugucuauuaa

SEQ ID NO: 1221243 - RNA, 19 nt, Homo sapiens
ggaacaggcuuucuauaac

SEQ ID NO: 1221244 - RNA, 19 nt, Homo sapiens
uaugagaucugcaugaaau

SEQ ID NO: 1221245 - RNA, 19 nt, Homo sapiens
caagaucgaugagcuguau

SEQ ID NO: 1221246 - RNA, 19 nt, Homo sapiens
agacgaagaugaagacaau

SEQ ID NO: 1221247 - RNA, 19 nt, Homo sapiens
gcacaucccuugccaaaau

SEQ ID NO: 1221248 - RNA, 19 nt, Homo sapiens
gaauuucugucuauuaagg

SEQ ID NO: 1221249 - RNA, 19 nt, Homo sapiens
ugacuaccguggccaguuu

SEQ ID NO: 1221250 - RNA, 19 nt, Homo sapiens
ucacggaauuucugucuau

SEQ ID NO: 1221251 - RNA, 19 nt, Homo sapiens
gaggugacccgccuagaaa

SEQ ID NO: 1221252 - RNA, 19 nt, Homo sapiens
cauggucccugucaucuga

SEQ ID NO: 1221253 - RNA, 19 nt, Homo sapiens
ggaggugacccgccuagaa

SEQ ID NO: 1221254 - RNA, 19 nt, Homo sapiens
caccuagacucaguucaua

SEQ ID NO: 1221255 - RNA, 19 nt, Homo sapiens
gcucugggcccuuggauga

SEQ ID NO: 1221256 - RNA, 19 nt, Homo sapiens
caaugaagacgaagaugaa

SEQ ID NO: 1221257 - RNA, 19 nt, Homo sapiens
ccuaauggcugcccuggau

SEQ ID NO: 1221258 - RNA, 19 nt, Homo sapiens
cgucagcgcuggaaacuac

SEQ ID NO: 1221259 - RNA, 19 nt, Homo sapiens
gaagaugaagacaaugaug

SEQ ID NO: 1221260 - RNA, 19 nt, Homo sapiens
acuacaggcucuaccuaua

SEQ ID NO: 1221261 - RNA, 19 nt, Homo sapiens
ccagaucccucagagucua

SEQ ID NO: 1221262 - RNA, 19 nt, Homo sapiens
ggauaucaaugaccuuggu

SEQ ID NO: 1221263 - RNA, 19 nt, Homo sapiens
ccacagauuccuagcaaug

SEQ ID NO: 1221264 - RNA, 19 nt, Homo sapiens
uagaaagucugcucaugca

SEQ ID NO: 1221265 - RNA, 19 nt, Homo sapiens
aggaggagcuggagaaugg

SEQ ID NO: 1221266 - RNA, 19 nt, Homo sapiens
ggccagcacagcauucuaa

SEQ ID NO: 1221267 - RNA, 19 nt, Homo sapiens
ucaaugaagacgaagauga

SEQ ID NO: 1221268 - RNA, 19 nt, Homo sapiens
cagcacaucccuugccaaa

SEQ ID NO: 1221269 - RNA, 19 nt, Homo sapiens
ccacaagucccacccacaa

SEQ ID NO: 1221270 - RNA, 19 nt, Homo sapiens
gcacuggcagggaggguaa

SEQ ID NO: 1221271 - RNA, 19 nt, Homo sapiens
uggaccagcuggaggauga

SEQ ID NO: 1221272 - RNA, 19 nt, Homo sapiens
ugacugaggcugugugugu

SEQ ID NO: 1221273 - RNA, 19 nt, Homo sapiens
gaauugaggguaguggaaa

SEQ ID NO: 1221274 - RNA, 19 nt, Homo sapiens
ucaaugaccuugguaccau

SEQ ID NO: 1221275 - RNA, 19 nt, Homo sapiens
gcugaaggcccugagauug

SEQ ID NO: 1221276 - RNA, 19 nt, Homo sapiens
cauaaucucuacccuuacu

SEQ ID NO: 1221277 - RNA, 19 nt, Homo sapiens
gcugaaacugggcacauuu

SEQ ID NO: 1221278 - RNA, 19 nt, Homo sapiens
cagcaucacuguggaacau

SEQ ID NO: 1221279 - RNA, 19 nt, Homo sapiens
uggcugcccuggaugacua

SEQ ID NO: 1221280 - RNA, 19 nt, Homo sapiens
gcaggugugggacaguuaa

SEQ ID NO: 1221281 - RNA, 19 nt, Homo sapiens
cugccaaacugacacagaa

SEQ ID NO: 1221282 - RNA, 19 nt, Homo sapiens
gcucacagucuuccaguuc

SEQ ID NO: 1221283 - RNA, 19 nt, Homo sapiens
ggaccuagcccaccuacac

SEQ ID NO: 1221284 - RNA, 19 nt, Homo sapiens
ggauggugccuacaacaug

SEQ ID NO: 1221285 - RNA, 19 nt, Homo sapiens
acagauuccuagcaaugaa

SEQ ID NO: 1221286 - RNA, 19 nt, Homo sapiens
ggaaucugaacucggauga

SEQ ID NO: 1221287 - RNA, 19 nt, Homo sapiens
aacaaggccuccacaguca

SEQ ID NO: 1221288 - RNA, 19 nt, Homo sapiens
gcccucagcugcuucuucu

SEQ ID NO: 1221289 - RNA, 19 nt, Homo sapiens
ggcccuacccucaauauca

SEQ ID NO: 1221290 - RNA, 19 nt, Homo sapiens
cagcacagcauucuaaacu

SEQ ID NO: 1221291 - RNA, 19 nt, Homo sapiens
cgaguuucaucuccgaaug

SEQ ID NO: 1221292 - RNA, 19 nt, Homo sapiens
aaucugaacucggaugauc

SEQ ID NO: 1221293 - RNA, 19 nt, Homo sapiens
gagaucugcaugaaauaug

SEQ ID NO: 1221294 - RNA, 19 nt, Homo sapiens
gcccuacccucaauaucau

SEQ ID NO: 1221295 - RNA, 19 nt, Homo sapiens
aguaugagaucugcaugaa

SEQ ID NO: 1221296 - RNA, 19 nt, Homo sapiens
gcaagaucgaugagcugua

SEQ ID NO: 1221297 - RNA, 19 nt, Homo sapiens
ucucuacccuuacuacuac

SEQ ID NO: 1221298 - RNA, 19 nt, Homo sapiens
ccaagcgcuucuccaccua

SEQ ID NO: 1221299 - RNA, 19 nt, Homo sapiens
ccuagaaagucugcucaug

SEQ ID NO: 1221300 - RNA, 19 nt, Homo sapiens
ccacaagcccauaaucucu

SEQ ID NO: 1221301 - RNA, 19 nt, Homo sapiens
cagugaggcuaguguagau

SEQ ID NO: 1221302 - RNA, 19 nt, Homo sapiens
cagagagacucagcugcuu

SEQ ID NO: 1221303 - RNA, 19 nt, Homo sapiens
cuauuaaggugacagaacu

SEQ ID NO: 1221304 - RNA, 19 nt, Homo sapiens
ccagccacaucccuugguu

SEQ ID NO: 1221305 - RNA, 19 nt, Homo sapiens
gggacagucugcccaucga

SEQ ID NO: 1221306 - RNA, 19 nt, Homo sapiens
gcauugagccccuggugua

SEQ ID NO: 1221307 - RNA, 19 nt, Homo sapiens
cccaggaaguggugcaguu

SEQ ID NO: 1221308 - RNA, 19 nt, Homo sapiens
aauguaagcccuuccacuu

SEQ ID NO: 1221309 - RNA, 19 nt, Homo sapiens
aagcgcuucuccaccuaua

SEQ ID NO: 1221310 - RNA, 19 nt, Homo sapiens
gauaucaaugaccuuggua

SEQ ID NO: 1221311 - RNA, 19 nt, Homo sapiens
ggugugggacaguuaagaa

SEQ ID NO: 1221312 - RNA, 19 nt, Homo sapiens
cuacuggugcggaaucuga

SEQ ID NO: 1221313 - RNA, 19 nt, Homo sapiens
uguaagcccuuccacuucu

SEQ ID NO: 1221314 - RNA, 19 nt, Homo sapiens
gcucguccauggcaacaac

SEQ ID NO: 1221315 - RNA, 19 nt, Homo sapiens
gcuucagcuuccucaauga

SEQ ID NO: 1221316 - RNA, 19 nt, Homo sapiens
ccacuacaggcucuaccua

SEQ ID NO: 1221317 - RNA, 19 nt, Homo sapiens
cgaauugaggguaguggaa

SEQ ID NO: 1221318 - RNA, 19 nt, Homo sapiens
ccacaucagugaggcuagu

SEQ ID NO: 1221319 - RNA, 19 nt, Homo sapiens
aggcacagcugggcgaguu

SEQ ID NO: 1221320 - RNA, 19 nt, Homo sapiens
gguuguggcuguggauauc

SEQ ID NO: 1221321 - RNA, 19 nt, Homo sapiens
acagcauucuaaacuauuc

SEQ ID NO: 1221322 - RNA, 19 nt, Homo sapiens
ggaggcaguaugcgaguuc

SEQ ID NO: 1221323 - RNA, 19 nt, Homo sapiens
gcacaccuagacucaguuc

SEQ ID NO: 1221324 - RNA, 19 nt, Homo sapiens
ccacaaaaccaguauguca

SEQ ID NO: 1221325 - RNA, 19 nt, Homo sapiens
cuacaggcucuaccuauag

SEQ ID NO: 1221326 - RNA, 19 nt, Homo sapiens
caucagugaggcuagugua

SEQ ID NO: 1221327 - RNA, 19 nt, Homo sapiens
ccacaucccuugguuuugu

SEQ ID NO: 1221328 - RNA, 19 nt, Homo sapiens
gucagugccugcagucaag

SEQ ID NO: 1221329 - RNA, 19 nt, Homo sapiens
ggaccagugcacagagaga

SEQ ID NO: 1221330 - RNA, 19 nt, Homo sapiens
guguguaggcgaucaguau

SEQ ID NO: 1221331 - RNA, 19 nt, Homo sapiens
acaagucccacccauccua

SEQ ID NO: 1221332 - RNA, 19 nt, Homo sapiens
ccacucauacuuccacaag

SEQ ID NO: 1221333 - RNA, 19 nt, Homo sapiens
cacaagcccauaaucucua

SEQ ID NO: 1221334 - RNA, 19 nt, Homo sapiens
guaugagaucugcaugaaa

SEQ ID NO: 1221335 - RNA, 19 nt, Homo sapiens
cuacagcaguguggagaag

SEQ ID NO: 1221336 - RNA, 19 nt, Homo sapiens
gaugaagacaaugauguuc

SEQ ID NO: 1221337 - RNA, 19 nt, Homo sapiens
ccucagagucuacgguuca

SEQ ID NO: 1221338 - RNA, 19 nt, Homo sapiens
gaaggaaguuuguuaacau

SEQ ID NO: 1221339 - RNA, 19 nt, Homo sapiens
gcacguuguuggugucaua

SEQ ID NO: 1221340 - RNA, 19 nt, Homo sapiens
ggaaggaaguuuguuaaca

SEQ ID NO: 1221341 - RNA, 19 nt, Homo sapiens
cuacaugcauugaaagaaa

SEQ ID NO: 1221342 - RNA, 19 nt, Homo sapiens
gcaguauauuggcaugaua

SEQ ID NO: 1221343 - RNA, 19 nt, Homo sapiens
gcaucuccauuuacuauga

SEQ ID NO: 1221344 - RNA, 19 nt, Homo sapiens
gucauuugaucuucacuua

SEQ ID NO: 1221345 - RNA, 19 nt, Homo sapiens
gccaguguauuccagguua

SEQ ID NO: 1221346 - RNA, 19 nt, Homo sapiens
gacaaagaguucagcauca

SEQ ID NO: 1221347 - RNA, 19 nt, Homo sapiens
ggaagaacuuguggccaaa

SEQ ID NO: 1221348 - RNA, 19 nt, Homo sapiens
ggaguucacacaaggagua

SEQ ID NO: 1221349 - RNA, 19 nt, Homo sapiens
aaaggaaggaaguuuguua

SEQ ID NO: 1221350 - RNA, 19 nt, Homo sapiens
ggugcuacaugcauugaaa

SEQ ID NO: 1221351 - RNA, 19 nt, Homo sapiens
gagaaaggaaggaaguuug

SEQ ID NO: 1221352 - RNA, 19 nt, Homo sapiens
gggccuauuucgacaaaga

SEQ ID NO: 1221353 - RNA, 19 nt, Homo sapiens
gcuggccgcucguuugcua

SEQ ID NO: 1221354 - RNA, 19 nt, Homo sapiens
gaaacacgagcgacagaga

SEQ ID NO: 1221355 - RNA, 19 nt, Homo sapiens
guguaaauuugaucuguug

SEQ ID NO: 1221356 - RNA, 19 nt, Homo sapiens
ccacuuugcucuccagucu

SEQ ID NO: 1221357 - RNA, 19 nt, Homo sapiens
uggguuaggacucgaauua

SEQ ID NO: 1221358 - RNA, 19 nt, Homo sapiens
aauuugaucuguuggaaga

SEQ ID NO: 1221359 - RNA, 19 nt, Homo sapiens
gguuaggacucgaauuaag

SEQ ID NO: 1221360 - RNA, 19 nt, Homo sapiens
gcagcaacagguccacuuu

SEQ ID NO: 1221361 - RNA, 19 nt, Homo sapiens
gaaaggucuucggaacuuc

SEQ ID NO: 1221362 - RNA, 19 nt, Homo sapiens
cuuauggacuuuagcaguu

SEQ ID NO: 1221363 - RNA, 19 nt, Homo sapiens
ccgcagccuucgcuucuuu

SEQ ID NO: 1221364 - RNA, 19 nt, Homo sapiens
aaaaucagcuuauggacuu

SEQ ID NO: 1221365 - RNA, 19 nt, Homo sapiens
gaaaggaaggaaguuuguu

SEQ ID NO: 1221366 - RNA, 19 nt, Homo sapiens
aaaaugcccuugcugcuaa

SEQ ID NO: 1221367 - RNA, 19 nt, Homo sapiens
uguggaaacuaaacaacuu

SEQ ID NO: 1221368 - RNA, 19 nt, Homo sapiens
gaauguggaaacuaaacaa

SEQ ID NO: 1221369 - RNA, 19 nt, Homo sapiens
aagaggagccaguguauuc

SEQ ID NO: 1221370 - RNA, 19 nt, Homo sapiens
uuacuucacuaccugacaa

SEQ ID NO: 1221371 - RNA, 19 nt, Homo sapiens
ggccacacuuugcuacuuc

SEQ ID NO: 1221372 - RNA, 19 nt, Homo sapiens
aagccugacuggaccauug

SEQ ID NO: 1221373 - RNA, 19 nt, Homo sapiens
ggaaucagaauguggaaac

SEQ ID NO: 1221374 - RNA, 19 nt, Homo sapiens
aucagaauguggaaacuaa

SEQ ID NO: 1221375 - RNA, 19 nt, Homo sapiens
ccaguguauuccagguuaa

SEQ ID NO: 1221376 - RNA, 19 nt, Homo sapiens
gaugagaaaggaaggaagu

SEQ ID NO: 1221377 - RNA, 19 nt, Homo sapiens
ugcccuugcugcuaacaua

SEQ ID NO: 1221378 - RNA, 19 nt, Homo sapiens
ugagaaaggaaggaaguuu

SEQ ID NO: 1221379 - RNA, 19 nt, Homo sapiens
auauuggcaugauacagua

SEQ ID NO: 1221380 - RNA, 19 nt, Homo sapiens
aaacaacuucuuagugcaa

SEQ ID NO: 1221381 - RNA, 19 nt, Homo sapiens
aagaggugcuacaugcauu

SEQ ID NO: 1221382 - RNA, 19 nt, Homo sapiens
uauccaaguugcugucaca

SEQ ID NO: 1221383 - RNA, 19 nt, Homo sapiens
cagagggaguucacacaag

SEQ ID NO: 1221384 - RNA, 19 nt, Homo sapiens
gaaagaaaagguuacuuca

SEQ ID NO: 1221385 - RNA, 19 nt, Homo sapiens
ggaaguuuguuaacauccu

SEQ ID NO: 1221386 - RNA, 19 nt, Homo sapiens
gcuaacauagaugaaauug

SEQ ID NO: 1221387 - RNA, 19 nt, Homo sapiens
cugcuaacauagaugaaau

SEQ ID NO: 1221388 - RNA, 19 nt, Homo sapiens
aaacacgagcgacagagaa

SEQ ID NO: 1221389 - RNA, 19 nt, Homo sapiens
uuacuaugaugagaaagga

SEQ ID NO: 1221390 - RNA, 19 nt, Homo sapiens
guaaauuugaucuguugga

SEQ ID NO: 1221391 - RNA, 19 nt, Homo sapiens
uauauuggcaugauacagu

SEQ ID NO: 1221392 - RNA, 19 nt, Homo sapiens
cgacuuccuuuccauacag

SEQ ID NO: 1221393 - RNA, 19 nt, Homo sapiens
ggaaacuaaacaacuucuu

SEQ ID NO: 1221394 - RNA, 19 nt, Homo sapiens
gaaucagaauguggaaacu

SEQ ID NO: 1221395 - RNA, 19 nt, Homo sapiens
aaggaaggaaguuuguuaa

SEQ ID NO: 1221396 - RNA, 19 nt, Homo sapiens
caguguaaauuugaucugu

SEQ ID NO: 1221397 - RNA, 19 nt, Homo sapiens
aagaacuuguggccaaaga

SEQ ID NO: 1221398 - RNA, 19 nt, Homo sapiens
cuucggaacuucggcucua

SEQ ID NO: 1221399 - RNA, 19 nt, Homo sapiens
ugucacaguguaaauuuga

SEQ ID NO: 1221400 - RNA, 19 nt, Homo sapiens
ccaccgacuuccuuuccau

SEQ ID NO: 1221401 - RNA, 19 nt, Homo sapiens
gcugcuaacauagaugaaa

SEQ ID NO: 1221402 - RNA, 19 nt, Homo sapiens
ggguuaggacucgaauuaa

SEQ ID NO: 1221403 - RNA, 19 nt, Homo sapiens
cguuguuggugucauauuc

SEQ ID NO: 1221404 - RNA, 19 nt, Homo sapiens
uaagaggagccaguguauu

SEQ ID NO: 1221405 - RNA, 19 nt, Homo sapiens
uuaagaggagccaguguau

SEQ ID NO: 1221406 - RNA, 19 nt, Homo sapiens
uuuaagaggagccagugua

SEQ ID NO: 1221407 - RNA, 19 nt, Homo sapiens
aaggaaguuuguuaacauc

SEQ ID NO: 1221408 - RNA, 19 nt, Homo sapiens
agaaaggaaggaaguuugu

SEQ ID NO: 1221409 - RNA, 19 nt, Homo sapiens
gaccauugcacggauugaa

SEQ ID NO: 1221410 - RNA, 19 nt, Homo sapiens
ucagagggaguucacacaa

SEQ ID NO: 1221411 - RNA, 19 nt, Homo sapiens
caucuccauuuacuaugau

SEQ ID NO: 1221412 - RNA, 19 nt, Homo sapiens
gaguucagcaucacagagu

SEQ ID NO: 1221413 - RNA, 19 nt, Homo sapiens
gaugaucguccugggauuc

SEQ ID NO: 1221414 - RNA, 19 nt, Homo sapiens
cagcaacagguccacuuug

SEQ ID NO: 1221415 - RNA, 19 nt, Homo sapiens
aggcaucuccauuuacuau

SEQ ID NO: 1221416 - RNA, 19 nt, Homo sapiens
agaaaagguuacuucacua

SEQ ID NO: 1221417 - RNA, 19 nt, Homo sapiens
cuugggagcggcguuauuu

SEQ ID NO: 1221418 - RNA, 19 nt, Homo sapiens
gcauugaaagaaaagguua

SEQ ID NO: 1221419 - RNA, 19 nt, Homo sapiens
ucuaaccagugccaacauc

SEQ ID NO: 1221420 - RNA, 19 nt, Homo sapiens
gcuacaugcauugaaagaa

SEQ ID NO: 1221421 - RNA, 19 nt, Homo sapiens
caaagaggugcuacaugca

SEQ ID NO: 1221422 - RNA, 19 nt, Homo sapiens
uugcucauguauccaaguu

SEQ ID NO: 1221423 - RNA, 19 nt, Homo sapiens
gcggcguuauuuccacgaa

SEQ ID NO: 1221424 - RNA, 19 nt, Homo sapiens
guucacacaaggaguaaag

SEQ ID NO: 1221425 - RNA, 19 nt, Homo sapiens
uagugcaagcuaugaguuu

SEQ ID NO: 1221426 - RNA, 19 nt, Homo sapiens
cggccacacuuugcuacuu

SEQ ID NO: 1221427 - RNA, 19 nt, Homo sapiens
ccauuuacuaugaugagaa

SEQ ID NO: 1221428 - RNA, 19 nt, Homo sapiens
gccaaagaggugcuacaug

SEQ ID NO: 1221429 - RNA, 19 nt, Homo sapiens
accagaggcugcagcaaca

SEQ ID NO: 1221430 - RNA, 19 nt, Homo sapiens
caaagaguucagcaucaca

SEQ ID NO: 1221431 - RNA, 19 nt, Homo sapiens
ggucauuugaucuucacuu

SEQ ID NO: 1221432 - RNA, 19 nt, Homo sapiens
uuauggacuuuagcaguug

SEQ ID NO: 1221433 - RNA, 19 nt, Homo sapiens
aaucagaauguggaaacua

SEQ ID NO: 1221434 - RNA, 19 nt, Homo sapiens
aagaaaagguuacuucacu

SEQ ID NO: 1221435 - RNA, 19 nt, Homo sapiens
ggaaagcuacugugaacua

SEQ ID NO: 1221436 - RNA, 19 nt, Homo sapiens
ccacuacccuccaaucuau

SEQ ID NO: 1221437 - RNA, 19 nt, Homo sapiens
gagcuagacugggauuaaa

SEQ ID NO: 1221438 - RNA, 19 nt, Homo sapiens
gaucaggucucagcauuuc

SEQ ID NO: 1221439 - RNA, 19 nt, Homo sapiens
ggacagcuuugacuucauc

SEQ ID NO: 1221440 - RNA, 19 nt, Homo sapiens
ccagaagccuccucuaaca

SEQ ID NO: 1221441 - RNA, 19 nt, Homo sapiens
ccagagaugugauuugcuu

SEQ ID NO: 1221442 - RNA, 19 nt, Homo sapiens
gaggacagcuuugacuuca

SEQ ID NO: 1221443 - RNA, 19 nt, Homo sapiens
uuacagaucaccagcauuu

SEQ ID NO: 1221444 - RNA, 19 nt, Homo sapiens
gccaaugccucucuuaaag

SEQ ID NO: 1221445 - RNA, 19 nt, Homo sapiens
gcaggcggguugauuaaag

SEQ ID NO: 1221446 - RNA, 19 nt, Homo sapiens
gaaagcuacugugaacuag

SEQ ID NO: 1221447 - RNA, 19 nt, Homo sapiens
ggaaugcauuuaucaucug

SEQ ID NO: 1221448 - RNA, 19 nt, Homo sapiens
ggacuuggacuuggauuug

SEQ ID NO: 1221449 - RNA, 19 nt, Homo sapiens
cagaagacgucgcauuuac

SEQ ID NO: 1221450 - RNA, 19 nt, Homo sapiens
gcauggcccuggguuagaa

SEQ ID NO: 1221451 - RNA, 19 nt, Homo sapiens
ggacuuggacuuggacuug

SEQ ID NO: 1221452 - RNA, 19 nt, Homo sapiens
ggccagaagccuccucuaa

SEQ ID NO: 1221453 - RNA, 19 nt, Homo sapiens
gaaggcuugugguuucaga

SEQ ID NO: 1221454 - RNA, 19 nt, Homo sapiens
ccagaagacgucgcauuua

SEQ ID NO: 1221455 - RNA, 19 nt, Homo sapiens
gauuaaagaugguguuuuc

SEQ ID NO: 1221456 - RNA, 19 nt, Homo sapiens
guagaggugagaacacuuu

SEQ ID NO: 1221457 - RNA, 19 nt, Homo sapiens
ggacguggacuuggacuug

SEQ ID NO: 1221458 - RNA, 19 nt, Homo sapiens
ggacuuggacguggacuug

SEQ ID NO: 1221459 - RNA, 19 nt, Homo sapiens
gaagugggccuugaacaca

SEQ ID NO: 1221460 - RNA, 19 nt, Homo sapiens
gaggcugguucuacuguau

SEQ ID NO: 1221461 - RNA, 19 nt, Homo sapiens
cuuagcaaauggacucuuu

SEQ ID NO: 1221462 - RNA, 19 nt, Homo sapiens
ggaggaggaggacagcuuu

SEQ ID NO: 1221463 - RNA, 19 nt, Homo sapiens
ggaccaccaugucaucucu

SEQ ID NO: 1221464 - RNA, 19 nt, Homo sapiens
gcaaauggacucuuuuaga

SEQ ID NO: 1221465 - RNA, 19 nt, Homo sapiens
guaauuaaucccuuagcaa

SEQ ID NO: 1221466 - RNA, 19 nt, Homo sapiens
ggaccgggacuucaucaug

SEQ ID NO: 1221467 - RNA, 19 nt, Homo sapiens
cccauucguucucuuauug

SEQ ID NO: 1221468 - RNA, 19 nt, Homo sapiens
gaaaggagggcaggagaca

SEQ ID NO: 1221469 - RNA, 19 nt, Homo sapiens
caaugccucucuuaaagca

SEQ ID NO: 1221470 - RNA, 19 nt, Homo sapiens
aaacugaugcccagagaug

SEQ ID NO: 1221471 - RNA, 19 nt, Homo sapiens
gcaaguagaggugagaaca

SEQ ID NO: 1221472 - RNA, 19 nt, Homo sapiens
cccagugucugcucucuga

SEQ ID NO: 1221473 - RNA, 19 nt, Homo sapiens
ggaggacagcuuugacuuc

SEQ ID NO: 1221474 - RNA, 19 nt, Homo sapiens
caucaugaccuucaacaca

SEQ ID NO: 1221475 - RNA, 19 nt, Homo sapiens
uaucaucugcuucuacuug

SEQ ID NO: 1221476 - RNA, 19 nt, Homo sapiens
ccaccucccuccacagaca

SEQ ID NO: 1221477 - RNA, 19 nt, Homo sapiens
ccauccaccucaccaguug

SEQ ID NO: 1221478 - RNA, 19 nt, Homo sapiens
gacuuggacuuggauuuga

SEQ ID NO: 1221479 - RNA, 19 nt, Homo sapiens
cccgguaccucauccugua

SEQ ID NO: 1221480 - RNA, 19 nt, Homo sapiens
gcaccucaaguaauuaauc

SEQ ID NO: 1221481 - RNA, 19 nt, Homo sapiens
cccagaagacgucgcauuu

SEQ ID NO: 1221482 - RNA, 19 nt, Homo sapiens
ggaucaggucucagcauuu

SEQ ID NO: 1221483 - RNA, 19 nt, Homo sapiens
agacuccaguguuuacaga

SEQ ID NO: 1221484 - RNA, 19 nt, Homo sapiens
gcucuggguuggcuggaau

SEQ ID NO: 1221485 - RNA, 19 nt, Homo sapiens
aagcuacugugaacuagga

SEQ ID NO: 1221486 - RNA, 19 nt, Homo sapiens
uggaaugcauuuaucaucu

SEQ ID NO: 1221487 - RNA, 19 nt, Homo sapiens
gcccagagaugugauuugc

SEQ ID NO: 1221488 - RNA, 19 nt, Homo sapiens
uuccgcaccucaaguaauu

SEQ ID NO: 1221489 - RNA, 19 nt, Homo sapiens
gaagacgucgcauuuacag

SEQ ID NO: 1221490 - RNA, 19 nt, Homo sapiens
caggcggguugauuaaaga

SEQ ID NO: 1221491 - RNA, 19 nt, Homo sapiens
gcauuuacaaccaauccaa

SEQ ID NO: 1221492 - RNA, 19 nt, Homo sapiens
caggagacauggaggaacu

SEQ ID NO: 1221493 - RNA, 19 nt, Homo sapiens
aggaucaggucucagcauu

SEQ ID NO: 1221494 - RNA, 19 nt, Homo sapiens
agacuucucauuuaacuca

SEQ ID NO: 1221495 - RNA, 19 nt, Homo sapiens
caaauggacucuuuuagac

SEQ ID NO: 1221496 - RNA, 19 nt, Homo sapiens
auuaaucccuuagcaaaug

SEQ ID NO: 1221497 - RNA, 19 nt, Homo sapiens
gcacaucauggcagucauc

SEQ ID NO: 1221498 - RNA, 19 nt, Homo sapiens
gugcaggcggguugauuaa

SEQ ID NO: 1221499 - RNA, 19 nt, Homo sapiens
ccaauccaauggccagaag

SEQ ID NO: 1221500 - RNA, 19 nt, Homo sapiens
gcccagacuccaguguuua

SEQ ID NO: 1221501 - RNA, 19 nt, Homo sapiens
uuggaaggcuugugguuuc

SEQ ID NO: 1221502 - RNA, 19 nt, Homo sapiens
caauauacccauucguucu

SEQ ID NO: 1221503 - RNA, 19 nt, Homo sapiens
ugagcuagacugggauuaa

SEQ ID NO: 1221504 - RNA, 19 nt, Homo sapiens
gcauuuaucaucugcuucu

SEQ ID NO: 1221505 - RNA, 19 nt, Homo sapiens
caccagcauuuacaaccaa

SEQ ID NO: 1221506 - RNA, 19 nt, Homo sapiens
ugcccagacuccaguguuu

SEQ ID NO: 1221507 - RNA, 19 nt, Homo sapiens
ugaggcugguucuacugua

SEQ ID NO: 1221508 - RNA, 19 nt, Homo sapiens
caguguacuuucugcaguu

SEQ ID NO: 1221509 - RNA, 19 nt, Homo sapiens
gcuaagcuacugcccuuca

SEQ ID NO: 1221510 - RNA, 19 nt, Homo sapiens
ggucucagcauuucaucug

SEQ ID NO: 1221511 - RNA, 19 nt, Homo sapiens
ggaggaccaccaugucauc

SEQ ID NO: 1221512 - RNA, 19 nt, Homo sapiens
ggaagugggccuugaacac

SEQ ID NO: 1221513 - RNA, 19 nt, Homo sapiens
gguuuccgcaccucaagua

SEQ ID NO: 1221514 - RNA, 19 nt, Homo sapiens
uaucauucccuacucucua

SEQ ID NO: 1221515 - RNA, 19 nt, Homo sapiens
gaggcauggcccuggguua

SEQ ID NO: 1221516 - RNA, 19 nt, Homo sapiens
gagaugugauuugcuugag

SEQ ID NO: 1221517 - RNA, 19 nt, Homo sapiens
ccugguggauggagaaugg

SEQ ID NO: 1221518 - RNA, 19 nt, Homo sapiens
ucuaaucgcagguccauca

SEQ ID NO: 1221519 - RNA, 19 nt, Homo sapiens
ugaacuaggagcaggauuc

SEQ ID NO: 1221520 - RNA, 19 nt, Homo sapiens
ggaccagguucucuuuuca

SEQ ID NO: 1221521 - RNA, 19 nt, Homo sapiens
uguagccacuggugcuuug

SEQ ID NO: 1221522 - RNA, 19 nt, Homo sapiens
uaaagcaauauacccauuc

SEQ ID NO: 1221523 - RNA, 19 nt, Homo sapiens
caccaccacuugccaaugc

SEQ ID NO: 1221524 - RNA, 19 nt, Homo sapiens
ucaauucccugagcuagac

SEQ ID NO: 1221525 - RNA, 19 nt, Homo sapiens
gccaaaauauccugagcaa

SEQ ID NO: 1221526 - RNA, 19 nt, Homo sapiens
caacuuccugcacaucaug

SEQ ID NO: 1221527 - RNA, 19 nt, Homo sapiens
gcuuugacuccuacggaua

SEQ ID NO: 1221528 - RNA, 19 nt, Homo sapiens
ugugcaggcggguugauua

SEQ ID NO: 1221529 - RNA, 19 nt, Homo sapiens
ucaccagcauuuacaacca

SEQ ID NO: 1221530 - RNA, 19 nt, Homo sapiens
guuuacagaucaccagcau

SEQ ID NO: 1221531 - RNA, 19 nt, Homo sapiens
guuggaaggcuugugguuu

SEQ ID NO: 1221532 - RNA, 19 nt, Homo sapiens
ugccaaugccucucuuaaa

SEQ ID NO: 1221533 - RNA, 19 nt, Homo sapiens
caaagcccuugcccucucu

SEQ ID NO: 1221534 - RNA, 19 nt, Homo sapiens
ccaacuuccugcacaucau

SEQ ID NO: 1221535 - RNA, 19 nt, Homo sapiens
ggaauuagcucagagauug

SEQ ID NO: 1221536 - RNA, 19 nt, Homo sapiens
caacuacuguuacugguua

SEQ ID NO: 1221537 - RNA, 19 nt, Homo sapiens
gcacaaagcuaggaguaaa

SEQ ID NO: 1221538 - RNA, 19 nt, Homo sapiens
gcaaauagcagaaaccaaa

SEQ ID NO: 1221539 - RNA, 19 nt, Homo sapiens
ggacuaauauguaucuuuc

SEQ ID NO: 1221540 - RNA, 19 nt, Homo sapiens
ugaaacagcugaaggaaga

SEQ ID NO: 1221541 - RNA, 19 nt, Homo sapiens
gccacuaacuggacuaaua

SEQ ID NO: 1221542 - RNA, 19 nt, Homo sapiens
caacgacuuugcuaucuuu

SEQ ID NO: 1221543 - RNA, 19 nt, Homo sapiens
ggacccagcugacacauca

SEQ ID NO: 1221544 - RNA, 19 nt, Homo sapiens
ucaauguccugaaagauaa

SEQ ID NO: 1221545 - RNA, 19 nt, Homo sapiens
ggacuuggagcuuagguua

SEQ ID NO: 1221546 - RNA, 19 nt, Homo sapiens
gcuaaggaauagugaguuu

SEQ ID NO: 1221547 - RNA, 19 nt, Homo sapiens
gagcuuagguuagaagaga

SEQ ID NO: 1221548 - RNA, 19 nt, Homo sapiens
ggaaggaacugggaagcuu

SEQ ID NO: 1221549 - RNA, 19 nt, Homo sapiens
gcaaucacaccgcuuauga

SEQ ID NO: 1221550 - RNA, 19 nt, Homo sapiens
caaagggaguucaguuaau

SEQ ID NO: 1221551 - RNA, 19 nt, Homo sapiens
cauggaggcuucuuacuug

SEQ ID NO: 1221552 - RNA, 19 nt, Homo sapiens
uaaugcugcuuuauccuua

SEQ ID NO: 1221553 - RNA, 19 nt, Homo sapiens
agacuuaaauggaacagaa

SEQ ID NO: 1221554 - RNA, 19 nt, Homo sapiens
gaaggaacugggaagcuua

SEQ ID NO: 1221555 - RNA, 19 nt, Homo sapiens
gcaggcagcuuuaguuagg

SEQ ID NO: 1221556 - RNA, 19 nt, Homo sapiens
gaaggcuacugcacucuau

SEQ ID NO: 1221557 - RNA, 19 nt, Homo sapiens
ggaugucaauguccugaaa

SEQ ID NO: 1221558 - RNA, 19 nt, Homo sapiens
auaaaguccuagcuucuua

SEQ ID NO: 1221559 - RNA, 19 nt, Homo sapiens
gcacaaaaccuagcuauuu

SEQ ID NO: 1221560 - RNA, 19 nt, Homo sapiens
gagaguggcguuagcagua

SEQ ID NO: 1221561 - RNA, 19 nt, Homo sapiens
gaccaggaaguuugaaaua

SEQ ID NO: 1221562 - RNA, 19 nt, Homo sapiens
gauuugaacugcagaccaa

SEQ ID NO: 1221563 - RNA, 19 nt, Homo sapiens
gaaagggaccaggaaguuu

SEQ ID NO: 1221564 - RNA, 19 nt, Homo sapiens
ccaaugagcccacuuucuu

SEQ ID NO: 1221565 - RNA, 19 nt, Homo sapiens
uugcagagcugaaggagaa

SEQ ID NO: 1221566 - RNA, 19 nt, Homo sapiens
agacucaguuggcuacuuu

SEQ ID NO: 1221567 - RNA, 19 nt, Homo sapiens
ggccugagauugugaguca

SEQ ID NO: 1221568 - RNA, 19 nt, Homo sapiens
ggaaagggaccaggaaguu

SEQ ID NO: 1221569 - RNA, 19 nt, Homo sapiens
aggaagaguuugagaggua

SEQ ID NO: 1221570 - RNA, 19 nt, Homo sapiens
ccaaagggaguucaguuaa

SEQ ID NO: 1221571 - RNA, 19 nt, Homo sapiens
gaaggagaaagaggcauua

SEQ ID NO: 1221572 - RNA, 19 nt, Homo sapiens
gggaugaccuaugcaauca

SEQ ID NO: 1221573 - RNA, 19 nt, Homo sapiens
gucaauguccugaaagaua

SEQ ID NO: 1221574 - RNA, 19 nt, Homo sapiens
gaacagauggaaggauuug

SEQ ID NO: 1221575 - RNA, 19 nt, Homo sapiens
aaaccugagugacuugaaa

SEQ ID NO: 1221576 - RNA, 19 nt, Homo sapiens
uuagggauuuccaaaguaa

SEQ ID NO: 1221577 - RNA, 19 nt, Homo sapiens
gaaauagugacauaucauc

SEQ ID NO: 1221578 - RNA, 19 nt, Homo sapiens
ccaggaaguuugaaauagu

SEQ ID NO: 1221579 - RNA, 19 nt, Homo sapiens
ucacagccauacugacuau

SEQ ID NO: 1221580 - RNA, 19 nt, Homo sapiens
gcaaggagguggagaucac

SEQ ID NO: 1221581 - RNA, 19 nt, Homo sapiens
gaacaagacacuggcucua

SEQ ID NO: 1221582 - RNA, 19 nt, Homo sapiens
ggagaaagaggcauuagag

SEQ ID NO: 1221583 - RNA, 19 nt, Homo sapiens
gauuaauccugcucuuuua

SEQ ID NO: 1221584 - RNA, 19 nt, Homo sapiens
gaaacaggacuuagaggau

SEQ ID NO: 1221585 - RNA, 19 nt, Homo sapiens
gcauggaggcuucuuacuu

SEQ ID NO: 1221586 - RNA, 19 nt, Homo sapiens
ggagaaacaagugauaaug

SEQ ID NO: 1221587 - RNA, 19 nt, Homo sapiens
gaucaacuccgucagcaau

SEQ ID NO: 1221588 - RNA, 19 nt, Homo sapiens
gaucuuagggauuuccaaa

SEQ ID NO: 1221589 - RNA, 19 nt, Homo sapiens
gagcaccagcuugaucuua

SEQ ID NO: 1221590 - RNA, 19 nt, Homo sapiens
ucacaccgcuuaugaccau

SEQ ID NO: 1221591 - RNA, 19 nt, Homo sapiens
ugagcagacuuaaauggaa

SEQ ID NO: 1221592 - RNA, 19 nt, Homo sapiens
aguccuagcuucuuacaga

SEQ ID NO: 1221593 - RNA, 19 nt, Homo sapiens
gaaguuggaacagugguaa

SEQ ID NO: 1221594 - RNA, 19 nt, Homo sapiens
aagaugagguuaggacuga

SEQ ID NO: 1221595 - RNA, 19 nt, Homo sapiens
ugaaagauaagauggagaa

SEQ ID NO: 1221596 - RNA, 19 nt, Homo sapiens
uggcagcccuggagaauca

SEQ ID NO: 1221597 - RNA, 19 nt, Homo sapiens
gaacugggaagcuuagucu

SEQ ID NO: 1221598 - RNA, 19 nt, Homo sapiens
ucugcugccucuucucuua

SEQ ID NO: 1221599 - RNA, 19 nt, Homo sapiens
gaggagaaacaagugauaa

SEQ ID NO: 1221600 - RNA, 19 nt, Homo sapiens
ugaaggagaaguauauuuc

SEQ ID NO: 1221601 - RNA, 19 nt, Homo sapiens
ucagcaaucucagguagaa

SEQ ID NO: 1221602 - RNA, 19 nt, Homo sapiens
uggcauaaguagauuaauc

SEQ ID NO: 1221603 - RNA, 19 nt, Homo sapiens
gcagaaaauuccaaaagau

SEQ ID NO: 1221604 - RNA, 19 nt, Homo sapiens
gagguuggccugagauugu

SEQ ID NO: 1221605 - RNA, 19 nt, Homo sapiens
ggcaguaucuucugauggu

SEQ ID NO: 1221606 - RNA, 19 nt, Homo sapiens
ggagaaguuugggaugaau

SEQ ID NO: 1221607 - RNA, 19 nt, Homo sapiens
gagcugaaggagaaguaua

SEQ ID NO: 1221608 - RNA, 19 nt, Homo sapiens
cugaacagauggaaggauu

SEQ ID NO: 1221609 - RNA, 19 nt, Homo sapiens
gaugaccuaugcaaucaca

SEQ ID NO: 1221610 - RNA, 19 nt, Homo sapiens
gaagggauuuucugccaaa

SEQ ID NO: 1221611 - RNA, 19 nt, Homo sapiens
gaaagggcaggcucugguu

SEQ ID NO: 1221612 - RNA, 19 nt, Homo sapiens
ucacaucacugaggaagca

SEQ ID NO: 1221613 - RNA, 19 nt, Homo sapiens
acagugagcagacuuaaau

SEQ ID NO: 1221614 - RNA, 19 nt, Homo sapiens
ccacuaacuggacuaauau

SEQ ID NO: 1221615 - RNA, 19 nt, Homo sapiens
cuauagagacccagaagaa

SEQ ID NO: 1221616 - RNA, 19 nt, Homo sapiens
gacccaagcauuacaacuu

SEQ ID NO: 1221617 - RNA, 19 nt, Homo sapiens
uagccugacccaagcauua

SEQ ID NO: 1221618 - RNA, 19 nt, Homo sapiens
uagcugugcucaccgagaa

SEQ ID NO: 1221619 - RNA, 19 nt, Homo sapiens
cgccaggacuuggagcuua

SEQ ID NO: 1221620 - RNA, 19 nt, Homo sapiens
cuaacuggacuaauaugua

SEQ ID NO: 1221621 - RNA, 19 nt, Homo sapiens
ggucuuggcauaaguagau

SEQ ID NO: 1221622 - RNA, 19 nt, Homo sapiens
acagggaagugguaaagau

SEQ ID NO: 1221623 - RNA, 19 nt, Homo sapiens
cccgcucgcuguuucuuua

SEQ ID NO: 1221624 - RNA, 19 nt, Homo sapiens
aaagggaguucaguuaauc

SEQ ID NO: 1221625 - RNA, 19 nt, Homo sapiens
acugagaagugcagaaguu

SEQ ID NO: 1221626 - RNA, 19 nt, Homo sapiens
caaugagcccacuuucuuu

SEQ ID NO: 1221627 - RNA, 19 nt, Homo sapiens
cuacugcacucuauuacca

SEQ ID NO: 1221628 - RNA, 19 nt, Homo sapiens
cgcauuagguccgggauaa

SEQ ID NO: 1221629 - RNA, 19 nt, Homo sapiens
ggaccgagcucagcguaac

SEQ ID NO: 1221630 - RNA, 19 nt, Homo sapiens
caggaaguuugaaauagug

SEQ ID NO: 1221631 - RNA, 19 nt, Homo sapiens
gagaagugcagaaguugga

SEQ ID NO: 1221632 - RNA, 19 nt, Homo sapiens
gaauuucugugccucuuuu

SEQ ID NO: 1221633 - RNA, 19 nt, Homo sapiens
gagccaaucuggaguaccu

SEQ ID NO: 1221634 - RNA, 19 nt, Homo sapiens
guggagaucacaucacuga

SEQ ID NO: 1221635 - RNA, 19 nt, Homo sapiens
gcaaugagauguugguaaa

SEQ ID NO: 1221636 - RNA, 19 nt, Homo sapiens
gaaaugauacugcaucuuu

SEQ ID NO: 1221637 - RNA, 19 nt, Homo sapiens
gaacaggauuugacucauu

SEQ ID NO: 1221638 - RNA, 19 nt, Homo sapiens
ucaaaggcaugguaaauaa

SEQ ID NO: 1221639 - RNA, 19 nt, Homo sapiens
gaaaguaauugcuaaguag

SEQ ID NO: 1221640 - RNA, 19 nt, Homo sapiens
ggguuuaucuacacuauua

SEQ ID NO: 1221641 - RNA, 19 nt, Homo sapiens
gcacuugcaucuaaacaaa

SEQ ID NO: 1221642 - RNA, 19 nt, Homo sapiens
aaacagggcuuccguguga

SEQ ID NO: 1221643 - RNA, 19 nt, Homo sapiens
ggaaggccgugcugcuuua

SEQ ID NO: 1221644 - RNA, 19 nt, Homo sapiens
caaugagacuugaagguua

SEQ ID NO: 1221645 - RNA, 19 nt, Homo sapiens
ggauuugacucauuggaua

SEQ ID NO: 1221646 - RNA, 19 nt, Homo sapiens
cuacagagaugccuacuug

SEQ ID NO: 1221647 - RNA, 19 nt, Homo sapiens
gagaauaccuacauauaag

SEQ ID NO: 1221648 - RNA, 19 nt, Homo sapiens
gagagaauaccuacauaua

SEQ ID NO: 1221649 - RNA, 19 nt, Homo sapiens
guuguucccucauaauuua

SEQ ID NO: 1221650 - RNA, 19 nt, Homo sapiens
caaguaugcucguguuauu

SEQ ID NO: 1221651 - RNA, 19 nt, Homo sapiens
gagagagaauaccuacaua

SEQ ID NO: 1221652 - RNA, 19 nt, Homo sapiens
ggaagaagcaacugaagaa

SEQ ID NO: 1221653 - RNA, 19 nt, Homo sapiens
guaaggaaauaaugagcua

SEQ ID NO: 1221654 - RNA, 19 nt, Homo sapiens
gcaagauguugaagaggua

SEQ ID NO: 1221655 - RNA, 19 nt, Homo sapiens
ugaaaguccugcacaguuu

SEQ ID NO: 1221656 - RNA, 19 nt, Homo sapiens
uaucaguccucaaagaaua

SEQ ID NO: 1221657 - RNA, 19 nt, Homo sapiens
agaaaugucugggaaagua

SEQ ID NO: 1221658 - RNA, 19 nt, Homo sapiens
cauauaaggugacccuaaa

SEQ ID NO: 1221659 - RNA, 19 nt, Homo sapiens
gaacaggauuuaguacuuc

SEQ ID NO: 1221660 - RNA, 19 nt, Homo sapiens
gcuaacaucacaaacaaua

SEQ ID NO: 1221661 - RNA, 19 nt, Homo sapiens
ggaaauaaugagcuagaua

SEQ ID NO: 1221662 - RNA, 19 nt, Homo sapiens
ugacaagacuggaacucua

SEQ ID NO: 1221663 - RNA, 19 nt, Homo sapiens
ggacagcucaaucuuguuu

SEQ ID NO: 1221664 - RNA, 19 nt, Homo sapiens
gugcacagcugguguccua

SEQ ID NO: 1221665 - RNA, 19 nt, Homo sapiens
ucucauccaucuccauuua

SEQ ID NO: 1221666 - RNA, 19 nt, Homo sapiens
ggccagagauuguggaaug

SEQ ID NO: 1221667 - RNA, 19 nt, Homo sapiens
gagaugcaauugagaacaa

SEQ ID NO: 1221668 - RNA, 19 nt, Homo sapiens
agaagcaacugaagaagaa

SEQ ID NO: 1221669 - RNA, 19 nt, Homo sapiens
gagcaaaauucaagcuuua

SEQ ID NO: 1221670 - RNA, 19 nt, Homo sapiens
gccaacaacagaauaaaua

SEQ ID NO: 1221671 - RNA, 19 nt, Homo sapiens
aggcauacauucauaauug

SEQ ID NO: 1221672 - RNA, 19 nt, Homo sapiens
gacacaccgugcuuuguua

SEQ ID NO: 1221673 - RNA, 19 nt, Homo sapiens
guacugaagcauauaauga

SEQ ID NO: 1221674 - RNA, 19 nt, Homo sapiens
aaacagcacuucauaaucg

SEQ ID NO: 1221675 - RNA, 19 nt, Homo sapiens
gaaaaugugugcaaugaga

SEQ ID NO: 1221676 - RNA, 19 nt, Homo sapiens
gaaaucggaguuuguuuga

SEQ ID NO: 1221677 - RNA, 19 nt, Homo sapiens
aaacugacauggcauaaag

SEQ ID NO: 1221678 - RNA, 19 nt, Homo sapiens
aggaauaggagaucaauua

SEQ ID NO: 1221679 - RNA, 19 nt, Homo sapiens
gaaaagaaaugaguccaaa

SEQ ID NO: 1221680 - RNA, 19 nt, Homo sapiens
ucaaaggaaugagguguuu

SEQ ID NO: 1221681 - RNA, 19 nt, Homo sapiens
ggagaaaguguuccaguga

SEQ ID NO: 1221682 - RNA, 19 nt, Homo sapiens
guaggaaguuagauuugaa

SEQ ID NO: 1221683 - RNA, 19 nt, Homo sapiens
ucagugauuuccacaauug

SEQ ID NO: 1221684 - RNA, 19 nt, Homo sapiens
ggcauaaaguacagaauau

SEQ ID NO: 1221685 - RNA, 19 nt, Homo sapiens
gugaugcugugcuuauuaa

SEQ ID NO: 1221686 - RNA, 19 nt, Homo sapiens
gaaagagagagaauaccua

SEQ ID NO: 1221687 - RNA, 19 nt, Homo sapiens
cuuauucucuggaucauuu

SEQ ID NO: 1221688 - RNA, 19 nt, Homo sapiens
gcaaugagacuugaagguu

SEQ ID NO: 1221689 - RNA, 19 nt, Homo sapiens
gagggaggguguuagagaa

SEQ ID NO: 1221690 - RNA, 19 nt, Homo sapiens
ggaggugguugggaacuuu

SEQ ID NO: 1221691 - RNA, 19 nt, Homo sapiens
gcagugcagucauccauca

SEQ ID NO: 1221692 - RNA, 19 nt, Homo sapiens
cagaaacagcuauagauaa

SEQ ID NO: 1221693 - RNA, 19 nt, Homo sapiens
gcaaauaaugcuugaauac

SEQ ID NO: 1221694 - RNA, 19 nt, Homo sapiens
ucaguggcaucucccuuua

SEQ ID NO: 1221695 - RNA, 19 nt, Homo sapiens
ggaaacacauaaacgacau

SEQ ID NO: 1221696 - RNA, 19 nt, Homo sapiens
cggaagaucuuuucauuuu

SEQ ID NO: 1221697 - RNA, 19 nt, Homo sapiens
agucuucucucguagguua

SEQ ID NO: 1221698 - RNA, 19 nt, Homo sapiens
ucauccaucuccauuuaua

SEQ ID NO: 1221699 - RNA, 19 nt, Homo sapiens
agacauaccauucaacuug

SEQ ID NO: 1221700 - RNA, 19 nt, Homo sapiens
gcagagaugcaauugagaa

SEQ ID NO: 1221701 - RNA, 19 nt, Homo sapiens
gaucagaagacacaguuga

SEQ ID NO: 1221702 - RNA, 19 nt, Homo sapiens
gaaacagcacuucauaauc

SEQ ID NO: 1221703 - RNA, 19 nt, Homo sapiens
gauaagcuguugaaaagaa

SEQ ID NO: 1221704 - RNA, 19 nt, Homo sapiens
ggaggguguuagagaauga

SEQ ID NO: 1221705 - RNA, 19 nt, Homo sapiens
gaacuuccagcuacuuaug

SEQ ID NO: 1221706 - RNA, 19 nt, Homo sapiens
ggaauaggagaucaauuau

SEQ ID NO: 1221707 - RNA, 19 nt, Homo sapiens
uaaggugacccuaaagaaa

SEQ ID NO: 1221708 - RNA, 19 nt, Homo sapiens
ggaaagaaagaguguuugu

SEQ ID NO: 1221709 - RNA, 19 nt, Homo sapiens
gggcagacauaccauucaa

SEQ ID NO: 1221710 - RNA, 19 nt, Homo sapiens
cagaggcuauuccgguuaa

SEQ ID NO: 1221711 - RNA, 19 nt, Homo sapiens
cugcaguacuugaagauuu

SEQ ID NO: 1221712 - RNA, 19 nt, Homo sapiens
gcucaaucuuguuugcuuu

SEQ ID NO: 1221713 - RNA, 19 nt, Homo sapiens
ucgagucucuugauauuau

SEQ ID NO: 1221714 - RNA, 19 nt, Homo sapiens
ggacgguugucaugagugu

SEQ ID NO: 1221715 - RNA, 19 nt, Homo sapiens
gcuaauagucaccauuuau

SEQ ID NO: 1221716 - RNA, 19 nt, Homo sapiens
ucacaggcaucuccuuugu

SEQ ID NO: 1221717 - RNA, 19 nt, Homo sapiens
gaguuuguuugaccuguuu

SEQ ID NO: 1221718 - RNA, 19 nt, Homo sapiens
caacuugaaucuuccuuac

SEQ ID NO: 1221719 - RNA, 19 nt, Homo sapiens
agaaacagcuauagauaac

SEQ ID NO: 1221720 - RNA, 19 nt, Homo sapiens
acagaaacagcuauagaua

SEQ ID NO: 1221721 - RNA, 19 nt, Homo sapiens
gcaaaugauuguggugcuu

SEQ ID NO: 1221722 - RNA, 19 nt, Homo sapiens
ggugauggcgcaaaugauu

SEQ ID NO: 1221723 - RNA, 19 nt, Homo sapiens
gauucuaccucaggauaaa

SEQ ID NO: 1221724 - RNA, 19 nt, Homo sapiens
uagcagagaugcaauugag

SEQ ID NO: 1221725 - RNA, 19 nt, Homo sapiens
guggacagcucaaucuugu

SEQ ID NO: 1221726 - RNA, 19 nt, Homo sapiens
uagcugaagucuaagaugu

SEQ ID NO: 1221727 - RNA, 19 nt, Homo sapiens
auaggaaacuggaagagaa

SEQ ID NO: 1221728 - RNA, 19 nt, Homo sapiens
ucaggguuguuuaaaguuu

SEQ ID NO: 1221729 - RNA, 19 nt, Homo sapiens
gaaaugucugggaaaguaa

SEQ ID NO: 1221730 - RNA, 19 nt, Homo sapiens
gcaucucccuuuaccucua

SEQ ID NO: 1221731 - RNA, 19 nt, Homo sapiens
acacggaggcauuuccuua

SEQ ID NO: 1221732 - RNA, 19 nt, Homo sapiens
gaagacacaguugauagaa

SEQ ID NO: 1221733 - RNA, 19 nt, Homo sapiens
ggaaaaucauucucaguga

SEQ ID NO: 1221734 - RNA, 19 nt, Homo sapiens
gacuggaacucuaacugaa

SEQ ID NO: 1221735 - RNA, 19 nt, Homo sapiens
gaaauuagguccucuauua

SEQ ID NO: 1221736 - RNA, 19 nt, Homo sapiens
gaacugagccgaguaauua

SEQ ID NO: 1221737 - RNA, 19 nt, Homo sapiens
ucauauaacuccuuccuua

SEQ ID NO: 1221738 - RNA, 19 nt, Homo sapiens
agacaaaguuggcaauaua

SEQ ID NO: 1221739 - RNA, 19 nt, Homo sapiens
cagcacaaaugaagaguua

SEQ ID NO: 1221740 - RNA, 19 nt, Homo sapiens
gcaguggucuguaugauga

SEQ ID NO: 1221741 - RNA, 19 nt, Homo sapiens
gaagaaaggacacaauuau

SEQ ID NO: 1221742 - RNA, 19 nt, Homo sapiens
ggaagaaaggacacaauua

SEQ ID NO: 1221743 - RNA, 19 nt, Homo sapiens
gcaguuaaauggagaagga

SEQ ID NO: 1221744 - RNA, 19 nt, Homo sapiens
gaaggaagcuauugaaucc

SEQ ID NO: 1221745 - RNA, 19 nt, Homo sapiens
cagaagagauucccguuug

SEQ ID NO: 1221746 - RNA, 19 nt, Homo sapiens
gaaagaagggacuacauga

SEQ ID NO: 1221747 - RNA, 19 nt, Homo sapiens
aaauuugccuuuccucaua

SEQ ID NO: 1221748 - RNA, 19 nt, Homo sapiens
ggaggagccugaucugguu

SEQ ID NO: 1221749 - RNA, 19 nt, Homo sapiens
gaagugugccaguauauga

SEQ ID NO: 1221750 - RNA, 19 nt, Homo sapiens
gauccaguguaauugcuua

SEQ ID NO: 1221751 - RNA, 19 nt, Homo sapiens
agggaaagcguauguauua

SEQ ID NO: 1221752 - RNA, 19 nt, Homo sapiens
gaaaagaaguagcaggaaa

SEQ ID NO: 1221753 - RNA, 19 nt, Homo sapiens
gaugcugucugcaacuuaa

SEQ ID NO: 1221754 - RNA, 19 nt, Homo sapiens
auagagaacugggcaauuu

SEQ ID NO: 1221755 - RNA, 19 nt, Homo sapiens
gauaaugacagcacaaaug

SEQ ID NO: 1221756 - RNA, 19 nt, Homo sapiens
cccaaaugcugaauuauug

SEQ ID NO: 1221757 - RNA, 19 nt, Homo sapiens
gagacaaaguuggcaauau

SEQ ID NO: 1221758 - RNA, 19 nt, Homo sapiens
ggaaagaagggacuacaug

SEQ ID NO: 1221759 - RNA, 19 nt, Homo sapiens
gaaaggacacaauuauauc

SEQ ID NO: 1221760 - RNA, 19 nt, Homo sapiens
ccggaccucuugcuucuua

SEQ ID NO: 1221761 - RNA, 19 nt, Homo sapiens
agaguuagcuauugcuuau

SEQ ID NO: 1221762 - RNA, 19 nt, Homo sapiens
aaaccagggugauuucuau

SEQ ID NO: 1221763 - RNA, 19 nt, Homo sapiens
ccucuugcuucuuaaguua

SEQ ID NO: 1221764 - RNA, 19 nt, Homo sapiens
guacauggaccaacucgaa

SEQ ID NO: 1221765 - RNA, 19 nt, Homo sapiens
ugggaucccugaugcaaua

SEQ ID NO: 1221766 - RNA, 19 nt, Homo sapiens
uacaggagcugauuugugu

SEQ ID NO: 1221767 - RNA, 19 nt, Homo sapiens
ggaucugccuggaagcuuu

SEQ ID NO: 1221768 - RNA, 19 nt, Homo sapiens
ccagggugauuucuauaaa

SEQ ID NO: 1221769 - RNA, 19 nt, Homo sapiens
caacaugagauaccuagaa

SEQ ID NO: 1221770 - RNA, 19 nt, Homo sapiens
acacagagcuauggguuug

SEQ ID NO: 1221771 - RNA, 19 nt, Homo sapiens
ugaaugaccucacuaaagc

SEQ ID NO: 1221772 - RNA, 19 nt, Homo sapiens
caugagauaccuagaauau

SEQ ID NO: 1221773 - RNA, 19 nt, Homo sapiens
gaucccugaugcaauauga

SEQ ID NO: 1221774 - RNA, 19 nt, Homo sapiens
ucacagccaggaacacuua

SEQ ID NO: 1221775 - RNA, 19 nt, Homo sapiens
ucucgaggauccaguguaa

SEQ ID NO: 1221776 - RNA, 19 nt, Homo sapiens
ggccaagucuauugcagaa

SEQ ID NO: 1221777 - RNA, 19 nt, Homo sapiens
caaaaguuaugcugaauga

SEQ ID NO: 1221778 - RNA, 19 nt, Homo sapiens
gaagggacuacaugacauu

SEQ ID NO: 1221779 - RNA, 19 nt, Homo sapiens
caaaugaagaguuagcuau

SEQ ID NO: 1221780 - RNA, 19 nt, Homo sapiens
agucccaaaugcugaauua

SEQ ID NO: 1221781 - RNA, 19 nt, Homo sapiens
ccaagucuauugcagaaca

SEQ ID NO: 1221782 - RNA, 19 nt, Homo sapiens
gcaacuuaaucuuauccuu

SEQ ID NO: 1221783 - RNA, 19 nt, Homo sapiens
ggagacaaaguuggcaaua

SEQ ID NO: 1221784 - RNA, 19 nt, Homo sapiens
ggaaggaauaugauggauu

SEQ ID NO: 1221785 - RNA, 19 nt, Homo sapiens
gaaguacaggagcugauuu

SEQ ID NO: 1221786 - RNA, 19 nt, Homo sapiens
gaagguuccugggccauca

SEQ ID NO: 1221787 - RNA, 19 nt, Homo sapiens
ggagggaaagcguauguau

SEQ ID NO: 1221788 - RNA, 19 nt, Homo sapiens
aaugaagugugccaguaua

SEQ ID NO: 1221789 - RNA, 19 nt, Homo sapiens
gcuaugcuauacaaagguu

SEQ ID NO: 1221790 - RNA, 19 nt, Homo sapiens
ucacguaaccuccaugugu

SEQ ID NO: 1221791 - RNA, 19 nt, Homo sapiens
aaagcuggaugaacuugaa

SEQ ID NO: 1221792 - RNA, 19 nt, Homo sapiens
gcaguggagagacauguuu

SEQ ID NO: 1221793 - RNA, 19 nt, Homo sapiens
caacagcccaugaagacuu

SEQ ID NO: 1221794 - RNA, 19 nt, Homo sapiens
gcacggcuguacagacauc

SEQ ID NO: 1221795 - RNA, 19 nt, Homo sapiens
gaguguuuguauuccuuua

SEQ ID NO: 1221796 - RNA, 19 nt, Homo sapiens
gaucaaaugccagcacgaa

SEQ ID NO: 1221797 - RNA, 19 nt, Homo sapiens
ggaacccuguacuucauau

SEQ ID NO: 1221798 - RNA, 19 nt, Homo sapiens
gagggaaagcguauguauu

SEQ ID NO: 1221799 - RNA, 19 nt, Homo sapiens
gagaauacacagagcuaug

SEQ ID NO: 1221800 - RNA, 19 nt, Homo sapiens
aggaagcccuuaagaacuu

SEQ ID NO: 1221801 - RNA, 19 nt, Homo sapiens
gcaggcauauagagaacug

SEQ ID NO: 1221802 - RNA, 19 nt, Homo sapiens
ucuguaugaugaagcaaua

SEQ ID NO: 1221803 - RNA, 19 nt, Homo sapiens
gauuggcaguggucuguau

SEQ ID NO: 1221804 - RNA, 19 nt, Homo sapiens
ugucugcaacuuaaucuua

SEQ ID NO: 1221805 - RNA, 19 nt, Homo sapiens
auaaugaagugugccagua

SEQ ID NO: 1221806 - RNA, 19 nt, Homo sapiens
gggacuacaugacauuaag

SEQ ID NO: 1221807 - RNA, 19 nt, Homo sapiens
gaacaaugcagacaguacu

SEQ ID NO: 1221808 - RNA, 19 nt, Homo sapiens
gauagagcaucuuuuguug

SEQ ID NO: 1221809 - RNA, 19 nt, Homo sapiens
uaguucugcugcuguauuu

SEQ ID NO: 1221810 - RNA, 19 nt, Homo sapiens
guucagaggccuuuagcaa

SEQ ID NO: 1221811 - RNA, 19 nt, Homo sapiens
gauuacaggagacaaaguu

SEQ ID NO: 1221812 - RNA, 19 nt, Homo sapiens
ggaaaagguacacaaagua

SEQ ID NO: 1221813 - RNA, 19 nt, Homo sapiens
guuauaagccugaaguaca

SEQ ID NO: 1221814 - RNA, 19 nt, Homo sapiens
ggaagcccuuaagaacuuu

SEQ ID NO: 1221815 - RNA, 19 nt, Homo sapiens
gccuguugguucccacuua

SEQ ID NO: 1221816 - RNA, 19 nt, Homo sapiens
gcagcuagagccauauaau

SEQ ID NO: 1221817 - RNA, 19 nt, Homo sapiens
guacaggagcugauuugug

SEQ ID NO: 1221818 - RNA, 19 nt, Homo sapiens
gaucugccuggaagcuuua

SEQ ID NO: 1221819 - RNA, 19 nt, Homo sapiens
gcuagagccauauaaugaa

SEQ ID NO: 1221820 - RNA, 19 nt, Homo sapiens
cacuaaagcuauccaacug

SEQ ID NO: 1221821 - RNA, 19 nt, Homo sapiens
uuaaugaagcagugaauga

SEQ ID NO: 1221822 - RNA, 19 nt, Homo sapiens
aaugaagaguuagcuauug

SEQ ID NO: 1221823 - RNA, 19 nt, Homo sapiens
gacaaaguuggcaauauau

SEQ ID NO: 1221824 - RNA, 19 nt, Homo sapiens
ggucaggugaucaacauga

SEQ ID NO: 1221825 - RNA, 19 nt, Homo sapiens
ccucauagaagacuacgaa

SEQ ID NO: 1221826 - RNA, 19 nt, Homo sapiens
agacaguacuugccagagu

SEQ ID NO: 1221827 - RNA, 19 nt, Homo sapiens
gaccuucuuccgauuauga

SEQ ID NO: 1221828 - RNA, 19 nt, Homo sapiens
aaagguacacaaaguagaa

SEQ ID NO: 1221829 - RNA, 19 nt, Homo sapiens
gagcagcgagcagaaauuc

SEQ ID NO: 1221830 - RNA, 19 nt, Homo sapiens
cagccaggaacacuuauuu

SEQ ID NO: 1221831 - RNA, 19 nt, Homo sapiens
acguuaagaucgaugauug

SEQ ID NO: 1221832 - RNA, 19 nt, Homo sapiens
gagcuaauaauccuaaagg

SEQ ID NO: 1221833 - RNA, 19 nt, Homo sapiens
uguuugacauugcaguuaa

SEQ ID NO: 1221834 - RNA, 19 nt, Homo sapiens
cauagaagacuacgaagag

SEQ ID NO: 1221835 - RNA, 19 nt, Homo sapiens
gcaaagaccucgacuugga

SEQ ID NO: 1221836 - RNA, 19 nt, Homo sapiens
aggaggagcuggacucuua

SEQ ID NO: 1221837 - RNA, 19 nt, Homo sapiens
gagcaaagaccucgacuug

SEQ ID NO: 1221838 - RNA, 19 nt, Homo sapiens
gcagaucugauacccauua

SEQ ID NO: 1221839 - RNA, 19 nt, Homo sapiens
gcaaagaccagcaggaaga

SEQ ID NO: 1221840 - RNA, 19 nt, Homo sapiens
ggugguggcuggugaagaa

SEQ ID NO: 1221841 - RNA, 19 nt, Homo sapiens
cagagaagcugcuguccuu

SEQ ID NO: 1221842 - RNA, 19 nt, Homo sapiens
ggacggagcggcuacauuc

SEQ ID NO: 1221843 - RNA, 19 nt, Homo sapiens
ucccaaaccuggagcauuu

SEQ ID NO: 1221844 - RNA, 19 nt, Homo sapiens
cagcagagccauuuacuug

SEQ ID NO: 1221845 - RNA, 19 nt, Homo sapiens
gaagaagaaauuugggaaa

SEQ ID NO: 1221846 - RNA, 19 nt, Homo sapiens
ucagaugacuggcaacuuc

SEQ ID NO: 1221847 - RNA, 19 nt, Homo sapiens
gcagagccauuuacuugca

SEQ ID NO: 1221848 - RNA, 19 nt, Homo sapiens
uaagggacauugagcuguu

SEQ ID NO: 1221849 - RNA, 19 nt, Homo sapiens
caacccacauucucagaug

SEQ ID NO: 1221850 - RNA, 19 nt, Homo sapiens
guacacauccucuucaagu

SEQ ID NO: 1221851 - RNA, 19 nt, Homo sapiens
agaaggcucuggaggaaga

SEQ ID NO: 1221852 - RNA, 19 nt, Homo sapiens
gccaagcacccuuaggaua

SEQ ID NO: 1221853 - RNA, 19 nt, Homo sapiens
guuccaaugcuucgacuua

SEQ ID NO: 1221854 - RNA, 19 nt, Homo sapiens
aggaagagcuggagcaaag

SEQ ID NO: 1221855 - RNA, 19 nt, Homo sapiens
ccaguaaccaccuauuuau

SEQ ID NO: 1221856 - RNA, 19 nt, Homo sapiens
gaaaggccgcucccuaugg

SEQ ID NO: 1221857 - RNA, 19 nt, Homo sapiens
gcaggaagaagaaauuugg

SEQ ID NO: 1221858 - RNA, 19 nt, Homo sapiens
ggaaaggccgcucccuaug

SEQ ID NO: 1221859 - RNA, 19 nt, Homo sapiens
cccaguaaccaccuauuua

SEQ ID NO: 1221860 - RNA, 19 nt, Homo sapiens
gcccagaggcugaagcaaa

SEQ ID NO: 1221861 - RNA, 19 nt, Homo sapiens
ccagcuacuucgcauaaga

SEQ ID NO: 1221862 - RNA, 19 nt, Homo sapiens
ccacaccagugcccgagaa

SEQ ID NO: 1221863 - RNA, 19 nt, Homo sapiens
gaucugauacccauuagag

SEQ ID NO: 1221864 - RNA, 19 nt, Homo sapiens
gcccuuaggcaccagcuua

SEQ ID NO: 1221865 - RNA, 19 nt, Homo sapiens
gagcacagccucccaccau

SEQ ID NO: 1221866 - RNA, 19 nt, Homo sapiens
cccagaaccucaccucaga

SEQ ID NO: 1221867 - RNA, 19 nt, Homo sapiens
gguggcuggugaagaauga

SEQ ID NO: 1221868 - RNA, 19 nt, Homo sapiens
gcuuagacaccuccaagaa

SEQ ID NO: 1221869 - RNA, 19 nt, Homo sapiens
aaaggccgcucccuaugga

SEQ ID NO: 1221870 - RNA, 19 nt, Homo sapiens
ugcagaagcuguucgagau

SEQ ID NO: 1221871 - RNA, 19 nt, Homo sapiens
ugucuaagcccaccugaga

SEQ ID NO: 1221872 - RNA, 19 nt, Homo sapiens
gcugaaccauguccuaagg

SEQ ID NO: 1221873 - RNA, 19 nt, Homo sapiens
ggagaaggcccaggcaaag

SEQ ID NO: 1221874 - RNA, 19 nt, Homo sapiens
gagaaggcccaggcaaaga

SEQ ID NO: 1221875 - RNA, 19 nt, Homo sapiens
aggaagugcugaaccaugu

SEQ ID NO: 1221876 - RNA, 19 nt, Homo sapiens
gaaccaagugccuuuacuc

SEQ ID NO: 1221877 - RNA, 19 nt, Homo sapiens
gcggcuacauuccaagcaa

SEQ ID NO: 1221878 - RNA, 19 nt, Homo sapiens
gcacaggguggagcacuug

SEQ ID NO: 1221879 - RNA, 19 nt, Homo sapiens
guggagcacuugaugacau

SEQ ID NO: 1221880 - RNA, 19 nt, Homo sapiens
gcaaacagugucccuucug

SEQ ID NO: 1221881 - RNA, 19 nt, Homo sapiens
ccaagcacccuuaggauac

SEQ ID NO: 1221882 - RNA, 19 nt, Homo sapiens
uaagcccaccugagaguaa

SEQ ID NO: 1221883 - RNA, 19 nt, Homo sapiens
gcuaucaaccugcuacagu

SEQ ID NO: 1221884 - RNA, 19 nt, Homo sapiens
ggacauugagcuguucaug

SEQ ID NO: 1221885 - RNA, 19 nt, Homo sapiens
ccagcaggaagaagaaauu

SEQ ID NO: 1221886 - RNA, 19 nt, Homo sapiens
ucccucuccuucucaauaa

SEQ ID NO: 1221887 - RNA, 19 nt, Homo sapiens
gcagcagagccauuuacuu

SEQ ID NO: 1221888 - RNA, 19 nt, Homo sapiens
cagccaagcacccuuagga

SEQ ID NO: 1221889 - RNA, 19 nt, Homo sapiens
gcauccaggccaugaaugu

SEQ ID NO: 1221890 - RNA, 19 nt, Homo sapiens
cauaagaccuggggagcua

SEQ ID NO: 1221891 - RNA, 19 nt, Homo sapiens
ccaugaauguggcgcucaa

SEQ ID NO: 1221892 - RNA, 19 nt, Homo sapiens
gcagaagcuguucgagaug

SEQ ID NO: 1221893 - RNA, 19 nt, Homo sapiens
gucccucuccuucucaaua

SEQ ID NO: 1221894 - RNA, 19 nt, Homo sapiens
caguaaccaccuauuuauu

SEQ ID NO: 1221895 - RNA, 19 nt, Homo sapiens
gcucguacacauccucuuc

SEQ ID NO: 1221896 - RNA, 19 nt, Homo sapiens
cgagaaccaagugccuuua

SEQ ID NO: 1221897 - RNA, 19 nt, Homo sapiens
cggaccaccugcuccaaga

SEQ ID NO: 1221898 - RNA, 19 nt, Homo sapiens
uggaaaggccgcucccuau

SEQ ID NO: 1221899 - RNA, 19 nt, Homo sapiens
caaagaccagcaggaagaa

SEQ ID NO: 1221900 - RNA, 19 nt, Homo sapiens
ggaggaagagcuggagcaa

SEQ ID NO: 1221901 - RNA, 19 nt, Homo sapiens
caccugagaguaaccuuug

SEQ ID NO: 1221902 - RNA, 19 nt, Homo sapiens
cagcaggaagaagaaauuu

SEQ ID NO: 1221903 - RNA, 19 nt, Homo sapiens
gugcugaaccauguccuaa

SEQ ID NO: 1221904 - RNA, 19 nt, Homo sapiens
gggcagagcgacugaagac

SEQ ID NO: 1221905 - RNA, 19 nt, Homo sapiens
cggagcggcuacauuccaa

SEQ ID NO: 1221906 - RNA, 19 nt, Homo sapiens
cuaccaacccacauucuca

SEQ ID NO: 1221907 - RNA, 19 nt, Homo sapiens
ccuagcagcccaagugauc

SEQ ID NO: 1221908 - RNA, 19 nt, Homo sapiens
uggagaaggcccaggcaaa

SEQ ID NO: 1221909 - RNA, 19 nt, Homo sapiens
gaggaagagcuggagcaaa

SEQ ID NO: 1221910 - RNA, 19 nt, Homo sapiens
cccagaggcugaagcaaac

SEQ ID NO: 1221911 - RNA, 19 nt, Homo sapiens
ccaccugagaguaaccuuu

SEQ ID NO: 1221912 - RNA, 19 nt, Homo sapiens
ccgagaaccaagugccuuu

SEQ ID NO: 1221913 - RNA, 19 nt, Homo sapiens
ggagcaaagaccucgacuu

SEQ ID NO: 1221914 - RNA, 19 nt, Homo sapiens
ggaagagcuggagcaaaga

SEQ ID NO: 1221915 - RNA, 19 nt, Homo sapiens
ccgaggaugccuugcagaa

SEQ ID NO: 1221916 - RNA, 19 nt, Homo sapiens
ccaaaccuggagcauuuau

SEQ ID NO: 1221917 - RNA, 19 nt, Homo sapiens
cagaucugauacccauuag

SEQ ID NO: 1221918 - RNA, 19 nt, Homo sapiens
gagccagcuacuucgcaua

SEQ ID NO: 1221919 - RNA, 19 nt, Homo sapiens
uggagcacuugaugacaug

SEQ ID NO: 1221920 - RNA, 19 nt, Homo sapiens
ggagcaggcacgcuaucug

SEQ ID NO: 1221921 - RNA, 19 nt, Homo sapiens
gaagagcuggagcaaagac

SEQ ID NO: 1221922 - RNA, 19 nt, Homo sapiens
ugucaagaaucuguucagu

SEQ ID NO: 1221923 - RNA, 19 nt, Homo sapiens
gaaggaugcuggggauaag

SEQ ID NO: 1221924 - RNA, 19 nt, Homo sapiens
cagcagcgucaacauguca

SEQ ID NO: 1221925 - RNA, 19 nt, Homo sapiens
gggacggagcggcuacauu

SEQ ID NO: 1221926 - RNA, 19 nt, Homo sapiens
gacagcauccaggccauga

SEQ ID NO: 1221927 - RNA, 19 nt, Homo sapiens
ccucagcagcgucaacaug

SEQ ID NO: 1221928 - RNA, 19 nt, Homo sapiens
gagaaccaagugccuuuac

SEQ ID NO: 1221929 - RNA, 19 nt, Homo sapiens
ccagcagcagagccauuua

SEQ ID NO: 1221930 - RNA, 19 nt, Homo sapiens
ggccugaagaggucacaga

SEQ ID NO: 1221931 - RNA, 19 nt, Homo sapiens
gaagaccagccugcagaag

SEQ ID NO: 1221932 - RNA, 19 nt, Homo sapiens
ugaagaccagccugcagaa

SEQ ID NO: 1221933 - RNA, 19 nt, Homo sapiens
cagcauccaggccaugaau

SEQ ID NO: 1221934 - RNA, 19 nt, Homo sapiens
gcaaagaccucgacuugga

SEQ ID NO: 1221935 - RNA, 19 nt, Homo sapiens
aggaggagcuggacucuua

SEQ ID NO: 1221936 - RNA, 19 nt, Homo sapiens
gagcaaagaccucgacuug

SEQ ID NO: 1221937 - RNA, 19 nt, Homo sapiens
gcagaucugauacccauua

SEQ ID NO: 1221938 - RNA, 19 nt, Homo sapiens
gcaaagaccagcaggaaga

SEQ ID NO: 1221939 - RNA, 19 nt, Homo sapiens
ggugguggcuggugaagaa

SEQ ID NO: 1221940 - RNA, 19 nt, Homo sapiens
cagagaagcugcuguccuu

SEQ ID NO: 1221941 - RNA, 19 nt, Homo sapiens
ggacggagcggcuacauuc

SEQ ID NO: 1221942 - RNA, 19 nt, Homo sapiens
ucccaaaccuggagcauuu

SEQ ID NO: 1221943 - RNA, 19 nt, Homo sapiens
cagcagagccauuuacuug

SEQ ID NO: 1221944 - RNA, 19 nt, Homo sapiens
gaagaagaaauuugggaaa

SEQ ID NO: 1221945 - RNA, 19 nt, Homo sapiens
ucagaugacuggcaacuuc

SEQ ID NO: 1221946 - RNA, 19 nt, Homo sapiens
gcagagccauuuacuugca

SEQ ID NO: 1221947 - RNA, 19 nt, Homo sapiens
uaagggacauugagcuguu

SEQ ID NO: 1221948 - RNA, 19 nt, Homo sapiens
caacccacauucucagaug

SEQ ID NO: 1221949 - RNA, 19 nt, Homo sapiens
guacacauccucuucaagu

SEQ ID NO: 1221950 - RNA, 19 nt, Homo sapiens
agaaggcucuggaggaaga

SEQ ID NO: 1221951 - RNA, 19 nt, Homo sapiens
gggagcaccucacacuuuc

SEQ ID NO: 1221952 - RNA, 19 nt, Homo sapiens
gccaagcacccuuaggaua

SEQ ID NO: 1221953 - RNA, 19 nt, Homo sapiens
guuccaaugcuucgacuua

SEQ ID NO: 1221954 - RNA, 19 nt, Homo sapiens
aggaagagcuggagcaaag

SEQ ID NO: 1221955 - RNA, 19 nt, Homo sapiens
ccaguaaccaccuauuuau

SEQ ID NO: 1221956 - RNA, 19 nt, Homo sapiens
gaaaggccgcucccuaugg

SEQ ID NO: 1221957 - RNA, 19 nt, Homo sapiens
gcaggaagaagaaauuugg

SEQ ID NO: 1221958 - RNA, 19 nt, Homo sapiens
ggaaaggccgcucccuaug

SEQ ID NO: 1221959 - RNA, 19 nt, Homo sapiens
cccaguaaccaccuauuua

SEQ ID NO: 1221960 - RNA, 19 nt, Homo sapiens
gcccagaggcugaagcaaa

SEQ ID NO: 1221961 - RNA, 19 nt, Homo sapiens
ccagcuacuucgcauaaga

SEQ ID NO: 1221962 - RNA, 19 nt, Homo sapiens
ccacaccagugcccgagaa

SEQ ID NO: 1221963 - RNA, 19 nt, Homo sapiens
gaucugauacccauuagag

SEQ ID NO: 1221964 - RNA, 19 nt, Homo sapiens
gcccuuaggcaccagcuua

SEQ ID NO: 1221965 - RNA, 19 nt, Homo sapiens
gagcacagccucccaccau

SEQ ID NO: 1221966 - RNA, 19 nt, Homo sapiens
cccagaaccucaccucaga

SEQ ID NO: 1221967 - RNA, 19 nt, Homo sapiens
gguggcuggugaagaauga

SEQ ID NO: 1221968 - RNA, 19 nt, Homo sapiens
gcuuagacaccuccaagaa

SEQ ID NO: 1221969 - RNA, 19 nt, Homo sapiens
aaaggccgcucccuaugga

SEQ ID NO: 1221970 - RNA, 19 nt, Homo sapiens
ugcagaagcuguucgagau

SEQ ID NO: 1221971 - RNA, 19 nt, Homo sapiens
gcggggaagucauagguua

SEQ ID NO: 1221972 - RNA, 19 nt, Homo sapiens
ugucuaagcccaccugaga

SEQ ID NO: 1221973 - RNA, 19 nt, Homo sapiens
gcugaaccauguccuaagg

SEQ ID NO: 1221974 - RNA, 19 nt, Homo sapiens
ggagaaggcccaggcaaag

SEQ ID NO: 1221975 - RNA, 19 nt, Homo sapiens
gagaaggcccaggcaaaga

SEQ ID NO: 1221976 - RNA, 19 nt, Homo sapiens
aggaagugcugaaccaugu

SEQ ID NO: 1221977 - RNA, 19 nt, Homo sapiens
gaaccaagugccuuuacuc

SEQ ID NO: 1221978 - RNA, 19 nt, Homo sapiens
agaagacacacaaccauga

SEQ ID NO: 1221979 - RNA, 19 nt, Homo sapiens
ggagaagacacacaaccau

SEQ ID NO: 1221980 - RNA, 19 nt, Homo sapiens
gcggcuacauuccaagcaa

SEQ ID NO: 1221981 - RNA, 19 nt, Homo sapiens
guggagcacuugaugacau

SEQ ID NO: 1221982 - RNA, 19 nt, Homo sapiens
gcacaggguggagcacuug

SEQ ID NO: 1221983 - RNA, 19 nt, Homo sapiens
gcaaacagugucccuucug

SEQ ID NO: 1221984 - RNA, 19 nt, Homo sapiens
ccaagcacccuuaggauac

SEQ ID NO: 1221985 - RNA, 19 nt, Homo sapiens
uaagcccaccugagaguaa

SEQ ID NO: 1221986 - RNA, 19 nt, Homo sapiens
gcuaucaaccugcuacagu

SEQ ID NO: 1221987 - RNA, 19 nt, Homo sapiens
ggacauugagcuguucaug

SEQ ID NO: 1221988 - RNA, 19 nt, Homo sapiens
ccagcaggaagaagaaauu

SEQ ID NO: 1221989 - RNA, 19 nt, Homo sapiens
ucccucuccuucucaauaa

SEQ ID NO: 1221990 - RNA, 19 nt, Homo sapiens
gcagcagagccauuuacuu

SEQ ID NO: 1221991 - RNA, 19 nt, Homo sapiens
cagccaagcacccuuagga

SEQ ID NO: 1221992 - RNA, 19 nt, Homo sapiens
gcauccaggccaugaaugu

SEQ ID NO: 1221993 - RNA, 19 nt, Homo sapiens
cauaagaccuggggagcua

SEQ ID NO: 1221994 - RNA, 19 nt, Homo sapiens
ccaugaauguggcgcucaa

SEQ ID NO: 1221995 - RNA, 19 nt, Homo sapiens
gcagaagcuguucgagaug

SEQ ID NO: 1221996 - RNA, 19 nt, Homo sapiens
gucccucuccuucucaaua

SEQ ID NO: 1221997 - RNA, 19 nt, Homo sapiens
caguaaccaccuauuuauu

SEQ ID NO: 1221998 - RNA, 19 nt, Homo sapiens
cggaccaccugcuccaaga

SEQ ID NO: 1221999 - RNA, 19 nt, Homo sapiens
gcucguacacauccucuuc

SEQ ID NO: 1222000 - RNA, 19 nt, Homo sapiens
cgagaaccaagugccuuua

SEQ ID NO: 1222001 - RNA, 19 nt, Homo sapiens
uggaaaggccgcucccuau

SEQ ID NO: 1222002 - RNA, 19 nt, Homo sapiens
caaagaccagcaggaagaa

SEQ ID NO: 1222003 - RNA, 19 nt, Homo sapiens
ggaggaagagcuggagcaa

SEQ ID NO: 1222004 - RNA, 19 nt, Homo sapiens
caccugagaguaaccuuug

SEQ ID NO: 1222005 - RNA, 19 nt, Homo sapiens
cagcaggaagaagaaauuu

SEQ ID NO: 1222006 - RNA, 19 nt, Homo sapiens
gugcugaaccauguccuaa

SEQ ID NO: 1222007 - RNA, 19 nt, Homo sapiens
gggcagagcgacugaagac

SEQ ID NO: 1222008 - RNA, 19 nt, Homo sapiens
agggagcaccucacacuuu

SEQ ID NO: 1222009 - RNA, 19 nt, Homo sapiens
cggagcggcuacauuccaa

SEQ ID NO: 1222010 - RNA, 19 nt, Homo sapiens
gaagacacacaaccaugac

SEQ ID NO: 1222011 - RNA, 19 nt, Homo sapiens
cuaccaacccacauucuca

SEQ ID NO: 1222012 - RNA, 19 nt, Homo sapiens
ccuagcagcccaagugauc

SEQ ID NO: 1222013 - RNA, 19 nt, Homo sapiens
uggagaaggcccaggcaaa

SEQ ID NO: 1222014 - RNA, 19 nt, Homo sapiens
gaggaagagcuggagcaaa

SEQ ID NO: 1222015 - RNA, 19 nt, Homo sapiens
cccagaggcugaagcaaac

SEQ ID NO: 1222016 - RNA, 19 nt, Homo sapiens
ccaccugagaguaaccuuu

SEQ ID NO: 1222017 - RNA, 19 nt, Homo sapiens
ccgagaaccaagugccuuu

SEQ ID NO: 1222018 - RNA, 19 nt, Homo sapiens
ggagcaaagaccucgacuu

SEQ ID NO: 1222019 - RNA, 19 nt, Homo sapiens
ggaagagcuggagcaaaga

SEQ ID NO: 1222020 - RNA, 19 nt, Homo sapiens
ccgaggaugccuugcagaa

SEQ ID NO: 1222021 - RNA, 19 nt, Homo sapiens
ccaaaccuggagcauuuau

SEQ ID NO: 1222022 - RNA, 19 nt, Homo sapiens
cagaucugauacccauuag

SEQ ID NO: 1222023 - RNA, 19 nt, Homo sapiens
gagccagcuacuucgcaua

SEQ ID NO: 1222024 - RNA, 19 nt, Homo sapiens
uggagcacuugaugacaug

SEQ ID NO: 1222025 - RNA, 19 nt, Homo sapiens
ggagcaggcacgcuaucug

SEQ ID NO: 1222026 - RNA, 19 nt, Homo sapiens
gaagagcuggagcaaagac

SEQ ID NO: 1222027 - RNA, 19 nt, Homo sapiens
ugucaagaaucuguucagu

SEQ ID NO: 1222028 - RNA, 19 nt, Homo sapiens
gaaggaugcuggggauaag

SEQ ID NO: 1222029 - RNA, 19 nt, Homo sapiens
gggacggagcggcuacauu

SEQ ID NO: 1222030 - RNA, 19 nt, Homo sapiens
gacagcauccaggccauga

SEQ ID NO: 1222031 - RNA, 19 nt, Homo sapiens
cagcagcgucaacauguca

SEQ ID NO: 1222032 - RNA, 19 nt, Homo sapiens
ccucagcagcgucaacaug

SEQ ID NO: 1222033 - RNA, 19 nt, Homo sapiens
ccagcagcagagccauuua

SEQ ID NO: 1222034 - RNA, 19 nt, Homo sapiens
aggaggagcuggacucuua

SEQ ID NO: 1222035 - RNA, 19 nt, Homo sapiens
gcagaucugauacccauua

SEQ ID NO: 1222036 - RNA, 19 nt, Homo sapiens
gcaaagaccagcaggaaga

SEQ ID NO: 1222037 - RNA, 19 nt, Homo sapiens
ggugguggcuggugaagaa

SEQ ID NO: 1222038 - RNA, 19 nt, Homo sapiens
cagagaagcugcuguccuu

SEQ ID NO: 1222039 - RNA, 19 nt, Homo sapiens
ggacggagcggcuacauuc

SEQ ID NO: 1222040 - RNA, 19 nt, Homo sapiens
ucccaaaccuggagcauuu

SEQ ID NO: 1222041 - RNA, 19 nt, Homo sapiens
cagcagagccauuuacuug

SEQ ID NO: 1222042 - RNA, 19 nt, Homo sapiens
gaagaagaaauuugggaaa

SEQ ID NO: 1222043 - RNA, 19 nt, Homo sapiens
ucagaugacuggcaacuuc

SEQ ID NO: 1222044 - RNA, 19 nt, Homo sapiens
caaagcagaccucgacuug

SEQ ID NO: 1222045 - RNA, 19 nt, Homo sapiens
gcagagccauuuacuugca

SEQ ID NO: 1222046 - RNA, 19 nt, Homo sapiens
uaagggacauugagcuguu

SEQ ID NO: 1222047 - RNA, 19 nt, Homo sapiens
caacccacauucucagaug

SEQ ID NO: 1222048 - RNA, 19 nt, Homo sapiens
guacacauccucuucaagu

SEQ ID NO: 1222049 - RNA, 19 nt, Homo sapiens
aagcagaccucgacuugga

SEQ ID NO: 1222050 - RNA, 19 nt, Homo sapiens
agaaggcucuggaggaaga

SEQ ID NO: 1222051 - RNA, 19 nt, Homo sapiens
gggagcaccucacacuuuc

SEQ ID NO: 1222052 - RNA, 19 nt, Homo sapiens
gccaagcacccuuaggaua

SEQ ID NO: 1222053 - RNA, 19 nt, Homo sapiens
guuccaaugcuucgacuua

SEQ ID NO: 1222054 - RNA, 19 nt, Homo sapiens
aggaagagcuggagcaaag

SEQ ID NO: 1222055 - RNA, 19 nt, Homo sapiens
ccaguaaccaccuauuuau

SEQ ID NO: 1222056 - RNA, 19 nt, Homo sapiens
gaaaggccgcucccuaugg

SEQ ID NO: 1222057 - RNA, 19 nt, Homo sapiens
gcaggaagaagaaauuugg

SEQ ID NO: 1222058 - RNA, 19 nt, Homo sapiens
ggaaaggccgcucccuaug

SEQ ID NO: 1222059 - RNA, 19 nt, Homo sapiens
cccaguaaccaccuauuua

SEQ ID NO: 1222060 - RNA, 19 nt, Homo sapiens
gcccagaggcugaagcaaa

SEQ ID NO: 1222061 - RNA, 19 nt, Homo sapiens
ccagcuacuucgcauaaga

SEQ ID NO: 1222062 - RNA, 19 nt, Homo sapiens
ccacaccagugcccgagaa

SEQ ID NO: 1222063 - RNA, 19 nt, Homo sapiens
gaucugauacccauuagag

SEQ ID NO: 1222064 - RNA, 19 nt, Homo sapiens
gcccuuaggcaccagcuua

SEQ ID NO: 1222065 - RNA, 19 nt, Homo sapiens
gagcacagccucccaccau

SEQ ID NO: 1222066 - RNA, 19 nt, Homo sapiens
cccagaaccucaccucaga

SEQ ID NO: 1222067 - RNA, 19 nt, Homo sapiens
gguggcuggugaagaauga

SEQ ID NO: 1222068 - RNA, 19 nt, Homo sapiens
gcuuagacaccuccaagaa

SEQ ID NO: 1222069 - RNA, 19 nt, Homo sapiens
aaaggccgcucccuaugga

SEQ ID NO: 1222070 - RNA, 19 nt, Homo sapiens
gcaaagcagaccucgacuu

SEQ ID NO: 1222071 - RNA, 19 nt, Homo sapiens
ugcagaagcuguucgagau

SEQ ID NO: 1222072 - RNA, 19 nt, Homo sapiens
gcggggaagucauagguua

SEQ ID NO: 1222073 - RNA, 19 nt, Homo sapiens
ugucuaagcccaccugaga

SEQ ID NO: 1222074 - RNA, 19 nt, Homo sapiens
gcugaaccauguccuaagg

SEQ ID NO: 1222075 - RNA, 19 nt, Homo sapiens
ggagaaggcccaggcaaag

SEQ ID NO: 1222076 - RNA, 19 nt, Homo sapiens
gagaaggcccaggcaaaga

SEQ ID NO: 1222077 - RNA, 19 nt, Homo sapiens
aggaagugcugaaccaugu

SEQ ID NO: 1222078 - RNA, 19 nt, Homo sapiens
gaaccaagugccuuuacuc

SEQ ID NO: 1222079 - RNA, 19 nt, Homo sapiens
agaagacacacaaccauga

SEQ ID NO: 1222080 - RNA, 19 nt, Homo sapiens
ggagaagacacacaaccau

SEQ ID NO: 1222081 - RNA, 19 nt, Homo sapiens
gcggcuacauuccaagcaa

SEQ ID NO: 1222082 - RNA, 19 nt, Homo sapiens
guggagcacuugaugacau

SEQ ID NO: 1222083 - RNA, 19 nt, Homo sapiens
gcacaggguggagcacuug

SEQ ID NO: 1222084 - RNA, 19 nt, Homo sapiens
gcaaacagugucccuucug

SEQ ID NO: 1222085 - RNA, 19 nt, Homo sapiens
ccaagcacccuuaggauac

SEQ ID NO: 1222086 - RNA, 19 nt, Homo sapiens
uaagcccaccugagaguaa

SEQ ID NO: 1222087 - RNA, 19 nt, Homo sapiens
gcuaucaaccugcuacagu

SEQ ID NO: 1222088 - RNA, 19 nt, Homo sapiens
ggacauugagcuguucaug

SEQ ID NO: 1222089 - RNA, 19 nt, Homo sapiens
ccagcaggaagaagaaauu

SEQ ID NO: 1222090 - RNA, 19 nt, Homo sapiens
ucccucuccuucucaauaa

SEQ ID NO: 1222091 - RNA, 19 nt, Homo sapiens
gcagcagagccauuuacuu

SEQ ID NO: 1222092 - RNA, 19 nt, Homo sapiens
cagccaagcacccuuagga

SEQ ID NO: 1222093 - RNA, 19 nt, Homo sapiens
gcauccaggccaugaaugu

SEQ ID NO: 1222094 - RNA, 19 nt, Homo sapiens
cauaagaccuggggagcua

SEQ ID NO: 1222095 - RNA, 19 nt, Homo sapiens
gcagaagcuguucgagaug

SEQ ID NO: 1222096 - RNA, 19 nt, Homo sapiens
ccaugaauguggcgcucaa

SEQ ID NO: 1222097 - RNA, 19 nt, Homo sapiens
gucccucuccuucucaaua

SEQ ID NO: 1222098 - RNA, 19 nt, Homo sapiens
caguaaccaccuauuuauu

SEQ ID NO: 1222099 - RNA, 19 nt, Homo sapiens
cggaccaccugcuccaaga

SEQ ID NO: 1222100 - RNA, 19 nt, Homo sapiens
gcucguacacauccucuuc

SEQ ID NO: 1222101 - RNA, 19 nt, Homo sapiens
cgagaaccaagugccuuua

SEQ ID NO: 1222102 - RNA, 19 nt, Homo sapiens
uggaaaggccgcucccuau

SEQ ID NO: 1222103 - RNA, 19 nt, Homo sapiens
gaagagcuggagcaaagca

SEQ ID NO: 1222104 - RNA, 19 nt, Homo sapiens
caaagaccagcaggaagaa

SEQ ID NO: 1222105 - RNA, 19 nt, Homo sapiens
ggaggaagagcuggagcaa

SEQ ID NO: 1222106 - RNA, 19 nt, Homo sapiens
caccugagaguaaccuuug

SEQ ID NO: 1222107 - RNA, 19 nt, Homo sapiens
cagcaggaagaagaaauuu

SEQ ID NO: 1222108 - RNA, 19 nt, Homo sapiens
gugcugaaccauguccuaa

SEQ ID NO: 1222109 - RNA, 19 nt, Homo sapiens
gggcagagcgacugaagac

SEQ ID NO: 1222110 - RNA, 19 nt, Homo sapiens
agggagcaccucacacuuu

SEQ ID NO: 1222111 - RNA, 19 nt, Homo sapiens
cggagcggcuacauuccaa

SEQ ID NO: 1222112 - RNA, 19 nt, Homo sapiens
gaagacacacaaccaugac

SEQ ID NO: 1222113 - RNA, 19 nt, Homo sapiens
cuaccaacccacauucuca

SEQ ID NO: 1222114 - RNA, 19 nt, Homo sapiens
ccuagcagcccaagugauc

SEQ ID NO: 1222115 - RNA, 19 nt, Homo sapiens
uggagaaggcccaggcaaa

SEQ ID NO: 1222116 - RNA, 19 nt, Homo sapiens
gaggaagagcuggagcaaa

SEQ ID NO: 1222117 - RNA, 19 nt, Homo sapiens
cccagaggcugaagcaaac

SEQ ID NO: 1222118 - RNA, 19 nt, Homo sapiens
ccaccugagaguaaccuuu

SEQ ID NO: 1222119 - RNA, 19 nt, Homo sapiens
ccgagaaccaagugccuuu

SEQ ID NO: 1222120 - RNA, 19 nt, Homo sapiens
ccgaggaugccuugcagaa

SEQ ID NO: 1222121 - RNA, 19 nt, Homo sapiens
ccaaaccuggagcauuuau

SEQ ID NO: 1222122 - RNA, 19 nt, Homo sapiens
cagaucugauacccauuag

SEQ ID NO: 1222123 - RNA, 19 nt, Homo sapiens
gagccagcuacuucgcaua

SEQ ID NO: 1222124 - RNA, 19 nt, Homo sapiens
uggagcacuugaugacaug

SEQ ID NO: 1222125 - RNA, 19 nt, Homo sapiens
ggagcaggcacgcuaucug

SEQ ID NO: 1222126 - RNA, 19 nt, Homo sapiens
ugucaagaaucuguucagu

SEQ ID NO: 1222127 - RNA, 19 nt, Homo sapiens
gaaggaugcuggggauaag

SEQ ID NO: 1222128 - RNA, 19 nt, Homo sapiens
gggacggagcggcuacauu

SEQ ID NO: 1222129 - RNA, 19 nt, Homo sapiens
gacagcauccaggccauga

SEQ ID NO: 1222130 - RNA, 19 nt, Homo sapiens
cagcagcgucaacauguca

SEQ ID NO: 1222131 - RNA, 19 nt, Homo sapiens
ccagcagcagagccauuua

SEQ ID NO: 1222132 - RNA, 19 nt, Homo sapiens
gagaaccaagugccuuuac

SEQ ID NO: 1222133 - RNA, 19 nt, Homo sapiens
ccucagcagcgucaacaug

SEQ ID NO: 1222134 - RNA, 19 nt, Homo sapiens
gcacauuccuggcacauga

SEQ ID NO: 1222135 - RNA, 19 nt, Homo sapiens
agaagcagcuguuaaagga

SEQ ID NO: 1222136 - RNA, 19 nt, Homo sapiens
caucucaacuuguaacuca

SEQ ID NO: 1222137 - RNA, 19 nt, Homo sapiens
aagaugaccuuguacagaa

SEQ ID NO: 1222138 - RNA, 19 nt, Homo sapiens
gaagaugaccuuguacaga

SEQ ID NO: 1222139 - RNA, 19 nt, Homo sapiens
ggaaggagcagcuggacuu

SEQ ID NO: 1222140 - RNA, 19 nt, Homo sapiens
gcgcaucacuagcugcaaa

SEQ ID NO: 1222141 - RNA, 19 nt, Homo sapiens
cugcacaucucaacuugua

SEQ ID NO: 1222142 - RNA, 19 nt, Homo sapiens
caacgugucauccuucgua

SEQ ID NO: 1222143 - RNA, 19 nt, Homo sapiens
cacggaagaugaccuugua

SEQ ID NO: 1222144 - RNA, 19 nt, Homo sapiens
caagaggaccauccauauu

SEQ ID NO: 1222145 - RNA, 19 nt, Homo sapiens
gaccauccauauugacugu

SEQ ID NO: 1222146 - RNA, 19 nt, Homo sapiens
ccaagaggaccauccauau

SEQ ID NO: 1222147 - RNA, 19 nt, Homo sapiens
ggacaugcgagcaaucuuc

SEQ ID NO: 1222148 - RNA, 19 nt, Homo sapiens
agaggaccauccauauuga

SEQ ID NO: 1222149 - RNA, 19 nt, Homo sapiens
acacgcugcuccacgaauu

SEQ ID NO: 1222150 - RNA, 19 nt, Homo sapiens
ucaauaaacagaagugaca

SEQ ID NO: 1222151 - RNA, 19 nt, Homo sapiens
aagaggaccauccauauug

SEQ ID NO: 1222152 - RNA, 19 nt, Homo sapiens
cggcaugcacgauaaguuu

SEQ ID NO: 1222153 - RNA, 19 nt, Homo sapiens
gagaagcagcuguuaaagg

SEQ ID NO: 1222154 - RNA, 19 nt, Homo sapiens
guaacucaauaaacagaag

SEQ ID NO: 1222155 - RNA, 19 nt, Homo sapiens
caaggagaagcagcuguua

SEQ ID NO: 1222156 - RNA, 19 nt, Homo sapiens
gagaagcgcaucacuagcu

SEQ ID NO: 1222157 - RNA, 19 nt, Homo sapiens
ccauccauauugacuguga

SEQ ID NO: 1222158 - RNA, 19 nt, Homo sapiens
ccaaggagaagcagcuguu

SEQ ID NO: 1222159 - RNA, 19 nt, Homo sapiens
aggagaagcagcuguuaaa

SEQ ID NO: 1222160 - RNA, 19 nt, Homo sapiens
cccaagaggaccauccaua

SEQ ID NO: 1222161 - RNA, 19 nt, Homo sapiens
aggagcagcuggacuucuu

SEQ ID NO: 1222162 - RNA, 19 nt, Homo sapiens
caagcgcuaugccaagaag

SEQ ID NO: 1222163 - RNA, 19 nt, Homo sapiens
gcagcuggacuucuuugug

SEQ ID NO: 1222164 - RNA, 19 nt, Homo sapiens
ccgacgguaucuucuguug

SEQ ID NO: 1222165 - RNA, 19 nt, Homo sapiens
ggaagaugaccuuguacag

SEQ ID NO: 1222166 - RNA, 19 nt, Homo sapiens
gcacaucucaacuuguaac

SEQ ID NO: 1222167 - RNA, 19 nt, Homo sapiens
gugcacaaggugaucauga

SEQ ID NO: 1222168 - RNA, 19 nt, Homo sapiens
caccgaaccugcacaucuc

SEQ ID NO: 1222169 - RNA, 19 nt, Homo sapiens
ccaccgaaccugcacaucu

SEQ ID NO: 1222170 - RNA, 19 nt, Homo sapiens
gagcagcuggacuucuuug

SEQ ID NO: 1222171 - RNA, 19 nt, Homo sapiens
cagcgauggcuacaccuuu

SEQ ID NO: 1222172 - RNA, 19 nt, Homo sapiens
cuccagaagacaagaagua

SEQ ID NO: 1222173 - RNA, 19 nt, Homo sapiens
guccacggcaugcacgaua

SEQ ID NO: 1222174 - RNA, 19 nt, Homo sapiens
ccaaggagccaaggagaag

SEQ ID NO: 1222175 - RNA, 19 nt, Homo sapiens
gccaaggagccaaggagaa

SEQ ID NO: 1222176 - RNA, 19 nt, Homo sapiens
cagcuucugcucaaucuuc

SEQ ID NO: 1222177 - RNA, 19 nt, Homo sapiens
ggagcagcuggacuucuuu

SEQ ID NO: 1222178 - RNA, 19 nt, Homo sapiens
ggagaagcagcuguuaaag

SEQ ID NO: 1222179 - RNA, 19 nt, Homo sapiens
gcuaugccaagaagcgaaa

SEQ ID NO: 1222180 - RNA, 19 nt, Homo sapiens
acccagaccuagugcacaa

SEQ ID NO: 1222181 - RNA, 19 nt, Homo sapiens
gacaugcgagcaaucuuca

SEQ ID NO: 1222182 - RNA, 19 nt, Homo sapiens
gcaugcacgauaaguuugu

SEQ ID NO: 1222183 - RNA, 19 nt, Homo sapiens
aaggagaagcagcuguuaa

SEQ ID NO: 1222184 - RNA, 19 nt, Homo sapiens
gcugaggacaugcgagcaa

SEQ ID NO: 1222185 - RNA, 19 nt, Homo sapiens
agcgauggcuacaccuuug

SEQ ID NO: 1222186 - RNA, 19 nt, Homo sapiens
ggacccucacggaagauga

SEQ ID NO: 1222187 - RNA, 19 nt, Homo sapiens
acauggugaugcuggaaug

SEQ ID NO: 1222188 - RNA, 19 nt, Homo sapiens
uccacggcaugcacgauaa

SEQ ID NO: 1222189 - RNA, 19 nt, Homo sapiens
ugcacaaggugaucaugau

SEQ ID NO: 1222190 - RNA, 19 nt, Homo sapiens
gaaccugcacaucucaacu

SEQ ID NO: 1222191 - RNA, 19 nt, Homo sapiens
ucacggaagaugaccuugu

SEQ ID NO: 1222192 - RNA, 19 nt, Homo sapiens
caacacgcugcuccacgaa

SEQ ID NO: 1222193 - RNA, 19 nt, Homo sapiens
gcagccacauggugaugcu

SEQ ID NO: 1222194 - RNA, 19 nt, Homo sapiens
ggagggcaacgcuuucaac

SEQ ID NO: 1222195 - RNA, 19 nt, Homo sapiens
ugaguacccagaccuagug

SEQ ID NO: 1222196 - RNA, 19 nt, Homo sapiens
gaagaaccaucagauuuaa

SEQ ID NO: 1222197 - RNA, 19 nt, Homo sapiens
gagaaaugguuuacagaaa

SEQ ID NO: 1222198 - RNA, 19 nt, Homo sapiens
gaaacagacuccagugaug

SEQ ID NO: 1222199 - RNA, 19 nt, Homo sapiens
cagaagagauuaagugaga

SEQ ID NO: 1222200 - RNA, 19 nt, Homo sapiens
gaaaugguuuacagaaaga

SEQ ID NO: 1222201 - RNA, 19 nt, Homo sapiens
gugaagaaauugcaucauu

SEQ ID NO: 1222202 - RNA, 19 nt, Homo sapiens
ugaagaaccaucagauuua

SEQ ID NO: 1222203 - RNA, 19 nt, Homo sapiens
aaacacagaucgaagaaau

SEQ ID NO: 1222204 - RNA, 19 nt, Homo sapiens
gaagaagucuagccguuca

SEQ ID NO: 1222205 - RNA, 19 nt, Homo sapiens
acacuuaccucucaagaug

SEQ ID NO: 1222206 - RNA, 19 nt, Homo sapiens
cuacugugccuucuauuua

SEQ ID NO: 1222207 - RNA, 19 nt, Homo sapiens
gauaaaccuuugaacuaug

SEQ ID NO: 1222208 - RNA, 19 nt, Homo sapiens
agggaaggaugacaaauaa

SEQ ID NO: 1222209 - RNA, 19 nt, Homo sapiens
gagcaaagaaagccaagaa

SEQ ID NO: 1222210 - RNA, 19 nt, Homo sapiens
acaagauucuggccaguuu

SEQ ID NO: 1222211 - RNA, 19 nt, Homo sapiens
gaaaagagaaccagaucua

SEQ ID NO: 1222212 - RNA, 19 nt, Homo sapiens
aaagaaagguccaagaaaa

SEQ ID NO: 1222213 - RNA, 19 nt, Homo sapiens
gaaggaugacaaauaaaga

SEQ ID NO: 1222214 - RNA, 19 nt, Homo sapiens
ggaaggaugacaaauaaag

SEQ ID NO: 1222215 - RNA, 19 nt, Homo sapiens
uaaagaaucccaagaagag

SEQ ID NO: 1222216 - RNA, 19 nt, Homo sapiens
ggaugaagagccaaagaaa

SEQ ID NO: 1222217 - RNA, 19 nt, Homo sapiens
gaaagagagagaacaagau

SEQ ID NO: 1222218 - RNA, 19 nt, Homo sapiens
gaagauagcgacagugacu

SEQ ID NO: 1222219 - RNA, 19 nt, Homo sapiens
auugggagcuccugaagua

SEQ ID NO: 1222220 - RNA, 19 nt, Homo sapiens
gaaguauucugaagauagc

SEQ ID NO: 1222221 - RNA, 19 nt, Homo sapiens
gaaguacccagaacugugu

SEQ ID NO: 1222222 - RNA, 19 nt, Homo sapiens
cuacagugcugaugagaag

SEQ ID NO: 1222223 - RNA, 19 nt, Homo sapiens
cuauggccaugcucuguua

SEQ ID NO: 1222224 - RNA, 19 nt, Homo sapiens
agaaaugguuuacagaaag

SEQ ID NO: 1222225 - RNA, 19 nt, Homo sapiens
cgaaagagagagaacaaga

SEQ ID NO: 1222226 - RNA, 19 nt, Homo sapiens
gaagagauuaagugagaga

SEQ ID NO: 1222227 - RNA, 19 nt, Homo sapiens
aaagagagagaacaagauu

SEQ ID NO: 1222228 - RNA, 19 nt, Homo sapiens
ugaaugcucagguuaugua

SEQ ID NO: 1222229 - RNA, 19 nt, Homo sapiens
caaagggaaggaugacaaa

SEQ ID NO: 1222230 - RNA, 19 nt, Homo sapiens
ccacgaagaggugaaauug

SEQ ID NO: 1222231 - RNA, 19 nt, Homo sapiens
gcuacugugccuucuauuu

SEQ ID NO: 1222232 - RNA, 19 nt, Homo sapiens
cgagaaaugguuuacagaa

SEQ ID NO: 1222233 - RNA, 19 nt, Homo sapiens
caagaagagagacgaaaga

SEQ ID NO: 1222234 - RNA, 19 nt, Homo sapiens
gagagcccuugcauccuuu

SEQ ID NO: 1222235 - RNA, 19 nt, Homo sapiens
aaagaauccugaaccagau

SEQ ID NO: 1222236 - RNA, 19 nt, Homo sapiens
gugcuacugugccuucuau

SEQ ID NO: 1222237 - RNA, 19 nt, Homo sapiens
aagggaaggaugacaaaua

SEQ ID NO: 1222238 - RNA, 19 nt, Homo sapiens
caagguuuccucagauuug

SEQ ID NO: 1222239 - RNA, 19 nt, Homo sapiens
ucaagaugauaaaccuuug

SEQ ID NO: 1222240 - RNA, 19 nt, Homo sapiens
gcaaagaaagccaagaaaa

SEQ ID NO: 1222241 - RNA, 19 nt, Homo sapiens
uacugugccuucuauuuaa

SEQ ID NO: 1222242 - RNA, 19 nt, Homo sapiens
agagagcccuugcauccuu

SEQ ID NO: 1222243 - RNA, 19 nt, Homo sapiens
gaucuacagugcugaugag

SEQ ID NO: 1222244 - RNA, 19 nt, Homo sapiens
agaacuguguccaagguuu

SEQ ID NO: 1222245 - RNA, 19 nt, Homo sapiens
aaacguaucccacgaagag

SEQ ID NO: 1222246 - RNA, 19 nt, Homo sapiens
ccagaacuguguccaaggu

SEQ ID NO: 1222247 - RNA, 19 nt, Homo sapiens
agaaagcuuuacagugcua

SEQ ID NO: 1222248 - RNA, 19 nt, Homo sapiens
agucuggguuccacacaua

SEQ ID NO: 1222249 - RNA, 19 nt, Homo sapiens
gcagaaguacccagaacug

SEQ ID NO: 1222250 - RNA, 19 nt, Homo sapiens
gaaccaaggcaacagacau

SEQ ID NO: 1222251 - RNA, 19 nt, Homo sapiens
gaugauaaaccuuugaacu

SEQ ID NO: 1222252 - RNA, 19 nt, Homo sapiens
gaaccaucagauuuaauug

SEQ ID NO: 1222253 - RNA, 19 nt, Homo sapiens
cuaaagaaucccaagaaga

SEQ ID NO: 1222254 - RNA, 19 nt, Homo sapiens
gagaagagagcccuugcau

SEQ ID NO: 1222255 - RNA, 19 nt, Homo sapiens
uagcaggcaucgccgaaug

SEQ ID NO: 1222256 - RNA, 19 nt, Homo sapiens
agcuauggcugaauaugua

SEQ ID NO: 1222257 - RNA, 19 nt, Homo sapiens
gaacuguguccaagguuuc

SEQ ID NO: 1222258 - RNA, 19 nt, Homo sapiens
uguccaagguuuccucaga

SEQ ID NO: 1222259 - RNA, 19 nt, Homo sapiens
ggucuaagaagagcagaaa

SEQ ID NO: 1222260 - RNA, 19 nt, Homo sapiens
gaaggguuuugcagaagua

SEQ ID NO: 1222261 - RNA, 19 nt, Homo sapiens
gaaacacagaucgaagaaa

SEQ ID NO: 1222262 - RNA, 19 nt, Homo sapiens
ugacucugauucugaaaca

SEQ ID NO: 1222263 - RNA, 19 nt, Homo sapiens
ccaaagggaaggaugacaa

SEQ ID NO: 1222264 - RNA, 19 nt, Homo sapiens
ggccuagccuccucgacaa

SEQ ID NO: 1222265 - RNA, 19 nt, Homo sapiens
caaggcaacagacaucuuc

SEQ ID NO: 1222266 - RNA, 19 nt, Homo sapiens
aacaaaggcugaagaacca

SEQ ID NO: 1222267 - RNA, 19 nt, Homo sapiens
acacagaucgaagaaauau

SEQ ID NO: 1222268 - RNA, 19 nt, Homo sapiens
aaacagacuccagugauga

SEQ ID NO: 1222269 - RNA, 19 nt, Homo sapiens
caaaagaaagguccaagaa

SEQ ID NO: 1222270 - RNA, 19 nt, Homo sapiens
auacaccaguggaggauga

SEQ ID NO: 1222271 - RNA, 19 nt, Homo sapiens
gaaaagaguccagugauuc

SEQ ID NO: 1222272 - RNA, 19 nt, Homo sapiens
gacgaaagagagagaacaa

SEQ ID NO: 1222273 - RNA, 19 nt, Homo sapiens
ggcagaagagauuaaguga

SEQ ID NO: 1222274 - RNA, 19 nt, Homo sapiens
cagugacucugauucugaa

SEQ ID NO: 1222275 - RNA, 19 nt, Homo sapiens
ggcaacagacaucuuccua

SEQ ID NO: 1222276 - RNA, 19 nt, Homo sapiens
augcucagguuauguaaug

SEQ ID NO: 1222277 - RNA, 19 nt, Homo sapiens
ucuaaagaaucccaagaag

SEQ ID NO: 1222278 - RNA, 19 nt, Homo sapiens
aaagagaaccagaucuaca

SEQ ID NO: 1222279 - RNA, 19 nt, Homo sapiens
gacagugacucugauucug

SEQ ID NO: 1222280 - RNA, 19 nt, Homo sapiens
uaagugagagagagagaau

SEQ ID NO: 1222281 - RNA, 19 nt, Homo sapiens
gagagacgaaagagagaga

SEQ ID NO: 1222282 - RNA, 19 nt, Homo sapiens
caagaugauaaaccuuuga

SEQ ID NO: 1222283 - RNA, 19 nt, Homo sapiens
agaaaagaguccagugauu

SEQ ID NO: 1222284 - RNA, 19 nt, Homo sapiens
ugaaacagacuccagugau

SEQ ID NO: 1222285 - RNA, 19 nt, Homo sapiens
gggagcuccugaaguaugg

SEQ ID NO: 1222286 - RNA, 19 nt, Homo sapiens
ccaagguuuccucagauuu

SEQ ID NO: 1222287 - RNA, 19 nt, Homo sapiens
gguuauguaaugaguggua

SEQ ID NO: 1222288 - RNA, 19 nt, Homo sapiens
gaaugcucagguuauguaa

SEQ ID NO: 1222289 - RNA, 19 nt, Homo sapiens
agacuccagugaugaagau

SEQ ID NO: 1222290 - RNA, 19 nt, Homo sapiens
gcagaaaagaguccaguga

SEQ ID NO: 1222291 - RNA, 19 nt, Homo sapiens
aagaaacacagaucgaaga

SEQ ID NO: 1222292 - RNA, 19 nt, Homo sapiens
gaggaugaagagccaaaga

SEQ ID NO: 1222293 - RNA, 19 nt, Homo sapiens
ggggaaggguuuugcagaa

SEQ ID NO: 1222294 - RNA, 19 nt, Homo sapiens
ccucagauuugggcuguuc

SEQ ID NO: 1222295 - RNA, 19 nt, Homo sapiens
guccaagguuuccucagau

SEQ ID NO: 1222296 - RNA, 19 nt, Homo sapiens
gaaaugggauguaacagua

SEQ ID NO: 1222297 - RNA, 19 nt, Homo sapiens
ugacauaacugcccuuaaa

SEQ ID NO: 1222298 - RNA, 19 nt, Homo sapiens
gaaaagaucuacuuggaua

SEQ ID NO: 1222299 - RNA, 19 nt, Homo sapiens
gaacaacuaucuuacaaag

SEQ ID NO: 1222300 - RNA, 19 nt, Homo sapiens
gcaaagaaaccacgaauug

SEQ ID NO: 1222301 - RNA, 19 nt, Homo sapiens
caaacgagcugcagaugaa

SEQ ID NO: 1222302 - RNA, 19 nt, Homo sapiens
gcuaccaccucuuuaauaa

SEQ ID NO: 1222303 - RNA, 19 nt, Homo sapiens
ugaagaaggucacagauug

SEQ ID NO: 1222304 - RNA, 19 nt, Homo sapiens
cagaagcgcucccuuagaa

SEQ ID NO: 1222305 - RNA, 19 nt, Homo sapiens
gcaaagggaugugacuauu

SEQ ID NO: 1222306 - RNA, 19 nt, Homo sapiens
gaacucagcuaucacaaac

SEQ ID NO: 1222307 - RNA, 19 nt, Homo sapiens
gaucuacuaucaagacuga

SEQ ID NO: 1222308 - RNA, 19 nt, Homo sapiens
gagauuggcugcccguuug

SEQ ID NO: 1222309 - RNA, 19 nt, Homo sapiens
caggaaagauucaaaggaa

SEQ ID NO: 1222310 - RNA, 19 nt, Homo sapiens
uacaguaccuuauagagua

SEQ ID NO: 1222311 - RNA, 19 nt, Homo sapiens
gacucaagcuuuaugaauu

SEQ ID NO: 1222312 - RNA, 19 nt, Homo sapiens
agacugaucuagaugauga

SEQ ID NO: 1222313 - RNA, 19 nt, Homo sapiens
ggauagaccaguguucuua

SEQ ID NO: 1222314 - RNA, 19 nt, Homo sapiens
gaaaagaucuacuaucaag

SEQ ID NO: 1222315 - RNA, 19 nt, Homo sapiens
guucagaaaugggauguaa

SEQ ID NO: 1222316 - RNA, 19 nt, Homo sapiens
ugaucuagaugaugacaua

SEQ ID NO: 1222317 - RNA, 19 nt, Homo sapiens
uaaccaugcuuaaugcaaa

SEQ ID NO: 1222318 - RNA, 19 nt, Homo sapiens
gaaucagaaugucaacuug

SEQ ID NO: 1222319 - RNA, 19 nt, Homo sapiens
gggaaacauuggacaggua

SEQ ID NO: 1222320 - RNA, 19 nt, Homo sapiens
uaacagauacgaucaggaa

SEQ ID NO: 1222321 - RNA, 19 nt, Homo sapiens
ccaagaaugugaagaccaa

SEQ ID NO: 1222322 - RNA, 19 nt, Homo sapiens
ggauguaacaguauuagaa

SEQ ID NO: 1222323 - RNA, 19 nt, Homo sapiens
gaacagauuaggucuuugu

SEQ ID NO: 1222324 - RNA, 19 nt, Homo sapiens
guacagacugaacagauua

SEQ ID NO: 1222325 - RNA, 19 nt, Homo sapiens
gaagcuaugucaguggaaa

SEQ ID NO: 1222326 - RNA, 19 nt, Homo sapiens
gaagggagacgaagugauc

SEQ ID NO: 1222327 - RNA, 19 nt, Homo sapiens
gaagaaggucacagauuga

SEQ ID NO: 1222328 - RNA, 19 nt, Homo sapiens
uuauuuggcuccuccauuu

SEQ ID NO: 1222329 - RNA, 19 nt, Homo sapiens
gcauaaaucgcacuugaga

SEQ ID NO: 1222330 - RNA, 19 nt, Homo sapiens
gaagauggcggacgugcuu

SEQ ID NO: 1222331 - RNA, 19 nt, Homo sapiens
gcagcuaccaccucuuuaa

SEQ ID NO: 1222332 - RNA, 19 nt, Homo sapiens
agaaggagauuguggugaa

SEQ ID NO: 1222333 - RNA, 19 nt, Homo sapiens
gaccuuauuugaugcuuug

SEQ ID NO: 1222334 - RNA, 19 nt, Homo sapiens
aagcauaaaucgcacuuga

SEQ ID NO: 1222335 - RNA, 19 nt, Homo sapiens
agacagaagcgcucccuua

SEQ ID NO: 1222336 - RNA, 19 nt, Homo sapiens
ggauccaaauguucagaaa

SEQ ID NO: 1222337 - RNA, 19 nt, Homo sapiens
guaugacacugaaaucugu

SEQ ID NO: 1222338 - RNA, 19 nt, Homo sapiens
gauacgaucaggaaagauu

SEQ ID NO: 1222339 - RNA, 19 nt, Homo sapiens
gcaauucuucaaucuguaa

SEQ ID NO: 1222340 - RNA, 19 nt, Homo sapiens
acaacuaucuuacaaagca

SEQ ID NO: 1222341 - RNA, 19 nt, Homo sapiens
caaagaaaccacgaauuga

SEQ ID NO: 1222342 - RNA, 19 nt, Homo sapiens
gacacgaacaacuaucuua

SEQ ID NO: 1222343 - RNA, 19 nt, Homo sapiens
gaugugacccgagauauug

SEQ ID NO: 1222344 - RNA, 19 nt, Homo sapiens
caaagggaugugacuauuu

SEQ ID NO: 1222345 - RNA, 19 nt, Homo sapiens
gcauggcaguucaaagguu

SEQ ID NO: 1222346 - RNA, 19 nt, Homo sapiens
gcaaucaaagccaaaauua

SEQ ID NO: 1222347 - RNA, 19 nt, Homo sapiens
gcaccuuucucauccuguu

SEQ ID NO: 1222348 - RNA, 19 nt, Homo sapiens
ugaaauuugucccaucaga

SEQ ID NO: 1222349 - RNA, 19 nt, Homo sapiens
gcgaucuacucaagucaaa

SEQ ID NO: 1222350 - RNA, 19 nt, Homo sapiens
gaaaauauuccugugguua

SEQ ID NO: 1222351 - RNA, 19 nt, Homo sapiens
cagauacgaucaggaaaga

SEQ ID NO: 1222352 - RNA, 19 nt, Homo sapiens
uagaagaccugaucgaaaa

SEQ ID NO: 1222353 - RNA, 19 nt, Homo sapiens
gaaugaaucagaaugucaa

SEQ ID NO: 1222354 - RNA, 19 nt, Homo sapiens
gguacaugguaaagcauaa

SEQ ID NO: 1222355 - RNA, 19 nt, Homo sapiens
uauuagaacucagcuauca

SEQ ID NO: 1222356 - RNA, 19 nt, Homo sapiens
gaaguaugaugaaguucgu

SEQ ID NO: 1222357 - RNA, 19 nt, Homo sapiens
gcaauuaguguuacaguac

SEQ ID NO: 1222358 - RNA, 19 nt, Homo sapiens
cuacuuggauaucucaaug

SEQ ID NO: 1222359 - RNA, 19 nt, Homo sapiens
caaagcacaggaaagaauu

SEQ ID NO: 1222360 - RNA, 19 nt, Homo sapiens
guagaugugacccgagaua

SEQ ID NO: 1222361 - RNA, 19 nt, Homo sapiens
cugaacagauuaggucuuu

SEQ ID NO: 1222362 - RNA, 19 nt, Homo sapiens
gaagcgcucccuuagaaau

SEQ ID NO: 1222363 - RNA, 19 nt, Homo sapiens
gauauugucagcagagaga

SEQ ID NO: 1222364 - RNA, 19 nt, Homo sapiens
gauuaggucuuugucugaa

SEQ ID NO: 1222365 - RNA, 19 nt, Homo sapiens
gaaugucaacuuguaugua

SEQ ID NO: 1222366 - RNA, 19 nt, Homo sapiens
auuaaagccuuccaucuga

SEQ ID NO: 1222367 - RNA, 19 nt, Homo sapiens
uuacaaagcacaggaaaga

SEQ ID NO: 1222368 - RNA, 19 nt, Homo sapiens
ccagagaguacuacacauu

SEQ ID NO: 1222369 - RNA, 19 nt, Homo sapiens
uuaauaacgugcaccuuuc

SEQ ID NO: 1222370 - RNA, 19 nt, Homo sapiens
ucugaaguaugaugaaguu

SEQ ID NO: 1222371 - RNA, 19 nt, Homo sapiens
uaauaaccaugcuuaaugc

SEQ ID NO: 1222372 - RNA, 19 nt, Homo sapiens
caagacugaucuagaugau

SEQ ID NO: 1222373 - RNA, 19 nt, Homo sapiens
aaccuagaaugauguguuu

SEQ ID NO: 1222374 - RNA, 19 nt, Homo sapiens
cuucuagucuguaauggaa

SEQ ID NO: 1222375 - RNA, 19 nt, Homo sapiens
gaccagccccuuaaacuua

SEQ ID NO: 1222376 - RNA, 19 nt, Homo sapiens
aaagggaugugacuauuuu

SEQ ID NO: 1222377 - RNA, 19 nt, Homo sapiens
guaacaguauuagaacuca

SEQ ID NO: 1222378 - RNA, 19 nt, Homo sapiens
gaaauuugucccaucagau

SEQ ID NO: 1222379 - RNA, 19 nt, Homo sapiens
uguacagacugaacagauu

SEQ ID NO: 1222380 - RNA, 19 nt, Homo sapiens
acgaacaacuaucuuacaa

SEQ ID NO: 1222381 - RNA, 19 nt, Homo sapiens
cuuaauaacgugcaccuuu

SEQ ID NO: 1222382 - RNA, 19 nt, Homo sapiens
aauauuagccuucuagucu

SEQ ID NO: 1222383 - RNA, 19 nt, Homo sapiens
ccugaaauuugucccauca

SEQ ID NO: 1222384 - RNA, 19 nt, Homo sapiens
caacaucggcaaguauaga

SEQ ID NO: 1222385 - RNA, 19 nt, Homo sapiens
uuugaaaccuagaaugaug

SEQ ID NO: 1222386 - RNA, 19 nt, Homo sapiens
ucugagccaucuucugauu

SEQ ID NO: 1222387 - RNA, 19 nt, Homo sapiens
ucucugagccaucuucuga

SEQ ID NO: 1222388 - RNA, 19 nt, Homo sapiens
acagguacaugguaaagca

SEQ ID NO: 1222389 - RNA, 19 nt, Homo sapiens
ggaggacacgaacaacuau

SEQ ID NO: 1222390 - RNA, 19 nt, Homo sapiens
gaugacauaacugcccuua

SEQ ID NO: 1222391 - RNA, 19 nt, Homo sapiens
ugucauccauauaagcaaa

SEQ ID NO: 1222392 - RNA, 19 nt, Homo sapiens
gagauauugucagcagaga

SEQ ID NO: 1222393 - RNA, 19 nt, Homo sapiens
ugaaucagaaugucaacuu

SEQ ID NO: 1222394 - RNA, 19 nt, Homo sapiens
ugauaccugucauccauau

SEQ ID NO: 1222395 - RNA, 19 nt, Homo sapiens
aguacaacauccagaagaa

SEQ ID NO: 1222396 - RNA, 19 nt, Homo sapiens
gaagugaccuguacaagug

SEQ ID NO: 1222397 - RNA, 19 nt, Homo sapiens
guaaucaucucaaguggua

SEQ ID NO: 1222398 - RNA, 19 nt, Homo sapiens
gcuguucccucgcauguua

SEQ ID NO: 1222399 - RNA, 19 nt, Homo sapiens
gaacagccguaugcuuaaa

SEQ ID NO: 1222400 - RNA, 19 nt, Homo sapiens
gaucaagugcuuucucuuu

SEQ ID NO: 1222401 - RNA, 19 nt, Homo sapiens
gaagacagggugugaguga

SEQ ID NO: 1222402 - RNA, 19 nt, Homo sapiens
ggacaaagugcaauacaga

SEQ ID NO: 1222403 - RNA, 19 nt, Homo sapiens
aaaggaggguuucaaagaa

SEQ ID NO: 1222404 - RNA, 19 nt, Homo sapiens
uggaacagccguaugcuua

SEQ ID NO: 1222405 - RNA, 19 nt, Homo sapiens
agaaagcagugacacauuc

SEQ ID NO: 1222406 - RNA, 19 nt, Homo sapiens
gguugucuguugaaucuuu

SEQ ID NO: 1222407 - RNA, 19 nt, Homo sapiens
cuaagaagauugggcaguu

SEQ ID NO: 1222408 - RNA, 19 nt, Homo sapiens
ggaagugaccuguacaagu

SEQ ID NO: 1222409 - RNA, 19 nt, Homo sapiens
caggaagcaugccaacaaa

SEQ ID NO: 1222410 - RNA, 19 nt, Homo sapiens
uggguggucugaauauuaa

SEQ ID NO: 1222411 - RNA, 19 nt, Homo sapiens
uuaaagcucuucauuucug

SEQ ID NO: 1222412 - RNA, 19 nt, Homo sapiens
ggaacagccguaugcuuaa

SEQ ID NO: 1222413 - RNA, 19 nt, Homo sapiens
gagaaagcagugacacauu

SEQ ID NO: 1222414 - RNA, 19 nt, Homo sapiens
gcagaaugagccaggagua

SEQ ID NO: 1222415 - RNA, 19 nt, Homo sapiens
caucucaagugguauuugu

SEQ ID NO: 1222416 - RNA, 19 nt, Homo sapiens
acaguauccucguuugaaa

SEQ ID NO: 1222417 - RNA, 19 nt, Homo sapiens
ccaggaagcaugccaacaa

SEQ ID NO: 1222418 - RNA, 19 nt, Homo sapiens
ggacuggaagugaccugua

SEQ ID NO: 1222419 - RNA, 19 nt, Homo sapiens
uaagaagauugggcaguug

SEQ ID NO: 1222420 - RNA, 19 nt, Homo sapiens
ccuaugagccacacauuau

SEQ ID NO: 1222421 - RNA, 19 nt, Homo sapiens
uagggcgucuccuguaauu

SEQ ID NO: 1222422 - RNA, 19 nt, Homo sapiens
gaaagcagugacacauuca

SEQ ID NO: 1222423 - RNA, 19 nt, Homo sapiens
aauccaagcagcagaauga

SEQ ID NO: 1222424 - RNA, 19 nt, Homo sapiens
ggagaaagcagugacacau

SEQ ID NO: 1222425 - RNA, 19 nt, Homo sapiens
ucaagugcuuucucuuuua

SEQ ID NO: 1222426 - RNA, 19 nt, Homo sapiens
gaguagggcgucuccugua

SEQ ID NO: 1222427 - RNA, 19 nt, Homo sapiens
ggucacaguauccucguuu

SEQ ID NO: 1222428 - RNA, 19 nt, Homo sapiens
gagauaggauguuuugcuu

SEQ ID NO: 1222429 - RNA, 19 nt, Homo sapiens
cuaauuaccaggccaggaa

SEQ ID NO: 1222430 - RNA, 19 nt, Homo sapiens
gggcugacuuguccagaag

SEQ ID NO: 1222431 - RNA, 19 nt, Homo sapiens
gcagggccuugacaggaau

SEQ ID NO: 1222432 - RNA, 19 nt, Homo sapiens
gaacggcuuggccagaaga

SEQ ID NO: 1222433 - RNA, 19 nt, Homo sapiens
guuucuggcuugagaugaa

SEQ ID NO: 1222434 - RNA, 19 nt, Homo sapiens
gcucuucauuucuggagau

SEQ ID NO: 1222435 - RNA, 19 nt, Homo sapiens
gccaaacgccuaauuacca

SEQ ID NO: 1222436 - RNA, 19 nt, Homo sapiens
caggagaugggcaaagaaa

SEQ ID NO: 1222437 - RNA, 19 nt, Homo sapiens
caucuggguggucugaaua

SEQ ID NO: 1222438 - RNA, 19 nt, Homo sapiens
aguagggcgucuccuguaa

SEQ ID NO: 1222439 - RNA, 19 nt, Homo sapiens
gggacaaagugcaauacag

SEQ ID NO: 1222440 - RNA, 19 nt, Homo sapiens
cugcaucccuuggcuguga

SEQ ID NO: 1222441 - RNA, 19 nt, Homo sapiens
gaaugagccaggaguagca

SEQ ID NO: 1222442 - RNA, 19 nt, Homo sapiens
guacaagugaugcagaaag

SEQ ID NO: 1222443 - RNA, 19 nt, Homo sapiens
ggaacggcuuggccagaag

SEQ ID NO: 1222444 - RNA, 19 nt, Homo sapiens
uauggcuccugcugaguuu

SEQ ID NO: 1222445 - RNA, 19 nt, Homo sapiens
cuggguggucugaauauua

SEQ ID NO: 1222446 - RNA, 19 nt, Homo sapiens
ccagucaucaucuccagaa

SEQ ID NO: 1222447 - RNA, 19 nt, Homo sapiens
cuaugagccacacauuaua

SEQ ID NO: 1222448 - RNA, 19 nt, Homo sapiens
ggaagcaugccaacaaagc

SEQ ID NO: 1222449 - RNA, 19 nt, Homo sapiens
gcaggagaugggcaaagaa

SEQ ID NO: 1222450 - RNA, 19 nt, Homo sapiens
gccguaugcuuaaaguaca

SEQ ID NO: 1222451 - RNA, 19 nt, Homo sapiens
guauggcuccugcugaguu

SEQ ID NO: 1222452 - RNA, 19 nt, Homo sapiens
gggcgucuccuguaauuac

SEQ ID NO: 1222453 - RNA, 19 nt, Homo sapiens
gacuggaagugaccuguac

SEQ ID NO: 1222454 - RNA, 19 nt, Homo sapiens
ggccuuuccugcccucugu

SEQ ID NO: 1222455 - RNA, 19 nt, Homo sapiens
gggcacagguuggguuugc

SEQ ID NO: 1222456 - RNA, 19 nt, Homo sapiens
gcucuagaggucacaguau

SEQ ID NO: 1222457 - RNA, 19 nt, Homo sapiens
gucaucaucuccagaacuc

SEQ ID NO: 1222458 - RNA, 19 nt, Homo sapiens
uacaagugaugcagaaagg

SEQ ID NO: 1222459 - RNA, 19 nt, Homo sapiens
cacaguauccucguuugaa

SEQ ID NO: 1222460 - RNA, 19 nt, Homo sapiens
ucacaguauccucguuuga

SEQ ID NO: 1222461 - RNA, 19 nt, Homo sapiens
gacaggaauccagggagua

SEQ ID NO: 1222462 - RNA, 19 nt, Homo sapiens
cugguugucuguugaaucu

SEQ ID NO: 1222463 - RNA, 19 nt, Homo sapiens
agugggagcuauuuucuuu

SEQ ID NO: 1222464 - RNA, 19 nt, Homo sapiens
ucaucuggguggucugaau

SEQ ID NO: 1222465 - RNA, 19 nt, Homo sapiens
uaauuacugccuugccauu

SEQ ID NO: 1222466 - RNA, 19 nt, Homo sapiens
agcaggagaugggcaaaga

SEQ ID NO: 1222467 - RNA, 19 nt, Homo sapiens
aggaacggcuuggccagaa

SEQ ID NO: 1222468 - RNA, 19 nt, Homo sapiens
agauugggcaguuggguuu

SEQ ID NO: 1222469 - RNA, 19 nt, Homo sapiens
ggcagcagguggcucuucu

SEQ ID NO: 1222470 - RNA, 19 nt, Homo sapiens
gacccuuccugcccaccuu

SEQ ID NO: 1222471 - RNA, 19 nt, Homo sapiens
gaguagcuccuggccagaa

SEQ ID NO: 1222472 - RNA, 19 nt, Homo sapiens
cagaagacagggugugagu

SEQ ID NO: 1222473 - RNA, 19 nt, Homo sapiens
gagacggcuucuggaggaa

SEQ ID NO: 1222474 - RNA, 19 nt, Homo sapiens
ggcuugugcucugcaaaga

SEQ ID NO: 1222475 - RNA, 19 nt, Homo sapiens
cccuaugagccacacauua

SEQ ID NO: 1222476 - RNA, 19 nt, Homo sapiens
aaucaucucaagugguauu

SEQ ID NO: 1222477 - RNA, 19 nt, Homo sapiens
agacagggugugagugaga

SEQ ID NO: 1222478 - RNA, 19 nt, Homo sapiens
gaauccaagcagcagaaug

SEQ ID NO: 1222479 - RNA, 19 nt, Homo sapiens
gaugcagaaaggaggguuu

SEQ ID NO: 1222480 - RNA, 19 nt, Homo sapiens
gucacaguauccucguuug

SEQ ID NO: 1222481 - RNA, 19 nt, Homo sapiens
uggaucaagugcuuucucu

SEQ ID NO: 1222482 - RNA, 19 nt, Homo sapiens
gccagaagacaggguguga

SEQ ID NO: 1222483 - RNA, 19 nt, Homo sapiens
cuguacaagugaugcagaa

SEQ ID NO: 1222484 - RNA, 19 nt, Homo sapiens
agcagggccuugacaggaa

SEQ ID NO: 1222485 - RNA, 19 nt, Homo sapiens
gaguggaacagccguaugc

SEQ ID NO: 1222486 - RNA, 19 nt, Homo sapiens
gcucggcgcuguugcuaug

SEQ ID NO: 1222487 - RNA, 19 nt, Homo sapiens
acaugugguuugcguaaua

SEQ ID NO: 1222488 - RNA, 19 nt, Homo sapiens
cagcaucuaucacguguuc

SEQ ID NO: 1222489 - RNA, 19 nt, Homo sapiens
ccaacgcgcugaccaaugg

SEQ ID NO: 1222490 - RNA, 19 nt, Homo sapiens
ccugccaccucgcuucuua

SEQ ID NO: 1222491 - RNA, 19 nt, Homo sapiens
guacacucguggacaccua

SEQ ID NO: 1222492 - RNA, 19 nt, Homo sapiens
gcaggacaguugcauucug

SEQ ID NO: 1222493 - RNA, 19 nt, Homo sapiens
agaacuggcugugaccuuu

SEQ ID NO: 1222494 - RNA, 19 nt, Homo sapiens
caugugguuugcguaauaa

SEQ ID NO: 1222495 - RNA, 19 nt, Homo sapiens
ucacuuuccugcccuucuu

SEQ ID NO: 1222496 - RNA, 19 nt, Homo sapiens
gaacuggcugugaccuuug

SEQ ID NO: 1222497 - RNA, 19 nt, Homo sapiens
cuacaugugguuugcguaa

SEQ ID NO: 1222498 - RNA, 19 nt, Homo sapiens
ggaccuacaugugguuugc

SEQ ID NO: 1222499 - RNA, 19 nt, Homo sapiens
ccaccugacgcuagaagaa

SEQ ID NO: 1222500 - RNA, 19 nt, Homo sapiens
uaccugugguggucaaaga

SEQ ID NO: 1222501 - RNA, 19 nt, Homo sapiens
acaccugucuuucccucaa

SEQ ID NO: 1222502 - RNA, 19 nt, Homo sapiens
uaaggccuaucagcuucua

SEQ ID NO: 1222503 - RNA, 19 nt, Homo sapiens
ucuuagcacuggccuuugu

SEQ ID NO: 1222504 - RNA, 19 nt, Homo sapiens
gcauucuguggccuucuua

SEQ ID NO: 1222505 - RNA, 19 nt, Homo sapiens
uuacgucucugugcuugug

SEQ ID NO: 1222506 - RNA, 19 nt, Homo sapiens
ucgacuuccuugagcguuu

SEQ ID NO: 1222507 - RNA, 19 nt, Homo sapiens
cagaggaagagguggaaga

SEQ ID NO: 1222508 - RNA, 19 nt, Homo sapiens
gugccucgaaugucacuuu

SEQ ID NO: 1222509 - RNA, 19 nt, Homo sapiens
ccuuugcccugaccuggaa

SEQ ID NO: 1222510 - RNA, 19 nt, Homo sapiens
ggaaaagaacuggcuguga

SEQ ID NO: 1222511 - RNA, 19 nt, Homo sapiens
gagccugggaccuacaugu

SEQ ID NO: 1222512 - RNA, 19 nt, Homo sapiens
ugucgugggugcugugucu

SEQ ID NO: 1222513 - RNA, 19 nt, Homo sapiens
ccaccaacgcgcugaccaa

SEQ ID NO: 1222514 - RNA, 19 nt, Homo sapiens
cuucuuagcacuggccuuu

SEQ ID NO: 1222515 - RNA, 19 nt, Homo sapiens
ggacaccuacacacuccau

SEQ ID NO: 1222516 - RNA, 19 nt, Homo sapiens
gcaaagaacugguuaaaug

SEQ ID NO: 1222517 - RNA, 19 nt, Homo sapiens
ggaaagagacaaaguaguu

SEQ ID NO: 1222518 - RNA, 19 nt, Homo sapiens
ugacaaagcuagagaagau

SEQ ID NO: 1222519 - RNA, 19 nt, Homo sapiens
gaaguuacauuaugcaucu

SEQ ID NO: 1222520 - RNA, 19 nt, Homo sapiens
aaacaguucuuccuucaaa

SEQ ID NO: 1222521 - RNA, 19 nt, Homo sapiens
gaagaugacuaugaauaug

SEQ ID NO: 1222522 - RNA, 19 nt, Homo sapiens
gcaaugaggugaauuuuga

SEQ ID NO: 1222523 - RNA, 19 nt, Homo sapiens
ggaaugaccagaacucuug

SEQ ID NO: 1222524 - RNA, 19 nt, Homo sapiens
ugcaguaccugaaguaaua

SEQ ID NO: 1222525 - RNA, 19 nt, Homo sapiens
ccaauuguguccaucgaua

SEQ ID NO: 1222526 - RNA, 19 nt, Homo sapiens
caaaguaguugggcagauu

SEQ ID NO: 1222527 - RNA, 19 nt, Homo sapiens
gcucauacuguuacuaaua

SEQ ID NO: 1222528 - RNA, 19 nt, Homo sapiens
caagaaacauugaagaaac

SEQ ID NO: 1222529 - RNA, 19 nt, Homo sapiens
caaacaagcagcugacaaa

SEQ ID NO: 1222530 - RNA, 19 nt, Homo sapiens
gaaaggcaauacaaaggau

SEQ ID NO: 1222531 - RNA, 19 nt, Homo sapiens
ucagaaaggucuucgugaa

SEQ ID NO: 1222532 - RNA, 19 nt, Homo sapiens
agaaagauuugaagcacua

SEQ ID NO: 1222533 - RNA, 19 nt, Homo sapiens
gaaagaugcagauguacuu

SEQ ID NO: 1222534 - RNA, 19 nt, Homo sapiens
gaacaggucaccauaacug

SEQ ID NO: 1222535 - RNA, 19 nt, Homo sapiens
gcaaguggcaaugguguua

SEQ ID NO: 1222536 - RNA, 19 nt, Homo sapiens
ugagaaacaccacacuuua

SEQ ID NO: 1222537 - RNA, 19 nt, Homo sapiens
ccagaacucuugauugcuu

SEQ ID NO: 1222538 - RNA, 19 nt, Homo sapiens
gaccagaacucuugauugc

SEQ ID NO: 1222539 - RNA, 19 nt, Homo sapiens
ucacaugcauucuaucaau

SEQ ID NO: 1222540 - RNA, 19 nt, Homo sapiens
gaaaaugccuccuguaguc

SEQ ID NO: 1222541 - RNA, 19 nt, Homo sapiens
ccaauacucuucucacaag

SEQ ID NO: 1222542 - RNA, 19 nt, Homo sapiens
agugaaagaugcagaugua

SEQ ID NO: 1222543 - RNA, 19 nt, Homo sapiens
uagagaagauuugcugaaa

SEQ ID NO: 1222544 - RNA, 19 nt, Homo sapiens
cggaagcuguuaccaauug

SEQ ID NO: 1222545 - RNA, 19 nt, Homo sapiens
ugacugaacuuagaacugu

SEQ ID NO: 1222546 - RNA, 19 nt, Homo sapiens
uuacaaagcugugggacuu

SEQ ID NO: 1222547 - RNA, 19 nt, Homo sapiens
cuauaaggguguuacauga

SEQ ID NO: 1222548 - RNA, 19 nt, Homo sapiens
caagaacaggcuacagaua

SEQ ID NO: 1222549 - RNA, 19 nt, Homo sapiens
caccauaacugaagcaucu

SEQ ID NO: 1222550 - RNA, 19 nt, Homo sapiens
gcaaagaggacauaguuac

SEQ ID NO: 1222551 - RNA, 19 nt, Homo sapiens
caauucagauggcccaaga

SEQ ID NO: 1222552 - RNA, 19 nt, Homo sapiens
gaaaacaguucuuccuuca

SEQ ID NO: 1222553 - RNA, 19 nt, Homo sapiens
uaccaugguccucaaauua

SEQ ID NO: 1222554 - RNA, 19 nt, Homo sapiens
gaaaggagugacugaacuu

SEQ ID NO: 1222555 - RNA, 19 nt, Homo sapiens
gcagauguacuuuguaugg

SEQ ID NO: 1222556 - RNA, 19 nt, Homo sapiens
caagaacagguauauguga

SEQ ID NO: 1222557 - RNA, 19 nt, Homo sapiens
gauaccagaugacaauuuu

SEQ ID NO: 1222558 - RNA, 19 nt, Homo sapiens
gaaagagacaaaguaguug

SEQ ID NO: 1222559 - RNA, 19 nt, Homo sapiens
gaagagauaccagaugaca

SEQ ID NO: 1222560 - RNA, 19 nt, Homo sapiens
caaagaacugguuaaaugu

SEQ ID NO: 1222561 - RNA, 19 nt, Homo sapiens
gcaagaacagguauaugug

SEQ ID NO: 1222562 - RNA, 19 nt, Homo sapiens
gcaauacaaaggauucaga

SEQ ID NO: 1222563 - RNA, 19 nt, Homo sapiens
ggguugaaguuacauuaug

SEQ ID NO: 1222564 - RNA, 19 nt, Homo sapiens
ggcuacagauacugaaauu

SEQ ID NO: 1222565 - RNA, 19 nt, Homo sapiens
ccaugguccucaaauuaaa

SEQ ID NO: 1222566 - RNA, 19 nt, Homo sapiens
acacuuuacugaaggagaa

SEQ ID NO: 1222567 - RNA, 19 nt, Homo sapiens
aaacaugcuuuggacauau

SEQ ID NO: 1222568 - RNA, 19 nt, Homo sapiens
uaaaugugccagcagguaa

SEQ ID NO: 1222569 - RNA, 19 nt, Homo sapiens
ggauguuaauagugaaaga

SEQ ID NO: 1222570 - RNA, 19 nt, Homo sapiens
ccacaaagacauccuaguc

SEQ ID NO: 1222571 - RNA, 19 nt, Homo sapiens
gaugaaaggcaauacaaag

SEQ ID NO: 1222572 - RNA, 19 nt, Homo sapiens
cagaagguccuacucagaa

SEQ ID NO: 1222573 - RNA, 19 nt, Homo sapiens
gaacgugauuuucaucgaa

SEQ ID NO: 1222574 - RNA, 19 nt, Homo sapiens
uauaugggaugcaagaaca

SEQ ID NO: 1222575 - RNA, 19 nt, Homo sapiens
cagaauuucccauagauau

SEQ ID NO: 1222576 - RNA, 19 nt, Homo sapiens
aaacaccacacuuuacuga

SEQ ID NO: 1222577 - RNA, 19 nt, Homo sapiens
augaagagauaccagauga

SEQ ID NO: 1222578 - RNA, 19 nt, Homo sapiens
uaacugaagcaucugaaga

SEQ ID NO: 1222579 - RNA, 19 nt, Homo sapiens
gcgacaaauuggcuacuuc

SEQ ID NO: 1222580 - RNA, 19 nt, Homo sapiens
gugcucauacuguuacuaa

SEQ ID NO: 1222581 - RNA, 19 nt, Homo sapiens
cagcaaagaacugguuaaa

SEQ ID NO: 1222582 - RNA, 19 nt, Homo sapiens
cugaagaugacuaugaaua

SEQ ID NO: 1222583 - RNA, 19 nt, Homo sapiens
cccagaaggugaagaagau

SEQ ID NO: 1222584 - RNA, 19 nt, Homo sapiens
uuaccaugguccucaaauu

SEQ ID NO: 1222585 - RNA, 19 nt, Homo sapiens
gagaaacaccacacuuuac

SEQ ID NO: 1222586 - RNA, 19 nt, Homo sapiens
cacaagcucugcagacaag

SEQ ID NO: 1222587 - RNA, 19 nt, Homo sapiens
gauaugcaaccaaauccaa

SEQ ID NO: 1222588 - RNA, 19 nt, Homo sapiens
agaagguccuacucagaaa

SEQ ID NO: 1222589 - RNA, 19 nt, Homo sapiens
gcaugcaguaccugaagua

SEQ ID NO: 1222590 - RNA, 19 nt, Homo sapiens
aaaagaaaaugcaccagaa

SEQ ID NO: 1222591 - RNA, 19 nt, Homo sapiens
gaugucuacacccagauua

SEQ ID NO: 1222592 - RNA, 19 nt, Homo sapiens
gaagacuuucucugcaauu

SEQ ID NO: 1222593 - RNA, 19 nt, Homo sapiens
ggucacaugcauucuauca

SEQ ID NO: 1222594 - RNA, 19 nt, Homo sapiens
gaaugcaucauaagcgaau

SEQ ID NO: 1222595 - RNA, 19 nt, Homo sapiens
aacaugcuuuggacauaua

SEQ ID NO: 1222596 - RNA, 19 nt, Homo sapiens
uuugggauguuaauaguga

SEQ ID NO: 1222597 - RNA, 19 nt, Homo sapiens
auaaggguguuacaugaga

SEQ ID NO: 1222598 - RNA, 19 nt, Homo sapiens
aggagugacugaacuuaga

SEQ ID NO: 1222599 - RNA, 19 nt, Homo sapiens
uaccugaaguaauagaaga

SEQ ID NO: 1222600 - RNA, 19 nt, Homo sapiens
ggaagcuguuaccaauugu

SEQ ID NO: 1222601 - RNA, 19 nt, Homo sapiens
agagauaccagaugacaau

SEQ ID NO: 1222602 - RNA, 19 nt, Homo sapiens
ugaagaagaucuggcaaaa

SEQ ID NO: 1222603 - RNA, 19 nt, Homo sapiens
caauacaaaggauucagaa

SEQ ID NO: 1222604 - RNA, 19 nt, Homo sapiens
acaccacacuuuacugaag

SEQ ID NO: 1222605 - RNA, 19 nt, Homo sapiens
ggagugacugaacuuagaa

SEQ ID NO: 1222606 - RNA, 19 nt, Homo sapiens
gacuuucucugcaauuucu

SEQ ID NO: 1222607 - RNA, 19 nt, Homo sapiens
cauuuacagucugcuuuaa

SEQ ID NO: 1222608 - RNA, 19 nt, Homo sapiens
ggagauucacaaauugaug

SEQ ID NO: 1222609 - RNA, 19 nt, Homo sapiens
gugaagaagaucuggcaaa

SEQ ID NO: 1222610 - RNA, 19 nt, Homo sapiens
agaugcagauguacuuugu

SEQ ID NO: 1222611 - RNA, 19 nt, Homo sapiens
ugaaaggcaauacaaagga

SEQ ID NO: 1222612 - RNA, 19 nt, Homo sapiens
cugcaaagaggacauaguu

SEQ ID NO: 1222613 - RNA, 19 nt, Homo sapiens
augcugaccuccuuggaaa

SEQ ID NO: 1222614 - RNA, 19 nt, Homo sapiens
gaaacaccacacuuuacug

SEQ ID NO: 1222615 - RNA, 19 nt, Homo sapiens
acaaagcuagagaagauuu

SEQ ID NO: 1222616 - RNA, 19 nt, Homo sapiens
caacugaucuucuugcaaa

SEQ ID NO: 1222617 - RNA, 19 nt, Homo sapiens
ggaaagugcucgacugaga

SEQ ID NO: 1222618 - RNA, 19 nt, Homo sapiens
ggaagcaggucccuacuau

SEQ ID NO: 1222619 - RNA, 19 nt, Homo sapiens
gcaguaagcugagaucaug

SEQ ID NO: 1222620 - RNA, 19 nt, Homo sapiens
guauuucucucuacagaua

SEQ ID NO: 1222621 - RNA, 19 nt, Homo sapiens
gaugauaucccacauuauu

SEQ ID NO: 1222622 - RNA, 19 nt, Homo sapiens
caucacgccuggcuaauuu

SEQ ID NO: 1222623 - RNA, 19 nt, Homo sapiens
guagacaguuugaugauau

SEQ ID NO: 1222624 - RNA, 19 nt, Homo sapiens
uaagugaucuucauaagca

SEQ ID NO: 1222625 - RNA, 19 nt, Homo sapiens
gacaggaguucucuuugaa

SEQ ID NO: 1222626 - RNA, 19 nt, Homo sapiens
gagcaagacucuaucaaaa

SEQ ID NO: 1222627 - RNA, 19 nt, Homo sapiens
uugaugauaucccacauua

SEQ ID NO: 1222628 - RNA, 19 nt, Homo sapiens
gguagacaguuugaugaua

SEQ ID NO: 1222629 - RNA, 19 nt, Homo sapiens
agacaggaguucucuuuga

SEQ ID NO: 1222630 - RNA, 19 nt, Homo sapiens
ggacaguacucugcucuca

SEQ ID NO: 1222631 - RNA, 19 nt, Homo sapiens
agacaucucccauggauuu

SEQ ID NO: 1222632 - RNA, 19 nt, Homo sapiens
uaagaagaccucuggcuuu

SEQ ID NO: 1222633 - RNA, 19 nt, Homo sapiens
guggguagguagacaguuu

SEQ ID NO: 1222634 - RNA, 19 nt, Homo sapiens
ggaguucucuuugaaacau

SEQ ID NO: 1222635 - RNA, 19 nt, Homo sapiens
gaucauaggcuaggaagug

SEQ ID NO: 1222636 - RNA, 19 nt, Homo sapiens
gggcaucgccugacugaga

SEQ ID NO: 1222637 - RNA, 19 nt, Homo sapiens
acagagagauuuaagugau

SEQ ID NO: 1222638 - RNA, 19 nt, Homo sapiens
uaagagguauccugaagca

SEQ ID NO: 1222639 - RNA, 19 nt, Homo sapiens
aaggugcaauccucaguua

SEQ ID NO: 1222640 - RNA, 19 nt, Homo sapiens
gcguugcccuucacuaaga

SEQ ID NO: 1222641 - RNA, 19 nt, Homo sapiens
ccacgguucuccagcaaga

SEQ ID NO: 1222642 - RNA, 19 nt, Homo sapiens
ggcaaggacugcacguuuc

SEQ ID NO: 1222643 - RNA, 19 nt, Homo sapiens
ggugcacucuucauggaaa

SEQ ID NO: 1222644 - RNA, 19 nt, Homo sapiens
uaggguagccggaaucuga

SEQ ID NO: 1222645 - RNA, 19 nt, Homo sapiens
gcagugcaguggcgcaauc

SEQ ID NO: 1222646 - RNA, 19 nt, Homo sapiens
gcagacacgccaagcuuug

SEQ ID NO: 1222647 - RNA, 19 nt, Homo sapiens
uagauagccuguagguaug

SEQ ID NO: 1222648 - RNA, 19 nt, Homo sapiens
auagauagccuguagguau

SEQ ID NO: 1222649 - RNA, 19 nt, Homo sapiens
gugaggaacuggucuucug

SEQ ID NO: 1222650 - RNA, 19 nt, Homo sapiens
ccagugaugacaacaauug

SEQ ID NO: 1222651 - RNA, 19 nt, Homo sapiens
guagguagacaguuugaug

SEQ ID NO: 1222652 - RNA, 19 nt, Homo sapiens
ucacagagagauuuaagug

SEQ ID NO: 1222653 - RNA, 19 nt, Homo sapiens
ggaauuaucccucuuucac

SEQ ID NO: 1222654 - RNA, 19 nt, Homo sapiens
gcaggucccuacuaucaac

SEQ ID NO: 1222655 - RNA, 19 nt, Homo sapiens
gaagaccucuggcuuuccu

SEQ ID NO: 1222656 - RNA, 19 nt, Homo sapiens
gggcgcagggaguaaguua

SEQ ID NO: 1222657 - RNA, 19 nt, Homo sapiens
ucaaggaggugcgcuucuu

SEQ ID NO: 1222658 - RNA, 19 nt, Homo sapiens
ggacugcacguuucuuucu

SEQ ID NO: 1222659 - RNA, 19 nt, Homo sapiens
cauaguauuucucucuaca

SEQ ID NO: 1222660 - RNA, 19 nt, Homo sapiens
agagguauccugaagcaaa

SEQ ID NO: 1222661 - RNA, 19 nt, Homo sapiens
ucuaagagguauccugaag

SEQ ID NO: 1222662 - RNA, 19 nt, Homo sapiens
aagaagaccucuggcuuuc

SEQ ID NO: 1222663 - RNA, 19 nt, Homo sapiens
caggugcacucuucaugga

SEQ ID NO: 1222664 - RNA, 19 nt, Homo sapiens
gccuguagguauguaagua

SEQ ID NO: 1222665 - RNA, 19 nt, Homo sapiens
gauagccuguagguaugua

SEQ ID NO: 1222666 - RNA, 19 nt, Homo sapiens
cagaagcacaccuuguaaa

SEQ ID NO: 1222667 - RNA, 19 nt, Homo sapiens
caccagugaugacaacaau

SEQ ID NO: 1222668 - RNA, 19 nt, Homo sapiens
ggcaucgccugacugagaa

SEQ ID NO: 1222669 - RNA, 19 nt, Homo sapiens
gauucaaccaccuuaagaa

SEQ ID NO: 1222670 - RNA, 19 nt, Homo sapiens
gaauuaucccucuuucaca

SEQ ID NO: 1222671 - RNA, 19 nt, Homo sapiens
aagcaggucccuacuauca

SEQ ID NO: 1222672 - RNA, 19 nt, Homo sapiens
uaguauuucucucuacaga

SEQ ID NO: 1222673 - RNA, 19 nt, Homo sapiens
gaguucucuuugaaacaua

SEQ ID NO: 1222674 - RNA, 19 nt, Homo sapiens
gaaagcucccagugaggaa

SEQ ID NO: 1222675 - RNA, 19 nt, Homo sapiens
gcaagaucauaggcuagga

SEQ ID NO: 1222676 - RNA, 19 nt, Homo sapiens
cagagagauuuaagugauc

SEQ ID NO: 1222677 - RNA, 19 nt, Homo sapiens
gagccagguaccggaauua

SEQ ID NO: 1222678 - RNA, 19 nt, Homo sapiens
ggugcaauccucaguuaug

SEQ ID NO: 1222679 - RNA, 19 nt, Homo sapiens
ucaaccaccuuaagaagac

SEQ ID NO: 1222680 - RNA, 19 nt, Homo sapiens
gacauggacguguuugaug

SEQ ID NO: 1222681 - RNA, 19 nt, Homo sapiens
ggagcugccuucucaucag

SEQ ID NO: 1222682 - RNA, 19 nt, Homo sapiens
ccaccugccuccugcucuu

SEQ ID NO: 1222683 - RNA, 19 nt, Homo sapiens
ugagaacucugggccuuag

SEQ ID NO: 1222684 - RNA, 19 nt, Homo sapiens
gaccugaugcgcucuaucu

SEQ ID NO: 1222685 - RNA, 19 nt, Homo sapiens
acuauauucuggccuaugu

SEQ ID NO: 1222686 - RNA, 19 nt, Homo sapiens
acacacggguaaagugauc

SEQ ID NO: 1222687 - RNA, 19 nt, Homo sapiens
ugagccagguaccggaauu

SEQ ID NO: 1222688 - RNA, 19 nt, Homo sapiens
ccugaugcgcucuaucuuu

SEQ ID NO: 1222689 - RNA, 19 nt, Homo sapiens
gagguauccugaagcaaaa

SEQ ID NO: 1222690 - RNA, 19 nt, Homo sapiens
gugcaauccucaguuaugg

SEQ ID NO: 1222691 - RNA, 19 nt, Homo sapiens
guggcacacuccuguaauc

SEQ ID NO: 1222692 - RNA, 19 nt, Homo sapiens
gagacucuguguggcauag

SEQ ID NO: 1222693 - RNA, 19 nt, Homo sapiens
guggguggguggguaggua

SEQ ID NO: 1222694 - RNA, 19 nt, Homo sapiens
caggaguucucuuugaaac

SEQ ID NO: 1222695 - RNA, 19 nt, Homo sapiens
caagaucauaggcuaggaa

SEQ ID NO: 1222696 - RNA, 19 nt, Homo sapiens
acagaagcacaccuuguaa

SEQ ID NO: 1222697 - RNA, 19 nt, Homo sapiens
gauagauagccuguaggua

SEQ ID NO: 1222698 - RNA, 19 nt, Homo sapiens
caccaucacgccuggcuaa

SEQ ID NO: 1222699 - RNA, 19 nt, Homo sapiens
gaggugggagaaucacuug

SEQ ID NO: 1222700 - RNA, 19 nt, Homo sapiens
ggucaggaguucgaaacca

SEQ ID NO: 1222701 - RNA, 19 nt, Homo sapiens
caucucccauggauuugug

SEQ ID NO: 1222702 - RNA, 19 nt, Homo sapiens
gcaaggacugcacguuucu

SEQ ID NO: 1222703 - RNA, 19 nt, Homo sapiens
cgacauggacguguuugau

SEQ ID NO: 1222704 - RNA, 19 nt, Homo sapiens
uaaaagggucucucuaaga

SEQ ID NO: 1222705 - RNA, 19 nt, Homo sapiens
ggcagacacgccaagcuuu

SEQ ID NO: 1222706 - RNA, 19 nt, Homo sapiens
uagguagacaguuugauga

SEQ ID NO: 1222707 - RNA, 19 nt, Homo sapiens
cuucauaagcaagaucaua

SEQ ID NO: 1222708 - RNA, 19 nt, Homo sapiens
ggugggagaaucacuugga

SEQ ID NO: 1222709 - RNA, 19 nt, Homo sapiens
aggcaaggacugcacguuu

SEQ ID NO: 1222710 - RNA, 19 nt, Homo sapiens
cauacuucgucuaggaaug

SEQ ID NO: 1222711 - RNA, 19 nt, Homo sapiens
cguguuugaugccuacaug

SEQ ID NO: 1222712 - RNA, 19 nt, Homo sapiens
uaauacagaagcacaccuu

SEQ ID NO: 1222713 - RNA, 19 nt, Homo sapiens
ugauucaaccaccuuaaga

SEQ ID NO: 1222714 - RNA, 19 nt, Homo sapiens
cugaugcgcucuaucuuuu

SEQ ID NO: 1222715 - RNA, 19 nt, Homo sapiens
ucccauggauuugugauca

SEQ ID NO: 1222716 - RNA, 19 nt, Homo sapiens
gaacaacucuggccucuuu

SEQ ID NO: 1222717 - RNA, 19 nt, Homo sapiens
gagaauaucugaacaaaca

SEQ ID NO: 1222718 - RNA, 19 nt, Homo sapiens
ccauaaagcugaucuguaa

SEQ ID NO: 1222719 - RNA, 19 nt, Homo sapiens
ccagauaccucaccuuaaa

SEQ ID NO: 1222720 - RNA, 19 nt, Homo sapiens
caaggacaauucaacaaua

SEQ ID NO: 1222721 - RNA, 19 nt, Homo sapiens
cagcauaacuaaugacaaa

SEQ ID NO: 1222722 - RNA, 19 nt, Homo sapiens
gaacaacccgaacuaguuu

SEQ ID NO: 1222723 - RNA, 19 nt, Homo sapiens
gcuaaacuuugaugaguaa

SEQ ID NO: 1222724 - RNA, 19 nt, Homo sapiens
gaacgaugaugaugauaca

SEQ ID NO: 1222725 - RNA, 19 nt, Homo sapiens
guagacagcuuuacucagu

SEQ ID NO: 1222726 - RNA, 19 nt, Homo sapiens
uaacaacccaucaauauga

SEQ ID NO: 1222727 - RNA, 19 nt, Homo sapiens
cggaagaaauaaagucuaa

SEQ ID NO: 1222728 - RNA, 19 nt, Homo sapiens
gaaaggaucaugucuugga

SEQ ID NO: 1222729 - RNA, 19 nt, Homo sapiens
gcacaccaaucaaaaguua

SEQ ID NO: 1222730 - RNA, 19 nt, Homo sapiens
gaucaugucuuggauauac

SEQ ID NO: 1222731 - RNA, 19 nt, Homo sapiens
gaagcuagauugagaucau

SEQ ID NO: 1222732 - RNA, 19 nt, Homo sapiens
gcacaaaccggaccuggaa

SEQ ID NO: 1222733 - RNA, 19 nt, Homo sapiens
guucuugcaugcauauaua

SEQ ID NO: 1222734 - RNA, 19 nt, Homo sapiens
ccaacuagcugaaacaucu

SEQ ID NO: 1222735 - RNA, 19 nt, Homo sapiens
aaucugaccuugucuguga

SEQ ID NO: 1222736 - RNA, 19 nt, Homo sapiens
cauggaagcucaaggucua

SEQ ID NO: 1222737 - RNA, 19 nt, Homo sapiens
gcugaucuguaaacccuua

SEQ ID NO: 1222738 - RNA, 19 nt, Homo sapiens
gacaauggauguaugaaag

SEQ ID NO: 1222739 - RNA, 19 nt, Homo sapiens
ugagauccuucauucauaa

SEQ ID NO: 1222740 - RNA, 19 nt, Homo sapiens
ccgagaaccugaagaaugu

SEQ ID NO: 1222741 - RNA, 19 nt, Homo sapiens
ccgaaaggaucaugucuug

SEQ ID NO: 1222742 - RNA, 19 nt, Homo sapiens
acaaaggguuuccaccuaa

SEQ ID NO: 1222743 - RNA, 19 nt, Homo sapiens
caacuaacccuuacugcuu

SEQ ID NO: 1222744 - RNA, 19 nt, Homo sapiens
gaucgaaauucuggauuga

SEQ ID NO: 1222745 - RNA, 19 nt, Homo sapiens
ggacaauggauguaugaaa

SEQ ID NO: 1222746 - RNA, 19 nt, Homo sapiens
ggacuuggguaucuuguac

SEQ ID NO: 1222747 - RNA, 19 nt, Homo sapiens
ccugaagaauguaccguua

SEQ ID NO: 1222748 - RNA, 19 nt, Homo sapiens
acaggaagcuagauugaga

SEQ ID NO: 1222749 - RNA, 19 nt, Homo sapiens
caaaggguuuccaccuaaa

SEQ ID NO: 1222750 - RNA, 19 nt, Homo sapiens
gcaaugaagggacuaacaa

SEQ ID NO: 1222751 - RNA, 19 nt, Homo sapiens
uaccuucccucaccagaua

SEQ ID NO: 1222752 - RNA, 19 nt, Homo sapiens
ccaaaggccuucuguacca

SEQ ID NO: 1222753 - RNA, 19 nt, Homo sapiens
acaaauggguagaucgaaa

SEQ ID NO: 1222754 - RNA, 19 nt, Homo sapiens
gggaacuuaugauuuagaa

SEQ ID NO: 1222755 - RNA, 19 nt, Homo sapiens
cuuaaaugcuagccaaauu

SEQ ID NO: 1222756 - RNA, 19 nt, Homo sapiens
aagcaggucuuaccgagaa

SEQ ID NO: 1222757 - RNA, 19 nt, Homo sapiens
caccagauaccucaccuua

SEQ ID NO: 1222758 - RNA, 19 nt, Homo sapiens
uacaaaggguuuccaccua

SEQ ID NO: 1222759 - RNA, 19 nt, Homo sapiens
gcucacagguuccaaucug

SEQ ID NO: 1222760 - RNA, 19 nt, Homo sapiens
ggacuaacaacccaucaau

SEQ ID NO: 1222761 - RNA, 19 nt, Homo sapiens
uuacaaaccugagauccuu

SEQ ID NO: 1222762 - RNA, 19 nt, Homo sapiens
uagacaauguuccugguuu

SEQ ID NO: 1222763 - RNA, 19 nt, Homo sapiens
aagcagaaguacagaauca

SEQ ID NO: 1222764 - RNA, 19 nt, Homo sapiens
uaaauggucugggcgaugu

SEQ ID NO: 1222765 - RNA, 19 nt, Homo sapiens
caugucaaguuucaaauag

SEQ ID NO: 1222766 - RNA, 19 nt, Homo sapiens
gaauguaccguuacuugau

SEQ ID NO: 1222767 - RNA, 19 nt, Homo sapiens
uaccucaccuuaaaugcua

SEQ ID NO: 1222768 - RNA, 19 nt, Homo sapiens
ccacuaagcagaccuugga

SEQ ID NO: 1222769 - RNA, 19 nt, Homo sapiens
cugagauccuucauucaua

SEQ ID NO: 1222770 - RNA, 19 nt, Homo sapiens
ggcuauggguuaccucaaa

SEQ ID NO: 1222771 - RNA, 19 nt, Homo sapiens
gcaccuucaugcccucuau

SEQ ID NO: 1222772 - RNA, 19 nt, Homo sapiens
cacuaucuaucuugacuaa

SEQ ID NO: 1222773 - RNA, 19 nt, Homo sapiens
agccuuagcuaaacuuuga

SEQ ID NO: 1222774 - RNA, 19 nt, Homo sapiens
cuaaacauuuccaaagcaa

SEQ ID NO: 1222775 - RNA, 19 nt, Homo sapiens
gaugaaguagacagcuuua

SEQ ID NO: 1222776 - RNA, 19 nt, Homo sapiens
gcucagcuguucccuugau

SEQ ID NO: 1222777 - RNA, 19 nt, Homo sapiens
caggaacgaugaugaugau

SEQ ID NO: 1222778 - RNA, 19 nt, Homo sapiens
gaccuauucuggacaaugg

SEQ ID NO: 1222779 - RNA, 19 nt, Homo sapiens
gugaacaucuagauaaugc

SEQ ID NO: 1222780 - RNA, 19 nt, Homo sapiens
gaugaugauacaaguguuu

SEQ ID NO: 1222781 - RNA, 19 nt, Homo sapiens
ucuaauugcugguuaugug

SEQ ID NO: 1222782 - RNA, 19 nt, Homo sapiens
cuaucuaucuugacuaauc

SEQ ID NO: 1222783 - RNA, 19 nt, Homo sapiens
gcaccugcuugcuccaguu

SEQ ID NO: 1222784 - RNA, 19 nt, Homo sapiens
ccucugaguguuccucuua

SEQ ID NO: 1222785 - RNA, 19 nt, Homo sapiens
uagcuaaacuuugaugagu

SEQ ID NO: 1222786 - RNA, 19 nt, Homo sapiens
gacuaacaacccaucaaua

SEQ ID NO: 1222787 - RNA, 19 nt, Homo sapiens
aaccugagauccuucauuc

SEQ ID NO: 1222788 - RNA, 19 nt, Homo sapiens
guacagaaucacucuacuu

SEQ ID NO: 1222789 - RNA, 19 nt, Homo sapiens
ggaguuugcuuguuuuaau

SEQ ID NO: 1222790 - RNA, 19 nt, Homo sapiens
ccacaggaagcuagauuga

SEQ ID NO: 1222791 - RNA, 19 nt, Homo sapiens
gauccuucauucauaaagu

SEQ ID NO: 1222792 - RNA, 19 nt, Homo sapiens
gauguggacuuggguaucu

SEQ ID NO: 1222793 - RNA, 19 nt, Homo sapiens
gaaauggagaugugcagau

SEQ ID NO: 1222794 - RNA, 19 nt, Homo sapiens
ccuaaacaauacuguaauc

SEQ ID NO: 1222795 - RNA, 19 nt, Homo sapiens
agaacaacccgaacuaguu

SEQ ID NO: 1222796 - RNA, 19 nt, Homo sapiens
acuaacaacccaucaauau

SEQ ID NO: 1222797 - RNA, 19 nt, Homo sapiens
aaucuauguucgugucuuu

SEQ ID NO: 1222798 - RNA, 19 nt, Homo sapiens
aguguugccucuauauaaa

SEQ ID NO: 1222799 - RNA, 19 nt, Homo sapiens
caguguugccucuauauaa

SEQ ID NO: 1222800 - RNA, 19 nt, Homo sapiens
uccaugagcagaugaagua

SEQ ID NO: 1222801 - RNA, 19 nt, Homo sapiens
cauaaaguaacaccgcaua

SEQ ID NO: 1222802 - RNA, 19 nt, Homo sapiens
ccagcuauuucgcaaccua

SEQ ID NO: 1222803 - RNA, 19 nt, Homo sapiens
ccaagaacuucaucuccau

SEQ ID NO: 1222804 - RNA, 19 nt, Homo sapiens
ucagucuaauugcugguua

SEQ ID NO: 1222805 - RNA, 19 nt, Homo sapiens
cauugaaucuccauugucu

SEQ ID NO: 1222806 - RNA, 19 nt, Homo sapiens
gacaauccaccucuguauu

SEQ ID NO: 1222807 - RNA, 19 nt, Homo sapiens
ccaaggagacacagacaau

SEQ ID NO: 1222808 - RNA, 19 nt, Homo sapiens
uaaaguaacaccgcauaga

SEQ ID NO: 1222809 - RNA, 19 nt, Homo sapiens
cagaugaaguagacagcuu

SEQ ID NO: 1222810 - RNA, 19 nt, Homo sapiens
agacaauguuccugguuug

SEQ ID NO: 1222811 - RNA, 19 nt, Homo sapiens
gcuauggguuaccucaaau

SEQ ID NO: 1222812 - RNA, 19 nt, Homo sapiens
ucugaguguuccucuuaua

SEQ ID NO: 1222813 - RNA, 19 nt, Homo sapiens
aaauggagaugugcagaug

SEQ ID NO: 1222814 - RNA, 19 nt, Homo sapiens
caugggaaauggagaugug

SEQ ID NO: 1222815 - RNA, 19 nt, Homo sapiens
gacagaggcacaugggaaa

SEQ ID NO: 1222816 - RNA, 19 nt, Homo sapiens
agaggcagcuguacuguua

SEQ ID NO: 1222817 - RNA, 19 nt, Homo sapiens
gcaccugccuuggauguuu

SEQ ID NO: 1222818 - RNA, 19 nt, Homo sapiens
gcaggaaccacaucaaauc

SEQ ID NO: 1222819 - RNA, 19 nt, Homo sapiens
ggaaccacaucaaaucaag

SEQ ID NO: 1222820 - RNA, 19 nt, Homo sapiens
gggaccagcugcccuacuu

SEQ ID NO: 1222821 - RNA, 19 nt, Homo sapiens
gcacgcaggcccaugagaa

SEQ ID NO: 1222822 - RNA, 19 nt, Homo sapiens
gccagcugcuccuauauga

SEQ ID NO: 1222823 - RNA, 19 nt, Homo sapiens
gggcugccauucagaccua

SEQ ID NO: 1222824 - RNA, 19 nt, Homo sapiens
cagagcugaugguccaaua

SEQ ID NO: 1222825 - RNA, 19 nt, Homo sapiens
caugagaacagcagggaua

SEQ ID NO: 1222826 - RNA, 19 nt, Homo sapiens
gggagcaccuugugucuac

SEQ ID NO: 1222827 - RNA, 19 nt, Homo sapiens
gcagcaggcaccacuguga

SEQ ID NO: 1222828 - RNA, 19 nt, Homo sapiens
gggcagcugugacugaucu

SEQ ID NO: 1222829 - RNA, 19 nt, Homo sapiens
ccgcaaggcuguggaguuc

SEQ ID NO: 1222830 - RNA, 19 nt, Homo sapiens
ggacuucucgcccuuugau

SEQ ID NO: 1222831 - RNA, 19 nt, Homo sapiens
gaugacguguucccagaca

SEQ ID NO: 1222832 - RNA, 19 nt, Homo sapiens
aggaggagcugcugaaugc

SEQ ID NO: 1222833 - RNA, 19 nt, Homo sapiens
cgucaugggcugcgaggua

SEQ ID NO: 1222834 - RNA, 19 nt, Homo sapiens
acaagcagcugcggaucuu

SEQ ID NO: 1222835 - RNA, 19 nt, Homo sapiens
ccucacggcucauccucaa

SEQ ID NO: 1222836 - RNA, 19 nt, Homo sapiens
gcuucaggguguccaaguu

SEQ ID NO: 1222837 - RNA, 19 nt, Homo sapiens
ucacaggccacacggagaa

SEQ ID NO: 1222838 - RNA, 19 nt, Homo sapiens
gcaccgagacagccacauc

SEQ ID NO: 1222839 - RNA, 19 nt, Homo sapiens
caagcgaggguuucucuuc

SEQ ID NO: 1222840 - RNA, 19 nt, Homo sapiens
gagcugaugguccaauaag

SEQ ID NO: 1222841 - RNA, 19 nt, Homo sapiens
ccacaucaccaaccucaag

SEQ ID NO: 1222842 - RNA, 19 nt, Homo sapiens
caucuugccugcuguucca

SEQ ID NO: 1222843 - RNA, 19 nt, Homo sapiens
gaaggaggagcugcugaau

SEQ ID NO: 1222844 - RNA, 19 nt, Homo sapiens
acgcggagcucgcauuguc

SEQ ID NO: 1222845 - RNA, 19 nt, Homo sapiens
gagaggcagcuguacuguu

SEQ ID NO: 1222846 - RNA, 19 nt, Homo sapiens
gcgcaguaccuggaagaaa

SEQ ID NO: 1222847 - RNA, 19 nt, Homo sapiens
agaaaagucugaccagcaa

SEQ ID NO: 1222848 - RNA, 19 nt, Homo sapiens
cgaccguccugguguacug

SEQ ID NO: 1222849 - RNA, 19 nt, Homo sapiens
gcgagaggcagcuguacug

SEQ ID NO: 1222850 - RNA, 19 nt, Homo sapiens
cagcugcuccuauaugaag

SEQ ID NO: 1222851 - RNA, 19 nt, Homo sapiens
uagagcagcaccagucuca

SEQ ID NO: 1222852 - RNA, 19 nt, Homo sapiens
cgcaguaccuggaagaaaa

SEQ ID NO: 1222853 - RNA, 19 nt, Homo sapiens
gcuggugucuggcuuugac

SEQ ID NO: 1222854 - RNA, 19 nt, Homo sapiens
caccuugugucuacuggau

SEQ ID NO: 1222855 - RNA, 19 nt, Homo sapiens
agaaggaggagcugcugaa

SEQ ID NO: 1222856 - RNA, 19 nt, Homo sapiens
ccaccugggcugccauuca

SEQ ID NO: 1222857 - RNA, 19 nt, Homo sapiens
caggaaccacaucaaauca

SEQ ID NO: 1222858 - RNA, 19 nt, Homo sapiens
gagacagccacaucaccaa

SEQ ID NO: 1222859 - RNA, 19 nt, Homo sapiens
gcccaucggcuaccaugug

SEQ ID NO: 1222860 - RNA, 19 nt, Homo sapiens
cgagguacuccgcguccua

SEQ ID NO: 1222861 - RNA, 19 nt, Homo sapiens
cuuccaggaugacguguuc

SEQ ID NO: 1222862 - RNA, 19 nt, Homo sapiens
caccugggcugccauucag

SEQ ID NO: 1222863 - RNA, 19 nt, Homo sapiens
acaaccagcaggugcagaa

SEQ ID NO: 1222864 - RNA, 19 nt, Homo sapiens
gcaccugggagcaccuugu

SEQ ID NO: 1222865 - RNA, 19 nt, Homo sapiens
cagcaggcaccacugugaa

SEQ ID NO: 1222866 - RNA, 19 nt, Homo sapiens
gcacaccucacggcucauc

SEQ ID NO: 1222867 - RNA, 19 nt, Homo sapiens
ccugcagccuccugacaug

SEQ ID NO: 1222868 - RNA, 19 nt, Homo sapiens
cggcuucugugccaacaag

SEQ ID NO: 1222869 - RNA, 19 nt, Homo sapiens
gacaagcagcugcggaucu

SEQ ID NO: 1222870 - RNA, 19 nt, Homo sapiens
agcgccagcugcuccuaua

SEQ ID NO: 1222871 - RNA, 19 nt, Homo sapiens
ucaccacgccagagacugu

SEQ ID NO: 1222872 - RNA, 19 nt, Homo sapiens
ugagagugacggcuucugu

SEQ ID NO: 1222873 - RNA, 19 nt, Homo sapiens
ccuugugucuacuggauuc

SEQ ID NO: 1222874 - RNA, 19 nt, Homo sapiens
gaagcucccugccuuuaau

SEQ ID NO: 1222875 - RNA, 19 nt, Homo sapiens
uuaauaaacuggccaagug

SEQ ID NO: 1222876 - RNA, 19 nt, Homo sapiens
gaacccagcuggccaugcu

SEQ ID NO: 1222877 - RNA, 19 nt, Homo sapiens
gaucuugccugugcccuau

SEQ ID NO: 1222878 - RNA, 19 nt, Homo sapiens
ucacggagcagcacgcuuu

SEQ ID NO: 1222879 - RNA, 19 nt, Homo sapiens
gggcugauguggccgaugu

SEQ ID NO: 1222880 - RNA, 19 nt, Homo sapiens
gcagcacggcgacgacuuu

SEQ ID NO: 1222881 - RNA, 19 nt, Homo sapiens
gaauggcuaccgacgcuuu

SEQ ID NO: 1222882 - RNA, 19 nt, Homo sapiens
ggaauacacgcuggacuug

SEQ ID NO: 1222883 - RNA, 19 nt, Homo sapiens
uggagagccuggaugugua

SEQ ID NO: 1222884 - RNA, 19 nt, Homo sapiens
gcgacgacuuugacugguu

SEQ ID NO: 1222885 - RNA, 19 nt, Homo sapiens
cgcccgagcugaacuggaa

SEQ ID NO: 1222886 - RNA, 19 nt, Homo sapiens
ugacccugcugcuacugua

SEQ ID NO: 1222887 - RNA, 19 nt, Homo sapiens
cgaagcucccugccuuuaa

SEQ ID NO: 1222888 - RNA, 19 nt, Homo sapiens
gcacguaccaggagaucca

SEQ ID NO: 1222889 - RNA, 19 nt, Homo sapiens
ccgaagcucccugccuuua

SEQ ID NO: 1222890 - RNA, 19 nt, Homo sapiens
aaacuggccaagugugaaa

SEQ ID NO: 1222891 - RNA, 19 nt, Homo sapiens
agugggagauccagaauac

SEQ ID NO: 1222892 - RNA, 19 nt, Homo sapiens
accaggagauccaggaguu

SEQ ID NO: 1222893 - RNA, 19 nt, Homo sapiens
gaacaggagcagggcaaca

SEQ ID NO: 1222894 - RNA, 19 nt, Homo sapiens
uggcggugcugaccucuca

SEQ ID NO: 1222895 - RNA, 19 nt, Homo sapiens
gacacuggccgcuuugauc

SEQ ID NO: 1222896 - RNA, 19 nt, Homo sapiens
ccgugacacuggccgcuuu

SEQ ID NO: 1222897 - RNA, 19 nt, Homo sapiens
gcacuggagccuggugaug

SEQ ID NO: 1222898 - RNA, 19 nt, Homo sapiens
gugacccugugcacaugua

SEQ ID NO: 1222899 - RNA, 19 nt, Homo sapiens
gacccucauuuccgaagug

SEQ ID NO: 1222900 - RNA, 19 nt, Homo sapiens
gcaugcugcugcaacaacu

SEQ ID NO: 1222901 - RNA, 19 nt, Homo sapiens
cagcgaggccugcuucuac

SEQ ID NO: 1222902 - RNA, 19 nt, Homo sapiens
aauacacgcuggacuugca

SEQ ID NO: 1222903 - RNA, 19 nt, Homo sapiens
gcacggcgacgacuuugac

SEQ ID NO: 1222904 - RNA, 19 nt, Homo sapiens
gucaggacccgcuacauca

SEQ ID NO: 1222905 - RNA, 19 nt, Homo sapiens
ggcggcagccucagaacaa

SEQ ID NO: 1222906 - RNA, 19 nt, Homo sapiens
cuacugccacggaggcuuu

SEQ ID NO: 1222907 - RNA, 19 nt, Homo sapiens
ccaggagauccaggaguua

SEQ ID NO: 1222908 - RNA, 19 nt, Homo sapiens
ccacguauuuaugcaguac

SEQ ID NO: 1222909 - RNA, 19 nt, Homo sapiens
uggccaugcuacucuuuga

SEQ ID NO: 1222910 - RNA, 19 nt, Homo sapiens
ggacccucauuuccgaagu

SEQ ID NO: 1222911 - RNA, 19 nt, Homo sapiens
uaauaaacuggccaagugu

SEQ ID NO: 1222912 - RNA, 19 nt, Homo sapiens
ccugggcucuggacaagca

SEQ ID NO: 1222913 - RNA, 19 nt, Homo sapiens
gaaccgcugccgcaugcau

SEQ ID NO: 1222914 - RNA, 19 nt, Homo sapiens
guggcugggucgcugcauu

SEQ ID NO: 1222915 - RNA, 19 nt, Homo sapiens
uggaauacacgcuggacuu

SEQ ID NO: 1222916 - RNA, 19 nt, Homo sapiens
gcgugacccugugcacaug

SEQ ID NO: 1222917 - RNA, 19 nt, Homo sapiens
ccaugcuacucuuugaaca

SEQ ID NO: 1222918 - RNA, 19 nt, Homo sapiens
cgucaggacccgcuacauc

SEQ ID NO: 1222919 - RNA, 19 nt, Homo sapiens
ggaguuacagugggagauc

SEQ ID NO: 1222920 - RNA, 19 nt, Homo sapiens
gcuggagcgugugguguuc

SEQ ID NO: 1222921 - RNA, 19 nt, Homo sapiens
uaaacuggccaagugugaa

SEQ ID NO: 1222922 - RNA, 19 nt, Homo sapiens
gagccacccacuucucauc

SEQ ID NO: 1222923 - RNA, 19 nt, Homo sapiens
cagagccacccacuucuca

SEQ ID NO: 1222924 - RNA, 19 nt, Homo sapiens
uguaccagcugcacaaagc

SEQ ID NO: 1222925 - RNA, 19 nt, Homo sapiens
ggcagccucagaacaagaa

SEQ ID NO: 1222926 - RNA, 19 nt, Homo sapiens
cgacuuugacugguucuuc

SEQ ID NO: 1222927 - RNA, 19 nt, Homo sapiens
ggucaaggcuuuauguuaa

SEQ ID NO: 1222928 - RNA, 19 nt, Homo sapiens
ccaaugagaugaauauuuc

SEQ ID NO: 1222929 - RNA, 19 nt, Homo sapiens
gagaaguccugcuguguuu

SEQ ID NO: 1222930 - RNA, 19 nt, Homo sapiens
caucaucucuuacuuugaa

SEQ ID NO: 1222931 - RNA, 19 nt, Homo sapiens
gcucauauguuagauuuga

SEQ ID NO: 1222932 - RNA, 19 nt, Homo sapiens
agacaaguauggcaaauug

SEQ ID NO: 1222933 - RNA, 19 nt, Homo sapiens
caugcuugcucauauguua

SEQ ID NO: 1222934 - RNA, 19 nt, Homo sapiens
gaagccgccuccugguaua

SEQ ID NO: 1222935 - RNA, 19 nt, Homo sapiens
gcaaaucaacaguacguuu

SEQ ID NO: 1222936 - RNA, 19 nt, Homo sapiens
ggacgcacgugccuacaug

SEQ ID NO: 1222937 - RNA, 19 nt, Homo sapiens
gccaucaucucuuacuuug

SEQ ID NO: 1222938 - RNA, 19 nt, Homo sapiens
gcugacauguugaggacua

SEQ ID NO: 1222939 - RNA, 19 nt, Homo sapiens
gaccaacuguauaugauca

SEQ ID NO: 1222940 - RNA, 19 nt, Homo sapiens
gcucugccaucgcuaguau

SEQ ID NO: 1222941 - RNA, 19 nt, Homo sapiens
gcuggccgcugacauguug

SEQ ID NO: 1222942 - RNA, 19 nt, Homo sapiens
ggacagaagcaguacaaca

SEQ ID NO: 1222943 - RNA, 19 nt, Homo sapiens
ggacauggcagcccugaag

SEQ ID NO: 1222944 - RNA, 19 nt, Homo sapiens
gccaaugagaugaauauuu

SEQ ID NO: 1222945 - RNA, 19 nt, Homo sapiens
gaaggauccuaaccaaggu

SEQ ID NO: 1222946 - RNA, 19 nt, Homo sapiens
gagccaaugagaugaauau

SEQ ID NO: 1222947 - RNA, 19 nt, Homo sapiens
ggcagcagcuccuagaaag

SEQ ID NO: 1222948 - RNA, 19 nt, Homo sapiens
uaggucagcauuaaaguaa

SEQ ID NO: 1222949 - RNA, 19 nt, Homo sapiens
caaaucaacaguacguuuc

SEQ ID NO: 1222950 - RNA, 19 nt, Homo sapiens
ggagacaaguauggcaaau

SEQ ID NO: 1222951 - RNA, 19 nt, Homo sapiens
caaaagagccaaugagaug

SEQ ID NO: 1222952 - RNA, 19 nt, Homo sapiens
gacagaagcaguacaacau

SEQ ID NO: 1222953 - RNA, 19 nt, Homo sapiens
gcagaagguccggcaguuu

SEQ ID NO: 1222954 - RNA, 19 nt, Homo sapiens
ggugauggguauuacagau

SEQ ID NO: 1222955 - RNA, 19 nt, Homo sapiens
auuaaggacuuucugaaga

SEQ ID NO: 1222956 - RNA, 19 nt, Homo sapiens
gcuaguaugguauuuggaa

SEQ ID NO: 1222957 - RNA, 19 nt, Homo sapiens
ucucuuacuuugaacaguu

SEQ ID NO: 1222958 - RNA, 19 nt, Homo sapiens
agacgggugugcaggugua

SEQ ID NO: 1222959 - RNA, 19 nt, Homo sapiens
cagaagguccggcaguuug

SEQ ID NO: 1222960 - RNA, 19 nt, Homo sapiens
ggcagaagguccggcaguu

SEQ ID NO: 1222961 - RNA, 19 nt, Homo sapiens
uuggugccaucaucucuua

SEQ ID NO: 1222962 - RNA, 19 nt, Homo sapiens
cgaaaauauuccucagaua

SEQ ID NO: 1222963 - RNA, 19 nt, Homo sapiens
uaaaguaaggcaaccaaca

SEQ ID NO: 1222964 - RNA, 19 nt, Homo sapiens
cgagaaguccugcuguguu

SEQ ID NO: 1222965 - RNA, 19 nt, Homo sapiens
gcaccaagagggccgugaa

SEQ ID NO: 1222966 - RNA, 19 nt, Homo sapiens
gcucagccaucgacuacag

SEQ ID NO: 1222967 - RNA, 19 nt, Homo sapiens
ggccaugcuugcucauaug

SEQ ID NO: 1222968 - RNA, 19 nt, Homo sapiens
gaaccugaagggccgagaa

SEQ ID NO: 1222969 - RNA, 19 nt, Homo sapiens
gcuguggaccaacuguaua

SEQ ID NO: 1222970 - RNA, 19 nt, Homo sapiens
gcacgccaaaggcaaagaa

SEQ ID NO: 1222971 - RNA, 19 nt, Homo sapiens
gagacaaguauggcaaauu

SEQ ID NO: 1222972 - RNA, 19 nt, Homo sapiens
gaggguaaccgaaaauauu

SEQ ID NO: 1222973 - RNA, 19 nt, Homo sapiens
ggucagcauuaaaguaagg

SEQ ID NO: 1222974 - RNA, 19 nt, Homo sapiens
ugggauagauuuagcuuuu

SEQ ID NO: 1222975 - RNA, 19 nt, Homo sapiens
ccucagauaauuucuuuca

SEQ ID NO: 1222976 - RNA, 19 nt, Homo sapiens
cgaagccgccuccugguau

SEQ ID NO: 1222977 - RNA, 19 nt, Homo sapiens
ugauggguauuacagaugu

SEQ ID NO: 1222978 - RNA, 19 nt, Homo sapiens
cagcgaggcuaccuugcau

SEQ ID NO: 1222979 - RNA, 19 nt, Homo sapiens
cgccaaaggcaaagaagaa

SEQ ID NO: 1222980 - RNA, 19 nt, Homo sapiens
uggccaugcuugcucauau

SEQ ID NO: 1222981 - RNA, 19 nt, Homo sapiens
cuaggucagcauuaaagua

SEQ ID NO: 1222982 - RNA, 19 nt, Homo sapiens
ggaccaacuguauaugauc

SEQ ID NO: 1222983 - RNA, 19 nt, Homo sapiens
guauagcuguggaccaacu

SEQ ID NO: 1222984 - RNA, 19 nt, Homo sapiens
guggaccaacuguauauga

SEQ ID NO: 1222985 - RNA, 19 nt, Homo sapiens
gcagcgaggcuaccuugca

SEQ ID NO: 1222986 - RNA, 19 nt, Homo sapiens
gaaguccugcuguguuugg

SEQ ID NO: 1222987 - RNA, 19 nt, Homo sapiens
gccaaaggcaaagaagaaa

SEQ ID NO: 1222988 - RNA, 19 nt, Homo sapiens
ccauucaggugggauagau

SEQ ID NO: 1222989 - RNA, 19 nt, Homo sapiens
aaagagccaaugagaugaa

SEQ ID NO: 1222990 - RNA, 19 nt, Homo sapiens
ccaacuguauaugaucaug

SEQ ID NO: 1222991 - RNA, 19 nt, Homo sapiens
cggcagcagcuccuagaaa

SEQ ID NO: 1222992 - RNA, 19 nt, Homo sapiens
uuaaggacuuucugaagac

SEQ ID NO: 1222993 - RNA, 19 nt, Homo sapiens
uaugguauuuggaagucaa

SEQ ID NO: 1222994 - RNA, 19 nt, Homo sapiens
uggaccaacuguauaugau

SEQ ID NO: 1222995 - RNA, 19 nt, Homo sapiens
aaaaggcaaugucuacuuc

SEQ ID NO: 1222996 - RNA, 19 nt, Homo sapiens
gcccacggcaucaacauca

SEQ ID NO: 1222997 - RNA, 19 nt, Homo sapiens
acaagacgcacccaugcuu

SEQ ID NO: 1222998 - RNA, 19 nt, Homo sapiens
guccaaaucauuaaagaac

SEQ ID NO: 1222999 - RNA, 19 nt, Homo sapiens
ugcgaagucuuucaucagu

SEQ ID NO: 1223000 - RNA, 19 nt, Homo sapiens
caucgcuaguaugguauuu

SEQ ID NO: 1223001 - RNA, 19 nt, Homo sapiens
uggcagcccugaagguucu

SEQ ID NO: 1223002 - RNA, 19 nt, Homo sapiens
ugaaccugcucacgacaag

SEQ ID NO: 1223003 - RNA, 19 nt, Homo sapiens
gcagcauagucauggugau

SEQ ID NO: 1223004 - RNA, 19 nt, Homo sapiens
ucgcuaguaugguauuugg

SEQ ID NO: 1223005 - RNA, 19 nt, Homo sapiens
uuugauaucauucgaagga

SEQ ID NO: 1223006 - RNA, 19 nt, Homo sapiens
gccaucgacuacagugaca

SEQ ID NO: 1223007 - RNA, 19 nt, Homo sapiens
gucauggugauggguauua

SEQ ID NO: 1223008 - RNA, 19 nt, Homo sapiens
gugccaucaucucuuacuu

SEQ ID NO: 1223009 - RNA, 19 nt, Homo sapiens
ugacagcgccaugcuccaa

SEQ ID NO: 1223010 - RNA, 19 nt, Homo sapiens
ccacaucaugagaacgaaa

SEQ ID NO: 1223011 - RNA, 19 nt, Homo sapiens
ccgaaaauauuccucagau

SEQ ID NO: 1223012 - RNA, 19 nt, Homo sapiens
cagcauagucauggugaug

SEQ ID NO: 1223013 - RNA, 19 nt, Homo sapiens
cuauuaaggacuuucugaa

SEQ ID NO: 1223014 - RNA, 19 nt, Homo sapiens
caucaugagaacgaaauug

SEQ ID NO: 1223015 - RNA, 19 nt, Homo sapiens
acaagcgucaugccaguga

SEQ ID NO: 1223016 - RNA, 19 nt, Homo sapiens
ugccaucaucucuuacuuu

SEQ ID NO: 1223017 - RNA, 19 nt, Homo sapiens
gaucuucguucaugaauua

SEQ ID NO: 1223018 - RNA, 19 nt, Homo sapiens
gaauugagguggauguuga

SEQ ID NO: 1223019 - RNA, 19 nt, Homo sapiens
gcucagaugacuaauauua

SEQ ID NO: 1223020 - RNA, 19 nt, Homo sapiens
gaucuggaauuguaaugua

SEQ ID NO: 1223021 - RNA, 19 nt, Homo sapiens
ggacuuaauugauugguau

SEQ ID NO: 1223022 - RNA, 19 nt, Homo sapiens
gaauguacuucaugugauu

SEQ ID NO: 1223023 - RNA, 19 nt, Homo sapiens
ccaggugccuuaauauaaa

SEQ ID NO: 1223024 - RNA, 19 nt, Homo sapiens
uaucagagauuauggacuu

SEQ ID NO: 1223025 - RNA, 19 nt, Homo sapiens
caaagaggcauacaaguga

SEQ ID NO: 1223026 - RNA, 19 nt, Homo sapiens
gugcucagaugacuaauau

SEQ ID NO: 1223027 - RNA, 19 nt, Homo sapiens
ggccuaguuucuauuaaua

SEQ ID NO: 1223028 - RNA, 19 nt, Homo sapiens
ugaaauugcuaaugacaga

SEQ ID NO: 1223029 - RNA, 19 nt, Homo sapiens
uaacagaacugccaaucag

SEQ ID NO: 1223030 - RNA, 19 nt, Homo sapiens
gaaaugcuguaaauauguc

SEQ ID NO: 1223031 - RNA, 19 nt, Homo sapiens
ggagauaguugugcugugu

SEQ ID NO: 1223032 - RNA, 19 nt, Homo sapiens
gaaacaaggagacaaggaa

SEQ ID NO: 1223033 - RNA, 19 nt, Homo sapiens
gcgaguacuucuugaaaug

SEQ ID NO: 1223034 - RNA, 19 nt, Homo sapiens
agacgaaacuccuaaucaa

SEQ ID NO: 1223035 - RNA, 19 nt, Homo sapiens
gguaaaccaugaagcaaau

SEQ ID NO: 1223036 - RNA, 19 nt, Homo sapiens
ggaagcagaggcaauuaaa

SEQ ID NO: 1223037 - RNA, 19 nt, Homo sapiens
gaaagucuacagcugguaa

SEQ ID NO: 1223038 - RNA, 19 nt, Homo sapiens
gaguagcuguaaucacuuu

SEQ ID NO: 1223039 - RNA, 19 nt, Homo sapiens
gaagaagacgaaacuccua

SEQ ID NO: 1223040 - RNA, 19 nt, Homo sapiens
gagaauuccaggugccuua

SEQ ID NO: 1223041 - RNA, 19 nt, Homo sapiens
gaguuuauguuugaccuaa

SEQ ID NO: 1223042 - RNA, 19 nt, Homo sapiens
caacccaaccuuugaagaa

SEQ ID NO: 1223043 - RNA, 19 nt, Homo sapiens
ggucauagaaguagggaaa

SEQ ID NO: 1223044 - RNA, 19 nt, Homo sapiens
acacuaauauuggucauug

SEQ ID NO: 1223045 - RNA, 19 nt, Homo sapiens
gggccuaguuucuauuaau

SEQ ID NO: 1223046 - RNA, 19 nt, Homo sapiens
gcaaccauauuuuccauaa

SEQ ID NO: 1223047 - RNA, 19 nt, Homo sapiens
gcaggaagcagaggcaauu

SEQ ID NO: 1223048 - RNA, 19 nt, Homo sapiens
ggucauugaucuucguuca

SEQ ID NO: 1223049 - RNA, 19 nt, Homo sapiens
gcuaaugacagaguaagua

SEQ ID NO: 1223050 - RNA, 19 nt, Homo sapiens
gacaauggucauagaagua

SEQ ID NO: 1223051 - RNA, 19 nt, Homo sapiens
ccaccaaaguuaaauagag

SEQ ID NO: 1223052 - RNA, 19 nt, Homo sapiens
ugaaaccauugcauucuug

SEQ ID NO: 1223053 - RNA, 19 nt, Homo sapiens
guaacccgcacacgaauuu

SEQ ID NO: 1223054 - RNA, 19 nt, Homo sapiens
aaccauaguuuaucagaga

SEQ ID NO: 1223055 - RNA, 19 nt, Homo sapiens
ucaaagaggcauacaagug

SEQ ID NO: 1223056 - RNA, 19 nt, Homo sapiens
uaagagugauacugaaagu

SEQ ID NO: 1223057 - RNA, 19 nt, Homo sapiens
ugagguggauguugaagau

SEQ ID NO: 1223058 - RNA, 19 nt, Homo sapiens
ccaucuggcuuaugagaga

SEQ ID NO: 1223059 - RNA, 19 nt, Homo sapiens
ggaugaaaccauugcauuc

SEQ ID NO: 1223060 - RNA, 19 nt, Homo sapiens
gcaaguuuccucucaguag

SEQ ID NO: 1223061 - RNA, 19 nt, Homo sapiens
gaaagugcucagaugacua

SEQ ID NO: 1223062 - RNA, 19 nt, Homo sapiens
gauguuauuccucauguug

SEQ ID NO: 1223063 - RNA, 19 nt, Homo sapiens
gaacacgugcagucaacaa

SEQ ID NO: 1223064 - RNA, 19 nt, Homo sapiens
ggaaauuggcccugaugga

SEQ ID NO: 1223065 - RNA, 19 nt, Homo sapiens
cggcaacugugggcuauuu

SEQ ID NO: 1223066 - RNA, 19 nt, Homo sapiens
ucaagagacugcuguucga

SEQ ID NO: 1223067 - RNA, 19 nt, Homo sapiens
acaagucccuguauccaau

SEQ ID NO: 1223068 - RNA, 19 nt, Homo sapiens
gcucgaaggcuacggaaug

SEQ ID NO: 1223069 - RNA, 19 nt, Homo sapiens
gcauacaagugacaauggu

SEQ ID NO: 1223070 - RNA, 19 nt, Homo sapiens
cuuguacacugauuugaaa

SEQ ID NO: 1223071 - RNA, 19 nt, Homo sapiens
aaagugcucagaugacuaa

SEQ ID NO: 1223072 - RNA, 19 nt, Homo sapiens
gucaacaaaugaaagucua

SEQ ID NO: 1223073 - RNA, 19 nt, Homo sapiens
gaaucaucauacuguuuga

SEQ ID NO: 1223074 - RNA, 19 nt, Homo sapiens
ucucaaacuugugggauuu

SEQ ID NO: 1223075 - RNA, 19 nt, Homo sapiens
ugacacaagauuagacaaa

SEQ ID NO: 1223076 - RNA, 19 nt, Homo sapiens
uggaguagcuguaaucacu

SEQ ID NO: 1223077 - RNA, 19 nt, Homo sapiens
ucauugaucuucguucaug

SEQ ID NO: 1223078 - RNA, 19 nt, Homo sapiens
cagaguaaguaacacuaau

SEQ ID NO: 1223079 - RNA, 19 nt, Homo sapiens
gugacauacucaaagcuuu

SEQ ID NO: 1223080 - RNA, 19 nt, Homo sapiens
aauuccaggugccuuaaua

SEQ ID NO: 1223081 - RNA, 19 nt, Homo sapiens
ugucaaccauaguuuauca

SEQ ID NO: 1223082 - RNA, 19 nt, Homo sapiens
gaagacgaaacuccuaauc

SEQ ID NO: 1223083 - RNA, 19 nt, Homo sapiens
cuguaaauaugucccaauu

SEQ ID NO: 1223084 - RNA, 19 nt, Homo sapiens
agagacugcuguucgagaa

SEQ ID NO: 1223085 - RNA, 19 nt, Homo sapiens
cuaaugacagaguaaguaa

SEQ ID NO: 1223086 - RNA, 19 nt, Homo sapiens
ugaaucaucauacuguuug

SEQ ID NO: 1223087 - RNA, 19 nt, Homo sapiens
gagccgucaucuuuaacuu

SEQ ID NO: 1223088 - RNA, 19 nt, Homo sapiens
ggcgaguacuucuugaaau

SEQ ID NO: 1223089 - RNA, 19 nt, Homo sapiens
caaguuuccucucaguagu

SEQ ID NO: 1223090 - RNA, 19 nt, Homo sapiens
aaacuuaggcgaguacuuc

SEQ ID NO: 1223091 - RNA, 19 nt, Homo sapiens
cuggagccgucaucuuuaa

SEQ ID NO: 1223092 - RNA, 19 nt, Homo sapiens
caaggaaauuggcccugau

SEQ ID NO: 1223093 - RNA, 19 nt, Homo sapiens
ucugcaaucuauucaaaga

SEQ ID NO: 1223094 - RNA, 19 nt, Homo sapiens
gaagcuucauccaccaaag

SEQ ID NO: 1223095 - RNA, 19 nt, Homo sapiens
caacuacgcacacugaaac

SEQ ID NO: 1223096 - RNA, 19 nt, Homo sapiens
caguagugauaacaacauu

SEQ ID NO: 1223097 - RNA, 19 nt, Homo sapiens
gcagucaacaaaugaaagu

SEQ ID NO: 1223098 - RNA, 19 nt, Homo sapiens
aaacaaggagacaaggaaa

SEQ ID NO: 1223099 - RNA, 19 nt, Homo sapiens
ggauguuauuccucauguu

SEQ ID NO: 1223100 - RNA, 19 nt, Homo sapiens
gaccgcaucaucuggauau

SEQ ID NO: 1223101 - RNA, 19 nt, Homo sapiens
gcagcgagaccgcaucauc

SEQ ID NO: 1223102 - RNA, 19 nt, Homo sapiens
ggaauugagguggauguug

SEQ ID NO: 1223103 - RNA, 19 nt, Homo sapiens
gauuugguacgcaucuuaa

SEQ ID NO: 1223104 - RNA, 19 nt, Homo sapiens
gcauugaauuguauaaacc

SEQ ID NO: 1223105 - RNA, 19 nt, Homo sapiens
acaaggagacaaggaaauu

SEQ ID NO: 1223106 - RNA, 19 nt, Homo sapiens
uccaggugccuuaauauaa

SEQ ID NO: 1223107 - RNA, 19 nt, Homo sapiens
aaauuaggcugaauguacu

SEQ ID NO: 1223108 - RNA, 19 nt, Homo sapiens
cgaaacuccuaaucaagag

SEQ ID NO: 1223109 - RNA, 19 nt, Homo sapiens
ggaucagugucuuuacaag

SEQ ID NO: 1223110 - RNA, 19 nt, Homo sapiens
caugaucggcaaucugaaa

SEQ ID NO: 1223111 - RNA, 19 nt, Homo sapiens
gucuggagccgucaucuuu

SEQ ID NO: 1223112 - RNA, 19 nt, Homo sapiens
ugaaagugcucagaugacu

SEQ ID NO: 1223113 - RNA, 19 nt, Homo sapiens
caaaagcucaguauaugaa

SEQ ID NO: 1223114 - RNA, 19 nt, Homo sapiens
cagggccuaguuucuauua

SEQ ID NO: 1223115 - RNA, 19 nt, Homo sapiens
aaucagggccuaguuucua

SEQ ID NO: 1223116 - RNA, 19 nt, Homo sapiens
gccaaucagggccuaguuu

SEQ ID NO: 1223117 - RNA, 19 nt, Homo sapiens
gcaaagggauuucuuacaa

SEQ ID NO: 1223118 - RNA, 19 nt, Homo sapiens
acaagaaggucuauuggua

SEQ ID NO: 1223119 - RNA, 19 nt, Homo sapiens
gcaaagugguucaaguuau

SEQ ID NO: 1223120 - RNA, 19 nt, Homo sapiens
gagaucgaguggagauuua

SEQ ID NO: 1223121 - RNA, 19 nt, Homo sapiens
gaaccaugaucccuaguga

SEQ ID NO: 1223122 - RNA, 19 nt, Homo sapiens
gaugaagacugguaucugu

SEQ ID NO: 1223123 - RNA, 19 nt, Homo sapiens
gaaggucuauugguauuga

SEQ ID NO: 1223124 - RNA, 19 nt, Homo sapiens
guggagagcugacaaggaa

SEQ ID NO: 1223125 - RNA, 19 nt, Homo sapiens
ggaaauacaagaaggucua

SEQ ID NO: 1223126 - RNA, 19 nt, Homo sapiens
gaaccuaugugcccugucu

SEQ ID NO: 1223127 - RNA, 19 nt, Homo sapiens
caaagugguucaaguuauc

SEQ ID NO: 1223128 - RNA, 19 nt, Homo sapiens
ucaaggagacccggaaaua

SEQ ID NO: 1223129 - RNA, 19 nt, Homo sapiens
guacgagucuccacacgau

SEQ ID NO: 1223130 - RNA, 19 nt, Homo sapiens
gaguggagauuuacugaag

SEQ ID NO: 1223131 - RNA, 19 nt, Homo sapiens
uaugugcccugucuaaaga

SEQ ID NO: 1223132 - RNA, 19 nt, Homo sapiens
caaagacacaucaguggaa

SEQ ID NO: 1223133 - RNA, 19 nt, Homo sapiens
ggcaaagugguucaaguua

SEQ ID NO: 1223134 - RNA, 19 nt, Homo sapiens
aagaaggucuauugguauu

SEQ ID NO: 1223135 - RNA, 19 nt, Homo sapiens
gagcugacaaggaagguuu

SEQ ID NO: 1223136 - RNA, 19 nt, Homo sapiens
gggcaaagugguucaaguu

SEQ ID NO: 1223137 - RNA, 19 nt, Homo sapiens
aguggaagaugcuuuagaa

SEQ ID NO: 1223138 - RNA, 19 nt, Homo sapiens
caagaaggucuauugguau

SEQ ID NO: 1223139 - RNA, 19 nt, Homo sapiens
ccugaaacguggauugaug

SEQ ID NO: 1223140 - RNA, 19 nt, Homo sapiens
gaaaguggagagcugacaa

SEQ ID NO: 1223141 - RNA, 19 nt, Homo sapiens
caaagggauuucuuacaac

SEQ ID NO: 1223142 - RNA, 19 nt, Homo sapiens
acacauuaccgcuacauug

SEQ ID NO: 1223143 - RNA, 19 nt, Homo sapiens
gaaauacaagaaggucuau

SEQ ID NO: 1223144 - RNA, 19 nt, Homo sapiens
gacaggaaacccacugaga

SEQ ID NO: 1223145 - RNA, 19 nt, Homo sapiens
gaagacugguaucuguucu

SEQ ID NO: 1223146 - RNA, 19 nt, Homo sapiens
gaucaaggagacccggaaa

SEQ ID NO: 1223147 - RNA, 19 nt, Homo sapiens
ucaaacuuguggauccuau

SEQ ID NO: 1223148 - RNA, 19 nt, Homo sapiens
gaagcagggcaaagugguu

SEQ ID NO: 1223149 - RNA, 19 nt, Homo sapiens
acacgaucagggagaauua

SEQ ID NO: 1223150 - RNA, 19 nt, Homo sapiens
ugggagggcugaacacaca

SEQ ID NO: 1223151 - RNA, 19 nt, Homo sapiens
ggagaauuaucccuaaacc

SEQ ID NO: 1223152 - RNA, 19 nt, Homo sapiens
gagggcugaacacacauua

SEQ ID NO: 1223153 - RNA, 19 nt, Homo sapiens
uuucagaugccaauaaaga

SEQ ID NO: 1223154 - RNA, 19 nt, Homo sapiens
ggaaacccacugagaucga

SEQ ID NO: 1223155 - RNA, 19 nt, Homo sapiens
ugagaucgaguggagauuu

SEQ ID NO: 1223156 - RNA, 19 nt, Homo sapiens
ggagagcggguacgagucu

SEQ ID NO: 1223157 - RNA, 19 nt, Homo sapiens
aggaagguuucgagcguuu

SEQ ID NO: 1223158 - RNA, 19 nt, Homo sapiens
gcaaggaugccgggaagca

SEQ ID NO: 1223159 - RNA, 19 nt, Homo sapiens
gagggcccaugugcugaaa

SEQ ID NO: 1223160 - RNA, 19 nt, Homo sapiens
gaauuucccagagcugaug

SEQ ID NO: 1223161 - RNA, 19 nt, Homo sapiens
cauuaccgcuaugggauga

SEQ ID NO: 1223162 - RNA, 19 nt, Homo sapiens
ggaaccaugaucccuagug

SEQ ID NO: 1223163 - RNA, 19 nt, Homo sapiens
uuggcaagaccauggauua

SEQ ID NO: 1223164 - RNA, 19 nt, Homo sapiens
agacugguaucuguucugu

SEQ ID NO: 1223165 - RNA, 19 nt, Homo sapiens
guggagauuuacugaagca

SEQ ID NO: 1223166 - RNA, 19 nt, Homo sapiens
caggaaacccacugagauc

SEQ ID NO: 1223167 - RNA, 19 nt, Homo sapiens
ggagggcugaacacacauu

SEQ ID NO: 1223168 - RNA, 19 nt, Homo sapiens
caaggagacccggaaauac

SEQ ID NO: 1223169 - RNA, 19 nt, Homo sapiens
acaggaaacccacugagau

SEQ ID NO: 1223170 - RNA, 19 nt, Homo sapiens
ccuccaggcaugcgucuuu

SEQ ID NO: 1223171 - RNA, 19 nt, Homo sapiens
aaggagacccggaaauaca

SEQ ID NO: 1223172 - RNA, 19 nt, Homo sapiens
ggacacgguggagauccua

SEQ ID NO: 1223173 - RNA, 19 nt, Homo sapiens
ggcaaagggauuucuuaca

SEQ ID NO: 1223174 - RNA, 19 nt, Homo sapiens
ugaagacugguaucuguuc

SEQ ID NO: 1223175 - RNA, 19 nt, Homo sapiens
cuugaaggcugaggcacuu

SEQ ID NO: 1223176 - RNA, 19 nt, Homo sapiens
ggaaaguggagagcugaca

SEQ ID NO: 1223177 - RNA, 19 nt, Homo sapiens
cacauuaccgcuacauugg

SEQ ID NO: 1223178 - RNA, 19 nt, Homo sapiens
gcaaagggauuucuuacaa

SEQ ID NO: 1223179 - RNA, 19 nt, Homo sapiens
acaagaaggucuauuggua

SEQ ID NO: 1223180 - RNA, 19 nt, Homo sapiens
gcaaagugguucaaguuau

SEQ ID NO: 1223181 - RNA, 19 nt, Homo sapiens
gagaucgaguggagauuua

SEQ ID NO: 1223182 - RNA, 19 nt, Homo sapiens
gaaccaugaucccuaguga

SEQ ID NO: 1223183 - RNA, 19 nt, Homo sapiens
gaugaagacugguaucugu

SEQ ID NO: 1223184 - RNA, 19 nt, Homo sapiens
gaaggucuauugguauuga

SEQ ID NO: 1223185 - RNA, 19 nt, Homo sapiens
ggaaauacaagaaggucua

SEQ ID NO: 1223186 - RNA, 19 nt, Homo sapiens
gaaccuaugugcccugucu

SEQ ID NO: 1223187 - RNA, 19 nt, Homo sapiens
caaagugguucaaguuauc

SEQ ID NO: 1223188 - RNA, 19 nt, Homo sapiens
aggcagagcugacaaggaa

SEQ ID NO: 1223189 - RNA, 19 nt, Homo sapiens
ucaaggagacccggaaaua

SEQ ID NO: 1223190 - RNA, 19 nt, Homo sapiens
guacgagucuccacacgau

SEQ ID NO: 1223191 - RNA, 19 nt, Homo sapiens
gaguggagauuuacugaag

SEQ ID NO: 1223192 - RNA, 19 nt, Homo sapiens
uaugugcccugucuaaaga

SEQ ID NO: 1223193 - RNA, 19 nt, Homo sapiens
caaagacacaucaguggaa

SEQ ID NO: 1223194 - RNA, 19 nt, Homo sapiens
ggcaaagugguucaaguua

SEQ ID NO: 1223195 - RNA, 19 nt, Homo sapiens
aagaaggucuauugguauu

SEQ ID NO: 1223196 - RNA, 19 nt, Homo sapiens
gagcugacaaggaagguuu

SEQ ID NO: 1223197 - RNA, 19 nt, Homo sapiens
gggcaaagugguucaaguu

SEQ ID NO: 1223198 - RNA, 19 nt, Homo sapiens
aguggaagaugcuuuagaa

SEQ ID NO: 1223199 - RNA, 19 nt, Homo sapiens
caagaaggucuauugguau

SEQ ID NO: 1223200 - RNA, 19 nt, Homo sapiens
ccugaaacguggauugaug

SEQ ID NO: 1223201 - RNA, 19 nt, Homo sapiens
caaagggauuucuuacaac

SEQ ID NO: 1223202 - RNA, 19 nt, Homo sapiens
acacauuaccgcuacauug

SEQ ID NO: 1223203 - RNA, 19 nt, Homo sapiens
gaaauacaagaaggucuau

SEQ ID NO: 1223204 - RNA, 19 nt, Homo sapiens
gacaggaaacccacugaga

SEQ ID NO: 1223205 - RNA, 19 nt, Homo sapiens
gaagacugguaucuguucu

SEQ ID NO: 1223206 - RNA, 19 nt, Homo sapiens
gaucaaggagacccggaaa

SEQ ID NO: 1223207 - RNA, 19 nt, Homo sapiens
ucaaacuuguggauccuau

SEQ ID NO: 1223208 - RNA, 19 nt, Homo sapiens
gaagcagggcaaagugguu

SEQ ID NO: 1223209 - RNA, 19 nt, Homo sapiens
acacgaucagggagaauua

SEQ ID NO: 1223210 - RNA, 19 nt, Homo sapiens
ugggagggcugaacacaca

SEQ ID NO: 1223211 - RNA, 19 nt, Homo sapiens
ggagaauuaucccuaaacc

SEQ ID NO: 1223212 - RNA, 19 nt, Homo sapiens
gagggcugaacacacauua

SEQ ID NO: 1223213 - RNA, 19 nt, Homo sapiens
uuucagaugccaauaaaga

SEQ ID NO: 1223214 - RNA, 19 nt, Homo sapiens
ggaaacccacugagaucga

SEQ ID NO: 1223215 - RNA, 19 nt, Homo sapiens
ugagaucgaguggagauuu

SEQ ID NO: 1223216 - RNA, 19 nt, Homo sapiens
ggagagcggguacgagucu

SEQ ID NO: 1223217 - RNA, 19 nt, Homo sapiens
aggaagguuucgagcguuu

SEQ ID NO: 1223218 - RNA, 19 nt, Homo sapiens
gcaaggaugccgggaagca

SEQ ID NO: 1223219 - RNA, 19 nt, Homo sapiens
gagggcccaugugcugaaa

SEQ ID NO: 1223220 - RNA, 19 nt, Homo sapiens
gaauuucccagagcugaug

SEQ ID NO: 1223221 - RNA, 19 nt, Homo sapiens
ggaaccaugaucccuagug

SEQ ID NO: 1223222 - RNA, 19 nt, Homo sapiens
cauuaccgcuaugggauga

SEQ ID NO: 1223223 - RNA, 19 nt, Homo sapiens
uuggcaagaccauggauua

SEQ ID NO: 1223224 - RNA, 19 nt, Homo sapiens
agacugguaucuguucugu

SEQ ID NO: 1223225 - RNA, 19 nt, Homo sapiens
guggagauuuacugaagca

SEQ ID NO: 1223226 - RNA, 19 nt, Homo sapiens
caggaaacccacugagauc

SEQ ID NO: 1223227 - RNA, 19 nt, Homo sapiens
ggagggcugaacacacauu

SEQ ID NO: 1223228 - RNA, 19 nt, Homo sapiens
caaggagacccggaaauac

SEQ ID NO: 1223229 - RNA, 19 nt, Homo sapiens
ccuccaggcaugcgucuuu

SEQ ID NO: 1223230 - RNA, 19 nt, Homo sapiens
acaggaaacccacugagau

SEQ ID NO: 1223231 - RNA, 19 nt, Homo sapiens
aaggagacccggaaauaca

SEQ ID NO: 1223232 - RNA, 19 nt, Homo sapiens
ggcaaagggauuucuuaca

SEQ ID NO: 1223233 - RNA, 19 nt, Homo sapiens
ggacacgguggagauccua

SEQ ID NO: 1223234 - RNA, 19 nt, Homo sapiens
ugaagacugguaucuguuc

SEQ ID NO: 1223235 - RNA, 19 nt, Homo sapiens
cuugaaggcugaggcacuu

SEQ ID NO: 1223236 - RNA, 19 nt, Homo sapiens
cacauuaccgcuacauugg

SEQ ID NO: 1223237 - RNA, 19 nt, Homo sapiens
aggcaaaucuccugacuua

SEQ ID NO: 1223238 - RNA, 19 nt, Homo sapiens
ggucagccuugauaaauuu

SEQ ID NO: 1223239 - RNA, 19 nt, Homo sapiens
gagcagcuaugcacuaguu

SEQ ID NO: 1223240 - RNA, 19 nt, Homo sapiens
gaucaacucucagauauag

SEQ ID NO: 1223241 - RNA, 19 nt, Homo sapiens
gcaaaucuccugacuuaug

SEQ ID NO: 1223242 - RNA, 19 nt, Homo sapiens
uaacacacaugaugaagga

SEQ ID NO: 1223243 - RNA, 19 nt, Homo sapiens
gaaaacagaucaacucuca

SEQ ID NO: 1223244 - RNA, 19 nt, Homo sapiens
caaggcagcuggauuugga

SEQ ID NO: 1223245 - RNA, 19 nt, Homo sapiens
ggagaaaccuggucuucca

SEQ ID NO: 1223246 - RNA, 19 nt, Homo sapiens
cagaucaacucucagauau

SEQ ID NO: 1223247 - RNA, 19 nt, Homo sapiens
gcacugguauauucuagga

SEQ ID NO: 1223248 - RNA, 19 nt, Homo sapiens
ugacugcccuuacccauga

SEQ ID NO: 1223249 - RNA, 19 nt, Homo sapiens
aaacacagauaccaaguuc

SEQ ID NO: 1223250 - RNA, 19 nt, Homo sapiens
ugaaguuccuuaugucaaa

SEQ ID NO: 1223251 - RNA, 19 nt, Homo sapiens
gaugguagaguuuauugua

SEQ ID NO: 1223252 - RNA, 19 nt, Homo sapiens
cauaaggccuccauucugu

SEQ ID NO: 1223253 - RNA, 19 nt, Homo sapiens
ucacauaucccaacuguca

SEQ ID NO: 1223254 - RNA, 19 nt, Homo sapiens
gauguagguucuuaagaga

SEQ ID NO: 1223255 - RNA, 19 nt, Homo sapiens
gaaggcagcagacaagaau

SEQ ID NO: 1223256 - RNA, 19 nt, Homo sapiens
ggaaugcaguggcgugauc

SEQ ID NO: 1223257 - RNA, 19 nt, Homo sapiens
gaagaaggcagcagacaag

SEQ ID NO: 1223258 - RNA, 19 nt, Homo sapiens
gcaccaacguccggagaaa

SEQ ID NO: 1223259 - RNA, 19 nt, Homo sapiens
gcagcuaugaugaacuuua

SEQ ID NO: 1223260 - RNA, 19 nt, Homo sapiens
gagcugguucgauccauua

SEQ ID NO: 1223261 - RNA, 19 nt, Homo sapiens
ucugaucacuggauggaua

SEQ ID NO: 1223262 - RNA, 19 nt, Homo sapiens
cagcagcuaugaugaacuu

SEQ ID NO: 1223263 - RNA, 19 nt, Homo sapiens
cauccaaccugccugagaa

SEQ ID NO: 1223264 - RNA, 19 nt, Homo sapiens
gaccuuuggcucagauuua

SEQ ID NO: 1223265 - RNA, 19 nt, Homo sapiens
uacauuagcccuuaugauu

SEQ ID NO: 1223266 - RNA, 19 nt, Homo sapiens
gguggcaaguugaaauuau

SEQ ID NO: 1223267 - RNA, 19 nt, Homo sapiens
ggacugccauccauuuaac

SEQ ID NO: 1223268 - RNA, 19 nt, Homo sapiens
caaaucuccugacuuaugg

SEQ ID NO: 1223269 - RNA, 19 nt, Homo sapiens
gaaacacagauaccaaguu

SEQ ID NO: 1223270 - RNA, 19 nt, Homo sapiens
uaguagagauggaguuuca

SEQ ID NO: 1223271 - RNA, 19 nt, Homo sapiens
caaggugacccaugcauug

SEQ ID NO: 1223272 - RNA, 19 nt, Homo sapiens
gaugaacuuuacuaugaga

SEQ ID NO: 1223273 - RNA, 19 nt, Homo sapiens
ggaagaaggcagcagacaa

SEQ ID NO: 1223274 - RNA, 19 nt, Homo sapiens
uggcucagauuuaggguaa

SEQ ID NO: 1223275 - RNA, 19 nt, Homo sapiens
caaccugccugagaauuuc

SEQ ID NO: 1223276 - RNA, 19 nt, Homo sapiens
agagugggcucccuaaaca

SEQ ID NO: 1223277 - RNA, 19 nt, Homo sapiens
gcucuggucagccuugaua

SEQ ID NO: 1223278 - RNA, 19 nt, Homo sapiens
cuaacaggcugccaugugu

SEQ ID NO: 1223279 - RNA, 19 nt, Homo sapiens
caacagcugccucugaaau

SEQ ID NO: 1223280 - RNA, 19 nt, Homo sapiens
ccaaagugcugggauuaca

SEQ ID NO: 1223281 - RNA, 19 nt, Homo sapiens
gcuacauccugcuuccuuu

SEQ ID NO: 1223282 - RNA, 19 nt, Homo sapiens
aaacagaucaacucucaga

SEQ ID NO: 1223283 - RNA, 19 nt, Homo sapiens
ucacauauggcgacacauu

SEQ ID NO: 1223284 - RNA, 19 nt, Homo sapiens
cauuagcccuuaugauugu

SEQ ID NO: 1223285 - RNA, 19 nt, Homo sapiens
caaaugagacuguacuuuu

SEQ ID NO: 1223286 - RNA, 19 nt, Homo sapiens
guggcaaguugaaauuauu

SEQ ID NO: 1223287 - RNA, 19 nt, Homo sapiens
guguagauguagguucuua

SEQ ID NO: 1223288 - RNA, 19 nt, Homo sapiens
gcuucgagauccucccuuu

SEQ ID NO: 1223289 - RNA, 19 nt, Homo sapiens
gcucagauuuaggguaaga

SEQ ID NO: 1223290 - RNA, 19 nt, Homo sapiens
gugcuuggcuugaaaucug

SEQ ID NO: 1223291 - RNA, 19 nt, Homo sapiens
uguagcuacugacuaauuu

SEQ ID NO: 1223292 - RNA, 19 nt, Homo sapiens
acagaucaacucucagaua

SEQ ID NO: 1223293 - RNA, 19 nt, Homo sapiens
ccucacauuuccaaucuug

SEQ ID NO: 1223294 - RNA, 19 nt, Homo sapiens
uacacaaacugcucugcua

SEQ ID NO: 1223295 - RNA, 19 nt, Homo sapiens
gcaaggugacccaugcauu

SEQ ID NO: 1223296 - RNA, 19 nt, Homo sapiens
gcugccauguguagaugua

SEQ ID NO: 1223297 - RNA, 19 nt, Homo sapiens
uccuauggaucucuauaua

SEQ ID NO: 1223298 - RNA, 19 nt, Homo sapiens
gcauaaggccuccauucug

SEQ ID NO: 1223299 - RNA, 19 nt, Homo sapiens
acaauagggucaccaccuu

SEQ ID NO: 1223300 - RNA, 19 nt, Homo sapiens
caagccagggauaaucuua

SEQ ID NO: 1223301 - RNA, 19 nt, Homo sapiens
gccaagaaguccugcucaa

SEQ ID NO: 1223302 - RNA, 19 nt, Homo sapiens
guccuacgcugcugugaau

SEQ ID NO: 1223303 - RNA, 19 nt, Homo sapiens
aggaguaagugcaggaauu

SEQ ID NO: 1223304 - RNA, 19 nt, Homo sapiens
cccaacagcugccucugaa

SEQ ID NO: 1223305 - RNA, 19 nt, Homo sapiens
ccaaccugccugagaauuu

SEQ ID NO: 1223306 - RNA, 19 nt, Homo sapiens
aaucacauaucccaacugu

SEQ ID NO: 1223307 - RNA, 19 nt, Homo sapiens
gcuaugaugaacuuuacua

SEQ ID NO: 1223308 - RNA, 19 nt, Homo sapiens
uuucuaaucugcuuuacug

SEQ ID NO: 1223309 - RNA, 19 nt, Homo sapiens
caauagggucaccaccuua

SEQ ID NO: 1223310 - RNA, 19 nt, Homo sapiens
ggaaggaagcagcuagcaa

SEQ ID NO: 1223311 - RNA, 19 nt, Homo sapiens
gaaguuccuuaugucaaau

SEQ ID NO: 1223312 - RNA, 19 nt, Homo sapiens
uaucacauauggcgacaca

SEQ ID NO: 1223313 - RNA, 19 nt, Homo sapiens
gggcugugcuuggcuugaa

SEQ ID NO: 1223314 - RNA, 19 nt, Homo sapiens
uaaauuugcugaaguuccu

SEQ ID NO: 1223315 - RNA, 19 nt, Homo sapiens
gguagaguuuauuguaaca

SEQ ID NO: 1223316 - RNA, 19 nt, Homo sapiens
agauguagguucuuaagag

SEQ ID NO: 1223317 - RNA, 19 nt, Homo sapiens
acuauaggcuuucccaaca

SEQ ID NO: 1223318 - RNA, 19 nt, Homo sapiens
uggaaccacuauaggcuuu

SEQ ID NO: 1223319 - RNA, 19 nt, Homo sapiens
ucaauauccugaguucaug

SEQ ID NO: 1223320 - RNA, 19 nt, Homo sapiens
gaccugaugguagaguuua

SEQ ID NO: 1223321 - RNA, 19 nt, Homo sapiens
ggugacccaugcauugguu

SEQ ID NO: 1223322 - RNA, 19 nt, Homo sapiens
uugcugaaguuccuuaugu

SEQ ID NO: 1223323 - RNA, 19 nt, Homo sapiens
ggaguaagugcaggaauuc

SEQ ID NO: 1223324 - RNA, 19 nt, Homo sapiens
ugacucaucagcacaauag

SEQ ID NO: 1223325 - RNA, 19 nt, Homo sapiens
ggaccugaugguagaguuu

SEQ ID NO: 1223326 - RNA, 19 nt, Homo sapiens
acccaugcauugguuaaua

SEQ ID NO: 1223327 - RNA, 19 nt, Homo sapiens
cagcuaugaugaacuuuac

SEQ ID NO: 1223328 - RNA, 19 nt, Homo sapiens
cuaaucugcuuuacugucu

SEQ ID NO: 1223329 - RNA, 19 nt, Homo sapiens
ccaggauggucucaauauc

SEQ ID NO: 1223330 - RNA, 19 nt, Homo sapiens
ucaaaugagacuguacuuu

SEQ ID NO: 1223331 - RNA, 19 nt, Homo sapiens
uaggguguguaugaaauaa

SEQ ID NO: 1223332 - RNA, 19 nt, Homo sapiens
aaucugcuuuacugucuuu

SEQ ID NO: 1223333 - RNA, 19 nt, Homo sapiens
gcauccagguaguacacaa

SEQ ID NO: 1223334 - RNA, 19 nt, Homo sapiens
ucagauuuaggguaagaua

SEQ ID NO: 1223335 - RNA, 19 nt, Homo sapiens
gccaucaucaaccacuuua

SEQ ID NO: 1223336 - RNA, 19 nt, Homo sapiens
ucccugccguccuuuagua

SEQ ID NO: 1223337 - RNA, 19 nt, Homo sapiens
gaaaaugccucaucacuua

SEQ ID NO: 1223338 - RNA, 19 nt, Homo sapiens
gaagagagaucaugugaag

SEQ ID NO: 1223339 - RNA, 19 nt, Homo sapiens
gcucaaagaucauucauca

SEQ ID NO: 1223340 - RNA, 19 nt, Homo sapiens
gaagagcgccuguguagug

SEQ ID NO: 1223341 - RNA, 19 nt, Homo sapiens
ucauuugggugaagauuua

SEQ ID NO: 1223342 - RNA, 19 nt, Homo sapiens
guacaacagcuaauaguuu

SEQ ID NO: 1223343 - RNA, 19 nt, Homo sapiens
gcaaggcugucacaaggaa

SEQ ID NO: 1223344 - RNA, 19 nt, Homo sapiens
ggugaagauuuaaagagua

SEQ ID NO: 1223345 - RNA, 19 nt, Homo sapiens
ggaauuggguagaaacucu

SEQ ID NO: 1223346 - RNA, 19 nt, Homo sapiens
ucaaagaucauucaucaga

SEQ ID NO: 1223347 - RNA, 19 nt, Homo sapiens
cagcaggaauuaaacaugu

SEQ ID NO: 1223348 - RNA, 19 nt, Homo sapiens
ccucacagcuuccuugcaa

SEQ ID NO: 1223349 - RNA, 19 nt, Homo sapiens
gcaacagauugaagagaga

SEQ ID NO: 1223350 - RNA, 19 nt, Homo sapiens
uacaacagcuaauaguuug

SEQ ID NO: 1223351 - RNA, 19 nt, Homo sapiens
gaacagcaggaauuaaaca

SEQ ID NO: 1223352 - RNA, 19 nt, Homo sapiens
gugaacagcaggaauuaaa

SEQ ID NO: 1223353 - RNA, 19 nt, Homo sapiens
ccacccaccuuuggaauga

SEQ ID NO: 1223354 - RNA, 19 nt, Homo sapiens
gcuuugacaucuuggugua

SEQ ID NO: 1223355 - RNA, 19 nt, Homo sapiens
ggagcugugcggucuguua

SEQ ID NO: 1223356 - RNA, 19 nt, Homo sapiens
ggcaugcaguacuaucuaa

SEQ ID NO: 1223357 - RNA, 19 nt, Homo sapiens
ccaacacagugcccuuuga

SEQ ID NO: 1223358 - RNA, 19 nt, Homo sapiens
gaaccacccaccuuuggaa

SEQ ID NO: 1223359 - RNA, 19 nt, Homo sapiens
gggugaagauuuaaagagu

SEQ ID NO: 1223360 - RNA, 19 nt, Homo sapiens
gaugcaguguccaguguga

SEQ ID NO: 1223361 - RNA, 19 nt, Homo sapiens
guuccugugucuucuguuu

SEQ ID NO: 1223362 - RNA, 19 nt, Homo sapiens
gguagaaacucuccaaacc

SEQ ID NO: 1223363 - RNA, 19 nt, Homo sapiens
ccaaacaaggcaugcagua

SEQ ID NO: 1223364 - RNA, 19 nt, Homo sapiens
gggaggaauuggguagaaa

SEQ ID NO: 1223365 - RNA, 19 nt, Homo sapiens
ggaaugauugcucaaagau

SEQ ID NO: 1223366 - RNA, 19 nt, Homo sapiens
gaaaaugcgugccuuaugc

SEQ ID NO: 1223367 - RNA, 19 nt, Homo sapiens
gagcugugcggucuguuaa

SEQ ID NO: 1223368 - RNA, 19 nt, Homo sapiens
gccuuaugcuguuauagaa

SEQ ID NO: 1223369 - RNA, 19 nt, Homo sapiens
ccacuggcccugauuugaa

SEQ ID NO: 1223370 - RNA, 19 nt, Homo sapiens
ucaccugcuugccuccuua

SEQ ID NO: 1223371 - RNA, 19 nt, Homo sapiens
aacaaggcaugcaguacua

SEQ ID NO: 1223372 - RNA, 19 nt, Homo sapiens
gaucagcagcucuucuguu

SEQ ID NO: 1223373 - RNA, 19 nt, Homo sapiens
ggcgacugauuucgaguuu

SEQ ID NO: 1223374 - RNA, 19 nt, Homo sapiens
uagagaccguguaugagaa

SEQ ID NO: 1223375 - RNA, 19 nt, Homo sapiens
uggaaugauugcucaaaga

SEQ ID NO: 1223376 - RNA, 19 nt, Homo sapiens
gagcgccuguguagugugu

SEQ ID NO: 1223377 - RNA, 19 nt, Homo sapiens
uaacagccaguuuguggaa

SEQ ID NO: 1223378 - RNA, 19 nt, Homo sapiens
ggaauuaaacauguugcaa

SEQ ID NO: 1223379 - RNA, 19 nt, Homo sapiens
ggccgacacuaguaugaug

SEQ ID NO: 1223380 - RNA, 19 nt, Homo sapiens
ucaugucgcuucuccuugu

SEQ ID NO: 1223381 - RNA, 19 nt, Homo sapiens
ccaaacccaugccuccaau

SEQ ID NO: 1223382 - RNA, 19 nt, Homo sapiens
ccgaggagaugcugaaggu

SEQ ID NO: 1223383 - RNA, 19 nt, Homo sapiens
cuucaaguccugcgucuuu

SEQ ID NO: 1223384 - RNA, 19 nt, Homo sapiens
cuagagaccguguaugaga

SEQ ID NO: 1223385 - RNA, 19 nt, Homo sapiens
gcaggaauuaaacauguug

SEQ ID NO: 1223386 - RNA, 19 nt, Homo sapiens
gaaagugaagucagcacau

SEQ ID NO: 1223387 - RNA, 19 nt, Homo sapiens
ucgcagcuuugacaucuug

SEQ ID NO: 1223388 - RNA, 19 nt, Homo sapiens
cccaagaagugcccuaucu

SEQ ID NO: 1223389 - RNA, 19 nt, Homo sapiens
gaccguguaugagaaguuc

SEQ ID NO: 1223390 - RNA, 19 nt, Homo sapiens
aagaugguguggaaucgaa

SEQ ID NO: 1223391 - RNA, 19 nt, Homo sapiens
aaagugaagucagcacauc

SEQ ID NO: 1223392 - RNA, 19 nt, Homo sapiens
ggucaacuuguguuccuuu

SEQ ID NO: 1223393 - RNA, 19 nt, Homo sapiens
ggacagggagagucugaag

SEQ ID NO: 1223394 - RNA, 19 nt, Homo sapiens
gaggacagggagagucuga

SEQ ID NO: 1223395 - RNA, 19 nt, Homo sapiens
cgaguuuccggucagguua

SEQ ID NO: 1223396 - RNA, 19 nt, Homo sapiens
gcuggcacccugagcauau

SEQ ID NO: 1223397 - RNA, 19 nt, Homo sapiens
gcaccaaagccagugauca

SEQ ID NO: 1223398 - RNA, 19 nt, Homo sapiens
ugugcggucuguuaaagaa

SEQ ID NO: 1223399 - RNA, 19 nt, Homo sapiens
gcugugcggucuguuaaag

SEQ ID NO: 1223400 - RNA, 19 nt, Homo sapiens
aaucgaaccacccaccuuu

SEQ ID NO: 1223401 - RNA, 19 nt, Homo sapiens
gaaucgaaccacccaccuu

SEQ ID NO: 1223402 - RNA, 19 nt, Homo sapiens
gaccaacacagugcccuuu

SEQ ID NO: 1223403 - RNA, 19 nt, Homo sapiens
cugagcauaugcccucuug

SEQ ID NO: 1223404 - RNA, 19 nt, Homo sapiens
cgacugauuucgaguuucc

SEQ ID NO: 1223405 - RNA, 19 nt, Homo sapiens
gccacccucuucuucauuc

SEQ ID NO: 1223406 - RNA, 19 nt, Homo sapiens
caacagcuaauaguuugga

SEQ ID NO: 1223407 - RNA, 19 nt, Homo sapiens
cgucgcagcuuugacaucu

SEQ ID NO: 1223408 - RNA, 19 nt, Homo sapiens
cagcagcucuucuguuccu

SEQ ID NO: 1223409 - RNA, 19 nt, Homo sapiens
cugaagagcgccuguguag

SEQ ID NO: 1223410 - RNA, 19 nt, Homo sapiens
gaaugauugcucaaagauc

SEQ ID NO: 1223411 - RNA, 19 nt, Homo sapiens
ggaaaaugcgugccuuaug

SEQ ID NO: 1223412 - RNA, 19 nt, Homo sapiens
gauugaagagagaucaugu

SEQ ID NO: 1223413 - RNA, 19 nt, Homo sapiens
ugccagaacccaagaagug

SEQ ID NO: 1223414 - RNA, 19 nt, Homo sapiens
aaacaaggcaugcaguacu

SEQ ID NO: 1223415 - RNA, 19 nt, Homo sapiens
ccaagagaccgaggagaug

SEQ ID NO: 1223416 - RNA, 19 nt, Homo sapiens
gugugaacagcaggaauua

SEQ ID NO: 1223417 - RNA, 19 nt, Homo sapiens
cccaaaggcauccaagaga

SEQ ID NO: 1223418 - RNA, 19 nt, Homo sapiens
caguggaucugggucuaga

SEQ ID NO: 1223419 - RNA, 19 nt, Homo sapiens
ccacaugugccacccucuu

SEQ ID NO: 1223420 - RNA, 19 nt, Homo sapiens
gcccaaaggcauccaagag

SEQ ID NO: 1223421 - RNA, 19 nt, Homo sapiens
guaguuggaggucacauac

SEQ ID NO: 1223422 - RNA, 19 nt, Homo sapiens
uugaagagagaucauguga

SEQ ID NO: 1223423 - RNA, 19 nt, Homo sapiens
gggcaggucaacuuguguu

SEQ ID NO: 1223424 - RNA, 19 nt, Homo sapiens
ggugcugccuccgaagaga

SEQ ID NO: 1223425 - RNA, 19 nt, Homo sapiens
aucagcagcucuucuguuc

SEQ ID NO: 1223426 - RNA, 19 nt, Homo sapiens
ccagugaucagcagcucuu

SEQ ID NO: 1223427 - RNA, 19 nt, Homo sapiens
cagaucagugcgaguguga

SEQ ID NO: 1223428 - RNA, 19 nt, Homo sapiens
gcagaugcaggaggaguuc

SEQ ID NO: 1223429 - RNA, 19 nt, Homo sapiens
ggacuugguggaggacuca

SEQ ID NO: 1223430 - RNA, 19 nt, Homo sapiens
ggagugugggcacguuugu

SEQ ID NO: 1223431 - RNA, 19 nt, Homo sapiens
ugucugagcagcuucaagu

SEQ ID NO: 1223432 - RNA, 19 nt, Homo sapiens
ucuguuaaagaaacgcuua

SEQ ID NO: 1223433 - RNA, 19 nt, Homo sapiens
cuaguguccuggccucaca

SEQ ID NO: 1223434 - RNA, 19 nt, Homo sapiens
guugcuugcuguggacuug

SEQ ID NO: 1223435 - RNA, 19 nt, Homo sapiens
ccaagaagugcccuaucug

SEQ ID NO: 1223436 - RNA, 19 nt, Homo sapiens
gugccacccucuucuucau

SEQ ID NO: 1223437 - RNA, 19 nt, Homo sapiens
ggaaauagcuaaucagaaa

SEQ ID NO: 1223438 - RNA, 19 nt, Homo sapiens
gaagaaaccugccacagau

SEQ ID NO: 1223439 - RNA, 19 nt, Homo sapiens
gcaagagccuguuguggua

SEQ ID NO: 1223440 - RNA, 19 nt, Homo sapiens
cauuggagcuucucauuua

SEQ ID NO: 1223441 - RNA, 19 nt, Homo sapiens
ugaaguacauucuugguua

SEQ ID NO: 1223442 - RNA, 19 nt, Homo sapiens
ggaagcaaauuuaugaaga

SEQ ID NO: 1223443 - RNA, 19 nt, Homo sapiens
gaacugauacagggaaaua

SEQ ID NO: 1223444 - RNA, 19 nt, Homo sapiens
gagauuggaagcaaauuua

SEQ ID NO: 1223445 - RNA, 19 nt, Homo sapiens
ugacgaaucuagaacauga

SEQ ID NO: 1223446 - RNA, 19 nt, Homo sapiens
ccacacaucuccagacguu

SEQ ID NO: 1223447 - RNA, 19 nt, Homo sapiens
ggaagaaaccugccacaga

SEQ ID NO: 1223448 - RNA, 19 nt, Homo sapiens
gccagagacuccaugcuua

SEQ ID NO: 1223449 - RNA, 19 nt, Homo sapiens
gaaguagaaccaauggaua

SEQ ID NO: 1223450 - RNA, 19 nt, Homo sapiens
caacagggccaucccagua

SEQ ID NO: 1223451 - RNA, 19 nt, Homo sapiens
gaaguacauucuugguuau

SEQ ID NO: 1223452 - RNA, 19 nt, Homo sapiens
ggaaauaugcagaggugua

SEQ ID NO: 1223453 - RNA, 19 nt, Homo sapiens
gaugaucuccaccgaauaa

SEQ ID NO: 1223454 - RNA, 19 nt, Homo sapiens
gauguccaguucuaaagua

SEQ ID NO: 1223455 - RNA, 19 nt, Homo sapiens
gaaauaugcagagguguaa

SEQ ID NO: 1223456 - RNA, 19 nt, Homo sapiens
agaagaaggugacaugaug

SEQ ID NO: 1223457 - RNA, 19 nt, Homo sapiens
ccucugugcugcccaguua

SEQ ID NO: 1223458 - RNA, 19 nt, Homo sapiens
gagacuguauccaaucaaa

SEQ ID NO: 1223459 - RNA, 19 nt, Homo sapiens
gguguaaacuugugaugga

SEQ ID NO: 1223460 - RNA, 19 nt, Homo sapiens
gcagauggagccacaauug

SEQ ID NO: 1223461 - RNA, 19 nt, Homo sapiens
guauuuaucuaguggauuc

SEQ ID NO: 1223462 - RNA, 19 nt, Homo sapiens
cuaaaggguuugaacuauu

SEQ ID NO: 1223463 - RNA, 19 nt, Homo sapiens
auagugagcugccuucuug

SEQ ID NO: 1223464 - RNA, 19 nt, Homo sapiens
gaaagaagaaguagaacca

SEQ ID NO: 1223465 - RNA, 19 nt, Homo sapiens
ccgaauaaacgaacugaua

SEQ ID NO: 1223466 - RNA, 19 nt, Homo sapiens
gaaguccacugccaagagu

SEQ ID NO: 1223467 - RNA, 19 nt, Homo sapiens
caagcgagcugccacaucu

SEQ ID NO: 1223468 - RNA, 19 nt, Homo sapiens
gcugugauguccaguucua

SEQ ID NO: 1223469 - RNA, 19 nt, Homo sapiens
ccacucggaccaucuguua

SEQ ID NO: 1223470 - RNA, 19 nt, Homo sapiens
aaacagcacugaugaugag

SEQ ID NO: 1223471 - RNA, 19 nt, Homo sapiens
gaaccaauggauaucauga

SEQ ID NO: 1223472 - RNA, 19 nt, Homo sapiens
guucugaaguacauucuug

SEQ ID NO: 1223473 - RNA, 19 nt, Homo sapiens
ggagauuggaagcaaauuu

SEQ ID NO: 1223474 - RNA, 19 nt, Homo sapiens
gcacaucauucaccaacca

SEQ ID NO: 1223475 - RNA, 19 nt, Homo sapiens
cuacaaaugugcaaauguc

SEQ ID NO: 1223476 - RNA, 19 nt, Homo sapiens
gugaugcuguuaauuguau

SEQ ID NO: 1223477 - RNA, 19 nt, Homo sapiens
gcagagguguaaacuugug

SEQ ID NO: 1223478 - RNA, 19 nt, Homo sapiens
gaaucacacuaccaucuca

SEQ ID NO: 1223479 - RNA, 19 nt, Homo sapiens
caucaugacuacaaaugug

SEQ ID NO: 1223480 - RNA, 19 nt, Homo sapiens
ggugugaugcuguuaauug

SEQ ID NO: 1223481 - RNA, 19 nt, Homo sapiens
gcaggcaacaccauaaguu

SEQ ID NO: 1223482 - RNA, 19 nt, Homo sapiens
ugaggaaggugugagauau

SEQ ID NO: 1223483 - RNA, 19 nt, Homo sapiens
ccaaggaguauauugauga

SEQ ID NO: 1223484 - RNA, 19 nt, Homo sapiens
caugugaucucaacagaag

SEQ ID NO: 1223485 - RNA, 19 nt, Homo sapiens
gauacagccugcaccacuu

SEQ ID NO: 1223486 - RNA, 19 nt, Homo sapiens
ccaguaaccugcaucacau

SEQ ID NO: 1223487 - RNA, 19 nt, Homo sapiens
augcagagguguaaacuug

SEQ ID NO: 1223488 - RNA, 19 nt, Homo sapiens
ucaacaguuuccucgguua

SEQ ID NO: 1223489 - RNA, 19 nt, Homo sapiens
ccacaucucacacucuaaa

SEQ ID NO: 1223490 - RNA, 19 nt, Homo sapiens
gaccaucuguuaucucucu

SEQ ID NO: 1223491 - RNA, 19 nt, Homo sapiens
aaccugaucugugucauaa

SEQ ID NO: 1223492 - RNA, 19 nt, Homo sapiens
caaaguggaacauugaaau

SEQ ID NO: 1223493 - RNA, 19 nt, Homo sapiens
gaaauccacgugucuaugg

SEQ ID NO: 1223494 - RNA, 19 nt, Homo sapiens
ccucacagcugccaaaugc

SEQ ID NO: 1223495 - RNA, 19 nt, Homo sapiens
uaaccugcaucacaucaug

SEQ ID NO: 1223496 - RNA, 19 nt, Homo sapiens
uagcaucccucaagcuuca

SEQ ID NO: 1223497 - RNA, 19 nt, Homo sapiens
gagaguagcaucccucaag

SEQ ID NO: 1223498 - RNA, 19 nt, Homo sapiens
ugaaauaaaggaaguguuc

SEQ ID NO: 1223499 - RNA, 19 nt, Homo sapiens
ggucaaagaggagaagaaa

SEQ ID NO: 1223500 - RNA, 19 nt, Homo sapiens
ggaguauauugaugaggaa

SEQ ID NO: 1223501 - RNA, 19 nt, Homo sapiens
gauaucaugaggccaguuu

SEQ ID NO: 1223502 - RNA, 19 nt, Homo sapiens
cgagaggaguagccugauu

SEQ ID NO: 1223503 - RNA, 19 nt, Homo sapiens
cgagaugucacaacaagaa

SEQ ID NO: 1223504 - RNA, 19 nt, Homo sapiens
gaaagcaacagcaugugau

SEQ ID NO: 1223505 - RNA, 19 nt, Homo sapiens
ccaguuccguguccacuau

SEQ ID NO: 1223506 - RNA, 19 nt, Homo sapiens
uaaagaccguguccugaag

SEQ ID NO: 1223507 - RNA, 19 nt, Homo sapiens
ucuaaaggguuugaacuau

SEQ ID NO: 1223508 - RNA, 19 nt, Homo sapiens
uguuaucucucuacacuga

SEQ ID NO: 1223509 - RNA, 19 nt, Homo sapiens
gcacugaugaugagaaguc

SEQ ID NO: 1223510 - RNA, 19 nt, Homo sapiens
caaacagcacugaugauga

SEQ ID NO: 1223511 - RNA, 19 nt, Homo sapiens
gcaacagcaugugaucuca

SEQ ID NO: 1223512 - RNA, 19 nt, Homo sapiens
ccaccgaccauuccaacua

SEQ ID NO: 1223513 - RNA, 19 nt, Homo sapiens
gcuccaaacucugccauca

SEQ ID NO: 1223514 - RNA, 19 nt, Homo sapiens
aaacagcagcuucauacaa

SEQ ID NO: 1223515 - RNA, 19 nt, Homo sapiens
caaaugugcaaaugucuau

SEQ ID NO: 1223516 - RNA, 19 nt, Homo sapiens
uguuaaaccugaucugugu

SEQ ID NO: 1223517 - RNA, 19 nt, Homo sapiens
ccagagacuccaugcuuaa

SEQ ID NO: 1223518 - RNA, 19 nt, Homo sapiens
agacaaacagcacugauga

SEQ ID NO: 1223519 - RNA, 19 nt, Homo sapiens
ccguucaguuccaauauuu

SEQ ID NO: 1223520 - RNA, 19 nt, Homo sapiens
caaguaccauuguuaccau

SEQ ID NO: 1223521 - RNA, 19 nt, Homo sapiens
aacagcagcuucauacaau

SEQ ID NO: 1223522 - RNA, 19 nt, Homo sapiens
gagccuggacugaaaguau

SEQ ID NO: 1223523 - RNA, 19 nt, Homo sapiens
caaauugaagcgaaaggaa

SEQ ID NO: 1223524 - RNA, 19 nt, Homo sapiens
gagacaaacagcacugaug

SEQ ID NO: 1223525 - RNA, 19 nt, Homo sapiens
ccagggagcacaugaguuc

SEQ ID NO: 1223526 - RNA, 19 nt, Homo sapiens
acacaucuccagacguuaa

SEQ ID NO: 1223527 - RNA, 19 nt, Homo sapiens
gguuaucuguacuucugua

SEQ ID NO: 1223528 - RNA, 19 nt, Homo sapiens
gcucucagauccuuguucu

SEQ ID NO: 1223529 - RNA, 19 nt, Homo sapiens
caagaacgggacugucaaa

SEQ ID NO: 1223530 - RNA, 19 nt, Homo sapiens
gaagcaagagccuguugug

SEQ ID NO: 1223531 - RNA, 19 nt, Homo sapiens
cgaaagcaacagcauguga

SEQ ID NO: 1223532 - RNA, 19 nt, Homo sapiens
gcagugguguuggcagaug

SEQ ID NO: 1223533 - RNA, 19 nt, Homo sapiens
caucacaucaugacuacaa

SEQ ID NO: 1223534 - RNA, 19 nt, Homo sapiens
uuacuuugcuucgucacua

SEQ ID NO: 1223535 - RNA, 19 nt, Homo sapiens
gaagaaguagaaccaaugg

SEQ ID NO: 1223536 - RNA, 19 nt, Homo sapiens
ggccaacccuauuagcaau

SEQ ID NO: 1223537 - RNA, 19 nt, Homo sapiens
uagaagagcuuaagaguaa

SEQ ID NO: 1223538 - RNA, 19 nt, Homo sapiens
gaaaucaggcuuauguuua

SEQ ID NO: 1223539 - RNA, 19 nt, Homo sapiens
gaaaugaaccggacaagaa

SEQ ID NO: 1223540 - RNA, 19 nt, Homo sapiens
gauaacagaucaccucaaa

SEQ ID NO: 1223541 - RNA, 19 nt, Homo sapiens
caucauagcuucauuguuc

SEQ ID NO: 1223542 - RNA, 19 nt, Homo sapiens
gaacaaagaccuauaucaa

SEQ ID NO: 1223543 - RNA, 19 nt, Homo sapiens
gaagauagguaagagguaa

SEQ ID NO: 1223544 - RNA, 19 nt, Homo sapiens
gaaguaauguuagauguga

SEQ ID NO: 1223545 - RNA, 19 nt, Homo sapiens
gcacuuggguuuagaggaa

SEQ ID NO: 1223546 - RNA, 19 nt, Homo sapiens
cuacaaagaugaagaacuu

SEQ ID NO: 1223547 - RNA, 19 nt, Homo sapiens
ggaacgaagugauaaguau

SEQ ID NO: 1223548 - RNA, 19 nt, Homo sapiens
aaauagcacucuagccuua

SEQ ID NO: 1223549 - RNA, 19 nt, Homo sapiens
cgaaauagauuguuuacag

SEQ ID NO: 1223550 - RNA, 19 nt, Homo sapiens
gaaagugaaccuaugcuaa

SEQ ID NO: 1223551 - RNA, 19 nt, Homo sapiens
ugaggaaccugauaaguug

SEQ ID NO: 1223552 - RNA, 19 nt, Homo sapiens
acaaagaccuauaucaaga

SEQ ID NO: 1223553 - RNA, 19 nt, Homo sapiens
ucuauacacugcucaauaa

SEQ ID NO: 1223554 - RNA, 19 nt, Homo sapiens
gaaaauugguguuugauga

SEQ ID NO: 1223555 - RNA, 19 nt, Homo sapiens
gaacgaagugauaaguaua

SEQ ID NO: 1223556 - RNA, 19 nt, Homo sapiens
gaacagcuaaugaaaucua

SEQ ID NO: 1223557 - RNA, 19 nt, Homo sapiens
aaacugagcuaaaccuuuc

SEQ ID NO: 1223558 - RNA, 19 nt, Homo sapiens
ggacgaaauagauuguuua

SEQ ID NO: 1223559 - RNA, 19 nt, Homo sapiens
gaugguggauuaaccugua

SEQ ID NO: 1223560 - RNA, 19 nt, Homo sapiens
ggaacacgauagcaaauuc

SEQ ID NO: 1223561 - RNA, 19 nt, Homo sapiens
cagaacagcuaaugaaauc

SEQ ID NO: 1223562 - RNA, 19 nt, Homo sapiens
caaagaauaugaggacgaa

SEQ ID NO: 1223563 - RNA, 19 nt, Homo sapiens
aaacuauucuggauccuuu

SEQ ID NO: 1223564 - RNA, 19 nt, Homo sapiens
gauuugugguugaagaaua

SEQ ID NO: 1223565 - RNA, 19 nt, Homo sapiens
aagcagaccuuaacuguuc

SEQ ID NO: 1223566 - RNA, 19 nt, Homo sapiens
gaaagaagcuaugaauucc

SEQ ID NO: 1223567 - RNA, 19 nt, Homo sapiens
gagaugcacagucuucaua

SEQ ID NO: 1223568 - RNA, 19 nt, Homo sapiens
gcaggaaaguaccagcaaa

SEQ ID NO: 1223569 - RNA, 19 nt, Homo sapiens
gaaaauccuugcaaagaaa

SEQ ID NO: 1223570 - RNA, 19 nt, Homo sapiens
caucaacaaccauguauuu

SEQ ID NO: 1223571 - RNA, 19 nt, Homo sapiens
uuagaaaggugucauuugu

SEQ ID NO: 1223572 - RNA, 19 nt, Homo sapiens
ugaaagaugauguggauaa

SEQ ID NO: 1223573 - RNA, 19 nt, Homo sapiens
ucacagauaauccaaguaa

SEQ ID NO: 1223574 - RNA, 19 nt, Homo sapiens
caaagguucucuaacuaau

SEQ ID NO: 1223575 - RNA, 19 nt, Homo sapiens
gauagcaaauucuguugga

SEQ ID NO: 1223576 - RNA, 19 nt, Homo sapiens
gaaagaaguagaagagcuu

SEQ ID NO: 1223577 - RNA, 19 nt, Homo sapiens
gaagaauaauagccagugu

SEQ ID NO: 1223578 - RNA, 19 nt, Homo sapiens
gcauggagcacuuggguuu

SEQ ID NO: 1223579 - RNA, 19 nt, Homo sapiens
acacuugaguuuaagcuuu

SEQ ID NO: 1223580 - RNA, 19 nt, Homo sapiens
caauaagacacuugaguuu

SEQ ID NO: 1223581 - RNA, 19 nt, Homo sapiens
acagguagaaguaauguua

SEQ ID NO: 1223582 - RNA, 19 nt, Homo sapiens
acaaacaucuagucacaga

SEQ ID NO: 1223583 - RNA, 19 nt, Homo sapiens
agacaaacaucuagucaca

SEQ ID NO: 1223584 - RNA, 19 nt, Homo sapiens
ggacaagaacauccaguga

SEQ ID NO: 1223585 - RNA, 19 nt, Homo sapiens
gaagagaaagaagcuauga

SEQ ID NO: 1223586 - RNA, 19 nt, Homo sapiens
guauauagaggaacuagaa

SEQ ID NO: 1223587 - RNA, 19 nt, Homo sapiens
guagaagagcuuaagagua

SEQ ID NO: 1223588 - RNA, 19 nt, Homo sapiens
uaagagguaagcacaauuu

SEQ ID NO: 1223589 - RNA, 19 nt, Homo sapiens
gguuggauauacauuguuu

SEQ ID NO: 1223590 - RNA, 19 nt, Homo sapiens
gaaguuagggaggagguua

SEQ ID NO: 1223591 - RNA, 19 nt, Homo sapiens
uaaaccaagugacugugua

SEQ ID NO: 1223592 - RNA, 19 nt, Homo sapiens
agaaagaagcuaugaauuc

SEQ ID NO: 1223593 - RNA, 19 nt, Homo sapiens
gagaaagaagcuaugaauu

SEQ ID NO: 1223594 - RNA, 19 nt, Homo sapiens
gaaagaugauguggauaag

SEQ ID NO: 1223595 - RNA, 19 nt, Homo sapiens
gaaauuauaggaggaacaa

SEQ ID NO: 1223596 - RNA, 19 nt, Homo sapiens
guucuaaacguauuuggua

SEQ ID NO: 1223597 - RNA, 19 nt, Homo sapiens
ccaaagguucucuaacuaa

SEQ ID NO: 1223598 - RNA, 19 nt, Homo sapiens
ggauuuggauggguuauca

SEQ ID NO: 1223599 - RNA, 19 nt, Homo sapiens
ugaguuggauucaaugaug

SEQ ID NO: 1223600 - RNA, 19 nt, Homo sapiens
gguaagagguaagcacaau

SEQ ID NO: 1223601 - RNA, 19 nt, Homo sapiens
gaauaaaccaagugacugu

SEQ ID NO: 1223602 - RNA, 19 nt, Homo sapiens
ucaagaacagguagaagua

SEQ ID NO: 1223603 - RNA, 19 nt, Homo sapiens
gaagcuaugaauuccauuu

SEQ ID NO: 1223604 - RNA, 19 nt, Homo sapiens
ggauuuguauugauuugug

SEQ ID NO: 1223605 - RNA, 19 nt, Homo sapiens
uagaggaacuagaaucuca

SEQ ID NO: 1223606 - RNA, 19 nt, Homo sapiens
gcuaaaggaggcaaauaaa

SEQ ID NO: 1223607 - RNA, 19 nt, Homo sapiens
gaagacaaacaucuaguca

SEQ ID NO: 1223608 - RNA, 19 nt, Homo sapiens
gauggaugcugcuuaccuu

SEQ ID NO: 1223609 - RNA, 19 nt, Homo sapiens
caaagcagaccuuaacugu

SEQ ID NO: 1223610 - RNA, 19 nt, Homo sapiens
caguucacaucgacuauuu

SEQ ID NO: 1223611 - RNA, 19 nt, Homo sapiens
aaauggaagugaauggaaa

SEQ ID NO: 1223612 - RNA, 19 nt, Homo sapiens
gcacucaaaccaucucaga

SEQ ID NO: 1223613 - RNA, 19 nt, Homo sapiens
uaagauguccucagagaug

SEQ ID NO: 1223614 - RNA, 19 nt, Homo sapiens
gaugauauaaguagaagug

SEQ ID NO: 1223615 - RNA, 19 nt, Homo sapiens
caagaaagcccuggaacga

SEQ ID NO: 1223616 - RNA, 19 nt, Homo sapiens
cauuaauacugcaugcuuu

SEQ ID NO: 1223617 - RNA, 19 nt, Homo sapiens
ugagaaaucaggcuuaugu

SEQ ID NO: 1223618 - RNA, 19 nt, Homo sapiens
ccucagagaugcacagucu

SEQ ID NO: 1223619 - RNA, 19 nt, Homo sapiens
gcucuucaguccaaaguag

SEQ ID NO: 1223620 - RNA, 19 nt, Homo sapiens
caaccaaaaugaagacaaa

SEQ ID NO: 1223621 - RNA, 19 nt, Homo sapiens
gcacugaacauuuuacauu

SEQ ID NO: 1223622 - RNA, 19 nt, Homo sapiens
guaguauguuucuuguuug

SEQ ID NO: 1223623 - RNA, 19 nt, Homo sapiens
gcucagaccgugcagaaug

SEQ ID NO: 1223624 - RNA, 19 nt, Homo sapiens
aagguucucuaacuaauga

SEQ ID NO: 1223625 - RNA, 19 nt, Homo sapiens
uuaagucacuggauuugga

SEQ ID NO: 1223626 - RNA, 19 nt, Homo sapiens
gacaagaacauccagugaa

SEQ ID NO: 1223627 - RNA, 19 nt, Homo sapiens
gaugugacagauacaagua

SEQ ID NO: 1223628 - RNA, 19 nt, Homo sapiens
gauguggugucaaagaauc

SEQ ID NO: 1223629 - RNA, 19 nt, Homo sapiens
gaucaaaacuauucuggau

SEQ ID NO: 1223630 - RNA, 19 nt, Homo sapiens
gaauggaaacccacuucuu

SEQ ID NO: 1223631 - RNA, 19 nt, Homo sapiens
ccugauaaguuggaagaaa

SEQ ID NO: 1223632 - RNA, 19 nt, Homo sapiens
ucaaggcagugaauuucuu

SEQ ID NO: 1223633 - RNA, 19 nt, Homo sapiens
gaaguagaagagcuuaaga

SEQ ID NO: 1223634 - RNA, 19 nt, Homo sapiens
aauggaaacccacuucuuu

SEQ ID NO: 1223635 - RNA, 19 nt, Homo sapiens
acaagaacauccagugaag

SEQ ID NO: 1223636 - RNA, 19 nt, Homo sapiens
ccaaaagguugaauucuau

SEQ ID NO: 1223637 - RNA, 19 nt, Homo sapiens
ugagaaagcuggacuauua

SEQ ID NO: 1223638 - RNA, 19 nt, Homo sapiens
gaaauacucucauggcaaa

SEQ ID NO: 1223639 - RNA, 19 nt, Homo sapiens
gaacaguugucgauuauga

SEQ ID NO: 1223640 - RNA, 19 nt, Homo sapiens
gaagugaaaucaauacaga

SEQ ID NO: 1223641 - RNA, 19 nt, Homo sapiens
guagguagaugcauuugua

SEQ ID NO: 1223642 - RNA, 19 nt, Homo sapiens
ggaggcagauauccacuua

SEQ ID NO: 1223643 - RNA, 19 nt, Homo sapiens
gaugauaaccacagucuua

SEQ ID NO: 1223644 - RNA, 19 nt, Homo sapiens
ggagaaaugcaaacgauua

SEQ ID NO: 1223645 - RNA, 19 nt, Homo sapiens
ggaagacaauuuaaugaug

SEQ ID NO: 1223646 - RNA, 19 nt, Homo sapiens
gaaauaaggagauuacgaa

SEQ ID NO: 1223647 - RNA, 19 nt, Homo sapiens
cugcuuaacugaugaaaua

SEQ ID NO: 1223648 - RNA, 19 nt, Homo sapiens
agaagaagcuuucagauuc

SEQ ID NO: 1223649 - RNA, 19 nt, Homo sapiens
gcaaauauuuauccucuca

SEQ ID NO: 1223650 - RNA, 19 nt, Homo sapiens
gcagaaacaaucagacaua

SEQ ID NO: 1223651 - RNA, 19 nt, Homo sapiens
gaugagaagugaaaucaau

SEQ ID NO: 1223652 - RNA, 19 nt, Homo sapiens
gaaauuagccagacacaag

SEQ ID NO: 1223653 - RNA, 19 nt, Homo sapiens
gacaagagauagcaaacuu

SEQ ID NO: 1223654 - RNA, 19 nt, Homo sapiens
gaacauggugaauggaaua

SEQ ID NO: 1223655 - RNA, 19 nt, Homo sapiens
ucaagcaacuucagagaaa

SEQ ID NO: 1223656 - RNA, 19 nt, Homo sapiens
gguaaggucucuacagguu

SEQ ID NO: 1223657 - RNA, 19 nt, Homo sapiens
gaaaccauaucucaagcaa

SEQ ID NO: 1223658 - RNA, 19 nt, Homo sapiens
uaaccacagucuuacauuu

SEQ ID NO: 1223659 - RNA, 19 nt, Homo sapiens
gaaguaaaguguucuaucc

SEQ ID NO: 1223660 - RNA, 19 nt, Homo sapiens
gcagauauccacuuaacuu

SEQ ID NO: 1223661 - RNA, 19 nt, Homo sapiens
gcuguaagguaccaaacua

SEQ ID NO: 1223662 - RNA, 19 nt, Homo sapiens
gaaacaaucagacauaaag

SEQ ID NO: 1223663 - RNA, 19 nt, Homo sapiens
gacagggacuacagaaauu

SEQ ID NO: 1223664 - RNA, 19 nt, Homo sapiens
ugaaaucaauacagaggua

SEQ ID NO: 1223665 - RNA, 19 nt, Homo sapiens
gaucaguuauuugcgguua

SEQ ID NO: 1223666 - RNA, 19 nt, Homo sapiens
gacguugcuucguguauua

SEQ ID NO: 1223667 - RNA, 19 nt, Homo sapiens
cuacaacccucaagccaaa

SEQ ID NO: 1223668 - RNA, 19 nt, Homo sapiens
ggacagggacuacagaaau

SEQ ID NO: 1223669 - RNA, 19 nt, Homo sapiens
gcacagcucuacagcaucu

SEQ ID NO: 1223670 - RNA, 19 nt, Homo sapiens
uaaaggaacuaguacaucu

SEQ ID NO: 1223671 - RNA, 19 nt, Homo sapiens
aagcugauauucacacuuu

SEQ ID NO: 1223672 - RNA, 19 nt, Homo sapiens
ccgaguaucugggauuaua

SEQ ID NO: 1223673 - RNA, 19 nt, Homo sapiens
ggaauuccauugacacagu

SEQ ID NO: 1223674 - RNA, 19 nt, Homo sapiens
gaagguccguggccauuca

SEQ ID NO: 1223675 - RNA, 19 nt, Homo sapiens
caaaguugcccuucagaaa

SEQ ID NO: 1223676 - RNA, 19 nt, Homo sapiens
cagaaacaaucagacauaa

SEQ ID NO: 1223677 - RNA, 19 nt, Homo sapiens
ugagaauucuguucaaaug

SEQ ID NO: 1223678 - RNA, 19 nt, Homo sapiens
acacuuugauucuggauaa

SEQ ID NO: 1223679 - RNA, 19 nt, Homo sapiens
ggucgaauaugaaugacuu

SEQ ID NO: 1223680 - RNA, 19 nt, Homo sapiens
uaauacuacuggucgaaua

SEQ ID NO: 1223681 - RNA, 19 nt, Homo sapiens
gagaaaucauuaccagaau

SEQ ID NO: 1223682 - RNA, 19 nt, Homo sapiens
caacugagcagaaacaauc

SEQ ID NO: 1223683 - RNA, 19 nt, Homo sapiens
caaaugaugagaagugaaa

SEQ ID NO: 1223684 - RNA, 19 nt, Homo sapiens
ggauaaacaguaaugauga

SEQ ID NO: 1223685 - RNA, 19 nt, Homo sapiens
gagaaaugcaaacgauuaa

SEQ ID NO: 1223686 - RNA, 19 nt, Homo sapiens
gauggaggcuggcucuguu

SEQ ID NO: 1223687 - RNA, 19 nt, Homo sapiens
aaaccucacuuuacuuguu

SEQ ID NO: 1223688 - RNA, 19 nt, Homo sapiens
uggcauaucuccuccuuug

SEQ ID NO: 1223689 - RNA, 19 nt, Homo sapiens
gagaaacuucccaugauuu

SEQ ID NO: 1223690 - RNA, 19 nt, Homo sapiens
gcucccagcucaugguauu

SEQ ID NO: 1223691 - RNA, 19 nt, Homo sapiens
uaacugaauugcaucaaca

SEQ ID NO: 1223692 - RNA, 19 nt, Homo sapiens
ugaagaacauggugaaugg

SEQ ID NO: 1223693 - RNA, 19 nt, Homo sapiens
guuuauugcuucugaugua

SEQ ID NO: 1223694 - RNA, 19 nt, Homo sapiens
cgucuaaguuccuggcaua

SEQ ID NO: 1223695 - RNA, 19 nt, Homo sapiens
agaaagagaugaagaacgu

SEQ ID NO: 1223696 - RNA, 19 nt, Homo sapiens
cagagaaacuucccaugau

SEQ ID NO: 1223697 - RNA, 19 nt, Homo sapiens
auacagagguaaaugagaa

SEQ ID NO: 1223698 - RNA, 19 nt, Homo sapiens
aaagccagguguuggauaa

SEQ ID NO: 1223699 - RNA, 19 nt, Homo sapiens
gcaaacgauuaauacaguu

SEQ ID NO: 1223700 - RNA, 19 nt, Homo sapiens
guaagguaccaaacuauuu

SEQ ID NO: 1223701 - RNA, 19 nt, Homo sapiens
caucaccucucuuagaaug

SEQ ID NO: 1223702 - RNA, 19 nt, Homo sapiens
ggaguccucuugugaucaa

SEQ ID NO: 1223703 - RNA, 19 nt, Homo sapiens
gaaauccggcuacgcagaa

SEQ ID NO: 1223704 - RNA, 19 nt, Homo sapiens
aauaaucagugcuaucuug

SEQ ID NO: 1223705 - RNA, 19 nt, Homo sapiens
cugaauggcucuauaguca

SEQ ID NO: 1223706 - RNA, 19 nt, Homo sapiens
ggacaauagucugcuugaa

SEQ ID NO: 1223707 - RNA, 19 nt, Homo sapiens
agucagauauggcaaagaa

SEQ ID NO: 1223708 - RNA, 19 nt, Homo sapiens
agagaaacuucccaugauu

SEQ ID NO: 1223709 - RNA, 19 nt, Homo sapiens
caaaugagaauucuguuca

SEQ ID NO: 1223710 - RNA, 19 nt, Homo sapiens
ggagaaauaagauuguguu

SEQ ID NO: 1223711 - RNA, 19 nt, Homo sapiens
cauaugaaguaaaguguuc

SEQ ID NO: 1223712 - RNA, 19 nt, Homo sapiens
gauagcaaacuucacauug

SEQ ID NO: 1223713 - RNA, 19 nt, Homo sapiens
gaagaggaacagccuuuau

SEQ ID NO: 1223714 - RNA, 19 nt, Homo sapiens
ggaagaggaacagccuuua

SEQ ID NO: 1223715 - RNA, 19 nt, Homo sapiens
acauccagcuuguccaaua

SEQ ID NO: 1223716 - RNA, 19 nt, Homo sapiens
gaauggcucuauagucaag

SEQ ID NO: 1223717 - RNA, 19 nt, Homo sapiens
caucuggaauggcugaauu

SEQ ID NO: 1223718 - RNA, 19 nt, Homo sapiens
guacguggcauuuguuguu

SEQ ID NO: 1223719 - RNA, 19 nt, Homo sapiens
uuacagacauacagcuauu

SEQ ID NO: 1223720 - RNA, 19 nt, Homo sapiens
gguagaugcauuuguaauu

SEQ ID NO: 1223721 - RNA, 19 nt, Homo sapiens
ggaagaaaagguaggauua

SEQ ID NO: 1223722 - RNA, 19 nt, Homo sapiens
ccaaagaugugcguuacga

SEQ ID NO: 1223723 - RNA, 19 nt, Homo sapiens
gaaaauacacaaccagaaa

SEQ ID NO: 1223724 - RNA, 19 nt, Homo sapiens
ggaaagugaacccgucauu

SEQ ID NO: 1223725 - RNA, 19 nt, Homo sapiens
gaaggaaaguuugaaagcu

SEQ ID NO: 1223726 - RNA, 19 nt, Homo sapiens
gauauucacacuuugauuc

SEQ ID NO: 1223727 - RNA, 19 nt, Homo sapiens
gagcugaguuuucauuuug

SEQ ID NO: 1223728 - RNA, 19 nt, Homo sapiens
ugacggugcuucuguagau

SEQ ID NO: 1223729 - RNA, 19 nt, Homo sapiens
caucgaaacauccauuauu

SEQ ID NO: 1223730 - RNA, 19 nt, Homo sapiens
uaaggucucuacagguuug

SEQ ID NO: 1223731 - RNA, 19 nt, Homo sapiens
gaaagccagguguuggaua

SEQ ID NO: 1223732 - RNA, 19 nt, Homo sapiens
ccuagaagaugaugguguu

SEQ ID NO: 1223733 - RNA, 19 nt, Homo sapiens
gaaauccgagacuuaaaug

SEQ ID NO: 1223734 - RNA, 19 nt, Homo sapiens
gaaauaugaggauugugaa

SEQ ID NO: 1223735 - RNA, 19 nt, Homo sapiens
gcacuuuauuucuuaacug

SEQ ID NO: 1223736 - RNA, 19 nt, Homo sapiens
acaauagucugcuugaaca

SEQ ID NO: 1223737 - RNA, 19 nt, Homo sapiens
gaaaggacgauucuuauuu

SEQ ID NO: 1223738 - RNA, 19 nt, Homo sapiens
gaagugaaguggacuaaau

SEQ ID NO: 1223739 - RNA, 19 nt, Homo sapiens
caauguaacugcaaaucua

SEQ ID NO: 1223740 - RNA, 19 nt, Homo sapiens
gcagucaucuauucauuga

SEQ ID NO: 1223741 - RNA, 19 nt, Homo sapiens
caaucuggcuguaaacuaa

SEQ ID NO: 1223742 - RNA, 19 nt, Homo sapiens
cgucaacgcuggacacuuu

SEQ ID NO: 1223743 - RNA, 19 nt, Homo sapiens
caccaaagcugaucucuca

SEQ ID NO: 1223744 - RNA, 19 nt, Homo sapiens
ggacguugcuguucucugu

SEQ ID NO: 1223745 - RNA, 19 nt, Homo sapiens
ggccagggcuucccagauu

SEQ ID NO: 1223746 - RNA, 19 nt, Homo sapiens
aaaccugcauuauccuuua

SEQ ID NO: 1223747 - RNA, 19 nt, Homo sapiens
gaauguuguucuugaggua

SEQ ID NO: 1223748 - RNA, 19 nt, Homo sapiens
ugagguaccugauucaaga

SEQ ID NO: 1223749 - RNA, 19 nt, Homo sapiens
aaacccaccucaaagagua

SEQ ID NO: 1223750 - RNA, 19 nt, Homo sapiens
gagaggaucacuugaggua

SEQ ID NO: 1223751 - RNA, 19 nt, Homo sapiens
gucauucagucucuaaaua

SEQ ID NO: 1223752 - RNA, 19 nt, Homo sapiens
uaaaguacagccucacaua

SEQ ID NO: 1223753 - RNA, 19 nt, Homo sapiens
gcuggacacuuuagccuuu

SEQ ID NO: 1223754 - RNA, 19 nt, Homo sapiens
gaacuuguugaccagauua

SEQ ID NO: 1223755 - RNA, 19 nt, Homo sapiens
aaaggacgauucuuauuuc

SEQ ID NO: 1223756 - RNA, 19 nt, Homo sapiens
caucaucucugugcacuga

SEQ ID NO: 1223757 - RNA, 19 nt, Homo sapiens
aaugaaaggacgauucuua

SEQ ID NO: 1223758 - RNA, 19 nt, Homo sapiens
gaaaugaaaggacgauucu

SEQ ID NO: 1223759 - RNA, 19 nt, Homo sapiens
cccauuagcugcuggauuc

SEQ ID NO: 1223760 - RNA, 19 nt, Homo sapiens
augcaucaguuccuuaaua

SEQ ID NO: 1223761 - RNA, 19 nt, Homo sapiens
ggaaaugaaaggacgauuc

SEQ ID NO: 1223762 - RNA, 19 nt, Homo sapiens
caaagcugaucucucauuc

SEQ ID NO: 1223763 - RNA, 19 nt, Homo sapiens
gauauggacagcuuacuau

SEQ ID NO: 1223764 - RNA, 19 nt, Homo sapiens
aaauagauauggacagcuu

SEQ ID NO: 1223765 - RNA, 19 nt, Homo sapiens
gccagggcuucccagauua

SEQ ID NO: 1223766 - RNA, 19 nt, Homo sapiens
gcaaucuggcuguaaacua

SEQ ID NO: 1223767 - RNA, 19 nt, Homo sapiens
caaccaaacuggauauucc

SEQ ID NO: 1223768 - RNA, 19 nt, Homo sapiens
gaccacaaauagauaugga

SEQ ID NO: 1223769 - RNA, 19 nt, Homo sapiens
gcgugaauguuguucuuga

SEQ ID NO: 1223770 - RNA, 19 nt, Homo sapiens
guacauucggugagauuaa

SEQ ID NO: 1223771 - RNA, 19 nt, Homo sapiens
uaugcaaucuggcuguaaa

SEQ ID NO: 1223772 - RNA, 19 nt, Homo sapiens
ccugcauuauccuuuauua

SEQ ID NO: 1223773 - RNA, 19 nt, Homo sapiens
auacacagaugcaggugaa

SEQ ID NO: 1223774 - RNA, 19 nt, Homo sapiens
cuacugcugcuaaauauga

SEQ ID NO: 1223775 - RNA, 19 nt, Homo sapiens
ugaaaggacgauucuuauu

SEQ ID NO: 1223776 - RNA, 19 nt, Homo sapiens
cagcuuacuauucuucaua

SEQ ID NO: 1223777 - RNA, 19 nt, Homo sapiens
ggacagcuuacuauucuuc

SEQ ID NO: 1223778 - RNA, 19 nt, Homo sapiens
ccaaagcugaucucucauu

SEQ ID NO: 1223779 - RNA, 19 nt, Homo sapiens
aagcagucaucuauucauu

SEQ ID NO: 1223780 - RNA, 19 nt, Homo sapiens
gaggccaacucaggaaaug

SEQ ID NO: 1223781 - RNA, 19 nt, Homo sapiens
gggcuuugguuauagaagu

SEQ ID NO: 1223782 - RNA, 19 nt, Homo sapiens
cauaaggggucugggauua

SEQ ID NO: 1223783 - RNA, 19 nt, Homo sapiens
uaacuucuucuucccguuu

SEQ ID NO: 1223784 - RNA, 19 nt, Homo sapiens
gcagacuucagauucguuu

SEQ ID NO: 1223785 - RNA, 19 nt, Homo sapiens
ucaucucugugcacugaua

SEQ ID NO: 1223786 - RNA, 19 nt, Homo sapiens
gcaucaguuccuuaauaua

SEQ ID NO: 1223787 - RNA, 19 nt, Homo sapiens
aaaggucccuaucacuguu

SEQ ID NO: 1223788 - RNA, 19 nt, Homo sapiens
uacauucggugagauuaaa

SEQ ID NO: 1223789 - RNA, 19 nt, Homo sapiens
caucaguuccuuaauauac

SEQ ID NO: 1223790 - RNA, 19 nt, Homo sapiens
ugcaucaguuccuuaauau

SEQ ID NO: 1223791 - RNA, 19 nt, Homo sapiens
ugaacuuguugaccagauu

SEQ ID NO: 1223792 - RNA, 19 nt, Homo sapiens
ucacggacguugcuguucu

SEQ ID NO: 1223793 - RNA, 19 nt, Homo sapiens
ggauuauucagaccacaaa

SEQ ID NO: 1223794 - RNA, 19 nt, Homo sapiens
gcaaacccaccucaaagag

SEQ ID NO: 1223795 - RNA, 19 nt, Homo sapiens
gaggcgagaggaucacuug

SEQ ID NO: 1223796 - RNA, 19 nt, Homo sapiens
caaacuauaaaccugcauu

SEQ ID NO: 1223797 - RNA, 19 nt, Homo sapiens
augccaggcugcccuuuaa

SEQ ID NO: 1223798 - RNA, 19 nt, Homo sapiens
ggccaacucaggaaaugaa

SEQ ID NO: 1223799 - RNA, 19 nt, Homo sapiens
acagcaaacccaccucaaa

SEQ ID NO: 1223800 - RNA, 19 nt, Homo sapiens
gacugcagcuccguggauu

SEQ ID NO: 1223801 - RNA, 19 nt, Homo sapiens
aagcugaucucucauucgu

SEQ ID NO: 1223802 - RNA, 19 nt, Homo sapiens
caaacuggauauuccuacu

SEQ ID NO: 1223803 - RNA, 19 nt, Homo sapiens
ucauauguuuccuucacaa

SEQ ID NO: 1223804 - RNA, 19 nt, Homo sapiens
ccagaaguaccugaugaaa

SEQ ID NO: 1223805 - RNA, 19 nt, Homo sapiens
uaaaccugcauuauccuuu

SEQ ID NO: 1223806 - RNA, 19 nt, Homo sapiens
cagcaaacccaccucaaag

SEQ ID NO: 1223807 - RNA, 19 nt, Homo sapiens
cuaauuucauccuccuuuc

SEQ ID NO: 1223808 - RNA, 19 nt, Homo sapiens
ucagaugcaucaguuccuu

SEQ ID NO: 1223809 - RNA, 19 nt, Homo sapiens
ccacugcgguuacuuuugu

SEQ ID NO: 1223810 - RNA, 19 nt, Homo sapiens
ucacuugagguaccugauu

SEQ ID NO: 1223811 - RNA, 19 nt, Homo sapiens
aagugaaguggacuaaaua

SEQ ID NO: 1223812 - RNA, 19 nt, Homo sapiens
cagauuacguggccccuuu

SEQ ID NO: 1223813 - RNA, 19 nt, Homo sapiens
ggguuccucugcagacuuc

SEQ ID NO: 1223814 - RNA, 19 nt, Homo sapiens
cagaugcaucaguuccuua

SEQ ID NO: 1223815 - RNA, 19 nt, Homo sapiens
agauauggacagcuuacua

SEQ ID NO: 1223816 - RNA, 19 nt, Homo sapiens
aaucauauguuuccuucac

SEQ ID NO: 1223817 - RNA, 19 nt, Homo sapiens
agaaguaccugaugaaaac

SEQ ID NO: 1223818 - RNA, 19 nt, Homo sapiens
caacucaggaaaugaaagg

SEQ ID NO: 1223819 - RNA, 19 nt, Homo sapiens
gcagccgacucucgucaac

SEQ ID NO: 1223820 - RNA, 19 nt, Homo sapiens
ucccugacaucaucucugu

SEQ ID NO: 1223821 - RNA, 19 nt, Homo sapiens
cuucgucccugacaucauc

SEQ ID NO: 1223822 - RNA, 19 nt, Homo sapiens
ucacaaccaaacuggauau

SEQ ID NO: 1223823 - RNA, 19 nt, Homo sapiens
gaaugcugaaucauauguu

SEQ ID NO: 1223824 - RNA, 19 nt, Homo sapiens
guuugacaaugcucagaug

SEQ ID NO: 1223825 - RNA, 19 nt, Homo sapiens
ucucugugucugugacuua

SEQ ID NO: 1223826 - RNA, 19 nt, Homo sapiens
gccaaaauagucaauguaa

SEQ ID NO: 1223827 - RNA, 19 nt, Homo sapiens
ggcuguaaacuaagacuga

SEQ ID NO: 1223828 - RNA, 19 nt, Homo sapiens
uagcacaacugagcaagac

SEQ ID NO: 1223829 - RNA, 19 nt, Homo sapiens
auggacagcuuacuauucu

SEQ ID NO: 1223830 - RNA, 19 nt, Homo sapiens
cacuugagguaccugauuc

SEQ ID NO: 1223831 - RNA, 19 nt, Homo sapiens
caaacccaccucaaagagu

SEQ ID NO: 1223832 - RNA, 19 nt, Homo sapiens
ucuaauuucauccuccuuu

SEQ ID NO: 1223833 - RNA, 19 nt, Homo sapiens
guacugguucacaccugua

SEQ ID NO: 1223834 - RNA, 19 nt, Homo sapiens
ucucugugcacugauaaua

SEQ ID NO: 1223835 - RNA, 19 nt, Homo sapiens
guaaaguacagccucacau

SEQ ID NO: 1223836 - RNA, 19 nt, Homo sapiens
gacgggaggacacugaugu

SEQ ID NO: 1223837 - RNA, 19 nt, Homo sapiens
gagaagaacuugaacguuu

SEQ ID NO: 1223838 - RNA, 19 nt, Homo sapiens
gcaccaagaugccuucuaa

SEQ ID NO: 1223839 - RNA, 19 nt, Homo sapiens
ggaagggucuccuauuuau

SEQ ID NO: 1223840 - RNA, 19 nt, Homo sapiens
ggaaggaucugguucaaca

SEQ ID NO: 1223841 - RNA, 19 nt, Homo sapiens
gaaagaauccaguguagaa

SEQ ID NO: 1223842 - RNA, 19 nt, Homo sapiens
gaagaaagaauccagugua

SEQ ID NO: 1223843 - RNA, 19 nt, Homo sapiens
gaaggucgguggcgaguga

SEQ ID NO: 1223844 - RNA, 19 nt, Homo sapiens
aaauagugcucgagucuua

SEQ ID NO: 1223845 - RNA, 19 nt, Homo sapiens
gaagguggucuuuggauua

SEQ ID NO: 1223846 - RNA, 19 nt, Homo sapiens
ggaacacucucuaaauuuc

SEQ ID NO: 1223847 - RNA, 19 nt, Homo sapiens
gauaaaggcucuaguuagg

SEQ ID NO: 1223848 - RNA, 19 nt, Homo sapiens
gggcugaucugauuacuuc

SEQ ID NO: 1223849 - RNA, 19 nt, Homo sapiens
gaacaguauuaaucccuuu

SEQ ID NO: 1223850 - RNA, 19 nt, Homo sapiens
gaggagcucuagaaacauu

SEQ ID NO: 1223851 - RNA, 19 nt, Homo sapiens
cagacuggcucaaggauaa

SEQ ID NO: 1223852 - RNA, 19 nt, Homo sapiens
guacaugacugagaagaga

SEQ ID NO: 1223853 - RNA, 19 nt, Homo sapiens
gacagaagcccacuuaguu

SEQ ID NO: 1223854 - RNA, 19 nt, Homo sapiens
ugaagaggaugcacuguga

SEQ ID NO: 1223855 - RNA, 19 nt, Homo sapiens
gggaagggucuccuauuua

SEQ ID NO: 1223856 - RNA, 19 nt, Homo sapiens
guauugcucuucugauuau

SEQ ID NO: 1223857 - RNA, 19 nt, Homo sapiens
ugacagugcucgcugagaa

SEQ ID NO: 1223858 - RNA, 19 nt, Homo sapiens
gcaggacaguggccauuug

SEQ ID NO: 1223859 - RNA, 19 nt, Homo sapiens
ccucggcucuccuugaaua

SEQ ID NO: 1223860 - RNA, 19 nt, Homo sapiens
gcucaaggauaaugacuuc

SEQ ID NO: 1223861 - RNA, 19 nt, Homo sapiens
gcacaaacccuuaggaaaa

SEQ ID NO: 1223862 - RNA, 19 nt, Homo sapiens
gugacaggauguuagauaa

SEQ ID NO: 1223863 - RNA, 19 nt, Homo sapiens
gguggucuuuggauuauuu

SEQ ID NO: 1223864 - RNA, 19 nt, Homo sapiens
gacgauggcucaugucaca

SEQ ID NO: 1223865 - RNA, 19 nt, Homo sapiens
ugggaagggucuccuauuu

SEQ ID NO: 1223866 - RNA, 19 nt, Homo sapiens
uggaggagcucuagaaaca

SEQ ID NO: 1223867 - RNA, 19 nt, Homo sapiens
gcuucauucuuucacauua

SEQ ID NO: 1223868 - RNA, 19 nt, Homo sapiens
ugggaugacuccauuauau

SEQ ID NO: 1223869 - RNA, 19 nt, Homo sapiens
gcaaguaccacacacuguu

SEQ ID NO: 1223870 - RNA, 19 nt, Homo sapiens
gggcauugcagccauuaua

SEQ ID NO: 1223871 - RNA, 19 nt, Homo sapiens
ggacagaagcccacuuagu

SEQ ID NO: 1223872 - RNA, 19 nt, Homo sapiens
uaagagugguguggcauuu

SEQ ID NO: 1223873 - RNA, 19 nt, Homo sapiens
cuggaacacucucuaaauu

SEQ ID NO: 1223874 - RNA, 19 nt, Homo sapiens
guguagaaguugagaagaa

SEQ ID NO: 1223875 - RNA, 19 nt, Homo sapiens
gguagacccuuccuuugga

SEQ ID NO: 1223876 - RNA, 19 nt, Homo sapiens
gguauugcucuucugauua

SEQ ID NO: 1223877 - RNA, 19 nt, Homo sapiens
ucucucggcucuucucuaa

SEQ ID NO: 1223878 - RNA, 19 nt, Homo sapiens
guauuaaucccuuugagaa

SEQ ID NO: 1223879 - RNA, 19 nt, Homo sapiens
ggugacaggauguuagaua

SEQ ID NO: 1223880 - RNA, 19 nt, Homo sapiens
caucagcuguuucauaucu

SEQ ID NO: 1223881 - RNA, 19 nt, Homo sapiens
gcagauaggcugguugaug

SEQ ID NO: 1223882 - RNA, 19 nt, Homo sapiens
ggucaugcacuuugggaua

SEQ ID NO: 1223883 - RNA, 19 nt, Homo sapiens
ccacacacuguuugaauuu

SEQ ID NO: 1223884 - RNA, 19 nt, Homo sapiens
gcucuucggucaugcacuu

SEQ ID NO: 1223885 - RNA, 19 nt, Homo sapiens
ggaucugguucauggaauu

SEQ ID NO: 1223886 - RNA, 19 nt, Homo sapiens
aaagccagcagaacucuua

SEQ ID NO: 1223887 - RNA, 19 nt, Homo sapiens
gcaucccgcucaccuuuau

SEQ ID NO: 1223888 - RNA, 19 nt, Homo sapiens
caaacuggcuucugaucca

SEQ ID NO: 1223889 - RNA, 19 nt, Homo sapiens
uguagaagauggcgaaaca

SEQ ID NO: 1223890 - RNA, 19 nt, Homo sapiens
aguaagagcaggaguguuu

SEQ ID NO: 1223891 - RNA, 19 nt, Homo sapiens
uaaggucacuguccuaggu

SEQ ID NO: 1223892 - RNA, 19 nt, Homo sapiens
gugcucgagucuuagguua

SEQ ID NO: 1223893 - RNA, 19 nt, Homo sapiens
uaugggaagucuuauuaga

SEQ ID NO: 1223894 - RNA, 19 nt, Homo sapiens
gacauaccuuggacccuaa

SEQ ID NO: 1223895 - RNA, 19 nt, Homo sapiens
gaaugaaacaugcaaguac

SEQ ID NO: 1223896 - RNA, 19 nt, Homo sapiens
cccaaacccuggcuuauuc

SEQ ID NO: 1223897 - RNA, 19 nt, Homo sapiens
ugcagugccugacagaaua

SEQ ID NO: 1223898 - RNA, 19 nt, Homo sapiens
ggugggaucuaggaagaaa

SEQ ID NO: 1223899 - RNA, 19 nt, Homo sapiens
acaagacgauggcucaugu

SEQ ID NO: 1223900 - RNA, 19 nt, Homo sapiens
agugaucccucaugaugua

SEQ ID NO: 1223901 - RNA, 19 nt, Homo sapiens
gacaggauguuagauaaag

SEQ ID NO: 1223902 - RNA, 19 nt, Homo sapiens
aaacuggauuacucuggua

SEQ ID NO: 1223903 - RNA, 19 nt, Homo sapiens
ggauaaugacuuccucuug

SEQ ID NO: 1223904 - RNA, 19 nt, Homo sapiens
gaaacaggcaacauuugga

SEQ ID NO: 1223905 - RNA, 19 nt, Homo sapiens
ggucuccuauuuauucaau

SEQ ID NO: 1223906 - RNA, 19 nt, Homo sapiens
uaaaucauaccucaaagga

SEQ ID NO: 1223907 - RNA, 19 nt, Homo sapiens
ucacuuccauggugucuca

SEQ ID NO: 1223908 - RNA, 19 nt, Homo sapiens
gugcagcccugucacaaca

SEQ ID NO: 1223909 - RNA, 19 nt, Homo sapiens
cgagugaucccucaugaug

SEQ ID NO: 1223910 - RNA, 19 nt, Homo sapiens
gggagaacaaagaaauuaa

SEQ ID NO: 1223911 - RNA, 19 nt, Homo sapiens
ggaguuucguuucaugauc

SEQ ID NO: 1223912 - RNA, 19 nt, Homo sapiens
gcucuucucuaaacuggau

SEQ ID NO: 1223913 - RNA, 19 nt, Homo sapiens
cucuacagcuucauucuuu

SEQ ID NO: 1223914 - RNA, 19 nt, Homo sapiens
caacagcacguaucagaag

SEQ ID NO: 1223915 - RNA, 19 nt, Homo sapiens
ugacaugaccacucccuuu

SEQ ID NO: 1223916 - RNA, 19 nt, Homo sapiens
gugcaucaauugggagaaa

SEQ ID NO: 1223917 - RNA, 19 nt, Homo sapiens
cucaucagcuguuucauau

SEQ ID NO: 1223918 - RNA, 19 nt, Homo sapiens
gccauucucugccuuucuu

SEQ ID NO: 1223919 - RNA, 19 nt, Homo sapiens
guugggaccucuacagcuu

SEQ ID NO: 1223920 - RNA, 19 nt, Homo sapiens
agaauccaguguagaaguu

SEQ ID NO: 1223921 - RNA, 19 nt, Homo sapiens
uuagguuacugucaucaaa

SEQ ID NO: 1223922 - RNA, 19 nt, Homo sapiens
gauuaggaaagaugaguuu

SEQ ID NO: 1223923 - RNA, 19 nt, Homo sapiens
acagaaacaggcaacauuu

SEQ ID NO: 1223924 - RNA, 19 nt, Homo sapiens
uuccuuggcuuuauuauuc

SEQ ID NO: 1223925 - RNA, 19 nt, Homo sapiens
aagaaagaauccaguguag

SEQ ID NO: 1223926 - RNA, 19 nt, Homo sapiens
ucucuaaauuucccucuau

SEQ ID NO: 1223927 - RNA, 19 nt, Homo sapiens
ucagcuguuucauaucuuu

SEQ ID NO: 1223928 - RNA, 19 nt, Homo sapiens
ucucuaaacuggauuacuc

SEQ ID NO: 1223929 - RNA, 19 nt, Homo sapiens
gcaacagcacguaucagaa

SEQ ID NO: 1223930 - RNA, 19 nt, Homo sapiens
gaagcccacuuaguuucuu

SEQ ID NO: 1223931 - RNA, 19 nt, Homo sapiens
gacagaauaaagaacagua

SEQ ID NO: 1223932 - RNA, 19 nt, Homo sapiens
ggaagaaagaauccagugu

SEQ ID NO: 1223933 - RNA, 19 nt, Homo sapiens
caauagaguuuucucaguu

SEQ ID NO: 1223934 - RNA, 19 nt, Homo sapiens
ggccuccuaugccuucuuu

SEQ ID NO: 1223935 - RNA, 19 nt, Homo sapiens
ucacugaaccucacuuuac

SEQ ID NO: 1223936 - RNA, 19 nt, Homo sapiens
ggaccuuucucugacauag

SEQ ID NO: 1223937 - RNA, 19 nt, Homo sapiens
ggacuuuccuuaccuguuu

SEQ ID NO: 1223938 - RNA, 19 nt, Homo sapiens
gaagaggcauugaggacuu

SEQ ID NO: 1223939 - RNA, 19 nt, Homo sapiens
agagaaugcuguccaguuu

SEQ ID NO: 1223940 - RNA, 19 nt, Homo sapiens
ccuguaagauggucaacua

SEQ ID NO: 1223941 - RNA, 19 nt, Homo sapiens
gaaaaggguccaauuaaaa

SEQ ID NO: 1223942 - RNA, 19 nt, Homo sapiens
ucaacuacaugcaguauca

SEQ ID NO: 1223943 - RNA, 19 nt, Homo sapiens
gccagugccuuggauauuu

SEQ ID NO: 1223944 - RNA, 19 nt, Homo sapiens
guucuggucuugccucauu

SEQ ID NO: 1223945 - RNA, 19 nt, Homo sapiens
ucaacgggcuucugauguu

SEQ ID NO: 1223946 - RNA, 19 nt, Homo sapiens
gcacacaacagccacauag

SEQ ID NO: 1223947 - RNA, 19 nt, Homo sapiens
uaaucaggcugcccuuuga

SEQ ID NO: 1223948 - RNA, 19 nt, Homo sapiens
ccaggaaccucugcagcua

SEQ ID NO: 1223949 - RNA, 19 nt, Homo sapiens
gagaaggacauucguagug

SEQ ID NO: 1223950 - RNA, 19 nt, Homo sapiens
guaagauggucaacuacau

SEQ ID NO: 1223951 - RNA, 19 nt, Homo sapiens
ugaaaaggguccaauuaaa

SEQ ID NO: 1223952 - RNA, 19 nt, Homo sapiens
guagugauguagaagaauc

SEQ ID NO: 1223953 - RNA, 19 nt, Homo sapiens
gcaggacagguucugguua

SEQ ID NO: 1223954 - RNA, 19 nt, Homo sapiens
agaaggacauucguaguga

SEQ ID NO: 1223955 - RNA, 19 nt, Homo sapiens
gaaggacauucguagugau

SEQ ID NO: 1223956 - RNA, 19 nt, Homo sapiens
gcuggagguuucucuucua

SEQ ID NO: 1223957 - RNA, 19 nt, Homo sapiens
gaaccucugcagcuaaaga

SEQ ID NO: 1223958 - RNA, 19 nt, Homo sapiens
gaggccagcuggagguuuc

SEQ ID NO: 1223959 - RNA, 19 nt, Homo sapiens
gaaggcugaugaucugucu

SEQ ID NO: 1223960 - RNA, 19 nt, Homo sapiens
agaaugcuguccaguuuca

SEQ ID NO: 1223961 - RNA, 19 nt, Homo sapiens
ucaaggagcaggugauaca

SEQ ID NO: 1223962 - RNA, 19 nt, Homo sapiens
caucuucuccuuugucuuc

SEQ ID NO: 1223963 - RNA, 19 nt, Homo sapiens
gcuggaggccuguaagaug

SEQ ID NO: 1223964 - RNA, 19 nt, Homo sapiens
ccaugcgccuugccuuuga

SEQ ID NO: 1223965 - RNA, 19 nt, Homo sapiens
gcugaaaaggguccaauua

SEQ ID NO: 1223966 - RNA, 19 nt, Homo sapiens
ccagugccuuggauauuuc

SEQ ID NO: 1223967 - RNA, 19 nt, Homo sapiens
gugaauaaacacagaagug

SEQ ID NO: 1223968 - RNA, 19 nt, Homo sapiens
gcugugggcaccaguaaug

SEQ ID NO: 1223969 - RNA, 19 nt, Homo sapiens
cagagaaugcuguccaguu

SEQ ID NO: 1223970 - RNA, 19 nt, Homo sapiens
caggacagguucugguuac

SEQ ID NO: 1223971 - RNA, 19 nt, Homo sapiens
ugggaaggcugaugaucug

SEQ ID NO: 1223972 - RNA, 19 nt, Homo sapiens
aggaaccucugcagcuaaa

SEQ ID NO: 1223973 - RNA, 19 nt, Homo sapiens
ggagaaggacauucguagu

SEQ ID NO: 1223974 - RNA, 19 nt, Homo sapiens
uaagauggucaacuacaug

SEQ ID NO: 1223975 - RNA, 19 nt, Homo sapiens
gaugucaagcgcaaggauu

SEQ ID NO: 1223976 - RNA, 19 nt, Homo sapiens
cugaugaccuucuccuaca

SEQ ID NO: 1223977 - RNA, 19 nt, Homo sapiens
ugaagaagggccagaugga

SEQ ID NO: 1223978 - RNA, 19 nt, Homo sapiens
ucuuggagcuggguuucua

SEQ ID NO: 1223979 - RNA, 19 nt, Homo sapiens
gaccccagcugaccaagaa

SEQ ID NO: 1223980 - RNA, 19 nt, Homo sapiens
ucguagugauguagaagaa

SEQ ID NO: 1223981 - RNA, 19 nt, Homo sapiens
ggccaugcgccuugccuuu

SEQ ID NO: 1223982 - RNA, 19 nt, Homo sapiens
gacgcucucuuccucaucu

SEQ ID NO: 1223983 - RNA, 19 nt, Homo sapiens
gcucucuggugcugcuguu

SEQ ID NO: 1223984 - RNA, 19 nt, Homo sapiens
acgccacgcuggagaaaca

SEQ ID NO: 1223985 - RNA, 19 nt, Homo sapiens
gcgccuugccuuugagaga

SEQ ID NO: 1223986 - RNA, 19 nt, Homo sapiens
aagaggcauugaggacuuu

SEQ ID NO: 1223987 - RNA, 19 nt, Homo sapiens
gagaaugcuguccaguuuc

SEQ ID NO: 1223988 - RNA, 19 nt, Homo sapiens
ccacccagauccucuacac

SEQ ID NO: 1223989 - RNA, 19 nt, Homo sapiens
caacgccacgcuggagaaa

SEQ ID NO: 1223990 - RNA, 19 nt, Homo sapiens
aagaaucagacuccaguga

SEQ ID NO: 1223991 - RNA, 19 nt, Homo sapiens
agaagggccagauggagaa

SEQ ID NO: 1223992 - RNA, 19 nt, Homo sapiens
uuccucaucuucuccuuug

SEQ ID NO: 1223993 - RNA, 19 nt, Homo sapiens
gcgacgcucucuuccucau

SEQ ID NO: 1223994 - RNA, 19 nt, Homo sapiens
ggucaacuacaugcaguau

SEQ ID NO: 1223995 - RNA, 19 nt, Homo sapiens
caggaaccucugcagcuaa

SEQ ID NO: 1223996 - RNA, 19 nt, Homo sapiens
cuacaugcaguaucagcaa

SEQ ID NO: 1223997 - RNA, 19 nt, Homo sapiens
gccuugccuuugagagauu

SEQ ID NO: 1223998 - RNA, 19 nt, Homo sapiens
cugauuagaagccucauuc

SEQ ID NO: 1223999 - RNA, 19 nt, Homo sapiens
gauuagaagccucauucag

SEQ ID NO: 1224000 - RNA, 19 nt, Homo sapiens
gaccaacaggcacacaaca

SEQ ID NO: 1224001 - RNA, 19 nt, Homo sapiens
cgcaugcucuauagcuuca

SEQ ID NO: 1224002 - RNA, 19 nt, Homo sapiens
auuagaagccucauucagu

SEQ ID NO: 1224003 - RNA, 19 nt, Homo sapiens
gccaugcgccuugccuuug

SEQ ID NO: 1224004 - RNA, 19 nt, Homo sapiens
ggcaggacagguucugguu

SEQ ID NO: 1224005 - RNA, 19 nt, Homo sapiens
ccagauggagaaggacauu

SEQ ID NO: 1224006 - RNA, 19 nt, Homo sapiens
ccacauacuacgaguccau

SEQ ID NO: 1224007 - RNA, 19 nt, Homo sapiens
cagauccucuacaccacau

SEQ ID NO: 1224008 - RNA, 19 nt, Homo sapiens
gccaaccugcugcgcauug

SEQ ID NO: 1224009 - RNA, 19 nt, Homo sapiens
ucacguggacagagcuaga

SEQ ID NO: 1224010 - RNA, 19 nt, Homo sapiens
cagcagacccagcgauggu

SEQ ID NO: 1224011 - RNA, 19 nt, Homo sapiens
gcagauacgaugacaaaua

SEQ ID NO: 1224012 - RNA, 19 nt, Homo sapiens
ggcaagaacuacaucauuu

SEQ ID NO: 1224013 - RNA, 19 nt, Homo sapiens
gcaaguauuucauuucuca

SEQ ID NO: 1224014 - RNA, 19 nt, Homo sapiens
caacagggcuggccuugga

SEQ ID NO: 1224015 - RNA, 19 nt, Homo sapiens
uaaggagacucuaaugaaa

SEQ ID NO: 1224016 - RNA, 19 nt, Homo sapiens
uggaugcgcugaagaauaa

SEQ ID NO: 1224017 - RNA, 19 nt, Homo sapiens
caaggaauuucugggauua

SEQ ID NO: 1224018 - RNA, 19 nt, Homo sapiens
gagagagacucgucagaga

SEQ ID NO: 1224019 - RNA, 19 nt, Homo sapiens
ucgagaagauccucaagua

SEQ ID NO: 1224020 - RNA, 19 nt, Homo sapiens
ggucagaacuugagcacau

SEQ ID NO: 1224021 - RNA, 19 nt, Homo sapiens
ggacgugguucaaguucaa

SEQ ID NO: 1224022 - RNA, 19 nt, Homo sapiens
cuaaagaucuacagcaauc

SEQ ID NO: 1224023 - RNA, 19 nt, Homo sapiens
cagaauuacuugucuugaa

SEQ ID NO: 1224024 - RNA, 19 nt, Homo sapiens
agagaugccugcuuccuaa

SEQ ID NO: 1224025 - RNA, 19 nt, Homo sapiens
aaacccaggugcuacauga

SEQ ID NO: 1224026 - RNA, 19 nt, Homo sapiens
cagauacgaugacaaauac

SEQ ID NO: 1224027 - RNA, 19 nt, Homo sapiens
aaacauguaugccaagaag

SEQ ID NO: 1224028 - RNA, 19 nt, Homo sapiens
gacgguugcuguccucauu

SEQ ID NO: 1224029 - RNA, 19 nt, Homo sapiens
gcacauccguggaaaauca

SEQ ID NO: 1224030 - RNA, 19 nt, Homo sapiens
ggacuguggugacaacucu

SEQ ID NO: 1224031 - RNA, 19 nt, Homo sapiens
cagauucucucaugacauc

SEQ ID NO: 1224032 - RNA, 19 nt, Homo sapiens
cgaugaggauccuguauuc

SEQ ID NO: 1224033 - RNA, 19 nt, Homo sapiens
cagacaacguccucaagaa

SEQ ID NO: 1224034 - RNA, 19 nt, Homo sapiens
ugaggauccuguauucauu

SEQ ID NO: 1224035 - RNA, 19 nt, Homo sapiens
gaaacucagugcagagcau

SEQ ID NO: 1224036 - RNA, 19 nt, Homo sapiens
gccaagcgauucauucaca

SEQ ID NO: 1224037 - RNA, 19 nt, Homo sapiens
gaccagaaacaaggaauuu

SEQ ID NO: 1224038 - RNA, 19 nt, Homo sapiens
gaaacacacaaccgaauuc

SEQ ID NO: 1224039 - RNA, 19 nt, Homo sapiens
gguguacaguggugaaaug

SEQ ID NO: 1224040 - RNA, 19 nt, Homo sapiens
gagagaugccugcuuccua

SEQ ID NO: 1224041 - RNA, 19 nt, Homo sapiens
gcagggagucaucaucaaa

SEQ ID NO: 1224042 - RNA, 19 nt, Homo sapiens
ccacauggagaaauauauu

SEQ ID NO: 1224043 - RNA, 19 nt, Homo sapiens
acaaggaauuucugggauu

SEQ ID NO: 1224044 - RNA, 19 nt, Homo sapiens
aggcagaucugggcacuuu

SEQ ID NO: 1224045 - RNA, 19 nt, Homo sapiens
caucaacaaugccuacauc

SEQ ID NO: 1224046 - RNA, 19 nt, Homo sapiens
cagcaaguauuucauuucu

SEQ ID NO: 1224047 - RNA, 19 nt, Homo sapiens
aagacgcccugcaugguua

SEQ ID NO: 1224048 - RNA, 19 nt, Homo sapiens
gaccugagcugcaguugcu

SEQ ID NO: 1224049 - RNA, 19 nt, Homo sapiens
gggaacauguccuugaucu

SEQ ID NO: 1224050 - RNA, 19 nt, Homo sapiens
caaccgaauucucuacgau

SEQ ID NO: 1224051 - RNA, 19 nt, Homo sapiens
gaugccugcuuccuaaaga

SEQ ID NO: 1224052 - RNA, 19 nt, Homo sapiens
gagaagauccucaaguacu

SEQ ID NO: 1224053 - RNA, 19 nt, Homo sapiens
gaagcaaccacagagcuaa

SEQ ID NO: 1224054 - RNA, 19 nt, Homo sapiens
uuaaggagacucuaaugaa

SEQ ID NO: 1224055 - RNA, 19 nt, Homo sapiens
gaugacaaauacagcaagu

SEQ ID NO: 1224056 - RNA, 19 nt, Homo sapiens
agaagauccucaaguacuu

SEQ ID NO: 1224057 - RNA, 19 nt, Homo sapiens
ucucuacgauggccauuug

SEQ ID NO: 1224058 - RNA, 19 nt, Homo sapiens
ccuuugaaccggucucuua

SEQ ID NO: 1224059 - RNA, 19 nt, Homo sapiens
ggcagcagguguucugguu

SEQ ID NO: 1224060 - RNA, 19 nt, Homo sapiens
gaucugcugguacaacaaa

SEQ ID NO: 1224061 - RNA, 19 nt, Homo sapiens
ggaggucccacccgaaaga

SEQ ID NO: 1224062 - RNA, 19 nt, Homo sapiens
guacaacaaaggacacuuc

SEQ ID NO: 1224063 - RNA, 19 nt, Homo sapiens
gccugacgcuguuugaaga

SEQ ID NO: 1224064 - RNA, 19 nt, Homo sapiens
uuuaccacauggagaaaua

SEQ ID NO: 1224065 - RNA, 19 nt, Homo sapiens
ugauguaaccaccucauuu

SEQ ID NO: 1224066 - RNA, 19 nt, Homo sapiens
caacucuggucagguguga

SEQ ID NO: 1224067 - RNA, 19 nt, Homo sapiens
ugucaucauuggcagaauu

SEQ ID NO: 1224068 - RNA, 19 nt, Homo sapiens
uacaauggcucagguguca

SEQ ID NO: 1224069 - RNA, 19 nt, Homo sapiens
gcuucaucauccagauuua

SEQ ID NO: 1224070 - RNA, 19 nt, Homo sapiens
ggacuucuuccagcucuuu

SEQ ID NO: 1224071 - RNA, 19 nt, Homo sapiens
gagugacccuggcaguguu

SEQ ID NO: 1224072 - RNA, 19 nt, Homo sapiens
gauggccauuugcucauug

SEQ ID NO: 1224073 - RNA, 19 nt, Homo sapiens
cagcaucgccaucaacaau

SEQ ID NO: 1224074 - RNA, 19 nt, Homo sapiens
gccauuugcucauugucuu

SEQ ID NO: 1224075 - RNA, 19 nt, Homo sapiens
ugaaacacacaaccgaauu

SEQ ID NO: 1224076 - RNA, 19 nt, Homo sapiens
gcacuuacacccacguucu

SEQ ID NO: 1224077 - RNA, 19 nt, Homo sapiens
ucucauaaaccaaacaaga

SEQ ID NO: 1224078 - RNA, 19 nt, Homo sapiens
gacgcuguuugaagaguuu

SEQ ID NO: 1224079 - RNA, 19 nt, Homo sapiens
gagcgggagcugcgaaaga

SEQ ID NO: 1224080 - RNA, 19 nt, Homo sapiens
agugaaggaugaugcuauu

SEQ ID NO: 1224081 - RNA, 19 nt, Homo sapiens
gaucugcagccaagcgauu

SEQ ID NO: 1224082 - RNA, 19 nt, Homo sapiens
cguccucacucaguuauug

SEQ ID NO: 1224083 - RNA, 19 nt, Homo sapiens
ccagacaacguccucaaga

SEQ ID NO: 1224084 - RNA, 19 nt, Homo sapiens
caaauuucagaucguguuu

SEQ ID NO: 1224085 - RNA, 19 nt, Homo sapiens
uugaaccggucucuuagaa

SEQ ID NO: 1224086 - RNA, 19 nt, Homo sapiens
gcagaacagcuucgacucu

SEQ ID NO: 1224087 - RNA, 19 nt, Homo sapiens
acacuuaaggagacucuaa

SEQ ID NO: 1224088 - RNA, 19 nt, Homo sapiens
cugcagauacgaugacaaa

SEQ ID NO: 1224089 - RNA, 19 nt, Homo sapiens
uugaagaguuugagaagca

SEQ ID NO: 1224090 - RNA, 19 nt, Homo sapiens
ucacggcucuuugcaugau

SEQ ID NO: 1224091 - RNA, 19 nt, Homo sapiens
ugcuucagaucuaauguaa

SEQ ID NO: 1224092 - RNA, 19 nt, Homo sapiens
gcaagaacuacaucauuuu

SEQ ID NO: 1224093 - RNA, 19 nt, Homo sapiens
gaacgcggcaggcaagaac

SEQ ID NO: 1224094 - RNA, 19 nt, Homo sapiens
agauuuauguccaccugaa

SEQ ID NO: 1224095 - RNA, 19 nt, Homo sapiens
gaggauccuguauucauug

SEQ ID NO: 1224096 - RNA, 19 nt, Homo sapiens
gaacaugguggugcagaca

SEQ ID NO: 1224097 - RNA, 19 nt, Homo sapiens
ccaaauuucagaucguguu

SEQ ID NO: 1224098 - RNA, 19 nt, Homo sapiens
gauugcaggccaaauuuca

SEQ ID NO: 1224099 - RNA, 19 nt, Homo sapiens
gauguaaccaccucauuuu

SEQ ID NO: 1224100 - RNA, 19 nt, Homo sapiens
acacacaaccgaauucucu

SEQ ID NO: 1224101 - RNA, 19 nt, Homo sapiens
gagugaaggaugaugcuau

SEQ ID NO: 1224102 - RNA, 19 nt, Homo sapiens
ggcagauucucucaugaca

SEQ ID NO: 1224103 - RNA, 19 nt, Homo sapiens
ccagugccguggacuucuu

SEQ ID NO: 1224104 - RNA, 19 nt, Homo sapiens
aagggcagauucucucaug

SEQ ID NO: 1224105 - RNA, 19 nt, Homo sapiens
ccggugugaugagcacuua

SEQ ID NO: 1224106 - RNA, 19 nt, Homo sapiens
gaaguuccaggagcgguuu

SEQ ID NO: 1224107 - RNA, 19 nt, Homo sapiens
acaaacauguaugccaaga

SEQ ID NO: 1224108 - RNA, 19 nt, Homo sapiens
gcagaauuacuugucuuga

SEQ ID NO: 1224109 - RNA, 19 nt, Homo sapiens
gagagagggaaaugccaaa

SEQ ID NO: 1224110 - RNA, 19 nt, Homo sapiens
ccaacuugcccaucagaga

SEQ ID NO: 1224111 - RNA, 19 nt, Homo sapiens
gcauaaaucugaccuagaa

SEQ ID NO: 1224112 - RNA, 19 nt, Homo sapiens
gaaauaagaggcuguagua

SEQ ID NO: 1224113 - RNA, 19 nt, Homo sapiens
ggaaagcagugacaaagaa

SEQ ID NO: 1224114 - RNA, 19 nt, Homo sapiens
aaauggagcccucguauua

SEQ ID NO: 1224115 - RNA, 19 nt, Homo sapiens
cagaaacucucuccucgua

SEQ ID NO: 1224116 - RNA, 19 nt, Homo sapiens
ggauuaaagucaucuccua

SEQ ID NO: 1224117 - RNA, 19 nt, Homo sapiens
gagagaaggucagcuaaau

SEQ ID NO: 1224118 - RNA, 19 nt, Homo sapiens
uaagaagccucgagaacuu

SEQ ID NO: 1224119 - RNA, 19 nt, Homo sapiens
gauaaucucuuggaacugu

SEQ ID NO: 1224120 - RNA, 19 nt, Homo sapiens
agaaaugucuccaugaaga

SEQ ID NO: 1224121 - RNA, 19 nt, Homo sapiens
gaaacuggauggcuucuac

SEQ ID NO: 1224122 - RNA, 19 nt, Homo sapiens
aaucugaccuagaacauuu

SEQ ID NO: 1224123 - RNA, 19 nt, Homo sapiens
caaggacuguuuauaugaa

SEQ ID NO: 1224124 - RNA, 19 nt, Homo sapiens
ucagaaaugucuccaugaa

SEQ ID NO: 1224125 - RNA, 19 nt, Homo sapiens
gagccaggccucugauaua

SEQ ID NO: 1224126 - RNA, 19 nt, Homo sapiens
agacguagaugaguucaaa

SEQ ID NO: 1224127 - RNA, 19 nt, Homo sapiens
gaggagacguagaugaguu

SEQ ID NO: 1224128 - RNA, 19 nt, Homo sapiens
acaagaaccugguccaugu

SEQ ID NO: 1224129 - RNA, 19 nt, Homo sapiens
gagaaaucaccaccguuua

SEQ ID NO: 1224130 - RNA, 19 nt, Homo sapiens
cagcagggauggugagaga

SEQ ID NO: 1224131 - RNA, 19 nt, Homo sapiens
ucaagcgacugacauguga

SEQ ID NO: 1224132 - RNA, 19 nt, Homo sapiens
agucaaagauggaagauuc

SEQ ID NO: 1224133 - RNA, 19 nt, Homo sapiens
acacugaagucaugagaga

SEQ ID NO: 1224134 - RNA, 19 nt, Homo sapiens
caggaacacugaagucaug

SEQ ID NO: 1224135 - RNA, 19 nt, Homo sapiens
ccacacagcacaccaaugu

SEQ ID NO: 1224136 - RNA, 19 nt, Homo sapiens
caacacaauucccagaaag

SEQ ID NO: 1224137 - RNA, 19 nt, Homo sapiens
ccaacacaauucccagaaa

SEQ ID NO: 1224138 - RNA, 19 nt, Homo sapiens
gaacuugugcuagugauug

SEQ ID NO: 1224139 - RNA, 19 nt, Homo sapiens
gaaagcagugacaaagaaa

SEQ ID NO: 1224140 - RNA, 19 nt, Homo sapiens
ugagagaaauucagaaacu

SEQ ID NO: 1224141 - RNA, 19 nt, Homo sapiens
gauggaagauucuggaaaa

SEQ ID NO: 1224142 - RNA, 19 nt, Homo sapiens
ccaccugguucuugauauu

SEQ ID NO: 1224143 - RNA, 19 nt, Homo sapiens
gaaaucaccaccguuuaga

SEQ ID NO: 1224144 - RNA, 19 nt, Homo sapiens
ugaccuuacugaugagaaa

SEQ ID NO: 1224145 - RNA, 19 nt, Homo sapiens
ggaacuguaugcagcagau

SEQ ID NO: 1224146 - RNA, 19 nt, Homo sapiens
ggaggaaagcagugacaaa

SEQ ID NO: 1224147 - RNA, 19 nt, Homo sapiens
ugagcgagcuagagaaauc

SEQ ID NO: 1224148 - RNA, 19 nt, Homo sapiens
gaacacugaagucaugaga

SEQ ID NO: 1224149 - RNA, 19 nt, Homo sapiens
cccaugaccuuauccagaa

SEQ ID NO: 1224150 - RNA, 19 nt, Homo sapiens
gagaaggucagcuaaaugg

SEQ ID NO: 1224151 - RNA, 19 nt, Homo sapiens
ggagaggagacguagauga

SEQ ID NO: 1224152 - RNA, 19 nt, Homo sapiens
ggacuguuuauaugaagua

SEQ ID NO: 1224153 - RNA, 19 nt, Homo sapiens
acaagaacccaacacaauu

SEQ ID NO: 1224154 - RNA, 19 nt, Homo sapiens
aagcugagcguguugcaua

SEQ ID NO: 1224155 - RNA, 19 nt, Homo sapiens
uggcgaaccucccaccaaa

SEQ ID NO: 1224156 - RNA, 19 nt, Homo sapiens
caagaacccaacacaauuc

SEQ ID NO: 1224157 - RNA, 19 nt, Homo sapiens
agagaaaucaccaccguuu

SEQ ID NO: 1224158 - RNA, 19 nt, Homo sapiens
gagaaaacaugcuggacaa

SEQ ID NO: 1224159 - RNA, 19 nt, Homo sapiens
gagaaauucagaaacucua

SEQ ID NO: 1224160 - RNA, 19 nt, Homo sapiens
ucaaggacuguuuauauga

SEQ ID NO: 1224161 - RNA, 19 nt, Homo sapiens
gaaguugucauucuuugca

SEQ ID NO: 1224162 - RNA, 19 nt, Homo sapiens
gcagcacacagugaaauaa

SEQ ID NO: 1224163 - RNA, 19 nt, Homo sapiens
ggugagagaaggucagcua

SEQ ID NO: 1224164 - RNA, 19 nt, Homo sapiens
augccgaucuuccagaaua

SEQ ID NO: 1224165 - RNA, 19 nt, Homo sapiens
uggaggcugucaagcauaa

SEQ ID NO: 1224166 - RNA, 19 nt, Homo sapiens
gaauauuucaagcgacuga

SEQ ID NO: 1224167 - RNA, 19 nt, Homo sapiens
caugagagaaauucagaaa

SEQ ID NO: 1224168 - RNA, 19 nt, Homo sapiens
caccaacccuaguggcauu

SEQ ID NO: 1224169 - RNA, 19 nt, Homo sapiens
ugacuugaagcucuaguuu

SEQ ID NO: 1224170 - RNA, 19 nt, Homo sapiens
gaaucacuguggcucuugu

SEQ ID NO: 1224171 - RNA, 19 nt, Homo sapiens
uacaagaacccaacacaau

SEQ ID NO: 1224172 - RNA, 19 nt, Homo sapiens
gagaggagacguagaugag

SEQ ID NO: 1224173 - RNA, 19 nt, Homo sapiens
gaagucaugagagaaauuc

SEQ ID NO: 1224174 - RNA, 19 nt, Homo sapiens
acacaauucccagaaagua

SEQ ID NO: 1224175 - RNA, 19 nt, Homo sapiens
ggagccaggccucugauau

SEQ ID NO: 1224176 - RNA, 19 nt, Homo sapiens
cgacugacaugugagaucu

SEQ ID NO: 1224177 - RNA, 19 nt, Homo sapiens
gagagaaauucagaaacuc

SEQ ID NO: 1224178 - RNA, 19 nt, Homo sapiens
gauauucugccgccuguuc

SEQ ID NO: 1224179 - RNA, 19 nt, Homo sapiens
gaggaaagcagugacaaag

SEQ ID NO: 1224180 - RNA, 19 nt, Homo sapiens
cccuugaccuuacugauga

SEQ ID NO: 1224181 - RNA, 19 nt, Homo sapiens
gauuaaagucaucuccuau

SEQ ID NO: 1224182 - RNA, 19 nt, Homo sapiens
uuaaagucaucuccuaugg

SEQ ID NO: 1224183 - RNA, 19 nt, Homo sapiens
ggagcccucguauuaacua

SEQ ID NO: 1224184 - RNA, 19 nt, Homo sapiens
uucaaggacuguuuauaug

SEQ ID NO: 1224185 - RNA, 19 nt, Homo sapiens
aacaauagccagagguuga

SEQ ID NO: 1224186 - RNA, 19 nt, Homo sapiens
guaacaauagccagagguu

SEQ ID NO: 1224187 - RNA, 19 nt, Homo sapiens
ugaccuagaacauuucaug

SEQ ID NO: 1224188 - RNA, 19 nt, Homo sapiens
gugauuggaacaggcauua

SEQ ID NO: 1224189 - RNA, 19 nt, Homo sapiens
gggcucaggagaagcguaa

SEQ ID NO: 1224190 - RNA, 19 nt, Homo sapiens
gcccucguauuaacuacaa

SEQ ID NO: 1224191 - RNA, 19 nt, Homo sapiens
gaaaauggagcccucguau

SEQ ID NO: 1224192 - RNA, 19 nt, Homo sapiens
cuguucaaguucaagaaua

SEQ ID NO: 1224193 - RNA, 19 nt, Homo sapiens
caugagcgagcuagagaaa

SEQ ID NO: 1224194 - RNA, 19 nt, Homo sapiens
gcacacagugaaauaagag

SEQ ID NO: 1224195 - RNA, 19 nt, Homo sapiens
ugagagaaggucagcuaaa

SEQ ID NO: 1224196 - RNA, 19 nt, Homo sapiens
cgagugggcucaggagaag

SEQ ID NO: 1224197 - RNA, 19 nt, Homo sapiens
cacaauucccagaaaguaa

SEQ ID NO: 1224198 - RNA, 19 nt, Homo sapiens
gaccuuauccagaaacucu

SEQ ID NO: 1224199 - RNA, 19 nt, Homo sapiens
gagaacuugugcuagugau

SEQ ID NO: 1224200 - RNA, 19 nt, Homo sapiens
ucaccaccguuuagaccaa

SEQ ID NO: 1224201 - RNA, 19 nt, Homo sapiens
agaaaucaccaccguuuag

SEQ ID NO: 1224202 - RNA, 19 nt, Homo sapiens
ucagcuaaauggcucaucu

SEQ ID NO: 1224203 - RNA, 19 nt, Homo sapiens
gcagcguaauccuucauac

SEQ ID NO: 1224204 - RNA, 19 nt, Homo sapiens
ccaaguuccagcccucaaa

SEQ ID NO: 1224205 - RNA, 19 nt, Homo sapiens
gaucuuccagaauauuuca

SEQ ID NO: 1224206 - RNA, 19 nt, Homo sapiens
ccucugauauagacgagau

SEQ ID NO: 1224207 - RNA, 19 nt, Homo sapiens
uugauaaucucuuggaacu

SEQ ID NO: 1224208 - RNA, 19 nt, Homo sapiens
ccucguaccaguaauguuc

SEQ ID NO: 1224209 - RNA, 19 nt, Homo sapiens
aaugugauacuuccacuga

SEQ ID NO: 1224210 - RNA, 19 nt, Homo sapiens
gcagggauggugagagaag

SEQ ID NO: 1224211 - RNA, 19 nt, Homo sapiens
gaagagacuuacccaauuu

SEQ ID NO: 1224212 - RNA, 19 nt, Homo sapiens
gaaagcauauugcaucuau

SEQ ID NO: 1224213 - RNA, 19 nt, Homo sapiens
agaaauagcugaaagaaug

SEQ ID NO: 1224214 - RNA, 19 nt, Homo sapiens
gagagaaucugugugcuua

SEQ ID NO: 1224215 - RNA, 19 nt, Homo sapiens
cagagaaguugauccauua

SEQ ID NO: 1224216 - RNA, 19 nt, Homo sapiens
guagaagacuggaaaauua

SEQ ID NO: 1224217 - RNA, 19 nt, Homo sapiens
ugaauuacaucaugaggua

SEQ ID NO: 1224218 - RNA, 19 nt, Homo sapiens
gaaaguagcagcaacuaga

SEQ ID NO: 1224219 - RNA, 19 nt, Homo sapiens
uaagagggcucaagauugu

SEQ ID NO: 1224220 - RNA, 19 nt, Homo sapiens
ggaagaaucagaucauuug

SEQ ID NO: 1224221 - RNA, 19 nt, Homo sapiens
gggaaagucugcccacuga

SEQ ID NO: 1224222 - RNA, 19 nt, Homo sapiens
ccaaagacauucccaguca

SEQ ID NO: 1224223 - RNA, 19 nt, Homo sapiens
ugaauaaggugccaggaaa

SEQ ID NO: 1224224 - RNA, 19 nt, Homo sapiens
ugaagagacuuacccaauu

SEQ ID NO: 1224225 - RNA, 19 nt, Homo sapiens
gauaaucugucagcuacua

SEQ ID NO: 1224226 - RNA, 19 nt, Homo sapiens
agaggaagcuuuagauaga

SEQ ID NO: 1224227 - RNA, 19 nt, Homo sapiens
gagaaacgguugcuacauc

SEQ ID NO: 1224228 - RNA, 19 nt, Homo sapiens
gaacgaacaucagcuuaca

SEQ ID NO: 1224229 - RNA, 19 nt, Homo sapiens
gaaguugauccauuaagua

SEQ ID NO: 1224230 - RNA, 19 nt, Homo sapiens
ugaaugcaaucuagaugua

SEQ ID NO: 1224231 - RNA, 19 nt, Homo sapiens
gaaugggaaugauagaaga

SEQ ID NO: 1224232 - RNA, 19 nt, Homo sapiens
gagggaaguuggaguaugu

SEQ ID NO: 1224233 - RNA, 19 nt, Homo sapiens
caggugcucuuuacuguuu

SEQ ID NO: 1224234 - RNA, 19 nt, Homo sapiens
caagauagcacccaugaau

SEQ ID NO: 1224235 - RNA, 19 nt, Homo sapiens
gcagagaaccgauauagca

SEQ ID NO: 1224236 - RNA, 19 nt, Homo sapiens
ucagagaaguugauccauu

SEQ ID NO: 1224237 - RNA, 19 nt, Homo sapiens
gaaagaaugggaaugauag

SEQ ID NO: 1224238 - RNA, 19 nt, Homo sapiens
gauagaagaggaagaauca

SEQ ID NO: 1224239 - RNA, 19 nt, Homo sapiens
gaagaaauagcugaaagaa

SEQ ID NO: 1224240 - RNA, 19 nt, Homo sapiens
gaacauuugauucacauug

SEQ ID NO: 1224241 - RNA, 19 nt, Homo sapiens
caggacagcuucgcucuuu

SEQ ID NO: 1224242 - RNA, 19 nt, Homo sapiens
cagcacagauaaagcauau

SEQ ID NO: 1224243 - RNA, 19 nt, Homo sapiens
agauagcacccaugaauua

SEQ ID NO: 1224244 - RNA, 19 nt, Homo sapiens
gaaaacaacugcagaggau

SEQ ID NO: 1224245 - RNA, 19 nt, Homo sapiens
aaugaggacugaucuugua

SEQ ID NO: 1224246 - RNA, 19 nt, Homo sapiens
ggacagaggaagcuuuaga

SEQ ID NO: 1224247 - RNA, 19 nt, Homo sapiens
cuaaagcuguuucugaaug

SEQ ID NO: 1224248 - RNA, 19 nt, Homo sapiens
gaggaagaaucagaucauu

SEQ ID NO: 1224249 - RNA, 19 nt, Homo sapiens
gaugggaaaugcuauacug

SEQ ID NO: 1224250 - RNA, 19 nt, Homo sapiens
gcacauucccaaagacauu

SEQ ID NO: 1224251 - RNA, 19 nt, Homo sapiens
agacuuacccaauuuauga

SEQ ID NO: 1224252 - RNA, 19 nt, Homo sapiens
gagggcacauucccaaaga

SEQ ID NO: 1224253 - RNA, 19 nt, Homo sapiens
ugaaacaaaugaggacuga

SEQ ID NO: 1224254 - RNA, 19 nt, Homo sapiens
gagaaucugugugcuuaug

SEQ ID NO: 1224255 - RNA, 19 nt, Homo sapiens
ggauaucuagcuuccuuua

SEQ ID NO: 1224256 - RNA, 19 nt, Homo sapiens
ugaaagaaugggaaugaua

SEQ ID NO: 1224257 - RNA, 19 nt, Homo sapiens
caagagggaaguuggagua

SEQ ID NO: 1224258 - RNA, 19 nt, Homo sapiens
ccaggaagauaauucuguu

SEQ ID NO: 1224259 - RNA, 19 nt, Homo sapiens
gaaaucaccagggucauga

SEQ ID NO: 1224260 - RNA, 19 nt, Homo sapiens
gauauggcuuuuagaguua

SEQ ID NO: 1224261 - RNA, 19 nt, Homo sapiens
ucaccagggucaugaaaga

SEQ ID NO: 1224262 - RNA, 19 nt, Homo sapiens
gacuuaagguugcaagaau

SEQ ID NO: 1224263 - RNA, 19 nt, Homo sapiens
gaagaguggucccaagacu

SEQ ID NO: 1224264 - RNA, 19 nt, Homo sapiens
ugugaagaaugcaguuuaa

SEQ ID NO: 1224265 - RNA, 19 nt, Homo sapiens
gaaguuggaguaugucugu

SEQ ID NO: 1224266 - RNA, 19 nt, Homo sapiens
guucaagugucauagcuau

SEQ ID NO: 1224267 - RNA, 19 nt, Homo sapiens
gcacagauaaagcauauac

SEQ ID NO: 1224268 - RNA, 19 nt, Homo sapiens
guagaacauuugauucaca

SEQ ID NO: 1224269 - RNA, 19 nt, Homo sapiens
agacugaguuuauagaaag

SEQ ID NO: 1224270 - RNA, 19 nt, Homo sapiens
cagcuucgcucuuucucuu

SEQ ID NO: 1224271 - RNA, 19 nt, Homo sapiens
aaacagccagucugaagua

SEQ ID NO: 1224272 - RNA, 19 nt, Homo sapiens
gaaggaaaauucauugaca

SEQ ID NO: 1224273 - RNA, 19 nt, Homo sapiens
gauuaagacugggaggauu

SEQ ID NO: 1224274 - RNA, 19 nt, Homo sapiens
caaaugaggacugaucuug

SEQ ID NO: 1224275 - RNA, 19 nt, Homo sapiens
uauaagagggcucaagauu

SEQ ID NO: 1224276 - RNA, 19 nt, Homo sapiens
acacaccugucaccuugua

SEQ ID NO: 1224277 - RNA, 19 nt, Homo sapiens
cccaagacuuuaaagauga

SEQ ID NO: 1224278 - RNA, 19 nt, Homo sapiens
gacagaagcagccauggaa

SEQ ID NO: 1224279 - RNA, 19 nt, Homo sapiens
gacaagauagcacccauga

SEQ ID NO: 1224280 - RNA, 19 nt, Homo sapiens
ggacuuaagguugcaagaa

SEQ ID NO: 1224281 - RNA, 19 nt, Homo sapiens
ccagagcccaggaagauaa

SEQ ID NO: 1224282 - RNA, 19 nt, Homo sapiens
uacagaaagucauucaaga

SEQ ID NO: 1224283 - RNA, 19 nt, Homo sapiens
gggcaaaggucugacucuu

SEQ ID NO: 1224284 - RNA, 19 nt, Homo sapiens
gaagauaauucuguuaccu

SEQ ID NO: 1224285 - RNA, 19 nt, Homo sapiens
gaaucugugugcuuaugga

SEQ ID NO: 1224286 - RNA, 19 nt, Homo sapiens
ggaagacucccacugaucu

SEQ ID NO: 1224287 - RNA, 19 nt, Homo sapiens
ugaccucucucuccucaga

SEQ ID NO: 1224288 - RNA, 19 nt, Homo sapiens
cgaggauccugcugucuug

SEQ ID NO: 1224289 - RNA, 19 nt, Homo sapiens
gaggacugaucuuguauac

SEQ ID NO: 1224290 - RNA, 19 nt, Homo sapiens
ucucagaaccauaaauuga

SEQ ID NO: 1224291 - RNA, 19 nt, Homo sapiens
uaaagcuguuucugaaugu

SEQ ID NO: 1224292 - RNA, 19 nt, Homo sapiens
gcugaaagaaugggaauga

SEQ ID NO: 1224293 - RNA, 19 nt, Homo sapiens
ggagagaaucugugugcuu

SEQ ID NO: 1224294 - RNA, 19 nt, Homo sapiens
gcuauaagagggcucaaga

SEQ ID NO: 1224295 - RNA, 19 nt, Homo sapiens
ccacugaucugagaaugag

SEQ ID NO: 1224296 - RNA, 19 nt, Homo sapiens
gcacuuucuucacuguguu

SEQ ID NO: 1224297 - RNA, 19 nt, Homo sapiens
ccaagacuuuaaagaugaa

SEQ ID NO: 1224298 - RNA, 19 nt, Homo sapiens
ucccaagacuuuaaagaug

SEQ ID NO: 1224299 - RNA, 19 nt, Homo sapiens
aauaacaggugcucuuuac

SEQ ID NO: 1224300 - RNA, 19 nt, Homo sapiens
cuacuaggcauuuauuguu

SEQ ID NO: 1224301 - RNA, 19 nt, Homo sapiens
gaggaugggaaaugcuaua

SEQ ID NO: 1224302 - RNA, 19 nt, Homo sapiens
agaaguugauccauuaagu

SEQ ID NO: 1224303 - RNA, 19 nt, Homo sapiens
gacauucccagucaugaaa

SEQ ID NO: 1224304 - RNA, 19 nt, Homo sapiens
caugagguaugugugaauu

SEQ ID NO: 1224305 - RNA, 19 nt, Homo sapiens
uauacaaagugccaacuca

SEQ ID NO: 1224306 - RNA, 19 nt, Homo sapiens
gaggaaaccaccaaagaag

SEQ ID NO: 1224307 - RNA, 19 nt, Homo sapiens
caacagagugggaccuaau

SEQ ID NO: 1224308 - RNA, 19 nt, Homo sapiens
gaucuacgguuuugggauu

SEQ ID NO: 1224309 - RNA, 19 nt, Homo sapiens
agacugcuguuagaaggua

SEQ ID NO: 1224310 - RNA, 19 nt, Homo sapiens
ggcucaagauugugaauuc

SEQ ID NO: 1224311 - RNA, 19 nt, Homo sapiens
gaacugagauauugucuug

SEQ ID NO: 1224312 - RNA, 19 nt, Homo sapiens
gaagagaacuaucugcuau

SEQ ID NO: 1224313 - RNA, 19 nt, Homo sapiens
gucaaggacuuuaaucaua

SEQ ID NO: 1224314 - RNA, 19 nt, Homo sapiens
cagcuuagguuacuuaguu

SEQ ID NO: 1224315 - RNA, 19 nt, Homo sapiens
gaauagagcaugugaauac

SEQ ID NO: 1224316 - RNA, 19 nt, Homo sapiens
ggugcuagaugguacauuu

SEQ ID NO: 1224317 - RNA, 19 nt, Homo sapiens
ucaccgaucuugaggaauu

SEQ ID NO: 1224318 - RNA, 19 nt, Homo sapiens
ccauuguccuuucuaaaua

SEQ ID NO: 1224319 - RNA, 19 nt, Homo sapiens
agagaacuaucugcuauua

SEQ ID NO: 1224320 - RNA, 19 nt, Homo sapiens
gcaucaaguucuucuuaaa

SEQ ID NO: 1224321 - RNA, 19 nt, Homo sapiens
acaggaagcuagagauaaa

SEQ ID NO: 1224322 - RNA, 19 nt, Homo sapiens
gauaucagcggauuugaaa

SEQ ID NO: 1224323 - RNA, 19 nt, Homo sapiens
gccauucgcucauauacaa

SEQ ID NO: 1224324 - RNA, 19 nt, Homo sapiens
guaaugaguugcuaagaag

SEQ ID NO: 1224325 - RNA, 19 nt, Homo sapiens
gagauccgauguauagaug

SEQ ID NO: 1224326 - RNA, 19 nt, Homo sapiens
gagauaaauuucugaagag

SEQ ID NO: 1224327 - RNA, 19 nt, Homo sapiens
ggacuuuaaucauacuugu

SEQ ID NO: 1224328 - RNA, 19 nt, Homo sapiens
cagcaucaaguucuucuua

SEQ ID NO: 1224329 - RNA, 19 nt, Homo sapiens
ggaagaaauagaaggcuuu

SEQ ID NO: 1224330 - RNA, 19 nt, Homo sapiens
gagaauagaaagaccaguu

SEQ ID NO: 1224331 - RNA, 19 nt, Homo sapiens
guaguaaccggauggaauu

SEQ ID NO: 1224332 - RNA, 19 nt, Homo sapiens
gaauuucuguucugugucu

SEQ ID NO: 1224333 - RNA, 19 nt, Homo sapiens
uguaaugaguugcuaagaa

SEQ ID NO: 1224334 - RNA, 19 nt, Homo sapiens
gagcauggagugagaauag

SEQ ID NO: 1224335 - RNA, 19 nt, Homo sapiens
gagauauugucuuguauac

SEQ ID NO: 1224336 - RNA, 19 nt, Homo sapiens
acugagauauugucuugua

SEQ ID NO: 1224337 - RNA, 19 nt, Homo sapiens
uaguuugucuucagaguuu

SEQ ID NO: 1224338 - RNA, 19 nt, Homo sapiens
gaugaagaguaucgaagug

SEQ ID NO: 1224339 - RNA, 19 nt, Homo sapiens
gaagccauucgcucauaua

SEQ ID NO: 1224340 - RNA, 19 nt, Homo sapiens
caaccuggguaaacuaaag

SEQ ID NO: 1224341 - RNA, 19 nt, Homo sapiens
ccacccgacuucauacuga

SEQ ID NO: 1224342 - RNA, 19 nt, Homo sapiens
gcucaugcacuuuauguau

SEQ ID NO: 1224343 - RNA, 19 nt, Homo sapiens
uuacguggcucaugcacuu

SEQ ID NO: 1224344 - RNA, 19 nt, Homo sapiens
gaagcuagagauaaauuuc

SEQ ID NO: 1224345 - RNA, 19 nt, Homo sapiens
gcuaagaagacaaaucaga

SEQ ID NO: 1224346 - RNA, 19 nt, Homo sapiens
ucaaggacuuuaaucauac

SEQ ID NO: 1224347 - RNA, 19 nt, Homo sapiens
ggaagcuagagauaaauuu

SEQ ID NO: 1224348 - RNA, 19 nt, Homo sapiens
uuagagauccgauguauag

SEQ ID NO: 1224349 - RNA, 19 nt, Homo sapiens
ugaagaguaucgaagugaa

SEQ ID NO: 1224350 - RNA, 19 nt, Homo sapiens
gcugaaaacucuaaaagau

SEQ ID NO: 1224351 - RNA, 19 nt, Homo sapiens
cucaugcacuuuauguaua

SEQ ID NO: 1224352 - RNA, 19 nt, Homo sapiens
aggaaaaucuggcuuaaaa

SEQ ID NO: 1224353 - RNA, 19 nt, Homo sapiens
gauccgauguauagaugau

SEQ ID NO: 1224354 - RNA, 19 nt, Homo sapiens
gaauacagcaugggaagau

SEQ ID NO: 1224355 - RNA, 19 nt, Homo sapiens
cuaagaagacaaaucagaa

SEQ ID NO: 1224356 - RNA, 19 nt, Homo sapiens
uaacaaccuggguaaacua

SEQ ID NO: 1224357 - RNA, 19 nt, Homo sapiens
cgugaagccuuuaaucauc

SEQ ID NO: 1224358 - RNA, 19 nt, Homo sapiens
aagaccaguuucaggcuua

SEQ ID NO: 1224359 - RNA, 19 nt, Homo sapiens
guacuguaaugaguugcua

SEQ ID NO: 1224360 - RNA, 19 nt, Homo sapiens
gugaauagagcaugugaau

SEQ ID NO: 1224361 - RNA, 19 nt, Homo sapiens
aauaaucugucaaggacuu

SEQ ID NO: 1224362 - RNA, 19 nt, Homo sapiens
aaacagccaacaugauuug

SEQ ID NO: 1224363 - RNA, 19 nt, Homo sapiens
gccauuguccuuucuaaau

SEQ ID NO: 1224364 - RNA, 19 nt, Homo sapiens
gcucuaacaaccuggguaa

SEQ ID NO: 1224365 - RNA, 19 nt, Homo sapiens
uuacaggaagcuagagaua

SEQ ID NO: 1224366 - RNA, 19 nt, Homo sapiens
ucagcuagauuuugacuuu

SEQ ID NO: 1224367 - RNA, 19 nt, Homo sapiens
aaagauaucagcggauuug

SEQ ID NO: 1224368 - RNA, 19 nt, Homo sapiens
aaucauacuuguuccaaag

SEQ ID NO: 1224369 - RNA, 19 nt, Homo sapiens
ugaagagaacuaucugcua

SEQ ID NO: 1224370 - RNA, 19 nt, Homo sapiens
gaauccagcuuagguuacu

SEQ ID NO: 1224371 - RNA, 19 nt, Homo sapiens
cagcggauuugaaacuugu

SEQ ID NO: 1224372 - RNA, 19 nt, Homo sapiens
uaaaagauaucagcggauu

SEQ ID NO: 1224373 - RNA, 19 nt, Homo sapiens
ccuuagagauccgauguau

SEQ ID NO: 1224374 - RNA, 19 nt, Homo sapiens
gcucauauacaauaaucug

SEQ ID NO: 1224375 - RNA, 19 nt, Homo sapiens
agaauagaaagaccaguuu

SEQ ID NO: 1224376 - RNA, 19 nt, Homo sapiens
guacagugcuacgacuaca

SEQ ID NO: 1224377 - RNA, 19 nt, Homo sapiens
aagacuugcugaagaugaa

SEQ ID NO: 1224378 - RNA, 19 nt, Homo sapiens
ugaagccauucgcucauau

SEQ ID NO: 1224379 - RNA, 19 nt, Homo sapiens
gcauggagugagaauagaa

SEQ ID NO: 1224380 - RNA, 19 nt, Homo sapiens
cuucuuaaauguugggaau

SEQ ID NO: 1224381 - RNA, 19 nt, Homo sapiens
uuacuuaguucagcaucaa

SEQ ID NO: 1224382 - RNA, 19 nt, Homo sapiens
augaagcagugaaagguuu

SEQ ID NO: 1224383 - RNA, 19 nt, Homo sapiens
ucagaagauuggaggaaca

SEQ ID NO: 1224384 - RNA, 19 nt, Homo sapiens
gugaagccuuuaaucaucu

SEQ ID NO: 1224385 - RNA, 19 nt, Homo sapiens
acugauggccgacugcaua

SEQ ID NO: 1224386 - RNA, 19 nt, Homo sapiens
uggguaaacuaaagaugug

SEQ ID NO: 1224387 - RNA, 19 nt, Homo sapiens
agucaccgaucuugaggaa

SEQ ID NO: 1224388 - RNA, 19 nt, Homo sapiens
gcacuuuauguauauguuc

SEQ ID NO: 1224389 - RNA, 19 nt, Homo sapiens
ugaauagagcaugugaaua

SEQ ID NO: 1224390 - RNA, 19 nt, Homo sapiens
cuaacaaccuggguaaacu

SEQ ID NO: 1224391 - RNA, 19 nt, Homo sapiens
gaagaguaucgaagugaag

SEQ ID NO: 1224392 - RNA, 19 nt, Homo sapiens
ucagcggauuugaaacuug

SEQ ID NO: 1224393 - RNA, 19 nt, Homo sapiens
ccucggggcugauguugua

SEQ ID NO: 1224394 - RNA, 19 nt, Homo sapiens
gcauuggugcuagauggua

SEQ ID NO: 1224395 - RNA, 19 nt, Homo sapiens
gugggacgcugccauuguc

SEQ ID NO: 1224396 - RNA, 19 nt, Homo sapiens
gaagauuggaggaacaaaa

SEQ ID NO: 1224397 - RNA, 19 nt, Homo sapiens
ucuuaaauguugggaauca

SEQ ID NO: 1224398 - RNA, 19 nt, Homo sapiens
agcaucaaguucuucuuaa

SEQ ID NO: 1224399 - RNA, 19 nt, Homo sapiens
guuucaggcuuaugcacuu

SEQ ID NO: 1224400 - RNA, 19 nt, Homo sapiens
gcgggaugguacagugcua

SEQ ID NO: 1224401 - RNA, 19 nt, Homo sapiens
gagaacuaucugcuauuau

SEQ ID NO: 1224402 - RNA, 19 nt, Homo sapiens
cagccaacaugauuugacu

SEQ ID NO: 1224403 - RNA, 19 nt, Homo sapiens
uacaauaaucugucaagga

SEQ ID NO: 1224404 - RNA, 19 nt, Homo sapiens
ucgcucauauacaauaauc

SEQ ID NO: 1224405 - RNA, 19 nt, Homo sapiens
uaagaagacaaaucagaag

SEQ ID NO: 1224406 - RNA, 19 nt, Homo sapiens
cuacgacuacagcaguaua

SEQ ID NO: 1224407 - RNA, 19 nt, Homo sapiens
cugaauccagcuuagguua

SEQ ID NO: 1224408 - RNA, 19 nt, Homo sapiens
gaguugcuaagaagacaaa

SEQ ID NO: 1224409 - RNA, 19 nt, Homo sapiens
cauucgcucauauacaaua

SEQ ID NO: 1224410 - RNA, 19 nt, Homo sapiens
guucugugucucucuguuu

SEQ ID NO: 1224411 - RNA, 19 nt, Homo sapiens
gaagaaggcuauuuguaug

SEQ ID NO: 1224412 - RNA, 19 nt, Homo sapiens
gugggcagcuucugacuua

SEQ ID NO: 1224413 - RNA, 19 nt, Homo sapiens
uggaguagcugccuuguuu

SEQ ID NO: 1224414 - RNA, 19 nt, Homo sapiens
gggauacgcugucaugcua

SEQ ID NO: 1224415 - RNA, 19 nt, Homo sapiens
gaaggcuauuuguauguua

SEQ ID NO: 1224416 - RNA, 19 nt, Homo sapiens
gaaaugcaguguuugucaa

SEQ ID NO: 1224417 - RNA, 19 nt, Homo sapiens
gaagcaagcauaaugaguu

SEQ ID NO: 1224418 - RNA, 19 nt, Homo sapiens
ucgaguggaugauguaaua

SEQ ID NO: 1224419 - RNA, 19 nt, Homo sapiens
gaaauugugaaacacguua

SEQ ID NO: 1224420 - RNA, 19 nt, Homo sapiens
ggaagaaucaggaagcauu

SEQ ID NO: 1224421 - RNA, 19 nt, Homo sapiens
gaacacccacuguauauuc

SEQ ID NO: 1224422 - RNA, 19 nt, Homo sapiens
gcauaaugaguuugucuua

SEQ ID NO: 1224423 - RNA, 19 nt, Homo sapiens
ggagaacgaugugauguag

SEQ ID NO: 1224424 - RNA, 19 nt, Homo sapiens
guacguaccacuuguagaa

SEQ ID NO: 1224425 - RNA, 19 nt, Homo sapiens
ucucauauuuggaggauuu

SEQ ID NO: 1224426 - RNA, 19 nt, Homo sapiens
ugaagaaggcuauuuguau

SEQ ID NO: 1224427 - RNA, 19 nt, Homo sapiens
cauccacagucucauauuu

SEQ ID NO: 1224428 - RNA, 19 nt, Homo sapiens
aagcaaccuuuaccuauaa

SEQ ID NO: 1224429 - RNA, 19 nt, Homo sapiens
gaguuugucuuauuccuau

SEQ ID NO: 1224430 - RNA, 19 nt, Homo sapiens
ggcaagccauacaagauaa

SEQ ID NO: 1224431 - RNA, 19 nt, Homo sapiens
aaacuuggccuaaacaaau

SEQ ID NO: 1224432 - RNA, 19 nt, Homo sapiens
uggaagaaauugugaaaca

SEQ ID NO: 1224433 - RNA, 19 nt, Homo sapiens
gggaagcaguacucucuga

SEQ ID NO: 1224434 - RNA, 19 nt, Homo sapiens
ucagaacacccacuguaua

SEQ ID NO: 1224435 - RNA, 19 nt, Homo sapiens
ccaaaacgcuggagaacaa

SEQ ID NO: 1224436 - RNA, 19 nt, Homo sapiens
aagcaagcauaaugaguuu

SEQ ID NO: 1224437 - RNA, 19 nt, Homo sapiens
ggaugaagaaggcuauuug

SEQ ID NO: 1224438 - RNA, 19 nt, Homo sapiens
gcucgguguuuaggaaaua

SEQ ID NO: 1224439 - RNA, 19 nt, Homo sapiens
gucaaugucuuccauauac

SEQ ID NO: 1224440 - RNA, 19 nt, Homo sapiens
ggucaaugucuuccauaua

SEQ ID NO: 1224441 - RNA, 19 nt, Homo sapiens
ugaaacacguuagacagaa

SEQ ID NO: 1224442 - RNA, 19 nt, Homo sapiens
gaaggaggguagaguacgu

SEQ ID NO: 1224443 - RNA, 19 nt, Homo sapiens
caggaagcauucaagcauu

SEQ ID NO: 1224444 - RNA, 19 nt, Homo sapiens
ggaagcauucaagcauuua

SEQ ID NO: 1224445 - RNA, 19 nt, Homo sapiens
acugaaggcucgguguuua

SEQ ID NO: 1224446 - RNA, 19 nt, Homo sapiens
gucccaggauacaauguua

SEQ ID NO: 1224447 - RNA, 19 nt, Homo sapiens
cagaacacccacuguauau

SEQ ID NO: 1224448 - RNA, 19 nt, Homo sapiens
ggucaagcauggcaucaag

SEQ ID NO: 1224449 - RNA, 19 nt, Homo sapiens
caugggaacacaacaguuu

SEQ ID NO: 1224450 - RNA, 19 nt, Homo sapiens
gaaaggugacacugugguu

SEQ ID NO: 1224451 - RNA, 19 nt, Homo sapiens
gauauuaugauaccaugga

SEQ ID NO: 1224452 - RNA, 19 nt, Homo sapiens
caacugcaauuagagcaau

SEQ ID NO: 1224453 - RNA, 19 nt, Homo sapiens
gcaagcauaaugaguuugu

SEQ ID NO: 1224454 - RNA, 19 nt, Homo sapiens
gaaacacguuagacagaac

SEQ ID NO: 1224455 - RNA, 19 nt, Homo sapiens
ucaggacucuggaagaauc

SEQ ID NO: 1224456 - RNA, 19 nt, Homo sapiens
guuggcaugugcaaggaua

SEQ ID NO: 1224457 - RNA, 19 nt, Homo sapiens
cauacaagauaacuucuac

SEQ ID NO: 1224458 - RNA, 19 nt, Homo sapiens
ucaauccuuucccauggua

SEQ ID NO: 1224459 - RNA, 19 nt, Homo sapiens
guacaagcccuggaccaaa

SEQ ID NO: 1224460 - RNA, 19 nt, Homo sapiens
ggaaauauugugguaaagu

SEQ ID NO: 1224461 - RNA, 19 nt, Homo sapiens
cuucagaguaccugucuua

SEQ ID NO: 1224462 - RNA, 19 nt, Homo sapiens
ggaguagcugccuuguuua

SEQ ID NO: 1224463 - RNA, 19 nt, Homo sapiens
gagcagaucagcugguaca

SEQ ID NO: 1224464 - RNA, 19 nt, Homo sapiens
ggacaacacaaaccagaca

SEQ ID NO: 1224465 - RNA, 19 nt, Homo sapiens
aggaagcauucaagcauuu

SEQ ID NO: 1224466 - RNA, 19 nt, Homo sapiens
gacuuaggcuggguuguug

SEQ ID NO: 1224467 - RNA, 19 nt, Homo sapiens
ugauugggaugaagagaug

SEQ ID NO: 1224468 - RNA, 19 nt, Homo sapiens
gcugaagcaagcauaauga

SEQ ID NO: 1224469 - RNA, 19 nt, Homo sapiens
caacagaggagcaaguuuu

SEQ ID NO: 1224470 - RNA, 19 nt, Homo sapiens
ugacaagguucaaaacauu

SEQ ID NO: 1224471 - RNA, 19 nt, Homo sapiens
guagucgcauugaucaugu

SEQ ID NO: 1224472 - RNA, 19 nt, Homo sapiens
cagcaucauuuggcauuga

SEQ ID NO: 1224473 - RNA, 19 nt, Homo sapiens
ggaagaaauugugaaacac

SEQ ID NO: 1224474 - RNA, 19 nt, Homo sapiens
gaguggaugauguaauaaa

SEQ ID NO: 1224475 - RNA, 19 nt, Homo sapiens
ugcgucauguguuggauua

SEQ ID NO: 1224476 - RNA, 19 nt, Homo sapiens
ggcgauguauaccauguug

SEQ ID NO: 1224477 - RNA, 19 nt, Homo sapiens
cgaaaugcaguguuuguca

SEQ ID NO: 1224478 - RNA, 19 nt, Homo sapiens
ggcagacugugcuguuguu

SEQ ID NO: 1224479 - RNA, 19 nt, Homo sapiens
guagaguacguaccacuug

SEQ ID NO: 1224480 - RNA, 19 nt, Homo sapiens
aacaaacacucgcccucua

SEQ ID NO: 1224481 - RNA, 19 nt, Homo sapiens
ggccuaaacaaaucuaaug

SEQ ID NO: 1224482 - RNA, 19 nt, Homo sapiens
gugaaacacguuagacaga

SEQ ID NO: 1224483 - RNA, 19 nt, Homo sapiens
ccgagcagaucagcuggua

SEQ ID NO: 1224484 - RNA, 19 nt, Homo sapiens
cagaugcuggcgcuuauuu

SEQ ID NO: 1224485 - RNA, 19 nt, Homo sapiens
ucgcauugaucauguaaag

SEQ ID NO: 1224486 - RNA, 19 nt, Homo sapiens
uaaguagucgcauugauca

SEQ ID NO: 1224487 - RNA, 19 nt, Homo sapiens
gugacacugugguuaucua

SEQ ID NO: 1224488 - RNA, 19 nt, Homo sapiens
gcaacagaggagcaaguuu

SEQ ID NO: 1224489 - RNA, 19 nt, Homo sapiens
agaaggcuauuuguauguu

SEQ ID NO: 1224490 - RNA, 19 nt, Homo sapiens
aagcaguacucucugacaa

SEQ ID NO: 1224491 - RNA, 19 nt, Homo sapiens
gcuauggaccucuucuuca

SEQ ID NO: 1224492 - RNA, 19 nt, Homo sapiens
gaugaagaaggcuauuugu

SEQ ID NO: 1224493 - RNA, 19 nt, Homo sapiens
agaacgaugugauguagag

SEQ ID NO: 1224494 - RNA, 19 nt, Homo sapiens
guagcugccuuguuuacag

SEQ ID NO: 1224495 - RNA, 19 nt, Homo sapiens
gauacgcugucaugcuaca

SEQ ID NO: 1224496 - RNA, 19 nt, Homo sapiens
gcacaacgggguuaccuaa

SEQ ID NO: 1224497 - RNA, 19 nt, Homo sapiens
gggaugaagagauggcaaa

SEQ ID NO: 1224498 - RNA, 19 nt, Homo sapiens
uuucaggacucuggaagaa

SEQ ID NO: 1224499 - RNA, 19 nt, Homo sapiens
cacccacuguauauucuuu

SEQ ID NO: 1224500 - RNA, 19 nt, Homo sapiens
acacaaaccagacaaaauu

SEQ ID NO: 1224501 - RNA, 19 nt, Homo sapiens
acacugugguuaucuacau

SEQ ID NO: 1224502 - RNA, 19 nt, Homo sapiens
uggaaggaaugcuuaacau

SEQ ID NO: 1224503 - RNA, 19 nt, Homo sapiens
gaagcaguacucucugaca

SEQ ID NO: 1224504 - RNA, 19 nt, Homo sapiens
ugacuuaggcuggguuguu

SEQ ID NO: 1224505 - RNA, 19 nt, Homo sapiens
uauaaucguccaaauaugg

SEQ ID NO: 1224506 - RNA, 19 nt, Homo sapiens
cugguuacauggaugaaga

SEQ ID NO: 1224507 - RNA, 19 nt, Homo sapiens
gaagcauucaagcauuuau

SEQ ID NO: 1224508 - RNA, 19 nt, Homo sapiens
cuauggaccucuucuucau

SEQ ID NO: 1224509 - RNA, 19 nt, Homo sapiens
caaaagcccagucacauga

SEQ ID NO: 1224510 - RNA, 19 nt, Homo sapiens
aaaggugacacugugguua

SEQ ID NO: 1224511 - RNA, 19 nt, Homo sapiens
gaucagcgauugaaauaua

SEQ ID NO: 1224512 - RNA, 19 nt, Homo sapiens
ggacacagcugauagauuc

SEQ ID NO: 1224513 - RNA, 19 nt, Homo sapiens
gcacauaccuguaauccaa

SEQ ID NO: 1224514 - RNA, 19 nt, Homo sapiens
gaucgcuucuguauaauua

SEQ ID NO: 1224515 - RNA, 19 nt, Homo sapiens
gaauaagggugcucuaguu

SEQ ID NO: 1224516 - RNA, 19 nt, Homo sapiens
gauaaucccuuaaccaaug

SEQ ID NO: 1224517 - RNA, 19 nt, Homo sapiens
gcauauagguaaucucaaa

SEQ ID NO: 1224518 - RNA, 19 nt, Homo sapiens
gaaaguagacuccuauaga

SEQ ID NO: 1224519 - RNA, 19 nt, Homo sapiens
caaccuagauaaugcuaua

SEQ ID NO: 1224520 - RNA, 19 nt, Homo sapiens
gaaaugugcuccaaguuca

SEQ ID NO: 1224521 - RNA, 19 nt, Homo sapiens
cagaaugcauuucagcuua

SEQ ID NO: 1224522 - RNA, 19 nt, Homo sapiens
uggcagauauugaaguuua

SEQ ID NO: 1224523 - RNA, 19 nt, Homo sapiens
gcaaaguucuaucucaaga

SEQ ID NO: 1224524 - RNA, 19 nt, Homo sapiens
gagcaaaguucuaucucaa

SEQ ID NO: 1224525 - RNA, 19 nt, Homo sapiens
ugagauaacugaugaccaa

SEQ ID NO: 1224526 - RNA, 19 nt, Homo sapiens
cauugacacucaucuguua

SEQ ID NO: 1224527 - RNA, 19 nt, Homo sapiens
gaauuccucuuggcagaua

SEQ ID NO: 1224528 - RNA, 19 nt, Homo sapiens
gauaacugaugaccaauuc

SEQ ID NO: 1224529 - RNA, 19 nt, Homo sapiens
gcacagcacuuugauaaac

SEQ ID NO: 1224530 - RNA, 19 nt, Homo sapiens
gcacugaaccauacagcua

SEQ ID NO: 1224531 - RNA, 19 nt, Homo sapiens
cuaaaucugugucuaauca

SEQ ID NO: 1224532 - RNA, 19 nt, Homo sapiens
ggcauauucuguaagcuua

SEQ ID NO: 1224533 - RNA, 19 nt, Homo sapiens
gaaagcaaacaacaagaaa

SEQ ID NO: 1224534 - RNA, 19 nt, Homo sapiens
uccgaucgcuucuguauaa

SEQ ID NO: 1224535 - RNA, 19 nt, Homo sapiens
gaaaucuucuagaaaguag

SEQ ID NO: 1224536 - RNA, 19 nt, Homo sapiens
gaaagagaacgucaacaga

SEQ ID NO: 1224537 - RNA, 19 nt, Homo sapiens
guaauggaaucacucaugu

SEQ ID NO: 1224538 - RNA, 19 nt, Homo sapiens
guagaugauuucagaaugu

SEQ ID NO: 1224539 - RNA, 19 nt, Homo sapiens
uacccgaccugccaauuua

SEQ ID NO: 1224540 - RNA, 19 nt, Homo sapiens
gucauaaccugcuuccuuu

SEQ ID NO: 1224541 - RNA, 19 nt, Homo sapiens
gaauugagaucaggguuuc

SEQ ID NO: 1224542 - RNA, 19 nt, Homo sapiens
ggaagaacuuauaccugaa

SEQ ID NO: 1224543 - RNA, 19 nt, Homo sapiens
gaggaaaugugcuccaagu

SEQ ID NO: 1224544 - RNA, 19 nt, Homo sapiens
acacucaucuguuagcauu

SEQ ID NO: 1224545 - RNA, 19 nt, Homo sapiens
gcagagaagagcucagaaa

SEQ ID NO: 1224546 - RNA, 19 nt, Homo sapiens
ggaaaugugcuccaaguuc

SEQ ID NO: 1224547 - RNA, 19 nt, Homo sapiens
gaaagaaagcaugcagaaa

SEQ ID NO: 1224548 - RNA, 19 nt, Homo sapiens
gaagauauacucagaagac

SEQ ID NO: 1224549 - RNA, 19 nt, Homo sapiens
ucauggaaauucacuggua

SEQ ID NO: 1224550 - RNA, 19 nt, Homo sapiens
gaagaacuuauaccugaaa

SEQ ID NO: 1224551 - RNA, 19 nt, Homo sapiens
gaagacaugccuuuuauuu

SEQ ID NO: 1224552 - RNA, 19 nt, Homo sapiens
gcacuuugauaaacuugga

SEQ ID NO: 1224553 - RNA, 19 nt, Homo sapiens
ccaguggccuuaaggaaga

SEQ ID NO: 1224554 - RNA, 19 nt, Homo sapiens
uaagggugcucuaguuuua

SEQ ID NO: 1224555 - RNA, 19 nt, Homo sapiens
aagagaacgucaacagaaa

SEQ ID NO: 1224556 - RNA, 19 nt, Homo sapiens
gcacaucaguuuuaaagug

SEQ ID NO: 1224557 - RNA, 19 nt, Homo sapiens
caggaucugugcuuugauu

SEQ ID NO: 1224558 - RNA, 19 nt, Homo sapiens
gcaagacuccaucucgaaa

SEQ ID NO: 1224559 - RNA, 19 nt, Homo sapiens
gcagugagccgagaucaug

SEQ ID NO: 1224560 - RNA, 19 nt, Homo sapiens
gaaagcaugcagaaagaga

SEQ ID NO: 1224561 - RNA, 19 nt, Homo sapiens
aagaaagcaugcagaaaga

SEQ ID NO: 1224562 - RNA, 19 nt, Homo sapiens
uagaucagcgauugaaaua

SEQ ID NO: 1224563 - RNA, 19 nt, Homo sapiens
cauggaaauucacugguaa

SEQ ID NO: 1224564 - RNA, 19 nt, Homo sapiens
gaaauguuguuguuauagc

SEQ ID NO: 1224565 - RNA, 19 nt, Homo sapiens
gcuaguacuccaacucuaa

SEQ ID NO: 1224566 - RNA, 19 nt, Homo sapiens
ugauaaacuuggacaguau

SEQ ID NO: 1224567 - RNA, 19 nt, Homo sapiens
aaagagaacgucaacagaa

SEQ ID NO: 1224568 - RNA, 19 nt, Homo sapiens
gaaccauacagcuaauuau

SEQ ID NO: 1224569 - RNA, 19 nt, Homo sapiens
ucaaagaagcugcaaagug

SEQ ID NO: 1224570 - RNA, 19 nt, Homo sapiens
gccaugcauugaccauuaa

SEQ ID NO: 1224571 - RNA, 19 nt, Homo sapiens
agccaugcauugaccauua

SEQ ID NO: 1224572 - RNA, 19 nt, Homo sapiens
caaccccacuguauuauuu

SEQ ID NO: 1224573 - RNA, 19 nt, Homo sapiens
uuucaaggcugcuagauca

SEQ ID NO: 1224574 - RNA, 19 nt, Homo sapiens
gauauacucagaagacaug

SEQ ID NO: 1224575 - RNA, 19 nt, Homo sapiens
aggcaagaauuaaugcuuu

SEQ ID NO: 1224576 - RNA, 19 nt, Homo sapiens
ugaaccauacagcuaauua

SEQ ID NO: 1224577 - RNA, 19 nt, Homo sapiens
aaagaaagcaugcagaaag

SEQ ID NO: 1224578 - RNA, 19 nt, Homo sapiens
ucagaaccuuguaaauaug

SEQ ID NO: 1224579 - RNA, 19 nt, Homo sapiens
uaugaugucuuggcaaaug

SEQ ID NO: 1224580 - RNA, 19 nt, Homo sapiens
uggcacagcacuuugauaa

SEQ ID NO: 1224581 - RNA, 19 nt, Homo sapiens
gaacaucugccauggaaaa

SEQ ID NO: 1224582 - RNA, 19 nt, Homo sapiens
caacagagcaagacuccau

SEQ ID NO: 1224583 - RNA, 19 nt, Homo sapiens
uugauaaacuuggacagua

SEQ ID NO: 1224584 - RNA, 19 nt, Homo sapiens
aaacuugucagccaaagaa

SEQ ID NO: 1224585 - RNA, 19 nt, Homo sapiens
gagauuagaagauauacuc

SEQ ID NO: 1224586 - RNA, 19 nt, Homo sapiens
gacaguauucuuuggcuuu

SEQ ID NO: 1224587 - RNA, 19 nt, Homo sapiens
agaggaagccguuaaguuc

SEQ ID NO: 1224588 - RNA, 19 nt, Homo sapiens
uagaagauauacucagaag

SEQ ID NO: 1224589 - RNA, 19 nt, Homo sapiens
guaugugguuucagacaga

SEQ ID NO: 1224590 - RNA, 19 nt, Homo sapiens
ccacaggcaagaauuaaug

SEQ ID NO: 1224591 - RNA, 19 nt, Homo sapiens
ugaaagcaaacaacaagaa

SEQ ID NO: 1224592 - RNA, 19 nt, Homo sapiens
aggaacaucugccauggaa

SEQ ID NO: 1224593 - RNA, 19 nt, Homo sapiens
aauauaggauggccuguca

SEQ ID NO: 1224594 - RNA, 19 nt, Homo sapiens
gaccugccaauuuacauaa

SEQ ID NO: 1224595 - RNA, 19 nt, Homo sapiens
aaaguagacuccuauagac

SEQ ID NO: 1224596 - RNA, 19 nt, Homo sapiens
gaagucgacaauccuaaug

SEQ ID NO: 1224597 - RNA, 19 nt, Homo sapiens
ugaaugaagucgacaaucc

SEQ ID NO: 1224598 - RNA, 19 nt, Homo sapiens
aggcuaaacuagaagaaga

SEQ ID NO: 1224599 - RNA, 19 nt, Homo sapiens
uauaggauggccugucaua

SEQ ID NO: 1224600 - RNA, 19 nt, Homo sapiens
aauaaagguuucugaagca

SEQ ID NO: 1224601 - RNA, 19 nt, Homo sapiens
cugauaacauugacacuca

SEQ ID NO: 1224602 - RNA, 19 nt, Homo sapiens
gaaccuuguugcugauaac

SEQ ID NO: 1224603 - RNA, 19 nt, Homo sapiens
cagaagacaugccuuuuau

SEQ ID NO: 1224604 - RNA, 19 nt, Homo sapiens
cauacauacugcaugagaa

SEQ ID NO: 1224605 - RNA, 19 nt, Homo sapiens
caauucgacuuccauacau

SEQ ID NO: 1224606 - RNA, 19 nt, Homo sapiens
caguguaugugguuucaga

SEQ ID NO: 1224607 - RNA, 19 nt, Homo sapiens
augcuucccuuuauuaaga

SEQ ID NO: 1224608 - RNA, 19 nt, Homo sapiens
gaaucacucauguucagaa

SEQ ID NO: 1224609 - RNA, 19 nt, Homo sapiens
ggcaagaauuaaugcuuuc

SEQ ID NO: 1224610 - RNA, 19 nt, Homo sapiens
uuugauuccuugucuguuu

SEQ ID NO: 1224611 - RNA, 19 nt, Homo sapiens
guaaugagcugaauuucuu

SEQ ID NO: 1224612 - RNA, 19 nt, Homo sapiens
ggauagaccuugugacaga

SEQ ID NO: 1224613 - RNA, 19 nt, Homo sapiens
ggucaucauugucuucuua

SEQ ID NO: 1224614 - RNA, 19 nt, Homo sapiens
ggaauaaagggccuacuua

SEQ ID NO: 1224615 - RNA, 19 nt, Homo sapiens
cagcuagacugcaggauua

SEQ ID NO: 1224616 - RNA, 19 nt, Homo sapiens
ggaaauaagugucugucuu

SEQ ID NO: 1224617 - RNA, 19 nt, Homo sapiens
caagcagaauuaaguguua

SEQ ID NO: 1224618 - RNA, 19 nt, Homo sapiens
guacaaaucuaucaugagu

SEQ ID NO: 1224619 - RNA, 19 nt, Homo sapiens
caugauagcuggacagaga

SEQ ID NO: 1224620 - RNA, 19 nt, Homo sapiens
gaaaucugcauauggguua

SEQ ID NO: 1224621 - RNA, 19 nt, Homo sapiens
gaaacaggguggccucuuc

SEQ ID NO: 1224622 - RNA, 19 nt, Homo sapiens
ggauucaggucucucauga

SEQ ID NO: 1224623 - RNA, 19 nt, Homo sapiens
guaaaugucagcccaaauu

SEQ ID NO: 1224624 - RNA, 19 nt, Homo sapiens
gaccacagguuucaugaga

SEQ ID NO: 1224625 - RNA, 19 nt, Homo sapiens
gguggccucuucauuauuu

SEQ ID NO: 1224626 - RNA, 19 nt, Homo sapiens
gacaugcagucaacaauga

SEQ ID NO: 1224627 - RNA, 19 nt, Homo sapiens
gaagaaccaucaacuuguc

SEQ ID NO: 1224628 - RNA, 19 nt, Homo sapiens
ggagagauuugaacaagca

SEQ ID NO: 1224629 - RNA, 19 nt, Homo sapiens
gaagaaagagaaacuagug

SEQ ID NO: 1224630 - RNA, 19 nt, Homo sapiens
gaggguagcuuugcccauu

SEQ ID NO: 1224631 - RNA, 19 nt, Homo sapiens
caacaucuuugacaacuag

SEQ ID NO: 1224632 - RNA, 19 nt, Homo sapiens
gaacuaaugacuguggaua

SEQ ID NO: 1224633 - RNA, 19 nt, Homo sapiens
gggcuuuaguucuuaagua

SEQ ID NO: 1224634 - RNA, 19 nt, Homo sapiens
caucagaacccuuaugcua

SEQ ID NO: 1224635 - RNA, 19 nt, Homo sapiens
caauggaaguguuucaaug

SEQ ID NO: 1224636 - RNA, 19 nt, Homo sapiens
gaauguagcuggcuuuuca

SEQ ID NO: 1224637 - RNA, 19 nt, Homo sapiens
aaauagggcuuuaguucuu

SEQ ID NO: 1224638 - RNA, 19 nt, Homo sapiens
agccagaucucaugaguaa

SEQ ID NO: 1224639 - RNA, 19 nt, Homo sapiens
gcaugcacauuccauaaau

SEQ ID NO: 1224640 - RNA, 19 nt, Homo sapiens
agaaugagaugaugguguu

SEQ ID NO: 1224641 - RNA, 19 nt, Homo sapiens
guagucacaugucauauag

SEQ ID NO: 1224642 - RNA, 19 nt, Homo sapiens
ugugcgaacuggucauuua

SEQ ID NO: 1224643 - RNA, 19 nt, Homo sapiens
caggguggccucuucauua

SEQ ID NO: 1224644 - RNA, 19 nt, Homo sapiens
ucaggucucucaugauuau

SEQ ID NO: 1224645 - RNA, 19 nt, Homo sapiens
ggauauaaauguguaugug

SEQ ID NO: 1224646 - RNA, 19 nt, Homo sapiens
gaagcuugauccucuaaca

SEQ ID NO: 1224647 - RNA, 19 nt, Homo sapiens
aaacaucacauuucucuga

SEQ ID NO: 1224648 - RNA, 19 nt, Homo sapiens
uaacuucaaucuggaaaga

SEQ ID NO: 1224649 - RNA, 19 nt, Homo sapiens
agucacaugucauauagua

SEQ ID NO: 1224650 - RNA, 19 nt, Homo sapiens
ggauuuacguuccuaacug

SEQ ID NO: 1224651 - RNA, 19 nt, Homo sapiens
ggcuuuaguucuuaaguaa

SEQ ID NO: 1224652 - RNA, 19 nt, Homo sapiens
gguagaaauuugugaguag

SEQ ID NO: 1224653 - RNA, 19 nt, Homo sapiens
uaaaugucagcccaaauua

SEQ ID NO: 1224654 - RNA, 19 nt, Homo sapiens
gaacaagcagaauuaagug

SEQ ID NO: 1224655 - RNA, 19 nt, Homo sapiens
caacagccauacucagcaa

SEQ ID NO: 1224656 - RNA, 19 nt, Homo sapiens
cuacagacccuacuauaau

SEQ ID NO: 1224657 - RNA, 19 nt, Homo sapiens
gcaacaucuuugacaacua

SEQ ID NO: 1224658 - RNA, 19 nt, Homo sapiens
acuaaugacuguggauaua

SEQ ID NO: 1224659 - RNA, 19 nt, Homo sapiens
uaaagggccuacuuaccaa

SEQ ID NO: 1224660 - RNA, 19 nt, Homo sapiens
uaaaagcguuccccagaua

SEQ ID NO: 1224661 - RNA, 19 nt, Homo sapiens
caacuugucuuuucuugaa

SEQ ID NO: 1224662 - RNA, 19 nt, Homo sapiens
caguacaaaucuaucauga

SEQ ID NO: 1224663 - RNA, 19 nt, Homo sapiens
gcacauuccauaaauaucu

SEQ ID NO: 1224664 - RNA, 19 nt, Homo sapiens
uaagcaacaucuuugacaa

SEQ ID NO: 1224665 - RNA, 19 nt, Homo sapiens
uuucagaacccauguuuaa

SEQ ID NO: 1224666 - RNA, 19 nt, Homo sapiens
caucacauuucucugaaga

SEQ ID NO: 1224667 - RNA, 19 nt, Homo sapiens
caugcacauuccauaaaua

SEQ ID NO: 1224668 - RNA, 19 nt, Homo sapiens
gaguaaaugucagcccaaa

SEQ ID NO: 1224669 - RNA, 19 nt, Homo sapiens
uacagacccuacuauaauu

SEQ ID NO: 1224670 - RNA, 19 nt, Homo sapiens
gcauggaguugcugugagu

SEQ ID NO: 1224671 - RNA, 19 nt, Homo sapiens
caacauaggcuaccaaaau

SEQ ID NO: 1224672 - RNA, 19 nt, Homo sapiens
ggagccagaucucaugagu

SEQ ID NO: 1224673 - RNA, 19 nt, Homo sapiens
caagaagaaucagaagcuu

SEQ ID NO: 1224674 - RNA, 19 nt, Homo sapiens
gaugaaggccauugcauag

SEQ ID NO: 1224675 - RNA, 19 nt, Homo sapiens
ccacaggaaugguucuaca

SEQ ID NO: 1224676 - RNA, 19 nt, Homo sapiens
guccaucucucccucaaga

SEQ ID NO: 1224677 - RNA, 19 nt, Homo sapiens
caagcaagaaugccacgua

SEQ ID NO: 1224678 - RNA, 19 nt, Homo sapiens
acaaaucuaucaugagucu

SEQ ID NO: 1224679 - RNA, 19 nt, Homo sapiens
ccaaacaguacaaaucuau

SEQ ID NO: 1224680 - RNA, 19 nt, Homo sapiens
acaaguaccuguguuucuu

SEQ ID NO: 1224681 - RNA, 19 nt, Homo sapiens
aguauacacuggcuauuug

SEQ ID NO: 1224682 - RNA, 19 nt, Homo sapiens
ugaaggccauugcauagau

SEQ ID NO: 1224683 - RNA, 19 nt, Homo sapiens
gaaccaucaacuugucuuu

SEQ ID NO: 1224684 - RNA, 19 nt, Homo sapiens
aaggagaacuaaugacugu

SEQ ID NO: 1224685 - RNA, 19 nt, Homo sapiens
ccauuaaguuggaaaccuu

SEQ ID NO: 1224686 - RNA, 19 nt, Homo sapiens
gaauaaagggccuacuuac

SEQ ID NO: 1224687 - RNA, 19 nt, Homo sapiens
gcauugcuuugauucaugu

SEQ ID NO: 1224688 - RNA, 19 nt, Homo sapiens
acagacauuucauggguuu

SEQ ID NO: 1224689 - RNA, 19 nt, Homo sapiens
aaacuggaaggaacaagua

SEQ ID NO: 1224690 - RNA, 19 nt, Homo sapiens
uaucaugagucugguagaa

SEQ ID NO: 1224691 - RNA, 19 nt, Homo sapiens
ugaacaagcagaauuaagu

SEQ ID NO: 1224692 - RNA, 19 nt, Homo sapiens
ccaugcagguagaaauuug

SEQ ID NO: 1224693 - RNA, 19 nt, Homo sapiens
gcaagaagaaucagaagcu

SEQ ID NO: 1224694 - RNA, 19 nt, Homo sapiens
gcaagaaugccacguacuc

SEQ ID NO: 1224695 - RNA, 19 nt, Homo sapiens
auucaggucucucaugauu

SEQ ID NO: 1224696 - RNA, 19 nt, Homo sapiens
cuacuucauuugauguuug

SEQ ID NO: 1224697 - RNA, 19 nt, Homo sapiens
ggucucucaugauuauauu

SEQ ID NO: 1224698 - RNA, 19 nt, Homo sapiens
ggauauaacccauguuuug

SEQ ID NO: 1224699 - RNA, 19 nt, Homo sapiens
gaaggccauugcauagauc

SEQ ID NO: 1224700 - RNA, 19 nt, Homo sapiens
gaaggucccugaaaacauc

SEQ ID NO: 1224701 - RNA, 19 nt, Homo sapiens
ccacagguuucaugagaag

SEQ ID NO: 1224702 - RNA, 19 nt, Homo sapiens
caaaaugcguagaugcuuu

SEQ ID NO: 1224703 - RNA, 19 nt, Homo sapiens
aaacuucagcugacauuga

SEQ ID NO: 1224704 - RNA, 19 nt, Homo sapiens
gaaguucaagccugugaug

SEQ ID NO: 1224705 - RNA, 19 nt, Homo sapiens
ucagaacccauguuuaaug

SEQ ID NO: 1224706 - RNA, 19 nt, Homo sapiens
guggauauaacccauguuu

SEQ ID NO: 1224707 - RNA, 19 nt, Homo sapiens
aauagggcuuuaguucuua

SEQ ID NO: 1224708 - RNA, 19 nt, Homo sapiens
cuaguagucacaugucaua

SEQ ID NO: 1224709 - RNA, 19 nt, Homo sapiens
aaauuucuaugcacaagga

SEQ ID NO: 1224710 - RNA, 19 nt, Homo sapiens
agaagaaucagaagcuuga

SEQ ID NO: 1224711 - RNA, 19 nt, Homo sapiens
gaacuugucucaaaggaaa

SEQ ID NO: 1224712 - RNA, 19 nt, Homo sapiens
gagcauaucuaaacaagaa

SEQ ID NO: 1224713 - RNA, 19 nt, Homo sapiens
gagaugagauucugcacaa

SEQ ID NO: 1224714 - RNA, 19 nt, Homo sapiens
gcauuagucuggauucuug

SEQ ID NO: 1224715 - RNA, 19 nt, Homo sapiens
guacagccgucucuuucua

SEQ ID NO: 1224716 - RNA, 19 nt, Homo sapiens
gaauugauaggcucacaua

SEQ ID NO: 1224717 - RNA, 19 nt, Homo sapiens
ggguauaucuucugugaau

SEQ ID NO: 1224718 - RNA, 19 nt, Homo sapiens
ccaaauagcugggacuaca

SEQ ID NO: 1224719 - RNA, 19 nt, Homo sapiens
ucacauaacugaaauucca

SEQ ID NO: 1224720 - RNA, 19 nt, Homo sapiens
gauucuugcuuacagauaa

SEQ ID NO: 1224721 - RNA, 19 nt, Homo sapiens
ggaaagcccucugacauac

SEQ ID NO: 1224722 - RNA, 19 nt, Homo sapiens
guagaggaaugaagacuca

SEQ ID NO: 1224723 - RNA, 19 nt, Homo sapiens
gcaagggagugauagaaag

SEQ ID NO: 1224724 - RNA, 19 nt, Homo sapiens
gacagggucuccauauguu

SEQ ID NO: 1224725 - RNA, 19 nt, Homo sapiens
gcccguaauucucacauuu

SEQ ID NO: 1224726 - RNA, 19 nt, Homo sapiens
auacugauaugguuacuga

SEQ ID NO: 1224727 - RNA, 19 nt, Homo sapiens
uggcaucacuuccaacuga

SEQ ID NO: 1224728 - RNA, 19 nt, Homo sapiens
ggugggaggucuucaaagu

SEQ ID NO: 1224729 - RNA, 19 nt, Homo sapiens
ugaccaaacuaaagugaga

SEQ ID NO: 1224730 - RNA, 19 nt, Homo sapiens
gagagacagugaugagcaa

SEQ ID NO: 1224731 - RNA, 19 nt, Homo sapiens
gcacauucuuugaccugaa

SEQ ID NO: 1224732 - RNA, 19 nt, Homo sapiens
guggguauaucuucuguga

SEQ ID NO: 1224733 - RNA, 19 nt, Homo sapiens
gcccaucccugaacaauac

SEQ ID NO: 1224734 - RNA, 19 nt, Homo sapiens
gauaggcucacauaacuga

SEQ ID NO: 1224735 - RNA, 19 nt, Homo sapiens
cagacaagacugcauguaa

SEQ ID NO: 1224736 - RNA, 19 nt, Homo sapiens
ggucgaggcaggaguauug

SEQ ID NO: 1224737 - RNA, 19 nt, Homo sapiens
cagcccaucucacuucuga

SEQ ID NO: 1224738 - RNA, 19 nt, Homo sapiens
uaccauagcagaagauuga

SEQ ID NO: 1224739 - RNA, 19 nt, Homo sapiens
gcagcaggaugagcagaaa

SEQ ID NO: 1224740 - RNA, 19 nt, Homo sapiens
aagauaggaucaaaugaga

SEQ ID NO: 1224741 - RNA, 19 nt, Homo sapiens
cccaggaguuuauauaaga

SEQ ID NO: 1224742 - RNA, 19 nt, Homo sapiens
gacaaugugaccaaacuaa

SEQ ID NO: 1224743 - RNA, 19 nt, Homo sapiens
uagguuaucuccaacuaug

SEQ ID NO: 1224744 - RNA, 19 nt, Homo sapiens
gaaggucuuugagcuuguu

SEQ ID NO: 1224745 - RNA, 19 nt, Homo sapiens
gaaguucgagaccagcuuu

SEQ ID NO: 1224746 - RNA, 19 nt, Homo sapiens
gagcaagcacauucuuuga

SEQ ID NO: 1224747 - RNA, 19 nt, Homo sapiens
gauaggaucaaaugagaug

SEQ ID NO: 1224748 - RNA, 19 nt, Homo sapiens
guacuacccuucccagacu

SEQ ID NO: 1224749 - RNA, 19 nt, Homo sapiens
uggaaagcccucugacaua

SEQ ID NO: 1224750 - RNA, 19 nt, Homo sapiens
agacaagacugcauguaag

SEQ ID NO: 1224751 - RNA, 19 nt, Homo sapiens
ggugauagagugagaacuu

SEQ ID NO: 1224752 - RNA, 19 nt, Homo sapiens
ggaggucgaggcaggagua

SEQ ID NO: 1224753 - RNA, 19 nt, Homo sapiens
ggagggcagugacgugauc

SEQ ID NO: 1224754 - RNA, 19 nt, Homo sapiens
gagcaguugucccacuuca

SEQ ID NO: 1224755 - RNA, 19 nt, Homo sapiens
guaaguggguauaucuucu

SEQ ID NO: 1224756 - RNA, 19 nt, Homo sapiens
guuagguuaucuccaacua

SEQ ID NO: 1224757 - RNA, 19 nt, Homo sapiens
cuuccaaucucagcuuaua

SEQ ID NO: 1224758 - RNA, 19 nt, Homo sapiens
gcucugagaugagauucug

SEQ ID NO: 1224759 - RNA, 19 nt, Homo sapiens
acaagucuuuaacuccaua

SEQ ID NO: 1224760 - RNA, 19 nt, Homo sapiens
caccaccacucccggcuaa

SEQ ID NO: 1224761 - RNA, 19 nt, Homo sapiens
agacagugaugagcaaaga

SEQ ID NO: 1224762 - RNA, 19 nt, Homo sapiens
gguauaucuucugugaaua

SEQ ID NO: 1224763 - RNA, 19 nt, Homo sapiens
caagauaggaucaaaugag

SEQ ID NO: 1224764 - RNA, 19 nt, Homo sapiens
aguaaguguuaguguguua

SEQ ID NO: 1224765 - RNA, 19 nt, Homo sapiens
uagucuggauucuugcuua

SEQ ID NO: 1224766 - RNA, 19 nt, Homo sapiens
gagcaagggagugauagaa

SEQ ID NO: 1224767 - RNA, 19 nt, Homo sapiens
ccucuuaucccauugcauu

SEQ ID NO: 1224768 - RNA, 19 nt, Homo sapiens
gcccaggaguuuauauaag

SEQ ID NO: 1224769 - RNA, 19 nt, Homo sapiens
ggacaaugugaccaaacua

SEQ ID NO: 1224770 - RNA, 19 nt, Homo sapiens
gacaagacugcauguaaga

SEQ ID NO: 1224771 - RNA, 19 nt, Homo sapiens
cacuucagccucccaaaua

SEQ ID NO: 1224772 - RNA, 19 nt, Homo sapiens
uaucuucugugaauagcaa

SEQ ID NO: 1224773 - RNA, 19 nt, Homo sapiens
gcccaucucacuucugaaa

SEQ ID NO: 1224774 - RNA, 19 nt, Homo sapiens
ugacagggucuccauaugu

SEQ ID NO: 1224775 - RNA, 19 nt, Homo sapiens
gggcagagcaaaccguaga

SEQ ID NO: 1224776 - RNA, 19 nt, Homo sapiens
ggcuaggucucucucaaug

SEQ ID NO: 1224777 - RNA, 19 nt, Homo sapiens
ggaaggucuuugagcuugu

SEQ ID NO: 1224778 - RNA, 19 nt, Homo sapiens
uaagguaggaggaggauuc

SEQ ID NO: 1224779 - RNA, 19 nt, Homo sapiens
uuaauuagcugggcauggu

SEQ ID NO: 1224780 - RNA, 19 nt, Homo sapiens
cacauucuuugaccugaaa

SEQ ID NO: 1224781 - RNA, 19 nt, Homo sapiens
ccugaacaauacugcaauu

SEQ ID NO: 1224782 - RNA, 19 nt, Homo sapiens
gacagaaaguauccaacca

SEQ ID NO: 1224783 - RNA, 19 nt, Homo sapiens
ggagacagaaaguauccaa

SEQ ID NO: 1224784 - RNA, 19 nt, Homo sapiens
cacaagauaggaucaaaug

SEQ ID NO: 1224785 - RNA, 19 nt, Homo sapiens
gugauagagugagaacuug

SEQ ID NO: 1224786 - RNA, 19 nt, Homo sapiens
caucauaaguacguauuac

SEQ ID NO: 1224787 - RNA, 19 nt, Homo sapiens
uauauaagagagacaguga

SEQ ID NO: 1224788 - RNA, 19 nt, Homo sapiens
uccaaucucagcuuauaua

SEQ ID NO: 1224789 - RNA, 19 nt, Homo sapiens
acuguacacuccugaaaug

SEQ ID NO: 1224790 - RNA, 19 nt, Homo sapiens
gagcaaaccguagaugucu

SEQ ID NO: 1224791 - RNA, 19 nt, Homo sapiens
gcuaguuacccaaaggaaa

SEQ ID NO: 1224792 - RNA, 19 nt, Homo sapiens
gaugagauucugcacaagu

SEQ ID NO: 1224793 - RNA, 19 nt, Homo sapiens
gguggaggcagcaggauga

SEQ ID NO: 1224794 - RNA, 19 nt, Homo sapiens
gaggccaucuuuggacaau

SEQ ID NO: 1224795 - RNA, 19 nt, Homo sapiens
agauuuauuugcugaagug

SEQ ID NO: 1224796 - RNA, 19 nt, Homo sapiens
uauaagagagacagugaug

SEQ ID NO: 1224797 - RNA, 19 nt, Homo sapiens
ggauucuugcuuacagaua

SEQ ID NO: 1224798 - RNA, 19 nt, Homo sapiens
ccaggacaaugugaccaaa

SEQ ID NO: 1224799 - RNA, 19 nt, Homo sapiens
gagcuuguucugagaggaa

SEQ ID NO: 1224800 - RNA, 19 nt, Homo sapiens
guauaucuucugugaauag

SEQ ID NO: 1224801 - RNA, 19 nt, Homo sapiens
gagauacaggagacagaaa

SEQ ID NO: 1224802 - RNA, 19 nt, Homo sapiens
ggguucgcuuugugugaua

SEQ ID NO: 1224803 - RNA, 19 nt, Homo sapiens
caggagcaagggagugaua

SEQ ID NO: 1224804 - RNA, 19 nt, Homo sapiens
uaagagagacagugaugag

SEQ ID NO: 1224805 - RNA, 19 nt, Homo sapiens
cagagcaagcacauucuuu

SEQ ID NO: 1224806 - RNA, 19 nt, Homo sapiens
uugauaggcucacauaacu

SEQ ID NO: 1224807 - RNA, 19 nt, Homo sapiens
guggaaagcccucugacau

SEQ ID NO: 1224808 - RNA, 19 nt, Homo sapiens
ggagcaagggagugauaga

SEQ ID NO: 1224809 - RNA, 19 nt, Homo sapiens
caagucagcagugcagaga

SEQ ID NO: 1224810 - RNA, 19 nt, Homo sapiens
ugggaggucuucaaaguac

SEQ ID NO: 1224811 - RNA, 19 nt, Homo sapiens
gaaaggaagacaaagauuu

SEQ ID NO: 1224812 - RNA, 19 nt, Homo sapiens
gagaaagacuugauaagag

SEQ ID NO: 1224813 - RNA, 19 nt, Homo sapiens
caugagggcuguuaauuug

SEQ ID NO: 1224814 - RNA, 19 nt, Homo sapiens
gaacccaacuugugaugga

SEQ ID NO: 1224815 - RNA, 19 nt, Homo sapiens
gggagaagcucguugaaag

SEQ ID NO: 1224816 - RNA, 19 nt, Homo sapiens
gggagugccucaaggagua

SEQ ID NO: 1224817 - RNA, 19 nt, Homo sapiens
cagaggaucucaagcuauu

SEQ ID NO: 1224818 - RNA, 19 nt, Homo sapiens
gaaguggucuugcuuucug

SEQ ID NO: 1224819 - RNA, 19 nt, Homo sapiens
caaccuccguucuauuuau

SEQ ID NO: 1224820 - RNA, 19 nt, Homo sapiens
ggaagguggugaaucuuuc

SEQ ID NO: 1224821 - RNA, 19 nt, Homo sapiens
gaggagagcucagccaagu

SEQ ID NO: 1224822 - RNA, 19 nt, Homo sapiens
ccagagaccugcagaggau

SEQ ID NO: 1224823 - RNA, 19 nt, Homo sapiens
guaaccaugugcaauaugu

SEQ ID NO: 1224824 - RNA, 19 nt, Homo sapiens
ucaaggaguaugcccauua

SEQ ID NO: 1224825 - RNA, 19 nt, Homo sapiens
gaaaauuccuuuggagaaa

SEQ ID NO: 1224826 - RNA, 19 nt, Homo sapiens
uuacagggcaugaguuuaa

SEQ ID NO: 1224827 - RNA, 19 nt, Homo sapiens
ggagagcucagccaaguga

SEQ ID NO: 1224828 - RNA, 19 nt, Homo sapiens
gcacguucauuuguuguug

SEQ ID NO: 1224829 - RNA, 19 nt, Homo sapiens
cgagaaagacuugauaaga

SEQ ID NO: 1224830 - RNA, 19 nt, Homo sapiens
gggauuuggugauacuuga

SEQ ID NO: 1224831 - RNA, 19 nt, Homo sapiens
ggacacagaccacugaucu

SEQ ID NO: 1224832 - RNA, 19 nt, Homo sapiens
ggauuugccugcagcuuuc

SEQ ID NO: 1224833 - RNA, 19 nt, Homo sapiens
gcaagcaguuuggauucaa

SEQ ID NO: 1224834 - RNA, 19 nt, Homo sapiens
gcauggagacaguaagaaa

SEQ ID NO: 1224835 - RNA, 19 nt, Homo sapiens
ggccugaguugguguguau

SEQ ID NO: 1224836 - RNA, 19 nt, Homo sapiens
gccaaccuccguucuauuu

SEQ ID NO: 1224837 - RNA, 19 nt, Homo sapiens
gaggaagccuuggagaugu

SEQ ID NO: 1224838 - RNA, 19 nt, Homo sapiens
cagcauguucuuugguuua

SEQ ID NO: 1224839 - RNA, 19 nt, Homo sapiens
ggagggagaagcucguuga

SEQ ID NO: 1224840 - RNA, 19 nt, Homo sapiens
gaucaaaagccaguauuua

SEQ ID NO: 1224841 - RNA, 19 nt, Homo sapiens
guacaugggcguuugauac

SEQ ID NO: 1224842 - RNA, 19 nt, Homo sapiens
cgaccacccuggcacaguu

SEQ ID NO: 1224843 - RNA, 19 nt, Homo sapiens
ccugcaagaucacauauuc

SEQ ID NO: 1224844 - RNA, 19 nt, Homo sapiens
auaaacacgucaccugcua

SEQ ID NO: 1224845 - RNA, 19 nt, Homo sapiens
aggaauaccugucuuggau

SEQ ID NO: 1224846 - RNA, 19 nt, Homo sapiens
ggauguacaugggcguuug

SEQ ID NO: 1224847 - RNA, 19 nt, Homo sapiens
gcagguaaccacagagcuu

SEQ ID NO: 1224848 - RNA, 19 nt, Homo sapiens
caaggaguaugcccauuac

SEQ ID NO: 1224849 - RNA, 19 nt, Homo sapiens
cauguucuuugguuuaguu

SEQ ID NO: 1224850 - RNA, 19 nt, Homo sapiens
gaggcuguguucaccacua

SEQ ID NO: 1224851 - RNA, 19 nt, Homo sapiens
gcauaugguuggagagaac

SEQ ID NO: 1224852 - RNA, 19 nt, Homo sapiens
ggaggcugcacguucauuu

SEQ ID NO: 1224853 - RNA, 19 nt, Homo sapiens
gcaaaggaccguggaagca

SEQ ID NO: 1224854 - RNA, 19 nt, Homo sapiens
gcugcacguucauuuguug

SEQ ID NO: 1224855 - RNA, 19 nt, Homo sapiens
gauaagaggccaggagagu

SEQ ID NO: 1224856 - RNA, 19 nt, Homo sapiens
caagaucacauauucuaca

SEQ ID NO: 1224857 - RNA, 19 nt, Homo sapiens
ggaagacaaagauuuaaac

SEQ ID NO: 1224858 - RNA, 19 nt, Homo sapiens
gcacguguauugaaauccu

SEQ ID NO: 1224859 - RNA, 19 nt, Homo sapiens
gagaagcucguugaaagga

SEQ ID NO: 1224860 - RNA, 19 nt, Homo sapiens
gcagaggaucucaagcuau

SEQ ID NO: 1224861 - RNA, 19 nt, Homo sapiens
acaugagggcuguuaauuu

SEQ ID NO: 1224862 - RNA, 19 nt, Homo sapiens
ggucugugcuccuuuuaaa

SEQ ID NO: 1224863 - RNA, 19 nt, Homo sapiens
gagcaccucagcacgugua

SEQ ID NO: 1224864 - RNA, 19 nt, Homo sapiens
uuugauaccaccauugaua

SEQ ID NO: 1224865 - RNA, 19 nt, Homo sapiens
guaugcccauuacuuccua

SEQ ID NO: 1224866 - RNA, 19 nt, Homo sapiens
ggagaugugggcagaggaa

SEQ ID NO: 1224867 - RNA, 19 nt, Homo sapiens
cgaggaagccuuggagaug

SEQ ID NO: 1224868 - RNA, 19 nt, Homo sapiens
ggaauaccugucuuggauu

SEQ ID NO: 1224869 - RNA, 19 nt, Homo sapiens
ugagggcuguuaauuugga

SEQ ID NO: 1224870 - RNA, 19 nt, Homo sapiens
ggaagaggacacugaagag

SEQ ID NO: 1224871 - RNA, 19 nt, Homo sapiens
caccucagcacguguauug

SEQ ID NO: 1224872 - RNA, 19 nt, Homo sapiens
gagcauuccucugagaaac

SEQ ID NO: 1224873 - RNA, 19 nt, Homo sapiens
gcugucugcugcugaguca

SEQ ID NO: 1224874 - RNA, 19 nt, Homo sapiens
guugaaaggaagacaaaga

SEQ ID NO: 1224875 - RNA, 19 nt, Homo sapiens
gugauggacccgcagguaa

SEQ ID NO: 1224876 - RNA, 19 nt, Homo sapiens
ggguggcugucuugccuuu

SEQ ID NO: 1224877 - RNA, 19 nt, Homo sapiens
cccggaggaucccauauug

SEQ ID NO: 1224878 - RNA, 19 nt, Homo sapiens
agugggaacuggacacaga

SEQ ID NO: 1224879 - RNA, 19 nt, Homo sapiens
cagcacguguauugaaauc

SEQ ID NO: 1224880 - RNA, 19 nt, Homo sapiens
aaacacgucaccugcuaaa

SEQ ID NO: 1224881 - RNA, 19 nt, Homo sapiens
gcaguuuggauucaaguuc

SEQ ID NO: 1224882 - RNA, 19 nt, Homo sapiens
gaggaauaccugucuugga

SEQ ID NO: 1224883 - RNA, 19 nt, Homo sapiens
caaaggaccguggaagcaa

SEQ ID NO: 1224884 - RNA, 19 nt, Homo sapiens
guucuuugguuuaguuugg

SEQ ID NO: 1224885 - RNA, 19 nt, Homo sapiens
cuuguaaccaugugcaaua

SEQ ID NO: 1224886 - RNA, 19 nt, Homo sapiens
ugaaaggaagacaaagauu

SEQ ID NO: 1224887 - RNA, 19 nt, Homo sapiens
cccagugaaucgagaaaga

SEQ ID NO: 1224888 - RNA, 19 nt, Homo sapiens
ccaaccuccguucuauuua

SEQ ID NO: 1224889 - RNA, 19 nt, Homo sapiens
ugcaagaucacauauucua

SEQ ID NO: 1224890 - RNA, 19 nt, Homo sapiens
ugcagaggaucucaagcua

SEQ ID NO: 1224891 - RNA, 19 nt, Homo sapiens
gaaggauagcaauguggaa

SEQ ID NO: 1224892 - RNA, 19 nt, Homo sapiens
ccaccucucuccaccacau

SEQ ID NO: 1224893 - RNA, 19 nt, Homo sapiens
acagaccacugaucucaag

SEQ ID NO: 1224894 - RNA, 19 nt, Homo sapiens
auaggaggcugcacguuca

SEQ ID NO: 1224895 - RNA, 19 nt, Homo sapiens
cagcauggagacaguaaga

SEQ ID NO: 1224896 - RNA, 19 nt, Homo sapiens
aaaggaccguggaagcaau

SEQ ID NO: 1224897 - RNA, 19 nt, Homo sapiens
ccgaaguggucuugcuuuc

SEQ ID NO: 1224898 - RNA, 19 nt, Homo sapiens
gaaauccugcugguagugu

SEQ ID NO: 1224899 - RNA, 19 nt, Homo sapiens
cagaggaagaggacacuga

SEQ ID NO: 1224900 - RNA, 19 nt, Homo sapiens
gcaugcauauggccauugc

SEQ ID NO: 1224901 - RNA, 19 nt, Homo sapiens
cggaagguggugaaucuuu

SEQ ID NO: 1224902 - RNA, 19 nt, Homo sapiens
ucagcauguucuuugguuu

SEQ ID NO: 1224903 - RNA, 19 nt, Homo sapiens
cuuagucccaccuguauuu

SEQ ID NO: 1224904 - RNA, 19 nt, Homo sapiens
gaggucacccugcaagauc

SEQ ID NO: 1224905 - RNA, 19 nt, Homo sapiens
ccacaugagggcuguuaau

SEQ ID NO: 1224906 - RNA, 19 nt, Homo sapiens
ggaccuaugcuuggccuau

SEQ ID NO: 1224907 - RNA, 19 nt, Homo sapiens
gugaaucgagaaagacuug

SEQ ID NO: 1224908 - RNA, 19 nt, Homo sapiens
cugcagcccuuggauaugu

SEQ ID NO: 1224909 - RNA, 19 nt, Homo sapiens
gaacugggaggugcaaagg

SEQ ID NO: 1224910 - RNA, 19 nt, Homo sapiens
gauaggcaagcgacugguu

SEQ ID NO: 1224911 - RNA, 19 nt, Homo sapiens
gguuaaacaugacaaguua

SEQ ID NO: 1224912 - RNA, 19 nt, Homo sapiens
ccucaguucucaaauauua

SEQ ID NO: 1224913 - RNA, 19 nt, Homo sapiens
ggucagaggucauacaguu

SEQ ID NO: 1224914 - RNA, 19 nt, Homo sapiens
ggaagaagguccagcuaug

SEQ ID NO: 1224915 - RNA, 19 nt, Homo sapiens
gcaaugcaguuauacagaa

SEQ ID NO: 1224916 - RNA, 19 nt, Homo sapiens
ggaaagaugucaccaacuc

SEQ ID NO: 1224917 - RNA, 19 nt, Homo sapiens
ggaccuagauguagaugau

SEQ ID NO: 1224918 - RNA, 19 nt, Homo sapiens
ucagggagguuaaacauga

SEQ ID NO: 1224919 - RNA, 19 nt, Homo sapiens
aauaagccgugccucauua

SEQ ID NO: 1224920 - RNA, 19 nt, Homo sapiens
caagcugugugacuuagua

SEQ ID NO: 1224921 - RNA, 19 nt, Homo sapiens
cuaagaaugucaauggaaa

SEQ ID NO: 1224922 - RNA, 19 nt, Homo sapiens
gaggagagccaauauugaa

SEQ ID NO: 1224923 - RNA, 19 nt, Homo sapiens
ggaauaguacuaacaaugu

SEQ ID NO: 1224924 - RNA, 19 nt, Homo sapiens
gcaaagagggaagaaauug

SEQ ID NO: 1224925 - RNA, 19 nt, Homo sapiens
gagaaucaauacccagaug

SEQ ID NO: 1224926 - RNA, 19 nt, Homo sapiens
ccaacgaaaucaagacaga

SEQ ID NO: 1224927 - RNA, 19 nt, Homo sapiens
gcgauuaucuacauccaau

SEQ ID NO: 1224928 - RNA, 19 nt, Homo sapiens
gaaguuaacaugccugaca

SEQ ID NO: 1224929 - RNA, 19 nt, Homo sapiens
cagaggcccuggaugauga

SEQ ID NO: 1224930 - RNA, 19 nt, Homo sapiens
ggaaguucauaugggaaua

SEQ ID NO: 1224931 - RNA, 19 nt, Homo sapiens
cauguguucuuacaguaua

SEQ ID NO: 1224932 - RNA, 19 nt, Homo sapiens
gcccucaguucucaaauau

SEQ ID NO: 1224933 - RNA, 19 nt, Homo sapiens
aguauuaacucccaguaaa

SEQ ID NO: 1224934 - RNA, 19 nt, Homo sapiens
uuaccucccugaaaguaua

SEQ ID NO: 1224935 - RNA, 19 nt, Homo sapiens
gcaaacagcaugggucaga

SEQ ID NO: 1224936 - RNA, 19 nt, Homo sapiens
gaagaggaccuagauguag

SEQ ID NO: 1224937 - RNA, 19 nt, Homo sapiens
gcgugaggauaauugauuu

SEQ ID NO: 1224938 - RNA, 19 nt, Homo sapiens
guuuagacguagcaccuua

SEQ ID NO: 1224939 - RNA, 19 nt, Homo sapiens
agacagaggcccuggauga

SEQ ID NO: 1224940 - RNA, 19 nt, Homo sapiens
ugucagaucuggaaagagu

SEQ ID NO: 1224941 - RNA, 19 nt, Homo sapiens
agauguagaugauaaagug

SEQ ID NO: 1224942 - RNA, 19 nt, Homo sapiens
gaauaguacuaacaauguc

SEQ ID NO: 1224943 - RNA, 19 nt, Homo sapiens
gaaggaaggagaucaagag

SEQ ID NO: 1224944 - RNA, 19 nt, Homo sapiens
gagagugcuuccagguauu

SEQ ID NO: 1224945 - RNA, 19 nt, Homo sapiens
ggaaauggcagcagucaac

SEQ ID NO: 1224946 - RNA, 19 nt, Homo sapiens
ggacagcagugugauaaaa

SEQ ID NO: 1224947 - RNA, 19 nt, Homo sapiens
gugccuggcuguuauggaa

SEQ ID NO: 1224948 - RNA, 19 nt, Homo sapiens
gggaauaguacuaacaaug

SEQ ID NO: 1224949 - RNA, 19 nt, Homo sapiens
cagcaauccuggagaguca

SEQ ID NO: 1224950 - RNA, 19 nt, Homo sapiens
uggcuguuauggaaaguua

SEQ ID NO: 1224951 - RNA, 19 nt, Homo sapiens
cgauuuaccuggagaaagg

SEQ ID NO: 1224952 - RNA, 19 nt, Homo sapiens
gacaaacccuggcgcuaca

SEQ ID NO: 1224953 - RNA, 19 nt, Homo sapiens
agagagugcuuccagguau

SEQ ID NO: 1224954 - RNA, 19 nt, Homo sapiens
gaaucaauacccagaugaa

SEQ ID NO: 1224955 - RNA, 19 nt, Homo sapiens
ccacacagacgcagcauuc

SEQ ID NO: 1224956 - RNA, 19 nt, Homo sapiens
gacccugaauggagacaaa

SEQ ID NO: 1224957 - RNA, 19 nt, Homo sapiens
gcuuccagguauuuagaua

SEQ ID NO: 1224958 - RNA, 19 nt, Homo sapiens
gcugucagaucuggaaaga

SEQ ID NO: 1224959 - RNA, 19 nt, Homo sapiens
ccaacucgcuaccaugcaa

SEQ ID NO: 1224960 - RNA, 19 nt, Homo sapiens
agacuuuccucgguccuua

SEQ ID NO: 1224961 - RNA, 19 nt, Homo sapiens
ugacugaucagggagguua

SEQ ID NO: 1224962 - RNA, 19 nt, Homo sapiens
gcaucuuccucuacagcua

SEQ ID NO: 1224963 - RNA, 19 nt, Homo sapiens
agaguuaccucccugaaag

SEQ ID NO: 1224964 - RNA, 19 nt, Homo sapiens
agaagaggaccuagaugua

SEQ ID NO: 1224965 - RNA, 19 nt, Homo sapiens
caauagaggacccugaaug

SEQ ID NO: 1224966 - RNA, 19 nt, Homo sapiens
aauacugccuucugccuuu

SEQ ID NO: 1224967 - RNA, 19 nt, Homo sapiens
caauaagccgugccucauu

SEQ ID NO: 1224968 - RNA, 19 nt, Homo sapiens
gcccucagccuuugcauau

SEQ ID NO: 1224969 - RNA, 19 nt, Homo sapiens
ggcccuggaugaugacuga

SEQ ID NO: 1224970 - RNA, 19 nt, Homo sapiens
cgacaaggagccaacgaaa

SEQ ID NO: 1224971 - RNA, 19 nt, Homo sapiens
gaugacaguacgagccaua

SEQ ID NO: 1224972 - RNA, 19 nt, Homo sapiens
caagaggagagccaauauu

SEQ ID NO: 1224973 - RNA, 19 nt, Homo sapiens
gaucagggagguuaaacau

SEQ ID NO: 1224974 - RNA, 19 nt, Homo sapiens
acaaggagccaacgaaauc

SEQ ID NO: 1224975 - RNA, 19 nt, Homo sapiens
gcuaagaaugucaauggaa

SEQ ID NO: 1224976 - RNA, 19 nt, Homo sapiens
ucagaucuggaaagaguua

SEQ ID NO: 1224977 - RNA, 19 nt, Homo sapiens
gcacagguaacagguauca

SEQ ID NO: 1224978 - RNA, 19 nt, Homo sapiens
cagaagaggaccuagaugu

SEQ ID NO: 1224979 - RNA, 19 nt, Homo sapiens
gcaauaagccgugccucau

SEQ ID NO: 1224980 - RNA, 19 nt, Homo sapiens
caaaggaacacuagaaucc

SEQ ID NO: 1224981 - RNA, 19 nt, Homo sapiens
gggaguauccacagaguca

SEQ ID NO: 1224982 - RNA, 19 nt, Homo sapiens
cgacgggaaugacuacucu

SEQ ID NO: 1224983 - RNA, 19 nt, Homo sapiens
ggagagucaugggauagau

SEQ ID NO: 1224984 - RNA, 19 nt, Homo sapiens
aagaggagagccaauauug

SEQ ID NO: 1224985 - RNA, 19 nt, Homo sapiens
gaggauuucccaagcaguu

SEQ ID NO: 1224986 - RNA, 19 nt, Homo sapiens
aagaggaccuagauguaga

SEQ ID NO: 1224987 - RNA, 19 nt, Homo sapiens
gcuagauuauacuucuuug

SEQ ID NO: 1224988 - RNA, 19 nt, Homo sapiens
uaauugguuugcuaacaga

SEQ ID NO: 1224989 - RNA, 19 nt, Homo sapiens
gaagaagguccagcuaugg

SEQ ID NO: 1224990 - RNA, 19 nt, Homo sapiens
aaugagcgauuaucuacau

SEQ ID NO: 1224991 - RNA, 19 nt, Homo sapiens
ggucguggcacaggaauga

SEQ ID NO: 1224992 - RNA, 19 nt, Homo sapiens
gcagucaaccacacuaucu

SEQ ID NO: 1224993 - RNA, 19 nt, Homo sapiens
gaagcaaagagggaagaaa

SEQ ID NO: 1224994 - RNA, 19 nt, Homo sapiens
gggagaauaaugagcgauu

SEQ ID NO: 1224995 - RNA, 19 nt, Homo sapiens
aaucuuggguaccuuuaga

SEQ ID NO: 1224996 - RNA, 19 nt, Homo sapiens
ccuggagagucaugggaua

SEQ ID NO: 1224997 - RNA, 19 nt, Homo sapiens
gagggacagcagugugaua

SEQ ID NO: 1224998 - RNA, 19 nt, Homo sapiens
ugugugacuuaguagauaa

SEQ ID NO: 1224999 - RNA, 19 nt, Homo sapiens
ccacagagucaaaggaaca

SEQ ID NO: 1225000 - RNA, 19 nt, Homo sapiens
cauaugggaauaguacuaa

SEQ ID NO: 1225001 - RNA, 19 nt, Homo sapiens
gacaaggagccaacgaaau

SEQ ID NO: 1225002 - RNA, 19 nt, Homo sapiens
ggcauuggcccgacaagga

SEQ ID NO: 1225003 - RNA, 19 nt, Homo sapiens
ugacuacucugagcaggau

SEQ ID NO: 1225004 - RNA, 19 nt, Homo sapiens
gagagccaauauugaagca

SEQ ID NO: 1225005 - RNA, 19 nt, Homo sapiens
gcaugggucagaggucaua

SEQ ID NO: 1225006 - RNA, 19 nt, Homo sapiens
guauuaacucccaguaaau

SEQ ID NO: 1225007 - RNA, 19 nt, Homo sapiens
aagcaaagagggaagaaau

SEQ ID NO: 1225008 - RNA, 19 nt, Homo sapiens
gcaguuguugcacagguaa

SEQ ID NO: 1225009 - RNA, 19 nt, Homo sapiens
gaugauaaaguggaagaau

SEQ ID NO: 1225010 - RNA, 19 nt, Homo sapiens
uagcaacaguuaugacacu

SEQ ID NO: 1225011 - RNA, 19 nt, Homo sapiens
gaacuaagguugccuaaag

SEQ ID NO: 1225012 - RNA, 19 nt, Homo sapiens
gaaggaagcugcucacacu

SEQ ID NO: 1225013 - RNA, 19 nt, Homo sapiens
caaacagggucgucuuaaa

SEQ ID NO: 1225014 - RNA, 19 nt, Homo sapiens
ccaucaagcucauuauuau

SEQ ID NO: 1225015 - RNA, 19 nt, Homo sapiens
gcaaacagggucgucuuaa

SEQ ID NO: 1225016 - RNA, 19 nt, Homo sapiens
gcagauaacgaacuaaggu

SEQ ID NO: 1225017 - RNA, 19 nt, Homo sapiens
cagagaauccucaccaguu

SEQ ID NO: 1225018 - RNA, 19 nt, Homo sapiens
ggcauuacuuagagauuga

SEQ ID NO: 1225019 - RNA, 19 nt, Homo sapiens
gagaaaaggggcauuguuu

SEQ ID NO: 1225020 - RNA, 19 nt, Homo sapiens
gguugcagauaacgaacua

SEQ ID NO: 1225021 - RNA, 19 nt, Homo sapiens
ggcaaacagggucgucuua

SEQ ID NO: 1225022 - RNA, 19 nt, Homo sapiens
agagaauccucaccaguuc

SEQ ID NO: 1225023 - RNA, 19 nt, Homo sapiens
cagcacuccuuuccugguu

SEQ ID NO: 1225024 - RNA, 19 nt, Homo sapiens
caaaaggcauuacuuagag

SEQ ID NO: 1225025 - RNA, 19 nt, Homo sapiens
accaucaagcucauuauua

SEQ ID NO: 1225026 - RNA, 19 nt, Homo sapiens
gggccacucacucgaauga

SEQ ID NO: 1225027 - RNA, 19 nt, Homo sapiens
gccacucacucgaaugaca

SEQ ID NO: 1225028 - RNA, 19 nt, Homo sapiens
aggcauuacuuagagauug

SEQ ID NO: 1225029 - RNA, 19 nt, Homo sapiens
caguuccugugaauaaaug

SEQ ID NO: 1225030 - RNA, 19 nt, Homo sapiens
aaacagggucgucuuaaaa

SEQ ID NO: 1225031 - RNA, 19 nt, Homo sapiens
ucaaaaggcauuacuuaga

SEQ ID NO: 1225032 - RNA, 19 nt, Homo sapiens
gcucugccaggacagguuu

SEQ ID NO: 1225033 - RNA, 19 nt, Homo sapiens
ccucaccaguucucaccaa

SEQ ID NO: 1225034 - RNA, 19 nt, Homo sapiens
cagggucgucuuaaaauua

SEQ ID NO: 1225035 - RNA, 19 nt, Homo sapiens
cagauaacgaacuaagguu

SEQ ID NO: 1225036 - RNA, 19 nt, Homo sapiens
uuucacugcuuucucaaca

SEQ ID NO: 1225037 - RNA, 19 nt, Homo sapiens
caaccagacaccucaaacu

SEQ ID NO: 1225038 - RNA, 19 nt, Homo sapiens
gugccgggaccauguguug

SEQ ID NO: 1225039 - RNA, 19 nt, Homo sapiens
cuacaucccuaaagaauua

SEQ ID NO: 1225040 - RNA, 19 nt, Homo sapiens
ucaauaaacugauguguga

SEQ ID NO: 1225041 - RNA, 19 nt, Homo sapiens
gcaaagagaagacauuaaa

SEQ ID NO: 1225042 - RNA, 19 nt, Homo sapiens
gauaacguguuuccaaauu

SEQ ID NO: 1225043 - RNA, 19 nt, Homo sapiens
ccaauuucauguucucuua

SEQ ID NO: 1225044 - RNA, 19 nt, Homo sapiens
ggaaggaagaggccaauuu

SEQ ID NO: 1225045 - RNA, 19 nt, Homo sapiens
cuaaagauuugaagacuga

SEQ ID NO: 1225046 - RNA, 19 nt, Homo sapiens
ugacaagaguggaaugaaa

SEQ ID NO: 1225047 - RNA, 19 nt, Homo sapiens
gaagaggauuauauucguu

SEQ ID NO: 1225048 - RNA, 19 nt, Homo sapiens
gccauuuacuuguucaaua

SEQ ID NO: 1225049 - RNA, 19 nt, Homo sapiens
ggaagaggccaauuucaug

SEQ ID NO: 1225050 - RNA, 19 nt, Homo sapiens
gaaggaagaggccaauuuc

SEQ ID NO: 1225051 - RNA, 19 nt, Homo sapiens
ggaagaggauuauauucgu

SEQ ID NO: 1225052 - RNA, 19 nt, Homo sapiens
caaggaagaggauuauauu

SEQ ID NO: 1225053 - RNA, 19 nt, Homo sapiens
ucagaaggcuuuggcuaaa

SEQ ID NO: 1225054 - RNA, 19 nt, Homo sapiens
guaaucacuugaagagaau

SEQ ID NO: 1225055 - RNA, 19 nt, Homo sapiens
ccuaaagaauuaagugaug

SEQ ID NO: 1225056 - RNA, 19 nt, Homo sapiens
aguaaucacuugaagagaa

SEQ ID NO: 1225057 - RNA, 19 nt, Homo sapiens
agaaggagccauuuacuug

SEQ ID NO: 1225058 - RNA, 19 nt, Homo sapiens
aaacugaugugugacaaug

SEQ ID NO: 1225059 - RNA, 19 nt, Homo sapiens
gaagaggccaauuucaugu

SEQ ID NO: 1225060 - RNA, 19 nt, Homo sapiens
cagcaaagagaagacauua

SEQ ID NO: 1225061 - RNA, 19 nt, Homo sapiens
gagaaggagccauuuacuu

SEQ ID NO: 1225062 - RNA, 19 nt, Homo sapiens
ucugauaucugacuacauc

SEQ ID NO: 1225063 - RNA, 19 nt, Homo sapiens
gaaacuuccuggacuugag

SEQ ID NO: 1225064 - RNA, 19 nt, Homo sapiens
caaauccuccaucaaagaa

SEQ ID NO: 1225065 - RNA, 19 nt, Homo sapiens
agucucaucugacauaaug

SEQ ID NO: 1225066 - RNA, 19 nt, Homo sapiens
cagcacguguuccugguuu

SEQ ID NO: 1225067 - RNA, 19 nt, Homo sapiens
cccauggucugauaucuga

SEQ ID NO: 1225068 - RNA, 19 nt, Homo sapiens
gcugaaacuuccuggacuu

SEQ ID NO: 1225069 - RNA, 19 nt, Homo sapiens
gaaggagccauuuacuugu

SEQ ID NO: 1225070 - RNA, 19 nt, Homo sapiens
guuccugguuucagaauau

SEQ ID NO: 1225071 - RNA, 19 nt, Homo sapiens
ccaaauccuccaucaaaga

SEQ ID NO: 1225072 - RNA, 19 nt, Homo sapiens
ucauaaaggcugauaagga

SEQ ID NO: 1225073 - RNA, 19 nt, Homo sapiens
ggagucucaucugacauaa

SEQ ID NO: 1225074 - RNA, 19 nt, Homo sapiens
guuaucagaugagccugua

SEQ ID NO: 1225075 - RNA, 19 nt, Homo sapiens
gccuggcgcuaaauuuaaa

SEQ ID NO: 1225076 - RNA, 19 nt, Homo sapiens
caaauugcaucuuguugcu

SEQ ID NO: 1225077 - RNA, 19 nt, Homo sapiens
acaaggaagaggauuauau

SEQ ID NO: 1225078 - RNA, 19 nt, Homo sapiens
acauuaaaguggcuggaaa

SEQ ID NO: 1225079 - RNA, 19 nt, Homo sapiens
caggagaaggagccauuua

SEQ ID NO: 1225080 - RNA, 19 nt, Homo sapiens
ugccaaauccuccaucaaa

SEQ ID NO: 1225081 - RNA, 19 nt, Homo sapiens
guuaaugacuaccuuuggu

SEQ ID NO: 1225082 - RNA, 19 nt, Homo sapiens
gccaaauccuccaucaaag

SEQ ID NO: 1225083 - RNA, 19 nt, Homo sapiens
gaccaagcuuccacugaca

SEQ ID NO: 1225084 - RNA, 19 nt, Homo sapiens
cuucauggcuauggccuuu

SEQ ID NO: 1225085 - RNA, 19 nt, Homo sapiens
ugugguggauaacguguuu

SEQ ID NO: 1225086 - RNA, 19 nt, Homo sapiens
aaggagccauuuacuuguu

SEQ ID NO: 1225087 - RNA, 19 nt, Homo sapiens
cugacuacaucccuaaaga

SEQ ID NO: 1225088 - RNA, 19 nt, Homo sapiens
ggucugauaucugacuaca

SEQ ID NO: 1225089 - RNA, 19 nt, Homo sapiens
uaacguguuuccaaauugc

SEQ ID NO: 1225090 - RNA, 19 nt, Homo sapiens
ggcuaaaguugacaagagu

SEQ ID NO: 1225091 - RNA, 19 nt, Homo sapiens
aaaaugggcuaauguuugu

SEQ ID NO: 1225092 - RNA, 19 nt, Homo sapiens
ccagaaauagacaacaaga

SEQ ID NO: 1225093 - RNA, 19 nt, Homo sapiens
ggauaacguguuuccaaau

SEQ ID NO: 1225094 - RNA, 19 nt, Homo sapiens
ugucuaacuucauggcuau

SEQ ID NO: 1225095 - RNA, 19 nt, Homo sapiens
gacuacaucccuaaagaau

SEQ ID NO: 1225096 - RNA, 19 nt, Homo sapiens
ucaaacuguggcagcauua

SEQ ID NO: 1225097 - RNA, 19 nt, Homo sapiens
cuucuccacuaccucauaa

SEQ ID NO: 1225098 - RNA, 19 nt, Homo sapiens
uggagucucaucugacaua

SEQ ID NO: 1225099 - RNA, 19 nt, Homo sapiens
uggcuaaaguugacaagag

SEQ ID NO: 1225100 - RNA, 19 nt, Homo sapiens
ugacuacaucccuaaagaa

SEQ ID NO: 1225101 - RNA, 19 nt, Homo sapiens
ccugguuucagaauauuua

SEQ ID NO: 1225102 - RNA, 19 nt, Homo sapiens
acaaguacagcaaagagaa

SEQ ID NO: 1225103 - RNA, 19 nt, Homo sapiens
ggagaaggagccauuuacu

SEQ ID NO: 1225104 - RNA, 19 nt, Homo sapiens
gaucaaguugugguggaua

SEQ ID NO: 1225105 - RNA, 19 nt, Homo sapiens
ugacaaggaagaggauuau

SEQ ID NO: 1225106 - RNA, 19 nt, Homo sapiens
aagagaagacauuaaagug

SEQ ID NO: 1225107 - RNA, 19 nt, Homo sapiens
caaagagaagacauuaaag

SEQ ID NO: 1225108 - RNA, 19 nt, Homo sapiens
auaacguguuuccaaauug

SEQ ID NO: 1225109 - RNA, 19 nt, Homo sapiens
aaacuguggcagcauuaaa

SEQ ID NO: 1225110 - RNA, 19 nt, Homo sapiens
acugaugugugacaauguu

SEQ ID NO: 1225111 - RNA, 19 nt, Homo sapiens
uguccuuccugacuguuaa

SEQ ID NO: 1225112 - RNA, 19 nt, Homo sapiens
uuaugcccauggucugaua

SEQ ID NO: 1225113 - RNA, 19 nt, Homo sapiens
gacaaggaagaggauuaua

SEQ ID NO: 1225114 - RNA, 19 nt, Homo sapiens
cagaaauagacaacaagaa

SEQ ID NO: 1225115 - RNA, 19 nt, Homo sapiens
gcagcugcuugaaguaaaa

SEQ ID NO: 1225116 - RNA, 19 nt, Homo sapiens
ggagccauuuacuuguuca

SEQ ID NO: 1225117 - RNA, 19 nt, Homo sapiens
caaacuguggcagcauuaa

SEQ ID NO: 1225118 - RNA, 19 nt, Homo sapiens
uauuucugcuucuccacua

SEQ ID NO: 1225119 - RNA, 19 nt, Homo sapiens
agaggccaauuucauguuc

SEQ ID NO: 1225120 - RNA, 19 nt, Homo sapiens
agaugagccuguagaagca

SEQ ID NO: 1225121 - RNA, 19 nt, Homo sapiens
accuguggauccucuauuu

SEQ ID NO: 1225122 - RNA, 19 nt, Homo sapiens
aauaugggaaagugucuaa

SEQ ID NO: 1225123 - RNA, 19 nt, Homo sapiens
gcuggucucggaaacgaaa

SEQ ID NO: 1225124 - RNA, 19 nt, Homo sapiens
guuuccaaauugcaucuug

SEQ ID NO: 1225125 - RNA, 19 nt, Homo sapiens
uaucagaugagccuguaga

SEQ ID NO: 1225126 - RNA, 19 nt, Homo sapiens
uaucugacuacaucccuaa

SEQ ID NO: 1225127 - RNA, 19 nt, Homo sapiens
ucucggaaacgaaacgaaa

SEQ ID NO: 1225128 - RNA, 19 nt, Homo sapiens
aagguaauccagaaauaga

SEQ ID NO: 1225129 - RNA, 19 nt, Homo sapiens
gacaagaguggaaugaaaa

SEQ ID NO: 1225130 - RNA, 19 nt, Homo sapiens
cucagaaggcuuuggcuaa

SEQ ID NO: 1225131 - RNA, 19 nt, Homo sapiens
gcaaaagaagauuacacua

SEQ ID NO: 1225132 - RNA, 19 nt, Homo sapiens
auacuuaaagcuuccagaa

SEQ ID NO: 1225133 - RNA, 19 nt, Homo sapiens
cugacaaggaagaggauua

SEQ ID NO: 1225134 - RNA, 19 nt, Homo sapiens
gcacguguuccugguuuca

SEQ ID NO: 1225135 - RNA, 19 nt, Homo sapiens
gacauuaaaguggcuggaa

SEQ ID NO: 1225136 - RNA, 19 nt, Homo sapiens
gcaggcuggucucggaaac

SEQ ID NO: 1225137 - RNA, 19 nt, Homo sapiens
aaaguugacaagaguggaa

SEQ ID NO: 1225138 - RNA, 19 nt, Homo sapiens
gcuucuccacuaccucaua

SEQ ID NO: 1225139 - RNA, 19 nt, Homo sapiens
gaaagaagcuccgagacua

SEQ ID NO: 1225140 - RNA, 19 nt, Homo sapiens
caagauggauggagaagua

SEQ ID NO: 1225141 - RNA, 19 nt, Homo sapiens
gaagucaacucccaaauag

SEQ ID NO: 1225142 - RNA, 19 nt, Homo sapiens
gagagaaacucacggaaga

SEQ ID NO: 1225143 - RNA, 19 nt, Homo sapiens
ccaaauagcccuagaauac

SEQ ID NO: 1225144 - RNA, 19 nt, Homo sapiens
gagaagagccgaagguuuc

SEQ ID NO: 1225145 - RNA, 19 nt, Homo sapiens
gaagaaggccauccagaga

SEQ ID NO: 1225146 - RNA, 19 nt, Homo sapiens
guacuuggccugagacuga

SEQ ID NO: 1225147 - RNA, 19 nt, Homo sapiens
caaaugcccuagucacaug

SEQ ID NO: 1225148 - RNA, 19 nt, Homo sapiens
gaaaguagagcccacagau

SEQ ID NO: 1225149 - RNA, 19 nt, Homo sapiens
ggaagggcauuaggacuug

SEQ ID NO: 1225150 - RNA, 19 nt, Homo sapiens
agaaggccauccagagaua

SEQ ID NO: 1225151 - RNA, 19 nt, Homo sapiens
gaagaagucaacucccaaa

SEQ ID NO: 1225152 - RNA, 19 nt, Homo sapiens
ggagaagagccgaagguuu

SEQ ID NO: 1225153 - RNA, 19 nt, Homo sapiens
ggaauggguccucgaauca

SEQ ID NO: 1225154 - RNA, 19 nt, Homo sapiens
gaaacucacggaagacaga

SEQ ID NO: 1225155 - RNA, 19 nt, Homo sapiens
cgaaucaucgugccucuuu

SEQ ID NO: 1225156 - RNA, 19 nt, Homo sapiens
agaagucaacucccaaaua

SEQ ID NO: 1225157 - RNA, 19 nt, Homo sapiens
gagacgagguuuccuucau

SEQ ID NO: 1225158 - RNA, 19 nt, Homo sapiens
ccacaccaaccaaccaaua

SEQ ID NO: 1225159 - RNA, 19 nt, Homo sapiens
ggaagaugaggacgaagaa

SEQ ID NO: 1225160 - RNA, 19 nt, Homo sapiens
gaauacggccaggcaauga

SEQ ID NO: 1225161 - RNA, 19 nt, Homo sapiens
gcaaugacgguccgagugu

SEQ ID NO: 1225162 - RNA, 19 nt, Homo sapiens
ugccucagcuuuaaggaaa

SEQ ID NO: 1225163 - RNA, 19 nt, Homo sapiens
gacgagguuuccuucauca

SEQ ID NO: 1225164 - RNA, 19 nt, Homo sapiens
agaggaagaugaggacgaa

SEQ ID NO: 1225165 - RNA, 19 nt, Homo sapiens
agagauacgugcagcucaa

SEQ ID NO: 1225166 - RNA, 19 nt, Homo sapiens
gaagggcauuaggacuuga

SEQ ID NO: 1225167 - RNA, 19 nt, Homo sapiens
cgagguuuccuucaucaaa

SEQ ID NO: 1225168 - RNA, 19 nt, Homo sapiens
ggaaaguagagcccacaga

SEQ ID NO: 1225169 - RNA, 19 nt, Homo sapiens
agacgagguuuccuucauc

SEQ ID NO: 1225170 - RNA, 19 nt, Homo sapiens
uggaggacguaccaucuga

SEQ ID NO: 1225171 - RNA, 19 nt, Homo sapiens
ggcauuaggacuugaaauc

SEQ ID NO: 1225172 - RNA, 19 nt, Homo sapiens
cugaguguauuggaaagua

SEQ ID NO: 1225173 - RNA, 19 nt, Homo sapiens
gagguuuccuucaucaaaa

SEQ ID NO: 1225174 - RNA, 19 nt, Homo sapiens
cugcgugccucagcuuuaa

SEQ ID NO: 1225175 - RNA, 19 nt, Homo sapiens
ucauguacuuggccugaga

SEQ ID NO: 1225176 - RNA, 19 nt, Homo sapiens
cggcaaagggcaacaggaa

SEQ ID NO: 1225177 - RNA, 19 nt, Homo sapiens
ccagugcucccuccuuuca

SEQ ID NO: 1225178 - RNA, 19 nt, Homo sapiens
agccagugcucccuccuuu

SEQ ID NO: 1225179 - RNA, 19 nt, Homo sapiens
gaaucaucgugccucuuuc

SEQ ID NO: 1225180 - RNA, 19 nt, Homo sapiens
gauggauggagaaguaaug

SEQ ID NO: 1225181 - RNA, 19 nt, Homo sapiens
gagaaacucacggaagaca

SEQ ID NO: 1225182 - RNA, 19 nt, Homo sapiens
gcagcauggucucgaacuc

SEQ ID NO: 1225183 - RNA, 19 nt, Homo sapiens
ggcaacaggaagggcauua

SEQ ID NO: 1225184 - RNA, 19 nt, Homo sapiens
aagaugaggacgaagaaga

SEQ ID NO: 1225185 - RNA, 19 nt, Homo sapiens
ugcgugagcuggagaagag

SEQ ID NO: 1225186 - RNA, 19 nt, Homo sapiens
ucacggaagacagaaagaa

SEQ ID NO: 1225187 - RNA, 19 nt, Homo sapiens
ccaaaugcccuagucacau

SEQ ID NO: 1225188 - RNA, 19 nt, Homo sapiens
cccaaauagcccuagaaua

SEQ ID NO: 1225189 - RNA, 19 nt, Homo sapiens
caacaggaagggcauuagg

SEQ ID NO: 1225190 - RNA, 19 nt, Homo sapiens
guaaugcccgugguuguag

SEQ ID NO: 1225191 - RNA, 19 nt, Homo sapiens
caauagacagggcgauucu

SEQ ID NO: 1225192 - RNA, 19 nt, Homo sapiens
ggaaucgagacgagguuuc

SEQ ID NO: 1225193 - RNA, 19 nt, Homo sapiens
agaaagaagcuccgagacu

SEQ ID NO: 1225194 - RNA, 19 nt, Homo sapiens
caggcugucucgcacuugu

SEQ ID NO: 1225195 - RNA, 19 nt, Homo sapiens
acagcagcauggucucgaa

SEQ ID NO: 1225196 - RNA, 19 nt, Homo sapiens
ugaguguauuggaaaguag

SEQ ID NO: 1225197 - RNA, 19 nt, Homo sapiens
gguaggcccugggagaacu

SEQ ID NO: 1225198 - RNA, 19 nt, Homo sapiens
ccgaggccauggacguguu

SEQ ID NO: 1225199 - RNA, 19 nt, Homo sapiens
ccaauagacagggcgauuc

SEQ ID NO: 1225200 - RNA, 19 nt, Homo sapiens
gccucgagcucacauuggu

SEQ ID NO: 1225201 - RNA, 19 nt, Homo sapiens
aaguagagcccacagaucu

SEQ ID NO: 1225202 - RNA, 19 nt, Homo sapiens
gaauggguccucgaaucau

SEQ ID NO: 1225203 - RNA, 19 nt, Homo sapiens
aguaaugcccgugguugua

SEQ ID NO: 1225204 - RNA, 19 nt, Homo sapiens
gcaacaggaagggcauuag

SEQ ID NO: 1225205 - RNA, 19 nt, Homo sapiens
gcacuugucauuggucacu

SEQ ID NO: 1225206 - RNA, 19 nt, Homo sapiens
ccugcgugccucagcuuua

SEQ ID NO: 1225207 - RNA, 19 nt, Homo sapiens
gauacgugcagcucaagca

SEQ ID NO: 1225208 - RNA, 19 nt, Homo sapiens
gguccgagugugcaagaug

SEQ ID NO: 1225209 - RNA, 19 nt, Homo sapiens
gcauuaggacuugaaaucg

SEQ ID NO: 1225210 - RNA, 19 nt, Homo sapiens
uagaauacggccaggcaau

SEQ ID NO: 1225211 - RNA, 19 nt, Homo sapiens
guaaacagcucaucaaauu

SEQ ID NO: 1225212 - RNA, 19 nt, Homo sapiens
gugaaaugcuugcgcaaua

SEQ ID NO: 1225213 - RNA, 19 nt, Homo sapiens
gcaagaagcucaguuccau

SEQ ID NO: 1225214 - RNA, 19 nt, Homo sapiens
gcaaggaaaucgucgucaa

SEQ ID NO: 1225215 - RNA, 19 nt, Homo sapiens
gagaauaucuacccugaac

SEQ ID NO: 1225216 - RNA, 19 nt, Homo sapiens
gaaaugccaacacguauau

SEQ ID NO: 1225217 - RNA, 19 nt, Homo sapiens
ggaaaugccaacacguaua

SEQ ID NO: 1225218 - RNA, 19 nt, Homo sapiens
gaaaucuccuuccgagugu

SEQ ID NO: 1225219 - RNA, 19 nt, Homo sapiens
gaggacaccuugcuguaug

SEQ ID NO: 1225220 - RNA, 19 nt, Homo sapiens
ugaaaugcuugcgcaauaa

SEQ ID NO: 1225221 - RNA, 19 nt, Homo sapiens
gaccauccgcaguguauua

SEQ ID NO: 1225222 - RNA, 19 nt, Homo sapiens
ggacuacauugagagauga

SEQ ID NO: 1225223 - RNA, 19 nt, Homo sapiens
gauccgggaaaucauauua

SEQ ID NO: 1225224 - RNA, 19 nt, Homo sapiens
gauuggaccugaggaagaa

SEQ ID NO: 1225225 - RNA, 19 nt, Homo sapiens
agacaaaucccacauguuc

SEQ ID NO: 1225226 - RNA, 19 nt, Homo sapiens
gaugaagaauggagguugu

SEQ ID NO: 1225227 - RNA, 19 nt, Homo sapiens
aaagacaaaucccacaugu

SEQ ID NO: 1225228 - RNA, 19 nt, Homo sapiens
gccaacacguauauaaaga

SEQ ID NO: 1225229 - RNA, 19 nt, Homo sapiens
caaugacccugaugacugu

SEQ ID NO: 1225230 - RNA, 19 nt, Homo sapiens
agaagugccuggaaucuca

SEQ ID NO: 1225231 - RNA, 19 nt, Homo sapiens
guggaugacuucagcaaug

SEQ ID NO: 1225232 - RNA, 19 nt, Homo sapiens
agacagaagugccuggaau

SEQ ID NO: 1225233 - RNA, 19 nt, Homo sapiens
ggccaggacuacauugaga

SEQ ID NO: 1225234 - RNA, 19 nt, Homo sapiens
ggagaugaccgacagcaau

SEQ ID NO: 1225235 - RNA, 19 nt, Homo sapiens
gaugcaaagucccagguau

SEQ ID NO: 1225236 - RNA, 19 nt, Homo sapiens
agugguaccuggagaauau

SEQ ID NO: 1225237 - RNA, 19 nt, Homo sapiens
gagaggcccuucgggaaug

SEQ ID NO: 1225238 - RNA, 19 nt, Homo sapiens
ucauuaaccuggacaccuu

SEQ ID NO: 1225239 - RNA, 19 nt, Homo sapiens
caagaaaccccaaaccuaa

SEQ ID NO: 1225240 - RNA, 19 nt, Homo sapiens
aaguguggauggaugaaua

SEQ ID NO: 1225241 - RNA, 19 nt, Homo sapiens
ucacggugcugcuguucuu

SEQ ID NO: 1225242 - RNA, 19 nt, Homo sapiens
gaagaauggagguuguuuc

SEQ ID NO: 1225243 - RNA, 19 nt, Homo sapiens
ggagaggcccuucgggaau

SEQ ID NO: 1225244 - RNA, 19 nt, Homo sapiens
guggauggaugaauacaag

SEQ ID NO: 1225245 - RNA, 19 nt, Homo sapiens
caacacguauauaaagaac

SEQ ID NO: 1225246 - RNA, 19 nt, Homo sapiens
gaaaugcuugcgcaauaau

SEQ ID NO: 1225247 - RNA, 19 nt, Homo sapiens
gaagcucaguuccauuugc

SEQ ID NO: 1225248 - RNA, 19 nt, Homo sapiens
gucauucccugauugguau

SEQ ID NO: 1225249 - RNA, 19 nt, Homo sapiens
gagcugugccugucaguca

SEQ ID NO: 1225250 - RNA, 19 nt, Homo sapiens
ggucaaaggcgaagaugca

SEQ ID NO: 1225251 - RNA, 19 nt, Homo sapiens
gaucgacaaagcuugguuu

SEQ ID NO: 1225252 - RNA, 19 nt, Homo sapiens
ucaaauugcccaaggugaa

SEQ ID NO: 1225253 - RNA, 19 nt, Homo sapiens
aagaagcucaguuccauuu

SEQ ID NO: 1225254 - RNA, 19 nt, Homo sapiens
ggccagucauucccugauu

SEQ ID NO: 1225255 - RNA, 19 nt, Homo sapiens
acagauauguucggugaug

SEQ ID NO: 1225256 - RNA, 19 nt, Homo sapiens
gagaugaccgacagcaaug

SEQ ID NO: 1225257 - RNA, 19 nt, Homo sapiens
gccagagcuucaaguggua

SEQ ID NO: 1225258 - RNA, 19 nt, Homo sapiens
caaauugcccaaggugaaa

SEQ ID NO: 1225259 - RNA, 19 nt, Homo sapiens
cgacagcaauggaccaaaa

SEQ ID NO: 1225260 - RNA, 19 nt, Homo sapiens
ggaggacaccuugcuguau

SEQ ID NO: 1225261 - RNA, 19 nt, Homo sapiens
ggaaaucauauuaguggau

SEQ ID NO: 1225262 - RNA, 19 nt, Homo sapiens
aaugggaaguguuuauugu

SEQ ID NO: 1225263 - RNA, 19 nt, Homo sapiens
ucucaaggccguuaaguuc

SEQ ID NO: 1225264 - RNA, 19 nt, Homo sapiens
ggacauggugagcucuuga

SEQ ID NO: 1225265 - RNA, 19 nt, Homo sapiens
ggagacagaaaccuaaugg

SEQ ID NO: 1225266 - RNA, 19 nt, Homo sapiens
caaagacaaaucccacaug

SEQ ID NO: 1225267 - RNA, 19 nt, Homo sapiens
gaauaucuacccugaacuc

SEQ ID NO: 1225268 - RNA, 19 nt, Homo sapiens
ggaucacggugcugcuguu

SEQ ID NO: 1225269 - RNA, 19 nt, Homo sapiens
gccagucauucccugauug

SEQ ID NO: 1225270 - RNA, 19 nt, Homo sapiens
ucacauacacccagcagau

SEQ ID NO: 1225271 - RNA, 19 nt, Homo sapiens
gcagauuggaccugaggaa

SEQ ID NO: 1225272 - RNA, 19 nt, Homo sapiens
ugggaaguguuuauuguuc

SEQ ID NO: 1225273 - RNA, 19 nt, Homo sapiens
acucaggucuuucuucaag

SEQ ID NO: 1225274 - RNA, 19 nt, Homo sapiens
auugagagaugaagaaugg

SEQ ID NO: 1225275 - RNA, 19 nt, Homo sapiens
gaaaacaucacaagccaau

SEQ ID NO: 1225276 - RNA, 19 nt, Homo sapiens
gcaccacucugacuuuccu

SEQ ID NO: 1225277 - RNA, 19 nt, Homo sapiens
ggucuuucuucaagucaga

SEQ ID NO: 1225278 - RNA, 19 nt, Homo sapiens
ucccaccucugccucgaua

SEQ ID NO: 1225279 - RNA, 19 nt, Homo sapiens
ccacaucgagcacauagca

SEQ ID NO: 1225280 - RNA, 19 nt, Homo sapiens
caaaggcgaagaugcaaag

SEQ ID NO: 1225281 - RNA, 19 nt, Homo sapiens
gggcaccacucugacuuuc

SEQ ID NO: 1225282 - RNA, 19 nt, Homo sapiens
uggaugacuucagcaauga

SEQ ID NO: 1225283 - RNA, 19 nt, Homo sapiens
cauauuaguggaugacuuc

SEQ ID NO: 1225284 - RNA, 19 nt, Homo sapiens
uaaugggaaguguuuauug

SEQ ID NO: 1225285 - RNA, 19 nt, Homo sapiens
ccaacacguauauaaagaa

SEQ ID NO: 1225286 - RNA, 19 nt, Homo sapiens
cugcuguucuucuggguaa

SEQ ID NO: 1225287 - RNA, 19 nt, Homo sapiens
gaaaccuaaugggaagugu

SEQ ID NO: 1225288 - RNA, 19 nt, Homo sapiens
cagcugaaguguggaugga

SEQ ID NO: 1225289 - RNA, 19 nt, Homo sapiens
aaacaucacaagccaaugg

SEQ ID NO: 1225290 - RNA, 19 nt, Homo sapiens
ccaagaaaccccaaaccua

SEQ ID NO: 1225291 - RNA, 19 nt, Homo sapiens
ggagguuguuuccaaaaga

SEQ ID NO: 1225292 - RNA, 19 nt, Homo sapiens
gaauguugagagcagauug

SEQ ID NO: 1225293 - RNA, 19 nt, Homo sapiens
aaacagcucaucaaauugc

SEQ ID NO: 1225294 - RNA, 19 nt, Homo sapiens
uaaacagcucaucaaauug

SEQ ID NO: 1225295 - RNA, 19 nt, Homo sapiens
caauggggcucaaagacaa

SEQ ID NO: 1225296 - RNA, 19 nt, Homo sapiens
gcaccgagaacggcaagga

SEQ ID NO: 1225297 - RNA, 19 nt, Homo sapiens
uggaugaauacaagcaaua

SEQ ID NO: 1225298 - RNA, 19 nt, Homo sapiens
caagaagcucaguuccauu

SEQ ID NO: 1225299 - RNA, 19 nt, Homo sapiens
ugucagucaucaccuuguu

SEQ ID NO: 1225300 - RNA, 19 nt, Homo sapiens
ugacccugaugacuguaaa

SEQ ID NO: 1225301 - RNA, 19 nt, Homo sapiens
caucaucaccuuccacaac

SEQ ID NO: 1225302 - RNA, 19 nt, Homo sapiens
aggacuacauugagagaug

SEQ ID NO: 1225303 - RNA, 19 nt, Homo sapiens
aaaggcagaacaaccaaga

SEQ ID NO: 1225304 - RNA, 19 nt, Homo sapiens
ggagaauaucuacccugaa

SEQ ID NO: 1225305 - RNA, 19 nt, Homo sapiens
ucaggucuuucuucaaguc

SEQ ID NO: 1225306 - RNA, 19 nt, Homo sapiens
ggacagcugaaguguggau

SEQ ID NO: 1225307 - RNA, 19 nt, Homo sapiens
acacguauauaaagaacac

SEQ ID NO: 1225308 - RNA, 19 nt, Homo sapiens
cauccgcaguguauuaaac

SEQ ID NO: 1225309 - RNA, 19 nt, Homo sapiens
gagguuguuuccaaaagaa

SEQ ID NO: 1225310 - RNA, 19 nt, Homo sapiens
ugaagaauggagguuguuu

SEQ ID NO: 1225311 - RNA, 19 nt, Homo sapiens
gcaaacagauaaaccauuu

SEQ ID NO: 1225312 - RNA, 19 nt, Homo sapiens
ggaaauaaaucuggaaaug

SEQ ID NO: 1225313 - RNA, 19 nt, Homo sapiens
gcaccacucuguaccauaa

SEQ ID NO: 1225314 - RNA, 19 nt, Homo sapiens
caacugugauguuugcuua

SEQ ID NO: 1225315 - RNA, 19 nt, Homo sapiens
gauuugagcuuguuacaga

SEQ ID NO: 1225316 - RNA, 19 nt, Homo sapiens
guacucaccugcaacaauu

SEQ ID NO: 1225317 - RNA, 19 nt, Homo sapiens
ggaaugaauugcaaacaga

SEQ ID NO: 1225318 - RNA, 19 nt, Homo sapiens
ugacuuauaugcugaacua

SEQ ID NO: 1225319 - RNA, 19 nt, Homo sapiens
ggaaauaagugugaucugu

SEQ ID NO: 1225320 - RNA, 19 nt, Homo sapiens
gaaauaauagcucuaggaa

SEQ ID NO: 1225321 - RNA, 19 nt, Homo sapiens
gauaagaacuauugaagac

SEQ ID NO: 1225322 - RNA, 19 nt, Homo sapiens
uaccacagaucuuaacuaa

SEQ ID NO: 1225323 - RNA, 19 nt, Homo sapiens
caucuuuggucauugcuua

SEQ ID NO: 1225324 - RNA, 19 nt, Homo sapiens
ucacaggaauccaucauug

SEQ ID NO: 1225325 - RNA, 19 nt, Homo sapiens
ggaaaaugcuuuagauaga

SEQ ID NO: 1225326 - RNA, 19 nt, Homo sapiens
uagaauggauguuaggaaa

SEQ ID NO: 1225327 - RNA, 19 nt, Homo sapiens
ggaaucaguaccuagaaua

SEQ ID NO: 1225328 - RNA, 19 nt, Homo sapiens
ccucugaacuggcuacuga

SEQ ID NO: 1225329 - RNA, 19 nt, Homo sapiens
gaacaucuuuggucauugc

SEQ ID NO: 1225330 - RNA, 19 nt, Homo sapiens
gcucucaguugcauagaaa

SEQ ID NO: 1225331 - RNA, 19 nt, Homo sapiens
cagaauaccacagaucuua

SEQ ID NO: 1225332 - RNA, 19 nt, Homo sapiens
gaacacagugaaacaaaug

SEQ ID NO: 1225333 - RNA, 19 nt, Homo sapiens
gaauaucaacagagucuuu

SEQ ID NO: 1225334 - RNA, 19 nt, Homo sapiens
ggaguacuaccaacaauga

SEQ ID NO: 1225335 - RNA, 19 nt, Homo sapiens
gguugcaccugacuuauau

SEQ ID NO: 1225336 - RNA, 19 nt, Homo sapiens
aaaaucagcugaaagauga

SEQ ID NO: 1225337 - RNA, 19 nt, Homo sapiens
aauauuagccgacuucuug

SEQ ID NO: 1225338 - RNA, 19 nt, Homo sapiens
acagaaggcacauuuaauu

SEQ ID NO: 1225339 - RNA, 19 nt, Homo sapiens
gcuuagcaauugcaagaaa

SEQ ID NO: 1225340 - RNA, 19 nt, Homo sapiens
ugaaugauauggaacaucu

SEQ ID NO: 1225341 - RNA, 19 nt, Homo sapiens
gaaguugacaggugacaga

SEQ ID NO: 1225342 - RNA, 19 nt, Homo sapiens
cuacagaaggcacauuuaa

SEQ ID NO: 1225343 - RNA, 19 nt, Homo sapiens
gcuacuagaguguauauug

SEQ ID NO: 1225344 - RNA, 19 nt, Homo sapiens
guacacugcaugguauuua

SEQ ID NO: 1225345 - RNA, 19 nt, Homo sapiens
cagaaggcacauuuaauuu

SEQ ID NO: 1225346 - RNA, 19 nt, Homo sapiens
ugauugaccuguagaaugg

SEQ ID NO: 1225347 - RNA, 19 nt, Homo sapiens
gguuguugguagaauguua

SEQ ID NO: 1225348 - RNA, 19 nt, Homo sapiens
ggaguuuucuguuccauuu

SEQ ID NO: 1225349 - RNA, 19 nt, Homo sapiens
cugcaacaauugauaagaa

SEQ ID NO: 1225350 - RNA, 19 nt, Homo sapiens
gaauggauguuaggaaacu

SEQ ID NO: 1225351 - RNA, 19 nt, Homo sapiens
cuacuagaguguauauugu

SEQ ID NO: 1225352 - RNA, 19 nt, Homo sapiens
gaaucaguaccuagaauau

SEQ ID NO: 1225353 - RNA, 19 nt, Homo sapiens
gacaggacgugggaucauu

SEQ ID NO: 1225354 - RNA, 19 nt, Homo sapiens
agagaggcauuucuuacaa

SEQ ID NO: 1225355 - RNA, 19 nt, Homo sapiens
ugaacuggcuacugagguu

SEQ ID NO: 1225356 - RNA, 19 nt, Homo sapiens
gaagaauucaugaagcaau

SEQ ID NO: 1225357 - RNA, 19 nt, Homo sapiens
cauugaauuuggaguacua

SEQ ID NO: 1225358 - RNA, 19 nt, Homo sapiens
uacgugcacuggaugauuu

SEQ ID NO: 1225359 - RNA, 19 nt, Homo sapiens
uggaacaucuuuggucauu

SEQ ID NO: 1225360 - RNA, 19 nt, Homo sapiens
caacagagucuuuuaaaug

SEQ ID NO: 1225361 - RNA, 19 nt, Homo sapiens
cuaucucucuccuuucuaa

SEQ ID NO: 1225362 - RNA, 19 nt, Homo sapiens
uaagugaguucugcuuuua

SEQ ID NO: 1225363 - RNA, 19 nt, Homo sapiens
cauauccgcuccucuaguc

SEQ ID NO: 1225364 - RNA, 19 nt, Homo sapiens
cagaauaccaauguacuaa

SEQ ID NO: 1225365 - RNA, 19 nt, Homo sapiens
ggaauccaucauugcuuua

SEQ ID NO: 1225366 - RNA, 19 nt, Homo sapiens
aggaauccaucauugcuuu

SEQ ID NO: 1225367 - RNA, 19 nt, Homo sapiens
caucauugcuuuauguacu

SEQ ID NO: 1225368 - RNA, 19 nt, Homo sapiens
ugaacacagugaaacaaau

SEQ ID NO: 1225369 - RNA, 19 nt, Homo sapiens
uugggcacaugaaauaaua

SEQ ID NO: 1225370 - RNA, 19 nt, Homo sapiens
gaaaaucagcugaaagaug

SEQ ID NO: 1225371 - RNA, 19 nt, Homo sapiens
ccuagaauaucaacagagu

SEQ ID NO: 1225372 - RNA, 19 nt, Homo sapiens
uacauugcaucgacauaaa

SEQ ID NO: 1225373 - RNA, 19 nt, Homo sapiens
ugucacagauaguaaauac

SEQ ID NO: 1225374 - RNA, 19 nt, Homo sapiens
uuaaacuucugcagauuuc

SEQ ID NO: 1225375 - RNA, 19 nt, Homo sapiens
gggaucauuugcauaucuu

SEQ ID NO: 1225376 - RNA, 19 nt, Homo sapiens
gaaauguuuuguugcacua

SEQ ID NO: 1225377 - RNA, 19 nt, Homo sapiens
uacacugcaugguauuuaa

SEQ ID NO: 1225378 - RNA, 19 nt, Homo sapiens
aauaguacacugcauggua

SEQ ID NO: 1225379 - RNA, 19 nt, Homo sapiens
ugagcuuguuacagauuua

SEQ ID NO: 1225380 - RNA, 19 nt, Homo sapiens
ucucgauaauucuggauuu

SEQ ID NO: 1225381 - RNA, 19 nt, Homo sapiens
gagccacuguuugccguuu

SEQ ID NO: 1225382 - RNA, 19 nt, Homo sapiens
ucucucuccuuucuaaauu

SEQ ID NO: 1225383 - RNA, 19 nt, Homo sapiens
ugagaaacacggagaggaa

SEQ ID NO: 1225384 - RNA, 19 nt, Homo sapiens
ucuuacaacugugauguuu

SEQ ID NO: 1225385 - RNA, 19 nt, Homo sapiens
gaaaaugcgcaucuuaaug

SEQ ID NO: 1225386 - RNA, 19 nt, Homo sapiens
ugaaauaauagcucuagga

SEQ ID NO: 1225387 - RNA, 19 nt, Homo sapiens
cguggaagcugaaaagaaa

SEQ ID NO: 1225388 - RNA, 19 nt, Homo sapiens
aaaaggagcacgugaauug

SEQ ID NO: 1225389 - RNA, 19 nt, Homo sapiens
aaagacagaauaccacaga

SEQ ID NO: 1225390 - RNA, 19 nt, Homo sapiens
guacuaccaacaaugaaug

SEQ ID NO: 1225391 - RNA, 19 nt, Homo sapiens
gaaaagguucuuaugcauu

SEQ ID NO: 1225392 - RNA, 19 nt, Homo sapiens
gagaggcauuucuuacaac

SEQ ID NO: 1225393 - RNA, 19 nt, Homo sapiens
auaguacacugcaugguau

SEQ ID NO: 1225394 - RNA, 19 nt, Homo sapiens
gaucgggcaccaaauaaag

SEQ ID NO: 1225395 - RNA, 19 nt, Homo sapiens
ucagaauaccaauguacua

SEQ ID NO: 1225396 - RNA, 19 nt, Homo sapiens
aaauaagugugaucugucu

SEQ ID NO: 1225397 - RNA, 19 nt, Homo sapiens
ucgaagaauucaugaagca

SEQ ID NO: 1225398 - RNA, 19 nt, Homo sapiens
uauauggaaucaguaccua

SEQ ID NO: 1225399 - RNA, 19 nt, Homo sapiens
gcaucuuaaugacucuuug

SEQ ID NO: 1225400 - RNA, 19 nt, Homo sapiens
ggguuuaccacaaucauau

SEQ ID NO: 1225401 - RNA, 19 nt, Homo sapiens
aaaagguucuuaugcauug

SEQ ID NO: 1225402 - RNA, 19 nt, Homo sapiens
guagaauggauguuaggaa

SEQ ID NO: 1225403 - RNA, 19 nt, Homo sapiens
aaaaugcgcaucuuaauga

SEQ ID NO: 1225404 - RNA, 19 nt, Homo sapiens
gaacuacagaaggcacauu

SEQ ID NO: 1225405 - RNA, 19 nt, Homo sapiens
gaacagguaaaacacagua

SEQ ID NO: 1225406 - RNA, 19 nt, Homo sapiens
ggaacaucuuuggucauug

SEQ ID NO: 1225407 - RNA, 19 nt, Homo sapiens
uuacaacugugauguuugc

SEQ ID NO: 1225408 - RNA, 19 nt, Homo sapiens
aggcauuucuuacaacugu

SEQ ID NO: 1225409 - RNA, 19 nt, Homo sapiens
gacgugggaucauuugcau

SEQ ID NO: 1225410 - RNA, 19 nt, Homo sapiens
caagggugauuugaauuac

SEQ ID NO: 1225411 - RNA, 19 nt, Homo sapiens
gcaaugauguugaguauuu

SEQ ID NO: 1225412 - RNA, 19 nt, Homo sapiens
gaaaggagcaucuauguug

SEQ ID NO: 1225413 - RNA, 19 nt, Homo sapiens
gagcugaaauuagcaguua

SEQ ID NO: 1225414 - RNA, 19 nt, Homo sapiens
gcucaaagaugggaagaua

SEQ ID NO: 1225415 - RNA, 19 nt, Homo sapiens
gcaaaucauuccucucuau

SEQ ID NO: 1225416 - RNA, 19 nt, Homo sapiens
guacuacuuugacguauuu

SEQ ID NO: 1225417 - RNA, 19 nt, Homo sapiens
gcacugaguuauucuccua

SEQ ID NO: 1225418 - RNA, 19 nt, Homo sapiens
gaaauuagcaguuaucucu

SEQ ID NO: 1225419 - RNA, 19 nt, Homo sapiens
guaaauauuuccacaguca

SEQ ID NO: 1225420 - RNA, 19 nt, Homo sapiens
agacacacauuucaaagua

SEQ ID NO: 1225421 - RNA, 19 nt, Homo sapiens
guacaaaguugacauacau

SEQ ID NO: 1225422 - RNA, 19 nt, Homo sapiens
gagaagagaugggaaacuu

SEQ ID NO: 1225423 - RNA, 19 nt, Homo sapiens
ggaaggcacugaguuauuc

SEQ ID NO: 1225424 - RNA, 19 nt, Homo sapiens
gaugauaacuacaaugaag

SEQ ID NO: 1225425 - RNA, 19 nt, Homo sapiens
ggaaacuucuucugucuca

SEQ ID NO: 1225426 - RNA, 19 nt, Homo sapiens
caacaaagagcacaauuuc

SEQ ID NO: 1225427 - RNA, 19 nt, Homo sapiens
guugugaccuguacuugua

SEQ ID NO: 1225428 - RNA, 19 nt, Homo sapiens
gagcaccgcuuauguaggu

SEQ ID NO: 1225429 - RNA, 19 nt, Homo sapiens
agaagacaauacuccauua

SEQ ID NO: 1225430 - RNA, 19 nt, Homo sapiens
agacaauacuccauuauca

SEQ ID NO: 1225431 - RNA, 19 nt, Homo sapiens
auaaguaacucuugaagga

SEQ ID NO: 1225432 - RNA, 19 nt, Homo sapiens
ggaagaagccaaacagaag

SEQ ID NO: 1225433 - RNA, 19 nt, Homo sapiens
ggaaggcauucagcaguuu

SEQ ID NO: 1225434 - RNA, 19 nt, Homo sapiens
caacguguguauauugaug

SEQ ID NO: 1225435 - RNA, 19 nt, Homo sapiens
caagguugauauucagaaa

SEQ ID NO: 1225436 - RNA, 19 nt, Homo sapiens
gaucuucuuucaacagaga

SEQ ID NO: 1225437 - RNA, 19 nt, Homo sapiens
gaccagauauaaggaagaa

SEQ ID NO: 1225438 - RNA, 19 nt, Homo sapiens
ggagggacauuaaaucacu

SEQ ID NO: 1225439 - RNA, 19 nt, Homo sapiens
gaaaagguccucuguaaau

SEQ ID NO: 1225440 - RNA, 19 nt, Homo sapiens
ccagauggagcugaaauua

SEQ ID NO: 1225441 - RNA, 19 nt, Homo sapiens
ucuguuaguuaccuucuua

SEQ ID NO: 1225442 - RNA, 19 nt, Homo sapiens
gaagaagccaaacagaaga

SEQ ID NO: 1225443 - RNA, 19 nt, Homo sapiens
caaaucauuccucucuaua

SEQ ID NO: 1225444 - RNA, 19 nt, Homo sapiens
gaagggagcaaaguuucua

SEQ ID NO: 1225445 - RNA, 19 nt, Homo sapiens
acaaagagcacaauuucaa

SEQ ID NO: 1225446 - RNA, 19 nt, Homo sapiens
ugaggaaggcacugaguua

SEQ ID NO: 1225447 - RNA, 19 nt, Homo sapiens
aaucuuaccugcuggaugu

SEQ ID NO: 1225448 - RNA, 19 nt, Homo sapiens
ccacaaggccuacuaagca

SEQ ID NO: 1225449 - RNA, 19 nt, Homo sapiens
caccgucucugaucugaaa

SEQ ID NO: 1225450 - RNA, 19 nt, Homo sapiens
gaaacaacccauucaguac

SEQ ID NO: 1225451 - RNA, 19 nt, Homo sapiens
ucaguuggaucuucuuuca

SEQ ID NO: 1225452 - RNA, 19 nt, Homo sapiens
agaagcagcagaucauuaa

SEQ ID NO: 1225453 - RNA, 19 nt, Homo sapiens
gcucaaggacccagaaguu

SEQ ID NO: 1225454 - RNA, 19 nt, Homo sapiens
gaaaggaaacaagaaagga

SEQ ID NO: 1225455 - RNA, 19 nt, Homo sapiens
gaagacagucgagcucaaa

SEQ ID NO: 1225456 - RNA, 19 nt, Homo sapiens
gaagacaauacuccauuau

SEQ ID NO: 1225457 - RNA, 19 nt, Homo sapiens
guugauagcccucuaguca

SEQ ID NO: 1225458 - RNA, 19 nt, Homo sapiens
agaaagcagugaccacaga

SEQ ID NO: 1225459 - RNA, 19 nt, Homo sapiens
gcacgcucccugcaguuua

SEQ ID NO: 1225460 - RNA, 19 nt, Homo sapiens
cagaagcagcagaucauua

SEQ ID NO: 1225461 - RNA, 19 nt, Homo sapiens
caagaaaggagcaucuaug

SEQ ID NO: 1225462 - RNA, 19 nt, Homo sapiens
ggauuuccuucugauaauu

SEQ ID NO: 1225463 - RNA, 19 nt, Homo sapiens
caaagagcacaauuucaaa

SEQ ID NO: 1225464 - RNA, 19 nt, Homo sapiens
gagcaucuauguugaaaau

SEQ ID NO: 1225465 - RNA, 19 nt, Homo sapiens
aaaggagcaucuauguuga

SEQ ID NO: 1225466 - RNA, 19 nt, Homo sapiens
ggcccaagguugauauuca

SEQ ID NO: 1225467 - RNA, 19 nt, Homo sapiens
caaaggcaaugauguugag

SEQ ID NO: 1225468 - RNA, 19 nt, Homo sapiens
aaucauuccucucuauaga

SEQ ID NO: 1225469 - RNA, 19 nt, Homo sapiens
gaaaagagagcaaaaccaa

SEQ ID NO: 1225470 - RNA, 19 nt, Homo sapiens
ucaacaaagagcacaauuu

SEQ ID NO: 1225471 - RNA, 19 nt, Homo sapiens
caccacaacuccagaaucu

SEQ ID NO: 1225472 - RNA, 19 nt, Homo sapiens
caugaacugcuucuaaauu

SEQ ID NO: 1225473 - RNA, 19 nt, Homo sapiens
ugcaugaacugcuucuaaa

SEQ ID NO: 1225474 - RNA, 19 nt, Homo sapiens
gaaggaaggauaucaacgu

SEQ ID NO: 1225475 - RNA, 19 nt, Homo sapiens
agaaguggaugauaacuac

SEQ ID NO: 1225476 - RNA, 19 nt, Homo sapiens
caugagcaccgcuuaugua

SEQ ID NO: 1225477 - RNA, 19 nt, Homo sapiens
caacagagaaagacacaca

SEQ ID NO: 1225478 - RNA, 19 nt, Homo sapiens
cuacaaaggcaaugauguu

SEQ ID NO: 1225479 - RNA, 19 nt, Homo sapiens
gagaaguugugaccuguac

SEQ ID NO: 1225480 - RNA, 19 nt, Homo sapiens
gaagacacaagaaucaaag

SEQ ID NO: 1225481 - RNA, 19 nt, Homo sapiens
gaggaaaaccuaaagcuaa

SEQ ID NO: 1225482 - RNA, 19 nt, Homo sapiens
cagagaaagacacacauuu

SEQ ID NO: 1225483 - RNA, 19 nt, Homo sapiens
caugguaccuagugugugu

SEQ ID NO: 1225484 - RNA, 19 nt, Homo sapiens
auucagcaguuucagcuua

SEQ ID NO: 1225485 - RNA, 19 nt, Homo sapiens
gcaacaugagcaccgcuua

SEQ ID NO: 1225486 - RNA, 19 nt, Homo sapiens
caacaucaacagcaacaug

SEQ ID NO: 1225487 - RNA, 19 nt, Homo sapiens
uaucucauguacaaaguug

SEQ ID NO: 1225488 - RNA, 19 nt, Homo sapiens
gaccacagaaacaauuaaa

SEQ ID NO: 1225489 - RNA, 19 nt, Homo sapiens
caaugaagaccagaagaaa

SEQ ID NO: 1225490 - RNA, 19 nt, Homo sapiens
ggauaucaacguguguaua

SEQ ID NO: 1225491 - RNA, 19 nt, Homo sapiens
gaacaaguuuugcaucuac

SEQ ID NO: 1225492 - RNA, 19 nt, Homo sapiens
gaugggaaacuucuucugu

SEQ ID NO: 1225493 - RNA, 19 nt, Homo sapiens
gacacacauuucaaaguau

SEQ ID NO: 1225494 - RNA, 19 nt, Homo sapiens
uagcaguuaucucuuuaga

SEQ ID NO: 1225495 - RNA, 19 nt, Homo sapiens
cucuauagaugcuaggaua

SEQ ID NO: 1225496 - RNA, 19 nt, Homo sapiens
gcacacacccacaaaugca

SEQ ID NO: 1225497 - RNA, 19 nt, Homo sapiens
gaaagcagugaccacagaa

SEQ ID NO: 1225498 - RNA, 19 nt, Homo sapiens
cgacugaaaggaaacaaga

SEQ ID NO: 1225499 - RNA, 19 nt, Homo sapiens
ugucaguguuucuaugauu

SEQ ID NO: 1225500 - RNA, 19 nt, Homo sapiens
uaucaacguguguauauug

SEQ ID NO: 1225501 - RNA, 19 nt, Homo sapiens
ugacuacucccacaguuga

SEQ ID NO: 1225502 - RNA, 19 nt, Homo sapiens
gcagugaccacagaaacaa

SEQ ID NO: 1225503 - RNA, 19 nt, Homo sapiens
uuucaugauucgucaguaa

SEQ ID NO: 1225504 - RNA, 19 nt, Homo sapiens
guaccuagugugugucuga

SEQ ID NO: 1225505 - RNA, 19 nt, Homo sapiens
ccacagaaacaauuaaagg

SEQ ID NO: 1225506 - RNA, 19 nt, Homo sapiens
gacaagcuccguaccuguu

SEQ ID NO: 1225507 - RNA, 19 nt, Homo sapiens
gaccaaggaagaagccaaa

SEQ ID NO: 1225508 - RNA, 19 nt, Homo sapiens
gaagaagacaauacuccau

SEQ ID NO: 1225509 - RNA, 19 nt, Homo sapiens
cuagucaguuauauugcua

SEQ ID NO: 1225510 - RNA, 19 nt, Homo sapiens
ccucuagucaguuauauug

SEQ ID NO: 1225511 - RNA, 19 nt, Homo sapiens
gcagugaggugcuagauga

SEQ ID NO: 1225512 - RNA, 19 nt, Homo sapiens
ccaaacagcuaguggagaa

SEQ ID NO: 1225513 - RNA, 19 nt, Homo sapiens
ucaaggaccugaucaaagu

SEQ ID NO: 1225514 - RNA, 19 nt, Homo sapiens
aaacuuggaucucuauuuc

SEQ ID NO: 1225515 - RNA, 19 nt, Homo sapiens
gaaacuuggaucucuauuu

SEQ ID NO: 1225516 - RNA, 19 nt, Homo sapiens
aaacagaacugccugaaaa

SEQ ID NO: 1225517 - RNA, 19 nt, Homo sapiens
gcaccgcaauggcuccuuu

SEQ ID NO: 1225518 - RNA, 19 nt, Homo sapiens
gaaacagaacugccugaaa

SEQ ID NO: 1225519 - RNA, 19 nt, Homo sapiens
gggaugugcugcuagaguu

SEQ ID NO: 1225520 - RNA, 19 nt, Homo sapiens
agacagagcuuggacagau

SEQ ID NO: 1225521 - RNA, 19 nt, Homo sapiens
gaugagcucuaccgugugu

SEQ ID NO: 1225522 - RNA, 19 nt, Homo sapiens
gcagagaagaagcuacuga

SEQ ID NO: 1225523 - RNA, 19 nt, Homo sapiens
caaaaugguugacugagaa

SEQ ID NO: 1225524 - RNA, 19 nt, Homo sapiens
auaagggacuucugaaaca

SEQ ID NO: 1225525 - RNA, 19 nt, Homo sapiens
gaucucuauuucucccaua

SEQ ID NO: 1225526 - RNA, 19 nt, Homo sapiens
ccacguguuugaucacuuc

SEQ ID NO: 1225527 - RNA, 19 nt, Homo sapiens
ugacggcacuuaccuuugg

SEQ ID NO: 1225528 - RNA, 19 nt, Homo sapiens
uggcucaucucuucauaga

SEQ ID NO: 1225529 - RNA, 19 nt, Homo sapiens
gcacauuccaccuugacaa

SEQ ID NO: 1225530 - RNA, 19 nt, Homo sapiens
gaucaaaguggccaucaag

SEQ ID NO: 1225531 - RNA, 19 nt, Homo sapiens
gaacauccaaggcaagacu

SEQ ID NO: 1225532 - RNA, 19 nt, Homo sapiens
ggaaacagaacugccugaa

SEQ ID NO: 1225533 - RNA, 19 nt, Homo sapiens
cagauaaugggcuuccuaa

SEQ ID NO: 1225534 - RNA, 19 nt, Homo sapiens
gcccugagccuagcacauu

SEQ ID NO: 1225535 - RNA, 19 nt, Homo sapiens
gacagagcuuggacagaug

SEQ ID NO: 1225536 - RNA, 19 nt, Homo sapiens
ugacuucacucagcaccuu

SEQ ID NO: 1225537 - RNA, 19 nt, Homo sapiens
gcacccagcacagcaguga

SEQ ID NO: 1225538 - RNA, 19 nt, Homo sapiens
ugaagcuucuccauucugu

SEQ ID NO: 1225539 - RNA, 19 nt, Homo sapiens
ccauaagggacuucugaaa

SEQ ID NO: 1225540 - RNA, 19 nt, Homo sapiens
aagcuucuccauucuguaa

SEQ ID NO: 1225541 - RNA, 19 nt, Homo sapiens
caugacggcacuuaccuuu

SEQ ID NO: 1225542 - RNA, 19 nt, Homo sapiens
gcaagcagagaagaagcua

SEQ ID NO: 1225543 - RNA, 19 nt, Homo sapiens
gauaaugggcuuccuaacc

SEQ ID NO: 1225544 - RNA, 19 nt, Homo sapiens
ucuccauucuguaagcuuu

SEQ ID NO: 1225545 - RNA, 19 nt, Homo sapiens
gcacuaacacuuuucaauc

SEQ ID NO: 1225546 - RNA, 19 nt, Homo sapiens
ccgcauccgccacguguuu

SEQ ID NO: 1225547 - RNA, 19 nt, Homo sapiens
cauaagggacuucugaaac

SEQ ID NO: 1225548 - RNA, 19 nt, Homo sapiens
caccuggcacuaacacuuu

SEQ ID NO: 1225549 - RNA, 19 nt, Homo sapiens
gccgggaugugcugcuaga

SEQ ID NO: 1225550 - RNA, 19 nt, Homo sapiens
agugaaacuuggaucucua

SEQ ID NO: 1225551 - RNA, 19 nt, Homo sapiens
ggaggcacagcccagagaa

SEQ ID NO: 1225552 - RNA, 19 nt, Homo sapiens
gaagcuucuccauucugua

SEQ ID NO: 1225553 - RNA, 19 nt, Homo sapiens
gggaacauccaaggcaaga

SEQ ID NO: 1225554 - RNA, 19 nt, Homo sapiens
cacauuccaccuugacaaa

SEQ ID NO: 1225555 - RNA, 19 nt, Homo sapiens
cuucgaggcugcuguucug

SEQ ID NO: 1225556 - RNA, 19 nt, Homo sapiens
uagaugagacaagcaguga

SEQ ID NO: 1225557 - RNA, 19 nt, Homo sapiens
acaaaaugguugacugaga

SEQ ID NO: 1225558 - RNA, 19 nt, Homo sapiens
ucaaaguggccaucaaggu

SEQ ID NO: 1225559 - RNA, 19 nt, Homo sapiens
cuucauuccuucccaagag

SEQ ID NO: 1225560 - RNA, 19 nt, Homo sapiens
ucaccuggcacuaacacuu

SEQ ID NO: 1225561 - RNA, 19 nt, Homo sapiens
acagauaaugggcuuccua

SEQ ID NO: 1225562 - RNA, 19 nt, Homo sapiens
ucucauaggggaaauaaaa

SEQ ID NO: 1225563 - RNA, 19 nt, Homo sapiens
gugaaacuuggaucucuau

SEQ ID NO: 1225564 - RNA, 19 nt, Homo sapiens
gagaaaacacagauaaugg

SEQ ID NO: 1225565 - RNA, 19 nt, Homo sapiens
uaagggacuucugaaacag

SEQ ID NO: 1225566 - RNA, 19 nt, Homo sapiens
ucaaucuucaggcuucauu

SEQ ID NO: 1225567 - RNA, 19 nt, Homo sapiens
gugccgggaugugcugcua

SEQ ID NO: 1225568 - RNA, 19 nt, Homo sapiens
uguggcucaucucuucaua

SEQ ID NO: 1225569 - RNA, 19 nt, Homo sapiens
ggaugugcugcuagaguug

SEQ ID NO: 1225570 - RNA, 19 nt, Homo sapiens
gauacuaaagacagaagag

SEQ ID NO: 1225571 - RNA, 19 nt, Homo sapiens
uguuugaucacuucucuga

SEQ ID NO: 1225572 - RNA, 19 nt, Homo sapiens
ccaccucacgcccaaguca

SEQ ID NO: 1225573 - RNA, 19 nt, Homo sapiens
ccaaagaacuaacuacaua

SEQ ID NO: 1225574 - RNA, 19 nt, Homo sapiens
gaagauuccuccuggcuua

SEQ ID NO: 1225575 - RNA, 19 nt, Homo sapiens
gaacagagaugaggucaau

SEQ ID NO: 1225576 - RNA, 19 nt, Homo sapiens
gcacaacuauuuaagaauc

SEQ ID NO: 1225577 - RNA, 19 nt, Homo sapiens
gagaugaggucaauuucaa

SEQ ID NO: 1225578 - RNA, 19 nt, Homo sapiens
gaagaagguggaaaugaua

SEQ ID NO: 1225579 - RNA, 19 nt, Homo sapiens
caaaacagcugaagacaaa

SEQ ID NO: 1225580 - RNA, 19 nt, Homo sapiens
gaaauacagaggacaguaa

SEQ ID NO: 1225581 - RNA, 19 nt, Homo sapiens
cagcacaacuauuuaagaa

SEQ ID NO: 1225582 - RNA, 19 nt, Homo sapiens
ccagggauuuguacaagua

SEQ ID NO: 1225583 - RNA, 19 nt, Homo sapiens
cgaagaagguggaaaugau

SEQ ID NO: 1225584 - RNA, 19 nt, Homo sapiens
gaacaugaauucucaaccu

SEQ ID NO: 1225585 - RNA, 19 nt, Homo sapiens
gcuguuaacuggcaggaaa

SEQ ID NO: 1225586 - RNA, 19 nt, Homo sapiens
uacccaaacuucaaagaua

SEQ ID NO: 1225587 - RNA, 19 nt, Homo sapiens
gaaaugauaaccaagacaa

SEQ ID NO: 1225588 - RNA, 19 nt, Homo sapiens
caaccacacuuacauucaa

SEQ ID NO: 1225589 - RNA, 19 nt, Homo sapiens
cuccucagcuguucauuua

SEQ ID NO: 1225590 - RNA, 19 nt, Homo sapiens
gcacaaccacacuuacauu

SEQ ID NO: 1225591 - RNA, 19 nt, Homo sapiens
cagaugguguuuacauuga

SEQ ID NO: 1225592 - RNA, 19 nt, Homo sapiens
ccucagcuguucauuuaaa

SEQ ID NO: 1225593 - RNA, 19 nt, Homo sapiens
gagcuuggauaugaaaguu

SEQ ID NO: 1225594 - RNA, 19 nt, Homo sapiens
ggaauaaaacugacugaua

SEQ ID NO: 1225595 - RNA, 19 nt, Homo sapiens
guaaauggaaaggagauua

SEQ ID NO: 1225596 - RNA, 19 nt, Homo sapiens
gaaauacaaauugccauga

SEQ ID NO: 1225597 - RNA, 19 nt, Homo sapiens
caaaagagccuguggaaga

SEQ ID NO: 1225598 - RNA, 19 nt, Homo sapiens
gcccagagcccagcaauga

SEQ ID NO: 1225599 - RNA, 19 nt, Homo sapiens
aaauugccaugauguugua

SEQ ID NO: 1225600 - RNA, 19 nt, Homo sapiens
caaaaugacuugagcaauc

SEQ ID NO: 1225601 - RNA, 19 nt, Homo sapiens
cuaguacagugaauuauca

SEQ ID NO: 1225602 - RNA, 19 nt, Homo sapiens
acagagaugaggucaauuu

SEQ ID NO: 1225603 - RNA, 19 nt, Homo sapiens
uaacgaagaagguggaaau

SEQ ID NO: 1225604 - RNA, 19 nt, Homo sapiens
ggacaguaaugcugagaac

SEQ ID NO: 1225605 - RNA, 19 nt, Homo sapiens
ccucucgccuccagucaua

SEQ ID NO: 1225606 - RNA, 19 nt, Homo sapiens
ccaugauguuguacuagua

SEQ ID NO: 1225607 - RNA, 19 nt, Homo sapiens
uaacuggcaggaaagauuu

SEQ ID NO: 1225608 - RNA, 19 nt, Homo sapiens
gccagaugguguuuacauu

SEQ ID NO: 1225609 - RNA, 19 nt, Homo sapiens
guacagugaauuaucagaa

SEQ ID NO: 1225610 - RNA, 19 nt, Homo sapiens
gaaguucuaaguaaaugga

SEQ ID NO: 1225611 - RNA, 19 nt, Homo sapiens
uuggugagcuuggauauga

SEQ ID NO: 1225612 - RNA, 19 nt, Homo sapiens
ugaagcaacugccaaacca

SEQ ID NO: 1225613 - RNA, 19 nt, Homo sapiens
gauuccuccuggcuuauaa

SEQ ID NO: 1225614 - RNA, 19 nt, Homo sapiens
caagccagaugguguuuac

SEQ ID NO: 1225615 - RNA, 19 nt, Homo sapiens
caaauugccaugauguugu

SEQ ID NO: 1225616 - RNA, 19 nt, Homo sapiens
gagcacaaccacacuuaca

SEQ ID NO: 1225617 - RNA, 19 nt, Homo sapiens
guuugugauuucugucaua

SEQ ID NO: 1225618 - RNA, 19 nt, Homo sapiens
gcaacugccaaaccaaaga

SEQ ID NO: 1225619 - RNA, 19 nt, Homo sapiens
gccaugauguuguacuagu

SEQ ID NO: 1225620 - RNA, 19 nt, Homo sapiens
gcugccaagccaagaaaua

SEQ ID NO: 1225621 - RNA, 19 nt, Homo sapiens
ccagaugguguuuacauug

SEQ ID NO: 1225622 - RNA, 19 nt, Homo sapiens
gauaaccaagacaaugaaa

SEQ ID NO: 1225623 - RNA, 19 nt, Homo sapiens
guaaugcugagaacaugaa

SEQ ID NO: 1225624 - RNA, 19 nt, Homo sapiens
gaagcugccaagccaagaa

SEQ ID NO: 1225625 - RNA, 19 nt, Homo sapiens
ucaaacuucuaugcacaaa

SEQ ID NO: 1225626 - RNA, 19 nt, Homo sapiens
acaaguaccgacaccagua

SEQ ID NO: 1225627 - RNA, 19 nt, Homo sapiens
gcuguucauuuaaauagca

SEQ ID NO: 1225628 - RNA, 19 nt, Homo sapiens
cauaacagucaaacuucua

SEQ ID NO: 1225629 - RNA, 19 nt, Homo sapiens
gggaagcaaagcccagaaa

SEQ ID NO: 1225630 - RNA, 19 nt, Homo sapiens
gacagaagagaaaggagaa

SEQ ID NO: 1225631 - RNA, 19 nt, Homo sapiens
augaagcucuuguggagaa

SEQ ID NO: 1225632 - RNA, 19 nt, Homo sapiens
ggaaaggagauuaugaaaa

SEQ ID NO: 1225633 - RNA, 19 nt, Homo sapiens
acccaaacuucaaagauau

SEQ ID NO: 1225634 - RNA, 19 nt, Homo sapiens
gcucuagaguauuuuguuu

SEQ ID NO: 1225635 - RNA, 19 nt, Homo sapiens
agucauaacagucaaacuu

SEQ ID NO: 1225636 - RNA, 19 nt, Homo sapiens
cuacacgccuucagagaac

SEQ ID NO: 1225637 - RNA, 19 nt, Homo sapiens
ugaaugagucccagcacaa

SEQ ID NO: 1225638 - RNA, 19 nt, Homo sapiens
aauacaaauugccaugaug

SEQ ID NO: 1225639 - RNA, 19 nt, Homo sapiens
caguaaugcugagaacaug

SEQ ID NO: 1225640 - RNA, 19 nt, Homo sapiens
guacccaaacuucaaagau

SEQ ID NO: 1225641 - RNA, 19 nt, Homo sapiens
agaagcaauuagaagauuc

SEQ ID NO: 1225642 - RNA, 19 nt, Homo sapiens
guguuuacauugaagaagu

SEQ ID NO: 1225643 - RNA, 19 nt, Homo sapiens
gaagagaaaggagaaagcu

SEQ ID NO: 1225644 - RNA, 19 nt, Homo sapiens
ccagcacaacuauuuaaga

SEQ ID NO: 1225645 - RNA, 19 nt, Homo sapiens
uuaacuggcaggaaagauu

SEQ ID NO: 1225646 - RNA, 19 nt, Homo sapiens
ccaguacccaaacuucaaa

SEQ ID NO: 1225647 - RNA, 19 nt, Homo sapiens
caaugaaaauccuggaaau

SEQ ID NO: 1225648 - RNA, 19 nt, Homo sapiens
guggaaaugauaaccaaga

SEQ ID NO: 1225649 - RNA, 19 nt, Homo sapiens
gaagcucuuguggagaaua

SEQ ID NO: 1225650 - RNA, 19 nt, Homo sapiens
gaugguguuuacauugaag

SEQ ID NO: 1225651 - RNA, 19 nt, Homo sapiens
gaaaauccuggaaauacaa

SEQ ID NO: 1225652 - RNA, 19 nt, Homo sapiens
ggaaaugauaaccaagaca

SEQ ID NO: 1225653 - RNA, 19 nt, Homo sapiens
gcuuggauaugaaaguuuu

SEQ ID NO: 1225654 - RNA, 19 nt, Homo sapiens
gaagcaacugccaaaccaa

SEQ ID NO: 1225655 - RNA, 19 nt, Homo sapiens
acaaauugccaugauguug

SEQ ID NO: 1225656 - RNA, 19 nt, Homo sapiens
cagcuguucauuuaaauag

SEQ ID NO: 1225657 - RNA, 19 nt, Homo sapiens
ucauaacagucaaacuucu

SEQ ID NO: 1225658 - RNA, 19 nt, Homo sapiens
gcucuuguggagaauacua

SEQ ID NO: 1225659 - RNA, 19 nt, Homo sapiens
agucccagcacaacuauuu

SEQ ID NO: 1225660 - RNA, 19 nt, Homo sapiens
gauaaaacuggaaauguug

SEQ ID NO: 1225661 - RNA, 19 nt, Homo sapiens
agccaucuguuugugauuu

SEQ ID NO: 1225662 - RNA, 19 nt, Homo sapiens
cgacaccaguacccaaacu

SEQ ID NO: 1225663 - RNA, 19 nt, Homo sapiens
gacuugagcaaucuucguu

SEQ ID NO: 1225664 - RNA, 19 nt, Homo sapiens
uggaaaggagauuaugaaa

SEQ ID NO: 1225665 - RNA, 19 nt, Homo sapiens
aagaagguggaaaugauaa

SEQ ID NO: 1225666 - RNA, 19 nt, Homo sapiens
agaaauacagaggacagua

SEQ ID NO: 1225667 - RNA, 19 nt, Homo sapiens
uggagcacaaccacacuua

SEQ ID NO: 1225668 - RNA, 19 nt, Homo sapiens
gcaaaacagcugaagacaa

SEQ ID NO: 1225669 - RNA, 19 nt, Homo sapiens
gaagcaaagcccagaaaau

SEQ ID NO: 1225670 - RNA, 19 nt, Homo sapiens
ggugagcuuggauaugaaa

SEQ ID NO: 1225671 - RNA, 19 nt, Homo sapiens
ccuccuggcuuauaaaaug

SEQ ID NO: 1225672 - RNA, 19 nt, Homo sapiens
gccaaagaacuaacuacau

SEQ ID NO: 1225673 - RNA, 19 nt, Homo sapiens
gcaaaggcuuggaaauuga

SEQ ID NO: 1225674 - RNA, 19 nt, Homo sapiens
gcuuggaaauugaauguua

SEQ ID NO: 1225675 - RNA, 19 nt, Homo sapiens
gaacaaaugaugcaaagug

SEQ ID NO: 1225676 - RNA, 19 nt, Homo sapiens
caagauaauucucugaaga

SEQ ID NO: 1225677 - RNA, 19 nt, Homo sapiens
gagcaaaggcuuggaaauu

SEQ ID NO: 1225678 - RNA, 19 nt, Homo sapiens
gcaagcagauuggaauuuc

SEQ ID NO: 1225679 - RNA, 19 nt, Homo sapiens
ccagauggauugcacgaaa

SEQ ID NO: 1225680 - RNA, 19 nt, Homo sapiens
gaaugucugucaugugaga

SEQ ID NO: 1225681 - RNA, 19 nt, Homo sapiens
gcacgaaaccugacuugga

SEQ ID NO: 1225682 - RNA, 19 nt, Homo sapiens
ggaaagcuguccugucucu

SEQ ID NO: 1225683 - RNA, 19 nt, Homo sapiens
ccaaagacaugauuguaag

SEQ ID NO: 1225684 - RNA, 19 nt, Homo sapiens
gugaggaagacauuuauua

SEQ ID NO: 1225685 - RNA, 19 nt, Homo sapiens
ggagagaauucaccaggau

SEQ ID NO: 1225686 - RNA, 19 nt, Homo sapiens
ccacugcccuaggcucuua

SEQ ID NO: 1225687 - RNA, 19 nt, Homo sapiens
ggauaucucucucagucuu

SEQ ID NO: 1225688 - RNA, 19 nt, Homo sapiens
guuuguagcuuaucugaga

SEQ ID NO: 1225689 - RNA, 19 nt, Homo sapiens
ccaaggaggcccuguacua

SEQ ID NO: 1225690 - RNA, 19 nt, Homo sapiens
aaacaaauccaccaaacaa

SEQ ID NO: 1225691 - RNA, 19 nt, Homo sapiens
gcccuaggcucuuaaauac

SEQ ID NO: 1225692 - RNA, 19 nt, Homo sapiens
gcacagucccugacaucua

SEQ ID NO: 1225693 - RNA, 19 nt, Homo sapiens
caaaugaugcaaaguguug

SEQ ID NO: 1225694 - RNA, 19 nt, Homo sapiens
aggcaccucuucugucuua

SEQ ID NO: 1225695 - RNA, 19 nt, Homo sapiens
gcauuuaugacauguguaa

SEQ ID NO: 1225696 - RNA, 19 nt, Homo sapiens
ggagcaggcuggacaacau

SEQ ID NO: 1225697 - RNA, 19 nt, Homo sapiens
aggaaugucugucauguga

SEQ ID NO: 1225698 - RNA, 19 nt, Homo sapiens
aagcaugguuuaaguguga

SEQ ID NO: 1225699 - RNA, 19 nt, Homo sapiens
uacaguagcaucugcaaua

SEQ ID NO: 1225700 - RNA, 19 nt, Homo sapiens
ccacauaaccucccagaag

SEQ ID NO: 1225701 - RNA, 19 nt, Homo sapiens
gagagagacuuuuguguga

SEQ ID NO: 1225702 - RNA, 19 nt, Homo sapiens
gggaaucacuccaggaaac

SEQ ID NO: 1225703 - RNA, 19 nt, Homo sapiens
gcagaggaaccuguaguuu

SEQ ID NO: 1225704 - RNA, 19 nt, Homo sapiens
gcacuuucuccauacauaa

SEQ ID NO: 1225705 - RNA, 19 nt, Homo sapiens
cuacuuagucacucuuaua

SEQ ID NO: 1225706 - RNA, 19 nt, Homo sapiens
caccucuucugucuuauuu

SEQ ID NO: 1225707 - RNA, 19 nt, Homo sapiens
ugacuuggauucaccaucu

SEQ ID NO: 1225708 - RNA, 19 nt, Homo sapiens
gcaggccacagaaagauuu

SEQ ID NO: 1225709 - RNA, 19 nt, Homo sapiens
gcucuuaaauacucauugg

SEQ ID NO: 1225710 - RNA, 19 nt, Homo sapiens
caccaaacaacaagucaua

SEQ ID NO: 1225711 - RNA, 19 nt, Homo sapiens
gagcuucaggacaccauua

SEQ ID NO: 1225712 - RNA, 19 nt, Homo sapiens
gcugaaggaugcccaugau

SEQ ID NO: 1225713 - RNA, 19 nt, Homo sapiens
uaaggaaugucugucaugu

SEQ ID NO: 1225714 - RNA, 19 nt, Homo sapiens
cacgaaaccugacuuggau

SEQ ID NO: 1225715 - RNA, 19 nt, Homo sapiens
gaggacugcuaccugaaga

SEQ ID NO: 1225716 - RNA, 19 nt, Homo sapiens
acaguagcaucugcaauaa

SEQ ID NO: 1225717 - RNA, 19 nt, Homo sapiens
gaaaccagcauucuaaagc

SEQ ID NO: 1225718 - RNA, 19 nt, Homo sapiens
agacacagccucagaaugg

SEQ ID NO: 1225719 - RNA, 19 nt, Homo sapiens
gugaacaaaugaugcaaag

SEQ ID NO: 1225720 - RNA, 19 nt, Homo sapiens
agcaaaggcuuggaaauug

SEQ ID NO: 1225721 - RNA, 19 nt, Homo sapiens
cagaauggccagauggauu

SEQ ID NO: 1225722 - RNA, 19 nt, Homo sapiens
ugaaugagugaacaaauga

SEQ ID NO: 1225723 - RNA, 19 nt, Homo sapiens
gaaugaaugagugaacaaa

SEQ ID NO: 1225724 - RNA, 19 nt, Homo sapiens
acacaaacagccucugaaa

SEQ ID NO: 1225725 - RNA, 19 nt, Homo sapiens
gcgaugagaauuccugguu

SEQ ID NO: 1225726 - RNA, 19 nt, Homo sapiens
caaauauuccaaagacaug

SEQ ID NO: 1225727 - RNA, 19 nt, Homo sapiens
ccaaacaacaagucauaga

SEQ ID NO: 1225728 - RNA, 19 nt, Homo sapiens
caaggaggcccuguacuau

SEQ ID NO: 1225729 - RNA, 19 nt, Homo sapiens
acagagugauuuauugcaa

SEQ ID NO: 1225730 - RNA, 19 nt, Homo sapiens
caaauccaccaaacaacaa

SEQ ID NO: 1225731 - RNA, 19 nt, Homo sapiens
gggauuauuuaaggaaugu

SEQ ID NO: 1225732 - RNA, 19 nt, Homo sapiens
agaauucaccaggaucuua

SEQ ID NO: 1225733 - RNA, 19 nt, Homo sapiens
guaaaagauugcucuguau

SEQ ID NO: 1225734 - RNA, 19 nt, Homo sapiens
ggaaugaaugagugaacaa

SEQ ID NO: 1225735 - RNA, 19 nt, Homo sapiens
cacagucccugacaucuag

SEQ ID NO: 1225736 - RNA, 19 nt, Homo sapiens
gcaccucuucugucuuauu

SEQ ID NO: 1225737 - RNA, 19 nt, Homo sapiens
uguaaaagauugcucugua

SEQ ID NO: 1225738 - RNA, 19 nt, Homo sapiens
uagcauuuaugacaugugu

SEQ ID NO: 1225739 - RNA, 19 nt, Homo sapiens
ccacacaaacagccucuga

SEQ ID NO: 1225740 - RNA, 19 nt, Homo sapiens
gggaggguccgaguccuua

SEQ ID NO: 1225741 - RNA, 19 nt, Homo sapiens
ccaagauaauucucugaag

SEQ ID NO: 1225742 - RNA, 19 nt, Homo sapiens
ccaaugaggaaaucaguca

SEQ ID NO: 1225743 - RNA, 19 nt, Homo sapiens
aaaccagcauucuaaagca

SEQ ID NO: 1225744 - RNA, 19 nt, Homo sapiens
ugugagacaauaagcuuua

SEQ ID NO: 1225745 - RNA, 19 nt, Homo sapiens
auucuuagcuacuccauca

SEQ ID NO: 1225746 - RNA, 19 nt, Homo sapiens
guauguaucacuccucaug

SEQ ID NO: 1225747 - RNA, 19 nt, Homo sapiens
gcaaaggcaagcagauugg

SEQ ID NO: 1225748 - RNA, 19 nt, Homo sapiens
ccuaggcucuuaaauacuc

SEQ ID NO: 1225749 - RNA, 19 nt, Homo sapiens
gacaugauuguaagccuuu

SEQ ID NO: 1225750 - RNA, 19 nt, Homo sapiens
ggugguacccaagauaauu

SEQ ID NO: 1225751 - RNA, 19 nt, Homo sapiens
gaauucaccaggaucuuag

SEQ ID NO: 1225752 - RNA, 19 nt, Homo sapiens
ggaggagaagggcucauug

SEQ ID NO: 1225753 - RNA, 19 nt, Homo sapiens
ugcccuaggcucuuaaaua

SEQ ID NO: 1225754 - RNA, 19 nt, Homo sapiens
augaaugagugaacaaaug

SEQ ID NO: 1225755 - RNA, 19 nt, Homo sapiens
gcuacuccaucaagcuaga

SEQ ID NO: 1225756 - RNA, 19 nt, Homo sapiens
cuucagaaccaaaguaugu

SEQ ID NO: 1225757 - RNA, 19 nt, Homo sapiens
gauuggaauuucugcucuu

SEQ ID NO: 1225758 - RNA, 19 nt, Homo sapiens
gcucauugcaggccacaga

SEQ ID NO: 1225759 - RNA, 19 nt, Homo sapiens
acuacucccugcacaugua

SEQ ID NO: 1225760 - RNA, 19 nt, Homo sapiens
cagagugauuuauugcaau

SEQ ID NO: 1225761 - RNA, 19 nt, Homo sapiens
uccaaagacaugauuguaa

SEQ ID NO: 1225762 - RNA, 19 nt, Homo sapiens
ccaucuuccuccugccaua

SEQ ID NO: 1225763 - RNA, 19 nt, Homo sapiens
guacuacucccugcacaug

SEQ ID NO: 1225764 - RNA, 19 nt, Homo sapiens
acauuuguuugugggauua

SEQ ID NO: 1225765 - RNA, 19 nt, Homo sapiens
caucugcaauaaggagaaa

SEQ ID NO: 1225766 - RNA, 19 nt, Homo sapiens
caaaggcuuggaaauugaa

SEQ ID NO: 1225767 - RNA, 19 nt, Homo sapiens
uuucugcucuucaccgauu

SEQ ID NO: 1225768 - RNA, 19 nt, Homo sapiens
gucauagacccguuagaaa

SEQ ID NO: 1225769 - RNA, 19 nt, Homo sapiens
aacaaaugaugcaaagugu

SEQ ID NO: 1225770 - RNA, 19 nt, Homo sapiens
ucagaauccugcauuacag

SEQ ID NO: 1225771 - RNA, 19 nt, Homo sapiens
agaauggccagauggauug

SEQ ID NO: 1225772 - RNA, 19 nt, Homo sapiens
aaggagagacugcuacaug

SEQ ID NO: 1225773 - RNA, 19 nt, Homo sapiens
gcaaaugccucuucaguuu

SEQ ID NO: 1225774 - RNA, 19 nt, Homo sapiens
gaaauucgaugaccaagga

SEQ ID NO: 1225775 - RNA, 19 nt, Homo sapiens
ccaagaagauuguguuuga

SEQ ID NO: 1225776 - RNA, 19 nt, Homo sapiens
ggagggaguuugagaugaa

SEQ ID NO: 1225777 - RNA, 19 nt, Homo sapiens
gcaaagaccaagaagauug

SEQ ID NO: 1225778 - RNA, 19 nt, Homo sapiens
agacucagauccagaaauu

SEQ ID NO: 1225779 - RNA, 19 nt, Homo sapiens
ccagugaaauaaacaugua

SEQ ID NO: 1225780 - RNA, 19 nt, Homo sapiens
gcaggucccuugcauuucu

SEQ ID NO: 1225781 - RNA, 19 nt, Homo sapiens
gaaggaggcccaaguugca

SEQ ID NO: 1225782 - RNA, 19 nt, Homo sapiens
cuugguaucucucagcuuu

SEQ ID NO: 1225783 - RNA, 19 nt, Homo sapiens
gcacaacccggacggaagu

SEQ ID NO: 1225784 - RNA, 19 nt, Homo sapiens
gaccaagaagauuguguuu

SEQ ID NO: 1225785 - RNA, 19 nt, Homo sapiens
cuccagaucucaaccuguu

SEQ ID NO: 1225786 - RNA, 19 nt, Homo sapiens
gauugcaaaugccucuuca

SEQ ID NO: 1225787 - RNA, 19 nt, Homo sapiens
ccagaaggaggcccaaguu

SEQ ID NO: 1225788 - RNA, 19 nt, Homo sapiens
caaagaccaagaagauugu

SEQ ID NO: 1225789 - RNA, 19 nt, Homo sapiens
ucaagacucagauccagaa

SEQ ID NO: 1225790 - RNA, 19 nt, Homo sapiens
ggaccaguacggagaguuc

SEQ ID NO: 1225791 - RNA, 19 nt, Homo sapiens
gaagauuguguuugaggau

SEQ ID NO: 1225792 - RNA, 19 nt, Homo sapiens
ucccuugcauuucuuggua

SEQ ID NO: 1225793 - RNA, 19 nt, Homo sapiens
ccagaaauucgaugaccaa

SEQ ID NO: 1225794 - RNA, 19 nt, Homo sapiens
aggcaaagaccaagaagau

SEQ ID NO: 1225795 - RNA, 19 nt, Homo sapiens
ccgacuaugagcuuaagua

SEQ ID NO: 1225796 - RNA, 19 nt, Homo sapiens
caagaagauuguguuugag

SEQ ID NO: 1225797 - RNA, 19 nt, Homo sapiens
cuacagggacuccagaucu

SEQ ID NO: 1225798 - RNA, 19 nt, Homo sapiens
ggcaaagaccaagaagauu

SEQ ID NO: 1225799 - RNA, 19 nt, Homo sapiens
cagaaggaggcccaaguug

SEQ ID NO: 1225800 - RNA, 19 nt, Homo sapiens
aaaugccucuucaguuugg

SEQ ID NO: 1225801 - RNA, 19 nt, Homo sapiens
gggcuccguguacuucuaa

SEQ ID NO: 1225802 - RNA, 19 nt, Homo sapiens
agauuguguuugaggauga

SEQ ID NO: 1225803 - RNA, 19 nt, Homo sapiens
ggauugcaaaugccucuuc

SEQ ID NO: 1225804 - RNA, 19 nt, Homo sapiens
acaaggcaaagaccaagaa

SEQ ID NO: 1225805 - RNA, 19 nt, Homo sapiens
uggagggaguuugagauga

SEQ ID NO: 1225806 - RNA, 19 nt, Homo sapiens
gugcccgacuaugagcuua

SEQ ID NO: 1225807 - RNA, 19 nt, Homo sapiens
ggaaaccccugagcugcuu

SEQ ID NO: 1225808 - RNA, 19 nt, Homo sapiens
ccucuucaguuuggacuca

SEQ ID NO: 1225809 - RNA, 19 nt, Homo sapiens
agaccaagaagauuguguu

SEQ ID NO: 1225810 - RNA, 19 nt, Homo sapiens
aguuugagaugaagcgaau

SEQ ID NO: 1225811 - RNA, 19 nt, Homo sapiens
gccgcuaugucgcaguguu

SEQ ID NO: 1225812 - RNA, 19 nt, Homo sapiens
ugcaaaugccucuucaguu

SEQ ID NO: 1225813 - RNA, 19 nt, Homo sapiens
ggguuuggagggaguuuga

SEQ ID NO: 1225814 - RNA, 19 nt, Homo sapiens
ucuccuggauugcaaaugc

SEQ ID NO: 1225815 - RNA, 19 nt, Homo sapiens
gagggaguuugagaugaag

SEQ ID NO: 1225816 - RNA, 19 nt, Homo sapiens
cuuaaguacccgccaguga

SEQ ID NO: 1225817 - RNA, 19 nt, Homo sapiens
acccagugcccgacuauga

SEQ ID NO: 1225818 - RNA, 19 nt, Homo sapiens
ggacauaacagaagcaaua

SEQ ID NO: 1225819 - RNA, 19 nt, Homo sapiens
gaagaaggcugcuaugacu

SEQ ID NO: 1225820 - RNA, 19 nt, Homo sapiens
cagaauggauguccucuuu

SEQ ID NO: 1225821 - RNA, 19 nt, Homo sapiens
gcaauagagacuaccauua

SEQ ID NO: 1225822 - RNA, 19 nt, Homo sapiens
ggauguauuucauguagaa

SEQ ID NO: 1225823 - RNA, 19 nt, Homo sapiens
gggagaggaugaauauuau

SEQ ID NO: 1225824 - RNA, 19 nt, Homo sapiens
gaauggauguccucuuugu

SEQ ID NO: 1225825 - RNA, 19 nt, Homo sapiens
cagguggucuauuauuaua

SEQ ID NO: 1225826 - RNA, 19 nt, Homo sapiens
auuaucagguggucuauua

SEQ ID NO: 1225827 - RNA, 19 nt, Homo sapiens
gugcagauuucaccauuga

SEQ ID NO: 1225828 - RNA, 19 nt, Homo sapiens
agaggaaauuggaagauaa

SEQ ID NO: 1225829 - RNA, 19 nt, Homo sapiens
caccauugauuacuccaua

SEQ ID NO: 1225830 - RNA, 19 nt, Homo sapiens
ugggagaggaugaauauua

SEQ ID NO: 1225831 - RNA, 19 nt, Homo sapiens
caauagagacuaccauuag

SEQ ID NO: 1225832 - RNA, 19 nt, Homo sapiens
aagaggaaauuggaagaua

SEQ ID NO: 1225833 - RNA, 19 nt, Homo sapiens
gaaccuaguccagaucuga

SEQ ID NO: 1225834 - RNA, 19 nt, Homo sapiens
gcagauuucaccauugauu

SEQ ID NO: 1225835 - RNA, 19 nt, Homo sapiens
gaggaaauuggaagauaaa

SEQ ID NO: 1225836 - RNA, 19 nt, Homo sapiens
gauaaggacauaacagaag

SEQ ID NO: 1225837 - RNA, 19 nt, Homo sapiens
ggauaaggacauaacagaa

SEQ ID NO: 1225838 - RNA, 19 nt, Homo sapiens
cagauuucaccauugauua

SEQ ID NO: 1225839 - RNA, 19 nt, Homo sapiens
acaagaauaugaggaugaa

SEQ ID NO: 1225840 - RNA, 19 nt, Homo sapiens
gagaggaugaauauuauca

SEQ ID NO: 1225841 - RNA, 19 nt, Homo sapiens
gcaagaggaaauuggaaga

SEQ ID NO: 1225842 - RNA, 19 nt, Homo sapiens
gacaagaauaugaggauga

SEQ ID NO: 1225843 - RNA, 19 nt, Homo sapiens
gguggucuauuauuauaca

SEQ ID NO: 1225844 - RNA, 19 nt, Homo sapiens
ggaagaaggcugcuaugac

SEQ ID NO: 1225845 - RNA, 19 nt, Homo sapiens
cagguuggauaaggacaua

SEQ ID NO: 1225846 - RNA, 19 nt, Homo sapiens
ugaacagguuggauaagga

SEQ ID NO: 1225847 - RNA, 19 nt, Homo sapiens
ugacuuuagugcagauuuc

SEQ ID NO: 1225848 - RNA, 19 nt, Homo sapiens
aucagguggucuauuauua

SEQ ID NO: 1225849 - RNA, 19 nt, Homo sapiens
auaugaggaugaagaaaga

SEQ ID NO: 1225850 - RNA, 19 nt, Homo sapiens
cagaagcaauagagacuac

SEQ ID NO: 1225851 - RNA, 19 nt, Homo sapiens
uagugcagauuucaccauu

SEQ ID NO: 1225852 - RNA, 19 nt, Homo sapiens
acgaugccguguccaguuu

SEQ ID NO: 1225853 - RNA, 19 nt, Homo sapiens
ggaugggagucuggcaaga

SEQ ID NO: 1225854 - RNA, 19 nt, Homo sapiens
uaucagguggucuauuauu

SEQ ID NO: 1225855 - RNA, 19 nt, Homo sapiens
gaauaugaggaugaagaaa

SEQ ID NO: 1225856 - RNA, 19 nt, Homo sapiens
caucuuugcugugccacuu

SEQ ID NO: 1225857 - RNA, 19 nt, Homo sapiens
ucagguggucuauuauuau

SEQ ID NO: 1225858 - RNA, 19 nt, Homo sapiens
aagaauaugaggaugaaga

SEQ ID NO: 1225859 - RNA, 19 nt, Homo sapiens
gggauguauuucauguaga

SEQ ID NO: 1225860 - RNA, 19 nt, Homo sapiens
gaccauccgaagccuguaa

SEQ ID NO: 1225861 - RNA, 19 nt, Homo sapiens
uaccauuagucuugaaaca

SEQ ID NO: 1225862 - RNA, 19 nt, Homo sapiens
aggacaggcugaacagguu

SEQ ID NO: 1225863 - RNA, 19 nt, Homo sapiens
ccaguuaugaugacuuuag

SEQ ID NO: 1225864 - RNA, 19 nt, Homo sapiens
aauauuaucagguggucua

SEQ ID NO: 1225865 - RNA, 19 nt, Homo sapiens
gaaggcugcuaugacucuu

SEQ ID NO: 1225866 - RNA, 19 nt, Homo sapiens
ccacuuauccugggacaag

SEQ ID NO: 1225867 - RNA, 19 nt, Homo sapiens
cauaacagaagcaauagag

SEQ ID NO: 1225868 - RNA, 19 nt, Homo sapiens
gguggaagaaggcugcuau

SEQ ID NO: 1225869 - RNA, 19 nt, Homo sapiens
cgaagccuguaacugugaa

SEQ ID NO: 1225870 - RNA, 19 nt, Homo sapiens
agaauaugaggaugaagaa

SEQ ID NO: 1225871 - RNA, 19 nt, Homo sapiens
uggauaaggacauaacaga

SEQ ID NO: 1225872 - RNA, 19 nt, Homo sapiens
aggcugaacagguuggaua

SEQ ID NO: 1225873 - RNA, 19 nt, Homo sapiens
gggacaagaauaugaggau

SEQ ID NO: 1225874 - RNA, 19 nt, Homo sapiens
ucauguagaagguggaaga

SEQ ID NO: 1225875 - RNA, 19 nt, Homo sapiens
aggcugcuaugacucuuug

SEQ ID NO: 1225876 - RNA, 19 nt, Homo sapiens
ccauugauuacuccauauu

SEQ ID NO: 1225877 - RNA, 19 nt, Homo sapiens
uauccugggacaagaauau

SEQ ID NO: 1225878 - RNA, 19 nt, Homo sapiens
caagaggaaauuggaagau

SEQ ID NO: 1225879 - RNA, 19 nt, Homo sapiens
ggggauguauuucauguag

SEQ ID NO: 1225880 - RNA, 19 nt, Homo sapiens
ggagaggaugaauauuauc

SEQ ID NO: 1225881 - RNA, 19 nt, Homo sapiens
caguuaugaugacuuuagu

SEQ ID NO: 1225882 - RNA, 19 nt, Homo sapiens
aauaugaggaugaagaaag

SEQ ID NO: 1225883 - RNA, 19 nt, Homo sapiens
uggaagaaggcugcuauga

SEQ ID NO: 1225884 - RNA, 19 nt, Homo sapiens
gacugggagaggaugaaua

SEQ ID NO: 1225885 - RNA, 19 nt, Homo sapiens
ggaaccuaguccagaucug

SEQ ID NO: 1225886 - RNA, 19 nt, Homo sapiens
gaagcaauagagacuacca

SEQ ID NO: 1225887 - RNA, 19 nt, Homo sapiens
ggcugaacagguuggauaa

SEQ ID NO: 1225888 - RNA, 19 nt, Homo sapiens
gggagucuggcaagaggaa

SEQ ID NO: 1225889 - RNA, 19 nt, Homo sapiens
acugggagaggaugaauau

SEQ ID NO: 1225890 - RNA, 19 nt, Homo sapiens
ccaguaacaacggaaccua

SEQ ID NO: 1225891 - RNA, 19 nt, Homo sapiens
cugaacagguuggauaagg

SEQ ID NO: 1225892 - RNA, 19 nt, Homo sapiens
gaaagaagaucaaagcaaa

SEQ ID NO: 1225893 - RNA, 19 nt, Homo sapiens
gaagggaacuggaauaucu

SEQ ID NO: 1225894 - RNA, 19 nt, Homo sapiens
caucaaggguuuaauauug

SEQ ID NO: 1225895 - RNA, 19 nt, Homo sapiens
gaaagaagcaugucgcuau

SEQ ID NO: 1225896 - RNA, 19 nt, Homo sapiens
cauaacaacucccaauaaa

SEQ ID NO: 1225897 - RNA, 19 nt, Homo sapiens
uaagauugaucgcuugaua

SEQ ID NO: 1225898 - RNA, 19 nt, Homo sapiens
gaaugaaacuguuaaacca

SEQ ID NO: 1225899 - RNA, 19 nt, Homo sapiens
ggacagacauguucaucau

SEQ ID NO: 1225900 - RNA, 19 nt, Homo sapiens
ugacaaagcuucaaaagaa

SEQ ID NO: 1225901 - RNA, 19 nt, Homo sapiens
gaagaggacaucacagaaa

SEQ ID NO: 1225902 - RNA, 19 nt, Homo sapiens
aaagaaagguuugcaaaga

SEQ ID NO: 1225903 - RNA, 19 nt, Homo sapiens
caacuaguauucagccauu

SEQ ID NO: 1225904 - RNA, 19 nt, Homo sapiens
cauggucaaugaagaaaua

SEQ ID NO: 1225905 - RNA, 19 nt, Homo sapiens
gaaauaggcaaacagcaaa

SEQ ID NO: 1225906 - RNA, 19 nt, Homo sapiens
uaggaggccuucaagauuu

SEQ ID NO: 1225907 - RNA, 19 nt, Homo sapiens
ugaaaugccucagcucgua

SEQ ID NO: 1225908 - RNA, 19 nt, Homo sapiens
gaacaaggagagcaaguau

SEQ ID NO: 1225909 - RNA, 19 nt, Homo sapiens
ccaacauacuagucaauaa

SEQ ID NO: 1225910 - RNA, 19 nt, Homo sapiens
gccagaaucuacagucaaa

SEQ ID NO: 1225911 - RNA, 19 nt, Homo sapiens
gaggaauacuugcacuuug

SEQ ID NO: 1225912 - RNA, 19 nt, Homo sapiens
ggagugccauugaaacaug

SEQ ID NO: 1225913 - RNA, 19 nt, Homo sapiens
gagcagagagggagacuga

SEQ ID NO: 1225914 - RNA, 19 nt, Homo sapiens
gagagaaggucggguacuu

SEQ ID NO: 1225915 - RNA, 19 nt, Homo sapiens
gaacaaggagcaagugauc

SEQ ID NO: 1225916 - RNA, 19 nt, Homo sapiens
gaagaagucacccagauuc

SEQ ID NO: 1225917 - RNA, 19 nt, Homo sapiens
gaauccaaguugacucuga

SEQ ID NO: 1225918 - RNA, 19 nt, Homo sapiens
gaaagaagggacagacaug

SEQ ID NO: 1225919 - RNA, 19 nt, Homo sapiens
gagaagaggacaucacaga

SEQ ID NO: 1225920 - RNA, 19 nt, Homo sapiens
gggagaagauggaggaaca

SEQ ID NO: 1225921 - RNA, 19 nt, Homo sapiens
gaagauggaggaacauugu

SEQ ID NO: 1225922 - RNA, 19 nt, Homo sapiens
gagacugaaucccaaguga

SEQ ID NO: 1225923 - RNA, 19 nt, Homo sapiens
gccaguagauaccgagauu

SEQ ID NO: 1225924 - RNA, 19 nt, Homo sapiens
auacaguccucuugaguuu

SEQ ID NO: 1225925 - RNA, 19 nt, Homo sapiens
gccaagaggugacgagcaa

SEQ ID NO: 1225926 - RNA, 19 nt, Homo sapiens
caagugaucuggcaaaaga

SEQ ID NO: 1225927 - RNA, 19 nt, Homo sapiens
agaaagguuugcaaagauu

SEQ ID NO: 1225928 - RNA, 19 nt, Homo sapiens
gcacaggaucacaaacuuu

SEQ ID NO: 1225929 - RNA, 19 nt, Homo sapiens
ggaggaauacuugcacuuu

SEQ ID NO: 1225930 - RNA, 19 nt, Homo sapiens
caacuacugaggaggaaua

SEQ ID NO: 1225931 - RNA, 19 nt, Homo sapiens
gugaguggcuuccaacuag

SEQ ID NO: 1225932 - RNA, 19 nt, Homo sapiens
gggagaaggcugacucuga

SEQ ID NO: 1225933 - RNA, 19 nt, Homo sapiens
caaggccucucacucaaga

SEQ ID NO: 1225934 - RNA, 19 nt, Homo sapiens
cagaagaagucacccagau

SEQ ID NO: 1225935 - RNA, 19 nt, Homo sapiens
caguguaucugaaccuauu

SEQ ID NO: 1225936 - RNA, 19 nt, Homo sapiens
gagaguugcuguugaacca

SEQ ID NO: 1225937 - RNA, 19 nt, Homo sapiens
aauagugacuucuuuagga

SEQ ID NO: 1225938 - RNA, 19 nt, Homo sapiens
uaacaacucccaauaaacu

SEQ ID NO: 1225939 - RNA, 19 nt, Homo sapiens
ccauaacaacucccaauaa

SEQ ID NO: 1225940 - RNA, 19 nt, Homo sapiens
gcagaggacacucagcaaa

SEQ ID NO: 1225941 - RNA, 19 nt, Homo sapiens
ggaaaugugcuaggaauag

SEQ ID NO: 1225942 - RNA, 19 nt, Homo sapiens
caacagguggaaaguauga

SEQ ID NO: 1225943 - RNA, 19 nt, Homo sapiens
gacaaaggcaugcagagaa

SEQ ID NO: 1225944 - RNA, 19 nt, Homo sapiens
gaagggugaucaggccaaa

SEQ ID NO: 1225945 - RNA, 19 nt, Homo sapiens
gcucugaggccuuugagaa

SEQ ID NO: 1225946 - RNA, 19 nt, Homo sapiens
ucagaagacccaagagaaa

SEQ ID NO: 1225947 - RNA, 19 nt, Homo sapiens
gaaaaccuguaucuucuga

SEQ ID NO: 1225948 - RNA, 19 nt, Homo sapiens
ccaaauacaguccucuuga

SEQ ID NO: 1225949 - RNA, 19 nt, Homo sapiens
agaagaaauugcucagaga

SEQ ID NO: 1225950 - RNA, 19 nt, Homo sapiens
cagaugauucucaccuuua

SEQ ID NO: 1225951 - RNA, 19 nt, Homo sapiens
gaaccaagcccggaaguac

SEQ ID NO: 1225952 - RNA, 19 nt, Homo sapiens
gcuaauugccaccaugaaa

SEQ ID NO: 1225953 - RNA, 19 nt, Homo sapiens
ggaccuaaguaaauuugag

SEQ ID NO: 1225954 - RNA, 19 nt, Homo sapiens
caaauacaguccucuugag

SEQ ID NO: 1225955 - RNA, 19 nt, Homo sapiens
acaaggagagcaaguauau

SEQ ID NO: 1225956 - RNA, 19 nt, Homo sapiens
ugacauccucuuugaauga

SEQ ID NO: 1225957 - RNA, 19 nt, Homo sapiens
gggcuaaucaccauaacaa

SEQ ID NO: 1225958 - RNA, 19 nt, Homo sapiens
caaaaucccugaaggaauc

SEQ ID NO: 1225959 - RNA, 19 nt, Homo sapiens
gaaccuauuauuccauuca

SEQ ID NO: 1225960 - RNA, 19 nt, Homo sapiens
gaaaugccucagcucguaa

SEQ ID NO: 1225961 - RNA, 19 nt, Homo sapiens
gaaaugugcuaggaauagg

SEQ ID NO: 1225962 - RNA, 19 nt, Homo sapiens
caggaaaugugcuaggaau

SEQ ID NO: 1225963 - RNA, 19 nt, Homo sapiens
gcacuucgccagaaucuac

SEQ ID NO: 1225964 - RNA, 19 nt, Homo sapiens
gcugaaagcuuugguuuug

SEQ ID NO: 1225965 - RNA, 19 nt, Homo sapiens
acagacauguucaucauca

SEQ ID NO: 1225966 - RNA, 19 nt, Homo sapiens
cgaaaauacucacaugauu

SEQ ID NO: 1225967 - RNA, 19 nt, Homo sapiens
caguugacauccucuuuga

SEQ ID NO: 1225968 - RNA, 19 nt, Homo sapiens
aaaguaucaucaaggguuu

SEQ ID NO: 1225969 - RNA, 19 nt, Homo sapiens
gaaaucaggaagaggacaa

SEQ ID NO: 1225970 - RNA, 19 nt, Homo sapiens
aaagaagcaugucgcuaug

SEQ ID NO: 1225971 - RNA, 19 nt, Homo sapiens
gaguugcuguugaaccaaa

SEQ ID NO: 1225972 - RNA, 19 nt, Homo sapiens
cgaagccacuccuauugug

SEQ ID NO: 1225973 - RNA, 19 nt, Homo sapiens
aaaccuguaucuucugaug

SEQ ID NO: 1225974 - RNA, 19 nt, Homo sapiens
agugacuucuuuaggauua

SEQ ID NO: 1225975 - RNA, 19 nt, Homo sapiens
acagggaaaugugguguuu

SEQ ID NO: 1225976 - RNA, 19 nt, Homo sapiens
acagaugauucucaccuuu

SEQ ID NO: 1225977 - RNA, 19 nt, Homo sapiens
gcagagagggagacugaau

SEQ ID NO: 1225978 - RNA, 19 nt, Homo sapiens
gcaguugacauccucuuug

SEQ ID NO: 1225979 - RNA, 19 nt, Homo sapiens
ucagagaaacaaucacaaa

SEQ ID NO: 1225980 - RNA, 19 nt, Homo sapiens
aagaaagguuugcaaagau

SEQ ID NO: 1225981 - RNA, 19 nt, Homo sapiens
ggccagcccacaacuagua

SEQ ID NO: 1225982 - RNA, 19 nt, Homo sapiens
aaggagagcaaguauauga

SEQ ID NO: 1225983 - RNA, 19 nt, Homo sapiens
gagcaacagguggaaagua

SEQ ID NO: 1225984 - RNA, 19 nt, Homo sapiens
guggggagauuacuauaua

SEQ ID NO: 1225985 - RNA, 19 nt, Homo sapiens
gccacauuaucucuguuua

SEQ ID NO: 1225986 - RNA, 19 nt, Homo sapiens
ucuaugcugucuugucaaa

SEQ ID NO: 1225987 - RNA, 19 nt, Homo sapiens
ugugagaguugcuguugaa

SEQ ID NO: 1225988 - RNA, 19 nt, Homo sapiens
aaugggaccuaaguaaauu

SEQ ID NO: 1225989 - RNA, 19 nt, Homo sapiens
cacaagaggccuauucuca

SEQ ID NO: 1225990 - RNA, 19 nt, Homo sapiens
gaauaggaggccuucaaga

SEQ ID NO: 1225991 - RNA, 19 nt, Homo sapiens
gccaaggccucucacucaa

SEQ ID NO: 1225992 - RNA, 19 nt, Homo sapiens
gagcacauauguagaauua

SEQ ID NO: 1225993 - RNA, 19 nt, Homo sapiens
ccaaagaacuggaauuuaa

SEQ ID NO: 1225994 - RNA, 19 nt, Homo sapiens
gaaauuaaguggacugaaa

SEQ ID NO: 1225995 - RNA, 19 nt, Homo sapiens
gaccaaggaugcucuauua

SEQ ID NO: 1225996 - RNA, 19 nt, Homo sapiens
gaacucagcaagaauauua

SEQ ID NO: 1225997 - RNA, 19 nt, Homo sapiens
gcaaagacacaaaucauua

SEQ ID NO: 1225998 - RNA, 19 nt, Homo sapiens
gaaaguaaaugaagcaaag

SEQ ID NO: 1225999 - RNA, 19 nt, Homo sapiens
gagcaugacuuuauacaga

SEQ ID NO: 1226000 - RNA, 19 nt, Homo sapiens
ugacagaauuugaagcuua

SEQ ID NO: 1226001 - RNA, 19 nt, Homo sapiens
caaagaugcucaugaagaa

SEQ ID NO: 1226002 - RNA, 19 nt, Homo sapiens
gcccaugacuuagaaauua

SEQ ID NO: 1226003 - RNA, 19 nt, Homo sapiens
gaaagagaccagaucauaa

SEQ ID NO: 1226004 - RNA, 19 nt, Homo sapiens
gcucagaacucaaccauca

SEQ ID NO: 1226005 - RNA, 19 nt, Homo sapiens
gcaagaauauuaugaaagg

SEQ ID NO: 1226006 - RNA, 19 nt, Homo sapiens
aaaggaagcugaucuuaga

SEQ ID NO: 1226007 - RNA, 19 nt, Homo sapiens
gagagucaaugagagauua

SEQ ID NO: 1226008 - RNA, 19 nt, Homo sapiens
ccucaaagcuagucauauu

SEQ ID NO: 1226009 - RNA, 19 nt, Homo sapiens
caaggaugcucuauuaaau

SEQ ID NO: 1226010 - RNA, 19 nt, Homo sapiens
acaaagaaguggaaaguga

SEQ ID NO: 1226011 - RNA, 19 nt, Homo sapiens
guugaaagaucgagagaaa

SEQ ID NO: 1226012 - RNA, 19 nt, Homo sapiens
gauaagaagucagcaaugu

SEQ ID NO: 1226013 - RNA, 19 nt, Homo sapiens
gagaccagaucauaaagaa

SEQ ID NO: 1226014 - RNA, 19 nt, Homo sapiens
gaaggcaaguugaauaaag

SEQ ID NO: 1226015 - RNA, 19 nt, Homo sapiens
gcacagaguugaggacaug

SEQ ID NO: 1226016 - RNA, 19 nt, Homo sapiens
gagcuugacuugacuaaag

SEQ ID NO: 1226017 - RNA, 19 nt, Homo sapiens
aaagagaacucagcaagaa

SEQ ID NO: 1226018 - RNA, 19 nt, Homo sapiens
cuaagagcaugacuuuaua

SEQ ID NO: 1226019 - RNA, 19 nt, Homo sapiens
ggaauuagagagaagcaua

SEQ ID NO: 1226020 - RNA, 19 nt, Homo sapiens
aggaaaggcuucagaauga

SEQ ID NO: 1226021 - RNA, 19 nt, Homo sapiens
ggagaaauggcccuauuaa

SEQ ID NO: 1226022 - RNA, 19 nt, Homo sapiens
gaacggaagaaacuaauug

SEQ ID NO: 1226023 - RNA, 19 nt, Homo sapiens
ggaagaacaacauaacaaa

SEQ ID NO: 1226024 - RNA, 19 nt, Homo sapiens
caaaugacccaggaaguua

SEQ ID NO: 1226025 - RNA, 19 nt, Homo sapiens
ggaugaagcuggaagucuu

SEQ ID NO: 1226026 - RNA, 19 nt, Homo sapiens
gcagaaggacuuauugcua

SEQ ID NO: 1226027 - RNA, 19 nt, Homo sapiens
gaagacaaguugaauacag

SEQ ID NO: 1226028 - RNA, 19 nt, Homo sapiens
gcuagcagcugccagagaa

SEQ ID NO: 1226029 - RNA, 19 nt, Homo sapiens
ccucaaagaugcucaugaa

SEQ ID NO: 1226030 - RNA, 19 nt, Homo sapiens
gagauuagaaggaaauuug

SEQ ID NO: 1226031 - RNA, 19 nt, Homo sapiens
ggaggugacucaauuaaac

SEQ ID NO: 1226032 - RNA, 19 nt, Homo sapiens
gaaauggcccuauuaagca

SEQ ID NO: 1226033 - RNA, 19 nt, Homo sapiens
gcauaaucaucaucaagaa

SEQ ID NO: 1226034 - RNA, 19 nt, Homo sapiens
gaacucaaccaucaacaug

SEQ ID NO: 1226035 - RNA, 19 nt, Homo sapiens
uaaaggaaguacuggaaga

SEQ ID NO: 1226036 - RNA, 19 nt, Homo sapiens
uaaacgaggcccauucuaa

SEQ ID NO: 1226037 - RNA, 19 nt, Homo sapiens
aacgugagcuugauacuuu

SEQ ID NO: 1226038 - RNA, 19 nt, Homo sapiens
ccaggaaguuacaauuaaa

SEQ ID NO: 1226039 - RNA, 19 nt, Homo sapiens
gagcuagaccuuagaagaa

SEQ ID NO: 1226040 - RNA, 19 nt, Homo sapiens
caagaggaauuaagacaca

SEQ ID NO: 1226041 - RNA, 19 nt, Homo sapiens
guaaggagcacauauguag

SEQ ID NO: 1226042 - RNA, 19 nt, Homo sapiens
gcaacagcaugaagaaaca

SEQ ID NO: 1226043 - RNA, 19 nt, Homo sapiens
caaacacugugaaugagaa

SEQ ID NO: 1226044 - RNA, 19 nt, Homo sapiens
aagaggaggugacucaauu

SEQ ID NO: 1226045 - RNA, 19 nt, Homo sapiens
gaacuggagaagaaaguaa

SEQ ID NO: 1226046 - RNA, 19 nt, Homo sapiens
cuaaagggcccaagacauu

SEQ ID NO: 1226047 - RNA, 19 nt, Homo sapiens
agaaagagaccagaucaua

SEQ ID NO: 1226048 - RNA, 19 nt, Homo sapiens
uaagugcccuaaccaaaga

SEQ ID NO: 1226049 - RNA, 19 nt, Homo sapiens
ucagcaaugucucaacuuu

SEQ ID NO: 1226050 - RNA, 19 nt, Homo sapiens
gaucuuguccucaaagcua

SEQ ID NO: 1226051 - RNA, 19 nt, Homo sapiens
gguacuauauuaugugugu

SEQ ID NO: 1226052 - RNA, 19 nt, Homo sapiens
aaagagaccagaucauaaa

SEQ ID NO: 1226053 - RNA, 19 nt, Homo sapiens
caagaacgacagcggcuua

SEQ ID NO: 1226054 - RNA, 19 nt, Homo sapiens
ccaaggaugcucuauuaaa

SEQ ID NO: 1226055 - RNA, 19 nt, Homo sapiens
cacagugccucaguaaaua

SEQ ID NO: 1226056 - RNA, 19 nt, Homo sapiens
guauuugucucuccaacuu

SEQ ID NO: 1226057 - RNA, 19 nt, Homo sapiens
caagaguguucuaaacuuc

SEQ ID NO: 1226058 - RNA, 19 nt, Homo sapiens
guaaauaaaggccaggaaa

SEQ ID NO: 1226059 - RNA, 19 nt, Homo sapiens
gcaccuucaugagaauaua

SEQ ID NO: 1226060 - RNA, 19 nt, Homo sapiens
cccaggaaguuacaauuaa

SEQ ID NO: 1226061 - RNA, 19 nt, Homo sapiens
gggagaaauggcccuauua

SEQ ID NO: 1226062 - RNA, 19 nt, Homo sapiens
gaagagauuagaaggaaau

SEQ ID NO: 1226063 - RNA, 19 nt, Homo sapiens
gacagaauuugaagcuuau

SEQ ID NO: 1226064 - RNA, 19 nt, Homo sapiens
gcagcaggcuuugacagaa

SEQ ID NO: 1226065 - RNA, 19 nt, Homo sapiens
gaauauaagugcccuaacc

SEQ ID NO: 1226066 - RNA, 19 nt, Homo sapiens
caacaaauucuugcugaaa

SEQ ID NO: 1226067 - RNA, 19 nt, Homo sapiens
gcacauguccuugcauuuc

SEQ ID NO: 1226068 - RNA, 19 nt, Homo sapiens
gacagcggcuuacgcaaga

SEQ ID NO: 1226069 - RNA, 19 nt, Homo sapiens
cagaggaacuacacagaau

SEQ ID NO: 1226070 - RNA, 19 nt, Homo sapiens
gaucacagugccucaguaa

SEQ ID NO: 1226071 - RNA, 19 nt, Homo sapiens
uacaagagcuauugaaguc

SEQ ID NO: 1226072 - RNA, 19 nt, Homo sapiens
gaauacgaagugaaucuaa

SEQ ID NO: 1226073 - RNA, 19 nt, Homo sapiens
gcacaaagaaguggaaagu

SEQ ID NO: 1226074 - RNA, 19 nt, Homo sapiens
ucaaagaugcucaugaaga

SEQ ID NO: 1226075 - RNA, 19 nt, Homo sapiens
ggagauacaagagcuauug

SEQ ID NO: 1226076 - RNA, 19 nt, Homo sapiens
ggagcuagaccuuagaaga

SEQ ID NO: 1226077 - RNA, 19 nt, Homo sapiens
caacagauaagauuagaag

SEQ ID NO: 1226078 - RNA, 19 nt, Homo sapiens
cagaggagcuagaccuuag

SEQ ID NO: 1226079 - RNA, 19 nt, Homo sapiens
ggagcgacaucagcaaaga

SEQ ID NO: 1226080 - RNA, 19 nt, Homo sapiens
gaauacagccaaucaagag

SEQ ID NO: 1226081 - RNA, 19 nt, Homo sapiens
gcagaggaacuacacagaa

SEQ ID NO: 1226082 - RNA, 19 nt, Homo sapiens
gaccaugucuagagaaguc

SEQ ID NO: 1226083 - RNA, 19 nt, Homo sapiens
uuacuaagagcaugacuuu

SEQ ID NO: 1226084 - RNA, 19 nt, Homo sapiens
cagaagauauacagaugau

SEQ ID NO: 1226085 - RNA, 19 nt, Homo sapiens
aacaauugcugccaugaaa

SEQ ID NO: 1226086 - RNA, 19 nt, Homo sapiens
agaaugagcuugacuugac

SEQ ID NO: 1226087 - RNA, 19 nt, Homo sapiens
gaagaaaguaaaugaagca

SEQ ID NO: 1226088 - RNA, 19 nt, Homo sapiens
ggagaagaaaguaaaugaa

SEQ ID NO: 1226089 - RNA, 19 nt, Homo sapiens
gaagugaaucuaaccaaca

SEQ ID NO: 1226090 - RNA, 19 nt, Homo sapiens
gagaauauaagugcccuaa

SEQ ID NO: 1226091 - RNA, 19 nt, Homo sapiens
gagagaagcauagacauca

SEQ ID NO: 1226092 - RNA, 19 nt, Homo sapiens
gcucagaaauggaauauga

SEQ ID NO: 1226093 - RNA, 19 nt, Homo sapiens
aaacaugugugguugaauu

SEQ ID NO: 1226094 - RNA, 19 nt, Homo sapiens
uaaaguugcugacuagguu

SEQ ID NO: 1226095 - RNA, 19 nt, Homo sapiens
gauagugacucccaugaau

SEQ ID NO: 1226096 - RNA, 19 nt, Homo sapiens
caacacaccucgcccuaga

SEQ ID NO: 1226097 - RNA, 19 nt, Homo sapiens
gcacuuuaacgcuuucuua

SEQ ID NO: 1226098 - RNA, 19 nt, Homo sapiens
ccacaaugcugcugaaaca

SEQ ID NO: 1226099 - RNA, 19 nt, Homo sapiens
gagcaagcaguuugacuua

SEQ ID NO: 1226100 - RNA, 19 nt, Homo sapiens
gaaacagacucacaacaac

SEQ ID NO: 1226101 - RNA, 19 nt, Homo sapiens
gcaaagcugggacaacuaa

SEQ ID NO: 1226102 - RNA, 19 nt, Homo sapiens
gggagaagccaaugguaua

SEQ ID NO: 1226103 - RNA, 19 nt, Homo sapiens
gaauugcaucuuccuauaa

SEQ ID NO: 1226104 - RNA, 19 nt, Homo sapiens
ugacuuaccagccuucaua

SEQ ID NO: 1226105 - RNA, 19 nt, Homo sapiens
uggcguauguguauuguuu

SEQ ID NO: 1226106 - RNA, 19 nt, Homo sapiens
aaggaaagcuuaugauugg

SEQ ID NO: 1226107 - RNA, 19 nt, Homo sapiens
gaaacacucuuaaaagguu

SEQ ID NO: 1226108 - RNA, 19 nt, Homo sapiens
gaacacugccaccuugcua

SEQ ID NO: 1226109 - RNA, 19 nt, Homo sapiens
ccagauaacauuuacucua

SEQ ID NO: 1226110 - RNA, 19 nt, Homo sapiens
gaacagaaugauugcaugu

SEQ ID NO: 1226111 - RNA, 19 nt, Homo sapiens
ucaaaccauuguaaaguug

SEQ ID NO: 1226112 - RNA, 19 nt, Homo sapiens
uaagggaugguaauacuuu

SEQ ID NO: 1226113 - RNA, 19 nt, Homo sapiens
acagaaugauugcauguug

SEQ ID NO: 1226114 - RNA, 19 nt, Homo sapiens
ugaaacagacucacaacaa

SEQ ID NO: 1226115 - RNA, 19 nt, Homo sapiens
gcagaaggccacugucuag

SEQ ID NO: 1226116 - RNA, 19 nt, Homo sapiens
gaaggccacugucuagaac

SEQ ID NO: 1226117 - RNA, 19 nt, Homo sapiens
auugauaccuuuaccauug

SEQ ID NO: 1226118 - RNA, 19 nt, Homo sapiens
gaacaguaugugugaaguu

SEQ ID NO: 1226119 - RNA, 19 nt, Homo sapiens
aaucuucacuugcucagaa

SEQ ID NO: 1226120 - RNA, 19 nt, Homo sapiens
uagguugggucacauuuga

SEQ ID NO: 1226121 - RNA, 19 nt, Homo sapiens
cuuuaacgcuuucuuauag

SEQ ID NO: 1226122 - RNA, 19 nt, Homo sapiens
gagaagccaaugguauaua

SEQ ID NO: 1226123 - RNA, 19 nt, Homo sapiens
gcuuaugauuggacuuauu

SEQ ID NO: 1226124 - RNA, 19 nt, Homo sapiens
ggagcaagcaguuugacuu

SEQ ID NO: 1226125 - RNA, 19 nt, Homo sapiens
gagcaaaugauuauagucu

SEQ ID NO: 1226126 - RNA, 19 nt, Homo sapiens
caguaugugugaaguuuau

SEQ ID NO: 1226127 - RNA, 19 nt, Homo sapiens
caacacuuacuuugucauu

SEQ ID NO: 1226128 - RNA, 19 nt, Homo sapiens
uuaaagaauugaccuaagg

SEQ ID NO: 1226129 - RNA, 19 nt, Homo sapiens
caugugugguugaauuuau

SEQ ID NO: 1226130 - RNA, 19 nt, Homo sapiens
guuaaaccaauccuuguaa

SEQ ID NO: 1226131 - RNA, 19 nt, Homo sapiens
agacucacaacaacucuua

SEQ ID NO: 1226132 - RNA, 19 nt, Homo sapiens
gacaacacacugcccauga

SEQ ID NO: 1226133 - RNA, 19 nt, Homo sapiens
guaauacuuuggaaaugca

SEQ ID NO: 1226134 - RNA, 19 nt, Homo sapiens
uauaagggaugguaauacu

SEQ ID NO: 1226135 - RNA, 19 nt, Homo sapiens
ccaaaucuucuacguucua

SEQ ID NO: 1226136 - RNA, 19 nt, Homo sapiens
gaauugaccuaaggaaagc

SEQ ID NO: 1226137 - RNA, 19 nt, Homo sapiens
uaaccacaaugcugcugaa

SEQ ID NO: 1226138 - RNA, 19 nt, Homo sapiens
gcagaacaguaugugugaa

SEQ ID NO: 1226139 - RNA, 19 nt, Homo sapiens
acaacacacugcccaugaa

SEQ ID NO: 1226140 - RNA, 19 nt, Homo sapiens
gguaauacuuuggaaaugc

SEQ ID NO: 1226141 - RNA, 19 nt, Homo sapiens
guacuggcacuauaaaaua

SEQ ID NO: 1226142 - RNA, 19 nt, Homo sapiens
ugaugcagaugaugaagau

SEQ ID NO: 1226143 - RNA, 19 nt, Homo sapiens
ggagaagccaaugguauau

SEQ ID NO: 1226144 - RNA, 19 nt, Homo sapiens
uguaugcuuucuacuugua

SEQ ID NO: 1226145 - RNA, 19 nt, Homo sapiens
cagaaugauugcauguugu

SEQ ID NO: 1226146 - RNA, 19 nt, Homo sapiens
uauuugauguugcucagaa

SEQ ID NO: 1226147 - RNA, 19 nt, Homo sapiens
uuaaacaugugugguugaa

SEQ ID NO: 1226148 - RNA, 19 nt, Homo sapiens
aacaguaugugugaaguuu

SEQ ID NO: 1226149 - RNA, 19 nt, Homo sapiens
caaaucuucuacguucuau

SEQ ID NO: 1226150 - RNA, 19 nt, Homo sapiens
ucaagucaaugaaucugau

SEQ ID NO: 1226151 - RNA, 19 nt, Homo sapiens
uaucucaagucaaugaauc

SEQ ID NO: 1226152 - RNA, 19 nt, Homo sapiens
ccaaccagauaacauuuac

SEQ ID NO: 1226153 - RNA, 19 nt, Homo sapiens
ucaggcagcacuucuaaga

SEQ ID NO: 1226154 - RNA, 19 nt, Homo sapiens
cucaaaccauuguaaaguu

SEQ ID NO: 1226155 - RNA, 19 nt, Homo sapiens
acuguaugcuuucuacuug

SEQ ID NO: 1226156 - RNA, 19 nt, Homo sapiens
gcaagcaguuugacuuacc

SEQ ID NO: 1226157 - RNA, 19 nt, Homo sapiens
caugaggcuuccauuagga

SEQ ID NO: 1226158 - RNA, 19 nt, Homo sapiens
uuuauguacuggcacuaua

SEQ ID NO: 1226159 - RNA, 19 nt, Homo sapiens
gacugaagccucgaaggua

SEQ ID NO: 1226160 - RNA, 19 nt, Homo sapiens
ggaugguaauacuuuggaa

SEQ ID NO: 1226161 - RNA, 19 nt, Homo sapiens
gcguauguguauuguuuca

SEQ ID NO: 1226162 - RNA, 19 nt, Homo sapiens
uuauuucccugcaugcauu

SEQ ID NO: 1226163 - RNA, 19 nt, Homo sapiens
ccuagaaacccaaguaucu

SEQ ID NO: 1226164 - RNA, 19 nt, Homo sapiens
ggcaucacaugguucuaga

SEQ ID NO: 1226165 - RNA, 19 nt, Homo sapiens
gcuuucuacuuguaaaugu

SEQ ID NO: 1226166 - RNA, 19 nt, Homo sapiens
ugucugaguauuugaguaa

SEQ ID NO: 1226167 - RNA, 19 nt, Homo sapiens
aaccaauccuuguaaagug

SEQ ID NO: 1226168 - RNA, 19 nt, Homo sapiens
gacuagugguggagggaaa

SEQ ID NO: 1226169 - RNA, 19 nt, Homo sapiens
gaugguaauacuuuggaaa

SEQ ID NO: 1226170 - RNA, 19 nt, Homo sapiens
gauuucaacacuuacuuug

SEQ ID NO: 1226171 - RNA, 19 nt, Homo sapiens
ccuauaagggaugguaaua

SEQ ID NO: 1226172 - RNA, 19 nt, Homo sapiens
agaagccaaugguauauac

SEQ ID NO: 1226173 - RNA, 19 nt, Homo sapiens
uuucaacacuuacuuuguc

SEQ ID NO: 1226174 - RNA, 19 nt, Homo sapiens
aagcuuaugauuggacuua

SEQ ID NO: 1226175 - RNA, 19 nt, Homo sapiens
ucaugaggcuuccauuagg

SEQ ID NO: 1226176 - RNA, 19 nt, Homo sapiens
ugauguugcucagaaaugu

SEQ ID NO: 1226177 - RNA, 19 nt, Homo sapiens
aaaccaauccuuguaaagu

SEQ ID NO: 1226178 - RNA, 19 nt, Homo sapiens
guauguguauuguuucaac

SEQ ID NO: 1226179 - RNA, 19 nt, Homo sapiens
gauccuugagcaaaugauu

SEQ ID NO: 1226180 - RNA, 19 nt, Homo sapiens
guguauuguuucaacugua

SEQ ID NO: 1226181 - RNA, 19 nt, Homo sapiens
gugugaaguuuauguacug

SEQ ID NO: 1226182 - RNA, 19 nt, Homo sapiens
cagggaagguaagaaaaua

SEQ ID NO: 1226183 - RNA, 19 nt, Homo sapiens
gaagcagaacaguaugugu

SEQ ID NO: 1226184 - RNA, 19 nt, Homo sapiens
gcagaugaugaagauaauu

SEQ ID NO: 1226185 - RNA, 19 nt, Homo sapiens
gaaguggagaggcucaaca

SEQ ID NO: 1226186 - RNA, 19 nt, Homo sapiens
agaauugaccuaaggaaag

SEQ ID NO: 1226187 - RNA, 19 nt, Homo sapiens
uaaagaauugaccuaagga

SEQ ID NO: 1226188 - RNA, 19 nt, Homo sapiens
uuucaugaggcuuccauua

SEQ ID NO: 1226189 - RNA, 19 nt, Homo sapiens
ggaagcagaacaguaugug

SEQ ID NO: 1226190 - RNA, 19 nt, Homo sapiens
cuucauauggucaagguuu

SEQ ID NO: 1226191 - RNA, 19 nt, Homo sapiens
agaaggccacugucuagaa

SEQ ID NO: 1226192 - RNA, 19 nt, Homo sapiens
gcuacaagcuucuaaauaa

SEQ ID NO: 1226193 - RNA, 19 nt, Homo sapiens
gagcagaucugauuauucu

SEQ ID NO: 1226194 - RNA, 19 nt, Homo sapiens
agugguaucuugacuauua

SEQ ID NO: 1226195 - RNA, 19 nt, Homo sapiens
ccacauauuucacaacuau

SEQ ID NO: 1226196 - RNA, 19 nt, Homo sapiens
ugaaaucucucucauuguu

SEQ ID NO: 1226197 - RNA, 19 nt, Homo sapiens
guaguacccucaaaucauu

SEQ ID NO: 1226198 - RNA, 19 nt, Homo sapiens
guaaguuguuugugcuuua

SEQ ID NO: 1226199 - RNA, 19 nt, Homo sapiens
ggauacagguguuauuuca

SEQ ID NO: 1226200 - RNA, 19 nt, Homo sapiens
ggaaauucuucgagauaaa

SEQ ID NO: 1226201 - RNA, 19 nt, Homo sapiens
agaaagaacuauucagaga

SEQ ID NO: 1226202 - RNA, 19 nt, Homo sapiens
ugaggaaacuggagaaaga

SEQ ID NO: 1226203 - RNA, 19 nt, Homo sapiens
guauaguguugcugaaaua

SEQ ID NO: 1226204 - RNA, 19 nt, Homo sapiens
ucaguaaucuucaaaguca

SEQ ID NO: 1226205 - RNA, 19 nt, Homo sapiens
ucagagagauggaaucaau

SEQ ID NO: 1226206 - RNA, 19 nt, Homo sapiens
auaaagaagugggucauua

SEQ ID NO: 1226207 - RNA, 19 nt, Homo sapiens
caaaguuaguucuuaguga

SEQ ID NO: 1226208 - RNA, 19 nt, Homo sapiens
ggagaaagaacuauucaga

SEQ ID NO: 1226209 - RNA, 19 nt, Homo sapiens
gcaagcaugguuucuauuu

SEQ ID NO: 1226210 - RNA, 19 nt, Homo sapiens
aguaauagcuuccuaaagu

SEQ ID NO: 1226211 - RNA, 19 nt, Homo sapiens
agaagugggucauuauaaa

SEQ ID NO: 1226212 - RNA, 19 nt, Homo sapiens
guaauagcuuccuaaaguu

SEQ ID NO: 1226213 - RNA, 19 nt, Homo sapiens
ucugaaaucucucucauug

SEQ ID NO: 1226214 - RNA, 19 nt, Homo sapiens
gagcuuguuugggagauua

SEQ ID NO: 1226215 - RNA, 19 nt, Homo sapiens
agacuuggcuaaccaguga

SEQ ID NO: 1226216 - RNA, 19 nt, Homo sapiens
aaagaacuauucagagaga

SEQ ID NO: 1226217 - RNA, 19 nt, Homo sapiens
aaaccuaacuugagcagau

SEQ ID NO: 1226218 - RNA, 19 nt, Homo sapiens
gaaucuaucaccuugguaa

SEQ ID NO: 1226219 - RNA, 19 nt, Homo sapiens
ggauaguauucaaguggua

SEQ ID NO: 1226220 - RNA, 19 nt, Homo sapiens
guuaaucucuuuccucagu

SEQ ID NO: 1226221 - RNA, 19 nt, Homo sapiens
gaaacuggagaaagaacua

SEQ ID NO: 1226222 - RNA, 19 nt, Homo sapiens
gauaaaccaaguggcauua

SEQ ID NO: 1226223 - RNA, 19 nt, Homo sapiens
gcagaucugauuauucuug

SEQ ID NO: 1226224 - RNA, 19 nt, Homo sapiens
caaguggcauuaauaugga

SEQ ID NO: 1226225 - RNA, 19 nt, Homo sapiens
aaaccaaguggcauuaaua

SEQ ID NO: 1226226 - RNA, 19 nt, Homo sapiens
gcacaaaggaaauauaacu

SEQ ID NO: 1226227 - RNA, 19 nt, Homo sapiens
uuaaccagcucuaacaaga

SEQ ID NO: 1226228 - RNA, 19 nt, Homo sapiens
gugauguacuugcauuauu

SEQ ID NO: 1226229 - RNA, 19 nt, Homo sapiens
caacaggcauuggaaguag

SEQ ID NO: 1226230 - RNA, 19 nt, Homo sapiens
cagccaagaugaugacuuc

SEQ ID NO: 1226231 - RNA, 19 nt, Homo sapiens
gaaaacagcauuggaauug

SEQ ID NO: 1226232 - RNA, 19 nt, Homo sapiens
uaucucaagugguaaguug

SEQ ID NO: 1226233 - RNA, 19 nt, Homo sapiens
gaaacaaugauggaaauuc

SEQ ID NO: 1226234 - RNA, 19 nt, Homo sapiens
uaaagaagugggucauuau

SEQ ID NO: 1226235 - RNA, 19 nt, Homo sapiens
gucacuaucagcacaauua

SEQ ID NO: 1226236 - RNA, 19 nt, Homo sapiens
gguauuugguuacauuauc

SEQ ID NO: 1226237 - RNA, 19 nt, Homo sapiens
aaacaagaaugagguagug

SEQ ID NO: 1226238 - RNA, 19 nt, Homo sapiens
gaaaucucucucauuguuu

SEQ ID NO: 1226239 - RNA, 19 nt, Homo sapiens
ggucaguaaucuucaaagu

SEQ ID NO: 1226240 - RNA, 19 nt, Homo sapiens
uaaaccaaguggcauuaau

SEQ ID NO: 1226241 - RNA, 19 nt, Homo sapiens
aaacagcauuggaauugga

SEQ ID NO: 1226242 - RNA, 19 nt, Homo sapiens
gauggaaauucuucgagau

SEQ ID NO: 1226243 - RNA, 19 nt, Homo sapiens
aaagaagugggucauuaua

SEQ ID NO: 1226244 - RNA, 19 nt, Homo sapiens
gaaacaagaaugagguagu

SEQ ID NO: 1226245 - RNA, 19 nt, Homo sapiens
ucuaucaccuugguaaauu

SEQ ID NO: 1226246 - RNA, 19 nt, Homo sapiens
gaucaguggucaguaaucu

SEQ ID NO: 1226247 - RNA, 19 nt, Homo sapiens
gugaucauauggucagcua

SEQ ID NO: 1226248 - RNA, 19 nt, Homo sapiens
caaguaagacucaaaauug

SEQ ID NO: 1226249 - RNA, 19 nt, Homo sapiens
gcauauuccuaucuugaca

SEQ ID NO: 1226250 - RNA, 19 nt, Homo sapiens
gguaaguuguuugugcuuu

SEQ ID NO: 1226251 - RNA, 19 nt, Homo sapiens
aaugacgcauggauuuaua

SEQ ID NO: 1226252 - RNA, 19 nt, Homo sapiens
ucaccaacauuugaacuug

SEQ ID NO: 1226253 - RNA, 19 nt, Homo sapiens
ccaaguggcauuaauaugg

SEQ ID NO: 1226254 - RNA, 19 nt, Homo sapiens
uaucagcacaauuagguua

SEQ ID NO: 1226255 - RNA, 19 nt, Homo sapiens
gaaccaaaaccuuaggaua

SEQ ID NO: 1226256 - RNA, 19 nt, Homo sapiens
gcuaaccagugagcuugua

SEQ ID NO: 1226257 - RNA, 19 nt, Homo sapiens
cuaucaccuugguaaauua

SEQ ID NO: 1226258 - RNA, 19 nt, Homo sapiens
gaucauauggucagcuaau

SEQ ID NO: 1226259 - RNA, 19 nt, Homo sapiens
cagucaaaguuaguucuua

SEQ ID NO: 1226260 - RNA, 19 nt, Homo sapiens
uggaaauucuucgagauaa

SEQ ID NO: 1226261 - RNA, 19 nt, Homo sapiens
cuaaucaacuuuccauaac

SEQ ID NO: 1226262 - RNA, 19 nt, Homo sapiens
gcuuguagcucugauuauc

SEQ ID NO: 1226263 - RNA, 19 nt, Homo sapiens
cauuugaacuugaagaucu

SEQ ID NO: 1226264 - RNA, 19 nt, Homo sapiens
agaaugagguaguggcaau

SEQ ID NO: 1226265 - RNA, 19 nt, Homo sapiens
aaccagcucuaacaagaaa

SEQ ID NO: 1226266 - RNA, 19 nt, Homo sapiens
uaguguugcugaaauagaa

SEQ ID NO: 1226267 - RNA, 19 nt, Homo sapiens
gcauuggaaguaguaaaua

SEQ ID NO: 1226268 - RNA, 19 nt, Homo sapiens
cuaaauaagcacaaaggaa

SEQ ID NO: 1226269 - RNA, 19 nt, Homo sapiens
cagcauauuccuaucuuga

SEQ ID NO: 1226270 - RNA, 19 nt, Homo sapiens
uuugggagauuagagaaua

SEQ ID NO: 1226271 - RNA, 19 nt, Homo sapiens
gaagacacccacucuacca

SEQ ID NO: 1226272 - RNA, 19 nt, Homo sapiens
ggcuacaagcuucuaaaua

SEQ ID NO: 1226273 - RNA, 19 nt, Homo sapiens
gauaccaguucaccaacau

SEQ ID NO: 1226274 - RNA, 19 nt, Homo sapiens
ggauaccaguucaccaaca

SEQ ID NO: 1226275 - RNA, 19 nt, Homo sapiens
gcagcauauuccuaucuug

SEQ ID NO: 1226276 - RNA, 19 nt, Homo sapiens
ggucugaaaucucucucau

SEQ ID NO: 1226277 - RNA, 19 nt, Homo sapiens
gacaugagaaacuaugcua

SEQ ID NO: 1226278 - RNA, 19 nt, Homo sapiens
cuacaagcuucuaaauaag

SEQ ID NO: 1226279 - RNA, 19 nt, Homo sapiens
aaacuaugcuaagcggaaa

SEQ ID NO: 1226280 - RNA, 19 nt, Homo sapiens
agugaucaguggucaguaa

SEQ ID NO: 1226281 - RNA, 19 nt, Homo sapiens
ggaacacccagacaugaga

SEQ ID NO: 1226282 - RNA, 19 nt, Homo sapiens
caccaacauuugaacuuga

SEQ ID NO: 1226283 - RNA, 19 nt, Homo sapiens
gaacacccagacaugagaa

SEQ ID NO: 1226284 - RNA, 19 nt, Homo sapiens
caggugauguacuugcauu

SEQ ID NO: 1226285 - RNA, 19 nt, Homo sapiens
cugcaagcaugguuucuau

SEQ ID NO: 1226286 - RNA, 19 nt, Homo sapiens
uaauauggagggagaauuc

SEQ ID NO: 1226287 - RNA, 19 nt, Homo sapiens
aagaagugggucauuauaa

SEQ ID NO: 1226288 - RNA, 19 nt, Homo sapiens
ucaguuacaucaagaaagc

SEQ ID NO: 1226289 - RNA, 19 nt, Homo sapiens
cguauaguguugcugaaau

SEQ ID NO: 1226290 - RNA, 19 nt, Homo sapiens
cagaaucuaucaccuuggu

SEQ ID NO: 1226291 - RNA, 19 nt, Homo sapiens
ccaguucaccaacauuuga

SEQ ID NO: 1226292 - RNA, 19 nt, Homo sapiens
gaagagagcuuaauaugaa

SEQ ID NO: 1226293 - RNA, 19 nt, Homo sapiens
cauaaucagugccuaaaua

SEQ ID NO: 1226294 - RNA, 19 nt, Homo sapiens
ggacauugcuauauuaaag

SEQ ID NO: 1226295 - RNA, 19 nt, Homo sapiens
gagggacauugcuauauua

SEQ ID NO: 1226296 - RNA, 19 nt, Homo sapiens
uauauuaggucagcucuua

SEQ ID NO: 1226297 - RNA, 19 nt, Homo sapiens
caaguacucuuaagugcua

SEQ ID NO: 1226298 - RNA, 19 nt, Homo sapiens
uaaagugaauucccugaaa

SEQ ID NO: 1226299 - RNA, 19 nt, Homo sapiens
agaaacaccuguagcauug

SEQ ID NO: 1226300 - RNA, 19 nt, Homo sapiens
caacaguccuacuagauau

SEQ ID NO: 1226301 - RNA, 19 nt, Homo sapiens
uagaaaggcuguuggauuc

SEQ ID NO: 1226302 - RNA, 19 nt, Homo sapiens
caugaaguauccuuuguaa

SEQ ID NO: 1226303 - RNA, 19 nt, Homo sapiens
acucuuaagugcuacauua

SEQ ID NO: 1226304 - RNA, 19 nt, Homo sapiens
aaggauagcauuccaaaua

SEQ ID NO: 1226305 - RNA, 19 nt, Homo sapiens
ccacaaaccuccaguuaac

SEQ ID NO: 1226306 - RNA, 19 nt, Homo sapiens
gaaguuggacuagugauuu

SEQ ID NO: 1226307 - RNA, 19 nt, Homo sapiens
gcagcaaagcgguuuauuu

SEQ ID NO: 1226308 - RNA, 19 nt, Homo sapiens
gauaacagcaaguccagua

SEQ ID NO: 1226309 - RNA, 19 nt, Homo sapiens
gagcaagcccagaaacuaa

SEQ ID NO: 1226310 - RNA, 19 nt, Homo sapiens
ugagacagcuucaaagaca

SEQ ID NO: 1226311 - RNA, 19 nt, Homo sapiens
caaacuagcuaaaggaaac

SEQ ID NO: 1226312 - RNA, 19 nt, Homo sapiens
ugagggacauugcuauauu

SEQ ID NO: 1226313 - RNA, 19 nt, Homo sapiens
gcaaggaagucauaaucag

SEQ ID NO: 1226314 - RNA, 19 nt, Homo sapiens
ggacuagugauuuauuuga

SEQ ID NO: 1226315 - RNA, 19 nt, Homo sapiens
ccagguagcuccuucuagu

SEQ ID NO: 1226316 - RNA, 19 nt, Homo sapiens
ggauagcauuccaaauaga

SEQ ID NO: 1226317 - RNA, 19 nt, Homo sapiens
ccaacaguccuacuagaua

SEQ ID NO: 1226318 - RNA, 19 nt, Homo sapiens
aauaagaacuggagcaagu

SEQ ID NO: 1226319 - RNA, 19 nt, Homo sapiens
gaaaauaggaugaacuuug

SEQ ID NO: 1226320 - RNA, 19 nt, Homo sapiens
aaagauuacuggagaaaca

SEQ ID NO: 1226321 - RNA, 19 nt, Homo sapiens
gccuuuaccuuguagcuuu

SEQ ID NO: 1226322 - RNA, 19 nt, Homo sapiens
gaauagcguucugccaguu

SEQ ID NO: 1226323 - RNA, 19 nt, Homo sapiens
cugaaugccuccacuuauu

SEQ ID NO: 1226324 - RNA, 19 nt, Homo sapiens
gaaaccaaccuaaggaagu

SEQ ID NO: 1226325 - RNA, 19 nt, Homo sapiens
ccuacuagauauuugguaa

SEQ ID NO: 1226326 - RNA, 19 nt, Homo sapiens
gagcaaguacucuuaagug

SEQ ID NO: 1226327 - RNA, 19 nt, Homo sapiens
gaaacuaacggcuacucaa

SEQ ID NO: 1226328 - RNA, 19 nt, Homo sapiens
ggucagcucuuacuuuuga

SEQ ID NO: 1226329 - RNA, 19 nt, Homo sapiens
acccuaaccuagccauuua

SEQ ID NO: 1226330 - RNA, 19 nt, Homo sapiens
guaaccagcuucccuuaac

SEQ ID NO: 1226331 - RNA, 19 nt, Homo sapiens
cagaaauuguuaagugaug

SEQ ID NO: 1226332 - RNA, 19 nt, Homo sapiens
guguuggagugaaggauua

SEQ ID NO: 1226333 - RNA, 19 nt, Homo sapiens
caaugugccuuuaccuugu

SEQ ID NO: 1226334 - RNA, 19 nt, Homo sapiens
ggagaaagaaauacagaca

SEQ ID NO: 1226335 - RNA, 19 nt, Homo sapiens
aaguuggacuagugauuua

SEQ ID NO: 1226336 - RNA, 19 nt, Homo sapiens
gacugaaugccuccacuua

SEQ ID NO: 1226337 - RNA, 19 nt, Homo sapiens
gcaaguccaguaagugcua

SEQ ID NO: 1226338 - RNA, 19 nt, Homo sapiens
gcaguucaagaaggaauua

SEQ ID NO: 1226339 - RNA, 19 nt, Homo sapiens
guacaugaaguauccuuug

SEQ ID NO: 1226340 - RNA, 19 nt, Homo sapiens
gaugaaggagacauauauu

SEQ ID NO: 1226341 - RNA, 19 nt, Homo sapiens
cuacaaguuugagaaggua

SEQ ID NO: 1226342 - RNA, 19 nt, Homo sapiens
ccauuuaccauacaucaaa

SEQ ID NO: 1226343 - RNA, 19 nt, Homo sapiens
uguaaaaucuccaucauga

SEQ ID NO: 1226344 - RNA, 19 nt, Homo sapiens
acucaaagccacuuagaaa

SEQ ID NO: 1226345 - RNA, 19 nt, Homo sapiens
aaacuaacggcuacucaaa

SEQ ID NO: 1226346 - RNA, 19 nt, Homo sapiens
agaagagagcuuaauauga

SEQ ID NO: 1226347 - RNA, 19 nt, Homo sapiens
ugaaugccuccacuuauuu

SEQ ID NO: 1226348 - RNA, 19 nt, Homo sapiens
ccagauugcuauuguaaaa

SEQ ID NO: 1226349 - RNA, 19 nt, Homo sapiens
ucccagaaauuguuaagug

SEQ ID NO: 1226350 - RNA, 19 nt, Homo sapiens
cagcaaagcgguuuauuuu

SEQ ID NO: 1226351 - RNA, 19 nt, Homo sapiens
ugaaggagacauauauuag

SEQ ID NO: 1226352 - RNA, 19 nt, Homo sapiens
gugaaggauuagaugguuu

SEQ ID NO: 1226353 - RNA, 19 nt, Homo sapiens
gauuccagauugcuauugu

SEQ ID NO: 1226354 - RNA, 19 nt, Homo sapiens
uuagaaaggcuguuggauu

SEQ ID NO: 1226355 - RNA, 19 nt, Homo sapiens
gacaggauguuccaaagac

SEQ ID NO: 1226356 - RNA, 19 nt, Homo sapiens
cccagaaauuguuaaguga

SEQ ID NO: 1226357 - RNA, 19 nt, Homo sapiens
acaggaggcuacugggaaa

SEQ ID NO: 1226358 - RNA, 19 nt, Homo sapiens
caacugagcgagccagaca

SEQ ID NO: 1226359 - RNA, 19 nt, Homo sapiens
gaaggagacauauauuagg

SEQ ID NO: 1226360 - RNA, 19 nt, Homo sapiens
gaaaguccaagcugagaca

SEQ ID NO: 1226361 - RNA, 19 nt, Homo sapiens
gaauacuccuguggcauca

SEQ ID NO: 1226362 - RNA, 19 nt, Homo sapiens
gaagaaacaccuguagcau

SEQ ID NO: 1226363 - RNA, 19 nt, Homo sapiens
gacccuaaccuagccauuu

SEQ ID NO: 1226364 - RNA, 19 nt, Homo sapiens
aagaagagagcuuaauaug

SEQ ID NO: 1226365 - RNA, 19 nt, Homo sapiens
cauugaaguuggacuagug

SEQ ID NO: 1226366 - RNA, 19 nt, Homo sapiens
aaaccaaccuaaggaagug

SEQ ID NO: 1226367 - RNA, 19 nt, Homo sapiens
cgacauugaaguuggacua

SEQ ID NO: 1226368 - RNA, 19 nt, Homo sapiens
caggugcacuuucuaguac

SEQ ID NO: 1226369 - RNA, 19 nt, Homo sapiens
cgauuucccuagcagcauu

SEQ ID NO: 1226370 - RNA, 19 nt, Homo sapiens
aagaaacaccuguagcauu

SEQ ID NO: 1226371 - RNA, 19 nt, Homo sapiens
cuaaaggaaaccaaccuaa

SEQ ID NO: 1226372 - RNA, 19 nt, Homo sapiens
gcuaaaggaaaccaaccua

SEQ ID NO: 1226373 - RNA, 19 nt, Homo sapiens
gguaaccagcuucccuuaa

SEQ ID NO: 1226374 - RNA, 19 nt, Homo sapiens
uaacagggguccucuaugg

SEQ ID NO: 1226375 - RNA, 19 nt, Homo sapiens
ugagcaagcccagaaacua

SEQ ID NO: 1226376 - RNA, 19 nt, Homo sapiens
guaaagugaauucccugaa

SEQ ID NO: 1226377 - RNA, 19 nt, Homo sapiens
ugaagaaacaccuguagca

SEQ ID NO: 1226378 - RNA, 19 nt, Homo sapiens
aaagcaggagaaagaaaua

SEQ ID NO: 1226379 - RNA, 19 nt, Homo sapiens
uaaaggaaaccaaccuaag

SEQ ID NO: 1226380 - RNA, 19 nt, Homo sapiens
uaaccuagccauuuaccau

SEQ ID NO: 1226381 - RNA, 19 nt, Homo sapiens
uaaauaagaacuggagcaa

SEQ ID NO: 1226382 - RNA, 19 nt, Homo sapiens
gaaggaauuacugcagcua

SEQ ID NO: 1226383 - RNA, 19 nt, Homo sapiens
ccauauguuuauucccauu

SEQ ID NO: 1226384 - RNA, 19 nt, Homo sapiens
acaggugcacuuucuagua

SEQ ID NO: 1226385 - RNA, 19 nt, Homo sapiens
gcuaagccccuacaaguuu

SEQ ID NO: 1226386 - RNA, 19 nt, Homo sapiens
gaaugccuccacuuauuuc

SEQ ID NO: 1226387 - RNA, 19 nt, Homo sapiens
cuaaauagacaggauguuc

SEQ ID NO: 1226388 - RNA, 19 nt, Homo sapiens
uaauugagcaagcccagaa

SEQ ID NO: 1226389 - RNA, 19 nt, Homo sapiens
ccuuuaccuuguagcuuua

SEQ ID NO: 1226390 - RNA, 19 nt, Homo sapiens
ugaacuuuguuucccagaa

SEQ ID NO: 1226391 - RNA, 19 nt, Homo sapiens
aaugcugaauccuaguaua

SEQ ID NO: 1226392 - RNA, 19 nt, Homo sapiens
ggacaggcauuuacacuga

SEQ ID NO: 1226393 - RNA, 19 nt, Homo sapiens
gcaaauuacugcagaaucu

SEQ ID NO: 1226394 - RNA, 19 nt, Homo sapiens
caccaugacuccaagauga

SEQ ID NO: 1226395 - RNA, 19 nt, Homo sapiens
agaagugucuggaguaguu

SEQ ID NO: 1226396 - RNA, 19 nt, Homo sapiens
gaagagacggcaacguaaa

SEQ ID NO: 1226397 - RNA, 19 nt, Homo sapiens
caaauaaaggguccuagaa

SEQ ID NO: 1226398 - RNA, 19 nt, Homo sapiens
ggaagagacggcaacguaa

SEQ ID NO: 1226399 - RNA, 19 nt, Homo sapiens
gaugauacgucggaauaga

SEQ ID NO: 1226400 - RNA, 19 nt, Homo sapiens
gauuaucccuuaacagaag

SEQ ID NO: 1226401 - RNA, 19 nt, Homo sapiens
aauaaaggguccuagaaga

SEQ ID NO: 1226402 - RNA, 19 nt, Homo sapiens
gugaugauacgucggaaua

SEQ ID NO: 1226403 - RNA, 19 nt, Homo sapiens
aagccaaggucuuuuauua

SEQ ID NO: 1226404 - RNA, 19 nt, Homo sapiens
ugagaugccucguggugaa

SEQ ID NO: 1226405 - RNA, 19 nt, Homo sapiens
uuaaaggucccgacuggua

SEQ ID NO: 1226406 - RNA, 19 nt, Homo sapiens
cccuuuauguucccaaaua

SEQ ID NO: 1226407 - RNA, 19 nt, Homo sapiens
ggaggugucccacucauca

SEQ ID NO: 1226408 - RNA, 19 nt, Homo sapiens
uaaaggucccgacugguaa

SEQ ID NO: 1226409 - RNA, 19 nt, Homo sapiens
ccaaauaaaggguccuaga

SEQ ID NO: 1226410 - RNA, 19 nt, Homo sapiens
gaaccuggcacagaucuuc

SEQ ID NO: 1226411 - RNA, 19 nt, Homo sapiens
gagccugucccuuuauguu

SEQ ID NO: 1226412 - RNA, 19 nt, Homo sapiens
caucucccauaucccauuu

SEQ ID NO: 1226413 - RNA, 19 nt, Homo sapiens
gaauggcaggugcuacaaa

SEQ ID NO: 1226414 - RNA, 19 nt, Homo sapiens
aggaagagacggcaacgua

SEQ ID NO: 1226415 - RNA, 19 nt, Homo sapiens
ggauuuauuucucgauucg

SEQ ID NO: 1226416 - RNA, 19 nt, Homo sapiens
ucuccaagcugggcauuug

SEQ ID NO: 1226417 - RNA, 19 nt, Homo sapiens
ggaguaguuuucagguaua

SEQ ID NO: 1226418 - RNA, 19 nt, Homo sapiens
ccagagacacggagaagau

SEQ ID NO: 1226419 - RNA, 19 nt, Homo sapiens
aaaggguccuagaagacua

SEQ ID NO: 1226420 - RNA, 19 nt, Homo sapiens
aacuggagcugcguucaua

SEQ ID NO: 1226421 - RNA, 19 nt, Homo sapiens
caucgggcaucaagcacaa

SEQ ID NO: 1226422 - RNA, 19 nt, Homo sapiens
gcaccaugacuccaagaug

SEQ ID NO: 1226423 - RNA, 19 nt, Homo sapiens
ucgccaacuucgcuuauga

SEQ ID NO: 1226424 - RNA, 19 nt, Homo sapiens
caggaaagaaacccauuug

SEQ ID NO: 1226425 - RNA, 19 nt, Homo sapiens
ccaggaaagaaacccauuu

SEQ ID NO: 1226426 - RNA, 19 nt, Homo sapiens
ccucugcugucacucaaug

SEQ ID NO: 1226427 - RNA, 19 nt, Homo sapiens
ucgccaaccucgccaacuu

SEQ ID NO: 1226428 - RNA, 19 nt, Homo sapiens
gagggucucgcucggcuuu

SEQ ID NO: 1226429 - RNA, 19 nt, Homo sapiens
ccucuucccucuccagaca

SEQ ID NO: 1226430 - RNA, 19 nt, Homo sapiens
ugccuucgcugcaggaaau

SEQ ID NO: 1226431 - RNA, 19 nt, Homo sapiens
gguccuggauuuauuucuc

SEQ ID NO: 1226432 - RNA, 19 nt, Homo sapiens
gcauuuacacugaugaaac

SEQ ID NO: 1226433 - RNA, 19 nt, Homo sapiens
ccugguaacugcaucuucu

SEQ ID NO: 1226434 - RNA, 19 nt, Homo sapiens
aaucugaacccaggaaaga

SEQ ID NO: 1226435 - RNA, 19 nt, Homo sapiens
gguccuugccucucgugua

SEQ ID NO: 1226436 - RNA, 19 nt, Homo sapiens
ugacagcccagggacuuaa

SEQ ID NO: 1226437 - RNA, 19 nt, Homo sapiens
acuccaagaugaagaugug

SEQ ID NO: 1226438 - RNA, 19 nt, Homo sapiens
gguggaguuugcuauugga

SEQ ID NO: 1226439 - RNA, 19 nt, Homo sapiens
aaauaaaggguccuagaag

SEQ ID NO: 1226440 - RNA, 19 nt, Homo sapiens
caucagggacgcagugagu

SEQ ID NO: 1226441 - RNA, 19 nt, Homo sapiens
ggaagccagacuccagaga

SEQ ID NO: 1226442 - RNA, 19 nt, Homo sapiens
gacaggcauuuacacugau

SEQ ID NO: 1226443 - RNA, 19 nt, Homo sapiens
ggaauggcaggugcuacaa

SEQ ID NO: 1226444 - RNA, 19 nt, Homo sapiens
guccuugccucucguguac

SEQ ID NO: 1226445 - RNA, 19 nt, Homo sapiens
gagcgugggauccgaugga

SEQ ID NO: 1226446 - RNA, 19 nt, Homo sapiens
uguaagaagcggccaagug

SEQ ID NO: 1226447 - RNA, 19 nt, Homo sapiens
cauuuacacugaugaaacg

SEQ ID NO: 1226448 - RNA, 19 nt, Homo sapiens
gcaggaggugucccacuca

SEQ ID NO: 1226449 - RNA, 19 nt, Homo sapiens
gaagugucuggaguaguuu

SEQ ID NO: 1226450 - RNA, 19 nt, Homo sapiens
gagacacggagaagaucaa

SEQ ID NO: 1226451 - RNA, 19 nt, Homo sapiens
ggccaugcaggugaugaua

SEQ ID NO: 1226452 - RNA, 19 nt, Homo sapiens
acacggagaagaucaaacu

SEQ ID NO: 1226453 - RNA, 19 nt, Homo sapiens
cuggauuuauuucucgauu

SEQ ID NO: 1226454 - RNA, 19 nt, Homo sapiens
ucugaacccaggaaagaaa

SEQ ID NO: 1226455 - RNA, 19 nt, Homo sapiens
acaaggccaugcaggugau

SEQ ID NO: 1226456 - RNA, 19 nt, Homo sapiens
guggaugccaaccuggaua

SEQ ID NO: 1226457 - RNA, 19 nt, Homo sapiens
gagaugccucguggugaaa

SEQ ID NO: 1226458 - RNA, 19 nt, Homo sapiens
aagccagacuccagagaca

SEQ ID NO: 1226459 - RNA, 19 nt, Homo sapiens
cagcaggacaggcauuuac

SEQ ID NO: 1226460 - RNA, 19 nt, Homo sapiens
ccacgugggcauggaaaug

SEQ ID NO: 1226461 - RNA, 19 nt, Homo sapiens
ucaagggagucaggaagag

SEQ ID NO: 1226462 - RNA, 19 nt, Homo sapiens
gaaucugaacccaggaaag

SEQ ID NO: 1226463 - RNA, 19 nt, Homo sapiens
augagacccugguggaguu

SEQ ID NO: 1226464 - RNA, 19 nt, Homo sapiens
gagacggcaacguaaagga

SEQ ID NO: 1226465 - RNA, 19 nt, Homo sapiens
caagggagucaggaagaga

SEQ ID NO: 1226466 - RNA, 19 nt, Homo sapiens
ccaagacgccaaggagcaa

SEQ ID NO: 1226467 - RNA, 19 nt, Homo sapiens
guucauaggcuggcacucu

SEQ ID NO: 1226468 - RNA, 19 nt, Homo sapiens
cagacagggccaacaagga

SEQ ID NO: 1226469 - RNA, 19 nt, Homo sapiens
ucagguauaggaaugagau

SEQ ID NO: 1226470 - RNA, 19 nt, Homo sapiens
ucagcaggacaggcauuua

SEQ ID NO: 1226471 - RNA, 19 nt, Homo sapiens
ggugagcccuaguugauuu

SEQ ID NO: 1226472 - RNA, 19 nt, Homo sapiens
gcucuuugauuaugagauu

SEQ ID NO: 1226473 - RNA, 19 nt, Homo sapiens
cagcaacgguggcgucaug

SEQ ID NO: 1226474 - RNA, 19 nt, Homo sapiens
ggcccgagcucuaccucua

SEQ ID NO: 1226475 - RNA, 19 nt, Homo sapiens
aaaaggggcugcaucguaa

SEQ ID NO: 1226476 - RNA, 19 nt, Homo sapiens
cucgagggcugacgaagua

SEQ ID NO: 1226477 - RNA, 19 nt, Homo sapiens
gugacuacccuacuuacua

SEQ ID NO: 1226478 - RNA, 19 nt, Homo sapiens
caaguacagugccaucuac

SEQ ID NO: 1226479 - RNA, 19 nt, Homo sapiens
cuguagagguugacaaaug

SEQ ID NO: 1226480 - RNA, 19 nt, Homo sapiens
caugcaggcuguagagguu

SEQ ID NO: 1226481 - RNA, 19 nt, Homo sapiens
gcagucaguuguguuugga

SEQ ID NO: 1226482 - RNA, 19 nt, Homo sapiens
ugacuacccuacuuacuac

SEQ ID NO: 1226483 - RNA, 19 nt, Homo sapiens
cggcagagcuggacuacac

SEQ ID NO: 1226484 - RNA, 19 nt, Homo sapiens
auuaugagauugagaagga

SEQ ID NO: 1226485 - RNA, 19 nt, Homo sapiens
ggacuacaccaucgagauc

SEQ ID NO: 1226486 - RNA, 19 nt, Homo sapiens
ccaaguacagugccaucua

SEQ ID NO: 1226487 - RNA, 19 nt, Homo sapiens
gcacucuucucguucaacu

SEQ ID NO: 1226488 - RNA, 19 nt, Homo sapiens
caaaaggggcugcaucgua

SEQ ID NO: 1226489 - RNA, 19 nt, Homo sapiens
uuuaaacucugguaagaac

SEQ ID NO: 1226490 - RNA, 19 nt, Homo sapiens
uguagagguugacaaaugg

SEQ ID NO: 1226491 - RNA, 19 nt, Homo sapiens
acucugguaagaacauuua

SEQ ID NO: 1226492 - RNA, 19 nt, Homo sapiens
aaacucugguaagaacauu

SEQ ID NO: 1226493 - RNA, 19 nt, Homo sapiens
gucgggcacucuucucguu

SEQ ID NO: 1226494 - RNA, 19 nt, Homo sapiens
acagugccaucuaccacaa

SEQ ID NO: 1226495 - RNA, 19 nt, Homo sapiens
gcuuaccacagaauccuaa

SEQ ID NO: 1226496 - RNA, 19 nt, Homo sapiens
ggguaucccuucacuucgu

SEQ ID NO: 1226497 - RNA, 19 nt, Homo sapiens
ucagccaccuccgugacua

SEQ ID NO: 1226498 - RNA, 19 nt, Homo sapiens
ggcuguagagguugacaaa

SEQ ID NO: 1226499 - RNA, 19 nt, Homo sapiens
ggucuucuucuccgaguca

SEQ ID NO: 1226500 - RNA, 19 nt, Homo sapiens
gggcacucuucucguucaa

SEQ ID NO: 1226501 - RNA, 19 nt, Homo sapiens
aagccucugugucgacuuc

SEQ ID NO: 1226502 - RNA, 19 nt, Homo sapiens
aguccuggccagagacaua

SEQ ID NO: 1226503 - RNA, 19 nt, Homo sapiens
aaguaguccuggccagaga

SEQ ID NO: 1226504 - RNA, 19 nt, Homo sapiens
caaagccucuaauaaauug

SEQ ID NO: 1226505 - RNA, 19 nt, Homo sapiens
gaacagaccgcacauguca

SEQ ID NO: 1226506 - RNA, 19 nt, Homo sapiens
ggacaggccucaagaagag

SEQ ID NO: 1226507 - RNA, 19 nt, Homo sapiens
gcaaagccucuaauaaauu

SEQ ID NO: 1226508 - RNA, 19 nt, Homo sapiens
ggaguccuauuuccuguuu

SEQ ID NO: 1226509 - RNA, 19 nt, Homo sapiens
gcucgaaacuuccuauaca

SEQ ID NO: 1226510 - RNA, 19 nt, Homo sapiens
guacaagggcaaggaaaua

SEQ ID NO: 1226511 - RNA, 19 nt, Homo sapiens
cugcaaagccucuaauaaa

SEQ ID NO: 1226512 - RNA, 19 nt, Homo sapiens
cuuaggaucuugcucauug

SEQ ID NO: 1226513 - RNA, 19 nt, Homo sapiens
caaggucacugcuguacug

SEQ ID NO: 1226514 - RNA, 19 nt, Homo sapiens
cagagaaagugcacagaug

SEQ ID NO: 1226515 - RNA, 19 nt, Homo sapiens
caaccugaauccuggagaa

SEQ ID NO: 1226516 - RNA, 19 nt, Homo sapiens
uugcagaacuccaggauau

SEQ ID NO: 1226517 - RNA, 19 nt, Homo sapiens
cagagcccauuaagcauuu

SEQ ID NO: 1226518 - RNA, 19 nt, Homo sapiens
ugcaaagccucuaauaaau

SEQ ID NO: 1226519 - RNA, 19 nt, Homo sapiens
gccagcagcucacauacug

SEQ ID NO: 1226520 - RNA, 19 nt, Homo sapiens
cccggaagcugccaucauu

SEQ ID NO: 1226521 - RNA, 19 nt, Homo sapiens
gaaugacgguggaguugag

SEQ ID NO: 1226522 - RNA, 19 nt, Homo sapiens
gcgaggcucucuggacuga

SEQ ID NO: 1226523 - RNA, 19 nt, Homo sapiens
gagggaaccugauucuacu

SEQ ID NO: 1226524 - RNA, 19 nt, Homo sapiens
gagaagaggaagccuggaa

SEQ ID NO: 1226525 - RNA, 19 nt, Homo sapiens
gcagagugaggacuucauu

SEQ ID NO: 1226526 - RNA, 19 nt, Homo sapiens
gaagagauccagguacaag

SEQ ID NO: 1226527 - RNA, 19 nt, Homo sapiens
gauauaggaagccagagaa

SEQ ID NO: 1226528 - RNA, 19 nt, Homo sapiens
cagggacaguuaagaguug

SEQ ID NO: 1226529 - RNA, 19 nt, Homo sapiens
gcacaugucagagcccauu

SEQ ID NO: 1226530 - RNA, 19 nt, Homo sapiens
ccuauuuccuguuuaacuu

SEQ ID NO: 1226531 - RNA, 19 nt, Homo sapiens
gugcacagaugaggauguu

SEQ ID NO: 1226532 - RNA, 19 nt, Homo sapiens
gugaggacuucauucucua

SEQ ID NO: 1226533 - RNA, 19 nt, Homo sapiens
ggcaaggaaauaagaauga

SEQ ID NO: 1226534 - RNA, 19 nt, Homo sapiens
ggaagcugccaucauucua

SEQ ID NO: 1226535 - RNA, 19 nt, Homo sapiens
ggauauaggaagccagaga

SEQ ID NO: 1226536 - RNA, 19 nt, Homo sapiens
gaauacacgagccuccaaa

SEQ ID NO: 1226537 - RNA, 19 nt, Homo sapiens
gaaccugucagcuucaaag

SEQ ID NO: 1226538 - RNA, 19 nt, Homo sapiens
ugucagagcccauuaagca

SEQ ID NO: 1226539 - RNA, 19 nt, Homo sapiens
gcagaacuccaggauauag

SEQ ID NO: 1226540 - RNA, 19 nt, Homo sapiens
ggacauaucagaaaagcuu

SEQ ID NO: 1226541 - RNA, 19 nt, Homo sapiens
gaagcugccaucauucuag

SEQ ID NO: 1226542 - RNA, 19 nt, Homo sapiens
gagggacagucuccaaguc

SEQ ID NO: 1226543 - RNA, 19 nt, Homo sapiens
ccucaggacauaucagaaa

SEQ ID NO: 1226544 - RNA, 19 nt, Homo sapiens
caagggcaaggaaauaaga

SEQ ID NO: 1226545 - RNA, 19 nt, Homo sapiens
gcaaggaaauaagaaugac

SEQ ID NO: 1226546 - RNA, 19 nt, Homo sapiens
gggacaggccucaagaaga

SEQ ID NO: 1226547 - RNA, 19 nt, Homo sapiens
aguccuauuuccuguuuaa

SEQ ID NO: 1226548 - RNA, 19 nt, Homo sapiens
uaagaaugacgguggaguu

SEQ ID NO: 1226549 - RNA, 19 nt, Homo sapiens
ggacaguuaagaguugaaa

SEQ ID NO: 1226550 - RNA, 19 nt, Homo sapiens
cagcucacauacuggagaa

SEQ ID NO: 1226551 - RNA, 19 nt, Homo sapiens
gagaugaccagggacaguu

SEQ ID NO: 1226552 - RNA, 19 nt, Homo sapiens
agagaaagugcacagauga

SEQ ID NO: 1226553 - RNA, 19 nt, Homo sapiens
gaaaaggccaggagaguca

SEQ ID NO: 1226554 - RNA, 19 nt, Homo sapiens
gaacuccaggauauaggaa

SEQ ID NO: 1226555 - RNA, 19 nt, Homo sapiens
ccagagaaccacaggagau

SEQ ID NO: 1226556 - RNA, 19 nt, Homo sapiens
ucagagcccauuaagcauu

SEQ ID NO: 1226557 - RNA, 19 nt, Homo sapiens
caguggcugugaaugguuu

SEQ ID NO: 1226558 - RNA, 19 nt, Homo sapiens
gggcaaggaaauaagaaug

SEQ ID NO: 1226559 - RNA, 19 nt, Homo sapiens
ccugcaaagccucuaauaa

SEQ ID NO: 1226560 - RNA, 19 nt, Homo sapiens
gaucacacugcuucacaga

SEQ ID NO: 1226561 - RNA, 19 nt, Homo sapiens
gagaucacacugcuucaca

SEQ ID NO: 1226562 - RNA, 19 nt, Homo sapiens
ugagggaaccugauucuac

SEQ ID NO: 1226563 - RNA, 19 nt, Homo sapiens
ggaacagaccgcacauguc

SEQ ID NO: 1226564 - RNA, 19 nt, Homo sapiens
ggauugcacaccugaagug

SEQ ID NO: 1226565 - RNA, 19 nt, Homo sapiens
guucagcgcccagacagaa

SEQ ID NO: 1226566 - RNA, 19 nt, Homo sapiens
gcuccaagcccagcaggaa

SEQ ID NO: 1226567 - RNA, 19 nt, Homo sapiens
gauccuggaguccuauuuc

SEQ ID NO: 1226568 - RNA, 19 nt, Homo sapiens
gaugaccagggacaguuaa

SEQ ID NO: 1226569 - RNA, 19 nt, Homo sapiens
gguacaagggcaaggaaau

SEQ ID NO: 1226570 - RNA, 19 nt, Homo sapiens
gaggcucucuggacugaac

SEQ ID NO: 1226571 - RNA, 19 nt, Homo sapiens
ccagggacaguuaagaguu

SEQ ID NO: 1226572 - RNA, 19 nt, Homo sapiens
uacaagggcaaggaaauaa

SEQ ID NO: 1226573 - RNA, 19 nt, Homo sapiens
cuuccagaauggcuuuaaa

SEQ ID NO: 1226574 - RNA, 19 nt, Homo sapiens
ccagagaaagugcacagau

SEQ ID NO: 1226575 - RNA, 19 nt, Homo sapiens
gcucacauacuggagaaga

SEQ ID NO: 1226576 - RNA, 19 nt, Homo sapiens
cuguuuaacuucuuaggau

SEQ ID NO: 1226577 - RNA, 19 nt, Homo sapiens
ggcggauccuggaguccua

SEQ ID NO: 1226578 - RNA, 19 nt, Homo sapiens
caguuaagaguugaaauug

SEQ ID NO: 1226579 - RNA, 19 nt, Homo sapiens
gggccacccuuccuaagac

SEQ ID NO: 1226580 - RNA, 19 nt, Homo sapiens
gaggauugcacaccugaag

SEQ ID NO: 1226581 - RNA, 19 nt, Homo sapiens
cugcagaaccugucagcuu

SEQ ID NO: 1226582 - RNA, 19 nt, Homo sapiens
agugaggacuucauucucu

SEQ ID NO: 1226583 - RNA, 19 nt, Homo sapiens
gaggacagcaucggagauc

SEQ ID NO: 1226584 - RNA, 19 nt, Homo sapiens
gaccagggacaguuaagag

SEQ ID NO: 1226585 - RNA, 19 nt, Homo sapiens
ggcaguggcugugaauggu

SEQ ID NO: 1226586 - RNA, 19 nt, Homo sapiens
cauccugggaggccucuaa

SEQ ID NO: 1226587 - RNA, 19 nt, Homo sapiens
ggaaaaugaucaggucaag

SEQ ID NO: 1226588 - RNA, 19 nt, Homo sapiens
gaguccuauuuccuguuua

SEQ ID NO: 1226589 - RNA, 19 nt, Homo sapiens
auaggaagccagagaaagu

SEQ ID NO: 1226590 - RNA, 19 nt, Homo sapiens
gcagaaccugucagcuuca

SEQ ID NO: 1226591 - RNA, 19 nt, Homo sapiens
aaugccagcagcucacaua

SEQ ID NO: 1226592 - RNA, 19 nt, Homo sapiens
gagagccucccagugagaa

SEQ ID NO: 1226593 - RNA, 19 nt, Homo sapiens
cucgaaacuuccuauacaa

SEQ ID NO: 1226594 - RNA, 19 nt, Homo sapiens
gcaguggcugugaaugguu

SEQ ID NO: 1226595 - RNA, 19 nt, Homo sapiens
ggagaugaccagggacagu

SEQ ID NO: 1226596 - RNA, 19 nt, Homo sapiens
cagaaccugucagcuucaa

SEQ ID NO: 1226597 - RNA, 19 nt, Homo sapiens
ggaggaaggaauguacauc

SEQ ID NO: 1226598 - RNA, 19 nt, Homo sapiens
acagaccgcacaugucaga

SEQ ID NO: 1226599 - RNA, 19 nt, Homo sapiens
gagaaagugcacagaugag

SEQ ID NO: 1226600 - RNA, 19 nt, Homo sapiens
aagcccagcaggaaaggua

SEQ ID NO: 1226601 - RNA, 19 nt, Homo sapiens
caaauggggcuccacagaa

SEQ ID NO: 1226602 - RNA, 19 nt, Homo sapiens
uuaggaucuugcucauuga

SEQ ID NO: 1226603 - RNA, 19 nt, Homo sapiens
agaugaccagggacaguua

SEQ ID NO: 1226604 - RNA, 19 nt, Homo sapiens
gaccagagcuaccaguuca

SEQ ID NO: 1226605 - RNA, 19 nt, Homo sapiens
gcaagagaacuucauccua

SEQ ID NO: 1226606 - RNA, 19 nt, Homo sapiens
caacaccgcccucugauca

SEQ ID NO: 1226607 - RNA, 19 nt, Homo sapiens
guauagugcuggugacugu

SEQ ID NO: 1226608 - RNA, 19 nt, Homo sapiens
gccagcagcucaaggacaa

SEQ ID NO: 1226609 - RNA, 19 nt, Homo sapiens
ccaagggugucccacauuc

SEQ ID NO: 1226610 - RNA, 19 nt, Homo sapiens
ugaagcagcugcaggacau

SEQ ID NO: 1226611 - RNA, 19 nt, Homo sapiens
ggacaagaucuccguguuc

SEQ ID NO: 1226612 - RNA, 19 nt, Homo sapiens
agacagagccacccuagga

SEQ ID NO: 1226613 - RNA, 19 nt, Homo sapiens
gaggaacgccacagacaga

SEQ ID NO: 1226614 - RNA, 19 nt, Homo sapiens
gacaagaucuccguguucu

SEQ ID NO: 1226615 - RNA, 19 nt, Homo sapiens
gaggaaggaaggcugguuu

SEQ ID NO: 1226616 - RNA, 19 nt, Homo sapiens
cagcccaacuccaccaaga

SEQ ID NO: 1226617 - RNA, 19 nt, Homo sapiens
ggguggcacugagcuauga

SEQ ID NO: 1226618 - RNA, 19 nt, Homo sapiens
gaucaccaugggaaucuuu

SEQ ID NO: 1226619 - RNA, 19 nt, Homo sapiens
caugugagccaagccauuu

SEQ ID NO: 1226620 - RNA, 19 nt, Homo sapiens
gaccgaggacagaaagauu

SEQ ID NO: 1226621 - RNA, 19 nt, Homo sapiens
gaaggaaggcugguuuggu

SEQ ID NO: 1226622 - RNA, 19 nt, Homo sapiens
acgccaggcugcuauuuau

SEQ ID NO: 1226623 - RNA, 19 nt, Homo sapiens
gcugauggacgcagugaug

SEQ ID NO: 1226624 - RNA, 19 nt, Homo sapiens
caaaguggagugcgugauc

SEQ ID NO: 1226625 - RNA, 19 nt, Homo sapiens
ggaccagagcuaccaguuc

SEQ ID NO: 1226626 - RNA, 19 nt, Homo sapiens
ggaggaccgaggacagaaa

SEQ ID NO: 1226627 - RNA, 19 nt, Homo sapiens
ggccaagggugucccacau

SEQ ID NO: 1226628 - RNA, 19 nt, Homo sapiens
ugaagggugugcugacucu

SEQ ID NO: 1226629 - RNA, 19 nt, Homo sapiens
caacgacgcccuggucuac

SEQ ID NO: 1226630 - RNA, 19 nt, Homo sapiens
ggaccgaggacagaaagau

SEQ ID NO: 1226631 - RNA, 19 nt, Homo sapiens
gggaggacaagcaguggaa

SEQ ID NO: 1226632 - RNA, 19 nt, Homo sapiens
cauuugcacugccaggaau

SEQ ID NO: 1226633 - RNA, 19 nt, Homo sapiens
caacgccaggcugcuauuu

SEQ ID NO: 1226634 - RNA, 19 nt, Homo sapiens
cgaggugcacgcuguguug

SEQ ID NO: 1226635 - RNA, 19 nt, Homo sapiens
aggacaagaucuccguguu

SEQ ID NO: 1226636 - RNA, 19 nt, Homo sapiens
cuacaucaaccucaacaag

SEQ ID NO: 1226637 - RNA, 19 nt, Homo sapiens
ccaacuccaccaagaacuu

SEQ ID NO: 1226638 - RNA, 19 nt, Homo sapiens
aggcggaugugaaccugaa

SEQ ID NO: 1226639 - RNA, 19 nt, Homo sapiens
ggugcacgcuguguugaag

SEQ ID NO: 1226640 - RNA, 19 nt, Homo sapiens
gaagugccaggaggaagga

SEQ ID NO: 1226641 - RNA, 19 nt, Homo sapiens
ggucaacgucuacaucaac

SEQ ID NO: 1226642 - RNA, 19 nt, Homo sapiens
gcuggugacuguguuucau

SEQ ID NO: 1226643 - RNA, 19 nt, Homo sapiens
gccaagggugucccacauu

SEQ ID NO: 1226644 - RNA, 19 nt, Homo sapiens
ggaaggaaggcugguuugg

SEQ ID NO: 1226645 - RNA, 19 nt, Homo sapiens
ggaggaaggaaggcugguu

SEQ ID NO: 1226646 - RNA, 19 nt, Homo sapiens
caagcaagagaacuucauc

SEQ ID NO: 1226647 - RNA, 19 nt, Homo sapiens
ugagccacgugcacaaagu

SEQ ID NO: 1226648 - RNA, 19 nt, Homo sapiens
aagaucaucagacuccaaa

SEQ ID NO: 1226649 - RNA, 19 nt, Homo sapiens
ggugaagggugugcugacu

SEQ ID NO: 1226650 - RNA, 19 nt, Homo sapiens
gugaggaacgccacagaca

SEQ ID NO: 1226651 - RNA, 19 nt, Homo sapiens
ucacagcacccaggagcuu

SEQ ID NO: 1226652 - RNA, 19 nt, Homo sapiens
caacuccaccaagaacuuc

SEQ ID NO: 1226653 - RNA, 19 nt, Homo sapiens
gaugccagaaaccauguga

SEQ ID NO: 1226654 - RNA, 19 nt, Homo sapiens
ucaacgacgcccuggucua

SEQ ID NO: 1226655 - RNA, 19 nt, Homo sapiens
ggugagccacgugcacaaa

SEQ ID NO: 1226656 - RNA, 19 nt, Homo sapiens
ggaugugaaccugaagaug

SEQ ID NO: 1226657 - RNA, 19 nt, Homo sapiens
ucccaacaccgcccucuga

SEQ ID NO: 1226658 - RNA, 19 nt, Homo sapiens
acaucaaccucaacaagcu

SEQ ID NO: 1226659 - RNA, 19 nt, Homo sapiens
gcacaaauauuuccuguuu

SEQ ID NO: 1226660 - RNA, 19 nt, Homo sapiens
ggagauugcuuacaggaaa

SEQ ID NO: 1226661 - RNA, 19 nt, Homo sapiens
gaucuaacuucuagcuaaa

SEQ ID NO: 1226662 - RNA, 19 nt, Homo sapiens
caaaggccuugaagaauau

SEQ ID NO: 1226663 - RNA, 19 nt, Homo sapiens
cagcaaauuuggcucgaua

SEQ ID NO: 1226664 - RNA, 19 nt, Homo sapiens
guucuuaucuuucaucugu

SEQ ID NO: 1226665 - RNA, 19 nt, Homo sapiens
gaguggagauguuuauuuc

SEQ ID NO: 1226666 - RNA, 19 nt, Homo sapiens
guaaggaacuugugcacau

SEQ ID NO: 1226667 - RNA, 19 nt, Homo sapiens
gugagggaauggcaaauaa

SEQ ID NO: 1226668 - RNA, 19 nt, Homo sapiens
gcacuguaauaccuauaaa

SEQ ID NO: 1226669 - RNA, 19 nt, Homo sapiens
caaauuaucaagcacugua

SEQ ID NO: 1226670 - RNA, 19 nt, Homo sapiens
caaauuuggcucgauaaua

SEQ ID NO: 1226671 - RNA, 19 nt, Homo sapiens
ugaucuaacuucuagcuaa

SEQ ID NO: 1226672 - RNA, 19 nt, Homo sapiens
uauaggaggagaacaauaa

SEQ ID NO: 1226673 - RNA, 19 nt, Homo sapiens
gaacggaucaccuugucaa

SEQ ID NO: 1226674 - RNA, 19 nt, Homo sapiens
gcaaugaacggaucaccuu

SEQ ID NO: 1226675 - RNA, 19 nt, Homo sapiens
gaacagcuugcaccucauu

SEQ ID NO: 1226676 - RNA, 19 nt, Homo sapiens
gcacacugcccacaaugaa

SEQ ID NO: 1226677 - RNA, 19 nt, Homo sapiens
caucacagccgacccauau

SEQ ID NO: 1226678 - RNA, 19 nt, Homo sapiens
guaauacugugugaauuca

SEQ ID NO: 1226679 - RNA, 19 nt, Homo sapiens
ucaacuagauggcuaugau

SEQ ID NO: 1226680 - RNA, 19 nt, Homo sapiens
ccgcaagcaugcuaauuug

SEQ ID NO: 1226681 - RNA, 19 nt, Homo sapiens
gaaagcagucucagguuca

SEQ ID NO: 1226682 - RNA, 19 nt, Homo sapiens
uagguaaaccagcaaauuu

SEQ ID NO: 1226683 - RNA, 19 nt, Homo sapiens
caacuagauggcuaugaua

SEQ ID NO: 1226684 - RNA, 19 nt, Homo sapiens
caagcaugcuaauuugaug

SEQ ID NO: 1226685 - RNA, 19 nt, Homo sapiens
uaauaucgcuggccuaagc

SEQ ID NO: 1226686 - RNA, 19 nt, Homo sapiens
gaagaagaaacagcagaaa

SEQ ID NO: 1226687 - RNA, 19 nt, Homo sapiens
ggagaacaauaaccuacca

SEQ ID NO: 1226688 - RNA, 19 nt, Homo sapiens
uuacaggguagcaugauua

SEQ ID NO: 1226689 - RNA, 19 nt, Homo sapiens
gcauaccauuagaagaauu

SEQ ID NO: 1226690 - RNA, 19 nt, Homo sapiens
gcaagcaugcuaauuugau

SEQ ID NO: 1226691 - RNA, 19 nt, Homo sapiens
gagggaauggcaaauaaga

SEQ ID NO: 1226692 - RNA, 19 nt, Homo sapiens
aagauugugucaccucaaa

SEQ ID NO: 1226693 - RNA, 19 nt, Homo sapiens
acacugcuuugaauuauag

SEQ ID NO: 1226694 - RNA, 19 nt, Homo sapiens
gaaguaacccuaggcucaa

SEQ ID NO: 1226695 - RNA, 19 nt, Homo sapiens
ccacaaugaauguaacuau

SEQ ID NO: 1226696 - RNA, 19 nt, Homo sapiens
gaauggcaaauaagaaugu

SEQ ID NO: 1226697 - RNA, 19 nt, Homo sapiens
gggaauggcaaauaagaau

SEQ ID NO: 1226698 - RNA, 19 nt, Homo sapiens
caauguuugugcagaguug

SEQ ID NO: 1226699 - RNA, 19 nt, Homo sapiens
gagagaguggagauguuua

SEQ ID NO: 1226700 - RNA, 19 nt, Homo sapiens
uaaagaggaaaccaagaaa

SEQ ID NO: 1226701 - RNA, 19 nt, Homo sapiens
gagauugcuuacaggaaau

SEQ ID NO: 1226702 - RNA, 19 nt, Homo sapiens
gaugaggacauucaacuag

SEQ ID NO: 1226703 - RNA, 19 nt, Homo sapiens
gaagaaacagcagaaagca

SEQ ID NO: 1226704 - RNA, 19 nt, Homo sapiens
gcaauccagucagccauca

SEQ ID NO: 1226705 - RNA, 19 nt, Homo sapiens
gaaaauuuacuguggcuuu

SEQ ID NO: 1226706 - RNA, 19 nt, Homo sapiens
cugcauaccauuagaagaa

SEQ ID NO: 1226707 - RNA, 19 nt, Homo sapiens
ggaggagaacaauaaccua

SEQ ID NO: 1226708 - RNA, 19 nt, Homo sapiens
uagagagaguggagauguu

SEQ ID NO: 1226709 - RNA, 19 nt, Homo sapiens
gcaaauuuggcucgauaau

SEQ ID NO: 1226710 - RNA, 19 nt, Homo sapiens
ccauauacaccaaggcaaa

SEQ ID NO: 1226711 - RNA, 19 nt, Homo sapiens
guuacaggguagcaugauu

SEQ ID NO: 1226712 - RNA, 19 nt, Homo sapiens
gcuaauuugauggaaguua

SEQ ID NO: 1226713 - RNA, 19 nt, Homo sapiens
ggauaagcacaaauauuuc

SEQ ID NO: 1226714 - RNA, 19 nt, Homo sapiens
ccauucagguguuacuugu

SEQ ID NO: 1226715 - RNA, 19 nt, Homo sapiens
ucacagccgacccauauga

SEQ ID NO: 1226716 - RNA, 19 nt, Homo sapiens
caagcacuguaauaccuau

SEQ ID NO: 1226717 - RNA, 19 nt, Homo sapiens
ggaauggcaaauaagaaug

SEQ ID NO: 1226718 - RNA, 19 nt, Homo sapiens
cggaucaccuugucaacug

SEQ ID NO: 1226719 - RNA, 19 nt, Homo sapiens
ccuuacaaauuacuuggaa

SEQ ID NO: 1226720 - RNA, 19 nt, Homo sapiens
agagauugaugaggacauu

SEQ ID NO: 1226721 - RNA, 19 nt, Homo sapiens
uacggaggcucucacaguu

SEQ ID NO: 1226722 - RNA, 19 nt, Homo sapiens
uuucugaucuaacuucuag

SEQ ID NO: 1226723 - RNA, 19 nt, Homo sapiens
guggauaagcacaaauauu

SEQ ID NO: 1226724 - RNA, 19 nt, Homo sapiens
auaaagaggaaaccaagaa

SEQ ID NO: 1226725 - RNA, 19 nt, Homo sapiens
cuagaagaacauuucagua

SEQ ID NO: 1226726 - RNA, 19 nt, Homo sapiens
ccaaagaccccagaaguaa

SEQ ID NO: 1226727 - RNA, 19 nt, Homo sapiens
gcucucacaguucaacaaa

SEQ ID NO: 1226728 - RNA, 19 nt, Homo sapiens
gaaccgguggcgcaaugaa

SEQ ID NO: 1226729 - RNA, 19 nt, Homo sapiens
gcauaacauugaccccaua

SEQ ID NO: 1226730 - RNA, 19 nt, Homo sapiens
gugugaauucagacuauua

SEQ ID NO: 1226731 - RNA, 19 nt, Homo sapiens
ugagcacacugcccacaau

SEQ ID NO: 1226732 - RNA, 19 nt, Homo sapiens
ucauaugacacuuggguuu

SEQ ID NO: 1226733 - RNA, 19 nt, Homo sapiens
agaguggagauguuuauuu

SEQ ID NO: 1226734 - RNA, 19 nt, Homo sapiens
gguauaaagaggaaaccaa

SEQ ID NO: 1226735 - RNA, 19 nt, Homo sapiens
cggaggcucucacaguuca

SEQ ID NO: 1226736 - RNA, 19 nt, Homo sapiens
ugaggacauucaacuagau

SEQ ID NO: 1226737 - RNA, 19 nt, Homo sapiens
ggccuugaagaauauauuu

SEQ ID NO: 1226738 - RNA, 19 nt, Homo sapiens
cuaauuugauggaaguuac

SEQ ID NO: 1226739 - RNA, 19 nt, Homo sapiens
gaguuccacugcugugcuu

SEQ ID NO: 1226740 - RNA, 19 nt, Homo sapiens
gugccaaggugcuacucuu

SEQ ID NO: 1226741 - RNA, 19 nt, Homo sapiens
aauacugugugaauucaga

SEQ ID NO: 1226742 - RNA, 19 nt, Homo sapiens
acacuuuacuagaagaaca

SEQ ID NO: 1226743 - RNA, 19 nt, Homo sapiens
cuacuggaguguguaagga

SEQ ID NO: 1226744 - RNA, 19 nt, Homo sapiens
cuagguaaaccagcaaauu

SEQ ID NO: 1226745 - RNA, 19 nt, Homo sapiens
uaaggaacuugugcacauc

SEQ ID NO: 1226746 - RNA, 19 nt, Homo sapiens
ucugggagaccauaaguga

SEQ ID NO: 1226747 - RNA, 19 nt, Homo sapiens
agaagaagaaacagcagaa

SEQ ID NO: 1226748 - RNA, 19 nt, Homo sapiens
gcagcaggcuaugggaucu

SEQ ID NO: 1226749 - RNA, 19 nt, Homo sapiens
gagaguggagauguuuauu

SEQ ID NO: 1226750 - RNA, 19 nt, Homo sapiens
cuuggaaauucaauguuug

SEQ ID NO: 1226751 - RNA, 19 nt, Homo sapiens
caggguagcaugauuaaaa

SEQ ID NO: 1226752 - RNA, 19 nt, Homo sapiens
cuacggaggcucucacagu

SEQ ID NO: 1226753 - RNA, 19 nt, Homo sapiens
uguaauacugugugaauuc

SEQ ID NO: 1226754 - RNA, 19 nt, Homo sapiens
gauaucugggagaccauaa

SEQ ID NO: 1226755 - RNA, 19 nt, Homo sapiens
cgugagggaauggcaaaua

SEQ ID NO: 1226756 - RNA, 19 nt, Homo sapiens
agagagaguggagauguuu

SEQ ID NO: 1226757 - RNA, 19 nt, Homo sapiens
caagccacacuuagagaga

SEQ ID NO: 1226758 - RNA, 19 nt, Homo sapiens
gagcacacugcccacaaug

SEQ ID NO: 1226759 - RNA, 19 nt, Homo sapiens
gcacagggcugguuugguu

SEQ ID NO: 1226760 - RNA, 19 nt, Homo sapiens
gaagacaccuccagaccuu

SEQ ID NO: 1226761 - RNA, 19 nt, Homo sapiens
gaaaggaccuccgaugcuu

SEQ ID NO: 1226762 - RNA, 19 nt, Homo sapiens
ggaaaugagugucugaaca

SEQ ID NO: 1226763 - RNA, 19 nt, Homo sapiens
gaaaugagugucugaacaa

SEQ ID NO: 1226764 - RNA, 19 nt, Homo sapiens
gggacaagcugaggcagua

SEQ ID NO: 1226765 - RNA, 19 nt, Homo sapiens
ggacaaggccauccugcaa

SEQ ID NO: 1226766 - RNA, 19 nt, Homo sapiens
ccaagcugcugcucaagaa

SEQ ID NO: 1226767 - RNA, 19 nt, Homo sapiens
gcuccucgcugcucccauu

SEQ ID NO: 1226768 - RNA, 19 nt, Homo sapiens
caacgccucuggugcuguu

SEQ ID NO: 1226769 - RNA, 19 nt, Homo sapiens
ucacggcucuguccacuag

SEQ ID NO: 1226770 - RNA, 19 nt, Homo sapiens
ucacccagaucgaaaugaa

SEQ ID NO: 1226771 - RNA, 19 nt, Homo sapiens
gggccaagcugcugcucaa

SEQ ID NO: 1226772 - RNA, 19 nt, Homo sapiens
acacccaccuccaguuuga

SEQ ID NO: 1226773 - RNA, 19 nt, Homo sapiens
gggcuuucuugcugaauug

SEQ ID NO: 1226774 - RNA, 19 nt, Homo sapiens
guauugaguucacccagau

SEQ ID NO: 1226775 - RNA, 19 nt, Homo sapiens
ggaaagccacaaggacaaa

SEQ ID NO: 1226776 - RNA, 19 nt, Homo sapiens
ggaguaccagcggcaaaua

SEQ ID NO: 1226777 - RNA, 19 nt, Homo sapiens
gggcugcaguuuggaaaug

SEQ ID NO: 1226778 - RNA, 19 nt, Homo sapiens
ggugcaggcuuccguuaag

SEQ ID NO: 1226779 - RNA, 19 nt, Homo sapiens
caggugauguccauugaag

SEQ ID NO: 1226780 - RNA, 19 nt, Homo sapiens
uugaagagguggagaggau

SEQ ID NO: 1226781 - RNA, 19 nt, Homo sapiens
ggaaggaacgggccaagcu

SEQ ID NO: 1226782 - RNA, 19 nt, Homo sapiens
ggccaugguucagaguauu

SEQ ID NO: 1226783 - RNA, 19 nt, Homo sapiens
cgcaaucacucaggaacaa

SEQ ID NO: 1226784 - RNA, 19 nt, Homo sapiens
agacacccaccuccaguuu

SEQ ID NO: 1226785 - RNA, 19 nt, Homo sapiens
ggacggagaaccagaucag

SEQ ID NO: 1226786 - RNA, 19 nt, Homo sapiens
uaacguggccucgucuugu

SEQ ID NO: 1226787 - RNA, 19 nt, Homo sapiens
uggaggagcugagcgcaau

SEQ ID NO: 1226788 - RNA, 19 nt, Homo sapiens
ucacucaggaggaugaaga

SEQ ID NO: 1226789 - RNA, 19 nt, Homo sapiens
gaucgaaaugaaagugaug

SEQ ID NO: 1226790 - RNA, 19 nt, Homo sapiens
cgccauggguaaccuguuc

SEQ ID NO: 1226791 - RNA, 19 nt, Homo sapiens
guaacguggccucgucuug

SEQ ID NO: 1226792 - RNA, 19 nt, Homo sapiens
gcaaucacucaggaacaaa

SEQ ID NO: 1226793 - RNA, 19 nt, Homo sapiens
gguggcagcuucguaacgu

SEQ ID NO: 1226794 - RNA, 19 nt, Homo sapiens
gccaagcugcugcucaaga

SEQ ID NO: 1226795 - RNA, 19 nt, Homo sapiens
ccugagaagaucccagaaa

SEQ ID NO: 1226796 - RNA, 19 nt, Homo sapiens
augagugucugaacaagau

SEQ ID NO: 1226797 - RNA, 19 nt, Homo sapiens
cugagaagaucccagaaaa

SEQ ID NO: 1226798 - RNA, 19 nt, Homo sapiens
ucacucaggaacaaauaga

SEQ ID NO: 1226799 - RNA, 19 nt, Homo sapiens
gaguucacccagaucgaaa

SEQ ID NO: 1226800 - RNA, 19 nt, Homo sapiens
ggugauguccauugaagag

SEQ ID NO: 1226801 - RNA, 19 nt, Homo sapiens
ggcugcaguuuggaaauga

SEQ ID NO: 1226802 - RNA, 19 nt, Homo sapiens
gggcugguuugguuaugag

SEQ ID NO: 1226803 - RNA, 19 nt, Homo sapiens
gaggccaugguucagagua

SEQ ID NO: 1226804 - RNA, 19 nt, Homo sapiens
gggcauggcgugacuucuc

SEQ ID NO: 1226805 - RNA, 19 nt, Homo sapiens
aaucacucaggaacaaaua

SEQ ID NO: 1226806 - RNA, 19 nt, Homo sapiens
ggcaguaccagaagaggau

SEQ ID NO: 1226807 - RNA, 19 nt, Homo sapiens
gaguaccagcggcaaauag

SEQ ID NO: 1226808 - RNA, 19 nt, Homo sapiens
gcaguuuggaaaugagugu

SEQ ID NO: 1226809 - RNA, 19 nt, Homo sapiens
cagaucgaaaugaaaguga

SEQ ID NO: 1226810 - RNA, 19 nt, Homo sapiens
acaaggccauccugcaacu

SEQ ID NO: 1226811 - RNA, 19 nt, Homo sapiens
cagaaaacgucccugucaa

SEQ ID NO: 1226812 - RNA, 19 nt, Homo sapiens
caaucacucaggaacaaau

SEQ ID NO: 1226813 - RNA, 19 nt, Homo sapiens
gagcgcaaucacucaggaa

SEQ ID NO: 1226814 - RNA, 19 nt, Homo sapiens
aagcuucacucaggaggau

SEQ ID NO: 1226815 - RNA, 19 nt, Homo sapiens
ugaguucacccagaucgaa

SEQ ID NO: 1226816 - RNA, 19 nt, Homo sapiens
ccacaaagaucuccaguua

SEQ ID NO: 1226817 - RNA, 19 nt, Homo sapiens
acaaagaucuccaguuaaa

SEQ ID NO: 1226818 - RNA, 19 nt, Homo sapiens
uagcagagcugaugaucua

SEQ ID NO: 1226819 - RNA, 19 nt, Homo sapiens
gaaagcaucagaagauaaa

SEQ ID NO: 1226820 - RNA, 19 nt, Homo sapiens
caguauaagugccauguua

SEQ ID NO: 1226821 - RNA, 19 nt, Homo sapiens
ggaguuaguuuauacuuuc

SEQ ID NO: 1226822 - RNA, 19 nt, Homo sapiens
gcacggugguuccauauuc

SEQ ID NO: 1226823 - RNA, 19 nt, Homo sapiens
gaaacucuccauuccauuu

SEQ ID NO: 1226824 - RNA, 19 nt, Homo sapiens
ggcacugucugcauucuua

SEQ ID NO: 1226825 - RNA, 19 nt, Homo sapiens
aaaggaagaucaucaaugg

SEQ ID NO: 1226826 - RNA, 19 nt, Homo sapiens
caagcacggugguuccaua

SEQ ID NO: 1226827 - RNA, 19 nt, Homo sapiens
uuucugagaugcuuucuaa

SEQ ID NO: 1226828 - RNA, 19 nt, Homo sapiens
gaaaaugaaucuccaaagu

SEQ ID NO: 1226829 - RNA, 19 nt, Homo sapiens
caauauccauuuccauuca

SEQ ID NO: 1226830 - RNA, 19 nt, Homo sapiens
uaaccucagucaugaagaa

SEQ ID NO: 1226831 - RNA, 19 nt, Homo sapiens
gagacugguuugaauaugu

SEQ ID NO: 1226832 - RNA, 19 nt, Homo sapiens
uaaguuaaccucagucaug

SEQ ID NO: 1226833 - RNA, 19 nt, Homo sapiens
guaggaauggacuauauaa

SEQ ID NO: 1226834 - RNA, 19 nt, Homo sapiens
gaaacccuaucuccgugaa

SEQ ID NO: 1226835 - RNA, 19 nt, Homo sapiens
caauggcucacaccuguua

SEQ ID NO: 1226836 - RNA, 19 nt, Homo sapiens
aaaguacaguuucagcaaa

SEQ ID NO: 1226837 - RNA, 19 nt, Homo sapiens
gagcugaugaucuacguuu

SEQ ID NO: 1226838 - RNA, 19 nt, Homo sapiens
caaaggaagaucaucaaug

SEQ ID NO: 1226839 - RNA, 19 nt, Homo sapiens
caucugcccaucaguauaa

SEQ ID NO: 1226840 - RNA, 19 nt, Homo sapiens
uaaugucugugugaguuua

SEQ ID NO: 1226841 - RNA, 19 nt, Homo sapiens
gacacacucuggauugaau

SEQ ID NO: 1226842 - RNA, 19 nt, Homo sapiens
ggucaucugcccaucagua

SEQ ID NO: 1226843 - RNA, 19 nt, Homo sapiens
cacucuggauugaauaaua

SEQ ID NO: 1226844 - RNA, 19 nt, Homo sapiens
caaaguacaguuucagcaa

SEQ ID NO: 1226845 - RNA, 19 nt, Homo sapiens
ggagacugguuugaauaug

SEQ ID NO: 1226846 - RNA, 19 nt, Homo sapiens
uacuguagccucauucaua

SEQ ID NO: 1226847 - RNA, 19 nt, Homo sapiens
caaaucauagccuaacaga

SEQ ID NO: 1226848 - RNA, 19 nt, Homo sapiens
guuuuggacuugucuauua

SEQ ID NO: 1226849 - RNA, 19 nt, Homo sapiens
ccucauucauauguaguua

SEQ ID NO: 1226850 - RNA, 19 nt, Homo sapiens
gcucaauaacuguuuguug

SEQ ID NO: 1226851 - RNA, 19 nt, Homo sapiens
gucagugucuucuccaaug

SEQ ID NO: 1226852 - RNA, 19 nt, Homo sapiens
gaacuagcagaaaguaucu

SEQ ID NO: 1226853 - RNA, 19 nt, Homo sapiens
gcauagcaagccuucauga

SEQ ID NO: 1226854 - RNA, 19 nt, Homo sapiens
ugaaagcaucagaagauaa

SEQ ID NO: 1226855 - RNA, 19 nt, Homo sapiens
agacugguuugaauauguu

SEQ ID NO: 1226856 - RNA, 19 nt, Homo sapiens
uagccuaacagaacacuuu

SEQ ID NO: 1226857 - RNA, 19 nt, Homo sapiens
aaucauagccuaacagaac

SEQ ID NO: 1226858 - RNA, 19 nt, Homo sapiens
uaacugugcugagccaagu

SEQ ID NO: 1226859 - RNA, 19 nt, Homo sapiens
aaugaaagcaucagaagau

SEQ ID NO: 1226860 - RNA, 19 nt, Homo sapiens
caagcaaacuaaccgaaaa

SEQ ID NO: 1226861 - RNA, 19 nt, Homo sapiens
aaaccaaccaacugauaaa

SEQ ID NO: 1226862 - RNA, 19 nt, Homo sapiens
aagcaggaguggucauuca

SEQ ID NO: 1226863 - RNA, 19 nt, Homo sapiens
cuucaugguuugcucagaa

SEQ ID NO: 1226864 - RNA, 19 nt, Homo sapiens
acuguagccucauucauau

SEQ ID NO: 1226865 - RNA, 19 nt, Homo sapiens
auaauacuguagccucauu

SEQ ID NO: 1226866 - RNA, 19 nt, Homo sapiens
acacaaaggaagaucauca

SEQ ID NO: 1226867 - RNA, 19 nt, Homo sapiens
ucuccaaaguaucuucaaa

SEQ ID NO: 1226868 - RNA, 19 nt, Homo sapiens
guagccucauucauaugua

SEQ ID NO: 1226869 - RNA, 19 nt, Homo sapiens
gugacacacucuggauuga

SEQ ID NO: 1226870 - RNA, 19 nt, Homo sapiens
aaguuaaccucagucauga

SEQ ID NO: 1226871 - RNA, 19 nt, Homo sapiens
caggaaugccuacauaaca

SEQ ID NO: 1226872 - RNA, 19 nt, Homo sapiens
gcaggaaugccuacauaac

SEQ ID NO: 1226873 - RNA, 19 nt, Homo sapiens
caacauggugaaacccuau

SEQ ID NO: 1226874 - RNA, 19 nt, Homo sapiens
ucuccaaugucaugauuca

SEQ ID NO: 1226875 - RNA, 19 nt, Homo sapiens
cugcacagcuuacgaagac

SEQ ID NO: 1226876 - RNA, 19 nt, Homo sapiens
augaaagcaucagaagaua

SEQ ID NO: 1226877 - RNA, 19 nt, Homo sapiens
aagcaaauuugucucuuac

SEQ ID NO: 1226878 - RNA, 19 nt, Homo sapiens
uaagugccauguuauucuc

SEQ ID NO: 1226879 - RNA, 19 nt, Homo sapiens
ugaacuagcagaaaguauc

SEQ ID NO: 1226880 - RNA, 19 nt, Homo sapiens
ccuaacagaacacuuugaa

SEQ ID NO: 1226881 - RNA, 19 nt, Homo sapiens
ggcuaguggugacaaaugu

SEQ ID NO: 1226882 - RNA, 19 nt, Homo sapiens
cuacuuagcagagcugaug

SEQ ID NO: 1226883 - RNA, 19 nt, Homo sapiens
uaaagcaggaguggucauu

SEQ ID NO: 1226884 - RNA, 19 nt, Homo sapiens
gggcugggaugggagaauc

SEQ ID NO: 1226885 - RNA, 19 nt, Homo sapiens
caauaacuguuuguugcau

SEQ ID NO: 1226886 - RNA, 19 nt, Homo sapiens
acacacacacacacacaaa

SEQ ID NO: 1226887 - RNA, 19 nt, Homo sapiens
uaaaaccaaccaacugaua

SEQ ID NO: 1226888 - RNA, 19 nt, Homo sapiens
ucucggcaaucucaggaaa

SEQ ID NO: 1226889 - RNA, 19 nt, Homo sapiens
uauuugaacuagcagaaag

SEQ ID NO: 1226890 - RNA, 19 nt, Homo sapiens
gaggucaaggguacaguga

SEQ ID NO: 1226891 - RNA, 19 nt, Homo sapiens
acaagcaaacuaaccgaaa

SEQ ID NO: 1226892 - RNA, 19 nt, Homo sapiens
cauagcaagccuucaugaa

SEQ ID NO: 1226893 - RNA, 19 nt, Homo sapiens
ucucuuacccgaagcauag

SEQ ID NO: 1226894 - RNA, 19 nt, Homo sapiens
ucaauauccauuuccauuc

SEQ ID NO: 1226895 - RNA, 19 nt, Homo sapiens
cacaaagaucuccaguuaa

SEQ ID NO: 1226896 - RNA, 19 nt, Homo sapiens
gcaguacuguuuuggacuu

SEQ ID NO: 1226897 - RNA, 19 nt, Homo sapiens
cuucuccaaugucaugauu

SEQ ID NO: 1226898 - RNA, 19 nt, Homo sapiens
auuaaugucugugugaguu

SEQ ID NO: 1226899 - RNA, 19 nt, Homo sapiens
cgaguuuguuggaguuagu

SEQ ID NO: 1226900 - RNA, 19 nt, Homo sapiens
ggugcucaauaacuguuug

SEQ ID NO: 1226901 - RNA, 19 nt, Homo sapiens
uugaaacucuccauuccau

SEQ ID NO: 1226902 - RNA, 19 nt, Homo sapiens
gaaugcaaaccaggugaug

SEQ ID NO: 1226903 - RNA, 19 nt, Homo sapiens
guuauucucggcaaucuca

SEQ ID NO: 1226904 - RNA, 19 nt, Homo sapiens
guuuguugcauuucaguaa

SEQ ID NO: 1226905 - RNA, 19 nt, Homo sapiens
gguggcuaguggugacaaa

SEQ ID NO: 1226906 - RNA, 19 nt, Homo sapiens
ccacaggaucccauuugga

SEQ ID NO: 1226907 - RNA, 19 nt, Homo sapiens
ugucuauuauguccuuguu

SEQ ID NO: 1226908 - RNA, 19 nt, Homo sapiens
ucucagugcuguggaaugg

SEQ ID NO: 1226909 - RNA, 19 nt, Homo sapiens
acagugagccgaggucaug

SEQ ID NO: 1226910 - RNA, 19 nt, Homo sapiens
uaacaggcugggugcaaug

SEQ ID NO: 1226911 - RNA, 19 nt, Homo sapiens
gcagaauaaccuuucaaaa

SEQ ID NO: 1226912 - RNA, 19 nt, Homo sapiens
acacacacacaaaggaaga

SEQ ID NO: 1226913 - RNA, 19 nt, Homo sapiens
acacacacacacaaaggaa

SEQ ID NO: 1226914 - RNA, 19 nt, Homo sapiens
uaaccacaggaucccauuu

SEQ ID NO: 1226915 - RNA, 19 nt, Homo sapiens
ucagugucuucuccaaugu

SEQ ID NO: 1226916 - RNA, 19 nt, Homo sapiens
gaagugaacugucuuauaa

SEQ ID NO: 1226917 - RNA, 19 nt, Homo sapiens
gacaagaagucccuuauua

SEQ ID NO: 1226918 - RNA, 19 nt, Homo sapiens
gcacauaacuggcauaaaa

SEQ ID NO: 1226919 - RNA, 19 nt, Homo sapiens
gagguucacuuacauauau

SEQ ID NO: 1226920 - RNA, 19 nt, Homo sapiens
ggaguggauucauggauua

SEQ ID NO: 1226921 - RNA, 19 nt, Homo sapiens
gaugaaagauacauggaaa

SEQ ID NO: 1226922 - RNA, 19 nt, Homo sapiens
ggaagacccugaugaagga

SEQ ID NO: 1226923 - RNA, 19 nt, Homo sapiens
ggaauaaacagauccauga

SEQ ID NO: 1226924 - RNA, 19 nt, Homo sapiens
gagaacauguacugaguuu

SEQ ID NO: 1226925 - RNA, 19 nt, Homo sapiens
guacugaguuucuuagguu

SEQ ID NO: 1226926 - RNA, 19 nt, Homo sapiens
gaagcuggguguacacuga

SEQ ID NO: 1226927 - RNA, 19 nt, Homo sapiens
gauguugaauuguguguuu

SEQ ID NO: 1226928 - RNA, 19 nt, Homo sapiens
gcaagaaacugcagaagcu

SEQ ID NO: 1226929 - RNA, 19 nt, Homo sapiens
caagauaaaugcaaacucu

SEQ ID NO: 1226930 - RNA, 19 nt, Homo sapiens
gcacacacauauugcuuau

SEQ ID NO: 1226931 - RNA, 19 nt, Homo sapiens
gcuuugaaguguuugauuu

SEQ ID NO: 1226932 - RNA, 19 nt, Homo sapiens
uggcacagcuuucagugua

SEQ ID NO: 1226933 - RNA, 19 nt, Homo sapiens
cuuauuagaugauggguuu

SEQ ID NO: 1226934 - RNA, 19 nt, Homo sapiens
caagaagucccuuauuaga

SEQ ID NO: 1226935 - RNA, 19 nt, Homo sapiens
gaagacaagaagucccuua

SEQ ID NO: 1226936 - RNA, 19 nt, Homo sapiens
gaacauguacugaguuucu

SEQ ID NO: 1226937 - RNA, 19 nt, Homo sapiens
ugagggagaucuagagaga

SEQ ID NO: 1226938 - RNA, 19 nt, Homo sapiens
cauugaaacuacuggauuu

SEQ ID NO: 1226939 - RNA, 19 nt, Homo sapiens
gaacagccuucucaaacag

SEQ ID NO: 1226940 - RNA, 19 nt, Homo sapiens
cuagagagaugaaagauac

SEQ ID NO: 1226941 - RNA, 19 nt, Homo sapiens
agaagucccuuauuagaug

SEQ ID NO: 1226942 - RNA, 19 nt, Homo sapiens
gaagcugacggacaccuua

SEQ ID NO: 1226943 - RNA, 19 nt, Homo sapiens
gcucaaguauucaaagauc

SEQ ID NO: 1226944 - RNA, 19 nt, Homo sapiens
caaauauucugcaugucaa

SEQ ID NO: 1226945 - RNA, 19 nt, Homo sapiens
gcauuuaguccucugcaua

SEQ ID NO: 1226946 - RNA, 19 nt, Homo sapiens
gaugauggguuuggcaaga

SEQ ID NO: 1226947 - RNA, 19 nt, Homo sapiens
gaaauauugcuuugaagug

SEQ ID NO: 1226948 - RNA, 19 nt, Homo sapiens
aaugacagaugacaugauu

SEQ ID NO: 1226949 - RNA, 19 nt, Homo sapiens
gaggcuaguugggauagua

SEQ ID NO: 1226950 - RNA, 19 nt, Homo sapiens
gaagucccuuauuagauga

SEQ ID NO: 1226951 - RNA, 19 nt, Homo sapiens
caaagagccagauggaauu

SEQ ID NO: 1226952 - RNA, 19 nt, Homo sapiens
cagaugacaugauuaugga

SEQ ID NO: 1226953 - RNA, 19 nt, Homo sapiens
gcacuguuacuaauaaaug

SEQ ID NO: 1226954 - RNA, 19 nt, Homo sapiens
ccaaagagccagauggaau

SEQ ID NO: 1226955 - RNA, 19 nt, Homo sapiens
ugaagugaacugucuuaua

SEQ ID NO: 1226956 - RNA, 19 nt, Homo sapiens
gcaguggagaggcguguua

SEQ ID NO: 1226957 - RNA, 19 nt, Homo sapiens
gggagaacauguacugagu

SEQ ID NO: 1226958 - RNA, 19 nt, Homo sapiens
gauaaugauggcuguguaa

SEQ ID NO: 1226959 - RNA, 19 nt, Homo sapiens
guucuauccucaucuaaau

SEQ ID NO: 1226960 - RNA, 19 nt, Homo sapiens
cauaauuacuguagauugg

SEQ ID NO: 1226961 - RNA, 19 nt, Homo sapiens
gaauaaacagauccaugaa

SEQ ID NO: 1226962 - RNA, 19 nt, Homo sapiens
uuucauggcuaaugcauug

SEQ ID NO: 1226963 - RNA, 19 nt, Homo sapiens
aaugauggcuguguaaaug

SEQ ID NO: 1226964 - RNA, 19 nt, Homo sapiens
gacagaguauuccgagguu

SEQ ID NO: 1226965 - RNA, 19 nt, Homo sapiens
gaaagauacauggaaauca

SEQ ID NO: 1226966 - RNA, 19 nt, Homo sapiens
gaacugucuuauaaagcuu

SEQ ID NO: 1226967 - RNA, 19 nt, Homo sapiens
ugacagaugacaugauuau

SEQ ID NO: 1226968 - RNA, 19 nt, Homo sapiens
cguaaugcauuucgaaaca

SEQ ID NO: 1226969 - RNA, 19 nt, Homo sapiens
aagaugagguucacuuaca

SEQ ID NO: 1226970 - RNA, 19 nt, Homo sapiens
ggugacggauucauuucaa

SEQ ID NO: 1226971 - RNA, 19 nt, Homo sapiens
ugauggcuguguaaaugua

SEQ ID NO: 1226972 - RNA, 19 nt, Homo sapiens
cauccugacuccacguauu

SEQ ID NO: 1226973 - RNA, 19 nt, Homo sapiens
gcaagacaguuaacuuuuc

SEQ ID NO: 1226974 - RNA, 19 nt, Homo sapiens
gaugagguucacuuacaua

SEQ ID NO: 1226975 - RNA, 19 nt, Homo sapiens
ugaacuggcugugagagaa

SEQ ID NO: 1226976 - RNA, 19 nt, Homo sapiens
ugaagaaaauggaucauga

SEQ ID NO: 1226977 - RNA, 19 nt, Homo sapiens
gagcagagggagaacaugu

SEQ ID NO: 1226978 - RNA, 19 nt, Homo sapiens
uagacuaucugucgaagca

SEQ ID NO: 1226979 - RNA, 19 nt, Homo sapiens
guauuggaguggauucaug

SEQ ID NO: 1226980 - RNA, 19 nt, Homo sapiens
gaggcaaggucugguuguu

SEQ ID NO: 1226981 - RNA, 19 nt, Homo sapiens
agagccagauggaauuuga

SEQ ID NO: 1226982 - RNA, 19 nt, Homo sapiens
gcugugaccuccugaagac

SEQ ID NO: 1226983 - RNA, 19 nt, Homo sapiens
uggaguggauucauggauu

SEQ ID NO: 1226984 - RNA, 19 nt, Homo sapiens
gauuauggacagaguauuc

SEQ ID NO: 1226985 - RNA, 19 nt, Homo sapiens
gcacagcuuucaguguauc

SEQ ID NO: 1226986 - RNA, 19 nt, Homo sapiens
cuacuggauuuccuuugaa

SEQ ID NO: 1226987 - RNA, 19 nt, Homo sapiens
agacaugaaccgcaagaaa

SEQ ID NO: 1226988 - RNA, 19 nt, Homo sapiens
gaucguaaugcauuucgaa

SEQ ID NO: 1226989 - RNA, 19 nt, Homo sapiens
ggaaugacagaugacauga

SEQ ID NO: 1226990 - RNA, 19 nt, Homo sapiens
aguauucuauugagcauug

SEQ ID NO: 1226991 - RNA, 19 nt, Homo sapiens
acaaauauucugcauguca

SEQ ID NO: 1226992 - RNA, 19 nt, Homo sapiens
uggcaagacaguuaacuuu

SEQ ID NO: 1226993 - RNA, 19 nt, Homo sapiens
ggguuuggcaagacaguua

SEQ ID NO: 1226994 - RNA, 19 nt, Homo sapiens
aaaggaggcacacacauau

SEQ ID NO: 1226995 - RNA, 19 nt, Homo sapiens
ugaggaagacccugaugaa

SEQ ID NO: 1226996 - RNA, 19 nt, Homo sapiens
guggauucauggauuauca

SEQ ID NO: 1226997 - RNA, 19 nt, Homo sapiens
uugaggcuuuggcuaaaua

SEQ ID NO: 1226998 - RNA, 19 nt, Homo sapiens
cauuauuguuugaggcuuu

SEQ ID NO: 1226999 - RNA, 19 nt, Homo sapiens
caaagauccaaaugaauuc

SEQ ID NO: 1227000 - RNA, 19 nt, Homo sapiens
ugaacugucuuauaaagcu

SEQ ID NO: 1227001 - RNA, 19 nt, Homo sapiens
agauaaugauggcugugua

SEQ ID NO: 1227002 - RNA, 19 nt, Homo sapiens
guugggauaguaaaucuuu

SEQ ID NO: 1227003 - RNA, 19 nt, Homo sapiens
aagcucaaguauucaaaga

SEQ ID NO: 1227004 - RNA, 19 nt, Homo sapiens
caccguaucuguucuaucc

SEQ ID NO: 1227005 - RNA, 19 nt, Homo sapiens
gcugcuuucugccuucuug

SEQ ID NO: 1227006 - RNA, 19 nt, Homo sapiens
ggagaacauguacugaguu

SEQ ID NO: 1227007 - RNA, 19 nt, Homo sapiens
gaagaugagguucacuuac

SEQ ID NO: 1227008 - RNA, 19 nt, Homo sapiens
caaacagccaucugaggaa

SEQ ID NO: 1227009 - RNA, 19 nt, Homo sapiens
acuacuggauuuccuuuga

SEQ ID NO: 1227010 - RNA, 19 nt, Homo sapiens
ggcacacacauauugcuua

SEQ ID NO: 1227011 - RNA, 19 nt, Homo sapiens
auucauggauuaucacugu

SEQ ID NO: 1227012 - RNA, 19 nt, Homo sapiens
guccauaauuacuguagau

SEQ ID NO: 1227013 - RNA, 19 nt, Homo sapiens
gacggacaccuuaaccaaa

SEQ ID NO: 1227014 - RNA, 19 nt, Homo sapiens
acaagaagucccuuauuag

SEQ ID NO: 1227015 - RNA, 19 nt, Homo sapiens
ucuauauugucucaaguga

SEQ ID NO: 1227016 - RNA, 19 nt, Homo sapiens
gaacuugacugccuuguaa

SEQ ID NO: 1227017 - RNA, 19 nt, Homo sapiens
guaaagggcuugcuguaua

SEQ ID NO: 1227018 - RNA, 19 nt, Homo sapiens
gaucaaagaugccaagaaa

SEQ ID NO: 1227019 - RNA, 19 nt, Homo sapiens
ggugagaccugauaacuaa

SEQ ID NO: 1227020 - RNA, 19 nt, Homo sapiens
gguccaaacuccauuuaua

SEQ ID NO: 1227021 - RNA, 19 nt, Homo sapiens
ggcaagagcuacuuuaguu

SEQ ID NO: 1227022 - RNA, 19 nt, Homo sapiens
gcgagaaucuguuaguaaa

SEQ ID NO: 1227023 - RNA, 19 nt, Homo sapiens
gcaauacagccucugauua

SEQ ID NO: 1227024 - RNA, 19 nt, Homo sapiens
gcugaauguugccauauua

SEQ ID NO: 1227025 - RNA, 19 nt, Homo sapiens
agagggaacuugcacuuua

SEQ ID NO: 1227026 - RNA, 19 nt, Homo sapiens
gauaggcacuacaaugaaa

SEQ ID NO: 1227027 - RNA, 19 nt, Homo sapiens
gaagagaggcugaguguca

SEQ ID NO: 1227028 - RNA, 19 nt, Homo sapiens
gcuaauaaaugucauccaa

SEQ ID NO: 1227029 - RNA, 19 nt, Homo sapiens
uaaaguaucggaacuguuu

SEQ ID NO: 1227030 - RNA, 19 nt, Homo sapiens
aagaagaaguugagaguuu

SEQ ID NO: 1227031 - RNA, 19 nt, Homo sapiens
gaaauaugguuaguccaaa

SEQ ID NO: 1227032 - RNA, 19 nt, Homo sapiens
gcagaggcaauguuauuua

SEQ ID NO: 1227033 - RNA, 19 nt, Homo sapiens
uguaggaaguugugucuua

SEQ ID NO: 1227034 - RNA, 19 nt, Homo sapiens
ccucuaccaugccuuauua

SEQ ID NO: 1227035 - RNA, 19 nt, Homo sapiens
ggucauauauacauucaga

SEQ ID NO: 1227036 - RNA, 19 nt, Homo sapiens
gagaaucuguuaguaaaga

SEQ ID NO: 1227037 - RNA, 19 nt, Homo sapiens
uaaagaagaucuggcaaga

SEQ ID NO: 1227038 - RNA, 19 nt, Homo sapiens
gagaagcgagaaucuguua

SEQ ID NO: 1227039 - RNA, 19 nt, Homo sapiens
gcucuuaucucgcacuuuc

SEQ ID NO: 1227040 - RNA, 19 nt, Homo sapiens
aaauagaggugcaguuaga

SEQ ID NO: 1227041 - RNA, 19 nt, Homo sapiens
uuauugagcuuccucuuaa

SEQ ID NO: 1227042 - RNA, 19 nt, Homo sapiens
guauauagccaguguuaaa

SEQ ID NO: 1227043 - RNA, 19 nt, Homo sapiens
ucaauacccucucaaugaa

SEQ ID NO: 1227044 - RNA, 19 nt, Homo sapiens
gaggcaauguuauuuaugu

SEQ ID NO: 1227045 - RNA, 19 nt, Homo sapiens
agaagaaguugagaguuua

SEQ ID NO: 1227046 - RNA, 19 nt, Homo sapiens
gcaagagcuacuuuaguua

SEQ ID NO: 1227047 - RNA, 19 nt, Homo sapiens
ccuucaaccuuaagauuua

SEQ ID NO: 1227048 - RNA, 19 nt, Homo sapiens
cuaccaugccuuauuauua

SEQ ID NO: 1227049 - RNA, 19 nt, Homo sapiens
gaaaauaacauacccugua

SEQ ID NO: 1227050 - RNA, 19 nt, Homo sapiens
caauacagccucugauuau

SEQ ID NO: 1227051 - RNA, 19 nt, Homo sapiens
gaacaugaggguuacuuug

SEQ ID NO: 1227052 - RNA, 19 nt, Homo sapiens
uggaggagauuaugaaaga

SEQ ID NO: 1227053 - RNA, 19 nt, Homo sapiens
uaaagggcuugcuguauau

SEQ ID NO: 1227054 - RNA, 19 nt, Homo sapiens
gcaaggguuugaaaugugu

SEQ ID NO: 1227055 - RNA, 19 nt, Homo sapiens
ggaacuguuuagcuuauga

SEQ ID NO: 1227056 - RNA, 19 nt, Homo sapiens
gaaugugugcuguuaauga

SEQ ID NO: 1227057 - RNA, 19 nt, Homo sapiens
aaauugagaugugcucuaa

SEQ ID NO: 1227058 - RNA, 19 nt, Homo sapiens
gugauaguguucauuugua

SEQ ID NO: 1227059 - RNA, 19 nt, Homo sapiens
uuaggcaacuuuaucagua

SEQ ID NO: 1227060 - RNA, 19 nt, Homo sapiens
caacauugcaguacuguau

SEQ ID NO: 1227061 - RNA, 19 nt, Homo sapiens
ggagagaacuugguaacgu

SEQ ID NO: 1227062 - RNA, 19 nt, Homo sapiens
caacgacagugauaguguu

SEQ ID NO: 1227063 - RNA, 19 nt, Homo sapiens
aaaggaagauugagcaaca

SEQ ID NO: 1227064 - RNA, 19 nt, Homo sapiens
ggaauggugagaccugaua

SEQ ID NO: 1227065 - RNA, 19 nt, Homo sapiens
agaaauagaggugcaguua

SEQ ID NO: 1227066 - RNA, 19 nt, Homo sapiens
aaucgacucugaauauuug

SEQ ID NO: 1227067 - RNA, 19 nt, Homo sapiens
uaucggaacuguuuagcuu

SEQ ID NO: 1227068 - RNA, 19 nt, Homo sapiens
gucaauacccucucaauga

SEQ ID NO: 1227069 - RNA, 19 nt, Homo sapiens
gagggaacuugcacuuuau

SEQ ID NO: 1227070 - RNA, 19 nt, Homo sapiens
caacaaaacccacuccaua

SEQ ID NO: 1227071 - RNA, 19 nt, Homo sapiens
ggaauuagucaauacaugu

SEQ ID NO: 1227072 - RNA, 19 nt, Homo sapiens
gcucaaacacaaaucuuaa

SEQ ID NO: 1227073 - RNA, 19 nt, Homo sapiens
cagaggcaauguuauuuau

SEQ ID NO: 1227074 - RNA, 19 nt, Homo sapiens
gaaauggcaaucaaagaug

SEQ ID NO: 1227075 - RNA, 19 nt, Homo sapiens
caaugaaacuuuuggcaua

SEQ ID NO: 1227076 - RNA, 19 nt, Homo sapiens
caaaugccauaauuaacug

SEQ ID NO: 1227077 - RNA, 19 nt, Homo sapiens
uaaaggagagaacuuggua

SEQ ID NO: 1227078 - RNA, 19 nt, Homo sapiens
gaagaucuggcaagagcua

SEQ ID NO: 1227079 - RNA, 19 nt, Homo sapiens
gaagaaguugagaguuuaa

SEQ ID NO: 1227080 - RNA, 19 nt, Homo sapiens
ggaauaugauuugaguuca

SEQ ID NO: 1227081 - RNA, 19 nt, Homo sapiens
gcaagaagaaguugagagu

SEQ ID NO: 1227082 - RNA, 19 nt, Homo sapiens
gcacaaacuggaugaacuu

SEQ ID NO: 1227083 - RNA, 19 nt, Homo sapiens
guacauagggauaguggaa

SEQ ID NO: 1227084 - RNA, 19 nt, Homo sapiens
ugaguucacugugcucuuu

SEQ ID NO: 1227085 - RNA, 19 nt, Homo sapiens
aagauuggaggcuuaauua

SEQ ID NO: 1227086 - RNA, 19 nt, Homo sapiens
ggagggaaaggaagauuga

SEQ ID NO: 1227087 - RNA, 19 nt, Homo sapiens
cauaugcacuggauuacug

SEQ ID NO: 1227088 - RNA, 19 nt, Homo sapiens
gaagagggaacuugcacuu

SEQ ID NO: 1227089 - RNA, 19 nt, Homo sapiens
cagcagaggcaauguuauu

SEQ ID NO: 1227090 - RNA, 19 nt, Homo sapiens
ggaagagcaagaagaaguu

SEQ ID NO: 1227091 - RNA, 19 nt, Homo sapiens
uaaacagaguugucuuugu

SEQ ID NO: 1227092 - RNA, 19 nt, Homo sapiens
gaugugcucuaaaggacaa

SEQ ID NO: 1227093 - RNA, 19 nt, Homo sapiens
guccaaacuccauuuauaa

SEQ ID NO: 1227094 - RNA, 19 nt, Homo sapiens
cgugaaguauuucucauug

SEQ ID NO: 1227095 - RNA, 19 nt, Homo sapiens
gucaaaaggucaacuaaaa

SEQ ID NO: 1227096 - RNA, 19 nt, Homo sapiens
gaaagguagaugagucuga

SEQ ID NO: 1227097 - RNA, 19 nt, Homo sapiens
ggagcaagucuuccauuug

SEQ ID NO: 1227098 - RNA, 19 nt, Homo sapiens
aaauggcaaucaaagauga

SEQ ID NO: 1227099 - RNA, 19 nt, Homo sapiens
uuacugaaauggcaaucaa

SEQ ID NO: 1227100 - RNA, 19 nt, Homo sapiens
uugguaacgugaaguauuu

SEQ ID NO: 1227101 - RNA, 19 nt, Homo sapiens
gcugguccgugauauuuau

SEQ ID NO: 1227102 - RNA, 19 nt, Homo sapiens
ugucuaacuuggaaaggua

SEQ ID NO: 1227103 - RNA, 19 nt, Homo sapiens
gaaaugcacguuuggugau

SEQ ID NO: 1227104 - RNA, 19 nt, Homo sapiens
aagcauguaugugaucuuu

SEQ ID NO: 1227105 - RNA, 19 nt, Homo sapiens
gcaguacuguaugcucaaa

SEQ ID NO: 1227106 - RNA, 19 nt, Homo sapiens
gaggagauuaugaaagauu

SEQ ID NO: 1227107 - RNA, 19 nt, Homo sapiens
ggacaagccgagugcuauu

SEQ ID NO: 1227108 - RNA, 19 nt, Homo sapiens
uauagacucugucaguuuc

SEQ ID NO: 1227109 - RNA, 19 nt, Homo sapiens
ccucuuauuuccucuaugu

SEQ ID NO: 1227110 - RNA, 19 nt, Homo sapiens
gguagaugagucugaauuu

SEQ ID NO: 1227111 - RNA, 19 nt, Homo sapiens
aaagguagaugagucugaa

SEQ ID NO: 1227112 - RNA, 19 nt, Homo sapiens
cgacucugaauauuuguua

SEQ ID NO: 1227113 - RNA, 19 nt, Homo sapiens
caaaggugauagcacacaa

SEQ ID NO: 1227114 - RNA, 19 nt, Homo sapiens
caaagacaacuauaaacga

SEQ ID NO: 1227115 - RNA, 19 nt, Homo sapiens
gaaccugagcgaugccaaa

SEQ ID NO: 1227116 - RNA, 19 nt, Homo sapiens
ccacuucaccuuuguauua

SEQ ID NO: 1227117 - RNA, 19 nt, Homo sapiens
gcacgacaauuaugguaaa

SEQ ID NO: 1227118 - RNA, 19 nt, Homo sapiens
ugagaacacuuaaacguuu

SEQ ID NO: 1227119 - RNA, 19 nt, Homo sapiens
uaucagagguggagacauu

SEQ ID NO: 1227120 - RNA, 19 nt, Homo sapiens
caaacuagcagaacaauau

SEQ ID NO: 1227121 - RNA, 19 nt, Homo sapiens
gauggccgcuguacacuuu

SEQ ID NO: 1227122 - RNA, 19 nt, Homo sapiens
ggacaaggccaacaagcua

SEQ ID NO: 1227123 - RNA, 19 nt, Homo sapiens
gaauauagucguuaucaga

SEQ ID NO: 1227124 - RNA, 19 nt, Homo sapiens
gcacagaauaugaaucgua

SEQ ID NO: 1227125 - RNA, 19 nt, Homo sapiens
ggugagaaauuagaacaaa

SEQ ID NO: 1227126 - RNA, 19 nt, Homo sapiens
ccgacaaguuggcauaaua

SEQ ID NO: 1227127 - RNA, 19 nt, Homo sapiens
guggagacauuuagaaguu

SEQ ID NO: 1227128 - RNA, 19 nt, Homo sapiens
cacagaauaugaaucguaa

SEQ ID NO: 1227129 - RNA, 19 nt, Homo sapiens
guauauguguguaugugua

SEQ ID NO: 1227130 - RNA, 19 nt, Homo sapiens
gcugugcccuacugugaua

SEQ ID NO: 1227131 - RNA, 19 nt, Homo sapiens
caugaagcuuugucacaua

SEQ ID NO: 1227132 - RNA, 19 nt, Homo sapiens
uaaguuaggauggacauua

SEQ ID NO: 1227133 - RNA, 19 nt, Homo sapiens
gcccuacugugauagauuu

SEQ ID NO: 1227134 - RNA, 19 nt, Homo sapiens
gagcaaauccucaauacca

SEQ ID NO: 1227135 - RNA, 19 nt, Homo sapiens
ggucuaaagaagaucauua

SEQ ID NO: 1227136 - RNA, 19 nt, Homo sapiens
gacacguggugagaaauua

SEQ ID NO: 1227137 - RNA, 19 nt, Homo sapiens
gagaguguguguauaugug

SEQ ID NO: 1227138 - RNA, 19 nt, Homo sapiens
agucagcgcucaccucauu

SEQ ID NO: 1227139 - RNA, 19 nt, Homo sapiens
gaaggaccagcccacauuu

SEQ ID NO: 1227140 - RNA, 19 nt, Homo sapiens
gaaguuguucuuaaucaga

SEQ ID NO: 1227141 - RNA, 19 nt, Homo sapiens
ccacaagcauaucuuucuu

SEQ ID NO: 1227142 - RNA, 19 nt, Homo sapiens
cauuucagcuccaacuuug

SEQ ID NO: 1227143 - RNA, 19 nt, Homo sapiens
agaccacccuggccaauau

SEQ ID NO: 1227144 - RNA, 19 nt, Homo sapiens
acagacacguggugagaaa

SEQ ID NO: 1227145 - RNA, 19 nt, Homo sapiens
ggucugcgguccuguaucu

SEQ ID NO: 1227146 - RNA, 19 nt, Homo sapiens
gaaggucugcgguccugua

SEQ ID NO: 1227147 - RNA, 19 nt, Homo sapiens
caacugguuugaugucaca

SEQ ID NO: 1227148 - RNA, 19 nt, Homo sapiens
gcaguagaaucacuugaac

SEQ ID NO: 1227149 - RNA, 19 nt, Homo sapiens
gagcagcaguuuagcaaaa

SEQ ID NO: 1227150 - RNA, 19 nt, Homo sapiens
aaacagcugugcccuacug

SEQ ID NO: 1227151 - RNA, 19 nt, Homo sapiens
gagaacacuuaaacguuuc

SEQ ID NO: 1227152 - RNA, 19 nt, Homo sapiens
gaagcuuugucacauaucu

SEQ ID NO: 1227153 - RNA, 19 nt, Homo sapiens
caagcuaugugucaugaag

SEQ ID NO: 1227154 - RNA, 19 nt, Homo sapiens
gcagugagcacagaucaug

SEQ ID NO: 1227155 - RNA, 19 nt, Homo sapiens
caacuuugcauccugagaa

SEQ ID NO: 1227156 - RNA, 19 nt, Homo sapiens
ggagacauuuagaaguugu

SEQ ID NO: 1227157 - RNA, 19 nt, Homo sapiens
gcagaacaauaugaaucuu

SEQ ID NO: 1227158 - RNA, 19 nt, Homo sapiens
gcaaauccucaauaccaaa

SEQ ID NO: 1227159 - RNA, 19 nt, Homo sapiens
ggaggaguaugagcaaauc

SEQ ID NO: 1227160 - RNA, 19 nt, Homo sapiens
gaaaccccaucucuacuaa

SEQ ID NO: 1227161 - RNA, 19 nt, Homo sapiens
gaggagccacuucaccuuu

SEQ ID NO: 1227162 - RNA, 19 nt, Homo sapiens
guaagaagugcgugugaga

SEQ ID NO: 1227163 - RNA, 19 nt, Homo sapiens
gaaauucacacaugaucag

SEQ ID NO: 1227164 - RNA, 19 nt, Homo sapiens
ugaauuuggugcacgacaa

SEQ ID NO: 1227165 - RNA, 19 nt, Homo sapiens
ucaguggcauucaacaaau

SEQ ID NO: 1227166 - RNA, 19 nt, Homo sapiens
ucacauaucuggguaucag

SEQ ID NO: 1227167 - RNA, 19 nt, Homo sapiens
uaugugagcgccucuuaaa

SEQ ID NO: 1227168 - RNA, 19 nt, Homo sapiens
cgacaaguuggcauaauau

SEQ ID NO: 1227169 - RNA, 19 nt, Homo sapiens
ucaccucauucacacaauu

SEQ ID NO: 1227170 - RNA, 19 nt, Homo sapiens
caacuugaaagaccguaaa

SEQ ID NO: 1227171 - RNA, 19 nt, Homo sapiens
gagaccacccuggccaaua

SEQ ID NO: 1227172 - RNA, 19 nt, Homo sapiens
gccugggcauguuagguua

SEQ ID NO: 1227173 - RNA, 19 nt, Homo sapiens
ucacacaugaucagauuau

SEQ ID NO: 1227174 - RNA, 19 nt, Homo sapiens
agaaggaccagcccacauu

SEQ ID NO: 1227175 - RNA, 19 nt, Homo sapiens
gcagguccauuuuauacaa

SEQ ID NO: 1227176 - RNA, 19 nt, Homo sapiens
agagcucccuggacacuga

SEQ ID NO: 1227177 - RNA, 19 nt, Homo sapiens
gaagugcgugugagagugu

SEQ ID NO: 1227178 - RNA, 19 nt, Homo sapiens
caacaagcuaugugucaug

SEQ ID NO: 1227179 - RNA, 19 nt, Homo sapiens
ucagagguggagacauuua

SEQ ID NO: 1227180 - RNA, 19 nt, Homo sapiens
ggcaguagaaucacuugaa

SEQ ID NO: 1227181 - RNA, 19 nt, Homo sapiens
ggagccacuucaccuuugu

SEQ ID NO: 1227182 - RNA, 19 nt, Homo sapiens
ucacacaauuaucauagag

SEQ ID NO: 1227183 - RNA, 19 nt, Homo sapiens
gacgggccauugacacaug

SEQ ID NO: 1227184 - RNA, 19 nt, Homo sapiens
aaacauuugcuuggucuaa

SEQ ID NO: 1227185 - RNA, 19 nt, Homo sapiens
cagcugugcccuacuguga

SEQ ID NO: 1227186 - RNA, 19 nt, Homo sapiens
auucacacaugaucagauu

SEQ ID NO: 1227187 - RNA, 19 nt, Homo sapiens
ucaugaagcuuugucacau

SEQ ID NO: 1227188 - RNA, 19 nt, Homo sapiens
ccaaacuagcagaacaaua

SEQ ID NO: 1227189 - RNA, 19 nt, Homo sapiens
ccuggacacugaaccucua

SEQ ID NO: 1227190 - RNA, 19 nt, Homo sapiens
gagguggagacauuuagaa

SEQ ID NO: 1227191 - RNA, 19 nt, Homo sapiens
ggacacugaaccucuaaag

SEQ ID NO: 1227192 - RNA, 19 nt, Homo sapiens
caccucauucacacaauua

SEQ ID NO: 1227193 - RNA, 19 nt, Homo sapiens
ggaggagccacuucaccuu

SEQ ID NO: 1227194 - RNA, 19 nt, Homo sapiens
gggcauguuagguuaauuc

SEQ ID NO: 1227195 - RNA, 19 nt, Homo sapiens
gaauuuggugcacgacaau

SEQ ID NO: 1227196 - RNA, 19 nt, Homo sapiens
gcagcaguuuagcaaaaua

SEQ ID NO: 1227197 - RNA, 19 nt, Homo sapiens
guuaauucuuugacuccaa

SEQ ID NO: 1227198 - RNA, 19 nt, Homo sapiens
uagcagaacaauaugaauc

SEQ ID NO: 1227199 - RNA, 19 nt, Homo sapiens
aauccucaauaccaaacua

SEQ ID NO: 1227200 - RNA, 19 nt, Homo sapiens
ccuguaaucccagcacuuu

SEQ ID NO: 1227201 - RNA, 19 nt, Homo sapiens
cuucaccuuuguauuaguu

SEQ ID NO: 1227202 - RNA, 19 nt, Homo sapiens
gggaggaguaugagcaaau

SEQ ID NO: 1227203 - RNA, 19 nt, Homo sapiens
cagaauaugaaucguaagu

SEQ ID NO: 1227204 - RNA, 19 nt, Homo sapiens
aacaagcuaugugucauga

SEQ ID NO: 1227205 - RNA, 19 nt, Homo sapiens
ccaacaagcuaugugucau

SEQ ID NO: 1227206 - RNA, 19 nt, Homo sapiens
gccaacaagcuauguguca

SEQ ID NO: 1227207 - RNA, 19 nt, Homo sapiens
auaccaaacuagcagaaca

SEQ ID NO: 1227208 - RNA, 19 nt, Homo sapiens
cugaaccucuaaagggaaa

SEQ ID NO: 1227209 - RNA, 19 nt, Homo sapiens
gugagaguguguguauaug

SEQ ID NO: 1227210 - RNA, 19 nt, Homo sapiens
aauaugugagcgccucuua

SEQ ID NO: 1227211 - RNA, 19 nt, Homo sapiens
cagauuaugcgacgguaug

SEQ ID NO: 1227212 - RNA, 19 nt, Homo sapiens
agacacguggugagaaauu

SEQ ID NO: 1227213 - RNA, 19 nt, Homo sapiens
aaucguaaguuaggaugga

SEQ ID NO: 1227214 - RNA, 19 nt, Homo sapiens
ugugagaguguguguauau

SEQ ID NO: 1227215 - RNA, 19 nt, Homo sapiens
cacaagcauaucuuucuuu

SEQ ID NO: 1227216 - RNA, 19 nt, Homo sapiens
gauaagagauuucagaaga

SEQ ID NO: 1227217 - RNA, 19 nt, Homo sapiens
gagaagagauuacaagaga

SEQ ID NO: 1227218 - RNA, 19 nt, Homo sapiens
gcuauggucuuuagaauug

SEQ ID NO: 1227219 - RNA, 19 nt, Homo sapiens
gaagagaaguaucguuugu

SEQ ID NO: 1227220 - RNA, 19 nt, Homo sapiens
ggagagaacaagcauauuu

SEQ ID NO: 1227221 - RNA, 19 nt, Homo sapiens
gaacacuuaucaagccuaa

SEQ ID NO: 1227222 - RNA, 19 nt, Homo sapiens
uaacucuccuucucaaaua

SEQ ID NO: 1227223 - RNA, 19 nt, Homo sapiens
ucaaguaucugucugagaa

SEQ ID NO: 1227224 - RNA, 19 nt, Homo sapiens
gaaaauggcuaaagagcua

SEQ ID NO: 1227225 - RNA, 19 nt, Homo sapiens
ugauguaccuauucucuua

SEQ ID NO: 1227226 - RNA, 19 nt, Homo sapiens
caagaugacuucugauauc

SEQ ID NO: 1227227 - RNA, 19 nt, Homo sapiens
uaaaucaaguccucagaaa

SEQ ID NO: 1227228 - RNA, 19 nt, Homo sapiens
gaaagcaacagucaaguau

SEQ ID NO: 1227229 - RNA, 19 nt, Homo sapiens
gaacauuagucaugacaag

SEQ ID NO: 1227230 - RNA, 19 nt, Homo sapiens
gaagcaccuuugaacauuu

SEQ ID NO: 1227231 - RNA, 19 nt, Homo sapiens
gaacuggcguauacaagau

SEQ ID NO: 1227232 - RNA, 19 nt, Homo sapiens
gaaaggaaguuggaaggau

SEQ ID NO: 1227233 - RNA, 19 nt, Homo sapiens
agaaaugggucuuagauuc

SEQ ID NO: 1227234 - RNA, 19 nt, Homo sapiens
caguugacauuaccaauuu

SEQ ID NO: 1227235 - RNA, 19 nt, Homo sapiens
uauacaagaugacuucuga

SEQ ID NO: 1227236 - RNA, 19 nt, Homo sapiens
gcugcuggguucucucuua

SEQ ID NO: 1227237 - RNA, 19 nt, Homo sapiens
ugacaagcaugccaucuga

SEQ ID NO: 1227238 - RNA, 19 nt, Homo sapiens
gaagaaagcaacagucaag

SEQ ID NO: 1227239 - RNA, 19 nt, Homo sapiens
gaagaagcccuaagguguu

SEQ ID NO: 1227240 - RNA, 19 nt, Homo sapiens
uacaagagaugaaggagaa

SEQ ID NO: 1227241 - RNA, 19 nt, Homo sapiens
ugauuuaacuccuuuggaa

SEQ ID NO: 1227242 - RNA, 19 nt, Homo sapiens
ucacucaccucgauaaauc

SEQ ID NO: 1227243 - RNA, 19 nt, Homo sapiens
ggauacaguggaaguguua

SEQ ID NO: 1227244 - RNA, 19 nt, Homo sapiens
auacuuugcugguggcuua

SEQ ID NO: 1227245 - RNA, 19 nt, Homo sapiens
agaaggaacuggcguauac

SEQ ID NO: 1227246 - RNA, 19 nt, Homo sapiens
guaugcagcccaaagauuu

SEQ ID NO: 1227247 - RNA, 19 nt, Homo sapiens
gcuggguucucucuuauga

SEQ ID NO: 1227248 - RNA, 19 nt, Homo sapiens
ugaagcaccuuugaacauu

SEQ ID NO: 1227249 - RNA, 19 nt, Homo sapiens
gaagagauuacaagagaug

SEQ ID NO: 1227250 - RNA, 19 nt, Homo sapiens
gaaagaagaaagcaacagu

SEQ ID NO: 1227251 - RNA, 19 nt, Homo sapiens
acaagaacauuagucauga

SEQ ID NO: 1227252 - RNA, 19 nt, Homo sapiens
ugacucaugugacggcuuu

SEQ ID NO: 1227253 - RNA, 19 nt, Homo sapiens
ggaacuggcguauacaaga

SEQ ID NO: 1227254 - RNA, 19 nt, Homo sapiens
agaauugggucacuggauu

SEQ ID NO: 1227255 - RNA, 19 nt, Homo sapiens
gagagaacaagcauauuug

SEQ ID NO: 1227256 - RNA, 19 nt, Homo sapiens
cgaacugucucaccacuuc

SEQ ID NO: 1227257 - RNA, 19 nt, Homo sapiens
gaugaugauuuaacuccuu

SEQ ID NO: 1227258 - RNA, 19 nt, Homo sapiens
aaucaaguccucagaaauu

SEQ ID NO: 1227259 - RNA, 19 nt, Homo sapiens
gcacacagcucgcaaaacu

SEQ ID NO: 1227260 - RNA, 19 nt, Homo sapiens
ucacuuguauugaaagcaa

SEQ ID NO: 1227261 - RNA, 19 nt, Homo sapiens
gagaaaugggucuuagauu

SEQ ID NO: 1227262 - RNA, 19 nt, Homo sapiens
gguuguggauaaauugaaa

SEQ ID NO: 1227263 - RNA, 19 nt, Homo sapiens
guguauuucuucacuugua

SEQ ID NO: 1227264 - RNA, 19 nt, Homo sapiens
auaggugacuuucugauga

SEQ ID NO: 1227265 - RNA, 19 nt, Homo sapiens
ggagacgucuacagaagag

SEQ ID NO: 1227266 - RNA, 19 nt, Homo sapiens
gagaacaagcauauuugaa

SEQ ID NO: 1227267 - RNA, 19 nt, Homo sapiens
aaggaaagguauucagaga

SEQ ID NO: 1227268 - RNA, 19 nt, Homo sapiens
caaguaacucucuguguga

SEQ ID NO: 1227269 - RNA, 19 nt, Homo sapiens
gaauugggucacuggauuu

SEQ ID NO: 1227270 - RNA, 19 nt, Homo sapiens
ccagaacaguugacauuac

SEQ ID NO: 1227271 - RNA, 19 nt, Homo sapiens
caguugagcugcagaaguc

SEQ ID NO: 1227272 - RNA, 19 nt, Homo sapiens
gaaaucaggaaaggaaguu

SEQ ID NO: 1227273 - RNA, 19 nt, Homo sapiens
acacuuaucaagccuaauu

SEQ ID NO: 1227274 - RNA, 19 nt, Homo sapiens
ugaaugugcugcugggaau

SEQ ID NO: 1227275 - RNA, 19 nt, Homo sapiens
uauauacucccacaauuga

SEQ ID NO: 1227276 - RNA, 19 nt, Homo sapiens
gaacaguugacauuaccaa

SEQ ID NO: 1227277 - RNA, 19 nt, Homo sapiens
gaaggagagaacaagcaua

SEQ ID NO: 1227278 - RNA, 19 nt, Homo sapiens
gaaucuuccuccugaaucu

SEQ ID NO: 1227279 - RNA, 19 nt, Homo sapiens
cugauaaucuuaaggaaag

SEQ ID NO: 1227280 - RNA, 19 nt, Homo sapiens
guaccuauucucuuauuug

SEQ ID NO: 1227281 - RNA, 19 nt, Homo sapiens
aaagugauguguguauuuc

SEQ ID NO: 1227282 - RNA, 19 nt, Homo sapiens
gagaaggaacuggcguaua

SEQ ID NO: 1227283 - RNA, 19 nt, Homo sapiens
aaacaaaacugugaagaga

SEQ ID NO: 1227284 - RNA, 19 nt, Homo sapiens
uggguucucucuuaugauu

SEQ ID NO: 1227285 - RNA, 19 nt, Homo sapiens
uacaagaugacuucugaua

SEQ ID NO: 1227286 - RNA, 19 nt, Homo sapiens
agaaagcaacagucaagua

SEQ ID NO: 1227287 - RNA, 19 nt, Homo sapiens
ucguuugucuccuaccuua

SEQ ID NO: 1227288 - RNA, 19 nt, Homo sapiens
gauacuuuguguucagaug

SEQ ID NO: 1227289 - RNA, 19 nt, Homo sapiens
auucagcagucucaugaua

SEQ ID NO: 1227290 - RNA, 19 nt, Homo sapiens
guaacucuccuucucaaau

SEQ ID NO: 1227291 - RNA, 19 nt, Homo sapiens
aggacaugaugaugauuua

SEQ ID NO: 1227292 - RNA, 19 nt, Homo sapiens
gaacauuucacgugauacu

SEQ ID NO: 1227293 - RNA, 19 nt, Homo sapiens
aaacuuacccggaggauac

SEQ ID NO: 1227294 - RNA, 19 nt, Homo sapiens
caucaagcccugcucaguu

SEQ ID NO: 1227295 - RNA, 19 nt, Homo sapiens
aaucucagcugccaucaag

SEQ ID NO: 1227296 - RNA, 19 nt, Homo sapiens
caggagacguuugaagaga

SEQ ID NO: 1227297 - RNA, 19 nt, Homo sapiens
caaagaaauauugcaggua

SEQ ID NO: 1227298 - RNA, 19 nt, Homo sapiens
ucagcagucucaugauaau

SEQ ID NO: 1227299 - RNA, 19 nt, Homo sapiens
gugacuuucugaugacuga

SEQ ID NO: 1227300 - RNA, 19 nt, Homo sapiens
gccaagcucugugaacuag

SEQ ID NO: 1227301 - RNA, 19 nt, Homo sapiens
ccacuucgcacccugaaug

SEQ ID NO: 1227302 - RNA, 19 nt, Homo sapiens
ccaacaagaacauuaguca

SEQ ID NO: 1227303 - RNA, 19 nt, Homo sapiens
uagacaggcugggaaagaa

SEQ ID NO: 1227304 - RNA, 19 nt, Homo sapiens
gcccuaagguguuguagac

SEQ ID NO: 1227305 - RNA, 19 nt, Homo sapiens
ggagacguuugaagagaag

SEQ ID NO: 1227306 - RNA, 19 nt, Homo sapiens
ggaaggauccauuaaugac

SEQ ID NO: 1227307 - RNA, 19 nt, Homo sapiens
acucauaggugacuuucug

SEQ ID NO: 1227308 - RNA, 19 nt, Homo sapiens
aagcaacagucaaguaucu

SEQ ID NO: 1227309 - RNA, 19 nt, Homo sapiens
gugcuauggucuuuagaau

SEQ ID NO: 1227310 - RNA, 19 nt, Homo sapiens
ggacaugaugaugauuuaa

SEQ ID NO: 1227311 - RNA, 19 nt, Homo sapiens
ucuccuaccuuaucuucaa

SEQ ID NO: 1227312 - RNA, 19 nt, Homo sapiens
agaagcgguuggucugaaa

SEQ ID NO: 1227313 - RNA, 19 nt, Homo sapiens
guagacaggcugggaaaga

SEQ ID NO: 1227314 - RNA, 19 nt, Homo sapiens
gagaaucuuccuccugaau

SEQ ID NO: 1227315 - RNA, 19 nt, Homo sapiens
gaaggauccauuaaugaca

SEQ ID NO: 1227316 - RNA, 19 nt, Homo sapiens
ucaggugucuucuggauuu

SEQ ID NO: 1227317 - RNA, 19 nt, Homo sapiens
gauauucucucucucucuu

SEQ ID NO: 1227318 - RNA, 19 nt, Homo sapiens
gagcagauguuucauuuug

SEQ ID NO: 1227319 - RNA, 19 nt, Homo sapiens
gguacagggugauaacuug

SEQ ID NO: 1227320 - RNA, 19 nt, Homo sapiens
ggaggaaccugcuaaaauc

SEQ ID NO: 1227321 - RNA, 19 nt, Homo sapiens
uuccacagauucuucuuua

SEQ ID NO: 1227322 - RNA, 19 nt, Homo sapiens
gaaacagucaguccucuuc

SEQ ID NO: 1227323 - RNA, 19 nt, Homo sapiens
acaaacagcccuucacuuc

SEQ ID NO: 1227324 - RNA, 19 nt, Homo sapiens
gagaaaaccaggaccuuua

SEQ ID NO: 1227325 - RNA, 19 nt, Homo sapiens
uuacaccaaucaagagaaa

SEQ ID NO: 1227326 - RNA, 19 nt, Homo sapiens
uugagcagauguuucauuu

SEQ ID NO: 1227327 - RNA, 19 nt, Homo sapiens
gcaagucugggaacaaguu

SEQ ID NO: 1227328 - RNA, 19 nt, Homo sapiens
gaauucaaccucaccacuu

SEQ ID NO: 1227329 - RNA, 19 nt, Homo sapiens
gcucugaaagcccguauga

SEQ ID NO: 1227330 - RNA, 19 nt, Homo sapiens
gcagagauuuccaguaccu

SEQ ID NO: 1227331 - RNA, 19 nt, Homo sapiens
gagcaaguccgcugcaagu

SEQ ID NO: 1227332 - RNA, 19 nt, Homo sapiens
aauucaaccucaccacuuu

SEQ ID NO: 1227333 - RNA, 19 nt, Homo sapiens
acagugugcugaacauguu

SEQ ID NO: 1227334 - RNA, 19 nt, Homo sapiens
gauggacagagaaaucuuu

SEQ ID NO: 1227335 - RNA, 19 nt, Homo sapiens
ggacagagucauggaggaa

SEQ ID NO: 1227336 - RNA, 19 nt, Homo sapiens
gugcugauauucucucucu

SEQ ID NO: 1227337 - RNA, 19 nt, Homo sapiens
aggcagagauuuccaguac

SEQ ID NO: 1227338 - RNA, 19 nt, Homo sapiens
ggaucugcuugauguguug

SEQ ID NO: 1227339 - RNA, 19 nt, Homo sapiens
acagagucauggaggaauu

SEQ ID NO: 1227340 - RNA, 19 nt, Homo sapiens
ccacuucaaagccaaggua

SEQ ID NO: 1227341 - RNA, 19 nt, Homo sapiens
aaacagcccuucacuuccu

SEQ ID NO: 1227342 - RNA, 19 nt, Homo sapiens
guggauggguuugaagaug

SEQ ID NO: 1227343 - RNA, 19 nt, Homo sapiens
cuaccaggauccuucuuuc

SEQ ID NO: 1227344 - RNA, 19 nt, Homo sapiens
uuucagagguggacagagu

SEQ ID NO: 1227345 - RNA, 19 nt, Homo sapiens
gaaagccaggccuccaaug

SEQ ID NO: 1227346 - RNA, 19 nt, Homo sapiens
gacuugagcagauguuuca

SEQ ID NO: 1227347 - RNA, 19 nt, Homo sapiens
ccacuucagcaauuuguau

SEQ ID NO: 1227348 - RNA, 19 nt, Homo sapiens
ucaccagaaucuccacugu

SEQ ID NO: 1227349 - RNA, 19 nt, Homo sapiens
ucucucuucuccucucuuu

SEQ ID NO: 1227350 - RNA, 19 nt, Homo sapiens
ggaccuuuauugggcuuga

SEQ ID NO: 1227351 - RNA, 19 nt, Homo sapiens
ugaccuccuuccacagauu

SEQ ID NO: 1227352 - RNA, 19 nt, Homo sapiens
ggccuccaaugcacuguga

SEQ ID NO: 1227353 - RNA, 19 nt, Homo sapiens
cagguugggugcugcuguu

SEQ ID NO: 1227354 - RNA, 19 nt, Homo sapiens
gauggaggaaccugcuaaa

SEQ ID NO: 1227355 - RNA, 19 nt, Homo sapiens
gcaaguccgcugcaagucu

SEQ ID NO: 1227356 - RNA, 19 nt, Homo sapiens
cacagauucuucuuuacug

SEQ ID NO: 1227357 - RNA, 19 nt, Homo sapiens
ccauuggccucagaucaga

SEQ ID NO: 1227358 - RNA, 19 nt, Homo sapiens
accagaaucuccacuguag

SEQ ID NO: 1227359 - RNA, 19 nt, Homo sapiens
ggugauggacagagaaauc

SEQ ID NO: 1227360 - RNA, 19 nt, Homo sapiens
uaacaaacagcccuucacu

SEQ ID NO: 1227361 - RNA, 19 nt, Homo sapiens
ccacagauucuucuuuacu

SEQ ID NO: 1227362 - RNA, 19 nt, Homo sapiens
ggccugcucugguggucuu

SEQ ID NO: 1227363 - RNA, 19 nt, Homo sapiens
aaucguggauggguuugaa

SEQ ID NO: 1227364 - RNA, 19 nt, Homo sapiens
gaucagaguguuuuaaauc

SEQ ID NO: 1227365 - RNA, 19 nt, Homo sapiens
caccagaaucuccacugua

SEQ ID NO: 1227366 - RNA, 19 nt, Homo sapiens
cacccacacucaccagaau

SEQ ID NO: 1227367 - RNA, 19 nt, Homo sapiens
ccuaaugcuuacucugguu

SEQ ID NO: 1227368 - RNA, 19 nt, Homo sapiens
gccaaccagguaaagauuu

SEQ ID NO: 1227369 - RNA, 19 nt, Homo sapiens
cagaaucuccacuguaguc

SEQ ID NO: 1227370 - RNA, 19 nt, Homo sapiens
guugggugcugcuguugug

SEQ ID NO: 1227371 - RNA, 19 nt, Homo sapiens
gacagugugcugaacaugu

SEQ ID NO: 1227372 - RNA, 19 nt, Homo sapiens
gcagcugcaggcauucuga

SEQ ID NO: 1227373 - RNA, 19 nt, Homo sapiens
ggccucagaucagaguguu

SEQ ID NO: 1227374 - RNA, 19 nt, Homo sapiens
cuuccucucuucucucuuc

SEQ ID NO: 1227375 - RNA, 19 nt, Homo sapiens
ggcaaucguggauggguuu

SEQ ID NO: 1227376 - RNA, 19 nt, Homo sapiens
ccaagguacagggugauaa

SEQ ID NO: 1227377 - RNA, 19 nt, Homo sapiens
gcuucuagccucccaguag

SEQ ID NO: 1227378 - RNA, 19 nt, Homo sapiens
gcugauauucucucucucu

SEQ ID NO: 1227379 - RNA, 19 nt, Homo sapiens
caaccucaccacuuucuac

SEQ ID NO: 1227380 - RNA, 19 nt, Homo sapiens
ggccacccacgucuaugua

SEQ ID NO: 1227381 - RNA, 19 nt, Homo sapiens
ugguaaggaugaagguguu

SEQ ID NO: 1227382 - RNA, 19 nt, Homo sapiens
cuucaggugucuucuggau

SEQ ID NO: 1227383 - RNA, 19 nt, Homo sapiens
ccagggaugcaugggauuu

SEQ ID NO: 1227384 - RNA, 19 nt, Homo sapiens
uggaucugcuugauguguu

SEQ ID NO: 1227385 - RNA, 19 nt, Homo sapiens
ccugagugcugauauucuc

SEQ ID NO: 1227386 - RNA, 19 nt, Homo sapiens
gagauggaggaaccugcua

SEQ ID NO: 1227387 - RNA, 19 nt, Homo sapiens
ccagcagcuuucccagaga

SEQ ID NO: 1227388 - RNA, 19 nt, Homo sapiens
gaagaugacagcacaaaac

SEQ ID NO: 1227389 - RNA, 19 nt, Homo sapiens
guacagggugauaacuugu

SEQ ID NO: 1227390 - RNA, 19 nt, Homo sapiens
guugugguccuucccagaa

SEQ ID NO: 1227391 - RNA, 19 nt, Homo sapiens
uaaaaucgauggagaugcu

SEQ ID NO: 1227392 - RNA, 19 nt, Homo sapiens
aaaccaggaccuuuauugg

SEQ ID NO: 1227393 - RNA, 19 nt, Homo sapiens
gagacuugagcagauguuu

SEQ ID NO: 1227394 - RNA, 19 nt, Homo sapiens
uuacucugguuguuacaca

SEQ ID NO: 1227395 - RNA, 19 nt, Homo sapiens
gcaugggauuuuaauuguu

SEQ ID NO: 1227396 - RNA, 19 nt, Homo sapiens
gccaagguacagggugaua

SEQ ID NO: 1227397 - RNA, 19 nt, Homo sapiens
ccacccacacucaccagaa

SEQ ID NO: 1227398 - RNA, 19 nt, Homo sapiens
ccucuccucucucucucuu

SEQ ID NO: 1227399 - RNA, 19 nt, Homo sapiens
cucgaugccuuugaaguga

SEQ ID NO: 1227400 - RNA, 19 nt, Homo sapiens
ugcaggaacuacaggcaau

SEQ ID NO: 1227401 - RNA, 19 nt, Homo sapiens
uaugaccuccuuccacaga

SEQ ID NO: 1227402 - RNA, 19 nt, Homo sapiens
uccuggaccugguuucaga

SEQ ID NO: 1227403 - RNA, 19 nt, Homo sapiens
caagguacagggugauaac

SEQ ID NO: 1227404 - RNA, 19 nt, Homo sapiens
uccuggaucugcuugaugu

SEQ ID NO: 1227405 - RNA, 19 nt, Homo sapiens
uauucucucucucucuuuc

SEQ ID NO: 1227406 - RNA, 19 nt, Homo sapiens
gaaaaccaggaccuuuauu

SEQ ID NO: 1227407 - RNA, 19 nt, Homo sapiens
cuggauuucuggugaugga

SEQ ID NO: 1227408 - RNA, 19 nt, Homo sapiens
ggugucuucuggauuucug

SEQ ID NO: 1227409 - RNA, 19 nt, Homo sapiens
ggagacuugagcagauguu

SEQ ID NO: 1227410 - RNA, 19 nt, Homo sapiens
gucacccucucuccuugaa

SEQ ID NO: 1227411 - RNA, 19 nt, Homo sapiens
ucucccacuucagcaauuu

SEQ ID NO: 1227412 - RNA, 19 nt, Homo sapiens
ucucgaugccuuugaagug

SEQ ID NO: 1227413 - RNA, 19 nt, Homo sapiens
gggccacccacgucuaugu

SEQ ID NO: 1227414 - RNA, 19 nt, Homo sapiens
gacgaugucucauggauua

SEQ ID NO: 1227415 - RNA, 19 nt, Homo sapiens
caacaucgcccacaucuuc

SEQ ID NO: 1227416 - RNA, 19 nt, Homo sapiens
gaagaacccagccuacuug

SEQ ID NO: 1227417 - RNA, 19 nt, Homo sapiens
gaugggacauugugggaaa

SEQ ID NO: 1227418 - RNA, 19 nt, Homo sapiens
ggaauacugugaguucaug

SEQ ID NO: 1227419 - RNA, 19 nt, Homo sapiens
ggaagaacccagccuacuu

SEQ ID NO: 1227420 - RNA, 19 nt, Homo sapiens
cuaaagcccuucacagcaa

SEQ ID NO: 1227421 - RNA, 19 nt, Homo sapiens
gacaagaacaugcucuaaa

SEQ ID NO: 1227422 - RNA, 19 nt, Homo sapiens
gaacccagccuacuugaag

SEQ ID NO: 1227423 - RNA, 19 nt, Homo sapiens
gcacauggacugcgagauc

SEQ ID NO: 1227424 - RNA, 19 nt, Homo sapiens
gcaagaugcccaagauugu

SEQ ID NO: 1227425 - RNA, 19 nt, Homo sapiens
gaauaggaggcuaaagaaa

SEQ ID NO: 1227426 - RNA, 19 nt, Homo sapiens
cagaauaggaggcuaaaga

SEQ ID NO: 1227427 - RNA, 19 nt, Homo sapiens
acaagaacaugcucuaaag

SEQ ID NO: 1227428 - RNA, 19 nt, Homo sapiens
cgcgugagaugguugguua

SEQ ID NO: 1227429 - RNA, 19 nt, Homo sapiens
ucuguggucuuucaaauga

SEQ ID NO: 1227430 - RNA, 19 nt, Homo sapiens
gcucucagaugggacauug

SEQ ID NO: 1227431 - RNA, 19 nt, Homo sapiens
ccugugagcccauccauaa

SEQ ID NO: 1227432 - RNA, 19 nt, Homo sapiens
gcacggcuauuuccaugag

SEQ ID NO: 1227433 - RNA, 19 nt, Homo sapiens
ugaagcacuuugccuuuga

SEQ ID NO: 1227434 - RNA, 19 nt, Homo sapiens
gcaggagaguucagagaag

SEQ ID NO: 1227435 - RNA, 19 nt, Homo sapiens
ggucucaguuccuaauauc

SEQ ID NO: 1227436 - RNA, 19 nt, Homo sapiens
gugaagcacuuugccuuug

SEQ ID NO: 1227437 - RNA, 19 nt, Homo sapiens
guacagagcaaggagaaga

SEQ ID NO: 1227438 - RNA, 19 nt, Homo sapiens
gcugcuguguccagaauga

SEQ ID NO: 1227439 - RNA, 19 nt, Homo sapiens
gcaagcgcaucgccuccaa

SEQ ID NO: 1227440 - RNA, 19 nt, Homo sapiens
ccucgugucuguggucuuu

SEQ ID NO: 1227441 - RNA, 19 nt, Homo sapiens
gcaaggagaagacaagaac

SEQ ID NO: 1227442 - RNA, 19 nt, Homo sapiens
gaagcacuuugccuuugau

SEQ ID NO: 1227443 - RNA, 19 nt, Homo sapiens
gaugucucauggauuaaau

SEQ ID NO: 1227444 - RNA, 19 nt, Homo sapiens
ggaggaggauguggucgau

SEQ ID NO: 1227445 - RNA, 19 nt, Homo sapiens
ggugaagcacuuugccuuu

SEQ ID NO: 1227446 - RNA, 19 nt, Homo sapiens
ggacgaugucucauggauu

SEQ ID NO: 1227447 - RNA, 19 nt, Homo sapiens
cggagacuuuggccacuuu

SEQ ID NO: 1227448 - RNA, 19 nt, Homo sapiens
gcaccaagggcagcuguga

SEQ ID NO: 1227449 - RNA, 19 nt, Homo sapiens
ggaacaaagguguguacga

SEQ ID NO: 1227450 - RNA, 19 nt, Homo sapiens
aaaucccucugaaggagua

SEQ ID NO: 1227451 - RNA, 19 nt, Homo sapiens
agaauaggaggcuaaagaa

SEQ ID NO: 1227452 - RNA, 19 nt, Homo sapiens
gggucucaguuccuaauau

SEQ ID NO: 1227453 - RNA, 19 nt, Homo sapiens
ugagggaccuggagaagcu

SEQ ID NO: 1227454 - RNA, 19 nt, Homo sapiens
ccuccaaggugaagcacuu

SEQ ID NO: 1227455 - RNA, 19 nt, Homo sapiens
gcucccaggugcacugcuu

SEQ ID NO: 1227456 - RNA, 19 nt, Homo sapiens
ugagcuccaugccugauga

SEQ ID NO: 1227457 - RNA, 19 nt, Homo sapiens
ccucgccagugccaucuuu

SEQ ID NO: 1227458 - RNA, 19 nt, Homo sapiens
gccuggagcugucuaucug

SEQ ID NO: 1227459 - RNA, 19 nt, Homo sapiens
ggacugcucggagacuuug

SEQ ID NO: 1227460 - RNA, 19 nt, Homo sapiens
uauaucacggucuucauuu

SEQ ID NO: 1227461 - RNA, 19 nt, Homo sapiens
ggccucugcugacaagaau

SEQ ID NO: 1227462 - RNA, 19 nt, Homo sapiens
gcuggugauuugcacguau

SEQ ID NO: 1227463 - RNA, 19 nt, Homo sapiens
ggcaggagaguucagagaa

SEQ ID NO: 1227464 - RNA, 19 nt, Homo sapiens
gcaugcugccugaggguuu

SEQ ID NO: 1227465 - RNA, 19 nt, Homo sapiens
ggaaggacgggcagaucga

SEQ ID NO: 1227466 - RNA, 19 nt, Homo sapiens
ccugcaagaugcccaagau

SEQ ID NO: 1227467 - RNA, 19 nt, Homo sapiens
caugccugaugaugucuuu

SEQ ID NO: 1227468 - RNA, 19 nt, Homo sapiens
ccacccaaccucuccauca

SEQ ID NO: 1227469 - RNA, 19 nt, Homo sapiens
gggagcguguccucugugu

SEQ ID NO: 1227470 - RNA, 19 nt, Homo sapiens
gggcaaacucagacucgaa

SEQ ID NO: 1227471 - RNA, 19 nt, Homo sapiens
caguuuauaucacggucuu

SEQ ID NO: 1227472 - RNA, 19 nt, Homo sapiens
ugucuguggucuuucaaau

SEQ ID NO: 1227473 - RNA, 19 nt, Homo sapiens
guucaugcacggcuauuuc

SEQ ID NO: 1227474 - RNA, 19 nt, Homo sapiens
uguacgagagcgugaagua

SEQ ID NO: 1227475 - RNA, 19 nt, Homo sapiens
acaauggccucugcugaca

SEQ ID NO: 1227476 - RNA, 19 nt, Homo sapiens
ugacaccggagcaucugua

SEQ ID NO: 1227477 - RNA, 19 nt, Homo sapiens
cacauggacugcgagauca

SEQ ID NO: 1227478 - RNA, 19 nt, Homo sapiens
gacaacaucgcccacaucu

SEQ ID NO: 1227479 - RNA, 19 nt, Homo sapiens
gagaagacaagaacaugcu

SEQ ID NO: 1227480 - RNA, 19 nt, Homo sapiens
gagaucaccacccgggaau

SEQ ID NO: 1227481 - RNA, 19 nt, Homo sapiens
agacaagaacaugcucuaa

SEQ ID NO: 1227482 - RNA, 19 nt, Homo sapiens
gagcaaggagaagacaaga

SEQ ID NO: 1227483 - RNA, 19 nt, Homo sapiens
uuauaucacggucuucauu

SEQ ID NO: 1227484 - RNA, 19 nt, Homo sapiens
acccugaggucccagauca

SEQ ID NO: 1227485 - RNA, 19 nt, Homo sapiens
gaucaccacccgggaauac

SEQ ID NO: 1227486 - RNA, 19 nt, Homo sapiens
aagggcagcugugagauca

SEQ ID NO: 1227487 - RNA, 19 nt, Homo sapiens
ccagcucgauugaccugau

SEQ ID NO: 1227488 - RNA, 19 nt, Homo sapiens
ugcaagaugcccaagauug

SEQ ID NO: 1227489 - RNA, 19 nt, Homo sapiens
gcccagugguuuggaguca

SEQ ID NO: 1227490 - RNA, 19 nt, Homo sapiens
ugcuguggcuguacaucua

SEQ ID NO: 1227491 - RNA, 19 nt, Homo sapiens
ccaucgugcucuuccuguu

SEQ ID NO: 1227492 - RNA, 19 nt, Homo sapiens
gggugcaaaucccucugaa

SEQ ID NO: 1227493 - RNA, 19 nt, Homo sapiens
gcuccaugccugaugaugu

SEQ ID NO: 1227494 - RNA, 19 nt, Homo sapiens
gccgauggcaggagaguuc

SEQ ID NO: 1227495 - RNA, 19 nt, Homo sapiens
cauccucaguggcaucaca

SEQ ID NO: 1227496 - RNA, 19 nt, Homo sapiens
ggucccagaucaguucuac

SEQ ID NO: 1227497 - RNA, 19 nt, Homo sapiens
ccacgccgcaagagaaugu

SEQ ID NO: 1227498 - RNA, 19 nt, Homo sapiens
caagaugcccaagauugug

SEQ ID NO: 1227499 - RNA, 19 nt, Homo sapiens
caagggcagcugugagauc

SEQ ID NO: 1227500 - RNA, 19 nt, Homo sapiens
ucaccuccuucaccagugu

SEQ ID NO: 1227501 - RNA, 19 nt, Homo sapiens
caucuucggcuuccucagu

SEQ ID NO: 1227502 - RNA, 19 nt, Homo sapiens
cgacaacaucgcccacauc

SEQ ID NO: 1227503 - RNA, 19 nt, Homo sapiens
ccagccacccuuccacaga

SEQ ID NO: 1227504 - RNA, 19 nt, Homo sapiens
gugccaucuuucucccaua

SEQ ID NO: 1227505 - RNA, 19 nt, Homo sapiens
caucgcacccgugggcuuu

SEQ ID NO: 1227506 - RNA, 19 nt, Homo sapiens
gaccuucguccaugucauc

SEQ ID NO: 1227507 - RNA, 19 nt, Homo sapiens
cccaaagcccugcaagaug

SEQ ID NO: 1227508 - RNA, 19 nt, Homo sapiens
uccauaaggcucucagaug

SEQ ID NO: 1227509 - RNA, 19 nt, Homo sapiens
cuggcugucucucuuccua

SEQ ID NO: 1227510 - RNA, 19 nt, Homo sapiens
ugaggucccagaucaguuc

SEQ ID NO: 1227511 - RNA, 19 nt, Homo sapiens
ggcccuacuucaccuacug

SEQ ID NO: 1227512 - RNA, 19 nt, Homo sapiens
gcgugaggccugugagauc

SEQ ID NO: 1227513 - RNA, 19 nt, Homo sapiens
gggaauacugugaguucau

SEQ ID NO: 1227514 - RNA, 19 nt, Homo sapiens
ccucugaacuucugucuau

SEQ ID NO: 1227515 - RNA, 19 nt, Homo sapiens
cagaaucuauagccgguua

SEQ ID NO: 1227516 - RNA, 19 nt, Homo sapiens
gcucgugacuuucuacaga

SEQ ID NO: 1227517 - RNA, 19 nt, Homo sapiens
gccgugggcuggacaauga

SEQ ID NO: 1227518 - RNA, 19 nt, Homo sapiens
ccgcuuugcuuugggauua

SEQ ID NO: 1227519 - RNA, 19 nt, Homo sapiens
cgagacacgugugcguuua

SEQ ID NO: 1227520 - RNA, 19 nt, Homo sapiens
ggaacagccuagaaaccaa

SEQ ID NO: 1227521 - RNA, 19 nt, Homo sapiens
gcaagccucugaacuucug

SEQ ID NO: 1227522 - RNA, 19 nt, Homo sapiens
aaacaaccauuuccucucu

SEQ ID NO: 1227523 - RNA, 19 nt, Homo sapiens
gaagcugagacacagguua

SEQ ID NO: 1227524 - RNA, 19 nt, Homo sapiens
ucaucgggcucgugacuuu

SEQ ID NO: 1227525 - RNA, 19 nt, Homo sapiens
agccauaucuuacacuuug

SEQ ID NO: 1227526 - RNA, 19 nt, Homo sapiens
ggaacauucuccacaagag

SEQ ID NO: 1227527 - RNA, 19 nt, Homo sapiens
caauauuccuugagugagu

SEQ ID NO: 1227528 - RNA, 19 nt, Homo sapiens
cuacagaauuggccauaca

SEQ ID NO: 1227529 - RNA, 19 nt, Homo sapiens
cagaaaaccaggaaaauuu

SEQ ID NO: 1227530 - RNA, 19 nt, Homo sapiens
gaggaugaguggugauguc

SEQ ID NO: 1227531 - RNA, 19 nt, Homo sapiens
gagugagucagaaucuaua

SEQ ID NO: 1227532 - RNA, 19 nt, Homo sapiens
cagccaugcucaucuggaa

SEQ ID NO: 1227533 - RNA, 19 nt, Homo sapiens
cacaauauuccuugaguga

SEQ ID NO: 1227534 - RNA, 19 nt, Homo sapiens
cugaacuucugucuauaaa

SEQ ID NO: 1227535 - RNA, 19 nt, Homo sapiens
gcgagacacgugugcguuu

SEQ ID NO: 1227536 - RNA, 19 nt, Homo sapiens
gcagaaaaccaggaaaauu

SEQ ID NO: 1227537 - RNA, 19 nt, Homo sapiens
gaaucguguucgugucugu

SEQ ID NO: 1227538 - RNA, 19 nt, Homo sapiens
cauggccgcugcauuccaa

SEQ ID NO: 1227539 - RNA, 19 nt, Homo sapiens
gaguggugauguccucuag

SEQ ID NO: 1227540 - RNA, 19 nt, Homo sapiens
ccagccauaucuuacacuu

SEQ ID NO: 1227541 - RNA, 19 nt, Homo sapiens
acgugugcguuuacuguua

SEQ ID NO: 1227542 - RNA, 19 nt, Homo sapiens
ggacugggacuuggcuuuc

SEQ ID NO: 1227543 - RNA, 19 nt, Homo sapiens
ucugaacuucugucuauaa

SEQ ID NO: 1227544 - RNA, 19 nt, Homo sapiens
ugagugagucagaaucuau

SEQ ID NO: 1227545 - RNA, 19 nt, Homo sapiens
gcgcuccgcuuugcuuugg

SEQ ID NO: 1227546 - RNA, 19 nt, Homo sapiens
uauccacaauauuccuuga

SEQ ID NO: 1227547 - RNA, 19 nt, Homo sapiens
cgugugcguuuacuguuau

SEQ ID NO: 1227548 - RNA, 19 nt, Homo sapiens
aaugcaagccucugaacuu

SEQ ID NO: 1227549 - RNA, 19 nt, Homo sapiens
augcucaucuggaacauuc

SEQ ID NO: 1227550 - RNA, 19 nt, Homo sapiens
ccugcuaccugaacauugg

SEQ ID NO: 1227551 - RNA, 19 nt, Homo sapiens
gguggacgcacaugacugu

SEQ ID NO: 1227552 - RNA, 19 nt, Homo sapiens
ggugcaggaaggaggauaa

SEQ ID NO: 1227553 - RNA, 19 nt, Homo sapiens
caucgaugcacaccugcua

SEQ ID NO: 1227554 - RNA, 19 nt, Homo sapiens
caagggacuccaccaccaa

SEQ ID NO: 1227555 - RNA, 19 nt, Homo sapiens
aauaaaugcaagccucuga

SEQ ID NO: 1227556 - RNA, 19 nt, Homo sapiens
caccugcuaucguggaaca

SEQ ID NO: 1227557 - RNA, 19 nt, Homo sapiens
gcaccccagccauaucuua

SEQ ID NO: 1227558 - RNA, 19 nt, Homo sapiens
cggcagccaugcucaucug

SEQ ID NO: 1227559 - RNA, 19 nt, Homo sapiens
acacgugugcguuuacugu

SEQ ID NO: 1227560 - RNA, 19 nt, Homo sapiens
gugaugguuucaggcagaa

SEQ ID NO: 1227561 - RNA, 19 nt, Homo sapiens
ucucacucauccucaacaa

SEQ ID NO: 1227562 - RNA, 19 nt, Homo sapiens
caugacgacuugaaauaua

SEQ ID NO: 1227563 - RNA, 19 nt, Homo sapiens
ggcaagaguuggagaagaa

SEQ ID NO: 1227564 - RNA, 19 nt, Homo sapiens
ggugagcucuguucuucua

SEQ ID NO: 1227565 - RNA, 19 nt, Homo sapiens
gaacccacauccacucaau

SEQ ID NO: 1227566 - RNA, 19 nt, Homo sapiens
ccggaaaguugaauaaaug

SEQ ID NO: 1227567 - RNA, 19 nt, Homo sapiens
gggaggcacugaacaacuu

SEQ ID NO: 1227568 - RNA, 19 nt, Homo sapiens
gaggcgcgauuauugcuaa

SEQ ID NO: 1227569 - RNA, 19 nt, Homo sapiens
cagcacggaucuacaucua

SEQ ID NO: 1227570 - RNA, 19 nt, Homo sapiens
gcaguaucguagccaauga

SEQ ID NO: 1227571 - RNA, 19 nt, Homo sapiens
ggaaggaacuaacauucac

SEQ ID NO: 1227572 - RNA, 19 nt, Homo sapiens
gagcaccugcccucacaua

SEQ ID NO: 1227573 - RNA, 19 nt, Homo sapiens
agccaugacucacaacuaa

SEQ ID NO: 1227574 - RNA, 19 nt, Homo sapiens
cagcuggcauggucaggua

SEQ ID NO: 1227575 - RNA, 19 nt, Homo sapiens
gccaugacgacuugaaaua

SEQ ID NO: 1227576 - RNA, 19 nt, Homo sapiens
ggaccguucucguuucauc

SEQ ID NO: 1227577 - RNA, 19 nt, Homo sapiens
guggugagcucuguucuuc

SEQ ID NO: 1227578 - RNA, 19 nt, Homo sapiens
ccuuaaaccuguuccuaga

SEQ ID NO: 1227579 - RNA, 19 nt, Homo sapiens
gggcuugcuucccgaggua

SEQ ID NO: 1227580 - RNA, 19 nt, Homo sapiens
acaaggagacguuugaguu

SEQ ID NO: 1227581 - RNA, 19 nt, Homo sapiens
gaaauauagucggcauugg

SEQ ID NO: 1227582 - RNA, 19 nt, Homo sapiens
gggaaggaacuaacauuca

SEQ ID NO: 1227583 - RNA, 19 nt, Homo sapiens
gaauggacaaggagacguu

SEQ ID NO: 1227584 - RNA, 19 nt, Homo sapiens
uaucguagccaaugagguu

SEQ ID NO: 1227585 - RNA, 19 nt, Homo sapiens
cagacaagcugggcuacga

SEQ ID NO: 1227586 - RNA, 19 nt, Homo sapiens
acucgcgggugcaguauuu

SEQ ID NO: 1227587 - RNA, 19 nt, Homo sapiens
caaggagacguuugaguuc

SEQ ID NO: 1227588 - RNA, 19 nt, Homo sapiens
uggaaggaauggacaagga

SEQ ID NO: 1227589 - RNA, 19 nt, Homo sapiens
ugaaauauagucggcauug

SEQ ID NO: 1227590 - RNA, 19 nt, Homo sapiens
gagauguggugagcucugu

SEQ ID NO: 1227591 - RNA, 19 nt, Homo sapiens
caccuucccugcccugguu

SEQ ID NO: 1227592 - RNA, 19 nt, Homo sapiens
aaugugaacucuacuacca

SEQ ID NO: 1227593 - RNA, 19 nt, Homo sapiens
ggaugggcagggagugaua

SEQ ID NO: 1227594 - RNA, 19 nt, Homo sapiens
gaccuuaaaccuguuccua

SEQ ID NO: 1227595 - RNA, 19 nt, Homo sapiens
gguauuucaccucuuaaga

SEQ ID NO: 1227596 - RNA, 19 nt, Homo sapiens
ggaagugauggaaggaaug

SEQ ID NO: 1227597 - RNA, 19 nt, Homo sapiens
gcgcaguggcaguaucgua

SEQ ID NO: 1227598 - RNA, 19 nt, Homo sapiens
caccugcccucacauacug

SEQ ID NO: 1227599 - RNA, 19 nt, Homo sapiens
gcagggagugauagccaaa

SEQ ID NO: 1227600 - RNA, 19 nt, Homo sapiens
gcguggccaucgacacuga

SEQ ID NO: 1227601 - RNA, 19 nt, Homo sapiens
gugaagcuccuggaaguga

SEQ ID NO: 1227602 - RNA, 19 nt, Homo sapiens
ggaaaguugaauaaaugga

SEQ ID NO: 1227603 - RNA, 19 nt, Homo sapiens
gcaagaguuggagaagaaa

SEQ ID NO: 1227604 - RNA, 19 nt, Homo sapiens
guucaaguuugggaaggaa

SEQ ID NO: 1227605 - RNA, 19 nt, Homo sapiens
uggugaagcuccuggaagu

SEQ ID NO: 1227606 - RNA, 19 nt, Homo sapiens
gcuaugcggccuacaacug

SEQ ID NO: 1227607 - RNA, 19 nt, Homo sapiens
ccaugacgacuugaaauau

SEQ ID NO: 1227608 - RNA, 19 nt, Homo sapiens
cuucagccaugacucacaa

SEQ ID NO: 1227609 - RNA, 19 nt, Homo sapiens
ggacuuugccuccauuuuc

SEQ ID NO: 1227610 - RNA, 19 nt, Homo sapiens
uggaagugauggaaggaau

SEQ ID NO: 1227611 - RNA, 19 nt, Homo sapiens
accggaaaguugaauaaau

SEQ ID NO: 1227612 - RNA, 19 nt, Homo sapiens
cuaaagccuagaccuuaaa

SEQ ID NO: 1227613 - RNA, 19 nt, Homo sapiens
gcaccugcccucacauacu

SEQ ID NO: 1227614 - RNA, 19 nt, Homo sapiens
gaagugauggaaggaaugg

SEQ ID NO: 1227615 - RNA, 19 nt, Homo sapiens
uugcauaccggaaaguuga

SEQ ID NO: 1227616 - RNA, 19 nt, Homo sapiens
caagaaggaagcaguagcu

SEQ ID NO: 1227617 - RNA, 19 nt, Homo sapiens
uggcaagaguuggagaaga

SEQ ID NO: 1227618 - RNA, 19 nt, Homo sapiens
ccaacccagucucaacaca

SEQ ID NO: 1227619 - RNA, 19 nt, Homo sapiens
cauaaaacacuggagguua

SEQ ID NO: 1227620 - RNA, 19 nt, Homo sapiens
ggccaucgacacugacaug

SEQ ID NO: 1227621 - RNA, 19 nt, Homo sapiens
cuaugccagugccaaggua

SEQ ID NO: 1227622 - RNA, 19 nt, Homo sapiens
aggagcagguggcagcuau

SEQ ID NO: 1227623 - RNA, 19 nt, Homo sapiens
gagcucuguucuucuacca

SEQ ID NO: 1227624 - RNA, 19 nt, Homo sapiens
gacugcaugugcuggugaa

SEQ ID NO: 1227625 - RNA, 19 nt, Homo sapiens
cagccaugacucacaacua

SEQ ID NO: 1227626 - RNA, 19 nt, Homo sapiens
cuacaucuacccagacaag

SEQ ID NO: 1227627 - RNA, 19 nt, Homo sapiens
aaggagacguuugaguuca

SEQ ID NO: 1227628 - RNA, 19 nt, Homo sapiens
auaccggaaaguugaauaa

SEQ ID NO: 1227629 - RNA, 19 nt, Homo sapiens
guucuugcauaccggaaag

SEQ ID NO: 1227630 - RNA, 19 nt, Homo sapiens
gauguggugagcucuguuc

SEQ ID NO: 1227631 - RNA, 19 nt, Homo sapiens
agugauagccaaacuccuu

SEQ ID NO: 1227632 - RNA, 19 nt, Homo sapiens
gaagcuccuggaagugaug

SEQ ID NO: 1227633 - RNA, 19 nt, Homo sapiens
ugaagcuccuggaagugau

SEQ ID NO: 1227634 - RNA, 19 nt, Homo sapiens
gacaaggagacguuugagu

SEQ ID NO: 1227635 - RNA, 19 nt, Homo sapiens
gcgcaagcucacccgguuu

SEQ ID NO: 1227636 - RNA, 19 nt, Homo sapiens
caggcaucgucgugggaua

SEQ ID NO: 1227637 - RNA, 19 nt, Homo sapiens
cauaccggaaaguugaaua

SEQ ID NO: 1227638 - RNA, 19 nt, Homo sapiens
aaaccuguuccuagagcua

SEQ ID NO: 1227639 - RNA, 19 nt, Homo sapiens
cagguuaaggccaguuaug

SEQ ID NO: 1227640 - RNA, 19 nt, Homo sapiens
cacagguuaaggccaguua

SEQ ID NO: 1227641 - RNA, 19 nt, Homo sapiens
ccacucaaugugaacucua

SEQ ID NO: 1227642 - RNA, 19 nt, Homo sapiens
uauccgaggcgcgauuauu

SEQ ID NO: 1227643 - RNA, 19 nt, Homo sapiens
caagguaugcgaggagaag

SEQ ID NO: 1227644 - RNA, 19 nt, Homo sapiens
ggcaguaucguagccaaug

SEQ ID NO: 1227645 - RNA, 19 nt, Homo sapiens
ccaagaagcucaaggagua

SEQ ID NO: 1227646 - RNA, 19 nt, Homo sapiens
gaagaagauuuacagcuua

SEQ ID NO: 1227647 - RNA, 19 nt, Homo sapiens
ggaagaagauuuacagcuu

SEQ ID NO: 1227648 - RNA, 19 nt, Homo sapiens
agacaaaucugaccuugaa

SEQ ID NO: 1227649 - RNA, 19 nt, Homo sapiens
gcacuugugucugaaauga

SEQ ID NO: 1227650 - RNA, 19 nt, Homo sapiens
ggaggcagcugguacaaca

SEQ ID NO: 1227651 - RNA, 19 nt, Homo sapiens
ggacauggacagucuagaa

SEQ ID NO: 1227652 - RNA, 19 nt, Homo sapiens
auggagagguuaaagauua

SEQ ID NO: 1227653 - RNA, 19 nt, Homo sapiens
ggaugaaacugaaauugca

SEQ ID NO: 1227654 - RNA, 19 nt, Homo sapiens
ccaaggagauuccaaguac

SEQ ID NO: 1227655 - RNA, 19 nt, Homo sapiens
agaagaagauggagagguu

SEQ ID NO: 1227656 - RNA, 19 nt, Homo sapiens
gaaagaugcagucccuaaa

SEQ ID NO: 1227657 - RNA, 19 nt, Homo sapiens
gcccuugccugaacugauu

SEQ ID NO: 1227658 - RNA, 19 nt, Homo sapiens
acaagaaacuguggaugaa

SEQ ID NO: 1227659 - RNA, 19 nt, Homo sapiens
acaaguauauccuagacaa

SEQ ID NO: 1227660 - RNA, 19 nt, Homo sapiens
ggagaaauggcaccagcua

SEQ ID NO: 1227661 - RNA, 19 nt, Homo sapiens
ggacaaguauauccuagac

SEQ ID NO: 1227662 - RNA, 19 nt, Homo sapiens
ucuccaaagucaacaagua

SEQ ID NO: 1227663 - RNA, 19 nt, Homo sapiens
gaagcgggauuuggguuga

SEQ ID NO: 1227664 - RNA, 19 nt, Homo sapiens
ucagagaguguuuguauga

SEQ ID NO: 1227665 - RNA, 19 nt, Homo sapiens
uuagacacaucaaggauug

SEQ ID NO: 1227666 - RNA, 19 nt, Homo sapiens
guguuuguaugacagaaua

SEQ ID NO: 1227667 - RNA, 19 nt, Homo sapiens
gaagaagauggagagguua

SEQ ID NO: 1227668 - RNA, 19 nt, Homo sapiens
cagaauagcacaagaaacu

SEQ ID NO: 1227669 - RNA, 19 nt, Homo sapiens
gacagaauagcacaagaaa

SEQ ID NO: 1227670 - RNA, 19 nt, Homo sapiens
gaaauggcaccagcuacaa

SEQ ID NO: 1227671 - RNA, 19 nt, Homo sapiens
gaauagcacaagaaacugu

SEQ ID NO: 1227672 - RNA, 19 nt, Homo sapiens
cgucagagaguguuuguau

SEQ ID NO: 1227673 - RNA, 19 nt, Homo sapiens
caacaaguacaucugugaa

SEQ ID NO: 1227674 - RNA, 19 nt, Homo sapiens
ugacagaauagcacaagaa

SEQ ID NO: 1227675 - RNA, 19 nt, Homo sapiens
ccucucgccucgcaaacua

SEQ ID NO: 1227676 - RNA, 19 nt, Homo sapiens
agaaagaugcagucccuaa

SEQ ID NO: 1227677 - RNA, 19 nt, Homo sapiens
caaguaacccaaggagauu

SEQ ID NO: 1227678 - RNA, 19 nt, Homo sapiens
gcaacuaccagcagcaaca

SEQ ID NO: 1227679 - RNA, 19 nt, Homo sapiens
acagugugaugcagaagaa

SEQ ID NO: 1227680 - RNA, 19 nt, Homo sapiens
cagaggacauggacagucu

SEQ ID NO: 1227681 - RNA, 19 nt, Homo sapiens
gaucugcaguccaagaaaa

SEQ ID NO: 1227682 - RNA, 19 nt, Homo sapiens
gaagaacgaagggaagcaa

SEQ ID NO: 1227683 - RNA, 19 nt, Homo sapiens
caaacuaagcaucgucaga

SEQ ID NO: 1227684 - RNA, 19 nt, Homo sapiens
aagcaaauacgucguccua

SEQ ID NO: 1227685 - RNA, 19 nt, Homo sapiens
acaaguaacccaaggagau

SEQ ID NO: 1227686 - RNA, 19 nt, Homo sapiens
gauggagagguuaaagauu

SEQ ID NO: 1227687 - RNA, 19 nt, Homo sapiens
caagaaacuguggaugaaa

SEQ ID NO: 1227688 - RNA, 19 nt, Homo sapiens
gagauuccaaguacacgaa

SEQ ID NO: 1227689 - RNA, 19 nt, Homo sapiens
cauggacagucuagaagau

SEQ ID NO: 1227690 - RNA, 19 nt, Homo sapiens
gaagauggagagguuaaag

SEQ ID NO: 1227691 - RNA, 19 nt, Homo sapiens
caagcuuucucuuaaucau

SEQ ID NO: 1227692 - RNA, 19 nt, Homo sapiens
ucaacaaguacaucuguga

SEQ ID NO: 1227693 - RNA, 19 nt, Homo sapiens
caaggagauuccaaguaca

SEQ ID NO: 1227694 - RNA, 19 nt, Homo sapiens
gggcacuugugucugaaau

SEQ ID NO: 1227695 - RNA, 19 nt, Homo sapiens
auauugaucugcaguccaa

SEQ ID NO: 1227696 - RNA, 19 nt, Homo sapiens
gaaacugaaauugcacaga

SEQ ID NO: 1227697 - RNA, 19 nt, Homo sapiens
aaacuguggaugaaacuga

SEQ ID NO: 1227698 - RNA, 19 nt, Homo sapiens
aaaguaaagucagaauguc

SEQ ID NO: 1227699 - RNA, 19 nt, Homo sapiens
gcucgcggcuggauuuuga

SEQ ID NO: 1227700 - RNA, 19 nt, Homo sapiens
gcagcaacaggaagagaug

SEQ ID NO: 1227701 - RNA, 19 nt, Homo sapiens
cgagcgaaguggcgcacaa

SEQ ID NO: 1227702 - RNA, 19 nt, Homo sapiens
uggagagguuaaagauuau

SEQ ID NO: 1227703 - RNA, 19 nt, Homo sapiens
cagcugcccuugccugaac

SEQ ID NO: 1227704 - RNA, 19 nt, Homo sapiens
aagaagauuuacagcuuag

SEQ ID NO: 1227705 - RNA, 19 nt, Homo sapiens
aagaaacuguggaugaaac

SEQ ID NO: 1227706 - RNA, 19 nt, Homo sapiens
agagaguguuuguaugaca

SEQ ID NO: 1227707 - RNA, 19 nt, Homo sapiens
ggagcuccgugaccuuaac

SEQ ID NO: 1227708 - RNA, 19 nt, Homo sapiens
cccaagcuuucucuuaauc

SEQ ID NO: 1227709 - RNA, 19 nt, Homo sapiens
gaagggaagcaaaauacaa

SEQ ID NO: 1227710 - RNA, 19 nt, Homo sapiens
gucagagaguguuuguaug

SEQ ID NO: 1227711 - RNA, 19 nt, Homo sapiens
agaaauggcaccagcuaca

SEQ ID NO: 1227712 - RNA, 19 nt, Homo sapiens
gauuccaaguacacgaaga

SEQ ID NO: 1227713 - RNA, 19 nt, Homo sapiens
gaagauuuacagcuuagac

SEQ ID NO: 1227714 - RNA, 19 nt, Homo sapiens
aagaagauggagagguuaa

SEQ ID NO: 1227715 - RNA, 19 nt, Homo sapiens
ggaguuacggagcacuuuc

SEQ ID NO: 1227716 - RNA, 19 nt, Homo sapiens
acaaguacaucugugaaaa

SEQ ID NO: 1227717 - RNA, 19 nt, Homo sapiens
cccaaggagauuccaagua

SEQ ID NO: 1227718 - RNA, 19 nt, Homo sapiens
uggcaccagcuacaaguaa

SEQ ID NO: 1227719 - RNA, 19 nt, Homo sapiens
gacauggacagucuagaag

SEQ ID NO: 1227720 - RNA, 19 nt, Homo sapiens
ggguugaugaggagaaaug

SEQ ID NO: 1227721 - RNA, 19 nt, Homo sapiens
caucugggaagcgggauuu

SEQ ID NO: 1227722 - RNA, 19 nt, Homo sapiens
gaacgaagggaagcaaaau

SEQ ID NO: 1227723 - RNA, 19 nt, Homo sapiens
gauccuggcgcuggcagaa

SEQ ID NO: 1227724 - RNA, 19 nt, Homo sapiens
ucauguagaagaagaugga

SEQ ID NO: 1227725 - RNA, 19 nt, Homo sapiens
gaguuacggagcacuuuca

SEQ ID NO: 1227726 - RNA, 19 nt, Homo sapiens
gauuuacagcuuagacaca

SEQ ID NO: 1227727 - RNA, 19 nt, Homo sapiens
uccccaagcuuucucuuaa

SEQ ID NO: 1227728 - RNA, 19 nt, Homo sapiens
caaguauauccuagacaau

SEQ ID NO: 1227729 - RNA, 19 nt, Homo sapiens
cauggacaaguauauccua

SEQ ID NO: 1227730 - RNA, 19 nt, Homo sapiens
ucagugaggaagcaaauac

SEQ ID NO: 1227731 - RNA, 19 nt, Homo sapiens
caaagucaacaaguacauc

SEQ ID NO: 1227732 - RNA, 19 nt, Homo sapiens
gcuggcagaagacaaaucu

SEQ ID NO: 1227733 - RNA, 19 nt, Homo sapiens
aaguauauccuagacaaug

SEQ ID NO: 1227734 - RNA, 19 nt, Homo sapiens
gcgaaguggcgcacaagag

SEQ ID NO: 1227735 - RNA, 19 nt, Homo sapiens
gaacagagcgucagcauau

SEQ ID NO: 1227736 - RNA, 19 nt, Homo sapiens
gaagagaauuuaccuccua

SEQ ID NO: 1227737 - RNA, 19 nt, Homo sapiens
gaugaugucuuucuugauu

SEQ ID NO: 1227738 - RNA, 19 nt, Homo sapiens
ugaagaaacugguaauuug

SEQ ID NO: 1227739 - RNA, 19 nt, Homo sapiens
gcaguugccuugaauagaa

SEQ ID NO: 1227740 - RNA, 19 nt, Homo sapiens
gaaguuauacaaaggcuua

SEQ ID NO: 1227741 - RNA, 19 nt, Homo sapiens
gcaauugacugcuacacaa

SEQ ID NO: 1227742 - RNA, 19 nt, Homo sapiens
aaaggaagcugacauagug

SEQ ID NO: 1227743 - RNA, 19 nt, Homo sapiens
gaacuaagaagacagaaug

SEQ ID NO: 1227744 - RNA, 19 nt, Homo sapiens
gaagaaaggcaaagcuaaa

SEQ ID NO: 1227745 - RNA, 19 nt, Homo sapiens
ggacuaucuuugaacauaa

SEQ ID NO: 1227746 - RNA, 19 nt, Homo sapiens
uaacagagcuauggccuau

SEQ ID NO: 1227747 - RNA, 19 nt, Homo sapiens
gaaagaguauuagaacuag

SEQ ID NO: 1227748 - RNA, 19 nt, Homo sapiens
cauaaugacuucagcaaau

SEQ ID NO: 1227749 - RNA, 19 nt, Homo sapiens
gaagaaacugguaauuuga

SEQ ID NO: 1227750 - RNA, 19 nt, Homo sapiens
caacuaaaccacucaagaa

SEQ ID NO: 1227751 - RNA, 19 nt, Homo sapiens
acacugggaugaugucuuu

SEQ ID NO: 1227752 - RNA, 19 nt, Homo sapiens
ggaauuaauugagaaagga

SEQ ID NO: 1227753 - RNA, 19 nt, Homo sapiens
gggaugaugucuuucuuga

SEQ ID NO: 1227754 - RNA, 19 nt, Homo sapiens
ggaaauaagcaagcaguaa

SEQ ID NO: 1227755 - RNA, 19 nt, Homo sapiens
gaaaaucagucaggcuuua

SEQ ID NO: 1227756 - RNA, 19 nt, Homo sapiens
gaaacaaaaugcagaagaa

SEQ ID NO: 1227757 - RNA, 19 nt, Homo sapiens
gaaggauaguucugucgaa

SEQ ID NO: 1227758 - RNA, 19 nt, Homo sapiens
gcaauugaaugcuauacuc

SEQ ID NO: 1227759 - RNA, 19 nt, Homo sapiens
uugaugagcuugacaaaga

SEQ ID NO: 1227760 - RNA, 19 nt, Homo sapiens
gaaaaugcccauagagaua

SEQ ID NO: 1227761 - RNA, 19 nt, Homo sapiens
acuauaaggugaauuguga

SEQ ID NO: 1227762 - RNA, 19 nt, Homo sapiens
aagauacggugguugauuu

SEQ ID NO: 1227763 - RNA, 19 nt, Homo sapiens
gaaaaguucuccagauaug

SEQ ID NO: 1227764 - RNA, 19 nt, Homo sapiens
gcaaauaaagcaaucgaau

SEQ ID NO: 1227765 - RNA, 19 nt, Homo sapiens
aaacucauauccaaaggaa

SEQ ID NO: 1227766 - RNA, 19 nt, Homo sapiens
ggaagaagaugggauucau

SEQ ID NO: 1227767 - RNA, 19 nt, Homo sapiens
gaagcugacauagugauua

SEQ ID NO: 1227768 - RNA, 19 nt, Homo sapiens
gaagaugggauucauguag

SEQ ID NO: 1227769 - RNA, 19 nt, Homo sapiens
uaacugaacucuccaaaau

SEQ ID NO: 1227770 - RNA, 19 nt, Homo sapiens
gcucauauucuaaagcuuu

SEQ ID NO: 1227771 - RNA, 19 nt, Homo sapiens
gaauuacaacuacaaguga

SEQ ID NO: 1227772 - RNA, 19 nt, Homo sapiens
gaaccaucuuuguauccua

SEQ ID NO: 1227773 - RNA, 19 nt, Homo sapiens
gcagaagaauuacaagacu

SEQ ID NO: 1227774 - RNA, 19 nt, Homo sapiens
gauauggcagugauguuua

SEQ ID NO: 1227775 - RNA, 19 nt, Homo sapiens
gcaaucgaauuacaacuac

SEQ ID NO: 1227776 - RNA, 19 nt, Homo sapiens
caacuguucuuccuccaau

SEQ ID NO: 1227777 - RNA, 19 nt, Homo sapiens
ccacaggcaccacaaguaa

SEQ ID NO: 1227778 - RNA, 19 nt, Homo sapiens
gaacuagaaccaaauaacu

SEQ ID NO: 1227779 - RNA, 19 nt, Homo sapiens
gcuauggccuaucugaaga

SEQ ID NO: 1227780 - RNA, 19 nt, Homo sapiens
ggagagcgaaagcaaauug

SEQ ID NO: 1227781 - RNA, 19 nt, Homo sapiens
aagcugacauagugauuaa

SEQ ID NO: 1227782 - RNA, 19 nt, Homo sapiens
caacuacaagugaaacaaa

SEQ ID NO: 1227783 - RNA, 19 nt, Homo sapiens
gaaauaagcaagcaguaac

SEQ ID NO: 1227784 - RNA, 19 nt, Homo sapiens
gaaggagagcgaaagcaaa

SEQ ID NO: 1227785 - RNA, 19 nt, Homo sapiens
gaaaagauacggugguuga

SEQ ID NO: 1227786 - RNA, 19 nt, Homo sapiens
caaaugaacucaggaaaau

SEQ ID NO: 1227787 - RNA, 19 nt, Homo sapiens
gaaaagccauuacucaucu

SEQ ID NO: 1227788 - RNA, 19 nt, Homo sapiens
gauacagacuauugaugug

SEQ ID NO: 1227789 - RNA, 19 nt, Homo sapiens
gaaauaugaagaagcugaa

SEQ ID NO: 1227790 - RNA, 19 nt, Homo sapiens
caacaaaugaacucaggaa

SEQ ID NO: 1227791 - RNA, 19 nt, Homo sapiens
uauccuaaguuguuucaga

SEQ ID NO: 1227792 - RNA, 19 nt, Homo sapiens
aagaggaacugcaagaaca

SEQ ID NO: 1227793 - RNA, 19 nt, Homo sapiens
ucagaaauaugaagaagcu

SEQ ID NO: 1227794 - RNA, 19 nt, Homo sapiens
ggauauggaacuaagaaga

SEQ ID NO: 1227795 - RNA, 19 nt, Homo sapiens
aggacuaucuuugaacaua

SEQ ID NO: 1227796 - RNA, 19 nt, Homo sapiens
guauucaaccagaucguua

SEQ ID NO: 1227797 - RNA, 19 nt, Homo sapiens
ccacaaguaagaagaauuc

SEQ ID NO: 1227798 - RNA, 19 nt, Homo sapiens
gugauuaagucaacagaag

SEQ ID NO: 1227799 - RNA, 19 nt, Homo sapiens
cagaagaauuacaagacuu

SEQ ID NO: 1227800 - RNA, 19 nt, Homo sapiens
gaaaauagaagaagucagu

SEQ ID NO: 1227801 - RNA, 19 nt, Homo sapiens
cuaaaccacucaagaaggu

SEQ ID NO: 1227802 - RNA, 19 nt, Homo sapiens
caaaggaagcugacauagu

SEQ ID NO: 1227803 - RNA, 19 nt, Homo sapiens
agaaugguguuccugaaga

SEQ ID NO: 1227804 - RNA, 19 nt, Homo sapiens
caaguaagaagaauucaag

SEQ ID NO: 1227805 - RNA, 19 nt, Homo sapiens
caacagaaggagagcgaaa

SEQ ID NO: 1227806 - RNA, 19 nt, Homo sapiens
gauuguaauuuagcaguug

SEQ ID NO: 1227807 - RNA, 19 nt, Homo sapiens
gaagaagaugggauucaug

SEQ ID NO: 1227808 - RNA, 19 nt, Homo sapiens
gaaaggacacugggaugau

SEQ ID NO: 1227809 - RNA, 19 nt, Homo sapiens
acugaacucuccaaaauua

SEQ ID NO: 1227810 - RNA, 19 nt, Homo sapiens
ugaaagagcaauugaaugc

SEQ ID NO: 1227811 - RNA, 19 nt, Homo sapiens
gcaccacaaguaagaagaa

SEQ ID NO: 1227812 - RNA, 19 nt, Homo sapiens
cgaauuacaacuacaagug

SEQ ID NO: 1227813 - RNA, 19 nt, Homo sapiens
caaauugaagcacaacaga

SEQ ID NO: 1227814 - RNA, 19 nt, Homo sapiens
aggcaaagcuaaagagucu

SEQ ID NO: 1227815 - RNA, 19 nt, Homo sapiens
gaaaggcaaagcuaaagag

SEQ ID NO: 1227816 - RNA, 19 nt, Homo sapiens
gaagaggaacugcaagaac

SEQ ID NO: 1227817 - RNA, 19 nt, Homo sapiens
ggcaauaaauacuucaaac

SEQ ID NO: 1227818 - RNA, 19 nt, Homo sapiens
gaagaauucaagccaagau

SEQ ID NO: 1227819 - RNA, 19 nt, Homo sapiens
aaagggcaauaaauacuuc

SEQ ID NO: 1227820 - RNA, 19 nt, Homo sapiens
aagaugggauucauguaga

SEQ ID NO: 1227821 - RNA, 19 nt, Homo sapiens
ccauagagauagaacaaaa

SEQ ID NO: 1227822 - RNA, 19 nt, Homo sapiens
gcacacaagccauuuuauu

SEQ ID NO: 1227823 - RNA, 19 nt, Homo sapiens
ggauucauguagauucaca

SEQ ID NO: 1227824 - RNA, 19 nt, Homo sapiens
ccacucaagaagguuauua

SEQ ID NO: 1227825 - RNA, 19 nt, Homo sapiens
aaaggacacugggaugaug

SEQ ID NO: 1227826 - RNA, 19 nt, Homo sapiens
agaagaaaggcaaagcuaa

SEQ ID NO: 1227827 - RNA, 19 nt, Homo sapiens
aaccaucuuuguauccuaa

SEQ ID NO: 1227828 - RNA, 19 nt, Homo sapiens
uagaagaagucagugauac

SEQ ID NO: 1227829 - RNA, 19 nt, Homo sapiens
gaaugguguuccugaagag

SEQ ID NO: 1227830 - RNA, 19 nt, Homo sapiens
ucaaagaggggaaauauga

SEQ ID NO: 1227831 - RNA, 19 nt, Homo sapiens
ggauccagauguauucaac

SEQ ID NO: 1227832 - RNA, 19 nt, Homo sapiens
ggaagcugacauagugauu

SEQ ID NO: 1227833 - RNA, 19 nt, Homo sapiens
ggugaauugugauuuaacu

SEQ ID NO: 1227834 - RNA, 19 nt, Homo sapiens
ccauuacucaucuuugaaa

SEQ ID NO: 1227835 - RNA, 19 nt, Homo sapiens
gaacacagcucggaauuau

SEQ ID NO: 1227836 - RNA, 19 nt, Homo sapiens
gugaaacacuuaacaaaug

SEQ ID NO: 1227837 - RNA, 19 nt, Homo sapiens
ccagaagugucuagucaua

SEQ ID NO: 1227838 - RNA, 19 nt, Homo sapiens
caaggucucuguaaaugaa

SEQ ID NO: 1227839 - RNA, 19 nt, Homo sapiens
gaaccuggcuggcuagaag

SEQ ID NO: 1227840 - RNA, 19 nt, Homo sapiens
gaaagugccgcuugcuaua

SEQ ID NO: 1227841 - RNA, 19 nt, Homo sapiens
cauuguggauguugaaaua

SEQ ID NO: 1227842 - RNA, 19 nt, Homo sapiens
cuaggaaacugcaggauug

SEQ ID NO: 1227843 - RNA, 19 nt, Homo sapiens
gaagugaagacaauaacaa

SEQ ID NO: 1227844 - RNA, 19 nt, Homo sapiens
acagguaccuccacacuug

SEQ ID NO: 1227845 - RNA, 19 nt, Homo sapiens
gcuggaagauggugacaau

SEQ ID NO: 1227846 - RNA, 19 nt, Homo sapiens
ggagaauucugcagauugg

SEQ ID NO: 1227847 - RNA, 19 nt, Homo sapiens
gaagagacaaggccagaga

SEQ ID NO: 1227848 - RNA, 19 nt, Homo sapiens
gauugugguuugcccauuu

SEQ ID NO: 1227849 - RNA, 19 nt, Homo sapiens
cauagaacauagcuuauag

SEQ ID NO: 1227850 - RNA, 19 nt, Homo sapiens
ugaguuacauggagauuuc

SEQ ID NO: 1227851 - RNA, 19 nt, Homo sapiens
gugauacuguuaacgauga

SEQ ID NO: 1227852 - RNA, 19 nt, Homo sapiens
ccaaggcuacugagugaua

SEQ ID NO: 1227853 - RNA, 19 nt, Homo sapiens
ggagggagcuuuggagacu

SEQ ID NO: 1227854 - RNA, 19 nt, Homo sapiens
aaagggaacuguacuacuc

SEQ ID NO: 1227855 - RNA, 19 nt, Homo sapiens
acauggagauuucauuguu

SEQ ID NO: 1227856 - RNA, 19 nt, Homo sapiens
gaauauuguuguggaaauc

SEQ ID NO: 1227857 - RNA, 19 nt, Homo sapiens
agucauagaacauagcuua

SEQ ID NO: 1227858 - RNA, 19 nt, Homo sapiens
guacacaaacugccagaga

SEQ ID NO: 1227859 - RNA, 19 nt, Homo sapiens
gacaagaggaccuuugaug

SEQ ID NO: 1227860 - RNA, 19 nt, Homo sapiens
ggugaaacacuuaacaaau

SEQ ID NO: 1227861 - RNA, 19 nt, Homo sapiens
cuacugagugauacuguua

SEQ ID NO: 1227862 - RNA, 19 nt, Homo sapiens
caagaggaccuuugaugau

SEQ ID NO: 1227863 - RNA, 19 nt, Homo sapiens
cccaacccaucucuuauuu

SEQ ID NO: 1227864 - RNA, 19 nt, Homo sapiens
gcagauggagggagcuuug

SEQ ID NO: 1227865 - RNA, 19 nt, Homo sapiens
cccagaaucucguguuaau

SEQ ID NO: 1227866 - RNA, 19 nt, Homo sapiens
uacacaaacugccagagaa

SEQ ID NO: 1227867 - RNA, 19 nt, Homo sapiens
acaagaggaccuuugauga

SEQ ID NO: 1227868 - RNA, 19 nt, Homo sapiens
ugaaagugccgcuugcuau

SEQ ID NO: 1227869 - RNA, 19 nt, Homo sapiens
uauccagcauauagaauga

SEQ ID NO: 1227870 - RNA, 19 nt, Homo sapiens
agagaagaauaaagagaug

SEQ ID NO: 1227871 - RNA, 19 nt, Homo sapiens
gcuuugaucucuacuacag

SEQ ID NO: 1227872 - RNA, 19 nt, Homo sapiens
uggagaagcugcuguuggu

SEQ ID NO: 1227873 - RNA, 19 nt, Homo sapiens
gcagaacacagcucggaau

SEQ ID NO: 1227874 - RNA, 19 nt, Homo sapiens
gaagaauaaagagauguug

SEQ ID NO: 1227875 - RNA, 19 nt, Homo sapiens
caaaucacuccaagcagaa

SEQ ID NO: 1227876 - RNA, 19 nt, Homo sapiens
ggacaagccaccugaaagc

SEQ ID NO: 1227877 - RNA, 19 nt, Homo sapiens
gaugacuguggcaaacuua

SEQ ID NO: 1227878 - RNA, 19 nt, Homo sapiens
gcuacugagugauacuguu

SEQ ID NO: 1227879 - RNA, 19 nt, Homo sapiens
gaagauggugacaauccuu

SEQ ID NO: 1227880 - RNA, 19 nt, Homo sapiens
ucagaauauuguuguggaa

SEQ ID NO: 1227881 - RNA, 19 nt, Homo sapiens
gagugauacuguuaacgau

SEQ ID NO: 1227882 - RNA, 19 nt, Homo sapiens
gugaagacaauaacaagug

SEQ ID NO: 1227883 - RNA, 19 nt, Homo sapiens
ggaagugaagacaauaaca

SEQ ID NO: 1227884 - RNA, 19 nt, Homo sapiens
ugccagaagugucuaguca

SEQ ID NO: 1227885 - RNA, 19 nt, Homo sapiens
gcacuggcguauuuguaac

SEQ ID NO: 1227886 - RNA, 19 nt, Homo sapiens
guauugggacuugugauuu

SEQ ID NO: 1227887 - RNA, 19 nt, Homo sapiens
aaacugccagagaagaaua

SEQ ID NO: 1227888 - RNA, 19 nt, Homo sapiens
gaguuaccaucaucacagu

SEQ ID NO: 1227889 - RNA, 19 nt, Homo sapiens
gaauaaagagauguuggau

SEQ ID NO: 1227890 - RNA, 19 nt, Homo sapiens
cagagaagaauaaagagau

SEQ ID NO: 1227891 - RNA, 19 nt, Homo sapiens
aagaggaccuuugaugauc

SEQ ID NO: 1227892 - RNA, 19 nt, Homo sapiens
ggauugugguuugcccauu

SEQ ID NO: 1227893 - RNA, 19 nt, Homo sapiens
gcggacaagccaccugaaa

SEQ ID NO: 1227894 - RNA, 19 nt, Homo sapiens
ggaagauggugacaauccu

SEQ ID NO: 1227895 - RNA, 19 nt, Homo sapiens
ccagagaagaauaaagaga

SEQ ID NO: 1227896 - RNA, 19 nt, Homo sapiens
ugcgauccauuucuuggua

SEQ ID NO: 1227897 - RNA, 19 nt, Homo sapiens
cauggagauuucauuguuc

SEQ ID NO: 1227898 - RNA, 19 nt, Homo sapiens
gccucaaggucucuguaaa

SEQ ID NO: 1227899 - RNA, 19 nt, Homo sapiens
agcgugcacuggcguauuu

SEQ ID NO: 1227900 - RNA, 19 nt, Homo sapiens
gaugaggccacaggaagaa

SEQ ID NO: 1227901 - RNA, 19 nt, Homo sapiens
uuacauggagauuucauug

SEQ ID NO: 1227902 - RNA, 19 nt, Homo sapiens
cuuguuugcuugcucacua

SEQ ID NO: 1227903 - RNA, 19 nt, Homo sapiens
aaagugccgcuugcuauaa

SEQ ID NO: 1227904 - RNA, 19 nt, Homo sapiens
agaacacagcucggaauua

SEQ ID NO: 1227905 - RNA, 19 nt, Homo sapiens
cagaacacagcucggaauu

SEQ ID NO: 1227906 - RNA, 19 nt, Homo sapiens
ugaugacuguggcaaacuu

SEQ ID NO: 1227907 - RNA, 19 nt, Homo sapiens
agcagaaccugaugacugu

SEQ ID NO: 1227908 - RNA, 19 nt, Homo sapiens
ugccagagaagaauaaaga

SEQ ID NO: 1227909 - RNA, 19 nt, Homo sapiens
ccucaaggucucuguaaau

SEQ ID NO: 1227910 - RNA, 19 nt, Homo sapiens
ugagugauacuguuaacga

SEQ ID NO: 1227911 - RNA, 19 nt, Homo sapiens
acacagcucggaauuaucu

SEQ ID NO: 1227912 - RNA, 19 nt, Homo sapiens
cucaaggucucuguaaaug

SEQ ID NO: 1227913 - RNA, 19 nt, Homo sapiens
ucuaugguccaguggcuua

SEQ ID NO: 1227914 - RNA, 19 nt, Homo sapiens
gagacugggcauccacuau

SEQ ID NO: 1227915 - RNA, 19 nt, Homo sapiens
acucccaacccaucucuua

SEQ ID NO: 1227916 - RNA, 19 nt, Homo sapiens
gcccguggccgucuacaau

SEQ ID NO: 1227917 - RNA, 19 nt, Homo sapiens
ccaccaaggcagucgaaga

SEQ ID NO: 1227918 - RNA, 19 nt, Homo sapiens
cagaaucucguguuaaugc

SEQ ID NO: 1227919 - RNA, 19 nt, Homo sapiens
uagacaagaggaccuuuga

SEQ ID NO: 1227920 - RNA, 19 nt, Homo sapiens
ugauagguuugcagagugu

SEQ ID NO: 1227921 - RNA, 19 nt, Homo sapiens
ggaggggaaugucaggauu

SEQ ID NO: 1227922 - RNA, 19 nt, Homo sapiens
cuacagauuuuacgaagug

SEQ ID NO: 1227923 - RNA, 19 nt, Homo sapiens
acaaacugccagagaagaa

SEQ ID NO: 1227924 - RNA, 19 nt, Homo sapiens
ucaaggucucuguaaauga

SEQ ID NO: 1227925 - RNA, 19 nt, Homo sapiens
ccucacccgugugcuguuu

SEQ ID NO: 1227926 - RNA, 19 nt, Homo sapiens
ggacgcaccacacagaacu

SEQ ID NO: 1227927 - RNA, 19 nt, Homo sapiens
ggagacugggcauccacua

SEQ ID NO: 1227928 - RNA, 19 nt, Homo sapiens
aagauggugacaauccuua

SEQ ID NO: 1227929 - RNA, 19 nt, Homo sapiens
ccuaggaaacugcaggauu

SEQ ID NO: 1227930 - RNA, 19 nt, Homo sapiens
ucgcugcccucauggacuu

SEQ ID NO: 1227931 - RNA, 19 nt, Homo sapiens
agcccagaaucucguguua

SEQ ID NO: 1227932 - RNA, 19 nt, Homo sapiens
gugcacuggcguauuugua

SEQ ID NO: 1227933 - RNA, 19 nt, Homo sapiens
guggccgucuacaaucuuu

SEQ ID NO: 1227934 - RNA, 19 nt, Homo sapiens
guuguggaaaucuuaauug

SEQ ID NO: 1227935 - RNA, 19 nt, Homo sapiens
gaacccaucuugauaauua

SEQ ID NO: 1227936 - RNA, 19 nt, Homo sapiens
gaacuuacaucuuguggua

SEQ ID NO: 1227937 - RNA, 19 nt, Homo sapiens
gaagcaaagcuacaaauua

SEQ ID NO: 1227938 - RNA, 19 nt, Homo sapiens
ggaagaaacuaaaccagaa

SEQ ID NO: 1227939 - RNA, 19 nt, Homo sapiens
uaagaucaguggcuuguua

SEQ ID NO: 1227940 - RNA, 19 nt, Homo sapiens
ugagaaaccugauuuagaa

SEQ ID NO: 1227941 - RNA, 19 nt, Homo sapiens
guacaugguuuacuugaaa

SEQ ID NO: 1227942 - RNA, 19 nt, Homo sapiens
gagguuaacuuuacuacaa

SEQ ID NO: 1227943 - RNA, 19 nt, Homo sapiens
gaagauaacauaugaguca

SEQ ID NO: 1227944 - RNA, 19 nt, Homo sapiens
cagaagaucccuuacaaua

SEQ ID NO: 1227945 - RNA, 19 nt, Homo sapiens
cauaacagcugguuccaaa

SEQ ID NO: 1227946 - RNA, 19 nt, Homo sapiens
gcagugcacuuauucaaga

SEQ ID NO: 1227947 - RNA, 19 nt, Homo sapiens
gaacauugauucuuuaagc

SEQ ID NO: 1227948 - RNA, 19 nt, Homo sapiens
agagaaaucuggucuaaug

SEQ ID NO: 1227949 - RNA, 19 nt, Homo sapiens
ccacaauccugcagcauuu

SEQ ID NO: 1227950 - RNA, 19 nt, Homo sapiens
caucagugcucccuuguuu

SEQ ID NO: 1227951 - RNA, 19 nt, Homo sapiens
gagcaagaguuuccaucua

SEQ ID NO: 1227952 - RNA, 19 nt, Homo sapiens
gaauauauaugucguuguc

SEQ ID NO: 1227953 - RNA, 19 nt, Homo sapiens
ggaugcagcuuccauuguu

SEQ ID NO: 1227954 - RNA, 19 nt, Homo sapiens
gaaaccugauuuagaagaa

SEQ ID NO: 1227955 - RNA, 19 nt, Homo sapiens
auacagaacuggguagaua

SEQ ID NO: 1227956 - RNA, 19 nt, Homo sapiens
cgacaaggaucuccaauac

SEQ ID NO: 1227957 - RNA, 19 nt, Homo sapiens
gaaauugaacccaucuuga

SEQ ID NO: 1227958 - RNA, 19 nt, Homo sapiens
ugaaagggaucgugugguu

SEQ ID NO: 1227959 - RNA, 19 nt, Homo sapiens
gcaaagcuacaaauuaaga

SEQ ID NO: 1227960 - RNA, 19 nt, Homo sapiens
gugaucagcuuccgucuug

SEQ ID NO: 1227961 - RNA, 19 nt, Homo sapiens
guggauagccuuaaauuug

SEQ ID NO: 1227962 - RNA, 19 nt, Homo sapiens
gaucaguucucagguuauu

SEQ ID NO: 1227963 - RNA, 19 nt, Homo sapiens
ggacuaucgugcugucauu

SEQ ID NO: 1227964 - RNA, 19 nt, Homo sapiens
cagagaauccagucacuua

SEQ ID NO: 1227965 - RNA, 19 nt, Homo sapiens
gaaagugccuccuccuaac

SEQ ID NO: 1227966 - RNA, 19 nt, Homo sapiens
uuagaguucuucagucaua

SEQ ID NO: 1227967 - RNA, 19 nt, Homo sapiens
caauaucgcucgcucaucu

SEQ ID NO: 1227968 - RNA, 19 nt, Homo sapiens
ggauagccuuaaauuugua

SEQ ID NO: 1227969 - RNA, 19 nt, Homo sapiens
gaugcagcuuccauuguua

SEQ ID NO: 1227970 - RNA, 19 nt, Homo sapiens
ccaauacugucauucauca

SEQ ID NO: 1227971 - RNA, 19 nt, Homo sapiens
gaaagaagcggagaguguu

SEQ ID NO: 1227972 - RNA, 19 nt, Homo sapiens
ggagacauguuacggaaag

SEQ ID NO: 1227973 - RNA, 19 nt, Homo sapiens
gaagaucccuuacaauacc

SEQ ID NO: 1227974 - RNA, 19 nt, Homo sapiens
acaaggaucuccaauacug

SEQ ID NO: 1227975 - RNA, 19 nt, Homo sapiens
ugaaacacuugaccuauca

SEQ ID NO: 1227976 - RNA, 19 nt, Homo sapiens
guacaacauuauugacaga

SEQ ID NO: 1227977 - RNA, 19 nt, Homo sapiens
gcuaagaccggacagauug

SEQ ID NO: 1227978 - RNA, 19 nt, Homo sapiens
caucagaggaacuacuuua

SEQ ID NO: 1227979 - RNA, 19 nt, Homo sapiens
ucaggaacuucaagaacua

SEQ ID NO: 1227980 - RNA, 19 nt, Homo sapiens
ggaaauugaacccaucuug

SEQ ID NO: 1227981 - RNA, 19 nt, Homo sapiens
caucuauccuugcaaagaa

SEQ ID NO: 1227982 - RNA, 19 nt, Homo sapiens
aagggaacauugauucuuu

SEQ ID NO: 1227983 - RNA, 19 nt, Homo sapiens
caauauugauguuccaugu

SEQ ID NO: 1227984 - RNA, 19 nt, Homo sapiens
agucauaccugaagcaguu

SEQ ID NO: 1227985 - RNA, 19 nt, Homo sapiens
ggaauuuguacaugguuua

SEQ ID NO: 1227986 - RNA, 19 nt, Homo sapiens
gagacuggcucuguuugaa

SEQ ID NO: 1227987 - RNA, 19 nt, Homo sapiens
aagagacacuggaaauuga

SEQ ID NO: 1227988 - RNA, 19 nt, Homo sapiens
aaagcugacucucaacaaa

SEQ ID NO: 1227989 - RNA, 19 nt, Homo sapiens
cagcuuccauuguuacuga

SEQ ID NO: 1227990 - RNA, 19 nt, Homo sapiens
ggaugcaugugguccauau

SEQ ID NO: 1227991 - RNA, 19 nt, Homo sapiens
uaacagcugguuccaaauu

SEQ ID NO: 1227992 - RNA, 19 nt, Homo sapiens
agcaagauguacuucauua

SEQ ID NO: 1227993 - RNA, 19 nt, Homo sapiens
caaaagccaucuucacaaa

SEQ ID NO: 1227994 - RNA, 19 nt, Homo sapiens
gaaagggaucgugugguua

SEQ ID NO: 1227995 - RNA, 19 nt, Homo sapiens
uuacugagguuaacuuuac

SEQ ID NO: 1227996 - RNA, 19 nt, Homo sapiens
gcuauucguuuaguacaaa

SEQ ID NO: 1227997 - RNA, 19 nt, Homo sapiens
gaaaucuggucuaaugaac

SEQ ID NO: 1227998 - RNA, 19 nt, Homo sapiens
gcaucucuuugccuguuua

SEQ ID NO: 1227999 - RNA, 19 nt, Homo sapiens
aaaccagaauucaaaccua

SEQ ID NO: 1228000 - RNA, 19 nt, Homo sapiens
gaggacguauagacaacua

SEQ ID NO: 1228001 - RNA, 19 nt, Homo sapiens
caucccaacuuuacuccua

SEQ ID NO: 1228002 - RNA, 19 nt, Homo sapiens
gcaugagaaaccugauuua

SEQ ID NO: 1228003 - RNA, 19 nt, Homo sapiens
cagaggaacuacuuuacug

SEQ ID NO: 1228004 - RNA, 19 nt, Homo sapiens
gaucuccaauacugucauu

SEQ ID NO: 1228005 - RNA, 19 nt, Homo sapiens
gaaacuaaaccagaauuca

SEQ ID NO: 1228006 - RNA, 19 nt, Homo sapiens
caacauuauugacagacuu

SEQ ID NO: 1228007 - RNA, 19 nt, Homo sapiens
agaacuagcuaaugcugaa

SEQ ID NO: 1228008 - RNA, 19 nt, Homo sapiens
gcaagaagcaaagcuacaa

SEQ ID NO: 1228009 - RNA, 19 nt, Homo sapiens
gggaauuuguacaugguuu

SEQ ID NO: 1228010 - RNA, 19 nt, Homo sapiens
uuacuacagucaagucuga

SEQ ID NO: 1228011 - RNA, 19 nt, Homo sapiens
gaaaaggaauugaauacuc

SEQ ID NO: 1228012 - RNA, 19 nt, Homo sapiens
gaacuucaagaacuagcua

SEQ ID NO: 1228013 - RNA, 19 nt, Homo sapiens
uagccaagcucgaagaauc

SEQ ID NO: 1228014 - RNA, 19 nt, Homo sapiens
ggaaaggucgacugcaaga

SEQ ID NO: 1228015 - RNA, 19 nt, Homo sapiens
gauguacaaugggaauuug

SEQ ID NO: 1228016 - RNA, 19 nt, Homo sapiens
ucaagcugauuuagcaauu

SEQ ID NO: 1228017 - RNA, 19 nt, Homo sapiens
caaagagacacuggaaauu

SEQ ID NO: 1228018 - RNA, 19 nt, Homo sapiens
gcaagaguuuccaucuauc

SEQ ID NO: 1228019 - RNA, 19 nt, Homo sapiens
gaaagcugacucucaacaa

SEQ ID NO: 1228020 - RNA, 19 nt, Homo sapiens
gcaagcagugcacuuauuc

SEQ ID NO: 1228021 - RNA, 19 nt, Homo sapiens
cauccagacacauuucuua

SEQ ID NO: 1228022 - RNA, 19 nt, Homo sapiens
ccagaauucaaaccuaaua

SEQ ID NO: 1228023 - RNA, 19 nt, Homo sapiens
aaccagaauucaaaccuaa

SEQ ID NO: 1228024 - RNA, 19 nt, Homo sapiens
guucucagguuauuucaca

SEQ ID NO: 1228025 - RNA, 19 nt, Homo sapiens
caugaucaguucucagguu

SEQ ID NO: 1228026 - RNA, 19 nt, Homo sapiens
ucaaacauguggucagucu

SEQ ID NO: 1228027 - RNA, 19 nt, Homo sapiens
agaaagugccuccuccuaa

SEQ ID NO: 1228028 - RNA, 19 nt, Homo sapiens
ccuaauacaucagaaagug

SEQ ID NO: 1228029 - RNA, 19 nt, Homo sapiens
ugccaaagauguacaaugg

SEQ ID NO: 1228030 - RNA, 19 nt, Homo sapiens
ucaagagucacuuaaagaa

SEQ ID NO: 1228031 - RNA, 19 nt, Homo sapiens
aaagcaagcagugcacuua

SEQ ID NO: 1228032 - RNA, 19 nt, Homo sapiens
uggauagccuuaaauuugu

SEQ ID NO: 1228033 - RNA, 19 nt, Homo sapiens
cccagaagaucccuuacaa

SEQ ID NO: 1228034 - RNA, 19 nt, Homo sapiens
gaagaaacuaaaccagaau

SEQ ID NO: 1228035 - RNA, 19 nt, Homo sapiens
caagauugguguuuacuua

SEQ ID NO: 1228036 - RNA, 19 nt, Homo sapiens
caagagagguuugccuuua

SEQ ID NO: 1228037 - RNA, 19 nt, Homo sapiens
ggacuuggguguucuuauu

SEQ ID NO: 1228038 - RNA, 19 nt, Homo sapiens
gaacucaaauggaagcaaa

SEQ ID NO: 1228039 - RNA, 19 nt, Homo sapiens
gaagugacucuguuuaaua

SEQ ID NO: 1228040 - RNA, 19 nt, Homo sapiens
gcagauuacuuagacuuua

SEQ ID NO: 1228041 - RNA, 19 nt, Homo sapiens
gaaaugggauuggcucuug

SEQ ID NO: 1228042 - RNA, 19 nt, Homo sapiens
ccucuucacuucuuucuua

SEQ ID NO: 1228043 - RNA, 19 nt, Homo sapiens
gaauggaguuugcugugua

SEQ ID NO: 1228044 - RNA, 19 nt, Homo sapiens
gaaaagaccucccauuugu

SEQ ID NO: 1228045 - RNA, 19 nt, Homo sapiens
gaaacccugucucuacuaa

SEQ ID NO: 1228046 - RNA, 19 nt, Homo sapiens
uaaaugcucuuaaggcuau

SEQ ID NO: 1228047 - RNA, 19 nt, Homo sapiens
caaauuaguuagugguuga

SEQ ID NO: 1228048 - RNA, 19 nt, Homo sapiens
gaauauccuuugaccaguu

SEQ ID NO: 1228049 - RNA, 19 nt, Homo sapiens
gaagagcuacacagacuuu

SEQ ID NO: 1228050 - RNA, 19 nt, Homo sapiens
gauaugccauucaacauca

SEQ ID NO: 1228051 - RNA, 19 nt, Homo sapiens
caacacaccagucaucaaa

SEQ ID NO: 1228052 - RNA, 19 nt, Homo sapiens
gguaacagacaguacuuua

SEQ ID NO: 1228053 - RNA, 19 nt, Homo sapiens
ggcaagaacuauaggauca

SEQ ID NO: 1228054 - RNA, 19 nt, Homo sapiens
gcuauucgauguaauucuu

SEQ ID NO: 1228055 - RNA, 19 nt, Homo sapiens
gaucauccgggcugaguua

SEQ ID NO: 1228056 - RNA, 19 nt, Homo sapiens
ggguaacacucuaggauga

SEQ ID NO: 1228057 - RNA, 19 nt, Homo sapiens
guucuuagccugaaaucua

SEQ ID NO: 1228058 - RNA, 19 nt, Homo sapiens
ggugaaaccucgucuguac

SEQ ID NO: 1228059 - RNA, 19 nt, Homo sapiens
ucaccgagcuccuagacaa

SEQ ID NO: 1228060 - RNA, 19 nt, Homo sapiens
cccaaguucuuauacguua

SEQ ID NO: 1228061 - RNA, 19 nt, Homo sapiens
gagaagaccgugaaaauaa

SEQ ID NO: 1228062 - RNA, 19 nt, Homo sapiens
ccacugaggccuuguauuc

SEQ ID NO: 1228063 - RNA, 19 nt, Homo sapiens
gcagagagcgagagcuuug

SEQ ID NO: 1228064 - RNA, 19 nt, Homo sapiens
ucaaaguguucucggaauu

SEQ ID NO: 1228065 - RNA, 19 nt, Homo sapiens
uuucagagauucauuguuc

SEQ ID NO: 1228066 - RNA, 19 nt, Homo sapiens
guaacagacaguacuuuaa

SEQ ID NO: 1228067 - RNA, 19 nt, Homo sapiens
ccugaaaucuaaugcuuug

SEQ ID NO: 1228068 - RNA, 19 nt, Homo sapiens
uaacgugcuuggcugguuu

SEQ ID NO: 1228069 - RNA, 19 nt, Homo sapiens
gaccacgucugccuugaga

SEQ ID NO: 1228070 - RNA, 19 nt, Homo sapiens
aaaucgaacucaaauggaa

SEQ ID NO: 1228071 - RNA, 19 nt, Homo sapiens
caacagaggcaagaacuau

SEQ ID NO: 1228072 - RNA, 19 nt, Homo sapiens
acacagacuuuccuuguca

SEQ ID NO: 1228073 - RNA, 19 nt, Homo sapiens
aaggaucacucuguucaua

SEQ ID NO: 1228074 - RNA, 19 nt, Homo sapiens
uagcauaaaucgaacucaa

SEQ ID NO: 1228075 - RNA, 19 nt, Homo sapiens
acacugagcugacgcacau

SEQ ID NO: 1228076 - RNA, 19 nt, Homo sapiens
aagagagguuugccuuuaa

SEQ ID NO: 1228077 - RNA, 19 nt, Homo sapiens
ggccgagugugguggcuua

SEQ ID NO: 1228078 - RNA, 19 nt, Homo sapiens
ggacaucgaguacagauac

SEQ ID NO: 1228079 - RNA, 19 nt, Homo sapiens
ccaaaagccuguucaucua

SEQ ID NO: 1228080 - RNA, 19 nt, Homo sapiens
ggacauuugauuugcauau

SEQ ID NO: 1228081 - RNA, 19 nt, Homo sapiens
cccgaaagcucaaugacuu

SEQ ID NO: 1228082 - RNA, 19 nt, Homo sapiens
gaaccucgcauuugagaag

SEQ ID NO: 1228083 - RNA, 19 nt, Homo sapiens
caacaucaccgagcuccua

SEQ ID NO: 1228084 - RNA, 19 nt, Homo sapiens
ugaagugacucuguuuaau

SEQ ID NO: 1228085 - RNA, 19 nt, Homo sapiens
gcauaaaucgaacucaaau

SEQ ID NO: 1228086 - RNA, 19 nt, Homo sapiens
gaaaccucgucuguacuaa

SEQ ID NO: 1228087 - RNA, 19 nt, Homo sapiens
guguguauguaaagagaua

SEQ ID NO: 1228088 - RNA, 19 nt, Homo sapiens
ugguuugucucauucuuua

SEQ ID NO: 1228089 - RNA, 19 nt, Homo sapiens
ggaugggaaucaagccuau

SEQ ID NO: 1228090 - RNA, 19 nt, Homo sapiens
gcacugcgaagguucagaa

SEQ ID NO: 1228091 - RNA, 19 nt, Homo sapiens
uaaagucuguugguuagug

SEQ ID NO: 1228092 - RNA, 19 nt, Homo sapiens
gaagcacaguugccuggau

SEQ ID NO: 1228093 - RNA, 19 nt, Homo sapiens
gacccucacuguucauugu

SEQ ID NO: 1228094 - RNA, 19 nt, Homo sapiens
uuaaggcuauucgauguaa

SEQ ID NO: 1228095 - RNA, 19 nt, Homo sapiens
ugccuuaucuuacuaaagu

SEQ ID NO: 1228096 - RNA, 19 nt, Homo sapiens
gagugaaacugucucaaaa

SEQ ID NO: 1228097 - RNA, 19 nt, Homo sapiens
gugcuuggcugguuugucu

SEQ ID NO: 1228098 - RNA, 19 nt, Homo sapiens
ggaccggauuugggaauau

SEQ ID NO: 1228099 - RNA, 19 nt, Homo sapiens
ggaguuugcuguguacuac

SEQ ID NO: 1228100 - RNA, 19 nt, Homo sapiens
ggaucacucuguucauaag

SEQ ID NO: 1228101 - RNA, 19 nt, Homo sapiens
gacuaaggaucacucuguu

SEQ ID NO: 1228102 - RNA, 19 nt, Homo sapiens
uaaauuuggugaucagaac

SEQ ID NO: 1228103 - RNA, 19 nt, Homo sapiens
gcaggagaaucacuugaac

SEQ ID NO: 1228104 - RNA, 19 nt, Homo sapiens
uauccaauaucuccucgaa

SEQ ID NO: 1228105 - RNA, 19 nt, Homo sapiens
aggcggagcuuacagugaa

SEQ ID NO: 1228106 - RNA, 19 nt, Homo sapiens
ccuuuaagaucucaccaaa

SEQ ID NO: 1228107 - RNA, 19 nt, Homo sapiens
ggacacuuaugccgguuca

SEQ ID NO: 1228108 - RNA, 19 nt, Homo sapiens
gacauggacuuggguguuc

SEQ ID NO: 1228109 - RNA, 19 nt, Homo sapiens
ggacauggacuuggguguu

SEQ ID NO: 1228110 - RNA, 19 nt, Homo sapiens
aaaggauccucuucacuuc

SEQ ID NO: 1228111 - RNA, 19 nt, Homo sapiens
cgacuaaggaucacucugu

SEQ ID NO: 1228112 - RNA, 19 nt, Homo sapiens
uuggugaucagaacuauua

SEQ ID NO: 1228113 - RNA, 19 nt, Homo sapiens
ugaaaccucgucuguacua

SEQ ID NO: 1228114 - RNA, 19 nt, Homo sapiens
gcaacagaggcaagaacua

SEQ ID NO: 1228115 - RNA, 19 nt, Homo sapiens
gcaauggacagacguacug

SEQ ID NO: 1228116 - RNA, 19 nt, Homo sapiens
ggccugaagugacucuguu

SEQ ID NO: 1228117 - RNA, 19 nt, Homo sapiens
ucacucuguucauaagaaa

SEQ ID NO: 1228118 - RNA, 19 nt, Homo sapiens
gagauucauuguucuuaac

SEQ ID NO: 1228119 - RNA, 19 nt, Homo sapiens
cagcaaauccagccagguu

SEQ ID NO: 1228120 - RNA, 19 nt, Homo sapiens
aaauaaggaugacguucga

SEQ ID NO: 1228121 - RNA, 19 nt, Homo sapiens
gaagugcccuccccacaau

SEQ ID NO: 1228122 - RNA, 19 nt, Homo sapiens
gagaucacaccacugcauu

SEQ ID NO: 1228123 - RNA, 19 nt, Homo sapiens
ggugaaacccugucucuac

SEQ ID NO: 1228124 - RNA, 19 nt, Homo sapiens
gagcaacacaccagucauc

SEQ ID NO: 1228125 - RNA, 19 nt, Homo sapiens
gggauuggcucuuguuuuc

SEQ ID NO: 1228126 - RNA, 19 nt, Homo sapiens
ggacaucagucgccaaaag

SEQ ID NO: 1228127 - RNA, 19 nt, Homo sapiens
cagauuacuuagacuuuag

SEQ ID NO: 1228128 - RNA, 19 nt, Homo sapiens
cauguuacccgacuaagga

SEQ ID NO: 1228129 - RNA, 19 nt, Homo sapiens
aagcaaaacugauuucaug

SEQ ID NO: 1228130 - RNA, 19 nt, Homo sapiens
ccagguggguaacacucua

SEQ ID NO: 1228131 - RNA, 19 nt, Homo sapiens
uuuaagaugccuugacuuu

SEQ ID NO: 1228132 - RNA, 19 nt, Homo sapiens
aagcacaguugccuggauu

SEQ ID NO: 1228133 - RNA, 19 nt, Homo sapiens
gggcaagauugguguuuac

SEQ ID NO: 1228134 - RNA, 19 nt, Homo sapiens
gcaaauccagccagguuca

SEQ ID NO: 1228135 - RNA, 19 nt, Homo sapiens
gaccagagguucuucaaug

SEQ ID NO: 1228136 - RNA, 19 nt, Homo sapiens
gcacaacucucaugguuuu

SEQ ID NO: 1228137 - RNA, 19 nt, Homo sapiens
ggaccaagcugcagaaucc

SEQ ID NO: 1228138 - RNA, 19 nt, Homo sapiens
gcaaagagagaccuuccua

SEQ ID NO: 1228139 - RNA, 19 nt, Homo sapiens
gagcugcgccugauacuga

SEQ ID NO: 1228140 - RNA, 19 nt, Homo sapiens
cuuuaaagcucaugugaaa

SEQ ID NO: 1228141 - RNA, 19 nt, Homo sapiens
ggacuuugcugccuuucga

SEQ ID NO: 1228142 - RNA, 19 nt, Homo sapiens
ccaaggaagugguccaguu

SEQ ID NO: 1228143 - RNA, 19 nt, Homo sapiens
gcaaggagcugcgccugau

SEQ ID NO: 1228144 - RNA, 19 nt, Homo sapiens
ggaggacuuugcugccuuu

SEQ ID NO: 1228145 - RNA, 19 nt, Homo sapiens
uacgaaaccuagcggauaa

SEQ ID NO: 1228146 - RNA, 19 nt, Homo sapiens
caacagaaccaucucaagu

SEQ ID NO: 1228147 - RNA, 19 nt, Homo sapiens
agagagaccuuccuaagag

SEQ ID NO: 1228148 - RNA, 19 nt, Homo sapiens
ccagccaguuugugaauga

SEQ ID NO: 1228149 - RNA, 19 nt, Homo sapiens
gggagagugugcuacgaaa

SEQ ID NO: 1228150 - RNA, 19 nt, Homo sapiens
guggagaaguccucuguca

SEQ ID NO: 1228151 - RNA, 19 nt, Homo sapiens
caaagagagaccuuccuaa

SEQ ID NO: 1228152 - RNA, 19 nt, Homo sapiens
cugcacaacucucaugguu

SEQ ID NO: 1228153 - RNA, 19 nt, Homo sapiens
gugaugauguuuguuuaug

SEQ ID NO: 1228154 - RNA, 19 nt, Homo sapiens
cuacgaaaccuagcggaua

SEQ ID NO: 1228155 - RNA, 19 nt, Homo sapiens
gaugauguuuguuuaugag

SEQ ID NO: 1228156 - RNA, 19 nt, Homo sapiens
caaggaagugguccaguug

SEQ ID NO: 1228157 - RNA, 19 nt, Homo sapiens
ugacaucccauccuuggaa

SEQ ID NO: 1228158 - RNA, 19 nt, Homo sapiens
ccgugaugauguuuguuua

SEQ ID NO: 1228159 - RNA, 19 nt, Homo sapiens
ugaguuagguccgacuguu

SEQ ID NO: 1228160 - RNA, 19 nt, Homo sapiens
gggagcaggcaauaucuga

SEQ ID NO: 1228161 - RNA, 19 nt, Homo sapiens
gcucgucgcugcuguuucc

SEQ ID NO: 1228162 - RNA, 19 nt, Homo sapiens
guucguuggugcuuaagau

SEQ ID NO: 1228163 - RNA, 19 nt, Homo sapiens
aaagagagaccuuccuaag

SEQ ID NO: 1228164 - RNA, 19 nt, Homo sapiens
gcuguucccugcacaacuc

SEQ ID NO: 1228165 - RNA, 19 nt, Homo sapiens
ggcaggccgugaugauguu

SEQ ID NO: 1228166 - RNA, 19 nt, Homo sapiens
aagagagaccuuccuaaga

SEQ ID NO: 1228167 - RNA, 19 nt, Homo sapiens
acccugaggugcccuuuga

SEQ ID NO: 1228168 - RNA, 19 nt, Homo sapiens
gggcaggccgugaugaugu

SEQ ID NO: 1228169 - RNA, 19 nt, Homo sapiens
gccgugaugauguuuguuu

SEQ ID NO: 1228170 - RNA, 19 nt, Homo sapiens
caucuuccacaucuuuaaa

SEQ ID NO: 1228171 - RNA, 19 nt, Homo sapiens
gcaacagaaccaucucaag

SEQ ID NO: 1228172 - RNA, 19 nt, Homo sapiens
gccagaagauaaggaccaa

SEQ ID NO: 1228173 - RNA, 19 nt, Homo sapiens
gagcaggcaauaucugaag

SEQ ID NO: 1228174 - RNA, 19 nt, Homo sapiens
caaggagcugcgccugaua

SEQ ID NO: 1228175 - RNA, 19 nt, Homo sapiens
acccugagccagaagauaa

SEQ ID NO: 1228176 - RNA, 19 nt, Homo sapiens
ggaccagagguucuucaau

SEQ ID NO: 1228177 - RNA, 19 nt, Homo sapiens
ggagcaggcaauaucugaa

SEQ ID NO: 1228178 - RNA, 19 nt, Homo sapiens
ggaccucagccucuuagca

SEQ ID NO: 1228179 - RNA, 19 nt, Homo sapiens
uagcggauaaggccuuuga

SEQ ID NO: 1228180 - RNA, 19 nt, Homo sapiens
ccacaucuuuaaagcucau

SEQ ID NO: 1228181 - RNA, 19 nt, Homo sapiens
acuguucguuggugcuuaa

SEQ ID NO: 1228182 - RNA, 19 nt, Homo sapiens
ggacacgaagggcaaagag

SEQ ID NO: 1228183 - RNA, 19 nt, Homo sapiens
ggucuaccuccucgccuuu

SEQ ID NO: 1228184 - RNA, 19 nt, Homo sapiens
gacuguucguuggugcuua

SEQ ID NO: 1228185 - RNA, 19 nt, Homo sapiens
aggcugacaucccauccuu

SEQ ID NO: 1228186 - RNA, 19 nt, Homo sapiens
gcaggaguaccagcaguuc

SEQ ID NO: 1228187 - RNA, 19 nt, Homo sapiens
ugacagggcaggccgugau

SEQ ID NO: 1228188 - RNA, 19 nt, Homo sapiens
guucagggagagugugcua

SEQ ID NO: 1228189 - RNA, 19 nt, Homo sapiens
gacacgaagggcaaagaga

SEQ ID NO: 1228190 - RNA, 19 nt, Homo sapiens
cagaguggaggacgcuuug

SEQ ID NO: 1228191 - RNA, 19 nt, Homo sapiens
uaaggaccaagcugcagaa

SEQ ID NO: 1228192 - RNA, 19 nt, Homo sapiens
gacccugagccagaagaua

SEQ ID NO: 1228193 - RNA, 19 nt, Homo sapiens
gggcgcaagucccgcaaaa

SEQ ID NO: 1228194 - RNA, 19 nt, Homo sapiens
cacgcuagcugggugacuu

SEQ ID NO: 1228195 - RNA, 19 nt, Homo sapiens
cagaccugcuggagcuaug

SEQ ID NO: 1228196 - RNA, 19 nt, Homo sapiens
gaguuagguccgacuguuc

SEQ ID NO: 1228197 - RNA, 19 nt, Homo sapiens
gagcagcacucuuaacuua

SEQ ID NO: 1228198 - RNA, 19 nt, Homo sapiens
gcuagucccugccugaaua

SEQ ID NO: 1228199 - RNA, 19 nt, Homo sapiens
ggaagagucugacccuguu

SEQ ID NO: 1228200 - RNA, 19 nt, Homo sapiens
gcagacaucauugguguua

SEQ ID NO: 1228201 - RNA, 19 nt, Homo sapiens
gaaugccgcuagucucuga

SEQ ID NO: 1228202 - RNA, 19 nt, Homo sapiens
caaagucccuggcccucua

SEQ ID NO: 1228203 - RNA, 19 nt, Homo sapiens
aauggaggcuguaggaaua

SEQ ID NO: 1228204 - RNA, 19 nt, Homo sapiens
gggaauuccuggagucuga

SEQ ID NO: 1228205 - RNA, 19 nt, Homo sapiens
cuuacgaucucuugacaua

SEQ ID NO: 1228206 - RNA, 19 nt, Homo sapiens
gaauggaggcuguaggaau

SEQ ID NO: 1228207 - RNA, 19 nt, Homo sapiens
gggccagggucuucuguug

SEQ ID NO: 1228208 - RNA, 19 nt, Homo sapiens
ggaaggaggaggugguaga

SEQ ID NO: 1228209 - RNA, 19 nt, Homo sapiens
ggacagugcugagccuucu

SEQ ID NO: 1228210 - RNA, 19 nt, Homo sapiens
gaggagagcagagaagaga

SEQ ID NO: 1228211 - RNA, 19 nt, Homo sapiens
gcccagaggcuucuccaaa

SEQ ID NO: 1228212 - RNA, 19 nt, Homo sapiens
agacaucauugguguuaau

SEQ ID NO: 1228213 - RNA, 19 nt, Homo sapiens
ucuccgagcugccuggaaa

SEQ ID NO: 1228214 - RNA, 19 nt, Homo sapiens
ugggauggcuggaguggaa

SEQ ID NO: 1228215 - RNA, 19 nt, Homo sapiens
ggagcagucugaggaagug

SEQ ID NO: 1228216 - RNA, 19 nt, Homo sapiens
gcagaacuggcucaggaaa

SEQ ID NO: 1228217 - RNA, 19 nt, Homo sapiens
ccaaagggagggugacaug

SEQ ID NO: 1228218 - RNA, 19 nt, Homo sapiens
cucaggagcagcacucuua

SEQ ID NO: 1228219 - RNA, 19 nt, Homo sapiens
ggagucugauucugugagu

SEQ ID NO: 1228220 - RNA, 19 nt, Homo sapiens
guaaugccuccgcuucaaa

SEQ ID NO: 1228221 - RNA, 19 nt, Homo sapiens
gaaaagggguguggcaaag

SEQ ID NO: 1228222 - RNA, 19 nt, Homo sapiens
gcagcacucuuaacuuacg

SEQ ID NO: 1228223 - RNA, 19 nt, Homo sapiens
agaggaagcugaggaggau

SEQ ID NO: 1228224 - RNA, 19 nt, Homo sapiens
ggaggcuguaggaauauaa

SEQ ID NO: 1228225 - RNA, 19 nt, Homo sapiens
agagagcccugagcccaaa

SEQ ID NO: 1228226 - RNA, 19 nt, Homo sapiens
gagcagggagagcugaaug

SEQ ID NO: 1228227 - RNA, 19 nt, Homo sapiens
gaagagucugacccuguuu

SEQ ID NO: 1228228 - RNA, 19 nt, Homo sapiens
ggagcaggguggcuucacu

SEQ ID NO: 1228229 - RNA, 19 nt, Homo sapiens
ggagcagcacucuuaacuu

SEQ ID NO: 1228230 - RNA, 19 nt, Homo sapiens
ggagagggagaacaaaguc

SEQ ID NO: 1228231 - RNA, 19 nt, Homo sapiens
cccagaggcuucuccaaag

SEQ ID NO: 1228232 - RNA, 19 nt, Homo sapiens
caaggaaugccgcuagucu

SEQ ID NO: 1228233 - RNA, 19 nt, Homo sapiens
agggugacaugcuggcuuu

SEQ ID NO: 1228234 - RNA, 19 nt, Homo sapiens
ccagaggcuucuccaaagg

SEQ ID NO: 1228235 - RNA, 19 nt, Homo sapiens
cagcugaaucccgauagua

SEQ ID NO: 1228236 - RNA, 19 nt, Homo sapiens
acucuuaacuuacgaucuc

SEQ ID NO: 1228237 - RNA, 19 nt, Homo sapiens
gcagagaggccugguugag

SEQ ID NO: 1228238 - RNA, 19 nt, Homo sapiens
gcaguagugcaccaucuca

SEQ ID NO: 1228239 - RNA, 19 nt, Homo sapiens
ucagagggaaggagauaga

SEQ ID NO: 1228240 - RNA, 19 nt, Homo sapiens
gucccugccugaauaaagu

SEQ ID NO: 1228241 - RNA, 19 nt, Homo sapiens
ccaucucacugcaguagca

SEQ ID NO: 1228242 - RNA, 19 nt, Homo sapiens
uaaccucccacccugcaaa

SEQ ID NO: 1228243 - RNA, 19 nt, Homo sapiens
uggccagggucccaacuug

SEQ ID NO: 1228244 - RNA, 19 nt, Homo sapiens
ucucuugccugcuccaucu

SEQ ID NO: 1228245 - RNA, 19 nt, Homo sapiens
gagccuacuccaagaaugg

SEQ ID NO: 1228246 - RNA, 19 nt, Homo sapiens
uggaggcuguaggaauaua

SEQ ID NO: 1228247 - RNA, 19 nt, Homo sapiens
gggaggagagcagagaaga

SEQ ID NO: 1228248 - RNA, 19 nt, Homo sapiens
ugagggagccagugugaag

SEQ ID NO: 1228249 - RNA, 19 nt, Homo sapiens
guugagggagccaguguga

SEQ ID NO: 1228250 - RNA, 19 nt, Homo sapiens
cugcaaagggaaucucuug

SEQ ID NO: 1228251 - RNA, 19 nt, Homo sapiens
aagaauggaggcuguagga

SEQ ID NO: 1228252 - RNA, 19 nt, Homo sapiens
ggaagcugaggaggaugua

SEQ ID NO: 1228253 - RNA, 19 nt, Homo sapiens
uggaagggccuagaaagga

SEQ ID NO: 1228254 - RNA, 19 nt, Homo sapiens
ggaugaggcagagcugaau

SEQ ID NO: 1228255 - RNA, 19 nt, Homo sapiens
aguaaugccuccgcuucaa

SEQ ID NO: 1228256 - RNA, 19 nt, Homo sapiens
ggugacggcacucccaugu

SEQ ID NO: 1228257 - RNA, 19 nt, Homo sapiens
gaaggaggaggugguagag

SEQ ID NO: 1228258 - RNA, 19 nt, Homo sapiens
cagacaucauugguguuaa

SEQ ID NO: 1228259 - RNA, 19 nt, Homo sapiens
gaauuccuggagucugauu

SEQ ID NO: 1228260 - RNA, 19 nt, Homo sapiens
cugaaucccgauaguacua

SEQ ID NO: 1228261 - RNA, 19 nt, Homo sapiens
gcuuggaagggccuagaaa

SEQ ID NO: 1228262 - RNA, 19 nt, Homo sapiens
caucucauaggcuaaguca

SEQ ID NO: 1228263 - RNA, 19 nt, Homo sapiens
auggagggcugcagaacug

SEQ ID NO: 1228264 - RNA, 19 nt, Homo sapiens
uaacuuacgaucucuugac

SEQ ID NO: 1228265 - RNA, 19 nt, Homo sapiens
ucaggagcagcacucuuaa

SEQ ID NO: 1228266 - RNA, 19 nt, Homo sapiens
agagcgagcaggaggaguu

SEQ ID NO: 1228267 - RNA, 19 nt, Homo sapiens
ucagcugaaucccgauagu

SEQ ID NO: 1228268 - RNA, 19 nt, Homo sapiens
agucugacccuguuuccuu

SEQ ID NO: 1228269 - RNA, 19 nt, Homo sapiens
gaccagggaagaggugaug

SEQ ID NO: 1228270 - RNA, 19 nt, Homo sapiens
gaaaguacauuguggauug

SEQ ID NO: 1228271 - RNA, 19 nt, Homo sapiens
gaacagauugccucaaaua

SEQ ID NO: 1228272 - RNA, 19 nt, Homo sapiens
ggaagaaguuuaugauuca

SEQ ID NO: 1228273 - RNA, 19 nt, Homo sapiens
caacuagaaucccuuauga

SEQ ID NO: 1228274 - RNA, 19 nt, Homo sapiens
gcacgacacuggaaugcua

SEQ ID NO: 1228275 - RNA, 19 nt, Homo sapiens
gagcacaguuccucaguuu

SEQ ID NO: 1228276 - RNA, 19 nt, Homo sapiens
uagaaucccuuaugaagaa

SEQ ID NO: 1228277 - RNA, 19 nt, Homo sapiens
gaagauacuccuuuccuuu

SEQ ID NO: 1228278 - RNA, 19 nt, Homo sapiens
cagauugccucaaauacua

SEQ ID NO: 1228279 - RNA, 19 nt, Homo sapiens
gaaagaggaggcauauuug

SEQ ID NO: 1228280 - RNA, 19 nt, Homo sapiens
ccucaaacauucauuucua

SEQ ID NO: 1228281 - RNA, 19 nt, Homo sapiens
gccaagagacaacaaauaa

SEQ ID NO: 1228282 - RNA, 19 nt, Homo sapiens
agaaagaggaggcauauuu

SEQ ID NO: 1228283 - RNA, 19 nt, Homo sapiens
ccaaccggcugcuuacuuu

SEQ ID NO: 1228284 - RNA, 19 nt, Homo sapiens
ugaagaaucuaguguguuc

SEQ ID NO: 1228285 - RNA, 19 nt, Homo sapiens
gcacaguuccucaguuuga

SEQ ID NO: 1228286 - RNA, 19 nt, Homo sapiens
ggaggaaggugaacauguc

SEQ ID NO: 1228287 - RNA, 19 nt, Homo sapiens
gugaacaugucaaaccuuu

SEQ ID NO: 1228288 - RNA, 19 nt, Homo sapiens
aguauaaacucauggauug

SEQ ID NO: 1228289 - RNA, 19 nt, Homo sapiens
gaaacuacauguaauuacg

SEQ ID NO: 1228290 - RNA, 19 nt, Homo sapiens
gaacaugucaaaccuuuua

SEQ ID NO: 1228291 - RNA, 19 nt, Homo sapiens
caagagacaacaaauaaug

SEQ ID NO: 1228292 - RNA, 19 nt, Homo sapiens
ggacaaggauggagaacac

SEQ ID NO: 1228293 - RNA, 19 nt, Homo sapiens
gcacagagguccgaagaac

SEQ ID NO: 1228294 - RNA, 19 nt, Homo sapiens
gauacaaggaagaaguuua

SEQ ID NO: 1228295 - RNA, 19 nt, Homo sapiens
caucugagguaguagaaau

SEQ ID NO: 1228296 - RNA, 19 nt, Homo sapiens
caucuggacuccuaugguu

SEQ ID NO: 1228297 - RNA, 19 nt, Homo sapiens
acaacaaccugcaaucuuc

SEQ ID NO: 1228298 - RNA, 19 nt, Homo sapiens
gaacaucugagguaguaga

SEQ ID NO: 1228299 - RNA, 19 nt, Homo sapiens
aaucuaguguguucaguaa

SEQ ID NO: 1228300 - RNA, 19 nt, Homo sapiens
aaauguaagucccaaguau

SEQ ID NO: 1228301 - RNA, 19 nt, Homo sapiens
caacaaauaaugagcaaca

SEQ ID NO: 1228302 - RNA, 19 nt, Homo sapiens
ccacugagguugaggaaac

SEQ ID NO: 1228303 - RNA, 19 nt, Homo sapiens
gcucaaagacaugcgguua

SEQ ID NO: 1228304 - RNA, 19 nt, Homo sapiens
gaaauggacaggaaaguac

SEQ ID NO: 1228305 - RNA, 19 nt, Homo sapiens
guuccucucucaucccaua

SEQ ID NO: 1228306 - RNA, 19 nt, Homo sapiens
cuacuuaaaugcagcuguu

SEQ ID NO: 1228307 - RNA, 19 nt, Homo sapiens
gaacuugaccacaggaaca

SEQ ID NO: 1228308 - RNA, 19 nt, Homo sapiens
uggaagaaauggacaggaa

SEQ ID NO: 1228309 - RNA, 19 nt, Homo sapiens
aggaagaaguuuaugauuc

SEQ ID NO: 1228310 - RNA, 19 nt, Homo sapiens
aggaacagauugccucaaa

SEQ ID NO: 1228311 - RNA, 19 nt, Homo sapiens
gacaacaaauaaugagcaa

SEQ ID NO: 1228312 - RNA, 19 nt, Homo sapiens
gcagagaauccacaaaaua

SEQ ID NO: 1228313 - RNA, 19 nt, Homo sapiens
ggaacagauugccucaaau

SEQ ID NO: 1228314 - RNA, 19 nt, Homo sapiens
ggacagguucucuuuguuc

SEQ ID NO: 1228315 - RNA, 19 nt, Homo sapiens
caggacagguucucuuugu

SEQ ID NO: 1228316 - RNA, 19 nt, Homo sapiens
ccggaaagcucaaagacau

SEQ ID NO: 1228317 - RNA, 19 nt, Homo sapiens
gaaucuaguguguucagua

SEQ ID NO: 1228318 - RNA, 19 nt, Homo sapiens
aagauacuccuuuccuuua

SEQ ID NO: 1228319 - RNA, 19 nt, Homo sapiens
gacacuggaaugcuaaaua

SEQ ID NO: 1228320 - RNA, 19 nt, Homo sapiens
ggaaggugaacaugucaaa

SEQ ID NO: 1228321 - RNA, 19 nt, Homo sapiens
ggacaggaaaguacauugu

SEQ ID NO: 1228322 - RNA, 19 nt, Homo sapiens
uaguauuucuggaccauuu

SEQ ID NO: 1228323 - RNA, 19 nt, Homo sapiens
uagccugugucaaauguaa

SEQ ID NO: 1228324 - RNA, 19 nt, Homo sapiens
ggaggcauauuuggaagug

SEQ ID NO: 1228325 - RNA, 19 nt, Homo sapiens
gaggugggccaaacaggua

SEQ ID NO: 1228326 - RNA, 19 nt, Homo sapiens
guagaaauccaagcacuga

SEQ ID NO: 1228327 - RNA, 19 nt, Homo sapiens
ggaagaaauggacaggaaa

SEQ ID NO: 1228328 - RNA, 19 nt, Homo sapiens
caaauguaagucccaagua

SEQ ID NO: 1228329 - RNA, 19 nt, Homo sapiens
ucaaagacaugcgguuaca

SEQ ID NO: 1228330 - RNA, 19 nt, Homo sapiens
ugaagauacuccuuuccuu

SEQ ID NO: 1228331 - RNA, 19 nt, Homo sapiens
gaugugaaauggucugacu

SEQ ID NO: 1228332 - RNA, 19 nt, Homo sapiens
cuacgacuccucaaacauu

SEQ ID NO: 1228333 - RNA, 19 nt, Homo sapiens
ggagaacacuuuggaaaau

SEQ ID NO: 1228334 - RNA, 19 nt, Homo sapiens
ggaggcagcaagucccuuu

SEQ ID NO: 1228335 - RNA, 19 nt, Homo sapiens
gaaauccaagcacugagaa

SEQ ID NO: 1228336 - RNA, 19 nt, Homo sapiens
uaacuugguauuccaggua

SEQ ID NO: 1228337 - RNA, 19 nt, Homo sapiens
ugugaccagucuaguauuu

SEQ ID NO: 1228338 - RNA, 19 nt, Homo sapiens
ugauucaaguggaagauga

SEQ ID NO: 1228339 - RNA, 19 nt, Homo sapiens
acacuggaaugcuaaauac

SEQ ID NO: 1228340 - RNA, 19 nt, Homo sapiens
caaggaagaaguuuaugau

SEQ ID NO: 1228341 - RNA, 19 nt, Homo sapiens
uaugaagaaucuagugugu

SEQ ID NO: 1228342 - RNA, 19 nt, Homo sapiens
gaagaaauggacaggaaag

SEQ ID NO: 1228343 - RNA, 19 nt, Homo sapiens
gggaccaaccggcugcuua

SEQ ID NO: 1228344 - RNA, 19 nt, Homo sapiens
ucaguuugcacauuuguaa

SEQ ID NO: 1228345 - RNA, 19 nt, Homo sapiens
aaggucaguuugcacauuu

SEQ ID NO: 1228346 - RNA, 19 nt, Homo sapiens
guauuuauccuuaccgaau

SEQ ID NO: 1228347 - RNA, 19 nt, Homo sapiens
ccaaacagguagccagaac

SEQ ID NO: 1228348 - RNA, 19 nt, Homo sapiens
aaccugcaaucuucuguaa

SEQ ID NO: 1228349 - RNA, 19 nt, Homo sapiens
gaacagauggagagcacau

SEQ ID NO: 1228350 - RNA, 19 nt, Homo sapiens
gagauuaugaccauuccaa

SEQ ID NO: 1228351 - RNA, 19 nt, Homo sapiens
guacaaggaaggaaacgau

SEQ ID NO: 1228352 - RNA, 19 nt, Homo sapiens
ccugucaucuggacuccua

SEQ ID NO: 1228353 - RNA, 19 nt, Homo sapiens
ggaaaguacauuguggauu

SEQ ID NO: 1228354 - RNA, 19 nt, Homo sapiens
ccugcaaucuucuguaaca

SEQ ID NO: 1228355 - RNA, 19 nt, Homo sapiens
uggcugcucuuuguuugua

SEQ ID NO: 1228356 - RNA, 19 nt, Homo sapiens
aaaggucaguuugcacauu

SEQ ID NO: 1228357 - RNA, 19 nt, Homo sapiens
caaggauggagaacacuuu

SEQ ID NO: 1228358 - RNA, 19 nt, Homo sapiens
agaaccgccuucagaaaga

SEQ ID NO: 1228359 - RNA, 19 nt, Homo sapiens
gcucuuuguuuguaagcuu

SEQ ID NO: 1228360 - RNA, 19 nt, Homo sapiens
auaaugagcaacagugaaa

SEQ ID NO: 1228361 - RNA, 19 nt, Homo sapiens
agaaauggacaggaaagua

SEQ ID NO: 1228362 - RNA, 19 nt, Homo sapiens
aagcagauacgauucagaa

SEQ ID NO: 1228363 - RNA, 19 nt, Homo sapiens
gcuugugugugcccugaaa

SEQ ID NO: 1228364 - RNA, 19 nt, Homo sapiens
ccaacuagaaucccuuaug

SEQ ID NO: 1228365 - RNA, 19 nt, Homo sapiens
acaaggaagaaguuuauga

SEQ ID NO: 1228366 - RNA, 19 nt, Homo sapiens
ggauggagaacacuuugga

SEQ ID NO: 1228367 - RNA, 19 nt, Homo sapiens
gagaacacuuuggaaaauu

SEQ ID NO: 1228368 - RNA, 19 nt, Homo sapiens
gaccacaggaacagacaaa

SEQ ID NO: 1228369 - RNA, 19 nt, Homo sapiens
acagguagccagaacuuga

SEQ ID NO: 1228370 - RNA, 19 nt, Homo sapiens
gaacaacacuuaucguuau

SEQ ID NO: 1228371 - RNA, 19 nt, Homo sapiens
gaagacaauuuccaguuua

SEQ ID NO: 1228372 - RNA, 19 nt, Homo sapiens
gaaauuaccucagaagaau

SEQ ID NO: 1228373 - RNA, 19 nt, Homo sapiens
gcagggaaauauauaaaga

SEQ ID NO: 1228374 - RNA, 19 nt, Homo sapiens
gcaauugucugguccuuca

SEQ ID NO: 1228375 - RNA, 19 nt, Homo sapiens
guaggaaaccagacuaaua

SEQ ID NO: 1228376 - RNA, 19 nt, Homo sapiens
caacacuuaucguuaugua

SEQ ID NO: 1228377 - RNA, 19 nt, Homo sapiens
ggaagaaauuaccucagaa

SEQ ID NO: 1228378 - RNA, 19 nt, Homo sapiens
ugaugaauguuacagguua

SEQ ID NO: 1228379 - RNA, 19 nt, Homo sapiens
ccaccgaaaucacuggaua

SEQ ID NO: 1228380 - RNA, 19 nt, Homo sapiens
gaagaauaccuuguacuuu

SEQ ID NO: 1228381 - RNA, 19 nt, Homo sapiens
ggaagaauaccuuguacuu

SEQ ID NO: 1228382 - RNA, 19 nt, Homo sapiens
ggaggguuccuacuuguua

SEQ ID NO: 1228383 - RNA, 19 nt, Homo sapiens
agaagacaauuuccaguuu

SEQ ID NO: 1228384 - RNA, 19 nt, Homo sapiens
caacuaaaauggaauggua

SEQ ID NO: 1228385 - RNA, 19 nt, Homo sapiens
cuuauggacugaaaguuua

SEQ ID NO: 1228386 - RNA, 19 nt, Homo sapiens
ggaggaucuugauauguuu

SEQ ID NO: 1228387 - RNA, 19 nt, Homo sapiens
guaccagaauugcccuuaa

SEQ ID NO: 1228388 - RNA, 19 nt, Homo sapiens
uagauaaguuugagggaaa

SEQ ID NO: 1228389 - RNA, 19 nt, Homo sapiens
auucuucacuccugauuua

SEQ ID NO: 1228390 - RNA, 19 nt, Homo sapiens
uggaagaaauuaccucaga

SEQ ID NO: 1228391 - RNA, 19 nt, Homo sapiens
gaugaauguuacagguuaa

SEQ ID NO: 1228392 - RNA, 19 nt, Homo sapiens
cacucaagauuuccaauuu

SEQ ID NO: 1228393 - RNA, 19 nt, Homo sapiens
gcacucaagauuuccaauu

SEQ ID NO: 1228394 - RNA, 19 nt, Homo sapiens
uagaguaucaagcuuguua

SEQ ID NO: 1228395 - RNA, 19 nt, Homo sapiens
gacaagaccacguucuaaa

SEQ ID NO: 1228396 - RNA, 19 nt, Homo sapiens
gaacuucaggauuauguug

SEQ ID NO: 1228397 - RNA, 19 nt, Homo sapiens
uggauggccuucugcauuu

SEQ ID NO: 1228398 - RNA, 19 nt, Homo sapiens
gaaaguuuauugcauucca

SEQ ID NO: 1228399 - RNA, 19 nt, Homo sapiens
gagacaagaccacguucua

SEQ ID NO: 1228400 - RNA, 19 nt, Homo sapiens
aaaggacgauugccauaug

SEQ ID NO: 1228401 - RNA, 19 nt, Homo sapiens
ccugaagagucauguguuu

SEQ ID NO: 1228402 - RNA, 19 nt, Homo sapiens
cuucacuccugauuuauaa

SEQ ID NO: 1228403 - RNA, 19 nt, Homo sapiens
ugaggaggaucuugauaug

SEQ ID NO: 1228404 - RNA, 19 nt, Homo sapiens
uguuguggguucuaacuua

SEQ ID NO: 1228405 - RNA, 19 nt, Homo sapiens
gcuuauggacugaaaguuu

SEQ ID NO: 1228406 - RNA, 19 nt, Homo sapiens
agaacaacacuuaucguua

SEQ ID NO: 1228407 - RNA, 19 nt, Homo sapiens
aggaggaucuugauauguu

SEQ ID NO: 1228408 - RNA, 19 nt, Homo sapiens
gcuaugugaaggaauauuu

SEQ ID NO: 1228409 - RNA, 19 nt, Homo sapiens
uagcuagagugccuugaaa

SEQ ID NO: 1228410 - RNA, 19 nt, Homo sapiens
uaacauccuccaacacauu

SEQ ID NO: 1228411 - RNA, 19 nt, Homo sapiens
cagaauugcccuuaaugaa

SEQ ID NO: 1228412 - RNA, 19 nt, Homo sapiens
uauaaggccucugauggaa

SEQ ID NO: 1228413 - RNA, 19 nt, Homo sapiens
gaagaaauuaccucagaag

SEQ ID NO: 1228414 - RNA, 19 nt, Homo sapiens
guuguggguucuaacuuaa

SEQ ID NO: 1228415 - RNA, 19 nt, Homo sapiens
agaaauuaccucagaagaa

SEQ ID NO: 1228416 - RNA, 19 nt, Homo sapiens
ccacugcugaagaugauua

SEQ ID NO: 1228417 - RNA, 19 nt, Homo sapiens
cauggaagaauaccuugua

SEQ ID NO: 1228418 - RNA, 19 nt, Homo sapiens
ggacugaaaguuuauugca

SEQ ID NO: 1228419 - RNA, 19 nt, Homo sapiens
gaacuuugucgcuuaugga

SEQ ID NO: 1228420 - RNA, 19 nt, Homo sapiens
gaagauacaucggaauacc

SEQ ID NO: 1228421 - RNA, 19 nt, Homo sapiens
gaagagucauguguuuuaa

SEQ ID NO: 1228422 - RNA, 19 nt, Homo sapiens
uuucagcacucaagauuuc

SEQ ID NO: 1228423 - RNA, 19 nt, Homo sapiens
uaggacagcauacaauuug

SEQ ID NO: 1228424 - RNA, 19 nt, Homo sapiens
uaaguuauuuagccugcaa

SEQ ID NO: 1228425 - RNA, 19 nt, Homo sapiens
cagaccagcuaguccaaau

SEQ ID NO: 1228426 - RNA, 19 nt, Homo sapiens
gaguugaagcucugacuga

SEQ ID NO: 1228427 - RNA, 19 nt, Homo sapiens
cagaagacaauuuccaguu

SEQ ID NO: 1228428 - RNA, 19 nt, Homo sapiens
ccagaauugcccuuaauga

SEQ ID NO: 1228429 - RNA, 19 nt, Homo sapiens
gaucccagccuguuauuac

SEQ ID NO: 1228430 - RNA, 19 nt, Homo sapiens
gaggguuccuacuuguuau

SEQ ID NO: 1228431 - RNA, 19 nt, Homo sapiens
gacaauuuccaguuuaugu

SEQ ID NO: 1228432 - RNA, 19 nt, Homo sapiens
ggauuauguugaagauaca

SEQ ID NO: 1228433 - RNA, 19 nt, Homo sapiens
uaucauggcagggaaauau

SEQ ID NO: 1228434 - RNA, 19 nt, Homo sapiens
guaggcaagaggaacauuu

SEQ ID NO: 1228435 - RNA, 19 nt, Homo sapiens
agaauugcccuuaaugaau

SEQ ID NO: 1228436 - RNA, 19 nt, Homo sapiens
uaccagaauugcccuuaau

SEQ ID NO: 1228437 - RNA, 19 nt, Homo sapiens
gaccagcuaguccaaauuc

SEQ ID NO: 1228438 - RNA, 19 nt, Homo sapiens
ugaagaugauuaugagcau

SEQ ID NO: 1228439 - RNA, 19 nt, Homo sapiens
guuccuacuuguuaucuca

SEQ ID NO: 1228440 - RNA, 19 nt, Homo sapiens
ucgaugcauuuacuucaaa

SEQ ID NO: 1228441 - RNA, 19 nt, Homo sapiens
caguuuauguacuaccaaa

SEQ ID NO: 1228442 - RNA, 19 nt, Homo sapiens
ccagaaaaguaccagaauu

SEQ ID NO: 1228443 - RNA, 19 nt, Homo sapiens
uuaguuauauugccagucu

SEQ ID NO: 1228444 - RNA, 19 nt, Homo sapiens
agacuaauacugcuuguag

SEQ ID NO: 1228445 - RNA, 19 nt, Homo sapiens
ggaaaccagacuaauacug

SEQ ID NO: 1228446 - RNA, 19 nt, Homo sapiens
aaugcaggaugagcucuua

SEQ ID NO: 1228447 - RNA, 19 nt, Homo sapiens
gauaccacaacacaacaaa

SEQ ID NO: 1228448 - RNA, 19 nt, Homo sapiens
aaaccuaucaaacgaguau

SEQ ID NO: 1228449 - RNA, 19 nt, Homo sapiens
gcuuucagcacucaagauu

SEQ ID NO: 1228450 - RNA, 19 nt, Homo sapiens
agacaagaccacguucuaa

SEQ ID NO: 1228451 - RNA, 19 nt, Homo sapiens
gagcaauugucugguccuu

SEQ ID NO: 1228452 - RNA, 19 nt, Homo sapiens
uuggcuaugugaaggaaua

SEQ ID NO: 1228453 - RNA, 19 nt, Homo sapiens
gacugaaaguuuauugcau

SEQ ID NO: 1228454 - RNA, 19 nt, Homo sapiens
aaaguagaguaucaagcuu

SEQ ID NO: 1228455 - RNA, 19 nt, Homo sapiens
ggaagaaaaucagaagaca

SEQ ID NO: 1228456 - RNA, 19 nt, Homo sapiens
uugaagauacaucggaaua

SEQ ID NO: 1228457 - RNA, 19 nt, Homo sapiens
cagcuguuguggguucuaa

SEQ ID NO: 1228458 - RNA, 19 nt, Homo sapiens
guagcuagagugccuugaa

SEQ ID NO: 1228459 - RNA, 19 nt, Homo sapiens
caucauggaagaauaccuu

SEQ ID NO: 1228460 - RNA, 19 nt, Homo sapiens
cuaaagaaacuaaguagcu

SEQ ID NO: 1228461 - RNA, 19 nt, Homo sapiens
ugaagagucauguguuuua

SEQ ID NO: 1228462 - RNA, 19 nt, Homo sapiens
uaggaaaccagacuaauac

SEQ ID NO: 1228463 - RNA, 19 nt, Homo sapiens
aggauuauguugaagauac

SEQ ID NO: 1228464 - RNA, 19 nt, Homo sapiens
ucaggauuauguugaagau

SEQ ID NO: 1228465 - RNA, 19 nt, Homo sapiens
aagaacaacacuuaucguu

SEQ ID NO: 1228466 - RNA, 19 nt, Homo sapiens
cuaggacagcauacaauuu

SEQ ID NO: 1228467 - RNA, 19 nt, Homo sapiens
ugcaagaccuguuguuacu

SEQ ID NO: 1228468 - RNA, 19 nt, Homo sapiens
cauggcagggaaauauaua

SEQ ID NO: 1228469 - RNA, 19 nt, Homo sapiens
ugaggacuguaccauggaa

SEQ ID NO: 1228470 - RNA, 19 nt, Homo sapiens
cuacagagcuuuauagaua

SEQ ID NO: 1228471 - RNA, 19 nt, Homo sapiens
gagaguagcugaagaaaug

SEQ ID NO: 1228472 - RNA, 19 nt, Homo sapiens
gaacuaaucaggaagcuua

SEQ ID NO: 1228473 - RNA, 19 nt, Homo sapiens
caaagaacauugaguugua

SEQ ID NO: 1228474 - RNA, 19 nt, Homo sapiens
gaaaugugcuucuacuuug

SEQ ID NO: 1228475 - RNA, 19 nt, Homo sapiens
agaaggagauggacaaaua

SEQ ID NO: 1228476 - RNA, 19 nt, Homo sapiens
gacaauagauggaaucaga

SEQ ID NO: 1228477 - RNA, 19 nt, Homo sapiens
gaaaugaaaugcacuuugg

SEQ ID NO: 1228478 - RNA, 19 nt, Homo sapiens
caagagaccuccaggaaga

SEQ ID NO: 1228479 - RNA, 19 nt, Homo sapiens
ucagguaugugaccauuua

SEQ ID NO: 1228480 - RNA, 19 nt, Homo sapiens
ggaaaugugcuucuacuuu

SEQ ID NO: 1228481 - RNA, 19 nt, Homo sapiens
cauaagagguuucuacuca

SEQ ID NO: 1228482 - RNA, 19 nt, Homo sapiens
aaucaaagcucaucaguuc

SEQ ID NO: 1228483 - RNA, 19 nt, Homo sapiens
gaacagagacaucgagaau

SEQ ID NO: 1228484 - RNA, 19 nt, Homo sapiens
ggaaauacaggaaguggua

SEQ ID NO: 1228485 - RNA, 19 nt, Homo sapiens
ggccuuaacugguaucaaa

SEQ ID NO: 1228486 - RNA, 19 nt, Homo sapiens
gaaggaagcagaacagaga

SEQ ID NO: 1228487 - RNA, 19 nt, Homo sapiens
caacucaacucccaaaaua

SEQ ID NO: 1228488 - RNA, 19 nt, Homo sapiens
uaaaugcaguugucaaaga

SEQ ID NO: 1228489 - RNA, 19 nt, Homo sapiens
gaacuaguuugacaucugu

SEQ ID NO: 1228490 - RNA, 19 nt, Homo sapiens
caagcucucugcauucuuu

SEQ ID NO: 1228491 - RNA, 19 nt, Homo sapiens
ugaaagaacucuaacuaca

SEQ ID NO: 1228492 - RNA, 19 nt, Homo sapiens
cauaagcaaugauacauga

SEQ ID NO: 1228493 - RNA, 19 nt, Homo sapiens
ggaugaagcccaugaaaga

SEQ ID NO: 1228494 - RNA, 19 nt, Homo sapiens
guauguaggugugauagua

SEQ ID NO: 1228495 - RNA, 19 nt, Homo sapiens
gcucaucaguucccauaaa

SEQ ID NO: 1228496 - RNA, 19 nt, Homo sapiens
ugaaauggcuggagacauc

SEQ ID NO: 1228497 - RNA, 19 nt, Homo sapiens
ccaaaggacagaugauaua

SEQ ID NO: 1228498 - RNA, 19 nt, Homo sapiens
gaagaaaugaugacaaauc

SEQ ID NO: 1228499 - RNA, 19 nt, Homo sapiens
gaacaggaaaccaaacuug

SEQ ID NO: 1228500 - RNA, 19 nt, Homo sapiens
acagagacaucgagaauug

SEQ ID NO: 1228501 - RNA, 19 nt, Homo sapiens
uaagagaacuaguuugaca

SEQ ID NO: 1228502 - RNA, 19 nt, Homo sapiens
ggagacagcaaucaaauau

SEQ ID NO: 1228503 - RNA, 19 nt, Homo sapiens
uaacuuccauuaugccaaa

SEQ ID NO: 1228504 - RNA, 19 nt, Homo sapiens
ccauuuaacuuccauuaug

SEQ ID NO: 1228505 - RNA, 19 nt, Homo sapiens
gaaagacaguacauguaau

SEQ ID NO: 1228506 - RNA, 19 nt, Homo sapiens
ucauaagguuucccuauuu

SEQ ID NO: 1228507 - RNA, 19 nt, Homo sapiens
caaaguaggauaccaaguu

SEQ ID NO: 1228508 - RNA, 19 nt, Homo sapiens
gcaaaucaaagcucauaaa

SEQ ID NO: 1228509 - RNA, 19 nt, Homo sapiens
gaacauaagagguuucuac

SEQ ID NO: 1228510 - RNA, 19 nt, Homo sapiens
acccaaaucuuaccaaauu

SEQ ID NO: 1228511 - RNA, 19 nt, Homo sapiens
ggacaauucauuccuuauu

SEQ ID NO: 1228512 - RNA, 19 nt, Homo sapiens
ugaaagacaguacauguaa

SEQ ID NO: 1228513 - RNA, 19 nt, Homo sapiens
gaacaaugcaaaucaagug

SEQ ID NO: 1228514 - RNA, 19 nt, Homo sapiens
uaaagugccuugccauaca

SEQ ID NO: 1228515 - RNA, 19 nt, Homo sapiens
caugugaucccugaaauua

SEQ ID NO: 1228516 - RNA, 19 nt, Homo sapiens
cuacagauaucuuauuugg

SEQ ID NO: 1228517 - RNA, 19 nt, Homo sapiens
aaagaacucuaacuacaga

SEQ ID NO: 1228518 - RNA, 19 nt, Homo sapiens
gcuaaaggauggaauaucg

SEQ ID NO: 1228519 - RNA, 19 nt, Homo sapiens
gaaggagauggacaaauaa

SEQ ID NO: 1228520 - RNA, 19 nt, Homo sapiens
aaaccaaacuugaauggau

SEQ ID NO: 1228521 - RNA, 19 nt, Homo sapiens
ggaggugguuccaauuuca

SEQ ID NO: 1228522 - RNA, 19 nt, Homo sapiens
caacgucuuugacaauaga

SEQ ID NO: 1228523 - RNA, 19 nt, Homo sapiens
guauuugucucccucacua

SEQ ID NO: 1228524 - RNA, 19 nt, Homo sapiens
ucugacaugugcaguaaua

SEQ ID NO: 1228525 - RNA, 19 nt, Homo sapiens
gaagcagacaacacuauuu

SEQ ID NO: 1228526 - RNA, 19 nt, Homo sapiens
gguaugugaccauuuauuu

SEQ ID NO: 1228527 - RNA, 19 nt, Homo sapiens
guuauuggccuaugaacua

SEQ ID NO: 1228528 - RNA, 19 nt, Homo sapiens
gcaaagugauuucccaaaa

SEQ ID NO: 1228529 - RNA, 19 nt, Homo sapiens
caucugacaugugcaguaa

SEQ ID NO: 1228530 - RNA, 19 nt, Homo sapiens
uagccaagcucucugcauu

SEQ ID NO: 1228531 - RNA, 19 nt, Homo sapiens
gggcagggacugugucuuu

SEQ ID NO: 1228532 - RNA, 19 nt, Homo sapiens
gaggaacuacuccaacuuu

SEQ ID NO: 1228533 - RNA, 19 nt, Homo sapiens
caccuggccuacucuguua

SEQ ID NO: 1228534 - RNA, 19 nt, Homo sapiens
guaaacaccucuacgucau

SEQ ID NO: 1228535 - RNA, 19 nt, Homo sapiens
ccaaguugcaugaauuuaa

SEQ ID NO: 1228536 - RNA, 19 nt, Homo sapiens
caaagucuacgcaagaauu

SEQ ID NO: 1228537 - RNA, 19 nt, Homo sapiens
aaauguagcucgaagaucu

SEQ ID NO: 1228538 - RNA, 19 nt, Homo sapiens
aacuuuagcugucaucuuu

SEQ ID NO: 1228539 - RNA, 19 nt, Homo sapiens
cauaagguuucccuauuug

SEQ ID NO: 1228540 - RNA, 19 nt, Homo sapiens
ugauggauguuuacugaaa

SEQ ID NO: 1228541 - RNA, 19 nt, Homo sapiens
gcagcuaaaggauggaaua

SEQ ID NO: 1228542 - RNA, 19 nt, Homo sapiens
gcaagaaggagauggacaa

SEQ ID NO: 1228543 - RNA, 19 nt, Homo sapiens
gucauaagguuucccuauu

SEQ ID NO: 1228544 - RNA, 19 nt, Homo sapiens
cacccucgauggcuuguua

SEQ ID NO: 1228545 - RNA, 19 nt, Homo sapiens
caugaaagaacucuaacua

SEQ ID NO: 1228546 - RNA, 19 nt, Homo sapiens
ggagauggacaaauaagga

SEQ ID NO: 1228547 - RNA, 19 nt, Homo sapiens
gucagcaacuauggaauua

SEQ ID NO: 1228548 - RNA, 19 nt, Homo sapiens
gcuuucggaucuauaguaa

SEQ ID NO: 1228549 - RNA, 19 nt, Homo sapiens
gcuucuacuuugccaguua

SEQ ID NO: 1228550 - RNA, 19 nt, Homo sapiens
gaugacaaauccauaucug

SEQ ID NO: 1228551 - RNA, 19 nt, Homo sapiens
gaaaugaugacaaauccau

SEQ ID NO: 1228552 - RNA, 19 nt, Homo sapiens
ugaaggcccuaaacaugaa

SEQ ID NO: 1228553 - RNA, 19 nt, Homo sapiens
caauagauggaaucagaua

SEQ ID NO: 1228554 - RNA, 19 nt, Homo sapiens
gaagaaaugaaaugcacuu

SEQ ID NO: 1228555 - RNA, 19 nt, Homo sapiens
cauuugcauugaagcauua

SEQ ID NO: 1228556 - RNA, 19 nt, Homo sapiens
cucgauggcuuguuaauau

SEQ ID NO: 1228557 - RNA, 19 nt, Homo sapiens
uaugacugauggauguuua

SEQ ID NO: 1228558 - RNA, 19 nt, Homo sapiens
ggucggcacuuguuauugg

SEQ ID NO: 1228559 - RNA, 19 nt, Homo sapiens
gaucuacuacuuccaauag

SEQ ID NO: 1228560 - RNA, 19 nt, Homo sapiens
caacagaggaggauauuuu

SEQ ID NO: 1228561 - RNA, 19 nt, Homo sapiens
ggaaggcuuuauccaguca

SEQ ID NO: 1228562 - RNA, 19 nt, Homo sapiens
cauaaaugcaguugucaaa

SEQ ID NO: 1228563 - RNA, 19 nt, Homo sapiens
gaaguaaacaccucuacgu

SEQ ID NO: 1228564 - RNA, 19 nt, Homo sapiens
gaacucuaacuacagauau

SEQ ID NO: 1228565 - RNA, 19 nt, Homo sapiens
gaaagaacucuaacuacag

SEQ ID NO: 1228566 - RNA, 19 nt, Homo sapiens
gagggacaauucauuccuu

SEQ ID NO: 1228567 - RNA, 19 nt, Homo sapiens
gcacuugcccacucuuguu

SEQ ID NO: 1228568 - RNA, 19 nt, Homo sapiens
aacaguagcuauagccauu

SEQ ID NO: 1228569 - RNA, 19 nt, Homo sapiens
aaaugcaguugucaaagaa

SEQ ID NO: 1228570 - RNA, 19 nt, Homo sapiens
gcacuacucuuuccauuua

SEQ ID NO: 1228571 - RNA, 19 nt, Homo sapiens
gcaaacaacuacagucuuu

SEQ ID NO: 1228572 - RNA, 19 nt, Homo sapiens
ggaaauacuucucaucuga

SEQ ID NO: 1228573 - RNA, 19 nt, Homo sapiens
gaaacuaucuugaauuugc

SEQ ID NO: 1228574 - RNA, 19 nt, Homo sapiens
uaaccuaugugccucaaua

SEQ ID NO: 1228575 - RNA, 19 nt, Homo sapiens
gagaaggaguauugacuaa

SEQ ID NO: 1228576 - RNA, 19 nt, Homo sapiens
gauggaggauucuuuggua

SEQ ID NO: 1228577 - RNA, 19 nt, Homo sapiens
ggaaauagaguagcaauug

SEQ ID NO: 1228578 - RNA, 19 nt, Homo sapiens
uaauagcacuguuacauga

SEQ ID NO: 1228579 - RNA, 19 nt, Homo sapiens
gcaaaugucaugagaaguu

SEQ ID NO: 1228580 - RNA, 19 nt, Homo sapiens
gaaggaguauugacuaagu

SEQ ID NO: 1228581 - RNA, 19 nt, Homo sapiens
gaauugucauacugcauua

SEQ ID NO: 1228582 - RNA, 19 nt, Homo sapiens
gccauuagguugaaaguau

SEQ ID NO: 1228583 - RNA, 19 nt, Homo sapiens
guggaaguauugucuauuu

SEQ ID NO: 1228584 - RNA, 19 nt, Homo sapiens
gagauuugcugguacauag

SEQ ID NO: 1228585 - RNA, 19 nt, Homo sapiens
caacuacagucuuugaaau

SEQ ID NO: 1228586 - RNA, 19 nt, Homo sapiens
gaauauaccgcaaauguca

SEQ ID NO: 1228587 - RNA, 19 nt, Homo sapiens
uaccuaggcuugaagauuu

SEQ ID NO: 1228588 - RNA, 19 nt, Homo sapiens
gcauuagcuucuaccuuua

SEQ ID NO: 1228589 - RNA, 19 nt, Homo sapiens
gcaauauugucauccagaa

SEQ ID NO: 1228590 - RNA, 19 nt, Homo sapiens
ugcauuagcuucuaccuuu

SEQ ID NO: 1228591 - RNA, 19 nt, Homo sapiens
ugaagucuccuuuaaauga

SEQ ID NO: 1228592 - RNA, 19 nt, Homo sapiens
gaagacacccaguaaugaa

SEQ ID NO: 1228593 - RNA, 19 nt, Homo sapiens
gagggagacuuaaggaaug

SEQ ID NO: 1228594 - RNA, 19 nt, Homo sapiens
gagaaaugcuaauggagau

SEQ ID NO: 1228595 - RNA, 19 nt, Homo sapiens
aaucagcagucuaaaguuu

SEQ ID NO: 1228596 - RNA, 19 nt, Homo sapiens
uuacaaagccuguguuaga

SEQ ID NO: 1228597 - RNA, 19 nt, Homo sapiens
gaauuugccugagaaacuu

SEQ ID NO: 1228598 - RNA, 19 nt, Homo sapiens
ucauugaagucuccuuuaa

SEQ ID NO: 1228599 - RNA, 19 nt, Homo sapiens
ggaagacacccaguaauga

SEQ ID NO: 1228600 - RNA, 19 nt, Homo sapiens
caacauaucugaaaaggau

SEQ ID NO: 1228601 - RNA, 19 nt, Homo sapiens
uaauggagauuugcuggua

SEQ ID NO: 1228602 - RNA, 19 nt, Homo sapiens
caaagaugagggagacuua

SEQ ID NO: 1228603 - RNA, 19 nt, Homo sapiens
ugagaaguuugauucagua

SEQ ID NO: 1228604 - RNA, 19 nt, Homo sapiens
caaaugucaugagaaguuu

SEQ ID NO: 1228605 - RNA, 19 nt, Homo sapiens
ggagaaggaguauugacua

SEQ ID NO: 1228606 - RNA, 19 nt, Homo sapiens
gcuucuaccuuuaguaaga

SEQ ID NO: 1228607 - RNA, 19 nt, Homo sapiens
guaucuuacuguuugguua

SEQ ID NO: 1228608 - RNA, 19 nt, Homo sapiens
gaaauagaguagcaauugc

SEQ ID NO: 1228609 - RNA, 19 nt, Homo sapiens
caucugacagcuacaaaua

SEQ ID NO: 1228610 - RNA, 19 nt, Homo sapiens
gaauggguguaauuaggaa

SEQ ID NO: 1228611 - RNA, 19 nt, Homo sapiens
cugagaaacuuguaaccua

SEQ ID NO: 1228612 - RNA, 19 nt, Homo sapiens
ggacacauuugggaguauu

SEQ ID NO: 1228613 - RNA, 19 nt, Homo sapiens
gaagucuccuuuaaaugau

SEQ ID NO: 1228614 - RNA, 19 nt, Homo sapiens
gcaaacagugaagcaaaua

SEQ ID NO: 1228615 - RNA, 19 nt, Homo sapiens
ccauuagguugaaaguaua

SEQ ID NO: 1228616 - RNA, 19 nt, Homo sapiens
uuuaacaggucauguacua

SEQ ID NO: 1228617 - RNA, 19 nt, Homo sapiens
ugagaaacuuguaaccuau

SEQ ID NO: 1228618 - RNA, 19 nt, Homo sapiens
gggaaauguugugagauaa

SEQ ID NO: 1228619 - RNA, 19 nt, Homo sapiens
gggaagacacccaguaaug

SEQ ID NO: 1228620 - RNA, 19 nt, Homo sapiens
ggucaaccuuuaacuauac

SEQ ID NO: 1228621 - RNA, 19 nt, Homo sapiens
gaucaugaaaccugagaaa

SEQ ID NO: 1228622 - RNA, 19 nt, Homo sapiens
ggggaaauguugugagaua

SEQ ID NO: 1228623 - RNA, 19 nt, Homo sapiens
gcuugaagauuuggaagaa

SEQ ID NO: 1228624 - RNA, 19 nt, Homo sapiens
ggaaguauugucuauuuca

SEQ ID NO: 1228625 - RNA, 19 nt, Homo sapiens
cuaugugccucaauauauu

SEQ ID NO: 1228626 - RNA, 19 nt, Homo sapiens
gaaaucagaauggaugaau

SEQ ID NO: 1228627 - RNA, 19 nt, Homo sapiens
gaagcaaauacuagacgua

SEQ ID NO: 1228628 - RNA, 19 nt, Homo sapiens
ggcaaacagugaagcaaau

SEQ ID NO: 1228629 - RNA, 19 nt, Homo sapiens
cauccugucuaaugguuaa

SEQ ID NO: 1228630 - RNA, 19 nt, Homo sapiens
gcaaaauucacaccuguua

SEQ ID NO: 1228631 - RNA, 19 nt, Homo sapiens
aggaauggauggcuaauca

SEQ ID NO: 1228632 - RNA, 19 nt, Homo sapiens
guacauaggaaucuagcaa

SEQ ID NO: 1228633 - RNA, 19 nt, Homo sapiens
gaaaagcacaacaaaacua

SEQ ID NO: 1228634 - RNA, 19 nt, Homo sapiens
aggauucuuugguaucuua

SEQ ID NO: 1228635 - RNA, 19 nt, Homo sapiens
ugacuaaguugugcaggaa

SEQ ID NO: 1228636 - RNA, 19 nt, Homo sapiens
gaaagaaaagcacaacaaa

SEQ ID NO: 1228637 - RNA, 19 nt, Homo sapiens
ccucaaggcagaccacuuu

SEQ ID NO: 1228638 - RNA, 19 nt, Homo sapiens
ugauaugucugaugaugau

SEQ ID NO: 1228639 - RNA, 19 nt, Homo sapiens
ugaggcaacuguauguaug

SEQ ID NO: 1228640 - RNA, 19 nt, Homo sapiens
caaccuuuauugacuuugu

SEQ ID NO: 1228641 - RNA, 19 nt, Homo sapiens
ugacagcuacaaauaacua

SEQ ID NO: 1228642 - RNA, 19 nt, Homo sapiens
ggagauuugcugguacaua

SEQ ID NO: 1228643 - RNA, 19 nt, Homo sapiens
caugaaaccugagaaaugc

SEQ ID NO: 1228644 - RNA, 19 nt, Homo sapiens
ccgcaaaugucaugagaag

SEQ ID NO: 1228645 - RNA, 19 nt, Homo sapiens
aaacaacuacagucuuuga

SEQ ID NO: 1228646 - RNA, 19 nt, Homo sapiens
gagcagcuggucaaccuuu

SEQ ID NO: 1228647 - RNA, 19 nt, Homo sapiens
ggugcucuuugaagugaua

SEQ ID NO: 1228648 - RNA, 19 nt, Homo sapiens
ccugagaaaugcuaaugga

SEQ ID NO: 1228649 - RNA, 19 nt, Homo sapiens
ucaugaaaccugagaaaug

SEQ ID NO: 1228650 - RNA, 19 nt, Homo sapiens
ggaggauucuuugguaucu

SEQ ID NO: 1228651 - RNA, 19 nt, Homo sapiens
gcacuguuacaugaaauaa

SEQ ID NO: 1228652 - RNA, 19 nt, Homo sapiens
gccaugaauuugccugaga

SEQ ID NO: 1228653 - RNA, 19 nt, Homo sapiens
gaaguauugucuauuucag

SEQ ID NO: 1228654 - RNA, 19 nt, Homo sapiens
ggucauguacuacguuguu

SEQ ID NO: 1228655 - RNA, 19 nt, Homo sapiens
gaugaugacgaugaugaua

SEQ ID NO: 1228656 - RNA, 19 nt, Homo sapiens
agacaccaacuaaaucuuu

SEQ ID NO: 1228657 - RNA, 19 nt, Homo sapiens
uguaggaaaugugaaagaa

SEQ ID NO: 1228658 - RNA, 19 nt, Homo sapiens
guggaucgcuuggcaaaca

SEQ ID NO: 1228659 - RNA, 19 nt, Homo sapiens
uagcuucuaccuuuaguaa

SEQ ID NO: 1228660 - RNA, 19 nt, Homo sapiens
auacagaauugucauacug

SEQ ID NO: 1228661 - RNA, 19 nt, Homo sapiens
ggagguauuuucacucuau

SEQ ID NO: 1228662 - RNA, 19 nt, Homo sapiens
uggucaaccuuuaacuaua

SEQ ID NO: 1228663 - RNA, 19 nt, Homo sapiens
ccaugaauuugccugagaa

SEQ ID NO: 1228664 - RNA, 19 nt, Homo sapiens
ugauagcagugacuaagga

SEQ ID NO: 1228665 - RNA, 19 nt, Homo sapiens
guaggaaaugugaaagaaa

SEQ ID NO: 1228666 - RNA, 19 nt, Homo sapiens
uuugguaucuuacuguuug

SEQ ID NO: 1228667 - RNA, 19 nt, Homo sapiens
gggauaggcuuuugcaaau

SEQ ID NO: 1228668 - RNA, 19 nt, Homo sapiens
ccuaugugccucaauauau

SEQ ID NO: 1228669 - RNA, 19 nt, Homo sapiens
uaaucaagacaccaacuaa

SEQ ID NO: 1228670 - RNA, 19 nt, Homo sapiens
gaacugagauccagagaga

SEQ ID NO: 1228671 - RNA, 19 nt, Homo sapiens
ccagagagaugaugacuuu

SEQ ID NO: 1228672 - RNA, 19 nt, Homo sapiens
gaacaaacggugauaauau

SEQ ID NO: 1228673 - RNA, 19 nt, Homo sapiens
gcuaugugcuuuagaaauu

SEQ ID NO: 1228674 - RNA, 19 nt, Homo sapiens
uaagugaucugauuagguu

SEQ ID NO: 1228675 - RNA, 19 nt, Homo sapiens
ccaaagugcugggauuaua

SEQ ID NO: 1228676 - RNA, 19 nt, Homo sapiens
gagaauaacuugucugacu

SEQ ID NO: 1228677 - RNA, 19 nt, Homo sapiens
gaugaugacuuugcccaua

SEQ ID NO: 1228678 - RNA, 19 nt, Homo sapiens
gacaagaguuucaccaugu

SEQ ID NO: 1228679 - RNA, 19 nt, Homo sapiens
gcuauaugaucucaggaua

SEQ ID NO: 1228680 - RNA, 19 nt, Homo sapiens
gugaaugccugcucuguga

SEQ ID NO: 1228681 - RNA, 19 nt, Homo sapiens
gaagggaaauuguaaucca

SEQ ID NO: 1228682 - RNA, 19 nt, Homo sapiens
agaaagcuauugagcguuu

SEQ ID NO: 1228683 - RNA, 19 nt, Homo sapiens
caggauaucggccauguua

SEQ ID NO: 1228684 - RNA, 19 nt, Homo sapiens
gaauucagcugcucagaac

SEQ ID NO: 1228685 - RNA, 19 nt, Homo sapiens
caaguggccucaaauucuu

SEQ ID NO: 1228686 - RNA, 19 nt, Homo sapiens
gaaacugaauuugcucuuc

SEQ ID NO: 1228687 - RNA, 19 nt, Homo sapiens
gaaauuguaauccaugaga

SEQ ID NO: 1228688 - RNA, 19 nt, Homo sapiens
gcagaagugcugaagauga

SEQ ID NO: 1228689 - RNA, 19 nt, Homo sapiens
gcaaguggccucaaauucu

SEQ ID NO: 1228690 - RNA, 19 nt, Homo sapiens
cagagaacaugcugaaaca

SEQ ID NO: 1228691 - RNA, 19 nt, Homo sapiens
gaagugcuccugcagcuau

SEQ ID NO: 1228692 - RNA, 19 nt, Homo sapiens
agaauaacuugucugacua

SEQ ID NO: 1228693 - RNA, 19 nt, Homo sapiens
ggaauguugccaaggauuu

SEQ ID NO: 1228694 - RNA, 19 nt, Homo sapiens
gugaauuucuucuggaaug

SEQ ID NO: 1228695 - RNA, 19 nt, Homo sapiens
cgaagauccuguucaagug

SEQ ID NO: 1228696 - RNA, 19 nt, Homo sapiens
gguagaagggaaauuguaa

SEQ ID NO: 1228697 - RNA, 19 nt, Homo sapiens
gagaacaugcugaaacaga

SEQ ID NO: 1228698 - RNA, 19 nt, Homo sapiens
ucucauauguuugcguaua

SEQ ID NO: 1228699 - RNA, 19 nt, Homo sapiens
ccuaaaguauugcuguauu

SEQ ID NO: 1228700 - RNA, 19 nt, Homo sapiens
gggaaauuguaauccauga

SEQ ID NO: 1228701 - RNA, 19 nt, Homo sapiens
uaacuuugauuuccugaag

SEQ ID NO: 1228702 - RNA, 19 nt, Homo sapiens
gaucaugguuaaccuuugg

SEQ ID NO: 1228703 - RNA, 19 nt, Homo sapiens
gagaacaaacggugauaau

SEQ ID NO: 1228704 - RNA, 19 nt, Homo sapiens
uagguuaaauggcuauaug

SEQ ID NO: 1228705 - RNA, 19 nt, Homo sapiens
guuaaugagucugauguug

SEQ ID NO: 1228706 - RNA, 19 nt, Homo sapiens
ggauaucggccauguuaau

SEQ ID NO: 1228707 - RNA, 19 nt, Homo sapiens
aaauuaguaugccuccuuu

SEQ ID NO: 1228708 - RNA, 19 nt, Homo sapiens
gaacaagaacugagaucca

SEQ ID NO: 1228709 - RNA, 19 nt, Homo sapiens
agaacaugcugaaacagaa

SEQ ID NO: 1228710 - RNA, 19 nt, Homo sapiens
guauaaggaacuacuggua

SEQ ID NO: 1228711 - RNA, 19 nt, Homo sapiens
gaucugauuagguuaguga

SEQ ID NO: 1228712 - RNA, 19 nt, Homo sapiens
ugaaggagccagucgaaga

SEQ ID NO: 1228713 - RNA, 19 nt, Homo sapiens
ucacugacuccaagaauga

SEQ ID NO: 1228714 - RNA, 19 nt, Homo sapiens
gcagagaacaugcugaaac

SEQ ID NO: 1228715 - RNA, 19 nt, Homo sapiens
gccagcagguucaccagaa

SEQ ID NO: 1228716 - RNA, 19 nt, Homo sapiens
gaaggagccagucgaagau

SEQ ID NO: 1228717 - RNA, 19 nt, Homo sapiens
cuagugggcucuggaagaa

SEQ ID NO: 1228718 - RNA, 19 nt, Homo sapiens
ucuuucagcucacaggaua

SEQ ID NO: 1228719 - RNA, 19 nt, Homo sapiens
gggagaauaacuugucuga

SEQ ID NO: 1228720 - RNA, 19 nt, Homo sapiens
gaucucaggauaagacaga

SEQ ID NO: 1228721 - RNA, 19 nt, Homo sapiens
gcaggcauuucuugaacau

SEQ ID NO: 1228722 - RNA, 19 nt, Homo sapiens
uauaaggaacuacugguaa

SEQ ID NO: 1228723 - RNA, 19 nt, Homo sapiens
cagaagugcugaagaugag

SEQ ID NO: 1228724 - RNA, 19 nt, Homo sapiens
aggcauuucuugaacauug

SEQ ID NO: 1228725 - RNA, 19 nt, Homo sapiens
uaacuauucucaggugugu

SEQ ID NO: 1228726 - RNA, 19 nt, Homo sapiens
agaacaaacggugauaaua

SEQ ID NO: 1228727 - RNA, 19 nt, Homo sapiens
gcuaucauucauccaguua

SEQ ID NO: 1228728 - RNA, 19 nt, Homo sapiens
uauaugaucucaggauaag

SEQ ID NO: 1228729 - RNA, 19 nt, Homo sapiens
gagaggagaccaggaugaa

SEQ ID NO: 1228730 - RNA, 19 nt, Homo sapiens
cacauugaauucaugauca

SEQ ID NO: 1228731 - RNA, 19 nt, Homo sapiens
agucugauguugcuaguau

SEQ ID NO: 1228732 - RNA, 19 nt, Homo sapiens
acacacguacggagaauuu

SEQ ID NO: 1228733 - RNA, 19 nt, Homo sapiens
gaacaugcugaaacagaau

SEQ ID NO: 1228734 - RNA, 19 nt, Homo sapiens
gaagauccuguucaagugu

SEQ ID NO: 1228735 - RNA, 19 nt, Homo sapiens
ggaguaugcagaacugguu

SEQ ID NO: 1228736 - RNA, 19 nt, Homo sapiens
caguuugucuugucauuca

SEQ ID NO: 1228737 - RNA, 19 nt, Homo sapiens
ccagcagguucaccagaaa

SEQ ID NO: 1228738 - RNA, 19 nt, Homo sapiens
gaaucuacuggcugaauga

SEQ ID NO: 1228739 - RNA, 19 nt, Homo sapiens
ccauagaccaaacaaagaa

SEQ ID NO: 1228740 - RNA, 19 nt, Homo sapiens
auaaggaacuacugguaau

SEQ ID NO: 1228741 - RNA, 19 nt, Homo sapiens
gaugaaggagccagucgaa

SEQ ID NO: 1228742 - RNA, 19 nt, Homo sapiens
uuacaacuccucuuacuag

SEQ ID NO: 1228743 - RNA, 19 nt, Homo sapiens
uguaauccaugagaagaaa

SEQ ID NO: 1228744 - RNA, 19 nt, Homo sapiens
gcccauagaccaaacaaag

SEQ ID NO: 1228745 - RNA, 19 nt, Homo sapiens
uaaggaacuacugguaaua

SEQ ID NO: 1228746 - RNA, 19 nt, Homo sapiens
cuuaaaggauagaaagugu

SEQ ID NO: 1228747 - RNA, 19 nt, Homo sapiens
gggugaauuucuucuggaa

SEQ ID NO: 1228748 - RNA, 19 nt, Homo sapiens
agucgaagauccuguucaa

SEQ ID NO: 1228749 - RNA, 19 nt, Homo sapiens
gguaauagccaagaaaauu

SEQ ID NO: 1228750 - RNA, 19 nt, Homo sapiens
ggagacgggacuuacuuug

SEQ ID NO: 1228751 - RNA, 19 nt, Homo sapiens
acaagaguuucaccauguu

SEQ ID NO: 1228752 - RNA, 19 nt, Homo sapiens
gaacuccugaccucaagug

SEQ ID NO: 1228753 - RNA, 19 nt, Homo sapiens
caccuugcccugcugauuu

SEQ ID NO: 1228754 - RNA, 19 nt, Homo sapiens
ucucuaagugaucugauua

SEQ ID NO: 1228755 - RNA, 19 nt, Homo sapiens
gaaagcuauugagcguuug

SEQ ID NO: 1228756 - RNA, 19 nt, Homo sapiens
gaaaauaugcacauuaugc

SEQ ID NO: 1228757 - RNA, 19 nt, Homo sapiens
cggaaaauaugcacauuau

SEQ ID NO: 1228758 - RNA, 19 nt, Homo sapiens
gauaucggccauguuaaug

SEQ ID NO: 1228759 - RNA, 19 nt, Homo sapiens
aaacggugauaauauaugc

SEQ ID NO: 1228760 - RNA, 19 nt, Homo sapiens
cagcugcucagaacaagaa

SEQ ID NO: 1228761 - RNA, 19 nt, Homo sapiens
cuuugucacuucccaguuu

SEQ ID NO: 1228762 - RNA, 19 nt, Homo sapiens
ccaaacaaagaaauacaug

SEQ ID NO: 1228763 - RNA, 19 nt, Homo sapiens
gugcagagaacaugcugaa

SEQ ID NO: 1228764 - RNA, 19 nt, Homo sapiens
cugauuagguuagugaugu

SEQ ID NO: 1228765 - RNA, 19 nt, Homo sapiens
agacagagaaaaucacuua

SEQ ID NO: 1228766 - RNA, 19 nt, Homo sapiens
guuaaccuuuggagagaga

SEQ ID NO: 1228767 - RNA, 19 nt, Homo sapiens
uaguaugccuccuuuuaua

SEQ ID NO: 1228768 - RNA, 19 nt, Homo sapiens
gggagacgggacuuacuuu

SEQ ID NO: 1228769 - RNA, 19 nt, Homo sapiens
agaaucuacuggcugaaug

SEQ ID NO: 1228770 - RNA, 19 nt, Homo sapiens
gcacaaacauggagagaua

SEQ ID NO: 1228771 - RNA, 19 nt, Homo sapiens
gaaugaagcugcugaugaa

SEQ ID NO: 1228772 - RNA, 19 nt, Homo sapiens
cgacuacacuguucacuua

SEQ ID NO: 1228773 - RNA, 19 nt, Homo sapiens
gaacagaaccuauaauugu

SEQ ID NO: 1228774 - RNA, 19 nt, Homo sapiens
gauguuagcuuucuugaug

SEQ ID NO: 1228775 - RNA, 19 nt, Homo sapiens
gaacuaugaucgaguaaug

SEQ ID NO: 1228776 - RNA, 19 nt, Homo sapiens
gaggacaggugaacuauga

SEQ ID NO: 1228777 - RNA, 19 nt, Homo sapiens
caacagcacuuaaacugaa

SEQ ID NO: 1228778 - RNA, 19 nt, Homo sapiens
gcauaucgauguuagcuuu

SEQ ID NO: 1228779 - RNA, 19 nt, Homo sapiens
ggaaguggaaucuaucuua

SEQ ID NO: 1228780 - RNA, 19 nt, Homo sapiens
ggaaguaauucgaacagaa

SEQ ID NO: 1228781 - RNA, 19 nt, Homo sapiens
uagcauaacuucuaucaga

SEQ ID NO: 1228782 - RNA, 19 nt, Homo sapiens
gacauuaacuguugcuuau

SEQ ID NO: 1228783 - RNA, 19 nt, Homo sapiens
gagaaggacugccuguuug

SEQ ID NO: 1228784 - RNA, 19 nt, Homo sapiens
ugaagcugcugaugaaaua

SEQ ID NO: 1228785 - RNA, 19 nt, Homo sapiens
guugaugucuuucagauuu

SEQ ID NO: 1228786 - RNA, 19 nt, Homo sapiens
ggaggaagauucugaaggu

SEQ ID NO: 1228787 - RNA, 19 nt, Homo sapiens
aaagaacuaugaucgagua

SEQ ID NO: 1228788 - RNA, 19 nt, Homo sapiens
aaagagauccuccgaguaa

SEQ ID NO: 1228789 - RNA, 19 nt, Homo sapiens
gcaauuaaaucgcacaaac

SEQ ID NO: 1228790 - RNA, 19 nt, Homo sapiens
gcggaucccuguauuaaau

SEQ ID NO: 1228791 - RNA, 19 nt, Homo sapiens
gaaguggaaucuaucuuag

SEQ ID NO: 1228792 - RNA, 19 nt, Homo sapiens
ggaagcaccuuugcauuuc

SEQ ID NO: 1228793 - RNA, 19 nt, Homo sapiens
gaggaaugccuaacucuaa

SEQ ID NO: 1228794 - RNA, 19 nt, Homo sapiens
ugacaaugauuccgaagaa

SEQ ID NO: 1228795 - RNA, 19 nt, Homo sapiens
gaaucaagacagaauagua

SEQ ID NO: 1228796 - RNA, 19 nt, Homo sapiens
caucugaccugcacaaaca

SEQ ID NO: 1228797 - RNA, 19 nt, Homo sapiens
ccacaucaguuccuucuuc

SEQ ID NO: 1228798 - RNA, 19 nt, Homo sapiens
ucaagaagcaaauggauaa

SEQ ID NO: 1228799 - RNA, 19 nt, Homo sapiens
caccauaucuggaaaucaa

SEQ ID NO: 1228800 - RNA, 19 nt, Homo sapiens
caaaauggcccuaugcuua

SEQ ID NO: 1228801 - RNA, 19 nt, Homo sapiens
ccucagggcuuauugguau

SEQ ID NO: 1228802 - RNA, 19 nt, Homo sapiens
gcucaucccuuacugcaau

SEQ ID NO: 1228803 - RNA, 19 nt, Homo sapiens
guauggaaguggaaucuau

SEQ ID NO: 1228804 - RNA, 19 nt, Homo sapiens
ggcaggaggcucucucuua

SEQ ID NO: 1228805 - RNA, 19 nt, Homo sapiens
aauccaaacugaaaucuga

SEQ ID NO: 1228806 - RNA, 19 nt, Homo sapiens
ggaaauagcggcugcuucu

SEQ ID NO: 1228807 - RNA, 19 nt, Homo sapiens
guaaugaaagcacuggaua

SEQ ID NO: 1228808 - RNA, 19 nt, Homo sapiens
gcaggaggcucucucuuac

SEQ ID NO: 1228809 - RNA, 19 nt, Homo sapiens
gaagaauuauauggacuga

SEQ ID NO: 1228810 - RNA, 19 nt, Homo sapiens
auacauaugugucaaguuc

SEQ ID NO: 1228811 - RNA, 19 nt, Homo sapiens
ucaaacugcuacugguuaa

SEQ ID NO: 1228812 - RNA, 19 nt, Homo sapiens
gcaaagccguaacuuaaaa

SEQ ID NO: 1228813 - RNA, 19 nt, Homo sapiens
ucaagcauaucauuugguu

SEQ ID NO: 1228814 - RNA, 19 nt, Homo sapiens
uuucauggcucacacauug

SEQ ID NO: 1228815 - RNA, 19 nt, Homo sapiens
aaacugagcuuuucaagga

SEQ ID NO: 1228816 - RNA, 19 nt, Homo sapiens
gaccaugucugcacacgau

SEQ ID NO: 1228817 - RNA, 19 nt, Homo sapiens
gaaucuaucuuaguccaau

SEQ ID NO: 1228818 - RNA, 19 nt, Homo sapiens
gcaauggguuauaucaagu

SEQ ID NO: 1228819 - RNA, 19 nt, Homo sapiens
gaaagcacuggauagcaua

SEQ ID NO: 1228820 - RNA, 19 nt, Homo sapiens
cugcaaagccguaacuuaa

SEQ ID NO: 1228821 - RNA, 19 nt, Homo sapiens
ucucuuaccucagggcuua

SEQ ID NO: 1228822 - RNA, 19 nt, Homo sapiens
gagcacaacacaaacuuga

SEQ ID NO: 1228823 - RNA, 19 nt, Homo sapiens
cuacuaguauccaugugua

SEQ ID NO: 1228824 - RNA, 19 nt, Homo sapiens
gagcucaggugguagaucu

SEQ ID NO: 1228825 - RNA, 19 nt, Homo sapiens
gaugaagaugugcuaguua

SEQ ID NO: 1228826 - RNA, 19 nt, Homo sapiens
ugaaagcacuggauagcau

SEQ ID NO: 1228827 - RNA, 19 nt, Homo sapiens
caauugaguuugcugaaca

SEQ ID NO: 1228828 - RNA, 19 nt, Homo sapiens
gaaggaggcauucacaaag

SEQ ID NO: 1228829 - RNA, 19 nt, Homo sapiens
gaagcaccuuugcauuuca

SEQ ID NO: 1228830 - RNA, 19 nt, Homo sapiens
gccaaagaauccaauuuua

SEQ ID NO: 1228831 - RNA, 19 nt, Homo sapiens
gccauauccuucuguggua

SEQ ID NO: 1228832 - RNA, 19 nt, Homo sapiens
ugacauuaacuguugcuua

SEQ ID NO: 1228833 - RNA, 19 nt, Homo sapiens
gagccaauaccaguaauuu

SEQ ID NO: 1228834 - RNA, 19 nt, Homo sapiens
acucagggaugaacaagaa

SEQ ID NO: 1228835 - RNA, 19 nt, Homo sapiens
cuaaugauccucagauguu

SEQ ID NO: 1228836 - RNA, 19 nt, Homo sapiens
ucucagaauggaagaauua

SEQ ID NO: 1228837 - RNA, 19 nt, Homo sapiens
acacagcaguggaaacaga

SEQ ID NO: 1228838 - RNA, 19 nt, Homo sapiens
ugagaaggacugccuguuu

SEQ ID NO: 1228839 - RNA, 19 nt, Homo sapiens
ccaguuaacaggcaauuga

SEQ ID NO: 1228840 - RNA, 19 nt, Homo sapiens
ugaaugaagcugcugauga

SEQ ID NO: 1228841 - RNA, 19 nt, Homo sapiens
gaacgggagcugugugugu

SEQ ID NO: 1228842 - RNA, 19 nt, Homo sapiens
caagacugaugaugugugu

SEQ ID NO: 1228843 - RNA, 19 nt, Homo sapiens
gguuaaaggaccaccauuu

SEQ ID NO: 1228844 - RNA, 19 nt, Homo sapiens
gaagugaucaccucaucug

SEQ ID NO: 1228845 - RNA, 19 nt, Homo sapiens
ggacagcaaucccaauucc

SEQ ID NO: 1228846 - RNA, 19 nt, Homo sapiens
agaagcaaauggauaaaca

SEQ ID NO: 1228847 - RNA, 19 nt, Homo sapiens
aauauugugugguuuguga

SEQ ID NO: 1228848 - RNA, 19 nt, Homo sapiens
gcaguuagagagauauaug

SEQ ID NO: 1228849 - RNA, 19 nt, Homo sapiens
ggaccaccauuuaauuaac

SEQ ID NO: 1228850 - RNA, 19 nt, Homo sapiens
aacaggcaauugaaguuua

SEQ ID NO: 1228851 - RNA, 19 nt, Homo sapiens
aagcaaauccaaacugaaa

SEQ ID NO: 1228852 - RNA, 19 nt, Homo sapiens
acuggaagcugauuuguca

SEQ ID NO: 1228853 - RNA, 19 nt, Homo sapiens
cuucucagcuugcuccaaa

SEQ ID NO: 1228854 - RNA, 19 nt, Homo sapiens
ugaugaagaugugcuaguu

SEQ ID NO: 1228855 - RNA, 19 nt, Homo sapiens
gaaguuuggguugcucaua

SEQ ID NO: 1228856 - RNA, 19 nt, Homo sapiens
gaccaccauuuaauuaaca

SEQ ID NO: 1228857 - RNA, 19 nt, Homo sapiens
caaagagauccuccgagua

SEQ ID NO: 1228858 - RNA, 19 nt, Homo sapiens
agugggagaugcaaauauu

SEQ ID NO: 1228859 - RNA, 19 nt, Homo sapiens
gcagcuccauggugcaaug

SEQ ID NO: 1228860 - RNA, 19 nt, Homo sapiens
uggaagcaccuuugcauuu

SEQ ID NO: 1228861 - RNA, 19 nt, Homo sapiens
cagcggaucccuguauuaa

SEQ ID NO: 1228862 - RNA, 19 nt, Homo sapiens
gagcgaauucagaaggaua

SEQ ID NO: 1228863 - RNA, 19 nt, Homo sapiens
gcuaugacagcaauuaaau

SEQ ID NO: 1228864 - RNA, 19 nt, Homo sapiens
gcacaagcacccacaacug

SEQ ID NO: 1228865 - RNA, 19 nt, Homo sapiens
aaauagcggcugcuucuuu

SEQ ID NO: 1228866 - RNA, 19 nt, Homo sapiens
ccacauguguuucaaaaug

SEQ ID NO: 1228867 - RNA, 19 nt, Homo sapiens
gcaaauccaaacugaaauc

SEQ ID NO: 1228868 - RNA, 19 nt, Homo sapiens
cgaacagaaccuauaauug

SEQ ID NO: 1228869 - RNA, 19 nt, Homo sapiens
uaacuguugcuuauccaua

SEQ ID NO: 1228870 - RNA, 19 nt, Homo sapiens
gaacaugaguaccuauuua

SEQ ID NO: 1228871 - RNA, 19 nt, Homo sapiens
gaagaucccuuugauuuga

SEQ ID NO: 1228872 - RNA, 19 nt, Homo sapiens
guugauggcuggaauauuu

SEQ ID NO: 1228873 - RNA, 19 nt, Homo sapiens
gacaaagacuuaagagaaa

SEQ ID NO: 1228874 - RNA, 19 nt, Homo sapiens
ggaaguagauaucaguuug

SEQ ID NO: 1228875 - RNA, 19 nt, Homo sapiens
gaauacaguuucaugguuu

SEQ ID NO: 1228876 - RNA, 19 nt, Homo sapiens
ccaaguaaauuaacccuuu

SEQ ID NO: 1228877 - RNA, 19 nt, Homo sapiens
gaagagaagggcacauuaa

SEQ ID NO: 1228878 - RNA, 19 nt, Homo sapiens
gauagauguugucgaauuu

SEQ ID NO: 1228879 - RNA, 19 nt, Homo sapiens
gaaguggucuggaaguaga

SEQ ID NO: 1228880 - RNA, 19 nt, Homo sapiens
gaagagacaggaugacaaa

SEQ ID NO: 1228881 - RNA, 19 nt, Homo sapiens
aaagggaggugucaacaaa

SEQ ID NO: 1228882 - RNA, 19 nt, Homo sapiens
gcaaagaggacaaagaaau

SEQ ID NO: 1228883 - RNA, 19 nt, Homo sapiens
gaagaugcccugaaccaaa

SEQ ID NO: 1228884 - RNA, 19 nt, Homo sapiens
caaaagcccugcagacaua

SEQ ID NO: 1228885 - RNA, 19 nt, Homo sapiens
gagaaguggucuggaagua

SEQ ID NO: 1228886 - RNA, 19 nt, Homo sapiens
cagcaaaggugccaauugu

SEQ ID NO: 1228887 - RNA, 19 nt, Homo sapiens
ggguuucccucucuaauuu

SEQ ID NO: 1228888 - RNA, 19 nt, Homo sapiens
ggcuucaacuuaacauuua

SEQ ID NO: 1228889 - RNA, 19 nt, Homo sapiens
ggaagagaagggcacauua

SEQ ID NO: 1228890 - RNA, 19 nt, Homo sapiens
gcaaaggugccaauuguga

SEQ ID NO: 1228891 - RNA, 19 nt, Homo sapiens
ugacaaagacuuaagagaa

SEQ ID NO: 1228892 - RNA, 19 nt, Homo sapiens
uagaugaacugccuaccua

SEQ ID NO: 1228893 - RNA, 19 nt, Homo sapiens
ugucagaacuauugaagaa

SEQ ID NO: 1228894 - RNA, 19 nt, Homo sapiens
uuuaaaggcucuucaggua

SEQ ID NO: 1228895 - RNA, 19 nt, Homo sapiens
caaagaggacaaagaaauu

SEQ ID NO: 1228896 - RNA, 19 nt, Homo sapiens
gaacuaaauugagccuguu

SEQ ID NO: 1228897 - RNA, 19 nt, Homo sapiens
ugagaaacaucuuaccuau

SEQ ID NO: 1228898 - RNA, 19 nt, Homo sapiens
caaagaaauucacaacaag

SEQ ID NO: 1228899 - RNA, 19 nt, Homo sapiens
ugauagauguugucgaauu

SEQ ID NO: 1228900 - RNA, 19 nt, Homo sapiens
cagguagccuuuccaguaa

SEQ ID NO: 1228901 - RNA, 19 nt, Homo sapiens
ucagguagccuuuccagua

SEQ ID NO: 1228902 - RNA, 19 nt, Homo sapiens
gaagauaagcccauacagu

SEQ ID NO: 1228903 - RNA, 19 nt, Homo sapiens
ggagcuggauuaucaagga

SEQ ID NO: 1228904 - RNA, 19 nt, Homo sapiens
aaugauagauguugucgaa

SEQ ID NO: 1228905 - RNA, 19 nt, Homo sapiens
gguagaagaguauuuggua

SEQ ID NO: 1228906 - RNA, 19 nt, Homo sapiens
gaaauuaggaugaagaacu

SEQ ID NO: 1228907 - RNA, 19 nt, Homo sapiens
gaacuaugccucgguuuau

SEQ ID NO: 1228908 - RNA, 19 nt, Homo sapiens
uagaucaggcuucaacuua

SEQ ID NO: 1228909 - RNA, 19 nt, Homo sapiens
aaagauacccugagaacaa

SEQ ID NO: 1228910 - RNA, 19 nt, Homo sapiens
gaacauguuauuagcauca

SEQ ID NO: 1228911 - RNA, 19 nt, Homo sapiens
caucuuaccuauuacaaca

SEQ ID NO: 1228912 - RNA, 19 nt, Homo sapiens
uagcaagaguccucagaaa

SEQ ID NO: 1228913 - RNA, 19 nt, Homo sapiens
guagaagaguauuugguau

SEQ ID NO: 1228914 - RNA, 19 nt, Homo sapiens
uaucaaugguagaagagua

SEQ ID NO: 1228915 - RNA, 19 nt, Homo sapiens
acacagaggaauuugauuu

SEQ ID NO: 1228916 - RNA, 19 nt, Homo sapiens
ggacaucauuuuauugcua

SEQ ID NO: 1228917 - RNA, 19 nt, Homo sapiens
gaagcaaagaggacaaaga

SEQ ID NO: 1228918 - RNA, 19 nt, Homo sapiens
cugcuguacuuccgauuua

SEQ ID NO: 1228919 - RNA, 19 nt, Homo sapiens
gaagaggacccagcaggaa

SEQ ID NO: 1228920 - RNA, 19 nt, Homo sapiens
gaaagggaggugucaacaa

SEQ ID NO: 1228921 - RNA, 19 nt, Homo sapiens
uugaagaucccuuugauuu

SEQ ID NO: 1228922 - RNA, 19 nt, Homo sapiens
agaaagucaugauguaugu

SEQ ID NO: 1228923 - RNA, 19 nt, Homo sapiens
ucuuggagcuggauuauca

SEQ ID NO: 1228924 - RNA, 19 nt, Homo sapiens
guuauuagcaucaggagaa

SEQ ID NO: 1228925 - RNA, 19 nt, Homo sapiens
ggauuggacugugucagaa

SEQ ID NO: 1228926 - RNA, 19 nt, Homo sapiens
cauaguaccuggucagaac

SEQ ID NO: 1228927 - RNA, 19 nt, Homo sapiens
aaaggaaugcccacaguuu

SEQ ID NO: 1228928 - RNA, 19 nt, Homo sapiens
gguugggccuucuucguuu

SEQ ID NO: 1228929 - RNA, 19 nt, Homo sapiens
ggaaugcccacaguuuaaa

SEQ ID NO: 1228930 - RNA, 19 nt, Homo sapiens
ggacaaagaaauucacaac

SEQ ID NO: 1228931 - RNA, 19 nt, Homo sapiens
ccagauguguuaacugaag

SEQ ID NO: 1228932 - RNA, 19 nt, Homo sapiens
gaccuugacgucuguauga

SEQ ID NO: 1228933 - RNA, 19 nt, Homo sapiens
gagaaacaucuuaccuauu

SEQ ID NO: 1228934 - RNA, 19 nt, Homo sapiens
cuccuggacuguuucuuua

SEQ ID NO: 1228935 - RNA, 19 nt, Homo sapiens
gaaguaaggaaaacaagua

SEQ ID NO: 1228936 - RNA, 19 nt, Homo sapiens
agaucaggcuucaacuuaa

SEQ ID NO: 1228937 - RNA, 19 nt, Homo sapiens
ggaagagacaggaugacaa

SEQ ID NO: 1228938 - RNA, 19 nt, Homo sapiens
ugaaacugcugagggauug

SEQ ID NO: 1228939 - RNA, 19 nt, Homo sapiens
gugaaguauuugugcuaua

SEQ ID NO: 1228940 - RNA, 19 nt, Homo sapiens
gagcccuccuggacuguuu

SEQ ID NO: 1228941 - RNA, 19 nt, Homo sapiens
ggacccagcaggaaucaug

SEQ ID NO: 1228942 - RNA, 19 nt, Homo sapiens
cacaacaaguacacagaaa

SEQ ID NO: 1228943 - RNA, 19 nt, Homo sapiens
agauauguaugaacugcua

SEQ ID NO: 1228944 - RNA, 19 nt, Homo sapiens
ggaaaaugcagcacucuaa

SEQ ID NO: 1228945 - RNA, 19 nt, Homo sapiens
gaaauucacaacaaguaca

SEQ ID NO: 1228946 - RNA, 19 nt, Homo sapiens
aagcaaagaggacaaagaa

SEQ ID NO: 1228947 - RNA, 19 nt, Homo sapiens
gagcuggauuaucaaggaa

SEQ ID NO: 1228948 - RNA, 19 nt, Homo sapiens
acacauuggcccuucauaa

SEQ ID NO: 1228949 - RNA, 19 nt, Homo sapiens
gaucaggcuucaacuuaac

SEQ ID NO: 1228950 - RNA, 19 nt, Homo sapiens
agaacuaugccucgguuua

SEQ ID NO: 1228951 - RNA, 19 nt, Homo sapiens
gaucaggcucgugaacaua

SEQ ID NO: 1228952 - RNA, 19 nt, Homo sapiens
ggaaaagccucagcgaaga

SEQ ID NO: 1228953 - RNA, 19 nt, Homo sapiens
aaccaaagauacccugaga

SEQ ID NO: 1228954 - RNA, 19 nt, Homo sapiens
ucaagggauuuccaaagga

SEQ ID NO: 1228955 - RNA, 19 nt, Homo sapiens
agaagaguauuugguauuc

SEQ ID NO: 1228956 - RNA, 19 nt, Homo sapiens
gaugaacugccuaccuauu

SEQ ID NO: 1228957 - RNA, 19 nt, Homo sapiens
gagacaggaugacaaagac

SEQ ID NO: 1228958 - RNA, 19 nt, Homo sapiens
ccugaaauauuuguugaug

SEQ ID NO: 1228959 - RNA, 19 nt, Homo sapiens
ccacucaggcguuccuauu

SEQ ID NO: 1228960 - RNA, 19 nt, Homo sapiens
aaggaaugcccacaguuua

SEQ ID NO: 1228961 - RNA, 19 nt, Homo sapiens
aaguguggcuggugucauu

SEQ ID NO: 1228962 - RNA, 19 nt, Homo sapiens
cccauagauuuaaggauuu

SEQ ID NO: 1228963 - RNA, 19 nt, Homo sapiens
gggauuggacugugucaga

SEQ ID NO: 1228964 - RNA, 19 nt, Homo sapiens
ugaagaucccuuugauuug

SEQ ID NO: 1228965 - RNA, 19 nt, Homo sapiens
cuucauaacacaaggcuuu

SEQ ID NO: 1228966 - RNA, 19 nt, Homo sapiens
caaaggugccaauugugaa

SEQ ID NO: 1228967 - RNA, 19 nt, Homo sapiens
ggacuguuucuuuaauuuc

SEQ ID NO: 1228968 - RNA, 19 nt, Homo sapiens
uaaaauugcugaaggucaa

SEQ ID NO: 1228969 - RNA, 19 nt, Homo sapiens
gguagccuuuccaguaaau

SEQ ID NO: 1228970 - RNA, 19 nt, Homo sapiens
ggacggcggugucagaaua

SEQ ID NO: 1228971 - RNA, 19 nt, Homo sapiens
gaacaugccuccucuccau

SEQ ID NO: 1228972 - RNA, 19 nt, Homo sapiens
gcacgggacuuuguaguga

SEQ ID NO: 1228973 - RNA, 19 nt, Homo sapiens
gggcauagcugagccaguu

SEQ ID NO: 1228974 - RNA, 19 nt, Homo sapiens
ggaaccagcugcuaucauc

SEQ ID NO: 1228975 - RNA, 19 nt, Homo sapiens
caugaccagugccaaauua

SEQ ID NO: 1228976 - RNA, 19 nt, Homo sapiens
ccaaggggcucacaucuua

SEQ ID NO: 1228977 - RNA, 19 nt, Homo sapiens
gcacugcucccucuagaaa

SEQ ID NO: 1228978 - RNA, 19 nt, Homo sapiens
gcaccugacuugcugcuau

SEQ ID NO: 1228979 - RNA, 19 nt, Homo sapiens
uaaagauggugaaucaaug

SEQ ID NO: 1228980 - RNA, 19 nt, Homo sapiens
ggucagugauccucaguga

SEQ ID NO: 1228981 - RNA, 19 nt, Homo sapiens
gaccaaagcauguggcauu

SEQ ID NO: 1228982 - RNA, 19 nt, Homo sapiens
gcaggaaacaccucaguga

SEQ ID NO: 1228983 - RNA, 19 nt, Homo sapiens
gcacugaccccuccaauuu

SEQ ID NO: 1228984 - RNA, 19 nt, Homo sapiens
caacggugcuggugacaca

SEQ ID NO: 1228985 - RNA, 19 nt, Homo sapiens
cacggaagcucgguagaua

SEQ ID NO: 1228986 - RNA, 19 nt, Homo sapiens
gaaggcaugcccuggauga

SEQ ID NO: 1228987 - RNA, 19 nt, Homo sapiens
ggacggaggaggaguuuca

SEQ ID NO: 1228988 - RNA, 19 nt, Homo sapiens
gaucugcgguuucucugau

SEQ ID NO: 1228989 - RNA, 19 nt, Homo sapiens
ccacuggcccuaaaccuuu

SEQ ID NO: 1228990 - RNA, 19 nt, Homo sapiens
gagaggaggacuacuacaa

SEQ ID NO: 1228991 - RNA, 19 nt, Homo sapiens
guucuggacugguguuaug

SEQ ID NO: 1228992 - RNA, 19 nt, Homo sapiens
gcaggcaccuagcuaugug

SEQ ID NO: 1228993 - RNA, 19 nt, Homo sapiens
cuacaacgaugauguucug

SEQ ID NO: 1228994 - RNA, 19 nt, Homo sapiens
ggccuugucucagcucuuu

SEQ ID NO: 1228995 - RNA, 19 nt, Homo sapiens
gcauuuggauggccagagu

SEQ ID NO: 1228996 - RNA, 19 nt, Homo sapiens
gggcagacccuuacaagca

SEQ ID NO: 1228997 - RNA, 19 nt, Homo sapiens
aguuaaagauggugaauca

SEQ ID NO: 1228998 - RNA, 19 nt, Homo sapiens
gcacacuccugccugucuu

SEQ ID NO: 1228999 - RNA, 19 nt, Homo sapiens
cuacaccucuacuucaaug

SEQ ID NO: 1229000 - RNA, 19 nt, Homo sapiens
gcaggcaccuucguguuca

SEQ ID NO: 1229001 - RNA, 19 nt, Homo sapiens
ucaaccugcugcgcaaaua

SEQ ID NO: 1229002 - RNA, 19 nt, Homo sapiens
ggugagaucugcgguuucu

SEQ ID NO: 1229003 - RNA, 19 nt, Homo sapiens
ggucccaccuccucuuugu

SEQ ID NO: 1229004 - RNA, 19 nt, Homo sapiens
ccauggugcuggagauguu

SEQ ID NO: 1229005 - RNA, 19 nt, Homo sapiens
gcaagaccuacuucucuga

SEQ ID NO: 1229006 - RNA, 19 nt, Homo sapiens
gcaggcacgggacuuugua

SEQ ID NO: 1229007 - RNA, 19 nt, Homo sapiens
gcaugaccagugccaaauu

SEQ ID NO: 1229008 - RNA, 19 nt, Homo sapiens
cugacuugcugcuauuaaa

SEQ ID NO: 1229009 - RNA, 19 nt, Homo sapiens
gugcuggguuugcgcaaga

SEQ ID NO: 1229010 - RNA, 19 nt, Homo sapiens
caccugacuugcugcuauu

SEQ ID NO: 1229011 - RNA, 19 nt, Homo sapiens
ggaggacgucagccuggua

SEQ ID NO: 1229012 - RNA, 19 nt, Homo sapiens
uagacacgguccacguuga

SEQ ID NO: 1229013 - RNA, 19 nt, Homo sapiens
ccagauguguuggaagcuu

SEQ ID NO: 1229014 - RNA, 19 nt, Homo sapiens
ggaaucuccaaguuaaaga

SEQ ID NO: 1229015 - RNA, 19 nt, Homo sapiens
gcgaccagaugaucguauc

SEQ ID NO: 1229016 - RNA, 19 nt, Homo sapiens
gcaagacgacccugcaaaa

SEQ ID NO: 1229017 - RNA, 19 nt, Homo sapiens
uggcugcccucuacauugu

SEQ ID NO: 1229018 - RNA, 19 nt, Homo sapiens
cagcgccucugcaacugaa

SEQ ID NO: 1229019 - RNA, 19 nt, Homo sapiens
gagaccuguugcugcauga

SEQ ID NO: 1229020 - RNA, 19 nt, Homo sapiens
ggacuacuacaacgaugau

SEQ ID NO: 1229021 - RNA, 19 nt, Homo sapiens
ggaggacuacuacaacgau

SEQ ID NO: 1229022 - RNA, 19 nt, Homo sapiens
ugggcaaguuggccuauga

SEQ ID NO: 1229023 - RNA, 19 nt, Homo sapiens
ggcagacccuuacaagcau

SEQ ID NO: 1229024 - RNA, 19 nt, Homo sapiens
gcccucacauuggugcuuu

SEQ ID NO: 1229025 - RNA, 19 nt, Homo sapiens
gcacuccagcgaccagaug

SEQ ID NO: 1229026 - RNA, 19 nt, Homo sapiens
ucagugauccucagugaag

SEQ ID NO: 1229027 - RNA, 19 nt, Homo sapiens
cagcugcuaucaucgucaa

SEQ ID NO: 1229028 - RNA, 19 nt, Homo sapiens
cccaggccaucaagaagaa

SEQ ID NO: 1229029 - RNA, 19 nt, Homo sapiens
caagaccuacuucucugaa

SEQ ID NO: 1229030 - RNA, 19 nt, Homo sapiens
ggaccuccgagaccuguug

SEQ ID NO: 1229031 - RNA, 19 nt, Homo sapiens
cuacuacaacgaugauguu

SEQ ID NO: 1229032 - RNA, 19 nt, Homo sapiens
gcccaaccuuugcccuaga

SEQ ID NO: 1229033 - RNA, 19 nt, Homo sapiens
gagaaugcccaggccauca

SEQ ID NO: 1229034 - RNA, 19 nt, Homo sapiens
ccgugugccuucuaccaaa

SEQ ID NO: 1229035 - RNA, 19 nt, Homo sapiens
uagaaggaccaaagcaugu

SEQ ID NO: 1229036 - RNA, 19 nt, Homo sapiens
ugagccaguugcccuccua

SEQ ID NO: 1229037 - RNA, 19 nt, Homo sapiens
ugugaccacuggcccuaaa

SEQ ID NO: 1229038 - RNA, 19 nt, Homo sapiens
gcccaggccaucaagaaga

SEQ ID NO: 1229039 - RNA, 19 nt, Homo sapiens
gcuagaaggaccaaagcau

SEQ ID NO: 1229040 - RNA, 19 nt, Homo sapiens
gcagaggaaugggcauagc

SEQ ID NO: 1229041 - RNA, 19 nt, Homo sapiens
cggaaggcaugcccuggau

SEQ ID NO: 1229042 - RNA, 19 nt, Homo sapiens
cagcggaaccucaauagcu

SEQ ID NO: 1229043 - RNA, 19 nt, Homo sapiens
uggaugcccuggagaaugc

SEQ ID NO: 1229044 - RNA, 19 nt, Homo sapiens
auaccuggcugcccucuac

SEQ ID NO: 1229045 - RNA, 19 nt, Homo sapiens
uccuauugcuggcucguuu

SEQ ID NO: 1229046 - RNA, 19 nt, Homo sapiens
aagcaccacuaccaaccuu

SEQ ID NO: 1229047 - RNA, 19 nt, Homo sapiens
accaaagcauguggcauuu

SEQ ID NO: 1229048 - RNA, 19 nt, Homo sapiens
acugcucccucuagaaaga

SEQ ID NO: 1229049 - RNA, 19 nt, Homo sapiens
guccagcggaaccucaaua

SEQ ID NO: 1229050 - RNA, 19 nt, Homo sapiens
cccaggcucugaccuucuu

SEQ ID NO: 1229051 - RNA, 19 nt, Homo sapiens
ggcagaugcaccugacuug

SEQ ID NO: 1229052 - RNA, 19 nt, Homo sapiens
ccuccuagggcauguuuga

SEQ ID NO: 1229053 - RNA, 19 nt, Homo sapiens
gaacugcuacaccucuacu

SEQ ID NO: 1229054 - RNA, 19 nt, Homo sapiens
uggaacugcuacaccucua

SEQ ID NO: 1229055 - RNA, 19 nt, Homo sapiens
cagggaggagcgccaguuu

SEQ ID NO: 1229056 - RNA, 19 nt, Homo sapiens
auaccaaccugcagaagcu

SEQ ID NO: 1229057 - RNA, 19 nt, Homo sapiens
cucugcaacugaagcuaua

SEQ ID NO: 1229058 - RNA, 19 nt, Homo sapiens
gaguaccccugaugagcua

SEQ ID NO: 1229059 - RNA, 19 nt, Homo sapiens
ccugugauccgcgagagua

SEQ ID NO: 1229060 - RNA, 19 nt, Homo sapiens
gaccagugccaaauuacca

SEQ ID NO: 1229061 - RNA, 19 nt, Homo sapiens
ccacggaagcucgguagau

SEQ ID NO: 1229062 - RNA, 19 nt, Homo sapiens
ccgcaagaccuacuucucu

SEQ ID NO: 1229063 - RNA, 19 nt, Homo sapiens
cacugcggcuguccaacaa

SEQ ID NO: 1229064 - RNA, 19 nt, Homo sapiens
ggacgucagccugguacug

SEQ ID NO: 1229065 - RNA, 19 nt, Homo sapiens
ggaggggcaccaccagaua

SEQ ID NO: 1229066 - RNA, 19 nt, Homo sapiens
ccaccucuucuuccacuau

SEQ ID NO: 1229067 - RNA, 19 nt, Homo sapiens
ccacguugacccugugauc

SEQ ID NO: 1229068 - RNA, 19 nt, Homo sapiens
gcaucucaaccucgacuuc

SEQ ID NO: 1229069 - RNA, 19 nt, Homo sapiens
caaguuaaagauggugaau

SEQ ID NO: 1229070 - RNA, 19 nt, Homo sapiens
gcacgggacuuuguaguga

SEQ ID NO: 1229071 - RNA, 19 nt, Homo sapiens
ggaaccagcugcuaucauc

SEQ ID NO: 1229072 - RNA, 19 nt, Homo sapiens
caugaccagugccaaauua

SEQ ID NO: 1229073 - RNA, 19 nt, Homo sapiens
gcaccugacuugcugcuau

SEQ ID NO: 1229074 - RNA, 19 nt, Homo sapiens
gcaggaaacaccucaguga

SEQ ID NO: 1229075 - RNA, 19 nt, Homo sapiens
gcacugaccccuccaauuu

SEQ ID NO: 1229076 - RNA, 19 nt, Homo sapiens
caacggugcuggugacaca

SEQ ID NO: 1229077 - RNA, 19 nt, Homo sapiens
cacggaagcucgguagaua

SEQ ID NO: 1229078 - RNA, 19 nt, Homo sapiens
gaaggcaugcccuggauga

SEQ ID NO: 1229079 - RNA, 19 nt, Homo sapiens
ggacggaggaggaguuuca

SEQ ID NO: 1229080 - RNA, 19 nt, Homo sapiens
gaucugcgguuucucugau

SEQ ID NO: 1229081 - RNA, 19 nt, Homo sapiens
gagaggaggacuacuacaa

SEQ ID NO: 1229082 - RNA, 19 nt, Homo sapiens
guucuggacugguguuaug

SEQ ID NO: 1229083 - RNA, 19 nt, Homo sapiens
cuacaacgaugauguucug

SEQ ID NO: 1229084 - RNA, 19 nt, Homo sapiens
ggccuugucucagcucuuu

SEQ ID NO: 1229085 - RNA, 19 nt, Homo sapiens
gggcagacccuuacaagca

SEQ ID NO: 1229086 - RNA, 19 nt, Homo sapiens
gcacacuccugccugucuu

SEQ ID NO: 1229087 - RNA, 19 nt, Homo sapiens
gcaggcaccuucguguuca

SEQ ID NO: 1229088 - RNA, 19 nt, Homo sapiens
ucaaccugcugcgcaaaua

SEQ ID NO: 1229089 - RNA, 19 nt, Homo sapiens
ggugagaucugcgguuucu

SEQ ID NO: 1229090 - RNA, 19 nt, Homo sapiens
ggucccaccuccucuuugu

SEQ ID NO: 1229091 - RNA, 19 nt, Homo sapiens
ccauggugcuggagauguu

SEQ ID NO: 1229092 - RNA, 19 nt, Homo sapiens
gcaagaccuacuucucuga

SEQ ID NO: 1229093 - RNA, 19 nt, Homo sapiens
gcaggcacgggacuuugua

SEQ ID NO: 1229094 - RNA, 19 nt, Homo sapiens
gcaugaccagugccaaauu

SEQ ID NO: 1229095 - RNA, 19 nt, Homo sapiens
cugacuugcugcuauuaaa

SEQ ID NO: 1229096 - RNA, 19 nt, Homo sapiens
gugcuggguuugcgcaaga

SEQ ID NO: 1229097 - RNA, 19 nt, Homo sapiens
caccugacuugcugcuauu

SEQ ID NO: 1229098 - RNA, 19 nt, Homo sapiens
ggaggacgucagccuggua

SEQ ID NO: 1229099 - RNA, 19 nt, Homo sapiens
uagacacgguccacguuga

SEQ ID NO: 1229100 - RNA, 19 nt, Homo sapiens
ccagauguguuggaagcuu

SEQ ID NO: 1229101 - RNA, 19 nt, Homo sapiens
gcaagacgacccugcaaaa

SEQ ID NO: 1229102 - RNA, 19 nt, Homo sapiens
uggcugcccucuacauugu

SEQ ID NO: 1229103 - RNA, 19 nt, Homo sapiens
gcgaccagaugaucguauc

SEQ ID NO: 1229104 - RNA, 19 nt, Homo sapiens
cagcgccucugcaacugaa

SEQ ID NO: 1229105 - RNA, 19 nt, Homo sapiens
gagaccuguugcugcauga

SEQ ID NO: 1229106 - RNA, 19 nt, Homo sapiens
ggacuacuacaacgaugau

SEQ ID NO: 1229107 - RNA, 19 nt, Homo sapiens
ggaggacuacuacaacgau

SEQ ID NO: 1229108 - RNA, 19 nt, Homo sapiens
ugggcaaguuggccuauga

SEQ ID NO: 1229109 - RNA, 19 nt, Homo sapiens
ggcagacccuuacaagcau

SEQ ID NO: 1229110 - RNA, 19 nt, Homo sapiens
gcccucacauuggugcuuu

SEQ ID NO: 1229111 - RNA, 19 nt, Homo sapiens
gcacuccagcgaccagaug

SEQ ID NO: 1229112 - RNA, 19 nt, Homo sapiens
cagcugcuaucaucgucaa

SEQ ID NO: 1229113 - RNA, 19 nt, Homo sapiens
cccaggccaucaagaagaa

SEQ ID NO: 1229114 - RNA, 19 nt, Homo sapiens
caagaccuacuucucugaa

SEQ ID NO: 1229115 - RNA, 19 nt, Homo sapiens
ggaccuccgagaccuguug

SEQ ID NO: 1229116 - RNA, 19 nt, Homo sapiens
cuacuacaacgaugauguu

SEQ ID NO: 1229117 - RNA, 19 nt, Homo sapiens
gagaaugcccaggccauca

SEQ ID NO: 1229118 - RNA, 19 nt, Homo sapiens
gcccaaccuuugcccuaga

SEQ ID NO: 1229119 - RNA, 19 nt, Homo sapiens
ccgugugccuucuaccaaa

SEQ ID NO: 1229120 - RNA, 19 nt, Homo sapiens
gcccaggccaucaagaaga

SEQ ID NO: 1229121 - RNA, 19 nt, Homo sapiens
cggaaggcaugcccuggau

SEQ ID NO: 1229122 - RNA, 19 nt, Homo sapiens
uggaugcccuggagaaugc

SEQ ID NO: 1229123 - RNA, 19 nt, Homo sapiens
auaccuggcugcccucuac

SEQ ID NO: 1229124 - RNA, 19 nt, Homo sapiens
uccuauugcuggcucguuu

SEQ ID NO: 1229125 - RNA, 19 nt, Homo sapiens
cccaggcucugaccuucuu

SEQ ID NO: 1229126 - RNA, 19 nt, Homo sapiens
ggcagaugcaccugacuug

SEQ ID NO: 1229127 - RNA, 19 nt, Homo sapiens
auaccaaccugcagaagcu

SEQ ID NO: 1229128 - RNA, 19 nt, Homo sapiens
cagggaggagcgccaguuu

SEQ ID NO: 1229129 - RNA, 19 nt, Homo sapiens
gaccagugccaaauuacca

SEQ ID NO: 1229130 - RNA, 19 nt, Homo sapiens
ccacggaagcucgguagau

SEQ ID NO: 1229131 - RNA, 19 nt, Homo sapiens
ccgcaagaccuacuucucu

SEQ ID NO: 1229132 - RNA, 19 nt, Homo sapiens
cucugcaacugaagcuaua

SEQ ID NO: 1229133 - RNA, 19 nt, Homo sapiens
gaguaccccugaugagcua

SEQ ID NO: 1229134 - RNA, 19 nt, Homo sapiens
ccugugauccgcgagagua

SEQ ID NO: 1229135 - RNA, 19 nt, Homo sapiens
cacugcggcuguccaacaa

SEQ ID NO: 1229136 - RNA, 19 nt, Homo sapiens
ggacgucagccugguacug

SEQ ID NO: 1229137 - RNA, 19 nt, Homo sapiens
ggaggggcaccaccagaua

SEQ ID NO: 1229138 - RNA, 19 nt, Homo sapiens
ccaccucuucuuccacuau

SEQ ID NO: 1229139 - RNA, 19 nt, Homo sapiens
ccacguugacccugugauc

SEQ ID NO: 1229140 - RNA, 19 nt, Homo sapiens
gcaucucaaccucgacuuc

SEQ ID NO: 1229141 - RNA, 19 nt, Homo sapiens
gagcugaacguggcguaca

SEQ ID NO: 1229142 - RNA, 19 nt, Homo sapiens
gguguugccgugcuaaugg

SEQ ID NO: 1229143 - RNA, 19 nt, Homo sapiens
ccacacugcggcuguccaa

SEQ ID NO: 1229144 - RNA, 19 nt, Homo sapiens
gcaaaaggugggcaaggaa

SEQ ID NO: 1229145 - RNA, 19 nt, Homo sapiens
gcgcaagacgacccugcaa

SEQ ID NO: 1229146 - RNA, 19 nt, Homo sapiens
acucggcccucugccauug

SEQ ID NO: 1229147 - RNA, 19 nt, Homo sapiens
ggcaauagcuggcauguuu

SEQ ID NO: 1229148 - RNA, 19 nt, Homo sapiens
gagcaagucuguaaacuga

SEQ ID NO: 1229149 - RNA, 19 nt, Homo sapiens
gagcccagcuggccgauuu

SEQ ID NO: 1229150 - RNA, 19 nt, Homo sapiens
gcaagucuguaaacugauu

SEQ ID NO: 1229151 - RNA, 19 nt, Homo sapiens
ccaaugcaguagcuuauuu

SEQ ID NO: 1229152 - RNA, 19 nt, Homo sapiens
ugaggaaucuggucaagug

SEQ ID NO: 1229153 - RNA, 19 nt, Homo sapiens
aaagaucccugaccuguuc

SEQ ID NO: 1229154 - RNA, 19 nt, Homo sapiens
ucucugagcuguucacguu

SEQ ID NO: 1229155 - RNA, 19 nt, Homo sapiens
uguaucagcucuuucacua

SEQ ID NO: 1229156 - RNA, 19 nt, Homo sapiens
gcacugcugcucauaggua

SEQ ID NO: 1229157 - RNA, 19 nt, Homo sapiens
gcaaauucuuguuucuuca

SEQ ID NO: 1229158 - RNA, 19 nt, Homo sapiens
agacauauuucaugaaugg

SEQ ID NO: 1229159 - RNA, 19 nt, Homo sapiens
gaaugucucugagcuguuc

SEQ ID NO: 1229160 - RNA, 19 nt, Homo sapiens
ggagaucaucccagccuua

SEQ ID NO: 1229161 - RNA, 19 nt, Homo sapiens
aauacaugcugaacucaua

SEQ ID NO: 1229162 - RNA, 19 nt, Homo sapiens
cuucauugcuucuguuauu

SEQ ID NO: 1229163 - RNA, 19 nt, Homo sapiens
ggcaaauucuuguuucuuc

SEQ ID NO: 1229164 - RNA, 19 nt, Homo sapiens
gaaaccaucuuacuaaaag

SEQ ID NO: 1229165 - RNA, 19 nt, Homo sapiens
ccaggagucuucauugcuu

SEQ ID NO: 1229166 - RNA, 19 nt, Homo sapiens
cggacuagcuuaagaccaa

SEQ ID NO: 1229167 - RNA, 19 nt, Homo sapiens
aaacaaacacggugaaagu

SEQ ID NO: 1229168 - RNA, 19 nt, Homo sapiens
gcugaguugucauuccuuu

SEQ ID NO: 1229169 - RNA, 19 nt, Homo sapiens
ugcaguagcuuauuuccaa

SEQ ID NO: 1229170 - RNA, 19 nt, Homo sapiens
ugacccagcuucuuucuac

SEQ ID NO: 1229171 - RNA, 19 nt, Homo sapiens
uaucuaagaggaaagguuu

SEQ ID NO: 1229172 - RNA, 19 nt, Homo sapiens
gaggaaagguuuugucauc

SEQ ID NO: 1229173 - RNA, 19 nt, Homo sapiens
ucaguuguaucagcucuuu

SEQ ID NO: 1229174 - RNA, 19 nt, Homo sapiens
ggagcgugcuggugaugga

SEQ ID NO: 1229175 - RNA, 19 nt, Homo sapiens
ucauuccuuugcaacauua

SEQ ID NO: 1229176 - RNA, 19 nt, Homo sapiens
uuccuucacuguuguagua

SEQ ID NO: 1229177 - RNA, 19 nt, Homo sapiens
aaucaagcguauuccguuu

SEQ ID NO: 1229178 - RNA, 19 nt, Homo sapiens
gauccucccugaacaucau

SEQ ID NO: 1229179 - RNA, 19 nt, Homo sapiens
uugaaccacuggaaucauu

SEQ ID NO: 1229180 - RNA, 19 nt, Homo sapiens
uaaaauacaugcugaacuc

SEQ ID NO: 1229181 - RNA, 19 nt, Homo sapiens
gagacauauuucaugaaug

SEQ ID NO: 1229182 - RNA, 19 nt, Homo sapiens
ucccagcguuguccacuuu

SEQ ID NO: 1229183 - RNA, 19 nt, Homo sapiens
gcuuaagaccaaugcagua

SEQ ID NO: 1229184 - RNA, 19 nt, Homo sapiens
gaccaaugcaguagcuuau

SEQ ID NO: 1229185 - RNA, 19 nt, Homo sapiens
uaucagcucuuucacuacu

SEQ ID NO: 1229186 - RNA, 19 nt, Homo sapiens
ggacugggucguguucuau

SEQ ID NO: 1229187 - RNA, 19 nt, Homo sapiens
gagagaugcgccugaagga

SEQ ID NO: 1229188 - RNA, 19 nt, Homo sapiens
agauggacaugguggagaa

SEQ ID NO: 1229189 - RNA, 19 nt, Homo sapiens
gucauuccuuugcaacauu

SEQ ID NO: 1229190 - RNA, 19 nt, Homo sapiens
gguaugagcagagggaugu

SEQ ID NO: 1229191 - RNA, 19 nt, Homo sapiens
agaccaaugcaguagcuua

SEQ ID NO: 1229192 - RNA, 19 nt, Homo sapiens
gcaauagcuggcauguuug

SEQ ID NO: 1229193 - RNA, 19 nt, Homo sapiens
gaucaucccagccuuacuc

SEQ ID NO: 1229194 - RNA, 19 nt, Homo sapiens
gcuggccgauuuacaccuu

SEQ ID NO: 1229195 - RNA, 19 nt, Homo sapiens
ugaggcaucugagcaguca

SEQ ID NO: 1229196 - RNA, 19 nt, Homo sapiens
gcggaggccagaagaaugu

SEQ ID NO: 1229197 - RNA, 19 nt, Homo sapiens
gggcacugcugcucauagg

SEQ ID NO: 1229198 - RNA, 19 nt, Homo sapiens
uaaagaucccugaccuguu

SEQ ID NO: 1229199 - RNA, 19 nt, Homo sapiens
ucugagcuguucacguuga

SEQ ID NO: 1229200 - RNA, 19 nt, Homo sapiens
gguagacggagccacacua

SEQ ID NO: 1229201 - RNA, 19 nt, Homo sapiens
ucagcucuuucacuacuug

SEQ ID NO: 1229202 - RNA, 19 nt, Homo sapiens
aggcugagcaagucuguaa

SEQ ID NO: 1229203 - RNA, 19 nt, Homo sapiens
ggaucaaggacgaguguuc

SEQ ID NO: 1229204 - RNA, 19 nt, Homo sapiens
uaagaccaaugcaguagcu

SEQ ID NO: 1229205 - RNA, 19 nt, Homo sapiens
ggacuagcuuaagaccaau

SEQ ID NO: 1229206 - RNA, 19 nt, Homo sapiens
ucacaugccggacuagcuu

SEQ ID NO: 1229207 - RNA, 19 nt, Homo sapiens
ucagagguuucuccacagu

SEQ ID NO: 1229208 - RNA, 19 nt, Homo sapiens
ggaggaacggcccuuugug

SEQ ID NO: 1229209 - RNA, 19 nt, Homo sapiens
ccgauuuacaccuugauaa

SEQ ID NO: 1229210 - RNA, 19 nt, Homo sapiens
ggagcuacgacacggauca

SEQ ID NO: 1229211 - RNA, 19 nt, Homo sapiens
gaguguucgugaaagugaa

SEQ ID NO: 1229212 - RNA, 19 nt, Homo sapiens
gagcagagggauguaugga

SEQ ID NO: 1229213 - RNA, 19 nt, Homo sapiens
ggaggccagaagaauguuu

SEQ ID NO: 1229214 - RNA, 19 nt, Homo sapiens
cgaguguucgugaaaguga

SEQ ID NO: 1229215 - RNA, 19 nt, Homo sapiens
gaaacguagcagaggauuc

SEQ ID NO: 1229216 - RNA, 19 nt, Homo sapiens
ggaaacguagcagaggauu

SEQ ID NO: 1229217 - RNA, 19 nt, Homo sapiens
gauuuacaccuugauaaca

SEQ ID NO: 1229218 - RNA, 19 nt, Homo sapiens
guggugacgugcuguggau

SEQ ID NO: 1229219 - RNA, 19 nt, Homo sapiens
gcaggaggaacggcccuuu

SEQ ID NO: 1229220 - RNA, 19 nt, Homo sapiens
cuacgacacggaucaagga

SEQ ID NO: 1229221 - RNA, 19 nt, Homo sapiens
gcccaagcccaucaagguu

SEQ ID NO: 1229222 - RNA, 19 nt, Homo sapiens
gaaaacaaacacggugaaa

SEQ ID NO: 1229223 - RNA, 19 nt, Homo sapiens
gggcaaauucuuguuucuu

SEQ ID NO: 1229224 - RNA, 19 nt, Homo sapiens
gccagaagaauguuugaag

SEQ ID NO: 1229225 - RNA, 19 nt, Homo sapiens
ggaggacugggucguguuc

SEQ ID NO: 1229226 - RNA, 19 nt, Homo sapiens
cauccaggagucuucauug

SEQ ID NO: 1229227 - RNA, 19 nt, Homo sapiens
cagaagaauguuugaaggu

SEQ ID NO: 1229228 - RNA, 19 nt, Homo sapiens
gaggccagaagaauguuug

SEQ ID NO: 1229229 - RNA, 19 nt, Homo sapiens
ggaaugucucugagcuguu

SEQ ID NO: 1229230 - RNA, 19 nt, Homo sapiens
ccaagcccaucaagguucu

SEQ ID NO: 1229231 - RNA, 19 nt, Homo sapiens
aggacugggucguguucua

SEQ ID NO: 1229232 - RNA, 19 nt, Homo sapiens
ucacuguuguaguaaagag

SEQ ID NO: 1229233 - RNA, 19 nt, Homo sapiens
caaugcaguagcuuauuuc

SEQ ID NO: 1229234 - RNA, 19 nt, Homo sapiens
ccacuggaaucauuuugga

SEQ ID NO: 1229235 - RNA, 19 nt, Homo sapiens
guuguaguaaagagacaua

SEQ ID NO: 1229236 - RNA, 19 nt, Homo sapiens
gccgauuuacaccuugaua

SEQ ID NO: 1229237 - RNA, 19 nt, Homo sapiens
caugaggaaucuggucaag

SEQ ID NO: 1229238 - RNA, 19 nt, Homo sapiens
ugaaccacuggaaucauuu

SEQ ID NO: 1229239 - RNA, 19 nt, Homo sapiens
ccucugggguggaaacgua

SEQ ID NO: 1229240 - RNA, 19 nt, Homo sapiens
gagucuucauugcuucugu

SEQ ID NO: 1229241 - RNA, 19 nt, Homo sapiens
agacggagccacacuacag

SEQ ID NO: 1229242 - RNA, 19 nt, Homo sapiens
gaggaaucuggucaaguga

SEQ ID NO: 1229243 - RNA, 19 nt, Homo sapiens
cccugaacaucaugaggaa

SEQ ID NO: 1229244 - RNA, 19 nt, Homo sapiens
caaggcggaggccagaaga

SEQ ID NO: 1229245 - RNA, 19 nt, Homo sapiens
gaaccacuggaaucauuuu

SEQ ID NO: 1229246 - RNA, 19 nt, Homo sapiens
caacaaagguguacaauga

SEQ ID NO: 1229247 - RNA, 19 nt, Homo sapiens
gcaccugacucaaauguua

SEQ ID NO: 1229248 - RNA, 19 nt, Homo sapiens
gagagaagcccuacaaaua

SEQ ID NO: 1229249 - RNA, 19 nt, Homo sapiens
gaauaucgcuggccucauu

SEQ ID NO: 1229250 - RNA, 19 nt, Homo sapiens
gagaacaucuuuacucuga

SEQ ID NO: 1229251 - RNA, 19 nt, Homo sapiens
gaaaguggaugauggagaa

SEQ ID NO: 1229252 - RNA, 19 nt, Homo sapiens
caaccgaaauucauccuua

SEQ ID NO: 1229253 - RNA, 19 nt, Homo sapiens
ggaaauccuucaacagaaa

SEQ ID NO: 1229254 - RNA, 19 nt, Homo sapiens
gagagaagccuuauacuug

SEQ ID NO: 1229255 - RNA, 19 nt, Homo sapiens
aaacggaacucuucucuug

SEQ ID NO: 1229256 - RNA, 19 nt, Homo sapiens
uaagagaacuggugacaau

SEQ ID NO: 1229257 - RNA, 19 nt, Homo sapiens
ggaagcaauuugugaauau

SEQ ID NO: 1229258 - RNA, 19 nt, Homo sapiens
ggagaaacccuaugaaugu

SEQ ID NO: 1229259 - RNA, 19 nt, Homo sapiens
ggaaaguccuucuccaaga

SEQ ID NO: 1229260 - RNA, 19 nt, Homo sapiens
uaacggaugugguuuguug

SEQ ID NO: 1229261 - RNA, 19 nt, Homo sapiens
gugaauaaauuaccuguga

SEQ ID NO: 1229262 - RNA, 19 nt, Homo sapiens
gggcauaaauggcuaaugu

SEQ ID NO: 1229263 - RNA, 19 nt, Homo sapiens
gcauuauacuccugcaaua

SEQ ID NO: 1229264 - RNA, 19 nt, Homo sapiens
gaagaaauccagugagaga

SEQ ID NO: 1229265 - RNA, 19 nt, Homo sapiens
caccaugccuggcuaauuu

SEQ ID NO: 1229266 - RNA, 19 nt, Homo sapiens
gaacaugauuggaaugaag

SEQ ID NO: 1229267 - RNA, 19 nt, Homo sapiens
cagaaacucucaccucauu

SEQ ID NO: 1229268 - RNA, 19 nt, Homo sapiens
caaauacccugaaaguguu

SEQ ID NO: 1229269 - RNA, 19 nt, Homo sapiens
acucugagcucaucgcuua

SEQ ID NO: 1229270 - RNA, 19 nt, Homo sapiens
ggaaagggcugcuucuaac

SEQ ID NO: 1229271 - RNA, 19 nt, Homo sapiens
gaaauuaucugggcauggu

SEQ ID NO: 1229272 - RNA, 19 nt, Homo sapiens
gagaaacccuaugaaugua

SEQ ID NO: 1229273 - RNA, 19 nt, Homo sapiens
gagagaagcccuaugaaug

SEQ ID NO: 1229274 - RNA, 19 nt, Homo sapiens
ggaaaaggcuucaaccauu

SEQ ID NO: 1229275 - RNA, 19 nt, Homo sapiens
ggaaugaaaugugcaaaca

SEQ ID NO: 1229276 - RNA, 19 nt, Homo sapiens
cgagaaaccuuaugaaugc

SEQ ID NO: 1229277 - RNA, 19 nt, Homo sapiens
gaaacaagcaggccagaug

SEQ ID NO: 1229278 - RNA, 19 nt, Homo sapiens
gaacuccagagacaacuua

SEQ ID NO: 1229279 - RNA, 19 nt, Homo sapiens
gaaacccuaugaauguaaa

SEQ ID NO: 1229280 - RNA, 19 nt, Homo sapiens
gaugugguuuguugcuuua

SEQ ID NO: 1229281 - RNA, 19 nt, Homo sapiens
gagaagccuuauacuugua

SEQ ID NO: 1229282 - RNA, 19 nt, Homo sapiens
gagcgagacuccauuucaa

SEQ ID NO: 1229283 - RNA, 19 nt, Homo sapiens
caaaguagcugggauugca

SEQ ID NO: 1229284 - RNA, 19 nt, Homo sapiens
gaaguacccugugauguag

SEQ ID NO: 1229285 - RNA, 19 nt, Homo sapiens
ccacacaccuggccugaau

SEQ ID NO: 1229286 - RNA, 19 nt, Homo sapiens
ccacaugagucuuccaguu

SEQ ID NO: 1229287 - RNA, 19 nt, Homo sapiens
gggaaauccuucaacagaa

SEQ ID NO: 1229288 - RNA, 19 nt, Homo sapiens
ccauauagauguaacgaau

SEQ ID NO: 1229289 - RNA, 19 nt, Homo sapiens
ggagagaagccuuauacuu

SEQ ID NO: 1229290 - RNA, 19 nt, Homo sapiens
ggaugugguuuguugcuuu

SEQ ID NO: 1229291 - RNA, 19 nt, Homo sapiens
gagaaccugugaaugcauu

SEQ ID NO: 1229292 - RNA, 19 nt, Homo sapiens
gggaaacccuucacugaca

SEQ ID NO: 1229293 - RNA, 19 nt, Homo sapiens
cagccacugugaaccauua

SEQ ID NO: 1229294 - RNA, 19 nt, Homo sapiens
gagaagcccuaugagugua

SEQ ID NO: 1229295 - RNA, 19 nt, Homo sapiens
gagaagcccuaugagugua

SEQ ID NO: 1229296 - RNA, 19 nt, Homo sapiens
gaaauccagugagagagaa

SEQ ID NO: 1229297 - RNA, 19 nt, Homo sapiens
caauaaugcugaggacuug

SEQ ID NO: 1229298 - RNA, 19 nt, Homo sapiens
gcaauaaugcugaggacuu

SEQ ID NO: 1229299 - RNA, 19 nt, Homo sapiens
ccagugaauugaugaaugu

SEQ ID NO: 1229300 - RNA, 19 nt, Homo sapiens
gcgagaaaccuuaugaaug

SEQ ID NO: 1229301 - RNA, 19 nt, Homo sapiens
ggagagaagcccuaugaau

SEQ ID NO: 1229302 - RNA, 19 nt, Homo sapiens
gaaaucguaugaagguaag

SEQ ID NO: 1229303 - RNA, 19 nt, Homo sapiens
agaaguacccugugaugua

SEQ ID NO: 1229304 - RNA, 19 nt, Homo sapiens
gggcaaacuaggugaauaa

SEQ ID NO: 1229305 - RNA, 19 nt, Homo sapiens
ggagagaaacaauauagau

SEQ ID NO: 1229306 - RNA, 19 nt, Homo sapiens
ggaaguuauucauggaaga

SEQ ID NO: 1229307 - RNA, 19 nt, Homo sapiens
acaaauacccugaaagugu

SEQ ID NO: 1229308 - RNA, 19 nt, Homo sapiens
gggagaaacccuaugaaug

SEQ ID NO: 1229309 - RNA, 19 nt, Homo sapiens
cuccaugguuguucauuua

SEQ ID NO: 1229310 - RNA, 19 nt, Homo sapiens
uaaagaauguggcaagacu

SEQ ID NO: 1229311 - RNA, 19 nt, Homo sapiens
acugacaucucccaccuua

SEQ ID NO: 1229312 - RNA, 19 nt, Homo sapiens
guaaaugugggaaagcuuu

SEQ ID NO: 1229313 - RNA, 19 nt, Homo sapiens
caagaaaucguaugaaggu

SEQ ID NO: 1229314 - RNA, 19 nt, Homo sapiens
ggcaagaaaucguaugaag

SEQ ID NO: 1229315 - RNA, 19 nt, Homo sapiens
gagagaaccugugaaugca

SEQ ID NO: 1229316 - RNA, 19 nt, Homo sapiens
gagagaaacaauauagaug

SEQ ID NO: 1229317 - RNA, 19 nt, Homo sapiens
guacguaagcaaacacuga

SEQ ID NO: 1229318 - RNA, 19 nt, Homo sapiens
uuaguggucuggauuguga

SEQ ID NO: 1229319 - RNA, 19 nt, Homo sapiens
agagaguucuggcaacaaa

SEQ ID NO: 1229320 - RNA, 19 nt, Homo sapiens
gaaccaggagggacacuug

SEQ ID NO: 1229321 - RNA, 19 nt, Homo sapiens
ccacugugaaccauuauaa

SEQ ID NO: 1229322 - RNA, 19 nt, Homo sapiens
ccuuuaagcuauccaguga

SEQ ID NO: 1229323 - RNA, 19 nt, Homo sapiens
guacaucagaggcuccaua

SEQ ID NO: 1229324 - RNA, 19 nt, Homo sapiens
gaaacucucaccucauugu

SEQ ID NO: 1229325 - RNA, 19 nt, Homo sapiens
gaaaaggcuucaaccauuc

SEQ ID NO: 1229326 - RNA, 19 nt, Homo sapiens
agagagaaguacccuguga

SEQ ID NO: 1229327 - RNA, 19 nt, Homo sapiens
gagggacacuugaggcaau

SEQ ID NO: 1229328 - RNA, 19 nt, Homo sapiens
gagacaggguuucgcuaug

SEQ ID NO: 1229329 - RNA, 19 nt, Homo sapiens
gagccacacuguuaagucu

SEQ ID NO: 1229330 - RNA, 19 nt, Homo sapiens
uaagcuauccagugaauug

SEQ ID NO: 1229331 - RNA, 19 nt, Homo sapiens
ggagagcaacccauggaaa

SEQ ID NO: 1229332 - RNA, 19 nt, Homo sapiens
agagaagccuuauacuugu

SEQ ID NO: 1229333 - RNA, 19 nt, Homo sapiens
gaacucuucucuuguuuug

SEQ ID NO: 1229334 - RNA, 19 nt, Homo sapiens
aaccaucgaugucaaguau

SEQ ID NO: 1229335 - RNA, 19 nt, Homo sapiens
cguaugaagguaagaauuu

SEQ ID NO: 1229336 - RNA, 19 nt, Homo sapiens
gaagcaauuugugaauauc

SEQ ID NO: 1229337 - RNA, 19 nt, Homo sapiens
acaaagguguacaaugaga

SEQ ID NO: 1229338 - RNA, 19 nt, Homo sapiens
caggagagaagcccuauga

SEQ ID NO: 1229339 - RNA, 19 nt, Homo sapiens
gagaacuggugacaaugau

SEQ ID NO: 1229340 - RNA, 19 nt, Homo sapiens
ggacucaggaagcaauuug

SEQ ID NO: 1229341 - RNA, 19 nt, Homo sapiens
aaugaagucguuccucuua

SEQ ID NO: 1229342 - RNA, 19 nt, Homo sapiens
ggaaugaagagcccuguag

SEQ ID NO: 1229343 - RNA, 19 nt, Homo sapiens
cacacacacuggaaugaaa

SEQ ID NO: 1229344 - RNA, 19 nt, Homo sapiens
gagagugcguaccucauca

SEQ ID NO: 1229345 - RNA, 19 nt, Homo sapiens
caagaacuacaaccugauu

SEQ ID NO: 1229346 - RNA, 19 nt, Homo sapiens
gcaggaauaugucuaacua

SEQ ID NO: 1229347 - RNA, 19 nt, Homo sapiens
ccacauaucuguagggauu

SEQ ID NO: 1229348 - RNA, 19 nt, Homo sapiens
ggaagaaacuccagagaca

SEQ ID NO: 1229349 - RNA, 19 nt, Homo sapiens
guagagaaguaaccacaua

SEQ ID NO: 1229350 - RNA, 19 nt, Homo sapiens
gaaagcauaugccauggaa

SEQ ID NO: 1229351 - RNA, 19 nt, Homo sapiens
ggacagauggcaaggauuu

SEQ ID NO: 1229352 - RNA, 19 nt, Homo sapiens
gaaagagauuggugagaga

SEQ ID NO: 1229353 - RNA, 19 nt, Homo sapiens
gaaguuguguagcaaaguu

SEQ ID NO: 1229354 - RNA, 19 nt, Homo sapiens
gagcauucguuucaccaua

SEQ ID NO: 1229355 - RNA, 19 nt, Homo sapiens
gaaaccaagcucauaguaa

SEQ ID NO: 1229356 - RNA, 19 nt, Homo sapiens
gaagacagccuuacagaag

SEQ ID NO: 1229357 - RNA, 19 nt, Homo sapiens
gucagaaacuguuaaagaa

SEQ ID NO: 1229358 - RNA, 19 nt, Homo sapiens
cagcaucucucuuucagaa

SEQ ID NO: 1229359 - RNA, 19 nt, Homo sapiens
ggaagaaaccaagcucaua

SEQ ID NO: 1229360 - RNA, 19 nt, Homo sapiens
caucugauaucaugaguug

SEQ ID NO: 1229361 - RNA, 19 nt, Homo sapiens
gaaguaaccacauaucugu

SEQ ID NO: 1229362 - RNA, 19 nt, Homo sapiens
ucagagaauuugucagaaa

SEQ ID NO: 1229363 - RNA, 19 nt, Homo sapiens
guugaaaucuguaucacaa

SEQ ID NO: 1229364 - RNA, 19 nt, Homo sapiens
gaauuguuguccuuuaaga

SEQ ID NO: 1229365 - RNA, 19 nt, Homo sapiens
gcauguagcagcaaagaaa

SEQ ID NO: 1229366 - RNA, 19 nt, Homo sapiens
gaacugugcaggaauaugu

SEQ ID NO: 1229367 - RNA, 19 nt, Homo sapiens
caacauggagcauucguuu

SEQ ID NO: 1229368 - RNA, 19 nt, Homo sapiens
caauagaacucagcaaagu

SEQ ID NO: 1229369 - RNA, 19 nt, Homo sapiens
gcauguggaugaagagaga

SEQ ID NO: 1229370 - RNA, 19 nt, Homo sapiens
aaaggaaagucuaaagaug

SEQ ID NO: 1229371 - RNA, 19 nt, Homo sapiens
gaagaaaccaagcucauag

SEQ ID NO: 1229372 - RNA, 19 nt, Homo sapiens
agagacaucuuccgcauga

SEQ ID NO: 1229373 - RNA, 19 nt, Homo sapiens
ucacugagcugagcggauu

SEQ ID NO: 1229374 - RNA, 19 nt, Homo sapiens
acacggaaguuauaguaaa

SEQ ID NO: 1229375 - RNA, 19 nt, Homo sapiens
gcaggauucuuaguaaaug

SEQ ID NO: 1229376 - RNA, 19 nt, Homo sapiens
uaaaauggcaggauucuua

SEQ ID NO: 1229377 - RNA, 19 nt, Homo sapiens
caagucagauggaaguuca

SEQ ID NO: 1229378 - RNA, 19 nt, Homo sapiens
gugcaacaauccugagaaa

SEQ ID NO: 1229379 - RNA, 19 nt, Homo sapiens
gagguucuuugacguguuu

SEQ ID NO: 1229380 - RNA, 19 nt, Homo sapiens
gcucacagcuuugaaacug

SEQ ID NO: 1229381 - RNA, 19 nt, Homo sapiens
gaaguguauuccuuuccua

SEQ ID NO: 1229382 - RNA, 19 nt, Homo sapiens
ccacaggcauuguauuauc

SEQ ID NO: 1229383 - RNA, 19 nt, Homo sapiens
gaaauuggaaagaagauuc

SEQ ID NO: 1229384 - RNA, 19 nt, Homo sapiens
guucagaaguguauuccuu

SEQ ID NO: 1229385 - RNA, 19 nt, Homo sapiens
ucagcaaagugaaagcaua

SEQ ID NO: 1229386 - RNA, 19 nt, Homo sapiens
cauauagacucagagaauu

SEQ ID NO: 1229387 - RNA, 19 nt, Homo sapiens
cagauuaccaaaccaauaa

SEQ ID NO: 1229388 - RNA, 19 nt, Homo sapiens
caccacaggcauuguauua

SEQ ID NO: 1229389 - RNA, 19 nt, Homo sapiens
ugaaaucuguaucacaaga

SEQ ID NO: 1229390 - RNA, 19 nt, Homo sapiens
gaagaaugcagcagaaugg

SEQ ID NO: 1229391 - RNA, 19 nt, Homo sapiens
gauaucaugaguugcauuu

SEQ ID NO: 1229392 - RNA, 19 nt, Homo sapiens
cagaauggcuccagugcau

SEQ ID NO: 1229393 - RNA, 19 nt, Homo sapiens
cagaucauguuucuauuuc

SEQ ID NO: 1229394 - RNA, 19 nt, Homo sapiens
ggucauuacugccuauaca

SEQ ID NO: 1229395 - RNA, 19 nt, Homo sapiens
aagauaagcucuacuugca

SEQ ID NO: 1229396 - RNA, 19 nt, Homo sapiens
ccuauagaauaccaagaua

SEQ ID NO: 1229397 - RNA, 19 nt, Homo sapiens
ugagaagaaugcagcagaa

SEQ ID NO: 1229398 - RNA, 19 nt, Homo sapiens
ugaaggcuguggccaagaa

SEQ ID NO: 1229399 - RNA, 19 nt, Homo sapiens
aaaccaagcucauaguaac

SEQ ID NO: 1229400 - RNA, 19 nt, Homo sapiens
aaggaacugugcaggaaua

SEQ ID NO: 1229401 - RNA, 19 nt, Homo sapiens
ggcaguaguugaaaucugu

SEQ ID NO: 1229402 - RNA, 19 nt, Homo sapiens
gaccuuucauggaauaaga

SEQ ID NO: 1229403 - RNA, 19 nt, Homo sapiens
gaaaucuucacagacaaua

SEQ ID NO: 1229404 - RNA, 19 nt, Homo sapiens
caacaauccugagaaagca

SEQ ID NO: 1229405 - RNA, 19 nt, Homo sapiens
gaagacacugugagaaguu

SEQ ID NO: 1229406 - RNA, 19 nt, Homo sapiens
guguauuccuuuccuaauu

SEQ ID NO: 1229407 - RNA, 19 nt, Homo sapiens
ccacagaggcaacaaggaa

SEQ ID NO: 1229408 - RNA, 19 nt, Homo sapiens
gaacucagcaaaguacaga

SEQ ID NO: 1229409 - RNA, 19 nt, Homo sapiens
ucaguuucauacccaaaua

SEQ ID NO: 1229410 - RNA, 19 nt, Homo sapiens
ucacacggaaguuauagua

SEQ ID NO: 1229411 - RNA, 19 nt, Homo sapiens
acaaggaacugugcaggaa

SEQ ID NO: 1229412 - RNA, 19 nt, Homo sapiens
guagcaaaguuguucuuca

SEQ ID NO: 1229413 - RNA, 19 nt, Homo sapiens
gagaaguuguguagcaaag

SEQ ID NO: 1229414 - RNA, 19 nt, Homo sapiens
cugcaaguccuauagaaua

SEQ ID NO: 1229415 - RNA, 19 nt, Homo sapiens
augacaagcugccguuuaa

SEQ ID NO: 1229416 - RNA, 19 nt, Homo sapiens
cagagagugucaaugaaga

SEQ ID NO: 1229417 - RNA, 19 nt, Homo sapiens
aaucgcaucugauaucaug

SEQ ID NO: 1229418 - RNA, 19 nt, Homo sapiens
aaagucaacugaucaaacu

SEQ ID NO: 1229419 - RNA, 19 nt, Homo sapiens
uggaauuguuguccuuuaa

SEQ ID NO: 1229420 - RNA, 19 nt, Homo sapiens
cgaagacacuccucaugca

SEQ ID NO: 1229421 - RNA, 19 nt, Homo sapiens
gaaagucaacugaucaaac

SEQ ID NO: 1229422 - RNA, 19 nt, Homo sapiens
aagggaaaguagagaagua

SEQ ID NO: 1229423 - RNA, 19 nt, Homo sapiens
caagauggccagccucuca

SEQ ID NO: 1229424 - RNA, 19 nt, Homo sapiens
ccagaucauguuucuauuu

SEQ ID NO: 1229425 - RNA, 19 nt, Homo sapiens
caaaggguguggguucaga

SEQ ID NO: 1229426 - RNA, 19 nt, Homo sapiens
gauauagucugggccaagu

SEQ ID NO: 1229427 - RNA, 19 nt, Homo sapiens
gagaccgaguccauugaaa

SEQ ID NO: 1229428 - RNA, 19 nt, Homo sapiens
uuagaugacucugagauug

SEQ ID NO: 1229429 - RNA, 19 nt, Homo sapiens
caaagaaagggaaaguaga

SEQ ID NO: 1229430 - RNA, 19 nt, Homo sapiens
ccaaagaaagggaaaguag

SEQ ID NO: 1229431 - RNA, 19 nt, Homo sapiens
ccauggaaauuggaaagaa

SEQ ID NO: 1229432 - RNA, 19 nt, Homo sapiens
gacagacacugagagauca

SEQ ID NO: 1229433 - RNA, 19 nt, Homo sapiens
gacaagcugccguuuaaga

SEQ ID NO: 1229434 - RNA, 19 nt, Homo sapiens
auaauuagcucaucuucag

SEQ ID NO: 1229435 - RNA, 19 nt, Homo sapiens
gucauacucuaacagcuuu

SEQ ID NO: 1229436 - RNA, 19 nt, Homo sapiens
gcaacaauccugagaaagc

SEQ ID NO: 1229437 - RNA, 19 nt, Homo sapiens
gcauaugccauggaaauug

SEQ ID NO: 1229438 - RNA, 19 nt, Homo sapiens
ugucagaaacuguuaaaga

SEQ ID NO: 1229439 - RNA, 19 nt, Homo sapiens
gaauuugucagaaacuguu

SEQ ID NO: 1229440 - RNA, 19 nt, Homo sapiens
gcugaucacacggaaguua

SEQ ID NO: 1229441 - RNA, 19 nt, Homo sapiens
guagaaagucaacugauca

SEQ ID NO: 1229442 - RNA, 19 nt, Homo sapiens
gaucauguuucuauuucag

SEQ ID NO: 1229443 - RNA, 19 nt, Homo sapiens
ccugaucaguguaccauug

SEQ ID NO: 1229444 - RNA, 19 nt, Homo sapiens
gcauucguuucaccauauu

SEQ ID NO: 1229445 - RNA, 19 nt, Homo sapiens
gaagacacuccucaugcaa

SEQ ID NO: 1229446 - RNA, 19 nt, Homo sapiens
gaagauaacucaagaauug

SEQ ID NO: 1229447 - RNA, 19 nt, Homo sapiens
gagaauuacugcuuaguua

SEQ ID NO: 1229448 - RNA, 19 nt, Homo sapiens
gaauaacccugacuucuga

SEQ ID NO: 1229449 - RNA, 19 nt, Homo sapiens
gaacuuaaaucucucaaag

SEQ ID NO: 1229450 - RNA, 19 nt, Homo sapiens
ggaaggaacuuaaaucucu

SEQ ID NO: 1229451 - RNA, 19 nt, Homo sapiens
gaagccaacugaaaugauu

SEQ ID NO: 1229452 - RNA, 19 nt, Homo sapiens
ggagaaggcuagaaagguu

SEQ ID NO: 1229453 - RNA, 19 nt, Homo sapiens
uaagauggauucagcauga

SEQ ID NO: 1229454 - RNA, 19 nt, Homo sapiens
gcagaagaccagccuguua

SEQ ID NO: 1229455 - RNA, 19 nt, Homo sapiens
gaagucaagucauguuugu

SEQ ID NO: 1229456 - RNA, 19 nt, Homo sapiens
ggacuuaaguuccuugucu

SEQ ID NO: 1229457 - RNA, 19 nt, Homo sapiens
gaaaugauuccucugugua

SEQ ID NO: 1229458 - RNA, 19 nt, Homo sapiens
cuaaauaaccugaguaguu

SEQ ID NO: 1229459 - RNA, 19 nt, Homo sapiens
ggaccuaacuggcgagcaa

SEQ ID NO: 1229460 - RNA, 19 nt, Homo sapiens
gaaaugcccugggaaucaa

SEQ ID NO: 1229461 - RNA, 19 nt, Homo sapiens
aaauaucccucacaugaaa

SEQ ID NO: 1229462 - RNA, 19 nt, Homo sapiens
cagagaccauccucaauuu

SEQ ID NO: 1229463 - RNA, 19 nt, Homo sapiens
ugaaugucaucguguguua

SEQ ID NO: 1229464 - RNA, 19 nt, Homo sapiens
agaaauaucccucacauga

SEQ ID NO: 1229465 - RNA, 19 nt, Homo sapiens
ggaggaaucaauuguguaa

SEQ ID NO: 1229466 - RNA, 19 nt, Homo sapiens
gaacuaugauccaccucaa

SEQ ID NO: 1229467 - RNA, 19 nt, Homo sapiens
gaucacguguauuuggaua

SEQ ID NO: 1229468 - RNA, 19 nt, Homo sapiens
cagaucagcauuuguauuu

SEQ ID NO: 1229469 - RNA, 19 nt, Homo sapiens
gaaauaucccucacaugaa

SEQ ID NO: 1229470 - RNA, 19 nt, Homo sapiens
gcaagugggaugugcauuu

SEQ ID NO: 1229471 - RNA, 19 nt, Homo sapiens
acaaauaugcuucgucuaa

SEQ ID NO: 1229472 - RNA, 19 nt, Homo sapiens
caagucauguuuguaguuu

SEQ ID NO: 1229473 - RNA, 19 nt, Homo sapiens
gagagaauguauauuugga

SEQ ID NO: 1229474 - RNA, 19 nt, Homo sapiens
caacugaggugucuguucu

SEQ ID NO: 1229475 - RNA, 19 nt, Homo sapiens
guaaaagccucgguucuua

SEQ ID NO: 1229476 - RNA, 19 nt, Homo sapiens
uacaaucccugcuauuauu

SEQ ID NO: 1229477 - RNA, 19 nt, Homo sapiens
agaaacucaugucugauua

SEQ ID NO: 1229478 - RNA, 19 nt, Homo sapiens
ggaaaccacacaggacuua

SEQ ID NO: 1229479 - RNA, 19 nt, Homo sapiens
guacuuugcuacuagauag

SEQ ID NO: 1229480 - RNA, 19 nt, Homo sapiens
uuacuucaguucugcauaa

SEQ ID NO: 1229481 - RNA, 19 nt, Homo sapiens
ggaauaacccugacuucug

SEQ ID NO: 1229482 - RNA, 19 nt, Homo sapiens
guagaaauaucccucacau

SEQ ID NO: 1229483 - RNA, 19 nt, Homo sapiens
uuaaacugcucucagaauu

SEQ ID NO: 1229484 - RNA, 19 nt, Homo sapiens
gaacacaacagcagauuuu

SEQ ID NO: 1229485 - RNA, 19 nt, Homo sapiens
ugaaagaaacaaagccaua

SEQ ID NO: 1229486 - RNA, 19 nt, Homo sapiens
ccugagagaauguauauuu

SEQ ID NO: 1229487 - RNA, 19 nt, Homo sapiens
uaauucagauuucccaguu

SEQ ID NO: 1229488 - RNA, 19 nt, Homo sapiens
uggccacacuugaauauuu

SEQ ID NO: 1229489 - RNA, 19 nt, Homo sapiens
caagugggaugugcauuug

SEQ ID NO: 1229490 - RNA, 19 nt, Homo sapiens
gaauguauauuuggagaag

SEQ ID NO: 1229491 - RNA, 19 nt, Homo sapiens
uagauuggauucucaacuu

SEQ ID NO: 1229492 - RNA, 19 nt, Homo sapiens
aaaccuugcugaagcugua

SEQ ID NO: 1229493 - RNA, 19 nt, Homo sapiens
uagcagaucagcauuugua

SEQ ID NO: 1229494 - RNA, 19 nt, Homo sapiens
aaggauugcuuuggaauuu

SEQ ID NO: 1229495 - RNA, 19 nt, Homo sapiens
agaguccaguuucaucuua

SEQ ID NO: 1229496 - RNA, 19 nt, Homo sapiens
gaagaaaugauugcuacuu

SEQ ID NO: 1229497 - RNA, 19 nt, Homo sapiens
cgaaacaacugaaacuacu

SEQ ID NO: 1229498 - RNA, 19 nt, Homo sapiens
gaaacucaugucugauuaa

SEQ ID NO: 1229499 - RNA, 19 nt, Homo sapiens
uagcugauauuguucauag

SEQ ID NO: 1229500 - RNA, 19 nt, Homo sapiens
guacuaggaggaaucaauu

SEQ ID NO: 1229501 - RNA, 19 nt, Homo sapiens
cuuagagaauuacugcuua

SEQ ID NO: 1229502 - RNA, 19 nt, Homo sapiens
gcuauaaaccauuagaguu

SEQ ID NO: 1229503 - RNA, 19 nt, Homo sapiens
cagaagaccagccuguuaa

SEQ ID NO: 1229504 - RNA, 19 nt, Homo sapiens
uaauaugacugcgaaacaa

SEQ ID NO: 1229505 - RNA, 19 nt, Homo sapiens
ccucgguucuuacgccuua

SEQ ID NO: 1229506 - RNA, 19 nt, Homo sapiens
uaagagcuauuuguccauu

SEQ ID NO: 1229507 - RNA, 19 nt, Homo sapiens
auaaagggccugucucaaa

SEQ ID NO: 1229508 - RNA, 19 nt, Homo sapiens
gaaaugauugcuacuuuac

SEQ ID NO: 1229509 - RNA, 19 nt, Homo sapiens
ugcgaaacuuagagaauua

SEQ ID NO: 1229510 - RNA, 19 nt, Homo sapiens
cauuagaguuguugaagau

SEQ ID NO: 1229511 - RNA, 19 nt, Homo sapiens
ugaaaugauuccucugugu

SEQ ID NO: 1229512 - RNA, 19 nt, Homo sapiens
aacaacaacugaugaacaa

SEQ ID NO: 1229513 - RNA, 19 nt, Homo sapiens
caacaacaacugaugaaca

SEQ ID NO: 1229514 - RNA, 19 nt, Homo sapiens
gcauggagaaggcuagaaa

SEQ ID NO: 1229515 - RNA, 19 nt, Homo sapiens
gaccauccucaauuucuua

SEQ ID NO: 1229516 - RNA, 19 nt, Homo sapiens
ucagagaccauccucaauu

SEQ ID NO: 1229517 - RNA, 19 nt, Homo sapiens
gaaccacuaauuauucaga

SEQ ID NO: 1229518 - RNA, 19 nt, Homo sapiens
ggaaugcguuuacagucau

SEQ ID NO: 1229519 - RNA, 19 nt, Homo sapiens
ccgcuucugucaacaauau

SEQ ID NO: 1229520 - RNA, 19 nt, Homo sapiens
ggucaacauaucuucuuua

SEQ ID NO: 1229521 - RNA, 19 nt, Homo sapiens
gcuagaaagguuugauauu

SEQ ID NO: 1229522 - RNA, 19 nt, Homo sapiens
acauuuggauggcuauaaa

SEQ ID NO: 1229523 - RNA, 19 nt, Homo sapiens
guacagaugaggagcaaau

SEQ ID NO: 1229524 - RNA, 19 nt, Homo sapiens
ugaauaaguguacagauga

SEQ ID NO: 1229525 - RNA, 19 nt, Homo sapiens
caucaguugugaaccacua

SEQ ID NO: 1229526 - RNA, 19 nt, Homo sapiens
uaaagggccugucucaaaa

SEQ ID NO: 1229527 - RNA, 19 nt, Homo sapiens
gagaagucaagucauguuu

SEQ ID NO: 1229528 - RNA, 19 nt, Homo sapiens
cuauggcacugucaacaaa

SEQ ID NO: 1229529 - RNA, 19 nt, Homo sapiens
ggaacacaacagcagauuu

SEQ ID NO: 1229530 - RNA, 19 nt, Homo sapiens
gugcaagaguccaguuuca

SEQ ID NO: 1229531 - RNA, 19 nt, Homo sapiens
ggagauauggaaagcagaa

SEQ ID NO: 1229532 - RNA, 19 nt, Homo sapiens
guaaucauccugcuagcuu

SEQ ID NO: 1229533 - RNA, 19 nt, Homo sapiens
cauuugauaugcuuuggaa

SEQ ID NO: 1229534 - RNA, 19 nt, Homo sapiens
gaauaaguguacagaugag

SEQ ID NO: 1229535 - RNA, 19 nt, Homo sapiens
aaauaugcuucgucuaaga

SEQ ID NO: 1229536 - RNA, 19 nt, Homo sapiens
ucacuauggucgucagaga

SEQ ID NO: 1229537 - RNA, 19 nt, Homo sapiens
gcaaugggagauauggaaa

SEQ ID NO: 1229538 - RNA, 19 nt, Homo sapiens
uuauuuguaucccugcuua

SEQ ID NO: 1229539 - RNA, 19 nt, Homo sapiens
gcagaucagcauuuguauu

SEQ ID NO: 1229540 - RNA, 19 nt, Homo sapiens
uaaacugcucucagaauuu

SEQ ID NO: 1229541 - RNA, 19 nt, Homo sapiens
caaauaugcuucgucuaag

SEQ ID NO: 1229542 - RNA, 19 nt, Homo sapiens
ggagaagucaagucauguu

SEQ ID NO: 1229543 - RNA, 19 nt, Homo sapiens
gcaagaguccaguuucauc

SEQ ID NO: 1229544 - RNA, 19 nt, Homo sapiens
acuuaaaucucucaaagga

SEQ ID NO: 1229545 - RNA, 19 nt, Homo sapiens
ccacuaauuauucagauga

SEQ ID NO: 1229546 - RNA, 19 nt, Homo sapiens
caaaugcgcugacguauau

SEQ ID NO: 1229547 - RNA, 19 nt, Homo sapiens
caaagaugcugccuuaguu

SEQ ID NO: 1229548 - RNA, 19 nt, Homo sapiens
gugaauaacuucccagaca

SEQ ID NO: 1229549 - RNA, 19 nt, Homo sapiens
gagcugggcugccacuaug

SEQ ID NO: 1229550 - RNA, 19 nt, Homo sapiens
gaugagggcuucggugaug

SEQ ID NO: 1229551 - RNA, 19 nt, Homo sapiens
ggucggcguuuaagucaaa

SEQ ID NO: 1229552 - RNA, 19 nt, Homo sapiens
gcaaagaugcugccuuagu

SEQ ID NO: 1229553 - RNA, 19 nt, Homo sapiens
ccaacaccaugaacaacua

SEQ ID NO: 1229554 - RNA, 19 nt, Homo sapiens
uggaagagcuggagcacuu

SEQ ID NO: 1229555 - RNA, 19 nt, Homo sapiens
guuacuggcuccuggauga

SEQ ID NO: 1229556 - RNA, 19 nt, Homo sapiens
ggagucagcagcuaggaaa

SEQ ID NO: 1229557 - RNA, 19 nt, Homo sapiens
acacaggacuuggccauga

SEQ ID NO: 1229558 - RNA, 19 nt, Homo sapiens
gcgcugacguauauaaagu

SEQ ID NO: 1229559 - RNA, 19 nt, Homo sapiens
ugacguauauaaagugcuu

SEQ ID NO: 1229560 - RNA, 19 nt, Homo sapiens
ucaaaugcgcugacguaua

SEQ ID NO: 1229561 - RNA, 19 nt, Homo sapiens
caguucagcugucuguaaa

SEQ ID NO: 1229562 - RNA, 19 nt, Homo sapiens
agagaggagugaauaacuu

SEQ ID NO: 1229563 - RNA, 19 nt, Homo sapiens
gaagcagggucuggaaugg

SEQ ID NO: 1229564 - RNA, 19 nt, Homo sapiens
ccuccgagcucuuuaaacu

SEQ ID NO: 1229565 - RNA, 19 nt, Homo sapiens
ggccagagaggagugaaua

SEQ ID NO: 1229566 - RNA, 19 nt, Homo sapiens
ggaccuccgagcucuuuaa

SEQ ID NO: 1229567 - RNA, 19 nt, Homo sapiens
ccaguucagcugucuguaa

SEQ ID NO: 1229568 - RNA, 19 nt, Homo sapiens
caagggaagccuccagaga

SEQ ID NO: 1229569 - RNA, 19 nt, Homo sapiens
gggcaggagucagcagcua

SEQ ID NO: 1229570 - RNA, 19 nt, Homo sapiens
gcagggugccuuccaguag

SEQ ID NO: 1229571 - RNA, 19 nt, Homo sapiens
ugccuucguuuccucauuu

SEQ ID NO: 1229572 - RNA, 19 nt, Homo sapiens
gagaggagugaauaacuuc

SEQ ID NO: 1229573 - RNA, 19 nt, Homo sapiens
ggagcugggcugccacuau

SEQ ID NO: 1229574 - RNA, 19 nt, Homo sapiens
ucuguaaaguggagccauu

SEQ ID NO: 1229575 - RNA, 19 nt, Homo sapiens
uaaaguggagccauuaguc

SEQ ID NO: 1229576 - RNA, 19 nt, Homo sapiens
guucagcugucuguaaagu

SEQ ID NO: 1229577 - RNA, 19 nt, Homo sapiens
uccgagcucuuuaaacugu

SEQ ID NO: 1229578 - RNA, 19 nt, Homo sapiens
gccuucguuuccucauuua

SEQ ID NO: 1229579 - RNA, 19 nt, Homo sapiens
ccaggcagagcccacagua

SEQ ID NO: 1229580 - RNA, 19 nt, Homo sapiens
gaccuccgagcucuuuaaa

SEQ ID NO: 1229581 - RNA, 19 nt, Homo sapiens
gggcugccacuaugauaau

SEQ ID NO: 1229582 - RNA, 19 nt, Homo sapiens
guaaaguggagccauuagu

SEQ ID NO: 1229583 - RNA, 19 nt, Homo sapiens
gaaggcacgacccaguuca

SEQ ID NO: 1229584 - RNA, 19 nt, Homo sapiens
gucauucuaugggcaaaga

SEQ ID NO: 1229585 - RNA, 19 nt, Homo sapiens
gcuucugggucauucuaug

SEQ ID NO: 1229586 - RNA, 19 nt, Homo sapiens
gugccuucguuuccucauu

SEQ ID NO: 1229587 - RNA, 19 nt, Homo sapiens
uaacuucccagacacuuac

SEQ ID NO: 1229588 - RNA, 19 nt, Homo sapiens
gccagagaggagugaauaa

SEQ ID NO: 1229589 - RNA, 19 nt, Homo sapiens
ggccaccaguagcaucuuc

SEQ ID NO: 1229590 - RNA, 19 nt, Homo sapiens
gaauaacuucccagacacu

SEQ ID NO: 1229591 - RNA, 19 nt, Homo sapiens
gugaaggcacgacccaguu

SEQ ID NO: 1229592 - RNA, 19 nt, Homo sapiens
gggaggcccaacaccauga

SEQ ID NO: 1229593 - RNA, 19 nt, Homo sapiens
cauuagucccugccucgua

SEQ ID NO: 1229594 - RNA, 19 nt, Homo sapiens
gaagcaccagcgggaacua

SEQ ID NO: 1229595 - RNA, 19 nt, Homo sapiens
ggacgagccgcugaugaca

SEQ ID NO: 1229596 - RNA, 19 nt, Homo sapiens
ggagaguccucagcaaccu

SEQ ID NO: 1229597 - RNA, 19 nt, Homo sapiens
uaguucagguuugucagaa

SEQ ID NO: 1229598 - RNA, 19 nt, Homo sapiens
cccagaugguugagcuuga

SEQ ID NO: 1229599 - RNA, 19 nt, Homo sapiens
ccaccaguagcaucuucua

SEQ ID NO: 1229600 - RNA, 19 nt, Homo sapiens
auaacuucccagacacuua

SEQ ID NO: 1229601 - RNA, 19 nt, Homo sapiens
gugcccacaccaccgguua

SEQ ID NO: 1229602 - RNA, 19 nt, Homo sapiens
agaagcagggucuggaaug

SEQ ID NO: 1229603 - RNA, 19 nt, Homo sapiens
cagcuucugggucauucua

SEQ ID NO: 1229604 - RNA, 19 nt, Homo sapiens
ccagaugguugagcuugag

SEQ ID NO: 1229605 - RNA, 19 nt, Homo sapiens
uuccagcuguguggcuuua

SEQ ID NO: 1229606 - RNA, 19 nt, Homo sapiens
gcugauggcccugcuguac

SEQ ID NO: 1229607 - RNA, 19 nt, Homo sapiens
ggcccaacaccaugaacaa

SEQ ID NO: 1229608 - RNA, 19 nt, Homo sapiens
ggaggagaagcgcaucuac

SEQ ID NO: 1229609 - RNA, 19 nt, Homo sapiens
gaaacgacauuaugaagaa

SEQ ID NO: 1229610 - RNA, 19 nt, Homo sapiens
gcagauaucucaauaacau

SEQ ID NO: 1229611 - RNA, 19 nt, Homo sapiens
gaaggaagauuauucauac

SEQ ID NO: 1229612 - RNA, 19 nt, Homo sapiens
gcaaauagccuaauugaca

SEQ ID NO: 1229613 - RNA, 19 nt, Homo sapiens
ggaaugagauauaugaugu

SEQ ID NO: 1229614 - RNA, 19 nt, Homo sapiens
gaagacgaauguaaaggua

SEQ ID NO: 1229615 - RNA, 19 nt, Homo sapiens
gcagauacaucaaggagaa

SEQ ID NO: 1229616 - RNA, 19 nt, Homo sapiens
gaacagcaggucagacuua

SEQ ID NO: 1229617 - RNA, 19 nt, Homo sapiens
gaacaccagucuguagaua

SEQ ID NO: 1229618 - RNA, 19 nt, Homo sapiens
ucugacagcuuuagaaaua

SEQ ID NO: 1229619 - RNA, 19 nt, Homo sapiens
caacaguucugacagcuuu

SEQ ID NO: 1229620 - RNA, 19 nt, Homo sapiens
gaacaaaaguacaaggaua

SEQ ID NO: 1229621 - RNA, 19 nt, Homo sapiens
gagaagagcggcuuacuga

SEQ ID NO: 1229622 - RNA, 19 nt, Homo sapiens
ggaagucgaucuuauaaac

SEQ ID NO: 1229623 - RNA, 19 nt, Homo sapiens
gaacauauggagcaacaaa

SEQ ID NO: 1229624 - RNA, 19 nt, Homo sapiens
gaacuugcuuuggcuauug

SEQ ID NO: 1229625 - RNA, 19 nt, Homo sapiens
gaacaaaggagcagauaca

SEQ ID NO: 1229626 - RNA, 19 nt, Homo sapiens
cagaggagaugaugccuuu

SEQ ID NO: 1229627 - RNA, 19 nt, Homo sapiens
ucagaugccuggaugaauu

SEQ ID NO: 1229628 - RNA, 19 nt, Homo sapiens
agaaagaacuagaggagaa

SEQ ID NO: 1229629 - RNA, 19 nt, Homo sapiens
gcuauugaaucuugcuuaa

SEQ ID NO: 1229630 - RNA, 19 nt, Homo sapiens
caaacuacauugccuuuca

SEQ ID NO: 1229631 - RNA, 19 nt, Homo sapiens
caaaggagcagauacauca

SEQ ID NO: 1229632 - RNA, 19 nt, Homo sapiens
caacgcaacuugaacagau

SEQ ID NO: 1229633 - RNA, 19 nt, Homo sapiens
gcaacaggcuccgugguuu

SEQ ID NO: 1229634 - RNA, 19 nt, Homo sapiens
ccacaagaaugaaacucua

SEQ ID NO: 1229635 - RNA, 19 nt, Homo sapiens
uaagacggcccagauauua

SEQ ID NO: 1229636 - RNA, 19 nt, Homo sapiens
aagaagagcugauugcaau

SEQ ID NO: 1229637 - RNA, 19 nt, Homo sapiens
caaccacaaucaaacauau

SEQ ID NO: 1229638 - RNA, 19 nt, Homo sapiens
caucaauucuggacaaaga

SEQ ID NO: 1229639 - RNA, 19 nt, Homo sapiens
agauguggauucugaaaua

SEQ ID NO: 1229640 - RNA, 19 nt, Homo sapiens
acacagagcugcuuaucau

SEQ ID NO: 1229641 - RNA, 19 nt, Homo sapiens
gaaagcaacgcaacuugaa

SEQ ID NO: 1229642 - RNA, 19 nt, Homo sapiens
gauggaagucgaucuuaua

SEQ ID NO: 1229643 - RNA, 19 nt, Homo sapiens
ugauaaagauggugacgaa

SEQ ID NO: 1229644 - RNA, 19 nt, Homo sapiens
gagcacagauucaagacau

SEQ ID NO: 1229645 - RNA, 19 nt, Homo sapiens
gaauuaaaccuugcugauu

SEQ ID NO: 1229646 - RNA, 19 nt, Homo sapiens
gagcagcuuuguaaacgaa

SEQ ID NO: 1229647 - RNA, 19 nt, Homo sapiens
gaaaagggccuauaaugaa

SEQ ID NO: 1229648 - RNA, 19 nt, Homo sapiens
gauaauccaguuucuguuu

SEQ ID NO: 1229649 - RNA, 19 nt, Homo sapiens
aagaagaauuggaggauuu

SEQ ID NO: 1229650 - RNA, 19 nt, Homo sapiens
gaaaauauggagcaucuua

SEQ ID NO: 1229651 - RNA, 19 nt, Homo sapiens
gagaagaauuagaugugaa

SEQ ID NO: 1229652 - RNA, 19 nt, Homo sapiens
uaacaugccuuguccugau

SEQ ID NO: 1229653 - RNA, 19 nt, Homo sapiens
agaagaagaugaugaccaa

SEQ ID NO: 1229654 - RNA, 19 nt, Homo sapiens
gccauggacuugauacuga

SEQ ID NO: 1229655 - RNA, 19 nt, Homo sapiens
ggugccaacuacauuauaa

SEQ ID NO: 1229656 - RNA, 19 nt, Homo sapiens
caaagaagaacauggcaaa

SEQ ID NO: 1229657 - RNA, 19 nt, Homo sapiens
ucaaaguauugcugguuua

SEQ ID NO: 1229658 - RNA, 19 nt, Homo sapiens
gaaguuggaauaauugaga

SEQ ID NO: 1229659 - RNA, 19 nt, Homo sapiens
uagaagguguuugacuuua

SEQ ID NO: 1229660 - RNA, 19 nt, Homo sapiens
ggaaacgacauuaugaaga

SEQ ID NO: 1229661 - RNA, 19 nt, Homo sapiens
gauguggauucugaaauaa

SEQ ID NO: 1229662 - RNA, 19 nt, Homo sapiens
gaggagaugaugccuuuaa

SEQ ID NO: 1229663 - RNA, 19 nt, Homo sapiens
acuacaaccugcaauuuaa

SEQ ID NO: 1229664 - RNA, 19 nt, Homo sapiens
gaagaacaccagucuguag

SEQ ID NO: 1229665 - RNA, 19 nt, Homo sapiens
agaggcaacugaaagaauu

SEQ ID NO: 1229666 - RNA, 19 nt, Homo sapiens
gaaagaugaugagcagcuu

SEQ ID NO: 1229667 - RNA, 19 nt, Homo sapiens
caaauagccuaauugacau

SEQ ID NO: 1229668 - RNA, 19 nt, Homo sapiens
uaaugaagcugagguuuua

SEQ ID NO: 1229669 - RNA, 19 nt, Homo sapiens
gaacagaugaaggaagauu

SEQ ID NO: 1229670 - RNA, 19 nt, Homo sapiens
ggagacaaauacaaauucu

SEQ ID NO: 1229671 - RNA, 19 nt, Homo sapiens
guucuaaugucaacuuugu

SEQ ID NO: 1229672 - RNA, 19 nt, Homo sapiens
caacuacaaccugcaauuu

SEQ ID NO: 1229673 - RNA, 19 nt, Homo sapiens
ggacaaagaaauuaaucga

SEQ ID NO: 1229674 - RNA, 19 nt, Homo sapiens
gaagaugaagcucaggaaa

SEQ ID NO: 1229675 - RNA, 19 nt, Homo sapiens
caagaagaauuggaggauu

SEQ ID NO: 1229676 - RNA, 19 nt, Homo sapiens
uaaccgauccuuaaacgaa

SEQ ID NO: 1229677 - RNA, 19 nt, Homo sapiens
acaaggauauucaagacaa

SEQ ID NO: 1229678 - RNA, 19 nt, Homo sapiens
guacaaggauauucaagac

SEQ ID NO: 1229679 - RNA, 19 nt, Homo sapiens
acaccagucuguagauauu

SEQ ID NO: 1229680 - RNA, 19 nt, Homo sapiens
gaaauucgggaacuugaga

SEQ ID NO: 1229681 - RNA, 19 nt, Homo sapiens
gaacauggcaaaauuaaga

SEQ ID NO: 1229682 - RNA, 19 nt, Homo sapiens
ugacgaagacgaauguaaa

SEQ ID NO: 1229683 - RNA, 19 nt, Homo sapiens
ugaaugccaucagagauaa

SEQ ID NO: 1229684 - RNA, 19 nt, Homo sapiens
ugaaggagacaaauacaaa

SEQ ID NO: 1229685 - RNA, 19 nt, Homo sapiens
gaaaugagcaagcaguucu

SEQ ID NO: 1229686 - RNA, 19 nt, Homo sapiens
gaaaugaaagaaacuccuu

SEQ ID NO: 1229687 - RNA, 19 nt, Homo sapiens
gaaagaggacaaacuacau

SEQ ID NO: 1229688 - RNA, 19 nt, Homo sapiens
gacuuuacgaugcaaauua

SEQ ID NO: 1229689 - RNA, 19 nt, Homo sapiens
gaagauacaggcagaacau

SEQ ID NO: 1229690 - RNA, 19 nt, Homo sapiens
gagggaaacgacauuauga

SEQ ID NO: 1229691 - RNA, 19 nt, Homo sapiens
gcagaaguuggaauaauug

SEQ ID NO: 1229692 - RNA, 19 nt, Homo sapiens
gggcaguggucaaugaaau

SEQ ID NO: 1229693 - RNA, 19 nt, Homo sapiens
gaggaacguuuucaaagua

SEQ ID NO: 1229694 - RNA, 19 nt, Homo sapiens
gaauugccauggacuugau

SEQ ID NO: 1229695 - RNA, 19 nt, Homo sapiens
caauuuagaagguguuuga

SEQ ID NO: 1229696 - RNA, 19 nt, Homo sapiens
acacuuggauaccuuaaau

SEQ ID NO: 1229697 - RNA, 19 nt, Homo sapiens
aauuaaaccuugcugauuc

SEQ ID NO: 1229698 - RNA, 19 nt, Homo sapiens
ggagaucgagaggaaauaa

SEQ ID NO: 1229699 - RNA, 19 nt, Homo sapiens
acauuuaucugcccuugaa

SEQ ID NO: 1229700 - RNA, 19 nt, Homo sapiens
cauagaugaugcuuauaga

SEQ ID NO: 1229701 - RNA, 19 nt, Homo sapiens
gaagaacauggcaaaauua

SEQ ID NO: 1229702 - RNA, 19 nt, Homo sapiens
gaauguaaagguacuacuu

SEQ ID NO: 1229703 - RNA, 19 nt, Homo sapiens
ccgaaugucugauccugaa

SEQ ID NO: 1229704 - RNA, 19 nt, Homo sapiens
cagcagaaguuggaauaau

SEQ ID NO: 1229705 - RNA, 19 nt, Homo sapiens
ucauggagaucgagaggaa

SEQ ID NO: 1229706 - RNA, 19 nt, Homo sapiens
gaaagaacuagaggagaaa

SEQ ID NO: 1229707 - RNA, 19 nt, Homo sapiens
gagagaagaauuagaugug

SEQ ID NO: 1229708 - RNA, 19 nt, Homo sapiens
caaggauauucaagacaaa

SEQ ID NO: 1229709 - RNA, 19 nt, Homo sapiens
gcagaaggcuccaauauga

SEQ ID NO: 1229710 - RNA, 19 nt, Homo sapiens
ggaaaugccugaugggauu

SEQ ID NO: 1229711 - RNA, 19 nt, Homo sapiens
gaaugaagcuuugaaggaa

SEQ ID NO: 1229712 - RNA, 19 nt, Homo sapiens
gacaaugacugcuugaauu

SEQ ID NO: 1229713 - RNA, 19 nt, Homo sapiens
gauaacaucucucagugaa

SEQ ID NO: 1229714 - RNA, 19 nt, Homo sapiens
gaacuagagucaacugugu

SEQ ID NO: 1229715 - RNA, 19 nt, Homo sapiens
uaagagaaaugccugaguu

SEQ ID NO: 1229716 - RNA, 19 nt, Homo sapiens
gcuuugagcugaacucuga

SEQ ID NO: 1229717 - RNA, 19 nt, Homo sapiens
gaaccugacaucaaacuuu

SEQ ID NO: 1229718 - RNA, 19 nt, Homo sapiens
gagcugaacucugagaaug

SEQ ID NO: 1229719 - RNA, 19 nt, Homo sapiens
aaacauauaccuuccauga

SEQ ID NO: 1229720 - RNA, 19 nt, Homo sapiens
gggauuaucuucagcuugu

SEQ ID NO: 1229721 - RNA, 19 nt, Homo sapiens
ggaaugaagcuuugaagga

SEQ ID NO: 1229722 - RNA, 19 nt, Homo sapiens
caacagggaucuacagaac

SEQ ID NO: 1229723 - RNA, 19 nt, Homo sapiens
gcccuuaccugaugcuaaa

SEQ ID NO: 1229724 - RNA, 19 nt, Homo sapiens
augcuaaccuugaguauaa

SEQ ID NO: 1229725 - RNA, 19 nt, Homo sapiens
gaauucauaucuagaaguc

SEQ ID NO: 1229726 - RNA, 19 nt, Homo sapiens
caccagauaugaccuaguu

SEQ ID NO: 1229727 - RNA, 19 nt, Homo sapiens
ggaagugaauguggacuau

SEQ ID NO: 1229728 - RNA, 19 nt, Homo sapiens
gaauugaggccuugaggaa

SEQ ID NO: 1229729 - RNA, 19 nt, Homo sapiens
ggagcaggaugaaauguuc

SEQ ID NO: 1229730 - RNA, 19 nt, Homo sapiens
uaacaucucucagugaaca

SEQ ID NO: 1229731 - RNA, 19 nt, Homo sapiens
ugacaaggccuaugggaaa

SEQ ID NO: 1229732 - RNA, 19 nt, Homo sapiens
acagggaucuacagaacua

SEQ ID NO: 1229733 - RNA, 19 nt, Homo sapiens
gagcauaauuagcaucauc

SEQ ID NO: 1229734 - RNA, 19 nt, Homo sapiens
ggaaugcuaaccuugagua

SEQ ID NO: 1229735 - RNA, 19 nt, Homo sapiens
gagccacggugacuguauu

SEQ ID NO: 1229736 - RNA, 19 nt, Homo sapiens
ggacaaugacugcuugaau

SEQ ID NO: 1229737 - RNA, 19 nt, Homo sapiens
caagccaaguucuguaaga

SEQ ID NO: 1229738 - RNA, 19 nt, Homo sapiens
gcaugcaaagucauuguua

SEQ ID NO: 1229739 - RNA, 19 nt, Homo sapiens
gcuccaauaugaacaagau

SEQ ID NO: 1229740 - RNA, 19 nt, Homo sapiens
caaauuaaggcaacaaaca

SEQ ID NO: 1229741 - RNA, 19 nt, Homo sapiens
uuguugagcuucuaaguuu

SEQ ID NO: 1229742 - RNA, 19 nt, Homo sapiens
gcaaauaagcauucugucu

SEQ ID NO: 1229743 - RNA, 19 nt, Homo sapiens
gugugucucuucuuucuuu

SEQ ID NO: 1229744 - RNA, 19 nt, Homo sapiens
ucugugcucuacaauguua

SEQ ID NO: 1229745 - RNA, 19 nt, Homo sapiens
ccaugaagguugugucugu

SEQ ID NO: 1229746 - RNA, 19 nt, Homo sapiens
aagugaauguggacuauaa

SEQ ID NO: 1229747 - RNA, 19 nt, Homo sapiens
ucaaagaaggcaaagauga

SEQ ID NO: 1229748 - RNA, 19 nt, Homo sapiens
gcacagagagccagaacuc

SEQ ID NO: 1229749 - RNA, 19 nt, Homo sapiens
caaacaagagcaagaaaca

SEQ ID NO: 1229750 - RNA, 19 nt, Homo sapiens
gcaccaggauaacaucucu

SEQ ID NO: 1229751 - RNA, 19 nt, Homo sapiens
cauauuagaaguugggaaa

SEQ ID NO: 1229752 - RNA, 19 nt, Homo sapiens
gagcaaacaagagcaagaa

SEQ ID NO: 1229753 - RNA, 19 nt, Homo sapiens
gaagugaauguggacuaua

SEQ ID NO: 1229754 - RNA, 19 nt, Homo sapiens
gcaaggacaaugacugcuu

SEQ ID NO: 1229755 - RNA, 19 nt, Homo sapiens
gaaaugccugaugggauua

SEQ ID NO: 1229756 - RNA, 19 nt, Homo sapiens
ugucugugcucuacaaugu

SEQ ID NO: 1229757 - RNA, 19 nt, Homo sapiens
gcuggcaccuacaaauguu

SEQ ID NO: 1229758 - RNA, 19 nt, Homo sapiens
ggauaacaucucucaguga

SEQ ID NO: 1229759 - RNA, 19 nt, Homo sapiens
uaagcauucugucucuuug

SEQ ID NO: 1229760 - RNA, 19 nt, Homo sapiens
gcugaacucugagaaugug

SEQ ID NO: 1229761 - RNA, 19 nt, Homo sapiens
guucaaagaaggcaaagau

SEQ ID NO: 1229762 - RNA, 19 nt, Homo sapiens
cagauacgcugggaaccuu

SEQ ID NO: 1229763 - RNA, 19 nt, Homo sapiens
cuaaguuucuuucccuuca

SEQ ID NO: 1229764 - RNA, 19 nt, Homo sapiens
gacaaggccuaugggaaau

SEQ ID NO: 1229765 - RNA, 19 nt, Homo sapiens
cauuagucauuggcaaaua

SEQ ID NO: 1229766 - RNA, 19 nt, Homo sapiens
cucaaaggcuucucugugu

SEQ ID NO: 1229767 - RNA, 19 nt, Homo sapiens
gacagaaucggagaucaaa

SEQ ID NO: 1229768 - RNA, 19 nt, Homo sapiens
guucugaucguucaagaga

SEQ ID NO: 1229769 - RNA, 19 nt, Homo sapiens
gcacucaucauuggcuuug

SEQ ID NO: 1229770 - RNA, 19 nt, Homo sapiens
uauucuggcuggagcaauu

SEQ ID NO: 1229771 - RNA, 19 nt, Homo sapiens
gccaucagcugggcacuuc

SEQ ID NO: 1229772 - RNA, 19 nt, Homo sapiens
cugagaaugugaccaugaa

SEQ ID NO: 1229773 - RNA, 19 nt, Homo sapiens
caaagaaggcaaagaugag

SEQ ID NO: 1229774 - RNA, 19 nt, Homo sapiens
aacaagagcaagaaacaaa

SEQ ID NO: 1229775 - RNA, 19 nt, Homo sapiens
gggaucuacagaacuauuu

SEQ ID NO: 1229776 - RNA, 19 nt, Homo sapiens
gauaucaaagugacagaau

SEQ ID NO: 1229777 - RNA, 19 nt, Homo sapiens
aaauaagcauucugucucu

SEQ ID NO: 1229778 - RNA, 19 nt, Homo sapiens
cagcuccacucagccagua

SEQ ID NO: 1229779 - RNA, 19 nt, Homo sapiens
aucauuggcuuugguauuu

SEQ ID NO: 1229780 - RNA, 19 nt, Homo sapiens
caucauuggcuuugguauu

SEQ ID NO: 1229781 - RNA, 19 nt, Homo sapiens
gcaaacaagagcaagaaac

SEQ ID NO: 1229782 - RNA, 19 nt, Homo sapiens
ucucggaagucuccaauac

SEQ ID NO: 1229783 - RNA, 19 nt, Homo sapiens
gcaccuacaaauguuauau

SEQ ID NO: 1229784 - RNA, 19 nt, Homo sapiens
ugaagcacacacagacuuu

SEQ ID NO: 1229785 - RNA, 19 nt, Homo sapiens
aagcagaaggcuccaauau

SEQ ID NO: 1229786 - RNA, 19 nt, Homo sapiens
uuagaguucugaucguuca

SEQ ID NO: 1229787 - RNA, 19 nt, Homo sapiens
caugugaacuagagucaac

SEQ ID NO: 1229788 - RNA, 19 nt, Homo sapiens
ugacagaaucggagaucaa

SEQ ID NO: 1229789 - RNA, 19 nt, Homo sapiens
ucacagaugcuggcaccua

SEQ ID NO: 1229790 - RNA, 19 nt, Homo sapiens
gaguucugaucguucaaga

SEQ ID NO: 1229791 - RNA, 19 nt, Homo sapiens
aaugaagcuuugaaggaaa

SEQ ID NO: 1229792 - RNA, 19 nt, Homo sapiens
cgccucagcugggaacauu

SEQ ID NO: 1229793 - RNA, 19 nt, Homo sapiens
uauaaugccagcucagaga

SEQ ID NO: 1229794 - RNA, 19 nt, Homo sapiens
ucugaucguucaagagaau

SEQ ID NO: 1229795 - RNA, 19 nt, Homo sapiens
acaaacauauaccuuccau

SEQ ID NO: 1229796 - RNA, 19 nt, Homo sapiens
ucaacugugucagggcuaa

SEQ ID NO: 1229797 - RNA, 19 nt, Homo sapiens
caaaggcuucucugugugu

SEQ ID NO: 1229798 - RNA, 19 nt, Homo sapiens
ucuacaauguuacgaucaa

SEQ ID NO: 1229799 - RNA, 19 nt, Homo sapiens
guccaugaguucaaagaag

SEQ ID NO: 1229800 - RNA, 19 nt, Homo sapiens
aaccugacaucaaacuuuc

SEQ ID NO: 1229801 - RNA, 19 nt, Homo sapiens
gagcuucuaaguuucuuuc

SEQ ID NO: 1229802 - RNA, 19 nt, Homo sapiens
caggauaacaucucucagu

SEQ ID NO: 1229803 - RNA, 19 nt, Homo sapiens
gaauccagagcugcacuuu

SEQ ID NO: 1229804 - RNA, 19 nt, Homo sapiens
gaaugugaccaugaagguu

SEQ ID NO: 1229805 - RNA, 19 nt, Homo sapiens
gaaaagggccuggaaagag

SEQ ID NO: 1229806 - RNA, 19 nt, Homo sapiens
aacaacacauacuccugua

SEQ ID NO: 1229807 - RNA, 19 nt, Homo sapiens
cagcaugccggaagugaau

SEQ ID NO: 1229808 - RNA, 19 nt, Homo sapiens
gaugcuggcaccuacaaau

SEQ ID NO: 1229809 - RNA, 19 nt, Homo sapiens
gaucaacucucagcagaua

SEQ ID NO: 1229810 - RNA, 19 nt, Homo sapiens
gaacgaccauggagcagaa

SEQ ID NO: 1229811 - RNA, 19 nt, Homo sapiens
auacuuagcuagguucuua

SEQ ID NO: 1229812 - RNA, 19 nt, Homo sapiens
ucaaggaaguuguucaaga

SEQ ID NO: 1229813 - RNA, 19 nt, Homo sapiens
gauguuuccugugggauua

SEQ ID NO: 1229814 - RNA, 19 nt, Homo sapiens
cacaauuggugcucauuaa

SEQ ID NO: 1229815 - RNA, 19 nt, Homo sapiens
uuacauguccuuccacuuu

SEQ ID NO: 1229816 - RNA, 19 nt, Homo sapiens
gcaggaaggugggaugcaa

SEQ ID NO: 1229817 - RNA, 19 nt, Homo sapiens
gggauagcaucuuggcaaa

SEQ ID NO: 1229818 - RNA, 19 nt, Homo sapiens
cuuaagcccuaguguguaa

SEQ ID NO: 1229819 - RNA, 19 nt, Homo sapiens
ggaccucguuccuguaugg

SEQ ID NO: 1229820 - RNA, 19 nt, Homo sapiens
caaggaaguuguucaagac

SEQ ID NO: 1229821 - RNA, 19 nt, Homo sapiens
gagcagaagagcacagcua

SEQ ID NO: 1229822 - RNA, 19 nt, Homo sapiens
gccaggaucucaaggaagu

SEQ ID NO: 1229823 - RNA, 19 nt, Homo sapiens
guccaacucuguaucuaga

SEQ ID NO: 1229824 - RNA, 19 nt, Homo sapiens
ugagugggauagcaucuug

SEQ ID NO: 1229825 - RNA, 19 nt, Homo sapiens
gauaguugcaucaucuuug

SEQ ID NO: 1229826 - RNA, 19 nt, Homo sapiens
ugucccagcuggaauguga

SEQ ID NO: 1229827 - RNA, 19 nt, Homo sapiens
ggcaauacuuagcuagguu

SEQ ID NO: 1229828 - RNA, 19 nt, Homo sapiens
acacaauuggugcucauua

SEQ ID NO: 1229829 - RNA, 19 nt, Homo sapiens
gcgauuacauguccuucca

SEQ ID NO: 1229830 - RNA, 19 nt, Homo sapiens
cugggcagcuggaagguuu

SEQ ID NO: 1229831 - RNA, 19 nt, Homo sapiens
aggcucagcugcaggcauu

SEQ ID NO: 1229832 - RNA, 19 nt, Homo sapiens
gugaggcaauacuuagcua

SEQ ID NO: 1229833 - RNA, 19 nt, Homo sapiens
cagaagagcacagcuagug

SEQ ID NO: 1229834 - RNA, 19 nt, Homo sapiens
guacacaauuggugcucau

SEQ ID NO: 1229835 - RNA, 19 nt, Homo sapiens
gaacaaugcugccccucau

SEQ ID NO: 1229836 - RNA, 19 nt, Homo sapiens
ucagcucuguggccuggua

SEQ ID NO: 1229837 - RNA, 19 nt, Homo sapiens
ccaggagagccaccacuuu

SEQ ID NO: 1229838 - RNA, 19 nt, Homo sapiens
uucaagacccgaacaguuu

SEQ ID NO: 1229839 - RNA, 19 nt, Homo sapiens
gagauccucaggcgccuaa

SEQ ID NO: 1229840 - RNA, 19 nt, Homo sapiens
cgguaaaccugcagaaagg

SEQ ID NO: 1229841 - RNA, 19 nt, Homo sapiens
uguuaacacuguagcucua

SEQ ID NO: 1229842 - RNA, 19 nt, Homo sapiens
caggagagccaccacuuuc

SEQ ID NO: 1229843 - RNA, 19 nt, Homo sapiens
gcuacuggaccgcuucuug

SEQ ID NO: 1229844 - RNA, 19 nt, Homo sapiens
gcgguaaaccugcagaaag

SEQ ID NO: 1229845 - RNA, 19 nt, Homo sapiens
gcuggaagguuuggaugca

SEQ ID NO: 1229846 - RNA, 19 nt, Homo sapiens
acaauuggugcucauuaaa

SEQ ID NO: 1229847 - RNA, 19 nt, Homo sapiens
uacauguccuuccacuuug

SEQ ID NO: 1229848 - RNA, 19 nt, Homo sapiens
aauuggugcucauuaaaca

SEQ ID NO: 1229849 - RNA, 19 nt, Homo sapiens
guguguaaaugacuuggau

SEQ ID NO: 1229850 - RNA, 19 nt, Homo sapiens
gcauucgcccuuugugugu

SEQ ID NO: 1229851 - RNA, 19 nt, Homo sapiens
gggauuaccagcaguucug

SEQ ID NO: 1229852 - RNA, 19 nt, Homo sapiens
uggcaaagaaugauguuuc

SEQ ID NO: 1229853 - RNA, 19 nt, Homo sapiens
auaguugcaucaucuuugu

SEQ ID NO: 1229854 - RNA, 19 nt, Homo sapiens
ccacaccugucccuagacu

SEQ ID NO: 1229855 - RNA, 19 nt, Homo sapiens
ccaacucuguaucuagaag

SEQ ID NO: 1229856 - RNA, 19 nt, Homo sapiens
gaacaguuuugcugaguac

SEQ ID NO: 1229857 - RNA, 19 nt, Homo sapiens
ucugggcagccgccaauua

SEQ ID NO: 1229858 - RNA, 19 nt, Homo sapiens
ggcaaagaaugauguuucc

SEQ ID NO: 1229859 - RNA, 19 nt, Homo sapiens
ugccacgucugcccuguug

SEQ ID NO: 1229860 - RNA, 19 nt, Homo sapiens
caagccugguccuguggaa

SEQ ID NO: 1229861 - RNA, 19 nt, Homo sapiens
ccuaguguguaaaugacuu

SEQ ID NO: 1229862 - RNA, 19 nt, Homo sapiens
aaucgugccugguguucug

SEQ ID NO: 1229863 - RNA, 19 nt, Homo sapiens
cugcccaguucuacaugua

SEQ ID NO: 1229864 - RNA, 19 nt, Homo sapiens
gacccaggcaccuuugaug

SEQ ID NO: 1229865 - RNA, 19 nt, Homo sapiens
acauguccuuccacuuuga

SEQ ID NO: 1229866 - RNA, 19 nt, Homo sapiens
gcaggcauucgcccuuugu

SEQ ID NO: 1229867 - RNA, 19 nt, Homo sapiens
gaaaacagaggaggagguu

SEQ ID NO: 1229868 - RNA, 19 nt, Homo sapiens
ggguccaacucuguaucua

SEQ ID NO: 1229869 - RNA, 19 nt, Homo sapiens
gcacuaucaggacaacauc

SEQ ID NO: 1229870 - RNA, 19 nt, Homo sapiens
cugccaggaucucaaggaa

SEQ ID NO: 1229871 - RNA, 19 nt, Homo sapiens
cagcugggcgauuacaugu

SEQ ID NO: 1229872 - RNA, 19 nt, Homo sapiens
gcucagacccaggcaccuu

SEQ ID NO: 1229873 - RNA, 19 nt, Homo sapiens
gggcagccgccaauuaugc

SEQ ID NO: 1229874 - RNA, 19 nt, Homo sapiens
cugcaucccugcccgucuu

SEQ ID NO: 1229875 - RNA, 19 nt, Homo sapiens
caacuccagcagagcuuga

SEQ ID NO: 1229876 - RNA, 19 nt, Homo sapiens
uguggugaggcaauacuua

SEQ ID NO: 1229877 - RNA, 19 nt, Homo sapiens
caauuggugcucauuaaac

SEQ ID NO: 1229878 - RNA, 19 nt, Homo sapiens
ccagcugggcgauuacaug

SEQ ID NO: 1229879 - RNA, 19 nt, Homo sapiens
auucgcccuuuguguguua

SEQ ID NO: 1229880 - RNA, 19 nt, Homo sapiens
cugcaggcauucgcccuuu

SEQ ID NO: 1229881 - RNA, 19 nt, Homo sapiens
gcagaagagcacagcuagu

SEQ ID NO: 1229882 - RNA, 19 nt, Homo sapiens
gguccaacucuguaucuag

SEQ ID NO: 1229883 - RNA, 19 nt, Homo sapiens
gcagcuggaagguuuggau

SEQ ID NO: 1229884 - RNA, 19 nt, Homo sapiens
augaugaaguggccugugu

SEQ ID NO: 1229885 - RNA, 19 nt, Homo sapiens
cauggcagcagauggacaa

SEQ ID NO: 1229886 - RNA, 19 nt, Homo sapiens
cgaacaguuuugcugagua

SEQ ID NO: 1229887 - RNA, 19 nt, Homo sapiens
cauugcggauucagcacuu

SEQ ID NO: 1229888 - RNA, 19 nt, Homo sapiens
uaacacuguagcucuaauc

SEQ ID NO: 1229889 - RNA, 19 nt, Homo sapiens
guuaacacuguagcucuaa

SEQ ID NO: 1229890 - RNA, 19 nt, Homo sapiens
cacacuggcugggacugaa

SEQ ID NO: 1229891 - RNA, 19 nt, Homo sapiens
aagaugcgcuuguuuugga

SEQ ID NO: 1229892 - RNA, 19 nt, Homo sapiens
gaagauaucucaugacaaa

SEQ ID NO: 1229893 - RNA, 19 nt, Homo sapiens
gaagaauucuccaaacauu

SEQ ID NO: 1229894 - RNA, 19 nt, Homo sapiens
gagagaaaguccucccuua

SEQ ID NO: 1229895 - RNA, 19 nt, Homo sapiens
gaagaaugcuaagaugauu

SEQ ID NO: 1229896 - RNA, 19 nt, Homo sapiens
caaauuaaauggcugugaa

SEQ ID NO: 1229897 - RNA, 19 nt, Homo sapiens
gguaugagcuauaauaaac

SEQ ID NO: 1229898 - RNA, 19 nt, Homo sapiens
gaaccaaacguaaaggaaa

SEQ ID NO: 1229899 - RNA, 19 nt, Homo sapiens
gcuaagaugauuucagaua

SEQ ID NO: 1229900 - RNA, 19 nt, Homo sapiens
aggaagaaaucaagaagua

SEQ ID NO: 1229901 - RNA, 19 nt, Homo sapiens
caagugaaaucgaaucugu

SEQ ID NO: 1229902 - RNA, 19 nt, Homo sapiens
gaccuuugauccuccuuua

SEQ ID NO: 1229903 - RNA, 19 nt, Homo sapiens
gaaagccaucugcgaaaua

SEQ ID NO: 1229904 - RNA, 19 nt, Homo sapiens
aaagagaacuuggcaauag

SEQ ID NO: 1229905 - RNA, 19 nt, Homo sapiens
gggaagauaucucaugaca

SEQ ID NO: 1229906 - RNA, 19 nt, Homo sapiens
ggaaaugaagcaagugaaa

SEQ ID NO: 1229907 - RNA, 19 nt, Homo sapiens
ugagaaagaugaagaaacu

SEQ ID NO: 1229908 - RNA, 19 nt, Homo sapiens
cuucagaacuuucagagaa

SEQ ID NO: 1229909 - RNA, 19 nt, Homo sapiens
ccagguaugagcuauaaua

SEQ ID NO: 1229910 - RNA, 19 nt, Homo sapiens
aaagaaagccagauguuga

SEQ ID NO: 1229911 - RNA, 19 nt, Homo sapiens
gaagaaagugauacaagga

SEQ ID NO: 1229912 - RNA, 19 nt, Homo sapiens
ugacaaaucugaaaaggaa

SEQ ID NO: 1229913 - RNA, 19 nt, Homo sapiens
ccagugacaucaaggaguu

SEQ ID NO: 1229914 - RNA, 19 nt, Homo sapiens
agaaagcucaggcccauua

SEQ ID NO: 1229915 - RNA, 19 nt, Homo sapiens
uuaaauggcugugaacaau

SEQ ID NO: 1229916 - RNA, 19 nt, Homo sapiens
uaaaggaaacguaugauuc

SEQ ID NO: 1229917 - RNA, 19 nt, Homo sapiens
ggaagaaugcuaagaugau

SEQ ID NO: 1229918 - RNA, 19 nt, Homo sapiens
gcuguuaccuucugaaacu

SEQ ID NO: 1229919 - RNA, 19 nt, Homo sapiens
ugaagcaagugaaaucgaa

SEQ ID NO: 1229920 - RNA, 19 nt, Homo sapiens
guaaaggaaacguaugauu

SEQ ID NO: 1229921 - RNA, 19 nt, Homo sapiens
aaagccagauguugacaaa

SEQ ID NO: 1229922 - RNA, 19 nt, Homo sapiens
gcucaagaaccaaacguaa

SEQ ID NO: 1229923 - RNA, 19 nt, Homo sapiens
ugaaagcauugaagaaagu

SEQ ID NO: 1229924 - RNA, 19 nt, Homo sapiens
ugauugaaguccaggauga

SEQ ID NO: 1229925 - RNA, 19 nt, Homo sapiens
ucugaugucucaagcauug

SEQ ID NO: 1229926 - RNA, 19 nt, Homo sapiens
ggaagaaaucaagaaguaa

SEQ ID NO: 1229927 - RNA, 19 nt, Homo sapiens
uuccagcucuguuauuuaa

SEQ ID NO: 1229928 - RNA, 19 nt, Homo sapiens
gaaaugaagcaagugaaau

SEQ ID NO: 1229929 - RNA, 19 nt, Homo sapiens
cugaaacuguaccuuuaua

SEQ ID NO: 1229930 - RNA, 19 nt, Homo sapiens
gagcaucaacaaagaauag

SEQ ID NO: 1229931 - RNA, 19 nt, Homo sapiens
gcccagcccucuguugaaa

SEQ ID NO: 1229932 - RNA, 19 nt, Homo sapiens
gaaaauaaguacacaacgu

SEQ ID NO: 1229933 - RNA, 19 nt, Homo sapiens
aaaguuaaaucagcagaga

SEQ ID NO: 1229934 - RNA, 19 nt, Homo sapiens
gaaagugauacaaggagaa

SEQ ID NO: 1229935 - RNA, 19 nt, Homo sapiens
aaacuuaugagaccuuuga

SEQ ID NO: 1229936 - RNA, 19 nt, Homo sapiens
uaaaggccauaaucaucuu

SEQ ID NO: 1229937 - RNA, 19 nt, Homo sapiens
gaaauaucaaccaucaguu

SEQ ID NO: 1229938 - RNA, 19 nt, Homo sapiens
cgacuuuccugauaauucu

SEQ ID NO: 1229939 - RNA, 19 nt, Homo sapiens
ccuagagcaucaacaaaga

SEQ ID NO: 1229940 - RNA, 19 nt, Homo sapiens
gccauaggcucagauacuu

SEQ ID NO: 1229941 - RNA, 19 nt, Homo sapiens
aagggaagauaucucauga

SEQ ID NO: 1229942 - RNA, 19 nt, Homo sapiens
gaaccacagcgucuucaga

SEQ ID NO: 1229943 - RNA, 19 nt, Homo sapiens
ugaugacucugaaagcauu

SEQ ID NO: 1229944 - RNA, 19 nt, Homo sapiens
uaaagaaagccagauguug

SEQ ID NO: 1229945 - RNA, 19 nt, Homo sapiens
caauagaaagucaaucgaa

SEQ ID NO: 1229946 - RNA, 19 nt, Homo sapiens
cgaaagccaucugcgaaau

SEQ ID NO: 1229947 - RNA, 19 nt, Homo sapiens
aaaggcagcguaugauuga

SEQ ID NO: 1229948 - RNA, 19 nt, Homo sapiens
ugauaauucugaugucuca

SEQ ID NO: 1229949 - RNA, 19 nt, Homo sapiens
agacacuucuggaaaugaa

SEQ ID NO: 1229950 - RNA, 19 nt, Homo sapiens
guuauggccuacuuagaau

SEQ ID NO: 1229951 - RNA, 19 nt, Homo sapiens
aaagccaucugcgaaauau

SEQ ID NO: 1229952 - RNA, 19 nt, Homo sapiens
guguucgacuuuccugaua

SEQ ID NO: 1229953 - RNA, 19 nt, Homo sapiens
ggaugaacugcuucgguua

SEQ ID NO: 1229954 - RNA, 19 nt, Homo sapiens
gauacaaggagaaaaguua

SEQ ID NO: 1229955 - RNA, 19 nt, Homo sapiens
gcucuguuauuuaaagcaa

SEQ ID NO: 1229956 - RNA, 19 nt, Homo sapiens
aaaggaaacguaugauuca

SEQ ID NO: 1229957 - RNA, 19 nt, Homo sapiens
gcagcauauuucuuaucua

SEQ ID NO: 1229958 - RNA, 19 nt, Homo sapiens
cugagucugucacuucuaa

SEQ ID NO: 1229959 - RNA, 19 nt, Homo sapiens
cgaaauaucaaccaucagu

SEQ ID NO: 1229960 - RNA, 19 nt, Homo sapiens
augcuaagaugauuucaga

SEQ ID NO: 1229961 - RNA, 19 nt, Homo sapiens
gaugaagaaacuuaugaga

SEQ ID NO: 1229962 - RNA, 19 nt, Homo sapiens
aaauggcugugaacaaugu

SEQ ID NO: 1229963 - RNA, 19 nt, Homo sapiens
gaugauuucagauaucgaa

SEQ ID NO: 1229964 - RNA, 19 nt, Homo sapiens
gauguugacaaaucugaaa

SEQ ID NO: 1229965 - RNA, 19 nt, Homo sapiens
cuuaaucggucccagguau

SEQ ID NO: 1229966 - RNA, 19 nt, Homo sapiens
aaaugugccuauaggaaga

SEQ ID NO: 1229967 - RNA, 19 nt, Homo sapiens
gagaaaguccucccuuagg

SEQ ID NO: 1229968 - RNA, 19 nt, Homo sapiens
aaacccaccuagagcauca

SEQ ID NO: 1229969 - RNA, 19 nt, Homo sapiens
gcacauuugguguccagaa

SEQ ID NO: 1229970 - RNA, 19 nt, Homo sapiens
gaaagucaaucgaaaacuc

SEQ ID NO: 1229971 - RNA, 19 nt, Homo sapiens
gcaucaguuuguccaauag

SEQ ID NO: 1229972 - RNA, 19 nt, Homo sapiens
ccagcucuguuauuuaaag

SEQ ID NO: 1229973 - RNA, 19 nt, Homo sapiens
cagcugaaacaacuacaaa

SEQ ID NO: 1229974 - RNA, 19 nt, Homo sapiens
gaaaaccagugacaucaag

SEQ ID NO: 1229975 - RNA, 19 nt, Homo sapiens
aagagaacuuggcaauaga

SEQ ID NO: 1229976 - RNA, 19 nt, Homo sapiens
uucugaaacuguaccuuua

SEQ ID NO: 1229977 - RNA, 19 nt, Homo sapiens
gcugaaacaacuacaaaca

SEQ ID NO: 1229978 - RNA, 19 nt, Homo sapiens
gaaaaggcagcguaugauu

SEQ ID NO: 1229979 - RNA, 19 nt, Homo sapiens
aaggaagaaugcuaagaug

SEQ ID NO: 1229980 - RNA, 19 nt, Homo sapiens
aaaggaagaaugcuaagau

SEQ ID NO: 1229981 - RNA, 19 nt, Homo sapiens
ucccagguaugagcuauaa

SEQ ID NO: 1229982 - RNA, 19 nt, Homo sapiens
agcaucaguuuguccaaua

SEQ ID NO: 1229983 - RNA, 19 nt, Homo sapiens
uaaauagcaucaguuuguc

SEQ ID NO: 1229984 - RNA, 19 nt, Homo sapiens
ccuuccagcucuguuauuu

SEQ ID NO: 1229985 - RNA, 19 nt, Homo sapiens
caagauuauucagauguuc

SEQ ID NO: 1229986 - RNA, 19 nt, Homo sapiens
gaaagccagauguugacaa

SEQ ID NO: 1229987 - RNA, 19 nt, Homo sapiens
ccaccuagagcaucaacaa

SEQ ID NO: 1229988 - RNA, 19 nt, Homo sapiens
ggaguugaauauuguuuug

SEQ ID NO: 1229989 - RNA, 19 nt, Homo sapiens
cagguaugagcuauaauaa

SEQ ID NO: 1229990 - RNA, 19 nt, Homo sapiens
gauccuccuuuacauagca

SEQ ID NO: 1229991 - RNA, 19 nt, Homo sapiens
uuaaagaaagccagauguu

SEQ ID NO: 1229992 - RNA, 19 nt, Homo sapiens
gaaacaaguucuucuguaa

SEQ ID NO: 1229993 - RNA, 19 nt, Homo sapiens
gcacuuauguguuaugcua

SEQ ID NO: 1229994 - RNA, 19 nt, Homo sapiens
caauugcacuuauguguua

SEQ ID NO: 1229995 - RNA, 19 nt, Homo sapiens
ggaaauaucuuuaccaacu

SEQ ID NO: 1229996 - RNA, 19 nt, Homo sapiens
gcaaauagauaucgcaaac

SEQ ID NO: 1229997 - RNA, 19 nt, Homo sapiens
ccaaagaagucaucaucaa

SEQ ID NO: 1229998 - RNA, 19 nt, Homo sapiens
aaaggauccuggucaaaua

SEQ ID NO: 1229999 - RNA, 19 nt, Homo sapiens
guacagagaccacuuagga

SEQ ID NO: 1230000 - RNA, 19 nt, Homo sapiens
ugacaacaauggaaauaga

SEQ ID NO: 1230001 - RNA, 19 nt, Homo sapiens
ggccagaccgugaaacuua

SEQ ID NO: 1230002 - RNA, 19 nt, Homo sapiens
aaaaugacguccucuguua

SEQ ID NO: 1230003 - RNA, 19 nt, Homo sapiens
gcaacgaacugagacuaau

SEQ ID NO: 1230004 - RNA, 19 nt, Homo sapiens
gcacaugggccaccaguuc

SEQ ID NO: 1230005 - RNA, 19 nt, Homo sapiens
gaaauaucuuuaccaacug

SEQ ID NO: 1230006 - RNA, 19 nt, Homo sapiens
aaacagaccugccauucca

SEQ ID NO: 1230007 - RNA, 19 nt, Homo sapiens
agaaguggcucccgaggaa

SEQ ID NO: 1230008 - RNA, 19 nt, Homo sapiens
aggaagugcugcuuucuuu

SEQ ID NO: 1230009 - RNA, 19 nt, Homo sapiens
ccaaggaagugcugcuuuc

SEQ ID NO: 1230010 - RNA, 19 nt, Homo sapiens
caagaccagugcauucaga

SEQ ID NO: 1230011 - RNA, 19 nt, Homo sapiens
ucgaugaggucucguguug

SEQ ID NO: 1230012 - RNA, 19 nt, Homo sapiens
gaugaggucucguguugag

SEQ ID NO: 1230013 - RNA, 19 nt, Homo sapiens
auagagaaguggcugcuuu

SEQ ID NO: 1230014 - RNA, 19 nt, Homo sapiens
caauggaaauagagaagug

SEQ ID NO: 1230015 - RNA, 19 nt, Homo sapiens
gcaauugcacuuauguguu

SEQ ID NO: 1230016 - RNA, 19 nt, Homo sapiens
gcugagagcuugguuucau

SEQ ID NO: 1230017 - RNA, 19 nt, Homo sapiens
gccauuccauuuguuaauu

SEQ ID NO: 1230018 - RNA, 19 nt, Homo sapiens
gcauucagagcaccaaauu

SEQ ID NO: 1230019 - RNA, 19 nt, Homo sapiens
gccagaccgugaaacuuaa

SEQ ID NO: 1230020 - RNA, 19 nt, Homo sapiens
caaagaagucaucaucaau

SEQ ID NO: 1230021 - RNA, 19 nt, Homo sapiens
cauugcagccuuugugaua

SEQ ID NO: 1230022 - RNA, 19 nt, Homo sapiens
uuacagugguguugcuauu

SEQ ID NO: 1230023 - RNA, 19 nt, Homo sapiens
gaccugccauuccauuugu

SEQ ID NO: 1230024 - RNA, 19 nt, Homo sapiens
uaaaggauccuggucaaau

SEQ ID NO: 1230025 - RNA, 19 nt, Homo sapiens
caaccugagugcuuugaca

SEQ ID NO: 1230026 - RNA, 19 nt, Homo sapiens
ucacuucaccuucuguuug

SEQ ID NO: 1230027 - RNA, 19 nt, Homo sapiens
ccaaccagacaacaaauga

SEQ ID NO: 1230028 - RNA, 19 nt, Homo sapiens
gcuccaaccagacaacaaa

SEQ ID NO: 1230029 - RNA, 19 nt, Homo sapiens
cugacagucuuuauauuug

SEQ ID NO: 1230030 - RNA, 19 nt, Homo sapiens
uguuucaccugcaagauuu

SEQ ID NO: 1230031 - RNA, 19 nt, Homo sapiens
aaagaagucaucaucaaug

SEQ ID NO: 1230032 - RNA, 19 nt, Homo sapiens
caacaauggaaauagagaa

SEQ ID NO: 1230033 - RNA, 19 nt, Homo sapiens
ccggaaagaugagcacaug

SEQ ID NO: 1230034 - RNA, 19 nt, Homo sapiens
gaucagcuccaaccagaca

SEQ ID NO: 1230035 - RNA, 19 nt, Homo sapiens
ccgugaaacuuaaauacug

SEQ ID NO: 1230036 - RNA, 19 nt, Homo sapiens
cuggaaaggcaaauagaua

SEQ ID NO: 1230037 - RNA, 19 nt, Homo sapiens
ccacgucauucuucguuca

SEQ ID NO: 1230038 - RNA, 19 nt, Homo sapiens
uaacugcguagaacgguuu

SEQ ID NO: 1230039 - RNA, 19 nt, Homo sapiens
ggaaaggcaaauagauauc

SEQ ID NO: 1230040 - RNA, 19 nt, Homo sapiens
gaucuggaaaggcaaauag

SEQ ID NO: 1230041 - RNA, 19 nt, Homo sapiens
gaccaagaccagugcauuc

SEQ ID NO: 1230042 - RNA, 19 nt, Homo sapiens
acggaaauaucuuuaccaa

SEQ ID NO: 1230043 - RNA, 19 nt, Homo sapiens
guccguaccuggcggugaa

SEQ ID NO: 1230044 - RNA, 19 nt, Homo sapiens
caacgaacugagacuaaug

SEQ ID NO: 1230045 - RNA, 19 nt, Homo sapiens
acagugguguugcuauuuc

SEQ ID NO: 1230046 - RNA, 19 nt, Homo sapiens
cccuacagcuacggaaaua

SEQ ID NO: 1230047 - RNA, 19 nt, Homo sapiens
caugaaagacugcgaguac

SEQ ID NO: 1230048 - RNA, 19 nt, Homo sapiens
cagcuacggaaauaucuuu

SEQ ID NO: 1230049 - RNA, 19 nt, Homo sapiens
ggaaaagaaacuacagauu

SEQ ID NO: 1230050 - RNA, 19 nt, Homo sapiens
gcguagaacgguuugauca

SEQ ID NO: 1230051 - RNA, 19 nt, Homo sapiens
agagcuugguuucauuuga

SEQ ID NO: 1230052 - RNA, 19 nt, Homo sapiens
guucacagcaaacaggauu

SEQ ID NO: 1230053 - RNA, 19 nt, Homo sapiens
cgugaaacuuaaauacugu

SEQ ID NO: 1230054 - RNA, 19 nt, Homo sapiens
ugagugcuuugacaacaau

SEQ ID NO: 1230055 - RNA, 19 nt, Homo sapiens
ucagagcaccaaauucguu

SEQ ID NO: 1230056 - RNA, 19 nt, Homo sapiens
cagcagcacccuccaaugg

SEQ ID NO: 1230057 - RNA, 19 nt, Homo sapiens
ucucaggauuccacaccua

SEQ ID NO: 1230058 - RNA, 19 nt, Homo sapiens
gaagacagugcaacgaacu

SEQ ID NO: 1230059 - RNA, 19 nt, Homo sapiens
ugaaacagaccugccauuc

SEQ ID NO: 1230060 - RNA, 19 nt, Homo sapiens
guccaucguuggccucuca

SEQ ID NO: 1230061 - RNA, 19 nt, Homo sapiens
uggaaaggcaaauagauau

SEQ ID NO: 1230062 - RNA, 19 nt, Homo sapiens
ggcauccuguucuucuuug

SEQ ID NO: 1230063 - RNA, 19 nt, Homo sapiens
gaaacagaccugccauucc

SEQ ID NO: 1230064 - RNA, 19 nt, Homo sapiens
ugagagcuugguuucauuu

SEQ ID NO: 1230065 - RNA, 19 nt, Homo sapiens
aagaagucaucaucaaugg

SEQ ID NO: 1230066 - RNA, 19 nt, Homo sapiens
gcaaacggcaccaguucag

SEQ ID NO: 1230067 - RNA, 19 nt, Homo sapiens
gaaaggcaaauagauaucg

SEQ ID NO: 1230068 - RNA, 19 nt, Homo sapiens
ggauucugcuaugacaguu

SEQ ID NO: 1230069 - RNA, 19 nt, Homo sapiens
cagagcaccaaauucguuu

SEQ ID NO: 1230070 - RNA, 19 nt, Homo sapiens
cgaccaagaccagugcauu

SEQ ID NO: 1230071 - RNA, 19 nt, Homo sapiens
cuacagcuacggaaauauc

SEQ ID NO: 1230072 - RNA, 19 nt, Homo sapiens
gaaccaaagaagucaucau

SEQ ID NO: 1230073 - RNA, 19 nt, Homo sapiens
guguugcuauuuccaagga

SEQ ID NO: 1230074 - RNA, 19 nt, Homo sapiens
ugacagucuuuauauuugc

SEQ ID NO: 1230075 - RNA, 19 nt, Homo sapiens
ugagacuaauggacagugu

SEQ ID NO: 1230076 - RNA, 19 nt, Homo sapiens
cugagagcuugguuucauu

SEQ ID NO: 1230077 - RNA, 19 nt, Homo sapiens
ggaggaaaugggagguguu

SEQ ID NO: 1230078 - RNA, 19 nt, Homo sapiens
ggauuccacaccuacuuga

SEQ ID NO: 1230079 - RNA, 19 nt, Homo sapiens
gaggaaaugggagguguuc

SEQ ID NO: 1230080 - RNA, 19 nt, Homo sapiens
gagcggggauucugcuaug

SEQ ID NO: 1230081 - RNA, 19 nt, Homo sapiens
aaugacguccucuguuauu

SEQ ID NO: 1230082 - RNA, 19 nt, Homo sapiens
cguuaucacccacgucauu

SEQ ID NO: 1230083 - RNA, 19 nt, Homo sapiens
gacagucuuuauauuugca

SEQ ID NO: 1230084 - RNA, 19 nt, Homo sapiens
gaccgugaaacuuaaauac

SEQ ID NO: 1230085 - RNA, 19 nt, Homo sapiens
gcuuugacaacaauggaaa

SEQ ID NO: 1230086 - RNA, 19 nt, Homo sapiens
ccugagugcuuugacaaca

SEQ ID NO: 1230087 - RNA, 19 nt, Homo sapiens
auuaaaggauccuggucaa

SEQ ID NO: 1230088 - RNA, 19 nt, Homo sapiens
ugugauaacugcguagaac

SEQ ID NO: 1230089 - RNA, 19 nt, Homo sapiens
agaccgugaaacuuaaaua

SEQ ID NO: 1230090 - RNA, 19 nt, Homo sapiens
gggauucugcuaugacagu

SEQ ID NO: 1230091 - RNA, 19 nt, Homo sapiens
gacguccucuguuauuuug

SEQ ID NO: 1230092 - RNA, 19 nt, Homo sapiens
gaaacaaguucuucuguaa

SEQ ID NO: 1230093 - RNA, 19 nt, Homo sapiens
gcacuuauguguuaugcua

SEQ ID NO: 1230094 - RNA, 19 nt, Homo sapiens
caauugcacuuauguguua

SEQ ID NO: 1230095 - RNA, 19 nt, Homo sapiens
ggaaauaucuuuaccaacu

SEQ ID NO: 1230096 - RNA, 19 nt, Homo sapiens
gcaaauagauaucgcaaac

SEQ ID NO: 1230097 - RNA, 19 nt, Homo sapiens
ccaaagaagucaucaucaa

SEQ ID NO: 1230098 - RNA, 19 nt, Homo sapiens
aaaggauccuggucaaaua

SEQ ID NO: 1230099 - RNA, 19 nt, Homo sapiens
guacagagaccacuuagga

SEQ ID NO: 1230100 - RNA, 19 nt, Homo sapiens
ugacaacaauggaaauaga

SEQ ID NO: 1230101 - RNA, 19 nt, Homo sapiens
ggccagaccgugaaacuua

SEQ ID NO: 1230102 - RNA, 19 nt, Homo sapiens
aaaaugacguccucuguua

SEQ ID NO: 1230103 - RNA, 19 nt, Homo sapiens
gcaacgaacugagacuaau

SEQ ID NO: 1230104 - RNA, 19 nt, Homo sapiens
gcacaugggccaccaguuc

SEQ ID NO: 1230105 - RNA, 19 nt, Homo sapiens
gaaauaucuuuaccaacug

SEQ ID NO: 1230106 - RNA, 19 nt, Homo sapiens
aaacagaccugccauucca

SEQ ID NO: 1230107 - RNA, 19 nt, Homo sapiens
agaaguggcucccgaggaa

SEQ ID NO: 1230108 - RNA, 19 nt, Homo sapiens
aggaagugcugcuuucuuu

SEQ ID NO: 1230109 - RNA, 19 nt, Homo sapiens
ccaaggaagugcugcuuuc

SEQ ID NO: 1230110 - RNA, 19 nt, Homo sapiens
ucgaugaggucucguguug

SEQ ID NO: 1230111 - RNA, 19 nt, Homo sapiens
gaugaggucucguguugag

SEQ ID NO: 1230112 - RNA, 19 nt, Homo sapiens
auagagaaguggcugcuuu

SEQ ID NO: 1230113 - RNA, 19 nt, Homo sapiens
caauggaaauagagaagug

SEQ ID NO: 1230114 - RNA, 19 nt, Homo sapiens
gcaauugcacuuauguguu

SEQ ID NO: 1230115 - RNA, 19 nt, Homo sapiens
gcugagagcuugguuucau

SEQ ID NO: 1230116 - RNA, 19 nt, Homo sapiens
gccauuccauuuguuaauu

SEQ ID NO: 1230117 - RNA, 19 nt, Homo sapiens
gccagaccgugaaacuuaa

SEQ ID NO: 1230118 - RNA, 19 nt, Homo sapiens
caaagaagucaucaucaau

SEQ ID NO: 1230119 - RNA, 19 nt, Homo sapiens
cauugcagccuuugugaua

SEQ ID NO: 1230120 - RNA, 19 nt, Homo sapiens
uuacagugguguugcuauu

SEQ ID NO: 1230121 - RNA, 19 nt, Homo sapiens
gaccugccauuccauuugu

SEQ ID NO: 1230122 - RNA, 19 nt, Homo sapiens
uaaaggauccuggucaaau

SEQ ID NO: 1230123 - RNA, 19 nt, Homo sapiens
caaccugagugcuuugaca

SEQ ID NO: 1230124 - RNA, 19 nt, Homo sapiens
ucacuucaccuucuguuug

SEQ ID NO: 1230125 - RNA, 19 nt, Homo sapiens
ccaaccagacaacaaauga

SEQ ID NO: 1230126 - RNA, 19 nt, Homo sapiens
gcuccaaccagacaacaaa

SEQ ID NO: 1230127 - RNA, 19 nt, Homo sapiens
cugacagucuuuauauuug

SEQ ID NO: 1230128 - RNA, 19 nt, Homo sapiens
uguuucaccugcaagauuu

SEQ ID NO: 1230129 - RNA, 19 nt, Homo sapiens
aaagaagucaucaucaaug

SEQ ID NO: 1230130 - RNA, 19 nt, Homo sapiens
caacaauggaaauagagaa

SEQ ID NO: 1230131 - RNA, 19 nt, Homo sapiens
ccggaaagaugagcacaug

SEQ ID NO: 1230132 - RNA, 19 nt, Homo sapiens
gaucagcuccaaccagaca

SEQ ID NO: 1230133 - RNA, 19 nt, Homo sapiens
ccgugaaacuuaaauacug

SEQ ID NO: 1230134 - RNA, 19 nt, Homo sapiens
cuggaaaggcaaauagaua

SEQ ID NO: 1230135 - RNA, 19 nt, Homo sapiens
ccacgucauucuucguuca

SEQ ID NO: 1230136 - RNA, 19 nt, Homo sapiens
uaacugcguagaacgguuu

SEQ ID NO: 1230137 - RNA, 19 nt, Homo sapiens
ggaaaggcaaauagauauc

SEQ ID NO: 1230138 - RNA, 19 nt, Homo sapiens
gaucuggaaaggcaaauag

SEQ ID NO: 1230139 - RNA, 19 nt, Homo sapiens
acggaaauaucuuuaccaa

SEQ ID NO: 1230140 - RNA, 19 nt, Homo sapiens
guccguaccuggcggugaa

SEQ ID NO: 1230141 - RNA, 19 nt, Homo sapiens
caacgaacugagacuaaug

SEQ ID NO: 1230142 - RNA, 19 nt, Homo sapiens
acagugguguugcuauuuc

SEQ ID NO: 1230143 - RNA, 19 nt, Homo sapiens
cccuacagcuacggaaaua

SEQ ID NO: 1230144 - RNA, 19 nt, Homo sapiens
caugaaagacugcgaguac

SEQ ID NO: 1230145 - RNA, 19 nt, Homo sapiens
cagcuacggaaauaucuuu

SEQ ID NO: 1230146 - RNA, 19 nt, Homo sapiens
ggaaaagaaacuacagauu

SEQ ID NO: 1230147 - RNA, 19 nt, Homo sapiens
gcguagaacgguuugauca

SEQ ID NO: 1230148 - RNA, 19 nt, Homo sapiens
agagcuugguuucauuuga

SEQ ID NO: 1230149 - RNA, 19 nt, Homo sapiens
guucacagcaaacaggauu

SEQ ID NO: 1230150 - RNA, 19 nt, Homo sapiens
cgugaaacuuaaauacugu

SEQ ID NO: 1230151 - RNA, 19 nt, Homo sapiens
ugagugcuuugacaacaau

SEQ ID NO: 1230152 - RNA, 19 nt, Homo sapiens
cagcagcacccuccaaugg

SEQ ID NO: 1230153 - RNA, 19 nt, Homo sapiens
ucucaggauuccacaccua

SEQ ID NO: 1230154 - RNA, 19 nt, Homo sapiens
gaagacagugcaacgaacu

SEQ ID NO: 1230155 - RNA, 19 nt, Homo sapiens
ugaaacagaccugccauuc

SEQ ID NO: 1230156 - RNA, 19 nt, Homo sapiens
guccaucguuggccucuca

SEQ ID NO: 1230157 - RNA, 19 nt, Homo sapiens
uggaaaggcaaauagauau

SEQ ID NO: 1230158 - RNA, 19 nt, Homo sapiens
ggcauccuguucuucuuug

SEQ ID NO: 1230159 - RNA, 19 nt, Homo sapiens
gaaacagaccugccauucc

SEQ ID NO: 1230160 - RNA, 19 nt, Homo sapiens
ugagagcuugguuucauuu

SEQ ID NO: 1230161 - RNA, 19 nt, Homo sapiens
aagaagucaucaucaaugg

SEQ ID NO: 1230162 - RNA, 19 nt, Homo sapiens
gcaaacggcaccaguucag

SEQ ID NO: 1230163 - RNA, 19 nt, Homo sapiens
gaaaggcaaauagauaucg

SEQ ID NO: 1230164 - RNA, 19 nt, Homo sapiens
ggauucugcuaugacaguu

SEQ ID NO: 1230165 - RNA, 19 nt, Homo sapiens
cuacagcuacggaaauauc

SEQ ID NO: 1230166 - RNA, 19 nt, Homo sapiens
gaaccaaagaagucaucau

SEQ ID NO: 1230167 - RNA, 19 nt, Homo sapiens
guguugcuauuuccaagga

SEQ ID NO: 1230168 - RNA, 19 nt, Homo sapiens
ugacagucuuuauauuugc

SEQ ID NO: 1230169 - RNA, 19 nt, Homo sapiens
ugagacuaauggacagugu

SEQ ID NO: 1230170 - RNA, 19 nt, Homo sapiens
cugagagcuugguuucauu

SEQ ID NO: 1230171 - RNA, 19 nt, Homo sapiens
ggauuccacaccuacuuga

SEQ ID NO: 1230172 - RNA, 19 nt, Homo sapiens
gaggaaaugggagguguuc

SEQ ID NO: 1230173 - RNA, 19 nt, Homo sapiens
gagcggggauucugcuaug

SEQ ID NO: 1230174 - RNA, 19 nt, Homo sapiens
ggaggaaaugggagguguu

SEQ ID NO: 1230175 - RNA, 19 nt, Homo sapiens
aaugacguccucuguuauu

SEQ ID NO: 1230176 - RNA, 19 nt, Homo sapiens
cguuaucacccacgucauu

SEQ ID NO: 1230177 - RNA, 19 nt, Homo sapiens
gacagucuuuauauuugca

SEQ ID NO: 1230178 - RNA, 19 nt, Homo sapiens
gaccgugaaacuuaaauac

SEQ ID NO: 1230179 - RNA, 19 nt, Homo sapiens
gcuuugacaacaauggaaa

SEQ ID NO: 1230180 - RNA, 19 nt, Homo sapiens
ccugagugcuuugacaaca

SEQ ID NO: 1230181 - RNA, 19 nt, Homo sapiens
auuaaaggauccuggucaa

SEQ ID NO: 1230182 - RNA, 19 nt, Homo sapiens
ugugauaacugcguagaac

SEQ ID NO: 1230183 - RNA, 19 nt, Homo sapiens
agaccgugaaacuuaaaua

SEQ ID NO: 1230184 - RNA, 19 nt, Homo sapiens
gggauucugcuaugacagu

SEQ ID NO: 1230185 - RNA, 19 nt, Homo sapiens
gacguccucuguuauuuug

SEQ ID NO: 1230186 - RNA, 19 nt, Homo sapiens
uggaagacagugcaacgaa

SEQ ID NO: 1230187 - RNA, 19 nt, Homo sapiens
caagugcuguuuuguugga

SEQ ID NO: 1230188 - RNA, 19 nt, Homo sapiens
aaggauccuggucaaauaa

SEQ ID NO: 1230189 - RNA, 19 nt, Homo sapiens
gcuguggugugcuucuucu

SEQ ID NO: 1230190 - RNA, 19 nt, Homo sapiens
ucaauggccagaccgugaa

SEQ ID NO: 1230191 - RNA, 19 nt, Homo sapiens
cuucuucgccuucgacugu

SEQ ID NO: 1230192 - RNA, 19 nt, Homo sapiens
ggaaagauguuuacuacaa

SEQ ID NO: 1230193 - RNA, 19 nt, Homo sapiens
ggaaagaggauauccguua

SEQ ID NO: 1230194 - RNA, 19 nt, Homo sapiens
aaacagaccucaccugaaa

SEQ ID NO: 1230195 - RNA, 19 nt, Homo sapiens
guagguacauuccauauug

SEQ ID NO: 1230196 - RNA, 19 nt, Homo sapiens
ucaaggagcuggagucaga

SEQ ID NO: 1230197 - RNA, 19 nt, Homo sapiens
ugaaauaccugucacaaag

SEQ ID NO: 1230198 - RNA, 19 nt, Homo sapiens
caagauauauagcgaacuu

SEQ ID NO: 1230199 - RNA, 19 nt, Homo sapiens
ggauauccguuaccauuau

SEQ ID NO: 1230200 - RNA, 19 nt, Homo sapiens
gaucaggaauuggaugaaa

SEQ ID NO: 1230201 - RNA, 19 nt, Homo sapiens
gugggaauguuguucaaua

SEQ ID NO: 1230202 - RNA, 19 nt, Homo sapiens
gaggauauccguuaccauu

SEQ ID NO: 1230203 - RNA, 19 nt, Homo sapiens
gcagaauauuguacagauu

SEQ ID NO: 1230204 - RNA, 19 nt, Homo sapiens
acaguuguguugccauuua

SEQ ID NO: 1230205 - RNA, 19 nt, Homo sapiens
gcucuuagcuccuucuucu

SEQ ID NO: 1230206 - RNA, 19 nt, Homo sapiens
gaaagaggauauccguuac

SEQ ID NO: 1230207 - RNA, 19 nt, Homo sapiens
ccaaauccaucuacaucaa

SEQ ID NO: 1230208 - RNA, 19 nt, Homo sapiens
gcaagcgacuucgggagua

SEQ ID NO: 1230209 - RNA, 19 nt, Homo sapiens
caacagaucaggaauugga

SEQ ID NO: 1230210 - RNA, 19 nt, Homo sapiens
ggaauuggaugaaauaccu

SEQ ID NO: 1230211 - RNA, 19 nt, Homo sapiens
gauaauggcaaguuaaauc

SEQ ID NO: 1230212 - RNA, 19 nt, Homo sapiens
gcccuaauauaaacaaaug

SEQ ID NO: 1230213 - RNA, 19 nt, Homo sapiens
cuaauaaacuggccauuuu

SEQ ID NO: 1230214 - RNA, 19 nt, Homo sapiens
agagagacaucaugcagaa

SEQ ID NO: 1230215 - RNA, 19 nt, Homo sapiens
cauggaaauugacuggaua

SEQ ID NO: 1230216 - RNA, 19 nt, Homo sapiens
gaaauaccugucacaaaga

SEQ ID NO: 1230217 - RNA, 19 nt, Homo sapiens
gaacccacccgaauuaucu

SEQ ID NO: 1230218 - RNA, 19 nt, Homo sapiens
agagaucacuauuagcaaa

SEQ ID NO: 1230219 - RNA, 19 nt, Homo sapiens
gagacaucaugcagaauau

SEQ ID NO: 1230220 - RNA, 19 nt, Homo sapiens
gcagcacuauggaggacua

SEQ ID NO: 1230221 - RNA, 19 nt, Homo sapiens
gcaaagauuggguugguau

SEQ ID NO: 1230222 - RNA, 19 nt, Homo sapiens
gcuuggagcugcacaugga

SEQ ID NO: 1230223 - RNA, 19 nt, Homo sapiens
cauggugggucagcuauuu

SEQ ID NO: 1230224 - RNA, 19 nt, Homo sapiens
ccacccgaauuaucuauug

SEQ ID NO: 1230225 - RNA, 19 nt, Homo sapiens
ccugaaggacggaucauua

SEQ ID NO: 1230226 - RNA, 19 nt, Homo sapiens
ggcuccaucuuucuaauaa

SEQ ID NO: 1230227 - RNA, 19 nt, Homo sapiens
acccuuagcuacuauugua

SEQ ID NO: 1230228 - RNA, 19 nt, Homo sapiens
cgacuucuaaggaaucaua

SEQ ID NO: 1230229 - RNA, 19 nt, Homo sapiens
cauuacagguggaaauaga

SEQ ID NO: 1230230 - RNA, 19 nt, Homo sapiens
aaaaugaacuggaaagaug

SEQ ID NO: 1230231 - RNA, 19 nt, Homo sapiens
gagcaagcaagauauauag

SEQ ID NO: 1230232 - RNA, 19 nt, Homo sapiens
aagauuggguugguauuaa

SEQ ID NO: 1230233 - RNA, 19 nt, Homo sapiens
agagacaucaugcagaaua

SEQ ID NO: 1230234 - RNA, 19 nt, Homo sapiens
ugagcaagcaagauauaua

SEQ ID NO: 1230235 - RNA, 19 nt, Homo sapiens
auagaacccacccgaauua

SEQ ID NO: 1230236 - RNA, 19 nt, Homo sapiens
gucagacucuucauggaaa

SEQ ID NO: 1230237 - RNA, 19 nt, Homo sapiens
ucaggaauuggaugaaaua

SEQ ID NO: 1230238 - RNA, 19 nt, Homo sapiens
aaagauuggguugguauua

SEQ ID NO: 1230239 - RNA, 19 nt, Homo sapiens
gaacuggaaagauguuuac

SEQ ID NO: 1230240 - RNA, 19 nt, Homo sapiens
gauauccguuaccauuaug

SEQ ID NO: 1230241 - RNA, 19 nt, Homo sapiens
gcacuauggaggacuauuc

SEQ ID NO: 1230242 - RNA, 19 nt, Homo sapiens
gcacagaagagagacauca

SEQ ID NO: 1230243 - RNA, 19 nt, Homo sapiens
uuucaaggcuccaucuuuc

SEQ ID NO: 1230244 - RNA, 19 nt, Homo sapiens
ccaucuacaucaaauuugu

SEQ ID NO: 1230245 - RNA, 19 nt, Homo sapiens
gagcugcacauggaaauug

SEQ ID NO: 1230246 - RNA, 19 nt, Homo sapiens
ucugugauguaccaacuuu

SEQ ID NO: 1230247 - RNA, 19 nt, Homo sapiens
gaccuuuguuucugugaug

SEQ ID NO: 1230248 - RNA, 19 nt, Homo sapiens
caaauccaucuacaucaaa

SEQ ID NO: 1230249 - RNA, 19 nt, Homo sapiens
cagcaaagauuggguuggu

SEQ ID NO: 1230250 - RNA, 19 nt, Homo sapiens
cuggaaagauguuuacuac

SEQ ID NO: 1230251 - RNA, 19 nt, Homo sapiens
caguacgacuucuaaggaa

SEQ ID NO: 1230252 - RNA, 19 nt, Homo sapiens
uggaaucgguacaguugaa

SEQ ID NO: 1230253 - RNA, 19 nt, Homo sapiens
gacaucaugcagaauauug

SEQ ID NO: 1230254 - RNA, 19 nt, Homo sapiens
ugaagaagcacagaagaga

SEQ ID NO: 1230255 - RNA, 19 nt, Homo sapiens
uuacaguuguguugccauu

SEQ ID NO: 1230256 - RNA, 19 nt, Homo sapiens
uccaacagaucaggaauug

SEQ ID NO: 1230257 - RNA, 19 nt, Homo sapiens
ccaguacgacuucuaagga

SEQ ID NO: 1230258 - RNA, 19 nt, Homo sapiens
gggaauguuguucaauauu

SEQ ID NO: 1230259 - RNA, 19 nt, Homo sapiens
uuucagagcuggacagacu

SEQ ID NO: 1230260 - RNA, 19 nt, Homo sapiens
ucuaauaaacuggccauuu

SEQ ID NO: 1230261 - RNA, 19 nt, Homo sapiens
gaugaaauaccugucacaa

SEQ ID NO: 1230262 - RNA, 19 nt, Homo sapiens
caauagauaauggcaaguu

SEQ ID NO: 1230263 - RNA, 19 nt, Homo sapiens
ugggaauguuguucaauau

SEQ ID NO: 1230264 - RNA, 19 nt, Homo sapiens
gcuccaucuuucuaauaaa

SEQ ID NO: 1230265 - RNA, 19 nt, Homo sapiens
ucaaggcuccaucuuucua

SEQ ID NO: 1230266 - RNA, 19 nt, Homo sapiens
aaauagaacccacccgaau

SEQ ID NO: 1230267 - RNA, 19 nt, Homo sapiens
ugaacuggaaagauguuua

SEQ ID NO: 1230268 - RNA, 19 nt, Homo sapiens
caucaugcagaauauugua

SEQ ID NO: 1230269 - RNA, 19 nt, Homo sapiens
caguuguguugccauuuaa

SEQ ID NO: 1230270 - RNA, 19 nt, Homo sapiens
gagcccuaauauaaacaaa

SEQ ID NO: 1230271 - RNA, 19 nt, Homo sapiens
gggccaguacgacuucuaa

SEQ ID NO: 1230272 - RNA, 19 nt, Homo sapiens
ucagaacuguauuguggau

SEQ ID NO: 1230273 - RNA, 19 nt, Homo sapiens
ucagauggcagcacuaugg

SEQ ID NO: 1230274 - RNA, 19 nt, Homo sapiens
ugucacaaagagaacauua

SEQ ID NO: 1230275 - RNA, 19 nt, Homo sapiens
cuucuaaggaaucauagua

SEQ ID NO: 1230276 - RNA, 19 nt, Homo sapiens
uuaguugagugccuggaaa

SEQ ID NO: 1230277 - RNA, 19 nt, Homo sapiens
aauagaacccacccgaauu

SEQ ID NO: 1230278 - RNA, 19 nt, Homo sapiens
caaggcuccaucuuucuaa

SEQ ID NO: 1230279 - RNA, 19 nt, Homo sapiens
ccacacauggagcaaaguu

SEQ ID NO: 1230280 - RNA, 19 nt, Homo sapiens
acaacugaaugucauccuu

SEQ ID NO: 1230281 - RNA, 19 nt, Homo sapiens
uuagagaucacuauuagca

SEQ ID NO: 1230282 - RNA, 19 nt, Homo sapiens
uauaacacccguuggaaag

SEQ ID NO: 1230283 - RNA, 19 nt, Homo sapiens
gugggucagcuauuucuuu

SEQ ID NO: 1230284 - RNA, 19 nt, Homo sapiens
cuucuucucuacucacuuc

SEQ ID NO: 1230285 - RNA, 19 nt, Homo sapiens
guagagagggauuuucuuu

SEQ ID NO: 1230286 - RNA, 19 nt, Homo sapiens
caccacacauggagcaaag

SEQ ID NO: 1230287 - RNA, 19 nt, Homo sapiens
acauggaaauugacuggau

SEQ ID NO: 1230288 - RNA, 19 nt, Homo sapiens
uaacacccguuggaaagag

SEQ ID NO: 1230289 - RNA, 19 nt, Homo sapiens
gcacgguguucggcagcaa

SEQ ID NO: 1230290 - RNA, 19 nt, Homo sapiens
uauuguggaucccggaguu

SEQ ID NO: 1230291 - RNA, 19 nt, Homo sapiens
caaagauuggguugguauu

SEQ ID NO: 1230292 - RNA, 19 nt, Homo sapiens
gaacauaccugugaaugaa

SEQ ID NO: 1230293 - RNA, 19 nt, Homo sapiens
ggugauaucuacuacauuu

SEQ ID NO: 1230294 - RNA, 19 nt, Homo sapiens
ggaaugaaguguaaugcuu

SEQ ID NO: 1230295 - RNA, 19 nt, Homo sapiens
gcacaggugauaucuacua

SEQ ID NO: 1230296 - RNA, 19 nt, Homo sapiens
gcaagaggguccagaagag

SEQ ID NO: 1230297 - RNA, 19 nt, Homo sapiens
ggaagaggaagacaaguga

SEQ ID NO: 1230298 - RNA, 19 nt, Homo sapiens
ggaacauaccugugaauga

SEQ ID NO: 1230299 - RNA, 19 nt, Homo sapiens
ugaagcacaucuuaaagga

SEQ ID NO: 1230300 - RNA, 19 nt, Homo sapiens
gagcguaaggcaccuauau

SEQ ID NO: 1230301 - RNA, 19 nt, Homo sapiens
guaaggcaccuauauaucu

SEQ ID NO: 1230302 - RNA, 19 nt, Homo sapiens
aagcacaucuuaaaggaau

SEQ ID NO: 1230303 - RNA, 19 nt, Homo sapiens
uaaacgacacuacaaguug

SEQ ID NO: 1230304 - RNA, 19 nt, Homo sapiens
gcaccuauauaucugugau

SEQ ID NO: 1230305 - RNA, 19 nt, Homo sapiens
gcguaaggcaccuauauau

SEQ ID NO: 1230306 - RNA, 19 nt, Homo sapiens
gcacgacacugacauuccu

SEQ ID NO: 1230307 - RNA, 19 nt, Homo sapiens
gagcaucucgcagaagaaa

SEQ ID NO: 1230308 - RNA, 19 nt, Homo sapiens
gaccagaccaggcuucaau

SEQ ID NO: 1230309 - RNA, 19 nt, Homo sapiens
aagagcaucucgcagaaga

SEQ ID NO: 1230310 - RNA, 19 nt, Homo sapiens
ugaacacccuacgacguua

SEQ ID NO: 1230311 - RNA, 19 nt, Homo sapiens
agaagagcaucucgcagaa

SEQ ID NO: 1230312 - RNA, 19 nt, Homo sapiens
caggugauaucuacuacau

SEQ ID NO: 1230313 - RNA, 19 nt, Homo sapiens
aagagacccuugccuacuu

SEQ ID NO: 1230314 - RNA, 19 nt, Homo sapiens
agaccaggcuucaauaagg

SEQ ID NO: 1230315 - RNA, 19 nt, Homo sapiens
gaaauaaaaggaagaggaa

SEQ ID NO: 1230316 - RNA, 19 nt, Homo sapiens
uaaggcaccuauauaucug

SEQ ID NO: 1230317 - RNA, 19 nt, Homo sapiens
gaagcacaucuuaaaggaa

SEQ ID NO: 1230318 - RNA, 19 nt, Homo sapiens
gugaagaguaacaagagua

SEQ ID NO: 1230319 - RNA, 19 nt, Homo sapiens
ccagaccaggcuucaauaa

SEQ ID NO: 1230320 - RNA, 19 nt, Homo sapiens
gugaacacccuacgacguu

SEQ ID NO: 1230321 - RNA, 19 nt, Homo sapiens
gcacaucuuaaaggaauga

SEQ ID NO: 1230322 - RNA, 19 nt, Homo sapiens
ucuacauggugaagaguaa

SEQ ID NO: 1230323 - RNA, 19 nt, Homo sapiens
ggugaagaguaacaagagu

SEQ ID NO: 1230324 - RNA, 19 nt, Homo sapiens
gaacacccuacgacguuau

SEQ ID NO: 1230325 - RNA, 19 nt, Homo sapiens
gagugaggaugaagcacau

SEQ ID NO: 1230326 - RNA, 19 nt, Homo sapiens
guuauaaacgacacuacaa

SEQ ID NO: 1230327 - RNA, 19 nt, Homo sapiens
ugacauuccugagguugau

SEQ ID NO: 1230328 - RNA, 19 nt, Homo sapiens
ccagaguguccgaaauaaa

SEQ ID NO: 1230329 - RNA, 19 nt, Homo sapiens
aaugaaguguaaugcuuga

SEQ ID NO: 1230330 - RNA, 19 nt, Homo sapiens
caauaaggcccaguuagca

SEQ ID NO: 1230331 - RNA, 19 nt, Homo sapiens
cagcuugagugaggaugaa

SEQ ID NO: 1230332 - RNA, 19 nt, Homo sapiens
cauccagaguguccgaaau

SEQ ID NO: 1230333 - RNA, 19 nt, Homo sapiens
aaaggaaugaaguguaaug

SEQ ID NO: 1230334 - RNA, 19 nt, Homo sapiens
uccagaguguccgaaauaa

SEQ ID NO: 1230335 - RNA, 19 nt, Homo sapiens
cuuaaaggaaugaagugua

SEQ ID NO: 1230336 - RNA, 19 nt, Homo sapiens
caucuuaaaggaaugaagu

SEQ ID NO: 1230337 - RNA, 19 nt, Homo sapiens
gcagcuugagugaggauga

SEQ ID NO: 1230338 - RNA, 19 nt, Homo sapiens
agucgacacuucaggaaca

SEQ ID NO: 1230339 - RNA, 19 nt, Homo sapiens
auaaacgacacuacaaguu

SEQ ID NO: 1230340 - RNA, 19 nt, Homo sapiens
aaaggaagaggaagacaag

SEQ ID NO: 1230341 - RNA, 19 nt, Homo sapiens
ugaaguguaaugcuugaug

SEQ ID NO: 1230342 - RNA, 19 nt, Homo sapiens
cagaguguccgaaauaaaa

SEQ ID NO: 1230343 - RNA, 19 nt, Homo sapiens
uauaaacgacacuacaagu

SEQ ID NO: 1230344 - RNA, 19 nt, Homo sapiens
ucaauaaggcccaguuagc

SEQ ID NO: 1230345 - RNA, 19 nt, Homo sapiens
uuccugagguugaucuguu

SEQ ID NO: 1230346 - RNA, 19 nt, Homo sapiens
gagcacgacacugacauuc

SEQ ID NO: 1230347 - RNA, 19 nt, Homo sapiens
augcacaggugauaucuac

SEQ ID NO: 1230348 - RNA, 19 nt, Homo sapiens
gaagaguaacaagaguaga

SEQ ID NO: 1230349 - RNA, 19 nt, Homo sapiens
ugaagaguaacaagaguag

SEQ ID NO: 1230350 - RNA, 19 nt, Homo sapiens
ucaucuacauggugaagag

SEQ ID NO: 1230351 - RNA, 19 nt, Homo sapiens
gaagagcaucucgcagaag

SEQ ID NO: 1230352 - RNA, 19 nt, Homo sapiens
gaggaagacaagugacgau

SEQ ID NO: 1230353 - RNA, 19 nt, Homo sapiens
cuucaauaaggcccaguua

SEQ ID NO: 1230354 - RNA, 19 nt, Homo sapiens
gaugcacaggugauaucua

SEQ ID NO: 1230355 - RNA, 19 nt, Homo sapiens
gacaucgacaagagcguaa

SEQ ID NO: 1230356 - RNA, 19 nt, Homo sapiens
gcaucucgcagaagaaacu

SEQ ID NO: 1230357 - RNA, 19 nt, Homo sapiens
gaaacugugagucgacacu

SEQ ID NO: 1230358 - RNA, 19 nt, Homo sapiens
cguaaggcaccuauauauc

SEQ ID NO: 1230359 - RNA, 19 nt, Homo sapiens
uuaagcccauaaagacugu

SEQ ID NO: 1230360 - RNA, 19 nt, Homo sapiens
gcaacgccuccuucagcaa

SEQ ID NO: 1230361 - RNA, 19 nt, Homo sapiens
gaaacucaagcuggacauc

SEQ ID NO: 1230362 - RNA, 19 nt, Homo sapiens
ccagagcugcugccucauc

SEQ ID NO: 1230363 - RNA, 19 nt, Homo sapiens
auccagaguguccgaaaua

SEQ ID NO: 1230364 - RNA, 19 nt, Homo sapiens
agagacccuugccuacuuc

SEQ ID NO: 1230365 - RNA, 19 nt, Homo sapiens
ucagcaagaggguccagaa

SEQ ID NO: 1230366 - RNA, 19 nt, Homo sapiens
cgagcacgacacugacauu

SEQ ID NO: 1230367 - RNA, 19 nt, Homo sapiens
gacccuugccuacuucauc

SEQ ID NO: 1230368 - RNA, 19 nt, Homo sapiens
uaaacgagguucucauaaa

SEQ ID NO: 1230369 - RNA, 19 nt, Homo sapiens
cagauaaccugcuuugaaa

SEQ ID NO: 1230370 - RNA, 19 nt, Homo sapiens
caaguucacucuacccuaa

SEQ ID NO: 1230371 - RNA, 19 nt, Homo sapiens
ggaaguagcaguguucuaa

SEQ ID NO: 1230372 - RNA, 19 nt, Homo sapiens
aaagagggcuuaauucugu

SEQ ID NO: 1230373 - RNA, 19 nt, Homo sapiens
ggaggaauuuguuucuaaa

SEQ ID NO: 1230374 - RNA, 19 nt, Homo sapiens
auacugaccuguucaugua

SEQ ID NO: 1230375 - RNA, 19 nt, Homo sapiens
caaacccacuucauccuuu

SEQ ID NO: 1230376 - RNA, 19 nt, Homo sapiens
ccagagcccucauuccaaa

SEQ ID NO: 1230377 - RNA, 19 nt, Homo sapiens
ucuggcagcuggugaguua

SEQ ID NO: 1230378 - RNA, 19 nt, Homo sapiens
cugaaacgcuugcuucuga

SEQ ID NO: 1230379 - RNA, 19 nt, Homo sapiens
cauaucuacucuugucaua

SEQ ID NO: 1230380 - RNA, 19 nt, Homo sapiens
gcucugggcuucagcacaa

SEQ ID NO: 1230381 - RNA, 19 nt, Homo sapiens
gagcauagcaugugugagu

SEQ ID NO: 1230382 - RNA, 19 nt, Homo sapiens
aaauguaucugcuuugugu

SEQ ID NO: 1230383 - RNA, 19 nt, Homo sapiens
gaccauaucuacucuuguc

SEQ ID NO: 1230384 - RNA, 19 nt, Homo sapiens
cauaaacgagguucucaua

SEQ ID NO: 1230385 - RNA, 19 nt, Homo sapiens
gaaagagggcuuaauucug

SEQ ID NO: 1230386 - RNA, 19 nt, Homo sapiens
ucccuuagcuucuguguau

SEQ ID NO: 1230387 - RNA, 19 nt, Homo sapiens
cauaucaaguccaaagcua

SEQ ID NO: 1230388 - RNA, 19 nt, Homo sapiens
cgagagacagcaaucauaa

SEQ ID NO: 1230389 - RNA, 19 nt, Homo sapiens
uagcuggaaugguguguuu

SEQ ID NO: 1230390 - RNA, 19 nt, Homo sapiens
gcaaaugguucagcaggau

SEQ ID NO: 1230391 - RNA, 19 nt, Homo sapiens
gaugaucacaccagauuga

SEQ ID NO: 1230392 - RNA, 19 nt, Homo sapiens
ggcagucgcuugugcaugu

SEQ ID NO: 1230393 - RNA, 19 nt, Homo sapiens
guaagaacaaggaggaauu

SEQ ID NO: 1230394 - RNA, 19 nt, Homo sapiens
gcagaggcccagagucaaa

SEQ ID NO: 1230395 - RNA, 19 nt, Homo sapiens
uguguuaucucgguucaua

SEQ ID NO: 1230396 - RNA, 19 nt, Homo sapiens
ugaagcugcucccagauga

SEQ ID NO: 1230397 - RNA, 19 nt, Homo sapiens
gcaauauggucaugacacu

SEQ ID NO: 1230398 - RNA, 19 nt, Homo sapiens
uagacacgaugcccucuuu

SEQ ID NO: 1230399 - RNA, 19 nt, Homo sapiens
gaaguagcaguguucuaaa

SEQ ID NO: 1230400 - RNA, 19 nt, Homo sapiens
gggaccauaucuacucuug

SEQ ID NO: 1230401 - RNA, 19 nt, Homo sapiens
gaguuuggccugcucauga

SEQ ID NO: 1230402 - RNA, 19 nt, Homo sapiens
aggaggaauuuguuucuaa

SEQ ID NO: 1230403 - RNA, 19 nt, Homo sapiens
gcagagggaccauaucuac

SEQ ID NO: 1230404 - RNA, 19 nt, Homo sapiens
ggagaccugguuacacuaa

SEQ ID NO: 1230405 - RNA, 19 nt, Homo sapiens
gcagacaauugaggcuuug

SEQ ID NO: 1230406 - RNA, 19 nt, Homo sapiens
gaggaucucugagccuuuc

SEQ ID NO: 1230407 - RNA, 19 nt, Homo sapiens
aaacgagguucucauaaac

SEQ ID NO: 1230408 - RNA, 19 nt, Homo sapiens
gcagguacccacugucugu

SEQ ID NO: 1230409 - RNA, 19 nt, Homo sapiens
agacaaacacauuccauug

SEQ ID NO: 1230410 - RNA, 19 nt, Homo sapiens
gaguccagccucugcauaa

SEQ ID NO: 1230411 - RNA, 19 nt, Homo sapiens
uacccaaaguccagaguuu

SEQ ID NO: 1230412 - RNA, 19 nt, Homo sapiens
gcacccagggcuaagcuuu

SEQ ID NO: 1230413 - RNA, 19 nt, Homo sapiens
uaagaacaaggaggaauuu

SEQ ID NO: 1230414 - RNA, 19 nt, Homo sapiens
cagcagaggcccagaguca

SEQ ID NO: 1230415 - RNA, 19 nt, Homo sapiens
aaacgacugucucggaaca

SEQ ID NO: 1230416 - RNA, 19 nt, Homo sapiens
gggaaggcaagcaguauug

SEQ ID NO: 1230417 - RNA, 19 nt, Homo sapiens
gauacugaccuguucaugu

SEQ ID NO: 1230418 - RNA, 19 nt, Homo sapiens
gcaaacccacuucauccuu

SEQ ID NO: 1230419 - RNA, 19 nt, Homo sapiens
gagaaagggagggaagaaa

SEQ ID NO: 1230420 - RNA, 19 nt, Homo sapiens
guguauaugugcauguaga

SEQ ID NO: 1230421 - RNA, 19 nt, Homo sapiens
gaccagagcccucauucca

SEQ ID NO: 1230422 - RNA, 19 nt, Homo sapiens
ugaaagagggcuuaauucu

SEQ ID NO: 1230423 - RNA, 19 nt, Homo sapiens
gcccaggcaaugcauauuu

SEQ ID NO: 1230424 - RNA, 19 nt, Homo sapiens
gacaauugaggcuuugaaa

SEQ ID NO: 1230425 - RNA, 19 nt, Homo sapiens
gcuccugggugcaaaucuu

SEQ ID NO: 1230426 - RNA, 19 nt, Homo sapiens
gggagcagguacccacugu

SEQ ID NO: 1230427 - RNA, 19 nt, Homo sapiens
uaaaguugcauugacguuu

SEQ ID NO: 1230428 - RNA, 19 nt, Homo sapiens
auaaacaaguucacucuac

SEQ ID NO: 1230429 - RNA, 19 nt, Homo sapiens
gugcaaaucuuggaaaaug

SEQ ID NO: 1230430 - RNA, 19 nt, Homo sapiens
caaugcauauuugcuuuca

SEQ ID NO: 1230431 - RNA, 19 nt, Homo sapiens
gggaugcacgcguauguga

SEQ ID NO: 1230432 - RNA, 19 nt, Homo sapiens
gcaggcagaggacagaguu

SEQ ID NO: 1230433 - RNA, 19 nt, Homo sapiens
gcuuuguguuuggaaauaa

SEQ ID NO: 1230434 - RNA, 19 nt, Homo sapiens
cuaagucuaugugagcaaa

SEQ ID NO: 1230435 - RNA, 19 nt, Homo sapiens
uuaauucuguggguccuaa

SEQ ID NO: 1230436 - RNA, 19 nt, Homo sapiens
gaauuuccuugggcugguu

SEQ ID NO: 1230437 - RNA, 19 nt, Homo sapiens
gcauauuugcuuucauuuc

SEQ ID NO: 1230438 - RNA, 19 nt, Homo sapiens
cuacacacaucuccaugca

SEQ ID NO: 1230439 - RNA, 19 nt, Homo sapiens
gguacccacugucugucua

SEQ ID NO: 1230440 - RNA, 19 nt, Homo sapiens
aauauggucaugacacuuu

SEQ ID NO: 1230441 - RNA, 19 nt, Homo sapiens
gcaccucuguggagaugag

SEQ ID NO: 1230442 - RNA, 19 nt, Homo sapiens
ccgagagacagcaaucaua

SEQ ID NO: 1230443 - RNA, 19 nt, Homo sapiens
guaccuggagaccugguua

SEQ ID NO: 1230444 - RNA, 19 nt, Homo sapiens
gaagcugugugugcaugug

SEQ ID NO: 1230445 - RNA, 19 nt, Homo sapiens
aaagaugguuugacguuuu

SEQ ID NO: 1230446 - RNA, 19 nt, Homo sapiens
gaaggcaagcaguauugga

SEQ ID NO: 1230447 - RNA, 19 nt, Homo sapiens
guguguauaugugcaugua

SEQ ID NO: 1230448 - RNA, 19 nt, Homo sapiens
gcuugugcauguuccagaa

SEQ ID NO: 1230449 - RNA, 19 nt, Homo sapiens
uacacuaaccugauacuga

SEQ ID NO: 1230450 - RNA, 19 nt, Homo sapiens
aaacccacuucauccuuug

SEQ ID NO: 1230451 - RNA, 19 nt, Homo sapiens
ucccuggcauucuccauaa

SEQ ID NO: 1230452 - RNA, 19 nt, Homo sapiens
cagcaccucuguggagaug

SEQ ID NO: 1230453 - RNA, 19 nt, Homo sapiens
cccaggcaaugcauauuug

SEQ ID NO: 1230454 - RNA, 19 nt, Homo sapiens
ggauucagcccaggcaaug

SEQ ID NO: 1230455 - RNA, 19 nt, Homo sapiens
gcaguuccaauuccucuca

SEQ ID NO: 1230456 - RNA, 19 nt, Homo sapiens
ggagaugagggacaaaguc

SEQ ID NO: 1230457 - RNA, 19 nt, Homo sapiens
cauaaacaaguucacucua

SEQ ID NO: 1230458 - RNA, 19 nt, Homo sapiens
aauaccagcuuuggaggaa

SEQ ID NO: 1230459 - RNA, 19 nt, Homo sapiens
uuugaaagagggcuuaauu

SEQ ID NO: 1230460 - RNA, 19 nt, Homo sapiens
ggccucaguugcuuuccuu

SEQ ID NO: 1230461 - RNA, 19 nt, Homo sapiens
uuugaacacuuucuuugug

SEQ ID NO: 1230462 - RNA, 19 nt, Homo sapiens
gagguucucauaaacaagu

SEQ ID NO: 1230463 - RNA, 19 nt, Homo sapiens
aaauggcaaguuuccaaua

SEQ ID NO: 1230464 - RNA, 19 nt, Homo sapiens
gagcagguacccacugucu

SEQ ID NO: 1230465 - RNA, 19 nt, Homo sapiens
gagggaccauaucuacucu

SEQ ID NO: 1230466 - RNA, 19 nt, Homo sapiens
guguguguguguuugugua

SEQ ID NO: 1230467 - RNA, 19 nt, Homo sapiens
gugguaaauuugggacuug

SEQ ID NO: 1230468 - RNA, 19 nt, Homo sapiens
ggaaaugucugaccucaau

SEQ ID NO: 1230469 - RNA, 19 nt, Homo sapiens
gaagugagauggauuucuu

SEQ ID NO: 1230470 - RNA, 19 nt, Homo sapiens
gaacaugugugcuggaaug

SEQ ID NO: 1230471 - RNA, 19 nt, Homo sapiens
uaaaguuccuccugaauuu

SEQ ID NO: 1230472 - RNA, 19 nt, Homo sapiens
ugucugaccucaauaaaua

SEQ ID NO: 1230473 - RNA, 19 nt, Homo sapiens
gcacgaguacuauuacaua

SEQ ID NO: 1230474 - RNA, 19 nt, Homo sapiens
gaaaggccguaguaguaaa

SEQ ID NO: 1230475 - RNA, 19 nt, Homo sapiens
cagaaaggccguaguagua

SEQ ID NO: 1230476 - RNA, 19 nt, Homo sapiens
aaacuggucuuauugaaug

SEQ ID NO: 1230477 - RNA, 19 nt, Homo sapiens
aaagaaaguucgcccauug

SEQ ID NO: 1230478 - RNA, 19 nt, Homo sapiens
gguaacaacucauuauaag

SEQ ID NO: 1230479 - RNA, 19 nt, Homo sapiens
gaugaacguuauaugguuu

SEQ ID NO: 1230480 - RNA, 19 nt, Homo sapiens
gaacacagguuugcuccau

SEQ ID NO: 1230481 - RNA, 19 nt, Homo sapiens
ugacauggacggcaaagua

SEQ ID NO: 1230482 - RNA, 19 nt, Homo sapiens
caugugugcuggaauguuu

SEQ ID NO: 1230483 - RNA, 19 nt, Homo sapiens
ugauuucucugcucauaaa

SEQ ID NO: 1230484 - RNA, 19 nt, Homo sapiens
gaaacuggucuuauugaau

SEQ ID NO: 1230485 - RNA, 19 nt, Homo sapiens
ggcagagucuucuuucaga

SEQ ID NO: 1230486 - RNA, 19 nt, Homo sapiens
gccgauggcucucaaaugg

SEQ ID NO: 1230487 - RNA, 19 nt, Homo sapiens
ggguaacaacucauuauaa

SEQ ID NO: 1230488 - RNA, 19 nt, Homo sapiens
aguuugagcuugauaguga

SEQ ID NO: 1230489 - RNA, 19 nt, Homo sapiens
gcagaaaggccguaguagu

SEQ ID NO: 1230490 - RNA, 19 nt, Homo sapiens
cagcagaaaggccguagua

SEQ ID NO: 1230491 - RNA, 19 nt, Homo sapiens
ugaugaacguuauaugguu

SEQ ID NO: 1230492 - RNA, 19 nt, Homo sapiens
guaugcacgaguacuauua

SEQ ID NO: 1230493 - RNA, 19 nt, Homo sapiens
agaaacuggucuuauugaa

SEQ ID NO: 1230494 - RNA, 19 nt, Homo sapiens
cuaaaguuccuccugaauu

SEQ ID NO: 1230495 - RNA, 19 nt, Homo sapiens
gaccaugagguuaauagaa

SEQ ID NO: 1230496 - RNA, 19 nt, Homo sapiens
ccaagcauaucagaacaug

SEQ ID NO: 1230497 - RNA, 19 nt, Homo sapiens
gaaaugucugaccucaaua

SEQ ID NO: 1230498 - RNA, 19 nt, Homo sapiens
ccaugagguuaauagaauu

SEQ ID NO: 1230499 - RNA, 19 nt, Homo sapiens
ggacggcaaaguacguaaa

SEQ ID NO: 1230500 - RNA, 19 nt, Homo sapiens
guaucucucugaauuccuu

SEQ ID NO: 1230501 - RNA, 19 nt, Homo sapiens
acacagguuugcuccauuc

SEQ ID NO: 1230502 - RNA, 19 nt, Homo sapiens
auugguaucucucugaauu

SEQ ID NO: 1230503 - RNA, 19 nt, Homo sapiens
gccgagagaucacaaugag

SEQ ID NO: 1230504 - RNA, 19 nt, Homo sapiens
aaaccaugguagcauuuga

SEQ ID NO: 1230505 - RNA, 19 nt, Homo sapiens
cagaacaugugugcuggaa

SEQ ID NO: 1230506 - RNA, 19 nt, Homo sapiens
ucacaaugagccaagcaua

SEQ ID NO: 1230507 - RNA, 19 nt, Homo sapiens
agauggauuucuuggguaa

SEQ ID NO: 1230508 - RNA, 19 nt, Homo sapiens
ccaacuuugugguuaugaa

SEQ ID NO: 1230509 - RNA, 19 nt, Homo sapiens
gcagaggaaaggauaaugg

SEQ ID NO: 1230510 - RNA, 19 nt, Homo sapiens
accaugagguuaauagaau

SEQ ID NO: 1230511 - RNA, 19 nt, Homo sapiens
ccagugcacuacuuacagu

SEQ ID NO: 1230512 - RNA, 19 nt, Homo sapiens
aggaaaggauaauggaaga

SEQ ID NO: 1230513 - RNA, 19 nt, Homo sapiens
agaaaggccguaguaguaa

SEQ ID NO: 1230514 - RNA, 19 nt, Homo sapiens
cuaguaagcacuuucaaca

SEQ ID NO: 1230515 - RNA, 19 nt, Homo sapiens
aaccgaaguuugagcuuga

SEQ ID NO: 1230516 - RNA, 19 nt, Homo sapiens
cacgaguacuauuacauau

SEQ ID NO: 1230517 - RNA, 19 nt, Homo sapiens
cuuauugaaugcauugaug

SEQ ID NO: 1230518 - RNA, 19 nt, Homo sapiens
gaaguuugagcuugauagu

SEQ ID NO: 1230519 - RNA, 19 nt, Homo sapiens
gagccaagcauaucagaac

SEQ ID NO: 1230520 - RNA, 19 nt, Homo sapiens
ucuacaguaugcacgagua

SEQ ID NO: 1230521 - RNA, 19 nt, Homo sapiens
cuacuuacaguucaaggaa

SEQ ID NO: 1230522 - RNA, 19 nt, Homo sapiens
ggaccaugagguuaauaga

SEQ ID NO: 1230523 - RNA, 19 nt, Homo sapiens
aaaugucugaccucaauaa

SEQ ID NO: 1230524 - RNA, 19 nt, Homo sapiens
gugcacuacuuacaguuca

SEQ ID NO: 1230525 - RNA, 19 nt, Homo sapiens
ccuuauaugacaugaauga

SEQ ID NO: 1230526 - RNA, 19 nt, Homo sapiens
aagcauaucagaacaugug

SEQ ID NO: 1230527 - RNA, 19 nt, Homo sapiens
uuugauuucucugcucaua

SEQ ID NO: 1230528 - RNA, 19 nt, Homo sapiens
cacaaugagccaagcauau

SEQ ID NO: 1230529 - RNA, 19 nt, Homo sapiens
ccauugagccgagagauca

SEQ ID NO: 1230530 - RNA, 19 nt, Homo sapiens
ggucuuauugaaugcauug

SEQ ID NO: 1230531 - RNA, 19 nt, Homo sapiens
agccuuauaugacaugaau

SEQ ID NO: 1230532 - RNA, 19 nt, Homo sapiens
uggguaacaacucauuaua

SEQ ID NO: 1230533 - RNA, 19 nt, Homo sapiens
gagccgagagaucacaaug

SEQ ID NO: 1230534 - RNA, 19 nt, Homo sapiens
gcauugaugaacguuauau

SEQ ID NO: 1230535 - RNA, 19 nt, Homo sapiens
ugaaugcauugaugaacgu

SEQ ID NO: 1230536 - RNA, 19 nt, Homo sapiens
cagguuugcuccauucaac

SEQ ID NO: 1230537 - RNA, 19 nt, Homo sapiens
uauauugguaucucucuga

SEQ ID NO: 1230538 - RNA, 19 nt, Homo sapiens
uggaagagcagcagaaagg

SEQ ID NO: 1230539 - RNA, 19 nt, Homo sapiens
ugacagccuuauaugacau

SEQ ID NO: 1230540 - RNA, 19 nt, Homo sapiens
caaugagccaagcauauca

SEQ ID NO: 1230541 - RNA, 19 nt, Homo sapiens
cagaggaaaggauaaugga

SEQ ID NO: 1230542 - RNA, 19 nt, Homo sapiens
uaauggaagagcagcagaa

SEQ ID NO: 1230543 - RNA, 19 nt, Homo sapiens
guuugacagccuuauauga

SEQ ID NO: 1230544 - RNA, 19 nt, Homo sapiens
gggcagagucuucuuucag

SEQ ID NO: 1230545 - RNA, 19 nt, Homo sapiens
uuaaaaccaugguagcauu

SEQ ID NO: 1230546 - RNA, 19 nt, Homo sapiens
ucaaauggcagaggaaagg

SEQ ID NO: 1230547 - RNA, 19 nt, Homo sapiens
acaaugagccaagcauauc

SEQ ID NO: 1230548 - RNA, 19 nt, Homo sapiens
augcauugaugaacguuau

SEQ ID NO: 1230549 - RNA, 19 nt, Homo sapiens
uuucuuggguaacaacuca

SEQ ID NO: 1230550 - RNA, 19 nt, Homo sapiens
ugagcuugauagugaacaa

SEQ ID NO: 1230551 - RNA, 19 nt, Homo sapiens
aagaaaguucgcccauuga

SEQ ID NO: 1230552 - RNA, 19 nt, Homo sapiens
uuaguuugacagccuuaua

SEQ ID NO: 1230553 - RNA, 19 nt, Homo sapiens
cgggaagugagauggauuu

SEQ ID NO: 1230554 - RNA, 19 nt, Homo sapiens
aaaagaaaguucgcccauu

SEQ ID NO: 1230555 - RNA, 19 nt, Homo sapiens
uaguuugacagccuuauau

SEQ ID NO: 1230556 - RNA, 19 nt, Homo sapiens
ucaccaggcuccacaucac

SEQ ID NO: 1230557 - RNA, 19 nt, Homo sapiens
gacauggacggcaaaguac

SEQ ID NO: 1230558 - RNA, 19 nt, Homo sapiens
guaacaacucauuauaagg

SEQ ID NO: 1230559 - RNA, 19 nt, Homo sapiens
caacuuugugguuaugaag

SEQ ID NO: 1230560 - RNA, 19 nt, Homo sapiens
aauggcagaggaaaggaua

SEQ ID NO: 1230561 - RNA, 19 nt, Homo sapiens
gaacuguauguggcagcua

SEQ ID NO: 1230562 - RNA, 19 nt, Homo sapiens
uacuuacaguucaaggaaa

SEQ ID NO: 1230563 - RNA, 19 nt, Homo sapiens
gcuaguaagcacuuucaac

SEQ ID NO: 1230564 - RNA, 19 nt, Homo sapiens
acuuacaguucaaggaaau

SEQ ID NO: 1230565 - RNA, 19 nt, Homo sapiens
caagaagucugacaucaua

SEQ ID NO: 1230566 - RNA, 19 nt, Homo sapiens
cuaaagaguuuccuuguua

SEQ ID NO: 1230567 - RNA, 19 nt, Homo sapiens
gaaauugacugacauacug

SEQ ID NO: 1230568 - RNA, 19 nt, Homo sapiens
ggaagugggucacaugaaa

SEQ ID NO: 1230569 - RNA, 19 nt, Homo sapiens
gcaagagacuguauguauu

SEQ ID NO: 1230570 - RNA, 19 nt, Homo sapiens
gcagaagucuugagcuauu

SEQ ID NO: 1230571 - RNA, 19 nt, Homo sapiens
aaacauugcuugucuuuga

SEQ ID NO: 1230572 - RNA, 19 nt, Homo sapiens
cagaguaccuugcucauuu

SEQ ID NO: 1230573 - RNA, 19 nt, Homo sapiens
cuauagagcuggcauguaa

SEQ ID NO: 1230574 - RNA, 19 nt, Homo sapiens
caacaugcaugaccuaaug

SEQ ID NO: 1230575 - RNA, 19 nt, Homo sapiens
gaagaucacugggauugaa

SEQ ID NO: 1230576 - RNA, 19 nt, Homo sapiens
gaaguaaaggcaaacauaa

SEQ ID NO: 1230577 - RNA, 19 nt, Homo sapiens
ggaaguaaaggcaaacaua

SEQ ID NO: 1230578 - RNA, 19 nt, Homo sapiens
gagcugagauugagacuag

SEQ ID NO: 1230579 - RNA, 19 nt, Homo sapiens
gcaaagaaggguugauaaa

SEQ ID NO: 1230580 - RNA, 19 nt, Homo sapiens
caauuuagcuggauuucug

SEQ ID NO: 1230581 - RNA, 19 nt, Homo sapiens
gaaaugaccccuugacuuu

SEQ ID NO: 1230582 - RNA, 19 nt, Homo sapiens
acagagagcauuaugauuu

SEQ ID NO: 1230583 - RNA, 19 nt, Homo sapiens
ggagaaaacuuguauagau

SEQ ID NO: 1230584 - RNA, 19 nt, Homo sapiens
caagagacuguauguauuu

SEQ ID NO: 1230585 - RNA, 19 nt, Homo sapiens
gaugaauucuagugaaaug

SEQ ID NO: 1230586 - RNA, 19 nt, Homo sapiens
gaucaaguuuguccuaauc

SEQ ID NO: 1230587 - RNA, 19 nt, Homo sapiens
ggauuugccuuccuucaug

SEQ ID NO: 1230588 - RNA, 19 nt, Homo sapiens
gugcagaagucuugagcua

SEQ ID NO: 1230589 - RNA, 19 nt, Homo sapiens
ggagagaguuccgauuugu

SEQ ID NO: 1230590 - RNA, 19 nt, Homo sapiens
ggaaacauugcuugucuuu

SEQ ID NO: 1230591 - RNA, 19 nt, Homo sapiens
ugaguuaagugaaaggaaa

SEQ ID NO: 1230592 - RNA, 19 nt, Homo sapiens
ggauuucacuugcauugug

SEQ ID NO: 1230593 - RNA, 19 nt, Homo sapiens
gagacguaaucuacccuua

SEQ ID NO: 1230594 - RNA, 19 nt, Homo sapiens
gcacuuccucuuacuauga

SEQ ID NO: 1230595 - RNA, 19 nt, Homo sapiens
uuacugagaggaacuauuu

SEQ ID NO: 1230596 - RNA, 19 nt, Homo sapiens
gaacuaugguuuugaaugu

SEQ ID NO: 1230597 - RNA, 19 nt, Homo sapiens
ugauggauauuguucguaa

SEQ ID NO: 1230598 - RNA, 19 nt, Homo sapiens
gcauguaauucuuccucua

SEQ ID NO: 1230599 - RNA, 19 nt, Homo sapiens
gaaaggaacucaaaacacu

SEQ ID NO: 1230600 - RNA, 19 nt, Homo sapiens
gagcuggcauguaauucuu

SEQ ID NO: 1230601 - RNA, 19 nt, Homo sapiens
agaaugauggguacaguua

SEQ ID NO: 1230602 - RNA, 19 nt, Homo sapiens
gacguaaucuacccuuaug

SEQ ID NO: 1230603 - RNA, 19 nt, Homo sapiens
gagacuagccuugugguuu

SEQ ID NO: 1230604 - RNA, 19 nt, Homo sapiens
gaagaaugauggguacagu

SEQ ID NO: 1230605 - RNA, 19 nt, Homo sapiens
caagaaggagaauccauuu

SEQ ID NO: 1230606 - RNA, 19 nt, Homo sapiens
gcucagugauucauaugug

SEQ ID NO: 1230607 - RNA, 19 nt, Homo sapiens
gaagagaacaccauuuuau

SEQ ID NO: 1230608 - RNA, 19 nt, Homo sapiens
ugacugacauacuggaaga

SEQ ID NO: 1230609 - RNA, 19 nt, Homo sapiens
caaaucguaucuuuccaau

SEQ ID NO: 1230610 - RNA, 19 nt, Homo sapiens
aaagagugauggauauugu

SEQ ID NO: 1230611 - RNA, 19 nt, Homo sapiens
guaaucuacccuuauguuu

SEQ ID NO: 1230612 - RNA, 19 nt, Homo sapiens
gcaacaaccucaaaaucaa

SEQ ID NO: 1230613 - RNA, 19 nt, Homo sapiens
gaaggagaauccauuuagc

SEQ ID NO: 1230614 - RNA, 19 nt, Homo sapiens
ggauauuguucguaaucuu

SEQ ID NO: 1230615 - RNA, 19 nt, Homo sapiens
aagcaaagagugauggaua

SEQ ID NO: 1230616 - RNA, 19 nt, Homo sapiens
aagaauagguauaggaaag

SEQ ID NO: 1230617 - RNA, 19 nt, Homo sapiens
caugaugaauucuagugaa

SEQ ID NO: 1230618 - RNA, 19 nt, Homo sapiens
gagaaaacuuguauagaug

SEQ ID NO: 1230619 - RNA, 19 nt, Homo sapiens
gauauuguucguaaucuug

SEQ ID NO: 1230620 - RNA, 19 nt, Homo sapiens
gcaaagagugauggauauu

SEQ ID NO: 1230621 - RNA, 19 nt, Homo sapiens
caaucaauauccagaaucu

SEQ ID NO: 1230622 - RNA, 19 nt, Homo sapiens
guauaggaaagacugaaua

SEQ ID NO: 1230623 - RNA, 19 nt, Homo sapiens
cuugguagcucugggauuu

SEQ ID NO: 1230624 - RNA, 19 nt, Homo sapiens
cagcaaagccaagcaaaga

SEQ ID NO: 1230625 - RNA, 19 nt, Homo sapiens
ccacagagagcauuaugau

SEQ ID NO: 1230626 - RNA, 19 nt, Homo sapiens
ugucuuggauacauacgua

SEQ ID NO: 1230627 - RNA, 19 nt, Homo sapiens
agacuagccuugugguuuc

SEQ ID NO: 1230628 - RNA, 19 nt, Homo sapiens
aguccaaacuggguuauuu

SEQ ID NO: 1230629 - RNA, 19 nt, Homo sapiens
uuaccucccugguguuauu

SEQ ID NO: 1230630 - RNA, 19 nt, Homo sapiens
guucaaagaaaccagaauu

SEQ ID NO: 1230631 - RNA, 19 nt, Homo sapiens
uagcuggauuucugaacua

SEQ ID NO: 1230632 - RNA, 19 nt, Homo sapiens
guagacaacacccuuacaa

SEQ ID NO: 1230633 - RNA, 19 nt, Homo sapiens
ucaagaaggagaauccauu

SEQ ID NO: 1230634 - RNA, 19 nt, Homo sapiens
uauaagagacguaaucuac

SEQ ID NO: 1230635 - RNA, 19 nt, Homo sapiens
gccaagaagucugacauca

SEQ ID NO: 1230636 - RNA, 19 nt, Homo sapiens
gaccuaaugucuugcaaaa

SEQ ID NO: 1230637 - RNA, 19 nt, Homo sapiens
gacagcaagcuaaauaaau

SEQ ID NO: 1230638 - RNA, 19 nt, Homo sapiens
cggcgaaacuucccucuac

SEQ ID NO: 1230639 - RNA, 19 nt, Homo sapiens
auauguggcuuugggaaua

SEQ ID NO: 1230640 - RNA, 19 nt, Homo sapiens
auagaugcacuuccucuua

SEQ ID NO: 1230641 - RNA, 19 nt, Homo sapiens
gcagaguaccuugcucauu

SEQ ID NO: 1230642 - RNA, 19 nt, Homo sapiens
cagaaucuaaugcagagua

SEQ ID NO: 1230643 - RNA, 19 nt, Homo sapiens
ucauagcaauccacagaga

SEQ ID NO: 1230644 - RNA, 19 nt, Homo sapiens
ugcaugaccuaaugucuug

SEQ ID NO: 1230645 - RNA, 19 nt, Homo sapiens
gugaucaaguuuguccuaa

SEQ ID NO: 1230646 - RNA, 19 nt, Homo sapiens
aagcaaagaaggguugaua

SEQ ID NO: 1230647 - RNA, 19 nt, Homo sapiens
gaagugggucacaugaaau

SEQ ID NO: 1230648 - RNA, 19 nt, Homo sapiens
ccagugugguuauucuguu

SEQ ID NO: 1230649 - RNA, 19 nt, Homo sapiens
acuaaagaguuuccuuguu

SEQ ID NO: 1230650 - RNA, 19 nt, Homo sapiens
uaucucagguuagugaaga

SEQ ID NO: 1230651 - RNA, 19 nt, Homo sapiens
ggaagagaacaccauuuua

SEQ ID NO: 1230652 - RNA, 19 nt, Homo sapiens
gggaaacauugcuugucuu

SEQ ID NO: 1230653 - RNA, 19 nt, Homo sapiens
cugcagcuauuuccaaugu

SEQ ID NO: 1230654 - RNA, 19 nt, Homo sapiens
caaagagugauggauauug

SEQ ID NO: 1230655 - RNA, 19 nt, Homo sapiens
gcaaagccaagcaaagagu

SEQ ID NO: 1230656 - RNA, 19 nt, Homo sapiens
ucagguuagugaagaauca

SEQ ID NO: 1230657 - RNA, 19 nt, Homo sapiens
ucacuucuuugccaucugu

SEQ ID NO: 1230658 - RNA, 19 nt, Homo sapiens
cauuccaaaucguaucuuu

SEQ ID NO: 1230659 - RNA, 19 nt, Homo sapiens
guucguaaucuuggacuua

SEQ ID NO: 1230660 - RNA, 19 nt, Homo sapiens
aaucauagcaauccacaga

SEQ ID NO: 1230661 - RNA, 19 nt, Homo sapiens
agacagcaagcuaaauaaa

SEQ ID NO: 1230662 - RNA, 19 nt, Homo sapiens
gaggaagugggucacauga

SEQ ID NO: 1230663 - RNA, 19 nt, Homo sapiens
ugagaaauugacugacaua

SEQ ID NO: 1230664 - RNA, 19 nt, Homo sapiens
uguuauugcugccauucua

SEQ ID NO: 1230665 - RNA, 19 nt, Homo sapiens
ccacuacgcucgcaacuua

SEQ ID NO: 1230666 - RNA, 19 nt, Homo sapiens
gggcacggauagagaaaua

SEQ ID NO: 1230667 - RNA, 19 nt, Homo sapiens
ugacauguuuguugaauga

SEQ ID NO: 1230668 - RNA, 19 nt, Homo sapiens
ggacugggcucucuauguc

SEQ ID NO: 1230669 - RNA, 19 nt, Homo sapiens
gaagagcagccauguuuga

SEQ ID NO: 1230670 - RNA, 19 nt, Homo sapiens
caccauacccggcuaauuu

SEQ ID NO: 1230671 - RNA, 19 nt, Homo sapiens
guggugaguuggaaugaua

SEQ ID NO: 1230672 - RNA, 19 nt, Homo sapiens
acagauacgugccaccaua

SEQ ID NO: 1230673 - RNA, 19 nt, Homo sapiens
gaucaucgcagccagauau

SEQ ID NO: 1230674 - RNA, 19 nt, Homo sapiens
ccaaagugcugccauuaca

SEQ ID NO: 1230675 - RNA, 19 nt, Homo sapiens
gcuacuagacuguucauuu

SEQ ID NO: 1230676 - RNA, 19 nt, Homo sapiens
cuacuagacuguucauuuc

SEQ ID NO: 1230677 - RNA, 19 nt, Homo sapiens
agacagggauucaacaugu

SEQ ID NO: 1230678 - RNA, 19 nt, Homo sapiens
gcagcaagaugccauuucu

SEQ ID NO: 1230679 - RNA, 19 nt, Homo sapiens
guagcuaggauuacagaua

SEQ ID NO: 1230680 - RNA, 19 nt, Homo sapiens
uggaagagcagccauguuu

SEQ ID NO: 1230681 - RNA, 19 nt, Homo sapiens
gagaggcccuagcgaaaca

SEQ ID NO: 1230682 - RNA, 19 nt, Homo sapiens
cauccuguuuccacuguua

SEQ ID NO: 1230683 - RNA, 19 nt, Homo sapiens
cgacugguguuccugaaga

SEQ ID NO: 1230684 - RNA, 19 nt, Homo sapiens
uaucaagcccugccucuuu

SEQ ID NO: 1230685 - RNA, 19 nt, Homo sapiens
gcucugccuucuccuacua

SEQ ID NO: 1230686 - RNA, 19 nt, Homo sapiens
ggagugcaguggcaugauc

SEQ ID NO: 1230687 - RNA, 19 nt, Homo sapiens
ccagaagggaugagucuuu

SEQ ID NO: 1230688 - RNA, 19 nt, Homo sapiens
uggcauggcuggacucugu

SEQ ID NO: 1230689 - RNA, 19 nt, Homo sapiens
cagaagggaugagucuuug

SEQ ID NO: 1230690 - RNA, 19 nt, Homo sapiens
gccaagagagggaauauuc

SEQ ID NO: 1230691 - RNA, 19 nt, Homo sapiens
gcaacuuacuaugguuuga

SEQ ID NO: 1230692 - RNA, 19 nt, Homo sapiens
ucucugacauguuuguuga

SEQ ID NO: 1230693 - RNA, 19 nt, Homo sapiens
ggagugagccacaggaagu

SEQ ID NO: 1230694 - RNA, 19 nt, Homo sapiens
acaucagacuacagauuua

SEQ ID NO: 1230695 - RNA, 19 nt, Homo sapiens
gcucgcaacuuacuauggu

SEQ ID NO: 1230696 - RNA, 19 nt, Homo sapiens
cagaguagcuaggauuaca

SEQ ID NO: 1230697 - RNA, 19 nt, Homo sapiens
aaacaucagacuacagauu

SEQ ID NO: 1230698 - RNA, 19 nt, Homo sapiens
gacagggauucaacauguu

SEQ ID NO: 1230699 - RNA, 19 nt, Homo sapiens
uagcuaggauuacagauac

SEQ ID NO: 1230700 - RNA, 19 nt, Homo sapiens
gaaugugagcgccuagcua

SEQ ID NO: 1230701 - RNA, 19 nt, Homo sapiens
gagcaggccuggggaauga

SEQ ID NO: 1230702 - RNA, 19 nt, Homo sapiens
ggaagagcagccauguuug

SEQ ID NO: 1230703 - RNA, 19 nt, Homo sapiens
caugguggcugaguacuuc

SEQ ID NO: 1230704 - RNA, 19 nt, Homo sapiens
gcucugggagucuucauga

SEQ ID NO: 1230705 - RNA, 19 nt, Homo sapiens
ccuccacccuccacucauu

SEQ ID NO: 1230706 - RNA, 19 nt, Homo sapiens
gaagggaugagucuuuguc

SEQ ID NO: 1230707 - RNA, 19 nt, Homo sapiens
agcgaaacauugucuggua

SEQ ID NO: 1230708 - RNA, 19 nt, Homo sapiens
guucauuucucucugacau

SEQ ID NO: 1230709 - RNA, 19 nt, Homo sapiens
aacaucagacuacagauuu

SEQ ID NO: 1230710 - RNA, 19 nt, Homo sapiens
gcccucauccauccuguuu

SEQ ID NO: 1230711 - RNA, 19 nt, Homo sapiens
gaagggcacaugugaugag

SEQ ID NO: 1230712 - RNA, 19 nt, Homo sapiens
caagagagggaauauucau

SEQ ID NO: 1230713 - RNA, 19 nt, Homo sapiens
uuccaggccucuaggguaa

SEQ ID NO: 1230714 - RNA, 19 nt, Homo sapiens
uuacaggcgugagccacua

SEQ ID NO: 1230715 - RNA, 19 nt, Homo sapiens
ugguuaggcuggucuugaa

SEQ ID NO: 1230716 - RNA, 19 nt, Homo sapiens
ccacaugggcccucucucu

SEQ ID NO: 1230717 - RNA, 19 nt, Homo sapiens
auaaacaucagacuacaga

SEQ ID NO: 1230718 - RNA, 19 nt, Homo sapiens
ccauaaacaucagacuaca

SEQ ID NO: 1230719 - RNA, 19 nt, Homo sapiens
cauccucugucaccacaug

SEQ ID NO: 1230720 - RNA, 19 nt, Homo sapiens
gagccugcuucaccgcuau

SEQ ID NO: 1230721 - RNA, 19 nt, Homo sapiens
gagacagggauucaacaug

SEQ ID NO: 1230722 - RNA, 19 nt, Homo sapiens
caaggccacucuccccaua

SEQ ID NO: 1230723 - RNA, 19 nt, Homo sapiens
cuauaaauccaccucauca

SEQ ID NO: 1230724 - RNA, 19 nt, Homo sapiens
ucauuucucucugacaugu

SEQ ID NO: 1230725 - RNA, 19 nt, Homo sapiens
auacguccauuucucuaug

SEQ ID NO: 1230726 - RNA, 19 nt, Homo sapiens
gauacguccauuucucuau

SEQ ID NO: 1230727 - RNA, 19 nt, Homo sapiens
caaggcagauccacaucac

SEQ ID NO: 1230728 - RNA, 19 nt, Homo sapiens
ggagucuucaugaccauug

SEQ ID NO: 1230729 - RNA, 19 nt, Homo sapiens
ccgagaggcccuagcgaaa

SEQ ID NO: 1230730 - RNA, 19 nt, Homo sapiens
caucgcagccagauaucaa

SEQ ID NO: 1230731 - RNA, 19 nt, Homo sapiens
ccaagagagggaauauuca

SEQ ID NO: 1230732 - RNA, 19 nt, Homo sapiens
uuacuaugguuugacuuug

SEQ ID NO: 1230733 - RNA, 19 nt, Homo sapiens
gcuuugcacuccagcucuu

SEQ ID NO: 1230734 - RNA, 19 nt, Homo sapiens
gcuggacucugucuuugac

SEQ ID NO: 1230735 - RNA, 19 nt, Homo sapiens
gacucugccucccaaagug

SEQ ID NO: 1230736 - RNA, 19 nt, Homo sapiens
gaguagcuaggauuacaga

SEQ ID NO: 1230737 - RNA, 19 nt, Homo sapiens
gcugaguacuucgaugagu

SEQ ID NO: 1230738 - RNA, 19 nt, Homo sapiens
ugccucagccuccagagua

SEQ ID NO: 1230739 - RNA, 19 nt, Homo sapiens
cuucaugaccauuggcuuu

SEQ ID NO: 1230740 - RNA, 19 nt, Homo sapiens
cugcaggucuugccuucug

SEQ ID NO: 1230741 - RNA, 19 nt, Homo sapiens
ccgcaagucaccaucuuug

SEQ ID NO: 1230742 - RNA, 19 nt, Homo sapiens
ggcaugaucucggcucacu

SEQ ID NO: 1230743 - RNA, 19 nt, Homo sapiens
aaacggagucuugcucugu

SEQ ID NO: 1230744 - RNA, 19 nt, Homo sapiens
uggcuggacucugucuuug

SEQ ID NO: 1230745 - RNA, 19 nt, Homo sapiens
gcccugccucuuucgauuu

SEQ ID NO: 1230746 - RNA, 19 nt, Homo sapiens
ugccuucuccuacuauaaa

SEQ ID NO: 1230747 - RNA, 19 nt, Homo sapiens
ccaaggcagauccacauca

SEQ ID NO: 1230748 - RNA, 19 nt, Homo sapiens
guuugaagggcacauguga

SEQ ID NO: 1230749 - RNA, 19 nt, Homo sapiens
guacaaggacaagcuggau

SEQ ID NO: 1230750 - RNA, 19 nt, Homo sapiens
gaggcuaccugggcuacag

SEQ ID NO: 1230751 - RNA, 19 nt, Homo sapiens
gaaauauuugcuacuagac

SEQ ID NO: 1230752 - RNA, 19 nt, Homo sapiens
ccucaggugauccacauga

SEQ ID NO: 1230753 - RNA, 19 nt, Homo sapiens
ucugacauguuuguugaau

SEQ ID NO: 1230754 - RNA, 19 nt, Homo sapiens
acuguucauuucucucuga

SEQ ID NO: 1230755 - RNA, 19 nt, Homo sapiens
uacguccauuucucuauga

SEQ ID NO: 1230756 - RNA, 19 nt, Homo sapiens
agagguacuucaggucaug

SEQ ID NO: 1230757 - RNA, 19 nt, Homo sapiens
ucccaaagugcugccauua

SEQ ID NO: 1230758 - RNA, 19 nt, Homo sapiens
ccccugagcuccaguacaa

SEQ ID NO: 1230759 - RNA, 19 nt, Homo sapiens
cagagaagagggccaagag

SEQ ID NO: 1230760 - RNA, 19 nt, Homo sapiens
cuuacuaugguuugacuuu

SEQ ID NO: 1230761 - RNA, 19 nt, Homo sapiens
ugacucugccucccaaagu

SEQ ID NO: 1230762 - RNA, 19 nt, Homo sapiens
ccaccauacccggcuaauu

SEQ ID NO: 1230763 - RNA, 19 nt, Homo sapiens
uccagaguagcuaggauua

SEQ ID NO: 1230764 - RNA, 19 nt, Homo sapiens
gcuaagguuuugggcuaua

SEQ ID NO: 1230765 - RNA, 19 nt, Homo sapiens
gaagaaaucuggcugguuu

SEQ ID NO: 1230766 - RNA, 19 nt, Homo sapiens
gaacauugcuccugugaug

SEQ ID NO: 1230767 - RNA, 19 nt, Homo sapiens
gaaaggaccuagaagaauc

SEQ ID NO: 1230768 - RNA, 19 nt, Homo sapiens
ggaagguaauucuuucuaa

SEQ ID NO: 1230769 - RNA, 19 nt, Homo sapiens
gugaagagauuuccucaaa

SEQ ID NO: 1230770 - RNA, 19 nt, Homo sapiens
gaauugaacugugaccuuu

SEQ ID NO: 1230771 - RNA, 19 nt, Homo sapiens
gggaagacgugaagaagaa

SEQ ID NO: 1230772 - RNA, 19 nt, Homo sapiens
ggaguggacuuauuugaga

SEQ ID NO: 1230773 - RNA, 19 nt, Homo sapiens
cguaauaacugaagaccua

SEQ ID NO: 1230774 - RNA, 19 nt, Homo sapiens
uaaaugaccuggauugauc

SEQ ID NO: 1230775 - RNA, 19 nt, Homo sapiens
uaaaggcaauagccaauaa

SEQ ID NO: 1230776 - RNA, 19 nt, Homo sapiens
gggauuacauuucaacuug

SEQ ID NO: 1230777 - RNA, 19 nt, Homo sapiens
cgaaugggcucuggacaua

SEQ ID NO: 1230778 - RNA, 19 nt, Homo sapiens
caccaugccuggcuaauuu

SEQ ID NO: 1230779 - RNA, 19 nt, Homo sapiens
aaauggcucuugugacuua

SEQ ID NO: 1230780 - RNA, 19 nt, Homo sapiens
gcucauaucugguguuagu

SEQ ID NO: 1230781 - RNA, 19 nt, Homo sapiens
agaaguaucuuguaaggaa

SEQ ID NO: 1230782 - RNA, 19 nt, Homo sapiens
gggaacaaauagucaaauu

SEQ ID NO: 1230783 - RNA, 19 nt, Homo sapiens
agaaggaguuggaaaguuu

SEQ ID NO: 1230784 - RNA, 19 nt, Homo sapiens
ccaaagaucugauuguuuu

SEQ ID NO: 1230785 - RNA, 19 nt, Homo sapiens
guaccaaacugcccacaug

SEQ ID NO: 1230786 - RNA, 19 nt, Homo sapiens
gcaauucacuuaacuucuc

SEQ ID NO: 1230787 - RNA, 19 nt, Homo sapiens
guucuuggauugcuauaaa

SEQ ID NO: 1230788 - RNA, 19 nt, Homo sapiens
ggacaggcauaauggauag

SEQ ID NO: 1230789 - RNA, 19 nt, Homo sapiens
ggacauaugccuguugauu

SEQ ID NO: 1230790 - RNA, 19 nt, Homo sapiens
gaguguccaugaauaaauu

SEQ ID NO: 1230791 - RNA, 19 nt, Homo sapiens
gaagguaauucuuucuaag

SEQ ID NO: 1230792 - RNA, 19 nt, Homo sapiens
ggagaaguaucuuguaagg

SEQ ID NO: 1230793 - RNA, 19 nt, Homo sapiens
gaagaaauaaucugagcuu

SEQ ID NO: 1230794 - RNA, 19 nt, Homo sapiens
gcacaacuuugaacacuac

SEQ ID NO: 1230795 - RNA, 19 nt, Homo sapiens
gggcauuacuuaacauugu

SEQ ID NO: 1230796 - RNA, 19 nt, Homo sapiens
aaagaggaguggacuuauu

SEQ ID NO: 1230797 - RNA, 19 nt, Homo sapiens
ugaaagagucgaaugguuu

SEQ ID NO: 1230798 - RNA, 19 nt, Homo sapiens
ugaaagaggaguggacuua

SEQ ID NO: 1230799 - RNA, 19 nt, Homo sapiens
cagaaucacucuuguacug

SEQ ID NO: 1230800 - RNA, 19 nt, Homo sapiens
gacagaauauaaagaagga

SEQ ID NO: 1230801 - RNA, 19 nt, Homo sapiens
caucacacgcugcauaaua

SEQ ID NO: 1230802 - RNA, 19 nt, Homo sapiens
uggguaaucuguaaagaaa

SEQ ID NO: 1230803 - RNA, 19 nt, Homo sapiens
ccacauggccuauuugcaa

SEQ ID NO: 1230804 - RNA, 19 nt, Homo sapiens
gacauaugccuguugauuu

SEQ ID NO: 1230805 - RNA, 19 nt, Homo sapiens
caugaagucuugacagaau

SEQ ID NO: 1230806 - RNA, 19 nt, Homo sapiens
gauacugucuagcucuaaa

SEQ ID NO: 1230807 - RNA, 19 nt, Homo sapiens
gaaauggugugagacgaau

SEQ ID NO: 1230808 - RNA, 19 nt, Homo sapiens
agagagaauugaacuguga

SEQ ID NO: 1230809 - RNA, 19 nt, Homo sapiens
gaaggaguuggaaaguuua

SEQ ID NO: 1230810 - RNA, 19 nt, Homo sapiens
guugaccgaucacuucuuu

SEQ ID NO: 1230811 - RNA, 19 nt, Homo sapiens
cgacuagccucugcugaaa

SEQ ID NO: 1230812 - RNA, 19 nt, Homo sapiens
gauuggacuuguucaaaug

SEQ ID NO: 1230813 - RNA, 19 nt, Homo sapiens
gauuagagucauagccuua

SEQ ID NO: 1230814 - RNA, 19 nt, Homo sapiens
acauaugccuguugauuug

SEQ ID NO: 1230815 - RNA, 19 nt, Homo sapiens
gaaagagucgaaugguuug

SEQ ID NO: 1230816 - RNA, 19 nt, Homo sapiens
gggcauacauccaccaucu

SEQ ID NO: 1230817 - RNA, 19 nt, Homo sapiens
gaagagacacuacuacaac

SEQ ID NO: 1230818 - RNA, 19 nt, Homo sapiens
ggaacaagacucagagcaa

SEQ ID NO: 1230819 - RNA, 19 nt, Homo sapiens
ccacaagacuggguaaucu

SEQ ID NO: 1230820 - RNA, 19 nt, Homo sapiens
agaaauggcucuugugacu

SEQ ID NO: 1230821 - RNA, 19 nt, Homo sapiens
caacuuugaacacuacuuu

SEQ ID NO: 1230822 - RNA, 19 nt, Homo sapiens
gauugaagguggagaugug

SEQ ID NO: 1230823 - RNA, 19 nt, Homo sapiens
gcugcuuccugcugaauaa

SEQ ID NO: 1230824 - RNA, 19 nt, Homo sapiens
gauagagauucauuuaguc

SEQ ID NO: 1230825 - RNA, 19 nt, Homo sapiens
gagacuggguaauuugguu

SEQ ID NO: 1230826 - RNA, 19 nt, Homo sapiens
cuaaguuaccucuguauuu

SEQ ID NO: 1230827 - RNA, 19 nt, Homo sapiens
ggaaauggugugagacgaa

SEQ ID NO: 1230828 - RNA, 19 nt, Homo sapiens
gcucgaguguauugaaaga

SEQ ID NO: 1230829 - RNA, 19 nt, Homo sapiens
guggagaugugauggaaga

SEQ ID NO: 1230830 - RNA, 19 nt, Homo sapiens
caugagggauccaccuuug

SEQ ID NO: 1230831 - RNA, 19 nt, Homo sapiens
gcaggcacaucacaugaca

SEQ ID NO: 1230832 - RNA, 19 nt, Homo sapiens
gcuuccugcugaauaaaua

SEQ ID NO: 1230833 - RNA, 19 nt, Homo sapiens
cuaacuacguaauaacuga

SEQ ID NO: 1230834 - RNA, 19 nt, Homo sapiens
gaagagauuuccucaaaag

SEQ ID NO: 1230835 - RNA, 19 nt, Homo sapiens
gcaggaagagucagagguu

SEQ ID NO: 1230836 - RNA, 19 nt, Homo sapiens
ggaugaagcugagucuuac

SEQ ID NO: 1230837 - RNA, 19 nt, Homo sapiens
agacucuucuggauacuuu

SEQ ID NO: 1230838 - RNA, 19 nt, Homo sapiens
gccgacaccucugagauaa

SEQ ID NO: 1230839 - RNA, 19 nt, Homo sapiens
guguuuggcuuucuguaaa

SEQ ID NO: 1230840 - RNA, 19 nt, Homo sapiens
ugacuuaacugggcuugga

SEQ ID NO: 1230841 - RNA, 19 nt, Homo sapiens
cuugagaucuugcaaauac

SEQ ID NO: 1230842 - RNA, 19 nt, Homo sapiens
agacuuaaaugaccuggau

SEQ ID NO: 1230843 - RNA, 19 nt, Homo sapiens
cuagaagaaucccuuagga

SEQ ID NO: 1230844 - RNA, 19 nt, Homo sapiens
auacaagucucacucuuca

SEQ ID NO: 1230845 - RNA, 19 nt, Homo sapiens
aaauguaguaggucuguua

SEQ ID NO: 1230846 - RNA, 19 nt, Homo sapiens
ccagaauccauaugaaauu

SEQ ID NO: 1230847 - RNA, 19 nt, Homo sapiens
ggaguagugguaaauauuc

SEQ ID NO: 1230848 - RNA, 19 nt, Homo sapiens
caacaguagagauauuuga

SEQ ID NO: 1230849 - RNA, 19 nt, Homo sapiens
ggauaggaaugaaugaacu

SEQ ID NO: 1230850 - RNA, 19 nt, Homo sapiens
cauaauggauaggaaugaa

SEQ ID NO: 1230851 - RNA, 19 nt, Homo sapiens
aaaugacuguuuccaaguu

SEQ ID NO: 1230852 - RNA, 19 nt, Homo sapiens
gggaguagugguaaauauu

SEQ ID NO: 1230853 - RNA, 19 nt, Homo sapiens
agaccuaucucuugugaag

SEQ ID NO: 1230854 - RNA, 19 nt, Homo sapiens
aaucagaaauggcucuugu

SEQ ID NO: 1230855 - RNA, 19 nt, Homo sapiens
gguuugaggguuuccuuua

SEQ ID NO: 1230856 - RNA, 19 nt, Homo sapiens
cagaagagugugaucauug

SEQ ID NO: 1230857 - RNA, 19 nt, Homo sapiens
ucagaagagugugaucauu

SEQ ID NO: 1230858 - RNA, 19 nt, Homo sapiens
ugaaauguguuagauugga

SEQ ID NO: 1230859 - RNA, 19 nt, Homo sapiens
ucauggcucugcaggcuuu

SEQ ID NO: 1230860 - RNA, 19 nt, Homo sapiens
gggacaggcauaauggaua

SEQ ID NO: 1230861 - RNA, 19 nt, Homo sapiens
gaaagaggaguggacuuau

SEQ ID NO: 1230862 - RNA, 19 nt, Homo sapiens
ugaaaacuguguccaauau

SEQ ID NO: 1230863 - RNA, 19 nt, Homo sapiens
gagcaggcacaucacauga

SEQ ID NO: 1230864 - RNA, 19 nt, Homo sapiens
gagacacuacuacaacaaa

SEQ ID NO: 1230865 - RNA, 19 nt, Homo sapiens
gguagaagcuccugucuua

SEQ ID NO: 1230866 - RNA, 19 nt, Homo sapiens
gaagagugcuugucaauga

SEQ ID NO: 1230867 - RNA, 19 nt, Homo sapiens
ugagagagcuuucuacuaa

SEQ ID NO: 1230868 - RNA, 19 nt, Homo sapiens
ucagauagauggucauaua

SEQ ID NO: 1230869 - RNA, 19 nt, Homo sapiens
cagaggagcuacacuauaa

SEQ ID NO: 1230870 - RNA, 19 nt, Homo sapiens
cgagaaaccuuauaaaugu

SEQ ID NO: 1230871 - RNA, 19 nt, Homo sapiens
gcaagugucugaaugaaga

SEQ ID NO: 1230872 - RNA, 19 nt, Homo sapiens
guccaaagcucagaucuua

SEQ ID NO: 1230873 - RNA, 19 nt, Homo sapiens
gaguagaccugauggguaa

SEQ ID NO: 1230874 - RNA, 19 nt, Homo sapiens
gacaaaugcuucaguagaa

SEQ ID NO: 1230875 - RNA, 19 nt, Homo sapiens
ccagagagcugcccuaaca

SEQ ID NO: 1230876 - RNA, 19 nt, Homo sapiens
gcucagaucuuacuucaca

SEQ ID NO: 1230877 - RNA, 19 nt, Homo sapiens
gagaggacuuuacaugaaa

SEQ ID NO: 1230878 - RNA, 19 nt, Homo sapiens
ucagagaacucauuaagau

SEQ ID NO: 1230879 - RNA, 19 nt, Homo sapiens
gaaauucuuugcccagaga

SEQ ID NO: 1230880 - RNA, 19 nt, Homo sapiens
ggaaaggcccuacaaaugu

SEQ ID NO: 1230881 - RNA, 19 nt, Homo sapiens
gcucagaucuuauuguaca

SEQ ID NO: 1230882 - RNA, 19 nt, Homo sapiens
gaaaucagaucuuauuagc

SEQ ID NO: 1230883 - RNA, 19 nt, Homo sapiens
gagaacacaugcagguaaa

SEQ ID NO: 1230884 - RNA, 19 nt, Homo sapiens
gaagacuguucucauaguu

SEQ ID NO: 1230885 - RNA, 19 nt, Homo sapiens
gaucaacucuugugguaca

SEQ ID NO: 1230886 - RNA, 19 nt, Homo sapiens
gcgagaagcuguaauacca

SEQ ID NO: 1230887 - RNA, 19 nt, Homo sapiens
auacuuaccuugagucuga

SEQ ID NO: 1230888 - RNA, 19 nt, Homo sapiens
uagcucagaucuuauugua

SEQ ID NO: 1230889 - RNA, 19 nt, Homo sapiens
ggagaaaccuuauaaaagu

SEQ ID NO: 1230890 - RNA, 19 nt, Homo sapiens
ggccagaaaucagaccuua

SEQ ID NO: 1230891 - RNA, 19 nt, Homo sapiens
gggaaaggcccuacaaaug

SEQ ID NO: 1230892 - RNA, 19 nt, Homo sapiens
gcagugagagauuuaauug

SEQ ID NO: 1230893 - RNA, 19 nt, Homo sapiens
gauccacaauuacgagaaa

SEQ ID NO: 1230894 - RNA, 19 nt, Homo sapiens
gauagauggucauauauac

SEQ ID NO: 1230895 - RNA, 19 nt, Homo sapiens
gaagagaaaccacaucagu

SEQ ID NO: 1230896 - RNA, 19 nt, Homo sapiens
auaaaugccuggaauguau

SEQ ID NO: 1230897 - RNA, 19 nt, Homo sapiens
uuaaaugccuucaguguca

SEQ ID NO: 1230898 - RNA, 19 nt, Homo sapiens
gagcuacacuauaaauaca

SEQ ID NO: 1230899 - RNA, 19 nt, Homo sapiens
gugagaagccguauaaaug

SEQ ID NO: 1230900 - RNA, 19 nt, Homo sapiens
uuaguugacucauauggua

SEQ ID NO: 1230901 - RNA, 19 nt, Homo sapiens
caacucacacucacacuuu

SEQ ID NO: 1230902 - RNA, 19 nt, Homo sapiens
gggagaagcccuauaagug

SEQ ID NO: 1230903 - RNA, 19 nt, Homo sapiens
agagaggacuuuacaugaa

SEQ ID NO: 1230904 - RNA, 19 nt, Homo sapiens
cauaguuaguugacucaua

SEQ ID NO: 1230905 - RNA, 19 nt, Homo sapiens
gcaugagauuauucagaua

SEQ ID NO: 1230906 - RNA, 19 nt, Homo sapiens
ggagaagcccuauaagugu

SEQ ID NO: 1230907 - RNA, 19 nt, Homo sapiens
uuaagugucucgaguguga

SEQ ID NO: 1230908 - RNA, 19 nt, Homo sapiens
gagaaaaccuuugguagaa

SEQ ID NO: 1230909 - RNA, 19 nt, Homo sapiens
gaaauccaauaaaggaaag

SEQ ID NO: 1230910 - RNA, 19 nt, Homo sapiens
gaggaaagacugcaagugu

SEQ ID NO: 1230911 - RNA, 19 nt, Homo sapiens
gaggacaaaucucagacuu

SEQ ID NO: 1230912 - RNA, 19 nt, Homo sapiens
ucagaagccucacagaugu

SEQ ID NO: 1230913 - RNA, 19 nt, Homo sapiens
aaacagaggagcuacacua

SEQ ID NO: 1230914 - RNA, 19 nt, Homo sapiens
accagaggauccacaauua

SEQ ID NO: 1230915 - RNA, 19 nt, Homo sapiens
gcucagcccuucucguugu

SEQ ID NO: 1230916 - RNA, 19 nt, Homo sapiens
ggaaaucagaucuuauuag

SEQ ID NO: 1230917 - RNA, 19 nt, Homo sapiens
gaaugaagagugcuuguca

SEQ ID NO: 1230918 - RNA, 19 nt, Homo sapiens
gagaagcuguaauaccaau

SEQ ID NO: 1230919 - RNA, 19 nt, Homo sapiens
guagagaggacuuuacaug

SEQ ID NO: 1230920 - RNA, 19 nt, Homo sapiens
gaccagagagccugcaauu

SEQ ID NO: 1230921 - RNA, 19 nt, Homo sapiens
gagaagccauacuggugaa

SEQ ID NO: 1230922 - RNA, 19 nt, Homo sapiens
caaguuugaucacucacaa

SEQ ID NO: 1230923 - RNA, 19 nt, Homo sapiens
guucagcccuucuucaaca

SEQ ID NO: 1230924 - RNA, 19 nt, Homo sapiens
ucagggaacucacauaggu

SEQ ID NO: 1230925 - RNA, 19 nt, Homo sapiens
gcaauuggaaauaugagaa

SEQ ID NO: 1230926 - RNA, 19 nt, Homo sapiens
acaauuacgagaaaccuua

SEQ ID NO: 1230927 - RNA, 19 nt, Homo sapiens
ucagaaauccaauaaagga

SEQ ID NO: 1230928 - RNA, 19 nt, Homo sapiens
caagaggauucauacaagu

SEQ ID NO: 1230929 - RNA, 19 nt, Homo sapiens
gagcugcccuaacagaaca

SEQ ID NO: 1230930 - RNA, 19 nt, Homo sapiens
ccagagagccugcaauugg

SEQ ID NO: 1230931 - RNA, 19 nt, Homo sapiens
gaagcuguaauaccaauau

SEQ ID NO: 1230932 - RNA, 19 nt, Homo sapiens
aacuguagcucagaucuua

SEQ ID NO: 1230933 - RNA, 19 nt, Homo sapiens
gggaaaucagaucuuauua

SEQ ID NO: 1230934 - RNA, 19 nt, Homo sapiens
ggacaucagagaacacaug

SEQ ID NO: 1230935 - RNA, 19 nt, Homo sapiens
aaagugauaugugugagaa

SEQ ID NO: 1230936 - RNA, 19 nt, Homo sapiens
ugucaaugaucaacucuug

SEQ ID NO: 1230937 - RNA, 19 nt, Homo sapiens
ggugagaagccguauaaau

SEQ ID NO: 1230938 - RNA, 19 nt, Homo sapiens
caggugagaagccguauaa

SEQ ID NO: 1230939 - RNA, 19 nt, Homo sapiens
acaagaggauucauacaag

SEQ ID NO: 1230940 - RNA, 19 nt, Homo sapiens
cagagagccugcaauugga

SEQ ID NO: 1230941 - RNA, 19 nt, Homo sapiens
aagcaaaacuucugugaaa

SEQ ID NO: 1230942 - RNA, 19 nt, Homo sapiens
ugagaaaccauuuaagugu

SEQ ID NO: 1230943 - RNA, 19 nt, Homo sapiens
ugacaaaugcuucaguaga

SEQ ID NO: 1230944 - RNA, 19 nt, Homo sapiens
ugugacaaaugcuucagua

SEQ ID NO: 1230945 - RNA, 19 nt, Homo sapiens
gagagagcuuucuacuaau

SEQ ID NO: 1230946 - RNA, 19 nt, Homo sapiens
caucagacaguacacauug

SEQ ID NO: 1230947 - RNA, 19 nt, Homo sapiens
uggaauguaugagaaguuu

SEQ ID NO: 1230948 - RNA, 19 nt, Homo sapiens
ugacauuuguggcaagaau

SEQ ID NO: 1230949 - RNA, 19 nt, Homo sapiens
gcaaaugugagaagagcuu

SEQ ID NO: 1230950 - RNA, 19 nt, Homo sapiens
agugagagauuuaauugug

SEQ ID NO: 1230951 - RNA, 19 nt, Homo sapiens
agagagcuuucuacuaaug

SEQ ID NO: 1230952 - RNA, 19 nt, Homo sapiens
ggagcuacacuauaaauac

SEQ ID NO: 1230953 - RNA, 19 nt, Homo sapiens
ggugagaaaccauuuaagu

SEQ ID NO: 1230954 - RNA, 19 nt, Homo sapiens
ugacuuacccaucagagaa

SEQ ID NO: 1230955 - RNA, 19 nt, Homo sapiens
gugggaaaccuuagaaaug

SEQ ID NO: 1230956 - RNA, 19 nt, Homo sapiens
gaucuuauuguacaucaga

SEQ ID NO: 1230957 - RNA, 19 nt, Homo sapiens
guucugcagugagagauuu

SEQ ID NO: 1230958 - RNA, 19 nt, Homo sapiens
caacucuugugguacauca

SEQ ID NO: 1230959 - RNA, 19 nt, Homo sapiens
ccagaaaucagaccuuauc

SEQ ID NO: 1230960 - RNA, 19 nt, Homo sapiens
cagccuucauuguacauaa

SEQ ID NO: 1230961 - RNA, 19 nt, Homo sapiens
guagugagugugacaaaug

SEQ ID NO: 1230962 - RNA, 19 nt, Homo sapiens
uagagaggacuuuacauga

SEQ ID NO: 1230963 - RNA, 19 nt, Homo sapiens
agugggaaaucagaucuua

SEQ ID NO: 1230964 - RNA, 19 nt, Homo sapiens
uggcaucacuuagcgcuuu

SEQ ID NO: 1230965 - RNA, 19 nt, Homo sapiens
gggaaaggauguauuuauu

SEQ ID NO: 1230966 - RNA, 19 nt, Homo sapiens
gcaauacuccgucucauaa

SEQ ID NO: 1230967 - RNA, 19 nt, Homo sapiens
ggaaauaaaccuccucuau

SEQ ID NO: 1230968 - RNA, 19 nt, Homo sapiens
gaaauaaaccuccucuauc

SEQ ID NO: 1230969 - RNA, 19 nt, Homo sapiens
gcacuagccugacuuuuaa

SEQ ID NO: 1230970 - RNA, 19 nt, Homo sapiens
gaaaugcugcuauuaaaca

SEQ ID NO: 1230971 - RNA, 19 nt, Homo sapiens
gaagugcugcgcuguuuaa

SEQ ID NO: 1230972 - RNA, 19 nt, Homo sapiens
agacuuggcucagauguuu

SEQ ID NO: 1230973 - RNA, 19 nt, Homo sapiens
ccuuggagcugcugguuua

SEQ ID NO: 1230974 - RNA, 19 nt, Homo sapiens
cggaggagcucaacaagga

SEQ ID NO: 1230975 - RNA, 19 nt, Homo sapiens
ggugucauguauuguaauu

SEQ ID NO: 1230976 - RNA, 19 nt, Homo sapiens
cuagguggccuuauucuaa

SEQ ID NO: 1230977 - RNA, 19 nt, Homo sapiens
gccaaaagcugaauggaaa

SEQ ID NO: 1230978 - RNA, 19 nt, Homo sapiens
auagugggaugucugcuua

SEQ ID NO: 1230979 - RNA, 19 nt, Homo sapiens
cuaguggugucauguauug

SEQ ID NO: 1230980 - RNA, 19 nt, Homo sapiens
gcccaggaguucagaauca

SEQ ID NO: 1230981 - RNA, 19 nt, Homo sapiens
ccucaguuguccuugguua

SEQ ID NO: 1230982 - RNA, 19 nt, Homo sapiens
gcauucggauuccugauca

SEQ ID NO: 1230983 - RNA, 19 nt, Homo sapiens
uaaaccuccucuauccuuu

SEQ ID NO: 1230984 - RNA, 19 nt, Homo sapiens
aaauaaaccuccucuaucc

SEQ ID NO: 1230985 - RNA, 19 nt, Homo sapiens
ugggaugucugcuuaguug

SEQ ID NO: 1230986 - RNA, 19 nt, Homo sapiens
cuaugugucuguccacuga

SEQ ID NO: 1230987 - RNA, 19 nt, Homo sapiens
cggaaaguuuggcaucauu

SEQ ID NO: 1230988 - RNA, 19 nt, Homo sapiens
uggccgacgucuacagaua

SEQ ID NO: 1230989 - RNA, 19 nt, Homo sapiens
guggugucauguauuguaa

SEQ ID NO: 1230990 - RNA, 19 nt, Homo sapiens
cuacagccauccuccaaca

SEQ ID NO: 1230991 - RNA, 19 nt, Homo sapiens
ccaagccucuggccguaug

SEQ ID NO: 1230992 - RNA, 19 nt, Homo sapiens
caggaucucuggccucagu

SEQ ID NO: 1230993 - RNA, 19 nt, Homo sapiens
gcugugcccuggaaaguac

SEQ ID NO: 1230994 - RNA, 19 nt, Homo sapiens
guuaagaacauuccuaggu

SEQ ID NO: 1230995 - RNA, 19 nt, Homo sapiens
ggugguggcauuuaagguu

SEQ ID NO: 1230996 - RNA, 19 nt, Homo sapiens
auaaguuucuucugucugu

SEQ ID NO: 1230997 - RNA, 19 nt, Homo sapiens
uagguggccuuauucuaau

SEQ ID NO: 1230998 - RNA, 19 nt, Homo sapiens
ggcacuagccugacuuuua

SEQ ID NO: 1230999 - RNA, 19 nt, Homo sapiens
caccggagcuagggcacua

SEQ ID NO: 1231000 - RNA, 19 nt, Homo sapiens
gaagcaggaaggcccaaga

SEQ ID NO: 1231001 - RNA, 19 nt, Homo sapiens
aaaccuccucuauccuuua

SEQ ID NO: 1231002 - RNA, 19 nt, Homo sapiens
uacagauacugccguguga

SEQ ID NO: 1231003 - RNA, 19 nt, Homo sapiens
ucugagcacuguagaccaa

SEQ ID NO: 1231004 - RNA, 19 nt, Homo sapiens
caagaccuggugcuggaua

SEQ ID NO: 1231005 - RNA, 19 nt, Homo sapiens
gaaucagccugggcaacau

SEQ ID NO: 1231006 - RNA, 19 nt, Homo sapiens
ggaaaguuuggcaucauuc

SEQ ID NO: 1231007 - RNA, 19 nt, Homo sapiens
gccuaguggugucauguau

SEQ ID NO: 1231008 - RNA, 19 nt, Homo sapiens
cagccauccuccaacagaa

SEQ ID NO: 1231009 - RNA, 19 nt, Homo sapiens
ugucauguauuguaauugc

SEQ ID NO: 1231010 - RNA, 19 nt, Homo sapiens
auuccuagguggccuuauu

SEQ ID NO: 1231011 - RNA, 19 nt, Homo sapiens
ggugcuggauacuaugugu

SEQ ID NO: 1231012 - RNA, 19 nt, Homo sapiens
ccaggccaguucucugaau

SEQ ID NO: 1231013 - RNA, 19 nt, Homo sapiens
gggcauuugaacuuuguuu

SEQ ID NO: 1231014 - RNA, 19 nt, Homo sapiens
ucaguuguccuugguuauu

SEQ ID NO: 1231015 - RNA, 19 nt, Homo sapiens
uauugggcauuugaacuuu

SEQ ID NO: 1231016 - RNA, 19 nt, Homo sapiens
caguuguccuugguuauug

SEQ ID NO: 1231017 - RNA, 19 nt, Homo sapiens
auauguguaccaaguguua

SEQ ID NO: 1231018 - RNA, 19 nt, Homo sapiens
aggccacucuucccucuga

SEQ ID NO: 1231019 - RNA, 19 nt, Homo sapiens
caauacuccgucucauaaa

SEQ ID NO: 1231020 - RNA, 19 nt, Homo sapiens
gagcucaacaaggaccuaa

SEQ ID NO: 1231021 - RNA, 19 nt, Homo sapiens
cagugacccuggugaugga

SEQ ID NO: 1231022 - RNA, 19 nt, Homo sapiens
aaaggcuccugaagcuaga

SEQ ID NO: 1231023 - RNA, 19 nt, Homo sapiens
ucgaggaguuccaggaucu

SEQ ID NO: 1231024 - RNA, 19 nt, Homo sapiens
cagauacugccgugugaga

SEQ ID NO: 1231025 - RNA, 19 nt, Homo sapiens
agcaauacuccgucucaua

SEQ ID NO: 1231026 - RNA, 19 nt, Homo sapiens
gagcccaggaguucagaau

SEQ ID NO: 1231027 - RNA, 19 nt, Homo sapiens
ugucaaggccucauuugca

SEQ ID NO: 1231028 - RNA, 19 nt, Homo sapiens
gaccuggugcuggauacua

SEQ ID NO: 1231029 - RNA, 19 nt, Homo sapiens
ggauuccugaucaugcuuu

SEQ ID NO: 1231030 - RNA, 19 nt, Homo sapiens
caggccaguucucugaaug

SEQ ID NO: 1231031 - RNA, 19 nt, Homo sapiens
uuauauguguaccaagugu

SEQ ID NO: 1231032 - RNA, 19 nt, Homo sapiens
agaagugcugcgcuguuua

SEQ ID NO: 1231033 - RNA, 19 nt, Homo sapiens
ggacugcuccccucacaug

SEQ ID NO: 1231034 - RNA, 19 nt, Homo sapiens
gaaaguuuggcaucauucg

SEQ ID NO: 1231035 - RNA, 19 nt, Homo sapiens
ggccuaguggugucaugua

SEQ ID NO: 1231036 - RNA, 19 nt, Homo sapiens
ccaaaggcuccugaagcua

SEQ ID NO: 1231037 - RNA, 19 nt, Homo sapiens
gcucaacaaggaccuaaac

SEQ ID NO: 1231038 - RNA, 19 nt, Homo sapiens
aaccuccucuauccuuuau

SEQ ID NO: 1231039 - RNA, 19 nt, Homo sapiens
gauacugccgugugagagu

SEQ ID NO: 1231040 - RNA, 19 nt, Homo sapiens
agguuuggauaaagauuga

SEQ ID NO: 1231041 - RNA, 19 nt, Homo sapiens
aaucagccugggcaacaua

SEQ ID NO: 1231042 - RNA, 19 nt, Homo sapiens
ccuguaaucccaacauucu

SEQ ID NO: 1231043 - RNA, 19 nt, Homo sapiens
ggggaaaggauguauuuau

SEQ ID NO: 1231044 - RNA, 19 nt, Homo sapiens
gcagccuuuugucuauuua

SEQ ID NO: 1231045 - RNA, 19 nt, Homo sapiens
auaaaccuccucuauccuu

SEQ ID NO: 1231046 - RNA, 19 nt, Homo sapiens
gggaaauaaaccuccucua

SEQ ID NO: 1231047 - RNA, 19 nt, Homo sapiens
accaaaggcuccugaagcu

SEQ ID NO: 1231048 - RNA, 19 nt, Homo sapiens
agucucaggugaccaaagg

SEQ ID NO: 1231049 - RNA, 19 nt, Homo sapiens
uuauugggcauuugaacuu

SEQ ID NO: 1231050 - RNA, 19 nt, Homo sapiens
cuuuauagccagggacuuu

SEQ ID NO: 1231051 - RNA, 19 nt, Homo sapiens
cagguuuggauaaagauug

SEQ ID NO: 1231052 - RNA, 19 nt, Homo sapiens
uuaaggcagugugucuuuc

SEQ ID NO: 1231053 - RNA, 19 nt, Homo sapiens
uuuaaggcagugugucuuu

SEQ ID NO: 1231054 - RNA, 19 nt, Homo sapiens
ggccucaguuguccuuggu

SEQ ID NO: 1231055 - RNA, 19 nt, Homo sapiens
gcaaugcucuuccuauguu

SEQ ID NO: 1231056 - RNA, 19 nt, Homo sapiens
gcacuuagcacacaguuaa

SEQ ID NO: 1231057 - RNA, 19 nt, Homo sapiens
gaaguuuggcuuuacauua

SEQ ID NO: 1231058 - RNA, 19 nt, Homo sapiens
gaaaaccccuuaaagauaa

SEQ ID NO: 1231059 - RNA, 19 nt, Homo sapiens
acaaauggcuuuacuuaug

SEQ ID NO: 1231060 - RNA, 19 nt, Homo sapiens
ggauaacucuacaauaaug

SEQ ID NO: 1231061 - RNA, 19 nt, Homo sapiens
cuggauaacucuacaauaa

SEQ ID NO: 1231062 - RNA, 19 nt, Homo sapiens
aagagcaacuuaugcauua

SEQ ID NO: 1231063 - RNA, 19 nt, Homo sapiens
ccacaaauggcuuuacuua

SEQ ID NO: 1231064 - RNA, 19 nt, Homo sapiens
gaaucaaugggaaguauua

SEQ ID NO: 1231065 - RNA, 19 nt, Homo sapiens
uagauaugaugcccaaaua

SEQ ID NO: 1231066 - RNA, 19 nt, Homo sapiens
uagaguagguccugaaguu

SEQ ID NO: 1231067 - RNA, 19 nt, Homo sapiens
gaaaucauccggccuuuua

SEQ ID NO: 1231068 - RNA, 19 nt, Homo sapiens
gcagauuugugguuaccua

SEQ ID NO: 1231069 - RNA, 19 nt, Homo sapiens
guacccaccugauguaaau

SEQ ID NO: 1231070 - RNA, 19 nt, Homo sapiens
guauuuagacucuggauaa

SEQ ID NO: 1231071 - RNA, 19 nt, Homo sapiens
caaaugcgcucagcuucaa

SEQ ID NO: 1231072 - RNA, 19 nt, Homo sapiens
ugaaggaacucagauugaa

SEQ ID NO: 1231073 - RNA, 19 nt, Homo sapiens
cuagagacauggaaaugaa

SEQ ID NO: 1231074 - RNA, 19 nt, Homo sapiens
gcucaucacaucagaauug

SEQ ID NO: 1231075 - RNA, 19 nt, Homo sapiens
gcauugggacccuagaaua

SEQ ID NO: 1231076 - RNA, 19 nt, Homo sapiens
ggaaagagcaacuuaugca

SEQ ID NO: 1231077 - RNA, 19 nt, Homo sapiens
ugggauaucuauugaagaa

SEQ ID NO: 1231078 - RNA, 19 nt, Homo sapiens
caaauggcuuuacuuaugg

SEQ ID NO: 1231079 - RNA, 19 nt, Homo sapiens
gauugcuucucaguuauua

SEQ ID NO: 1231080 - RNA, 19 nt, Homo sapiens
gaauugggcuagccuaaaa

SEQ ID NO: 1231081 - RNA, 19 nt, Homo sapiens
ggaaucauccaguguuaga

SEQ ID NO: 1231082 - RNA, 19 nt, Homo sapiens
ccagcugccuguuucuuaa

SEQ ID NO: 1231083 - RNA, 19 nt, Homo sapiens
gaaggaacucagauugaaa

SEQ ID NO: 1231084 - RNA, 19 nt, Homo sapiens
gucauuagguugucuuuua

SEQ ID NO: 1231085 - RNA, 19 nt, Homo sapiens
cuagaauagccaagaauua

SEQ ID NO: 1231086 - RNA, 19 nt, Homo sapiens
uagauuaccguccucauaa

SEQ ID NO: 1231087 - RNA, 19 nt, Homo sapiens
ucaaugggaaguauuauga

SEQ ID NO: 1231088 - RNA, 19 nt, Homo sapiens
gcgcucagcuucaauuggu

SEQ ID NO: 1231089 - RNA, 19 nt, Homo sapiens
ccaaauaaauaggauugug

SEQ ID NO: 1231090 - RNA, 19 nt, Homo sapiens
uaugauggacuguuuauug

SEQ ID NO: 1231091 - RNA, 19 nt, Homo sapiens
guuuagcacuguaucagaa

SEQ ID NO: 1231092 - RNA, 19 nt, Homo sapiens
gauaaaugcuuguguuacc

SEQ ID NO: 1231093 - RNA, 19 nt, Homo sapiens
cacaauaccacaugagaaa

SEQ ID NO: 1231094 - RNA, 19 nt, Homo sapiens
caccugauguaaaugauga

SEQ ID NO: 1231095 - RNA, 19 nt, Homo sapiens
ggcccaggauacauagaua

SEQ ID NO: 1231096 - RNA, 19 nt, Homo sapiens
guccugaaguuuggcuuua

SEQ ID NO: 1231097 - RNA, 19 nt, Homo sapiens
aaccugaaauggcuuuaaa

SEQ ID NO: 1231098 - RNA, 19 nt, Homo sapiens
cauccuagacccaaauaaa

SEQ ID NO: 1231099 - RNA, 19 nt, Homo sapiens
gacacaacccuccagauga

SEQ ID NO: 1231100 - RNA, 19 nt, Homo sapiens
gaauugggaaguuacaguu

SEQ ID NO: 1231101 - RNA, 19 nt, Homo sapiens
uaguauaucuugucgaucu

SEQ ID NO: 1231102 - RNA, 19 nt, Homo sapiens
gacauuggcuccagcuuuu

SEQ ID NO: 1231103 - RNA, 19 nt, Homo sapiens
guuuaguguuucugcuuua

SEQ ID NO: 1231104 - RNA, 19 nt, Homo sapiens
gaaccugaaauggcuuuaa

SEQ ID NO: 1231105 - RNA, 19 nt, Homo sapiens
cuagauuaccguccucaua

SEQ ID NO: 1231106 - RNA, 19 nt, Homo sapiens
gagaaccuacugauaacuu

SEQ ID NO: 1231107 - RNA, 19 nt, Homo sapiens
guagauaugaugcccaaau

SEQ ID NO: 1231108 - RNA, 19 nt, Homo sapiens
gcuuuacagugcugaauuc

SEQ ID NO: 1231109 - RNA, 19 nt, Homo sapiens
gaguagguccugaaguuug

SEQ ID NO: 1231110 - RNA, 19 nt, Homo sapiens
uuacagugcugaauuccau

SEQ ID NO: 1231111 - RNA, 19 nt, Homo sapiens
uaggaaggccugcuaucua

SEQ ID NO: 1231112 - RNA, 19 nt, Homo sapiens
gccagcugccuguuucuua

SEQ ID NO: 1231113 - RNA, 19 nt, Homo sapiens
gcaugaaggaacucagauu

SEQ ID NO: 1231114 - RNA, 19 nt, Homo sapiens
ggaaguauuaugaaauugg

SEQ ID NO: 1231115 - RNA, 19 nt, Homo sapiens
ugacauuggcuccagcuuu

SEQ ID NO: 1231116 - RNA, 19 nt, Homo sapiens
gauuugugguuaccuauac

SEQ ID NO: 1231117 - RNA, 19 nt, Homo sapiens
ccugaaauggcuuuaaauu

SEQ ID NO: 1231118 - RNA, 19 nt, Homo sapiens
aaaaugggccaaucuguua

SEQ ID NO: 1231119 - RNA, 19 nt, Homo sapiens
aaagagcaacuuaugcauu

SEQ ID NO: 1231120 - RNA, 19 nt, Homo sapiens
ccauauagcaaucgagaug

SEQ ID NO: 1231121 - RNA, 19 nt, Homo sapiens
uacuagcccucucuuggua

SEQ ID NO: 1231122 - RNA, 19 nt, Homo sapiens
ggcuuuacauuaaguuuag

SEQ ID NO: 1231123 - RNA, 19 nt, Homo sapiens
gaccaaauuguguuaggaa

SEQ ID NO: 1231124 - RNA, 19 nt, Homo sapiens
aggauuguguguauauuug

SEQ ID NO: 1231125 - RNA, 19 nt, Homo sapiens
agacacaacccuccagaug

SEQ ID NO: 1231126 - RNA, 19 nt, Homo sapiens
gaaagagcaacuuaugcau

SEQ ID NO: 1231127 - RNA, 19 nt, Homo sapiens
uggcaaugcucuuccuaug

SEQ ID NO: 1231128 - RNA, 19 nt, Homo sapiens
caaauugaucacuugugua

SEQ ID NO: 1231129 - RNA, 19 nt, Homo sapiens
uauuacaguugguauggaa

SEQ ID NO: 1231130 - RNA, 19 nt, Homo sapiens
agaaaaccccuuaaagaua

SEQ ID NO: 1231131 - RNA, 19 nt, Homo sapiens
aaagaaaaccccuuaaaga

SEQ ID NO: 1231132 - RNA, 19 nt, Homo sapiens
ucgggauccuucugucaua

SEQ ID NO: 1231133 - RNA, 19 nt, Homo sapiens
gaucgccagcugccuguuu

SEQ ID NO: 1231134 - RNA, 19 nt, Homo sapiens
ccucauaaaccaggucuuu

SEQ ID NO: 1231135 - RNA, 19 nt, Homo sapiens
gagaaaauaucugagacaa

SEQ ID NO: 1231136 - RNA, 19 nt, Homo sapiens
gagcaacuuaugcauuaga

SEQ ID NO: 1231137 - RNA, 19 nt, Homo sapiens
gggaaguauuaugaaauug

SEQ ID NO: 1231138 - RNA, 19 nt, Homo sapiens
ccgaaucaaugggaaguau

SEQ ID NO: 1231139 - RNA, 19 nt, Homo sapiens
uauauuaccaagccugaaa

SEQ ID NO: 1231140 - RNA, 19 nt, Homo sapiens
cauagaaccauauagcaau

SEQ ID NO: 1231141 - RNA, 19 nt, Homo sapiens
ucuugucgaucuuuaaguu

SEQ ID NO: 1231142 - RNA, 19 nt, Homo sapiens
guaccuuccucucaauuuu

SEQ ID NO: 1231143 - RNA, 19 nt, Homo sapiens
cugauuugauggcaauuga

SEQ ID NO: 1231144 - RNA, 19 nt, Homo sapiens
agauuaccguccucauaaa

SEQ ID NO: 1231145 - RNA, 19 nt, Homo sapiens
caugaaggaacucagauug

SEQ ID NO: 1231146 - RNA, 19 nt, Homo sapiens
auggagaaccuacugauaa

SEQ ID NO: 1231147 - RNA, 19 nt, Homo sapiens
agugcugaauuccauauuu

SEQ ID NO: 1231148 - RNA, 19 nt, Homo sapiens
uccuagacccaaauaaaua

SEQ ID NO: 1231149 - RNA, 19 nt, Homo sapiens
gccaagaauuauccacaag

SEQ ID NO: 1231150 - RNA, 19 nt, Homo sapiens
agacaaaugcgcucagcuu

SEQ ID NO: 1231151 - RNA, 19 nt, Homo sapiens
guuuauugcccuucuggua

SEQ ID NO: 1231152 - RNA, 19 nt, Homo sapiens
caauucuccuuaugaugga

SEQ ID NO: 1231153 - RNA, 19 nt, Homo sapiens
agaaccuacugauaacuug

SEQ ID NO: 1231154 - RNA, 19 nt, Homo sapiens
acacaacccuccagaugac

SEQ ID NO: 1231155 - RNA, 19 nt, Homo sapiens
gcaaagagaagaaauauga

SEQ ID NO: 1231156 - RNA, 19 nt, Homo sapiens
gcaggaggauggaucuuua

SEQ ID NO: 1231157 - RNA, 19 nt, Homo sapiens
gggacaagcuccaguguaa

SEQ ID NO: 1231158 - RNA, 19 nt, Homo sapiens
ggacaggccuggcuucuuc

SEQ ID NO: 1231159 - RNA, 19 nt, Homo sapiens
caggacaucuguuaucaua

SEQ ID NO: 1231160 - RNA, 19 nt, Homo sapiens
gaggauggaucuuuauuuc

SEQ ID NO: 1231161 - RNA, 19 nt, Homo sapiens
uuaaagagcucuacuacca

SEQ ID NO: 1231162 - RNA, 19 nt, Homo sapiens
caucaggucuccaacaaug

SEQ ID NO: 1231163 - RNA, 19 nt, Homo sapiens
ucaaagagcgcauguuaug

SEQ ID NO: 1231164 - RNA, 19 nt, Homo sapiens
acaaaggacuaacagacua

SEQ ID NO: 1231165 - RNA, 19 nt, Homo sapiens
ggaagcagcuccgggacaa

SEQ ID NO: 1231166 - RNA, 19 nt, Homo sapiens
gaagugauccuuguagaug

SEQ ID NO: 1231167 - RNA, 19 nt, Homo sapiens
ggacaucuguuaucauagc

SEQ ID NO: 1231168 - RNA, 19 nt, Homo sapiens
ggaacccgcugugcaaaga

SEQ ID NO: 1231169 - RNA, 19 nt, Homo sapiens
ggaggauggaucuuuauuu

SEQ ID NO: 1231170 - RNA, 19 nt, Homo sapiens
caguuucguuccacucuua

SEQ ID NO: 1231171 - RNA, 19 nt, Homo sapiens
cuucaaagagcgcauguua

SEQ ID NO: 1231172 - RNA, 19 nt, Homo sapiens
gcaggaauggauacccuua

SEQ ID NO: 1231173 - RNA, 19 nt, Homo sapiens
gacaccaggucauucugua

SEQ ID NO: 1231174 - RNA, 19 nt, Homo sapiens
uagaagaagugauccuugu

SEQ ID NO: 1231175 - RNA, 19 nt, Homo sapiens
gaagaagugauccuuguag

SEQ ID NO: 1231176 - RNA, 19 nt, Homo sapiens
ggauggaucuuuauuucac

SEQ ID NO: 1231177 - RNA, 19 nt, Homo sapiens
aaguauggauggaugaauu

SEQ ID NO: 1231178 - RNA, 19 nt, Homo sapiens
cuauaacccucccgaugaa

SEQ ID NO: 1231179 - RNA, 19 nt, Homo sapiens
auacaggaauggaaguuug

SEQ ID NO: 1231180 - RNA, 19 nt, Homo sapiens
cagaaagaaauacgcuaua

SEQ ID NO: 1231181 - RNA, 19 nt, Homo sapiens
gaacaguccaagaaaugug

SEQ ID NO: 1231182 - RNA, 19 nt, Homo sapiens
ggagucgagugacaguuuc

SEQ ID NO: 1231183 - RNA, 19 nt, Homo sapiens
gaaagaaauacgcuauaac

SEQ ID NO: 1231184 - RNA, 19 nt, Homo sapiens
guacacgucccagaaagaa

SEQ ID NO: 1231185 - RNA, 19 nt, Homo sapiens
caucuguuaucauagcauu

SEQ ID NO: 1231186 - RNA, 19 nt, Homo sapiens
ucacgaacaguccaagaaa

SEQ ID NO: 1231187 - RNA, 19 nt, Homo sapiens
gagaggauacggaugcaau

SEQ ID NO: 1231188 - RNA, 19 nt, Homo sapiens
cgaggaaggagucgaguga

SEQ ID NO: 1231189 - RNA, 19 nt, Homo sapiens
gaucuuuauuucacgaaca

SEQ ID NO: 1231190 - RNA, 19 nt, Homo sapiens
gacuacugcuuugacuaua

SEQ ID NO: 1231191 - RNA, 19 nt, Homo sapiens
ggauggaugaauuuaaaga

SEQ ID NO: 1231192 - RNA, 19 nt, Homo sapiens
gucaucaggucuccaacaa

SEQ ID NO: 1231193 - RNA, 19 nt, Homo sapiens
ccagaaagaaauacgcuau

SEQ ID NO: 1231194 - RNA, 19 nt, Homo sapiens
gggcugcauugcuguggaa

SEQ ID NO: 1231195 - RNA, 19 nt, Homo sapiens
cuaacagacuacugcuuug

SEQ ID NO: 1231196 - RNA, 19 nt, Homo sapiens
caaagagcgcauguuauga

SEQ ID NO: 1231197 - RNA, 19 nt, Homo sapiens
gaguacacgucccagaaag

SEQ ID NO: 1231198 - RNA, 19 nt, Homo sapiens
aagaagugauccuuguaga

SEQ ID NO: 1231199 - RNA, 19 nt, Homo sapiens
cggauauccugcuagaaga

SEQ ID NO: 1231200 - RNA, 19 nt, Homo sapiens
gaaucagaaguucaucuug

SEQ ID NO: 1231201 - RNA, 19 nt, Homo sapiens
uaacagacuacugcuuuga

SEQ ID NO: 1231202 - RNA, 19 nt, Homo sapiens
gacaagcuccaguguaaag

SEQ ID NO: 1231203 - RNA, 19 nt, Homo sapiens
ggacaagcuccaguguaaa

SEQ ID NO: 1231204 - RNA, 19 nt, Homo sapiens
gauacaggaauggaaguuu

SEQ ID NO: 1231205 - RNA, 19 nt, Homo sapiens
cgaguacacgucccagaaa

SEQ ID NO: 1231206 - RNA, 19 nt, Homo sapiens
ggacaccaggucauucugu

SEQ ID NO: 1231207 - RNA, 19 nt, Homo sapiens
gugcaaagagaagaaauau

SEQ ID NO: 1231208 - RNA, 19 nt, Homo sapiens
acuaacagacuacugcuuu

SEQ ID NO: 1231209 - RNA, 19 nt, Homo sapiens
cacgaacaguccaagaaau

SEQ ID NO: 1231210 - RNA, 19 nt, Homo sapiens
acuauaacccucccgauga

SEQ ID NO: 1231211 - RNA, 19 nt, Homo sapiens
acuacugcuuugacuauaa

SEQ ID NO: 1231212 - RNA, 19 nt, Homo sapiens
uugaauaucuggggucuua

SEQ ID NO: 1231213 - RNA, 19 nt, Homo sapiens
auagagagcaccugaagga

SEQ ID NO: 1231214 - RNA, 19 nt, Homo sapiens
ggauauccugcuagaagaa

SEQ ID NO: 1231215 - RNA, 19 nt, Homo sapiens
ggaugggccagaaucaguu

SEQ ID NO: 1231216 - RNA, 19 nt, Homo sapiens
agacuacugcuuugacuau

SEQ ID NO: 1231217 - RNA, 19 nt, Homo sapiens
gcuccaguguaaagacuuc

SEQ ID NO: 1231218 - RNA, 19 nt, Homo sapiens
guauggauggaugaauuua

SEQ ID NO: 1231219 - RNA, 19 nt, Homo sapiens
ggugggcuguuugcuguga

SEQ ID NO: 1231220 - RNA, 19 nt, Homo sapiens
aaggagcgcuuggccaaug

SEQ ID NO: 1231221 - RNA, 19 nt, Homo sapiens
gaaggagucgagugacagu

SEQ ID NO: 1231222 - RNA, 19 nt, Homo sapiens
gcuggaacccgcugugcaa

SEQ ID NO: 1231223 - RNA, 19 nt, Homo sapiens
agaagaagugauccuugua

SEQ ID NO: 1231224 - RNA, 19 nt, Homo sapiens
acaaggcucuggccaacag

SEQ ID NO: 1231225 - RNA, 19 nt, Homo sapiens
ggucuuaugauacaggaau

SEQ ID NO: 1231226 - RNA, 19 nt, Homo sapiens
gcugugaguaagaaauauu

SEQ ID NO: 1231227 - RNA, 19 nt, Homo sapiens
ugcagaggauccaugaaga

SEQ ID NO: 1231228 - RNA, 19 nt, Homo sapiens
gcgcuuggccaaugagcuu

SEQ ID NO: 1231229 - RNA, 19 nt, Homo sapiens
uuacgagacugcaccaacu

SEQ ID NO: 1231230 - RNA, 19 nt, Homo sapiens
aaugaagccuggucaacuc

SEQ ID NO: 1231231 - RNA, 19 nt, Homo sapiens
gcagaggauccaugaagag

SEQ ID NO: 1231232 - RNA, 19 nt, Homo sapiens
augcaucucugcgaagaaa

SEQ ID NO: 1231233 - RNA, 19 nt, Homo sapiens
ucaugcaucucugcgaaga

SEQ ID NO: 1231234 - RNA, 19 nt, Homo sapiens
gaugggccagaaucaguuu

SEQ ID NO: 1231235 - RNA, 19 nt, Homo sapiens
cccaggacaucuguuauca

SEQ ID NO: 1231236 - RNA, 19 nt, Homo sapiens
ccagaacaaaggacuaaca

SEQ ID NO: 1231237 - RNA, 19 nt, Homo sapiens
gaugugaucgacuggaaca

SEQ ID NO: 1231238 - RNA, 19 nt, Homo sapiens
aagugauccuuguagauga

SEQ ID NO: 1231239 - RNA, 19 nt, Homo sapiens
gggaugggccagaaucagu

SEQ ID NO: 1231240 - RNA, 19 nt, Homo sapiens
ucgggaugcuccagaacaa

SEQ ID NO: 1231241 - RNA, 19 nt, Homo sapiens
gaaguauggauggaugaau

SEQ ID NO: 1231242 - RNA, 19 nt, Homo sapiens
acuggaacaccuucgaaua

SEQ ID NO: 1231243 - RNA, 19 nt, Homo sapiens
cagagaaucagaaguucau

SEQ ID NO: 1231244 - RNA, 19 nt, Homo sapiens
ccggauauccugcuagaag

SEQ ID NO: 1231245 - RNA, 19 nt, Homo sapiens
ugugcaaagagaagaaaua

SEQ ID NO: 1231246 - RNA, 19 nt, Homo sapiens
ucgugcagcugaaguaugg

SEQ ID NO: 1231247 - RNA, 19 nt, Homo sapiens
ccucagcgaccgcaucuca

SEQ ID NO: 1231248 - RNA, 19 nt, Homo sapiens
guggaagcaggaauggaua

SEQ ID NO: 1231249 - RNA, 19 nt, Homo sapiens
gacuguguauccagaacug

SEQ ID NO: 1231250 - RNA, 19 nt, Homo sapiens
cagcugaaguauggaugga

SEQ ID NO: 1231251 - RNA, 19 nt, Homo sapiens
caacucuccuucggacagu

SEQ ID NO: 1231252 - RNA, 19 nt, Homo sapiens
ggaacaccuucgaauaccu

SEQ ID NO: 1231253 - RNA, 19 nt, Homo sapiens
gcuagaagaagugauccuu

SEQ ID NO: 1231254 - RNA, 19 nt, Homo sapiens
agaaucagaaguucaucuu

SEQ ID NO: 1231255 - RNA, 19 nt, Homo sapiens
gcacagaacuagagcagua

SEQ ID NO: 1231256 - RNA, 19 nt, Homo sapiens
gauagaagcaugaaucuuu

SEQ ID NO: 1231257 - RNA, 19 nt, Homo sapiens
ccaaggaaaugguuuguuu

SEQ ID NO: 1231258 - RNA, 19 nt, Homo sapiens
agacaacaauggaaacuuu

SEQ ID NO: 1231259 - RNA, 19 nt, Homo sapiens
ggagagaggaugaaacuug

SEQ ID NO: 1231260 - RNA, 19 nt, Homo sapiens
uaaggaagcauuauaguug

SEQ ID NO: 1231261 - RNA, 19 nt, Homo sapiens
gcugguaugcuuuauguua

SEQ ID NO: 1231262 - RNA, 19 nt, Homo sapiens
gcaccagacuccucagguu

SEQ ID NO: 1231263 - RNA, 19 nt, Homo sapiens
ucaaacagcucccagaucu

SEQ ID NO: 1231264 - RNA, 19 nt, Homo sapiens
ggucaggucugggaaacua

SEQ ID NO: 1231265 - RNA, 19 nt, Homo sapiens
ccaguucucugauuauaga

SEQ ID NO: 1231266 - RNA, 19 nt, Homo sapiens
gaacugucauccaccucua

SEQ ID NO: 1231267 - RNA, 19 nt, Homo sapiens
gagcagaguuaaagguaau

SEQ ID NO: 1231268 - RNA, 19 nt, Homo sapiens
ggagcagaguuaaagguaa

SEQ ID NO: 1231269 - RNA, 19 nt, Homo sapiens
ugaagacacugaagaguca

SEQ ID NO: 1231270 - RNA, 19 nt, Homo sapiens
gagagacacuccaacaucu

SEQ ID NO: 1231271 - RNA, 19 nt, Homo sapiens
ggagauagaagcaugaauc

SEQ ID NO: 1231272 - RNA, 19 nt, Homo sapiens
gaggaagaauuuaguagag

SEQ ID NO: 1231273 - RNA, 19 nt, Homo sapiens
gggcugguaugcuuuaugu

SEQ ID NO: 1231274 - RNA, 19 nt, Homo sapiens
guaagaccaucaagaacug

SEQ ID NO: 1231275 - RNA, 19 nt, Homo sapiens
gagcagacaacaauggaaa

SEQ ID NO: 1231276 - RNA, 19 nt, Homo sapiens
gaacuagagcaguacuuga

SEQ ID NO: 1231277 - RNA, 19 nt, Homo sapiens
gcaaauuccucucguucag

SEQ ID NO: 1231278 - RNA, 19 nt, Homo sapiens
cacaggaagucgugcagua

SEQ ID NO: 1231279 - RNA, 19 nt, Homo sapiens
aaacggagagcuacagaaa

SEQ ID NO: 1231280 - RNA, 19 nt, Homo sapiens
ccagcaagauccagaaagu

SEQ ID NO: 1231281 - RNA, 19 nt, Homo sapiens
aagaguugauucuggauaa

SEQ ID NO: 1231282 - RNA, 19 nt, Homo sapiens
ggaaucagccagcaagauc

SEQ ID NO: 1231283 - RNA, 19 nt, Homo sapiens
gaggagagagccacugcua

SEQ ID NO: 1231284 - RNA, 19 nt, Homo sapiens
guuauugcccucagaauug

SEQ ID NO: 1231285 - RNA, 19 nt, Homo sapiens
ggagagagccacugcuaag

SEQ ID NO: 1231286 - RNA, 19 nt, Homo sapiens
ggaguagaauuugaugcaa

SEQ ID NO: 1231287 - RNA, 19 nt, Homo sapiens
uggaaacuguucacacuug

SEQ ID NO: 1231288 - RNA, 19 nt, Homo sapiens
ucuaggaacuuugguguga

SEQ ID NO: 1231289 - RNA, 19 nt, Homo sapiens
gccaauaaccaggacuuua

SEQ ID NO: 1231290 - RNA, 19 nt, Homo sapiens
uggauaaagucuauacuca

SEQ ID NO: 1231291 - RNA, 19 nt, Homo sapiens
cauuccaguucucugauua

SEQ ID NO: 1231292 - RNA, 19 nt, Homo sapiens
ggagagcuacagaaaauua

SEQ ID NO: 1231293 - RNA, 19 nt, Homo sapiens
gcaguaaaugggaguagaa

SEQ ID NO: 1231294 - RNA, 19 nt, Homo sapiens
gguggaaacuguucacacu

SEQ ID NO: 1231295 - RNA, 19 nt, Homo sapiens
aagagcaacuggagauaga

SEQ ID NO: 1231296 - RNA, 19 nt, Homo sapiens
gaggaaauccgaagaaagc

SEQ ID NO: 1231297 - RNA, 19 nt, Homo sapiens
gugcagauccgaagacuag

SEQ ID NO: 1231298 - RNA, 19 nt, Homo sapiens
ugccaaagguggaaacugu

SEQ ID NO: 1231299 - RNA, 19 nt, Homo sapiens
agccaucgguggagaaauu

SEQ ID NO: 1231300 - RNA, 19 nt, Homo sapiens
gaaggccguggcaaacuuu

SEQ ID NO: 1231301 - RNA, 19 nt, Homo sapiens
gaggaaccagggcaacuuu

SEQ ID NO: 1231302 - RNA, 19 nt, Homo sapiens
gauucuggauaaagucuau

SEQ ID NO: 1231303 - RNA, 19 nt, Homo sapiens
aaggaagcauuauaguuga

SEQ ID NO: 1231304 - RNA, 19 nt, Homo sapiens
gaagagcaacuggagauag

SEQ ID NO: 1231305 - RNA, 19 nt, Homo sapiens
gguaugcuuuauguuauug

SEQ ID NO: 1231306 - RNA, 19 nt, Homo sapiens
gagcaacacauucccaagu

SEQ ID NO: 1231307 - RNA, 19 nt, Homo sapiens
cagaauugaugggugaaga

SEQ ID NO: 1231308 - RNA, 19 nt, Homo sapiens
ccagcuucccacuaaauua

SEQ ID NO: 1231309 - RNA, 19 nt, Homo sapiens
gcagaaagaaaucaaacag

SEQ ID NO: 1231310 - RNA, 19 nt, Homo sapiens
cuaaggaagcauuauaguu

SEQ ID NO: 1231311 - RNA, 19 nt, Homo sapiens
ccucuaaggaagcauuaua

SEQ ID NO: 1231312 - RNA, 19 nt, Homo sapiens
cgagagguccagcagguaa

SEQ ID NO: 1231313 - RNA, 19 nt, Homo sapiens
gaggaggaacucagaagga

SEQ ID NO: 1231314 - RNA, 19 nt, Homo sapiens
gaggaggaaauccgaagaa

SEQ ID NO: 1231315 - RNA, 19 nt, Homo sapiens
gcagauccgaagacuagaa

SEQ ID NO: 1231316 - RNA, 19 nt, Homo sapiens
gguagcaagcaauaauaaa

SEQ ID NO: 1231317 - RNA, 19 nt, Homo sapiens
ugaguuugaggaagaauuu

SEQ ID NO: 1231318 - RNA, 19 nt, Homo sapiens
agaaggccguggcaaacuu

SEQ ID NO: 1231319 - RNA, 19 nt, Homo sapiens
caagauccagaaagugauu

SEQ ID NO: 1231320 - RNA, 19 nt, Homo sapiens
gcaaagcagaaagaaauca

SEQ ID NO: 1231321 - RNA, 19 nt, Homo sapiens
gagcuuagaggaggaaauc

SEQ ID NO: 1231322 - RNA, 19 nt, Homo sapiens
ggaaaugguuuguuuuacu

SEQ ID NO: 1231323 - RNA, 19 nt, Homo sapiens
caaagcagaaagaaaucaa

SEQ ID NO: 1231324 - RNA, 19 nt, Homo sapiens
gaugcaaagcagaaagaaa

SEQ ID NO: 1231325 - RNA, 19 nt, Homo sapiens
ccaagaggaaaguguuuga

SEQ ID NO: 1231326 - RNA, 19 nt, Homo sapiens
ccauuccaguucucugauu

SEQ ID NO: 1231327 - RNA, 19 nt, Homo sapiens
caaauggaacacccaaaca

SEQ ID NO: 1231328 - RNA, 19 nt, Homo sapiens
gcaugaaucuuuuauccau

SEQ ID NO: 1231329 - RNA, 19 nt, Homo sapiens
cagaagagcaacuggagau

SEQ ID NO: 1231330 - RNA, 19 nt, Homo sapiens
gcagaguuaaagguaauaa

SEQ ID NO: 1231331 - RNA, 19 nt, Homo sapiens
agaaggauccagacgcaaa

SEQ ID NO: 1231332 - RNA, 19 nt, Homo sapiens
cgagagaguuuucaucuag

SEQ ID NO: 1231333 - RNA, 19 nt, Homo sapiens
gaaauuccagccuguccau

SEQ ID NO: 1231334 - RNA, 19 nt, Homo sapiens
gcugguagcaagcaauaau

SEQ ID NO: 1231335 - RNA, 19 nt, Homo sapiens
ugaggaagaauuuaguaga

SEQ ID NO: 1231336 - RNA, 19 nt, Homo sapiens
aauuugaguuugaggaaga

SEQ ID NO: 1231337 - RNA, 19 nt, Homo sapiens
gcaacaccauguacaaacc

SEQ ID NO: 1231338 - RNA, 19 nt, Homo sapiens
ggaggaaauccgaagaaag

SEQ ID NO: 1231339 - RNA, 19 nt, Homo sapiens
ggacggagugggugcagau

SEQ ID NO: 1231340 - RNA, 19 nt, Homo sapiens
gaaaugguuuguuuuacuc

SEQ ID NO: 1231341 - RNA, 19 nt, Homo sapiens
uuacaaccuugggcuggua

SEQ ID NO: 1231342 - RNA, 19 nt, Homo sapiens
gcuaagggcacagaacuag

SEQ ID NO: 1231343 - RNA, 19 nt, Homo sapiens
cugguaugcuuuauguuau

SEQ ID NO: 1231344 - RNA, 19 nt, Homo sapiens
aaauggaacacccaaacaa

SEQ ID NO: 1231345 - RNA, 19 nt, Homo sapiens
gggaguagaauuugaugca

SEQ ID NO: 1231346 - RNA, 19 nt, Homo sapiens
caagguggcugagcaacac

SEQ ID NO: 1231347 - RNA, 19 nt, Homo sapiens
ggagaaggccguggcaaac

SEQ ID NO: 1231348 - RNA, 19 nt, Homo sapiens
ggaggucaggucugggaaa

SEQ ID NO: 1231349 - RNA, 19 nt, Homo sapiens
gaagaauuuaguagagaca

SEQ ID NO: 1231350 - RNA, 19 nt, Homo sapiens
gacagaggaggaacucaga

SEQ ID NO: 1231351 - RNA, 19 nt, Homo sapiens
aggaggaaauccgaagaaa

SEQ ID NO: 1231352 - RNA, 19 nt, Homo sapiens
aaagaguugauucuggaua

SEQ ID NO: 1231353 - RNA, 19 nt, Homo sapiens
uuauugcccucagaauuga

SEQ ID NO: 1231354 - RNA, 19 nt, Homo sapiens
cauuauaguugagcagaca

SEQ ID NO: 1231355 - RNA, 19 nt, Homo sapiens
gaagaaccaucucaucuag

SEQ ID NO: 1231356 - RNA, 19 nt, Homo sapiens
gaaagcagcugcgaagugu

SEQ ID NO: 1231357 - RNA, 19 nt, Homo sapiens
ggaagaaccaucucaucua

SEQ ID NO: 1231358 - RNA, 19 nt, Homo sapiens
gccauuuguuucucuauua

SEQ ID NO: 1231359 - RNA, 19 nt, Homo sapiens
gcuggaaccuggagauuug

SEQ ID NO: 1231360 - RNA, 19 nt, Homo sapiens
gaauuuggaucuuucaucu

SEQ ID NO: 1231361 - RNA, 19 nt, Homo sapiens
gugcucacauuuaccuuua

SEQ ID NO: 1231362 - RNA, 19 nt, Homo sapiens
gucaguauccuguuuguua

SEQ ID NO: 1231363 - RNA, 19 nt, Homo sapiens
aaacaaggcaguagugauu

SEQ ID NO: 1231364 - RNA, 19 nt, Homo sapiens
gaaccgcuuucauggagaa

SEQ ID NO: 1231365 - RNA, 19 nt, Homo sapiens
gcgaagaaccgcuuucaug

SEQ ID NO: 1231366 - RNA, 19 nt, Homo sapiens
gcauucagauucuaaggau

SEQ ID NO: 1231367 - RNA, 19 nt, Homo sapiens
gcaagcugaugccauggaa

SEQ ID NO: 1231368 - RNA, 19 nt, Homo sapiens
ggaagaaaauguggaguuu

SEQ ID NO: 1231369 - RNA, 19 nt, Homo sapiens
gcaccaacuucaucaccuu

SEQ ID NO: 1231370 - RNA, 19 nt, Homo sapiens
gaagaaccgcuuucaugga

SEQ ID NO: 1231371 - RNA, 19 nt, Homo sapiens
cccgagacuucauggauua

SEQ ID NO: 1231372 - RNA, 19 nt, Homo sapiens
cuggagauuugcuguauuu

SEQ ID NO: 1231373 - RNA, 19 nt, Homo sapiens
gugcaccgcgcaacacuua

SEQ ID NO: 1231374 - RNA, 19 nt, Homo sapiens
aaacucacguucuuaccuu

SEQ ID NO: 1231375 - RNA, 19 nt, Homo sapiens
aaacagaaguccauaugcu

SEQ ID NO: 1231376 - RNA, 19 nt, Homo sapiens
uuaaagugccaaagaauga

SEQ ID NO: 1231377 - RNA, 19 nt, Homo sapiens
aggaaacucuggcguguau

SEQ ID NO: 1231378 - RNA, 19 nt, Homo sapiens
caucucaucuagguacaaa

SEQ ID NO: 1231379 - RNA, 19 nt, Homo sapiens
ggaaacaaggcaguaguga

SEQ ID NO: 1231380 - RNA, 19 nt, Homo sapiens
gcaacgaggaggugcaguu

SEQ ID NO: 1231381 - RNA, 19 nt, Homo sapiens
ucaguauccuguuuguuau

SEQ ID NO: 1231382 - RNA, 19 nt, Homo sapiens
gaaacaaggcaguagugau

SEQ ID NO: 1231383 - RNA, 19 nt, Homo sapiens
ggaaaacucccguguguau

SEQ ID NO: 1231384 - RNA, 19 nt, Homo sapiens
ggccauuuguuucucuauu

SEQ ID NO: 1231385 - RNA, 19 nt, Homo sapiens
ccgcaggcuuucucuacua

SEQ ID NO: 1231386 - RNA, 19 nt, Homo sapiens
guugauugcuggaaacaag

SEQ ID NO: 1231387 - RNA, 19 nt, Homo sapiens
acacuuugcuccuguugau

SEQ ID NO: 1231388 - RNA, 19 nt, Homo sapiens
ccgcugaccuggauucgau

SEQ ID NO: 1231389 - RNA, 19 nt, Homo sapiens
caagagcaguuuggaagca

SEQ ID NO: 1231390 - RNA, 19 nt, Homo sapiens
guuauuaaagugccaaaga

SEQ ID NO: 1231391 - RNA, 19 nt, Homo sapiens
gguguggucuggccaugga

SEQ ID NO: 1231392 - RNA, 19 nt, Homo sapiens
ucacguucuuaccuugaua

SEQ ID NO: 1231393 - RNA, 19 nt, Homo sapiens
gcucacauuuaccuuuauc

SEQ ID NO: 1231394 - RNA, 19 nt, Homo sapiens
ggcaggaccacaccuacua

SEQ ID NO: 1231395 - RNA, 19 nt, Homo sapiens
ggaauuuggaucuuucauc

SEQ ID NO: 1231396 - RNA, 19 nt, Homo sapiens
cgaaagcagcugcgaagug

SEQ ID NO: 1231397 - RNA, 19 nt, Homo sapiens
gcaguucggccagcauuug

SEQ ID NO: 1231398 - RNA, 19 nt, Homo sapiens
gaaggugcgggucuugguu

SEQ ID NO: 1231399 - RNA, 19 nt, Homo sapiens
gaaacucuggcguguauac

SEQ ID NO: 1231400 - RNA, 19 nt, Homo sapiens
ggguaacacugaccauguc

SEQ ID NO: 1231401 - RNA, 19 nt, Homo sapiens
agaaccaucucaucuaggu

SEQ ID NO: 1231402 - RNA, 19 nt, Homo sapiens
agaaacagaaguccauaug

SEQ ID NO: 1231403 - RNA, 19 nt, Homo sapiens
uaacacugaccaugucguu

SEQ ID NO: 1231404 - RNA, 19 nt, Homo sapiens
guucuuauccagaguuugu

SEQ ID NO: 1231405 - RNA, 19 nt, Homo sapiens
gggcugcugcucacuaaga

SEQ ID NO: 1231406 - RNA, 19 nt, Homo sapiens
gaaacagaaguccauaugc

SEQ ID NO: 1231407 - RNA, 19 nt, Homo sapiens
ccaggaagauacgaaagca

SEQ ID NO: 1231408 - RNA, 19 nt, Homo sapiens
auuuggaucuuucaucuga

SEQ ID NO: 1231409 - RNA, 19 nt, Homo sapiens
uggaagaacccaagugcuu

SEQ ID NO: 1231410 - RNA, 19 nt, Homo sapiens
gagccaaagacuucauuca

SEQ ID NO: 1231411 - RNA, 19 nt, Homo sapiens
gagacuucauggauuacau

SEQ ID NO: 1231412 - RNA, 19 nt, Homo sapiens
gaaccaucucaucuaggua

SEQ ID NO: 1231413 - RNA, 19 nt, Homo sapiens
ccagcgagccaaagacuuc

SEQ ID NO: 1231414 - RNA, 19 nt, Homo sapiens
ucuuucaucugaguucuuu

SEQ ID NO: 1231415 - RNA, 19 nt, Homo sapiens
uaccuggggugacuucuua

SEQ ID NO: 1231416 - RNA, 19 nt, Homo sapiens
gcagcuggaagguaggaaa

SEQ ID NO: 1231417 - RNA, 19 nt, Homo sapiens
gcccagcauucagauucua

SEQ ID NO: 1231418 - RNA, 19 nt, Homo sapiens
gauagggagagggcacuaa

SEQ ID NO: 1231419 - RNA, 19 nt, Homo sapiens
aacuguugcuugguucuua

SEQ ID NO: 1231420 - RNA, 19 nt, Homo sapiens
gggcccagcauucagauuc

SEQ ID NO: 1231421 - RNA, 19 nt, Homo sapiens
ggagaaggugcgggucuug

SEQ ID NO: 1231422 - RNA, 19 nt, Homo sapiens
guggaaaacucccgugugu

SEQ ID NO: 1231423 - RNA, 19 nt, Homo sapiens
ccauuuguuucucuauuac

SEQ ID NO: 1231424 - RNA, 19 nt, Homo sapiens
agacuucauucacgauucu

SEQ ID NO: 1231425 - RNA, 19 nt, Homo sapiens
aagcagcugcgaaguguug

SEQ ID NO: 1231426 - RNA, 19 nt, Homo sapiens
gacaacagaaacagaaguc

SEQ ID NO: 1231427 - RNA, 19 nt, Homo sapiens
gaggcuggagaaccuguaa

SEQ ID NO: 1231428 - RNA, 19 nt, Homo sapiens
caacgaggaggugcaguuc

SEQ ID NO: 1231429 - RNA, 19 nt, Homo sapiens
gaacuggcucugacaucca

SEQ ID NO: 1231430 - RNA, 19 nt, Homo sapiens
uaaagugccaaagaaugaa

SEQ ID NO: 1231431 - RNA, 19 nt, Homo sapiens
uuucagagcaccaacuuca

SEQ ID NO: 1231432 - RNA, 19 nt, Homo sapiens
cagaaacagaaguccauau

SEQ ID NO: 1231433 - RNA, 19 nt, Homo sapiens
ggacacuuugcuccuguug

SEQ ID NO: 1231434 - RNA, 19 nt, Homo sapiens
gguccaggaagauacgaaa

SEQ ID NO: 1231435 - RNA, 19 nt, Homo sapiens
ccacguaccagcgcaauac

SEQ ID NO: 1231436 - RNA, 19 nt, Homo sapiens
uggcaggcuccaacguuua

SEQ ID NO: 1231437 - RNA, 19 nt, Homo sapiens
guaugaaccuuagaaaagu

SEQ ID NO: 1231438 - RNA, 19 nt, Homo sapiens
gcuugagacagauauuaga

SEQ ID NO: 1231439 - RNA, 19 nt, Homo sapiens
ucagagcaccaacuucauc

SEQ ID NO: 1231440 - RNA, 19 nt, Homo sapiens
cccuugagguccaggaaga

SEQ ID NO: 1231441 - RNA, 19 nt, Homo sapiens
gggacacuuugcuccuguu

SEQ ID NO: 1231442 - RNA, 19 nt, Homo sapiens
aguauccuguuuguuauug

SEQ ID NO: 1231443 - RNA, 19 nt, Homo sapiens
gaucauuucagagcaccaa

SEQ ID NO: 1231444 - RNA, 19 nt, Homo sapiens
gcugcgaaguguuguaucc

SEQ ID NO: 1231445 - RNA, 19 nt, Homo sapiens
acaaggcaguagugauucu

SEQ ID NO: 1231446 - RNA, 19 nt, Homo sapiens
ccuggagauuugcuguauu

SEQ ID NO: 1231447 - RNA, 19 nt, Homo sapiens
gcuggaagguaggaaacuc

SEQ ID NO: 1231448 - RNA, 19 nt, Homo sapiens
gaucuuucaucugaguucu

SEQ ID NO: 1231449 - RNA, 19 nt, Homo sapiens
uccuuaaacucacguucuu

SEQ ID NO: 1231450 - RNA, 19 nt, Homo sapiens
gcagcugcgaaguguugua

SEQ ID NO: 1231451 - RNA, 19 nt, Homo sapiens
caaagacuucauucacgau

SEQ ID NO: 1231452 - RNA, 19 nt, Homo sapiens
cauggcaggcuccaacguu

SEQ ID NO: 1231453 - RNA, 19 nt, Homo sapiens
aaagugccaaagaaugaaa

SEQ ID NO: 1231454 - RNA, 19 nt, Homo sapiens
gggucaguauccuguuugu

SEQ ID NO: 1231455 - RNA, 19 nt, Homo sapiens
gcaaacaguuggagcauua

SEQ ID NO: 1231456 - RNA, 19 nt, Homo sapiens
gaaagagcaugaccgauaa

SEQ ID NO: 1231457 - RNA, 19 nt, Homo sapiens
ggaaagagcaugaccgaua

SEQ ID NO: 1231458 - RNA, 19 nt, Homo sapiens
gcacagaacuggaacagau

SEQ ID NO: 1231459 - RNA, 19 nt, Homo sapiens
agaccaaccugaagaauaa

SEQ ID NO: 1231460 - RNA, 19 nt, Homo sapiens
gaaaugcacaguguuguua

SEQ ID NO: 1231461 - RNA, 19 nt, Homo sapiens
cuacaaaccuccugugaug

SEQ ID NO: 1231462 - RNA, 19 nt, Homo sapiens
gcacacagccgaccuacaa

SEQ ID NO: 1231463 - RNA, 19 nt, Homo sapiens
gaagagauucagacagaua

SEQ ID NO: 1231464 - RNA, 19 nt, Homo sapiens
ccaccucuauccagaaaua

SEQ ID NO: 1231465 - RNA, 19 nt, Homo sapiens
gagcaugaccgauaaagaa

SEQ ID NO: 1231466 - RNA, 19 nt, Homo sapiens
gaacaguuucucaagguua

SEQ ID NO: 1231467 - RNA, 19 nt, Homo sapiens
gagaauugcuuaucaacca

SEQ ID NO: 1231468 - RNA, 19 nt, Homo sapiens
agaacgagauggaaauaaa

SEQ ID NO: 1231469 - RNA, 19 nt, Homo sapiens
aagcaucaaucaagacaua

SEQ ID NO: 1231470 - RNA, 19 nt, Homo sapiens
aagaagagauucagacaga

SEQ ID NO: 1231471 - RNA, 19 nt, Homo sapiens
ggaaagaagugagaaaauu

SEQ ID NO: 1231472 - RNA, 19 nt, Homo sapiens
gaacugugggcuuuaauug

SEQ ID NO: 1231473 - RNA, 19 nt, Homo sapiens
agaggaggcuucuuucuug

SEQ ID NO: 1231474 - RNA, 19 nt, Homo sapiens
cgauauugaucaggauuua

SEQ ID NO: 1231475 - RNA, 19 nt, Homo sapiens
gaugaaguccuccgauauu

SEQ ID NO: 1231476 - RNA, 19 nt, Homo sapiens
gcacaguguuguuaugaag

SEQ ID NO: 1231477 - RNA, 19 nt, Homo sapiens
gggaguaaauaaaggaaga

SEQ ID NO: 1231478 - RNA, 19 nt, Homo sapiens
ccucagagcauaauuauuc

SEQ ID NO: 1231479 - RNA, 19 nt, Homo sapiens
gagcugagguggcaacaac

SEQ ID NO: 1231480 - RNA, 19 nt, Homo sapiens
gaacuggaacagaucacua

SEQ ID NO: 1231481 - RNA, 19 nt, Homo sapiens
gugaaagcaucaaucaaga

SEQ ID NO: 1231482 - RNA, 19 nt, Homo sapiens
ucuguuaaauccucaauga

SEQ ID NO: 1231483 - RNA, 19 nt, Homo sapiens
caauuccgcuguaaaauaa

SEQ ID NO: 1231484 - RNA, 19 nt, Homo sapiens
gcagagacaggaacgugua

SEQ ID NO: 1231485 - RNA, 19 nt, Homo sapiens
ggagcauuauucaaacuga

SEQ ID NO: 1231486 - RNA, 19 nt, Homo sapiens
gcaucucccuaucaaagaa

SEQ ID NO: 1231487 - RNA, 19 nt, Homo sapiens
ggucgcaucucccuaucaa

SEQ ID NO: 1231488 - RNA, 19 nt, Homo sapiens
ccaagaggcuccggucaga

SEQ ID NO: 1231489 - RNA, 19 nt, Homo sapiens
ggaaaagccugaugaaguc

SEQ ID NO: 1231490 - RNA, 19 nt, Homo sapiens
gaccggacuuggugucuug

SEQ ID NO: 1231491 - RNA, 19 nt, Homo sapiens
gaggaggcuucuuucuuga

SEQ ID NO: 1231492 - RNA, 19 nt, Homo sapiens
caacaugucauucacuuca

SEQ ID NO: 1231493 - RNA, 19 nt, Homo sapiens
ggauacugaucguuuggaa

SEQ ID NO: 1231494 - RNA, 19 nt, Homo sapiens
gaagugggacguugagcuu

SEQ ID NO: 1231495 - RNA, 19 nt, Homo sapiens
ucaugaggcucuuucucua

SEQ ID NO: 1231496 - RNA, 19 nt, Homo sapiens
ggccugaacugugggcuuu

SEQ ID NO: 1231497 - RNA, 19 nt, Homo sapiens
agacgaagggaguaaauaa

SEQ ID NO: 1231498 - RNA, 19 nt, Homo sapiens
gaucuaaacaccagaccaa

SEQ ID NO: 1231499 - RNA, 19 nt, Homo sapiens
gagaagaccccauuaaaga

SEQ ID NO: 1231500 - RNA, 19 nt, Homo sapiens
gaagggaguaaauaaagga

SEQ ID NO: 1231501 - RNA, 19 nt, Homo sapiens
uggaacagaucacuauuag

SEQ ID NO: 1231502 - RNA, 19 nt, Homo sapiens
gcuucuuucuugaacaaua

SEQ ID NO: 1231503 - RNA, 19 nt, Homo sapiens
gaaagcaucaaucaagaca

SEQ ID NO: 1231504 - RNA, 19 nt, Homo sapiens
ugugcagccugguuuaaua

SEQ ID NO: 1231505 - RNA, 19 nt, Homo sapiens
aauaagcauuguccgagua

SEQ ID NO: 1231506 - RNA, 19 nt, Homo sapiens
ucagugagcaauaaacaaa

SEQ ID NO: 1231507 - RNA, 19 nt, Homo sapiens
cugaugaaguccuccgaua

SEQ ID NO: 1231508 - RNA, 19 nt, Homo sapiens
gguaaguuaugauauuugg

SEQ ID NO: 1231509 - RNA, 19 nt, Homo sapiens
cagaccaaccugaagaaua

SEQ ID NO: 1231510 - RNA, 19 nt, Homo sapiens
ccaaaagcauccaaaagaa

SEQ ID NO: 1231511 - RNA, 19 nt, Homo sapiens
ccaaauaauagcuuaggaa

SEQ ID NO: 1231512 - RNA, 19 nt, Homo sapiens
gaagacgaagggaguaaau

SEQ ID NO: 1231513 - RNA, 19 nt, Homo sapiens
ggagccagguuuaccaucu

SEQ ID NO: 1231514 - RNA, 19 nt, Homo sapiens
uauaaggauucacagauuc

SEQ ID NO: 1231515 - RNA, 19 nt, Homo sapiens
caaauaaauaccagucguu

SEQ ID NO: 1231516 - RNA, 19 nt, Homo sapiens
guagugaaagcaucaauca

SEQ ID NO: 1231517 - RNA, 19 nt, Homo sapiens
aaacaguuccuuucugaug

SEQ ID NO: 1231518 - RNA, 19 nt, Homo sapiens
gaaguccuccgauauugau

SEQ ID NO: 1231519 - RNA, 19 nt, Homo sapiens
caccagaggaggcuucuuu

SEQ ID NO: 1231520 - RNA, 19 nt, Homo sapiens
ggcaauccaucuucuugug

SEQ ID NO: 1231521 - RNA, 19 nt, Homo sapiens
gacgaagggaguaaauaaa

SEQ ID NO: 1231522 - RNA, 19 nt, Homo sapiens
uuuaccaucugaacaauga

SEQ ID NO: 1231523 - RNA, 19 nt, Homo sapiens
caaagaagagauucagaca

SEQ ID NO: 1231524 - RNA, 19 nt, Homo sapiens
gaaaauaccaaauggacaa

SEQ ID NO: 1231525 - RNA, 19 nt, Homo sapiens
aagaguugcuuuguuagaa

SEQ ID NO: 1231526 - RNA, 19 nt, Homo sapiens
gguggccgauucccauuau

SEQ ID NO: 1231527 - RNA, 19 nt, Homo sapiens
guggagaauugcuuaucaa

SEQ ID NO: 1231528 - RNA, 19 nt, Homo sapiens
gaagugaugccgacauggu

SEQ ID NO: 1231529 - RNA, 19 nt, Homo sapiens
ggaugggaagaaucuauuu

SEQ ID NO: 1231530 - RNA, 19 nt, Homo sapiens
guugccaaauaauagcuua

SEQ ID NO: 1231531 - RNA, 19 nt, Homo sapiens
caaugagugugauguaaac

SEQ ID NO: 1231532 - RNA, 19 nt, Homo sapiens
ucaaugagugugauguaaa

SEQ ID NO: 1231533 - RNA, 19 nt, Homo sapiens
uagauuuccucagagcaua

SEQ ID NO: 1231534 - RNA, 19 nt, Homo sapiens
guuaugauauuuggaugga

SEQ ID NO: 1231535 - RNA, 19 nt, Homo sapiens
ggucugaggcgcaauuaca

SEQ ID NO: 1231536 - RNA, 19 nt, Homo sapiens
ccagaacgagauggaaaua

SEQ ID NO: 1231537 - RNA, 19 nt, Homo sapiens
gaugaucuucuuaggcaaa

SEQ ID NO: 1231538 - RNA, 19 nt, Homo sapiens
uauucuagauuuccucaga

SEQ ID NO: 1231539 - RNA, 19 nt, Homo sapiens
cagauucacauacgacuga

SEQ ID NO: 1231540 - RNA, 19 nt, Homo sapiens
gaggcgcaauuacagaugu

SEQ ID NO: 1231541 - RNA, 19 nt, Homo sapiens
gagagaagaccccauuaaa

SEQ ID NO: 1231542 - RNA, 19 nt, Homo sapiens
cgaagggaguaaauaaagg

SEQ ID NO: 1231543 - RNA, 19 nt, Homo sapiens
ggauucacagauucacaua

SEQ ID NO: 1231544 - RNA, 19 nt, Homo sapiens
caagaguugcuuuguuaga

SEQ ID NO: 1231545 - RNA, 19 nt, Homo sapiens
cuucuugugucagcaauuu

SEQ ID NO: 1231546 - RNA, 19 nt, Homo sapiens
gaacgagauggaaauaaac

SEQ ID NO: 1231547 - RNA, 19 nt, Homo sapiens
aacaguuucucaagguuaa

SEQ ID NO: 1231548 - RNA, 19 nt, Homo sapiens
ucugaacaaugaagacgaa

SEQ ID NO: 1231549 - RNA, 19 nt, Homo sapiens
gcacagcugaucuccgaau

SEQ ID NO: 1231550 - RNA, 19 nt, Homo sapiens
cagaggaggcuucuuucuu

SEQ ID NO: 1231551 - RNA, 19 nt, Homo sapiens
gcccacagcuucgcucuac

SEQ ID NO: 1231552 - RNA, 19 nt, Homo sapiens
cguggagaauugcuuauca

SEQ ID NO: 1231553 - RNA, 19 nt, Homo sapiens
acauuaugauggcaagaaa

SEQ ID NO: 1231554 - RNA, 19 nt, Homo sapiens
ugauggcccagcaacauua

SEQ ID NO: 1231555 - RNA, 19 nt, Homo sapiens
gagauaaaguuucccauuu

SEQ ID NO: 1231556 - RNA, 19 nt, Homo sapiens
gauggaauguugaguauuu

SEQ ID NO: 1231557 - RNA, 19 nt, Homo sapiens
gaacagcccuaauugauac

SEQ ID NO: 1231558 - RNA, 19 nt, Homo sapiens
ccaauacaguuucacauuu

SEQ ID NO: 1231559 - RNA, 19 nt, Homo sapiens
gaacugaccucaugaucca

SEQ ID NO: 1231560 - RNA, 19 nt, Homo sapiens
gcagaagcaauuuauguua

SEQ ID NO: 1231561 - RNA, 19 nt, Homo sapiens
ugaaggagaccaucaguua

SEQ ID NO: 1231562 - RNA, 19 nt, Homo sapiens
ugacaaaucacugcuauua

SEQ ID NO: 1231563 - RNA, 19 nt, Homo sapiens
ggaaauuuaugcgaaguuu

SEQ ID NO: 1231564 - RNA, 19 nt, Homo sapiens
gaauugaaaucacaagcuu

SEQ ID NO: 1231565 - RNA, 19 nt, Homo sapiens
gaacaugcaauuagccuuu

SEQ ID NO: 1231566 - RNA, 19 nt, Homo sapiens
acaaaucacugcuauuaga

SEQ ID NO: 1231567 - RNA, 19 nt, Homo sapiens
gcaaguauuuccuaugauc

SEQ ID NO: 1231568 - RNA, 19 nt, Homo sapiens
gcuguaaccuuucuucgaa

SEQ ID NO: 1231569 - RNA, 19 nt, Homo sapiens
caauacaguuucacauuug

SEQ ID NO: 1231570 - RNA, 19 nt, Homo sapiens
gcaaacuauuuccaaacua

SEQ ID NO: 1231571 - RNA, 19 nt, Homo sapiens
ggaauuaacacaucaaugg

SEQ ID NO: 1231572 - RNA, 19 nt, Homo sapiens
ccaauggguuccuacaauu

SEQ ID NO: 1231573 - RNA, 19 nt, Homo sapiens
guucgaaucugcuuugugu

SEQ ID NO: 1231574 - RNA, 19 nt, Homo sapiens
caacuucugugcaaaauuu

SEQ ID NO: 1231575 - RNA, 19 nt, Homo sapiens
caagauggaauguugagua

SEQ ID NO: 1231576 - RNA, 19 nt, Homo sapiens
ucucagauauugucacuug

SEQ ID NO: 1231577 - RNA, 19 nt, Homo sapiens
guacagguguugugugcaa

SEQ ID NO: 1231578 - RNA, 19 nt, Homo sapiens
ggacucugauggaggguuu

SEQ ID NO: 1231579 - RNA, 19 nt, Homo sapiens
gaugugagccugugagaug

SEQ ID NO: 1231580 - RNA, 19 nt, Homo sapiens
ggagauaaaguuucccauu

SEQ ID NO: 1231581 - RNA, 19 nt, Homo sapiens
ccacuccacuguguugaua

SEQ ID NO: 1231582 - RNA, 19 nt, Homo sapiens
ccagaaaucguuacaguug

SEQ ID NO: 1231583 - RNA, 19 nt, Homo sapiens
ucgaauaaaucucuucaga

SEQ ID NO: 1231584 - RNA, 19 nt, Homo sapiens
acaguccuauuguauguua

SEQ ID NO: 1231585 - RNA, 19 nt, Homo sapiens
cgacaggguuucaccaugu

SEQ ID NO: 1231586 - RNA, 19 nt, Homo sapiens
uaaugucaaugcccaguuu

SEQ ID NO: 1231587 - RNA, 19 nt, Homo sapiens
ggaaacaucaguaaacuac

SEQ ID NO: 1231588 - RNA, 19 nt, Homo sapiens
caacaacccagaaaucguu

SEQ ID NO: 1231589 - RNA, 19 nt, Homo sapiens
guguagcuguguucaauuu

SEQ ID NO: 1231590 - RNA, 19 nt, Homo sapiens
gcaauuagccuuuugaaau

SEQ ID NO: 1231591 - RNA, 19 nt, Homo sapiens
guaggucucugucugugaa

SEQ ID NO: 1231592 - RNA, 19 nt, Homo sapiens
gaaaucacaagcuuacuuc

SEQ ID NO: 1231593 - RNA, 19 nt, Homo sapiens
uggagaggauggucgaaua

SEQ ID NO: 1231594 - RNA, 19 nt, Homo sapiens
ccugagaccuuaaugacaa

SEQ ID NO: 1231595 - RNA, 19 nt, Homo sapiens
gauaugaucagaguaaaga

SEQ ID NO: 1231596 - RNA, 19 nt, Homo sapiens
ucagauagaacaugcaauu

SEQ ID NO: 1231597 - RNA, 19 nt, Homo sapiens
ggagaggauggucgaauaa

SEQ ID NO: 1231598 - RNA, 19 nt, Homo sapiens
ugaacagcccuaauugaua

SEQ ID NO: 1231599 - RNA, 19 nt, Homo sapiens
gcaaaagaccgaauugaaa

SEQ ID NO: 1231600 - RNA, 19 nt, Homo sapiens
acacaucaauggugguuau

SEQ ID NO: 1231601 - RNA, 19 nt, Homo sapiens
gauagaacaugcaauuagc

SEQ ID NO: 1231602 - RNA, 19 nt, Homo sapiens
guucaccagucugucauua

SEQ ID NO: 1231603 - RNA, 19 nt, Homo sapiens
ggaggaagaagcaguacuu

SEQ ID NO: 1231604 - RNA, 19 nt, Homo sapiens
gucaggguuucacuaaaua

SEQ ID NO: 1231605 - RNA, 19 nt, Homo sapiens
ccaaagugcugugauuaca

SEQ ID NO: 1231606 - RNA, 19 nt, Homo sapiens
guuauugugugauaucaga

SEQ ID NO: 1231607 - RNA, 19 nt, Homo sapiens
gaaggagaccaucaguuau

SEQ ID NO: 1231608 - RNA, 19 nt, Homo sapiens
ggguuucacuaaauaaaug

SEQ ID NO: 1231609 - RNA, 19 nt, Homo sapiens
uuauugaccugagaccuua

SEQ ID NO: 1231610 - RNA, 19 nt, Homo sapiens
uuagccaccuauaguguua

SEQ ID NO: 1231611 - RNA, 19 nt, Homo sapiens
uugcaaguauuuccuauga

SEQ ID NO: 1231612 - RNA, 19 nt, Homo sapiens
gcugaaggcucaugaagcu

SEQ ID NO: 1231613 - RNA, 19 nt, Homo sapiens
ucacugcuauuagacaauu

SEQ ID NO: 1231614 - RNA, 19 nt, Homo sapiens
cagaaagaauugaguagag

SEQ ID NO: 1231615 - RNA, 19 nt, Homo sapiens
auagaugacugauggcaaa

SEQ ID NO: 1231616 - RNA, 19 nt, Homo sapiens
gcacugauccugcaaaaga

SEQ ID NO: 1231617 - RNA, 19 nt, Homo sapiens
gaacucuuucagcuuguua

SEQ ID NO: 1231618 - RNA, 19 nt, Homo sapiens
uaugauccuuccacacuuu

SEQ ID NO: 1231619 - RNA, 19 nt, Homo sapiens
gcugaaaugugggaaguuc

SEQ ID NO: 1231620 - RNA, 19 nt, Homo sapiens
uagguugccuucagaguau

SEQ ID NO: 1231621 - RNA, 19 nt, Homo sapiens
ccaaacaguuguagaaucc

SEQ ID NO: 1231622 - RNA, 19 nt, Homo sapiens
caaggaggaagaagcagua

SEQ ID NO: 1231623 - RNA, 19 nt, Homo sapiens
ucacaaggaagcuguaaga

SEQ ID NO: 1231624 - RNA, 19 nt, Homo sapiens
ugucaggguuucacuaaau

SEQ ID NO: 1231625 - RNA, 19 nt, Homo sapiens
caacuuugcuuuuguuuag

SEQ ID NO: 1231626 - RNA, 19 nt, Homo sapiens
uguagaauccgauagauga

SEQ ID NO: 1231627 - RNA, 19 nt, Homo sapiens
caucaguaaacuaccauua

SEQ ID NO: 1231628 - RNA, 19 nt, Homo sapiens
uggccaagauggaauguug

SEQ ID NO: 1231629 - RNA, 19 nt, Homo sapiens
gcaggagaauugcucaaac

SEQ ID NO: 1231630 - RNA, 19 nt, Homo sapiens
cagaagcaauuuauguuac

SEQ ID NO: 1231631 - RNA, 19 nt, Homo sapiens
ugauagacaucccaaccaa

SEQ ID NO: 1231632 - RNA, 19 nt, Homo sapiens
cgaaguuugugucccagaa

SEQ ID NO: 1231633 - RNA, 19 nt, Homo sapiens
gauguuagacaagguacua

SEQ ID NO: 1231634 - RNA, 19 nt, Homo sapiens
aagauggaauguugaguau

SEQ ID NO: 1231635 - RNA, 19 nt, Homo sapiens
aauaugggauuucagacaa

SEQ ID NO: 1231636 - RNA, 19 nt, Homo sapiens
gacaaugcagauaguagua

SEQ ID NO: 1231637 - RNA, 19 nt, Homo sapiens
guaagaaccauagacaaug

SEQ ID NO: 1231638 - RNA, 19 nt, Homo sapiens
guaaaaggguacaguccua

SEQ ID NO: 1231639 - RNA, 19 nt, Homo sapiens
ccuccaaagugcugugauu

SEQ ID NO: 1231640 - RNA, 19 nt, Homo sapiens
acagacagcuuguggaacu

SEQ ID NO: 1231641 - RNA, 19 nt, Homo sapiens
ccacagauguaccugaaaa

SEQ ID NO: 1231642 - RNA, 19 nt, Homo sapiens
gaggauggucgaauaaauc

SEQ ID NO: 1231643 - RNA, 19 nt, Homo sapiens
gagccaaucaccaguuguu

SEQ ID NO: 1231644 - RNA, 19 nt, Homo sapiens
gaacacucaauccuguaaa

SEQ ID NO: 1231645 - RNA, 19 nt, Homo sapiens
caauggguuccuacaauuu

SEQ ID NO: 1231646 - RNA, 19 nt, Homo sapiens
aaacaucaguaaacuacca

SEQ ID NO: 1231647 - RNA, 19 nt, Homo sapiens
gaaggcucaugaagcugaa

SEQ ID NO: 1231648 - RNA, 19 nt, Homo sapiens
uaagaaccauagacaaugc

SEQ ID NO: 1231649 - RNA, 19 nt, Homo sapiens
gcuauuagacaauugaagu

SEQ ID NO: 1231650 - RNA, 19 nt, Homo sapiens
gaaguuugugucccagaaa

SEQ ID NO: 1231651 - RNA, 19 nt, Homo sapiens
cagauagaacaugcaauua

SEQ ID NO: 1231652 - RNA, 19 nt, Homo sapiens
uaaccaagcuaauguucac

SEQ ID NO: 1231653 - RNA, 19 nt, Homo sapiens
ccaaucaccaguuguuaug

SEQ ID NO: 1231654 - RNA, 19 nt, Homo sapiens
uauguuaacacacugauga

SEQ ID NO: 1231655 - RNA, 19 nt, Homo sapiens
caccaugccuggcuaauua

SEQ ID NO: 1231656 - RNA, 19 nt, Homo sapiens
ggaccaaacugcacaaagu

SEQ ID NO: 1231657 - RNA, 19 nt, Homo sapiens
gaaccuugaugacagauug

SEQ ID NO: 1231658 - RNA, 19 nt, Homo sapiens
gcugugaacuccaucauga

SEQ ID NO: 1231659 - RNA, 19 nt, Homo sapiens
gcucacaacucaucucaau

SEQ ID NO: 1231660 - RNA, 19 nt, Homo sapiens
gcuaggacauccaguaaug

SEQ ID NO: 1231661 - RNA, 19 nt, Homo sapiens
guaacacccuuccagauga

SEQ ID NO: 1231662 - RNA, 19 nt, Homo sapiens
ggacaaacucugcugcuuu

SEQ ID NO: 1231663 - RNA, 19 nt, Homo sapiens
gaugacuacuuucuucaaa

SEQ ID NO: 1231664 - RNA, 19 nt, Homo sapiens
uaacaggauuucuucaguu

SEQ ID NO: 1231665 - RNA, 19 nt, Homo sapiens
caaaguauuucgugagauc

SEQ ID NO: 1231666 - RNA, 19 nt, Homo sapiens
gcccaaagguuucuuccaa

SEQ ID NO: 1231667 - RNA, 19 nt, Homo sapiens
ucaagcagcugacacacaa

SEQ ID NO: 1231668 - RNA, 19 nt, Homo sapiens
ggauagagauuuggugcuu

SEQ ID NO: 1231669 - RNA, 19 nt, Homo sapiens
ggacauccaguaaugcuuu

SEQ ID NO: 1231670 - RNA, 19 nt, Homo sapiens
guuaucccgugguuuaaua

SEQ ID NO: 1231671 - RNA, 19 nt, Homo sapiens
caauuuggauagagauuug

SEQ ID NO: 1231672 - RNA, 19 nt, Homo sapiens
gagaaugaacccacuuuga

SEQ ID NO: 1231673 - RNA, 19 nt, Homo sapiens
ggucagauuucauuucagu

SEQ ID NO: 1231674 - RNA, 19 nt, Homo sapiens
gcaugguccucaagaaguu

SEQ ID NO: 1231675 - RNA, 19 nt, Homo sapiens
gcuagugauuuccauagaa

SEQ ID NO: 1231676 - RNA, 19 nt, Homo sapiens
ccaaccagcuuaacaggau

SEQ ID NO: 1231677 - RNA, 19 nt, Homo sapiens
acaacuagauggagucuca

SEQ ID NO: 1231678 - RNA, 19 nt, Homo sapiens
gaucacccaacaccaauuu

SEQ ID NO: 1231679 - RNA, 19 nt, Homo sapiens
caaacugcacaaaguauuu

SEQ ID NO: 1231680 - RNA, 19 nt, Homo sapiens
gaccaaacugcacaaagua

SEQ ID NO: 1231681 - RNA, 19 nt, Homo sapiens
ccucugauauugucaacuu

SEQ ID NO: 1231682 - RNA, 19 nt, Homo sapiens
ggaauggaauugcucuuuu

SEQ ID NO: 1231683 - RNA, 19 nt, Homo sapiens
gccguuaucccgugguuua

SEQ ID NO: 1231684 - RNA, 19 nt, Homo sapiens
gaagggcagcuagugauuu

SEQ ID NO: 1231685 - RNA, 19 nt, Homo sapiens
cacaaaguauuucgugaga

SEQ ID NO: 1231686 - RNA, 19 nt, Homo sapiens
agaaugaacccacuuugaa

SEQ ID NO: 1231687 - RNA, 19 nt, Homo sapiens
ucauuucaguguaaaggua

SEQ ID NO: 1231688 - RNA, 19 nt, Homo sapiens
gguaacacccuuccagaug

SEQ ID NO: 1231689 - RNA, 19 nt, Homo sapiens
aggagcagcuuccgaaaga

SEQ ID NO: 1231690 - RNA, 19 nt, Homo sapiens
gacaaacucugcugcuuuu

SEQ ID NO: 1231691 - RNA, 19 nt, Homo sapiens
agauaccucuucuuuaguu

SEQ ID NO: 1231692 - RNA, 19 nt, Homo sapiens
ccagaaccuugaugacaga

SEQ ID NO: 1231693 - RNA, 19 nt, Homo sapiens
gcaagguuccauccaauuc

SEQ ID NO: 1231694 - RNA, 19 nt, Homo sapiens
cagauuucauuucagugua

SEQ ID NO: 1231695 - RNA, 19 nt, Homo sapiens
aacaggauuucuucaguuu

SEQ ID NO: 1231696 - RNA, 19 nt, Homo sapiens
auacuuugcucacaacuca

SEQ ID NO: 1231697 - RNA, 19 nt, Homo sapiens
gacuuggacuucagaggaa

SEQ ID NO: 1231698 - RNA, 19 nt, Homo sapiens
ucaagaaguuccuaaaaga

SEQ ID NO: 1231699 - RNA, 19 nt, Homo sapiens
gccgaugacuacuuucuuc

SEQ ID NO: 1231700 - RNA, 19 nt, Homo sapiens
gaauggaauugcucuuuug

SEQ ID NO: 1231701 - RNA, 19 nt, Homo sapiens
gggaauggaauugcucuuu

SEQ ID NO: 1231702 - RNA, 19 nt, Homo sapiens
gcaaagcugacuuggacuu

SEQ ID NO: 1231703 - RNA, 19 nt, Homo sapiens
ccaauucacuguggacaag

SEQ ID NO: 1231704 - RNA, 19 nt, Homo sapiens
gagccacaguguagugcaa

SEQ ID NO: 1231705 - RNA, 19 nt, Homo sapiens
ccgaguagcugggauuaca

SEQ ID NO: 1231706 - RNA, 19 nt, Homo sapiens
aaggucagauuucauuuca

SEQ ID NO: 1231707 - RNA, 19 nt, Homo sapiens
ccuaaggucagauuucauu

SEQ ID NO: 1231708 - RNA, 19 nt, Homo sapiens
gaaaagcccagaaccuuga

SEQ ID NO: 1231709 - RNA, 19 nt, Homo sapiens
gcagcuauucucaggauau

SEQ ID NO: 1231710 - RNA, 19 nt, Homo sapiens
gcagcuagugauuuccaua

SEQ ID NO: 1231711 - RNA, 19 nt, Homo sapiens
gugcaagguuccauccaau

SEQ ID NO: 1231712 - RNA, 19 nt, Homo sapiens
ggauuuccacagugcauuu

SEQ ID NO: 1231713 - RNA, 19 nt, Homo sapiens
ggagaaugaacccacuuug

SEQ ID NO: 1231714 - RNA, 19 nt, Homo sapiens
guguaaagguaaauggaau

SEQ ID NO: 1231715 - RNA, 19 nt, Homo sapiens
gaggugaagcagcagcuaa

SEQ ID NO: 1231716 - RNA, 19 nt, Homo sapiens
ccaaacugcacaaaguauu

SEQ ID NO: 1231717 - RNA, 19 nt, Homo sapiens
ugccaaggcucagcagaaa

SEQ ID NO: 1231718 - RNA, 19 nt, Homo sapiens
gaaugaacccacuuugaac

SEQ ID NO: 1231719 - RNA, 19 nt, Homo sapiens
gagcagcuuccgaaagaug

SEQ ID NO: 1231720 - RNA, 19 nt, Homo sapiens
caaccagcuuaacaggauu

SEQ ID NO: 1231721 - RNA, 19 nt, Homo sapiens
gaaccuugggaauggaauu

SEQ ID NO: 1231722 - RNA, 19 nt, Homo sapiens
uaacacccuuccagaugau

SEQ ID NO: 1231723 - RNA, 19 nt, Homo sapiens
gagcagccgaugacuacuu

SEQ ID NO: 1231724 - RNA, 19 nt, Homo sapiens
cagcuuaacaggauuucuu

SEQ ID NO: 1231725 - RNA, 19 nt, Homo sapiens
ggagagccacaguguagug

SEQ ID NO: 1231726 - RNA, 19 nt, Homo sapiens
uuaacaggauuucuucagu

SEQ ID NO: 1231727 - RNA, 19 nt, Homo sapiens
gugcuaggacauccaguaa

SEQ ID NO: 1231728 - RNA, 19 nt, Homo sapiens
ugagaucacccaacaccaa

SEQ ID NO: 1231729 - RNA, 19 nt, Homo sapiens
ggaucucaauuuggauaga

SEQ ID NO: 1231730 - RNA, 19 nt, Homo sapiens
gggagcagccgaugacuac

SEQ ID NO: 1231731 - RNA, 19 nt, Homo sapiens
aagggcagcuagugauuuc

SEQ ID NO: 1231732 - RNA, 19 nt, Homo sapiens
cacaagaguucaggaccaa

SEQ ID NO: 1231733 - RNA, 19 nt, Homo sapiens
gaucucaauuuggauagag

SEQ ID NO: 1231734 - RNA, 19 nt, Homo sapiens
cuagugauuuccauagaag

SEQ ID NO: 1231735 - RNA, 19 nt, Homo sapiens
ccauagaaggauuaaauuc

SEQ ID NO: 1231736 - RNA, 19 nt, Homo sapiens
gaaaacaagaggcucaaga

SEQ ID NO: 1231737 - RNA, 19 nt, Homo sapiens
cagcagcuaacccuagaaa

SEQ ID NO: 1231738 - RNA, 19 nt, Homo sapiens
gagaucacccaacaccaau

SEQ ID NO: 1231739 - RNA, 19 nt, Homo sapiens
ucacaacucaucucaaugc

SEQ ID NO: 1231740 - RNA, 19 nt, Homo sapiens
gauaccucuucuuuaguug

SEQ ID NO: 1231741 - RNA, 19 nt, Homo sapiens
cagcuauucucaggauaug

SEQ ID NO: 1231742 - RNA, 19 nt, Homo sapiens
gggucugccucugauauug

SEQ ID NO: 1231743 - RNA, 19 nt, Homo sapiens
caucaugaguauucugacu

SEQ ID NO: 1231744 - RNA, 19 nt, Homo sapiens
aaagaaauacaguccauac

SEQ ID NO: 1231745 - RNA, 19 nt, Homo sapiens
ugauuuccauagaaggauu

SEQ ID NO: 1231746 - RNA, 19 nt, Homo sapiens
ugaguuaucagguggaauc

SEQ ID NO: 1231747 - RNA, 19 nt, Homo sapiens
ccaccaugccuggcuaauu

SEQ ID NO: 1231748 - RNA, 19 nt, Homo sapiens
ggucgacucccagcauuau

SEQ ID NO: 1231749 - RNA, 19 nt, Homo sapiens
ccaggcaaaugcucuucau

SEQ ID NO: 1231750 - RNA, 19 nt, Homo sapiens
gauuuccauagaaggauua

SEQ ID NO: 1231751 - RNA, 19 nt, Homo sapiens
cauuaugugagaccaaauu

SEQ ID NO: 1231752 - RNA, 19 nt, Homo sapiens
uaaggucagauuucauuuc

SEQ ID NO: 1231753 - RNA, 19 nt, Homo sapiens
gaggaaggcagcuauucuc

SEQ ID NO: 1231754 - RNA, 19 nt, Homo sapiens
caagguuccauccaauuca

SEQ ID NO: 1231755 - RNA, 19 nt, Homo sapiens
gaaugaaugaguuccuuua

SEQ ID NO: 1231756 - RNA, 19 nt, Homo sapiens
gaagacagauggaguucuc

SEQ ID NO: 1231757 - RNA, 19 nt, Homo sapiens
gugcaaacauagccacuuu

SEQ ID NO: 1231758 - RNA, 19 nt, Homo sapiens
gcacaugcauuacacacau

SEQ ID NO: 1231759 - RNA, 19 nt, Homo sapiens
aagaagugcugagaaguua

SEQ ID NO: 1231760 - RNA, 19 nt, Homo sapiens
ugaaugaguuccuuuaagu

SEQ ID NO: 1231761 - RNA, 19 nt, Homo sapiens
gcuaagaagugcugagaag

SEQ ID NO: 1231762 - RNA, 19 nt, Homo sapiens
gauacaacagcaaacauuu

SEQ ID NO: 1231763 - RNA, 19 nt, Homo sapiens
ggauacaacagcaaacauu

SEQ ID NO: 1231764 - RNA, 19 nt, Homo sapiens
ggucucagauggaauuaca

SEQ ID NO: 1231765 - RNA, 19 nt, Homo sapiens
gagaaugaaugaguuccuu

SEQ ID NO: 1231766 - RNA, 19 nt, Homo sapiens
cagcaggacuucagaaagg

SEQ ID NO: 1231767 - RNA, 19 nt, Homo sapiens
gcagggagaugagacucuu

SEQ ID NO: 1231768 - RNA, 19 nt, Homo sapiens
aggaaucacucacugacua

SEQ ID NO: 1231769 - RNA, 19 nt, Homo sapiens
ugaaguuuguugacccuuu

SEQ ID NO: 1231770 - RNA, 19 nt, Homo sapiens
uaagaagugcugagaaguu

SEQ ID NO: 1231771 - RNA, 19 nt, Homo sapiens
ccgagucauugccgucuua

SEQ ID NO: 1231772 - RNA, 19 nt, Homo sapiens
gcacacacauaugcacaca

SEQ ID NO: 1231773 - RNA, 19 nt, Homo sapiens
guuuauagcuuugucaagu

SEQ ID NO: 1231774 - RNA, 19 nt, Homo sapiens
acacacauaugcacacaca

SEQ ID NO: 1231775 - RNA, 19 nt, Homo sapiens
cagauggaauuacacuaga

SEQ ID NO: 1231776 - RNA, 19 nt, Homo sapiens
gaagauccucgccgucaga

SEQ ID NO: 1231777 - RNA, 19 nt, Homo sapiens
aguaauaucucagcaguca

SEQ ID NO: 1231778 - RNA, 19 nt, Homo sapiens
aaugggaguuugaaagaga

SEQ ID NO: 1231779 - RNA, 19 nt, Homo sapiens
ugucaagaguuacccuuug

SEQ ID NO: 1231780 - RNA, 19 nt, Homo sapiens
acacacaugcacacacaua

SEQ ID NO: 1231781 - RNA, 19 nt, Homo sapiens
gagauguuaucgucauugg

SEQ ID NO: 1231782 - RNA, 19 nt, Homo sapiens
gaaguuuguugacccuuuu

SEQ ID NO: 1231783 - RNA, 19 nt, Homo sapiens
uuacacacaugcacacaca

SEQ ID NO: 1231784 - RNA, 19 nt, Homo sapiens
gaaugggaguuugaaagag

SEQ ID NO: 1231785 - RNA, 19 nt, Homo sapiens
ccagggaguucgacauuuu

SEQ ID NO: 1231786 - RNA, 19 nt, Homo sapiens
ucauuggccuggagaagga

SEQ ID NO: 1231787 - RNA, 19 nt, Homo sapiens
ggccuuguguuuauagcuu

SEQ ID NO: 1231788 - RNA, 19 nt, Homo sapiens
gaaugaguuccuuuaagug

SEQ ID NO: 1231789 - RNA, 19 nt, Homo sapiens
gccagggaguucgacauuu

SEQ ID NO: 1231790 - RNA, 19 nt, Homo sapiens
agaaugggaguuugaaaga

SEQ ID NO: 1231791 - RNA, 19 nt, Homo sapiens
ccuguuuguuugcacauaa

SEQ ID NO: 1231792 - RNA, 19 nt, Homo sapiens
guucugagcugggucaaac

SEQ ID NO: 1231793 - RNA, 19 nt, Homo sapiens
ccaggucucagauggaauu

SEQ ID NO: 1231794 - RNA, 19 nt, Homo sapiens
gagaugagacucuuuuaau

SEQ ID NO: 1231795 - RNA, 19 nt, Homo sapiens
acacauaugcacacacaug

SEQ ID NO: 1231796 - RNA, 19 nt, Homo sapiens
ucacauuguaugggauuua

SEQ ID NO: 1231797 - RNA, 19 nt, Homo sapiens
cacauuguaugggauuuau

SEQ ID NO: 1231798 - RNA, 19 nt, Homo sapiens
ucagauggaauuacacuag

SEQ ID NO: 1231799 - RNA, 19 nt, Homo sapiens
cgucagagaccucauuugg

SEQ ID NO: 1231800 - RNA, 19 nt, Homo sapiens
ggagaugagacucuuuuaa

SEQ ID NO: 1231801 - RNA, 19 nt, Homo sapiens
gccaagaucagaugucucu

SEQ ID NO: 1231802 - RNA, 19 nt, Homo sapiens
cugaacuccuugcugcuaa

SEQ ID NO: 1231803 - RNA, 19 nt, Homo sapiens
cgaggacucagacaugcua

SEQ ID NO: 1231804 - RNA, 19 nt, Homo sapiens
ugaaagagagaucauacuc

SEQ ID NO: 1231805 - RNA, 19 nt, Homo sapiens
cuagaagacagauggaguu

SEQ ID NO: 1231806 - RNA, 19 nt, Homo sapiens
guggagauguuaucgucau

SEQ ID NO: 1231807 - RNA, 19 nt, Homo sapiens
cgacaggucugagcaugac

SEQ ID NO: 1231808 - RNA, 19 nt, Homo sapiens
ugagcaucauguacaguga

SEQ ID NO: 1231809 - RNA, 19 nt, Homo sapiens
gucaagaguuacccuuugg

SEQ ID NO: 1231810 - RNA, 19 nt, Homo sapiens
gacgugagcaucauguaca

SEQ ID NO: 1231811 - RNA, 19 nt, Homo sapiens
ugagcugggucaaacaaag

SEQ ID NO: 1231812 - RNA, 19 nt, Homo sapiens
ggagauguuaucgucauug

SEQ ID NO: 1231813 - RNA, 19 nt, Homo sapiens
ggacgugagcaucauguac

SEQ ID NO: 1231814 - RNA, 19 nt, Homo sapiens
cacaggggauuuauggaua

SEQ ID NO: 1231815 - RNA, 19 nt, Homo sapiens
cugggaagcacuugaggua

SEQ ID NO: 1231816 - RNA, 19 nt, Homo sapiens
cagaaugggaguuugaaag

SEQ ID NO: 1231817 - RNA, 19 nt, Homo sapiens
gaucauacuccagcugaag

SEQ ID NO: 1231818 - RNA, 19 nt, Homo sapiens
uccagagaaugaaugaguu

SEQ ID NO: 1231819 - RNA, 19 nt, Homo sapiens
gcacucgcaagagaaggua

SEQ ID NO: 1231820 - RNA, 19 nt, Homo sapiens
gacucagacaugcuacaua

SEQ ID NO: 1231821 - RNA, 19 nt, Homo sapiens
ccagaaugggaguuugaaa

SEQ ID NO: 1231822 - RNA, 19 nt, Homo sapiens
gccuuguguuuauagcuuu

SEQ ID NO: 1231823 - RNA, 19 nt, Homo sapiens
ccacacggccaacccaaag

SEQ ID NO: 1231824 - RNA, 19 nt, Homo sapiens
ggacucagacaugcuacau

SEQ ID NO: 1231825 - RNA, 19 nt, Homo sapiens
gaagugcugagaaguuacu

SEQ ID NO: 1231826 - RNA, 19 nt, Homo sapiens
gaacuccuugcugcuaaga

SEQ ID NO: 1231827 - RNA, 19 nt, Homo sapiens
cagucaggcuucugguugu

SEQ ID NO: 1231828 - RNA, 19 nt, Homo sapiens
aguauuugcuggauaugca

SEQ ID NO: 1231829 - RNA, 19 nt, Homo sapiens
acacaugcacacacauaug

SEQ ID NO: 1231830 - RNA, 19 nt, Homo sapiens
ucaggcuucugguugugaa

SEQ ID NO: 1231831 - RNA, 19 nt, Homo sapiens
guugugugcaccuuugaaa

SEQ ID NO: 1231832 - RNA, 19 nt, Homo sapiens
cagcaaguucuuccagugu

SEQ ID NO: 1231833 - RNA, 19 nt, Homo sapiens
ggaaucacucacugacuac

SEQ ID NO: 1231834 - RNA, 19 nt, Homo sapiens
agaaugaaugaguuccuuu

SEQ ID NO: 1231835 - RNA, 19 nt, Homo sapiens
ccagagaaugaaugaguuc

SEQ ID NO: 1231836 - RNA, 19 nt, Homo sapiens
gccucuaguucuccaagga

SEQ ID NO: 1231837 - RNA, 19 nt, Homo sapiens
acacguguacagcggagua

SEQ ID NO: 1231838 - RNA, 19 nt, Homo sapiens
guucuuccagugugccuuu

SEQ ID NO: 1231839 - RNA, 19 nt, Homo sapiens
gauaugcagggagaugaga

SEQ ID NO: 1231840 - RNA, 19 nt, Homo sapiens
gcaagccaagaucagaugu

SEQ ID NO: 1231841 - RNA, 19 nt, Homo sapiens
uggagauguuaucgucauu

SEQ ID NO: 1231842 - RNA, 19 nt, Homo sapiens
gggcaagccaagaucagau

SEQ ID NO: 1231843 - RNA, 19 nt, Homo sapiens
ggcaaaggacacuguugug

SEQ ID NO: 1231844 - RNA, 19 nt, Homo sapiens
uacuccagcugaaguuugu

SEQ ID NO: 1231845 - RNA, 19 nt, Homo sapiens
augaaugaguuccuuuaag

SEQ ID NO: 1231846 - RNA, 19 nt, Homo sapiens
ggcaagccaagaucagaug

SEQ ID NO: 1231847 - RNA, 19 nt, Homo sapiens
caaggaccuagaagacaga

SEQ ID NO: 1231848 - RNA, 19 nt, Homo sapiens
uggcaaaggacacuguugu

SEQ ID NO: 1231849 - RNA, 19 nt, Homo sapiens
caaagaagaugaaacuuga

SEQ ID NO: 1231850 - RNA, 19 nt, Homo sapiens
ggacaaagcaguuccaauu

SEQ ID NO: 1231851 - RNA, 19 nt, Homo sapiens
ggaagggaacguuuauuua

SEQ ID NO: 1231852 - RNA, 19 nt, Homo sapiens
ccacauauuugaacaguga

SEQ ID NO: 1231853 - RNA, 19 nt, Homo sapiens
ggaagaagcgccagaaguu

SEQ ID NO: 1231854 - RNA, 19 nt, Homo sapiens
cagagacaguuucuaguua

SEQ ID NO: 1231855 - RNA, 19 nt, Homo sapiens
gcaaagaagaugaaacuug

SEQ ID NO: 1231856 - RNA, 19 nt, Homo sapiens
gaaaggaaacccagaaaca

SEQ ID NO: 1231857 - RNA, 19 nt, Homo sapiens
gaagaagcgccagaaguua

SEQ ID NO: 1231858 - RNA, 19 nt, Homo sapiens
caacagcugugauuucauc

SEQ ID NO: 1231859 - RNA, 19 nt, Homo sapiens
gcagaacacccuugcguuu

SEQ ID NO: 1231860 - RNA, 19 nt, Homo sapiens
gaagggaacguuuauuuag

SEQ ID NO: 1231861 - RNA, 19 nt, Homo sapiens
agaaauuacuggcaaagaa

SEQ ID NO: 1231862 - RNA, 19 nt, Homo sapiens
gggaagggaacguuuauuu

SEQ ID NO: 1231863 - RNA, 19 nt, Homo sapiens
ggacagagagccucaccuu

SEQ ID NO: 1231864 - RNA, 19 nt, Homo sapiens
gaugaaacuugaacagaag

SEQ ID NO: 1231865 - RNA, 19 nt, Homo sapiens
agaugaaacuugaacagaa

SEQ ID NO: 1231866 - RNA, 19 nt, Homo sapiens
gggaacguuuauuuaguaa

SEQ ID NO: 1231867 - RNA, 19 nt, Homo sapiens
gaacagaagaaacaagaag

SEQ ID NO: 1231868 - RNA, 19 nt, Homo sapiens
agucagcccuaauaaauga

SEQ ID NO: 1231869 - RNA, 19 nt, Homo sapiens
ggagagucagcccuaauaa

SEQ ID NO: 1231870 - RNA, 19 nt, Homo sapiens
gaagaacccggacaaagca

SEQ ID NO: 1231871 - RNA, 19 nt, Homo sapiens
aaaauuggaugcagaguuu

SEQ ID NO: 1231872 - RNA, 19 nt, Homo sapiens
gagagucagcccuaauaaa

SEQ ID NO: 1231873 - RNA, 19 nt, Homo sapiens
cgacagagacaguuucuag

SEQ ID NO: 1231874 - RNA, 19 nt, Homo sapiens
agggaacguuuauuuagua

SEQ ID NO: 1231875 - RNA, 19 nt, Homo sapiens
gaaauuacuggcaaagaag

SEQ ID NO: 1231876 - RNA, 19 nt, Homo sapiens
ccuaauaaaugagcacaug

SEQ ID NO: 1231877 - RNA, 19 nt, Homo sapiens
agaaaagacuggaaaagaa

SEQ ID NO: 1231878 - RNA, 19 nt, Homo sapiens
gagcagaaggcgagggauu

SEQ ID NO: 1231879 - RNA, 19 nt, Homo sapiens
caaagcaguuccaauucca

SEQ ID NO: 1231880 - RNA, 19 nt, Homo sapiens
aggaggaagugcccaguuu

SEQ ID NO: 1231881 - RNA, 19 nt, Homo sapiens
agagucagcccuaauaaau

SEQ ID NO: 1231882 - RNA, 19 nt, Homo sapiens
agaagaaauuacuggcaaa

SEQ ID NO: 1231883 - RNA, 19 nt, Homo sapiens
cagaggagcagaccgcaaa

SEQ ID NO: 1231884 - RNA, 19 nt, Homo sapiens
gauagcuucugucccuuca

SEQ ID NO: 1231885 - RNA, 19 nt, Homo sapiens
uuugaacagugaugaguuu

SEQ ID NO: 1231886 - RNA, 19 nt, Homo sapiens
aagaagcgccagaaguuaa

SEQ ID NO: 1231887 - RNA, 19 nt, Homo sapiens
cggagagucagcccuaaua

SEQ ID NO: 1231888 - RNA, 19 nt, Homo sapiens
aggcugagaugccaccauu

SEQ ID NO: 1231889 - RNA, 19 nt, Homo sapiens
gacaaagcaguuccaauuc

SEQ ID NO: 1231890 - RNA, 19 nt, Homo sapiens
cauccgugcuccugguaaa

SEQ ID NO: 1231891 - RNA, 19 nt, Homo sapiens
gaauuuguccgagauguca

SEQ ID NO: 1231892 - RNA, 19 nt, Homo sapiens
agccucaccuugccacaua

SEQ ID NO: 1231893 - RNA, 19 nt, Homo sapiens
gaaacuugaacagaagaaa

SEQ ID NO: 1231894 - RNA, 19 nt, Homo sapiens
gaagaugaaacuugaacag

SEQ ID NO: 1231895 - RNA, 19 nt, Homo sapiens
gggaaaggaaacccagaaa

SEQ ID NO: 1231896 - RNA, 19 nt, Homo sapiens
guacuuugauagaacuaag

SEQ ID NO: 1231897 - RNA, 19 nt, Homo sapiens
agagacaguuucuaguuag

SEQ ID NO: 1231898 - RNA, 19 nt, Homo sapiens
cgaugaugaugaacacaga

SEQ ID NO: 1231899 - RNA, 19 nt, Homo sapiens
gcacaugcccuggcuguac

SEQ ID NO: 1231900 - RNA, 19 nt, Homo sapiens
caccgaggcccaagaaaga

SEQ ID NO: 1231901 - RNA, 19 nt, Homo sapiens
acagagacaguuucuaguu

SEQ ID NO: 1231902 - RNA, 19 nt, Homo sapiens
aaggaaacccagaaacauu

SEQ ID NO: 1231903 - RNA, 19 nt, Homo sapiens
gaggaagugcccaguuuca

SEQ ID NO: 1231904 - RNA, 19 nt, Homo sapiens
gaacccggacaaagcaguu

SEQ ID NO: 1231905 - RNA, 19 nt, Homo sapiens
gcugugaccagaagggaaa

SEQ ID NO: 1231906 - RNA, 19 nt, Homo sapiens
gaaaagacuggaaaagaau

SEQ ID NO: 1231907 - RNA, 19 nt, Homo sapiens
gcaguuccaauuccagaga

SEQ ID NO: 1231908 - RNA, 19 nt, Homo sapiens
guucaugucacagggauuu

SEQ ID NO: 1231909 - RNA, 19 nt, Homo sapiens
aggaaacccagaaacauuu

SEQ ID NO: 1231910 - RNA, 19 nt, Homo sapiens
gggaaaggcggcuguuugg

SEQ ID NO: 1231911 - RNA, 19 nt, Homo sapiens
gagucagcccuaauaaaug

SEQ ID NO: 1231912 - RNA, 19 nt, Homo sapiens
ggaaaggaaacccagaaac

SEQ ID NO: 1231913 - RNA, 19 nt, Homo sapiens
gcaggaggaccgcuugagu

SEQ ID NO: 1231914 - RNA, 19 nt, Homo sapiens
gagaagagaggcggaacug

SEQ ID NO: 1231915 - RNA, 19 nt, Homo sapiens
gaagaaauuacuggcaaag

SEQ ID NO: 1231916 - RNA, 19 nt, Homo sapiens
caucugugauagcuucugu

SEQ ID NO: 1231917 - RNA, 19 nt, Homo sapiens
uuacuucuguaguguagau

SEQ ID NO: 1231918 - RNA, 19 nt, Homo sapiens
ggacgacagagacaguuuc

SEQ ID NO: 1231919 - RNA, 19 nt, Homo sapiens
aagggaacguuuauuuagu

SEQ ID NO: 1231920 - RNA, 19 nt, Homo sapiens
ggaggaagugcccaguuuc

SEQ ID NO: 1231921 - RNA, 19 nt, Homo sapiens
uagcuucugucccuucauc

SEQ ID NO: 1231922 - RNA, 19 nt, Homo sapiens
ccgcuugaguccagggauu

SEQ ID NO: 1231923 - RNA, 19 nt, Homo sapiens
gcgccuagaaucccagcua

SEQ ID NO: 1231924 - RNA, 19 nt, Homo sapiens
uuacguacuuugauagaac

SEQ ID NO: 1231925 - RNA, 19 nt, Homo sapiens
gagaaggcaccugcagaga

SEQ ID NO: 1231926 - RNA, 19 nt, Homo sapiens
ucgcaaacacucuggagaa

SEQ ID NO: 1231927 - RNA, 19 nt, Homo sapiens
ugaagaacccggacaaagc

SEQ ID NO: 1231928 - RNA, 19 nt, Homo sapiens
cuaaggaaauagugguuuu

SEQ ID NO: 1231929 - RNA, 19 nt, Homo sapiens
aaacgaugaugaugaacac

SEQ ID NO: 1231930 - RNA, 19 nt, Homo sapiens
gugauuucaucccgaagug

SEQ ID NO: 1231931 - RNA, 19 nt, Homo sapiens
accaacagcugugauuuca

SEQ ID NO: 1231932 - RNA, 19 nt, Homo sapiens
cccuguagcaucugugaua

SEQ ID NO: 1231933 - RNA, 19 nt, Homo sapiens
uggaugccauggcugagaa

SEQ ID NO: 1231934 - RNA, 19 nt, Homo sapiens
caccuugccacauauuuga

SEQ ID NO: 1231935 - RNA, 19 nt, Homo sapiens
gaccaccgaggcccaagaa

SEQ ID NO: 1231936 - RNA, 19 nt, Homo sapiens
ugagugaagggaaaggaaa

SEQ ID NO: 1231937 - RNA, 19 nt, Homo sapiens
ggaaauagugguuuugagu

SEQ ID NO: 1231938 - RNA, 19 nt, Homo sapiens
ccacagccucugccuggaa

SEQ ID NO: 1231939 - RNA, 19 nt, Homo sapiens
gaggaggaagugcccaguu

SEQ ID NO: 1231940 - RNA, 19 nt, Homo sapiens
cagaauuuguccgagaugu

SEQ ID NO: 1231941 - RNA, 19 nt, Homo sapiens
acaaagcaguuccaauucc

SEQ ID NO: 1231942 - RNA, 19 nt, Homo sapiens
ucugagcccuguagcaucu

SEQ ID NO: 1231943 - RNA, 19 nt, Homo sapiens
ggacugaagacacauuacg

SEQ ID NO: 1231944 - RNA, 19 nt, Homo sapiens
ucaccuugccacauauuug

SEQ ID NO: 1231945 - RNA, 19 nt, Homo sapiens
gaagggaaaggcggcuguu

SEQ ID NO: 1231946 - RNA, 19 nt, Homo sapiens
ccaccgaggcccaagaaag

SEQ ID NO: 1231947 - RNA, 19 nt, Homo sapiens
cacaugcccuggcuguaca

SEQ ID NO: 1231948 - RNA, 19 nt, Homo sapiens
gaugucauggguucaagug

SEQ ID NO: 1231949 - RNA, 19 nt, Homo sapiens
cacagaagaugguauauua

SEQ ID NO: 1231950 - RNA, 19 nt, Homo sapiens
ggaauuugcugaugaagaa

SEQ ID NO: 1231951 - RNA, 19 nt, Homo sapiens
aaacagagauuccucagaa

SEQ ID NO: 1231952 - RNA, 19 nt, Homo sapiens
cagaauaacuccaagaaau

SEQ ID NO: 1231953 - RNA, 19 nt, Homo sapiens
caagagacaugauggaguu

SEQ ID NO: 1231954 - RNA, 19 nt, Homo sapiens
ccaaaccacuuucuccuuu

SEQ ID NO: 1231955 - RNA, 19 nt, Homo sapiens
gaaauagagagucacauaa

SEQ ID NO: 1231956 - RNA, 19 nt, Homo sapiens
gaugguauauuaugggaaa

SEQ ID NO: 1231957 - RNA, 19 nt, Homo sapiens
uaagugaagucaugucuau

SEQ ID NO: 1231958 - RNA, 19 nt, Homo sapiens
guucagcgcuuacaagaga

SEQ ID NO: 1231959 - RNA, 19 nt, Homo sapiens
caaaccacuuucuccuuua

SEQ ID NO: 1231960 - RNA, 19 nt, Homo sapiens
gaagucaugucuauaagag

SEQ ID NO: 1231961 - RNA, 19 nt, Homo sapiens
gagccaguguggaugguua

SEQ ID NO: 1231962 - RNA, 19 nt, Homo sapiens
ucacaacggauuacaauuu

SEQ ID NO: 1231963 - RNA, 19 nt, Homo sapiens
guucuagucuucuguguga

SEQ ID NO: 1231964 - RNA, 19 nt, Homo sapiens
ugaguucacuggacauaaa

SEQ ID NO: 1231965 - RNA, 19 nt, Homo sapiens
cuaaaugaauccacagcua

SEQ ID NO: 1231966 - RNA, 19 nt, Homo sapiens
ggaggcacauaaagagaaa

SEQ ID NO: 1231967 - RNA, 19 nt, Homo sapiens
ccagaaagcuuugucucaa

SEQ ID NO: 1231968 - RNA, 19 nt, Homo sapiens
guucagcucuuuucaguua

SEQ ID NO: 1231969 - RNA, 19 nt, Homo sapiens
gauaccugauuaaccauuu

SEQ ID NO: 1231970 - RNA, 19 nt, Homo sapiens
cggccuaggucauuuguuu

SEQ ID NO: 1231971 - RNA, 19 nt, Homo sapiens
gcacaccuguaaucccaaa

SEQ ID NO: 1231972 - RNA, 19 nt, Homo sapiens
agaaauagagagucacaua

SEQ ID NO: 1231973 - RNA, 19 nt, Homo sapiens
ggagggaugcagaaacuaa

SEQ ID NO: 1231974 - RNA, 19 nt, Homo sapiens
gcucugaccacaguaaaua

SEQ ID NO: 1231975 - RNA, 19 nt, Homo sapiens
ugggaaaccuucuuguaaa

SEQ ID NO: 1231976 - RNA, 19 nt, Homo sapiens
gguuacagcccauccauuu

SEQ ID NO: 1231977 - RNA, 19 nt, Homo sapiens
gcagaugcuuuggaauuug

SEQ ID NO: 1231978 - RNA, 19 nt, Homo sapiens
caccauagauaacccauuc

SEQ ID NO: 1231979 - RNA, 19 nt, Homo sapiens
ugcaggaucucgagcauaa

SEQ ID NO: 1231980 - RNA, 19 nt, Homo sapiens
ugacauggauggcuuguac

SEQ ID NO: 1231981 - RNA, 19 nt, Homo sapiens
guacuuggucuguuauauu

SEQ ID NO: 1231982 - RNA, 19 nt, Homo sapiens
guagaggcauugacaugga

SEQ ID NO: 1231983 - RNA, 19 nt, Homo sapiens
acagcaggcuuugauuaua

SEQ ID NO: 1231984 - RNA, 19 nt, Homo sapiens
gcaagaccaagaugagaaa

SEQ ID NO: 1231985 - RNA, 19 nt, Homo sapiens
gauaacccauuccugaaag

SEQ ID NO: 1231986 - RNA, 19 nt, Homo sapiens
gcagucgcacuccggauua

SEQ ID NO: 1231987 - RNA, 19 nt, Homo sapiens
cagaugaacuuuuguauca

SEQ ID NO: 1231988 - RNA, 19 nt, Homo sapiens
gcuagccucugaugagaug

SEQ ID NO: 1231989 - RNA, 19 nt, Homo sapiens
cagcaggcuuugauuauag

SEQ ID NO: 1231990 - RNA, 19 nt, Homo sapiens
agacagcaggcuuugauua

SEQ ID NO: 1231991 - RNA, 19 nt, Homo sapiens
ggauaagacagcaggcuuu

SEQ ID NO: 1231992 - RNA, 19 nt, Homo sapiens
caugaauggugcccuuauu

SEQ ID NO: 1231993 - RNA, 19 nt, Homo sapiens
gaccuaaguucugucgaaa

SEQ ID NO: 1231994 - RNA, 19 nt, Homo sapiens
gguugcauuucuuugcuua

SEQ ID NO: 1231995 - RNA, 19 nt, Homo sapiens
guguguagcuagccucuga

SEQ ID NO: 1231996 - RNA, 19 nt, Homo sapiens
gauuauagagcucugaguu

SEQ ID NO: 1231997 - RNA, 19 nt, Homo sapiens
ccaaagugcugggauuaca

SEQ ID NO: 1231998 - RNA, 19 nt, Homo sapiens
ucgugaaugucauauagua

SEQ ID NO: 1231999 - RNA, 19 nt, Homo sapiens
ugaauggugcccuuauuaa

SEQ ID NO: 1232000 - RNA, 19 nt, Homo sapiens
gagacaugauggaguuuca

SEQ ID NO: 1232001 - RNA, 19 nt, Homo sapiens
gaauaacuccaagaaauag

SEQ ID NO: 1232002 - RNA, 19 nt, Homo sapiens
ugauagguguuuauacaga

SEQ ID NO: 1232003 - RNA, 19 nt, Homo sapiens
ccacggccaccauagauaa

SEQ ID NO: 1232004 - RNA, 19 nt, Homo sapiens
uaaacuuccuggagcauca

SEQ ID NO: 1232005 - RNA, 19 nt, Homo sapiens
auagauaccugauuaacca

SEQ ID NO: 1232006 - RNA, 19 nt, Homo sapiens
gguguaacuuggaggaaga

SEQ ID NO: 1232007 - RNA, 19 nt, Homo sapiens
ggaccugguuauuagaauc

SEQ ID NO: 1232008 - RNA, 19 nt, Homo sapiens
agaccuaaguucugucgaa

SEQ ID NO: 1232009 - RNA, 19 nt, Homo sapiens
gacagcaggcuuugauuau

SEQ ID NO: 1232010 - RNA, 19 nt, Homo sapiens
gcaagaucauggauaagac

SEQ ID NO: 1232011 - RNA, 19 nt, Homo sapiens
ggucuguuauauucaauca

SEQ ID NO: 1232012 - RNA, 19 nt, Homo sapiens
gcuauugccauuccacauu

SEQ ID NO: 1232013 - RNA, 19 nt, Homo sapiens
aaauauaugccagaccuua

SEQ ID NO: 1232014 - RNA, 19 nt, Homo sapiens
cagaagaugguauauuaug

SEQ ID NO: 1232015 - RNA, 19 nt, Homo sapiens
guuaacagaugaacuuuug

SEQ ID NO: 1232016 - RNA, 19 nt, Homo sapiens
ggaugcagaaacuaaauga

SEQ ID NO: 1232017 - RNA, 19 nt, Homo sapiens
gagcuaaggaccgugaauu

SEQ ID NO: 1232018 - RNA, 19 nt, Homo sapiens
acugauagguguuuauaca

SEQ ID NO: 1232019 - RNA, 19 nt, Homo sapiens
ugcaugagcuagaauuugu

SEQ ID NO: 1232020 - RNA, 19 nt, Homo sapiens
ccacagaagaugguauauu

SEQ ID NO: 1232021 - RNA, 19 nt, Homo sapiens
auagagcucugaguucaaa

SEQ ID NO: 1232022 - RNA, 19 nt, Homo sapiens
uuauagagcucugaguuca

SEQ ID NO: 1232023 - RNA, 19 nt, Homo sapiens
gaacaguuugugugccauu

SEQ ID NO: 1232024 - RNA, 19 nt, Homo sapiens
gagaaaccauaccgaagac

SEQ ID NO: 1232025 - RNA, 19 nt, Homo sapiens
uaucaggucccuuucaaug

SEQ ID NO: 1232026 - RNA, 19 nt, Homo sapiens
uaagacagcaggcuuugau

SEQ ID NO: 1232027 - RNA, 19 nt, Homo sapiens
gcacauaaagagaaaccau

SEQ ID NO: 1232028 - RNA, 19 nt, Homo sapiens
cacuggacauaaacugaua

SEQ ID NO: 1232029 - RNA, 19 nt, Homo sapiens
gggaaaccuucuuguaaaa

SEQ ID NO: 1232030 - RNA, 19 nt, Homo sapiens
ggcaagaucauggauaaga

SEQ ID NO: 1232031 - RNA, 19 nt, Homo sapiens
agagauuccucagaaaguu

SEQ ID NO: 1232032 - RNA, 19 nt, Homo sapiens
caguuugugugccauuaaa

SEQ ID NO: 1232033 - RNA, 19 nt, Homo sapiens
ccgaagaccuaaguucugu

SEQ ID NO: 1232034 - RNA, 19 nt, Homo sapiens
agagaaaccauaccgaaga

SEQ ID NO: 1232035 - RNA, 19 nt, Homo sapiens
cguuggagcuauugccauu

SEQ ID NO: 1232036 - RNA, 19 nt, Homo sapiens
uaaggaccgugaauugucu

SEQ ID NO: 1232037 - RNA, 19 nt, Homo sapiens
ccuaucaggucccuuucaa

SEQ ID NO: 1232038 - RNA, 19 nt, Homo sapiens
aauagagagucacauaaca

SEQ ID NO: 1232039 - RNA, 19 nt, Homo sapiens
ugcagaugcuuuggaauuu

SEQ ID NO: 1232040 - RNA, 19 nt, Homo sapiens
gauggcaagaucauggaua

SEQ ID NO: 1232041 - RNA, 19 nt, Homo sapiens
ccacuuucuccuuuacaua

SEQ ID NO: 1232042 - RNA, 19 nt, Homo sapiens
caagcuuccuguggucaaa

SEQ ID NO: 1232043 - RNA, 19 nt, Homo sapiens
ccacagcuacuuacucauc

SEQ ID NO: 1232044 - RNA, 19 nt, Homo sapiens
aggaguaagugaagucaug

SEQ ID NO: 1232045 - RNA, 19 nt, Homo sapiens
gauaagacagcaggcuuug

SEQ ID NO: 1232046 - RNA, 19 nt, Homo sapiens
aguuguacuuggucuguua

SEQ ID NO: 1232047 - RNA, 19 nt, Homo sapiens
uaugggaaaccuucuugua

SEQ ID NO: 1232048 - RNA, 19 nt, Homo sapiens
cagaaagcuuugucucaag

SEQ ID NO: 1232049 - RNA, 19 nt, Homo sapiens
gaaaucagcucgagacaug

SEQ ID NO: 1232050 - RNA, 19 nt, Homo sapiens
gcacagagaugaacaagau

SEQ ID NO: 1232051 - RNA, 19 nt, Homo sapiens
agaaaucgcuuguguuuga

SEQ ID NO: 1232052 - RNA, 19 nt, Homo sapiens
ccaaguagcugggacuaua

SEQ ID NO: 1232053 - RNA, 19 nt, Homo sapiens
caucacaucuggcuaguuu

SEQ ID NO: 1232054 - RNA, 19 nt, Homo sapiens
gcagaaaucgcuuguguuu

SEQ ID NO: 1232055 - RNA, 19 nt, Homo sapiens
aaagauaaguuccugauuc

SEQ ID NO: 1232056 - RNA, 19 nt, Homo sapiens
gcacucaugucacaaagau

SEQ ID NO: 1232057 - RNA, 19 nt, Homo sapiens
gaaccaagcccucuucauc

SEQ ID NO: 1232058 - RNA, 19 nt, Homo sapiens
gaagaaugguugacugagu

SEQ ID NO: 1232059 - RNA, 19 nt, Homo sapiens
gugaagaguuuguaccauu

SEQ ID NO: 1232060 - RNA, 19 nt, Homo sapiens
ugacugaguuugauucuuc

SEQ ID NO: 1232061 - RNA, 19 nt, Homo sapiens
aggcagagguucagaugua

SEQ ID NO: 1232062 - RNA, 19 nt, Homo sapiens
ggacugggaccucaucuau

SEQ ID NO: 1232063 - RNA, 19 nt, Homo sapiens
gacgaggucuucaugauca

SEQ ID NO: 1232064 - RNA, 19 nt, Homo sapiens
gaaugaggcauaauuguuc

SEQ ID NO: 1232065 - RNA, 19 nt, Homo sapiens
ccaguuggguugaagaaug

SEQ ID NO: 1232066 - RNA, 19 nt, Homo sapiens
gggaacuucucacucauug

SEQ ID NO: 1232067 - RNA, 19 nt, Homo sapiens
uaagaugcuucuauccauu

SEQ ID NO: 1232068 - RNA, 19 nt, Homo sapiens
gcgcacaccugccuacauc

SEQ ID NO: 1232069 - RNA, 19 nt, Homo sapiens
caagaucgguuccuucacu

SEQ ID NO: 1232070 - RNA, 19 nt, Homo sapiens
gcacacaggcagcauuaau

SEQ ID NO: 1232071 - RNA, 19 nt, Homo sapiens
augcaagguucccauguua

SEQ ID NO: 1232072 - RNA, 19 nt, Homo sapiens
gacuacaccugguccuuug

SEQ ID NO: 1232073 - RNA, 19 nt, Homo sapiens
ggaggaguacggauucuug

SEQ ID NO: 1232074 - RNA, 19 nt, Homo sapiens
aagaaugguugacugaguu

SEQ ID NO: 1232075 - RNA, 19 nt, Homo sapiens
ugaaugaggcauaauuguu

SEQ ID NO: 1232076 - RNA, 19 nt, Homo sapiens
gaacaaugagcacgucaag

SEQ ID NO: 1232077 - RNA, 19 nt, Homo sapiens
gcacuagugauacacauuc

SEQ ID NO: 1232078 - RNA, 19 nt, Homo sapiens
ugaagaguuuguaccauuc

SEQ ID NO: 1232079 - RNA, 19 nt, Homo sapiens
aaauguuccugguugguuu

SEQ ID NO: 1232080 - RNA, 19 nt, Homo sapiens
caagacaccggacaagaug

SEQ ID NO: 1232081 - RNA, 19 nt, Homo sapiens
cgagacaugugggcugauu

SEQ ID NO: 1232082 - RNA, 19 nt, Homo sapiens
ugaugaaguugcucuguuc

SEQ ID NO: 1232083 - RNA, 19 nt, Homo sapiens
gaguuugauucuuccugua

SEQ ID NO: 1232084 - RNA, 19 nt, Homo sapiens
gaaugggaguaaacaaggu

SEQ ID NO: 1232085 - RNA, 19 nt, Homo sapiens
cugggaauauugagauaaa

SEQ ID NO: 1232086 - RNA, 19 nt, Homo sapiens
guucaugugcccagcauuu

SEQ ID NO: 1232087 - RNA, 19 nt, Homo sapiens
gugcacacaggcagcauua

SEQ ID NO: 1232088 - RNA, 19 nt, Homo sapiens
ggacgaggaaggcccgaaa

SEQ ID NO: 1232089 - RNA, 19 nt, Homo sapiens
ugugggaacuucucacuca

SEQ ID NO: 1232090 - RNA, 19 nt, Homo sapiens
ggcagugaaugaggcauaa

SEQ ID NO: 1232091 - RNA, 19 nt, Homo sapiens
caagagacgucugaugaac

SEQ ID NO: 1232092 - RNA, 19 nt, Homo sapiens
ugccacaaguguuuauuga

SEQ ID NO: 1232093 - RNA, 19 nt, Homo sapiens
caagguacuuuucacuuuu

SEQ ID NO: 1232094 - RNA, 19 nt, Homo sapiens
uaugcaagguucccauguu

SEQ ID NO: 1232095 - RNA, 19 nt, Homo sapiens
cugcagaaaucgcuugugu

SEQ ID NO: 1232096 - RNA, 19 nt, Homo sapiens
gaaacacuggucugacuca

SEQ ID NO: 1232097 - RNA, 19 nt, Homo sapiens
acugggaccucaucuaugu

SEQ ID NO: 1232098 - RNA, 19 nt, Homo sapiens
ccaagacaccggacaagau

SEQ ID NO: 1232099 - RNA, 19 nt, Homo sapiens
caaagauaaguuccugauu

SEQ ID NO: 1232100 - RNA, 19 nt, Homo sapiens
caagcccucuucaucuguu

SEQ ID NO: 1232101 - RNA, 19 nt, Homo sapiens
gcacucgaccuuccugauc

SEQ ID NO: 1232102 - RNA, 19 nt, Homo sapiens
ggaugggaaugggaguaaa

SEQ ID NO: 1232103 - RNA, 19 nt, Homo sapiens
acucaugucacaaagauaa

SEQ ID NO: 1232104 - RNA, 19 nt, Homo sapiens
ccaaagugcuaggguuaca

SEQ ID NO: 1232105 - RNA, 19 nt, Homo sapiens
caaccugcaugccuucucu

SEQ ID NO: 1232106 - RNA, 19 nt, Homo sapiens
gcaggcagagguucagaug

SEQ ID NO: 1232107 - RNA, 19 nt, Homo sapiens
cugauuacauccuguuugu

SEQ ID NO: 1232108 - RNA, 19 nt, Homo sapiens
gaacuccugaccucaagug

SEQ ID NO: 1232109 - RNA, 19 nt, Homo sapiens
acagcacccuccaggauga

SEQ ID NO: 1232110 - RNA, 19 nt, Homo sapiens
agcaagggcuggaggaguu

SEQ ID NO: 1232111 - RNA, 19 nt, Homo sapiens
guaggacauuucccagcaa

SEQ ID NO: 1232112 - RNA, 19 nt, Homo sapiens
uuggugggaucauguguuu

SEQ ID NO: 1232113 - RNA, 19 nt, Homo sapiens
ccucacagacucccaguug

SEQ ID NO: 1232114 - RNA, 19 nt, Homo sapiens
gaggaaggcccgaaacacu

SEQ ID NO: 1232115 - RNA, 19 nt, Homo sapiens
gcccagcauuuauuaagca

SEQ ID NO: 1232116 - RNA, 19 nt, Homo sapiens
ccacagcacccuccaggau

SEQ ID NO: 1232117 - RNA, 19 nt, Homo sapiens
gcaagcaggcagagguuca

SEQ ID NO: 1232118 - RNA, 19 nt, Homo sapiens
caacuucugguguggaaug

SEQ ID NO: 1232119 - RNA, 19 nt, Homo sapiens
agaugcuucuauccauuua

SEQ ID NO: 1232120 - RNA, 19 nt, Homo sapiens
guccagcaauucuuguuuc

SEQ ID NO: 1232121 - RNA, 19 nt, Homo sapiens
gagacaugugggcugauua

SEQ ID NO: 1232122 - RNA, 19 nt, Homo sapiens
ucaagagacgucugaugaa

SEQ ID NO: 1232123 - RNA, 19 nt, Homo sapiens
cagccugaaucgaauguca

SEQ ID NO: 1232124 - RNA, 19 nt, Homo sapiens
gucccugccugcuugauga

SEQ ID NO: 1232125 - RNA, 19 nt, Homo sapiens
caaaagagugugacaguug

SEQ ID NO: 1232126 - RNA, 19 nt, Homo sapiens
gcauaauuguucccuccau

SEQ ID NO: 1232127 - RNA, 19 nt, Homo sapiens
ccgaaacacuggucugacu

SEQ ID NO: 1232128 - RNA, 19 nt, Homo sapiens
ccagccagcucuugcuaag

SEQ ID NO: 1232129 - RNA, 19 nt, Homo sapiens
caaggaggaguacggauuc

SEQ ID NO: 1232130 - RNA, 19 nt, Homo sapiens
cuucaugccacaaguguuu

SEQ ID NO: 1232131 - RNA, 19 nt, Homo sapiens
acaagguacuuuucacuuu

SEQ ID NO: 1232132 - RNA, 19 nt, Homo sapiens
ucagucguauggaacaaug

SEQ ID NO: 1232133 - RNA, 19 nt, Homo sapiens
agaccucagucguauggaa

SEQ ID NO: 1232134 - RNA, 19 nt, Homo sapiens
acaaggaggaguacggauu

SEQ ID NO: 1232135 - RNA, 19 nt, Homo sapiens
ugacuacaccugguccuuu

SEQ ID NO: 1232136 - RNA, 19 nt, Homo sapiens
cggacaaccugauccucaa

SEQ ID NO: 1232137 - RNA, 19 nt, Homo sapiens
cuagugauacacauucauu

SEQ ID NO: 1232138 - RNA, 19 nt, Homo sapiens
caccgagaccucagucgua

SEQ ID NO: 1232139 - RNA, 19 nt, Homo sapiens
gggaaugggaguaaacaag

SEQ ID NO: 1232140 - RNA, 19 nt, Homo sapiens
auaagaugcuucuauccau

SEQ ID NO: 1232141 - RNA, 19 nt, Homo sapiens
gaaaucgcuuguguuugag

SEQ ID NO: 1232142 - RNA, 19 nt, Homo sapiens
ggcagagguucagauguau

SEQ ID NO: 1232143 - RNA, 19 nt, Homo sapiens
gggaugggaaugggaguaa

SEQ ID NO: 1232144 - RNA, 19 nt, Homo sapiens
aagauaaguuccugauucg

SEQ ID NO: 1232145 - RNA, 19 nt, Homo sapiens
ggaacaaugagcacgucaa

SEQ ID NO: 1232146 - RNA, 19 nt, Homo sapiens
ggagacgauggcuauguga

SEQ ID NO: 1232147 - RNA, 19 nt, Homo sapiens
cacaggagacgauggcuau

SEQ ID NO: 1232148 - RNA, 19 nt, Homo sapiens
uaaauguuccugguugguu

SEQ ID NO: 1232149 - RNA, 19 nt, Homo sapiens
gaagaaggcuccagaauga

SEQ ID NO: 1232150 - RNA, 19 nt, Homo sapiens
aaaccuaccuucacaaaua

SEQ ID NO: 1232151 - RNA, 19 nt, Homo sapiens
gaaaugggaccuaaauuaa

SEQ ID NO: 1232152 - RNA, 19 nt, Homo sapiens
guacagauaugacauggaa

SEQ ID NO: 1232153 - RNA, 19 nt, Homo sapiens
gcaagaaacacauggguua

SEQ ID NO: 1232154 - RNA, 19 nt, Homo sapiens
agagagagcuggaagaauu

SEQ ID NO: 1232155 - RNA, 19 nt, Homo sapiens
gcacaaccauaaacaaaga

SEQ ID NO: 1232156 - RNA, 19 nt, Homo sapiens
gagcaaagcuaagaaacaa

SEQ ID NO: 1232157 - RNA, 19 nt, Homo sapiens
ggagaaagaggccaguuua

SEQ ID NO: 1232158 - RNA, 19 nt, Homo sapiens
guaacaaucucguuggaaa

SEQ ID NO: 1232159 - RNA, 19 nt, Homo sapiens
gaaagaggccaguuuaaau

SEQ ID NO: 1232160 - RNA, 19 nt, Homo sapiens
gaacagccaugauaaaucg

SEQ ID NO: 1232161 - RNA, 19 nt, Homo sapiens
gaagccaucuugaacuauu

SEQ ID NO: 1232162 - RNA, 19 nt, Homo sapiens
uaaauaggcuuucaagagu

SEQ ID NO: 1232163 - RNA, 19 nt, Homo sapiens
ggaaagaaccaaagaggaa

SEQ ID NO: 1232164 - RNA, 19 nt, Homo sapiens
gagcgaaggucauaauaca

SEQ ID NO: 1232165 - RNA, 19 nt, Homo sapiens
gaacaagaacucauugaug

SEQ ID NO: 1232166 - RNA, 19 nt, Homo sapiens
ucaagaaaguccaacauga

SEQ ID NO: 1232167 - RNA, 19 nt, Homo sapiens
agaaauggcuggauugaau

SEQ ID NO: 1232168 - RNA, 19 nt, Homo sapiens
gauccucacuguucaagaa

SEQ ID NO: 1232169 - RNA, 19 nt, Homo sapiens
agaaaugggaccuaaauua

SEQ ID NO: 1232170 - RNA, 19 nt, Homo sapiens
gauauguggucuauuguau

SEQ ID NO: 1232171 - RNA, 19 nt, Homo sapiens
gaaaguccaacaugaauug

SEQ ID NO: 1232172 - RNA, 19 nt, Homo sapiens
gaagccaacucguggagaa

SEQ ID NO: 1232173 - RNA, 19 nt, Homo sapiens
gaacauccgcagaaauaaa

SEQ ID NO: 1232174 - RNA, 19 nt, Homo sapiens
gacaacaccuucucuagau

SEQ ID NO: 1232175 - RNA, 19 nt, Homo sapiens
uaaaugcccuugcccagaa

SEQ ID NO: 1232176 - RNA, 19 nt, Homo sapiens
gaaggugacuacccagaug

SEQ ID NO: 1232177 - RNA, 19 nt, Homo sapiens
caccaucucuucaacuuaa

SEQ ID NO: 1232178 - RNA, 19 nt, Homo sapiens
agacauggguucaguguga

SEQ ID NO: 1232179 - RNA, 19 nt, Homo sapiens
caaauaagcaggugagaau

SEQ ID NO: 1232180 - RNA, 19 nt, Homo sapiens
caacugagugguacagaua

SEQ ID NO: 1232181 - RNA, 19 nt, Homo sapiens
gaagaaagcagaucaccau

SEQ ID NO: 1232182 - RNA, 19 nt, Homo sapiens
gcacucguguucucauuug

SEQ ID NO: 1232183 - RNA, 19 nt, Homo sapiens
aaagaggccaguuuaaaua

SEQ ID NO: 1232184 - RNA, 19 nt, Homo sapiens
gaaauggcuggauugaaua

SEQ ID NO: 1232185 - RNA, 19 nt, Homo sapiens
ccaaagauccucacuguuc

SEQ ID NO: 1232186 - RNA, 19 nt, Homo sapiens
cauaacaaccgacucauaa

SEQ ID NO: 1232187 - RNA, 19 nt, Homo sapiens
gauaugacauggaagaucu

SEQ ID NO: 1232188 - RNA, 19 nt, Homo sapiens
ccauucagcugaucccuuu

SEQ ID NO: 1232189 - RNA, 19 nt, Homo sapiens
caacaccuucucuagauua

SEQ ID NO: 1232190 - RNA, 19 nt, Homo sapiens
caagaauaguaaccaguuu

SEQ ID NO: 1232191 - RNA, 19 nt, Homo sapiens
ccaagagccuggccaaugu

SEQ ID NO: 1232192 - RNA, 19 nt, Homo sapiens
gaauagggagguuucaauu

SEQ ID NO: 1232193 - RNA, 19 nt, Homo sapiens
uagaagccaucuugaacua

SEQ ID NO: 1232194 - RNA, 19 nt, Homo sapiens
gaccugaaagcuuuaauuu

SEQ ID NO: 1232195 - RNA, 19 nt, Homo sapiens
gaucggguaugacucagaa

SEQ ID NO: 1232196 - RNA, 19 nt, Homo sapiens
caagauugguggcagaaga

SEQ ID NO: 1232197 - RNA, 19 nt, Homo sapiens
guaggacuaugguugauau

SEQ ID NO: 1232198 - RNA, 19 nt, Homo sapiens
agagggagaugaccuagaa

SEQ ID NO: 1232199 - RNA, 19 nt, Homo sapiens
caagaaaguccaacaugaa

SEQ ID NO: 1232200 - RNA, 19 nt, Homo sapiens
ggagaacagccaugauaaa

SEQ ID NO: 1232201 - RNA, 19 nt, Homo sapiens
uggagaagguguaggagua

SEQ ID NO: 1232202 - RNA, 19 nt, Homo sapiens
ggagaaagcaagaggcuau

SEQ ID NO: 1232203 - RNA, 19 nt, Homo sapiens
caccaaagauccucacugu

SEQ ID NO: 1232204 - RNA, 19 nt, Homo sapiens
gcaagaauaguaaccaguu

SEQ ID NO: 1232205 - RNA, 19 nt, Homo sapiens
ggacuaugguugauauuuu

SEQ ID NO: 1232206 - RNA, 19 nt, Homo sapiens
caaucucguuggaaacaua

SEQ ID NO: 1232207 - RNA, 19 nt, Homo sapiens
agaagaagaugccuaugga

SEQ ID NO: 1232208 - RNA, 19 nt, Homo sapiens
gaagguuccugaccagaca

SEQ ID NO: 1232209 - RNA, 19 nt, Homo sapiens
gaaggcaccacaccagaaa

SEQ ID NO: 1232210 - RNA, 19 nt, Homo sapiens
gagaaagaggccaguuuaa

SEQ ID NO: 1232211 - RNA, 19 nt, Homo sapiens
uguaaauccuggcucauaa

SEQ ID NO: 1232212 - RNA, 19 nt, Homo sapiens
caacuuaagccucuggauu

SEQ ID NO: 1232213 - RNA, 19 nt, Homo sapiens
caaagauccucacuguuca

SEQ ID NO: 1232214 - RNA, 19 nt, Homo sapiens
gcaaagcuaagaaacaaga

SEQ ID NO: 1232215 - RNA, 19 nt, Homo sapiens
uggaacauccgcagaaaua

SEQ ID NO: 1232216 - RNA, 19 nt, Homo sapiens
ggaggcaaaucacauacug

SEQ ID NO: 1232217 - RNA, 19 nt, Homo sapiens
cacgucagcuaucuccuua

SEQ ID NO: 1232218 - RNA, 19 nt, Homo sapiens
aaucugaguuggacuuuga

SEQ ID NO: 1232219 - RNA, 19 nt, Homo sapiens
ucucuuaucuucugucugu

SEQ ID NO: 1232220 - RNA, 19 nt, Homo sapiens
ucagcuaucuccuuacuuc

SEQ ID NO: 1232221 - RNA, 19 nt, Homo sapiens
gaaagaaccaaagaggaaa

SEQ ID NO: 1232222 - RNA, 19 nt, Homo sapiens
cauaauacaccaaaguuga

SEQ ID NO: 1232223 - RNA, 19 nt, Homo sapiens
gaggagagcgaaggucaua

SEQ ID NO: 1232224 - RNA, 19 nt, Homo sapiens
ggaacccagugccuuauuc

SEQ ID NO: 1232225 - RNA, 19 nt, Homo sapiens
agagguagcacaaccauaa

SEQ ID NO: 1232226 - RNA, 19 nt, Homo sapiens
aagaucagaugccaagauu

SEQ ID NO: 1232227 - RNA, 19 nt, Homo sapiens
uaaaucgaguucugagaga

SEQ ID NO: 1232228 - RNA, 19 nt, Homo sapiens
gagaacagccaugauaaau

SEQ ID NO: 1232229 - RNA, 19 nt, Homo sapiens
gaugaagaccugugcuuga

SEQ ID NO: 1232230 - RNA, 19 nt, Homo sapiens
gaguaccggcuaacaauaa

SEQ ID NO: 1232231 - RNA, 19 nt, Homo sapiens
gagcauggccacacuguca

SEQ ID NO: 1232232 - RNA, 19 nt, Homo sapiens
guuggaaacauaagacaua

SEQ ID NO: 1232233 - RNA, 19 nt, Homo sapiens
cuggauauguggucuauug

SEQ ID NO: 1232234 - RNA, 19 nt, Homo sapiens
ccaaagguguuagagauuc

SEQ ID NO: 1232235 - RNA, 19 nt, Homo sapiens
cgaagaaggcuccagaaug

SEQ ID NO: 1232236 - RNA, 19 nt, Homo sapiens
ggaguaccggcuaacaaua

SEQ ID NO: 1232237 - RNA, 19 nt, Homo sapiens
uaaccaguuuggaauaaug

SEQ ID NO: 1232238 - RNA, 19 nt, Homo sapiens
gauauuggguccgguauac

SEQ ID NO: 1232239 - RNA, 19 nt, Homo sapiens
cauccugguuucagacuuu

SEQ ID NO: 1232240 - RNA, 19 nt, Homo sapiens
aaagagaaacugaaggaaa

SEQ ID NO: 1232241 - RNA, 19 nt, Homo sapiens
caacaugaauuggugaucu

SEQ ID NO: 1232242 - RNA, 19 nt, Homo sapiens
acaagacaauuggauauga

SEQ ID NO: 1232243 - RNA, 19 nt, Homo sapiens
gcaagaugguuuuguuauu

SEQ ID NO: 1232244 - RNA, 19 nt, Homo sapiens
caaagaagaagucaacaag

SEQ ID NO: 1232245 - RNA, 19 nt, Homo sapiens
uuagaucaaucagcagaua

SEQ ID NO: 1232246 - RNA, 19 nt, Homo sapiens
ggauauguggucuauugua

SEQ ID NO: 1232247 - RNA, 19 nt, Homo sapiens
caauaugacauccugguuu

SEQ ID NO: 1232248 - RNA, 19 nt, Homo sapiens
gaauuggugaucuacagua

SEQ ID NO: 1232249 - RNA, 19 nt, Homo sapiens
gcuaugcccuggagaauuu

SEQ ID NO: 1232250 - RNA, 19 nt, Homo sapiens
gcauuucgcuguacaaguu

SEQ ID NO: 1232251 - RNA, 19 nt, Homo sapiens
ggagguagcuagaaaugug

SEQ ID NO: 1232252 - RNA, 19 nt, Homo sapiens
ggagugcccucaccugaau

SEQ ID NO: 1232253 - RNA, 19 nt, Homo sapiens
ggaagaagaggaugacuca

SEQ ID NO: 1232254 - RNA, 19 nt, Homo sapiens
gcaaggccuuacugaagaa

SEQ ID NO: 1232255 - RNA, 19 nt, Homo sapiens
gcacaaggccugucaaagc

SEQ ID NO: 1232256 - RNA, 19 nt, Homo sapiens
ggaccaggauucagaagag

SEQ ID NO: 1232257 - RNA, 19 nt, Homo sapiens
gagcaaggccuuacugaag

SEQ ID NO: 1232258 - RNA, 19 nt, Homo sapiens
gcauugugccucaguauga

SEQ ID NO: 1232259 - RNA, 19 nt, Homo sapiens
ggaugaggauguggaagaa

SEQ ID NO: 1232260 - RNA, 19 nt, Homo sapiens
cagccuauuugcagccuua

SEQ ID NO: 1232261 - RNA, 19 nt, Homo sapiens
gaggaagaguuggagauug

SEQ ID NO: 1232262 - RNA, 19 nt, Homo sapiens
gugaggcccuugaggcuuu

SEQ ID NO: 1232263 - RNA, 19 nt, Homo sapiens
cuacuucccugccaucaug

SEQ ID NO: 1232264 - RNA, 19 nt, Homo sapiens
aggaagaguuggagauuga

SEQ ID NO: 1232265 - RNA, 19 nt, Homo sapiens
ugacggcccugcagagaga

SEQ ID NO: 1232266 - RNA, 19 nt, Homo sapiens
ucucugaaguccucacauu

SEQ ID NO: 1232267 - RNA, 19 nt, Homo sapiens
guacugggccucuccuaga

SEQ ID NO: 1232268 - RNA, 19 nt, Homo sapiens
gcuccuuccuucuguuuga

SEQ ID NO: 1232269 - RNA, 19 nt, Homo sapiens
ugaauacgacgccauguug

SEQ ID NO: 1232270 - RNA, 19 nt, Homo sapiens
gaggaugacucagagaucu

SEQ ID NO: 1232271 - RNA, 19 nt, Homo sapiens
ggaagaggaagaugaugau

SEQ ID NO: 1232272 - RNA, 19 nt, Homo sapiens
ggaggaagaggaagaugau

SEQ ID NO: 1232273 - RNA, 19 nt, Homo sapiens
gguagacgacgcugacuug

SEQ ID NO: 1232274 - RNA, 19 nt, Homo sapiens
ugacguuccuggccaaaca

SEQ ID NO: 1232275 - RNA, 19 nt, Homo sapiens
caccaaggccgcacuguug

SEQ ID NO: 1232276 - RNA, 19 nt, Homo sapiens
ucagagaucucaggguaca

SEQ ID NO: 1232277 - RNA, 19 nt, Homo sapiens
ggcuuuggaugaacuguug

SEQ ID NO: 1232278 - RNA, 19 nt, Homo sapiens
gcacaccgacagcuuucaa

SEQ ID NO: 1232279 - RNA, 19 nt, Homo sapiens
gccuggagguagcuagaaa

SEQ ID NO: 1232280 - RNA, 19 nt, Homo sapiens
gagcuucuucggcuucuga

SEQ ID NO: 1232281 - RNA, 19 nt, Homo sapiens
cauaucagcagcuauucaa

SEQ ID NO: 1232282 - RNA, 19 nt, Homo sapiens
cggaacagcuccagaucgu

SEQ ID NO: 1232283 - RNA, 19 nt, Homo sapiens
aagaagaggaugacucaga

SEQ ID NO: 1232284 - RNA, 19 nt, Homo sapiens
agcaaggccuuacugaaga

SEQ ID NO: 1232285 - RNA, 19 nt, Homo sapiens
gcacaguggcagagaaguc

SEQ ID NO: 1232286 - RNA, 19 nt, Homo sapiens
ccgguuuccugccauuauu

SEQ ID NO: 1232287 - RNA, 19 nt, Homo sapiens
gaagaggaugacucagaga

SEQ ID NO: 1232288 - RNA, 19 nt, Homo sapiens
gcagcuccuuccuucuguu

SEQ ID NO: 1232289 - RNA, 19 nt, Homo sapiens
gcacguacagccuauuugc

SEQ ID NO: 1232290 - RNA, 19 nt, Homo sapiens
cugcgggaauuccuguuaa

SEQ ID NO: 1232291 - RNA, 19 nt, Homo sapiens
cuccugggcugcucuucua

SEQ ID NO: 1232292 - RNA, 19 nt, Homo sapiens
gugggacccucacacugaa

SEQ ID NO: 1232293 - RNA, 19 nt, Homo sapiens
cacaaggccugucaaagcu

SEQ ID NO: 1232294 - RNA, 19 nt, Homo sapiens
ccacggaacagcuccagau

SEQ ID NO: 1232295 - RNA, 19 nt, Homo sapiens
ucccaagcauuucgcugua

SEQ ID NO: 1232296 - RNA, 19 nt, Homo sapiens
gaggagugggucaccauug

SEQ ID NO: 1232297 - RNA, 19 nt, Homo sapiens
ccaagcauuucgcuguaca

SEQ ID NO: 1232298 - RNA, 19 nt, Homo sapiens
gcucacugccuguugacaa

SEQ ID NO: 1232299 - RNA, 19 nt, Homo sapiens
acccaacacugcugcuuug

SEQ ID NO: 1232300 - RNA, 19 nt, Homo sapiens
ggccuuccuuccauacaug

SEQ ID NO: 1232301 - RNA, 19 nt, Homo sapiens
ggaggagugggucaccauu

SEQ ID NO: 1232302 - RNA, 19 nt, Homo sapiens
gcugcucccugugcuguug

SEQ ID NO: 1232303 - RNA, 19 nt, Homo sapiens
ggaccuuggcagagacuau

SEQ ID NO: 1232304 - RNA, 19 nt, Homo sapiens
gaaaaccuacagccccaua

SEQ ID NO: 1232305 - RNA, 19 nt, Homo sapiens
cagaagaggaagaguugga

SEQ ID NO: 1232306 - RNA, 19 nt, Homo sapiens
cauucuggcugacaacaag

SEQ ID NO: 1232307 - RNA, 19 nt, Homo sapiens
cucccgagcuucugcguau

SEQ ID NO: 1232308 - RNA, 19 nt, Homo sapiens
gaccuuggcagagacuauu

SEQ ID NO: 1232309 - RNA, 19 nt, Homo sapiens
aggcugugcugcagaggaa

SEQ ID NO: 1232310 - RNA, 19 nt, Homo sapiens
gaacccaacacugcugcuu

SEQ ID NO: 1232311 - RNA, 19 nt, Homo sapiens
augaggauguggaagaaga

SEQ ID NO: 1232312 - RNA, 19 nt, Homo sapiens
uggagcaccugcgggaauu

SEQ ID NO: 1232313 - RNA, 19 nt, Homo sapiens
gcuccucgccuacuugaag

SEQ ID NO: 1232314 - RNA, 19 nt, Homo sapiens
gguacagcguggagaaugc

SEQ ID NO: 1232315 - RNA, 19 nt, Homo sapiens
gcacacccuuuuccccauu

SEQ ID NO: 1232316 - RNA, 19 nt, Homo sapiens
caagagcaaggccuuacug

SEQ ID NO: 1232317 - RNA, 19 nt, Homo sapiens
cugaccagguuauagaugu

SEQ ID NO: 1232318 - RNA, 19 nt, Homo sapiens
cugcaugcccugccacuga

SEQ ID NO: 1232319 - RNA, 19 nt, Homo sapiens
ggagcuggcgaccacauca

SEQ ID NO: 1232320 - RNA, 19 nt, Homo sapiens
ccgaggaccaggauucaga

SEQ ID NO: 1232321 - RNA, 19 nt, Homo sapiens
ccuugaggcuuuggaugaa

SEQ ID NO: 1232322 - RNA, 19 nt, Homo sapiens
aacaagaucccaccagaca

SEQ ID NO: 1232323 - RNA, 19 nt, Homo sapiens
ugaccagguuauagaugug

SEQ ID NO: 1232324 - RNA, 19 nt, Homo sapiens
aggaagaggaagaugauga

SEQ ID NO: 1232325 - RNA, 19 nt, Homo sapiens
cgaggaggaggaagaggaa

SEQ ID NO: 1232326 - RNA, 19 nt, Homo sapiens
gaagaggaagaugaugauc

SEQ ID NO: 1232327 - RNA, 19 nt, Homo sapiens
agagagagauggggcuuuu

SEQ ID NO: 1232328 - RNA, 19 nt, Homo sapiens
ggauguggaagaagaggau

SEQ ID NO: 1232329 - RNA, 19 nt, Homo sapiens
ggaggaggaagaggaagau

SEQ ID NO: 1232330 - RNA, 19 nt, Homo sapiens
guguggccuuccuuccaua

SEQ ID NO: 1232331 - RNA, 19 nt, Homo sapiens
uggaugaggauguggaaga

SEQ ID NO: 1232332 - RNA, 19 nt, Homo sapiens
ccugcgggaauuccuguua

SEQ ID NO: 1232333 - RNA, 19 nt, Homo sapiens
ucucgcugcugcccuacuu

SEQ ID NO: 1232334 - RNA, 19 nt, Homo sapiens
gaagucggugccucuugga

SEQ ID NO: 1232335 - RNA, 19 nt, Homo sapiens
ugaugcccauguuggaaga

SEQ ID NO: 1232336 - RNA, 19 nt, Homo sapiens
agaggaagaguuggagauu

SEQ ID NO: 1232337 - RNA, 19 nt, Homo sapiens
agucagaggugccggucau

SEQ ID NO: 1232338 - RNA, 19 nt, Homo sapiens
acagcacaccgacagcuuu

SEQ ID NO: 1232339 - RNA, 19 nt, Homo sapiens
ggaugacucagagaucuca

SEQ ID NO: 1232340 - RNA, 19 nt, Homo sapiens
cagcuccuuccuucuguuu

SEQ ID NO: 1232341 - RNA, 19 nt, Homo sapiens
ugcugcagcuucugaggaa

SEQ ID NO: 1232342 - RNA, 19 nt, Homo sapiens
ggagcgagagcccauacca

SEQ ID NO: 1232343 - RNA, 19 nt, Homo sapiens
caacgggagagccucaagu

SEQ ID NO: 1232344 - RNA, 19 nt, Homo sapiens
acaccaaggccgcacuguu

SEQ ID NO: 1232345 - RNA, 19 nt, Homo sapiens
ugcaugcccugccacugaa

SEQ ID NO: 1232346 - RNA, 19 nt, Homo sapiens
uuauuggugugcaagacaa

SEQ ID NO: 1232347 - RNA, 19 nt, Homo sapiens
gcccugggagccauugcua

SEQ ID NO: 1232348 - RNA, 19 nt, Homo sapiens
ccaggauucagaagaggaa

SEQ ID NO: 1232349 - RNA, 19 nt, Homo sapiens
ggagaaaccuucacagaug

SEQ ID NO: 1232350 - RNA, 19 nt, Homo sapiens
caagagaccagauauuaua

SEQ ID NO: 1232351 - RNA, 19 nt, Homo sapiens
gcagagagauucagaggau

SEQ ID NO: 1232352 - RNA, 19 nt, Homo sapiens
gaagccaacuaucccauaa

SEQ ID NO: 1232353 - RNA, 19 nt, Homo sapiens
cagcaaagaugacuacuuc

SEQ ID NO: 1232354 - RNA, 19 nt, Homo sapiens
ucagaaugcuuugggauua

SEQ ID NO: 1232355 - RNA, 19 nt, Homo sapiens
ucacagaugucccagauau

SEQ ID NO: 1232356 - RNA, 19 nt, Homo sapiens
gaagaacuuuccagagugu

SEQ ID NO: 1232357 - RNA, 19 nt, Homo sapiens
ucacaaacuugcagccuaa

SEQ ID NO: 1232358 - RNA, 19 nt, Homo sapiens
ggacaaacaugacaaacac

SEQ ID NO: 1232359 - RNA, 19 nt, Homo sapiens
uauguggccuguuguauaa

SEQ ID NO: 1232360 - RNA, 19 nt, Homo sapiens
gcacucauguaucccauau

SEQ ID NO: 1232361 - RNA, 19 nt, Homo sapiens
caacagagccuagggaaga

SEQ ID NO: 1232362 - RNA, 19 nt, Homo sapiens
gcauccaccuacaaauaua

SEQ ID NO: 1232363 - RNA, 19 nt, Homo sapiens
aaauucaggucucugcuua

SEQ ID NO: 1232364 - RNA, 19 nt, Homo sapiens
gagaccagauauuauaaga

SEQ ID NO: 1232365 - RNA, 19 nt, Homo sapiens
uaagaggucuggcagguau

SEQ ID NO: 1232366 - RNA, 19 nt, Homo sapiens
cauggugccugaauucuuu

SEQ ID NO: 1232367 - RNA, 19 nt, Homo sapiens
gcaaagacugcuacacauu

SEQ ID NO: 1232368 - RNA, 19 nt, Homo sapiens
uaaaguacccacugcaauu

SEQ ID NO: 1232369 - RNA, 19 nt, Homo sapiens
gggcagccaucgcagaauu

SEQ ID NO: 1232370 - RNA, 19 nt, Homo sapiens
gcaagagaccagauauuau

SEQ ID NO: 1232371 - RNA, 19 nt, Homo sapiens
gaaaggaggaucagaaugc

SEQ ID NO: 1232372 - RNA, 19 nt, Homo sapiens
aaauacagauuccuagaga

SEQ ID NO: 1232373 - RNA, 19 nt, Homo sapiens
gagaaaccuucacagaugu

SEQ ID NO: 1232374 - RNA, 19 nt, Homo sapiens
ccacgugucuguacuugga

SEQ ID NO: 1232375 - RNA, 19 nt, Homo sapiens
gaagaugcucggccuuaaa

SEQ ID NO: 1232376 - RNA, 19 nt, Homo sapiens
auugggaucuucugucuua

SEQ ID NO: 1232377 - RNA, 19 nt, Homo sapiens
caacagcuaagcaugaauu

SEQ ID NO: 1232378 - RNA, 19 nt, Homo sapiens
guaauucggacaaacauga

SEQ ID NO: 1232379 - RNA, 19 nt, Homo sapiens
caaagacugcuacacauug

SEQ ID NO: 1232380 - RNA, 19 nt, Homo sapiens
guugaucccugugacauuu

SEQ ID NO: 1232381 - RNA, 19 nt, Homo sapiens
guaaagauguuuugaaugg

SEQ ID NO: 1232382 - RNA, 19 nt, Homo sapiens
ggugggagcaugauaaaga

SEQ ID NO: 1232383 - RNA, 19 nt, Homo sapiens
aaauccaccucgucagaua

SEQ ID NO: 1232384 - RNA, 19 nt, Homo sapiens
cagaggauuuauugaagaa

SEQ ID NO: 1232385 - RNA, 19 nt, Homo sapiens
cagagugugcccauauuua

SEQ ID NO: 1232386 - RNA, 19 nt, Homo sapiens
gugcauggcugauguuguc

SEQ ID NO: 1232387 - RNA, 19 nt, Homo sapiens
uugaauggcuagaugguaa

SEQ ID NO: 1232388 - RNA, 19 nt, Homo sapiens
aaugaacacugacauacuu

SEQ ID NO: 1232389 - RNA, 19 nt, Homo sapiens
acacuuggcuggguuucua

SEQ ID NO: 1232390 - RNA, 19 nt, Homo sapiens
caucggagccuucuugugu

SEQ ID NO: 1232391 - RNA, 19 nt, Homo sapiens
gugccugaauucuuucuuu

SEQ ID NO: 1232392 - RNA, 19 nt, Homo sapiens
ugcaagagaccagauauua

SEQ ID NO: 1232393 - RNA, 19 nt, Homo sapiens
gcacuuuucuuuuagcaaa

SEQ ID NO: 1232394 - RNA, 19 nt, Homo sapiens
cagaaugcuuugggauuaa

SEQ ID NO: 1232395 - RNA, 19 nt, Homo sapiens
gcauugggaucuucugucu

SEQ ID NO: 1232396 - RNA, 19 nt, Homo sapiens
ucagaggauuuauugaaga

SEQ ID NO: 1232397 - RNA, 19 nt, Homo sapiens
gugaagguauuaauaagag

SEQ ID NO: 1232398 - RNA, 19 nt, Homo sapiens
cugaagaacuuuccagagu

SEQ ID NO: 1232399 - RNA, 19 nt, Homo sapiens
gacaagaauauuuggguaa

SEQ ID NO: 1232400 - RNA, 19 nt, Homo sapiens
ucacagaguuacauuugca

SEQ ID NO: 1232401 - RNA, 19 nt, Homo sapiens
gagagauucagaggauuua

SEQ ID NO: 1232402 - RNA, 19 nt, Homo sapiens
guuggaagcuguguacugu

SEQ ID NO: 1232403 - RNA, 19 nt, Homo sapiens
gagauucagaggauuuauu

SEQ ID NO: 1232404 - RNA, 19 nt, Homo sapiens
ugauaaagauccagaaagc

SEQ ID NO: 1232405 - RNA, 19 nt, Homo sapiens
cagccaaacugcagcuuca

SEQ ID NO: 1232406 - RNA, 19 nt, Homo sapiens
cagcuaagcaugaauucuu

SEQ ID NO: 1232407 - RNA, 19 nt, Homo sapiens
acagaugucccagauauuu

SEQ ID NO: 1232408 - RNA, 19 nt, Homo sapiens
gcagguauucccaugauuc

SEQ ID NO: 1232409 - RNA, 19 nt, Homo sapiens
auauuuaccugaucagaga

SEQ ID NO: 1232410 - RNA, 19 nt, Homo sapiens
gcccauauuuaccugauca

SEQ ID NO: 1232411 - RNA, 19 nt, Homo sapiens
agaagaugcucggccuuaa

SEQ ID NO: 1232412 - RNA, 19 nt, Homo sapiens
caagauaaacagcuguaau

SEQ ID NO: 1232413 - RNA, 19 nt, Homo sapiens
gguuuaucccgaaauauuu

SEQ ID NO: 1232414 - RNA, 19 nt, Homo sapiens
acucauguaucccauaugu

SEQ ID NO: 1232415 - RNA, 19 nt, Homo sapiens
caaagaugacuacuuccaa

SEQ ID NO: 1232416 - RNA, 19 nt, Homo sapiens
gcaaagaugacuacuucca

SEQ ID NO: 1232417 - RNA, 19 nt, Homo sapiens
cuagagacguuaugauggu

SEQ ID NO: 1232418 - RNA, 19 nt, Homo sapiens
acaggaaucagacuugaaa

SEQ ID NO: 1232419 - RNA, 19 nt, Homo sapiens
gggaagauuugugacagau

SEQ ID NO: 1232420 - RNA, 19 nt, Homo sapiens
agacaggaaucagacuuga

SEQ ID NO: 1232421 - RNA, 19 nt, Homo sapiens
aaagacugcuacacauugu

SEQ ID NO: 1232422 - RNA, 19 nt, Homo sapiens
aauucaagcucucaucaug

SEQ ID NO: 1232423 - RNA, 19 nt, Homo sapiens
cagaguuacauuugcauuu

SEQ ID NO: 1232424 - RNA, 19 nt, Homo sapiens
uaaccgcacucauguaucc

SEQ ID NO: 1232425 - RNA, 19 nt, Homo sapiens
aagaaaaucugcagaggaa

SEQ ID NO: 1232426 - RNA, 19 nt, Homo sapiens
agacuuaggacucaauuuc

SEQ ID NO: 1232427 - RNA, 19 nt, Homo sapiens
uugcauccaccuacaaaua

SEQ ID NO: 1232428 - RNA, 19 nt, Homo sapiens
uauaaccgcacucauguau

SEQ ID NO: 1232429 - RNA, 19 nt, Homo sapiens
aaaguacccacugcaauuu

SEQ ID NO: 1232430 - RNA, 19 nt, Homo sapiens
gauaaacagcuguaauucg

SEQ ID NO: 1232431 - RNA, 19 nt, Homo sapiens
gcaagauaaacagcuguaa

SEQ ID NO: 1232432 - RNA, 19 nt, Homo sapiens
gaucagagagaaaagaaaa

SEQ ID NO: 1232433 - RNA, 19 nt, Homo sapiens
cuuaaagacuuaggacuca

SEQ ID NO: 1232434 - RNA, 19 nt, Homo sapiens
gcuuaugauuucaauaguc

SEQ ID NO: 1232435 - RNA, 19 nt, Homo sapiens
ugacauggugccugaauuc

SEQ ID NO: 1232436 - RNA, 19 nt, Homo sapiens
ccagagugugcccauauuu

SEQ ID NO: 1232437 - RNA, 19 nt, Homo sapiens
cuacuuacccagcaaagau

SEQ ID NO: 1232438 - RNA, 19 nt, Homo sapiens
aagaagaugcucggccuua

SEQ ID NO: 1232439 - RNA, 19 nt, Homo sapiens
cacauugucuggccucaca

SEQ ID NO: 1232440 - RNA, 19 nt, Homo sapiens
ccagugauuuugauagaaa

SEQ ID NO: 1232441 - RNA, 19 nt, Homo sapiens
uaucaucggagccuucuug

SEQ ID NO: 1232442 - RNA, 19 nt, Homo sapiens
acagauuccuagagacguu

SEQ ID NO: 1232443 - RNA, 19 nt, Homo sapiens
ucaggucucugcuuacaac

SEQ ID NO: 1232444 - RNA, 19 nt, Homo sapiens
caugauaaagauccagaaa

SEQ ID NO: 1232445 - RNA, 19 nt, Homo sapiens
ugaagccaacuaucccaua

SEQ ID NO: 1232446 - RNA, 19 nt, Homo sapiens
guauaaccgcacucaugua

SEQ ID NO: 1232447 - RNA, 19 nt, Homo sapiens
cuucacagaugucccagau

SEQ ID NO: 1232448 - RNA, 19 nt, Homo sapiens
agagagauucagaggauuu

SEQ ID NO: 1232449 - RNA, 19 nt, Homo sapiens
gaacuuugcugacuacuaa

SEQ ID NO: 1232450 - RNA, 19 nt, Homo sapiens
gaaggaggccucacuacuu

SEQ ID NO: 1232451 - RNA, 19 nt, Homo sapiens
gggcuuaacacccaauaaa

SEQ ID NO: 1232452 - RNA, 19 nt, Homo sapiens
gcuuaacacccaauaaaga

SEQ ID NO: 1232453 - RNA, 19 nt, Homo sapiens
uggaagagcugauuguacu

SEQ ID NO: 1232454 - RNA, 19 nt, Homo sapiens
ggagaaagccgaccccuau

SEQ ID NO: 1232455 - RNA, 19 nt, Homo sapiens
uagcgauccuccuguuuau

SEQ ID NO: 1232456 - RNA, 19 nt, Homo sapiens
aaggaggccucacuacuuc

SEQ ID NO: 1232457 - RNA, 19 nt, Homo sapiens
gcgauccuccuguuuauuc

SEQ ID NO: 1232458 - RNA, 19 nt, Homo sapiens
ugauagcgauccuccuguu

SEQ ID NO: 1232459 - RNA, 19 nt, Homo sapiens
ucaaugaccacggcgauuu

SEQ ID NO: 1232460 - RNA, 19 nt, Homo sapiens
acgcagaggcgcuguguuu

SEQ ID NO: 1232461 - RNA, 19 nt, Homo sapiens
cagaggcgcuguguuugga

SEQ ID NO: 1232462 - RNA, 19 nt, Homo sapiens
ccacggcgauuucguaacg

SEQ ID NO: 1232463 - RNA, 19 nt, Homo sapiens
ggaaggaggccucacuacu

SEQ ID NO: 1232464 - RNA, 19 nt, Homo sapiens
gguccaccuuugccuauuc

SEQ ID NO: 1232465 - RNA, 19 nt, Homo sapiens
gaccacggcgauuucguaa

SEQ ID NO: 1232466 - RNA, 19 nt, Homo sapiens
ugaccacggcgauuucgua

SEQ ID NO: 1232467 - RNA, 19 nt, Homo sapiens
auagcgauccuccuguuua

SEQ ID NO: 1232468 - RNA, 19 nt, Homo sapiens
gauagcgauccuccuguuu

SEQ ID NO: 1232469 - RNA, 19 nt, Homo sapiens
acaccuggccgcaagauau

SEQ ID NO: 1232470 - RNA, 19 nt, Homo sapiens
ugucucgccuccuggauga

SEQ ID NO: 1232471 - RNA, 19 nt, Homo sapiens
cuuaacacccaauaaagaa

SEQ ID NO: 1232472 - RNA, 19 nt, Homo sapiens
gcuggaagagcugauugua

SEQ ID NO: 1232473 - RNA, 19 nt, Homo sapiens
gcagaggcgcuguguuugg

SEQ ID NO: 1232474 - RNA, 19 nt, Homo sapiens
gcagcucaccagcaaguuc

SEQ ID NO: 1232475 - RNA, 19 nt, Homo sapiens
gaaaacugcggacucaaug

SEQ ID NO: 1232476 - RNA, 19 nt, Homo sapiens
caacuucagcugaggaacu

SEQ ID NO: 1232477 - RNA, 19 nt, Homo sapiens
ggaaaacugcggacucaau

SEQ ID NO: 1232478 - RNA, 19 nt, Homo sapiens
gcgcagcucaccagcaagu

SEQ ID NO: 1232479 - RNA, 19 nt, Homo sapiens
caaugaccacggcgauuuc

SEQ ID NO: 1232480 - RNA, 19 nt, Homo sapiens
gggcucugauugagauggu

SEQ ID NO: 1232481 - RNA, 19 nt, Homo sapiens
gacaccuggccgcaagaua

SEQ ID NO: 1232482 - RNA, 19 nt, Homo sapiens
ggaacccagacaacaagug

SEQ ID NO: 1232483 - RNA, 19 nt, Homo sapiens
ggacagauaugaagaguuu

SEQ ID NO: 1232484 - RNA, 19 nt, Homo sapiens
gaauguggauuuaaguaga

SEQ ID NO: 1232485 - RNA, 19 nt, Homo sapiens
gcaaguccauucaugucua

SEQ ID NO: 1232486 - RNA, 19 nt, Homo sapiens
uacaggagcugaaggcuuu

SEQ ID NO: 1232487 - RNA, 19 nt, Homo sapiens
gaaaagacuuguagccaaa

SEQ ID NO: 1232488 - RNA, 19 nt, Homo sapiens
ugaaagagcagcuuaguca

SEQ ID NO: 1232489 - RNA, 19 nt, Homo sapiens
ggcaauagcugugaaugug

SEQ ID NO: 1232490 - RNA, 19 nt, Homo sapiens
gagaacaggcgucuagcua

SEQ ID NO: 1232491 - RNA, 19 nt, Homo sapiens
gaccagagacagagaugua

SEQ ID NO: 1232492 - RNA, 19 nt, Homo sapiens
gaacaggcgucuagcuacu

SEQ ID NO: 1232493 - RNA, 19 nt, Homo sapiens
gcagcuugauggccuagaa

SEQ ID NO: 1232494 - RNA, 19 nt, Homo sapiens
gacagaggcugagaaagug

SEQ ID NO: 1232495 - RNA, 19 nt, Homo sapiens
ggaggacagucaguacuug

SEQ ID NO: 1232496 - RNA, 19 nt, Homo sapiens
ugacagaggcugagaaagu

SEQ ID NO: 1232497 - RNA, 19 nt, Homo sapiens
agacaagguucauuuacau

SEQ ID NO: 1232498 - RNA, 19 nt, Homo sapiens
caacaggaacaccaucuau

SEQ ID NO: 1232499 - RNA, 19 nt, Homo sapiens
uagacaagguucauuuaca

SEQ ID NO: 1232500 - RNA, 19 nt, Homo sapiens
agauguagauguccuuuca

SEQ ID NO: 1232501 - RNA, 19 nt, Homo sapiens
gcacagcauucagcaacga

SEQ ID NO: 1232502 - RNA, 19 nt, Homo sapiens
gggcugagaggaccaagaa

SEQ ID NO: 1232503 - RNA, 19 nt, Homo sapiens
gcaaugaagcgagccuuug

SEQ ID NO: 1232504 - RNA, 19 nt, Homo sapiens
guagagaaucguagcaaug

SEQ ID NO: 1232505 - RNA, 19 nt, Homo sapiens
ccaggcaaguccauucaug

SEQ ID NO: 1232506 - RNA, 19 nt, Homo sapiens
ccaagaggccauucgagaa

SEQ ID NO: 1232507 - RNA, 19 nt, Homo sapiens
gggaaagucaugagaagga

SEQ ID NO: 1232508 - RNA, 19 nt, Homo sapiens
aaagagcagcuuagucauu

SEQ ID NO: 1232509 - RNA, 19 nt, Homo sapiens
caagaacuggucccucauu

SEQ ID NO: 1232510 - RNA, 19 nt, Homo sapiens
uguacaaccucaaucugaa

SEQ ID NO: 1232511 - RNA, 19 nt, Homo sapiens
aagagcagcuuagucauuc

SEQ ID NO: 1232512 - RNA, 19 nt, Homo sapiens
gcgggaaagucaugagaag

SEQ ID NO: 1232513 - RNA, 19 nt, Homo sapiens
gaaggagcaguaucugugu

SEQ ID NO: 1232514 - RNA, 19 nt, Homo sapiens
ggacagucaguacuuggaa

SEQ ID NO: 1232515 - RNA, 19 nt, Homo sapiens
uagagaaucguagcaauga

SEQ ID NO: 1232516 - RNA, 19 nt, Homo sapiens
gugaauguggauuuaagua

SEQ ID NO: 1232517 - RNA, 19 nt, Homo sapiens
ggugacagaggcugagaaa

SEQ ID NO: 1232518 - RNA, 19 nt, Homo sapiens
gcaggcaugcuucgcuuug

SEQ ID NO: 1232519 - RNA, 19 nt, Homo sapiens
caaguccauucaugucuag

SEQ ID NO: 1232520 - RNA, 19 nt, Homo sapiens
gacaagguucauuuacauu

SEQ ID NO: 1232521 - RNA, 19 nt, Homo sapiens
uguagacaagguucauuua

SEQ ID NO: 1232522 - RNA, 19 nt, Homo sapiens
gcuauucaaagccagcuaa

SEQ ID NO: 1232523 - RNA, 19 nt, Homo sapiens
gcacccuggucaccugugu

SEQ ID NO: 1232524 - RNA, 19 nt, Homo sapiens
aagaacuggucccucauug

SEQ ID NO: 1232525 - RNA, 19 nt, Homo sapiens
aggcaugcuucgcuuugua

SEQ ID NO: 1232526 - RNA, 19 nt, Homo sapiens
gagaaucguagcaaugaag

SEQ ID NO: 1232527 - RNA, 19 nt, Homo sapiens
ccaaauggcuggggugguu

SEQ ID NO: 1232528 - RNA, 19 nt, Homo sapiens
agacuuggugggacagaua

SEQ ID NO: 1232529 - RNA, 19 nt, Homo sapiens
gcauguacaaccucaaucu

SEQ ID NO: 1232530 - RNA, 19 nt, Homo sapiens
acaggaacaccaucuauag

SEQ ID NO: 1232531 - RNA, 19 nt, Homo sapiens
aacaggaacaccaucuaua

SEQ ID NO: 1232532 - RNA, 19 nt, Homo sapiens
gggaggacagucaguacuu

SEQ ID NO: 1232533 - RNA, 19 nt, Homo sapiens
aaagacuuguagccaaaug

SEQ ID NO: 1232534 - RNA, 19 nt, Homo sapiens
gaaagagcagcuuagucau

SEQ ID NO: 1232535 - RNA, 19 nt, Homo sapiens
gcucuacaugcuauucaaa

SEQ ID NO: 1232536 - RNA, 19 nt, Homo sapiens
ccagggaggacagucagua

SEQ ID NO: 1232537 - RNA, 19 nt, Homo sapiens
ugguucagcuuguaaaguc

SEQ ID NO: 1232538 - RNA, 19 nt, Homo sapiens
cgccagaucucaggaugau

SEQ ID NO: 1232539 - RNA, 19 nt, Homo sapiens
ggaccuccacaaucucaug

SEQ ID NO: 1232540 - RNA, 19 nt, Homo sapiens
gagaggcucgggaggacuu

SEQ ID NO: 1232541 - RNA, 19 nt, Homo sapiens
guagacaagguucauuuac

SEQ ID NO: 1232542 - RNA, 19 nt, Homo sapiens
gggcauguacaaccucaau

SEQ ID NO: 1232543 - RNA, 19 nt, Homo sapiens
ccugugcucuacaugcuau

SEQ ID NO: 1232544 - RNA, 19 nt, Homo sapiens
agagaaucguagcaaugaa

SEQ ID NO: 1232545 - RNA, 19 nt, Homo sapiens
uagcugugaauguggauuu

SEQ ID NO: 1232546 - RNA, 19 nt, Homo sapiens
caagaggccauucgagaac

SEQ ID NO: 1232547 - RNA, 19 nt, Homo sapiens
caaugaagcgagccuuugg

SEQ ID NO: 1232548 - RNA, 19 nt, Homo sapiens
ucaacaggaacaccaucua

SEQ ID NO: 1232549 - RNA, 19 nt, Homo sapiens
caagccagcccggagagaa

SEQ ID NO: 1232550 - RNA, 19 nt, Homo sapiens
ugaauguggauuuaaguag

SEQ ID NO: 1232551 - RNA, 19 nt, Homo sapiens
gcugugaauguggauuuaa

SEQ ID NO: 1232552 - RNA, 19 nt, Homo sapiens
aagcccaagucaacaggaa

SEQ ID NO: 1232553 - RNA, 19 nt, Homo sapiens
guacaaccucaaucugaag

SEQ ID NO: 1232554 - RNA, 19 nt, Homo sapiens
cugagaaaguguucauggu

SEQ ID NO: 1232555 - RNA, 19 nt, Homo sapiens
gagacagagauguagaugu

SEQ ID NO: 1232556 - RNA, 19 nt, Homo sapiens
ccagagacagagauguaga

SEQ ID NO: 1232557 - RNA, 19 nt, Homo sapiens
ucaaucugaaggagcagua

SEQ ID NO: 1232558 - RNA, 19 nt, Homo sapiens
acacggagcagagacuaga

SEQ ID NO: 1232559 - RNA, 19 nt, Homo sapiens
gcugagaggaccaagaacu

SEQ ID NO: 1232560 - RNA, 19 nt, Homo sapiens
aguagagaaucguagcaau

SEQ ID NO: 1232561 - RNA, 19 nt, Homo sapiens
guccauucaugucuagaag

SEQ ID NO: 1232562 - RNA, 19 nt, Homo sapiens
acagauaugaagaguuugu

SEQ ID NO: 1232563 - RNA, 19 nt, Homo sapiens
cagcugugcgggaaaguca

SEQ ID NO: 1232564 - RNA, 19 nt, Homo sapiens
gcaaaggcaucgucuauga

SEQ ID NO: 1232565 - RNA, 19 nt, Homo sapiens
gcgcaucgcugcauuguga

SEQ ID NO: 1232566 - RNA, 19 nt, Homo sapiens
ggaagacgguggaaaucaa

SEQ ID NO: 1232567 - RNA, 19 nt, Homo sapiens
gcaggaagauggcgaacgu

SEQ ID NO: 1232568 - RNA, 19 nt, Homo sapiens
ggacugagacaucuucugu

SEQ ID NO: 1232569 - RNA, 19 nt, Homo sapiens
gaaagauugcccuucauau

SEQ ID NO: 1232570 - RNA, 19 nt, Homo sapiens
gaaagauggagcugacuug

SEQ ID NO: 1232571 - RNA, 19 nt, Homo sapiens
ugagacaucuucuguaaac

SEQ ID NO: 1232572 - RNA, 19 nt, Homo sapiens
acugagacaucuucuguaa

SEQ ID NO: 1232573 - RNA, 19 nt, Homo sapiens
agaauucacuugagguuca

SEQ ID NO: 1232574 - RNA, 19 nt, Homo sapiens
ucgaggagauuaacaaagu

SEQ ID NO: 1232575 - RNA, 19 nt, Homo sapiens
gcagauggcguguccuaug

SEQ ID NO: 1232576 - RNA, 19 nt, Homo sapiens
gggcaaaggcaucgucuau

SEQ ID NO: 1232577 - RNA, 19 nt, Homo sapiens
gaacugaagacgagaggau

SEQ ID NO: 1232578 - RNA, 19 nt, Homo sapiens
gacacacccugcaaugaga

SEQ ID NO: 1232579 - RNA, 19 nt, Homo sapiens
ggacacacccugcaaugag

SEQ ID NO: 1232580 - RNA, 19 nt, Homo sapiens
caucuucuguaaacugcua

SEQ ID NO: 1232581 - RNA, 19 nt, Homo sapiens
gagguucaauuaaauacag

SEQ ID NO: 1232582 - RNA, 19 nt, Homo sapiens
aaagauugcccuucauaug

SEQ ID NO: 1232583 - RNA, 19 nt, Homo sapiens
gguggaaacagcugaaguu

SEQ ID NO: 1232584 - RNA, 19 nt, Homo sapiens
gaaaggagcuggggaucau

SEQ ID NO: 1232585 - RNA, 19 nt, Homo sapiens
ucaagcaggguuucaaaga

SEQ ID NO: 1232586 - RNA, 19 nt, Homo sapiens
cgaggagauuaacaaaguu

SEQ ID NO: 1232587 - RNA, 19 nt, Homo sapiens
gagauuaacaaaguuggaa

SEQ ID NO: 1232588 - RNA, 19 nt, Homo sapiens
gcccagcccugugaaagau

SEQ ID NO: 1232589 - RNA, 19 nt, Homo sapiens
caagcaggguuucaaagac

SEQ ID NO: 1232590 - RNA, 19 nt, Homo sapiens
gacaaacggggaucuuuua

SEQ ID NO: 1232591 - RNA, 19 nt, Homo sapiens
gaggagauuaacaaaguug

SEQ ID NO: 1232592 - RNA, 19 nt, Homo sapiens
uuaccucacuuugcacuga

SEQ ID NO: 1232593 - RNA, 19 nt, Homo sapiens
aagcaggguuucaaagaca

SEQ ID NO: 1232594 - RNA, 19 nt, Homo sapiens
cgacaaggccagaugacau

SEQ ID NO: 1232595 - RNA, 19 nt, Homo sapiens
gaagacgagaggauuugga

SEQ ID NO: 1232596 - RNA, 19 nt, Homo sapiens
gaucaucccaaccaucauc

SEQ ID NO: 1232597 - RNA, 19 nt, Homo sapiens
uuacaggacugagacaucu

SEQ ID NO: 1232598 - RNA, 19 nt, Homo sapiens
uuaacaaaguuggaaagga

SEQ ID NO: 1232599 - RNA, 19 nt, Homo sapiens
gauggcguguccuaugcuu

SEQ ID NO: 1232600 - RNA, 19 nt, Homo sapiens
cuucagagccgcaaucaag

SEQ ID NO: 1232601 - RNA, 19 nt, Homo sapiens
gggcuuguuucuguuuguu

SEQ ID NO: 1232602 - RNA, 19 nt, Homo sapiens
gggaagacgguggaaauca

SEQ ID NO: 1232603 - RNA, 19 nt, Homo sapiens
cagggaagacgguggaaau

SEQ ID NO: 1232604 - RNA, 19 nt, Homo sapiens
cagauggcguguccuaugc

SEQ ID NO: 1232605 - RNA, 19 nt, Homo sapiens
ggagauuaacaaaguugga

SEQ ID NO: 1232606 - RNA, 19 nt, Homo sapiens
caaccuccacgcuguguuc

SEQ ID NO: 1232607 - RNA, 19 nt, Homo sapiens
aaucaagcaggguuucaaa

SEQ ID NO: 1232608 - RNA, 19 nt, Homo sapiens
ucagaauucacuugagguu

SEQ ID NO: 1232609 - RNA, 19 nt, Homo sapiens
ugaaagauggagcugacuu

SEQ ID NO: 1232610 - RNA, 19 nt, Homo sapiens
cuucaucgccucacacauc

SEQ ID NO: 1232611 - RNA, 19 nt, Homo sapiens
gcaaucaagcaggguuuca

SEQ ID NO: 1232612 - RNA, 19 nt, Homo sapiens
aagauugcccuucauaugg

SEQ ID NO: 1232613 - RNA, 19 nt, Homo sapiens
gaagacgguggaaaucaac

SEQ ID NO: 1232614 - RNA, 19 nt, Homo sapiens
ucauauggguuuugguuug

SEQ ID NO: 1232615 - RNA, 19 nt, Homo sapiens
uggcggacaugaagaacuc

SEQ ID NO: 1232616 - RNA, 19 nt, Homo sapiens
gcauugccacagggaagua

SEQ ID NO: 1232617 - RNA, 19 nt, Homo sapiens
ucaaagggaagacuaccau

SEQ ID NO: 1232618 - RNA, 19 nt, Homo sapiens
ccucucagaauucacuuga

SEQ ID NO: 1232619 - RNA, 19 nt, Homo sapiens
gacugagacaucuucugua

SEQ ID NO: 1232620 - RNA, 19 nt, Homo sapiens
gcuuguuucuguuuguuac

SEQ ID NO: 1232621 - RNA, 19 nt, Homo sapiens
cgagaggauuuggaggaau

SEQ ID NO: 1232622 - RNA, 19 nt, Homo sapiens
agacaucuucuguaaacug

SEQ ID NO: 1232623 - RNA, 19 nt, Homo sapiens
gauuaacaaaguuggaaag

SEQ ID NO: 1232624 - RNA, 19 nt, Homo sapiens
aaaggcaucgucuaugaca

SEQ ID NO: 1232625 - RNA, 19 nt, Homo sapiens
gcuuagcgaaugccacaga

SEQ ID NO: 1232626 - RNA, 19 nt, Homo sapiens
uugcagugcuuagcgaaug

SEQ ID NO: 1232627 - RNA, 19 nt, Homo sapiens
ugauuuauagggcaagaga

SEQ ID NO: 1232628 - RNA, 19 nt, Homo sapiens
acgagaggauuuggaggaa

SEQ ID NO: 1232629 - RNA, 19 nt, Homo sapiens
cacuuugcacugauuaauu

SEQ ID NO: 1232630 - RNA, 19 nt, Homo sapiens
ccucgaggagauuaacaaa

SEQ ID NO: 1232631 - RNA, 19 nt, Homo sapiens
ccucagcuguggcggacau

SEQ ID NO: 1232632 - RNA, 19 nt, Homo sapiens
uggcagauggcguguccua

SEQ ID NO: 1232633 - RNA, 19 nt, Homo sapiens
caaucaagcaggguuucaa

SEQ ID NO: 1232634 - RNA, 19 nt, Homo sapiens
ggaggccucagcaucaaag

SEQ ID NO: 1232635 - RNA, 19 nt, Homo sapiens
ggaaggcuuuggaaauuua

SEQ ID NO: 1232636 - RNA, 19 nt, Homo sapiens
gaaaccaaguuauugcuau

SEQ ID NO: 1232637 - RNA, 19 nt, Homo sapiens
cgacaguccuuuguguuua

SEQ ID NO: 1232638 - RNA, 19 nt, Homo sapiens
caaugaagauggugccaaa

SEQ ID NO: 1232639 - RNA, 19 nt, Homo sapiens
gauuauggaugcaugaaug

SEQ ID NO: 1232640 - RNA, 19 nt, Homo sapiens
gaacuguuaaucaccuuua

SEQ ID NO: 1232641 - RNA, 19 nt, Homo sapiens
aagagaagauaguggauaa

SEQ ID NO: 1232642 - RNA, 19 nt, Homo sapiens
gacagaaacugaaguaaaa

SEQ ID NO: 1232643 - RNA, 19 nt, Homo sapiens
gaagagaagauaguggaua

SEQ ID NO: 1232644 - RNA, 19 nt, Homo sapiens
caguagaguucaccacuuu

SEQ ID NO: 1232645 - RNA, 19 nt, Homo sapiens
gcagugguguguaggcaaa

SEQ ID NO: 1232646 - RNA, 19 nt, Homo sapiens
ugaaaugccugaacacaag

SEQ ID NO: 1232647 - RNA, 19 nt, Homo sapiens
agaaugcacuuccggguuu

SEQ ID NO: 1232648 - RNA, 19 nt, Homo sapiens
gagcuuauugggaauuaua

SEQ ID NO: 1232649 - RNA, 19 nt, Homo sapiens
ugacagaaacugaaguaaa

SEQ ID NO: 1232650 - RNA, 19 nt, Homo sapiens
gcguagagauagaagagaa

SEQ ID NO: 1232651 - RNA, 19 nt, Homo sapiens
gcaguagaguucaccacuu

SEQ ID NO: 1232652 - RNA, 19 nt, Homo sapiens
ggaaauuuaucagcaucaa

SEQ ID NO: 1232653 - RNA, 19 nt, Homo sapiens
ucagccaucuuuauacuau

SEQ ID NO: 1232654 - RNA, 19 nt, Homo sapiens
caaaacugcuuucuccuuu

SEQ ID NO: 1232655 - RNA, 19 nt, Homo sapiens
ccacuuuggcggacuauuu

SEQ ID NO: 1232656 - RNA, 19 nt, Homo sapiens
gcugagccaugaggauuaa

SEQ ID NO: 1232657 - RNA, 19 nt, Homo sapiens
ggaaaccaaguuauugcua

SEQ ID NO: 1232658 - RNA, 19 nt, Homo sapiens
ucggaaggcuuuggaaauu

SEQ ID NO: 1232659 - RNA, 19 nt, Homo sapiens
gcagauggcggaaauggau

SEQ ID NO: 1232660 - RNA, 19 nt, Homo sapiens
gaaugucagccaucuuuau

SEQ ID NO: 1232661 - RNA, 19 nt, Homo sapiens
aaugacaccugauaugaug

SEQ ID NO: 1232662 - RNA, 19 nt, Homo sapiens
gacaguccuuuguguuuau

SEQ ID NO: 1232663 - RNA, 19 nt, Homo sapiens
caagugcaauaaagugugu

SEQ ID NO: 1232664 - RNA, 19 nt, Homo sapiens
gcgcugggcugagguuaug

SEQ ID NO: 1232665 - RNA, 19 nt, Homo sapiens
ggugguggcuaauauccuu

SEQ ID NO: 1232666 - RNA, 19 nt, Homo sapiens
gcaccuuccuggcaguaga

SEQ ID NO: 1232667 - RNA, 19 nt, Homo sapiens
agagauagaagagaagaua

SEQ ID NO: 1232668 - RNA, 19 nt, Homo sapiens
ucacgacaguccuuugugu

SEQ ID NO: 1232669 - RNA, 19 nt, Homo sapiens
gcagauaacaaugaagaug

SEQ ID NO: 1232670 - RNA, 19 nt, Homo sapiens
cggaaggcuuuggaaauuu

SEQ ID NO: 1232671 - RNA, 19 nt, Homo sapiens
ccacugcagauaacaauga

SEQ ID NO: 1232672 - RNA, 19 nt, Homo sapiens
ggugacagaaacugaagua

SEQ ID NO: 1232673 - RNA, 19 nt, Homo sapiens
ggacagagaaaaugaaaga

SEQ ID NO: 1232674 - RNA, 19 nt, Homo sapiens
gagaagauaguggauaauc

SEQ ID NO: 1232675 - RNA, 19 nt, Homo sapiens
gauaguggauaaucuucag

SEQ ID NO: 1232676 - RNA, 19 nt, Homo sapiens
gcucccaaagcauuuauaa

SEQ ID NO: 1232677 - RNA, 19 nt, Homo sapiens
aaugucagccaucuuuaua

SEQ ID NO: 1232678 - RNA, 19 nt, Homo sapiens
ccuuuaaguuggagacuga

SEQ ID NO: 1232679 - RNA, 19 nt, Homo sapiens
guugaaugccuauguaugu

SEQ ID NO: 1232680 - RNA, 19 nt, Homo sapiens
gaagagcuuauugggaauu

SEQ ID NO: 1232681 - RNA, 19 nt, Homo sapiens
gaaauugaacacuagaacu

SEQ ID NO: 1232682 - RNA, 19 nt, Homo sapiens
ccaaagacucggaaaccaa

SEQ ID NO: 1232683 - RNA, 19 nt, Homo sapiens
ugugucagauuucuauguu

SEQ ID NO: 1232684 - RNA, 19 nt, Homo sapiens
gcuuucauauggacagaga

SEQ ID NO: 1232685 - RNA, 19 nt, Homo sapiens
acacuagaacuguuaauca

SEQ ID NO: 1232686 - RNA, 19 nt, Homo sapiens
uuaaugacaccugauauga

SEQ ID NO: 1232687 - RNA, 19 nt, Homo sapiens
caaguggugguggcuaaua

SEQ ID NO: 1232688 - RNA, 19 nt, Homo sapiens
gaacacaagauccagucau

SEQ ID NO: 1232689 - RNA, 19 nt, Homo sapiens
aauaaaguguguguccaaa

SEQ ID NO: 1232690 - RNA, 19 nt, Homo sapiens
caauaaaguguguguccaa

SEQ ID NO: 1232691 - RNA, 19 nt, Homo sapiens
ggucaugcuuuggagauca

SEQ ID NO: 1232692 - RNA, 19 nt, Homo sapiens
acacacagcuuuuauaggu

SEQ ID NO: 1232693 - RNA, 19 nt, Homo sapiens
gaaaugccugaacacaaga

SEQ ID NO: 1232694 - RNA, 19 nt, Homo sapiens
cugcggcugugucagauuu

SEQ ID NO: 1232695 - RNA, 19 nt, Homo sapiens
gcccugugcugagccauga

SEQ ID NO: 1232696 - RNA, 19 nt, Homo sapiens
aagagcuuauugggaauua

SEQ ID NO: 1232697 - RNA, 19 nt, Homo sapiens
aaaccaaguuauugcuauc

SEQ ID NO: 1232698 - RNA, 19 nt, Homo sapiens
ucucugaaaugccugaaca

SEQ ID NO: 1232699 - RNA, 19 nt, Homo sapiens
gauagaagagaagauagug

SEQ ID NO: 1232700 - RNA, 19 nt, Homo sapiens
aaacugcuuucuccuuugg

SEQ ID NO: 1232701 - RNA, 19 nt, Homo sapiens
gcucggaaggcuuuggaaa

SEQ ID NO: 1232702 - RNA, 19 nt, Homo sapiens
ugaaugucagccaucuuua

SEQ ID NO: 1232703 - RNA, 19 nt, Homo sapiens
ggacuauuugcaucuguug

SEQ ID NO: 1232704 - RNA, 19 nt, Homo sapiens
uccaaaagcugacacaaug

SEQ ID NO: 1232705 - RNA, 19 nt, Homo sapiens
ucaccacuuuggcggacua

SEQ ID NO: 1232706 - RNA, 19 nt, Homo sapiens
ccaaguuauugcuaucaag

SEQ ID NO: 1232707 - RNA, 19 nt, Homo sapiens
agacucggaaaccaaguua

SEQ ID NO: 1232708 - RNA, 19 nt, Homo sapiens
uuauugcuaucaaggaaga

SEQ ID NO: 1232709 - RNA, 19 nt, Homo sapiens
uaaaguguguguccaaaag

SEQ ID NO: 1232710 - RNA, 19 nt, Homo sapiens
ugaauggucaugcuuugga

SEQ ID NO: 1232711 - RNA, 19 nt, Homo sapiens
uaaugacaccugauaugau

SEQ ID NO: 1232712 - RNA, 19 nt, Homo sapiens
uugguugaaugccuaugua

SEQ ID NO: 1232713 - RNA, 19 nt, Homo sapiens
aaauugaacacuagaacug

SEQ ID NO: 1232714 - RNA, 19 nt, Homo sapiens
aaucuucagucucgacaca

SEQ ID NO: 1232715 - RNA, 19 nt, Homo sapiens
gaaauuuaucagcaucaag

SEQ ID NO: 1232716 - RNA, 19 nt, Homo sapiens
aacacaagauccagucauc

SEQ ID NO: 1232717 - RNA, 19 nt, Homo sapiens
gagauagaagagaagauag

SEQ ID NO: 1232718 - RNA, 19 nt, Homo sapiens
acucggaaaccaaguuauu

SEQ ID NO: 1232719 - RNA, 19 nt, Homo sapiens
gugcugagccaugaggauu

SEQ ID NO: 1232720 - RNA, 19 nt, Homo sapiens
guagagauagaagagaaga

SEQ ID NO: 1232721 - RNA, 19 nt, Homo sapiens
cggacuauuugcaucuguu

SEQ ID NO: 1232722 - RNA, 19 nt, Homo sapiens
ugucagccaucuuuauacu

SEQ ID NO: 1232723 - RNA, 19 nt, Homo sapiens
cagagaaaaugaaagaaag

SEQ ID NO: 1232724 - RNA, 19 nt, Homo sapiens
aaaagcccuuauaggauua

SEQ ID NO: 1232725 - RNA, 19 nt, Homo sapiens
agauaacaaugaagauggu

SEQ ID NO: 1232726 - RNA, 19 nt, Homo sapiens
ggauuauggaugcaugaau

SEQ ID NO: 1232727 - RNA, 19 nt, Homo sapiens
aaaccauggcuuucauaug

SEQ ID NO: 1232728 - RNA, 19 nt, Homo sapiens
aaguggugguggcuaauau

SEQ ID NO: 1232729 - RNA, 19 nt, Homo sapiens
gaaggcuuuggaaauuuau

SEQ ID NO: 1232730 - RNA, 19 nt, Homo sapiens
cugcagauaacaaugaaga

SEQ ID NO: 1232731 - RNA, 19 nt, Homo sapiens
aaagcugacacaauggaaa

SEQ ID NO: 1232732 - RNA, 19 nt, Homo sapiens
aguuauugcuaucaaggaa

SEQ ID NO: 1232733 - RNA, 19 nt, Homo sapiens
cuauguuccugucucugaa

SEQ ID NO: 1232734 - RNA, 19 nt, Homo sapiens
acgacaguccuuuguguuu

SEQ ID NO: 1232735 - RNA, 19 nt, Homo sapiens
uaaccaaacuccaguauua

SEQ ID NO: 1232736 - RNA, 19 nt, Homo sapiens
cgacaugacuuuaaagaua

SEQ ID NO: 1232737 - RNA, 19 nt, Homo sapiens
ggacaagacagaccuauua

SEQ ID NO: 1232738 - RNA, 19 nt, Homo sapiens
uaauaaagcuguuguguug

SEQ ID NO: 1232739 - RNA, 19 nt, Homo sapiens
gggaacagguggaauauuu

SEQ ID NO: 1232740 - RNA, 19 nt, Homo sapiens
ggaaauagcgcuacuaguu

SEQ ID NO: 1232741 - RNA, 19 nt, Homo sapiens
ggacuaugauacuguaaua

SEQ ID NO: 1232742 - RNA, 19 nt, Homo sapiens
gcauaaaggcccuauauuu

SEQ ID NO: 1232743 - RNA, 19 nt, Homo sapiens
gcagacaggugcucuaguu

SEQ ID NO: 1232744 - RNA, 19 nt, Homo sapiens
ugaaaucccuccuaauaaa

SEQ ID NO: 1232745 - RNA, 19 nt, Homo sapiens
gcacuugaauuccugcuuu

SEQ ID NO: 1232746 - RNA, 19 nt, Homo sapiens
ccagaaaggucuacaguau

SEQ ID NO: 1232747 - RNA, 19 nt, Homo sapiens
gcaagugcauccuuugauu

SEQ ID NO: 1232748 - RNA, 19 nt, Homo sapiens
gaauggagcacauacuaua

SEQ ID NO: 1232749 - RNA, 19 nt, Homo sapiens
caacaagcuuauagagaua

SEQ ID NO: 1232750 - RNA, 19 nt, Homo sapiens
cauauuacccugugacuua

SEQ ID NO: 1232751 - RNA, 19 nt, Homo sapiens
ggacauauuucugccaauu

SEQ ID NO: 1232752 - RNA, 19 nt, Homo sapiens
gcaagcacauaauaaagaa

SEQ ID NO: 1232753 - RNA, 19 nt, Homo sapiens
cguaaugccugauguagua

SEQ ID NO: 1232754 - RNA, 19 nt, Homo sapiens
gaugguaccuuguuugaug

SEQ ID NO: 1232755 - RNA, 19 nt, Homo sapiens
guugugaccucaugguuua

SEQ ID NO: 1232756 - RNA, 19 nt, Homo sapiens
guugaaaucccuccuaaua

SEQ ID NO: 1232757 - RNA, 19 nt, Homo sapiens
gaagcagaaguuaguauua

SEQ ID NO: 1232758 - RNA, 19 nt, Homo sapiens
gugaaucaguuucuuguuu

SEQ ID NO: 1232759 - RNA, 19 nt, Homo sapiens
gcauauaacacugccauua

SEQ ID NO: 1232760 - RNA, 19 nt, Homo sapiens
ccauagagaagauacauua

SEQ ID NO: 1232761 - RNA, 19 nt, Homo sapiens
gaaauagcgcuacuaguug

SEQ ID NO: 1232762 - RNA, 19 nt, Homo sapiens
gcacauacuauagcaaaua

SEQ ID NO: 1232763 - RNA, 19 nt, Homo sapiens
ccagguaugucauuucuga

SEQ ID NO: 1232764 - RNA, 19 nt, Homo sapiens
cagcagacaccauggauua

SEQ ID NO: 1232765 - RNA, 19 nt, Homo sapiens
gaagagaauagucaucaaa

SEQ ID NO: 1232766 - RNA, 19 nt, Homo sapiens
gagcauauauucaguuggu

SEQ ID NO: 1232767 - RNA, 19 nt, Homo sapiens
guacagauaugugcauuca

SEQ ID NO: 1232768 - RNA, 19 nt, Homo sapiens
cauaaaggcccuauauuug

SEQ ID NO: 1232769 - RNA, 19 nt, Homo sapiens
gaauauggaaucuuaguga

SEQ ID NO: 1232770 - RNA, 19 nt, Homo sapiens
gcaagauaacggcauauaa

SEQ ID NO: 1232771 - RNA, 19 nt, Homo sapiens
guaguuuguucuugcuuua

SEQ ID NO: 1232772 - RNA, 19 nt, Homo sapiens
uaaccuugcuagcaccuua

SEQ ID NO: 1232773 - RNA, 19 nt, Homo sapiens
ugaccucuguuauuguuua

SEQ ID NO: 1232774 - RNA, 19 nt, Homo sapiens
uaauaaggcuugucaugau

SEQ ID NO: 1232775 - RNA, 19 nt, Homo sapiens
acaauuguguccaugauuu

SEQ ID NO: 1232776 - RNA, 19 nt, Homo sapiens
gagaauggagcacauacua

SEQ ID NO: 1232777 - RNA, 19 nt, Homo sapiens
gaggucaacuucuugguau

SEQ ID NO: 1232778 - RNA, 19 nt, Homo sapiens
guaagggagugaaucaguu

SEQ ID NO: 1232779 - RNA, 19 nt, Homo sapiens
gguggaauauuugaaguuu

SEQ ID NO: 1232780 - RNA, 19 nt, Homo sapiens
gaacagguggaauauuuga

SEQ ID NO: 1232781 - RNA, 19 nt, Homo sapiens
ccugauagaugccguaaug

SEQ ID NO: 1232782 - RNA, 19 nt, Homo sapiens
cgaaugaaguaaaugcuau

SEQ ID NO: 1232783 - RNA, 19 nt, Homo sapiens
acaacaagcuuauagagau

SEQ ID NO: 1232784 - RNA, 19 nt, Homo sapiens
gaaguaagggagugaauca

SEQ ID NO: 1232785 - RNA, 19 nt, Homo sapiens
ggauguagaccgagggaua

SEQ ID NO: 1232786 - RNA, 19 nt, Homo sapiens
gcaacugguuccuaugaug

SEQ ID NO: 1232787 - RNA, 19 nt, Homo sapiens
agaaaggucuacaguaugu

SEQ ID NO: 1232788 - RNA, 19 nt, Homo sapiens
gaaugcagcaggagacaaa

SEQ ID NO: 1232789 - RNA, 19 nt, Homo sapiens
gcauucaugucuguaaauu

SEQ ID NO: 1232790 - RNA, 19 nt, Homo sapiens
aaagcaagauaacggcaua

SEQ ID NO: 1232791 - RNA, 19 nt, Homo sapiens
gcagacaccauggauuaua

SEQ ID NO: 1232792 - RNA, 19 nt, Homo sapiens
acagauaugugcauucaug

SEQ ID NO: 1232793 - RNA, 19 nt, Homo sapiens
gacuaaagaugguaaccuu

SEQ ID NO: 1232794 - RNA, 19 nt, Homo sapiens
aaacaagacaacaagcuua

SEQ ID NO: 1232795 - RNA, 19 nt, Homo sapiens
gaccgacuaugaaugugua

SEQ ID NO: 1232796 - RNA, 19 nt, Homo sapiens
uaaauuaggacaagacaga

SEQ ID NO: 1232797 - RNA, 19 nt, Homo sapiens
ggacauacgaaugaaguaa

SEQ ID NO: 1232798 - RNA, 19 nt, Homo sapiens
cauccuaagugcuggagua

SEQ ID NO: 1232799 - RNA, 19 nt, Homo sapiens
gagcacauacuauagcaaa

SEQ ID NO: 1232800 - RNA, 19 nt, Homo sapiens
uggcuuaaaugcaauaguu

SEQ ID NO: 1232801 - RNA, 19 nt, Homo sapiens
gauuauggaugcaugaagu

SEQ ID NO: 1232802 - RNA, 19 nt, Homo sapiens
ggaaauuucauccuaagug

SEQ ID NO: 1232803 - RNA, 19 nt, Homo sapiens
gugaugaggucaacuucuu

SEQ ID NO: 1232804 - RNA, 19 nt, Homo sapiens
cuaaaugacagccuuguuu

SEQ ID NO: 1232805 - RNA, 19 nt, Homo sapiens
ggcaagauguuccaagcaa

SEQ ID NO: 1232806 - RNA, 19 nt, Homo sapiens
guacuuagacauuguauac

SEQ ID NO: 1232807 - RNA, 19 nt, Homo sapiens
guaaugcagcuuugauuga

SEQ ID NO: 1232808 - RNA, 19 nt, Homo sapiens
caccauggauuauauucuu

SEQ ID NO: 1232809 - RNA, 19 nt, Homo sapiens
ccacuacagccaaaucuaa

SEQ ID NO: 1232810 - RNA, 19 nt, Homo sapiens
caguggcucuacacaguua

SEQ ID NO: 1232811 - RNA, 19 nt, Homo sapiens
ggccaugaaucugaaguuu

SEQ ID NO: 1232812 - RNA, 19 nt, Homo sapiens
caagagaggcagucauuca

SEQ ID NO: 1232813 - RNA, 19 nt, Homo sapiens
ugguucaguuuguguauua

SEQ ID NO: 1232814 - RNA, 19 nt, Homo sapiens
guuagcaagugcauccuuu

SEQ ID NO: 1232815 - RNA, 19 nt, Homo sapiens
ggacgcacauacuggugaa

SEQ ID NO: 1232816 - RNA, 19 nt, Homo sapiens
gccagaauauggacuaaag

SEQ ID NO: 1232817 - RNA, 19 nt, Homo sapiens
aggaauugcuuauuguuga

SEQ ID NO: 1232818 - RNA, 19 nt, Homo sapiens
aaauagcagugauucagaa

SEQ ID NO: 1232819 - RNA, 19 nt, Homo sapiens
ugauguggcuuaaaugcaa

SEQ ID NO: 1232820 - RNA, 19 nt, Homo sapiens
cagacaccauggauuauau

SEQ ID NO: 1232821 - RNA, 19 nt, Homo sapiens
caacaggaccagggacuaa

SEQ ID NO: 1232822 - RNA, 19 nt, Homo sapiens
gacaagacagaccuauuaa

SEQ ID NO: 1232823 - RNA, 19 nt, Homo sapiens
gcaccagcauuggauguug

SEQ ID NO: 1232824 - RNA, 19 nt, Homo sapiens
uaaccuguguucuaaguag

SEQ ID NO: 1232825 - RNA, 19 nt, Homo sapiens
gacauauuucugccaauua

SEQ ID NO: 1232826 - RNA, 19 nt, Homo sapiens
guagugagcaguuuguaug

SEQ ID NO: 1232827 - RNA, 19 nt, Homo sapiens
cugaguaucuggcacuuga

SEQ ID NO: 1232828 - RNA, 19 nt, Homo sapiens
uaaggcuugucaugauuaa

SEQ ID NO: 1232829 - RNA, 19 nt, Homo sapiens
cagagcauauauucaguug

SEQ ID NO: 1232830 - RNA, 19 nt, Homo sapiens
ggacuaauaauccaaaugc

SEQ ID NO: 1232831 - RNA, 19 nt, Homo sapiens
gcagagcaacaacaccuuu

SEQ ID NO: 1232832 - RNA, 19 nt, Homo sapiens
ccaagcaacaguuuccuuu

SEQ ID NO: 1232833 - RNA, 19 nt, Homo sapiens
uaaaggcccuauauuugca

SEQ ID NO: 1232834 - RNA, 19 nt, Homo sapiens
cagcauaaaggcccuauau

SEQ ID NO: 1232835 - RNA, 19 nt, Homo sapiens
aaacaaagccagaugauua

SEQ ID NO: 1232836 - RNA, 19 nt, Homo sapiens
ggaaaguacugcaaauaaa

SEQ ID NO: 1232837 - RNA, 19 nt, Homo sapiens
gaggagauguggagaauuu

SEQ ID NO: 1232838 - RNA, 19 nt, Homo sapiens
ggaggcagcugcagaauug

SEQ ID NO: 1232839 - RNA, 19 nt, Homo sapiens
gaaguuggcucugggauug

SEQ ID NO: 1232840 - RNA, 19 nt, Homo sapiens
agacagagaugaaauugaa

SEQ ID NO: 1232841 - RNA, 19 nt, Homo sapiens
gaacagaagaucuuauugu

SEQ ID NO: 1232842 - RNA, 19 nt, Homo sapiens
gaauggagccucaaacaug

SEQ ID NO: 1232843 - RNA, 19 nt, Homo sapiens
gaugaugacuucccagaau

SEQ ID NO: 1232844 - RNA, 19 nt, Homo sapiens
ggaaaccucucuacugagu

SEQ ID NO: 1232845 - RNA, 19 nt, Homo sapiens
ggaauacagugauaguaau

SEQ ID NO: 1232846 - RNA, 19 nt, Homo sapiens
gcucugaacuggcacauag

SEQ ID NO: 1232847 - RNA, 19 nt, Homo sapiens
gaacacuggacauugcuua

SEQ ID NO: 1232848 - RNA, 19 nt, Homo sapiens
gcagcuaagucucuaccua

SEQ ID NO: 1232849 - RNA, 19 nt, Homo sapiens
gaaggaaaccucucuacug

SEQ ID NO: 1232850 - RNA, 19 nt, Homo sapiens
gaauugaugugagcuaugu

SEQ ID NO: 1232851 - RNA, 19 nt, Homo sapiens
aaacagaccagacuagaaa

SEQ ID NO: 1232852 - RNA, 19 nt, Homo sapiens
aaggaaaccucucuacuga

SEQ ID NO: 1232853 - RNA, 19 nt, Homo sapiens
cagaggaacugauaagcaa

SEQ ID NO: 1232854 - RNA, 19 nt, Homo sapiens
cauuguggaucccauguua

SEQ ID NO: 1232855 - RNA, 19 nt, Homo sapiens
ggggauauguuguauguua

SEQ ID NO: 1232856 - RNA, 19 nt, Homo sapiens
ggaacaaaccauagcauug

SEQ ID NO: 1232857 - RNA, 19 nt, Homo sapiens
cagaaggaauggaaugcua

SEQ ID NO: 1232858 - RNA, 19 nt, Homo sapiens
aaacauggcuuugaauugg

SEQ ID NO: 1232859 - RNA, 19 nt, Homo sapiens
cagcagacaucaaucuaug

SEQ ID NO: 1232860 - RNA, 19 nt, Homo sapiens
cuaagucucuaccuaagaa

SEQ ID NO: 1232861 - RNA, 19 nt, Homo sapiens
gaacaaaccauagcauugg

SEQ ID NO: 1232862 - RNA, 19 nt, Homo sapiens
gauaggaaccaaggcuuua

SEQ ID NO: 1232863 - RNA, 19 nt, Homo sapiens
caaugaugcugugagauuu

SEQ ID NO: 1232864 - RNA, 19 nt, Homo sapiens
aaagaaacagguuggguua

SEQ ID NO: 1232865 - RNA, 19 nt, Homo sapiens
ggaaugaggguaggauaaa

SEQ ID NO: 1232866 - RNA, 19 nt, Homo sapiens
gauggagagcacugaauua

SEQ ID NO: 1232867 - RNA, 19 nt, Homo sapiens
cauguuagaucuggauauu

SEQ ID NO: 1232868 - RNA, 19 nt, Homo sapiens
ccaauguagugaugaagaa

SEQ ID NO: 1232869 - RNA, 19 nt, Homo sapiens
gaaacagguuggguuagga

SEQ ID NO: 1232870 - RNA, 19 nt, Homo sapiens
ccuggaccauugauaauaa

SEQ ID NO: 1232871 - RNA, 19 nt, Homo sapiens
ccaaugaugcugugagauu

SEQ ID NO: 1232872 - RNA, 19 nt, Homo sapiens
ugucugagcucaugcuaga

SEQ ID NO: 1232873 - RNA, 19 nt, Homo sapiens
uuacacagcaugaaagaaa

SEQ ID NO: 1232874 - RNA, 19 nt, Homo sapiens
auaagcaaauggcaaguuu

SEQ ID NO: 1232875 - RNA, 19 nt, Homo sapiens
gugauaacauaccgugauu

SEQ ID NO: 1232876 - RNA, 19 nt, Homo sapiens
gcaaaggauuucuauucca

SEQ ID NO: 1232877 - RNA, 19 nt, Homo sapiens
gaaugaggguaggauaaau

SEQ ID NO: 1232878 - RNA, 19 nt, Homo sapiens
uguaagagagugaggaaua

SEQ ID NO: 1232879 - RNA, 19 nt, Homo sapiens
gcgauagagugucugaaga

SEQ ID NO: 1232880 - RNA, 19 nt, Homo sapiens
aaaccucucuacugaguug

SEQ ID NO: 1232881 - RNA, 19 nt, Homo sapiens
aaauugcccuuaucauguu

SEQ ID NO: 1232882 - RNA, 19 nt, Homo sapiens
gaagaaugauaggaaccaa

SEQ ID NO: 1232883 - RNA, 19 nt, Homo sapiens
gcccaucaguguuucuuug

SEQ ID NO: 1232884 - RNA, 19 nt, Homo sapiens
gaaauucuucuguccuaga

SEQ ID NO: 1232885 - RNA, 19 nt, Homo sapiens
gaaaagugcaugcagaaaa

SEQ ID NO: 1232886 - RNA, 19 nt, Homo sapiens
cacaacagaugcccagguu

SEQ ID NO: 1232887 - RNA, 19 nt, Homo sapiens
guacugaaucccucucuga

SEQ ID NO: 1232888 - RNA, 19 nt, Homo sapiens
guagugaugaagaaugaua

SEQ ID NO: 1232889 - RNA, 19 nt, Homo sapiens
cccagaaucuacaggagua

SEQ ID NO: 1232890 - RNA, 19 nt, Homo sapiens
ugaggaggaugaugacuuc

SEQ ID NO: 1232891 - RNA, 19 nt, Homo sapiens
gauagagugucugaagaug

SEQ ID NO: 1232892 - RNA, 19 nt, Homo sapiens
uggaaaguacugcaaauaa

SEQ ID NO: 1232893 - RNA, 19 nt, Homo sapiens
ugccagagcuguguuguug

SEQ ID NO: 1232894 - RNA, 19 nt, Homo sapiens
cugcgacgcuuccucauga

SEQ ID NO: 1232895 - RNA, 19 nt, Homo sapiens
uguuagaucuggauauuca

SEQ ID NO: 1232896 - RNA, 19 nt, Homo sapiens
uccagacacuaccuuauaa

SEQ ID NO: 1232897 - RNA, 19 nt, Homo sapiens
cagcuaagucucuaccuaa

SEQ ID NO: 1232898 - RNA, 19 nt, Homo sapiens
aguaggagguuaaggagaa

SEQ ID NO: 1232899 - RNA, 19 nt, Homo sapiens
cauguuggcugccugacuu

SEQ ID NO: 1232900 - RNA, 19 nt, Homo sapiens
gccaaugugugguccaaug

SEQ ID NO: 1232901 - RNA, 19 nt, Homo sapiens
ugagugaggauuucuuaaa

SEQ ID NO: 1232902 - RNA, 19 nt, Homo sapiens
gaauacagugauaguaaug

SEQ ID NO: 1232903 - RNA, 19 nt, Homo sapiens
ggaaguuggcucugggauu

SEQ ID NO: 1232904 - RNA, 19 nt, Homo sapiens
guuaggagcagaaagaaau

SEQ ID NO: 1232905 - RNA, 19 nt, Homo sapiens
gaggguaggauaaaucuca

SEQ ID NO: 1232906 - RNA, 19 nt, Homo sapiens
gguccaauguagugaugaa

SEQ ID NO: 1232907 - RNA, 19 nt, Homo sapiens
uggcguacccugugcguua

SEQ ID NO: 1232908 - RNA, 19 nt, Homo sapiens
ucuauccuuugucuuguua

SEQ ID NO: 1232909 - RNA, 19 nt, Homo sapiens
guaagagagugaggaauac

SEQ ID NO: 1232910 - RNA, 19 nt, Homo sapiens
ggagacagagaugaaauug

SEQ ID NO: 1232911 - RNA, 19 nt, Homo sapiens
cugaaucccucucugauca

SEQ ID NO: 1232912 - RNA, 19 nt, Homo sapiens
auacuaggccaucugguua

SEQ ID NO: 1232913 - RNA, 19 nt, Homo sapiens
aaaggaagaguggaaagua

SEQ ID NO: 1232914 - RNA, 19 nt, Homo sapiens
aacagaagaucuuauugug

SEQ ID NO: 1232915 - RNA, 19 nt, Homo sapiens
ggaguugccugaggaggau

SEQ ID NO: 1232916 - RNA, 19 nt, Homo sapiens
ggugggcucuagaaccauu

SEQ ID NO: 1232917 - RNA, 19 nt, Homo sapiens
caacauacccuuggaacag

SEQ ID NO: 1232918 - RNA, 19 nt, Homo sapiens
ggaacagaagaucuuauug

SEQ ID NO: 1232919 - RNA, 19 nt, Homo sapiens
uccaagcauuugugguuua

SEQ ID NO: 1232920 - RNA, 19 nt, Homo sapiens
uaggccaucugguuagaaa

SEQ ID NO: 1232921 - RNA, 19 nt, Homo sapiens
gagcuaugaugcuuuuauu

SEQ ID NO: 1232922 - RNA, 19 nt, Homo sapiens
gaucuuggucugcgauaga

SEQ ID NO: 1232923 - RNA, 19 nt, Homo sapiens
guggggaagugaaauguua

SEQ ID NO: 1232924 - RNA, 19 nt, Homo sapiens
gauaacauaccgugauuuu

SEQ ID NO: 1232925 - RNA, 19 nt, Homo sapiens
gagacaguaugugauaaca

SEQ ID NO: 1232926 - RNA, 19 nt, Homo sapiens
cauuugugguuuacuuuga

SEQ ID NO: 1232927 - RNA, 19 nt, Homo sapiens
caggaguugugucaccuuu

SEQ ID NO: 1232928 - RNA, 19 nt, Homo sapiens
gaggaauacagugauagua

SEQ ID NO: 1232929 - RNA, 19 nt, Homo sapiens
aaucgggccuugauagugu

SEQ ID NO: 1232930 - RNA, 19 nt, Homo sapiens
cuuaaaagauggaagguuu

SEQ ID NO: 1232931 - RNA, 19 nt, Homo sapiens
uauguuagagagaaccuua

SEQ ID NO: 1232932 - RNA, 19 nt, Homo sapiens
cagaauugaugugagcuau

SEQ ID NO: 1232933 - RNA, 19 nt, Homo sapiens
gggagacagagaugaaauu

SEQ ID NO: 1232934 - RNA, 19 nt, Homo sapiens
uaaacaaagccagaugauu

SEQ ID NO: 1232935 - RNA, 19 nt, Homo sapiens
gaacauggcagagaaguuu

SEQ ID NO: 1232936 - RNA, 19 nt, Homo sapiens
gaaagacaguccuaugugu

SEQ ID NO: 1232937 - RNA, 19 nt, Homo sapiens
gacuugaacucuacuguaa

SEQ ID NO: 1232938 - RNA, 19 nt, Homo sapiens
caaguucauugcccuguua

SEQ ID NO: 1232939 - RNA, 19 nt, Homo sapiens
cagcgugucugucugauuu

SEQ ID NO: 1232940 - RNA, 19 nt, Homo sapiens
gaacucauguuugggaaga

SEQ ID NO: 1232941 - RNA, 19 nt, Homo sapiens
ggaagacacugagaacaug

SEQ ID NO: 1232942 - RNA, 19 nt, Homo sapiens
gaacucuacuguaacuguu

SEQ ID NO: 1232943 - RNA, 19 nt, Homo sapiens
ugacggagauggugcagaa

SEQ ID NO: 1232944 - RNA, 19 nt, Homo sapiens
gacgugagcuuggcauuga

SEQ ID NO: 1232945 - RNA, 19 nt, Homo sapiens
gggccaagauugaggaaga

SEQ ID NO: 1232946 - RNA, 19 nt, Homo sapiens
ggacuugaacucuacugua

SEQ ID NO: 1232947 - RNA, 19 nt, Homo sapiens
cacagaauguucagcuuaa

SEQ ID NO: 1232948 - RNA, 19 nt, Homo sapiens
ccaagaccauucagggaaa

SEQ ID NO: 1232949 - RNA, 19 nt, Homo sapiens
gauacugucuugagcagau

SEQ ID NO: 1232950 - RNA, 19 nt, Homo sapiens
ggagaggucaccauaguca

SEQ ID NO: 1232951 - RNA, 19 nt, Homo sapiens
acacagaauguucagcuua

SEQ ID NO: 1232952 - RNA, 19 nt, Homo sapiens
gaagaccaaauuagacaga

SEQ ID NO: 1232953 - RNA, 19 nt, Homo sapiens
gagcuuggcauugaaguug

SEQ ID NO: 1232954 - RNA, 19 nt, Homo sapiens
guaggucaguggugaguag

SEQ ID NO: 1232955 - RNA, 19 nt, Homo sapiens
aaaugcagauacugucuug

SEQ ID NO: 1232956 - RNA, 19 nt, Homo sapiens
caucaaggcaguugugugu

SEQ ID NO: 1232957 - RNA, 19 nt, Homo sapiens
ggagaacuuccucuggauu

SEQ ID NO: 1232958 - RNA, 19 nt, Homo sapiens
gaggagacacagaauguuc

SEQ ID NO: 1232959 - RNA, 19 nt, Homo sapiens
gaaucgugguccuucuguu

SEQ ID NO: 1232960 - RNA, 19 nt, Homo sapiens
gcaauuuccuuuugugcaa

SEQ ID NO: 1232961 - RNA, 19 nt, Homo sapiens
gcccugaagguuucuauga

SEQ ID NO: 1232962 - RNA, 19 nt, Homo sapiens
cgaaagacaguccuaugug

SEQ ID NO: 1232963 - RNA, 19 nt, Homo sapiens
ugaccuggcugcugcucuu

SEQ ID NO: 1232964 - RNA, 19 nt, Homo sapiens
guccuucuguugcagcuuu

SEQ ID NO: 1232965 - RNA, 19 nt, Homo sapiens
gagaacuuccucuggauuc

SEQ ID NO: 1232966 - RNA, 19 nt, Homo sapiens
cagcuuaacaaagaaauga

SEQ ID NO: 1232967 - RNA, 19 nt, Homo sapiens
ccgaugaaguggaugcaau

SEQ ID NO: 1232968 - RNA, 19 nt, Homo sapiens
ggucaguggugaguaguag

SEQ ID NO: 1232969 - RNA, 19 nt, Homo sapiens
cugagaacauggcagagaa

SEQ ID NO: 1232970 - RNA, 19 nt, Homo sapiens
ccaaguucauugcccuguu

SEQ ID NO: 1232971 - RNA, 19 nt, Homo sapiens
cuucagagccacaagcaaa

SEQ ID NO: 1232972 - RNA, 19 nt, Homo sapiens
gacacagaauguucagcuu

SEQ ID NO: 1232973 - RNA, 19 nt, Homo sapiens
cugcugcucuugcuucaga

SEQ ID NO: 1232974 - RNA, 19 nt, Homo sapiens
ccucuggauuccuucauug

SEQ ID NO: 1232975 - RNA, 19 nt, Homo sapiens
gacagaaggcagaacugaa

SEQ ID NO: 1232976 - RNA, 19 nt, Homo sapiens
ugaaguggaugcaauuucc

SEQ ID NO: 1232977 - RNA, 19 nt, Homo sapiens
gaugaaguggaugcaauuu

SEQ ID NO: 1232978 - RNA, 19 nt, Homo sapiens
ugacagaaggcagaacuga

SEQ ID NO: 1232979 - RNA, 19 nt, Homo sapiens
cugaagguuucuaugaaga

SEQ ID NO: 1232980 - RNA, 19 nt, Homo sapiens
uccgugugauuucuaagua

SEQ ID NO: 1232981 - RNA, 19 nt, Homo sapiens
gaaaaggccgaggugcuua

SEQ ID NO: 1232982 - RNA, 19 nt, Homo sapiens
cccugaagguuucuaugaa

SEQ ID NO: 1232983 - RNA, 19 nt, Homo sapiens
ccugaagguuucuaugaag

SEQ ID NO: 1232984 - RNA, 19 nt, Homo sapiens
ggaggagacacagaauguu

SEQ ID NO: 1232985 - RNA, 19 nt, Homo sapiens
guugcucacugaaucuguu

SEQ ID NO: 1232986 - RNA, 19 nt, Homo sapiens
ggcuugccauguucuguga

SEQ ID NO: 1232987 - RNA, 19 nt, Homo sapiens
cgaugaaguggaugcaauu

SEQ ID NO: 1232988 - RNA, 19 nt, Homo sapiens
caagaccauucagggaaau

SEQ ID NO: 1232989 - RNA, 19 nt, Homo sapiens
guugcagcuuuauuuaaug

SEQ ID NO: 1232990 - RNA, 19 nt, Homo sapiens
cuggauuccuucauugaug

SEQ ID NO: 1232991 - RNA, 19 nt, Homo sapiens
ucgaaaugccgaugaagug

SEQ ID NO: 1232992 - RNA, 19 nt, Homo sapiens
uuuacuacgugugugauuu

SEQ ID NO: 1232993 - RNA, 19 nt, Homo sapiens
gcgcacgagugggacuuug

SEQ ID NO: 1232994 - RNA, 19 nt, Homo sapiens
ucgaaagacaguccuaugu

SEQ ID NO: 1232995 - RNA, 19 nt, Homo sapiens
ucuguugcagcuuuauuua

SEQ ID NO: 1232996 - RNA, 19 nt, Homo sapiens
cggagauggugcagaagau

SEQ ID NO: 1232997 - RNA, 19 nt, Homo sapiens
ugcauuauccgugugauuu

SEQ ID NO: 1232998 - RNA, 19 nt, Homo sapiens
uggcaccuguugacggaaa

SEQ ID NO: 1232999 - RNA, 19 nt, Homo sapiens
cggcucugcuuucucugaa

SEQ ID NO: 1233000 - RNA, 19 nt, Homo sapiens
gcauuauccgugugauuuc

SEQ ID NO: 1233001 - RNA, 19 nt, Homo sapiens
ggagauggugcagaagaug

SEQ ID NO: 1233002 - RNA, 19 nt, Homo sapiens
ccagucccauuuagaaucg

SEQ ID NO: 1233003 - RNA, 19 nt, Homo sapiens
acagaaggcagaacugaag

SEQ ID NO: 1233004 - RNA, 19 nt, Homo sapiens
aaaugccgaugaaguggau

SEQ ID NO: 1233005 - RNA, 19 nt, Homo sapiens
ggggagaggucaccauagu

SEQ ID NO: 1233006 - RNA, 19 nt, Homo sapiens
aaagaagaccaaauuagac

SEQ ID NO: 1233007 - RNA, 19 nt, Homo sapiens
uuacugcggccaugaguuc

SEQ ID NO: 1233008 - RNA, 19 nt, Homo sapiens
uaucagagcaaacggaaac

SEQ ID NO: 1233009 - RNA, 19 nt, Homo sapiens
uggauuccuucauugaugu

SEQ ID NO: 1233010 - RNA, 19 nt, Homo sapiens
aagaagaccaaauuagaca

SEQ ID NO: 1233011 - RNA, 19 nt, Homo sapiens
ccggugcuguggcuguaaa

SEQ ID NO: 1233012 - RNA, 19 nt, Homo sapiens
gagacccuguuagcacuuc

SEQ ID NO: 1233013 - RNA, 19 nt, Homo sapiens
ccucagugaccauacauuc

SEQ ID NO: 1233014 - RNA, 19 nt, Homo sapiens
uggaggagacacagaaugu

SEQ ID NO: 1233015 - RNA, 19 nt, Homo sapiens
ucauguuugggaagaaaua

SEQ ID NO: 1233016 - RNA, 19 nt, Homo sapiens
gcagaaggggccaagauug

SEQ ID NO: 1233017 - RNA, 19 nt, Homo sapiens
ugaacucuacuguaacugu

SEQ ID NO: 1233018 - RNA, 19 nt, Homo sapiens
ggaaaaggccgaggugcuu

SEQ ID NO: 1233019 - RNA, 19 nt, Homo sapiens
cagauaaagaagaccaaau

SEQ ID NO: 1233020 - RNA, 19 nt, Homo sapiens
gcacgagugggacuuugca

SEQ ID NO: 1233021 - RNA, 19 nt, Homo sapiens
acucauguuugggaagaaa

SEQ ID NO: 1233022 - RNA, 19 nt, Homo sapiens
cgugugauuucuaaguauc

SEQ ID NO: 1233023 - RNA, 19 nt, Homo sapiens
uuauccgugugauuucuaa

SEQ ID NO: 1233024 - RNA, 19 nt, Homo sapiens
ggccagcgugucugucuga

SEQ ID NO: 1233025 - RNA, 19 nt, Homo sapiens
ccacaugcgacgggugaaa

SEQ ID NO: 1233026 - RNA, 19 nt, Homo sapiens
ucucggacuugaacucuac

SEQ ID NO: 1233027 - RNA, 19 nt, Homo sapiens
agaccaaauuagacagaca

SEQ ID NO: 1233028 - RNA, 19 nt, Homo sapiens
aguugugugugccggguua

SEQ ID NO: 1233029 - RNA, 19 nt, Homo sapiens
aggauucucuucgcaguuc

SEQ ID NO: 1233030 - RNA, 19 nt, Homo sapiens
uggagaacuuccucuggau

SEQ ID NO: 1233031 - RNA, 19 nt, Homo sapiens
gaggaagacacugagaaca

SEQ ID NO: 1233032 - RNA, 19 nt, Homo sapiens
guccggugcuguggcugua

SEQ ID NO: 1233033 - RNA, 19 nt, Homo sapiens
cuugaacucuacuguaacu

SEQ ID NO: 1233034 - RNA, 19 nt, Homo sapiens
gggcaguggcaccuguuga

SEQ ID NO: 1233035 - RNA, 19 nt, Homo sapiens
gcagaaauguagaugaaua

SEQ ID NO: 1233036 - RNA, 19 nt, Homo sapiens
gaagugagcaggauuuauu

SEQ ID NO: 1233037 - RNA, 19 nt, Homo sapiens
gaacgaagaccaauuuagu

SEQ ID NO: 1233038 - RNA, 19 nt, Homo sapiens
uuaguaagcugcauucuau

SEQ ID NO: 1233039 - RNA, 19 nt, Homo sapiens
uaagaacgaagaccaauuu

SEQ ID NO: 1233040 - RNA, 19 nt, Homo sapiens
gcagagagcccaucagaag

SEQ ID NO: 1233041 - RNA, 19 nt, Homo sapiens
caagauuacuccaguuugu

SEQ ID NO: 1233042 - RNA, 19 nt, Homo sapiens
ggacaagauuacuccaguu

SEQ ID NO: 1233043 - RNA, 19 nt, Homo sapiens
agaaaccgcuggcccguaa

SEQ ID NO: 1233044 - RNA, 19 nt, Homo sapiens
ugccagauguuacuagaua

SEQ ID NO: 1233045 - RNA, 19 nt, Homo sapiens
gagaaccucugcggacaaa

SEQ ID NO: 1233046 - RNA, 19 nt, Homo sapiens
uaagcagccugaacaauuc

SEQ ID NO: 1233047 - RNA, 19 nt, Homo sapiens
gaagaccaauuuaguaagc

SEQ ID NO: 1233048 - RNA, 19 nt, Homo sapiens
ggcaauaacuuccuaacag

SEQ ID NO: 1233049 - RNA, 19 nt, Homo sapiens
gagcagagagcccaucaga

SEQ ID NO: 1233050 - RNA, 19 nt, Homo sapiens
cuaagcagccugaacaauu

SEQ ID NO: 1233051 - RNA, 19 nt, Homo sapiens
gccacucgcugcagaaaug

SEQ ID NO: 1233052 - RNA, 19 nt, Homo sapiens
gaagaaaaccucagacaau

SEQ ID NO: 1233053 - RNA, 19 nt, Homo sapiens
cuacacauguccaccauca

SEQ ID NO: 1233054 - RNA, 19 nt, Homo sapiens
caacgugcucaaccaaaua

SEQ ID NO: 1233055 - RNA, 19 nt, Homo sapiens
gacaagauuacuccaguuu

SEQ ID NO: 1233056 - RNA, 19 nt, Homo sapiens
cugcagaaauguagaugaa

SEQ ID NO: 1233057 - RNA, 19 nt, Homo sapiens
gauacucccuaaauaagca

SEQ ID NO: 1233058 - RNA, 19 nt, Homo sapiens
uggcuaugguugaauuuaa

SEQ ID NO: 1233059 - RNA, 19 nt, Homo sapiens
cagaagagagugaacauuc

SEQ ID NO: 1233060 - RNA, 19 nt, Homo sapiens
ggacugugucuucuucuga

SEQ ID NO: 1233061 - RNA, 19 nt, Homo sapiens
gcucugcuccucaucauau

SEQ ID NO: 1233062 - RNA, 19 nt, Homo sapiens
ggacaccucagaagucaau

SEQ ID NO: 1233063 - RNA, 19 nt, Homo sapiens
gcaauuccaagucaacgaa

SEQ ID NO: 1233064 - RNA, 19 nt, Homo sapiens
aaucagggaucuuccuuuc

SEQ ID NO: 1233065 - RNA, 19 nt, Homo sapiens
ucaacgugcucaaccaaau

SEQ ID NO: 1233066 - RNA, 19 nt, Homo sapiens
caagaaagaagagcagaga

SEQ ID NO: 1233067 - RNA, 19 nt, Homo sapiens
guaagaacgaagaccaauu

SEQ ID NO: 1233068 - RNA, 19 nt, Homo sapiens
caccuucgccaucuacaua

SEQ ID NO: 1233069 - RNA, 19 nt, Homo sapiens
ccaucacccugggcaauaa

SEQ ID NO: 1233070 - RNA, 19 nt, Homo sapiens
gcagggaccgauacagaga

SEQ ID NO: 1233071 - RNA, 19 nt, Homo sapiens
gaagagagugaacauucug

SEQ ID NO: 1233072 - RNA, 19 nt, Homo sapiens
gccagauguuacuagauaa

SEQ ID NO: 1233073 - RNA, 19 nt, Homo sapiens
gcucauuuaacacuuacua

SEQ ID NO: 1233074 - RNA, 19 nt, Homo sapiens
acgaagaccaauuuaguaa

SEQ ID NO: 1233075 - RNA, 19 nt, Homo sapiens
auaagcugcuggacagauu

SEQ ID NO: 1233076 - RNA, 19 nt, Homo sapiens
ccuggaagagugauucuaa

SEQ ID NO: 1233077 - RNA, 19 nt, Homo sapiens
cagcagggaccgauacaga

SEQ ID NO: 1233078 - RNA, 19 nt, Homo sapiens
acugagcuauguuugguuu

SEQ ID NO: 1233079 - RNA, 19 nt, Homo sapiens
gcagaagagagugaacauu

SEQ ID NO: 1233080 - RNA, 19 nt, Homo sapiens
gcugccagauguuacuaga

SEQ ID NO: 1233081 - RNA, 19 nt, Homo sapiens
cgggcucauuuaacacuua

SEQ ID NO: 1233082 - RNA, 19 nt, Homo sapiens
guaaggggcuuccaccaau

SEQ ID NO: 1233083 - RNA, 19 nt, Homo sapiens
ucagguggcuaugguugaa

SEQ ID NO: 1233084 - RNA, 19 nt, Homo sapiens
caaccaaauauucugcaaa

SEQ ID NO: 1233085 - RNA, 19 nt, Homo sapiens
ccacaucccagacaaacau

SEQ ID NO: 1233086 - RNA, 19 nt, Homo sapiens
uguggcaugugcacuguuu

SEQ ID NO: 1233087 - RNA, 19 nt, Homo sapiens
gcccagcgaucucagaaaa

SEQ ID NO: 1233088 - RNA, 19 nt, Homo sapiens
gaaaaccucagacaauuca

SEQ ID NO: 1233089 - RNA, 19 nt, Homo sapiens
gguaccaacugccaagaac

SEQ ID NO: 1233090 - RNA, 19 nt, Homo sapiens
gacaucaucaccaccuuug

SEQ ID NO: 1233091 - RNA, 19 nt, Homo sapiens
acaauucacaugcucagaa

SEQ ID NO: 1233092 - RNA, 19 nt, Homo sapiens
uuaagucugugaauuucug

SEQ ID NO: 1233093 - RNA, 19 nt, Homo sapiens
uauuugggugugcauauua

SEQ ID NO: 1233094 - RNA, 19 nt, Homo sapiens
gaauauuugggugugcaua

SEQ ID NO: 1233095 - RNA, 19 nt, Homo sapiens
aguaagcugcauucuauaa

SEQ ID NO: 1233096 - RNA, 19 nt, Homo sapiens
caccagugaugaaaauuaa

SEQ ID NO: 1233097 - RNA, 19 nt, Homo sapiens
caaccuagcuccccuacca

SEQ ID NO: 1233098 - RNA, 19 nt, Homo sapiens
ccaucuacauaauccauca

SEQ ID NO: 1233099 - RNA, 19 nt, Homo sapiens
aagaaaaccucagacaauu

SEQ ID NO: 1233100 - RNA, 19 nt, Homo sapiens
aguacgcuuugcugaauaa

SEQ ID NO: 1233101 - RNA, 19 nt, Homo sapiens
acacagcacagcagcagaa

SEQ ID NO: 1233102 - RNA, 19 nt, Homo sapiens
ccgagugcuuccugcaauu

SEQ ID NO: 1233103 - RNA, 19 nt, Homo sapiens
caauucacaugcucagaac

SEQ ID NO: 1233104 - RNA, 19 nt, Homo sapiens
gggcuuccaccaaucagaa

SEQ ID NO: 1233105 - RNA, 19 nt, Homo sapiens
ucaaccaaauauucugcaa

SEQ ID NO: 1233106 - RNA, 19 nt, Homo sapiens
aaauuccuaugaucaguca

SEQ ID NO: 1233107 - RNA, 19 nt, Homo sapiens
aacgaagaccaauuuagua

SEQ ID NO: 1233108 - RNA, 19 nt, Homo sapiens
ggagaaccucugcggacaa

SEQ ID NO: 1233109 - RNA, 19 nt, Homo sapiens
ucagggaucuuccuuucac

SEQ ID NO: 1233110 - RNA, 19 nt, Homo sapiens
gggcaauaacuuccuaaca

SEQ ID NO: 1233111 - RNA, 19 nt, Homo sapiens
cagagucucccacccauca

SEQ ID NO: 1233112 - RNA, 19 nt, Homo sapiens
gugaucagguggcuauggu

SEQ ID NO: 1233113 - RNA, 19 nt, Homo sapiens
cagcacagcagcagaagag

SEQ ID NO: 1233114 - RNA, 19 nt, Homo sapiens
gacugugucuucuucugau

SEQ ID NO: 1233115 - RNA, 19 nt, Homo sapiens
ccucagacaauucaaaaua

SEQ ID NO: 1233116 - RNA, 19 nt, Homo sapiens
ccacaugccaaaauuaaaa

SEQ ID NO: 1233117 - RNA, 19 nt, Homo sapiens
ccaagucaacgaagacaca

SEQ ID NO: 1233118 - RNA, 19 nt, Homo sapiens
aaaccucagacaauucaaa

SEQ ID NO: 1233119 - RNA, 19 nt, Homo sapiens
ugacaucaucaccaccuuu

SEQ ID NO: 1233120 - RNA, 19 nt, Homo sapiens
uaagcugcauucuauaagc

SEQ ID NO: 1233121 - RNA, 19 nt, Homo sapiens
ccuucgggcucauuuaaca

SEQ ID NO: 1233122 - RNA, 19 nt, Homo sapiens
ucagguauuuuccuacaaa

SEQ ID NO: 1233123 - RNA, 19 nt, Homo sapiens
ggcuaugguugaauuuaag

SEQ ID NO: 1233124 - RNA, 19 nt, Homo sapiens
aaguacgcuuugcugaaua

SEQ ID NO: 1233125 - RNA, 19 nt, Homo sapiens
gcauauuaagucugugaau

SEQ ID NO: 1233126 - RNA, 19 nt, Homo sapiens
gugcauauuaagucuguga

SEQ ID NO: 1233127 - RNA, 19 nt, Homo sapiens
gugugcauauuaagucugu

SEQ ID NO: 1233128 - RNA, 19 nt, Homo sapiens
caauuuaguaagcugcauu

SEQ ID NO: 1233129 - RNA, 19 nt, Homo sapiens
gacaaaauuuucagcaucu

SEQ ID NO: 1233130 - RNA, 19 nt, Homo sapiens
cuaaucagguauuuuccua

SEQ ID NO: 1233131 - RNA, 19 nt, Homo sapiens
aagugagcaggauuuauua

SEQ ID NO: 1233132 - RNA, 19 nt, Homo sapiens
aagaacagccuggugauca

SEQ ID NO: 1233133 - RNA, 19 nt, Homo sapiens
aagaacgaagaccaauuua

SEQ ID NO: 1233134 - RNA, 19 nt, Homo sapiens
acacauguccaccaucauc

SEQ ID NO: 1233135 - RNA, 19 nt, Homo sapiens
gaaagguucuggagauaua

SEQ ID NO: 1233136 - RNA, 19 nt, Homo sapiens
caacuucacucuuucauaa

SEQ ID NO: 1233137 - RNA, 19 nt, Homo sapiens
gaaauagagcugaugauua

SEQ ID NO: 1233138 - RNA, 19 nt, Homo sapiens
gaagcaaucuagacuguug

SEQ ID NO: 1233139 - RNA, 19 nt, Homo sapiens
gaagaaggcuaaacaaagg

SEQ ID NO: 1233140 - RNA, 19 nt, Homo sapiens
gcguuaagcugauaaugua

SEQ ID NO: 1233141 - RNA, 19 nt, Homo sapiens
ggaaucagcuuagucaaug

SEQ ID NO: 1233142 - RNA, 19 nt, Homo sapiens
gagaagagcugacuuuuga

SEQ ID NO: 1233143 - RNA, 19 nt, Homo sapiens
gggagaagcuagacuuuau

SEQ ID NO: 1233144 - RNA, 19 nt, Homo sapiens
gcaaagcaauaacuccaaa

SEQ ID NO: 1233145 - RNA, 19 nt, Homo sapiens
gcugagagaucaaagauuc

SEQ ID NO: 1233146 - RNA, 19 nt, Homo sapiens
gaacucaacagaagaaaga

SEQ ID NO: 1233147 - RNA, 19 nt, Homo sapiens
gcaccucaaugauaaagaa

SEQ ID NO: 1233148 - RNA, 19 nt, Homo sapiens
gcucauugcuccaggcuuu

SEQ ID NO: 1233149 - RNA, 19 nt, Homo sapiens
caaagugugugccugaauu

SEQ ID NO: 1233150 - RNA, 19 nt, Homo sapiens
acaaauaggugauacugaa

SEQ ID NO: 1233151 - RNA, 19 nt, Homo sapiens
guacuuaagucuaugugaa

SEQ ID NO: 1233152 - RNA, 19 nt, Homo sapiens
ggaauauguuggagaggua

SEQ ID NO: 1233153 - RNA, 19 nt, Homo sapiens
uaugacaacuucacucuuu

SEQ ID NO: 1233154 - RNA, 19 nt, Homo sapiens
gugugugccugaauuauua

SEQ ID NO: 1233155 - RNA, 19 nt, Homo sapiens
uaaagacccuugugaagau

SEQ ID NO: 1233156 - RNA, 19 nt, Homo sapiens
gaagcuaccuuugguuguu

SEQ ID NO: 1233157 - RNA, 19 nt, Homo sapiens
cagcacuucuuaaucuuua

SEQ ID NO: 1233158 - RNA, 19 nt, Homo sapiens
gcaaaucuagcuuucagua

SEQ ID NO: 1233159 - RNA, 19 nt, Homo sapiens
ggaaaucugugucgaguac

SEQ ID NO: 1233160 - RNA, 19 nt, Homo sapiens
ggaaauagagcugaugauu

SEQ ID NO: 1233161 - RNA, 19 nt, Homo sapiens
gaagaaagaaucauaaagg

SEQ ID NO: 1233162 - RNA, 19 nt, Homo sapiens
gugggaggcuuccaacaua

SEQ ID NO: 1233163 - RNA, 19 nt, Homo sapiens
gcaauucucuaaugacaag

SEQ ID NO: 1233164 - RNA, 19 nt, Homo sapiens
gcagugagccaagaucaua

SEQ ID NO: 1233165 - RNA, 19 nt, Homo sapiens
gaaacccugucucuacuga

SEQ ID NO: 1233166 - RNA, 19 nt, Homo sapiens
acagauugcuucuuucaaa

SEQ ID NO: 1233167 - RNA, 19 nt, Homo sapiens
aaagaaaggcaaagcaaua

SEQ ID NO: 1233168 - RNA, 19 nt, Homo sapiens
ucacuguacuuguauuuga

SEQ ID NO: 1233169 - RNA, 19 nt, Homo sapiens
gcagacuauuuacagcuua

SEQ ID NO: 1233170 - RNA, 19 nt, Homo sapiens
ucacguaucucuuugaucu

SEQ ID NO: 1233171 - RNA, 19 nt, Homo sapiens
ggaaucacguaucucuuug

SEQ ID NO: 1233172 - RNA, 19 nt, Homo sapiens
gaaccaacuucaagaaugc

SEQ ID NO: 1233173 - RNA, 19 nt, Homo sapiens
gcaggagaaucacuugaau

SEQ ID NO: 1233174 - RNA, 19 nt, Homo sapiens
cauuacagccucucaauuu

SEQ ID NO: 1233175 - RNA, 19 nt, Homo sapiens
ccauuaugcuucuuugaaa

SEQ ID NO: 1233176 - RNA, 19 nt, Homo sapiens
gauaaaugcagcaaaucua

SEQ ID NO: 1233177 - RNA, 19 nt, Homo sapiens
gggaaucacguaucucuuu

SEQ ID NO: 1233178 - RNA, 19 nt, Homo sapiens
ccucugaucuaaacgguaa

SEQ ID NO: 1233179 - RNA, 19 nt, Homo sapiens
ggucagaacaguauguaaa

SEQ ID NO: 1233180 - RNA, 19 nt, Homo sapiens
guaaagacccuugugaaga

SEQ ID NO: 1233181 - RNA, 19 nt, Homo sapiens
gagcagcuguaccuaacaa

SEQ ID NO: 1233182 - RNA, 19 nt, Homo sapiens
agaaaugccucccguagug

SEQ ID NO: 1233183 - RNA, 19 nt, Homo sapiens
gggcaaaucuacaguucug

SEQ ID NO: 1233184 - RNA, 19 nt, Homo sapiens
gaggacaguucuaugacaa

SEQ ID NO: 1233185 - RNA, 19 nt, Homo sapiens
ggagagcagcuguaccuaa

SEQ ID NO: 1233186 - RNA, 19 nt, Homo sapiens
cgacauauuuauagugcuu

SEQ ID NO: 1233187 - RNA, 19 nt, Homo sapiens
guaccuaacaauacuguaa

SEQ ID NO: 1233188 - RNA, 19 nt, Homo sapiens
ugaaagcguuaagcugaua

SEQ ID NO: 1233189 - RNA, 19 nt, Homo sapiens
gaagucgacauauuuauag

SEQ ID NO: 1233190 - RNA, 19 nt, Homo sapiens
ucgaguaccucugaucuaa

SEQ ID NO: 1233191 - RNA, 19 nt, Homo sapiens
cauaaaugcuggagaagag

SEQ ID NO: 1233192 - RNA, 19 nt, Homo sapiens
gaaugcagcacuucuuaau

SEQ ID NO: 1233193 - RNA, 19 nt, Homo sapiens
gcagcuguaccuaacaaua

SEQ ID NO: 1233194 - RNA, 19 nt, Homo sapiens
gagagcagcuguaccuaac

SEQ ID NO: 1233195 - RNA, 19 nt, Homo sapiens
uggaaaggauggccagauu

SEQ ID NO: 1233196 - RNA, 19 nt, Homo sapiens
cuucagguguucaauguuu

SEQ ID NO: 1233197 - RNA, 19 nt, Homo sapiens
ucuuugaucuggacuauga

SEQ ID NO: 1233198 - RNA, 19 nt, Homo sapiens
gcacagauugcuucuuuca

SEQ ID NO: 1233199 - RNA, 19 nt, Homo sapiens
gcagagauggcaagaugaa

SEQ ID NO: 1233200 - RNA, 19 nt, Homo sapiens
aauacucacuguacuugua

SEQ ID NO: 1233201 - RNA, 19 nt, Homo sapiens
guacucccaucuaugaaug

SEQ ID NO: 1233202 - RNA, 19 nt, Homo sapiens
gaagcuagacuuuauucau

SEQ ID NO: 1233203 - RNA, 19 nt, Homo sapiens
ggacguggcugggguguaa

SEQ ID NO: 1233204 - RNA, 19 nt, Homo sapiens
caaugaagcuaccuuuggu

SEQ ID NO: 1233205 - RNA, 19 nt, Homo sapiens
gaaucagcuuagucaauga

SEQ ID NO: 1233206 - RNA, 19 nt, Homo sapiens
caagaugaacucaacagaa

SEQ ID NO: 1233207 - RNA, 19 nt, Homo sapiens
cagcaauucucuaaugaca

SEQ ID NO: 1233208 - RNA, 19 nt, Homo sapiens
caaauucggagaaacaguu

SEQ ID NO: 1233209 - RNA, 19 nt, Homo sapiens
guaaagaaaggcaaagcaa

SEQ ID NO: 1233210 - RNA, 19 nt, Homo sapiens
gcacacaguauucgcuuug

SEQ ID NO: 1233211 - RNA, 19 nt, Homo sapiens
cugcagagauggcaagaug

SEQ ID NO: 1233212 - RNA, 19 nt, Homo sapiens
ucaggcagguguaacaguu

SEQ ID NO: 1233213 - RNA, 19 nt, Homo sapiens
guguaugucugaaccugua

SEQ ID NO: 1233214 - RNA, 19 nt, Homo sapiens
aaucuagacuguugugaug

SEQ ID NO: 1233215 - RNA, 19 nt, Homo sapiens
ggagaaacaguuaauuugg

SEQ ID NO: 1233216 - RNA, 19 nt, Homo sapiens
cuaugagucugaugaauuc

SEQ ID NO: 1233217 - RNA, 19 nt, Homo sapiens
augcacagauugcuucuuu

SEQ ID NO: 1233218 - RNA, 19 nt, Homo sapiens
aagaugaacucaacagaag

SEQ ID NO: 1233219 - RNA, 19 nt, Homo sapiens
cugaguacauugugaagaa

SEQ ID NO: 1233220 - RNA, 19 nt, Homo sapiens
gaaaggauggccagauucu

SEQ ID NO: 1233221 - RNA, 19 nt, Homo sapiens
ggacaguucuaugacaaca

SEQ ID NO: 1233222 - RNA, 19 nt, Homo sapiens
aaugaaagguucuggagau

SEQ ID NO: 1233223 - RNA, 19 nt, Homo sapiens
aaccauaaaugcuggagaa

SEQ ID NO: 1233224 - RNA, 19 nt, Homo sapiens
gacgaggacaguucuauga

SEQ ID NO: 1233225 - RNA, 19 nt, Homo sapiens
ucagcuucauuucguauuu

SEQ ID NO: 1233226 - RNA, 19 nt, Homo sapiens
gaaggcagacuauuuacag

SEQ ID NO: 1233227 - RNA, 19 nt, Homo sapiens
caauucauguuucaagaca

SEQ ID NO: 1233228 - RNA, 19 nt, Homo sapiens
cuucagcaauucucuaaug

SEQ ID NO: 1233229 - RNA, 19 nt, Homo sapiens
gaugaacucaacagaagaa

SEQ ID NO: 1233230 - RNA, 19 nt, Homo sapiens
gugaagaaggcuaaacaaa

SEQ ID NO: 1233231 - RNA, 19 nt, Homo sapiens
ggagaagcuagacuuuauu

SEQ ID NO: 1233232 - RNA, 19 nt, Homo sapiens
gaagugcccguuacugcuu

SEQ ID NO: 1233233 - RNA, 19 nt, Homo sapiens
ggacucuuauuaucaaggu

SEQ ID NO: 1233234 - RNA, 19 nt, Homo sapiens
gggcccaccuucagacuuc

SEQ ID NO: 1233235 - RNA, 19 nt, Homo sapiens
gcucugaccucaucaaaca

SEQ ID NO: 1233236 - RNA, 19 nt, Homo sapiens
cgacagcucuuaccugcuu

SEQ ID NO: 1233237 - RNA, 19 nt, Homo sapiens
gacaugcccuggagacuug

SEQ ID NO: 1233238 - RNA, 19 nt, Homo sapiens
gagaagcccuacaaaugug

SEQ ID NO: 1233239 - RNA, 19 nt, Homo sapiens
ucugagagcucuagauaug

SEQ ID NO: 1233240 - RNA, 19 nt, Homo sapiens
gaaccaggguggaggaagu

SEQ ID NO: 1233241 - RNA, 19 nt, Homo sapiens
ggagcuagaggaaccuuua

SEQ ID NO: 1233242 - RNA, 19 nt, Homo sapiens
ccagaacacugagcucaaa

SEQ ID NO: 1233243 - RNA, 19 nt, Homo sapiens
gugagaagcccuacaaaug

SEQ ID NO: 1233244 - RNA, 19 nt, Homo sapiens
ugagagcucuagauaugaa

SEQ ID NO: 1233245 - RNA, 19 nt, Homo sapiens
gugcggagaugcuucugaa

SEQ ID NO: 1233246 - RNA, 19 nt, Homo sapiens
ugaggaugcuggaagaaga

SEQ ID NO: 1233247 - RNA, 19 nt, Homo sapiens
gcaacaugagugagaauga

SEQ ID NO: 1233248 - RNA, 19 nt, Homo sapiens
gccagaagcccuacaagug

SEQ ID NO: 1233249 - RNA, 19 nt, Homo sapiens
gcucaaaguuccaaauucc

SEQ ID NO: 1233250 - RNA, 19 nt, Homo sapiens
ugagaagcccuacaaaugu

SEQ ID NO: 1233251 - RNA, 19 nt, Homo sapiens
gaaugaggaagaggaaauu

SEQ ID NO: 1233252 - RNA, 19 nt, Homo sapiens
caacaugagugagaaugag

SEQ ID NO: 1233253 - RNA, 19 nt, Homo sapiens
ccaggaaggugcggagaug

SEQ ID NO: 1233254 - RNA, 19 nt, Homo sapiens
ucgaagagauaccauuugg

SEQ ID NO: 1233255 - RNA, 19 nt, Homo sapiens
cuaugaagucgaagagaua

SEQ ID NO: 1233256 - RNA, 19 nt, Homo sapiens
gaggcaacaugagugagaa

SEQ ID NO: 1233257 - RNA, 19 nt, Homo sapiens
ggugagaagcccuacaaau

SEQ ID NO: 1233258 - RNA, 19 nt, Homo sapiens
ccagagcccuagguaugaa

SEQ ID NO: 1233259 - RNA, 19 nt, Homo sapiens
gaauggaggagcugaggau

SEQ ID NO: 1233260 - RNA, 19 nt, Homo sapiens
ccacgcuucugcagcauca

SEQ ID NO: 1233261 - RNA, 19 nt, Homo sapiens
uagaguggguuagcuuaga

SEQ ID NO: 1233262 - RNA, 19 nt, Homo sapiens
gggaggcccugggagaaau

SEQ ID NO: 1233263 - RNA, 19 nt, Homo sapiens
uggagaagccgcaggagaa

SEQ ID NO: 1233264 - RNA, 19 nt, Homo sapiens
agaggaaauuucucagcaa

SEQ ID NO: 1233265 - RNA, 19 nt, Homo sapiens
gagcucugaccucaucaaa

SEQ ID NO: 1233266 - RNA, 19 nt, Homo sapiens
ugagugagaaugaggaaga

SEQ ID NO: 1233267 - RNA, 19 nt, Homo sapiens
gcgagcggccuuacaagug

SEQ ID NO: 1233268 - RNA, 19 nt, Homo sapiens
gaagcucaaaguuccaaau

SEQ ID NO: 1233269 - RNA, 19 nt, Homo sapiens
gccacaaagcccagaguuu

SEQ ID NO: 1233270 - RNA, 19 nt, Homo sapiens
aguuugagaugcuucagaa

SEQ ID NO: 1233271 - RNA, 19 nt, Homo sapiens
cccaggaugugcagaguuc

SEQ ID NO: 1233272 - RNA, 19 nt, Homo sapiens
ccagagcuccgaccucauc

SEQ ID NO: 1233273 - RNA, 19 nt, Homo sapiens
gcacccagaagcccugaau

SEQ ID NO: 1233274 - RNA, 19 nt, Homo sapiens
ggagaagccgcaggagaau

SEQ ID NO: 1233275 - RNA, 19 nt, Homo sapiens
uagggaggauaguggagaa

SEQ ID NO: 1233276 - RNA, 19 nt, Homo sapiens
agauaugaaucccagaaca

SEQ ID NO: 1233277 - RNA, 19 nt, Homo sapiens
acuaugaagucgaagagau

SEQ ID NO: 1233278 - RNA, 19 nt, Homo sapiens
gauaccauuugggcuugaa

SEQ ID NO: 1233279 - RNA, 19 nt, Homo sapiens
ggguuagcuuagauuggua

SEQ ID NO: 1233280 - RNA, 19 nt, Homo sapiens
ugucuacaccgcaguuuga

SEQ ID NO: 1233281 - RNA, 19 nt, Homo sapiens
ucagaggcaacaugaguga

SEQ ID NO: 1233282 - RNA, 19 nt, Homo sapiens
caagugcuauagccagaac

SEQ ID NO: 1233283 - RNA, 19 nt, Homo sapiens
gaaccuuuagggaggauag

SEQ ID NO: 1233284 - RNA, 19 nt, Homo sapiens
aagaguccuuugaauaucu

SEQ ID NO: 1233285 - RNA, 19 nt, Homo sapiens
aagcucaaaguuccaaauu

SEQ ID NO: 1233286 - RNA, 19 nt, Homo sapiens
ucccagagcccuagguaug

SEQ ID NO: 1233287 - RNA, 19 nt, Homo sapiens
auugguagcugcugaaacu

SEQ ID NO: 1233288 - RNA, 19 nt, Homo sapiens
ggaggugugggcagaagau

SEQ ID NO: 1233289 - RNA, 19 nt, Homo sapiens
ggccagaagcccuacaagu

SEQ ID NO: 1233290 - RNA, 19 nt, Homo sapiens
ugaggaagaggaaauuucu

SEQ ID NO: 1233291 - RNA, 19 nt, Homo sapiens
agaaugaggaagaggaaau

SEQ ID NO: 1233292 - RNA, 19 nt, Homo sapiens
aacccaaagcccagaauuu

SEQ ID NO: 1233293 - RNA, 19 nt, Homo sapiens
agucgaagagauaccauuu

SEQ ID NO: 1233294 - RNA, 19 nt, Homo sapiens
uggguuagcuuagauuggu

SEQ ID NO: 1233295 - RNA, 19 nt, Homo sapiens
ugacaugcccuggagacuu

SEQ ID NO: 1233296 - RNA, 19 nt, Homo sapiens
ggccagggagcuagaggaa

SEQ ID NO: 1233297 - RNA, 19 nt, Homo sapiens
cuacaccgcaguuugagau

SEQ ID NO: 1233298 - RNA, 19 nt, Homo sapiens
ggaaggugcggagaugcuu

SEQ ID NO: 1233299 - RNA, 19 nt, Homo sapiens
agaguggguuagcuuagau

SEQ ID NO: 1233300 - RNA, 19 nt, Homo sapiens
aaugugaggucugcagcaa

SEQ ID NO: 1233301 - RNA, 19 nt, Homo sapiens
cuagauaugaaucccagaa

SEQ ID NO: 1233302 - RNA, 19 nt, Homo sapiens
ggugugggcagaagauaag

SEQ ID NO: 1233303 - RNA, 19 nt, Homo sapiens
gaggugugggcagaagaua

SEQ ID NO: 1233304 - RNA, 19 nt, Homo sapiens
ugagaaugaggaagaggaa

SEQ ID NO: 1233305 - RNA, 19 nt, Homo sapiens
aaacccaaagcccagaauu

SEQ ID NO: 1233306 - RNA, 19 nt, Homo sapiens
gagaaugaggaagaggaaa

SEQ ID NO: 1233307 - RNA, 19 nt, Homo sapiens
gagugcggcaagugcuaua

SEQ ID NO: 1233308 - RNA, 19 nt, Homo sapiens
gauaugaaucccagaacac

SEQ ID NO: 1233309 - RNA, 19 nt, Homo sapiens
gcaagugcuauagccagaa

SEQ ID NO: 1233310 - RNA, 19 nt, Homo sapiens
cccuacaagugcccacauu

SEQ ID NO: 1233311 - RNA, 19 nt, Homo sapiens
gagaagccgcaggagaaug

SEQ ID NO: 1233312 - RNA, 19 nt, Homo sapiens
gagcuagaggaaccuuuag

SEQ ID NO: 1233313 - RNA, 19 nt, Homo sapiens
gagaucagcucuaucaaua

SEQ ID NO: 1233314 - RNA, 19 nt, Homo sapiens
gaacaccucuugguuauuu

SEQ ID NO: 1233315 - RNA, 19 nt, Homo sapiens
ggcgaaaucucaucuguua

SEQ ID NO: 1233316 - RNA, 19 nt, Homo sapiens
ccagaaagcuuacuauaau

SEQ ID NO: 1233317 - RNA, 19 nt, Homo sapiens
guagcaaagucuaugauua

SEQ ID NO: 1233318 - RNA, 19 nt, Homo sapiens
ggagaacaccucuugguua

SEQ ID NO: 1233319 - RNA, 19 nt, Homo sapiens
agagagaacugauaugaaa

SEQ ID NO: 1233320 - RNA, 19 nt, Homo sapiens
guaagcaucuuugacauuu

SEQ ID NO: 1233321 - RNA, 19 nt, Homo sapiens
gagaacaccucuugguuau

SEQ ID NO: 1233322 - RNA, 19 nt, Homo sapiens
ggucaucuguacaggauua

SEQ ID NO: 1233323 - RNA, 19 nt, Homo sapiens
gaacgugguuauccaaaug

SEQ ID NO: 1233324 - RNA, 19 nt, Homo sapiens
gaauggagaucagcucuau

SEQ ID NO: 1233325 - RNA, 19 nt, Homo sapiens
gaucauaggcgaaaucuca

SEQ ID NO: 1233326 - RNA, 19 nt, Homo sapiens
uaaaauggcucuaccaaaa

SEQ ID NO: 1233327 - RNA, 19 nt, Homo sapiens
caaagggaauuguaucuuc

SEQ ID NO: 1233328 - RNA, 19 nt, Homo sapiens
gaguguagccagugcauua

SEQ ID NO: 1233329 - RNA, 19 nt, Homo sapiens
ccgcagaaaugaaacaauu

SEQ ID NO: 1233330 - RNA, 19 nt, Homo sapiens
gaauaagcaucucuuugau

SEQ ID NO: 1233331 - RNA, 19 nt, Homo sapiens
ugaauaagcaucucuuuga

SEQ ID NO: 1233332 - RNA, 19 nt, Homo sapiens
ggagagaaacagaugagua

SEQ ID NO: 1233333 - RNA, 19 nt, Homo sapiens
gcuaauaccaguaguaaau

SEQ ID NO: 1233334 - RNA, 19 nt, Homo sapiens
guaagaacccauucaagaa

SEQ ID NO: 1233335 - RNA, 19 nt, Homo sapiens
ccacccaacucuuuaguga

SEQ ID NO: 1233336 - RNA, 19 nt, Homo sapiens
uuccuuaucuucugacuua

SEQ ID NO: 1233337 - RNA, 19 nt, Homo sapiens
gaaacaauuugcauguaca

SEQ ID NO: 1233338 - RNA, 19 nt, Homo sapiens
uaaaccacguguuaauuga

SEQ ID NO: 1233339 - RNA, 19 nt, Homo sapiens
ggaauuguaucuucaacag

SEQ ID NO: 1233340 - RNA, 19 nt, Homo sapiens
ucaaguugcuaaaggauau

SEQ ID NO: 1233341 - RNA, 19 nt, Homo sapiens
gggucacuauuauuuguua

SEQ ID NO: 1233342 - RNA, 19 nt, Homo sapiens
ggagaccagauacaaauuu

SEQ ID NO: 1233343 - RNA, 19 nt, Homo sapiens
gaucagcucuaucaauacu

SEQ ID NO: 1233344 - RNA, 19 nt, Homo sapiens
gagaccagauacaaauuuc

SEQ ID NO: 1233345 - RNA, 19 nt, Homo sapiens
caaauucagucaugaucau

SEQ ID NO: 1233346 - RNA, 19 nt, Homo sapiens
ggaggaacaggaauuauca

SEQ ID NO: 1233347 - RNA, 19 nt, Homo sapiens
gucaacagauugcauacuu

SEQ ID NO: 1233348 - RNA, 19 nt, Homo sapiens
uaaacugagugacauagga

SEQ ID NO: 1233349 - RNA, 19 nt, Homo sapiens
ggagaagugugugccauca

SEQ ID NO: 1233350 - RNA, 19 nt, Homo sapiens
gaugaguacuccgcagaaa

SEQ ID NO: 1233351 - RNA, 19 nt, Homo sapiens
aguaggaacuguuauggaa

SEQ ID NO: 1233352 - RNA, 19 nt, Homo sapiens
ccuuagaccugccaccuuu

SEQ ID NO: 1233353 - RNA, 19 nt, Homo sapiens
aaacgccacuugcuucaga

SEQ ID NO: 1233354 - RNA, 19 nt, Homo sapiens
gauccuagcagucacaguu

SEQ ID NO: 1233355 - RNA, 19 nt, Homo sapiens
ucaggcauuugcuaaguaa

SEQ ID NO: 1233356 - RNA, 19 nt, Homo sapiens
guacuccgcagaaaugaaa

SEQ ID NO: 1233357 - RNA, 19 nt, Homo sapiens
cgaaaucucaucuguuaug

SEQ ID NO: 1233358 - RNA, 19 nt, Homo sapiens
gaaagaauaccaaguacac

SEQ ID NO: 1233359 - RNA, 19 nt, Homo sapiens
caaguuaucagcucuuuua

SEQ ID NO: 1233360 - RNA, 19 nt, Homo sapiens
cagcauccuucaucuucua

SEQ ID NO: 1233361 - RNA, 19 nt, Homo sapiens
ggagaucagcucuaucaau

SEQ ID NO: 1233362 - RNA, 19 nt, Homo sapiens
gaaacacuggucaucugua

SEQ ID NO: 1233363 - RNA, 19 nt, Homo sapiens
gacacuagcaauaaucaaa

SEQ ID NO: 1233364 - RNA, 19 nt, Homo sapiens
caaucuguuugacaucuuu

SEQ ID NO: 1233365 - RNA, 19 nt, Homo sapiens
guacugaaagugaauagug

SEQ ID NO: 1233366 - RNA, 19 nt, Homo sapiens
uguaagaacccauucaaga

SEQ ID NO: 1233367 - RNA, 19 nt, Homo sapiens
ggacuuaaagggccucugu

SEQ ID NO: 1233368 - RNA, 19 nt, Homo sapiens
ggacuuuggucuuggaaaa

SEQ ID NO: 1233369 - RNA, 19 nt, Homo sapiens
ugaaacaauuugcauguac

SEQ ID NO: 1233370 - RNA, 19 nt, Homo sapiens
gagagaaacagaugaguac

SEQ ID NO: 1233371 - RNA, 19 nt, Homo sapiens
ggaacaggaauuaucaaau

SEQ ID NO: 1233372 - RNA, 19 nt, Homo sapiens
caucuguacaggauuauaa

SEQ ID NO: 1233373 - RNA, 19 nt, Homo sapiens
aaacaucauucagagagaa

SEQ ID NO: 1233374 - RNA, 19 nt, Homo sapiens
guauaccucucaagcaaca

SEQ ID NO: 1233375 - RNA, 19 nt, Homo sapiens
aaagggaauuguaucuuca

SEQ ID NO: 1233376 - RNA, 19 nt, Homo sapiens
cauguacacucuacuugug

SEQ ID NO: 1233377 - RNA, 19 nt, Homo sapiens
cgaagaggguauuugucaa

SEQ ID NO: 1233378 - RNA, 19 nt, Homo sapiens
ggugucagcguuacaaaga

SEQ ID NO: 1233379 - RNA, 19 nt, Homo sapiens
uaucugacacuagcaauaa

SEQ ID NO: 1233380 - RNA, 19 nt, Homo sapiens
ggcagcaccucguggaguu

SEQ ID NO: 1233381 - RNA, 19 nt, Homo sapiens
acagauugcauacuucuuu

SEQ ID NO: 1233382 - RNA, 19 nt, Homo sapiens
gaugaaacgccacuugcuu

SEQ ID NO: 1233383 - RNA, 19 nt, Homo sapiens
caacgaagaguagagaaug

SEQ ID NO: 1233384 - RNA, 19 nt, Homo sapiens
aguaguaaauucaggcauu

SEQ ID NO: 1233385 - RNA, 19 nt, Homo sapiens
uaucagcucuuuuaacuug

SEQ ID NO: 1233386 - RNA, 19 nt, Homo sapiens
gagcucaauuuucagauuu

SEQ ID NO: 1233387 - RNA, 19 nt, Homo sapiens
gaagaggguauuugucaag

SEQ ID NO: 1233388 - RNA, 19 nt, Homo sapiens
gcuacgagcucaauuuuca

SEQ ID NO: 1233389 - RNA, 19 nt, Homo sapiens
ucaugaucaucuggaauua

SEQ ID NO: 1233390 - RNA, 19 nt, Homo sapiens
gggccucuguugccugaaa

SEQ ID NO: 1233391 - RNA, 19 nt, Homo sapiens
ugacauaggaaucacaguu

SEQ ID NO: 1233392 - RNA, 19 nt, Homo sapiens
aaguauaccucucaagcaa

SEQ ID NO: 1233393 - RNA, 19 nt, Homo sapiens
aaagaagaaugguuugcau

SEQ ID NO: 1233394 - RNA, 19 nt, Homo sapiens
ggaaagaauaccaaguaca

SEQ ID NO: 1233395 - RNA, 19 nt, Homo sapiens
gcaguagcaaagucuauga

SEQ ID NO: 1233396 - RNA, 19 nt, Homo sapiens
agaagugugugccaucaau

SEQ ID NO: 1233397 - RNA, 19 nt, Homo sapiens
ugucgggucauaaauauuu

SEQ ID NO: 1233398 - RNA, 19 nt, Homo sapiens
uacuagaccugucagauca

SEQ ID NO: 1233399 - RNA, 19 nt, Homo sapiens
gcaaagucuaugauuaugu

SEQ ID NO: 1233400 - RNA, 19 nt, Homo sapiens
gaccagauacaaauuucaa

SEQ ID NO: 1233401 - RNA, 19 nt, Homo sapiens
uaauugaagccaagacuau

SEQ ID NO: 1233402 - RNA, 19 nt, Homo sapiens
guauugguaccauccauuu

SEQ ID NO: 1233403 - RNA, 19 nt, Homo sapiens
cagauugcauacuucuuug

SEQ ID NO: 1233404 - RNA, 19 nt, Homo sapiens
ucucaaagccucuaaaauu

SEQ ID NO: 1233405 - RNA, 19 nt, Homo sapiens
cuagaccugucagaucaua

SEQ ID NO: 1233406 - RNA, 19 nt, Homo sapiens
uccagaaagcuuacuauaa

SEQ ID NO: 1233407 - RNA, 19 nt, Homo sapiens
ggucaugccuuuuccuuau

SEQ ID NO: 1233408 - RNA, 19 nt, Homo sapiens
ccacuugcuaagauuaaua

SEQ ID NO: 1233409 - RNA, 19 nt, Homo sapiens
ugauggagacgacaugaaa

SEQ ID NO: 1233410 - RNA, 19 nt, Homo sapiens
ggaaacacuggucaucugu

SEQ ID NO: 1233411 - RNA, 19 nt, Homo sapiens
caauuugcauguacacucu

SEQ ID NO: 1233412 - RNA, 19 nt, Homo sapiens
ucacgaagaggguauuugu

SEQ ID NO: 1233413 - RNA, 19 nt, Homo sapiens
gaucaaaccuccuuaauuu

SEQ ID NO: 1233414 - RNA, 19 nt, Homo sapiens
gaauguaacuccauguuua

SEQ ID NO: 1233415 - RNA, 19 nt, Homo sapiens
ugacguaucuugugcauuu

SEQ ID NO: 1233416 - RNA, 19 nt, Homo sapiens
ccacaacucuuaaaugaug

SEQ ID NO: 1233417 - RNA, 19 nt, Homo sapiens
gcaguggaguucaccuuua

SEQ ID NO: 1233418 - RNA, 19 nt, Homo sapiens
gaaagggaauaugaaugua

SEQ ID NO: 1233419 - RNA, 19 nt, Homo sapiens
gcuagaaacuuuaugucaa

SEQ ID NO: 1233420 - RNA, 19 nt, Homo sapiens
ggacuucacuacguugauu

SEQ ID NO: 1233421 - RNA, 19 nt, Homo sapiens
ggugagauccuuaaccuuu

SEQ ID NO: 1233422 - RNA, 19 nt, Homo sapiens
ccuacaaccugcauacuuu

SEQ ID NO: 1233423 - RNA, 19 nt, Homo sapiens
ggaucaaaccuccuuaauu

SEQ ID NO: 1233424 - RNA, 19 nt, Homo sapiens
caaaguggccacaagauug

SEQ ID NO: 1233425 - RNA, 19 nt, Homo sapiens
caugguagcuaaaggagaa

SEQ ID NO: 1233426 - RNA, 19 nt, Homo sapiens
ggauggauauaugaaguaa

SEQ ID NO: 1233427 - RNA, 19 nt, Homo sapiens
aaaccuaccuuacuguguu

SEQ ID NO: 1233428 - RNA, 19 nt, Homo sapiens
gagcaucagccauauggua

SEQ ID NO: 1233429 - RNA, 19 nt, Homo sapiens
gguggaguauucuguauug

SEQ ID NO: 1233430 - RNA, 19 nt, Homo sapiens
cuauugaacuaccucauuu

SEQ ID NO: 1233431 - RNA, 19 nt, Homo sapiens
gcacagaauugagccacaa

SEQ ID NO: 1233432 - RNA, 19 nt, Homo sapiens
gauuaauagugucauggua

SEQ ID NO: 1233433 - RNA, 19 nt, Homo sapiens
agaguaagcugcacaugga

SEQ ID NO: 1233434 - RNA, 19 nt, Homo sapiens
gguacuuccuuucccauuu

SEQ ID NO: 1233435 - RNA, 19 nt, Homo sapiens
acuggaagauugggaauua

SEQ ID NO: 1233436 - RNA, 19 nt, Homo sapiens
ggagacaggugcuacaacu

SEQ ID NO: 1233437 - RNA, 19 nt, Homo sapiens
cuccacaacucuuaaauga

SEQ ID NO: 1233438 - RNA, 19 nt, Homo sapiens
ccacacacauacacauuuc

SEQ ID NO: 1233439 - RNA, 19 nt, Homo sapiens
ucaagaccauuaccauuuc

SEQ ID NO: 1233440 - RNA, 19 nt, Homo sapiens
caguggaguucaccuuuaa

SEQ ID NO: 1233441 - RNA, 19 nt, Homo sapiens
ggaaauggugguacacaga

SEQ ID NO: 1233442 - RNA, 19 nt, Homo sapiens
gucaagaccauuaccauuu

SEQ ID NO: 1233443 - RNA, 19 nt, Homo sapiens
gaaagggugagucaaagga

SEQ ID NO: 1233444 - RNA, 19 nt, Homo sapiens
caagaaagggaauaugaau

SEQ ID NO: 1233445 - RNA, 19 nt, Homo sapiens
gccaagaaagggaauauga

SEQ ID NO: 1233446 - RNA, 19 nt, Homo sapiens
ggagugcacagccuauuga

SEQ ID NO: 1233447 - RNA, 19 nt, Homo sapiens
cuacaacuguggaggucua

SEQ ID NO: 1233448 - RNA, 19 nt, Homo sapiens
gaguucaccuuuaagaagu

SEQ ID NO: 1233449 - RNA, 19 nt, Homo sapiens
uaacacaagcugacucuuc

SEQ ID NO: 1233450 - RNA, 19 nt, Homo sapiens
ggccuaguuuguguaaaua

SEQ ID NO: 1233451 - RNA, 19 nt, Homo sapiens
gagccaagccacuacauuc

SEQ ID NO: 1233452 - RNA, 19 nt, Homo sapiens
caaccaugcucuguccaaa

SEQ ID NO: 1233453 - RNA, 19 nt, Homo sapiens
uuacacacccacacacaua

SEQ ID NO: 1233454 - RNA, 19 nt, Homo sapiens
cuucuacccugcccucuuu

SEQ ID NO: 1233455 - RNA, 19 nt, Homo sapiens
cgggacaaaugcaauagaa

SEQ ID NO: 1233456 - RNA, 19 nt, Homo sapiens
guccugcccugcuacagua

SEQ ID NO: 1233457 - RNA, 19 nt, Homo sapiens
ggaguucaccuuuaagaag

SEQ ID NO: 1233458 - RNA, 19 nt, Homo sapiens
ccaaguuacuguauuuguc

SEQ ID NO: 1233459 - RNA, 19 nt, Homo sapiens
aaacgggacaaaugcaaua

SEQ ID NO: 1233460 - RNA, 19 nt, Homo sapiens
ccgcaaaccuaccuuacug

SEQ ID NO: 1233461 - RNA, 19 nt, Homo sapiens
gcaggugcuagaaacuuua

SEQ ID NO: 1233462 - RNA, 19 nt, Homo sapiens
cuugaaccauccuuucuuu

SEQ ID NO: 1233463 - RNA, 19 nt, Homo sapiens
gaaggguuccggagcuuga

SEQ ID NO: 1233464 - RNA, 19 nt, Homo sapiens
ccaagaaagggaauaugaa

SEQ ID NO: 1233465 - RNA, 19 nt, Homo sapiens
ugagaucaccgcaaaccua

SEQ ID NO: 1233466 - RNA, 19 nt, Homo sapiens
ggauaaguuuaaagaccaa

SEQ ID NO: 1233467 - RNA, 19 nt, Homo sapiens
cgaauguaacuccauguuu

SEQ ID NO: 1233468 - RNA, 19 nt, Homo sapiens
ucaaaguggccacaagauu

SEQ ID NO: 1233469 - RNA, 19 nt, Homo sapiens
agaaagggaauaugaaugu

SEQ ID NO: 1233470 - RNA, 19 nt, Homo sapiens
ggagugcagugagcugaga

SEQ ID NO: 1233471 - RNA, 19 nt, Homo sapiens
ggguaaugaugauggcaaa

SEQ ID NO: 1233472 - RNA, 19 nt, Homo sapiens
ccaagccacuacauucugu

SEQ ID NO: 1233473 - RNA, 19 nt, Homo sapiens
agagagcaagccaagauua

SEQ ID NO: 1233474 - RNA, 19 nt, Homo sapiens
gccauaguguccucuugaa

SEQ ID NO: 1233475 - RNA, 19 nt, Homo sapiens
gggaaagggugagucaaag

SEQ ID NO: 1233476 - RNA, 19 nt, Homo sapiens
gaaacgggacaaaugcaau

SEQ ID NO: 1233477 - RNA, 19 nt, Homo sapiens
guggaggucuagaucauca

SEQ ID NO: 1233478 - RNA, 19 nt, Homo sapiens
ccagagagcaagccaagau

SEQ ID NO: 1233479 - RNA, 19 nt, Homo sapiens
gaaccauccuuucuuuugu

SEQ ID NO: 1233480 - RNA, 19 nt, Homo sapiens
gucgagggauggauauaug

SEQ ID NO: 1233481 - RNA, 19 nt, Homo sapiens
guucacaccaucacccuuu

SEQ ID NO: 1233482 - RNA, 19 nt, Homo sapiens
guacuuccuuucccauuuu

SEQ ID NO: 1233483 - RNA, 19 nt, Homo sapiens
ggccuuccauguagaaagu

SEQ ID NO: 1233484 - RNA, 19 nt, Homo sapiens
ccauuaccauuucuuucuu

SEQ ID NO: 1233485 - RNA, 19 nt, Homo sapiens
uggccuaguuuguguaaau

SEQ ID NO: 1233486 - RNA, 19 nt, Homo sapiens
caguagugauuaauagugu

SEQ ID NO: 1233487 - RNA, 19 nt, Homo sapiens
gggauggauauaugaagua

SEQ ID NO: 1233488 - RNA, 19 nt, Homo sapiens
gcagcugucccaagcaaug

SEQ ID NO: 1233489 - RNA, 19 nt, Homo sapiens
ugccagagcaucagccaua

SEQ ID NO: 1233490 - RNA, 19 nt, Homo sapiens
gaucuugaaccauccuuuc

SEQ ID NO: 1233491 - RNA, 19 nt, Homo sapiens
guauuugucugggcuuugu

SEQ ID NO: 1233492 - RNA, 19 nt, Homo sapiens
gagagcaagccaagauuag

SEQ ID NO: 1233493 - RNA, 19 nt, Homo sapiens
gcgaaugacguaucuugug

SEQ ID NO: 1233494 - RNA, 19 nt, Homo sapiens
guauaagaccagauucaug

SEQ ID NO: 1233495 - RNA, 19 nt, Homo sapiens
gugagauccuuaaccuuuc

SEQ ID NO: 1233496 - RNA, 19 nt, Homo sapiens
gcgcagcaggaauuacuuu

SEQ ID NO: 1233497 - RNA, 19 nt, Homo sapiens
ggagccaagccacuacauu

SEQ ID NO: 1233498 - RNA, 19 nt, Homo sapiens
caaccugcauacuuugagu

SEQ ID NO: 1233499 - RNA, 19 nt, Homo sapiens
aauaggagacgaacgaaug

SEQ ID NO: 1233500 - RNA, 19 nt, Homo sapiens
ugaggguugucuaauccua

SEQ ID NO: 1233501 - RNA, 19 nt, Homo sapiens
guguuuauuugaugguuga

SEQ ID NO: 1233502 - RNA, 19 nt, Homo sapiens
ugcaggugcuagaaacuuu

SEQ ID NO: 1233503 - RNA, 19 nt, Homo sapiens
acauacacauuucaugcuu

SEQ ID NO: 1233504 - RNA, 19 nt, Homo sapiens
uauaugaaguaaggugaga

SEQ ID NO: 1233505 - RNA, 19 nt, Homo sapiens
cacaggacgugcuuuacau

SEQ ID NO: 1233506 - RNA, 19 nt, Homo sapiens
aaucuaaggcccucauuuc

SEQ ID NO: 1233507 - RNA, 19 nt, Homo sapiens
gagaggaagaagaagaaau

SEQ ID NO: 1233508 - RNA, 19 nt, Homo sapiens
acucuuaaaugauguaugc

SEQ ID NO: 1233509 - RNA, 19 nt, Homo sapiens
ugagauccuuaaccuuuca

SEQ ID NO: 1233510 - RNA, 19 nt, Homo sapiens
cuagaguugcuaaggauaa

SEQ ID NO: 1233511 - RNA, 19 nt, Homo sapiens
aauaagagcuggcuuuucu

SEQ ID NO: 1233512 - RNA, 19 nt, Homo sapiens
ucagguacaugagcaaucu

SEQ ID NO: 1233513 - RNA, 19 nt, Homo sapiens
gaucuuggauguacauuua

SEQ ID NO: 1233514 - RNA, 19 nt, Homo sapiens
gaagcaaccucuccucuuu

SEQ ID NO: 1233515 - RNA, 19 nt, Homo sapiens
ggaaagagccgguuguaaa

SEQ ID NO: 1233516 - RNA, 19 nt, Homo sapiens
gauaaugacuugucuagga

SEQ ID NO: 1233517 - RNA, 19 nt, Homo sapiens
uaaaugaacucaccuacaa

SEQ ID NO: 1233518 - RNA, 19 nt, Homo sapiens
gcagugaacuuacuacuca

SEQ ID NO: 1233519 - RNA, 19 nt, Homo sapiens
gaaauaagaacucaccuuu

SEQ ID NO: 1233520 - RNA, 19 nt, Homo sapiens
gaagucaccucacacaaau

SEQ ID NO: 1233521 - RNA, 19 nt, Homo sapiens
gcccacaaguucuaauuua

SEQ ID NO: 1233522 - RNA, 19 nt, Homo sapiens
acaauugguuucagaguua

SEQ ID NO: 1233523 - RNA, 19 nt, Homo sapiens
ccaaagagcugaaaagauu

SEQ ID NO: 1233524 - RNA, 19 nt, Homo sapiens
gcauaaacauuccgucgaa

SEQ ID NO: 1233525 - RNA, 19 nt, Homo sapiens
aaagagccauguaucauaa

SEQ ID NO: 1233526 - RNA, 19 nt, Homo sapiens
gaagaggaccuuauuguuc

SEQ ID NO: 1233527 - RNA, 19 nt, Homo sapiens
gaagaaagaagcagcagaa

SEQ ID NO: 1233528 - RNA, 19 nt, Homo sapiens
ccucaaggcuccuaugaaa

SEQ ID NO: 1233529 - RNA, 19 nt, Homo sapiens
gaacucaccuacaauaacu

SEQ ID NO: 1233530 - RNA, 19 nt, Homo sapiens
cagauaaccuccuuguaaa

SEQ ID NO: 1233531 - RNA, 19 nt, Homo sapiens
cagaagaggacauuuauuu

SEQ ID NO: 1233532 - RNA, 19 nt, Homo sapiens
gaaagaagcagcagaagag

SEQ ID NO: 1233533 - RNA, 19 nt, Homo sapiens
cuacugaagucuggaaaua

SEQ ID NO: 1233534 - RNA, 19 nt, Homo sapiens
uaucacagacuuucaguua

SEQ ID NO: 1233535 - RNA, 19 nt, Homo sapiens
aaagugagauucuaaguca

SEQ ID NO: 1233536 - RNA, 19 nt, Homo sapiens
gaacagaugacacccaaga

SEQ ID NO: 1233537 - RNA, 19 nt, Homo sapiens
acaaagaggaggcuaguua

SEQ ID NO: 1233538 - RNA, 19 nt, Homo sapiens
gauaaccuccuuguaaaua

SEQ ID NO: 1233539 - RNA, 19 nt, Homo sapiens
gaagaggacauuuauuuca

SEQ ID NO: 1233540 - RNA, 19 nt, Homo sapiens
ucacaaagccuauucugaa

SEQ ID NO: 1233541 - RNA, 19 nt, Homo sapiens
gccaggagcugcauaaaca

SEQ ID NO: 1233542 - RNA, 19 nt, Homo sapiens
gcaaauauuucauguucuc

SEQ ID NO: 1233543 - RNA, 19 nt, Homo sapiens
guugauacauuccuaagaa

SEQ ID NO: 1233544 - RNA, 19 nt, Homo sapiens
ccaacuugcucauuugaaa

SEQ ID NO: 1233545 - RNA, 19 nt, Homo sapiens
gaagacaguguauuaauuc

SEQ ID NO: 1233546 - RNA, 19 nt, Homo sapiens
gaacaggaagaaaucagua

SEQ ID NO: 1233547 - RNA, 19 nt, Homo sapiens
guacauaaagcuucaaaug

SEQ ID NO: 1233548 - RNA, 19 nt, Homo sapiens
caaagccuauucugaaaug

SEQ ID NO: 1233549 - RNA, 19 nt, Homo sapiens
uaaagagccauguaucaua

SEQ ID NO: 1233550 - RNA, 19 nt, Homo sapiens
gggauggaaugcugaguuu

SEQ ID NO: 1233551 - RNA, 19 nt, Homo sapiens
gguagaagauacacaggaa

SEQ ID NO: 1233552 - RNA, 19 nt, Homo sapiens
gcacauugaugauucuuac

SEQ ID NO: 1233553 - RNA, 19 nt, Homo sapiens
ccaagcaccugguagaaga

SEQ ID NO: 1233554 - RNA, 19 nt, Homo sapiens
acagauaaccuccuuguaa

SEQ ID NO: 1233555 - RNA, 19 nt, Homo sapiens
gaaacugaccaaagugaaa

SEQ ID NO: 1233556 - RNA, 19 nt, Homo sapiens
gaacaccuccacccauuga

SEQ ID NO: 1233557 - RNA, 19 nt, Homo sapiens
gauggaaugcugaguuuaa

SEQ ID NO: 1233558 - RNA, 19 nt, Homo sapiens
ggauauauugggccucuua

SEQ ID NO: 1233559 - RNA, 19 nt, Homo sapiens
cagcagaagaggacauuua

SEQ ID NO: 1233560 - RNA, 19 nt, Homo sapiens
acugaagucuggaaauaua

SEQ ID NO: 1233561 - RNA, 19 nt, Homo sapiens
ggacaaccaaguucaagaa

SEQ ID NO: 1233562 - RNA, 19 nt, Homo sapiens
ugaggaaacugaccaaagu

SEQ ID NO: 1233563 - RNA, 19 nt, Homo sapiens
uacaauaacuuaccagcaa

SEQ ID NO: 1233564 - RNA, 19 nt, Homo sapiens
aaagguagcagugaacuua

SEQ ID NO: 1233565 - RNA, 19 nt, Homo sapiens
gcagcaaucuugacuucug

SEQ ID NO: 1233566 - RNA, 19 nt, Homo sapiens
ggagagagacaucuuaaag

SEQ ID NO: 1233567 - RNA, 19 nt, Homo sapiens
gaaauggggcuucucuuua

SEQ ID NO: 1233568 - RNA, 19 nt, Homo sapiens
gaaagagccgguuguaaag

SEQ ID NO: 1233569 - RNA, 19 nt, Homo sapiens
uaacuuaccagcaaaugaa

SEQ ID NO: 1233570 - RNA, 19 nt, Homo sapiens
cacaaagccuauucugaaa

SEQ ID NO: 1233571 - RNA, 19 nt, Homo sapiens
uuaccaagcuucagucugu

SEQ ID NO: 1233572 - RNA, 19 nt, Homo sapiens
cgcagagguuccaguauua

SEQ ID NO: 1233573 - RNA, 19 nt, Homo sapiens
gaagaaaagucgucaucaa

SEQ ID NO: 1233574 - RNA, 19 nt, Homo sapiens
gaacacauuccuccuaaag

SEQ ID NO: 1233575 - RNA, 19 nt, Homo sapiens
gaagaaaucaguagcaaaa

SEQ ID NO: 1233576 - RNA, 19 nt, Homo sapiens
agacaucuaucacacuuga

SEQ ID NO: 1233577 - RNA, 19 nt, Homo sapiens
ucgcagagguuccaguauu

SEQ ID NO: 1233578 - RNA, 19 nt, Homo sapiens
aaagagggaagcuguauuu

SEQ ID NO: 1233579 - RNA, 19 nt, Homo sapiens
gaaccaguuacagaaauua

SEQ ID NO: 1233580 - RNA, 19 nt, Homo sapiens
ccaaagagagugagucguu

SEQ ID NO: 1233581 - RNA, 19 nt, Homo sapiens
aaucagcucuguagaaaca

SEQ ID NO: 1233582 - RNA, 19 nt, Homo sapiens
gugaaguccugcucagaaa

SEQ ID NO: 1233583 - RNA, 19 nt, Homo sapiens
ucaagaaccucucagaaac

SEQ ID NO: 1233584 - RNA, 19 nt, Homo sapiens
ucauuuggaugucaagaaa

SEQ ID NO: 1233585 - RNA, 19 nt, Homo sapiens
gcagugggacccuuucuga

SEQ ID NO: 1233586 - RNA, 19 nt, Homo sapiens
uguauaaucucgugugugu

SEQ ID NO: 1233587 - RNA, 19 nt, Homo sapiens
uaaaggaacaggaagaaau

SEQ ID NO: 1233588 - RNA, 19 nt, Homo sapiens
cagcagcaaucuugacuuc

SEQ ID NO: 1233589 - RNA, 19 nt, Homo sapiens
ucagagagaucagggcauu

SEQ ID NO: 1233590 - RNA, 19 nt, Homo sapiens
ccagugauacuaaacaauu

SEQ ID NO: 1233591 - RNA, 19 nt, Homo sapiens
acacaaauaucagcacgaa

SEQ ID NO: 1233592 - RNA, 19 nt, Homo sapiens
gaagaagucaccucacaca

SEQ ID NO: 1233593 - RNA, 19 nt, Homo sapiens
acacgaagcauguccaauu

SEQ ID NO: 1233594 - RNA, 19 nt, Homo sapiens
gaacucaccuuuuaagucu

SEQ ID NO: 1233595 - RNA, 19 nt, Homo sapiens
aaagacaucuaucacacuu

SEQ ID NO: 1233596 - RNA, 19 nt, Homo sapiens
ccacugaucuuggauguac

SEQ ID NO: 1233597 - RNA, 19 nt, Homo sapiens
caacauuggucuuuuguga

SEQ ID NO: 1233598 - RNA, 19 nt, Homo sapiens
ccuggaaggugacgugaaa

SEQ ID NO: 1233599 - RNA, 19 nt, Homo sapiens
gggccuuucuucauccaua

SEQ ID NO: 1233600 - RNA, 19 nt, Homo sapiens
ccugcuagaucaccaguaa

SEQ ID NO: 1233601 - RNA, 19 nt, Homo sapiens
ccaggaggauuaccuauac

SEQ ID NO: 1233602 - RNA, 19 nt, Homo sapiens
uauauugggccucuuagua

SEQ ID NO: 1233603 - RNA, 19 nt, Homo sapiens
gcgaagauguaguuucucu

SEQ ID NO: 1233604 - RNA, 19 nt, Homo sapiens
aggcaaauauuucauguuc

SEQ ID NO: 1233605 - RNA, 19 nt, Homo sapiens
cuaagaagaccuaauuuca

SEQ ID NO: 1233606 - RNA, 19 nt, Homo sapiens
aggauuaccuauacaaaga

SEQ ID NO: 1233607 - RNA, 19 nt, Homo sapiens
cauaacugcuugcgaagau

SEQ ID NO: 1233608 - RNA, 19 nt, Homo sapiens
gaaaaucagcucuguagaa

SEQ ID NO: 1233609 - RNA, 19 nt, Homo sapiens
gaauacagcaagacacuag

SEQ ID NO: 1233610 - RNA, 19 nt, Homo sapiens
uagauuuacuucaccugua

SEQ ID NO: 1233611 - RNA, 19 nt, Homo sapiens
cuaaacaauucgacaguuc

SEQ ID NO: 1233612 - RNA, 19 nt, Homo sapiens
gaaagugagauucuaaguc

SEQ ID NO: 1233613 - RNA, 19 nt, Homo sapiens
ggaaucagcuccuauuaag

SEQ ID NO: 1233614 - RNA, 19 nt, Homo sapiens
gaucccagcuccugacaaa

SEQ ID NO: 1233615 - RNA, 19 nt, Homo sapiens
gaugaaauguacccuaguu

SEQ ID NO: 1233616 - RNA, 19 nt, Homo sapiens
caaagauggugcaaaguga

SEQ ID NO: 1233617 - RNA, 19 nt, Homo sapiens
gcccacaucuguauauuug

SEQ ID NO: 1233618 - RNA, 19 nt, Homo sapiens
ggguaugucuguauauaaa

SEQ ID NO: 1233619 - RNA, 19 nt, Homo sapiens
gaaugaaggaguugaugua

SEQ ID NO: 1233620 - RNA, 19 nt, Homo sapiens
aaacaagaaugaaggaguu

SEQ ID NO: 1233621 - RNA, 19 nt, Homo sapiens
gaaauguacccuaguuaga

SEQ ID NO: 1233622 - RNA, 19 nt, Homo sapiens
gagaagacccucacucuag

SEQ ID NO: 1233623 - RNA, 19 nt, Homo sapiens
ggagaucguggaaaugaua

SEQ ID NO: 1233624 - RNA, 19 nt, Homo sapiens
gaucccggcuccugacaaa

SEQ ID NO: 1233625 - RNA, 19 nt, Homo sapiens
gauaaagucccuaauccaa

SEQ ID NO: 1233626 - RNA, 19 nt, Homo sapiens
ggaaggagagugucaagga

SEQ ID NO: 1233627 - RNA, 19 nt, Homo sapiens
gcggguaugucuguauaua

SEQ ID NO: 1233628 - RNA, 19 nt, Homo sapiens
gaaggucaaguacuuugua

SEQ ID NO: 1233629 - RNA, 19 nt, Homo sapiens
gagcacagcagcccgguaa

SEQ ID NO: 1233630 - RNA, 19 nt, Homo sapiens
agaggaaauugcagacaua

SEQ ID NO: 1233631 - RNA, 19 nt, Homo sapiens
gagauugaauugacuuuac

SEQ ID NO: 1233632 - RNA, 19 nt, Homo sapiens
gcaggcagaggaucaagua

SEQ ID NO: 1233633 - RNA, 19 nt, Homo sapiens
caccagagaugacauucaa

SEQ ID NO: 1233634 - RNA, 19 nt, Homo sapiens
gggaaucagcuccuauuaa

SEQ ID NO: 1233635 - RNA, 19 nt, Homo sapiens
gagaggaaauugcagacau

SEQ ID NO: 1233636 - RNA, 19 nt, Homo sapiens
gggaguggcuuccaaagag

SEQ ID NO: 1233637 - RNA, 19 nt, Homo sapiens
ugaaucugcugcucucuga

SEQ ID NO: 1233638 - RNA, 19 nt, Homo sapiens
gagaugacauucaauucca

SEQ ID NO: 1233639 - RNA, 19 nt, Homo sapiens
gagacuggguucaaguaga

SEQ ID NO: 1233640 - RNA, 19 nt, Homo sapiens
gggaaacgcgagaaaugua

SEQ ID NO: 1233641 - RNA, 19 nt, Homo sapiens
uaaagucccuaauccaaag

SEQ ID NO: 1233642 - RNA, 19 nt, Homo sapiens
gcaauguggugugugauca

SEQ ID NO: 1233643 - RNA, 19 nt, Homo sapiens
gaaaugauaaaggagauug

SEQ ID NO: 1233644 - RNA, 19 nt, Homo sapiens
ccuaaagccugagcuagaa

SEQ ID NO: 1233645 - RNA, 19 nt, Homo sapiens
ccagagaugacauucaauu

SEQ ID NO: 1233646 - RNA, 19 nt, Homo sapiens
ggaaguggcuccaaaagag

SEQ ID NO: 1233647 - RNA, 19 nt, Homo sapiens
ccaaagaggauccaucauc

SEQ ID NO: 1233648 - RNA, 19 nt, Homo sapiens
ccaaagauggugcaaagug

SEQ ID NO: 1233649 - RNA, 19 nt, Homo sapiens
ggaaacgcgagaaauguau

SEQ ID NO: 1233650 - RNA, 19 nt, Homo sapiens
ucacuucucuucggaggaa

SEQ ID NO: 1233651 - RNA, 19 nt, Homo sapiens
ccacaucuguauauuuguc

SEQ ID NO: 1233652 - RNA, 19 nt, Homo sapiens
caugcaaugugguguguga

SEQ ID NO: 1233653 - RNA, 19 nt, Homo sapiens
gcugcucucugauccuaaa

SEQ ID NO: 1233654 - RNA, 19 nt, Homo sapiens
gcacacgacuuugggaaac

SEQ ID NO: 1233655 - RNA, 19 nt, Homo sapiens
agaggaagcugaccgacau

SEQ ID NO: 1233656 - RNA, 19 nt, Homo sapiens
ggcccaggcuugaaugugu

SEQ ID NO: 1233657 - RNA, 19 nt, Homo sapiens
gacccaugcuggacuggaa

SEQ ID NO: 1233658 - RNA, 19 nt, Homo sapiens
aagaggaaguggcuccaaa

SEQ ID NO: 1233659 - RNA, 19 nt, Homo sapiens
ggaggcaccuuccaaugac

SEQ ID NO: 1233660 - RNA, 19 nt, Homo sapiens
gcagaaggucaaguacuuu

SEQ ID NO: 1233661 - RNA, 19 nt, Homo sapiens
gugauguauuugaguauug

SEQ ID NO: 1233662 - RNA, 19 nt, Homo sapiens
ggaaauugcagacauagcu

SEQ ID NO: 1233663 - RNA, 19 nt, Homo sapiens
ugaaggaguugauguaacg

SEQ ID NO: 1233664 - RNA, 19 nt, Homo sapiens
aagaggaggugacccugaa

SEQ ID NO: 1233665 - RNA, 19 nt, Homo sapiens
ugggagagaugaaauguac

SEQ ID NO: 1233666 - RNA, 19 nt, Homo sapiens
ucaauuccaucacuucucu

SEQ ID NO: 1233667 - RNA, 19 nt, Homo sapiens
ugcagaaggucaaguacuu

SEQ ID NO: 1233668 - RNA, 19 nt, Homo sapiens
ggcagaggaucaaguaaac

SEQ ID NO: 1233669 - RNA, 19 nt, Homo sapiens
ggaggaagcccugcagaag

SEQ ID NO: 1233670 - RNA, 19 nt, Homo sapiens
ccaagaccacagaggauaa

SEQ ID NO: 1233671 - RNA, 19 nt, Homo sapiens
ucacgcaggguuaaugauu

SEQ ID NO: 1233672 - RNA, 19 nt, Homo sapiens
gcuaggucauccugccaaa

SEQ ID NO: 1233673 - RNA, 19 nt, Homo sapiens
gccgagcucuggucuaguc

SEQ ID NO: 1233674 - RNA, 19 nt, Homo sapiens
gauccuaaagccugagcua

SEQ ID NO: 1233675 - RNA, 19 nt, Homo sapiens
gacauucaauuccaucacu

SEQ ID NO: 1233676 - RNA, 19 nt, Homo sapiens
gaaacgcgagaaauguaug

SEQ ID NO: 1233677 - RNA, 19 nt, Homo sapiens
cagaggagacccugacugu

SEQ ID NO: 1233678 - RNA, 19 nt, Homo sapiens
gaagcuggucccacggaaa

SEQ ID NO: 1233679 - RNA, 19 nt, Homo sapiens
gaggaggcaccuuccaaug

SEQ ID NO: 1233680 - RNA, 19 nt, Homo sapiens
aaagugguaucucgggaau

SEQ ID NO: 1233681 - RNA, 19 nt, Homo sapiens
caaggacgaagaggaguuu

SEQ ID NO: 1233682 - RNA, 19 nt, Homo sapiens
guauuugaguauuguugug

SEQ ID NO: 1233683 - RNA, 19 nt, Homo sapiens
cacgcaggguuaaugauug

SEQ ID NO: 1233684 - RNA, 19 nt, Homo sapiens
ggagagauugaauugacuu

SEQ ID NO: 1233685 - RNA, 19 nt, Homo sapiens
ccuccagacucccaagaga

SEQ ID NO: 1233686 - RNA, 19 nt, Homo sapiens
gagaucguggaaaugauaa

SEQ ID NO: 1233687 - RNA, 19 nt, Homo sapiens
ugaaauguacccuaguuag

SEQ ID NO: 1233688 - RNA, 19 nt, Homo sapiens
agacuggguucaaguagag

SEQ ID NO: 1233689 - RNA, 19 nt, Homo sapiens
ggaaaugauaaaggagauu

SEQ ID NO: 1233690 - RNA, 19 nt, Homo sapiens
gcaggguuaaugauuguug

SEQ ID NO: 1233691 - RNA, 19 nt, Homo sapiens
ccagacaugccuucaguca

SEQ ID NO: 1233692 - RNA, 19 nt, Homo sapiens
gagagauugaauugacuuu

SEQ ID NO: 1233693 - RNA, 19 nt, Homo sapiens
gacccugacuguggacgaa

SEQ ID NO: 1233694 - RNA, 19 nt, Homo sapiens
gcacagcagcccgguaaag

SEQ ID NO: 1233695 - RNA, 19 nt, Homo sapiens
acacgcagacgcagaccua

SEQ ID NO: 1233696 - RNA, 19 nt, Homo sapiens
gaaugugcgggcagguauu

SEQ ID NO: 1233697 - RNA, 19 nt, Homo sapiens
gggagaucguggaaaugau

SEQ ID NO: 1233698 - RNA, 19 nt, Homo sapiens
gaauugacuuuaccaaaac

SEQ ID NO: 1233699 - RNA, 19 nt, Homo sapiens
cagaaggucaaguacuuug

SEQ ID NO: 1233700 - RNA, 19 nt, Homo sapiens
ucguggaaaugauaaagga

SEQ ID NO: 1233701 - RNA, 19 nt, Homo sapiens
auaaagucccuaauccaaa

SEQ ID NO: 1233702 - RNA, 19 nt, Homo sapiens
agugguaucucgggaauca

SEQ ID NO: 1233703 - RNA, 19 nt, Homo sapiens
ucaaguagagggcagaucu

SEQ ID NO: 1233704 - RNA, 19 nt, Homo sapiens
aaacggagucuuggagaga

SEQ ID NO: 1233705 - RNA, 19 nt, Homo sapiens
cauccaggccugcccuuga

SEQ ID NO: 1233706 - RNA, 19 nt, Homo sapiens
cgggaaucagcuccuauua

SEQ ID NO: 1233707 - RNA, 19 nt, Homo sapiens
caagaaugaaggaguugau

SEQ ID NO: 1233708 - RNA, 19 nt, Homo sapiens
ccgcaaaacuacacggaaa

SEQ ID NO: 1233709 - RNA, 19 nt, Homo sapiens
aggaggcaccuuccaauga

SEQ ID NO: 1233710 - RNA, 19 nt, Homo sapiens
gagaggugccugggagaga

SEQ ID NO: 1233711 - RNA, 19 nt, Homo sapiens
aggaagcccugcagaaggu

SEQ ID NO: 1233712 - RNA, 19 nt, Homo sapiens
uguuuaguguguucuguga

SEQ ID NO: 1233713 - RNA, 19 nt, Homo sapiens
gcagguagcucauuagaaa

SEQ ID NO: 1233714 - RNA, 19 nt, Homo sapiens
ugaagaaacccacaaauua

SEQ ID NO: 1233715 - RNA, 19 nt, Homo sapiens
ggacaaaucucgaagucuu

SEQ ID NO: 1233716 - RNA, 19 nt, Homo sapiens
gagaagaggcuauaauaaa

SEQ ID NO: 1233717 - RNA, 19 nt, Homo sapiens
gaagaaacccacaaauuau

SEQ ID NO: 1233718 - RNA, 19 nt, Homo sapiens
ugacugaaguugaguuuaa

SEQ ID NO: 1233719 - RNA, 19 nt, Homo sapiens
gauaauggcauccaaauga

SEQ ID NO: 1233720 - RNA, 19 nt, Homo sapiens
gagcaaauuuccaucuaaa

SEQ ID NO: 1233721 - RNA, 19 nt, Homo sapiens
gaacagggaaugaacauga

SEQ ID NO: 1233722 - RNA, 19 nt, Homo sapiens
gaagauacagaauuccuua

SEQ ID NO: 1233723 - RNA, 19 nt, Homo sapiens
ggacaaacuucacguucuu

SEQ ID NO: 1233724 - RNA, 19 nt, Homo sapiens
gcuaacacaugcaaugaaa

SEQ ID NO: 1233725 - RNA, 19 nt, Homo sapiens
gggcagacaugcugaauuc

SEQ ID NO: 1233726 - RNA, 19 nt, Homo sapiens
uaagaaagcacuggaauuu

SEQ ID NO: 1233727 - RNA, 19 nt, Homo sapiens
gcacagaaagucuuaauca

SEQ ID NO: 1233728 - RNA, 19 nt, Homo sapiens
gaucacagguuacagaaag

SEQ ID NO: 1233729 - RNA, 19 nt, Homo sapiens
gggaguggcugcauuugaa

SEQ ID NO: 1233730 - RNA, 19 nt, Homo sapiens
ggaguacaaucacaagcua

SEQ ID NO: 1233731 - RNA, 19 nt, Homo sapiens
uaucagcggucagaacuua

SEQ ID NO: 1233732 - RNA, 19 nt, Homo sapiens
gagaaacaauaauguagga

SEQ ID NO: 1233733 - RNA, 19 nt, Homo sapiens
cauuugagcagucuuauua

SEQ ID NO: 1233734 - RNA, 19 nt, Homo sapiens
ggucagaacuuaucucacu

SEQ ID NO: 1233735 - RNA, 19 nt, Homo sapiens
guacacaguugcccacaug

SEQ ID NO: 1233736 - RNA, 19 nt, Homo sapiens
cagaaagucuuaaucaagu

SEQ ID NO: 1233737 - RNA, 19 nt, Homo sapiens
gaugccaacucaacauuug

SEQ ID NO: 1233738 - RNA, 19 nt, Homo sapiens
uaucagagacuguaacaaa

SEQ ID NO: 1233739 - RNA, 19 nt, Homo sapiens
caugaugcccuuucaauuu

SEQ ID NO: 1233740 - RNA, 19 nt, Homo sapiens
gcagacacacuucuuaaga

SEQ ID NO: 1233741 - RNA, 19 nt, Homo sapiens
ggaugaugaugucuuaaug

SEQ ID NO: 1233742 - RNA, 19 nt, Homo sapiens
gaagagaagaggcuauaau

SEQ ID NO: 1233743 - RNA, 19 nt, Homo sapiens
aaaugaagcuguuguuaag

SEQ ID NO: 1233744 - RNA, 19 nt, Homo sapiens
cagaauuccuuaaagauca

SEQ ID NO: 1233745 - RNA, 19 nt, Homo sapiens
uauggaugaugaugucuua

SEQ ID NO: 1233746 - RNA, 19 nt, Homo sapiens
gaacuaagggccuccacuu

SEQ ID NO: 1233747 - RNA, 19 nt, Homo sapiens
ggacuccguuuaugucaug

SEQ ID NO: 1233748 - RNA, 19 nt, Homo sapiens
cagcaaagcagaauucaga

SEQ ID NO: 1233749 - RNA, 19 nt, Homo sapiens
gcauauugaugauaaaguc

SEQ ID NO: 1233750 - RNA, 19 nt, Homo sapiens
gaaacuaaagccagugcua

SEQ ID NO: 1233751 - RNA, 19 nt, Homo sapiens
gaucauuugagcagucuua

SEQ ID NO: 1233752 - RNA, 19 nt, Homo sapiens
cuagggaucuucuaagugu

SEQ ID NO: 1233753 - RNA, 19 nt, Homo sapiens
agaagaggcuauaauaaag

SEQ ID NO: 1233754 - RNA, 19 nt, Homo sapiens
aagagaagaggcuauaaua

SEQ ID NO: 1233755 - RNA, 19 nt, Homo sapiens
augaugcccuuucaauuua

SEQ ID NO: 1233756 - RNA, 19 nt, Homo sapiens
caacauuuguacugucguu

SEQ ID NO: 1233757 - RNA, 19 nt, Homo sapiens
gaucucggaugccaacuca

SEQ ID NO: 1233758 - RNA, 19 nt, Homo sapiens
uaaagccagugcuaaucua

SEQ ID NO: 1233759 - RNA, 19 nt, Homo sapiens
gaacagcuaacacaugcaa

SEQ ID NO: 1233760 - RNA, 19 nt, Homo sapiens
gauacagaauuccuuaaag

SEQ ID NO: 1233761 - RNA, 19 nt, Homo sapiens
uaucagaaguucaagaagu

SEQ ID NO: 1233762 - RNA, 19 nt, Homo sapiens
gaugcuauaugauuuccaa

SEQ ID NO: 1233763 - RNA, 19 nt, Homo sapiens
ucaaauagcacacaggaau

SEQ ID NO: 1233764 - RNA, 19 nt, Homo sapiens
ugagcaaauuuccaucuaa

SEQ ID NO: 1233765 - RNA, 19 nt, Homo sapiens
uacuaaagcucaagcaguu

SEQ ID NO: 1233766 - RNA, 19 nt, Homo sapiens
gaacaugaagauacagaau

SEQ ID NO: 1233767 - RNA, 19 nt, Homo sapiens
gcuauaugauuuccaagau

SEQ ID NO: 1233768 - RNA, 19 nt, Homo sapiens
caucauggcaacagaaauu

SEQ ID NO: 1233769 - RNA, 19 nt, Homo sapiens
uaacgugacugaaguugag

SEQ ID NO: 1233770 - RNA, 19 nt, Homo sapiens
gagaggauccaguuagaga

SEQ ID NO: 1233771 - RNA, 19 nt, Homo sapiens
ccaaagagcaguugauuuu

SEQ ID NO: 1233772 - RNA, 19 nt, Homo sapiens
gaugucgaaucaagcauga

SEQ ID NO: 1233773 - RNA, 19 nt, Homo sapiens
ccacauccuuccagaaaca

SEQ ID NO: 1233774 - RNA, 19 nt, Homo sapiens
ccacaauaccagaucauuu

SEQ ID NO: 1233775 - RNA, 19 nt, Homo sapiens
gcaacagaaauugucauua

SEQ ID NO: 1233776 - RNA, 19 nt, Homo sapiens
aaaugucgauucaucuuga

SEQ ID NO: 1233777 - RNA, 19 nt, Homo sapiens
gcacacaggaaucaaacuu

SEQ ID NO: 1233778 - RNA, 19 nt, Homo sapiens
caagugagaaacaauaaug

SEQ ID NO: 1233779 - RNA, 19 nt, Homo sapiens
gaaaagaggaaaagccuaa

SEQ ID NO: 1233780 - RNA, 19 nt, Homo sapiens
gaagagcccauaucagaag

SEQ ID NO: 1233781 - RNA, 19 nt, Homo sapiens
aaacucguguccuuucuga

SEQ ID NO: 1233782 - RNA, 19 nt, Homo sapiens
gugagcaaauuuccaucua

SEQ ID NO: 1233783 - RNA, 19 nt, Homo sapiens
acuaagggccuccacuuua

SEQ ID NO: 1233784 - RNA, 19 nt, Homo sapiens
ggcaagaugucgaaucaag

SEQ ID NO: 1233785 - RNA, 19 nt, Homo sapiens
aaaauuggcugcagcauug

SEQ ID NO: 1233786 - RNA, 19 nt, Homo sapiens
cuaaggauccugacuugaa

SEQ ID NO: 1233787 - RNA, 19 nt, Homo sapiens
gcaaaacuguugaaugcaa

SEQ ID NO: 1233788 - RNA, 19 nt, Homo sapiens
agacaagugagaaacaaua

SEQ ID NO: 1233789 - RNA, 19 nt, Homo sapiens
guauuucucugaagauucu

SEQ ID NO: 1233790 - RNA, 19 nt, Homo sapiens
gaaaaugaagcuguuguua

SEQ ID NO: 1233791 - RNA, 19 nt, Homo sapiens
acaugaagauacagaauuc

SEQ ID NO: 1233792 - RNA, 19 nt, Homo sapiens
cacaauaccagaucauuug

SEQ ID NO: 1233793 - RNA, 19 nt, Homo sapiens
cacagaaagucuuaaucaa

SEQ ID NO: 1233794 - RNA, 19 nt, Homo sapiens
gacaagugagaaacaauaa

SEQ ID NO: 1233795 - RNA, 19 nt, Homo sapiens
caagcgauaccuauuguug

SEQ ID NO: 1233796 - RNA, 19 nt, Homo sapiens
gaagaggcuauaauaaagu

SEQ ID NO: 1233797 - RNA, 19 nt, Homo sapiens
ugagcagucuuauuauugu

SEQ ID NO: 1233798 - RNA, 19 nt, Homo sapiens
caacucaacauuuguacug

SEQ ID NO: 1233799 - RNA, 19 nt, Homo sapiens
ugaaacccaucgagauugu

SEQ ID NO: 1233800 - RNA, 19 nt, Homo sapiens
aaaggugccacuacugaua

SEQ ID NO: 1233801 - RNA, 19 nt, Homo sapiens
agucaaaucuguauugcau

SEQ ID NO: 1233802 - RNA, 19 nt, Homo sapiens
gcaaagcagaauucagaga

SEQ ID NO: 1233803 - RNA, 19 nt, Homo sapiens
ugaguuggguaaaucauca

SEQ ID NO: 1233804 - RNA, 19 nt, Homo sapiens
gcugcuaccucguuguuca

SEQ ID NO: 1233805 - RNA, 19 nt, Homo sapiens
aucaaaggaucacagguua

SEQ ID NO: 1233806 - RNA, 19 nt, Homo sapiens
aaauauggaugaugauguc

SEQ ID NO: 1233807 - RNA, 19 nt, Homo sapiens
agagaagaggcuauaauaa

SEQ ID NO: 1233808 - RNA, 19 nt, Homo sapiens
guaggaagcgcaggaaguu

SEQ ID NO: 1233809 - RNA, 19 nt, Homo sapiens
gggauugaguuggguaaau

SEQ ID NO: 1233810 - RNA, 19 nt, Homo sapiens
cagaaacaguuaggaaaca

SEQ ID NO: 1233811 - RNA, 19 nt, Homo sapiens
cgauaccuauuguugaaga

SEQ ID NO: 1233812 - RNA, 19 nt, Homo sapiens
uggaacaucggaauucuaa

SEQ ID NO: 1233813 - RNA, 19 nt, Homo sapiens
gcacaaaccuucagccaaa

SEQ ID NO: 1233814 - RNA, 19 nt, Homo sapiens
caacauaccugucuucguu

SEQ ID NO: 1233815 - RNA, 19 nt, Homo sapiens
gcaagaagagguacuuaua

SEQ ID NO: 1233816 - RNA, 19 nt, Homo sapiens
gaagcacuguggcaacaua

SEQ ID NO: 1233817 - RNA, 19 nt, Homo sapiens
gacaguggcuuuguacaua

SEQ ID NO: 1233818 - RNA, 19 nt, Homo sapiens
ucuaguagcucgaaauaaa

SEQ ID NO: 1233819 - RNA, 19 nt, Homo sapiens
caauguuccugcuuucuua

SEQ ID NO: 1233820 - RNA, 19 nt, Homo sapiens
gaauuagucucaaaguuuc

SEQ ID NO: 1233821 - RNA, 19 nt, Homo sapiens
gagaagaacgauaccauuu

SEQ ID NO: 1233822 - RNA, 19 nt, Homo sapiens
ucccagaacuucaccuuua

SEQ ID NO: 1233823 - RNA, 19 nt, Homo sapiens
gcgacaauauccucacuuu

SEQ ID NO: 1233824 - RNA, 19 nt, Homo sapiens
gccauaagauaucauagaa

SEQ ID NO: 1233825 - RNA, 19 nt, Homo sapiens
uuaaaucacucccugugua

SEQ ID NO: 1233826 - RNA, 19 nt, Homo sapiens
ugagggagcuggagaacuu

SEQ ID NO: 1233827 - RNA, 19 nt, Homo sapiens
ggaggcaccuggcagaguu

SEQ ID NO: 1233828 - RNA, 19 nt, Homo sapiens
cagcugcuauucauucuuu

SEQ ID NO: 1233829 - RNA, 19 nt, Homo sapiens
guucaaggcuacaacaaug

SEQ ID NO: 1233830 - RNA, 19 nt, Homo sapiens
gacaauauccucacuuuag

SEQ ID NO: 1233831 - RNA, 19 nt, Homo sapiens
ucaaauccauuaccucaau

SEQ ID NO: 1233832 - RNA, 19 nt, Homo sapiens
gaagauugguuaaggaaaa

SEQ ID NO: 1233833 - RNA, 19 nt, Homo sapiens
uuacagaagucuaccaaug

SEQ ID NO: 1233834 - RNA, 19 nt, Homo sapiens
uaaggacaguggcuuugua

SEQ ID NO: 1233835 - RNA, 19 nt, Homo sapiens
guacaagggcagcugauaa

SEQ ID NO: 1233836 - RNA, 19 nt, Homo sapiens
gaagagguacuuauagcaa

SEQ ID NO: 1233837 - RNA, 19 nt, Homo sapiens
cagaaugcauguuuggauu

SEQ ID NO: 1233838 - RNA, 19 nt, Homo sapiens
cauuaacacucaagccuuu

SEQ ID NO: 1233839 - RNA, 19 nt, Homo sapiens
gaagugaugucaggagcuu

SEQ ID NO: 1233840 - RNA, 19 nt, Homo sapiens
uccauuaccucaauuaaga

SEQ ID NO: 1233841 - RNA, 19 nt, Homo sapiens
auaccugucuucguuauua

SEQ ID NO: 1233842 - RNA, 19 nt, Homo sapiens
ggacugaacaugaaaagua

SEQ ID NO: 1233843 - RNA, 19 nt, Homo sapiens
ggacagauuagaacauaug

SEQ ID NO: 1233844 - RNA, 19 nt, Homo sapiens
gaaccuucaggcaaacuua

SEQ ID NO: 1233845 - RNA, 19 nt, Homo sapiens
gcacacgguugcugcuguu

SEQ ID NO: 1233846 - RNA, 19 nt, Homo sapiens
caaugaugguucucucaaa

SEQ ID NO: 1233847 - RNA, 19 nt, Homo sapiens
guugaacucugucacaaau

SEQ ID NO: 1233848 - RNA, 19 nt, Homo sapiens
gcagagauuucuuuuguug

SEQ ID NO: 1233849 - RNA, 19 nt, Homo sapiens
uaagguaccugaggagaau

SEQ ID NO: 1233850 - RNA, 19 nt, Homo sapiens
ccaauaaucacauccaaug

SEQ ID NO: 1233851 - RNA, 19 nt, Homo sapiens
guucuggguucuauauuga

SEQ ID NO: 1233852 - RNA, 19 nt, Homo sapiens
uggaguaccugcgacaaua

SEQ ID NO: 1233853 - RNA, 19 nt, Homo sapiens
gaaauugugaugccaagga

SEQ ID NO: 1233854 - RNA, 19 nt, Homo sapiens
ggaaagccuucagguuguu

SEQ ID NO: 1233855 - RNA, 19 nt, Homo sapiens
gggagcagcugagaaagga

SEQ ID NO: 1233856 - RNA, 19 nt, Homo sapiens
caucuuggguguugacaau

SEQ ID NO: 1233857 - RNA, 19 nt, Homo sapiens
aaggacagauuagaacaua

SEQ ID NO: 1233858 - RNA, 19 nt, Homo sapiens
caggacaacuucaucuaga

SEQ ID NO: 1233859 - RNA, 19 nt, Homo sapiens
gccauauacuuugugauaa

SEQ ID NO: 1233860 - RNA, 19 nt, Homo sapiens
gaggagcgcuuagccagau

SEQ ID NO: 1233861 - RNA, 19 nt, Homo sapiens
ugaacucugucacaaauuc

SEQ ID NO: 1233862 - RNA, 19 nt, Homo sapiens
caagaucuuaugcagguua

SEQ ID NO: 1233863 - RNA, 19 nt, Homo sapiens
caaauccauuaccucaauu

SEQ ID NO: 1233864 - RNA, 19 nt, Homo sapiens
aggaugagcucccgcaaga

SEQ ID NO: 1233865 - RNA, 19 nt, Homo sapiens
cagauuagaacauaugcua

SEQ ID NO: 1233866 - RNA, 19 nt, Homo sapiens
uauccucacuuuaggugua

SEQ ID NO: 1233867 - RNA, 19 nt, Homo sapiens
uaaaucacucccuguguaa

SEQ ID NO: 1233868 - RNA, 19 nt, Homo sapiens
caucuaguagcucgaaaua

SEQ ID NO: 1233869 - RNA, 19 nt, Homo sapiens
ggaguucuguggaaguaca

SEQ ID NO: 1233870 - RNA, 19 nt, Homo sapiens
caugagggauaaugaagau

SEQ ID NO: 1233871 - RNA, 19 nt, Homo sapiens
acucaagccuuucuacaug

SEQ ID NO: 1233872 - RNA, 19 nt, Homo sapiens
cgacaauauccucacuuua

SEQ ID NO: 1233873 - RNA, 19 nt, Homo sapiens
ugccauauacuuugugaua

SEQ ID NO: 1233874 - RNA, 19 nt, Homo sapiens
caagaagagguacuuauag

SEQ ID NO: 1233875 - RNA, 19 nt, Homo sapiens
cagagacacugcacaugau

SEQ ID NO: 1233876 - RNA, 19 nt, Homo sapiens
gcaagcaucccagaacuuc

SEQ ID NO: 1233877 - RNA, 19 nt, Homo sapiens
ggacaguggcuuuguacau

SEQ ID NO: 1233878 - RNA, 19 nt, Homo sapiens
ccuugacaguagagaauua

SEQ ID NO: 1233879 - RNA, 19 nt, Homo sapiens
gaacgauaccauuucuuag

SEQ ID NO: 1233880 - RNA, 19 nt, Homo sapiens
uaugauagaagcagagauu

SEQ ID NO: 1233881 - RNA, 19 nt, Homo sapiens
cgacagcugcuauucauuc

SEQ ID NO: 1233882 - RNA, 19 nt, Homo sapiens
gaggguauuucacguaagg

SEQ ID NO: 1233883 - RNA, 19 nt, Homo sapiens
gcagaaugcauguuuggau

SEQ ID NO: 1233884 - RNA, 19 nt, Homo sapiens
cacuuuagguguaggacua

SEQ ID NO: 1233885 - RNA, 19 nt, Homo sapiens
gggacucucaaauccauua

SEQ ID NO: 1233886 - RNA, 19 nt, Homo sapiens
uaauuguugugccauaaga

SEQ ID NO: 1233887 - RNA, 19 nt, Homo sapiens
ugacagccuucaagaucuu

SEQ ID NO: 1233888 - RNA, 19 nt, Homo sapiens
guacauauucauacuccaa

SEQ ID NO: 1233889 - RNA, 19 nt, Homo sapiens
uuagaaaguugaggguauu

SEQ ID NO: 1233890 - RNA, 19 nt, Homo sapiens
caguggagaucuuaaagca

SEQ ID NO: 1233891 - RNA, 19 nt, Homo sapiens
gugcugaccuacggacuga

SEQ ID NO: 1233892 - RNA, 19 nt, Homo sapiens
gguucuauauugaggauuc

SEQ ID NO: 1233893 - RNA, 19 nt, Homo sapiens
gacaguagagaauuaacuu

SEQ ID NO: 1233894 - RNA, 19 nt, Homo sapiens
guauuucacguaaggauga

SEQ ID NO: 1233895 - RNA, 19 nt, Homo sapiens
cuuagaaaguugaggguau

SEQ ID NO: 1233896 - RNA, 19 nt, Homo sapiens
gcuggaagauugguuaagg

SEQ ID NO: 1233897 - RNA, 19 nt, Homo sapiens
ggaccuucgucgauuugga

SEQ ID NO: 1233898 - RNA, 19 nt, Homo sapiens
uggaaagccuucagguugu

SEQ ID NO: 1233899 - RNA, 19 nt, Homo sapiens
ugaagauguugaacucugu

SEQ ID NO: 1233900 - RNA, 19 nt, Homo sapiens
cuacaacaaugaugguucu

SEQ ID NO: 1233901 - RNA, 19 nt, Homo sapiens
uuacucaaguguuuaccuu

SEQ ID NO: 1233902 - RNA, 19 nt, Homo sapiens
ucacauccaaugacucuga

SEQ ID NO: 1233903 - RNA, 19 nt, Homo sapiens
ggaagauugguuaaggaaa

SEQ ID NO: 1233904 - RNA, 19 nt, Homo sapiens
caagguuuccucauucaug

SEQ ID NO: 1233905 - RNA, 19 nt, Homo sapiens
uuagccagaucgggacuua

SEQ ID NO: 1233906 - RNA, 19 nt, Homo sapiens
ccuacggacugaacaugaa

SEQ ID NO: 1233907 - RNA, 19 nt, Homo sapiens
acucaaguguuuaccuuug

SEQ ID NO: 1233908 - RNA, 19 nt, Homo sapiens
gaaugcauguuuggauuuu

SEQ ID NO: 1233909 - RNA, 19 nt, Homo sapiens
uacaagggcagcugauaaa

SEQ ID NO: 1233910 - RNA, 19 nt, Homo sapiens
ccagaaggaagucuuguuc

SEQ ID NO: 1233911 - RNA, 19 nt, Homo sapiens
gaugagcucccgcaagaag

SEQ ID NO: 1233912 - RNA, 19 nt, Homo sapiens
gauugugcauacagcagaa

SEQ ID NO: 1233913 - RNA, 19 nt, Homo sapiens
agaaaggccuaacccauua

SEQ ID NO: 1233914 - RNA, 19 nt, Homo sapiens
cagagcagcuguuuacaau

SEQ ID NO: 1233915 - RNA, 19 nt, Homo sapiens
gaacucguuugcuccuaaa

SEQ ID NO: 1233916 - RNA, 19 nt, Homo sapiens
gaccaugggugaagucuag

SEQ ID NO: 1233917 - RNA, 19 nt, Homo sapiens
gggcaaaggugagagauca

SEQ ID NO: 1233918 - RNA, 19 nt, Homo sapiens
caugaacuuuguuggguua

SEQ ID NO: 1233919 - RNA, 19 nt, Homo sapiens
caacaagaacguuucagaa

SEQ ID NO: 1233920 - RNA, 19 nt, Homo sapiens
gcuccuaaaucuuguuaau

SEQ ID NO: 1233921 - RNA, 19 nt, Homo sapiens
cuauguuccucuucucuua

SEQ ID NO: 1233922 - RNA, 19 nt, Homo sapiens
ucacaagugccaugaguuu

SEQ ID NO: 1233923 - RNA, 19 nt, Homo sapiens
gcugggagcucuguugugu

SEQ ID NO: 1233924 - RNA, 19 nt, Homo sapiens
acaaagaacccauuuccuu

SEQ ID NO: 1233925 - RNA, 19 nt, Homo sapiens
uagaaaggccuaacccauu

SEQ ID NO: 1233926 - RNA, 19 nt, Homo sapiens
ugaacucguuugcuccuaa

SEQ ID NO: 1233927 - RNA, 19 nt, Homo sapiens
gagcagcuguuuacaaucc

SEQ ID NO: 1233928 - RNA, 19 nt, Homo sapiens
gagaucaccuucccuaucc

SEQ ID NO: 1233929 - RNA, 19 nt, Homo sapiens
gaacuuuguuggguuaagg

SEQ ID NO: 1233930 - RNA, 19 nt, Homo sapiens
cgaaacaaagaacccauuu

SEQ ID NO: 1233931 - RNA, 19 nt, Homo sapiens
agagaagggucuugguuuc

SEQ ID NO: 1233932 - RNA, 19 nt, Homo sapiens
cagagaagggucuugguuu

SEQ ID NO: 1233933 - RNA, 19 nt, Homo sapiens
cgauaugccaaaccaauuu

SEQ ID NO: 1233934 - RNA, 19 nt, Homo sapiens
ggugguuugucccguguaa

SEQ ID NO: 1233935 - RNA, 19 nt, Homo sapiens
cauaacaacaagaacguuu

SEQ ID NO: 1233936 - RNA, 19 nt, Homo sapiens
cgagugcauuuaacgagaa

SEQ ID NO: 1233937 - RNA, 19 nt, Homo sapiens
gccaggacuucuccgugua

SEQ ID NO: 1233938 - RNA, 19 nt, Homo sapiens
uggcugcgcugucccuuug

SEQ ID NO: 1233939 - RNA, 19 nt, Homo sapiens
acacagagaggccaacuuc

SEQ ID NO: 1233940 - RNA, 19 nt, Homo sapiens
ccucuucucuuauccucaa

SEQ ID NO: 1233941 - RNA, 19 nt, Homo sapiens
guuccugcuucuuguauau

SEQ ID NO: 1233942 - RNA, 19 nt, Homo sapiens
caaaacaaaaggcucauaa

SEQ ID NO: 1233943 - RNA, 19 nt, Homo sapiens
ccagagcagcuguuuacaa

SEQ ID NO: 1233944 - RNA, 19 nt, Homo sapiens
gcgaaacaaagaacccauu

SEQ ID NO: 1233945 - RNA, 19 nt, Homo sapiens
gaugcaacagcgaaacaaa

SEQ ID NO: 1233946 - RNA, 19 nt, Homo sapiens
uaacaacaagaacguuuca

SEQ ID NO: 1233947 - RNA, 19 nt, Homo sapiens
gggcugaggcacacagaga

SEQ ID NO: 1233948 - RNA, 19 nt, Homo sapiens
gcaacagcgaaacaaagaa

SEQ ID NO: 1233949 - RNA, 19 nt, Homo sapiens
ucucuuauccucaacuuuc

SEQ ID NO: 1233950 - RNA, 19 nt, Homo sapiens
acaacaagaacguuucaga

SEQ ID NO: 1233951 - RNA, 19 nt, Homo sapiens
acaaaaggcucauaacaac

SEQ ID NO: 1233952 - RNA, 19 nt, Homo sapiens
aagaugcuuugucaagaug

SEQ ID NO: 1233953 - RNA, 19 nt, Homo sapiens
aaacaaagaacccauuucc

SEQ ID NO: 1233954 - RNA, 19 nt, Homo sapiens
gaggagggccaggagaguu

SEQ ID NO: 1233955 - RNA, 19 nt, Homo sapiens
caacagcgaaacaaagaac

SEQ ID NO: 1233956 - RNA, 19 nt, Homo sapiens
ggagggcaagggacaguuc

SEQ ID NO: 1233957 - RNA, 19 nt, Homo sapiens
gaacagguguggggaagag

SEQ ID NO: 1233958 - RNA, 19 nt, Homo sapiens
ggucgggacacccauguuc

SEQ ID NO: 1233959 - RNA, 19 nt, Homo sapiens
gagagaucaccuucccuau

SEQ ID NO: 1233960 - RNA, 19 nt, Homo sapiens
gcgcugucccuuugaguuc

SEQ ID NO: 1233961 - RNA, 19 nt, Homo sapiens
ccucaacuuucuguccauu

SEQ ID NO: 1233962 - RNA, 19 nt, Homo sapiens
acagagaagggucuugguu

SEQ ID NO: 1233963 - RNA, 19 nt, Homo sapiens
gggaagauggggcugauuu

SEQ ID NO: 1233964 - RNA, 19 nt, Homo sapiens
gcauuuaacgagaacaaaa

SEQ ID NO: 1233965 - RNA, 19 nt, Homo sapiens
gcugggacgguacagagaa

SEQ ID NO: 1233966 - RNA, 19 nt, Homo sapiens
caaagggagagagggugua

SEQ ID NO: 1233967 - RNA, 19 nt, Homo sapiens
cagccuuccuuguaucucu

SEQ ID NO: 1233968 - RNA, 19 nt, Homo sapiens
gaagaccaugggugaaguc

SEQ ID NO: 1233969 - RNA, 19 nt, Homo sapiens
cugcugccaugaacuuugu

SEQ ID NO: 1233970 - RNA, 19 nt, Homo sapiens
ugcaacagcgaaacaaaga

SEQ ID NO: 1233971 - RNA, 19 nt, Homo sapiens
ucgauaugccaaaccaauu

SEQ ID NO: 1233972 - RNA, 19 nt, Homo sapiens
ucaacuuucuguccauucg

SEQ ID NO: 1233973 - RNA, 19 nt, Homo sapiens
cguuugcuccuaaaucuug

SEQ ID NO: 1233974 - RNA, 19 nt, Homo sapiens
ccuuguaucucuccagacu

SEQ ID NO: 1233975 - RNA, 19 nt, Homo sapiens
gcccagccuuccuuguauc

SEQ ID NO: 1233976 - RNA, 19 nt, Homo sapiens
ugcccagccuuccuuguau

SEQ ID NO: 1233977 - RNA, 19 nt, Homo sapiens
cugcccagccuuccuugua

SEQ ID NO: 1233978 - RNA, 19 nt, Homo sapiens
cgccagagcagcuguuuac

SEQ ID NO: 1233979 - RNA, 19 nt, Homo sapiens
ucuccuacucccuuccuua

SEQ ID NO: 1233980 - RNA, 19 nt, Homo sapiens
gaaaggccuaacccauuac

SEQ ID NO: 1233981 - RNA, 19 nt, Homo sapiens
agagaucaccuucccuauc

SEQ ID NO: 1233982 - RNA, 19 nt, Homo sapiens
cagaagaccaugggugaag

SEQ ID NO: 1233983 - RNA, 19 nt, Homo sapiens
gcugauuucccaccuagag

SEQ ID NO: 1233984 - RNA, 19 nt, Homo sapiens
gaguuccugcuucuuguau

SEQ ID NO: 1233985 - RNA, 19 nt, Homo sapiens
caacagaggauguccauua

SEQ ID NO: 1233986 - RNA, 19 nt, Homo sapiens
gaagagcaaucaagugaau

SEQ ID NO: 1233987 - RNA, 19 nt, Homo sapiens
ggacucaucucacccaaug

SEQ ID NO: 1233988 - RNA, 19 nt, Homo sapiens
ccagaaaucaguccaaaua

SEQ ID NO: 1233989 - RNA, 19 nt, Homo sapiens
ggagccagcuggagaaaga

SEQ ID NO: 1233990 - RNA, 19 nt, Homo sapiens
caagaaaguucauguuaca

SEQ ID NO: 1233991 - RNA, 19 nt, Homo sapiens
gaauagagucuguuaaugu

SEQ ID NO: 1233992 - RNA, 19 nt, Homo sapiens
caacaaagcugagaguucu

SEQ ID NO: 1233993 - RNA, 19 nt, Homo sapiens
uaacacagcauucccuuaa

SEQ ID NO: 1233994 - RNA, 19 nt, Homo sapiens
ggagaaagaggcucaaaga

SEQ ID NO: 1233995 - RNA, 19 nt, Homo sapiens
caacaauccucaaucaagu

SEQ ID NO: 1233996 - RNA, 19 nt, Homo sapiens
gcucgcagcuauuuguaaa

SEQ ID NO: 1233997 - RNA, 19 nt, Homo sapiens
gauguuggcuuaguuuaau

SEQ ID NO: 1233998 - RNA, 19 nt, Homo sapiens
gaagggccaccaacuauga

SEQ ID NO: 1233999 - RNA, 19 nt, Homo sapiens
gcucagccauuguaaacuu

SEQ ID NO: 1234000 - RNA, 19 nt, Homo sapiens
gaucggagaaagauaaauu

SEQ ID NO: 1234001 - RNA, 19 nt, Homo sapiens
guaacaccguugaagcuaa

SEQ ID NO: 1234002 - RNA, 19 nt, Homo sapiens
gaguacagcuggcaagauc

SEQ ID NO: 1234003 - RNA, 19 nt, Homo sapiens
gaaagugaucggagaaaga

SEQ ID NO: 1234004 - RNA, 19 nt, Homo sapiens
ucaaucaagucuauggaaa

SEQ ID NO: 1234005 - RNA, 19 nt, Homo sapiens
ccaagaauagagucuguua

SEQ ID NO: 1234006 - RNA, 19 nt, Homo sapiens
gagaaggcagccaaugaua

SEQ ID NO: 1234007 - RNA, 19 nt, Homo sapiens
cgacacccaucucuuauca

SEQ ID NO: 1234008 - RNA, 19 nt, Homo sapiens
auuaggagguuguaugaua

SEQ ID NO: 1234009 - RNA, 19 nt, Homo sapiens
caaagaaaaugcuguguga

SEQ ID NO: 1234010 - RNA, 19 nt, Homo sapiens
cagaggauguccauuaauc

SEQ ID NO: 1234011 - RNA, 19 nt, Homo sapiens
ccacagaugccaccacuga

SEQ ID NO: 1234012 - RNA, 19 nt, Homo sapiens
acacccaucucuuaucaaa

SEQ ID NO: 1234013 - RNA, 19 nt, Homo sapiens
gcaacaauccucaaucaag

SEQ ID NO: 1234014 - RNA, 19 nt, Homo sapiens
gguaaagaguauagaaagu

SEQ ID NO: 1234015 - RNA, 19 nt, Homo sapiens
guacacagacugauuugga

SEQ ID NO: 1234016 - RNA, 19 nt, Homo sapiens
gcaccacccacucuucuaa

SEQ ID NO: 1234017 - RNA, 19 nt, Homo sapiens
acccaucucuuaucaaauu

SEQ ID NO: 1234018 - RNA, 19 nt, Homo sapiens
ccaaauggacaaucaguug

SEQ ID NO: 1234019 - RNA, 19 nt, Homo sapiens
ugauauagcuaauguucug

SEQ ID NO: 1234020 - RNA, 19 nt, Homo sapiens
ucaagugaauccagacaga

SEQ ID NO: 1234021 - RNA, 19 nt, Homo sapiens
uagaagagcaaucaaguga

SEQ ID NO: 1234022 - RNA, 19 nt, Homo sapiens
uagcuaauguucugaguag

SEQ ID NO: 1234023 - RNA, 19 nt, Homo sapiens
gcugugugauguauaaugu

SEQ ID NO: 1234024 - RNA, 19 nt, Homo sapiens
ggauguccauuaaucaaca

SEQ ID NO: 1234025 - RNA, 19 nt, Homo sapiens
aacagaggauguccauuaa

SEQ ID NO: 1234026 - RNA, 19 nt, Homo sapiens
ugaguagccuggaucuuau

SEQ ID NO: 1234027 - RNA, 19 nt, Homo sapiens
ugaacucacugcuguuaau

SEQ ID NO: 1234028 - RNA, 19 nt, Homo sapiens
ucaagaaaguucauguuac

SEQ ID NO: 1234029 - RNA, 19 nt, Homo sapiens
gaaaucaguccaaauacca

SEQ ID NO: 1234030 - RNA, 19 nt, Homo sapiens
caaagggucacaauuagug

SEQ ID NO: 1234031 - RNA, 19 nt, Homo sapiens
uaacaccguugaagcuaau

SEQ ID NO: 1234032 - RNA, 19 nt, Homo sapiens
ggccagagccagccaaaug

SEQ ID NO: 1234033 - RNA, 19 nt, Homo sapiens
cugaguagccuggaucuua

SEQ ID NO: 1234034 - RNA, 19 nt, Homo sapiens
agcauucccuuaaacauuu

SEQ ID NO: 1234035 - RNA, 19 nt, Homo sapiens
gcccagaaaucaguccaaa

SEQ ID NO: 1234036 - RNA, 19 nt, Homo sapiens
gcaguuagaagagcaauca

SEQ ID NO: 1234037 - RNA, 19 nt, Homo sapiens
gaacccaagcucagccauu

SEQ ID NO: 1234038 - RNA, 19 nt, Homo sapiens
gaacucacugcuguuaauu

SEQ ID NO: 1234039 - RNA, 19 nt, Homo sapiens
cagcauucccuuaaacauu

SEQ ID NO: 1234040 - RNA, 19 nt, Homo sapiens
gacaucaucugaacucacu

SEQ ID NO: 1234041 - RNA, 19 nt, Homo sapiens
cgaggacagugguuccaaa

SEQ ID NO: 1234042 - RNA, 19 nt, Homo sapiens
agcuaugccuauacuauua

SEQ ID NO: 1234043 - RNA, 19 nt, Homo sapiens
guaaagaguauagaaagug

SEQ ID NO: 1234044 - RNA, 19 nt, Homo sapiens
aaugcugugugauguauaa

SEQ ID NO: 1234045 - RNA, 19 nt, Homo sapiens
guuaaugucgcaccagaaa

SEQ ID NO: 1234046 - RNA, 19 nt, Homo sapiens
agaauagagucuguuaaug

SEQ ID NO: 1234047 - RNA, 19 nt, Homo sapiens
ccagccaaauggacaauca

SEQ ID NO: 1234048 - RNA, 19 nt, Homo sapiens
gaaaauguacacagacuga

SEQ ID NO: 1234049 - RNA, 19 nt, Homo sapiens
gaggauguccauuaaucaa

SEQ ID NO: 1234050 - RNA, 19 nt, Homo sapiens
uuaggagguuguaugauau

SEQ ID NO: 1234051 - RNA, 19 nt, Homo sapiens
gaauccagacagaaaguga

SEQ ID NO: 1234052 - RNA, 19 nt, Homo sapiens
ccagcccagucauucauuu

SEQ ID NO: 1234053 - RNA, 19 nt, Homo sapiens
cccaaagggucacaauuag

SEQ ID NO: 1234054 - RNA, 19 nt, Homo sapiens
ggaagggccaccaacuaug

SEQ ID NO: 1234055 - RNA, 19 nt, Homo sapiens
aaagagaacugugccaaaa

SEQ ID NO: 1234056 - RNA, 19 nt, Homo sapiens
ccagugacaucaucugaac

SEQ ID NO: 1234057 - RNA, 19 nt, Homo sapiens
ucaaaagacuccacagaug

SEQ ID NO: 1234058 - RNA, 19 nt, Homo sapiens
acucgacacccaucucuua

SEQ ID NO: 1234059 - RNA, 19 nt, Homo sapiens
cgugggaaaccaaacuuua

SEQ ID NO: 1234060 - RNA, 19 nt, Homo sapiens
gagguuguaugauauagcu

SEQ ID NO: 1234061 - RNA, 19 nt, Homo sapiens
gaacacauucucugaaaau

SEQ ID NO: 1234062 - RNA, 19 nt, Homo sapiens
caagaauagagucuguuaa

SEQ ID NO: 1234063 - RNA, 19 nt, Homo sapiens
uugcaacaauccucaauca

SEQ ID NO: 1234064 - RNA, 19 nt, Homo sapiens
ugugugauguauaauguug

SEQ ID NO: 1234065 - RNA, 19 nt, Homo sapiens
aauagagucuguuaauguc

SEQ ID NO: 1234066 - RNA, 19 nt, Homo sapiens
guuccugugucuccaagaa

SEQ ID NO: 1234067 - RNA, 19 nt, Homo sapiens
acaaucaguugcugugaca

SEQ ID NO: 1234068 - RNA, 19 nt, Homo sapiens
caagugcucuuuccccaaa

SEQ ID NO: 1234069 - RNA, 19 nt, Homo sapiens
gaaauuuaaagaggaccua

SEQ ID NO: 1234070 - RNA, 19 nt, Homo sapiens
aaauuaggagguuguauga

SEQ ID NO: 1234071 - RNA, 19 nt, Homo sapiens
ucugcacccuucccaagua

SEQ ID NO: 1234072 - RNA, 19 nt, Homo sapiens
gaaaaugcugugugaugua

SEQ ID NO: 1234073 - RNA, 19 nt, Homo sapiens
ccuauacuauuaugcaaag

SEQ ID NO: 1234074 - RNA, 19 nt, Homo sapiens
cuuaggaacucucuuuguc

SEQ ID NO: 1234075 - RNA, 19 nt, Homo sapiens
ccaacaaagcugagaguuc

SEQ ID NO: 1234076 - RNA, 19 nt, Homo sapiens
cccaguagcccuaucaaga

SEQ ID NO: 1234077 - RNA, 19 nt, Homo sapiens
uagcuaugccuauacuauu

SEQ ID NO: 1234078 - RNA, 19 nt, Homo sapiens
aauccucaaucaagucuau

SEQ ID NO: 1234079 - RNA, 19 nt, Homo sapiens
gcaccugggacucaucuca

SEQ ID NO: 1234080 - RNA, 19 nt, Homo sapiens
gacagaaagugagaguaca

SEQ ID NO: 1234081 - RNA, 19 nt, Homo sapiens
uaaauucugcgcccaguag

SEQ ID NO: 1234082 - RNA, 19 nt, Homo sapiens
gguuguaugauauagcuaa

SEQ ID NO: 1234083 - RNA, 19 nt, Homo sapiens
acacagcauucccuuaaac

SEQ ID NO: 1234084 - RNA, 19 nt, Homo sapiens
guccauuaaucaacagaug

SEQ ID NO: 1234085 - RNA, 19 nt, Homo sapiens
gagcuggccuggcagagua

SEQ ID NO: 1234086 - RNA, 19 nt, Homo sapiens
gcaaauggagauucaggua

SEQ ID NO: 1234087 - RNA, 19 nt, Homo sapiens
aaauggagauucagguauu

SEQ ID NO: 1234088 - RNA, 19 nt, Homo sapiens
gcagauguguggcaauguc

SEQ ID NO: 1234089 - RNA, 19 nt, Homo sapiens
ucaaagaccggauggaaga

SEQ ID NO: 1234090 - RNA, 19 nt, Homo sapiens
ugaaggcccucaggcagua

SEQ ID NO: 1234091 - RNA, 19 nt, Homo sapiens
gauggguccuugcuucuca

SEQ ID NO: 1234092 - RNA, 19 nt, Homo sapiens
aggaggagcucacgcaaau

SEQ ID NO: 1234093 - RNA, 19 nt, Homo sapiens
gcaagcuggugcuggacaa

SEQ ID NO: 1234094 - RNA, 19 nt, Homo sapiens
gcaagugggugcggcucaa

SEQ ID NO: 1234095 - RNA, 19 nt, Homo sapiens
ggaggaagccgaguucuac

SEQ ID NO: 1234096 - RNA, 19 nt, Homo sapiens
gaagccgaguucuacaaca

SEQ ID NO: 1234097 - RNA, 19 nt, Homo sapiens
caaauggagauucagguau

SEQ ID NO: 1234098 - RNA, 19 nt, Homo sapiens
guucccaucugaaauccuu

SEQ ID NO: 1234099 - RNA, 19 nt, Homo sapiens
ggauggaagagaaggacua

SEQ ID NO: 1234100 - RNA, 19 nt, Homo sapiens
aggcagaguuccugugugu

SEQ ID NO: 1234101 - RNA, 19 nt, Homo sapiens
gcgaggaccaggcagaguu

SEQ ID NO: 1234102 - RNA, 19 nt, Homo sapiens
ucgagcagcuggugaacau

SEQ ID NO: 1234103 - RNA, 19 nt, Homo sapiens
gaggaggagcucacgcaaa

SEQ ID NO: 1234104 - RNA, 19 nt, Homo sapiens
guaguuggcuuggccuucu

SEQ ID NO: 1234105 - RNA, 19 nt, Homo sapiens
gaggagcucacgcaaaugg

SEQ ID NO: 1234106 - RNA, 19 nt, Homo sapiens
uggcagauguguggcaaug

SEQ ID NO: 1234107 - RNA, 19 nt, Homo sapiens
guaauaaaacccaaaggaa

SEQ ID NO: 1234108 - RNA, 19 nt, Homo sapiens
gcugccaucccugcuguua

SEQ ID NO: 1234109 - RNA, 19 nt, Homo sapiens
ggccuucucuuuggugauc

SEQ ID NO: 1234110 - RNA, 19 nt, Homo sapiens
uggcuuggccuucucuuug

SEQ ID NO: 1234111 - RNA, 19 nt, Homo sapiens
guuugcaaauggagauuca

SEQ ID NO: 1234112 - RNA, 19 nt, Homo sapiens
gaucaccuccagggacuug

SEQ ID NO: 1234113 - RNA, 19 nt, Homo sapiens
ugccaucccugcuguuaca

SEQ ID NO: 1234114 - RNA, 19 nt, Homo sapiens
guggaggacucaggaacug

SEQ ID NO: 1234115 - RNA, 19 nt, Homo sapiens
aagccgaguucuacaacau

SEQ ID NO: 1234116 - RNA, 19 nt, Homo sapiens
gaggagcaaagucccugaa

SEQ ID NO: 1234117 - RNA, 19 nt, Homo sapiens
gcccuccuguguuugacuu

SEQ ID NO: 1234118 - RNA, 19 nt, Homo sapiens
ggaagccgaguucuacaac

SEQ ID NO: 1234119 - RNA, 19 nt, Homo sapiens
aagaccggauggaagagaa

SEQ ID NO: 1234120 - RNA, 19 nt, Homo sapiens
gcccucaggcaguauauag

SEQ ID NO: 1234121 - RNA, 19 nt, Homo sapiens
ggucacauugccuccuuga

SEQ ID NO: 1234122 - RNA, 19 nt, Homo sapiens
caugguggaugugcuccuu

SEQ ID NO: 1234123 - RNA, 19 nt, Homo sapiens
cagaggcacccggauguga

SEQ ID NO: 1234124 - RNA, 19 nt, Homo sapiens
uggaggaagccgaguucua

SEQ ID NO: 1234125 - RNA, 19 nt, Homo sapiens
aauggagauucagguauug

SEQ ID NO: 1234126 - RNA, 19 nt, Homo sapiens
gcagguggaggcagaugca

SEQ ID NO: 1234127 - RNA, 19 nt, Homo sapiens
ggcuuggccuucucuuugg

SEQ ID NO: 1234128 - RNA, 19 nt, Homo sapiens
gcaugaagcugcaguggaa

SEQ ID NO: 1234129 - RNA, 19 nt, Homo sapiens
ucaacgagcugacuaugaa

SEQ ID NO: 1234130 - RNA, 19 nt, Homo sapiens
gcacugggcuccuguagag

SEQ ID NO: 1234131 - RNA, 19 nt, Homo sapiens
caagggaacuuugaagaga

SEQ ID NO: 1234132 - RNA, 19 nt, Homo sapiens
agaacgagguggaugcuuu

SEQ ID NO: 1234133 - RNA, 19 nt, Homo sapiens
gcuacagggugguguuuga

SEQ ID NO: 1234134 - RNA, 19 nt, Homo sapiens
acaacacgcugacuaggaa

SEQ ID NO: 1234135 - RNA, 19 nt, Homo sapiens
gcacugacaggaccaacaa

SEQ ID NO: 1234136 - RNA, 19 nt, Homo sapiens
gaugaguauuuccgcauga

SEQ ID NO: 1234137 - RNA, 19 nt, Homo sapiens
gaugugagccgcacugaca

SEQ ID NO: 1234138 - RNA, 19 nt, Homo sapiens
ucucaucgcuggugucauc

SEQ ID NO: 1234139 - RNA, 19 nt, Homo sapiens
uaaacugacacuucucaaa

SEQ ID NO: 1234140 - RNA, 19 nt, Homo sapiens
gcaagaaaacggaugagua

SEQ ID NO: 1234141 - RNA, 19 nt, Homo sapiens
caccagcgcuaagaaguau

SEQ ID NO: 1234142 - RNA, 19 nt, Homo sapiens
ucauuaaacugacacuucu

SEQ ID NO: 1234143 - RNA, 19 nt, Homo sapiens
guucugcacaggcacuuua

SEQ ID NO: 1234144 - RNA, 19 nt, Homo sapiens
gcaagggaacuuugaagag

SEQ ID NO: 1234145 - RNA, 19 nt, Homo sapiens
gaacgagguggaugcuuuc

SEQ ID NO: 1234146 - RNA, 19 nt, Homo sapiens
cugcucaucugguucaaga

SEQ ID NO: 1234147 - RNA, 19 nt, Homo sapiens
ugacaggaccaacaaguuc

SEQ ID NO: 1234148 - RNA, 19 nt, Homo sapiens
gagcggagaaacucacuuc

SEQ ID NO: 1234149 - RNA, 19 nt, Homo sapiens
gcacagcugaggagcacaa

SEQ ID NO: 1234150 - RNA, 19 nt, Homo sapiens
gaggaggaaccaaccuuug

SEQ ID NO: 1234151 - RNA, 19 nt, Homo sapiens
cagcugggccuaccugguu

SEQ ID NO: 1234152 - RNA, 19 nt, Homo sapiens
gacaacacgcugacuagga

SEQ ID NO: 1234153 - RNA, 19 nt, Homo sapiens
gguggcugcucaucugguu

SEQ ID NO: 1234154 - RNA, 19 nt, Homo sapiens
gggcaugagugaucuucuc

SEQ ID NO: 1234155 - RNA, 19 nt, Homo sapiens
ggaccaacaaguucuacga

SEQ ID NO: 1234156 - RNA, 19 nt, Homo sapiens
caagaaaacggaugaguau

SEQ ID NO: 1234157 - RNA, 19 nt, Homo sapiens
ggagcacaaggcccacaua

SEQ ID NO: 1234158 - RNA, 19 nt, Homo sapiens
ugucauccgugucguggaa

SEQ ID NO: 1234159 - RNA, 19 nt, Homo sapiens
acucacuucugcauggaua

SEQ ID NO: 1234160 - RNA, 19 nt, Homo sapiens
gaccaggacagcuccaaug

SEQ ID NO: 1234161 - RNA, 19 nt, Homo sapiens
gcacaccagcgcuaagaag

SEQ ID NO: 1234162 - RNA, 19 nt, Homo sapiens
acagggugguguuugagaa

SEQ ID NO: 1234163 - RNA, 19 nt, Homo sapiens
gaugcuuucugguguuucu

SEQ ID NO: 1234164 - RNA, 19 nt, Homo sapiens
gagcaggagcggagaaacu

SEQ ID NO: 1234165 - RNA, 19 nt, Homo sapiens
acaccagcgcuaagaagua

SEQ ID NO: 1234166 - RNA, 19 nt, Homo sapiens
ggcuucggcuccaaugaga

SEQ ID NO: 1234167 - RNA, 19 nt, Homo sapiens
agaaaacggaugaguauuu

SEQ ID NO: 1234168 - RNA, 19 nt, Homo sapiens
ccucugcucucuccaacuc

SEQ ID NO: 1234169 - RNA, 19 nt, Homo sapiens
ugaggaggaaccaaccuuu

SEQ ID NO: 1234170 - RNA, 19 nt, Homo sapiens
cccaaauccucuucuccaa

SEQ ID NO: 1234171 - RNA, 19 nt, Homo sapiens
aaacugacacuucucaaaa

SEQ ID NO: 1234172 - RNA, 19 nt, Homo sapiens
acgauauccuccucaccua

SEQ ID NO: 1234173 - RNA, 19 nt, Homo sapiens
cuacgagggucccgagaac

SEQ ID NO: 1234174 - RNA, 19 nt, Homo sapiens
uaccgcagccucaucgaaa

SEQ ID NO: 1234175 - RNA, 19 nt, Homo sapiens
gcucugcgacuuccuggau

SEQ ID NO: 1234176 - RNA, 19 nt, Homo sapiens
guggaugcuuucugguguu

SEQ ID NO: 1234177 - RNA, 19 nt, Homo sapiens
gagcacaaggcccacauac

SEQ ID NO: 1234178 - RNA, 19 nt, Homo sapiens
ggacucccgccucuaccuu

SEQ ID NO: 1234179 - RNA, 19 nt, Homo sapiens
aaacucacuucugcaugga

SEQ ID NO: 1234180 - RNA, 19 nt, Homo sapiens
gcacaucaacgagcugacu

SEQ ID NO: 1234181 - RNA, 19 nt, Homo sapiens
guguuucuguggcuucaug

SEQ ID NO: 1234182 - RNA, 19 nt, Homo sapiens
uggaugcuuucugguguuu

SEQ ID NO: 1234183 - RNA, 19 nt, Homo sapiens
ccuacugcauguaucacuu

SEQ ID NO: 1234184 - RNA, 19 nt, Homo sapiens
aggaggaaccaaccuuuga

SEQ ID NO: 1234185 - RNA, 19 nt, Homo sapiens
gagauccucaagcacauca

SEQ ID NO: 1234186 - RNA, 19 nt, Homo sapiens
ugagaagggcggaguguac

SEQ ID NO: 1234187 - RNA, 19 nt, Homo sapiens
agaggaggcuggagauucc

SEQ ID NO: 1234188 - RNA, 19 nt, Homo sapiens
ccacccaaauccucuucuc

SEQ ID NO: 1234189 - RNA, 19 nt, Homo sapiens
uagaggaggcuggagauuc

SEQ ID NO: 1234190 - RNA, 19 nt, Homo sapiens
guagaggaggcuggagauu

SEQ ID NO: 1234191 - RNA, 19 nt, Homo sapiens
gcucgugcaagggaacuuu

SEQ ID NO: 1234192 - RNA, 19 nt, Homo sapiens
ucaccuacugcauguauca

SEQ ID NO: 1234193 - RNA, 19 nt, Homo sapiens
ccucaccuacugcauguau

SEQ ID NO: 1234194 - RNA, 19 nt, Homo sapiens
ggaagaagguccaucaaua

SEQ ID NO: 1234195 - RNA, 19 nt, Homo sapiens
gagaaagacuuaagaauug

SEQ ID NO: 1234196 - RNA, 19 nt, Homo sapiens
gaagagauuuccucgauca

SEQ ID NO: 1234197 - RNA, 19 nt, Homo sapiens
gagauuuccucgaucauuu

SEQ ID NO: 1234198 - RNA, 19 nt, Homo sapiens
gaagaagguccaucaauau

SEQ ID NO: 1234199 - RNA, 19 nt, Homo sapiens
gaaaagagcuagugaagca

SEQ ID NO: 1234200 - RNA, 19 nt, Homo sapiens
gaauacagcaucuacuaaa

SEQ ID NO: 1234201 - RNA, 19 nt, Homo sapiens
gggcucaccuugaucguaa

SEQ ID NO: 1234202 - RNA, 19 nt, Homo sapiens
gaaagagaaagacuuaaga

SEQ ID NO: 1234203 - RNA, 19 nt, Homo sapiens
guuuguaacuccauacuuu

SEQ ID NO: 1234204 - RNA, 19 nt, Homo sapiens
caugcuguaugccuuauua

SEQ ID NO: 1234205 - RNA, 19 nt, Homo sapiens
aaacaggacuauccauuca

SEQ ID NO: 1234206 - RNA, 19 nt, Homo sapiens
gaaaauuacucccaauguu

SEQ ID NO: 1234207 - RNA, 19 nt, Homo sapiens
gagcgggucuguccucuuc

SEQ ID NO: 1234208 - RNA, 19 nt, Homo sapiens
uagaagagauuuccucgau

SEQ ID NO: 1234209 - RNA, 19 nt, Homo sapiens
gccaagaccaaaucaauaa

SEQ ID NO: 1234210 - RNA, 19 nt, Homo sapiens
guacugggccuuacauaau

SEQ ID NO: 1234211 - RNA, 19 nt, Homo sapiens
ggagagagguggagaugcu

SEQ ID NO: 1234212 - RNA, 19 nt, Homo sapiens
gaacucaucucuguuucca

SEQ ID NO: 1234213 - RNA, 19 nt, Homo sapiens
gaaaaccgguuccugagaa

SEQ ID NO: 1234214 - RNA, 19 nt, Homo sapiens
ugaaugugcccuuguuuaa

SEQ ID NO: 1234215 - RNA, 19 nt, Homo sapiens
caaagugaccguuggaguu

SEQ ID NO: 1234216 - RNA, 19 nt, Homo sapiens
uaaugaaugugcccuuguu

SEQ ID NO: 1234217 - RNA, 19 nt, Homo sapiens
cuacugaacuacaaagagu

SEQ ID NO: 1234218 - RNA, 19 nt, Homo sapiens
ggaauauacucaucaucag

SEQ ID NO: 1234219 - RNA, 19 nt, Homo sapiens
aaaguacaguucaaguuug

SEQ ID NO: 1234220 - RNA, 19 nt, Homo sapiens
gaagguccaucaauaucgu

SEQ ID NO: 1234221 - RNA, 19 nt, Homo sapiens
ccucaaaccagacauagaa

SEQ ID NO: 1234222 - RNA, 19 nt, Homo sapiens
acagcaggcuuccaucuug

SEQ ID NO: 1234223 - RNA, 19 nt, Homo sapiens
aaagaugccuaaagcagau

SEQ ID NO: 1234224 - RNA, 19 nt, Homo sapiens
agacauagaaagagaaaga

SEQ ID NO: 1234225 - RNA, 19 nt, Homo sapiens
caaaccagacauagaaaga

SEQ ID NO: 1234226 - RNA, 19 nt, Homo sapiens
acuugaagcuuuccgauug

SEQ ID NO: 1234227 - RNA, 19 nt, Homo sapiens
gagguuaacgugcuaaagu

SEQ ID NO: 1234228 - RNA, 19 nt, Homo sapiens
ucaccuugaucguaaguug

SEQ ID NO: 1234229 - RNA, 19 nt, Homo sapiens
uacagcaucuacuaaagaa

SEQ ID NO: 1234230 - RNA, 19 nt, Homo sapiens
gacaagcucuucucuucag

SEQ ID NO: 1234231 - RNA, 19 nt, Homo sapiens
gcuguaugccuuauuaaau

SEQ ID NO: 1234232 - RNA, 19 nt, Homo sapiens
gaacagcaggcuuccaucu

SEQ ID NO: 1234233 - RNA, 19 nt, Homo sapiens
gccuaaagcagauuucuau

SEQ ID NO: 1234234 - RNA, 19 nt, Homo sapiens
gaggaagacuggaccuacu

SEQ ID NO: 1234235 - RNA, 19 nt, Homo sapiens
ugaauacagcaucuacuaa

SEQ ID NO: 1234236 - RNA, 19 nt, Homo sapiens
uugacaagcucuucucuuc

SEQ ID NO: 1234237 - RNA, 19 nt, Homo sapiens
gacuggaccuacugauuca

SEQ ID NO: 1234238 - RNA, 19 nt, Homo sapiens
ugauucaacuuggagauga

SEQ ID NO: 1234239 - RNA, 19 nt, Homo sapiens
guuaacgugcuaaaguaua

SEQ ID NO: 1234240 - RNA, 19 nt, Homo sapiens
agguuaacgugcuaaagua

SEQ ID NO: 1234241 - RNA, 19 nt, Homo sapiens
acucaucucuguuuccaau

SEQ ID NO: 1234242 - RNA, 19 nt, Homo sapiens
uacugggccuuacauaauu

SEQ ID NO: 1234243 - RNA, 19 nt, Homo sapiens
gaauauacucaucaucagu

SEQ ID NO: 1234244 - RNA, 19 nt, Homo sapiens
ccuuagaauucugagguua

SEQ ID NO: 1234245 - RNA, 19 nt, Homo sapiens
ucucuucgauucuauacug

SEQ ID NO: 1234246 - RNA, 19 nt, Homo sapiens
acaggacuauccauucaga

SEQ ID NO: 1234247 - RNA, 19 nt, Homo sapiens
ggaagacuggaccuacuga

SEQ ID NO: 1234248 - RNA, 19 nt, Homo sapiens
gagaggaauauacucauca

SEQ ID NO: 1234249 - RNA, 19 nt, Homo sapiens
aaagugaccguuggaguuu

SEQ ID NO: 1234250 - RNA, 19 nt, Homo sapiens
aaccagacauagaaagaga

SEQ ID NO: 1234251 - RNA, 19 nt, Homo sapiens
aaaagaaagucaccggaaa

SEQ ID NO: 1234252 - RNA, 19 nt, Homo sapiens
aaugugcccuuguuuaagu

SEQ ID NO: 1234253 - RNA, 19 nt, Homo sapiens
acaauaagccaagaccaaa

SEQ ID NO: 1234254 - RNA, 19 nt, Homo sapiens
uagcaguguuugacucuca

SEQ ID NO: 1234255 - RNA, 19 nt, Homo sapiens
guucuucccaucagauaaa

SEQ ID NO: 1234256 - RNA, 19 nt, Homo sapiens
cuaaagcagauuucuaugu

SEQ ID NO: 1234257 - RNA, 19 nt, Homo sapiens
gaccguuggaguuuaauga

SEQ ID NO: 1234258 - RNA, 19 nt, Homo sapiens
uuucaaagaugccuaaagc

SEQ ID NO: 1234259 - RNA, 19 nt, Homo sapiens
ccaaagacuggacgggaaa

SEQ ID NO: 1234260 - RNA, 19 nt, Homo sapiens
acucucagccuuagaauuc

SEQ ID NO: 1234261 - RNA, 19 nt, Homo sapiens
agauuucuauguucuggaa

SEQ ID NO: 1234262 - RNA, 19 nt, Homo sapiens
uuuccucgaucauuucaaa

SEQ ID NO: 1234263 - RNA, 19 nt, Homo sapiens
uaucguagagcacagagaa

SEQ ID NO: 1234264 - RNA, 19 nt, Homo sapiens
agacuggaccuacugauuc

SEQ ID NO: 1234265 - RNA, 19 nt, Homo sapiens
caguuucucuucgauucua

SEQ ID NO: 1234266 - RNA, 19 nt, Homo sapiens
ccaauacuguuacauuuuc

SEQ ID NO: 1234267 - RNA, 19 nt, Homo sapiens
agguggagaugcuuucuga

SEQ ID NO: 1234268 - RNA, 19 nt, Homo sapiens
caucuugcauguguugaau

SEQ ID NO: 1234269 - RNA, 19 nt, Homo sapiens
ccaagaccaaaucaauaaa

SEQ ID NO: 1234270 - RNA, 19 nt, Homo sapiens
aaagcagauuucuauguuc

SEQ ID NO: 1234271 - RNA, 19 nt, Homo sapiens
gaguuuaaugagaggaaua

SEQ ID NO: 1234272 - RNA, 19 nt, Homo sapiens
ggaguuuaaugagaggaau

SEQ ID NO: 1234273 - RNA, 19 nt, Homo sapiens
gaccuacugauucaacuug

SEQ ID NO: 1234274 - RNA, 19 nt, Homo sapiens
gcuuccaucuugcaugugu

SEQ ID NO: 1234275 - RNA, 19 nt, Homo sapiens
cacaauaagccaagaccaa

SEQ ID NO: 1234276 - RNA, 19 nt, Homo sapiens
acaaagaguagaagagcuu

SEQ ID NO: 1234277 - RNA, 19 nt, Homo sapiens
aagcagauuucuauguucu

SEQ ID NO: 1234278 - RNA, 19 nt, Homo sapiens
caaaggagcccgaaaaugc

SEQ ID NO: 1234279 - RNA, 19 nt, Homo sapiens
cucaucaucagucuauuua

SEQ ID NO: 1234280 - RNA, 19 nt, Homo sapiens
aggaauauacucaucauca

SEQ ID NO: 1234281 - RNA, 19 nt, Homo sapiens
ccagacauagaaagagaaa

SEQ ID NO: 1234282 - RNA, 19 nt, Homo sapiens
gcuccucaaaccagacaua

SEQ ID NO: 1234283 - RNA, 19 nt, Homo sapiens
gaacugaugauuggugacu

SEQ ID NO: 1234284 - RNA, 19 nt, Homo sapiens
agugaccguuggaguuuaa

SEQ ID NO: 1234285 - RNA, 19 nt, Homo sapiens
gaaugugcccuuguuuaag

SEQ ID NO: 1234286 - RNA, 19 nt, Homo sapiens
gacuauccauucagaacuc

SEQ ID NO: 1234287 - RNA, 19 nt, Homo sapiens
agaaagagaaagacuuaag

SEQ ID NO: 1234288 - RNA, 19 nt, Homo sapiens
cauagaaagagaaagacuu

SEQ ID NO: 1234289 - RNA, 19 nt, Homo sapiens
uugaauacagcaucuacua

SEQ ID NO: 1234290 - RNA, 19 nt, Homo sapiens
caauaagccaagaccaaau

SEQ ID NO: 1234291 - RNA, 19 nt, Homo sapiens
gagaaaacuuugggccauu

SEQ ID NO: 1234292 - RNA, 19 nt, Homo sapiens
agccaagaccaaaucaaua

SEQ ID NO: 1234293 - RNA, 19 nt, Homo sapiens
gccuuagaauucugagguu

SEQ ID NO: 1234294 - RNA, 19 nt, Homo sapiens
gaacaaagaugcauuggaa

SEQ ID NO: 1234295 - RNA, 19 nt, Homo sapiens
gaaacaggcuaacugauua

SEQ ID NO: 1234296 - RNA, 19 nt, Homo sapiens
gguaauggcucaauacaaa

SEQ ID NO: 1234297 - RNA, 19 nt, Homo sapiens
gaucauagcuggucuugug

SEQ ID NO: 1234298 - RNA, 19 nt, Homo sapiens
gauaauagcuaaugcacuu

SEQ ID NO: 1234299 - RNA, 19 nt, Homo sapiens
cagaagugcuuguugaaua

SEQ ID NO: 1234300 - RNA, 19 nt, Homo sapiens
gcucauaucuagugugaaa

SEQ ID NO: 1234301 - RNA, 19 nt, Homo sapiens
guaaggauaugucauguau

SEQ ID NO: 1234302 - RNA, 19 nt, Homo sapiens
gguaaucacuguuaagaga

SEQ ID NO: 1234303 - RNA, 19 nt, Homo sapiens
ggaagcauguuaccaguga

SEQ ID NO: 1234304 - RNA, 19 nt, Homo sapiens
gaaacaaccagauuuaguu

SEQ ID NO: 1234305 - RNA, 19 nt, Homo sapiens
gcucagauauguuaaguuc

SEQ ID NO: 1234306 - RNA, 19 nt, Homo sapiens
gagagaacauuguguagga

SEQ ID NO: 1234307 - RNA, 19 nt, Homo sapiens
ggaagagugggaagaaaua

SEQ ID NO: 1234308 - RNA, 19 nt, Homo sapiens
gaaagaaacaggcuaacug

SEQ ID NO: 1234309 - RNA, 19 nt, Homo sapiens
ggaagcggcucagauaugu

SEQ ID NO: 1234310 - RNA, 19 nt, Homo sapiens
aaguacagcuuuccacaua

SEQ ID NO: 1234311 - RNA, 19 nt, Homo sapiens
ugaaacaucuacauaguca

SEQ ID NO: 1234312 - RNA, 19 nt, Homo sapiens
ggaucagaguuuauucuaa

SEQ ID NO: 1234313 - RNA, 19 nt, Homo sapiens
uauaagagcuguccaugca

SEQ ID NO: 1234314 - RNA, 19 nt, Homo sapiens
guaaaccucuuauccuuag

SEQ ID NO: 1234315 - RNA, 19 nt, Homo sapiens
gaaauauaacugugcauug

SEQ ID NO: 1234316 - RNA, 19 nt, Homo sapiens
agaagugcuuguugaauaa

SEQ ID NO: 1234317 - RNA, 19 nt, Homo sapiens
ccacauacauauauaagag

SEQ ID NO: 1234318 - RNA, 19 nt, Homo sapiens
uaucagugguugaguguuu

SEQ ID NO: 1234319 - RNA, 19 nt, Homo sapiens
gauaguaacagaaaccauu

SEQ ID NO: 1234320 - RNA, 19 nt, Homo sapiens
gcucuuagaagcauacuuu

SEQ ID NO: 1234321 - RNA, 19 nt, Homo sapiens
uaacacugcuuuggugaaa

SEQ ID NO: 1234322 - RNA, 19 nt, Homo sapiens
ucagaaaguucacaaucaa

SEQ ID NO: 1234323 - RNA, 19 nt, Homo sapiens
guugaugugugacuacuuu

SEQ ID NO: 1234324 - RNA, 19 nt, Homo sapiens
caggcuaacugauuauuau

SEQ ID NO: 1234325 - RNA, 19 nt, Homo sapiens
gaacaauuccacugcuuau

SEQ ID NO: 1234326 - RNA, 19 nt, Homo sapiens
ggacacaguugcagagaac

SEQ ID NO: 1234327 - RNA, 19 nt, Homo sapiens
uaagaacaguggagaaagu

SEQ ID NO: 1234328 - RNA, 19 nt, Homo sapiens
uaagagacacccucagaaa

SEQ ID NO: 1234329 - RNA, 19 nt, Homo sapiens
gaacaguggagaaaguuau

SEQ ID NO: 1234330 - RNA, 19 nt, Homo sapiens
gggcuuauucuaauuguuu

SEQ ID NO: 1234331 - RNA, 19 nt, Homo sapiens
gaauggugauaguaacaga

SEQ ID NO: 1234332 - RNA, 19 nt, Homo sapiens
aaagagagaacauugugua

SEQ ID NO: 1234333 - RNA, 19 nt, Homo sapiens
gagacacccucagaaaguu

SEQ ID NO: 1234334 - RNA, 19 nt, Homo sapiens
ggucacaaauauuacuaga

SEQ ID NO: 1234335 - RNA, 19 nt, Homo sapiens
acacugacaccaacagaua

SEQ ID NO: 1234336 - RNA, 19 nt, Homo sapiens
uguguuagccuauguguuu

SEQ ID NO: 1234337 - RNA, 19 nt, Homo sapiens
uaaagucaguucagucuac

SEQ ID NO: 1234338 - RNA, 19 nt, Homo sapiens
gacaugguaaucacuguua

SEQ ID NO: 1234339 - RNA, 19 nt, Homo sapiens
cuucaguucuucaguguuu

SEQ ID NO: 1234340 - RNA, 19 nt, Homo sapiens
guacagcuuuccacauaca

SEQ ID NO: 1234341 - RNA, 19 nt, Homo sapiens
agaaacaggcuaacugauu

SEQ ID NO: 1234342 - RNA, 19 nt, Homo sapiens
ucagacagguuuggaauca

SEQ ID NO: 1234343 - RNA, 19 nt, Homo sapiens
agaguuaccuuuccucauc

SEQ ID NO: 1234344 - RNA, 19 nt, Homo sapiens
acacugcuuuggugaaauu

SEQ ID NO: 1234345 - RNA, 19 nt, Homo sapiens
guuccacaguaacaaauaa

SEQ ID NO: 1234346 - RNA, 19 nt, Homo sapiens
cuagaaaggauaugcaauu

SEQ ID NO: 1234347 - RNA, 19 nt, Homo sapiens
cuucaucguuacauguuua

SEQ ID NO: 1234348 - RNA, 19 nt, Homo sapiens
caauuccacugcuuauuca

SEQ ID NO: 1234349 - RNA, 19 nt, Homo sapiens
uaaaaugcuucggcaauua

SEQ ID NO: 1234350 - RNA, 19 nt, Homo sapiens
gaagagugggaagaaauaa

SEQ ID NO: 1234351 - RNA, 19 nt, Homo sapiens
ucacuggccuuccuguuuc

SEQ ID NO: 1234352 - RNA, 19 nt, Homo sapiens
cagaccagauacaaauauu

SEQ ID NO: 1234353 - RNA, 19 nt, Homo sapiens
acacuuagagcaucccaua

SEQ ID NO: 1234354 - RNA, 19 nt, Homo sapiens
uaugaaccauuacucaaga

SEQ ID NO: 1234355 - RNA, 19 nt, Homo sapiens
ggauugguguauuugaguu

SEQ ID NO: 1234356 - RNA, 19 nt, Homo sapiens
ugucauguauuuacugguu

SEQ ID NO: 1234357 - RNA, 19 nt, Homo sapiens
uagaaagggaagcauguua

SEQ ID NO: 1234358 - RNA, 19 nt, Homo sapiens
aaagaaacaggcuaacuga

SEQ ID NO: 1234359 - RNA, 19 nt, Homo sapiens
ucauuggucuuucuccauu

SEQ ID NO: 1234360 - RNA, 19 nt, Homo sapiens
ggaaaagacaaaagcaaua

SEQ ID NO: 1234361 - RNA, 19 nt, Homo sapiens
agccagaguuccacaguaa

SEQ ID NO: 1234362 - RNA, 19 nt, Homo sapiens
gccaguaggugguaauuuu

SEQ ID NO: 1234363 - RNA, 19 nt, Homo sapiens
gcauuuauaccacacucua

SEQ ID NO: 1234364 - RNA, 19 nt, Homo sapiens
gaagcacaguuucagacau

SEQ ID NO: 1234365 - RNA, 19 nt, Homo sapiens
gaaaccauucagccucuuu

SEQ ID NO: 1234366 - RNA, 19 nt, Homo sapiens
ugaggaugcuuuacaugga

SEQ ID NO: 1234367 - RNA, 19 nt, Homo sapiens
caaccagauuuaguuaguu

SEQ ID NO: 1234368 - RNA, 19 nt, Homo sapiens
gguaauuccagauguagaa

SEQ ID NO: 1234369 - RNA, 19 nt, Homo sapiens
ugugaaacaaccagauuua

SEQ ID NO: 1234370 - RNA, 19 nt, Homo sapiens
uuagaggacuucaugcaau

SEQ ID NO: 1234371 - RNA, 19 nt, Homo sapiens
ggaaaauagcguaacuuua

SEQ ID NO: 1234372 - RNA, 19 nt, Homo sapiens
gggaagcggcucagauaug

SEQ ID NO: 1234373 - RNA, 19 nt, Homo sapiens
gcaaucacagacagagaaa

SEQ ID NO: 1234374 - RNA, 19 nt, Homo sapiens
gaguaaaaggcucaaauua

SEQ ID NO: 1234375 - RNA, 19 nt, Homo sapiens
gaaaguucacaaucaagau

SEQ ID NO: 1234376 - RNA, 19 nt, Homo sapiens
guaaauaccagcuacuaac

SEQ ID NO: 1234377 - RNA, 19 nt, Homo sapiens
uggaaucaguaauggguaa

SEQ ID NO: 1234378 - RNA, 19 nt, Homo sapiens
aagcggcucagauauguua

SEQ ID NO: 1234379 - RNA, 19 nt, Homo sapiens
guucaucuaggcuugauaa

SEQ ID NO: 1234380 - RNA, 19 nt, Homo sapiens
aaagugggauugguguauu

SEQ ID NO: 1234381 - RNA, 19 nt, Homo sapiens
ggauaugucauguauuuac

SEQ ID NO: 1234382 - RNA, 19 nt, Homo sapiens
guucuucaguguuugacaa

SEQ ID NO: 1234383 - RNA, 19 nt, Homo sapiens
acagauacauuccaaacag

SEQ ID NO: 1234384 - RNA, 19 nt, Homo sapiens
caacagauacauuccaaac

SEQ ID NO: 1234385 - RNA, 19 nt, Homo sapiens
uauaagaacaguggagaaa

SEQ ID NO: 1234386 - RNA, 19 nt, Homo sapiens
gaggaucauuggucuuucu

SEQ ID NO: 1234387 - RNA, 19 nt, Homo sapiens
gcaauaaugaaacaucuac

SEQ ID NO: 1234388 - RNA, 19 nt, Homo sapiens
uagcuggucuugugcuuca

SEQ ID NO: 1234389 - RNA, 19 nt, Homo sapiens
guuaagagacacccucaga

SEQ ID NO: 1234390 - RNA, 19 nt, Homo sapiens
ccuggaggcgcuacacuua

SEQ ID NO: 1234391 - RNA, 19 nt, Homo sapiens
gugggaagaaauaaucaua

SEQ ID NO: 1234392 - RNA, 19 nt, Homo sapiens
uguucucgguggaaauuua

SEQ ID NO: 1234393 - RNA, 19 nt, Homo sapiens
cuuuaucaguucucuguaa

SEQ ID NO: 1234394 - RNA, 19 nt, Homo sapiens
gcaaagaacaugaccauua

SEQ ID NO: 1234395 - RNA, 19 nt, Homo sapiens
caaagaacaugaccauuaa

SEQ ID NO: 1234396 - RNA, 19 nt, Homo sapiens
gauaagaaauggugacaaa

SEQ ID NO: 1234397 - RNA, 19 nt, Homo sapiens
ggagugauauuucagaauu

SEQ ID NO: 1234398 - RNA, 19 nt, Homo sapiens
gcacauaugcacccuaaua

SEQ ID NO: 1234399 - RNA, 19 nt, Homo sapiens
gaaggugccugauguugaa

SEQ ID NO: 1234400 - RNA, 19 nt, Homo sapiens
gauaagaacuuucagugau

SEQ ID NO: 1234401 - RNA, 19 nt, Homo sapiens
gaagaaacuuggccaaaca

SEQ ID NO: 1234402 - RNA, 19 nt, Homo sapiens
ccaccaagauaauaugaua

SEQ ID NO: 1234403 - RNA, 19 nt, Homo sapiens
gaaagaagaauuagcagaa

SEQ ID NO: 1234404 - RNA, 19 nt, Homo sapiens
gaagauaaagcauuacuug

SEQ ID NO: 1234405 - RNA, 19 nt, Homo sapiens
caaaguggcuucauauugg

SEQ ID NO: 1234406 - RNA, 19 nt, Homo sapiens
gaucuuuccugcugaauau

SEQ ID NO: 1234407 - RNA, 19 nt, Homo sapiens
aaaccaaaguggcuucaua

SEQ ID NO: 1234408 - RNA, 19 nt, Homo sapiens
ggaaagaagaguugaaaga

SEQ ID NO: 1234409 - RNA, 19 nt, Homo sapiens
cagcaaacguuccaucaaa

SEQ ID NO: 1234410 - RNA, 19 nt, Homo sapiens
ggaugaaacugagaacaaa

SEQ ID NO: 1234411 - RNA, 19 nt, Homo sapiens
gcuagugguuuacaaauau

SEQ ID NO: 1234412 - RNA, 19 nt, Homo sapiens
gaauuuauccuccugaaga

SEQ ID NO: 1234413 - RNA, 19 nt, Homo sapiens
guaaagacccugauuguag

SEQ ID NO: 1234414 - RNA, 19 nt, Homo sapiens
gaagaucgccauugguuau

SEQ ID NO: 1234415 - RNA, 19 nt, Homo sapiens
caacaacccagcuccauaa

SEQ ID NO: 1234416 - RNA, 19 nt, Homo sapiens
gaccaaagccucuguguuc

SEQ ID NO: 1234417 - RNA, 19 nt, Homo sapiens
agaaguacauuccaccuaa

SEQ ID NO: 1234418 - RNA, 19 nt, Homo sapiens
uuucagagcugcaaaauua

SEQ ID NO: 1234419 - RNA, 19 nt, Homo sapiens
gaacaagcauaaugagcau

SEQ ID NO: 1234420 - RNA, 19 nt, Homo sapiens
aauggaagguuacaaguuu

SEQ ID NO: 1234421 - RNA, 19 nt, Homo sapiens
aaagucagaugcagaauca

SEQ ID NO: 1234422 - RNA, 19 nt, Homo sapiens
uaacaagucagaccuuauu

SEQ ID NO: 1234423 - RNA, 19 nt, Homo sapiens
gagacucgcucaaguacga

SEQ ID NO: 1234424 - RNA, 19 nt, Homo sapiens
caugggauuucuuugauaa

SEQ ID NO: 1234425 - RNA, 19 nt, Homo sapiens
aaagaagaguugaaagaga

SEQ ID NO: 1234426 - RNA, 19 nt, Homo sapiens
gaacaccaaccuacaacuu

SEQ ID NO: 1234427 - RNA, 19 nt, Homo sapiens
uaacuuugguauccugaaa

SEQ ID NO: 1234428 - RNA, 19 nt, Homo sapiens
agucagaccuuauuuguuc

SEQ ID NO: 1234429 - RNA, 19 nt, Homo sapiens
uaccaacucucaagugauu

SEQ ID NO: 1234430 - RNA, 19 nt, Homo sapiens
caacaaaugauaucugugu

SEQ ID NO: 1234431 - RNA, 19 nt, Homo sapiens
cagaauuccuucaagcaaa

SEQ ID NO: 1234432 - RNA, 19 nt, Homo sapiens
caaaugguuuacagaauuc

SEQ ID NO: 1234433 - RNA, 19 nt, Homo sapiens
gaacaaaggcagcaaacgu

SEQ ID NO: 1234434 - RNA, 19 nt, Homo sapiens
cagcagcucuucagaaucu

SEQ ID NO: 1234435 - RNA, 19 nt, Homo sapiens
ccuaaugaguccaauuuga

SEQ ID NO: 1234436 - RNA, 19 nt, Homo sapiens
ggaagaucgccauugguua

SEQ ID NO: 1234437 - RNA, 19 nt, Homo sapiens
ggaaggugccugauguuga

SEQ ID NO: 1234438 - RNA, 19 nt, Homo sapiens
ccaaaguggcuucauauug

SEQ ID NO: 1234439 - RNA, 19 nt, Homo sapiens
gagaaaagcaaguuacaua

SEQ ID NO: 1234440 - RNA, 19 nt, Homo sapiens
caaagccucuguguucuau

SEQ ID NO: 1234441 - RNA, 19 nt, Homo sapiens
gaaguacauuccaccuaau

SEQ ID NO: 1234442 - RNA, 19 nt, Homo sapiens
acacacugcuugcuaauca

SEQ ID NO: 1234443 - RNA, 19 nt, Homo sapiens
guccaucucugcucaauca

SEQ ID NO: 1234444 - RNA, 19 nt, Homo sapiens
gaugaaggaagaagauauu

SEQ ID NO: 1234445 - RNA, 19 nt, Homo sapiens
ccaauuugacccaguuaua

SEQ ID NO: 1234446 - RNA, 19 nt, Homo sapiens
agaauuaccuuaucaaagc

SEQ ID NO: 1234447 - RNA, 19 nt, Homo sapiens
uuuguuagcuguugccuuu

SEQ ID NO: 1234448 - RNA, 19 nt, Homo sapiens
gugacaaacuuccaucuca

SEQ ID NO: 1234449 - RNA, 19 nt, Homo sapiens
aaaggaaagucagaaagaa

SEQ ID NO: 1234450 - RNA, 19 nt, Homo sapiens
gauauggccaucugugaaa

SEQ ID NO: 1234451 - RNA, 19 nt, Homo sapiens
caacccagcuccauaagac

SEQ ID NO: 1234452 - RNA, 19 nt, Homo sapiens
gaaguccugggauuugaua

SEQ ID NO: 1234453 - RNA, 19 nt, Homo sapiens
gaaacguaauaaaccaugu

SEQ ID NO: 1234454 - RNA, 19 nt, Homo sapiens
gaaagaagaguugaaagag

SEQ ID NO: 1234455 - RNA, 19 nt, Homo sapiens
agacuuaaccuuucuggaa

SEQ ID NO: 1234456 - RNA, 19 nt, Homo sapiens
gggaagaucgccauugguu

SEQ ID NO: 1234457 - RNA, 19 nt, Homo sapiens
ugacagcaguuaugauagu

SEQ ID NO: 1234458 - RNA, 19 nt, Homo sapiens
guccugggauuugauauuu

SEQ ID NO: 1234459 - RNA, 19 nt, Homo sapiens
gguaaagacccugauugua

SEQ ID NO: 1234460 - RNA, 19 nt, Homo sapiens
acaugcaucugacaaacua

SEQ ID NO: 1234461 - RNA, 19 nt, Homo sapiens
gaauggguacagagaagua

SEQ ID NO: 1234462 - RNA, 19 nt, Homo sapiens
ggucaugggauuucuuuga

SEQ ID NO: 1234463 - RNA, 19 nt, Homo sapiens
gaacugaucagaaaauaga

SEQ ID NO: 1234464 - RNA, 19 nt, Homo sapiens
ggaaugacucgcuccaaug

SEQ ID NO: 1234465 - RNA, 19 nt, Homo sapiens
caaauaugcaacugacaaa

SEQ ID NO: 1234466 - RNA, 19 nt, Homo sapiens
gacagcaguuaugauagua

SEQ ID NO: 1234467 - RNA, 19 nt, Homo sapiens
gcaaacguuccaucaaaug

SEQ ID NO: 1234468 - RNA, 19 nt, Homo sapiens
ucuaacaagucagaccuua

SEQ ID NO: 1234469 - RNA, 19 nt, Homo sapiens
gauaguagcagcagcucuu

SEQ ID NO: 1234470 - RNA, 19 nt, Homo sapiens
ggaagaagauauuuuggau

SEQ ID NO: 1234471 - RNA, 19 nt, Homo sapiens
gaggauuccaccaagauaa

SEQ ID NO: 1234472 - RNA, 19 nt, Homo sapiens
gaaugacucgcuccaaugu

SEQ ID NO: 1234473 - RNA, 19 nt, Homo sapiens
acaccaaccuacaacuuga

SEQ ID NO: 1234474 - RNA, 19 nt, Homo sapiens
caagucagaccuuauuugu

SEQ ID NO: 1234475 - RNA, 19 nt, Homo sapiens
cagcgagaguugaauaauc

SEQ ID NO: 1234476 - RNA, 19 nt, Homo sapiens
ucaugggauuucuuugaua

SEQ ID NO: 1234477 - RNA, 19 nt, Homo sapiens
gcacccuaauaacauauau

SEQ ID NO: 1234478 - RNA, 19 nt, Homo sapiens
gaaagucagaugcagaauc

SEQ ID NO: 1234479 - RNA, 19 nt, Homo sapiens
gaaggaagaagauauuuug

SEQ ID NO: 1234480 - RNA, 19 nt, Homo sapiens
gaaaauuuguuagcuguug

SEQ ID NO: 1234481 - RNA, 19 nt, Homo sapiens
caucaaaugguuuacagaa

SEQ ID NO: 1234482 - RNA, 19 nt, Homo sapiens
gggaugaaacugagaacaa

SEQ ID NO: 1234483 - RNA, 19 nt, Homo sapiens
gagaaguacauuccaccua

SEQ ID NO: 1234484 - RNA, 19 nt, Homo sapiens
gcgaauggguacagagaag

SEQ ID NO: 1234485 - RNA, 19 nt, Homo sapiens
caagggcuguggaacuguu

SEQ ID NO: 1234486 - RNA, 19 nt, Homo sapiens
gcagugacagcaguuauga

SEQ ID NO: 1234487 - RNA, 19 nt, Homo sapiens
ugagaguacugagauaaug

SEQ ID NO: 1234488 - RNA, 19 nt, Homo sapiens
gagaguugaauaauccuuu

SEQ ID NO: 1234489 - RNA, 19 nt, Homo sapiens
cauaaggaccagugacaaa

SEQ ID NO: 1234490 - RNA, 19 nt, Homo sapiens
aagaaauggugacaaacuu

SEQ ID NO: 1234491 - RNA, 19 nt, Homo sapiens
uaggaaggauuucuuagca

SEQ ID NO: 1234492 - RNA, 19 nt, Homo sapiens
gauuauacuggcacaauga

SEQ ID NO: 1234493 - RNA, 19 nt, Homo sapiens
gagaguacugagauaauga

SEQ ID NO: 1234494 - RNA, 19 nt, Homo sapiens
gaaauagccugcagaagua

SEQ ID NO: 1234495 - RNA, 19 nt, Homo sapiens
gaaauuaucucaagacauc

SEQ ID NO: 1234496 - RNA, 19 nt, Homo sapiens
gaaguaagccuauaacaaa

SEQ ID NO: 1234497 - RNA, 19 nt, Homo sapiens
gaauugagcuguucuggaa

SEQ ID NO: 1234498 - RNA, 19 nt, Homo sapiens
gaccauagcuuaagugaau

SEQ ID NO: 1234499 - RNA, 19 nt, Homo sapiens
gaauuuacaugcagcagua

SEQ ID NO: 1234500 - RNA, 19 nt, Homo sapiens
gagaaccacuuaauauuga

SEQ ID NO: 1234501 - RNA, 19 nt, Homo sapiens
agaaacagcucuacuuauu

SEQ ID NO: 1234502 - RNA, 19 nt, Homo sapiens
cagaagaguucccagauuu

SEQ ID NO: 1234503 - RNA, 19 nt, Homo sapiens
gaaacagcucuacuuauua

SEQ ID NO: 1234504 - RNA, 19 nt, Homo sapiens
agaaugagcuuuccuuaga

SEQ ID NO: 1234505 - RNA, 19 nt, Homo sapiens
aagaauagcuuuccauaug

SEQ ID NO: 1234506 - RNA, 19 nt, Homo sapiens
ggagagaaccacuuaauau

SEQ ID NO: 1234507 - RNA, 19 nt, Homo sapiens
caaagaauccuuggaauug

SEQ ID NO: 1234508 - RNA, 19 nt, Homo sapiens
gaagacauucuauccuaua

SEQ ID NO: 1234509 - RNA, 19 nt, Homo sapiens
gaauagcuuuccauaugaa

SEQ ID NO: 1234510 - RNA, 19 nt, Homo sapiens
gcaauugucuuggguguuc

SEQ ID NO: 1234511 - RNA, 19 nt, Homo sapiens
ggauuacacuugcagaaga

SEQ ID NO: 1234512 - RNA, 19 nt, Homo sapiens
gagagaaccacuuaauauu

SEQ ID NO: 1234513 - RNA, 19 nt, Homo sapiens
cagaguccaucaucaagua

SEQ ID NO: 1234514 - RNA, 19 nt, Homo sapiens
ggacuugagagauucuuua

SEQ ID NO: 1234515 - RNA, 19 nt, Homo sapiens
uaagucagauuuccacaga

SEQ ID NO: 1234516 - RNA, 19 nt, Homo sapiens
gaaacagaauuuacaugca

SEQ ID NO: 1234517 - RNA, 19 nt, Homo sapiens
gaagauagucgaacuggau

SEQ ID NO: 1234518 - RNA, 19 nt, Homo sapiens
ugagaaacagcucuacuua

SEQ ID NO: 1234519 - RNA, 19 nt, Homo sapiens
uuucaaggcuacaaacuaa

SEQ ID NO: 1234520 - RNA, 19 nt, Homo sapiens
cagaaaauauugugccuua

SEQ ID NO: 1234521 - RNA, 19 nt, Homo sapiens
gaagaggaauuugaagaag

SEQ ID NO: 1234522 - RNA, 19 nt, Homo sapiens
gaagaauagcuuuccauau

SEQ ID NO: 1234523 - RNA, 19 nt, Homo sapiens
acacacagcucuuuuauug

SEQ ID NO: 1234524 - RNA, 19 nt, Homo sapiens
guucauuacuguuuccauu

SEQ ID NO: 1234525 - RNA, 19 nt, Homo sapiens
ucagaagaguucccagauu

SEQ ID NO: 1234526 - RNA, 19 nt, Homo sapiens
gaaagacucaacuuacuuc

SEQ ID NO: 1234527 - RNA, 19 nt, Homo sapiens
gaguaaagcaaacaacuga

SEQ ID NO: 1234528 - RNA, 19 nt, Homo sapiens
gccaaucacugaauauaag

SEQ ID NO: 1234529 - RNA, 19 nt, Homo sapiens
aaagaugggucagaaauca

SEQ ID NO: 1234530 - RNA, 19 nt, Homo sapiens
agaauagcuuuccauauga

SEQ ID NO: 1234531 - RNA, 19 nt, Homo sapiens
cgaacuggaugauacuuau

SEQ ID NO: 1234532 - RNA, 19 nt, Homo sapiens
gugauuaccuauccaagug

SEQ ID NO: 1234533 - RNA, 19 nt, Homo sapiens
ggucaaagaguacuuaaag

SEQ ID NO: 1234534 - RNA, 19 nt, Homo sapiens
uagagcugcuucugaaauu

SEQ ID NO: 1234535 - RNA, 19 nt, Homo sapiens
agaaauagccugcagaagu

SEQ ID NO: 1234536 - RNA, 19 nt, Homo sapiens
gaaugagcuuuccuuagau

SEQ ID NO: 1234537 - RNA, 19 nt, Homo sapiens
ucaaagaauccuuggaauu

SEQ ID NO: 1234538 - RNA, 19 nt, Homo sapiens
gacauucuauccuauaugg

SEQ ID NO: 1234539 - RNA, 19 nt, Homo sapiens
agacucaacuuacuuccuu

SEQ ID NO: 1234540 - RNA, 19 nt, Homo sapiens
guacaacacacagcucuuu

SEQ ID NO: 1234541 - RNA, 19 nt, Homo sapiens
gaugcacaguguucucaaa

SEQ ID NO: 1234542 - RNA, 19 nt, Homo sapiens
ucaaggcuacaaacuaaua

SEQ ID NO: 1234543 - RNA, 19 nt, Homo sapiens
aaagaauccuuggaauuga

SEQ ID NO: 1234544 - RNA, 19 nt, Homo sapiens
caucaaagaauccuuggaa

SEQ ID NO: 1234545 - RNA, 19 nt, Homo sapiens
gagaaacagcucuacuuau

SEQ ID NO: 1234546 - RNA, 19 nt, Homo sapiens
agagagaccugaaccaucu

SEQ ID NO: 1234547 - RNA, 19 nt, Homo sapiens
ucagauacguucccacauc

SEQ ID NO: 1234548 - RNA, 19 nt, Homo sapiens
caagcaacaugucaucaca

SEQ ID NO: 1234549 - RNA, 19 nt, Homo sapiens
ccacagauuuccuuaagac

SEQ ID NO: 1234550 - RNA, 19 nt, Homo sapiens
ugaauaugcugauaaugca

SEQ ID NO: 1234551 - RNA, 19 nt, Homo sapiens
caagaaauagccugcagaa

SEQ ID NO: 1234552 - RNA, 19 nt, Homo sapiens
acacuaccguggucaaaga

SEQ ID NO: 1234553 - RNA, 19 nt, Homo sapiens
gagcuguucuggaagagau

SEQ ID NO: 1234554 - RNA, 19 nt, Homo sapiens
cuacugaucaacauacuuu

SEQ ID NO: 1234555 - RNA, 19 nt, Homo sapiens
gccaagcuuugaagaauca

SEQ ID NO: 1234556 - RNA, 19 nt, Homo sapiens
uauaagaggccaagcuuug

SEQ ID NO: 1234557 - RNA, 19 nt, Homo sapiens
gcaaacaacugagaaaagu

SEQ ID NO: 1234558 - RNA, 19 nt, Homo sapiens
caacaugucaucacacuac

SEQ ID NO: 1234559 - RNA, 19 nt, Homo sapiens
gaauauaagucagauuucc

SEQ ID NO: 1234560 - RNA, 19 nt, Homo sapiens
ugagcaaucuguauaagag

SEQ ID NO: 1234561 - RNA, 19 nt, Homo sapiens
gcagacagucaacgaaguu

SEQ ID NO: 1234562 - RNA, 19 nt, Homo sapiens
ggaugauacuuaugaagag

SEQ ID NO: 1234563 - RNA, 19 nt, Homo sapiens
guaaagcaaacaacugaga

SEQ ID NO: 1234564 - RNA, 19 nt, Homo sapiens
gaagagauaccaaaauuca

SEQ ID NO: 1234565 - RNA, 19 nt, Homo sapiens
ccagaaugagcuuuccuua

SEQ ID NO: 1234566 - RNA, 19 nt, Homo sapiens
gaccuucaacagcaaauuu

SEQ ID NO: 1234567 - RNA, 19 nt, Homo sapiens
caacuuacuuccuucucau

SEQ ID NO: 1234568 - RNA, 19 nt, Homo sapiens
gaacuuaaagaagacauuc

SEQ ID NO: 1234569 - RNA, 19 nt, Homo sapiens
agagagacuucuuaaaucu

SEQ ID NO: 1234570 - RNA, 19 nt, Homo sapiens
ggaauuugaagaagcagaa

SEQ ID NO: 1234571 - RNA, 19 nt, Homo sapiens
agagaaccacuuaauauug

SEQ ID NO: 1234572 - RNA, 19 nt, Homo sapiens
gucaaagaguacuuaaaga

SEQ ID NO: 1234573 - RNA, 19 nt, Homo sapiens
agucagauuuccacagauu

SEQ ID NO: 1234574 - RNA, 19 nt, Homo sapiens
gaagaguucccagauuuca

SEQ ID NO: 1234575 - RNA, 19 nt, Homo sapiens
agaagaauagcuuuccaua

SEQ ID NO: 1234576 - RNA, 19 nt, Homo sapiens
gcacaguguucucaaaaug

SEQ ID NO: 1234577 - RNA, 19 nt, Homo sapiens
ugaagaggaauuugaagaa

SEQ ID NO: 1234578 - RNA, 19 nt, Homo sapiens
cauccucgaucaagaagug

SEQ ID NO: 1234579 - RNA, 19 nt, Homo sapiens
uuccaacucuguuaaagaa

SEQ ID NO: 1234580 - RNA, 19 nt, Homo sapiens
gcucagaguccaucaucaa

SEQ ID NO: 1234581 - RNA, 19 nt, Homo sapiens
caaaugaaagacucaacuu

SEQ ID NO: 1234582 - RNA, 19 nt, Homo sapiens
aaagucaucacuguuguua

SEQ ID NO: 1234583 - RNA, 19 nt, Homo sapiens
ggaagaaugcgaaguacag

SEQ ID NO: 1234584 - RNA, 19 nt, Homo sapiens
ccacuuuccaacucuguua

SEQ ID NO: 1234585 - RNA, 19 nt, Homo sapiens
gauuccagaccauagcuua

SEQ ID NO: 1234586 - RNA, 19 nt, Homo sapiens
aggagaaacuucaaacaca

SEQ ID NO: 1234587 - RNA, 19 nt, Homo sapiens
cuaccguggucaaagagua

SEQ ID NO: 1234588 - RNA, 19 nt, Homo sapiens
ugauauuacugaccagaau

SEQ ID NO: 1234589 - RNA, 19 nt, Homo sapiens
ucaacuuacuuccuucuca

SEQ ID NO: 1234590 - RNA, 19 nt, Homo sapiens
agaaguaagccuauaacaa

SEQ ID NO: 1234591 - RNA, 19 nt, Homo sapiens
uuugcuagguagagauuua

SEQ ID NO: 1234592 - RNA, 19 nt, Homo sapiens
caaggacacuuugcuaggu

SEQ ID NO: 1234593 - RNA, 19 nt, Homo sapiens
guguaucacuugaaagcaa

SEQ ID NO: 1234594 - RNA, 19 nt, Homo sapiens
gaaaggagcucugugauga

SEQ ID NO: 1234595 - RNA, 19 nt, Homo sapiens
ggaagacgcuuauuaaaug

SEQ ID NO: 1234596 - RNA, 19 nt, Homo sapiens
gaagguaucuuuacuagga

SEQ ID NO: 1234597 - RNA, 19 nt, Homo sapiens
gaaaggaaaucgcaaguau

SEQ ID NO: 1234598 - RNA, 19 nt, Homo sapiens
gcaaagaaguucaagauuc

SEQ ID NO: 1234599 - RNA, 19 nt, Homo sapiens
gaugaacgauugcauagua

SEQ ID NO: 1234600 - RNA, 19 nt, Homo sapiens
ccaagaaacuucaagcuaa

SEQ ID NO: 1234601 - RNA, 19 nt, Homo sapiens
ggacguagcauaccagaua

SEQ ID NO: 1234602 - RNA, 19 nt, Homo sapiens
ggacaaaggacaagugaua

SEQ ID NO: 1234603 - RNA, 19 nt, Homo sapiens
gaagagauauacuaaagga

SEQ ID NO: 1234604 - RNA, 19 nt, Homo sapiens
gaaugugucuuuaccauau

SEQ ID NO: 1234605 - RNA, 19 nt, Homo sapiens
gaagaggucuaaugaagga

SEQ ID NO: 1234606 - RNA, 19 nt, Homo sapiens
caaagaaguucaagauuca

SEQ ID NO: 1234607 - RNA, 19 nt, Homo sapiens
guagaacccuugacaaaug

SEQ ID NO: 1234608 - RNA, 19 nt, Homo sapiens
gugaugagguuccagcuua

SEQ ID NO: 1234609 - RNA, 19 nt, Homo sapiens
gaaauacaguggaucaaca

SEQ ID NO: 1234610 - RNA, 19 nt, Homo sapiens
ggaaaucgcaaguauagaa

SEQ ID NO: 1234611 - RNA, 19 nt, Homo sapiens
gaaauucugagcaagauaa

SEQ ID NO: 1234612 - RNA, 19 nt, Homo sapiens
caagaaacuucaagcuaaa

SEQ ID NO: 1234613 - RNA, 19 nt, Homo sapiens
gaacaaagaacucucaaag

SEQ ID NO: 1234614 - RNA, 19 nt, Homo sapiens
caaguaaauucccaacaaa

SEQ ID NO: 1234615 - RNA, 19 nt, Homo sapiens
gaagacgcuuauuaaauga

SEQ ID NO: 1234616 - RNA, 19 nt, Homo sapiens
ccaaguaaauucccaacaa

SEQ ID NO: 1234617 - RNA, 19 nt, Homo sapiens
aaagaugacugaagaacaa

SEQ ID NO: 1234618 - RNA, 19 nt, Homo sapiens
ugagagagguacaauaaau

SEQ ID NO: 1234619 - RNA, 19 nt, Homo sapiens
gcaauuagagauucaagaa

SEQ ID NO: 1234620 - RNA, 19 nt, Homo sapiens
ugaaagguguuaauggaaa

SEQ ID NO: 1234621 - RNA, 19 nt, Homo sapiens
gagauauacuaaaggauga

SEQ ID NO: 1234622 - RNA, 19 nt, Homo sapiens
gagauaaagacacaacuaa

SEQ ID NO: 1234623 - RNA, 19 nt, Homo sapiens
ccaggagacugauguagaa

SEQ ID NO: 1234624 - RNA, 19 nt, Homo sapiens
cuacacaacugaagaguca

SEQ ID NO: 1234625 - RNA, 19 nt, Homo sapiens
ggaagggaaaggcguaaua

SEQ ID NO: 1234626 - RNA, 19 nt, Homo sapiens
uaagcaacaugacaaauuc

SEQ ID NO: 1234627 - RNA, 19 nt, Homo sapiens
guuguuaccuuaagccaaa

SEQ ID NO: 1234628 - RNA, 19 nt, Homo sapiens
caugacaaauucagaaaug

SEQ ID NO: 1234629 - RNA, 19 nt, Homo sapiens
gaagagguauaauaauagg

SEQ ID NO: 1234630 - RNA, 19 nt, Homo sapiens
gcaaguggguaauagucaa

SEQ ID NO: 1234631 - RNA, 19 nt, Homo sapiens
gggaagacgcuuauuaaau

SEQ ID NO: 1234632 - RNA, 19 nt, Homo sapiens
gcuuaaacaucaagauuca

SEQ ID NO: 1234633 - RNA, 19 nt, Homo sapiens
gaugaagaaucaggugaaa

SEQ ID NO: 1234634 - RNA, 19 nt, Homo sapiens
uaagaaaggagcucuguga

SEQ ID NO: 1234635 - RNA, 19 nt, Homo sapiens
cuucuaagaucaagccuuu

SEQ ID NO: 1234636 - RNA, 19 nt, Homo sapiens
ugaaggaaauucugagcaa

SEQ ID NO: 1234637 - RNA, 19 nt, Homo sapiens
accaaucagugcacaauua

SEQ ID NO: 1234638 - RNA, 19 nt, Homo sapiens
ccgagagacugauaaagaa

SEQ ID NO: 1234639 - RNA, 19 nt, Homo sapiens
ggcaaagaauuauuacuca

SEQ ID NO: 1234640 - RNA, 19 nt, Homo sapiens
aaaccuaccuauaaagugu

SEQ ID NO: 1234641 - RNA, 19 nt, Homo sapiens
caagacguuuccuuuagaa

SEQ ID NO: 1234642 - RNA, 19 nt, Homo sapiens
acacaagacguuuccuuua

SEQ ID NO: 1234643 - RNA, 19 nt, Homo sapiens
caucaagacucaaugucaa

SEQ ID NO: 1234644 - RNA, 19 nt, Homo sapiens
ggaaaggaaaucgcaagua

SEQ ID NO: 1234645 - RNA, 19 nt, Homo sapiens
ggaaagacacaagacguuu

SEQ ID NO: 1234646 - RNA, 19 nt, Homo sapiens
caacaugacaaauucagaa

SEQ ID NO: 1234647 - RNA, 19 nt, Homo sapiens
ggaagagguauaauaauag

SEQ ID NO: 1234648 - RNA, 19 nt, Homo sapiens
agaaagaguuacccugaga

SEQ ID NO: 1234649 - RNA, 19 nt, Homo sapiens
ggccugauauagaacaauu

SEQ ID NO: 1234650 - RNA, 19 nt, Homo sapiens
ucaagaagcgaaucucaaa

SEQ ID NO: 1234651 - RNA, 19 nt, Homo sapiens
gaaaggcguaauacucgua

SEQ ID NO: 1234652 - RNA, 19 nt, Homo sapiens
gcaagugaaggaacaaaga

SEQ ID NO: 1234653 - RNA, 19 nt, Homo sapiens
aaucagaaaugcaagugaa

SEQ ID NO: 1234654 - RNA, 19 nt, Homo sapiens
ugacugaagaacaaacuua

SEQ ID NO: 1234655 - RNA, 19 nt, Homo sapiens
caacaaugcaaguggguaa

SEQ ID NO: 1234656 - RNA, 19 nt, Homo sapiens
uggaagagauauacuaaag

SEQ ID NO: 1234657 - RNA, 19 nt, Homo sapiens
gagaggugcuuugggaaga

SEQ ID NO: 1234658 - RNA, 19 nt, Homo sapiens
cacaagacguuuccuuuag

SEQ ID NO: 1234659 - RNA, 19 nt, Homo sapiens
gaacaucaagauucagugu

SEQ ID NO: 1234660 - RNA, 19 nt, Homo sapiens
ccacucaccacuccugaua

SEQ ID NO: 1234661 - RNA, 19 nt, Homo sapiens
agacauccaccuuccuuua

SEQ ID NO: 1234662 - RNA, 19 nt, Homo sapiens
ugaguacucuucacccuau

SEQ ID NO: 1234663 - RNA, 19 nt, Homo sapiens
agaggaaacuuaugaguac

SEQ ID NO: 1234664 - RNA, 19 nt, Homo sapiens
acaaagauauguccguaca

SEQ ID NO: 1234665 - RNA, 19 nt, Homo sapiens
ggauauaucacuugaacau

SEQ ID NO: 1234666 - RNA, 19 nt, Homo sapiens
agaacaaacuuaccaagca

SEQ ID NO: 1234667 - RNA, 19 nt, Homo sapiens
gguuccagcuuacuucuau

SEQ ID NO: 1234668 - RNA, 19 nt, Homo sapiens
caacuaaggacucacuaug

SEQ ID NO: 1234669 - RNA, 19 nt, Homo sapiens
uggaagaggucuaaugaag

SEQ ID NO: 1234670 - RNA, 19 nt, Homo sapiens
caacauacagucaaagagu

SEQ ID NO: 1234671 - RNA, 19 nt, Homo sapiens
gacacaagacguuuccuuu

SEQ ID NO: 1234672 - RNA, 19 nt, Homo sapiens
ggagcucugugaugagguu

SEQ ID NO: 1234673 - RNA, 19 nt, Homo sapiens
aauaaauucuggaguggaa

SEQ ID NO: 1234674 - RNA, 19 nt, Homo sapiens
gacguagcauaccagauaa

SEQ ID NO: 1234675 - RNA, 19 nt, Homo sapiens
caucaagaaucauugucaa

SEQ ID NO: 1234676 - RNA, 19 nt, Homo sapiens
ggcagugaaugugucuuua

SEQ ID NO: 1234677 - RNA, 19 nt, Homo sapiens
gcuauuggaagagauauaa

SEQ ID NO: 1234678 - RNA, 19 nt, Homo sapiens
acaagacguuuccuuuaga

SEQ ID NO: 1234679 - RNA, 19 nt, Homo sapiens
augaaaggcuuguaguuga

SEQ ID NO: 1234680 - RNA, 19 nt, Homo sapiens
guaaugcuuucugguguga

SEQ ID NO: 1234681 - RNA, 19 nt, Homo sapiens
caauuuaucacccuuugaa

SEQ ID NO: 1234682 - RNA, 19 nt, Homo sapiens
gauaaagacacaacuaagg

SEQ ID NO: 1234683 - RNA, 19 nt, Homo sapiens
ccaaucagugcacaauuaa

SEQ ID NO: 1234684 - RNA, 19 nt, Homo sapiens
acaauugacagaugcauuu

SEQ ID NO: 1234685 - RNA, 19 nt, Homo sapiens
ucaucaagauucaaaguca

SEQ ID NO: 1234686 - RNA, 19 nt, Homo sapiens
ggagaaggacguagcauac

SEQ ID NO: 1234687 - RNA, 19 nt, Homo sapiens
caagugcaauuagagauuc

SEQ ID NO: 1234688 - RNA, 19 nt, Homo sapiens
cgaaaguuguuaccuuaag

SEQ ID NO: 1234689 - RNA, 19 nt, Homo sapiens
uucgaaaguuguuaccuua

SEQ ID NO: 1234690 - RNA, 19 nt, Homo sapiens
gaacuucuuugccuaugcu

SEQ ID NO: 1234691 - RNA, 19 nt, Homo sapiens
cagcaaagaaguucaagau

SEQ ID NO: 1234692 - RNA, 19 nt, Homo sapiens
gaaaguuguuaccuuaagc

SEQ ID NO: 1234693 - RNA, 19 nt, Homo sapiens
gcuauuggaagagguauaa

SEQ ID NO: 1234694 - RNA, 19 nt, Homo sapiens
caacaugccugcuaaauuu

SEQ ID NO: 1234695 - RNA, 19 nt, Homo sapiens
ggacaggucuucccuauga

SEQ ID NO: 1234696 - RNA, 19 nt, Homo sapiens
caacagagguccaggguuu

SEQ ID NO: 1234697 - RNA, 19 nt, Homo sapiens
ccaaagaccugcagcauug

SEQ ID NO: 1234698 - RNA, 19 nt, Homo sapiens
uaaagaggcuucugcauca

SEQ ID NO: 1234699 - RNA, 19 nt, Homo sapiens
gcaaauuacucagaugauu

SEQ ID NO: 1234700 - RNA, 19 nt, Homo sapiens
ggacaucuauuugcaagaa

SEQ ID NO: 1234701 - RNA, 19 nt, Homo sapiens
gaaaucaccugucaagacu

SEQ ID NO: 1234702 - RNA, 19 nt, Homo sapiens
gaaauaagaucugacaacu

SEQ ID NO: 1234703 - RNA, 19 nt, Homo sapiens
gcaguuaucuauuguugug

SEQ ID NO: 1234704 - RNA, 19 nt, Homo sapiens
uagaauuccuuguuccuua

SEQ ID NO: 1234705 - RNA, 19 nt, Homo sapiens
gcacaauauucucugauga

SEQ ID NO: 1234706 - RNA, 19 nt, Homo sapiens
ggcaggagcugaugcugua

SEQ ID NO: 1234707 - RNA, 19 nt, Homo sapiens
acaaaggucucacucugua

SEQ ID NO: 1234708 - RNA, 19 nt, Homo sapiens
gggcaauucugacaacauu

SEQ ID NO: 1234709 - RNA, 19 nt, Homo sapiens
gcagauagaauuccuuguu

SEQ ID NO: 1234710 - RNA, 19 nt, Homo sapiens
ggguguaucugguuugaaa

SEQ ID NO: 1234711 - RNA, 19 nt, Homo sapiens
gaugaacucucuuaucucu

SEQ ID NO: 1234712 - RNA, 19 nt, Homo sapiens
gcaacaugccugcuaaauu

SEQ ID NO: 1234713 - RNA, 19 nt, Homo sapiens
caucaaaccuucacaugca

SEQ ID NO: 1234714 - RNA, 19 nt, Homo sapiens
gcacugagaacuuccagaa

SEQ ID NO: 1234715 - RNA, 19 nt, Homo sapiens
gagaagugauuuagaaacu

SEQ ID NO: 1234716 - RNA, 19 nt, Homo sapiens
gaagaaauaagaucugaca

SEQ ID NO: 1234717 - RNA, 19 nt, Homo sapiens
acagagagguuccagaaau

SEQ ID NO: 1234718 - RNA, 19 nt, Homo sapiens
acugggaggugguaaguua

SEQ ID NO: 1234719 - RNA, 19 nt, Homo sapiens
gcuaaucacaucuaugaaa

SEQ ID NO: 1234720 - RNA, 19 nt, Homo sapiens
gcugauugcuggugauguu

SEQ ID NO: 1234721 - RNA, 19 nt, Homo sapiens
cagcaaauauagcaguuau

SEQ ID NO: 1234722 - RNA, 19 nt, Homo sapiens
uagccaaguugacacauaa

SEQ ID NO: 1234723 - RNA, 19 nt, Homo sapiens
ccaaacagaaguagacaaa

SEQ ID NO: 1234724 - RNA, 19 nt, Homo sapiens
gcagaugggagaagugauu

SEQ ID NO: 1234725 - RNA, 19 nt, Homo sapiens
gaugaaagcaaaucuagau

SEQ ID NO: 1234726 - RNA, 19 nt, Homo sapiens
gccaagcccugccucugua

SEQ ID NO: 1234727 - RNA, 19 nt, Homo sapiens
gcccugagcuguucuuucu

SEQ ID NO: 1234728 - RNA, 19 nt, Homo sapiens
uuacucagaugauuccaaa

SEQ ID NO: 1234729 - RNA, 19 nt, Homo sapiens
gaaaugcaaggaugaggaa

SEQ ID NO: 1234730 - RNA, 19 nt, Homo sapiens
ccgauuccuugcuuucuua

SEQ ID NO: 1234731 - RNA, 19 nt, Homo sapiens
aaacagaaguagacaaagg

SEQ ID NO: 1234732 - RNA, 19 nt, Homo sapiens
gugcuaaucacaucuauga

SEQ ID NO: 1234733 - RNA, 19 nt, Homo sapiens
ugagauaacaccagugaaa

SEQ ID NO: 1234734 - RNA, 19 nt, Homo sapiens
aaacagagagguuccagaa

SEQ ID NO: 1234735 - RNA, 19 nt, Homo sapiens
uuauagagguugcucagaa

SEQ ID NO: 1234736 - RNA, 19 nt, Homo sapiens
ugggagaagugauuuagaa

SEQ ID NO: 1234737 - RNA, 19 nt, Homo sapiens
gauagcaccagacaagaaa

SEQ ID NO: 1234738 - RNA, 19 nt, Homo sapiens
ggacuuuccucggucuuga

SEQ ID NO: 1234739 - RNA, 19 nt, Homo sapiens
uaagggcuuugaaugauug

SEQ ID NO: 1234740 - RNA, 19 nt, Homo sapiens
cagagaaacagaaccagua

SEQ ID NO: 1234741 - RNA, 19 nt, Homo sapiens
cagauagaauuccuuguuc

SEQ ID NO: 1234742 - RNA, 19 nt, Homo sapiens
gagcugaugcuguaguuug

SEQ ID NO: 1234743 - RNA, 19 nt, Homo sapiens
uggaugaacucucuuaucu

SEQ ID NO: 1234744 - RNA, 19 nt, Homo sapiens
cagagagguuccagaaaug

SEQ ID NO: 1234745 - RNA, 19 nt, Homo sapiens
uagcaguuaucuauuguug

SEQ ID NO: 1234746 - RNA, 19 nt, Homo sapiens
gcaaauauagcaguuaucu

SEQ ID NO: 1234747 - RNA, 19 nt, Homo sapiens
ccacccagauuaccuagau

SEQ ID NO: 1234748 - RNA, 19 nt, Homo sapiens
gaucaggcccacccagauu

SEQ ID NO: 1234749 - RNA, 19 nt, Homo sapiens
ggauagcaccagacaagaa

SEQ ID NO: 1234750 - RNA, 19 nt, Homo sapiens
agaauuccuuguuccuuaa

SEQ ID NO: 1234751 - RNA, 19 nt, Homo sapiens
ggagcuagggcaauucuga

SEQ ID NO: 1234752 - RNA, 19 nt, Homo sapiens
gcauggagcccagcacuga

SEQ ID NO: 1234753 - RNA, 19 nt, Homo sapiens
auagagacauugacugguu

SEQ ID NO: 1234754 - RNA, 19 nt, Homo sapiens
guaacaauauagccaagca

SEQ ID NO: 1234755 - RNA, 19 nt, Homo sapiens
uauuggaaaugguugguuu

SEQ ID NO: 1234756 - RNA, 19 nt, Homo sapiens
cuagccaaguugacacaua

SEQ ID NO: 1234757 - RNA, 19 nt, Homo sapiens
guaguuugcagauagaauu

SEQ ID NO: 1234758 - RNA, 19 nt, Homo sapiens
gcccagagcccaagaugga

SEQ ID NO: 1234759 - RNA, 19 nt, Homo sapiens
gcauaccucuuuuacuuuu

SEQ ID NO: 1234760 - RNA, 19 nt, Homo sapiens
caaaggcccacauaacuuc

SEQ ID NO: 1234761 - RNA, 19 nt, Homo sapiens
auaaggagcuagggcaauu

SEQ ID NO: 1234762 - RNA, 19 nt, Homo sapiens
ucagaaccagcuacaauuu

SEQ ID NO: 1234763 - RNA, 19 nt, Homo sapiens
gaauacagccuagccaagu

SEQ ID NO: 1234764 - RNA, 19 nt, Homo sapiens
cacagcaacaccuagauua

SEQ ID NO: 1234765 - RNA, 19 nt, Homo sapiens
gccaaucgcaggucaaaug

SEQ ID NO: 1234766 - RNA, 19 nt, Homo sapiens
ccaaaggcccacauaacuu

SEQ ID NO: 1234767 - RNA, 19 nt, Homo sapiens
caaauuacucagaugauuc

SEQ ID NO: 1234768 - RNA, 19 nt, Homo sapiens
uagaaacuccaaagcaauu

SEQ ID NO: 1234769 - RNA, 19 nt, Homo sapiens
uuuagaaacuccaaagcaa

SEQ ID NO: 1234770 - RNA, 19 nt, Homo sapiens
uaaggauugugguagagaa

SEQ ID NO: 1234771 - RNA, 19 nt, Homo sapiens
uuaagggcuuugaaugauu

SEQ ID NO: 1234772 - RNA, 19 nt, Homo sapiens
gucaugaaaucaccuguca

SEQ ID NO: 1234773 - RNA, 19 nt, Homo sapiens
caaaggccccuaucaagua

SEQ ID NO: 1234774 - RNA, 19 nt, Homo sapiens
cuuccaagaugaaagcaaa

SEQ ID NO: 1234775 - RNA, 19 nt, Homo sapiens
gcugagauaacaccaguga

SEQ ID NO: 1234776 - RNA, 19 nt, Homo sapiens
gcacaugccaaacagaagu

SEQ ID NO: 1234777 - RNA, 19 nt, Homo sapiens
acaccuagauuagcauuca

SEQ ID NO: 1234778 - RNA, 19 nt, Homo sapiens
ccaguaggagauacauaua

SEQ ID NO: 1234779 - RNA, 19 nt, Homo sapiens
agauagaaccugauaagga

SEQ ID NO: 1234780 - RNA, 19 nt, Homo sapiens
gcccagcacugagaacuuc

SEQ ID NO: 1234781 - RNA, 19 nt, Homo sapiens
guaucugguuugaaaugaa

SEQ ID NO: 1234782 - RNA, 19 nt, Homo sapiens
gcaucacccugaaccaaag

SEQ ID NO: 1234783 - RNA, 19 nt, Homo sapiens
ggucuggucugaaggaaaa

SEQ ID NO: 1234784 - RNA, 19 nt, Homo sapiens
aaucaccugucaagacuau

SEQ ID NO: 1234785 - RNA, 19 nt, Homo sapiens
aagcauaccucuuuuacuu

SEQ ID NO: 1234786 - RNA, 19 nt, Homo sapiens
cgagaucucagacaggaaa

SEQ ID NO: 1234787 - RNA, 19 nt, Homo sapiens
uuagacuggucagcaaaua

SEQ ID NO: 1234788 - RNA, 19 nt, Homo sapiens
gagcugccuccaucauaaa

SEQ ID NO: 1234789 - RNA, 19 nt, Homo sapiens
gggagaagugauuuagaaa

SEQ ID NO: 1234790 - RNA, 19 nt, Homo sapiens
gcuguaguuugcagauaga

SEQ ID NO: 1234791 - RNA, 19 nt, Homo sapiens
acugagaacuuccagaaag

SEQ ID NO: 1234792 - RNA, 19 nt, Homo sapiens
gcaauucugacaacauuac

SEQ ID NO: 1234793 - RNA, 19 nt, Homo sapiens
uaugagauagaaccugaua

SEQ ID NO: 1234794 - RNA, 19 nt, Homo sapiens
gaauggagauugcuugaug

SEQ ID NO: 1234795 - RNA, 19 nt, Homo sapiens
ggagagaagucacauagga

SEQ ID NO: 1234796 - RNA, 19 nt, Homo sapiens
gagaauuccugacagauug

SEQ ID NO: 1234797 - RNA, 19 nt, Homo sapiens
ggucagaaauauuuacuug

SEQ ID NO: 1234798 - RNA, 19 nt, Homo sapiens
ugagggagcuggcaauuga

SEQ ID NO: 1234799 - RNA, 19 nt, Homo sapiens
gggaaguuauuuagagaua

SEQ ID NO: 1234800 - RNA, 19 nt, Homo sapiens
ggagaaagaccuuauaagu

SEQ ID NO: 1234801 - RNA, 19 nt, Homo sapiens
gagaaaggccuuacaagug

SEQ ID NO: 1234802 - RNA, 19 nt, Homo sapiens
ggauguggcugucuacuuc

SEQ ID NO: 1234803 - RNA, 19 nt, Homo sapiens
gcaaugugaugcuggagaa

SEQ ID NO: 1234804 - RNA, 19 nt, Homo sapiens
ggaguggucuugguucaaa

SEQ ID NO: 1234805 - RNA, 19 nt, Homo sapiens
gagaauuccagccuuguua

SEQ ID NO: 1234806 - RNA, 19 nt, Homo sapiens
gagaauuccacccuaguua

SEQ ID NO: 1234807 - RNA, 19 nt, Homo sapiens
gagaaagaccuuauaagug

SEQ ID NO: 1234808 - RNA, 19 nt, Homo sapiens
gaugagaauuccugacaga

SEQ ID NO: 1234809 - RNA, 19 nt, Homo sapiens
gaagguaacagauggaaau

SEQ ID NO: 1234810 - RNA, 19 nt, Homo sapiens
agagauauguccaaccuuu

SEQ ID NO: 1234811 - RNA, 19 nt, Homo sapiens
cauaggagcuccaaaagua

SEQ ID NO: 1234812 - RNA, 19 nt, Homo sapiens
gaaugugggagauuguuua

SEQ ID NO: 1234813 - RNA, 19 nt, Homo sapiens
ggucuugguucaaauguga

SEQ ID NO: 1234814 - RNA, 19 nt, Homo sapiens
ccaaaggccuaacccuauu

SEQ ID NO: 1234815 - RNA, 19 nt, Homo sapiens
gaaugugggaaguuauuua

SEQ ID NO: 1234816 - RNA, 19 nt, Homo sapiens
uaacccagcuggagucaug

SEQ ID NO: 1234817 - RNA, 19 nt, Homo sapiens
ucagagaaguccuugcaaa

SEQ ID NO: 1234818 - RNA, 19 nt, Homo sapiens
gaaaggaguggucuugguu

SEQ ID NO: 1234819 - RNA, 19 nt, Homo sapiens
gagacuacaugcugggaaa

SEQ ID NO: 1234820 - RNA, 19 nt, Homo sapiens
caauaugaccucacuuaaa

SEQ ID NO: 1234821 - RNA, 19 nt, Homo sapiens
gcucaacccucaugcaaca

SEQ ID NO: 1234822 - RNA, 19 nt, Homo sapiens
gcucaagccucaugcaaca

SEQ ID NO: 1234823 - RNA, 19 nt, Homo sapiens
ggagaaaggccuuacaagu

SEQ ID NO: 1234824 - RNA, 19 nt, Homo sapiens
gagaaguccuugcaaagca

SEQ ID NO: 1234825 - RNA, 19 nt, Homo sapiens
ggaaaggaguggucuuggu

SEQ ID NO: 1234826 - RNA, 19 nt, Homo sapiens
guucaaacauucagcaaca

SEQ ID NO: 1234827 - RNA, 19 nt, Homo sapiens
cgccacaacuccagucuuu

SEQ ID NO: 1234828 - RNA, 19 nt, Homo sapiens
gcagcacuguggagagaaa

SEQ ID NO: 1234829 - RNA, 19 nt, Homo sapiens
cagggaaugugggaaauuu

SEQ ID NO: 1234830 - RNA, 19 nt, Homo sapiens
gggagauucuuuagagaga

SEQ ID NO: 1234831 - RNA, 19 nt, Homo sapiens
ggugacagguuauguacug

SEQ ID NO: 1234832 - RNA, 19 nt, Homo sapiens
gcaaaguucaccuaucaga

SEQ ID NO: 1234833 - RNA, 19 nt, Homo sapiens
gauucacacuggagaaaug

SEQ ID NO: 1234834 - RNA, 19 nt, Homo sapiens
ggagggcuaugugaccuuu

SEQ ID NO: 1234835 - RNA, 19 nt, Homo sapiens
ccagaaaguuuagaaugga

SEQ ID NO: 1234836 - RNA, 19 nt, Homo sapiens
ggagauuguuuagagagaa

SEQ ID NO: 1234837 - RNA, 19 nt, Homo sapiens
ggagaaaugcagugauugu

SEQ ID NO: 1234838 - RNA, 19 nt, Homo sapiens
cagcgacugugggaaauuu

SEQ ID NO: 1234839 - RNA, 19 nt, Homo sapiens
cagugaaugugggaaguua

SEQ ID NO: 1234840 - RNA, 19 nt, Homo sapiens
cuggagaacuuuacacuuc

SEQ ID NO: 1234841 - RNA, 19 nt, Homo sapiens
gcucagguguucucaagca

SEQ ID NO: 1234842 - RNA, 19 nt, Homo sapiens
gccuuagggugacagguua

SEQ ID NO: 1234843 - RNA, 19 nt, Homo sapiens
ggaaggcccuccugaucag

SEQ ID NO: 1234844 - RNA, 19 nt, Homo sapiens
uugcaaaguucaccuauca

SEQ ID NO: 1234845 - RNA, 19 nt, Homo sapiens
gaaucaauaugaccucacu

SEQ ID NO: 1234846 - RNA, 19 nt, Homo sapiens
uacugucucugaaucaaua

SEQ ID NO: 1234847 - RNA, 19 nt, Homo sapiens
gaaaauccuuuagccguaa

SEQ ID NO: 1234848 - RNA, 19 nt, Homo sapiens
cagggaaugugggaaguuu

SEQ ID NO: 1234849 - RNA, 19 nt, Homo sapiens
gagauuguuuagagagaau

SEQ ID NO: 1234850 - RNA, 19 nt, Homo sapiens
gaaaggccuuacgggugua

SEQ ID NO: 1234851 - RNA, 19 nt, Homo sapiens
gccaaaggccuaacccuau

SEQ ID NO: 1234852 - RNA, 19 nt, Homo sapiens
cuggagaaaugcagugauu

SEQ ID NO: 1234853 - RNA, 19 nt, Homo sapiens
gaauuccacccuaguuaga

SEQ ID NO: 1234854 - RNA, 19 nt, Homo sapiens
gggagauuguuuagagaga

SEQ ID NO: 1234855 - RNA, 19 nt, Homo sapiens
gaauuccagccuuguuaaa

SEQ ID NO: 1234856 - RNA, 19 nt, Homo sapiens
aggcauaauuccacacuug

SEQ ID NO: 1234857 - RNA, 19 nt, Homo sapiens
ucaauaugaccucacuuaa

SEQ ID NO: 1234858 - RNA, 19 nt, Homo sapiens
gggaaggcccuccugauca

SEQ ID NO: 1234859 - RNA, 19 nt, Homo sapiens
gaggaaaggaguggucuug

SEQ ID NO: 1234860 - RNA, 19 nt, Homo sapiens
caacuccagccucaugaaa

SEQ ID NO: 1234861 - RNA, 19 nt, Homo sapiens
cagcucagguguucucaag

SEQ ID NO: 1234862 - RNA, 19 nt, Homo sapiens
aaaguucaccuaucagaga

SEQ ID NO: 1234863 - RNA, 19 nt, Homo sapiens
ugagaauuccugacagauu

SEQ ID NO: 1234864 - RNA, 19 nt, Homo sapiens
ggaggcaagaugagaauuc

SEQ ID NO: 1234865 - RNA, 19 nt, Homo sapiens
guuauguacugucucugaa

SEQ ID NO: 1234866 - RNA, 19 nt, Homo sapiens
agccacaaguccaaccuua

SEQ ID NO: 1234867 - RNA, 19 nt, Homo sapiens
ccacacuuguucagcauca

SEQ ID NO: 1234868 - RNA, 19 nt, Homo sapiens
gugggaaguuauuuagaga

SEQ ID NO: 1234869 - RNA, 19 nt, Homo sapiens
gaaaguuuagaauggagaa

SEQ ID NO: 1234870 - RNA, 19 nt, Homo sapiens
gcaaugaaugugggagauu

SEQ ID NO: 1234871 - RNA, 19 nt, Homo sapiens
gcaaugaaugugggagauu

SEQ ID NO: 1234872 - RNA, 19 nt, Homo sapiens
aguccaaccuuaucaaaca

SEQ ID NO: 1234873 - RNA, 19 nt, Homo sapiens
caaguccaaccuuaucaaa

SEQ ID NO: 1234874 - RNA, 19 nt, Homo sapiens
ccuuauaagugcagugaau

SEQ ID NO: 1234875 - RNA, 19 nt, Homo sapiens
gcuguucuugugaauguua

SEQ ID NO: 1234876 - RNA, 19 nt, Homo sapiens
cagauuguccuuccugaga

SEQ ID NO: 1234877 - RNA, 19 nt, Homo sapiens
uggacaauguagugaauau

SEQ ID NO: 1234878 - RNA, 19 nt, Homo sapiens
ccacaccuccagucucauu

SEQ ID NO: 1234879 - RNA, 19 nt, Homo sapiens
uuacaaaugcagugaaugu

SEQ ID NO: 1234880 - RNA, 19 nt, Homo sapiens
uuccaagacccaugaaaua

SEQ ID NO: 1234881 - RNA, 19 nt, Homo sapiens
aaacaucgaaggauucaca

SEQ ID NO: 1234882 - RNA, 19 nt, Homo sapiens
ccacaaguccaaccuuauc

SEQ ID NO: 1234883 - RNA, 19 nt, Homo sapiens
ggccuaacccuauucaaca

SEQ ID NO: 1234884 - RNA, 19 nt, Homo sapiens
ccaaccuuaucaaacauug

SEQ ID NO: 1234885 - RNA, 19 nt, Homo sapiens
cugcagacuugcuuacaga

SEQ ID NO: 1234886 - RNA, 19 nt, Homo sapiens
gcauaauuccacacuuguu

SEQ ID NO: 1234887 - RNA, 19 nt, Homo sapiens
aagcagcacuguggagaga

SEQ ID NO: 1234888 - RNA, 19 nt, Homo sapiens
gguuauguacugucucuga

SEQ ID NO: 1234889 - RNA, 19 nt, Homo sapiens
gaaaggccuuagggugaca

SEQ ID NO: 1234890 - RNA, 19 nt, Homo sapiens
gacaauguagugaauaugg

SEQ ID NO: 1234891 - RNA, 19 nt, Homo sapiens
ugugggagauuguuuagag

SEQ ID NO: 1234892 - RNA, 19 nt, Homo sapiens
gcagggaaugugggaaauu

SEQ ID NO: 1234893 - RNA, 19 nt, Homo sapiens
ugugggagauucuuuagag

SEQ ID NO: 1234894 - RNA, 19 nt, Homo sapiens
ggacaaacaugaaugcuuu

SEQ ID NO: 1234895 - RNA, 19 nt, Homo sapiens
ggucagaacuguuaauaaa

SEQ ID NO: 1234896 - RNA, 19 nt, Homo sapiens
ggaaacagcuguaaaauuu

SEQ ID NO: 1234897 - RNA, 19 nt, Homo sapiens
gaaaugagauucuuaagag

SEQ ID NO: 1234898 - RNA, 19 nt, Homo sapiens
gcagugggcuggcauugaa

SEQ ID NO: 1234899 - RNA, 19 nt, Homo sapiens
agagauggauugacagaua

SEQ ID NO: 1234900 - RNA, 19 nt, Homo sapiens
acagaagguugguacauua

SEQ ID NO: 1234901 - RNA, 19 nt, Homo sapiens
caacaucuacagcaaauaa

SEQ ID NO: 1234902 - RNA, 19 nt, Homo sapiens
uaagagagguugcaaugug

SEQ ID NO: 1234903 - RNA, 19 nt, Homo sapiens
gaagguugguacauuaaga

SEQ ID NO: 1234904 - RNA, 19 nt, Homo sapiens
gagauuaacagaagaaaug

SEQ ID NO: 1234905 - RNA, 19 nt, Homo sapiens
ggaacagcuuugcauauug

SEQ ID NO: 1234906 - RNA, 19 nt, Homo sapiens
caagaaugaugguucaguu

SEQ ID NO: 1234907 - RNA, 19 nt, Homo sapiens
gcaaucagcaguaacaaga

SEQ ID NO: 1234908 - RNA, 19 nt, Homo sapiens
ggaaaugagauucuuaaga

SEQ ID NO: 1234909 - RNA, 19 nt, Homo sapiens
caaauaaacagaaccauuc

SEQ ID NO: 1234910 - RNA, 19 nt, Homo sapiens
gacagaagguugguacauu

SEQ ID NO: 1234911 - RNA, 19 nt, Homo sapiens
gaacagcuuugcauauugc

SEQ ID NO: 1234912 - RNA, 19 nt, Homo sapiens
ugaugucccugaacuuaua

SEQ ID NO: 1234913 - RNA, 19 nt, Homo sapiens
gaaggaagaauauaacaca

SEQ ID NO: 1234914 - RNA, 19 nt, Homo sapiens
caaaggccaugcucccaaa

SEQ ID NO: 1234915 - RNA, 19 nt, Homo sapiens
ggacagaucccugcugaug

SEQ ID NO: 1234916 - RNA, 19 nt, Homo sapiens
gagauggauugacagauau

SEQ ID NO: 1234917 - RNA, 19 nt, Homo sapiens
gaaaaggugugauaagugu

SEQ ID NO: 1234918 - RNA, 19 nt, Homo sapiens
gaaagauguugcccugcuu

SEQ ID NO: 1234919 - RNA, 19 nt, Homo sapiens
ggucgaaggaagaauauaa

SEQ ID NO: 1234920 - RNA, 19 nt, Homo sapiens
uggaacagcuuugcauauu

SEQ ID NO: 1234921 - RNA, 19 nt, Homo sapiens
ugauagagauggauugaca

SEQ ID NO: 1234922 - RNA, 19 nt, Homo sapiens
guaacagauucccuggaua

SEQ ID NO: 1234923 - RNA, 19 nt, Homo sapiens
gaaugaugguucaguugga

SEQ ID NO: 1234924 - RNA, 19 nt, Homo sapiens
guagauaugccguuagaga

SEQ ID NO: 1234925 - RNA, 19 nt, Homo sapiens
gugcaaagaguaacagauu

SEQ ID NO: 1234926 - RNA, 19 nt, Homo sapiens
aggccaugcucccaaauua

SEQ ID NO: 1234927 - RNA, 19 nt, Homo sapiens
acagaucccugcugauguu

SEQ ID NO: 1234928 - RNA, 19 nt, Homo sapiens
ugacagauaugacucuuuu

SEQ ID NO: 1234929 - RNA, 19 nt, Homo sapiens
ugugauaaguguauugaga

SEQ ID NO: 1234930 - RNA, 19 nt, Homo sapiens
gaacaugaugggauucugu

SEQ ID NO: 1234931 - RNA, 19 nt, Homo sapiens
gcacaacuucugcuucuuc

SEQ ID NO: 1234932 - RNA, 19 nt, Homo sapiens
cuaaggaaaucaagcagau

SEQ ID NO: 1234933 - RNA, 19 nt, Homo sapiens
cggagucgcuggacaaaca

SEQ ID NO: 1234934 - RNA, 19 nt, Homo sapiens
gaggucagaacuguuaaua

SEQ ID NO: 1234935 - RNA, 19 nt, Homo sapiens
agaaugcaaucagcaguaa

SEQ ID NO: 1234936 - RNA, 19 nt, Homo sapiens
uagcucaugugacgucaaa

SEQ ID NO: 1234937 - RNA, 19 nt, Homo sapiens
caguagauaugccguuaga

SEQ ID NO: 1234938 - RNA, 19 nt, Homo sapiens
cauuauaccugcaaaucug

SEQ ID NO: 1234939 - RNA, 19 nt, Homo sapiens
caagugaguauuaagaaga

SEQ ID NO: 1234940 - RNA, 19 nt, Homo sapiens
gaucccugcugauguuguu

SEQ ID NO: 1234941 - RNA, 19 nt, Homo sapiens
uagcuguucuccaagauau

SEQ ID NO: 1234942 - RNA, 19 nt, Homo sapiens
gcaaugugaaugauagaga

SEQ ID NO: 1234943 - RNA, 19 nt, Homo sapiens
gguaugguauagagcuuga

SEQ ID NO: 1234944 - RNA, 19 nt, Homo sapiens
gcaguaacaagaagacaau

SEQ ID NO: 1234945 - RNA, 19 nt, Homo sapiens
gugaagaacuuaaaacugu

SEQ ID NO: 1234946 - RNA, 19 nt, Homo sapiens
aaaggucgaaggaagaaua

SEQ ID NO: 1234947 - RNA, 19 nt, Homo sapiens
gagaaaaggugugauaagu

SEQ ID NO: 1234948 - RNA, 19 nt, Homo sapiens
auagaggucagaacuguua

SEQ ID NO: 1234949 - RNA, 19 nt, Homo sapiens
caaugugaaugauagagau

SEQ ID NO: 1234950 - RNA, 19 nt, Homo sapiens
ccaagaaacagaaugcaau

SEQ ID NO: 1234951 - RNA, 19 nt, Homo sapiens
ucauagaggucagaacugu

SEQ ID NO: 1234952 - RNA, 19 nt, Homo sapiens
aagagagguugcaauguga

SEQ ID NO: 1234953 - RNA, 19 nt, Homo sapiens
ggauauugguaugguauag

SEQ ID NO: 1234954 - RNA, 19 nt, Homo sapiens
agauagugcuucugaguca

SEQ ID NO: 1234955 - RNA, 19 nt, Homo sapiens
ccaagugaguauuaagaag

SEQ ID NO: 1234956 - RNA, 19 nt, Homo sapiens
uuggaggugugcaguauuu

SEQ ID NO: 1234957 - RNA, 19 nt, Homo sapiens
gagguugcaaugugaauga

SEQ ID NO: 1234958 - RNA, 19 nt, Homo sapiens
agaugaacaugaugggauu

SEQ ID NO: 1234959 - RNA, 19 nt, Homo sapiens
ccucggagagagaguguua

SEQ ID NO: 1234960 - RNA, 19 nt, Homo sapiens
gcuucugagucaacacuuu

SEQ ID NO: 1234961 - RNA, 19 nt, Homo sapiens
uggaacaacugaauuugca

SEQ ID NO: 1234962 - RNA, 19 nt, Homo sapiens
gcaaugcuuacgucacuug

SEQ ID NO: 1234963 - RNA, 19 nt, Homo sapiens
cccaguagauaugccguua

SEQ ID NO: 1234964 - RNA, 19 nt, Homo sapiens
aaaguggagugcuguaucu

SEQ ID NO: 1234965 - RNA, 19 nt, Homo sapiens
uaacagauucccuggauac

SEQ ID NO: 1234966 - RNA, 19 nt, Homo sapiens
guucuaggauauugguaug

SEQ ID NO: 1234967 - RNA, 19 nt, Homo sapiens
cagagacugggcaccauua

SEQ ID NO: 1234968 - RNA, 19 nt, Homo sapiens
agagagaguguuaguggua

SEQ ID NO: 1234969 - RNA, 19 nt, Homo sapiens
cagaaugcaaucagcagua

SEQ ID NO: 1234970 - RNA, 19 nt, Homo sapiens
gaccugggagcagacauua

SEQ ID NO: 1234971 - RNA, 19 nt, Homo sapiens
aaaaggagauuaacagaag

SEQ ID NO: 1234972 - RNA, 19 nt, Homo sapiens
agacagagcuaccccaaga

SEQ ID NO: 1234973 - RNA, 19 nt, Homo sapiens
uaacacacacuccuucuac

SEQ ID NO: 1234974 - RNA, 19 nt, Homo sapiens
ucagcaacaucuacagcaa

SEQ ID NO: 1234975 - RNA, 19 nt, Homo sapiens
caugugacgucaaaaguaa

SEQ ID NO: 1234976 - RNA, 19 nt, Homo sapiens
guccaguacuuuaaaugug

SEQ ID NO: 1234977 - RNA, 19 nt, Homo sapiens
ucccugaacuuauaagagu

SEQ ID NO: 1234978 - RNA, 19 nt, Homo sapiens
guugcaaugugaaugauag

SEQ ID NO: 1234979 - RNA, 19 nt, Homo sapiens
ugagucaacacuuucauug

SEQ ID NO: 1234980 - RNA, 19 nt, Homo sapiens
cagaagguugguacauuaa

SEQ ID NO: 1234981 - RNA, 19 nt, Homo sapiens
ggacagaagguugguacau

SEQ ID NO: 1234982 - RNA, 19 nt, Homo sapiens
caagaaacagaaugcaauc

SEQ ID NO: 1234983 - RNA, 19 nt, Homo sapiens
aaauugacguagcucaugu

SEQ ID NO: 1234984 - RNA, 19 nt, Homo sapiens
gugauaaguguauugagaa

SEQ ID NO: 1234985 - RNA, 19 nt, Homo sapiens
ggagauuaacagaagaaau

SEQ ID NO: 1234986 - RNA, 19 nt, Homo sapiens
aguaacagauucccuggau

SEQ ID NO: 1234987 - RNA, 19 nt, Homo sapiens
uaauggaaguguuggaaaa

SEQ ID NO: 1234988 - RNA, 19 nt, Homo sapiens
gaaugauagagauggauug

SEQ ID NO: 1234989 - RNA, 19 nt, Homo sapiens
aaaggagauuaacagaaga

SEQ ID NO: 1234990 - RNA, 19 nt, Homo sapiens
uggcaagaaugaugguuca

SEQ ID NO: 1234991 - RNA, 19 nt, Homo sapiens
gccaugcucccaaauuaug

SEQ ID NO: 1234992 - RNA, 19 nt, Homo sapiens
gaaaacgucgaaaccaaaa

SEQ ID NO: 1234993 - RNA, 19 nt, Homo sapiens
gcauugcuugguagaguuu

SEQ ID NO: 1234994 - RNA, 19 nt, Homo sapiens
ugaaaucucuccaaaguga

SEQ ID NO: 1234995 - RNA, 19 nt, Homo sapiens
gcugaaaucucuccaaagu

SEQ ID NO: 1234996 - RNA, 19 nt, Homo sapiens
caagagcagugccuagaaa

SEQ ID NO: 1234997 - RNA, 19 nt, Homo sapiens
aaagugacauucuucauga

SEQ ID NO: 1234998 - RNA, 19 nt, Homo sapiens
gcauuuggccuacauuaaa

SEQ ID NO: 1234999 - RNA, 19 nt, Homo sapiens
gcaacgaucugaaagucau

SEQ ID NO: 1235000 - RNA, 19 nt, Homo sapiens
gcaaagccaccuucuacaa

SEQ ID NO: 1235001 - RNA, 19 nt, Homo sapiens
gaucugaaagucauuauca

SEQ ID NO: 1235002 - RNA, 19 nt, Homo sapiens
caggagaggcgacacauuu

SEQ ID NO: 1235003 - RNA, 19 nt, Homo sapiens
caaagugacauucuucaug

SEQ ID NO: 1235004 - RNA, 19 nt, Homo sapiens
gaacgucgggcucuucugu

SEQ ID NO: 1235005 - RNA, 19 nt, Homo sapiens
ugauuaccaugccgaagua

SEQ ID NO: 1235006 - RNA, 19 nt, Homo sapiens
gcaaggccgugauuaccau

SEQ ID NO: 1235007 - RNA, 19 nt, Homo sapiens
gcaagagcagugccuagaa

SEQ ID NO: 1235008 - RNA, 19 nt, Homo sapiens
ugacagcaacgaucugaaa

SEQ ID NO: 1235009 - RNA, 19 nt, Homo sapiens
ccaagaagaggaacacguu

SEQ ID NO: 1235010 - RNA, 19 nt, Homo sapiens
gaacaucgucuugagcaau

SEQ ID NO: 1235011 - RNA, 19 nt, Homo sapiens
gggcaaagccaccuucuac

SEQ ID NO: 1235012 - RNA, 19 nt, Homo sapiens
uaaggaacaucgucuugag

SEQ ID NO: 1235013 - RNA, 19 nt, Homo sapiens
cuauagagacuuaaucaug

SEQ ID NO: 1235014 - RNA, 19 nt, Homo sapiens
gccugacccuuaucugaaa

SEQ ID NO: 1235015 - RNA, 19 nt, Homo sapiens
gacgccagccugacccuua

SEQ ID NO: 1235016 - RNA, 19 nt, Homo sapiens
ggaacaucgucuugagcaa

SEQ ID NO: 1235017 - RNA, 19 nt, Homo sapiens
gagacuuaaucaugccuau

SEQ ID NO: 1235018 - RNA, 19 nt, Homo sapiens
uuaccaugccgaaguauuu

SEQ ID NO: 1235019 - RNA, 19 nt, Homo sapiens
cagcaacgaucugaaaguc

SEQ ID NO: 1235020 - RNA, 19 nt, Homo sapiens
gccuauggcuuugaauaau

SEQ ID NO: 1235021 - RNA, 19 nt, Homo sapiens
aggaacacguugucacuug

SEQ ID NO: 1235022 - RNA, 19 nt, Homo sapiens
caagugggcccaugugucu

SEQ ID NO: 1235023 - RNA, 19 nt, Homo sapiens
ggagaggcgacacauuuca

SEQ ID NO: 1235024 - RNA, 19 nt, Homo sapiens
uagcauuuggccuacauua

SEQ ID NO: 1235025 - RNA, 19 nt, Homo sapiens
caaagccaccuucuacaag

SEQ ID NO: 1235026 - RNA, 19 nt, Homo sapiens
guuccaaggucaugaugca

SEQ ID NO: 1235027 - RNA, 19 nt, Homo sapiens
ggagcaaggccgugauuac

SEQ ID NO: 1235028 - RNA, 19 nt, Homo sapiens
cauaaggaacaucgucuug

SEQ ID NO: 1235029 - RNA, 19 nt, Homo sapiens
gaagaggaacacguuguca

SEQ ID NO: 1235030 - RNA, 19 nt, Homo sapiens
cugcuuucgugacuugaua

SEQ ID NO: 1235031 - RNA, 19 nt, Homo sapiens
ucacggccuuccuccagaa

SEQ ID NO: 1235032 - RNA, 19 nt, Homo sapiens
gucgggcucuucuguucua

SEQ ID NO: 1235033 - RNA, 19 nt, Homo sapiens
ccuauggcuuugaauaauc

SEQ ID NO: 1235034 - RNA, 19 nt, Homo sapiens
gagaggcgacacauuucaa

SEQ ID NO: 1235035 - RNA, 19 nt, Homo sapiens
gcaaucccaagaagaggaa

SEQ ID NO: 1235036 - RNA, 19 nt, Homo sapiens
gaaacguccuaagcagagu

SEQ ID NO: 1235037 - RNA, 19 nt, Homo sapiens
ugauauuggugucauagca

SEQ ID NO: 1235038 - RNA, 19 nt, Homo sapiens
gaggagcaaggccgugauu

SEQ ID NO: 1235039 - RNA, 19 nt, Homo sapiens
cagccugacccuuaucuga

SEQ ID NO: 1235040 - RNA, 19 nt, Homo sapiens
ugaaagucauuaucaucuc

SEQ ID NO: 1235041 - RNA, 19 nt, Homo sapiens
caaaauggagggugacuga

SEQ ID NO: 1235042 - RNA, 19 nt, Homo sapiens
ccacugccucucagcuuaa

SEQ ID NO: 1235043 - RNA, 19 nt, Homo sapiens
ccaugcggaucgcuaggaa

SEQ ID NO: 1235044 - RNA, 19 nt, Homo sapiens
aaucaugccuauggcuuug

SEQ ID NO: 1235045 - RNA, 19 nt, Homo sapiens
uaaucaugccuauggcuuu

SEQ ID NO: 1235046 - RNA, 19 nt, Homo sapiens
gcauaaggaacaucgucuu

SEQ ID NO: 1235047 - RNA, 19 nt, Homo sapiens
augcugaaaucucuccaaa

SEQ ID NO: 1235048 - RNA, 19 nt, Homo sapiens
gugggaagccuggcauuug

SEQ ID NO: 1235049 - RNA, 19 nt, Homo sapiens
accacugccucucagcuua

SEQ ID NO: 1235050 - RNA, 19 nt, Homo sapiens
gagcagugccuagaaaggu

SEQ ID NO: 1235051 - RNA, 19 nt, Homo sapiens
guugccagcugcgacauug

SEQ ID NO: 1235052 - RNA, 19 nt, Homo sapiens
uugcaaugcugaaaucucu

SEQ ID NO: 1235053 - RNA, 19 nt, Homo sapiens
cgagcgacaaguccucuuu

SEQ ID NO: 1235054 - RNA, 19 nt, Homo sapiens
ggugggaagccuggcauuu

SEQ ID NO: 1235055 - RNA, 19 nt, Homo sapiens
cauagcauuuggccuacau

SEQ ID NO: 1235056 - RNA, 19 nt, Homo sapiens
ucuccaaagugacauucuu

SEQ ID NO: 1235057 - RNA, 19 nt, Homo sapiens
cuucuugauucuauagaga

SEQ ID NO: 1235058 - RNA, 19 nt, Homo sapiens
ggugguaucccugggcaaa

SEQ ID NO: 1235059 - RNA, 19 nt, Homo sapiens
ccuuggagaugcucuuuac

SEQ ID NO: 1235060 - RNA, 19 nt, Homo sapiens
cuucugggcaugacuuaaa

SEQ ID NO: 1235061 - RNA, 19 nt, Homo sapiens
uuucgugacuugauauugg

SEQ ID NO: 1235062 - RNA, 19 nt, Homo sapiens
ccaaggucaugaugcacau

SEQ ID NO: 1235063 - RNA, 19 nt, Homo sapiens
gacuuaaucaugccuaugg

SEQ ID NO: 1235064 - RNA, 19 nt, Homo sapiens
ugggaagccuggcauuugg

SEQ ID NO: 1235065 - RNA, 19 nt, Homo sapiens
gaacacguugucacuugca

SEQ ID NO: 1235066 - RNA, 19 nt, Homo sapiens
ugccuauggcuuugaauaa

SEQ ID NO: 1235067 - RNA, 19 nt, Homo sapiens
gaaaaccugucuggucaca

SEQ ID NO: 1235068 - RNA, 19 nt, Homo sapiens
gugauuaccaugccgaagu

SEQ ID NO: 1235069 - RNA, 19 nt, Homo sapiens
cagcuggacggcauaagga

SEQ ID NO: 1235070 - RNA, 19 nt, Homo sapiens
ucaugccuauggcuuugaa

SEQ ID NO: 1235071 - RNA, 19 nt, Homo sapiens
gaggaacacguugucacuu

SEQ ID NO: 1235072 - RNA, 19 nt, Homo sapiens
gcagcuggacggcauaagg

SEQ ID NO: 1235073 - RNA, 19 nt, Homo sapiens
auauuggugucauagcauu

SEQ ID NO: 1235074 - RNA, 19 nt, Homo sapiens
gauauuggugucauagcau

SEQ ID NO: 1235075 - RNA, 19 nt, Homo sapiens
ugagcaaucccaagaagag

SEQ ID NO: 1235076 - RNA, 19 nt, Homo sapiens
ucacuugcaaugcugaaau

SEQ ID NO: 1235077 - RNA, 19 nt, Homo sapiens
guccuaagcagaguuaauc

SEQ ID NO: 1235078 - RNA, 19 nt, Homo sapiens
acaggugacaggcugcuuu

SEQ ID NO: 1235079 - RNA, 19 nt, Homo sapiens
cuauggcuuugaauaaucu

SEQ ID NO: 1235080 - RNA, 19 nt, Homo sapiens
cauuuggccuacauuaaaa

SEQ ID NO: 1235081 - RNA, 19 nt, Homo sapiens
cacuugcaaugcugaaauc

SEQ ID NO: 1235082 - RNA, 19 nt, Homo sapiens
aggcugcuuucgugacuug

SEQ ID NO: 1235083 - RNA, 19 nt, Homo sapiens
ccaaagugacauucuucau

SEQ ID NO: 1235084 - RNA, 19 nt, Homo sapiens
gaaguauuucagaccuguu

SEQ ID NO: 1235085 - RNA, 19 nt, Homo sapiens
aacaucgucuugagcaauc

SEQ ID NO: 1235086 - RNA, 19 nt, Homo sapiens
ccagagagcugccgauuua

SEQ ID NO: 1235087 - RNA, 19 nt, Homo sapiens
gaaccaaacucaaagaauu

SEQ ID NO: 1235088 - RNA, 19 nt, Homo sapiens
gaagagcgguugaaguuaa

SEQ ID NO: 1235089 - RNA, 19 nt, Homo sapiens
gcacaacacuucaggguuu

SEQ ID NO: 1235090 - RNA, 19 nt, Homo sapiens
ggaagaaauucaucaguuu

SEQ ID NO: 1235091 - RNA, 19 nt, Homo sapiens
gcaaacagaugaauugaau

SEQ ID NO: 1235092 - RNA, 19 nt, Homo sapiens
gcaagucuuuggaaucuua

SEQ ID NO: 1235093 - RNA, 19 nt, Homo sapiens
ucagaaagcuaguauuuga

SEQ ID NO: 1235094 - RNA, 19 nt, Homo sapiens
gagaggaacuuacguuaga

SEQ ID NO: 1235095 - RNA, 19 nt, Homo sapiens
gcaaagagaugacacaaac

SEQ ID NO: 1235096 - RNA, 19 nt, Homo sapiens
ggaaacaucuccacgacuu

SEQ ID NO: 1235097 - RNA, 19 nt, Homo sapiens
gaacuuccaacaacaaaua

SEQ ID NO: 1235098 - RNA, 19 nt, Homo sapiens
gcacuagaauuuauggauu

SEQ ID NO: 1235099 - RNA, 19 nt, Homo sapiens
ggaaagaacuaggaagaug

SEQ ID NO: 1235100 - RNA, 19 nt, Homo sapiens
gauauuaggccaaaugaaa

SEQ ID NO: 1235101 - RNA, 19 nt, Homo sapiens
guaugcaguuucucucuua

SEQ ID NO: 1235102 - RNA, 19 nt, Homo sapiens
cagauuauacugugacuua

SEQ ID NO: 1235103 - RNA, 19 nt, Homo sapiens
ccaacugccuuacgaauug

SEQ ID NO: 1235104 - RNA, 19 nt, Homo sapiens
ucucacagcugaaacguuu

SEQ ID NO: 1235105 - RNA, 19 nt, Homo sapiens
gggcacagaugaacaaaca

SEQ ID NO: 1235106 - RNA, 19 nt, Homo sapiens
gaugugccuuucuuugaua

SEQ ID NO: 1235107 - RNA, 19 nt, Homo sapiens
ccaugaagcuggagacaga

SEQ ID NO: 1235108 - RNA, 19 nt, Homo sapiens
uggaauggcuggacguuaa

SEQ ID NO: 1235109 - RNA, 19 nt, Homo sapiens
gaacgaguguccuacuauc

SEQ ID NO: 1235110 - RNA, 19 nt, Homo sapiens
aauaaacccuacuggauuu

SEQ ID NO: 1235111 - RNA, 19 nt, Homo sapiens
caacaagaagacccaaaua

SEQ ID NO: 1235112 - RNA, 19 nt, Homo sapiens
cauauugccuuaacuuuca

SEQ ID NO: 1235113 - RNA, 19 nt, Homo sapiens
gaacagccaccaaauucuu

SEQ ID NO: 1235114 - RNA, 19 nt, Homo sapiens
uacguuagauugcuuauga

SEQ ID NO: 1235115 - RNA, 19 nt, Homo sapiens
ggaaguagcagcagcaauc

SEQ ID NO: 1235116 - RNA, 19 nt, Homo sapiens
cggaagaaauucaucaguu

SEQ ID NO: 1235117 - RNA, 19 nt, Homo sapiens
caaauaaacccuacuggau

SEQ ID NO: 1235118 - RNA, 19 nt, Homo sapiens
gauuaaacuuggaaagaga

SEQ ID NO: 1235119 - RNA, 19 nt, Homo sapiens
ugaaagacacgaggaguua

SEQ ID NO: 1235120 - RNA, 19 nt, Homo sapiens
uaaacucucugcagcuuug

SEQ ID NO: 1235121 - RNA, 19 nt, Homo sapiens
gcuaguauuugaagccauu

SEQ ID NO: 1235122 - RNA, 19 nt, Homo sapiens
caagaacagccaccaaauu

SEQ ID NO: 1235123 - RNA, 19 nt, Homo sapiens
uggaagaaguggcaauuga

SEQ ID NO: 1235124 - RNA, 19 nt, Homo sapiens
ggagugcgguguggaagaa

SEQ ID NO: 1235125 - RNA, 19 nt, Homo sapiens
uaccuuagcggguucauua

SEQ ID NO: 1235126 - RNA, 19 nt, Homo sapiens
gaagaugggcacagaugaa

SEQ ID NO: 1235127 - RNA, 19 nt, Homo sapiens
acaagaagacccaaauaaa

SEQ ID NO: 1235128 - RNA, 19 nt, Homo sapiens
ggaaaugugauugcuaauu

SEQ ID NO: 1235129 - RNA, 19 nt, Homo sapiens
ccaaguucauauugccuua

SEQ ID NO: 1235130 - RNA, 19 nt, Homo sapiens
gcaaaaggcggaagaaauu

SEQ ID NO: 1235131 - RNA, 19 nt, Homo sapiens
ugaaugaugugccuuucuu

SEQ ID NO: 1235132 - RNA, 19 nt, Homo sapiens
ggagacacaugcuacucuu

SEQ ID NO: 1235133 - RNA, 19 nt, Homo sapiens
guuaagauauuaggccaaa

SEQ ID NO: 1235134 - RNA, 19 nt, Homo sapiens
gaaacaucuccacgacuua

SEQ ID NO: 1235135 - RNA, 19 nt, Homo sapiens
ccucagauauccacuguuc

SEQ ID NO: 1235136 - RNA, 19 nt, Homo sapiens
ggauuaaacuuggaaagag

SEQ ID NO: 1235137 - RNA, 19 nt, Homo sapiens
gaagaguacagaaacaaau

SEQ ID NO: 1235138 - RNA, 19 nt, Homo sapiens
ggaagaguacagaaacaaa

SEQ ID NO: 1235139 - RNA, 19 nt, Homo sapiens
ccaagaauaagaagggaua

SEQ ID NO: 1235140 - RNA, 19 nt, Homo sapiens
gaacuuacguuagauugcu

SEQ ID NO: 1235141 - RNA, 19 nt, Homo sapiens
ugaaagcuauuggaaaugu

SEQ ID NO: 1235142 - RNA, 19 nt, Homo sapiens
guaggacacuccauacaca

SEQ ID NO: 1235143 - RNA, 19 nt, Homo sapiens
gcacagaugaacaaacaga

SEQ ID NO: 1235144 - RNA, 19 nt, Homo sapiens
ccucagaaagcuaguauuu

SEQ ID NO: 1235145 - RNA, 19 nt, Homo sapiens
gaaguuaaaggaugaaguc

SEQ ID NO: 1235146 - RNA, 19 nt, Homo sapiens
aagaagagcgguugaaguu

SEQ ID NO: 1235147 - RNA, 19 nt, Homo sapiens
gaaaagacagccaaagaaa

SEQ ID NO: 1235148 - RNA, 19 nt, Homo sapiens
ccacaagugauaaagagua

SEQ ID NO: 1235149 - RNA, 19 nt, Homo sapiens
ugaagccauuugaguuuaa

SEQ ID NO: 1235150 - RNA, 19 nt, Homo sapiens
ggauauguauaaggaaaug

SEQ ID NO: 1235151 - RNA, 19 nt, Homo sapiens
uacacgaucuccaacaauu

SEQ ID NO: 1235152 - RNA, 19 nt, Homo sapiens
aaauaaacccuacuggauu

SEQ ID NO: 1235153 - RNA, 19 nt, Homo sapiens
ggaaucuuauccaugcuau

SEQ ID NO: 1235154 - RNA, 19 nt, Homo sapiens
ggacaggaaagaacuagga

SEQ ID NO: 1235155 - RNA, 19 nt, Homo sapiens
caagaagacccaaauaaac

SEQ ID NO: 1235156 - RNA, 19 nt, Homo sapiens
gacacgaggaguuaauuaa

SEQ ID NO: 1235157 - RNA, 19 nt, Homo sapiens
ggcuggacguuaaauauug

SEQ ID NO: 1235158 - RNA, 19 nt, Homo sapiens
gguaaacucucugcagcuu

SEQ ID NO: 1235159 - RNA, 19 nt, Homo sapiens
gaccagaguccuuagcauu

SEQ ID NO: 1235160 - RNA, 19 nt, Homo sapiens
ucaaagaauucugcagguu

SEQ ID NO: 1235161 - RNA, 19 nt, Homo sapiens
gcugagaguccgccuauau

SEQ ID NO: 1235162 - RNA, 19 nt, Homo sapiens
gagaaugaaaugaaugaug

SEQ ID NO: 1235163 - RNA, 19 nt, Homo sapiens
gguugaaguuaaaggauga

SEQ ID NO: 1235164 - RNA, 19 nt, Homo sapiens
cggcgaauauggacgacua

SEQ ID NO: 1235165 - RNA, 19 nt, Homo sapiens
gaaagacacgaggaguuaa

SEQ ID NO: 1235166 - RNA, 19 nt, Homo sapiens
ggaaaaggccaagcuauaa

SEQ ID NO: 1235167 - RNA, 19 nt, Homo sapiens
gguauucgguuaaaguucu

SEQ ID NO: 1235168 - RNA, 19 nt, Homo sapiens
gaugaagaaacuaagauug

SEQ ID NO: 1235169 - RNA, 19 nt, Homo sapiens
aaagaauucugcagguuca

SEQ ID NO: 1235170 - RNA, 19 nt, Homo sapiens
gguuugagcucccagucuu

SEQ ID NO: 1235171 - RNA, 19 nt, Homo sapiens
guuucucucuuaagacuaa

SEQ ID NO: 1235172 - RNA, 19 nt, Homo sapiens
gaaaccaggcagucuuguu

SEQ ID NO: 1235173 - RNA, 19 nt, Homo sapiens
aaacuuggaaagagagaua

SEQ ID NO: 1235174 - RNA, 19 nt, Homo sapiens
uuggaaaugugauugcuaa

SEQ ID NO: 1235175 - RNA, 19 nt, Homo sapiens
gaaagcuauuggaaaugug

SEQ ID NO: 1235176 - RNA, 19 nt, Homo sapiens
ggacuucucacagcugaaa

SEQ ID NO: 1235177 - RNA, 19 nt, Homo sapiens
ccagacucccacacuauua

SEQ ID NO: 1235178 - RNA, 19 nt, Homo sapiens
accacaaccugcuacaaua

SEQ ID NO: 1235179 - RNA, 19 nt, Homo sapiens
uuauucagguauucgguua

SEQ ID NO: 1235180 - RNA, 19 nt, Homo sapiens
guauucugcugaggaagua

SEQ ID NO: 1235181 - RNA, 19 nt, Homo sapiens
ggaagaugggcacagauga

SEQ ID NO: 1235182 - RNA, 19 nt, Homo sapiens
gcagcauggugucauuugu

SEQ ID NO: 1235183 - RNA, 19 nt, Homo sapiens
uaagauauuaggccaaaug

SEQ ID NO: 1235184 - RNA, 19 nt, Homo sapiens
gaugaaguccuggauaugu

SEQ ID NO: 1235185 - RNA, 19 nt, Homo sapiens
uaucugaaagccaaacuaa

SEQ ID NO: 1235186 - RNA, 19 nt, Homo sapiens
gcuggaaucuccucucuua

SEQ ID NO: 1235187 - RNA, 19 nt, Homo sapiens
guagaacgcucucuggauu

SEQ ID NO: 1235188 - RNA, 19 nt, Homo sapiens
gcugaaauccuaguuauua

SEQ ID NO: 1235189 - RNA, 19 nt, Homo sapiens
ggaugaagcuggcacugaa

SEQ ID NO: 1235190 - RNA, 19 nt, Homo sapiens
gcaaucagcugagaagugu

SEQ ID NO: 1235191 - RNA, 19 nt, Homo sapiens
gaaaccuagugcugaagua

SEQ ID NO: 1235192 - RNA, 19 nt, Homo sapiens
ggaauguccugaaugacuu

SEQ ID NO: 1235193 - RNA, 19 nt, Homo sapiens
guuccagucuccaccuuua

SEQ ID NO: 1235194 - RNA, 19 nt, Homo sapiens
cagcugaaauccuaguuau

SEQ ID NO: 1235195 - RNA, 19 nt, Homo sapiens
caaauggugugccuaccuu

SEQ ID NO: 1235196 - RNA, 19 nt, Homo sapiens
gaaagagagccaugacugu

SEQ ID NO: 1235197 - RNA, 19 nt, Homo sapiens
ggcaggagcugaacaagag

SEQ ID NO: 1235198 - RNA, 19 nt, Homo sapiens
agagagccaugacuguaua

SEQ ID NO: 1235199 - RNA, 19 nt, Homo sapiens
agaagcaacucguggaaga

SEQ ID NO: 1235200 - RNA, 19 nt, Homo sapiens
gagccaugacuguauauaa

SEQ ID NO: 1235201 - RNA, 19 nt, Homo sapiens
gccaauuucuguucuguuc

SEQ ID NO: 1235202 - RNA, 19 nt, Homo sapiens
ggagcgggaugcacaguuc

SEQ ID NO: 1235203 - RNA, 19 nt, Homo sapiens
ggaagcaggcagugucuug

SEQ ID NO: 1235204 - RNA, 19 nt, Homo sapiens
gaaauccuaguuauuagug

SEQ ID NO: 1235205 - RNA, 19 nt, Homo sapiens
caaacucacccauaacaga

SEQ ID NO: 1235206 - RNA, 19 nt, Homo sapiens
ugagaagugucacgucaug

SEQ ID NO: 1235207 - RNA, 19 nt, Homo sapiens
cuaagagugugucaacuuc

SEQ ID NO: 1235208 - RNA, 19 nt, Homo sapiens
gugccuaccuucccacuuc

SEQ ID NO: 1235209 - RNA, 19 nt, Homo sapiens
ggaagaggcuauggaacag

SEQ ID NO: 1235210 - RNA, 19 nt, Homo sapiens
ugacagagcaacccugaga

SEQ ID NO: 1235211 - RNA, 19 nt, Homo sapiens
ccggagcgaugcuguguga

SEQ ID NO: 1235212 - RNA, 19 nt, Homo sapiens
ccaagccuaucuucugguu

SEQ ID NO: 1235213 - RNA, 19 nt, Homo sapiens
gcuaagagugugucaacuu

SEQ ID NO: 1235214 - RNA, 19 nt, Homo sapiens
ccaagaacgagacagauga

SEQ ID NO: 1235215 - RNA, 19 nt, Homo sapiens
caacuuccagggacccaua

SEQ ID NO: 1235216 - RNA, 19 nt, Homo sapiens
ucucccagcugaaauccua

SEQ ID NO: 1235217 - RNA, 19 nt, Homo sapiens
aaagagagccaugacugua

SEQ ID NO: 1235218 - RNA, 19 nt, Homo sapiens
gugauaugcuggucuucuu

SEQ ID NO: 1235219 - RNA, 19 nt, Homo sapiens
gaugcacaguucacacaga

SEQ ID NO: 1235220 - RNA, 19 nt, Homo sapiens
ucccaagauuguaggaaua

SEQ ID NO: 1235221 - RNA, 19 nt, Homo sapiens
gaaccugggcucacucaag

SEQ ID NO: 1235222 - RNA, 19 nt, Homo sapiens
ccaugacuguauauaauuc

SEQ ID NO: 1235223 - RNA, 19 nt, Homo sapiens
ggaaucuccucucuuagcu

SEQ ID NO: 1235224 - RNA, 19 nt, Homo sapiens
uguccugaaugacuucuaa

SEQ ID NO: 1235225 - RNA, 19 nt, Homo sapiens
ccaccuuuauuguucuuga

SEQ ID NO: 1235226 - RNA, 19 nt, Homo sapiens
gacagaagccacagacaca

SEQ ID NO: 1235227 - RNA, 19 nt, Homo sapiens
gcugugauaugcuggucuu

SEQ ID NO: 1235228 - RNA, 19 nt, Homo sapiens
aagccuaucuucugguuuc

SEQ ID NO: 1235229 - RNA, 19 nt, Homo sapiens
gggaggaguacgaggagua

SEQ ID NO: 1235230 - RNA, 19 nt, Homo sapiens
gcuuugaacccucgacuau

SEQ ID NO: 1235231 - RNA, 19 nt, Homo sapiens
ggagcgaugcugugugaga

SEQ ID NO: 1235232 - RNA, 19 nt, Homo sapiens
gcaugagccgggaggagua

SEQ ID NO: 1235233 - RNA, 19 nt, Homo sapiens
gaaaguuggaagaggcuau

SEQ ID NO: 1235234 - RNA, 19 nt, Homo sapiens
gccaugacuguauauaauu

SEQ ID NO: 1235235 - RNA, 19 nt, Homo sapiens
agccaugacuguauauaau

SEQ ID NO: 1235236 - RNA, 19 nt, Homo sapiens
gcucccaccucguuaaagg

SEQ ID NO: 1235237 - RNA, 19 nt, Homo sapiens
ccagcugaaauccuaguua

SEQ ID NO: 1235238 - RNA, 19 nt, Homo sapiens
gccaacucguggaaccaua

SEQ ID NO: 1235239 - RNA, 19 nt, Homo sapiens
ccucagagccugcuuugca

SEQ ID NO: 1235240 - RNA, 19 nt, Homo sapiens
aaaugggaauguccugaau

SEQ ID NO: 1235241 - RNA, 19 nt, Homo sapiens
ccacagagagacacacaca

SEQ ID NO: 1235242 - RNA, 19 nt, Homo sapiens
ggaguaaaguccccaucuu

SEQ ID NO: 1235243 - RNA, 19 nt, Homo sapiens
cgaagaccauggcguucau

SEQ ID NO: 1235244 - RNA, 19 nt, Homo sapiens
ggagcucggcguugaagga

SEQ ID NO: 1235245 - RNA, 19 nt, Homo sapiens
caagagccuucaggagugu

SEQ ID NO: 1235246 - RNA, 19 nt, Homo sapiens
gggaauguccugaaugacu

SEQ ID NO: 1235247 - RNA, 19 nt, Homo sapiens
ccagacaccaccacucaga

SEQ ID NO: 1235248 - RNA, 19 nt, Homo sapiens
gcagagugccaaggaugaa

SEQ ID NO: 1235249 - RNA, 19 nt, Homo sapiens
augggaauguccugaauga

SEQ ID NO: 1235250 - RNA, 19 nt, Homo sapiens
gagagagcaugggcagaca

SEQ ID NO: 1235251 - RNA, 19 nt, Homo sapiens
ccaacucguggaaccauaa

SEQ ID NO: 1235252 - RNA, 19 nt, Homo sapiens
gaaagccccugcucucucu

SEQ ID NO: 1235253 - RNA, 19 nt, Homo sapiens
cagaggaggaggaggagaa

SEQ ID NO: 1235254 - RNA, 19 nt, Homo sapiens
guacgaggaguaucagaag

SEQ ID NO: 1235255 - RNA, 19 nt, Homo sapiens
gacacacacaggacacaaa

SEQ ID NO: 1235256 - RNA, 19 nt, Homo sapiens
gagcuguccgcgaaaccua

SEQ ID NO: 1235257 - RNA, 19 nt, Homo sapiens
uggaagaggcuauggaaca

SEQ ID NO: 1235258 - RNA, 19 nt, Homo sapiens
uccucaaacucacccauaa

SEQ ID NO: 1235259 - RNA, 19 nt, Homo sapiens
ucucuuagcucagugaaaa

SEQ ID NO: 1235260 - RNA, 19 nt, Homo sapiens
ucucugagccuuauuucau

SEQ ID NO: 1235261 - RNA, 19 nt, Homo sapiens
agacaccaccacucagaaa

SEQ ID NO: 1235262 - RNA, 19 nt, Homo sapiens
ccuaucuucugguuucuuc

SEQ ID NO: 1235263 - RNA, 19 nt, Homo sapiens
gauaugcuggucuucuuuc

SEQ ID NO: 1235264 - RNA, 19 nt, Homo sapiens
aauaccggcuacccaagaa

SEQ ID NO: 1235265 - RNA, 19 nt, Homo sapiens
ggaggaguacgaggaguau

SEQ ID NO: 1235266 - RNA, 19 nt, Homo sapiens
cgcgaaaccuagugcugaa

SEQ ID NO: 1235267 - RNA, 19 nt, Homo sapiens
uuucuguucuguuccugua

SEQ ID NO: 1235268 - RNA, 19 nt, Homo sapiens
ggacccauacuccauuugg

SEQ ID NO: 1235269 - RNA, 19 nt, Homo sapiens
caagcaaucagcugagaag

SEQ ID NO: 1235270 - RNA, 19 nt, Homo sapiens
cugaaauccuaguuauuag

SEQ ID NO: 1235271 - RNA, 19 nt, Homo sapiens
gagcagugucucccagugu

SEQ ID NO: 1235272 - RNA, 19 nt, Homo sapiens
caagaccuuucccauccau

SEQ ID NO: 1235273 - RNA, 19 nt, Homo sapiens
cgaggaguaucagaagcaa

SEQ ID NO: 1235274 - RNA, 19 nt, Homo sapiens
gagaggccaacucguggaa

SEQ ID NO: 1235275 - RNA, 19 nt, Homo sapiens
auaauucuguccucaaacu

SEQ ID NO: 1235276 - RNA, 19 nt, Homo sapiens
uuugaacccucgacuaugg

SEQ ID NO: 1235277 - RNA, 19 nt, Homo sapiens
uagcuggaaucuccucucu

SEQ ID NO: 1235278 - RNA, 19 nt, Homo sapiens
gagccacuuccgagacaaa

SEQ ID NO: 1235279 - RNA, 19 nt, Homo sapiens
guuggaagaggcuauggaa

SEQ ID NO: 1235280 - RNA, 19 nt, Homo sapiens
ggcaugcucccaccucguu

SEQ ID NO: 1235281 - RNA, 19 nt, Homo sapiens
gaagauggagcgggaugca

SEQ ID NO: 1235282 - RNA, 19 nt, Homo sapiens
gcgaagaccauggcguuca

SEQ ID NO: 1235283 - RNA, 19 nt, Homo sapiens
gagggaaagagagccauga

SEQ ID NO: 1235284 - RNA, 19 nt, Homo sapiens
gggcccagccaauuucugu

SEQ ID NO: 1235285 - RNA, 19 nt, Homo sapiens
gcaugcucccaccucguua

SEQ ID NO: 1235286 - RNA, 19 nt, Homo sapiens
gaaagucggucaaguuuau

SEQ ID NO: 1235287 - RNA, 19 nt, Homo sapiens
agacaaagacgaacaaaua

SEQ ID NO: 1235288 - RNA, 19 nt, Homo sapiens
ggacgaccguguaagauga

SEQ ID NO: 1235289 - RNA, 19 nt, Homo sapiens
gaacagcagacucuaugua

SEQ ID NO: 1235290 - RNA, 19 nt, Homo sapiens
ucagaacgaugucaaguga

SEQ ID NO: 1235291 - RNA, 19 nt, Homo sapiens
ucgcaugagugcaauauuu

SEQ ID NO: 1235292 - RNA, 19 nt, Homo sapiens
gaugaaagucggucaaguu

SEQ ID NO: 1235293 - RNA, 19 nt, Homo sapiens
ggucaaguuuauuugcuuu

SEQ ID NO: 1235294 - RNA, 19 nt, Homo sapiens
guaaauguguaaacuaagg

SEQ ID NO: 1235295 - RNA, 19 nt, Homo sapiens
gcacgauuccuguaaaugu

SEQ ID NO: 1235296 - RNA, 19 nt, Homo sapiens
gaaggcacgauuccuguaa

SEQ ID NO: 1235297 - RNA, 19 nt, Homo sapiens
caaguuagccacugcucua

SEQ ID NO: 1235298 - RNA, 19 nt, Homo sapiens
caucucaccuguguucaaa

SEQ ID NO: 1235299 - RNA, 19 nt, Homo sapiens
gacaaagacgaacaaauau

SEQ ID NO: 1235300 - RNA, 19 nt, Homo sapiens
caagcagaaugcaugcaaa

SEQ ID NO: 1235301 - RNA, 19 nt, Homo sapiens
gagcaucucaccuguguuc

SEQ ID NO: 1235302 - RNA, 19 nt, Homo sapiens
caaccuauaucugauuucu

SEQ ID NO: 1235303 - RNA, 19 nt, Homo sapiens
acagcagacucuauguaaa

SEQ ID NO: 1235304 - RNA, 19 nt, Homo sapiens
cacgggagcuucaggaaag

SEQ ID NO: 1235305 - RNA, 19 nt, Homo sapiens
aguaguaggugccgugaga

SEQ ID NO: 1235306 - RNA, 19 nt, Homo sapiens
guuagccacugcucuagga

SEQ ID NO: 1235307 - RNA, 19 nt, Homo sapiens
ggccacacacuccuuauau

SEQ ID NO: 1235308 - RNA, 19 nt, Homo sapiens
uguaucugcugaaucauau

SEQ ID NO: 1235309 - RNA, 19 nt, Homo sapiens
ugaaagucggucaaguuua

SEQ ID NO: 1235310 - RNA, 19 nt, Homo sapiens
ugagugcaauauuucauuc

SEQ ID NO: 1235311 - RNA, 19 nt, Homo sapiens
gggccacacacuccuuaua

SEQ ID NO: 1235312 - RNA, 19 nt, Homo sapiens
agaacgaugucaagugaag

SEQ ID NO: 1235313 - RNA, 19 nt, Homo sapiens
gccacacacuccuuauauc

SEQ ID NO: 1235314 - RNA, 19 nt, Homo sapiens
cagcagacucuauguaaag

SEQ ID NO: 1235315 - RNA, 19 nt, Homo sapiens
ggcacccucugaucucuug

SEQ ID NO: 1235316 - RNA, 19 nt, Homo sapiens
aacagcagacucuauguaa

SEQ ID NO: 1235317 - RNA, 19 nt, Homo sapiens
cuuauauccucccacacua

SEQ ID NO: 1235318 - RNA, 19 nt, Homo sapiens
acacaaagguuuuaugaac

SEQ ID NO: 1235319 - RNA, 19 nt, Homo sapiens
gaucagaacgaugucaagu

SEQ ID NO: 1235320 - RNA, 19 nt, Homo sapiens
ccacgggagcuucaggaaa

SEQ ID NO: 1235321 - RNA, 19 nt, Homo sapiens
accuauaucugauuucugu

SEQ ID NO: 1235322 - RNA, 19 nt, Homo sapiens
gggacgaccguguaagaug

SEQ ID NO: 1235323 - RNA, 19 nt, Homo sapiens
cacgauuccuguaaaugug

SEQ ID NO: 1235324 - RNA, 19 nt, Homo sapiens
cgaaggcacgauuccugua

SEQ ID NO: 1235325 - RNA, 19 nt, Homo sapiens
gcagaaugcaugcaaaaga

SEQ ID NO: 1235326 - RNA, 19 nt, Homo sapiens
ccaagcagaaugcaugcaa

SEQ ID NO: 1235327 - RNA, 19 nt, Homo sapiens
uccaaccuauaucugauuu

SEQ ID NO: 1235328 - RNA, 19 nt, Homo sapiens
caacagccgugagcaucuc

SEQ ID NO: 1235329 - RNA, 19 nt, Homo sapiens
gacucuauguaaaggcauu

SEQ ID NO: 1235330 - RNA, 19 nt, Homo sapiens
ccacaccacaggccucgaa

SEQ ID NO: 1235331 - RNA, 19 nt, Homo sapiens
cgauuccuguaaaugugua

SEQ ID NO: 1235332 - RNA, 19 nt, Homo sapiens
gaacgaugucaagugaaga

SEQ ID NO: 1235333 - RNA, 19 nt, Homo sapiens
gcaugagugcaauauuuca

SEQ ID NO: 1235334 - RNA, 19 nt, Homo sapiens
gcaucucaccuguguucaa

SEQ ID NO: 1235335 - RNA, 19 nt, Homo sapiens
aaggcacgauuccuguaaa

SEQ ID NO: 1235336 - RNA, 19 nt, Homo sapiens
aagcagggcccagcucuga

SEQ ID NO: 1235337 - RNA, 19 nt, Homo sapiens
caagacaaagacgaacaaa

SEQ ID NO: 1235338 - RNA, 19 nt, Homo sapiens
augaaagucggucaaguuu

SEQ ID NO: 1235339 - RNA, 19 nt, Homo sapiens
cuaaggggaugguuggauu

SEQ ID NO: 1235340 - RNA, 19 nt, Homo sapiens
ucacagucccaccagauuc

SEQ ID NO: 1235341 - RNA, 19 nt, Homo sapiens
ccuguaaauguguaaacua

SEQ ID NO: 1235342 - RNA, 19 nt, Homo sapiens
ucagugcaucuccuagaaa

SEQ ID NO: 1235343 - RNA, 19 nt, Homo sapiens
ugacggcacccucugaucu

SEQ ID NO: 1235344 - RNA, 19 nt, Homo sapiens
uaagaugaaagucggucaa

SEQ ID NO: 1235345 - RNA, 19 nt, Homo sapiens
cuuuggaaaugcacuguuc

SEQ ID NO: 1235346 - RNA, 19 nt, Homo sapiens
ccacagccaaggacagaca

SEQ ID NO: 1235347 - RNA, 19 nt, Homo sapiens
gaccguguaagaugaaagu

SEQ ID NO: 1235348 - RNA, 19 nt, Homo sapiens
gggaucagaacgaugucaa

SEQ ID NO: 1235349 - RNA, 19 nt, Homo sapiens
ggagguuucucggccuuuu

SEQ ID NO: 1235350 - RNA, 19 nt, Homo sapiens
acaagacaaagacgaacaa

SEQ ID NO: 1235351 - RNA, 19 nt, Homo sapiens
uucagugcaucuccuagaa

SEQ ID NO: 1235352 - RNA, 19 nt, Homo sapiens
uuauauccucccacacuaa

SEQ ID NO: 1235353 - RNA, 19 nt, Homo sapiens
caaguuuauuugcuuucag

SEQ ID NO: 1235354 - RNA, 19 nt, Homo sapiens
uauuccaaccuauaucuga

SEQ ID NO: 1235355 - RNA, 19 nt, Homo sapiens
caaaggaccuguuaauaaa

SEQ ID NO: 1235356 - RNA, 19 nt, Homo sapiens
caacugagaucaccucuaa

SEQ ID NO: 1235357 - RNA, 19 nt, Homo sapiens
gcaaaggaccuguuaauaa

SEQ ID NO: 1235358 - RNA, 19 nt, Homo sapiens
gaaagcaaaucauaucaug

SEQ ID NO: 1235359 - RNA, 19 nt, Homo sapiens
gcaaggaggagucggauua

SEQ ID NO: 1235360 - RNA, 19 nt, Homo sapiens
gauuccagcugucugauua

SEQ ID NO: 1235361 - RNA, 19 nt, Homo sapiens
caacuuaaacagcacauua

SEQ ID NO: 1235362 - RNA, 19 nt, Homo sapiens
ucagaaagcuguaauaaac

SEQ ID NO: 1235363 - RNA, 19 nt, Homo sapiens
ccaaauaggaguaauugua

SEQ ID NO: 1235364 - RNA, 19 nt, Homo sapiens
ggcaauagcucauguccuu

SEQ ID NO: 1235365 - RNA, 19 nt, Homo sapiens
ggugagagcugaugcugaa

SEQ ID NO: 1235366 - RNA, 19 nt, Homo sapiens
gaagaaagcaaaucauauc

SEQ ID NO: 1235367 - RNA, 19 nt, Homo sapiens
gcacgaaacaugccaagaa

SEQ ID NO: 1235368 - RNA, 19 nt, Homo sapiens
gcuguuugcuccuuacuaa

SEQ ID NO: 1235369 - RNA, 19 nt, Homo sapiens
aaccaucgcuggauauuaa

SEQ ID NO: 1235370 - RNA, 19 nt, Homo sapiens
ccagcugucugauuaauga

SEQ ID NO: 1235371 - RNA, 19 nt, Homo sapiens
caaaucauaucaugcaaca

SEQ ID NO: 1235372 - RNA, 19 nt, Homo sapiens
gaucaccucuaaaguggaa

SEQ ID NO: 1235373 - RNA, 19 nt, Homo sapiens
gcacaacagugguacuaag

SEQ ID NO: 1235374 - RNA, 19 nt, Homo sapiens
gcucauguccuucuacuga

SEQ ID NO: 1235375 - RNA, 19 nt, Homo sapiens
aaacagcacauuagcagua

SEQ ID NO: 1235376 - RNA, 19 nt, Homo sapiens
auacaguccuuacaacaaa

SEQ ID NO: 1235377 - RNA, 19 nt, Homo sapiens
acacaggccuccaaaauaa

SEQ ID NO: 1235378 - RNA, 19 nt, Homo sapiens
uaaaccauuucuucccuuu

SEQ ID NO: 1235379 - RNA, 19 nt, Homo sapiens
ggcaaaggaccuguuaaua

SEQ ID NO: 1235380 - RNA, 19 nt, Homo sapiens
ccgaagaaagcaaaucaua

SEQ ID NO: 1235381 - RNA, 19 nt, Homo sapiens
ggaaacacaggccuccaaa

SEQ ID NO: 1235382 - RNA, 19 nt, Homo sapiens
ugaaagggcucugcucuac

SEQ ID NO: 1235383 - RNA, 19 nt, Homo sapiens
uaaauacaguccuuacaac

SEQ ID NO: 1235384 - RNA, 19 nt, Homo sapiens
cgaagaaagcaaaucauau

SEQ ID NO: 1235385 - RNA, 19 nt, Homo sapiens
caaaacggcuucuuuacug

SEQ ID NO: 1235386 - RNA, 19 nt, Homo sapiens
gacgacaacuguggaaauc

SEQ ID NO: 1235387 - RNA, 19 nt, Homo sapiens
gcagggacaccagcaauau

SEQ ID NO: 1235388 - RNA, 19 nt, Homo sapiens
caccgaauguagcaugaaa

SEQ ID NO: 1235389 - RNA, 19 nt, Homo sapiens
caaauaggaguaauuguac

SEQ ID NO: 1235390 - RNA, 19 nt, Homo sapiens
cuaaauacaguccuuacaa

SEQ ID NO: 1235391 - RNA, 19 nt, Homo sapiens
gaucuuagcccuggaaagg

SEQ ID NO: 1235392 - RNA, 19 nt, Homo sapiens
gaaaggcaaaggaccuguu

SEQ ID NO: 1235393 - RNA, 19 nt, Homo sapiens
ugagaucaccucuaaagug

SEQ ID NO: 1235394 - RNA, 19 nt, Homo sapiens
aaaccuaaauacaguccuu

SEQ ID NO: 1235395 - RNA, 19 nt, Homo sapiens
gcaguagaaggcacaaaga

SEQ ID NO: 1235396 - RNA, 19 nt, Homo sapiens
aaaggcaaaggaccuguua

SEQ ID NO: 1235397 - RNA, 19 nt, Homo sapiens
cuacugagaccgaggaaga

SEQ ID NO: 1235398 - RNA, 19 nt, Homo sapiens
caguugagauuuaauucug

SEQ ID NO: 1235399 - RNA, 19 nt, Homo sapiens
guaauaaaccauacauucg

SEQ ID NO: 1235400 - RNA, 19 nt, Homo sapiens
caaccaucgcuggauauua

SEQ ID NO: 1235401 - RNA, 19 nt, Homo sapiens
uuucuucccuuuccucuug

SEQ ID NO: 1235402 - RNA, 19 nt, Homo sapiens
gcacaaaaccauguuagaa

SEQ ID NO: 1235403 - RNA, 19 nt, Homo sapiens
caaaagcaguguuaugaca

SEQ ID NO: 1235404 - RNA, 19 nt, Homo sapiens
gcgauggacccgauucaga

SEQ ID NO: 1235405 - RNA, 19 nt, Homo sapiens
uugcaaccaucgcuggaua

SEQ ID NO: 1235406 - RNA, 19 nt, Homo sapiens
gcugucugauuaaugagaa

SEQ ID NO: 1235407 - RNA, 19 nt, Homo sapiens
cgauggacccgauucagaa

SEQ ID NO: 1235408 - RNA, 19 nt, Homo sapiens
gcgcacaacagugguacua

SEQ ID NO: 1235409 - RNA, 19 nt, Homo sapiens
uaucaacgacgacaacugu

SEQ ID NO: 1235410 - RNA, 19 nt, Homo sapiens
gauucagaaagcuguaaua

SEQ ID NO: 1235411 - RNA, 19 nt, Homo sapiens
cacgaaacaugccaagaag

SEQ ID NO: 1235412 - RNA, 19 nt, Homo sapiens
gcuggauauuaaaccauuu

SEQ ID NO: 1235413 - RNA, 19 nt, Homo sapiens
gcaaccaucgcuggauauu

SEQ ID NO: 1235414 - RNA, 19 nt, Homo sapiens
caauaccagcucugacaaa

SEQ ID NO: 1235415 - RNA, 19 nt, Homo sapiens
agaaagcuguaauaaacca

SEQ ID NO: 1235416 - RNA, 19 nt, Homo sapiens
guuugcuccuuacuaaauu

SEQ ID NO: 1235417 - RNA, 19 nt, Homo sapiens
ggaggagucggauuacagu

SEQ ID NO: 1235418 - RNA, 19 nt, Homo sapiens
aaagggcucugcucuacgu

SEQ ID NO: 1235419 - RNA, 19 nt, Homo sapiens
gaagcucaaagcacuggaa

SEQ ID NO: 1235420 - RNA, 19 nt, Homo sapiens
gagauuuaauucugauagc

SEQ ID NO: 1235421 - RNA, 19 nt, Homo sapiens
gauggacccgauucagaaa

SEQ ID NO: 1235422 - RNA, 19 nt, Homo sapiens
acaacaaacuacagaagac

SEQ ID NO: 1235423 - RNA, 19 nt, Homo sapiens
cgacgacaacuguggaaau

SEQ ID NO: 1235424 - RNA, 19 nt, Homo sapiens
ucaccuccaucacuaccaa

SEQ ID NO: 1235425 - RNA, 19 nt, Homo sapiens
gcuccuuacuaaauuccaa

SEQ ID NO: 1235426 - RNA, 19 nt, Homo sapiens
cccgaaaccuaaauacagu

SEQ ID NO: 1235427 - RNA, 19 nt, Homo sapiens
uacaaaggcacgaaacaug

SEQ ID NO: 1235428 - RNA, 19 nt, Homo sapiens
uuagaagcccggaauggaa

SEQ ID NO: 1235429 - RNA, 19 nt, Homo sapiens
guuagaagcccggaaugga

SEQ ID NO: 1235430 - RNA, 19 nt, Homo sapiens
ggauuccagcugucugauu

SEQ ID NO: 1235431 - RNA, 19 nt, Homo sapiens
aaggacagcgcaaagacua

SEQ ID NO: 1235432 - RNA, 19 nt, Homo sapiens
caacaaacuacagaagaca

SEQ ID NO: 1235433 - RNA, 19 nt, Homo sapiens
cggaaacgcaacuuaaaca

SEQ ID NO: 1235434 - RNA, 19 nt, Homo sapiens
cuucuuuacuguucgcuau

SEQ ID NO: 1235435 - RNA, 19 nt, Homo sapiens
ccacuacaaaggcacgaaa

SEQ ID NO: 1235436 - RNA, 19 nt, Homo sapiens
cagcugcagucaaccucuu

SEQ ID NO: 1235437 - RNA, 19 nt, Homo sapiens
uacaacaaacuacagaaga

SEQ ID NO: 1235438 - RNA, 19 nt, Homo sapiens
gcaauaucaacgacgacaa

SEQ ID NO: 1235439 - RNA, 19 nt, Homo sapiens
cuaccaauaccaucaauac

SEQ ID NO: 1235440 - RNA, 19 nt, Homo sapiens
aagcaaaucauaucaugca

SEQ ID NO: 1235441 - RNA, 19 nt, Homo sapiens
gagagcugaugcugaagac

SEQ ID NO: 1235442 - RNA, 19 nt, Homo sapiens
cagcacauuagcaguagaa

SEQ ID NO: 1235443 - RNA, 19 nt, Homo sapiens
ggaaacgcaacuuaaacag

SEQ ID NO: 1235444 - RNA, 19 nt, Homo sapiens
gcgcaaagacuaccuucac

SEQ ID NO: 1235445 - RNA, 19 nt, Homo sapiens
acucggaaacgcaacuuaa

SEQ ID NO: 1235446 - RNA, 19 nt, Homo sapiens
ucauguccuucuacugaga

SEQ ID NO: 1235447 - RNA, 19 nt, Homo sapiens
cgaaacaugccaagaagcu

SEQ ID NO: 1235448 - RNA, 19 nt, Homo sapiens
cgcuggauauuaaaccauu

SEQ ID NO: 1235449 - RNA, 19 nt, Homo sapiens
caccgaagaaagcaaauca

SEQ ID NO: 1235450 - RNA, 19 nt, Homo sapiens
aauacaguccuuacaacaa

SEQ ID NO: 1235451 - RNA, 19 nt, Homo sapiens
aaacacaggccuccaaaau

SEQ ID NO: 1235452 - RNA, 19 nt, Homo sapiens
aaauacaguccuuacaaca

SEQ ID NO: 1235453 - RNA, 19 nt, Homo sapiens
ggacaccagcaauaucaac

SEQ ID NO: 1235454 - RNA, 19 nt, Homo sapiens
gaggagucggauuacagua

SEQ ID NO: 1235455 - RNA, 19 nt, Homo sapiens
gaagagccauccagaguga

SEQ ID NO: 1235456 - RNA, 19 nt, Homo sapiens
cgaguuaaauggcugauaa

SEQ ID NO: 1235457 - RNA, 19 nt, Homo sapiens
gcagaaaucuuuacauucc

SEQ ID NO: 1235458 - RNA, 19 nt, Homo sapiens
gacaucagcucucuaagga

SEQ ID NO: 1235459 - RNA, 19 nt, Homo sapiens
gaacuaacuuacccagcuu

SEQ ID NO: 1235460 - RNA, 19 nt, Homo sapiens
cagccaagcucaucaaugg

SEQ ID NO: 1235461 - RNA, 19 nt, Homo sapiens
ccauggagaugcugaagau

SEQ ID NO: 1235462 - RNA, 19 nt, Homo sapiens
gcugcugcuuacagaauua

SEQ ID NO: 1235463 - RNA, 19 nt, Homo sapiens
ucgcacagguggucuacuu

SEQ ID NO: 1235464 - RNA, 19 nt, Homo sapiens
gggagcugcugugaacuug

SEQ ID NO: 1235465 - RNA, 19 nt, Homo sapiens
ggaaagccgaggugaaggu

SEQ ID NO: 1235466 - RNA, 19 nt, Homo sapiens
gagcugcugugaacuugac

SEQ ID NO: 1235467 - RNA, 19 nt, Homo sapiens
gaaagccgaggugaagguu

SEQ ID NO: 1235468 - RNA, 19 nt, Homo sapiens
gcuccuaccugggugcaau

SEQ ID NO: 1235469 - RNA, 19 nt, Homo sapiens
gcauguguguguguaugug

SEQ ID NO: 1235470 - RNA, 19 nt, Homo sapiens
gaagacgcggcuccaguca

SEQ ID NO: 1235471 - RNA, 19 nt, Homo sapiens
cgacaucagcucucuaagg

SEQ ID NO: 1235472 - RNA, 19 nt, Homo sapiens
agaccaggcugcagaacca

SEQ ID NO: 1235473 - RNA, 19 nt, Homo sapiens
ugggugcaaucgaguuaaa

SEQ ID NO: 1235474 - RNA, 19 nt, Homo sapiens
ggguugcccugaggucuga

SEQ ID NO: 1235475 - RNA, 19 nt, Homo sapiens
ggugacagacccugaugug

SEQ ID NO: 1235476 - RNA, 19 nt, Homo sapiens
ccgaggagaagucgccuuu

SEQ ID NO: 1235477 - RNA, 19 nt, Homo sapiens
ugacccugcuuaaagagau

SEQ ID NO: 1235478 - RNA, 19 nt, Homo sapiens
gugcauguguguguguaug

SEQ ID NO: 1235479 - RNA, 19 nt, Homo sapiens
caacgaggacaccuacucu

SEQ ID NO: 1235480 - RNA, 19 nt, Homo sapiens
cuugucaugucagagaaua

SEQ ID NO: 1235481 - RNA, 19 nt, Homo sapiens
gcccugaggucugacucuu

SEQ ID NO: 1235482 - RNA, 19 nt, Homo sapiens
agccaggaaucccaaguga

SEQ ID NO: 1235483 - RNA, 19 nt, Homo sapiens
ccacgcugcucagggaugu

SEQ ID NO: 1235484 - RNA, 19 nt, Homo sapiens
ggugcaaucgaguuaaaug

SEQ ID NO: 1235485 - RNA, 19 nt, Homo sapiens
gugcaugcguguguguguu

SEQ ID NO: 1235486 - RNA, 19 nt, Homo sapiens
gagccaggaaucccaagug

SEQ ID NO: 1235487 - RNA, 19 nt, Homo sapiens
guuaaauggcugauaagca

SEQ ID NO: 1235488 - RNA, 19 nt, Homo sapiens
agacgcggcuccagucacu

SEQ ID NO: 1235489 - RNA, 19 nt, Homo sapiens
gcugcuuacagaauuauau

SEQ ID NO: 1235490 - RNA, 19 nt, Homo sapiens
ugaccacgcccauggagau

SEQ ID NO: 1235491 - RNA, 19 nt, Homo sapiens
ccaagaccaggcugcagaa

SEQ ID NO: 1235492 - RNA, 19 nt, Homo sapiens
ugucaugucagagaauaaa

SEQ ID NO: 1235493 - RNA, 19 nt, Homo sapiens
caucagaaccuuggaagcu

SEQ ID NO: 1235494 - RNA, 19 nt, Homo sapiens
ucacaucagaaccuuggaa

SEQ ID NO: 1235495 - RNA, 19 nt, Homo sapiens
cuccugcccucucuguuga

SEQ ID NO: 1235496 - RNA, 19 nt, Homo sapiens
ggacggagcaagggaagac

SEQ ID NO: 1235497 - RNA, 19 nt, Homo sapiens
ggacugugccaggaagauc

SEQ ID NO: 1235498 - RNA, 19 nt, Homo sapiens
gcauugccggucucuacaa

SEQ ID NO: 1235499 - RNA, 19 nt, Homo sapiens
ccaucgaccuggccaagac

SEQ ID NO: 1235500 - RNA, 19 nt, Homo sapiens
aagccgaggugaagguuac

SEQ ID NO: 1235501 - RNA, 19 nt, Homo sapiens
gcaccguugggaucaaugu

SEQ ID NO: 1235502 - RNA, 19 nt, Homo sapiens
gacccugcuuaaagagaug

SEQ ID NO: 1235503 - RNA, 19 nt, Homo sapiens
ccugggugcaaucgaguua

SEQ ID NO: 1235504 - RNA, 19 nt, Homo sapiens
gaagaguuuuaagaaguug

SEQ ID NO: 1235505 - RNA, 19 nt, Homo sapiens
gccaugugaucguguuggu

SEQ ID NO: 1235506 - RNA, 19 nt, Homo sapiens
cuccagcccuuccguccuu

SEQ ID NO: 1235507 - RNA, 19 nt, Homo sapiens
ccugugauguggugaagac

SEQ ID NO: 1235508 - RNA, 19 nt, Homo sapiens
gaagugaucuuuauucagu

SEQ ID NO: 1235509 - RNA, 19 nt, Homo sapiens
gcaguuauauguccuuauu

SEQ ID NO: 1235510 - RNA, 19 nt, Homo sapiens
gaagacagaucaacauaca

SEQ ID NO: 1235511 - RNA, 19 nt, Homo sapiens
caacauauuuagacgagua

SEQ ID NO: 1235512 - RNA, 19 nt, Homo sapiens
ugaaacagcugcaaagguu

SEQ ID NO: 1235513 - RNA, 19 nt, Homo sapiens
ggacauauguaguggcuau

SEQ ID NO: 1235514 - RNA, 19 nt, Homo sapiens
uggaauaucucaaugauga

SEQ ID NO: 1235515 - RNA, 19 nt, Homo sapiens
gagagaaagagaugaaaua

SEQ ID NO: 1235516 - RNA, 19 nt, Homo sapiens
guacggauccucaauuauu

SEQ ID NO: 1235517 - RNA, 19 nt, Homo sapiens
gaagaaagaugggauagcu

SEQ ID NO: 1235518 - RNA, 19 nt, Homo sapiens
caacaaagauguauuuccu

SEQ ID NO: 1235519 - RNA, 19 nt, Homo sapiens
caaagacugugcugagaga

SEQ ID NO: 1235520 - RNA, 19 nt, Homo sapiens
uguaguggcuauagguuua

SEQ ID NO: 1235521 - RNA, 19 nt, Homo sapiens
ggauagcucaacuucauua

SEQ ID NO: 1235522 - RNA, 19 nt, Homo sapiens
guguacggauccucaauua

SEQ ID NO: 1235523 - RNA, 19 nt, Homo sapiens
gauaagucauuaccacaga

SEQ ID NO: 1235524 - RNA, 19 nt, Homo sapiens
gaugucagcuguugauugg

SEQ ID NO: 1235525 - RNA, 19 nt, Homo sapiens
ucacauuacuucaggagaa

SEQ ID NO: 1235526 - RNA, 19 nt, Homo sapiens
caaaacacaugccaaauga

SEQ ID NO: 1235527 - RNA, 19 nt, Homo sapiens
ccacagacagaaagaauuu

SEQ ID NO: 1235528 - RNA, 19 nt, Homo sapiens
uacggauccucaauuauua

SEQ ID NO: 1235529 - RNA, 19 nt, Homo sapiens
gauaaagacccaccucuag

SEQ ID NO: 1235530 - RNA, 19 nt, Homo sapiens
agaaagagaugaaauacac

SEQ ID NO: 1235531 - RNA, 19 nt, Homo sapiens
gcaaguaaacgauggaaag

SEQ ID NO: 1235532 - RNA, 19 nt, Homo sapiens
gauccucaauuauuagcaa

SEQ ID NO: 1235533 - RNA, 19 nt, Homo sapiens
aaaccuggauugcuaagga

SEQ ID NO: 1235534 - RNA, 19 nt, Homo sapiens
cucagaaacuuguuaaaga

SEQ ID NO: 1235535 - RNA, 19 nt, Homo sapiens
ugaggugacuguaaucaau

SEQ ID NO: 1235536 - RNA, 19 nt, Homo sapiens
gggaauaaauuuggaaugc

SEQ ID NO: 1235537 - RNA, 19 nt, Homo sapiens
agacgaguauucuugacua

SEQ ID NO: 1235538 - RNA, 19 nt, Homo sapiens
gcagagagagaaagagaug

SEQ ID NO: 1235539 - RNA, 19 nt, Homo sapiens
gaugauuguucaggaauau

SEQ ID NO: 1235540 - RNA, 19 nt, Homo sapiens
gacagaauggaaaguauuu

SEQ ID NO: 1235541 - RNA, 19 nt, Homo sapiens
gcauauuucugauaaagac

SEQ ID NO: 1235542 - RNA, 19 nt, Homo sapiens
acacuucgguuuucucuua

SEQ ID NO: 1235543 - RNA, 19 nt, Homo sapiens
cgaaggaagggaucucuuu

SEQ ID NO: 1235544 - RNA, 19 nt, Homo sapiens
gagaagagcaaaccaaugc

SEQ ID NO: 1235545 - RNA, 19 nt, Homo sapiens
cgaguauucuugacuagug

SEQ ID NO: 1235546 - RNA, 19 nt, Homo sapiens
gggcauauuucugauaaag

SEQ ID NO: 1235547 - RNA, 19 nt, Homo sapiens
ucagucagaucaugagugu

SEQ ID NO: 1235548 - RNA, 19 nt, Homo sapiens
ccggagagauggcggaguu

SEQ ID NO: 1235549 - RNA, 19 nt, Homo sapiens
uuggaaaccuggauugcua

SEQ ID NO: 1235550 - RNA, 19 nt, Homo sapiens
ugacaacaacaaagaugua

SEQ ID NO: 1235551 - RNA, 19 nt, Homo sapiens
guagugacaacaacaaaga

SEQ ID NO: 1235552 - RNA, 19 nt, Homo sapiens
gagacaccgucaucaguca

SEQ ID NO: 1235553 - RNA, 19 nt, Homo sapiens
aaacacaugccaaaugaug

SEQ ID NO: 1235554 - RNA, 19 nt, Homo sapiens
ugggauagcucaacuucau

SEQ ID NO: 1235555 - RNA, 19 nt, Homo sapiens
ggccaagccuagcaucaug

SEQ ID NO: 1235556 - RNA, 19 nt, Homo sapiens
ugauggcgauaagucauua

SEQ ID NO: 1235557 - RNA, 19 nt, Homo sapiens
ggagaaacagcaaguaaac

SEQ ID NO: 1235558 - RNA, 19 nt, Homo sapiens
cuacuacuauauagacaga

SEQ ID NO: 1235559 - RNA, 19 nt, Homo sapiens
ucucaaugaugaagaacaa

SEQ ID NO: 1235560 - RNA, 19 nt, Homo sapiens
guggaaauauaaucuugga

SEQ ID NO: 1235561 - RNA, 19 nt, Homo sapiens
ugaugauuguucaggaaua

SEQ ID NO: 1235562 - RNA, 19 nt, Homo sapiens
uguugaaucuuacuuggaa

SEQ ID NO: 1235563 - RNA, 19 nt, Homo sapiens
caggagaaacagcaaguaa

SEQ ID NO: 1235564 - RNA, 19 nt, Homo sapiens
agacccaccucuagugaga

SEQ ID NO: 1235565 - RNA, 19 nt, Homo sapiens
ucagaaacuuguuaaagac

SEQ ID NO: 1235566 - RNA, 19 nt, Homo sapiens
ggaauaaauuuggaaugcu

SEQ ID NO: 1235567 - RNA, 19 nt, Homo sapiens
uagacagaauggaaaguau

SEQ ID NO: 1235568 - RNA, 19 nt, Homo sapiens
gcaaaacacaugccaaaug

SEQ ID NO: 1235569 - RNA, 19 nt, Homo sapiens
gagaaagagaugaaauaca

SEQ ID NO: 1235570 - RNA, 19 nt, Homo sapiens
ggaugucagcuguugauug

SEQ ID NO: 1235571 - RNA, 19 nt, Homo sapiens
caaagauucaagucagaaa

SEQ ID NO: 1235572 - RNA, 19 nt, Homo sapiens
gagaagccuuacccuugga

SEQ ID NO: 1235573 - RNA, 19 nt, Homo sapiens
gagcaaagagaagagcaaa

SEQ ID NO: 1235574 - RNA, 19 nt, Homo sapiens
uaaagacccaccucuagug

SEQ ID NO: 1235575 - RNA, 19 nt, Homo sapiens
guccugaggugacuguaau

SEQ ID NO: 1235576 - RNA, 19 nt, Homo sapiens
ccacucagaaacuuguuaa

SEQ ID NO: 1235577 - RNA, 19 nt, Homo sapiens
caucuuacccaugcucuuu

SEQ ID NO: 1235578 - RNA, 19 nt, Homo sapiens
ugauaaagacccaccucua

SEQ ID NO: 1235579 - RNA, 19 nt, Homo sapiens
gccuuacccuuggaucaua

SEQ ID NO: 1235580 - RNA, 19 nt, Homo sapiens
cuaaagggagcaaagagaa

SEQ ID NO: 1235581 - RNA, 19 nt, Homo sapiens
guauagccuugcugucugu

SEQ ID NO: 1235582 - RNA, 19 nt, Homo sapiens
ucauggagccagaaaguau

SEQ ID NO: 1235583 - RNA, 19 nt, Homo sapiens
agacugugcugagagagaa

SEQ ID NO: 1235584 - RNA, 19 nt, Homo sapiens
guggcuauagguuuacuua

SEQ ID NO: 1235585 - RNA, 19 nt, Homo sapiens
gaaacagcaaguaaacgau

SEQ ID NO: 1235586 - RNA, 19 nt, Homo sapiens
agucagaucaugaguguga

SEQ ID NO: 1235587 - RNA, 19 nt, Homo sapiens
cagggagucucaugguugu

SEQ ID NO: 1235588 - RNA, 19 nt, Homo sapiens
gaugggauagcucaacuuc

SEQ ID NO: 1235589 - RNA, 19 nt, Homo sapiens
ccauuugugugugaugauu

SEQ ID NO: 1235590 - RNA, 19 nt, Homo sapiens
uaacuuauuuccccuuaug

SEQ ID NO: 1235591 - RNA, 19 nt, Homo sapiens
aaucuuacuuggaauaguc

SEQ ID NO: 1235592 - RNA, 19 nt, Homo sapiens
gaucauacuuuggaaaccu

SEQ ID NO: 1235593 - RNA, 19 nt, Homo sapiens
cuauauagacagaauggaa

SEQ ID NO: 1235594 - RNA, 19 nt, Homo sapiens
gagauuuucuuccauuugu

SEQ ID NO: 1235595 - RNA, 19 nt, Homo sapiens
uagccuugcugucugucua

SEQ ID NO: 1235596 - RNA, 19 nt, Homo sapiens
cauggagccagaaaguaua

SEQ ID NO: 1235597 - RNA, 19 nt, Homo sapiens
gaaaucacagggaaaauuc

SEQ ID NO: 1235598 - RNA, 19 nt, Homo sapiens
gaaucuuacuuggaauagu

SEQ ID NO: 1235599 - RNA, 19 nt, Homo sapiens
cauuauugauuccaagaca

SEQ ID NO: 1235600 - RNA, 19 nt, Homo sapiens
agacagaauggaaaguauu

SEQ ID NO: 1235601 - RNA, 19 nt, Homo sapiens
ccccaaaacuacuacuaua

SEQ ID NO: 1235602 - RNA, 19 nt, Homo sapiens
agacagaucaacauacauc

SEQ ID NO: 1235603 - RNA, 19 nt, Homo sapiens
gaguauucuugacuagugu

SEQ ID NO: 1235604 - RNA, 19 nt, Homo sapiens
ugaaauacacuucgguuuu

SEQ ID NO: 1235605 - RNA, 19 nt, Homo sapiens
uagcagagagagaaagaga

SEQ ID NO: 1235606 - RNA, 19 nt, Homo sapiens
aaagagaagagcaaaccaa

SEQ ID NO: 1235607 - RNA, 19 nt, Homo sapiens
agaaacagcaaguaaacga

SEQ ID NO: 1235608 - RNA, 19 nt, Homo sapiens
gaaauaaacugucacugau

SEQ ID NO: 1235609 - RNA, 19 nt, Homo sapiens
gagcucaacugaucuguuu

SEQ ID NO: 1235610 - RNA, 19 nt, Homo sapiens
gcaaaggccucccugcauu

SEQ ID NO: 1235611 - RNA, 19 nt, Homo sapiens
ugacagcguucuuucuuua

SEQ ID NO: 1235612 - RNA, 19 nt, Homo sapiens
agaacagucucaccaauua

SEQ ID NO: 1235613 - RNA, 19 nt, Homo sapiens
aaaccaagcuuugaacuuu

SEQ ID NO: 1235614 - RNA, 19 nt, Homo sapiens
caacugaucuguuuucuuu

SEQ ID NO: 1235615 - RNA, 19 nt, Homo sapiens
gugaaagaauuccugauuu

SEQ ID NO: 1235616 - RNA, 19 nt, Homo sapiens
ugaauacacugacuaaugu

SEQ ID NO: 1235617 - RNA, 19 nt, Homo sapiens
uaaagcagguuguguuguu

SEQ ID NO: 1235618 - RNA, 19 nt, Homo sapiens
gaaauuggcuguggaucug

SEQ ID NO: 1235619 - RNA, 19 nt, Homo sapiens
guacauacaucgacagagu

SEQ ID NO: 1235620 - RNA, 19 nt, Homo sapiens
gaaccgagcccgaggaguu

SEQ ID NO: 1235621 - RNA, 19 nt, Homo sapiens
cuacacauuucauccuuua

SEQ ID NO: 1235622 - RNA, 19 nt, Homo sapiens
ggaaagaugacgaggauga

SEQ ID NO: 1235623 - RNA, 19 nt, Homo sapiens
uuaaagagcugauacugau

SEQ ID NO: 1235624 - RNA, 19 nt, Homo sapiens
gaaauagacaggaaagaug

SEQ ID NO: 1235625 - RNA, 19 nt, Homo sapiens
aauaucggcuuguggaaua

SEQ ID NO: 1235626 - RNA, 19 nt, Homo sapiens
gcaauggaaccuucuuaaa

SEQ ID NO: 1235627 - RNA, 19 nt, Homo sapiens
ugagagagguuguauuuac

SEQ ID NO: 1235628 - RNA, 19 nt, Homo sapiens
guauugagccacagagaua

SEQ ID NO: 1235629 - RNA, 19 nt, Homo sapiens
uagaggagcucaacugauc

SEQ ID NO: 1235630 - RNA, 19 nt, Homo sapiens
aaacuaagaacccaaacua

SEQ ID NO: 1235631 - RNA, 19 nt, Homo sapiens
gucggacacuucugaaaua

SEQ ID NO: 1235632 - RNA, 19 nt, Homo sapiens
gagcagagaaucuuacuag

SEQ ID NO: 1235633 - RNA, 19 nt, Homo sapiens
gcaagucuccucgcaguaa

SEQ ID NO: 1235634 - RNA, 19 nt, Homo sapiens
aguauuugcugcuuacaua

SEQ ID NO: 1235635 - RNA, 19 nt, Homo sapiens
guugagagagguuguauuu

SEQ ID NO: 1235636 - RNA, 19 nt, Homo sapiens
agaaauaaacugucacuga

SEQ ID NO: 1235637 - RNA, 19 nt, Homo sapiens
ccacagagauacuaugaac

SEQ ID NO: 1235638 - RNA, 19 nt, Homo sapiens
ggaagaagagcgggaguuu

SEQ ID NO: 1235639 - RNA, 19 nt, Homo sapiens
cagauuguguuaccauuug

SEQ ID NO: 1235640 - RNA, 19 nt, Homo sapiens
gugaagcccuacaucauug

SEQ ID NO: 1235641 - RNA, 19 nt, Homo sapiens
gcacagggaaccaucagaa

SEQ ID NO: 1235642 - RNA, 19 nt, Homo sapiens
agaggaauauguguaagua

SEQ ID NO: 1235643 - RNA, 19 nt, Homo sapiens
gaauauacccgugcugaug

SEQ ID NO: 1235644 - RNA, 19 nt, Homo sapiens
cuaagaacccaaacuauug

SEQ ID NO: 1235645 - RNA, 19 nt, Homo sapiens
gagcagguuuucauuuaua

SEQ ID NO: 1235646 - RNA, 19 nt, Homo sapiens
gauacacgguuuccuucuu

SEQ ID NO: 1235647 - RNA, 19 nt, Homo sapiens
caggaaagaugacgaggau

SEQ ID NO: 1235648 - RNA, 19 nt, Homo sapiens
uggcgucucuacccauuua

SEQ ID NO: 1235649 - RNA, 19 nt, Homo sapiens
ucugacagcuagcaaacua

SEQ ID NO: 1235650 - RNA, 19 nt, Homo sapiens
ggacacuucugaaauagac

SEQ ID NO: 1235651 - RNA, 19 nt, Homo sapiens
gagcaucgccagaggaaug

SEQ ID NO: 1235652 - RNA, 19 nt, Homo sapiens
guggaucuguucuuuguga

SEQ ID NO: 1235653 - RNA, 19 nt, Homo sapiens
aaucauggcuuguucucuu

SEQ ID NO: 1235654 - RNA, 19 nt, Homo sapiens
guacucaaauuuggauuca

SEQ ID NO: 1235655 - RNA, 19 nt, Homo sapiens
acagagauacuaugaacua

SEQ ID NO: 1235656 - RNA, 19 nt, Homo sapiens
aauggaaccuucuuaaaca

SEQ ID NO: 1235657 - RNA, 19 nt, Homo sapiens
guacuucaguuuugcauuu

SEQ ID NO: 1235658 - RNA, 19 nt, Homo sapiens
cauauuaacuguacuucag

SEQ ID NO: 1235659 - RNA, 19 nt, Homo sapiens
gagcauguacacaacaauu

SEQ ID NO: 1235660 - RNA, 19 nt, Homo sapiens
gaucacccgucuuguucaa

SEQ ID NO: 1235661 - RNA, 19 nt, Homo sapiens
gaacacaggagagcuagga

SEQ ID NO: 1235662 - RNA, 19 nt, Homo sapiens
gaccuuggcucaggcaaug

SEQ ID NO: 1235663 - RNA, 19 nt, Homo sapiens
uugcagacauuccaauuga

SEQ ID NO: 1235664 - RNA, 19 nt, Homo sapiens
aaaacaaccuccaguauau

SEQ ID NO: 1235665 - RNA, 19 nt, Homo sapiens
caaaacaaccuccaguaua

SEQ ID NO: 1235666 - RNA, 19 nt, Homo sapiens
cagaacugcugccuaggaa

SEQ ID NO: 1235667 - RNA, 19 nt, Homo sapiens
gggaaaucauggcuuguuc

SEQ ID NO: 1235668 - RNA, 19 nt, Homo sapiens
ggugguggguccagcacua

SEQ ID NO: 1235669 - RNA, 19 nt, Homo sapiens
ggagagcuaggaacaguga

SEQ ID NO: 1235670 - RNA, 19 nt, Homo sapiens
gaauauguguaaguagcaa

SEQ ID NO: 1235671 - RNA, 19 nt, Homo sapiens
gugacagcguucuuucuuu

SEQ ID NO: 1235672 - RNA, 19 nt, Homo sapiens
uagcagagaauacgucuug

SEQ ID NO: 1235673 - RNA, 19 nt, Homo sapiens
ggaaccuucuuaaacaaca

SEQ ID NO: 1235674 - RNA, 19 nt, Homo sapiens
gaaugaaggcggugaagag

SEQ ID NO: 1235675 - RNA, 19 nt, Homo sapiens
aauaaacugucacugaugu

SEQ ID NO: 1235676 - RNA, 19 nt, Homo sapiens
gaaccuucuuaaacaacaa

SEQ ID NO: 1235677 - RNA, 19 nt, Homo sapiens
caaaggccucccugcauuu

SEQ ID NO: 1235678 - RNA, 19 nt, Homo sapiens
gaacccaaacuauugauac

SEQ ID NO: 1235679 - RNA, 19 nt, Homo sapiens
uaagaacccaaacuauuga

SEQ ID NO: 1235680 - RNA, 19 nt, Homo sapiens
agaaaaggauguacucaaa

SEQ ID NO: 1235681 - RNA, 19 nt, Homo sapiens
caauugaucacccgucuug

SEQ ID NO: 1235682 - RNA, 19 nt, Homo sapiens
gaacagugaccgggacaga

SEQ ID NO: 1235683 - RNA, 19 nt, Homo sapiens
aaagagcugauacugauuu

SEQ ID NO: 1235684 - RNA, 19 nt, Homo sapiens
guuaaagagcugauacuga

SEQ ID NO: 1235685 - RNA, 19 nt, Homo sapiens
gagaaucuuacuaggcuuu

SEQ ID NO: 1235686 - RNA, 19 nt, Homo sapiens
uaguagaaguguugugguu

SEQ ID NO: 1235687 - RNA, 19 nt, Homo sapiens
ggaaccaucagaacaggaa

SEQ ID NO: 1235688 - RNA, 19 nt, Homo sapiens
aagagcagguuuucauuua

SEQ ID NO: 1235689 - RNA, 19 nt, Homo sapiens
cagaacagucucaccaauu

SEQ ID NO: 1235690 - RNA, 19 nt, Homo sapiens
cagagauacuaugaacuaa

SEQ ID NO: 1235691 - RNA, 19 nt, Homo sapiens
agcaugcggucuuucaaua

SEQ ID NO: 1235692 - RNA, 19 nt, Homo sapiens
gagcuuagaaguugauuuu

SEQ ID NO: 1235693 - RNA, 19 nt, Homo sapiens
caguauauaccaaagcuuu

SEQ ID NO: 1235694 - RNA, 19 nt, Homo sapiens
acuaagaacccaaacuauu

SEQ ID NO: 1235695 - RNA, 19 nt, Homo sapiens
aaauuuggauucaguagca

SEQ ID NO: 1235696 - RNA, 19 nt, Homo sapiens
ccucaccacucaacaguca

SEQ ID NO: 1235697 - RNA, 19 nt, Homo sapiens
caauggaaccuucuuaaac

SEQ ID NO: 1235698 - RNA, 19 nt, Homo sapiens
aaacaaccuccaguauaua

SEQ ID NO: 1235699 - RNA, 19 nt, Homo sapiens
uuacuaggcuuugguuauc

SEQ ID NO: 1235700 - RNA, 19 nt, Homo sapiens
guagaaguguugugguuuu

SEQ ID NO: 1235701 - RNA, 19 nt, Homo sapiens
ucagaacagucucaccaau

SEQ ID NO: 1235702 - RNA, 19 nt, Homo sapiens
uuaagucuuuccucuguug

SEQ ID NO: 1235703 - RNA, 19 nt, Homo sapiens
ggcaauggaaccuucuuaa

SEQ ID NO: 1235704 - RNA, 19 nt, Homo sapiens
gaagagcagguuuucauuu

SEQ ID NO: 1235705 - RNA, 19 nt, Homo sapiens
guacagaaggauccugguu

SEQ ID NO: 1235706 - RNA, 19 nt, Homo sapiens
aaauagacaggaaagauga

SEQ ID NO: 1235707 - RNA, 19 nt, Homo sapiens
acaguuggccgaagaguga

SEQ ID NO: 1235708 - RNA, 19 nt, Homo sapiens
ggagaagauugccaaguua

SEQ ID NO: 1235709 - RNA, 19 nt, Homo sapiens
ggaaggcccuggcuuugua

SEQ ID NO: 1235710 - RNA, 19 nt, Homo sapiens
gcacugaguuucuuaggaa

SEQ ID NO: 1235711 - RNA, 19 nt, Homo sapiens
ggaagaagccgucugacua

SEQ ID NO: 1235712 - RNA, 19 nt, Homo sapiens
ggaggacuuugcaugauua

SEQ ID NO: 1235713 - RNA, 19 nt, Homo sapiens
ggaaauuugucuucaguau

SEQ ID NO: 1235714 - RNA, 19 nt, Homo sapiens
caccaucgcccacuuauua

SEQ ID NO: 1235715 - RNA, 19 nt, Homo sapiens
gaaggugugucaaggugua

SEQ ID NO: 1235716 - RNA, 19 nt, Homo sapiens
ccacggcuguugcucaaua

SEQ ID NO: 1235717 - RNA, 19 nt, Homo sapiens
guucugcccuuucaucuuu

SEQ ID NO: 1235718 - RNA, 19 nt, Homo sapiens
gaaccuacccucucaaugg

SEQ ID NO: 1235719 - RNA, 19 nt, Homo sapiens
ggacuuugcaugauuaguu

SEQ ID NO: 1235720 - RNA, 19 nt, Homo sapiens
gaaugugugaggcuucuua

SEQ ID NO: 1235721 - RNA, 19 nt, Homo sapiens
uggagaagauugccaaguu

SEQ ID NO: 1235722 - RNA, 19 nt, Homo sapiens
gcacuggguucugcccuuu

SEQ ID NO: 1235723 - RNA, 19 nt, Homo sapiens
gagcgggaguuccgaaugu

SEQ ID NO: 1235724 - RNA, 19 nt, Homo sapiens
ccaagugcuucgaguacua

SEQ ID NO: 1235725 - RNA, 19 nt, Homo sapiens
gagaagauugccaaguuaa

SEQ ID NO: 1235726 - RNA, 19 nt, Homo sapiens
ucaaagugcugcucaaugc

SEQ ID NO: 1235727 - RNA, 19 nt, Homo sapiens
gggagcaucuggacugugu

SEQ ID NO: 1235728 - RNA, 19 nt, Homo sapiens
gugugaggcuucuuauuga

SEQ ID NO: 1235729 - RNA, 19 nt, Homo sapiens
cgagaugcuuaucgaguuu

SEQ ID NO: 1235730 - RNA, 19 nt, Homo sapiens
guccuaaacugagaagaaa

SEQ ID NO: 1235731 - RNA, 19 nt, Homo sapiens
guucagggaugagugguuu

SEQ ID NO: 1235732 - RNA, 19 nt, Homo sapiens
gcuaacuccuugaagcuau

SEQ ID NO: 1235733 - RNA, 19 nt, Homo sapiens
gaagaagccgucugacuac

SEQ ID NO: 1235734 - RNA, 19 nt, Homo sapiens
cgugauugcuguagauaga

SEQ ID NO: 1235735 - RNA, 19 nt, Homo sapiens
caagaauguugaccucauc

SEQ ID NO: 1235736 - RNA, 19 nt, Homo sapiens
uugauuaccucuccuacaa

SEQ ID NO: 1235737 - RNA, 19 nt, Homo sapiens
cggccaaggucaagaaugu

SEQ ID NO: 1235738 - RNA, 19 nt, Homo sapiens
gagacagugugccgggaaa

SEQ ID NO: 1235739 - RNA, 19 nt, Homo sapiens
gucuuugccuucauaaauu

SEQ ID NO: 1235740 - RNA, 19 nt, Homo sapiens
aaacaggucguucugcauu

SEQ ID NO: 1235741 - RNA, 19 nt, Homo sapiens
gcccacuuauuauuuaguu

SEQ ID NO: 1235742 - RNA, 19 nt, Homo sapiens
guugucaaaugaauucuuc

SEQ ID NO: 1235743 - RNA, 19 nt, Homo sapiens
ggugagggcucugccuguu

SEQ ID NO: 1235744 - RNA, 19 nt, Homo sapiens
ggucuucguccuaaacuga

SEQ ID NO: 1235745 - RNA, 19 nt, Homo sapiens
caucgcccacuuauuauuu

SEQ ID NO: 1235746 - RNA, 19 nt, Homo sapiens
uggaggacuuugcaugauu

SEQ ID NO: 1235747 - RNA, 19 nt, Homo sapiens
ucuaucacauccagcauug

SEQ ID NO: 1235748 - RNA, 19 nt, Homo sapiens
ccacuaagguuuugguaau

SEQ ID NO: 1235749 - RNA, 19 nt, Homo sapiens
gcaucuggacugugucaaa

SEQ ID NO: 1235750 - RNA, 19 nt, Homo sapiens
gacuuugcaugauuaguuc

SEQ ID NO: 1235751 - RNA, 19 nt, Homo sapiens
agccauagguggagcauuc

SEQ ID NO: 1235752 - RNA, 19 nt, Homo sapiens
ugugugaggcuucuuauug

SEQ ID NO: 1235753 - RNA, 19 nt, Homo sapiens
uaggaaauuugucuucagu

SEQ ID NO: 1235754 - RNA, 19 nt, Homo sapiens
gcugcuguguggaugcuuu

SEQ ID NO: 1235755 - RNA, 19 nt, Homo sapiens
uacagaaccuacccucuca

SEQ ID NO: 1235756 - RNA, 19 nt, Homo sapiens
gaagauugccaaguuaaac

SEQ ID NO: 1235757 - RNA, 19 nt, Homo sapiens
aacaggucguucugcauua

SEQ ID NO: 1235758 - RNA, 19 nt, Homo sapiens
gcuaucaaauuaguaagag

SEQ ID NO: 1235759 - RNA, 19 nt, Homo sapiens
ccacaaguagcacugaguu

SEQ ID NO: 1235760 - RNA, 19 nt, Homo sapiens
caacgugaaugcggcaaag

SEQ ID NO: 1235761 - RNA, 19 nt, Homo sapiens
aggagucuuugccuucaua

SEQ ID NO: 1235762 - RNA, 19 nt, Homo sapiens
gggcauuguugcugauucu

SEQ ID NO: 1235763 - RNA, 19 nt, Homo sapiens
gauuaccucuccuacaacu

SEQ ID NO: 1235764 - RNA, 19 nt, Homo sapiens
aagaaaagcauuccuguuu

SEQ ID NO: 1235765 - RNA, 19 nt, Homo sapiens
gaaggucggccugggaugu

SEQ ID NO: 1235766 - RNA, 19 nt, Homo sapiens
gcgggaagaagccgucuga

SEQ ID NO: 1235767 - RNA, 19 nt, Homo sapiens
uggagacucugugggaauu

SEQ ID NO: 1235768 - RNA, 19 nt, Homo sapiens
cgucucaggucacaguugu

SEQ ID NO: 1235769 - RNA, 19 nt, Homo sapiens
caucuggacugugucaaag

SEQ ID NO: 1235770 - RNA, 19 nt, Homo sapiens
gaaacaggucguucugcau

SEQ ID NO: 1235771 - RNA, 19 nt, Homo sapiens
gagacucugugggaauugu

SEQ ID NO: 1235772 - RNA, 19 nt, Homo sapiens
aguauuaggucuccaacuc

SEQ ID NO: 1235773 - RNA, 19 nt, Homo sapiens
gaagcgcacgauugccauu

SEQ ID NO: 1235774 - RNA, 19 nt, Homo sapiens
gcaccaucgcccacuuauu

SEQ ID NO: 1235775 - RNA, 19 nt, Homo sapiens
uuucuaugguugucaaaug

SEQ ID NO: 1235776 - RNA, 19 nt, Homo sapiens
caaaccgacagcaguguga

SEQ ID NO: 1235777 - RNA, 19 nt, Homo sapiens
ggcgguaccacuaagguuu

SEQ ID NO: 1235778 - RNA, 19 nt, Homo sapiens
uauuaggucuccaacucuu

SEQ ID NO: 1235779 - RNA, 19 nt, Homo sapiens
gggcccaaccauccaguuu

SEQ ID NO: 1235780 - RNA, 19 nt, Homo sapiens
gccaaggcaggauaagaaa

SEQ ID NO: 1235781 - RNA, 19 nt, Homo sapiens
uuaccucuccuacaacuga

SEQ ID NO: 1235782 - RNA, 19 nt, Homo sapiens
uccgagggcuggagaagau

SEQ ID NO: 1235783 - RNA, 19 nt, Homo sapiens
gccaaggucaagaauguug

SEQ ID NO: 1235784 - RNA, 19 nt, Homo sapiens
gcagggugaacuugaggaa

SEQ ID NO: 1235785 - RNA, 19 nt, Homo sapiens
gaagaaaagcauuccuguu

SEQ ID NO: 1235786 - RNA, 19 nt, Homo sapiens
cguccuaaacugagaagaa

SEQ ID NO: 1235787 - RNA, 19 nt, Homo sapiens
ggucaggaguucgaaacca

SEQ ID NO: 1235788 - RNA, 19 nt, Homo sapiens
gcagacaguguggaacaga

SEQ ID NO: 1235789 - RNA, 19 nt, Homo sapiens
ucacccacccuacaguuug

SEQ ID NO: 1235790 - RNA, 19 nt, Homo sapiens
gcagugugaagguguguca

SEQ ID NO: 1235791 - RNA, 19 nt, Homo sapiens
gagcaucuggacuguguca

SEQ ID NO: 1235792 - RNA, 19 nt, Homo sapiens
ggucuccaacucuuguaaa

SEQ ID NO: 1235793 - RNA, 19 nt, Homo sapiens
caaguagcacugaguuucu

SEQ ID NO: 1235794 - RNA, 19 nt, Homo sapiens
acaaguagcacugaguuuc

SEQ ID NO: 1235795 - RNA, 19 nt, Homo sapiens
ucacucagggacuuucuau

SEQ ID NO: 1235796 - RNA, 19 nt, Homo sapiens
agaagauugccaaguuaaa

SEQ ID NO: 1235797 - RNA, 19 nt, Homo sapiens
gggaagaagccgucugacu

SEQ ID NO: 1235798 - RNA, 19 nt, Homo sapiens
cacggcuguugcucaauaa

SEQ ID NO: 1235799 - RNA, 19 nt, Homo sapiens
cuaggagucuuugccuuca

SEQ ID NO: 1235800 - RNA, 19 nt, Homo sapiens
acaggucguucugcauuau

SEQ ID NO: 1235801 - RNA, 19 nt, Homo sapiens
ucagugcaaaggccuguuu

SEQ ID NO: 1235802 - RNA, 19 nt, Homo sapiens
gugucaagguguauauucu

SEQ ID NO: 1235803 - RNA, 19 nt, Homo sapiens
gggaaggcccuggcuuugu

SEQ ID NO: 1235804 - RNA, 19 nt, Homo sapiens
agucuuugccuucauaaau

SEQ ID NO: 1235805 - RNA, 19 nt, Homo sapiens
gaaggcccuggcuuuguau

SEQ ID NO: 1235806 - RNA, 19 nt, Homo sapiens
ucucacaguagagcacuua

SEQ ID NO: 1235807 - RNA, 19 nt, Homo sapiens
augauuaguucagggauga

SEQ ID NO: 1235808 - RNA, 19 nt, Homo sapiens
ggaaagcccuucaaguaua

SEQ ID NO: 1235809 - RNA, 19 nt, Homo sapiens
gaaagcccuucaaguauaa

SEQ ID NO: 1235810 - RNA, 19 nt, Homo sapiens
gaaguauggucuuuguaaa

SEQ ID NO: 1235811 - RNA, 19 nt, Homo sapiens
caggaaagcccuucaagua

SEQ ID NO: 1235812 - RNA, 19 nt, Homo sapiens
caccagaguuuccacauaa

SEQ ID NO: 1235813 - RNA, 19 nt, Homo sapiens
ccaauaaacucauaugaac

SEQ ID NO: 1235814 - RNA, 19 nt, Homo sapiens
gaacuggcacuuucacauu

SEQ ID NO: 1235815 - RNA, 19 nt, Homo sapiens
ccaguaagccucaauguug

SEQ ID NO: 1235816 - RNA, 19 nt, Homo sapiens
ccaagugcccuaaaucuaa

SEQ ID NO: 1235817 - RNA, 19 nt, Homo sapiens
aaugagaagucacaucuuu

SEQ ID NO: 1235818 - RNA, 19 nt, Homo sapiens
ccaccagaguuuccacaua

SEQ ID NO: 1235819 - RNA, 19 nt, Homo sapiens
gcucucaccugcuugaaga

SEQ ID NO: 1235820 - RNA, 19 nt, Homo sapiens
ucaaagagcggaagccaaa

SEQ ID NO: 1235821 - RNA, 19 nt, Homo sapiens
cagugaauguucuggcuua

SEQ ID NO: 1235822 - RNA, 19 nt, Homo sapiens
ucaagaggcuauuuauaca

SEQ ID NO: 1235823 - RNA, 19 nt, Homo sapiens
cuucaggccuguuaagaaa

SEQ ID NO: 1235824 - RNA, 19 nt, Homo sapiens
gccgauuccuuacggauuu

SEQ ID NO: 1235825 - RNA, 19 nt, Homo sapiens
ugaaguauggucuuuguaa

SEQ ID NO: 1235826 - RNA, 19 nt, Homo sapiens
gaaccauaaggaaacauaa

SEQ ID NO: 1235827 - RNA, 19 nt, Homo sapiens
caaaagaggacaagucuaa

SEQ ID NO: 1235828 - RNA, 19 nt, Homo sapiens
ggaaaccgccagcuucuca

SEQ ID NO: 1235829 - RNA, 19 nt, Homo sapiens
ggagcucgccugaguguga

SEQ ID NO: 1235830 - RNA, 19 nt, Homo sapiens
gcaaugagaagucacaucu

SEQ ID NO: 1235831 - RNA, 19 nt, Homo sapiens
caucaagaggcuauuuaua

SEQ ID NO: 1235832 - RNA, 19 nt, Homo sapiens
gggaagacaucaaggaaaa

SEQ ID NO: 1235833 - RNA, 19 nt, Homo sapiens
gccaagaggcccaguguga

SEQ ID NO: 1235834 - RNA, 19 nt, Homo sapiens
caagacacacccacacuga

SEQ ID NO: 1235835 - RNA, 19 nt, Homo sapiens
ucagagcucucaccugcuu

SEQ ID NO: 1235836 - RNA, 19 nt, Homo sapiens
ccaagucugucgcaaaugg

SEQ ID NO: 1235837 - RNA, 19 nt, Homo sapiens
ccucugaacuggcacuuuc

SEQ ID NO: 1235838 - RNA, 19 nt, Homo sapiens
uccaagaaaucagagauaa

SEQ ID NO: 1235839 - RNA, 19 nt, Homo sapiens
caugaaguauggucuuugu

SEQ ID NO: 1235840 - RNA, 19 nt, Homo sapiens
gcaggaccuuccacucaau

SEQ ID NO: 1235841 - RNA, 19 nt, Homo sapiens
ggaaccugcugcugcuguu

SEQ ID NO: 1235842 - RNA, 19 nt, Homo sapiens
ugaaugacucuaagacuga

SEQ ID NO: 1235843 - RNA, 19 nt, Homo sapiens
caaugucccuuuacuugca

SEQ ID NO: 1235844 - RNA, 19 nt, Homo sapiens
agagcuggcuucugauaga

SEQ ID NO: 1235845 - RNA, 19 nt, Homo sapiens
acucuaagacugauaugua

SEQ ID NO: 1235846 - RNA, 19 nt, Homo sapiens
gacacuggcuuuacacaac

SEQ ID NO: 1235847 - RNA, 19 nt, Homo sapiens
uuaaucacaugaaguaugg

SEQ ID NO: 1235848 - RNA, 19 nt, Homo sapiens
ccaagaaaucagagauaaa

SEQ ID NO: 1235849 - RNA, 19 nt, Homo sapiens
uguacgaccucuccaacaa

SEQ ID NO: 1235850 - RNA, 19 nt, Homo sapiens
acagaagacugggacagaa

SEQ ID NO: 1235851 - RNA, 19 nt, Homo sapiens
caagaaaucagagauaaac

SEQ ID NO: 1235852 - RNA, 19 nt, Homo sapiens
gcaagcgugagaacaggua

SEQ ID NO: 1235853 - RNA, 19 nt, Homo sapiens
cacaugaaguauggucuuu

SEQ ID NO: 1235854 - RNA, 19 nt, Homo sapiens
ggugaagguauuaucaauu

SEQ ID NO: 1235855 - RNA, 19 nt, Homo sapiens
caguaagccucaauguugu

SEQ ID NO: 1235856 - RNA, 19 nt, Homo sapiens
gugcauuacuggugaaggu

SEQ ID NO: 1235857 - RNA, 19 nt, Homo sapiens
acagcagagucuccaguaa

SEQ ID NO: 1235858 - RNA, 19 nt, Homo sapiens
cccuaaaucuaacucacua

SEQ ID NO: 1235859 - RNA, 19 nt, Homo sapiens
cauuaaagugccauaugua

SEQ ID NO: 1235860 - RNA, 19 nt, Homo sapiens
cuacaacaccucugaacug

SEQ ID NO: 1235861 - RNA, 19 nt, Homo sapiens
ugaaccauaaggaaacaua

SEQ ID NO: 1235862 - RNA, 19 nt, Homo sapiens
ugaauguucuggcuuacuc

SEQ ID NO: 1235863 - RNA, 19 nt, Homo sapiens
uagggaaagugcauuacug

SEQ ID NO: 1235864 - RNA, 19 nt, Homo sapiens
uaacacacaaacaucaaga

SEQ ID NO: 1235865 - RNA, 19 nt, Homo sapiens
gaaugacucuaagacugau

SEQ ID NO: 1235866 - RNA, 19 nt, Homo sapiens
cuuccaagguggcaagcua

SEQ ID NO: 1235867 - RNA, 19 nt, Homo sapiens
ccgagacacuggcuuuaca

SEQ ID NO: 1235868 - RNA, 19 nt, Homo sapiens
caagaggcuauuuauacaa

SEQ ID NO: 1235869 - RNA, 19 nt, Homo sapiens
aaacaucaagaggcuauuu

SEQ ID NO: 1235870 - RNA, 19 nt, Homo sapiens
caagcuacaacaccucuga

SEQ ID NO: 1235871 - RNA, 19 nt, Homo sapiens
caagugcccuaaaucuaac

SEQ ID NO: 1235872 - RNA, 19 nt, Homo sapiens
aacuggcacuuucacauuu

SEQ ID NO: 1235873 - RNA, 19 nt, Homo sapiens
cagaguacccgccucacuu

SEQ ID NO: 1235874 - RNA, 19 nt, Homo sapiens
gcuuauaauguuacaguga

SEQ ID NO: 1235875 - RNA, 19 nt, Homo sapiens
guucccaagugcccuaaau

SEQ ID NO: 1235876 - RNA, 19 nt, Homo sapiens
ccacacacacgccuuccaa

SEQ ID NO: 1235877 - RNA, 19 nt, Homo sapiens
cuaaccugccgauuccuua

SEQ ID NO: 1235878 - RNA, 19 nt, Homo sapiens
cauacgaucacuacagguu

SEQ ID NO: 1235879 - RNA, 19 nt, Homo sapiens
uaucucaccauuacaacaa

SEQ ID NO: 1235880 - RNA, 19 nt, Homo sapiens
uccaaugucccuuuacuug

SEQ ID NO: 1235881 - RNA, 19 nt, Homo sapiens
gagccaagaggcccagugu

SEQ ID NO: 1235882 - RNA, 19 nt, Homo sapiens
cucgaguccuuccagguua

SEQ ID NO: 1235883 - RNA, 19 nt, Homo sapiens
aggaaagcccuucaaguau

SEQ ID NO: 1235884 - RNA, 19 nt, Homo sapiens
cagcucggccuucugcauu

SEQ ID NO: 1235885 - RNA, 19 nt, Homo sapiens
cucuaagacugauauguau

SEQ ID NO: 1235886 - RNA, 19 nt, Homo sapiens
caaccucuccaagaaauca

SEQ ID NO: 1235887 - RNA, 19 nt, Homo sapiens
uauccagccucgaguccuu

SEQ ID NO: 1235888 - RNA, 19 nt, Homo sapiens
gcucggccuucugcauuug

SEQ ID NO: 1235889 - RNA, 19 nt, Homo sapiens
ugauguguauguugcuaau

SEQ ID NO: 1235890 - RNA, 19 nt, Homo sapiens
ccucagacccaaaggacaa

SEQ ID NO: 1235891 - RNA, 19 nt, Homo sapiens
ucgaguccuuccagguuaa

SEQ ID NO: 1235892 - RNA, 19 nt, Homo sapiens
ccacauacgaucacuacag

SEQ ID NO: 1235893 - RNA, 19 nt, Homo sapiens
agaguacccgccucacuuu

SEQ ID NO: 1235894 - RNA, 19 nt, Homo sapiens
cagggaagacaucaaggaa

SEQ ID NO: 1235895 - RNA, 19 nt, Homo sapiens
cauuacuggugaagguauu

SEQ ID NO: 1235896 - RNA, 19 nt, Homo sapiens
ucuaagggaugcuggaaaa

SEQ ID NO: 1235897 - RNA, 19 nt, Homo sapiens
guccaauuccugaggcuaa

SEQ ID NO: 1235898 - RNA, 19 nt, Homo sapiens
cgaguucgaaaguccaauu

SEQ ID NO: 1235899 - RNA, 19 nt, Homo sapiens
ccacauaaaaucucaucua

SEQ ID NO: 1235900 - RNA, 19 nt, Homo sapiens
ccaaggccgugucuuucca

SEQ ID NO: 1235901 - RNA, 19 nt, Homo sapiens
ccagggaagacaucaagga

SEQ ID NO: 1235902 - RNA, 19 nt, Homo sapiens
uuccaagucugucgcaaau

SEQ ID NO: 1235903 - RNA, 19 nt, Homo sapiens
cccaagugcccuaaaucua

SEQ ID NO: 1235904 - RNA, 19 nt, Homo sapiens
uggugaagguauuaucaau

SEQ ID NO: 1235905 - RNA, 19 nt, Homo sapiens
aacaucaagaggcuauuua

SEQ ID NO: 1235906 - RNA, 19 nt, Homo sapiens
acaaacaucaagaggcuau

SEQ ID NO: 1235907 - RNA, 19 nt, Homo sapiens
gcucuagcugcauauuuga

SEQ ID NO: 1235908 - RNA, 19 nt, Homo sapiens
ugacugggauucaugaugu

SEQ ID NO: 1235909 - RNA, 19 nt, Homo sapiens
guaagcacaccuaugguuu

SEQ ID NO: 1235910 - RNA, 19 nt, Homo sapiens
ugaaaggaaggauggauaa

SEQ ID NO: 1235911 - RNA, 19 nt, Homo sapiens
ccacccacgugucucauug

SEQ ID NO: 1235912 - RNA, 19 nt, Homo sapiens
gcacagggagagcaguuga

SEQ ID NO: 1235913 - RNA, 19 nt, Homo sapiens
gguaagcacaccuaugguu

SEQ ID NO: 1235914 - RNA, 19 nt, Homo sapiens
ggucgccucugccuaguca

SEQ ID NO: 1235915 - RNA, 19 nt, Homo sapiens
uuucaaaguucgagacuca

SEQ ID NO: 1235916 - RNA, 19 nt, Homo sapiens
aaggaaggauggauaacga

SEQ ID NO: 1235917 - RNA, 19 nt, Homo sapiens
cauuguggcugccuaugga

SEQ ID NO: 1235918 - RNA, 19 nt, Homo sapiens
gcgaagguuuugucuguuu

SEQ ID NO: 1235919 - RNA, 19 nt, Homo sapiens
ggauggauaacgaggagaa

SEQ ID NO: 1235920 - RNA, 19 nt, Homo sapiens
guaucuucaugggacauua

SEQ ID NO: 1235921 - RNA, 19 nt, Homo sapiens
acacuggccugucugaacu

SEQ ID NO: 1235922 - RNA, 19 nt, Homo sapiens
cagcgaagguuuugucugu

SEQ ID NO: 1235923 - RNA, 19 nt, Homo sapiens
ggaagccaagguacagaga

SEQ ID NO: 1235924 - RNA, 19 nt, Homo sapiens
cugaaaggaaggauggaua

SEQ ID NO: 1235925 - RNA, 19 nt, Homo sapiens
ggcccauccucaacagcua

SEQ ID NO: 1235926 - RNA, 19 nt, Homo sapiens
gaccugcugucugcuguca

SEQ ID NO: 1235927 - RNA, 19 nt, Homo sapiens
guacuggcacccaaguuca

SEQ ID NO: 1235928 - RNA, 19 nt, Homo sapiens
gaggcaggaagccaaggua

SEQ ID NO: 1235929 - RNA, 19 nt, Homo sapiens
ccaggcccuuccacugauu

SEQ ID NO: 1235930 - RNA, 19 nt, Homo sapiens
gguacuggcacccaaguuc

SEQ ID NO: 1235931 - RNA, 19 nt, Homo sapiens
ggauaacgaggagaaaaua

SEQ ID NO: 1235932 - RNA, 19 nt, Homo sapiens
gcccauaccaagacucugu

SEQ ID NO: 1235933 - RNA, 19 nt, Homo sapiens
gccaggcccuuccacugau

SEQ ID NO: 1235934 - RNA, 19 nt, Homo sapiens
uuaacuugcugagauuuag

SEQ ID NO: 1235935 - RNA, 19 nt, Homo sapiens
gcaggaagccaagguacag

SEQ ID NO: 1235936 - RNA, 19 nt, Homo sapiens
ccacugaggaaggaaaugu

SEQ ID NO: 1235937 - RNA, 19 nt, Homo sapiens
gaaaggaaggauggauaac

SEQ ID NO: 1235938 - RNA, 19 nt, Homo sapiens
uuacuggugcugaaaggaa

SEQ ID NO: 1235939 - RNA, 19 nt, Homo sapiens
gaaccauugcuggaucuca

SEQ ID NO: 1235940 - RNA, 19 nt, Homo sapiens
cugaugcugugccuuguca

SEQ ID NO: 1235941 - RNA, 19 nt, Homo sapiens
gcacaccuaugguuuuggu

SEQ ID NO: 1235942 - RNA, 19 nt, Homo sapiens
gacauuagggguuuucuau

SEQ ID NO: 1235943 - RNA, 19 nt, Homo sapiens
gcugcaagagggaccaaga

SEQ ID NO: 1235944 - RNA, 19 nt, Homo sapiens
ggagaaaauaaaacuguga

SEQ ID NO: 1235945 - RNA, 19 nt, Homo sapiens
gauaacgaggagaaaauaa

SEQ ID NO: 1235946 - RNA, 19 nt, Homo sapiens
gggcugcuccugucaugca

SEQ ID NO: 1235947 - RNA, 19 nt, Homo sapiens
caagucuuuacaccugaua

SEQ ID NO: 1235948 - RNA, 19 nt, Homo sapiens
uaacuugcugagauuuaga

SEQ ID NO: 1235949 - RNA, 19 nt, Homo sapiens
ggacucugcuucucuauuu

SEQ ID NO: 1235950 - RNA, 19 nt, Homo sapiens
aaagagagcucacagaaga

SEQ ID NO: 1235951 - RNA, 19 nt, Homo sapiens
gaaagaacaccauuugaug

SEQ ID NO: 1235952 - RNA, 19 nt, Homo sapiens
caaagcaacugcccuugaa

SEQ ID NO: 1235953 - RNA, 19 nt, Homo sapiens
agaauugccuuagaagaua

SEQ ID NO: 1235954 - RNA, 19 nt, Homo sapiens
gaggagaaacucauugaaa

SEQ ID NO: 1235955 - RNA, 19 nt, Homo sapiens
aaacugcacuuuacauauc

SEQ ID NO: 1235956 - RNA, 19 nt, Homo sapiens
cagguugcauggucaauaa

SEQ ID NO: 1235957 - RNA, 19 nt, Homo sapiens
gcucagacauuuaaauagg

SEQ ID NO: 1235958 - RNA, 19 nt, Homo sapiens
ggaggaauguugguucaga

SEQ ID NO: 1235959 - RNA, 19 nt, Homo sapiens
ccaagcaaaucuggaaauu

SEQ ID NO: 1235960 - RNA, 19 nt, Homo sapiens
cacagaagauggacuugaa

SEQ ID NO: 1235961 - RNA, 19 nt, Homo sapiens
gcaaagcaacugcccuuga

SEQ ID NO: 1235962 - RNA, 19 nt, Homo sapiens
ccaaacugcacuuuacaua

SEQ ID NO: 1235963 - RNA, 19 nt, Homo sapiens
ccaauacucugggugugua

SEQ ID NO: 1235964 - RNA, 19 nt, Homo sapiens
cuaugaaucugcauguaaa

SEQ ID NO: 1235965 - RNA, 19 nt, Homo sapiens
gcuaugaaucugcauguaa

SEQ ID NO: 1235966 - RNA, 19 nt, Homo sapiens
guaccagaauugccuuaga

SEQ ID NO: 1235967 - RNA, 19 nt, Homo sapiens
ggaagccaguuucuacaca

SEQ ID NO: 1235968 - RNA, 19 nt, Homo sapiens
gaggaauguugguucagaa

SEQ ID NO: 1235969 - RNA, 19 nt, Homo sapiens
cgaaagaacaccauuugau

SEQ ID NO: 1235970 - RNA, 19 nt, Homo sapiens
gaugggaacuuuuauuuca

SEQ ID NO: 1235971 - RNA, 19 nt, Homo sapiens
uaccagaauugccuuagaa

SEQ ID NO: 1235972 - RNA, 19 nt, Homo sapiens
aggagaaacucauugaaau

SEQ ID NO: 1235973 - RNA, 19 nt, Homo sapiens
gaagaggagaaacucauug

SEQ ID NO: 1235974 - RNA, 19 nt, Homo sapiens
gagaggcaguuccuaccuu

SEQ ID NO: 1235975 - RNA, 19 nt, Homo sapiens
gaauguugguucagaaacu

SEQ ID NO: 1235976 - RNA, 19 nt, Homo sapiens
gagaaccacccuugcuuga

SEQ ID NO: 1235977 - RNA, 19 nt, Homo sapiens
uccauguucugaucaauaa

SEQ ID NO: 1235978 - RNA, 19 nt, Homo sapiens
gcaggaacauaaacuccau

SEQ ID NO: 1235979 - RNA, 19 nt, Homo sapiens
uacaagggaugggaacuuu

SEQ ID NO: 1235980 - RNA, 19 nt, Homo sapiens
ggagaaacucauugaaauc

SEQ ID NO: 1235981 - RNA, 19 nt, Homo sapiens
ccagguugguagcuucuuu

SEQ ID NO: 1235982 - RNA, 19 nt, Homo sapiens
caaacugcacuuuacauau

SEQ ID NO: 1235983 - RNA, 19 nt, Homo sapiens
gcagguugcauggucaaua

SEQ ID NO: 1235984 - RNA, 19 nt, Homo sapiens
uaaacuccauguucugauc

SEQ ID NO: 1235985 - RNA, 19 nt, Homo sapiens
cagaauugccuuagaagau

SEQ ID NO: 1235986 - RNA, 19 nt, Homo sapiens
aaacuuugcugccaauacu

SEQ ID NO: 1235987 - RNA, 19 nt, Homo sapiens
acagcuggcucagacauuu

SEQ ID NO: 1235988 - RNA, 19 nt, Homo sapiens
gaucuccaguccgaaagaa

SEQ ID NO: 1235989 - RNA, 19 nt, Homo sapiens
caccaagaguggcuaugaa

SEQ ID NO: 1235990 - RNA, 19 nt, Homo sapiens
uggcucagacauuuaaaua

SEQ ID NO: 1235991 - RNA, 19 nt, Homo sapiens
aaacugaacaccaaugauc

SEQ ID NO: 1235992 - RNA, 19 nt, Homo sapiens
ggaggaaacagcggcauug

SEQ ID NO: 1235993 - RNA, 19 nt, Homo sapiens
gaucggaagccaguuucua

SEQ ID NO: 1235994 - RNA, 19 nt, Homo sapiens
ucaucaagguccugugaga

SEQ ID NO: 1235995 - RNA, 19 nt, Homo sapiens
acagugcgguaccagaauu

SEQ ID NO: 1235996 - RNA, 19 nt, Homo sapiens
gaacagcuggcucagacau

SEQ ID NO: 1235997 - RNA, 19 nt, Homo sapiens
cacccuugcuugaggaauu

SEQ ID NO: 1235998 - RNA, 19 nt, Homo sapiens
uagcuucuuuggagacuug

SEQ ID NO: 1235999 - RNA, 19 nt, Homo sapiens
aaacagcggcauuggcaaa

SEQ ID NO: 1236000 - RNA, 19 nt, Homo sapiens
ucauugaaauccuggaaca

SEQ ID NO: 1236001 - RNA, 19 nt, Homo sapiens
gccaguuucuacacacuug

SEQ ID NO: 1236002 - RNA, 19 nt, Homo sapiens
uggcuucucuuuccucugu

SEQ ID NO: 1236003 - RNA, 19 nt, Homo sapiens
uggaagcagugaucuguuc

SEQ ID NO: 1236004 - RNA, 19 nt, Homo sapiens
caagaguggcuaugaaucu

SEQ ID NO: 1236005 - RNA, 19 nt, Homo sapiens
gaauugccuuagaagauac

SEQ ID NO: 1236006 - RNA, 19 nt, Homo sapiens
gaaucugcauguaaagacu

SEQ ID NO: 1236007 - RNA, 19 nt, Homo sapiens
gggcuucuuuggcgagaug

SEQ ID NO: 1236008 - RNA, 19 nt, Homo sapiens
caggaggaauguugguuca

SEQ ID NO: 1236009 - RNA, 19 nt, Homo sapiens
cgaagaggagaaacucauu

SEQ ID NO: 1236010 - RNA, 19 nt, Homo sapiens
ugauggaacuauggucuau

SEQ ID NO: 1236011 - RNA, 19 nt, Homo sapiens
ucuagggaccagugaauaa

SEQ ID NO: 1236012 - RNA, 19 nt, Homo sapiens
acacuugccucucgcuaca

SEQ ID NO: 1236013 - RNA, 19 nt, Homo sapiens
ccuugggaauggaagauuu

SEQ ID NO: 1236014 - RNA, 19 nt, Homo sapiens
cauaaacuccauguucuga

SEQ ID NO: 1236015 - RNA, 19 nt, Homo sapiens
caagggaugggaacuuuua

SEQ ID NO: 1236016 - RNA, 19 nt, Homo sapiens
gaaacugaacaccaaugau

SEQ ID NO: 1236017 - RNA, 19 nt, Homo sapiens
gcucacagaagauggacuu

SEQ ID NO: 1236018 - RNA, 19 nt, Homo sapiens
caagaggcagcaagugguu

SEQ ID NO: 1236019 - RNA, 19 nt, Homo sapiens
uaaaagagagcucacagaa

SEQ ID NO: 1236020 - RNA, 19 nt, Homo sapiens
ucucugcgguucccucuca

SEQ ID NO: 1236021 - RNA, 19 nt, Homo sapiens
guucccaaacugcacuuua

SEQ ID NO: 1236022 - RNA, 19 nt, Homo sapiens
aagggacucugcuucucua

SEQ ID NO: 1236023 - RNA, 19 nt, Homo sapiens
guaagggacucugcuucuc

SEQ ID NO: 1236024 - RNA, 19 nt, Homo sapiens
ucccugugcuggagaaaga

SEQ ID NO: 1236025 - RNA, 19 nt, Homo sapiens
ugucugaucccaagcaaau

SEQ ID NO: 1236026 - RNA, 19 nt, Homo sapiens
ggcuaugaaucugcaugua

SEQ ID NO: 1236027 - RNA, 19 nt, Homo sapiens
cagcuggcucagacauuua

SEQ ID NO: 1236028 - RNA, 19 nt, Homo sapiens
uuggcgagaugauugcuuu

SEQ ID NO: 1236029 - RNA, 19 nt, Homo sapiens
acacagugcgguaccagaa

SEQ ID NO: 1236030 - RNA, 19 nt, Homo sapiens
agaaacugaacaccaauga

SEQ ID NO: 1236031 - RNA, 19 nt, Homo sapiens
gggaugggaacuuuuauuu

SEQ ID NO: 1236032 - RNA, 19 nt, Homo sapiens
ccagaauugccuuagaaga

SEQ ID NO: 1236033 - RNA, 19 nt, Homo sapiens
gcgguucccucucacuuuu

SEQ ID NO: 1236034 - RNA, 19 nt, Homo sapiens
gcacuuuacauaucaaucc

SEQ ID NO: 1236035 - RNA, 19 nt, Homo sapiens
ucacagaagauggacuuga

SEQ ID NO: 1236036 - RNA, 19 nt, Homo sapiens
cuuugucccucaugacuug

SEQ ID NO: 1236037 - RNA, 19 nt, Homo sapiens
ggaccagugaauaagaaga

SEQ ID NO: 1236038 - RNA, 19 nt, Homo sapiens
aagaggagaaacucauuga

SEQ ID NO: 1236039 - RNA, 19 nt, Homo sapiens
uaacggacucugcuucucu

SEQ ID NO: 1236040 - RNA, 19 nt, Homo sapiens
ccgaaagaacaccauuuga

SEQ ID NO: 1236041 - RNA, 19 nt, Homo sapiens
ucucuuuccucuguucuug

SEQ ID NO: 1236042 - RNA, 19 nt, Homo sapiens
ggaagcagugaucuguuca

SEQ ID NO: 1236043 - RNA, 19 nt, Homo sapiens
agggaccagugaauaagaa

SEQ ID NO: 1236044 - RNA, 19 nt, Homo sapiens
cauguucugaucaauaaug

SEQ ID NO: 1236045 - RNA, 19 nt, Homo sapiens
gagaaacucauugaaaucc

SEQ ID NO: 1236046 - RNA, 19 nt, Homo sapiens
uuagaucggaagccaguuu

SEQ ID NO: 1236047 - RNA, 19 nt, Homo sapiens
acaccaagaguggcuauga

SEQ ID NO: 1236048 - RNA, 19 nt, Homo sapiens
acuauggucuaugcacaaa

SEQ ID NO: 1236049 - RNA, 19 nt, Homo sapiens
uaaaggaaauguuguggaa

SEQ ID NO: 1236050 - RNA, 19 nt, Homo sapiens
aaggaaauguuguggaaua

SEQ ID NO: 1236051 - RNA, 19 nt, Homo sapiens
ucaagugccugcaauguga

SEQ ID NO: 1236052 - RNA, 19 nt, Homo sapiens
gaaacccacuccuugcuau

SEQ ID NO: 1236053 - RNA, 19 nt, Homo sapiens
ggagucagguggugugaug

SEQ ID NO: 1236054 - RNA, 19 nt, Homo sapiens
gaauauaauuggacuuagg

SEQ ID NO: 1236055 - RNA, 19 nt, Homo sapiens
gagcuuugcugacccuuca

SEQ ID NO: 1236056 - RNA, 19 nt, Homo sapiens
ucacgcagcucaguuccua

SEQ ID NO: 1236057 - RNA, 19 nt, Homo sapiens
augaagaggugaagccaua

SEQ ID NO: 1236058 - RNA, 19 nt, Homo sapiens
cagcacaagucucaucaga

SEQ ID NO: 1236059 - RNA, 19 nt, Homo sapiens
ggaaauguuguggaauaua

SEQ ID NO: 1236060 - RNA, 19 nt, Homo sapiens
gcuauuaaaggaaauguug

SEQ ID NO: 1236061 - RNA, 19 nt, Homo sapiens
ggagucagcacaagucuca

SEQ ID NO: 1236062 - RNA, 19 nt, Homo sapiens
aaacacagccgcacucaca

SEQ ID NO: 1236063 - RNA, 19 nt, Homo sapiens
guaccaagacauuuccaaa

SEQ ID NO: 1236064 - RNA, 19 nt, Homo sapiens
ugaggaggcugacgagaag

SEQ ID NO: 1236065 - RNA, 19 nt, Homo sapiens
ggaauauaauuggacuuag

SEQ ID NO: 1236066 - RNA, 19 nt, Homo sapiens
guacuuuggugacacuuuu

SEQ ID NO: 1236067 - RNA, 19 nt, Homo sapiens
cauguggaaugccaagaug

SEQ ID NO: 1236068 - RNA, 19 nt, Homo sapiens
gugaggaggcugacgagaa

SEQ ID NO: 1236069 - RNA, 19 nt, Homo sapiens
gagcggacccaucgaagca

SEQ ID NO: 1236070 - RNA, 19 nt, Homo sapiens
guaacacucauuaaagcuu

SEQ ID NO: 1236071 - RNA, 19 nt, Homo sapiens
ucaaggaccuccgcaacca

SEQ ID NO: 1236072 - RNA, 19 nt, Homo sapiens
ggagaaaacuucgugaaac

SEQ ID NO: 1236073 - RNA, 19 nt, Homo sapiens
augcuucucugccgccaua

SEQ ID NO: 1236074 - RNA, 19 nt, Homo sapiens
ugaaacccacuccuugcua

SEQ ID NO: 1236075 - RNA, 19 nt, Homo sapiens
ccugguggcuuugcuagga

SEQ ID NO: 1236076 - RNA, 19 nt, Homo sapiens
gcaaacacagccgcacuca

SEQ ID NO: 1236077 - RNA, 19 nt, Homo sapiens
gcaagcaccggcguacuca

SEQ ID NO: 1236078 - RNA, 19 nt, Homo sapiens
ucuccaagcucaagaucca

SEQ ID NO: 1236079 - RNA, 19 nt, Homo sapiens
acccacuccuugcuauuaa

SEQ ID NO: 1236080 - RNA, 19 nt, Homo sapiens
gaagcugagacgugacugu

SEQ ID NO: 1236081 - RNA, 19 nt, Homo sapiens
guuguggaauauaauugga

SEQ ID NO: 1236082 - RNA, 19 nt, Homo sapiens
gccuggcucugcucuuuag

SEQ ID NO: 1236083 - RNA, 19 nt, Homo sapiens
uugccuggcucugcucuuu

SEQ ID NO: 1236084 - RNA, 19 nt, Homo sapiens
gugccagccucacgaagca

SEQ ID NO: 1236085 - RNA, 19 nt, Homo sapiens
ucaccaaggccauggaagu

SEQ ID NO: 1236086 - RNA, 19 nt, Homo sapiens
gaacuuucccuuccuuccu

SEQ ID NO: 1236087 - RNA, 19 nt, Homo sapiens
aggaaauguuguggaauau

SEQ ID NO: 1236088 - RNA, 19 nt, Homo sapiens
caaggcagauggagaaaac

SEQ ID NO: 1236089 - RNA, 19 nt, Homo sapiens
gcaugugggaaauccuuug

SEQ ID NO: 1236090 - RNA, 19 nt, Homo sapiens
uaacgcaugugggaaaucc

SEQ ID NO: 1236091 - RNA, 19 nt, Homo sapiens
aacccacuccuugcuauua

SEQ ID NO: 1236092 - RNA, 19 nt, Homo sapiens
ggacccaucgaagcaguga

SEQ ID NO: 1236093 - RNA, 19 nt, Homo sapiens
cgacugcggcaagagcuuu

SEQ ID NO: 1236094 - RNA, 19 nt, Homo sapiens
gaagccaaagccagagaca

SEQ ID NO: 1236095 - RNA, 19 nt, Homo sapiens
aacuuucccuuccuuccua

SEQ ID NO: 1236096 - RNA, 19 nt, Homo sapiens
agccaaagccagagacaga

SEQ ID NO: 1236097 - RNA, 19 nt, Homo sapiens
gagaaaccccguucaccaa

SEQ ID NO: 1236098 - RNA, 19 nt, Homo sapiens
gagcuugagcauggccuuu

SEQ ID NO: 1236099 - RNA, 19 nt, Homo sapiens
gccagccucacgaagcaua

SEQ ID NO: 1236100 - RNA, 19 nt, Homo sapiens
agccagagacagaagcuaa

SEQ ID NO: 1236101 - RNA, 19 nt, Homo sapiens
uaauuggacuuagguuuug

SEQ ID NO: 1236102 - RNA, 19 nt, Homo sapiens
ccacggagucagcacaagu

SEQ ID NO: 1236103 - RNA, 19 nt, Homo sapiens
gacgguggagcauguggaa

SEQ ID NO: 1236104 - RNA, 19 nt, Homo sapiens
guucaagugccugcaaugu

SEQ ID NO: 1236105 - RNA, 19 nt, Homo sapiens
ccauaccacugcgagaagu

SEQ ID NO: 1236106 - RNA, 19 nt, Homo sapiens
gugaagagcuggccaaaug

SEQ ID NO: 1236107 - RNA, 19 nt, Homo sapiens
guuaugagcucccuuggaa

SEQ ID NO: 1236108 - RNA, 19 nt, Homo sapiens
cgacaggaguccagauaaa

SEQ ID NO: 1236109 - RNA, 19 nt, Homo sapiens
guaaaggugugugucguuu

SEQ ID NO: 1236110 - RNA, 19 nt, Homo sapiens
ccauaaagauauuguguuc

SEQ ID NO: 1236111 - RNA, 19 nt, Homo sapiens
ggccagagguuccugaaau

SEQ ID NO: 1236112 - RNA, 19 nt, Homo sapiens
gagauuaggauuugauuuc

SEQ ID NO: 1236113 - RNA, 19 nt, Homo sapiens
gcaacucuaggaauucuaa

SEQ ID NO: 1236114 - RNA, 19 nt, Homo sapiens
cauauaccuucaagccaua

SEQ ID NO: 1236115 - RNA, 19 nt, Homo sapiens
guaaaacucugcaacucua

SEQ ID NO: 1236116 - RNA, 19 nt, Homo sapiens
gcucaagaaucccuggaau

SEQ ID NO: 1236117 - RNA, 19 nt, Homo sapiens
gaagagcuggccaaauguu

SEQ ID NO: 1236118 - RNA, 19 nt, Homo sapiens
ggaauucuaagaucccauu

SEQ ID NO: 1236119 - RNA, 19 nt, Homo sapiens
ggagauuaggauuugauuu

SEQ ID NO: 1236120 - RNA, 19 nt, Homo sapiens
ggagggagccaagacaaug

SEQ ID NO: 1236121 - RNA, 19 nt, Homo sapiens
uuaaagaggcugcaaaguc

SEQ ID NO: 1236122 - RNA, 19 nt, Homo sapiens
ccgcaagucuccuggaaag

SEQ ID NO: 1236123 - RNA, 19 nt, Homo sapiens
cccaagcgcuccuccuguu

SEQ ID NO: 1236124 - RNA, 19 nt, Homo sapiens
uaugagcucccuuggaauu

SEQ ID NO: 1236125 - RNA, 19 nt, Homo sapiens
ucccauagcucaagaaucc

SEQ ID NO: 1236126 - RNA, 19 nt, Homo sapiens
gauaaaaggccgaggauuc

SEQ ID NO: 1236127 - RNA, 19 nt, Homo sapiens
gaguccagauaaaggugua

SEQ ID NO: 1236128 - RNA, 19 nt, Homo sapiens
gauauuguguucacuuuuc

SEQ ID NO: 1236129 - RNA, 19 nt, Homo sapiens
gccagagguuccugaaauc

SEQ ID NO: 1236130 - RNA, 19 nt, Homo sapiens
gaaaauucgacuccuguuu

SEQ ID NO: 1236131 - RNA, 19 nt, Homo sapiens
gcgcugcuccgauguagug

SEQ ID NO: 1236132 - RNA, 19 nt, Homo sapiens
ggccgcaagucuccuggaa

SEQ ID NO: 1236133 - RNA, 19 nt, Homo sapiens
gcaaacuccagugaacauu

SEQ ID NO: 1236134 - RNA, 19 nt, Homo sapiens
gauugggagauuaggauuu

SEQ ID NO: 1236135 - RNA, 19 nt, Homo sapiens
ucuggcggcuucucuguug

SEQ ID NO: 1236136 - RNA, 19 nt, Homo sapiens
ccuucaagccauaaagaua

SEQ ID NO: 1236137 - RNA, 19 nt, Homo sapiens
auucuaagaucccauugga

SEQ ID NO: 1236138 - RNA, 19 nt, Homo sapiens
ucccaggccucccaauguu

SEQ ID NO: 1236139 - RNA, 19 nt, Homo sapiens
ccuuuaaguucaggaugua

SEQ ID NO: 1236140 - RNA, 19 nt, Homo sapiens
uguaguuccuuuaaguuca

SEQ ID NO: 1236141 - RNA, 19 nt, Homo sapiens
cagcguggccguucacauc

SEQ ID NO: 1236142 - RNA, 19 nt, Homo sapiens
ggauguggccaacuucuac

SEQ ID NO: 1236143 - RNA, 19 nt, Homo sapiens
gagguggggugauaaagga

SEQ ID NO: 1236144 - RNA, 19 nt, Homo sapiens
gaacccuacagaaauaugg

SEQ ID NO: 1236145 - RNA, 19 nt, Homo sapiens
uaagaucccauuggaagga

SEQ ID NO: 1236146 - RNA, 19 nt, Homo sapiens
cuucaagccauaaagauau

SEQ ID NO: 1236147 - RNA, 19 nt, Homo sapiens
gcugcagacucccauaggu

SEQ ID NO: 1236148 - RNA, 19 nt, Homo sapiens
caaacuccagugaacauuc

SEQ ID NO: 1236149 - RNA, 19 nt, Homo sapiens
ucacuaagccuccuaucac

SEQ ID NO: 1236150 - RNA, 19 nt, Homo sapiens
gcgaucagggugcaacuuc

SEQ ID NO: 1236151 - RNA, 19 nt, Homo sapiens
gcaucgagguggggugaua

SEQ ID NO: 1236152 - RNA, 19 nt, Homo sapiens
ggccgaggauucgcgauca

SEQ ID NO: 1236153 - RNA, 19 nt, Homo sapiens
ggauugggagauuaggauu

SEQ ID NO: 1236154 - RNA, 19 nt, Homo sapiens
ggagcugggccaaguacga

SEQ ID NO: 1236155 - RNA, 19 nt, Homo sapiens
gcacacgacagcagauucg

SEQ ID NO: 1236156 - RNA, 19 nt, Homo sapiens
uacgacaggaguccagaua

SEQ ID NO: 1236157 - RNA, 19 nt, Homo sapiens
gccauaaagauauuguguu

SEQ ID NO: 1236158 - RNA, 19 nt, Homo sapiens
cgaucagggugcaacuuca

SEQ ID NO: 1236159 - RNA, 19 nt, Homo sapiens
ggagccaagacaaugcaaa

SEQ ID NO: 1236160 - RNA, 19 nt, Homo sapiens
gggagauuaggauuugauu

SEQ ID NO: 1236161 - RNA, 19 nt, Homo sapiens
acaaugcaaacuccaguga

SEQ ID NO: 1236162 - RNA, 19 nt, Homo sapiens
guaguuccuuuaaguucag

SEQ ID NO: 1236163 - RNA, 19 nt, Homo sapiens
caguggagcugggccaagu

SEQ ID NO: 1236164 - RNA, 19 nt, Homo sapiens
gaggcgcugcuccgaugua

SEQ ID NO: 1236165 - RNA, 19 nt, Homo sapiens
aaaggugugugucguuucg

SEQ ID NO: 1236166 - RNA, 19 nt, Homo sapiens
cuaagccuccuaucacuag

SEQ ID NO: 1236167 - RNA, 19 nt, Homo sapiens
gagccaagacaaugcaaac

SEQ ID NO: 1236168 - RNA, 19 nt, Homo sapiens
gggauugggagauuaggau

SEQ ID NO: 1236169 - RNA, 19 nt, Homo sapiens
gacaggaguccagauaaag

SEQ ID NO: 1236170 - RNA, 19 nt, Homo sapiens
cagccacccugaagauacu

SEQ ID NO: 1236171 - RNA, 19 nt, Homo sapiens
caaugcaaacuccagugaa

SEQ ID NO: 1236172 - RNA, 19 nt, Homo sapiens
auugggagauuaggauuug

SEQ ID NO: 1236173 - RNA, 19 nt, Homo sapiens
ucccauaggugugcaagca

SEQ ID NO: 1236174 - RNA, 19 nt, Homo sapiens
ggucaucaggugagcuuca

SEQ ID NO: 1236175 - RNA, 19 nt, Homo sapiens
ccaggagugucccauagcu

SEQ ID NO: 1236176 - RNA, 19 nt, Homo sapiens
agccuccuaucacuaguaa

SEQ ID NO: 1236177 - RNA, 19 nt, Homo sapiens
acaucacgcgcuucacuaa

SEQ ID NO: 1236178 - RNA, 19 nt, Homo sapiens
guucacaucacgcgcuuca

SEQ ID NO: 1236179 - RNA, 19 nt, Homo sapiens
aaugcaaacuccagugaac

SEQ ID NO: 1236180 - RNA, 19 nt, Homo sapiens
ccuccugggucuagucagu

SEQ ID NO: 1236181 - RNA, 19 nt, Homo sapiens
ccuuccagcgcauuguuua

SEQ ID NO: 1236182 - RNA, 19 nt, Homo sapiens
ccugcuaaagaaccaguua

SEQ ID NO: 1236183 - RNA, 19 nt, Homo sapiens
ggaggaagcugaagaagua

SEQ ID NO: 1236184 - RNA, 19 nt, Homo sapiens
ggaagaggauguuacuaga

SEQ ID NO: 1236185 - RNA, 19 nt, Homo sapiens
caucucaccuggauucaaa

SEQ ID NO: 1236186 - RNA, 19 nt, Homo sapiens
ggagacagaugugaaggaa

SEQ ID NO: 1236187 - RNA, 19 nt, Homo sapiens
ugaaacaagugaucugguu

SEQ ID NO: 1236188 - RNA, 19 nt, Homo sapiens
ugacuuuguuuccagaaua

SEQ ID NO: 1236189 - RNA, 19 nt, Homo sapiens
agacagaugugaaggaaau

SEQ ID NO: 1236190 - RNA, 19 nt, Homo sapiens
cagcauauuuggaagagaa

SEQ ID NO: 1236191 - RNA, 19 nt, Homo sapiens
gcucaugcuucucuaauca

SEQ ID NO: 1236192 - RNA, 19 nt, Homo sapiens
gcaagaggacguuggaaga

SEQ ID NO: 1236193 - RNA, 19 nt, Homo sapiens
cagaugauuugcuguauuc

SEQ ID NO: 1236194 - RNA, 19 nt, Homo sapiens
gaagaaguacggcaagaau

SEQ ID NO: 1236195 - RNA, 19 nt, Homo sapiens
ggagagauagucauaagug

SEQ ID NO: 1236196 - RNA, 19 nt, Homo sapiens
gcuagacucugcuucacuu

SEQ ID NO: 1236197 - RNA, 19 nt, Homo sapiens
ccacuguucugacuuuguu

SEQ ID NO: 1236198 - RNA, 19 nt, Homo sapiens
ccaggcagcccacaaguuu

SEQ ID NO: 1236199 - RNA, 19 nt, Homo sapiens
gagaaggaaccaguaagua

SEQ ID NO: 1236200 - RNA, 19 nt, Homo sapiens
gcaugacuguuuaaaguag

SEQ ID NO: 1236201 - RNA, 19 nt, Homo sapiens
ggucaauccugcagagaau

SEQ ID NO: 1236202 - RNA, 19 nt, Homo sapiens
uaucagugcccacaccuua

SEQ ID NO: 1236203 - RNA, 19 nt, Homo sapiens
guaagcauuuggauugugu

SEQ ID NO: 1236204 - RNA, 19 nt, Homo sapiens
gcaagaaugucgggaaggu

SEQ ID NO: 1236205 - RNA, 19 nt, Homo sapiens
gaacacacagcauauuugg

SEQ ID NO: 1236206 - RNA, 19 nt, Homo sapiens
uggcaugacuguuuaaagu

SEQ ID NO: 1236207 - RNA, 19 nt, Homo sapiens
cuaaggagcuguuuauucc

SEQ ID NO: 1236208 - RNA, 19 nt, Homo sapiens
gagauagucauaaguggaa

SEQ ID NO: 1236209 - RNA, 19 nt, Homo sapiens
guaaguaggagacagaugu

SEQ ID NO: 1236210 - RNA, 19 nt, Homo sapiens
gcuaaggagcuguuuauuc

SEQ ID NO: 1236211 - RNA, 19 nt, Homo sapiens
cucaaucccuggaguguaa

SEQ ID NO: 1236212 - RNA, 19 nt, Homo sapiens
gaaaguggauauggcacau

SEQ ID NO: 1236213 - RNA, 19 nt, Homo sapiens
acacacagcauauuuggaa

SEQ ID NO: 1236214 - RNA, 19 nt, Homo sapiens
gaccucaucucaccuggau

SEQ ID NO: 1236215 - RNA, 19 nt, Homo sapiens
ggaaggucaucaucaaagg

SEQ ID NO: 1236216 - RNA, 19 nt, Homo sapiens
aaagggagagauagucaua

SEQ ID NO: 1236217 - RNA, 19 nt, Homo sapiens
ugaaggaaauggaaaugag

SEQ ID NO: 1236218 - RNA, 19 nt, Homo sapiens
ucagaugauuugcuguauu

SEQ ID NO: 1236219 - RNA, 19 nt, Homo sapiens
cucauuggcugccuuugua

SEQ ID NO: 1236220 - RNA, 19 nt, Homo sapiens
acagaaagacagacagaaa

SEQ ID NO: 1236221 - RNA, 19 nt, Homo sapiens
gaacagggagaugaaagga

SEQ ID NO: 1236222 - RNA, 19 nt, Homo sapiens
gaagaagggcaaguucaga

SEQ ID NO: 1236223 - RNA, 19 nt, Homo sapiens
ggauguuacuagagucaga

SEQ ID NO: 1236224 - RNA, 19 nt, Homo sapiens
caaaggggcuguugcugaa

SEQ ID NO: 1236225 - RNA, 19 nt, Homo sapiens
caacuaagagugcuuuguc

SEQ ID NO: 1236226 - RNA, 19 nt, Homo sapiens
gaagccaacacucaacaga

SEQ ID NO: 1236227 - RNA, 19 nt, Homo sapiens
aaguggauauggcacauuu

SEQ ID NO: 1236228 - RNA, 19 nt, Homo sapiens
uaaucaagcccuaccaaga

SEQ ID NO: 1236229 - RNA, 19 nt, Homo sapiens
ccucaacgcucaugcuucu

SEQ ID NO: 1236230 - RNA, 19 nt, Homo sapiens
gaagagaaaacaugccuuu

SEQ ID NO: 1236231 - RNA, 19 nt, Homo sapiens
ggaggaagaagggcaaguu

SEQ ID NO: 1236232 - RNA, 19 nt, Homo sapiens
gcugacaggcgcucacauu

SEQ ID NO: 1236233 - RNA, 19 nt, Homo sapiens
gagcuucucacaucucuca

SEQ ID NO: 1236234 - RNA, 19 nt, Homo sapiens
ggguuucucuuacucaauc

SEQ ID NO: 1236235 - RNA, 19 nt, Homo sapiens
ggagaaagggagagauagu

SEQ ID NO: 1236236 - RNA, 19 nt, Homo sapiens
ggagcuagacucugcuuca

SEQ ID NO: 1236237 - RNA, 19 nt, Homo sapiens
gaauauccagaaauccaaa

SEQ ID NO: 1236238 - RNA, 19 nt, Homo sapiens
gacuuuguuuccagaauau

SEQ ID NO: 1236239 - RNA, 19 nt, Homo sapiens
gacauaacacccaggaaug

SEQ ID NO: 1236240 - RNA, 19 nt, Homo sapiens
acauuaguaugaugaguga

SEQ ID NO: 1236241 - RNA, 19 nt, Homo sapiens
guagcauccugucuucuuc

SEQ ID NO: 1236242 - RNA, 19 nt, Homo sapiens
auacagauuuagagaagga

SEQ ID NO: 1236243 - RNA, 19 nt, Homo sapiens
cgaccagagucccugcaaa

SEQ ID NO: 1236244 - RNA, 19 nt, Homo sapiens
caccaggaguuuaauuaca

SEQ ID NO: 1236245 - RNA, 19 nt, Homo sapiens
ggcaugacuguuuaaagua

SEQ ID NO: 1236246 - RNA, 19 nt, Homo sapiens
cagcagaacagugaucuug

SEQ ID NO: 1236247 - RNA, 19 nt, Homo sapiens
gacuugaacacacagcaua

SEQ ID NO: 1236248 - RNA, 19 nt, Homo sapiens
caagacagacagaaagaca

SEQ ID NO: 1236249 - RNA, 19 nt, Homo sapiens
caacgcucaugcuucucua

SEQ ID NO: 1236250 - RNA, 19 nt, Homo sapiens
cuucugugcugccugguuu

SEQ ID NO: 1236251 - RNA, 19 nt, Homo sapiens
gucaccaggaguuuaauua

SEQ ID NO: 1236252 - RNA, 19 nt, Homo sapiens
uuacuagagucagaugauu

SEQ ID NO: 1236253 - RNA, 19 nt, Homo sapiens
aagaggauguuacuagagu

SEQ ID NO: 1236254 - RNA, 19 nt, Homo sapiens
ucacuaaugucaaaaguca

SEQ ID NO: 1236255 - RNA, 19 nt, Homo sapiens
uagcccagaugaugaaagu

SEQ ID NO: 1236256 - RNA, 19 nt, Homo sapiens
gaggaaaagugaaacaagu

SEQ ID NO: 1236257 - RNA, 19 nt, Homo sapiens
gaaggucaucaucaaagga

SEQ ID NO: 1236258 - RNA, 19 nt, Homo sapiens
agacauaacacccaggaau

SEQ ID NO: 1236259 - RNA, 19 nt, Homo sapiens
aguguggcaugacuguuua

SEQ ID NO: 1236260 - RNA, 19 nt, Homo sapiens
guuuauuccucaagucaug

SEQ ID NO: 1236261 - RNA, 19 nt, Homo sapiens
uccagaauauccagaaauc

SEQ ID NO: 1236262 - RNA, 19 nt, Homo sapiens
aaauggaaaugaggcaaga

SEQ ID NO: 1236263 - RNA, 19 nt, Homo sapiens
ggacauaggggcugagaga

SEQ ID NO: 1236264 - RNA, 19 nt, Homo sapiens
ggaagaagggcaaguucag

SEQ ID NO: 1236265 - RNA, 19 nt, Homo sapiens
gaagaggauguuacuagag

SEQ ID NO: 1236266 - RNA, 19 nt, Homo sapiens
caacagaugcaagcagugu

SEQ ID NO: 1236267 - RNA, 19 nt, Homo sapiens
ucgggaaggucaucaucaa

SEQ ID NO: 1236268 - RNA, 19 nt, Homo sapiens
guucacggguacagaagau

SEQ ID NO: 1236269 - RNA, 19 nt, Homo sapiens
cuaccaagacagacagaaa

SEQ ID NO: 1236270 - RNA, 19 nt, Homo sapiens
gagcaucucagacuugaac

SEQ ID NO: 1236271 - RNA, 19 nt, Homo sapiens
agaaggaaccaguaaguag

SEQ ID NO: 1236272 - RNA, 19 nt, Homo sapiens
cagguuggcuaagggacua

SEQ ID NO: 1236273 - RNA, 19 nt, Homo sapiens
gaagaaaggaagaaaagau

SEQ ID NO: 1236274 - RNA, 19 nt, Homo sapiens
ucucagacuugaacacaca

SEQ ID NO: 1236275 - RNA, 19 nt, Homo sapiens
ggaggaagaggauguuacu

SEQ ID NO: 1236276 - RNA, 19 nt, Homo sapiens
gggaaggucaucaucaaag

SEQ ID NO: 1236277 - RNA, 19 nt, Homo sapiens
gaccagagucccugcaaag

SEQ ID NO: 1236278 - RNA, 19 nt, Homo sapiens
cugugaagcuggcgaggaa

SEQ ID NO: 1236279 - RNA, 19 nt, Homo sapiens
ugaacacacagcauauuug

SEQ ID NO: 1236280 - RNA, 19 nt, Homo sapiens
gcuguauucuccugaaagg

SEQ ID NO: 1236281 - RNA, 19 nt, Homo sapiens
agccaacacucaacagaug

SEQ ID NO: 1236282 - RNA, 19 nt, Homo sapiens
gggcggaagccaacacuca

SEQ ID NO: 1236283 - RNA, 19 nt, Homo sapiens
caaaugagacuccuggaaa

SEQ ID NO: 1236284 - RNA, 19 nt, Homo sapiens
ucaaggagauccagaaacu

SEQ ID NO: 1236285 - RNA, 19 nt, Homo sapiens
gaagaccacccuccuguca

SEQ ID NO: 1236286 - RNA, 19 nt, Homo sapiens
gcaaaugagacuccuggaa

SEQ ID NO: 1236287 - RNA, 19 nt, Homo sapiens
ggacagcugcucccggaaa

SEQ ID NO: 1236288 - RNA, 19 nt, Homo sapiens
gaaacugggugggaauugg

SEQ ID NO: 1236289 - RNA, 19 nt, Homo sapiens
uccagaaacucaucaagga

SEQ ID NO: 1236290 - RNA, 19 nt, Homo sapiens
gaacucccuccuccacuga

SEQ ID NO: 1236291 - RNA, 19 nt, Homo sapiens
gaaguuccgccacaacauc

SEQ ID NO: 1236292 - RNA, 19 nt, Homo sapiens
gugcugcucuguggcauug

SEQ ID NO: 1236293 - RNA, 19 nt, Homo sapiens
gacagcugcucccggaaau

SEQ ID NO: 1236294 - RNA, 19 nt, Homo sapiens
gccacaacaucgccuacuu

SEQ ID NO: 1236295 - RNA, 19 nt, Homo sapiens
gagaaguuccgccacaaca

SEQ ID NO: 1236296 - RNA, 19 nt, Homo sapiens
ggaaacugggugggaauug

SEQ ID NO: 1236297 - RNA, 19 nt, Homo sapiens
ugugugacaugcaggagaa

SEQ ID NO: 1236298 - RNA, 19 nt, Homo sapiens
ccacaacaucgccuacuuc

SEQ ID NO: 1236299 - RNA, 19 nt, Homo sapiens
guucaaggagauccagaaa

SEQ ID NO: 1236300 - RNA, 19 nt, Homo sapiens
ggcacaggccugcaucuug

SEQ ID NO: 1236301 - RNA, 19 nt, Homo sapiens
aaaugagacuccuggaaac

SEQ ID NO: 1236302 - RNA, 19 nt, Homo sapiens
ggugcugccuucccauugg

SEQ ID NO: 1236303 - RNA, 19 nt, Homo sapiens
ggagauccagaaacucauc

SEQ ID NO: 1236304 - RNA, 19 nt, Homo sapiens
aaggagauccagaaacuca

SEQ ID NO: 1236305 - RNA, 19 nt, Homo sapiens
gguuggcccugaccucucu

SEQ ID NO: 1236306 - RNA, 19 nt, Homo sapiens
ucccacagaucgucucagu

SEQ ID NO: 1236307 - RNA, 19 nt, Homo sapiens
gugcugccuucccauugga

SEQ ID NO: 1236308 - RNA, 19 nt, Homo sapiens
ggagaaguuccgccacaac

SEQ ID NO: 1236309 - RNA, 19 nt, Homo sapiens
caacaaggcuuaccaauau

SEQ ID NO: 1236310 - RNA, 19 nt, Homo sapiens
ugagaaagcuucagcauuu

SEQ ID NO: 1236311 - RNA, 19 nt, Homo sapiens
gaacugaacaugcaacauu

SEQ ID NO: 1236312 - RNA, 19 nt, Homo sapiens
ggagaaaguugaagccauu

SEQ ID NO: 1236313 - RNA, 19 nt, Homo sapiens
gcaacaaggcuuaccaaua

SEQ ID NO: 1236314 - RNA, 19 nt, Homo sapiens
ggaaggagcuugaggugau

SEQ ID NO: 1236315 - RNA, 19 nt, Homo sapiens
gaacaugcaacauuuauca

SEQ ID NO: 1236316 - RNA, 19 nt, Homo sapiens
gcugggagaugaucagaaa

SEQ ID NO: 1236317 - RNA, 19 nt, Homo sapiens
ggaagaagaauaugaacaa

SEQ ID NO: 1236318 - RNA, 19 nt, Homo sapiens
gugccacaaucacuuauua

SEQ ID NO: 1236319 - RNA, 19 nt, Homo sapiens
gugcagagauggaggaaga

SEQ ID NO: 1236320 - RNA, 19 nt, Homo sapiens
ggaauugguaguucaagua

SEQ ID NO: 1236321 - RNA, 19 nt, Homo sapiens
ugaaagaacuacaggaaag

SEQ ID NO: 1236322 - RNA, 19 nt, Homo sapiens
gcagagcacagaguuauuu

SEQ ID NO: 1236323 - RNA, 19 nt, Homo sapiens
gcagcucccuggaagacua

SEQ ID NO: 1236324 - RNA, 19 nt, Homo sapiens
ggacacucauccacuguug

SEQ ID NO: 1236325 - RNA, 19 nt, Homo sapiens
ggaggaagaagaauaugaa

SEQ ID NO: 1236326 - RNA, 19 nt, Homo sapiens
ucacacuccuuaagauuug

SEQ ID NO: 1236327 - RNA, 19 nt, Homo sapiens
uuacuugucuauacucuga

SEQ ID NO: 1236328 - RNA, 19 nt, Homo sapiens
gaaggagcuugaggugauu

SEQ ID NO: 1236329 - RNA, 19 nt, Homo sapiens
gaaaguugaagccauuaug

SEQ ID NO: 1236330 - RNA, 19 nt, Homo sapiens
gcaaggcacucaaaacaug

SEQ ID NO: 1236331 - RNA, 19 nt, Homo sapiens
acaguggcuuugacuauaa

SEQ ID NO: 1236332 - RNA, 19 nt, Homo sapiens
uacaguggcuuugacuaua

SEQ ID NO: 1236333 - RNA, 19 nt, Homo sapiens
gcauuucucuugcuaacag

SEQ ID NO: 1236334 - RNA, 19 nt, Homo sapiens
gggcacagccucaggucua

SEQ ID NO: 1236335 - RNA, 19 nt, Homo sapiens
agacagugcugggagauga

SEQ ID NO: 1236336 - RNA, 19 nt, Homo sapiens
ugcgagagcucauggagaa

SEQ ID NO: 1236337 - RNA, 19 nt, Homo sapiens
gauggaggaagaagaauau

SEQ ID NO: 1236338 - RNA, 19 nt, Homo sapiens
uaaggugccuguugugucu

SEQ ID NO: 1236339 - RNA, 19 nt, Homo sapiens
gcugaaagaacuacaggaa

SEQ ID NO: 1236340 - RNA, 19 nt, Homo sapiens
ccauugaacugaacaugca

SEQ ID NO: 1236341 - RNA, 19 nt, Homo sapiens
gcauugccuuucaugaguu

SEQ ID NO: 1236342 - RNA, 19 nt, Homo sapiens
uauuggaccuucuaucuca

SEQ ID NO: 1236343 - RNA, 19 nt, Homo sapiens
gaauugguaguucaaguau

SEQ ID NO: 1236344 - RNA, 19 nt, Homo sapiens
guucaugucuucuacuuuu

SEQ ID NO: 1236345 - RNA, 19 nt, Homo sapiens
caaagcagagcacagaguu

SEQ ID NO: 1236346 - RNA, 19 nt, Homo sapiens
gcaagcuguugaccagaug

SEQ ID NO: 1236347 - RNA, 19 nt, Homo sapiens
ggucaugacgucuggugua

SEQ ID NO: 1236348 - RNA, 19 nt, Homo sapiens
gaccaagaccucccagaga

SEQ ID NO: 1236349 - RNA, 19 nt, Homo sapiens
cauacacuguggaagcuuu

SEQ ID NO: 1236350 - RNA, 19 nt, Homo sapiens
uaucauacauucaguucuc

SEQ ID NO: 1236351 - RNA, 19 nt, Homo sapiens
gggcaggccuguaucuuuu

SEQ ID NO: 1236352 - RNA, 19 nt, Homo sapiens
caugacgucugguguagga

SEQ ID NO: 1236353 - RNA, 19 nt, Homo sapiens
gguuuaaggugccuguugu

SEQ ID NO: 1236354 - RNA, 19 nt, Homo sapiens
ucugauagaaccaaaguuu

SEQ ID NO: 1236355 - RNA, 19 nt, Homo sapiens
uggagaugcucaacagcua

SEQ ID NO: 1236356 - RNA, 19 nt, Homo sapiens
ggaagagugcaacaggaaa

SEQ ID NO: 1236357 - RNA, 19 nt, Homo sapiens
gcuaacagauucagaaaag

SEQ ID NO: 1236358 - RNA, 19 nt, Homo sapiens
cuacaggaaaggcaaguaa

SEQ ID NO: 1236359 - RNA, 19 nt, Homo sapiens
gggaagagugcaacaggaa

SEQ ID NO: 1236360 - RNA, 19 nt, Homo sapiens
gggaauugguaguucaagu

SEQ ID NO: 1236361 - RNA, 19 nt, Homo sapiens
cuuaagauuuggucagaau

SEQ ID NO: 1236362 - RNA, 19 nt, Homo sapiens
gccacaaucacuuauuaaa

SEQ ID NO: 1236363 - RNA, 19 nt, Homo sapiens
gaaacuccagagcuacuga

SEQ ID NO: 1236364 - RNA, 19 nt, Homo sapiens
gcacgcugucuuccuauug

SEQ ID NO: 1236365 - RNA, 19 nt, Homo sapiens
aaacgaaggagauuauuac

SEQ ID NO: 1236366 - RNA, 19 nt, Homo sapiens
gccaagccaucgucuuauc

SEQ ID NO: 1236367 - RNA, 19 nt, Homo sapiens
ucauucagauaggagauaa

SEQ ID NO: 1236368 - RNA, 19 nt, Homo sapiens
acagaguuauuugguguuu

SEQ ID NO: 1236369 - RNA, 19 nt, Homo sapiens
cauugccuuucaugaguua

SEQ ID NO: 1236370 - RNA, 19 nt, Homo sapiens
ccagaucacauuccaguuc

SEQ ID NO: 1236371 - RNA, 19 nt, Homo sapiens
gagaaaguugaagccauua

SEQ ID NO: 1236372 - RNA, 19 nt, Homo sapiens
cugccaagccaucgucuua

SEQ ID NO: 1236373 - RNA, 19 nt, Homo sapiens
ggagauuauuacagcaaca

SEQ ID NO: 1236374 - RNA, 19 nt, Homo sapiens
ggaaaacgaaggagauuau

SEQ ID NO: 1236375 - RNA, 19 nt, Homo sapiens
gcaccagacccgugaccaa

SEQ ID NO: 1236376 - RNA, 19 nt, Homo sapiens
ugagggaauugguaguuca

SEQ ID NO: 1236377 - RNA, 19 nt, Homo sapiens
caugcaacauuuaucauac

SEQ ID NO: 1236378 - RNA, 19 nt, Homo sapiens
gaacagaagaccccaagga

SEQ ID NO: 1236379 - RNA, 19 nt, Homo sapiens
aacugaacaugcaacauuu

SEQ ID NO: 1236380 - RNA, 19 nt, Homo sapiens
gagcacagaguuauuuggu

SEQ ID NO: 1236381 - RNA, 19 nt, Homo sapiens
aacaaggcuuaccaauaua

SEQ ID NO: 1236382 - RNA, 19 nt, Homo sapiens
uaagggagaaagaacagaa

SEQ ID NO: 1236383 - RNA, 19 nt, Homo sapiens
uacauucaguucucauuca

SEQ ID NO: 1236384 - RNA, 19 nt, Homo sapiens
cucaacagcuagacacaga

SEQ ID NO: 1236385 - RNA, 19 nt, Homo sapiens
ugaggagucuuggcuggaa

SEQ ID NO: 1236386 - RNA, 19 nt, Homo sapiens
gcucauggagaaaguugaa

SEQ ID NO: 1236387 - RNA, 19 nt, Homo sapiens
acuugaaacuccagagcua

SEQ ID NO: 1236388 - RNA, 19 nt, Homo sapiens
caacagcuagacacagaug

SEQ ID NO: 1236389 - RNA, 19 nt, Homo sapiens
agagauggaggaagaagaa

SEQ ID NO: 1236390 - RNA, 19 nt, Homo sapiens
gagagcucauggagaaagu

SEQ ID NO: 1236391 - RNA, 19 nt, Homo sapiens
gauugacacacccaacauu

SEQ ID NO: 1236392 - RNA, 19 nt, Homo sapiens
cauauugguauucuaguug

SEQ ID NO: 1236393 - RNA, 19 nt, Homo sapiens
uuacaguggcuuugacuau

SEQ ID NO: 1236394 - RNA, 19 nt, Homo sapiens
gggacgucuucgagucuaa

SEQ ID NO: 1236395 - RNA, 19 nt, Homo sapiens
gagauccauucagcgacua

SEQ ID NO: 1236396 - RNA, 19 nt, Homo sapiens
gaagagugcaacaggaaac

SEQ ID NO: 1236397 - RNA, 19 nt, Homo sapiens
cauucacacuccuuaagau

SEQ ID NO: 1236398 - RNA, 19 nt, Homo sapiens
aaagcagagcacagaguua

SEQ ID NO: 1236399 - RNA, 19 nt, Homo sapiens
ggagucaugcagucacguu

SEQ ID NO: 1236400 - RNA, 19 nt, Homo sapiens
ugaguuacuugucuauacu

SEQ ID NO: 1236401 - RNA, 19 nt, Homo sapiens
caggaggucuaagggagaa

SEQ ID NO: 1236402 - RNA, 19 nt, Homo sapiens
gaaagaacuacaggaaagg

SEQ ID NO: 1236403 - RNA, 19 nt, Homo sapiens
gagcucauggagaaaguug

SEQ ID NO: 1236404 - RNA, 19 nt, Homo sapiens
cauugcggcuucaacaaca

SEQ ID NO: 1236405 - RNA, 19 nt, Homo sapiens
ucuaguuggcaaugucuua

SEQ ID NO: 1236406 - RNA, 19 nt, Homo sapiens
ggacgucuucgagucuaaa

SEQ ID NO: 1236407 - RNA, 19 nt, Homo sapiens
gagauuauuacagcaacaa

SEQ ID NO: 1236408 - RNA, 19 nt, Homo sapiens
gagagugggcugggaagga

SEQ ID NO: 1236409 - RNA, 19 nt, Homo sapiens
gcauccagcuguugaauaa

SEQ ID NO: 1236410 - RNA, 19 nt, Homo sapiens
ggagauacaucaccgagaa

SEQ ID NO: 1236411 - RNA, 19 nt, Homo sapiens
agagauugcugcagaaaua

SEQ ID NO: 1236412 - RNA, 19 nt, Homo sapiens
acaaggaccucuaugaguu

SEQ ID NO: 1236413 - RNA, 19 nt, Homo sapiens
ugaaugcgcucacuuaugg

SEQ ID NO: 1236414 - RNA, 19 nt, Homo sapiens
gcacaugcuugacuaucuu

SEQ ID NO: 1236415 - RNA, 19 nt, Homo sapiens
gcgcggagaucaagaaugg

SEQ ID NO: 1236416 - RNA, 19 nt, Homo sapiens
ugaggaagguggugugcua

SEQ ID NO: 1236417 - RNA, 19 nt, Homo sapiens
gaacaaggaccucuaugag

SEQ ID NO: 1236418 - RNA, 19 nt, Homo sapiens
guaaugggcuccagauacu

SEQ ID NO: 1236419 - RNA, 19 nt, Homo sapiens
gaguuggccuucucaauca

SEQ ID NO: 1236420 - RNA, 19 nt, Homo sapiens
ugacggugcugcuguguga

SEQ ID NO: 1236421 - RNA, 19 nt, Homo sapiens
ggacuucucacccauguuc

SEQ ID NO: 1236422 - RNA, 19 nt, Homo sapiens
ugggugggcugcagaguaa

SEQ ID NO: 1236423 - RNA, 19 nt, Homo sapiens
gauacuaggcaccaucauu

SEQ ID NO: 1236424 - RNA, 19 nt, Homo sapiens
caacuucaacuucugcuau

SEQ ID NO: 1236425 - RNA, 19 nt, Homo sapiens
gcagaacaaggaccucuau

SEQ ID NO: 1236426 - RNA, 19 nt, Homo sapiens
ccacuucccuggagcucuu

SEQ ID NO: 1236427 - RNA, 19 nt, Homo sapiens
gauacaucaccgagaauaa

SEQ ID NO: 1236428 - RNA, 19 nt, Homo sapiens
guacagccgguuuguguug

SEQ ID NO: 1236429 - RNA, 19 nt, Homo sapiens
aaacugggcuuuucuaaca

SEQ ID NO: 1236430 - RNA, 19 nt, Homo sapiens
gagaaugaccacuccacuu

SEQ ID NO: 1236431 - RNA, 19 nt, Homo sapiens
gccaguucaucuauaagaa

SEQ ID NO: 1236432 - RNA, 19 nt, Homo sapiens
agaaugaccacuccacuug

SEQ ID NO: 1236433 - RNA, 19 nt, Homo sapiens
agaacaaggaccucuauga

SEQ ID NO: 1236434 - RNA, 19 nt, Homo sapiens
aagcguaccucaacuucau

SEQ ID NO: 1236435 - RNA, 19 nt, Homo sapiens
ugaauaagaccuggaagga

SEQ ID NO: 1236436 - RNA, 19 nt, Homo sapiens
agaggaaccuucgccaguu

SEQ ID NO: 1236437 - RNA, 19 nt, Homo sapiens
gaggucaucagccguaaug

SEQ ID NO: 1236438 - RNA, 19 nt, Homo sapiens
gagauugcugcagaaauaa

SEQ ID NO: 1236439 - RNA, 19 nt, Homo sapiens
caaggaccucuaugaguug

SEQ ID NO: 1236440 - RNA, 19 nt, Homo sapiens
uccacgagcucuucugugu

SEQ ID NO: 1236441 - RNA, 19 nt, Homo sapiens
gcguacagccgguuugugu

SEQ ID NO: 1236442 - RNA, 19 nt, Homo sapiens
aaagucugcuuggcucuug

SEQ ID NO: 1236443 - RNA, 19 nt, Homo sapiens
ggacuucgacaaggucaug

SEQ ID NO: 1236444 - RNA, 19 nt, Homo sapiens
auacuaggcaccaucauug

SEQ ID NO: 1236445 - RNA, 19 nt, Homo sapiens
ccaccaacuucaacuucug

SEQ ID NO: 1236446 - RNA, 19 nt, Homo sapiens
ggcauccagcuguugaaua

SEQ ID NO: 1236447 - RNA, 19 nt, Homo sapiens
ggaagguggugugcuacgu

SEQ ID NO: 1236448 - RNA, 19 nt, Homo sapiens
gaugggcaccggagauaca

SEQ ID NO: 1236449 - RNA, 19 nt, Homo sapiens
ugagacagcccaggacuuc

SEQ ID NO: 1236450 - RNA, 19 nt, Homo sapiens
cuucgccaguucaucuaua

SEQ ID NO: 1236451 - RNA, 19 nt, Homo sapiens
caggacuucucacccaugu

SEQ ID NO: 1236452 - RNA, 19 nt, Homo sapiens
cagaguaacaguccugaag

SEQ ID NO: 1236453 - RNA, 19 nt, Homo sapiens
gggaggucaucagccguaa

SEQ ID NO: 1236454 - RNA, 19 nt, Homo sapiens
ccucggacaugaucuuugc

SEQ ID NO: 1236455 - RNA, 19 nt, Homo sapiens
ccgggaagcagaacaagga

SEQ ID NO: 1236456 - RNA, 19 nt, Homo sapiens
aggauaagcugugguucug

SEQ ID NO: 1236457 - RNA, 19 nt, Homo sapiens
gcaaacugggcuuuucuaa

SEQ ID NO: 1236458 - RNA, 19 nt, Homo sapiens
ugugcuacgugaacaugaa

SEQ ID NO: 1236459 - RNA, 19 nt, Homo sapiens
cgcugaaccuugacagugu

SEQ ID NO: 1236460 - RNA, 19 nt, Homo sapiens
agauacaucaccgagaaua

SEQ ID NO: 1236461 - RNA, 19 nt, Homo sapiens
gggcaccggagauacauca

SEQ ID NO: 1236462 - RNA, 19 nt, Homo sapiens
auccagcuguugaauaaga

SEQ ID NO: 1236463 - RNA, 19 nt, Homo sapiens
uaggcaccaucauugaaga

SEQ ID NO: 1236464 - RNA, 19 nt, Homo sapiens
cggaugggcaccggagaua

SEQ ID NO: 1236465 - RNA, 19 nt, Homo sapiens
caugagggcacuccugaca

SEQ ID NO: 1236466 - RNA, 19 nt, Homo sapiens
gcagaguaacaguccugaa

SEQ ID NO: 1236467 - RNA, 19 nt, Homo sapiens
gggcuacacaggaggacuu

SEQ ID NO: 1236468 - RNA, 19 nt, Homo sapiens
cguaaugggcuccagauac

SEQ ID NO: 1236469 - RNA, 19 nt, Homo sapiens
gagauacaucaccgagaau

SEQ ID NO: 1236470 - RNA, 19 nt, Homo sapiens
gccaggauaagcugugguu

SEQ ID NO: 1236471 - RNA, 19 nt, Homo sapiens
uacuggagcugcgggagaa

SEQ ID NO: 1236472 - RNA, 19 nt, Homo sapiens
guggacagaugggcucagu

SEQ ID NO: 1236473 - RNA, 19 nt, Homo sapiens
gccgguuuguguuggagaa

SEQ ID NO: 1236474 - RNA, 19 nt, Homo sapiens
ucuaugaguuggccuucuc

SEQ ID NO: 1236475 - RNA, 19 nt, Homo sapiens
ggagccugacgcacucuga

SEQ ID NO: 1236476 - RNA, 19 nt, Homo sapiens
guuacgcccugcaguuugc

SEQ ID NO: 1236477 - RNA, 19 nt, Homo sapiens
ggauguagaugcuuauuua

SEQ ID NO: 1236478 - RNA, 19 nt, Homo sapiens
ggacuuggcuaauuuauau

SEQ ID NO: 1236479 - RNA, 19 nt, Homo sapiens
gaauguagcuuuaacuuuc

SEQ ID NO: 1236480 - RNA, 19 nt, Homo sapiens
gagauugaauguagcuuua

SEQ ID NO: 1236481 - RNA, 19 nt, Homo sapiens
guaauaagauugaggauca

SEQ ID NO: 1236482 - RNA, 19 nt, Homo sapiens
gcagauuucuugcucuuaa

SEQ ID NO: 1236483 - RNA, 19 nt, Homo sapiens
gaacauauuugguuaacuc

SEQ ID NO: 1236484 - RNA, 19 nt, Homo sapiens
gcugugacauggcaaauaa

SEQ ID NO: 1236485 - RNA, 19 nt, Homo sapiens
caagaccaaucaucauuaa

SEQ ID NO: 1236486 - RNA, 19 nt, Homo sapiens
acaguuggcugcuuacaua

SEQ ID NO: 1236487 - RNA, 19 nt, Homo sapiens
guaaugaaaccacuaauga

SEQ ID NO: 1236488 - RNA, 19 nt, Homo sapiens
ucacuuggcugcuguguug

SEQ ID NO: 1236489 - RNA, 19 nt, Homo sapiens
ugaaggagguuaagaaauc

SEQ ID NO: 1236490 - RNA, 19 nt, Homo sapiens
gcacgucugugauuugaga

SEQ ID NO: 1236491 - RNA, 19 nt, Homo sapiens
ucagaaacccacaauguua

SEQ ID NO: 1236492 - RNA, 19 nt, Homo sapiens
gcacuugaauguaaaccuu

SEQ ID NO: 1236493 - RNA, 19 nt, Homo sapiens
ggucagaacuaucauccaa

SEQ ID NO: 1236494 - RNA, 19 nt, Homo sapiens
gaaagagaaguauaaguga

SEQ ID NO: 1236495 - RNA, 19 nt, Homo sapiens
gaauuucucugcaguaguc

SEQ ID NO: 1236496 - RNA, 19 nt, Homo sapiens
ucauugaucuuccuagaaa

SEQ ID NO: 1236497 - RNA, 19 nt, Homo sapiens
caucaucccuuuccaaauc

SEQ ID NO: 1236498 - RNA, 19 nt, Homo sapiens
gauugaggaucauuucauu

SEQ ID NO: 1236499 - RNA, 19 nt, Homo sapiens
caucaucccauccuuaaua

SEQ ID NO: 1236500 - RNA, 19 nt, Homo sapiens
gcaggaauaugagauugaa

SEQ ID NO: 1236501 - RNA, 19 nt, Homo sapiens
caaaacaguuggcugcuua

SEQ ID NO: 1236502 - RNA, 19 nt, Homo sapiens
ccaaauccuuguuacagaa

SEQ ID NO: 1236503 - RNA, 19 nt, Homo sapiens
guaaaccuguuaucucugu

SEQ ID NO: 1236504 - RNA, 19 nt, Homo sapiens
cagugaacaugaauuguaa

SEQ ID NO: 1236505 - RNA, 19 nt, Homo sapiens
ccauggacuuggcuaauuu

SEQ ID NO: 1236506 - RNA, 19 nt, Homo sapiens
aaagugaucuaucgcagaa

SEQ ID NO: 1236507 - RNA, 19 nt, Homo sapiens
acaguuacauugagagauu

SEQ ID NO: 1236508 - RNA, 19 nt, Homo sapiens
uaaccuuucuuugugcuua

SEQ ID NO: 1236509 - RNA, 19 nt, Homo sapiens
aagccaauguguuaugaua

SEQ ID NO: 1236510 - RNA, 19 nt, Homo sapiens
agacaggacuuaccacuag

SEQ ID NO: 1236511 - RNA, 19 nt, Homo sapiens
acaauuaaguggauuaugg

SEQ ID NO: 1236512 - RNA, 19 nt, Homo sapiens
uaacagcucuaaaucuuac

SEQ ID NO: 1236513 - RNA, 19 nt, Homo sapiens
ccaagaccaaucaucauua

SEQ ID NO: 1236514 - RNA, 19 nt, Homo sapiens
gaacuuguagcuuauuugu

SEQ ID NO: 1236515 - RNA, 19 nt, Homo sapiens
gcagaaagaaaguucauca

SEQ ID NO: 1236516 - RNA, 19 nt, Homo sapiens
gagauuauggcaucagaaa

SEQ ID NO: 1236517 - RNA, 19 nt, Homo sapiens
gaaaaugauugggguuuaa

SEQ ID NO: 1236518 - RNA, 19 nt, Homo sapiens
cuuaacagcucuaaaucuu

SEQ ID NO: 1236519 - RNA, 19 nt, Homo sapiens
ugaaaccacuaaugaaauc

SEQ ID NO: 1236520 - RNA, 19 nt, Homo sapiens
gaccaaucaucauuaacuu

SEQ ID NO: 1236521 - RNA, 19 nt, Homo sapiens
ggaaaaccaucuuacuuug

SEQ ID NO: 1236522 - RNA, 19 nt, Homo sapiens
ugacauggcaaauaaagaa

SEQ ID NO: 1236523 - RNA, 19 nt, Homo sapiens
uuaaaugugugcagcuauu

SEQ ID NO: 1236524 - RNA, 19 nt, Homo sapiens
uuugagaggugaguuauuu

SEQ ID NO: 1236525 - RNA, 19 nt, Homo sapiens
acuuguagcuuauuuguug

SEQ ID NO: 1236526 - RNA, 19 nt, Homo sapiens
uuacuuugguuccaggaua

SEQ ID NO: 1236527 - RNA, 19 nt, Homo sapiens
agucgaacauauuugguua

SEQ ID NO: 1236528 - RNA, 19 nt, Homo sapiens
agaggugaguuauuuaaga

SEQ ID NO: 1236529 - RNA, 19 nt, Homo sapiens
caucagaaacccacaaugu

SEQ ID NO: 1236530 - RNA, 19 nt, Homo sapiens
agaaagagaaguauaagug

SEQ ID NO: 1236531 - RNA, 19 nt, Homo sapiens
caugauagucgaacauauu

SEQ ID NO: 1236532 - RNA, 19 nt, Homo sapiens
cagaaacccacaauguuaa

SEQ ID NO: 1236533 - RNA, 19 nt, Homo sapiens
agaguuacauacagugauu

SEQ ID NO: 1236534 - RNA, 19 nt, Homo sapiens
ggaauuaaaucagggguuu

SEQ ID NO: 1236535 - RNA, 19 nt, Homo sapiens
acagaaagcccaucaucaa

SEQ ID NO: 1236536 - RNA, 19 nt, Homo sapiens
gaggugaguuauuuaagag

SEQ ID NO: 1236537 - RNA, 19 nt, Homo sapiens
gucacuaccuccucuaaug

SEQ ID NO: 1236538 - RNA, 19 nt, Homo sapiens
gaaacacucucugcaccau

SEQ ID NO: 1236539 - RNA, 19 nt, Homo sapiens
gaacaggaaaaccaucuua

SEQ ID NO: 1236540 - RNA, 19 nt, Homo sapiens
gguuuaaacuggcuucaag

SEQ ID NO: 1236541 - RNA, 19 nt, Homo sapiens
ccagauaaacuucguaaag

SEQ ID NO: 1236542 - RNA, 19 nt, Homo sapiens
gaaggagguuaagaaaucu

SEQ ID NO: 1236543 - RNA, 19 nt, Homo sapiens
acagugaacaugaauugua

SEQ ID NO: 1236544 - RNA, 19 nt, Homo sapiens
guucaccuuugcugcauuu

SEQ ID NO: 1236545 - RNA, 19 nt, Homo sapiens
uagaagaucuuggcguugu

SEQ ID NO: 1236546 - RNA, 19 nt, Homo sapiens
gaaagcccaucaucaaaau

SEQ ID NO: 1236547 - RNA, 19 nt, Homo sapiens
gaaccaccaagaccaauca

SEQ ID NO: 1236548 - RNA, 19 nt, Homo sapiens
aggagcagcuucaauuuca

SEQ ID NO: 1236549 - RNA, 19 nt, Homo sapiens
cuaauaagaacaugaagga

SEQ ID NO: 1236550 - RNA, 19 nt, Homo sapiens
gugaacuuguagcuuauuu

SEQ ID NO: 1236551 - RNA, 19 nt, Homo sapiens
cagaaagcccaucaucaaa

SEQ ID NO: 1236552 - RNA, 19 nt, Homo sapiens
ccaccaagaccaaucauca

SEQ ID NO: 1236553 - RNA, 19 nt, Homo sapiens
uugguuaacuccagugauu

SEQ ID NO: 1236554 - RNA, 19 nt, Homo sapiens
gaaaagcccagauaaacuu

SEQ ID NO: 1236555 - RNA, 19 nt, Homo sapiens
ugacaggcaucugagcaaa

SEQ ID NO: 1236556 - RNA, 19 nt, Homo sapiens
acacaucaucccauccuua

SEQ ID NO: 1236557 - RNA, 19 nt, Homo sapiens
ccaauuguuuacaggaaga

SEQ ID NO: 1236558 - RNA, 19 nt, Homo sapiens
ucaggaccaugaaacaaug

SEQ ID NO: 1236559 - RNA, 19 nt, Homo sapiens
ugagaggugaguuauuuaa

SEQ ID NO: 1236560 - RNA, 19 nt, Homo sapiens
auacagugauuuagaaugg

SEQ ID NO: 1236561 - RNA, 19 nt, Homo sapiens
gagcagcuucaauuucauu

SEQ ID NO: 1236562 - RNA, 19 nt, Homo sapiens
gauuucaucuacuaaagag

SEQ ID NO: 1236563 - RNA, 19 nt, Homo sapiens
ggaauaugagauugaaugu

SEQ ID NO: 1236564 - RNA, 19 nt, Homo sapiens
gauuauugcacgucuguga

SEQ ID NO: 1236565 - RNA, 19 nt, Homo sapiens
aguuaaugcugaucuugua

SEQ ID NO: 1236566 - RNA, 19 nt, Homo sapiens
uggagaaagagaaguauaa

SEQ ID NO: 1236567 - RNA, 19 nt, Homo sapiens
gcuggugguucacacauca

SEQ ID NO: 1236568 - RNA, 19 nt, Homo sapiens
aaacuuccuucauuugagu

SEQ ID NO: 1236569 - RNA, 19 nt, Homo sapiens
aaaggagcagcuucaauuu

SEQ ID NO: 1236570 - RNA, 19 nt, Homo sapiens
caugaaggagguuaagaaa

SEQ ID NO: 1236571 - RNA, 19 nt, Homo sapiens
gacagaaagcccaucauca

SEQ ID NO: 1236572 - RNA, 19 nt, Homo sapiens
cagauuucuugcucuuaaa

SEQ ID NO: 1236573 - RNA, 19 nt, Homo sapiens
guuggcugcuuacauaaau

SEQ ID NO: 1236574 - RNA, 19 nt, Homo sapiens
aacacucucugcaccauuu

SEQ ID NO: 1236575 - RNA, 19 nt, Homo sapiens
cuaaagagcauuugguuuu

SEQ ID NO: 1236576 - RNA, 19 nt, Homo sapiens
uaagaaaucuccaaaacag

SEQ ID NO: 1236577 - RNA, 19 nt, Homo sapiens
gaacuucaauccuucguuu

SEQ ID NO: 1236578 - RNA, 19 nt, Homo sapiens
gaaaguauguaaccagaau

SEQ ID NO: 1236579 - RNA, 19 nt, Homo sapiens
gaaauuagugcuacaguuu

SEQ ID NO: 1236580 - RNA, 19 nt, Homo sapiens
gagaaacauuacaggauua

SEQ ID NO: 1236581 - RNA, 19 nt, Homo sapiens
gaaaggaaaugcuguaacu

SEQ ID NO: 1236582 - RNA, 19 nt, Homo sapiens
ggaaaguaauccaguuuga

SEQ ID NO: 1236583 - RNA, 19 nt, Homo sapiens
cgacagaggacuccaauaa

SEQ ID NO: 1236584 - RNA, 19 nt, Homo sapiens
cacaggaccuuauggauuu

SEQ ID NO: 1236585 - RNA, 19 nt, Homo sapiens
ucaaggagcuaaaccaaug

SEQ ID NO: 1236586 - RNA, 19 nt, Homo sapiens
ggaaaguggucgcuuaugg

SEQ ID NO: 1236587 - RNA, 19 nt, Homo sapiens
gcaugaacguaauccagua

SEQ ID NO: 1236588 - RNA, 19 nt, Homo sapiens
aaauaggacucucagguaa

SEQ ID NO: 1236589 - RNA, 19 nt, Homo sapiens
agaaugacaugcuuacuau

SEQ ID NO: 1236590 - RNA, 19 nt, Homo sapiens
ucacaaggcacccuaaauu

SEQ ID NO: 1236591 - RNA, 19 nt, Homo sapiens
gcuaauuaccucaucauaa

SEQ ID NO: 1236592 - RNA, 19 nt, Homo sapiens
caagaagaaugugguggua

SEQ ID NO: 1236593 - RNA, 19 nt, Homo sapiens
gaaaugugaagauguauuc

SEQ ID NO: 1236594 - RNA, 19 nt, Homo sapiens
agaggaaaguggucgcuua

SEQ ID NO: 1236595 - RNA, 19 nt, Homo sapiens
ccagugacguguugacuug

SEQ ID NO: 1236596 - RNA, 19 nt, Homo sapiens
agagaaacauuacaggauu

SEQ ID NO: 1236597 - RNA, 19 nt, Homo sapiens
gguagugacuguacucuag

SEQ ID NO: 1236598 - RNA, 19 nt, Homo sapiens
acagagaagaggaguauua

SEQ ID NO: 1236599 - RNA, 19 nt, Homo sapiens
gcaagcgauuagaagauuu

SEQ ID NO: 1236600 - RNA, 19 nt, Homo sapiens
gguaucagguauucuaugu

SEQ ID NO: 1236601 - RNA, 19 nt, Homo sapiens
uaagcagcaugcauuaauu

SEQ ID NO: 1236602 - RNA, 19 nt, Homo sapiens
ggagaaaggaaaugcugua

SEQ ID NO: 1236603 - RNA, 19 nt, Homo sapiens
gaagguuagcuuucuguuu

SEQ ID NO: 1236604 - RNA, 19 nt, Homo sapiens
gaacguaauccaguauuug

SEQ ID NO: 1236605 - RNA, 19 nt, Homo sapiens
ucaguucuaugcuaacgua

SEQ ID NO: 1236606 - RNA, 19 nt, Homo sapiens
gcucaauuauuaucaguuc

SEQ ID NO: 1236607 - RNA, 19 nt, Homo sapiens
gaaaugcuguaacuaaagc

SEQ ID NO: 1236608 - RNA, 19 nt, Homo sapiens
gaguagugauggucugaaa

SEQ ID NO: 1236609 - RNA, 19 nt, Homo sapiens
gacaagagcaggaacaugu

SEQ ID NO: 1236610 - RNA, 19 nt, Homo sapiens
gaaauaaaaccucagauga

SEQ ID NO: 1236611 - RNA, 19 nt, Homo sapiens
ggacugguugcuuguauuu

SEQ ID NO: 1236612 - RNA, 19 nt, Homo sapiens
guuacaggaugcucaguuu

SEQ ID NO: 1236613 - RNA, 19 nt, Homo sapiens
gaaaguaauccaguuugaa

SEQ ID NO: 1236614 - RNA, 19 nt, Homo sapiens
gcuacaguuucauacauuu

SEQ ID NO: 1236615 - RNA, 19 nt, Homo sapiens
ggaaagaggaacuucaauc

SEQ ID NO: 1236616 - RNA, 19 nt, Homo sapiens
ugaacguaauccaguauuu

SEQ ID NO: 1236617 - RNA, 19 nt, Homo sapiens
caccguagcuguuccuaau

SEQ ID NO: 1236618 - RNA, 19 nt, Homo sapiens
acagaggacuccaauaaca

SEQ ID NO: 1236619 - RNA, 19 nt, Homo sapiens
acacuucccugacagagaa

SEQ ID NO: 1236620 - RNA, 19 nt, Homo sapiens
ggcaagcgauuagaagauu

SEQ ID NO: 1236621 - RNA, 19 nt, Homo sapiens
caaggcacccuaaauucua

SEQ ID NO: 1236622 - RNA, 19 nt, Homo sapiens
aagguuagcuuucuguuuc

SEQ ID NO: 1236623 - RNA, 19 nt, Homo sapiens
guauagaagccaagaagaa

SEQ ID NO: 1236624 - RNA, 19 nt, Homo sapiens
gcaccucgaugggacacua

SEQ ID NO: 1236625 - RNA, 19 nt, Homo sapiens
cagauaugacagcuaauua

SEQ ID NO: 1236626 - RNA, 19 nt, Homo sapiens
gcaggaacauguggaguag

SEQ ID NO: 1236627 - RNA, 19 nt, Homo sapiens
aaaccaauggccagauuua

SEQ ID NO: 1236628 - RNA, 19 nt, Homo sapiens
cuaaaccaauggccagauu

SEQ ID NO: 1236629 - RNA, 19 nt, Homo sapiens
ucacaggaccuuauggauu

SEQ ID NO: 1236630 - RNA, 19 nt, Homo sapiens
ggacagggcagcagaagag

SEQ ID NO: 1236631 - RNA, 19 nt, Homo sapiens
gauguuaggagaaaggaaa

SEQ ID NO: 1236632 - RNA, 19 nt, Homo sapiens
gagaguauucgguggcuaa

SEQ ID NO: 1236633 - RNA, 19 nt, Homo sapiens
aggaaaugcuguaacuaaa

SEQ ID NO: 1236634 - RNA, 19 nt, Homo sapiens
acucucagguaauaguuua

SEQ ID NO: 1236635 - RNA, 19 nt, Homo sapiens
auaggacucucagguaaua

SEQ ID NO: 1236636 - RNA, 19 nt, Homo sapiens
gagagaaacauuacaggau

SEQ ID NO: 1236637 - RNA, 19 nt, Homo sapiens
ggagcacacuucccugaca

SEQ ID NO: 1236638 - RNA, 19 nt, Homo sapiens
cuaauuguuuccaggguuu

SEQ ID NO: 1236639 - RNA, 19 nt, Homo sapiens
auucagauaugacagcuaa

SEQ ID NO: 1236640 - RNA, 19 nt, Homo sapiens
uagaaugacaugcuuacua

SEQ ID NO: 1236641 - RNA, 19 nt, Homo sapiens
gcaauaagcaaaugcaaaa

SEQ ID NO: 1236642 - RNA, 19 nt, Homo sapiens
gaaacuucaggcagauuaa

SEQ ID NO: 1236643 - RNA, 19 nt, Homo sapiens
ugaaagaaguuggaaagag

SEQ ID NO: 1236644 - RNA, 19 nt, Homo sapiens
ccacagcugccagguguua

SEQ ID NO: 1236645 - RNA, 19 nt, Homo sapiens
guccauagcaggaaaguau

SEQ ID NO: 1236646 - RNA, 19 nt, Homo sapiens
guaauccaguuugaaaugu

SEQ ID NO: 1236647 - RNA, 19 nt, Homo sapiens
uagaugcacuauucuuguu

SEQ ID NO: 1236648 - RNA, 19 nt, Homo sapiens
agaaauuagugcuacaguu

SEQ ID NO: 1236649 - RNA, 19 nt, Homo sapiens
ggacuccaauaacacugaa

SEQ ID NO: 1236650 - RNA, 19 nt, Homo sapiens
aaggaaaugcuguaacuaa

SEQ ID NO: 1236651 - RNA, 19 nt, Homo sapiens
gcagaauagugaguagaau

SEQ ID NO: 1236652 - RNA, 19 nt, Homo sapiens
gagaaaggaaaugcuguaa

SEQ ID NO: 1236653 - RNA, 19 nt, Homo sapiens
gugauggucugaaagaagu

SEQ ID NO: 1236654 - RNA, 19 nt, Homo sapiens
cagcacagcagccuuucua

SEQ ID NO: 1236655 - RNA, 19 nt, Homo sapiens
gcaagguaaaucaguuaaa

SEQ ID NO: 1236656 - RNA, 19 nt, Homo sapiens
ggaaaugcuguaacuaaag

SEQ ID NO: 1236657 - RNA, 19 nt, Homo sapiens
ugccagaugucacgaaguu

SEQ ID NO: 1236658 - RNA, 19 nt, Homo sapiens
guagugauggucugaaaga

SEQ ID NO: 1236659 - RNA, 19 nt, Homo sapiens
gaaugacaugcuuacuaua

SEQ ID NO: 1236660 - RNA, 19 nt, Homo sapiens
cguguugacuugaaacuuc

SEQ ID NO: 1236661 - RNA, 19 nt, Homo sapiens
gaaagaggaacuucaaucc

SEQ ID NO: 1236662 - RNA, 19 nt, Homo sapiens
gaguggauagguaggguua

SEQ ID NO: 1236663 - RNA, 19 nt, Homo sapiens
ucaaguagccaagcucuga

SEQ ID NO: 1236664 - RNA, 19 nt, Homo sapiens
cagcaugcauuaauugaac

SEQ ID NO: 1236665 - RNA, 19 nt, Homo sapiens
uuaaguuguuucuggguaa

SEQ ID NO: 1236666 - RNA, 19 nt, Homo sapiens
aguauucgguggcuaauuc

SEQ ID NO: 1236667 - RNA, 19 nt, Homo sapiens
gaaaguggucgcuuauggu

SEQ ID NO: 1236668 - RNA, 19 nt, Homo sapiens
aaucauaguuaccuaagca

SEQ ID NO: 1236669 - RNA, 19 nt, Homo sapiens
guucuaugcuaacguauac

SEQ ID NO: 1236670 - RNA, 19 nt, Homo sapiens
ugauguuugugaucucuaa

SEQ ID NO: 1236671 - RNA, 19 nt, Homo sapiens
agaauguggugguaacuca

SEQ ID NO: 1236672 - RNA, 19 nt, Homo sapiens
guagcuguuccuaauauuu

SEQ ID NO: 1236673 - RNA, 19 nt, Homo sapiens
ccaauaacacugaaagucu

SEQ ID NO: 1236674 - RNA, 19 nt, Homo sapiens
gcugccagguguuaagaug

SEQ ID NO: 1236675 - RNA, 19 nt, Homo sapiens
ugaguagaaugacaugcuu

SEQ ID NO: 1236676 - RNA, 19 nt, Homo sapiens
ccguagcuguuccuaauau

SEQ ID NO: 1236677 - RNA, 19 nt, Homo sapiens
ggacaaagaugcugggaaa

SEQ ID NO: 1236678 - RNA, 19 nt, Homo sapiens
ggucaucuaucuugaaaua

SEQ ID NO: 1236679 - RNA, 19 nt, Homo sapiens
gaacaacgauagacugcua

SEQ ID NO: 1236680 - RNA, 19 nt, Homo sapiens
ggaauaaagucuucacguu

SEQ ID NO: 1236681 - RNA, 19 nt, Homo sapiens
gaaagcaagucuaaauaug

SEQ ID NO: 1236682 - RNA, 19 nt, Homo sapiens
gagaggagauauuaaagaa

SEQ ID NO: 1236683 - RNA, 19 nt, Homo sapiens
gaacagaaguacauugaag

SEQ ID NO: 1236684 - RNA, 19 nt, Homo sapiens
gaagaaagcaagucuaaau

SEQ ID NO: 1236685 - RNA, 19 nt, Homo sapiens
gaacauuaauacccaaaga

SEQ ID NO: 1236686 - RNA, 19 nt, Homo sapiens
gagagaaucuguaaauagu

SEQ ID NO: 1236687 - RNA, 19 nt, Homo sapiens
ggaagaagaagaugacaaa

SEQ ID NO: 1236688 - RNA, 19 nt, Homo sapiens
caaaguugcuauaccauug

SEQ ID NO: 1236689 - RNA, 19 nt, Homo sapiens
caucagagcggaaggguua

SEQ ID NO: 1236690 - RNA, 19 nt, Homo sapiens
ggaacgagaggagauauua

SEQ ID NO: 1236691 - RNA, 19 nt, Homo sapiens
caaggagucucgcugcuuu

SEQ ID NO: 1236692 - RNA, 19 nt, Homo sapiens
uaucagaccuacacagaaa

SEQ ID NO: 1236693 - RNA, 19 nt, Homo sapiens
aggcauaugucuuugaaua

SEQ ID NO: 1236694 - RNA, 19 nt, Homo sapiens
gaaguacauugaagaggaa

SEQ ID NO: 1236695 - RNA, 19 nt, Homo sapiens
cagagucccuucagaugua

SEQ ID NO: 1236696 - RNA, 19 nt, Homo sapiens
agaagaagaugacaaagau

SEQ ID NO: 1236697 - RNA, 19 nt, Homo sapiens
aaagaaauauagcccauug

SEQ ID NO: 1236698 - RNA, 19 nt, Homo sapiens
gaggaggagucauugauau

SEQ ID NO: 1236699 - RNA, 19 nt, Homo sapiens
gagaaucuguaaauagugu

SEQ ID NO: 1236700 - RNA, 19 nt, Homo sapiens
gauagacugcuaacacaua

SEQ ID NO: 1236701 - RNA, 19 nt, Homo sapiens
ggagggaacaauuugauuu

SEQ ID NO: 1236702 - RNA, 19 nt, Homo sapiens
gaugugacccuuacucuga

SEQ ID NO: 1236703 - RNA, 19 nt, Homo sapiens
ugacacaauuggaguuaaa

SEQ ID NO: 1236704 - RNA, 19 nt, Homo sapiens
ugauaacacuggaagauau

SEQ ID NO: 1236705 - RNA, 19 nt, Homo sapiens
gcgaaaggauaaagaauac

SEQ ID NO: 1236706 - RNA, 19 nt, Homo sapiens
ugacaaugcuaaugaggaa

SEQ ID NO: 1236707 - RNA, 19 nt, Homo sapiens
acagaaagccuacgucuug

SEQ ID NO: 1236708 - RNA, 19 nt, Homo sapiens
gaacgagaggagauauuaa

SEQ ID NO: 1236709 - RNA, 19 nt, Homo sapiens
ucugaaagauccucauuau

SEQ ID NO: 1236710 - RNA, 19 nt, Homo sapiens
gaaagccuacgucuugaaa

SEQ ID NO: 1236711 - RNA, 19 nt, Homo sapiens
gaagugacaguuuaugaug

SEQ ID NO: 1236712 - RNA, 19 nt, Homo sapiens
cuaaacagcugcuacuaag

SEQ ID NO: 1236713 - RNA, 19 nt, Homo sapiens
ccugaaagaugugggauuu

SEQ ID NO: 1236714 - RNA, 19 nt, Homo sapiens
gauaacacuggaagauaua

SEQ ID NO: 1236715 - RNA, 19 nt, Homo sapiens
gaaaccagauccuucucau

SEQ ID NO: 1236716 - RNA, 19 nt, Homo sapiens
ggcgaaaggauaaagaaua

SEQ ID NO: 1236717 - RNA, 19 nt, Homo sapiens
gcaauaccaagaacugaaa

SEQ ID NO: 1236718 - RNA, 19 nt, Homo sapiens
acaaugaacuacuugacuu

SEQ ID NO: 1236719 - RNA, 19 nt, Homo sapiens
gaaggaacgagaggagaua

SEQ ID NO: 1236720 - RNA, 19 nt, Homo sapiens
gaagaaagaggaggaguca

SEQ ID NO: 1236721 - RNA, 19 nt, Homo sapiens
ugagauacauuguccuugu

SEQ ID NO: 1236722 - RNA, 19 nt, Homo sapiens
uaacacauacugucuacaa

SEQ ID NO: 1236723 - RNA, 19 nt, Homo sapiens
gaugugacaaugcuaauga

SEQ ID NO: 1236724 - RNA, 19 nt, Homo sapiens
gaaaagugccugcaauuug

SEQ ID NO: 1236725 - RNA, 19 nt, Homo sapiens
gaaagaggaggagucauug

SEQ ID NO: 1236726 - RNA, 19 nt, Homo sapiens
aaacagcugcuacuaagaa

SEQ ID NO: 1236727 - RNA, 19 nt, Homo sapiens
gcuauaccauugcugucua

SEQ ID NO: 1236728 - RNA, 19 nt, Homo sapiens
aauaaagucuucacguuca

SEQ ID NO: 1236729 - RNA, 19 nt, Homo sapiens
gugaagaaagcaagucuaa

SEQ ID NO: 1236730 - RNA, 19 nt, Homo sapiens
gccauuguauauaaaggua

SEQ ID NO: 1236731 - RNA, 19 nt, Homo sapiens
gaacugaaaccagauccuu

SEQ ID NO: 1236732 - RNA, 19 nt, Homo sapiens
ccaaagaacagaaguacau

SEQ ID NO: 1236733 - RNA, 19 nt, Homo sapiens
aaagauauccauucaguuc

SEQ ID NO: 1236734 - RNA, 19 nt, Homo sapiens
gggcaucaauaaauuuaca

SEQ ID NO: 1236735 - RNA, 19 nt, Homo sapiens
ccauugcugucuauucaaa

SEQ ID NO: 1236736 - RNA, 19 nt, Homo sapiens
agaaagaggaggagucauu

SEQ ID NO: 1236737 - RNA, 19 nt, Homo sapiens
agagcaagauuaugccaaa

SEQ ID NO: 1236738 - RNA, 19 nt, Homo sapiens
gaaagauccucauuauccu

SEQ ID NO: 1236739 - RNA, 19 nt, Homo sapiens
agggagccauuguauauaa

SEQ ID NO: 1236740 - RNA, 19 nt, Homo sapiens
uguuagcuguggauaauaa

SEQ ID NO: 1236741 - RNA, 19 nt, Homo sapiens
guacaaaggcauaugucuu

SEQ ID NO: 1236742 - RNA, 19 nt, Homo sapiens
cagcuuacgaacauuaaua

SEQ ID NO: 1236743 - RNA, 19 nt, Homo sapiens
gugcagggcuguugcuauc

SEQ ID NO: 1236744 - RNA, 19 nt, Homo sapiens
cagcaucucugaccugucu

SEQ ID NO: 1236745 - RNA, 19 nt, Homo sapiens
ucgagagaaucuguaaaua

SEQ ID NO: 1236746 - RNA, 19 nt, Homo sapiens
uaccauugcugucuauuca

SEQ ID NO: 1236747 - RNA, 19 nt, Homo sapiens
ggacgaggaagaagaagau

SEQ ID NO: 1236748 - RNA, 19 nt, Homo sapiens
cagcuggacauuacauuaa

SEQ ID NO: 1236749 - RNA, 19 nt, Homo sapiens
cgagagaaucuguaaauag

SEQ ID NO: 1236750 - RNA, 19 nt, Homo sapiens
gaacuacuugacuuccuuu

SEQ ID NO: 1236751 - RNA, 19 nt, Homo sapiens
gaaguacaagagcaagauu

SEQ ID NO: 1236752 - RNA, 19 nt, Homo sapiens
ugaaagauccucauuaucc

SEQ ID NO: 1236753 - RNA, 19 nt, Homo sapiens
gggagccauuguauauaaa

SEQ ID NO: 1236754 - RNA, 19 nt, Homo sapiens
uuagggagccauuguauau

SEQ ID NO: 1236755 - RNA, 19 nt, Homo sapiens
ggacgagugauccauaugu

SEQ ID NO: 1236756 - RNA, 19 nt, Homo sapiens
ccagcuggacauuacauua

SEQ ID NO: 1236757 - RNA, 19 nt, Homo sapiens
uaaauaugcaguucucuca

SEQ ID NO: 1236758 - RNA, 19 nt, Homo sapiens
uaaacaggcccacagaugu

SEQ ID NO: 1236759 - RNA, 19 nt, Homo sapiens
gaggagaccagcaucuguu

SEQ ID NO: 1236760 - RNA, 19 nt, Homo sapiens
guccauaugcaauugauaa

SEQ ID NO: 1236761 - RNA, 19 nt, Homo sapiens
gacaguuuaugaugaagau

SEQ ID NO: 1236762 - RNA, 19 nt, Homo sapiens
gucuucacguucaacauua

SEQ ID NO: 1236763 - RNA, 19 nt, Homo sapiens
gcuaacacauacugucuac

SEQ ID NO: 1236764 - RNA, 19 nt, Homo sapiens
ggagaggaauagucagcau

SEQ ID NO: 1236765 - RNA, 19 nt, Homo sapiens
aagaaggggucaaaguuua

SEQ ID NO: 1236766 - RNA, 19 nt, Homo sapiens
gagggacgagugauccaua

SEQ ID NO: 1236767 - RNA, 19 nt, Homo sapiens
gcaaugaggagaccagcau

SEQ ID NO: 1236768 - RNA, 19 nt, Homo sapiens
ucucauagcccauauaaaa

SEQ ID NO: 1236769 - RNA, 19 nt, Homo sapiens
gaaaacagacucucuaaac

SEQ ID NO: 1236770 - RNA, 19 nt, Homo sapiens
cagaaagccuacgucuuga

SEQ ID NO: 1236771 - RNA, 19 nt, Homo sapiens
cagcaucuguuugggaaga

SEQ ID NO: 1236772 - RNA, 19 nt, Homo sapiens
gagauacauuguccuuguc

SEQ ID NO: 1236773 - RNA, 19 nt, Homo sapiens
gauauccauucaguucuug

SEQ ID NO: 1236774 - RNA, 19 nt, Homo sapiens
cgagaggagauauuaaaga

SEQ ID NO: 1236775 - RNA, 19 nt, Homo sapiens
gacgagugauccauaugug

SEQ ID NO: 1236776 - RNA, 19 nt, Homo sapiens
cagcagcauuuccuuucuu

SEQ ID NO: 1236777 - RNA, 19 nt, Homo sapiens
gaagaauacuaccagauua

SEQ ID NO: 1236778 - RNA, 19 nt, Homo sapiens
ggaagaauacuaccagauu

SEQ ID NO: 1236779 - RNA, 19 nt, Homo sapiens
aacgaaggcucgaagauua

SEQ ID NO: 1236780 - RNA, 19 nt, Homo sapiens
caggauaucugguucuuau

SEQ ID NO: 1236781 - RNA, 19 nt, Homo sapiens
guacucaucugcugugugu

SEQ ID NO: 1236782 - RNA, 19 nt, Homo sapiens
gaucugggacuguuuguuu

SEQ ID NO: 1236783 - RNA, 19 nt, Homo sapiens
ugacaggccuucugaggaa

SEQ ID NO: 1236784 - RNA, 19 nt, Homo sapiens
gcuguuagaugcucuuguu

SEQ ID NO: 1236785 - RNA, 19 nt, Homo sapiens
ggauaucugguucuuauaa

SEQ ID NO: 1236786 - RNA, 19 nt, Homo sapiens
acaaugugcugcuggcaua

SEQ ID NO: 1236787 - RNA, 19 nt, Homo sapiens
ccuaauggcuguacucauc

SEQ ID NO: 1236788 - RNA, 19 nt, Homo sapiens
gcgauaaguuuaagcagau

SEQ ID NO: 1236789 - RNA, 19 nt, Homo sapiens
gcacgagaaucacuugaac

SEQ ID NO: 1236790 - RNA, 19 nt, Homo sapiens
ucaaagagaagaccauguu

SEQ ID NO: 1236791 - RNA, 19 nt, Homo sapiens
uaacgaaggcucgaagauu

SEQ ID NO: 1236792 - RNA, 19 nt, Homo sapiens
cagcugggccuucaucaaa

SEQ ID NO: 1236793 - RNA, 19 nt, Homo sapiens
agaggacccuguacaaugu

SEQ ID NO: 1236794 - RNA, 19 nt, Homo sapiens
gacauuugcgauaaguuua

SEQ ID NO: 1236795 - RNA, 19 nt, Homo sapiens
gaauacuaccagauuacua

SEQ ID NO: 1236796 - RNA, 19 nt, Homo sapiens
gggagucaguaguuuccua

SEQ ID NO: 1236797 - RNA, 19 nt, Homo sapiens
caccagcguuccagacauu

SEQ ID NO: 1236798 - RNA, 19 nt, Homo sapiens
guuagaugcucuuguugga

SEQ ID NO: 1236799 - RNA, 19 nt, Homo sapiens
ggagucaguaguuuccuaa

SEQ ID NO: 1236800 - RNA, 19 nt, Homo sapiens
cagaggacccuguacaaug

SEQ ID NO: 1236801 - RNA, 19 nt, Homo sapiens
gcaaacgugggcgguauuu

SEQ ID NO: 1236802 - RNA, 19 nt, Homo sapiens
gcuuauguagucccaguua

SEQ ID NO: 1236803 - RNA, 19 nt, Homo sapiens
gaaaccccgucucuacuaa

SEQ ID NO: 1236804 - RNA, 19 nt, Homo sapiens
caaagggagcuucgugaug

SEQ ID NO: 1236805 - RNA, 19 nt, Homo sapiens
agacauuugcgauaaguuu

SEQ ID NO: 1236806 - RNA, 19 nt, Homo sapiens
gcugggccuucaucaaaga

SEQ ID NO: 1236807 - RNA, 19 nt, Homo sapiens
aaacgugggcgguauuuca

SEQ ID NO: 1236808 - RNA, 19 nt, Homo sapiens
cgagggcuuuccugucuau

SEQ ID NO: 1236809 - RNA, 19 nt, Homo sapiens
cgauaaguuuaagcagaua

SEQ ID NO: 1236810 - RNA, 19 nt, Homo sapiens
gauaucugguucuuauaac

SEQ ID NO: 1236811 - RNA, 19 nt, Homo sapiens
caaagagaagaccauguug

SEQ ID NO: 1236812 - RNA, 19 nt, Homo sapiens
ugugguggcucacgcuuau

SEQ ID NO: 1236813 - RNA, 19 nt, Homo sapiens
gcaggauaucugguucuua

SEQ ID NO: 1236814 - RNA, 19 nt, Homo sapiens
gucaguaguuuccuaagag

SEQ ID NO: 1236815 - RNA, 19 nt, Homo sapiens
ggguggcccugaccuuaau

SEQ ID NO: 1236816 - RNA, 19 nt, Homo sapiens
ggccaaggcguguggauca

SEQ ID NO: 1236817 - RNA, 19 nt, Homo sapiens
agucaguaguuuccuaaga

SEQ ID NO: 1236818 - RNA, 19 nt, Homo sapiens
uuccagacauuugcgauaa

SEQ ID NO: 1236819 - RNA, 19 nt, Homo sapiens
uuaagcagauaaccaaagg

SEQ ID NO: 1236820 - RNA, 19 nt, Homo sapiens
gggccuucaucaaagagaa

SEQ ID NO: 1236821 - RNA, 19 nt, Homo sapiens
ccagacauuugcgauaagu

SEQ ID NO: 1236822 - RNA, 19 nt, Homo sapiens
gggaaugaauuuuauagca

SEQ ID NO: 1236823 - RNA, 19 nt, Homo sapiens
gggacuguuuguuuaacga

SEQ ID NO: 1236824 - RNA, 19 nt, Homo sapiens
gcagcugggccuucaucaa

SEQ ID NO: 1236825 - RNA, 19 nt, Homo sapiens
uuaagcagcaccaggaguu

SEQ ID NO: 1236826 - RNA, 19 nt, Homo sapiens
ggacuguuuguuuaacgaa

SEQ ID NO: 1236827 - RNA, 19 nt, Homo sapiens
guuccagacauuugcgaua

SEQ ID NO: 1236828 - RNA, 19 nt, Homo sapiens
agacagugcuucggaucug

SEQ ID NO: 1236829 - RNA, 19 nt, Homo sapiens
aacgugaaguuccggaaga

SEQ ID NO: 1236830 - RNA, 19 nt, Homo sapiens
uggcaaacgugggcgguau

SEQ ID NO: 1236831 - RNA, 19 nt, Homo sapiens
ccaaagggagcuucgugau

SEQ ID NO: 1236832 - RNA, 19 nt, Homo sapiens
uauagcaggauaucugguu

SEQ ID NO: 1236833 - RNA, 19 nt, Homo sapiens
ggcucacgcuuauguaguc

SEQ ID NO: 1236834 - RNA, 19 nt, Homo sapiens
ggccugggagucaguaguu

SEQ ID NO: 1236835 - RNA, 19 nt, Homo sapiens
ggcauagggcacaggauga

SEQ ID NO: 1236836 - RNA, 19 nt, Homo sapiens
ggcacgagaaucacuugaa

SEQ ID NO: 1236837 - RNA, 19 nt, Homo sapiens
cuucggaucugggacuguu

SEQ ID NO: 1236838 - RNA, 19 nt, Homo sapiens
ugguucaucugccuguuug

SEQ ID NO: 1236839 - RNA, 19 nt, Homo sapiens
uccgagggcuuuccugucu

SEQ ID NO: 1236840 - RNA, 19 nt, Homo sapiens
ccaccagcguuccagacau

SEQ ID NO: 1236841 - RNA, 19 nt, Homo sapiens
gccugggagucaguaguuu

SEQ ID NO: 1236842 - RNA, 19 nt, Homo sapiens
gccagggaaugaauuuuau

SEQ ID NO: 1236843 - RNA, 19 nt, Homo sapiens
ccgagggcuuuccugucua

SEQ ID NO: 1236844 - RNA, 19 nt, Homo sapiens
ccagcucuguccugcaucu

SEQ ID NO: 1236845 - RNA, 19 nt, Homo sapiens
cagcaccaggaguugauuu

SEQ ID NO: 1236846 - RNA, 19 nt, Homo sapiens
cggguggcccugaccuuaa

SEQ ID NO: 1236847 - RNA, 19 nt, Homo sapiens
ccagaaucccggcuacuac

SEQ ID NO: 1236848 - RNA, 19 nt, Homo sapiens
aucugggacuguuuguuua

SEQ ID NO: 1236849 - RNA, 19 nt, Homo sapiens
gaacauggguuucuacauc

SEQ ID NO: 1236850 - RNA, 19 nt, Homo sapiens
gaaaggagcugaggucuac

SEQ ID NO: 1236851 - RNA, 19 nt, Homo sapiens
ggaaauuaauagcagagua

SEQ ID NO: 1236852 - RNA, 19 nt, Homo sapiens
gaaggacuauucuggcaaa

SEQ ID NO: 1236853 - RNA, 19 nt, Homo sapiens
ggacaaagacgaacugauc

SEQ ID NO: 1236854 - RNA, 19 nt, Homo sapiens
caugaugccuugaaauaaa

SEQ ID NO: 1236855 - RNA, 19 nt, Homo sapiens
ggaaugguuugguguuuga

SEQ ID NO: 1236856 - RNA, 19 nt, Homo sapiens
ggaauugacuuucuuaagc

SEQ ID NO: 1236857 - RNA, 19 nt, Homo sapiens
gcuaguguaucaguucuua

SEQ ID NO: 1236858 - RNA, 19 nt, Homo sapiens
gaugauagucaacaacaua

SEQ ID NO: 1236859 - RNA, 19 nt, Homo sapiens
gaaguggcgugaacuguca

SEQ ID NO: 1236860 - RNA, 19 nt, Homo sapiens
gaaaaugagcgguuuauaa

SEQ ID NO: 1236861 - RNA, 19 nt, Homo sapiens
caugaugacuuugauguaa

SEQ ID NO: 1236862 - RNA, 19 nt, Homo sapiens
gaagugagaccaagaaguc

SEQ ID NO: 1236863 - RNA, 19 nt, Homo sapiens
ccaaggcucccacuguuua

SEQ ID NO: 1236864 - RNA, 19 nt, Homo sapiens
gcgcuucccuuguggugua

SEQ ID NO: 1236865 - RNA, 19 nt, Homo sapiens
ugucaggaguucuagauaa

SEQ ID NO: 1236866 - RNA, 19 nt, Homo sapiens
ggacauccaucaccagcau

SEQ ID NO: 1236867 - RNA, 19 nt, Homo sapiens
ggaaggggcuggcuaaugu

SEQ ID NO: 1236868 - RNA, 19 nt, Homo sapiens
gagauagacucggcuugaa

SEQ ID NO: 1236869 - RNA, 19 nt, Homo sapiens
cagcaggccuugagguuau

SEQ ID NO: 1236870 - RNA, 19 nt, Homo sapiens
gauguaaccucauucucau

SEQ ID NO: 1236871 - RNA, 19 nt, Homo sapiens
gaaagauguaguagggaua

SEQ ID NO: 1236872 - RNA, 19 nt, Homo sapiens
gauuauugguuuccuuguu

SEQ ID NO: 1236873 - RNA, 19 nt, Homo sapiens
ggccaaggcucccacuguu

SEQ ID NO: 1236874 - RNA, 19 nt, Homo sapiens
uaagugaaauaacggguau

SEQ ID NO: 1236875 - RNA, 19 nt, Homo sapiens
ggcagaaucuagcaugaug

SEQ ID NO: 1236876 - RNA, 19 nt, Homo sapiens
gucaggaguucuagauaaa

SEQ ID NO: 1236877 - RNA, 19 nt, Homo sapiens
ggaaugguguaugcuguug

SEQ ID NO: 1236878 - RNA, 19 nt, Homo sapiens
uggcaaagccuaaaggaaa

SEQ ID NO: 1236879 - RNA, 19 nt, Homo sapiens
uagggaaguuagucauuaa

SEQ ID NO: 1236880 - RNA, 19 nt, Homo sapiens
auagggaaguuagucauua

SEQ ID NO: 1236881 - RNA, 19 nt, Homo sapiens
gaauugacuuucuuaagcu

SEQ ID NO: 1236882 - RNA, 19 nt, Homo sapiens
ucaccagcaucaaaucaaa

SEQ ID NO: 1236883 - RNA, 19 nt, Homo sapiens
agacucggcuugaaucuca

SEQ ID NO: 1236884 - RNA, 19 nt, Homo sapiens
guuuauaacugaugaguac

SEQ ID NO: 1236885 - RNA, 19 nt, Homo sapiens
caguaagcauucauucauu

SEQ ID NO: 1236886 - RNA, 19 nt, Homo sapiens
gaaauuaauagcagaguac

SEQ ID NO: 1236887 - RNA, 19 nt, Homo sapiens
guaaccucauucucauuaa

SEQ ID NO: 1236888 - RNA, 19 nt, Homo sapiens
gaaaugguugugauuagga

SEQ ID NO: 1236889 - RNA, 19 nt, Homo sapiens
uaacggguauggcagaauc

SEQ ID NO: 1236890 - RNA, 19 nt, Homo sapiens
cacaguagcuuucuagacu

SEQ ID NO: 1236891 - RNA, 19 nt, Homo sapiens
gccaccaucuuuauuuaga

SEQ ID NO: 1236892 - RNA, 19 nt, Homo sapiens
ugcaaaggcugacagauuc

SEQ ID NO: 1236893 - RNA, 19 nt, Homo sapiens
uuaggagcaugaugacuuu

SEQ ID NO: 1236894 - RNA, 19 nt, Homo sapiens
ugaugaagaugaagaugau

SEQ ID NO: 1236895 - RNA, 19 nt, Homo sapiens
ugacugaaaugguugugau

SEQ ID NO: 1236896 - RNA, 19 nt, Homo sapiens
guucaagaaacaagugaua

SEQ ID NO: 1236897 - RNA, 19 nt, Homo sapiens
ugggugcucuccucaagua

SEQ ID NO: 1236898 - RNA, 19 nt, Homo sapiens
cacccugccugccacuuua

SEQ ID NO: 1236899 - RNA, 19 nt, Homo sapiens
ggaaccagcaccagagaga

SEQ ID NO: 1236900 - RNA, 19 nt, Homo sapiens
uaucaguucuuaagaugug

SEQ ID NO: 1236901 - RNA, 19 nt, Homo sapiens
gcaugaugacuuugaugua

SEQ ID NO: 1236902 - RNA, 19 nt, Homo sapiens
ggugagagacgagucagua

SEQ ID NO: 1236903 - RNA, 19 nt, Homo sapiens
ccauuugacuuccuuucuu

SEQ ID NO: 1236904 - RNA, 19 nt, Homo sapiens
gggaaugguuugguguuug

SEQ ID NO: 1236905 - RNA, 19 nt, Homo sapiens
caguagcuuucuagacuaa

SEQ ID NO: 1236906 - RNA, 19 nt, Homo sapiens
aaacggguacccaguguaa

SEQ ID NO: 1236907 - RNA, 19 nt, Homo sapiens
gaagaggaccaugacauca

SEQ ID NO: 1236908 - RNA, 19 nt, Homo sapiens
gauagggaaguuagucauu

SEQ ID NO: 1236909 - RNA, 19 nt, Homo sapiens
gcaggaggaggcagagaaa

SEQ ID NO: 1236910 - RNA, 19 nt, Homo sapiens
ggaagcgggaauugacuuu

SEQ ID NO: 1236911 - RNA, 19 nt, Homo sapiens
ugaaucugaugaugaugaa

SEQ ID NO: 1236912 - RNA, 19 nt, Homo sapiens
ucauuaagguguuuauguc

SEQ ID NO: 1236913 - RNA, 19 nt, Homo sapiens
uguaaccucauucucauua

SEQ ID NO: 1236914 - RNA, 19 nt, Homo sapiens
ccuuugugcuaccaacuua

SEQ ID NO: 1236915 - RNA, 19 nt, Homo sapiens
aagcagcaaucuuccagaa

SEQ ID NO: 1236916 - RNA, 19 nt, Homo sapiens
caugucauuuguucaagaa

SEQ ID NO: 1236917 - RNA, 19 nt, Homo sapiens
gagccuccauccugucuuc

SEQ ID NO: 1236918 - RNA, 19 nt, Homo sapiens
uaaaggaagcgggaauuga

SEQ ID NO: 1236919 - RNA, 19 nt, Homo sapiens
gcacccugccugccacuuu

SEQ ID NO: 1236920 - RNA, 19 nt, Homo sapiens
cuauaaucauguucuggua

SEQ ID NO: 1236921 - RNA, 19 nt, Homo sapiens
gaaacggguacccagugua

SEQ ID NO: 1236922 - RNA, 19 nt, Homo sapiens
cagaugguguucuugaauc

SEQ ID NO: 1236923 - RNA, 19 nt, Homo sapiens
ggagcaugaugacuuugau

SEQ ID NO: 1236924 - RNA, 19 nt, Homo sapiens
ugaagucaguggaguccuu

SEQ ID NO: 1236925 - RNA, 19 nt, Homo sapiens
guagcuuucuagacuaaau

SEQ ID NO: 1236926 - RNA, 19 nt, Homo sapiens
uugccaccaucuuuauuua

SEQ ID NO: 1236927 - RNA, 19 nt, Homo sapiens
caucauggaagccgauuug

SEQ ID NO: 1236928 - RNA, 19 nt, Homo sapiens
cugcaaaggcugacagauu

SEQ ID NO: 1236929 - RNA, 19 nt, Homo sapiens
guguuuaugucucugcaaa

SEQ ID NO: 1236930 - RNA, 19 nt, Homo sapiens
gccaugaccaccacccaua

SEQ ID NO: 1236931 - RNA, 19 nt, Homo sapiens
ccucaaguggaaauuaaua

SEQ ID NO: 1236932 - RNA, 19 nt, Homo sapiens
aaugagcgguuuauaacug

SEQ ID NO: 1236933 - RNA, 19 nt, Homo sapiens
agaugaagaugaugaagag

SEQ ID NO: 1236934 - RNA, 19 nt, Homo sapiens
uguaucaguucuuaagaug

SEQ ID NO: 1236935 - RNA, 19 nt, Homo sapiens
guucuuaagaugugugaaa

SEQ ID NO: 1236936 - RNA, 19 nt, Homo sapiens
guuaggagcaugaugacuu

SEQ ID NO: 1236937 - RNA, 19 nt, Homo sapiens
cuucaugccugcacaguag

SEQ ID NO: 1236938 - RNA, 19 nt, Homo sapiens
caaauuguugcuaguguau

SEQ ID NO: 1236939 - RNA, 19 nt, Homo sapiens
cagcaucaaaucaaaguga

SEQ ID NO: 1236940 - RNA, 19 nt, Homo sapiens
acaaguaccucgggacauc

SEQ ID NO: 1236941 - RNA, 19 nt, Homo sapiens
ugacuuccuuucuucuuuc

SEQ ID NO: 1236942 - RNA, 19 nt, Homo sapiens
gcauugccaccaucuuuau

SEQ ID NO: 1236943 - RNA, 19 nt, Homo sapiens
aggcauuucuguauucgaa

SEQ ID NO: 1236944 - RNA, 19 nt, Homo sapiens
gguagugggaugagucuga

SEQ ID NO: 1236945 - RNA, 19 nt, Homo sapiens
guuuuaaggucuucaagua

SEQ ID NO: 1236946 - RNA, 19 nt, Homo sapiens
ugauguaaccucauucuca

SEQ ID NO: 1236947 - RNA, 19 nt, Homo sapiens
gauagacucggcuugaauc

SEQ ID NO: 1236948 - RNA, 19 nt, Homo sapiens
uuaguaagcagcaaucuuc

SEQ ID NO: 1236949 - RNA, 19 nt, Homo sapiens
caaagagcauguuagauua

SEQ ID NO: 1236950 - RNA, 19 nt, Homo sapiens
gcaaagacauccaaaguag

SEQ ID NO: 1236951 - RNA, 19 nt, Homo sapiens
ccaaagagcauguuagauu

SEQ ID NO: 1236952 - RNA, 19 nt, Homo sapiens
ugacccagcuuccuuuaua

SEQ ID NO: 1236953 - RNA, 19 nt, Homo sapiens
gaauggauauguucagugu

SEQ ID NO: 1236954 - RNA, 19 nt, Homo sapiens
caacgaugcuucagaaaca

SEQ ID NO: 1236955 - RNA, 19 nt, Homo sapiens
gggcaaaguuguaggugaa

SEQ ID NO: 1236956 - RNA, 19 nt, Homo sapiens
gaaagugccagaugauguu

SEQ ID NO: 1236957 - RNA, 19 nt, Homo sapiens
ggaauuagaggccaccaaa

SEQ ID NO: 1236958 - RNA, 19 nt, Homo sapiens
cagaugauguuuacugaug

SEQ ID NO: 1236959 - RNA, 19 nt, Homo sapiens
aaacacaugucgauccuau

SEQ ID NO: 1236960 - RNA, 19 nt, Homo sapiens
gcggacaguucuugccaua

SEQ ID NO: 1236961 - RNA, 19 nt, Homo sapiens
acagaaaguuguucagaug

SEQ ID NO: 1236962 - RNA, 19 nt, Homo sapiens
acacuuacguuguuccauu

SEQ ID NO: 1236963 - RNA, 19 nt, Homo sapiens
gaaagugaccagccgcaaa

SEQ ID NO: 1236964 - RNA, 19 nt, Homo sapiens
gaguuuauaugcagaaagu

SEQ ID NO: 1236965 - RNA, 19 nt, Homo sapiens
ggacaguucuugccauacu

SEQ ID NO: 1236966 - RNA, 19 nt, Homo sapiens
gacaggaucccgugcuuaa

SEQ ID NO: 1236967 - RNA, 19 nt, Homo sapiens
gcuagaagacuuagauaau

SEQ ID NO: 1236968 - RNA, 19 nt, Homo sapiens
cgucaaguaugaguuuaua

SEQ ID NO: 1236969 - RNA, 19 nt, Homo sapiens
gccagaagcuagaagacuu

SEQ ID NO: 1236970 - RNA, 19 nt, Homo sapiens
gaugguaauuucaauagca

SEQ ID NO: 1236971 - RNA, 19 nt, Homo sapiens
caaaaguccuucuguuauu

SEQ ID NO: 1236972 - RNA, 19 nt, Homo sapiens
gaagcuagaagacuuagau

SEQ ID NO: 1236973 - RNA, 19 nt, Homo sapiens
ggcaaagacauccaaagua

SEQ ID NO: 1236974 - RNA, 19 nt, Homo sapiens
uaacaccuauccucaucuu

SEQ ID NO: 1236975 - RNA, 19 nt, Homo sapiens
ugaagacgccgcaguaaau

SEQ ID NO: 1236976 - RNA, 19 nt, Homo sapiens
gauaauucuuuggaaguga

SEQ ID NO: 1236977 - RNA, 19 nt, Homo sapiens
gaugauguuuacugaugaa

SEQ ID NO: 1236978 - RNA, 19 nt, Homo sapiens
gccagaugauguuuacuga

SEQ ID NO: 1236979 - RNA, 19 nt, Homo sapiens
cauccaaaguagaaaguga

SEQ ID NO: 1236980 - RNA, 19 nt, Homo sapiens
acagugagcugagccagaa

SEQ ID NO: 1236981 - RNA, 19 nt, Homo sapiens
gaaaguuguucagaugagu

SEQ ID NO: 1236982 - RNA, 19 nt, Homo sapiens
caacgguuaccucaaguuu

SEQ ID NO: 1236983 - RNA, 19 nt, Homo sapiens
aaagacauccaaaguagaa

SEQ ID NO: 1236984 - RNA, 19 nt, Homo sapiens
caaaaguacugcuacagaa

SEQ ID NO: 1236985 - RNA, 19 nt, Homo sapiens
aaucucaucugcucuuuca

SEQ ID NO: 1236986 - RNA, 19 nt, Homo sapiens
augaaguccuggccuaaua

SEQ ID NO: 1236987 - RNA, 19 nt, Homo sapiens
gcaagaacagcagcagaaa

SEQ ID NO: 1236988 - RNA, 19 nt, Homo sapiens
ccagaagcuagaagacuua

SEQ ID NO: 1236989 - RNA, 19 nt, Homo sapiens
aaacaagcaaugagaaaug

SEQ ID NO: 1236990 - RNA, 19 nt, Homo sapiens
gccaacaccuccagucaag

SEQ ID NO: 1236991 - RNA, 19 nt, Homo sapiens
gaaaccaguucaggcaaag

SEQ ID NO: 1236992 - RNA, 19 nt, Homo sapiens
agaaaccaguucaggcaaa

SEQ ID NO: 1236993 - RNA, 19 nt, Homo sapiens
ucccuggguuugcuucuua

SEQ ID NO: 1236994 - RNA, 19 nt, Homo sapiens
ucaaacaagcaaugagaaa

SEQ ID NO: 1236995 - RNA, 19 nt, Homo sapiens
aaaccucacuacccacaga

SEQ ID NO: 1236996 - RNA, 19 nt, Homo sapiens
gcagaaagugccagaugau

SEQ ID NO: 1236997 - RNA, 19 nt, Homo sapiens
uggccuagaugguaauuuc

SEQ ID NO: 1236998 - RNA, 19 nt, Homo sapiens
cacagaaaguuguucagau

SEQ ID NO: 1236999 - RNA, 19 nt, Homo sapiens
cagcaaauaucagugucuu

SEQ ID NO: 1237000 - RNA, 19 nt, Homo sapiens
gaugaagacgccgcaguaa

SEQ ID NO: 1237001 - RNA, 19 nt, Homo sapiens
aaaagaagaaccccaguua

SEQ ID NO: 1237002 - RNA, 19 nt, Homo sapiens
aauaacaccuauccucauc

SEQ ID NO: 1237003 - RNA, 19 nt, Homo sapiens
gauguuuacugaugaagac

SEQ ID NO: 1237004 - RNA, 19 nt, Homo sapiens
agaaacaaaggaagacaaa

SEQ ID NO: 1237005 - RNA, 19 nt, Homo sapiens
aaugagaaaugccaaagag

SEQ ID NO: 1237006 - RNA, 19 nt, Homo sapiens
ugaugaagacgccgcagua

SEQ ID NO: 1237007 - RNA, 19 nt, Homo sapiens
ugcagaaagugccagauga

SEQ ID NO: 1237008 - RNA, 19 nt, Homo sapiens
cagucaagcuugcacaaag

SEQ ID NO: 1237009 - RNA, 19 nt, Homo sapiens
ccacagaaaguuguucaga

SEQ ID NO: 1237010 - RNA, 19 nt, Homo sapiens
acgguuaccucaaguuugu

SEQ ID NO: 1237011 - RNA, 19 nt, Homo sapiens
caaacaagcaaugagaaau

SEQ ID NO: 1237012 - RNA, 19 nt, Homo sapiens
gcagcaguaccaacaguau

SEQ ID NO: 1237013 - RNA, 19 nt, Homo sapiens
cuucuggccuagaugguaa

SEQ ID NO: 1237014 - RNA, 19 nt, Homo sapiens
gcagcuucuucuaauaaca

SEQ ID NO: 1237015 - RNA, 19 nt, Homo sapiens
caaagacauccaaaguaga

SEQ ID NO: 1237016 - RNA, 19 nt, Homo sapiens
gacccagcuuccuuuauag

SEQ ID NO: 1237017 - RNA, 19 nt, Homo sapiens
gaagacgccgcaguaaauc

SEQ ID NO: 1237018 - RNA, 19 nt, Homo sapiens
cuccaacgaugcuucagaa

SEQ ID NO: 1237019 - RNA, 19 nt, Homo sapiens
cuucaacgguuaccucaag

SEQ ID NO: 1237020 - RNA, 19 nt, Homo sapiens
acacaugucgauccuauuc

SEQ ID NO: 1237021 - RNA, 19 nt, Homo sapiens
agucaagcuugcacaaaga

SEQ ID NO: 1237022 - RNA, 19 nt, Homo sapiens
cugcagcuucuucuaauaa

SEQ ID NO: 1237023 - RNA, 19 nt, Homo sapiens
ucugcagcuucuucuaaua

SEQ ID NO: 1237024 - RNA, 19 nt, Homo sapiens
aaucaaacaagcaaugaga

SEQ ID NO: 1237025 - RNA, 19 nt, Homo sapiens
caucaaaaguccuucuguu

SEQ ID NO: 1237026 - RNA, 19 nt, Homo sapiens
ucaauagcauccgaaugga

SEQ ID NO: 1237027 - RNA, 19 nt, Homo sapiens
cagaaaguuguucagauga

SEQ ID NO: 1237028 - RNA, 19 nt, Homo sapiens
aaucaccgaggaggaauua

SEQ ID NO: 1237029 - RNA, 19 nt, Homo sapiens
gacaguucuugccauacuu

SEQ ID NO: 1237030 - RNA, 19 nt, Homo sapiens
acaccuauccucaucuuuc

SEQ ID NO: 1237031 - RNA, 19 nt, Homo sapiens
caaugagaaaugccaaaga

SEQ ID NO: 1237032 - RNA, 19 nt, Homo sapiens
gcaaugagaaaugccaaag

SEQ ID NO: 1237033 - RNA, 19 nt, Homo sapiens
ucggucagccuuugauuga

SEQ ID NO: 1237034 - RNA, 19 nt, Homo sapiens
gaagacaaaaguacugcua

SEQ ID NO: 1237035 - RNA, 19 nt, Homo sapiens
ucaccgaggaggaauuaga

SEQ ID NO: 1237036 - RNA, 19 nt, Homo sapiens
ccuagaugguaauuucaau

SEQ ID NO: 1237037 - RNA, 19 nt, Homo sapiens
cuuuggaagugaaggcuaa

SEQ ID NO: 1237038 - RNA, 19 nt, Homo sapiens
gagcauguuagauuauuac

SEQ ID NO: 1237039 - RNA, 19 nt, Homo sapiens
ugucgauccuauucaguug

SEQ ID NO: 1237040 - RNA, 19 nt, Homo sapiens
gcacaaagagaaaacaauc

SEQ ID NO: 1237041 - RNA, 19 nt, Homo sapiens
caagcuugcacaaagagaa

SEQ ID NO: 1237042 - RNA, 19 nt, Homo sapiens
ggugacccagcuuccuuua

SEQ ID NO: 1237043 - RNA, 19 nt, Homo sapiens
agaugauguuuacugauga

SEQ ID NO: 1237044 - RNA, 19 nt, Homo sapiens
agaaagugccagaugaugu

SEQ ID NO: 1237045 - RNA, 19 nt, Homo sapiens
cuauucaguugcaggcauu

SEQ ID NO: 1237046 - RNA, 19 nt, Homo sapiens
gaagaaccccaguuagaau

SEQ ID NO: 1237047 - RNA, 19 nt, Homo sapiens
gcaaaguuguaggugaaac

SEQ ID NO: 1237048 - RNA, 19 nt, Homo sapiens
agaaaguuguucagaugag

SEQ ID NO: 1237049 - RNA, 19 nt, Homo sapiens
cuacaucacugaaaugaaa

SEQ ID NO: 1237050 - RNA, 19 nt, Homo sapiens
cagaggacauguuugguua

SEQ ID NO: 1237051 - RNA, 19 nt, Homo sapiens
ggaaagagcagguugugaa

SEQ ID NO: 1237052 - RNA, 19 nt, Homo sapiens
ccagagaccuuccugagaa

SEQ ID NO: 1237053 - RNA, 19 nt, Homo sapiens
gaagugaauccuuggcuua

SEQ ID NO: 1237054 - RNA, 19 nt, Homo sapiens
ggacauguuugguuacuuc

SEQ ID NO: 1237055 - RNA, 19 nt, Homo sapiens
acaaaggaauguuucacua

SEQ ID NO: 1237056 - RNA, 19 nt, Homo sapiens
caaaggaauguuucacuaa

SEQ ID NO: 1237057 - RNA, 19 nt, Homo sapiens
gaagagaugcugcgauucu

SEQ ID NO: 1237058 - RNA, 19 nt, Homo sapiens
uagaagaacagcauucaaa

SEQ ID NO: 1237059 - RNA, 19 nt, Homo sapiens
aagauucacuuacaaagga

SEQ ID NO: 1237060 - RNA, 19 nt, Homo sapiens
gcagaggacauguuugguu

SEQ ID NO: 1237061 - RNA, 19 nt, Homo sapiens
gaaagagcagguugugaau

SEQ ID NO: 1237062 - RNA, 19 nt, Homo sapiens
ggaacagucugggcaagau

SEQ ID NO: 1237063 - RNA, 19 nt, Homo sapiens
gaguacuccuaucuuguuu

SEQ ID NO: 1237064 - RNA, 19 nt, Homo sapiens
uccagaaccugcccaagaa

SEQ ID NO: 1237065 - RNA, 19 nt, Homo sapiens
ugaaacugguggcacagaa

SEQ ID NO: 1237066 - RNA, 19 nt, Homo sapiens
ccugaguacuccuaucuug

SEQ ID NO: 1237067 - RNA, 19 nt, Homo sapiens
gaagauucacuuacaaagg

SEQ ID NO: 1237068 - RNA, 19 nt, Homo sapiens
augaagagaugcugcgauu

SEQ ID NO: 1237069 - RNA, 19 nt, Homo sapiens
ggucacagguuggaaagag

SEQ ID NO: 1237070 - RNA, 19 nt, Homo sapiens
guacuccuaucuuguuucu

SEQ ID NO: 1237071 - RNA, 19 nt, Homo sapiens
gagaugugcaccuaaagga

SEQ ID NO: 1237072 - RNA, 19 nt, Homo sapiens
caacugagacuaucuugcu

SEQ ID NO: 1237073 - RNA, 19 nt, Homo sapiens
caguggcucuuccgaaugu

SEQ ID NO: 1237074 - RNA, 19 nt, Homo sapiens
gaaagcgugaucccaggaa

SEQ ID NO: 1237075 - RNA, 19 nt, Homo sapiens
aagagcagguugugaaugg

SEQ ID NO: 1237076 - RNA, 19 nt, Homo sapiens
ggaggcugcaguuguggua

SEQ ID NO: 1237077 - RNA, 19 nt, Homo sapiens
ggcagcaucuggaggaaag

SEQ ID NO: 1237078 - RNA, 19 nt, Homo sapiens
ugaguacuccuaucuuguu

SEQ ID NO: 1237079 - RNA, 19 nt, Homo sapiens
gugaauccuuggcuuaugg

SEQ ID NO: 1237080 - RNA, 19 nt, Homo sapiens
ugucugaggccucuaaaga

SEQ ID NO: 1237081 - RNA, 19 nt, Homo sapiens
ccgaggagguugagcucuu

SEQ ID NO: 1237082 - RNA, 19 nt, Homo sapiens
gguugugaauggagauguu

SEQ ID NO: 1237083 - RNA, 19 nt, Homo sapiens
gguggcagaggacauguuu

SEQ ID NO: 1237084 - RNA, 19 nt, Homo sapiens
gaacagucugggcaagaug

SEQ ID NO: 1237085 - RNA, 19 nt, Homo sapiens
gcaguuugcucgcuuuccu

SEQ ID NO: 1237086 - RNA, 19 nt, Homo sapiens
cgaggagguugagcucuug

SEQ ID NO: 1237087 - RNA, 19 nt, Homo sapiens
gcaugggcaccgagaaaga

SEQ ID NO: 1237088 - RNA, 19 nt, Homo sapiens
cagcaugggcaccgagaaa

SEQ ID NO: 1237089 - RNA, 19 nt, Homo sapiens
uuggagaugugcaccuaaa

SEQ ID NO: 1237090 - RNA, 19 nt, Homo sapiens
gcagccaacugagacuauc

SEQ ID NO: 1237091 - RNA, 19 nt, Homo sapiens
gcuggagccugagcugguu

SEQ ID NO: 1237092 - RNA, 19 nt, Homo sapiens
aagagaugcugcgauucua

SEQ ID NO: 1237093 - RNA, 19 nt, Homo sapiens
cagagucgcucaaaaguag

SEQ ID NO: 1237094 - RNA, 19 nt, Homo sapiens
uuccuaggguuuagaagaa

SEQ ID NO: 1237095 - RNA, 19 nt, Homo sapiens
gaagaacagcauucaaaau

SEQ ID NO: 1237096 - RNA, 19 nt, Homo sapiens
gaggacauguuugguuacu

SEQ ID NO: 1237097 - RNA, 19 nt, Homo sapiens
agaaggugaucgacacagu

SEQ ID NO: 1237098 - RNA, 19 nt, Homo sapiens
ggagaugugcaccuaaagg

SEQ ID NO: 1237099 - RNA, 19 nt, Homo sapiens
gaaacugguggcacagaag

SEQ ID NO: 1237100 - RNA, 19 nt, Homo sapiens
gggccuggaagaaugauug

SEQ ID NO: 1237101 - RNA, 19 nt, Homo sapiens
gaacagcauucaaaauucc

SEQ ID NO: 1237102 - RNA, 19 nt, Homo sapiens
uccaguggcucuuccgaau

SEQ ID NO: 1237103 - RNA, 19 nt, Homo sapiens
gagaugcugcgauucuaca

SEQ ID NO: 1237104 - RNA, 19 nt, Homo sapiens
gcagagucgcucaaaagua

SEQ ID NO: 1237105 - RNA, 19 nt, Homo sapiens
cugccuacaucacugaaau

SEQ ID NO: 1237106 - RNA, 19 nt, Homo sapiens
augcugcgauucuacaguu

SEQ ID NO: 1237107 - RNA, 19 nt, Homo sapiens
cagugagcgucauccagaa

SEQ ID NO: 1237108 - RNA, 19 nt, Homo sapiens
gagcccgacugccagaaac

SEQ ID NO: 1237109 - RNA, 19 nt, Homo sapiens
ggucucugcagccaacuga

SEQ ID NO: 1237110 - RNA, 19 nt, Homo sapiens
ccucaaccacaacuucuga

SEQ ID NO: 1237111 - RNA, 19 nt, Homo sapiens
gauucuacaguuacuacaa

SEQ ID NO: 1237112 - RNA, 19 nt, Homo sapiens
cucgggacgucuucauuga

SEQ ID NO: 1237113 - RNA, 19 nt, Homo sapiens
cugggaggcugcaguugug

SEQ ID NO: 1237114 - RNA, 19 nt, Homo sapiens
ggacaguucgagcacuaca

SEQ ID NO: 1237115 - RNA, 19 nt, Homo sapiens
guucgggaguuggagaugu

SEQ ID NO: 1237116 - RNA, 19 nt, Homo sapiens
gcuccucaaccacaacuuc

SEQ ID NO: 1237117 - RNA, 19 nt, Homo sapiens
ggggacaguucgagcacua

SEQ ID NO: 1237118 - RNA, 19 nt, Homo sapiens
caugggcaccgagaaagaa

SEQ ID NO: 1237119 - RNA, 19 nt, Homo sapiens
gugaauaucugcaacauga

SEQ ID NO: 1237120 - RNA, 19 nt, Homo sapiens
ggaaggaggaggagaagaa

SEQ ID NO: 1237121 - RNA, 19 nt, Homo sapiens
uaaagaaaccgaccacaug

SEQ ID NO: 1237122 - RNA, 19 nt, Homo sapiens
ggaccuggcauccggauuu

SEQ ID NO: 1237123 - RNA, 19 nt, Homo sapiens
gaaggucucaggcagcuuu

SEQ ID NO: 1237124 - RNA, 19 nt, Homo sapiens
ggaggaacuuggcugaauc

SEQ ID NO: 1237125 - RNA, 19 nt, Homo sapiens
ggauggagagcgaaucuga

SEQ ID NO: 1237126 - RNA, 19 nt, Homo sapiens
gaccugcgcuaccgucugu

SEQ ID NO: 1237127 - RNA, 19 nt, Homo sapiens
ggagaugacgcugaggaua

SEQ ID NO: 1237128 - RNA, 19 nt, Homo sapiens
ucuguggucucaauaaaga

SEQ ID NO: 1237129 - RNA, 19 nt, Homo sapiens
gagaugacgcugaggauag

SEQ ID NO: 1237130 - RNA, 19 nt, Homo sapiens
gaaggaggaggagaagaaa

SEQ ID NO: 1237131 - RNA, 19 nt, Homo sapiens
cgucuguggucucaauaaa

SEQ ID NO: 1237132 - RNA, 19 nt, Homo sapiens
gguaaaagcaccaccuuaa

SEQ ID NO: 1237133 - RNA, 19 nt, Homo sapiens
ccgcugagcacgagcagua

SEQ ID NO: 1237134 - RNA, 19 nt, Homo sapiens
gcccgaggcucugaaguca

SEQ ID NO: 1237135 - RNA, 19 nt, Homo sapiens
ccucaaaccacacucaguu

SEQ ID NO: 1237136 - RNA, 19 nt, Homo sapiens
gaccuggcauccggauuug

SEQ ID NO: 1237137 - RNA, 19 nt, Homo sapiens
gaacaagaggaggaucaga

SEQ ID NO: 1237138 - RNA, 19 nt, Homo sapiens
gaacgaccgcagugacauc

SEQ ID NO: 1237139 - RNA, 19 nt, Homo sapiens
gcacgagcaguaccucuca

SEQ ID NO: 1237140 - RNA, 19 nt, Homo sapiens
ggagaagaaaccucaccuu

SEQ ID NO: 1237141 - RNA, 19 nt, Homo sapiens
aaaguccgcccucguguga

SEQ ID NO: 1237142 - RNA, 19 nt, Homo sapiens
agaggaagaaguccaaguu

SEQ ID NO: 1237143 - RNA, 19 nt, Homo sapiens
gaggaagaaguccaaguuc

SEQ ID NO: 1237144 - RNA, 19 nt, Homo sapiens
ggacugguucuggcucauu

SEQ ID NO: 1237145 - RNA, 19 nt, Homo sapiens
agaggcagcugcaggacau

SEQ ID NO: 1237146 - RNA, 19 nt, Homo sapiens
gagcaccagccuccaggaa

SEQ ID NO: 1237147 - RNA, 19 nt, Homo sapiens
gcuggaaggaggaggagaa

SEQ ID NO: 1237148 - RNA, 19 nt, Homo sapiens
aaaccacacucaguucaag

SEQ ID NO: 1237149 - RNA, 19 nt, Homo sapiens
caaaccacacucaguucaa

SEQ ID NO: 1237150 - RNA, 19 nt, Homo sapiens
gcccucgugugaccaauag

SEQ ID NO: 1237151 - RNA, 19 nt, Homo sapiens
gggaacaagaggaggauca

SEQ ID NO: 1237152 - RNA, 19 nt, Homo sapiens
gacugguucuggcucauuc

SEQ ID NO: 1237153 - RNA, 19 nt, Homo sapiens
gauggagagcgaaucugaa

SEQ ID NO: 1237154 - RNA, 19 nt, Homo sapiens
aggaggaacuuggcugaau

SEQ ID NO: 1237155 - RNA, 19 nt, Homo sapiens
ggacccggcauucggacuu

SEQ ID NO: 1237156 - RNA, 19 nt, Homo sapiens
cagagcugauguacaaguc

SEQ ID NO: 1237157 - RNA, 19 nt, Homo sapiens
uaccgucuguggucucaau

SEQ ID NO: 1237158 - RNA, 19 nt, Homo sapiens
gacccggcauucggacuug

SEQ ID NO: 1237159 - RNA, 19 nt, Homo sapiens
acaagaggaggaucagaug

SEQ ID NO: 1237160 - RNA, 19 nt, Homo sapiens
ggacucugaagcccaagga

SEQ ID NO: 1237161 - RNA, 19 nt, Homo sapiens
ucaaaccacacucaguuca

SEQ ID NO: 1237162 - RNA, 19 nt, Homo sapiens
ugcgggacaugauugagaa

SEQ ID NO: 1237163 - RNA, 19 nt, Homo sapiens
ccgaggcucugaagucacu

SEQ ID NO: 1237164 - RNA, 19 nt, Homo sapiens
gcuaccgucuguggucuca

SEQ ID NO: 1237165 - RNA, 19 nt, Homo sapiens
ucccuuagccaagccguua

SEQ ID NO: 1237166 - RNA, 19 nt, Homo sapiens
ccacaagcaagucccuuag

SEQ ID NO: 1237167 - RNA, 19 nt, Homo sapiens
cgaguggcagcuccucaaa

SEQ ID NO: 1237168 - RNA, 19 nt, Homo sapiens
ugaagcaccacaagcaagu

SEQ ID NO: 1237169 - RNA, 19 nt, Homo sapiens
gggacaugauugagaagcu

SEQ ID NO: 1237170 - RNA, 19 nt, Homo sapiens
agaaggcccaggaggcaaa

SEQ ID NO: 1237171 - RNA, 19 nt, Homo sapiens
gcugggaguguccacauca

SEQ ID NO: 1237172 - RNA, 19 nt, Homo sapiens
gggcuaccgcgacgugaau

SEQ ID NO: 1237173 - RNA, 19 nt, Homo sapiens
gugcuuggccucccuucga

SEQ ID NO: 1237174 - RNA, 19 nt, Homo sapiens
cgucacuuguucuauccaa

SEQ ID NO: 1237175 - RNA, 19 nt, Homo sapiens
auaaagaaaccgaccacau

SEQ ID NO: 1237176 - RNA, 19 nt, Homo sapiens
ccaaggacagcagcaagga

SEQ ID NO: 1237177 - RNA, 19 nt, Homo sapiens
gcaaggaaacuuacagaaa

SEQ ID NO: 1237178 - RNA, 19 nt, Homo sapiens
ggagaugagugaaguguuc

SEQ ID NO: 1237179 - RNA, 19 nt, Homo sapiens
ggagaagacccaaguauca

SEQ ID NO: 1237180 - RNA, 19 nt, Homo sapiens
ggauaaacccuuugaggaa

SEQ ID NO: 1237181 - RNA, 19 nt, Homo sapiens
caaggaaacuuacagaaac

SEQ ID NO: 1237182 - RNA, 19 nt, Homo sapiens
aaacgaagccauugugaaa

SEQ ID NO: 1237183 - RNA, 19 nt, Homo sapiens
agaagaaacuaaagagaug

SEQ ID NO: 1237184 - RNA, 19 nt, Homo sapiens
ugagugaaguguucgauga

SEQ ID NO: 1237185 - RNA, 19 nt, Homo sapiens
gaagaagaaacuaaagaga

SEQ ID NO: 1237186 - RNA, 19 nt, Homo sapiens
gaagaaaccagcaaaauug

SEQ ID NO: 1237187 - RNA, 19 nt, Homo sapiens
gaaccuccacaaauaguaa

SEQ ID NO: 1237188 - RNA, 19 nt, Homo sapiens
ugaaggaguucgucuguca

SEQ ID NO: 1237189 - RNA, 19 nt, Homo sapiens
gaaacuuacagaaacauga

SEQ ID NO: 1237190 - RNA, 19 nt, Homo sapiens
gaaacgaagccauugugaa

SEQ ID NO: 1237191 - RNA, 19 nt, Homo sapiens
gagaaucaacauuucauug

SEQ ID NO: 1237192 - RNA, 19 nt, Homo sapiens
aaagaaauccagacaguug

SEQ ID NO: 1237193 - RNA, 19 nt, Homo sapiens
gagaaugccgccucuguga

SEQ ID NO: 1237194 - RNA, 19 nt, Homo sapiens
gaaucaacauuucauuggu

SEQ ID NO: 1237195 - RNA, 19 nt, Homo sapiens
caaaucccuuggagaauca

SEQ ID NO: 1237196 - RNA, 19 nt, Homo sapiens
cuaaagagaugcccaagcu

SEQ ID NO: 1237197 - RNA, 19 nt, Homo sapiens
ggaaaauguuguccuuuga

SEQ ID NO: 1237198 - RNA, 19 nt, Homo sapiens
ucaaaucccuuggagaauc

SEQ ID NO: 1237199 - RNA, 19 nt, Homo sapiens
ggaaacgaagccauuguga

SEQ ID NO: 1237200 - RNA, 19 nt, Homo sapiens
ggaggaaggagcacggaaa

SEQ ID NO: 1237201 - RNA, 19 nt, Homo sapiens
ggaagaagaaacuaaagag

SEQ ID NO: 1237202 - RNA, 19 nt, Homo sapiens
gcauggagaugagugaagu

SEQ ID NO: 1237203 - RNA, 19 nt, Homo sapiens
ggaguucgucugucaguau

SEQ ID NO: 1237204 - RNA, 19 nt, Homo sapiens
ggagaaucaacauuucauu

SEQ ID NO: 1237205 - RNA, 19 nt, Homo sapiens
gaguucgucugucaguauu

SEQ ID NO: 1237206 - RNA, 19 nt, Homo sapiens
gagcaaaaccacaaauauu

SEQ ID NO: 1237207 - RNA, 19 nt, Homo sapiens
gauaaaguggguagguuug

SEQ ID NO: 1237208 - RNA, 19 nt, Homo sapiens
cagauaaaguggguagguu

SEQ ID NO: 1237209 - RNA, 19 nt, Homo sapiens
caaaauccaugaaagaauc

SEQ ID NO: 1237210 - RNA, 19 nt, Homo sapiens
guaaauacccagcagaacu

SEQ ID NO: 1237211 - RNA, 19 nt, Homo sapiens
ggauguaccuguuuuaucu

SEQ ID NO: 1237212 - RNA, 19 nt, Homo sapiens
ugcccaagcugcaguguga

SEQ ID NO: 1237213 - RNA, 19 nt, Homo sapiens
ccugaaagaugacaguaag

SEQ ID NO: 1237214 - RNA, 19 nt, Homo sapiens
ccaaaaggauaacauacaa

SEQ ID NO: 1237215 - RNA, 19 nt, Homo sapiens
ggaaccuccacaaauagua

SEQ ID NO: 1237216 - RNA, 19 nt, Homo sapiens
ugaggaagaagaaacuaaa

SEQ ID NO: 1237217 - RNA, 19 nt, Homo sapiens
ccaaaagcauuaaggagaa

SEQ ID NO: 1237218 - RNA, 19 nt, Homo sapiens
gcccgagccauaaauguaa

SEQ ID NO: 1237219 - RNA, 19 nt, Homo sapiens
gaaauccagacaguugaaa

SEQ ID NO: 1237220 - RNA, 19 nt, Homo sapiens
cauacaaaccgguguggaa

SEQ ID NO: 1237221 - RNA, 19 nt, Homo sapiens
acucaaaucccuuggagaa

SEQ ID NO: 1237222 - RNA, 19 nt, Homo sapiens
aacaggagcccgagccaua

SEQ ID NO: 1237223 - RNA, 19 nt, Homo sapiens
gaccaggauuccacugaca

SEQ ID NO: 1237224 - RNA, 19 nt, Homo sapiens
gaaugccgccucugugauc

SEQ ID NO: 1237225 - RNA, 19 nt, Homo sapiens
ggaggagucaaacuauguu

SEQ ID NO: 1237226 - RNA, 19 nt, Homo sapiens
ccaccgacaucuuacuucu

SEQ ID NO: 1237227 - RNA, 19 nt, Homo sapiens
gaaaccagcaaaauugaaa

SEQ ID NO: 1237228 - RNA, 19 nt, Homo sapiens
caugaaagaauccauacug

SEQ ID NO: 1237229 - RNA, 19 nt, Homo sapiens
uaaauacccagcagaacug

SEQ ID NO: 1237230 - RNA, 19 nt, Homo sapiens
guacacagcagccaguuuu

SEQ ID NO: 1237231 - RNA, 19 nt, Homo sapiens
ggaaggagcacggaaacag

SEQ ID NO: 1237232 - RNA, 19 nt, Homo sapiens
ugacgcaagugaccaggau

SEQ ID NO: 1237233 - RNA, 19 nt, Homo sapiens
gggagaagacccaaguauc

SEQ ID NO: 1237234 - RNA, 19 nt, Homo sapiens
gcacauucuaggaucuaaa

SEQ ID NO: 1237235 - RNA, 19 nt, Homo sapiens
gcaccaaaagaaacacuua

SEQ ID NO: 1237236 - RNA, 19 nt, Homo sapiens
gcauccaccugggcuugaa

SEQ ID NO: 1237237 - RNA, 19 nt, Homo sapiens
ggaaacuuacagaaacaug

SEQ ID NO: 1237238 - RNA, 19 nt, Homo sapiens
gaagacccaaguaucagau

SEQ ID NO: 1237239 - RNA, 19 nt, Homo sapiens
guaagcccgagccagauaa

SEQ ID NO: 1237240 - RNA, 19 nt, Homo sapiens
acucugugauggagacaaa

SEQ ID NO: 1237241 - RNA, 19 nt, Homo sapiens
gaaaaggcacauucuagga

SEQ ID NO: 1237242 - RNA, 19 nt, Homo sapiens
ugaagaaaccagcaaaauu

SEQ ID NO: 1237243 - RNA, 19 nt, Homo sapiens
aaggaaacuuacagaaaca

SEQ ID NO: 1237244 - RNA, 19 nt, Homo sapiens
cuacaacuacaaacccaaa

SEQ ID NO: 1237245 - RNA, 19 nt, Homo sapiens
cauucuaggaucuaaauug

SEQ ID NO: 1237246 - RNA, 19 nt, Homo sapiens
ccuuggagaaucaacauuu

SEQ ID NO: 1237247 - RNA, 19 nt, Homo sapiens
gagggagaagacccaagua

SEQ ID NO: 1237248 - RNA, 19 nt, Homo sapiens
uaccggaggagucaaacua

SEQ ID NO: 1237249 - RNA, 19 nt, Homo sapiens
agaaauaccggaggaguca

SEQ ID NO: 1237250 - RNA, 19 nt, Homo sapiens
uaaaguggguagguuugca

SEQ ID NO: 1237251 - RNA, 19 nt, Homo sapiens
gcccaagucagcaggagaa

SEQ ID NO: 1237252 - RNA, 19 nt, Homo sapiens
ggcauauucgggagcauaa

SEQ ID NO: 1237253 - RNA, 19 nt, Homo sapiens
cagcaaccacagagccuuu

SEQ ID NO: 1237254 - RNA, 19 nt, Homo sapiens
gcugcagugugaacucugu

SEQ ID NO: 1237255 - RNA, 19 nt, Homo sapiens
gucaaacuauguugcugau

SEQ ID NO: 1237256 - RNA, 19 nt, Homo sapiens
agauaaaguggguagguuu

SEQ ID NO: 1237257 - RNA, 19 nt, Homo sapiens
gacaaugaccaaaaggaua

SEQ ID NO: 1237258 - RNA, 19 nt, Homo sapiens
auaaacccuuugaggaaga

SEQ ID NO: 1237259 - RNA, 19 nt, Homo sapiens
auugaaaccuacauugcaa

SEQ ID NO: 1237260 - RNA, 19 nt, Homo sapiens
ccagcaaaauugaaaccua

SEQ ID NO: 1237261 - RNA, 19 nt, Homo sapiens
ccggaggagucaaacuaug

SEQ ID NO: 1237262 - RNA, 19 nt, Homo sapiens
guggguagguuugcaagca

SEQ ID NO: 1237263 - RNA, 19 nt, Homo sapiens
guaccuguuuuaucuuuga

SEQ ID NO: 1237264 - RNA, 19 nt, Homo sapiens
cauauucgggagcauaaug

SEQ ID NO: 1237265 - RNA, 19 nt, Homo sapiens
aguaauagcagugagaaug

SEQ ID NO: 1237266 - RNA, 19 nt, Homo sapiens
uaaacccuuugaggaagaa

SEQ ID NO: 1237267 - RNA, 19 nt, Homo sapiens
ugaguggcaagaauuagaa

SEQ ID NO: 1237268 - RNA, 19 nt, Homo sapiens
acauuucauugguucagaa

SEQ ID NO: 1237269 - RNA, 19 nt, Homo sapiens
ccgccucugugaucagcua

SEQ ID NO: 1237270 - RNA, 19 nt, Homo sapiens
gaggaagaagaaacuaaag

SEQ ID NO: 1237271 - RNA, 19 nt, Homo sapiens
ggaaagucaacuggaggaa

SEQ ID NO: 1237272 - RNA, 19 nt, Homo sapiens
guaauagcagugagaaugc

SEQ ID NO: 1237273 - RNA, 19 nt, Homo sapiens
uggaaaauguuguccuuug

SEQ ID NO: 1237274 - RNA, 19 nt, Homo sapiens
agaaucaacauuucauugg

SEQ ID NO: 1237275 - RNA, 19 nt, Homo sapiens
gugcaaggaaacuuacaga

SEQ ID NO: 1237276 - RNA, 19 nt, Homo sapiens
gaccagcagcaaccacaga

SEQ ID NO: 1237277 - RNA, 19 nt, Homo sapiens
gaagaaaccucauauauca

SEQ ID NO: 1237278 - RNA, 19 nt, Homo sapiens
caaacaaacuggacaaaua

SEQ ID NO: 1237279 - RNA, 19 nt, Homo sapiens
caaacaaacuggacaaaua

SEQ ID NO: 1237280 - RNA, 19 nt, Homo sapiens
gaucaacgcuuuagaugaa

SEQ ID NO: 1237281 - RNA, 19 nt, Homo sapiens
ggagaaauauggucaacuu

SEQ ID NO: 1237282 - RNA, 19 nt, Homo sapiens
gaaguaguaucucacaauu

SEQ ID NO: 1237283 - RNA, 19 nt, Homo sapiens
gagcagaaaucucgaguug

SEQ ID NO: 1237284 - RNA, 19 nt, Homo sapiens
aaacaaagaucucgucaga

SEQ ID NO: 1237285 - RNA, 19 nt, Homo sapiens
gcagaaaucucgaguugau

SEQ ID NO: 1237286 - RNA, 19 nt, Homo sapiens
gcuaacaucucuucauuau

SEQ ID NO: 1237287 - RNA, 19 nt, Homo sapiens
caagagacccgguuucuaa

SEQ ID NO: 1237288 - RNA, 19 nt, Homo sapiens
ugaaagagagcucaacuua

SEQ ID NO: 1237289 - RNA, 19 nt, Homo sapiens
ccagaucuguuuauucuuu

SEQ ID NO: 1237290 - RNA, 19 nt, Homo sapiens
cagaagaaguugaagauga

SEQ ID NO: 1237291 - RNA, 19 nt, Homo sapiens
ggaaagagcaauauaagga

SEQ ID NO: 1237292 - RNA, 19 nt, Homo sapiens
ugaaugagcuguugauauc

SEQ ID NO: 1237293 - RNA, 19 nt, Homo sapiens
aaagagagcucaacuuaag

SEQ ID NO: 1237294 - RNA, 19 nt, Homo sapiens
augaagagcuugauaguaa

SEQ ID NO: 1237295 - RNA, 19 nt, Homo sapiens
ggaagaagaggauaauuau

SEQ ID NO: 1237296 - RNA, 19 nt, Homo sapiens
ggauaaugaucucaacaaa

SEQ ID NO: 1237297 - RNA, 19 nt, Homo sapiens
ggauaaugaucucaacaaa

SEQ ID NO: 1237298 - RNA, 19 nt, Homo sapiens
aaacauaguccgaagcuua

SEQ ID NO: 1237299 - RNA, 19 nt, Homo sapiens
gaaagagagcucaacuuaa

SEQ ID NO: 1237300 - RNA, 19 nt, Homo sapiens
uuggaaagcuggaaacaua

SEQ ID NO: 1237301 - RNA, 19 nt, Homo sapiens
agaaucagaucauagcaua

SEQ ID NO: 1237302 - RNA, 19 nt, Homo sapiens
guccgaagcuuaagugaaa

SEQ ID NO: 1237303 - RNA, 19 nt, Homo sapiens
ggaagaaaccucauauauc

SEQ ID NO: 1237304 - RNA, 19 nt, Homo sapiens
gaagagaaguuugaguugu

SEQ ID NO: 1237305 - RNA, 19 nt, Homo sapiens
gaaaauggcuggauuaagg

SEQ ID NO: 1237306 - RNA, 19 nt, Homo sapiens
caagggaccugauuguaau

SEQ ID NO: 1237307 - RNA, 19 nt, Homo sapiens
gcacucuacacucuaauua

SEQ ID NO: 1237308 - RNA, 19 nt, Homo sapiens
guagagugguugaagauga

SEQ ID NO: 1237309 - RNA, 19 nt, Homo sapiens
gugaagaauuugauaguga

SEQ ID NO: 1237310 - RNA, 19 nt, Homo sapiens
gcauaucuauucuaaguag

SEQ ID NO: 1237311 - RNA, 19 nt, Homo sapiens
augaagagcuugauaguga

SEQ ID NO: 1237312 - RNA, 19 nt, Homo sapiens
augaagagcuugauaguga

SEQ ID NO: 1237313 - RNA, 19 nt, Homo sapiens
ccucauauaucauucaguu

SEQ ID NO: 1237314 - RNA, 19 nt, Homo sapiens
ugacagcgauauccuaguu

SEQ ID NO: 1237315 - RNA, 19 nt, Homo sapiens
gagcucaacuuaaguaaaa

SEQ ID NO: 1237316 - RNA, 19 nt, Homo sapiens
guugauauccugucaguuu

SEQ ID NO: 1237317 - RNA, 19 nt, Homo sapiens
caucacaacugaaauuagu

SEQ ID NO: 1237318 - RNA, 19 nt, Homo sapiens
guaagugucucauuaacuc

SEQ ID NO: 1237319 - RNA, 19 nt, Homo sapiens
ggccagaucuguuuauucu

SEQ ID NO: 1237320 - RNA, 19 nt, Homo sapiens
aagagaaguuugaguugua

SEQ ID NO: 1237321 - RNA, 19 nt, Homo sapiens
agaagaaguugaagaugaa

SEQ ID NO: 1237322 - RNA, 19 nt, Homo sapiens
gaagauggagaugauuaua

SEQ ID NO: 1237323 - RNA, 19 nt, Homo sapiens
gaaacaguggaaagaauuu

SEQ ID NO: 1237324 - RNA, 19 nt, Homo sapiens
cacaauuacuugauaguga

SEQ ID NO: 1237325 - RNA, 19 nt, Homo sapiens
gcauuuaucaggagaguug

SEQ ID NO: 1237326 - RNA, 19 nt, Homo sapiens
ggagggugaugaagagaau

SEQ ID NO: 1237327 - RNA, 19 nt, Homo sapiens
ucaaagaacucucaaaaca

SEQ ID NO: 1237328 - RNA, 19 nt, Homo sapiens
gcgauauccuaguuagaaa

SEQ ID NO: 1237329 - RNA, 19 nt, Homo sapiens
aaaguaauccucuuggaaa

SEQ ID NO: 1237330 - RNA, 19 nt, Homo sapiens
caaaagauaugcuaacauc

SEQ ID NO: 1237331 - RNA, 19 nt, Homo sapiens
aggaagaagaggauaauua

SEQ ID NO: 1237332 - RNA, 19 nt, Homo sapiens
gacaaauaauagaggauga

SEQ ID NO: 1237333 - RNA, 19 nt, Homo sapiens
gacaaauaauagaggauga

SEQ ID NO: 1237334 - RNA, 19 nt, Homo sapiens
uggcaacgguucaacauau

SEQ ID NO: 1237335 - RNA, 19 nt, Homo sapiens
gcauugcuuugcauaucua

SEQ ID NO: 1237336 - RNA, 19 nt, Homo sapiens
gaagacaucaagcgaggaa

SEQ ID NO: 1237337 - RNA, 19 nt, Homo sapiens
uaaagaaacaguggaaaga

SEQ ID NO: 1237338 - RNA, 19 nt, Homo sapiens
ggaccaugcaaauagauaa

SEQ ID NO: 1237339 - RNA, 19 nt, Homo sapiens
gaagaauccugaaaacugu

SEQ ID NO: 1237340 - RNA, 19 nt, Homo sapiens
gaugaagagcuugauagua

SEQ ID NO: 1237341 - RNA, 19 nt, Homo sapiens
gcuugauagugaagaauuu

SEQ ID NO: 1237342 - RNA, 19 nt, Homo sapiens
cuaaguagaggaaugcuuu

SEQ ID NO: 1237343 - RNA, 19 nt, Homo sapiens
cugcaucgcuacuguaaau

SEQ ID NO: 1237344 - RNA, 19 nt, Homo sapiens
gaagaagaggauaauuaug

SEQ ID NO: 1237345 - RNA, 19 nt, Homo sapiens
ucacgugccugagcagaaa

SEQ ID NO: 1237346 - RNA, 19 nt, Homo sapiens
ucuaaucccugcucuguca

SEQ ID NO: 1237347 - RNA, 19 nt, Homo sapiens
caucgcuacuguaaauauu

SEQ ID NO: 1237348 - RNA, 19 nt, Homo sapiens
ggagaugauuauauuaucg

SEQ ID NO: 1237349 - RNA, 19 nt, Homo sapiens
aauagaggaugaucaggaa

SEQ ID NO: 1237350 - RNA, 19 nt, Homo sapiens
caugaaacaaggagaaauu

SEQ ID NO: 1237351 - RNA, 19 nt, Homo sapiens
uggaagaaaccucauauau

SEQ ID NO: 1237352 - RNA, 19 nt, Homo sapiens
guaacacauuuccaucaga

SEQ ID NO: 1237353 - RNA, 19 nt, Homo sapiens
ccaggaccaugcaaauaga

SEQ ID NO: 1237354 - RNA, 19 nt, Homo sapiens
uaucaggagaguuguauaa

SEQ ID NO: 1237355 - RNA, 19 nt, Homo sapiens
agaggaugauuuagaagaa

SEQ ID NO: 1237356 - RNA, 19 nt, Homo sapiens
ugaaggaaaugacaguaag

SEQ ID NO: 1237357 - RNA, 19 nt, Homo sapiens
guaaaugugaagaucauga

SEQ ID NO: 1237358 - RNA, 19 nt, Homo sapiens
ggauuaaggagaaauaugg

SEQ ID NO: 1237359 - RNA, 19 nt, Homo sapiens
cuacaucacaacugaaauu

SEQ ID NO: 1237360 - RNA, 19 nt, Homo sapiens
gaaaccucauauaucauuc

SEQ ID NO: 1237361 - RNA, 19 nt, Homo sapiens
cggauuacuuucaagaaga

SEQ ID NO: 1237362 - RNA, 19 nt, Homo sapiens
aagaaacaguggaaagaau

SEQ ID NO: 1237363 - RNA, 19 nt, Homo sapiens
gcagugaugaaguugauga

SEQ ID NO: 1237364 - RNA, 19 nt, Homo sapiens
cagagacgcaguaguggua

SEQ ID NO: 1237365 - RNA, 19 nt, Homo sapiens
caaacuggacaaauaauag

SEQ ID NO: 1237366 - RNA, 19 nt, Homo sapiens
caaacuggacaaauaauag

SEQ ID NO: 1237367 - RNA, 19 nt, Homo sapiens
ucaggccucuagagucuuu

SEQ ID NO: 1237368 - RNA, 19 nt, Homo sapiens
ucccauugcuucagaauca

SEQ ID NO: 1237369 - RNA, 19 nt, Homo sapiens
uugauauccugucaguuua

SEQ ID NO: 1237370 - RNA, 19 nt, Homo sapiens
ucaagugaaugagcuguug

SEQ ID NO: 1237371 - RNA, 19 nt, Homo sapiens
gcggauuacuuucaagaag

SEQ ID NO: 1237372 - RNA, 19 nt, Homo sapiens
ucaggagaguuguauaaca

SEQ ID NO: 1237373 - RNA, 19 nt, Homo sapiens
guuggaaagagcaauauaa

SEQ ID NO: 1237374 - RNA, 19 nt, Homo sapiens
ugaugaagauggagaugau

SEQ ID NO: 1237375 - RNA, 19 nt, Homo sapiens
uagagugguugaagaugaa

SEQ ID NO: 1237376 - RNA, 19 nt, Homo sapiens
gaaagcauauuuugguauc

SEQ ID NO: 1237377 - RNA, 19 nt, Homo sapiens
ggaaugaggugcagauaaa

SEQ ID NO: 1237378 - RNA, 19 nt, Homo sapiens
gaaggagggucagcuauua

SEQ ID NO: 1237379 - RNA, 19 nt, Homo sapiens
cgaugaggcuguuaaauua

SEQ ID NO: 1237380 - RNA, 19 nt, Homo sapiens
gaaauacccuguaaagagu

SEQ ID NO: 1237381 - RNA, 19 nt, Homo sapiens
ucacggaguuccauuauuu

SEQ ID NO: 1237382 - RNA, 19 nt, Homo sapiens
gcaaaucuaucugcaagaa

SEQ ID NO: 1237383 - RNA, 19 nt, Homo sapiens
gaauccaccuccucucuuu

SEQ ID NO: 1237384 - RNA, 19 nt, Homo sapiens
gcaagaaagugacagauac

SEQ ID NO: 1237385 - RNA, 19 nt, Homo sapiens
ggauacagguugaugaguu

SEQ ID NO: 1237386 - RNA, 19 nt, Homo sapiens
gcaaagcaauccaagauac

SEQ ID NO: 1237387 - RNA, 19 nt, Homo sapiens
gacaugaaauacccuguaa

SEQ ID NO: 1237388 - RNA, 19 nt, Homo sapiens
gaagaugauugaaccacaa

SEQ ID NO: 1237389 - RNA, 19 nt, Homo sapiens
ugaagucggugcuacagua

SEQ ID NO: 1237390 - RNA, 19 nt, Homo sapiens
ccuaagggcuuuauucaug

SEQ ID NO: 1237391 - RNA, 19 nt, Homo sapiens
uaaaguaugugcagaucuu

SEQ ID NO: 1237392 - RNA, 19 nt, Homo sapiens
gaauuucucucaggacuau

SEQ ID NO: 1237393 - RNA, 19 nt, Homo sapiens
gcaagaauauagagcaaag

SEQ ID NO: 1237394 - RNA, 19 nt, Homo sapiens
ggagaaguuggaaguaaua

SEQ ID NO: 1237395 - RNA, 19 nt, Homo sapiens
gaagaaggagggucagcua

SEQ ID NO: 1237396 - RNA, 19 nt, Homo sapiens
gcagaucuuuagaaaccua

SEQ ID NO: 1237397 - RNA, 19 nt, Homo sapiens
gauacagguugaugaguug

SEQ ID NO: 1237398 - RNA, 19 nt, Homo sapiens
ggacuaugauccagaacug

SEQ ID NO: 1237399 - RNA, 19 nt, Homo sapiens
ggaaggauguaacgcauac

SEQ ID NO: 1237400 - RNA, 19 nt, Homo sapiens
gaaaggaacaaaggagaaa

SEQ ID NO: 1237401 - RNA, 19 nt, Homo sapiens
ggaagagggucugguggaa

SEQ ID NO: 1237402 - RNA, 19 nt, Homo sapiens
uuagaaaccuagagaaugu

SEQ ID NO: 1237403 - RNA, 19 nt, Homo sapiens
ugacuacccugacguugaa

SEQ ID NO: 1237404 - RNA, 19 nt, Homo sapiens
gagcaaagcaauccaagau

SEQ ID NO: 1237405 - RNA, 19 nt, Homo sapiens
gaauauagagcaaagcaau

SEQ ID NO: 1237406 - RNA, 19 nt, Homo sapiens
gcggacagcggaauagaua

SEQ ID NO: 1237407 - RNA, 19 nt, Homo sapiens
gaaaggaaagaaaggcaaa

SEQ ID NO: 1237408 - RNA, 19 nt, Homo sapiens
gaaagggagcgcccaguga

SEQ ID NO: 1237409 - RNA, 19 nt, Homo sapiens
caucgaaugcagaaauuua

SEQ ID NO: 1237410 - RNA, 19 nt, Homo sapiens
ggaguuccauuauuucgau

SEQ ID NO: 1237411 - RNA, 19 nt, Homo sapiens
ggaagaaggauuacugauc

SEQ ID NO: 1237412 - RNA, 19 nt, Homo sapiens
gaaaagaauuacagucaga

SEQ ID NO: 1237413 - RNA, 19 nt, Homo sapiens
ccacaaagaaaucagguuu

SEQ ID NO: 1237414 - RNA, 19 nt, Homo sapiens
auaaggaacugguggaaga

SEQ ID NO: 1237415 - RNA, 19 nt, Homo sapiens
uaaagagccucagaagaug

SEQ ID NO: 1237416 - RNA, 19 nt, Homo sapiens
gaccuaaaguugauagaag

SEQ ID NO: 1237417 - RNA, 19 nt, Homo sapiens
gaugagacaggaacuuaaa

SEQ ID NO: 1237418 - RNA, 19 nt, Homo sapiens
acaaagaaaucuggaugaa

SEQ ID NO: 1237419 - RNA, 19 nt, Homo sapiens
caucaagaaugaccuaaag

SEQ ID NO: 1237420 - RNA, 19 nt, Homo sapiens
ucaaagaggagaaacgaaa

SEQ ID NO: 1237421 - RNA, 19 nt, Homo sapiens
caagaaugaccuaaaguug

SEQ ID NO: 1237422 - RNA, 19 nt, Homo sapiens
ugaaauacccuguaaagag

SEQ ID NO: 1237423 - RNA, 19 nt, Homo sapiens
gauaaagagccucagaaga

SEQ ID NO: 1237424 - RNA, 19 nt, Homo sapiens
caccuccucucuuuaauga

SEQ ID NO: 1237425 - RNA, 19 nt, Homo sapiens
ggcaagaaagugacagaua

SEQ ID NO: 1237426 - RNA, 19 nt, Homo sapiens
auaaagagccucagaagau

SEQ ID NO: 1237427 - RNA, 19 nt, Homo sapiens
caaagaaggauaaagaucu

SEQ ID NO: 1237428 - RNA, 19 nt, Homo sapiens
caagaagaaaggaaagaaa

SEQ ID NO: 1237429 - RNA, 19 nt, Homo sapiens
gaauuacagucagagauca

SEQ ID NO: 1237430 - RNA, 19 nt, Homo sapiens
ggagaaacgaaaagaauua

SEQ ID NO: 1237431 - RNA, 19 nt, Homo sapiens
agaaugaccuaaaguugau

SEQ ID NO: 1237432 - RNA, 19 nt, Homo sapiens
gcaaagaaggauaaagauc

SEQ ID NO: 1237433 - RNA, 19 nt, Homo sapiens
ccacagucuuuccaaguug

SEQ ID NO: 1237434 - RNA, 19 nt, Homo sapiens
caacguaaggaaacugaaa

SEQ ID NO: 1237435 - RNA, 19 nt, Homo sapiens
cuaagggcuuuauucauga

SEQ ID NO: 1237436 - RNA, 19 nt, Homo sapiens
gaaagucaaccucacucuu

SEQ ID NO: 1237437 - RNA, 19 nt, Homo sapiens
agaaagagaagaaggcaaa

SEQ ID NO: 1237438 - RNA, 19 nt, Homo sapiens
ucgaugaggcuguuaaauu

SEQ ID NO: 1237439 - RNA, 19 nt, Homo sapiens
aaggagaaguuggaaguaa

SEQ ID NO: 1237440 - RNA, 19 nt, Homo sapiens
caaagaaaucuggaugaaa

SEQ ID NO: 1237441 - RNA, 19 nt, Homo sapiens
gaagucggugcuacaguaa

SEQ ID NO: 1237442 - RNA, 19 nt, Homo sapiens
gugcagaucuuuagaaacc

SEQ ID NO: 1237443 - RNA, 19 nt, Homo sapiens
gauccaggcucugaaaguc

SEQ ID NO: 1237444 - RNA, 19 nt, Homo sapiens
gcagauaaagcaugaagag

SEQ ID NO: 1237445 - RNA, 19 nt, Homo sapiens
gacaauuaguaagcaauga

SEQ ID NO: 1237446 - RNA, 19 nt, Homo sapiens
ucgagucucuguauaagga

SEQ ID NO: 1237447 - RNA, 19 nt, Homo sapiens
auccagaacugaucaaaga

SEQ ID NO: 1237448 - RNA, 19 nt, Homo sapiens
aaaccaagaggaagaagaa

SEQ ID NO: 1237449 - RNA, 19 nt, Homo sapiens
ggagggucagcuauuauuu

SEQ ID NO: 1237450 - RNA, 19 nt, Homo sapiens
gaaauuuaaccgggacauu

SEQ ID NO: 1237451 - RNA, 19 nt, Homo sapiens
gcguggauaucaaggagaa

SEQ ID NO: 1237452 - RNA, 19 nt, Homo sapiens
ucaagaaugaccuaaaguu

SEQ ID NO: 1237453 - RNA, 19 nt, Homo sapiens
aaagucaaccucacucuug

SEQ ID NO: 1237454 - RNA, 19 nt, Homo sapiens
aaagaaggauaaagaucug

SEQ ID NO: 1237455 - RNA, 19 nt, Homo sapiens
ucaggacuaugauccagaa

SEQ ID NO: 1237456 - RNA, 19 nt, Homo sapiens
gaguaucccuuucgaugag

SEQ ID NO: 1237457 - RNA, 19 nt, Homo sapiens
gaccaucgagucucuguau

SEQ ID NO: 1237458 - RNA, 19 nt, Homo sapiens
gaucaaagaggagaaacga

SEQ ID NO: 1237459 - RNA, 19 nt, Homo sapiens
uaaaggagaaguuggaagu

SEQ ID NO: 1237460 - RNA, 19 nt, Homo sapiens
gaauacugaucaggaaagu

SEQ ID NO: 1237461 - RNA, 19 nt, Homo sapiens
gcaaugaaggaaggaugua

SEQ ID NO: 1237462 - RNA, 19 nt, Homo sapiens
gaugauugaaccacaaaga

SEQ ID NO: 1237463 - RNA, 19 nt, Homo sapiens
uagaaggcguggauaucaa

SEQ ID NO: 1237464 - RNA, 19 nt, Homo sapiens
aagaaugaccuaaaguuga

SEQ ID NO: 1237465 - RNA, 19 nt, Homo sapiens
gaagcaaaucuaucugcaa

SEQ ID NO: 1237466 - RNA, 19 nt, Homo sapiens
gaggaaaacagaauguaua

SEQ ID NO: 1237467 - RNA, 19 nt, Homo sapiens
gcacggcaaggucgccuaa

SEQ ID NO: 1237468 - RNA, 19 nt, Homo sapiens
uuagccaccuucuacguaa

SEQ ID NO: 1237469 - RNA, 19 nt, Homo sapiens
gaaugucuacgaccaguuc

SEQ ID NO: 1237470 - RNA, 19 nt, Homo sapiens
ccaucgagucucuguauaa

SEQ ID NO: 1237471 - RNA, 19 nt, Homo sapiens
ccauacaacagguuauuga

SEQ ID NO: 1237472 - RNA, 19 nt, Homo sapiens
cagaagguuuggcgacguu

SEQ ID NO: 1237473 - RNA, 19 nt, Homo sapiens
gauugaaccacaaagaaau

SEQ ID NO: 1237474 - RNA, 19 nt, Homo sapiens
ggacagcggaauagauaca

SEQ ID NO: 1237475 - RNA, 19 nt, Homo sapiens
gaagaaggcaaagaaggau

SEQ ID NO: 1237476 - RNA, 19 nt, Homo sapiens
agugaaagcaggaaagaaa

SEQ ID NO: 1237477 - RNA, 19 nt, Homo sapiens
gcauugaagucauuaguua

SEQ ID NO: 1237478 - RNA, 19 nt, Homo sapiens
caacaagugucuagauuug

SEQ ID NO: 1237479 - RNA, 19 nt, Homo sapiens
gaaaggcacuagcugucua

SEQ ID NO: 1237480 - RNA, 19 nt, Homo sapiens
gaauaacuguggauuaaca

SEQ ID NO: 1237481 - RNA, 19 nt, Homo sapiens
ugauugagcuuguggauug

SEQ ID NO: 1237482 - RNA, 19 nt, Homo sapiens
ggagaagcauuugagauga

SEQ ID NO: 1237483 - RNA, 19 nt, Homo sapiens
ggcacuagcugucuaauag

SEQ ID NO: 1237484 - RNA, 19 nt, Homo sapiens
gaugauuccugaacuugaa

SEQ ID NO: 1237485 - RNA, 19 nt, Homo sapiens
guacuugaucuuuccauua

SEQ ID NO: 1237486 - RNA, 19 nt, Homo sapiens
ggucauuccuuuacuuuca

SEQ ID NO: 1237487 - RNA, 19 nt, Homo sapiens
gaacacaggcuugacagaa

SEQ ID NO: 1237488 - RNA, 19 nt, Homo sapiens
gaccugagcuacaaugaca

SEQ ID NO: 1237489 - RNA, 19 nt, Homo sapiens
gaacuugaagagcuaaauu

SEQ ID NO: 1237490 - RNA, 19 nt, Homo sapiens
gcugcaaagucucgaagua

SEQ ID NO: 1237491 - RNA, 19 nt, Homo sapiens
gagcuaaauuugucuugga

SEQ ID NO: 1237492 - RNA, 19 nt, Homo sapiens
gaaagcaacaggaagaugu

SEQ ID NO: 1237493 - RNA, 19 nt, Homo sapiens
ggacaaugguuuagacacu

SEQ ID NO: 1237494 - RNA, 19 nt, Homo sapiens
caacagcggacaugaaaga

SEQ ID NO: 1237495 - RNA, 19 nt, Homo sapiens
ugaccaagcuuccucagau

SEQ ID NO: 1237496 - RNA, 19 nt, Homo sapiens
ggauuuaucagccaacaaa

SEQ ID NO: 1237497 - RNA, 19 nt, Homo sapiens
guaaacugauuucccaugu

SEQ ID NO: 1237498 - RNA, 19 nt, Homo sapiens
gauauuagccuucgaccau

SEQ ID NO: 1237499 - RNA, 19 nt, Homo sapiens
ggaagaacuagaaugcuuu

SEQ ID NO: 1237500 - RNA, 19 nt, Homo sapiens
gcuaaagcaucuacaaguc

SEQ ID NO: 1237501 - RNA, 19 nt, Homo sapiens
caguauugcucagggauua

SEQ ID NO: 1237502 - RNA, 19 nt, Homo sapiens
ggagcaagauacaaaugau

SEQ ID NO: 1237503 - RNA, 19 nt, Homo sapiens
gacuucaacugucaacaaa

SEQ ID NO: 1237504 - RNA, 19 nt, Homo sapiens
ucucagauauaaaccauga

SEQ ID NO: 1237505 - RNA, 19 nt, Homo sapiens
ugaaaguacugaaguuaca

SEQ ID NO: 1237506 - RNA, 19 nt, Homo sapiens
cuucaacugucaacaaauu

SEQ ID NO: 1237507 - RNA, 19 nt, Homo sapiens
uuagaucuuuccugcaaua

SEQ ID NO: 1237508 - RNA, 19 nt, Homo sapiens
gagaagcauuugagaugau

SEQ ID NO: 1237509 - RNA, 19 nt, Homo sapiens
gggagaagcauuugagaug

SEQ ID NO: 1237510 - RNA, 19 nt, Homo sapiens
cagcggacaugaaagaaau

SEQ ID NO: 1237511 - RNA, 19 nt, Homo sapiens
cuacuaagcuacaaaccau

SEQ ID NO: 1237512 - RNA, 19 nt, Homo sapiens
caacuucugggccauuuaa

SEQ ID NO: 1237513 - RNA, 19 nt, Homo sapiens
cuacaaaccauucuccaaa

SEQ ID NO: 1237514 - RNA, 19 nt, Homo sapiens
gaucuuuccugcaauaagg

SEQ ID NO: 1237515 - RNA, 19 nt, Homo sapiens
gucagaagaugggacauuu

SEQ ID NO: 1237516 - RNA, 19 nt, Homo sapiens
acaagugucuagauuugaa

SEQ ID NO: 1237517 - RNA, 19 nt, Homo sapiens
gucaacaagugucuagauu

SEQ ID NO: 1237518 - RNA, 19 nt, Homo sapiens
ugggugagcugaggaaauu

SEQ ID NO: 1237519 - RNA, 19 nt, Homo sapiens
caugguggguuucaguaaa

SEQ ID NO: 1237520 - RNA, 19 nt, Homo sapiens
ucacugagauaggaaugaa

SEQ ID NO: 1237521 - RNA, 19 nt, Homo sapiens
uaaagugggaggaaauuug

SEQ ID NO: 1237522 - RNA, 19 nt, Homo sapiens
gaaaagaacaugaacgaau

SEQ ID NO: 1237523 - RNA, 19 nt, Homo sapiens
aaacagaaagcaacaggaa

SEQ ID NO: 1237524 - RNA, 19 nt, Homo sapiens
uaacaacagcggacaugaa

SEQ ID NO: 1237525 - RNA, 19 nt, Homo sapiens
gaagaacuagaaugcuuug

SEQ ID NO: 1237526 - RNA, 19 nt, Homo sapiens
ucaccucucugcucuggaa

SEQ ID NO: 1237527 - RNA, 19 nt, Homo sapiens
caacugugcuuuggagagu

SEQ ID NO: 1237528 - RNA, 19 nt, Homo sapiens
gcaagauacaaaugauuga

SEQ ID NO: 1237529 - RNA, 19 nt, Homo sapiens
aaagggagcaagauacaaa

SEQ ID NO: 1237530 - RNA, 19 nt, Homo sapiens
gaaagaaaugggagaagca

SEQ ID NO: 1237531 - RNA, 19 nt, Homo sapiens
aaaccauucuccaaaggaa

SEQ ID NO: 1237532 - RNA, 19 nt, Homo sapiens
agaaugcuuugaccaagaa

SEQ ID NO: 1237533 - RNA, 19 nt, Homo sapiens
gaugggcaguucuucugaa

SEQ ID NO: 1237534 - RNA, 19 nt, Homo sapiens
aauuagaucuuuccugcaa

SEQ ID NO: 1237535 - RNA, 19 nt, Homo sapiens
ccucaaaucugaaaguacu

SEQ ID NO: 1237536 - RNA, 19 nt, Homo sapiens
cccaucaacuucaccauga

SEQ ID NO: 1237537 - RNA, 19 nt, Homo sapiens
gagcaagauacaaaugauu

SEQ ID NO: 1237538 - RNA, 19 nt, Homo sapiens
agaggacaaugaccuuaaa

SEQ ID NO: 1237539 - RNA, 19 nt, Homo sapiens
aauaugagcaugccauuau

SEQ ID NO: 1237540 - RNA, 19 nt, Homo sapiens
gauuucccauguccuacua

SEQ ID NO: 1237541 - RNA, 19 nt, Homo sapiens
aaaagcaccucaaaucuga

SEQ ID NO: 1237542 - RNA, 19 nt, Homo sapiens
gggaggauauuuugauuga

SEQ ID NO: 1237543 - RNA, 19 nt, Homo sapiens
uagaaugcuuugaccaaga

SEQ ID NO: 1237544 - RNA, 19 nt, Homo sapiens
cacuaaagcuuuccauguc

SEQ ID NO: 1237545 - RNA, 19 nt, Homo sapiens
cugaggaaauuagaucuuu

SEQ ID NO: 1237546 - RNA, 19 nt, Homo sapiens
caccucaaaucugaaagua

SEQ ID NO: 1237547 - RNA, 19 nt, Homo sapiens
ggacauuucugggucaacu

SEQ ID NO: 1237548 - RNA, 19 nt, Homo sapiens
ugagaugauuccugaacuu

SEQ ID NO: 1237549 - RNA, 19 nt, Homo sapiens
ggaggaagaacuagaaugc

SEQ ID NO: 1237550 - RNA, 19 nt, Homo sapiens
gacaaugguuuagacacuu

SEQ ID NO: 1237551 - RNA, 19 nt, Homo sapiens
ucucugcucuggaaguauu

SEQ ID NO: 1237552 - RNA, 19 nt, Homo sapiens
ucaacaagugucuagauuu

SEQ ID NO: 1237553 - RNA, 19 nt, Homo sapiens
gagcaugccauuauucucu

SEQ ID NO: 1237554 - RNA, 19 nt, Homo sapiens
ccagagucaugaacugaau

SEQ ID NO: 1237555 - RNA, 19 nt, Homo sapiens
aggaagaacuagaaugcuu

SEQ ID NO: 1237556 - RNA, 19 nt, Homo sapiens
gguuuagacacuuguuaua

SEQ ID NO: 1237557 - RNA, 19 nt, Homo sapiens
gaugcaggguggaccaugu

SEQ ID NO: 1237558 - RNA, 19 nt, Homo sapiens
uugaagagcuaaauuuguc

SEQ ID NO: 1237559 - RNA, 19 nt, Homo sapiens
guguguaauucuaauguga

SEQ ID NO: 1237560 - RNA, 19 nt, Homo sapiens
ugaacgaauuccagaguca

SEQ ID NO: 1237561 - RNA, 19 nt, Homo sapiens
uauucaaccuuucuuggaa

SEQ ID NO: 1237562 - RNA, 19 nt, Homo sapiens
gggagcaagauacaaauga

SEQ ID NO: 1237563 - RNA, 19 nt, Homo sapiens
cuaaauuugucuuggaaca

SEQ ID NO: 1237564 - RNA, 19 nt, Homo sapiens
ccaggucauuccuuuacuu

SEQ ID NO: 1237565 - RNA, 19 nt, Homo sapiens
gaccaagcuuccucagauc

SEQ ID NO: 1237566 - RNA, 19 nt, Homo sapiens
cuggaaguauucaaccuuu

SEQ ID NO: 1237567 - RNA, 19 nt, Homo sapiens
uaccagcauugaagucauu

SEQ ID NO: 1237568 - RNA, 19 nt, Homo sapiens
gcagaaaagaggacaauga

SEQ ID NO: 1237569 - RNA, 19 nt, Homo sapiens
acagaaagcaacaggaaga

SEQ ID NO: 1237570 - RNA, 19 nt, Homo sapiens
guaaagugggaggaaauuu

SEQ ID NO: 1237571 - RNA, 19 nt, Homo sapiens
gagaugauuccugaacuug

SEQ ID NO: 1237572 - RNA, 19 nt, Homo sapiens
gauauaaaccaugaacagu

SEQ ID NO: 1237573 - RNA, 19 nt, Homo sapiens
ggaucuagguggagguuuu

SEQ ID NO: 1237574 - RNA, 19 nt, Homo sapiens
gagcugaggaaauuagauc

SEQ ID NO: 1237575 - RNA, 19 nt, Homo sapiens
gaaauuugccucugauccu

SEQ ID NO: 1237576 - RNA, 19 nt, Homo sapiens
acaaugguuuagacacuug

SEQ ID NO: 1237577 - RNA, 19 nt, Homo sapiens
ggacagaaaguacauauua

SEQ ID NO: 1237578 - RNA, 19 nt, Homo sapiens
ggaaaggacuguucauuga

SEQ ID NO: 1237579 - RNA, 19 nt, Homo sapiens
ucacauagcugcaaauuau

SEQ ID NO: 1237580 - RNA, 19 nt, Homo sapiens
gaaacucacugacaaagga

SEQ ID NO: 1237581 - RNA, 19 nt, Homo sapiens
ccacuaagaagaagauuua

SEQ ID NO: 1237582 - RNA, 19 nt, Homo sapiens
uauuauggcuggauugaua

SEQ ID NO: 1237583 - RNA, 19 nt, Homo sapiens
ccacuggccuguaugcaua

SEQ ID NO: 1237584 - RNA, 19 nt, Homo sapiens
gcaaggguauuacacaaug

SEQ ID NO: 1237585 - RNA, 19 nt, Homo sapiens
ggaaauaaccagcaguuug

SEQ ID NO: 1237586 - RNA, 19 nt, Homo sapiens
aaagggcucuuccucauaa

SEQ ID NO: 1237587 - RNA, 19 nt, Homo sapiens
uaaugaaucuagugccuuu

SEQ ID NO: 1237588 - RNA, 19 nt, Homo sapiens
ggucagacagguccaauuu

SEQ ID NO: 1237589 - RNA, 19 nt, Homo sapiens
uuaaauguaucccacguuu

SEQ ID NO: 1237590 - RNA, 19 nt, Homo sapiens
aagaagaacugaccagcaa

SEQ ID NO: 1237591 - RNA, 19 nt, Homo sapiens
ggauuugccugaguugauu

SEQ ID NO: 1237592 - RNA, 19 nt, Homo sapiens
gaaauaaccagcaguuugc

SEQ ID NO: 1237593 - RNA, 19 nt, Homo sapiens
aaaggacuguucauugauu

SEQ ID NO: 1237594 - RNA, 19 nt, Homo sapiens
gggaaaggacuguucauug

SEQ ID NO: 1237595 - RNA, 19 nt, Homo sapiens
gaucuuggagcagaaguua

SEQ ID NO: 1237596 - RNA, 19 nt, Homo sapiens
ggauggcuauauuguaguu

SEQ ID NO: 1237597 - RNA, 19 nt, Homo sapiens
gagcagaaguuauaaaagu

SEQ ID NO: 1237598 - RNA, 19 nt, Homo sapiens
gaaaagggcucuuccucau

SEQ ID NO: 1237599 - RNA, 19 nt, Homo sapiens
caucccagguggcguguuu

SEQ ID NO: 1237600 - RNA, 19 nt, Homo sapiens
gagcuauuauggcuggauu

SEQ ID NO: 1237601 - RNA, 19 nt, Homo sapiens
gaauuuaggagaucuugga

SEQ ID NO: 1237602 - RNA, 19 nt, Homo sapiens
gcaguggagucccguaugg

SEQ ID NO: 1237603 - RNA, 19 nt, Homo sapiens
ugccugaguugauugauaa

SEQ ID NO: 1237604 - RNA, 19 nt, Homo sapiens
aaccaaggauggcuauauu

SEQ ID NO: 1237605 - RNA, 19 nt, Homo sapiens
cagcaaggguauuacacaa

SEQ ID NO: 1237606 - RNA, 19 nt, Homo sapiens
caaggauggcuauauugua

SEQ ID NO: 1237607 - RNA, 19 nt, Homo sapiens
gcagucagauaugaacaau

SEQ ID NO: 1237608 - RNA, 19 nt, Homo sapiens
gaagaauguauuugcagaa

SEQ ID NO: 1237609 - RNA, 19 nt, Homo sapiens
gcuguugccucggcuguuu

SEQ ID NO: 1237610 - RNA, 19 nt, Homo sapiens
acaauggccucguuaugga

SEQ ID NO: 1237611 - RNA, 19 nt, Homo sapiens
gcugcaaauuaucuuauug

SEQ ID NO: 1237612 - RNA, 19 nt, Homo sapiens
gaaaggacuguucauugau

SEQ ID NO: 1237613 - RNA, 19 nt, Homo sapiens
ucagacagguccaauuucu

SEQ ID NO: 1237614 - RNA, 19 nt, Homo sapiens
guaugcauauggagcuauu

SEQ ID NO: 1237615 - RNA, 19 nt, Homo sapiens
guacauauuaucucagugu

SEQ ID NO: 1237616 - RNA, 19 nt, Homo sapiens
acaugaaacucacugacaa

SEQ ID NO: 1237617 - RNA, 19 nt, Homo sapiens
gcaagugguuauaucuuuu

SEQ ID NO: 1237618 - RNA, 19 nt, Homo sapiens
guaguuggagcaggaaaua

SEQ ID NO: 1237619 - RNA, 19 nt, Homo sapiens
aaggauggcuauauuguag

SEQ ID NO: 1237620 - RNA, 19 nt, Homo sapiens
uacaguaaguucaagaugu

SEQ ID NO: 1237621 - RNA, 19 nt, Homo sapiens
gacuguucauugauuguaa

SEQ ID NO: 1237622 - RNA, 19 nt, Homo sapiens
ggacuguucauugauugua

SEQ ID NO: 1237623 - RNA, 19 nt, Homo sapiens
cauggcaucuccagaaugg

SEQ ID NO: 1237624 - RNA, 19 nt, Homo sapiens
ugaacgguuugaagaagaa

SEQ ID NO: 1237625 - RNA, 19 nt, Homo sapiens
uuacauggcaucuccagaa

SEQ ID NO: 1237626 - RNA, 19 nt, Homo sapiens
gaauguauuugcagaaccu

SEQ ID NO: 1237627 - RNA, 19 nt, Homo sapiens
agcaagugguuauaucuuu

SEQ ID NO: 1237628 - RNA, 19 nt, Homo sapiens
gaguagcuaugacugaucu

SEQ ID NO: 1237629 - RNA, 19 nt, Homo sapiens
gaagaagauuuagaguaac

SEQ ID NO: 1237630 - RNA, 19 nt, Homo sapiens
gaagaacugaccagcaagu

SEQ ID NO: 1237631 - RNA, 19 nt, Homo sapiens
caugaagaauguauuugca

SEQ ID NO: 1237632 - RNA, 19 nt, Homo sapiens
uaucugaacgguuugaaga

SEQ ID NO: 1237633 - RNA, 19 nt, Homo sapiens
guacagcucauggcaguau

SEQ ID NO: 1237634 - RNA, 19 nt, Homo sapiens
cugaguugauugauaauuc

SEQ ID NO: 1237635 - RNA, 19 nt, Homo sapiens
caaaaggggugaaaaucau

SEQ ID NO: 1237636 - RNA, 19 nt, Homo sapiens
cauaaccucgauccgaaua

SEQ ID NO: 1237637 - RNA, 19 nt, Homo sapiens
ccaaggauggcuauauugu

SEQ ID NO: 1237638 - RNA, 19 nt, Homo sapiens
ccaguucugauaccacuaa

SEQ ID NO: 1237639 - RNA, 19 nt, Homo sapiens
acacaacgcacauccugaa

SEQ ID NO: 1237640 - RNA, 19 nt, Homo sapiens
acaguaaguucaagauguc

SEQ ID NO: 1237641 - RNA, 19 nt, Homo sapiens
uccaaagccugcugcauuc

SEQ ID NO: 1237642 - RNA, 19 nt, Homo sapiens
ucuuggagcagaaguuaua

SEQ ID NO: 1237643 - RNA, 19 nt, Homo sapiens
uaaccucgauccgaauaca

SEQ ID NO: 1237644 - RNA, 19 nt, Homo sapiens
gaucagcaaggguauuaca

SEQ ID NO: 1237645 - RNA, 19 nt, Homo sapiens
ccaaucaacaacaugaaga

SEQ ID NO: 1237646 - RNA, 19 nt, Homo sapiens
gcaguaucguuccuuacca

SEQ ID NO: 1237647 - RNA, 19 nt, Homo sapiens
caccuucggguacacaaua

SEQ ID NO: 1237648 - RNA, 19 nt, Homo sapiens
agacagguccaauuucuca

SEQ ID NO: 1237649 - RNA, 19 nt, Homo sapiens
ugagauacaguaaguucaa

SEQ ID NO: 1237650 - RNA, 19 nt, Homo sapiens
caaucaacaacaugaagaa

SEQ ID NO: 1237651 - RNA, 19 nt, Homo sapiens
gggugaaaaucaucuauug

SEQ ID NO: 1237652 - RNA, 19 nt, Homo sapiens
gagauacaguaaguucaag

SEQ ID NO: 1237653 - RNA, 19 nt, Homo sapiens
guauaaaacuaaccaccuu

SEQ ID NO: 1237654 - RNA, 19 nt, Homo sapiens
uugccugaguugauugaua

SEQ ID NO: 1237655 - RNA, 19 nt, Homo sapiens
aaaccaaggauggcuauau

SEQ ID NO: 1237656 - RNA, 19 nt, Homo sapiens
uuuguucccuaccaucuuu

SEQ ID NO: 1237657 - RNA, 19 nt, Homo sapiens
gcuauuauggcuggauuga

SEQ ID NO: 1237658 - RNA, 19 nt, Homo sapiens
caucuauuguuccaucaca

SEQ ID NO: 1237659 - RNA, 19 nt, Homo sapiens
ucugauaccacuaagaaga

SEQ ID NO: 1237660 - RNA, 19 nt, Homo sapiens
caugaaacucacugacaaa

SEQ ID NO: 1237661 - RNA, 19 nt, Homo sapiens
uuacacaauggccucguua

SEQ ID NO: 1237662 - RNA, 19 nt, Homo sapiens
caggaaauaaccagcaguu

SEQ ID NO: 1237663 - RNA, 19 nt, Homo sapiens
uuauggauuugugggauuu

SEQ ID NO: 1237664 - RNA, 19 nt, Homo sapiens
uuccaaagccugcugcauu

SEQ ID NO: 1237665 - RNA, 19 nt, Homo sapiens
cugaacgguuugaagaaga

SEQ ID NO: 1237666 - RNA, 19 nt, Homo sapiens
uacauggcaucuccagaau

SEQ ID NO: 1237667 - RNA, 19 nt, Homo sapiens
gauacaguaaguucaagau

SEQ ID NO: 1237668 - RNA, 19 nt, Homo sapiens
acacaauggccucguuaug

SEQ ID NO: 1237669 - RNA, 19 nt, Homo sapiens
aguaacuccagauuucuua

SEQ ID NO: 1237670 - RNA, 19 nt, Homo sapiens
guaaguucaagaugucaga

SEQ ID NO: 1237671 - RNA, 19 nt, Homo sapiens
gggacagaaaguacauauu

SEQ ID NO: 1237672 - RNA, 19 nt, Homo sapiens
aggaucagcaaggguauua

SEQ ID NO: 1237673 - RNA, 19 nt, Homo sapiens
cacaauggccucguuaugg

SEQ ID NO: 1237674 - RNA, 19 nt, Homo sapiens
caaggguauuacacaaugg

SEQ ID NO: 1237675 - RNA, 19 nt, Homo sapiens
cacaggguauggucagaca

SEQ ID NO: 1237676 - RNA, 19 nt, Homo sapiens
cagcaagugguuauaucuu

SEQ ID NO: 1237677 - RNA, 19 nt, Homo sapiens
ugacagaacuggaggauga

SEQ ID NO: 1237678 - RNA, 19 nt, Homo sapiens
ggagcuaccuugcuuguug

SEQ ID NO: 1237679 - RNA, 19 nt, Homo sapiens
gggaugagauggcagauga

SEQ ID NO: 1237680 - RNA, 19 nt, Homo sapiens
gcagcacucuggcauuuau

SEQ ID NO: 1237681 - RNA, 19 nt, Homo sapiens
gaagaagcagcgcaaguuu

SEQ ID NO: 1237682 - RNA, 19 nt, Homo sapiens
ggagaaggcagcuguacuu

SEQ ID NO: 1237683 - RNA, 19 nt, Homo sapiens
cagaugagguggccaaugg

SEQ ID NO: 1237684 - RNA, 19 nt, Homo sapiens
gagcacaggugacagaacu

SEQ ID NO: 1237685 - RNA, 19 nt, Homo sapiens
gaacaggcagccaaugauc

SEQ ID NO: 1237686 - RNA, 19 nt, Homo sapiens
gagcgcauccucucuggaa

SEQ ID NO: 1237687 - RNA, 19 nt, Homo sapiens
gcaaggaggaggcggugaa

SEQ ID NO: 1237688 - RNA, 19 nt, Homo sapiens
ugagcacccuggagaagaa

SEQ ID NO: 1237689 - RNA, 19 nt, Homo sapiens
ccugcaaccucccaucaaa

SEQ ID NO: 1237690 - RNA, 19 nt, Homo sapiens
uugcugcccuugagucuaa

SEQ ID NO: 1237691 - RNA, 19 nt, Homo sapiens
cagaacaggcagccaauga

SEQ ID NO: 1237692 - RNA, 19 nt, Homo sapiens
gaccauugcugcccuugag

SEQ ID NO: 1237693 - RNA, 19 nt, Homo sapiens
gacuggagcuaccuugcuu

SEQ ID NO: 1237694 - RNA, 19 nt, Homo sapiens
agaagcagcgcaaguuuga

SEQ ID NO: 1237695 - RNA, 19 nt, Homo sapiens
gcgcaaguuugaccagcuu

SEQ ID NO: 1237696 - RNA, 19 nt, Homo sapiens
gaugagguggccaauggua

SEQ ID NO: 1237697 - RNA, 19 nt, Homo sapiens
gagcgugcaugagcuggaa

SEQ ID NO: 1237698 - RNA, 19 nt, Homo sapiens
uggcagaaauaaacuccaa

SEQ ID NO: 1237699 - RNA, 19 nt, Homo sapiens
gggaaaccuucgagucaag

SEQ ID NO: 1237700 - RNA, 19 nt, Homo sapiens
ugaugaggcuggugaagag

SEQ ID NO: 1237701 - RNA, 19 nt, Homo sapiens
ccagaugcacuaacagaug

SEQ ID NO: 1237702 - RNA, 19 nt, Homo sapiens
gagaagaagcagcgcaagu

SEQ ID NO: 1237703 - RNA, 19 nt, Homo sapiens
agaagaagcagcgcaaguu

SEQ ID NO: 1237704 - RNA, 19 nt, Homo sapiens
cuacguagccacucuccuu

SEQ ID NO: 1237705 - RNA, 19 nt, Homo sapiens
cagaaucgggaaagugaaa

SEQ ID NO: 1237706 - RNA, 19 nt, Homo sapiens
cgccaggucuuccgacuag

SEQ ID NO: 1237707 - RNA, 19 nt, Homo sapiens
gcaagaugcaggcccagau

SEQ ID NO: 1237708 - RNA, 19 nt, Homo sapiens
cagcagcggcagcuuguga

SEQ ID NO: 1237709 - RNA, 19 nt, Homo sapiens
aggagcagcuagagcaaga

SEQ ID NO: 1237710 - RNA, 19 nt, Homo sapiens
gccacaagaugaccauugc

SEQ ID NO: 1237711 - RNA, 19 nt, Homo sapiens
gaucuauagacauuaggaa

SEQ ID NO: 1237712 - RNA, 19 nt, Homo sapiens
agcgugagcuggaagaugu

SEQ ID NO: 1237713 - RNA, 19 nt, Homo sapiens
caagaugcaggcccagaug

SEQ ID NO: 1237714 - RNA, 19 nt, Homo sapiens
cgacgaggaggcagaggaa

SEQ ID NO: 1237715 - RNA, 19 nt, Homo sapiens
gagcagcuagagcaagaga

SEQ ID NO: 1237716 - RNA, 19 nt, Homo sapiens
ucagcucccuguccuccuu

SEQ ID NO: 1237717 - RNA, 19 nt, Homo sapiens
ugcaggcucucaagacuca

SEQ ID NO: 1237718 - RNA, 19 nt, Homo sapiens
caaccucccaucaaaggau

SEQ ID NO: 1237719 - RNA, 19 nt, Homo sapiens
gcaggaccgggaugagaug

SEQ ID NO: 1237720 - RNA, 19 nt, Homo sapiens
cccagaaucgggaaaguga

SEQ ID NO: 1237721 - RNA, 19 nt, Homo sapiens
cguuauugaucuauagaca

SEQ ID NO: 1237722 - RNA, 19 nt, Homo sapiens
gccaagcagcugagagaug

SEQ ID NO: 1237723 - RNA, 19 nt, Homo sapiens
gugaugaggcuggugaaga

SEQ ID NO: 1237724 - RNA, 19 nt, Homo sapiens
gaacuccugagcgacagaa

SEQ ID NO: 1237725 - RNA, 19 nt, Homo sapiens
ccaaugguaaccuuagcaa

SEQ ID NO: 1237726 - RNA, 19 nt, Homo sapiens
gguggccaaugguaaccuu

SEQ ID NO: 1237727 - RNA, 19 nt, Homo sapiens
gcagaacaggcagccaaug

SEQ ID NO: 1237728 - RNA, 19 nt, Homo sapiens
gcagaugagguggccaaug

SEQ ID NO: 1237729 - RNA, 19 nt, Homo sapiens
cagcaggaccgggaugaga

SEQ ID NO: 1237730 - RNA, 19 nt, Homo sapiens
gaugaccccuaaacacaga

SEQ ID NO: 1237731 - RNA, 19 nt, Homo sapiens
caagcuguguuuccaucag

SEQ ID NO: 1237732 - RNA, 19 nt, Homo sapiens
aagaagcagcgcaaguuug

SEQ ID NO: 1237733 - RNA, 19 nt, Homo sapiens
uagcaaggcagccauucug

SEQ ID NO: 1237734 - RNA, 19 nt, Homo sapiens
gcaagcuguguuuccauca

SEQ ID NO: 1237735 - RNA, 19 nt, Homo sapiens
ggacuggagcuaccuugcu

SEQ ID NO: 1237736 - RNA, 19 nt, Homo sapiens
ucugacuucuugcccuuug

SEQ ID NO: 1237737 - RNA, 19 nt, Homo sapiens
acacagaaccuuucauuua

SEQ ID NO: 1237738 - RNA, 19 nt, Homo sapiens
ggaaacaacuaaaucuaga

SEQ ID NO: 1237739 - RNA, 19 nt, Homo sapiens
ggacagcgaucccaguuug

SEQ ID NO: 1237740 - RNA, 19 nt, Homo sapiens
gcagauggguuuguuauug

SEQ ID NO: 1237741 - RNA, 19 nt, Homo sapiens
gaaggaaaucuguuuagua

SEQ ID NO: 1237742 - RNA, 19 nt, Homo sapiens
cuaaaucaauggccaaauu

SEQ ID NO: 1237743 - RNA, 19 nt, Homo sapiens
acagugagguuucuuacua

SEQ ID NO: 1237744 - RNA, 19 nt, Homo sapiens
cacagaaccuuucauuuau

SEQ ID NO: 1237745 - RNA, 19 nt, Homo sapiens
ggaaaucuguuuaguagac

SEQ ID NO: 1237746 - RNA, 19 nt, Homo sapiens
gaaaggaaacaacuaaauc

SEQ ID NO: 1237747 - RNA, 19 nt, Homo sapiens
aaauaggacugaccaagaa

SEQ ID NO: 1237748 - RNA, 19 nt, Homo sapiens
uaaaagagcuguggaauca

SEQ ID NO: 1237749 - RNA, 19 nt, Homo sapiens
ggaaaggaaacaacuaaau

SEQ ID NO: 1237750 - RNA, 19 nt, Homo sapiens
ccugggagauuuccuauau

SEQ ID NO: 1237751 - RNA, 19 nt, Homo sapiens
gucccuacauccuuaaaua

SEQ ID NO: 1237752 - RNA, 19 nt, Homo sapiens
aaggaaaucuguuuaguag

SEQ ID NO: 1237753 - RNA, 19 nt, Homo sapiens
agaaauauaugacccuugu

SEQ ID NO: 1237754 - RNA, 19 nt, Homo sapiens
caagaugaaugaugugaag

SEQ ID NO: 1237755 - RNA, 19 nt, Homo sapiens
ggagauaugaaaugauuga

SEQ ID NO: 1237756 - RNA, 19 nt, Homo sapiens
ggaaagagaaggaaaucug

SEQ ID NO: 1237757 - RNA, 19 nt, Homo sapiens
aaacagaugucaaacuucu

SEQ ID NO: 1237758 - RNA, 19 nt, Homo sapiens
ggagauuuccuauaucaga

SEQ ID NO: 1237759 - RNA, 19 nt, Homo sapiens
gaagccagacugaguuuga

SEQ ID NO: 1237760 - RNA, 19 nt, Homo sapiens
aaagcaagaugaaugaugu

SEQ ID NO: 1237761 - RNA, 19 nt, Homo sapiens
cagaaccuuucauuuauug

SEQ ID NO: 1237762 - RNA, 19 nt, Homo sapiens
agacugaguuugacagaga

SEQ ID NO: 1237763 - RNA, 19 nt, Homo sapiens
cugauaaacuucaaacuca

SEQ ID NO: 1237764 - RNA, 19 nt, Homo sapiens
agugauaggucuucauuug

SEQ ID NO: 1237765 - RNA, 19 nt, Homo sapiens
auaagaagcacuuguguuu

SEQ ID NO: 1237766 - RNA, 19 nt, Homo sapiens
gaaagagaaggaaaucugu

SEQ ID NO: 1237767 - RNA, 19 nt, Homo sapiens
uaaacgaccaugccauaaa

SEQ ID NO: 1237768 - RNA, 19 nt, Homo sapiens
aaacuaaccuuuguaugca

SEQ ID NO: 1237769 - RNA, 19 nt, Homo sapiens
gagcuucacugggcagaug

SEQ ID NO: 1237770 - RNA, 19 nt, Homo sapiens
ucaaacuucuugcaucuca

SEQ ID NO: 1237771 - RNA, 19 nt, Homo sapiens
ucacacagaaccuuucauu

SEQ ID NO: 1237772 - RNA, 19 nt, Homo sapiens
uaacugcaaauacuuggua

SEQ ID NO: 1237773 - RNA, 19 nt, Homo sapiens
uaaacuaaccuuuguaugc

SEQ ID NO: 1237774 - RNA, 19 nt, Homo sapiens
gagguggaaaugauguuua

SEQ ID NO: 1237775 - RNA, 19 nt, Homo sapiens
cagauggguuuguuauugu

SEQ ID NO: 1237776 - RNA, 19 nt, Homo sapiens
cagugagguuucuuacuaa

SEQ ID NO: 1237777 - RNA, 19 nt, Homo sapiens
ccaauucugugaacugucu

SEQ ID NO: 1237778 - RNA, 19 nt, Homo sapiens
gcacuuguguuuggaaagg

SEQ ID NO: 1237779 - RNA, 19 nt, Homo sapiens
gaaaaccgaugccaauucu

SEQ ID NO: 1237780 - RNA, 19 nt, Homo sapiens
gguuuguuauuguguauga

SEQ ID NO: 1237781 - RNA, 19 nt, Homo sapiens
caguggaucuaaaucaaug

SEQ ID NO: 1237782 - RNA, 19 nt, Homo sapiens
caaaagcgcugaucuacag

SEQ ID NO: 1237783 - RNA, 19 nt, Homo sapiens
ucacugggcagauggguuu

SEQ ID NO: 1237784 - RNA, 19 nt, Homo sapiens
gcaaaauucucccucacaa

SEQ ID NO: 1237785 - RNA, 19 nt, Homo sapiens
aagaagcacuuguguuugg

SEQ ID NO: 1237786 - RNA, 19 nt, Homo sapiens
cuucuugcaucucaaauau

SEQ ID NO: 1237787 - RNA, 19 nt, Homo sapiens
gaaaucuguuuaguagaca

SEQ ID NO: 1237788 - RNA, 19 nt, Homo sapiens
caaaucuggucccuacauc

SEQ ID NO: 1237789 - RNA, 19 nt, Homo sapiens
ugggagauuuccuauauca

SEQ ID NO: 1237790 - RNA, 19 nt, Homo sapiens
gagaaggaaaucuguuuag

SEQ ID NO: 1237791 - RNA, 19 nt, Homo sapiens
gagguuggcugggaagaag

SEQ ID NO: 1237792 - RNA, 19 nt, Homo sapiens
gaugaaugaugugaagcuu

SEQ ID NO: 1237793 - RNA, 19 nt, Homo sapiens
gcgcugaucuacagaaucc

SEQ ID NO: 1237794 - RNA, 19 nt, Homo sapiens
ucuggucccuacauccuua

SEQ ID NO: 1237795 - RNA, 19 nt, Homo sapiens
gcaaaucuggucccuacau

SEQ ID NO: 1237796 - RNA, 19 nt, Homo sapiens
aaacgaccaugccauaaaa

SEQ ID NO: 1237797 - RNA, 19 nt, Homo sapiens
agagaaggaaaucuguuua

SEQ ID NO: 1237798 - RNA, 19 nt, Homo sapiens
gaaggaacaggcaaaucug

SEQ ID NO: 1237799 - RNA, 19 nt, Homo sapiens
gggcagauggguuuguuau

SEQ ID NO: 1237800 - RNA, 19 nt, Homo sapiens
gcaagaugaaugaugugaa

SEQ ID NO: 1237801 - RNA, 19 nt, Homo sapiens
ucacucuccuucacacaga

SEQ ID NO: 1237802 - RNA, 19 nt, Homo sapiens
ugaaggaacaggcaaaucu

SEQ ID NO: 1237803 - RNA, 19 nt, Homo sapiens
gauaggucuucauuugcuu

SEQ ID NO: 1237804 - RNA, 19 nt, Homo sapiens
ugucuuggguggugaagga

SEQ ID NO: 1237805 - RNA, 19 nt, Homo sapiens
agaaggaaaucuguuuagu

SEQ ID NO: 1237806 - RNA, 19 nt, Homo sapiens
aagagaaggaaaucuguuu

SEQ ID NO: 1237807 - RNA, 19 nt, Homo sapiens
ggacauccugauaaacuuc

SEQ ID NO: 1237808 - RNA, 19 nt, Homo sapiens
ggagguggaaaugauguuu

SEQ ID NO: 1237809 - RNA, 19 nt, Homo sapiens
ucagugauaggucuucauu

SEQ ID NO: 1237810 - RNA, 19 nt, Homo sapiens
cuacauccuuaaauaacug

SEQ ID NO: 1237811 - RNA, 19 nt, Homo sapiens
gaaaugauugaguaugaac

SEQ ID NO: 1237812 - RNA, 19 nt, Homo sapiens
ggcaacaaacgagaucuuu

SEQ ID NO: 1237813 - RNA, 19 nt, Homo sapiens
ugucaaacuucuugcaucu

SEQ ID NO: 1237814 - RNA, 19 nt, Homo sapiens
cccaguggaucuaaaucaa

SEQ ID NO: 1237815 - RNA, 19 nt, Homo sapiens
aacgagaucuuugucaugu

SEQ ID NO: 1237816 - RNA, 19 nt, Homo sapiens
uaugacccuuguucucaaa

SEQ ID NO: 1237817 - RNA, 19 nt, Homo sapiens
aaaccgaugccaauucugu

SEQ ID NO: 1237818 - RNA, 19 nt, Homo sapiens
uguggaaucagcaguguuu

SEQ ID NO: 1237819 - RNA, 19 nt, Homo sapiens
gagccacaaacuagucauu

SEQ ID NO: 1237820 - RNA, 19 nt, Homo sapiens
aauacuugguagugucuuu

SEQ ID NO: 1237821 - RNA, 19 nt, Homo sapiens
uauaugacccuuguucuca

SEQ ID NO: 1237822 - RNA, 19 nt, Homo sapiens
aaauauaugacccuuguuc

SEQ ID NO: 1237823 - RNA, 19 nt, Homo sapiens
ucuuggagauaugaaauga

SEQ ID NO: 1237824 - RNA, 19 nt, Homo sapiens
aaacuucuugcaucucaaa

SEQ ID NO: 1237825 - RNA, 19 nt, Homo sapiens
guuguacccugcucacucu

SEQ ID NO: 1237826 - RNA, 19 nt, Homo sapiens
ugauaggucuucauuugcu

SEQ ID NO: 1237827 - RNA, 19 nt, Homo sapiens
uaagaagcacuuguguuug

SEQ ID NO: 1237828 - RNA, 19 nt, Homo sapiens
uauaagaagcacuuguguu

SEQ ID NO: 1237829 - RNA, 19 nt, Homo sapiens
auuaaacgaccaugccaua

SEQ ID NO: 1237830 - RNA, 19 nt, Homo sapiens
ucagaauuaucaaggacau

SEQ ID NO: 1237831 - RNA, 19 nt, Homo sapiens
aaacgagaucuuugucaug

SEQ ID NO: 1237832 - RNA, 19 nt, Homo sapiens
ugugaagcuugcugucuug

SEQ ID NO: 1237833 - RNA, 19 nt, Homo sapiens
gaaauauaugacccuuguu

SEQ ID NO: 1237834 - RNA, 19 nt, Homo sapiens
gaagcacuuguguuuggaa

SEQ ID NO: 1237835 - RNA, 19 nt, Homo sapiens
acagaugucaaacuucuug

SEQ ID NO: 1237836 - RNA, 19 nt, Homo sapiens
uuacacauaguaccuugaa

SEQ ID NO: 1237837 - RNA, 19 nt, Homo sapiens
gcugaaaucucuuuaauga

SEQ ID NO: 1237838 - RNA, 19 nt, Homo sapiens
gcaagaaccugcuaugcua

SEQ ID NO: 1237839 - RNA, 19 nt, Homo sapiens
gaacggagcgcucucuuca

SEQ ID NO: 1237840 - RNA, 19 nt, Homo sapiens
ccaaucuucuuuauaggua

SEQ ID NO: 1237841 - RNA, 19 nt, Homo sapiens
gggcugaaaucucuuuaau

SEQ ID NO: 1237842 - RNA, 19 nt, Homo sapiens
gcagcaacuucuuaguauu

SEQ ID NO: 1237843 - RNA, 19 nt, Homo sapiens
ccuccaaucuucuuuauag

SEQ ID NO: 1237844 - RNA, 19 nt, Homo sapiens
cagcagcaacuucuuagua

SEQ ID NO: 1237845 - RNA, 19 nt, Homo sapiens
ggagcgcucucuucaguag

SEQ ID NO: 1237846 - RNA, 19 nt, Homo sapiens
gaccagcagcaacuucuua

SEQ ID NO: 1237847 - RNA, 19 nt, Homo sapiens
ccaagaccgugcaggugua

SEQ ID NO: 1237848 - RNA, 19 nt, Homo sapiens
cagcgaaucaucaaaggua

SEQ ID NO: 1237849 - RNA, 19 nt, Homo sapiens
ggccacgacuaccaaauug

SEQ ID NO: 1237850 - RNA, 19 nt, Homo sapiens
gagcuggccuccaucuaca

SEQ ID NO: 1237851 - RNA, 19 nt, Homo sapiens
gauaucacaguaaccaauu

SEQ ID NO: 1237852 - RNA, 19 nt, Homo sapiens
gaugcggccuccaaucuuc

SEQ ID NO: 1237853 - RNA, 19 nt, Homo sapiens
acaaagacuucguguacau

SEQ ID NO: 1237854 - RNA, 19 nt, Homo sapiens
caagaucagcgaaucauca

SEQ ID NO: 1237855 - RNA, 19 nt, Homo sapiens
ggccagaggacaagaagaa

SEQ ID NO: 1237856 - RNA, 19 nt, Homo sapiens
gaucagcgaaucaucaaag

SEQ ID NO: 1237857 - RNA, 19 nt, Homo sapiens
gggccacgacuaccaaauu

SEQ ID NO: 1237858 - RNA, 19 nt, Homo sapiens
agaaggagguggagcugau

SEQ ID NO: 1237859 - RNA, 19 nt, Homo sapiens
ggaucaagguggccuccau

SEQ ID NO: 1237860 - RNA, 19 nt, Homo sapiens
guagacuucugcugugagu

SEQ ID NO: 1237861 - RNA, 19 nt, Homo sapiens
gcgaaucaucaaagguaua

SEQ ID NO: 1237862 - RNA, 19 nt, Homo sapiens
cagcaacuucuuaguauuc

SEQ ID NO: 1237863 - RNA, 19 nt, Homo sapiens
cagaggacaagaagaagaa

SEQ ID NO: 1237864 - RNA, 19 nt, Homo sapiens
ggccuccaaucuucuuuau

SEQ ID NO: 1237865 - RNA, 19 nt, Homo sapiens
ggacggugguagacuucug

SEQ ID NO: 1237866 - RNA, 19 nt, Homo sapiens
cauacaagaucagcgaauc

SEQ ID NO: 1237867 - RNA, 19 nt, Homo sapiens
gagcagugggucaaagaga

SEQ ID NO: 1237868 - RNA, 19 nt, Homo sapiens
gcgaggacaacuaccugua

SEQ ID NO: 1237869 - RNA, 19 nt, Homo sapiens
ucaaggccgugguggacuu

SEQ ID NO: 1237870 - RNA, 19 nt, Homo sapiens
agcagcaacuucuuaguau

SEQ ID NO: 1237871 - RNA, 19 nt, Homo sapiens
uaguauuccggaaacauua

SEQ ID NO: 1237872 - RNA, 19 nt, Homo sapiens
gacccuagcugcgccucuu

SEQ ID NO: 1237873 - RNA, 19 nt, Homo sapiens
caagaagaagaaaggcaaa

SEQ ID NO: 1237874 - RNA, 19 nt, Homo sapiens
ugccagggcugaaaucucu

SEQ ID NO: 1237875 - RNA, 19 nt, Homo sapiens
caagguggccuccaugaac

SEQ ID NO: 1237876 - RNA, 19 nt, Homo sapiens
guaaacaguggaucaaggu

SEQ ID NO: 1237877 - RNA, 19 nt, Homo sapiens
ugcagaagcugugugucua

SEQ ID NO: 1237878 - RNA, 19 nt, Homo sapiens
gaacgucuccaugcagaag

SEQ ID NO: 1237879 - RNA, 19 nt, Homo sapiens
caacugcgagggcuucauc

SEQ ID NO: 1237880 - RNA, 19 nt, Homo sapiens
gaaccagcgccguguggau

SEQ ID NO: 1237881 - RNA, 19 nt, Homo sapiens
ccagaggacaagaagaaga

SEQ ID NO: 1237882 - RNA, 19 nt, Homo sapiens
ggaugcggccuccaaucuu

SEQ ID NO: 1237883 - RNA, 19 nt, Homo sapiens
acggagcgcucucuucagu

SEQ ID NO: 1237884 - RNA, 19 nt, Homo sapiens
cuacuucaacuccauguuc

SEQ ID NO: 1237885 - RNA, 19 nt, Homo sapiens
gggaugcggccuccaaucu

SEQ ID NO: 1237886 - RNA, 19 nt, Homo sapiens
gccgugcgcuaccacaaca

SEQ ID NO: 1237887 - RNA, 19 nt, Homo sapiens
gcgacuacuucaacuccau

SEQ ID NO: 1237888 - RNA, 19 nt, Homo sapiens
gcgagcagugggucaaaga

SEQ ID NO: 1237889 - RNA, 19 nt, Homo sapiens
ucuaugauaucacaguaac

SEQ ID NO: 1237890 - RNA, 19 nt, Homo sapiens
ucaacuccauguucaccau

SEQ ID NO: 1237891 - RNA, 19 nt, Homo sapiens
uguacaacuuagcagcuuu

SEQ ID NO: 1237892 - RNA, 19 nt, Homo sapiens
uuaguauuccggaaacauu

SEQ ID NO: 1237893 - RNA, 19 nt, Homo sapiens
aacacugccuucuccaaga

SEQ ID NO: 1237894 - RNA, 19 nt, Homo sapiens
ggcuacagcugggagaaca

SEQ ID NO: 1237895 - RNA, 19 nt, Homo sapiens
gcagaucuggacgguggua

SEQ ID NO: 1237896 - RNA, 19 nt, Homo sapiens
gcggcaacauugacuacgu

SEQ ID NO: 1237897 - RNA, 19 nt, Homo sapiens
gagugucucggccauacaa

SEQ ID NO: 1237898 - RNA, 19 nt, Homo sapiens
cgggcaccaucuacaaaga

SEQ ID NO: 1237899 - RNA, 19 nt, Homo sapiens
ucaagguggccuccaugaa

SEQ ID NO: 1237900 - RNA, 19 nt, Homo sapiens
ucagugacgacaccugcua

SEQ ID NO: 1237901 - RNA, 19 nt, Homo sapiens
ccagggcugaaaucucuuu

SEQ ID NO: 1237902 - RNA, 19 nt, Homo sapiens
gcuggauggcggcaacauu

SEQ ID NO: 1237903 - RNA, 19 nt, Homo sapiens
gauucuugguauuucuaug

SEQ ID NO: 1237904 - RNA, 19 nt, Homo sapiens
cuaccuugccuccaucgaa

SEQ ID NO: 1237905 - RNA, 19 nt, Homo sapiens
ccguguggauuucuaccuu

SEQ ID NO: 1237906 - RNA, 19 nt, Homo sapiens
gcagaagcugugugucuac

SEQ ID NO: 1237907 - RNA, 19 nt, Homo sapiens
ucuggacggugguagacuu

SEQ ID NO: 1237908 - RNA, 19 nt, Homo sapiens
ugauaucacaguaaccaau

SEQ ID NO: 1237909 - RNA, 19 nt, Homo sapiens
gagcgagcagugggucaaa

SEQ ID NO: 1237910 - RNA, 19 nt, Homo sapiens
cuggauggcggcaacauug

SEQ ID NO: 1237911 - RNA, 19 nt, Homo sapiens
ucucggccauacaagauca

SEQ ID NO: 1237912 - RNA, 19 nt, Homo sapiens
gagacguacagucccaaga

SEQ ID NO: 1237913 - RNA, 19 nt, Homo sapiens
uacuucaacuccauguuca

SEQ ID NO: 1237914 - RNA, 19 nt, Homo sapiens
gugcagcgacuacuucaac

SEQ ID NO: 1237915 - RNA, 19 nt, Homo sapiens
uaaagggacuugcaaauuu

SEQ ID NO: 1237916 - RNA, 19 nt, Homo sapiens
gcgcagaccuguggaauaa

SEQ ID NO: 1237917 - RNA, 19 nt, Homo sapiens
gcgaugcgcuuuagagaaa

SEQ ID NO: 1237918 - RNA, 19 nt, Homo sapiens
gcuaggaguuugugaaaug

SEQ ID NO: 1237919 - RNA, 19 nt, Homo sapiens
gaaaccaggucucacuaug

SEQ ID NO: 1237920 - RNA, 19 nt, Homo sapiens
ggacauaggacucuuuaau

SEQ ID NO: 1237921 - RNA, 19 nt, Homo sapiens
uagaggugcugcuguauuu

SEQ ID NO: 1237922 - RNA, 19 nt, Homo sapiens
gcuuagaggugcugcugua

SEQ ID NO: 1237923 - RNA, 19 nt, Homo sapiens
caaaugacaucacauacag

SEQ ID NO: 1237924 - RNA, 19 nt, Homo sapiens
gacauaggacucuuuaauu

SEQ ID NO: 1237925 - RNA, 19 nt, Homo sapiens
acauaggacucuuuaauuc

SEQ ID NO: 1237926 - RNA, 19 nt, Homo sapiens
caccauacccagcuaauuu

SEQ ID NO: 1237927 - RNA, 19 nt, Homo sapiens
uaaacgugaucaucucuug

SEQ ID NO: 1237928 - RNA, 19 nt, Homo sapiens
ggucagugcucagcuauca

SEQ ID NO: 1237929 - RNA, 19 nt, Homo sapiens
uaacagcucucuucuucca

SEQ ID NO: 1237930 - RNA, 19 nt, Homo sapiens
aaagggacuugcaaauuug

SEQ ID NO: 1237931 - RNA, 19 nt, Homo sapiens
ucccagagcuugagacaug

SEQ ID NO: 1237932 - RNA, 19 nt, Homo sapiens
gaggacauaggacucuuua

SEQ ID NO: 1237933 - RNA, 19 nt, Homo sapiens
acaaauguguggucucuuc

SEQ ID NO: 1237934 - RNA, 19 nt, Homo sapiens
uuuaacagcucucuucuuc

SEQ ID NO: 1237935 - RNA, 19 nt, Homo sapiens
guauuuaccugagagcuau

SEQ ID NO: 1237936 - RNA, 19 nt, Homo sapiens
ccagacuucuagcaacuuu

SEQ ID NO: 1237937 - RNA, 19 nt, Homo sapiens
gcagaccuguggaauaaac

SEQ ID NO: 1237938 - RNA, 19 nt, Homo sapiens
caccaaaugacaucacaua

SEQ ID NO: 1237939 - RNA, 19 nt, Homo sapiens
gcacaucaggagcauaaau

SEQ ID NO: 1237940 - RNA, 19 nt, Homo sapiens
cacaucaggagcauaaaua

SEQ ID NO: 1237941 - RNA, 19 nt, Homo sapiens
gaaaggaggcugugaaaag

SEQ ID NO: 1237942 - RNA, 19 nt, Homo sapiens
aaccaggucucacuauguu

SEQ ID NO: 1237943 - RNA, 19 nt, Homo sapiens
ccaaaugacaucacauaca

SEQ ID NO: 1237944 - RNA, 19 nt, Homo sapiens
ugacaaauguguggucucu

SEQ ID NO: 1237945 - RNA, 19 nt, Homo sapiens
uuaaagggacuugcaaauu

SEQ ID NO: 1237946 - RNA, 19 nt, Homo sapiens
ccaggccggucuuaaacuu

SEQ ID NO: 1237947 - RNA, 19 nt, Homo sapiens
gggccuaucugccauugca

SEQ ID NO: 1237948 - RNA, 19 nt, Homo sapiens
ccaaagugcuaggauuaca

SEQ ID NO: 1237949 - RNA, 19 nt, Homo sapiens
gaugcgcuuuagagaaauu

SEQ ID NO: 1237950 - RNA, 19 nt, Homo sapiens
ccacagcccaggaugcauu

SEQ ID NO: 1237951 - RNA, 19 nt, Homo sapiens
uagggucucugcugaggaa

SEQ ID NO: 1237952 - RNA, 19 nt, Homo sapiens
gccauuuggugcagaacaa

SEQ ID NO: 1237953 - RNA, 19 nt, Homo sapiens
ucccaaagugcuaggauua

SEQ ID NO: 1237954 - RNA, 19 nt, Homo sapiens
cuccugagcucaagcaauc

SEQ ID NO: 1237955 - RNA, 19 nt, Homo sapiens
caacaaguagccacugaca

SEQ ID NO: 1237956 - RNA, 19 nt, Homo sapiens
gcucagcuaucaaggucau

SEQ ID NO: 1237957 - RNA, 19 nt, Homo sapiens
auacaaacacccaugauca

SEQ ID NO: 1237958 - RNA, 19 nt, Homo sapiens
cauacauggucuugcuuug

SEQ ID NO: 1237959 - RNA, 19 nt, Homo sapiens
gaauacaaacacccaugau

SEQ ID NO: 1237960 - RNA, 19 nt, Homo sapiens
cagcucucuucuuccaaua

SEQ ID NO: 1237961 - RNA, 19 nt, Homo sapiens
ccacuggcugcaacaagua

SEQ ID NO: 1237962 - RNA, 19 nt, Homo sapiens
cuaggaguuugugaaauga

SEQ ID NO: 1237963 - RNA, 19 nt, Homo sapiens
gugcuaggaguuugugaaa

SEQ ID NO: 1237964 - RNA, 19 nt, Homo sapiens
caaacacccaugaucaauc

SEQ ID NO: 1237965 - RNA, 19 nt, Homo sapiens
gaaagggaggaggucguaa

SEQ ID NO: 1237966 - RNA, 19 nt, Homo sapiens
auacagaaggccucagaaa

SEQ ID NO: 1237967 - RNA, 19 nt, Homo sapiens
gcacagcaggccugaggau

SEQ ID NO: 1237968 - RNA, 19 nt, Homo sapiens
uucggaaacugacaaaugu

SEQ ID NO: 1237969 - RNA, 19 nt, Homo sapiens
cugcacaucaggagcauaa

SEQ ID NO: 1237970 - RNA, 19 nt, Homo sapiens
ggucucugcugaggaagug

SEQ ID NO: 1237971 - RNA, 19 nt, Homo sapiens
uaccugagagcuaugcuuu

SEQ ID NO: 1237972 - RNA, 19 nt, Homo sapiens
acagaaggccucagaaagg

SEQ ID NO: 1237973 - RNA, 19 nt, Homo sapiens
gcagcaaagcacaaagugu

SEQ ID NO: 1237974 - RNA, 19 nt, Homo sapiens
uugugugccuuccucauaa

SEQ ID NO: 1237975 - RNA, 19 nt, Homo sapiens
gaacuccugagcucaagca

SEQ ID NO: 1237976 - RNA, 19 nt, Homo sapiens
ugauuuaacagcucucuuc

SEQ ID NO: 1237977 - RNA, 19 nt, Homo sapiens
ggccagacuucuagcaacu

SEQ ID NO: 1237978 - RNA, 19 nt, Homo sapiens
agaauacaaacacccauga

SEQ ID NO: 1237979 - RNA, 19 nt, Homo sapiens
gagcuaugcuuuucaucga

SEQ ID NO: 1237980 - RNA, 19 nt, Homo sapiens
uacauggucuugcuuuguc

SEQ ID NO: 1237981 - RNA, 19 nt, Homo sapiens
gggcgaugcgcuuuagaga

SEQ ID NO: 1237982 - RNA, 19 nt, Homo sapiens
acagcucucuucuuccaau

SEQ ID NO: 1237983 - RNA, 19 nt, Homo sapiens
uacaaacacccaugaucaa

SEQ ID NO: 1237984 - RNA, 19 nt, Homo sapiens
aaaccaggucucacuaugu

SEQ ID NO: 1237985 - RNA, 19 nt, Homo sapiens
caggaaaggaggcugugaa

SEQ ID NO: 1237986 - RNA, 19 nt, Homo sapiens
caggugagcgugcaaaguc

SEQ ID NO: 1237987 - RNA, 19 nt, Homo sapiens
ugaaaagucuugagcaaac

SEQ ID NO: 1237988 - RNA, 19 nt, Homo sapiens
ccagguuccuuuccuuacu

SEQ ID NO: 1237989 - RNA, 19 nt, Homo sapiens
cggccucugccucuuguua

SEQ ID NO: 1237990 - RNA, 19 nt, Homo sapiens
uagaaaccaggucucacua

SEQ ID NO: 1237991 - RNA, 19 nt, Homo sapiens
ugcaacaaguagccacuga

SEQ ID NO: 1237992 - RNA, 19 nt, Homo sapiens
agaaagggaggaggucgua

SEQ ID NO: 1237993 - RNA, 19 nt, Homo sapiens
gcaggccugaggaucauga

SEQ ID NO: 1237994 - RNA, 19 nt, Homo sapiens
cagcaggccugaggaucau

SEQ ID NO: 1237995 - RNA, 19 nt, Homo sapiens
gaaaagucuugagcaaaca

SEQ ID NO: 1237996 - RNA, 19 nt, Homo sapiens
acccacuccucccagaaua

SEQ ID NO: 1237997 - RNA, 19 nt, Homo sapiens
ggccucugccucuuguuaa

SEQ ID NO: 1237998 - RNA, 19 nt, Homo sapiens
aggccggucuuaaacuuug

SEQ ID NO: 1237999 - RNA, 19 nt, Homo sapiens
acaucaggagcauaaauaa

SEQ ID NO: 1238000 - RNA, 19 nt, Homo sapiens
aagggucagugcucagcua

SEQ ID NO: 1238001 - RNA, 19 nt, Homo sapiens
aaugacaucacauacagaa

SEQ ID NO: 1238002 - RNA, 19 nt, Homo sapiens
cuugugugccuuccucaua

SEQ ID NO: 1238003 - RNA, 19 nt, Homo sapiens
uuaauuugaccacaucaug

SEQ ID NO: 1238004 - RNA, 19 nt, Homo sapiens
cucugccucuuguuaauuu

SEQ ID NO: 1238005 - RNA, 19 nt, Homo sapiens
ccaagucgaccuggcauca

SEQ ID NO: 1238006 - RNA, 19 nt, Homo sapiens
guggccaucuucacaacug

SEQ ID NO: 1238007 - RNA, 19 nt, Homo sapiens
gcucucuucuuccaauacu

SEQ ID NO: 1238008 - RNA, 19 nt, Homo sapiens
cuaucaaggucaucuucug

SEQ ID NO: 1238009 - RNA, 19 nt, Homo sapiens
ggacacacagcugaugaag

SEQ ID NO: 1238010 - RNA, 19 nt, Homo sapiens
ucucuucagugcccagugu

SEQ ID NO: 1238011 - RNA, 19 nt, Homo sapiens
ccaccauacccagcuaauu

SEQ ID NO: 1238012 - RNA, 19 nt, Homo sapiens
guaaggacacacagcugau

SEQ ID NO: 1238013 - RNA, 19 nt, Homo sapiens
gaggugcugcuguauuuac

SEQ ID NO: 1238014 - RNA, 19 nt, Homo sapiens
ugugugccuuccucauaaa

SEQ ID NO: 1238015 - RNA, 19 nt, Homo sapiens
gaaacgcugucucuacuaa

SEQ ID NO: 1238016 - RNA, 19 nt, Homo sapiens
agacaaaccuuacaaaugu

SEQ ID NO: 1238017 - RNA, 19 nt, Homo sapiens
gguaaagccuucagucaaa

SEQ ID NO: 1238018 - RNA, 19 nt, Homo sapiens
gguaaggucuucacacaaa

SEQ ID NO: 1238019 - RNA, 19 nt, Homo sapiens
gaaagaugaugaaggaaau

SEQ ID NO: 1238020 - RNA, 19 nt, Homo sapiens
ggagaagccuuacaagugu

SEQ ID NO: 1238021 - RNA, 19 nt, Homo sapiens
ugagaaaccuuauaagugu

SEQ ID NO: 1238022 - RNA, 19 nt, Homo sapiens
ccucagauaucucuuguaa

SEQ ID NO: 1238023 - RNA, 19 nt, Homo sapiens
ugagaaaccuuacaagugu

SEQ ID NO: 1238024 - RNA, 19 nt, Homo sapiens
ggaaaggucuucagucaac

SEQ ID NO: 1238025 - RNA, 19 nt, Homo sapiens
ggcaaggucuuuacucaaa

SEQ ID NO: 1238026 - RNA, 19 nt, Homo sapiens
ggaaacaggcauauugaaa

SEQ ID NO: 1238027 - RNA, 19 nt, Homo sapiens
gggaaagccuucaguguuc

SEQ ID NO: 1238028 - RNA, 19 nt, Homo sapiens
ggcaaggucuucacucaaa

SEQ ID NO: 1238029 - RNA, 19 nt, Homo sapiens
caguaugcauucaaacuua

SEQ ID NO: 1238030 - RNA, 19 nt, Homo sapiens
ggcaaggucuucagucaaa

SEQ ID NO: 1238031 - RNA, 19 nt, Homo sapiens
gcaggaaacaggcauauug

SEQ ID NO: 1238032 - RNA, 19 nt, Homo sapiens
gcuaacaagucauaagaga

SEQ ID NO: 1238033 - RNA, 19 nt, Homo sapiens
ggaaagaugaugaaggaaa

SEQ ID NO: 1238034 - RNA, 19 nt, Homo sapiens
agagaaaccuuacaagugu

SEQ ID NO: 1238035 - RNA, 19 nt, Homo sapiens
agagaaaccuuacaagugu

SEQ ID NO: 1238036 - RNA, 19 nt, Homo sapiens
gagagaaaccuuacaagug

SEQ ID NO: 1238037 - RNA, 19 nt, Homo sapiens
gagagaaaccuuacaagug

SEQ ID NO: 1238038 - RNA, 19 nt, Homo sapiens
gagacaaaccuuacaaaug

SEQ ID NO: 1238039 - RNA, 19 nt, Homo sapiens
guggaaagaugaugaagga

SEQ ID NO: 1238040 - RNA, 19 nt, Homo sapiens
gagaaaccuuauaagugua

SEQ ID NO: 1238041 - RNA, 19 nt, Homo sapiens
gcaaaucaucgaagaauuc

SEQ ID NO: 1238042 - RNA, 19 nt, Homo sapiens
uagaagagcucaacgugau

SEQ ID NO: 1238043 - RNA, 19 nt, Homo sapiens
gagaaaagccuuacaaaug

SEQ ID NO: 1238044 - RNA, 19 nt, Homo sapiens
gaagaacaauaugggagaa

SEQ ID NO: 1238045 - RNA, 19 nt, Homo sapiens
gggagaagccuuacaagug

SEQ ID NO: 1238046 - RNA, 19 nt, Homo sapiens
gaucauccauaccggagaa

SEQ ID NO: 1238047 - RNA, 19 nt, Homo sapiens
guggaaaggucuucaguca

SEQ ID NO: 1238048 - RNA, 19 nt, Homo sapiens
gacaauacauacuggacaa

SEQ ID NO: 1238049 - RNA, 19 nt, Homo sapiens
gcaaggcauuggagaguuc

SEQ ID NO: 1238050 - RNA, 19 nt, Homo sapiens
gggaaagccuucaguaugc

SEQ ID NO: 1238051 - RNA, 19 nt, Homo sapiens
uuacaagugugaugaaugu

SEQ ID NO: 1238052 - RNA, 19 nt, Homo sapiens
gcaaaucauagaagaauuc

SEQ ID NO: 1238053 - RNA, 19 nt, Homo sapiens
gaagaauucauaguggaua

SEQ ID NO: 1238054 - RNA, 19 nt, Homo sapiens
aaacucacaucuugcaaau

SEQ ID NO: 1238055 - RNA, 19 nt, Homo sapiens
agucaaacaucacaacuug

SEQ ID NO: 1238056 - RNA, 19 nt, Homo sapiens
ggucaucagagaauucaua

SEQ ID NO: 1238057 - RNA, 19 nt, Homo sapiens
acucacaucuugcaaauca

SEQ ID NO: 1238058 - RNA, 19 nt, Homo sapiens
cggcaaagcauuuagugua

SEQ ID NO: 1238059 - RNA, 19 nt, Homo sapiens
ggagagaaaccuuacaagu

SEQ ID NO: 1238060 - RNA, 19 nt, Homo sapiens
ggagagaaaccuuacaagu

SEQ ID NO: 1238061 - RNA, 19 nt, Homo sapiens
ggagacaaaccuuacaaau

SEQ ID NO: 1238062 - RNA, 19 nt, Homo sapiens
gcaaagcaucggcgaauuc

SEQ ID NO: 1238063 - RNA, 19 nt, Homo sapiens
gagaagccuuaccagugua

SEQ ID NO: 1238064 - RNA, 19 nt, Homo sapiens
gcgguaaggucuucacaca

SEQ ID NO: 1238065 - RNA, 19 nt, Homo sapiens
gcaagucaucgaagaauuc

SEQ ID NO: 1238066 - RNA, 19 nt, Homo sapiens
aagcaucggcgaauucaua

SEQ ID NO: 1238067 - RNA, 19 nt, Homo sapiens
agagaagccuuaccagugu

SEQ ID NO: 1238068 - RNA, 19 nt, Homo sapiens
ugagcgagaucaugccauu

SEQ ID NO: 1238069 - RNA, 19 nt, Homo sapiens
gugagaaaccuuauaagug

SEQ ID NO: 1238070 - RNA, 19 nt, Homo sapiens
uaacuaagcaucagaucau

SEQ ID NO: 1238071 - RNA, 19 nt, Homo sapiens
ggauagaaaccuuacaaag

SEQ ID NO: 1238072 - RNA, 19 nt, Homo sapiens
ucccugaacugcagcaauu

SEQ ID NO: 1238073 - RNA, 19 nt, Homo sapiens
ucacaucuugcaaaucaua

SEQ ID NO: 1238074 - RNA, 19 nt, Homo sapiens
gcaaagcauuuaguguaca

SEQ ID NO: 1238075 - RNA, 19 nt, Homo sapiens
gugagaaaccuuacaagug

SEQ ID NO: 1238076 - RNA, 19 nt, Homo sapiens
cauaagagaauucauacug

SEQ ID NO: 1238077 - RNA, 19 nt, Homo sapiens
gaaacaggcauauugaaaa

SEQ ID NO: 1238078 - RNA, 19 nt, Homo sapiens
uagaagggcugcaggaaac

SEQ ID NO: 1238079 - RNA, 19 nt, Homo sapiens
gcaggagaaucacuugaac

SEQ ID NO: 1238080 - RNA, 19 nt, Homo sapiens
ggugagaaaccuuauaagu

SEQ ID NO: 1238081 - RNA, 19 nt, Homo sapiens
uuacaggugugaugagugu

SEQ ID NO: 1238082 - RNA, 19 nt, Homo sapiens
ggucuucagucaaccuuca

SEQ ID NO: 1238083 - RNA, 19 nt, Homo sapiens
guucaaaccuaacaaucca

SEQ ID NO: 1238084 - RNA, 19 nt, Homo sapiens
gaaaaucucccugguagaa

SEQ ID NO: 1238085 - RNA, 19 nt, Homo sapiens
gugaaacgcugucucuacu

SEQ ID NO: 1238086 - RNA, 19 nt, Homo sapiens
cauaguggauagaaaccuu

SEQ ID NO: 1238087 - RNA, 19 nt, Homo sapiens
uaguguacauucaaaccua

SEQ ID NO: 1238088 - RNA, 19 nt, Homo sapiens
ggcaaagcauuuaguguac

SEQ ID NO: 1238089 - RNA, 19 nt, Homo sapiens
agaaaagccuuacaaaugu

SEQ ID NO: 1238090 - RNA, 19 nt, Homo sapiens
caucagagaauucauacug

SEQ ID NO: 1238091 - RNA, 19 nt, Homo sapiens
gaaaaucagcuuggaguaa

SEQ ID NO: 1238092 - RNA, 19 nt, Homo sapiens
caucgaagaauucauagug

SEQ ID NO: 1238093 - RNA, 19 nt, Homo sapiens
ccuuauagguguaaugagu

SEQ ID NO: 1238094 - RNA, 19 nt, Homo sapiens
caaagcauuuaguguacau

SEQ ID NO: 1238095 - RNA, 19 nt, Homo sapiens
gagaguucauacuggagaa

SEQ ID NO: 1238096 - RNA, 19 nt, Homo sapiens
gaagucuccuaauaaucga

SEQ ID NO: 1238097 - RNA, 19 nt, Homo sapiens
gagugucaguggaaagaug

SEQ ID NO: 1238098 - RNA, 19 nt, Homo sapiens
guggcaaggucuuuacuca

SEQ ID NO: 1238099 - RNA, 19 nt, Homo sapiens
ggaaagccuucaguaugca

SEQ ID NO: 1238100 - RNA, 19 nt, Homo sapiens
auucauaccuugcaaagca

SEQ ID NO: 1238101 - RNA, 19 nt, Homo sapiens
ucacggcuaacaagucaua

SEQ ID NO: 1238102 - RNA, 19 nt, Homo sapiens
agucaucgaagaauucaua

SEQ ID NO: 1238103 - RNA, 19 nt, Homo sapiens
cauacgacuuugaguguca

SEQ ID NO: 1238104 - RNA, 19 nt, Homo sapiens
guggcaaggucuucacuca

SEQ ID NO: 1238105 - RNA, 19 nt, Homo sapiens
auucguaccuugcaauuca

SEQ ID NO: 1238106 - RNA, 19 nt, Homo sapiens
guggcaaggucuucaguca

SEQ ID NO: 1238107 - RNA, 19 nt, Homo sapiens
caggaaacaggcauauuga

SEQ ID NO: 1238108 - RNA, 19 nt, Homo sapiens
gcauuuaguguacauucaa

SEQ ID NO: 1238109 - RNA, 19 nt, Homo sapiens
cacucaguauucacacuua

SEQ ID NO: 1238110 - RNA, 19 nt, Homo sapiens
gcacaauucauaccuugca

SEQ ID NO: 1238111 - RNA, 19 nt, Homo sapiens
acacaucaggucauccaua

SEQ ID NO: 1238112 - RNA, 19 nt, Homo sapiens
aaaucucccugguagaaga

SEQ ID NO: 1238113 - RNA, 19 nt, Homo sapiens
acucaaaacucacaucuug

SEQ ID NO: 1238114 - RNA, 19 nt, Homo sapiens
aaaccuagcuacccaucag

SEQ ID NO: 1238115 - RNA, 19 nt, Homo sapiens
gagcguaccuacacuguua

SEQ ID NO: 1238116 - RNA, 19 nt, Homo sapiens
ggaaucugcugcacgaaua

SEQ ID NO: 1238117 - RNA, 19 nt, Homo sapiens
guagaaaguucacuauuug

SEQ ID NO: 1238118 - RNA, 19 nt, Homo sapiens
cagaagaaaccgaauauua

SEQ ID NO: 1238119 - RNA, 19 nt, Homo sapiens
guaagaaccugucccuuug

SEQ ID NO: 1238120 - RNA, 19 nt, Homo sapiens
ggacaugucuuggcaguug

SEQ ID NO: 1238121 - RNA, 19 nt, Homo sapiens
caaggucgcuggugacauu

SEQ ID NO: 1238122 - RNA, 19 nt, Homo sapiens
uaaagaaguuccuaucgaa

SEQ ID NO: 1238123 - RNA, 19 nt, Homo sapiens
cguagaaaguucacuauuu

SEQ ID NO: 1238124 - RNA, 19 nt, Homo sapiens
gaacauaauccucuucuuc

SEQ ID NO: 1238125 - RNA, 19 nt, Homo sapiens
caacccaccucuagaaguu

SEQ ID NO: 1238126 - RNA, 19 nt, Homo sapiens
gcacaaacaauaauucuca

SEQ ID NO: 1238127 - RNA, 19 nt, Homo sapiens
gaaccugucccuuugcuuu

SEQ ID NO: 1238128 - RNA, 19 nt, Homo sapiens
cagaagacaucaugguuga

SEQ ID NO: 1238129 - RNA, 19 nt, Homo sapiens
gaagagacaccaguggaua

SEQ ID NO: 1238130 - RNA, 19 nt, Homo sapiens
gagcucaucgggcagauua

SEQ ID NO: 1238131 - RNA, 19 nt, Homo sapiens
gaagaaggccuggauuuca

SEQ ID NO: 1238132 - RNA, 19 nt, Homo sapiens
cagaugaccuagaagaaga

SEQ ID NO: 1238133 - RNA, 19 nt, Homo sapiens
caacauagcgaaagcacuu

SEQ ID NO: 1238134 - RNA, 19 nt, Homo sapiens
cacagugacuccagcauuu

SEQ ID NO: 1238135 - RNA, 19 nt, Homo sapiens
gauccuuucugcaguaaga

SEQ ID NO: 1238136 - RNA, 19 nt, Homo sapiens
ugacuuacguggcacaguu

SEQ ID NO: 1238137 - RNA, 19 nt, Homo sapiens
gacgagcagucuaucauga

SEQ ID NO: 1238138 - RNA, 19 nt, Homo sapiens
gaacgcagcagaucuggau

SEQ ID NO: 1238139 - RNA, 19 nt, Homo sapiens
cccacgaccucuucuauuu

SEQ ID NO: 1238140 - RNA, 19 nt, Homo sapiens
uaacagcgaccuaauagau

SEQ ID NO: 1238141 - RNA, 19 nt, Homo sapiens
gagaggagcguggcaauau

SEQ ID NO: 1238142 - RNA, 19 nt, Homo sapiens
acagcgaccuaauagauuu

SEQ ID NO: 1238143 - RNA, 19 nt, Homo sapiens
gaagaaaccgaauauuaac

SEQ ID NO: 1238144 - RNA, 19 nt, Homo sapiens
gaaaguucacuauuuguag

SEQ ID NO: 1238145 - RNA, 19 nt, Homo sapiens
gaaagaaucaaucaguagu

SEQ ID NO: 1238146 - RNA, 19 nt, Homo sapiens
gcgaagaaggccuggauuu

SEQ ID NO: 1238147 - RNA, 19 nt, Homo sapiens
acgaaagaaucaaucagua

SEQ ID NO: 1238148 - RNA, 19 nt, Homo sapiens
agaaauggaucucgaagag

SEQ ID NO: 1238149 - RNA, 19 nt, Homo sapiens
guuggaagccgaagauauu

SEQ ID NO: 1238150 - RNA, 19 nt, Homo sapiens
gcagaaacucuccaucuuc

SEQ ID NO: 1238151 - RNA, 19 nt, Homo sapiens
ugacagaagaaaccgaaua

SEQ ID NO: 1238152 - RNA, 19 nt, Homo sapiens
cgauucagauaaagaaguu

SEQ ID NO: 1238153 - RNA, 19 nt, Homo sapiens
cgccagagccucaaguuaa

SEQ ID NO: 1238154 - RNA, 19 nt, Homo sapiens
guggagggcacaaacaaua

SEQ ID NO: 1238155 - RNA, 19 nt, Homo sapiens
gcaaaauccuaauggcuuu

SEQ ID NO: 1238156 - RNA, 19 nt, Homo sapiens
agccggauaugauguauuu

SEQ ID NO: 1238157 - RNA, 19 nt, Homo sapiens
gugcagaagaggaccuuua

SEQ ID NO: 1238158 - RNA, 19 nt, Homo sapiens
caagaaaacaguucacuuu

SEQ ID NO: 1238159 - RNA, 19 nt, Homo sapiens
aagaaggccuggauuucaa

SEQ ID NO: 1238160 - RNA, 19 nt, Homo sapiens
gacagaagaaaccgaauau

SEQ ID NO: 1238161 - RNA, 19 nt, Homo sapiens
aagaggaccuuuacacgau

SEQ ID NO: 1238162 - RNA, 19 nt, Homo sapiens
aaagggagaccaaagagaa

SEQ ID NO: 1238163 - RNA, 19 nt, Homo sapiens
gaacaggagagcaaagucu

SEQ ID NO: 1238164 - RNA, 19 nt, Homo sapiens
ggaacauaauccucuucuu

SEQ ID NO: 1238165 - RNA, 19 nt, Homo sapiens
uaagauggacaaacaugaa

SEQ ID NO: 1238166 - RNA, 19 nt, Homo sapiens
gcccaagaguggcaaagga

SEQ ID NO: 1238167 - RNA, 19 nt, Homo sapiens
gaaaacaguucacuuugag

SEQ ID NO: 1238168 - RNA, 19 nt, Homo sapiens
gagcaaagucuucguucug

SEQ ID NO: 1238169 - RNA, 19 nt, Homo sapiens
auaaagaaguuccuaucga

SEQ ID NO: 1238170 - RNA, 19 nt, Homo sapiens
acucauaggucuucggaau

SEQ ID NO: 1238171 - RNA, 19 nt, Homo sapiens
uuuggaggcuuauguagaa

SEQ ID NO: 1238172 - RNA, 19 nt, Homo sapiens
aguaagaaccugucccuuu

SEQ ID NO: 1238173 - RNA, 19 nt, Homo sapiens
acgugugucuggauaauaa

SEQ ID NO: 1238174 - RNA, 19 nt, Homo sapiens
ccacguagaaaguucacua

SEQ ID NO: 1238175 - RNA, 19 nt, Homo sapiens
ccgagagcaugaaggaauu

SEQ ID NO: 1238176 - RNA, 19 nt, Homo sapiens
gggcacagacucagacuca

SEQ ID NO: 1238177 - RNA, 19 nt, Homo sapiens
ugauacgugugucuggaua

SEQ ID NO: 1238178 - RNA, 19 nt, Homo sapiens
uagaggagggagacuauuu

SEQ ID NO: 1238179 - RNA, 19 nt, Homo sapiens
uaauggugcuuuagagagu

SEQ ID NO: 1238180 - RNA, 19 nt, Homo sapiens
ggagagcaaagucuucguu

SEQ ID NO: 1238181 - RNA, 19 nt, Homo sapiens
gaagacaucaugguugaca

SEQ ID NO: 1238182 - RNA, 19 nt, Homo sapiens
caaaguuccuucaccucau

SEQ ID NO: 1238183 - RNA, 19 nt, Homo sapiens
gcagauggcaacccuucuu

SEQ ID NO: 1238184 - RNA, 19 nt, Homo sapiens
gccaacagcucaggagaag

SEQ ID NO: 1238185 - RNA, 19 nt, Homo sapiens
aaguuaagauggacaaaca

SEQ ID NO: 1238186 - RNA, 19 nt, Homo sapiens
gaguucaugcaccagauua

SEQ ID NO: 1238187 - RNA, 19 nt, Homo sapiens
gaaaauuccacacgagaaa

SEQ ID NO: 1238188 - RNA, 19 nt, Homo sapiens
ggagugggcuggcuuuccu

SEQ ID NO: 1238189 - RNA, 19 nt, Homo sapiens
gcacagacucagacucauc

SEQ ID NO: 1238190 - RNA, 19 nt, Homo sapiens
gcgaccaggugcuguaucu

SEQ ID NO: 1238191 - RNA, 19 nt, Homo sapiens
gccagagccucaaguuaag

SEQ ID NO: 1238192 - RNA, 19 nt, Homo sapiens
gacaaaaccugacgaggau

SEQ ID NO: 1238193 - RNA, 19 nt, Homo sapiens
uugaagccaucccauuaaa

SEQ ID NO: 1238194 - RNA, 19 nt, Homo sapiens
gaaggaauuccgccuggau

SEQ ID NO: 1238195 - RNA, 19 nt, Homo sapiens
uuuggaagauagcaaugua

SEQ ID NO: 1238196 - RNA, 19 nt, Homo sapiens
cgaaagaaucaaucaguag

SEQ ID NO: 1238197 - RNA, 19 nt, Homo sapiens
ggaagagggagaagacgau

SEQ ID NO: 1238198 - RNA, 19 nt, Homo sapiens
ccaccacccuccaaagucu

SEQ ID NO: 1238199 - RNA, 19 nt, Homo sapiens
ccuacacuguuaaccauga

SEQ ID NO: 1238200 - RNA, 19 nt, Homo sapiens
caggcaaccucagcagaaa

SEQ ID NO: 1238201 - RNA, 19 nt, Homo sapiens
gauguuagcaggcucugau

SEQ ID NO: 1238202 - RNA, 19 nt, Homo sapiens
gcaaagggagaccaaagag

SEQ ID NO: 1238203 - RNA, 19 nt, Homo sapiens
cgaagaaggccuggauuuc

SEQ ID NO: 1238204 - RNA, 19 nt, Homo sapiens
gccgauuccuuccagauca

SEQ ID NO: 1238205 - RNA, 19 nt, Homo sapiens
cacaguuucuagaacguuu

SEQ ID NO: 1238206 - RNA, 19 nt, Homo sapiens
guaacgaaagaaucaauca

SEQ ID NO: 1238207 - RNA, 19 nt, Homo sapiens
gugcaacccaccucuagaa

SEQ ID NO: 1238208 - RNA, 19 nt, Homo sapiens
caaagggagaccaaagaga

SEQ ID NO: 1238209 - RNA, 19 nt, Homo sapiens
ucaaagguuuccgucauuc

SEQ ID NO: 1238210 - RNA, 19 nt, Homo sapiens
ucucaaagguuuccgucau

SEQ ID NO: 1238211 - RNA, 19 nt, Homo sapiens
ucaggacuccggagaagaa

SEQ ID NO: 1238212 - RNA, 19 nt, Homo sapiens
aaaguuccuucaccucaug

SEQ ID NO: 1238213 - RNA, 19 nt, Homo sapiens
agaaaacaguucacuuuga

SEQ ID NO: 1238214 - RNA, 19 nt, Homo sapiens
ucuccagaauccuccauuu

SEQ ID NO: 1238215 - RNA, 19 nt, Homo sapiens
gagaaagacucacgagaaa

SEQ ID NO: 1238216 - RNA, 19 nt, Homo sapiens
gaagauucaccauuguuua

SEQ ID NO: 1238217 - RNA, 19 nt, Homo sapiens
ggagaaagacucacgagaa

SEQ ID NO: 1238218 - RNA, 19 nt, Homo sapiens
ggaagaagcugagcauguc

SEQ ID NO: 1238219 - RNA, 19 nt, Homo sapiens
cauaugagaugacgaggaa

SEQ ID NO: 1238220 - RNA, 19 nt, Homo sapiens
gaacauaagaauucccauu

SEQ ID NO: 1238221 - RNA, 19 nt, Homo sapiens
gacauagaccugcauauuu

SEQ ID NO: 1238222 - RNA, 19 nt, Homo sapiens
uggcaaagguuccuaaaug

SEQ ID NO: 1238223 - RNA, 19 nt, Homo sapiens
acauagaccugcauauuug

SEQ ID NO: 1238224 - RNA, 19 nt, Homo sapiens
gcacggaccuacccagcuu

SEQ ID NO: 1238225 - RNA, 19 nt, Homo sapiens
gcauuagccuacaagcuuu

SEQ ID NO: 1238226 - RNA, 19 nt, Homo sapiens
caaaugaggcagucucuga

SEQ ID NO: 1238227 - RNA, 19 nt, Homo sapiens
caaagguuccuaaauggua

SEQ ID NO: 1238228 - RNA, 19 nt, Homo sapiens
caucaagccuggccucuuc

SEQ ID NO: 1238229 - RNA, 19 nt, Homo sapiens
gcacgugcuucugauuaaa

SEQ ID NO: 1238230 - RNA, 19 nt, Homo sapiens
ccacaggccuucgaugaga

SEQ ID NO: 1238231 - RNA, 19 nt, Homo sapiens
ggcgugagcuccaggaaug

SEQ ID NO: 1238232 - RNA, 19 nt, Homo sapiens
gaaccugcaggauguguuu

SEQ ID NO: 1238233 - RNA, 19 nt, Homo sapiens
ugacauagaccugcauauu

SEQ ID NO: 1238234 - RNA, 19 nt, Homo sapiens
gaacucugaccugugaaua

SEQ ID NO: 1238235 - RNA, 19 nt, Homo sapiens
guuggcaucuccugaagaa

SEQ ID NO: 1238236 - RNA, 19 nt, Homo sapiens
ccacgucgaugacccuaug

SEQ ID NO: 1238237 - RNA, 19 nt, Homo sapiens
ucaccgauauagacacauu

SEQ ID NO: 1238238 - RNA, 19 nt, Homo sapiens
ucugaacucugaccuguga

SEQ ID NO: 1238239 - RNA, 19 nt, Homo sapiens
gaugaguucuccaccaagu

SEQ ID NO: 1238240 - RNA, 19 nt, Homo sapiens
aaagguuccuaaaugguaa

SEQ ID NO: 1238241 - RNA, 19 nt, Homo sapiens
ggacgcacgugcuucugau

SEQ ID NO: 1238242 - RNA, 19 nt, Homo sapiens
ggcaaagguuccuaaaugg

SEQ ID NO: 1238243 - RNA, 19 nt, Homo sapiens
ccagacagggcguuuguuu

SEQ ID NO: 1238244 - RNA, 19 nt, Homo sapiens
gugagcggauagagugaua

SEQ ID NO: 1238245 - RNA, 19 nt, Homo sapiens
gaagcagcaugcacuuugg

SEQ ID NO: 1238246 - RNA, 19 nt, Homo sapiens
ugacuggccuuuaaagaac

SEQ ID NO: 1238247 - RNA, 19 nt, Homo sapiens
guagagagugugacauaga

SEQ ID NO: 1238248 - RNA, 19 nt, Homo sapiens
agaagcauuucaccucuga

SEQ ID NO: 1238249 - RNA, 19 nt, Homo sapiens
ggcuggagcugaaauccuu

SEQ ID NO: 1238250 - RNA, 19 nt, Homo sapiens
gcccaggucugcacgaagu

SEQ ID NO: 1238251 - RNA, 19 nt, Homo sapiens
ucagagaauuggcaaaggu

SEQ ID NO: 1238252 - RNA, 19 nt, Homo sapiens
ggagugcccauaugagaug

SEQ ID NO: 1238253 - RNA, 19 nt, Homo sapiens
ggaaguugguaggaucuca

SEQ ID NO: 1238254 - RNA, 19 nt, Homo sapiens
uagacugggucguguguga

SEQ ID NO: 1238255 - RNA, 19 nt, Homo sapiens
ucgaugacccuaugagauu

SEQ ID NO: 1238256 - RNA, 19 nt, Homo sapiens
gagaaaagccaguggagaa

SEQ ID NO: 1238257 - RNA, 19 nt, Homo sapiens
cuccuugacuggccuuuaa

SEQ ID NO: 1238258 - RNA, 19 nt, Homo sapiens
ggaggacuguugggcaugu

SEQ ID NO: 1238259 - RNA, 19 nt, Homo sapiens
uagggaaugucaccugaau

SEQ ID NO: 1238260 - RNA, 19 nt, Homo sapiens
ucaagccucuguucaggau

SEQ ID NO: 1238261 - RNA, 19 nt, Homo sapiens
cgcacgugcuucugauuaa

SEQ ID NO: 1238262 - RNA, 19 nt, Homo sapiens
uuacuuugcuucccagagu

SEQ ID NO: 1238263 - RNA, 19 nt, Homo sapiens
ccuggccucuucaaaggua

SEQ ID NO: 1238264 - RNA, 19 nt, Homo sapiens
gcaaagguuccuaaauggu

SEQ ID NO: 1238265 - RNA, 19 nt, Homo sapiens
gagaccaaccugaggaugu

SEQ ID NO: 1238266 - RNA, 19 nt, Homo sapiens
gagaugcucaagaacauuc

SEQ ID NO: 1238267 - RNA, 19 nt, Homo sapiens
acauccagauugugaagaa

SEQ ID NO: 1238268 - RNA, 19 nt, Homo sapiens
cagcgagccuucccucucu

SEQ ID NO: 1238269 - RNA, 19 nt, Homo sapiens
gagguuggcaucuccugaa

SEQ ID NO: 1238270 - RNA, 19 nt, Homo sapiens
ggagaucacaggcgugucu

SEQ ID NO: 1238271 - RNA, 19 nt, Homo sapiens
gaaccagcgcaacuucaau

SEQ ID NO: 1238272 - RNA, 19 nt, Homo sapiens
cugaugaauuucuccuuga

SEQ ID NO: 1238273 - RNA, 19 nt, Homo sapiens
ugucugggcugcuccaagu

SEQ ID NO: 1238274 - RNA, 19 nt, Homo sapiens
agaagcagcaugcacuuug

SEQ ID NO: 1238275 - RNA, 19 nt, Homo sapiens
acucugaccugugaauaga

SEQ ID NO: 1238276 - RNA, 19 nt, Homo sapiens
gugcauguacggccacaaa

SEQ ID NO: 1238277 - RNA, 19 nt, Homo sapiens
guuccuaaaugguaaucug

SEQ ID NO: 1238278 - RNA, 19 nt, Homo sapiens
gccaggagugcccauauga

SEQ ID NO: 1238279 - RNA, 19 nt, Homo sapiens
gagcggauagagugauaga

SEQ ID NO: 1238280 - RNA, 19 nt, Homo sapiens
cagcaugcacuuuggaaau

SEQ ID NO: 1238281 - RNA, 19 nt, Homo sapiens
gcagcaugcacuuuggaaa

SEQ ID NO: 1238282 - RNA, 19 nt, Homo sapiens
gagauucaagccucuguuc

SEQ ID NO: 1238283 - RNA, 19 nt, Homo sapiens
caggagugcccauaugaga

SEQ ID NO: 1238284 - RNA, 19 nt, Homo sapiens
gaggacuguugggcaugua

SEQ ID NO: 1238285 - RNA, 19 nt, Homo sapiens
gauguccugggaaauguuu

SEQ ID NO: 1238286 - RNA, 19 nt, Homo sapiens
gaucacaggcgugucuugu

SEQ ID NO: 1238287 - RNA, 19 nt, Homo sapiens
gcuuggaguuuggacagaa

SEQ ID NO: 1238288 - RNA, 19 nt, Homo sapiens
ccugcuggcucuugugugu

SEQ ID NO: 1238289 - RNA, 19 nt, Homo sapiens
gaaagacucacgagaaaag

SEQ ID NO: 1238290 - RNA, 19 nt, Homo sapiens
gggaaugucaccugaaugc

SEQ ID NO: 1238291 - RNA, 19 nt, Homo sapiens
cugagcaugucuuaccaaa

SEQ ID NO: 1238292 - RNA, 19 nt, Homo sapiens
gccacggccuggagauugu

SEQ ID NO: 1238293 - RNA, 19 nt, Homo sapiens
aacauaagaauucccauug

SEQ ID NO: 1238294 - RNA, 19 nt, Homo sapiens
agaagcugagcaugucuua

SEQ ID NO: 1238295 - RNA, 19 nt, Homo sapiens
gcauguagacuggcaccuu

SEQ ID NO: 1238296 - RNA, 19 nt, Homo sapiens
gagaaccagcgcaacuuca

SEQ ID NO: 1238297 - RNA, 19 nt, Homo sapiens
aggaugaguucuccaccaa

SEQ ID NO: 1238298 - RNA, 19 nt, Homo sapiens
acgcacgugcuucugauua

SEQ ID NO: 1238299 - RNA, 19 nt, Homo sapiens
gaguaugguguuugcgaaa

SEQ ID NO: 1238300 - RNA, 19 nt, Homo sapiens
acuggcaccuugaagauuc

SEQ ID NO: 1238301 - RNA, 19 nt, Homo sapiens
gauagacugggucgugugu

SEQ ID NO: 1238302 - RNA, 19 nt, Homo sapiens
acagcgagccggacacaga

SEQ ID NO: 1238303 - RNA, 19 nt, Homo sapiens
ugaggcagucucugaguga

SEQ ID NO: 1238304 - RNA, 19 nt, Homo sapiens
ggugugugcucgccuuugc

SEQ ID NO: 1238305 - RNA, 19 nt, Homo sapiens
agccagauaucgggccaua

SEQ ID NO: 1238306 - RNA, 19 nt, Homo sapiens
cauuucaccucugaucuca

SEQ ID NO: 1238307 - RNA, 19 nt, Homo sapiens
uggaagaagcugagcaugu

SEQ ID NO: 1238308 - RNA, 19 nt, Homo sapiens
gauggaagaagcugagcau

SEQ ID NO: 1238309 - RNA, 19 nt, Homo sapiens
cgugaggaguaugguguuu

SEQ ID NO: 1238310 - RNA, 19 nt, Homo sapiens
ccacggccacauccagauu

SEQ ID NO: 1238311 - RNA, 19 nt, Homo sapiens
gggacgcacgugcuucuga

SEQ ID NO: 1238312 - RNA, 19 nt, Homo sapiens
cuagaggcgugcccuuugg

SEQ ID NO: 1238313 - RNA, 19 nt, Homo sapiens
ccucugugguggucacugu

SEQ ID NO: 1238314 - RNA, 19 nt, Homo sapiens
guggacggccuguucauca

SEQ ID NO: 1238315 - RNA, 19 nt, Homo sapiens
caauaaagguggcauacga

SEQ ID NO: 1238316 - RNA, 19 nt, Homo sapiens
gcaccucaaugaaugugua

SEQ ID NO: 1238317 - RNA, 19 nt, Homo sapiens
ggaacucgcuaucccuguu

SEQ ID NO: 1238318 - RNA, 19 nt, Homo sapiens
gggcagagguggagaccau

SEQ ID NO: 1238319 - RNA, 19 nt, Homo sapiens
gcaggagcuuccacuucua

SEQ ID NO: 1238320 - RNA, 19 nt, Homo sapiens
ccaaggaacuggagcuuuu

SEQ ID NO: 1238321 - RNA, 19 nt, Homo sapiens
ggacgaguguggccuagag

SEQ ID NO: 1238322 - RNA, 19 nt, Homo sapiens
guccuucucuucccggaua

SEQ ID NO: 1238323 - RNA, 19 nt, Homo sapiens
ggcaggagcuuccacuucu

SEQ ID NO: 1238324 - RNA, 19 nt, Homo sapiens
uggcccagcugguuauuga

SEQ ID NO: 1238325 - RNA, 19 nt, Homo sapiens
aaagguggcauacgaagga

SEQ ID NO: 1238326 - RNA, 19 nt, Homo sapiens
gaacucgcuaucccuguug

SEQ ID NO: 1238327 - RNA, 19 nt, Homo sapiens
gguugcaguuucacuuuua

SEQ ID NO: 1238328 - RNA, 19 nt, Homo sapiens
ccucuggccucuccaugau

SEQ ID NO: 1238329 - RNA, 19 nt, Homo sapiens
uccagcaccucaaugaaug

SEQ ID NO: 1238330 - RNA, 19 nt, Homo sapiens
gagcuuccacuucuacgau

SEQ ID NO: 1238331 - RNA, 19 nt, Homo sapiens
gguguuguccuccggaaug

SEQ ID NO: 1238332 - RNA, 19 nt, Homo sapiens
gguuauugacucugacuug

SEQ ID NO: 1238333 - RNA, 19 nt, Homo sapiens
gugucaaccugucuaucaa

SEQ ID NO: 1238334 - RNA, 19 nt, Homo sapiens
ucuggccucuccaugauga

SEQ ID NO: 1238335 - RNA, 19 nt, Homo sapiens
gaaaccccguuauaagugu

SEQ ID NO: 1238336 - RNA, 19 nt, Homo sapiens
acacaauaaagguggcaua

SEQ ID NO: 1238337 - RNA, 19 nt, Homo sapiens
cagguugcaguuucacuuu

SEQ ID NO: 1238338 - RNA, 19 nt, Homo sapiens
gaaggccaggagcccagua

SEQ ID NO: 1238339 - RNA, 19 nt, Homo sapiens
cagcagggcagaguguuug

SEQ ID NO: 1238340 - RNA, 19 nt, Homo sapiens
caggagcgcagcaccaugu

SEQ ID NO: 1238341 - RNA, 19 nt, Homo sapiens
ugagugaaacgcagcacaa

SEQ ID NO: 1238342 - RNA, 19 nt, Homo sapiens
agaagaagacggucaccau

SEQ ID NO: 1238343 - RNA, 19 nt, Homo sapiens
cuucuacgaugccauggau

SEQ ID NO: 1238344 - RNA, 19 nt, Homo sapiens
ccagcagggcagaguguuu

SEQ ID NO: 1238345 - RNA, 19 nt, Homo sapiens
cguggugacugaggugcua

SEQ ID NO: 1238346 - RNA, 19 nt, Homo sapiens
gcagccagaacacaaaguc

SEQ ID NO: 1238347 - RNA, 19 nt, Homo sapiens
ccuacugccuggugguuag

SEQ ID NO: 1238348 - RNA, 19 nt, Homo sapiens
gaaugcuggugccggaacu

SEQ ID NO: 1238349 - RNA, 19 nt, Homo sapiens
ugugucaaccugucuauca

SEQ ID NO: 1238350 - RNA, 19 nt, Homo sapiens
ggaaaccccguuauaagug

SEQ ID NO: 1238351 - RNA, 19 nt, Homo sapiens
gaacagcuggggcgaagga

SEQ ID NO: 1238352 - RNA, 19 nt, Homo sapiens
uggagugccugguguuguc

SEQ ID NO: 1238353 - RNA, 19 nt, Homo sapiens
gaggugcuacagacacaga

SEQ ID NO: 1238354 - RNA, 19 nt, Homo sapiens
aauaaagguggcauacgaa

SEQ ID NO: 1238355 - RNA, 19 nt, Homo sapiens
gcuccagcaccucaaugaa

SEQ ID NO: 1238356 - RNA, 19 nt, Homo sapiens
gugaaacgcagcacaagcu

SEQ ID NO: 1238357 - RNA, 19 nt, Homo sapiens
gcgucagguugcaguuuca

SEQ ID NO: 1238358 - RNA, 19 nt, Homo sapiens
guaaauggcugcuguaaug

SEQ ID NO: 1238359 - RNA, 19 nt, Homo sapiens
gacaggagcuccaaccuua

SEQ ID NO: 1238360 - RNA, 19 nt, Homo sapiens
caagaaaucuauuccguuu

SEQ ID NO: 1238361 - RNA, 19 nt, Homo sapiens
acacacaacucuccuauau

SEQ ID NO: 1238362 - RNA, 19 nt, Homo sapiens
ggaggaauuuguucucauu

SEQ ID NO: 1238363 - RNA, 19 nt, Homo sapiens
gaggaaaccuuggcuuuga

SEQ ID NO: 1238364 - RNA, 19 nt, Homo sapiens
ggaaggauuugcugguaaa

SEQ ID NO: 1238365 - RNA, 19 nt, Homo sapiens
acacaacucuccuauauuc

SEQ ID NO: 1238366 - RNA, 19 nt, Homo sapiens
gauccucucugccuuugua

SEQ ID NO: 1238367 - RNA, 19 nt, Homo sapiens
gaagaucacuuugaguugu

SEQ ID NO: 1238368 - RNA, 19 nt, Homo sapiens
gaauaguacugcucuuugu

SEQ ID NO: 1238369 - RNA, 19 nt, Homo sapiens
gaaucagccucuccuuuga

SEQ ID NO: 1238370 - RNA, 19 nt, Homo sapiens
ggaaucagccucuccuuug

SEQ ID NO: 1238371 - RNA, 19 nt, Homo sapiens
ggccauauuugccuucuaa

SEQ ID NO: 1238372 - RNA, 19 nt, Homo sapiens
gagcaaggucuuuguaauu

SEQ ID NO: 1238373 - RNA, 19 nt, Homo sapiens
gaggaaggauuugcuggua

SEQ ID NO: 1238374 - RNA, 19 nt, Homo sapiens
agauggaacucuucuguaa

SEQ ID NO: 1238375 - RNA, 19 nt, Homo sapiens
gcauuggacuucucggauu

SEQ ID NO: 1238376 - RNA, 19 nt, Homo sapiens
cuaauacauuccugcaaua

SEQ ID NO: 1238377 - RNA, 19 nt, Homo sapiens
ucucauccaucuauuguuu

SEQ ID NO: 1238378 - RNA, 19 nt, Homo sapiens
ucagagcacugcaagagaa

SEQ ID NO: 1238379 - RNA, 19 nt, Homo sapiens
gaagaagaaacccagcuuu

SEQ ID NO: 1238380 - RNA, 19 nt, Homo sapiens
ccacccagauacaacauuu

SEQ ID NO: 1238381 - RNA, 19 nt, Homo sapiens
gugaacaguuuauaccaaa

SEQ ID NO: 1238382 - RNA, 19 nt, Homo sapiens
gaacacacaacucuccuau

SEQ ID NO: 1238383 - RNA, 19 nt, Homo sapiens
ccucguagcuugcuguaug

SEQ ID NO: 1238384 - RNA, 19 nt, Homo sapiens
agucgaaugugcucauaua

SEQ ID NO: 1238385 - RNA, 19 nt, Homo sapiens
gccauauccugacguguaa

SEQ ID NO: 1238386 - RNA, 19 nt, Homo sapiens
cguggaaagugcaguuuaa

SEQ ID NO: 1238387 - RNA, 19 nt, Homo sapiens
ggaauuuguucucauuucu

SEQ ID NO: 1238388 - RNA, 19 nt, Homo sapiens
cuaauucuguggucaguau

SEQ ID NO: 1238389 - RNA, 19 nt, Homo sapiens
cucaaggucuagaauauuu

SEQ ID NO: 1238390 - RNA, 19 nt, Homo sapiens
gaagagcgcauuuuacauu

SEQ ID NO: 1238391 - RNA, 19 nt, Homo sapiens
gaauuucagugucugucuu

SEQ ID NO: 1238392 - RNA, 19 nt, Homo sapiens
cagacacucuuccauucua

SEQ ID NO: 1238393 - RNA, 19 nt, Homo sapiens
ggagucacgugaacacaca

SEQ ID NO: 1238394 - RNA, 19 nt, Homo sapiens
ggacgugaauauucucucu

SEQ ID NO: 1238395 - RNA, 19 nt, Homo sapiens
gaugaacucggcuacguuu

SEQ ID NO: 1238396 - RNA, 19 nt, Homo sapiens
ggacuacaucgaacucuga

SEQ ID NO: 1238397 - RNA, 19 nt, Homo sapiens
caucaugcccuucgaauag

SEQ ID NO: 1238398 - RNA, 19 nt, Homo sapiens
ggaaucuccuccagguuca

SEQ ID NO: 1238399 - RNA, 19 nt, Homo sapiens
gagcuuauuuuaacucuug

SEQ ID NO: 1238400 - RNA, 19 nt, Homo sapiens
ucuaauacauuccugcaau

SEQ ID NO: 1238401 - RNA, 19 nt, Homo sapiens
agcaaggucuuuguaauuu

SEQ ID NO: 1238402 - RNA, 19 nt, Homo sapiens
gagagggcagugagagaua

SEQ ID NO: 1238403 - RNA, 19 nt, Homo sapiens
guagucgaaugugcucaua

SEQ ID NO: 1238404 - RNA, 19 nt, Homo sapiens
ggcucaaggucuagaauau

SEQ ID NO: 1238405 - RNA, 19 nt, Homo sapiens
guagcuugcuguauguguu

SEQ ID NO: 1238406 - RNA, 19 nt, Homo sapiens
guucuguguucucgaguuu

SEQ ID NO: 1238407 - RNA, 19 nt, Homo sapiens
guaguggugauuucccuua

SEQ ID NO: 1238408 - RNA, 19 nt, Homo sapiens
ugagcaaggucuuuguaau

SEQ ID NO: 1238409 - RNA, 19 nt, Homo sapiens
ggagagcacuguuuuagca

SEQ ID NO: 1238410 - RNA, 19 nt, Homo sapiens
ggauuccuuuggaguaaug

SEQ ID NO: 1238411 - RNA, 19 nt, Homo sapiens
uugcuuguauuuccacuuu

SEQ ID NO: 1238412 - RNA, 19 nt, Homo sapiens
cgauggagaauuaaacuug

SEQ ID NO: 1238413 - RNA, 19 nt, Homo sapiens
accuuacgauggagaauua

SEQ ID NO: 1238414 - RNA, 19 nt, Homo sapiens
gcaugucucauccaucuau

SEQ ID NO: 1238415 - RNA, 19 nt, Homo sapiens
uaaacagacgcaccucgua

SEQ ID NO: 1238416 - RNA, 19 nt, Homo sapiens
aauagaaacccaacguuga

SEQ ID NO: 1238417 - RNA, 19 nt, Homo sapiens
gcagcaggacuacaucgaa

SEQ ID NO: 1238418 - RNA, 19 nt, Homo sapiens
gcaaggucuuuguaauuuu

SEQ ID NO: 1238419 - RNA, 19 nt, Homo sapiens
cuuuauugcuuucagcuuu

SEQ ID NO: 1238420 - RNA, 19 nt, Homo sapiens
cccugaacgugaccuguua

SEQ ID NO: 1238421 - RNA, 19 nt, Homo sapiens
gauggaacucuucuguaaa

SEQ ID NO: 1238422 - RNA, 19 nt, Homo sapiens
agaaaucuauuccguuugc

SEQ ID NO: 1238423 - RNA, 19 nt, Homo sapiens
cgaauaguacugcucuuug

SEQ ID NO: 1238424 - RNA, 19 nt, Homo sapiens
aaacccagcuuucuaucag

SEQ ID NO: 1238425 - RNA, 19 nt, Homo sapiens
agacacucuuccauucuaa

SEQ ID NO: 1238426 - RNA, 19 nt, Homo sapiens
ucacgguggugguggaguu

SEQ ID NO: 1238427 - RNA, 19 nt, Homo sapiens
gugaggaaaccuuggcuuu

SEQ ID NO: 1238428 - RNA, 19 nt, Homo sapiens
ugcaggaccucaucucaga

SEQ ID NO: 1238429 - RNA, 19 nt, Homo sapiens
guacuugaagagcgcauuu

SEQ ID NO: 1238430 - RNA, 19 nt, Homo sapiens
acucugaugugccggauug

SEQ ID NO: 1238431 - RNA, 19 nt, Homo sapiens
uauuagaucccaagaaauc

SEQ ID NO: 1238432 - RNA, 19 nt, Homo sapiens
guaagcuggucaggcaauu

SEQ ID NO: 1238433 - RNA, 19 nt, Homo sapiens
gcucaaggucuagaauauu

SEQ ID NO: 1238434 - RNA, 19 nt, Homo sapiens
auaaagcacuccccauuuu

SEQ ID NO: 1238435 - RNA, 19 nt, Homo sapiens
gcuuguauuuccacuuugu

SEQ ID NO: 1238436 - RNA, 19 nt, Homo sapiens
uaaacuugcuuguauuucc

SEQ ID NO: 1238437 - RNA, 19 nt, Homo sapiens
ggcugucgcucgucuacuu

SEQ ID NO: 1238438 - RNA, 19 nt, Homo sapiens
ccuacuaccucuuauacuc

SEQ ID NO: 1238439 - RNA, 19 nt, Homo sapiens
gcagugagagauaggaauc

SEQ ID NO: 1238440 - RNA, 19 nt, Homo sapiens
ucgaagaucacuuugaguu

SEQ ID NO: 1238441 - RNA, 19 nt, Homo sapiens
gagcaacauaacauagauu

SEQ ID NO: 1238442 - RNA, 19 nt, Homo sapiens
auauuugguuucccuauga

SEQ ID NO: 1238443 - RNA, 19 nt, Homo sapiens
acucuuccauucuaaucua

SEQ ID NO: 1238444 - RNA, 19 nt, Homo sapiens
guuuguauuucgacaguau

SEQ ID NO: 1238445 - RNA, 19 nt, Homo sapiens
ggcagucgaagaucacuuu

SEQ ID NO: 1238446 - RNA, 19 nt, Homo sapiens
ugagcaacauaacauagau

SEQ ID NO: 1238447 - RNA, 19 nt, Homo sapiens
cuaacugcacgauuucuaa

SEQ ID NO: 1238448 - RNA, 19 nt, Homo sapiens
uccaggcucuuucacugua

SEQ ID NO: 1238449 - RNA, 19 nt, Homo sapiens
aggaaggauuugcugguaa

SEQ ID NO: 1238450 - RNA, 19 nt, Homo sapiens
caauauguaguggugauuu

SEQ ID NO: 1238451 - RNA, 19 nt, Homo sapiens
caaggucuagaauauuuga

SEQ ID NO: 1238452 - RNA, 19 nt, Homo sapiens
gaggaauuuguucucauuu

SEQ ID NO: 1238453 - RNA, 19 nt, Homo sapiens
ucucgaguuucaggaguua

SEQ ID NO: 1238454 - RNA, 19 nt, Homo sapiens
cgaagaucacuuugaguug

SEQ ID NO: 1238455 - RNA, 19 nt, Homo sapiens
gaacaguuuauaccaaagg

SEQ ID NO: 1238456 - RNA, 19 nt, Homo sapiens
ugugaacaguuuauaccaa

SEQ ID NO: 1238457 - RNA, 19 nt, Homo sapiens
cugcaugucucauccaucu

SEQ ID NO: 1238458 - RNA, 19 nt, Homo sapiens
gaagagccauccagauaua

SEQ ID NO: 1238459 - RNA, 19 nt, Homo sapiens
ugacuucucuuauggaaua

SEQ ID NO: 1238460 - RNA, 19 nt, Homo sapiens
ccagaaauguuaccacuuu

SEQ ID NO: 1238461 - RNA, 19 nt, Homo sapiens
gaacaaagcaggacaaguc

SEQ ID NO: 1238462 - RNA, 19 nt, Homo sapiens
guacagaacccugguauuu

SEQ ID NO: 1238463 - RNA, 19 nt, Homo sapiens
gaauuucaauguagccuuu

SEQ ID NO: 1238464 - RNA, 19 nt, Homo sapiens
ccuaguagcuucuguaugu

SEQ ID NO: 1238465 - RNA, 19 nt, Homo sapiens
gcaagaauucuacaaacua

SEQ ID NO: 1238466 - RNA, 19 nt, Homo sapiens
aaacacagguggaagaguu

SEQ ID NO: 1238467 - RNA, 19 nt, Homo sapiens
caacaucucugacugugau

SEQ ID NO: 1238468 - RNA, 19 nt, Homo sapiens
uagaagagccauccagaua

SEQ ID NO: 1238469 - RNA, 19 nt, Homo sapiens
gcacgugagucgaaugaug

SEQ ID NO: 1238470 - RNA, 19 nt, Homo sapiens
uaauaaaggucuucugaca

SEQ ID NO: 1238471 - RNA, 19 nt, Homo sapiens
cagugcagcucuugguuua

SEQ ID NO: 1238472 - RNA, 19 nt, Homo sapiens
gggaaggguuucagacuug

SEQ ID NO: 1238473 - RNA, 19 nt, Homo sapiens
cgaguuaucugggaacaaa

SEQ ID NO: 1238474 - RNA, 19 nt, Homo sapiens
ggacaagacuuccauugcu

SEQ ID NO: 1238475 - RNA, 19 nt, Homo sapiens
gauaucgccuggagcacua

SEQ ID NO: 1238476 - RNA, 19 nt, Homo sapiens
ucucagcacuggcauguuu

SEQ ID NO: 1238477 - RNA, 19 nt, Homo sapiens
gcugauggcccucauacua

SEQ ID NO: 1238478 - RNA, 19 nt, Homo sapiens
caauguagccuuugcuuug

SEQ ID NO: 1238479 - RNA, 19 nt, Homo sapiens
ucauggaccugaucuuuau

SEQ ID NO: 1238480 - RNA, 19 nt, Homo sapiens
gcucuugguuuacccauug

SEQ ID NO: 1238481 - RNA, 19 nt, Homo sapiens
ugacaugaaugaccagaau

SEQ ID NO: 1238482 - RNA, 19 nt, Homo sapiens
gaauuuaggccacccguau

SEQ ID NO: 1238483 - RNA, 19 nt, Homo sapiens
auaaaggucuucugacaug

SEQ ID NO: 1238484 - RNA, 19 nt, Homo sapiens
cugcagagauuucauguuc

SEQ ID NO: 1238485 - RNA, 19 nt, Homo sapiens
gccauuauuuaguggauuu

SEQ ID NO: 1238486 - RNA, 19 nt, Homo sapiens
cgaauuggcuggcauuagg

SEQ ID NO: 1238487 - RNA, 19 nt, Homo sapiens
ugaaggaucuacugcuuuc

SEQ ID NO: 1238488 - RNA, 19 nt, Homo sapiens
ucacaaagaggagagauuu

SEQ ID NO: 1238489 - RNA, 19 nt, Homo sapiens
gagauuucauguucagaau

SEQ ID NO: 1238490 - RNA, 19 nt, Homo sapiens
ccacugacuucucuuaugg

SEQ ID NO: 1238491 - RNA, 19 nt, Homo sapiens
gaugcuagccuucuugguu

SEQ ID NO: 1238492 - RNA, 19 nt, Homo sapiens
gaaugaugcuagccuucuu

SEQ ID NO: 1238493 - RNA, 19 nt, Homo sapiens
ccauccagauauauugaua

SEQ ID NO: 1238494 - RNA, 19 nt, Homo sapiens
ucauugacagcuacuauua

SEQ ID NO: 1238495 - RNA, 19 nt, Homo sapiens
gccauucgcuccuaugcuu

SEQ ID NO: 1238496 - RNA, 19 nt, Homo sapiens
ugacugugaugaaacauuc

SEQ ID NO: 1238497 - RNA, 19 nt, Homo sapiens
gcagagauuucauguucag

SEQ ID NO: 1238498 - RNA, 19 nt, Homo sapiens
gaacccugguauuucuauu

SEQ ID NO: 1238499 - RNA, 19 nt, Homo sapiens
gccuguaacauuuguaaua

SEQ ID NO: 1238500 - RNA, 19 nt, Homo sapiens
ccagaaggcagaccuguga

SEQ ID NO: 1238501 - RNA, 19 nt, Homo sapiens
cagcauuccuuccuaguag

SEQ ID NO: 1238502 - RNA, 19 nt, Homo sapiens
gucaucgccuguaacauuu

SEQ ID NO: 1238503 - RNA, 19 nt, Homo sapiens
gaugguauauggacaagac

SEQ ID NO: 1238504 - RNA, 19 nt, Homo sapiens
gaacugucuuccuguuugg

SEQ ID NO: 1238505 - RNA, 19 nt, Homo sapiens
uggaucagcuuggccuaua

SEQ ID NO: 1238506 - RNA, 19 nt, Homo sapiens
gaaauguuaccacuuugug

SEQ ID NO: 1238507 - RNA, 19 nt, Homo sapiens
acccugguauuucuauuua

SEQ ID NO: 1238508 - RNA, 19 nt, Homo sapiens
ggaccugaucuuuauggua

SEQ ID NO: 1238509 - RNA, 19 nt, Homo sapiens
aaacuacaccauccucaaa

SEQ ID NO: 1238510 - RNA, 19 nt, Homo sapiens
gaaaagagugguaucgauu

SEQ ID NO: 1238511 - RNA, 19 nt, Homo sapiens
caaccaucuuguuaacuau

SEQ ID NO: 1238512 - RNA, 19 nt, Homo sapiens
uauagaccauuccuugaug

SEQ ID NO: 1238513 - RNA, 19 nt, Homo sapiens
gcuuucaagugucugcuuu

SEQ ID NO: 1238514 - RNA, 19 nt, Homo sapiens
cauccacacugucccagaa

SEQ ID NO: 1238515 - RNA, 19 nt, Homo sapiens
gaucuacugcuuucaagug

SEQ ID NO: 1238516 - RNA, 19 nt, Homo sapiens
gagcuguauuugugaacuu

SEQ ID NO: 1238517 - RNA, 19 nt, Homo sapiens
ccaaaggacaaccaucuug

SEQ ID NO: 1238518 - RNA, 19 nt, Homo sapiens
gaaggcagaccugugaaug

SEQ ID NO: 1238519 - RNA, 19 nt, Homo sapiens
ugauggcccucauacuauu

SEQ ID NO: 1238520 - RNA, 19 nt, Homo sapiens
uauguacacuacguugaua

SEQ ID NO: 1238521 - RNA, 19 nt, Homo sapiens
cacacuaccucaucuaugg

SEQ ID NO: 1238522 - RNA, 19 nt, Homo sapiens
agucaucgccuguaacauu

SEQ ID NO: 1238523 - RNA, 19 nt, Homo sapiens
aaagagugguaucgauuuc

SEQ ID NO: 1238524 - RNA, 19 nt, Homo sapiens
ucagaucaguauacagugu

SEQ ID NO: 1238525 - RNA, 19 nt, Homo sapiens
caaagcugcugcgggcauu

SEQ ID NO: 1238526 - RNA, 19 nt, Homo sapiens
ugaaugaccagaaucuaga

SEQ ID NO: 1238527 - RNA, 19 nt, Homo sapiens
cccagcagcuuccuucuuc

SEQ ID NO: 1238528 - RNA, 19 nt, Homo sapiens
ggaaaagagugguaucgau

SEQ ID NO: 1238529 - RNA, 19 nt, Homo sapiens
uguuugggcucuugucauu

SEQ ID NO: 1238530 - RNA, 19 nt, Homo sapiens
uuugugagcuguauuugug

SEQ ID NO: 1238531 - RNA, 19 nt, Homo sapiens
caacacacuaccucaucua

SEQ ID NO: 1238532 - RNA, 19 nt, Homo sapiens
aagcaaagcaaaucaggaa

SEQ ID NO: 1238533 - RNA, 19 nt, Homo sapiens
guucagaggucaguuacca

SEQ ID NO: 1238534 - RNA, 19 nt, Homo sapiens
ccugaaggaucuacugcuu

SEQ ID NO: 1238535 - RNA, 19 nt, Homo sapiens
uguaauaaaggucuucuga

SEQ ID NO: 1238536 - RNA, 19 nt, Homo sapiens
ugcgaugucuucuggcuuu

SEQ ID NO: 1238537 - RNA, 19 nt, Homo sapiens
gagcaacaucucugacugu

SEQ ID NO: 1238538 - RNA, 19 nt, Homo sapiens
caagucaucgccuguaaca

SEQ ID NO: 1238539 - RNA, 19 nt, Homo sapiens
gagccauccagauauauug

SEQ ID NO: 1238540 - RNA, 19 nt, Homo sapiens
acaauuggcagcuucaguu

SEQ ID NO: 1238541 - RNA, 19 nt, Homo sapiens
cagaaauguuaccacuuug

SEQ ID NO: 1238542 - RNA, 19 nt, Homo sapiens
uaucuuuacuccucaugga

SEQ ID NO: 1238543 - RNA, 19 nt, Homo sapiens
gaaugaccagaaucuagaa

SEQ ID NO: 1238544 - RNA, 19 nt, Homo sapiens
uaugggaaguuggugauug

SEQ ID NO: 1238545 - RNA, 19 nt, Homo sapiens
uaaaggucuucugacauga

SEQ ID NO: 1238546 - RNA, 19 nt, Homo sapiens
ucagaggucaguuaccaaa

SEQ ID NO: 1238547 - RNA, 19 nt, Homo sapiens
cuggagcacuauacuguga

SEQ ID NO: 1238548 - RNA, 19 nt, Homo sapiens
acaaggcugugugcaagaa

SEQ ID NO: 1238549 - RNA, 19 nt, Homo sapiens
cauaugccauucgcuccua

SEQ ID NO: 1238550 - RNA, 19 nt, Homo sapiens
gauuguuccuacugacaug

SEQ ID NO: 1238551 - RNA, 19 nt, Homo sapiens
ccaacacacuaccucaucu

SEQ ID NO: 1238552 - RNA, 19 nt, Homo sapiens
ggagcacuauacugugaca

SEQ ID NO: 1238553 - RNA, 19 nt, Homo sapiens
ccucauggaccugaucuuu

SEQ ID NO: 1238554 - RNA, 19 nt, Homo sapiens
gauugcaccacucaacauu

SEQ ID NO: 1238555 - RNA, 19 nt, Homo sapiens
caugcaagaauucuacaaa

SEQ ID NO: 1238556 - RNA, 19 nt, Homo sapiens
uaacuauugauuccaguga

SEQ ID NO: 1238557 - RNA, 19 nt, Homo sapiens
ggaucagcuuggccuauag

SEQ ID NO: 1238558 - RNA, 19 nt, Homo sapiens
ugacacagcuccauaaaga

SEQ ID NO: 1238559 - RNA, 19 nt, Homo sapiens
ggacaaagaggcagcugua

SEQ ID NO: 1238560 - RNA, 19 nt, Homo sapiens
gaccgaauuuccaaggaua

SEQ ID NO: 1238561 - RNA, 19 nt, Homo sapiens
uaaagaagcacgcauuugu

SEQ ID NO: 1238562 - RNA, 19 nt, Homo sapiens
gaggagaaccugucauuag

SEQ ID NO: 1238563 - RNA, 19 nt, Homo sapiens
gagacauccucgcuuuaaa

SEQ ID NO: 1238564 - RNA, 19 nt, Homo sapiens
cuacagcugugccaccuaa

SEQ ID NO: 1238565 - RNA, 19 nt, Homo sapiens
gcagaaccuugcauagauc

SEQ ID NO: 1238566 - RNA, 19 nt, Homo sapiens
ggaggagaaccugucauua

SEQ ID NO: 1238567 - RNA, 19 nt, Homo sapiens
ggaccgaauuuccaaggau

SEQ ID NO: 1238568 - RNA, 19 nt, Homo sapiens
ggagaagggcgagggagua

SEQ ID NO: 1238569 - RNA, 19 nt, Homo sapiens
gcacagaugccaccugaac

SEQ ID NO: 1238570 - RNA, 19 nt, Homo sapiens
ggugagcccuggacuuaag

SEQ ID NO: 1238571 - RNA, 19 nt, Homo sapiens
gagaagggcgagggaguaa

SEQ ID NO: 1238572 - RNA, 19 nt, Homo sapiens
ggaagaaggcgcugcaacu

SEQ ID NO: 1238573 - RNA, 19 nt, Homo sapiens
ggagccaguuucucaucuu

SEQ ID NO: 1238574 - RNA, 19 nt, Homo sapiens
caaagaggcagcuguagca

SEQ ID NO: 1238575 - RNA, 19 nt, Homo sapiens
gaaguggagucugcuguac

SEQ ID NO: 1238576 - RNA, 19 nt, Homo sapiens
gaagggcgagggaguaaag

SEQ ID NO: 1238577 - RNA, 19 nt, Homo sapiens
guacgcagggccucaaaga

SEQ ID NO: 1238578 - RNA, 19 nt, Homo sapiens
gagaagaggaagcucacuu

SEQ ID NO: 1238579 - RNA, 19 nt, Homo sapiens
ggccacaagcccuuucuuu

SEQ ID NO: 1238580 - RNA, 19 nt, Homo sapiens
gagccaguuucucaucuuc

SEQ ID NO: 1238581 - RNA, 19 nt, Homo sapiens
cagcagaaccuugcauaga

SEQ ID NO: 1238582 - RNA, 19 nt, Homo sapiens
gccacaagcccuuucuuug

SEQ ID NO: 1238583 - RNA, 19 nt, Homo sapiens
guaccgguguggagagugu

SEQ ID NO: 1238584 - RNA, 19 nt, Homo sapiens
gcuaauccauaaggacaug

SEQ ID NO: 1238585 - RNA, 19 nt, Homo sapiens
caaccugcgugggcauuug

SEQ ID NO: 1238586 - RNA, 19 nt, Homo sapiens
cacaagcccuuucuuugca

SEQ ID NO: 1238587 - RNA, 19 nt, Homo sapiens
ggaauccgagguucgcauu

SEQ ID NO: 1238588 - RNA, 19 nt, Homo sapiens
ggcuucaucugcaagugua

SEQ ID NO: 1238589 - RNA, 19 nt, Homo sapiens
uggcuggacuagcuuggua

SEQ ID NO: 1238590 - RNA, 19 nt, Homo sapiens
aaggauagccagccacuug

SEQ ID NO: 1238591 - RNA, 19 nt, Homo sapiens
cgagaggcuucaucugcaa

SEQ ID NO: 1238592 - RNA, 19 nt, Homo sapiens
gaagaaggcgcugcaacuc

SEQ ID NO: 1238593 - RNA, 19 nt, Homo sapiens
gccuggugcuaauccauaa

SEQ ID NO: 1238594 - RNA, 19 nt, Homo sapiens
gcaggaagcuccccaaagc

SEQ ID NO: 1238595 - RNA, 19 nt, Homo sapiens
ccacaagcccuuucuuugc

SEQ ID NO: 1238596 - RNA, 19 nt, Homo sapiens
cuaccuggccaagaaguua

SEQ ID NO: 1238597 - RNA, 19 nt, Homo sapiens
gaguguggcaagagcuaua

SEQ ID NO: 1238598 - RNA, 19 nt, Homo sapiens
ccuaaagaagcacgcauuu

SEQ ID NO: 1238599 - RNA, 19 nt, Homo sapiens
cgacguggaugaggaaugc

SEQ ID NO: 1238600 - RNA, 19 nt, Homo sapiens
agcagaaccuugcauagau

SEQ ID NO: 1238601 - RNA, 19 nt, Homo sapiens
gacauccucgcuuuaaaga

SEQ ID NO: 1238602 - RNA, 19 nt, Homo sapiens
cagaaagccaggagaagug

SEQ ID NO: 1238603 - RNA, 19 nt, Homo sapiens
uagcaguggugacagaagu

SEQ ID NO: 1238604 - RNA, 19 nt, Homo sapiens
gaugggcaccugacagcuu

SEQ ID NO: 1238605 - RNA, 19 nt, Homo sapiens
ccaguccugugcaccaaug

SEQ ID NO: 1238606 - RNA, 19 nt, Homo sapiens
gcauccaggcagagaauau

SEQ ID NO: 1238607 - RNA, 19 nt, Homo sapiens
gaggagcugagaagaggaa

SEQ ID NO: 1238608 - RNA, 19 nt, Homo sapiens
cacaacugcuggacacaca

SEQ ID NO: 1238609 - RNA, 19 nt, Homo sapiens
gagaguguggcaaggcauu

SEQ ID NO: 1238610 - RNA, 19 nt, Homo sapiens
ugaggcuucuuuccugaga

SEQ ID NO: 1238611 - RNA, 19 nt, Homo sapiens
ggagagugagggaaaugug

SEQ ID NO: 1238612 - RNA, 19 nt, Homo sapiens
ggcgccaccucaaaucuca

SEQ ID NO: 1238613 - RNA, 19 nt, Homo sapiens
cuaaagaagcacgcauuug

SEQ ID NO: 1238614 - RNA, 19 nt, Homo sapiens
cagcugugccaccuaaaga

SEQ ID NO: 1238615 - RNA, 19 nt, Homo sapiens
agaaguggagucugcugua

SEQ ID NO: 1238616 - RNA, 19 nt, Homo sapiens
aggagaaccugucauuagg

SEQ ID NO: 1238617 - RNA, 19 nt, Homo sapiens
ggccuggacuuaggaugga

SEQ ID NO: 1238618 - RNA, 19 nt, Homo sapiens
aaagaagcacgcauuugug

SEQ ID NO: 1238619 - RNA, 19 nt, Homo sapiens
gccaguuucucaucuucug

SEQ ID NO: 1238620 - RNA, 19 nt, Homo sapiens
gcagcagaaccuugcauag

SEQ ID NO: 1238621 - RNA, 19 nt, Homo sapiens
ugaggucaccauuucagaa

SEQ ID NO: 1238622 - RNA, 19 nt, Homo sapiens
cgucugcacuccggagaga

SEQ ID NO: 1238623 - RNA, 19 nt, Homo sapiens
gcguagggaggcuuucuga

SEQ ID NO: 1238624 - RNA, 19 nt, Homo sapiens
ucagaaagccaggagaagu

SEQ ID NO: 1238625 - RNA, 19 nt, Homo sapiens
ccaccucaaaucucacuug

SEQ ID NO: 1238626 - RNA, 19 nt, Homo sapiens
cuuacacgcuggccaccaa

SEQ ID NO: 1238627 - RNA, 19 nt, Homo sapiens
gcaaccugcgugggcauuu

SEQ ID NO: 1238628 - RNA, 19 nt, Homo sapiens
caguggagccaguuucuca

SEQ ID NO: 1238629 - RNA, 19 nt, Homo sapiens
acagaugccaccugaacuu

SEQ ID NO: 1238630 - RNA, 19 nt, Homo sapiens
auggugagcccuggacuua

SEQ ID NO: 1238631 - RNA, 19 nt, Homo sapiens
gcuggagagugagggaaau

SEQ ID NO: 1238632 - RNA, 19 nt, Homo sapiens
uuguugaggucaccauuuc

SEQ ID NO: 1238633 - RNA, 19 nt, Homo sapiens
guuguugaggucaccauuu

SEQ ID NO: 1238634 - RNA, 19 nt, Homo sapiens
cgccagggauguuguugag

SEQ ID NO: 1238635 - RNA, 19 nt, Homo sapiens
agacauccucgcuuuaaag

SEQ ID NO: 1238636 - RNA, 19 nt, Homo sapiens
ggcgccaucucaucucaca

SEQ ID NO: 1238637 - RNA, 19 nt, Homo sapiens
ccagcgagaccucaaagag

SEQ ID NO: 1238638 - RNA, 19 nt, Homo sapiens
gcacccagcgagaccucaa

SEQ ID NO: 1238639 - RNA, 19 nt, Homo sapiens
aggaggagaaccugucauu

SEQ ID NO: 1238640 - RNA, 19 nt, Homo sapiens
augggcaccugacagcuuu

SEQ ID NO: 1238641 - RNA, 19 nt, Homo sapiens
aaucucacuuggaggacaa

SEQ ID NO: 1238642 - RNA, 19 nt, Homo sapiens
ccugacagcuuugccuuuu

SEQ ID NO: 1238643 - RNA, 19 nt, Homo sapiens
ccagcucugaggcuucuuu

SEQ ID NO: 1238644 - RNA, 19 nt, Homo sapiens
uggacuagcuugguacaac

SEQ ID NO: 1238645 - RNA, 19 nt, Homo sapiens
uaacauagcucacaugaag

SEQ ID NO: 1238646 - RNA, 19 nt, Homo sapiens
gcuaugagauuaucaagaa

SEQ ID NO: 1238647 - RNA, 19 nt, Homo sapiens
gaacaugucaguaagauau

SEQ ID NO: 1238648 - RNA, 19 nt, Homo sapiens
ccaaacacauggauauaaa

SEQ ID NO: 1238649 - RNA, 19 nt, Homo sapiens
ggacaugaauacaucuaaa

SEQ ID NO: 1238650 - RNA, 19 nt, Homo sapiens
gaacagucauuaccgauuc

SEQ ID NO: 1238651 - RNA, 19 nt, Homo sapiens
gaaaccaacuacgauguaa

SEQ ID NO: 1238652 - RNA, 19 nt, Homo sapiens
gaguauaucucauucuuuc

SEQ ID NO: 1238653 - RNA, 19 nt, Homo sapiens
caaaggagcagcuguagaa

SEQ ID NO: 1238654 - RNA, 19 nt, Homo sapiens
caacuacgauguaaugcuu

SEQ ID NO: 1238655 - RNA, 19 nt, Homo sapiens
ucagguaaguguucuauga

SEQ ID NO: 1238656 - RNA, 19 nt, Homo sapiens
gagcagcuguagaaauaaa

SEQ ID NO: 1238657 - RNA, 19 nt, Homo sapiens
aggagcagcuguagaaaua

SEQ ID NO: 1238658 - RNA, 19 nt, Homo sapiens
gcacuacucuauagaugug

SEQ ID NO: 1238659 - RNA, 19 nt, Homo sapiens
uaaagagaaugcuaugaga

SEQ ID NO: 1238660 - RNA, 19 nt, Homo sapiens
ucaaagccuucguuaauug

SEQ ID NO: 1238661 - RNA, 19 nt, Homo sapiens
ggugauaauuacugaguuu

SEQ ID NO: 1238662 - RNA, 19 nt, Homo sapiens
uaucaagaauucaccauga

SEQ ID NO: 1238663 - RNA, 19 nt, Homo sapiens
gaaugaaugggaucuauga

SEQ ID NO: 1238664 - RNA, 19 nt, Homo sapiens
gggaagaguuuuauaguaa

SEQ ID NO: 1238665 - RNA, 19 nt, Homo sapiens
ggaaaccaacuacgaugua

SEQ ID NO: 1238666 - RNA, 19 nt, Homo sapiens
caacugcuauauucuuguu

SEQ ID NO: 1238667 - RNA, 19 nt, Homo sapiens
gcugagauauggcuaauac

SEQ ID NO: 1238668 - RNA, 19 nt, Homo sapiens
ggacuaacagacagaauga

SEQ ID NO: 1238669 - RNA, 19 nt, Homo sapiens
ugccaucacucaaccaaua

SEQ ID NO: 1238670 - RNA, 19 nt, Homo sapiens
agagaaugcuaugagauua

SEQ ID NO: 1238671 - RNA, 19 nt, Homo sapiens
gagaacaugucaguaagau

SEQ ID NO: 1238672 - RNA, 19 nt, Homo sapiens
gauaacauagcucacauga

SEQ ID NO: 1238673 - RNA, 19 nt, Homo sapiens
ggaaggcccacuacauuau

SEQ ID NO: 1238674 - RNA, 19 nt, Homo sapiens
uuacagauguugauuaggu

SEQ ID NO: 1238675 - RNA, 19 nt, Homo sapiens
guaaagcucuacacaaagc

SEQ ID NO: 1238676 - RNA, 19 nt, Homo sapiens
caaggugaacagauuauuu

SEQ ID NO: 1238677 - RNA, 19 nt, Homo sapiens
ccacauagaauuuggugaa

SEQ ID NO: 1238678 - RNA, 19 nt, Homo sapiens
ugaagaagcuacaggaaac

SEQ ID NO: 1238679 - RNA, 19 nt, Homo sapiens
gagcgaagcugugggaaac

SEQ ID NO: 1238680 - RNA, 19 nt, Homo sapiens
gauagggugacaugcaaua

SEQ ID NO: 1238681 - RNA, 19 nt, Homo sapiens
acaaggacaugaauacauc

SEQ ID NO: 1238682 - RNA, 19 nt, Homo sapiens
uaugacaagcgaagauuua

SEQ ID NO: 1238683 - RNA, 19 nt, Homo sapiens
gcuuauagacccugugauu

SEQ ID NO: 1238684 - RNA, 19 nt, Homo sapiens
ugugagagcuuuaucuaca

SEQ ID NO: 1238685 - RNA, 19 nt, Homo sapiens
gauaguacacuuaaagaag

SEQ ID NO: 1238686 - RNA, 19 nt, Homo sapiens
gauucaggauuacgacuau

SEQ ID NO: 1238687 - RNA, 19 nt, Homo sapiens
gaaaguaagaucagugaac

SEQ ID NO: 1238688 - RNA, 19 nt, Homo sapiens
ucagugaucucagaaaaua

SEQ ID NO: 1238689 - RNA, 19 nt, Homo sapiens
cagcuccacuuuccuaugu

SEQ ID NO: 1238690 - RNA, 19 nt, Homo sapiens
ggacagaacagaagaaaau

SEQ ID NO: 1238691 - RNA, 19 nt, Homo sapiens
auaaagagaugcuuguucu

SEQ ID NO: 1238692 - RNA, 19 nt, Homo sapiens
ucaguaagauauucaaggu

SEQ ID NO: 1238693 - RNA, 19 nt, Homo sapiens
ccacacaaaucagguaagu

SEQ ID NO: 1238694 - RNA, 19 nt, Homo sapiens
ggcaacugcuauauucuug

SEQ ID NO: 1238695 - RNA, 19 nt, Homo sapiens
guaaaccugccaaagcuuu

SEQ ID NO: 1238696 - RNA, 19 nt, Homo sapiens
auagagaacaugucaguaa

SEQ ID NO: 1238697 - RNA, 19 nt, Homo sapiens
gugcucacacuuagaauuu

SEQ ID NO: 1238698 - RNA, 19 nt, Homo sapiens
uagaaaaccugcauaacaa

SEQ ID NO: 1238699 - RNA, 19 nt, Homo sapiens
agagaugcuuguucugaaa

SEQ ID NO: 1238700 - RNA, 19 nt, Homo sapiens
guaaguguucuaugagauu

SEQ ID NO: 1238701 - RNA, 19 nt, Homo sapiens
ggaucuaugaagcuauuua

SEQ ID NO: 1238702 - RNA, 19 nt, Homo sapiens
guuggaggauugcacugua

SEQ ID NO: 1238703 - RNA, 19 nt, Homo sapiens
gaacauauugggauuuuga

SEQ ID NO: 1238704 - RNA, 19 nt, Homo sapiens
cagcacuacucuauagaug

SEQ ID NO: 1238705 - RNA, 19 nt, Homo sapiens
gaagaaaaggcuaauauca

SEQ ID NO: 1238706 - RNA, 19 nt, Homo sapiens
gagauauggcuaauacgaa

SEQ ID NO: 1238707 - RNA, 19 nt, Homo sapiens
uaggaaggcccacuacauu

SEQ ID NO: 1238708 - RNA, 19 nt, Homo sapiens
gguaaguguucuaugagau

SEQ ID NO: 1238709 - RNA, 19 nt, Homo sapiens
acauggauauaaagaggua

SEQ ID NO: 1238710 - RNA, 19 nt, Homo sapiens
gugauagggugacaugcaa

SEQ ID NO: 1238711 - RNA, 19 nt, Homo sapiens
acucaaagccuucguuaau

SEQ ID NO: 1238712 - RNA, 19 nt, Homo sapiens
gaaauucuuacagauguug

SEQ ID NO: 1238713 - RNA, 19 nt, Homo sapiens
cuacauagccagcaucagu

SEQ ID NO: 1238714 - RNA, 19 nt, Homo sapiens
agggugacaugcaauauga

SEQ ID NO: 1238715 - RNA, 19 nt, Homo sapiens
ugaauuuccucaaccauac

SEQ ID NO: 1238716 - RNA, 19 nt, Homo sapiens
gggaaaagcugagauaugg

SEQ ID NO: 1238717 - RNA, 19 nt, Homo sapiens
aaaccugcauaacaaauag

SEQ ID NO: 1238718 - RNA, 19 nt, Homo sapiens
ucacucaaagccuucguua

SEQ ID NO: 1238719 - RNA, 19 nt, Homo sapiens
ugacacaaggacaugaaua

SEQ ID NO: 1238720 - RNA, 19 nt, Homo sapiens
uguggcaacugcuauauuc

SEQ ID NO: 1238721 - RNA, 19 nt, Homo sapiens
cccaugaccucaccugguu

SEQ ID NO: 1238722 - RNA, 19 nt, Homo sapiens
ucaccaugaucaaccugua

SEQ ID NO: 1238723 - RNA, 19 nt, Homo sapiens
gagaaugcuaugagauuau

SEQ ID NO: 1238724 - RNA, 19 nt, Homo sapiens
aauuugaggugguccauau

SEQ ID NO: 1238725 - RNA, 19 nt, Homo sapiens
gcgaagcugugggaaacuu

SEQ ID NO: 1238726 - RNA, 19 nt, Homo sapiens
gaaugucuugccaggcuua

SEQ ID NO: 1238727 - RNA, 19 nt, Homo sapiens
aaagagaugcuuguucuga

SEQ ID NO: 1238728 - RNA, 19 nt, Homo sapiens
gaucaugagguugugagua

SEQ ID NO: 1238729 - RNA, 19 nt, Homo sapiens
gcuuugagaacagucauua

SEQ ID NO: 1238730 - RNA, 19 nt, Homo sapiens
cauauuuggugaucagcuu

SEQ ID NO: 1238731 - RNA, 19 nt, Homo sapiens
aagagaugcuuguucugaa

SEQ ID NO: 1238732 - RNA, 19 nt, Homo sapiens
ugaccuagcucugaauguc

SEQ ID NO: 1238733 - RNA, 19 nt, Homo sapiens
ggaaugaaugggaucuaug

SEQ ID NO: 1238734 - RNA, 19 nt, Homo sapiens
ccacagaagguguuaugga

SEQ ID NO: 1238735 - RNA, 19 nt, Homo sapiens
cauaccaaccuaacuuuga

SEQ ID NO: 1238736 - RNA, 19 nt, Homo sapiens
auacgaacauauugggauu

SEQ ID NO: 1238737 - RNA, 19 nt, Homo sapiens
gaaggcccacuacauuaug

SEQ ID NO: 1238738 - RNA, 19 nt, Homo sapiens
ggauucaggauuacgacua

SEQ ID NO: 1238739 - RNA, 19 nt, Homo sapiens
gaugcuuguucugaaagua

SEQ ID NO: 1238740 - RNA, 19 nt, Homo sapiens
caguaaaccacacaaauca

SEQ ID NO: 1238741 - RNA, 19 nt, Homo sapiens
gcgaucagcugcccaugac

SEQ ID NO: 1238742 - RNA, 19 nt, Homo sapiens
caagaauucaccaugauca

SEQ ID NO: 1238743 - RNA, 19 nt, Homo sapiens
cucaaagccuucguuaauu

SEQ ID NO: 1238744 - RNA, 19 nt, Homo sapiens
ggccaaaggagcagcugua

SEQ ID NO: 1238745 - RNA, 19 nt, Homo sapiens
ucaaagagauacaugcuua

SEQ ID NO: 1238746 - RNA, 19 nt, Homo sapiens
gaagugcuguaaugaauaa

SEQ ID NO: 1238747 - RNA, 19 nt, Homo sapiens
gaacuucaguggacaagaa

SEQ ID NO: 1238748 - RNA, 19 nt, Homo sapiens
guacagaaauccuugagaa

SEQ ID NO: 1238749 - RNA, 19 nt, Homo sapiens
cuacagcuaucaugauuua

SEQ ID NO: 1238750 - RNA, 19 nt, Homo sapiens
gaacaaguguaugcaguaa

SEQ ID NO: 1238751 - RNA, 19 nt, Homo sapiens
guacagaaguuuccugaau

SEQ ID NO: 1238752 - RNA, 19 nt, Homo sapiens
gauagucugugauccauuu

SEQ ID NO: 1238753 - RNA, 19 nt, Homo sapiens
ccacucagcucuuauugaa

SEQ ID NO: 1238754 - RNA, 19 nt, Homo sapiens
gaaguuuccugaauauaga

SEQ ID NO: 1238755 - RNA, 19 nt, Homo sapiens
gaaggugaauauagucaaa

SEQ ID NO: 1238756 - RNA, 19 nt, Homo sapiens
ggagaaagcuuuuaacaug

SEQ ID NO: 1238757 - RNA, 19 nt, Homo sapiens
ucaauggucccaagaauua

SEQ ID NO: 1238758 - RNA, 19 nt, Homo sapiens
ucacucauaucacagaaua

SEQ ID NO: 1238759 - RNA, 19 nt, Homo sapiens
aaagagaccaugacaguua

SEQ ID NO: 1238760 - RNA, 19 nt, Homo sapiens
ggacagguacuucguguaa

SEQ ID NO: 1238761 - RNA, 19 nt, Homo sapiens
gccacuaucugaagguuua

SEQ ID NO: 1238762 - RNA, 19 nt, Homo sapiens
gaguagagcugugguaaug

SEQ ID NO: 1238763 - RNA, 19 nt, Homo sapiens
gaaaggaaggugaauauag

SEQ ID NO: 1238764 - RNA, 19 nt, Homo sapiens
gaagagaaacccaguaaca

SEQ ID NO: 1238765 - RNA, 19 nt, Homo sapiens
ggaugucccugaagagaaa

SEQ ID NO: 1238766 - RNA, 19 nt, Homo sapiens
caaaagcuguucugaauuu

SEQ ID NO: 1238767 - RNA, 19 nt, Homo sapiens
gacaaccacucagcucuua

SEQ ID NO: 1238768 - RNA, 19 nt, Homo sapiens
ggaauccaaugcacaaaug

SEQ ID NO: 1238769 - RNA, 19 nt, Homo sapiens
gacaagcaguuuagaauca

SEQ ID NO: 1238770 - RNA, 19 nt, Homo sapiens
ggugacuucugaugucuua

SEQ ID NO: 1238771 - RNA, 19 nt, Homo sapiens
guacaccucuccugaugaa

SEQ ID NO: 1238772 - RNA, 19 nt, Homo sapiens
gagaaucaauuaccaccaa

SEQ ID NO: 1238773 - RNA, 19 nt, Homo sapiens
gcagagcaauuccaucuag

SEQ ID NO: 1238774 - RNA, 19 nt, Homo sapiens
gaacuggauugcaaaauuu

SEQ ID NO: 1238775 - RNA, 19 nt, Homo sapiens
gaaccagcauugucuaugg

SEQ ID NO: 1238776 - RNA, 19 nt, Homo sapiens
gauacaugcuuaacccaaa

SEQ ID NO: 1238777 - RNA, 19 nt, Homo sapiens
ggaaacagcuaagaaaauu

SEQ ID NO: 1238778 - RNA, 19 nt, Homo sapiens
ucaaguagcacauaagauu

SEQ ID NO: 1238779 - RNA, 19 nt, Homo sapiens
gguagaaguuggagauguu

SEQ ID NO: 1238780 - RNA, 19 nt, Homo sapiens
cagaaauccuugagaaaug

SEQ ID NO: 1238781 - RNA, 19 nt, Homo sapiens
uacagaaguuuccugaaua

SEQ ID NO: 1238782 - RNA, 19 nt, Homo sapiens
gagccaaguuaaacaagaa

SEQ ID NO: 1238783 - RNA, 19 nt, Homo sapiens
cagcucggauuuacauuaa

SEQ ID NO: 1238784 - RNA, 19 nt, Homo sapiens
aaccagugcucaaguauuu

SEQ ID NO: 1238785 - RNA, 19 nt, Homo sapiens
guucaaacccgaugaggua

SEQ ID NO: 1238786 - RNA, 19 nt, Homo sapiens
uagaaaguguccuaacauu

SEQ ID NO: 1238787 - RNA, 19 nt, Homo sapiens
gaccaugacaguuacauuu

SEQ ID NO: 1238788 - RNA, 19 nt, Homo sapiens
gggaauagaacaaguguau

SEQ ID NO: 1238789 - RNA, 19 nt, Homo sapiens
acagcaagcucaucaguau

SEQ ID NO: 1238790 - RNA, 19 nt, Homo sapiens
uaggugguauguacaguua

SEQ ID NO: 1238791 - RNA, 19 nt, Homo sapiens
uaucuggugugagcuauua

SEQ ID NO: 1238792 - RNA, 19 nt, Homo sapiens
ucacauaaaugaagcuaca

SEQ ID NO: 1238793 - RNA, 19 nt, Homo sapiens
aaaggaaggugaauauagu

SEQ ID NO: 1238794 - RNA, 19 nt, Homo sapiens
uuacaacucuggugacuuc

SEQ ID NO: 1238795 - RNA, 19 nt, Homo sapiens
gcugugguaucaguaaaua

SEQ ID NO: 1238796 - RNA, 19 nt, Homo sapiens
uuacacaacuacaggguuu

SEQ ID NO: 1238797 - RNA, 19 nt, Homo sapiens
gaagaccaguuugaugaga

SEQ ID NO: 1238798 - RNA, 19 nt, Homo sapiens
caacucuggugacuucuga

SEQ ID NO: 1238799 - RNA, 19 nt, Homo sapiens
ucaaacauccuucccauug

SEQ ID NO: 1238800 - RNA, 19 nt, Homo sapiens
cauuaagagucaaccauaa

SEQ ID NO: 1238801 - RNA, 19 nt, Homo sapiens
ggaagugcuguaaugaaua

SEQ ID NO: 1238802 - RNA, 19 nt, Homo sapiens
uaaggaaacagcuaagaaa

SEQ ID NO: 1238803 - RNA, 19 nt, Homo sapiens
agaugagaauugugcauua

SEQ ID NO: 1238804 - RNA, 19 nt, Homo sapiens
uaagugagacugaauuaga

SEQ ID NO: 1238805 - RNA, 19 nt, Homo sapiens
gugggaauauucucaaaga

SEQ ID NO: 1238806 - RNA, 19 nt, Homo sapiens
ccaaaggccuguguauugu

SEQ ID NO: 1238807 - RNA, 19 nt, Homo sapiens
ccacaguaauauagucuga

SEQ ID NO: 1238808 - RNA, 19 nt, Homo sapiens
guaauggagugucaguaug

SEQ ID NO: 1238809 - RNA, 19 nt, Homo sapiens
cagccacuuucuucuaaua

SEQ ID NO: 1238810 - RNA, 19 nt, Homo sapiens
gagaaacccaguaacagaa

SEQ ID NO: 1238811 - RNA, 19 nt, Homo sapiens
gcauggaacaaucuaauga

SEQ ID NO: 1238812 - RNA, 19 nt, Homo sapiens
aauaggaagugcuguaaug

SEQ ID NO: 1238813 - RNA, 19 nt, Homo sapiens
gcaguaaggaaacagcuaa

SEQ ID NO: 1238814 - RNA, 19 nt, Homo sapiens
ggaauggcacaagugauua

SEQ ID NO: 1238815 - RNA, 19 nt, Homo sapiens
ggaauugaauaugauguca

SEQ ID NO: 1238816 - RNA, 19 nt, Homo sapiens
gagacaagcaguuuagaau

SEQ ID NO: 1238817 - RNA, 19 nt, Homo sapiens
uaaacaagaacccaaagaa

SEQ ID NO: 1238818 - RNA, 19 nt, Homo sapiens
guaaggaaacagcuaagaa

SEQ ID NO: 1238819 - RNA, 19 nt, Homo sapiens
guucuuaggugguauguac

SEQ ID NO: 1238820 - RNA, 19 nt, Homo sapiens
aagaagaacuugguagaug

SEQ ID NO: 1238821 - RNA, 19 nt, Homo sapiens
guagagcugugguaaugga

SEQ ID NO: 1238822 - RNA, 19 nt, Homo sapiens
acagguacuucguguaauu

SEQ ID NO: 1238823 - RNA, 19 nt, Homo sapiens
cuugaggccuggaauuuaa

SEQ ID NO: 1238824 - RNA, 19 nt, Homo sapiens
gcauuacccucacguuuac

SEQ ID NO: 1238825 - RNA, 19 nt, Homo sapiens
uaccguggcuacuguguaa

SEQ ID NO: 1238826 - RNA, 19 nt, Homo sapiens
acagaaguuuccugaauau

SEQ ID NO: 1238827 - RNA, 19 nt, Homo sapiens
gaggauggauggagauaac

SEQ ID NO: 1238828 - RNA, 19 nt, Homo sapiens
gguagaugcuggugguguu

SEQ ID NO: 1238829 - RNA, 19 nt, Homo sapiens
uaaagaagaacuugguaga

SEQ ID NO: 1238830 - RNA, 19 nt, Homo sapiens
ucaaagagaccaugacagu

SEQ ID NO: 1238831 - RNA, 19 nt, Homo sapiens
gaauauagaguuccuacag

SEQ ID NO: 1238832 - RNA, 19 nt, Homo sapiens
gagacucccugccucacuu

SEQ ID NO: 1238833 - RNA, 19 nt, Homo sapiens
gguaauggagugucaguau

SEQ ID NO: 1238834 - RNA, 19 nt, Homo sapiens
gacaauaccagcaauuaca

SEQ ID NO: 1238835 - RNA, 19 nt, Homo sapiens
cagacaauaccagcaauua

SEQ ID NO: 1238836 - RNA, 19 nt, Homo sapiens
caaagaaccagcauugucu

SEQ ID NO: 1238837 - RNA, 19 nt, Homo sapiens
ggagaugugcagacuauuc

SEQ ID NO: 1238838 - RNA, 19 nt, Homo sapiens
ugagguaccugaaagacau

SEQ ID NO: 1238839 - RNA, 19 nt, Homo sapiens
gaauagaacaaguguaugc

SEQ ID NO: 1238840 - RNA, 19 nt, Homo sapiens
aggcagaacuggauugcaa

SEQ ID NO: 1238841 - RNA, 19 nt, Homo sapiens
guccaaggguacaaagauu

SEQ ID NO: 1238842 - RNA, 19 nt, Homo sapiens
gucauagccuucaaagaga

SEQ ID NO: 1238843 - RNA, 19 nt, Homo sapiens
ucaccaggagaaucaauua

SEQ ID NO: 1238844 - RNA, 19 nt, Homo sapiens
cccaaaggccuguguauug

SEQ ID NO: 1238845 - RNA, 19 nt, Homo sapiens
gaauuuaucugccuaauca

SEQ ID NO: 1238846 - RNA, 19 nt, Homo sapiens
gcaagcugaugacaacuua

SEQ ID NO: 1238847 - RNA, 19 nt, Homo sapiens
gaaauucaguuccauagug

SEQ ID NO: 1238848 - RNA, 19 nt, Homo sapiens
guaauuaccuuuagcacuu

SEQ ID NO: 1238849 - RNA, 19 nt, Homo sapiens
gauuguagcuaccgugaua

SEQ ID NO: 1238850 - RNA, 19 nt, Homo sapiens
gaagaacucggauuuauau

SEQ ID NO: 1238851 - RNA, 19 nt, Homo sapiens
gcaagaaagugcugaagau

SEQ ID NO: 1238852 - RNA, 19 nt, Homo sapiens
gagggaaucuuaauuguuc

SEQ ID NO: 1238853 - RNA, 19 nt, Homo sapiens
gaagauucaugcagugauu

SEQ ID NO: 1238854 - RNA, 19 nt, Homo sapiens
gcagaaaugaaauguguua

SEQ ID NO: 1238855 - RNA, 19 nt, Homo sapiens
ggaagggaaugcaagacua

SEQ ID NO: 1238856 - RNA, 19 nt, Homo sapiens
ugagguauguguuugguua

SEQ ID NO: 1238857 - RNA, 19 nt, Homo sapiens
ggagaaagguuuguuccaa

SEQ ID NO: 1238858 - RNA, 19 nt, Homo sapiens
caucaggacuuauuguuga

SEQ ID NO: 1238859 - RNA, 19 nt, Homo sapiens
caagggugcugguauagaa

SEQ ID NO: 1238860 - RNA, 19 nt, Homo sapiens
gaagaauucuaacauccaa

SEQ ID NO: 1238861 - RNA, 19 nt, Homo sapiens
cagcagaguuucuaaugaa

SEQ ID NO: 1238862 - RNA, 19 nt, Homo sapiens
gauauggccuaccagauga

SEQ ID NO: 1238863 - RNA, 19 nt, Homo sapiens
agacagcccuugcaauuga

SEQ ID NO: 1238864 - RNA, 19 nt, Homo sapiens
ggugaaaccuacaaucuuc

SEQ ID NO: 1238865 - RNA, 19 nt, Homo sapiens
guacagcauucuucuuaga

SEQ ID NO: 1238866 - RNA, 19 nt, Homo sapiens
ggagauguuuguugggauu

SEQ ID NO: 1238867 - RNA, 19 nt, Homo sapiens
cgauuaagauugcauuaug

SEQ ID NO: 1238868 - RNA, 19 nt, Homo sapiens
gaaccucgauuaagauugc

SEQ ID NO: 1238869 - RNA, 19 nt, Homo sapiens
acaugguucucucauauua

SEQ ID NO: 1238870 - RNA, 19 nt, Homo sapiens
gaagggauccucauuaagg

SEQ ID NO: 1238871 - RNA, 19 nt, Homo sapiens
ggaaggauauggccuacca

SEQ ID NO: 1238872 - RNA, 19 nt, Homo sapiens
agauauccauggugaauaa

SEQ ID NO: 1238873 - RNA, 19 nt, Homo sapiens
cagaugacauugugauaga

SEQ ID NO: 1238874 - RNA, 19 nt, Homo sapiens
ccauugaguuggaaggaua

SEQ ID NO: 1238875 - RNA, 19 nt, Homo sapiens
gcaauaggugucauaugua

SEQ ID NO: 1238876 - RNA, 19 nt, Homo sapiens
acacaugguucucucauau

SEQ ID NO: 1238877 - RNA, 19 nt, Homo sapiens
uaaugaagguuaugguguu

SEQ ID NO: 1238878 - RNA, 19 nt, Homo sapiens
guagagggaaucuuaauug

SEQ ID NO: 1238879 - RNA, 19 nt, Homo sapiens
gaagaaagagaaauucagu

SEQ ID NO: 1238880 - RNA, 19 nt, Homo sapiens
gaggagaguuacaggaaau

SEQ ID NO: 1238881 - RNA, 19 nt, Homo sapiens
caauugagcaugucagauu

SEQ ID NO: 1238882 - RNA, 19 nt, Homo sapiens
ccagacagcccuugcaauu

SEQ ID NO: 1238883 - RNA, 19 nt, Homo sapiens
ugauuuccauccuguauuu

SEQ ID NO: 1238884 - RNA, 19 nt, Homo sapiens
gaagauggaacugaagaaa

SEQ ID NO: 1238885 - RNA, 19 nt, Homo sapiens
ggauauggccuaccagaug

SEQ ID NO: 1238886 - RNA, 19 nt, Homo sapiens
aaacacucccucuuuauaa

SEQ ID NO: 1238887 - RNA, 19 nt, Homo sapiens
cgaguuccaucaggacuua

SEQ ID NO: 1238888 - RNA, 19 nt, Homo sapiens
aagcagaaaugaaaugugu

SEQ ID NO: 1238889 - RNA, 19 nt, Homo sapiens
ugcaauaggugucauaugu

SEQ ID NO: 1238890 - RNA, 19 nt, Homo sapiens
ugagugaaagguagauuua

SEQ ID NO: 1238891 - RNA, 19 nt, Homo sapiens
agaaagugcugaagaugga

SEQ ID NO: 1238892 - RNA, 19 nt, Homo sapiens
ugaagaacucggauuuaua

SEQ ID NO: 1238893 - RNA, 19 nt, Homo sapiens
gaaggugacacuguuauug

SEQ ID NO: 1238894 - RNA, 19 nt, Homo sapiens
aagaaucacugcugccauu

SEQ ID NO: 1238895 - RNA, 19 nt, Homo sapiens
cagaaaggccagauaaaga

SEQ ID NO: 1238896 - RNA, 19 nt, Homo sapiens
aagaagaggaggaugaaua

SEQ ID NO: 1238897 - RNA, 19 nt, Homo sapiens
uauuugggcuugagugaaa

SEQ ID NO: 1238898 - RNA, 19 nt, Homo sapiens
guaguuugcuguauugucu

SEQ ID NO: 1238899 - RNA, 19 nt, Homo sapiens
ggaauucacagcugaguuc

SEQ ID NO: 1238900 - RNA, 19 nt, Homo sapiens
ugaaagaguggaucuagaa

SEQ ID NO: 1238901 - RNA, 19 nt, Homo sapiens
gcccaggaguucaagacua

SEQ ID NO: 1238902 - RNA, 19 nt, Homo sapiens
aaucacugcugccauugua

SEQ ID NO: 1238903 - RNA, 19 nt, Homo sapiens
uaaugaagaacucggauuu

SEQ ID NO: 1238904 - RNA, 19 nt, Homo sapiens
acacagaaaggccagauaa

SEQ ID NO: 1238905 - RNA, 19 nt, Homo sapiens
ucagcagaguuucuaauga

SEQ ID NO: 1238906 - RNA, 19 nt, Homo sapiens
gauccauugucugcuauaa

SEQ ID NO: 1238907 - RNA, 19 nt, Homo sapiens
gucagaagaucacucaugu

SEQ ID NO: 1238908 - RNA, 19 nt, Homo sapiens
ccaauuacagugagucuga

SEQ ID NO: 1238909 - RNA, 19 nt, Homo sapiens
caauaggugucauauguac

SEQ ID NO: 1238910 - RNA, 19 nt, Homo sapiens
gaaaauauuuggagauugc

SEQ ID NO: 1238911 - RNA, 19 nt, Homo sapiens
gguucuaguuuacaaaguu

SEQ ID NO: 1238912 - RNA, 19 nt, Homo sapiens
aaauucaguuccauaguga

SEQ ID NO: 1238913 - RNA, 19 nt, Homo sapiens
gcaagucgagggaaauugu

SEQ ID NO: 1238914 - RNA, 19 nt, Homo sapiens
cgccaagggugcugguaua

SEQ ID NO: 1238915 - RNA, 19 nt, Homo sapiens
agaaagguuuguuccaaga

SEQ ID NO: 1238916 - RNA, 19 nt, Homo sapiens
gagcuaugcagucgucaaa

SEQ ID NO: 1238917 - RNA, 19 nt, Homo sapiens
aaagagaaauucaguucca

SEQ ID NO: 1238918 - RNA, 19 nt, Homo sapiens
ggagauggaacaguugaaa

SEQ ID NO: 1238919 - RNA, 19 nt, Homo sapiens
gcacaugcugcccuaagaa

SEQ ID NO: 1238920 - RNA, 19 nt, Homo sapiens
acagugauguaaguagaua

SEQ ID NO: 1238921 - RNA, 19 nt, Homo sapiens
agaaaggccagauaaagaa

SEQ ID NO: 1238922 - RNA, 19 nt, Homo sapiens
uguugaaccucgauuaaga

SEQ ID NO: 1238923 - RNA, 19 nt, Homo sapiens
cauuguaguuugcuguauu

SEQ ID NO: 1238924 - RNA, 19 nt, Homo sapiens
gcggacaucagcagaguuu

SEQ ID NO: 1238925 - RNA, 19 nt, Homo sapiens
ugucauauguacagcauuc

SEQ ID NO: 1238926 - RNA, 19 nt, Homo sapiens
gauguaaguagauagcaaa

SEQ ID NO: 1238927 - RNA, 19 nt, Homo sapiens
caaauuguaacucugauuc

SEQ ID NO: 1238928 - RNA, 19 nt, Homo sapiens
ugaggagaguuacaggaaa

SEQ ID NO: 1238929 - RNA, 19 nt, Homo sapiens
ggaguugggaugaagaaga

SEQ ID NO: 1238930 - RNA, 19 nt, Homo sapiens
aaacagcgauagacagcau

SEQ ID NO: 1238931 - RNA, 19 nt, Homo sapiens
gcacuucaaagacgaggaa

SEQ ID NO: 1238932 - RNA, 19 nt, Homo sapiens
ggaaugggaaagguaguuu

SEQ ID NO: 1238933 - RNA, 19 nt, Homo sapiens
caagauauccauggugaau

SEQ ID NO: 1238934 - RNA, 19 nt, Homo sapiens
uagagggaaucuuaauugu

SEQ ID NO: 1238935 - RNA, 19 nt, Homo sapiens
uauaaaugccugcuucgaa

SEQ ID NO: 1238936 - RNA, 19 nt, Homo sapiens
uccauugucugcuauaaau

SEQ ID NO: 1238937 - RNA, 19 nt, Homo sapiens
gagaaauucaguuccauag

SEQ ID NO: 1238938 - RNA, 19 nt, Homo sapiens
ugaggaagaaagagaaauu

SEQ ID NO: 1238939 - RNA, 19 nt, Homo sapiens
ggucagaagaucacucaug

SEQ ID NO: 1238940 - RNA, 19 nt, Homo sapiens
guuugaagcagaaaugaaa

SEQ ID NO: 1238941 - RNA, 19 nt, Homo sapiens
gaagggaaugcaagacuag

SEQ ID NO: 1238942 - RNA, 19 nt, Homo sapiens
ucagagccuaucaagauua

SEQ ID NO: 1238943 - RNA, 19 nt, Homo sapiens
ucucugaccugcaagaaag

SEQ ID NO: 1238944 - RNA, 19 nt, Homo sapiens
gaguugggaugaagaagag

SEQ ID NO: 1238945 - RNA, 19 nt, Homo sapiens
gaaagucacugcugaauaa

SEQ ID NO: 1238946 - RNA, 19 nt, Homo sapiens
uaacaaagcugaccugaaa

SEQ ID NO: 1238947 - RNA, 19 nt, Homo sapiens
gaaccagccucaaaccaua

SEQ ID NO: 1238948 - RNA, 19 nt, Homo sapiens
gagaaaggcuccuccaaga

SEQ ID NO: 1238949 - RNA, 19 nt, Homo sapiens
gaacagguuugaagagguu

SEQ ID NO: 1238950 - RNA, 19 nt, Homo sapiens
gaagcgagcuggcagaagu

SEQ ID NO: 1238951 - RNA, 19 nt, Homo sapiens
gaagagacaugagcugugu

SEQ ID NO: 1238952 - RNA, 19 nt, Homo sapiens
gguaagcacuaguccauga

SEQ ID NO: 1238953 - RNA, 19 nt, Homo sapiens
gaauaaagaccuuagaagu

SEQ ID NO: 1238954 - RNA, 19 nt, Homo sapiens
gcugucuacugaauaaaua

SEQ ID NO: 1238955 - RNA, 19 nt, Homo sapiens
gaaaagauccgaauuagug

SEQ ID NO: 1238956 - RNA, 19 nt, Homo sapiens
ggaaggguuugcauguuau

SEQ ID NO: 1238957 - RNA, 19 nt, Homo sapiens
aggaaggguuugcauguua

SEQ ID NO: 1238958 - RNA, 19 nt, Homo sapiens
uaaaugcaccuucucugua

SEQ ID NO: 1238959 - RNA, 19 nt, Homo sapiens
ccacguggaucuauuuaca

SEQ ID NO: 1238960 - RNA, 19 nt, Homo sapiens
gagaccauaucccagauug

SEQ ID NO: 1238961 - RNA, 19 nt, Homo sapiens
gaaaggcuccuccaagaag

SEQ ID NO: 1238962 - RNA, 19 nt, Homo sapiens
ucaauggccuguauaucuu

SEQ ID NO: 1238963 - RNA, 19 nt, Homo sapiens
gacuauugcuucccuaaug

SEQ ID NO: 1238964 - RNA, 19 nt, Homo sapiens
gcucugccuuccauucuaa

SEQ ID NO: 1238965 - RNA, 19 nt, Homo sapiens
guguggagauuacauuaaa

SEQ ID NO: 1238966 - RNA, 19 nt, Homo sapiens
guggaucuauuuacaaguu

SEQ ID NO: 1238967 - RNA, 19 nt, Homo sapiens
ggagagccaccucaucaaa

SEQ ID NO: 1238968 - RNA, 19 nt, Homo sapiens
agagaaagcugcuagaaaa

SEQ ID NO: 1238969 - RNA, 19 nt, Homo sapiens
gaacagggcaggcucacau

SEQ ID NO: 1238970 - RNA, 19 nt, Homo sapiens
gggacaucauggaauauuu

SEQ ID NO: 1238971 - RNA, 19 nt, Homo sapiens
gcaaguucaucaucuccuu

SEQ ID NO: 1238972 - RNA, 19 nt, Homo sapiens
gaacguccacuccuaaucu

SEQ ID NO: 1238973 - RNA, 19 nt, Homo sapiens
aaaugcaccuucucuguau

SEQ ID NO: 1238974 - RNA, 19 nt, Homo sapiens
gcaccacguggaucuauuu

SEQ ID NO: 1238975 - RNA, 19 nt, Homo sapiens
ugggaaaucuugcugucua

SEQ ID NO: 1238976 - RNA, 19 nt, Homo sapiens
uuugaaagguggaaacuau

SEQ ID NO: 1238977 - RNA, 19 nt, Homo sapiens
guagaaaagauccgaauua

SEQ ID NO: 1238978 - RNA, 19 nt, Homo sapiens
gcaccuggguuaugguaag

SEQ ID NO: 1238979 - RNA, 19 nt, Homo sapiens
ccuacaagcagcaagaaua

SEQ ID NO: 1238980 - RNA, 19 nt, Homo sapiens
uaaaggaacaaucagagaa

SEQ ID NO: 1238981 - RNA, 19 nt, Homo sapiens
acccaucgcuucuuuguug

SEQ ID NO: 1238982 - RNA, 19 nt, Homo sapiens
ugaaagucacugcugaaua

SEQ ID NO: 1238983 - RNA, 19 nt, Homo sapiens
uuagugagaugaagguuuc

SEQ ID NO: 1238984 - RNA, 19 nt, Homo sapiens
uggcagaagucucccuuga

SEQ ID NO: 1238985 - RNA, 19 nt, Homo sapiens
cagagaaagcugcuagaaa

SEQ ID NO: 1238986 - RNA, 19 nt, Homo sapiens
guauaucuuuggagacuuc

SEQ ID NO: 1238987 - RNA, 19 nt, Homo sapiens
gguuaugucuaucgugguu

SEQ ID NO: 1238988 - RNA, 19 nt, Homo sapiens
cauaauggcggacaacuuc

SEQ ID NO: 1238989 - RNA, 19 nt, Homo sapiens
acugggacaucauggaaua

SEQ ID NO: 1238990 - RNA, 19 nt, Homo sapiens
gcccaggguuugucugaga

SEQ ID NO: 1238991 - RNA, 19 nt, Homo sapiens
uggaaaugcucagaacaaa

SEQ ID NO: 1238992 - RNA, 19 nt, Homo sapiens
cagagagggucaucuugga

SEQ ID NO: 1238993 - RNA, 19 nt, Homo sapiens
aaaucuugcugucuacuga

SEQ ID NO: 1238994 - RNA, 19 nt, Homo sapiens
gcgagggccugguacaaag

SEQ ID NO: 1238995 - RNA, 19 nt, Homo sapiens
gauccgaauuagugagaug

SEQ ID NO: 1238996 - RNA, 19 nt, Homo sapiens
agucacugcugaauaaaga

SEQ ID NO: 1238997 - RNA, 19 nt, Homo sapiens
ggaucuauuuacaaguuug

SEQ ID NO: 1238998 - RNA, 19 nt, Homo sapiens
caucaucuccuuugcugaa

SEQ ID NO: 1238999 - RNA, 19 nt, Homo sapiens
cacuggagguuaugucuau

SEQ ID NO: 1239000 - RNA, 19 nt, Homo sapiens
cggcacccaucgcuucuuu

SEQ ID NO: 1239001 - RNA, 19 nt, Homo sapiens
ggagauuacauuaaagaca

SEQ ID NO: 1239002 - RNA, 19 nt, Homo sapiens
agagccaccucaucaaaug

SEQ ID NO: 1239003 - RNA, 19 nt, Homo sapiens
guggucgacuuauggcuuu

SEQ ID NO: 1239004 - RNA, 19 nt, Homo sapiens
caugaguggucgacuuaug

SEQ ID NO: 1239005 - RNA, 19 nt, Homo sapiens
cacaaucgcaaguucuaua

SEQ ID NO: 1239006 - RNA, 19 nt, Homo sapiens
aaaggaacaaucagagaaa

SEQ ID NO: 1239007 - RNA, 19 nt, Homo sapiens
gagagcaaaggaaggguuu

SEQ ID NO: 1239008 - RNA, 19 nt, Homo sapiens
guacugggacaucauggaa

SEQ ID NO: 1239009 - RNA, 19 nt, Homo sapiens
cauagcaaguucaucaucu

SEQ ID NO: 1239010 - RNA, 19 nt, Homo sapiens
ccauuucccugcugaccaa

SEQ ID NO: 1239011 - RNA, 19 nt, Homo sapiens
gagagccaccucaucaaau

SEQ ID NO: 1239012 - RNA, 19 nt, Homo sapiens
agaagucucccuugaccua

SEQ ID NO: 1239013 - RNA, 19 nt, Homo sapiens
ccaggcaagugcaaauaca

SEQ ID NO: 1239014 - RNA, 19 nt, Homo sapiens
ucacaaugccucuuuggau

SEQ ID NO: 1239015 - RNA, 19 nt, Homo sapiens
caaagaagaaagccagagu

SEQ ID NO: 1239016 - RNA, 19 nt, Homo sapiens
ggacaagaagaagguagaa

SEQ ID NO: 1239017 - RNA, 19 nt, Homo sapiens
gcacccaucgcuucuuugu

SEQ ID NO: 1239018 - RNA, 19 nt, Homo sapiens
cugagaacguccacuccua

SEQ ID NO: 1239019 - RNA, 19 nt, Homo sapiens
ugagaacguccacuccuaa

SEQ ID NO: 1239020 - RNA, 19 nt, Homo sapiens
ccagacgccucuccggaau

SEQ ID NO: 1239021 - RNA, 19 nt, Homo sapiens
caugagcuguguggagauu

SEQ ID NO: 1239022 - RNA, 19 nt, Homo sapiens
gaaagcugcuagaaaaucu

SEQ ID NO: 1239023 - RNA, 19 nt, Homo sapiens
ccaugagccugcuuggaau

SEQ ID NO: 1239024 - RNA, 19 nt, Homo sapiens
cuugcugucuacugaauaa

SEQ ID NO: 1239025 - RNA, 19 nt, Homo sapiens
gaagguuucucgggcugau

SEQ ID NO: 1239026 - RNA, 19 nt, Homo sapiens
aauaaagaccuuagaaguc

SEQ ID NO: 1239027 - RNA, 19 nt, Homo sapiens
aaaggaaggguuugcaugu

SEQ ID NO: 1239028 - RNA, 19 nt, Homo sapiens
gggcugauccuaacaaagc

SEQ ID NO: 1239029 - RNA, 19 nt, Homo sapiens
gaaaucuugcugucuacug

SEQ ID NO: 1239030 - RNA, 19 nt, Homo sapiens
uggaugauguucugccaau

SEQ ID NO: 1239031 - RNA, 19 nt, Homo sapiens
gaaaugcucagaacaaaag

SEQ ID NO: 1239032 - RNA, 19 nt, Homo sapiens
ggacaucauggaauauuuu

SEQ ID NO: 1239033 - RNA, 19 nt, Homo sapiens
gaggaacgacuaucucaac

SEQ ID NO: 1239034 - RNA, 19 nt, Homo sapiens
gaagccaaccugagcaaac

SEQ ID NO: 1239035 - RNA, 19 nt, Homo sapiens
aaaucucaauggccuguau

SEQ ID NO: 1239036 - RNA, 19 nt, Homo sapiens
ccuuuggccuguuuggaaa

SEQ ID NO: 1239037 - RNA, 19 nt, Homo sapiens
auucgugccuggacaagaa

SEQ ID NO: 1239038 - RNA, 19 nt, Homo sapiens
ggacuauugcuucccuaau

SEQ ID NO: 1239039 - RNA, 19 nt, Homo sapiens
uuacugcucugccuuccau

SEQ ID NO: 1239040 - RNA, 19 nt, Homo sapiens
gagccugcuuggaaucaca

SEQ ID NO: 1239041 - RNA, 19 nt, Homo sapiens
cuaaaggaacaaucagaga

SEQ ID NO: 1239042 - RNA, 19 nt, Homo sapiens
caaguucaucaucuccuuu

SEQ ID NO: 1239043 - RNA, 19 nt, Homo sapiens
cagcacccauagcaaguuc

SEQ ID NO: 1239044 - RNA, 19 nt, Homo sapiens
ggccagaacagguuugaag

SEQ ID NO: 1239045 - RNA, 19 nt, Homo sapiens
ggacauaccucccagauga

SEQ ID NO: 1239046 - RNA, 19 nt, Homo sapiens
ccaaggaucugguguuuga

SEQ ID NO: 1239047 - RNA, 19 nt, Homo sapiens
gcugaggacugaguugaua

SEQ ID NO: 1239048 - RNA, 19 nt, Homo sapiens
aauaaccgcuggaaaggaa

SEQ ID NO: 1239049 - RNA, 19 nt, Homo sapiens
ccagcucacuccagaagaa

SEQ ID NO: 1239050 - RNA, 19 nt, Homo sapiens
gggaauaaccgcuggaaag

SEQ ID NO: 1239051 - RNA, 19 nt, Homo sapiens
ggaagguccuaaguacaga

SEQ ID NO: 1239052 - RNA, 19 nt, Homo sapiens
gaagggugccugggacuug

SEQ ID NO: 1239053 - RNA, 19 nt, Homo sapiens
gugcugggcuccacauugg

SEQ ID NO: 1239054 - RNA, 19 nt, Homo sapiens
gcauggaggaugaggaaga

SEQ ID NO: 1239055 - RNA, 19 nt, Homo sapiens
gcacugcugaccauguuga

SEQ ID NO: 1239056 - RNA, 19 nt, Homo sapiens
caggguacaucugcuagaa

SEQ ID NO: 1239057 - RNA, 19 nt, Homo sapiens
cuuggucucuccuacagua

SEQ ID NO: 1239058 - RNA, 19 nt, Homo sapiens
gccuaaagcugugcuccaa

SEQ ID NO: 1239059 - RNA, 19 nt, Homo sapiens
gggaaucuucgucugcuuu

SEQ ID NO: 1239060 - RNA, 19 nt, Homo sapiens
ggucucuccuacaguaaga

SEQ ID NO: 1239061 - RNA, 19 nt, Homo sapiens
ggaauaaccgcuggaaagg

SEQ ID NO: 1239062 - RNA, 19 nt, Homo sapiens
gagcuccugcuucuacuga

SEQ ID NO: 1239063 - RNA, 19 nt, Homo sapiens
gaauaaccgcuggaaagga

SEQ ID NO: 1239064 - RNA, 19 nt, Homo sapiens
guugauaggagaccagcua

SEQ ID NO: 1239065 - RNA, 19 nt, Homo sapiens
caucugcacugcugaccau

SEQ ID NO: 1239066 - RNA, 19 nt, Homo sapiens
gcagagcaccgagcugugu

SEQ ID NO: 1239067 - RNA, 19 nt, Homo sapiens
guauggaccuguguaugca

SEQ ID NO: 1239068 - RNA, 19 nt, Homo sapiens
gaggcuugcuuggacaguu

SEQ ID NO: 1239069 - RNA, 19 nt, Homo sapiens
gcccaguucuaagcccaua

SEQ ID NO: 1239070 - RNA, 19 nt, Homo sapiens
ggauuaccgaggcuuagaa

SEQ ID NO: 1239071 - RNA, 19 nt, Homo sapiens
cauuggaacugcuggacau

SEQ ID NO: 1239072 - RNA, 19 nt, Homo sapiens
agccaaggaucugguguuu

SEQ ID NO: 1239073 - RNA, 19 nt, Homo sapiens
gcugagcuccugcuucuac

SEQ ID NO: 1239074 - RNA, 19 nt, Homo sapiens
cugcacugcugaccauguu

SEQ ID NO: 1239075 - RNA, 19 nt, Homo sapiens
ccagaagaacugagacaca

SEQ ID NO: 1239076 - RNA, 19 nt, Homo sapiens
cuuggagggucccauguau

SEQ ID NO: 1239077 - RNA, 19 nt, Homo sapiens
ccugauguguggaagaaag

SEQ ID NO: 1239078 - RNA, 19 nt, Homo sapiens
cccacaggguguugaguug

SEQ ID NO: 1239079 - RNA, 19 nt, Homo sapiens
agacaggguacaucugcua

SEQ ID NO: 1239080 - RNA, 19 nt, Homo sapiens
gaaucuucgucugcuuuca

SEQ ID NO: 1239081 - RNA, 19 nt, Homo sapiens
ggaaucuucgucugcuuuc

SEQ ID NO: 1239082 - RNA, 19 nt, Homo sapiens
gcccagcucaacaccguuu

SEQ ID NO: 1239083 - RNA, 19 nt, Homo sapiens
ucacugacacaggaaauca

SEQ ID NO: 1239084 - RNA, 19 nt, Homo sapiens
acugugggcuugcucaaag

SEQ ID NO: 1239085 - RNA, 19 nt, Homo sapiens
ucaggcaucagaacacuca

SEQ ID NO: 1239086 - RNA, 19 nt, Homo sapiens
ccaggcaagggcaaaguga

SEQ ID NO: 1239087 - RNA, 19 nt, Homo sapiens
cggcauggaggaugaggaa

SEQ ID NO: 1239088 - RNA, 19 nt, Homo sapiens
gcacugugagccuauugca

SEQ ID NO: 1239089 - RNA, 19 nt, Homo sapiens
ggaagggugccugggacuu

SEQ ID NO: 1239090 - RNA, 19 nt, Homo sapiens
cugcagcccuaggcacauu

SEQ ID NO: 1239091 - RNA, 19 nt, Homo sapiens
gcacauuucagggcacucu

SEQ ID NO: 1239092 - RNA, 19 nt, Homo sapiens
gggauuaccgaggcuuaga

SEQ ID NO: 1239093 - RNA, 19 nt, Homo sapiens
ggcccacguucuacucauc

SEQ ID NO: 1239094 - RNA, 19 nt, Homo sapiens
cauggaggaugaggaagag

SEQ ID NO: 1239095 - RNA, 19 nt, Homo sapiens
gcuuucagccacugugugu

SEQ ID NO: 1239096 - RNA, 19 nt, Homo sapiens
ggagauggcucuucugugu

SEQ ID NO: 1239097 - RNA, 19 nt, Homo sapiens
caaaggagauguuuagaca

SEQ ID NO: 1239098 - RNA, 19 nt, Homo sapiens
aaauagagcugcacaaaca

SEQ ID NO: 1239099 - RNA, 19 nt, Homo sapiens
ccacagcuguuuauucuug

SEQ ID NO: 1239100 - RNA, 19 nt, Homo sapiens
ugaacaauguggauaauga

SEQ ID NO: 1239101 - RNA, 19 nt, Homo sapiens
gcagagcuguguugaagga

SEQ ID NO: 1239102 - RNA, 19 nt, Homo sapiens
ucaagugccuuuaaauaga

SEQ ID NO: 1239103 - RNA, 19 nt, Homo sapiens
ugagaccaauccaguauuu

SEQ ID NO: 1239104 - RNA, 19 nt, Homo sapiens
ucaaucaagugccuuuaaa

SEQ ID NO: 1239105 - RNA, 19 nt, Homo sapiens
cagggagccuuuccagaua

SEQ ID NO: 1239106 - RNA, 19 nt, Homo sapiens
gagcuauacgcaauaauaa

SEQ ID NO: 1239107 - RNA, 19 nt, Homo sapiens
ucacugagcuauacgcaau

SEQ ID NO: 1239108 - RNA, 19 nt, Homo sapiens
gcaaacaacccaucucucu

SEQ ID NO: 1239109 - RNA, 19 nt, Homo sapiens
cugcuagcaugauuuguua

SEQ ID NO: 1239110 - RNA, 19 nt, Homo sapiens
aaucuuggcugcuguugaa

SEQ ID NO: 1239111 - RNA, 19 nt, Homo sapiens
acuguuaguuccuguauuu

SEQ ID NO: 1239112 - RNA, 19 nt, Homo sapiens
ugagcuauacgcaauaaua

SEQ ID NO: 1239113 - RNA, 19 nt, Homo sapiens
gcguagaucuugucacgau

SEQ ID NO: 1239114 - RNA, 19 nt, Homo sapiens
agauggcucuucuguguaa

SEQ ID NO: 1239115 - RNA, 19 nt, Homo sapiens
cacagacaauuaaaucuug

SEQ ID NO: 1239116 - RNA, 19 nt, Homo sapiens
aaacaacccaucucucuug

SEQ ID NO: 1239117 - RNA, 19 nt, Homo sapiens
gagaauccacacuucguuu

SEQ ID NO: 1239118 - RNA, 19 nt, Homo sapiens
ccaacucccucccacaaau

SEQ ID NO: 1239119 - RNA, 19 nt, Homo sapiens
gaucuugucacgauugaga

SEQ ID NO: 1239120 - RNA, 19 nt, Homo sapiens
caacauuuccucaaucaag

SEQ ID NO: 1239121 - RNA, 19 nt, Homo sapiens
uaagagaaauagggugaau

SEQ ID NO: 1239122 - RNA, 19 nt, Homo sapiens
gaaacccucaccgcuauuu

SEQ ID NO: 1239123 - RNA, 19 nt, Homo sapiens
cgauuuaggucgccagcuu

SEQ ID NO: 1239124 - RNA, 19 nt, Homo sapiens
caacugcuagcaugauuug

SEQ ID NO: 1239125 - RNA, 19 nt, Homo sapiens
caaacagauuggcggcaaa

SEQ ID NO: 1239126 - RNA, 19 nt, Homo sapiens
ccagggagccuuuccagau

SEQ ID NO: 1239127 - RNA, 19 nt, Homo sapiens
caagugccuuuaaauagag

SEQ ID NO: 1239128 - RNA, 19 nt, Homo sapiens
guuuagacaacccauauaa

SEQ ID NO: 1239129 - RNA, 19 nt, Homo sapiens
ggagaauccacacuucguu

SEQ ID NO: 1239130 - RNA, 19 nt, Homo sapiens
gagcugcacaaacagauug

SEQ ID NO: 1239131 - RNA, 19 nt, Homo sapiens
gcuguuuauucuuguuuga

SEQ ID NO: 1239132 - RNA, 19 nt, Homo sapiens
gcuauacgcaauaauaaag

SEQ ID NO: 1239133 - RNA, 19 nt, Homo sapiens
uuaaauagagcugcacaaa

SEQ ID NO: 1239134 - RNA, 19 nt, Homo sapiens
guagaucucugggcaugca

SEQ ID NO: 1239135 - RNA, 19 nt, Homo sapiens
aggaaacccucaccgcuau

SEQ ID NO: 1239136 - RNA, 19 nt, Homo sapiens
cguucuagcugccugaaga

SEQ ID NO: 1239137 - RNA, 19 nt, Homo sapiens
gcacuguuaguuccuguau

SEQ ID NO: 1239138 - RNA, 19 nt, Homo sapiens
ggaccuaggcgucucuaag

SEQ ID NO: 1239139 - RNA, 19 nt, Homo sapiens
gguacugucacuuauauuc

SEQ ID NO: 1239140 - RNA, 19 nt, Homo sapiens
gcugguacugucacuuaua

SEQ ID NO: 1239141 - RNA, 19 nt, Homo sapiens
gagauggcucuucugugua

SEQ ID NO: 1239142 - RNA, 19 nt, Homo sapiens
auaauaaagugcgugauuc

SEQ ID NO: 1239143 - RNA, 19 nt, Homo sapiens
gaccuaggcgucucuaagu

SEQ ID NO: 1239144 - RNA, 19 nt, Homo sapiens
acgcagagcuguguugaag

SEQ ID NO: 1239145 - RNA, 19 nt, Homo sapiens
caaacaacccaucucucuu

SEQ ID NO: 1239146 - RNA, 19 nt, Homo sapiens
aaaccagugucguguccuu

SEQ ID NO: 1239147 - RNA, 19 nt, Homo sapiens
gcacgcagagcuguguuga

SEQ ID NO: 1239148 - RNA, 19 nt, Homo sapiens
guagaucuugucacgauug

SEQ ID NO: 1239149 - RNA, 19 nt, Homo sapiens
cuuccauccugguuaaauu

SEQ ID NO: 1239150 - RNA, 19 nt, Homo sapiens
gacuguggguuucuugaca

SEQ ID NO: 1239151 - RNA, 19 nt, Homo sapiens
cugguacugucacuuauau

SEQ ID NO: 1239152 - RNA, 19 nt, Homo sapiens
ccuuauauuucacagacaa

SEQ ID NO: 1239153 - RNA, 19 nt, Homo sapiens
gcucuucuguguaaaucag

SEQ ID NO: 1239154 - RNA, 19 nt, Homo sapiens
guuagcgguuugcuggauu

SEQ ID NO: 1239155 - RNA, 19 nt, Homo sapiens
gagcuguguugaaggacau

SEQ ID NO: 1239156 - RNA, 19 nt, Homo sapiens
uuucagccuuguuugcuuu

SEQ ID NO: 1239157 - RNA, 19 nt, Homo sapiens
gcaaaagcguagaucuugu

SEQ ID NO: 1239158 - RNA, 19 nt, Homo sapiens
caucugaacaauguggaua

SEQ ID NO: 1239159 - RNA, 19 nt, Homo sapiens
acgauuagcugagugaucu

SEQ ID NO: 1239160 - RNA, 19 nt, Homo sapiens
gacaacccauauaaaauga

SEQ ID NO: 1239161 - RNA, 19 nt, Homo sapiens
aaggagauguuuagacaac

SEQ ID NO: 1239162 - RNA, 19 nt, Homo sapiens
ccacacuucguuucuucua

SEQ ID NO: 1239163 - RNA, 19 nt, Homo sapiens
uuccacagcuguuuauucu

SEQ ID NO: 1239164 - RNA, 19 nt, Homo sapiens
cauccugguuaaauucuca

SEQ ID NO: 1239165 - RNA, 19 nt, Homo sapiens
gauuuaggucgccagcuuu

SEQ ID NO: 1239166 - RNA, 19 nt, Homo sapiens
guccuuaccggcuuccuuu

SEQ ID NO: 1239167 - RNA, 19 nt, Homo sapiens
uagaucuugucacgauuga

SEQ ID NO: 1239168 - RNA, 19 nt, Homo sapiens
caaucaagugccuuuaaau

SEQ ID NO: 1239169 - RNA, 19 nt, Homo sapiens
gauacugcuucuccucucu

SEQ ID NO: 1239170 - RNA, 19 nt, Homo sapiens
gaacaauguggauaaugac

SEQ ID NO: 1239171 - RNA, 19 nt, Homo sapiens
gauguuuagacaacccaua

SEQ ID NO: 1239172 - RNA, 19 nt, Homo sapiens
agaccaauccaguauuuca

SEQ ID NO: 1239173 - RNA, 19 nt, Homo sapiens
caacucccucccacaaaug

SEQ ID NO: 1239174 - RNA, 19 nt, Homo sapiens
cagagcgggucgcacuguu

SEQ ID NO: 1239175 - RNA, 19 nt, Homo sapiens
gcacugggucugcaucaac

SEQ ID NO: 1239176 - RNA, 19 nt, Homo sapiens
uugcugguacugucacuua

SEQ ID NO: 1239177 - RNA, 19 nt, Homo sapiens
ugaaaacgauuagaacuag

SEQ ID NO: 1239178 - RNA, 19 nt, Homo sapiens
agagaaauagggugaauac

SEQ ID NO: 1239179 - RNA, 19 nt, Homo sapiens
ugcguucggucaccucgua

SEQ ID NO: 1239180 - RNA, 19 nt, Homo sapiens
uuagcgguuugcuggauuu

SEQ ID NO: 1239181 - RNA, 19 nt, Homo sapiens
gguccagccuaaauguuac

SEQ ID NO: 1239182 - RNA, 19 nt, Homo sapiens
acugagcuauacgcaauaa

SEQ ID NO: 1239183 - RNA, 19 nt, Homo sapiens
uaaauagagcugcacaaac

SEQ ID NO: 1239184 - RNA, 19 nt, Homo sapiens
ggaaacccucaccgcuauu

SEQ ID NO: 1239185 - RNA, 19 nt, Homo sapiens
gucgccagcuuuccaguca

SEQ ID NO: 1239186 - RNA, 19 nt, Homo sapiens
caguauuucagccuuguuu

SEQ ID NO: 1239187 - RNA, 19 nt, Homo sapiens
ucucugggcaugcauaugu

SEQ ID NO: 1239188 - RNA, 19 nt, Homo sapiens
uuucuuccguuccguucua

SEQ ID NO: 1239189 - RNA, 19 nt, Homo sapiens
gagcgggucgcacuguuag

SEQ ID NO: 1239190 - RNA, 19 nt, Homo sapiens
ggugggcaggcuagaguaa

SEQ ID NO: 1239191 - RNA, 19 nt, Homo sapiens
caacuugcgcuggcucaga

SEQ ID NO: 1239192 - RNA, 19 nt, Homo sapiens
caccuucccucucucuucu

SEQ ID NO: 1239193 - RNA, 19 nt, Homo sapiens
guacugucacuuauauucu

SEQ ID NO: 1239194 - RNA, 19 nt, Homo sapiens
gcauugaacaaaggagaug

SEQ ID NO: 1239195 - RNA, 19 nt, Homo sapiens
agguccagccuaaauguua

SEQ ID NO: 1239196 - RNA, 19 nt, Homo sapiens
ggaaggagcuggagaaaua

SEQ ID NO: 1239197 - RNA, 19 nt, Homo sapiens
caucagauaugcaaacuua

SEQ ID NO: 1239198 - RNA, 19 nt, Homo sapiens
ggauuuaccucugacauua

SEQ ID NO: 1239199 - RNA, 19 nt, Homo sapiens
uaagguaacucuaacagua

SEQ ID NO: 1239200 - RNA, 19 nt, Homo sapiens
gauguguucugaugucuua

SEQ ID NO: 1239201 - RNA, 19 nt, Homo sapiens
ugaaaaggcugaaguaaua

SEQ ID NO: 1239202 - RNA, 19 nt, Homo sapiens
ugaagacccuacaauauaa

SEQ ID NO: 1239203 - RNA, 19 nt, Homo sapiens
ggaguuacuuccuucuuaa

SEQ ID NO: 1239204 - RNA, 19 nt, Homo sapiens
gaguacagcuucaauuuca

SEQ ID NO: 1239205 - RNA, 19 nt, Homo sapiens
cacaagaggucacguacua

SEQ ID NO: 1239206 - RNA, 19 nt, Homo sapiens
ggaagcagcugguccucaa

SEQ ID NO: 1239207 - RNA, 19 nt, Homo sapiens
ccauuuaccuacuuucuuu

SEQ ID NO: 1239208 - RNA, 19 nt, Homo sapiens
gggcugagcugauggacaa

SEQ ID NO: 1239209 - RNA, 19 nt, Homo sapiens
cucaagaucuuaaggauaa

SEQ ID NO: 1239210 - RNA, 19 nt, Homo sapiens
gcacacacgugaggagauu

SEQ ID NO: 1239211 - RNA, 19 nt, Homo sapiens
ggauucaccuggaaauaga

SEQ ID NO: 1239212 - RNA, 19 nt, Homo sapiens
uuaaagauguguucugaug

SEQ ID NO: 1239213 - RNA, 19 nt, Homo sapiens
gaggucacguacuauuaua

SEQ ID NO: 1239214 - RNA, 19 nt, Homo sapiens
agaaauaccugcacacagu

SEQ ID NO: 1239215 - RNA, 19 nt, Homo sapiens
gaucugagcacucugaaug

SEQ ID NO: 1239216 - RNA, 19 nt, Homo sapiens
guacuggauuuaccucuga

SEQ ID NO: 1239217 - RNA, 19 nt, Homo sapiens
gaagugggcuaucaaaucc

SEQ ID NO: 1239218 - RNA, 19 nt, Homo sapiens
gaggaacugcaacuauuua

SEQ ID NO: 1239219 - RNA, 19 nt, Homo sapiens
ucaagaaggucaagauugg

SEQ ID NO: 1239220 - RNA, 19 nt, Homo sapiens
uggaguuacuuccuucuua

SEQ ID NO: 1239221 - RNA, 19 nt, Homo sapiens
ggacccaguucuuugaaau

SEQ ID NO: 1239222 - RNA, 19 nt, Homo sapiens
uccaggcgauccagaauua

SEQ ID NO: 1239223 - RNA, 19 nt, Homo sapiens
ggaggaacugcaacuauuu

SEQ ID NO: 1239224 - RNA, 19 nt, Homo sapiens
gagagcagacggccgauuu

SEQ ID NO: 1239225 - RNA, 19 nt, Homo sapiens
agucuucgguccaguguua

SEQ ID NO: 1239226 - RNA, 19 nt, Homo sapiens
gaaugaagauccugaaacc

SEQ ID NO: 1239227 - RNA, 19 nt, Homo sapiens
gcugagggcugacauaagg

SEQ ID NO: 1239228 - RNA, 19 nt, Homo sapiens
cgagaguccuugccuauca

SEQ ID NO: 1239229 - RNA, 19 nt, Homo sapiens
guucacauuucaucugauu

SEQ ID NO: 1239230 - RNA, 19 nt, Homo sapiens
guaauucagucccuaagca

SEQ ID NO: 1239231 - RNA, 19 nt, Homo sapiens
aaaccuuucuguucacauu

SEQ ID NO: 1239232 - RNA, 19 nt, Homo sapiens
gcuagucuauguucuguca

SEQ ID NO: 1239233 - RNA, 19 nt, Homo sapiens
gaggagauuuaagguacua

SEQ ID NO: 1239234 - RNA, 19 nt, Homo sapiens
cauuaugccucaccaauag

SEQ ID NO: 1239235 - RNA, 19 nt, Homo sapiens
ugaaugaagugggcuauca

SEQ ID NO: 1239236 - RNA, 19 nt, Homo sapiens
caugaagacccuacaauau

SEQ ID NO: 1239237 - RNA, 19 nt, Homo sapiens
ggcaauacaagaaccauuu

SEQ ID NO: 1239238 - RNA, 19 nt, Homo sapiens
gguacuauaugcaaguguu

SEQ ID NO: 1239239 - RNA, 19 nt, Homo sapiens
gcagagaccaggagugauc

SEQ ID NO: 1239240 - RNA, 19 nt, Homo sapiens
gauuuaagguacuauaugc

SEQ ID NO: 1239241 - RNA, 19 nt, Homo sapiens
gaccucaucuuugacuuug

SEQ ID NO: 1239242 - RNA, 19 nt, Homo sapiens
ccacacaggacaacccuaa

SEQ ID NO: 1239243 - RNA, 19 nt, Homo sapiens
gagaaugggacauggaaug

SEQ ID NO: 1239244 - RNA, 19 nt, Homo sapiens
ggagauuuaagguacuaua

SEQ ID NO: 1239245 - RNA, 19 nt, Homo sapiens
uagcaacaaugccaacuca

SEQ ID NO: 1239246 - RNA, 19 nt, Homo sapiens
cuaacagccuagucuugua

SEQ ID NO: 1239247 - RNA, 19 nt, Homo sapiens
caagaggucacguacuauu

SEQ ID NO: 1239248 - RNA, 19 nt, Homo sapiens
uugagaagcuagucuaugu

SEQ ID NO: 1239249 - RNA, 19 nt, Homo sapiens
aaaccuacuucucaggaaa

SEQ ID NO: 1239250 - RNA, 19 nt, Homo sapiens
augaagacccuacaauaua

SEQ ID NO: 1239251 - RNA, 19 nt, Homo sapiens
ugaaggaugccaagaauca

SEQ ID NO: 1239252 - RNA, 19 nt, Homo sapiens
acaugaagacccuacaaua

SEQ ID NO: 1239253 - RNA, 19 nt, Homo sapiens
ugaaauucuucuggcaaua

SEQ ID NO: 1239254 - RNA, 19 nt, Homo sapiens
aggaggaacugcaacuauu

SEQ ID NO: 1239255 - RNA, 19 nt, Homo sapiens
aaacuacuuucaccacguu

SEQ ID NO: 1239256 - RNA, 19 nt, Homo sapiens
caagaguacagcuucaauu

SEQ ID NO: 1239257 - RNA, 19 nt, Homo sapiens
cagcaggucuucagaacca

SEQ ID NO: 1239258 - RNA, 19 nt, Homo sapiens
gguaaccauuagcuuuaaa

SEQ ID NO: 1239259 - RNA, 19 nt, Homo sapiens
ggaacugcaacuauuuauu

SEQ ID NO: 1239260 - RNA, 19 nt, Homo sapiens
gauccagaauuacaugaag

SEQ ID NO: 1239261 - RNA, 19 nt, Homo sapiens
acccaguucuuugaaauua

SEQ ID NO: 1239262 - RNA, 19 nt, Homo sapiens
gugcaucuccucuggcuuu

SEQ ID NO: 1239263 - RNA, 19 nt, Homo sapiens
gcagacggccgauuucagu

SEQ ID NO: 1239264 - RNA, 19 nt, Homo sapiens
gguaccauuucaugacauu

SEQ ID NO: 1239265 - RNA, 19 nt, Homo sapiens
guacagcuucaauuucauu

SEQ ID NO: 1239266 - RNA, 19 nt, Homo sapiens
gagaagcuagucuauguuc

SEQ ID NO: 1239267 - RNA, 19 nt, Homo sapiens
gaaucugagugggugguaa

SEQ ID NO: 1239268 - RNA, 19 nt, Homo sapiens
gagaaugaagauccugaaa

SEQ ID NO: 1239269 - RNA, 19 nt, Homo sapiens
gagaguccuugccuaucaa

SEQ ID NO: 1239270 - RNA, 19 nt, Homo sapiens
aagaguacagcuucaauuu

SEQ ID NO: 1239271 - RNA, 19 nt, Homo sapiens
ggauaaccguaacugaagu

SEQ ID NO: 1239272 - RNA, 19 nt, Homo sapiens
ccagggacaugagaaugaa

SEQ ID NO: 1239273 - RNA, 19 nt, Homo sapiens
gaaauaugccagggacaug

SEQ ID NO: 1239274 - RNA, 19 nt, Homo sapiens
guaaauaucaagaguacag

SEQ ID NO: 1239275 - RNA, 19 nt, Homo sapiens
gugauuaucuuccaguacu

SEQ ID NO: 1239276 - RNA, 19 nt, Homo sapiens
aaagauguguucugauguc

SEQ ID NO: 1239277 - RNA, 19 nt, Homo sapiens
uguuaaagauguguucuga

SEQ ID NO: 1239278 - RNA, 19 nt, Homo sapiens
agggaggacucacuguuaa

SEQ ID NO: 1239279 - RNA, 19 nt, Homo sapiens
gaucagcaggucuucagaa

SEQ ID NO: 1239280 - RNA, 19 nt, Homo sapiens
guucugucacuaacauuua

SEQ ID NO: 1239281 - RNA, 19 nt, Homo sapiens
uuaaagcauucacugaugu

SEQ ID NO: 1239282 - RNA, 19 nt, Homo sapiens
ggaaacagcaaaagaaaug

SEQ ID NO: 1239283 - RNA, 19 nt, Homo sapiens
cugaagguguuuauaggaa

SEQ ID NO: 1239284 - RNA, 19 nt, Homo sapiens
uggccaaggugcacccuaa

SEQ ID NO: 1239285 - RNA, 19 nt, Homo sapiens
ugacugaagguguuuauag

SEQ ID NO: 1239286 - RNA, 19 nt, Homo sapiens
cagaggaggaggacaaaga

SEQ ID NO: 1239287 - RNA, 19 nt, Homo sapiens
guguaaauaucaagaguac

SEQ ID NO: 1239288 - RNA, 19 nt, Homo sapiens
gaggcaggcuuugauucuu

SEQ ID NO: 1239289 - RNA, 19 nt, Homo sapiens
gaagcuagucuauguucug

SEQ ID NO: 1239290 - RNA, 19 nt, Homo sapiens
cuuaaagcauucacugaug

SEQ ID NO: 1239291 - RNA, 19 nt, Homo sapiens
gaauuuagccaagccauac

SEQ ID NO: 1239292 - RNA, 19 nt, Homo sapiens
ugaagugggcuaucaaauc

SEQ ID NO: 1239293 - RNA, 19 nt, Homo sapiens
uaaggaaggagcuggagaa

SEQ ID NO: 1239294 - RNA, 19 nt, Homo sapiens
gggacccaguucuuugaaa

SEQ ID NO: 1239295 - RNA, 19 nt, Homo sapiens
cugaguggguuaauggaaa

SEQ ID NO: 1239296 - RNA, 19 nt, Homo sapiens
gaccaaagcuaacuuguuu

SEQ ID NO: 1239297 - RNA, 19 nt, Homo sapiens
gauccaauuucuccauuua

SEQ ID NO: 1239298 - RNA, 19 nt, Homo sapiens
gaaagccugugcugaaguu

SEQ ID NO: 1239299 - RNA, 19 nt, Homo sapiens
ccaaagaggugaguagaga

SEQ ID NO: 1239300 - RNA, 19 nt, Homo sapiens
ugaacagcauccaaacuua

SEQ ID NO: 1239301 - RNA, 19 nt, Homo sapiens
ggccaaaccuggugacaga

SEQ ID NO: 1239302 - RNA, 19 nt, Homo sapiens
guagaacgaucagacaauu

SEQ ID NO: 1239303 - RNA, 19 nt, Homo sapiens
cugagaagcugguagaauu

SEQ ID NO: 1239304 - RNA, 19 nt, Homo sapiens
gguagaauuuccauugcua

SEQ ID NO: 1239305 - RNA, 19 nt, Homo sapiens
gaaaguggcauucucaaag

SEQ ID NO: 1239306 - RNA, 19 nt, Homo sapiens
ggaugcaucuuuccucuuc

SEQ ID NO: 1239307 - RNA, 19 nt, Homo sapiens
gauugugguuucagaauga

SEQ ID NO: 1239308 - RNA, 19 nt, Homo sapiens
gcaagauugugguuucaga

SEQ ID NO: 1239309 - RNA, 19 nt, Homo sapiens
acagaaggcugauggaguu

SEQ ID NO: 1239310 - RNA, 19 nt, Homo sapiens
gaccaaccauggccaaguu

SEQ ID NO: 1239311 - RNA, 19 nt, Homo sapiens
ggcagaagcucaagcaaca

SEQ ID NO: 1239312 - RNA, 19 nt, Homo sapiens
gaacagcauccaaacuuau

SEQ ID NO: 1239313 - RNA, 19 nt, Homo sapiens
caacugaacagcauccaaa

SEQ ID NO: 1239314 - RNA, 19 nt, Homo sapiens
ccaagagucuggaacugaa

SEQ ID NO: 1239315 - RNA, 19 nt, Homo sapiens
guaauuaucagcaggaaau

SEQ ID NO: 1239316 - RNA, 19 nt, Homo sapiens
gauguugaaauacggauua

SEQ ID NO: 1239317 - RNA, 19 nt, Homo sapiens
ucucaaagcucacaguaca

SEQ ID NO: 1239318 - RNA, 19 nt, Homo sapiens
gaaauacuacagcuagaga

SEQ ID NO: 1239319 - RNA, 19 nt, Homo sapiens
gaaauauugaccucugaaa

SEQ ID NO: 1239320 - RNA, 19 nt, Homo sapiens
ggaccaaagcuaacuuguu

SEQ ID NO: 1239321 - RNA, 19 nt, Homo sapiens
ggcaggagcucccaccaau

SEQ ID NO: 1239322 - RNA, 19 nt, Homo sapiens
caguucagcuagccaaauu

SEQ ID NO: 1239323 - RNA, 19 nt, Homo sapiens
cauccaaacuuaugugaag

SEQ ID NO: 1239324 - RNA, 19 nt, Homo sapiens
ggauccaauuucuccauuu

SEQ ID NO: 1239325 - RNA, 19 nt, Homo sapiens
gcauaaugaugauaaacuc

SEQ ID NO: 1239326 - RNA, 19 nt, Homo sapiens
ccagaaauccuaugaagca

SEQ ID NO: 1239327 - RNA, 19 nt, Homo sapiens
aaagcuaacuuguuugucu

SEQ ID NO: 1239328 - RNA, 19 nt, Homo sapiens
gugacagaauuguggauuu

SEQ ID NO: 1239329 - RNA, 19 nt, Homo sapiens
gguaacaaaucaggccaaa

SEQ ID NO: 1239330 - RNA, 19 nt, Homo sapiens
ucagguaaagccagaauaa

SEQ ID NO: 1239331 - RNA, 19 nt, Homo sapiens
uaacuuguuugucuuacug

SEQ ID NO: 1239332 - RNA, 19 nt, Homo sapiens
caaaccuggugacagaauu

SEQ ID NO: 1239333 - RNA, 19 nt, Homo sapiens
ugacagaauuguggauuuc

SEQ ID NO: 1239334 - RNA, 19 nt, Homo sapiens
caacuauaccuguagaaau

SEQ ID NO: 1239335 - RNA, 19 nt, Homo sapiens
gaacucaccaucccuuugg

SEQ ID NO: 1239336 - RNA, 19 nt, Homo sapiens
gcacaggcauugucuuuuc

SEQ ID NO: 1239337 - RNA, 19 nt, Homo sapiens
ucacccaagucaaauaugu

SEQ ID NO: 1239338 - RNA, 19 nt, Homo sapiens
acuaagagaugaccugauc

SEQ ID NO: 1239339 - RNA, 19 nt, Homo sapiens
acagaaggaugcaucuuuc

SEQ ID NO: 1239340 - RNA, 19 nt, Homo sapiens
ucagggccauguuggaauu

SEQ ID NO: 1239341 - RNA, 19 nt, Homo sapiens
gaauuguccuugcucacau

SEQ ID NO: 1239342 - RNA, 19 nt, Homo sapiens
gaaaagggcauugaaguga

SEQ ID NO: 1239343 - RNA, 19 nt, Homo sapiens
gggauccaauuucuccauu

SEQ ID NO: 1239344 - RNA, 19 nt, Homo sapiens
gcugguagaauuuccauug

SEQ ID NO: 1239345 - RNA, 19 nt, Homo sapiens
ugagacacauaauccagaa

SEQ ID NO: 1239346 - RNA, 19 nt, Homo sapiens
gcaggagcucccaccaaua

SEQ ID NO: 1239347 - RNA, 19 nt, Homo sapiens
aaagaggugaguagagaua

SEQ ID NO: 1239348 - RNA, 19 nt, Homo sapiens
cuacuuggacucuugauug

SEQ ID NO: 1239349 - RNA, 19 nt, Homo sapiens
gagcauguguuugcagaag

SEQ ID NO: 1239350 - RNA, 19 nt, Homo sapiens
gcgaguauuuuccacauaa

SEQ ID NO: 1239351 - RNA, 19 nt, Homo sapiens
ggaaauauugaccucugaa

SEQ ID NO: 1239352 - RNA, 19 nt, Homo sapiens
ugaggaagcagcaacaguu

SEQ ID NO: 1239353 - RNA, 19 nt, Homo sapiens
aacagcagcuucuaagugu

SEQ ID NO: 1239354 - RNA, 19 nt, Homo sapiens
gcgaccaggugacccaaug

SEQ ID NO: 1239355 - RNA, 19 nt, Homo sapiens
aaacagcagcuucuaagug

SEQ ID NO: 1239356 - RNA, 19 nt, Homo sapiens
caucuuuccucuucauaca

SEQ ID NO: 1239357 - RNA, 19 nt, Homo sapiens
ggaauuguccuugcucaca

SEQ ID NO: 1239358 - RNA, 19 nt, Homo sapiens
ggacuuuucucaccaaaca

SEQ ID NO: 1239359 - RNA, 19 nt, Homo sapiens
gaacuucugggcuuuaaaa

SEQ ID NO: 1239360 - RNA, 19 nt, Homo sapiens
gcuuaguugucaccaaaga

SEQ ID NO: 1239361 - RNA, 19 nt, Homo sapiens
aaagccagaauaagagaua

SEQ ID NO: 1239362 - RNA, 19 nt, Homo sapiens
caccaucccuuuggcuauu

SEQ ID NO: 1239363 - RNA, 19 nt, Homo sapiens
gcuguuguauugagacaca

SEQ ID NO: 1239364 - RNA, 19 nt, Homo sapiens
ugaagucccagguguagaa

SEQ ID NO: 1239365 - RNA, 19 nt, Homo sapiens
uagaaauacuacagcuaga

SEQ ID NO: 1239366 - RNA, 19 nt, Homo sapiens
aggacuugcuguuguauug

SEQ ID NO: 1239367 - RNA, 19 nt, Homo sapiens
guaaagccagaauaagaga

SEQ ID NO: 1239368 - RNA, 19 nt, Homo sapiens
gcauugaagugauguuuuc

SEQ ID NO: 1239369 - RNA, 19 nt, Homo sapiens
ugagaagcugguagaauuu

SEQ ID NO: 1239370 - RNA, 19 nt, Homo sapiens
uggcagauauugugcucuu

SEQ ID NO: 1239371 - RNA, 19 nt, Homo sapiens
ugaaaguggcauucucaaa

SEQ ID NO: 1239372 - RNA, 19 nt, Homo sapiens
gaacugaaaguggcauucu

SEQ ID NO: 1239373 - RNA, 19 nt, Homo sapiens
gagugcauaaugaugauaa

SEQ ID NO: 1239374 - RNA, 19 nt, Homo sapiens
ggcauugucuuuucuuuga

SEQ ID NO: 1239375 - RNA, 19 nt, Homo sapiens
gguaaagccagaauaagag

SEQ ID NO: 1239376 - RNA, 19 nt, Homo sapiens
caaccuugucuauguggua

SEQ ID NO: 1239377 - RNA, 19 nt, Homo sapiens
gguaaaauguccagugauc

SEQ ID NO: 1239378 - RNA, 19 nt, Homo sapiens
aaagggcauugaagugaug

SEQ ID NO: 1239379 - RNA, 19 nt, Homo sapiens
ggaagugccaggaguaaaa

SEQ ID NO: 1239380 - RNA, 19 nt, Homo sapiens
uauccaucauuucuuggua

SEQ ID NO: 1239381 - RNA, 19 nt, Homo sapiens
gaagaaccagcuacuacca

SEQ ID NO: 1239382 - RNA, 19 nt, Homo sapiens
uugcuuaguugucaccaaa

SEQ ID NO: 1239383 - RNA, 19 nt, Homo sapiens
caggugacccaaugaaaga

SEQ ID NO: 1239384 - RNA, 19 nt, Homo sapiens
cuuuggcuauugagaauuu

SEQ ID NO: 1239385 - RNA, 19 nt, Homo sapiens
cuguuugccugcaguagua

SEQ ID NO: 1239386 - RNA, 19 nt, Homo sapiens
cagaagaagaauaccugua

SEQ ID NO: 1239387 - RNA, 19 nt, Homo sapiens
ccaacuauaccuguagaaa

SEQ ID NO: 1239388 - RNA, 19 nt, Homo sapiens
uaacaaaucaggccaaacc

SEQ ID NO: 1239389 - RNA, 19 nt, Homo sapiens
guacaggaagaaccagcua

SEQ ID NO: 1239390 - RNA, 19 nt, Homo sapiens
uuagagugcauaaugauga

SEQ ID NO: 1239391 - RNA, 19 nt, Homo sapiens
ggaccaggcuaugugaacu

SEQ ID NO: 1239392 - RNA, 19 nt, Homo sapiens
caggagcucccaccaauag

SEQ ID NO: 1239393 - RNA, 19 nt, Homo sapiens
gaaaaugaaagccauaaag

SEQ ID NO: 1239394 - RNA, 19 nt, Homo sapiens
gaaaagcuguggggaccaa

SEQ ID NO: 1239395 - RNA, 19 nt, Homo sapiens
guccagugaucgagcuuug

SEQ ID NO: 1239396 - RNA, 19 nt, Homo sapiens
gaacuuagguguugguuua

SEQ ID NO: 1239397 - RNA, 19 nt, Homo sapiens
gauacaaacuggcauuuaa

SEQ ID NO: 1239398 - RNA, 19 nt, Homo sapiens
gaaaccagcugaagcguau

SEQ ID NO: 1239399 - RNA, 19 nt, Homo sapiens
uaaacaagaugcuaacuga

SEQ ID NO: 1239400 - RNA, 19 nt, Homo sapiens
gagauggcauggaaauaua

SEQ ID NO: 1239401 - RNA, 19 nt, Homo sapiens
cugcaaagcuuaugaauau

SEQ ID NO: 1239402 - RNA, 19 nt, Homo sapiens
gcucugaacuaguauuuga

SEQ ID NO: 1239403 - RNA, 19 nt, Homo sapiens
ggacacaacagaaaugaaa

SEQ ID NO: 1239404 - RNA, 19 nt, Homo sapiens
gaacuaguauuugaaggaa

SEQ ID NO: 1239405 - RNA, 19 nt, Homo sapiens
agacugcucugaacuagua

SEQ ID NO: 1239406 - RNA, 19 nt, Homo sapiens
gcaagaaucugugcaacug

SEQ ID NO: 1239407 - RNA, 19 nt, Homo sapiens
gaacaagcauuaaauaccu

SEQ ID NO: 1239408 - RNA, 19 nt, Homo sapiens
uaauaaagcucggaaagau

SEQ ID NO: 1239409 - RNA, 19 nt, Homo sapiens
ggaaaacuauugcuuaaug

SEQ ID NO: 1239410 - RNA, 19 nt, Homo sapiens
gaugagagcuaugucuuuc

SEQ ID NO: 1239411 - RNA, 19 nt, Homo sapiens
caucaauccuuccacauau

SEQ ID NO: 1239412 - RNA, 19 nt, Homo sapiens
gagcaagcauauacagaug

SEQ ID NO: 1239413 - RNA, 19 nt, Homo sapiens
guacagaucaucaauccuu

SEQ ID NO: 1239414 - RNA, 19 nt, Homo sapiens
gcaguaaacaagaugcuaa

SEQ ID NO: 1239415 - RNA, 19 nt, Homo sapiens
ggaaggcaguaaacaagau

SEQ ID NO: 1239416 - RNA, 19 nt, Homo sapiens
gcuaacugauggagugaaa

SEQ ID NO: 1239417 - RNA, 19 nt, Homo sapiens
ugaaggaacuaaugaacau

SEQ ID NO: 1239418 - RNA, 19 nt, Homo sapiens
ggauacaaacuggcauuua

SEQ ID NO: 1239419 - RNA, 19 nt, Homo sapiens
uguuggaggugaaguauuu

SEQ ID NO: 1239420 - RNA, 19 nt, Homo sapiens
ggauucaauugacauaugu

SEQ ID NO: 1239421 - RNA, 19 nt, Homo sapiens
gaaauagcagcaucugaga

SEQ ID NO: 1239422 - RNA, 19 nt, Homo sapiens
aaacuaggcagucuugauu

SEQ ID NO: 1239423 - RNA, 19 nt, Homo sapiens
auagagaucuguuugaauc

SEQ ID NO: 1239424 - RNA, 19 nt, Homo sapiens
gcaguagaaccauaucuug

SEQ ID NO: 1239425 - RNA, 19 nt, Homo sapiens
aaacggugccugcgucaua

SEQ ID NO: 1239426 - RNA, 19 nt, Homo sapiens
cggcuuauaugaucuugaa

SEQ ID NO: 1239427 - RNA, 19 nt, Homo sapiens
ggcaacggcuuauaugauc

SEQ ID NO: 1239428 - RNA, 19 nt, Homo sapiens
gaauggcaacggcuuauau

SEQ ID NO: 1239429 - RNA, 19 nt, Homo sapiens
ggauuugauugccuuaugu

SEQ ID NO: 1239430 - RNA, 19 nt, Homo sapiens
ugauagagaucuguuugaa

SEQ ID NO: 1239431 - RNA, 19 nt, Homo sapiens
gcauggaaauauagcaauc

SEQ ID NO: 1239432 - RNA, 19 nt, Homo sapiens
cagaaaggauauacuugau

SEQ ID NO: 1239433 - RNA, 19 nt, Homo sapiens
ugaagcacauccaacuuau

SEQ ID NO: 1239434 - RNA, 19 nt, Homo sapiens
uauugaugcugaagaguuu

SEQ ID NO: 1239435 - RNA, 19 nt, Homo sapiens
cuaccaaacagaaaucuaa

SEQ ID NO: 1239436 - RNA, 19 nt, Homo sapiens
caacugagaagcaagaauc

SEQ ID NO: 1239437 - RNA, 19 nt, Homo sapiens
ggaugagagcuaugucuuu

SEQ ID NO: 1239438 - RNA, 19 nt, Homo sapiens
ucagaaaggauauacuuga

SEQ ID NO: 1239439 - RNA, 19 nt, Homo sapiens
aauaugacauggcagaaga

SEQ ID NO: 1239440 - RNA, 19 nt, Homo sapiens
gcaguaagaacagcagaaa

SEQ ID NO: 1239441 - RNA, 19 nt, Homo sapiens
gcugcaaagcuuaugaaua

SEQ ID NO: 1239442 - RNA, 19 nt, Homo sapiens
gaagcaagaaucugugcaa

SEQ ID NO: 1239443 - RNA, 19 nt, Homo sapiens
ggaggugaaguauuugaaa

SEQ ID NO: 1239444 - RNA, 19 nt, Homo sapiens
gcacauccaacuuauccaa

SEQ ID NO: 1239445 - RNA, 19 nt, Homo sapiens
acuaugagauggcauggaa

SEQ ID NO: 1239446 - RNA, 19 nt, Homo sapiens
ggauuggaaugcuauugau

SEQ ID NO: 1239447 - RNA, 19 nt, Homo sapiens
gaugcugccuugaacuaug

SEQ ID NO: 1239448 - RNA, 19 nt, Homo sapiens
ccaaacagaaaucuaaugu

SEQ ID NO: 1239449 - RNA, 19 nt, Homo sapiens
ccacauauacaaguucauu

SEQ ID NO: 1239450 - RNA, 19 nt, Homo sapiens
ucaucaauccuuccacaua

SEQ ID NO: 1239451 - RNA, 19 nt, Homo sapiens
gauauguggauucaauuga

SEQ ID NO: 1239452 - RNA, 19 nt, Homo sapiens
gaauccagauaaugaaacu

SEQ ID NO: 1239453 - RNA, 19 nt, Homo sapiens
gcuacuugcugauauuuac

SEQ ID NO: 1239454 - RNA, 19 nt, Homo sapiens
caccagcaguagaaccaua

SEQ ID NO: 1239455 - RNA, 19 nt, Homo sapiens
ggaauggcaacggcuuaua

SEQ ID NO: 1239456 - RNA, 19 nt, Homo sapiens
gaaggcaagugcagcuaac

SEQ ID NO: 1239457 - RNA, 19 nt, Homo sapiens
gagcuuaaacagaccauca

SEQ ID NO: 1239458 - RNA, 19 nt, Homo sapiens
caaacuggcauuuaauuac

SEQ ID NO: 1239459 - RNA, 19 nt, Homo sapiens
uauaugggauacauuaugg

SEQ ID NO: 1239460 - RNA, 19 nt, Homo sapiens
gcugcuacuugcugauauu

SEQ ID NO: 1239461 - RNA, 19 nt, Homo sapiens
gcugaagcguauugcgaaa

SEQ ID NO: 1239462 - RNA, 19 nt, Homo sapiens
cauuaaauaccuucacuga

SEQ ID NO: 1239463 - RNA, 19 nt, Homo sapiens
gaacuaaugaacaugacau

SEQ ID NO: 1239464 - RNA, 19 nt, Homo sapiens
cauggcagaagaccuguua

SEQ ID NO: 1239465 - RNA, 19 nt, Homo sapiens
gauggagaccuggguaauu

SEQ ID NO: 1239466 - RNA, 19 nt, Homo sapiens
gcugaagaguuugagaaga

SEQ ID NO: 1239467 - RNA, 19 nt, Homo sapiens
caucugagaaggagcauau

SEQ ID NO: 1239468 - RNA, 19 nt, Homo sapiens
ucacguacagcuucgcaua

SEQ ID NO: 1239469 - RNA, 19 nt, Homo sapiens
uuaaacagaccaucacaug

SEQ ID NO: 1239470 - RNA, 19 nt, Homo sapiens
ugagauggcauggaaauau

SEQ ID NO: 1239471 - RNA, 19 nt, Homo sapiens
cagcuucgcauaauggaaa

SEQ ID NO: 1239472 - RNA, 19 nt, Homo sapiens
uaauacaacugagaagucu

SEQ ID NO: 1239473 - RNA, 19 nt, Homo sapiens
uugaagcacauccaacuua

SEQ ID NO: 1239474 - RNA, 19 nt, Homo sapiens
gaggucaccagcaguagaa

SEQ ID NO: 1239475 - RNA, 19 nt, Homo sapiens
guuugaauccagauaauga

SEQ ID NO: 1239476 - RNA, 19 nt, Homo sapiens
guaauucaacugagaagca

SEQ ID NO: 1239477 - RNA, 19 nt, Homo sapiens
uaauucaacugagaagcaa

SEQ ID NO: 1239478 - RNA, 19 nt, Homo sapiens
gaggugaaguauuugaaaa

SEQ ID NO: 1239479 - RNA, 19 nt, Homo sapiens
guaaacaagaugcuaacug

SEQ ID NO: 1239480 - RNA, 19 nt, Homo sapiens
uaaggcccgugcgucuuua

SEQ ID NO: 1239481 - RNA, 19 nt, Homo sapiens
uggauucaauugacauaug

SEQ ID NO: 1239482 - RNA, 19 nt, Homo sapiens
ugagaagaguuggcugcua

SEQ ID NO: 1239483 - RNA, 19 nt, Homo sapiens
ugaugacucugcuucuaug

SEQ ID NO: 1239484 - RNA, 19 nt, Homo sapiens
aauuugaacuuagguguug

SEQ ID NO: 1239485 - RNA, 19 nt, Homo sapiens
gauagagaucuguuugaau

SEQ ID NO: 1239486 - RNA, 19 nt, Homo sapiens
gccaaaaugcccuuuauaa

SEQ ID NO: 1239487 - RNA, 19 nt, Homo sapiens
cugaagaguuugagaagag

SEQ ID NO: 1239488 - RNA, 19 nt, Homo sapiens
cagaugcugccuugaacua

SEQ ID NO: 1239489 - RNA, 19 nt, Homo sapiens
guacagcuucgcauaaugg

SEQ ID NO: 1239490 - RNA, 19 nt, Homo sapiens
ggcaagugcagcuaacuga

SEQ ID NO: 1239491 - RNA, 19 nt, Homo sapiens
gaaggcaguaaacaagaug

SEQ ID NO: 1239492 - RNA, 19 nt, Homo sapiens
caaacuaggcagucuugau

SEQ ID NO: 1239493 - RNA, 19 nt, Homo sapiens
aaauauagcaaucggacaa

SEQ ID NO: 1239494 - RNA, 19 nt, Homo sapiens
uaacugauggagugaaauc

SEQ ID NO: 1239495 - RNA, 19 nt, Homo sapiens
gggaaggcaguaaacaaga

SEQ ID NO: 1239496 - RNA, 19 nt, Homo sapiens
gaaaguggcuguugcaugu

SEQ ID NO: 1239497 - RNA, 19 nt, Homo sapiens
caaauucucugcccucaua

SEQ ID NO: 1239498 - RNA, 19 nt, Homo sapiens
gaaaugagauagggaauau

SEQ ID NO: 1239499 - RNA, 19 nt, Homo sapiens
agaagaagcucuacucaaa

SEQ ID NO: 1239500 - RNA, 19 nt, Homo sapiens
gcacauaguacaugcaaua

SEQ ID NO: 1239501 - RNA, 19 nt, Homo sapiens
guuauuaccuuuccuaaga

SEQ ID NO: 1239502 - RNA, 19 nt, Homo sapiens
gaaagcauagccugcauua

SEQ ID NO: 1239503 - RNA, 19 nt, Homo sapiens
gaaggaaccuggucagucu

SEQ ID NO: 1239504 - RNA, 19 nt, Homo sapiens
cagauaauguggugaaauu

SEQ ID NO: 1239505 - RNA, 19 nt, Homo sapiens
gauaguggcuggcacauag

SEQ ID NO: 1239506 - RNA, 19 nt, Homo sapiens
gcuaaaagauaccuacuua

SEQ ID NO: 1239507 - RNA, 19 nt, Homo sapiens
aaagauaccuacuuacaga

SEQ ID NO: 1239508 - RNA, 19 nt, Homo sapiens
gcacuaaagaaacguauuu

SEQ ID NO: 1239509 - RNA, 19 nt, Homo sapiens
caguauggcugcugcauuu

SEQ ID NO: 1239510 - RNA, 19 nt, Homo sapiens
caguggagcucaugaaaga

SEQ ID NO: 1239511 - RNA, 19 nt, Homo sapiens
gcacauugguauaauugau

SEQ ID NO: 1239512 - RNA, 19 nt, Homo sapiens
gcuguugcauguaaucuuu

SEQ ID NO: 1239513 - RNA, 19 nt, Homo sapiens
gauaccuacuuacagauaa

SEQ ID NO: 1239514 - RNA, 19 nt, Homo sapiens
ggacaggauccgcauauga

SEQ ID NO: 1239515 - RNA, 19 nt, Homo sapiens
ggucaccacugauucuuug

SEQ ID NO: 1239516 - RNA, 19 nt, Homo sapiens
caaaugaguucuuccuucu

SEQ ID NO: 1239517 - RNA, 19 nt, Homo sapiens
caugaaagaccagcauuua

SEQ ID NO: 1239518 - RNA, 19 nt, Homo sapiens
gagguuguguuacgaguug

SEQ ID NO: 1239519 - RNA, 19 nt, Homo sapiens
gaauagcccugagucuuuc

SEQ ID NO: 1239520 - RNA, 19 nt, Homo sapiens
ucucacacguugcuauuaa

SEQ ID NO: 1239521 - RNA, 19 nt, Homo sapiens
caccaaagauaccuauguu

SEQ ID NO: 1239522 - RNA, 19 nt, Homo sapiens
ucaguuuccucauuuggua

SEQ ID NO: 1239523 - RNA, 19 nt, Homo sapiens
ugaauagcccugagucuuu

SEQ ID NO: 1239524 - RNA, 19 nt, Homo sapiens
ccucauagaauccuaauug

SEQ ID NO: 1239525 - RNA, 19 nt, Homo sapiens
gcaccacugugaaggucua

SEQ ID NO: 1239526 - RNA, 19 nt, Homo sapiens
gauagggaauauaaagcaa

SEQ ID NO: 1239527 - RNA, 19 nt, Homo sapiens
cuagugaguuauuaccuuu

SEQ ID NO: 1239528 - RNA, 19 nt, Homo sapiens
aagcauagccugcauuaau

SEQ ID NO: 1239529 - RNA, 19 nt, Homo sapiens
aaaccaagaugugaaguuc

SEQ ID NO: 1239530 - RNA, 19 nt, Homo sapiens
gaauauaaagcaagcagau

SEQ ID NO: 1239531 - RNA, 19 nt, Homo sapiens
gcucuuaagaaacagaaua

SEQ ID NO: 1239532 - RNA, 19 nt, Homo sapiens
guaguuacuugcaaauuac

SEQ ID NO: 1239533 - RNA, 19 nt, Homo sapiens
aagcuuggcucccucagaa

SEQ ID NO: 1239534 - RNA, 19 nt, Homo sapiens
gagagucgcacauugguau

SEQ ID NO: 1239535 - RNA, 19 nt, Homo sapiens
gaagccagguaucgcacuu

SEQ ID NO: 1239536 - RNA, 19 nt, Homo sapiens
acacguugcuauuaaacaa

SEQ ID NO: 1239537 - RNA, 19 nt, Homo sapiens
gcauagccugcauuaauuu

SEQ ID NO: 1239538 - RNA, 19 nt, Homo sapiens
gagaagaagcucuacucaa

SEQ ID NO: 1239539 - RNA, 19 nt, Homo sapiens
gaccagcauuuacgagguu

SEQ ID NO: 1239540 - RNA, 19 nt, Homo sapiens
uuacauccuugcugaauuc

SEQ ID NO: 1239541 - RNA, 19 nt, Homo sapiens
gaagugcuggccaaaguga

SEQ ID NO: 1239542 - RNA, 19 nt, Homo sapiens
gaaagaccagcauuuacga

SEQ ID NO: 1239543 - RNA, 19 nt, Homo sapiens
aaaagaaacugacccagaa

SEQ ID NO: 1239544 - RNA, 19 nt, Homo sapiens
ggcccaaucucaacuguag

SEQ ID NO: 1239545 - RNA, 19 nt, Homo sapiens
ggccaaauuugaugagauc

SEQ ID NO: 1239546 - RNA, 19 nt, Homo sapiens
ggaugugccugcccuugug

SEQ ID NO: 1239547 - RNA, 19 nt, Homo sapiens
auaccuauguucuugcuuu

SEQ ID NO: 1239548 - RNA, 19 nt, Homo sapiens
aaucucaacuguagacugu

SEQ ID NO: 1239549 - RNA, 19 nt, Homo sapiens
ccuaauuguuucuguaugu

SEQ ID NO: 1239550 - RNA, 19 nt, Homo sapiens
uaaugguaccgaccucuua

SEQ ID NO: 1239551 - RNA, 19 nt, Homo sapiens
agucacagcuucagguguu

SEQ ID NO: 1239552 - RNA, 19 nt, Homo sapiens
gaauucaggagguuaagga

SEQ ID NO: 1239553 - RNA, 19 nt, Homo sapiens
gacuccacaucauucaaua

SEQ ID NO: 1239554 - RNA, 19 nt, Homo sapiens
cauccucaguuuccucauu

SEQ ID NO: 1239555 - RNA, 19 nt, Homo sapiens
gaauccaggucugagauca

SEQ ID NO: 1239556 - RNA, 19 nt, Homo sapiens
uaauccauauccagucaaa

SEQ ID NO: 1239557 - RNA, 19 nt, Homo sapiens
uauaauccauauccaguca

SEQ ID NO: 1239558 - RNA, 19 nt, Homo sapiens
ggauaacucugauuuucaa

SEQ ID NO: 1239559 - RNA, 19 nt, Homo sapiens
guaccaugccgaucucuga

SEQ ID NO: 1239560 - RNA, 19 nt, Homo sapiens
gcagaaggaaauuuaucaa

SEQ ID NO: 1239561 - RNA, 19 nt, Homo sapiens
agcauagccugcauuaauu

SEQ ID NO: 1239562 - RNA, 19 nt, Homo sapiens
gaagaagcucuacucaaag

SEQ ID NO: 1239563 - RNA, 19 nt, Homo sapiens
uguaccacauuaucucuuu

SEQ ID NO: 1239564 - RNA, 19 nt, Homo sapiens
guaagcaccaucaggaaug

SEQ ID NO: 1239565 - RNA, 19 nt, Homo sapiens
gaggacaggauccgcauau

SEQ ID NO: 1239566 - RNA, 19 nt, Homo sapiens
ggaaacgauccaugcaaga

SEQ ID NO: 1239567 - RNA, 19 nt, Homo sapiens
cuacaaguguggauaacuc

SEQ ID NO: 1239568 - RNA, 19 nt, Homo sapiens
uaagcaccaucaggaauga

SEQ ID NO: 1239569 - RNA, 19 nt, Homo sapiens
caaaucaugaauccagaaa

SEQ ID NO: 1239570 - RNA, 19 nt, Homo sapiens
ccaaagauaccuauguucu

SEQ ID NO: 1239571 - RNA, 19 nt, Homo sapiens
guugauaaccuuacuacau

SEQ ID NO: 1239572 - RNA, 19 nt, Homo sapiens
ugaaaugagauagggaaua

SEQ ID NO: 1239573 - RNA, 19 nt, Homo sapiens
gcaaguauugauagagaug

SEQ ID NO: 1239574 - RNA, 19 nt, Homo sapiens
gaacagccccauuuagaga

SEQ ID NO: 1239575 - RNA, 19 nt, Homo sapiens
ugguagagcugagauuaga

SEQ ID NO: 1239576 - RNA, 19 nt, Homo sapiens
cauagccugcauuaauuua

SEQ ID NO: 1239577 - RNA, 19 nt, Homo sapiens
cuguuucgcuguggcauua

SEQ ID NO: 1239578 - RNA, 19 nt, Homo sapiens
uaaccuuacuacauuugug

SEQ ID NO: 1239579 - RNA, 19 nt, Homo sapiens
uugcaaguauugauagaga

SEQ ID NO: 1239580 - RNA, 19 nt, Homo sapiens
gcauuuacgagguuucuuc

SEQ ID NO: 1239581 - RNA, 19 nt, Homo sapiens
gugaggaugaaaugagaua

SEQ ID NO: 1239582 - RNA, 19 nt, Homo sapiens
gugugaggaugaaaugaga

SEQ ID NO: 1239583 - RNA, 19 nt, Homo sapiens
cacauuaucucuuuucaga

SEQ ID NO: 1239584 - RNA, 19 nt, Homo sapiens
uaaucuuucuggcacuaaa

SEQ ID NO: 1239585 - RNA, 19 nt, Homo sapiens
gaaacgauccaugcaagag

SEQ ID NO: 1239586 - RNA, 19 nt, Homo sapiens
gaaacugacccagaacaag

SEQ ID NO: 1239587 - RNA, 19 nt, Homo sapiens
ggcaaaagcuguguccauu

SEQ ID NO: 1239588 - RNA, 19 nt, Homo sapiens
guacuacauuaagagaaga

SEQ ID NO: 1239589 - RNA, 19 nt, Homo sapiens
gauaaccuuacuacauuug

SEQ ID NO: 1239590 - RNA, 19 nt, Homo sapiens
ugagauagggaauauaaag

SEQ ID NO: 1239591 - RNA, 19 nt, Homo sapiens
caaguguggauaacucuga

SEQ ID NO: 1239592 - RNA, 19 nt, Homo sapiens
ggaaaucucacacguugcu

SEQ ID NO: 1239593 - RNA, 19 nt, Homo sapiens
ccaaauuugaugagaucua

SEQ ID NO: 1239594 - RNA, 19 nt, Homo sapiens
auccauauccagucaaaua

SEQ ID NO: 1239595 - RNA, 19 nt, Homo sapiens
gcuguggcauuagcucuga

SEQ ID NO: 1239596 - RNA, 19 nt, Homo sapiens
ggaaguggcuccggauuua

SEQ ID NO: 1239597 - RNA, 19 nt, Homo sapiens
gaacaaagguugagagaac

SEQ ID NO: 1239598 - RNA, 19 nt, Homo sapiens
gaaaucuccuguaaacuuu

SEQ ID NO: 1239599 - RNA, 19 nt, Homo sapiens
gaacggugauuauucauga

SEQ ID NO: 1239600 - RNA, 19 nt, Homo sapiens
gaaaugaacuuagagaauc

SEQ ID NO: 1239601 - RNA, 19 nt, Homo sapiens
gaaaggagaacggugauua

SEQ ID NO: 1239602 - RNA, 19 nt, Homo sapiens
uaaggaagcugaacggauu

SEQ ID NO: 1239603 - RNA, 19 nt, Homo sapiens
ggagaacggugauuauuca

SEQ ID NO: 1239604 - RNA, 19 nt, Homo sapiens
caacagaacagauuuaaug

SEQ ID NO: 1239605 - RNA, 19 nt, Homo sapiens
uaaaggagaucauuguaga

SEQ ID NO: 1239606 - RNA, 19 nt, Homo sapiens
gauaaagacuacagaagga

SEQ ID NO: 1239607 - RNA, 19 nt, Homo sapiens
ggaauuguguggguauuaa

SEQ ID NO: 1239608 - RNA, 19 nt, Homo sapiens
ugaaggcugucuacacuua

SEQ ID NO: 1239609 - RNA, 19 nt, Homo sapiens
ccaaauagauucaugaaac

SEQ ID NO: 1239610 - RNA, 19 nt, Homo sapiens
agaagguacuguuacauua

SEQ ID NO: 1239611 - RNA, 19 nt, Homo sapiens
cgagaacgcauuagaauaa

SEQ ID NO: 1239612 - RNA, 19 nt, Homo sapiens
guaaagaugagaagaauga

SEQ ID NO: 1239613 - RNA, 19 nt, Homo sapiens
gcucuagaguuacuucuuu

SEQ ID NO: 1239614 - RNA, 19 nt, Homo sapiens
uagguaaucugcacuguuu

SEQ ID NO: 1239615 - RNA, 19 nt, Homo sapiens
gaaagggaacgcauucgua

SEQ ID NO: 1239616 - RNA, 19 nt, Homo sapiens
ggaagaacgggaacgcuua

SEQ ID NO: 1239617 - RNA, 19 nt, Homo sapiens
gaaaccaaauagauucaug

SEQ ID NO: 1239618 - RNA, 19 nt, Homo sapiens
gaagguacuguuacauuaa

SEQ ID NO: 1239619 - RNA, 19 nt, Homo sapiens
gauccaagcuucgaaagau

SEQ ID NO: 1239620 - RNA, 19 nt, Homo sapiens
ggacauaugguaauacuag

SEQ ID NO: 1239621 - RNA, 19 nt, Homo sapiens
gaaaagaucgucugagaaa

SEQ ID NO: 1239622 - RNA, 19 nt, Homo sapiens
gcgaauaaguuccaagagu

SEQ ID NO: 1239623 - RNA, 19 nt, Homo sapiens
gaaaagaagcgaauaaguu

SEQ ID NO: 1239624 - RNA, 19 nt, Homo sapiens
gagaaaagaucgucugaga

SEQ ID NO: 1239625 - RNA, 19 nt, Homo sapiens
guuuaacgcugugugaaua

SEQ ID NO: 1239626 - RNA, 19 nt, Homo sapiens
agauacagaugcacgauuu

SEQ ID NO: 1239627 - RNA, 19 nt, Homo sapiens
gguuuaauuugcagccuua

SEQ ID NO: 1239628 - RNA, 19 nt, Homo sapiens
gaacggauugcucgagaaa

SEQ ID NO: 1239629 - RNA, 19 nt, Homo sapiens
guacaaaucaguggcaauu

SEQ ID NO: 1239630 - RNA, 19 nt, Homo sapiens
gaacuuagagaaucagaca

SEQ ID NO: 1239631 - RNA, 19 nt, Homo sapiens
gaaacgcccacgugaugua

SEQ ID NO: 1239632 - RNA, 19 nt, Homo sapiens
gagagcgccuagaaauuga

SEQ ID NO: 1239633 - RNA, 19 nt, Homo sapiens
gugucuggcucuagaguua

SEQ ID NO: 1239634 - RNA, 19 nt, Homo sapiens
gcaguacagucuucaucuu

SEQ ID NO: 1239635 - RNA, 19 nt, Homo sapiens
gaacgggaacgcuuacaga

SEQ ID NO: 1239636 - RNA, 19 nt, Homo sapiens
cuagaugggugaaucaguu

SEQ ID NO: 1239637 - RNA, 19 nt, Homo sapiens
gcacacuuguucagguuug

SEQ ID NO: 1239638 - RNA, 19 nt, Homo sapiens
gagaaccgauuuucaguuu

SEQ ID NO: 1239639 - RNA, 19 nt, Homo sapiens
ugaaaucuccuguaaacuu

SEQ ID NO: 1239640 - RNA, 19 nt, Homo sapiens
aagcaaggauacuaagaaa

SEQ ID NO: 1239641 - RNA, 19 nt, Homo sapiens
ggcaggagcaggcaugaua

SEQ ID NO: 1239642 - RNA, 19 nt, Homo sapiens
gagcagagagggagacaga

SEQ ID NO: 1239643 - RNA, 19 nt, Homo sapiens
gaaagcaaggauacuaaga

SEQ ID NO: 1239644 - RNA, 19 nt, Homo sapiens
gaacaggaacgucguaagg

SEQ ID NO: 1239645 - RNA, 19 nt, Homo sapiens
ggaacgcauucguauugaa

SEQ ID NO: 1239646 - RNA, 19 nt, Homo sapiens
aaaguugucucuagauaca

SEQ ID NO: 1239647 - RNA, 19 nt, Homo sapiens
gagagagcgccuagaaauu

SEQ ID NO: 1239648 - RNA, 19 nt, Homo sapiens
gcgagaacgcauuagaaua

SEQ ID NO: 1239649 - RNA, 19 nt, Homo sapiens
uauaguugcuaaaguguug

SEQ ID NO: 1239650 - RNA, 19 nt, Homo sapiens
uaacccaacauucaaguaa

SEQ ID NO: 1239651 - RNA, 19 nt, Homo sapiens
cagaacagauuuaaugacu

SEQ ID NO: 1239652 - RNA, 19 nt, Homo sapiens
ccaaacaucagaaucgauu

SEQ ID NO: 1239653 - RNA, 19 nt, Homo sapiens
gaauaagauuguucauugc

SEQ ID NO: 1239654 - RNA, 19 nt, Homo sapiens
caugauaacccaacauuca

SEQ ID NO: 1239655 - RNA, 19 nt, Homo sapiens
ugagaagaaugauaaugga

SEQ ID NO: 1239656 - RNA, 19 nt, Homo sapiens
caacagcagcuucguuaug

SEQ ID NO: 1239657 - RNA, 19 nt, Homo sapiens
aaucugcacuguuuguuug

SEQ ID NO: 1239658 - RNA, 19 nt, Homo sapiens
ugauaucacucauccuaga

SEQ ID NO: 1239659 - RNA, 19 nt, Homo sapiens
gaagaaaagaagcgaauaa

SEQ ID NO: 1239660 - RNA, 19 nt, Homo sapiens
gguaugaaaccaaauagau

SEQ ID NO: 1239661 - RNA, 19 nt, Homo sapiens
gcugugugguagugguuua

SEQ ID NO: 1239662 - RNA, 19 nt, Homo sapiens
gaauugaagucguuuuguu

SEQ ID NO: 1239663 - RNA, 19 nt, Homo sapiens
ugacaggccugauaucacu

SEQ ID NO: 1239664 - RNA, 19 nt, Homo sapiens
gagcgagaacgcauuagaa

SEQ ID NO: 1239665 - RNA, 19 nt, Homo sapiens
cgagagcgagaacgcauua

SEQ ID NO: 1239666 - RNA, 19 nt, Homo sapiens
gaagaggaagauaugagaa

SEQ ID NO: 1239667 - RNA, 19 nt, Homo sapiens
gcaccgaggcacauuugaa

SEQ ID NO: 1239668 - RNA, 19 nt, Homo sapiens
gaacgcgaacgcuuggaaa

SEQ ID NO: 1239669 - RNA, 19 nt, Homo sapiens
gaaaggcugcgacgagcaa

SEQ ID NO: 1239670 - RNA, 19 nt, Homo sapiens
guugagagaacauuuaguu

SEQ ID NO: 1239671 - RNA, 19 nt, Homo sapiens
ggagaucauuguagaccau

SEQ ID NO: 1239672 - RNA, 19 nt, Homo sapiens
aaagaaagcaaggauacua

SEQ ID NO: 1239673 - RNA, 19 nt, Homo sapiens
cagaagguacuguuacauu

SEQ ID NO: 1239674 - RNA, 19 nt, Homo sapiens
ggagaagauguuuaaauag

SEQ ID NO: 1239675 - RNA, 19 nt, Homo sapiens
gcaggagcaggcaugauaa

SEQ ID NO: 1239676 - RNA, 19 nt, Homo sapiens
agaaagagaggaacucaga

SEQ ID NO: 1239677 - RNA, 19 nt, Homo sapiens
ggagcgacaugugguugaa

SEQ ID NO: 1239678 - RNA, 19 nt, Homo sapiens
caagaaaugaacuuagaga

SEQ ID NO: 1239679 - RNA, 19 nt, Homo sapiens
gaagggaagauccaagcuu

SEQ ID NO: 1239680 - RNA, 19 nt, Homo sapiens
aacagcagcuucguuauga

SEQ ID NO: 1239681 - RNA, 19 nt, Homo sapiens
gaaagagaggaacucagaa

SEQ ID NO: 1239682 - RNA, 19 nt, Homo sapiens
acaggaacgucguaaggaa

SEQ ID NO: 1239683 - RNA, 19 nt, Homo sapiens
gagagagagcgccuagaaa

SEQ ID NO: 1239684 - RNA, 19 nt, Homo sapiens
ucaagaagaggaagauaug

SEQ ID NO: 1239685 - RNA, 19 nt, Homo sapiens
cagcacacuuguucagguu

SEQ ID NO: 1239686 - RNA, 19 nt, Homo sapiens
gaaugauaauggagcaagu

SEQ ID NO: 1239687 - RNA, 19 nt, Homo sapiens
gaucgucugagaaaucuga

SEQ ID NO: 1239688 - RNA, 19 nt, Homo sapiens
gguagugguuuaauuugca

SEQ ID NO: 1239689 - RNA, 19 nt, Homo sapiens
acagaggagucaucacaga

SEQ ID NO: 1239690 - RNA, 19 nt, Homo sapiens
ggaaacaagaguugaaagg

SEQ ID NO: 1239691 - RNA, 19 nt, Homo sapiens
ugacaaacgggaaacaaga

SEQ ID NO: 1239692 - RNA, 19 nt, Homo sapiens
cgacuacucucgccaacag

SEQ ID NO: 1239693 - RNA, 19 nt, Homo sapiens
gcagcuucguuaugaacaa

SEQ ID NO: 1239694 - RNA, 19 nt, Homo sapiens
aacaacagcagcuucguua

SEQ ID NO: 1239695 - RNA, 19 nt, Homo sapiens
gggaacgcauucguauuga

SEQ ID NO: 1239696 - RNA, 19 nt, Homo sapiens
ggaaagcccugccugguaa

SEQ ID NO: 1239697 - RNA, 19 nt, Homo sapiens
guacguggcuucccuguaa

SEQ ID NO: 1239698 - RNA, 19 nt, Homo sapiens
ggaagaagcagcagaaaga

SEQ ID NO: 1239699 - RNA, 19 nt, Homo sapiens
gcaacgacgucaagaaugu

SEQ ID NO: 1239700 - RNA, 19 nt, Homo sapiens
gagaaggacuggaaugcuu

SEQ ID NO: 1239701 - RNA, 19 nt, Homo sapiens
gaacagugagucaauuaaa

SEQ ID NO: 1239702 - RNA, 19 nt, Homo sapiens
gcagaagggugagcgagua

SEQ ID NO: 1239703 - RNA, 19 nt, Homo sapiens
ccucuucucuucucccuua

SEQ ID NO: 1239704 - RNA, 19 nt, Homo sapiens
ccacauacaucaacauugg

SEQ ID NO: 1239705 - RNA, 19 nt, Homo sapiens
gcaaagaugguguggugua

SEQ ID NO: 1239706 - RNA, 19 nt, Homo sapiens
uggaggagcuuuaaccaaa

SEQ ID NO: 1239707 - RNA, 19 nt, Homo sapiens
gcgaguaugguuugaguua

SEQ ID NO: 1239708 - RNA, 19 nt, Homo sapiens
gggcacgaguucccugaua

SEQ ID NO: 1239709 - RNA, 19 nt, Homo sapiens
guuggaaacuucuguacaa

SEQ ID NO: 1239710 - RNA, 19 nt, Homo sapiens
gaaaccuucugcaaagaug

SEQ ID NO: 1239711 - RNA, 19 nt, Homo sapiens
gauaguuccuccuguguuc

SEQ ID NO: 1239712 - RNA, 19 nt, Homo sapiens
gagaucagguggagguaau

SEQ ID NO: 1239713 - RNA, 19 nt, Homo sapiens
guacuagccucucugaucu

SEQ ID NO: 1239714 - RNA, 19 nt, Homo sapiens
ggccauuucuccaugauga

SEQ ID NO: 1239715 - RNA, 19 nt, Homo sapiens
gcagugagcguugaauuug

SEQ ID NO: 1239716 - RNA, 19 nt, Homo sapiens
caacgucacuagcaguuuc

SEQ ID NO: 1239717 - RNA, 19 nt, Homo sapiens
ggacugcaauugccagaag

SEQ ID NO: 1239718 - RNA, 19 nt, Homo sapiens
gagcaacgacgucaagaau

SEQ ID NO: 1239719 - RNA, 19 nt, Homo sapiens
ggacgagacuuucgaucag

SEQ ID NO: 1239720 - RNA, 19 nt, Homo sapiens
ggaaaggaaauuaguaucu

SEQ ID NO: 1239721 - RNA, 19 nt, Homo sapiens
cuuacuagcucuuugcaaa

SEQ ID NO: 1239722 - RNA, 19 nt, Homo sapiens
gcacguggaugagaucaag

SEQ ID NO: 1239723 - RNA, 19 nt, Homo sapiens
ggaacagugagucaauuaa

SEQ ID NO: 1239724 - RNA, 19 nt, Homo sapiens
gagcgaguaugguuugagu

SEQ ID NO: 1239725 - RNA, 19 nt, Homo sapiens
gcaauugccagaagcucua

SEQ ID NO: 1239726 - RNA, 19 nt, Homo sapiens
agaagucucugaucaugga

SEQ ID NO: 1239727 - RNA, 19 nt, Homo sapiens
caauuaaaccucuuuccuu

SEQ ID NO: 1239728 - RNA, 19 nt, Homo sapiens
ggaagagggacaagaagga

SEQ ID NO: 1239729 - RNA, 19 nt, Homo sapiens
uggaggagcugcaggugaa

SEQ ID NO: 1239730 - RNA, 19 nt, Homo sapiens
gggaggaggaguugcagua

SEQ ID NO: 1239731 - RNA, 19 nt, Homo sapiens
gauggaagcaaaucaaaca

SEQ ID NO: 1239732 - RNA, 19 nt, Homo sapiens
caaccugcuuggucucuau

SEQ ID NO: 1239733 - RNA, 19 nt, Homo sapiens
ggaaacuucuguacaacac

SEQ ID NO: 1239734 - RNA, 19 nt, Homo sapiens
ggccuucuaugccagcuuu

SEQ ID NO: 1239735 - RNA, 19 nt, Homo sapiens
gaaagucaaagucauguac

SEQ ID NO: 1239736 - RNA, 19 nt, Homo sapiens
ccaagaugauccugagcuu

SEQ ID NO: 1239737 - RNA, 19 nt, Homo sapiens
ggaggaauguuuaaaaugg

SEQ ID NO: 1239738 - RNA, 19 nt, Homo sapiens
gaagagggacaagaaggaa

SEQ ID NO: 1239739 - RNA, 19 nt, Homo sapiens
gcccaggcuuccaguacua

SEQ ID NO: 1239740 - RNA, 19 nt, Homo sapiens
gauguggacaccaaauuga

SEQ ID NO: 1239741 - RNA, 19 nt, Homo sapiens
cuucaaaccuggccaccuu

SEQ ID NO: 1239742 - RNA, 19 nt, Homo sapiens
cacgagaucugaugauuuu

SEQ ID NO: 1239743 - RNA, 19 nt, Homo sapiens
cgaguaugguuugaguuaa

SEQ ID NO: 1239744 - RNA, 19 nt, Homo sapiens
aaacuucuguacaacacuu

SEQ ID NO: 1239745 - RNA, 19 nt, Homo sapiens
gcagcuacuucccugaaca

SEQ ID NO: 1239746 - RNA, 19 nt, Homo sapiens
gagacuuucgaucagauua

SEQ ID NO: 1239747 - RNA, 19 nt, Homo sapiens
gaggaggaguugcaguaca

SEQ ID NO: 1239748 - RNA, 19 nt, Homo sapiens
ccaggaaccucaggaugga

SEQ ID NO: 1239749 - RNA, 19 nt, Homo sapiens
augccgaccucaucaagua

SEQ ID NO: 1239750 - RNA, 19 nt, Homo sapiens
ucucagagcugcacaugac

SEQ ID NO: 1239751 - RNA, 19 nt, Homo sapiens
ggauuaaaccaaccugcuu

SEQ ID NO: 1239752 - RNA, 19 nt, Homo sapiens
ggcuggaggucauucaguu

SEQ ID NO: 1239753 - RNA, 19 nt, Homo sapiens
uguccaagcuggucaccuu

SEQ ID NO: 1239754 - RNA, 19 nt, Homo sapiens
ccaccuugcugcagugauc

SEQ ID NO: 1239755 - RNA, 19 nt, Homo sapiens
ucacgagaucugaugauuu

SEQ ID NO: 1239756 - RNA, 19 nt, Homo sapiens
ggccugggcuccaacucuu

SEQ ID NO: 1239757 - RNA, 19 nt, Homo sapiens
ggaaaccuucugcaaagau

SEQ ID NO: 1239758 - RNA, 19 nt, Homo sapiens
caaagccugcacagccuua

SEQ ID NO: 1239759 - RNA, 19 nt, Homo sapiens
guggacaccuuccuacaag

SEQ ID NO: 1239760 - RNA, 19 nt, Homo sapiens
gcacgaguucccugauaga

SEQ ID NO: 1239761 - RNA, 19 nt, Homo sapiens
ccagaaagucaaagucaug

SEQ ID NO: 1239762 - RNA, 19 nt, Homo sapiens
caccacacccuguauucua

SEQ ID NO: 1239763 - RNA, 19 nt, Homo sapiens
uggcaugccuucucagaca

SEQ ID NO: 1239764 - RNA, 19 nt, Homo sapiens
gaguaugguuugaguuaac

SEQ ID NO: 1239765 - RNA, 19 nt, Homo sapiens
gacgagacuuucgaucaga

SEQ ID NO: 1239766 - RNA, 19 nt, Homo sapiens
uggaacagugagucaauua

SEQ ID NO: 1239767 - RNA, 19 nt, Homo sapiens
cuggaaaccuucugcaaag

SEQ ID NO: 1239768 - RNA, 19 nt, Homo sapiens
ggacaccuuccuacaagug

SEQ ID NO: 1239769 - RNA, 19 nt, Homo sapiens
gcuccagacugccagaaag

SEQ ID NO: 1239770 - RNA, 19 nt, Homo sapiens
guggaacagugagucaauu

SEQ ID NO: 1239771 - RNA, 19 nt, Homo sapiens
cuagagggcaaugggauua

SEQ ID NO: 1239772 - RNA, 19 nt, Homo sapiens
ucucuucucccuuaucgua

SEQ ID NO: 1239773 - RNA, 19 nt, Homo sapiens
caacuucuuugguguuuug

SEQ ID NO: 1239774 - RNA, 19 nt, Homo sapiens
caaagauggugugguguac

SEQ ID NO: 1239775 - RNA, 19 nt, Homo sapiens
uugcugcagugaucaauga

SEQ ID NO: 1239776 - RNA, 19 nt, Homo sapiens
ccaugcuguucuugugaua

SEQ ID NO: 1239777 - RNA, 19 nt, Homo sapiens
caauggcagucugguguug

SEQ ID NO: 1239778 - RNA, 19 nt, Homo sapiens
ucaaacagggcacgaguuc

SEQ ID NO: 1239779 - RNA, 19 nt, Homo sapiens
uggaaagcccugccuggua

SEQ ID NO: 1239780 - RNA, 19 nt, Homo sapiens
caaccaagggaaaggaaau

SEQ ID NO: 1239781 - RNA, 19 nt, Homo sapiens
ggaucaauaacaaagagaa

SEQ ID NO: 1239782 - RNA, 19 nt, Homo sapiens
acccagggaucaauaacaa

SEQ ID NO: 1239783 - RNA, 19 nt, Homo sapiens
gaaguucaacaccacauac

SEQ ID NO: 1239784 - RNA, 19 nt, Homo sapiens
gcagaaagaccuggaagcu

SEQ ID NO: 1239785 - RNA, 19 nt, Homo sapiens
gcaggaaagggaagaagca

SEQ ID NO: 1239786 - RNA, 19 nt, Homo sapiens
ccuuguaggauaugguuua

SEQ ID NO: 1239787 - RNA, 19 nt, Homo sapiens
caagggaaaggaaauuagu

SEQ ID NO: 1239788 - RNA, 19 nt, Homo sapiens
uacaacuucuuugguguuu

SEQ ID NO: 1239789 - RNA, 19 nt, Homo sapiens
gaugagaaggacuggaaug

SEQ ID NO: 1239790 - RNA, 19 nt, Homo sapiens
gaacuuccaagggcucaug

SEQ ID NO: 1239791 - RNA, 19 nt, Homo sapiens
gcucuuccacagccucuuu

SEQ ID NO: 1239792 - RNA, 19 nt, Homo sapiens
uggaugagaucaaggaacu

SEQ ID NO: 1239793 - RNA, 19 nt, Homo sapiens
ccacguggacaccuuccua

SEQ ID NO: 1239794 - RNA, 19 nt, Homo sapiens
ggcacgaguucccugauag

SEQ ID NO: 1239795 - RNA, 19 nt, Homo sapiens
cugccaugauuguaaguuu

SEQ ID NO: 1239796 - RNA, 19 nt, Homo sapiens
gcacagcccuugaggacua

SEQ ID NO: 1239797 - RNA, 19 nt, Homo sapiens
ggauucagaugucaccuua

SEQ ID NO: 1239798 - RNA, 19 nt, Homo sapiens
caaacagcguggucaagua

SEQ ID NO: 1239799 - RNA, 19 nt, Homo sapiens
gaaaucgcgucguacagaa

SEQ ID NO: 1239800 - RNA, 19 nt, Homo sapiens
gggcaaggcugcagcucua

SEQ ID NO: 1239801 - RNA, 19 nt, Homo sapiens
ggacggugauugagauguu

SEQ ID NO: 1239802 - RNA, 19 nt, Homo sapiens
gaacaucgacagaaauauc

SEQ ID NO: 1239803 - RNA, 19 nt, Homo sapiens
caagaaaggccacuacgaa

SEQ ID NO: 1239804 - RNA, 19 nt, Homo sapiens
gaugaaggcucagcagaga

SEQ ID NO: 1239805 - RNA, 19 nt, Homo sapiens
ggaauucugucuucacaag

SEQ ID NO: 1239806 - RNA, 19 nt, Homo sapiens
ucuuugaucucgacaauaa

SEQ ID NO: 1239807 - RNA, 19 nt, Homo sapiens
caaagcagcuguacuucuc

SEQ ID NO: 1239808 - RNA, 19 nt, Homo sapiens
ucaaaggaauucugucuuc

SEQ ID NO: 1239809 - RNA, 19 nt, Homo sapiens
gaugucaccuuaaagaaca

SEQ ID NO: 1239810 - RNA, 19 nt, Homo sapiens
gcagugaaguaccucauca

SEQ ID NO: 1239811 - RNA, 19 nt, Homo sapiens
cagcaacggauacaucuua

SEQ ID NO: 1239812 - RNA, 19 nt, Homo sapiens
aaauggagcaccagaauaa

SEQ ID NO: 1239813 - RNA, 19 nt, Homo sapiens
gagcguggaccaugaauug

SEQ ID NO: 1239814 - RNA, 19 nt, Homo sapiens
aaacauuucugacuuugga

SEQ ID NO: 1239815 - RNA, 19 nt, Homo sapiens
ggaaggcggugacgagucu

SEQ ID NO: 1239816 - RNA, 19 nt, Homo sapiens
caguaaagaucccagagaa

SEQ ID NO: 1239817 - RNA, 19 nt, Homo sapiens
ccaugaacaucgacagaaa

SEQ ID NO: 1239818 - RNA, 19 nt, Homo sapiens
gcaagaccaugccgaaguc

SEQ ID NO: 1239819 - RNA, 19 nt, Homo sapiens
acaaguacgucucucagaa

SEQ ID NO: 1239820 - RNA, 19 nt, Homo sapiens
ccuauagccugguuccuaa

SEQ ID NO: 1239821 - RNA, 19 nt, Homo sapiens
ccaaagaggugacgauagc

SEQ ID NO: 1239822 - RNA, 19 nt, Homo sapiens
caacggauacaucuuaaau

SEQ ID NO: 1239823 - RNA, 19 nt, Homo sapiens
cagcaucucucaccguuuc

SEQ ID NO: 1239824 - RNA, 19 nt, Homo sapiens
ucacucaucugcaguacug

SEQ ID NO: 1239825 - RNA, 19 nt, Homo sapiens
cagaugugcuggagacaga

SEQ ID NO: 1239826 - RNA, 19 nt, Homo sapiens
cgaagaaugggaaccuaua

SEQ ID NO: 1239827 - RNA, 19 nt, Homo sapiens
gagaagcuagagaucauaa

SEQ ID NO: 1239828 - RNA, 19 nt, Homo sapiens
acagaaauaucacucaucu

SEQ ID NO: 1239829 - RNA, 19 nt, Homo sapiens
gaucaagccagccaggaaa

SEQ ID NO: 1239830 - RNA, 19 nt, Homo sapiens
gaauccagcauuaagaaga

SEQ ID NO: 1239831 - RNA, 19 nt, Homo sapiens
caaaggaauucugucuuca

SEQ ID NO: 1239832 - RNA, 19 nt, Homo sapiens
gggagagccuggagaugga

SEQ ID NO: 1239833 - RNA, 19 nt, Homo sapiens
ugauugagauguuuaagag

SEQ ID NO: 1239834 - RNA, 19 nt, Homo sapiens
guaaagaucccagagaagu

SEQ ID NO: 1239835 - RNA, 19 nt, Homo sapiens
uggaggaacugccgaaauc

SEQ ID NO: 1239836 - RNA, 19 nt, Homo sapiens
cagagagcguggaccauga

SEQ ID NO: 1239837 - RNA, 19 nt, Homo sapiens
auucagaugucaccuuaaa

SEQ ID NO: 1239838 - RNA, 19 nt, Homo sapiens
caagggcucugacaucaac

SEQ ID NO: 1239839 - RNA, 19 nt, Homo sapiens
ucaccacacuggccaacaa

SEQ ID NO: 1239840 - RNA, 19 nt, Homo sapiens
ugacgagucugaccugagu

SEQ ID NO: 1239841 - RNA, 19 nt, Homo sapiens
cgacagaaauaucacucau

SEQ ID NO: 1239842 - RNA, 19 nt, Homo sapiens
gugcgagccucaacucuca

SEQ ID NO: 1239843 - RNA, 19 nt, Homo sapiens
gcacaaacagcguggucaa

SEQ ID NO: 1239844 - RNA, 19 nt, Homo sapiens
ucagaugucaccuuaaaga

SEQ ID NO: 1239845 - RNA, 19 nt, Homo sapiens
gaagaaugggaaccuauag

SEQ ID NO: 1239846 - RNA, 19 nt, Homo sapiens
ggucaaguaugggcugaug

SEQ ID NO: 1239847 - RNA, 19 nt, Homo sapiens
ggccaacgguccagaugug

SEQ ID NO: 1239848 - RNA, 19 nt, Homo sapiens
gcauaacucauuccacugu

SEQ ID NO: 1239849 - RNA, 19 nt, Homo sapiens
gcaccuuugucugcgagua

SEQ ID NO: 1239850 - RNA, 19 nt, Homo sapiens
ggagaaccgcuacgacugu

SEQ ID NO: 1239851 - RNA, 19 nt, Homo sapiens
uccaguaccugcuuucgaa

SEQ ID NO: 1239852 - RNA, 19 nt, Homo sapiens
gcggagaaguagaaagaag

SEQ ID NO: 1239853 - RNA, 19 nt, Homo sapiens
aaacagaggacggugauug

SEQ ID NO: 1239854 - RNA, 19 nt, Homo sapiens
accaaugggucuugugaaa

SEQ ID NO: 1239855 - RNA, 19 nt, Homo sapiens
gaaaggaaagaccgacagu

SEQ ID NO: 1239856 - RNA, 19 nt, Homo sapiens
cgaaaucgcgucguacaga

SEQ ID NO: 1239857 - RNA, 19 nt, Homo sapiens
caggguacauggaaguuuc

SEQ ID NO: 1239858 - RNA, 19 nt, Homo sapiens
aaacaaccaucuggaagca

SEQ ID NO: 1239859 - RNA, 19 nt, Homo sapiens
gauggcaccaacacacuaa

SEQ ID NO: 1239860 - RNA, 19 nt, Homo sapiens
gagaucauaaggaaccaaa

SEQ ID NO: 1239861 - RNA, 19 nt, Homo sapiens
gcaugcagccaguaaagau

SEQ ID NO: 1239862 - RNA, 19 nt, Homo sapiens
guggagcgcucugcagaug

SEQ ID NO: 1239863 - RNA, 19 nt, Homo sapiens
ggacgucaacugucaggau

SEQ ID NO: 1239864 - RNA, 19 nt, Homo sapiens
ugaaggcucagcagagaaa

SEQ ID NO: 1239865 - RNA, 19 nt, Homo sapiens
ggaucaagccagccaggaa

SEQ ID NO: 1239866 - RNA, 19 nt, Homo sapiens
aauccagcauuaagaagaa

SEQ ID NO: 1239867 - RNA, 19 nt, Homo sapiens
caacacacuaacucggaua

SEQ ID NO: 1239868 - RNA, 19 nt, Homo sapiens
uagccugguuccuaagaaa

SEQ ID NO: 1239869 - RNA, 19 nt, Homo sapiens
caaaagaggagaucaacaa

SEQ ID NO: 1239870 - RNA, 19 nt, Homo sapiens
uaaagaucccagagaaguu

SEQ ID NO: 1239871 - RNA, 19 nt, Homo sapiens
ggagcgcucugcagaugag

SEQ ID NO: 1239872 - RNA, 19 nt, Homo sapiens
ugaagcugcugcuguccaa

SEQ ID NO: 1239873 - RNA, 19 nt, Homo sapiens
aaacagcguggucaaguau

SEQ ID NO: 1239874 - RNA, 19 nt, Homo sapiens
gcacaggguacauggaagu

SEQ ID NO: 1239875 - RNA, 19 nt, Homo sapiens
aaaaggaggcggagaagua

SEQ ID NO: 1239876 - RNA, 19 nt, Homo sapiens
ugcaguaucucggaagaaa

SEQ ID NO: 1239877 - RNA, 19 nt, Homo sapiens
ggccaaagaggugacgaua

SEQ ID NO: 1239878 - RNA, 19 nt, Homo sapiens
uuaagagcauaacucauuc

SEQ ID NO: 1239879 - RNA, 19 nt, Homo sapiens
uuuagcagcugcaguaucu

SEQ ID NO: 1239880 - RNA, 19 nt, Homo sapiens
cagagaaguucgagaagcu

SEQ ID NO: 1239881 - RNA, 19 nt, Homo sapiens
acuacgaagugguccagua

SEQ ID NO: 1239882 - RNA, 19 nt, Homo sapiens
gcacagcggguaauuuuau

SEQ ID NO: 1239883 - RNA, 19 nt, Homo sapiens
ggauggcaccaacacacua

SEQ ID NO: 1239884 - RNA, 19 nt, Homo sapiens
gcaacggauacaucuuaaa

SEQ ID NO: 1239885 - RNA, 19 nt, Homo sapiens
ugagauguuuaagagcaua

SEQ ID NO: 1239886 - RNA, 19 nt, Homo sapiens
gacggugauugagauguuu

SEQ ID NO: 1239887 - RNA, 19 nt, Homo sapiens
gaagcuagagaucauaagg

SEQ ID NO: 1239888 - RNA, 19 nt, Homo sapiens
ucgagaagcuagagaucau

SEQ ID NO: 1239889 - RNA, 19 nt, Homo sapiens
gcucggguuugacuaugga

SEQ ID NO: 1239890 - RNA, 19 nt, Homo sapiens
gcagcucggguuugacuau

SEQ ID NO: 1239891 - RNA, 19 nt, Homo sapiens
ccucuuugaucucgacaau

SEQ ID NO: 1239892 - RNA, 19 nt, Homo sapiens
agauggacgucaacuguca

SEQ ID NO: 1239893 - RNA, 19 nt, Homo sapiens
gaucuccgagucaaaggaa

SEQ ID NO: 1239894 - RNA, 19 nt, Homo sapiens
cagcacaggguacauggaa

SEQ ID NO: 1239895 - RNA, 19 nt, Homo sapiens
agaggacggugauugagau

SEQ ID NO: 1239896 - RNA, 19 nt, Homo sapiens
gaugaaagauggaggauaa

SEQ ID NO: 1239897 - RNA, 19 nt, Homo sapiens
gcugaagacugcuggauga

SEQ ID NO: 1239898 - RNA, 19 nt, Homo sapiens
gaagacugcuggaugaagu

SEQ ID NO: 1239899 - RNA, 19 nt, Homo sapiens
caagaagaacuuaugagua

SEQ ID NO: 1239900 - RNA, 19 nt, Homo sapiens
cggcuaaccugcuguuuga

SEQ ID NO: 1239901 - RNA, 19 nt, Homo sapiens
ggaggcaaacccauuuaua

SEQ ID NO: 1239902 - RNA, 19 nt, Homo sapiens
gaggcaaacccauuuauau

SEQ ID NO: 1239903 - RNA, 19 nt, Homo sapiens
ucaagaggccuaugagaaa

SEQ ID NO: 1239904 - RNA, 19 nt, Homo sapiens
gggauaaucaguagaauuc

SEQ ID NO: 1239905 - RNA, 19 nt, Homo sapiens
gaccuuggaucccuacaga

SEQ ID NO: 1239906 - RNA, 19 nt, Homo sapiens
caggacagcugccggcaaa

SEQ ID NO: 1239907 - RNA, 19 nt, Homo sapiens
cuaaggaacuuggauuaau

SEQ ID NO: 1239908 - RNA, 19 nt, Homo sapiens
gaagucgggauaaucagua

SEQ ID NO: 1239909 - RNA, 19 nt, Homo sapiens
uaagcagucugagaacuaa

SEQ ID NO: 1239910 - RNA, 19 nt, Homo sapiens
gcugugaucuugucgaagu

SEQ ID NO: 1239911 - RNA, 19 nt, Homo sapiens
caacauuucuaaggaacuu

SEQ ID NO: 1239912 - RNA, 19 nt, Homo sapiens
ccaaacagcaacauuucua

SEQ ID NO: 1239913 - RNA, 19 nt, Homo sapiens
gagaucacacaaucacaua

SEQ ID NO: 1239914 - RNA, 19 nt, Homo sapiens
guaagcagucugagaacua

SEQ ID NO: 1239915 - RNA, 19 nt, Homo sapiens
ggagugcaauggcaugauc

SEQ ID NO: 1239916 - RNA, 19 nt, Homo sapiens
gaaugucaaucuuuacaac

SEQ ID NO: 1239917 - RNA, 19 nt, Homo sapiens
cagcaacauuucuaaggaa

SEQ ID NO: 1239918 - RNA, 19 nt, Homo sapiens
gugaugggcugugaucuug

SEQ ID NO: 1239919 - RNA, 19 nt, Homo sapiens
ggacagcugccggcaaauu

SEQ ID NO: 1239920 - RNA, 19 nt, Homo sapiens
gcaaacccauuuauaucag

SEQ ID NO: 1239921 - RNA, 19 nt, Homo sapiens
ccauuuauaucagcuuuga

SEQ ID NO: 1239922 - RNA, 19 nt, Homo sapiens
caaacagcaacauuucuaa

SEQ ID NO: 1239923 - RNA, 19 nt, Homo sapiens
gcuggacgcugccuucauc

SEQ ID NO: 1239924 - RNA, 19 nt, Homo sapiens
ugaaauugcuggucucacu

SEQ ID NO: 1239925 - RNA, 19 nt, Homo sapiens
gaugugaaugucaaucuuu

SEQ ID NO: 1239926 - RNA, 19 nt, Homo sapiens
gggcugugaucuugucgaa

SEQ ID NO: 1239927 - RNA, 19 nt, Homo sapiens
gauaaucaguagaauucuc

SEQ ID NO: 1239928 - RNA, 19 nt, Homo sapiens
ugaguaagcagucugagaa

SEQ ID NO: 1239929 - RNA, 19 nt, Homo sapiens
ccucaugguugcagaccua

SEQ ID NO: 1239930 - RNA, 19 nt, Homo sapiens
guagaauucucacccaaac

SEQ ID NO: 1239931 - RNA, 19 nt, Homo sapiens
caaagugacaaccgucuga

SEQ ID NO: 1239932 - RNA, 19 nt, Homo sapiens
ggcaaacccauuuauauca

SEQ ID NO: 1239933 - RNA, 19 nt, Homo sapiens
cacaaucacauaucccaua

SEQ ID NO: 1239934 - RNA, 19 nt, Homo sapiens
ggguggagaucacacaauc

SEQ ID NO: 1239935 - RNA, 19 nt, Homo sapiens
acagcaacauuucuaagga

SEQ ID NO: 1239936 - RNA, 19 nt, Homo sapiens
gaaagauggaggauaaagg

SEQ ID NO: 1239937 - RNA, 19 nt, Homo sapiens
ugucauugcuggcugugaa

SEQ ID NO: 1239938 - RNA, 19 nt, Homo sapiens
ggagaucacacaaucacau

SEQ ID NO: 1239939 - RNA, 19 nt, Homo sapiens
ucaagaagaacuuaugagu

SEQ ID NO: 1239940 - RNA, 19 nt, Homo sapiens
ccuuggaucccuacagaua

SEQ ID NO: 1239941 - RNA, 19 nt, Homo sapiens
gaucacacaaucacauauc

SEQ ID NO: 1239942 - RNA, 19 nt, Homo sapiens
aagaguuuaugccaagaaa

SEQ ID NO: 1239943 - RNA, 19 nt, Homo sapiens
uugcgucgcugacaaguuc

SEQ ID NO: 1239944 - RNA, 19 nt, Homo sapiens
cagauugcgucgcugacaa

SEQ ID NO: 1239945 - RNA, 19 nt, Homo sapiens
ggguaguccuggcugaaga

SEQ ID NO: 1239946 - RNA, 19 nt, Homo sapiens
guaagcguguggugcagau

SEQ ID NO: 1239947 - RNA, 19 nt, Homo sapiens
gcugugaagucgggauaau

SEQ ID NO: 1239948 - RNA, 19 nt, Homo sapiens
gaugggcugugaucuuguc

SEQ ID NO: 1239949 - RNA, 19 nt, Homo sapiens
cgaugugaaugucaaucuu

SEQ ID NO: 1239950 - RNA, 19 nt, Homo sapiens
cacccaaacagcaacauuu

SEQ ID NO: 1239951 - RNA, 19 nt, Homo sapiens
gacaaccgucugagucuug

SEQ ID NO: 1239952 - RNA, 19 nt, Homo sapiens
gugggcgucugcuccauga

SEQ ID NO: 1239953 - RNA, 19 nt, Homo sapiens
gcugaaggugcggaaguua

SEQ ID NO: 1239954 - RNA, 19 nt, Homo sapiens
gcuaaccugcuguuugaga

SEQ ID NO: 1239955 - RNA, 19 nt, Homo sapiens
gaaguuucaccaccguaug

SEQ ID NO: 1239956 - RNA, 19 nt, Homo sapiens
gacaaggcccuaggagaga

SEQ ID NO: 1239957 - RNA, 19 nt, Homo sapiens
gcggcuaaccugcuguuug

SEQ ID NO: 1239958 - RNA, 19 nt, Homo sapiens
ucaccaccguaugaucuuu

SEQ ID NO: 1239959 - RNA, 19 nt, Homo sapiens
gucaaggccugaacgugau

SEQ ID NO: 1239960 - RNA, 19 nt, Homo sapiens
caagaggccuaugagaaaa

SEQ ID NO: 1239961 - RNA, 19 nt, Homo sapiens
gacagcugccggcaaauuc

SEQ ID NO: 1239962 - RNA, 19 nt, Homo sapiens
ugacaaccgucugagucuu

SEQ ID NO: 1239963 - RNA, 19 nt, Homo sapiens
agaccuaggcgaugugaau

SEQ ID NO: 1239964 - RNA, 19 nt, Homo sapiens
gcuaugugcucuccccaaa

SEQ ID NO: 1239965 - RNA, 19 nt, Homo sapiens
gagggucuccuggacugua

SEQ ID NO: 1239966 - RNA, 19 nt, Homo sapiens
aaacccaucucugcugaag

SEQ ID NO: 1239967 - RNA, 19 nt, Homo sapiens
ucuaaggaacuuggauuaa

SEQ ID NO: 1239968 - RNA, 19 nt, Homo sapiens
acaaggcccuaggagagaa

SEQ ID NO: 1239969 - RNA, 19 nt, Homo sapiens
ugaucucgguucauugcaa

SEQ ID NO: 1239970 - RNA, 19 nt, Homo sapiens
ugaacgugaugggcuguga

SEQ ID NO: 1239971 - RNA, 19 nt, Homo sapiens
gggaggcaaacccauuuau

SEQ ID NO: 1239972 - RNA, 19 nt, Homo sapiens
cuaaccugcuguuugagau

SEQ ID NO: 1239973 - RNA, 19 nt, Homo sapiens
uacuuguacugcuuugauu

SEQ ID NO: 1239974 - RNA, 19 nt, Homo sapiens
ucucaagaagaacuuauga

SEQ ID NO: 1239975 - RNA, 19 nt, Homo sapiens
gcaaauucaagaggccuau

SEQ ID NO: 1239976 - RNA, 19 nt, Homo sapiens
gggcgucugcuccaugaug

SEQ ID NO: 1239977 - RNA, 19 nt, Homo sapiens
aaauucaagaggccuauga

SEQ ID NO: 1239978 - RNA, 19 nt, Homo sapiens
cgaaguuucaccaccguau

SEQ ID NO: 1239979 - RNA, 19 nt, Homo sapiens
ggaagucaggcagcagaug

SEQ ID NO: 1239980 - RNA, 19 nt, Homo sapiens
ugugaagucgggauaauca

SEQ ID NO: 1239981 - RNA, 19 nt, Homo sapiens
gcagucugagaacuaaaga

SEQ ID NO: 1239982 - RNA, 19 nt, Homo sapiens
gugaaugucaaucuuuaca

SEQ ID NO: 1239983 - RNA, 19 nt, Homo sapiens
gaccuuggguggagaucac

SEQ ID NO: 1239984 - RNA, 19 nt, Homo sapiens
gaacgugaugggcugugau

SEQ ID NO: 1239985 - RNA, 19 nt, Homo sapiens
aggcaaacccauuuauauc

SEQ ID NO: 1239986 - RNA, 19 nt, Homo sapiens
aaacagcaacauuucuaag

SEQ ID NO: 1239987 - RNA, 19 nt, Homo sapiens
cgggauaaucaguagaauu

SEQ ID NO: 1239988 - RNA, 19 nt, Homo sapiens
uucaagaggccuaugagaa

SEQ ID NO: 1239989 - RNA, 19 nt, Homo sapiens
gcagaccuaggcgauguga

SEQ ID NO: 1239990 - RNA, 19 nt, Homo sapiens
gucaggcucuggagaucau

SEQ ID NO: 1239991 - RNA, 19 nt, Homo sapiens
acacggacacgaccgacaa

SEQ ID NO: 1239992 - RNA, 19 nt, Homo sapiens
acccaucucugcugaaggu

SEQ ID NO: 1239993 - RNA, 19 nt, Homo sapiens
uaggcgaugugaaugucaa

SEQ ID NO: 1239994 - RNA, 19 nt, Homo sapiens
ucgauucuccugccucaug

SEQ ID NO: 1239995 - RNA, 19 nt, Homo sapiens
ugucaaucuuuacaaccuu

SEQ ID NO: 1239996 - RNA, 19 nt, Homo sapiens
gcacaaggcugacacauaa

SEQ ID NO: 1239997 - RNA, 19 nt, Homo sapiens
caagaacaguacaguauua

SEQ ID NO: 1239998 - RNA, 19 nt, Homo sapiens
ggaagugacucaacaaaga

SEQ ID NO: 1239999 - RNA, 19 nt, Homo sapiens
gaagaaagaggucuaaaug

SEQ ID NO: 1240000 - RNA, 19 nt, Homo sapiens
gaacauauuuacuggugaa

SEQ ID NO: 1240001 - RNA, 19 nt, Homo sapiens
caacaguggugccaguuaa

SEQ ID NO: 1240002 - RNA, 19 nt, Homo sapiens
ccacgaaacucuacaauac

SEQ ID NO: 1240003 - RNA, 19 nt, Homo sapiens
gaaacuuggugaucaguau

SEQ ID NO: 1240004 - RNA, 19 nt, Homo sapiens
gcaggaauguugcacagaa

SEQ ID NO: 1240005 - RNA, 19 nt, Homo sapiens
gcacagaaacauacauuug

SEQ ID NO: 1240006 - RNA, 19 nt, Homo sapiens
agaggaaguuuaagaagua

SEQ ID NO: 1240007 - RNA, 19 nt, Homo sapiens
gcaacagucuuauauugau

SEQ ID NO: 1240008 - RNA, 19 nt, Homo sapiens
gaaaaggaaugaagcauau

SEQ ID NO: 1240009 - RNA, 19 nt, Homo sapiens
ggaagaggaaguuuaagaa

SEQ ID NO: 1240010 - RNA, 19 nt, Homo sapiens
guaaggaagaggaaguuua

SEQ ID NO: 1240011 - RNA, 19 nt, Homo sapiens
uaaggaagaggaaguuuaa

SEQ ID NO: 1240012 - RNA, 19 nt, Homo sapiens
gaaauauucucaccuucag

SEQ ID NO: 1240013 - RNA, 19 nt, Homo sapiens
ggacucugcuuguuucagu

SEQ ID NO: 1240014 - RNA, 19 nt, Homo sapiens
gucaguugcuucacuuuaa

SEQ ID NO: 1240015 - RNA, 19 nt, Homo sapiens
gcaagaacaguacaguauu

SEQ ID NO: 1240016 - RNA, 19 nt, Homo sapiens
caucauugcagguaucaua

SEQ ID NO: 1240017 - RNA, 19 nt, Homo sapiens
gacgagcugucacugaauu

SEQ ID NO: 1240018 - RNA, 19 nt, Homo sapiens
guaggacucugcuuguuuc

SEQ ID NO: 1240019 - RNA, 19 nt, Homo sapiens
ggaccucucccuagugauu

SEQ ID NO: 1240020 - RNA, 19 nt, Homo sapiens
gauggcaguuccugaucua

SEQ ID NO: 1240021 - RNA, 19 nt, Homo sapiens
cauugcagguaucauauuu

SEQ ID NO: 1240022 - RNA, 19 nt, Homo sapiens
gcaacuaacuuaccccauu

SEQ ID NO: 1240023 - RNA, 19 nt, Homo sapiens
ucucaggcaugaucacuuu

SEQ ID NO: 1240024 - RNA, 19 nt, Homo sapiens
guagugccauuauuucugu

SEQ ID NO: 1240025 - RNA, 19 nt, Homo sapiens
ggaaugugauuuggagugu

SEQ ID NO: 1240026 - RNA, 19 nt, Homo sapiens
ccuaagcucugacagucua

SEQ ID NO: 1240027 - RNA, 19 nt, Homo sapiens
guuauucgauaccaccuuu

SEQ ID NO: 1240028 - RNA, 19 nt, Homo sapiens
cugcaacagucuuauauug

SEQ ID NO: 1240029 - RNA, 19 nt, Homo sapiens
cauauuuacuggugaacuu

SEQ ID NO: 1240030 - RNA, 19 nt, Homo sapiens
gaacuuugcagccuaugga

SEQ ID NO: 1240031 - RNA, 19 nt, Homo sapiens
gauggcuguuggccuguua

SEQ ID NO: 1240032 - RNA, 19 nt, Homo sapiens
caagucaaguuccugaauc

SEQ ID NO: 1240033 - RNA, 19 nt, Homo sapiens
gaaugaagcauauggugau

SEQ ID NO: 1240034 - RNA, 19 nt, Homo sapiens
uaggaacaaugcagagauu

SEQ ID NO: 1240035 - RNA, 19 nt, Homo sapiens
gaaguaggacucugcuugu

SEQ ID NO: 1240036 - RNA, 19 nt, Homo sapiens
gcauucuccuguauuucua

SEQ ID NO: 1240037 - RNA, 19 nt, Homo sapiens
guacgacacuggcauuugc

SEQ ID NO: 1240038 - RNA, 19 nt, Homo sapiens
ggcauucagugauagugua

SEQ ID NO: 1240039 - RNA, 19 nt, Homo sapiens
agaaagaggucuaaaugcu

SEQ ID NO: 1240040 - RNA, 19 nt, Homo sapiens
aaauauaacucaggcaauc

SEQ ID NO: 1240041 - RNA, 19 nt, Homo sapiens
gcugacacauaaauucaug

SEQ ID NO: 1240042 - RNA, 19 nt, Homo sapiens
ggaaccagauucaccuuuu

SEQ ID NO: 1240043 - RNA, 19 nt, Homo sapiens
uacaaucagugccaucauu

SEQ ID NO: 1240044 - RNA, 19 nt, Homo sapiens
ggccauacuucaagagugu

SEQ ID NO: 1240045 - RNA, 19 nt, Homo sapiens
gaagaggaaguuuaagaag

SEQ ID NO: 1240046 - RNA, 19 nt, Homo sapiens
gucagcagcucuuuuauaa

SEQ ID NO: 1240047 - RNA, 19 nt, Homo sapiens
gagccaaaguggagagaag

SEQ ID NO: 1240048 - RNA, 19 nt, Homo sapiens
gaaauauuccugacacaac

SEQ ID NO: 1240049 - RNA, 19 nt, Homo sapiens
gucauuccuugguguauuu

SEQ ID NO: 1240050 - RNA, 19 nt, Homo sapiens
ucaguugcuucacuuuaaa

SEQ ID NO: 1240051 - RNA, 19 nt, Homo sapiens
gcucugacagucuaauauu

SEQ ID NO: 1240052 - RNA, 19 nt, Homo sapiens
gaacaucugcaacagucuu

SEQ ID NO: 1240053 - RNA, 19 nt, Homo sapiens
gauagcaucuuguguuuuc

SEQ ID NO: 1240054 - RNA, 19 nt, Homo sapiens
caugauagcaucuuguguu

SEQ ID NO: 1240055 - RNA, 19 nt, Homo sapiens
ccaaggccauacuucaaga

SEQ ID NO: 1240056 - RNA, 19 nt, Homo sapiens
guaggacuaauguuuguuu

SEQ ID NO: 1240057 - RNA, 19 nt, Homo sapiens
ggugaucaguauuucucua

SEQ ID NO: 1240058 - RNA, 19 nt, Homo sapiens
ggcaguuccugaucuaugu

SEQ ID NO: 1240059 - RNA, 19 nt, Homo sapiens
caggaauguugcacagaaa

SEQ ID NO: 1240060 - RNA, 19 nt, Homo sapiens
gccacgaaacucuacaaua

SEQ ID NO: 1240061 - RNA, 19 nt, Homo sapiens
ggaaacuuggugaucagua

SEQ ID NO: 1240062 - RNA, 19 nt, Homo sapiens
caacuaacuuaccccauuu

SEQ ID NO: 1240063 - RNA, 19 nt, Homo sapiens
ccuuucaaguacuaaguua

SEQ ID NO: 1240064 - RNA, 19 nt, Homo sapiens
gcauucauuucaguccuuu

SEQ ID NO: 1240065 - RNA, 19 nt, Homo sapiens
agaaaggcuuggagggaaa

SEQ ID NO: 1240066 - RNA, 19 nt, Homo sapiens
acagguagugccauuauuu

SEQ ID NO: 1240067 - RNA, 19 nt, Homo sapiens
aaaguaggacuaauguuug

SEQ ID NO: 1240068 - RNA, 19 nt, Homo sapiens
aagaggaaguuuaagaagu

SEQ ID NO: 1240069 - RNA, 19 nt, Homo sapiens
caaccucacucccaaaaga

SEQ ID NO: 1240070 - RNA, 19 nt, Homo sapiens
gagagaagaaagaggucua

SEQ ID NO: 1240071 - RNA, 19 nt, Homo sapiens
uggacgagcugucacugaa

SEQ ID NO: 1240072 - RNA, 19 nt, Homo sapiens
ugaagcauauggugauucu

SEQ ID NO: 1240073 - RNA, 19 nt, Homo sapiens
caggcaaucucagcaagaa

SEQ ID NO: 1240074 - RNA, 19 nt, Homo sapiens
uuaggaaacuuggugauca

SEQ ID NO: 1240075 - RNA, 19 nt, Homo sapiens
ggaacaaugcagagauuag

SEQ ID NO: 1240076 - RNA, 19 nt, Homo sapiens
aaaucucaccuuucaagua

SEQ ID NO: 1240077 - RNA, 19 nt, Homo sapiens
ggccacaggucgcauaggu

SEQ ID NO: 1240078 - RNA, 19 nt, Homo sapiens
uaacuuaccccauuuucua

SEQ ID NO: 1240079 - RNA, 19 nt, Homo sapiens
gaaaauuaagggucucuuu

SEQ ID NO: 1240080 - RNA, 19 nt, Homo sapiens
aaucucaccuuucaaguac

SEQ ID NO: 1240081 - RNA, 19 nt, Homo sapiens
cagcuacaccuuacucaga

SEQ ID NO: 1240082 - RNA, 19 nt, Homo sapiens
caucugcaacagucuuaua

SEQ ID NO: 1240083 - RNA, 19 nt, Homo sapiens
gaguuuugcuggcuauuuu

SEQ ID NO: 1240084 - RNA, 19 nt, Homo sapiens
cagcaagaacaguacagua

SEQ ID NO: 1240085 - RNA, 19 nt, Homo sapiens
ggaaguuuaagaaguagga

SEQ ID NO: 1240086 - RNA, 19 nt, Homo sapiens
agucuaauauuuccaugga

SEQ ID NO: 1240087 - RNA, 19 nt, Homo sapiens
guuggccuguuauucgaua

SEQ ID NO: 1240088 - RNA, 19 nt, Homo sapiens
ggauggcaguuccugaucu

SEQ ID NO: 1240089 - RNA, 19 nt, Homo sapiens
gaacaguacaguauuaccu

SEQ ID NO: 1240090 - RNA, 19 nt, Homo sapiens
gugaucaguauuucucuaa

SEQ ID NO: 1240091 - RNA, 19 nt, Homo sapiens
agaauugcaagucaucuuu

SEQ ID NO: 1240092 - RNA, 19 nt, Homo sapiens
gaaugugauuuggaguguu

SEQ ID NO: 1240093 - RNA, 19 nt, Homo sapiens
uggcaauucuagccucauu

SEQ ID NO: 1240094 - RNA, 19 nt, Homo sapiens
ucugcauucuccuguauuu

SEQ ID NO: 1240095 - RNA, 19 nt, Homo sapiens
gcauuugcaggaacauauu

SEQ ID NO: 1240096 - RNA, 19 nt, Homo sapiens
gagcaacucuggcggauuu

SEQ ID NO: 1240097 - RNA, 19 nt, Homo sapiens
ggaaacgucuuacagauug

SEQ ID NO: 1240098 - RNA, 19 nt, Homo sapiens
gcagauaggaaacgucuua

SEQ ID NO: 1240099 - RNA, 19 nt, Homo sapiens
ucagggaccucaaggguua

SEQ ID NO: 1240100 - RNA, 19 nt, Homo sapiens
uaaaucggcucaagcaguu

SEQ ID NO: 1240101 - RNA, 19 nt, Homo sapiens
caauucaagucucagauaa

SEQ ID NO: 1240102 - RNA, 19 nt, Homo sapiens
gcagccaacuccaggguuu

SEQ ID NO: 1240103 - RNA, 19 nt, Homo sapiens
gcuacugccuugaagauga

SEQ ID NO: 1240104 - RNA, 19 nt, Homo sapiens
gaacaucacaagcagauag

SEQ ID NO: 1240105 - RNA, 19 nt, Homo sapiens
gcucuccgacgcugaauua

SEQ ID NO: 1240106 - RNA, 19 nt, Homo sapiens
gaucuagucugugguguag

SEQ ID NO: 1240107 - RNA, 19 nt, Homo sapiens
gaccagaggaccaucauga

SEQ ID NO: 1240108 - RNA, 19 nt, Homo sapiens
uaauaaagcacccgggaaa

SEQ ID NO: 1240109 - RNA, 19 nt, Homo sapiens
ccaauucaagucucagaua

SEQ ID NO: 1240110 - RNA, 19 nt, Homo sapiens
ucaugaaaccucuggagua

SEQ ID NO: 1240111 - RNA, 19 nt, Homo sapiens
gcugugacgucucuuccaa

SEQ ID NO: 1240112 - RNA, 19 nt, Homo sapiens
ccagaggaccaucaugaaa

SEQ ID NO: 1240113 - RNA, 19 nt, Homo sapiens
uaggaaacgucuuacagau

SEQ ID NO: 1240114 - RNA, 19 nt, Homo sapiens
gaaaagcacuucgccuugu

SEQ ID NO: 1240115 - RNA, 19 nt, Homo sapiens
caagacaggaacacaaguu

SEQ ID NO: 1240116 - RNA, 19 nt, Homo sapiens
gcccgacucuggcuaaagu

SEQ ID NO: 1240117 - RNA, 19 nt, Homo sapiens
uaucagggcauucuaaauc

SEQ ID NO: 1240118 - RNA, 19 nt, Homo sapiens
ugacgucucuuccaacaac

SEQ ID NO: 1240119 - RNA, 19 nt, Homo sapiens
ugaaaccucuggaguacca

SEQ ID NO: 1240120 - RNA, 19 nt, Homo sapiens
caugaaaccucuggaguac

SEQ ID NO: 1240121 - RNA, 19 nt, Homo sapiens
ggucucaccugcugaacca

SEQ ID NO: 1240122 - RNA, 19 nt, Homo sapiens
gccaucacguguaauaaag

SEQ ID NO: 1240123 - RNA, 19 nt, Homo sapiens
cuccgacgcugaauuauca

SEQ ID NO: 1240124 - RNA, 19 nt, Homo sapiens
ggucaagggcuacaacauc

SEQ ID NO: 1240125 - RNA, 19 nt, Homo sapiens
gaaacgucuuacagauugu

SEQ ID NO: 1240126 - RNA, 19 nt, Homo sapiens
ucaagaguaucguggucaa

SEQ ID NO: 1240127 - RNA, 19 nt, Homo sapiens
gaaagcaaggcaccaggau

SEQ ID NO: 1240128 - RNA, 19 nt, Homo sapiens
gucaagggcuacaacaucu

SEQ ID NO: 1240129 - RNA, 19 nt, Homo sapiens
caaggguuauccugaugga

SEQ ID NO: 1240130 - RNA, 19 nt, Homo sapiens
ccucaaggguuauccugau

SEQ ID NO: 1240131 - RNA, 19 nt, Homo sapiens
guucaccuguggcagaaga

SEQ ID NO: 1240132 - RNA, 19 nt, Homo sapiens
gauaggaaacgucuuacag

SEQ ID NO: 1240133 - RNA, 19 nt, Homo sapiens
ccuugaagaugaccucuag

SEQ ID NO: 1240134 - RNA, 19 nt, Homo sapiens
gggcaagcguuggaaugga

SEQ ID NO: 1240135 - RNA, 19 nt, Homo sapiens
ccugaggacuuugaagaug

SEQ ID NO: 1240136 - RNA, 19 nt, Homo sapiens
auucaagucucagauaaug

SEQ ID NO: 1240137 - RNA, 19 nt, Homo sapiens
gcucaccgguggcuacaac

SEQ ID NO: 1240138 - RNA, 19 nt, Homo sapiens
cugauggagucaagaguau

SEQ ID NO: 1240139 - RNA, 19 nt, Homo sapiens
gagagccaccugccuauac

SEQ ID NO: 1240140 - RNA, 19 nt, Homo sapiens
caucacguguaauaaagca

SEQ ID NO: 1240141 - RNA, 19 nt, Homo sapiens
ccagugguguggucaggau

SEQ ID NO: 1240142 - RNA, 19 nt, Homo sapiens
cgacuuccuuggcgucuac

SEQ ID NO: 1240143 - RNA, 19 nt, Homo sapiens
ccugauggagucaagagua

SEQ ID NO: 1240144 - RNA, 19 nt, Homo sapiens
gcagaagaggcaucaaggu

SEQ ID NO: 1240145 - RNA, 19 nt, Homo sapiens
gagcuuugaggacaucaug

SEQ ID NO: 1240146 - RNA, 19 nt, Homo sapiens
acuacucgcugcacaagau

SEQ ID NO: 1240147 - RNA, 19 nt, Homo sapiens
cagaacaucacaagcagau

SEQ ID NO: 1240148 - RNA, 19 nt, Homo sapiens
cgccaucacguguaauaaa

SEQ ID NO: 1240149 - RNA, 19 nt, Homo sapiens
gcauggaagaggccagaug

SEQ ID NO: 1240150 - RNA, 19 nt, Homo sapiens
agacccauguccugaagau

SEQ ID NO: 1240151 - RNA, 19 nt, Homo sapiens
cugcaggagucgagcuuug

SEQ ID NO: 1240152 - RNA, 19 nt, Homo sapiens
caucacaagcagauaggaa

SEQ ID NO: 1240153 - RNA, 19 nt, Homo sapiens
ggcaaagcccagagacaga

SEQ ID NO: 1240154 - RNA, 19 nt, Homo sapiens
ccagcaggauguggcagaa

SEQ ID NO: 1240155 - RNA, 19 nt, Homo sapiens
cgaggugccugagaugucu

SEQ ID NO: 1240156 - RNA, 19 nt, Homo sapiens
ggaguaccaauucaagucu

SEQ ID NO: 1240157 - RNA, 19 nt, Homo sapiens
ccucuggaguaccaauuca

SEQ ID NO: 1240158 - RNA, 19 nt, Homo sapiens
ccacggccaucagcagcuu

SEQ ID NO: 1240159 - RNA, 19 nt, Homo sapiens
aggaaacgucuuacagauu

SEQ ID NO: 1240160 - RNA, 19 nt, Homo sapiens
gcguuggaauggacgacuu

SEQ ID NO: 1240161 - RNA, 19 nt, Homo sapiens
cagguuuucuccucauuuu

SEQ ID NO: 1240162 - RNA, 19 nt, Homo sapiens
cccagcaggugaaggacaa

SEQ ID NO: 1240163 - RNA, 19 nt, Homo sapiens
auaggaaacgucuuacaga

SEQ ID NO: 1240164 - RNA, 19 nt, Homo sapiens
ugugacgucucuuccaaca

SEQ ID NO: 1240165 - RNA, 19 nt, Homo sapiens
ggaguuggagagcauuuac

SEQ ID NO: 1240166 - RNA, 19 nt, Homo sapiens
agagccaccugccuauaca

SEQ ID NO: 1240167 - RNA, 19 nt, Homo sapiens
ccugaggguucccaagaca

SEQ ID NO: 1240168 - RNA, 19 nt, Homo sapiens
uggcagaacaucacaagca

SEQ ID NO: 1240169 - RNA, 19 nt, Homo sapiens
cgaucuagucuguggugua

SEQ ID NO: 1240170 - RNA, 19 nt, Homo sapiens
uguaccagaucaccuacug

SEQ ID NO: 1240171 - RNA, 19 nt, Homo sapiens
ugagagccaccugccuaua

SEQ ID NO: 1240172 - RNA, 19 nt, Homo sapiens
cugggacccugaggacuuu

SEQ ID NO: 1240173 - RNA, 19 nt, Homo sapiens
cagaggaccaucaugaaac

SEQ ID NO: 1240174 - RNA, 19 nt, Homo sapiens
guccugggaucucgaacuc

SEQ ID NO: 1240175 - RNA, 19 nt, Homo sapiens
gucgccaucacguguaaua

SEQ ID NO: 1240176 - RNA, 19 nt, Homo sapiens
guaccagaucaccuacuga

SEQ ID NO: 1240177 - RNA, 19 nt, Homo sapiens
uggagagcauuuacuacuc

SEQ ID NO: 1240178 - RNA, 19 nt, Homo sapiens
ucugggaccugcgggauca

SEQ ID NO: 1240179 - RNA, 19 nt, Homo sapiens
ugaggacuuugaagaugca

SEQ ID NO: 1240180 - RNA, 19 nt, Homo sapiens
acagacccauguccugaag

SEQ ID NO: 1240181 - RNA, 19 nt, Homo sapiens
caagugagcuucaaccuua

SEQ ID NO: 1240182 - RNA, 19 nt, Homo sapiens
gcguaaagcugacaaguua

SEQ ID NO: 1240183 - RNA, 19 nt, Homo sapiens
ccaaagaacuuccuucaga

SEQ ID NO: 1240184 - RNA, 19 nt, Homo sapiens
gaagaaacuuugagagguu

SEQ ID NO: 1240185 - RNA, 19 nt, Homo sapiens
ggaaguagauaagaaugua

SEQ ID NO: 1240186 - RNA, 19 nt, Homo sapiens
gaacacugauacugcauaa

SEQ ID NO: 1240187 - RNA, 19 nt, Homo sapiens
gcaauaagccuuccuuuca

SEQ ID NO: 1240188 - RNA, 19 nt, Homo sapiens
caacaacgaggaaauauuu

SEQ ID NO: 1240189 - RNA, 19 nt, Homo sapiens
ggaagagacugguuacuag

SEQ ID NO: 1240190 - RNA, 19 nt, Homo sapiens
uaagagcauuguccuauaa

SEQ ID NO: 1240191 - RNA, 19 nt, Homo sapiens
gaaaugugccucucugauu

SEQ ID NO: 1240192 - RNA, 19 nt, Homo sapiens
ccagacggcugacuuguaa

SEQ ID NO: 1240193 - RNA, 19 nt, Homo sapiens
ggaaaucauucaagaggaa

SEQ ID NO: 1240194 - RNA, 19 nt, Homo sapiens
gguaaauucuggcaaacua

SEQ ID NO: 1240195 - RNA, 19 nt, Homo sapiens
gcucugaucugugguuuaa

SEQ ID NO: 1240196 - RNA, 19 nt, Homo sapiens
ucacuuaucugucuuguca

SEQ ID NO: 1240197 - RNA, 19 nt, Homo sapiens
gcuacaaacacuucuauua

SEQ ID NO: 1240198 - RNA, 19 nt, Homo sapiens
aggaugaucucaaguauaa

SEQ ID NO: 1240199 - RNA, 19 nt, Homo sapiens
ccacaucacucucuguuau

SEQ ID NO: 1240200 - RNA, 19 nt, Homo sapiens
gaaaggaagcgaaagagaa

SEQ ID NO: 1240201 - RNA, 19 nt, Homo sapiens
ggagggaaguagauaagaa

SEQ ID NO: 1240202 - RNA, 19 nt, Homo sapiens
ggaaaacucuuagauagua

SEQ ID NO: 1240203 - RNA, 19 nt, Homo sapiens
ugagaugcgugucguauuu

SEQ ID NO: 1240204 - RNA, 19 nt, Homo sapiens
ccaugaaacugaacacuga

SEQ ID NO: 1240205 - RNA, 19 nt, Homo sapiens
gaaaaucucugcagucaau

SEQ ID NO: 1240206 - RNA, 19 nt, Homo sapiens
ccacuccucugccacguua

SEQ ID NO: 1240207 - RNA, 19 nt, Homo sapiens
gaauaaugcaucuguacua

SEQ ID NO: 1240208 - RNA, 19 nt, Homo sapiens
gcagucagaugauauagca

SEQ ID NO: 1240209 - RNA, 19 nt, Homo sapiens
gaucacaaguacauaaaca

SEQ ID NO: 1240210 - RNA, 19 nt, Homo sapiens
cauagcauuucccuaauaa

SEQ ID NO: 1240211 - RNA, 19 nt, Homo sapiens
ccauagcauuucccuaaua

SEQ ID NO: 1240212 - RNA, 19 nt, Homo sapiens
gcaggaugaucucaaguau

SEQ ID NO: 1240213 - RNA, 19 nt, Homo sapiens
aaucagagcuuuauuugca

SEQ ID NO: 1240214 - RNA, 19 nt, Homo sapiens
gaagaaaggaaagcuguuu

SEQ ID NO: 1240215 - RNA, 19 nt, Homo sapiens
gaucaacaacgaggaaaua

SEQ ID NO: 1240216 - RNA, 19 nt, Homo sapiens
gaaggcggcugugcaguug

SEQ ID NO: 1240217 - RNA, 19 nt, Homo sapiens
gagaaauacugaucuagag

SEQ ID NO: 1240218 - RNA, 19 nt, Homo sapiens
cauaugaaauuuccacuca

SEQ ID NO: 1240219 - RNA, 19 nt, Homo sapiens
caugauuacugcaguguuu

SEQ ID NO: 1240220 - RNA, 19 nt, Homo sapiens
uuagaaagguccaaagaug

SEQ ID NO: 1240221 - RNA, 19 nt, Homo sapiens
cagaagacagucagaauaa

SEQ ID NO: 1240222 - RNA, 19 nt, Homo sapiens
caaacagggucuucacguu

SEQ ID NO: 1240223 - RNA, 19 nt, Homo sapiens
gagcacacacucccuaauu

SEQ ID NO: 1240224 - RNA, 19 nt, Homo sapiens
uaaaugaguuucguugaug

SEQ ID NO: 1240225 - RNA, 19 nt, Homo sapiens
gaagacagucagaauaaug

SEQ ID NO: 1240226 - RNA, 19 nt, Homo sapiens
ggaccacccuggcugaaau

SEQ ID NO: 1240227 - RNA, 19 nt, Homo sapiens
gcauggaaauucuauagca

SEQ ID NO: 1240228 - RNA, 19 nt, Homo sapiens
caggacacauacauuuaua

SEQ ID NO: 1240229 - RNA, 19 nt, Homo sapiens
gacaagauaggcaaaguuu

SEQ ID NO: 1240230 - RNA, 19 nt, Homo sapiens
caaagaacuuccuucagau

SEQ ID NO: 1240231 - RNA, 19 nt, Homo sapiens
ggaucaaccucaucuaugg

SEQ ID NO: 1240232 - RNA, 19 nt, Homo sapiens
gcagggaagagacugguua

SEQ ID NO: 1240233 - RNA, 19 nt, Homo sapiens
gguguucccuucccaaaga

SEQ ID NO: 1240234 - RNA, 19 nt, Homo sapiens
gaccagcagugaacaugaa

SEQ ID NO: 1240235 - RNA, 19 nt, Homo sapiens
ugaaggcuauuaccaguug

SEQ ID NO: 1240236 - RNA, 19 nt, Homo sapiens
gcauucaucccuuuccaua

SEQ ID NO: 1240237 - RNA, 19 nt, Homo sapiens
gcauugcagucagaugaua

SEQ ID NO: 1240238 - RNA, 19 nt, Homo sapiens
ggacacauacauuuauaga

SEQ ID NO: 1240239 - RNA, 19 nt, Homo sapiens
gaaaauaaguugcagacau

SEQ ID NO: 1240240 - RNA, 19 nt, Homo sapiens
gugcaucaguuguuaaugu

SEQ ID NO: 1240241 - RNA, 19 nt, Homo sapiens
ugaauauguuccugcauuu

SEQ ID NO: 1240242 - RNA, 19 nt, Homo sapiens
ucacagagauccagagaac

SEQ ID NO: 1240243 - RNA, 19 nt, Homo sapiens
ccagaagacagucagaaua

SEQ ID NO: 1240244 - RNA, 19 nt, Homo sapiens
cgccuaagcuuuacuggaa

SEQ ID NO: 1240245 - RNA, 19 nt, Homo sapiens
gagaagaccauguccauag

SEQ ID NO: 1240246 - RNA, 19 nt, Homo sapiens
auacugaucuagagucauu

SEQ ID NO: 1240247 - RNA, 19 nt, Homo sapiens
auucaucccuuuccauaua

SEQ ID NO: 1240248 - RNA, 19 nt, Homo sapiens
cgagauacagguuacauuu

SEQ ID NO: 1240249 - RNA, 19 nt, Homo sapiens
gaacuuuggcacauucuga

SEQ ID NO: 1240250 - RNA, 19 nt, Homo sapiens
ggcauucucuguugaccua

SEQ ID NO: 1240251 - RNA, 19 nt, Homo sapiens
gaaaugacgagcaggaugu

SEQ ID NO: 1240252 - RNA, 19 nt, Homo sapiens
gagagaugauuaggaagaa

SEQ ID NO: 1240253 - RNA, 19 nt, Homo sapiens
ggagagaugauuaggaaga

SEQ ID NO: 1240254 - RNA, 19 nt, Homo sapiens
gcugugaucucucccugaa

SEQ ID NO: 1240255 - RNA, 19 nt, Homo sapiens
gggaagagacugguuacua

SEQ ID NO: 1240256 - RNA, 19 nt, Homo sapiens
ucaugacacugacauuauu

SEQ ID NO: 1240257 - RNA, 19 nt, Homo sapiens
gaaagauuauagugaguac

SEQ ID NO: 1240258 - RNA, 19 nt, Homo sapiens
caucauuccuugucucuuc

SEQ ID NO: 1240259 - RNA, 19 nt, Homo sapiens
cggcuguaauugagaaaua

SEQ ID NO: 1240260 - RNA, 19 nt, Homo sapiens
ggaccuuuguuauucauuc

SEQ ID NO: 1240261 - RNA, 19 nt, Homo sapiens
ccucugcaauacacaguua

SEQ ID NO: 1240262 - RNA, 19 nt, Homo sapiens
gagcuaacuuccuccuuuc

SEQ ID NO: 1240263 - RNA, 19 nt, Homo sapiens
aggauccaaucaagaauua

SEQ ID NO: 1240264 - RNA, 19 nt, Homo sapiens
ccacagaacuuuggcacau

SEQ ID NO: 1240265 - RNA, 19 nt, Homo sapiens
cauaauacuuccagugauc

SEQ ID NO: 1240266 - RNA, 19 nt, Homo sapiens
uuugguacguguagauuua

SEQ ID NO: 1240267 - RNA, 19 nt, Homo sapiens
guacaugaaccuucuuaug

SEQ ID NO: 1240268 - RNA, 19 nt, Homo sapiens
ccagagaacagaaacaaga

SEQ ID NO: 1240269 - RNA, 19 nt, Homo sapiens
gcugacaaguuaccaguuc

SEQ ID NO: 1240270 - RNA, 19 nt, Homo sapiens
guccauagcauuucccuaa

SEQ ID NO: 1240271 - RNA, 19 nt, Homo sapiens
ugauguaacucaacgugaa

SEQ ID NO: 1240272 - RNA, 19 nt, Homo sapiens
caaaggaucacaaguacau

SEQ ID NO: 1240273 - RNA, 19 nt, Homo sapiens
gaacucuucuaggguaaau

SEQ ID NO: 1240274 - RNA, 19 nt, Homo sapiens
gcacuaaugaacucuucua

SEQ ID NO: 1240275 - RNA, 19 nt, Homo sapiens
gcugcuaccucaccauguu

SEQ ID NO: 1240276 - RNA, 19 nt, Homo sapiens
ggagcuagagccuuugaaa

SEQ ID NO: 1240277 - RNA, 19 nt, Homo sapiens
ucuauagcauucuuuggua

SEQ ID NO: 1240278 - RNA, 19 nt, Homo sapiens
agccagaggugaaauauuc

SEQ ID NO: 1240279 - RNA, 19 nt, Homo sapiens
auaagagcauuguccuaua

SEQ ID NO: 1240280 - RNA, 19 nt, Homo sapiens
ggacaagauaggcaaaguu

SEQ ID NO: 1240281 - RNA, 19 nt, Homo sapiens
gaaauccucuagcaaauau

SEQ ID NO: 1240282 - RNA, 19 nt, Homo sapiens
gauuuacucugcuguauaa

SEQ ID NO: 1240283 - RNA, 19 nt, Homo sapiens
gcagacaaccauugauuua

SEQ ID NO: 1240284 - RNA, 19 nt, Homo sapiens
gaggaugcaugaaacauuu

SEQ ID NO: 1240285 - RNA, 19 nt, Homo sapiens
uauuugagcuguaggauaa

SEQ ID NO: 1240286 - RNA, 19 nt, Homo sapiens
ggucugcucuccuuggaua

SEQ ID NO: 1240287 - RNA, 19 nt, Homo sapiens
ugaguaagauccugugauu

SEQ ID NO: 1240288 - RNA, 19 nt, Homo sapiens
ggagaaaggccauaugaau

SEQ ID NO: 1240289 - RNA, 19 nt, Homo sapiens
gcaaaucucuucacuucgu

SEQ ID NO: 1240290 - RNA, 19 nt, Homo sapiens
ccaaagauauacucaguca

SEQ ID NO: 1240291 - RNA, 19 nt, Homo sapiens
gccgaaagcuccagucuca

SEQ ID NO: 1240292 - RNA, 19 nt, Homo sapiens
gcacaaguaccaccucauu

SEQ ID NO: 1240293 - RNA, 19 nt, Homo sapiens
ggaaauccucuagcaaaua

SEQ ID NO: 1240294 - RNA, 19 nt, Homo sapiens
gagaauacacaccugagua

SEQ ID NO: 1240295 - RNA, 19 nt, Homo sapiens
uaugacagcuucaguaauc

SEQ ID NO: 1240296 - RNA, 19 nt, Homo sapiens
gagaaaggccauaugaaug

SEQ ID NO: 1240297 - RNA, 19 nt, Homo sapiens
ugggauaugugggaaauua

SEQ ID NO: 1240298 - RNA, 19 nt, Homo sapiens
ggaguacaguggcauaauc

SEQ ID NO: 1240299 - RNA, 19 nt, Homo sapiens
guauucaccuggagccuuu

SEQ ID NO: 1240300 - RNA, 19 nt, Homo sapiens
gggaaauccucuagcaaau

SEQ ID NO: 1240301 - RNA, 19 nt, Homo sapiens
ugacugauguaauaaagug

SEQ ID NO: 1240302 - RNA, 19 nt, Homo sapiens
ggauuauaguuaacacuga

SEQ ID NO: 1240303 - RNA, 19 nt, Homo sapiens
ccacaccucuguauuccuu

SEQ ID NO: 1240304 - RNA, 19 nt, Homo sapiens
agaagaguccuuacaagua

SEQ ID NO: 1240305 - RNA, 19 nt, Homo sapiens
aguccagucucauuaaaua

SEQ ID NO: 1240306 - RNA, 19 nt, Homo sapiens
ccauaugaaugcagugauu

SEQ ID NO: 1240307 - RNA, 19 nt, Homo sapiens
aggcaaaucucuucacuuc

SEQ ID NO: 1240308 - RNA, 19 nt, Homo sapiens
ggaguucacacuagagaaa

SEQ ID NO: 1240309 - RNA, 19 nt, Homo sapiens
ucaaggaguucacacuaga

SEQ ID NO: 1240310 - RNA, 19 nt, Homo sapiens
gaaaccaucaucagaguca

SEQ ID NO: 1240311 - RNA, 19 nt, Homo sapiens
gagaagaguccuuacaagu

SEQ ID NO: 1240312 - RNA, 19 nt, Homo sapiens
gcuccagucucacuaaaca

SEQ ID NO: 1240313 - RNA, 19 nt, Homo sapiens
ggagagaagccauaugagu

SEQ ID NO: 1240314 - RNA, 19 nt, Homo sapiens
ggaggaugcaugaaacauu

SEQ ID NO: 1240315 - RNA, 19 nt, Homo sapiens
ggauaagucuugaauuuuc

SEQ ID NO: 1240316 - RNA, 19 nt, Homo sapiens
caucaucagagucacaaua

SEQ ID NO: 1240317 - RNA, 19 nt, Homo sapiens
caccaccacuccuaccuuu

SEQ ID NO: 1240318 - RNA, 19 nt, Homo sapiens
caccaaagauauacucagu

SEQ ID NO: 1240319 - RNA, 19 nt, Homo sapiens
gagccgagauugcaacacu

SEQ ID NO: 1240320 - RNA, 19 nt, Homo sapiens
ccagucucauuaaauauug

SEQ ID NO: 1240321 - RNA, 19 nt, Homo sapiens
ggauaugugggaaauuauu

SEQ ID NO: 1240322 - RNA, 19 nt, Homo sapiens
caucagagucacaauaaug

SEQ ID NO: 1240323 - RNA, 19 nt, Homo sapiens
gccaggaaguucucaaucu

SEQ ID NO: 1240324 - RNA, 19 nt, Homo sapiens
ccuaauagcugggacuaca

SEQ ID NO: 1240325 - RNA, 19 nt, Homo sapiens
gaaugaaggccuuacuagu

SEQ ID NO: 1240326 - RNA, 19 nt, Homo sapiens
caggauuacuccagcaaga

SEQ ID NO: 1240327 - RNA, 19 nt, Homo sapiens
agaauacacaccugaguaa

SEQ ID NO: 1240328 - RNA, 19 nt, Homo sapiens
caaaagaaagggcuuauga

SEQ ID NO: 1240329 - RNA, 19 nt, Homo sapiens
cuacauuccguguucauaa

SEQ ID NO: 1240330 - RNA, 19 nt, Homo sapiens
ucaccuggagccuuuauaa

SEQ ID NO: 1240331 - RNA, 19 nt, Homo sapiens
ucuaaucuaucaccuuugu

SEQ ID NO: 1240332 - RNA, 19 nt, Homo sapiens
gaaagcuccagucucacua

SEQ ID NO: 1240333 - RNA, 19 nt, Homo sapiens
acacuggucagaagccuua

SEQ ID NO: 1240334 - RNA, 19 nt, Homo sapiens
aaauaugacagcuucagua

SEQ ID NO: 1240335 - RNA, 19 nt, Homo sapiens
uuacuagugugacaaauac

SEQ ID NO: 1240336 - RNA, 19 nt, Homo sapiens
ggagaguucacacuagaga

SEQ ID NO: 1240337 - RNA, 19 nt, Homo sapiens
cagcaaauguggaaaaugu

SEQ ID NO: 1240338 - RNA, 19 nt, Homo sapiens
gauugugggaagucauuua

SEQ ID NO: 1240339 - RNA, 19 nt, Homo sapiens
gaaaggccauaugaaugca

SEQ ID NO: 1240340 - RNA, 19 nt, Homo sapiens
ugagguuugucagaaauuu

SEQ ID NO: 1240341 - RNA, 19 nt, Homo sapiens
caucaaggaguucacacua

SEQ ID NO: 1240342 - RNA, 19 nt, Homo sapiens
gcaaccaccaccacuccua

SEQ ID NO: 1240343 - RNA, 19 nt, Homo sapiens
ugccucagccucccuaaua

SEQ ID NO: 1240344 - RNA, 19 nt, Homo sapiens
ucagagaguucacaaaaga

SEQ ID NO: 1240345 - RNA, 19 nt, Homo sapiens
gugaaugugggaaaucuuu

SEQ ID NO: 1240346 - RNA, 19 nt, Homo sapiens
ggucagaagccuuaugagu

SEQ ID NO: 1240347 - RNA, 19 nt, Homo sapiens
ccauaugagugugagguuu

SEQ ID NO: 1240348 - RNA, 19 nt, Homo sapiens
agacaaccauugauuuacu

SEQ ID NO: 1240349 - RNA, 19 nt, Homo sapiens
gugggaggauugcuacaug

SEQ ID NO: 1240350 - RNA, 19 nt, Homo sapiens
gcagugagccgagauugca

SEQ ID NO: 1240351 - RNA, 19 nt, Homo sapiens
auacacaccugaguaagau

SEQ ID NO: 1240352 - RNA, 19 nt, Homo sapiens
agagacugcucccuacaga

SEQ ID NO: 1240353 - RNA, 19 nt, Homo sapiens
aaagaaagggcuuaugagu

SEQ ID NO: 1240354 - RNA, 19 nt, Homo sapiens
aauaugacagcuucaguaa

SEQ ID NO: 1240355 - RNA, 19 nt, Homo sapiens
ccaggaaguucucaaucuc

SEQ ID NO: 1240356 - RNA, 19 nt, Homo sapiens
agugagacccuguuucaaa

SEQ ID NO: 1240357 - RNA, 19 nt, Homo sapiens
aaugaaggccuuacuagug

SEQ ID NO: 1240358 - RNA, 19 nt, Homo sapiens
uagagaagaguccuuacaa

SEQ ID NO: 1240359 - RNA, 19 nt, Homo sapiens
gcaagaggccacucacacu

SEQ ID NO: 1240360 - RNA, 19 nt, Homo sapiens
ugggaaauccucuagcaaa

SEQ ID NO: 1240361 - RNA, 19 nt, Homo sapiens
gagugugugucucuguuuc

SEQ ID NO: 1240362 - RNA, 19 nt, Homo sapiens
agagaagaguccuuacaag

SEQ ID NO: 1240363 - RNA, 19 nt, Homo sapiens
ucuaucaccuuuguauuca

SEQ ID NO: 1240364 - RNA, 19 nt, Homo sapiens
ccuucaggauuauaguuaa

SEQ ID NO: 1240365 - RNA, 19 nt, Homo sapiens
cagcuucaguaaucaucaa

SEQ ID NO: 1240366 - RNA, 19 nt, Homo sapiens
gcuguaggauaagucuuga

SEQ ID NO: 1240367 - RNA, 19 nt, Homo sapiens
gaaaauguuuacccaaagg

SEQ ID NO: 1240368 - RNA, 19 nt, Homo sapiens
gcaaauguggaaaauguuu

SEQ ID NO: 1240369 - RNA, 19 nt, Homo sapiens
gugugagguuugucagaaa

SEQ ID NO: 1240370 - RNA, 19 nt, Homo sapiens
gugagacccuguuucaaaa

SEQ ID NO: 1240371 - RNA, 19 nt, Homo sapiens
agagugagacccuguuuca

SEQ ID NO: 1240372 - RNA, 19 nt, Homo sapiens
ugugacaaauacaggauau

SEQ ID NO: 1240373 - RNA, 19 nt, Homo sapiens
augaaggccuuacuagugu

SEQ ID NO: 1240374 - RNA, 19 nt, Homo sapiens
ggaaaauguuuacccaaag

SEQ ID NO: 1240375 - RNA, 19 nt, Homo sapiens
guaagauccugugauugca

SEQ ID NO: 1240376 - RNA, 19 nt, Homo sapiens
gcuuaugagugcagugagu

SEQ ID NO: 1240377 - RNA, 19 nt, Homo sapiens
ugauuuacucugcuguaua

SEQ ID NO: 1240378 - RNA, 19 nt, Homo sapiens
gacaaccauugauuuacuc

SEQ ID NO: 1240379 - RNA, 19 nt, Homo sapiens
gcuccuggcuugaauuuuc

SEQ ID NO: 1240380 - RNA, 19 nt, Homo sapiens
cuuacuagugugacaaaua

SEQ ID NO: 1240381 - RNA, 19 nt, Homo sapiens
ccacucagaugcaauauua

SEQ ID NO: 1240382 - RNA, 19 nt, Homo sapiens
ggacuagacuguuaugauu

SEQ ID NO: 1240383 - RNA, 19 nt, Homo sapiens
gcaaugaccuauauguuga

SEQ ID NO: 1240384 - RNA, 19 nt, Homo sapiens
gaaaaggacuagacuguua

SEQ ID NO: 1240385 - RNA, 19 nt, Homo sapiens
ugaagaagcugagaaagua

SEQ ID NO: 1240386 - RNA, 19 nt, Homo sapiens
gaaacuaguucucuaaugg

SEQ ID NO: 1240387 - RNA, 19 nt, Homo sapiens
ccaaauggguuauacgaaa

SEQ ID NO: 1240388 - RNA, 19 nt, Homo sapiens
caaauguacuuccuaaaga

SEQ ID NO: 1240389 - RNA, 19 nt, Homo sapiens
agaaauacaugcagaagaa

SEQ ID NO: 1240390 - RNA, 19 nt, Homo sapiens
gaaaguaacucagagaaac

SEQ ID NO: 1240391 - RNA, 19 nt, Homo sapiens
gaacuacagcugccaguaa

SEQ ID NO: 1240392 - RNA, 19 nt, Homo sapiens
gaagauaaaggcauaaugu

SEQ ID NO: 1240393 - RNA, 19 nt, Homo sapiens
gcagaagaaucaacaauac

SEQ ID NO: 1240394 - RNA, 19 nt, Homo sapiens
caaauuucaucaggacuua

SEQ ID NO: 1240395 - RNA, 19 nt, Homo sapiens
ggaggaggaagaagaaaua

SEQ ID NO: 1240396 - RNA, 19 nt, Homo sapiens
cuauggaacuuguaucuuu

SEQ ID NO: 1240397 - RNA, 19 nt, Homo sapiens
agaaauaugccuacuguuu

SEQ ID NO: 1240398 - RNA, 19 nt, Homo sapiens
gaacuuguaucuuuaucag

SEQ ID NO: 1240399 - RNA, 19 nt, Homo sapiens
ugagaaauaugccuacugu

SEQ ID NO: 1240400 - RNA, 19 nt, Homo sapiens
ugaagagccugaagauguu

SEQ ID NO: 1240401 - RNA, 19 nt, Homo sapiens
gcaaauguacuuccuaaag

SEQ ID NO: 1240402 - RNA, 19 nt, Homo sapiens
gaaggaggaggaagaagaa

SEQ ID NO: 1240403 - RNA, 19 nt, Homo sapiens
gaagaccacucagaugcaa

SEQ ID NO: 1240404 - RNA, 19 nt, Homo sapiens
ggaaucaaguucacaacca

SEQ ID NO: 1240405 - RNA, 19 nt, Homo sapiens
gagauaauacucacagaga

SEQ ID NO: 1240406 - RNA, 19 nt, Homo sapiens
ccaaggguccaguguauaa

SEQ ID NO: 1240407 - RNA, 19 nt, Homo sapiens
guacggagcaacaguaaug

SEQ ID NO: 1240408 - RNA, 19 nt, Homo sapiens
aagcaaauguacuuccuaa

SEQ ID NO: 1240409 - RNA, 19 nt, Homo sapiens
uaugggcacuuuggauuua

SEQ ID NO: 1240410 - RNA, 19 nt, Homo sapiens
gaaaggaugaugcagacuu

SEQ ID NO: 1240411 - RNA, 19 nt, Homo sapiens
gaaacagauuaggcaauga

SEQ ID NO: 1240412 - RNA, 19 nt, Homo sapiens
gaaguccuuuguagaaaca

SEQ ID NO: 1240413 - RNA, 19 nt, Homo sapiens
ccagggagcacuacagaaa

SEQ ID NO: 1240414 - RNA, 19 nt, Homo sapiens
aauggaagauaaaggcaua

SEQ ID NO: 1240415 - RNA, 19 nt, Homo sapiens
caagaauuaugaaguccuu

SEQ ID NO: 1240416 - RNA, 19 nt, Homo sapiens
gaaauaugccuacuguuuu

SEQ ID NO: 1240417 - RNA, 19 nt, Homo sapiens
ggccagaacguauuuauca

SEQ ID NO: 1240418 - RNA, 19 nt, Homo sapiens
gcuugcugcuggucaauaa

SEQ ID NO: 1240419 - RNA, 19 nt, Homo sapiens
gaagaagcugagaaaguaa

SEQ ID NO: 1240420 - RNA, 19 nt, Homo sapiens
ggcaaugaccuauauguug

SEQ ID NO: 1240421 - RNA, 19 nt, Homo sapiens
guuaugauuugaugcgauu

SEQ ID NO: 1240422 - RNA, 19 nt, Homo sapiens
agaaacagauuaggcaaug

SEQ ID NO: 1240423 - RNA, 19 nt, Homo sapiens
guucacaaccauucucuuu

SEQ ID NO: 1240424 - RNA, 19 nt, Homo sapiens
uguauaaagugacauggaa

SEQ ID NO: 1240425 - RNA, 19 nt, Homo sapiens
caacaauacccgccaacuu

SEQ ID NO: 1240426 - RNA, 19 nt, Homo sapiens
gaugcagacuuucaaugga

SEQ ID NO: 1240427 - RNA, 19 nt, Homo sapiens
gaaucaaguucacaaccau

SEQ ID NO: 1240428 - RNA, 19 nt, Homo sapiens
gagaacaggguggagauuu

SEQ ID NO: 1240429 - RNA, 19 nt, Homo sapiens
gauuugaugcgauuaaaga

SEQ ID NO: 1240430 - RNA, 19 nt, Homo sapiens
caacuacaguggauagaac

SEQ ID NO: 1240431 - RNA, 19 nt, Homo sapiens
ugaaacuaguucucuaaug

SEQ ID NO: 1240432 - RNA, 19 nt, Homo sapiens
aaaccaaucagcauaauuc

SEQ ID NO: 1240433 - RNA, 19 nt, Homo sapiens
ggaggaagaagaaauacau

SEQ ID NO: 1240434 - RNA, 19 nt, Homo sapiens
gacagaaacacugagauuu

SEQ ID NO: 1240435 - RNA, 19 nt, Homo sapiens
agacagugauggacagguu

SEQ ID NO: 1240436 - RNA, 19 nt, Homo sapiens
agaacaggguggagauuug

SEQ ID NO: 1240437 - RNA, 19 nt, Homo sapiens
gaacaagaucgaggaacaa

SEQ ID NO: 1240438 - RNA, 19 nt, Homo sapiens
ggaccuguauggcaacuac

SEQ ID NO: 1240439 - RNA, 19 nt, Homo sapiens
gcccaaacuugcagcuuau

SEQ ID NO: 1240440 - RNA, 19 nt, Homo sapiens
gagaaaguaacucagagaa

SEQ ID NO: 1240441 - RNA, 19 nt, Homo sapiens
ccaaucagcauaauucauc

SEQ ID NO: 1240442 - RNA, 19 nt, Homo sapiens
ggagauauaauggauacuu

SEQ ID NO: 1240443 - RNA, 19 nt, Homo sapiens
agaacaagaucgaggaaca

SEQ ID NO: 1240444 - RNA, 19 nt, Homo sapiens
uaugaaguccuuuguagaa

SEQ ID NO: 1240445 - RNA, 19 nt, Homo sapiens
caauggagcaccaaagaau

SEQ ID NO: 1240446 - RNA, 19 nt, Homo sapiens
cauggucucuguagaaucu

SEQ ID NO: 1240447 - RNA, 19 nt, Homo sapiens
gggauuuguaugauucuua

SEQ ID NO: 1240448 - RNA, 19 nt, Homo sapiens
gcauaauucaucauuccua

SEQ ID NO: 1240449 - RNA, 19 nt, Homo sapiens
guguaugaacugagaaaua

SEQ ID NO: 1240450 - RNA, 19 nt, Homo sapiens
cuacuucuguuguuuacga

SEQ ID NO: 1240451 - RNA, 19 nt, Homo sapiens
uaacucagagaaacaagaa

SEQ ID NO: 1240452 - RNA, 19 nt, Homo sapiens
gcuaugggcacuuuggauu

SEQ ID NO: 1240453 - RNA, 19 nt, Homo sapiens
ggauuuguaugauucuuac

SEQ ID NO: 1240454 - RNA, 19 nt, Homo sapiens
ugaccuauauguugaaagg

SEQ ID NO: 1240455 - RNA, 19 nt, Homo sapiens
gguccaguguauaaaguga

SEQ ID NO: 1240456 - RNA, 19 nt, Homo sapiens
caauaaagaaucccaugug

SEQ ID NO: 1240457 - RNA, 19 nt, Homo sapiens
gagcagccuugccuggaau

SEQ ID NO: 1240458 - RNA, 19 nt, Homo sapiens
agcccaaacuugcagcuua

SEQ ID NO: 1240459 - RNA, 19 nt, Homo sapiens
agacagaaacacugagauu

SEQ ID NO: 1240460 - RNA, 19 nt, Homo sapiens
gagcaccaaagaauaaaga

SEQ ID NO: 1240461 - RNA, 19 nt, Homo sapiens
ucacaaccauucucuuugc

SEQ ID NO: 1240462 - RNA, 19 nt, Homo sapiens
ggaagaagaaauacaugca

SEQ ID NO: 1240463 - RNA, 19 nt, Homo sapiens
cugaagagccugaagaugu

SEQ ID NO: 1240464 - RNA, 19 nt, Homo sapiens
ggaagauaaaggcauaaug

SEQ ID NO: 1240465 - RNA, 19 nt, Homo sapiens
gacguugccuggucuccaa

SEQ ID NO: 1240466 - RNA, 19 nt, Homo sapiens
gccguuggcuaucacaaug

SEQ ID NO: 1240467 - RNA, 19 nt, Homo sapiens
uggaacgacuuuggucuuu

SEQ ID NO: 1240468 - RNA, 19 nt, Homo sapiens
gaagaaauacaugcagaag

SEQ ID NO: 1240469 - RNA, 19 nt, Homo sapiens
aaaagaaccugaaccugaa

SEQ ID NO: 1240470 - RNA, 19 nt, Homo sapiens
gagauuugggaccuucaua

SEQ ID NO: 1240471 - RNA, 19 nt, Homo sapiens
cagcuacuucuguuguuua

SEQ ID NO: 1240472 - RNA, 19 nt, Homo sapiens
ccagcuacuucuguuguuu

SEQ ID NO: 1240473 - RNA, 19 nt, Homo sapiens
guauuuaucagaguccaua

SEQ ID NO: 1240474 - RNA, 19 nt, Homo sapiens
caccaaagaauaaagaugu

SEQ ID NO: 1240475 - RNA, 19 nt, Homo sapiens
agacuguuaugauuugaug

SEQ ID NO: 1240476 - RNA, 19 nt, Homo sapiens
acuagacuguuaugauuug

SEQ ID NO: 1240477 - RNA, 19 nt, Homo sapiens
caaauggguuauacgaaaa

SEQ ID NO: 1240478 - RNA, 19 nt, Homo sapiens
gcaacuacaguggauagaa

SEQ ID NO: 1240479 - RNA, 19 nt, Homo sapiens
gaguuacugcuguggauuu

SEQ ID NO: 1240480 - RNA, 19 nt, Homo sapiens
aacaauacccgccaacuug

SEQ ID NO: 1240481 - RNA, 19 nt, Homo sapiens
ggaaaugucuauaaacuca

SEQ ID NO: 1240482 - RNA, 19 nt, Homo sapiens
gcacaugguucuuauacaa

SEQ ID NO: 1240483 - RNA, 19 nt, Homo sapiens
ggucucaacuuaagcauaa

SEQ ID NO: 1240484 - RNA, 19 nt, Homo sapiens
gaaacgaucuacagcaaga

SEQ ID NO: 1240485 - RNA, 19 nt, Homo sapiens
caacuucacuggcauuuau

SEQ ID NO: 1240486 - RNA, 19 nt, Homo sapiens
gaacacauggugaucauaa

SEQ ID NO: 1240487 - RNA, 19 nt, Homo sapiens
gaaagugcacccaacaaua

SEQ ID NO: 1240488 - RNA, 19 nt, Homo sapiens
gcacaaaggaucagaaguu

SEQ ID NO: 1240489 - RNA, 19 nt, Homo sapiens
gcaagaaguucggcaauau

SEQ ID NO: 1240490 - RNA, 19 nt, Homo sapiens
agaaagguauugcaacaua

SEQ ID NO: 1240491 - RNA, 19 nt, Homo sapiens
gaagaaaccaagagaaguu

SEQ ID NO: 1240492 - RNA, 19 nt, Homo sapiens
ucacauuccuagcaaauuu

SEQ ID NO: 1240493 - RNA, 19 nt, Homo sapiens
gaaccaaauucacaaucaa

SEQ ID NO: 1240494 - RNA, 19 nt, Homo sapiens
uaauaaagcuggaaauguc

SEQ ID NO: 1240495 - RNA, 19 nt, Homo sapiens
gcaaaggaauggacgaaca

SEQ ID NO: 1240496 - RNA, 19 nt, Homo sapiens
caagagaaguuuucaagua

SEQ ID NO: 1240497 - RNA, 19 nt, Homo sapiens
gcaaacccauaccaagaaa

SEQ ID NO: 1240498 - RNA, 19 nt, Homo sapiens
uaagaaagguauugcaaca

SEQ ID NO: 1240499 - RNA, 19 nt, Homo sapiens
ggacgaacauggaaaauau

SEQ ID NO: 1240500 - RNA, 19 nt, Homo sapiens
uaaacucacucuugauuca

SEQ ID NO: 1240501 - RNA, 19 nt, Homo sapiens
aaugagagcucuuguuugu

SEQ ID NO: 1240502 - RNA, 19 nt, Homo sapiens
gccaauuccuagaacaaua

SEQ ID NO: 1240503 - RNA, 19 nt, Homo sapiens
gaaaaccgguaaauucaaa

SEQ ID NO: 1240504 - RNA, 19 nt, Homo sapiens
gaagauacagauauagaga

SEQ ID NO: 1240505 - RNA, 19 nt, Homo sapiens
ucuauaaacucacucuuga

SEQ ID NO: 1240506 - RNA, 19 nt, Homo sapiens
cagcacaccuccuuagaug

SEQ ID NO: 1240507 - RNA, 19 nt, Homo sapiens
ucacuggcauuuauuaugu

SEQ ID NO: 1240508 - RNA, 19 nt, Homo sapiens
gcacaccuccuuagaugaa

SEQ ID NO: 1240509 - RNA, 19 nt, Homo sapiens
ugaaugagagcucuuguuu

SEQ ID NO: 1240510 - RNA, 19 nt, Homo sapiens
cgcuuuaaguuuccaauua

SEQ ID NO: 1240511 - RNA, 19 nt, Homo sapiens
aaacuuugccgauaaacua

SEQ ID NO: 1240512 - RNA, 19 nt, Homo sapiens
cacaauauccaguuucuuu

SEQ ID NO: 1240513 - RNA, 19 nt, Homo sapiens
cacaaaggaucagaaguuu

SEQ ID NO: 1240514 - RNA, 19 nt, Homo sapiens
caagaaguucggcaauaua

SEQ ID NO: 1240515 - RNA, 19 nt, Homo sapiens
gaucagaaguuuucacaug

SEQ ID NO: 1240516 - RNA, 19 nt, Homo sapiens
ggaggacauuccaaagaug

SEQ ID NO: 1240517 - RNA, 19 nt, Homo sapiens
gaguguaacugcacaaagg

SEQ ID NO: 1240518 - RNA, 19 nt, Homo sapiens
gcuauuccacucacagaua

SEQ ID NO: 1240519 - RNA, 19 nt, Homo sapiens
gaccgucauuucaggagua

SEQ ID NO: 1240520 - RNA, 19 nt, Homo sapiens
cuacaggccuccaucuaau

SEQ ID NO: 1240521 - RNA, 19 nt, Homo sapiens
ccuaauuuguuggaaguua

SEQ ID NO: 1240522 - RNA, 19 nt, Homo sapiens
uggaaacccuaauuuguug

SEQ ID NO: 1240523 - RNA, 19 nt, Homo sapiens
caacauacgacuccuaaag

SEQ ID NO: 1240524 - RNA, 19 nt, Homo sapiens
gcacaacuggaaacugaaa

SEQ ID NO: 1240525 - RNA, 19 nt, Homo sapiens
aggcacaacuggaaacuga

SEQ ID NO: 1240526 - RNA, 19 nt, Homo sapiens
gcaauauacacuauggaaa

SEQ ID NO: 1240527 - RNA, 19 nt, Homo sapiens
ucuacugagugcuuuguua

SEQ ID NO: 1240528 - RNA, 19 nt, Homo sapiens
caccaucccucaacauugu

SEQ ID NO: 1240529 - RNA, 19 nt, Homo sapiens
ugagagcucuuguuugucu

SEQ ID NO: 1240530 - RNA, 19 nt, Homo sapiens
caaucuccauaucugguua

SEQ ID NO: 1240531 - RNA, 19 nt, Homo sapiens
aaucaggaaugggaagaua

SEQ ID NO: 1240532 - RNA, 19 nt, Homo sapiens
aaagugcacccaacaauau

SEQ ID NO: 1240533 - RNA, 19 nt, Homo sapiens
agagaagacuguagugcuu

SEQ ID NO: 1240534 - RNA, 19 nt, Homo sapiens
caaagauggauuagaagaa

SEQ ID NO: 1240535 - RNA, 19 nt, Homo sapiens
ccaacaauaugaccuuucu

SEQ ID NO: 1240536 - RNA, 19 nt, Homo sapiens
guuccucgcuuuaaguuuc

SEQ ID NO: 1240537 - RNA, 19 nt, Homo sapiens
cuauuccacucacagauaa

SEQ ID NO: 1240538 - RNA, 19 nt, Homo sapiens
uacagcagcuuccucauca

SEQ ID NO: 1240539 - RNA, 19 nt, Homo sapiens
gcucuuguuugucuaguuc

SEQ ID NO: 1240540 - RNA, 19 nt, Homo sapiens
ccacagccuuuggaaauuc

SEQ ID NO: 1240541 - RNA, 19 nt, Homo sapiens
cacuugggauuccuacaua

SEQ ID NO: 1240542 - RNA, 19 nt, Homo sapiens
cauaaagggcucugaacuu

SEQ ID NO: 1240543 - RNA, 19 nt, Homo sapiens
cuccauaucugguuacugu

SEQ ID NO: 1240544 - RNA, 19 nt, Homo sapiens
uuaguggaguucauaaaga

SEQ ID NO: 1240545 - RNA, 19 nt, Homo sapiens
ggaauggacgaacauggaa

SEQ ID NO: 1240546 - RNA, 19 nt, Homo sapiens
gauuagaagaagugaauga

SEQ ID NO: 1240547 - RNA, 19 nt, Homo sapiens
ugacugaagugaacaugag

SEQ ID NO: 1240548 - RNA, 19 nt, Homo sapiens
gaaugagagcucuuguuug

SEQ ID NO: 1240549 - RNA, 19 nt, Homo sapiens
aaacugcuacuugucaaua

SEQ ID NO: 1240550 - RNA, 19 nt, Homo sapiens
ccaaagauggauuagaaga

SEQ ID NO: 1240551 - RNA, 19 nt, Homo sapiens
ucaugcagauccuagcaaa

SEQ ID NO: 1240552 - RNA, 19 nt, Homo sapiens
ugacuguguuuguuggaaa

SEQ ID NO: 1240553 - RNA, 19 nt, Homo sapiens
gcuaaggucauacggaaug

SEQ ID NO: 1240554 - RNA, 19 nt, Homo sapiens
gcuuuaaguuuccaauuac

SEQ ID NO: 1240555 - RNA, 19 nt, Homo sapiens
uagcaaacccauaccaaga

SEQ ID NO: 1240556 - RNA, 19 nt, Homo sapiens
ggcaacagcgguagugcua

SEQ ID NO: 1240557 - RNA, 19 nt, Homo sapiens
gaaguuacagcugaaguca

SEQ ID NO: 1240558 - RNA, 19 nt, Homo sapiens
gaaguguuacugagagaau

SEQ ID NO: 1240559 - RNA, 19 nt, Homo sapiens
ccaggacacacgcuuauug

SEQ ID NO: 1240560 - RNA, 19 nt, Homo sapiens
gagcacaugguucuuauac

SEQ ID NO: 1240561 - RNA, 19 nt, Homo sapiens
guucggcaauauacacuau

SEQ ID NO: 1240562 - RNA, 19 nt, Homo sapiens
gcucugaacuuuuccacuu

SEQ ID NO: 1240563 - RNA, 19 nt, Homo sapiens
gaaaagcagcuguaguuau

SEQ ID NO: 1240564 - RNA, 19 nt, Homo sapiens
cuaguucccuuuugauuaa

SEQ ID NO: 1240565 - RNA, 19 nt, Homo sapiens
cauaagaaagguauugcaa

SEQ ID NO: 1240566 - RNA, 19 nt, Homo sapiens
ccagauaugggcuuugaga

SEQ ID NO: 1240567 - RNA, 19 nt, Homo sapiens
uccuucaggucucaacuua

SEQ ID NO: 1240568 - RNA, 19 nt, Homo sapiens
ucaaacagugugcuaaugu

SEQ ID NO: 1240569 - RNA, 19 nt, Homo sapiens
aaaagcagcuguaguuauc

SEQ ID NO: 1240570 - RNA, 19 nt, Homo sapiens
cgacaauggugccaacacu

SEQ ID NO: 1240571 - RNA, 19 nt, Homo sapiens
cccucaacauugugaaaua

SEQ ID NO: 1240572 - RNA, 19 nt, Homo sapiens
cuaaagagcacaugguucu

SEQ ID NO: 1240573 - RNA, 19 nt, Homo sapiens
gcagcuuccucaucacaag

SEQ ID NO: 1240574 - RNA, 19 nt, Homo sapiens
guacagcagcuuccucauc

SEQ ID NO: 1240575 - RNA, 19 nt, Homo sapiens
ggcaauauacacuauggaa

SEQ ID NO: 1240576 - RNA, 19 nt, Homo sapiens
agcaagaaguucggcaaua

SEQ ID NO: 1240577 - RNA, 19 nt, Homo sapiens
aggaaacgaucuacagcaa

SEQ ID NO: 1240578 - RNA, 19 nt, Homo sapiens
ucaaacugcuacuugucaa

SEQ ID NO: 1240579 - RNA, 19 nt, Homo sapiens
cuucaggucucaacuuaag

SEQ ID NO: 1240580 - RNA, 19 nt, Homo sapiens
aaagaaaaccgguaaauuc

SEQ ID NO: 1240581 - RNA, 19 nt, Homo sapiens
gaaagacccuggagugaaa

SEQ ID NO: 1240582 - RNA, 19 nt, Homo sapiens
gaagcaaacacucugauua

SEQ ID NO: 1240583 - RNA, 19 nt, Homo sapiens
gaacauuucuacagugaug

SEQ ID NO: 1240584 - RNA, 19 nt, Homo sapiens
gcacuuuccuuccuaaaug

SEQ ID NO: 1240585 - RNA, 19 nt, Homo sapiens
uagagaagcugcaguaaug

SEQ ID NO: 1240586 - RNA, 19 nt, Homo sapiens
caaacacucugauuaugaa

SEQ ID NO: 1240587 - RNA, 19 nt, Homo sapiens
ccacauaggcagucauaua

SEQ ID NO: 1240588 - RNA, 19 nt, Homo sapiens
gcaauaccgugaagaacuu

SEQ ID NO: 1240589 - RNA, 19 nt, Homo sapiens
gcaaacacucugauuauga

SEQ ID NO: 1240590 - RNA, 19 nt, Homo sapiens
gaagguuccgucuuucuua

SEQ ID NO: 1240591 - RNA, 19 nt, Homo sapiens
ccacgaugcuauugaagaa

SEQ ID NO: 1240592 - RNA, 19 nt, Homo sapiens
guauuccucuucacuauug

SEQ ID NO: 1240593 - RNA, 19 nt, Homo sapiens
gaacaaaacagagaaagua

SEQ ID NO: 1240594 - RNA, 19 nt, Homo sapiens
aaacauguauuccucuuca

SEQ ID NO: 1240595 - RNA, 19 nt, Homo sapiens
ccauucaacucaacaauca

SEQ ID NO: 1240596 - RNA, 19 nt, Homo sapiens
ggaaucaggucuggaaucu

SEQ ID NO: 1240597 - RNA, 19 nt, Homo sapiens
aaguagaccuuucguagaa

SEQ ID NO: 1240598 - RNA, 19 nt, Homo sapiens
agaagcagcucccaagugu

SEQ ID NO: 1240599 - RNA, 19 nt, Homo sapiens
caaguaagaagaaugaaug

SEQ ID NO: 1240600 - RNA, 19 nt, Homo sapiens
ucuggaaucugaaggaauu

SEQ ID NO: 1240601 - RNA, 19 nt, Homo sapiens
ugagaaaguugaggaauca

SEQ ID NO: 1240602 - RNA, 19 nt, Homo sapiens
aaccaaagccaaagacaua

SEQ ID NO: 1240603 - RNA, 19 nt, Homo sapiens
cucaugacauucuucaaua

SEQ ID NO: 1240604 - RNA, 19 nt, Homo sapiens
gaaugaagccacgaugcua

SEQ ID NO: 1240605 - RNA, 19 nt, Homo sapiens
gaagaauuacuguuagcaa

SEQ ID NO: 1240606 - RNA, 19 nt, Homo sapiens
cgccaucucucucugauug

SEQ ID NO: 1240607 - RNA, 19 nt, Homo sapiens
ggaagcugcucaggaggaa

SEQ ID NO: 1240608 - RNA, 19 nt, Homo sapiens
guaagaagaaugaaugaag

SEQ ID NO: 1240609 - RNA, 19 nt, Homo sapiens
gaaugagucuguggaacau

SEQ ID NO: 1240610 - RNA, 19 nt, Homo sapiens
ccauagagaagcugcagua

SEQ ID NO: 1240611 - RNA, 19 nt, Homo sapiens
gaaaguuccccugguauua

SEQ ID NO: 1240612 - RNA, 19 nt, Homo sapiens
gaacuacccaccucucucu

SEQ ID NO: 1240613 - RNA, 19 nt, Homo sapiens
caagcaauaccgugaagaa

SEQ ID NO: 1240614 - RNA, 19 nt, Homo sapiens
ccaaacauguauuccucuu

SEQ ID NO: 1240615 - RNA, 19 nt, Homo sapiens
acacucugauuaugaagaa

SEQ ID NO: 1240616 - RNA, 19 nt, Homo sapiens
caaguagaccuuucguaga

SEQ ID NO: 1240617 - RNA, 19 nt, Homo sapiens
caaagccaaagacauauug

SEQ ID NO: 1240618 - RNA, 19 nt, Homo sapiens
agagaagagucgacagaga

SEQ ID NO: 1240619 - RNA, 19 nt, Homo sapiens
ggagaucugucugcugaag

SEQ ID NO: 1240620 - RNA, 19 nt, Homo sapiens
uggaacauuucuacaguga

SEQ ID NO: 1240621 - RNA, 19 nt, Homo sapiens
gaauauauaccugccuuca

SEQ ID NO: 1240622 - RNA, 19 nt, Homo sapiens
acucaacaaucaaaccaaa

SEQ ID NO: 1240623 - RNA, 19 nt, Homo sapiens
gaaaaccagauuuggcuua

SEQ ID NO: 1240624 - RNA, 19 nt, Homo sapiens
aagcaaacacucugauuau

SEQ ID NO: 1240625 - RNA, 19 nt, Homo sapiens
ggacgagacaaugggauuu

SEQ ID NO: 1240626 - RNA, 19 nt, Homo sapiens
cuucaucagucuaauggaa

SEQ ID NO: 1240627 - RNA, 19 nt, Homo sapiens
auauauaccugccuucauc

SEQ ID NO: 1240628 - RNA, 19 nt, Homo sapiens
gagaagcugcaguaauguu

SEQ ID NO: 1240629 - RNA, 19 nt, Homo sapiens
agauuuggcuuaacugaag

SEQ ID NO: 1240630 - RNA, 19 nt, Homo sapiens
gaagccacgaugcuauuga

SEQ ID NO: 1240631 - RNA, 19 nt, Homo sapiens
ucacgucaaaguacaguuu

SEQ ID NO: 1240632 - RNA, 19 nt, Homo sapiens
ggucuggaaucugaaggaa

SEQ ID NO: 1240633 - RNA, 19 nt, Homo sapiens
cauaggcagucauauagag

SEQ ID NO: 1240634 - RNA, 19 nt, Homo sapiens
gaagaagcagcucccaagu

SEQ ID NO: 1240635 - RNA, 19 nt, Homo sapiens
ccacaucauccgccuaaug

SEQ ID NO: 1240636 - RNA, 19 nt, Homo sapiens
cgaaugagucuguggaaca

SEQ ID NO: 1240637 - RNA, 19 nt, Homo sapiens
ccaaguuuaaugcugauaa

SEQ ID NO: 1240638 - RNA, 19 nt, Homo sapiens
aagguuccgucuuucuuaa

SEQ ID NO: 1240639 - RNA, 19 nt, Homo sapiens
gaagcugcaguaauguuga

SEQ ID NO: 1240640 - RNA, 19 nt, Homo sapiens
aaagagaagagucgacaga

SEQ ID NO: 1240641 - RNA, 19 nt, Homo sapiens
ccaaagccaaagacauauu

SEQ ID NO: 1240642 - RNA, 19 nt, Homo sapiens
gagcugcacuuuccuuccu

SEQ ID NO: 1240643 - RNA, 19 nt, Homo sapiens
gcccacaucauccgccuaa

SEQ ID NO: 1240644 - RNA, 19 nt, Homo sapiens
caaucaaaccaaagccaaa

SEQ ID NO: 1240645 - RNA, 19 nt, Homo sapiens
aagccacgaugcuauugaa

SEQ ID NO: 1240646 - RNA, 19 nt, Homo sapiens
ugaggaaucaggucuggaa

SEQ ID NO: 1240647 - RNA, 19 nt, Homo sapiens
cacauaggcagucauauag

SEQ ID NO: 1240648 - RNA, 19 nt, Homo sapiens
gcugcacuuuccuuccuaa

SEQ ID NO: 1240649 - RNA, 19 nt, Homo sapiens
guagaagcaaacacucuga

SEQ ID NO: 1240650 - RNA, 19 nt, Homo sapiens
augagucuguggaacauuu

SEQ ID NO: 1240651 - RNA, 19 nt, Homo sapiens
agaaagacccuggagugaa

SEQ ID NO: 1240652 - RNA, 19 nt, Homo sapiens
gguauccaguagacuuuua

SEQ ID NO: 1240653 - RNA, 19 nt, Homo sapiens
caacugaaaaggaacaaaa

SEQ ID NO: 1240654 - RNA, 19 nt, Homo sapiens
gacaaaaugugccauagag

SEQ ID NO: 1240655 - RNA, 19 nt, Homo sapiens
ccucaugacauucuucaau

SEQ ID NO: 1240656 - RNA, 19 nt, Homo sapiens
cucaggcccucaugacauu

SEQ ID NO: 1240657 - RNA, 19 nt, Homo sapiens
ucacucaaguaagaagaau

SEQ ID NO: 1240658 - RNA, 19 nt, Homo sapiens
gcucaggcccucaugacau

SEQ ID NO: 1240659 - RNA, 19 nt, Homo sapiens
aguacaguuucaagccuua

SEQ ID NO: 1240660 - RNA, 19 nt, Homo sapiens
caaaaugugccauagagaa

SEQ ID NO: 1240661 - RNA, 19 nt, Homo sapiens
aagcagcucccaaguguca

SEQ ID NO: 1240662 - RNA, 19 nt, Homo sapiens
uuugaugccuuuggaauuc

SEQ ID NO: 1240663 - RNA, 19 nt, Homo sapiens
gccuaaugcuuaaguacca

SEQ ID NO: 1240664 - RNA, 19 nt, Homo sapiens
uguggaacauuucuacagu

SEQ ID NO: 1240665 - RNA, 19 nt, Homo sapiens
aagcugcaguaauguugaa

SEQ ID NO: 1240666 - RNA, 19 nt, Homo sapiens
ggauguacugcuaaaguca

SEQ ID NO: 1240667 - RNA, 19 nt, Homo sapiens
uugagaaaguugaggaauc

SEQ ID NO: 1240668 - RNA, 19 nt, Homo sapiens
cauguauuccucuucacua

SEQ ID NO: 1240669 - RNA, 19 nt, Homo sapiens
caacucaacaaucaaacca

SEQ ID NO: 1240670 - RNA, 19 nt, Homo sapiens
ccagauuuggcuuaacuga

SEQ ID NO: 1240671 - RNA, 19 nt, Homo sapiens
ccccaagacuucaaaggua

SEQ ID NO: 1240672 - RNA, 19 nt, Homo sapiens
acucaaguaagaagaauga

SEQ ID NO: 1240673 - RNA, 19 nt, Homo sapiens
gguuccgucuuucuuaauc

SEQ ID NO: 1240674 - RNA, 19 nt, Homo sapiens
caucauccgccuaaugcuu

SEQ ID NO: 1240675 - RNA, 19 nt, Homo sapiens
ccaucucucucugauugaa

SEQ ID NO: 1240676 - RNA, 19 nt, Homo sapiens
cuucaaagguacugcaaaa

SEQ ID NO: 1240677 - RNA, 19 nt, Homo sapiens
cuuaaguaccagaagauuu

SEQ ID NO: 1240678 - RNA, 19 nt, Homo sapiens
aagaaagacccuggaguga

SEQ ID NO: 1240679 - RNA, 19 nt, Homo sapiens
gugauggcaccgaaccuuu

SEQ ID NO: 1240680 - RNA, 19 nt, Homo sapiens
gauguacugcuaaagucaa

SEQ ID NO: 1240681 - RNA, 19 nt, Homo sapiens
ucagaaggcugguguguuu

SEQ ID NO: 1240682 - RNA, 19 nt, Homo sapiens
gaauuugacuggugaacaa

SEQ ID NO: 1240683 - RNA, 19 nt, Homo sapiens
gcaaagaaagggaaacuga

SEQ ID NO: 1240684 - RNA, 19 nt, Homo sapiens
agauuaagcuucucaaaga

SEQ ID NO: 1240685 - RNA, 19 nt, Homo sapiens
ggaaagcgaugguauuugc

SEQ ID NO: 1240686 - RNA, 19 nt, Homo sapiens
guacagagccagccuuguu

SEQ ID NO: 1240687 - RNA, 19 nt, Homo sapiens
gacaauacaggaaauguuu

SEQ ID NO: 1240688 - RNA, 19 nt, Homo sapiens
ggaaggacauuuugacauu

SEQ ID NO: 1240689 - RNA, 19 nt, Homo sapiens
cgacauguaucuguaagaa

SEQ ID NO: 1240690 - RNA, 19 nt, Homo sapiens
gaccaaacauggauagaag

SEQ ID NO: 1240691 - RNA, 19 nt, Homo sapiens
ggaauacuuuaaaccaguu

SEQ ID NO: 1240692 - RNA, 19 nt, Homo sapiens
cagcaaauaucaugauucu

SEQ ID NO: 1240693 - RNA, 19 nt, Homo sapiens
ucaguaaacccagcaaaua

SEQ ID NO: 1240694 - RNA, 19 nt, Homo sapiens
ggacauauaugaagaaaac

SEQ ID NO: 1240695 - RNA, 19 nt, Homo sapiens
acauguaucuguaagaaga

SEQ ID NO: 1240696 - RNA, 19 nt, Homo sapiens
gugcauggguccaauauac

SEQ ID NO: 1240697 - RNA, 19 nt, Homo sapiens
cgaagaaacguaucaagug

SEQ ID NO: 1240698 - RNA, 19 nt, Homo sapiens
caagacaucaucacaagga

SEQ ID NO: 1240699 - RNA, 19 nt, Homo sapiens
gcucaugguugcuauuucu

SEQ ID NO: 1240700 - RNA, 19 nt, Homo sapiens
caugauucuuuccugguua

SEQ ID NO: 1240701 - RNA, 19 nt, Homo sapiens
gaaaaggccaucagaaaug

SEQ ID NO: 1240702 - RNA, 19 nt, Homo sapiens
caaagacgaagaaacguau

SEQ ID NO: 1240703 - RNA, 19 nt, Homo sapiens
gcugguuucuguauccaaa

SEQ ID NO: 1240704 - RNA, 19 nt, Homo sapiens
aauaguggauccuugaaug

SEQ ID NO: 1240705 - RNA, 19 nt, Homo sapiens
acccaucccuccuucauuu

SEQ ID NO: 1240706 - RNA, 19 nt, Homo sapiens
gaugauugccugcgacaug

SEQ ID NO: 1240707 - RNA, 19 nt, Homo sapiens
ggaaggcuccagugagaug

SEQ ID NO: 1240708 - RNA, 19 nt, Homo sapiens
caaagaaagggaaacugaa

SEQ ID NO: 1240709 - RNA, 19 nt, Homo sapiens
ucaaagacgaagaaacgua

SEQ ID NO: 1240710 - RNA, 19 nt, Homo sapiens
cuuaccagcuuugacaaua

SEQ ID NO: 1240711 - RNA, 19 nt, Homo sapiens
ggaaaacccggacauauau

SEQ ID NO: 1240712 - RNA, 19 nt, Homo sapiens
cugaagagguuuuggcuua

SEQ ID NO: 1240713 - RNA, 19 nt, Homo sapiens
caucuucuguccugaauac

SEQ ID NO: 1240714 - RNA, 19 nt, Homo sapiens
cagccuuguugaugcaaua

SEQ ID NO: 1240715 - RNA, 19 nt, Homo sapiens
cauaauaguggauccuuga

SEQ ID NO: 1240716 - RNA, 19 nt, Homo sapiens
uaacagaaggcaaagaaag

SEQ ID NO: 1240717 - RNA, 19 nt, Homo sapiens
caguaaacccagcaaauau

SEQ ID NO: 1240718 - RNA, 19 nt, Homo sapiens
guaaacccagcaaauauca

SEQ ID NO: 1240719 - RNA, 19 nt, Homo sapiens
ccucaagcacaauaauaua

SEQ ID NO: 1240720 - RNA, 19 nt, Homo sapiens
ucaagugcauagggaauau

SEQ ID NO: 1240721 - RNA, 19 nt, Homo sapiens
agaugucucucaacuggaa

SEQ ID NO: 1240722 - RNA, 19 nt, Homo sapiens
ucuguuaacugaugggaau

SEQ ID NO: 1240723 - RNA, 19 nt, Homo sapiens
gaugggauaaugagacaga

SEQ ID NO: 1240724 - RNA, 19 nt, Homo sapiens
gucugugacuugaauuuga

SEQ ID NO: 1240725 - RNA, 19 nt, Homo sapiens
cugcagaugucaaagaagu

SEQ ID NO: 1240726 - RNA, 19 nt, Homo sapiens
gaaggcaaagaaagggaaa

SEQ ID NO: 1240727 - RNA, 19 nt, Homo sapiens
gcauggguccaauauacaa

SEQ ID NO: 1240728 - RNA, 19 nt, Homo sapiens
aaacguaucaagugcauag

SEQ ID NO: 1240729 - RNA, 19 nt, Homo sapiens
guggauccuugaauguuga

SEQ ID NO: 1240730 - RNA, 19 nt, Homo sapiens
ucaugauucuuuccugguu

SEQ ID NO: 1240731 - RNA, 19 nt, Homo sapiens
guaacagaaggcaaagaaa

SEQ ID NO: 1240732 - RNA, 19 nt, Homo sapiens
caucagaaaugugcaagac

SEQ ID NO: 1240733 - RNA, 19 nt, Homo sapiens
ugacaauacaggaaauguu

SEQ ID NO: 1240734 - RNA, 19 nt, Homo sapiens
gagggaauacuuuaaacca

SEQ ID NO: 1240735 - RNA, 19 nt, Homo sapiens
gggauaaugagacagaugu

SEQ ID NO: 1240736 - RNA, 19 nt, Homo sapiens
cuggugaacaaacuaaaua

SEQ ID NO: 1240737 - RNA, 19 nt, Homo sapiens
ccugcgacauguaucugua

SEQ ID NO: 1240738 - RNA, 19 nt, Homo sapiens
gccgagggaauacuuuaaa

SEQ ID NO: 1240739 - RNA, 19 nt, Homo sapiens
gaaggcugguguguuuaag

SEQ ID NO: 1240740 - RNA, 19 nt, Homo sapiens
gcagaugucaaagaaguuc

SEQ ID NO: 1240741 - RNA, 19 nt, Homo sapiens
ccuugaauguugaagaugu

SEQ ID NO: 1240742 - RNA, 19 nt, Homo sapiens
agaaggcugguguguuuaa

SEQ ID NO: 1240743 - RNA, 19 nt, Homo sapiens
ugcaagacaucaucacaag

SEQ ID NO: 1240744 - RNA, 19 nt, Homo sapiens
gccucaagcacaauaauau

SEQ ID NO: 1240745 - RNA, 19 nt, Homo sapiens
gcaucuggccaucugaaga

SEQ ID NO: 1240746 - RNA, 19 nt, Homo sapiens
ugacuggugaacaaacuaa

SEQ ID NO: 1240747 - RNA, 19 nt, Homo sapiens
gauuaagcuucucaaagac

SEQ ID NO: 1240748 - RNA, 19 nt, Homo sapiens
ugaccaaacauggauagaa

SEQ ID NO: 1240749 - RNA, 19 nt, Homo sapiens
gaaggacauuuugacauug

SEQ ID NO: 1240750 - RNA, 19 nt, Homo sapiens
gggcucaugguugcuauuu

SEQ ID NO: 1240751 - RNA, 19 nt, Homo sapiens
caggaaauguuugcaucug

SEQ ID NO: 1240752 - RNA, 19 nt, Homo sapiens
aguaucuccuuaaggcaua

SEQ ID NO: 1240753 - RNA, 19 nt, Homo sapiens
cccagcaaauaucaugauu

SEQ ID NO: 1240754 - RNA, 19 nt, Homo sapiens
guccugcccuaaaccuuug

SEQ ID NO: 1240755 - RNA, 19 nt, Homo sapiens
agaaacguaucaagugcau

SEQ ID NO: 1240756 - RNA, 19 nt, Homo sapiens
gacaucaucacaaggaauc

SEQ ID NO: 1240757 - RNA, 19 nt, Homo sapiens
gugcaagacaucaucacaa

SEQ ID NO: 1240758 - RNA, 19 nt, Homo sapiens
aaacccagcaaauaucaug

SEQ ID NO: 1240759 - RNA, 19 nt, Homo sapiens
ccaaacauggauagaagau

SEQ ID NO: 1240760 - RNA, 19 nt, Homo sapiens
uuucaaacuuccacuccaa

SEQ ID NO: 1240761 - RNA, 19 nt, Homo sapiens
guuaacugaugggaaugaa

SEQ ID NO: 1240762 - RNA, 19 nt, Homo sapiens
aaagaaagggaaacugaag

SEQ ID NO: 1240763 - RNA, 19 nt, Homo sapiens
gaauguugaagauguccuu

SEQ ID NO: 1240764 - RNA, 19 nt, Homo sapiens
aagauguccuuaccagcuu

SEQ ID NO: 1240765 - RNA, 19 nt, Homo sapiens
ccggacauauaugaagaaa

SEQ ID NO: 1240766 - RNA, 19 nt, Homo sapiens
aguaacagaaggcaaagaa

SEQ ID NO: 1240767 - RNA, 19 nt, Homo sapiens
gauccuugaauguugaaga

SEQ ID NO: 1240768 - RNA, 19 nt, Homo sapiens
aguggauccuugaauguug

SEQ ID NO: 1240769 - RNA, 19 nt, Homo sapiens
uaacugaugggaaugaaaa

SEQ ID NO: 1240770 - RNA, 19 nt, Homo sapiens
caauauacaagcaucuucu

SEQ ID NO: 1240771 - RNA, 19 nt, Homo sapiens
uuuggucuuuguucuguuu

SEQ ID NO: 1240772 - RNA, 19 nt, Homo sapiens
ggaaaucuguaagggguau

SEQ ID NO: 1240773 - RNA, 19 nt, Homo sapiens
cauuacccgcuucugcuua

SEQ ID NO: 1240774 - RNA, 19 nt, Homo sapiens
gggaaagcgaugguauuug

SEQ ID NO: 1240775 - RNA, 19 nt, Homo sapiens
uaccagcuuugacaauaca

SEQ ID NO: 1240776 - RNA, 19 nt, Homo sapiens
cguccugcccuaaaccuuu

SEQ ID NO: 1240777 - RNA, 19 nt, Homo sapiens
caaacauggauagaagauu

SEQ ID NO: 1240778 - RNA, 19 nt, Homo sapiens
aggaaaacccggacauaua

SEQ ID NO: 1240779 - RNA, 19 nt, Homo sapiens
ggacauuuugacauuguua

SEQ ID NO: 1240780 - RNA, 19 nt, Homo sapiens
ggaaacugaagaggagguu

SEQ ID NO: 1240781 - RNA, 19 nt, Homo sapiens
ggauaacaaugcugauuua

SEQ ID NO: 1240782 - RNA, 19 nt, Homo sapiens
gcagauaccauuucaguaa

SEQ ID NO: 1240783 - RNA, 19 nt, Homo sapiens
gcacaaagggauccaauuu

SEQ ID NO: 1240784 - RNA, 19 nt, Homo sapiens
gaaagaagcaccugcaaug

SEQ ID NO: 1240785 - RNA, 19 nt, Homo sapiens
gaacacugcacuccaauuu

SEQ ID NO: 1240786 - RNA, 19 nt, Homo sapiens
uaaaugcaguggauacuuu

SEQ ID NO: 1240787 - RNA, 19 nt, Homo sapiens
gggaauagcuggugaaacu

SEQ ID NO: 1240788 - RNA, 19 nt, Homo sapiens
gaacuuagauuuuggagaa

SEQ ID NO: 1240789 - RNA, 19 nt, Homo sapiens
gaaaggaaauaagagaaga

SEQ ID NO: 1240790 - RNA, 19 nt, Homo sapiens
guaaccaaguuucuucuaa

SEQ ID NO: 1240791 - RNA, 19 nt, Homo sapiens
ggaaguggaugaagauaag

SEQ ID NO: 1240792 - RNA, 19 nt, Homo sapiens
gcuuaacucugcuguaauu

SEQ ID NO: 1240793 - RNA, 19 nt, Homo sapiens
uaacaaugcugauuuaugc

SEQ ID NO: 1240794 - RNA, 19 nt, Homo sapiens
caaaguaaaugcaguggau

SEQ ID NO: 1240795 - RNA, 19 nt, Homo sapiens
gaguaaauuugucuucuga

SEQ ID NO: 1240796 - RNA, 19 nt, Homo sapiens
ggaaaaggcugcgguaaaa

SEQ ID NO: 1240797 - RNA, 19 nt, Homo sapiens
ccacggaccucccaucuuc

SEQ ID NO: 1240798 - RNA, 19 nt, Homo sapiens
gcaauugguuugucuccuu

SEQ ID NO: 1240799 - RNA, 19 nt, Homo sapiens
caugcaguguuuacaauua

SEQ ID NO: 1240800 - RNA, 19 nt, Homo sapiens
gagaaacaauugcuuaacu

SEQ ID NO: 1240801 - RNA, 19 nt, Homo sapiens
gaagauggcaugcaguguu

SEQ ID NO: 1240802 - RNA, 19 nt, Homo sapiens
aaacagaggacugccauua

SEQ ID NO: 1240803 - RNA, 19 nt, Homo sapiens
acagaggacugccauuauu

SEQ ID NO: 1240804 - RNA, 19 nt, Homo sapiens
caauugguuugucuccuua

SEQ ID NO: 1240805 - RNA, 19 nt, Homo sapiens
gaaccaaacccaagacuac

SEQ ID NO: 1240806 - RNA, 19 nt, Homo sapiens
gcacugcccaucauacaaa

SEQ ID NO: 1240807 - RNA, 19 nt, Homo sapiens
guaaaucagacacgaguaa

SEQ ID NO: 1240808 - RNA, 19 nt, Homo sapiens
guuaaacuaugaugacaug

SEQ ID NO: 1240809 - RNA, 19 nt, Homo sapiens
gaugaguucuuggauauuc

SEQ ID NO: 1240810 - RNA, 19 nt, Homo sapiens
gaauagagccaugaucuca

SEQ ID NO: 1240811 - RNA, 19 nt, Homo sapiens
gccaaugggucaucuuuca

SEQ ID NO: 1240812 - RNA, 19 nt, Homo sapiens
ugacaugucuguagcuauc

SEQ ID NO: 1240813 - RNA, 19 nt, Homo sapiens
gauauuccuugcacaaaca

SEQ ID NO: 1240814 - RNA, 19 nt, Homo sapiens
cagauaccauuucaguaaa

SEQ ID NO: 1240815 - RNA, 19 nt, Homo sapiens
gcaaugaaauaagcuuaag

SEQ ID NO: 1240816 - RNA, 19 nt, Homo sapiens
cagaaacacuagugcaugu

SEQ ID NO: 1240817 - RNA, 19 nt, Homo sapiens
gggacggacuucuuuccua

SEQ ID NO: 1240818 - RNA, 19 nt, Homo sapiens
gaagauaagagcacaaagg

SEQ ID NO: 1240819 - RNA, 19 nt, Homo sapiens
ggaaauaagagaagaucga

SEQ ID NO: 1240820 - RNA, 19 nt, Homo sapiens
caaaggauguggacgaaaa

SEQ ID NO: 1240821 - RNA, 19 nt, Homo sapiens
gaugacaugucuguagcua

SEQ ID NO: 1240822 - RNA, 19 nt, Homo sapiens
gaacucauucgcuucuuug

SEQ ID NO: 1240823 - RNA, 19 nt, Homo sapiens
ccauguugcuggagaagaa

SEQ ID NO: 1240824 - RNA, 19 nt, Homo sapiens
ggaaguggcaauugguuug

SEQ ID NO: 1240825 - RNA, 19 nt, Homo sapiens
gagcagauaccauuucagu

SEQ ID NO: 1240826 - RNA, 19 nt, Homo sapiens
cagaggacugccauuauua

SEQ ID NO: 1240827 - RNA, 19 nt, Homo sapiens
gaauagcuggugaaacuga

SEQ ID NO: 1240828 - RNA, 19 nt, Homo sapiens
gcgugaaacugcucagaau

SEQ ID NO: 1240829 - RNA, 19 nt, Homo sapiens
aaagaugcacccaaaguaa

SEQ ID NO: 1240830 - RNA, 19 nt, Homo sapiens
gccuggagcuuugcaauga

SEQ ID NO: 1240831 - RNA, 19 nt, Homo sapiens
gcaaagagaaguguguuuc

SEQ ID NO: 1240832 - RNA, 19 nt, Homo sapiens
agaagcaccugcaauguag

SEQ ID NO: 1240833 - RNA, 19 nt, Homo sapiens
cauacaaaguaaccaaguu

SEQ ID NO: 1240834 - RNA, 19 nt, Homo sapiens
ugacagccaugaaggugaa

SEQ ID NO: 1240835 - RNA, 19 nt, Homo sapiens
gagaaaggaaauaagagaa

SEQ ID NO: 1240836 - RNA, 19 nt, Homo sapiens
cacgaugaguucuuggaua

SEQ ID NO: 1240837 - RNA, 19 nt, Homo sapiens
aagauggcaugcaguguuu

SEQ ID NO: 1240838 - RNA, 19 nt, Homo sapiens
cucauucgcuucuuugauu

SEQ ID NO: 1240839 - RNA, 19 nt, Homo sapiens
ccauggugcugcugauuau

SEQ ID NO: 1240840 - RNA, 19 nt, Homo sapiens
caaguuccaucuccuuuac

SEQ ID NO: 1240841 - RNA, 19 nt, Homo sapiens
uugcuuaacucugcuguaa

SEQ ID NO: 1240842 - RNA, 19 nt, Homo sapiens
ugaaacugcucagaauaga

SEQ ID NO: 1240843 - RNA, 19 nt, Homo sapiens
cgaaaugggaacuuagauu

SEQ ID NO: 1240844 - RNA, 19 nt, Homo sapiens
ggaaccaaacccaagacua

SEQ ID NO: 1240845 - RNA, 19 nt, Homo sapiens
ggauauuccuugcacaaac

SEQ ID NO: 1240846 - RNA, 19 nt, Homo sapiens
aagaagcaccugcaaugua

SEQ ID NO: 1240847 - RNA, 19 nt, Homo sapiens
gagcuuugcaaugaaauaa

SEQ ID NO: 1240848 - RNA, 19 nt, Homo sapiens
cuacggcuauucaagguau

SEQ ID NO: 1240849 - RNA, 19 nt, Homo sapiens
gaaaauggccuggagaaga

SEQ ID NO: 1240850 - RNA, 19 nt, Homo sapiens
gcauguuucugaugaggau

SEQ ID NO: 1240851 - RNA, 19 nt, Homo sapiens
uaacacagcaugucaucau

SEQ ID NO: 1240852 - RNA, 19 nt, Homo sapiens
aaacuaugaugacaugucu

SEQ ID NO: 1240853 - RNA, 19 nt, Homo sapiens
acgaugaguucuuggauau

SEQ ID NO: 1240854 - RNA, 19 nt, Homo sapiens
ccugagaaacaauugcuua

SEQ ID NO: 1240855 - RNA, 19 nt, Homo sapiens
caaaguaaccaaguuucuu

SEQ ID NO: 1240856 - RNA, 19 nt, Homo sapiens
ucaaguuccaucuccuuua

SEQ ID NO: 1240857 - RNA, 19 nt, Homo sapiens
gaagaggcuuuuccauguu

SEQ ID NO: 1240858 - RNA, 19 nt, Homo sapiens
cguaagagaaaggaaauaa

SEQ ID NO: 1240859 - RNA, 19 nt, Homo sapiens
ggcaugcaguguuuacaau

SEQ ID NO: 1240860 - RNA, 19 nt, Homo sapiens
gaggacugccauuauuaaa

SEQ ID NO: 1240861 - RNA, 19 nt, Homo sapiens
gaacgugaaagauauugca

SEQ ID NO: 1240862 - RNA, 19 nt, Homo sapiens
uaaccaaguuucuucuaac

SEQ ID NO: 1240863 - RNA, 19 nt, Homo sapiens
gaggauaacaaugcugauu

SEQ ID NO: 1240864 - RNA, 19 nt, Homo sapiens
caaugggucaucuuucaaa

SEQ ID NO: 1240865 - RNA, 19 nt, Homo sapiens
guagcuaucagaaagagaa

SEQ ID NO: 1240866 - RNA, 19 nt, Homo sapiens
cgaguaaauuugucuucug

SEQ ID NO: 1240867 - RNA, 19 nt, Homo sapiens
cccaggaacccacagauaa

SEQ ID NO: 1240868 - RNA, 19 nt, Homo sapiens
ggagcuuugcaaugaaaua

SEQ ID NO: 1240869 - RNA, 19 nt, Homo sapiens
aaacaucaggccaacauau

SEQ ID NO: 1240870 - RNA, 19 nt, Homo sapiens
caaagagaaguguguuuca

SEQ ID NO: 1240871 - RNA, 19 nt, Homo sapiens
gguaaaaucaguaaaguug

SEQ ID NO: 1240872 - RNA, 19 nt, Homo sapiens
gaaacaauugcuuaacucu

SEQ ID NO: 1240873 - RNA, 19 nt, Homo sapiens
aauaaaagaugcacccaaa

SEQ ID NO: 1240874 - RNA, 19 nt, Homo sapiens
ccacuccaguagccaauuc

SEQ ID NO: 1240875 - RNA, 19 nt, Homo sapiens
aaucagacacgaguaaauu

SEQ ID NO: 1240876 - RNA, 19 nt, Homo sapiens
gaaagagaagcugggaaga

SEQ ID NO: 1240877 - RNA, 19 nt, Homo sapiens
ccagcuugaucaggacaua

SEQ ID NO: 1240878 - RNA, 19 nt, Homo sapiens
aagagaagaucgagauagg

SEQ ID NO: 1240879 - RNA, 19 nt, Homo sapiens
gcaugcaguguuuacaauu

SEQ ID NO: 1240880 - RNA, 19 nt, Homo sapiens
gaaaaguuacugacucuau

SEQ ID NO: 1240881 - RNA, 19 nt, Homo sapiens
cggagaagcucaugacuua

SEQ ID NO: 1240882 - RNA, 19 nt, Homo sapiens
gguagaagcuggccuugaa

SEQ ID NO: 1240883 - RNA, 19 nt, Homo sapiens
gacaauggguguucauaga

SEQ ID NO: 1240884 - RNA, 19 nt, Homo sapiens
caggaaauguugaugacua

SEQ ID NO: 1240885 - RNA, 19 nt, Homo sapiens
caucagaacuugagucucu

SEQ ID NO: 1240886 - RNA, 19 nt, Homo sapiens
gcagagcccuggaugaagu

SEQ ID NO: 1240887 - RNA, 19 nt, Homo sapiens
ggaccagccuccaugauca

SEQ ID NO: 1240888 - RNA, 19 nt, Homo sapiens
uaacuuagacugucauuag

SEQ ID NO: 1240889 - RNA, 19 nt, Homo sapiens
gaaggaguaggccaagaua

SEQ ID NO: 1240890 - RNA, 19 nt, Homo sapiens
ggaaggaacaaucacugua

SEQ ID NO: 1240891 - RNA, 19 nt, Homo sapiens
gaaaauccguugcagaaga

SEQ ID NO: 1240892 - RNA, 19 nt, Homo sapiens
ccaccagaguccacauuaa

SEQ ID NO: 1240893 - RNA, 19 nt, Homo sapiens
gguaggauuuagacaggua

SEQ ID NO: 1240894 - RNA, 19 nt, Homo sapiens
gcucaugacuuacuuuggu

SEQ ID NO: 1240895 - RNA, 19 nt, Homo sapiens
gagcaaagguguggaacca

SEQ ID NO: 1240896 - RNA, 19 nt, Homo sapiens
aaagauccauugccaaaca

SEQ ID NO: 1240897 - RNA, 19 nt, Homo sapiens
gaaaggagggaagggcaua

SEQ ID NO: 1240898 - RNA, 19 nt, Homo sapiens
gaaggaacaaucacuguag

SEQ ID NO: 1240899 - RNA, 19 nt, Homo sapiens
ugagcacgcuggacgcuuu

SEQ ID NO: 1240900 - RNA, 19 nt, Homo sapiens
caagaguaaugaaccugaa

SEQ ID NO: 1240901 - RNA, 19 nt, Homo sapiens
agaaagauccauugccaaa

SEQ ID NO: 1240902 - RNA, 19 nt, Homo sapiens
gauacccagucucaccuaa

SEQ ID NO: 1240903 - RNA, 19 nt, Homo sapiens
auagacagcuugcccaugu

SEQ ID NO: 1240904 - RNA, 19 nt, Homo sapiens
ugaaaccagugcuaaaugg

SEQ ID NO: 1240905 - RNA, 19 nt, Homo sapiens
ggaaggaguaggccaagau

SEQ ID NO: 1240906 - RNA, 19 nt, Homo sapiens
gaaauguugaugacuagga

SEQ ID NO: 1240907 - RNA, 19 nt, Homo sapiens
ugggauaccuggucuguag

SEQ ID NO: 1240908 - RNA, 19 nt, Homo sapiens
gcagagaugcccacuuucu

SEQ ID NO: 1240909 - RNA, 19 nt, Homo sapiens
aggaaaggcugagggaauu

SEQ ID NO: 1240910 - RNA, 19 nt, Homo sapiens
caccagaguccacauuaaa

SEQ ID NO: 1240911 - RNA, 19 nt, Homo sapiens
gaagcagagcccuggauga

SEQ ID NO: 1240912 - RNA, 19 nt, Homo sapiens
gacagcagcucuggaagca

SEQ ID NO: 1240913 - RNA, 19 nt, Homo sapiens
cgcauuaacuccugaacug

SEQ ID NO: 1240914 - RNA, 19 nt, Homo sapiens
gaggacagguaggauuuag

SEQ ID NO: 1240915 - RNA, 19 nt, Homo sapiens
gagacugggcccaaccuuu

SEQ ID NO: 1240916 - RNA, 19 nt, Homo sapiens
aggcagaguugcagcagaa

SEQ ID NO: 1240917 - RNA, 19 nt, Homo sapiens
caauggguguucauagaca

SEQ ID NO: 1240918 - RNA, 19 nt, Homo sapiens
aaauguugaugacuaggaa

SEQ ID NO: 1240919 - RNA, 19 nt, Homo sapiens
caccugaugccguaucuuu

SEQ ID NO: 1240920 - RNA, 19 nt, Homo sapiens
cauuaaagcccugcaguug

SEQ ID NO: 1240921 - RNA, 19 nt, Homo sapiens
gcagaagguggaagagaau

SEQ ID NO: 1240922 - RNA, 19 nt, Homo sapiens
uaaugaaccugaagaugcu

SEQ ID NO: 1240923 - RNA, 19 nt, Homo sapiens
gaaaccagugcuaaaugga

SEQ ID NO: 1240924 - RNA, 19 nt, Homo sapiens
ggagggaagggcauagaau

SEQ ID NO: 1240925 - RNA, 19 nt, Homo sapiens
gccaagauacccagucuca

SEQ ID NO: 1240926 - RNA, 19 nt, Homo sapiens
uagaggacagguaggauuu

SEQ ID NO: 1240927 - RNA, 19 nt, Homo sapiens
agacugggcccaaccuuug

SEQ ID NO: 1240928 - RNA, 19 nt, Homo sapiens
ggaauggaagaguccugua

SEQ ID NO: 1240929 - RNA, 19 nt, Homo sapiens
ggugaaaccagugcuaaau

SEQ ID NO: 1240930 - RNA, 19 nt, Homo sapiens
caagagcaaagguguggaa

SEQ ID NO: 1240931 - RNA, 19 nt, Homo sapiens
gccaccagaguccacauua

SEQ ID NO: 1240932 - RNA, 19 nt, Homo sapiens
ggaccugaacauaucgaaa

SEQ ID NO: 1240933 - RNA, 19 nt, Homo sapiens
guacucuccuccucaaugc

SEQ ID NO: 1240934 - RNA, 19 nt, Homo sapiens
cccagucucaccuaacuua

SEQ ID NO: 1240935 - RNA, 19 nt, Homo sapiens
gagggaagggcauagaauc

SEQ ID NO: 1240936 - RNA, 19 nt, Homo sapiens
ggacagguaggauuuagac

SEQ ID NO: 1240937 - RNA, 19 nt, Homo sapiens
cagccugacugccuuugga

SEQ ID NO: 1240938 - RNA, 19 nt, Homo sapiens
agcagaagguggaagagaa

SEQ ID NO: 1240939 - RNA, 19 nt, Homo sapiens
gagaagcucaugacuuacu

SEQ ID NO: 1240940 - RNA, 19 nt, Homo sapiens
aagcagagcccuggaugaa

SEQ ID NO: 1240941 - RNA, 19 nt, Homo sapiens
cuuagacugucauuagaga

SEQ ID NO: 1240942 - RNA, 19 nt, Homo sapiens
gaagcucaugacuuacuuu

SEQ ID NO: 1240943 - RNA, 19 nt, Homo sapiens
gcggagaagcucaugacuu

SEQ ID NO: 1240944 - RNA, 19 nt, Homo sapiens
gguaauggcaagagcaaag

SEQ ID NO: 1240945 - RNA, 19 nt, Homo sapiens
uuagacagguaaagaaagg

SEQ ID NO: 1240946 - RNA, 19 nt, Homo sapiens
agagaugcccacuuucuga

SEQ ID NO: 1240947 - RNA, 19 nt, Homo sapiens
gaauggaagaguccuguac

SEQ ID NO: 1240948 - RNA, 19 nt, Homo sapiens
gcuaaauggagguaaaaua

SEQ ID NO: 1240949 - RNA, 19 nt, Homo sapiens
gugaaaccagugcuaaaug

SEQ ID NO: 1240950 - RNA, 19 nt, Homo sapiens
gcugagggaauuccaagga

SEQ ID NO: 1240951 - RNA, 19 nt, Homo sapiens
cugggaaucugaguaucua

SEQ ID NO: 1240952 - RNA, 19 nt, Homo sapiens
gagcuggaggccugcauug

SEQ ID NO: 1240953 - RNA, 19 nt, Homo sapiens
gcagaggcaggugugauga

SEQ ID NO: 1240954 - RNA, 19 nt, Homo sapiens
uuaaagcccugcaguugcu

SEQ ID NO: 1240955 - RNA, 19 nt, Homo sapiens
cgucacaucaucagaacuu

SEQ ID NO: 1240956 - RNA, 19 nt, Homo sapiens
caggagacaagaguaauga

SEQ ID NO: 1240957 - RNA, 19 nt, Homo sapiens
gagccaggagacaagagua

SEQ ID NO: 1240958 - RNA, 19 nt, Homo sapiens
uagacagcuugcccaugua

SEQ ID NO: 1240959 - RNA, 19 nt, Homo sapiens
uaccuggucuguaggaaag

SEQ ID NO: 1240960 - RNA, 19 nt, Homo sapiens
gcuccgggaccugaacaua

SEQ ID NO: 1240961 - RNA, 19 nt, Homo sapiens
uaggaaaggcugagggaau

SEQ ID NO: 1240962 - RNA, 19 nt, Homo sapiens
ggcuggagcugcagauggu

SEQ ID NO: 1240963 - RNA, 19 nt, Homo sapiens
ggagacaagaguaaugaac

SEQ ID NO: 1240964 - RNA, 19 nt, Homo sapiens
uuagagagaaagauccauu

SEQ ID NO: 1240965 - RNA, 19 nt, Homo sapiens
cuagaggacagguaggauu

SEQ ID NO: 1240966 - RNA, 19 nt, Homo sapiens
gggugaaaccagugcuaaa

SEQ ID NO: 1240967 - RNA, 19 nt, Homo sapiens
gacugucauuagagagaaa

SEQ ID NO: 1240968 - RNA, 19 nt, Homo sapiens
ugacaauggguguucauag

SEQ ID NO: 1240969 - RNA, 19 nt, Homo sapiens
ccacugacagcuggucuga

SEQ ID NO: 1240970 - RNA, 19 nt, Homo sapiens
gaccugaacauaucgaaaa

SEQ ID NO: 1240971 - RNA, 19 nt, Homo sapiens
gacuuacuuuggucacuuc

SEQ ID NO: 1240972 - RNA, 19 nt, Homo sapiens
gguggcaggaggagaagaa

SEQ ID NO: 1240973 - RNA, 19 nt, Homo sapiens
ccaggagacaagaguaaug

SEQ ID NO: 1240974 - RNA, 19 nt, Homo sapiens
ucacaucaucagaacuuga

SEQ ID NO: 1240975 - RNA, 19 nt, Homo sapiens
ggaaucugaguaucuagca

SEQ ID NO: 1240976 - RNA, 19 nt, Homo sapiens
ggagcuggaggccugcauu

SEQ ID NO: 1240977 - RNA, 19 nt, Homo sapiens
agaagcucaugacuuacuu

SEQ ID NO: 1240978 - RNA, 19 nt, Homo sapiens
aacuuagacugucauuaga

SEQ ID NO: 1240979 - RNA, 19 nt, Homo sapiens
ugcaagggaugcugggaau

SEQ ID NO: 1240980 - RNA, 19 nt, Homo sapiens
gauaccuggucuguaggaa

SEQ ID NO: 1240981 - RNA, 19 nt, Homo sapiens
gaagagagaccuaaugaaa

SEQ ID NO: 1240982 - RNA, 19 nt, Homo sapiens
ggaaacaugugucuucuau

SEQ ID NO: 1240983 - RNA, 19 nt, Homo sapiens
gaaaugggaugcuguuugu

SEQ ID NO: 1240984 - RNA, 19 nt, Homo sapiens
uaggaaugcugaaagauua

SEQ ID NO: 1240985 - RNA, 19 nt, Homo sapiens
guacugagcuaaccacuuc

SEQ ID NO: 1240986 - RNA, 19 nt, Homo sapiens
caacgaagcugggaaggaa

SEQ ID NO: 1240987 - RNA, 19 nt, Homo sapiens
ggaaagacaaagaaagaua

SEQ ID NO: 1240988 - RNA, 19 nt, Homo sapiens
ggacuuuccugcuagauau

SEQ ID NO: 1240989 - RNA, 19 nt, Homo sapiens
agagagaccuaaugaaauu

SEQ ID NO: 1240990 - RNA, 19 nt, Homo sapiens
ggagaagagugaaugaguu

SEQ ID NO: 1240991 - RNA, 19 nt, Homo sapiens
aaacaugugucuucuauuc

SEQ ID NO: 1240992 - RNA, 19 nt, Homo sapiens
gagccaagauuaugccauu

SEQ ID NO: 1240993 - RNA, 19 nt, Homo sapiens
caaacggucugaauuacaa

SEQ ID NO: 1240994 - RNA, 19 nt, Homo sapiens
cagagcccauuguguauua

SEQ ID NO: 1240995 - RNA, 19 nt, Homo sapiens
uauagucucuucuuucuga

SEQ ID NO: 1240996 - RNA, 19 nt, Homo sapiens
gcugaaagauuacccaaca

SEQ ID NO: 1240997 - RNA, 19 nt, Homo sapiens
gugcuuugauucacaauuu

SEQ ID NO: 1240998 - RNA, 19 nt, Homo sapiens
guggagccaugucaucuua

SEQ ID NO: 1240999 - RNA, 19 nt, Homo sapiens
ugacuuaacuucauuuguc

SEQ ID NO: 1241000 - RNA, 19 nt, Homo sapiens
ugucuucuauucugacuua

SEQ ID NO: 1241001 - RNA, 19 nt, Homo sapiens
gagcuaaccacuucuaaga

SEQ ID NO: 1241002 - RNA, 19 nt, Homo sapiens
ggaaaggugaggugaauau

SEQ ID NO: 1241003 - RNA, 19 nt, Homo sapiens
agaaagauaugaggaagaa

SEQ ID NO: 1241004 - RNA, 19 nt, Homo sapiens
caacauaccauuauagucu

SEQ ID NO: 1241005 - RNA, 19 nt, Homo sapiens
ggagccaugucaucuuaaa

SEQ ID NO: 1241006 - RNA, 19 nt, Homo sapiens
gagaagagugaaugaguuu

SEQ ID NO: 1241007 - RNA, 19 nt, Homo sapiens
ccuguaagguuaagaauuc

SEQ ID NO: 1241008 - RNA, 19 nt, Homo sapiens
ggaaaugggaugcuguuug

SEQ ID NO: 1241009 - RNA, 19 nt, Homo sapiens
gaagaagagagaccuaaug

SEQ ID NO: 1241010 - RNA, 19 nt, Homo sapiens
caaaucagaugccucuaag

SEQ ID NO: 1241011 - RNA, 19 nt, Homo sapiens
cugcaaacuuauuggauua

SEQ ID NO: 1241012 - RNA, 19 nt, Homo sapiens
ggaugcuguuuguaaauuu

SEQ ID NO: 1241013 - RNA, 19 nt, Homo sapiens
gaaagcaggaguccaaauc

SEQ ID NO: 1241014 - RNA, 19 nt, Homo sapiens
caaccacccuggacgaguu

SEQ ID NO: 1241015 - RNA, 19 nt, Homo sapiens
gggaugcuguuuguaaauu

SEQ ID NO: 1241016 - RNA, 19 nt, Homo sapiens
gaaaggugaggugaauaua

SEQ ID NO: 1241017 - RNA, 19 nt, Homo sapiens
guaagcugauucaucugua

SEQ ID NO: 1241018 - RNA, 19 nt, Homo sapiens
ggacuagaaagggagauua

SEQ ID NO: 1241019 - RNA, 19 nt, Homo sapiens
ugaaagauuacccaacaua

SEQ ID NO: 1241020 - RNA, 19 nt, Homo sapiens
caaagaaagauaugaggaa

SEQ ID NO: 1241021 - RNA, 19 nt, Homo sapiens
gagcagagccuuccaaacg

SEQ ID NO: 1241022 - RNA, 19 nt, Homo sapiens
gaaaccacacccagcauga

SEQ ID NO: 1241023 - RNA, 19 nt, Homo sapiens
acacugagaucaagagagu

SEQ ID NO: 1241024 - RNA, 19 nt, Homo sapiens
gcacggaacagauucagau

SEQ ID NO: 1241025 - RNA, 19 nt, Homo sapiens
uaagcugauucaucuguaa

SEQ ID NO: 1241026 - RNA, 19 nt, Homo sapiens
gaacgucugccucccaaau

SEQ ID NO: 1241027 - RNA, 19 nt, Homo sapiens
gaaaguccaccaugcuaau

SEQ ID NO: 1241028 - RNA, 19 nt, Homo sapiens
cauccaagcccaaguguga

SEQ ID NO: 1241029 - RNA, 19 nt, Homo sapiens
gucauaagguuuggauauu

SEQ ID NO: 1241030 - RNA, 19 nt, Homo sapiens
cuaaugaaauucgagaaga

SEQ ID NO: 1241031 - RNA, 19 nt, Homo sapiens
ggccuuugcuuccaauuuc

SEQ ID NO: 1241032 - RNA, 19 nt, Homo sapiens
gucgucaugucuacaauaa

SEQ ID NO: 1241033 - RNA, 19 nt, Homo sapiens
gaauggcugcucaccgaua

SEQ ID NO: 1241034 - RNA, 19 nt, Homo sapiens
gcagugagccaagauuaug

SEQ ID NO: 1241035 - RNA, 19 nt, Homo sapiens
ucaaaucagaugccucuaa

SEQ ID NO: 1241036 - RNA, 19 nt, Homo sapiens
gaaggaaagacaaagaaag

SEQ ID NO: 1241037 - RNA, 19 nt, Homo sapiens
gauaaugaagggaaccaaa

SEQ ID NO: 1241038 - RNA, 19 nt, Homo sapiens
ccauuauagucucuucuuu

SEQ ID NO: 1241039 - RNA, 19 nt, Homo sapiens
gauguuaugaggauuguug

SEQ ID NO: 1241040 - RNA, 19 nt, Homo sapiens
aagacacucuggauauuga

SEQ ID NO: 1241041 - RNA, 19 nt, Homo sapiens
caacguccuuagaaagaau

SEQ ID NO: 1241042 - RNA, 19 nt, Homo sapiens
caacaugucauuuaucaac

SEQ ID NO: 1241043 - RNA, 19 nt, Homo sapiens
gcaggaguccaaaucuauu

SEQ ID NO: 1241044 - RNA, 19 nt, Homo sapiens
aagcaggaguccaaaucua

SEQ ID NO: 1241045 - RNA, 19 nt, Homo sapiens
gaugagcauuuuccuuaua

SEQ ID NO: 1241046 - RNA, 19 nt, Homo sapiens
ggacucuucucgucauugg

SEQ ID NO: 1241047 - RNA, 19 nt, Homo sapiens
ggaaggagagcugacagaa

SEQ ID NO: 1241048 - RNA, 19 nt, Homo sapiens
gaaagagggagaggaugaa

SEQ ID NO: 1241049 - RNA, 19 nt, Homo sapiens
caagagaguggcagaggaa

SEQ ID NO: 1241050 - RNA, 19 nt, Homo sapiens
ggaagaagagagaccuaau

SEQ ID NO: 1241051 - RNA, 19 nt, Homo sapiens
aaagggagauuagaucagu

SEQ ID NO: 1241052 - RNA, 19 nt, Homo sapiens
uacccaacauaccauuaua

SEQ ID NO: 1241053 - RNA, 19 nt, Homo sapiens
gaaagauuacccaacauac

SEQ ID NO: 1241054 - RNA, 19 nt, Homo sapiens
cuucuccucuugcuaguuu

SEQ ID NO: 1241055 - RNA, 19 nt, Homo sapiens
gcuggagcccugcugauuu

SEQ ID NO: 1241056 - RNA, 19 nt, Homo sapiens
gagcuuuccaucuucauga

SEQ ID NO: 1241057 - RNA, 19 nt, Homo sapiens
ucugcaaacuuauuggauu

SEQ ID NO: 1241058 - RNA, 19 nt, Homo sapiens
gcauugcacggaacagauu

SEQ ID NO: 1241059 - RNA, 19 nt, Homo sapiens
gaauuacaauggacuugac

SEQ ID NO: 1241060 - RNA, 19 nt, Homo sapiens
aagaagagagaccuaauga

SEQ ID NO: 1241061 - RNA, 19 nt, Homo sapiens
aaagauaugaggaagaaga

SEQ ID NO: 1241062 - RNA, 19 nt, Homo sapiens
aagcaagacuccaucucaa

SEQ ID NO: 1241063 - RNA, 19 nt, Homo sapiens
gacuuaacuucauuuguca

SEQ ID NO: 1241064 - RNA, 19 nt, Homo sapiens
aaaggaaacaugugucuuc

SEQ ID NO: 1241065 - RNA, 19 nt, Homo sapiens
cagaugagcauuuuccuua

SEQ ID NO: 1241066 - RNA, 19 nt, Homo sapiens
cgaaggaaagacaaagaaa

SEQ ID NO: 1241067 - RNA, 19 nt, Homo sapiens
gaagagugaaugaguuucu

SEQ ID NO: 1241068 - RNA, 19 nt, Homo sapiens
agaaagagggagaggauga

SEQ ID NO: 1241069 - RNA, 19 nt, Homo sapiens
cuaggaaugcugaaagauu

SEQ ID NO: 1241070 - RNA, 19 nt, Homo sapiens
cgucaugucuacaauaacu

SEQ ID NO: 1241071 - RNA, 19 nt, Homo sapiens
uaacuugacugaggaacag

SEQ ID NO: 1241072 - RNA, 19 nt, Homo sapiens
aagacuggguggacuagaa

SEQ ID NO: 1241073 - RNA, 19 nt, Homo sapiens
cuagauauuucuggaagga

SEQ ID NO: 1241074 - RNA, 19 nt, Homo sapiens
agaacccacagccuuauua

SEQ ID NO: 1241075 - RNA, 19 nt, Homo sapiens
aaggaaagacaaagaaaga

SEQ ID NO: 1241076 - RNA, 19 nt, Homo sapiens
gcagcgaauccgagagaaa

SEQ ID NO: 1241077 - RNA, 19 nt, Homo sapiens
gaaggagagcugacagaag

SEQ ID NO: 1241078 - RNA, 19 nt, Homo sapiens
ggaugucccuccuccuucu

SEQ ID NO: 1241079 - RNA, 19 nt, Homo sapiens
gaaacaugugucuucuauu

SEQ ID NO: 1241080 - RNA, 19 nt, Homo sapiens
gcauuucugcaaacuuauu

SEQ ID NO: 1241081 - RNA, 19 nt, Homo sapiens
gcucauaucugaaauagaa

SEQ ID NO: 1241082 - RNA, 19 nt, Homo sapiens
gaucgccgcuuacaaguua

SEQ ID NO: 1241083 - RNA, 19 nt, Homo sapiens
gcagugagcugagauugua

SEQ ID NO: 1241084 - RNA, 19 nt, Homo sapiens
cagaauagcuccaauaugg

SEQ ID NO: 1241085 - RNA, 19 nt, Homo sapiens
ggacauuguuuaucugaaa

SEQ ID NO: 1241086 - RNA, 19 nt, Homo sapiens
gagagaagcuaguaaauac

SEQ ID NO: 1241087 - RNA, 19 nt, Homo sapiens
ggacugugcuauucaagga

SEQ ID NO: 1241088 - RNA, 19 nt, Homo sapiens
guaagucuauuguuucuca

SEQ ID NO: 1241089 - RNA, 19 nt, Homo sapiens
gaauagcuccaauauggua

SEQ ID NO: 1241090 - RNA, 19 nt, Homo sapiens
gaucguaauuggcuguuga

SEQ ID NO: 1241091 - RNA, 19 nt, Homo sapiens
gagaaagcacaccuuauuu

SEQ ID NO: 1241092 - RNA, 19 nt, Homo sapiens
gaagagaauuuguauuucc

SEQ ID NO: 1241093 - RNA, 19 nt, Homo sapiens
gcaaagccaguuuagauga

SEQ ID NO: 1241094 - RNA, 19 nt, Homo sapiens
uaccagagcauauuucuuu

SEQ ID NO: 1241095 - RNA, 19 nt, Homo sapiens
gacaggacauuguuuaucu

SEQ ID NO: 1241096 - RNA, 19 nt, Homo sapiens
caaugccacuuucaggaua

SEQ ID NO: 1241097 - RNA, 19 nt, Homo sapiens
uauggagacuggauuguuu

SEQ ID NO: 1241098 - RNA, 19 nt, Homo sapiens
gaaauucagaggcucauau

SEQ ID NO: 1241099 - RNA, 19 nt, Homo sapiens
caaagccaguuuagaugaa

SEQ ID NO: 1241100 - RNA, 19 nt, Homo sapiens
guaaaccaguucccaaaca

SEQ ID NO: 1241101 - RNA, 19 nt, Homo sapiens
gaagagaaggcgagagaau

SEQ ID NO: 1241102 - RNA, 19 nt, Homo sapiens
gcaguggucuaaggaagaa

SEQ ID NO: 1241103 - RNA, 19 nt, Homo sapiens
agagaaagcacaccuuauu

SEQ ID NO: 1241104 - RNA, 19 nt, Homo sapiens
ccagaggacugugcuauuc

SEQ ID NO: 1241105 - RNA, 19 nt, Homo sapiens
gcaaauuccagaaaccauu

SEQ ID NO: 1241106 - RNA, 19 nt, Homo sapiens
aagagcaaguuaaguauga

SEQ ID NO: 1241107 - RNA, 19 nt, Homo sapiens
ggacacauuuuacaagauu

SEQ ID NO: 1241108 - RNA, 19 nt, Homo sapiens
gaaaaguucugguucuuca

SEQ ID NO: 1241109 - RNA, 19 nt, Homo sapiens
guaaauacugggacacauu

SEQ ID NO: 1241110 - RNA, 19 nt, Homo sapiens
uggaagagcaaguuaagua

SEQ ID NO: 1241111 - RNA, 19 nt, Homo sapiens
gauaugcucaagcuuguuu

SEQ ID NO: 1241112 - RNA, 19 nt, Homo sapiens
gcuuacaaguuaauaggaa

SEQ ID NO: 1241113 - RNA, 19 nt, Homo sapiens
uguaugugaugauggcuua

SEQ ID NO: 1241114 - RNA, 19 nt, Homo sapiens
agagagaagcuaguaaaua

SEQ ID NO: 1241115 - RNA, 19 nt, Homo sapiens
ggaagagcaaguuaaguau

SEQ ID NO: 1241116 - RNA, 19 nt, Homo sapiens
gaagagcaaguuaaguaug

SEQ ID NO: 1241117 - RNA, 19 nt, Homo sapiens
agacugaacuuuguaacau

SEQ ID NO: 1241118 - RNA, 19 nt, Homo sapiens
uaucuacacuccuuucaca

SEQ ID NO: 1241119 - RNA, 19 nt, Homo sapiens
gaugauggcuuaccuuacc

SEQ ID NO: 1241120 - RNA, 19 nt, Homo sapiens
caacaagcccaaggucaaa

SEQ ID NO: 1241121 - RNA, 19 nt, Homo sapiens
agagagaaagcacaccuua

SEQ ID NO: 1241122 - RNA, 19 nt, Homo sapiens
uaaagucacacucguccua

SEQ ID NO: 1241123 - RNA, 19 nt, Homo sapiens
agaaugcacuguccuacug

SEQ ID NO: 1241124 - RNA, 19 nt, Homo sapiens
cuacacuccuuucacaaga

SEQ ID NO: 1241125 - RNA, 19 nt, Homo sapiens
gcuccaauaugguaucuac

SEQ ID NO: 1241126 - RNA, 19 nt, Homo sapiens
cagagcauauuucuuuaca

SEQ ID NO: 1241127 - RNA, 19 nt, Homo sapiens
gugaugauggcuuaccuua

SEQ ID NO: 1241128 - RNA, 19 nt, Homo sapiens
ugagagagaagcuaguaaa

SEQ ID NO: 1241129 - RNA, 19 nt, Homo sapiens
cuacaaaucguuucucaag

SEQ ID NO: 1241130 - RNA, 19 nt, Homo sapiens
ccaaggucaaaguguauua

SEQ ID NO: 1241131 - RNA, 19 nt, Homo sapiens
caaggcaaauuccagaaac

SEQ ID NO: 1241132 - RNA, 19 nt, Homo sapiens
ggaaguccacaguauguuc

SEQ ID NO: 1241133 - RNA, 19 nt, Homo sapiens
cggaguccuuucuguauug

SEQ ID NO: 1241134 - RNA, 19 nt, Homo sapiens
gcaaugccacuuucaggau

SEQ ID NO: 1241135 - RNA, 19 nt, Homo sapiens
gagagagaagcuaguaaau

SEQ ID NO: 1241136 - RNA, 19 nt, Homo sapiens
caauggcucgcaccuguaa

SEQ ID NO: 1241137 - RNA, 19 nt, Homo sapiens
gcaauggcucgcaccugua

SEQ ID NO: 1241138 - RNA, 19 nt, Homo sapiens
gagagaaagcacaccuuau

SEQ ID NO: 1241139 - RNA, 19 nt, Homo sapiens
uaugguaucuacacuccuu

SEQ ID NO: 1241140 - RNA, 19 nt, Homo sapiens
cugaaauucuuccaguuga

SEQ ID NO: 1241141 - RNA, 19 nt, Homo sapiens
gagaaaauguaacuugaca

SEQ ID NO: 1241142 - RNA, 19 nt, Homo sapiens
gacugaacuuuguaacaug

SEQ ID NO: 1241143 - RNA, 19 nt, Homo sapiens
caaauuccagaaaccauug

SEQ ID NO: 1241144 - RNA, 19 nt, Homo sapiens
gaugguaccagagcauauu

SEQ ID NO: 1241145 - RNA, 19 nt, Homo sapiens
gucagacucuucccauugu

SEQ ID NO: 1241146 - RNA, 19 nt, Homo sapiens
cacaguauguucugcaaag

SEQ ID NO: 1241147 - RNA, 19 nt, Homo sapiens
gagaugguaccagagcaua

SEQ ID NO: 1241148 - RNA, 19 nt, Homo sapiens
cuacagagcaacccagugu

SEQ ID NO: 1241149 - RNA, 19 nt, Homo sapiens
gcaaguuaaguaugagaga

SEQ ID NO: 1241150 - RNA, 19 nt, Homo sapiens
ugagcuccuuugugcauuu

SEQ ID NO: 1241151 - RNA, 19 nt, Homo sapiens
caugauguaugugaugaug

SEQ ID NO: 1241152 - RNA, 19 nt, Homo sapiens
ugucauaggugagcuccuu

SEQ ID NO: 1241153 - RNA, 19 nt, Homo sapiens
gaucacaugcaguggucua

SEQ ID NO: 1241154 - RNA, 19 nt, Homo sapiens
acagagcaacccaguguuu

SEQ ID NO: 1241155 - RNA, 19 nt, Homo sapiens
guccuacugugccugauga

SEQ ID NO: 1241156 - RNA, 19 nt, Homo sapiens
ucaagaaugcacuguccua

SEQ ID NO: 1241157 - RNA, 19 nt, Homo sapiens
gaagaagcagcagccagaa

SEQ ID NO: 1241158 - RNA, 19 nt, Homo sapiens
uucaggcuauucuuagaua

SEQ ID NO: 1241159 - RNA, 19 nt, Homo sapiens
guaagugguucagcacagu

SEQ ID NO: 1241160 - RNA, 19 nt, Homo sapiens
ccggaguccuuucuguauu

SEQ ID NO: 1241161 - RNA, 19 nt, Homo sapiens
gauacuagagguugguugu

SEQ ID NO: 1241162 - RNA, 19 nt, Homo sapiens
gaaauucuuccaguugauc

SEQ ID NO: 1241163 - RNA, 19 nt, Homo sapiens
caggcuauucuuagauaua

SEQ ID NO: 1241164 - RNA, 19 nt, Homo sapiens
uuuaguuccucuuuccuuu

SEQ ID NO: 1241165 - RNA, 19 nt, Homo sapiens
gaggcucauaucugaaaua

SEQ ID NO: 1241166 - RNA, 19 nt, Homo sapiens
ucugguugaucgccgcuua

SEQ ID NO: 1241167 - RNA, 19 nt, Homo sapiens
aaagccaguuuagaugaaa

SEQ ID NO: 1241168 - RNA, 19 nt, Homo sapiens
cugcaaagccaguuuagau

SEQ ID NO: 1241169 - RNA, 19 nt, Homo sapiens
uuugugcucucuucuauuc

SEQ ID NO: 1241170 - RNA, 19 nt, Homo sapiens
uacaaaucguuucucaaga

SEQ ID NO: 1241171 - RNA, 19 nt, Homo sapiens
guuucaaccucccagauuc

SEQ ID NO: 1241172 - RNA, 19 nt, Homo sapiens
ucaaggcaaauuccagaaa

SEQ ID NO: 1241173 - RNA, 19 nt, Homo sapiens
guucugcaaagccaguuua

SEQ ID NO: 1241174 - RNA, 19 nt, Homo sapiens
ugaaauucuuccaguugau

SEQ ID NO: 1241175 - RNA, 19 nt, Homo sapiens
uuucaaggaucguaauugg

SEQ ID NO: 1241176 - RNA, 19 nt, Homo sapiens
uuuccaaccuagacucuga

SEQ ID NO: 1241177 - RNA, 19 nt, Homo sapiens
gaaggcgagagaaucauca

SEQ ID NO: 1241178 - RNA, 19 nt, Homo sapiens
ccuguaaucccagcacuuu

SEQ ID NO: 1241179 - RNA, 19 nt, Homo sapiens
acaacaagcccaaggucaa

SEQ ID NO: 1241180 - RNA, 19 nt, Homo sapiens
ccagggaaagcuacaacaa

SEQ ID NO: 1241181 - RNA, 19 nt, Homo sapiens
ggacacagaugcuaaauau

SEQ ID NO: 1241182 - RNA, 19 nt, Homo sapiens
ccaaauaccucuguucuua

SEQ ID NO: 1241183 - RNA, 19 nt, Homo sapiens
guaguuaacuccauugauu

SEQ ID NO: 1241184 - RNA, 19 nt, Homo sapiens
ggagaaagccuuccucuuc

SEQ ID NO: 1241185 - RNA, 19 nt, Homo sapiens
gagaagcguugcaauuuga

SEQ ID NO: 1241186 - RNA, 19 nt, Homo sapiens
ggauguugcugcauucuaa

SEQ ID NO: 1241187 - RNA, 19 nt, Homo sapiens
gcacacagaugaagaaggu

SEQ ID NO: 1241188 - RNA, 19 nt, Homo sapiens
gagcugagaucacgccauu

SEQ ID NO: 1241189 - RNA, 19 nt, Homo sapiens
ucacaaugcucucuccuaa

SEQ ID NO: 1241190 - RNA, 19 nt, Homo sapiens
gagagggccuugcagcuuu

SEQ ID NO: 1241191 - RNA, 19 nt, Homo sapiens
gaaaggacacagaugcuaa

SEQ ID NO: 1241192 - RNA, 19 nt, Homo sapiens
uaacagcucccuuuggaua

SEQ ID NO: 1241193 - RNA, 19 nt, Homo sapiens
gggaggaaaugacagauga

SEQ ID NO: 1241194 - RNA, 19 nt, Homo sapiens
ccuaaggccuuuccucuuu

SEQ ID NO: 1241195 - RNA, 19 nt, Homo sapiens
gaugaagaagguuauguua

SEQ ID NO: 1241196 - RNA, 19 nt, Homo sapiens
ccucuucucucauaggaua

SEQ ID NO: 1241197 - RNA, 19 nt, Homo sapiens
ggacaaauggaauguuuau

SEQ ID NO: 1241198 - RNA, 19 nt, Homo sapiens
caaauggaauguuuauguc

SEQ ID NO: 1241199 - RNA, 19 nt, Homo sapiens
gcaccuaacagcucccuuu

SEQ ID NO: 1241200 - RNA, 19 nt, Homo sapiens
gauagaaacggguugaaug

SEQ ID NO: 1241201 - RNA, 19 nt, Homo sapiens
gcaaagccaaggagaagaa

SEQ ID NO: 1241202 - RNA, 19 nt, Homo sapiens
ccuaacagcucccuuugga

SEQ ID NO: 1241203 - RNA, 19 nt, Homo sapiens
gcaguuggaauugcuguua

SEQ ID NO: 1241204 - RNA, 19 nt, Homo sapiens
cagagaagcguugcaauuu

SEQ ID NO: 1241205 - RNA, 19 nt, Homo sapiens
gcuaugaagugcaguugga

SEQ ID NO: 1241206 - RNA, 19 nt, Homo sapiens
ugucuuagaucauggauuc

SEQ ID NO: 1241207 - RNA, 19 nt, Homo sapiens
gcagggaaaugaagaaagc

SEQ ID NO: 1241208 - RNA, 19 nt, Homo sapiens
gguguaagaucugggugua

SEQ ID NO: 1241209 - RNA, 19 nt, Homo sapiens
gggagaaagucaagcaaag

SEQ ID NO: 1241210 - RNA, 19 nt, Homo sapiens
gggaugaaguccuguacug

SEQ ID NO: 1241211 - RNA, 19 nt, Homo sapiens
aaacgaauaugcaaaccau

SEQ ID NO: 1241212 - RNA, 19 nt, Homo sapiens
ggacuucucguuccucaug

SEQ ID NO: 1241213 - RNA, 19 nt, Homo sapiens
agagaagcguugcaauuug

SEQ ID NO: 1241214 - RNA, 19 nt, Homo sapiens
gcaggagacucgcuugaac

SEQ ID NO: 1241215 - RNA, 19 nt, Homo sapiens
gcucagaacuaaugcucau

SEQ ID NO: 1241216 - RNA, 19 nt, Homo sapiens
gagagaaacgggaggaaau

SEQ ID NO: 1241217 - RNA, 19 nt, Homo sapiens
ggagaggcacuaucugaga

SEQ ID NO: 1241218 - RNA, 19 nt, Homo sapiens
ggacugggaacuccuuaga

SEQ ID NO: 1241219 - RNA, 19 nt, Homo sapiens
gugccaagaugcagggaaa

SEQ ID NO: 1241220 - RNA, 19 nt, Homo sapiens
ucagagaagcguugcaauu

SEQ ID NO: 1241221 - RNA, 19 nt, Homo sapiens
gaagugcaguuggaaagca

SEQ ID NO: 1241222 - RNA, 19 nt, Homo sapiens
gcuuuacacuggaauaagu

SEQ ID NO: 1241223 - RNA, 19 nt, Homo sapiens
gaauguuuauguccaccuu

SEQ ID NO: 1241224 - RNA, 19 nt, Homo sapiens
ccaaggagaagaagcagaa

SEQ ID NO: 1241225 - RNA, 19 nt, Homo sapiens
gccaacagcacacagauga

SEQ ID NO: 1241226 - RNA, 19 nt, Homo sapiens
acacagaugaagaagguua

SEQ ID NO: 1241227 - RNA, 19 nt, Homo sapiens
ccugauaccucucacucaa

SEQ ID NO: 1241228 - RNA, 19 nt, Homo sapiens
ucccaguguucaagaaaua

SEQ ID NO: 1241229 - RNA, 19 nt, Homo sapiens
aaagggagagggaagagua

SEQ ID NO: 1241230 - RNA, 19 nt, Homo sapiens
ggaaaggccuggggaaguu

SEQ ID NO: 1241231 - RNA, 19 nt, Homo sapiens
ucucuaggcuccuggaugu

SEQ ID NO: 1241232 - RNA, 19 nt, Homo sapiens
cagucuacguugucucuuu

SEQ ID NO: 1241233 - RNA, 19 nt, Homo sapiens
ggacuccuaagaaucauga

SEQ ID NO: 1241234 - RNA, 19 nt, Homo sapiens
acaaugcucucuccuaagg

SEQ ID NO: 1241235 - RNA, 19 nt, Homo sapiens
gaaguccuguacugcuaug

SEQ ID NO: 1241236 - RNA, 19 nt, Homo sapiens
aaaggcaggcucagaacua

SEQ ID NO: 1241237 - RNA, 19 nt, Homo sapiens
gccuuccucuucucucaua

SEQ ID NO: 1241238 - RNA, 19 nt, Homo sapiens
uguaagaucuggguguaga

SEQ ID NO: 1241239 - RNA, 19 nt, Homo sapiens
auacacacuuggacaaaug

SEQ ID NO: 1241240 - RNA, 19 nt, Homo sapiens
gaaacgggaggaaaugaca

SEQ ID NO: 1241241 - RNA, 19 nt, Homo sapiens
gaauaugcaaaccauguau

SEQ ID NO: 1241242 - RNA, 19 nt, Homo sapiens
uaaggugaguucagucuac

SEQ ID NO: 1241243 - RNA, 19 nt, Homo sapiens
gguggacuccuaagaauca

SEQ ID NO: 1241244 - RNA, 19 nt, Homo sapiens
cugaaaggaccaacaauga

SEQ ID NO: 1241245 - RNA, 19 nt, Homo sapiens
uuggacaaauggaauguuu

SEQ ID NO: 1241246 - RNA, 19 nt, Homo sapiens
cgaauaugcaaaccaugua

SEQ ID NO: 1241247 - RNA, 19 nt, Homo sapiens
gucuugagcccauucauuu

SEQ ID NO: 1241248 - RNA, 19 nt, Homo sapiens
gaccugcaaucacucuugu

SEQ ID NO: 1241249 - RNA, 19 nt, Homo sapiens
agaaacggguugaaugucu

SEQ ID NO: 1241250 - RNA, 19 nt, Homo sapiens
caguuggaauugcuguuaa

SEQ ID NO: 1241251 - RNA, 19 nt, Homo sapiens
gagaaacgggaggaaauga

SEQ ID NO: 1241252 - RNA, 19 nt, Homo sapiens
ggucuugagcccauucauu

SEQ ID NO: 1241253 - RNA, 19 nt, Homo sapiens
gagcauguuuaggaagaga

SEQ ID NO: 1241254 - RNA, 19 nt, Homo sapiens
agagggccuugcagcuuua

SEQ ID NO: 1241255 - RNA, 19 nt, Homo sapiens
uagaaaggcaggcucagaa

SEQ ID NO: 1241256 - RNA, 19 nt, Homo sapiens
ucauguaguuaacuccauu

SEQ ID NO: 1241257 - RNA, 19 nt, Homo sapiens
aaauaccucuguucuuagu

SEQ ID NO: 1241258 - RNA, 19 nt, Homo sapiens
caagaugcagggaaaugaa

SEQ ID NO: 1241259 - RNA, 19 nt, Homo sapiens
acaggagcauguuuaggaa

SEQ ID NO: 1241260 - RNA, 19 nt, Homo sapiens
cacaggagcauguuuagga

SEQ ID NO: 1241261 - RNA, 19 nt, Homo sapiens
acugggaacuccuuagaga

SEQ ID NO: 1241262 - RNA, 19 nt, Homo sapiens
gcacuuugcgcugcucuug

SEQ ID NO: 1241263 - RNA, 19 nt, Homo sapiens
ucucguuccucauguaguu

SEQ ID NO: 1241264 - RNA, 19 nt, Homo sapiens
uaacggagacugggaagau

SEQ ID NO: 1241265 - RNA, 19 nt, Homo sapiens
caaaagcccaucucuacua

SEQ ID NO: 1241266 - RNA, 19 nt, Homo sapiens
gagugguccuugcuucuca

SEQ ID NO: 1241267 - RNA, 19 nt, Homo sapiens
caagcaaagccaaggagaa

SEQ ID NO: 1241268 - RNA, 19 nt, Homo sapiens
ggauugcuccuaugagauc

SEQ ID NO: 1241269 - RNA, 19 nt, Homo sapiens
gacuugagcuuuugauuca

SEQ ID NO: 1241270 - RNA, 19 nt, Homo sapiens
gacucacgcuugcgcaguu

SEQ ID NO: 1241271 - RNA, 19 nt, Homo sapiens
ccaagaugcagggaaauga

SEQ ID NO: 1241272 - RNA, 19 nt, Homo sapiens
ggagcgagcagccauggau

SEQ ID NO: 1241273 - RNA, 19 nt, Homo sapiens
aaagccaaauccuuaucaa

SEQ ID NO: 1241274 - RNA, 19 nt, Homo sapiens
aaggcaggcucagaacuaa

SEQ ID NO: 1241275 - RNA, 19 nt, Homo sapiens
uugcugcauucuaagcuua

SEQ ID NO: 1241276 - RNA, 19 nt, Homo sapiens
cauacacacuuggacaaau

SEQ ID NO: 1241277 - RNA, 19 nt, Homo sapiens
ccugacacauacacacuug

SEQ ID NO: 1241278 - RNA, 19 nt, Homo sapiens
guggcugccuccucauuug

SEQ ID NO: 1241279 - RNA, 19 nt, Homo sapiens
cagaugaccgagccuggua

SEQ ID NO: 1241280 - RNA, 19 nt, Homo sapiens
ugaguucagucuacguugu

SEQ ID NO: 1241281 - RNA, 19 nt, Homo sapiens
gaaaggaucugcucaacuu

SEQ ID NO: 1241282 - RNA, 19 nt, Homo sapiens
gaaauuaguucaagcgauu

SEQ ID NO: 1241283 - RNA, 19 nt, Homo sapiens
ccaaagagcuucaaaauaa

SEQ ID NO: 1241284 - RNA, 19 nt, Homo sapiens
gauggaaucuucuucagua

SEQ ID NO: 1241285 - RNA, 19 nt, Homo sapiens
caugaacacugaugucuua

SEQ ID NO: 1241286 - RNA, 19 nt, Homo sapiens
guacacaaauucaaaguga

SEQ ID NO: 1241287 - RNA, 19 nt, Homo sapiens
caaagaguauuacagcaua

SEQ ID NO: 1241288 - RNA, 19 nt, Homo sapiens
gcaaauuucagaacuguua

SEQ ID NO: 1241289 - RNA, 19 nt, Homo sapiens
gagcaggaguugguaaaua

SEQ ID NO: 1241290 - RNA, 19 nt, Homo sapiens
gcaagccauucuucaaaua

SEQ ID NO: 1241291 - RNA, 19 nt, Homo sapiens
gaacacugaugucuuacaa

SEQ ID NO: 1241292 - RNA, 19 nt, Homo sapiens
accaagagcuuuauacaua

SEQ ID NO: 1241293 - RNA, 19 nt, Homo sapiens
aaagguaaaucacgaagua

SEQ ID NO: 1241294 - RNA, 19 nt, Homo sapiens
ccagaagacugcuauuauu

SEQ ID NO: 1241295 - RNA, 19 nt, Homo sapiens
cgacaaugcucaagaguau

SEQ ID NO: 1241296 - RNA, 19 nt, Homo sapiens
aaacuuaucugcagcaaau

SEQ ID NO: 1241297 - RNA, 19 nt, Homo sapiens
gaacagcuuucaauuugug

SEQ ID NO: 1241298 - RNA, 19 nt, Homo sapiens
cgaaacagauugagggaaa

SEQ ID NO: 1241299 - RNA, 19 nt, Homo sapiens
caaaggaugugauuagugu

SEQ ID NO: 1241300 - RNA, 19 nt, Homo sapiens
aagaacagcuuucaauuug

SEQ ID NO: 1241301 - RNA, 19 nt, Homo sapiens
gcucaagaguauugucaua

SEQ ID NO: 1241302 - RNA, 19 nt, Homo sapiens
gaacagaggaaauauguca

SEQ ID NO: 1241303 - RNA, 19 nt, Homo sapiens
ugaaagaaaugacguauac

SEQ ID NO: 1241304 - RNA, 19 nt, Homo sapiens
gcaugagagugccuauuaa

SEQ ID NO: 1241305 - RNA, 19 nt, Homo sapiens
gacauuaucccagaacuua

SEQ ID NO: 1241306 - RNA, 19 nt, Homo sapiens
gguaaaucacgaaguauua

SEQ ID NO: 1241307 - RNA, 19 nt, Homo sapiens
cagcagaauucaagaaaga

SEQ ID NO: 1241308 - RNA, 19 nt, Homo sapiens
ggaagagagucauuugcaa

SEQ ID NO: 1241309 - RNA, 19 nt, Homo sapiens
ccaaaccacuuauaucugu

SEQ ID NO: 1241310 - RNA, 19 nt, Homo sapiens
gaaaugagagcaaaagaua

SEQ ID NO: 1241311 - RNA, 19 nt, Homo sapiens
ccacggaacuucuaauugg

SEQ ID NO: 1241312 - RNA, 19 nt, Homo sapiens
gcaagaaacauauaucaca

SEQ ID NO: 1241313 - RNA, 19 nt, Homo sapiens
gauacaguuucuucaguaa

SEQ ID NO: 1241314 - RNA, 19 nt, Homo sapiens
gauguggcauucuguuauu

SEQ ID NO: 1241315 - RNA, 19 nt, Homo sapiens
gaucguacauuacuaucug

SEQ ID NO: 1241316 - RNA, 19 nt, Homo sapiens
aaagauacgacuccaguua

SEQ ID NO: 1241317 - RNA, 19 nt, Homo sapiens
gagagugccuauuaaaucu

SEQ ID NO: 1241318 - RNA, 19 nt, Homo sapiens
gaacuuaccuaaaagacuu

SEQ ID NO: 1241319 - RNA, 19 nt, Homo sapiens
cgaaacauuuauaggcuaa

SEQ ID NO: 1241320 - RNA, 19 nt, Homo sapiens
caagaaagaagaaccaaga

SEQ ID NO: 1241321 - RNA, 19 nt, Homo sapiens
uaugauagcaccacuaauu

SEQ ID NO: 1241322 - RNA, 19 nt, Homo sapiens
ggaaucuucuucaguaagu

SEQ ID NO: 1241323 - RNA, 19 nt, Homo sapiens
gaacugcugugagaacugu

SEQ ID NO: 1241324 - RNA, 19 nt, Homo sapiens
ggaaacuguucuucaggaa

SEQ ID NO: 1241325 - RNA, 19 nt, Homo sapiens
gcccucagaugaaaugauu

SEQ ID NO: 1241326 - RNA, 19 nt, Homo sapiens
uaaggauugugccaguuua

SEQ ID NO: 1241327 - RNA, 19 nt, Homo sapiens
gaaguuauagcaagccauu

SEQ ID NO: 1241328 - RNA, 19 nt, Homo sapiens
guaaugcuguugcuaguag

SEQ ID NO: 1241329 - RNA, 19 nt, Homo sapiens
cauaaucuuugcaguaaug

SEQ ID NO: 1241330 - RNA, 19 nt, Homo sapiens
uaccaugcaucacugaaua

SEQ ID NO: 1241331 - RNA, 19 nt, Homo sapiens
ggauggaacagaggaaaua

SEQ ID NO: 1241332 - RNA, 19 nt, Homo sapiens
gaaccaagagcuuuauaca

SEQ ID NO: 1241333 - RNA, 19 nt, Homo sapiens
caucaaaggcuaucuuaau

SEQ ID NO: 1241334 - RNA, 19 nt, Homo sapiens
cagccuaucuugucuuuca

SEQ ID NO: 1241335 - RNA, 19 nt, Homo sapiens
agagagugcuucacaguug

SEQ ID NO: 1241336 - RNA, 19 nt, Homo sapiens
caaaacauguucaggaauu

SEQ ID NO: 1241337 - RNA, 19 nt, Homo sapiens
gauagcaccacuaauuuga

SEQ ID NO: 1241338 - RNA, 19 nt, Homo sapiens
aaagcaguguuuacccuua

SEQ ID NO: 1241339 - RNA, 19 nt, Homo sapiens
guucaccaguuccuucuaa

SEQ ID NO: 1241340 - RNA, 19 nt, Homo sapiens
ccacagcuauucagguuuc

SEQ ID NO: 1241341 - RNA, 19 nt, Homo sapiens
acuguaagcuggaaaucua

SEQ ID NO: 1241342 - RNA, 19 nt, Homo sapiens
acagaacgauaaacaguga

SEQ ID NO: 1241343 - RNA, 19 nt, Homo sapiens
agauacgacuccaguuaua

SEQ ID NO: 1241344 - RNA, 19 nt, Homo sapiens
gacagucucauuacuuuaa

SEQ ID NO: 1241345 - RNA, 19 nt, Homo sapiens
gagugccuauuaaaucuuu

SEQ ID NO: 1241346 - RNA, 19 nt, Homo sapiens
ucagucagaugaaagaaau

SEQ ID NO: 1241347 - RNA, 19 nt, Homo sapiens
agucucggcuguuuguuua

SEQ ID NO: 1241348 - RNA, 19 nt, Homo sapiens
ccacauacuucagauggaa

SEQ ID NO: 1241349 - RNA, 19 nt, Homo sapiens
guuuggaacuggagaauuc

SEQ ID NO: 1241350 - RNA, 19 nt, Homo sapiens
cagcuugucuucucugugu

SEQ ID NO: 1241351 - RNA, 19 nt, Homo sapiens
uaauauuccuugucucuca

SEQ ID NO: 1241352 - RNA, 19 nt, Homo sapiens
gcaauugguuccaguacag

SEQ ID NO: 1241353 - RNA, 19 nt, Homo sapiens
gaaggacagucucauuacu

SEQ ID NO: 1241354 - RNA, 19 nt, Homo sapiens
gauagauauuggcaaguug

SEQ ID NO: 1241355 - RNA, 19 nt, Homo sapiens
gucguuacaugaagaguuu

SEQ ID NO: 1241356 - RNA, 19 nt, Homo sapiens
gagauugucccaugucguu

SEQ ID NO: 1241357 - RNA, 19 nt, Homo sapiens
gcauaaacuucgucagucu

SEQ ID NO: 1241358 - RNA, 19 nt, Homo sapiens
cauagaugauaguugcaua

SEQ ID NO: 1241359 - RNA, 19 nt, Homo sapiens
ggagaauuccuuugcauca

SEQ ID NO: 1241360 - RNA, 19 nt, Homo sapiens
guucaacacuauuuguaug

SEQ ID NO: 1241361 - RNA, 19 nt, Homo sapiens
gcaaauuggaguugauaug

SEQ ID NO: 1241362 - RNA, 19 nt, Homo sapiens
cuucgaagauuguuucaga

SEQ ID NO: 1241363 - RNA, 19 nt, Homo sapiens
agauacaguuucuucagua

SEQ ID NO: 1241364 - RNA, 19 nt, Homo sapiens
gagagugcuucacaguuga

SEQ ID NO: 1241365 - RNA, 19 nt, Homo sapiens
ccagaacucaggagaauga

SEQ ID NO: 1241366 - RNA, 19 nt, Homo sapiens
gauucuuggucuauaauug

SEQ ID NO: 1241367 - RNA, 19 nt, Homo sapiens
uuucggaguuugauuauug

SEQ ID NO: 1241368 - RNA, 19 nt, Homo sapiens
caguagaucuuggcaauuc

SEQ ID NO: 1241369 - RNA, 19 nt, Homo sapiens
uaaaauagcagcagaauuc

SEQ ID NO: 1241370 - RNA, 19 nt, Homo sapiens
acugaaauguugcaggaua

SEQ ID NO: 1241371 - RNA, 19 nt, Homo sapiens
ucuaagaguucaccuagug

SEQ ID NO: 1241372 - RNA, 19 nt, Homo sapiens
ggacagucucauuacuuua

SEQ ID NO: 1241373 - RNA, 19 nt, Homo sapiens
cugaaagacucaaugaaau

SEQ ID NO: 1241374 - RNA, 19 nt, Homo sapiens
ccugaaagacucaaugaaa

SEQ ID NO: 1241375 - RNA, 19 nt, Homo sapiens
agcaggaguugguaaauaa

SEQ ID NO: 1241376 - RNA, 19 nt, Homo sapiens
uaccaaggauuagauacua

SEQ ID NO: 1241377 - RNA, 19 nt, Homo sapiens
ugcaggauauugugaauga

SEQ ID NO: 1241378 - RNA, 19 nt, Homo sapiens
ccacuuauaucuguuccuu

SEQ ID NO: 1241379 - RNA, 19 nt, Homo sapiens
ugauagauauuggcaaguu

SEQ ID NO: 1241380 - RNA, 19 nt, Homo sapiens
guaauaccaugggacaaga

SEQ ID NO: 1241381 - RNA, 19 nt, Homo sapiens
gcaaauacaucgugaauga

SEQ ID NO: 1241382 - RNA, 19 nt, Homo sapiens
gcauucaucuguucacuaa

SEQ ID NO: 1241383 - RNA, 19 nt, Homo sapiens
gagcaacccugcacaaaga

SEQ ID NO: 1241384 - RNA, 19 nt, Homo sapiens
ccacugagcucuucuacga

SEQ ID NO: 1241385 - RNA, 19 nt, Homo sapiens
acacgcaccuucuccauaa

SEQ ID NO: 1241386 - RNA, 19 nt, Homo sapiens
ccacuucgcugugcccaua

SEQ ID NO: 1241387 - RNA, 19 nt, Homo sapiens
gaucgauacuccuaugcua

SEQ ID NO: 1241388 - RNA, 19 nt, Homo sapiens
ggacauccuucuuaaaguc

SEQ ID NO: 1241389 - RNA, 19 nt, Homo sapiens
gaaggacauugcagacaga

SEQ ID NO: 1241390 - RNA, 19 nt, Homo sapiens
gaaguggaguuuggaguau

SEQ ID NO: 1241391 - RNA, 19 nt, Homo sapiens
guaauugugucucguuugu

SEQ ID NO: 1241392 - RNA, 19 nt, Homo sapiens
guaaagaagaccugaaguu

SEQ ID NO: 1241393 - RNA, 19 nt, Homo sapiens
ggagagagcugggcauugc

SEQ ID NO: 1241394 - RNA, 19 nt, Homo sapiens
guacacagaugaggaaugg

SEQ ID NO: 1241395 - RNA, 19 nt, Homo sapiens
agacacaccucccuggaaa

SEQ ID NO: 1241396 - RNA, 19 nt, Homo sapiens
gcacauggcaggacguaga

SEQ ID NO: 1241397 - RNA, 19 nt, Homo sapiens
aagaagaccugaaguugga

SEQ ID NO: 1241398 - RNA, 19 nt, Homo sapiens
gaagaaaccaccaaaccau

SEQ ID NO: 1241399 - RNA, 19 nt, Homo sapiens
gauuccagaugugaaguua

SEQ ID NO: 1241400 - RNA, 19 nt, Homo sapiens
gaggaaaucaccaucaaug

SEQ ID NO: 1241401 - RNA, 19 nt, Homo sapiens
gcucuaugcuuucuguaau

SEQ ID NO: 1241402 - RNA, 19 nt, Homo sapiens
gaaccuguguccugaagag

SEQ ID NO: 1241403 - RNA, 19 nt, Homo sapiens
gaaguugguucgagguaca

SEQ ID NO: 1241404 - RNA, 19 nt, Homo sapiens
uaaagaagaccugaaguug

SEQ ID NO: 1241405 - RNA, 19 nt, Homo sapiens
ggccagagaaggcacuuua

SEQ ID NO: 1241406 - RNA, 19 nt, Homo sapiens
ggacgccacagccugaaua

SEQ ID NO: 1241407 - RNA, 19 nt, Homo sapiens
ggugaaacaugggcucuga

SEQ ID NO: 1241408 - RNA, 19 nt, Homo sapiens
ccaauuacucugauccuuu

SEQ ID NO: 1241409 - RNA, 19 nt, Homo sapiens
guccgucccuccagcauuu

SEQ ID NO: 1241410 - RNA, 19 nt, Homo sapiens
aaacaugggcucugagguu

SEQ ID NO: 1241411 - RNA, 19 nt, Homo sapiens
ggcaggacguagacaaaga

SEQ ID NO: 1241412 - RNA, 19 nt, Homo sapiens
ggagaaucccgaccuggaa

SEQ ID NO: 1241413 - RNA, 19 nt, Homo sapiens
ucaacgaguucaucagcaa

SEQ ID NO: 1241414 - RNA, 19 nt, Homo sapiens
ggagcguggugacauuguu

SEQ ID NO: 1241415 - RNA, 19 nt, Homo sapiens
gcagguuuguuuuauguuu

SEQ ID NO: 1241416 - RNA, 19 nt, Homo sapiens
gaaguaaugacucucaaac

SEQ ID NO: 1241417 - RNA, 19 nt, Homo sapiens
caauuacucugauccuuuu

SEQ ID NO: 1241418 - RNA, 19 nt, Homo sapiens
ucagaaagccgaauguuuu

SEQ ID NO: 1241419 - RNA, 19 nt, Homo sapiens
gaccagaucccggaguuga

SEQ ID NO: 1241420 - RNA, 19 nt, Homo sapiens
gcacgcagguuuguuuuau

SEQ ID NO: 1241421 - RNA, 19 nt, Homo sapiens
gagaaucccgaccuggaaa

SEQ ID NO: 1241422 - RNA, 19 nt, Homo sapiens
gacacgcaccuucuccaua

SEQ ID NO: 1241423 - RNA, 19 nt, Homo sapiens
gggacauccuucuuaaagu

SEQ ID NO: 1241424 - RNA, 19 nt, Homo sapiens
cgaaggucuugcuggauga

SEQ ID NO: 1241425 - RNA, 19 nt, Homo sapiens
gcugagcagugggagcuuu

SEQ ID NO: 1241426 - RNA, 19 nt, Homo sapiens
ucacugaucccaauuacuc

SEQ ID NO: 1241427 - RNA, 19 nt, Homo sapiens
ugaaagggccugacaugca

SEQ ID NO: 1241428 - RNA, 19 nt, Homo sapiens
gaaaaguuccccaaguuug

SEQ ID NO: 1241429 - RNA, 19 nt, Homo sapiens
gcugaaagggccugacaug

SEQ ID NO: 1241430 - RNA, 19 nt, Homo sapiens
agaaguggaguuuggagua

SEQ ID NO: 1241431 - RNA, 19 nt, Homo sapiens
ccagagaaggcacuuuaug

SEQ ID NO: 1241432 - RNA, 19 nt, Homo sapiens
ggaggcccgugauccugaa

SEQ ID NO: 1241433 - RNA, 19 nt, Homo sapiens
ggcggaccaugguuugauu

SEQ ID NO: 1241434 - RNA, 19 nt, Homo sapiens
caagggcggaccaugguuu

SEQ ID NO: 1241435 - RNA, 19 nt, Homo sapiens
agaggagcguggugacauu

SEQ ID NO: 1241436 - RNA, 19 nt, Homo sapiens
gcucagcaccagcucuuug

SEQ ID NO: 1241437 - RNA, 19 nt, Homo sapiens
cagcaaauacaucgugaau

SEQ ID NO: 1241438 - RNA, 19 nt, Homo sapiens
gagguacacagaugaggaa

SEQ ID NO: 1241439 - RNA, 19 nt, Homo sapiens
ccuggaaucuauagagaca

SEQ ID NO: 1241440 - RNA, 19 nt, Homo sapiens
guccuggaaucuauagaga

SEQ ID NO: 1241441 - RNA, 19 nt, Homo sapiens
gagcggugagcgaucgaua

SEQ ID NO: 1241442 - RNA, 19 nt, Homo sapiens
cagaaguaaugacucucaa

SEQ ID NO: 1241443 - RNA, 19 nt, Homo sapiens
ggucguagccaggauagga

SEQ ID NO: 1241444 - RNA, 19 nt, Homo sapiens
gcucaaggauaaccuaccu

SEQ ID NO: 1241445 - RNA, 19 nt, Homo sapiens
ggaggaaaucaccaucaau

SEQ ID NO: 1241446 - RNA, 19 nt, Homo sapiens
ggccgugcaugcagaagug

SEQ ID NO: 1241447 - RNA, 19 nt, Homo sapiens
uuccagaugugaaguuaga

SEQ ID NO: 1241448 - RNA, 19 nt, Homo sapiens
cagagaaggcacuuuaugg

SEQ ID NO: 1241449 - RNA, 19 nt, Homo sapiens
gagacaagcaggacugaac

SEQ ID NO: 1241450 - RNA, 19 nt, Homo sapiens
gcaugcagaaguggaguuu

SEQ ID NO: 1241451 - RNA, 19 nt, Homo sapiens
gaggaggaaaucaccauca

SEQ ID NO: 1241452 - RNA, 19 nt, Homo sapiens
ggagagcccagaaggacau

SEQ ID NO: 1241453 - RNA, 19 nt, Homo sapiens
aggaggaaaucaccaucaa

SEQ ID NO: 1241454 - RNA, 19 nt, Homo sapiens
gguucgagguacacagaug

SEQ ID NO: 1241455 - RNA, 19 nt, Homo sapiens
ccagaugugaaguuagaaa

SEQ ID NO: 1241456 - RNA, 19 nt, Homo sapiens
ucuaugcuuucuguaauug

SEQ ID NO: 1241457 - RNA, 19 nt, Homo sapiens
ccagaaguaaugacucuca

SEQ ID NO: 1241458 - RNA, 19 nt, Homo sapiens
ggucuugcuggaugacuuu

SEQ ID NO: 1241459 - RNA, 19 nt, Homo sapiens
gagcugaaagggccugaca

SEQ ID NO: 1241460 - RNA, 19 nt, Homo sapiens
ccggugaaauacuggcauu

SEQ ID NO: 1241461 - RNA, 19 nt, Homo sapiens
caacgaguucaucagcaaa

SEQ ID NO: 1241462 - RNA, 19 nt, Homo sapiens
aauugugucucguuugugu

SEQ ID NO: 1241463 - RNA, 19 nt, Homo sapiens
ugaagaaaccaccaaacca

SEQ ID NO: 1241464 - RNA, 19 nt, Homo sapiens
ccuggguccuggaaucuau

SEQ ID NO: 1241465 - RNA, 19 nt, Homo sapiens
gcaacccugcacaaagaaa

SEQ ID NO: 1241466 - RNA, 19 nt, Homo sapiens
gagcguggugacauuguug

SEQ ID NO: 1241467 - RNA, 19 nt, Homo sapiens
gaaacgggugggucacaca

SEQ ID NO: 1241468 - RNA, 19 nt, Homo sapiens
cuggagagauccuguucau

SEQ ID NO: 1241469 - RNA, 19 nt, Homo sapiens
caucggcugccuccugaaa

SEQ ID NO: 1241470 - RNA, 19 nt, Homo sapiens
acgaguucaucagcaaaua

SEQ ID NO: 1241471 - RNA, 19 nt, Homo sapiens
cagagcaacccugcacaaa

SEQ ID NO: 1241472 - RNA, 19 nt, Homo sapiens
gagaggagcguggugacau

SEQ ID NO: 1241473 - RNA, 19 nt, Homo sapiens
aaguggaguuuggaguaua

SEQ ID NO: 1241474 - RNA, 19 nt, Homo sapiens
ugacaugggccugcugaug

SEQ ID NO: 1241475 - RNA, 19 nt, Homo sapiens
gugaaauacuggcauuacg

SEQ ID NO: 1241476 - RNA, 19 nt, Homo sapiens
ggaaccaucuccccacuac

SEQ ID NO: 1241477 - RNA, 19 nt, Homo sapiens
caggcucuaugcuuucugu

SEQ ID NO: 1241478 - RNA, 19 nt, Homo sapiens
agaaaccaccaaaccauca

SEQ ID NO: 1241479 - RNA, 19 nt, Homo sapiens
caagugaagaaaccaccaa

SEQ ID NO: 1241480 - RNA, 19 nt, Homo sapiens
caucagaaagccgaauguu

SEQ ID NO: 1241481 - RNA, 19 nt, Homo sapiens
gggaacagauauuuacuua

SEQ ID NO: 1241482 - RNA, 19 nt, Homo sapiens
gaaaagagcuaaaggaaaa

SEQ ID NO: 1241483 - RNA, 19 nt, Homo sapiens
gaagagcaaugaugagcua

SEQ ID NO: 1241484 - RNA, 19 nt, Homo sapiens
ucagaaagcugccaugaug

SEQ ID NO: 1241485 - RNA, 19 nt, Homo sapiens
gcaagaaccucuccacucu

SEQ ID NO: 1241486 - RNA, 19 nt, Homo sapiens
uaaggagacucuagccaua

SEQ ID NO: 1241487 - RNA, 19 nt, Homo sapiens
gguacuuucuucucauuua

SEQ ID NO: 1241488 - RNA, 19 nt, Homo sapiens
gaaauaaaccuucacaaac

SEQ ID NO: 1241489 - RNA, 19 nt, Homo sapiens
gaacagauauuuacuuacc

SEQ ID NO: 1241490 - RNA, 19 nt, Homo sapiens
ccagaugguucguacauuu

SEQ ID NO: 1241491 - RNA, 19 nt, Homo sapiens
cuaccaaucuugaaucuga

SEQ ID NO: 1241492 - RNA, 19 nt, Homo sapiens
uagaagacauagagacuuu

SEQ ID NO: 1241493 - RNA, 19 nt, Homo sapiens
gaagacaacaguaaucaga

SEQ ID NO: 1241494 - RNA, 19 nt, Homo sapiens
cagagagcgugaugaauuu

SEQ ID NO: 1241495 - RNA, 19 nt, Homo sapiens
ggcaaagccuauaauaaga

SEQ ID NO: 1241496 - RNA, 19 nt, Homo sapiens
ggacacuguugccauagaa

SEQ ID NO: 1241497 - RNA, 19 nt, Homo sapiens
gaggaacugcuauuucuaa

SEQ ID NO: 1241498 - RNA, 19 nt, Homo sapiens
uacauggaauugcuuguua

SEQ ID NO: 1241499 - RNA, 19 nt, Homo sapiens
gguaacaguccaucagaua

SEQ ID NO: 1241500 - RNA, 19 nt, Homo sapiens
gauauagucaagaugcuua

SEQ ID NO: 1241501 - RNA, 19 nt, Homo sapiens
gagucucucugcuauguuu

SEQ ID NO: 1241502 - RNA, 19 nt, Homo sapiens
gaguuuguuucuaguagua

SEQ ID NO: 1241503 - RNA, 19 nt, Homo sapiens
uagauggcaugcuaaauga

SEQ ID NO: 1241504 - RNA, 19 nt, Homo sapiens
gaaaagaaccuccagcuau

SEQ ID NO: 1241505 - RNA, 19 nt, Homo sapiens
gcaaagccuauaauaagaa

SEQ ID NO: 1241506 - RNA, 19 nt, Homo sapiens
caaagcccauugaacuuga

SEQ ID NO: 1241507 - RNA, 19 nt, Homo sapiens
gauggcaugcuaaaugaua

SEQ ID NO: 1241508 - RNA, 19 nt, Homo sapiens
caagcuaagccaaguagua

SEQ ID NO: 1241509 - RNA, 19 nt, Homo sapiens
caaacaagaaggaauaugu

SEQ ID NO: 1241510 - RNA, 19 nt, Homo sapiens
agacaacaguaaucagaaa

SEQ ID NO: 1241511 - RNA, 19 nt, Homo sapiens
gagagugaauuuaccuuag

SEQ ID NO: 1241512 - RNA, 19 nt, Homo sapiens
gagguacuuucuucucauu

SEQ ID NO: 1241513 - RNA, 19 nt, Homo sapiens
ucaaagagguggaggaaaa

SEQ ID NO: 1241514 - RNA, 19 nt, Homo sapiens
caccaaaucugcacaagag

SEQ ID NO: 1241515 - RNA, 19 nt, Homo sapiens
acagagagcgugaugaauu

SEQ ID NO: 1241516 - RNA, 19 nt, Homo sapiens
gagcaaugaugagcuacuu

SEQ ID NO: 1241517 - RNA, 19 nt, Homo sapiens
ggaugcuacuucugauaaa

SEQ ID NO: 1241518 - RNA, 19 nt, Homo sapiens
caaaucugcacaagaguuu

SEQ ID NO: 1241519 - RNA, 19 nt, Homo sapiens
caggauuuauugccucuuu

SEQ ID NO: 1241520 - RNA, 19 nt, Homo sapiens
aaagagaguugugaaauac

SEQ ID NO: 1241521 - RNA, 19 nt, Homo sapiens
gaacacaagagcaaugaag

SEQ ID NO: 1241522 - RNA, 19 nt, Homo sapiens
caagaaggaauaugucaga

SEQ ID NO: 1241523 - RNA, 19 nt, Homo sapiens
gugaugaauuugugguaaa

SEQ ID NO: 1241524 - RNA, 19 nt, Homo sapiens
aagcgucucuacucccuua

SEQ ID NO: 1241525 - RNA, 19 nt, Homo sapiens
guaacaguccaucagauaa

SEQ ID NO: 1241526 - RNA, 19 nt, Homo sapiens
cuacaacacccacaccuuu

SEQ ID NO: 1241527 - RNA, 19 nt, Homo sapiens
gaaaagggcaaguuaaaga

SEQ ID NO: 1241528 - RNA, 19 nt, Homo sapiens
gagaugcaaagaguaaaua

SEQ ID NO: 1241529 - RNA, 19 nt, Homo sapiens
uaacaguccaucagauaaa

SEQ ID NO: 1241530 - RNA, 19 nt, Homo sapiens
caagagcaaugaaggaaac

SEQ ID NO: 1241531 - RNA, 19 nt, Homo sapiens
ccugagauccauacuagua

SEQ ID NO: 1241532 - RNA, 19 nt, Homo sapiens
gaaauucgagauggucaaa

SEQ ID NO: 1241533 - RNA, 19 nt, Homo sapiens
gguaaagauagaagacaua

SEQ ID NO: 1241534 - RNA, 19 nt, Homo sapiens
gaaccucuccacucuacuu

SEQ ID NO: 1241535 - RNA, 19 nt, Homo sapiens
gacucuagccauaguauuu

SEQ ID NO: 1241536 - RNA, 19 nt, Homo sapiens
ucauuuggaucaaucauuc

SEQ ID NO: 1241537 - RNA, 19 nt, Homo sapiens
gccaagaaauaaaccuuca

SEQ ID NO: 1241538 - RNA, 19 nt, Homo sapiens
aucauucacuccaucauua

SEQ ID NO: 1241539 - RNA, 19 nt, Homo sapiens
gaucaaagagguggaggaa

SEQ ID NO: 1241540 - RNA, 19 nt, Homo sapiens
gagcuauaauugguaaugu

SEQ ID NO: 1241541 - RNA, 19 nt, Homo sapiens
uuuaagagcuacauggaau

SEQ ID NO: 1241542 - RNA, 19 nt, Homo sapiens
acagaaauuuguuccugaa

SEQ ID NO: 1241543 - RNA, 19 nt, Homo sapiens
aaaagaaccuccagcuauu

SEQ ID NO: 1241544 - RNA, 19 nt, Homo sapiens
cagugaagcuccuguugau

SEQ ID NO: 1241545 - RNA, 19 nt, Homo sapiens
uaggagcuauaauugguaa

SEQ ID NO: 1241546 - RNA, 19 nt, Homo sapiens
gcaguaaauauucuggaaa

SEQ ID NO: 1241547 - RNA, 19 nt, Homo sapiens
uggcaaagccuauaauaag

SEQ ID NO: 1241548 - RNA, 19 nt, Homo sapiens
gagcuacuuuuaccucaua

SEQ ID NO: 1241549 - RNA, 19 nt, Homo sapiens
uagagaagagcaaugauga

SEQ ID NO: 1241550 - RNA, 19 nt, Homo sapiens
uauaagcucuucagaaucc

SEQ ID NO: 1241551 - RNA, 19 nt, Homo sapiens
uaaguaccauguuuaucug

SEQ ID NO: 1241552 - RNA, 19 nt, Homo sapiens
gcuaaaugauaaccgaaag

SEQ ID NO: 1241553 - RNA, 19 nt, Homo sapiens
gaaccucccgcucccuuug

SEQ ID NO: 1241554 - RNA, 19 nt, Homo sapiens
gaagacauagagacuuuua

SEQ ID NO: 1241555 - RNA, 19 nt, Homo sapiens
ggaggaacugcuauuucua

SEQ ID NO: 1241556 - RNA, 19 nt, Homo sapiens
guagugacgaugaggaauu

SEQ ID NO: 1241557 - RNA, 19 nt, Homo sapiens
gagaaggccaauacagaga

SEQ ID NO: 1241558 - RNA, 19 nt, Homo sapiens
gagagagugcuacaucaga

SEQ ID NO: 1241559 - RNA, 19 nt, Homo sapiens
gcagucagugucaagauug

SEQ ID NO: 1241560 - RNA, 19 nt, Homo sapiens
ugagacagaagaucaaaga

SEQ ID NO: 1241561 - RNA, 19 nt, Homo sapiens
caagaguuuguuucuagua

SEQ ID NO: 1241562 - RNA, 19 nt, Homo sapiens
uggaggaacugcuauuucu

SEQ ID NO: 1241563 - RNA, 19 nt, Homo sapiens
ugacacaaugcaagccuua

SEQ ID NO: 1241564 - RNA, 19 nt, Homo sapiens
cgugaaacccaaaguuaaa

SEQ ID NO: 1241565 - RNA, 19 nt, Homo sapiens
caucagagagugaauuuac

SEQ ID NO: 1241566 - RNA, 19 nt, Homo sapiens
uagugacgaugaggaauuu

SEQ ID NO: 1241567 - RNA, 19 nt, Homo sapiens
ggagaugcaaagaguaaau

SEQ ID NO: 1241568 - RNA, 19 nt, Homo sapiens
aaagauagaagacauagag

SEQ ID NO: 1241569 - RNA, 19 nt, Homo sapiens
uguaggagcuauaauuggu

SEQ ID NO: 1241570 - RNA, 19 nt, Homo sapiens
gaauuugugguaaagauag

SEQ ID NO: 1241571 - RNA, 19 nt, Homo sapiens
gauauguaaggaugaggua

SEQ ID NO: 1241572 - RNA, 19 nt, Homo sapiens
gugaagcuccuguugauag

SEQ ID NO: 1241573 - RNA, 19 nt, Homo sapiens
gaacuugauggucuuccuu

SEQ ID NO: 1241574 - RNA, 19 nt, Homo sapiens
uacaacacccacaccuuua

SEQ ID NO: 1241575 - RNA, 19 nt, Homo sapiens
agagagugaauuuaccuua

SEQ ID NO: 1241576 - RNA, 19 nt, Homo sapiens
guaaggaugagguacuuuc

SEQ ID NO: 1241577 - RNA, 19 nt, Homo sapiens
ccaaaucugcacaagaguu

SEQ ID NO: 1241578 - RNA, 19 nt, Homo sapiens
gcaaagaguggaggaacug

SEQ ID NO: 1241579 - RNA, 19 nt, Homo sapiens
acaguggugugucaaugaa

SEQ ID NO: 1241580 - RNA, 19 nt, Homo sapiens
gauagaagacauagagacu

SEQ ID NO: 1241581 - RNA, 19 nt, Homo sapiens
gggagaagcugaugcauuu

SEQ ID NO: 1241582 - RNA, 19 nt, Homo sapiens
agaaauggcuugagaagaa

SEQ ID NO: 1241583 - RNA, 19 nt, Homo sapiens
gaaagaacagccuaaagaa

SEQ ID NO: 1241584 - RNA, 19 nt, Homo sapiens
cuaaagaaauggcuugaga

SEQ ID NO: 1241585 - RNA, 19 nt, Homo sapiens
cagcagcucuaaugagauu

SEQ ID NO: 1241586 - RNA, 19 nt, Homo sapiens
gugagaagaaugaguauaa

SEQ ID NO: 1241587 - RNA, 19 nt, Homo sapiens
gaagaaugaguauaaagga

SEQ ID NO: 1241588 - RNA, 19 nt, Homo sapiens
ucuuacagcuucccaauga

SEQ ID NO: 1241589 - RNA, 19 nt, Homo sapiens
agaaagaacagccuaaaga

SEQ ID NO: 1241590 - RNA, 19 nt, Homo sapiens
gccaggaagugugaacaua

SEQ ID NO: 1241591 - RNA, 19 nt, Homo sapiens
ccagugagaagaaugagua

SEQ ID NO: 1241592 - RNA, 19 nt, Homo sapiens
gacccagucucugccaaua

SEQ ID NO: 1241593 - RNA, 19 nt, Homo sapiens
gugaauggaugaagaaagg

SEQ ID NO: 1241594 - RNA, 19 nt, Homo sapiens
gauggcagcaugucuguga

SEQ ID NO: 1241595 - RNA, 19 nt, Homo sapiens
aaagaacagccuaaagaaa

SEQ ID NO: 1241596 - RNA, 19 nt, Homo sapiens
gugaacauacugauagaaa

SEQ ID NO: 1241597 - RNA, 19 nt, Homo sapiens
gacuauagacccaccauau

SEQ ID NO: 1241598 - RNA, 19 nt, Homo sapiens
aagaacagccuaaagaaau

SEQ ID NO: 1241599 - RNA, 19 nt, Homo sapiens
gaguauaaaggauggguuu

SEQ ID NO: 1241600 - RNA, 19 nt, Homo sapiens
agaacagccuaaagaaaug

SEQ ID NO: 1241601 - RNA, 19 nt, Homo sapiens
gcagacuguugaaacuaug

SEQ ID NO: 1241602 - RNA, 19 nt, Homo sapiens
gacaugcugugcagacugu

SEQ ID NO: 1241603 - RNA, 19 nt, Homo sapiens
ggaagugugaacauacuga

SEQ ID NO: 1241604 - RNA, 19 nt, Homo sapiens
gagagaaagaacagccuaa

SEQ ID NO: 1241605 - RNA, 19 nt, Homo sapiens
ccaauauuguccuugugaa

SEQ ID NO: 1241606 - RNA, 19 nt, Homo sapiens
cccagucucugccaauauu

SEQ ID NO: 1241607 - RNA, 19 nt, Homo sapiens
ugcagcagcucuaaugaga

SEQ ID NO: 1241608 - RNA, 19 nt, Homo sapiens
gaaauggcuugagaagaac

SEQ ID NO: 1241609 - RNA, 19 nt, Homo sapiens
uaaagaaauggcuugagaa

SEQ ID NO: 1241610 - RNA, 19 nt, Homo sapiens
gagaagcugaugcauuugu

SEQ ID NO: 1241611 - RNA, 19 nt, Homo sapiens
gcaugucugugaccggaau

SEQ ID NO: 1241612 - RNA, 19 nt, Homo sapiens
gaaggacaucuuacagcuu

SEQ ID NO: 1241613 - RNA, 19 nt, Homo sapiens
gagaaagaacagccuaaag

SEQ ID NO: 1241614 - RNA, 19 nt, Homo sapiens
gagaagaaugaguauaaag

SEQ ID NO: 1241615 - RNA, 19 nt, Homo sapiens
gaaaauugcagcagcucua

SEQ ID NO: 1241616 - RNA, 19 nt, Homo sapiens
ugacagccagugagaagaa

SEQ ID NO: 1241617 - RNA, 19 nt, Homo sapiens
gagaggccaggaaguguga

SEQ ID NO: 1241618 - RNA, 19 nt, Homo sapiens
gccaauauuguccuuguga

SEQ ID NO: 1241619 - RNA, 19 nt, Homo sapiens
agaagcugaugcauuuguu

SEQ ID NO: 1241620 - RNA, 19 nt, Homo sapiens
caaagagguccgagugaca

SEQ ID NO: 1241621 - RNA, 19 nt, Homo sapiens
gaucuggaagagagaaaga

SEQ ID NO: 1241622 - RNA, 19 nt, Homo sapiens
cuuauugaaggacaucuua

SEQ ID NO: 1241623 - RNA, 19 nt, Homo sapiens
ggcaagauuacauuuacaa

SEQ ID NO: 1241624 - RNA, 19 nt, Homo sapiens
ccuuagaauggcaagauua

SEQ ID NO: 1241625 - RNA, 19 nt, Homo sapiens
gugugaacauacugauaga

SEQ ID NO: 1241626 - RNA, 19 nt, Homo sapiens
aaagaaauggcuugagaag

SEQ ID NO: 1241627 - RNA, 19 nt, Homo sapiens
ugcagacuguugaaacuau

SEQ ID NO: 1241628 - RNA, 19 nt, Homo sapiens
gaagugugaacauacugau

SEQ ID NO: 1241629 - RNA, 19 nt, Homo sapiens
caggaagugugaacauacu

SEQ ID NO: 1241630 - RNA, 19 nt, Homo sapiens
gaagcugaugcauuuguuc

SEQ ID NO: 1241631 - RNA, 19 nt, Homo sapiens
gaaggggaccauagaguga

SEQ ID NO: 1241632 - RNA, 19 nt, Homo sapiens
ugagugaauggaugaagaa

SEQ ID NO: 1241633 - RNA, 19 nt, Homo sapiens
uagaauggcaagauuacau

SEQ ID NO: 1241634 - RNA, 19 nt, Homo sapiens
gcaaucaugagugaaugga

SEQ ID NO: 1241635 - RNA, 19 nt, Homo sapiens
gaacagccuaaagaaaugg

SEQ ID NO: 1241636 - RNA, 19 nt, Homo sapiens
agagaaagaacagccuaaa

SEQ ID NO: 1241637 - RNA, 19 nt, Homo sapiens
cgagugacagccagugaga

SEQ ID NO: 1241638 - RNA, 19 nt, Homo sapiens
agaagaaugaguauaaagg

SEQ ID NO: 1241639 - RNA, 19 nt, Homo sapiens
gacagccagugagaagaau

SEQ ID NO: 1241640 - RNA, 19 nt, Homo sapiens
ugacuauagacccaccaua

SEQ ID NO: 1241641 - RNA, 19 nt, Homo sapiens
gaaugaaggggaccauaga

SEQ ID NO: 1241642 - RNA, 19 nt, Homo sapiens
cuguugaaacuaugaauga

SEQ ID NO: 1241643 - RNA, 19 nt, Homo sapiens
gugcagacuguugaaacua

SEQ ID NO: 1241644 - RNA, 19 nt, Homo sapiens
uuacagcuucccaaugaga

SEQ ID NO: 1241645 - RNA, 19 nt, Homo sapiens
cagccagugagaagaauga

SEQ ID NO: 1241646 - RNA, 19 nt, Homo sapiens
caucuuacagcuucccaau

SEQ ID NO: 1241647 - RNA, 19 nt, Homo sapiens
ccaggaagugugaacauac

SEQ ID NO: 1241648 - RNA, 19 nt, Homo sapiens
augagugaauggaugaaga

SEQ ID NO: 1241649 - RNA, 19 nt, Homo sapiens
auauuguccuugugaacuu

SEQ ID NO: 1241650 - RNA, 19 nt, Homo sapiens
ccagaguugcgaggaguuu

SEQ ID NO: 1241651 - RNA, 19 nt, Homo sapiens
cugccaauauuguccuugu

SEQ ID NO: 1241652 - RNA, 19 nt, Homo sapiens
uggcaagauuacauuuaca

SEQ ID NO: 1241653 - RNA, 19 nt, Homo sapiens
ugagaaagcugcaggacua

SEQ ID NO: 1241654 - RNA, 19 nt, Homo sapiens
gaaauaguaccugaacuua

SEQ ID NO: 1241655 - RNA, 19 nt, Homo sapiens
gagaagcccuggccauugu

SEQ ID NO: 1241656 - RNA, 19 nt, Homo sapiens
ggaccaaggguuucauuaa

SEQ ID NO: 1241657 - RNA, 19 nt, Homo sapiens
gcaggacgaugaagagaau

SEQ ID NO: 1241658 - RNA, 19 nt, Homo sapiens
guccagagcucaagacuuc

SEQ ID NO: 1241659 - RNA, 19 nt, Homo sapiens
ggaaauaguaccugaacuu

SEQ ID NO: 1241660 - RNA, 19 nt, Homo sapiens
gacaagggcccuagagauu

SEQ ID NO: 1241661 - RNA, 19 nt, Homo sapiens
aauaguaccugaacuuaga

SEQ ID NO: 1241662 - RNA, 19 nt, Homo sapiens
ggaacuuucugguguuaug

SEQ ID NO: 1241663 - RNA, 19 nt, Homo sapiens
caagggcccuagagauuga

SEQ ID NO: 1241664 - RNA, 19 nt, Homo sapiens
gaacuuagacuugaaggau

SEQ ID NO: 1241665 - RNA, 19 nt, Homo sapiens
gaccaaggguuucauuaag

SEQ ID NO: 1241666 - RNA, 19 nt, Homo sapiens
caggacagcuucgaguuaa

SEQ ID NO: 1241667 - RNA, 19 nt, Homo sapiens
gcccuuagauggccaguuc

SEQ ID NO: 1241668 - RNA, 19 nt, Homo sapiens
ggaaaaggcauaugcaaaa

SEQ ID NO: 1241669 - RNA, 19 nt, Homo sapiens
ggcggaggcugaacucuug

SEQ ID NO: 1241670 - RNA, 19 nt, Homo sapiens
ggacaagggcccuagagau

SEQ ID NO: 1241671 - RNA, 19 nt, Homo sapiens
guacuucuuguucgaauuu

SEQ ID NO: 1241672 - RNA, 19 nt, Homo sapiens
caggcuagcucgaagucua

SEQ ID NO: 1241673 - RNA, 19 nt, Homo sapiens
ccaggacagcuucgaguua

SEQ ID NO: 1241674 - RNA, 19 nt, Homo sapiens
guucggacaucgagaagug

SEQ ID NO: 1241675 - RNA, 19 nt, Homo sapiens
agauggagcuggaaagauc

SEQ ID NO: 1241676 - RNA, 19 nt, Homo sapiens
gcugaacucuuggcacuuc

SEQ ID NO: 1241677 - RNA, 19 nt, Homo sapiens
gaaagcugcaggacuaaca

SEQ ID NO: 1241678 - RNA, 19 nt, Homo sapiens
gggccgagaucccaguuuc

SEQ ID NO: 1241679 - RNA, 19 nt, Homo sapiens
guggaacuuucugguguua

SEQ ID NO: 1241680 - RNA, 19 nt, Homo sapiens
gggagucacugugcuggaa

SEQ ID NO: 1241681 - RNA, 19 nt, Homo sapiens
gauggccaguucuaccaaa

SEQ ID NO: 1241682 - RNA, 19 nt, Homo sapiens
gagauugacccugcaguga

SEQ ID NO: 1241683 - RNA, 19 nt, Homo sapiens
uaccugaacuuagacuuga

SEQ ID NO: 1241684 - RNA, 19 nt, Homo sapiens
ggaccugggcaucaucuug

SEQ ID NO: 1241685 - RNA, 19 nt, Homo sapiens
guaccugaacuuagacuug

SEQ ID NO: 1241686 - RNA, 19 nt, Homo sapiens
ccaaggguuucauuaaggu

SEQ ID NO: 1241687 - RNA, 19 nt, Homo sapiens
gggaccaaggguuucauua

SEQ ID NO: 1241688 - RNA, 19 nt, Homo sapiens
ugaugagccugacguggaa

SEQ ID NO: 1241689 - RNA, 19 nt, Homo sapiens
ggaccagccagguauggaa

SEQ ID NO: 1241690 - RNA, 19 nt, Homo sapiens
acuuagacuugaaggauaa

SEQ ID NO: 1241691 - RNA, 19 nt, Homo sapiens
cagagaagcccuggccauu

SEQ ID NO: 1241692 - RNA, 19 nt, Homo sapiens
ggccaguucuaccaaagau

SEQ ID NO: 1241693 - RNA, 19 nt, Homo sapiens
gaguacuucuuguucgaau

SEQ ID NO: 1241694 - RNA, 19 nt, Homo sapiens
cuacaaugaguacuucuug

SEQ ID NO: 1241695 - RNA, 19 nt, Homo sapiens
aacuuagacuugaaggaua

SEQ ID NO: 1241696 - RNA, 19 nt, Homo sapiens
ggacagcuucgaguuaauc

SEQ ID NO: 1241697 - RNA, 19 nt, Homo sapiens
ggucagaggaggacuuugg

SEQ ID NO: 1241698 - RNA, 19 nt, Homo sapiens
gauggguuccgcugcauga

SEQ ID NO: 1241699 - RNA, 19 nt, Homo sapiens
gaaaaggcauaugcaaaag

SEQ ID NO: 1241700 - RNA, 19 nt, Homo sapiens
gagaaagcugcaggacuaa

SEQ ID NO: 1241701 - RNA, 19 nt, Homo sapiens
caaugaguacuucuuguuc

SEQ ID NO: 1241702 - RNA, 19 nt, Homo sapiens
gcuccgggauagucuucaa

SEQ ID NO: 1241703 - RNA, 19 nt, Homo sapiens
gauugacccugcagugacu

SEQ ID NO: 1241704 - RNA, 19 nt, Homo sapiens
gagccugacguggaacuuu

SEQ ID NO: 1241705 - RNA, 19 nt, Homo sapiens
gaggaaauaguaccugaac

SEQ ID NO: 1241706 - RNA, 19 nt, Homo sapiens
ggaaucguccccuuauuga

SEQ ID NO: 1241707 - RNA, 19 nt, Homo sapiens
ccuaugugcgggugucuuu

SEQ ID NO: 1241708 - RNA, 19 nt, Homo sapiens
cuugaaggauaacagaugu

SEQ ID NO: 1241709 - RNA, 19 nt, Homo sapiens
ggauaggcaccuucaggau

SEQ ID NO: 1241710 - RNA, 19 nt, Homo sapiens
uggugggagucaacauuaa

SEQ ID NO: 1241711 - RNA, 19 nt, Homo sapiens
gagaagugagccgggauga

SEQ ID NO: 1241712 - RNA, 19 nt, Homo sapiens
ucuucaaggucucaacgaa

SEQ ID NO: 1241713 - RNA, 19 nt, Homo sapiens
gaccaguguccuucagaga

SEQ ID NO: 1241714 - RNA, 19 nt, Homo sapiens
gaacuuucugguguuaugu

SEQ ID NO: 1241715 - RNA, 19 nt, Homo sapiens
uaacugggaggagagaaug

SEQ ID NO: 1241716 - RNA, 19 nt, Homo sapiens
acaagggcccuagagauug

SEQ ID NO: 1241717 - RNA, 19 nt, Homo sapiens
gcaggacuaacaccaccuu

SEQ ID NO: 1241718 - RNA, 19 nt, Homo sapiens
cuggugggagucaacauua

SEQ ID NO: 1241719 - RNA, 19 nt, Homo sapiens
ugagauggagcuggaaaga

SEQ ID NO: 1241720 - RNA, 19 nt, Homo sapiens
gagauggagcuggaaagau

SEQ ID NO: 1241721 - RNA, 19 nt, Homo sapiens
cguggaacuuucugguguu

SEQ ID NO: 1241722 - RNA, 19 nt, Homo sapiens
cagcuucgaguuaaucauc

SEQ ID NO: 1241723 - RNA, 19 nt, Homo sapiens
ugucccggcucacccgaaa

SEQ ID NO: 1241724 - RNA, 19 nt, Homo sapiens
agacuugaaggauaacaga

SEQ ID NO: 1241725 - RNA, 19 nt, Homo sapiens
agagaagcccuggccauug

SEQ ID NO: 1241726 - RNA, 19 nt, Homo sapiens
ucgcagacccuccccuuua

SEQ ID NO: 1241727 - RNA, 19 nt, Homo sapiens
gaaacuggugggagucaac

SEQ ID NO: 1241728 - RNA, 19 nt, Homo sapiens
aagacuugcugcuggagau

SEQ ID NO: 1241729 - RNA, 19 nt, Homo sapiens
aaauaguaccugaacuuag

SEQ ID NO: 1241730 - RNA, 19 nt, Homo sapiens
gguggagcuugaccugaag

SEQ ID NO: 1241731 - RNA, 19 nt, Homo sapiens
gaaggaagcuuuaugaaga

SEQ ID NO: 1241732 - RNA, 19 nt, Homo sapiens
gaucagaaauguucaauuc

SEQ ID NO: 1241733 - RNA, 19 nt, Homo sapiens
aaacagaacucaucaagga

SEQ ID NO: 1241734 - RNA, 19 nt, Homo sapiens
ggacaaaccugcucucagu

SEQ ID NO: 1241735 - RNA, 19 nt, Homo sapiens
gcucauagcuaaauuccuu

SEQ ID NO: 1241736 - RNA, 19 nt, Homo sapiens
caaaugaccacuugcuuua

SEQ ID NO: 1241737 - RNA, 19 nt, Homo sapiens
caacacagccgacauugaa

SEQ ID NO: 1241738 - RNA, 19 nt, Homo sapiens
ggagucuucuuguaaauau

SEQ ID NO: 1241739 - RNA, 19 nt, Homo sapiens
gaaugugaccuauuugaaa

SEQ ID NO: 1241740 - RNA, 19 nt, Homo sapiens
agagagaaauugaguagaa

SEQ ID NO: 1241741 - RNA, 19 nt, Homo sapiens
gugcugagcucaugggauu

SEQ ID NO: 1241742 - RNA, 19 nt, Homo sapiens
ugaaugcgcucuauguaug

SEQ ID NO: 1241743 - RNA, 19 nt, Homo sapiens
ggagauggcagcagucuga

SEQ ID NO: 1241744 - RNA, 19 nt, Homo sapiens
gagagaaauugaguagaaa

SEQ ID NO: 1241745 - RNA, 19 nt, Homo sapiens
cgacgcaucugaccuugaa

SEQ ID NO: 1241746 - RNA, 19 nt, Homo sapiens
cagcagagguguuuaagag

SEQ ID NO: 1241747 - RNA, 19 nt, Homo sapiens
gaacgaaggaagcuuuaug

SEQ ID NO: 1241748 - RNA, 19 nt, Homo sapiens
gcucucaguuuaccacuug

SEQ ID NO: 1241749 - RNA, 19 nt, Homo sapiens
gaacaagagagcaagaugu

SEQ ID NO: 1241750 - RNA, 19 nt, Homo sapiens
ggaaagaacaagagagcaa

SEQ ID NO: 1241751 - RNA, 19 nt, Homo sapiens
aaugaccacuugcuuuaua

SEQ ID NO: 1241752 - RNA, 19 nt, Homo sapiens
gugaagcccucgaggugua

SEQ ID NO: 1241753 - RNA, 19 nt, Homo sapiens
uaauaaagccuccaagcaa

SEQ ID NO: 1241754 - RNA, 19 nt, Homo sapiens
gaggagaagugggaugcua

SEQ ID NO: 1241755 - RNA, 19 nt, Homo sapiens
ggacccagcuaaagugaag

SEQ ID NO: 1241756 - RNA, 19 nt, Homo sapiens
gaagcuuuaugaagaggaa

SEQ ID NO: 1241757 - RNA, 19 nt, Homo sapiens
ccaaaugaccacuugcuuu

SEQ ID NO: 1241758 - RNA, 19 nt, Homo sapiens
aaggaaacauugccagauu

SEQ ID NO: 1241759 - RNA, 19 nt, Homo sapiens
uaagggaguuucucuacug

SEQ ID NO: 1241760 - RNA, 19 nt, Homo sapiens
ccggaaaugucauggguuu

SEQ ID NO: 1241761 - RNA, 19 nt, Homo sapiens
gaucacagagagaaauuga

SEQ ID NO: 1241762 - RNA, 19 nt, Homo sapiens
gagcucaugggauuacaua

SEQ ID NO: 1241763 - RNA, 19 nt, Homo sapiens
caucaaggaucuagucucu

SEQ ID NO: 1241764 - RNA, 19 nt, Homo sapiens
ugaaagaccaggaagaaga

SEQ ID NO: 1241765 - RNA, 19 nt, Homo sapiens
cugcauaacuacauaaaca

SEQ ID NO: 1241766 - RNA, 19 nt, Homo sapiens
ggaaacagaacucaucaag

SEQ ID NO: 1241767 - RNA, 19 nt, Homo sapiens
gaacugaaggaacgaagga

SEQ ID NO: 1241768 - RNA, 19 nt, Homo sapiens
aaacggggaugccuaauaa

SEQ ID NO: 1241769 - RNA, 19 nt, Homo sapiens
ggaaacauugccagauuga

SEQ ID NO: 1241770 - RNA, 19 nt, Homo sapiens
gaaaaugccaggaaaagaa

SEQ ID NO: 1241771 - RNA, 19 nt, Homo sapiens
caagagagcaagaugugaa

SEQ ID NO: 1241772 - RNA, 19 nt, Homo sapiens
gaguuucucuacuguguau

SEQ ID NO: 1241773 - RNA, 19 nt, Homo sapiens
cagaaaagcccaagccuua

SEQ ID NO: 1241774 - RNA, 19 nt, Homo sapiens
aaagaugccuagaucacaa

SEQ ID NO: 1241775 - RNA, 19 nt, Homo sapiens
guuuaccacuugcaucuuu

SEQ ID NO: 1241776 - RNA, 19 nt, Homo sapiens
gcaagcaucauugugguuu

SEQ ID NO: 1241777 - RNA, 19 nt, Homo sapiens
gcaagauccucccacugau

SEQ ID NO: 1241778 - RNA, 19 nt, Homo sapiens
gugaguggauugccgaaga

SEQ ID NO: 1241779 - RNA, 19 nt, Homo sapiens
cgacuccauucucaauaaa

SEQ ID NO: 1241780 - RNA, 19 nt, Homo sapiens
gaaagaugccuagaucaca

SEQ ID NO: 1241781 - RNA, 19 nt, Homo sapiens
gggaguuucucuacugugu

SEQ ID NO: 1241782 - RNA, 19 nt, Homo sapiens
uuacauaacugugucuauc

SEQ ID NO: 1241783 - RNA, 19 nt, Homo sapiens
gaagaggagcucccaccuu

SEQ ID NO: 1241784 - RNA, 19 nt, Homo sapiens
uaaagaaucggauacucaa

SEQ ID NO: 1241785 - RNA, 19 nt, Homo sapiens
ucgacuccauucucaauaa

SEQ ID NO: 1241786 - RNA, 19 nt, Homo sapiens
guguaucccuugauggaaa

SEQ ID NO: 1241787 - RNA, 19 nt, Homo sapiens
aggcggcacugcucaagua

SEQ ID NO: 1241788 - RNA, 19 nt, Homo sapiens
ccuuggagauccugucaaa

SEQ ID NO: 1241789 - RNA, 19 nt, Homo sapiens
gcacaucuuugagccuugu

SEQ ID NO: 1241790 - RNA, 19 nt, Homo sapiens
gagaaauugaguagaaaga

SEQ ID NO: 1241791 - RNA, 19 nt, Homo sapiens
ggacagacugaaugguauu

SEQ ID NO: 1241792 - RNA, 19 nt, Homo sapiens
ucgcucaaauuaucccuaa

SEQ ID NO: 1241793 - RNA, 19 nt, Homo sapiens
gaugauucguagaugcauu

SEQ ID NO: 1241794 - RNA, 19 nt, Homo sapiens
uaaaaugccuagaaagaug

SEQ ID NO: 1241795 - RNA, 19 nt, Homo sapiens
gaugugaagcccaaagaga

SEQ ID NO: 1241796 - RNA, 19 nt, Homo sapiens
ggauugugcugagcucaug

SEQ ID NO: 1241797 - RNA, 19 nt, Homo sapiens
cuagagaucagaaauguuc

SEQ ID NO: 1241798 - RNA, 19 nt, Homo sapiens
ucacagugcuuggcaucaa

SEQ ID NO: 1241799 - RNA, 19 nt, Homo sapiens
caacgcaaaguguccauug

SEQ ID NO: 1241800 - RNA, 19 nt, Homo sapiens
agaaucggauacucaauca

SEQ ID NO: 1241801 - RNA, 19 nt, Homo sapiens
gcaucauugugguuucauu

SEQ ID NO: 1241802 - RNA, 19 nt, Homo sapiens
ugaauacauugaagaccaa

SEQ ID NO: 1241803 - RNA, 19 nt, Homo sapiens
acacagccgacauugaaua

SEQ ID NO: 1241804 - RNA, 19 nt, Homo sapiens
ggucagcagcgacaacuug

SEQ ID NO: 1241805 - RNA, 19 nt, Homo sapiens
caaaguguccauugugcaa

SEQ ID NO: 1241806 - RNA, 19 nt, Homo sapiens
gaaacggggaugccuaaua

SEQ ID NO: 1241807 - RNA, 19 nt, Homo sapiens
aaacauugccagauugaau

SEQ ID NO: 1241808 - RNA, 19 nt, Homo sapiens
cgacauugaauacauugaa

SEQ ID NO: 1241809 - RNA, 19 nt, Homo sapiens
cuacaacacagccgacauu

SEQ ID NO: 1241810 - RNA, 19 nt, Homo sapiens
gaaagaccaggaagaagag

SEQ ID NO: 1241811 - RNA, 19 nt, Homo sapiens
caugaaagaccaggaagaa

SEQ ID NO: 1241812 - RNA, 19 nt, Homo sapiens
guucaauucuuugcugaug

SEQ ID NO: 1241813 - RNA, 19 nt, Homo sapiens
gcacuaagggaguuucucu

SEQ ID NO: 1241814 - RNA, 19 nt, Homo sapiens
ucgaacagaugcugagcuu

SEQ ID NO: 1241815 - RNA, 19 nt, Homo sapiens
cggcacugcucaaguacaa

SEQ ID NO: 1241816 - RNA, 19 nt, Homo sapiens
gggagucuucuuguaaaua

SEQ ID NO: 1241817 - RNA, 19 nt, Homo sapiens
uagcaguucuucccuugga

SEQ ID NO: 1241818 - RNA, 19 nt, Homo sapiens
gauacucaaucacuuuggu

SEQ ID NO: 1241819 - RNA, 19 nt, Homo sapiens
cuaaagaaucggauacuca

SEQ ID NO: 1241820 - RNA, 19 nt, Homo sapiens
gacauugaauacauugaag

SEQ ID NO: 1241821 - RNA, 19 nt, Homo sapiens
auucguagaugcauugaga

SEQ ID NO: 1241822 - RNA, 19 nt, Homo sapiens
cgaaggaagcuuuaugaag

SEQ ID NO: 1241823 - RNA, 19 nt, Homo sapiens
gaaugcgcucuauguauga

SEQ ID NO: 1241824 - RNA, 19 nt, Homo sapiens
gaccuugaaugcgcucuau

SEQ ID NO: 1241825 - RNA, 19 nt, Homo sapiens
gcagaaauagcauguaagc

SEQ ID NO: 1241826 - RNA, 19 nt, Homo sapiens
gaggaaauggaagaacuuu

SEQ ID NO: 1241827 - RNA, 19 nt, Homo sapiens
guacaacgaggcaguuaag

SEQ ID NO: 1241828 - RNA, 19 nt, Homo sapiens
cagccgacauugaauacau

SEQ ID NO: 1241829 - RNA, 19 nt, Homo sapiens
gcucagugguugacagcau

SEQ ID NO: 1241830 - RNA, 19 nt, Homo sapiens
gaacucaucaaggaucuag

SEQ ID NO: 1241831 - RNA, 19 nt, Homo sapiens
gaagagagauguggaguuu

SEQ ID NO: 1241832 - RNA, 19 nt, Homo sapiens
ggacugaucugucucacaa

SEQ ID NO: 1241833 - RNA, 19 nt, Homo sapiens
ugaguaaucucuucccuua

SEQ ID NO: 1241834 - RNA, 19 nt, Homo sapiens
gaaccuccgugaucgauuu

SEQ ID NO: 1241835 - RNA, 19 nt, Homo sapiens
ugagaacccugaugagaua

SEQ ID NO: 1241836 - RNA, 19 nt, Homo sapiens
uaagaggacucaugauuau

SEQ ID NO: 1241837 - RNA, 19 nt, Homo sapiens
caagaggaguacccaguua

SEQ ID NO: 1241838 - RNA, 19 nt, Homo sapiens
aaagauaguugauguguga

SEQ ID NO: 1241839 - RNA, 19 nt, Homo sapiens
ggaagauguuugacuauug

SEQ ID NO: 1241840 - RNA, 19 nt, Homo sapiens
gcacacacacgauggaaua

SEQ ID NO: 1241841 - RNA, 19 nt, Homo sapiens
gaagucugcuuguaguauu

SEQ ID NO: 1241842 - RNA, 19 nt, Homo sapiens
gaucaauucuggucauuuc

SEQ ID NO: 1241843 - RNA, 19 nt, Homo sapiens
ucaaagaaguauccaguga

SEQ ID NO: 1241844 - RNA, 19 nt, Homo sapiens
gcuaagcgauuccuggauu

SEQ ID NO: 1241845 - RNA, 19 nt, Homo sapiens
gauauggacuuucucaaca

SEQ ID NO: 1241846 - RNA, 19 nt, Homo sapiens
ggacauugcugacaugcau

SEQ ID NO: 1241847 - RNA, 19 nt, Homo sapiens
aaaggaauaucucuacuug

SEQ ID NO: 1241848 - RNA, 19 nt, Homo sapiens
ccaguucucuucuuccuuu

SEQ ID NO: 1241849 - RNA, 19 nt, Homo sapiens
uguaauaucuccuguuguu

SEQ ID NO: 1241850 - RNA, 19 nt, Homo sapiens
gauaguugaugugugauaa

SEQ ID NO: 1241851 - RNA, 19 nt, Homo sapiens
gauggucgcuuccuuaucu

SEQ ID NO: 1241852 - RNA, 19 nt, Homo sapiens
gaugugugauaaucucaua

SEQ ID NO: 1241853 - RNA, 19 nt, Homo sapiens
gaagaaaggaauaucucua

SEQ ID NO: 1241854 - RNA, 19 nt, Homo sapiens
ggaccugacuggacagaug

SEQ ID NO: 1241855 - RNA, 19 nt, Homo sapiens
gaagaaagcagcucaugca

SEQ ID NO: 1241856 - RNA, 19 nt, Homo sapiens
cuaagaggacucaugauua

SEQ ID NO: 1241857 - RNA, 19 nt, Homo sapiens
ggacucuggucaucaaaga

SEQ ID NO: 1241858 - RNA, 19 nt, Homo sapiens
gcauugaugaccaagauua

SEQ ID NO: 1241859 - RNA, 19 nt, Homo sapiens
gggaagauguuugacuauu

SEQ ID NO: 1241860 - RNA, 19 nt, Homo sapiens
uggagaagcugaagagaga

SEQ ID NO: 1241861 - RNA, 19 nt, Homo sapiens
caacaagaaccagaaagua

SEQ ID NO: 1241862 - RNA, 19 nt, Homo sapiens
ggaaaagguuaaagaauug

SEQ ID NO: 1241863 - RNA, 19 nt, Homo sapiens
gaaaggaauaucucuacuu

SEQ ID NO: 1241864 - RNA, 19 nt, Homo sapiens
ggacagauggccuucuuug

SEQ ID NO: 1241865 - RNA, 19 nt, Homo sapiens
gaagauguuugacuauugc

SEQ ID NO: 1241866 - RNA, 19 nt, Homo sapiens
ucucuucuguccugucuua

SEQ ID NO: 1241867 - RNA, 19 nt, Homo sapiens
cagauggccuucuuuguca

SEQ ID NO: 1241868 - RNA, 19 nt, Homo sapiens
ggaccuggcucaagcaacu

SEQ ID NO: 1241869 - RNA, 19 nt, Homo sapiens
caacuggccuguggugaug

SEQ ID NO: 1241870 - RNA, 19 nt, Homo sapiens
caugagaagucugcuugua

SEQ ID NO: 1241871 - RNA, 19 nt, Homo sapiens
acaagaaccagaaaguaua

SEQ ID NO: 1241872 - RNA, 19 nt, Homo sapiens
aggaauaucucuacuugga

SEQ ID NO: 1241873 - RNA, 19 nt, Homo sapiens
gcacagcaacccagagaug

SEQ ID NO: 1241874 - RNA, 19 nt, Homo sapiens
caacgaagacagcuacaug

SEQ ID NO: 1241875 - RNA, 19 nt, Homo sapiens
gaguuugaguccuucauug

SEQ ID NO: 1241876 - RNA, 19 nt, Homo sapiens
ggacuacagccuucugcua

SEQ ID NO: 1241877 - RNA, 19 nt, Homo sapiens
gaaagugaaggcagugaug

SEQ ID NO: 1241878 - RNA, 19 nt, Homo sapiens
ggauugggucucugucaua

SEQ ID NO: 1241879 - RNA, 19 nt, Homo sapiens
gaccuaagaggacucauga

SEQ ID NO: 1241880 - RNA, 19 nt, Homo sapiens
gcaagaggaguacccaguu

SEQ ID NO: 1241881 - RNA, 19 nt, Homo sapiens
gagaggagucagagccaua

SEQ ID NO: 1241882 - RNA, 19 nt, Homo sapiens
gccuugaucuuuguaauau

SEQ ID NO: 1241883 - RNA, 19 nt, Homo sapiens
gcuccaagaucaaggucaa

SEQ ID NO: 1241884 - RNA, 19 nt, Homo sapiens
gaugagauacauugucuuc

SEQ ID NO: 1241885 - RNA, 19 nt, Homo sapiens
ucaugggccucauugauau

SEQ ID NO: 1241886 - RNA, 19 nt, Homo sapiens
auagcaaccucuccaacua

SEQ ID NO: 1241887 - RNA, 19 nt, Homo sapiens
gggaaaaucugcccaguca

SEQ ID NO: 1241888 - RNA, 19 nt, Homo sapiens
ggaugacacucaagauacu

SEQ ID NO: 1241889 - RNA, 19 nt, Homo sapiens
gcaguaugcuaagcgauuc

SEQ ID NO: 1241890 - RNA, 19 nt, Homo sapiens
gugaugcgcaauauguuua

SEQ ID NO: 1241891 - RNA, 19 nt, Homo sapiens
gaaaaucugcccagucauu

SEQ ID NO: 1241892 - RNA, 19 nt, Homo sapiens
ccuaagaggacucaugauu

SEQ ID NO: 1241893 - RNA, 19 nt, Homo sapiens
ugagaagucugcuuguagu

SEQ ID NO: 1241894 - RNA, 19 nt, Homo sapiens
ggugguagcaagaggagua

SEQ ID NO: 1241895 - RNA, 19 nt, Homo sapiens
guaccuagcacacuuccuu

SEQ ID NO: 1241896 - RNA, 19 nt, Homo sapiens
ggauucauucuccauguaa

SEQ ID NO: 1241897 - RNA, 19 nt, Homo sapiens
caagaaccagaaaguauau

SEQ ID NO: 1241898 - RNA, 19 nt, Homo sapiens
gaagccagcgauaaggaaa

SEQ ID NO: 1241899 - RNA, 19 nt, Homo sapiens
agaucaaggucaacaauca

SEQ ID NO: 1241900 - RNA, 19 nt, Homo sapiens
ggauggaggccucaagugu

SEQ ID NO: 1241901 - RNA, 19 nt, Homo sapiens
gggccaggguguaggauuc

SEQ ID NO: 1241902 - RNA, 19 nt, Homo sapiens
ucaagcaacuacucuggau

SEQ ID NO: 1241903 - RNA, 19 nt, Homo sapiens
ccuaagagacugccugguu

SEQ ID NO: 1241904 - RNA, 19 nt, Homo sapiens
agagagauguggaguuucu

SEQ ID NO: 1241905 - RNA, 19 nt, Homo sapiens
agaccaagaagaagcauuu

SEQ ID NO: 1241906 - RNA, 19 nt, Homo sapiens
guaucuggcuggacugauc

SEQ ID NO: 1241907 - RNA, 19 nt, Homo sapiens
cuaagcgauuccuggauuu

SEQ ID NO: 1241908 - RNA, 19 nt, Homo sapiens
ucauugauauccuuacaca

SEQ ID NO: 1241909 - RNA, 19 nt, Homo sapiens
gauucauucuccauguaaa

SEQ ID NO: 1241910 - RNA, 19 nt, Homo sapiens
guggguguguggccaguuu

SEQ ID NO: 1241911 - RNA, 19 nt, Homo sapiens
ucucuucccuuaccucaau

SEQ ID NO: 1241912 - RNA, 19 nt, Homo sapiens
uaucuccuguuguuucuau

SEQ ID NO: 1241913 - RNA, 19 nt, Homo sapiens
uaauaucuccuguuguuuc

SEQ ID NO: 1241914 - RNA, 19 nt, Homo sapiens
gagaagucugcuuguagua

SEQ ID NO: 1241915 - RNA, 19 nt, Homo sapiens
aaagaauugcccacccuua

SEQ ID NO: 1241916 - RNA, 19 nt, Homo sapiens
caagguuuauuuccagaag

SEQ ID NO: 1241917 - RNA, 19 nt, Homo sapiens
cauucuccauguaaaguuu

SEQ ID NO: 1241918 - RNA, 19 nt, Homo sapiens
ccacccaucucuacaucug

SEQ ID NO: 1241919 - RNA, 19 nt, Homo sapiens
ggaccuaagaggacucaug

SEQ ID NO: 1241920 - RNA, 19 nt, Homo sapiens
guagcccacucgaucaaug

SEQ ID NO: 1241921 - RNA, 19 nt, Homo sapiens
ggaagccagcgauaaggaa

SEQ ID NO: 1241922 - RNA, 19 nt, Homo sapiens
cgugaucgauuuggcauug

SEQ ID NO: 1241923 - RNA, 19 nt, Homo sapiens
gcaacuggccuguggugau

SEQ ID NO: 1241924 - RNA, 19 nt, Homo sapiens
caagaucaaggucaacaau

SEQ ID NO: 1241925 - RNA, 19 nt, Homo sapiens
ucgaguaggcucuuucuga

SEQ ID NO: 1241926 - RNA, 19 nt, Homo sapiens
cuucuuccuuugcuaaauu

SEQ ID NO: 1241927 - RNA, 19 nt, Homo sapiens
gcccagucauuucaaguuc

SEQ ID NO: 1241928 - RNA, 19 nt, Homo sapiens
uugauauccuuacacagua

SEQ ID NO: 1241929 - RNA, 19 nt, Homo sapiens
aagaagccaugaggccaua

SEQ ID NO: 1241930 - RNA, 19 nt, Homo sapiens
uaggauggaugacacucaa

SEQ ID NO: 1241931 - RNA, 19 nt, Homo sapiens
gaaacugacuaccauguaa

SEQ ID NO: 1241932 - RNA, 19 nt, Homo sapiens
gaacugaucuaugcacaaa

SEQ ID NO: 1241933 - RNA, 19 nt, Homo sapiens
ggaguuauguugugauuug

SEQ ID NO: 1241934 - RNA, 19 nt, Homo sapiens
gaacuucagcuucaucaua

SEQ ID NO: 1241935 - RNA, 19 nt, Homo sapiens
ggagagagguggagcaaca

SEQ ID NO: 1241936 - RNA, 19 nt, Homo sapiens
ccucacagaugaugacuuu

SEQ ID NO: 1241937 - RNA, 19 nt, Homo sapiens
ugauaaggcugcuccauga

SEQ ID NO: 1241938 - RNA, 19 nt, Homo sapiens
gcacugagauaagggagaa

SEQ ID NO: 1241939 - RNA, 19 nt, Homo sapiens
gaaccagcguccucuccua

SEQ ID NO: 1241940 - RNA, 19 nt, Homo sapiens
gcaaacagacccaucguau

SEQ ID NO: 1241941 - RNA, 19 nt, Homo sapiens
ucauuggcauucuuuguua

SEQ ID NO: 1241942 - RNA, 19 nt, Homo sapiens
guuaaucgcaucccuuaua

SEQ ID NO: 1241943 - RNA, 19 nt, Homo sapiens
cggaacaacuucauuaauc

SEQ ID NO: 1241944 - RNA, 19 nt, Homo sapiens
ggaaacugacuaccaugua

SEQ ID NO: 1241945 - RNA, 19 nt, Homo sapiens
gaauuaaagccaucaggaa

SEQ ID NO: 1241946 - RNA, 19 nt, Homo sapiens
gaacaugauggcagucuug

SEQ ID NO: 1241947 - RNA, 19 nt, Homo sapiens
uuuauuaccuggcugagua

SEQ ID NO: 1241948 - RNA, 19 nt, Homo sapiens
ggacuucacugucacucau

SEQ ID NO: 1241949 - RNA, 19 nt, Homo sapiens
ugaucaagcugcaggauau

SEQ ID NO: 1241950 - RNA, 19 nt, Homo sapiens
gcagggaguuauguuguga

SEQ ID NO: 1241951 - RNA, 19 nt, Homo sapiens
caaggaccauggaagagaa

SEQ ID NO: 1241952 - RNA, 19 nt, Homo sapiens
ucauacagguugagaaugu

SEQ ID NO: 1241953 - RNA, 19 nt, Homo sapiens
gggugugacugcuguauga

SEQ ID NO: 1241954 - RNA, 19 nt, Homo sapiens
uagaagaucaguucaagaa

SEQ ID NO: 1241955 - RNA, 19 nt, Homo sapiens
ccagacaccaaucaaauaa

SEQ ID NO: 1241956 - RNA, 19 nt, Homo sapiens
gauaaaauguuccugauag

SEQ ID NO: 1241957 - RNA, 19 nt, Homo sapiens
caucauaaucccucaguuu

SEQ ID NO: 1241958 - RNA, 19 nt, Homo sapiens
ggaugcaacugaucacaag

SEQ ID NO: 1241959 - RNA, 19 nt, Homo sapiens
ggugaagaguguugggaaa

SEQ ID NO: 1241960 - RNA, 19 nt, Homo sapiens
gaucauuggaggcaaguuu

SEQ ID NO: 1241961 - RNA, 19 nt, Homo sapiens
caacaugguuuugucaaua

SEQ ID NO: 1241962 - RNA, 19 nt, Homo sapiens
uuaaugagggcaaagauaa

SEQ ID NO: 1241963 - RNA, 19 nt, Homo sapiens
gggacacagugauguacua

SEQ ID NO: 1241964 - RNA, 19 nt, Homo sapiens
ccagcguccucuccuauuu

SEQ ID NO: 1241965 - RNA, 19 nt, Homo sapiens
uaucggagauccaagaaca

SEQ ID NO: 1241966 - RNA, 19 nt, Homo sapiens
ggaaaauaguugacaaaga

SEQ ID NO: 1241967 - RNA, 19 nt, Homo sapiens
gagggaaggaagauuauga

SEQ ID NO: 1241968 - RNA, 19 nt, Homo sapiens
acagagggaaggaagauua

SEQ ID NO: 1241969 - RNA, 19 nt, Homo sapiens
caggagaauuccaaguuga

SEQ ID NO: 1241970 - RNA, 19 nt, Homo sapiens
ucaggagaauuccaaguug

SEQ ID NO: 1241971 - RNA, 19 nt, Homo sapiens
ugagauggcuuuugaaguu

SEQ ID NO: 1241972 - RNA, 19 nt, Homo sapiens
auaccuggauugcugauuu

SEQ ID NO: 1241973 - RNA, 19 nt, Homo sapiens
ugacuaccauguaauuauc

SEQ ID NO: 1241974 - RNA, 19 nt, Homo sapiens
cuaaucaucaccuaucuuu

SEQ ID NO: 1241975 - RNA, 19 nt, Homo sapiens
ccaccugcuucuucaguuu

SEQ ID NO: 1241976 - RNA, 19 nt, Homo sapiens
ccaagggccugaugacucu

SEQ ID NO: 1241977 - RNA, 19 nt, Homo sapiens
ggaacaacuucauuaaucc

SEQ ID NO: 1241978 - RNA, 19 nt, Homo sapiens
ucaccaagcugaucuuuug

SEQ ID NO: 1241979 - RNA, 19 nt, Homo sapiens
gcagcuggccuacaucuuc

SEQ ID NO: 1241980 - RNA, 19 nt, Homo sapiens
acacagugauguacuaugg

SEQ ID NO: 1241981 - RNA, 19 nt, Homo sapiens
aacuucagcuucaucauaa

SEQ ID NO: 1241982 - RNA, 19 nt, Homo sapiens
agaagacgcugaagaucau

SEQ ID NO: 1241983 - RNA, 19 nt, Homo sapiens
gggaaggaagauuaugaua

SEQ ID NO: 1241984 - RNA, 19 nt, Homo sapiens
ccucuccuauuucaacuuu

SEQ ID NO: 1241985 - RNA, 19 nt, Homo sapiens
gggcaaagauaaaauguuc

SEQ ID NO: 1241986 - RNA, 19 nt, Homo sapiens
ccaaguauuuccggaacaa

SEQ ID NO: 1241987 - RNA, 19 nt, Homo sapiens
uaucggaaccucauuggaa

SEQ ID NO: 1241988 - RNA, 19 nt, Homo sapiens
gaugaccacgugaaugaaa

SEQ ID NO: 1241989 - RNA, 19 nt, Homo sapiens
gaagaaaauccaaggcuuu

SEQ ID NO: 1241990 - RNA, 19 nt, Homo sapiens
gaucaguucaagaagguaa

SEQ ID NO: 1241991 - RNA, 19 nt, Homo sapiens
ggaacaugauggcagucuu

SEQ ID NO: 1241992 - RNA, 19 nt, Homo sapiens
cagaagacgcugaagauca

SEQ ID NO: 1241993 - RNA, 19 nt, Homo sapiens
caaaaggaaugaccaaaag

SEQ ID NO: 1241994 - RNA, 19 nt, Homo sapiens
uaaccagacaccaaucaaa

SEQ ID NO: 1241995 - RNA, 19 nt, Homo sapiens
gagaaucauugggaugcaa

SEQ ID NO: 1241996 - RNA, 19 nt, Homo sapiens
ccgcuucucugccuacaug

SEQ ID NO: 1241997 - RNA, 19 nt, Homo sapiens
guucaaggacagaaguuaa

SEQ ID NO: 1241998 - RNA, 19 nt, Homo sapiens
gcaaaaggaaugaccaaaa

SEQ ID NO: 1241999 - RNA, 19 nt, Homo sapiens
ggcauucuuuguuacuauu

SEQ ID NO: 1242000 - RNA, 19 nt, Homo sapiens
ugaaugguguaucccuuug

SEQ ID NO: 1242001 - RNA, 19 nt, Homo sapiens
ccgaugaccacgugaauga

SEQ ID NO: 1242002 - RNA, 19 nt, Homo sapiens
ugcaggauauggagaagaa

SEQ ID NO: 1242003 - RNA, 19 nt, Homo sapiens
uaagggagaaccugucaga

SEQ ID NO: 1242004 - RNA, 19 nt, Homo sapiens
gauaagggagaaccuguca

SEQ ID NO: 1242005 - RNA, 19 nt, Homo sapiens
caugccaccugugccuuua

SEQ ID NO: 1242006 - RNA, 19 nt, Homo sapiens
cugcugcccuuuauccaaa

SEQ ID NO: 1242007 - RNA, 19 nt, Homo sapiens
ggauuggcaucuucuucug

SEQ ID NO: 1242008 - RNA, 19 nt, Homo sapiens
uguguucucuuuagucaau

SEQ ID NO: 1242009 - RNA, 19 nt, Homo sapiens
caauugcuguauucagugu

SEQ ID NO: 1242010 - RNA, 19 nt, Homo sapiens
caucauacagguugagaau

SEQ ID NO: 1242011 - RNA, 19 nt, Homo sapiens
cagcucacuuguucuggaa

SEQ ID NO: 1242012 - RNA, 19 nt, Homo sapiens
gaucgacacccuaaguaca

SEQ ID NO: 1242013 - RNA, 19 nt, Homo sapiens
gcacgaagucuacguucuc

SEQ ID NO: 1242014 - RNA, 19 nt, Homo sapiens
cauagacacuccugguucu

SEQ ID NO: 1242015 - RNA, 19 nt, Homo sapiens
aggagaugcuguccgauga

SEQ ID NO: 1242016 - RNA, 19 nt, Homo sapiens
gaacugcccagaagaaaau

SEQ ID NO: 1242017 - RNA, 19 nt, Homo sapiens
agacaccaaucaaauaagg

SEQ ID NO: 1242018 - RNA, 19 nt, Homo sapiens
gggaggagaugaaaaugga

SEQ ID NO: 1242019 - RNA, 19 nt, Homo sapiens
guuacugccuuucguugug

SEQ ID NO: 1242020 - RNA, 19 nt, Homo sapiens
guuauguugugauuugugu

SEQ ID NO: 1242021 - RNA, 19 nt, Homo sapiens
cagcuggccuacaucuuca

SEQ ID NO: 1242022 - RNA, 19 nt, Homo sapiens
ggcagaagacgcugaagau

SEQ ID NO: 1242023 - RNA, 19 nt, Homo sapiens
cccuuuauccaaaugauua

SEQ ID NO: 1242024 - RNA, 19 nt, Homo sapiens
guuguguccugcauuaauc

SEQ ID NO: 1242025 - RNA, 19 nt, Homo sapiens
ucauuaauccccacauuua

SEQ ID NO: 1242026 - RNA, 19 nt, Homo sapiens
ggaaugaccaaaaggguaa

SEQ ID NO: 1242027 - RNA, 19 nt, Homo sapiens
ucaagcaucaacaugguuu

SEQ ID NO: 1242028 - RNA, 19 nt, Homo sapiens
gagcggaaacugacuacca

SEQ ID NO: 1242029 - RNA, 19 nt, Homo sapiens
uaaugagggcaaagauaaa

SEQ ID NO: 1242030 - RNA, 19 nt, Homo sapiens
caaacucugguguggauug

SEQ ID NO: 1242031 - RNA, 19 nt, Homo sapiens
gagcagagcuagagagauu

SEQ ID NO: 1242032 - RNA, 19 nt, Homo sapiens
gaaggcaacuuguaagauu

SEQ ID NO: 1242033 - RNA, 19 nt, Homo sapiens
ggaaauacuugaaagagaa

SEQ ID NO: 1242034 - RNA, 19 nt, Homo sapiens
caauaaaucugccuuugga

SEQ ID NO: 1242035 - RNA, 19 nt, Homo sapiens
ggaacaaggugugguuauu

SEQ ID NO: 1242036 - RNA, 19 nt, Homo sapiens
acaagacgcugggucauua

SEQ ID NO: 1242037 - RNA, 19 nt, Homo sapiens
uaacagauacugcauauuc

SEQ ID NO: 1242038 - RNA, 19 nt, Homo sapiens
caagaacugucaggcaaua

SEQ ID NO: 1242039 - RNA, 19 nt, Homo sapiens
aagaugagcuugaugauuc

SEQ ID NO: 1242040 - RNA, 19 nt, Homo sapiens
caacaugccuacuauaaac

SEQ ID NO: 1242041 - RNA, 19 nt, Homo sapiens
gaagagaaagaaagaaaug

SEQ ID NO: 1242042 - RNA, 19 nt, Homo sapiens
gacaauaccaggcaaauau

SEQ ID NO: 1242043 - RNA, 19 nt, Homo sapiens
gggaaauacuugaaagaga

SEQ ID NO: 1242044 - RNA, 19 nt, Homo sapiens
cagagugauuugugaguua

SEQ ID NO: 1242045 - RNA, 19 nt, Homo sapiens
gaacugucaggcaauauaa

SEQ ID NO: 1242046 - RNA, 19 nt, Homo sapiens
gacgcugggucauuaauaa

SEQ ID NO: 1242047 - RNA, 19 nt, Homo sapiens
gcaucagcauugcaaagua

SEQ ID NO: 1242048 - RNA, 19 nt, Homo sapiens
ugaaagaguuugacauucu

SEQ ID NO: 1242049 - RNA, 19 nt, Homo sapiens
gaacaaggugugguuauug

SEQ ID NO: 1242050 - RNA, 19 nt, Homo sapiens
gaaaucaggccaaaauuaa

SEQ ID NO: 1242051 - RNA, 19 nt, Homo sapiens
caacugaaggcaacuugua

SEQ ID NO: 1242052 - RNA, 19 nt, Homo sapiens
aagcaucgcugagaaacua

SEQ ID NO: 1242053 - RNA, 19 nt, Homo sapiens
gaacucaggcacuugcaaa

SEQ ID NO: 1242054 - RNA, 19 nt, Homo sapiens
ucuagaugguguugauuua

SEQ ID NO: 1242055 - RNA, 19 nt, Homo sapiens
gaagugagcaagaugaauc

SEQ ID NO: 1242056 - RNA, 19 nt, Homo sapiens
uggaagagcuuuuggauaa

SEQ ID NO: 1242057 - RNA, 19 nt, Homo sapiens
gaagaugagcuugaugauu

SEQ ID NO: 1242058 - RNA, 19 nt, Homo sapiens
ugagcaagaugaaucagaa

SEQ ID NO: 1242059 - RNA, 19 nt, Homo sapiens
aaacagaagugagcaagau

SEQ ID NO: 1242060 - RNA, 19 nt, Homo sapiens
gauacugcauauucucaaa

SEQ ID NO: 1242061 - RNA, 19 nt, Homo sapiens
uuaaugggcuucuucacuu

SEQ ID NO: 1242062 - RNA, 19 nt, Homo sapiens
gaaguggaaguaugaagaa

SEQ ID NO: 1242063 - RNA, 19 nt, Homo sapiens
gagaaaugcgcacagcuuu

SEQ ID NO: 1242064 - RNA, 19 nt, Homo sapiens
gggauggcagguuguauua

SEQ ID NO: 1242065 - RNA, 19 nt, Homo sapiens
gcagaaguaaagaaacuaa

SEQ ID NO: 1242066 - RNA, 19 nt, Homo sapiens
gaagaauccaaaucucaaa

SEQ ID NO: 1242067 - RNA, 19 nt, Homo sapiens
ggaagaauccaaaucucaa

SEQ ID NO: 1242068 - RNA, 19 nt, Homo sapiens
gaaguaugaagaacugaaa

SEQ ID NO: 1242069 - RNA, 19 nt, Homo sapiens
ggaaguggaaguaugaaga

SEQ ID NO: 1242070 - RNA, 19 nt, Homo sapiens
gaaauugugguuaugugaa

SEQ ID NO: 1242071 - RNA, 19 nt, Homo sapiens
gaaaauagaaggcugaaga

SEQ ID NO: 1242072 - RNA, 19 nt, Homo sapiens
ggaaauugugguuauguga

SEQ ID NO: 1242073 - RNA, 19 nt, Homo sapiens
ccuaacagauacugcauau

SEQ ID NO: 1242074 - RNA, 19 nt, Homo sapiens
ggacaagagggaaauacuu

SEQ ID NO: 1242075 - RNA, 19 nt, Homo sapiens
cagcaaagacagagugauu

SEQ ID NO: 1242076 - RNA, 19 nt, Homo sapiens
gugguuaugugaauauuuc

SEQ ID NO: 1242077 - RNA, 19 nt, Homo sapiens
uggaaacggugaaacgaaa

SEQ ID NO: 1242078 - RNA, 19 nt, Homo sapiens
gcaaaguagcaucuaggua

SEQ ID NO: 1242079 - RNA, 19 nt, Homo sapiens
caaauugaucugcaagaaa

SEQ ID NO: 1242080 - RNA, 19 nt, Homo sapiens
ucaaaguccugauuucaag

SEQ ID NO: 1242081 - RNA, 19 nt, Homo sapiens
gaaagaaauggaagagcuu

SEQ ID NO: 1242082 - RNA, 19 nt, Homo sapiens
aaacugggcugagacugaa

SEQ ID NO: 1242083 - RNA, 19 nt, Homo sapiens
caaucuagaugguguugau

SEQ ID NO: 1242084 - RNA, 19 nt, Homo sapiens
acaaauugaucugcaagaa

SEQ ID NO: 1242085 - RNA, 19 nt, Homo sapiens
uucaagaugucacaaauug

SEQ ID NO: 1242086 - RNA, 19 nt, Homo sapiens
gucaauaacauacugguuu

SEQ ID NO: 1242087 - RNA, 19 nt, Homo sapiens
cagauaaccaggugauuga

SEQ ID NO: 1242088 - RNA, 19 nt, Homo sapiens
cguagacaauacacaaauu

SEQ ID NO: 1242089 - RNA, 19 nt, Homo sapiens
gcaggugcauuuggaugaa

SEQ ID NO: 1242090 - RNA, 19 nt, Homo sapiens
ggaugaagagaaagaaaga

SEQ ID NO: 1242091 - RNA, 19 nt, Homo sapiens
gaagauccaggugaaagaa

SEQ ID NO: 1242092 - RNA, 19 nt, Homo sapiens
gauggcagguuguauuaac

SEQ ID NO: 1242093 - RNA, 19 nt, Homo sapiens
gauuagggccuuaaagaca

SEQ ID NO: 1242094 - RNA, 19 nt, Homo sapiens
gcugggucauuaauaagaa

SEQ ID NO: 1242095 - RNA, 19 nt, Homo sapiens
ugaagcagaaguaaagaaa

SEQ ID NO: 1242096 - RNA, 19 nt, Homo sapiens
uagauuaagugcaaacucu

SEQ ID NO: 1242097 - RNA, 19 nt, Homo sapiens
gcaauaaaucugccuuugg

SEQ ID NO: 1242098 - RNA, 19 nt, Homo sapiens
caucagcauugcaaaguag

SEQ ID NO: 1242099 - RNA, 19 nt, Homo sapiens
ggaaaggcaucagcauugc

SEQ ID NO: 1242100 - RNA, 19 nt, Homo sapiens
uucuagagguguaacaaua

SEQ ID NO: 1242101 - RNA, 19 nt, Homo sapiens
gaacuaaagcagggacuca

SEQ ID NO: 1242102 - RNA, 19 nt, Homo sapiens
caagaugucacaaauugau

SEQ ID NO: 1242103 - RNA, 19 nt, Homo sapiens
augaagaacugaaagaauc

SEQ ID NO: 1242104 - RNA, 19 nt, Homo sapiens
aacaaggugugguuauuga

SEQ ID NO: 1242105 - RNA, 19 nt, Homo sapiens
caaauuaaugggcuucuuc

SEQ ID NO: 1242106 - RNA, 19 nt, Homo sapiens
aaacguagacaauacacaa

SEQ ID NO: 1242107 - RNA, 19 nt, Homo sapiens
gaaaugcgcacagcuuugg

SEQ ID NO: 1242108 - RNA, 19 nt, Homo sapiens
gggcugagacugaaagcaa

SEQ ID NO: 1242109 - RNA, 19 nt, Homo sapiens
ucaacaugccuacuauaaa

SEQ ID NO: 1242110 - RNA, 19 nt, Homo sapiens
ggaaguaugaagaacugaa

SEQ ID NO: 1242111 - RNA, 19 nt, Homo sapiens
gaugaagcccaaucuagau

SEQ ID NO: 1242112 - RNA, 19 nt, Homo sapiens
uuauguacguguugucuau

SEQ ID NO: 1242113 - RNA, 19 nt, Homo sapiens
gugaaagaguuugacauuc

SEQ ID NO: 1242114 - RNA, 19 nt, Homo sapiens
caaggugugguuauugauu

SEQ ID NO: 1242115 - RNA, 19 nt, Homo sapiens
gaacugaaagaaucaaagc

SEQ ID NO: 1242116 - RNA, 19 nt, Homo sapiens
aaaugaagcagaaguaaag

SEQ ID NO: 1242117 - RNA, 19 nt, Homo sapiens
gaagagcuuuuggauaaga

SEQ ID NO: 1242118 - RNA, 19 nt, Homo sapiens
gagggaaauacuugaaaga

SEQ ID NO: 1242119 - RNA, 19 nt, Homo sapiens
gaguuugacauucuucuug

SEQ ID NO: 1242120 - RNA, 19 nt, Homo sapiens
ugaaagaaucaaagccaaa

SEQ ID NO: 1242121 - RNA, 19 nt, Homo sapiens
aaggcaacuuguaagauuu

SEQ ID NO: 1242122 - RNA, 19 nt, Homo sapiens
uggaaaggcaucagcauug

SEQ ID NO: 1242123 - RNA, 19 nt, Homo sapiens
uaaagacauuuccauaucc

SEQ ID NO: 1242124 - RNA, 19 nt, Homo sapiens
ccuuaaagacauuuccaua

SEQ ID NO: 1242125 - RNA, 19 nt, Homo sapiens
aagauuagggccuuaaaga

SEQ ID NO: 1242126 - RNA, 19 nt, Homo sapiens
gaacugacucaugcaaaca

SEQ ID NO: 1242127 - RNA, 19 nt, Homo sapiens
agagugauuugugaguuaa

SEQ ID NO: 1242128 - RNA, 19 nt, Homo sapiens
agaacugucaggcaauaua

SEQ ID NO: 1242129 - RNA, 19 nt, Homo sapiens
ugugaaagaguuugacauu

SEQ ID NO: 1242130 - RNA, 19 nt, Homo sapiens
guggaaguaugaagaacug

SEQ ID NO: 1242131 - RNA, 19 nt, Homo sapiens
gagagaagaugaucaaaca

SEQ ID NO: 1242132 - RNA, 19 nt, Homo sapiens
caagacagauagaugauug

SEQ ID NO: 1242133 - RNA, 19 nt, Homo sapiens
gcacaagacagauagauga

SEQ ID NO: 1242134 - RNA, 19 nt, Homo sapiens
gauagaugauugcugcuuu

SEQ ID NO: 1242135 - RNA, 19 nt, Homo sapiens
gcagagaccucagcuguca

SEQ ID NO: 1242136 - RNA, 19 nt, Homo sapiens
gaauuggccuucccuguuc

SEQ ID NO: 1242137 - RNA, 19 nt, Homo sapiens
gggcaugagucuggcauua

SEQ ID NO: 1242138 - RNA, 19 nt, Homo sapiens
caccacaccuagcuaauuu

SEQ ID NO: 1242139 - RNA, 19 nt, Homo sapiens
uuacauggcagcaauauuu

SEQ ID NO: 1242140 - RNA, 19 nt, Homo sapiens
gaagacagaaccauuugaa

SEQ ID NO: 1242141 - RNA, 19 nt, Homo sapiens
gaugauugcugcuuuccuu

SEQ ID NO: 1242142 - RNA, 19 nt, Homo sapiens
uuaaaugccuccuuauuca

SEQ ID NO: 1242143 - RNA, 19 nt, Homo sapiens
gcagggcuaugccuuguug

SEQ ID NO: 1242144 - RNA, 19 nt, Homo sapiens
ugucaaaggucaagaggaa

SEQ ID NO: 1242145 - RNA, 19 nt, Homo sapiens
caaggggucucuucaguua

SEQ ID NO: 1242146 - RNA, 19 nt, Homo sapiens
aaacagugcuucccugcaa

SEQ ID NO: 1242147 - RNA, 19 nt, Homo sapiens
gcacacaccaccacaccua

SEQ ID NO: 1242148 - RNA, 19 nt, Homo sapiens
cuagcaacguuacuucaua

SEQ ID NO: 1242149 - RNA, 19 nt, Homo sapiens
ugagggagcuagcaacguu

SEQ ID NO: 1242150 - RNA, 19 nt, Homo sapiens
gacagaaccauuugaagaa

SEQ ID NO: 1242151 - RNA, 19 nt, Homo sapiens
gagaagaugaucaaacaau

SEQ ID NO: 1242152 - RNA, 19 nt, Homo sapiens
gaacucauaacccaauuca

SEQ ID NO: 1242153 - RNA, 19 nt, Homo sapiens
gcaugagucuggcauuaca

SEQ ID NO: 1242154 - RNA, 19 nt, Homo sapiens
agacaaggcuuugccaugu

SEQ ID NO: 1242155 - RNA, 19 nt, Homo sapiens
caacagguguggcaugaac

SEQ ID NO: 1242156 - RNA, 19 nt, Homo sapiens
ggcuacagcuugcagagaa

SEQ ID NO: 1242157 - RNA, 19 nt, Homo sapiens
guuaaaugccuccuuauuc

SEQ ID NO: 1242158 - RNA, 19 nt, Homo sapiens
ccaauucacuuccuucacu

SEQ ID NO: 1242159 - RNA, 19 nt, Homo sapiens
ggcuaugccuuguugguuu

SEQ ID NO: 1242160 - RNA, 19 nt, Homo sapiens
uaccacgccuauccaauuu

SEQ ID NO: 1242161 - RNA, 19 nt, Homo sapiens
agacagaaccauuugaaga

SEQ ID NO: 1242162 - RNA, 19 nt, Homo sapiens
gcaacguuacuucauauga

SEQ ID NO: 1242163 - RNA, 19 nt, Homo sapiens
ccaaagugcugggauuaca

SEQ ID NO: 1242164 - RNA, 19 nt, Homo sapiens
gacaaggcuuugccauguu

SEQ ID NO: 1242165 - RNA, 19 nt, Homo sapiens
ugaaagaccuagagaucca

SEQ ID NO: 1242166 - RNA, 19 nt, Homo sapiens
uagcaacguuacuucauau

SEQ ID NO: 1242167 - RNA, 19 nt, Homo sapiens
gaauuuccacugcaugcua

SEQ ID NO: 1242168 - RNA, 19 nt, Homo sapiens
ggccuucccuguucaagug

SEQ ID NO: 1242169 - RNA, 19 nt, Homo sapiens
caagaaagcaccacacacu

SEQ ID NO: 1242170 - RNA, 19 nt, Homo sapiens
cagcuuuccucugucauuu

SEQ ID NO: 1242171 - RNA, 19 nt, Homo sapiens
gaacagguggacacuagug

SEQ ID NO: 1242172 - RNA, 19 nt, Homo sapiens
gagaucgauugaagacaga

SEQ ID NO: 1242173 - RNA, 19 nt, Homo sapiens
gguuaaaugccuccuuauu

SEQ ID NO: 1242174 - RNA, 19 nt, Homo sapiens
cugcauaacugggacuaaa

SEQ ID NO: 1242175 - RNA, 19 nt, Homo sapiens
acagaaccauuugaagaaa

SEQ ID NO: 1242176 - RNA, 19 nt, Homo sapiens
agagcuaagucuccauuug

SEQ ID NO: 1242177 - RNA, 19 nt, Homo sapiens
ucagaggccuccuguaagg

SEQ ID NO: 1242178 - RNA, 19 nt, Homo sapiens
agucagaggccuccuguaa

SEQ ID NO: 1242179 - RNA, 19 nt, Homo sapiens
gagauccucauaccucaaa

SEQ ID NO: 1242180 - RNA, 19 nt, Homo sapiens
gaaacuuuggucucaagaa

SEQ ID NO: 1242181 - RNA, 19 nt, Homo sapiens
ucaugaaucugcaggaucu

SEQ ID NO: 1242182 - RNA, 19 nt, Homo sapiens
cuaccacgccuauccaauu

SEQ ID NO: 1242183 - RNA, 19 nt, Homo sapiens
gagcuaagucuccauuugg

SEQ ID NO: 1242184 - RNA, 19 nt, Homo sapiens
accauggacuuuagguaua

SEQ ID NO: 1242185 - RNA, 19 nt, Homo sapiens
gcagaugcacugauucuac

SEQ ID NO: 1242186 - RNA, 19 nt, Homo sapiens
ccuauccaauuucugguuu

SEQ ID NO: 1242187 - RNA, 19 nt, Homo sapiens
acaaggcuuugccauguug

SEQ ID NO: 1242188 - RNA, 19 nt, Homo sapiens
cagcauuggugauggaaag

SEQ ID NO: 1242189 - RNA, 19 nt, Homo sapiens
augguuaaaugccuccuua

SEQ ID NO: 1242190 - RNA, 19 nt, Homo sapiens
cagauucuucguaaacuuu

SEQ ID NO: 1242191 - RNA, 19 nt, Homo sapiens
ccauggacuuuagguauau

SEQ ID NO: 1242192 - RNA, 19 nt, Homo sapiens
gcaacagguuaaacuacca

SEQ ID NO: 1242193 - RNA, 19 nt, Homo sapiens
gagccaaggagcugaacaa

SEQ ID NO: 1242194 - RNA, 19 nt, Homo sapiens
gauugaagacagaaccauu

SEQ ID NO: 1242195 - RNA, 19 nt, Homo sapiens
gcagcuuuccucugucauu

SEQ ID NO: 1242196 - RNA, 19 nt, Homo sapiens
cccgugcucuccucucuuu

SEQ ID NO: 1242197 - RNA, 19 nt, Homo sapiens
aaauagugauacagucaga

SEQ ID NO: 1242198 - RNA, 19 nt, Homo sapiens
uggcagcaauauuucuaaa

SEQ ID NO: 1242199 - RNA, 19 nt, Homo sapiens
aggaaucgauagccaaugu

SEQ ID NO: 1242200 - RNA, 19 nt, Homo sapiens
uaugaaagaccuagagauc

SEQ ID NO: 1242201 - RNA, 19 nt, Homo sapiens
uguggcagaugcacugauu

SEQ ID NO: 1242202 - RNA, 19 nt, Homo sapiens
gcuaccuucuccugugauu

SEQ ID NO: 1242203 - RNA, 19 nt, Homo sapiens
gcuaugccuuguugguuuc

SEQ ID NO: 1242204 - RNA, 19 nt, Homo sapiens
aaguauaggcaacagguua

SEQ ID NO: 1242205 - RNA, 19 nt, Homo sapiens
aaacuuuggucucaagaac

SEQ ID NO: 1242206 - RNA, 19 nt, Homo sapiens
uaacccaauucacuuccuu

SEQ ID NO: 1242207 - RNA, 19 nt, Homo sapiens
ggaacaauuuaugauagag

SEQ ID NO: 1242208 - RNA, 19 nt, Homo sapiens
ccaccacaccuagcuaauu

SEQ ID NO: 1242209 - RNA, 19 nt, Homo sapiens
ucagauucuucguaaacuu

SEQ ID NO: 1242210 - RNA, 19 nt, Homo sapiens
gauuacuuaugcuguggaa

SEQ ID NO: 1242211 - RNA, 19 nt, Homo sapiens
aagcuuacauggcagcaau

SEQ ID NO: 1242212 - RNA, 19 nt, Homo sapiens
uacuuucgaugguuaaaug

SEQ ID NO: 1242213 - RNA, 19 nt, Homo sapiens
ucccuggucucccaacauu

SEQ ID NO: 1242214 - RNA, 19 nt, Homo sapiens
uauauauacuggcguuucu

SEQ ID NO: 1242215 - RNA, 19 nt, Homo sapiens
cuauccaauuucugguuua

SEQ ID NO: 1242216 - RNA, 19 nt, Homo sapiens
ggauggacuuggagaacag

SEQ ID NO: 1242217 - RNA, 19 nt, Homo sapiens
ucaaaggucaagaggaaga

SEQ ID NO: 1242218 - RNA, 19 nt, Homo sapiens
gaaucgauagccaaugugu

SEQ ID NO: 1242219 - RNA, 19 nt, Homo sapiens
ccacgccuauccaauuucu

SEQ ID NO: 1242220 - RNA, 19 nt, Homo sapiens
ucucuucaguuaaucuguu

SEQ ID NO: 1242221 - RNA, 19 nt, Homo sapiens
caaggaaucgauagccaau

SEQ ID NO: 1242222 - RNA, 19 nt, Homo sapiens
ggagcaaggccuguugaug

SEQ ID NO: 1242223 - RNA, 19 nt, Homo sapiens
gagcuagcaacguuacuuc

SEQ ID NO: 1242224 - RNA, 19 nt, Homo sapiens
ggugggcacaagacagaua

SEQ ID NO: 1242225 - RNA, 19 nt, Homo sapiens
gaagccuugucuaccuuuc

SEQ ID NO: 1242226 - RNA, 19 nt, Homo sapiens
ggaagccuugucuaccuuu

SEQ ID NO: 1242227 - RNA, 19 nt, Homo sapiens
agaaagcaccacacacuca

SEQ ID NO: 1242228 - RNA, 19 nt, Homo sapiens
aagcuaccuucuccuguga

SEQ ID NO: 1242229 - RNA, 19 nt, Homo sapiens
ucauuuggauaaucuccuu

SEQ ID NO: 1242230 - RNA, 19 nt, Homo sapiens
aaaugccuccuuauucaaa

SEQ ID NO: 1242231 - RNA, 19 nt, Homo sapiens
gaacugaccucuacacuaa

SEQ ID NO: 1242232 - RNA, 19 nt, Homo sapiens
gaacgagucuuuccuuuaa

SEQ ID NO: 1242233 - RNA, 19 nt, Homo sapiens
gcagacagcuucuuuauga

SEQ ID NO: 1242234 - RNA, 19 nt, Homo sapiens
gcacagauauaccucauuu

SEQ ID NO: 1242235 - RNA, 19 nt, Homo sapiens
gcacugaccuuacacuuug

SEQ ID NO: 1242236 - RNA, 19 nt, Homo sapiens
gaacaguugucuaucaauu

SEQ ID NO: 1242237 - RNA, 19 nt, Homo sapiens
guaaucagcugccuauuug

SEQ ID NO: 1242238 - RNA, 19 nt, Homo sapiens
gaaaugagcaguaucagaa

SEQ ID NO: 1242239 - RNA, 19 nt, Homo sapiens
aaagagagguucuguugua

SEQ ID NO: 1242240 - RNA, 19 nt, Homo sapiens
ugucaaagcuuucuaguga

SEQ ID NO: 1242241 - RNA, 19 nt, Homo sapiens
gaacucaccuugcgaacug

SEQ ID NO: 1242242 - RNA, 19 nt, Homo sapiens
gaaaucaaguacuacaaga

SEQ ID NO: 1242243 - RNA, 19 nt, Homo sapiens
gcacacuucuacccauaua

SEQ ID NO: 1242244 - RNA, 19 nt, Homo sapiens
gagagguucuguuguauug

SEQ ID NO: 1242245 - RNA, 19 nt, Homo sapiens
gaucugaaguccuuagguu

SEQ ID NO: 1242246 - RNA, 19 nt, Homo sapiens
gaaggaaguuggagugaca

SEQ ID NO: 1242247 - RNA, 19 nt, Homo sapiens
uggacaagauguagauuua

SEQ ID NO: 1242248 - RNA, 19 nt, Homo sapiens
ccaggacacuugcuucuuu

SEQ ID NO: 1242249 - RNA, 19 nt, Homo sapiens
gcuccaagauggccaauug

SEQ ID NO: 1242250 - RNA, 19 nt, Homo sapiens
gacaggaaauccacaagaa

SEQ ID NO: 1242251 - RNA, 19 nt, Homo sapiens
caaggugcuucccauguua

SEQ ID NO: 1242252 - RNA, 19 nt, Homo sapiens
aguaauggcuccuggguua

SEQ ID NO: 1242253 - RNA, 19 nt, Homo sapiens
uaacaacaaucgcaaauac

SEQ ID NO: 1242254 - RNA, 19 nt, Homo sapiens
gacaagauguagauuuaga

SEQ ID NO: 1242255 - RNA, 19 nt, Homo sapiens
gauuacagauucacauaug

SEQ ID NO: 1242256 - RNA, 19 nt, Homo sapiens
gauagaagccaucaacaga

SEQ ID NO: 1242257 - RNA, 19 nt, Homo sapiens
ccaauauuauggcuacuuu

SEQ ID NO: 1242258 - RNA, 19 nt, Homo sapiens
caagaugcauaccucauga

SEQ ID NO: 1242259 - RNA, 19 nt, Homo sapiens
ggagaaugcagaauaagaa

SEQ ID NO: 1242260 - RNA, 19 nt, Homo sapiens
gcaaauacuggcuucauga

SEQ ID NO: 1242261 - RNA, 19 nt, Homo sapiens
ggaugaagccacucuugua

SEQ ID NO: 1242262 - RNA, 19 nt, Homo sapiens
agaggcagcugcaaagaaa

SEQ ID NO: 1242263 - RNA, 19 nt, Homo sapiens
gcaaggaccagaagauaau

SEQ ID NO: 1242264 - RNA, 19 nt, Homo sapiens
uagcaaacauagcagauga

SEQ ID NO: 1242265 - RNA, 19 nt, Homo sapiens
gauuugaacaggcauuaua

SEQ ID NO: 1242266 - RNA, 19 nt, Homo sapiens
ccauauacauacacugauu

SEQ ID NO: 1242267 - RNA, 19 nt, Homo sapiens
gaaaacauccaucauauug

SEQ ID NO: 1242268 - RNA, 19 nt, Homo sapiens
gauaauacucuacuguuug

SEQ ID NO: 1242269 - RNA, 19 nt, Homo sapiens
gaaauaccguuuacuugcu

SEQ ID NO: 1242270 - RNA, 19 nt, Homo sapiens
gcaggagccuagcaggaaa

SEQ ID NO: 1242271 - RNA, 19 nt, Homo sapiens
ucugcaagcuccaaacuuu

SEQ ID NO: 1242272 - RNA, 19 nt, Homo sapiens
gaaggaacaggacgaguug

SEQ ID NO: 1242273 - RNA, 19 nt, Homo sapiens
ccauucaguuuccauauga

SEQ ID NO: 1242274 - RNA, 19 nt, Homo sapiens
gaagauaauacucuacugu

SEQ ID NO: 1242275 - RNA, 19 nt, Homo sapiens
caagauggccaauugaaug

SEQ ID NO: 1242276 - RNA, 19 nt, Homo sapiens
ggaacugcauuuacuugug

SEQ ID NO: 1242277 - RNA, 19 nt, Homo sapiens
aaagggagaaugcagaaua

SEQ ID NO: 1242278 - RNA, 19 nt, Homo sapiens
gagcagacagcuucuuuau

SEQ ID NO: 1242279 - RNA, 19 nt, Homo sapiens
aaugagguauucccacaua

SEQ ID NO: 1242280 - RNA, 19 nt, Homo sapiens
ucgaagaucugaaguccuu

SEQ ID NO: 1242281 - RNA, 19 nt, Homo sapiens
ucaaggugcuucccauguu

SEQ ID NO: 1242282 - RNA, 19 nt, Homo sapiens
gaguagacaccuaugagua

SEQ ID NO: 1242283 - RNA, 19 nt, Homo sapiens
ggaagaauaacccucaaug

SEQ ID NO: 1242284 - RNA, 19 nt, Homo sapiens
augcauaccucaugaauuc

SEQ ID NO: 1242285 - RNA, 19 nt, Homo sapiens
gaggagagaaggaaaugaa

SEQ ID NO: 1242286 - RNA, 19 nt, Homo sapiens
ucuauggccuaucaguuua

SEQ ID NO: 1242287 - RNA, 19 nt, Homo sapiens
ccacauagaaauaacaaug

SEQ ID NO: 1242288 - RNA, 19 nt, Homo sapiens
ccucaugaauucaacuauu

SEQ ID NO: 1242289 - RNA, 19 nt, Homo sapiens
uaacagaagauaccucaga

SEQ ID NO: 1242290 - RNA, 19 nt, Homo sapiens
agauguagauuuagaagga

SEQ ID NO: 1242291 - RNA, 19 nt, Homo sapiens
caagaaauuccaugaacuu

SEQ ID NO: 1242292 - RNA, 19 nt, Homo sapiens
gcccagcuccucagagaua

SEQ ID NO: 1242293 - RNA, 19 nt, Homo sapiens
acacugauuugcaaugcua

SEQ ID NO: 1242294 - RNA, 19 nt, Homo sapiens
gauggccaauugaauguga

SEQ ID NO: 1242295 - RNA, 19 nt, Homo sapiens
gacagcuucuuuaugauga

SEQ ID NO: 1242296 - RNA, 19 nt, Homo sapiens
gcagugugcuauaauaaaa

SEQ ID NO: 1242297 - RNA, 19 nt, Homo sapiens
ugaacgagucuuuccuuua

SEQ ID NO: 1242298 - RNA, 19 nt, Homo sapiens
gccaacacccgcaauauug

SEQ ID NO: 1242299 - RNA, 19 nt, Homo sapiens
ggagcagacagcuucuuua

SEQ ID NO: 1242300 - RNA, 19 nt, Homo sapiens
aaacugaaguguguucuca

SEQ ID NO: 1242301 - RNA, 19 nt, Homo sapiens
agaaggaaaugaaaucaag

SEQ ID NO: 1242302 - RNA, 19 nt, Homo sapiens
aagggagaaugcagaauaa

SEQ ID NO: 1242303 - RNA, 19 nt, Homo sapiens
aaacaacccuauccagucu

SEQ ID NO: 1242304 - RNA, 19 nt, Homo sapiens
aaacauccaucauauugag

SEQ ID NO: 1242305 - RNA, 19 nt, Homo sapiens
uagcugggauuacagauuc

SEQ ID NO: 1242306 - RNA, 19 nt, Homo sapiens
uagaagccaucaacagaga

SEQ ID NO: 1242307 - RNA, 19 nt, Homo sapiens
accgucaccuccaauauua

SEQ ID NO: 1242308 - RNA, 19 nt, Homo sapiens
guaucaugcucuccaaaga

SEQ ID NO: 1242309 - RNA, 19 nt, Homo sapiens
ggucuugagugccagaguu

SEQ ID NO: 1242310 - RNA, 19 nt, Homo sapiens
gaagauaccucagaaaagg

SEQ ID NO: 1242311 - RNA, 19 nt, Homo sapiens
gaugcagaaguuaaaguua

SEQ ID NO: 1242312 - RNA, 19 nt, Homo sapiens
cagauggucuuccuguuca

SEQ ID NO: 1242313 - RNA, 19 nt, Homo sapiens
ugacaguucucucucagau

SEQ ID NO: 1242314 - RNA, 19 nt, Homo sapiens
ggccacagucguaagaaua

SEQ ID NO: 1242315 - RNA, 19 nt, Homo sapiens
gagguucuguuguauugug

SEQ ID NO: 1242316 - RNA, 19 nt, Homo sapiens
gggauuacagauucacaua

SEQ ID NO: 1242317 - RNA, 19 nt, Homo sapiens
ugccucagcuuuccgagua

SEQ ID NO: 1242318 - RNA, 19 nt, Homo sapiens
ccaaagagaaccauaaacu

SEQ ID NO: 1242319 - RNA, 19 nt, Homo sapiens
ggaaauccacaagaaauuc

SEQ ID NO: 1242320 - RNA, 19 nt, Homo sapiens
guaacauguucccagcuuu

SEQ ID NO: 1242321 - RNA, 19 nt, Homo sapiens
gcaaugcuaccuccuguca

SEQ ID NO: 1242322 - RNA, 19 nt, Homo sapiens
aaugugaggucaucaagga

SEQ ID NO: 1242323 - RNA, 19 nt, Homo sapiens
agacuauuccugauccuua

SEQ ID NO: 1242324 - RNA, 19 nt, Homo sapiens
gagagaaggaaaugaaauc

SEQ ID NO: 1242325 - RNA, 19 nt, Homo sapiens
cauaugaccaggacacuug

SEQ ID NO: 1242326 - RNA, 19 nt, Homo sapiens
ggaccauucaguuuccaua

SEQ ID NO: 1242327 - RNA, 19 nt, Homo sapiens
ggagagaaggaaaugaaau

SEQ ID NO: 1242328 - RNA, 19 nt, Homo sapiens
gaugcuaccuaucgcuuca

SEQ ID NO: 1242329 - RNA, 19 nt, Homo sapiens
cagaaaagaugcuaccuau

SEQ ID NO: 1242330 - RNA, 19 nt, Homo sapiens
cagcauguucggaagaaua

SEQ ID NO: 1242331 - RNA, 19 nt, Homo sapiens
gcaaugaagguauuucuuu

SEQ ID NO: 1242332 - RNA, 19 nt, Homo sapiens
gaacauaaagcuagcaaug

SEQ ID NO: 1242333 - RNA, 19 nt, Homo sapiens
caccaugccuggcuaauuu

SEQ ID NO: 1242334 - RNA, 19 nt, Homo sapiens
acucacagcuuccuaguuu

SEQ ID NO: 1242335 - RNA, 19 nt, Homo sapiens
ggugaaaguugaagcuauu

SEQ ID NO: 1242336 - RNA, 19 nt, Homo sapiens
ugagagagcuuucccaucu

SEQ ID NO: 1242337 - RNA, 19 nt, Homo sapiens
ccuaguagcuccacugaga

SEQ ID NO: 1242338 - RNA, 19 nt, Homo sapiens
caaugaagguauuucuuug

SEQ ID NO: 1242339 - RNA, 19 nt, Homo sapiens
ccagcuaauuccuguauuu

SEQ ID NO: 1242340 - RNA, 19 nt, Homo sapiens
ggagugcaguggcgcaauu

SEQ ID NO: 1242341 - RNA, 19 nt, Homo sapiens
acauaaagcuagcaaugaa

SEQ ID NO: 1242342 - RNA, 19 nt, Homo sapiens
ugaagagacugauguguca

SEQ ID NO: 1242343 - RNA, 19 nt, Homo sapiens
uguaaucgcuucucacugu

SEQ ID NO: 1242344 - RNA, 19 nt, Homo sapiens
agagggaucugguguguau

SEQ ID NO: 1242345 - RNA, 19 nt, Homo sapiens
gauggcagcucagaagguu

SEQ ID NO: 1242346 - RNA, 19 nt, Homo sapiens
caagagggaucuggugugu

SEQ ID NO: 1242347 - RNA, 19 nt, Homo sapiens
cacuuuaccugucuucuga

SEQ ID NO: 1242348 - RNA, 19 nt, Homo sapiens
ccaaagugcugggauuaca

SEQ ID NO: 1242349 - RNA, 19 nt, Homo sapiens
guaaucgcuucucacugua

SEQ ID NO: 1242350 - RNA, 19 nt, Homo sapiens
agacaggguuucaccaugu

SEQ ID NO: 1242351 - RNA, 19 nt, Homo sapiens
gagggccaccuaaagauuu

SEQ ID NO: 1242352 - RNA, 19 nt, Homo sapiens
caucucagcaguuucauug

SEQ ID NO: 1242353 - RNA, 19 nt, Homo sapiens
ggagggccaccuaaagauu

SEQ ID NO: 1242354 - RNA, 19 nt, Homo sapiens
gaaaguugaagcuauugug

SEQ ID NO: 1242355 - RNA, 19 nt, Homo sapiens
gcucuuaccauccuuagau

SEQ ID NO: 1242356 - RNA, 19 nt, Homo sapiens
gagcgggaauuggacaaga

SEQ ID NO: 1242357 - RNA, 19 nt, Homo sapiens
gggagaugcuuagggaguu

SEQ ID NO: 1242358 - RNA, 19 nt, Homo sapiens
ccagauaagcaggacuuua

SEQ ID NO: 1242359 - RNA, 19 nt, Homo sapiens
ggacuacaggcgccuauca

SEQ ID NO: 1242360 - RNA, 19 nt, Homo sapiens
ggaaaccaacucacagcuu

SEQ ID NO: 1242361 - RNA, 19 nt, Homo sapiens
gacaggguuucaccauguu

SEQ ID NO: 1242362 - RNA, 19 nt, Homo sapiens
gccaacagacccucaucua

SEQ ID NO: 1242363 - RNA, 19 nt, Homo sapiens
gaccauuccuacaaacuac

SEQ ID NO: 1242364 - RNA, 19 nt, Homo sapiens
gagguguaaucgcuucuca

SEQ ID NO: 1242365 - RNA, 19 nt, Homo sapiens
gcuacuugcacaugaauga

SEQ ID NO: 1242366 - RNA, 19 nt, Homo sapiens
uuagggaguucucgaagug

SEQ ID NO: 1242367 - RNA, 19 nt, Homo sapiens
ccaagggcacugggaauuu

SEQ ID NO: 1242368 - RNA, 19 nt, Homo sapiens
ccaccacgcccagcuaauu

SEQ ID NO: 1242369 - RNA, 19 nt, Homo sapiens
gguggugggugagguauca

SEQ ID NO: 1242370 - RNA, 19 nt, Homo sapiens
ugggugagguaucagcuuu

SEQ ID NO: 1242371 - RNA, 19 nt, Homo sapiens
gaugagccaccaaugucua

SEQ ID NO: 1242372 - RNA, 19 nt, Homo sapiens
ccagcuacuugcacaugaa

SEQ ID NO: 1242373 - RNA, 19 nt, Homo sapiens
ccaggaagcuuugggguuu

SEQ ID NO: 1242374 - RNA, 19 nt, Homo sapiens
cuauugugaucucugauga

SEQ ID NO: 1242375 - RNA, 19 nt, Homo sapiens
aagcgauucucuuaacuca

SEQ ID NO: 1242376 - RNA, 19 nt, Homo sapiens
cugagaccauuccuacaaa

SEQ ID NO: 1242377 - RNA, 19 nt, Homo sapiens
ccagaugagccaccaaugu

SEQ ID NO: 1242378 - RNA, 19 nt, Homo sapiens
gccagcuacuugcacauga

SEQ ID NO: 1242379 - RNA, 19 nt, Homo sapiens
cuucuggacuuuauguaug

SEQ ID NO: 1242380 - RNA, 19 nt, Homo sapiens
acaaggagcgggaauugga

SEQ ID NO: 1242381 - RNA, 19 nt, Homo sapiens
gaauuuuccugagguguaa

SEQ ID NO: 1242382 - RNA, 19 nt, Homo sapiens
ucucagcaguuucauugga

SEQ ID NO: 1242383 - RNA, 19 nt, Homo sapiens
caagggcacugggaauuuu

SEQ ID NO: 1242384 - RNA, 19 nt, Homo sapiens
gauggucucgaucuucuga

SEQ ID NO: 1242385 - RNA, 19 nt, Homo sapiens
gcuacugccugcggagcua

SEQ ID NO: 1242386 - RNA, 19 nt, Homo sapiens
cucaugcucuuacacacua

SEQ ID NO: 1242387 - RNA, 19 nt, Homo sapiens
ggagaugcuuagggaguuc

SEQ ID NO: 1242388 - RNA, 19 nt, Homo sapiens
gagagagcuuucccaucug

SEQ ID NO: 1242389 - RNA, 19 nt, Homo sapiens
aagcuauugugaucucuga

SEQ ID NO: 1242390 - RNA, 19 nt, Homo sapiens
ccaggauggucucgaucuu

SEQ ID NO: 1242391 - RNA, 19 nt, Homo sapiens
uaagggagcaugagcugau

SEQ ID NO: 1242392 - RNA, 19 nt, Homo sapiens
gauguucccaccugcaaga

SEQ ID NO: 1242393 - RNA, 19 nt, Homo sapiens
guuggcaucugcugagaca

SEQ ID NO: 1242394 - RNA, 19 nt, Homo sapiens
aaaguugaagcuauuguga

SEQ ID NO: 1242395 - RNA, 19 nt, Homo sapiens
gagccacugccaucucuug

SEQ ID NO: 1242396 - RNA, 19 nt, Homo sapiens
ucuggcaucucagcaguuu

SEQ ID NO: 1242397 - RNA, 19 nt, Homo sapiens
gccucaagcgauucucuua

SEQ ID NO: 1242398 - RNA, 19 nt, Homo sapiens
gacaggguuucaccguguu

SEQ ID NO: 1242399 - RNA, 19 nt, Homo sapiens
uuaccugucuucugaguac

SEQ ID NO: 1242400 - RNA, 19 nt, Homo sapiens
acaaacuacuucucuucug

SEQ ID NO: 1242401 - RNA, 19 nt, Homo sapiens
cuacaaacuacuucucuuc

SEQ ID NO: 1242402 - RNA, 19 nt, Homo sapiens
ccuacaaacuacuucucuu

SEQ ID NO: 1242403 - RNA, 19 nt, Homo sapiens
cuacaaggagcgggaauug

SEQ ID NO: 1242404 - RNA, 19 nt, Homo sapiens
uugaguagcugggauuaca

SEQ ID NO: 1242405 - RNA, 19 nt, Homo sapiens
cagaugagccaccaauguc

SEQ ID NO: 1242406 - RNA, 19 nt, Homo sapiens
gcugcucccucaccuacug

SEQ ID NO: 1242407 - RNA, 19 nt, Homo sapiens
ggaggaggaaaccaacuca

SEQ ID NO: 1242408 - RNA, 19 nt, Homo sapiens
cacgugagcgacccuauga

SEQ ID NO: 1242409 - RNA, 19 nt, Homo sapiens
agaccauuccuacaaacua

SEQ ID NO: 1242410 - RNA, 19 nt, Homo sapiens
aaagcuagcaaugaaggua

SEQ ID NO: 1242411 - RNA, 19 nt, Homo sapiens
gcuaguucccacccuggua

SEQ ID NO: 1242412 - RNA, 19 nt, Homo sapiens
ccucaagcgauucucuuaa

SEQ ID NO: 1242413 - RNA, 19 nt, Homo sapiens
gcuauugugaucucugaug

SEQ ID NO: 1242414 - RNA, 19 nt, Homo sapiens
ucucuugccagcccuagua

SEQ ID NO: 1242415 - RNA, 19 nt, Homo sapiens
cuacacagccuggcaugga

SEQ ID NO: 1242416 - RNA, 19 nt, Homo sapiens
agaaggaggaggaaaccaa

SEQ ID NO: 1242417 - RNA, 19 nt, Homo sapiens
ucucuuaacucagccucuu

SEQ ID NO: 1242418 - RNA, 19 nt, Homo sapiens
gcaaggccugggagcgaaa

SEQ ID NO: 1242419 - RNA, 19 nt, Homo sapiens
ugauguggguccugagagu

SEQ ID NO: 1242420 - RNA, 19 nt, Homo sapiens
ccaagaaggaggaggaaac

SEQ ID NO: 1242421 - RNA, 19 nt, Homo sapiens
ggugagguaucagcuuucu

SEQ ID NO: 1242422 - RNA, 19 nt, Homo sapiens
gcccagcuaauuccuguau

SEQ ID NO: 1242423 - RNA, 19 nt, Homo sapiens
ugccuggccucaagcgauu

SEQ ID NO: 1242424 - RNA, 19 nt, Homo sapiens
ucaccaugccuggcuaauu

SEQ ID NO: 1242425 - RNA, 19 nt, Homo sapiens
ggaccucuaccgccacauc

SEQ ID NO: 1242426 - RNA, 19 nt, Homo sapiens
ugcaagacaugugggaaga

SEQ ID NO: 1242427 - RNA, 19 nt, Homo sapiens
aguugaagcuauugugauc

SEQ ID NO: 1242428 - RNA, 19 nt, Homo sapiens
ugucucagcuccaguucca

SEQ ID NO: 1242429 - RNA, 19 nt, Homo sapiens
uagcuccacugagaccauu

SEQ ID NO: 1242430 - RNA, 19 nt, Homo sapiens
ccgcagugcugggauuaca

SEQ ID NO: 1242431 - RNA, 19 nt, Homo sapiens
gaagacaauuucagaaugu

SEQ ID NO: 1242432 - RNA, 19 nt, Homo sapiens
ggacugcuauuuacucuug

SEQ ID NO: 1242433 - RNA, 19 nt, Homo sapiens
caaaugaaucgguauguua

SEQ ID NO: 1242434 - RNA, 19 nt, Homo sapiens
agaagaagaugaagaagaa

SEQ ID NO: 1242435 - RNA, 19 nt, Homo sapiens
ggaagacaauuucagaaug

SEQ ID NO: 1242436 - RNA, 19 nt, Homo sapiens
gcaacaagauucugcuuca

SEQ ID NO: 1242437 - RNA, 19 nt, Homo sapiens
gcaaaugaaucgguauguu

SEQ ID NO: 1242438 - RNA, 19 nt, Homo sapiens
gggaaugauuguuuauuug

SEQ ID NO: 1242439 - RNA, 19 nt, Homo sapiens
ggacuacgauggcaacaag

SEQ ID NO: 1242440 - RNA, 19 nt, Homo sapiens
gcacucauucauucauuua

SEQ ID NO: 1242441 - RNA, 19 nt, Homo sapiens
gaacgggccaguccuguga

SEQ ID NO: 1242442 - RNA, 19 nt, Homo sapiens
uaacccagcuggauguguu

SEQ ID NO: 1242443 - RNA, 19 nt, Homo sapiens
ggacagugguucuuguuac

SEQ ID NO: 1242444 - RNA, 19 nt, Homo sapiens
caggauaauugcauuguau

SEQ ID NO: 1242445 - RNA, 19 nt, Homo sapiens
gaagcgaccuugcaaaaga

SEQ ID NO: 1242446 - RNA, 19 nt, Homo sapiens
gcucaucugcuucucauuu

SEQ ID NO: 1242447 - RNA, 19 nt, Homo sapiens
gaacuugguguuaagaaug

SEQ ID NO: 1242448 - RNA, 19 nt, Homo sapiens
cagaaugucuccuucaucu

SEQ ID NO: 1242449 - RNA, 19 nt, Homo sapiens
ugccuuagccuccugauua

SEQ ID NO: 1242450 - RNA, 19 nt, Homo sapiens
gagcaggacuuggguucuu

SEQ ID NO: 1242451 - RNA, 19 nt, Homo sapiens
gaaucagccuguuaguugu

SEQ ID NO: 1242452 - RNA, 19 nt, Homo sapiens
gggccaguccugugaaaua

SEQ ID NO: 1242453 - RNA, 19 nt, Homo sapiens
agaaucagccuguuaguug

SEQ ID NO: 1242454 - RNA, 19 nt, Homo sapiens
aaacaacaguguccuuaag

SEQ ID NO: 1242455 - RNA, 19 nt, Homo sapiens
gaacccaggcagacuuauu

SEQ ID NO: 1242456 - RNA, 19 nt, Homo sapiens
gcuccaggcugacuucugu

SEQ ID NO: 1242457 - RNA, 19 nt, Homo sapiens
ugacuucugucucugcaaa

SEQ ID NO: 1242458 - RNA, 19 nt, Homo sapiens
gagcuucucuugccguaag

SEQ ID NO: 1242459 - RNA, 19 nt, Homo sapiens
gcacguguuagucugguua

SEQ ID NO: 1242460 - RNA, 19 nt, Homo sapiens
ggccaugacuguccaucuu

SEQ ID NO: 1242461 - RNA, 19 nt, Homo sapiens
gugcgguggugccaucaua

SEQ ID NO: 1242462 - RNA, 19 nt, Homo sapiens
gcuauuuacucuugaaugc

SEQ ID NO: 1242463 - RNA, 19 nt, Homo sapiens
ucaggauaauugcauugua

SEQ ID NO: 1242464 - RNA, 19 nt, Homo sapiens
cuucggugcugcaguuuaa

SEQ ID NO: 1242465 - RNA, 19 nt, Homo sapiens
aaaaucagguugaacauga

SEQ ID NO: 1242466 - RNA, 19 nt, Homo sapiens
gcuugaccaucauaaauuc

SEQ ID NO: 1242467 - RNA, 19 nt, Homo sapiens
gacagugguucuuguuaca

SEQ ID NO: 1242468 - RNA, 19 nt, Homo sapiens
caagagaucggccaguuag

SEQ ID NO: 1242469 - RNA, 19 nt, Homo sapiens
ucaagagaucggccaguua

SEQ ID NO: 1242470 - RNA, 19 nt, Homo sapiens
gagagaagcgaccuugcaa

SEQ ID NO: 1242471 - RNA, 19 nt, Homo sapiens
uuacuuagguugcauagcu

SEQ ID NO: 1242472 - RNA, 19 nt, Homo sapiens
gacaccggcuugaccauca

SEQ ID NO: 1242473 - RNA, 19 nt, Homo sapiens
caugugaccucuuuuggua

SEQ ID NO: 1242474 - RNA, 19 nt, Homo sapiens
uaaaggugcugggaaugau

SEQ ID NO: 1242475 - RNA, 19 nt, Homo sapiens
ccugugaaauacugugaaa

SEQ ID NO: 1242476 - RNA, 19 nt, Homo sapiens
ccaggaagacaauuucaga

SEQ ID NO: 1242477 - RNA, 19 nt, Homo sapiens
guuuguaucuggaaugagu

SEQ ID NO: 1242478 - RNA, 19 nt, Homo sapiens
gcaguuccuccauggauga

SEQ ID NO: 1242479 - RNA, 19 nt, Homo sapiens
uaacuaggccuuguucaca

SEQ ID NO: 1242480 - RNA, 19 nt, Homo sapiens
gugcugggaaugauuguuu

SEQ ID NO: 1242481 - RNA, 19 nt, Homo sapiens
gaacagugggccuucuaca

SEQ ID NO: 1242482 - RNA, 19 nt, Homo sapiens
ggaaggcugugucccuacu

SEQ ID NO: 1242483 - RNA, 19 nt, Homo sapiens
aaauuggacugguugaucu

SEQ ID NO: 1242484 - RNA, 19 nt, Homo sapiens
uggacaauauggacugcua

SEQ ID NO: 1242485 - RNA, 19 nt, Homo sapiens
gcaccugucuucucaucac

SEQ ID NO: 1242486 - RNA, 19 nt, Homo sapiens
ggccgcuucuucauucauu

SEQ ID NO: 1242487 - RNA, 19 nt, Homo sapiens
gaugggagucuuccucugu

SEQ ID NO: 1242488 - RNA, 19 nt, Homo sapiens
ggaaugauuguuuauuugc

SEQ ID NO: 1242489 - RNA, 19 nt, Homo sapiens
gaagacgccaucagacucu

SEQ ID NO: 1242490 - RNA, 19 nt, Homo sapiens
aaccaaagaggaacauuga

SEQ ID NO: 1242491 - RNA, 19 nt, Homo sapiens
aaaccaaagaggaacauug

SEQ ID NO: 1242492 - RNA, 19 nt, Homo sapiens
acuaggccuuguucacaua

SEQ ID NO: 1242493 - RNA, 19 nt, Homo sapiens
gguaccaggaagacaauuu

SEQ ID NO: 1242494 - RNA, 19 nt, Homo sapiens
ggcuugaccaucauaaauu

SEQ ID NO: 1242495 - RNA, 19 nt, Homo sapiens
cuugggagcuggcaugcuu

SEQ ID NO: 1242496 - RNA, 19 nt, Homo sapiens
gagaagcgaccuugcaaaa

SEQ ID NO: 1242497 - RNA, 19 nt, Homo sapiens
ggauguccguguugcucuu

SEQ ID NO: 1242498 - RNA, 19 nt, Homo sapiens
agaacuugguguuaagaau

SEQ ID NO: 1242499 - RNA, 19 nt, Homo sapiens
acagucagcugcccaucug

SEQ ID NO: 1242500 - RNA, 19 nt, Homo sapiens
cuaaaggugcugggaauga

SEQ ID NO: 1242501 - RNA, 19 nt, Homo sapiens
ugaccaucauaaauucuga

SEQ ID NO: 1242502 - RNA, 19 nt, Homo sapiens
gaggacagugguucuuguu

SEQ ID NO: 1242503 - RNA, 19 nt, Homo sapiens
aagaagaagaugaagaaga

SEQ ID NO: 1242504 - RNA, 19 nt, Homo sapiens
guaccaggaagacaauuuc

SEQ ID NO: 1242505 - RNA, 19 nt, Homo sapiens
ucagcugaauccagaacuu

SEQ ID NO: 1242506 - RNA, 19 nt, Homo sapiens
gguggcagacucaggacua

SEQ ID NO: 1242507 - RNA, 19 nt, Homo sapiens
gcacuguggcuccgagauc

SEQ ID NO: 1242508 - RNA, 19 nt, Homo sapiens
gggcuuuccugcucaucug

SEQ ID NO: 1242509 - RNA, 19 nt, Homo sapiens
aaaucagguugaacaugaa

SEQ ID NO: 1242510 - RNA, 19 nt, Homo sapiens
auccagaacuugguguuaa

SEQ ID NO: 1242511 - RNA, 19 nt, Homo sapiens
aagugauccuccugccuua

SEQ ID NO: 1242512 - RNA, 19 nt, Homo sapiens
ccaguuagugccucugcua

SEQ ID NO: 1242513 - RNA, 19 nt, Homo sapiens
gcuccuggauugcauuugc

SEQ ID NO: 1242514 - RNA, 19 nt, Homo sapiens
guuacaaaccaaagaggaa

SEQ ID NO: 1242515 - RNA, 19 nt, Homo sapiens
ggacaauauggacugcuau

SEQ ID NO: 1242516 - RNA, 19 nt, Homo sapiens
uaagagaacacagccaaca

SEQ ID NO: 1242517 - RNA, 19 nt, Homo sapiens
gucuaaaggugcugggaau

SEQ ID NO: 1242518 - RNA, 19 nt, Homo sapiens
guuuaagguucaagagauc

SEQ ID NO: 1242519 - RNA, 19 nt, Homo sapiens
agucuucggugcugcaguu

SEQ ID NO: 1242520 - RNA, 19 nt, Homo sapiens
cuacacacgcugucuuugu

SEQ ID NO: 1242521 - RNA, 19 nt, Homo sapiens
cagaaucagccuguuaguu

SEQ ID NO: 1242522 - RNA, 19 nt, Homo sapiens
ccagcuggauguguugaau

SEQ ID NO: 1242523 - RNA, 19 nt, Homo sapiens
ccuguuaguuguucaucug

SEQ ID NO: 1242524 - RNA, 19 nt, Homo sapiens
ggccaguccugugaaauac

SEQ ID NO: 1242525 - RNA, 19 nt, Homo sapiens
gccuuagccuccugauuag

SEQ ID NO: 1242526 - RNA, 19 nt, Homo sapiens
ccaucagacucuacgagau

SEQ ID NO: 1242527 - RNA, 19 nt, Homo sapiens
cgcacucauucauucauuu

SEQ ID NO: 1242528 - RNA, 19 nt, Homo sapiens
aaaacgcacucauucauuc

SEQ ID NO: 1242529 - RNA, 19 nt, Homo sapiens
gaggaacauugagcacagu

SEQ ID NO: 1242530 - RNA, 19 nt, Homo sapiens
cuucuucauucauuucaga

SEQ ID NO: 1242531 - RNA, 19 nt, Homo sapiens
gcaaauggaucaacaacug

SEQ ID NO: 1242532 - RNA, 19 nt, Homo sapiens
gcccagacuucuuaucuua

SEQ ID NO: 1242533 - RNA, 19 nt, Homo sapiens
gaagaugucaagaauauga

SEQ ID NO: 1242534 - RNA, 19 nt, Homo sapiens
ggaaauacauugccuacgu

SEQ ID NO: 1242535 - RNA, 19 nt, Homo sapiens
cagaagccauacucaauaa

SEQ ID NO: 1242536 - RNA, 19 nt, Homo sapiens
ccaagaagaugaccaccuu

SEQ ID NO: 1242537 - RNA, 19 nt, Homo sapiens
guaugaagaugucaagaau

SEQ ID NO: 1242538 - RNA, 19 nt, Homo sapiens
ugacagugcugaaagugaa

SEQ ID NO: 1242539 - RNA, 19 nt, Homo sapiens
gcaaauggacaaaggaguu

SEQ ID NO: 1242540 - RNA, 19 nt, Homo sapiens
gcacaguacugagaaaugg

SEQ ID NO: 1242541 - RNA, 19 nt, Homo sapiens
gcaaagaagagaguucaaa

SEQ ID NO: 1242542 - RNA, 19 nt, Homo sapiens
ccagaagccauacucaaua

SEQ ID NO: 1242543 - RNA, 19 nt, Homo sapiens
agaccuggauucugaguuu

SEQ ID NO: 1242544 - RNA, 19 nt, Homo sapiens
gcacaguacugggaaaugg

SEQ ID NO: 1242545 - RNA, 19 nt, Homo sapiens
gcacaguacugggaaaugg

SEQ ID NO: 1242546 - RNA, 19 nt, Homo sapiens
gcacaguacugggaaaugg

SEQ ID NO: 1242547 - RNA, 19 nt, Homo sapiens
gcacaguacugggaaaugg

SEQ ID NO: 1242548 - RNA, 19 nt, Homo sapiens
ccgaguauaucuacacuug

SEQ ID NO: 1242549 - RNA, 19 nt, Homo sapiens
gaagagaguucaaaacauc

SEQ ID NO: 1242550 - RNA, 19 nt, Homo sapiens
gaaagugaagacugagauu

SEQ ID NO: 1242551 - RNA, 19 nt, Homo sapiens
gaagccauacucaauaaug

SEQ ID NO: 1242552 - RNA, 19 nt, Homo sapiens
gcacaguacuaggaaaugg

SEQ ID NO: 1242553 - RNA, 19 nt, Homo sapiens
cagggccucuugcugcuua

SEQ ID NO: 1242554 - RNA, 19 nt, Homo sapiens
gaccaccacugcaaaugga

SEQ ID NO: 1242555 - RNA, 19 nt, Homo sapiens
ggaaaugggagcauaguac

SEQ ID NO: 1242556 - RNA, 19 nt, Homo sapiens
ggagcacaguacugagaaa

SEQ ID NO: 1242557 - RNA, 19 nt, Homo sapiens
gaaacaacagagcccauga

SEQ ID NO: 1242558 - RNA, 19 nt, Homo sapiens
gugggaagccggaauuauu

SEQ ID NO: 1242559 - RNA, 19 nt, Homo sapiens
ggaaaugggcauacaguac

SEQ ID NO: 1242560 - RNA, 19 nt, Homo sapiens
ggaaaugggcauacaguac

SEQ ID NO: 1242561 - RNA, 19 nt, Homo sapiens
gaagacccguguccaucug

SEQ ID NO: 1242562 - RNA, 19 nt, Homo sapiens
gaugaccaccuuugaguau

SEQ ID NO: 1242563 - RNA, 19 nt, Homo sapiens
gaaaugggcauacaguacu

SEQ ID NO: 1242564 - RNA, 19 nt, Homo sapiens
gaaaugggcauacaguacu

SEQ ID NO: 1242565 - RNA, 19 nt, Homo sapiens
gcaggaggguuuacaucuc

SEQ ID NO: 1242566 - RNA, 19 nt, Homo sapiens
gguaugaagaugucaagaa

SEQ ID NO: 1242567 - RNA, 19 nt, Homo sapiens
ggaaaugggagcacaguac

SEQ ID NO: 1242568 - RNA, 19 nt, Homo sapiens
ggaaaugggagcacaguac

SEQ ID NO: 1242569 - RNA, 19 nt, Homo sapiens
ggaaaugggagcacaguac

SEQ ID NO: 1242570 - RNA, 19 nt, Homo sapiens
guuuacaucuccaggaaga

SEQ ID NO: 1242571 - RNA, 19 nt, Homo sapiens
gaaagauccauacgugcaa

SEQ ID NO: 1242572 - RNA, 19 nt, Homo sapiens
ggguuuacaucuccaggaa

SEQ ID NO: 1242573 - RNA, 19 nt, Homo sapiens
ggaauuauugguucuucuu

SEQ ID NO: 1242574 - RNA, 19 nt, Homo sapiens
gggcauacaguacugagaa

SEQ ID NO: 1242575 - RNA, 19 nt, Homo sapiens
ggaacucccggcugauuug

SEQ ID NO: 1242576 - RNA, 19 nt, Homo sapiens
caagagcucccugcugauu

SEQ ID NO: 1242577 - RNA, 19 nt, Homo sapiens
aagccauacucaauaauga

SEQ ID NO: 1242578 - RNA, 19 nt, Homo sapiens
ggagcacaguauugggaaa

SEQ ID NO: 1242579 - RNA, 19 nt, Homo sapiens
ggagcacaguacuaggaaa

SEQ ID NO: 1242580 - RNA, 19 nt, Homo sapiens
gaagaugaccaccuuugag

SEQ ID NO: 1242581 - RNA, 19 nt, Homo sapiens
ggcauacaguacugagaaa

SEQ ID NO: 1242582 - RNA, 19 nt, Homo sapiens
guacacuacugagaaaugg

SEQ ID NO: 1242583 - RNA, 19 nt, Homo sapiens
ucagacucaugaagaacua

SEQ ID NO: 1242584 - RNA, 19 nt, Homo sapiens
gggaaaugggcauacagua

SEQ ID NO: 1242585 - RNA, 19 nt, Homo sapiens
gggaaaugggcauacagua

SEQ ID NO: 1242586 - RNA, 19 nt, Homo sapiens
caacagagcccaugaaaac

SEQ ID NO: 1242587 - RNA, 19 nt, Homo sapiens
uuaauaaccgcaaagaaga

SEQ ID NO: 1242588 - RNA, 19 nt, Homo sapiens
ggagcacaguacugggaaa

SEQ ID NO: 1242589 - RNA, 19 nt, Homo sapiens
ggagcacaguacugggaaa

SEQ ID NO: 1242590 - RNA, 19 nt, Homo sapiens
gcacaguauugggaaaugg

SEQ ID NO: 1242591 - RNA, 19 nt, Homo sapiens
ggagcacaguacugggaaa

SEQ ID NO: 1242592 - RNA, 19 nt, Homo sapiens
ggagcacaguacugggaaa

SEQ ID NO: 1242593 - RNA, 19 nt, Homo sapiens
uguauguccucguccagua

SEQ ID NO: 1242594 - RNA, 19 nt, Homo sapiens
ccagacuucuuaucuuagu

SEQ ID NO: 1242595 - RNA, 19 nt, Homo sapiens
gagaaaugggagcacagua

SEQ ID NO: 1242596 - RNA, 19 nt, Homo sapiens
gagaaaugggagcacagua

SEQ ID NO: 1242597 - RNA, 19 nt, Homo sapiens
gagcacaguacuaggaaau

SEQ ID NO: 1242598 - RNA, 19 nt, Homo sapiens
cagcaugucuguucauucc

SEQ ID NO: 1242599 - RNA, 19 nt, Homo sapiens
gcauccaucucugucauca

SEQ ID NO: 1242600 - RNA, 19 nt, Homo sapiens
ucaagguccugccuguaga

SEQ ID NO: 1242601 - RNA, 19 nt, Homo sapiens
cacaagcacuuaugucacu

SEQ ID NO: 1242602 - RNA, 19 nt, Homo sapiens
gaaaugggagcauaguacu

SEQ ID NO: 1242603 - RNA, 19 nt, Homo sapiens
gccagcaacugcagaggau

SEQ ID NO: 1242604 - RNA, 19 nt, Homo sapiens
gccuagcccagacuucuua

SEQ ID NO: 1242605 - RNA, 19 nt, Homo sapiens
gagaagugggagcacagua

SEQ ID NO: 1242606 - RNA, 19 nt, Homo sapiens
gagaaaugggaguacacua

SEQ ID NO: 1242607 - RNA, 19 nt, Homo sapiens
ggaagugggagcacaguac

SEQ ID NO: 1242608 - RNA, 19 nt, Homo sapiens
gguccugccuguagagucu

SEQ ID NO: 1242609 - RNA, 19 nt, Homo sapiens
cuucuuaucuuaguagaca

SEQ ID NO: 1242610 - RNA, 19 nt, Homo sapiens
gaaaugggagcacaguacu

SEQ ID NO: 1242611 - RNA, 19 nt, Homo sapiens
gaaaugggagcacaguacu

SEQ ID NO: 1242612 - RNA, 19 nt, Homo sapiens
gaaaugggagcacaguacu

SEQ ID NO: 1242613 - RNA, 19 nt, Homo sapiens
ucacagcacugcaaaaugg

SEQ ID NO: 1242614 - RNA, 19 nt, Homo sapiens
gaaaugggagcacaguacu

SEQ ID NO: 1242615 - RNA, 19 nt, Homo sapiens
gaaaugggagcacaguacu

SEQ ID NO: 1242616 - RNA, 19 nt, Homo sapiens
gaaccagagcccaucaucu

SEQ ID NO: 1242617 - RNA, 19 nt, Homo sapiens
gcaaagccuccugcuccua

SEQ ID NO: 1242618 - RNA, 19 nt, Homo sapiens
gcacaggaagcagaugaug

SEQ ID NO: 1242619 - RNA, 19 nt, Homo sapiens
gaagccggaauuauugguu

SEQ ID NO: 1242620 - RNA, 19 nt, Homo sapiens
ggcauacaguacugggaaa

SEQ ID NO: 1242621 - RNA, 19 nt, Homo sapiens
cagagcccaucaucucaga

SEQ ID NO: 1242622 - RNA, 19 nt, Homo sapiens
aaacaacagagcccaugaa

SEQ ID NO: 1242623 - RNA, 19 nt, Homo sapiens
ucacuucugcacuucagua

SEQ ID NO: 1242624 - RNA, 19 nt, Homo sapiens
aaagauccauacgugcaaa

SEQ ID NO: 1242625 - RNA, 19 nt, Homo sapiens
gcacggaccccagguauga

SEQ ID NO: 1242626 - RNA, 19 nt, Homo sapiens
ggcauccucuguauuuuaa

SEQ ID NO: 1242627 - RNA, 19 nt, Homo sapiens
gaugaagacccguguccau

SEQ ID NO: 1242628 - RNA, 19 nt, Homo sapiens
ggagcauaguacugggaaa

SEQ ID NO: 1242629 - RNA, 19 nt, Homo sapiens
gaugaugccccgaguauau

SEQ ID NO: 1242630 - RNA, 19 nt, Homo sapiens
gcucccugcugauucacaa

SEQ ID NO: 1242631 - RNA, 19 nt, Homo sapiens
gggagaaaguuacauauuu

SEQ ID NO: 1242632 - RNA, 19 nt, Homo sapiens
gcaagugucuggugaaaug

SEQ ID NO: 1242633 - RNA, 19 nt, Homo sapiens
gaggagggcuaguucuaua

SEQ ID NO: 1242634 - RNA, 19 nt, Homo sapiens
gccaagaaguuacaauuau

SEQ ID NO: 1242635 - RNA, 19 nt, Homo sapiens
gaacauugggauucuauug

SEQ ID NO: 1242636 - RNA, 19 nt, Homo sapiens
gcacaggcaucuuugucuu

SEQ ID NO: 1242637 - RNA, 19 nt, Homo sapiens
gauacgaaaucuccagaau

SEQ ID NO: 1242638 - RNA, 19 nt, Homo sapiens
gaacaccagccucgucaaa

SEQ ID NO: 1242639 - RNA, 19 nt, Homo sapiens
gcucuuaccucucuacaac

SEQ ID NO: 1242640 - RNA, 19 nt, Homo sapiens
gggaugagacgggcucuua

SEQ ID NO: 1242641 - RNA, 19 nt, Homo sapiens
cagaagagcagggacauaa

SEQ ID NO: 1242642 - RNA, 19 nt, Homo sapiens
gagggaggcucuguaugaa

SEQ ID NO: 1242643 - RNA, 19 nt, Homo sapiens
cgagggaggcucuguauga

SEQ ID NO: 1242644 - RNA, 19 nt, Homo sapiens
ugagaaggguggucuagga

SEQ ID NO: 1242645 - RNA, 19 nt, Homo sapiens
gauccgagccuccggcaaa

SEQ ID NO: 1242646 - RNA, 19 nt, Homo sapiens
uacgaaaucuccagaaugg

SEQ ID NO: 1242647 - RNA, 19 nt, Homo sapiens
gagcagggacauaaaggaa

SEQ ID NO: 1242648 - RNA, 19 nt, Homo sapiens
ccacggugcuauccauuca

SEQ ID NO: 1242649 - RNA, 19 nt, Homo sapiens
gaagagcagggacauaaag

SEQ ID NO: 1242650 - RNA, 19 nt, Homo sapiens
ggaaggaaagaucaaggaa

SEQ ID NO: 1242651 - RNA, 19 nt, Homo sapiens
caagaccagugccagaugu

SEQ ID NO: 1242652 - RNA, 19 nt, Homo sapiens
uggaugagcuggugugagu

SEQ ID NO: 1242653 - RNA, 19 nt, Homo sapiens
agggcuaguucuauacuua

SEQ ID NO: 1242654 - RNA, 19 nt, Homo sapiens
gagcugccuugacccagaa

SEQ ID NO: 1242655 - RNA, 19 nt, Homo sapiens
uaaaggugaugccaagaag

SEQ ID NO: 1242656 - RNA, 19 nt, Homo sapiens
caacaucuauauggucauc

SEQ ID NO: 1242657 - RNA, 19 nt, Homo sapiens
ggugggagaaaguuacaua

SEQ ID NO: 1242658 - RNA, 19 nt, Homo sapiens
ggaaagaucaaggaaccaa

SEQ ID NO: 1242659 - RNA, 19 nt, Homo sapiens
ucaagaacauggagaaagc

SEQ ID NO: 1242660 - RNA, 19 nt, Homo sapiens
gggaggcucuguaugaaac

SEQ ID NO: 1242661 - RNA, 19 nt, Homo sapiens
cuccuucccuuuguaaaua

SEQ ID NO: 1242662 - RNA, 19 nt, Homo sapiens
gcagggacauaaaggaaaa

SEQ ID NO: 1242663 - RNA, 19 nt, Homo sapiens
ccucuugccucauggaugu

SEQ ID NO: 1242664 - RNA, 19 nt, Homo sapiens
ggaaccaggcacagaguga

SEQ ID NO: 1242665 - RNA, 19 nt, Homo sapiens
ccuauuccauguugagguu

SEQ ID NO: 1242666 - RNA, 19 nt, Homo sapiens
ugccaagaaguuacaauua

SEQ ID NO: 1242667 - RNA, 19 nt, Homo sapiens
ggaaggaaggaaagaucaa

SEQ ID NO: 1242668 - RNA, 19 nt, Homo sapiens
uaacaaguuucucuaaccu

SEQ ID NO: 1242669 - RNA, 19 nt, Homo sapiens
ggagcuuccuauuccaugu

SEQ ID NO: 1242670 - RNA, 19 nt, Homo sapiens
gaucaagaacauggagaaa

SEQ ID NO: 1242671 - RNA, 19 nt, Homo sapiens
gggcuaguucuauacuuaa

SEQ ID NO: 1242672 - RNA, 19 nt, Homo sapiens
gcaagaccagugccagaug

SEQ ID NO: 1242673 - RNA, 19 nt, Homo sapiens
gcacagcuccaaccaacag

SEQ ID NO: 1242674 - RNA, 19 nt, Homo sapiens
ggcuaguucuauacuuaaa

SEQ ID NO: 1242675 - RNA, 19 nt, Homo sapiens
ucagucucuuccucaguua

SEQ ID NO: 1242676 - RNA, 19 nt, Homo sapiens
gaagggaaggaaggaaaga

SEQ ID NO: 1242677 - RNA, 19 nt, Homo sapiens
gauaccuccuucccuuugu

SEQ ID NO: 1242678 - RNA, 19 nt, Homo sapiens
gacgggcucuuaccucucu

SEQ ID NO: 1242679 - RNA, 19 nt, Homo sapiens
ccgcaagugucuggugaaa

SEQ ID NO: 1242680 - RNA, 19 nt, Homo sapiens
ugucuacgguuaagcaaca

SEQ ID NO: 1242681 - RNA, 19 nt, Homo sapiens
cuucauugaugcacccauu

SEQ ID NO: 1242682 - RNA, 19 nt, Homo sapiens
acauugggauucuauugga

SEQ ID NO: 1242683 - RNA, 19 nt, Homo sapiens
cgcgggacuuuguuuguuu

SEQ ID NO: 1242684 - RNA, 19 nt, Homo sapiens
uccaagaccuuccgcucaa

SEQ ID NO: 1242685 - RNA, 19 nt, Homo sapiens
gagggcuaguucuauacuu

SEQ ID NO: 1242686 - RNA, 19 nt, Homo sapiens
caugggaccuauggaaaca

SEQ ID NO: 1242687 - RNA, 19 nt, Homo sapiens
gggaaggaaggaaagauca

SEQ ID NO: 1242688 - RNA, 19 nt, Homo sapiens
caaccgcgacuucauugau

SEQ ID NO: 1242689 - RNA, 19 nt, Homo sapiens
uaacaagcccauugcuagu

SEQ ID NO: 1242690 - RNA, 19 nt, Homo sapiens
agagugaucgauacggaua

SEQ ID NO: 1242691 - RNA, 19 nt, Homo sapiens
ucucggagcuuccuauucc

SEQ ID NO: 1242692 - RNA, 19 nt, Homo sapiens
uagaagggaaggaaggaaa

SEQ ID NO: 1242693 - RNA, 19 nt, Homo sapiens
agugaucgauacggauaua

SEQ ID NO: 1242694 - RNA, 19 nt, Homo sapiens
ugggaccuauggaaacaaa

SEQ ID NO: 1242695 - RNA, 19 nt, Homo sapiens
uuacaugggaccuauggaa

SEQ ID NO: 1242696 - RNA, 19 nt, Homo sapiens
gaaggaaggaaagaucaag

SEQ ID NO: 1242697 - RNA, 19 nt, Homo sapiens
uuucaaggcucccauuagg

SEQ ID NO: 1242698 - RNA, 19 nt, Homo sapiens
uuaaaggugaugccaagaa

SEQ ID NO: 1242699 - RNA, 19 nt, Homo sapiens
gcgggacuuuguuuguuuc

SEQ ID NO: 1242700 - RNA, 19 nt, Homo sapiens
ggagggaguucggcuucuc

SEQ ID NO: 1242701 - RNA, 19 nt, Homo sapiens
ugggagaaaguuacauauu

SEQ ID NO: 1242702 - RNA, 19 nt, Homo sapiens
ggugaaauggcuggaaguu

SEQ ID NO: 1242703 - RNA, 19 nt, Homo sapiens
gacccacggugcuauccau

SEQ ID NO: 1242704 - RNA, 19 nt, Homo sapiens
uguaacaagcccauugcua

SEQ ID NO: 1242705 - RNA, 19 nt, Homo sapiens
gaaccaggcacagagugau

SEQ ID NO: 1242706 - RNA, 19 nt, Homo sapiens
aggcaucuuugucuucaug

SEQ ID NO: 1242707 - RNA, 19 nt, Homo sapiens
acaggcaucuuugucuuca

SEQ ID NO: 1242708 - RNA, 19 nt, Homo sapiens
auaccuccuucccuuugua

SEQ ID NO: 1242709 - RNA, 19 nt, Homo sapiens
gagcuuccuauuccauguu

SEQ ID NO: 1242710 - RNA, 19 nt, Homo sapiens
acaucuauauggucaucuu

SEQ ID NO: 1242711 - RNA, 19 nt, Homo sapiens
gaaaaugucaguguuuaca

SEQ ID NO: 1242712 - RNA, 19 nt, Homo sapiens
gaucgauacggauauaagg

SEQ ID NO: 1242713 - RNA, 19 nt, Homo sapiens
aggcacagagugaucgaua

SEQ ID NO: 1242714 - RNA, 19 nt, Homo sapiens
gccaaccgcgacuucauug

SEQ ID NO: 1242715 - RNA, 19 nt, Homo sapiens
ugagggugggagaaaguua

SEQ ID NO: 1242716 - RNA, 19 nt, Homo sapiens
cagauaccuccuucccuuu

SEQ ID NO: 1242717 - RNA, 19 nt, Homo sapiens
aggaaaaugucaguguuua

SEQ ID NO: 1242718 - RNA, 19 nt, Homo sapiens
aaaggaaaaugucaguguu

SEQ ID NO: 1242719 - RNA, 19 nt, Homo sapiens
agaagagcagggacauaaa

SEQ ID NO: 1242720 - RNA, 19 nt, Homo sapiens
gagccuccggcaaagguuu

SEQ ID NO: 1242721 - RNA, 19 nt, Homo sapiens
aaggugaugccaagaaguu

SEQ ID NO: 1242722 - RNA, 19 nt, Homo sapiens
uucagucucuuccucaguu

SEQ ID NO: 1242723 - RNA, 19 nt, Homo sapiens
ggaccuauggaaacaaagg

SEQ ID NO: 1242724 - RNA, 19 nt, Homo sapiens
ucuauauggucaucuuugg

SEQ ID NO: 1242725 - RNA, 19 nt, Homo sapiens
aaccgcgacuucauugaug

SEQ ID NO: 1242726 - RNA, 19 nt, Homo sapiens
gaugagaaggguggucuag

SEQ ID NO: 1242727 - RNA, 19 nt, Homo sapiens
uacaugggaccuauggaaa

SEQ ID NO: 1242728 - RNA, 19 nt, Homo sapiens
cgaucaagaacauggagaa

SEQ ID NO: 1242729 - RNA, 19 nt, Homo sapiens
caaggggaaggaugaguua

SEQ ID NO: 1242730 - RNA, 19 nt, Homo sapiens
ggagguggugcuuaaaggu

SEQ ID NO: 1242731 - RNA, 19 nt, Homo sapiens
aaagagagcuggcuaauaa

SEQ ID NO: 1242732 - RNA, 19 nt, Homo sapiens
ggagaaauauggaaugaaa

SEQ ID NO: 1242733 - RNA, 19 nt, Homo sapiens
ccagaugcguuacaguuua

SEQ ID NO: 1242734 - RNA, 19 nt, Homo sapiens
ggaaauccagucugauaua

SEQ ID NO: 1242735 - RNA, 19 nt, Homo sapiens
gaaauccagucugauauau

SEQ ID NO: 1242736 - RNA, 19 nt, Homo sapiens
gaaagaugguugcuucucu

SEQ ID NO: 1242737 - RNA, 19 nt, Homo sapiens
gaaguuacagaguggcuua

SEQ ID NO: 1242738 - RNA, 19 nt, Homo sapiens
gcaaaugauaggaaucuuu

SEQ ID NO: 1242739 - RNA, 19 nt, Homo sapiens
caacaaguuugcccagaug

SEQ ID NO: 1242740 - RNA, 19 nt, Homo sapiens
cagaguggcuuaggcuaua

SEQ ID NO: 1242741 - RNA, 19 nt, Homo sapiens
gaacugaaggaguagauau

SEQ ID NO: 1242742 - RNA, 19 nt, Homo sapiens
guagauaucguucuucaug

SEQ ID NO: 1242743 - RNA, 19 nt, Homo sapiens
aucaguggcuccuuuauua

SEQ ID NO: 1242744 - RNA, 19 nt, Homo sapiens
gaguagauaucguucuuca

SEQ ID NO: 1242745 - RNA, 19 nt, Homo sapiens
gggaaaugcucgaguccuu

SEQ ID NO: 1242746 - RNA, 19 nt, Homo sapiens
auacggauauugcucuuaa

SEQ ID NO: 1242747 - RNA, 19 nt, Homo sapiens
caaagagagcuggcuaaua

SEQ ID NO: 1242748 - RNA, 19 nt, Homo sapiens
gaacaauucagcaaaugau

SEQ ID NO: 1242749 - RNA, 19 nt, Homo sapiens
uuucggaacugaaggagua

SEQ ID NO: 1242750 - RNA, 19 nt, Homo sapiens
cagaugcguuacaguuuaa

SEQ ID NO: 1242751 - RNA, 19 nt, Homo sapiens
aaauuuaccuggccuaucu

SEQ ID NO: 1242752 - RNA, 19 nt, Homo sapiens
ggaacaauucagcaaauga

SEQ ID NO: 1242753 - RNA, 19 nt, Homo sapiens
agaugagacuguaaacaaa

SEQ ID NO: 1242754 - RNA, 19 nt, Homo sapiens
aagcacuccugcccgauua

SEQ ID NO: 1242755 - RNA, 19 nt, Homo sapiens
uaagaccagucacuacaga

SEQ ID NO: 1242756 - RNA, 19 nt, Homo sapiens
ggaagaagccauuguuuug

SEQ ID NO: 1242757 - RNA, 19 nt, Homo sapiens
uauccuaucuggccuuugu

SEQ ID NO: 1242758 - RNA, 19 nt, Homo sapiens
gccaagacaugcaaaauga

SEQ ID NO: 1242759 - RNA, 19 nt, Homo sapiens
gguaacaguuuucauggua

SEQ ID NO: 1242760 - RNA, 19 nt, Homo sapiens
aaagaguauuccuacguaa

SEQ ID NO: 1242761 - RNA, 19 nt, Homo sapiens
uggcuuaggcuauaaugua

SEQ ID NO: 1242762 - RNA, 19 nt, Homo sapiens
gggaacaauucagcaaaug

SEQ ID NO: 1242763 - RNA, 19 nt, Homo sapiens
ggugaaagcaguuaaaauu

SEQ ID NO: 1242764 - RNA, 19 nt, Homo sapiens
ugucaucaguggcuccuuu

SEQ ID NO: 1242765 - RNA, 19 nt, Homo sapiens
cuauagaagccuccagaua

SEQ ID NO: 1242766 - RNA, 19 nt, Homo sapiens
agagcuggcuaauaaauca

SEQ ID NO: 1242767 - RNA, 19 nt, Homo sapiens
gcaaagagagcuggcuaau

SEQ ID NO: 1242768 - RNA, 19 nt, Homo sapiens
gagccauggucuaccuuga

SEQ ID NO: 1242769 - RNA, 19 nt, Homo sapiens
gaccagucacuacagauaa

SEQ ID NO: 1242770 - RNA, 19 nt, Homo sapiens
gcaugcaauugccacuuug

SEQ ID NO: 1242771 - RNA, 19 nt, Homo sapiens
uauagaagccuccagauac

SEQ ID NO: 1242772 - RNA, 19 nt, Homo sapiens
ugucacccuuuguaucaua

SEQ ID NO: 1242773 - RNA, 19 nt, Homo sapiens
uaauaagcaagccuaauga

SEQ ID NO: 1242774 - RNA, 19 nt, Homo sapiens
aagaugagacuguaaacaa

SEQ ID NO: 1242775 - RNA, 19 nt, Homo sapiens
aaaagaguauuccuacgua

SEQ ID NO: 1242776 - RNA, 19 nt, Homo sapiens
gaaagcaguuaaaauugug

SEQ ID NO: 1242777 - RNA, 19 nt, Homo sapiens
gcccucugguggaguagua

SEQ ID NO: 1242778 - RNA, 19 nt, Homo sapiens
uaccauaaacgaccacaaa

SEQ ID NO: 1242779 - RNA, 19 nt, Homo sapiens
gaagaugagacuguaaaca

SEQ ID NO: 1242780 - RNA, 19 nt, Homo sapiens
gcuaaaacguuaaagaaag

SEQ ID NO: 1242781 - RNA, 19 nt, Homo sapiens
ggaacugaaggaguagaua

SEQ ID NO: 1242782 - RNA, 19 nt, Homo sapiens
caucaguggcuccuuuauu

SEQ ID NO: 1242783 - RNA, 19 nt, Homo sapiens
uaucuggccuuugugagaa

SEQ ID NO: 1242784 - RNA, 19 nt, Homo sapiens
aaaggaagaagccauuguu

SEQ ID NO: 1242785 - RNA, 19 nt, Homo sapiens
auaauaagcaagccuaaug

SEQ ID NO: 1242786 - RNA, 19 nt, Homo sapiens
gcccagaugcguuacaguu

SEQ ID NO: 1242787 - RNA, 19 nt, Homo sapiens
ggugcccucugguggagua

SEQ ID NO: 1242788 - RNA, 19 nt, Homo sapiens
aguggcuccuuuauuaaua

SEQ ID NO: 1242789 - RNA, 19 nt, Homo sapiens
ugcaauauuucaccaaaca

SEQ ID NO: 1242790 - RNA, 19 nt, Homo sapiens
gauaucguucuucauguga

SEQ ID NO: 1242791 - RNA, 19 nt, Homo sapiens
ugaaggaguagauaucguu

SEQ ID NO: 1242792 - RNA, 19 nt, Homo sapiens
ugcaugcaauugccacuuu

SEQ ID NO: 1242793 - RNA, 19 nt, Homo sapiens
agaccagucacuacagaua

SEQ ID NO: 1242794 - RNA, 19 nt, Homo sapiens
uaagcaagccuaaugaaaa

SEQ ID NO: 1242795 - RNA, 19 nt, Homo sapiens
gcugcuagucuuuuaauua

SEQ ID NO: 1242796 - RNA, 19 nt, Homo sapiens
gacagcugcuagucuuuua

SEQ ID NO: 1242797 - RNA, 19 nt, Homo sapiens
uggucuaccuugaagauga

SEQ ID NO: 1242798 - RNA, 19 nt, Homo sapiens
gagggugaaagcaguuaaa

SEQ ID NO: 1242799 - RNA, 19 nt, Homo sapiens
guccuugcauuucuagaau

SEQ ID NO: 1242800 - RNA, 19 nt, Homo sapiens
gaagccuccagauaccaua

SEQ ID NO: 1242801 - RNA, 19 nt, Homo sapiens
uuuggaagcuauuacaaca

SEQ ID NO: 1242802 - RNA, 19 nt, Homo sapiens
gcaauugccacuuugucau

SEQ ID NO: 1242803 - RNA, 19 nt, Homo sapiens
uagauaucguucuucaugu

SEQ ID NO: 1242804 - RNA, 19 nt, Homo sapiens
ccagucugauauauuacuu

SEQ ID NO: 1242805 - RNA, 19 nt, Homo sapiens
ucagucaugguaacaguuu

SEQ ID NO: 1242806 - RNA, 19 nt, Homo sapiens
aaauuaagaccagucacua

SEQ ID NO: 1242807 - RNA, 19 nt, Homo sapiens
ucaguggcuccuuuauuaa

SEQ ID NO: 1242808 - RNA, 19 nt, Homo sapiens
ggaguaaaacgugauaaaa

SEQ ID NO: 1242809 - RNA, 19 nt, Homo sapiens
guacauuggacagcauuug

SEQ ID NO: 1242810 - RNA, 19 nt, Homo sapiens
agauaucguucuucaugug

SEQ ID NO: 1242811 - RNA, 19 nt, Homo sapiens
aggaguagauaucguucuu

SEQ ID NO: 1242812 - RNA, 19 nt, Homo sapiens
ccuugaagaugagacugua

SEQ ID NO: 1242813 - RNA, 19 nt, Homo sapiens
gcagagggugaaagcaguu

SEQ ID NO: 1242814 - RNA, 19 nt, Homo sapiens
gagagcuggcuaauaaauc

SEQ ID NO: 1242815 - RNA, 19 nt, Homo sapiens
uagaauggugugagaguga

SEQ ID NO: 1242816 - RNA, 19 nt, Homo sapiens
gaugagacuguaaacaaag

SEQ ID NO: 1242817 - RNA, 19 nt, Homo sapiens
gccauggucuaccuugaag

SEQ ID NO: 1242818 - RNA, 19 nt, Homo sapiens
gauacggauauugcucuua

SEQ ID NO: 1242819 - RNA, 19 nt, Homo sapiens
caccaaacacauauuaaag

SEQ ID NO: 1242820 - RNA, 19 nt, Homo sapiens
cugcaaagugauauaauug

SEQ ID NO: 1242821 - RNA, 19 nt, Homo sapiens
gcuccuuuauuaauagaag

SEQ ID NO: 1242822 - RNA, 19 nt, Homo sapiens
uagaacaucaaacgcuaaa

SEQ ID NO: 1242823 - RNA, 19 nt, Homo sapiens
uuggagaaauauggaauga

SEQ ID NO: 1242824 - RNA, 19 nt, Homo sapiens
ggcuauaauguacuucuuu

SEQ ID NO: 1242825 - RNA, 19 nt, Homo sapiens
auaagcaagccuaaugaaa

SEQ ID NO: 1242826 - RNA, 19 nt, Homo sapiens
ucgaguccuugcauuucua

SEQ ID NO: 1242827 - RNA, 19 nt, Homo sapiens
accagucacuacagauaaa

SEQ ID NO: 1242828 - RNA, 19 nt, Homo sapiens
gaucagacagcugcuaguc

SEQ ID NO: 1242829 - RNA, 19 nt, Homo sapiens
ggcaagggaagaaggauca

SEQ ID NO: 1242830 - RNA, 19 nt, Homo sapiens
ggcuuaggcuauaauguac

SEQ ID NO: 1242831 - RNA, 19 nt, Homo sapiens
gcaccuggcugcucuguuu

SEQ ID NO: 1242832 - RNA, 19 nt, Homo sapiens
ggacgugcuucucuuguaa

SEQ ID NO: 1242833 - RNA, 19 nt, Homo sapiens
ggacuuagccugcucaugu

SEQ ID NO: 1242834 - RNA, 19 nt, Homo sapiens
gauagaagaggaccaagaa

SEQ ID NO: 1242835 - RNA, 19 nt, Homo sapiens
gagacaggguuucaucaug

SEQ ID NO: 1242836 - RNA, 19 nt, Homo sapiens
gcccaaacccuggauguua

SEQ ID NO: 1242837 - RNA, 19 nt, Homo sapiens
cagugaaagucucugcuua

SEQ ID NO: 1242838 - RNA, 19 nt, Homo sapiens
ccgaguaggugggauuaua

SEQ ID NO: 1242839 - RNA, 19 nt, Homo sapiens
gggacgugcuucucuugua

SEQ ID NO: 1242840 - RNA, 19 nt, Homo sapiens
gaccauaucucccuuucca

SEQ ID NO: 1242841 - RNA, 19 nt, Homo sapiens
cccaaacccuggauguuaa

SEQ ID NO: 1242842 - RNA, 19 nt, Homo sapiens
gcaaccgcgucuucacuga

SEQ ID NO: 1242843 - RNA, 19 nt, Homo sapiens
ucacugagggcaccuguaa

SEQ ID NO: 1242844 - RNA, 19 nt, Homo sapiens
ggcaagggcugggccauau

SEQ ID NO: 1242845 - RNA, 19 nt, Homo sapiens
agacaggguuucaucaugu

SEQ ID NO: 1242846 - RNA, 19 nt, Homo sapiens
ccuguaagcugcugaccuu

SEQ ID NO: 1242847 - RNA, 19 nt, Homo sapiens
ccaaagugcugggaauaca

SEQ ID NO: 1242848 - RNA, 19 nt, Homo sapiens
ccacacggccucuaaagau

SEQ ID NO: 1242849 - RNA, 19 nt, Homo sapiens
gacaggguuucaccacauu

SEQ ID NO: 1242850 - RNA, 19 nt, Homo sapiens
ggagacgccugcacauggu

SEQ ID NO: 1242851 - RNA, 19 nt, Homo sapiens
ggauagaagaggaccaaga

SEQ ID NO: 1242852 - RNA, 19 nt, Homo sapiens
gacaggguuucaucauguu

SEQ ID NO: 1242853 - RNA, 19 nt, Homo sapiens
cagggaaagcugacuguaa

SEQ ID NO: 1242854 - RNA, 19 nt, Homo sapiens
gacuuagccugcucauguu

SEQ ID NO: 1242855 - RNA, 19 nt, Homo sapiens
ccacccagguucaagcaau

SEQ ID NO: 1242856 - RNA, 19 nt, Homo sapiens
agggaaagcugacuguaag

SEQ ID NO: 1242857 - RNA, 19 nt, Homo sapiens
gaacuccugaccucaagug

SEQ ID NO: 1242858 - RNA, 19 nt, Homo sapiens
guaagcugcugaccuuggu

SEQ ID NO: 1242859 - RNA, 19 nt, Homo sapiens
gcucugggcugggcuuucu

SEQ ID NO: 1242860 - RNA, 19 nt, Homo sapiens
ucaggaaccacuuuuaaua

SEQ ID NO: 1242861 - RNA, 19 nt, Homo sapiens
guagagacaggguuucauc

SEQ ID NO: 1242862 - RNA, 19 nt, Homo sapiens
aaucugggcucacugaaac

SEQ ID NO: 1242863 - RNA, 19 nt, Homo sapiens
caacuucuucccucucuuc

SEQ ID NO: 1242864 - RNA, 19 nt, Homo sapiens
uggccaggcuagucucaaa

SEQ ID NO: 1242865 - RNA, 19 nt, Homo sapiens
cacacggccucuaaagaug

SEQ ID NO: 1242866 - RNA, 19 nt, Homo sapiens
ucagggacgugcuucucuu

SEQ ID NO: 1242867 - RNA, 19 nt, Homo sapiens
agacaggguuucaccacau

SEQ ID NO: 1242868 - RNA, 19 nt, Homo sapiens
acgaggaccuggugcugaa

SEQ ID NO: 1242869 - RNA, 19 nt, Homo sapiens
ugauuaaagucagccauuc

SEQ ID NO: 1242870 - RNA, 19 nt, Homo sapiens
ccuuauagacugauuaaag

SEQ ID NO: 1242871 - RNA, 19 nt, Homo sapiens
caaucugggcucacugaaa

SEQ ID NO: 1242872 - RNA, 19 nt, Homo sapiens
gaggauagaagaggaccaa

SEQ ID NO: 1242873 - RNA, 19 nt, Homo sapiens
cacccagguucaagcaauu

SEQ ID NO: 1242874 - RNA, 19 nt, Homo sapiens
uuccagcagucccucauaa

SEQ ID NO: 1242875 - RNA, 19 nt, Homo sapiens
caucuguuguccgaccaua

SEQ ID NO: 1242876 - RNA, 19 nt, Homo sapiens
ccucggcacuccucuuugg

SEQ ID NO: 1242877 - RNA, 19 nt, Homo sapiens
ucaacaaccucuacuuccu

SEQ ID NO: 1242878 - RNA, 19 nt, Homo sapiens
uacugcaacugcucccuuu

SEQ ID NO: 1242879 - RNA, 19 nt, Homo sapiens
cuccugaccucaagugauc

SEQ ID NO: 1242880 - RNA, 19 nt, Homo sapiens
ggucuuccacugccacuuc

SEQ ID NO: 1242881 - RNA, 19 nt, Homo sapiens
ccacuucaacagcaacuuc

SEQ ID NO: 1242882 - RNA, 19 nt, Homo sapiens
gcugcucuguuucuacaca

SEQ ID NO: 1242883 - RNA, 19 nt, Homo sapiens
uggcugcucuguuucuaca

SEQ ID NO: 1242884 - RNA, 19 nt, Homo sapiens
caagggcugggccauaugu

SEQ ID NO: 1242885 - RNA, 19 nt, Homo sapiens
gcaacuucuucccucucuu

SEQ ID NO: 1242886 - RNA, 19 nt, Homo sapiens
gauuaaagucagccauucu

SEQ ID NO: 1242887 - RNA, 19 nt, Homo sapiens
gcaagggcugggccauaug

SEQ ID NO: 1242888 - RNA, 19 nt, Homo sapiens
aacccuggauguuaagaug

SEQ ID NO: 1242889 - RNA, 19 nt, Homo sapiens
uauaggagcgugccaucau

SEQ ID NO: 1242890 - RNA, 19 nt, Homo sapiens
cgaguaggugggauuauag

SEQ ID NO: 1242891 - RNA, 19 nt, Homo sapiens
ugccucagccucccgagua

SEQ ID NO: 1242892 - RNA, 19 nt, Homo sapiens
uguugggccucuccuaugu

SEQ ID NO: 1242893 - RNA, 19 nt, Homo sapiens
caagccaggccagaccuuu

SEQ ID NO: 1242894 - RNA, 19 nt, Homo sapiens
ucucaacaaccucuacuuc

SEQ ID NO: 1242895 - RNA, 19 nt, Homo sapiens
gcaaucugggcucacugaa

SEQ ID NO: 1242896 - RNA, 19 nt, Homo sapiens
auguuaagauggugugaga

SEQ ID NO: 1242897 - RNA, 19 nt, Homo sapiens
ggaaccacuuuuaauacug

SEQ ID NO: 1242898 - RNA, 19 nt, Homo sapiens
cacuguggccaaccuaauu

SEQ ID NO: 1242899 - RNA, 19 nt, Homo sapiens
auaggagcgugccaucaug

SEQ ID NO: 1242900 - RNA, 19 nt, Homo sapiens
uaaggcaggaggauagaag

SEQ ID NO: 1242901 - RNA, 19 nt, Homo sapiens
cugcugugccucuucauug

SEQ ID NO: 1242902 - RNA, 19 nt, Homo sapiens
uuagccugcucauguuguu

SEQ ID NO: 1242903 - RNA, 19 nt, Homo sapiens
gcaaucaaauguccuauua

SEQ ID NO: 1242904 - RNA, 19 nt, Homo sapiens
ggacagcgaugaugaaauu

SEQ ID NO: 1242905 - RNA, 19 nt, Homo sapiens
gaaggcauuugucuuguua

SEQ ID NO: 1242906 - RNA, 19 nt, Homo sapiens
ggaaaggacuagacauuga

SEQ ID NO: 1242907 - RNA, 19 nt, Homo sapiens
gcauuugucuuguuacuaa

SEQ ID NO: 1242908 - RNA, 19 nt, Homo sapiens
gaacuggauugaacuacua

SEQ ID NO: 1242909 - RNA, 19 nt, Homo sapiens
gcaggaaggugccaaaguu

SEQ ID NO: 1242910 - RNA, 19 nt, Homo sapiens
ccaaagaccuccuucaguu

SEQ ID NO: 1242911 - RNA, 19 nt, Homo sapiens
gaaaugaagggaacuguaa

SEQ ID NO: 1242912 - RNA, 19 nt, Homo sapiens
gaauucugcuugucauuaa

SEQ ID NO: 1242913 - RNA, 19 nt, Homo sapiens
gaagggaacuguaauuacu

SEQ ID NO: 1242914 - RNA, 19 nt, Homo sapiens
gaacgaaugcgaagacuga

SEQ ID NO: 1242915 - RNA, 19 nt, Homo sapiens
ggauugaacuacuauaugu

SEQ ID NO: 1242916 - RNA, 19 nt, Homo sapiens
uuaaugagcugaaagauag

SEQ ID NO: 1242917 - RNA, 19 nt, Homo sapiens
gaaaacagcuucguaguga

SEQ ID NO: 1242918 - RNA, 19 nt, Homo sapiens
ggaauuaucagaaaugaga

SEQ ID NO: 1242919 - RNA, 19 nt, Homo sapiens
guaaugaacuggauugaac

SEQ ID NO: 1242920 - RNA, 19 nt, Homo sapiens
gaacaaacggaaaggacua

SEQ ID NO: 1242921 - RNA, 19 nt, Homo sapiens
gaagagaggcgucuacaag

SEQ ID NO: 1242922 - RNA, 19 nt, Homo sapiens
caagagcgauugcuacaca

SEQ ID NO: 1242923 - RNA, 19 nt, Homo sapiens
gaagaaacaaagcacauga

SEQ ID NO: 1242924 - RNA, 19 nt, Homo sapiens
gaacuacuauaugugcauu

SEQ ID NO: 1242925 - RNA, 19 nt, Homo sapiens
ggccaugauuauugauuua

SEQ ID NO: 1242926 - RNA, 19 nt, Homo sapiens
agacauauccugccauuga

SEQ ID NO: 1242927 - RNA, 19 nt, Homo sapiens
gagcuuagagugagaaaug

SEQ ID NO: 1242928 - RNA, 19 nt, Homo sapiens
agaagaggcugaacagaau

SEQ ID NO: 1242929 - RNA, 19 nt, Homo sapiens
aagauaaggugaauaagug

SEQ ID NO: 1242930 - RNA, 19 nt, Homo sapiens
ugaaaggaaugguaaaucu

SEQ ID NO: 1242931 - RNA, 19 nt, Homo sapiens
cagauggucucucucuaaa

SEQ ID NO: 1242932 - RNA, 19 nt, Homo sapiens
aaacaaagcacaugagaca

SEQ ID NO: 1242933 - RNA, 19 nt, Homo sapiens
agauagagauucagaaaca

SEQ ID NO: 1242934 - RNA, 19 nt, Homo sapiens
gcaagcuccugucagaaga

SEQ ID NO: 1242935 - RNA, 19 nt, Homo sapiens
gagaugacacuagugauuu

SEQ ID NO: 1242936 - RNA, 19 nt, Homo sapiens
caucccaagugcuaaagua

SEQ ID NO: 1242937 - RNA, 19 nt, Homo sapiens
gaucaucacaccuuagaga

SEQ ID NO: 1242938 - RNA, 19 nt, Homo sapiens
agccauacguuaaauguuu

SEQ ID NO: 1242939 - RNA, 19 nt, Homo sapiens
caaacucuguagcaacuga

SEQ ID NO: 1242940 - RNA, 19 nt, Homo sapiens
uaauacagaugaugagagu

SEQ ID NO: 1242941 - RNA, 19 nt, Homo sapiens
caaagaaugcccagagaug

SEQ ID NO: 1242942 - RNA, 19 nt, Homo sapiens
cagaagaggcugaacagaa

SEQ ID NO: 1242943 - RNA, 19 nt, Homo sapiens
caucacaccuuagagauuc

SEQ ID NO: 1242944 - RNA, 19 nt, Homo sapiens
gacauauccugccauugaa

SEQ ID NO: 1242945 - RNA, 19 nt, Homo sapiens
gaagaggcugaacagaaua

SEQ ID NO: 1242946 - RNA, 19 nt, Homo sapiens
caagagaucaucacaccuu

SEQ ID NO: 1242947 - RNA, 19 nt, Homo sapiens
ugauguaacuacuucuuga

SEQ ID NO: 1242948 - RNA, 19 nt, Homo sapiens
ggaacuguaauuacuugua

SEQ ID NO: 1242949 - RNA, 19 nt, Homo sapiens
ugagacauauccugccauu

SEQ ID NO: 1242950 - RNA, 19 nt, Homo sapiens
cgaguugaucugaaauuua

SEQ ID NO: 1242951 - RNA, 19 nt, Homo sapiens
guugcaagcuccugucaga

SEQ ID NO: 1242952 - RNA, 19 nt, Homo sapiens
ccagauggucucucucuaa

SEQ ID NO: 1242953 - RNA, 19 nt, Homo sapiens
gcgaagacugaaugaauuu

SEQ ID NO: 1242954 - RNA, 19 nt, Homo sapiens
gggcuuacggugagacaua

SEQ ID NO: 1242955 - RNA, 19 nt, Homo sapiens
gcccagagaugacacuagu

SEQ ID NO: 1242956 - RNA, 19 nt, Homo sapiens
ugaauucugcuugucauua

SEQ ID NO: 1242957 - RNA, 19 nt, Homo sapiens
uaagagagcagcagaagag

SEQ ID NO: 1242958 - RNA, 19 nt, Homo sapiens
aaacacgaguugaucugaa

SEQ ID NO: 1242959 - RNA, 19 nt, Homo sapiens
gaaagauagagauucagaa

SEQ ID NO: 1242960 - RNA, 19 nt, Homo sapiens
uagcagucguccuaaugua

SEQ ID NO: 1242961 - RNA, 19 nt, Homo sapiens
gauagcagucguccuaaug

SEQ ID NO: 1242962 - RNA, 19 nt, Homo sapiens
ugacacuagugauuucuug

SEQ ID NO: 1242963 - RNA, 19 nt, Homo sapiens
gaaacacgaguugaucuga

SEQ ID NO: 1242964 - RNA, 19 nt, Homo sapiens
ggaucaaacucuguagcaa

SEQ ID NO: 1242965 - RNA, 19 nt, Homo sapiens
gaaaggacuagacauugau

SEQ ID NO: 1242966 - RNA, 19 nt, Homo sapiens
gagaucaucacaccuuaga

SEQ ID NO: 1242967 - RNA, 19 nt, Homo sapiens
ccagagaugacacuaguga

SEQ ID NO: 1242968 - RNA, 19 nt, Homo sapiens
gagcugaaagauagagauu

SEQ ID NO: 1242969 - RNA, 19 nt, Homo sapiens
guugacagcaucauacauu

SEQ ID NO: 1242970 - RNA, 19 nt, Homo sapiens
ugaaggcauuugucuuguu

SEQ ID NO: 1242971 - RNA, 19 nt, Homo sapiens
gaaaggaaugguaaaucug

SEQ ID NO: 1242972 - RNA, 19 nt, Homo sapiens
agacagccuucuccuauag

SEQ ID NO: 1242973 - RNA, 19 nt, Homo sapiens
aagagaucaucacaccuua

SEQ ID NO: 1242974 - RNA, 19 nt, Homo sapiens
ugcgaagacugaaugaauu

SEQ ID NO: 1242975 - RNA, 19 nt, Homo sapiens
gcuuagacgcugccacuuu

SEQ ID NO: 1242976 - RNA, 19 nt, Homo sapiens
caucaucuuucuguuucua

SEQ ID NO: 1242977 - RNA, 19 nt, Homo sapiens
ggaagaaacaaagcacaug

SEQ ID NO: 1242978 - RNA, 19 nt, Homo sapiens
gcaaagaaugcccagagau

SEQ ID NO: 1242979 - RNA, 19 nt, Homo sapiens
caaagaccuccuucaguug

SEQ ID NO: 1242980 - RNA, 19 nt, Homo sapiens
uacaucaucuuucuguuuc

SEQ ID NO: 1242981 - RNA, 19 nt, Homo sapiens
ugucuuaaacguccuguaa

SEQ ID NO: 1242982 - RNA, 19 nt, Homo sapiens
gagaaaugaggaacgaaug

SEQ ID NO: 1242983 - RNA, 19 nt, Homo sapiens
gauggucucucucuaaaau

SEQ ID NO: 1242984 - RNA, 19 nt, Homo sapiens
uaaaaggccaugauuauug

SEQ ID NO: 1242985 - RNA, 19 nt, Homo sapiens
gccauacguuaaauguuug

SEQ ID NO: 1242986 - RNA, 19 nt, Homo sapiens
gcacaguuuugucauaaau

SEQ ID NO: 1242987 - RNA, 19 nt, Homo sapiens
ugacggaucaaacucugua

SEQ ID NO: 1242988 - RNA, 19 nt, Homo sapiens
ccuuuaauauguccuacuu

SEQ ID NO: 1242989 - RNA, 19 nt, Homo sapiens
uaaggugaaaggaauggua

SEQ ID NO: 1242990 - RNA, 19 nt, Homo sapiens
agagaugacacuagugauu

SEQ ID NO: 1242991 - RNA, 19 nt, Homo sapiens
uaaaguacgagagcaaaga

SEQ ID NO: 1242992 - RNA, 19 nt, Homo sapiens
gcugugauuauuccaguuu

SEQ ID NO: 1242993 - RNA, 19 nt, Homo sapiens
aaaaggccaugauuauuga

SEQ ID NO: 1242994 - RNA, 19 nt, Homo sapiens
gcacaugguuaaaauaaac

SEQ ID NO: 1242995 - RNA, 19 nt, Homo sapiens
ugacaucaugaaacacaua

SEQ ID NO: 1242996 - RNA, 19 nt, Homo sapiens
cgaaugcgaagacugaaug

SEQ ID NO: 1242997 - RNA, 19 nt, Homo sapiens
aaagaaugcccagagauga

SEQ ID NO: 1242998 - RNA, 19 nt, Homo sapiens
aaagaccuccuucaguuga

SEQ ID NO: 1242999 - RNA, 19 nt, Homo sapiens
gaugcaaucaaauguccua

SEQ ID NO: 1243000 - RNA, 19 nt, Homo sapiens
acgaguugaucugaaauuu

SEQ ID NO: 1243001 - RNA, 19 nt, Homo sapiens
aacacgaguugaucugaaa

SEQ ID NO: 1243002 - RNA, 19 nt, Homo sapiens
guaaauguugaugagcuua

SEQ ID NO: 1243003 - RNA, 19 nt, Homo sapiens
gaacugagaugucuguaug

SEQ ID NO: 1243004 - RNA, 19 nt, Homo sapiens
ccaggacccuugaguguaa

SEQ ID NO: 1243005 - RNA, 19 nt, Homo sapiens
ggagaaagccgcagaucug

SEQ ID NO: 1243006 - RNA, 19 nt, Homo sapiens
gcaggacacagccucguua

SEQ ID NO: 1243007 - RNA, 19 nt, Homo sapiens
ggccagagguggaagaaca

SEQ ID NO: 1243008 - RNA, 19 nt, Homo sapiens
gcaagugggagacgugauu

SEQ ID NO: 1243009 - RNA, 19 nt, Homo sapiens
ccaaagcugggcauugaua

SEQ ID NO: 1243010 - RNA, 19 nt, Homo sapiens
gcaggaugcucucucuaag

SEQ ID NO: 1243011 - RNA, 19 nt, Homo sapiens
ggucaccguugcauuuguu

SEQ ID NO: 1243012 - RNA, 19 nt, Homo sapiens
ggacacagccucguuaacu

SEQ ID NO: 1243013 - RNA, 19 nt, Homo sapiens
gaagccaucuggaccuuuu

SEQ ID NO: 1243014 - RNA, 19 nt, Homo sapiens
cagaggacccuucacuuga

SEQ ID NO: 1243015 - RNA, 19 nt, Homo sapiens
ggcaggaugcucucucuaa

SEQ ID NO: 1243016 - RNA, 19 nt, Homo sapiens
acacaagcgugccuucugu

SEQ ID NO: 1243017 - RNA, 19 nt, Homo sapiens
ggaagugaaugggcuuugg

SEQ ID NO: 1243018 - RNA, 19 nt, Homo sapiens
gcgccagggucuucaggaa

SEQ ID NO: 1243019 - RNA, 19 nt, Homo sapiens
gugaacggguauccuguug

SEQ ID NO: 1243020 - RNA, 19 nt, Homo sapiens
ggucaacccagaacugaga

SEQ ID NO: 1243021 - RNA, 19 nt, Homo sapiens
ggguguugcugacaguauu

SEQ ID NO: 1243022 - RNA, 19 nt, Homo sapiens
caaagcugggcauugauaa

SEQ ID NO: 1243023 - RNA, 19 nt, Homo sapiens
cagcucagccucacugguu

SEQ ID NO: 1243024 - RNA, 19 nt, Homo sapiens
gcaaagaggagggcaagag

SEQ ID NO: 1243025 - RNA, 19 nt, Homo sapiens
ccucuuggcucccgacagu

SEQ ID NO: 1243026 - RNA, 19 nt, Homo sapiens
acagaggacccuucacuug

SEQ ID NO: 1243027 - RNA, 19 nt, Homo sapiens
caccguugcauuuguuaua

SEQ ID NO: 1243028 - RNA, 19 nt, Homo sapiens
gagacgugauucuggaagu

SEQ ID NO: 1243029 - RNA, 19 nt, Homo sapiens
aagaggagggcaagaguuu

SEQ ID NO: 1243030 - RNA, 19 nt, Homo sapiens
gcaaucaggguccuuucug

SEQ ID NO: 1243031 - RNA, 19 nt, Homo sapiens
gacacagccucguuaacuc

SEQ ID NO: 1243032 - RNA, 19 nt, Homo sapiens
ugaaagaugagggugguuu

SEQ ID NO: 1243033 - RNA, 19 nt, Homo sapiens
ccucgcuucuguuuacuga

SEQ ID NO: 1243034 - RNA, 19 nt, Homo sapiens
uaugacagccacuccuaaa

SEQ ID NO: 1243035 - RNA, 19 nt, Homo sapiens
caaagaggagggcaagagu

SEQ ID NO: 1243036 - RNA, 19 nt, Homo sapiens
gccacauagugaaagauga

SEQ ID NO: 1243037 - RNA, 19 nt, Homo sapiens
guaugacagccacuccuaa

SEQ ID NO: 1243038 - RNA, 19 nt, Homo sapiens
cggccucgcuucuguuuac

SEQ ID NO: 1243039 - RNA, 19 nt, Homo sapiens
gcucuggccucggaucuac

SEQ ID NO: 1243040 - RNA, 19 nt, Homo sapiens
gacagaggacccuucacuu

SEQ ID NO: 1243041 - RNA, 19 nt, Homo sapiens
aaaucugacugccuguguu

SEQ ID NO: 1243042 - RNA, 19 nt, Homo sapiens
cagugggccucgucucuuc

SEQ ID NO: 1243043 - RNA, 19 nt, Homo sapiens
gggcuaccgugucuucacu

SEQ ID NO: 1243044 - RNA, 19 nt, Homo sapiens
gaaagaugagggugguuuu

SEQ ID NO: 1243045 - RNA, 19 nt, Homo sapiens
cguugcauuuguuauagaa

SEQ ID NO: 1243046 - RNA, 19 nt, Homo sapiens
uccagaggaugucauaugg

SEQ ID NO: 1243047 - RNA, 19 nt, Homo sapiens
gaccagagggacucagaca

SEQ ID NO: 1243048 - RNA, 19 nt, Homo sapiens
agaagaugcccaccucugu

SEQ ID NO: 1243049 - RNA, 19 nt, Homo sapiens
uaaaucugacugccugugu

SEQ ID NO: 1243050 - RNA, 19 nt, Homo sapiens
gaaugggcuuuggcagagu

SEQ ID NO: 1243051 - RNA, 19 nt, Homo sapiens
uaucaaucacugaaucuca

SEQ ID NO: 1243052 - RNA, 19 nt, Homo sapiens
cuuggucaccguugcauuu

SEQ ID NO: 1243053 - RNA, 19 nt, Homo sapiens
aaagaggagggcaagaguu

SEQ ID NO: 1243054 - RNA, 19 nt, Homo sapiens
ccugcuugguacagacaua

SEQ ID NO: 1243055 - RNA, 19 nt, Homo sapiens
gacacaagcgugccuucug

SEQ ID NO: 1243056 - RNA, 19 nt, Homo sapiens
gguuuuggcuucaguguca

SEQ ID NO: 1243057 - RNA, 19 nt, Homo sapiens
aaucugacugccuguguuu

SEQ ID NO: 1243058 - RNA, 19 nt, Homo sapiens
caggacacagccucguuaa

SEQ ID NO: 1243059 - RNA, 19 nt, Homo sapiens
gauccuggcggugaacaau

SEQ ID NO: 1243060 - RNA, 19 nt, Homo sapiens
uccuggcggugaacaauga

SEQ ID NO: 1243061 - RNA, 19 nt, Homo sapiens
ccacauagugaaagaugag

SEQ ID NO: 1243062 - RNA, 19 nt, Homo sapiens
ccauucgccauaaaucuga

SEQ ID NO: 1243063 - RNA, 19 nt, Homo sapiens
ucuguuuacugagcaaaga

SEQ ID NO: 1243064 - RNA, 19 nt, Homo sapiens
gaugucauaugggaguuuu

SEQ ID NO: 1243065 - RNA, 19 nt, Homo sapiens
agcuauggcuuccgacuca

SEQ ID NO: 1243066 - RNA, 19 nt, Homo sapiens
ccaagaaggcugggaugca

SEQ ID NO: 1243067 - RNA, 19 nt, Homo sapiens
gccauucgccauaaaucug

SEQ ID NO: 1243068 - RNA, 19 nt, Homo sapiens
acucagacaccaccgauca

SEQ ID NO: 1243069 - RNA, 19 nt, Homo sapiens
cagccucguuaacucugaa

SEQ ID NO: 1243070 - RNA, 19 nt, Homo sapiens
agacgugauucuggaagug

SEQ ID NO: 1243071 - RNA, 19 nt, Homo sapiens
agacagaggacccuucacu

SEQ ID NO: 1243072 - RNA, 19 nt, Homo sapiens
ugagacagaggacccuuca

SEQ ID NO: 1243073 - RNA, 19 nt, Homo sapiens
uguggaacacgaagacuau

SEQ ID NO: 1243074 - RNA, 19 nt, Homo sapiens
ggucagaguugaauucuua

SEQ ID NO: 1243075 - RNA, 19 nt, Homo sapiens
gaauaugugugguuucuga

SEQ ID NO: 1243076 - RNA, 19 nt, Homo sapiens
gaacugagcacuccguuug

SEQ ID NO: 1243077 - RNA, 19 nt, Homo sapiens
gaaguaaugucgucuugug

SEQ ID NO: 1243078 - RNA, 19 nt, Homo sapiens
caacuaggaugaauuuaag

SEQ ID NO: 1243079 - RNA, 19 nt, Homo sapiens
gaucaacuaggaugaauuu

SEQ ID NO: 1243080 - RNA, 19 nt, Homo sapiens
guucucaagugguaguuua

SEQ ID NO: 1243081 - RNA, 19 nt, Homo sapiens
gcagaguacuugagugcuu

SEQ ID NO: 1243082 - RNA, 19 nt, Homo sapiens
gcagagggcgagcucauaa

SEQ ID NO: 1243083 - RNA, 19 nt, Homo sapiens
cuaaaggacugauuugucu

SEQ ID NO: 1243084 - RNA, 19 nt, Homo sapiens
gguaguuauugaucguuua

SEQ ID NO: 1243085 - RNA, 19 nt, Homo sapiens
guaagugucugcacaucug

SEQ ID NO: 1243086 - RNA, 19 nt, Homo sapiens
caacacucauucaucauuc

SEQ ID NO: 1243087 - RNA, 19 nt, Homo sapiens
caugugauguggaaaccua

SEQ ID NO: 1243088 - RNA, 19 nt, Homo sapiens
ccucguagcuccucagauc

SEQ ID NO: 1243089 - RNA, 19 nt, Homo sapiens
cauauuaccuccuucuucu

SEQ ID NO: 1243090 - RNA, 19 nt, Homo sapiens
gagaucagcacaaccuuug

SEQ ID NO: 1243091 - RNA, 19 nt, Homo sapiens
guggguagguaguuauuga

SEQ ID NO: 1243092 - RNA, 19 nt, Homo sapiens
cuucuaacuugcccuauuu

SEQ ID NO: 1243093 - RNA, 19 nt, Homo sapiens
cauguguucucaaguggua

SEQ ID NO: 1243094 - RNA, 19 nt, Homo sapiens
acagaaggcugcggaguga

SEQ ID NO: 1243095 - RNA, 19 nt, Homo sapiens
cgaaaccgccucaugauca

SEQ ID NO: 1243096 - RNA, 19 nt, Homo sapiens
uugauaagccgauggauuu

SEQ ID NO: 1243097 - RNA, 19 nt, Homo sapiens
caucauucccgaucaacua

SEQ ID NO: 1243098 - RNA, 19 nt, Homo sapiens
caucuagacugcagaguac

SEQ ID NO: 1243099 - RNA, 19 nt, Homo sapiens
gggaauaugugugguuucu

SEQ ID NO: 1243100 - RNA, 19 nt, Homo sapiens
ugaaaugugucaucuagac

SEQ ID NO: 1243101 - RNA, 19 nt, Homo sapiens
ccucagacuuuggguauug

SEQ ID NO: 1243102 - RNA, 19 nt, Homo sapiens
gaaggcaguccggcucuuu

SEQ ID NO: 1243103 - RNA, 19 nt, Homo sapiens
ggccaaugccuuccucgua

SEQ ID NO: 1243104 - RNA, 19 nt, Homo sapiens
ccauguaccucugugaaug

SEQ ID NO: 1243105 - RNA, 19 nt, Homo sapiens
cagaguacuugagugcuuu

SEQ ID NO: 1243106 - RNA, 19 nt, Homo sapiens
cuauagacuuccaaucaga

SEQ ID NO: 1243107 - RNA, 19 nt, Homo sapiens
ugccaacacucauucauca

SEQ ID NO: 1243108 - RNA, 19 nt, Homo sapiens
ccaacacucauucaucauu

SEQ ID NO: 1243109 - RNA, 19 nt, Homo sapiens
ccaaagcccauuccugugu

SEQ ID NO: 1243110 - RNA, 19 nt, Homo sapiens
gaguugaauucuuaugucu

SEQ ID NO: 1243111 - RNA, 19 nt, Homo sapiens
uaccauguguucucaagug

SEQ ID NO: 1243112 - RNA, 19 nt, Homo sapiens
cauuguggguagguaguua

SEQ ID NO: 1243113 - RNA, 19 nt, Homo sapiens
cuggguagccucagacuuu

SEQ ID NO: 1243114 - RNA, 19 nt, Homo sapiens
ugugguuucugauuccaua

SEQ ID NO: 1243115 - RNA, 19 nt, Homo sapiens
ccacucagcauuccaugga

SEQ ID NO: 1243116 - RNA, 19 nt, Homo sapiens
gacuaagccugcuccaagu

SEQ ID NO: 1243117 - RNA, 19 nt, Homo sapiens
agacugugcuaccaugugu

SEQ ID NO: 1243118 - RNA, 19 nt, Homo sapiens
uggcuuugguagcuguuua

SEQ ID NO: 1243119 - RNA, 19 nt, Homo sapiens
ugaaaugauggcuuuggua

SEQ ID NO: 1243120 - RNA, 19 nt, Homo sapiens
ccaaaccacucaggacagu

SEQ ID NO: 1243121 - RNA, 19 nt, Homo sapiens
ccucagaucuacugguucu

SEQ ID NO: 1243122 - RNA, 19 nt, Homo sapiens
uggaaguaaugucgucuug

SEQ ID NO: 1243123 - RNA, 19 nt, Homo sapiens
caaagugguuuuaaugcaa

SEQ ID NO: 1243124 - RNA, 19 nt, Homo sapiens
gcaaagugguuuuaaugca

SEQ ID NO: 1243125 - RNA, 19 nt, Homo sapiens
gauaagccgauggauuuga

SEQ ID NO: 1243126 - RNA, 19 nt, Homo sapiens
gccuuucaauugucuguga

SEQ ID NO: 1243127 - RNA, 19 nt, Homo sapiens
gccaagagaucagcacaac

SEQ ID NO: 1243128 - RNA, 19 nt, Homo sapiens
agacuuuggguauugauaa

SEQ ID NO: 1243129 - RNA, 19 nt, Homo sapiens
uguacaaggugaauggaau

SEQ ID NO: 1243130 - RNA, 19 nt, Homo sapiens
gaaaccgccucaugaucac

SEQ ID NO: 1243131 - RNA, 19 nt, Homo sapiens
ucaucuagacugcagagua

SEQ ID NO: 1243132 - RNA, 19 nt, Homo sapiens
uuuacuagauaacccauug

SEQ ID NO: 1243133 - RNA, 19 nt, Homo sapiens
acuauuggguccugucaga

SEQ ID NO: 1243134 - RNA, 19 nt, Homo sapiens
uaugugugguuucugauuc

SEQ ID NO: 1243135 - RNA, 19 nt, Homo sapiens
guagguaguuauugaucgu

SEQ ID NO: 1243136 - RNA, 19 nt, Homo sapiens
uauuaccuccuucuucuaa

SEQ ID NO: 1243137 - RNA, 19 nt, Homo sapiens
ggaaggcaguccggcucuu

SEQ ID NO: 1243138 - RNA, 19 nt, Homo sapiens
gcuaccauguguucucaag

SEQ ID NO: 1243139 - RNA, 19 nt, Homo sapiens
ccgggaauaugugugguuu

SEQ ID NO: 1243140 - RNA, 19 nt, Homo sapiens
gugaaaugauggcuuuggu

SEQ ID NO: 1243141 - RNA, 19 nt, Homo sapiens
ggacagcaaagugguuuua

SEQ ID NO: 1243142 - RNA, 19 nt, Homo sapiens
gcacacccuucuguacaag

SEQ ID NO: 1243143 - RNA, 19 nt, Homo sapiens
aggaugaauuuaagacugu

SEQ ID NO: 1243144 - RNA, 19 nt, Homo sapiens
uccaaaccaugaaaugugu

SEQ ID NO: 1243145 - RNA, 19 nt, Homo sapiens
agucgaaaccgccucauga

SEQ ID NO: 1243146 - RNA, 19 nt, Homo sapiens
gugcuuugccucccgauau

SEQ ID NO: 1243147 - RNA, 19 nt, Homo sapiens
caagagaucagcacaaccu

SEQ ID NO: 1243148 - RNA, 19 nt, Homo sapiens
cagggaagcgugaaaugau

SEQ ID NO: 1243149 - RNA, 19 nt, Homo sapiens
agaguugaauucuuauguc

SEQ ID NO: 1243150 - RNA, 19 nt, Homo sapiens
agggaugacuugguucuug

SEQ ID NO: 1243151 - RNA, 19 nt, Homo sapiens
ucuucuaacuugcccuauu

SEQ ID NO: 1243152 - RNA, 19 nt, Homo sapiens
gcaguccggcucuuugaca

SEQ ID NO: 1243153 - RNA, 19 nt, Homo sapiens
gcagcacacccuucuguac

SEQ ID NO: 1243154 - RNA, 19 nt, Homo sapiens
cuacuucuguccuccaaac

SEQ ID NO: 1243155 - RNA, 19 nt, Homo sapiens
cuacccaccuuccaaacca

SEQ ID NO: 1243156 - RNA, 19 nt, Homo sapiens
cagcacacccuucuguaca

SEQ ID NO: 1243157 - RNA, 19 nt, Homo sapiens
cagcagcacacccuucugu

SEQ ID NO: 1243158 - RNA, 19 nt, Homo sapiens
gugcuaccauguguucuca

SEQ ID NO: 1243159 - RNA, 19 nt, Homo sapiens
agcgugaaaugauggcuuu

SEQ ID NO: 1243160 - RNA, 19 nt, Homo sapiens
gaucagcacaaccuuugca

SEQ ID NO: 1243161 - RNA, 19 nt, Homo sapiens
cagaguugaauucuuaugu

SEQ ID NO: 1243162 - RNA, 19 nt, Homo sapiens
acaucugccugucccugua

SEQ ID NO: 1243163 - RNA, 19 nt, Homo sapiens
gacuuuggguauugauaag

SEQ ID NO: 1243164 - RNA, 19 nt, Homo sapiens
guacaaggugaauggaauc

SEQ ID NO: 1243165 - RNA, 19 nt, Homo sapiens
acagggaagcgugaaauga

SEQ ID NO: 1243166 - RNA, 19 nt, Homo sapiens
uuugcaggcugacuugcua

SEQ ID NO: 1243167 - RNA, 19 nt, Homo sapiens
cuccucagaucuacugguu

SEQ ID NO: 1243168 - RNA, 19 nt, Homo sapiens
gaaaugugucaucuagacu

SEQ ID NO: 1243169 - RNA, 19 nt, Homo sapiens
uguggaaaccuacuucugu

SEQ ID NO: 1243170 - RNA, 19 nt, Homo sapiens
agggaagcgugaaaugaug

SEQ ID NO: 1243171 - RNA, 19 nt, Homo sapiens
gcaggcaggaggcauggau

SEQ ID NO: 1243172 - RNA, 19 nt, Homo sapiens
ucauauuaccuccuucuuc

SEQ ID NO: 1243173 - RNA, 19 nt, Homo sapiens
ccgaucaacuaggaugaau

SEQ ID NO: 1243174 - RNA, 19 nt, Homo sapiens
ccgagaagcugcugucuau

SEQ ID NO: 1243175 - RNA, 19 nt, Homo sapiens
gaacacacacccauuaucu

SEQ ID NO: 1243176 - RNA, 19 nt, Homo sapiens
caauacugcugaccacauu

SEQ ID NO: 1243177 - RNA, 19 nt, Homo sapiens
auacaugggugaacucuug

SEQ ID NO: 1243178 - RNA, 19 nt, Homo sapiens
ggagaaggacacuuacuug

SEQ ID NO: 1243179 - RNA, 19 nt, Homo sapiens
cagagccgcuuccauguug

SEQ ID NO: 1243180 - RNA, 19 nt, Homo sapiens
gugcuacucugaauacaau

SEQ ID NO: 1243181 - RNA, 19 nt, Homo sapiens
gcucgaggccuuccuuuau

SEQ ID NO: 1243182 - RNA, 19 nt, Homo sapiens
gagaagcugcugucuaugu

SEQ ID NO: 1243183 - RNA, 19 nt, Homo sapiens
gaaggaacacacacccauu

SEQ ID NO: 1243184 - RNA, 19 nt, Homo sapiens
cccaggagaugcaccagua

SEQ ID NO: 1243185 - RNA, 19 nt, Homo sapiens
ugcaagaccugcuggacua

SEQ ID NO: 1243186 - RNA, 19 nt, Homo sapiens
gaccacauuuggcuacuuc

SEQ ID NO: 1243187 - RNA, 19 nt, Homo sapiens
cgaaaccucuucaggaacu

SEQ ID NO: 1243188 - RNA, 19 nt, Homo sapiens
cuacuucagcuuaaaugua

SEQ ID NO: 1243189 - RNA, 19 nt, Homo sapiens
guacaugugggccuucuug

SEQ ID NO: 1243190 - RNA, 19 nt, Homo sapiens
ucgaggccuuccuuuauaa

SEQ ID NO: 1243191 - RNA, 19 nt, Homo sapiens
ccaugucgguguaccaaga

SEQ ID NO: 1243192 - RNA, 19 nt, Homo sapiens
cucgaggccuuccuuuaua

SEQ ID NO: 1243193 - RNA, 19 nt, Homo sapiens
aaggaacacacacccauua

SEQ ID NO: 1243194 - RNA, 19 nt, Homo sapiens
gggagaaggacacuuacuu

SEQ ID NO: 1243195 - RNA, 19 nt, Homo sapiens
caggaggcauggauacuca

SEQ ID NO: 1243196 - RNA, 19 nt, Homo sapiens
gagaugcaccaguacaugu

SEQ ID NO: 1243197 - RNA, 19 nt, Homo sapiens
gaacuggguauaccucucu

SEQ ID NO: 1243198 - RNA, 19 nt, Homo sapiens
gcauguguguguaacaaac

SEQ ID NO: 1243199 - RNA, 19 nt, Homo sapiens
gggccucacucugcgcuuu

SEQ ID NO: 1243200 - RNA, 19 nt, Homo sapiens
accgaaaccucuucaggaa

SEQ ID NO: 1243201 - RNA, 19 nt, Homo sapiens
ggccuuccuuuauaacuuc

SEQ ID NO: 1243202 - RNA, 19 nt, Homo sapiens
cugcacggcuucccugaga

SEQ ID NO: 1243203 - RNA, 19 nt, Homo sapiens
ggaacacacacccauuauc

SEQ ID NO: 1243204 - RNA, 19 nt, Homo sapiens
ggucuucagcucagugcua

SEQ ID NO: 1243205 - RNA, 19 nt, Homo sapiens
gaccuuaaacccugaccuu

SEQ ID NO: 1243206 - RNA, 19 nt, Homo sapiens
ggagaugcaccaguacaug

SEQ ID NO: 1243207 - RNA, 19 nt, Homo sapiens
ggaugcaccucgggaugug

SEQ ID NO: 1243208 - RNA, 19 nt, Homo sapiens
acacacacccauuaucugu

SEQ ID NO: 1243209 - RNA, 19 nt, Homo sapiens
aggcauggauacucaggaa

SEQ ID NO: 1243210 - RNA, 19 nt, Homo sapiens
ugggugaacucuugaaucg

SEQ ID NO: 1243211 - RNA, 19 nt, Homo sapiens
uagcugcacagaccuuaaa

SEQ ID NO: 1243212 - RNA, 19 nt, Homo sapiens
agaaggacacuuacuugga

SEQ ID NO: 1243213 - RNA, 19 nt, Homo sapiens
gagcugaccacacccacau

SEQ ID NO: 1243214 - RNA, 19 nt, Homo sapiens
caugugggccuucuugcaa

SEQ ID NO: 1243215 - RNA, 19 nt, Homo sapiens
ccagagccgcuuccauguu

SEQ ID NO: 1243216 - RNA, 19 nt, Homo sapiens
ggacacaccaaccccuaua

SEQ ID NO: 1243217 - RNA, 19 nt, Homo sapiens
cuucagcgcgucccacaaa

SEQ ID NO: 1243218 - RNA, 19 nt, Homo sapiens
guucuuccguucccacuac

SEQ ID NO: 1243219 - RNA, 19 nt, Homo sapiens
ccacaucagccaguucuuc

SEQ ID NO: 1243220 - RNA, 19 nt, Homo sapiens
gcauuucuccaucuacuac

SEQ ID NO: 1243221 - RNA, 19 nt, Homo sapiens
gcugaccacacccacauug

SEQ ID NO: 1243222 - RNA, 19 nt, Homo sapiens
agaagcugcugucuauguc

SEQ ID NO: 1243223 - RNA, 19 nt, Homo sapiens
gaaaccucuucaggaacuu

SEQ ID NO: 1243224 - RNA, 19 nt, Homo sapiens
acucuugaaucgcucauag

SEQ ID NO: 1243225 - RNA, 19 nt, Homo sapiens
gggcauuggaucccacaga

SEQ ID NO: 1243226 - RNA, 19 nt, Homo sapiens
gagcucgaggccuuccuuu

SEQ ID NO: 1243227 - RNA, 19 nt, Homo sapiens
cauggauacucaggaagga

SEQ ID NO: 1243228 - RNA, 19 nt, Homo sapiens
guggugcgcucuggcuguu

SEQ ID NO: 1243229 - RNA, 19 nt, Homo sapiens
ccuggcauuucuccaucua

SEQ ID NO: 1243230 - RNA, 19 nt, Homo sapiens
gccugcgucugcacuaugu

SEQ ID NO: 1243231 - RNA, 19 nt, Homo sapiens
gggccugcgucugcacuau

SEQ ID NO: 1243232 - RNA, 19 nt, Homo sapiens
uguuguggcuguggacuug

SEQ ID NO: 1243233 - RNA, 19 nt, Homo sapiens
gcggaugguuguggucagu

SEQ ID NO: 1243234 - RNA, 19 nt, Homo sapiens
gcauccuuguggcccauga

SEQ ID NO: 1243235 - RNA, 19 nt, Homo sapiens
cccacuacauguuccuguu

SEQ ID NO: 1243236 - RNA, 19 nt, Homo sapiens
gcugguggacaucaaagau

SEQ ID NO: 1243237 - RNA, 19 nt, Homo sapiens
gcagugcucagucccaaaa

SEQ ID NO: 1243238 - RNA, 19 nt, Homo sapiens
cauagcugcacagaccuua

SEQ ID NO: 1243239 - RNA, 19 nt, Homo sapiens
ucgcuucucugccauagcu

SEQ ID NO: 1243240 - RNA, 19 nt, Homo sapiens
ugagcacgguuuccugaac

SEQ ID NO: 1243241 - RNA, 19 nt, Homo sapiens
ccacuacauguuccuguuc

SEQ ID NO: 1243242 - RNA, 19 nt, Homo sapiens
gaagucaaauuguguaguu

SEQ ID NO: 1243243 - RNA, 19 nt, Homo sapiens
gaacggaagucauccugaa

SEQ ID NO: 1243244 - RNA, 19 nt, Homo sapiens
gcauaacacucucauauca

SEQ ID NO: 1243245 - RNA, 19 nt, Homo sapiens
gaacuggaauguuucuuuc

SEQ ID NO: 1243246 - RNA, 19 nt, Homo sapiens
ggagauguuuacuguuaua

SEQ ID NO: 1243247 - RNA, 19 nt, Homo sapiens
gaagguaauuucacacaau

SEQ ID NO: 1243248 - RNA, 19 nt, Homo sapiens
ggaggaguauguagaagaa

SEQ ID NO: 1243249 - RNA, 19 nt, Homo sapiens
gcacagaauggcccaauuu

SEQ ID NO: 1243250 - RNA, 19 nt, Homo sapiens
gaaagcacguuguaaaugc

SEQ ID NO: 1243251 - RNA, 19 nt, Homo sapiens
ugaaugcaaucaagucuuu

SEQ ID NO: 1243252 - RNA, 19 nt, Homo sapiens
ucaauaaacccaccaguaa

SEQ ID NO: 1243253 - RNA, 19 nt, Homo sapiens
gcaaucaagucuuuagauc

SEQ ID NO: 1243254 - RNA, 19 nt, Homo sapiens
guaaguaucaguaguuuga

SEQ ID NO: 1243255 - RNA, 19 nt, Homo sapiens
guagaaagcacguuguaaa

SEQ ID NO: 1243256 - RNA, 19 nt, Homo sapiens
cagcaaagcuaaaaucuaa

SEQ ID NO: 1243257 - RNA, 19 nt, Homo sapiens
gaaggaggaugagaaggaa

SEQ ID NO: 1243258 - RNA, 19 nt, Homo sapiens
gcgaagaagucaaauugug

SEQ ID NO: 1243259 - RNA, 19 nt, Homo sapiens
gaagaagucaaauugugua

SEQ ID NO: 1243260 - RNA, 19 nt, Homo sapiens
ugagggaacuguuauagau

SEQ ID NO: 1243261 - RNA, 19 nt, Homo sapiens
guacaguggugcuaucuca

SEQ ID NO: 1243262 - RNA, 19 nt, Homo sapiens
ggaaagguggagagaauuu

SEQ ID NO: 1243263 - RNA, 19 nt, Homo sapiens
gaagucauccugaaaauaa

SEQ ID NO: 1243264 - RNA, 19 nt, Homo sapiens
caacaguaaugccaauugu

SEQ ID NO: 1243265 - RNA, 19 nt, Homo sapiens
guacauggcaauucauuau

SEQ ID NO: 1243266 - RNA, 19 nt, Homo sapiens
caucucagccucccuagua

SEQ ID NO: 1243267 - RNA, 19 nt, Homo sapiens
ggggagauguuuacuguua

SEQ ID NO: 1243268 - RNA, 19 nt, Homo sapiens
gaggucagguauggaauuu

SEQ ID NO: 1243269 - RNA, 19 nt, Homo sapiens
ggaaggaggaugagaagga

SEQ ID NO: 1243270 - RNA, 19 nt, Homo sapiens
agggaacuguuauagauua

SEQ ID NO: 1243271 - RNA, 19 nt, Homo sapiens
gagaauagaggcauguuuc

SEQ ID NO: 1243272 - RNA, 19 nt, Homo sapiens
gggaugggaugcaagucua

SEQ ID NO: 1243273 - RNA, 19 nt, Homo sapiens
gagaagggaaggaggauga

SEQ ID NO: 1243274 - RNA, 19 nt, Homo sapiens
gaaaacaaacauaggcuua

SEQ ID NO: 1243275 - RNA, 19 nt, Homo sapiens
gaagaccaauuuucucaaa

SEQ ID NO: 1243276 - RNA, 19 nt, Homo sapiens
gcuaaacacauguaaacuu

SEQ ID NO: 1243277 - RNA, 19 nt, Homo sapiens
guggugcuaucucagcuua

SEQ ID NO: 1243278 - RNA, 19 nt, Homo sapiens
gggaacuguuauagauuaa

SEQ ID NO: 1243279 - RNA, 19 nt, Homo sapiens
caacaacaauguccuugac

SEQ ID NO: 1243280 - RNA, 19 nt, Homo sapiens
caaggguauuuaucacauu

SEQ ID NO: 1243281 - RNA, 19 nt, Homo sapiens
aaacaucagugacauucau

SEQ ID NO: 1243282 - RNA, 19 nt, Homo sapiens
gaauguuucuuucaucacu

SEQ ID NO: 1243283 - RNA, 19 nt, Homo sapiens
gagauaauugggaggagua

SEQ ID NO: 1243284 - RNA, 19 nt, Homo sapiens
uacauaaccugaaugcaau

SEQ ID NO: 1243285 - RNA, 19 nt, Homo sapiens
aaucaacccuucacguaga

SEQ ID NO: 1243286 - RNA, 19 nt, Homo sapiens
gcaacaguaaugccaauug

SEQ ID NO: 1243287 - RNA, 19 nt, Homo sapiens
caugagccaucgcgccuaa

SEQ ID NO: 1243288 - RNA, 19 nt, Homo sapiens
gcagggaacacuaggacaa

SEQ ID NO: 1243289 - RNA, 19 nt, Homo sapiens
gcgaguggcuggagagcau

SEQ ID NO: 1243290 - RNA, 19 nt, Homo sapiens
gcaacaacaauguccuuga

SEQ ID NO: 1243291 - RNA, 19 nt, Homo sapiens
acagguacauggcaauuca

SEQ ID NO: 1243292 - RNA, 19 nt, Homo sapiens
agaggcauguuucagcuaa

SEQ ID NO: 1243293 - RNA, 19 nt, Homo sapiens
ggaguaguucucaauguga

SEQ ID NO: 1243294 - RNA, 19 nt, Homo sapiens
ugggaaagguggagagaau

SEQ ID NO: 1243295 - RNA, 19 nt, Homo sapiens
aaacaaacauaggcuuauc

SEQ ID NO: 1243296 - RNA, 19 nt, Homo sapiens
auacauaaccugaaugcaa

SEQ ID NO: 1243297 - RNA, 19 nt, Homo sapiens
gacugcaacucaucacaug

SEQ ID NO: 1243298 - RNA, 19 nt, Homo sapiens
ugugauaccucuaauuguc

SEQ ID NO: 1243299 - RNA, 19 nt, Homo sapiens
gggagauguuuacuguuau

SEQ ID NO: 1243300 - RNA, 19 nt, Homo sapiens
uaaccugaaugcaaucaag

SEQ ID NO: 1243301 - RNA, 19 nt, Homo sapiens
aagcgaagaagucaaauug

SEQ ID NO: 1243302 - RNA, 19 nt, Homo sapiens
uuaggucuauugcuuguug

SEQ ID NO: 1243303 - RNA, 19 nt, Homo sapiens
aagguccucucauguguaa

SEQ ID NO: 1243304 - RNA, 19 nt, Homo sapiens
uaacaaggguauuuaucac

SEQ ID NO: 1243305 - RNA, 19 nt, Homo sapiens
cuauaugugccaaucuuua

SEQ ID NO: 1243306 - RNA, 19 nt, Homo sapiens
gaacucauggacucaagug

SEQ ID NO: 1243307 - RNA, 19 nt, Homo sapiens
aacauaggcuuauccacuu

SEQ ID NO: 1243308 - RNA, 19 nt, Homo sapiens
cauccaggcucucuuaaaa

SEQ ID NO: 1243309 - RNA, 19 nt, Homo sapiens
gguacauggcaauucauua

SEQ ID NO: 1243310 - RNA, 19 nt, Homo sapiens
cuaaagugcugcgauuaca

SEQ ID NO: 1243311 - RNA, 19 nt, Homo sapiens
gcacguuguaaaugcauaa

SEQ ID NO: 1243312 - RNA, 19 nt, Homo sapiens
gguccucucauguguaauu

SEQ ID NO: 1243313 - RNA, 19 nt, Homo sapiens
uauaggagcaggucugaug

SEQ ID NO: 1243314 - RNA, 19 nt, Homo sapiens
caggauaacaaggguauuu

SEQ ID NO: 1243315 - RNA, 19 nt, Homo sapiens
cgaagaagucaaauugugu

SEQ ID NO: 1243316 - RNA, 19 nt, Homo sapiens
acaguaaugccaauuguga

SEQ ID NO: 1243317 - RNA, 19 nt, Homo sapiens
ucauuauacccuccuauuu

SEQ ID NO: 1243318 - RNA, 19 nt, Homo sapiens
gaguaguucucaaugugau

SEQ ID NO: 1243319 - RNA, 19 nt, Homo sapiens
gagggaacuguuauagauu

SEQ ID NO: 1243320 - RNA, 19 nt, Homo sapiens
uagaaagcacguuguaaau

SEQ ID NO: 1243321 - RNA, 19 nt, Homo sapiens
guaguacaguggugcuauc

SEQ ID NO: 1243322 - RNA, 19 nt, Homo sapiens
gcuuauccacuucucagua

SEQ ID NO: 1243323 - RNA, 19 nt, Homo sapiens
gagcaucuaguuuccacuu

SEQ ID NO: 1243324 - RNA, 19 nt, Homo sapiens
uggaauguuucuuucauca

SEQ ID NO: 1243325 - RNA, 19 nt, Homo sapiens
aaugugauaccucuaauug

SEQ ID NO: 1243326 - RNA, 19 nt, Homo sapiens
caucacaugaggucaggua

SEQ ID NO: 1243327 - RNA, 19 nt, Homo sapiens
guaggucugauaaugguuu

SEQ ID NO: 1243328 - RNA, 19 nt, Homo sapiens
ucuauugcuuguuggaauu

SEQ ID NO: 1243329 - RNA, 19 nt, Homo sapiens
cuuauccacuucucaguau

SEQ ID NO: 1243330 - RNA, 19 nt, Homo sapiens
caacaacagaacuggaaug

SEQ ID NO: 1243331 - RNA, 19 nt, Homo sapiens
uaggaguaguucucaaugu

SEQ ID NO: 1243332 - RNA, 19 nt, Homo sapiens
uagugaugcucaaccugua

SEQ ID NO: 1243333 - RNA, 19 nt, Homo sapiens
cacuugugguguuacguua

SEQ ID NO: 1243334 - RNA, 19 nt, Homo sapiens
augcaagucuaaccacaaa

SEQ ID NO: 1243335 - RNA, 19 nt, Homo sapiens
gggaggaguauguagaaga

SEQ ID NO: 1243336 - RNA, 19 nt, Homo sapiens
guaaacuuugucagagaua

SEQ ID NO: 1243337 - RNA, 19 nt, Homo sapiens
ggcacagaauggcccaauu

SEQ ID NO: 1243338 - RNA, 19 nt, Homo sapiens
ccacuaugccaagcuaauu

SEQ ID NO: 1243339 - RNA, 19 nt, Homo sapiens
gugcaccuccuacugguuu

SEQ ID NO: 1243340 - RNA, 19 nt, Homo sapiens
agucauuggugcucuguau

SEQ ID NO: 1243341 - RNA, 19 nt, Homo sapiens
acaaggguauuuaucacau

SEQ ID NO: 1243342 - RNA, 19 nt, Homo sapiens
gaacaaacaccgacaguga

SEQ ID NO: 1243343 - RNA, 19 nt, Homo sapiens
cgaauaaauugcucaaaga

SEQ ID NO: 1243344 - RNA, 19 nt, Homo sapiens
ggaugggucugaggaauuu

SEQ ID NO: 1243345 - RNA, 19 nt, Homo sapiens
cagauuacauguguucaua

SEQ ID NO: 1243346 - RNA, 19 nt, Homo sapiens
caaauuccuuagaugguuu

SEQ ID NO: 1243347 - RNA, 19 nt, Homo sapiens
ccaaauuccuuagaugguu

SEQ ID NO: 1243348 - RNA, 19 nt, Homo sapiens
gcaggagagugaggagaaa

SEQ ID NO: 1243349 - RNA, 19 nt, Homo sapiens
uuacauguguucauaacga

SEQ ID NO: 1243350 - RNA, 19 nt, Homo sapiens
gaccuggauuguccuagaa

SEQ ID NO: 1243351 - RNA, 19 nt, Homo sapiens
ggaccugcccgauccugua

SEQ ID NO: 1243352 - RNA, 19 nt, Homo sapiens
gcauguggcuugucuucca

SEQ ID NO: 1243353 - RNA, 19 nt, Homo sapiens
gagggcagcagaagccuaa

SEQ ID NO: 1243354 - RNA, 19 nt, Homo sapiens
ggaaucagcagagauaugg

SEQ ID NO: 1243355 - RNA, 19 nt, Homo sapiens
gcacaaucgccucccacua

SEQ ID NO: 1243356 - RNA, 19 nt, Homo sapiens
ggauuguccuagaacuuug

SEQ ID NO: 1243357 - RNA, 19 nt, Homo sapiens
uucaacagcuuccucuauu

SEQ ID NO: 1243358 - RNA, 19 nt, Homo sapiens
acgaauaaauugcucaaag

SEQ ID NO: 1243359 - RNA, 19 nt, Homo sapiens
gauuacauguguucauaac

SEQ ID NO: 1243360 - RNA, 19 nt, Homo sapiens
ugaccuggauuguccuaga

SEQ ID NO: 1243361 - RNA, 19 nt, Homo sapiens
ggaggacagaauacaauga

SEQ ID NO: 1243362 - RNA, 19 nt, Homo sapiens
uccaacagauuacaugugu

SEQ ID NO: 1243363 - RNA, 19 nt, Homo sapiens
ggugagugcccuccgcuuu

SEQ ID NO: 1243364 - RNA, 19 nt, Homo sapiens
ucaacagcuuccucuauuc

SEQ ID NO: 1243365 - RNA, 19 nt, Homo sapiens
ugaaggaugaccuggauug

SEQ ID NO: 1243366 - RNA, 19 nt, Homo sapiens
agauauggaggacagaaua

SEQ ID NO: 1243367 - RNA, 19 nt, Homo sapiens
cgacagugaaggagaguga

SEQ ID NO: 1243368 - RNA, 19 nt, Homo sapiens
ccaaauuaguuucccuuuu

SEQ ID NO: 1243369 - RNA, 19 nt, Homo sapiens
gaaaaggggagggaaguuu

SEQ ID NO: 1243370 - RNA, 19 nt, Homo sapiens
cacaaucgccucccacuag

SEQ ID NO: 1243371 - RNA, 19 nt, Homo sapiens
cauguguucauaacgaaua

SEQ ID NO: 1243372 - RNA, 19 nt, Homo sapiens
ggcccuacgucuccgcaaa

SEQ ID NO: 1243373 - RNA, 19 nt, Homo sapiens
ggcaggggcuucuucauug

SEQ ID NO: 1243374 - RNA, 19 nt, Homo sapiens
ucgcucagcugccagaucu

SEQ ID NO: 1243375 - RNA, 19 nt, Homo sapiens
gaccugcccgauccuguaa

SEQ ID NO: 1243376 - RNA, 19 nt, Homo sapiens
gggcagcagaagccuaauu

SEQ ID NO: 1243377 - RNA, 19 nt, Homo sapiens
gaaggaugaccuggauugu

SEQ ID NO: 1243378 - RNA, 19 nt, Homo sapiens
ugugucagguucagcuuau

SEQ ID NO: 1243379 - RNA, 19 nt, Homo sapiens
gggaaucagcagagauaug

SEQ ID NO: 1243380 - RNA, 19 nt, Homo sapiens
agagugaccugagcaagca

SEQ ID NO: 1243381 - RNA, 19 nt, Homo sapiens
gcagagagggcagcagaag

SEQ ID NO: 1243382 - RNA, 19 nt, Homo sapiens
aaacaccgacagugaagga

SEQ ID NO: 1243383 - RNA, 19 nt, Homo sapiens
ggcaggagagugaggagaa

SEQ ID NO: 1243384 - RNA, 19 nt, Homo sapiens
ccacuagcggugacuguug

SEQ ID NO: 1243385 - RNA, 19 nt, Homo sapiens
gagauauggaggacagaau

SEQ ID NO: 1243386 - RNA, 19 nt, Homo sapiens
ggucugaggaauuugaaca

SEQ ID NO: 1243387 - RNA, 19 nt, Homo sapiens
uggauuguccuagaacuuu

SEQ ID NO: 1243388 - RNA, 19 nt, Homo sapiens
cagcuuccucuauuccuuu

SEQ ID NO: 1243389 - RNA, 19 nt, Homo sapiens
gaggacagaauacaaugag

SEQ ID NO: 1243390 - RNA, 19 nt, Homo sapiens
uacauguguucauaacgaa

SEQ ID NO: 1243391 - RNA, 19 nt, Homo sapiens
ggcagcagaagccuaauuc

SEQ ID NO: 1243392 - RNA, 19 nt, Homo sapiens
ugcaaauauugaaggauga

SEQ ID NO: 1243393 - RNA, 19 nt, Homo sapiens
guagugggguaaauggaaa

SEQ ID NO: 1243394 - RNA, 19 nt, Homo sapiens
uguaacaacccucgugcuu

SEQ ID NO: 1243395 - RNA, 19 nt, Homo sapiens
guggaugggucugaggaau

SEQ ID NO: 1243396 - RNA, 19 nt, Homo sapiens
gauauggaggacagaauac

SEQ ID NO: 1243397 - RNA, 19 nt, Homo sapiens
aaaugggaaucagcagaga

SEQ ID NO: 1243398 - RNA, 19 nt, Homo sapiens
gguaaauggaaauagacaa

SEQ ID NO: 1243399 - RNA, 19 nt, Homo sapiens
gaccugagcaagcaguagu

SEQ ID NO: 1243400 - RNA, 19 nt, Homo sapiens
aaaaggggagggaaguuua

SEQ ID NO: 1243401 - RNA, 19 nt, Homo sapiens
acagcuuccucuauuccuu

SEQ ID NO: 1243402 - RNA, 19 nt, Homo sapiens
aacaaacaccgacagugaa

SEQ ID NO: 1243403 - RNA, 19 nt, Homo sapiens
gaaguuuagaugggaagug

SEQ ID NO: 1243404 - RNA, 19 nt, Homo sapiens
ucaagaagcuguacaaagu

SEQ ID NO: 1243405 - RNA, 19 nt, Homo sapiens
gaacuuggcucgcauuggu

SEQ ID NO: 1243406 - RNA, 19 nt, Homo sapiens
gaauuuguaugcucuuaga

SEQ ID NO: 1243407 - RNA, 19 nt, Homo sapiens
gaaacuccgucucaaaaua

SEQ ID NO: 1243408 - RNA, 19 nt, Homo sapiens
ccaaggaguuacuggaauu

SEQ ID NO: 1243409 - RNA, 19 nt, Homo sapiens
ggaggugcccaaggaguua

SEQ ID NO: 1243410 - RNA, 19 nt, Homo sapiens
cgaaacgccugcccaacug

SEQ ID NO: 1243411 - RNA, 19 nt, Homo sapiens
ggaggugguagaauuugua

SEQ ID NO: 1243412 - RNA, 19 nt, Homo sapiens
gccuuuggcugccuccuaa

SEQ ID NO: 1243413 - RNA, 19 nt, Homo sapiens
ccauguggaucccuauguu

SEQ ID NO: 1243414 - RNA, 19 nt, Homo sapiens
ggcagggcuuggaggcuua

SEQ ID NO: 1243415 - RNA, 19 nt, Homo sapiens
cagcaucagcccagauaaa

SEQ ID NO: 1243416 - RNA, 19 nt, Homo sapiens
gaucaagaagcuguacaaa

SEQ ID NO: 1243417 - RNA, 19 nt, Homo sapiens
gaaagucaugugccucugu

SEQ ID NO: 1243418 - RNA, 19 nt, Homo sapiens
cagagucgcugcccaacgu

SEQ ID NO: 1243419 - RNA, 19 nt, Homo sapiens
gauaaagcccagccaaagg

SEQ ID NO: 1243420 - RNA, 19 nt, Homo sapiens
cagauaaagcccagccaaa

SEQ ID NO: 1243421 - RNA, 19 nt, Homo sapiens
gcuggaggugguagaauuu

SEQ ID NO: 1243422 - RNA, 19 nt, Homo sapiens
ggaucaagaagcuguacaa

SEQ ID NO: 1243423 - RNA, 19 nt, Homo sapiens
gggucaagaagauaaguaa

SEQ ID NO: 1243424 - RNA, 19 nt, Homo sapiens
caaggcagggucaagaaga

SEQ ID NO: 1243425 - RNA, 19 nt, Homo sapiens
ucgggaagcugagguagga

SEQ ID NO: 1243426 - RNA, 19 nt, Homo sapiens
gaaaccccgucucuacuga

SEQ ID NO: 1243427 - RNA, 19 nt, Homo sapiens
ccaacgugguggugaaugg

SEQ ID NO: 1243428 - RNA, 19 nt, Homo sapiens
gcccaaggcaggagaaucu

SEQ ID NO: 1243429 - RNA, 19 nt, Homo sapiens
agacggguuucaccacguu

SEQ ID NO: 1243430 - RNA, 19 nt, Homo sapiens
ccuguaaucccagcacuuu

SEQ ID NO: 1243431 - RNA, 19 nt, Homo sapiens
ggacccaggacuuaauuac

SEQ ID NO: 1243432 - RNA, 19 nt, Homo sapiens
gcccaaggaguuacuggaa

SEQ ID NO: 1243433 - RNA, 19 nt, Homo sapiens
caagaagcuguacaaagug

SEQ ID NO: 1243434 - RNA, 19 nt, Homo sapiens
ggcagggucaagaagauaa

SEQ ID NO: 1243435 - RNA, 19 nt, Homo sapiens
gaucaguccagaggccuuu

SEQ ID NO: 1243436 - RNA, 19 nt, Homo sapiens
ccaaagugcugggauuacg

SEQ ID NO: 1243437 - RNA, 19 nt, Homo sapiens
ggaagcugagguaggagaa

SEQ ID NO: 1243438 - RNA, 19 nt, Homo sapiens
gcacaagcggaucaagaag

SEQ ID NO: 1243439 - RNA, 19 nt, Homo sapiens
ggugguagaauuuguaugc

SEQ ID NO: 1243440 - RNA, 19 nt, Homo sapiens
cucuacagcuucagcauca

SEQ ID NO: 1243441 - RNA, 19 nt, Homo sapiens
cauguggaucccuauguuu

SEQ ID NO: 1243442 - RNA, 19 nt, Homo sapiens
cccaaggaguuacuggaau

SEQ ID NO: 1243443 - RNA, 19 nt, Homo sapiens
accaggaggugcccaagga

SEQ ID NO: 1243444 - RNA, 19 nt, Homo sapiens
cgccucggcuucccaaagu

SEQ ID NO: 1243445 - RNA, 19 nt, Homo sapiens
ucgaguggcugggauuaca

SEQ ID NO: 1243446 - RNA, 19 nt, Homo sapiens
gccaaggcagggucaagaa

SEQ ID NO: 1243447 - RNA, 19 nt, Homo sapiens
gaggugguagaauuuguau

SEQ ID NO: 1243448 - RNA, 19 nt, Homo sapiens
ucaugugccucuguccuau

SEQ ID NO: 1243449 - RNA, 19 nt, Homo sapiens
acaagcggaucaagaagcu

SEQ ID NO: 1243450 - RNA, 19 nt, Homo sapiens
gugaaacuccgucucaaaa

SEQ ID NO: 1243451 - RNA, 19 nt, Homo sapiens
ggucaagaagauaaguaau

SEQ ID NO: 1243452 - RNA, 19 nt, Homo sapiens
agcuggaggugguagaauu

SEQ ID NO: 1243453 - RNA, 19 nt, Homo sapiens
gggcuuggaggcuuacauc

SEQ ID NO: 1243454 - RNA, 19 nt, Homo sapiens
gucaugugccucuguccua

SEQ ID NO: 1243455 - RNA, 19 nt, Homo sapiens
aaacuccgucucaaaauaa

SEQ ID NO: 1243456 - RNA, 19 nt, Homo sapiens
aagcugagguaggagaauc

SEQ ID NO: 1243457 - RNA, 19 nt, Homo sapiens
agaccagccugaccaccau

SEQ ID NO: 1243458 - RNA, 19 nt, Homo sapiens
ugcacaagcggaucaagaa

SEQ ID NO: 1243459 - RNA, 19 nt, Homo sapiens
gcgcggaugcuggaaguuc

SEQ ID NO: 1243460 - RNA, 19 nt, Homo sapiens
aaggcagggucaagaagau

SEQ ID NO: 1243461 - RNA, 19 nt, Homo sapiens
ggaccagaggguuggaaca

SEQ ID NO: 1243462 - RNA, 19 nt, Homo sapiens
uuggcugccuccuaagaaa

SEQ ID NO: 1243463 - RNA, 19 nt, Homo sapiens
agauaaagcccagccaaag

SEQ ID NO: 1243464 - RNA, 19 nt, Homo sapiens
ggaagcggauggcaacuua

SEQ ID NO: 1243465 - RNA, 19 nt, Homo sapiens
caaauacccuccccaauua

SEQ ID NO: 1243466 - RNA, 19 nt, Homo sapiens
aaacagcgcucccaacaau

SEQ ID NO: 1243467 - RNA, 19 nt, Homo sapiens
gcggagaguuggcgacuuu

SEQ ID NO: 1243468 - RNA, 19 nt, Homo sapiens
gcaguguccuugaugagaa

SEQ ID NO: 1243469 - RNA, 19 nt, Homo sapiens
gcaggcccauuuaaucaaa

SEQ ID NO: 1243470 - RNA, 19 nt, Homo sapiens
gagcgaauggcguuuauug

SEQ ID NO: 1243471 - RNA, 19 nt, Homo sapiens
gagcaggcccauuuaauca

SEQ ID NO: 1243472 - RNA, 19 nt, Homo sapiens
caacguggaucccucaacu

SEQ ID NO: 1243473 - RNA, 19 nt, Homo sapiens
ggagcaggcccauuuaauc

SEQ ID NO: 1243474 - RNA, 19 nt, Homo sapiens
cgaagcacguggucuguca

SEQ ID NO: 1243475 - RNA, 19 nt, Homo sapiens
ccaaaggccgauuuaaaga

SEQ ID NO: 1243476 - RNA, 19 nt, Homo sapiens
gcacaugcagcccuuuguu

SEQ ID NO: 1243477 - RNA, 19 nt, Homo sapiens
caaagaaccuggggucuga

SEQ ID NO: 1243478 - RNA, 19 nt, Homo sapiens
gaaaagucauugucaccuu

SEQ ID NO: 1243479 - RNA, 19 nt, Homo sapiens
uccggcgacuccucaauua

SEQ ID NO: 1243480 - RNA, 19 nt, Homo sapiens
acacgagcguaccaaagaa

SEQ ID NO: 1243481 - RNA, 19 nt, Homo sapiens
gcgaauggcguuuauuguc

SEQ ID NO: 1243482 - RNA, 19 nt, Homo sapiens
gaaaacagcgcucccaaca

SEQ ID NO: 1243483 - RNA, 19 nt, Homo sapiens
gggcugcagucaacuaaac

SEQ ID NO: 1243484 - RNA, 19 nt, Homo sapiens
ucaaauacccuccccaauu

SEQ ID NO: 1243485 - RNA, 19 nt, Homo sapiens
gccggacacuggacgauca

SEQ ID NO: 1243486 - RNA, 19 nt, Homo sapiens
gggagcaggcccauuuaau

SEQ ID NO: 1243487 - RNA, 19 nt, Homo sapiens
gagggcugcagucaacuaa

SEQ ID NO: 1243488 - RNA, 19 nt, Homo sapiens
gaacgcaccgggagcaaaa

SEQ ID NO: 1243489 - RNA, 19 nt, Homo sapiens
uaaacacgagcguaccaaa

SEQ ID NO: 1243490 - RNA, 19 nt, Homo sapiens
cccaaaggccgauuuaaag

SEQ ID NO: 1243491 - RNA, 19 nt, Homo sapiens
cauggcaccucgcacaagu

SEQ ID NO: 1243492 - RNA, 19 nt, Homo sapiens
gcccauuuaaucaaaguuu

SEQ ID NO: 1243493 - RNA, 19 nt, Homo sapiens
gacaaaacuuccugugugu

SEQ ID NO: 1243494 - RNA, 19 nt, Homo sapiens
cacaugcagcccuuuguuu

SEQ ID NO: 1243495 - RNA, 19 nt, Homo sapiens
caguguccuugaugagaaa

SEQ ID NO: 1243496 - RNA, 19 nt, Homo sapiens
ccaacaaugccaccuccaa

SEQ ID NO: 1243497 - RNA, 19 nt, Homo sapiens
ccgagcgaauggcguuuau

SEQ ID NO: 1243498 - RNA, 19 nt, Homo sapiens
ggagaguuggcgacuuuca

SEQ ID NO: 1243499 - RNA, 19 nt, Homo sapiens
cggcgacuccucaauuaug

SEQ ID NO: 1243500 - RNA, 19 nt, Homo sapiens
gcguguugcucucauuguc

SEQ ID NO: 1243501 - RNA, 19 nt, Homo sapiens
caucagcaaaccacauugu

SEQ ID NO: 1243502 - RNA, 19 nt, Homo sapiens
aaacuuccuguguguaugu

SEQ ID NO: 1243503 - RNA, 19 nt, Homo sapiens
gggcuggacauucggacaa

SEQ ID NO: 1243504 - RNA, 19 nt, Homo sapiens
aacacgagcguaccaaaga

SEQ ID NO: 1243505 - RNA, 19 nt, Homo sapiens
ccgaaacucgcccgaacuu

SEQ ID NO: 1243506 - RNA, 19 nt, Homo sapiens
gcuuuccucucgggccuuu

SEQ ID NO: 1243507 - RNA, 19 nt, Homo sapiens
cgagggcugcagucaacua

SEQ ID NO: 1243508 - RNA, 19 nt, Homo sapiens
gcccugcggaguucacuga

SEQ ID NO: 1243509 - RNA, 19 nt, Homo sapiens
caaaggccgauuuaaagac

SEQ ID NO: 1243510 - RNA, 19 nt, Homo sapiens
uuuaagcgaccgcguguug

SEQ ID NO: 1243511 - RNA, 19 nt, Homo sapiens
caaaacuuccuguguguau

SEQ ID NO: 1243512 - RNA, 19 nt, Homo sapiens
gcgacuuucacucugcuuu

SEQ ID NO: 1243513 - RNA, 19 nt, Homo sapiens
aaugccaccuccaagacaa

SEQ ID NO: 1243514 - RNA, 19 nt, Homo sapiens
aaacacgagcguaccaaag

SEQ ID NO: 1243515 - RNA, 19 nt, Homo sapiens
ccuccccaauuaauaaaua

SEQ ID NO: 1243516 - RNA, 19 nt, Homo sapiens
gaacaagaauccuucauua

SEQ ID NO: 1243517 - RNA, 19 nt, Homo sapiens
gaaggaggcugcucauaua

SEQ ID NO: 1243518 - RNA, 19 nt, Homo sapiens
ggaaauaucuguuggagaa

SEQ ID NO: 1243519 - RNA, 19 nt, Homo sapiens
caacagccauuuccacuua

SEQ ID NO: 1243520 - RNA, 19 nt, Homo sapiens
guacuacgcugaugcauuu

SEQ ID NO: 1243521 - RNA, 19 nt, Homo sapiens
cauauaagcugaacucuau

SEQ ID NO: 1243522 - RNA, 19 nt, Homo sapiens
ggacagaaguauuugaaga

SEQ ID NO: 1243523 - RNA, 19 nt, Homo sapiens
gaagauauguguguauuuc

SEQ ID NO: 1243524 - RNA, 19 nt, Homo sapiens
gcacuucucuagacacaaa

SEQ ID NO: 1243525 - RNA, 19 nt, Homo sapiens
ccaaagaccuugauugcaa

SEQ ID NO: 1243526 - RNA, 19 nt, Homo sapiens
gcaaacgaaugcaagaauu

SEQ ID NO: 1243527 - RNA, 19 nt, Homo sapiens
caagaauccuucauuaaga

SEQ ID NO: 1243528 - RNA, 19 nt, Homo sapiens
gaccaacacuggaugaauu

SEQ ID NO: 1243529 - RNA, 19 nt, Homo sapiens
gaaccuuaaucucaucuuu

SEQ ID NO: 1243530 - RNA, 19 nt, Homo sapiens
gaagaaauagcguuagaaa

SEQ ID NO: 1243531 - RNA, 19 nt, Homo sapiens
ugucuuagcugaccuguuu

SEQ ID NO: 1243532 - RNA, 19 nt, Homo sapiens
gaaggucacuggacucuag

SEQ ID NO: 1243533 - RNA, 19 nt, Homo sapiens
ggaagaagaaauagcguua

SEQ ID NO: 1243534 - RNA, 19 nt, Homo sapiens
ggaggcugcucauauaauu

SEQ ID NO: 1243535 - RNA, 19 nt, Homo sapiens
aagcagagcucccaucuug

SEQ ID NO: 1243536 - RNA, 19 nt, Homo sapiens
gccgagaucuggacgauaa

SEQ ID NO: 1243537 - RNA, 19 nt, Homo sapiens
ggaacugucuaucugguuu

SEQ ID NO: 1243538 - RNA, 19 nt, Homo sapiens
uuaggagacuggaauguua

SEQ ID NO: 1243539 - RNA, 19 nt, Homo sapiens
agaaagaaaucaggaauga

SEQ ID NO: 1243540 - RNA, 19 nt, Homo sapiens
agaaauagcguuagaaaga

SEQ ID NO: 1243541 - RNA, 19 nt, Homo sapiens
gauacuucaucgagacuua

SEQ ID NO: 1243542 - RNA, 19 nt, Homo sapiens
gugauucucuucuaugauu

SEQ ID NO: 1243543 - RNA, 19 nt, Homo sapiens
gcaagauaauuucugcauu

SEQ ID NO: 1243544 - RNA, 19 nt, Homo sapiens
gcccuuccaugacuaauaa

SEQ ID NO: 1243545 - RNA, 19 nt, Homo sapiens
cgugugcucuucauuauuu

SEQ ID NO: 1243546 - RNA, 19 nt, Homo sapiens
agacuggaauguuaaguuu

SEQ ID NO: 1243547 - RNA, 19 nt, Homo sapiens
gagcucccaucuugacuuu

SEQ ID NO: 1243548 - RNA, 19 nt, Homo sapiens
gaauugagaucucggaacu

SEQ ID NO: 1243549 - RNA, 19 nt, Homo sapiens
caaacgaggagaggaauua

SEQ ID NO: 1243550 - RNA, 19 nt, Homo sapiens
gcagcugaguguugaugua

SEQ ID NO: 1243551 - RNA, 19 nt, Homo sapiens
gagaugugcugcaugaauc

SEQ ID NO: 1243552 - RNA, 19 nt, Homo sapiens
ucaaacucauccauagaua

SEQ ID NO: 1243553 - RNA, 19 nt, Homo sapiens
uaugagaugugcugcauga

SEQ ID NO: 1243554 - RNA, 19 nt, Homo sapiens
ccaggcggcugaugagaaa

SEQ ID NO: 1243555 - RNA, 19 nt, Homo sapiens
ggaugaauuugaccauuuc

SEQ ID NO: 1243556 - RNA, 19 nt, Homo sapiens
gcuuauagaucaaguuugg

SEQ ID NO: 1243557 - RNA, 19 nt, Homo sapiens
uaaggaagauaugugugua

SEQ ID NO: 1243558 - RNA, 19 nt, Homo sapiens
aagcugaacucuauuaugg

SEQ ID NO: 1243559 - RNA, 19 nt, Homo sapiens
guguagauauucagaaaug

SEQ ID NO: 1243560 - RNA, 19 nt, Homo sapiens
guacuggcuucuuuagaga

SEQ ID NO: 1243561 - RNA, 19 nt, Homo sapiens
gaaagaccagagaaagaaa

SEQ ID NO: 1243562 - RNA, 19 nt, Homo sapiens
ggaagaggaaucugaugaa

SEQ ID NO: 1243563 - RNA, 19 nt, Homo sapiens
ggagcaaccugagggaaga

SEQ ID NO: 1243564 - RNA, 19 nt, Homo sapiens
gaaccuaauguguagauau

SEQ ID NO: 1243565 - RNA, 19 nt, Homo sapiens
ggacuauacccugagauaa

SEQ ID NO: 1243566 - RNA, 19 nt, Homo sapiens
gaaauagcguuagaaagac

SEQ ID NO: 1243567 - RNA, 19 nt, Homo sapiens
gaagaguacuacgcugaug

SEQ ID NO: 1243568 - RNA, 19 nt, Homo sapiens
uggaugaauuugaccauuu

SEQ ID NO: 1243569 - RNA, 19 nt, Homo sapiens
acaaggaccuggauuaaaa

SEQ ID NO: 1243570 - RNA, 19 nt, Homo sapiens
gaagaggucuauaauuacc

SEQ ID NO: 1243571 - RNA, 19 nt, Homo sapiens
gaacugaccaacacuggau

SEQ ID NO: 1243572 - RNA, 19 nt, Homo sapiens
uuugaggccugcccgauua

SEQ ID NO: 1243573 - RNA, 19 nt, Homo sapiens
gcucccaucuugacuuuca

SEQ ID NO: 1243574 - RNA, 19 nt, Homo sapiens
gcugggaguugacuacaug

SEQ ID NO: 1243575 - RNA, 19 nt, Homo sapiens
ggaagauauguguguauuu

SEQ ID NO: 1243576 - RNA, 19 nt, Homo sapiens
ugaggaggaagaagaaaua

SEQ ID NO: 1243577 - RNA, 19 nt, Homo sapiens
gaccuuggauaccaugaga

SEQ ID NO: 1243578 - RNA, 19 nt, Homo sapiens
gaagaggaaucugaugaac

SEQ ID NO: 1243579 - RNA, 19 nt, Homo sapiens
aagaagaaauagcguuaga

SEQ ID NO: 1243580 - RNA, 19 nt, Homo sapiens
gggaagaggaaucugauga

SEQ ID NO: 1243581 - RNA, 19 nt, Homo sapiens
gcagggaagaggaaucuga

SEQ ID NO: 1243582 - RNA, 19 nt, Homo sapiens
caaacucauccauagauaa

SEQ ID NO: 1243583 - RNA, 19 nt, Homo sapiens
gcuggaaagucugaacuga

SEQ ID NO: 1243584 - RNA, 19 nt, Homo sapiens
agaacuaaaugccaucaug

SEQ ID NO: 1243585 - RNA, 19 nt, Homo sapiens
aaccaguucucucuuguuu

SEQ ID NO: 1243586 - RNA, 19 nt, Homo sapiens
ccaguucucucuuguuugg

SEQ ID NO: 1243587 - RNA, 19 nt, Homo sapiens
gaccagcuccuguacuuug

SEQ ID NO: 1243588 - RNA, 19 nt, Homo sapiens
gagcagcuacagaaccuaa

SEQ ID NO: 1243589 - RNA, 19 nt, Homo sapiens
caaagaccaucaccaccau

SEQ ID NO: 1243590 - RNA, 19 nt, Homo sapiens
gagaaagaaaucaggaaug

SEQ ID NO: 1243591 - RNA, 19 nt, Homo sapiens
ccacaucugaccuuggaua

SEQ ID NO: 1243592 - RNA, 19 nt, Homo sapiens
caaacgaaugcaagaauug

SEQ ID NO: 1243593 - RNA, 19 nt, Homo sapiens
gaccuggccacaacuuuaa

SEQ ID NO: 1243594 - RNA, 19 nt, Homo sapiens
ugaccuggccacaacuuua

SEQ ID NO: 1243595 - RNA, 19 nt, Homo sapiens
aaacuguacaggccaauuu

SEQ ID NO: 1243596 - RNA, 19 nt, Homo sapiens
gcagagauccgcgaguguu

SEQ ID NO: 1243597 - RNA, 19 nt, Homo sapiens
agaaggaggcugcucauau

SEQ ID NO: 1243598 - RNA, 19 nt, Homo sapiens
ccaaggcuaugacacaaag

SEQ ID NO: 1243599 - RNA, 19 nt, Homo sapiens
gaauauaaacaagcuggaa

SEQ ID NO: 1243600 - RNA, 19 nt, Homo sapiens
gccgugugcucuucauuau

SEQ ID NO: 1243601 - RNA, 19 nt, Homo sapiens
aaguuuggcucccuugaaa

SEQ ID NO: 1243602 - RNA, 19 nt, Homo sapiens
guggacaaauuuaugugaa

SEQ ID NO: 1243603 - RNA, 19 nt, Homo sapiens
guucaaguggacaaauuua

SEQ ID NO: 1243604 - RNA, 19 nt, Homo sapiens
caaaccaacaggacaguga

SEQ ID NO: 1243605 - RNA, 19 nt, Homo sapiens
gaaaauagcaaacgaaugc

SEQ ID NO: 1243606 - RNA, 19 nt, Homo sapiens
gaaaaugacgccaagagaa

SEQ ID NO: 1243607 - RNA, 19 nt, Homo sapiens
ugagagauauccaaaagaa

SEQ ID NO: 1243608 - RNA, 19 nt, Homo sapiens
gagaggaggauacuucauc

SEQ ID NO: 1243609 - RNA, 19 nt, Homo sapiens
ggagaacuaaauccaaaug

SEQ ID NO: 1243610 - RNA, 19 nt, Homo sapiens
gagacuggaauguuaaguu

SEQ ID NO: 1243611 - RNA, 19 nt, Homo sapiens
agaggaaucugaugaacca

SEQ ID NO: 1243612 - RNA, 19 nt, Homo sapiens
aaaugacucuggaagacaa

SEQ ID NO: 1243613 - RNA, 19 nt, Homo sapiens
caacacuggaugaauuuga

SEQ ID NO: 1243614 - RNA, 19 nt, Homo sapiens
ccacuuauccaaagaccuu

SEQ ID NO: 1243615 - RNA, 19 nt, Homo sapiens
acacaaggaccuggauuaa

SEQ ID NO: 1243616 - RNA, 19 nt, Homo sapiens
gggaggagcuuacauauaa

SEQ ID NO: 1243617 - RNA, 19 nt, Homo sapiens
aaacauagcugaagaaauc

SEQ ID NO: 1243618 - RNA, 19 nt, Homo sapiens
aaagaaaccuggugccuua

SEQ ID NO: 1243619 - RNA, 19 nt, Homo sapiens
ggaaagaagaguccaaaua

SEQ ID NO: 1243620 - RNA, 19 nt, Homo sapiens
gggcaaaucuggaugcuaa

SEQ ID NO: 1243621 - RNA, 19 nt, Homo sapiens
gcaacaugcucuccaguuu

SEQ ID NO: 1243622 - RNA, 19 nt, Homo sapiens
gaaauucacagaagcuaua

SEQ ID NO: 1243623 - RNA, 19 nt, Homo sapiens
gaaucuaacuugcuuuguu

SEQ ID NO: 1243624 - RNA, 19 nt, Homo sapiens
ggucguaacuuucuuuaug

SEQ ID NO: 1243625 - RNA, 19 nt, Homo sapiens
gaagucauguucagguaaa

SEQ ID NO: 1243626 - RNA, 19 nt, Homo sapiens
gacacagucuucaaguuua

SEQ ID NO: 1243627 - RNA, 19 nt, Homo sapiens
gcaagagucuguuacaaag

SEQ ID NO: 1243628 - RNA, 19 nt, Homo sapiens
gcuaauugcuaacuaaaug

SEQ ID NO: 1243629 - RNA, 19 nt, Homo sapiens
gaagggaaauucacagaag

SEQ ID NO: 1243630 - RNA, 19 nt, Homo sapiens
gaaagaagaguccaaauac

SEQ ID NO: 1243631 - RNA, 19 nt, Homo sapiens
ucacaaggauucagcuaaa

SEQ ID NO: 1243632 - RNA, 19 nt, Homo sapiens
gaaaccucaugaacugaua

SEQ ID NO: 1243633 - RNA, 19 nt, Homo sapiens
gaagucuugugcauacuaa

SEQ ID NO: 1243634 - RNA, 19 nt, Homo sapiens
aaacaacacuggguaauuc

SEQ ID NO: 1243635 - RNA, 19 nt, Homo sapiens
gguauuggcugcucugugu

SEQ ID NO: 1243636 - RNA, 19 nt, Homo sapiens
gaugcuaauugcuaacuaa

SEQ ID NO: 1243637 - RNA, 19 nt, Homo sapiens
ccacugagcacucuaggua

SEQ ID NO: 1243638 - RNA, 19 nt, Homo sapiens
gaauguacaccuucauauu

SEQ ID NO: 1243639 - RNA, 19 nt, Homo sapiens
ccacaccacugcccuuuga

SEQ ID NO: 1243640 - RNA, 19 nt, Homo sapiens
gaagguggaauuuggagua

SEQ ID NO: 1243641 - RNA, 19 nt, Homo sapiens
acaauucgcuaucgagaaa

SEQ ID NO: 1243642 - RNA, 19 nt, Homo sapiens
cagcauaugucccaaggaa

SEQ ID NO: 1243643 - RNA, 19 nt, Homo sapiens
gaaucaauaugucacugaa

SEQ ID NO: 1243644 - RNA, 19 nt, Homo sapiens
gaaacaacacuggguaauu

SEQ ID NO: 1243645 - RNA, 19 nt, Homo sapiens
ccaagucacugucccaaug

SEQ ID NO: 1243646 - RNA, 19 nt, Homo sapiens
ccacugcccuuugaaugua

SEQ ID NO: 1243647 - RNA, 19 nt, Homo sapiens
gcacccauguuuguuguuu

SEQ ID NO: 1243648 - RNA, 19 nt, Homo sapiens
caaggaaacuaaucccaau

SEQ ID NO: 1243649 - RNA, 19 nt, Homo sapiens
cuaauggucucuuaacaug

SEQ ID NO: 1243650 - RNA, 19 nt, Homo sapiens
ggacagauuccacugaaga

SEQ ID NO: 1243651 - RNA, 19 nt, Homo sapiens
ggaauuuggaguaagauuu

SEQ ID NO: 1243652 - RNA, 19 nt, Homo sapiens
ccggaaacauugcaaacua

SEQ ID NO: 1243653 - RNA, 19 nt, Homo sapiens
guugcuaacugcacucuuu

SEQ ID NO: 1243654 - RNA, 19 nt, Homo sapiens
ccaacacaguuuaugaauu

SEQ ID NO: 1243655 - RNA, 19 nt, Homo sapiens
gaacacacauaaacauagc

SEQ ID NO: 1243656 - RNA, 19 nt, Homo sapiens
ccauguuuguuguuucuua

SEQ ID NO: 1243657 - RNA, 19 nt, Homo sapiens
ggauauggcagcaauguau

SEQ ID NO: 1243658 - RNA, 19 nt, Homo sapiens
gaaacuaaucccaauaaca

SEQ ID NO: 1243659 - RNA, 19 nt, Homo sapiens
gaaagacaauguggaaggu

SEQ ID NO: 1243660 - RNA, 19 nt, Homo sapiens
gcacagaaauugccaaaag

SEQ ID NO: 1243661 - RNA, 19 nt, Homo sapiens
gaagaguccaaauacagua

SEQ ID NO: 1243662 - RNA, 19 nt, Homo sapiens
ugacacagucuucaaguuu

SEQ ID NO: 1243663 - RNA, 19 nt, Homo sapiens
gcagcaauguaucaccaaa

SEQ ID NO: 1243664 - RNA, 19 nt, Homo sapiens
ggaggagcuuacauauaaa

SEQ ID NO: 1243665 - RNA, 19 nt, Homo sapiens
agauuccacugaagaguua

SEQ ID NO: 1243666 - RNA, 19 nt, Homo sapiens
gcacgacccacaacaguga

SEQ ID NO: 1243667 - RNA, 19 nt, Homo sapiens
gaauguuacucacaaggau

SEQ ID NO: 1243668 - RNA, 19 nt, Homo sapiens
ucaagcaagugauucagaa

SEQ ID NO: 1243669 - RNA, 19 nt, Homo sapiens
gguggaauuuggaguaaga

SEQ ID NO: 1243670 - RNA, 19 nt, Homo sapiens
ucuaauaccucaguuugaa

SEQ ID NO: 1243671 - RNA, 19 nt, Homo sapiens
caauaacaaucaucaagca

SEQ ID NO: 1243672 - RNA, 19 nt, Homo sapiens
ucacagaagcuauaguuga

SEQ ID NO: 1243673 - RNA, 19 nt, Homo sapiens
ccuguaagcccaacacuuu

SEQ ID NO: 1243674 - RNA, 19 nt, Homo sapiens
acucugugcuuucugcuua

SEQ ID NO: 1243675 - RNA, 19 nt, Homo sapiens
aauguucucuggauggaua

SEQ ID NO: 1243676 - RNA, 19 nt, Homo sapiens
acacauuuacugcaucuua

SEQ ID NO: 1243677 - RNA, 19 nt, Homo sapiens
auacuaguccaccuuauua

SEQ ID NO: 1243678 - RNA, 19 nt, Homo sapiens
gauacuaguccaccuuauu

SEQ ID NO: 1243679 - RNA, 19 nt, Homo sapiens
uaauaaggguggaaagaag

SEQ ID NO: 1243680 - RNA, 19 nt, Homo sapiens
gugguuaaccuuccucuuu

SEQ ID NO: 1243681 - RNA, 19 nt, Homo sapiens
caacacuggguaauucuaa

SEQ ID NO: 1243682 - RNA, 19 nt, Homo sapiens
uaacaaucaucaagcaagu

SEQ ID NO: 1243683 - RNA, 19 nt, Homo sapiens
guaaaacccaucagucuua

SEQ ID NO: 1243684 - RNA, 19 nt, Homo sapiens
ggacacauuuacugcaucu

SEQ ID NO: 1243685 - RNA, 19 nt, Homo sapiens
aaagaagaguccaaauaca

SEQ ID NO: 1243686 - RNA, 19 nt, Homo sapiens
ggaaacauugcaaacuauu

SEQ ID NO: 1243687 - RNA, 19 nt, Homo sapiens
cacagaagcuauaguugau

SEQ ID NO: 1243688 - RNA, 19 nt, Homo sapiens
aaucaaauguucucuggau

SEQ ID NO: 1243689 - RNA, 19 nt, Homo sapiens
aaucuaacuugcuuuguug

SEQ ID NO: 1243690 - RNA, 19 nt, Homo sapiens
ugcauuagauguuucagaa

SEQ ID NO: 1243691 - RNA, 19 nt, Homo sapiens
cauauaaagccacguaguu

SEQ ID NO: 1243692 - RNA, 19 nt, Homo sapiens
ucuauugucucucuuaaca

SEQ ID NO: 1243693 - RNA, 19 nt, Homo sapiens
cagaugcacucaagacaca

SEQ ID NO: 1243694 - RNA, 19 nt, Homo sapiens
ccaaauacaguagcuuaaa

SEQ ID NO: 1243695 - RNA, 19 nt, Homo sapiens
cagacugcuucuuauaauu

SEQ ID NO: 1243696 - RNA, 19 nt, Homo sapiens
ggaagucuugugcauacua

SEQ ID NO: 1243697 - RNA, 19 nt, Homo sapiens
agacacaauuagcuaagaa

SEQ ID NO: 1243698 - RNA, 19 nt, Homo sapiens
ccacaucaauaccacaagu

SEQ ID NO: 1243699 - RNA, 19 nt, Homo sapiens
ggguggugauugcuuaauu

SEQ ID NO: 1243700 - RNA, 19 nt, Homo sapiens
gagaaucuaacuugcuuug

SEQ ID NO: 1243701 - RNA, 19 nt, Homo sapiens
gaaggaaaccuggaagucu

SEQ ID NO: 1243702 - RNA, 19 nt, Homo sapiens
ggaugcuaauugcuaacua

SEQ ID NO: 1243703 - RNA, 19 nt, Homo sapiens
ccugggaaaugcacagaaa

SEQ ID NO: 1243704 - RNA, 19 nt, Homo sapiens
guccaaauguaaagcuuga

SEQ ID NO: 1243705 - RNA, 19 nt, Homo sapiens
gauggauacauacugauuu

SEQ ID NO: 1243706 - RNA, 19 nt, Homo sapiens
ggauggauacauacugauu

SEQ ID NO: 1243707 - RNA, 19 nt, Homo sapiens
caaauguucucuggaugga

SEQ ID NO: 1243708 - RNA, 19 nt, Homo sapiens
cggaaacauugcaaacuau

SEQ ID NO: 1243709 - RNA, 19 nt, Homo sapiens
aagagaaucuaacuugcuu

SEQ ID NO: 1243710 - RNA, 19 nt, Homo sapiens
gaaugaaggaaaccuggaa

SEQ ID NO: 1243711 - RNA, 19 nt, Homo sapiens
gcaaaucuggaugcuaauu

SEQ ID NO: 1243712 - RNA, 19 nt, Homo sapiens
cugcaucccuaauguuuga

SEQ ID NO: 1243713 - RNA, 19 nt, Homo sapiens
aagaagucauguucaggua

SEQ ID NO: 1243714 - RNA, 19 nt, Homo sapiens
aaacccaucagucuuaauu

SEQ ID NO: 1243715 - RNA, 19 nt, Homo sapiens
gguggugauugcuuaauuc

SEQ ID NO: 1243716 - RNA, 19 nt, Homo sapiens
uagaagaacuggaagauaa

SEQ ID NO: 1243717 - RNA, 19 nt, Homo sapiens
guaaguaauucgcuagaua

SEQ ID NO: 1243718 - RNA, 19 nt, Homo sapiens
gaucagugguuacuuauga

SEQ ID NO: 1243719 - RNA, 19 nt, Homo sapiens
ccaauaagaucagugguua

SEQ ID NO: 1243720 - RNA, 19 nt, Homo sapiens
ggcaggagcuuucuggaua

SEQ ID NO: 1243721 - RNA, 19 nt, Homo sapiens
guaauucgcuagauauaga

SEQ ID NO: 1243722 - RNA, 19 nt, Homo sapiens
gagcaagacuccaucucua

SEQ ID NO: 1243723 - RNA, 19 nt, Homo sapiens
gaagagagauuaaaagguu

SEQ ID NO: 1243724 - RNA, 19 nt, Homo sapiens
gaagauaaauggugugacu

SEQ ID NO: 1243725 - RNA, 19 nt, Homo sapiens
guaagaugauugcaaguug

SEQ ID NO: 1243726 - RNA, 19 nt, Homo sapiens
ccucauaucaucugucuua

SEQ ID NO: 1243727 - RNA, 19 nt, Homo sapiens
ggaacaaacauaacacauu

SEQ ID NO: 1243728 - RNA, 19 nt, Homo sapiens
gcucauucaugucagauuu

SEQ ID NO: 1243729 - RNA, 19 nt, Homo sapiens
uaacucacuuagaccaaua

SEQ ID NO: 1243730 - RNA, 19 nt, Homo sapiens
gggaggagcaucaugagua

SEQ ID NO: 1243731 - RNA, 19 nt, Homo sapiens
caaguugucaugaagauaa

SEQ ID NO: 1243732 - RNA, 19 nt, Homo sapiens
acagagagaugaccaaugg

SEQ ID NO: 1243733 - RNA, 19 nt, Homo sapiens
gugagagaguucuggauaa

SEQ ID NO: 1243734 - RNA, 19 nt, Homo sapiens
gccauaaacagauuuguaa

SEQ ID NO: 1243735 - RNA, 19 nt, Homo sapiens
ggguauguguguuuaugua

SEQ ID NO: 1243736 - RNA, 19 nt, Homo sapiens
gaagaugccauaaacagau

SEQ ID NO: 1243737 - RNA, 19 nt, Homo sapiens
ggaggagcaucaugaguag

SEQ ID NO: 1243738 - RNA, 19 nt, Homo sapiens
gcaagacuccaucucuaaa

SEQ ID NO: 1243739 - RNA, 19 nt, Homo sapiens
uuagugaguucagguguua

SEQ ID NO: 1243740 - RNA, 19 nt, Homo sapiens
gagaugaccaauggaauuu

SEQ ID NO: 1243741 - RNA, 19 nt, Homo sapiens
acaauagcuuggugccuua

SEQ ID NO: 1243742 - RNA, 19 nt, Homo sapiens
ucacaaugauaggcauaua

SEQ ID NO: 1243743 - RNA, 19 nt, Homo sapiens
uauagagacucgauuagau

SEQ ID NO: 1243744 - RNA, 19 nt, Homo sapiens
gcacgagaauugcuugaac

SEQ ID NO: 1243745 - RNA, 19 nt, Homo sapiens
ucaguaaggaguuugauuu

SEQ ID NO: 1243746 - RNA, 19 nt, Homo sapiens
uuugagagcuaaaggauga

SEQ ID NO: 1243747 - RNA, 19 nt, Homo sapiens
ggaagaugccauaaacaga

SEQ ID NO: 1243748 - RNA, 19 nt, Homo sapiens
gaaauugugccacuaguac

SEQ ID NO: 1243749 - RNA, 19 nt, Homo sapiens
ggaggcagagguuacagua

SEQ ID NO: 1243750 - RNA, 19 nt, Homo sapiens
cauaucaucugucuuaagg

SEQ ID NO: 1243751 - RNA, 19 nt, Homo sapiens
ccagagaaauagccagugu

SEQ ID NO: 1243752 - RNA, 19 nt, Homo sapiens
ucucucauguuuccuguaa

SEQ ID NO: 1243753 - RNA, 19 nt, Homo sapiens
caugucagauuuccagaga

SEQ ID NO: 1243754 - RNA, 19 nt, Homo sapiens
ccacaagccagucaccuuu

SEQ ID NO: 1243755 - RNA, 19 nt, Homo sapiens
ugauuaagcacuuuccuaa

SEQ ID NO: 1243756 - RNA, 19 nt, Homo sapiens
caucaaguuucaccaaauc

SEQ ID NO: 1243757 - RNA, 19 nt, Homo sapiens
ccaagggucuaucagaauc

SEQ ID NO: 1243758 - RNA, 19 nt, Homo sapiens
gcagccaguuucucgaguu

SEQ ID NO: 1243759 - RNA, 19 nt, Homo sapiens
gaagauaagacagcauugu

SEQ ID NO: 1243760 - RNA, 19 nt, Homo sapiens
gauugcaaguugucaugaa

SEQ ID NO: 1243761 - RNA, 19 nt, Homo sapiens
gugguaaaguguacauaug

SEQ ID NO: 1243762 - RNA, 19 nt, Homo sapiens
agauauagagacucgauua

SEQ ID NO: 1243763 - RNA, 19 nt, Homo sapiens
gcaggagcuuucuggauag

SEQ ID NO: 1243764 - RNA, 19 nt, Homo sapiens
cuuaacaccuccacagaga

SEQ ID NO: 1243765 - RNA, 19 nt, Homo sapiens
gcaugcagaagagagauua

SEQ ID NO: 1243766 - RNA, 19 nt, Homo sapiens
cagggaccauuggauauaa

SEQ ID NO: 1243767 - RNA, 19 nt, Homo sapiens
uaagaugauugcaaguugu

SEQ ID NO: 1243768 - RNA, 19 nt, Homo sapiens
gaauccagcugugaacaag

SEQ ID NO: 1243769 - RNA, 19 nt, Homo sapiens
uggcauaaguacauuaaca

SEQ ID NO: 1243770 - RNA, 19 nt, Homo sapiens
ugcaaaaccugaaacuuua

SEQ ID NO: 1243771 - RNA, 19 nt, Homo sapiens
ccuuucagguggagaagua

SEQ ID NO: 1243772 - RNA, 19 nt, Homo sapiens
ugagagaguucuggauaau

SEQ ID NO: 1243773 - RNA, 19 nt, Homo sapiens
cgaaauugugccacuagua

SEQ ID NO: 1243774 - RNA, 19 nt, Homo sapiens
gguagaauaugcauaacac

SEQ ID NO: 1243775 - RNA, 19 nt, Homo sapiens
gugcaggucucaguaagga

SEQ ID NO: 1243776 - RNA, 19 nt, Homo sapiens
uuaagcacuuuccuaaaug

SEQ ID NO: 1243777 - RNA, 19 nt, Homo sapiens
gugaggugacccuagauua

SEQ ID NO: 1243778 - RNA, 19 nt, Homo sapiens
gaacaagccauugcugucu

SEQ ID NO: 1243779 - RNA, 19 nt, Homo sapiens
cacgugaaauuuggaguuu

SEQ ID NO: 1243780 - RNA, 19 nt, Homo sapiens
gaccauuggauauaaauuc

SEQ ID NO: 1243781 - RNA, 19 nt, Homo sapiens
ccagggaccauuggauaua

SEQ ID NO: 1243782 - RNA, 19 nt, Homo sapiens
gcagcagcguguguaaaga

SEQ ID NO: 1243783 - RNA, 19 nt, Homo sapiens
ucauaaacuucuccaucaa

SEQ ID NO: 1243784 - RNA, 19 nt, Homo sapiens
aagauaagacagcauugua

SEQ ID NO: 1243785 - RNA, 19 nt, Homo sapiens
gguaaaguguacauaugca

SEQ ID NO: 1243786 - RNA, 19 nt, Homo sapiens
gauuaagcacuuuccuaaa

SEQ ID NO: 1243787 - RNA, 19 nt, Homo sapiens
gaggugacccuagauuaga

SEQ ID NO: 1243788 - RNA, 19 nt, Homo sapiens
gguaagaugauugcaaguu

SEQ ID NO: 1243789 - RNA, 19 nt, Homo sapiens
ccuagcauuucuucuuuau

SEQ ID NO: 1243790 - RNA, 19 nt, Homo sapiens
caaguuucaccaaaucauu

SEQ ID NO: 1243791 - RNA, 19 nt, Homo sapiens
ccaucaaguuucaccaaau

SEQ ID NO: 1243792 - RNA, 19 nt, Homo sapiens
acaagccauugcugucuuu

SEQ ID NO: 1243793 - RNA, 19 nt, Homo sapiens
cagccaguuucucgaguuu

SEQ ID NO: 1243794 - RNA, 19 nt, Homo sapiens
ggccgaggcacgagaauug

SEQ ID NO: 1243795 - RNA, 19 nt, Homo sapiens
uuggcuagauacacuauuu

SEQ ID NO: 1243796 - RNA, 19 nt, Homo sapiens
gaagaacuggaagauaaau

SEQ ID NO: 1243797 - RNA, 19 nt, Homo sapiens
gcaaguugucaugaagaua

SEQ ID NO: 1243798 - RNA, 19 nt, Homo sapiens
caacaucccaaacugaaag

SEQ ID NO: 1243799 - RNA, 19 nt, Homo sapiens
ccauccaucuccagaacuu

SEQ ID NO: 1243800 - RNA, 19 nt, Homo sapiens
uaacaccuccacagagaga

SEQ ID NO: 1243801 - RNA, 19 nt, Homo sapiens
aagaugccauaaacagauu

SEQ ID NO: 1243802 - RNA, 19 nt, Homo sapiens
uggugugacugcagaauga

SEQ ID NO: 1243803 - RNA, 19 nt, Homo sapiens
ugugguagaauaugcauaa

SEQ ID NO: 1243804 - RNA, 19 nt, Homo sapiens
agagaugaccaauggaauu

SEQ ID NO: 1243805 - RNA, 19 nt, Homo sapiens
cagaauccuaacucacuua

SEQ ID NO: 1243806 - RNA, 19 nt, Homo sapiens
ucagaauccuaacucacuu

SEQ ID NO: 1243807 - RNA, 19 nt, Homo sapiens
ggagggaggcaggagcuuu

SEQ ID NO: 1243808 - RNA, 19 nt, Homo sapiens
ugugagagaguucuggaua

SEQ ID NO: 1243809 - RNA, 19 nt, Homo sapiens
ggugguaaaguguacauau

SEQ ID NO: 1243810 - RNA, 19 nt, Homo sapiens
ugucuuaaggucacagaua

SEQ ID NO: 1243811 - RNA, 19 nt, Homo sapiens
acaguaaaccgaaauugug

SEQ ID NO: 1243812 - RNA, 19 nt, Homo sapiens
cacaaugauaggcauauaa

SEQ ID NO: 1243813 - RNA, 19 nt, Homo sapiens
guauguguguuuauguaca

SEQ ID NO: 1243814 - RNA, 19 nt, Homo sapiens
gaacgggaggagcaucaug

SEQ ID NO: 1243815 - RNA, 19 nt, Homo sapiens
gaguugggcagcacacuug

SEQ ID NO: 1243816 - RNA, 19 nt, Homo sapiens
gcaaaugaaugucaaguua

SEQ ID NO: 1243817 - RNA, 19 nt, Homo sapiens
gaauauagcagaaagacua

SEQ ID NO: 1243818 - RNA, 19 nt, Homo sapiens
gagcauuucugcacuggua

SEQ ID NO: 1243819 - RNA, 19 nt, Homo sapiens
gcacacaaaugcaucuuuc

SEQ ID NO: 1243820 - RNA, 19 nt, Homo sapiens
uaaauuaagugggucagua

SEQ ID NO: 1243821 - RNA, 19 nt, Homo sapiens
acaaaugcaucuuucgaua

SEQ ID NO: 1243822 - RNA, 19 nt, Homo sapiens
gaauguagaccuaauugaa

SEQ ID NO: 1243823 - RNA, 19 nt, Homo sapiens
gaacucaaaucaggcaaga

SEQ ID NO: 1243824 - RNA, 19 nt, Homo sapiens
uaugauauaugccaucgua

SEQ ID NO: 1243825 - RNA, 19 nt, Homo sapiens
caaauggcguuguucuuga

SEQ ID NO: 1243826 - RNA, 19 nt, Homo sapiens
gaggcacucuguucaguuu

SEQ ID NO: 1243827 - RNA, 19 nt, Homo sapiens
ggaagugaaugcagcaauc

SEQ ID NO: 1243828 - RNA, 19 nt, Homo sapiens
caucgucucugcugacaaa

SEQ ID NO: 1243829 - RNA, 19 nt, Homo sapiens
ggaggaugcugccaacaau

SEQ ID NO: 1243830 - RNA, 19 nt, Homo sapiens
ggagccaacuguuauagau

SEQ ID NO: 1243831 - RNA, 19 nt, Homo sapiens
caucaccacugcuugcuuu

SEQ ID NO: 1243832 - RNA, 19 nt, Homo sapiens
ggaacucuauugccuggaa

SEQ ID NO: 1243833 - RNA, 19 nt, Homo sapiens
ggagagggacuaugaggaa

SEQ ID NO: 1243834 - RNA, 19 nt, Homo sapiens
ggacaacgaggccgucuau

SEQ ID NO: 1243835 - RNA, 19 nt, Homo sapiens
guacaagucagcucugcua

SEQ ID NO: 1243836 - RNA, 19 nt, Homo sapiens
ccacaaguuugaccucaug

SEQ ID NO: 1243837 - RNA, 19 nt, Homo sapiens
ggguuuacgucucucuuaa

SEQ ID NO: 1243838 - RNA, 19 nt, Homo sapiens
gacaagagcugggaagcau

SEQ ID NO: 1243839 - RNA, 19 nt, Homo sapiens
uaugaugggugcaaaugaa

SEQ ID NO: 1243840 - RNA, 19 nt, Homo sapiens
ggaaguggcgcaaaguuuc

SEQ ID NO: 1243841 - RNA, 19 nt, Homo sapiens
gaaagacuaagcuggaguu

SEQ ID NO: 1243842 - RNA, 19 nt, Homo sapiens
agacuaagcuggaguucuc

SEQ ID NO: 1243843 - RNA, 19 nt, Homo sapiens
cagcacauguugauuacga

SEQ ID NO: 1243844 - RNA, 19 nt, Homo sapiens
gaagggcacguucucauca

SEQ ID NO: 1243845 - RNA, 19 nt, Homo sapiens
ugacaaagccuaccaugag

SEQ ID NO: 1243846 - RNA, 19 nt, Homo sapiens
caacgaggccgucuaugau

SEQ ID NO: 1243847 - RNA, 19 nt, Homo sapiens
gcacugguaccucagagaa

SEQ ID NO: 1243848 - RNA, 19 nt, Homo sapiens
ccaaauggcguuguucuug

SEQ ID NO: 1243849 - RNA, 19 nt, Homo sapiens
gggagccuuuggaagcuua

SEQ ID NO: 1243850 - RNA, 19 nt, Homo sapiens
caaaguuucugaggcaugu

SEQ ID NO: 1243851 - RNA, 19 nt, Homo sapiens
uaaacucgguguugaaugc

SEQ ID NO: 1243852 - RNA, 19 nt, Homo sapiens
uuacgucucucuuaaugga

SEQ ID NO: 1243853 - RNA, 19 nt, Homo sapiens
gcacucuguucaguuugua

SEQ ID NO: 1243854 - RNA, 19 nt, Homo sapiens
gcccuugaauguagaccua

SEQ ID NO: 1243855 - RNA, 19 nt, Homo sapiens
ggugguaucuuccaucacu

SEQ ID NO: 1243856 - RNA, 19 nt, Homo sapiens
gaagcuggcagaacagugu

SEQ ID NO: 1243857 - RNA, 19 nt, Homo sapiens
aagagacaaugaaauccua

SEQ ID NO: 1243858 - RNA, 19 nt, Homo sapiens
gacucuagguuccacacua

SEQ ID NO: 1243859 - RNA, 19 nt, Homo sapiens
guuuacgucucucuuaaug

SEQ ID NO: 1243860 - RNA, 19 nt, Homo sapiens
acaacgaggccgucuauga

SEQ ID NO: 1243861 - RNA, 19 nt, Homo sapiens
gauaccuucuucugugaga

SEQ ID NO: 1243862 - RNA, 19 nt, Homo sapiens
caugagcaguucucugugu

SEQ ID NO: 1243863 - RNA, 19 nt, Homo sapiens
acucuagguuccacacuaa

SEQ ID NO: 1243864 - RNA, 19 nt, Homo sapiens
gugguggacuucagggauu

SEQ ID NO: 1243865 - RNA, 19 nt, Homo sapiens
uagguuccacacuaaauua

SEQ ID NO: 1243866 - RNA, 19 nt, Homo sapiens
ccuuugaacugcugaguca

SEQ ID NO: 1243867 - RNA, 19 nt, Homo sapiens
cacauuauuuccuggucua

SEQ ID NO: 1243868 - RNA, 19 nt, Homo sapiens
ggaagggcacguucucauc

SEQ ID NO: 1243869 - RNA, 19 nt, Homo sapiens
ugauauaugccaucguaaa

SEQ ID NO: 1243870 - RNA, 19 nt, Homo sapiens
aggaugcugccaacaauua

SEQ ID NO: 1243871 - RNA, 19 nt, Homo sapiens
guuccacacuaaauuaagu

SEQ ID NO: 1243872 - RNA, 19 nt, Homo sapiens
guucaggguuuacgucucu

SEQ ID NO: 1243873 - RNA, 19 nt, Homo sapiens
gaggaaguggcgcaaaguu

SEQ ID NO: 1243874 - RNA, 19 nt, Homo sapiens
caggugguaucuuccauca

SEQ ID NO: 1243875 - RNA, 19 nt, Homo sapiens
gacaaugaaauccuaaagu

SEQ ID NO: 1243876 - RNA, 19 nt, Homo sapiens
gagggacuaugaggaagug

SEQ ID NO: 1243877 - RNA, 19 nt, Homo sapiens
gggagugccuuuccaucca

SEQ ID NO: 1243878 - RNA, 19 nt, Homo sapiens
ccucagagaaggcauggaa

SEQ ID NO: 1243879 - RNA, 19 nt, Homo sapiens
gauauaugccaucguaaac

SEQ ID NO: 1243880 - RNA, 19 nt, Homo sapiens
cgaggccgucuaugauaua

SEQ ID NO: 1243881 - RNA, 19 nt, Homo sapiens
ucaacaggaucagcuggaa

SEQ ID NO: 1243882 - RNA, 19 nt, Homo sapiens
ggagaauauagcagaaaga

SEQ ID NO: 1243883 - RNA, 19 nt, Homo sapiens
gaggcucacaggagaauau

SEQ ID NO: 1243884 - RNA, 19 nt, Homo sapiens
caacaggaucagcuggaaa

SEQ ID NO: 1243885 - RNA, 19 nt, Homo sapiens
ggucaguaccaacaaugaa

SEQ ID NO: 1243886 - RNA, 19 nt, Homo sapiens
caagucagcucugcuaccu

SEQ ID NO: 1243887 - RNA, 19 nt, Homo sapiens
gcguuguucuugacacuca

SEQ ID NO: 1243888 - RNA, 19 nt, Homo sapiens
ucagagaaggcauggaaga

SEQ ID NO: 1243889 - RNA, 19 nt, Homo sapiens
ggccgucuaugauauaugc

SEQ ID NO: 1243890 - RNA, 19 nt, Homo sapiens
ggcacugguucaggguuua

SEQ ID NO: 1243891 - RNA, 19 nt, Homo sapiens
cccggaagcuggcagaaca

SEQ ID NO: 1243892 - RNA, 19 nt, Homo sapiens
ucgauaccuucuucuguga

SEQ ID NO: 1243893 - RNA, 19 nt, Homo sapiens
gagacaaugaaauccuaaa

SEQ ID NO: 1243894 - RNA, 19 nt, Homo sapiens
gaacugcugagucacuucu

SEQ ID NO: 1243895 - RNA, 19 nt, Homo sapiens
gcaacaccacggcgauugu

SEQ ID NO: 1243896 - RNA, 19 nt, Homo sapiens
caaggugggcaucaacaau

SEQ ID NO: 1243897 - RNA, 19 nt, Homo sapiens
gaggccgucuaugauauau

SEQ ID NO: 1243898 - RNA, 19 nt, Homo sapiens
guaccuucaugguggacaa

SEQ ID NO: 1243899 - RNA, 19 nt, Homo sapiens
caaaugcaucuuucgauac

SEQ ID NO: 1243900 - RNA, 19 nt, Homo sapiens
acaggagaauauagcagaa

SEQ ID NO: 1243901 - RNA, 19 nt, Homo sapiens
ccagcaccguucacucuuc

SEQ ID NO: 1243902 - RNA, 19 nt, Homo sapiens
aagcuuagaguccuuugaa

SEQ ID NO: 1243903 - RNA, 19 nt, Homo sapiens
gaagcuuagaguccuuuga

SEQ ID NO: 1243904 - RNA, 19 nt, Homo sapiens
gagcaacaccacggcgauu

SEQ ID NO: 1243905 - RNA, 19 nt, Homo sapiens
uauaugccaucguaaacuc

SEQ ID NO: 1243906 - RNA, 19 nt, Homo sapiens
caagagcugggaagcaugu

SEQ ID NO: 1243907 - RNA, 19 nt, Homo sapiens
gaacagugugguggacuuc

SEQ ID NO: 1243908 - RNA, 19 nt, Homo sapiens
gaggaugcugccaacaauu

SEQ ID NO: 1243909 - RNA, 19 nt, Homo sapiens
uuaagugggucaguaccaa

SEQ ID NO: 1243910 - RNA, 19 nt, Homo sapiens
caaaucaggcaagacucua

SEQ ID NO: 1243911 - RNA, 19 nt, Homo sapiens
caucguaaacucgguguug

SEQ ID NO: 1243912 - RNA, 19 nt, Homo sapiens
gcacauguugauuacgaau

SEQ ID NO: 1243913 - RNA, 19 nt, Homo sapiens
gaugggugcaaaugaaugu

SEQ ID NO: 1243914 - RNA, 19 nt, Homo sapiens
guaugaugggugcaaauga

SEQ ID NO: 1243915 - RNA, 19 nt, Homo sapiens
gaaguggcgcaaaguuucu

SEQ ID NO: 1243916 - RNA, 19 nt, Homo sapiens
gaacauuucuacuggauua

SEQ ID NO: 1243917 - RNA, 19 nt, Homo sapiens
gaaagacccuauaaaugua

SEQ ID NO: 1243918 - RNA, 19 nt, Homo sapiens
uaaagaagauggucaguau

SEQ ID NO: 1243919 - RNA, 19 nt, Homo sapiens
gaaccuggcuucuguagga

SEQ ID NO: 1243920 - RNA, 19 nt, Homo sapiens
ggaaagaccagaauauuga

SEQ ID NO: 1243921 - RNA, 19 nt, Homo sapiens
gguaaagcauucacuguuu

SEQ ID NO: 1243922 - RNA, 19 nt, Homo sapiens
ggagaaagacccuauaaau

SEQ ID NO: 1243923 - RNA, 19 nt, Homo sapiens
gaagagggcugguugaaac

SEQ ID NO: 1243924 - RNA, 19 nt, Homo sapiens
gauaaagccuucagcuguu

SEQ ID NO: 1243925 - RNA, 19 nt, Homo sapiens
gagaaagacccuauaaaug

SEQ ID NO: 1243926 - RNA, 19 nt, Homo sapiens
ggaaugggcuuugcuagau

SEQ ID NO: 1243927 - RNA, 19 nt, Homo sapiens
gaaacccugucuuuacaaa

SEQ ID NO: 1243928 - RNA, 19 nt, Homo sapiens
gagaaacccuaugaaugua

SEQ ID NO: 1243929 - RNA, 19 nt, Homo sapiens
ggauguggcugugaacuuu

SEQ ID NO: 1243930 - RNA, 19 nt, Homo sapiens
guacgucauucccucuuua

SEQ ID NO: 1243931 - RNA, 19 nt, Homo sapiens
gaagacacaugauaaugca

SEQ ID NO: 1243932 - RNA, 19 nt, Homo sapiens
gagaaacccuacgaaugua

SEQ ID NO: 1243933 - RNA, 19 nt, Homo sapiens
gaaacccuaugaauguaaa

SEQ ID NO: 1243934 - RNA, 19 nt, Homo sapiens
gagagaagcaauauaaaug

SEQ ID NO: 1243935 - RNA, 19 nt, Homo sapiens
guaggaaccuggcuucugu

SEQ ID NO: 1243936 - RNA, 19 nt, Homo sapiens
gagagaaacccuaugaaug

SEQ ID NO: 1243937 - RNA, 19 nt, Homo sapiens
gaaacaaccugggcaacau

SEQ ID NO: 1243938 - RNA, 19 nt, Homo sapiens
agaaagacccuauaaaugu

SEQ ID NO: 1243939 - RNA, 19 nt, Homo sapiens
gaaauccagcuuauaaaug

SEQ ID NO: 1243940 - RNA, 19 nt, Homo sapiens
gaucugaacgagaacauuu

SEQ ID NO: 1243941 - RNA, 19 nt, Homo sapiens
gagagaaacccuacgaaug

SEQ ID NO: 1243942 - RNA, 19 nt, Homo sapiens
ggaaauccagcuuauaaau

SEQ ID NO: 1243943 - RNA, 19 nt, Homo sapiens
ggagagaagcaauauaaau

SEQ ID NO: 1243944 - RNA, 19 nt, Homo sapiens
ccaugugaaugcaguauuu

SEQ ID NO: 1243945 - RNA, 19 nt, Homo sapiens
gaaguugucagccaaauuc

SEQ ID NO: 1243946 - RNA, 19 nt, Homo sapiens
gguaaagccuacacucguu

SEQ ID NO: 1243947 - RNA, 19 nt, Homo sapiens
ggagagaaacccuaugaau

SEQ ID NO: 1243948 - RNA, 19 nt, Homo sapiens
gagaagcaauauaaaugug

SEQ ID NO: 1243949 - RNA, 19 nt, Homo sapiens
gaaugggcuuugcuagauu

SEQ ID NO: 1243950 - RNA, 19 nt, Homo sapiens
guucuugucuaauacauga

SEQ ID NO: 1243951 - RNA, 19 nt, Homo sapiens
gaaagaagucaugauauag

SEQ ID NO: 1243952 - RNA, 19 nt, Homo sapiens
ggagagagacccuaugagu

SEQ ID NO: 1243953 - RNA, 19 nt, Homo sapiens
guaaagcauucacuguuuc

SEQ ID NO: 1243954 - RNA, 19 nt, Homo sapiens
uaaacaaugugguaaagca

SEQ ID NO: 1243955 - RNA, 19 nt, Homo sapiens
gcucaguccucuucuguuc

SEQ ID NO: 1243956 - RNA, 19 nt, Homo sapiens
gagacugugugaaaguaaa

SEQ ID NO: 1243957 - RNA, 19 nt, Homo sapiens
ucagaagaaucucuacaga

SEQ ID NO: 1243958 - RNA, 19 nt, Homo sapiens
gugaaacccugucuuuaca

SEQ ID NO: 1243959 - RNA, 19 nt, Homo sapiens
guuagaagacacaugauaa

SEQ ID NO: 1243960 - RNA, 19 nt, Homo sapiens
cgucauucccucuuuaaua

SEQ ID NO: 1243961 - RNA, 19 nt, Homo sapiens
agagaaacccuaugaaugu

SEQ ID NO: 1243962 - RNA, 19 nt, Homo sapiens
guaaagaagauggucagua

SEQ ID NO: 1243963 - RNA, 19 nt, Homo sapiens
gagagacccuaugagugua

SEQ ID NO: 1243964 - RNA, 19 nt, Homo sapiens
ggagagaaacccuacgaau

SEQ ID NO: 1243965 - RNA, 19 nt, Homo sapiens
gucauucccucuuuaauag

SEQ ID NO: 1243966 - RNA, 19 nt, Homo sapiens
cagagacugugugaaagua

SEQ ID NO: 1243967 - RNA, 19 nt, Homo sapiens
agagaaacccuacgaaugu

SEQ ID NO: 1243968 - RNA, 19 nt, Homo sapiens
gaaagaccagaauauugaa

SEQ ID NO: 1243969 - RNA, 19 nt, Homo sapiens
gggcuuugcuagauucuuc

SEQ ID NO: 1243970 - RNA, 19 nt, Homo sapiens
gagaagugaugcaggaaac

SEQ ID NO: 1243971 - RNA, 19 nt, Homo sapiens
aaccauagaaguacucaua

SEQ ID NO: 1243972 - RNA, 19 nt, Homo sapiens
guagugacucagccuauaa

SEQ ID NO: 1243973 - RNA, 19 nt, Homo sapiens
gaacucacacuggagagaa

SEQ ID NO: 1243974 - RNA, 19 nt, Homo sapiens
caaaccauauggagagaag

SEQ ID NO: 1243975 - RNA, 19 nt, Homo sapiens
ggaggaaugggcuuugcua

SEQ ID NO: 1243976 - RNA, 19 nt, Homo sapiens
ugugggaaauucuucguuu

SEQ ID NO: 1243977 - RNA, 19 nt, Homo sapiens
gaacuuuacccaggaggaa

SEQ ID NO: 1243978 - RNA, 19 nt, Homo sapiens
ggugaaacccugucuuuac

SEQ ID NO: 1243979 - RNA, 19 nt, Homo sapiens
gaauguaaacaaugugauc

SEQ ID NO: 1243980 - RNA, 19 nt, Homo sapiens
gagaagagggcugguugaa

SEQ ID NO: 1243981 - RNA, 19 nt, Homo sapiens
gcaggagaauggcaugaac

SEQ ID NO: 1243982 - RNA, 19 nt, Homo sapiens
gaaaccccgucucuacuaa

SEQ ID NO: 1243983 - RNA, 19 nt, Homo sapiens
cguuugaguucccuuugua

SEQ ID NO: 1243984 - RNA, 19 nt, Homo sapiens
guaggaagccaauggaaag

SEQ ID NO: 1243985 - RNA, 19 nt, Homo sapiens
ggccaaggcguguggauug

SEQ ID NO: 1243986 - RNA, 19 nt, Homo sapiens
ccuauaaucccagcacuuu

SEQ ID NO: 1243987 - RNA, 19 nt, Homo sapiens
agagagacccuaugagugu

SEQ ID NO: 1243988 - RNA, 19 nt, Homo sapiens
gauaaugcacaguggaaau

SEQ ID NO: 1243989 - RNA, 19 nt, Homo sapiens
uuccaaaucuugaucugaa

SEQ ID NO: 1243990 - RNA, 19 nt, Homo sapiens
gagaaguugucagccaaau

SEQ ID NO: 1243991 - RNA, 19 nt, Homo sapiens
caauggaaagaccagaaua

SEQ ID NO: 1243992 - RNA, 19 nt, Homo sapiens
uguagugacucagccuaua

SEQ ID NO: 1243993 - RNA, 19 nt, Homo sapiens
uaccauggaagcauucaua

SEQ ID NO: 1243994 - RNA, 19 nt, Homo sapiens
gacucacacuggagaaaga

SEQ ID NO: 1243995 - RNA, 19 nt, Homo sapiens
cauauggagagaagcaaua

SEQ ID NO: 1243996 - RNA, 19 nt, Homo sapiens
cuacgaauguaaggaaugu

SEQ ID NO: 1243997 - RNA, 19 nt, Homo sapiens
ugaaagacaucagagaacu

SEQ ID NO: 1243998 - RNA, 19 nt, Homo sapiens
gaaugcaguauuuguggaa

SEQ ID NO: 1243999 - RNA, 19 nt, Homo sapiens
uggaaagaccagaauauug

SEQ ID NO: 1244000 - RNA, 19 nt, Homo sapiens
ggagaagagggcugguuga

SEQ ID NO: 1244001 - RNA, 19 nt, Homo sapiens
ucuaauacaugaacgaacu

SEQ ID NO: 1244002 - RNA, 19 nt, Homo sapiens
guugaaagacaucagagaa

SEQ ID NO: 1244003 - RNA, 19 nt, Homo sapiens
ucaccuuacucgccaugaa

SEQ ID NO: 1244004 - RNA, 19 nt, Homo sapiens
uuccgguucuugucuaaua

SEQ ID NO: 1244005 - RNA, 19 nt, Homo sapiens
gaacagugugggaaauucu

SEQ ID NO: 1244006 - RNA, 19 nt, Homo sapiens
uguaagaaaugcgguaaag

SEQ ID NO: 1244007 - RNA, 19 nt, Homo sapiens
gauguggcugugaacuuua

SEQ ID NO: 1244008 - RNA, 19 nt, Homo sapiens
caaggcguguggauugcuu

SEQ ID NO: 1244009 - RNA, 19 nt, Homo sapiens
cauggaagcauucauacug

SEQ ID NO: 1244010 - RNA, 19 nt, Homo sapiens
ggagaaguugucagccaaa

SEQ ID NO: 1244011 - RNA, 19 nt, Homo sapiens
ccacuucccuucguuacca

SEQ ID NO: 1244012 - RNA, 19 nt, Homo sapiens
gccuucagcuguuccacuu

SEQ ID NO: 1244013 - RNA, 19 nt, Homo sapiens
cagccaaauuccaaaucuu

SEQ ID NO: 1244014 - RNA, 19 nt, Homo sapiens
ugaacagugugggaaauuc

SEQ ID NO: 1244015 - RNA, 19 nt, Homo sapiens
auggagagaagcaauauaa

SEQ ID NO: 1244016 - RNA, 19 nt, Homo sapiens
gcgaggagguugaagauga

SEQ ID NO: 1244017 - RNA, 19 nt, Homo sapiens
uaucacagauucucacaaa

SEQ ID NO: 1244018 - RNA, 19 nt, Homo sapiens
caagaaauuugccucgaaa

SEQ ID NO: 1244019 - RNA, 19 nt, Homo sapiens
agaacuggcucaagaaauu

SEQ ID NO: 1244020 - RNA, 19 nt, Homo sapiens
ugaacggccuccucuauaa

SEQ ID NO: 1244021 - RNA, 19 nt, Homo sapiens
acaagcagauuauggagua

SEQ ID NO: 1244022 - RNA, 19 nt, Homo sapiens
gagaggagguggcagaaca

SEQ ID NO: 1244023 - RNA, 19 nt, Homo sapiens
caagggaaaugcagcucua

SEQ ID NO: 1244024 - RNA, 19 nt, Homo sapiens
caggacagcucccucaaga

SEQ ID NO: 1244025 - RNA, 19 nt, Homo sapiens
acagcucccucaagaguua

SEQ ID NO: 1244026 - RNA, 19 nt, Homo sapiens
ucaagaaauuugccucgaa

SEQ ID NO: 1244027 - RNA, 19 nt, Homo sapiens
ccacagagccgaccacaag

SEQ ID NO: 1244028 - RNA, 19 nt, Homo sapiens
ggacagcucccucaagagu

SEQ ID NO: 1244029 - RNA, 19 nt, Homo sapiens
gcagguggcugagcugaca

SEQ ID NO: 1244030 - RNA, 19 nt, Homo sapiens
uuacaaaccauccaaguug

SEQ ID NO: 1244031 - RNA, 19 nt, Homo sapiens
gaacuggcucaagaaauuu

SEQ ID NO: 1244032 - RNA, 19 nt, Homo sapiens
gcaagaacuggcucaagaa

SEQ ID NO: 1244033 - RNA, 19 nt, Homo sapiens
uuaaauggccaucuuauca

SEQ ID NO: 1244034 - RNA, 19 nt, Homo sapiens
aaacacaauuugcuacaca

SEQ ID NO: 1244035 - RNA, 19 nt, Homo sapiens
ugcaagaacuggcucaaga

SEQ ID NO: 1244036 - RNA, 19 nt, Homo sapiens
cagcagacccugaggaaug

SEQ ID NO: 1244037 - RNA, 19 nt, Homo sapiens
ggcaguugauggaguuaaa

SEQ ID NO: 1244038 - RNA, 19 nt, Homo sapiens
gcacuguguguaauuuaaa

SEQ ID NO: 1244039 - RNA, 19 nt, Homo sapiens
uaaaccaucugcucuucug

SEQ ID NO: 1244040 - RNA, 19 nt, Homo sapiens
caagaacuggcucaagaaa

SEQ ID NO: 1244041 - RNA, 19 nt, Homo sapiens
ccucaagaguuaccuguca

SEQ ID NO: 1244042 - RNA, 19 nt, Homo sapiens
ccgcgaugcugcgcuauuu

SEQ ID NO: 1244043 - RNA, 19 nt, Homo sapiens
ugaggcaguugauggaguu

SEQ ID NO: 1244044 - RNA, 19 nt, Homo sapiens
gcucugcugucuccugcaa

SEQ ID NO: 1244045 - RNA, 19 nt, Homo sapiens
gauaguguuuguucaagac

SEQ ID NO: 1244046 - RNA, 19 nt, Homo sapiens
cgauaguguuuguucaaga

SEQ ID NO: 1244047 - RNA, 19 nt, Homo sapiens
acaauuugcuacacaaguc

SEQ ID NO: 1244048 - RNA, 19 nt, Homo sapiens
ggaguuggaggcagagaga

SEQ ID NO: 1244049 - RNA, 19 nt, Homo sapiens
ugugugggaucgaucauga

SEQ ID NO: 1244050 - RNA, 19 nt, Homo sapiens
caggagcuguaugaccuua

SEQ ID NO: 1244051 - RNA, 19 nt, Homo sapiens
caaguuggaauuccucaug

SEQ ID NO: 1244052 - RNA, 19 nt, Homo sapiens
caugcacuguguguaauuu

SEQ ID NO: 1244053 - RNA, 19 nt, Homo sapiens
guuaaaccaucugcucuuc

SEQ ID NO: 1244054 - RNA, 19 nt, Homo sapiens
ucacucgacuuacaaacca

SEQ ID NO: 1244055 - RNA, 19 nt, Homo sapiens
gaacggccuccucuauaag

SEQ ID NO: 1244056 - RNA, 19 nt, Homo sapiens
gcucugcccaucccacauu

SEQ ID NO: 1244057 - RNA, 19 nt, Homo sapiens
ggaaugugccaccgauagu

SEQ ID NO: 1244058 - RNA, 19 nt, Homo sapiens
ugagucaggagcuguauga

SEQ ID NO: 1244059 - RNA, 19 nt, Homo sapiens
cuacacaagucacuguuuu

SEQ ID NO: 1244060 - RNA, 19 nt, Homo sapiens
gagcaagcagggaguagau

SEQ ID NO: 1244061 - RNA, 19 nt, Homo sapiens
ggagcuguaugaccuuaac

SEQ ID NO: 1244062 - RNA, 19 nt, Homo sapiens
cagcauguggcuucauuga

SEQ ID NO: 1244063 - RNA, 19 nt, Homo sapiens
gcgcacaugaggcaccuuu

SEQ ID NO: 1244064 - RNA, 19 nt, Homo sapiens
ugcacuguguguaauuuaa

SEQ ID NO: 1244065 - RNA, 19 nt, Homo sapiens
cugaacggccuccucuaua

SEQ ID NO: 1244066 - RNA, 19 nt, Homo sapiens
gcuacacaagucacuguuu

SEQ ID NO: 1244067 - RNA, 19 nt, Homo sapiens
gguaugaaaguccuuccuu

SEQ ID NO: 1244068 - RNA, 19 nt, Homo sapiens
aaauggccaucuuaucaca

SEQ ID NO: 1244069 - RNA, 19 nt, Homo sapiens
caucugcucuucugcuacu

SEQ ID NO: 1244070 - RNA, 19 nt, Homo sapiens
cgcagcauguggcuucauu

SEQ ID NO: 1244071 - RNA, 19 nt, Homo sapiens
gaggaaugugccaccgaua

SEQ ID NO: 1244072 - RNA, 19 nt, Homo sapiens
uggguucucacucgacuua

SEQ ID NO: 1244073 - RNA, 19 nt, Homo sapiens
gaggcuguccugcagagaa

SEQ ID NO: 1244074 - RNA, 19 nt, Homo sapiens
ggagcaagcagggaguaga

SEQ ID NO: 1244075 - RNA, 19 nt, Homo sapiens
accacaagcuccagucugu

SEQ ID NO: 1244076 - RNA, 19 nt, Homo sapiens
ccaccgauaguguuuguuc

SEQ ID NO: 1244077 - RNA, 19 nt, Homo sapiens
aaguuggaauuccucauga

SEQ ID NO: 1244078 - RNA, 19 nt, Homo sapiens
gggaugaaagagacaacuu

SEQ ID NO: 1244079 - RNA, 19 nt, Homo sapiens
cgagcguacuggaagacaa

SEQ ID NO: 1244080 - RNA, 19 nt, Homo sapiens
gaaugugccaccgauagug

SEQ ID NO: 1244081 - RNA, 19 nt, Homo sapiens
gguucucacucgacuuaca

SEQ ID NO: 1244082 - RNA, 19 nt, Homo sapiens
acaaaaggaggaaagauaa

SEQ ID NO: 1244083 - RNA, 19 nt, Homo sapiens
gcacgcaacgcagcaugug

SEQ ID NO: 1244084 - RNA, 19 nt, Homo sapiens
gcaggacagcucccucaag

SEQ ID NO: 1244085 - RNA, 19 nt, Homo sapiens
gcacaugaggcaccuuuug

SEQ ID NO: 1244086 - RNA, 19 nt, Homo sapiens
cgacuuacaaaccauccaa

SEQ ID NO: 1244087 - RNA, 19 nt, Homo sapiens
ucuauaaggcacugacaga

SEQ ID NO: 1244088 - RNA, 19 nt, Homo sapiens
ccugaacggccuccucuau

SEQ ID NO: 1244089 - RNA, 19 nt, Homo sapiens
gagagaggagguggcagaa

SEQ ID NO: 1244090 - RNA, 19 nt, Homo sapiens
uacaaaaggaggaaagaua

SEQ ID NO: 1244091 - RNA, 19 nt, Homo sapiens
gcagauuauggaguacaaa

SEQ ID NO: 1244092 - RNA, 19 nt, Homo sapiens
ucugcugucuccugcaaga

SEQ ID NO: 1244093 - RNA, 19 nt, Homo sapiens
cuuacaaaccauccaaguu

SEQ ID NO: 1244094 - RNA, 19 nt, Homo sapiens
cgaggagguugaagaugac

SEQ ID NO: 1244095 - RNA, 19 nt, Homo sapiens
cuucugcuacuucaacauu

SEQ ID NO: 1244096 - RNA, 19 nt, Homo sapiens
caaaaggaggaaagauaaa

SEQ ID NO: 1244097 - RNA, 19 nt, Homo sapiens
gaagaaaguuuaccugaaa

SEQ ID NO: 1244098 - RNA, 19 nt, Homo sapiens
gaagauaaauggcaucaaa

SEQ ID NO: 1244099 - RNA, 19 nt, Homo sapiens
cacaacagcuaaagaauua

SEQ ID NO: 1244100 - RNA, 19 nt, Homo sapiens
acaccaagcugaaagguua

SEQ ID NO: 1244101 - RNA, 19 nt, Homo sapiens
gaaagugaaucccaacuca

SEQ ID NO: 1244102 - RNA, 19 nt, Homo sapiens
caucaaaucugacucauca

SEQ ID NO: 1244103 - RNA, 19 nt, Homo sapiens
gaaaggcucucaguuuguu

SEQ ID NO: 1244104 - RNA, 19 nt, Homo sapiens
gaacaaccuuaaugaacuu

SEQ ID NO: 1244105 - RNA, 19 nt, Homo sapiens
caacaaagccugaaucgau

SEQ ID NO: 1244106 - RNA, 19 nt, Homo sapiens
gaacacuggucucaauaug

SEQ ID NO: 1244107 - RNA, 19 nt, Homo sapiens
gaauuggagcugaauaaua

SEQ ID NO: 1244108 - RNA, 19 nt, Homo sapiens
cagaaaggcucucaguuug

SEQ ID NO: 1244109 - RNA, 19 nt, Homo sapiens
gcagaaggcuuuggaauac

SEQ ID NO: 1244110 - RNA, 19 nt, Homo sapiens
gacaagacgucuauucaga

SEQ ID NO: 1244111 - RNA, 19 nt, Homo sapiens
gcacaacagcuaaagaauu

SEQ ID NO: 1244112 - RNA, 19 nt, Homo sapiens
aaagaaaccuccaauacau

SEQ ID NO: 1244113 - RNA, 19 nt, Homo sapiens
caagcucacuuugggauua

SEQ ID NO: 1244114 - RNA, 19 nt, Homo sapiens
gacccgaacuggaagagua

SEQ ID NO: 1244115 - RNA, 19 nt, Homo sapiens
caaaguccuucacaucgua

SEQ ID NO: 1244116 - RNA, 19 nt, Homo sapiens
gaaauuccauucuucuucu

SEQ ID NO: 1244117 - RNA, 19 nt, Homo sapiens
ccagaaaggcucucaguuu

SEQ ID NO: 1244118 - RNA, 19 nt, Homo sapiens
gaaagagaguccacagagu

SEQ ID NO: 1244119 - RNA, 19 nt, Homo sapiens
ccaaagaaaccaagugaaa

SEQ ID NO: 1244120 - RNA, 19 nt, Homo sapiens
gcuaaagaauuaccaggaa

SEQ ID NO: 1244121 - RNA, 19 nt, Homo sapiens
ggacagcucuuuagaaaau

SEQ ID NO: 1244122 - RNA, 19 nt, Homo sapiens
ucaaagagcacaacagcua

SEQ ID NO: 1244123 - RNA, 19 nt, Homo sapiens
ucaaacagccuuauacaga

SEQ ID NO: 1244124 - RNA, 19 nt, Homo sapiens
gagugcagcuucuuuacuu

SEQ ID NO: 1244125 - RNA, 19 nt, Homo sapiens
gcucucaguuuguuuauca

SEQ ID NO: 1244126 - RNA, 19 nt, Homo sapiens
gguuagagcuucuccagau

SEQ ID NO: 1244127 - RNA, 19 nt, Homo sapiens
cagaaagccucacgcaaga

SEQ ID NO: 1244128 - RNA, 19 nt, Homo sapiens
caaagaaaccuccaauaca

SEQ ID NO: 1244129 - RNA, 19 nt, Homo sapiens
gacaaggucuuaucuaaaa

SEQ ID NO: 1244130 - RNA, 19 nt, Homo sapiens
gagcacaacagcuaaagaa

SEQ ID NO: 1244131 - RNA, 19 nt, Homo sapiens
cauaaauacucauggauca

SEQ ID NO: 1244132 - RNA, 19 nt, Homo sapiens
ggcagaaggcuuuggaaua

SEQ ID NO: 1244133 - RNA, 19 nt, Homo sapiens
gagauuaugugccauucug

SEQ ID NO: 1244134 - RNA, 19 nt, Homo sapiens
ucacauaaauacucaugga

SEQ ID NO: 1244135 - RNA, 19 nt, Homo sapiens
acacuggucucaauaugaa

SEQ ID NO: 1244136 - RNA, 19 nt, Homo sapiens
uaacaggcaacaaccaaua

SEQ ID NO: 1244137 - RNA, 19 nt, Homo sapiens
caaaacaagucaaggagua

SEQ ID NO: 1244138 - RNA, 19 nt, Homo sapiens
caaaauaagccucuugaua

SEQ ID NO: 1244139 - RNA, 19 nt, Homo sapiens
caaaucaguuagaauugga

SEQ ID NO: 1244140 - RNA, 19 nt, Homo sapiens
caacucaaacagccuuaua

SEQ ID NO: 1244141 - RNA, 19 nt, Homo sapiens
caucgauccugaagauaaa

SEQ ID NO: 1244142 - RNA, 19 nt, Homo sapiens
agaagaaaguuuaccugaa

SEQ ID NO: 1244143 - RNA, 19 nt, Homo sapiens
uaaagaaagaggacacaaa

SEQ ID NO: 1244144 - RNA, 19 nt, Homo sapiens
acucugggcugaauguuaa

SEQ ID NO: 1244145 - RNA, 19 nt, Homo sapiens
gcacuuagaagccacaauc

SEQ ID NO: 1244146 - RNA, 19 nt, Homo sapiens
acggacagcucuuuagaaa

SEQ ID NO: 1244147 - RNA, 19 nt, Homo sapiens
cuucugacauggugaauga

SEQ ID NO: 1244148 - RNA, 19 nt, Homo sapiens
ggacucuuaucuucaacuu

SEQ ID NO: 1244149 - RNA, 19 nt, Homo sapiens
acagugaccuggaggagaa

SEQ ID NO: 1244150 - RNA, 19 nt, Homo sapiens
caggaacacuggucucaau

SEQ ID NO: 1244151 - RNA, 19 nt, Homo sapiens
cgucagagcuacagacaag

SEQ ID NO: 1244152 - RNA, 19 nt, Homo sapiens
gcuaugacccgaacuggaa

SEQ ID NO: 1244153 - RNA, 19 nt, Homo sapiens
gaagaggaagcaaguggaa

SEQ ID NO: 1244154 - RNA, 19 nt, Homo sapiens
agacaacauuugauaggaa

SEQ ID NO: 1244155 - RNA, 19 nt, Homo sapiens
gaacuuagaaauguuaugg

SEQ ID NO: 1244156 - RNA, 19 nt, Homo sapiens
uugacaaggucuuaucuaa

SEQ ID NO: 1244157 - RNA, 19 nt, Homo sapiens
cgaaggaaauccaaacaac

SEQ ID NO: 1244158 - RNA, 19 nt, Homo sapiens
gaagacacuauccauucua

SEQ ID NO: 1244159 - RNA, 19 nt, Homo sapiens
ggcugaauguuaauaaaga

SEQ ID NO: 1244160 - RNA, 19 nt, Homo sapiens
caagagggcaaccuucuga

SEQ ID NO: 1244161 - RNA, 19 nt, Homo sapiens
gaaggaaauccaaacaaca

SEQ ID NO: 1244162 - RNA, 19 nt, Homo sapiens
ucagagagaagccaaagaa

SEQ ID NO: 1244163 - RNA, 19 nt, Homo sapiens
ugaacaaccuuaaugaacu

SEQ ID NO: 1244164 - RNA, 19 nt, Homo sapiens
ucaaagaaaccuccaauac

SEQ ID NO: 1244165 - RNA, 19 nt, Homo sapiens
gaaagccucacgcaagaga

SEQ ID NO: 1244166 - RNA, 19 nt, Homo sapiens
uaugugccauucugaguuu

SEQ ID NO: 1244167 - RNA, 19 nt, Homo sapiens
ggcuguggcugcuuucaaa

SEQ ID NO: 1244168 - RNA, 19 nt, Homo sapiens
ugucaaggguagaaaguga

SEQ ID NO: 1244169 - RNA, 19 nt, Homo sapiens
caaagaccaagaagagaaa

SEQ ID NO: 1244170 - RNA, 19 nt, Homo sapiens
ugggaaagaagaaaguuua

SEQ ID NO: 1244171 - RNA, 19 nt, Homo sapiens
guaagaacaccaagcugaa

SEQ ID NO: 1244172 - RNA, 19 nt, Homo sapiens
uacaggaacuuagaaaugu

SEQ ID NO: 1244173 - RNA, 19 nt, Homo sapiens
aacaaagccugaaucgauu

SEQ ID NO: 1244174 - RNA, 19 nt, Homo sapiens
cccaaaccaucaaaucuga

SEQ ID NO: 1244175 - RNA, 19 nt, Homo sapiens
aaacagccuuauacagaga

SEQ ID NO: 1244176 - RNA, 19 nt, Homo sapiens
ugacaaggucuuaucuaaa

SEQ ID NO: 1244177 - RNA, 19 nt, Homo sapiens
ccaucgauccugaagauaa

SEQ ID NO: 1244178 - RNA, 19 nt, Homo sapiens
ggaaaaugcugccaucgau

SEQ ID NO: 1244179 - RNA, 19 nt, Homo sapiens
acucuuaucuucaacuuca

SEQ ID NO: 1244180 - RNA, 19 nt, Homo sapiens
ggagcugaauaauaacuag

SEQ ID NO: 1244181 - RNA, 19 nt, Homo sapiens
gcaaaaggaauaugcaaaa

SEQ ID NO: 1244182 - RNA, 19 nt, Homo sapiens
ggaacacuggucucaauau

SEQ ID NO: 1244183 - RNA, 19 nt, Homo sapiens
caaagagcacaacagcuaa

SEQ ID NO: 1244184 - RNA, 19 nt, Homo sapiens
gagcucaaguucacauaac

SEQ ID NO: 1244185 - RNA, 19 nt, Homo sapiens
gcagcuucuuuacuuggua

SEQ ID NO: 1244186 - RNA, 19 nt, Homo sapiens
uagaauuggagcugaauaa

SEQ ID NO: 1244187 - RNA, 19 nt, Homo sapiens
agaaaccuccaauacauuu

SEQ ID NO: 1244188 - RNA, 19 nt, Homo sapiens
aaguuuaccugaaaucuca

SEQ ID NO: 1244189 - RNA, 19 nt, Homo sapiens
gacacuauccauucuauca

SEQ ID NO: 1244190 - RNA, 19 nt, Homo sapiens
gaaaccaagugaaaauuag

SEQ ID NO: 1244191 - RNA, 19 nt, Homo sapiens
acacaaagaccaagaagag

SEQ ID NO: 1244192 - RNA, 19 nt, Homo sapiens
cagccaagcucaagauucg

SEQ ID NO: 1244193 - RNA, 19 nt, Homo sapiens
ggaaauacugcagaacaga

SEQ ID NO: 1244194 - RNA, 19 nt, Homo sapiens
auucagaccuccgcuauga

SEQ ID NO: 1244195 - RNA, 19 nt, Homo sapiens
gaaagaagaaaguuuaccu

SEQ ID NO: 1244196 - RNA, 19 nt, Homo sapiens
ugaagacacuauccauucu

SEQ ID NO: 1244197 - RNA, 19 nt, Homo sapiens
gaaaauagcuccccaagag

SEQ ID NO: 1244198 - RNA, 19 nt, Homo sapiens
gaacauuccuuucacacau

SEQ ID NO: 1244199 - RNA, 19 nt, Homo sapiens
caagcagccuccuaagaua

SEQ ID NO: 1244200 - RNA, 19 nt, Homo sapiens
ggauaaaugugacaacugu

SEQ ID NO: 1244201 - RNA, 19 nt, Homo sapiens
ggacaauaauuccuacuuc

SEQ ID NO: 1244202 - RNA, 19 nt, Homo sapiens
cagaauccaucuccacuaa

SEQ ID NO: 1244203 - RNA, 19 nt, Homo sapiens
gacugaggcugaagaauug

SEQ ID NO: 1244204 - RNA, 19 nt, Homo sapiens
gcaagcagccuccuaagau

SEQ ID NO: 1244205 - RNA, 19 nt, Homo sapiens
ugaaagaggacaauaauuc

SEQ ID NO: 1244206 - RNA, 19 nt, Homo sapiens
gcagaucucuccucaacag

SEQ ID NO: 1244207 - RNA, 19 nt, Homo sapiens
gaauccaucuccacuaagu

SEQ ID NO: 1244208 - RNA, 19 nt, Homo sapiens
gaucauggucuauggguuu

SEQ ID NO: 1244209 - RNA, 19 nt, Homo sapiens
ucacacaucuggacaacau

SEQ ID NO: 1244210 - RNA, 19 nt, Homo sapiens
gagaggaaacagugacuaa

SEQ ID NO: 1244211 - RNA, 19 nt, Homo sapiens
gagaaagucccgaggaaau

SEQ ID NO: 1244212 - RNA, 19 nt, Homo sapiens
gaaucgggcucacgaaugc

SEQ ID NO: 1244213 - RNA, 19 nt, Homo sapiens
cagcagaucucuccucaac

SEQ ID NO: 1244214 - RNA, 19 nt, Homo sapiens
ggcuacagcuucacugcua

SEQ ID NO: 1244215 - RNA, 19 nt, Homo sapiens
ucaagaagaagaaguguga

SEQ ID NO: 1244216 - RNA, 19 nt, Homo sapiens
agacugaggcugaagaauu

SEQ ID NO: 1244217 - RNA, 19 nt, Homo sapiens
gcaauagagggaagacuga

SEQ ID NO: 1244218 - RNA, 19 nt, Homo sapiens
gcugagaccuuggcucugu

SEQ ID NO: 1244219 - RNA, 19 nt, Homo sapiens
gacaauaauuccuacuucu

SEQ ID NO: 1244220 - RNA, 19 nt, Homo sapiens
ggacagacagacagacaga

SEQ ID NO: 1244221 - RNA, 19 nt, Homo sapiens
gaggagcccuagggaagaa

SEQ ID NO: 1244222 - RNA, 19 nt, Homo sapiens
ggaggcacuucuucccuau

SEQ ID NO: 1244223 - RNA, 19 nt, Homo sapiens
gaagaggcagggaguaauc

SEQ ID NO: 1244224 - RNA, 19 nt, Homo sapiens
ggagaaugcagccuggauu

SEQ ID NO: 1244225 - RNA, 19 nt, Homo sapiens
gaccuuggcucuguaugga

SEQ ID NO: 1244226 - RNA, 19 nt, Homo sapiens
caaagggcaucagggagaa

SEQ ID NO: 1244227 - RNA, 19 nt, Homo sapiens
agagacacauggcaagcua

SEQ ID NO: 1244228 - RNA, 19 nt, Homo sapiens
gaagacugaggcugaagaa

SEQ ID NO: 1244229 - RNA, 19 nt, Homo sapiens
gacccaaugucccgaggaa

SEQ ID NO: 1244230 - RNA, 19 nt, Homo sapiens
ugaagacaguaacuuggaa

SEQ ID NO: 1244231 - RNA, 19 nt, Homo sapiens
ggagaaagucccgaggaaa

SEQ ID NO: 1244232 - RNA, 19 nt, Homo sapiens
uuaugaagcuggaggacuu

SEQ ID NO: 1244233 - RNA, 19 nt, Homo sapiens
ccacuggugugaugguguu

SEQ ID NO: 1244234 - RNA, 19 nt, Homo sapiens
gcuguucucccuaucauga

SEQ ID NO: 1244235 - RNA, 19 nt, Homo sapiens
ggucagggacguuccaaug

SEQ ID NO: 1244236 - RNA, 19 nt, Homo sapiens
uaaaugggcagcuucacuu

SEQ ID NO: 1244237 - RNA, 19 nt, Homo sapiens
gugcagugcuccuauaagg

SEQ ID NO: 1244238 - RNA, 19 nt, Homo sapiens
cuacugaccuggagugacu

SEQ ID NO: 1244239 - RNA, 19 nt, Homo sapiens
gccaguaucgaucuuauga

SEQ ID NO: 1244240 - RNA, 19 nt, Homo sapiens
caccuugccuaggcucuua

SEQ ID NO: 1244241 - RNA, 19 nt, Homo sapiens
cugccuaacuucccuaaau

SEQ ID NO: 1244242 - RNA, 19 nt, Homo sapiens
ugacaacugugcauugaac

SEQ ID NO: 1244243 - RNA, 19 nt, Homo sapiens
aaugaaggcuggagaaugc

SEQ ID NO: 1244244 - RNA, 19 nt, Homo sapiens
cccagaggcugccauccua

SEQ ID NO: 1244245 - RNA, 19 nt, Homo sapiens
caauaauuccuacuucuca

SEQ ID NO: 1244246 - RNA, 19 nt, Homo sapiens
gaaagucccgaggaaaugu

SEQ ID NO: 1244247 - RNA, 19 nt, Homo sapiens
ccaccauccuguuguauac

SEQ ID NO: 1244248 - RNA, 19 nt, Homo sapiens
ggaagacugaggcugaaga

SEQ ID NO: 1244249 - RNA, 19 nt, Homo sapiens
caguaucgaucuuaugaag

SEQ ID NO: 1244250 - RNA, 19 nt, Homo sapiens
gaucugaggccacuuaagc

SEQ ID NO: 1244251 - RNA, 19 nt, Homo sapiens
gaagaccagagcccuaugu

SEQ ID NO: 1244252 - RNA, 19 nt, Homo sapiens
gugcagcgauccuucuaca

SEQ ID NO: 1244253 - RNA, 19 nt, Homo sapiens
ucaggcaccaggauguuua

SEQ ID NO: 1244254 - RNA, 19 nt, Homo sapiens
cuacuucucaagauuguuu

SEQ ID NO: 1244255 - RNA, 19 nt, Homo sapiens
guaucgaucuuaugaagcu

SEQ ID NO: 1244256 - RNA, 19 nt, Homo sapiens
gaaagaggacaauaauucc

SEQ ID NO: 1244257 - RNA, 19 nt, Homo sapiens
uauacuaggagagaacuua

SEQ ID NO: 1244258 - RNA, 19 nt, Homo sapiens
uagccaccauccuguugua

SEQ ID NO: 1244259 - RNA, 19 nt, Homo sapiens
ggacacagugaagacagua

SEQ ID NO: 1244260 - RNA, 19 nt, Homo sapiens
gggccaguaucgaucuuau

SEQ ID NO: 1244261 - RNA, 19 nt, Homo sapiens
acacacccaucucugucua

SEQ ID NO: 1244262 - RNA, 19 nt, Homo sapiens
ugugacaacugugcauuga

SEQ ID NO: 1244263 - RNA, 19 nt, Homo sapiens
gaccuggagugacuggaau

SEQ ID NO: 1244264 - RNA, 19 nt, Homo sapiens
gccgcugccuccuuagaaa

SEQ ID NO: 1244265 - RNA, 19 nt, Homo sapiens
guuggcagcuucucuuguc

SEQ ID NO: 1244266 - RNA, 19 nt, Homo sapiens
gcaaugaaggcuggagaau

SEQ ID NO: 1244267 - RNA, 19 nt, Homo sapiens
gaaaauggagcccaaguag

SEQ ID NO: 1244268 - RNA, 19 nt, Homo sapiens
gccaccauccuguuguaua

SEQ ID NO: 1244269 - RNA, 19 nt, Homo sapiens
ggaagaggcagggaguaau

SEQ ID NO: 1244270 - RNA, 19 nt, Homo sapiens
ggaaaauggagcccaagua

SEQ ID NO: 1244271 - RNA, 19 nt, Homo sapiens
gugaaagaggacaauaauu

SEQ ID NO: 1244272 - RNA, 19 nt, Homo sapiens
cuagcaagcagccuccuaa

SEQ ID NO: 1244273 - RNA, 19 nt, Homo sapiens
ccaauggccaagagaguga

SEQ ID NO: 1244274 - RNA, 19 nt, Homo sapiens
uggagugacuggaauagca

SEQ ID NO: 1244275 - RNA, 19 nt, Homo sapiens
ggguggaacugucacaacu

SEQ ID NO: 1244276 - RNA, 19 nt, Homo sapiens
ggaggagcccuagggaaga

SEQ ID NO: 1244277 - RNA, 19 nt, Homo sapiens
ucugugcagugcuccuaua

SEQ ID NO: 1244278 - RNA, 19 nt, Homo sapiens
gcucagacucagccucuau

SEQ ID NO: 1244279 - RNA, 19 nt, Homo sapiens
gaggaaacagugacuaaaa

SEQ ID NO: 1244280 - RNA, 19 nt, Homo sapiens
ggagaggaaacagugacua

SEQ ID NO: 1244281 - RNA, 19 nt, Homo sapiens
aaagugaggcuccuugaag

SEQ ID NO: 1244282 - RNA, 19 nt, Homo sapiens
gaccgcgucucccagcaau

SEQ ID NO: 1244283 - RNA, 19 nt, Homo sapiens
caaugaaggcuggagaaug

SEQ ID NO: 1244284 - RNA, 19 nt, Homo sapiens
gccacaggguugcgucuca

SEQ ID NO: 1244285 - RNA, 19 nt, Homo sapiens
ugccuaacuucccuaaaug

SEQ ID NO: 1244286 - RNA, 19 nt, Homo sapiens
agacagacacgcacacaca

SEQ ID NO: 1244287 - RNA, 19 nt, Homo sapiens
gaauagcaccuggggauaa

SEQ ID NO: 1244288 - RNA, 19 nt, Homo sapiens
gagagagaagacacacuug

SEQ ID NO: 1244289 - RNA, 19 nt, Homo sapiens
ggaggagaggaaacaguga

SEQ ID NO: 1244290 - RNA, 19 nt, Homo sapiens
gaucucuccucaacagacu

SEQ ID NO: 1244291 - RNA, 19 nt, Homo sapiens
ccagaauccaucuccacua

SEQ ID NO: 1244292 - RNA, 19 nt, Homo sapiens
agacucagccucuauuguc

SEQ ID NO: 1244293 - RNA, 19 nt, Homo sapiens
gugaagacaguaacuugga

SEQ ID NO: 1244294 - RNA, 19 nt, Homo sapiens
gggacacagugaagacagu

SEQ ID NO: 1244295 - RNA, 19 nt, Homo sapiens
agagagagaagacacacuu

SEQ ID NO: 1244296 - RNA, 19 nt, Homo sapiens
ccagcagccuccaggaagu

SEQ ID NO: 1244297 - RNA, 19 nt, Homo sapiens
gaaaguuacugcaaagaaa

SEQ ID NO: 1244298 - RNA, 19 nt, Homo sapiens
gaugagaccacuuggauua

SEQ ID NO: 1244299 - RNA, 19 nt, Homo sapiens
caaaggaaguuuacuguuc

SEQ ID NO: 1244300 - RNA, 19 nt, Homo sapiens
agacuaagcuuaagaguuc

SEQ ID NO: 1244301 - RNA, 19 nt, Homo sapiens
caaagaaagugaugcacaa

SEQ ID NO: 1244302 - RNA, 19 nt, Homo sapiens
gaagcaauauuauggauac

SEQ ID NO: 1244303 - RNA, 19 nt, Homo sapiens
gcaguaacauucagaugga

SEQ ID NO: 1244304 - RNA, 19 nt, Homo sapiens
caugugaaguugagaguaa

SEQ ID NO: 1244305 - RNA, 19 nt, Homo sapiens
gaacaaaggaaguuuacug

SEQ ID NO: 1244306 - RNA, 19 nt, Homo sapiens
guucaaacaucacuagaga

SEQ ID NO: 1244307 - RNA, 19 nt, Homo sapiens
uuaaggagccgguugauaa

SEQ ID NO: 1244308 - RNA, 19 nt, Homo sapiens
gaaguuuacuguucauucu

SEQ ID NO: 1244309 - RNA, 19 nt, Homo sapiens
caaguaacaugcuuagcuu

SEQ ID NO: 1244310 - RNA, 19 nt, Homo sapiens
gaaagaauuagcacuguug

SEQ ID NO: 1244311 - RNA, 19 nt, Homo sapiens
gaauauuccuuccacagau

SEQ ID NO: 1244312 - RNA, 19 nt, Homo sapiens
gcuauaauacgcagaauug

SEQ ID NO: 1244313 - RNA, 19 nt, Homo sapiens
cauggaugcugcuggaaua

SEQ ID NO: 1244314 - RNA, 19 nt, Homo sapiens
gaaucaaagacuaagcuua

SEQ ID NO: 1244315 - RNA, 19 nt, Homo sapiens
cuuaagaguuccucgcaua

SEQ ID NO: 1244316 - RNA, 19 nt, Homo sapiens
gcagugucauuccuuguga

SEQ ID NO: 1244317 - RNA, 19 nt, Homo sapiens
gcaauauuauggauacagu

SEQ ID NO: 1244318 - RNA, 19 nt, Homo sapiens
gagaaagaauuagcacugu

SEQ ID NO: 1244319 - RNA, 19 nt, Homo sapiens
cagaaguccuuauauagau

SEQ ID NO: 1244320 - RNA, 19 nt, Homo sapiens
gaaaugcuccuggaacuuc

SEQ ID NO: 1244321 - RNA, 19 nt, Homo sapiens
caauaacacuguggauaug

SEQ ID NO: 1244322 - RNA, 19 nt, Homo sapiens
gaauacaccuacggcaguu

SEQ ID NO: 1244323 - RNA, 19 nt, Homo sapiens
gacaauaacacuguggaua

SEQ ID NO: 1244324 - RNA, 19 nt, Homo sapiens
ugaggaagauaaagagaau

SEQ ID NO: 1244325 - RNA, 19 nt, Homo sapiens
ggaagcaauauuauggaua

SEQ ID NO: 1244326 - RNA, 19 nt, Homo sapiens
cuacggcaguuuaguaaug

SEQ ID NO: 1244327 - RNA, 19 nt, Homo sapiens
cuaugagacuucagaugua

SEQ ID NO: 1244328 - RNA, 19 nt, Homo sapiens
aaaggaaguuuacuguuca

SEQ ID NO: 1244329 - RNA, 19 nt, Homo sapiens
gaagcaagaccacacaaca

SEQ ID NO: 1244330 - RNA, 19 nt, Homo sapiens
aaagggagaaagacaauaa

SEQ ID NO: 1244331 - RNA, 19 nt, Homo sapiens
gcuuagcuuucccuccuua

SEQ ID NO: 1244332 - RNA, 19 nt, Homo sapiens
agaaagugaugcacaaaca

SEQ ID NO: 1244333 - RNA, 19 nt, Homo sapiens
gugaagaugaggaagauaa

SEQ ID NO: 1244334 - RNA, 19 nt, Homo sapiens
ggaccucagugauucagau

SEQ ID NO: 1244335 - RNA, 19 nt, Homo sapiens
aagcaucuccgacuccuua

SEQ ID NO: 1244336 - RNA, 19 nt, Homo sapiens
ucaagggcuuacugacaua

SEQ ID NO: 1244337 - RNA, 19 nt, Homo sapiens
gaaagggagaaagacaaua

SEQ ID NO: 1244338 - RNA, 19 nt, Homo sapiens
ucagaaguccuuauauaga

SEQ ID NO: 1244339 - RNA, 19 nt, Homo sapiens
uaacuaguccuucgccuau

SEQ ID NO: 1244340 - RNA, 19 nt, Homo sapiens
gaaagcaguaacauucaga

SEQ ID NO: 1244341 - RNA, 19 nt, Homo sapiens
gaaagcagugucauuccuu

SEQ ID NO: 1244342 - RNA, 19 nt, Homo sapiens
ggagaaagacaauaacacu

SEQ ID NO: 1244343 - RNA, 19 nt, Homo sapiens
aagaguuccucgcauauau

SEQ ID NO: 1244344 - RNA, 19 nt, Homo sapiens
gguugauccuauagagaua

SEQ ID NO: 1244345 - RNA, 19 nt, Homo sapiens
ucagaacaaaggaaguuua

SEQ ID NO: 1244346 - RNA, 19 nt, Homo sapiens
gguugauaauggcaguuua

SEQ ID NO: 1244347 - RNA, 19 nt, Homo sapiens
acaauaacacuguggauau

SEQ ID NO: 1244348 - RNA, 19 nt, Homo sapiens
uaucggaccucagugauuc

SEQ ID NO: 1244349 - RNA, 19 nt, Homo sapiens
ggaaguuuacuguucauuc

SEQ ID NO: 1244350 - RNA, 19 nt, Homo sapiens
gacauaggaacaacagaaa

SEQ ID NO: 1244351 - RNA, 19 nt, Homo sapiens
ugacauaggaacaacagaa

SEQ ID NO: 1244352 - RNA, 19 nt, Homo sapiens
uaagaguuccucgcauaua

SEQ ID NO: 1244353 - RNA, 19 nt, Homo sapiens
agaaagaauuagcacuguu

SEQ ID NO: 1244354 - RNA, 19 nt, Homo sapiens
cagaaaugcuccuggaacu

SEQ ID NO: 1244355 - RNA, 19 nt, Homo sapiens
caugucaccucuugcugaa

SEQ ID NO: 1244356 - RNA, 19 nt, Homo sapiens
auagauuugucuccuguaa

SEQ ID NO: 1244357 - RNA, 19 nt, Homo sapiens
ggauuaaggagccgguuga

SEQ ID NO: 1244358 - RNA, 19 nt, Homo sapiens
cauaggaacaacagaaaug

SEQ ID NO: 1244359 - RNA, 19 nt, Homo sapiens
gcugaaagcagugucauuc

SEQ ID NO: 1244360 - RNA, 19 nt, Homo sapiens
guuuacccaugacugauuu

SEQ ID NO: 1244361 - RNA, 19 nt, Homo sapiens
acaaacaugugaaguugag

SEQ ID NO: 1244362 - RNA, 19 nt, Homo sapiens
gcauugccuucaguauuga

SEQ ID NO: 1244363 - RNA, 19 nt, Homo sapiens
acuaauccguguaucagaa

SEQ ID NO: 1244364 - RNA, 19 nt, Homo sapiens
caucuggaacaaauucuaa

SEQ ID NO: 1244365 - RNA, 19 nt, Homo sapiens
gugcacaggaucaacauga

SEQ ID NO: 1244366 - RNA, 19 nt, Homo sapiens
acagagguguuggaugaaa

SEQ ID NO: 1244367 - RNA, 19 nt, Homo sapiens
ugugaaagcaguaacauuc

SEQ ID NO: 1244368 - RNA, 19 nt, Homo sapiens
agaaagacaauaacacugu

SEQ ID NO: 1244369 - RNA, 19 nt, Homo sapiens
gugacugccaugucuguua

SEQ ID NO: 1244370 - RNA, 19 nt, Homo sapiens
ggaagcauaacuaguccuu

SEQ ID NO: 1244371 - RNA, 19 nt, Homo sapiens
caaugcagcaguccauaga

SEQ ID NO: 1244372 - RNA, 19 nt, Homo sapiens
caagaccacacaacacaga

SEQ ID NO: 1244373 - RNA, 19 nt, Homo sapiens
gaaagugaugcacaaacau

SEQ ID NO: 1244374 - RNA, 19 nt, Homo sapiens
agauuugucuccuguaaag

SEQ ID NO: 1244375 - RNA, 19 nt, Homo sapiens
caaaaucaguccagugcuu

SEQ ID NO: 1244376 - RNA, 19 nt, Homo sapiens
uaugagacuucagauguau

SEQ ID NO: 1244377 - RNA, 19 nt, Homo sapiens
ccuaugagacuucagaugu

SEQ ID NO: 1244378 - RNA, 19 nt, Homo sapiens
acuaguccuucgccuauuu

SEQ ID NO: 1244379 - RNA, 19 nt, Homo sapiens
ugccaugucuguuacacaa

SEQ ID NO: 1244380 - RNA, 19 nt, Homo sapiens
ggaaaccucaguucuucau

SEQ ID NO: 1244381 - RNA, 19 nt, Homo sapiens
uguaucagaaguccuuaua

SEQ ID NO: 1244382 - RNA, 19 nt, Homo sapiens
ucaaagacuaagcuuaaga

SEQ ID NO: 1244383 - RNA, 19 nt, Homo sapiens
agaaaguuacugcaaagaa

SEQ ID NO: 1244384 - RNA, 19 nt, Homo sapiens
cagaugagaccacuuggau

SEQ ID NO: 1244385 - RNA, 19 nt, Homo sapiens
uagcagaugagaccacuug

SEQ ID NO: 1244386 - RNA, 19 nt, Homo sapiens
agacuccacucucagaaca

SEQ ID NO: 1244387 - RNA, 19 nt, Homo sapiens
gcugaugaauuugcagauc

SEQ ID NO: 1244388 - RNA, 19 nt, Homo sapiens
ucagauaccuuuuacucuu

SEQ ID NO: 1244389 - RNA, 19 nt, Homo sapiens
cuggaaaccucaguucuuc

SEQ ID NO: 1244390 - RNA, 19 nt, Homo sapiens
ugucagaaucaaagacuaa

SEQ ID NO: 1244391 - RNA, 19 nt, Homo sapiens
gcagaugagaccacuugga

SEQ ID NO: 1244392 - RNA, 19 nt, Homo sapiens
ugaagaugaggaagauaaa

SEQ ID NO: 1244393 - RNA, 19 nt, Homo sapiens
gaccucagugauucagaua

SEQ ID NO: 1244394 - RNA, 19 nt, Homo sapiens
caccuacggcaguuuagua

SEQ ID NO: 1244395 - RNA, 19 nt, Homo sapiens
agaaguccuuauauagaug

SEQ ID NO: 1244396 - RNA, 19 nt, Homo sapiens
guccuucgccuauuucuuc

SEQ ID NO: 1244397 - RNA, 19 nt, Homo sapiens
gauaaagaauguugccuua

SEQ ID NO: 1244398 - RNA, 19 nt, Homo sapiens
caacugaccuagacaaauu

SEQ ID NO: 1244399 - RNA, 19 nt, Homo sapiens
ggagaaugcuguugaaaga

SEQ ID NO: 1244400 - RNA, 19 nt, Homo sapiens
gaagaagaauuaucuggaa

SEQ ID NO: 1244401 - RNA, 19 nt, Homo sapiens
ggaaugcucaucaaauuua

SEQ ID NO: 1244402 - RNA, 19 nt, Homo sapiens
ugaauaaugucacgacuuu

SEQ ID NO: 1244403 - RNA, 19 nt, Homo sapiens
acacagagauuuguaguaa

SEQ ID NO: 1244404 - RNA, 19 nt, Homo sapiens
caagauuccagaucaauua

SEQ ID NO: 1244405 - RNA, 19 nt, Homo sapiens
caggaaugcucaucaaauu

SEQ ID NO: 1244406 - RNA, 19 nt, Homo sapiens
gaccuugacuucagugauu

SEQ ID NO: 1244407 - RNA, 19 nt, Homo sapiens
ggacgaggcgggaauauug

SEQ ID NO: 1244408 - RNA, 19 nt, Homo sapiens
caacagaaaugaggugugu

SEQ ID NO: 1244409 - RNA, 19 nt, Homo sapiens
gauguuaaaugcguuacua

SEQ ID NO: 1244410 - RNA, 19 nt, Homo sapiens
uaaaauuccugcacaguua

SEQ ID NO: 1244411 - RNA, 19 nt, Homo sapiens
gaguaugacugcaacagaa

SEQ ID NO: 1244412 - RNA, 19 nt, Homo sapiens
uggcauuucuucacaauuu

SEQ ID NO: 1244413 - RNA, 19 nt, Homo sapiens
gaaauaauacguguagaug

SEQ ID NO: 1244414 - RNA, 19 nt, Homo sapiens
guacucagcucagggagaa

SEQ ID NO: 1244415 - RNA, 19 nt, Homo sapiens
acaaggagaucccauuaug

SEQ ID NO: 1244416 - RNA, 19 nt, Homo sapiens
guggagugcugaacaauga

SEQ ID NO: 1244417 - RNA, 19 nt, Homo sapiens
ugacuucagugauuuguug

SEQ ID NO: 1244418 - RNA, 19 nt, Homo sapiens
ggaagcaacugaccuagac

SEQ ID NO: 1244419 - RNA, 19 nt, Homo sapiens
gaagaauuaucuggaaauc

SEQ ID NO: 1244420 - RNA, 19 nt, Homo sapiens
aaacaaggagaucccauua

SEQ ID NO: 1244421 - RNA, 19 nt, Homo sapiens
ggaaauuuaugccaacucu

SEQ ID NO: 1244422 - RNA, 19 nt, Homo sapiens
ucaacaggaugaauaaugu

SEQ ID NO: 1244423 - RNA, 19 nt, Homo sapiens
gauaaugacacagagauuu

SEQ ID NO: 1244424 - RNA, 19 nt, Homo sapiens
caagaacgagaugguauua

SEQ ID NO: 1244425 - RNA, 19 nt, Homo sapiens
ggacugguguuccuccaau

SEQ ID NO: 1244426 - RNA, 19 nt, Homo sapiens
gagaugguauuaucaaugc

SEQ ID NO: 1244427 - RNA, 19 nt, Homo sapiens
cuuguaugcuucucuauaa

SEQ ID NO: 1244428 - RNA, 19 nt, Homo sapiens
gacaaauucaucaccaaua

SEQ ID NO: 1244429 - RNA, 19 nt, Homo sapiens
uaaagaauguugccuuagg

SEQ ID NO: 1244430 - RNA, 19 nt, Homo sapiens
cagcacaucuacucauuca

SEQ ID NO: 1244431 - RNA, 19 nt, Homo sapiens
gaagucgggauuaaugaaa

SEQ ID NO: 1244432 - RNA, 19 nt, Homo sapiens
gaacgagaugguauuauca

SEQ ID NO: 1244433 - RNA, 19 nt, Homo sapiens
cuaaauaucaacaggauga

SEQ ID NO: 1244434 - RNA, 19 nt, Homo sapiens
acucuucucugacccauaa

SEQ ID NO: 1244435 - RNA, 19 nt, Homo sapiens
gcacaucuacucauucaag

SEQ ID NO: 1244436 - RNA, 19 nt, Homo sapiens
ccaaagugcugagauuaca

SEQ ID NO: 1244437 - RNA, 19 nt, Homo sapiens
gugcauccguccaguuuau

SEQ ID NO: 1244438 - RNA, 19 nt, Homo sapiens
gauacucgguguagagaca

SEQ ID NO: 1244439 - RNA, 19 nt, Homo sapiens
gaccaggaaugcucaucaa

SEQ ID NO: 1244440 - RNA, 19 nt, Homo sapiens
gcgaagguguuggaaguga

SEQ ID NO: 1244441 - RNA, 19 nt, Homo sapiens
caccaugccuggcuguauu

SEQ ID NO: 1244442 - RNA, 19 nt, Homo sapiens
caauacagaaacuccuuua

SEQ ID NO: 1244443 - RNA, 19 nt, Homo sapiens
gagaucccauuaugacugu

SEQ ID NO: 1244444 - RNA, 19 nt, Homo sapiens
acaagguucuccucaguga

SEQ ID NO: 1244445 - RNA, 19 nt, Homo sapiens
cgauuacgcugaucuuagu

SEQ ID NO: 1244446 - RNA, 19 nt, Homo sapiens
gauuaaugcccaccagaaa

SEQ ID NO: 1244447 - RNA, 19 nt, Homo sapiens
gaaacuccuuuaaauaacg

SEQ ID NO: 1244448 - RNA, 19 nt, Homo sapiens
agaacgagaugguauuauc

SEQ ID NO: 1244449 - RNA, 19 nt, Homo sapiens
acacacccuuccuugguua

SEQ ID NO: 1244450 - RNA, 19 nt, Homo sapiens
ccaucugacuucucaaaga

SEQ ID NO: 1244451 - RNA, 19 nt, Homo sapiens
ggaacuauaccaagaacga

SEQ ID NO: 1244452 - RNA, 19 nt, Homo sapiens
gaucucggcucaccacaac

SEQ ID NO: 1244453 - RNA, 19 nt, Homo sapiens
gcauccguccaguuuauua

SEQ ID NO: 1244454 - RNA, 19 nt, Homo sapiens
agaaagggauaaugacaca

SEQ ID NO: 1244455 - RNA, 19 nt, Homo sapiens
caaacaaggagaucccauu

SEQ ID NO: 1244456 - RNA, 19 nt, Homo sapiens
gugcgaagguguuggaagu

SEQ ID NO: 1244457 - RNA, 19 nt, Homo sapiens
ccaaagugcugggaucaca

SEQ ID NO: 1244458 - RNA, 19 nt, Homo sapiens
ggagcugcauucucagugu

SEQ ID NO: 1244459 - RNA, 19 nt, Homo sapiens
gauuccagaucaauuauac

SEQ ID NO: 1244460 - RNA, 19 nt, Homo sapiens
ugacaagauuccagaucaa

SEQ ID NO: 1244461 - RNA, 19 nt, Homo sapiens
caacuccgauuacgcugau

SEQ ID NO: 1244462 - RNA, 19 nt, Homo sapiens
uguccgagcucuaaauauc

SEQ ID NO: 1244463 - RNA, 19 nt, Homo sapiens
aaagaauguugccuuagga

SEQ ID NO: 1244464 - RNA, 19 nt, Homo sapiens
gcgaagauaaagaauguug

SEQ ID NO: 1244465 - RNA, 19 nt, Homo sapiens
ucaaugcgaagauaaagaa

SEQ ID NO: 1244466 - RNA, 19 nt, Homo sapiens
cauuaugacuguaaagaag

SEQ ID NO: 1244467 - RNA, 19 nt, Homo sapiens
agacaggguuccaccguau

SEQ ID NO: 1244468 - RNA, 19 nt, Homo sapiens
uaugcaaagccuauaguua

SEQ ID NO: 1244469 - RNA, 19 nt, Homo sapiens
ugagaggcaacuccgauua

SEQ ID NO: 1244470 - RNA, 19 nt, Homo sapiens
caaggagaucccauuauga

SEQ ID NO: 1244471 - RNA, 19 nt, Homo sapiens
guuguagucuuguaugcuu

SEQ ID NO: 1244472 - RNA, 19 nt, Homo sapiens
caccagaaagggauaauga

SEQ ID NO: 1244473 - RNA, 19 nt, Homo sapiens
acaaauucaucaccaauac

SEQ ID NO: 1244474 - RNA, 19 nt, Homo sapiens
caccaaaagugaucuauga

SEQ ID NO: 1244475 - RNA, 19 nt, Homo sapiens
caacacacccuuccuuggu

SEQ ID NO: 1244476 - RNA, 19 nt, Homo sapiens
gugauuuguuguagucuug

SEQ ID NO: 1244477 - RNA, 19 nt, Homo sapiens
agugauggcuggcucgaaa

SEQ ID NO: 1244478 - RNA, 19 nt, Homo sapiens
gcccuuguccuuguaauuu

SEQ ID NO: 1244479 - RNA, 19 nt, Homo sapiens
uaugccaacucuucucuga

SEQ ID NO: 1244480 - RNA, 19 nt, Homo sapiens
caaagccuauaguuagaca

SEQ ID NO: 1244481 - RNA, 19 nt, Homo sapiens
agugugggcuuaccuguga

SEQ ID NO: 1244482 - RNA, 19 nt, Homo sapiens
cgaaauaauacguguagau

SEQ ID NO: 1244483 - RNA, 19 nt, Homo sapiens
gucacgacuuuacaucuuu

SEQ ID NO: 1244484 - RNA, 19 nt, Homo sapiens
ucucauaauucauccuguu

SEQ ID NO: 1244485 - RNA, 19 nt, Homo sapiens
ccaaugagacagauuccuu

SEQ ID NO: 1244486 - RNA, 19 nt, Homo sapiens
ucagugauuuguuguaguc

SEQ ID NO: 1244487 - RNA, 19 nt, Homo sapiens
agacaagguucuccucagu

SEQ ID NO: 1244488 - RNA, 19 nt, Homo sapiens
gcaacuuucaaacccauuu

SEQ ID NO: 1244489 - RNA, 19 nt, Homo sapiens
ggauaaugacacagagauu

SEQ ID NO: 1244490 - RNA, 19 nt, Homo sapiens
gauuuguuguagucuugua

SEQ ID NO: 1244491 - RNA, 19 nt, Homo sapiens
gaauaugcaaagccuauag

SEQ ID NO: 1244492 - RNA, 19 nt, Homo sapiens
ggagauacucgguguagag

SEQ ID NO: 1244493 - RNA, 19 nt, Homo sapiens
gaauaaugucacgacuuua

SEQ ID NO: 1244494 - RNA, 19 nt, Homo sapiens
ccaagaacgagaugguauu

SEQ ID NO: 1244495 - RNA, 19 nt, Homo sapiens
ccaguggcauuucuucaca

SEQ ID NO: 1244496 - RNA, 19 nt, Homo sapiens
gcaggacgaggcgggaaua

SEQ ID NO: 1244497 - RNA, 19 nt, Homo sapiens
gcacaugguucucugcuuu

SEQ ID NO: 1244498 - RNA, 19 nt, Homo sapiens
gaauucaucucgguuuaua

SEQ ID NO: 1244499 - RNA, 19 nt, Homo sapiens
gcaauguuaugucuaauga

SEQ ID NO: 1244500 - RNA, 19 nt, Homo sapiens
cuggauaacucacuuaaua

SEQ ID NO: 1244501 - RNA, 19 nt, Homo sapiens
gaaagaaguuuacaugacu

SEQ ID NO: 1244502 - RNA, 19 nt, Homo sapiens
gaaggucccucuacaaugg

SEQ ID NO: 1244503 - RNA, 19 nt, Homo sapiens
gcaguacuauuucaaucua

SEQ ID NO: 1244504 - RNA, 19 nt, Homo sapiens
ggacauagcucaggcaaac

SEQ ID NO: 1244505 - RNA, 19 nt, Homo sapiens
ugagauggauguacaacua

SEQ ID NO: 1244506 - RNA, 19 nt, Homo sapiens
guucucugcuuuagauuua

SEQ ID NO: 1244507 - RNA, 19 nt, Homo sapiens
ggaaagaaguuuacaugac

SEQ ID NO: 1244508 - RNA, 19 nt, Homo sapiens
ccaguugcauucugugaua

SEQ ID NO: 1244509 - RNA, 19 nt, Homo sapiens
gcuaugauaacuucucuua

SEQ ID NO: 1244510 - RNA, 19 nt, Homo sapiens
uauguaagauccagcagua

SEQ ID NO: 1244511 - RNA, 19 nt, Homo sapiens
guauugaauuggugucuuu

SEQ ID NO: 1244512 - RNA, 19 nt, Homo sapiens
cagaugaguugugugaaua

SEQ ID NO: 1244513 - RNA, 19 nt, Homo sapiens
ucaaauucauggugcuaua

SEQ ID NO: 1244514 - RNA, 19 nt, Homo sapiens
gagagaagauggcauacag

SEQ ID NO: 1244515 - RNA, 19 nt, Homo sapiens
gaggagagaagauggcaua

SEQ ID NO: 1244516 - RNA, 19 nt, Homo sapiens
gaucaaaccguuccucaau

SEQ ID NO: 1244517 - RNA, 19 nt, Homo sapiens
gugcagagccagacuauga

SEQ ID NO: 1244518 - RNA, 19 nt, Homo sapiens
acagacagcuggcaauguu

SEQ ID NO: 1244519 - RNA, 19 nt, Homo sapiens
ggacacaguuaccucauac

SEQ ID NO: 1244520 - RNA, 19 nt, Homo sapiens
ggcgauaucaugaagaaua

SEQ ID NO: 1244521 - RNA, 19 nt, Homo sapiens
ccagagcuaugauaacuuc

SEQ ID NO: 1244522 - RNA, 19 nt, Homo sapiens
gaagccaguugcauucugu

SEQ ID NO: 1244523 - RNA, 19 nt, Homo sapiens
ccaaugcacuacucacaga

SEQ ID NO: 1244524 - RNA, 19 nt, Homo sapiens
gaagaugaugggaaauauu

SEQ ID NO: 1244525 - RNA, 19 nt, Homo sapiens
gaauaaggagucccaguau

SEQ ID NO: 1244526 - RNA, 19 nt, Homo sapiens
ugauuuaggugauuagugu

SEQ ID NO: 1244527 - RNA, 19 nt, Homo sapiens
gcacaguuagcaguaaaua

SEQ ID NO: 1244528 - RNA, 19 nt, Homo sapiens
cuaaggaaauugagaugga

SEQ ID NO: 1244529 - RNA, 19 nt, Homo sapiens
ccagaugaguugugugaau

SEQ ID NO: 1244530 - RNA, 19 nt, Homo sapiens
uuacugcacuguauugaau

SEQ ID NO: 1244531 - RNA, 19 nt, Homo sapiens
ugaauaaggagucccagua

SEQ ID NO: 1244532 - RNA, 19 nt, Homo sapiens
cagcuccagucuuaucuaa

SEQ ID NO: 1244533 - RNA, 19 nt, Homo sapiens
gcagcuuccugugccaaua

SEQ ID NO: 1244534 - RNA, 19 nt, Homo sapiens
cagaagaugaugggaaaua

SEQ ID NO: 1244535 - RNA, 19 nt, Homo sapiens
cagcaaacuugucucuuca

SEQ ID NO: 1244536 - RNA, 19 nt, Homo sapiens
gaaaaugggcgauaucaug

SEQ ID NO: 1244537 - RNA, 19 nt, Homo sapiens
ggaaauauugcagcaguug

SEQ ID NO: 1244538 - RNA, 19 nt, Homo sapiens
acagcaaacuugucucuuc

SEQ ID NO: 1244539 - RNA, 19 nt, Homo sapiens
ggaugagacugcuuaugca

SEQ ID NO: 1244540 - RNA, 19 nt, Homo sapiens
cccauaugcuauuguuuaa

SEQ ID NO: 1244541 - RNA, 19 nt, Homo sapiens
gggaaagaaguuuacauga

SEQ ID NO: 1244542 - RNA, 19 nt, Homo sapiens
guaagauccagcaguauga

SEQ ID NO: 1244543 - RNA, 19 nt, Homo sapiens
ccacuucaguuuccucaca

SEQ ID NO: 1244544 - RNA, 19 nt, Homo sapiens
ugaguugugugaauaagga

SEQ ID NO: 1244545 - RNA, 19 nt, Homo sapiens
cauauuaaaccaugcagaa

SEQ ID NO: 1244546 - RNA, 19 nt, Homo sapiens
ccagcaguaugaaguauuc

SEQ ID NO: 1244547 - RNA, 19 nt, Homo sapiens
uguuccagcuccagucuua

SEQ ID NO: 1244548 - RNA, 19 nt, Homo sapiens
ucccauaugcuauuguuua

SEQ ID NO: 1244549 - RNA, 19 nt, Homo sapiens
gcuuuagauuuaucccaua

SEQ ID NO: 1244550 - RNA, 19 nt, Homo sapiens
aaauugagauggauguaca

SEQ ID NO: 1244551 - RNA, 19 nt, Homo sapiens
uagcacaacugcaucuaca

SEQ ID NO: 1244552 - RNA, 19 nt, Homo sapiens
ggcaauggccagagugaaa

SEQ ID NO: 1244553 - RNA, 19 nt, Homo sapiens
gaaguuuacaugacuaugg

SEQ ID NO: 1244554 - RNA, 19 nt, Homo sapiens
gcaguaugaaguauucuug

SEQ ID NO: 1244555 - RNA, 19 nt, Homo sapiens
guagagaauuauccagucu

SEQ ID NO: 1244556 - RNA, 19 nt, Homo sapiens
auuaaaccaugcagaauug

SEQ ID NO: 1244557 - RNA, 19 nt, Homo sapiens
gauccagcaguaugaagua

SEQ ID NO: 1244558 - RNA, 19 nt, Homo sapiens
uauaaauccugggccaauu

SEQ ID NO: 1244559 - RNA, 19 nt, Homo sapiens
uauggugguucuucucaaa

SEQ ID NO: 1244560 - RNA, 19 nt, Homo sapiens
acacacggcaggccagaua

SEQ ID NO: 1244561 - RNA, 19 nt, Homo sapiens
agaagaugaugggaaauau

SEQ ID NO: 1244562 - RNA, 19 nt, Homo sapiens
ggagggcaauggccagagu

SEQ ID NO: 1244563 - RNA, 19 nt, Homo sapiens
aggaauucaucucgguuua

SEQ ID NO: 1244564 - RNA, 19 nt, Homo sapiens
caaauucauggugcuauaa

SEQ ID NO: 1244565 - RNA, 19 nt, Homo sapiens
agagaauuauccagucuau

SEQ ID NO: 1244566 - RNA, 19 nt, Homo sapiens
ucaguuuccucacagaaug

SEQ ID NO: 1244567 - RNA, 19 nt, Homo sapiens
gggaaauauugcagcaguu

SEQ ID NO: 1244568 - RNA, 19 nt, Homo sapiens
gcagucuauuauccaguaa

SEQ ID NO: 1244569 - RNA, 19 nt, Homo sapiens
gcggaagcaucagcaaaug

SEQ ID NO: 1244570 - RNA, 19 nt, Homo sapiens
gagcuaugauaacuucucu

SEQ ID NO: 1244571 - RNA, 19 nt, Homo sapiens
ggaaauugagauggaugua

SEQ ID NO: 1244572 - RNA, 19 nt, Homo sapiens
ucauggagcagucuauuau

SEQ ID NO: 1244573 - RNA, 19 nt, Homo sapiens
uaggauugcagugcuauua

SEQ ID NO: 1244574 - RNA, 19 nt, Homo sapiens
gcagagccagacuaugaaa

SEQ ID NO: 1244575 - RNA, 19 nt, Homo sapiens
agauuuaucccauaugcua

SEQ ID NO: 1244576 - RNA, 19 nt, Homo sapiens
agccuuugcuucuggauaa

SEQ ID NO: 1244577 - RNA, 19 nt, Homo sapiens
agaauuauccagucuauac

SEQ ID NO: 1244578 - RNA, 19 nt, Homo sapiens
gcagcuucauguagagaau

SEQ ID NO: 1244579 - RNA, 19 nt, Homo sapiens
aaagucauguucuaugucu

SEQ ID NO: 1244580 - RNA, 19 nt, Homo sapiens
caacugcaucuacagcaaa

SEQ ID NO: 1244581 - RNA, 19 nt, Homo sapiens
gagccagacuaugaaacuu

SEQ ID NO: 1244582 - RNA, 19 nt, Homo sapiens
gggaugagacugcuuaugc

SEQ ID NO: 1244583 - RNA, 19 nt, Homo sapiens
cuggcaauguuaugucuaa

SEQ ID NO: 1244584 - RNA, 19 nt, Homo sapiens
ccauuugucagcuuuauau

SEQ ID NO: 1244585 - RNA, 19 nt, Homo sapiens
ggagucccaguauggauuu

SEQ ID NO: 1244586 - RNA, 19 nt, Homo sapiens
ccagauuauuccuguguuc

SEQ ID NO: 1244587 - RNA, 19 nt, Homo sapiens
acagugaggugaggagaga

SEQ ID NO: 1244588 - RNA, 19 nt, Homo sapiens
aagaugaugggaaauauug

SEQ ID NO: 1244589 - RNA, 19 nt, Homo sapiens
uaucccauaugcuauuguu

SEQ ID NO: 1244590 - RNA, 19 nt, Homo sapiens
ucaaaccguuccucaaugc

SEQ ID NO: 1244591 - RNA, 19 nt, Homo sapiens
ggaauucaucucgguuuau

SEQ ID NO: 1244592 - RNA, 19 nt, Homo sapiens
aauaaggagucccaguaug

SEQ ID NO: 1244593 - RNA, 19 nt, Homo sapiens
ccaagagccuuugcuucug

SEQ ID NO: 1244594 - RNA, 19 nt, Homo sapiens
gcucaggcaaacagacuuu

SEQ ID NO: 1244595 - RNA, 19 nt, Homo sapiens
gggcuuggaagaaacuauu

SEQ ID NO: 1244596 - RNA, 19 nt, Homo sapiens
ucucguucauuuagacgua

SEQ ID NO: 1244597 - RNA, 19 nt, Homo sapiens
gaagaacccuugugaagua

SEQ ID NO: 1244598 - RNA, 19 nt, Homo sapiens
gaacagaaauuaccuuaug

SEQ ID NO: 1244599 - RNA, 19 nt, Homo sapiens
gaaagaaccuaaagacuuc

SEQ ID NO: 1244600 - RNA, 19 nt, Homo sapiens
ggaguggacuugauugaua

SEQ ID NO: 1244601 - RNA, 19 nt, Homo sapiens
gagaaaaggugacaguuua

SEQ ID NO: 1244602 - RNA, 19 nt, Homo sapiens
ucacaaauuuggugucuuu

SEQ ID NO: 1244603 - RNA, 19 nt, Homo sapiens
ggaaagaaccuaaagacuu

SEQ ID NO: 1244604 - RNA, 19 nt, Homo sapiens
gaaggcuacuuucuuguuu

SEQ ID NO: 1244605 - RNA, 19 nt, Homo sapiens
cagguaaagucacaaauuu

SEQ ID NO: 1244606 - RNA, 19 nt, Homo sapiens
gcucuuaguuguucccuuu

SEQ ID NO: 1244607 - RNA, 19 nt, Homo sapiens
gaugagacuuggcauguga

SEQ ID NO: 1244608 - RNA, 19 nt, Homo sapiens
aaacagagcccgacuugaa

SEQ ID NO: 1244609 - RNA, 19 nt, Homo sapiens
gagaacagaaauuaccuua

SEQ ID NO: 1244610 - RNA, 19 nt, Homo sapiens
guccucaucuccucucuua

SEQ ID NO: 1244611 - RNA, 19 nt, Homo sapiens
cuaaagacuucgugugauu

SEQ ID NO: 1244612 - RNA, 19 nt, Homo sapiens
agacaucgcucccgggaaa

SEQ ID NO: 1244613 - RNA, 19 nt, Homo sapiens
ggagagagacugaauugga

SEQ ID NO: 1244614 - RNA, 19 nt, Homo sapiens
gcagguaaagucacaaauu

SEQ ID NO: 1244615 - RNA, 19 nt, Homo sapiens
gaaguaaccaggaggaaug

SEQ ID NO: 1244616 - RNA, 19 nt, Homo sapiens
uaacauaccacuucuuugu

SEQ ID NO: 1244617 - RNA, 19 nt, Homo sapiens
ggauuacagugacgcaauu

SEQ ID NO: 1244618 - RNA, 19 nt, Homo sapiens
cagaucagauugaccugua

SEQ ID NO: 1244619 - RNA, 19 nt, Homo sapiens
gacauagggucacuagaga

SEQ ID NO: 1244620 - RNA, 19 nt, Homo sapiens
gcuaacauaccacuucuuu

SEQ ID NO: 1244621 - RNA, 19 nt, Homo sapiens
uagacgagcugccguuuau

SEQ ID NO: 1244622 - RNA, 19 nt, Homo sapiens
gacccagaguucaacaaua

SEQ ID NO: 1244623 - RNA, 19 nt, Homo sapiens
ugaaugaacucagcucaga

SEQ ID NO: 1244624 - RNA, 19 nt, Homo sapiens
gaagccgaauuugaagaua

SEQ ID NO: 1244625 - RNA, 19 nt, Homo sapiens
agauugaccuguaugauga

SEQ ID NO: 1244626 - RNA, 19 nt, Homo sapiens
gcccucagcacuagauuua

SEQ ID NO: 1244627 - RNA, 19 nt, Homo sapiens
caacaauacagaucagauu

SEQ ID NO: 1244628 - RNA, 19 nt, Homo sapiens
ccagcacguuucucauaua

SEQ ID NO: 1244629 - RNA, 19 nt, Homo sapiens
gaaaggagucugguuggaa

SEQ ID NO: 1244630 - RNA, 19 nt, Homo sapiens
gagugaagccgaauuugaa

SEQ ID NO: 1244631 - RNA, 19 nt, Homo sapiens
gcaaauggccaguccaaag

SEQ ID NO: 1244632 - RNA, 19 nt, Homo sapiens
gaggagagagacugaauug

SEQ ID NO: 1244633 - RNA, 19 nt, Homo sapiens
gcaauaaccagcucuuagu

SEQ ID NO: 1244634 - RNA, 19 nt, Homo sapiens
acauaccacuucuuuguuu

SEQ ID NO: 1244635 - RNA, 19 nt, Homo sapiens
gguggcaucuuccuuacuu

SEQ ID NO: 1244636 - RNA, 19 nt, Homo sapiens
cuacuucuguuccugcuuu

SEQ ID NO: 1244637 - RNA, 19 nt, Homo sapiens
cagggcaucugacaccuaa

SEQ ID NO: 1244638 - RNA, 19 nt, Homo sapiens
gggauaaccuggcacuagu

SEQ ID NO: 1244639 - RNA, 19 nt, Homo sapiens
ggaagguacugcccauugg

SEQ ID NO: 1244640 - RNA, 19 nt, Homo sapiens
gaagaucggcaugaugauu

SEQ ID NO: 1244641 - RNA, 19 nt, Homo sapiens
uuggguaccucuugcaaua

SEQ ID NO: 1244642 - RNA, 19 nt, Homo sapiens
cauaccacuucuuuguuua

SEQ ID NO: 1244643 - RNA, 19 nt, Homo sapiens
gaguggacuugauugauau

SEQ ID NO: 1244644 - RNA, 19 nt, Homo sapiens
gcaugaugauuauuuccaa

SEQ ID NO: 1244645 - RNA, 19 nt, Homo sapiens
ucacagccauugcgguuau

SEQ ID NO: 1244646 - RNA, 19 nt, Homo sapiens
uacaguggccugcguaaua

SEQ ID NO: 1244647 - RNA, 19 nt, Homo sapiens
ggccaaguguuaagugaug

SEQ ID NO: 1244648 - RNA, 19 nt, Homo sapiens
gaagcgaaacagagcaauu

SEQ ID NO: 1244649 - RNA, 19 nt, Homo sapiens
ugaaaacucuguccacaaa

SEQ ID NO: 1244650 - RNA, 19 nt, Homo sapiens
ggacugucuucauggcauu

SEQ ID NO: 1244651 - RNA, 19 nt, Homo sapiens
cuuaauagcuccucucacu

SEQ ID NO: 1244652 - RNA, 19 nt, Homo sapiens
ggcaggauauggccuacuu

SEQ ID NO: 1244653 - RNA, 19 nt, Homo sapiens
cauagagaauggugcuuug

SEQ ID NO: 1244654 - RNA, 19 nt, Homo sapiens
cuuaaggacugucuucaug

SEQ ID NO: 1244655 - RNA, 19 nt, Homo sapiens
ccagugugcugcccuacuu

SEQ ID NO: 1244656 - RNA, 19 nt, Homo sapiens
ccucacagcccucagauga

SEQ ID NO: 1244657 - RNA, 19 nt, Homo sapiens
ccacccaacuggccaagug

SEQ ID NO: 1244658 - RNA, 19 nt, Homo sapiens
caucugacaccuaacauga

SEQ ID NO: 1244659 - RNA, 19 nt, Homo sapiens
caaugaagaacccuuguga

SEQ ID NO: 1244660 - RNA, 19 nt, Homo sapiens
ccucagcacuagauuuaau

SEQ ID NO: 1244661 - RNA, 19 nt, Homo sapiens
gcauugaagccaaguccua

SEQ ID NO: 1244662 - RNA, 19 nt, Homo sapiens
ccauugcgguuaucaaaca

SEQ ID NO: 1244663 - RNA, 19 nt, Homo sapiens
cagggaaaguucuuaaugg

SEQ ID NO: 1244664 - RNA, 19 nt, Homo sapiens
guugaaauuugcagagaau

SEQ ID NO: 1244665 - RNA, 19 nt, Homo sapiens
ucgauuaccuccucaucuu

SEQ ID NO: 1244666 - RNA, 19 nt, Homo sapiens
aagcagagaaggccuauga

SEQ ID NO: 1244667 - RNA, 19 nt, Homo sapiens
gaaccgggagcaugagaga

SEQ ID NO: 1244668 - RNA, 19 nt, Homo sapiens
gaguugaaauuugcagaga

SEQ ID NO: 1244669 - RNA, 19 nt, Homo sapiens
aagaucggcaugaugauua

SEQ ID NO: 1244670 - RNA, 19 nt, Homo sapiens
gcagagaaucgagcaaaug

SEQ ID NO: 1244671 - RNA, 19 nt, Homo sapiens
gagaugagacuuggcaugu

SEQ ID NO: 1244672 - RNA, 19 nt, Homo sapiens
gcacuaguaggcagguaaa

SEQ ID NO: 1244673 - RNA, 19 nt, Homo sapiens
gaagcaaguugggcaggau

SEQ ID NO: 1244674 - RNA, 19 nt, Homo sapiens
agagaaggccuaugagguu

SEQ ID NO: 1244675 - RNA, 19 nt, Homo sapiens
agacuuccuucccaaagaa

SEQ ID NO: 1244676 - RNA, 19 nt, Homo sapiens
caugagagacaccgggaua

SEQ ID NO: 1244677 - RNA, 19 nt, Homo sapiens
caucugcucguguggauaa

SEQ ID NO: 1244678 - RNA, 19 nt, Homo sapiens
ucuaugaugugguggaguu

SEQ ID NO: 1244679 - RNA, 19 nt, Homo sapiens
cugcaauucuguauaccua

SEQ ID NO: 1244680 - RNA, 19 nt, Homo sapiens
gagacugaauuggacuaaa

SEQ ID NO: 1244681 - RNA, 19 nt, Homo sapiens
cagaaggaguggacuugau

SEQ ID NO: 1244682 - RNA, 19 nt, Homo sapiens
guaggcagguaaagucaca

SEQ ID NO: 1244683 - RNA, 19 nt, Homo sapiens
ucacagcccucagaugaca

SEQ ID NO: 1244684 - RNA, 19 nt, Homo sapiens
gagcaaauggccaguccaa

SEQ ID NO: 1244685 - RNA, 19 nt, Homo sapiens
gugguggaguugaaauuug

SEQ ID NO: 1244686 - RNA, 19 nt, Homo sapiens
ggauaaccuggcacuagua

SEQ ID NO: 1244687 - RNA, 19 nt, Homo sapiens
aaaggaaccgggagcauga

SEQ ID NO: 1244688 - RNA, 19 nt, Homo sapiens
accgggaucugcuucauaa

SEQ ID NO: 1244689 - RNA, 19 nt, Homo sapiens
ugagugaagccgaauuuga

SEQ ID NO: 1244690 - RNA, 19 nt, Homo sapiens
uguugucggugauuuguuu

SEQ ID NO: 1244691 - RNA, 19 nt, Homo sapiens
ccguuuacccggagaauuu

SEQ ID NO: 1244692 - RNA, 19 nt, Homo sapiens
cagcacguuucucauauag

SEQ ID NO: 1244693 - RNA, 19 nt, Homo sapiens
cguaugaguuucugauucu

SEQ ID NO: 1244694 - RNA, 19 nt, Homo sapiens
ccuccacccucuacaguga

SEQ ID NO: 1244695 - RNA, 19 nt, Homo sapiens
caccagauacuuacaugaa

SEQ ID NO: 1244696 - RNA, 19 nt, Homo sapiens
gaaggaguggacuugauug

SEQ ID NO: 1244697 - RNA, 19 nt, Homo sapiens
gcaaacugcugccugauuu

SEQ ID NO: 1244698 - RNA, 19 nt, Homo sapiens
ggacuaaaguugugccaaa

SEQ ID NO: 1244699 - RNA, 19 nt, Homo sapiens
ggacagaagucgaagaauc

SEQ ID NO: 1244700 - RNA, 19 nt, Homo sapiens
caaagaaccuugaagaagu

SEQ ID NO: 1244701 - RNA, 19 nt, Homo sapiens
gaagucaccauuaauguaa

SEQ ID NO: 1244702 - RNA, 19 nt, Homo sapiens
uuacaaaucuuaccagguu

SEQ ID NO: 1244703 - RNA, 19 nt, Homo sapiens
guacaagacuuuaccauac

SEQ ID NO: 1244704 - RNA, 19 nt, Homo sapiens
uaaacuagguguucuaauc

SEQ ID NO: 1244705 - RNA, 19 nt, Homo sapiens
caaaagaagucaccauuaa

SEQ ID NO: 1244706 - RNA, 19 nt, Homo sapiens
gcaaaucacucugcaaugg

SEQ ID NO: 1244707 - RNA, 19 nt, Homo sapiens
ugagguagcugacacagaa

SEQ ID NO: 1244708 - RNA, 19 nt, Homo sapiens
guaauacggucugguguaa

SEQ ID NO: 1244709 - RNA, 19 nt, Homo sapiens
gaauuagacccuuaaggua

SEQ ID NO: 1244710 - RNA, 19 nt, Homo sapiens
agacagaaacuaauccuua

SEQ ID NO: 1244711 - RNA, 19 nt, Homo sapiens
gugccaaacuauaucaaua

SEQ ID NO: 1244712 - RNA, 19 nt, Homo sapiens
uaacuaggagacugaauua

SEQ ID NO: 1244713 - RNA, 19 nt, Homo sapiens
gauaguguauucuguuuca

SEQ ID NO: 1244714 - RNA, 19 nt, Homo sapiens
ccaaaguaauguagcauga

SEQ ID NO: 1244715 - RNA, 19 nt, Homo sapiens
cuucugagccuucuacuua

SEQ ID NO: 1244716 - RNA, 19 nt, Homo sapiens
ggaaagauaggacuaaagu

SEQ ID NO: 1244717 - RNA, 19 nt, Homo sapiens
gaaacauguucaucuggaa

SEQ ID NO: 1244718 - RNA, 19 nt, Homo sapiens
gcaccugguugauguguau

SEQ ID NO: 1244719 - RNA, 19 nt, Homo sapiens
uaaaagagaugcuaagaga

SEQ ID NO: 1244720 - RNA, 19 nt, Homo sapiens
caaaugugcaguucaguuu

SEQ ID NO: 1244721 - RNA, 19 nt, Homo sapiens
uaagaaagugucucuguuu

SEQ ID NO: 1244722 - RNA, 19 nt, Homo sapiens
uugcauagcuuuccaguuc

SEQ ID NO: 1244723 - RNA, 19 nt, Homo sapiens
gcagagaguccaagcagaa

SEQ ID NO: 1244724 - RNA, 19 nt, Homo sapiens
gagaaugccugcaaaagaa

SEQ ID NO: 1244725 - RNA, 19 nt, Homo sapiens
gcauguuguuuggaauuua

SEQ ID NO: 1244726 - RNA, 19 nt, Homo sapiens
agacugaauuagacccuua

SEQ ID NO: 1244727 - RNA, 19 nt, Homo sapiens
aaagauaggacuaaaguug

SEQ ID NO: 1244728 - RNA, 19 nt, Homo sapiens
ggaaaugcagggcacauga

SEQ ID NO: 1244729 - RNA, 19 nt, Homo sapiens
gaaagugucucuguuuuau

SEQ ID NO: 1244730 - RNA, 19 nt, Homo sapiens
cgucuuaccuggcagcaaa

SEQ ID NO: 1244731 - RNA, 19 nt, Homo sapiens
gcaaccuccuuaucugcua

SEQ ID NO: 1244732 - RNA, 19 nt, Homo sapiens
ggccaaugcauccaaauaa

SEQ ID NO: 1244733 - RNA, 19 nt, Homo sapiens
agaagaagacgaacuguga

SEQ ID NO: 1244734 - RNA, 19 nt, Homo sapiens
caggcaagcuuauucuuuc

SEQ ID NO: 1244735 - RNA, 19 nt, Homo sapiens
gaaagagucacaccuuagu

SEQ ID NO: 1244736 - RNA, 19 nt, Homo sapiens
aaagaacugugucaacuag

SEQ ID NO: 1244737 - RNA, 19 nt, Homo sapiens
caaagaacugugucaacua

SEQ ID NO: 1244738 - RNA, 19 nt, Homo sapiens
aacagugacuucauaacua

SEQ ID NO: 1244739 - RNA, 19 nt, Homo sapiens
gagaugauccagagacaug

SEQ ID NO: 1244740 - RNA, 19 nt, Homo sapiens
gcaaaugugcaguucaguu

SEQ ID NO: 1244741 - RNA, 19 nt, Homo sapiens
gcaaaagaagucaccauua

SEQ ID NO: 1244742 - RNA, 19 nt, Homo sapiens
gacagaaacuaauccuuac

SEQ ID NO: 1244743 - RNA, 19 nt, Homo sapiens
acaaguggguagugucauu

SEQ ID NO: 1244744 - RNA, 19 nt, Homo sapiens
gcagauggacuucuucagu

SEQ ID NO: 1244745 - RNA, 19 nt, Homo sapiens
uuaagaaagugucucuguu

SEQ ID NO: 1244746 - RNA, 19 nt, Homo sapiens
guaaauguauuggcacagu

SEQ ID NO: 1244747 - RNA, 19 nt, Homo sapiens
gacagaagucgaagaauca

SEQ ID NO: 1244748 - RNA, 19 nt, Homo sapiens
gaaguuaaaccaugugacu

SEQ ID NO: 1244749 - RNA, 19 nt, Homo sapiens
gccuauugguguuauguuu

SEQ ID NO: 1244750 - RNA, 19 nt, Homo sapiens
ugguugauguguauucaua

SEQ ID NO: 1244751 - RNA, 19 nt, Homo sapiens
cuuugcaacuccuguaaua

SEQ ID NO: 1244752 - RNA, 19 nt, Homo sapiens
acagauagcauccaacaga

SEQ ID NO: 1244753 - RNA, 19 nt, Homo sapiens
aaagaagucaccauuaaug

SEQ ID NO: 1244754 - RNA, 19 nt, Homo sapiens
cuaagagaaugccugcaaa

SEQ ID NO: 1244755 - RNA, 19 nt, Homo sapiens
ucuaguaugucuugaaaca

SEQ ID NO: 1244756 - RNA, 19 nt, Homo sapiens
gcaagcuuauucuuuccuu

SEQ ID NO: 1244757 - RNA, 19 nt, Homo sapiens
aaagaaccuugaagaagug

SEQ ID NO: 1244758 - RNA, 19 nt, Homo sapiens
caguucaguuugucucuuu

SEQ ID NO: 1244759 - RNA, 19 nt, Homo sapiens
aaagagaugcuaagagaau

SEQ ID NO: 1244760 - RNA, 19 nt, Homo sapiens
caaccuccuuaucugcuaa

SEQ ID NO: 1244761 - RNA, 19 nt, Homo sapiens
cagauacgcaaccuccuua

SEQ ID NO: 1244762 - RNA, 19 nt, Homo sapiens
acucuaaacccacauauug

SEQ ID NO: 1244763 - RNA, 19 nt, Homo sapiens
ggcacuggaucccaucaaa

SEQ ID NO: 1244764 - RNA, 19 nt, Homo sapiens
uaacagauagcauccaaca

SEQ ID NO: 1244765 - RNA, 19 nt, Homo sapiens
gcuaagagaaugccugcaa

SEQ ID NO: 1244766 - RNA, 19 nt, Homo sapiens
cagaaacuaauccuuacua

SEQ ID NO: 1244767 - RNA, 19 nt, Homo sapiens
guuaaaccaugugacuaaa

SEQ ID NO: 1244768 - RNA, 19 nt, Homo sapiens
agacagcaaccagaaguua

SEQ ID NO: 1244769 - RNA, 19 nt, Homo sapiens
uaagguauaguguguguug

SEQ ID NO: 1244770 - RNA, 19 nt, Homo sapiens
ugaauuagacccuuaaggu

SEQ ID NO: 1244771 - RNA, 19 nt, Homo sapiens
gugacuaucuauccugaau

SEQ ID NO: 1244772 - RNA, 19 nt, Homo sapiens
gaaagauaggacuaaaguu

SEQ ID NO: 1244773 - RNA, 19 nt, Homo sapiens
gaccugaauucuacugagu

SEQ ID NO: 1244774 - RNA, 19 nt, Homo sapiens
acaaagaacugugucaacu

SEQ ID NO: 1244775 - RNA, 19 nt, Homo sapiens
gucgaagaaucacaaagaa

SEQ ID NO: 1244776 - RNA, 19 nt, Homo sapiens
gaaacagaauggccuucag

SEQ ID NO: 1244777 - RNA, 19 nt, Homo sapiens
uguaugagacagaaacuaa

SEQ ID NO: 1244778 - RNA, 19 nt, Homo sapiens
aggguagguuugugucuua

SEQ ID NO: 1244779 - RNA, 19 nt, Homo sapiens
acucugcaauggaaacuuu

SEQ ID NO: 1244780 - RNA, 19 nt, Homo sapiens
uauaguguguguugcaaau

SEQ ID NO: 1244781 - RNA, 19 nt, Homo sapiens
agaagucaccauuaaugua

SEQ ID NO: 1244782 - RNA, 19 nt, Homo sapiens
auuagacccuuaagguaua

SEQ ID NO: 1244783 - RNA, 19 nt, Homo sapiens
ccauuaauguaacagauag

SEQ ID NO: 1244784 - RNA, 19 nt, Homo sapiens
gacagcaaccagaaguuaa

SEQ ID NO: 1244785 - RNA, 19 nt, Homo sapiens
gccaaugcauccaaauaag

SEQ ID NO: 1244786 - RNA, 19 nt, Homo sapiens
cuaucuauccugaaucuaa

SEQ ID NO: 1244787 - RNA, 19 nt, Homo sapiens
cuacaggucaguuuaugaa

SEQ ID NO: 1244788 - RNA, 19 nt, Homo sapiens
ggaauacccaacccagaga

SEQ ID NO: 1244789 - RNA, 19 nt, Homo sapiens
gaaaugcagggcacaugau

SEQ ID NO: 1244790 - RNA, 19 nt, Homo sapiens
uguacaagacuuuaccaua

SEQ ID NO: 1244791 - RNA, 19 nt, Homo sapiens
aaaucacucugcaauggaa

SEQ ID NO: 1244792 - RNA, 19 nt, Homo sapiens
gacuaucuauccugaaucu

SEQ ID NO: 1244793 - RNA, 19 nt, Homo sapiens
ucaggcaagcuuauucuuu

SEQ ID NO: 1244794 - RNA, 19 nt, Homo sapiens
ggagacagcaaccagaagu

SEQ ID NO: 1244795 - RNA, 19 nt, Homo sapiens
cagguacuaugcagauguu

SEQ ID NO: 1244796 - RNA, 19 nt, Homo sapiens
cagcuagacauugcaauuu

SEQ ID NO: 1244797 - RNA, 19 nt, Homo sapiens
aaagaaagcuggucacaaa

SEQ ID NO: 1244798 - RNA, 19 nt, Homo sapiens
ggaaagagaaacuuacuua

SEQ ID NO: 1244799 - RNA, 19 nt, Homo sapiens
gaacuucuauucaccguuu

SEQ ID NO: 1244800 - RNA, 19 nt, Homo sapiens
ggagaaagaugcuacaugu

SEQ ID NO: 1244801 - RNA, 19 nt, Homo sapiens
gaaguacaguuaugcagua

SEQ ID NO: 1244802 - RNA, 19 nt, Homo sapiens
guuaggcgauugcaaauua

SEQ ID NO: 1244803 - RNA, 19 nt, Homo sapiens
ucacaaagcuaacuccaaa

SEQ ID NO: 1244804 - RNA, 19 nt, Homo sapiens
gagaaaagcucuacauauu

SEQ ID NO: 1244805 - RNA, 19 nt, Homo sapiens
gcaaggagguagggauaua

SEQ ID NO: 1244806 - RNA, 19 nt, Homo sapiens
ggaaaugcuuuaaauggaa

SEQ ID NO: 1244807 - RNA, 19 nt, Homo sapiens
uuaaaccacugccaaguua

SEQ ID NO: 1244808 - RNA, 19 nt, Homo sapiens
gaaagaugcuacaugugaa

SEQ ID NO: 1244809 - RNA, 19 nt, Homo sapiens
aaggaaagcugaacuagaa

SEQ ID NO: 1244810 - RNA, 19 nt, Homo sapiens
gaauggacuuuaauugcua

SEQ ID NO: 1244811 - RNA, 19 nt, Homo sapiens
gaagagaggcauccugauu

SEQ ID NO: 1244812 - RNA, 19 nt, Homo sapiens
gagaagaaguacaguuaug

SEQ ID NO: 1244813 - RNA, 19 nt, Homo sapiens
gaagacagaagaaacauug

SEQ ID NO: 1244814 - RNA, 19 nt, Homo sapiens
aagaagaacuugaugaaga

SEQ ID NO: 1244815 - RNA, 19 nt, Homo sapiens
gaauuaugcuucugugugu

SEQ ID NO: 1244816 - RNA, 19 nt, Homo sapiens
ggagguagggauauaauuu

SEQ ID NO: 1244817 - RNA, 19 nt, Homo sapiens
ggaaaugacagcuacuaaa

SEQ ID NO: 1244818 - RNA, 19 nt, Homo sapiens
ggaaacagaccaaauucaa

SEQ ID NO: 1244819 - RNA, 19 nt, Homo sapiens
gcaguaggccauagaauug

SEQ ID NO: 1244820 - RNA, 19 nt, Homo sapiens
gaaagcagcccacuggaau

SEQ ID NO: 1244821 - RNA, 19 nt, Homo sapiens
gagagacaauuucuagaau

SEQ ID NO: 1244822 - RNA, 19 nt, Homo sapiens
ggagagacaauuucuagaa

SEQ ID NO: 1244823 - RNA, 19 nt, Homo sapiens
cgacaauccuagccacuuu

SEQ ID NO: 1244824 - RNA, 19 nt, Homo sapiens
gaugaacguucuauuguca

SEQ ID NO: 1244825 - RNA, 19 nt, Homo sapiens
cagauuacauugggagaua

SEQ ID NO: 1244826 - RNA, 19 nt, Homo sapiens
gaaagugaauacaguaggu

SEQ ID NO: 1244827 - RNA, 19 nt, Homo sapiens
gaaaugacagcuacuaaag

SEQ ID NO: 1244828 - RNA, 19 nt, Homo sapiens
agacauaccuuuaccucuu

SEQ ID NO: 1244829 - RNA, 19 nt, Homo sapiens
gcaguuaggcgauugcaaa

SEQ ID NO: 1244830 - RNA, 19 nt, Homo sapiens
gaaagucuaaccaucauau

SEQ ID NO: 1244831 - RNA, 19 nt, Homo sapiens
uacaguaggucagaaauaa

SEQ ID NO: 1244832 - RNA, 19 nt, Homo sapiens
gaaaagcucuacauauugu

SEQ ID NO: 1244833 - RNA, 19 nt, Homo sapiens
ggaauggacuuuaauugcu

SEQ ID NO: 1244834 - RNA, 19 nt, Homo sapiens
ugaaggagacuuugauuga

SEQ ID NO: 1244835 - RNA, 19 nt, Homo sapiens
ggacuucaguucagguugu

SEQ ID NO: 1244836 - RNA, 19 nt, Homo sapiens
caacaagaauaaccaaguc

SEQ ID NO: 1244837 - RNA, 19 nt, Homo sapiens
gacauaccuuuaccucuuu

SEQ ID NO: 1244838 - RNA, 19 nt, Homo sapiens
cagcuuggaugagucuuua

SEQ ID NO: 1244839 - RNA, 19 nt, Homo sapiens
cagaagaguuccuaaugga

SEQ ID NO: 1244840 - RNA, 19 nt, Homo sapiens
caaccuaaacucuaaauuc

SEQ ID NO: 1244841 - RNA, 19 nt, Homo sapiens
gaauaaccaagucuuugua

SEQ ID NO: 1244842 - RNA, 19 nt, Homo sapiens
caaagaacagacaguagua

SEQ ID NO: 1244843 - RNA, 19 nt, Homo sapiens
gaacagacaguaguagaug

SEQ ID NO: 1244844 - RNA, 19 nt, Homo sapiens
ugaugaagaugacauaauc

SEQ ID NO: 1244845 - RNA, 19 nt, Homo sapiens
guacaguuaugcaguaaag

SEQ ID NO: 1244846 - RNA, 19 nt, Homo sapiens
agaagaagcugggaauugu

SEQ ID NO: 1244847 - RNA, 19 nt, Homo sapiens
gaagauugaauuugagaga

SEQ ID NO: 1244848 - RNA, 19 nt, Homo sapiens
aaacagacaaguacuuuga

SEQ ID NO: 1244849 - RNA, 19 nt, Homo sapiens
agauagaggagaaucauua

SEQ ID NO: 1244850 - RNA, 19 nt, Homo sapiens
caaguacuuugaaacaaga

SEQ ID NO: 1244851 - RNA, 19 nt, Homo sapiens
gaacuuucagguuaacaaa

SEQ ID NO: 1244852 - RNA, 19 nt, Homo sapiens
guucgaacuuucagguuaa

SEQ ID NO: 1244853 - RNA, 19 nt, Homo sapiens
caugugaacuuccuuuaca

SEQ ID NO: 1244854 - RNA, 19 nt, Homo sapiens
agaaagaugcuacauguga

SEQ ID NO: 1244855 - RNA, 19 nt, Homo sapiens
ccaggaaacagaccaaauu

SEQ ID NO: 1244856 - RNA, 19 nt, Homo sapiens
gaacaaaguggccauucug

SEQ ID NO: 1244857 - RNA, 19 nt, Homo sapiens
gaagaagcugggaauugua

SEQ ID NO: 1244858 - RNA, 19 nt, Homo sapiens
cuucuuggcuccaccagua

SEQ ID NO: 1244859 - RNA, 19 nt, Homo sapiens
gaaggagacuuugauugag

SEQ ID NO: 1244860 - RNA, 19 nt, Homo sapiens
gaauacaguaggucagaaa

SEQ ID NO: 1244861 - RNA, 19 nt, Homo sapiens
ugaacuuccuuuacagaaa

SEQ ID NO: 1244862 - RNA, 19 nt, Homo sapiens
gacaaguacuuugaaacaa

SEQ ID NO: 1244863 - RNA, 19 nt, Homo sapiens
guaagcaauuaggucaaua

SEQ ID NO: 1244864 - RNA, 19 nt, Homo sapiens
gguggugacugauaacuag

SEQ ID NO: 1244865 - RNA, 19 nt, Homo sapiens
gagcaugauuccaccuuuc

SEQ ID NO: 1244866 - RNA, 19 nt, Homo sapiens
gaccacagcugcaccaaaa

SEQ ID NO: 1244867 - RNA, 19 nt, Homo sapiens
acagugaugucguggauga

SEQ ID NO: 1244868 - RNA, 19 nt, Homo sapiens
gucacaggcuagaucaaua

SEQ ID NO: 1244869 - RNA, 19 nt, Homo sapiens
agagugauauauuccauga

SEQ ID NO: 1244870 - RNA, 19 nt, Homo sapiens
ucaggaagguaugguguuu

SEQ ID NO: 1244871 - RNA, 19 nt, Homo sapiens
acacaaaccugcggaaugg

SEQ ID NO: 1244872 - RNA, 19 nt, Homo sapiens
gauuccaccuuuccacuga

SEQ ID NO: 1244873 - RNA, 19 nt, Homo sapiens
ugaagaaaccaccaaauca

SEQ ID NO: 1244874 - RNA, 19 nt, Homo sapiens
aaagcuaacuccaaacaca

SEQ ID NO: 1244875 - RNA, 19 nt, Homo sapiens
gauaguagcagugacaaug

SEQ ID NO: 1244876 - RNA, 19 nt, Homo sapiens
uggagaagaaguacaguua

SEQ ID NO: 1244877 - RNA, 19 nt, Homo sapiens
ggaugaacguucuauuguc

SEQ ID NO: 1244878 - RNA, 19 nt, Homo sapiens
ggcaaaggcuacugucauc

SEQ ID NO: 1244879 - RNA, 19 nt, Homo sapiens
uggaaucuguaguuuguuu

SEQ ID NO: 1244880 - RNA, 19 nt, Homo sapiens
aauggaaucuguaguuugu

SEQ ID NO: 1244881 - RNA, 19 nt, Homo sapiens
ggagauauuuacacacaac

SEQ ID NO: 1244882 - RNA, 19 nt, Homo sapiens
gaaaacgcaucguacuuga

SEQ ID NO: 1244883 - RNA, 19 nt, Homo sapiens
cccgaagccucucugguua

SEQ ID NO: 1244884 - RNA, 19 nt, Homo sapiens
aaucauuacuccaacaaga

SEQ ID NO: 1244885 - RNA, 19 nt, Homo sapiens
cacccuccuugaagaauua

SEQ ID NO: 1244886 - RNA, 19 nt, Homo sapiens
cagaacagcuuggaugagu

SEQ ID NO: 1244887 - RNA, 19 nt, Homo sapiens
ggucagaaauaacucuagu

SEQ ID NO: 1244888 - RNA, 19 nt, Homo sapiens
ggcaguaggccauagaauu

SEQ ID NO: 1244889 - RNA, 19 nt, Homo sapiens
guagggauauaauuucucu

SEQ ID NO: 1244890 - RNA, 19 nt, Homo sapiens
gaauauuacagaagaguuc

SEQ ID NO: 1244891 - RNA, 19 nt, Homo sapiens
ggugacugauaacuaguuu

SEQ ID NO: 1244892 - RNA, 19 nt, Homo sapiens
aaaguugaguaaaguguug

SEQ ID NO: 1244893 - RNA, 19 nt, Homo sapiens
agaagaacuugaugaagau

SEQ ID NO: 1244894 - RNA, 19 nt, Homo sapiens
cgaagccucucugguuaaa

SEQ ID NO: 1244895 - RNA, 19 nt, Homo sapiens
acagacaaguacuuugaaa

SEQ ID NO: 1244896 - RNA, 19 nt, Homo sapiens
gggcaaggagguagggaua

SEQ ID NO: 1244897 - RNA, 19 nt, Homo sapiens
cauagggucuuguuucuua

SEQ ID NO: 1244898 - RNA, 19 nt, Homo sapiens
caagauauagaccguauua

SEQ ID NO: 1244899 - RNA, 19 nt, Homo sapiens
gcagacgaauuccuauaaa

SEQ ID NO: 1244900 - RNA, 19 nt, Homo sapiens
gagcacagcuauauuuuaa

SEQ ID NO: 1244901 - RNA, 19 nt, Homo sapiens
gggaaugaguccugguaua

SEQ ID NO: 1244902 - RNA, 19 nt, Homo sapiens
gaagaacgguaugacugua

SEQ ID NO: 1244903 - RNA, 19 nt, Homo sapiens
cuauaaagcucaucuccaa

SEQ ID NO: 1244904 - RNA, 19 nt, Homo sapiens
gacaagauauagaccguau

SEQ ID NO: 1244905 - RNA, 19 nt, Homo sapiens
ggaaugaguccugguauau

SEQ ID NO: 1244906 - RNA, 19 nt, Homo sapiens
guucaagggugcaagagaa

SEQ ID NO: 1244907 - RNA, 19 nt, Homo sapiens
aaguguggauugccuauua

SEQ ID NO: 1244908 - RNA, 19 nt, Homo sapiens
gagguucucucuucaugug

SEQ ID NO: 1244909 - RNA, 19 nt, Homo sapiens
acagauaaguggcucaguu

SEQ ID NO: 1244910 - RNA, 19 nt, Homo sapiens
gaugccaccuuauaugaau

SEQ ID NO: 1244911 - RNA, 19 nt, Homo sapiens
gcccagaugccaccuuaua

SEQ ID NO: 1244912 - RNA, 19 nt, Homo sapiens
caagagaacauauuugucu

SEQ ID NO: 1244913 - RNA, 19 nt, Homo sapiens
uauauggccugcaccaaga

SEQ ID NO: 1244914 - RNA, 19 nt, Homo sapiens
caaagcagcauaucaugau

SEQ ID NO: 1244915 - RNA, 19 nt, Homo sapiens
guugagcacagcuauauuu

SEQ ID NO: 1244916 - RNA, 19 nt, Homo sapiens
ccagaucagacaagauaua

SEQ ID NO: 1244917 - RNA, 19 nt, Homo sapiens
aaauucaggugcuagagaa

SEQ ID NO: 1244918 - RNA, 19 nt, Homo sapiens
cacaugagcacuauaauca

SEQ ID NO: 1244919 - RNA, 19 nt, Homo sapiens
uaucaaccaucgccauaug

SEQ ID NO: 1244920 - RNA, 19 nt, Homo sapiens
gaugaagaaggauuugauu

SEQ ID NO: 1244921 - RNA, 19 nt, Homo sapiens
gaccguauuaccaaugaua

SEQ ID NO: 1244922 - RNA, 19 nt, Homo sapiens
ccaauaagccauccaaugc

SEQ ID NO: 1244923 - RNA, 19 nt, Homo sapiens
cgaacucaaagaacuauaa

SEQ ID NO: 1244924 - RNA, 19 nt, Homo sapiens
gcacagcuauauuuuaaca

SEQ ID NO: 1244925 - RNA, 19 nt, Homo sapiens
acuccgagcccuccauuua

SEQ ID NO: 1244926 - RNA, 19 nt, Homo sapiens
guacuccucacuugguaua

SEQ ID NO: 1244927 - RNA, 19 nt, Homo sapiens
ccaaagcagcauaucauga

SEQ ID NO: 1244928 - RNA, 19 nt, Homo sapiens
gcaccgcgaacucaaagaa

SEQ ID NO: 1244929 - RNA, 19 nt, Homo sapiens
acccagaggugaccauuug

SEQ ID NO: 1244930 - RNA, 19 nt, Homo sapiens
gaguuacaaggcacuaaua

SEQ ID NO: 1244931 - RNA, 19 nt, Homo sapiens
ucacacugacaaugaguua

SEQ ID NO: 1244932 - RNA, 19 nt, Homo sapiens
gaacuccgagcccuccauu

SEQ ID NO: 1244933 - RNA, 19 nt, Homo sapiens
gauauagaccguauuacca

SEQ ID NO: 1244934 - RNA, 19 nt, Homo sapiens
cagaugccaccuuauauga

SEQ ID NO: 1244935 - RNA, 19 nt, Homo sapiens
gauaaacaucuuaggugaa

SEQ ID NO: 1244936 - RNA, 19 nt, Homo sapiens
gaagaagaacgguaugacu

SEQ ID NO: 1244937 - RNA, 19 nt, Homo sapiens
gguucucucuucaugugua

SEQ ID NO: 1244938 - RNA, 19 nt, Homo sapiens
ggggugagcuguuugcaaa

SEQ ID NO: 1244939 - RNA, 19 nt, Homo sapiens
ucaccaucauccugaauau

SEQ ID NO: 1244940 - RNA, 19 nt, Homo sapiens
cauaucaaccaucgccaua

SEQ ID NO: 1244941 - RNA, 19 nt, Homo sapiens
ggugcaagagaacauauuu

SEQ ID NO: 1244942 - RNA, 19 nt, Homo sapiens
cagaggugaccauuuguaa

SEQ ID NO: 1244943 - RNA, 19 nt, Homo sapiens
gaccacaucauccagauca

SEQ ID NO: 1244944 - RNA, 19 nt, Homo sapiens
gaaugaguccugguauaug

SEQ ID NO: 1244945 - RNA, 19 nt, Homo sapiens
guaucgcacccucaucaua

SEQ ID NO: 1244946 - RNA, 19 nt, Homo sapiens
caaauucaggugcuagaga

SEQ ID NO: 1244947 - RNA, 19 nt, Homo sapiens
caagaaaacacagcaauuu

SEQ ID NO: 1244948 - RNA, 19 nt, Homo sapiens
ccagacaagcaccauauga

SEQ ID NO: 1244949 - RNA, 19 nt, Homo sapiens
aaagggagauaagaugugu

SEQ ID NO: 1244950 - RNA, 19 nt, Homo sapiens
gaucagacaagauauagac

SEQ ID NO: 1244951 - RNA, 19 nt, Homo sapiens
acacauagggucuuguuuc

SEQ ID NO: 1244952 - RNA, 19 nt, Homo sapiens
uagaccguauuaccaauga

SEQ ID NO: 1244953 - RNA, 19 nt, Homo sapiens
uaaagcucaucuccaaaca

SEQ ID NO: 1244954 - RNA, 19 nt, Homo sapiens
cagacgaauuccuauaaag

SEQ ID NO: 1244955 - RNA, 19 nt, Homo sapiens
agaacgguaugacuguaaa

SEQ ID NO: 1244956 - RNA, 19 nt, Homo sapiens
ccagaggugaccauuugua

SEQ ID NO: 1244957 - RNA, 19 nt, Homo sapiens
ccagaugccaccuuauaug

SEQ ID NO: 1244958 - RNA, 19 nt, Homo sapiens
uacacgagguucucucuuc

SEQ ID NO: 1244959 - RNA, 19 nt, Homo sapiens
ggugagcuguuugcaaauc

SEQ ID NO: 1244960 - RNA, 19 nt, Homo sapiens
ggaucacacugacaaugag

SEQ ID NO: 1244961 - RNA, 19 nt, Homo sapiens
uauuaugccuccacagcaa

SEQ ID NO: 1244962 - RNA, 19 nt, Homo sapiens
uaucgcacccucaucauau

SEQ ID NO: 1244963 - RNA, 19 nt, Homo sapiens
aagcucaucuccaaacaag

SEQ ID NO: 1244964 - RNA, 19 nt, Homo sapiens
ccacaugagcacuauaauc

SEQ ID NO: 1244965 - RNA, 19 nt, Homo sapiens
cagauaaguggcucaguug

SEQ ID NO: 1244966 - RNA, 19 nt, Homo sapiens
caggaugacucaaauucag

SEQ ID NO: 1244967 - RNA, 19 nt, Homo sapiens
aaaggaugauacaccaguu

SEQ ID NO: 1244968 - RNA, 19 nt, Homo sapiens
uaaugaagaagaacgguau

SEQ ID NO: 1244969 - RNA, 19 nt, Homo sapiens
gaggugaccauuuguaaaa

SEQ ID NO: 1244970 - RNA, 19 nt, Homo sapiens
cacauagggucuuguuucu

SEQ ID NO: 1244971 - RNA, 19 nt, Homo sapiens
gacauauuauugcccagau

SEQ ID NO: 1244972 - RNA, 19 nt, Homo sapiens
gcucaucuccaaacaagca

SEQ ID NO: 1244973 - RNA, 19 nt, Homo sapiens
acacgagguucucucuuca

SEQ ID NO: 1244974 - RNA, 19 nt, Homo sapiens
ccauuauaauccuaacuca

SEQ ID NO: 1244975 - RNA, 19 nt, Homo sapiens
uugcccagaugccaccuua

SEQ ID NO: 1244976 - RNA, 19 nt, Homo sapiens
acuccucacuugguauaua

SEQ ID NO: 1244977 - RNA, 19 nt, Homo sapiens
acacagcaauuuaauaacc

SEQ ID NO: 1244978 - RNA, 19 nt, Homo sapiens
ccaccuccuuugcaacaug

SEQ ID NO: 1244979 - RNA, 19 nt, Homo sapiens
gcaagagaacauauuuguc

SEQ ID NO: 1244980 - RNA, 19 nt, Homo sapiens
gcagcgaauugagcagugu

SEQ ID NO: 1244981 - RNA, 19 nt, Homo sapiens
ucauuucugugacaagugu

SEQ ID NO: 1244982 - RNA, 19 nt, Homo sapiens
ccaguucauuucugugaca

SEQ ID NO: 1244983 - RNA, 19 nt, Homo sapiens
ugaaaucccugagcguuuu

SEQ ID NO: 1244984 - RNA, 19 nt, Homo sapiens
ugcuaugacugugcuauuu

SEQ ID NO: 1244985 - RNA, 19 nt, Homo sapiens
cgcagacgaauuccuauaa

SEQ ID NO: 1244986 - RNA, 19 nt, Homo sapiens
aaugaguccugguauaugg

SEQ ID NO: 1244987 - RNA, 19 nt, Homo sapiens
acuauaaucagccacauga

SEQ ID NO: 1244988 - RNA, 19 nt, Homo sapiens
gccaccaccuccuuugcaa

SEQ ID NO: 1244989 - RNA, 19 nt, Homo sapiens
ugagccauauuccgccaaa

SEQ ID NO: 1244990 - RNA, 19 nt, Homo sapiens
gauccugugcagcgaauug

SEQ ID NO: 1244991 - RNA, 19 nt, Homo sapiens
gaaucauggaucacacuga

SEQ ID NO: 1244992 - RNA, 19 nt, Homo sapiens
gcacuauaaucagccacau

SEQ ID NO: 1244993 - RNA, 19 nt, Homo sapiens
uguccaggcuguagugauc

SEQ ID NO: 1244994 - RNA, 19 nt, Homo sapiens
guucauuucugugacaagu

SEQ ID NO: 1244995 - RNA, 19 nt, Homo sapiens
caucuuaggugaaaaggau

SEQ ID NO: 1244996 - RNA, 19 nt, Homo sapiens
cuucauguguagcauuguu

SEQ ID NO: 1244997 - RNA, 19 nt, Homo sapiens
ggaaaggccugcauucuga

SEQ ID NO: 1244998 - RNA, 19 nt, Homo sapiens
gcacuucucuccacacaga

SEQ ID NO: 1244999 - RNA, 19 nt, Homo sapiens
gcacguugcugaguaaaga

SEQ ID NO: 1245000 - RNA, 19 nt, Homo sapiens
ggucagggaugucuguuga

SEQ ID NO: 1245001 - RNA, 19 nt, Homo sapiens
ggaaggugauggaggaaga

SEQ ID NO: 1245002 - RNA, 19 nt, Homo sapiens
ucagggaucuuguugcauu

SEQ ID NO: 1245003 - RNA, 19 nt, Homo sapiens
ggacagugccuuuaaccaa

SEQ ID NO: 1245004 - RNA, 19 nt, Homo sapiens
gcaagaggcuggcgaucag

SEQ ID NO: 1245005 - RNA, 19 nt, Homo sapiens
cccaagagcuacccuguga

SEQ ID NO: 1245006 - RNA, 19 nt, Homo sapiens
gagcauuccucuagauugc

SEQ ID NO: 1245007 - RNA, 19 nt, Homo sapiens
cuucagggauccucuguug

SEQ ID NO: 1245008 - RNA, 19 nt, Homo sapiens
guggaauucucaagacuuc

SEQ ID NO: 1245009 - RNA, 19 nt, Homo sapiens
gggaaaggccugcauucug

SEQ ID NO: 1245010 - RNA, 19 nt, Homo sapiens
ggagcauuccucuagauug

SEQ ID NO: 1245011 - RNA, 19 nt, Homo sapiens
ccagacaguguggguguua

SEQ ID NO: 1245012 - RNA, 19 nt, Homo sapiens
ccaguggcaucuccucauc

SEQ ID NO: 1245013 - RNA, 19 nt, Homo sapiens
caagagcuacccugugauc

SEQ ID NO: 1245014 - RNA, 19 nt, Homo sapiens
ugccagagcugcacuucuc

SEQ ID NO: 1245015 - RNA, 19 nt, Homo sapiens
gcagagggguggcaugaag

SEQ ID NO: 1245016 - RNA, 19 nt, Homo sapiens
gcugcgagcccaugacauc

SEQ ID NO: 1245017 - RNA, 19 nt, Homo sapiens
ccagguggaauucucaaga

SEQ ID NO: 1245018 - RNA, 19 nt, Homo sapiens
ggcaucuccucaucacguu

SEQ ID NO: 1245019 - RNA, 19 nt, Homo sapiens
aggaugaggugcuacugau

SEQ ID NO: 1245020 - RNA, 19 nt, Homo sapiens
ggcaagaggcuggcgauca

SEQ ID NO: 1245021 - RNA, 19 nt, Homo sapiens
ccaccuggaggcaguguga

SEQ ID NO: 1245022 - RNA, 19 nt, Homo sapiens
gcugaguaaagagguguua

SEQ ID NO: 1245023 - RNA, 19 nt, Homo sapiens
gaaaggccugcauucugau

SEQ ID NO: 1245024 - RNA, 19 nt, Homo sapiens
ucagggauccucuguuguc

SEQ ID NO: 1245025 - RNA, 19 nt, Homo sapiens
ggaggaagaccugcaaagc

SEQ ID NO: 1245026 - RNA, 19 nt, Homo sapiens
gauggaggaagaccugcaa

SEQ ID NO: 1245027 - RNA, 19 nt, Homo sapiens
gcacugugagcccgagaca

SEQ ID NO: 1245028 - RNA, 19 nt, Homo sapiens
caggaugaggugcuacuga

SEQ ID NO: 1245029 - RNA, 19 nt, Homo sapiens
cagggaucuuguugcauug

SEQ ID NO: 1245030 - RNA, 19 nt, Homo sapiens
gcucguggcuaccuuuacc

SEQ ID NO: 1245031 - RNA, 19 nt, Homo sapiens
agggaugucuguugacucu

SEQ ID NO: 1245032 - RNA, 19 nt, Homo sapiens
gguggaauucucaagacuu

SEQ ID NO: 1245033 - RNA, 19 nt, Homo sapiens
gggcagauuccagccuuug

SEQ ID NO: 1245034 - RNA, 19 nt, Homo sapiens
uggcaucuguuugaaugug

SEQ ID NO: 1245035 - RNA, 19 nt, Homo sapiens
cagguggaauucucaagac

SEQ ID NO: 1245036 - RNA, 19 nt, Homo sapiens
gggagcagcugcagacaga

SEQ ID NO: 1245037 - RNA, 19 nt, Homo sapiens
gccgacagcugcagaagga

SEQ ID NO: 1245038 - RNA, 19 nt, Homo sapiens
gcucacaacugcgaugaca

SEQ ID NO: 1245039 - RNA, 19 nt, Homo sapiens
gagcagugcagagggauuu

SEQ ID NO: 1245040 - RNA, 19 nt, Homo sapiens
ucccagaccuccucucaga

SEQ ID NO: 1245041 - RNA, 19 nt, Homo sapiens
gagguaaagcgguugaaug

SEQ ID NO: 1245042 - RNA, 19 nt, Homo sapiens
gagcaagugcgcagcauca

SEQ ID NO: 1245043 - RNA, 19 nt, Homo sapiens
auaagcagcucagcgcaaa

SEQ ID NO: 1245044 - RNA, 19 nt, Homo sapiens
gcaagugcgcagcaucaug

SEQ ID NO: 1245045 - RNA, 19 nt, Homo sapiens
gaccuccucucagaacaga

SEQ ID NO: 1245046 - RNA, 19 nt, Homo sapiens
agguaaagcgguugaauga

SEQ ID NO: 1245047 - RNA, 19 nt, Homo sapiens
cggagaagcugcgggagau

SEQ ID NO: 1245048 - RNA, 19 nt, Homo sapiens
ggccugagacggagcaaug

SEQ ID NO: 1245049 - RNA, 19 nt, Homo sapiens
gaucguacugcccauggaa

SEQ ID NO: 1245050 - RNA, 19 nt, Homo sapiens
gcaggacugugaggagaag

SEQ ID NO: 1245051 - RNA, 19 nt, Homo sapiens
ggacugugccaagcagaug

SEQ ID NO: 1245052 - RNA, 19 nt, Homo sapiens
ccagaucaccgcccugaag

SEQ ID NO: 1245053 - RNA, 19 nt, Homo sapiens
ggacgucagggacaucaag

SEQ ID NO: 1245054 - RNA, 19 nt, Homo sapiens
gcagggcgaggaggaauca

SEQ ID NO: 1245055 - RNA, 19 nt, Homo sapiens
gcuccaagagggccugaga

SEQ ID NO: 1245056 - RNA, 19 nt, Homo sapiens
gcgccuccaucuccuccuu

SEQ ID NO: 1245057 - RNA, 19 nt, Homo sapiens
gaagcugcgggagaucgua

SEQ ID NO: 1245058 - RNA, 19 nt, Homo sapiens
gcucccagaccuccucuca

SEQ ID NO: 1245059 - RNA, 19 nt, Homo sapiens
gggccgaggagcugauuca

SEQ ID NO: 1245060 - RNA, 19 nt, Homo sapiens
ggagaucgaggagcugaag

SEQ ID NO: 1245061 - RNA, 19 nt, Homo sapiens
ucacggacgucagggacau

SEQ ID NO: 1245062 - RNA, 19 nt, Homo sapiens
cugagacccuggagcaagu

SEQ ID NO: 1245063 - RNA, 19 nt, Homo sapiens
gacccagaccuccaagcuu

SEQ ID NO: 1245064 - RNA, 19 nt, Homo sapiens
cagaacagagggccaaggu

SEQ ID NO: 1245065 - RNA, 19 nt, Homo sapiens
gaaaggugcugcuucauuu

SEQ ID NO: 1245066 - RNA, 19 nt, Homo sapiens
gcacagaccuucccaguca

SEQ ID NO: 1245067 - RNA, 19 nt, Homo sapiens
ccaaaacacugcuguauua

SEQ ID NO: 1245068 - RNA, 19 nt, Homo sapiens
acagauagcucacaugaau

SEQ ID NO: 1245069 - RNA, 19 nt, Homo sapiens
aaacacugcuguauuagaa

SEQ ID NO: 1245070 - RNA, 19 nt, Homo sapiens
gaugaggaaugcaacauga

SEQ ID NO: 1245071 - RNA, 19 nt, Homo sapiens
ccaagagacugagaaguuu

SEQ ID NO: 1245072 - RNA, 19 nt, Homo sapiens
caaagacauuagacuguuu

SEQ ID NO: 1245073 - RNA, 19 nt, Homo sapiens
guacuuagaugugaaaggu

SEQ ID NO: 1245074 - RNA, 19 nt, Homo sapiens
gcagguguacucacagaua

SEQ ID NO: 1245075 - RNA, 19 nt, Homo sapiens
ggacagaggacccgugaug

SEQ ID NO: 1245076 - RNA, 19 nt, Homo sapiens
ggaugucuguuccuacuug

SEQ ID NO: 1245077 - RNA, 19 nt, Homo sapiens
gcacagaagcacucaugaa

SEQ ID NO: 1245078 - RNA, 19 nt, Homo sapiens
aggcucaacuuaaguaauu

SEQ ID NO: 1245079 - RNA, 19 nt, Homo sapiens
ggaggugauuuguguuaga

SEQ ID NO: 1245080 - RNA, 19 nt, Homo sapiens
gcaaggacaaguacuacaa

SEQ ID NO: 1245081 - RNA, 19 nt, Homo sapiens
gaugacaugacucuaagua

SEQ ID NO: 1245082 - RNA, 19 nt, Homo sapiens
gaaagaaugcagacaccuu

SEQ ID NO: 1245083 - RNA, 19 nt, Homo sapiens
ugaagaggcuccugagagu

SEQ ID NO: 1245084 - RNA, 19 nt, Homo sapiens
ucaaagacauuagacuguu

SEQ ID NO: 1245085 - RNA, 19 nt, Homo sapiens
gggaugugguugacgauga

SEQ ID NO: 1245086 - RNA, 19 nt, Homo sapiens
cagaagcacucaugaagag

SEQ ID NO: 1245087 - RNA, 19 nt, Homo sapiens
gaggagcccugcaacaucu

SEQ ID NO: 1245088 - RNA, 19 nt, Homo sapiens
gagggaccauguucaccua

SEQ ID NO: 1245089 - RNA, 19 nt, Homo sapiens
gaggugauuuguguuagaa

SEQ ID NO: 1245090 - RNA, 19 nt, Homo sapiens
caacagagggaggugauuu

SEQ ID NO: 1245091 - RNA, 19 nt, Homo sapiens
ggaucgcaguacccuauuu

SEQ ID NO: 1245092 - RNA, 19 nt, Homo sapiens
gugauugccugaaauucuu

SEQ ID NO: 1245093 - RNA, 19 nt, Homo sapiens
agagggaggugauuugugu

SEQ ID NO: 1245094 - RNA, 19 nt, Homo sapiens
acaggacucugccagcuuu

SEQ ID NO: 1245095 - RNA, 19 nt, Homo sapiens
ugacaugacucuaaguaac

SEQ ID NO: 1245096 - RNA, 19 nt, Homo sapiens
ggaacgaggagaaggaaga

SEQ ID NO: 1245097 - RNA, 19 nt, Homo sapiens
cuacuggucuuucuaaacu

SEQ ID NO: 1245098 - RNA, 19 nt, Homo sapiens
aagaggcuccugagaguua

SEQ ID NO: 1245099 - RNA, 19 nt, Homo sapiens
ggaccauguucaccuacaa

SEQ ID NO: 1245100 - RNA, 19 nt, Homo sapiens
gaacugggcaauugaucga

SEQ ID NO: 1245101 - RNA, 19 nt, Homo sapiens
ggaggagggagaacagaaa

SEQ ID NO: 1245102 - RNA, 19 nt, Homo sapiens
cacagauacuagcuccuua

SEQ ID NO: 1245103 - RNA, 19 nt, Homo sapiens
aaugggaacugggcaauug

SEQ ID NO: 1245104 - RNA, 19 nt, Homo sapiens
acacagauagcucacauga

SEQ ID NO: 1245105 - RNA, 19 nt, Homo sapiens
ccuacaagcguccaaauga

SEQ ID NO: 1245106 - RNA, 19 nt, Homo sapiens
ggagccaaaugguuuagca

SEQ ID NO: 1245107 - RNA, 19 nt, Homo sapiens
gcaauugaucgaccaggaa

SEQ ID NO: 1245108 - RNA, 19 nt, Homo sapiens
uagcucacaugaauauugu

SEQ ID NO: 1245109 - RNA, 19 nt, Homo sapiens
gaaugcagacaccuuugaa

SEQ ID NO: 1245110 - RNA, 19 nt, Homo sapiens
ugagaaguuucccagaaug

SEQ ID NO: 1245111 - RNA, 19 nt, Homo sapiens
gcacuacgaguacgugauc

SEQ ID NO: 1245112 - RNA, 19 nt, Homo sapiens
ugacacagauagcucacau

SEQ ID NO: 1245113 - RNA, 19 nt, Homo sapiens
ccacuaagccuugcugaca

SEQ ID NO: 1245114 - RNA, 19 nt, Homo sapiens
acuggucuuucuaaacuua

SEQ ID NO: 1245115 - RNA, 19 nt, Homo sapiens
gcucacaacaucccagaau

SEQ ID NO: 1245116 - RNA, 19 nt, Homo sapiens
cuuagcagcucacaacauc

SEQ ID NO: 1245117 - RNA, 19 nt, Homo sapiens
gaccuggcaucugcuaaug

SEQ ID NO: 1245118 - RNA, 19 nt, Homo sapiens
gaaaccagaagagagagaa

SEQ ID NO: 1245119 - RNA, 19 nt, Homo sapiens
ggaggaacgaggagaagga

SEQ ID NO: 1245120 - RNA, 19 nt, Homo sapiens
ucccagcacucaguuguuu

SEQ ID NO: 1245121 - RNA, 19 nt, Homo sapiens
acugagaaguuucccagaa

SEQ ID NO: 1245122 - RNA, 19 nt, Homo sapiens
ggaccuggcaucugcuaau

SEQ ID NO: 1245123 - RNA, 19 nt, Homo sapiens
guugaaaccagaagagaga

SEQ ID NO: 1245124 - RNA, 19 nt, Homo sapiens
ggaggagcccugcaacauc

SEQ ID NO: 1245125 - RNA, 19 nt, Homo sapiens
gaaguuucccagaaugcaa

SEQ ID NO: 1245126 - RNA, 19 nt, Homo sapiens
uagcagguguacucacaga

SEQ ID NO: 1245127 - RNA, 19 nt, Homo sapiens
gagagagaaucuuguaacc

SEQ ID NO: 1245128 - RNA, 19 nt, Homo sapiens
uacacaagauguuugaaag

SEQ ID NO: 1245129 - RNA, 19 nt, Homo sapiens
ggugauuuguguuagaaag

SEQ ID NO: 1245130 - RNA, 19 nt, Homo sapiens
ggacucugccagcuuuguu

SEQ ID NO: 1245131 - RNA, 19 nt, Homo sapiens
cugagaaguuucccagaau

SEQ ID NO: 1245132 - RNA, 19 nt, Homo sapiens
ggccuguacuuagauguga

SEQ ID NO: 1245133 - RNA, 19 nt, Homo sapiens
cuaauggugcccuuugaaa

SEQ ID NO: 1245134 - RNA, 19 nt, Homo sapiens
gacucugugucuacaacua

SEQ ID NO: 1245135 - RNA, 19 nt, Homo sapiens
cagaggacccgugauguga

SEQ ID NO: 1245136 - RNA, 19 nt, Homo sapiens
cuacaagcguccaaaugag

SEQ ID NO: 1245137 - RNA, 19 nt, Homo sapiens
ccagucaucuaccaguauc

SEQ ID NO: 1245138 - RNA, 19 nt, Homo sapiens
gaggacccgugaugugaag

SEQ ID NO: 1245139 - RNA, 19 nt, Homo sapiens
gcacucaguuguuuuggau

SEQ ID NO: 1245140 - RNA, 19 nt, Homo sapiens
ggugcugcuucauuucuga

SEQ ID NO: 1245141 - RNA, 19 nt, Homo sapiens
agauagcucacaugaauau

SEQ ID NO: 1245142 - RNA, 19 nt, Homo sapiens
gcccagaugugccuguuuu

SEQ ID NO: 1245143 - RNA, 19 nt, Homo sapiens
gcuaauggugcccuuugaa

SEQ ID NO: 1245144 - RNA, 19 nt, Homo sapiens
ucugaugacaugacucuaa

SEQ ID NO: 1245145 - RNA, 19 nt, Homo sapiens
caauugaucgaccaggaaa

SEQ ID NO: 1245146 - RNA, 19 nt, Homo sapiens
gaagaggcuccugagaguu

SEQ ID NO: 1245147 - RNA, 19 nt, Homo sapiens
cuuuaagcaucaccaugua

SEQ ID NO: 1245148 - RNA, 19 nt, Homo sapiens
ggaugugguugacgaugag

SEQ ID NO: 1245149 - RNA, 19 nt, Homo sapiens
gauguucaccucagaaucg

SEQ ID NO: 1245150 - RNA, 19 nt, Homo sapiens
ggugauugccugaaauucu

SEQ ID NO: 1245151 - RNA, 19 nt, Homo sapiens
accaagagacugagaaguu

SEQ ID NO: 1245152 - RNA, 19 nt, Homo sapiens
uuacugacagggaaacuga

SEQ ID NO: 1245153 - RNA, 19 nt, Homo sapiens
gugcuacuggucuuucuaa

SEQ ID NO: 1245154 - RNA, 19 nt, Homo sapiens
cagaugggccacugacaga

SEQ ID NO: 1245155 - RNA, 19 nt, Homo sapiens
aaaguuacagauccuaguu

SEQ ID NO: 1245156 - RNA, 19 nt, Homo sapiens
cagauagcucacaugaaua

SEQ ID NO: 1245157 - RNA, 19 nt, Homo sapiens
gaagugugugagcaacauu

SEQ ID NO: 1245158 - RNA, 19 nt, Homo sapiens
agucaggcauccagacaga

SEQ ID NO: 1245159 - RNA, 19 nt, Homo sapiens
gagauguucaccucagaau

SEQ ID NO: 1245160 - RNA, 19 nt, Homo sapiens
gacucugccagcuuuguua

SEQ ID NO: 1245161 - RNA, 19 nt, Homo sapiens
ucacagauacuagcuccuu

SEQ ID NO: 1245162 - RNA, 19 nt, Homo sapiens
gucuacaacuacuacaaga

SEQ ID NO: 1245163 - RNA, 19 nt, Homo sapiens
cgggcaagguggagugguu

SEQ ID NO: 1245164 - RNA, 19 nt, Homo sapiens
uacugugacuccagcauga

SEQ ID NO: 1245165 - RNA, 19 nt, Homo sapiens
gcauacagcuuauugauua

SEQ ID NO: 1245166 - RNA, 19 nt, Homo sapiens
ggacaaaucugauccugua

SEQ ID NO: 1245167 - RNA, 19 nt, Homo sapiens
gaaauaacauccucucaaa

SEQ ID NO: 1245168 - RNA, 19 nt, Homo sapiens
caaaggauauuguaggaua

SEQ ID NO: 1245169 - RNA, 19 nt, Homo sapiens
ggacaaggcauacagcuua

SEQ ID NO: 1245170 - RNA, 19 nt, Homo sapiens
guauugagcugguaucuga

SEQ ID NO: 1245171 - RNA, 19 nt, Homo sapiens
ggacauggacaauaaagua

SEQ ID NO: 1245172 - RNA, 19 nt, Homo sapiens
ggacaaacauggauggaau

SEQ ID NO: 1245173 - RNA, 19 nt, Homo sapiens
ggaauugcuuucuauaaga

SEQ ID NO: 1245174 - RNA, 19 nt, Homo sapiens
gaacuagccaauaugaaua

SEQ ID NO: 1245175 - RNA, 19 nt, Homo sapiens
ggaagcagcaggaggaaua

SEQ ID NO: 1245176 - RNA, 19 nt, Homo sapiens
agacuuaccugaaggaauu

SEQ ID NO: 1245177 - RNA, 19 nt, Homo sapiens
gcucagaggugguggauuc

SEQ ID NO: 1245178 - RNA, 19 nt, Homo sapiens
guaaguugcuacucuuuga

SEQ ID NO: 1245179 - RNA, 19 nt, Homo sapiens
ccucuucccuugaaauuaa

SEQ ID NO: 1245180 - RNA, 19 nt, Homo sapiens
gaagcucgaaugacaauaa

SEQ ID NO: 1245181 - RNA, 19 nt, Homo sapiens
gcucgaaugacaauaaaua

SEQ ID NO: 1245182 - RNA, 19 nt, Homo sapiens
aaacuuagggcaacauuaa

SEQ ID NO: 1245183 - RNA, 19 nt, Homo sapiens
gagauaauccaugaagaua

SEQ ID NO: 1245184 - RNA, 19 nt, Homo sapiens
gauuagagcuggcaagcau

SEQ ID NO: 1245185 - RNA, 19 nt, Homo sapiens
gaacauacucugaggaaca

SEQ ID NO: 1245186 - RNA, 19 nt, Homo sapiens
ggaacuagccaauaugaau

SEQ ID NO: 1245187 - RNA, 19 nt, Homo sapiens
gcugggaucuuaguacaaa

SEQ ID NO: 1245188 - RNA, 19 nt, Homo sapiens
uaaagccucuucccuugaa

SEQ ID NO: 1245189 - RNA, 19 nt, Homo sapiens
aacaagagguuauacaaga

SEQ ID NO: 1245190 - RNA, 19 nt, Homo sapiens
aauguuugcugaugaagua

SEQ ID NO: 1245191 - RNA, 19 nt, Homo sapiens
gaaacgaaugggaauugua

SEQ ID NO: 1245192 - RNA, 19 nt, Homo sapiens
acaagaagaggaagagaua

SEQ ID NO: 1245193 - RNA, 19 nt, Homo sapiens
gaagccaaauccucagugu

SEQ ID NO: 1245194 - RNA, 19 nt, Homo sapiens
gaagagauaauccaugaag

SEQ ID NO: 1245195 - RNA, 19 nt, Homo sapiens
gcaggaggaauauaagaaa

SEQ ID NO: 1245196 - RNA, 19 nt, Homo sapiens
caagcaggauuaaguaaag

SEQ ID NO: 1245197 - RNA, 19 nt, Homo sapiens
aaacgaaugggaauuguaa

SEQ ID NO: 1245198 - RNA, 19 nt, Homo sapiens
caaaucugauccuguaauc

SEQ ID NO: 1245199 - RNA, 19 nt, Homo sapiens
aggaagagauaauccauga

SEQ ID NO: 1245200 - RNA, 19 nt, Homo sapiens
gaacuuggacaaacaugga

SEQ ID NO: 1245201 - RNA, 19 nt, Homo sapiens
guaaugaacuuggacaaac

SEQ ID NO: 1245202 - RNA, 19 nt, Homo sapiens
aauaaguaaugguggguua

SEQ ID NO: 1245203 - RNA, 19 nt, Homo sapiens
cuaacuugaucaacaauga

SEQ ID NO: 1245204 - RNA, 19 nt, Homo sapiens
cuacuaacuugaucaacaa

SEQ ID NO: 1245205 - RNA, 19 nt, Homo sapiens
cauggacaauaaaguagua

SEQ ID NO: 1245206 - RNA, 19 nt, Homo sapiens
gagcugguaucugagguuu

SEQ ID NO: 1245207 - RNA, 19 nt, Homo sapiens
ggaagauucuggugaaagc

SEQ ID NO: 1245208 - RNA, 19 nt, Homo sapiens
gggagaaggacaaggcaua

SEQ ID NO: 1245209 - RNA, 19 nt, Homo sapiens
aagaaaaccucaaaggaua

SEQ ID NO: 1245210 - RNA, 19 nt, Homo sapiens
gacaagauguggcauuggu

SEQ ID NO: 1245211 - RNA, 19 nt, Homo sapiens
gcuuauaauuccuggagaa

SEQ ID NO: 1245212 - RNA, 19 nt, Homo sapiens
augaggacauggacaauaa

SEQ ID NO: 1245213 - RNA, 19 nt, Homo sapiens
gcugguaucugagguuuca

SEQ ID NO: 1245214 - RNA, 19 nt, Homo sapiens
caucaagcaggauuaagua

SEQ ID NO: 1245215 - RNA, 19 nt, Homo sapiens
acaagagguuauacaagaa

SEQ ID NO: 1245216 - RNA, 19 nt, Homo sapiens
aauaacauccucucaaaug

SEQ ID NO: 1245217 - RNA, 19 nt, Homo sapiens
gacaaggcauacagcuuau

SEQ ID NO: 1245218 - RNA, 19 nt, Homo sapiens
aguauaugauccucagaua

SEQ ID NO: 1245219 - RNA, 19 nt, Homo sapiens
ccaacgaaaucauuaacuc

SEQ ID NO: 1245220 - RNA, 19 nt, Homo sapiens
gauguggcauugguaaguu

SEQ ID NO: 1245221 - RNA, 19 nt, Homo sapiens
caagauguggcauugguaa

SEQ ID NO: 1245222 - RNA, 19 nt, Homo sapiens
uaaugaacuuggacaaaca

SEQ ID NO: 1245223 - RNA, 19 nt, Homo sapiens
gaaaugcugacaagaugug

SEQ ID NO: 1245224 - RNA, 19 nt, Homo sapiens
ugaaguacaaguugaaaug

SEQ ID NO: 1245225 - RNA, 19 nt, Homo sapiens
ugaaauaacauccucucaa

SEQ ID NO: 1245226 - RNA, 19 nt, Homo sapiens
cguguuaaaguuucuguua

SEQ ID NO: 1245227 - RNA, 19 nt, Homo sapiens
cugaaaugcugacaagaug

SEQ ID NO: 1245228 - RNA, 19 nt, Homo sapiens
uggaauugcuuucuauaag

SEQ ID NO: 1245229 - RNA, 19 nt, Homo sapiens
gaaaucauuaacucuccua

SEQ ID NO: 1245230 - RNA, 19 nt, Homo sapiens
uuagcuguguggacaauuu

SEQ ID NO: 1245231 - RNA, 19 nt, Homo sapiens
caacauuucauggauagaa

SEQ ID NO: 1245232 - RNA, 19 nt, Homo sapiens
gccaauaugaauagacuuu

SEQ ID NO: 1245233 - RNA, 19 nt, Homo sapiens
gagaaaauccguaccuuug

SEQ ID NO: 1245234 - RNA, 19 nt, Homo sapiens
aguaaucccuugugucugu

SEQ ID NO: 1245235 - RNA, 19 nt, Homo sapiens
gauaaugaaugggguauug

SEQ ID NO: 1245236 - RNA, 19 nt, Homo sapiens
caaggcauacagcuuauug

SEQ ID NO: 1245237 - RNA, 19 nt, Homo sapiens
gaauagacuuuucuuccaa

SEQ ID NO: 1245238 - RNA, 19 nt, Homo sapiens
gcugaaaugcugacaagau

SEQ ID NO: 1245239 - RNA, 19 nt, Homo sapiens
gaaguacaaguugaaaugu

SEQ ID NO: 1245240 - RNA, 19 nt, Homo sapiens
gaauuguaagcgacuauga

SEQ ID NO: 1245241 - RNA, 19 nt, Homo sapiens
uguaagcgacuaugagaaa

SEQ ID NO: 1245242 - RNA, 19 nt, Homo sapiens
guugaaauguaguuauugg

SEQ ID NO: 1245243 - RNA, 19 nt, Homo sapiens
uagugugacugcugaaaug

SEQ ID NO: 1245244 - RNA, 19 nt, Homo sapiens
uauaugauccucagauaca

SEQ ID NO: 1245245 - RNA, 19 nt, Homo sapiens
ugugguugcugggaucuua

SEQ ID NO: 1245246 - RNA, 19 nt, Homo sapiens
cagaggugguggauucgaa

SEQ ID NO: 1245247 - RNA, 19 nt, Homo sapiens
gugagacaaaggcaaauaa

SEQ ID NO: 1245248 - RNA, 19 nt, Homo sapiens
aaagugagacaaaggcaaa

SEQ ID NO: 1245249 - RNA, 19 nt, Homo sapiens
gaauuacaguggcauacac

SEQ ID NO: 1245250 - RNA, 19 nt, Homo sapiens
ucagugugaugacagaaau

SEQ ID NO: 1245251 - RNA, 19 nt, Homo sapiens
gaaaauugcccacuacuac

SEQ ID NO: 1245252 - RNA, 19 nt, Homo sapiens
ccuugugucuguugcauga

SEQ ID NO: 1245253 - RNA, 19 nt, Homo sapiens
acauagcuguugaaacguu

SEQ ID NO: 1245254 - RNA, 19 nt, Homo sapiens
aagauucugucacugaguu

SEQ ID NO: 1245255 - RNA, 19 nt, Homo sapiens
ucaagcaggauuaaguaaa

SEQ ID NO: 1245256 - RNA, 19 nt, Homo sapiens
uguaaccuguggaucauau

SEQ ID NO: 1245257 - RNA, 19 nt, Homo sapiens
ccaguaaucccuugugucu

SEQ ID NO: 1245258 - RNA, 19 nt, Homo sapiens
cuuagggcaacauuaauua

SEQ ID NO: 1245259 - RNA, 19 nt, Homo sapiens
aagcucgaaugacaauaaa

SEQ ID NO: 1245260 - RNA, 19 nt, Homo sapiens
cauacucugaggaacauua

SEQ ID NO: 1245261 - RNA, 19 nt, Homo sapiens
ugagacaaaggcaaauaaa

SEQ ID NO: 1245262 - RNA, 19 nt, Homo sapiens
acuacuaacuugaucaaca

SEQ ID NO: 1245263 - RNA, 19 nt, Homo sapiens
gcccacuacuacuaacuug

SEQ ID NO: 1245264 - RNA, 19 nt, Homo sapiens
guuuggaauugcuuucuau

SEQ ID NO: 1245265 - RNA, 19 nt, Homo sapiens
gcaaggagaugaugaagga

SEQ ID NO: 1245266 - RNA, 19 nt, Homo sapiens
ccaagaaguugcucaagua

SEQ ID NO: 1245267 - RNA, 19 nt, Homo sapiens
gaaauagccugcuguccuu

SEQ ID NO: 1245268 - RNA, 19 nt, Homo sapiens
gaccaaggguuuccauguu

SEQ ID NO: 1245269 - RNA, 19 nt, Homo sapiens
gggcuugaauccucucuaa

SEQ ID NO: 1245270 - RNA, 19 nt, Homo sapiens
uaaaguguguugaucugaa

SEQ ID NO: 1245271 - RNA, 19 nt, Homo sapiens
gcuggagaauggcgacaua

SEQ ID NO: 1245272 - RNA, 19 nt, Homo sapiens
caaccgugaugguguguga

SEQ ID NO: 1245273 - RNA, 19 nt, Homo sapiens
cccacuaccuucugccuua

SEQ ID NO: 1245274 - RNA, 19 nt, Homo sapiens
gagaauggcgacauaaauc

SEQ ID NO: 1245275 - RNA, 19 nt, Homo sapiens
ggagaauggcgacauaaau

SEQ ID NO: 1245276 - RNA, 19 nt, Homo sapiens
gcccugcucuccagugauu

SEQ ID NO: 1245277 - RNA, 19 nt, Homo sapiens
gaagcacaccgugguagua

SEQ ID NO: 1245278 - RNA, 19 nt, Homo sapiens
auucaucucuguguucuua

SEQ ID NO: 1245279 - RNA, 19 nt, Homo sapiens
guuaaggaccguuacguuu

SEQ ID NO: 1245280 - RNA, 19 nt, Homo sapiens
guuauuggcugccguuaag

SEQ ID NO: 1245281 - RNA, 19 nt, Homo sapiens
gagcagcaccuacagaaca

SEQ ID NO: 1245282 - RNA, 19 nt, Homo sapiens
guacaguaauuagccgaaa

SEQ ID NO: 1245283 - RNA, 19 nt, Homo sapiens
gaacagcaaccgugauggu

SEQ ID NO: 1245284 - RNA, 19 nt, Homo sapiens
gcucagugauccagguguu

SEQ ID NO: 1245285 - RNA, 19 nt, Homo sapiens
aaaguguguugaucugaaa

SEQ ID NO: 1245286 - RNA, 19 nt, Homo sapiens
ggaccaaggguuuccaugu

SEQ ID NO: 1245287 - RNA, 19 nt, Homo sapiens
gccaggccaucccgucuuu

SEQ ID NO: 1245288 - RNA, 19 nt, Homo sapiens
gcucuccagugauucugua

SEQ ID NO: 1245289 - RNA, 19 nt, Homo sapiens
cagagacugcuauacauuu

SEQ ID NO: 1245290 - RNA, 19 nt, Homo sapiens
cgaguggagugucaccaaa

SEQ ID NO: 1245291 - RNA, 19 nt, Homo sapiens
agaaguugcucaaguacau

SEQ ID NO: 1245292 - RNA, 19 nt, Homo sapiens
gcuacgugauucuggauau

SEQ ID NO: 1245293 - RNA, 19 nt, Homo sapiens
gaaggagacguucaaguac

SEQ ID NO: 1245294 - RNA, 19 nt, Homo sapiens
aggauucucucguggguaa

SEQ ID NO: 1245295 - RNA, 19 nt, Homo sapiens
uggaguguauccuauuuga

SEQ ID NO: 1245296 - RNA, 19 nt, Homo sapiens
ggauaccgcuacgugauuc

SEQ ID NO: 1245297 - RNA, 19 nt, Homo sapiens
aggguucgaugcugguuua

SEQ ID NO: 1245298 - RNA, 19 nt, Homo sapiens
gccuggaccucuugguauu

SEQ ID NO: 1245299 - RNA, 19 nt, Homo sapiens
ccacguaggguuuguguag

SEQ ID NO: 1245300 - RNA, 19 nt, Homo sapiens
uggguuagguggucuagga

SEQ ID NO: 1245301 - RNA, 19 nt, Homo sapiens
cuaagcaccuaccccauua

SEQ ID NO: 1245302 - RNA, 19 nt, Homo sapiens
ccaaggguuuccauguuca

SEQ ID NO: 1245303 - RNA, 19 nt, Homo sapiens
gaaaugccccagaccaaaa

SEQ ID NO: 1245304 - RNA, 19 nt, Homo sapiens
ccagcaagcagcaaggauu

SEQ ID NO: 1245305 - RNA, 19 nt, Homo sapiens
gggauaccgcuacgugauu

SEQ ID NO: 1245306 - RNA, 19 nt, Homo sapiens
gagauucgcaaggagauga

SEQ ID NO: 1245307 - RNA, 19 nt, Homo sapiens
aauaaaguguguugaucug

SEQ ID NO: 1245308 - RNA, 19 nt, Homo sapiens
uuaccuuaauccaacagua

SEQ ID NO: 1245309 - RNA, 19 nt, Homo sapiens
gguauuccguguacaccau

SEQ ID NO: 1245310 - RNA, 19 nt, Homo sapiens
gcucccacauccugcuuau

SEQ ID NO: 1245311 - RNA, 19 nt, Homo sapiens
agagacugcuauacauuuc

SEQ ID NO: 1245312 - RNA, 19 nt, Homo sapiens
uaauccaacaguacaguaa

SEQ ID NO: 1245313 - RNA, 19 nt, Homo sapiens
ucagagacugcuauacauu

SEQ ID NO: 1245314 - RNA, 19 nt, Homo sapiens
gucagagacugcuauacau

SEQ ID NO: 1245315 - RNA, 19 nt, Homo sapiens
gcacaccgugguaguauac

SEQ ID NO: 1245316 - RNA, 19 nt, Homo sapiens
ucccacauccugcuuauug

SEQ ID NO: 1245317 - RNA, 19 nt, Homo sapiens
gcggacagcucucuuuccu

SEQ ID NO: 1245318 - RNA, 19 nt, Homo sapiens
cgcuguugguguuuaauaa

SEQ ID NO: 1245319 - RNA, 19 nt, Homo sapiens
agccgaaacuugccugguu

SEQ ID NO: 1245320 - RNA, 19 nt, Homo sapiens
cagaacagcaaccgugaug

SEQ ID NO: 1245321 - RNA, 19 nt, Homo sapiens
cgaugcugguuuaggguuu

SEQ ID NO: 1245322 - RNA, 19 nt, Homo sapiens
cacgggaaaucauguugga

SEQ ID NO: 1245323 - RNA, 19 nt, Homo sapiens
ugaaagcaacagucagaga

SEQ ID NO: 1245324 - RNA, 19 nt, Homo sapiens
gcccgcuguugguguuuaa

SEQ ID NO: 1245325 - RNA, 19 nt, Homo sapiens
ucucguggguaacgcugua

SEQ ID NO: 1245326 - RNA, 19 nt, Homo sapiens
ugggauaccuuuuauuuuc

SEQ ID NO: 1245327 - RNA, 19 nt, Homo sapiens
uuuggaguguauccuauuu

SEQ ID NO: 1245328 - RNA, 19 nt, Homo sapiens
guuagguggucuaggauac

SEQ ID NO: 1245329 - RNA, 19 nt, Homo sapiens
gcugggcugugcggugauu

SEQ ID NO: 1245330 - RNA, 19 nt, Homo sapiens
gcuccuggcuccguagucu

SEQ ID NO: 1245331 - RNA, 19 nt, Homo sapiens
uuaaggaccguuacguuuc

SEQ ID NO: 1245332 - RNA, 19 nt, Homo sapiens
gguuagguggucuaggaua

SEQ ID NO: 1245333 - RNA, 19 nt, Homo sapiens
guucaggcacugucuaaag

SEQ ID NO: 1245334 - RNA, 19 nt, Homo sapiens
ggaccacgggaaaucaugu

SEQ ID NO: 1245335 - RNA, 19 nt, Homo sapiens
ugugaaagcaacagucaga

SEQ ID NO: 1245336 - RNA, 19 nt, Homo sapiens
aggagacguucaaguacuu

SEQ ID NO: 1245337 - RNA, 19 nt, Homo sapiens
uccaacaguacaguaauua

SEQ ID NO: 1245338 - RNA, 19 nt, Homo sapiens
accaagaaguugcucaagu

SEQ ID NO: 1245339 - RNA, 19 nt, Homo sapiens
ccgcuguugguguuuaaua

SEQ ID NO: 1245340 - RNA, 19 nt, Homo sapiens
caacaguacaguaauuagc

SEQ ID NO: 1245341 - RNA, 19 nt, Homo sapiens
cuucggcacugaggucuug

SEQ ID NO: 1245342 - RNA, 19 nt, Homo sapiens
acaccauccuugcuguuuc

SEQ ID NO: 1245343 - RNA, 19 nt, Homo sapiens
agacugcuauacauuucug

SEQ ID NO: 1245344 - RNA, 19 nt, Homo sapiens
cacauccuguuuccucuca

SEQ ID NO: 1245345 - RNA, 19 nt, Homo sapiens
gcugaagccagguaacaca

SEQ ID NO: 1245346 - RNA, 19 nt, Homo sapiens
caugaagcacaccguggua

SEQ ID NO: 1245347 - RNA, 19 nt, Homo sapiens
uguuugagaccaagaaguu

SEQ ID NO: 1245348 - RNA, 19 nt, Homo sapiens
cagcaagcagcaaggauuc

SEQ ID NO: 1245349 - RNA, 19 nt, Homo sapiens
ccacacacacacacacaca

SEQ ID NO: 1245350 - RNA, 19 nt, Homo sapiens
auccaacaguacaguaauu

SEQ ID NO: 1245351 - RNA, 19 nt, Homo sapiens
ccucaacauuuuaccuuaa

SEQ ID NO: 1245352 - RNA, 19 nt, Homo sapiens
guacaccauccuugcuguu

SEQ ID NO: 1245353 - RNA, 19 nt, Homo sapiens
accaaggguuuccauguuc

SEQ ID NO: 1245354 - RNA, 19 nt, Homo sapiens
gcgaguggagugucaccaa

SEQ ID NO: 1245355 - RNA, 19 nt, Homo sapiens
uggagaauggcgacauaaa

SEQ ID NO: 1245356 - RNA, 19 nt, Homo sapiens
uaaggaccguuacguuucc

SEQ ID NO: 1245357 - RNA, 19 nt, Homo sapiens
caccauccuugcuguuucu

SEQ ID NO: 1245358 - RNA, 19 nt, Homo sapiens
gaugcugguuuaggguuuc

SEQ ID NO: 1245359 - RNA, 19 nt, Homo sapiens
gaaguugcucaaguacaug

SEQ ID NO: 1245360 - RNA, 19 nt, Homo sapiens
cuugaauccucucuaagca

SEQ ID NO: 1245361 - RNA, 19 nt, Homo sapiens
caagaaguugcucaaguac

SEQ ID NO: 1245362 - RNA, 19 nt, Homo sapiens
gugauggugugugaaagca

SEQ ID NO: 1245363 - RNA, 19 nt, Homo sapiens
ucuaccugcucacccacua

SEQ ID NO: 1245364 - RNA, 19 nt, Homo sapiens
aaggagacguucaaguacu

SEQ ID NO: 1245365 - RNA, 19 nt, Homo sapiens
gaagagaaacgccgaaaga

SEQ ID NO: 1245366 - RNA, 19 nt, Homo sapiens
gcacugacccuuuccagaa

SEQ ID NO: 1245367 - RNA, 19 nt, Homo sapiens
cgaggauugugcacuauua

SEQ ID NO: 1245368 - RNA, 19 nt, Homo sapiens
gagaaacgccgaaagaaag

SEQ ID NO: 1245369 - RNA, 19 nt, Homo sapiens
gagcagcuguuggcacuga

SEQ ID NO: 1245370 - RNA, 19 nt, Homo sapiens
gcucaccgcugcugaugug

SEQ ID NO: 1245371 - RNA, 19 nt, Homo sapiens
gauauggaccuucuucaau

SEQ ID NO: 1245372 - RNA, 19 nt, Homo sapiens
ugagaaagacuccaacuuc

SEQ ID NO: 1245373 - RNA, 19 nt, Homo sapiens
caagagguuuggauaugga

SEQ ID NO: 1245374 - RNA, 19 nt, Homo sapiens
gaucccagucugaguuaua

SEQ ID NO: 1245375 - RNA, 19 nt, Homo sapiens
gccuggagaucuacaagaa

SEQ ID NO: 1245376 - RNA, 19 nt, Homo sapiens
ggaagcagcagaacuaggu

SEQ ID NO: 1245377 - RNA, 19 nt, Homo sapiens
auauggaccuucuucaauu

SEQ ID NO: 1245378 - RNA, 19 nt, Homo sapiens
gaagauguuugaggugaag

SEQ ID NO: 1245379 - RNA, 19 nt, Homo sapiens
ggauauggaccuucuucaa

SEQ ID NO: 1245380 - RNA, 19 nt, Homo sapiens
gauugugcacuauuacuuu

SEQ ID NO: 1245381 - RNA, 19 nt, Homo sapiens
agagaaacgccgaaagaaa

SEQ ID NO: 1245382 - RNA, 19 nt, Homo sapiens
caacuuccagaacccauuu

SEQ ID NO: 1245383 - RNA, 19 nt, Homo sapiens
cuggagaucuacaagaaga

SEQ ID NO: 1245384 - RNA, 19 nt, Homo sapiens
gcucaagagguuuggauau

SEQ ID NO: 1245385 - RNA, 19 nt, Homo sapiens
ccugagagaagaagagaaa

SEQ ID NO: 1245386 - RNA, 19 nt, Homo sapiens
uggcacagcugaacgacau

SEQ ID NO: 1245387 - RNA, 19 nt, Homo sapiens
agaaggcccugagagaaga

SEQ ID NO: 1245388 - RNA, 19 nt, Homo sapiens
ccagaaggcccugagagaa

SEQ ID NO: 1245389 - RNA, 19 nt, Homo sapiens
ggauugugcacuauuacuu

SEQ ID NO: 1245390 - RNA, 19 nt, Homo sapiens
gccagcagacccuuugaaa

SEQ ID NO: 1245391 - RNA, 19 nt, Homo sapiens
ucaagagguuuggauaugg

SEQ ID NO: 1245392 - RNA, 19 nt, Homo sapiens
caacuggaaccuccucauc

SEQ ID NO: 1245393 - RNA, 19 nt, Homo sapiens
acccaagccuggagaucua

SEQ ID NO: 1245394 - RNA, 19 nt, Homo sapiens
uauggaccuucuucaauuc

SEQ ID NO: 1245395 - RNA, 19 nt, Homo sapiens
ggaaggagauccgaaaagg

SEQ ID NO: 1245396 - RNA, 19 nt, Homo sapiens
cucaagagguuuggauaug

SEQ ID NO: 1245397 - RNA, 19 nt, Homo sapiens
cagcagaacuagguuuuga

SEQ ID NO: 1245398 - RNA, 19 nt, Homo sapiens
ucccgaggauugugcacua

SEQ ID NO: 1245399 - RNA, 19 nt, Homo sapiens
agaagauguuugaggugaa

SEQ ID NO: 1245400 - RNA, 19 nt, Homo sapiens
cagaaggcccugagagaag

SEQ ID NO: 1245401 - RNA, 19 nt, Homo sapiens
ucagauggcuggauuuucu

SEQ ID NO: 1245402 - RNA, 19 nt, Homo sapiens
acuauuacuuugaccacaa

SEQ ID NO: 1245403 - RNA, 19 nt, Homo sapiens
ucaaggggcucuuuaaggu

SEQ ID NO: 1245404 - RNA, 19 nt, Homo sapiens
gcugaugugcucccagaug

SEQ ID NO: 1245405 - RNA, 19 nt, Homo sapiens
ucuacaagaagauguuuga

SEQ ID NO: 1245406 - RNA, 19 nt, Homo sapiens
ucccagcacugacccuuuc

SEQ ID NO: 1245407 - RNA, 19 nt, Homo sapiens
gugagaaagacuccaacuu

SEQ ID NO: 1245408 - RNA, 19 nt, Homo sapiens
gccgaaagaaagaggagaa

SEQ ID NO: 1245409 - RNA, 19 nt, Homo sapiens
agaaacgccgaaagaaaga

SEQ ID NO: 1245410 - RNA, 19 nt, Homo sapiens
gaagcagcagaacuagguu

SEQ ID NO: 1245411 - RNA, 19 nt, Homo sapiens
gaaccuggcacagcugaac

SEQ ID NO: 1245412 - RNA, 19 nt, Homo sapiens
aagagaaacgccgaaagaa

SEQ ID NO: 1245413 - RNA, 19 nt, Homo sapiens
cuggccagcucaagagguu

SEQ ID NO: 1245414 - RNA, 19 nt, Homo sapiens
cgacuggccagcucaagag

SEQ ID NO: 1245415 - RNA, 19 nt, Homo sapiens
gacccaagccuggagaucu

SEQ ID NO: 1245416 - RNA, 19 nt, Homo sapiens
cgaaaaggcccaaggaucu

SEQ ID NO: 1245417 - RNA, 19 nt, Homo sapiens
gaagaaaccugaugucaaa

SEQ ID NO: 1245418 - RNA, 19 nt, Homo sapiens
gcacagcucuccucucuaa

SEQ ID NO: 1245419 - RNA, 19 nt, Homo sapiens
gaaaggcucugugauggua

SEQ ID NO: 1245420 - RNA, 19 nt, Homo sapiens
gaacgugacugcauuccaa

SEQ ID NO: 1245421 - RNA, 19 nt, Homo sapiens
ggaagugugucaucuggua

SEQ ID NO: 1245422 - RNA, 19 nt, Homo sapiens
ccacagacuugcauuguuu

SEQ ID NO: 1245423 - RNA, 19 nt, Homo sapiens
caaaagagcugucucaaga

SEQ ID NO: 1245424 - RNA, 19 nt, Homo sapiens
aaagagcugucucaagaua

SEQ ID NO: 1245425 - RNA, 19 nt, Homo sapiens
gcucauggcuuucaauaag

SEQ ID NO: 1245426 - RNA, 19 nt, Homo sapiens
gcgauaaaguccucuaaga

SEQ ID NO: 1245427 - RNA, 19 nt, Homo sapiens
gaaacaacugccugucuua

SEQ ID NO: 1245428 - RNA, 19 nt, Homo sapiens
guucagaguuguccagaaa

SEQ ID NO: 1245429 - RNA, 19 nt, Homo sapiens
gauaguaugccaaauggua

SEQ ID NO: 1245430 - RNA, 19 nt, Homo sapiens
gaucuggugagcauaauua

SEQ ID NO: 1245431 - RNA, 19 nt, Homo sapiens
ccagauggcuuuagagauc

SEQ ID NO: 1245432 - RNA, 19 nt, Homo sapiens
gggaggagguugcaguauu

SEQ ID NO: 1245433 - RNA, 19 nt, Homo sapiens
uuacacagcuggaaacuca

SEQ ID NO: 1245434 - RNA, 19 nt, Homo sapiens
cagcuggucccucauauua

SEQ ID NO: 1245435 - RNA, 19 nt, Homo sapiens
gagcgaacgugacugcauu

SEQ ID NO: 1245436 - RNA, 19 nt, Homo sapiens
ggacccauauagcuuguuu

SEQ ID NO: 1245437 - RNA, 19 nt, Homo sapiens
gauaaaguccucuaagaug

SEQ ID NO: 1245438 - RNA, 19 nt, Homo sapiens
ggaggagguugcaguauuc

SEQ ID NO: 1245439 - RNA, 19 nt, Homo sapiens
ucagaguuguccagaaaua

SEQ ID NO: 1245440 - RNA, 19 nt, Homo sapiens
gguaccagcuguguucuaa

SEQ ID NO: 1245441 - RNA, 19 nt, Homo sapiens
gcagauaguaugccaaaug

SEQ ID NO: 1245442 - RNA, 19 nt, Homo sapiens
ggucuugccuguauaguag

SEQ ID NO: 1245443 - RNA, 19 nt, Homo sapiens
gcuuguuucucccuaauaa

SEQ ID NO: 1245444 - RNA, 19 nt, Homo sapiens
gaagggcgauggguugaug

SEQ ID NO: 1245445 - RNA, 19 nt, Homo sapiens
guagcugugugcuuuguuu

SEQ ID NO: 1245446 - RNA, 19 nt, Homo sapiens
ggauuaugcuggugugugu

SEQ ID NO: 1245447 - RNA, 19 nt, Homo sapiens
ugaaacaacugccugucuu

SEQ ID NO: 1245448 - RNA, 19 nt, Homo sapiens
cagcaaacauuuucuguaa

SEQ ID NO: 1245449 - RNA, 19 nt, Homo sapiens
agaaauagcucaguguaag

SEQ ID NO: 1245450 - RNA, 19 nt, Homo sapiens
ucgcaucucugauuccaaa

SEQ ID NO: 1245451 - RNA, 19 nt, Homo sapiens
gcacaggauucagcaaaca

SEQ ID NO: 1245452 - RNA, 19 nt, Homo sapiens
ccagacccaugcuuauauu

SEQ ID NO: 1245453 - RNA, 19 nt, Homo sapiens
cagcaugacuaccugaaau

SEQ ID NO: 1245454 - RNA, 19 nt, Homo sapiens
ccaccauucuuuccuuuau

SEQ ID NO: 1245455 - RNA, 19 nt, Homo sapiens
caaccucgcaucucugauu

SEQ ID NO: 1245456 - RNA, 19 nt, Homo sapiens
gagcauaauuaucugaaac

SEQ ID NO: 1245457 - RNA, 19 nt, Homo sapiens
gaaaucaggaaguguguca

SEQ ID NO: 1245458 - RNA, 19 nt, Homo sapiens
gccauuaucugucauugca

SEQ ID NO: 1245459 - RNA, 19 nt, Homo sapiens
gcauggccauuaucuguca

SEQ ID NO: 1245460 - RNA, 19 nt, Homo sapiens
cuagagagccgcuguggaa

SEQ ID NO: 1245461 - RNA, 19 nt, Homo sapiens
cagcugcuuuguuugagua

SEQ ID NO: 1245462 - RNA, 19 nt, Homo sapiens
gcuaagcuguaccucauuc

SEQ ID NO: 1245463 - RNA, 19 nt, Homo sapiens
acaacugccugucuuaugu

SEQ ID NO: 1245464 - RNA, 19 nt, Homo sapiens
agaaugaucuggugagcau

SEQ ID NO: 1245465 - RNA, 19 nt, Homo sapiens
ccucuaagaugucauaacu

SEQ ID NO: 1245466 - RNA, 19 nt, Homo sapiens
ucuggaaucuguaacuuug

SEQ ID NO: 1245467 - RNA, 19 nt, Homo sapiens
ccacaucuauccuuuuaaa

SEQ ID NO: 1245468 - RNA, 19 nt, Homo sapiens
gcccacagcacaggaaaua

SEQ ID NO: 1245469 - RNA, 19 nt, Homo sapiens
gaaccacagacuugcauug

SEQ ID NO: 1245470 - RNA, 19 nt, Homo sapiens
ugagagaaccacagacuug

SEQ ID NO: 1245471 - RNA, 19 nt, Homo sapiens
gaagacauuaaacaccuuu

SEQ ID NO: 1245472 - RNA, 19 nt, Homo sapiens
ucauggcuuucaauaagua

SEQ ID NO: 1245473 - RNA, 19 nt, Homo sapiens
gcuggucccucauauuaca

SEQ ID NO: 1245474 - RNA, 19 nt, Homo sapiens
guggaugguugcugaguga

SEQ ID NO: 1245475 - RNA, 19 nt, Homo sapiens
ucuagcaucuucuuuguca

SEQ ID NO: 1245476 - RNA, 19 nt, Homo sapiens
uaccugaaauucuuaguca

SEQ ID NO: 1245477 - RNA, 19 nt, Homo sapiens
cagauaguaugccaaaugg

SEQ ID NO: 1245478 - RNA, 19 nt, Homo sapiens
cuacucaccucugcuguug

SEQ ID NO: 1245479 - RNA, 19 nt, Homo sapiens
uugaguagcugugugcuuu

SEQ ID NO: 1245480 - RNA, 19 nt, Homo sapiens
ccagaaauagcucagugua

SEQ ID NO: 1245481 - RNA, 19 nt, Homo sapiens
auacagaacagacaaaugu

SEQ ID NO: 1245482 - RNA, 19 nt, Homo sapiens
ggaacccucccuccaggua

SEQ ID NO: 1245483 - RNA, 19 nt, Homo sapiens
gcaaacauuuucuguaaag

SEQ ID NO: 1245484 - RNA, 19 nt, Homo sapiens
auaaaguccucuaagaugu

SEQ ID NO: 1245485 - RNA, 19 nt, Homo sapiens
ccagaguucuagcaucuuc

SEQ ID NO: 1245486 - RNA, 19 nt, Homo sapiens
gugacugcauuccaauaaa

SEQ ID NO: 1245487 - RNA, 19 nt, Homo sapiens
acucaccucugcuguugua

SEQ ID NO: 1245488 - RNA, 19 nt, Homo sapiens
uauauugcaucccugauca

SEQ ID NO: 1245489 - RNA, 19 nt, Homo sapiens
guucuagcaucuucuuugu

SEQ ID NO: 1245490 - RNA, 19 nt, Homo sapiens
gauaacagugggugggaaa

SEQ ID NO: 1245491 - RNA, 19 nt, Homo sapiens
gcaagcaacccagugauag

SEQ ID NO: 1245492 - RNA, 19 nt, Homo sapiens
cagaaauagcucaguguaa

SEQ ID NO: 1245493 - RNA, 19 nt, Homo sapiens
ucucuaagguagugauugu

SEQ ID NO: 1245494 - RNA, 19 nt, Homo sapiens
uuacuuugcucucuaaggu

SEQ ID NO: 1245495 - RNA, 19 nt, Homo sapiens
cuugguaccucuacuuguu

SEQ ID NO: 1245496 - RNA, 19 nt, Homo sapiens
ggacuugguaccucuacuu

SEQ ID NO: 1245497 - RNA, 19 nt, Homo sapiens
acacagcugcuuuguuuga

SEQ ID NO: 1245498 - RNA, 19 nt, Homo sapiens
gauuauauauugggaacca

SEQ ID NO: 1245499 - RNA, 19 nt, Homo sapiens
gcaggaaaaugaacuuauc

SEQ ID NO: 1245500 - RNA, 19 nt, Homo sapiens
gaugcuagauuugcucagu

SEQ ID NO: 1245501 - RNA, 19 nt, Homo sapiens
gcugugugcuuuguuuaug

SEQ ID NO: 1245502 - RNA, 19 nt, Homo sapiens
gaagugugucaucugguaa

SEQ ID NO: 1245503 - RNA, 19 nt, Homo sapiens
cggcuaagcuguaccucau

SEQ ID NO: 1245504 - RNA, 19 nt, Homo sapiens
ucucuguucuguuccauga

SEQ ID NO: 1245505 - RNA, 19 nt, Homo sapiens
cugagaggguggucuuuga

SEQ ID NO: 1245506 - RNA, 19 nt, Homo sapiens
ucucuaaggaucguauuua

SEQ ID NO: 1245507 - RNA, 19 nt, Homo sapiens
gcucugugaugguagaagu

SEQ ID NO: 1245508 - RNA, 19 nt, Homo sapiens
gaugguugcugagugaauc

SEQ ID NO: 1245509 - RNA, 19 nt, Homo sapiens
cgauaaaguccucuaagau

SEQ ID NO: 1245510 - RNA, 19 nt, Homo sapiens
gaaacucaaccucgcaucu

SEQ ID NO: 1245511 - RNA, 19 nt, Homo sapiens
acacagcuggucccucaua

SEQ ID NO: 1245512 - RNA, 19 nt, Homo sapiens
agaagaaaccugaugucaa

SEQ ID NO: 1245513 - RNA, 19 nt, Homo sapiens
gaacaauuuuccaaagauc

SEQ ID NO: 1245514 - RNA, 19 nt, Homo sapiens
aaauaucaguggaccagau

SEQ ID NO: 1245515 - RNA, 19 nt, Homo sapiens
ugaguguccuugagcucua

SEQ ID NO: 1245516 - RNA, 19 nt, Homo sapiens
gacccaugcuuauauugca

SEQ ID NO: 1245517 - RNA, 19 nt, Homo sapiens
ggaagaagaugaugauuac

SEQ ID NO: 1245518 - RNA, 19 nt, Homo sapiens
cuacagaacuugucaaauc

SEQ ID NO: 1245519 - RNA, 19 nt, Homo sapiens
gagcuuauguugaugaaga

SEQ ID NO: 1245520 - RNA, 19 nt, Homo sapiens
cgacuaaugucaacaguga

SEQ ID NO: 1245521 - RNA, 19 nt, Homo sapiens
gcccuucuauugaaauuua

SEQ ID NO: 1245522 - RNA, 19 nt, Homo sapiens
guagucagcucugccguua

SEQ ID NO: 1245523 - RNA, 19 nt, Homo sapiens
guacuggccugcuuguaaa

SEQ ID NO: 1245524 - RNA, 19 nt, Homo sapiens
gauaaacuucgcucuguua

SEQ ID NO: 1245525 - RNA, 19 nt, Homo sapiens
cgacaugccuugaaaugga

SEQ ID NO: 1245526 - RNA, 19 nt, Homo sapiens
gauggaaugucccuucuau

SEQ ID NO: 1245527 - RNA, 19 nt, Homo sapiens
gaaugucccuucuaucauc

SEQ ID NO: 1245528 - RNA, 19 nt, Homo sapiens
gaaagauacucuacagaac

SEQ ID NO: 1245529 - RNA, 19 nt, Homo sapiens
gaacaacacaauucgauuc

SEQ ID NO: 1245530 - RNA, 19 nt, Homo sapiens
gaacuuccugauuacauua

SEQ ID NO: 1245531 - RNA, 19 nt, Homo sapiens
ugacgaagaccucaacuuu

SEQ ID NO: 1245532 - RNA, 19 nt, Homo sapiens
caacagcagcagaauagua

SEQ ID NO: 1245533 - RNA, 19 nt, Homo sapiens
uuaaacagguugcaauuuc

SEQ ID NO: 1245534 - RNA, 19 nt, Homo sapiens
aaacuucgcucuguuacaa

SEQ ID NO: 1245535 - RNA, 19 nt, Homo sapiens
ggcagaagaucaugcaguu

SEQ ID NO: 1245536 - RNA, 19 nt, Homo sapiens
agauagugguguucauuua

SEQ ID NO: 1245537 - RNA, 19 nt, Homo sapiens
gagaagaggaggaagaaga

SEQ ID NO: 1245538 - RNA, 19 nt, Homo sapiens
gcaaguagaaaugcagaua

SEQ ID NO: 1245539 - RNA, 19 nt, Homo sapiens
uaacgugccuucaaacaag

SEQ ID NO: 1245540 - RNA, 19 nt, Homo sapiens
gaaauggauucgaccucaa

SEQ ID NO: 1245541 - RNA, 19 nt, Homo sapiens
aaacagacacuuccaguug

SEQ ID NO: 1245542 - RNA, 19 nt, Homo sapiens
gugguaaguucaguuguua

SEQ ID NO: 1245543 - RNA, 19 nt, Homo sapiens
gauaccaacaucuuugaua

SEQ ID NO: 1245544 - RNA, 19 nt, Homo sapiens
gaugaaagauacucuacag

SEQ ID NO: 1245545 - RNA, 19 nt, Homo sapiens
guaaauaugaugcaaagug

SEQ ID NO: 1245546 - RNA, 19 nt, Homo sapiens
ugaaagauacucuacagaa

SEQ ID NO: 1245547 - RNA, 19 nt, Homo sapiens
cuuaacagcuuagaagaaa

SEQ ID NO: 1245548 - RNA, 19 nt, Homo sapiens
gcagaguaguuggguauau

SEQ ID NO: 1245549 - RNA, 19 nt, Homo sapiens
gcaggagaaucccuuaucu

SEQ ID NO: 1245550 - RNA, 19 nt, Homo sapiens
cugaagaugugauugauau

SEQ ID NO: 1245551 - RNA, 19 nt, Homo sapiens
gauagugguguucauuuaa

SEQ ID NO: 1245552 - RNA, 19 nt, Homo sapiens
gaauuaggagcuuauguug

SEQ ID NO: 1245553 - RNA, 19 nt, Homo sapiens
gaaacagacacuuccaguu

SEQ ID NO: 1245554 - RNA, 19 nt, Homo sapiens
caaguucgcaggagucaaa

SEQ ID NO: 1245555 - RNA, 19 nt, Homo sapiens
acaauucgauucaccguau

SEQ ID NO: 1245556 - RNA, 19 nt, Homo sapiens
cagaacuugucaaaucuuu

SEQ ID NO: 1245557 - RNA, 19 nt, Homo sapiens
gauugucccuucacucaug

SEQ ID NO: 1245558 - RNA, 19 nt, Homo sapiens
gaacucgaacuucucaaga

SEQ ID NO: 1245559 - RNA, 19 nt, Homo sapiens
uaaacagguugcaauuuca

SEQ ID NO: 1245560 - RNA, 19 nt, Homo sapiens
caacugaacccucuagucu

SEQ ID NO: 1245561 - RNA, 19 nt, Homo sapiens
acgaagaccucaacuuugu

SEQ ID NO: 1245562 - RNA, 19 nt, Homo sapiens
ugucaacagugaaaccuuu

SEQ ID NO: 1245563 - RNA, 19 nt, Homo sapiens
gaaaguugccugugguaag

SEQ ID NO: 1245564 - RNA, 19 nt, Homo sapiens
gauaguaacgugccuucaa

SEQ ID NO: 1245565 - RNA, 19 nt, Homo sapiens
gaggaucugucccuguuuc

SEQ ID NO: 1245566 - RNA, 19 nt, Homo sapiens
gaugguggccaacaagaaa

SEQ ID NO: 1245567 - RNA, 19 nt, Homo sapiens
cagaagaucaugcaguuug

SEQ ID NO: 1245568 - RNA, 19 nt, Homo sapiens
gcaaagccuuccccaauug

SEQ ID NO: 1245569 - RNA, 19 nt, Homo sapiens
gcucaagaauccguaacaa

SEQ ID NO: 1245570 - RNA, 19 nt, Homo sapiens
cuaaacaagcuaacaagaa

SEQ ID NO: 1245571 - RNA, 19 nt, Homo sapiens
ucagacagacuuacgauga

SEQ ID NO: 1245572 - RNA, 19 nt, Homo sapiens
gcagauagugguguucauu

SEQ ID NO: 1245573 - RNA, 19 nt, Homo sapiens
uagauaaacuucgcucugu

SEQ ID NO: 1245574 - RNA, 19 nt, Homo sapiens
gaugcaaaguguacuaaac

SEQ ID NO: 1245575 - RNA, 19 nt, Homo sapiens
aggaagaagaugaugauua

SEQ ID NO: 1245576 - RNA, 19 nt, Homo sapiens
caacaucuuugauaguaac

SEQ ID NO: 1245577 - RNA, 19 nt, Homo sapiens
ccaacaucuuugauaguaa

SEQ ID NO: 1245578 - RNA, 19 nt, Homo sapiens
ggaacaacacaauucgauu

SEQ ID NO: 1245579 - RNA, 19 nt, Homo sapiens
uagaagaauuccaguacug

SEQ ID NO: 1245580 - RNA, 19 nt, Homo sapiens
gguaaguucaguuguuaaa

SEQ ID NO: 1245581 - RNA, 19 nt, Homo sapiens
aaaugaguauggaggauga

SEQ ID NO: 1245582 - RNA, 19 nt, Homo sapiens
cagaggugcuuaacagcuu

SEQ ID NO: 1245583 - RNA, 19 nt, Homo sapiens
auaguaacgugccuucaaa

SEQ ID NO: 1245584 - RNA, 19 nt, Homo sapiens
agaacuuccugauuacauu

SEQ ID NO: 1245585 - RNA, 19 nt, Homo sapiens
ggaggaagaagaugaugau

SEQ ID NO: 1245586 - RNA, 19 nt, Homo sapiens
accaacaucuuugauagua

SEQ ID NO: 1245587 - RNA, 19 nt, Homo sapiens
ccacagaaacagacacuuc

SEQ ID NO: 1245588 - RNA, 19 nt, Homo sapiens
ggcuauaucugaagcucaa

SEQ ID NO: 1245589 - RNA, 19 nt, Homo sapiens
gagaaaguugccuguggua

SEQ ID NO: 1245590 - RNA, 19 nt, Homo sapiens
cagaguaguuggguauaug

SEQ ID NO: 1245591 - RNA, 19 nt, Homo sapiens
gagaugagaggaggcauga

SEQ ID NO: 1245592 - RNA, 19 nt, Homo sapiens
acugaacccucuagucuga

SEQ ID NO: 1245593 - RNA, 19 nt, Homo sapiens
caagcuaacaagaaucuga

SEQ ID NO: 1245594 - RNA, 19 nt, Homo sapiens
gacgaagaccucaacuuug

SEQ ID NO: 1245595 - RNA, 19 nt, Homo sapiens
aagauacucuacagaacuu

SEQ ID NO: 1245596 - RNA, 19 nt, Homo sapiens
auuaggagcuuauguugau

SEQ ID NO: 1245597 - RNA, 19 nt, Homo sapiens
ugagaugagugaacugagu

SEQ ID NO: 1245598 - RNA, 19 nt, Homo sapiens
agaauuaggagcuuauguu

SEQ ID NO: 1245599 - RNA, 19 nt, Homo sapiens
guaacgugccuucaaacaa

SEQ ID NO: 1245600 - RNA, 19 nt, Homo sapiens
uacaagaauuaggagcuua

SEQ ID NO: 1245601 - RNA, 19 nt, Homo sapiens
guagaagaauuccaguacu

SEQ ID NO: 1245602 - RNA, 19 nt, Homo sapiens
gaguagaagaauuccagua

SEQ ID NO: 1245603 - RNA, 19 nt, Homo sapiens
cagcuuagaagaaacguau

SEQ ID NO: 1245604 - RNA, 19 nt, Homo sapiens
gaaccagaggugcuuaaca

SEQ ID NO: 1245605 - RNA, 19 nt, Homo sapiens
guaguuggguauaugaaac

SEQ ID NO: 1245606 - RNA, 19 nt, Homo sapiens
uggaaugucccuucuauca

SEQ ID NO: 1245607 - RNA, 19 nt, Homo sapiens
gcaccaccuuccaguaguc

SEQ ID NO: 1245608 - RNA, 19 nt, Homo sapiens
aaaguugccugugguaagu

SEQ ID NO: 1245609 - RNA, 19 nt, Homo sapiens
cagacagacuuacgaugau

SEQ ID NO: 1245610 - RNA, 19 nt, Homo sapiens
gaugagaggaggcaugaag

SEQ ID NO: 1245611 - RNA, 19 nt, Homo sapiens
gaucugucccuguuucuag

SEQ ID NO: 1245612 - RNA, 19 nt, Homo sapiens
ugugguaaguucaguuguu

SEQ ID NO: 1245613 - RNA, 19 nt, Homo sapiens
cagauagugguguucauuu

SEQ ID NO: 1245614 - RNA, 19 nt, Homo sapiens
auaccaacaucuuugauag

SEQ ID NO: 1245615 - RNA, 19 nt, Homo sapiens
ggacugcacauucuaccau

SEQ ID NO: 1245616 - RNA, 19 nt, Homo sapiens
guuuaacacucaauguaca

SEQ ID NO: 1245617 - RNA, 19 nt, Homo sapiens
gagaaucgcuuuaggcuau

SEQ ID NO: 1245618 - RNA, 19 nt, Homo sapiens
cuaguuagcugguaaagca

SEQ ID NO: 1245619 - RNA, 19 nt, Homo sapiens
gagcuuaaccuggccuaua

SEQ ID NO: 1245620 - RNA, 19 nt, Homo sapiens
gaacaaccagcuccaggaa

SEQ ID NO: 1245621 - RNA, 19 nt, Homo sapiens
agaacaaucucaucuccaa

SEQ ID NO: 1245622 - RNA, 19 nt, Homo sapiens
caacacagcaagacccuau

SEQ ID NO: 1245623 - RNA, 19 nt, Homo sapiens
guaaagcaaucagaacaag

SEQ ID NO: 1245624 - RNA, 19 nt, Homo sapiens
ugcaagagauccacauuuc

SEQ ID NO: 1245625 - RNA, 19 nt, Homo sapiens
gauaagaguggguuagaag

SEQ ID NO: 1245626 - RNA, 19 nt, Homo sapiens
gucccaaacauucuaguua

SEQ ID NO: 1245627 - RNA, 19 nt, Homo sapiens
caagagauccacauuucug

SEQ ID NO: 1245628 - RNA, 19 nt, Homo sapiens
cugcguggcuucacaacaa

SEQ ID NO: 1245629 - RNA, 19 nt, Homo sapiens
cagcaagacccuaucucua

SEQ ID NO: 1245630 - RNA, 19 nt, Homo sapiens
gcaggagaaucgcuuuagg

SEQ ID NO: 1245631 - RNA, 19 nt, Homo sapiens
gacccuaucucuaccaaaa

SEQ ID NO: 1245632 - RNA, 19 nt, Homo sapiens
aaagcaaucagaacaagaa

SEQ ID NO: 1245633 - RNA, 19 nt, Homo sapiens
caacaagaacaaucucauc

SEQ ID NO: 1245634 - RNA, 19 nt, Homo sapiens
cuccagagcucccaaacug

SEQ ID NO: 1245635 - RNA, 19 nt, Homo sapiens
gaaguuugaggcugcaaug

SEQ ID NO: 1245636 - RNA, 19 nt, Homo sapiens
cuaccagccucacggagaa

SEQ ID NO: 1245637 - RNA, 19 nt, Homo sapiens
agcuuaaccuggccuauaa

SEQ ID NO: 1245638 - RNA, 19 nt, Homo sapiens
acaaccagcugaccacagu

SEQ ID NO: 1245639 - RNA, 19 nt, Homo sapiens
gguaaagcaaucagaacaa

SEQ ID NO: 1245640 - RNA, 19 nt, Homo sapiens
ugauaagaguggguuagaa

SEQ ID NO: 1245641 - RNA, 19 nt, Homo sapiens
ucccaaacauucuaguuag

SEQ ID NO: 1245642 - RNA, 19 nt, Homo sapiens
gacagacaguggccuggau

SEQ ID NO: 1245643 - RNA, 19 nt, Homo sapiens
gcaaucagaacaagaaaau

SEQ ID NO: 1245644 - RNA, 19 nt, Homo sapiens
gcaagagauccacauuucu

SEQ ID NO: 1245645 - RNA, 19 nt, Homo sapiens
gcugguaaagcaaucagaa

SEQ ID NO: 1245646 - RNA, 19 nt, Homo sapiens
cauucuaguuagcugguaa

SEQ ID NO: 1245647 - RNA, 19 nt, Homo sapiens
ccacgucccaaacauucua

SEQ ID NO: 1245648 - RNA, 19 nt, Homo sapiens
gcaaccagcugcggaugcu

SEQ ID NO: 1245649 - RNA, 19 nt, Homo sapiens
gcuuggaccuucgaguguu

SEQ ID NO: 1245650 - RNA, 19 nt, Homo sapiens
gcuuuaggcuauggguuug

SEQ ID NO: 1245651 - RNA, 19 nt, Homo sapiens
ccuguaaucccagcacuuu

SEQ ID NO: 1245652 - RNA, 19 nt, Homo sapiens
acaaccagcuccaggaacu

SEQ ID NO: 1245653 - RNA, 19 nt, Homo sapiens
gcacacgcugcaccucuau

SEQ ID NO: 1245654 - RNA, 19 nt, Homo sapiens
cgcguggucugcgcuauuu

SEQ ID NO: 1245655 - RNA, 19 nt, Homo sapiens
uaaagcaaucagaacaaga

SEQ ID NO: 1245656 - RNA, 19 nt, Homo sapiens
ggaagacucagcccuaucc

SEQ ID NO: 1245657 - RNA, 19 nt, Homo sapiens
ccagagcucccaaacugau

SEQ ID NO: 1245658 - RNA, 19 nt, Homo sapiens
gucaggcacaggcugguua

SEQ ID NO: 1245659 - RNA, 19 nt, Homo sapiens
ggagcucccacacuuucaa

SEQ ID NO: 1245660 - RNA, 19 nt, Homo sapiens
ucgacacuguggacuguga

SEQ ID NO: 1245661 - RNA, 19 nt, Homo sapiens
cugcaagagauccacauuu

SEQ ID NO: 1245662 - RNA, 19 nt, Homo sapiens
gaggagacagagccugcuu

SEQ ID NO: 1245663 - RNA, 19 nt, Homo sapiens
uaagaguggguuagaaggu

SEQ ID NO: 1245664 - RNA, 19 nt, Homo sapiens
gggaguuuccagucugaug

SEQ ID NO: 1245665 - RNA, 19 nt, Homo sapiens
ggagaaggauggacuagaa

SEQ ID NO: 1245666 - RNA, 19 nt, Homo sapiens
gaagaaaacugaagaagaa

SEQ ID NO: 1245667 - RNA, 19 nt, Homo sapiens
ugacacagaugaucacuuu

SEQ ID NO: 1245668 - RNA, 19 nt, Homo sapiens
gugaugagauuguuucuuu

SEQ ID NO: 1245669 - RNA, 19 nt, Homo sapiens
gaaaggagagagaauauga

SEQ ID NO: 1245670 - RNA, 19 nt, Homo sapiens
gaacuacuuuccaggauga

SEQ ID NO: 1245671 - RNA, 19 nt, Homo sapiens
ggagagagaauaugaaaga

SEQ ID NO: 1245672 - RNA, 19 nt, Homo sapiens
uaacugcuguugagaaaug

SEQ ID NO: 1245673 - RNA, 19 nt, Homo sapiens
gugaagacauuguuguaaa

SEQ ID NO: 1245674 - RNA, 19 nt, Homo sapiens
guugagaaauggaaugaaa

SEQ ID NO: 1245675 - RNA, 19 nt, Homo sapiens
gauuauggaugaugacaga

SEQ ID NO: 1245676 - RNA, 19 nt, Homo sapiens
uaacaagucuagcaucauc

SEQ ID NO: 1245677 - RNA, 19 nt, Homo sapiens
ggaaacuguugccgagaaa

SEQ ID NO: 1245678 - RNA, 19 nt, Homo sapiens
gaugaucacuuuaaaccau

SEQ ID NO: 1245679 - RNA, 19 nt, Homo sapiens
gacaaaggaguucugaaua

SEQ ID NO: 1245680 - RNA, 19 nt, Homo sapiens
gagcaaagaaacagaaaga

SEQ ID NO: 1245681 - RNA, 19 nt, Homo sapiens
cagaacaguugauccacua

SEQ ID NO: 1245682 - RNA, 19 nt, Homo sapiens
guugagaaauccaaggaaa

SEQ ID NO: 1245683 - RNA, 19 nt, Homo sapiens
gaaaagauccaaaugaaga

SEQ ID NO: 1245684 - RNA, 19 nt, Homo sapiens
cagaugacuuugacaguga

SEQ ID NO: 1245685 - RNA, 19 nt, Homo sapiens
gaaagaggaggaaacuguu

SEQ ID NO: 1245686 - RNA, 19 nt, Homo sapiens
aaaagaggcuugaagaaaa

SEQ ID NO: 1245687 - RNA, 19 nt, Homo sapiens
agaccaagcuacuaucaga

SEQ ID NO: 1245688 - RNA, 19 nt, Homo sapiens
caugaaaugcacagaauaa

SEQ ID NO: 1245689 - RNA, 19 nt, Homo sapiens
aagcacaucuucagcagaa

SEQ ID NO: 1245690 - RNA, 19 nt, Homo sapiens
gaggauucaugcuuaacaa

SEQ ID NO: 1245691 - RNA, 19 nt, Homo sapiens
acacagaugaucacuuuaa

SEQ ID NO: 1245692 - RNA, 19 nt, Homo sapiens
ggaaggcuaugaaagaaaa

SEQ ID NO: 1245693 - RNA, 19 nt, Homo sapiens
gaugaugacagaacaguug

SEQ ID NO: 1245694 - RNA, 19 nt, Homo sapiens
ugaauacucagaugacuuu

SEQ ID NO: 1245695 - RNA, 19 nt, Homo sapiens
gaagaagcauuagcaucau

SEQ ID NO: 1245696 - RNA, 19 nt, Homo sapiens
caaaugaagaaaucacuga

SEQ ID NO: 1245697 - RNA, 19 nt, Homo sapiens
caacagccuugacacagau

SEQ ID NO: 1245698 - RNA, 19 nt, Homo sapiens
acaaaggaguucugaauac

SEQ ID NO: 1245699 - RNA, 19 nt, Homo sapiens
uaauuuaacugcuguugag

SEQ ID NO: 1245700 - RNA, 19 nt, Homo sapiens
cugaugaccuugaagaaga

SEQ ID NO: 1245701 - RNA, 19 nt, Homo sapiens
cgaauggcauacaauuaga

SEQ ID NO: 1245702 - RNA, 19 nt, Homo sapiens
aagcggaacugauuaugga

SEQ ID NO: 1245703 - RNA, 19 nt, Homo sapiens
agaagaagcauuagcauca

SEQ ID NO: 1245704 - RNA, 19 nt, Homo sapiens
acaauuagaagcugagaaa

SEQ ID NO: 1245705 - RNA, 19 nt, Homo sapiens
ggacuagaagauaaagaaa

SEQ ID NO: 1245706 - RNA, 19 nt, Homo sapiens
uaacauaaccaaagaugag

SEQ ID NO: 1245707 - RNA, 19 nt, Homo sapiens
cacuaugucugaugaaguu

SEQ ID NO: 1245708 - RNA, 19 nt, Homo sapiens
gaaagagcaaagaaacaga

SEQ ID NO: 1245709 - RNA, 19 nt, Homo sapiens
gugaagaauuggaguuaca

SEQ ID NO: 1245710 - RNA, 19 nt, Homo sapiens
cacagaugaucacuuuaaa

SEQ ID NO: 1245711 - RNA, 19 nt, Homo sapiens
ccuaaacccagaauucuuu

SEQ ID NO: 1245712 - RNA, 19 nt, Homo sapiens
gcaccacuuuggcauauac

SEQ ID NO: 1245713 - RNA, 19 nt, Homo sapiens
gauccaaaaugaacagaaa

SEQ ID NO: 1245714 - RNA, 19 nt, Homo sapiens
cuaucuaaaucucagagua

SEQ ID NO: 1245715 - RNA, 19 nt, Homo sapiens
cuacugcaguugagaaauc

SEQ ID NO: 1245716 - RNA, 19 nt, Homo sapiens
aaagucacauggaggagaa

SEQ ID NO: 1245717 - RNA, 19 nt, Homo sapiens
gccagugugugccaucaaa

SEQ ID NO: 1245718 - RNA, 19 nt, Homo sapiens
gaaaaggaagcaaagaaaa

SEQ ID NO: 1245719 - RNA, 19 nt, Homo sapiens
aggauggacuagaagauaa

SEQ ID NO: 1245720 - RNA, 19 nt, Homo sapiens
caaaggaguucugaauacu

SEQ ID NO: 1245721 - RNA, 19 nt, Homo sapiens
agaaaaugcugcaagaaaa

SEQ ID NO: 1245722 - RNA, 19 nt, Homo sapiens
gagggaaacgcaucuggaa

SEQ ID NO: 1245723 - RNA, 19 nt, Homo sapiens
cuagcaucaucaucacuua

SEQ ID NO: 1245724 - RNA, 19 nt, Homo sapiens
gaagaauuggaguuacauu

SEQ ID NO: 1245725 - RNA, 19 nt, Homo sapiens
acaacagccuugacacaga

SEQ ID NO: 1245726 - RNA, 19 nt, Homo sapiens
ccaauaaaucaaacgguaa

SEQ ID NO: 1245727 - RNA, 19 nt, Homo sapiens
ugacagugaugagauuguu

SEQ ID NO: 1245728 - RNA, 19 nt, Homo sapiens
acaaagaguccaaaaguua

SEQ ID NO: 1245729 - RNA, 19 nt, Homo sapiens
uacaugaaaugcacagaau

SEQ ID NO: 1245730 - RNA, 19 nt, Homo sapiens
gaacugauuauggaugaug

SEQ ID NO: 1245731 - RNA, 19 nt, Homo sapiens
cggaacugauuauggauga

SEQ ID NO: 1245732 - RNA, 19 nt, Homo sapiens
gccgaauggcauacaauua

SEQ ID NO: 1245733 - RNA, 19 nt, Homo sapiens
aaaccuaaacccagaauuc

SEQ ID NO: 1245734 - RNA, 19 nt, Homo sapiens
agacaaaggaguucugaau

SEQ ID NO: 1245735 - RNA, 19 nt, Homo sapiens
gaauaugaaagagcaaaga

SEQ ID NO: 1245736 - RNA, 19 nt, Homo sapiens
gauccacuacuaucuaaau

SEQ ID NO: 1245737 - RNA, 19 nt, Homo sapiens
uuuaacugcuguugagaaa

SEQ ID NO: 1245738 - RNA, 19 nt, Homo sapiens
agaaagaggaggaaacugu

SEQ ID NO: 1245739 - RNA, 19 nt, Homo sapiens
ggccaaggaguauguuaaa

SEQ ID NO: 1245740 - RNA, 19 nt, Homo sapiens
gcuacuaucagaaguugaa

SEQ ID NO: 1245741 - RNA, 19 nt, Homo sapiens
ccacuacuaucuaaaucuc

SEQ ID NO: 1245742 - RNA, 19 nt, Homo sapiens
gaggaaauggcaccugaug

SEQ ID NO: 1245743 - RNA, 19 nt, Homo sapiens
aauacacuaugucugauga

SEQ ID NO: 1245744 - RNA, 19 nt, Homo sapiens
cuuaacaagucuagcauca

SEQ ID NO: 1245745 - RNA, 19 nt, Homo sapiens
gauucaugcuuaacaaguc

SEQ ID NO: 1245746 - RNA, 19 nt, Homo sapiens
gaauggcauacaauuagaa

SEQ ID NO: 1245747 - RNA, 19 nt, Homo sapiens
uagcaccacuuuggcauau

SEQ ID NO: 1245748 - RNA, 19 nt, Homo sapiens
ugaugggugugaagacauu

SEQ ID NO: 1245749 - RNA, 19 nt, Homo sapiens
gaugagauuguuucuuuag

SEQ ID NO: 1245750 - RNA, 19 nt, Homo sapiens
gcaaaagcggaacugauua

SEQ ID NO: 1245751 - RNA, 19 nt, Homo sapiens
ccaugugacuacugcaguu

SEQ ID NO: 1245752 - RNA, 19 nt, Homo sapiens
ccugaggauucaugcuuaa

SEQ ID NO: 1245753 - RNA, 19 nt, Homo sapiens
gaaggauggacuagaagau

SEQ ID NO: 1245754 - RNA, 19 nt, Homo sapiens
gguaacauaaccaaagaug

SEQ ID NO: 1245755 - RNA, 19 nt, Homo sapiens
cauaauuccuugaaaucag

SEQ ID NO: 1245756 - RNA, 19 nt, Homo sapiens
ccgaagacgcuguuuccua

SEQ ID NO: 1245757 - RNA, 19 nt, Homo sapiens
ggauggacuagaagauaaa

SEQ ID NO: 1245758 - RNA, 19 nt, Homo sapiens
gagaauaugaaagagcaaa

SEQ ID NO: 1245759 - RNA, 19 nt, Homo sapiens
uagaaaggagagagaauau

SEQ ID NO: 1245760 - RNA, 19 nt, Homo sapiens
ccuggaaggcuaugaaaga

SEQ ID NO: 1245761 - RNA, 19 nt, Homo sapiens
aagaagcauuagcaucauu

SEQ ID NO: 1245762 - RNA, 19 nt, Homo sapiens
ccgaauggcauacaauuag

SEQ ID NO: 1245763 - RNA, 19 nt, Homo sapiens
ggaggagaaggauggacua

SEQ ID NO: 1245764 - RNA, 19 nt, Homo sapiens
gaaaagaauccuucaaaac

SEQ ID NO: 1245765 - RNA, 19 nt, Homo sapiens
gcacagaggaugaugagua

SEQ ID NO: 1245766 - RNA, 19 nt, Homo sapiens
caucauugcugacuccaua

SEQ ID NO: 1245767 - RNA, 19 nt, Homo sapiens
gggauuugcugcccucuuu

SEQ ID NO: 1245768 - RNA, 19 nt, Homo sapiens
gaugaugaguaccuggaua

SEQ ID NO: 1245769 - RNA, 19 nt, Homo sapiens
gcgcacagcccgcaucauu

SEQ ID NO: 1245770 - RNA, 19 nt, Homo sapiens
gagcucaagugguccuuug

SEQ ID NO: 1245771 - RNA, 19 nt, Homo sapiens
gagaggaacaucaagaaau

SEQ ID NO: 1245772 - RNA, 19 nt, Homo sapiens
ggagaggaacaucaagaaa

SEQ ID NO: 1245773 - RNA, 19 nt, Homo sapiens
uggauaagguggagaggaa

SEQ ID NO: 1245774 - RNA, 19 nt, Homo sapiens
agaggaacaucaagaaauc

SEQ ID NO: 1245775 - RNA, 19 nt, Homo sapiens
gaagcugcaucccuuugau

SEQ ID NO: 1245776 - RNA, 19 nt, Homo sapiens
gcaaagugaucaauuuccu

SEQ ID NO: 1245777 - RNA, 19 nt, Homo sapiens
cacacgaggcgcuaucuua

SEQ ID NO: 1245778 - RNA, 19 nt, Homo sapiens
gccaucaaguuucuguuug

SEQ ID NO: 1245779 - RNA, 19 nt, Homo sapiens
ccagacaggaggaaccaua

SEQ ID NO: 1245780 - RNA, 19 nt, Homo sapiens
acacgaggcgcuaucuuaa

SEQ ID NO: 1245781 - RNA, 19 nt, Homo sapiens
ggagcuggcccuuccucua

SEQ ID NO: 1245782 - RNA, 19 nt, Homo sapiens
gagacacccuggccaaucg

SEQ ID NO: 1245783 - RNA, 19 nt, Homo sapiens
caagugguccuuugcuguu

SEQ ID NO: 1245784 - RNA, 19 nt, Homo sapiens
acgaggcgcuaucuuaaug

SEQ ID NO: 1245785 - RNA, 19 nt, Homo sapiens
uauaggcacugguguggau

SEQ ID NO: 1245786 - RNA, 19 nt, Homo sapiens
cgacaagcguguguacauc

SEQ ID NO: 1245787 - RNA, 19 nt, Homo sapiens
ccagggaggcaggcaguua

SEQ ID NO: 1245788 - RNA, 19 nt, Homo sapiens
ggagaagcugcaucccuuu

SEQ ID NO: 1245789 - RNA, 19 nt, Homo sapiens
caaagugaucaauuuccua

SEQ ID NO: 1245790 - RNA, 19 nt, Homo sapiens
gcuacaacaucaccuucau

SEQ ID NO: 1245791 - RNA, 19 nt, Homo sapiens
cuccauacuuaaucuguuu

SEQ ID NO: 1245792 - RNA, 19 nt, Homo sapiens
cuccagggcuaccaucauu

SEQ ID NO: 1245793 - RNA, 19 nt, Homo sapiens
gacaggaggaaccauaaug

SEQ ID NO: 1245794 - RNA, 19 nt, Homo sapiens
ccaccuccauccugacuag

SEQ ID NO: 1245795 - RNA, 19 nt, Homo sapiens
gagaagcugcaucccuuug

SEQ ID NO: 1245796 - RNA, 19 nt, Homo sapiens
auugcugacuccauacuua

SEQ ID NO: 1245797 - RNA, 19 nt, Homo sapiens
gcacagcccgcaucauugc

SEQ ID NO: 1245798 - RNA, 19 nt, Homo sapiens
ggggcaaagugaucaauuu

SEQ ID NO: 1245799 - RNA, 19 nt, Homo sapiens
gggcaaagugaucaauuuc

SEQ ID NO: 1245800 - RNA, 19 nt, Homo sapiens
cacagaggaugaugaguac

SEQ ID NO: 1245801 - RNA, 19 nt, Homo sapiens
gagcuggcccuuccucuac

SEQ ID NO: 1245802 - RNA, 19 nt, Homo sapiens
gagacuucauggacgacaa

SEQ ID NO: 1245803 - RNA, 19 nt, Homo sapiens
ccagggcuaccaucauuga

SEQ ID NO: 1245804 - RNA, 19 nt, Homo sapiens
cagacaggaggaaccauaa

SEQ ID NO: 1245805 - RNA, 19 nt, Homo sapiens
acagguggguucccucauc

SEQ ID NO: 1245806 - RNA, 19 nt, Homo sapiens
cagggaggcaggcaguuaa

SEQ ID NO: 1245807 - RNA, 19 nt, Homo sapiens
gaagucaccagcccauagg

SEQ ID NO: 1245808 - RNA, 19 nt, Homo sapiens
gacaagcguguguacauca

SEQ ID NO: 1245809 - RNA, 19 nt, Homo sapiens
cgaagucaccagcccauag

SEQ ID NO: 1245810 - RNA, 19 nt, Homo sapiens
ggacgacaagcguguguac

SEQ ID NO: 1245811 - RNA, 19 nt, Homo sapiens
gcacacgaggcgcuaucuu

SEQ ID NO: 1245812 - RNA, 19 nt, Homo sapiens
ggaaaauggggcaaaguga

SEQ ID NO: 1245813 - RNA, 19 nt, Homo sapiens
guugcuaccaucacagaaa

SEQ ID NO: 1245814 - RNA, 19 nt, Homo sapiens
gaggcgcuaucuuaaugag

SEQ ID NO: 1245815 - RNA, 19 nt, Homo sapiens
gaaaauggggcaaagugau

SEQ ID NO: 1245816 - RNA, 19 nt, Homo sapiens
cgacguggugguauacaau

SEQ ID NO: 1245817 - RNA, 19 nt, Homo sapiens
ugcccgacguggugguaua

SEQ ID NO: 1245818 - RNA, 19 nt, Homo sapiens
cgccaucaaguuucuguuu

SEQ ID NO: 1245819 - RNA, 19 nt, Homo sapiens
acaucacgcucgccaucaa

SEQ ID NO: 1245820 - RNA, 19 nt, Homo sapiens
guggagaggaacaucaaga

SEQ ID NO: 1245821 - RNA, 19 nt, Homo sapiens
gauaagguggagaggaaca

SEQ ID NO: 1245822 - RNA, 19 nt, Homo sapiens
ccgacguggugguauacaa

SEQ ID NO: 1245823 - RNA, 19 nt, Homo sapiens
uggagaggaacaucaagaa

SEQ ID NO: 1245824 - RNA, 19 nt, Homo sapiens
uugcuaccaucacagaaau

SEQ ID NO: 1245825 - RNA, 19 nt, Homo sapiens
cuacaaccgccacaucuac

SEQ ID NO: 1245826 - RNA, 19 nt, Homo sapiens
cagguggguucccucaucu

SEQ ID NO: 1245827 - RNA, 19 nt, Homo sapiens
gggcacagaggaugaugag

SEQ ID NO: 1245828 - RNA, 19 nt, Homo sapiens
agaagcugcaucccuuuga

SEQ ID NO: 1245829 - RNA, 19 nt, Homo sapiens
gaacaaagccacaucauuu

SEQ ID NO: 1245830 - RNA, 19 nt, Homo sapiens
gaucugaugugcuauaauu

SEQ ID NO: 1245831 - RNA, 19 nt, Homo sapiens
aaugaaagcuggugauaua

SEQ ID NO: 1245832 - RNA, 19 nt, Homo sapiens
uuaaagaucugaugugcua

SEQ ID NO: 1245833 - RNA, 19 nt, Homo sapiens
gaucugaaaugacugagaa

SEQ ID NO: 1245834 - RNA, 19 nt, Homo sapiens
gcaaagagucgugguauuu

SEQ ID NO: 1245835 - RNA, 19 nt, Homo sapiens
ggagaaagacauugagaaa

SEQ ID NO: 1245836 - RNA, 19 nt, Homo sapiens
gaacuaauugcccauguuu

SEQ ID NO: 1245837 - RNA, 19 nt, Homo sapiens
uagaugaccuggagaaaga

SEQ ID NO: 1245838 - RNA, 19 nt, Homo sapiens
gaugggaucugauuuaguc

SEQ ID NO: 1245839 - RNA, 19 nt, Homo sapiens
cgaagcauguuucucuuaa

SEQ ID NO: 1245840 - RNA, 19 nt, Homo sapiens
gaugcuuccugauguguua

SEQ ID NO: 1245841 - RNA, 19 nt, Homo sapiens
gagaaacggcgcaaacgua

SEQ ID NO: 1245842 - RNA, 19 nt, Homo sapiens
uaucugauguaguugcuua

SEQ ID NO: 1245843 - RNA, 19 nt, Homo sapiens
aagugaagcuggucagaua

SEQ ID NO: 1245844 - RNA, 19 nt, Homo sapiens
ggaauggacucugauaugg

SEQ ID NO: 1245845 - RNA, 19 nt, Homo sapiens
uaccauccuuccacaauua

SEQ ID NO: 1245846 - RNA, 19 nt, Homo sapiens
gcacagugaccuugaagaa

SEQ ID NO: 1245847 - RNA, 19 nt, Homo sapiens
uaaauuaccuguggcuguu

SEQ ID NO: 1245848 - RNA, 19 nt, Homo sapiens
ggaagcagaugaugguucu

SEQ ID NO: 1245849 - RNA, 19 nt, Homo sapiens
gucaggaaaugaagaauau

SEQ ID NO: 1245850 - RNA, 19 nt, Homo sapiens
uagccuggauacuuuguua

SEQ ID NO: 1245851 - RNA, 19 nt, Homo sapiens
uggauagccuggauacuuu

SEQ ID NO: 1245852 - RNA, 19 nt, Homo sapiens
guuacugucuuaugaauuc

SEQ ID NO: 1245853 - RNA, 19 nt, Homo sapiens
gaaagcuggugauauaaaa

SEQ ID NO: 1245854 - RNA, 19 nt, Homo sapiens
guauaaaugcagaugcuua

SEQ ID NO: 1245855 - RNA, 19 nt, Homo sapiens
ugauguaguugcuuaaaga

SEQ ID NO: 1245856 - RNA, 19 nt, Homo sapiens
gcagugcuucuguauuaua

SEQ ID NO: 1245857 - RNA, 19 nt, Homo sapiens
acaauggaauggacucuga

SEQ ID NO: 1245858 - RNA, 19 nt, Homo sapiens
ggacuggaccugacugugu

SEQ ID NO: 1245859 - RNA, 19 nt, Homo sapiens
ggacuuuccuccgaugguu

SEQ ID NO: 1245860 - RNA, 19 nt, Homo sapiens
aguuagagcuccugucuga

SEQ ID NO: 1245861 - RNA, 19 nt, Homo sapiens
uaaaugcagaugcuuauga

SEQ ID NO: 1245862 - RNA, 19 nt, Homo sapiens
cagcaggaaacuaaauaua

SEQ ID NO: 1245863 - RNA, 19 nt, Homo sapiens
ucaggaaccuuugauaagu

SEQ ID NO: 1245864 - RNA, 19 nt, Homo sapiens
ucucauguaacccuuauua

SEQ ID NO: 1245865 - RNA, 19 nt, Homo sapiens
cagccuagguauuuaacuu

SEQ ID NO: 1245866 - RNA, 19 nt, Homo sapiens
caggaaccuuugauaaguu

SEQ ID NO: 1245867 - RNA, 19 nt, Homo sapiens
ggaagauagugauguacuc

SEQ ID NO: 1245868 - RNA, 19 nt, Homo sapiens
gaugcauuauucuagguuu

SEQ ID NO: 1245869 - RNA, 19 nt, Homo sapiens
cauguaacccuuauuagga

SEQ ID NO: 1245870 - RNA, 19 nt, Homo sapiens
aacaaagccacaucauuua

SEQ ID NO: 1245871 - RNA, 19 nt, Homo sapiens
gaaaauacaguccaaagug

SEQ ID NO: 1245872 - RNA, 19 nt, Homo sapiens
gauaccauuggaugcauua

SEQ ID NO: 1245873 - RNA, 19 nt, Homo sapiens
ugaaagcuggugauauaaa

SEQ ID NO: 1245874 - RNA, 19 nt, Homo sapiens
gcagaugaugguucuaaga

SEQ ID NO: 1245875 - RNA, 19 nt, Homo sapiens
acuaauugcccauguuuaa

SEQ ID NO: 1245876 - RNA, 19 nt, Homo sapiens
gaagcauguuucucuuaag

SEQ ID NO: 1245877 - RNA, 19 nt, Homo sapiens
acaaagccacaucauuuaa

SEQ ID NO: 1245878 - RNA, 19 nt, Homo sapiens
guguguuacugucuuauga

SEQ ID NO: 1245879 - RNA, 19 nt, Homo sapiens
gaagauagugauguacuca

SEQ ID NO: 1245880 - RNA, 19 nt, Homo sapiens
ccugaagguuuggaauuaa

SEQ ID NO: 1245881 - RNA, 19 nt, Homo sapiens
gagaauaagcaaccugaag

SEQ ID NO: 1245882 - RNA, 19 nt, Homo sapiens
cagcaagacaucuguauag

SEQ ID NO: 1245883 - RNA, 19 nt, Homo sapiens
aauggacucugauauggaa

SEQ ID NO: 1245884 - RNA, 19 nt, Homo sapiens
aaagaucugaugugcuaua

SEQ ID NO: 1245885 - RNA, 19 nt, Homo sapiens
ugacgaagcauguuucucu

SEQ ID NO: 1245886 - RNA, 19 nt, Homo sapiens
ugaacaaagccacaucauu

SEQ ID NO: 1245887 - RNA, 19 nt, Homo sapiens
aaagccagccuagguauuu

SEQ ID NO: 1245888 - RNA, 19 nt, Homo sapiens
gcugugggaacgccaauuu

SEQ ID NO: 1245889 - RNA, 19 nt, Homo sapiens
uagcagacacgccauucua

SEQ ID NO: 1245890 - RNA, 19 nt, Homo sapiens
caaagccacaucauuuaau

SEQ ID NO: 1245891 - RNA, 19 nt, Homo sapiens
cugaagguuuggaauuaaa

SEQ ID NO: 1245892 - RNA, 19 nt, Homo sapiens
ggaagaggaagcagaugau

SEQ ID NO: 1245893 - RNA, 19 nt, Homo sapiens
cguagagauccuuaacuua

SEQ ID NO: 1245894 - RNA, 19 nt, Homo sapiens
gacgaagcauguuucucuu

SEQ ID NO: 1245895 - RNA, 19 nt, Homo sapiens
gccuagguauuuaacuuga

SEQ ID NO: 1245896 - RNA, 19 nt, Homo sapiens
gaugagggcaagagcgauu

SEQ ID NO: 1245897 - RNA, 19 nt, Homo sapiens
gaauggacucugauaugga

SEQ ID NO: 1245898 - RNA, 19 nt, Homo sapiens
uuagagcuccugucugaaa

SEQ ID NO: 1245899 - RNA, 19 nt, Homo sapiens
acguagagauccuuaacuu

SEQ ID NO: 1245900 - RNA, 19 nt, Homo sapiens
uuaccauccuuccacaauu

SEQ ID NO: 1245901 - RNA, 19 nt, Homo sapiens
gaucugaagacuuuugaua

SEQ ID NO: 1245902 - RNA, 19 nt, Homo sapiens
ggaacaaguuuucauuuac

SEQ ID NO: 1245903 - RNA, 19 nt, Homo sapiens
gugcuucuguauuauagga

SEQ ID NO: 1245904 - RNA, 19 nt, Homo sapiens
agaacuaauugcccauguu

SEQ ID NO: 1245905 - RNA, 19 nt, Homo sapiens
ucuuaaggcuacuuguauu

SEQ ID NO: 1245906 - RNA, 19 nt, Homo sapiens
uggauacuuuguuagauga

SEQ ID NO: 1245907 - RNA, 19 nt, Homo sapiens
gcagcaggaaacuaaauau

SEQ ID NO: 1245908 - RNA, 19 nt, Homo sapiens
gaaaaggggaagauaguga

SEQ ID NO: 1245909 - RNA, 19 nt, Homo sapiens
aaaauacaguccaaaguga

SEQ ID NO: 1245910 - RNA, 19 nt, Homo sapiens
gaagaggaagcagaugaug

SEQ ID NO: 1245911 - RNA, 19 nt, Homo sapiens
gaaccuuugauaaguuguu

SEQ ID NO: 1245912 - RNA, 19 nt, Homo sapiens
ugucaggaaaugaagaaua

SEQ ID NO: 1245913 - RNA, 19 nt, Homo sapiens
uaaaagccauuagcaaaga

SEQ ID NO: 1245914 - RNA, 19 nt, Homo sapiens
cuaaugaaagcuggugaua

SEQ ID NO: 1245915 - RNA, 19 nt, Homo sapiens
ucagcaagacaucuguaua

SEQ ID NO: 1245916 - RNA, 19 nt, Homo sapiens
uguaguugcuuaaagaucu

SEQ ID NO: 1245917 - RNA, 19 nt, Homo sapiens
uuccugauguguuaaagaa

SEQ ID NO: 1245918 - RNA, 19 nt, Homo sapiens
accauuggaugcauuauuc

SEQ ID NO: 1245919 - RNA, 19 nt, Homo sapiens
aauguguguuacugucuua

SEQ ID NO: 1245920 - RNA, 19 nt, Homo sapiens
aagccagccuagguauuua

SEQ ID NO: 1245921 - RNA, 19 nt, Homo sapiens
uuaaagcccuaaugaaagc

SEQ ID NO: 1245922 - RNA, 19 nt, Homo sapiens
agaaagacauugagaaaag

SEQ ID NO: 1245923 - RNA, 19 nt, Homo sapiens
ccacaauuagggaugcuuu

SEQ ID NO: 1245924 - RNA, 19 nt, Homo sapiens
aagaucugaugugcuauaa

SEQ ID NO: 1245925 - RNA, 19 nt, Homo sapiens
gcaaaagauugacgaagca

SEQ ID NO: 1245926 - RNA, 19 nt, Homo sapiens
gauagaugaccuggagaaa

SEQ ID NO: 1245927 - RNA, 19 nt, Homo sapiens
cuggauacuuuguuagaug

SEQ ID NO: 1245928 - RNA, 19 nt, Homo sapiens
cuguauagauucugcuuca

SEQ ID NO: 1245929 - RNA, 19 nt, Homo sapiens
ggacuacucuuaugauuua

SEQ ID NO: 1245930 - RNA, 19 nt, Homo sapiens
gaagagggcuauauuagaa

SEQ ID NO: 1245931 - RNA, 19 nt, Homo sapiens
ggacauugcuccgcucuua

SEQ ID NO: 1245932 - RNA, 19 nt, Homo sapiens
ggagggagaugacggacua

SEQ ID NO: 1245933 - RNA, 19 nt, Homo sapiens
gaaccacagucuugacaaa

SEQ ID NO: 1245934 - RNA, 19 nt, Homo sapiens
acacaaagguggcagauau

SEQ ID NO: 1245935 - RNA, 19 nt, Homo sapiens
gaacucaccuaacccaagu

SEQ ID NO: 1245936 - RNA, 19 nt, Homo sapiens
caaaggcacucuguacauu

SEQ ID NO: 1245937 - RNA, 19 nt, Homo sapiens
gcaccuauaacaaucaaua

SEQ ID NO: 1245938 - RNA, 19 nt, Homo sapiens
gcagauaucuaccuagcau

SEQ ID NO: 1245939 - RNA, 19 nt, Homo sapiens
caaagaagagggcuauauu

SEQ ID NO: 1245940 - RNA, 19 nt, Homo sapiens
gaauaguguuggagaucua

SEQ ID NO: 1245941 - RNA, 19 nt, Homo sapiens
caagguggccucccuguuu

SEQ ID NO: 1245942 - RNA, 19 nt, Homo sapiens
ggagcaaauuccuacauau

SEQ ID NO: 1245943 - RNA, 19 nt, Homo sapiens
aaagaagagggcuauauua

SEQ ID NO: 1245944 - RNA, 19 nt, Homo sapiens
gauauuggcccuccuacaa

SEQ ID NO: 1245945 - RNA, 19 nt, Homo sapiens
cggcauccaugaaauauau

SEQ ID NO: 1245946 - RNA, 19 nt, Homo sapiens
uggauaaagugcaggauuu

SEQ ID NO: 1245947 - RNA, 19 nt, Homo sapiens
caagggaaagugacugaua

SEQ ID NO: 1245948 - RNA, 19 nt, Homo sapiens
gcaaagaagagggcuauau

SEQ ID NO: 1245949 - RNA, 19 nt, Homo sapiens
gcaggagucuacuaugcaa

SEQ ID NO: 1245950 - RNA, 19 nt, Homo sapiens
uggagucucuggaugauuu

SEQ ID NO: 1245951 - RNA, 19 nt, Homo sapiens
ccagaggucuacaacuuug

SEQ ID NO: 1245952 - RNA, 19 nt, Homo sapiens
gcaguagucgccucucuuu

SEQ ID NO: 1245953 - RNA, 19 nt, Homo sapiens
gaagggacaaagccaauga

SEQ ID NO: 1245954 - RNA, 19 nt, Homo sapiens
cacgaaaccuuccaucaug

SEQ ID NO: 1245955 - RNA, 19 nt, Homo sapiens
gagcaaauuccuacauaug

SEQ ID NO: 1245956 - RNA, 19 nt, Homo sapiens
gaggugggcagacaucuuu

SEQ ID NO: 1245957 - RNA, 19 nt, Homo sapiens
ugaaugaccacuacacaaa

SEQ ID NO: 1245958 - RNA, 19 nt, Homo sapiens
ccaucagaauuaugcaaua

SEQ ID NO: 1245959 - RNA, 19 nt, Homo sapiens
cuagaagacuguaaauaag

SEQ ID NO: 1245960 - RNA, 19 nt, Homo sapiens
uggagcaaauuccuacaua

SEQ ID NO: 1245961 - RNA, 19 nt, Homo sapiens
ccaauaugauggcagauag

SEQ ID NO: 1245962 - RNA, 19 nt, Homo sapiens
gaugggacaugggacauug

SEQ ID NO: 1245963 - RNA, 19 nt, Homo sapiens
ugaagaaaguaaagcugaa

SEQ ID NO: 1245964 - RNA, 19 nt, Homo sapiens
caauguuccuuuccaugaa

SEQ ID NO: 1245965 - RNA, 19 nt, Homo sapiens
auacaacucuggcaccuau

SEQ ID NO: 1245966 - RNA, 19 nt, Homo sapiens
gggcagacaucuuuucaaa

SEQ ID NO: 1245967 - RNA, 19 nt, Homo sapiens
caagguucuuccuggauuu

SEQ ID NO: 1245968 - RNA, 19 nt, Homo sapiens
ucaagguucuuccuggauu

SEQ ID NO: 1245969 - RNA, 19 nt, Homo sapiens
gauacggcauccaugaaau

SEQ ID NO: 1245970 - RNA, 19 nt, Homo sapiens
gauaccaaaggcacuauuu

SEQ ID NO: 1245971 - RNA, 19 nt, Homo sapiens
guaaauaagauaccaaagg

SEQ ID NO: 1245972 - RNA, 19 nt, Homo sapiens
gcuauccacuguuaguuca

SEQ ID NO: 1245973 - RNA, 19 nt, Homo sapiens
gauaaagauaccagcagua

SEQ ID NO: 1245974 - RNA, 19 nt, Homo sapiens
gguggcagauaucuaccua

SEQ ID NO: 1245975 - RNA, 19 nt, Homo sapiens
ugccagaggucuacaacuu

SEQ ID NO: 1245976 - RNA, 19 nt, Homo sapiens
caaugacccuguuccagau

SEQ ID NO: 1245977 - RNA, 19 nt, Homo sapiens
caaagccaaugacccuguu

SEQ ID NO: 1245978 - RNA, 19 nt, Homo sapiens
ucaaagaauacaagacuga

SEQ ID NO: 1245979 - RNA, 19 nt, Homo sapiens
gccuauggcuuuuacaaua

SEQ ID NO: 1245980 - RNA, 19 nt, Homo sapiens
cagccaugcucaggauaua

SEQ ID NO: 1245981 - RNA, 19 nt, Homo sapiens
caacaaaacucuacaucag

SEQ ID NO: 1245982 - RNA, 19 nt, Homo sapiens
gaaaagacaguacaaguca

SEQ ID NO: 1245983 - RNA, 19 nt, Homo sapiens
gccaugcucaggauauaua

SEQ ID NO: 1245984 - RNA, 19 nt, Homo sapiens
ucuuagcaguggauugaua

SEQ ID NO: 1245985 - RNA, 19 nt, Homo sapiens
ggacuucaacaucauagau

SEQ ID NO: 1245986 - RNA, 19 nt, Homo sapiens
acacaugaaugaccacuac

SEQ ID NO: 1245987 - RNA, 19 nt, Homo sapiens
gaccugaacucaccuaacc

SEQ ID NO: 1245988 - RNA, 19 nt, Homo sapiens
gagcaaagaagagggcuau

SEQ ID NO: 1245989 - RNA, 19 nt, Homo sapiens
ggacuagaagacuguaaau

SEQ ID NO: 1245990 - RNA, 19 nt, Homo sapiens
ggagaugacggacuagaag

SEQ ID NO: 1245991 - RNA, 19 nt, Homo sapiens
gacuucaacaucauagaua

SEQ ID NO: 1245992 - RNA, 19 nt, Homo sapiens
uauaaacacugggacuuca

SEQ ID NO: 1245993 - RNA, 19 nt, Homo sapiens
gacuagaagacuguaaaua

SEQ ID NO: 1245994 - RNA, 19 nt, Homo sapiens
gcuccgcucuuaucaaggu

SEQ ID NO: 1245995 - RNA, 19 nt, Homo sapiens
acccacagcugaucacgaa

SEQ ID NO: 1245996 - RNA, 19 nt, Homo sapiens
aaagauaccagcaguaguc

SEQ ID NO: 1245997 - RNA, 19 nt, Homo sapiens
gggcuuggacuacucuuau

SEQ ID NO: 1245998 - RNA, 19 nt, Homo sapiens
ggcaagaggugggcagaca

SEQ ID NO: 1245999 - RNA, 19 nt, Homo sapiens
caucauagauaaagauacc

SEQ ID NO: 1246000 - RNA, 19 nt, Homo sapiens
agaagagggcuauauuaga

SEQ ID NO: 1246001 - RNA, 19 nt, Homo sapiens
aaagacaguacaagucaaa

SEQ ID NO: 1246002 - RNA, 19 nt, Homo sapiens
caaagguggcagauaucua

SEQ ID NO: 1246003 - RNA, 19 nt, Homo sapiens
gccagaggucuacaacuuu

SEQ ID NO: 1246004 - RNA, 19 nt, Homo sapiens
acaauguuccuuuccauga

SEQ ID NO: 1246005 - RNA, 19 nt, Homo sapiens
ugacaaaggcacucuguac

SEQ ID NO: 1246006 - RNA, 19 nt, Homo sapiens
ggagaucagagcuggcuau

SEQ ID NO: 1246007 - RNA, 19 nt, Homo sapiens
uaagauaccaaaggcacua

SEQ ID NO: 1246008 - RNA, 19 nt, Homo sapiens
gcugggaccguuucaacaa

SEQ ID NO: 1246009 - RNA, 19 nt, Homo sapiens
gacaaaggcacucuguaca

SEQ ID NO: 1246010 - RNA, 19 nt, Homo sapiens
ucacgaaaccuuccaucau

SEQ ID NO: 1246011 - RNA, 19 nt, Homo sapiens
gagaugacggacuagaaga

SEQ ID NO: 1246012 - RNA, 19 nt, Homo sapiens
gggagaugacggacuagaa

SEQ ID NO: 1246013 - RNA, 19 nt, Homo sapiens
aagaagagggcuauauuag

SEQ ID NO: 1246014 - RNA, 19 nt, Homo sapiens
gcagccaugcucaggauau

SEQ ID NO: 1246015 - RNA, 19 nt, Homo sapiens
auacggcauccaugaaaua

SEQ ID NO: 1246016 - RNA, 19 nt, Homo sapiens
guacauuguggagcaaauu

SEQ ID NO: 1246017 - RNA, 19 nt, Homo sapiens
aagcugaaccacagucuug

SEQ ID NO: 1246018 - RNA, 19 nt, Homo sapiens
aaacggcagccuaaagguu

SEQ ID NO: 1246019 - RNA, 19 nt, Homo sapiens
cagcugaucacgaaaccuu

SEQ ID NO: 1246020 - RNA, 19 nt, Homo sapiens
ugauacggcauccaugaaa

SEQ ID NO: 1246021 - RNA, 19 nt, Homo sapiens
gcaguggauugauauugcu

SEQ ID NO: 1246022 - RNA, 19 nt, Homo sapiens
gaucugauucccucacucu

SEQ ID NO: 1246023 - RNA, 19 nt, Homo sapiens
cuacaauguuccuuuccau

SEQ ID NO: 1246024 - RNA, 19 nt, Homo sapiens
uaccaaaggcacuauuuua

SEQ ID NO: 1246025 - RNA, 19 nt, Homo sapiens
acaacucuggcaccuauaa

SEQ ID NO: 1246026 - RNA, 19 nt, Homo sapiens
gaguccguguggccaauau

SEQ ID NO: 1246027 - RNA, 19 nt, Homo sapiens
ugaauaguguuggagaucu

SEQ ID NO: 1246028 - RNA, 19 nt, Homo sapiens
aaagguggcagauaucuac

SEQ ID NO: 1246029 - RNA, 19 nt, Homo sapiens
gcaagaagcuggauuagga

SEQ ID NO: 1246030 - RNA, 19 nt, Homo sapiens
gaacucugauccaguauau

SEQ ID NO: 1246031 - RNA, 19 nt, Homo sapiens
ggacagauacucagaaaga

SEQ ID NO: 1246032 - RNA, 19 nt, Homo sapiens
ggagguaaauaaacuaaga

SEQ ID NO: 1246033 - RNA, 19 nt, Homo sapiens
gagaggagccgcagucuuu

SEQ ID NO: 1246034 - RNA, 19 nt, Homo sapiens
gaaggaacuuguacaaaca

SEQ ID NO: 1246035 - RNA, 19 nt, Homo sapiens
gagaagagccugcaaaugg

SEQ ID NO: 1246036 - RNA, 19 nt, Homo sapiens
gcacaauaaucaucacaga

SEQ ID NO: 1246037 - RNA, 19 nt, Homo sapiens
caaauaaacuggacaccau

SEQ ID NO: 1246038 - RNA, 19 nt, Homo sapiens
gcaaauggccaaugaagga

SEQ ID NO: 1246039 - RNA, 19 nt, Homo sapiens
ggaaaguggccacagauaa

SEQ ID NO: 1246040 - RNA, 19 nt, Homo sapiens
guacauagcguugaguuaa

SEQ ID NO: 1246041 - RNA, 19 nt, Homo sapiens
gaaaguggccacagauaau

SEQ ID NO: 1246042 - RNA, 19 nt, Homo sapiens
ggacacagaagaaauccua

SEQ ID NO: 1246043 - RNA, 19 nt, Homo sapiens
caaugaaggagguaaauaa

SEQ ID NO: 1246044 - RNA, 19 nt, Homo sapiens
gaagggaggagagaagaua

SEQ ID NO: 1246045 - RNA, 19 nt, Homo sapiens
ucaaucaccucgacuuguu

SEQ ID NO: 1246046 - RNA, 19 nt, Homo sapiens
ggcauaacguaauccauuu

SEQ ID NO: 1246047 - RNA, 19 nt, Homo sapiens
gggcaucucuauagaaagu

SEQ ID NO: 1246048 - RNA, 19 nt, Homo sapiens
guuuguaucuuguuccuuu

SEQ ID NO: 1246049 - RNA, 19 nt, Homo sapiens
ccacagguuugcagaaaug

SEQ ID NO: 1246050 - RNA, 19 nt, Homo sapiens
ccauuucacuguagccuaa

SEQ ID NO: 1246051 - RNA, 19 nt, Homo sapiens
aaacagacuuugaauggau

SEQ ID NO: 1246052 - RNA, 19 nt, Homo sapiens
gcaguuugauguuucuguu

SEQ ID NO: 1246053 - RNA, 19 nt, Homo sapiens
gacaucaccuuguuucauc

SEQ ID NO: 1246054 - RNA, 19 nt, Homo sapiens
gaucagacacauuucgaaa

SEQ ID NO: 1246055 - RNA, 19 nt, Homo sapiens
gagggaggguugccaugaa

SEQ ID NO: 1246056 - RNA, 19 nt, Homo sapiens
cguaauccauuucacugua

SEQ ID NO: 1246057 - RNA, 19 nt, Homo sapiens
cuucaaaccuggugcauuc

SEQ ID NO: 1246058 - RNA, 19 nt, Homo sapiens
ccagcuggcuuucaagaug

SEQ ID NO: 1246059 - RNA, 19 nt, Homo sapiens
ggagagaagauagguauug

SEQ ID NO: 1246060 - RNA, 19 nt, Homo sapiens
ggaccugccuaauuaccuu

SEQ ID NO: 1246061 - RNA, 19 nt, Homo sapiens
ugaaggagguaaauaaacu

SEQ ID NO: 1246062 - RNA, 19 nt, Homo sapiens
agaaggaacuuguacaaac

SEQ ID NO: 1246063 - RNA, 19 nt, Homo sapiens
gaaggagguaaauaaacua

SEQ ID NO: 1246064 - RNA, 19 nt, Homo sapiens
gcuccucacuccugcugua

SEQ ID NO: 1246065 - RNA, 19 nt, Homo sapiens
gaagacauguuuucacugu

SEQ ID NO: 1246066 - RNA, 19 nt, Homo sapiens
gaggagagaagauagguau

SEQ ID NO: 1246067 - RNA, 19 nt, Homo sapiens
gaacugugaauguacauag

SEQ ID NO: 1246068 - RNA, 19 nt, Homo sapiens
gagguuggauauuguucaa

SEQ ID NO: 1246069 - RNA, 19 nt, Homo sapiens
ggaagccuguucgcaagaa

SEQ ID NO: 1246070 - RNA, 19 nt, Homo sapiens
gauaaacagacuuugaaug

SEQ ID NO: 1246071 - RNA, 19 nt, Homo sapiens
gacuugaguuugcuuccua

SEQ ID NO: 1246072 - RNA, 19 nt, Homo sapiens
gguuggauauuguucaaau

SEQ ID NO: 1246073 - RNA, 19 nt, Homo sapiens
agacagggauggaguaaac

SEQ ID NO: 1246074 - RNA, 19 nt, Homo sapiens
uauagaaagugaccaccaa

SEQ ID NO: 1246075 - RNA, 19 nt, Homo sapiens
ucaccuuguuucaucauuu

SEQ ID NO: 1246076 - RNA, 19 nt, Homo sapiens
ucagaaagagccaggauga

SEQ ID NO: 1246077 - RNA, 19 nt, Homo sapiens
gaauguacauagcguugag

SEQ ID NO: 1246078 - RNA, 19 nt, Homo sapiens
uaaacagacuuugaaugga

SEQ ID NO: 1246079 - RNA, 19 nt, Homo sapiens
gcaucucuauagaaaguga

SEQ ID NO: 1246080 - RNA, 19 nt, Homo sapiens
ccucugacaucaccuuguu

SEQ ID NO: 1246081 - RNA, 19 nt, Homo sapiens
uuacuaacuuccucagaga

SEQ ID NO: 1246082 - RNA, 19 nt, Homo sapiens
ccaccaaggccaguaagua

SEQ ID NO: 1246083 - RNA, 19 nt, Homo sapiens
ggaacucugauccaguaua

SEQ ID NO: 1246084 - RNA, 19 nt, Homo sapiens
aagcaaaggcuccggguuu

SEQ ID NO: 1246085 - RNA, 19 nt, Homo sapiens
ugaagucccucugacauca

SEQ ID NO: 1246086 - RNA, 19 nt, Homo sapiens
uauagaaucugaggcuguu

SEQ ID NO: 1246087 - RNA, 19 nt, Homo sapiens
ccaggauucucgcaggaaa

SEQ ID NO: 1246088 - RNA, 19 nt, Homo sapiens
ugaaggaacuugggauuuu

SEQ ID NO: 1246089 - RNA, 19 nt, Homo sapiens
uacauagcguugaguuaaa

SEQ ID NO: 1246090 - RNA, 19 nt, Homo sapiens
ccaaugaaggagguaaaua

SEQ ID NO: 1246091 - RNA, 19 nt, Homo sapiens
ggaaaacaguagaagaaau

SEQ ID NO: 1246092 - RNA, 19 nt, Homo sapiens
caauaaucaucacagacuu

SEQ ID NO: 1246093 - RNA, 19 nt, Homo sapiens
guaauccauuucacuguag

SEQ ID NO: 1246094 - RNA, 19 nt, Homo sapiens
ugacuuaaauuuccaucag

SEQ ID NO: 1246095 - RNA, 19 nt, Homo sapiens
cggcauaacguaauccauu

SEQ ID NO: 1246096 - RNA, 19 nt, Homo sapiens
ucacgcagccacccgagua

SEQ ID NO: 1246097 - RNA, 19 nt, Homo sapiens
gauagguauugcggaguuu

SEQ ID NO: 1246098 - RNA, 19 nt, Homo sapiens
gagagaagauagguauugc

SEQ ID NO: 1246099 - RNA, 19 nt, Homo sapiens
ggggaacucugauccagua

SEQ ID NO: 1246100 - RNA, 19 nt, Homo sapiens
ggagaagagccugcaaaug

SEQ ID NO: 1246101 - RNA, 19 nt, Homo sapiens
ccacugacagacauuuaaa

SEQ ID NO: 1246102 - RNA, 19 nt, Homo sapiens
ccucagagauucgugauac

SEQ ID NO: 1246103 - RNA, 19 nt, Homo sapiens
gcuccggguuuguuuggaa

SEQ ID NO: 1246104 - RNA, 19 nt, Homo sapiens
gaucacauucgcugacuuc

SEQ ID NO: 1246105 - RNA, 19 nt, Homo sapiens
ccagaaggaacuuguacaa

SEQ ID NO: 1246106 - RNA, 19 nt, Homo sapiens
gccgagccgucaccugauu

SEQ ID NO: 1246107 - RNA, 19 nt, Homo sapiens
gacuuugaauggauguuug

SEQ ID NO: 1246108 - RNA, 19 nt, Homo sapiens
ucagggcucuuggcuguug

SEQ ID NO: 1246109 - RNA, 19 nt, Homo sapiens
acacuugccuuuuagaauu

SEQ ID NO: 1246110 - RNA, 19 nt, Homo sapiens
ggccacagauaaugauuuu

SEQ ID NO: 1246111 - RNA, 19 nt, Homo sapiens
ccauccagcuggcuuucaa

SEQ ID NO: 1246112 - RNA, 19 nt, Homo sapiens
gaaaacaguagaagaaauc

SEQ ID NO: 1246113 - RNA, 19 nt, Homo sapiens
gaacuugggauuuucaaug

SEQ ID NO: 1246114 - RNA, 19 nt, Homo sapiens
auaaacagacuuugaaugg

SEQ ID NO: 1246115 - RNA, 19 nt, Homo sapiens
gccugcaaauggccaauga

SEQ ID NO: 1246116 - RNA, 19 nt, Homo sapiens
ugaccuuccugcagagaga

SEQ ID NO: 1246117 - RNA, 19 nt, Homo sapiens
gggcuuugacuuaaauuuc

SEQ ID NO: 1246118 - RNA, 19 nt, Homo sapiens
ugcuggagcucaugaguau

SEQ ID NO: 1246119 - RNA, 19 nt, Homo sapiens
agauagguauugcggaguu

SEQ ID NO: 1246120 - RNA, 19 nt, Homo sapiens
ggaggagagaagauaggua

SEQ ID NO: 1246121 - RNA, 19 nt, Homo sapiens
cuggacagauacucagaaa

SEQ ID NO: 1246122 - RNA, 19 nt, Homo sapiens
cagcuccguuucaaucaau

SEQ ID NO: 1246123 - RNA, 19 nt, Homo sapiens
gaguauggcugaccuuccu

SEQ ID NO: 1246124 - RNA, 19 nt, Homo sapiens
ugugaaguguguugcagaa

SEQ ID NO: 1246125 - RNA, 19 nt, Homo sapiens
ucagacacauuucgaaagc

SEQ ID NO: 1246126 - RNA, 19 nt, Homo sapiens
ggaccuggagcgcuggaaa

SEQ ID NO: 1246127 - RNA, 19 nt, Homo sapiens
uggagaaugcguaaagauu

SEQ ID NO: 1246128 - RNA, 19 nt, Homo sapiens
cagaaggaacuuguacaaa

SEQ ID NO: 1246129 - RNA, 19 nt, Homo sapiens
gacaagggcucguacuuug

SEQ ID NO: 1246130 - RNA, 19 nt, Homo sapiens
gaaggaagccaucaacuca

SEQ ID NO: 1246131 - RNA, 19 nt, Homo sapiens
guacaaauguguccugaag

SEQ ID NO: 1246132 - RNA, 19 nt, Homo sapiens
gacggcauguucuucauua

SEQ ID NO: 1246133 - RNA, 19 nt, Homo sapiens
ggacaagggcucguacuuu

SEQ ID NO: 1246134 - RNA, 19 nt, Homo sapiens
gagauucgcaccaugauga

SEQ ID NO: 1246135 - RNA, 19 nt, Homo sapiens
gaagaagcccuccaugauc

SEQ ID NO: 1246136 - RNA, 19 nt, Homo sapiens
gcagcaaccucacggagau

SEQ ID NO: 1246137 - RNA, 19 nt, Homo sapiens
ccagagcuguggcagauug

SEQ ID NO: 1246138 - RNA, 19 nt, Homo sapiens
gcucaaggagaaccaguua

SEQ ID NO: 1246139 - RNA, 19 nt, Homo sapiens
aaacggaucucucgacaac

SEQ ID NO: 1246140 - RNA, 19 nt, Homo sapiens
agaaguuccugcagaaguu

SEQ ID NO: 1246141 - RNA, 19 nt, Homo sapiens
gaggguuccuacuaucuga

SEQ ID NO: 1246142 - RNA, 19 nt, Homo sapiens
aggaggagcuggagcaguu

SEQ ID NO: 1246143 - RNA, 19 nt, Homo sapiens
cggcugagcuuugccaguu

SEQ ID NO: 1246144 - RNA, 19 nt, Homo sapiens
gagaggguguccuuagaag

SEQ ID NO: 1246145 - RNA, 19 nt, Homo sapiens
cauccucggucuuugcaaa

SEQ ID NO: 1246146 - RNA, 19 nt, Homo sapiens
caagcgcgacuuccacuuu

SEQ ID NO: 1246147 - RNA, 19 nt, Homo sapiens
cucaagaccugcaaacuca

SEQ ID NO: 1246148 - RNA, 19 nt, Homo sapiens
gcagcauguuccacgcuuu

SEQ ID NO: 1246149 - RNA, 19 nt, Homo sapiens
ggagcucgaagcaauugua

SEQ ID NO: 1246150 - RNA, 19 nt, Homo sapiens
gagucugccuuguacaaau

SEQ ID NO: 1246151 - RNA, 19 nt, Homo sapiens
agaagaagcccuccaugau

SEQ ID NO: 1246152 - RNA, 19 nt, Homo sapiens
uggagaaguuccugcagaa

SEQ ID NO: 1246153 - RNA, 19 nt, Homo sapiens
aggaggagcucgaagcaau

SEQ ID NO: 1246154 - RNA, 19 nt, Homo sapiens
ccgagaggguguccuuaga

SEQ ID NO: 1246155 - RNA, 19 nt, Homo sapiens
ccaacaaccgcaagcugua

SEQ ID NO: 1246156 - RNA, 19 nt, Homo sapiens
aagaagaagcccuccauga

SEQ ID NO: 1246157 - RNA, 19 nt, Homo sapiens
gagaaguuccugcagaagu

SEQ ID NO: 1246158 - RNA, 19 nt, Homo sapiens
ugcagcagcucaaggagaa

SEQ ID NO: 1246159 - RNA, 19 nt, Homo sapiens
gcaggacaguugugaaaau

SEQ ID NO: 1246160 - RNA, 19 nt, Homo sapiens
caagagcuacgacaagauc

SEQ ID NO: 1246161 - RNA, 19 nt, Homo sapiens
cgaagcaauuguagagucu

SEQ ID NO: 1246162 - RNA, 19 nt, Homo sapiens
ggaggagcucgaagcaauu

SEQ ID NO: 1246163 - RNA, 19 nt, Homo sapiens
ggagaaccaguuagugauc

SEQ ID NO: 1246164 - RNA, 19 nt, Homo sapiens
gcucaagaccugcaaacuc

SEQ ID NO: 1246165 - RNA, 19 nt, Homo sapiens
aaggagaaccaguuaguga

SEQ ID NO: 1246166 - RNA, 19 nt, Homo sapiens
caugaugaccugcgagaga

SEQ ID NO: 1246167 - RNA, 19 nt, Homo sapiens
uggagcacaucaagagcua

SEQ ID NO: 1246168 - RNA, 19 nt, Homo sapiens
ccugcaaacucaucuacga

SEQ ID NO: 1246169 - RNA, 19 nt, Homo sapiens
gcucgaagcaauuguagag

SEQ ID NO: 1246170 - RNA, 19 nt, Homo sapiens
agacggaaagggaaacuga

SEQ ID NO: 1246171 - RNA, 19 nt, Homo sapiens
accgcaagcuguacaagaa

SEQ ID NO: 1246172 - RNA, 19 nt, Homo sapiens
gcugagcuuugccaguuuc

SEQ ID NO: 1246173 - RNA, 19 nt, Homo sapiens
gagacggcauguucuucau

SEQ ID NO: 1246174 - RNA, 19 nt, Homo sapiens
gacccucccagcucccuua

SEQ ID NO: 1246175 - RNA, 19 nt, Homo sapiens
gcagugcgcggagaaguuc

SEQ ID NO: 1246176 - RNA, 19 nt, Homo sapiens
cgagaggguguccuuagaa

SEQ ID NO: 1246177 - RNA, 19 nt, Homo sapiens
aggaagccaucaacucaug

SEQ ID NO: 1246178 - RNA, 19 nt, Homo sapiens
caggagauucgcaccauga

SEQ ID NO: 1246179 - RNA, 19 nt, Homo sapiens
ugccugugcucauguaugu

SEQ ID NO: 1246180 - RNA, 19 nt, Homo sapiens
agaagaagaucuccauccu

SEQ ID NO: 1246181 - RNA, 19 nt, Homo sapiens
ucaaggagaaccaguuagu

SEQ ID NO: 1246182 - RNA, 19 nt, Homo sapiens
uguagagucugccuuguac

SEQ ID NO: 1246183 - RNA, 19 nt, Homo sapiens
caggacaguugugaaaaua

SEQ ID NO: 1246184 - RNA, 19 nt, Homo sapiens
aagcgcgacuuccacuuug

SEQ ID NO: 1246185 - RNA, 19 nt, Homo sapiens
gaggagcucgaagcaauug

SEQ ID NO: 1246186 - RNA, 19 nt, Homo sapiens
guucuucauuagacggaaa

SEQ ID NO: 1246187 - RNA, 19 nt, Homo sapiens
cggagaugcugcaggagau

SEQ ID NO: 1246188 - RNA, 19 nt, Homo sapiens
caagaagcagcuagacaca

SEQ ID NO: 1246189 - RNA, 19 nt, Homo sapiens
ucgcaggacaguugugaaa

SEQ ID NO: 1246190 - RNA, 19 nt, Homo sapiens
ccucccagcucccuuagag

SEQ ID NO: 1246191 - RNA, 19 nt, Homo sapiens
caccaccacugaccuaggu

SEQ ID NO: 1246192 - RNA, 19 nt, Homo sapiens
ggcauguucuucauuagac

SEQ ID NO: 1246193 - RNA, 19 nt, Homo sapiens
gcccaggacagccaaacaa

SEQ ID NO: 1246194 - RNA, 19 nt, Homo sapiens
cgagacggcauguucuuca

SEQ ID NO: 1246195 - RNA, 19 nt, Homo sapiens
acaccgagacggcauguuc

SEQ ID NO: 1246196 - RNA, 19 nt, Homo sapiens
cgacuuccacuuugucuac

SEQ ID NO: 1246197 - RNA, 19 nt, Homo sapiens
acgcugagcucugcacaca

SEQ ID NO: 1246198 - RNA, 19 nt, Homo sapiens
ggagauucgcaccaugaug

SEQ ID NO: 1246199 - RNA, 19 nt, Homo sapiens
gagggcaaguccuaauagc

SEQ ID NO: 1246200 - RNA, 19 nt, Homo sapiens
ggagcccaacuuccuguga

SEQ ID NO: 1246201 - RNA, 19 nt, Homo sapiens
ggaggguuccuacuaucug

SEQ ID NO: 1246202 - RNA, 19 nt, Homo sapiens
ugaaggaagccaucaacuc

SEQ ID NO: 1246203 - RNA, 19 nt, Homo sapiens
acggaucucucgacaacug

SEQ ID NO: 1246204 - RNA, 19 nt, Homo sapiens
ggcugagcuuugccaguuu

SEQ ID NO: 1246205 - RNA, 19 nt, Homo sapiens
ggacaguugugaaaauaac

SEQ ID NO: 1246206 - RNA, 19 nt, Homo sapiens
caucaagagcuacgacaag

SEQ ID NO: 1246207 - RNA, 19 nt, Homo sapiens
agucugccuuguacaaaug

SEQ ID NO: 1246208 - RNA, 19 nt, Homo sapiens
gaggguguccuuagaagac

SEQ ID NO: 1246209 - RNA, 19 nt, Homo sapiens
ugcaucagauccacagcaa

SEQ ID NO: 1246210 - RNA, 19 nt, Homo sapiens
ggagaugcugcaggagauu

SEQ ID NO: 1246211 - RNA, 19 nt, Homo sapiens
guguacagccuggagauga

SEQ ID NO: 1246212 - RNA, 19 nt, Homo sapiens
acgcuuuccucuccaacaa

SEQ ID NO: 1246213 - RNA, 19 nt, Homo sapiens
ugaagaagaagcccuccau

SEQ ID NO: 1246214 - RNA, 19 nt, Homo sapiens
caaggagaaccaguuagug

SEQ ID NO: 1246215 - RNA, 19 nt, Homo sapiens
uagagucugccuuguacaa

SEQ ID NO: 1246216 - RNA, 19 nt, Homo sapiens
cugagggcaaguccuaaua

SEQ ID NO: 1246217 - RNA, 19 nt, Homo sapiens
ggagcaaggccaggacaca

SEQ ID NO: 1246218 - RNA, 19 nt, Homo sapiens
guccuuagaagaccaaagu

SEQ ID NO: 1246219 - RNA, 19 nt, Homo sapiens
aucaagagcuacgacaaga

SEQ ID NO: 1246220 - RNA, 19 nt, Homo sapiens
ggcaagaagcagcuagaca

SEQ ID NO: 1246221 - RNA, 19 nt, Homo sapiens
cggcauguucuucauuaga

SEQ ID NO: 1246222 - RNA, 19 nt, Homo sapiens
ccaggacacagaggugaaa

SEQ ID NO: 1246223 - RNA, 19 nt, Homo sapiens
gaaguuccugcagaaguuc

SEQ ID NO: 1246224 - RNA, 19 nt, Homo sapiens
gagcucgaagcaauuguag

SEQ ID NO: 1246225 - RNA, 19 nt, Homo sapiens
uguacagccuggagaugau

SEQ ID NO: 1246226 - RNA, 19 nt, Homo sapiens
cagggugucgguuaagaga

SEQ ID NO: 1246227 - RNA, 19 nt, Homo sapiens
ugccggaggugcccaugau

SEQ ID NO: 1246228 - RNA, 19 nt, Homo sapiens
ggaaaggccuuaugugugu

SEQ ID NO: 1246229 - RNA, 19 nt, Homo sapiens
ugacauauguggcccaaua

SEQ ID NO: 1246230 - RNA, 19 nt, Homo sapiens
gaaauaaucagcuuuguuc

SEQ ID NO: 1246231 - RNA, 19 nt, Homo sapiens
gggaaagccuucacucaaa

SEQ ID NO: 1246232 - RNA, 19 nt, Homo sapiens
gcuaugaccucuuuaaaca

SEQ ID NO: 1246233 - RNA, 19 nt, Homo sapiens
gggaaauucuuuagacaaa

SEQ ID NO: 1246234 - RNA, 19 nt, Homo sapiens
guaaauggcauggaaauaa

SEQ ID NO: 1246235 - RNA, 19 nt, Homo sapiens
ggaaagcaauucugguuca

SEQ ID NO: 1246236 - RNA, 19 nt, Homo sapiens
gcaaugugcugucucuguu

SEQ ID NO: 1246237 - RNA, 19 nt, Homo sapiens
gggaaggccuuuagccaaa

SEQ ID NO: 1246238 - RNA, 19 nt, Homo sapiens
ucacauugcucaugauaau

SEQ ID NO: 1246239 - RNA, 19 nt, Homo sapiens
agccaaagcucccaccuua

SEQ ID NO: 1246240 - RNA, 19 nt, Homo sapiens
ggcccaauauugaaagaua

SEQ ID NO: 1246241 - RNA, 19 nt, Homo sapiens
aaugggagcuucuugauga

SEQ ID NO: 1246242 - RNA, 19 nt, Homo sapiens
ccuuacaccuggcuaaaua

SEQ ID NO: 1246243 - RNA, 19 nt, Homo sapiens
gggcagaccucucuucucu

SEQ ID NO: 1246244 - RNA, 19 nt, Homo sapiens
auacugcguuuaccauuua

SEQ ID NO: 1246245 - RNA, 19 nt, Homo sapiens
gggaaauucuucagccaaa

SEQ ID NO: 1246246 - RNA, 19 nt, Homo sapiens
gcagaaaccauacuugugu

SEQ ID NO: 1246247 - RNA, 19 nt, Homo sapiens
gagaagagcccugggugua

SEQ ID NO: 1246248 - RNA, 19 nt, Homo sapiens
gaagagcccuggguguaug

SEQ ID NO: 1246249 - RNA, 19 nt, Homo sapiens
agacuuaccuguguugauu

SEQ ID NO: 1246250 - RNA, 19 nt, Homo sapiens
agaaaggccuuaugagugu

SEQ ID NO: 1246251 - RNA, 19 nt, Homo sapiens
uggcagagcuggagucuca

SEQ ID NO: 1246252 - RNA, 19 nt, Homo sapiens
gaaacuagagcgaggagaa

SEQ ID NO: 1246253 - RNA, 19 nt, Homo sapiens
ggagaaaggccuuaugagu

SEQ ID NO: 1246254 - RNA, 19 nt, Homo sapiens
ggagaaaggccuuaugagu

SEQ ID NO: 1246255 - RNA, 19 nt, Homo sapiens
gagaagacccucacaugug

SEQ ID NO: 1246256 - RNA, 19 nt, Homo sapiens
ggagaacuuugcacuuuua

SEQ ID NO: 1246257 - RNA, 19 nt, Homo sapiens
ggaaagccuucacucaaag

SEQ ID NO: 1246258 - RNA, 19 nt, Homo sapiens
ggaaauaaucagcuuuguu

SEQ ID NO: 1246259 - RNA, 19 nt, Homo sapiens
gaauucauccggaaacaga

SEQ ID NO: 1246260 - RNA, 19 nt, Homo sapiens
aagcaauucugguucagua

SEQ ID NO: 1246261 - RNA, 19 nt, Homo sapiens
gaguguagcagauguggua

SEQ ID NO: 1246262 - RNA, 19 nt, Homo sapiens
ggacuuagaccugguuguu

SEQ ID NO: 1246263 - RNA, 19 nt, Homo sapiens
cauacugcguuuaccauuu

SEQ ID NO: 1246264 - RNA, 19 nt, Homo sapiens
gcagaugugguaaagcuuu

SEQ ID NO: 1246265 - RNA, 19 nt, Homo sapiens
gagggaaccaucaguaaga

SEQ ID NO: 1246266 - RNA, 19 nt, Homo sapiens
gaaaggccuuaugugugua

SEQ ID NO: 1246267 - RNA, 19 nt, Homo sapiens
aaaguucacucuggagaaa

SEQ ID NO: 1246268 - RNA, 19 nt, Homo sapiens
gaaaggccuuaugagugua

SEQ ID NO: 1246269 - RNA, 19 nt, Homo sapiens
ggaacugccugcuucacau

SEQ ID NO: 1246270 - RNA, 19 nt, Homo sapiens
gcauggaaauaaucagcuu

SEQ ID NO: 1246271 - RNA, 19 nt, Homo sapiens
gaaaguucacucuggagaa

SEQ ID NO: 1246272 - RNA, 19 nt, Homo sapiens
caguaagucuaaucucauu

SEQ ID NO: 1246273 - RNA, 19 nt, Homo sapiens
cagcagugauuaugagugu

SEQ ID NO: 1246274 - RNA, 19 nt, Homo sapiens
ccaaagcucccaccuuaau

SEQ ID NO: 1246275 - RNA, 19 nt, Homo sapiens
ggauguguuuguauacuuc

SEQ ID NO: 1246276 - RNA, 19 nt, Homo sapiens
cuggagaacuuugcacuuu

SEQ ID NO: 1246277 - RNA, 19 nt, Homo sapiens
gaacugccugcuucacauu

SEQ ID NO: 1246278 - RNA, 19 nt, Homo sapiens
gaaggauucugcaaauagc

SEQ ID NO: 1246279 - RNA, 19 nt, Homo sapiens
uugaggauguguuuguaua

SEQ ID NO: 1246280 - RNA, 19 nt, Homo sapiens
ggaaagcgcggaggagaug

SEQ ID NO: 1246281 - RNA, 19 nt, Homo sapiens
ugauguaaauggcauggaa

SEQ ID NO: 1246282 - RNA, 19 nt, Homo sapiens
ccaaguaugugagaugcuu

SEQ ID NO: 1246283 - RNA, 19 nt, Homo sapiens
gggaaagucuuaggccaau

SEQ ID NO: 1246284 - RNA, 19 nt, Homo sapiens
aauguacacuggagaauuc

SEQ ID NO: 1246285 - RNA, 19 nt, Homo sapiens
ggccuuauguguguaguga

SEQ ID NO: 1246286 - RNA, 19 nt, Homo sapiens
gauuaugaguguagcagau

SEQ ID NO: 1246287 - RNA, 19 nt, Homo sapiens
gcuggagucucacccaugu

SEQ ID NO: 1246288 - RNA, 19 nt, Homo sapiens
ggucuuaauuuccucucuu

SEQ ID NO: 1246289 - RNA, 19 nt, Homo sapiens
ggugaaagacucuaucagu

SEQ ID NO: 1246290 - RNA, 19 nt, Homo sapiens
gggagggaaccaucaguaa

SEQ ID NO: 1246291 - RNA, 19 nt, Homo sapiens
gaaagaguucagucggaaa

SEQ ID NO: 1246292 - RNA, 19 nt, Homo sapiens
ggcauggaguggaggauga

SEQ ID NO: 1246293 - RNA, 19 nt, Homo sapiens
cccaacagcucacccuaga

SEQ ID NO: 1246294 - RNA, 19 nt, Homo sapiens
gagaauucauccggaaaca

SEQ ID NO: 1246295 - RNA, 19 nt, Homo sapiens
uuaccuguguugauugauu

SEQ ID NO: 1246296 - RNA, 19 nt, Homo sapiens
guuaaugagugcagcagau

SEQ ID NO: 1246297 - RNA, 19 nt, Homo sapiens
ggagccaggccuuauguau

SEQ ID NO: 1246298 - RNA, 19 nt, Homo sapiens
cagagaagacccucacaug

SEQ ID NO: 1246299 - RNA, 19 nt, Homo sapiens
cagaucacgugcagucaug

SEQ ID NO: 1246300 - RNA, 19 nt, Homo sapiens
gaaugggagcuucuugaug

SEQ ID NO: 1246301 - RNA, 19 nt, Homo sapiens
caacagcucacccuagagu

SEQ ID NO: 1246302 - RNA, 19 nt, Homo sapiens
ucaaagacccaaccucauc

SEQ ID NO: 1246303 - RNA, 19 nt, Homo sapiens
gagccaggccuuauguaug

SEQ ID NO: 1246304 - RNA, 19 nt, Homo sapiens
ugaaagacucuaucagugu

SEQ ID NO: 1246305 - RNA, 19 nt, Homo sapiens
gaugcucguuauggauaua

SEQ ID NO: 1246306 - RNA, 19 nt, Homo sapiens
gaaagccuucacucaaaga

SEQ ID NO: 1246307 - RNA, 19 nt, Homo sapiens
uagcagaugugguaaagcu

SEQ ID NO: 1246308 - RNA, 19 nt, Homo sapiens
uuaagaguguagcaaaugu

SEQ ID NO: 1246309 - RNA, 19 nt, Homo sapiens
uaccuguguugauugauuu

SEQ ID NO: 1246310 - RNA, 19 nt, Homo sapiens
caaauagccugcggagacu

SEQ ID NO: 1246311 - RNA, 19 nt, Homo sapiens
gaggguucaugcuggagaa

SEQ ID NO: 1246312 - RNA, 19 nt, Homo sapiens
ggucuuugaggauguguuu

SEQ ID NO: 1246313 - RNA, 19 nt, Homo sapiens
gaugaugcucagagacuuu

SEQ ID NO: 1246314 - RNA, 19 nt, Homo sapiens
gcucccaccuuaauguaca

SEQ ID NO: 1246315 - RNA, 19 nt, Homo sapiens
uuucauaugaugcucguua

SEQ ID NO: 1246316 - RNA, 19 nt, Homo sapiens
auaaucagcuuuguucaag

SEQ ID NO: 1246317 - RNA, 19 nt, Homo sapiens
gucuuaauuuccucucuuu

SEQ ID NO: 1246318 - RNA, 19 nt, Homo sapiens
ggaaccaucaguaagaagu

SEQ ID NO: 1246319 - RNA, 19 nt, Homo sapiens
gaaaagcuuuaagagugua

SEQ ID NO: 1246320 - RNA, 19 nt, Homo sapiens
gagagaauucauccggaaa

SEQ ID NO: 1246321 - RNA, 19 nt, Homo sapiens
ggaaauucuucagccaaag

SEQ ID NO: 1246322 - RNA, 19 nt, Homo sapiens
guggaaagcaauucugguu

SEQ ID NO: 1246323 - RNA, 19 nt, Homo sapiens
aguggaggaugaagaggua

SEQ ID NO: 1246324 - RNA, 19 nt, Homo sapiens
caaagacccaaccucauca

SEQ ID NO: 1246325 - RNA, 19 nt, Homo sapiens
gcagugauuaugaguguag

SEQ ID NO: 1246326 - RNA, 19 nt, Homo sapiens
gaacucacacuggagaaag

SEQ ID NO: 1246327 - RNA, 19 nt, Homo sapiens
gcaguaagucuaaucucau

SEQ ID NO: 1246328 - RNA, 19 nt, Homo sapiens
gaacacuuguaucgaauua

SEQ ID NO: 1246329 - RNA, 19 nt, Homo sapiens
gacaaucuaucucugaaua

SEQ ID NO: 1246330 - RNA, 19 nt, Homo sapiens
gaaauucuguacugucauu

SEQ ID NO: 1246331 - RNA, 19 nt, Homo sapiens
gaacaugaaccauuugaaa

SEQ ID NO: 1246332 - RNA, 19 nt, Homo sapiens
gaagaugacuuuguggaaa

SEQ ID NO: 1246333 - RNA, 19 nt, Homo sapiens
gaagaagguuguugcaguu

SEQ ID NO: 1246334 - RNA, 19 nt, Homo sapiens
gaaauuucguugcaugauu

SEQ ID NO: 1246335 - RNA, 19 nt, Homo sapiens
acaaagcugugcccaaaua

SEQ ID NO: 1246336 - RNA, 19 nt, Homo sapiens
ggcagaagguggauuauga

SEQ ID NO: 1246337 - RNA, 19 nt, Homo sapiens
gagaauucaugugaucuua

SEQ ID NO: 1246338 - RNA, 19 nt, Homo sapiens
acuauaagguugccaauuu

SEQ ID NO: 1246339 - RNA, 19 nt, Homo sapiens
gaacuugucuucuccuuuu

SEQ ID NO: 1246340 - RNA, 19 nt, Homo sapiens
uagagaacaugaaccauuu

SEQ ID NO: 1246341 - RNA, 19 nt, Homo sapiens
gauuuaaacucuccacgaa

SEQ ID NO: 1246342 - RNA, 19 nt, Homo sapiens
cuacaaagcugugcccaaa

SEQ ID NO: 1246343 - RNA, 19 nt, Homo sapiens
ugagagagcugaacugaag

SEQ ID NO: 1246344 - RNA, 19 nt, Homo sapiens
gaauuccccugcaauauua

SEQ ID NO: 1246345 - RNA, 19 nt, Homo sapiens
cgaauugucuccagucaga

SEQ ID NO: 1246346 - RNA, 19 nt, Homo sapiens
caaccagaaucuucagaaa

SEQ ID NO: 1246347 - RNA, 19 nt, Homo sapiens
cuauaagguugccaauuua

SEQ ID NO: 1246348 - RNA, 19 nt, Homo sapiens
ucagaaagguuaggacauu

SEQ ID NO: 1246349 - RNA, 19 nt, Homo sapiens
caaguaauccgaauaaauc

SEQ ID NO: 1246350 - RNA, 19 nt, Homo sapiens
cagcaauacuucccuugua

SEQ ID NO: 1246351 - RNA, 19 nt, Homo sapiens
caagaggaguuaugaagau

SEQ ID NO: 1246352 - RNA, 19 nt, Homo sapiens
caccaaacauggaggagua

SEQ ID NO: 1246353 - RNA, 19 nt, Homo sapiens
gaucuuagcccagaaguug

SEQ ID NO: 1246354 - RNA, 19 nt, Homo sapiens
ggaauagagugcagugcuu

SEQ ID NO: 1246355 - RNA, 19 nt, Homo sapiens
ccaaggcaguugaagauga

SEQ ID NO: 1246356 - RNA, 19 nt, Homo sapiens
cgaaauaccacuuuggaaa

SEQ ID NO: 1246357 - RNA, 19 nt, Homo sapiens
caucucaucuccacaguau

SEQ ID NO: 1246358 - RNA, 19 nt, Homo sapiens
aagcacauguucuucauuu

SEQ ID NO: 1246359 - RNA, 19 nt, Homo sapiens
gaaacagggucagccuuga

SEQ ID NO: 1246360 - RNA, 19 nt, Homo sapiens
acaguuaacuugagugguu

SEQ ID NO: 1246361 - RNA, 19 nt, Homo sapiens
ggaaugcugugcuacaaag

SEQ ID NO: 1246362 - RNA, 19 nt, Homo sapiens
acagaacacuuguaucgaa

SEQ ID NO: 1246363 - RNA, 19 nt, Homo sapiens
aaaccaagcucgagucagu

SEQ ID NO: 1246364 - RNA, 19 nt, Homo sapiens
gaacuuugccuucuuaaaa

SEQ ID NO: 1246365 - RNA, 19 nt, Homo sapiens
ggaauucauuguaccuaau

SEQ ID NO: 1246366 - RNA, 19 nt, Homo sapiens
cagaaagguuaggacauua

SEQ ID NO: 1246367 - RNA, 19 nt, Homo sapiens
gaagguuguugcaguuuca

SEQ ID NO: 1246368 - RNA, 19 nt, Homo sapiens
gauauucaguaaggacuuu

SEQ ID NO: 1246369 - RNA, 19 nt, Homo sapiens
ggcaaacuguagccacaua

SEQ ID NO: 1246370 - RNA, 19 nt, Homo sapiens
gaaauaaccaaggcaguug

SEQ ID NO: 1246371 - RNA, 19 nt, Homo sapiens
gcagaugacuauagagaac

SEQ ID NO: 1246372 - RNA, 19 nt, Homo sapiens
gaaaugcugaaaugaagaa

SEQ ID NO: 1246373 - RNA, 19 nt, Homo sapiens
gcugaacucucugaacuug

SEQ ID NO: 1246374 - RNA, 19 nt, Homo sapiens
gagcaaaguacauuaguca

SEQ ID NO: 1246375 - RNA, 19 nt, Homo sapiens
cauuguaccuaauaacuga

SEQ ID NO: 1246376 - RNA, 19 nt, Homo sapiens
ucauugaguugcuuugauu

SEQ ID NO: 1246377 - RNA, 19 nt, Homo sapiens
gaauaguaccuucacagaa

SEQ ID NO: 1246378 - RNA, 19 nt, Homo sapiens
ggaauaguaccuucacaga

SEQ ID NO: 1246379 - RNA, 19 nt, Homo sapiens
caaguuucauguccgaauu

SEQ ID NO: 1246380 - RNA, 19 nt, Homo sapiens
ggcaacagcugaacucucu

SEQ ID NO: 1246381 - RNA, 19 nt, Homo sapiens
gcagaaagaccaacaugca

SEQ ID NO: 1246382 - RNA, 19 nt, Homo sapiens
gaaaggacaaucuaucucu

SEQ ID NO: 1246383 - RNA, 19 nt, Homo sapiens
gaagguuuaugaagauugg

SEQ ID NO: 1246384 - RNA, 19 nt, Homo sapiens
gcagaaaaguucccuugaa

SEQ ID NO: 1246385 - RNA, 19 nt, Homo sapiens
gacuagaccuuccuuaaac

SEQ ID NO: 1246386 - RNA, 19 nt, Homo sapiens
gauguaauaccuaugaaga

SEQ ID NO: 1246387 - RNA, 19 nt, Homo sapiens
gaaaccaagacacuacauu

SEQ ID NO: 1246388 - RNA, 19 nt, Homo sapiens
gaaauucauuccccacaaa

SEQ ID NO: 1246389 - RNA, 19 nt, Homo sapiens
caacacaucaacccauuau

SEQ ID NO: 1246390 - RNA, 19 nt, Homo sapiens
gggauuguuucaaaguaaa

SEQ ID NO: 1246391 - RNA, 19 nt, Homo sapiens
aaagaagccuauguuaaug

SEQ ID NO: 1246392 - RNA, 19 nt, Homo sapiens
gugccaauguaacuuguaa

SEQ ID NO: 1246393 - RNA, 19 nt, Homo sapiens
gagaagaaaguaauugagu

SEQ ID NO: 1246394 - RNA, 19 nt, Homo sapiens
ccuauaaggccuaaauuga

SEQ ID NO: 1246395 - RNA, 19 nt, Homo sapiens
acacaucaacccauuauug

SEQ ID NO: 1246396 - RNA, 19 nt, Homo sapiens
ugaagaugaugacgauaug

SEQ ID NO: 1246397 - RNA, 19 nt, Homo sapiens
agacagacuuucuauugug

SEQ ID NO: 1246398 - RNA, 19 nt, Homo sapiens
gcaguaccuugggcuguuu

SEQ ID NO: 1246399 - RNA, 19 nt, Homo sapiens
gaaaaguucccuugaaaga

SEQ ID NO: 1246400 - RNA, 19 nt, Homo sapiens
cuucggauuucuuauguuu

SEQ ID NO: 1246401 - RNA, 19 nt, Homo sapiens
gaaaugaagaagguuguug

SEQ ID NO: 1246402 - RNA, 19 nt, Homo sapiens
uaacaaagaggagagcaaa

SEQ ID NO: 1246403 - RNA, 19 nt, Homo sapiens
gcaacacaucaacccauua

SEQ ID NO: 1246404 - RNA, 19 nt, Homo sapiens
gcccagaaguugcaacaca

SEQ ID NO: 1246405 - RNA, 19 nt, Homo sapiens
agauugggauuguuucaaa

SEQ ID NO: 1246406 - RNA, 19 nt, Homo sapiens
caugugaucuguguggaaa

SEQ ID NO: 1246407 - RNA, 19 nt, Homo sapiens
ccaaguaauccgaauaaau

SEQ ID NO: 1246408 - RNA, 19 nt, Homo sapiens
ggaguuaugaagaugauga

SEQ ID NO: 1246409 - RNA, 19 nt, Homo sapiens
gaucagcuaacaucugcua

SEQ ID NO: 1246410 - RNA, 19 nt, Homo sapiens
gaacgauggcugagagcaa

SEQ ID NO: 1246411 - RNA, 19 nt, Homo sapiens
cagcugaacucucugaacu

SEQ ID NO: 1246412 - RNA, 19 nt, Homo sapiens
cagaaaaguucccuugaaa

SEQ ID NO: 1246413 - RNA, 19 nt, Homo sapiens
agacuagaccuuccuuaaa

SEQ ID NO: 1246414 - RNA, 19 nt, Homo sapiens
gcccaaauaugaaaacaaa

SEQ ID NO: 1246415 - RNA, 19 nt, Homo sapiens
gaaaucaagccugguaaca

SEQ ID NO: 1246416 - RNA, 19 nt, Homo sapiens
gggagaagaaaguaauuga

SEQ ID NO: 1246417 - RNA, 19 nt, Homo sapiens
gugcugaguauacugaaua

SEQ ID NO: 1246418 - RNA, 19 nt, Homo sapiens
guuuguugcucuaacguaa

SEQ ID NO: 1246419 - RNA, 19 nt, Homo sapiens
gcaaccagaaucuucagaa

SEQ ID NO: 1246420 - RNA, 19 nt, Homo sapiens
gaggcguacuugccauuga

SEQ ID NO: 1246421 - RNA, 19 nt, Homo sapiens
uugauaauguugcugauug

SEQ ID NO: 1246422 - RNA, 19 nt, Homo sapiens
gcaaacuguagccacauaa

SEQ ID NO: 1246423 - RNA, 19 nt, Homo sapiens
cacaguauauacaagaaga

SEQ ID NO: 1246424 - RNA, 19 nt, Homo sapiens
aggaaaagcugaaggaaaa

SEQ ID NO: 1246425 - RNA, 19 nt, Homo sapiens
uggaggagguggugcaaga

SEQ ID NO: 1246426 - RNA, 19 nt, Homo sapiens
ugaaauuguuaaccaagga

SEQ ID NO: 1246427 - RNA, 19 nt, Homo sapiens
cuauaaggccuaaauugaa

SEQ ID NO: 1246428 - RNA, 19 nt, Homo sapiens
gaaacagacuucauagaaa

SEQ ID NO: 1246429 - RNA, 19 nt, Homo sapiens
guacauggguccaaacuaa

SEQ ID NO: 1246430 - RNA, 19 nt, Homo sapiens
cgagagaccucaggaaaua

SEQ ID NO: 1246431 - RNA, 19 nt, Homo sapiens
uaagagaacucaagcaaga

SEQ ID NO: 1246432 - RNA, 19 nt, Homo sapiens
gcaagauacugaaauguga

SEQ ID NO: 1246433 - RNA, 19 nt, Homo sapiens
ggaaacagacuucauagaa

SEQ ID NO: 1246434 - RNA, 19 nt, Homo sapiens
gaacuaaugucgcaggaau

SEQ ID NO: 1246435 - RNA, 19 nt, Homo sapiens
acaaugagcugaauauaug

SEQ ID NO: 1246436 - RNA, 19 nt, Homo sapiens
gaacuugacugcagcaaag

SEQ ID NO: 1246437 - RNA, 19 nt, Homo sapiens
agauauagcucaagaagaa

SEQ ID NO: 1246438 - RNA, 19 nt, Homo sapiens
gcaacaggaucuaaguauu

SEQ ID NO: 1246439 - RNA, 19 nt, Homo sapiens
gaauaauggugcacagcua

SEQ ID NO: 1246440 - RNA, 19 nt, Homo sapiens
gaaauaccaugcacacagu

SEQ ID NO: 1246441 - RNA, 19 nt, Homo sapiens
gcacugaaggcauuuguaa

SEQ ID NO: 1246442 - RNA, 19 nt, Homo sapiens
gaaggcauuuguaaucaug

SEQ ID NO: 1246443 - RNA, 19 nt, Homo sapiens
guacagaaaugacaaugag

SEQ ID NO: 1246444 - RNA, 19 nt, Homo sapiens
gaagagaaaggcaugcaaa

SEQ ID NO: 1246445 - RNA, 19 nt, Homo sapiens
uaauaaauacugccgguua

SEQ ID NO: 1246446 - RNA, 19 nt, Homo sapiens
ggugaugacucuuguguuc

SEQ ID NO: 1246447 - RNA, 19 nt, Homo sapiens
caauagauauagcucaaga

SEQ ID NO: 1246448 - RNA, 19 nt, Homo sapiens
gacaauagauauagcucaa

SEQ ID NO: 1246449 - RNA, 19 nt, Homo sapiens
gacagcaucugaaggagaa

SEQ ID NO: 1246450 - RNA, 19 nt, Homo sapiens
ggaaaucuuuaucucacaa

SEQ ID NO: 1246451 - RNA, 19 nt, Homo sapiens
caacaggaucuaaguauug

SEQ ID NO: 1246452 - RNA, 19 nt, Homo sapiens
ucaaugugauucuuucuug

SEQ ID NO: 1246453 - RNA, 19 nt, Homo sapiens
gacaacggcuggagcaaau

SEQ ID NO: 1246454 - RNA, 19 nt, Homo sapiens
gaaaugacaaugagcugaa

SEQ ID NO: 1246455 - RNA, 19 nt, Homo sapiens
ggaaugcagggaugaagua

SEQ ID NO: 1246456 - RNA, 19 nt, Homo sapiens
guaagaagaauaagagaug

SEQ ID NO: 1246457 - RNA, 19 nt, Homo sapiens
gugcacagcuaaagcaguu

SEQ ID NO: 1246458 - RNA, 19 nt, Homo sapiens
gaaacacucacgaugacua

SEQ ID NO: 1246459 - RNA, 19 nt, Homo sapiens
caaagaggaugauggugau

SEQ ID NO: 1246460 - RNA, 19 nt, Homo sapiens
gcaaagacaauagauauag

SEQ ID NO: 1246461 - RNA, 19 nt, Homo sapiens
caguugcacuccuuagaua

SEQ ID NO: 1246462 - RNA, 19 nt, Homo sapiens
gacaaugagcugaauauau

SEQ ID NO: 1246463 - RNA, 19 nt, Homo sapiens
gcuugggaauucaucuuua

SEQ ID NO: 1246464 - RNA, 19 nt, Homo sapiens
caacggcuggagcaaauua

SEQ ID NO: 1246465 - RNA, 19 nt, Homo sapiens
aaagcaagauacugaaaug

SEQ ID NO: 1246466 - RNA, 19 nt, Homo sapiens
aauaaauacugccgguuaa

SEQ ID NO: 1246467 - RNA, 19 nt, Homo sapiens
gagcauacaauauccuuau

SEQ ID NO: 1246468 - RNA, 19 nt, Homo sapiens
ugacgauggugauggaauu

SEQ ID NO: 1246469 - RNA, 19 nt, Homo sapiens
aaauagcucugucuuucaa

SEQ ID NO: 1246470 - RNA, 19 nt, Homo sapiens
gaucacaagaggcccauuu

SEQ ID NO: 1246471 - RNA, 19 nt, Homo sapiens
gauuguggauauucaucua

SEQ ID NO: 1246472 - RNA, 19 nt, Homo sapiens
gcaggagggcgaagagaaa

SEQ ID NO: 1246473 - RNA, 19 nt, Homo sapiens
gaauaagagaugucaguug

SEQ ID NO: 1246474 - RNA, 19 nt, Homo sapiens
uaaaauagcucugucuuuc

SEQ ID NO: 1246475 - RNA, 19 nt, Homo sapiens
gaaaauagcagcugcaaag

SEQ ID NO: 1246476 - RNA, 19 nt, Homo sapiens
ggaaguaagccaagagaag

SEQ ID NO: 1246477 - RNA, 19 nt, Homo sapiens
ugauauuccuacucccuua

SEQ ID NO: 1246478 - RNA, 19 nt, Homo sapiens
guaacuagaagcugcauga

SEQ ID NO: 1246479 - RNA, 19 nt, Homo sapiens
caucugaaggagaaauuua

SEQ ID NO: 1246480 - RNA, 19 nt, Homo sapiens
ggugauaguuguguugaau

SEQ ID NO: 1246481 - RNA, 19 nt, Homo sapiens
gauguugccugcacugaag

SEQ ID NO: 1246482 - RNA, 19 nt, Homo sapiens
cuaauaaccagucuuucua

SEQ ID NO: 1246483 - RNA, 19 nt, Homo sapiens
gccaagagcuuaguugaac

SEQ ID NO: 1246484 - RNA, 19 nt, Homo sapiens
cuacagcaauagagaacaa

SEQ ID NO: 1246485 - RNA, 19 nt, Homo sapiens
ggaguccugucuguaacua

SEQ ID NO: 1246486 - RNA, 19 nt, Homo sapiens
aaagauacacauccugaaa

SEQ ID NO: 1246487 - RNA, 19 nt, Homo sapiens
gaaagacugcaucgaaucu

SEQ ID NO: 1246488 - RNA, 19 nt, Homo sapiens
auacauguuugcugugaaa

SEQ ID NO: 1246489 - RNA, 19 nt, Homo sapiens
ccaagggaguccugucugu

SEQ ID NO: 1246490 - RNA, 19 nt, Homo sapiens
guagacauccacuugcaaa

SEQ ID NO: 1246491 - RNA, 19 nt, Homo sapiens
ggcuggagcaaauuaaaua

SEQ ID NO: 1246492 - RNA, 19 nt, Homo sapiens
gcuaauaaccagucuuucu

SEQ ID NO: 1246493 - RNA, 19 nt, Homo sapiens
ucuccacacuguaauggua

SEQ ID NO: 1246494 - RNA, 19 nt, Homo sapiens
uaugaaagacugcaucgaa

SEQ ID NO: 1246495 - RNA, 19 nt, Homo sapiens
agaaaggcaugcaaagaca

SEQ ID NO: 1246496 - RNA, 19 nt, Homo sapiens
gaugucaguugcacuccuu

SEQ ID NO: 1246497 - RNA, 19 nt, Homo sapiens
uguaguggcugguugacaa

SEQ ID NO: 1246498 - RNA, 19 nt, Homo sapiens
ggauguaugggaacuaaug

SEQ ID NO: 1246499 - RNA, 19 nt, Homo sapiens
cuaaaugacaugauagaug

SEQ ID NO: 1246500 - RNA, 19 nt, Homo sapiens
ugauuuaagccaucucuuu

SEQ ID NO: 1246501 - RNA, 19 nt, Homo sapiens
gaagggagugaaacagguu

SEQ ID NO: 1246502 - RNA, 19 nt, Homo sapiens
ucauguaccuguccuagca

SEQ ID NO: 1246503 - RNA, 19 nt, Homo sapiens
gguaauacuuguguagaag

SEQ ID NO: 1246504 - RNA, 19 nt, Homo sapiens
gagaaaggcaugcaaagac

SEQ ID NO: 1246505 - RNA, 19 nt, Homo sapiens
ggaugauggugauaguugu

SEQ ID NO: 1246506 - RNA, 19 nt, Homo sapiens
aggcuuaucuccacacugu

SEQ ID NO: 1246507 - RNA, 19 nt, Homo sapiens
gccaagagaaggaaacaga

SEQ ID NO: 1246508 - RNA, 19 nt, Homo sapiens
aaacauaucugcgaaaaca

SEQ ID NO: 1246509 - RNA, 19 nt, Homo sapiens
gguccaaacuaaaugacau

SEQ ID NO: 1246510 - RNA, 19 nt, Homo sapiens
gugaugaacauauccagaa

SEQ ID NO: 1246511 - RNA, 19 nt, Homo sapiens
gcuuaucuccacacuguaa

SEQ ID NO: 1246512 - RNA, 19 nt, Homo sapiens
cagcuugucccauguguug

SEQ ID NO: 1246513 - RNA, 19 nt, Homo sapiens
uuuagugacuuauggcaaa

SEQ ID NO: 1246514 - RNA, 19 nt, Homo sapiens
gguagugauuguggauauu

SEQ ID NO: 1246515 - RNA, 19 nt, Homo sapiens
uuaauugacucgaguuguc

SEQ ID NO: 1246516 - RNA, 19 nt, Homo sapiens
uggaaauccugcucuugaa

SEQ ID NO: 1246517 - RNA, 19 nt, Homo sapiens
ccucauuaguucuuucuuc

SEQ ID NO: 1246518 - RNA, 19 nt, Homo sapiens
auaguuguguugaauguug

SEQ ID NO: 1246519 - RNA, 19 nt, Homo sapiens
gaagaugguaauacuugug

SEQ ID NO: 1246520 - RNA, 19 nt, Homo sapiens
gaaaggcaugcaaagacaa

SEQ ID NO: 1246521 - RNA, 19 nt, Homo sapiens
augcagggaugaaguaguu

SEQ ID NO: 1246522 - RNA, 19 nt, Homo sapiens
ucuucaggcuugugucuuu

SEQ ID NO: 1246523 - RNA, 19 nt, Homo sapiens
gggagacgguggagguauc

SEQ ID NO: 1246524 - RNA, 19 nt, Homo sapiens
ugauaguuguguugaaugu

SEQ ID NO: 1246525 - RNA, 19 nt, Homo sapiens
caaagacaauagauauagc

SEQ ID NO: 1246526 - RNA, 19 nt, Homo sapiens
gcggugcuguccacaugaa

SEQ ID NO: 1246527 - RNA, 19 nt, Homo sapiens
auaaaguccuccgagcaua

SEQ ID NO: 1246528 - RNA, 19 nt, Homo sapiens
gcucauggcuagugaaaua

SEQ ID NO: 1246529 - RNA, 19 nt, Homo sapiens
gcacugcccucgucuuuga

SEQ ID NO: 1246530 - RNA, 19 nt, Homo sapiens
gcaagcaccuauauaguau

SEQ ID NO: 1246531 - RNA, 19 nt, Homo sapiens
ggaaggaaaugcacaucuu

SEQ ID NO: 1246532 - RNA, 19 nt, Homo sapiens
gaaggaaaugcacaucuua

SEQ ID NO: 1246533 - RNA, 19 nt, Homo sapiens
gauguggccuccuaccuuu

SEQ ID NO: 1246534 - RNA, 19 nt, Homo sapiens
gagaagaacccugaaauca

SEQ ID NO: 1246535 - RNA, 19 nt, Homo sapiens
ggcaagcaccuauauagua

SEQ ID NO: 1246536 - RNA, 19 nt, Homo sapiens
ggcaagagcuucugcuaca

SEQ ID NO: 1246537 - RNA, 19 nt, Homo sapiens
ccuccuaccuuuccaguuu

SEQ ID NO: 1246538 - RNA, 19 nt, Homo sapiens
ggagagggcaggauggaaa

SEQ ID NO: 1246539 - RNA, 19 nt, Homo sapiens
gcucggaccucaccaagca

SEQ ID NO: 1246540 - RNA, 19 nt, Homo sapiens
acucguagauggagauuug

SEQ ID NO: 1246541 - RNA, 19 nt, Homo sapiens
gcccacaucuucuccuuuc

SEQ ID NO: 1246542 - RNA, 19 nt, Homo sapiens
gggagaaacccuucaagug

SEQ ID NO: 1246543 - RNA, 19 nt, Homo sapiens
guacgcauguggcgacugu

SEQ ID NO: 1246544 - RNA, 19 nt, Homo sapiens
ucucugguguuucugauuu

SEQ ID NO: 1246545 - RNA, 19 nt, Homo sapiens
gccaugcuguccucguaua

SEQ ID NO: 1246546 - RNA, 19 nt, Homo sapiens
gagcgugccuugggacuca

SEQ ID NO: 1246547 - RNA, 19 nt, Homo sapiens
aacaugagguuauuuccaa

SEQ ID NO: 1246548 - RNA, 19 nt, Homo sapiens
gaacaugagguuauuucca

SEQ ID NO: 1246549 - RNA, 19 nt, Homo sapiens
gaaggaugucuccaugcua

SEQ ID NO: 1246550 - RNA, 19 nt, Homo sapiens
gacucuugguucccuguua

SEQ ID NO: 1246551 - RNA, 19 nt, Homo sapiens
ggcaagugcuuuggcaaga

SEQ ID NO: 1246552 - RNA, 19 nt, Homo sapiens
guggcacgcuucccuguga

SEQ ID NO: 1246553 - RNA, 19 nt, Homo sapiens
ugagaaauguggguaugga

SEQ ID NO: 1246554 - RNA, 19 nt, Homo sapiens
gugugucccuuuaaugcua

SEQ ID NO: 1246555 - RNA, 19 nt, Homo sapiens
gaacccguccucaccaugu

SEQ ID NO: 1246556 - RNA, 19 nt, Homo sapiens
gaaagcucacuuccaugaa

SEQ ID NO: 1246557 - RNA, 19 nt, Homo sapiens
gguaauggucacagauuug

SEQ ID NO: 1246558 - RNA, 19 nt, Homo sapiens
guguuggugugucccuuua

SEQ ID NO: 1246559 - RNA, 19 nt, Homo sapiens
cagaagagagacuugaaga

SEQ ID NO: 1246560 - RNA, 19 nt, Homo sapiens
guacagaagagagacuuga

SEQ ID NO: 1246561 - RNA, 19 nt, Homo sapiens
guuggcagcccuucacgua

SEQ ID NO: 1246562 - RNA, 19 nt, Homo sapiens
ccgcuuccguugccuagaa

SEQ ID NO: 1246563 - RNA, 19 nt, Homo sapiens
ggaaaugcacaucuuacuc

SEQ ID NO: 1246564 - RNA, 19 nt, Homo sapiens
gcacacacacgggcgagaa

SEQ ID NO: 1246565 - RNA, 19 nt, Homo sapiens
ccaaguggaacaugagguu

SEQ ID NO: 1246566 - RNA, 19 nt, Homo sapiens
gccacaagccacacaaaug

SEQ ID NO: 1246567 - RNA, 19 nt, Homo sapiens
uuuauucugucuucucuug

SEQ ID NO: 1246568 - RNA, 19 nt, Homo sapiens
acucuugguucccuguuaa

SEQ ID NO: 1246569 - RNA, 19 nt, Homo sapiens
cuccuuuccugauuacuuu

SEQ ID NO: 1246570 - RNA, 19 nt, Homo sapiens
ucucuuguccuaucucauu

SEQ ID NO: 1246571 - RNA, 19 nt, Homo sapiens
aagcaccuauauaguauca

SEQ ID NO: 1246572 - RNA, 19 nt, Homo sapiens
gcaagugcuuuggcaagag

SEQ ID NO: 1246573 - RNA, 19 nt, Homo sapiens
ggccagacccucuacaucu

SEQ ID NO: 1246574 - RNA, 19 nt, Homo sapiens
caaguggaacaugagguua

SEQ ID NO: 1246575 - RNA, 19 nt, Homo sapiens
aagacgauguggccuccua

SEQ ID NO: 1246576 - RNA, 19 nt, Homo sapiens
ccacaagccacacaaaugc

SEQ ID NO: 1246577 - RNA, 19 nt, Homo sapiens
ccacaugcgugcgccacuu

SEQ ID NO: 1246578 - RNA, 19 nt, Homo sapiens
ugaaggaugucuccaugcu

SEQ ID NO: 1246579 - RNA, 19 nt, Homo sapiens
ggcgaccgguuuccacuuc

SEQ ID NO: 1246580 - RNA, 19 nt, Homo sapiens
guuggugugucccuuuaau

SEQ ID NO: 1246581 - RNA, 19 nt, Homo sapiens
gagaagccguacgcaugug

SEQ ID NO: 1246582 - RNA, 19 nt, Homo sapiens
uagagaagaacccugaaau

SEQ ID NO: 1246583 - RNA, 19 nt, Homo sapiens
agguaauggucacagauuu

SEQ ID NO: 1246584 - RNA, 19 nt, Homo sapiens
ugucuucucuuguccuauc

SEQ ID NO: 1246585 - RNA, 19 nt, Homo sapiens
gggcaagcaccuauauagu

SEQ ID NO: 1246586 - RNA, 19 nt, Homo sapiens
gcugaggcuucucuaaagg

SEQ ID NO: 1246587 - RNA, 19 nt, Homo sapiens
gguucucuguguccuaguu

SEQ ID NO: 1246588 - RNA, 19 nt, Homo sapiens
cgagaagccguacgcaugu

SEQ ID NO: 1246589 - RNA, 19 nt, Homo sapiens
ggaggugggugggaaagcu

SEQ ID NO: 1246590 - RNA, 19 nt, Homo sapiens
cagguaauggucacagauu

SEQ ID NO: 1246591 - RNA, 19 nt, Homo sapiens
cuacuccgcauccguaaug

SEQ ID NO: 1246592 - RNA, 19 nt, Homo sapiens
gauucucuccucaggugua

SEQ ID NO: 1246593 - RNA, 19 nt, Homo sapiens
cauccguaauggaaggaaa

SEQ ID NO: 1246594 - RNA, 19 nt, Homo sapiens
gcaagagcuucugcuacag

SEQ ID NO: 1246595 - RNA, 19 nt, Homo sapiens
cgaccgguuuccacuucaa

SEQ ID NO: 1246596 - RNA, 19 nt, Homo sapiens
acugugcucucugguguuu

SEQ ID NO: 1246597 - RNA, 19 nt, Homo sapiens
ugcaagagcccagguguug

SEQ ID NO: 1246598 - RNA, 19 nt, Homo sapiens
ccuguuaacucuguuucug

SEQ ID NO: 1246599 - RNA, 19 nt, Homo sapiens
cagcccacaucuucuccuu

SEQ ID NO: 1246600 - RNA, 19 nt, Homo sapiens
uugccaugcuguccucgua

SEQ ID NO: 1246601 - RNA, 19 nt, Homo sapiens
cgauguggccuccuaccuu

SEQ ID NO: 1246602 - RNA, 19 nt, Homo sapiens
aagccaggguucucugugu

SEQ ID NO: 1246603 - RNA, 19 nt, Homo sapiens
agagaagaacccugaaauc

SEQ ID NO: 1246604 - RNA, 19 nt, Homo sapiens
acaugagguuauuuccaaa

SEQ ID NO: 1246605 - RNA, 19 nt, Homo sapiens
ggccacaagccacacaaau

SEQ ID NO: 1246606 - RNA, 19 nt, Homo sapiens
gcuagugaaauaaaguugu

SEQ ID NO: 1246607 - RNA, 19 nt, Homo sapiens
aguggaacaugagguuauu

SEQ ID NO: 1246608 - RNA, 19 nt, Homo sapiens
ucuucuccuuuccugauua

SEQ ID NO: 1246609 - RNA, 19 nt, Homo sapiens
caucuucuccuuuccugau

SEQ ID NO: 1246610 - RNA, 19 nt, Homo sapiens
uuuccugccuuuauucugu

SEQ ID NO: 1246611 - RNA, 19 nt, Homo sapiens
caagagcccagguguuggu

SEQ ID NO: 1246612 - RNA, 19 nt, Homo sapiens
gaauguggcaagagcuucu

SEQ ID NO: 1246613 - RNA, 19 nt, Homo sapiens
gcgaauguggcaagagcuu

SEQ ID NO: 1246614 - RNA, 19 nt, Homo sapiens
ucugagaaauguggguaug

SEQ ID NO: 1246615 - RNA, 19 nt, Homo sapiens
gcucucugguguuucugau

SEQ ID NO: 1246616 - RNA, 19 nt, Homo sapiens
gcaacucguagauggagau

SEQ ID NO: 1246617 - RNA, 19 nt, Homo sapiens
uugcugaggcuucucuaaa

SEQ ID NO: 1246618 - RNA, 19 nt, Homo sapiens
uuagagaagaacccugaaa

SEQ ID NO: 1246619 - RNA, 19 nt, Homo sapiens
ccuguacccuagcgagugu

SEQ ID NO: 1246620 - RNA, 19 nt, Homo sapiens
guaauggucacagauuugg

SEQ ID NO: 1246621 - RNA, 19 nt, Homo sapiens
gguguuggugugucccuuu

SEQ ID NO: 1246622 - RNA, 19 nt, Homo sapiens
ccuggagccggucaacuuu

SEQ ID NO: 1246623 - RNA, 19 nt, Homo sapiens
ccucguauaacucggauuc

SEQ ID NO: 1246624 - RNA, 19 nt, Homo sapiens
ugccucgccucuacaccua

SEQ ID NO: 1246625 - RNA, 19 nt, Homo sapiens
ggacucaagcgccaaaccu

SEQ ID NO: 1246626 - RNA, 19 nt, Homo sapiens
gcaaagcacuggaauuuca

SEQ ID NO: 1246627 - RNA, 19 nt, Homo sapiens
gagagaggcucgccacuaa

SEQ ID NO: 1246628 - RNA, 19 nt, Homo sapiens
gcacaguaauggcaucuuu

SEQ ID NO: 1246629 - RNA, 19 nt, Homo sapiens
caacguggcuggagaagau

SEQ ID NO: 1246630 - RNA, 19 nt, Homo sapiens
caaccuagauaccaauuga

SEQ ID NO: 1246631 - RNA, 19 nt, Homo sapiens
gaagaugggcaacauauug

SEQ ID NO: 1246632 - RNA, 19 nt, Homo sapiens
gaccugaacuuuagaaucu

SEQ ID NO: 1246633 - RNA, 19 nt, Homo sapiens
ucaguucugucacuucuua

SEQ ID NO: 1246634 - RNA, 19 nt, Homo sapiens
auacucagcugucauguuu

SEQ ID NO: 1246635 - RNA, 19 nt, Homo sapiens
ccaauugaccugaacuuua

SEQ ID NO: 1246636 - RNA, 19 nt, Homo sapiens
caauugaccugaacuuuag

SEQ ID NO: 1246637 - RNA, 19 nt, Homo sapiens
gagggucacugucugguuu

SEQ ID NO: 1246638 - RNA, 19 nt, Homo sapiens
gcacuggaauuucacacuu

SEQ ID NO: 1246639 - RNA, 19 nt, Homo sapiens
gaauuuaaaccacguaguu

SEQ ID NO: 1246640 - RNA, 19 nt, Homo sapiens
cagcaaagcacuggaauuu

SEQ ID NO: 1246641 - RNA, 19 nt, Homo sapiens
gcaugccuauugacagaua

SEQ ID NO: 1246642 - RNA, 19 nt, Homo sapiens
guaauucucuuaacaacag

SEQ ID NO: 1246643 - RNA, 19 nt, Homo sapiens
gcaguuacauggccacauc

SEQ ID NO: 1246644 - RNA, 19 nt, Homo sapiens
cuaacaaccucaguaguaa

SEQ ID NO: 1246645 - RNA, 19 nt, Homo sapiens
ggacaaaggagacugaaca

SEQ ID NO: 1246646 - RNA, 19 nt, Homo sapiens
gugcuuguguuucucauuu

SEQ ID NO: 1246647 - RNA, 19 nt, Homo sapiens
guaaacauauguagguaag

SEQ ID NO: 1246648 - RNA, 19 nt, Homo sapiens
gcugucauguuuauaauuc

SEQ ID NO: 1246649 - RNA, 19 nt, Homo sapiens
gacauucccugacccagaa

SEQ ID NO: 1246650 - RNA, 19 nt, Homo sapiens
cuauaaacuuggacgauaa

SEQ ID NO: 1246651 - RNA, 19 nt, Homo sapiens
gugaaacugugagucaaua

SEQ ID NO: 1246652 - RNA, 19 nt, Homo sapiens
ucuauaaacuuggacgaua

SEQ ID NO: 1246653 - RNA, 19 nt, Homo sapiens
gagcuuaucacaucuggaa

SEQ ID NO: 1246654 - RNA, 19 nt, Homo sapiens
uaacaacaguggcuucagu

SEQ ID NO: 1246655 - RNA, 19 nt, Homo sapiens
gagaagaugggcaacauau

SEQ ID NO: 1246656 - RNA, 19 nt, Homo sapiens
gaauugaagccaaacaaau

SEQ ID NO: 1246657 - RNA, 19 nt, Homo sapiens
caaccucaguaguaauuug

SEQ ID NO: 1246658 - RNA, 19 nt, Homo sapiens
gacaacaaauggcuuccaa

SEQ ID NO: 1246659 - RNA, 19 nt, Homo sapiens
ucaagaaggucuggauaug

SEQ ID NO: 1246660 - RNA, 19 nt, Homo sapiens
caaaggagacugaacaucu

SEQ ID NO: 1246661 - RNA, 19 nt, Homo sapiens
gcaugucacucuuuagucu

SEQ ID NO: 1246662 - RNA, 19 nt, Homo sapiens
ucaaauuucaguccacaua

SEQ ID NO: 1246663 - RNA, 19 nt, Homo sapiens
ucuaacaaccucaguagua

SEQ ID NO: 1246664 - RNA, 19 nt, Homo sapiens
aggauaggcugguaauuug

SEQ ID NO: 1246665 - RNA, 19 nt, Homo sapiens
caggauaggcugguaauuu

SEQ ID NO: 1246666 - RNA, 19 nt, Homo sapiens
uaauagcacuagcuggauu

SEQ ID NO: 1246667 - RNA, 19 nt, Homo sapiens
ccacaucuuuggucauugu

SEQ ID NO: 1246668 - RNA, 19 nt, Homo sapiens
ggccacaucuuuggucauu

SEQ ID NO: 1246669 - RNA, 19 nt, Homo sapiens
gcaucuggcuuguaauucu

SEQ ID NO: 1246670 - RNA, 19 nt, Homo sapiens
gagcauugccauuuauuuc

SEQ ID NO: 1246671 - RNA, 19 nt, Homo sapiens
aaaggagacugaacaucuu

SEQ ID NO: 1246672 - RNA, 19 nt, Homo sapiens
guacuguguugcuuucaga

SEQ ID NO: 1246673 - RNA, 19 nt, Homo sapiens
ccugaacuuuagaaucuua

SEQ ID NO: 1246674 - RNA, 19 nt, Homo sapiens
guaguuaucuuuucacuuc

SEQ ID NO: 1246675 - RNA, 19 nt, Homo sapiens
ggagaagaugggcaacaua

SEQ ID NO: 1246676 - RNA, 19 nt, Homo sapiens
gauguugcagcucaaauuu

SEQ ID NO: 1246677 - RNA, 19 nt, Homo sapiens
gcagaaggcucaaaagaag

SEQ ID NO: 1246678 - RNA, 19 nt, Homo sapiens
aaacuuggacgauaaugaa

SEQ ID NO: 1246679 - RNA, 19 nt, Homo sapiens
caacaguggcuucaguuau

SEQ ID NO: 1246680 - RNA, 19 nt, Homo sapiens
ggacagcugaaucugcuuu

SEQ ID NO: 1246681 - RNA, 19 nt, Homo sapiens
uaaagcguguacuguguug

SEQ ID NO: 1246682 - RNA, 19 nt, Homo sapiens
uuguaaagcugcauauuca

SEQ ID NO: 1246683 - RNA, 19 nt, Homo sapiens
cagauugccucacuuaacu

SEQ ID NO: 1246684 - RNA, 19 nt, Homo sapiens
ggagcauugccauuuauuu

SEQ ID NO: 1246685 - RNA, 19 nt, Homo sapiens
aagcaugccuauugacaga

SEQ ID NO: 1246686 - RNA, 19 nt, Homo sapiens
gauugccucacuuaacuua

SEQ ID NO: 1246687 - RNA, 19 nt, Homo sapiens
gaaacugugagucaauaug

SEQ ID NO: 1246688 - RNA, 19 nt, Homo sapiens
uaccaguccucugcaguua

SEQ ID NO: 1246689 - RNA, 19 nt, Homo sapiens
ggaauuucacacuuuaaug

SEQ ID NO: 1246690 - RNA, 19 nt, Homo sapiens
gcuccagaguuugagauuu

SEQ ID NO: 1246691 - RNA, 19 nt, Homo sapiens
agcacuagcuggauugaaa

SEQ ID NO: 1246692 - RNA, 19 nt, Homo sapiens
gcucaagaaggucuggaua

SEQ ID NO: 1246693 - RNA, 19 nt, Homo sapiens
aacaguggcuucaguuaug

SEQ ID NO: 1246694 - RNA, 19 nt, Homo sapiens
cuucuuaccucuauaaacu

SEQ ID NO: 1246695 - RNA, 19 nt, Homo sapiens
aaacauauguagguaaggu

SEQ ID NO: 1246696 - RNA, 19 nt, Homo sapiens
guaguaaacauauguaggu

SEQ ID NO: 1246697 - RNA, 19 nt, Homo sapiens
acuggaauuucacacuuua

SEQ ID NO: 1246698 - RNA, 19 nt, Homo sapiens
gccacuaaguauucuaaau

SEQ ID NO: 1246699 - RNA, 19 nt, Homo sapiens
aaagugugcuuguguuucu

SEQ ID NO: 1246700 - RNA, 19 nt, Homo sapiens
guauauauccaagcugaaa

SEQ ID NO: 1246701 - RNA, 19 nt, Homo sapiens
cuccagaguuugagauuug

SEQ ID NO: 1246702 - RNA, 19 nt, Homo sapiens
aaacugugagucaauauga

SEQ ID NO: 1246703 - RNA, 19 nt, Homo sapiens
gaaggucuggauaugcuuu

SEQ ID NO: 1246704 - RNA, 19 nt, Homo sapiens
gccauuuauuucuccauuu

SEQ ID NO: 1246705 - RNA, 19 nt, Homo sapiens
guuacuggacuuucauuaa

SEQ ID NO: 1246706 - RNA, 19 nt, Homo sapiens
gugcagauagccuuggaua

SEQ ID NO: 1246707 - RNA, 19 nt, Homo sapiens
ucagcugucauguuuauaa

SEQ ID NO: 1246708 - RNA, 19 nt, Homo sapiens
gcuuguaauucucuuaaca

SEQ ID NO: 1246709 - RNA, 19 nt, Homo sapiens
aagugcaucuggcuuguaa

SEQ ID NO: 1246710 - RNA, 19 nt, Homo sapiens
ggagugugcgcuauggaaa

SEQ ID NO: 1246711 - RNA, 19 nt, Homo sapiens
aaacaggagugugcgcuau

SEQ ID NO: 1246712 - RNA, 19 nt, Homo sapiens
gcagauugccucacuuaac

SEQ ID NO: 1246713 - RNA, 19 nt, Homo sapiens
ucacuucuuaccucuauaa

SEQ ID NO: 1246714 - RNA, 19 nt, Homo sapiens
aaauuucaguccacauaug

SEQ ID NO: 1246715 - RNA, 19 nt, Homo sapiens
acucagcugucauguuuau

SEQ ID NO: 1246716 - RNA, 19 nt, Homo sapiens
acacaucacugccuguuuu

SEQ ID NO: 1246717 - RNA, 19 nt, Homo sapiens
ugaaaagcaugccuauuga

SEQ ID NO: 1246718 - RNA, 19 nt, Homo sapiens
auggagagcuuaucacauc

SEQ ID NO: 1246719 - RNA, 19 nt, Homo sapiens
uggaaucuacaccucauua

SEQ ID NO: 1246720 - RNA, 19 nt, Homo sapiens
uuacauggccacaucuuug

SEQ ID NO: 1246721 - RNA, 19 nt, Homo sapiens
uaaacuuggacgauaauga

SEQ ID NO: 1246722 - RNA, 19 nt, Homo sapiens
gggcaaauauuuucaacau

SEQ ID NO: 1246723 - RNA, 19 nt, Homo sapiens
gaagugcaucuggcuugua

SEQ ID NO: 1246724 - RNA, 19 nt, Homo sapiens
cagcugucauguuuauaau

SEQ ID NO: 1246725 - RNA, 19 nt, Homo sapiens
cacuggaauuucacacuuu

SEQ ID NO: 1246726 - RNA, 19 nt, Homo sapiens
gcuauuaacuccaccuaua

SEQ ID NO: 1246727 - RNA, 19 nt, Homo sapiens
uaauaaagauggacagcua

SEQ ID NO: 1246728 - RNA, 19 nt, Homo sapiens
gaacgacauuuacacuuga

SEQ ID NO: 1246729 - RNA, 19 nt, Homo sapiens
gcacacaacugauacacau

SEQ ID NO: 1246730 - RNA, 19 nt, Homo sapiens
ucucaaaucuucaaaccua

SEQ ID NO: 1246731 - RNA, 19 nt, Homo sapiens
caaaaugucugguauacua

SEQ ID NO: 1246732 - RNA, 19 nt, Homo sapiens
gcacggaccuuugagcuau

SEQ ID NO: 1246733 - RNA, 19 nt, Homo sapiens
ggagucaauucuuacguaa

SEQ ID NO: 1246734 - RNA, 19 nt, Homo sapiens
caccacacauggcuaauuu

SEQ ID NO: 1246735 - RNA, 19 nt, Homo sapiens
gcaugaggcuuuauuagag

SEQ ID NO: 1246736 - RNA, 19 nt, Homo sapiens
ugaauacucuguugauuag

SEQ ID NO: 1246737 - RNA, 19 nt, Homo sapiens
gugaauacucuguugauua

SEQ ID NO: 1246738 - RNA, 19 nt, Homo sapiens
agacagcaguuucccuaua

SEQ ID NO: 1246739 - RNA, 19 nt, Homo sapiens
aaaccuagaacgacauuua

SEQ ID NO: 1246740 - RNA, 19 nt, Homo sapiens
gacagcaguuucccuauau

SEQ ID NO: 1246741 - RNA, 19 nt, Homo sapiens
caucaagucagcucuauuu

SEQ ID NO: 1246742 - RNA, 19 nt, Homo sapiens
ccgcauaucuugaucuugu

SEQ ID NO: 1246743 - RNA, 19 nt, Homo sapiens
caugcaggcuuuaaagauu

SEQ ID NO: 1246744 - RNA, 19 nt, Homo sapiens
gcuauaagcaugcaauaau

SEQ ID NO: 1246745 - RNA, 19 nt, Homo sapiens
aaacugcacacaacugaua

SEQ ID NO: 1246746 - RNA, 19 nt, Homo sapiens
gcaguuucccuauauuauu

SEQ ID NO: 1246747 - RNA, 19 nt, Homo sapiens
gaaacaguaagcagaacua

SEQ ID NO: 1246748 - RNA, 19 nt, Homo sapiens
caaaauggcuaacuugaau

SEQ ID NO: 1246749 - RNA, 19 nt, Homo sapiens
gaacaaaacagcaagagaa

SEQ ID NO: 1246750 - RNA, 19 nt, Homo sapiens
gaagagucauguggaacaa

SEQ ID NO: 1246751 - RNA, 19 nt, Homo sapiens
agaacgacauuuacacuug

SEQ ID NO: 1246752 - RNA, 19 nt, Homo sapiens
gaagugaauacagaaauga

SEQ ID NO: 1246753 - RNA, 19 nt, Homo sapiens
caacaccacacauggcuaa

SEQ ID NO: 1246754 - RNA, 19 nt, Homo sapiens
caagucagcucuauuugcu

SEQ ID NO: 1246755 - RNA, 19 nt, Homo sapiens
gugauuaucucaucuacag

SEQ ID NO: 1246756 - RNA, 19 nt, Homo sapiens
gcagauagggugcaagaca

SEQ ID NO: 1246757 - RNA, 19 nt, Homo sapiens
uagaaagucagcaucauuu

SEQ ID NO: 1246758 - RNA, 19 nt, Homo sapiens
gaugaaacaguaagcagaa

SEQ ID NO: 1246759 - RNA, 19 nt, Homo sapiens
gaugagguuucgccauguu

SEQ ID NO: 1246760 - RNA, 19 nt, Homo sapiens
aaacuugcccugugauuau

SEQ ID NO: 1246761 - RNA, 19 nt, Homo sapiens
aaagauggacagcuaauga

SEQ ID NO: 1246762 - RNA, 19 nt, Homo sapiens
cagcaguuucccuauauua

SEQ ID NO: 1246763 - RNA, 19 nt, Homo sapiens
ggacagcuaaugacagaau

SEQ ID NO: 1246764 - RNA, 19 nt, Homo sapiens
cagauagggugcaagacaa

SEQ ID NO: 1246765 - RNA, 19 nt, Homo sapiens
uaaagauugucaagaccaa

SEQ ID NO: 1246766 - RNA, 19 nt, Homo sapiens
uggagucaauucuuacgua

SEQ ID NO: 1246767 - RNA, 19 nt, Homo sapiens
agaagugaauacagaaaug

SEQ ID NO: 1246768 - RNA, 19 nt, Homo sapiens
aagcagaacuacuuagaag

SEQ ID NO: 1246769 - RNA, 19 nt, Homo sapiens
gaauggaggaaguaguaaa

SEQ ID NO: 1246770 - RNA, 19 nt, Homo sapiens
gcauaucuugaucuuguua

SEQ ID NO: 1246771 - RNA, 19 nt, Homo sapiens
cagcugauaugaaugucuu

SEQ ID NO: 1246772 - RNA, 19 nt, Homo sapiens
ucuauuugcuggguucaua

SEQ ID NO: 1246773 - RNA, 19 nt, Homo sapiens
ccacaggaaacuuugguaa

SEQ ID NO: 1246774 - RNA, 19 nt, Homo sapiens
guaaacucuucuauuagga

SEQ ID NO: 1246775 - RNA, 19 nt, Homo sapiens
acaggaaacuuugguaaca

SEQ ID NO: 1246776 - RNA, 19 nt, Homo sapiens
aaauuuaucugugccucua

SEQ ID NO: 1246777 - RNA, 19 nt, Homo sapiens
augcaggcuuuaaagauua

SEQ ID NO: 1246778 - RNA, 19 nt, Homo sapiens
cuacagcccauuacucaaa

SEQ ID NO: 1246779 - RNA, 19 nt, Homo sapiens
gguauacuauuuggcgauu

SEQ ID NO: 1246780 - RNA, 19 nt, Homo sapiens
ccuuugagcuaucauacuu

SEQ ID NO: 1246781 - RNA, 19 nt, Homo sapiens
cagcaucauuuccagauag

SEQ ID NO: 1246782 - RNA, 19 nt, Homo sapiens
uacacuugauggcuaauaa

SEQ ID NO: 1246783 - RNA, 19 nt, Homo sapiens
aacaggacauuaugaucua

SEQ ID NO: 1246784 - RNA, 19 nt, Homo sapiens
caugaggcuuuauuagaga

SEQ ID NO: 1246785 - RNA, 19 nt, Homo sapiens
ggaaacuuugguaacauuu

SEQ ID NO: 1246786 - RNA, 19 nt, Homo sapiens
ccaaagugcuaggauuaca

SEQ ID NO: 1246787 - RNA, 19 nt, Homo sapiens
ucccacacccucacuguua

SEQ ID NO: 1246788 - RNA, 19 nt, Homo sapiens
ucagcaucauuuccagaua

SEQ ID NO: 1246789 - RNA, 19 nt, Homo sapiens
cuugauggcuaauaaagau

SEQ ID NO: 1246790 - RNA, 19 nt, Homo sapiens
gaaagaaaacuagcacaaa

SEQ ID NO: 1246791 - RNA, 19 nt, Homo sapiens
ggaccuuugagcuaucaua

SEQ ID NO: 1246792 - RNA, 19 nt, Homo sapiens
gaucuuuaaucuggaagug

SEQ ID NO: 1246793 - RNA, 19 nt, Homo sapiens
ucaaaagucugaucucuag

SEQ ID NO: 1246794 - RNA, 19 nt, Homo sapiens
gacagcuaaugacagaauu

SEQ ID NO: 1246795 - RNA, 19 nt, Homo sapiens
cuuuggauguguacgguua

SEQ ID NO: 1246796 - RNA, 19 nt, Homo sapiens
aagagaagauggaguacca

SEQ ID NO: 1246797 - RNA, 19 nt, Homo sapiens
ucucacacuguccaaauua

SEQ ID NO: 1246798 - RNA, 19 nt, Homo sapiens
ucccaaagugcuaggauua

SEQ ID NO: 1246799 - RNA, 19 nt, Homo sapiens
aaacaggacauuaugaucu

SEQ ID NO: 1246800 - RNA, 19 nt, Homo sapiens
uaauagagaugagguuucg

SEQ ID NO: 1246801 - RNA, 19 nt, Homo sapiens
caugucaccuccucagauc

SEQ ID NO: 1246802 - RNA, 19 nt, Homo sapiens
caaaagugguugcagauag

SEQ ID NO: 1246803 - RNA, 19 nt, Homo sapiens
gauuagaaagucagcauca

SEQ ID NO: 1246804 - RNA, 19 nt, Homo sapiens
aggaaacuuugguaacauu

SEQ ID NO: 1246805 - RNA, 19 nt, Homo sapiens
ugaaacugcacacaacuga

SEQ ID NO: 1246806 - RNA, 19 nt, Homo sapiens
guauacuauuuggcgauua

SEQ ID NO: 1246807 - RNA, 19 nt, Homo sapiens
ugauaugaaugucuugaag

SEQ ID NO: 1246808 - RNA, 19 nt, Homo sapiens
agaaaucaaugagacuuca

SEQ ID NO: 1246809 - RNA, 19 nt, Homo sapiens
gacaaaacuugcccuguga

SEQ ID NO: 1246810 - RNA, 19 nt, Homo sapiens
cuauuaacuccaccuauaa

SEQ ID NO: 1246811 - RNA, 19 nt, Homo sapiens
ucucaucuacagcccauua

SEQ ID NO: 1246812 - RNA, 19 nt, Homo sapiens
cccagucgaugucuguauu

SEQ ID NO: 1246813 - RNA, 19 nt, Homo sapiens
aguaaacucuucuauuagg

SEQ ID NO: 1246814 - RNA, 19 nt, Homo sapiens
ggaggaaguaguaaacucu

SEQ ID NO: 1246815 - RNA, 19 nt, Homo sapiens
ggguucauacaaugcauua

SEQ ID NO: 1246816 - RNA, 19 nt, Homo sapiens
cacaacugauacacauauu

SEQ ID NO: 1246817 - RNA, 19 nt, Homo sapiens
acacaacugauacacauau

SEQ ID NO: 1246818 - RNA, 19 nt, Homo sapiens
guuugcaccugcuaucaug

SEQ ID NO: 1246819 - RNA, 19 nt, Homo sapiens
caugagggguguaucaauu

SEQ ID NO: 1246820 - RNA, 19 nt, Homo sapiens
gagaaacuucagcaggauu

SEQ ID NO: 1246821 - RNA, 19 nt, Homo sapiens
uuagaaagucagcaucauu

SEQ ID NO: 1246822 - RNA, 19 nt, Homo sapiens
gauguacucuguccuucac

SEQ ID NO: 1246823 - RNA, 19 nt, Homo sapiens
uuuccaggcugaucuugaa

SEQ ID NO: 1246824 - RNA, 19 nt, Homo sapiens
uugaauggaggaaguagua

SEQ ID NO: 1246825 - RNA, 19 nt, Homo sapiens
gcccugugauuaucucauc

SEQ ID NO: 1246826 - RNA, 19 nt, Homo sapiens
guacagaccugccuaacau

SEQ ID NO: 1246827 - RNA, 19 nt, Homo sapiens
cuacaacccuugccaaaca

SEQ ID NO: 1246828 - RNA, 19 nt, Homo sapiens
aaacacagcccacuccauu

SEQ ID NO: 1246829 - RNA, 19 nt, Homo sapiens
gagccaagcagauuccaaa

SEQ ID NO: 1246830 - RNA, 19 nt, Homo sapiens
ccaagcagauuccaaacca

SEQ ID NO: 1246831 - RNA, 19 nt, Homo sapiens
gccaacgcuuccucaauga

SEQ ID NO: 1246832 - RNA, 19 nt, Homo sapiens
agccaacgcuuccucaaug

SEQ ID NO: 1246833 - RNA, 19 nt, Homo sapiens
agacucaggguuccaguaa

SEQ ID NO: 1246834 - RNA, 19 nt, Homo sapiens
acacagcccacuccauuuc

SEQ ID NO: 1246835 - RNA, 19 nt, Homo sapiens
caacgcuuccucaaugauc

SEQ ID NO: 1246836 - RNA, 19 nt, Homo sapiens
cgggaucccucggugaaga

SEQ ID NO: 1246837 - RNA, 19 nt, Homo sapiens
aguaaccagugauggauuc

SEQ ID NO: 1246838 - RNA, 19 nt, Homo sapiens
gcagauuccaaaccacuac

SEQ ID NO: 1246839 - RNA, 19 nt, Homo sapiens
caucucccaaauaaaguuu

SEQ ID NO: 1246840 - RNA, 19 nt, Homo sapiens
cagccaacgcuuccucaau

SEQ ID NO: 1246841 - RNA, 19 nt, Homo sapiens
ggagagaagucauauauau

SEQ ID NO: 1246842 - RNA, 19 nt, Homo sapiens
ggagagaagucauauauau

SEQ ID NO: 1246843 - RNA, 19 nt, Homo sapiens
gaagggaaaucucauugua

SEQ ID NO: 1246844 - RNA, 19 nt, Homo sapiens
gcucagaccucauuaacua

SEQ ID NO: 1246845 - RNA, 19 nt, Homo sapiens
gaacaaugccauaaacaua

SEQ ID NO: 1246846 - RNA, 19 nt, Homo sapiens
agucauagcuuaucacaua

SEQ ID NO: 1246847 - RNA, 19 nt, Homo sapiens
gcaaagaugucugaagaga

SEQ ID NO: 1246848 - RNA, 19 nt, Homo sapiens
gguaugaaaucaagaauuc

SEQ ID NO: 1246849 - RNA, 19 nt, Homo sapiens
uaaagacucuguuaacaug

SEQ ID NO: 1246850 - RNA, 19 nt, Homo sapiens
gcccagaaguggaauaauu

SEQ ID NO: 1246851 - RNA, 19 nt, Homo sapiens
gauaaagacucuguuaaca

SEQ ID NO: 1246852 - RNA, 19 nt, Homo sapiens
ggaaaaggcuucauccaaa

SEQ ID NO: 1246853 - RNA, 19 nt, Homo sapiens
ggaaaaggcuucauucaga

SEQ ID NO: 1246854 - RNA, 19 nt, Homo sapiens
ggaaaaggcuucaucaaga

SEQ ID NO: 1246855 - RNA, 19 nt, Homo sapiens
guacaucagcgaauucaua

SEQ ID NO: 1246856 - RNA, 19 nt, Homo sapiens
ccagaagacauguuuaaua

SEQ ID NO: 1246857 - RNA, 19 nt, Homo sapiens
gaagacauguuuaauaucc

SEQ ID NO: 1246858 - RNA, 19 nt, Homo sapiens
gaacaccagagaacucaua

SEQ ID NO: 1246859 - RNA, 19 nt, Homo sapiens
ggaaacaucauucaucaga

SEQ ID NO: 1246860 - RNA, 19 nt, Homo sapiens
ggagagaaacccuauguau

SEQ ID NO: 1246861 - RNA, 19 nt, Homo sapiens
uaaaucaugucucaacaga

SEQ ID NO: 1246862 - RNA, 19 nt, Homo sapiens
caagaagucucggcucauu

SEQ ID NO: 1246863 - RNA, 19 nt, Homo sapiens
ccucauggaugcaguauau

SEQ ID NO: 1246864 - RNA, 19 nt, Homo sapiens
aagcaaagaugucugaaga

SEQ ID NO: 1246865 - RNA, 19 nt, Homo sapiens
gagagaaacccuauacaug

SEQ ID NO: 1246866 - RNA, 19 nt, Homo sapiens
gagagaaacccuaugaaug

SEQ ID NO: 1246867 - RNA, 19 nt, Homo sapiens
gagagaaacccuaugaaug

SEQ ID NO: 1246868 - RNA, 19 nt, Homo sapiens
cagaugcacucuucaaguu

SEQ ID NO: 1246869 - RNA, 19 nt, Homo sapiens
gaaaucucauuguacauca

SEQ ID NO: 1246870 - RNA, 19 nt, Homo sapiens
caagaagucucgccucauc

SEQ ID NO: 1246871 - RNA, 19 nt, Homo sapiens
caagaaaguugacaaucau

SEQ ID NO: 1246872 - RNA, 19 nt, Homo sapiens
caaaccagaugcacucuuc

SEQ ID NO: 1246873 - RNA, 19 nt, Homo sapiens
ggagagccauggacaguag

SEQ ID NO: 1246874 - RNA, 19 nt, Homo sapiens
ugucaugccuuguuuauca

SEQ ID NO: 1246875 - RNA, 19 nt, Homo sapiens
gaaaaggcuucauccaaaa

SEQ ID NO: 1246876 - RNA, 19 nt, Homo sapiens
ggagagaaacccuaugaau

SEQ ID NO: 1246877 - RNA, 19 nt, Homo sapiens
gaaaaggcuucaucaagaa

SEQ ID NO: 1246878 - RNA, 19 nt, Homo sapiens
ggagagaaacccuaugaau

SEQ ID NO: 1246879 - RNA, 19 nt, Homo sapiens
gagagaaacccuauguaug

SEQ ID NO: 1246880 - RNA, 19 nt, Homo sapiens
gaaaguugacaaucaucua

SEQ ID NO: 1246881 - RNA, 19 nt, Homo sapiens
gauaaaucaugucucaaca

SEQ ID NO: 1246882 - RNA, 19 nt, Homo sapiens
gagaaacccuauacaugca

SEQ ID NO: 1246883 - RNA, 19 nt, Homo sapiens
aaagaugucugaagagagu

SEQ ID NO: 1246884 - RNA, 19 nt, Homo sapiens
acauacacgugaucucaua

SEQ ID NO: 1246885 - RNA, 19 nt, Homo sapiens
gcucauuaaucaucagaga

SEQ ID NO: 1246886 - RNA, 19 nt, Homo sapiens
gaaacccuauguaugcaau

SEQ ID NO: 1246887 - RNA, 19 nt, Homo sapiens
gaaaaggcuucauucagaa

SEQ ID NO: 1246888 - RNA, 19 nt, Homo sapiens
ggagagaaacccuauacau

SEQ ID NO: 1246889 - RNA, 19 nt, Homo sapiens
gaaaguccgggcucacuga

SEQ ID NO: 1246890 - RNA, 19 nt, Homo sapiens
ugccaagcaugaacaauuu

SEQ ID NO: 1246891 - RNA, 19 nt, Homo sapiens
gaagguggaaauucuguga

SEQ ID NO: 1246892 - RNA, 19 nt, Homo sapiens
ggauguggcuguggaguuc

SEQ ID NO: 1246893 - RNA, 19 nt, Homo sapiens
gaaaauccuugcucagaga

SEQ ID NO: 1246894 - RNA, 19 nt, Homo sapiens
agacaucggagaacucaua

SEQ ID NO: 1246895 - RNA, 19 nt, Homo sapiens
caggagagaagucauauau

SEQ ID NO: 1246896 - RNA, 19 nt, Homo sapiens
ggaaaucacagcucaaugc

SEQ ID NO: 1246897 - RNA, 19 nt, Homo sapiens
ggagagaaaccacauggau

SEQ ID NO: 1246898 - RNA, 19 nt, Homo sapiens
caggagagaagucauauau

SEQ ID NO: 1246899 - RNA, 19 nt, Homo sapiens
ggaaaucacagcucaaugc

SEQ ID NO: 1246900 - RNA, 19 nt, Homo sapiens
ucacugaacaccagagaaa

SEQ ID NO: 1246901 - RNA, 19 nt, Homo sapiens
gaagagaguggaacaaugc

SEQ ID NO: 1246902 - RNA, 19 nt, Homo sapiens
ugaagagaguggaacaaug

SEQ ID NO: 1246903 - RNA, 19 nt, Homo sapiens
ccagaaaucaagaaaguug

SEQ ID NO: 1246904 - RNA, 19 nt, Homo sapiens
guccagaaaucaagaaagu

SEQ ID NO: 1246905 - RNA, 19 nt, Homo sapiens
agagaaauguguagguuca

SEQ ID NO: 1246906 - RNA, 19 nt, Homo sapiens
gcucaaugcacaucagaaa

SEQ ID NO: 1246907 - RNA, 19 nt, Homo sapiens
caagugauccucucuccuu

SEQ ID NO: 1246908 - RNA, 19 nt, Homo sapiens
caagucaggucucauuaac

SEQ ID NO: 1246909 - RNA, 19 nt, Homo sapiens
ccucaucuaucaucagaga

SEQ ID NO: 1246910 - RNA, 19 nt, Homo sapiens
gaacaaggagagccaugga

SEQ ID NO: 1246911 - RNA, 19 nt, Homo sapiens
ggauaaagacucuguuaac

SEQ ID NO: 1246912 - RNA, 19 nt, Homo sapiens
caggauaaagacucuguua

SEQ ID NO: 1246913 - RNA, 19 nt, Homo sapiens
caacagacaucggagaacu

SEQ ID NO: 1246914 - RNA, 19 nt, Homo sapiens
gguccaggcucacugaaca

SEQ ID NO: 1246915 - RNA, 19 nt, Homo sapiens
gaaauccacagccaaaucu

SEQ ID NO: 1246916 - RNA, 19 nt, Homo sapiens
gagacgugauguuggagaa

SEQ ID NO: 1246917 - RNA, 19 nt, Homo sapiens
gcucaaugcacaccagaaa

SEQ ID NO: 1246918 - RNA, 19 nt, Homo sapiens
gaacaaaagguaugaaauc

SEQ ID NO: 1246919 - RNA, 19 nt, Homo sapiens
ccacauuuauccaucuugu

SEQ ID NO: 1246920 - RNA, 19 nt, Homo sapiens
ggaaaucucauuguacauc

SEQ ID NO: 1246921 - RNA, 19 nt, Homo sapiens
uaaguuuagucaaccagaa

SEQ ID NO: 1246922 - RNA, 19 nt, Homo sapiens
ugacuuacaugggaaaaua

SEQ ID NO: 1246923 - RNA, 19 nt, Homo sapiens
cauaaugcauuuggaaaca

SEQ ID NO: 1246924 - RNA, 19 nt, Homo sapiens
ggaacaaugccauaaacau

SEQ ID NO: 1246925 - RNA, 19 nt, Homo sapiens
gcucagagagucauagcuu

SEQ ID NO: 1246926 - RNA, 19 nt, Homo sapiens
ccaagcagagagcaaagua

SEQ ID NO: 1246927 - RNA, 19 nt, Homo sapiens
agagagaaauguguagguu

SEQ ID NO: 1246928 - RNA, 19 nt, Homo sapiens
uaauaucccaucagagauu

SEQ ID NO: 1246929 - RNA, 19 nt, Homo sapiens
ucagcgaacucaaaacaua

SEQ ID NO: 1246930 - RNA, 19 nt, Homo sapiens
gccauaaacauaaugcauu

SEQ ID NO: 1246931 - RNA, 19 nt, Homo sapiens
gcagauaguagaauuugca

SEQ ID NO: 1246932 - RNA, 19 nt, Homo sapiens
gagcaaaguagccauugug

SEQ ID NO: 1246933 - RNA, 19 nt, Homo sapiens
gagaaacccuauguaugca

SEQ ID NO: 1246934 - RNA, 19 nt, Homo sapiens
gagaaacccuaugaaugca

SEQ ID NO: 1246935 - RNA, 19 nt, Homo sapiens
gagaaacccuaugaaugca

SEQ ID NO: 1246936 - RNA, 19 nt, Homo sapiens
cuacagaugcacucacaaa

SEQ ID NO: 1246937 - RNA, 19 nt, Homo sapiens
ccguauggaugcucugauu

SEQ ID NO: 1246938 - RNA, 19 nt, Homo sapiens
acacaagucaggucucauu

SEQ ID NO: 1246939 - RNA, 19 nt, Homo sapiens
gcgaauucauacuggagaa

SEQ ID NO: 1246940 - RNA, 19 nt, Homo sapiens
acacaggagagaagucaua

SEQ ID NO: 1246941 - RNA, 19 nt, Homo sapiens
gaacuuggaucauucauua

SEQ ID NO: 1246942 - RNA, 19 nt, Homo sapiens
ggagagcagucaucaauua

SEQ ID NO: 1246943 - RNA, 19 nt, Homo sapiens
gaaugugccuuccuuauuu

SEQ ID NO: 1246944 - RNA, 19 nt, Homo sapiens
gaauggaagugucaguaua

SEQ ID NO: 1246945 - RNA, 19 nt, Homo sapiens
ucacagagcucuagaagca

SEQ ID NO: 1246946 - RNA, 19 nt, Homo sapiens
ggaaggauguuuauucucu

SEQ ID NO: 1246947 - RNA, 19 nt, Homo sapiens
gcauuucccuucugaguga

SEQ ID NO: 1246948 - RNA, 19 nt, Homo sapiens
gcugagaauuucaaacaaa

SEQ ID NO: 1246949 - RNA, 19 nt, Homo sapiens
gaucauucauuacagacua

SEQ ID NO: 1246950 - RNA, 19 nt, Homo sapiens
aagcagagcuccugggaaa

SEQ ID NO: 1246951 - RNA, 19 nt, Homo sapiens
gagcagucaucaauuaaau

SEQ ID NO: 1246952 - RNA, 19 nt, Homo sapiens
cuagugauguggagguuua

SEQ ID NO: 1246953 - RNA, 19 nt, Homo sapiens
ggaagugguucaggauaaa

SEQ ID NO: 1246954 - RNA, 19 nt, Homo sapiens
ccucuugucucucucauuu

SEQ ID NO: 1246955 - RNA, 19 nt, Homo sapiens
gguagcaacaugauaauuu

SEQ ID NO: 1246956 - RNA, 19 nt, Homo sapiens
guagguagcaacaugauaa

SEQ ID NO: 1246957 - RNA, 19 nt, Homo sapiens
gggaaaccguuguuguaaa

SEQ ID NO: 1246958 - RNA, 19 nt, Homo sapiens
gcaagugguuucuccuuuc

SEQ ID NO: 1246959 - RNA, 19 nt, Homo sapiens
agaagcagcuggacuugaa

SEQ ID NO: 1246960 - RNA, 19 nt, Homo sapiens
cauaggaucuugcacuguu

SEQ ID NO: 1246961 - RNA, 19 nt, Homo sapiens
caacacauauaaccaccaa

SEQ ID NO: 1246962 - RNA, 19 nt, Homo sapiens
gauagcuucuguccuuauu

SEQ ID NO: 1246963 - RNA, 19 nt, Homo sapiens
gaucuugcacuguucauuu

SEQ ID NO: 1246964 - RNA, 19 nt, Homo sapiens
caacuggccuguaucuauc

SEQ ID NO: 1246965 - RNA, 19 nt, Homo sapiens
ucauugagccuuagcauuu

SEQ ID NO: 1246966 - RNA, 19 nt, Homo sapiens
ggaaaccguuguuguaaac

SEQ ID NO: 1246967 - RNA, 19 nt, Homo sapiens
cuauguauguguuggauaa

SEQ ID NO: 1246968 - RNA, 19 nt, Homo sapiens
gcagaggauucuccaggaa

SEQ ID NO: 1246969 - RNA, 19 nt, Homo sapiens
gaggagagcagucaucaau

SEQ ID NO: 1246970 - RNA, 19 nt, Homo sapiens
cuugauggcugggaauuua

SEQ ID NO: 1246971 - RNA, 19 nt, Homo sapiens
gcaaauggagcaucaguag

SEQ ID NO: 1246972 - RNA, 19 nt, Homo sapiens
ccaaccaacuggccuguau

SEQ ID NO: 1246973 - RNA, 19 nt, Homo sapiens
cagaauugcugggaaaguu

SEQ ID NO: 1246974 - RNA, 19 nt, Homo sapiens
gcugaucugcugagaauuu

SEQ ID NO: 1246975 - RNA, 19 nt, Homo sapiens
gcaugcguguguauauaaa

SEQ ID NO: 1246976 - RNA, 19 nt, Homo sapiens
gauccaggcaaaguaauua

SEQ ID NO: 1246977 - RNA, 19 nt, Homo sapiens
agagugaacuuggaucauu

SEQ ID NO: 1246978 - RNA, 19 nt, Homo sapiens
uggaagugguucaggauaa

SEQ ID NO: 1246979 - RNA, 19 nt, Homo sapiens
guagugaccaguugccuaa

SEQ ID NO: 1246980 - RNA, 19 nt, Homo sapiens
gauggcauuucccuucuga

SEQ ID NO: 1246981 - RNA, 19 nt, Homo sapiens
guaucuaucuaucuggauu

SEQ ID NO: 1246982 - RNA, 19 nt, Homo sapiens
uaagugcugaugacuguua

SEQ ID NO: 1246983 - RNA, 19 nt, Homo sapiens
gagagcagucaucaauuaa

SEQ ID NO: 1246984 - RNA, 19 nt, Homo sapiens
acugauagcuucuguccuu

SEQ ID NO: 1246985 - RNA, 19 nt, Homo sapiens
gauuagaauugugcucuug

SEQ ID NO: 1246986 - RNA, 19 nt, Homo sapiens
gagcugcccugucuuucau

SEQ ID NO: 1246987 - RNA, 19 nt, Homo sapiens
cagcagggcucugggaaug

SEQ ID NO: 1246988 - RNA, 19 nt, Homo sapiens
gagaauggaagugucagua

SEQ ID NO: 1246989 - RNA, 19 nt, Homo sapiens
ggagagaaauguccaaaag

SEQ ID NO: 1246990 - RNA, 19 nt, Homo sapiens
agacccaguuugccucaua

SEQ ID NO: 1246991 - RNA, 19 nt, Homo sapiens
ccaacuggccuguaucuau

SEQ ID NO: 1246992 - RNA, 19 nt, Homo sapiens
gaagagugaacuuggauca

SEQ ID NO: 1246993 - RNA, 19 nt, Homo sapiens
gaugcugccuuauuuccuu

SEQ ID NO: 1246994 - RNA, 19 nt, Homo sapiens
uuuaugcgaugcugccuua

SEQ ID NO: 1246995 - RNA, 19 nt, Homo sapiens
guacuuaagugcugaugac

SEQ ID NO: 1246996 - RNA, 19 nt, Homo sapiens
gaccacuucuucacugaga

SEQ ID NO: 1246997 - RNA, 19 nt, Homo sapiens
gaucuauccucaaccuaca

SEQ ID NO: 1246998 - RNA, 19 nt, Homo sapiens
guauagacccauuguacuu

SEQ ID NO: 1246999 - RNA, 19 nt, Homo sapiens
gagugaacuuggaucauuc

SEQ ID NO: 1247000 - RNA, 19 nt, Homo sapiens
ggaugcggcuguugaagag

SEQ ID NO: 1247001 - RNA, 19 nt, Homo sapiens
ugaaugagauggucuugac

SEQ ID NO: 1247002 - RNA, 19 nt, Homo sapiens
caaggugacuguccugaac

SEQ ID NO: 1247003 - RNA, 19 nt, Homo sapiens
uggaggagcuggugaagca

SEQ ID NO: 1247004 - RNA, 19 nt, Homo sapiens
ggacuugaacccacaaugg

SEQ ID NO: 1247005 - RNA, 19 nt, Homo sapiens
gcagggcucuuaggucaca

SEQ ID NO: 1247006 - RNA, 19 nt, Homo sapiens
ccaaugacguauccaaugc

SEQ ID NO: 1247007 - RNA, 19 nt, Homo sapiens
gaacuaugccuccccgaua

SEQ ID NO: 1247008 - RNA, 19 nt, Homo sapiens
ucuuaaaugucccugauga

SEQ ID NO: 1247009 - RNA, 19 nt, Homo sapiens
gggagaaggugaagaucag

SEQ ID NO: 1247010 - RNA, 19 nt, Homo sapiens
ugaaauuguugaacuggau

SEQ ID NO: 1247011 - RNA, 19 nt, Homo sapiens
cugcugaucugcugagaau

SEQ ID NO: 1247012 - RNA, 19 nt, Homo sapiens
uaagagugaugggagagaa

SEQ ID NO: 1247013 - RNA, 19 nt, Homo sapiens
gcagggcucugggaaugug

SEQ ID NO: 1247014 - RNA, 19 nt, Homo sapiens
caauuguagugaccaguug

SEQ ID NO: 1247015 - RNA, 19 nt, Homo sapiens
augcgaugcugccuuauuu

SEQ ID NO: 1247016 - RNA, 19 nt, Homo sapiens
cuuaagugcugaugacugu

SEQ ID NO: 1247017 - RNA, 19 nt, Homo sapiens
ugucuuucauugagccuua

SEQ ID NO: 1247018 - RNA, 19 nt, Homo sapiens
ugacugugaccacuucuuu

SEQ ID NO: 1247019 - RNA, 19 nt, Homo sapiens
ccaggcaaaguaauuaauu

SEQ ID NO: 1247020 - RNA, 19 nt, Homo sapiens
uauagacccauuguacuua

SEQ ID NO: 1247021 - RNA, 19 nt, Homo sapiens
uaucuuaaaugucccugau

SEQ ID NO: 1247022 - RNA, 19 nt, Homo sapiens
uagcuucuguccuuauuag

SEQ ID NO: 1247023 - RNA, 19 nt, Homo sapiens
ccucugacccuuccuguug

SEQ ID NO: 1247024 - RNA, 19 nt, Homo sapiens
cacagaggccuuuggcuuu

SEQ ID NO: 1247025 - RNA, 19 nt, Homo sapiens
aagccuaccuggagaagug

SEQ ID NO: 1247026 - RNA, 19 nt, Homo sapiens
gaaccagcuucuugcaaaa

SEQ ID NO: 1247027 - RNA, 19 nt, Homo sapiens
gcuucuguccuuauuagua

SEQ ID NO: 1247028 - RNA, 19 nt, Homo sapiens
cauggaaaauggaauguuu

SEQ ID NO: 1247029 - RNA, 19 nt, Homo sapiens
aaacggacuuucucaucau

SEQ ID NO: 1247030 - RNA, 19 nt, Homo sapiens
gucaggacaacacauauaa

SEQ ID NO: 1247031 - RNA, 19 nt, Homo sapiens
caagcugugugaaggugaa

SEQ ID NO: 1247032 - RNA, 19 nt, Homo sapiens
gagcaucaguagguagcaa

SEQ ID NO: 1247033 - RNA, 19 nt, Homo sapiens
guugaagagugaacuugga

SEQ ID NO: 1247034 - RNA, 19 nt, Homo sapiens
gacccuuccuguugguauu

SEQ ID NO: 1247035 - RNA, 19 nt, Homo sapiens
uaucuggauuugacuugaa

SEQ ID NO: 1247036 - RNA, 19 nt, Homo sapiens
gggaccacuucuucacuga

SEQ ID NO: 1247037 - RNA, 19 nt, Homo sapiens
caagugagaguuauuugca

SEQ ID NO: 1247038 - RNA, 19 nt, Homo sapiens
auagacccauuguacuuaa

SEQ ID NO: 1247039 - RNA, 19 nt, Homo sapiens
guccuuauuaguacacuua

SEQ ID NO: 1247040 - RNA, 19 nt, Homo sapiens
uggcuuguguaaauucgua

SEQ ID NO: 1247041 - RNA, 19 nt, Homo sapiens
gaacugaccugaauuggaa

SEQ ID NO: 1247042 - RNA, 19 nt, Homo sapiens
gcucugggcugacaaauua

SEQ ID NO: 1247043 - RNA, 19 nt, Homo sapiens
gcagagaucuaccauguaa

SEQ ID NO: 1247044 - RNA, 19 nt, Homo sapiens
caacagcacuuaugggauu

SEQ ID NO: 1247045 - RNA, 19 nt, Homo sapiens
gaucaugacucuacacaga

SEQ ID NO: 1247046 - RNA, 19 nt, Homo sapiens
gcagcaagcuccugaugaa

SEQ ID NO: 1247047 - RNA, 19 nt, Homo sapiens
gaagaaagccuuagguauc

SEQ ID NO: 1247048 - RNA, 19 nt, Homo sapiens
gaaacaacaucucagacuu

SEQ ID NO: 1247049 - RNA, 19 nt, Homo sapiens
ucuaagcacuuuacacaua

SEQ ID NO: 1247050 - RNA, 19 nt, Homo sapiens
gcacaaagacagaaguaaa

SEQ ID NO: 1247051 - RNA, 19 nt, Homo sapiens
ggaaaggaugugauuaaua

SEQ ID NO: 1247052 - RNA, 19 nt, Homo sapiens
agaaacagguuaucaguga

SEQ ID NO: 1247053 - RNA, 19 nt, Homo sapiens
gggcagagaucuaccaugu

SEQ ID NO: 1247054 - RNA, 19 nt, Homo sapiens
gaaccacaauguuaacaau

SEQ ID NO: 1247055 - RNA, 19 nt, Homo sapiens
gaauagcacuguugcaaag

SEQ ID NO: 1247056 - RNA, 19 nt, Homo sapiens
gagacuaggguuuauguua

SEQ ID NO: 1247057 - RNA, 19 nt, Homo sapiens
gcaacaacauggacaaauc

SEQ ID NO: 1247058 - RNA, 19 nt, Homo sapiens
caaagugguagcacaauua

SEQ ID NO: 1247059 - RNA, 19 nt, Homo sapiens
ggucagacuuggaagaauu

SEQ ID NO: 1247060 - RNA, 19 nt, Homo sapiens
cauguaagcugugcuguuu

SEQ ID NO: 1247061 - RNA, 19 nt, Homo sapiens
cgacuaagccgccagaauu

SEQ ID NO: 1247062 - RNA, 19 nt, Homo sapiens
gcuagggucuuuccugauu

SEQ ID NO: 1247063 - RNA, 19 nt, Homo sapiens
ggcaauagcuagggucuuu

SEQ ID NO: 1247064 - RNA, 19 nt, Homo sapiens
gacaaugauuucacaacua

SEQ ID NO: 1247065 - RNA, 19 nt, Homo sapiens
gcugauauuuccuaccuaa

SEQ ID NO: 1247066 - RNA, 19 nt, Homo sapiens
ggagcgcacuagaguuuaa

SEQ ID NO: 1247067 - RNA, 19 nt, Homo sapiens
gaugaaguagguauuguua

SEQ ID NO: 1247068 - RNA, 19 nt, Homo sapiens
gagaagaaagccuuaggua

SEQ ID NO: 1247069 - RNA, 19 nt, Homo sapiens
gaacagggagcaagagguu

SEQ ID NO: 1247070 - RNA, 19 nt, Homo sapiens
gauaaucuggcuugguuua

SEQ ID NO: 1247071 - RNA, 19 nt, Homo sapiens
ggacaggguuuagaucaug

SEQ ID NO: 1247072 - RNA, 19 nt, Homo sapiens
caucauaucccuuaaacuu

SEQ ID NO: 1247073 - RNA, 19 nt, Homo sapiens
cagcaucccuggccuguug

SEQ ID NO: 1247074 - RNA, 19 nt, Homo sapiens
cacaaaggaugguuucuug

SEQ ID NO: 1247075 - RNA, 19 nt, Homo sapiens
gaccacaguugccaaucua

SEQ ID NO: 1247076 - RNA, 19 nt, Homo sapiens
ccuauuagccauaugauaa

SEQ ID NO: 1247077 - RNA, 19 nt, Homo sapiens
ggaauugucaucuuuggaa

SEQ ID NO: 1247078 - RNA, 19 nt, Homo sapiens
aauggaaccugcccucuaa

SEQ ID NO: 1247079 - RNA, 19 nt, Homo sapiens
cagcuggguuggacugaua

SEQ ID NO: 1247080 - RNA, 19 nt, Homo sapiens
gaaacagguuaucagugaa

SEQ ID NO: 1247081 - RNA, 19 nt, Homo sapiens
gcaagcuccugaugaaauc

SEQ ID NO: 1247082 - RNA, 19 nt, Homo sapiens
guacagucuuggugccaua

SEQ ID NO: 1247083 - RNA, 19 nt, Homo sapiens
ccuaugaacugaccugaau

SEQ ID NO: 1247084 - RNA, 19 nt, Homo sapiens
gcacuagaauagcacuguu

SEQ ID NO: 1247085 - RNA, 19 nt, Homo sapiens
guuaggguauugauagauu

SEQ ID NO: 1247086 - RNA, 19 nt, Homo sapiens
gcagaauagauacucaaua

SEQ ID NO: 1247087 - RNA, 19 nt, Homo sapiens
gcacaaagugguagcacaa

SEQ ID NO: 1247088 - RNA, 19 nt, Homo sapiens
gaguagugcuuaugcugaa

SEQ ID NO: 1247089 - RNA, 19 nt, Homo sapiens
ggagccaaauucuaccauu

SEQ ID NO: 1247090 - RNA, 19 nt, Homo sapiens
gcacuguugcaaaguauuu

SEQ ID NO: 1247091 - RNA, 19 nt, Homo sapiens
ggguugauguacuuuauga

SEQ ID NO: 1247092 - RNA, 19 nt, Homo sapiens
cuacacagauaccaugaug

SEQ ID NO: 1247093 - RNA, 19 nt, Homo sapiens
ucaugacucuacacagaua

SEQ ID NO: 1247094 - RNA, 19 nt, Homo sapiens
gcagucauuuccuguuaau

SEQ ID NO: 1247095 - RNA, 19 nt, Homo sapiens
gugguuauguuaccuuuau

SEQ ID NO: 1247096 - RNA, 19 nt, Homo sapiens
guagagauagagccauaua

SEQ ID NO: 1247097 - RNA, 19 nt, Homo sapiens
ugaaguagcagcaaggaaa

SEQ ID NO: 1247098 - RNA, 19 nt, Homo sapiens
gagccaaauucuaccauuc

SEQ ID NO: 1247099 - RNA, 19 nt, Homo sapiens
uaagggauaucgacaagca

SEQ ID NO: 1247100 - RNA, 19 nt, Homo sapiens
aacaacaucucagacuuua

SEQ ID NO: 1247101 - RNA, 19 nt, Homo sapiens
aagcugugcuguuuagaaa

SEQ ID NO: 1247102 - RNA, 19 nt, Homo sapiens
uuacauagaggaacacaaa

SEQ ID NO: 1247103 - RNA, 19 nt, Homo sapiens
uagaaggaguaguugcaua

SEQ ID NO: 1247104 - RNA, 19 nt, Homo sapiens
gguaauagagccagaagga

SEQ ID NO: 1247105 - RNA, 19 nt, Homo sapiens
ugacacuuguuugaucuua

SEQ ID NO: 1247106 - RNA, 19 nt, Homo sapiens
gauuagagcaggugguuga

SEQ ID NO: 1247107 - RNA, 19 nt, Homo sapiens
gcccauacauguuuauucu

SEQ ID NO: 1247108 - RNA, 19 nt, Homo sapiens
cgacaagcaguuucuguuu

SEQ ID NO: 1247109 - RNA, 19 nt, Homo sapiens
aaacaacaucucagacuuu

SEQ ID NO: 1247110 - RNA, 19 nt, Homo sapiens
ccauuucacuaagcuauuu

SEQ ID NO: 1247111 - RNA, 19 nt, Homo sapiens
gcaggugguugaagagauc

SEQ ID NO: 1247112 - RNA, 19 nt, Homo sapiens
caaaggaugguuucuugaa

SEQ ID NO: 1247113 - RNA, 19 nt, Homo sapiens
aaacuuagcucuggaugag

SEQ ID NO: 1247114 - RNA, 19 nt, Homo sapiens
cguagaagaaagaacauua

SEQ ID NO: 1247115 - RNA, 19 nt, Homo sapiens
caacaucucagacuuuaca

SEQ ID NO: 1247116 - RNA, 19 nt, Homo sapiens
acacucaucugaaucaaca

SEQ ID NO: 1247117 - RNA, 19 nt, Homo sapiens
gcagauauaaauugugguu

SEQ ID NO: 1247118 - RNA, 19 nt, Homo sapiens
caaagcguuuauugagaaa

SEQ ID NO: 1247119 - RNA, 19 nt, Homo sapiens
ucauaucccuuaaacuuca

SEQ ID NO: 1247120 - RNA, 19 nt, Homo sapiens
agacagacgggaugaagua

SEQ ID NO: 1247121 - RNA, 19 nt, Homo sapiens
ggaugaggcugggcagaga

SEQ ID NO: 1247122 - RNA, 19 nt, Homo sapiens
guuaaacaaugaaguagca

SEQ ID NO: 1247123 - RNA, 19 nt, Homo sapiens
gaaccugcccucuaaagca

SEQ ID NO: 1247124 - RNA, 19 nt, Homo sapiens
acaaagugguagcacaauu

SEQ ID NO: 1247125 - RNA, 19 nt, Homo sapiens
gcauaucuguagcuuucaa

SEQ ID NO: 1247126 - RNA, 19 nt, Homo sapiens
aggcauaucuguagcuuuc

SEQ ID NO: 1247127 - RNA, 19 nt, Homo sapiens
gcuccaaacacuccucuaa

SEQ ID NO: 1247128 - RNA, 19 nt, Homo sapiens
acaaugauuucacaacuag

SEQ ID NO: 1247129 - RNA, 19 nt, Homo sapiens
gaagguguuuucguaaaua

SEQ ID NO: 1247130 - RNA, 19 nt, Homo sapiens
gagagauccugcauacagu

SEQ ID NO: 1247131 - RNA, 19 nt, Homo sapiens
cccauaaucuaauuucaga

SEQ ID NO: 1247132 - RNA, 19 nt, Homo sapiens
aagaaagccuuagguauca

SEQ ID NO: 1247133 - RNA, 19 nt, Homo sapiens
gauuuuagcugcugaacaa

SEQ ID NO: 1247134 - RNA, 19 nt, Homo sapiens
aucuguagcuuucaaguua

SEQ ID NO: 1247135 - RNA, 19 nt, Homo sapiens
uagagcaggugguugaaga

SEQ ID NO: 1247136 - RNA, 19 nt, Homo sapiens
gaaacuuagcucuggauga

SEQ ID NO: 1247137 - RNA, 19 nt, Homo sapiens
gauauuuccuaccuaagca

SEQ ID NO: 1247138 - RNA, 19 nt, Homo sapiens
guacuuacuuccaaagacu

SEQ ID NO: 1247139 - RNA, 19 nt, Homo sapiens
cuaagcacuuuacacauau

SEQ ID NO: 1247140 - RNA, 19 nt, Homo sapiens
gcacuuacuaugcuccaaa

SEQ ID NO: 1247141 - RNA, 19 nt, Homo sapiens
agacgaagcugccuuguua

SEQ ID NO: 1247142 - RNA, 19 nt, Homo sapiens
gcagaugacugaacaaguu

SEQ ID NO: 1247143 - RNA, 19 nt, Homo sapiens
guaaggauguagauguuua

SEQ ID NO: 1247144 - RNA, 19 nt, Homo sapiens
caauggagcucaucuggaa

SEQ ID NO: 1247145 - RNA, 19 nt, Homo sapiens
gaacagaaacaggugauuu

SEQ ID NO: 1247146 - RNA, 19 nt, Homo sapiens
ccauugaucugcacuacua

SEQ ID NO: 1247147 - RNA, 19 nt, Homo sapiens
gaacagacuuaugaguuga

SEQ ID NO: 1247148 - RNA, 19 nt, Homo sapiens
gcuccaggaugaugacaua

SEQ ID NO: 1247149 - RNA, 19 nt, Homo sapiens
gagcauguauggaggaaau

SEQ ID NO: 1247150 - RNA, 19 nt, Homo sapiens
ggauguagauguuuacucu

SEQ ID NO: 1247151 - RNA, 19 nt, Homo sapiens
gggagaugcugguauguga

SEQ ID NO: 1247152 - RNA, 19 nt, Homo sapiens
cagcagaacagacuuauga

SEQ ID NO: 1247153 - RNA, 19 nt, Homo sapiens
cgacgcagcuucucuccuu

SEQ ID NO: 1247154 - RNA, 19 nt, Homo sapiens
ugagaaaacucuucaauga

SEQ ID NO: 1247155 - RNA, 19 nt, Homo sapiens
ccaagaagaaccaaaugua

SEQ ID NO: 1247156 - RNA, 19 nt, Homo sapiens
ugacauccaucaaguaauc

SEQ ID NO: 1247157 - RNA, 19 nt, Homo sapiens
caaguucgcagcauuugua

SEQ ID NO: 1247158 - RNA, 19 nt, Homo sapiens
ccugagaacugcuucaaug

SEQ ID NO: 1247159 - RNA, 19 nt, Homo sapiens
gggaaaguaucgcgaguuc

SEQ ID NO: 1247160 - RNA, 19 nt, Homo sapiens
ugaaucccauggaaucuuu

SEQ ID NO: 1247161 - RNA, 19 nt, Homo sapiens
agaacagacuuaugaguug

SEQ ID NO: 1247162 - RNA, 19 nt, Homo sapiens
gacagaugcucuccaagga

SEQ ID NO: 1247163 - RNA, 19 nt, Homo sapiens
gagaauugacgaagaguug

SEQ ID NO: 1247164 - RNA, 19 nt, Homo sapiens
guagauguuuacucucaaa

SEQ ID NO: 1247165 - RNA, 19 nt, Homo sapiens
caagaagaaccaaauguau

SEQ ID NO: 1247166 - RNA, 19 nt, Homo sapiens
ucaaugugguaucuuugua

SEQ ID NO: 1247167 - RNA, 19 nt, Homo sapiens
gaacugcuucaauguggua

SEQ ID NO: 1247168 - RNA, 19 nt, Homo sapiens
gauguuuacucucaaaucu

SEQ ID NO: 1247169 - RNA, 19 nt, Homo sapiens
gcuucaaugugguaucuuu

SEQ ID NO: 1247170 - RNA, 19 nt, Homo sapiens
cagaaaaucucaauugguu

SEQ ID NO: 1247171 - RNA, 19 nt, Homo sapiens
gacgaagaguugacuggaa

SEQ ID NO: 1247172 - RNA, 19 nt, Homo sapiens
guauggcaauguauauaga

SEQ ID NO: 1247173 - RNA, 19 nt, Homo sapiens
gaaaguaucgcgaguucca

SEQ ID NO: 1247174 - RNA, 19 nt, Homo sapiens
cagaacagacuuaugaguu

SEQ ID NO: 1247175 - RNA, 19 nt, Homo sapiens
gaaccugugugagauucuu

SEQ ID NO: 1247176 - RNA, 19 nt, Homo sapiens
guggaaaugcugagacuuu

SEQ ID NO: 1247177 - RNA, 19 nt, Homo sapiens
guuggcagccuuugaguuu

SEQ ID NO: 1247178 - RNA, 19 nt, Homo sapiens
gcagugagaauccaagcaa

SEQ ID NO: 1247179 - RNA, 19 nt, Homo sapiens
caugacagcuucuggaacu

SEQ ID NO: 1247180 - RNA, 19 nt, Homo sapiens
acgaagaguugacuggaaa

SEQ ID NO: 1247181 - RNA, 19 nt, Homo sapiens
ccagagaauugacgaagag

SEQ ID NO: 1247182 - RNA, 19 nt, Homo sapiens
cagagauggugccaaguug

SEQ ID NO: 1247183 - RNA, 19 nt, Homo sapiens
gcaagcuccuccagucaca

SEQ ID NO: 1247184 - RNA, 19 nt, Homo sapiens
gggaacacccagacacuga

SEQ ID NO: 1247185 - RNA, 19 nt, Homo sapiens
ggaugaggcccgacagaug

SEQ ID NO: 1247186 - RNA, 19 nt, Homo sapiens
acagguuccucagggauua

SEQ ID NO: 1247187 - RNA, 19 nt, Homo sapiens
guucgcagcauuuguaaga

SEQ ID NO: 1247188 - RNA, 19 nt, Homo sapiens
gagaugcugguaugugaaa

SEQ ID NO: 1247189 - RNA, 19 nt, Homo sapiens
gagaauccaagcaaacaug

SEQ ID NO: 1247190 - RNA, 19 nt, Homo sapiens
caaugaaucccauggaauc

SEQ ID NO: 1247191 - RNA, 19 nt, Homo sapiens
gaaagccguccgcaacaau

SEQ ID NO: 1247192 - RNA, 19 nt, Homo sapiens
cugaguaauugguaucauu

SEQ ID NO: 1247193 - RNA, 19 nt, Homo sapiens
gugcauggagaaucugaua

SEQ ID NO: 1247194 - RNA, 19 nt, Homo sapiens
aagaagaccugugcaugga

SEQ ID NO: 1247195 - RNA, 19 nt, Homo sapiens
ugacucggcucuuguacuc

SEQ ID NO: 1247196 - RNA, 19 nt, Homo sapiens
ugugcgagguggacaguuu

SEQ ID NO: 1247197 - RNA, 19 nt, Homo sapiens
cuaaagauccagccaaugg

SEQ ID NO: 1247198 - RNA, 19 nt, Homo sapiens
ucaauugguucgagugagu

SEQ ID NO: 1247199 - RNA, 19 nt, Homo sapiens
gagcggauaccucugaaca

SEQ ID NO: 1247200 - RNA, 19 nt, Homo sapiens
cccuggagcugcacauuga

SEQ ID NO: 1247201 - RNA, 19 nt, Homo sapiens
guacgccucgggacuguuu

SEQ ID NO: 1247202 - RNA, 19 nt, Homo sapiens
gaaaccuccuucaacaaaa

SEQ ID NO: 1247203 - RNA, 19 nt, Homo sapiens
gagccaacagucacuuuga

SEQ ID NO: 1247204 - RNA, 19 nt, Homo sapiens
gcagccaggucuccauuuu

SEQ ID NO: 1247205 - RNA, 19 nt, Homo sapiens
ugaaagccguccgcaacaa

SEQ ID NO: 1247206 - RNA, 19 nt, Homo sapiens
gaacuucugaguaauuggu

SEQ ID NO: 1247207 - RNA, 19 nt, Homo sapiens
uguuuacucucaaaucuug

SEQ ID NO: 1247208 - RNA, 19 nt, Homo sapiens
cuauuucgguuccaacaug

SEQ ID NO: 1247209 - RNA, 19 nt, Homo sapiens
ugcaauugcugcuaaagau

SEQ ID NO: 1247210 - RNA, 19 nt, Homo sapiens
ccguaaggauguagauguu

SEQ ID NO: 1247211 - RNA, 19 nt, Homo sapiens
cagccaugaugcucaguga

SEQ ID NO: 1247212 - RNA, 19 nt, Homo sapiens
gagacgaagcugccuuguu

SEQ ID NO: 1247213 - RNA, 19 nt, Homo sapiens
ucagagauggugccaaguu

SEQ ID NO: 1247214 - RNA, 19 nt, Homo sapiens
ggcgugaauuccaagaaga

SEQ ID NO: 1247215 - RNA, 19 nt, Homo sapiens
uugaugacgucucggauug

SEQ ID NO: 1247216 - RNA, 19 nt, Homo sapiens
ggccugagcgggaagcauu

SEQ ID NO: 1247217 - RNA, 19 nt, Homo sapiens
uggcagccuuugaguuuga

SEQ ID NO: 1247218 - RNA, 19 nt, Homo sapiens
gcagaacagacuuaugagu

SEQ ID NO: 1247219 - RNA, 19 nt, Homo sapiens
ccuagugacucggcucuug

SEQ ID NO: 1247220 - RNA, 19 nt, Homo sapiens
ccaggaugaugacauagag

SEQ ID NO: 1247221 - RNA, 19 nt, Homo sapiens
cugagcaacuggugguuug

SEQ ID NO: 1247222 - RNA, 19 nt, Homo sapiens
gcacuggcacgaggaaugu

SEQ ID NO: 1247223 - RNA, 19 nt, Homo sapiens
aagagaaggcucacuggaa

SEQ ID NO: 1247224 - RNA, 19 nt, Homo sapiens
ucgauuacuuugauuacug

SEQ ID NO: 1247225 - RNA, 19 nt, Homo sapiens
caccuggagucucucuuga

SEQ ID NO: 1247226 - RNA, 19 nt, Homo sapiens
ggaggaaaugcaccagguu

SEQ ID NO: 1247227 - RNA, 19 nt, Homo sapiens
ucacacaaccucuauuucg

SEQ ID NO: 1247228 - RNA, 19 nt, Homo sapiens
gcccucaccuggagucucu

SEQ ID NO: 1247229 - RNA, 19 nt, Homo sapiens
ccaacagucacuuugauuc

SEQ ID NO: 1247230 - RNA, 19 nt, Homo sapiens
cagugagaauccaagcaaa

SEQ ID NO: 1247231 - RNA, 19 nt, Homo sapiens
gcaccagguugcaauugcu

SEQ ID NO: 1247232 - RNA, 19 nt, Homo sapiens
gccaacagucacuuugauu

SEQ ID NO: 1247233 - RNA, 19 nt, Homo sapiens
gagcgaggcugcuuuucug

SEQ ID NO: 1247234 - RNA, 19 nt, Homo sapiens
guuccaacaugagagaguu

SEQ ID NO: 1247235 - RNA, 19 nt, Homo sapiens
gcaauugcugcuaaagauc

SEQ ID NO: 1247236 - RNA, 19 nt, Homo sapiens
caaugugguaucuuuguau

SEQ ID NO: 1247237 - RNA, 19 nt, Homo sapiens
agucacacaaccucuauuu

SEQ ID NO: 1247238 - RNA, 19 nt, Homo sapiens
ggagaugcugguaugugaa

SEQ ID NO: 1247239 - RNA, 19 nt, Homo sapiens
ggugagagcagcccagaac

SEQ ID NO: 1247240 - RNA, 19 nt, Homo sapiens
gaacacccagacacugaca

SEQ ID NO: 1247241 - RNA, 19 nt, Homo sapiens
gauaguagcugaaauuaag

SEQ ID NO: 1247242 - RNA, 19 nt, Homo sapiens
cggcauagguucccucuua

SEQ ID NO: 1247243 - RNA, 19 nt, Homo sapiens
uaaagaggauggagauauu

SEQ ID NO: 1247244 - RNA, 19 nt, Homo sapiens
gggaggaacgcaaguauua

SEQ ID NO: 1247245 - RNA, 19 nt, Homo sapiens
ggacacacuugaccguaaa

SEQ ID NO: 1247246 - RNA, 19 nt, Homo sapiens
guagcguucugucucauua

SEQ ID NO: 1247247 - RNA, 19 nt, Homo sapiens
gauaucacauccaacaaga

SEQ ID NO: 1247248 - RNA, 19 nt, Homo sapiens
aaagauggcuucaccuaug

SEQ ID NO: 1247249 - RNA, 19 nt, Homo sapiens
gggcagagaugcugucagu

SEQ ID NO: 1247250 - RNA, 19 nt, Homo sapiens
gcaggugcaucacauacuu

SEQ ID NO: 1247251 - RNA, 19 nt, Homo sapiens
cuacagaggugccauugug

SEQ ID NO: 1247252 - RNA, 19 nt, Homo sapiens
caacacagcaauaaacuuc

SEQ ID NO: 1247253 - RNA, 19 nt, Homo sapiens
ccucaaggcugccaucugu

SEQ ID NO: 1247254 - RNA, 19 nt, Homo sapiens
ggauggagauauucuagca

SEQ ID NO: 1247255 - RNA, 19 nt, Homo sapiens
gcucugccauggacauuug

SEQ ID NO: 1247256 - RNA, 19 nt, Homo sapiens
acacagcaauaaacuucua

SEQ ID NO: 1247257 - RNA, 19 nt, Homo sapiens
ggaaugauaguagcugaaa

SEQ ID NO: 1247258 - RNA, 19 nt, Homo sapiens
caacaacacagcaauaaac

SEQ ID NO: 1247259 - RNA, 19 nt, Homo sapiens
gagauauucuagcauccaa

SEQ ID NO: 1247260 - RNA, 19 nt, Homo sapiens
ucaaagauggcuucaccua

SEQ ID NO: 1247261 - RNA, 19 nt, Homo sapiens
ggaccaaaauacauaaaga

SEQ ID NO: 1247262 - RNA, 19 nt, Homo sapiens
gcaccugggcucugcacua

SEQ ID NO: 1247263 - RNA, 19 nt, Homo sapiens
uagguucccucuuacuuga

SEQ ID NO: 1247264 - RNA, 19 nt, Homo sapiens
gaggaacgcaaguauuaug

SEQ ID NO: 1247265 - RNA, 19 nt, Homo sapiens
cacccucccuggacgauuu

SEQ ID NO: 1247266 - RNA, 19 nt, Homo sapiens
caagucgcguacauccuaa

SEQ ID NO: 1247267 - RNA, 19 nt, Homo sapiens
gaaugauaguagcugaaau

SEQ ID NO: 1247268 - RNA, 19 nt, Homo sapiens
gaguacagccggaccaugu

SEQ ID NO: 1247269 - RNA, 19 nt, Homo sapiens
caaagauggcuucaccuau

SEQ ID NO: 1247270 - RNA, 19 nt, Homo sapiens
uaaaggaucacauaucaac

SEQ ID NO: 1247271 - RNA, 19 nt, Homo sapiens
ggucgggcaucucuuccaa

SEQ ID NO: 1247272 - RNA, 19 nt, Homo sapiens
uagcugaaauuaagaacag

SEQ ID NO: 1247273 - RNA, 19 nt, Homo sapiens
ucacauccaacaagaaguu

SEQ ID NO: 1247274 - RNA, 19 nt, Homo sapiens
gcgaaucaguggcgaucau

SEQ ID NO: 1247275 - RNA, 19 nt, Homo sapiens
gcugccaucugucuuguag

SEQ ID NO: 1247276 - RNA, 19 nt, Homo sapiens
gaccuuggcaugcuccauu

SEQ ID NO: 1247277 - RNA, 19 nt, Homo sapiens
uggacacacuugaccguaa

SEQ ID NO: 1247278 - RNA, 19 nt, Homo sapiens
ugacauagacacugugaag

SEQ ID NO: 1247279 - RNA, 19 nt, Homo sapiens
acaagucgcguacauccua

SEQ ID NO: 1247280 - RNA, 19 nt, Homo sapiens
acacacaagucgcguacau

SEQ ID NO: 1247281 - RNA, 19 nt, Homo sapiens
gaggugccauugugggaau

SEQ ID NO: 1247282 - RNA, 19 nt, Homo sapiens
ccaacaacacagcaauaaa

SEQ ID NO: 1247283 - RNA, 19 nt, Homo sapiens
ggagggagagggaggaaca

SEQ ID NO: 1247284 - RNA, 19 nt, Homo sapiens
ccacuccgcugccuguucu

SEQ ID NO: 1247285 - RNA, 19 nt, Homo sapiens
caagggaggaacgcaagua

SEQ ID NO: 1247286 - RNA, 19 nt, Homo sapiens
ccaagaguggcaucgagua

SEQ ID NO: 1247287 - RNA, 19 nt, Homo sapiens
cagcaauaaacuucuauga

SEQ ID NO: 1247288 - RNA, 19 nt, Homo sapiens
gguucccucuuacuugaaa

SEQ ID NO: 1247289 - RNA, 19 nt, Homo sapiens
cacaggcggucacgcauca

SEQ ID NO: 1247290 - RNA, 19 nt, Homo sapiens
ggaggaacgcaaguauuau

SEQ ID NO: 1247291 - RNA, 19 nt, Homo sapiens
gacccaguguggcugcauu

SEQ ID NO: 1247292 - RNA, 19 nt, Homo sapiens
ucaagcagcaccacuaucu

SEQ ID NO: 1247293 - RNA, 19 nt, Homo sapiens
caccaacaacacagcaaua

SEQ ID NO: 1247294 - RNA, 19 nt, Homo sapiens
gaugacauagacacuguga

SEQ ID NO: 1247295 - RNA, 19 nt, Homo sapiens
caugugauuucuauuucug

SEQ ID NO: 1247296 - RNA, 19 nt, Homo sapiens
gaacaggaccaaaauacau

SEQ ID NO: 1247297 - RNA, 19 nt, Homo sapiens
gugcaucacauacuucuag

SEQ ID NO: 1247298 - RNA, 19 nt, Homo sapiens
ccagaaccagcccaaagaa

SEQ ID NO: 1247299 - RNA, 19 nt, Homo sapiens
guacagccggaccauguga

SEQ ID NO: 1247300 - RNA, 19 nt, Homo sapiens
ccucugccacgaugacaua

SEQ ID NO: 1247301 - RNA, 19 nt, Homo sapiens
gaggauggagauauucuag

SEQ ID NO: 1247302 - RNA, 19 nt, Homo sapiens
gcgcugagcccuacaacac

SEQ ID NO: 1247303 - RNA, 19 nt, Homo sapiens
caaguauuauggacacacu

SEQ ID NO: 1247304 - RNA, 19 nt, Homo sapiens
ggaacgcaaguauuaugga

SEQ ID NO: 1247305 - RNA, 19 nt, Homo sapiens
caucugaccccuucuguuu

SEQ ID NO: 1247306 - RNA, 19 nt, Homo sapiens
caaagccauuuaccugcau

SEQ ID NO: 1247307 - RNA, 19 nt, Homo sapiens
guucaggaagcacggcaua

SEQ ID NO: 1247308 - RNA, 19 nt, Homo sapiens
ucucauuacgagcaaauaa

SEQ ID NO: 1247309 - RNA, 19 nt, Homo sapiens
caccugggcucugcacuag

SEQ ID NO: 1247310 - RNA, 19 nt, Homo sapiens
aagauggcuucaccuaugu

SEQ ID NO: 1247311 - RNA, 19 nt, Homo sapiens
caugcugacugccugaauc

SEQ ID NO: 1247312 - RNA, 19 nt, Homo sapiens
uagcugcagugucacaaag

SEQ ID NO: 1247313 - RNA, 19 nt, Homo sapiens
accacuaucuccccuauua

SEQ ID NO: 1247314 - RNA, 19 nt, Homo sapiens
auaaagaggauggagauau

SEQ ID NO: 1247315 - RNA, 19 nt, Homo sapiens
ggaccacugcaaagccauu

SEQ ID NO: 1247316 - RNA, 19 nt, Homo sapiens
ucgcguacauccuaagucu

SEQ ID NO: 1247317 - RNA, 19 nt, Homo sapiens
cauagguucccucuuacuu

SEQ ID NO: 1247318 - RNA, 19 nt, Homo sapiens
cauaaagaggauggagaua

SEQ ID NO: 1247319 - RNA, 19 nt, Homo sapiens
acgaugacauagacacugu

SEQ ID NO: 1247320 - RNA, 19 nt, Homo sapiens
gcaccacuaucuccccuau

SEQ ID NO: 1247321 - RNA, 19 nt, Homo sapiens
uaucacauccaacaagaag

SEQ ID NO: 1247322 - RNA, 19 nt, Homo sapiens
caucacauacuucuagcau

SEQ ID NO: 1247323 - RNA, 19 nt, Homo sapiens
guuuaaaggaucacauauc

SEQ ID NO: 1247324 - RNA, 19 nt, Homo sapiens
ucuccacccugcauuccaa

SEQ ID NO: 1247325 - RNA, 19 nt, Homo sapiens
ggcauagguucccucuuac

SEQ ID NO: 1247326 - RNA, 19 nt, Homo sapiens
gcaguguccagcccagugu

SEQ ID NO: 1247327 - RNA, 19 nt, Homo sapiens
uaagaacaggaccaaaaua

SEQ ID NO: 1247328 - RNA, 19 nt, Homo sapiens
gaaucaguggcgaucaugu

SEQ ID NO: 1247329 - RNA, 19 nt, Homo sapiens
acauaaagaggauggagau

SEQ ID NO: 1247330 - RNA, 19 nt, Homo sapiens
gcauagcugcagugucaca

SEQ ID NO: 1247331 - RNA, 19 nt, Homo sapiens
gggaaugauaguagcugaa

SEQ ID NO: 1247332 - RNA, 19 nt, Homo sapiens
gauauucuagcauccaacu

SEQ ID NO: 1247333 - RNA, 19 nt, Homo sapiens
ggagauauucuagcaucca

SEQ ID NO: 1247334 - RNA, 19 nt, Homo sapiens
gaaguaccauuaccauaaa

SEQ ID NO: 1247335 - RNA, 19 nt, Homo sapiens
gaagauugauuugcucauu

SEQ ID NO: 1247336 - RNA, 19 nt, Homo sapiens
cauuugagcuccauagauu

SEQ ID NO: 1247337 - RNA, 19 nt, Homo sapiens
gcagagggaagauugauuu

SEQ ID NO: 1247338 - RNA, 19 nt, Homo sapiens
gcacaacacaggccgcaua

SEQ ID NO: 1247339 - RNA, 19 nt, Homo sapiens
ugaaguaccauuaccauaa

SEQ ID NO: 1247340 - RNA, 19 nt, Homo sapiens
caagugaggugguauaugc

SEQ ID NO: 1247341 - RNA, 19 nt, Homo sapiens
gauguuaaagggaucauaa

SEQ ID NO: 1247342 - RNA, 19 nt, Homo sapiens
guggguaucucacuuuguu

SEQ ID NO: 1247343 - RNA, 19 nt, Homo sapiens
gacaagaggaggaccaauu

SEQ ID NO: 1247344 - RNA, 19 nt, Homo sapiens
gaggagacagaaucagaua

SEQ ID NO: 1247345 - RNA, 19 nt, Homo sapiens
cuugugagcugaaucuuga

SEQ ID NO: 1247346 - RNA, 19 nt, Homo sapiens
ggagguaggugucuaaacc

SEQ ID NO: 1247347 - RNA, 19 nt, Homo sapiens
gagacagaaucagauacua

SEQ ID NO: 1247348 - RNA, 19 nt, Homo sapiens
caacacaggccgcauaugg

SEQ ID NO: 1247349 - RNA, 19 nt, Homo sapiens
ggaaaagccuuagcacuug

SEQ ID NO: 1247350 - RNA, 19 nt, Homo sapiens
cauuagcuguuuaucauga

SEQ ID NO: 1247351 - RNA, 19 nt, Homo sapiens
ggagguggguaucucacuu

SEQ ID NO: 1247352 - RNA, 19 nt, Homo sapiens
agauugacauucugauuug

SEQ ID NO: 1247353 - RNA, 19 nt, Homo sapiens
gagggaagauugauuugcu

SEQ ID NO: 1247354 - RNA, 19 nt, Homo sapiens
gcagggagguaggugucua

SEQ ID NO: 1247355 - RNA, 19 nt, Homo sapiens
caugauugaaguaccauua

SEQ ID NO: 1247356 - RNA, 19 nt, Homo sapiens
cacagugccuggccugauu

SEQ ID NO: 1247357 - RNA, 19 nt, Homo sapiens
gagcucaagugauccucuu

SEQ ID NO: 1247358 - RNA, 19 nt, Homo sapiens
gcaggggcauguucauuaa

SEQ ID NO: 1247359 - RNA, 19 nt, Homo sapiens
cuacuucacugcaggaaag

SEQ ID NO: 1247360 - RNA, 19 nt, Homo sapiens
cuugacaucuuaacuacuu

SEQ ID NO: 1247361 - RNA, 19 nt, Homo sapiens
caacuuauugcaugauuca

SEQ ID NO: 1247362 - RNA, 19 nt, Homo sapiens
cacuuguugugaacuauua

SEQ ID NO: 1247363 - RNA, 19 nt, Homo sapiens
cagcaggaacugugaacua

SEQ ID NO: 1247364 - RNA, 19 nt, Homo sapiens
ggagaauugcggcgaaaga

SEQ ID NO: 1247365 - RNA, 19 nt, Homo sapiens
gcaguuagacagcuuggau

SEQ ID NO: 1247366 - RNA, 19 nt, Homo sapiens
gcuaugaucacaccacugu

SEQ ID NO: 1247367 - RNA, 19 nt, Homo sapiens
ugcauuagcuguuuaucau

SEQ ID NO: 1247368 - RNA, 19 nt, Homo sapiens
uugcaugauucacuacuuu

SEQ ID NO: 1247369 - RNA, 19 nt, Homo sapiens
uagcacuuguugugaacua

SEQ ID NO: 1247370 - RNA, 19 nt, Homo sapiens
ugauacagguguucuaggu

SEQ ID NO: 1247371 - RNA, 19 nt, Homo sapiens
ggacacggagacccacauu

SEQ ID NO: 1247372 - RNA, 19 nt, Homo sapiens
cuuauugcaugauucacua

SEQ ID NO: 1247373 - RNA, 19 nt, Homo sapiens
gcacuuguugugaacuauu

SEQ ID NO: 1247374 - RNA, 19 nt, Homo sapiens
gaacccacgccugguacua

SEQ ID NO: 1247375 - RNA, 19 nt, Homo sapiens
cauaaaugcuauacaucca

SEQ ID NO: 1247376 - RNA, 19 nt, Homo sapiens
gaacucccgugagcucaag

SEQ ID NO: 1247377 - RNA, 19 nt, Homo sapiens
cacugugccuggcuaguuu

SEQ ID NO: 1247378 - RNA, 19 nt, Homo sapiens
ggagacccacauuagguuu

SEQ ID NO: 1247379 - RNA, 19 nt, Homo sapiens
gagguggguaucucacuuu

SEQ ID NO: 1247380 - RNA, 19 nt, Homo sapiens
ggugguauaugccuguagu

SEQ ID NO: 1247381 - RNA, 19 nt, Homo sapiens
ugccuggccugauucauga

SEQ ID NO: 1247382 - RNA, 19 nt, Homo sapiens
cccgugagcucaagugauc

SEQ ID NO: 1247383 - RNA, 19 nt, Homo sapiens
cagaggagacagaaucaga

SEQ ID NO: 1247384 - RNA, 19 nt, Homo sapiens
ucucaugccuugcguaugc

SEQ ID NO: 1247385 - RNA, 19 nt, Homo sapiens
cugcaugcauuagcuguuu

SEQ ID NO: 1247386 - RNA, 19 nt, Homo sapiens
uugcuuccauucccacuaa

SEQ ID NO: 1247387 - RNA, 19 nt, Homo sapiens
cugguacuaucugaauuua

SEQ ID NO: 1247388 - RNA, 19 nt, Homo sapiens
cuccauagauugacauucu

SEQ ID NO: 1247389 - RNA, 19 nt, Homo sapiens
gaggugggaggacugauug

SEQ ID NO: 1247390 - RNA, 19 nt, Homo sapiens
ucacugcagccuugaauuc

SEQ ID NO: 1247391 - RNA, 19 nt, Homo sapiens
gagggcagagggaagauug

SEQ ID NO: 1247392 - RNA, 19 nt, Homo sapiens
ccuuagcacuuguugugaa

SEQ ID NO: 1247393 - RNA, 19 nt, Homo sapiens
uaucucagcuuucuuuuca

SEQ ID NO: 1247394 - RNA, 19 nt, Homo sapiens
auuaagcccugcaugcauu

SEQ ID NO: 1247395 - RNA, 19 nt, Homo sapiens
acacggagacccacauuag

SEQ ID NO: 1247396 - RNA, 19 nt, Homo sapiens
gauugacauucugauuuga

SEQ ID NO: 1247397 - RNA, 19 nt, Homo sapiens
gcuauacauccaugcauug

SEQ ID NO: 1247398 - RNA, 19 nt, Homo sapiens
ugagcugaaucuugagaga

SEQ ID NO: 1247399 - RNA, 19 nt, Homo sapiens
uaaaccaggaugugagcua

SEQ ID NO: 1247400 - RNA, 19 nt, Homo sapiens
ggagacagaaucagauacu

SEQ ID NO: 1247401 - RNA, 19 nt, Homo sapiens
gggaaaagccuuagcacuu

SEQ ID NO: 1247402 - RNA, 19 nt, Homo sapiens
acccaucaccuagguauua

SEQ ID NO: 1247403 - RNA, 19 nt, Homo sapiens
caacccaucaccuagguau

SEQ ID NO: 1247404 - RNA, 19 nt, Homo sapiens
ccuaucaacccaucaccua

SEQ ID NO: 1247405 - RNA, 19 nt, Homo sapiens
gacacggagacccacauua

SEQ ID NO: 1247406 - RNA, 19 nt, Homo sapiens
uugaacaguuucccauaga

SEQ ID NO: 1247407 - RNA, 19 nt, Homo sapiens
gaggugguauaugccugua

SEQ ID NO: 1247408 - RNA, 19 nt, Homo sapiens
gggagcaguuagacagcuu

SEQ ID NO: 1247409 - RNA, 19 nt, Homo sapiens
ggagagucggugucuguug

SEQ ID NO: 1247410 - RNA, 19 nt, Homo sapiens
caccagcaccuguuucuca

SEQ ID NO: 1247411 - RNA, 19 nt, Homo sapiens
aggaugugcagguuuguua

SEQ ID NO: 1247412 - RNA, 19 nt, Homo sapiens
caggauacaugugcaggau

SEQ ID NO: 1247413 - RNA, 19 nt, Homo sapiens
gaggagggcagagggaaga

SEQ ID NO: 1247414 - RNA, 19 nt, Homo sapiens
gaaaagccuuagcacuugu

SEQ ID NO: 1247415 - RNA, 19 nt, Homo sapiens
ggacagguucaugcccuuu

SEQ ID NO: 1247416 - RNA, 19 nt, Homo sapiens
cccaucaccuagguauuaa

SEQ ID NO: 1247417 - RNA, 19 nt, Homo sapiens
uaugugccauggugguuug

SEQ ID NO: 1247418 - RNA, 19 nt, Homo sapiens
gugcuuggcagacagaguu

SEQ ID NO: 1247419 - RNA, 19 nt, Homo sapiens
acaagaggaggaccaauuc

SEQ ID NO: 1247420 - RNA, 19 nt, Homo sapiens
gagcuccaguccugaacca

SEQ ID NO: 1247421 - RNA, 19 nt, Homo sapiens
gcccagaggagacagaauc

SEQ ID NO: 1247422 - RNA, 19 nt, Homo sapiens
ggccgcauauggacacaca

SEQ ID NO: 1247423 - RNA, 19 nt, Homo sapiens
gaugcugucccuccugaug

SEQ ID NO: 1247424 - RNA, 19 nt, Homo sapiens
uuagaguguuccuaugugu

SEQ ID NO: 1247425 - RNA, 19 nt, Homo sapiens
ccugguacuaucugaauuu

SEQ ID NO: 1247426 - RNA, 19 nt, Homo sapiens
ugcuauacauccaugcauu

SEQ ID NO: 1247427 - RNA, 19 nt, Homo sapiens
gugccuggccugauucaug

SEQ ID NO: 1247428 - RNA, 19 nt, Homo sapiens
ucacugugccuggcuaguu

SEQ ID NO: 1247429 - RNA, 19 nt, Homo sapiens
cagcuacucaggagguuga

SEQ ID NO: 1247430 - RNA, 19 nt, Homo sapiens
ggcaggggcauguucauua

SEQ ID NO: 1247431 - RNA, 19 nt, Homo sapiens
uuagacagcuuggauuuug

SEQ ID NO: 1247432 - RNA, 19 nt, Homo sapiens
agacagaaucagauacuag

SEQ ID NO: 1247433 - RNA, 19 nt, Homo sapiens
gcaaggccugcccacaaug

SEQ ID NO: 1247434 - RNA, 19 nt, Homo sapiens
gcacaugccuguaauauca

SEQ ID NO: 1247435 - RNA, 19 nt, Homo sapiens
gaaaggaccucagaagaaa

SEQ ID NO: 1247436 - RNA, 19 nt, Homo sapiens
ggaguagccuggaauuuaa

SEQ ID NO: 1247437 - RNA, 19 nt, Homo sapiens
gagcagaucuggaggaaga

SEQ ID NO: 1247438 - RNA, 19 nt, Homo sapiens
gaaacuccgucuccacuaa

SEQ ID NO: 1247439 - RNA, 19 nt, Homo sapiens
gaagaaacaauacgcauuu

SEQ ID NO: 1247440 - RNA, 19 nt, Homo sapiens
gagcugagaucacaccauu

SEQ ID NO: 1247441 - RNA, 19 nt, Homo sapiens
gagcggagacgguaguuua

SEQ ID NO: 1247442 - RNA, 19 nt, Homo sapiens
gggaguagccuggaauuua

SEQ ID NO: 1247443 - RNA, 19 nt, Homo sapiens
gagaaccucuucauauugu

SEQ ID NO: 1247444 - RNA, 19 nt, Homo sapiens
gaggagcacuuucagaguu

SEQ ID NO: 1247445 - RNA, 19 nt, Homo sapiens
cagaagaacagaaguuuaa

SEQ ID NO: 1247446 - RNA, 19 nt, Homo sapiens
gaaagcuccuggugaccua

SEQ ID NO: 1247447 - RNA, 19 nt, Homo sapiens
uuagaaagcuguugcuguu

SEQ ID NO: 1247448 - RNA, 19 nt, Homo sapiens
gagcagcuaucccuggaaa

SEQ ID NO: 1247449 - RNA, 19 nt, Homo sapiens
caauacgcauuuacucuuu

SEQ ID NO: 1247450 - RNA, 19 nt, Homo sapiens
gcaguuccuuucuucauga

SEQ ID NO: 1247451 - RNA, 19 nt, Homo sapiens
agaaagcuguugcuguuaa

SEQ ID NO: 1247452 - RNA, 19 nt, Homo sapiens
guuccuuucuucaugauua

SEQ ID NO: 1247453 - RNA, 19 nt, Homo sapiens
gagcaaaacucucccuaaa

SEQ ID NO: 1247454 - RNA, 19 nt, Homo sapiens
gcaauaauaccucugacaa

SEQ ID NO: 1247455 - RNA, 19 nt, Homo sapiens
ggauuauucuccaggcuuu

SEQ ID NO: 1247456 - RNA, 19 nt, Homo sapiens
gggcuucagugacuuagaa

SEQ ID NO: 1247457 - RNA, 19 nt, Homo sapiens
ugaucacgcuggccaauuu

SEQ ID NO: 1247458 - RNA, 19 nt, Homo sapiens
gaacuucaccuaugaucug

SEQ ID NO: 1247459 - RNA, 19 nt, Homo sapiens
agacgguaguuuaguauuu

SEQ ID NO: 1247460 - RNA, 19 nt, Homo sapiens
uaagauuuccguuauggua

SEQ ID NO: 1247461 - RNA, 19 nt, Homo sapiens
cuucuaagcugaccuagug

SEQ ID NO: 1247462 - RNA, 19 nt, Homo sapiens
gaugacacaugugaccuuu

SEQ ID NO: 1247463 - RNA, 19 nt, Homo sapiens
caauauacguagcaacugu

SEQ ID NO: 1247464 - RNA, 19 nt, Homo sapiens
gaguuuaugugcacaagug

SEQ ID NO: 1247465 - RNA, 19 nt, Homo sapiens
gacauuacaccauugauga

SEQ ID NO: 1247466 - RNA, 19 nt, Homo sapiens
ggacaugaggaacuaacua

SEQ ID NO: 1247467 - RNA, 19 nt, Homo sapiens
gaaaucgacaagaugguuu

SEQ ID NO: 1247468 - RNA, 19 nt, Homo sapiens
gaccucagaagaaacaaua

SEQ ID NO: 1247469 - RNA, 19 nt, Homo sapiens
gcccaugaguguauaacaa

SEQ ID NO: 1247470 - RNA, 19 nt, Homo sapiens
cggagacgguaguuuagua

SEQ ID NO: 1247471 - RNA, 19 nt, Homo sapiens
uuacggacauuacaccauu

SEQ ID NO: 1247472 - RNA, 19 nt, Homo sapiens
gugcagcuguguuuaccua

SEQ ID NO: 1247473 - RNA, 19 nt, Homo sapiens
gaaauguacaagcugauga

SEQ ID NO: 1247474 - RNA, 19 nt, Homo sapiens
ggacauuacaccauugaug

SEQ ID NO: 1247475 - RNA, 19 nt, Homo sapiens
uaaugcaugugccuuuauu

SEQ ID NO: 1247476 - RNA, 19 nt, Homo sapiens
auuggaggcugguuucuua

SEQ ID NO: 1247477 - RNA, 19 nt, Homo sapiens
uaucuaccgucuauuguga

SEQ ID NO: 1247478 - RNA, 19 nt, Homo sapiens
agaaaggaccucagaagaa

SEQ ID NO: 1247479 - RNA, 19 nt, Homo sapiens
uaacagaagaacagaaguu

SEQ ID NO: 1247480 - RNA, 19 nt, Homo sapiens
aaagggacaugaggaacua

SEQ ID NO: 1247481 - RNA, 19 nt, Homo sapiens
aaaggucgguggaaggauu

SEQ ID NO: 1247482 - RNA, 19 nt, Homo sapiens
gacgguaguuuaguauuug

SEQ ID NO: 1247483 - RNA, 19 nt, Homo sapiens
uaacuagacugagcgugaa

SEQ ID NO: 1247484 - RNA, 19 nt, Homo sapiens
aauaauaccucugacaauc

SEQ ID NO: 1247485 - RNA, 19 nt, Homo sapiens
gaaagaaugcggcagaaaa

SEQ ID NO: 1247486 - RNA, 19 nt, Homo sapiens
gguaucuucucgucccuuu

SEQ ID NO: 1247487 - RNA, 19 nt, Homo sapiens
aaacacacacguccacauu

SEQ ID NO: 1247488 - RNA, 19 nt, Homo sapiens
uguacaagcugaugaucuu

SEQ ID NO: 1247489 - RNA, 19 nt, Homo sapiens
gaaacaauacgcauuuacu

SEQ ID NO: 1247490 - RNA, 19 nt, Homo sapiens
gcagaaaggaccucagaag

SEQ ID NO: 1247491 - RNA, 19 nt, Homo sapiens
cagaguuacugcaacaaga

SEQ ID NO: 1247492 - RNA, 19 nt, Homo sapiens
uuucagaacuucaccuaug

SEQ ID NO: 1247493 - RNA, 19 nt, Homo sapiens
ggaaaucgacaagaugguu

SEQ ID NO: 1247494 - RNA, 19 nt, Homo sapiens
uaacccagcccuuaauuag

SEQ ID NO: 1247495 - RNA, 19 nt, Homo sapiens
gggcuguguuuggcaauaa

SEQ ID NO: 1247496 - RNA, 19 nt, Homo sapiens
gaucuucgacuucaucauc

SEQ ID NO: 1247497 - RNA, 19 nt, Homo sapiens
gaagaacagaaguuuaagu

SEQ ID NO: 1247498 - RNA, 19 nt, Homo sapiens
gcaggagaauugcuugaac

SEQ ID NO: 1247499 - RNA, 19 nt, Homo sapiens
cgugacaagugcuaccuaa

SEQ ID NO: 1247500 - RNA, 19 nt, Homo sapiens
gaguuugccauuccugaua

SEQ ID NO: 1247501 - RNA, 19 nt, Homo sapiens
cagaaaggaccucagaaga

SEQ ID NO: 1247502 - RNA, 19 nt, Homo sapiens
gagguggaguuugcaguga

SEQ ID NO: 1247503 - RNA, 19 nt, Homo sapiens
gaacccaggagguggaguu

SEQ ID NO: 1247504 - RNA, 19 nt, Homo sapiens
cagcggcucacgccuguua

SEQ ID NO: 1247505 - RNA, 19 nt, Homo sapiens
uuaauuagggcuucaguga

SEQ ID NO: 1247506 - RNA, 19 nt, Homo sapiens
gaggaacuaacuagacuga

SEQ ID NO: 1247507 - RNA, 19 nt, Homo sapiens
uaccuaauccagaaacuaa

SEQ ID NO: 1247508 - RNA, 19 nt, Homo sapiens
uauuguaucuaccgucuau

SEQ ID NO: 1247509 - RNA, 19 nt, Homo sapiens
gaaccucuucauauuguau

SEQ ID NO: 1247510 - RNA, 19 nt, Homo sapiens
aggagcacuuucagaguua

SEQ ID NO: 1247511 - RNA, 19 nt, Homo sapiens
gaaagcuguugcuguuaac

SEQ ID NO: 1247512 - RNA, 19 nt, Homo sapiens
gaccagcccaugaguguau

SEQ ID NO: 1247513 - RNA, 19 nt, Homo sapiens
aagcucagccuguuaauca

SEQ ID NO: 1247514 - RNA, 19 nt, Homo sapiens
cauaugugcagcuguguuu

SEQ ID NO: 1247515 - RNA, 19 nt, Homo sapiens
acgcaucccuuccucgaaa

SEQ ID NO: 1247516 - RNA, 19 nt, Homo sapiens
guucagagcauccaauucu

SEQ ID NO: 1247517 - RNA, 19 nt, Homo sapiens
gcaauugcaacccugaaau

SEQ ID NO: 1247518 - RNA, 19 nt, Homo sapiens
ugacacucuucguggauuu

SEQ ID NO: 1247519 - RNA, 19 nt, Homo sapiens
ugacaauccuuaggugugu

SEQ ID NO: 1247520 - RNA, 19 nt, Homo sapiens
gcccugagccuucuuugga

SEQ ID NO: 1247521 - RNA, 19 nt, Homo sapiens
ggacuguaguuuuguaaug

SEQ ID NO: 1247522 - RNA, 19 nt, Homo sapiens
ucagagcauccaauucuaa

SEQ ID NO: 1247523 - RNA, 19 nt, Homo sapiens
acagaagaacagaaguuua

SEQ ID NO: 1247524 - RNA, 19 nt, Homo sapiens
auaccucauuguaagcuua

SEQ ID NO: 1247525 - RNA, 19 nt, Homo sapiens
ucucuuaagauuuccguua

SEQ ID NO: 1247526 - RNA, 19 nt, Homo sapiens
uuuaaugcaugugccuuua

SEQ ID NO: 1247527 - RNA, 19 nt, Homo sapiens
ccugagccuucuuuggaua

SEQ ID NO: 1247528 - RNA, 19 nt, Homo sapiens
ugacaagugcuaccuaauc

SEQ ID NO: 1247529 - RNA, 19 nt, Homo sapiens
ugacacaugugaccuuugc

SEQ ID NO: 1247530 - RNA, 19 nt, Homo sapiens
guauuugagccacgaguuu

SEQ ID NO: 1247531 - RNA, 19 nt, Homo sapiens
ggagacgguaguuuaguau

SEQ ID NO: 1247532 - RNA, 19 nt, Homo sapiens
cuaacccagcccuuaauua

SEQ ID NO: 1247533 - RNA, 19 nt, Homo sapiens
uuauuugccucaucauguu

SEQ ID NO: 1247534 - RNA, 19 nt, Homo sapiens
caaauuccuucuuucgaua

SEQ ID NO: 1247535 - RNA, 19 nt, Homo sapiens
gcucaggggucaccuauua

SEQ ID NO: 1247536 - RNA, 19 nt, Homo sapiens
cacgggaaguuguuauuua

SEQ ID NO: 1247537 - RNA, 19 nt, Homo sapiens
ggaccgggauggacaagug

SEQ ID NO: 1247538 - RNA, 19 nt, Homo sapiens
caccuucucuggacaguuu

SEQ ID NO: 1247539 - RNA, 19 nt, Homo sapiens
ccaaauuccuucuuucgau

SEQ ID NO: 1247540 - RNA, 19 nt, Homo sapiens
guuauggugucuacguaua

SEQ ID NO: 1247541 - RNA, 19 nt, Homo sapiens
gaacgguuauggugucuac

SEQ ID NO: 1247542 - RNA, 19 nt, Homo sapiens
ggacagagacaaccaagag

SEQ ID NO: 1247543 - RNA, 19 nt, Homo sapiens
gggaaguuguuauuuaaag

SEQ ID NO: 1247544 - RNA, 19 nt, Homo sapiens
gcacagcgacgucuucagu

SEQ ID NO: 1247545 - RNA, 19 nt, Homo sapiens
ggcagaugcucuuucagaa

SEQ ID NO: 1247546 - RNA, 19 nt, Homo sapiens
gggcagaugcucuuucaga

SEQ ID NO: 1247547 - RNA, 19 nt, Homo sapiens
gggaguacgugcucaugau

SEQ ID NO: 1247548 - RNA, 19 nt, Homo sapiens
acgggaaguuguuauuuaa

SEQ ID NO: 1247549 - RNA, 19 nt, Homo sapiens
ucagaacggugacaaguac

SEQ ID NO: 1247550 - RNA, 19 nt, Homo sapiens
gcuacggcgucauggagua

SEQ ID NO: 1247551 - RNA, 19 nt, Homo sapiens
auacccaaauuccuucuuu

SEQ ID NO: 1247552 - RNA, 19 nt, Homo sapiens
uauuauggguuguggauca

SEQ ID NO: 1247553 - RNA, 19 nt, Homo sapiens
gauaugaaggagaauggaa

SEQ ID NO: 1247554 - RNA, 19 nt, Homo sapiens
gcauuugggugcccuccau

SEQ ID NO: 1247555 - RNA, 19 nt, Homo sapiens
gugccgaguucacagaugu

SEQ ID NO: 1247556 - RNA, 19 nt, Homo sapiens
ggacagccuccacaagaag

SEQ ID NO: 1247557 - RNA, 19 nt, Homo sapiens
guccggaggugauggaagu

SEQ ID NO: 1247558 - RNA, 19 nt, Homo sapiens
gcgggaaggacacggguuu

SEQ ID NO: 1247559 - RNA, 19 nt, Homo sapiens
ggagagaucacgggagaag

SEQ ID NO: 1247560 - RNA, 19 nt, Homo sapiens
guugcuggcuugaauaaaa

SEQ ID NO: 1247561 - RNA, 19 nt, Homo sapiens
ucacgggaaguuguuauuu

SEQ ID NO: 1247562 - RNA, 19 nt, Homo sapiens
agauggcaguuauuacgaa

SEQ ID NO: 1247563 - RNA, 19 nt, Homo sapiens
cgugguugcuggcuugaau

SEQ ID NO: 1247564 - RNA, 19 nt, Homo sapiens
caaccaagagacacucauc

SEQ ID NO: 1247565 - RNA, 19 nt, Homo sapiens
ggaaggacacggguuucug

SEQ ID NO: 1247566 - RNA, 19 nt, Homo sapiens
cgguuauggugucuacgua

SEQ ID NO: 1247567 - RNA, 19 nt, Homo sapiens
caaaguggacagagacaac

SEQ ID NO: 1247568 - RNA, 19 nt, Homo sapiens
ggaguacgugcucaugauc

SEQ ID NO: 1247569 - RNA, 19 nt, Homo sapiens
gcagaugcucuuucagaac

SEQ ID NO: 1247570 - RNA, 19 nt, Homo sapiens
gacagagacaaccaagaga

SEQ ID NO: 1247571 - RNA, 19 nt, Homo sapiens
cagaacaagcuacgaggau

SEQ ID NO: 1247572 - RNA, 19 nt, Homo sapiens
ucaaggcuacggcgucaug

SEQ ID NO: 1247573 - RNA, 19 nt, Homo sapiens
ggaaagcagggaggaagca

SEQ ID NO: 1247574 - RNA, 19 nt, Homo sapiens
gcacggucacgggaaguug

SEQ ID NO: 1247575 - RNA, 19 nt, Homo sapiens
cugggcagaugcucuuuca

SEQ ID NO: 1247576 - RNA, 19 nt, Homo sapiens
aaagauggcaguuauuacg

SEQ ID NO: 1247577 - RNA, 19 nt, Homo sapiens
uaaagauggcaguuauuac

SEQ ID NO: 1247578 - RNA, 19 nt, Homo sapiens
guucgaaugcaucccuuau

SEQ ID NO: 1247579 - RNA, 19 nt, Homo sapiens
ggucucccuucucggugaa

SEQ ID NO: 1247580 - RNA, 19 nt, Homo sapiens
caauggccacccagcagaa

SEQ ID NO: 1247581 - RNA, 19 nt, Homo sapiens
uauggguuguggaucaaug

SEQ ID NO: 1247582 - RNA, 19 nt, Homo sapiens
cggugugaauggaaggaaa

SEQ ID NO: 1247583 - RNA, 19 nt, Homo sapiens
ugaaggagaauggaaagca

SEQ ID NO: 1247584 - RNA, 19 nt, Homo sapiens
cuacucugaggucaacuuu

SEQ ID NO: 1247585 - RNA, 19 nt, Homo sapiens
ggaaacgcugccucugcuu

SEQ ID NO: 1247586 - RNA, 19 nt, Homo sapiens
gagaccuggagcugcauuu

SEQ ID NO: 1247587 - RNA, 19 nt, Homo sapiens
ucgaaugcaucccuuaucc

SEQ ID NO: 1247588 - RNA, 19 nt, Homo sapiens
gucuacguauacccaaauu

SEQ ID NO: 1247589 - RNA, 19 nt, Homo sapiens
ccacagagcugcuuucuua

SEQ ID NO: 1247590 - RNA, 19 nt, Homo sapiens
gaaauugcuuguaguauuc

SEQ ID NO: 1247591 - RNA, 19 nt, Homo sapiens
cauaagaaauugcuuguag

SEQ ID NO: 1247592 - RNA, 19 nt, Homo sapiens
gaaaugcaggccagagaua

SEQ ID NO: 1247593 - RNA, 19 nt, Homo sapiens
ucaggaggcugggaucuua

SEQ ID NO: 1247594 - RNA, 19 nt, Homo sapiens
guuaaaagcugucuauuug

SEQ ID NO: 1247595 - RNA, 19 nt, Homo sapiens
gaucuuagcauucacacuu

SEQ ID NO: 1247596 - RNA, 19 nt, Homo sapiens
gaaaauggguagccuuaug

SEQ ID NO: 1247597 - RNA, 19 nt, Homo sapiens
ucagaaacuccaccaauuu

SEQ ID NO: 1247598 - RNA, 19 nt, Homo sapiens
aagcaaagcaucugaaaug

SEQ ID NO: 1247599 - RNA, 19 nt, Homo sapiens
acacagacauacagcagaa

SEQ ID NO: 1247600 - RNA, 19 nt, Homo sapiens
gcagaagaaacaaacuaaa

SEQ ID NO: 1247601 - RNA, 19 nt, Homo sapiens
gcugggaucuuagcauuca

SEQ ID NO: 1247602 - RNA, 19 nt, Homo sapiens
gagcagugcccgacacaga

SEQ ID NO: 1247603 - RNA, 19 nt, Homo sapiens
gcauaucccagguauccua

SEQ ID NO: 1247604 - RNA, 19 nt, Homo sapiens
gcuugucccuugaauuguu

SEQ ID NO: 1247605 - RNA, 19 nt, Homo sapiens
gagcugcuuucuuauacau

SEQ ID NO: 1247606 - RNA, 19 nt, Homo sapiens
acagagcugcuuucuuaua

SEQ ID NO: 1247607 - RNA, 19 nt, Homo sapiens
ggucaaguuucaucagaag

SEQ ID NO: 1247608 - RNA, 19 nt, Homo sapiens
ggaagcuugucccuugaau

SEQ ID NO: 1247609 - RNA, 19 nt, Homo sapiens
uuacauaggcgcugugugu

SEQ ID NO: 1247610 - RNA, 19 nt, Homo sapiens
cucaggagauucacccuuu

SEQ ID NO: 1247611 - RNA, 19 nt, Homo sapiens
uucagaaacuccaccaauu

SEQ ID NO: 1247612 - RNA, 19 nt, Homo sapiens
cagagcugcuuucuuauac

SEQ ID NO: 1247613 - RNA, 19 nt, Homo sapiens
ccuuauguaucuacccuaa

SEQ ID NO: 1247614 - RNA, 19 nt, Homo sapiens
ugagcaaucuguguuggaa

SEQ ID NO: 1247615 - RNA, 19 nt, Homo sapiens
cagcagaagaaacaaacua

SEQ ID NO: 1247616 - RNA, 19 nt, Homo sapiens
gaacgacacagccaaacag

SEQ ID NO: 1247617 - RNA, 19 nt, Homo sapiens
guaucuacccuaaaggaaa

SEQ ID NO: 1247618 - RNA, 19 nt, Homo sapiens
aagcuugucccuugaauug

SEQ ID NO: 1247619 - RNA, 19 nt, Homo sapiens
gauaaagugcagccugaug

SEQ ID NO: 1247620 - RNA, 19 nt, Homo sapiens
cgaaggcuguggaguggau

SEQ ID NO: 1247621 - RNA, 19 nt, Homo sapiens
gggucaaguuucaucagaa

SEQ ID NO: 1247622 - RNA, 19 nt, Homo sapiens
guuccugggucaaguuuca

SEQ ID NO: 1247623 - RNA, 19 nt, Homo sapiens
gaagcuugucccuugaauu

SEQ ID NO: 1247624 - RNA, 19 nt, Homo sapiens
uaaaagcugucuauuugga

SEQ ID NO: 1247625 - RNA, 19 nt, Homo sapiens
ggacuggagagccuggaaa

SEQ ID NO: 1247626 - RNA, 19 nt, Homo sapiens
caaccuugccagcauguau

SEQ ID NO: 1247627 - RNA, 19 nt, Homo sapiens
gguauccuaucccaaccuu

SEQ ID NO: 1247628 - RNA, 19 nt, Homo sapiens
cacagguccuaaugggaua

SEQ ID NO: 1247629 - RNA, 19 nt, Homo sapiens
uuauguaucuacccuaaag

SEQ ID NO: 1247630 - RNA, 19 nt, Homo sapiens
caaguuucaucagaaguca

SEQ ID NO: 1247631 - RNA, 19 nt, Homo sapiens
gcuguggaguggauagauc

SEQ ID NO: 1247632 - RNA, 19 nt, Homo sapiens
gggcugagcaaucuguguu

SEQ ID NO: 1247633 - RNA, 19 nt, Homo sapiens
aggcugggaucuuagcauu

SEQ ID NO: 1247634 - RNA, 19 nt, Homo sapiens
guucagaaacuccaccaau

SEQ ID NO: 1247635 - RNA, 19 nt, Homo sapiens
uggagagccuggaaauaca

SEQ ID NO: 1247636 - RNA, 19 nt, Homo sapiens
agcaguggcugucagaaga

SEQ ID NO: 1247637 - RNA, 19 nt, Homo sapiens
ucccuacccugucgaguug

SEQ ID NO: 1247638 - RNA, 19 nt, Homo sapiens
agacauacagcagaagaaa

SEQ ID NO: 1247639 - RNA, 19 nt, Homo sapiens
uggguagccuuauguaucu

SEQ ID NO: 1247640 - RNA, 19 nt, Homo sapiens
ccagcaggcccuuacauag

SEQ ID NO: 1247641 - RNA, 19 nt, Homo sapiens
gggcaaguuuccagaagcu

SEQ ID NO: 1247642 - RNA, 19 nt, Homo sapiens
acauacagcagaagaaaca

SEQ ID NO: 1247643 - RNA, 19 nt, Homo sapiens
ggagcugugcugacucuuc

SEQ ID NO: 1247644 - RNA, 19 nt, Homo sapiens
caugaacgacacagccaaa

SEQ ID NO: 1247645 - RNA, 19 nt, Homo sapiens
ugggucaaguuucaucaga

SEQ ID NO: 1247646 - RNA, 19 nt, Homo sapiens
caggcccucugauaaggaa

SEQ ID NO: 1247647 - RNA, 19 nt, Homo sapiens
cuucuguacuguccaggaa

SEQ ID NO: 1247648 - RNA, 19 nt, Homo sapiens
aaaugcaggccagagauaa

SEQ ID NO: 1247649 - RNA, 19 nt, Homo sapiens
uaucuacccuaaaggaaaa

SEQ ID NO: 1247650 - RNA, 19 nt, Homo sapiens
uccagcaggcccuuacaua

SEQ ID NO: 1247651 - RNA, 19 nt, Homo sapiens
cagggcaaguuuccagaag

SEQ ID NO: 1247652 - RNA, 19 nt, Homo sapiens
gagcaaucuguguuggaaa

SEQ ID NO: 1247653 - RNA, 19 nt, Homo sapiens
aaacagcaggccgguugua

SEQ ID NO: 1247654 - RNA, 19 nt, Homo sapiens
ggucacccgugucccuagu

SEQ ID NO: 1247655 - RNA, 19 nt, Homo sapiens
cagaaacuccaccaauuuu

SEQ ID NO: 1247656 - RNA, 19 nt, Homo sapiens
gcgguaggagugcuuugaa

SEQ ID NO: 1247657 - RNA, 19 nt, Homo sapiens
uagaaaauggguagccuua

SEQ ID NO: 1247658 - RNA, 19 nt, Homo sapiens
ccucaucccacaccugguu

SEQ ID NO: 1247659 - RNA, 19 nt, Homo sapiens
cagcaggcccuuacauagg

SEQ ID NO: 1247660 - RNA, 19 nt, Homo sapiens
ccucugcacacccgggaua

SEQ ID NO: 1247661 - RNA, 19 nt, Homo sapiens
ggagaagcaguggcuguca

SEQ ID NO: 1247662 - RNA, 19 nt, Homo sapiens
gcaggccagagauaaagug

SEQ ID NO: 1247663 - RNA, 19 nt, Homo sapiens
aaauggguagccuuaugua

SEQ ID NO: 1247664 - RNA, 19 nt, Homo sapiens
gaaacuccaccaauuuuag

SEQ ID NO: 1247665 - RNA, 19 nt, Homo sapiens
ggcaggcccucugauaagg

SEQ ID NO: 1247666 - RNA, 19 nt, Homo sapiens
uuacauauaauggccauag

SEQ ID NO: 1247667 - RNA, 19 nt, Homo sapiens
ugaaaugcaggccagagau

SEQ ID NO: 1247668 - RNA, 19 nt, Homo sapiens
gcaggcccucugauaagga

SEQ ID NO: 1247669 - RNA, 19 nt, Homo sapiens
gcagugcccgacacagaca

SEQ ID NO: 1247670 - RNA, 19 nt, Homo sapiens
ccaaggggcugagcaaucu

SEQ ID NO: 1247671 - RNA, 19 nt, Homo sapiens
gaacuggacuggagaagaa

SEQ ID NO: 1247672 - RNA, 19 nt, Homo sapiens
gagaagagauuuacaagga

SEQ ID NO: 1247673 - RNA, 19 nt, Homo sapiens
gaagaaggcugacauuaca

SEQ ID NO: 1247674 - RNA, 19 nt, Homo sapiens
gcuaagugaucuugaaaua

SEQ ID NO: 1247675 - RNA, 19 nt, Homo sapiens
gcaccuggcuaccaaagua

SEQ ID NO: 1247676 - RNA, 19 nt, Homo sapiens
gcuuagaucuuauugauga

SEQ ID NO: 1247677 - RNA, 19 nt, Homo sapiens
caagguggcuuccagauga

SEQ ID NO: 1247678 - RNA, 19 nt, Homo sapiens
gaagaaccgucaggaauuc

SEQ ID NO: 1247679 - RNA, 19 nt, Homo sapiens
ggacaaaacuggugaagga

SEQ ID NO: 1247680 - RNA, 19 nt, Homo sapiens
ggagaacauuuguauuuca

SEQ ID NO: 1247681 - RNA, 19 nt, Homo sapiens
ggacggaggacacaauaaa

SEQ ID NO: 1247682 - RNA, 19 nt, Homo sapiens
ggaaugugaauaaugcuua

SEQ ID NO: 1247683 - RNA, 19 nt, Homo sapiens
gcaaagggccucugcaauc

SEQ ID NO: 1247684 - RNA, 19 nt, Homo sapiens
ggaaggaguacgugacuuu

SEQ ID NO: 1247685 - RNA, 19 nt, Homo sapiens
ggaaggaccagccauuuau

SEQ ID NO: 1247686 - RNA, 19 nt, Homo sapiens
agacaugcauggccuguuu

SEQ ID NO: 1247687 - RNA, 19 nt, Homo sapiens
gggaaggaccagccauuua

SEQ ID NO: 1247688 - RNA, 19 nt, Homo sapiens
caaggaaugugaauaaugc

SEQ ID NO: 1247689 - RNA, 19 nt, Homo sapiens
agacaaggaaugugaauaa

SEQ ID NO: 1247690 - RNA, 19 nt, Homo sapiens
gcacggacaggcagaauug

SEQ ID NO: 1247691 - RNA, 19 nt, Homo sapiens
ggaagaaggcugacauuac

SEQ ID NO: 1247692 - RNA, 19 nt, Homo sapiens
gaguauccguccuauaaug

SEQ ID NO: 1247693 - RNA, 19 nt, Homo sapiens
guucuccucuucucucuaa

SEQ ID NO: 1247694 - RNA, 19 nt, Homo sapiens
caucccacauucuucuuua

SEQ ID NO: 1247695 - RNA, 19 nt, Homo sapiens
gaguguauccuaaugguuu

SEQ ID NO: 1247696 - RNA, 19 nt, Homo sapiens
gggcucaguuccucucauu

SEQ ID NO: 1247697 - RNA, 19 nt, Homo sapiens
gggaagaaggcugacauua

SEQ ID NO: 1247698 - RNA, 19 nt, Homo sapiens
gacauuacauuuaguuugc

SEQ ID NO: 1247699 - RNA, 19 nt, Homo sapiens
ugaagaaccgucaggaauu

SEQ ID NO: 1247700 - RNA, 19 nt, Homo sapiens
uaaaugaccagucccuuau

SEQ ID NO: 1247701 - RNA, 19 nt, Homo sapiens
cgggauauguugauagaga

SEQ ID NO: 1247702 - RNA, 19 nt, Homo sapiens
ggauuaguucccagucuua

SEQ ID NO: 1247703 - RNA, 19 nt, Homo sapiens
ggaauccaggguacagaua

SEQ ID NO: 1247704 - RNA, 19 nt, Homo sapiens
gacagaguguauccuaaug

SEQ ID NO: 1247705 - RNA, 19 nt, Homo sapiens
gaugacagaguguauccua

SEQ ID NO: 1247706 - RNA, 19 nt, Homo sapiens
gaaugugaauaaugcuuag

SEQ ID NO: 1247707 - RNA, 19 nt, Homo sapiens
uaaggucucucucccagau

SEQ ID NO: 1247708 - RNA, 19 nt, Homo sapiens
gacaaggaaugugaauaau

SEQ ID NO: 1247709 - RNA, 19 nt, Homo sapiens
uagauuaaguagacaagga

SEQ ID NO: 1247710 - RNA, 19 nt, Homo sapiens
cuccgcaccuugagcauua

SEQ ID NO: 1247711 - RNA, 19 nt, Homo sapiens
gaaggcugacauuacauuu

SEQ ID NO: 1247712 - RNA, 19 nt, Homo sapiens
uugaguauccguccuauaa

SEQ ID NO: 1247713 - RNA, 19 nt, Homo sapiens
aaugaccagucccuuauuu

SEQ ID NO: 1247714 - RNA, 19 nt, Homo sapiens
acagauaggagauaccuuu

SEQ ID NO: 1247715 - RNA, 19 nt, Homo sapiens
uaagugaucuugaaauacc

SEQ ID NO: 1247716 - RNA, 19 nt, Homo sapiens
auaaaugaccagucccuua

SEQ ID NO: 1247717 - RNA, 19 nt, Homo sapiens
gaacucccauagucaucug

SEQ ID NO: 1247718 - RNA, 19 nt, Homo sapiens
ugaaauguaggaugaauca

SEQ ID NO: 1247719 - RNA, 19 nt, Homo sapiens
agaagagauuuacaaggaa

SEQ ID NO: 1247720 - RNA, 19 nt, Homo sapiens
acucugcuguggccuauuu

SEQ ID NO: 1247721 - RNA, 19 nt, Homo sapiens
gggaccaucuccuucuuca

SEQ ID NO: 1247722 - RNA, 19 nt, Homo sapiens
uuaugcagaugccacagua

SEQ ID NO: 1247723 - RNA, 19 nt, Homo sapiens
gaaggaccagccauuuaug

SEQ ID NO: 1247724 - RNA, 19 nt, Homo sapiens
gugaagaaccgucaggaau

SEQ ID NO: 1247725 - RNA, 19 nt, Homo sapiens
ucuccaaauuccaguguaa

SEQ ID NO: 1247726 - RNA, 19 nt, Homo sapiens
guuggaugcuggccucuau

SEQ ID NO: 1247727 - RNA, 19 nt, Homo sapiens
ggugaaauguaggaugaau

SEQ ID NO: 1247728 - RNA, 19 nt, Homo sapiens
gcagggacaggaucagaga

SEQ ID NO: 1247729 - RNA, 19 nt, Homo sapiens
gcucaguuccucucauuuc

SEQ ID NO: 1247730 - RNA, 19 nt, Homo sapiens
cucuaugggugcaggauua

SEQ ID NO: 1247731 - RNA, 19 nt, Homo sapiens
aggcugugguguagauuaa

SEQ ID NO: 1247732 - RNA, 19 nt, Homo sapiens
gagaacauuuguauuucac

SEQ ID NO: 1247733 - RNA, 19 nt, Homo sapiens
gaaggaguacgugacuuug

SEQ ID NO: 1247734 - RNA, 19 nt, Homo sapiens
aggcugacauuacauuuag

SEQ ID NO: 1247735 - RNA, 19 nt, Homo sapiens
ggacaaacagagacaugca

SEQ ID NO: 1247736 - RNA, 19 nt, Homo sapiens
acgcagcauucuccuguuu

SEQ ID NO: 1247737 - RNA, 19 nt, Homo sapiens
ccuguuuccugucuccuaa

SEQ ID NO: 1247738 - RNA, 19 nt, Homo sapiens
caaagggccucugcaaucc

SEQ ID NO: 1247739 - RNA, 19 nt, Homo sapiens
aaacuguaacccauagaaa

SEQ ID NO: 1247740 - RNA, 19 nt, Homo sapiens
gcucugcguuucugaucug

SEQ ID NO: 1247741 - RNA, 19 nt, Homo sapiens
ccacagacuccaggacaaa

SEQ ID NO: 1247742 - RNA, 19 nt, Homo sapiens
ugauagagacauccagcua

SEQ ID NO: 1247743 - RNA, 19 nt, Homo sapiens
ugacagaguguauccuaau

SEQ ID NO: 1247744 - RNA, 19 nt, Homo sapiens
ccucuucucucuaauccau

SEQ ID NO: 1247745 - RNA, 19 nt, Homo sapiens
gggucuuccuggacuauga

SEQ ID NO: 1247746 - RNA, 19 nt, Homo sapiens
uggagaacauuuguauuuc

SEQ ID NO: 1247747 - RNA, 19 nt, Homo sapiens
ggaacuggacuggagaaga

SEQ ID NO: 1247748 - RNA, 19 nt, Homo sapiens
cgucaccucuccugucauc

SEQ ID NO: 1247749 - RNA, 19 nt, Homo sapiens
gcugugguguagauuaagu

SEQ ID NO: 1247750 - RNA, 19 nt, Homo sapiens
acauucuucuuuagggaua

SEQ ID NO: 1247751 - RNA, 19 nt, Homo sapiens
auagucaucugcccaguca

SEQ ID NO: 1247752 - RNA, 19 nt, Homo sapiens
gaccaucuccuucuucaac

SEQ ID NO: 1247753 - RNA, 19 nt, Homo sapiens
ggggugaaauguaggauga

SEQ ID NO: 1247754 - RNA, 19 nt, Homo sapiens
gagacaagcaacagugagu

SEQ ID NO: 1247755 - RNA, 19 nt, Homo sapiens
gcagaugccacaguaucaa

SEQ ID NO: 1247756 - RNA, 19 nt, Homo sapiens
cagaguguauccuaauggu

SEQ ID NO: 1247757 - RNA, 19 nt, Homo sapiens
acaaggaaugugaauaaug

SEQ ID NO: 1247758 - RNA, 19 nt, Homo sapiens
gucaggaauucccaucuca

SEQ ID NO: 1247759 - RNA, 19 nt, Homo sapiens
ggugaagaaccgucaggaa

SEQ ID NO: 1247760 - RNA, 19 nt, Homo sapiens
uauugaggcccuacauuga

SEQ ID NO: 1247761 - RNA, 19 nt, Homo sapiens
ggaggugacucuggaucca

SEQ ID NO: 1247762 - RNA, 19 nt, Homo sapiens
ccucuccugucauccguuu

SEQ ID NO: 1247763 - RNA, 19 nt, Homo sapiens
caaaacuggugaaggauuc

SEQ ID NO: 1247764 - RNA, 19 nt, Homo sapiens
gcugacauuacauuuaguu

SEQ ID NO: 1247765 - RNA, 19 nt, Homo sapiens
aaucacaucccacauucuu

SEQ ID NO: 1247766 - RNA, 19 nt, Homo sapiens
caucuccuucuucaacaua

SEQ ID NO: 1247767 - RNA, 19 nt, Homo sapiens
aaggcugacauuacauuua

SEQ ID NO: 1247768 - RNA, 19 nt, Homo sapiens
uuauugaggcccuacauug

SEQ ID NO: 1247769 - RNA, 19 nt, Homo sapiens
ugugguggcuucucagagu

SEQ ID NO: 1247770 - RNA, 19 nt, Homo sapiens
gaauccaggguacagauag

SEQ ID NO: 1247771 - RNA, 19 nt, Homo sapiens
gaaauuagcagauugguaa

SEQ ID NO: 1247772 - RNA, 19 nt, Homo sapiens
ggaaauaccguguuuguaa

SEQ ID NO: 1247773 - RNA, 19 nt, Homo sapiens
gcacaacuaucuuugcaaa

SEQ ID NO: 1247774 - RNA, 19 nt, Homo sapiens
caacguauguuuccaguga

SEQ ID NO: 1247775 - RNA, 19 nt, Homo sapiens
ggaaguaucgcaauuguuu

SEQ ID NO: 1247776 - RNA, 19 nt, Homo sapiens
caaggaagauuguuuacuu

SEQ ID NO: 1247777 - RNA, 19 nt, Homo sapiens
caagauaccuuacgcacaa

SEQ ID NO: 1247778 - RNA, 19 nt, Homo sapiens
guucaggaguuucaauuua

SEQ ID NO: 1247779 - RNA, 19 nt, Homo sapiens
gguaagaagugcaaauuau

SEQ ID NO: 1247780 - RNA, 19 nt, Homo sapiens
gaugauaacugcuuuacug

SEQ ID NO: 1247781 - RNA, 19 nt, Homo sapiens
ucaaagaccuucuguguuc

SEQ ID NO: 1247782 - RNA, 19 nt, Homo sapiens
guacuucgcuuaaauaguc

SEQ ID NO: 1247783 - RNA, 19 nt, Homo sapiens
cuagaagucuguaauauug

SEQ ID NO: 1247784 - RNA, 19 nt, Homo sapiens
gaacaguagcgcaguauuu

SEQ ID NO: 1247785 - RNA, 19 nt, Homo sapiens
auacacaccuucaugaaua

SEQ ID NO: 1247786 - RNA, 19 nt, Homo sapiens
gaaauaccguguuuguaau

SEQ ID NO: 1247787 - RNA, 19 nt, Homo sapiens
gagaggaaguacugaaaga

SEQ ID NO: 1247788 - RNA, 19 nt, Homo sapiens
gggcaacgauguaucaaga

SEQ ID NO: 1247789 - RNA, 19 nt, Homo sapiens
ugaaauggcucauguaacu

SEQ ID NO: 1247790 - RNA, 19 nt, Homo sapiens
caucaaaccuuuccuuuac

SEQ ID NO: 1247791 - RNA, 19 nt, Homo sapiens
ccauuaaacugcuggcuaa

SEQ ID NO: 1247792 - RNA, 19 nt, Homo sapiens
ucaagaagcuaacagacaa

SEQ ID NO: 1247793 - RNA, 19 nt, Homo sapiens
ggucugauccuuauguuaa

SEQ ID NO: 1247794 - RNA, 19 nt, Homo sapiens
gaaaccagccaacugcuuu

SEQ ID NO: 1247795 - RNA, 19 nt, Homo sapiens
gcauauauaucuagaucug

SEQ ID NO: 1247796 - RNA, 19 nt, Homo sapiens
ugauguaucugguucguuu

SEQ ID NO: 1247797 - RNA, 19 nt, Homo sapiens
gggaacuucuuauucaauu

SEQ ID NO: 1247798 - RNA, 19 nt, Homo sapiens
caagaccucugacugauuc

SEQ ID NO: 1247799 - RNA, 19 nt, Homo sapiens
guauuaugcucaccuggua

SEQ ID NO: 1247800 - RNA, 19 nt, Homo sapiens
cgagaagccugcaucaguu

SEQ ID NO: 1247801 - RNA, 19 nt, Homo sapiens
guacagauucaccaagaua

SEQ ID NO: 1247802 - RNA, 19 nt, Homo sapiens
ggacaaagaacaugacagu

SEQ ID NO: 1247803 - RNA, 19 nt, Homo sapiens
gaacuucagcugcuaacuu

SEQ ID NO: 1247804 - RNA, 19 nt, Homo sapiens
aaucagacuuccacuauga

SEQ ID NO: 1247805 - RNA, 19 nt, Homo sapiens
gaacaaugagacggaaaua

SEQ ID NO: 1247806 - RNA, 19 nt, Homo sapiens
gaucuggauugauaauaga

SEQ ID NO: 1247807 - RNA, 19 nt, Homo sapiens
gcagugcagagaagaaaua

SEQ ID NO: 1247808 - RNA, 19 nt, Homo sapiens
gcacaauguacuucgcuua

SEQ ID NO: 1247809 - RNA, 19 nt, Homo sapiens
gugcagagaagaaauauug

SEQ ID NO: 1247810 - RNA, 19 nt, Homo sapiens
uacacgaucuguuucuaua

SEQ ID NO: 1247811 - RNA, 19 nt, Homo sapiens
ccaaagagauaaaagguuu

SEQ ID NO: 1247812 - RNA, 19 nt, Homo sapiens
caauguacuucgcuuaaau

SEQ ID NO: 1247813 - RNA, 19 nt, Homo sapiens
aaacuugugccuaaagaua

SEQ ID NO: 1247814 - RNA, 19 nt, Homo sapiens
ccacuagaagucuguaaua

SEQ ID NO: 1247815 - RNA, 19 nt, Homo sapiens
caaggugucaaucaaauuu

SEQ ID NO: 1247816 - RNA, 19 nt, Homo sapiens
ggguauggcuacacaaugu

SEQ ID NO: 1247817 - RNA, 19 nt, Homo sapiens
uaauucaguucauguguga

SEQ ID NO: 1247818 - RNA, 19 nt, Homo sapiens
gaagucaauugaguaagga

SEQ ID NO: 1247819 - RNA, 19 nt, Homo sapiens
ugccaaggcuguacagauu

SEQ ID NO: 1247820 - RNA, 19 nt, Homo sapiens
ugacagugcugaaggaagu

SEQ ID NO: 1247821 - RNA, 19 nt, Homo sapiens
aacuucagcugcuaacuua

SEQ ID NO: 1247822 - RNA, 19 nt, Homo sapiens
ucggagggaucaauaauau

SEQ ID NO: 1247823 - RNA, 19 nt, Homo sapiens
ucacagaccagcugcguaa

SEQ ID NO: 1247824 - RNA, 19 nt, Homo sapiens
ggaaauuagcagauuggua

SEQ ID NO: 1247825 - RNA, 19 nt, Homo sapiens
aaccuuuccuuuacaguua

SEQ ID NO: 1247826 - RNA, 19 nt, Homo sapiens
uauaggaaguaucgcaauu

SEQ ID NO: 1247827 - RNA, 19 nt, Homo sapiens
acaucacacucgauuauuu

SEQ ID NO: 1247828 - RNA, 19 nt, Homo sapiens
caucaaagaccuucugugu

SEQ ID NO: 1247829 - RNA, 19 nt, Homo sapiens
gcaacgauguaucaagaag

SEQ ID NO: 1247830 - RNA, 19 nt, Homo sapiens
caaagcacaaccuguaauu

SEQ ID NO: 1247831 - RNA, 19 nt, Homo sapiens
gaccagcugcguaagauuu

SEQ ID NO: 1247832 - RNA, 19 nt, Homo sapiens
uaacagacaaucagacuuc

SEQ ID NO: 1247833 - RNA, 19 nt, Homo sapiens
gauaaaagguuugaagguu

SEQ ID NO: 1247834 - RNA, 19 nt, Homo sapiens
caucugcccuccaugaaau

SEQ ID NO: 1247835 - RNA, 19 nt, Homo sapiens
aaggacaccuccagccaua

SEQ ID NO: 1247836 - RNA, 19 nt, Homo sapiens
ugaauugacauacaacgua

SEQ ID NO: 1247837 - RNA, 19 nt, Homo sapiens
gcagagaagaaauauugaa

SEQ ID NO: 1247838 - RNA, 19 nt, Homo sapiens
gaucaaggcaacagcaaga

SEQ ID NO: 1247839 - RNA, 19 nt, Homo sapiens
ucccaaagauugaugucua

SEQ ID NO: 1247840 - RNA, 19 nt, Homo sapiens
ccagugaagucaauugagu

SEQ ID NO: 1247841 - RNA, 19 nt, Homo sapiens
guaagaagugcaaauuaug

SEQ ID NO: 1247842 - RNA, 19 nt, Homo sapiens
caaacucugucaaacuugu

SEQ ID NO: 1247843 - RNA, 19 nt, Homo sapiens
gauagacaagaggaaauua

SEQ ID NO: 1247844 - RNA, 19 nt, Homo sapiens
ucaucaaaccuuuccuuua

SEQ ID NO: 1247845 - RNA, 19 nt, Homo sapiens
cugguucguuugaauauaa

SEQ ID NO: 1247846 - RNA, 19 nt, Homo sapiens
guuaauacaaggaagauug

SEQ ID NO: 1247847 - RNA, 19 nt, Homo sapiens
ggagaaagacuaucaaccu

SEQ ID NO: 1247848 - RNA, 19 nt, Homo sapiens
ucaaacuugugccuaaaga

SEQ ID NO: 1247849 - RNA, 19 nt, Homo sapiens
gugugaaguucuugauauu

SEQ ID NO: 1247850 - RNA, 19 nt, Homo sapiens
caaggaggccugccaguca

SEQ ID NO: 1247851 - RNA, 19 nt, Homo sapiens
gaagugacucauuguggaa

SEQ ID NO: 1247852 - RNA, 19 nt, Homo sapiens
cgacaucugcccuccauga

SEQ ID NO: 1247853 - RNA, 19 nt, Homo sapiens
aaggaacacagcaucauua

SEQ ID NO: 1247854 - RNA, 19 nt, Homo sapiens
caaggaacacagcaucauu

SEQ ID NO: 1247855 - RNA, 19 nt, Homo sapiens
aggaaguacugaaagauga

SEQ ID NO: 1247856 - RNA, 19 nt, Homo sapiens
gaacaugacagugcugaag

SEQ ID NO: 1247857 - RNA, 19 nt, Homo sapiens
gagaagccugcaucaguuu

SEQ ID NO: 1247858 - RNA, 19 nt, Homo sapiens
guucaagucaagaauguaa

SEQ ID NO: 1247859 - RNA, 19 nt, Homo sapiens
gggcaaacccauuaaacug

SEQ ID NO: 1247860 - RNA, 19 nt, Homo sapiens
gcagggcaacgauguauca

SEQ ID NO: 1247861 - RNA, 19 nt, Homo sapiens
gagcaaccaagaccucuga

SEQ ID NO: 1247862 - RNA, 19 nt, Homo sapiens
ugaagucaauugaguaagg

SEQ ID NO: 1247863 - RNA, 19 nt, Homo sapiens
acugaaagaugaauugaca

SEQ ID NO: 1247864 - RNA, 19 nt, Homo sapiens
gaggaaguacugaaagaug

SEQ ID NO: 1247865 - RNA, 19 nt, Homo sapiens
aaacaucuccucaaacucu

SEQ ID NO: 1247866 - RNA, 19 nt, Homo sapiens
acaccuaccugccacuaga

SEQ ID NO: 1247867 - RNA, 19 nt, Homo sapiens
ugugugaaguucuugauau

SEQ ID NO: 1247868 - RNA, 19 nt, Homo sapiens
gaauuagacaagccaauca

SEQ ID NO: 1247869 - RNA, 19 nt, Homo sapiens
gugcauucauauauucuug

SEQ ID NO: 1247870 - RNA, 19 nt, Homo sapiens
guccaaguauauucucuga

SEQ ID NO: 1247871 - RNA, 19 nt, Homo sapiens
gaaagggacuucuagcaaa

SEQ ID NO: 1247872 - RNA, 19 nt, Homo sapiens
gcggugaacucaagaaauu

SEQ ID NO: 1247873 - RNA, 19 nt, Homo sapiens
uggguuaucuucuccauua

SEQ ID NO: 1247874 - RNA, 19 nt, Homo sapiens
ggaaagcgcuguggcugaa

SEQ ID NO: 1247875 - RNA, 19 nt, Homo sapiens
gauaauaccaggcuaguug

SEQ ID NO: 1247876 - RNA, 19 nt, Homo sapiens
gcccaacucugacaggaua

SEQ ID NO: 1247877 - RNA, 19 nt, Homo sapiens
uagcaaaccugcaggaaga

SEQ ID NO: 1247878 - RNA, 19 nt, Homo sapiens
gaaugugagugaauauguu

SEQ ID NO: 1247879 - RNA, 19 nt, Homo sapiens
aaacaagaauggauagaug

SEQ ID NO: 1247880 - RNA, 19 nt, Homo sapiens
gaaguuauggcucaucaaa

SEQ ID NO: 1247881 - RNA, 19 nt, Homo sapiens
gaaagagguuaaacauaag

SEQ ID NO: 1247882 - RNA, 19 nt, Homo sapiens
ucacagcgcuccaauccuu

SEQ ID NO: 1247883 - RNA, 19 nt, Homo sapiens
aaacguggcauuuaaguaa

SEQ ID NO: 1247884 - RNA, 19 nt, Homo sapiens
uuaggaggguuaauguuua

SEQ ID NO: 1247885 - RNA, 19 nt, Homo sapiens
ggaaagggacuucuagcaa

SEQ ID NO: 1247886 - RNA, 19 nt, Homo sapiens
uagcagaccauuaagauaa

SEQ ID NO: 1247887 - RNA, 19 nt, Homo sapiens
ggaaagguacaaugguuaa

SEQ ID NO: 1247888 - RNA, 19 nt, Homo sapiens
ggucguaaguccuaagaug

SEQ ID NO: 1247889 - RNA, 19 nt, Homo sapiens
gccauuagcagaccauuaa

SEQ ID NO: 1247890 - RNA, 19 nt, Homo sapiens
ggauagauguuccaauguc

SEQ ID NO: 1247891 - RNA, 19 nt, Homo sapiens
gagaaguuauggcucauca

SEQ ID NO: 1247892 - RNA, 19 nt, Homo sapiens
cauacacacuccucauaaa

SEQ ID NO: 1247893 - RNA, 19 nt, Homo sapiens
gcauacacacuccucauaa

SEQ ID NO: 1247894 - RNA, 19 nt, Homo sapiens
guugaaagcuccuauuacu

SEQ ID NO: 1247895 - RNA, 19 nt, Homo sapiens
aaacagugaaguccuauaa

SEQ ID NO: 1247896 - RNA, 19 nt, Homo sapiens
ccugacuccuugaaauuua

SEQ ID NO: 1247897 - RNA, 19 nt, Homo sapiens
gauagauguuccaauguca

SEQ ID NO: 1247898 - RNA, 19 nt, Homo sapiens
cagggaaugugagugaaua

SEQ ID NO: 1247899 - RNA, 19 nt, Homo sapiens
gggaaagguacaaugguua

SEQ ID NO: 1247900 - RNA, 19 nt, Homo sapiens
uccagaagcugaauuagau

SEQ ID NO: 1247901 - RNA, 19 nt, Homo sapiens
caggcuaguugguggguua

SEQ ID NO: 1247902 - RNA, 19 nt, Homo sapiens
gagugaauauguuagaagu

SEQ ID NO: 1247903 - RNA, 19 nt, Homo sapiens
gaaacaagaauggauagau

SEQ ID NO: 1247904 - RNA, 19 nt, Homo sapiens
caaauaugauccauucacu

SEQ ID NO: 1247905 - RNA, 19 nt, Homo sapiens
aagaaacagugaaguccua

SEQ ID NO: 1247906 - RNA, 19 nt, Homo sapiens
gcuauuucguucccuaaga

SEQ ID NO: 1247907 - RNA, 19 nt, Homo sapiens
acagugaaguccuauaauc

SEQ ID NO: 1247908 - RNA, 19 nt, Homo sapiens
ggaaugugagugaauaugu

SEQ ID NO: 1247909 - RNA, 19 nt, Homo sapiens
acgcaaauaugauccauuc

SEQ ID NO: 1247910 - RNA, 19 nt, Homo sapiens
ggacuuucuucucccuuau

SEQ ID NO: 1247911 - RNA, 19 nt, Homo sapiens
cgacugcggugaacucaag

SEQ ID NO: 1247912 - RNA, 19 nt, Homo sapiens
gcacccaaaucucccaaag

SEQ ID NO: 1247913 - RNA, 19 nt, Homo sapiens
ggugaacucaagaaauuaa

SEQ ID NO: 1247914 - RNA, 19 nt, Homo sapiens
caaaggaagguguuuaugg

SEQ ID NO: 1247915 - RNA, 19 nt, Homo sapiens
gaaguccuauaaucagagu

SEQ ID NO: 1247916 - RNA, 19 nt, Homo sapiens
gaaacagugaaguccuaua

SEQ ID NO: 1247917 - RNA, 19 nt, Homo sapiens
gcaggaagagaucauggaa

SEQ ID NO: 1247918 - RNA, 19 nt, Homo sapiens
gugaaguccuauaaucaga

SEQ ID NO: 1247919 - RNA, 19 nt, Homo sapiens
cauccugacuccuugaaau

SEQ ID NO: 1247920 - RNA, 19 nt, Homo sapiens
aaccaaaccuccucuccaa

SEQ ID NO: 1247921 - RNA, 19 nt, Homo sapiens
acccaaaucucccaaagga

SEQ ID NO: 1247922 - RNA, 19 nt, Homo sapiens
cuaauuaugcuuugccauu

SEQ ID NO: 1247923 - RNA, 19 nt, Homo sapiens
guacaaugguuaacuuucc

SEQ ID NO: 1247924 - RNA, 19 nt, Homo sapiens
cuaagaauagucacaaaga

SEQ ID NO: 1247925 - RNA, 19 nt, Homo sapiens
uaaacccacuuggcaaaga

SEQ ID NO: 1247926 - RNA, 19 nt, Homo sapiens
gcgacgaggucagaggaaa

SEQ ID NO: 1247927 - RNA, 19 nt, Homo sapiens
ggcauacacacuccucaua

SEQ ID NO: 1247928 - RNA, 19 nt, Homo sapiens
gugaauauguuagaagucu

SEQ ID NO: 1247929 - RNA, 19 nt, Homo sapiens
aaccugcgcugcaacuaaa

SEQ ID NO: 1247930 - RNA, 19 nt, Homo sapiens
cauauaggguuucaagacu

SEQ ID NO: 1247931 - RNA, 19 nt, Homo sapiens
ucacaaacgcuuuaacucu

SEQ ID NO: 1247932 - RNA, 19 nt, Homo sapiens
uaaccugcgcugcaacuaa

SEQ ID NO: 1247933 - RNA, 19 nt, Homo sapiens
ugaauuagauagacuuucc

SEQ ID NO: 1247934 - RNA, 19 nt, Homo sapiens
aauaugauccauucacuug

SEQ ID NO: 1247935 - RNA, 19 nt, Homo sapiens
uggacuuucuucucccuua

SEQ ID NO: 1247936 - RNA, 19 nt, Homo sapiens
gcgcuguggcugaagauuu

SEQ ID NO: 1247937 - RNA, 19 nt, Homo sapiens
cuuuaacucuccagugaaa

SEQ ID NO: 1247938 - RNA, 19 nt, Homo sapiens
ggagauggacuuggaaugg

SEQ ID NO: 1247939 - RNA, 19 nt, Homo sapiens
ggagucauauaggguuuca

SEQ ID NO: 1247940 - RNA, 19 nt, Homo sapiens
cuauuucguucccuaagaa

SEQ ID NO: 1247941 - RNA, 19 nt, Homo sapiens
cgcuuuaacucuccaguga

SEQ ID NO: 1247942 - RNA, 19 nt, Homo sapiens
agaagucacaaacgcuuua

SEQ ID NO: 1247943 - RNA, 19 nt, Homo sapiens
ugccauacacguaaucuuu

SEQ ID NO: 1247944 - RNA, 19 nt, Homo sapiens
uuucuucucccuuaucaua

SEQ ID NO: 1247945 - RNA, 19 nt, Homo sapiens
guuaucuucuccauuagga

SEQ ID NO: 1247946 - RNA, 19 nt, Homo sapiens
gauaaacaggagaaaguuc

SEQ ID NO: 1247947 - RNA, 19 nt, Homo sapiens
gaagucacaaacgcuuuaa

SEQ ID NO: 1247948 - RNA, 19 nt, Homo sapiens
aaauuaaccugcgcugcaa

SEQ ID NO: 1247949 - RNA, 19 nt, Homo sapiens
gaagcugaauuagauagac

SEQ ID NO: 1247950 - RNA, 19 nt, Homo sapiens
gcaaauaugauccauucac

SEQ ID NO: 1247951 - RNA, 19 nt, Homo sapiens
agagugacccacgcaaaua

SEQ ID NO: 1247952 - RNA, 19 nt, Homo sapiens
cacucggucuucugguuua

SEQ ID NO: 1247953 - RNA, 19 nt, Homo sapiens
aggaagagaucauggaaaa

SEQ ID NO: 1247954 - RNA, 19 nt, Homo sapiens
gagugacccacgcaaauau

SEQ ID NO: 1247955 - RNA, 19 nt, Homo sapiens
uaaugaugccauacacgua

SEQ ID NO: 1247956 - RNA, 19 nt, Homo sapiens
aaaacucucuugcuucuug

SEQ ID NO: 1247957 - RNA, 19 nt, Homo sapiens
cgaccgagauagagaaagc

SEQ ID NO: 1247958 - RNA, 19 nt, Homo sapiens
guccagaagcugaauuaga

SEQ ID NO: 1247959 - RNA, 19 nt, Homo sapiens
gugagugaauauguuagaa

SEQ ID NO: 1247960 - RNA, 19 nt, Homo sapiens
aaauuugguuuccuacaca

SEQ ID NO: 1247961 - RNA, 19 nt, Homo sapiens
uggguuggcuugggucgua

SEQ ID NO: 1247962 - RNA, 19 nt, Homo sapiens
ccagaagcugaauuagaua

SEQ ID NO: 1247963 - RNA, 19 nt, Homo sapiens
acacacuccucauaaagag

SEQ ID NO: 1247964 - RNA, 19 nt, Homo sapiens
gcagggaaugugagugaau

SEQ ID NO: 1247965 - RNA, 19 nt, Homo sapiens
uauaggguuucaagacugu

SEQ ID NO: 1247966 - RNA, 19 nt, Homo sapiens
aaaguucacacuccugcua

SEQ ID NO: 1247967 - RNA, 19 nt, Homo sapiens
gaagcugugaagcgaacua

SEQ ID NO: 1247968 - RNA, 19 nt, Homo sapiens
aagguacaaugguuaacuu

SEQ ID NO: 1247969 - RNA, 19 nt, Homo sapiens
aaaggaaggcacccaaauc

SEQ ID NO: 1247970 - RNA, 19 nt, Homo sapiens
cacacucggucuucugguu

SEQ ID NO: 1247971 - RNA, 19 nt, Homo sapiens
gaagaacacugcauuguaa

SEQ ID NO: 1247972 - RNA, 19 nt, Homo sapiens
gaugggagcugucuuaauu

SEQ ID NO: 1247973 - RNA, 19 nt, Homo sapiens
caugaaggcuugaaucuua

SEQ ID NO: 1247974 - RNA, 19 nt, Homo sapiens
gaaaguggaugaucauaug

SEQ ID NO: 1247975 - RNA, 19 nt, Homo sapiens
gcaaucagcacguauauaa

SEQ ID NO: 1247976 - RNA, 19 nt, Homo sapiens
gaaacuaugugugaaguaa

SEQ ID NO: 1247977 - RNA, 19 nt, Homo sapiens
gcaguuggcuacucacuuu

SEQ ID NO: 1247978 - RNA, 19 nt, Homo sapiens
gaagugauuugggccauua

SEQ ID NO: 1247979 - RNA, 19 nt, Homo sapiens
gaaugacuguauugaguua

SEQ ID NO: 1247980 - RNA, 19 nt, Homo sapiens
uaaagcaacugaagaguga

SEQ ID NO: 1247981 - RNA, 19 nt, Homo sapiens
acacaacacugaccgcuua

SEQ ID NO: 1247982 - RNA, 19 nt, Homo sapiens
ggacaucccugaucuacau

SEQ ID NO: 1247983 - RNA, 19 nt, Homo sapiens
ugacauggauuucagcuuu

SEQ ID NO: 1247984 - RNA, 19 nt, Homo sapiens
caggaugaguuuagaauuu

SEQ ID NO: 1247985 - RNA, 19 nt, Homo sapiens
ugaaaccgauuuagaagaa

SEQ ID NO: 1247986 - RNA, 19 nt, Homo sapiens
gaauuaaugcugagaugua

SEQ ID NO: 1247987 - RNA, 19 nt, Homo sapiens
aaaggaagcuagaagcaaa

SEQ ID NO: 1247988 - RNA, 19 nt, Homo sapiens
gaagaacaaucaaguacca

SEQ ID NO: 1247989 - RNA, 19 nt, Homo sapiens
gaaugcagcccaacacaaa

SEQ ID NO: 1247990 - RNA, 19 nt, Homo sapiens
acacaucccuuccugauau

SEQ ID NO: 1247991 - RNA, 19 nt, Homo sapiens
agaauucgauguugaagaa

SEQ ID NO: 1247992 - RNA, 19 nt, Homo sapiens
uaucaucaguguuagcaua

SEQ ID NO: 1247993 - RNA, 19 nt, Homo sapiens
agacagugcucaggaauuu

SEQ ID NO: 1247994 - RNA, 19 nt, Homo sapiens
uaucaggcaucaucgauuu

SEQ ID NO: 1247995 - RNA, 19 nt, Homo sapiens
uaaagcagauaauguagga

SEQ ID NO: 1247996 - RNA, 19 nt, Homo sapiens
acaaucaaguaccauguua

SEQ ID NO: 1247997 - RNA, 19 nt, Homo sapiens
gugaaccucugucaguaua

SEQ ID NO: 1247998 - RNA, 19 nt, Homo sapiens
ucccugaucuacauauuua

SEQ ID NO: 1247999 - RNA, 19 nt, Homo sapiens
caaguaccauguuaggaaa

SEQ ID NO: 1248000 - RNA, 19 nt, Homo sapiens
uuucuuagcuccuguauuc

SEQ ID NO: 1248001 - RNA, 19 nt, Homo sapiens
ggacauccuugaucuacau

SEQ ID NO: 1248002 - RNA, 19 nt, Homo sapiens
ggacgaggaauacaucaaa

SEQ ID NO: 1248003 - RNA, 19 nt, Homo sapiens
uauagaaucuggcguaaag

SEQ ID NO: 1248004 - RNA, 19 nt, Homo sapiens
gagcaaauuuagguaaguu

SEQ ID NO: 1248005 - RNA, 19 nt, Homo sapiens
caucaguguuagcauauuu

SEQ ID NO: 1248006 - RNA, 19 nt, Homo sapiens
gaaccauucuuugugaaau

SEQ ID NO: 1248007 - RNA, 19 nt, Homo sapiens
ggaagaauucgauguugaa

SEQ ID NO: 1248008 - RNA, 19 nt, Homo sapiens
gaacggugguauugcacuu

SEQ ID NO: 1248009 - RNA, 19 nt, Homo sapiens
aaaucuaccuucaggauga

SEQ ID NO: 1248010 - RNA, 19 nt, Homo sapiens
ugaaggcugugaagugauu

SEQ ID NO: 1248011 - RNA, 19 nt, Homo sapiens
aaccaaaguugauauguga

SEQ ID NO: 1248012 - RNA, 19 nt, Homo sapiens
cagcuucuccuguuauuaa

SEQ ID NO: 1248013 - RNA, 19 nt, Homo sapiens
caccaaauguagaaccuuu

SEQ ID NO: 1248014 - RNA, 19 nt, Homo sapiens
cuacaggaguuacaccaaa

SEQ ID NO: 1248015 - RNA, 19 nt, Homo sapiens
guugauaugugaaggaaau

SEQ ID NO: 1248016 - RNA, 19 nt, Homo sapiens
gaaccucugucaguauaau

SEQ ID NO: 1248017 - RNA, 19 nt, Homo sapiens
uaucgucaguguuagcaua

SEQ ID NO: 1248018 - RNA, 19 nt, Homo sapiens
ugaagaacacugcauugua

SEQ ID NO: 1248019 - RNA, 19 nt, Homo sapiens
gcacagggcuuagguucag

SEQ ID NO: 1248020 - RNA, 19 nt, Homo sapiens
ucagcuaucaucaguguua

SEQ ID NO: 1248021 - RNA, 19 nt, Homo sapiens
caucagcuaucaucagugu

SEQ ID NO: 1248022 - RNA, 19 nt, Homo sapiens
caacacaaaucuguaaacu

SEQ ID NO: 1248023 - RNA, 19 nt, Homo sapiens
acacugaccgcuuagauaa

SEQ ID NO: 1248024 - RNA, 19 nt, Homo sapiens
gcugagauguaccaaagga

SEQ ID NO: 1248025 - RNA, 19 nt, Homo sapiens
gggcuuagguucagaucau

SEQ ID NO: 1248026 - RNA, 19 nt, Homo sapiens
gauguggccugucuaugug

SEQ ID NO: 1248027 - RNA, 19 nt, Homo sapiens
aaaccaaaguugauaugug

SEQ ID NO: 1248028 - RNA, 19 nt, Homo sapiens
ucagcuaucgucaguguua

SEQ ID NO: 1248029 - RNA, 19 nt, Homo sapiens
gaaaccgauuuagaagaaa

SEQ ID NO: 1248030 - RNA, 19 nt, Homo sapiens
aggagcagcugaauucuug

SEQ ID NO: 1248031 - RNA, 19 nt, Homo sapiens
agauaaagcuauagggaau

SEQ ID NO: 1248032 - RNA, 19 nt, Homo sapiens
caucagcuaucgucagugu

SEQ ID NO: 1248033 - RNA, 19 nt, Homo sapiens
cuagacagaugggauggua

SEQ ID NO: 1248034 - RNA, 19 nt, Homo sapiens
gcacacaucccuuccugau

SEQ ID NO: 1248035 - RNA, 19 nt, Homo sapiens
ggaaauccuuauguauuag

SEQ ID NO: 1248036 - RNA, 19 nt, Homo sapiens
gaacaaucaaguaccaugu

SEQ ID NO: 1248037 - RNA, 19 nt, Homo sapiens
caagagaccauaagucagu

SEQ ID NO: 1248038 - RNA, 19 nt, Homo sapiens
cagcugaauucuugacuuc

SEQ ID NO: 1248039 - RNA, 19 nt, Homo sapiens
agacaauucuucuuccaau

SEQ ID NO: 1248040 - RNA, 19 nt, Homo sapiens
agacaauucuucuuccaau

SEQ ID NO: 1248041 - RNA, 19 nt, Homo sapiens
cgucaguguuagcauauuu

SEQ ID NO: 1248042 - RNA, 19 nt, Homo sapiens
gcagcugaauucuugacuu

SEQ ID NO: 1248043 - RNA, 19 nt, Homo sapiens
gcacguauauaagaaacuc

SEQ ID NO: 1248044 - RNA, 19 nt, Homo sapiens
ucaaguaccauguuaggaa

SEQ ID NO: 1248045 - RNA, 19 nt, Homo sapiens
cagaacagcuuugaaugca

SEQ ID NO: 1248046 - RNA, 19 nt, Homo sapiens
uaccaaaggacgaggaaua

SEQ ID NO: 1248047 - RNA, 19 nt, Homo sapiens
gagacucuauugacaugga

SEQ ID NO: 1248048 - RNA, 19 nt, Homo sapiens
guauugcacuugaguuagu

SEQ ID NO: 1248049 - RNA, 19 nt, Homo sapiens
gagcuaaaccaaaguugau

SEQ ID NO: 1248050 - RNA, 19 nt, Homo sapiens
ggagcuaaaccaaaguuga

SEQ ID NO: 1248051 - RNA, 19 nt, Homo sapiens
cauccuugaucuacauauu

SEQ ID NO: 1248052 - RNA, 19 nt, Homo sapiens
uggaagaauucgauguuga

SEQ ID NO: 1248053 - RNA, 19 nt, Homo sapiens
ugauuuagcuuuggagcaa

SEQ ID NO: 1248054 - RNA, 19 nt, Homo sapiens
ggaauuucuucaggaauca

SEQ ID NO: 1248055 - RNA, 19 nt, Homo sapiens
ucaggagacucuauugaca

SEQ ID NO: 1248056 - RNA, 19 nt, Homo sapiens
agaagaugguggccugaaa

SEQ ID NO: 1248057 - RNA, 19 nt, Homo sapiens
gauauucucuugguaacag

SEQ ID NO: 1248058 - RNA, 19 nt, Homo sapiens
cuuagcuccuguauucuua

SEQ ID NO: 1248059 - RNA, 19 nt, Homo sapiens
cagugaaccucugucagua

SEQ ID NO: 1248060 - RNA, 19 nt, Homo sapiens
ugaauuguacuucugguuu

SEQ ID NO: 1248061 - RNA, 19 nt, Homo sapiens
ucugcuagauccaaauauu

SEQ ID NO: 1248062 - RNA, 19 nt, Homo sapiens
gaaccagauauacaacuga

SEQ ID NO: 1248063 - RNA, 19 nt, Homo sapiens
guauuaggaauccgugaua

SEQ ID NO: 1248064 - RNA, 19 nt, Homo sapiens
gaauuguacuucugguuuu

SEQ ID NO: 1248065 - RNA, 19 nt, Homo sapiens
gacauggauuucagcuuug

SEQ ID NO: 1248066 - RNA, 19 nt, Homo sapiens
gacccaggcuagacagaug

SEQ ID NO: 1248067 - RNA, 19 nt, Homo sapiens
gaaauugaaggcugugaag

SEQ ID NO: 1248068 - RNA, 19 nt, Homo sapiens
gauuggacauccuugaucu

SEQ ID NO: 1248069 - RNA, 19 nt, Homo sapiens
gacaauucuucuuccaaug

SEQ ID NO: 1248070 - RNA, 19 nt, Homo sapiens
gacaauucuucuuccaaug

SEQ ID NO: 1248071 - RNA, 19 nt, Homo sapiens
cagaagagcugcaguccua

SEQ ID NO: 1248072 - RNA, 19 nt, Homo sapiens
gaagggagauuagaugcua

SEQ ID NO: 1248073 - RNA, 19 nt, Homo sapiens
caaaggacguucaggaaau

SEQ ID NO: 1248074 - RNA, 19 nt, Homo sapiens
gcagugggcuaaucauuuc

SEQ ID NO: 1248075 - RNA, 19 nt, Homo sapiens
ccaccuagaugauaaugaa

SEQ ID NO: 1248076 - RNA, 19 nt, Homo sapiens
ugauagagcugaauaugga

SEQ ID NO: 1248077 - RNA, 19 nt, Homo sapiens
gagaauaacguccacaaga

SEQ ID NO: 1248078 - RNA, 19 nt, Homo sapiens
gcagcacucugaccucuga

SEQ ID NO: 1248079 - RNA, 19 nt, Homo sapiens
gaccugcccuucagaauuc

SEQ ID NO: 1248080 - RNA, 19 nt, Homo sapiens
caagguugccuauggaaua

SEQ ID NO: 1248081 - RNA, 19 nt, Homo sapiens
cuacaucgcugaggauuau

SEQ ID NO: 1248082 - RNA, 19 nt, Homo sapiens
ggacugugauugugcuaga

SEQ ID NO: 1248083 - RNA, 19 nt, Homo sapiens
uggaaagcaugaaugauuu

SEQ ID NO: 1248084 - RNA, 19 nt, Homo sapiens
ggacacaaauguacaaaau

SEQ ID NO: 1248085 - RNA, 19 nt, Homo sapiens
caagucugcuggucacauu

SEQ ID NO: 1248086 - RNA, 19 nt, Homo sapiens
ugaaccaccuagaugauaa

SEQ ID NO: 1248087 - RNA, 19 nt, Homo sapiens
uggaggagauucugcauga

SEQ ID NO: 1248088 - RNA, 19 nt, Homo sapiens
agaaggaacuguuggagau

SEQ ID NO: 1248089 - RNA, 19 nt, Homo sapiens
ggcgguguccugauuauua

SEQ ID NO: 1248090 - RNA, 19 nt, Homo sapiens
guggaaagcaugaaugauu

SEQ ID NO: 1248091 - RNA, 19 nt, Homo sapiens
gagacuaacuggccuucug

SEQ ID NO: 1248092 - RNA, 19 nt, Homo sapiens
agaauaacguccacaagau

SEQ ID NO: 1248093 - RNA, 19 nt, Homo sapiens
uaacuggccuucugauguc

SEQ ID NO: 1248094 - RNA, 19 nt, Homo sapiens
gaaagaguaugaagaaaag

SEQ ID NO: 1248095 - RNA, 19 nt, Homo sapiens
gcaggaacuucuagaggau

SEQ ID NO: 1248096 - RNA, 19 nt, Homo sapiens
gaagauguggaaagcauga

SEQ ID NO: 1248097 - RNA, 19 nt, Homo sapiens
ggagcaggcuaagcagaaa

SEQ ID NO: 1248098 - RNA, 19 nt, Homo sapiens
gaauaacguccacaagaug

SEQ ID NO: 1248099 - RNA, 19 nt, Homo sapiens
ggauuauguggaagaauua

SEQ ID NO: 1248100 - RNA, 19 nt, Homo sapiens
cagcauaucaucagcuauu

SEQ ID NO: 1248101 - RNA, 19 nt, Homo sapiens
caggaaagaguaugaagaa

SEQ ID NO: 1248102 - RNA, 19 nt, Homo sapiens
gauaaugaaguuuggauca

SEQ ID NO: 1248103 - RNA, 19 nt, Homo sapiens
caagaugcagcucccauuu

SEQ ID NO: 1248104 - RNA, 19 nt, Homo sapiens
aggauuauguggaagaauu

SEQ ID NO: 1248105 - RNA, 19 nt, Homo sapiens
ccaaaggacguucaggaaa

SEQ ID NO: 1248106 - RNA, 19 nt, Homo sapiens
gcgguguccugauuauuau

SEQ ID NO: 1248107 - RNA, 19 nt, Homo sapiens
gaauggagaaggaacuguu

SEQ ID NO: 1248108 - RNA, 19 nt, Homo sapiens
aaauggcgguguccugauu

SEQ ID NO: 1248109 - RNA, 19 nt, Homo sapiens
ggaaagaguaugaagaaaa

SEQ ID NO: 1248110 - RNA, 19 nt, Homo sapiens
ccagccaucucucauagga

SEQ ID NO: 1248111 - RNA, 19 nt, Homo sapiens
ggcagcauaucaucagcua

SEQ ID NO: 1248112 - RNA, 19 nt, Homo sapiens
ggaagaauuacacaaaugg

SEQ ID NO: 1248113 - RNA, 19 nt, Homo sapiens
guggaagaauuacacaaau

SEQ ID NO: 1248114 - RNA, 19 nt, Homo sapiens
gaagccaagcagcugguua

SEQ ID NO: 1248115 - RNA, 19 nt, Homo sapiens
ggaauagacagccucuuca

SEQ ID NO: 1248116 - RNA, 19 nt, Homo sapiens
aggaaaugcugguucagaa

SEQ ID NO: 1248117 - RNA, 19 nt, Homo sapiens
uggaagaauuacacaaaug

SEQ ID NO: 1248118 - RNA, 19 nt, Homo sapiens
aauucgagcuccagagauu

SEQ ID NO: 1248119 - RNA, 19 nt, Homo sapiens
uaucaucagcuauuuguug

SEQ ID NO: 1248120 - RNA, 19 nt, Homo sapiens
gcucgugacugggccuuga

SEQ ID NO: 1248121 - RNA, 19 nt, Homo sapiens
gaagaacaggcugggauug

SEQ ID NO: 1248122 - RNA, 19 nt, Homo sapiens
ccuagaugauaaugaaguu

SEQ ID NO: 1248123 - RNA, 19 nt, Homo sapiens
guagacagcaagccagaga

SEQ ID NO: 1248124 - RNA, 19 nt, Homo sapiens
acugauuucuuaccacauu

SEQ ID NO: 1248125 - RNA, 19 nt, Homo sapiens
ggaggacacaaauguacaa

SEQ ID NO: 1248126 - RNA, 19 nt, Homo sapiens
gcaaaugaugucugagcuu

SEQ ID NO: 1248127 - RNA, 19 nt, Homo sapiens
ucagcuuccuggagcagua

SEQ ID NO: 1248128 - RNA, 19 nt, Homo sapiens
aaaggacguucaggaaaug

SEQ ID NO: 1248129 - RNA, 19 nt, Homo sapiens
gaguggaggacacaaaugu

SEQ ID NO: 1248130 - RNA, 19 nt, Homo sapiens
aauguauccuggcaugaaa

SEQ ID NO: 1248131 - RNA, 19 nt, Homo sapiens
caauguauccuggcaugaa

SEQ ID NO: 1248132 - RNA, 19 nt, Homo sapiens
uaacuuggcagcauaucau

SEQ ID NO: 1248133 - RNA, 19 nt, Homo sapiens
ucuagaggauggccagaug

SEQ ID NO: 1248134 - RNA, 19 nt, Homo sapiens
caaaguuaagggacacuga

SEQ ID NO: 1248135 - RNA, 19 nt, Homo sapiens
agauguaccugcccaaguc

SEQ ID NO: 1248136 - RNA, 19 nt, Homo sapiens
ccacuguauucacggcaaa

SEQ ID NO: 1248137 - RNA, 19 nt, Homo sapiens
cacggcaaaugaugucuga

SEQ ID NO: 1248138 - RNA, 19 nt, Homo sapiens
gcuacaucgcugaggauua

SEQ ID NO: 1248139 - RNA, 19 nt, Homo sapiens
acaauaagccaaagaacuc

SEQ ID NO: 1248140 - RNA, 19 nt, Homo sapiens
cuucugaugucuuuguuca

SEQ ID NO: 1248141 - RNA, 19 nt, Homo sapiens
gcauaucaucagcuauuug

SEQ ID NO: 1248142 - RNA, 19 nt, Homo sapiens
uggaagauguggaaagcau

SEQ ID NO: 1248143 - RNA, 19 nt, Homo sapiens
cuaaucauuucaucuggau

SEQ ID NO: 1248144 - RNA, 19 nt, Homo sapiens
gggcuaaucauuucaucug

SEQ ID NO: 1248145 - RNA, 19 nt, Homo sapiens
gaugugcagugggcuaauc

SEQ ID NO: 1248146 - RNA, 19 nt, Homo sapiens
ccaggaaagaguaugaaga

SEQ ID NO: 1248147 - RNA, 19 nt, Homo sapiens
aggaguugcugcuggacua

SEQ ID NO: 1248148 - RNA, 19 nt, Homo sapiens
cauaucaucagcuauuugu

SEQ ID NO: 1248149 - RNA, 19 nt, Homo sapiens
cuaacuggccuucugaugu

SEQ ID NO: 1248150 - RNA, 19 nt, Homo sapiens
gaaccaccuagaugauaau

SEQ ID NO: 1248151 - RNA, 19 nt, Homo sapiens
uagacagccucuucagcuu

SEQ ID NO: 1248152 - RNA, 19 nt, Homo sapiens
agaagccggucaccacugu

SEQ ID NO: 1248153 - RNA, 19 nt, Homo sapiens
guugaucaucccauaguuu

SEQ ID NO: 1248154 - RNA, 19 nt, Homo sapiens
agcaguaaaugaagacaga

SEQ ID NO: 1248155 - RNA, 19 nt, Homo sapiens
gaagagcugcaguccuaca

SEQ ID NO: 1248156 - RNA, 19 nt, Homo sapiens
cuucugugguagagacuaa

SEQ ID NO: 1248157 - RNA, 19 nt, Homo sapiens
ucagaauucgguucacuug

SEQ ID NO: 1248158 - RNA, 19 nt, Homo sapiens
agaccugcccuucagaauu

SEQ ID NO: 1248159 - RNA, 19 nt, Homo sapiens
gaaggaacuguuggagaug

SEQ ID NO: 1248160 - RNA, 19 nt, Homo sapiens
gcuauuuguugggacagaa

SEQ ID NO: 1248161 - RNA, 19 nt, Homo sapiens
uguuuaacuuggcagcaua

SEQ ID NO: 1248162 - RNA, 19 nt, Homo sapiens
aaggaacuguuggagauga

SEQ ID NO: 1248163 - RNA, 19 nt, Homo sapiens
gacagccucuucagcuucu

SEQ ID NO: 1248164 - RNA, 19 nt, Homo sapiens
gaauauggacuccccagaa

SEQ ID NO: 1248165 - RNA, 19 nt, Homo sapiens
uggaauagacagccucuuc

SEQ ID NO: 1248166 - RNA, 19 nt, Homo sapiens
gaauagacagccucuucag

SEQ ID NO: 1248167 - RNA, 19 nt, Homo sapiens
gaucaccaggaaagaguau

SEQ ID NO: 1248168 - RNA, 19 nt, Homo sapiens
aaguuuggaucaccaggaa

SEQ ID NO: 1248169 - RNA, 19 nt, Homo sapiens
aguacauucuggacaggua

SEQ ID NO: 1248170 - RNA, 19 nt, Homo sapiens
aaugaugucugagcuucuu

SEQ ID NO: 1248171 - RNA, 19 nt, Homo sapiens
ucaaagcucuggagaauua

SEQ ID NO: 1248172 - RNA, 19 nt, Homo sapiens
gaagauuccugcacuauuu

SEQ ID NO: 1248173 - RNA, 19 nt, Homo sapiens
gaaauuagguggucaaauc

SEQ ID NO: 1248174 - RNA, 19 nt, Homo sapiens
gaagaaagacagcaauuua

SEQ ID NO: 1248175 - RNA, 19 nt, Homo sapiens
gaacugaacacuaaaguaa

SEQ ID NO: 1248176 - RNA, 19 nt, Homo sapiens
ggaaaugaguuagcuauaa

SEQ ID NO: 1248177 - RNA, 19 nt, Homo sapiens
gaaagaaaccaaaugagua

SEQ ID NO: 1248178 - RNA, 19 nt, Homo sapiens
gaacgaccauuaacccuuu

SEQ ID NO: 1248179 - RNA, 19 nt, Homo sapiens
gaaagaggguuaauuuauc

SEQ ID NO: 1248180 - RNA, 19 nt, Homo sapiens
ggauaaagcuagauucuuc

SEQ ID NO: 1248181 - RNA, 19 nt, Homo sapiens
aaacaacucuucugggaua

SEQ ID NO: 1248182 - RNA, 19 nt, Homo sapiens
gaugaaagcagucaagaua

SEQ ID NO: 1248183 - RNA, 19 nt, Homo sapiens
aaaggugacugaagaaaua

SEQ ID NO: 1248184 - RNA, 19 nt, Homo sapiens
gaaauguucucaaauguag

SEQ ID NO: 1248185 - RNA, 19 nt, Homo sapiens
uagaagaucuggaagaauu

SEQ ID NO: 1248186 - RNA, 19 nt, Homo sapiens
gcaaagaagacuauaguuu

SEQ ID NO: 1248187 - RNA, 19 nt, Homo sapiens
gaagaaaucaaguucagua

SEQ ID NO: 1248188 - RNA, 19 nt, Homo sapiens
gagcuuggauuuaagauau

SEQ ID NO: 1248189 - RNA, 19 nt, Homo sapiens
gcaaauacuugugauauca

SEQ ID NO: 1248190 - RNA, 19 nt, Homo sapiens
ggaaggaauuuacugaaga

SEQ ID NO: 1248191 - RNA, 19 nt, Homo sapiens
caaacaagguguaaacuca

SEQ ID NO: 1248192 - RNA, 19 nt, Homo sapiens
aagaagagcugaauuggaa

SEQ ID NO: 1248193 - RNA, 19 nt, Homo sapiens
gaaggaauuuacugaagaa

SEQ ID NO: 1248194 - RNA, 19 nt, Homo sapiens
gggaaagagugcaagauaa

SEQ ID NO: 1248195 - RNA, 19 nt, Homo sapiens
uaaauucucucucugaguu

SEQ ID NO: 1248196 - RNA, 19 nt, Homo sapiens
ggaaauagcagaaauguac

SEQ ID NO: 1248197 - RNA, 19 nt, Homo sapiens
gcagaaagaccuuaaugaa

SEQ ID NO: 1248198 - RNA, 19 nt, Homo sapiens
uagcagaaauguacaacua

SEQ ID NO: 1248199 - RNA, 19 nt, Homo sapiens
ccagugaacuuauaggaaa

SEQ ID NO: 1248200 - RNA, 19 nt, Homo sapiens
gaacauggccuugauaaca

SEQ ID NO: 1248201 - RNA, 19 nt, Homo sapiens
gaaacaauccagagacaaa

SEQ ID NO: 1248202 - RNA, 19 nt, Homo sapiens
caaauucuaucucaguuga

SEQ ID NO: 1248203 - RNA, 19 nt, Homo sapiens
gaaaugcagagauguagua

SEQ ID NO: 1248204 - RNA, 19 nt, Homo sapiens
ggaaagagugcaagauaaa

SEQ ID NO: 1248205 - RNA, 19 nt, Homo sapiens
gacccaacauuuaguuuaa

SEQ ID NO: 1248206 - RNA, 19 nt, Homo sapiens
gaaagacagcaauuuauga

SEQ ID NO: 1248207 - RNA, 19 nt, Homo sapiens
gaaauugucagaaacagaa

SEQ ID NO: 1248208 - RNA, 19 nt, Homo sapiens
caugcaaacucuagagaua

SEQ ID NO: 1248209 - RNA, 19 nt, Homo sapiens
aaaugaagcuccaauugaa

SEQ ID NO: 1248210 - RNA, 19 nt, Homo sapiens
uaucuuggcugcuaacauu

SEQ ID NO: 1248211 - RNA, 19 nt, Homo sapiens
gcgcaauaauguauacuuu

SEQ ID NO: 1248212 - RNA, 19 nt, Homo sapiens
gaaaucaaguucaguacuc

SEQ ID NO: 1248213 - RNA, 19 nt, Homo sapiens
gaagauauagcaaaugaug

SEQ ID NO: 1248214 - RNA, 19 nt, Homo sapiens
aaagaaagaugaugacaca

SEQ ID NO: 1248215 - RNA, 19 nt, Homo sapiens
gcaacuaauucaaauguca

SEQ ID NO: 1248216 - RNA, 19 nt, Homo sapiens
ucagagagcccuauuagaa

SEQ ID NO: 1248217 - RNA, 19 nt, Homo sapiens
ggaaauguucucaaaugua

SEQ ID NO: 1248218 - RNA, 19 nt, Homo sapiens
caaaugagaagacacaauu

SEQ ID NO: 1248219 - RNA, 19 nt, Homo sapiens
gaggauaucagucauuaaa

SEQ ID NO: 1248220 - RNA, 19 nt, Homo sapiens
gaugauggguguuguuugu

SEQ ID NO: 1248221 - RNA, 19 nt, Homo sapiens
agaaauagcgauacccuua

SEQ ID NO: 1248222 - RNA, 19 nt, Homo sapiens
ggacuuuccugaucaaucu

SEQ ID NO: 1248223 - RNA, 19 nt, Homo sapiens
ugaauugucuugcuaggaa

SEQ ID NO: 1248224 - RNA, 19 nt, Homo sapiens
uaaacgaccuguaauccuu

SEQ ID NO: 1248225 - RNA, 19 nt, Homo sapiens
uaagaugaacucccuauuu

SEQ ID NO: 1248226 - RNA, 19 nt, Homo sapiens
ugaaugaugugcuaggaaa

SEQ ID NO: 1248227 - RNA, 19 nt, Homo sapiens
gaagagauccaaccaacga

SEQ ID NO: 1248228 - RNA, 19 nt, Homo sapiens
agaaaugacuuuaguugga

SEQ ID NO: 1248229 - RNA, 19 nt, Homo sapiens
gauaacauguccuucuuag

SEQ ID NO: 1248230 - RNA, 19 nt, Homo sapiens
gcagccaacuuaucggaaa

SEQ ID NO: 1248231 - RNA, 19 nt, Homo sapiens
acaagugacccaacauuua

SEQ ID NO: 1248232 - RNA, 19 nt, Homo sapiens
aaaauaagcuccccuaaga

SEQ ID NO: 1248233 - RNA, 19 nt, Homo sapiens
gaacugaagacaugcuuug

SEQ ID NO: 1248234 - RNA, 19 nt, Homo sapiens
gaaauagcgauacccuuaa

SEQ ID NO: 1248235 - RNA, 19 nt, Homo sapiens
cuaaacagauggagaauac

SEQ ID NO: 1248236 - RNA, 19 nt, Homo sapiens
gaaauuaguagcgacgaua

SEQ ID NO: 1248237 - RNA, 19 nt, Homo sapiens
guucucaaauguagaguuu

SEQ ID NO: 1248238 - RNA, 19 nt, Homo sapiens
gaacagaaacaaauuacuc

SEQ ID NO: 1248239 - RNA, 19 nt, Homo sapiens
caaagauucuggaacugaa

SEQ ID NO: 1248240 - RNA, 19 nt, Homo sapiens
gcauaccaguuaaagauau

SEQ ID NO: 1248241 - RNA, 19 nt, Homo sapiens
gcagcccaguuaaaugaua

SEQ ID NO: 1248242 - RNA, 19 nt, Homo sapiens
caagaaacaaguagaggua

SEQ ID NO: 1248243 - RNA, 19 nt, Homo sapiens
aagaggauaucagucauua

SEQ ID NO: 1248244 - RNA, 19 nt, Homo sapiens
ucagucagcagcuaauuua

SEQ ID NO: 1248245 - RNA, 19 nt, Homo sapiens
uaacauguccuucuuagau

SEQ ID NO: 1248246 - RNA, 19 nt, Homo sapiens
uaaaacaacugcaggaaaa

SEQ ID NO: 1248247 - RNA, 19 nt, Homo sapiens
gagagucgucuuugcaaua

SEQ ID NO: 1248248 - RNA, 19 nt, Homo sapiens
aaagcuagauucuuccaaa

SEQ ID NO: 1248249 - RNA, 19 nt, Homo sapiens
gaaaccaaaugaguauuca

SEQ ID NO: 1248250 - RNA, 19 nt, Homo sapiens
ugacacaucuaccugcaaa

SEQ ID NO: 1248251 - RNA, 19 nt, Homo sapiens
cagaaagaccuuaaugaaa

SEQ ID NO: 1248252 - RNA, 19 nt, Homo sapiens
guaugugagugaacuguuu

SEQ ID NO: 1248253 - RNA, 19 nt, Homo sapiens
ucucugaguucauggauaa

SEQ ID NO: 1248254 - RNA, 19 nt, Homo sapiens
cagacuaaaucuacaaaug

SEQ ID NO: 1248255 - RNA, 19 nt, Homo sapiens
gaacuuauaggaaaugagu

SEQ ID NO: 1248256 - RNA, 19 nt, Homo sapiens
aagcgugacuuccuaauga

SEQ ID NO: 1248257 - RNA, 19 nt, Homo sapiens
ggaagaaauugucagaaac

SEQ ID NO: 1248258 - RNA, 19 nt, Homo sapiens
gaaguaggaagagaugaua

SEQ ID NO: 1248259 - RNA, 19 nt, Homo sapiens
uaucugauccugagaauga

SEQ ID NO: 1248260 - RNA, 19 nt, Homo sapiens
gguaauagacaagcuagua

SEQ ID NO: 1248261 - RNA, 19 nt, Homo sapiens
gagucgaucucuucucuau

SEQ ID NO: 1248262 - RNA, 19 nt, Homo sapiens
gaaagagaacagccauuga

SEQ ID NO: 1248263 - RNA, 19 nt, Homo sapiens
gaaggaagaauggcauaaa

SEQ ID NO: 1248264 - RNA, 19 nt, Homo sapiens
aaagaaacguguagaccuu

SEQ ID NO: 1248265 - RNA, 19 nt, Homo sapiens
gcagaaauguacaacuagu

SEQ ID NO: 1248266 - RNA, 19 nt, Homo sapiens
ugaugaagaugcuggguuu

SEQ ID NO: 1248267 - RNA, 19 nt, Homo sapiens
gcgcagugguagacaaauu

SEQ ID NO: 1248268 - RNA, 19 nt, Homo sapiens
gaagaaauugucagaaaca

SEQ ID NO: 1248269 - RNA, 19 nt, Homo sapiens
caauuuguguuccuucuga

SEQ ID NO: 1248270 - RNA, 19 nt, Homo sapiens
gcagaaaacauucaagaua

SEQ ID NO: 1248271 - RNA, 19 nt, Homo sapiens
gguuagagcuguagauaga

SEQ ID NO: 1248272 - RNA, 19 nt, Homo sapiens
gugaagaggugaacacuug

SEQ ID NO: 1248273 - RNA, 19 nt, Homo sapiens
gagggaagcuguggucuga

SEQ ID NO: 1248274 - RNA, 19 nt, Homo sapiens
cuacucaacuauccgaaua

SEQ ID NO: 1248275 - RNA, 19 nt, Homo sapiens
gcagagaauugcuugaauc

SEQ ID NO: 1248276 - RNA, 19 nt, Homo sapiens
ggacgacgcucaagaagac

SEQ ID NO: 1248277 - RNA, 19 nt, Homo sapiens
cagcagcacuucccuaguu

SEQ ID NO: 1248278 - RNA, 19 nt, Homo sapiens
guacagggucucacacaua

SEQ ID NO: 1248279 - RNA, 19 nt, Homo sapiens
ggucaaagcacgauuuaau

SEQ ID NO: 1248280 - RNA, 19 nt, Homo sapiens
ggaaggaagaaagaauuua

SEQ ID NO: 1248281 - RNA, 19 nt, Homo sapiens
gcugauguauguaaugaga

SEQ ID NO: 1248282 - RNA, 19 nt, Homo sapiens
gcuacuggcuuuauugcaa

SEQ ID NO: 1248283 - RNA, 19 nt, Homo sapiens
ggucgauccugcuugagua

SEQ ID NO: 1248284 - RNA, 19 nt, Homo sapiens
ucaccugcauugacaagua

SEQ ID NO: 1248285 - RNA, 19 nt, Homo sapiens
uacaauaguugcacaucua

SEQ ID NO: 1248286 - RNA, 19 nt, Homo sapiens
acacugagccuaccucuga

SEQ ID NO: 1248287 - RNA, 19 nt, Homo sapiens
gaggaacggugaagacaag

SEQ ID NO: 1248288 - RNA, 19 nt, Homo sapiens
uacagggucucacacauaa

SEQ ID NO: 1248289 - RNA, 19 nt, Homo sapiens
ggccuagucugccagcuuu

SEQ ID NO: 1248290 - RNA, 19 nt, Homo sapiens
gcuugcacauguuaucuuu

SEQ ID NO: 1248291 - RNA, 19 nt, Homo sapiens
gcuggacucugcggacaua

SEQ ID NO: 1248292 - RNA, 19 nt, Homo sapiens
ccaagucuguccucucaau

SEQ ID NO: 1248293 - RNA, 19 nt, Homo sapiens
gcuguggucugacggaaug

SEQ ID NO: 1248294 - RNA, 19 nt, Homo sapiens
gcacaucuacucaacuauc

SEQ ID NO: 1248295 - RNA, 19 nt, Homo sapiens
gggaaggaagaaagaauuu

SEQ ID NO: 1248296 - RNA, 19 nt, Homo sapiens
uagcugauguauguaauga

SEQ ID NO: 1248297 - RNA, 19 nt, Homo sapiens
uaacgcaccuccccaauug

SEQ ID NO: 1248298 - RNA, 19 nt, Homo sapiens
gaaagaggaacggugaaga

SEQ ID NO: 1248299 - RNA, 19 nt, Homo sapiens
aguaaucgcugacgagcuu

SEQ ID NO: 1248300 - RNA, 19 nt, Homo sapiens
uugcacaucuacucaacua

SEQ ID NO: 1248301 - RNA, 19 nt, Homo sapiens
gggucucacacauaaauua

SEQ ID NO: 1248302 - RNA, 19 nt, Homo sapiens
gcuccucuccuuauucauu

SEQ ID NO: 1248303 - RNA, 19 nt, Homo sapiens
gcuggaggaacaagacaua

SEQ ID NO: 1248304 - RNA, 19 nt, Homo sapiens
gacagucgccugccucaug

SEQ ID NO: 1248305 - RNA, 19 nt, Homo sapiens
gagugcagauagcuacaga

SEQ ID NO: 1248306 - RNA, 19 nt, Homo sapiens
ggcagagaauugcuugaau

SEQ ID NO: 1248307 - RNA, 19 nt, Homo sapiens
ggaagaaagaauuuaaagg

SEQ ID NO: 1248308 - RNA, 19 nt, Homo sapiens
cgggagaggcccagaguuu

SEQ ID NO: 1248309 - RNA, 19 nt, Homo sapiens
cagcaccguugguuagaga

SEQ ID NO: 1248310 - RNA, 19 nt, Homo sapiens
uuguguagcugauguaugu

SEQ ID NO: 1248311 - RNA, 19 nt, Homo sapiens
gcacauguuaucuuugcuu

SEQ ID NO: 1248312 - RNA, 19 nt, Homo sapiens
ccacaucaacggagaguca

SEQ ID NO: 1248313 - RNA, 19 nt, Homo sapiens
cccaauugauccaggguaa

SEQ ID NO: 1248314 - RNA, 19 nt, Homo sapiens
ugacagagcgagaaucagu

SEQ ID NO: 1248315 - RNA, 19 nt, Homo sapiens
gaauuuaaaggaccggaau

SEQ ID NO: 1248316 - RNA, 19 nt, Homo sapiens
gccaccauguacuuaguuu

SEQ ID NO: 1248317 - RNA, 19 nt, Homo sapiens
gagggucaaagcacgauuu

SEQ ID NO: 1248318 - RNA, 19 nt, Homo sapiens
gcaccaguguauccacagu

SEQ ID NO: 1248319 - RNA, 19 nt, Homo sapiens
ccucagggcaaacuaugua

SEQ ID NO: 1248320 - RNA, 19 nt, Homo sapiens
agucuggcgugcuuucuuu

SEQ ID NO: 1248321 - RNA, 19 nt, Homo sapiens
gugggucgauccugcuuga

SEQ ID NO: 1248322 - RNA, 19 nt, Homo sapiens
ggugacagagcgagaauca

SEQ ID NO: 1248323 - RNA, 19 nt, Homo sapiens
acacccaggagacuaauaa

SEQ ID NO: 1248324 - RNA, 19 nt, Homo sapiens
gagccccagucuauaaaua

SEQ ID NO: 1248325 - RNA, 19 nt, Homo sapiens
cauguuaucuuugcuucug

SEQ ID NO: 1248326 - RNA, 19 nt, Homo sapiens
ucccaagucuguccucuca

SEQ ID NO: 1248327 - RNA, 19 nt, Homo sapiens
caagagccccagucuauaa

SEQ ID NO: 1248328 - RNA, 19 nt, Homo sapiens
ugacggaaugggcaacuuu

SEQ ID NO: 1248329 - RNA, 19 nt, Homo sapiens
cuccucuccuuauucauua

SEQ ID NO: 1248330 - RNA, 19 nt, Homo sapiens
uaaugagaguagacagaug

SEQ ID NO: 1248331 - RNA, 19 nt, Homo sapiens
gguaccaucucauccuucu

SEQ ID NO: 1248332 - RNA, 19 nt, Homo sapiens
gcuagguacuguggagaug

SEQ ID NO: 1248333 - RNA, 19 nt, Homo sapiens
cuacaauaguugcacaucu

SEQ ID NO: 1248334 - RNA, 19 nt, Homo sapiens
ccagucaccuccgcuguca

SEQ ID NO: 1248335 - RNA, 19 nt, Homo sapiens
gaaaccccgucucuacuga

SEQ ID NO: 1248336 - RNA, 19 nt, Homo sapiens
guaaugagaguagacagau

SEQ ID NO: 1248337 - RNA, 19 nt, Homo sapiens
ggaggaacaagacauaaaa

SEQ ID NO: 1248338 - RNA, 19 nt, Homo sapiens
gugcagauagcuacagaga

SEQ ID NO: 1248339 - RNA, 19 nt, Homo sapiens
cccaggagacuaauaauag

SEQ ID NO: 1248340 - RNA, 19 nt, Homo sapiens
ggaggugugguucuucaga

SEQ ID NO: 1248341 - RNA, 19 nt, Homo sapiens
ucgauccggucuugacuug

SEQ ID NO: 1248342 - RNA, 19 nt, Homo sapiens
caccugcauugacaaguau

SEQ ID NO: 1248343 - RNA, 19 nt, Homo sapiens
ucaacuauccgaauauguc

SEQ ID NO: 1248344 - RNA, 19 nt, Homo sapiens
ggaaagaggaacggugaag

SEQ ID NO: 1248345 - RNA, 19 nt, Homo sapiens
ccucgcagcgucaguggua

SEQ ID NO: 1248346 - RNA, 19 nt, Homo sapiens
gaucacgaggucaagaguu

SEQ ID NO: 1248347 - RNA, 19 nt, Homo sapiens
cuacuggcuuuauugcaau

SEQ ID NO: 1248348 - RNA, 19 nt, Homo sapiens
gugguuagagcuguagaua

SEQ ID NO: 1248349 - RNA, 19 nt, Homo sapiens
ccuguaaucccagcacuuu

SEQ ID NO: 1248350 - RNA, 19 nt, Homo sapiens
guggaggugugguucuuca

SEQ ID NO: 1248351 - RNA, 19 nt, Homo sapiens
cagguaccaucucauccuu

SEQ ID NO: 1248352 - RNA, 19 nt, Homo sapiens
aaauuagccagguguggua

SEQ ID NO: 1248353 - RNA, 19 nt, Homo sapiens
ugauguauguaaugagagu

SEQ ID NO: 1248354 - RNA, 19 nt, Homo sapiens
uuccguacauggugaagaa

SEQ ID NO: 1248355 - RNA, 19 nt, Homo sapiens
uaccaucucauccuucuau

SEQ ID NO: 1248356 - RNA, 19 nt, Homo sapiens
gcgcugaggaucccaacga

SEQ ID NO: 1248357 - RNA, 19 nt, Homo sapiens
uggagaugcuggaggaaca

SEQ ID NO: 1248358 - RNA, 19 nt, Homo sapiens
caccauguacuuaguuuua

SEQ ID NO: 1248359 - RNA, 19 nt, Homo sapiens
ggagcugguucgcgguuac

SEQ ID NO: 1248360 - RNA, 19 nt, Homo sapiens
gcuagugcccagcgaggaa

SEQ ID NO: 1248361 - RNA, 19 nt, Homo sapiens
agagcagccuggccaagau

SEQ ID NO: 1248362 - RNA, 19 nt, Homo sapiens
uggaggaacaagacauaaa

SEQ ID NO: 1248363 - RNA, 19 nt, Homo sapiens
agucuguccucucaauuuc

SEQ ID NO: 1248364 - RNA, 19 nt, Homo sapiens
uuagagcuguagauagaca

SEQ ID NO: 1248365 - RNA, 19 nt, Homo sapiens
cagggucucacacauaaau

SEQ ID NO: 1248366 - RNA, 19 nt, Homo sapiens
cugcuccucuccuuauuca

SEQ ID NO: 1248367 - RNA, 19 nt, Homo sapiens
aggcugaggcagagaauug

SEQ ID NO: 1248368 - RNA, 19 nt, Homo sapiens
cagccaccauguacuuagu

SEQ ID NO: 1248369 - RNA, 19 nt, Homo sapiens
cgauccugcuugaguaauc

SEQ ID NO: 1248370 - RNA, 19 nt, Homo sapiens
gagcagccuggccaagaug

SEQ ID NO: 1248371 - RNA, 19 nt, Homo sapiens
ucaaggaggacuucaauua

SEQ ID NO: 1248372 - RNA, 19 nt, Homo sapiens
ggacauacgguaguaauaa

SEQ ID NO: 1248373 - RNA, 19 nt, Homo sapiens
gggaaucacugcuaauugu

SEQ ID NO: 1248374 - RNA, 19 nt, Homo sapiens
gggaggaggugcugacuga

SEQ ID NO: 1248375 - RNA, 19 nt, Homo sapiens
gaauaaacccuaagacauc

SEQ ID NO: 1248376 - RNA, 19 nt, Homo sapiens
gaucuuacaucaguuguug

SEQ ID NO: 1248377 - RNA, 19 nt, Homo sapiens
ggagacagcugcuucaaaa

SEQ ID NO: 1248378 - RNA, 19 nt, Homo sapiens
gaagagggagccuuuguga

SEQ ID NO: 1248379 - RNA, 19 nt, Homo sapiens
gaaucacugcuaauuguua

SEQ ID NO: 1248380 - RNA, 19 nt, Homo sapiens
gagcugaccaccacacuaa

SEQ ID NO: 1248381 - RNA, 19 nt, Homo sapiens
agagggagccuuugugaua

SEQ ID NO: 1248382 - RNA, 19 nt, Homo sapiens
ggaauaaacccuaagacau

SEQ ID NO: 1248383 - RNA, 19 nt, Homo sapiens
ccacucagcccauuccuaa

SEQ ID NO: 1248384 - RNA, 19 nt, Homo sapiens
aaggaggacuucaauuauu

SEQ ID NO: 1248385 - RNA, 19 nt, Homo sapiens
ucacaacgccaaucuagaa

SEQ ID NO: 1248386 - RNA, 19 nt, Homo sapiens
ugaaagguaaggcaaauuu

SEQ ID NO: 1248387 - RNA, 19 nt, Homo sapiens
ggaggacuucaauuauuua

SEQ ID NO: 1248388 - RNA, 19 nt, Homo sapiens
uuaauaagcuguguaacug

SEQ ID NO: 1248389 - RNA, 19 nt, Homo sapiens
ugaaaagacucuggauuua

SEQ ID NO: 1248390 - RNA, 19 nt, Homo sapiens
aggaggacuucaauuauuu

SEQ ID NO: 1248391 - RNA, 19 nt, Homo sapiens
caaggaggacuucaauuau

SEQ ID NO: 1248392 - RNA, 19 nt, Homo sapiens
gaccuaugccacagacuua

SEQ ID NO: 1248393 - RNA, 19 nt, Homo sapiens
ucacaaauauucccaagcu

SEQ ID NO: 1248394 - RNA, 19 nt, Homo sapiens
ggcaacugauucauaugua

SEQ ID NO: 1248395 - RNA, 19 nt, Homo sapiens
caacgccaaucuagaauac

SEQ ID NO: 1248396 - RNA, 19 nt, Homo sapiens
gagggaacagcaagccuua

SEQ ID NO: 1248397 - RNA, 19 nt, Homo sapiens
ugaccaagguuuacucagu

SEQ ID NO: 1248398 - RNA, 19 nt, Homo sapiens
auaauagacuuuggaggua

SEQ ID NO: 1248399 - RNA, 19 nt, Homo sapiens
gaacagcagacuugggaau

SEQ ID NO: 1248400 - RNA, 19 nt, Homo sapiens
caaaguuggugugcuagga

SEQ ID NO: 1248401 - RNA, 19 nt, Homo sapiens
gcaacugauucauauguac

SEQ ID NO: 1248402 - RNA, 19 nt, Homo sapiens
uagaauacucugcgaauug

SEQ ID NO: 1248403 - RNA, 19 nt, Homo sapiens
gggaauaaacccuaagaca

SEQ ID NO: 1248404 - RNA, 19 nt, Homo sapiens
gaaaagacucuggauuuaa

SEQ ID NO: 1248405 - RNA, 19 nt, Homo sapiens
uaaggaagucuaugcgaaa

SEQ ID NO: 1248406 - RNA, 19 nt, Homo sapiens
ugauucauauguacgguuu

SEQ ID NO: 1248407 - RNA, 19 nt, Homo sapiens
agacauacuaaaccacuua

SEQ ID NO: 1248408 - RNA, 19 nt, Homo sapiens
gccugacgaucacaaauau

SEQ ID NO: 1248409 - RNA, 19 nt, Homo sapiens
gcgcugggauuuccuaugc

SEQ ID NO: 1248410 - RNA, 19 nt, Homo sapiens
caacacuuaugggcaaaug

SEQ ID NO: 1248411 - RNA, 19 nt, Homo sapiens
gagggcagccugacgauca

SEQ ID NO: 1248412 - RNA, 19 nt, Homo sapiens
gagggagccuuugugauag

SEQ ID NO: 1248413 - RNA, 19 nt, Homo sapiens
caugaaagguaaggcaaau

SEQ ID NO: 1248414 - RNA, 19 nt, Homo sapiens
gaggaaaaguagcaaaguu

SEQ ID NO: 1248415 - RNA, 19 nt, Homo sapiens
ggaagucuaugcgaaacuc

SEQ ID NO: 1248416 - RNA, 19 nt, Homo sapiens
gaccaccacacuaaaggua

SEQ ID NO: 1248417 - RNA, 19 nt, Homo sapiens
guuagcaguuucccuguuc

SEQ ID NO: 1248418 - RNA, 19 nt, Homo sapiens
agaauacucugcgaauugu

SEQ ID NO: 1248419 - RNA, 19 nt, Homo sapiens
ugugauggccuauagcuuu

SEQ ID NO: 1248420 - RNA, 19 nt, Homo sapiens
cuagaauacucugcgaauu

SEQ ID NO: 1248421 - RNA, 19 nt, Homo sapiens
gcuaauacucauugauguu

SEQ ID NO: 1248422 - RNA, 19 nt, Homo sapiens
uaacuaagucuuguugugu

SEQ ID NO: 1248423 - RNA, 19 nt, Homo sapiens
ggaaucacugcuaauuguu

SEQ ID NO: 1248424 - RNA, 19 nt, Homo sapiens
agguaagggugauguguuu

SEQ ID NO: 1248425 - RNA, 19 nt, Homo sapiens
gaggaaaauuuggaucuuu

SEQ ID NO: 1248426 - RNA, 19 nt, Homo sapiens
gcugggauuuccuaugcaa

SEQ ID NO: 1248427 - RNA, 19 nt, Homo sapiens
gaauugucuucggauggua

SEQ ID NO: 1248428 - RNA, 19 nt, Homo sapiens
ccacuuagccaaucacaac

SEQ ID NO: 1248429 - RNA, 19 nt, Homo sapiens
ggaggaagaagaggaugaa

SEQ ID NO: 1248430 - RNA, 19 nt, Homo sapiens
gauaguuacccaaaguuca

SEQ ID NO: 1248431 - RNA, 19 nt, Homo sapiens
ggaagagggagccuuugug

SEQ ID NO: 1248432 - RNA, 19 nt, Homo sapiens
ccuaaaggccaugagauuu

SEQ ID NO: 1248433 - RNA, 19 nt, Homo sapiens
uaaaccacuuagccaauca

SEQ ID NO: 1248434 - RNA, 19 nt, Homo sapiens
uguccucucuggccauaaa

SEQ ID NO: 1248435 - RNA, 19 nt, Homo sapiens
ccaaaguucagucuagaug

SEQ ID NO: 1248436 - RNA, 19 nt, Homo sapiens
gacauacgguaguaauaac

SEQ ID NO: 1248437 - RNA, 19 nt, Homo sapiens
gagaaggauuuggccaaca

SEQ ID NO: 1248438 - RNA, 19 nt, Homo sapiens
aaaggcaccuaguguacga

SEQ ID NO: 1248439 - RNA, 19 nt, Homo sapiens
guaauaaggaagucuaugc

SEQ ID NO: 1248440 - RNA, 19 nt, Homo sapiens
caaauauucccaagcucaa

SEQ ID NO: 1248441 - RNA, 19 nt, Homo sapiens
gcugguggcccuugugaug

SEQ ID NO: 1248442 - RNA, 19 nt, Homo sapiens
gcugaaaggcaccuagugu

SEQ ID NO: 1248443 - RNA, 19 nt, Homo sapiens
acuggcaacugauucauau

SEQ ID NO: 1248444 - RNA, 19 nt, Homo sapiens
aauaaacccuaagacauca

SEQ ID NO: 1248445 - RNA, 19 nt, Homo sapiens
guagaccccugguuuaaau

SEQ ID NO: 1248446 - RNA, 19 nt, Homo sapiens
acagcaagccuuacagguu

SEQ ID NO: 1248447 - RNA, 19 nt, Homo sapiens
agaaggauuuggccaacau

SEQ ID NO: 1248448 - RNA, 19 nt, Homo sapiens
gaggaguucagagagcuua

SEQ ID NO: 1248449 - RNA, 19 nt, Homo sapiens
gugauggccuauagcuuuc

SEQ ID NO: 1248450 - RNA, 19 nt, Homo sapiens
ccggagagcugcuguucgu

SEQ ID NO: 1248451 - RNA, 19 nt, Homo sapiens
aaccaccucucagggaaua

SEQ ID NO: 1248452 - RNA, 19 nt, Homo sapiens
ugacaacacagaugacaca

SEQ ID NO: 1248453 - RNA, 19 nt, Homo sapiens
ggagguagaccccugguuu

SEQ ID NO: 1248454 - RNA, 19 nt, Homo sapiens
uaagucuuguuguguuuca

SEQ ID NO: 1248455 - RNA, 19 nt, Homo sapiens
acuaagucuuguuguguuu

SEQ ID NO: 1248456 - RNA, 19 nt, Homo sapiens
auaacuaagucuuguugug

SEQ ID NO: 1248457 - RNA, 19 nt, Homo sapiens
gguagccacucagcccauu

SEQ ID NO: 1248458 - RNA, 19 nt, Homo sapiens
aagcuaauacucauugaug

SEQ ID NO: 1248459 - RNA, 19 nt, Homo sapiens
ggagcugaccaccacacua

SEQ ID NO: 1248460 - RNA, 19 nt, Homo sapiens
gggaagagggagccuuugu

SEQ ID NO: 1248461 - RNA, 19 nt, Homo sapiens
ggaagaagaggaugaaaag

SEQ ID NO: 1248462 - RNA, 19 nt, Homo sapiens
cagguucgcuauggucaga

SEQ ID NO: 1248463 - RNA, 19 nt, Homo sapiens
gaaagguaaggcaaauuuu

SEQ ID NO: 1248464 - RNA, 19 nt, Homo sapiens
caguggacauacgguagua

SEQ ID NO: 1248465 - RNA, 19 nt, Homo sapiens
gcuaauuguuacuuaaagc

SEQ ID NO: 1248466 - RNA, 19 nt, Homo sapiens
guaagggugauguguuuua

SEQ ID NO: 1248467 - RNA, 19 nt, Homo sapiens
gggaacagcaagccuuaca

SEQ ID NO: 1248468 - RNA, 19 nt, Homo sapiens
aggaggugcugacugaaga

SEQ ID NO: 1248469 - RNA, 19 nt, Homo sapiens
cugaaaggcaccuagugua

SEQ ID NO: 1248470 - RNA, 19 nt, Homo sapiens
gcuuggagcacccgauguu

SEQ ID NO: 1248471 - RNA, 19 nt, Homo sapiens
gaaacgggcuucuccuuga

SEQ ID NO: 1248472 - RNA, 19 nt, Homo sapiens
gagggcagcuugagaagaa

SEQ ID NO: 1248473 - RNA, 19 nt, Homo sapiens
gugaugaaaugcuguauau

SEQ ID NO: 1248474 - RNA, 19 nt, Homo sapiens
gcaagucgcugagcugaca

SEQ ID NO: 1248475 - RNA, 19 nt, Homo sapiens
ccaccaugauugucaguuu

SEQ ID NO: 1248476 - RNA, 19 nt, Homo sapiens
ccaaaucucagguagaauu

SEQ ID NO: 1248477 - RNA, 19 nt, Homo sapiens
cagccaugcuuccuguaua

SEQ ID NO: 1248478 - RNA, 19 nt, Homo sapiens
ggacuacucccaucugcuu

SEQ ID NO: 1248479 - RNA, 19 nt, Homo sapiens
gcucaugugcugauggaua

SEQ ID NO: 1248480 - RNA, 19 nt, Homo sapiens
gaaaggguacuguccacuu

SEQ ID NO: 1248481 - RNA, 19 nt, Homo sapiens
gugccaagcucuccaugug

SEQ ID NO: 1248482 - RNA, 19 nt, Homo sapiens
ucgcugagcugacaguugu

SEQ ID NO: 1248483 - RNA, 19 nt, Homo sapiens
gccgaggacugucaccauu

SEQ ID NO: 1248484 - RNA, 19 nt, Homo sapiens
aaaugaaugugcuggguau

SEQ ID NO: 1248485 - RNA, 19 nt, Homo sapiens
cucaugugcugauggauaa

SEQ ID NO: 1248486 - RNA, 19 nt, Homo sapiens
guggccagcuccucacuug

SEQ ID NO: 1248487 - RNA, 19 nt, Homo sapiens
ggaccuuggugccaucuac

SEQ ID NO: 1248488 - RNA, 19 nt, Homo sapiens
ggauuucucccuuacuguu

SEQ ID NO: 1248489 - RNA, 19 nt, Homo sapiens
ggugaugaaaugcuguaua

SEQ ID NO: 1248490 - RNA, 19 nt, Homo sapiens
acccaaaucucagguagaa

SEQ ID NO: 1248491 - RNA, 19 nt, Homo sapiens
gcaaacuaaagccaacuga

SEQ ID NO: 1248492 - RNA, 19 nt, Homo sapiens
ggcccugccugcacuguau

SEQ ID NO: 1248493 - RNA, 19 nt, Homo sapiens
ugaaugugcuggguauaca

SEQ ID NO: 1248494 - RNA, 19 nt, Homo sapiens
ccuccuaccucguucuuag

SEQ ID NO: 1248495 - RNA, 19 nt, Homo sapiens
uuacuguucucaugauagu

SEQ ID NO: 1248496 - RNA, 19 nt, Homo sapiens
ggaaguggccccugauaug

SEQ ID NO: 1248497 - RNA, 19 nt, Homo sapiens
ggagaacaaucagcuucca

SEQ ID NO: 1248498 - RNA, 19 nt, Homo sapiens
guggauuucucccuuacug

SEQ ID NO: 1248499 - RNA, 19 nt, Homo sapiens
caaaucucagguagaauug

SEQ ID NO: 1248500 - RNA, 19 nt, Homo sapiens
gccauuccuuggugaugaa

SEQ ID NO: 1248501 - RNA, 19 nt, Homo sapiens
ggacaaguuccaggucuuc

SEQ ID NO: 1248502 - RNA, 19 nt, Homo sapiens
aaucucagguagaauugga

SEQ ID NO: 1248503 - RNA, 19 nt, Homo sapiens
cgaggacugucaccauugg

SEQ ID NO: 1248504 - RNA, 19 nt, Homo sapiens
caccaugauugucaguuuc

SEQ ID NO: 1248505 - RNA, 19 nt, Homo sapiens
uaagauaugccuccuucuc

SEQ ID NO: 1248506 - RNA, 19 nt, Homo sapiens
ccuuacuguucucaugaua

SEQ ID NO: 1248507 - RNA, 19 nt, Homo sapiens
gguagaauuggaucugugu

SEQ ID NO: 1248508 - RNA, 19 nt, Homo sapiens
gauaugccuccuucuccuu

SEQ ID NO: 1248509 - RNA, 19 nt, Homo sapiens
gguauacacagcagaaagg

SEQ ID NO: 1248510 - RNA, 19 nt, Homo sapiens
ccugagggcagcuugagaa

SEQ ID NO: 1248511 - RNA, 19 nt, Homo sapiens
cagguagaauuggaucugu

SEQ ID NO: 1248512 - RNA, 19 nt, Homo sapiens
ugcagcagaugcccggauu

SEQ ID NO: 1248513 - RNA, 19 nt, Homo sapiens
caugauagugagugaguuc

SEQ ID NO: 1248514 - RNA, 19 nt, Homo sapiens
ugccauuccuuggugauga

SEQ ID NO: 1248515 - RNA, 19 nt, Homo sapiens
aaacgggcuucuccuugag

SEQ ID NO: 1248516 - RNA, 19 nt, Homo sapiens
ugcagagcaucuuccagaa

SEQ ID NO: 1248517 - RNA, 19 nt, Homo sapiens
ggauaaggaccggaucucu

SEQ ID NO: 1248518 - RNA, 19 nt, Homo sapiens
ugguggugcugcucuguug

SEQ ID NO: 1248519 - RNA, 19 nt, Homo sapiens
ucuccggccauguaagaua

SEQ ID NO: 1248520 - RNA, 19 nt, Homo sapiens
gggguggauuucucccuua

SEQ ID NO: 1248521 - RNA, 19 nt, Homo sapiens
ugagucuucuccauucucu

SEQ ID NO: 1248522 - RNA, 19 nt, Homo sapiens
cuccggccauguaagauau

SEQ ID NO: 1248523 - RNA, 19 nt, Homo sapiens
gaucaaagccgauaugaaa

SEQ ID NO: 1248524 - RNA, 19 nt, Homo sapiens
gaaguacuuugccauauuu

SEQ ID NO: 1248525 - RNA, 19 nt, Homo sapiens
gaaagcagcuagggauauu

SEQ ID NO: 1248526 - RNA, 19 nt, Homo sapiens
caagaagucuggauuccua

SEQ ID NO: 1248527 - RNA, 19 nt, Homo sapiens
uaaagaagaugccagaugu

SEQ ID NO: 1248528 - RNA, 19 nt, Homo sapiens
ccacaaauuccuugaaaua

SEQ ID NO: 1248529 - RNA, 19 nt, Homo sapiens
ccaaguggcuuuacagaug

SEQ ID NO: 1248530 - RNA, 19 nt, Homo sapiens
gaaagcagcugugagaaag

SEQ ID NO: 1248531 - RNA, 19 nt, Homo sapiens
ugaagaagauagucuagaa

SEQ ID NO: 1248532 - RNA, 19 nt, Homo sapiens
gaaauaugucccuuuagua

SEQ ID NO: 1248533 - RNA, 19 nt, Homo sapiens
gaacuuucgucaugaggaa

SEQ ID NO: 1248534 - RNA, 19 nt, Homo sapiens
gauaauaaugcccagaaua

SEQ ID NO: 1248535 - RNA, 19 nt, Homo sapiens
gaugaaagcagucaaugaa

SEQ ID NO: 1248536 - RNA, 19 nt, Homo sapiens
uaaaugagauggaagacau

SEQ ID NO: 1248537 - RNA, 19 nt, Homo sapiens
guuugcagcugacgcauua

SEQ ID NO: 1248538 - RNA, 19 nt, Homo sapiens
gaauaacaaugccaacauc

SEQ ID NO: 1248539 - RNA, 19 nt, Homo sapiens
ggaaauuucguaaucguaa

SEQ ID NO: 1248540 - RNA, 19 nt, Homo sapiens
ggaaagcagcugugagaaa

SEQ ID NO: 1248541 - RNA, 19 nt, Homo sapiens
gcucacagccaggcaauua

SEQ ID NO: 1248542 - RNA, 19 nt, Homo sapiens
ugaaauaugucccuuuagu

SEQ ID NO: 1248543 - RNA, 19 nt, Homo sapiens
gcaggcaugcccaaacuua

SEQ ID NO: 1248544 - RNA, 19 nt, Homo sapiens
gaagaugccagauguugaa

SEQ ID NO: 1248545 - RNA, 19 nt, Homo sapiens
gaaacaaaggacuauauga

SEQ ID NO: 1248546 - RNA, 19 nt, Homo sapiens
gaaauuugcacacuauugu

SEQ ID NO: 1248547 - RNA, 19 nt, Homo sapiens
ugaaguacuuugccauauu

SEQ ID NO: 1248548 - RNA, 19 nt, Homo sapiens
cuugaaauaugucccuuua

SEQ ID NO: 1248549 - RNA, 19 nt, Homo sapiens
caucagcucuuguuagcaa

SEQ ID NO: 1248550 - RNA, 19 nt, Homo sapiens
gaaagcagucaaugaaguu

SEQ ID NO: 1248551 - RNA, 19 nt, Homo sapiens
cuuaagaacuuucgucaug

SEQ ID NO: 1248552 - RNA, 19 nt, Homo sapiens
gaggaaagcagcugugaga

SEQ ID NO: 1248553 - RNA, 19 nt, Homo sapiens
aaaccaaccucaauuacug

SEQ ID NO: 1248554 - RNA, 19 nt, Homo sapiens
gaaaugacagcagaugaaa

SEQ ID NO: 1248555 - RNA, 19 nt, Homo sapiens
gauaucauguguauggaau

SEQ ID NO: 1248556 - RNA, 19 nt, Homo sapiens
uguaucagcuuaagaacuu

SEQ ID NO: 1248557 - RNA, 19 nt, Homo sapiens
ggugaauguuccugaaauu

SEQ ID NO: 1248558 - RNA, 19 nt, Homo sapiens
gcacaggaauugguguuuc

SEQ ID NO: 1248559 - RNA, 19 nt, Homo sapiens
ggacucgauugguugauau

SEQ ID NO: 1248560 - RNA, 19 nt, Homo sapiens
ccaacaaugacgauaauaa

SEQ ID NO: 1248561 - RNA, 19 nt, Homo sapiens
cuacacaacccauacaauu

SEQ ID NO: 1248562 - RNA, 19 nt, Homo sapiens
ugaaguagaucuugguuac

SEQ ID NO: 1248563 - RNA, 19 nt, Homo sapiens
uguggaaacuucucauuug

SEQ ID NO: 1248564 - RNA, 19 nt, Homo sapiens
caauuacuguucaugauuc

SEQ ID NO: 1248565 - RNA, 19 nt, Homo sapiens
aaccagaacuccaacaaug

SEQ ID NO: 1248566 - RNA, 19 nt, Homo sapiens
cuuugaagcuggacucuuu

SEQ ID NO: 1248567 - RNA, 19 nt, Homo sapiens
gaagacaguuggagaucag

SEQ ID NO: 1248568 - RNA, 19 nt, Homo sapiens
gcaagacuccacuucgaaa

SEQ ID NO: 1248569 - RNA, 19 nt, Homo sapiens
acaaaggacuauaugaauc

SEQ ID NO: 1248570 - RNA, 19 nt, Homo sapiens
agagagugaugaugaagaa

SEQ ID NO: 1248571 - RNA, 19 nt, Homo sapiens
gaagacaucguccaagaag

SEQ ID NO: 1248572 - RNA, 19 nt, Homo sapiens
ugaaagcagucaaugaagu

SEQ ID NO: 1248573 - RNA, 19 nt, Homo sapiens
gagccaaaauucaaacuuu

SEQ ID NO: 1248574 - RNA, 19 nt, Homo sapiens
gacagcagaugaaacaaag

SEQ ID NO: 1248575 - RNA, 19 nt, Homo sapiens
caaccucaauuacuguuca

SEQ ID NO: 1248576 - RNA, 19 nt, Homo sapiens
gccgagaguggaaauaaua

SEQ ID NO: 1248577 - RNA, 19 nt, Homo sapiens
caacauccacgacaacaau

SEQ ID NO: 1248578 - RNA, 19 nt, Homo sapiens
gaucucagaccacucaaga

SEQ ID NO: 1248579 - RNA, 19 nt, Homo sapiens
augcggaucuggugaagua

SEQ ID NO: 1248580 - RNA, 19 nt, Homo sapiens
gaaauuccagaagaaauga

SEQ ID NO: 1248581 - RNA, 19 nt, Homo sapiens
ggaugaaagcagucaauga

SEQ ID NO: 1248582 - RNA, 19 nt, Homo sapiens
caaaggacuauaugaauca

SEQ ID NO: 1248583 - RNA, 19 nt, Homo sapiens
gaagaaaugacagcagaug

SEQ ID NO: 1248584 - RNA, 19 nt, Homo sapiens
ggaagacaucguccaagaa

SEQ ID NO: 1248585 - RNA, 19 nt, Homo sapiens
gagcagaucaaagccgaua

SEQ ID NO: 1248586 - RNA, 19 nt, Homo sapiens
guaaaaccaaccucaauua

SEQ ID NO: 1248587 - RNA, 19 nt, Homo sapiens
cgacaacaaucaccaucau

SEQ ID NO: 1248588 - RNA, 19 nt, Homo sapiens
gcccguagguuacaugaag

SEQ ID NO: 1248589 - RNA, 19 nt, Homo sapiens
guacucggcguuacucuga

SEQ ID NO: 1248590 - RNA, 19 nt, Homo sapiens
uaggauauguagaugaguu

SEQ ID NO: 1248591 - RNA, 19 nt, Homo sapiens
ccacagccauuuaaagacu

SEQ ID NO: 1248592 - RNA, 19 nt, Homo sapiens
aagauggacucgauugguu

SEQ ID NO: 1248593 - RNA, 19 nt, Homo sapiens
gaucuugguuaccucaaca

SEQ ID NO: 1248594 - RNA, 19 nt, Homo sapiens
gugcaggacccacaaauuc

SEQ ID NO: 1248595 - RNA, 19 nt, Homo sapiens
ucagaccacucaagaugga

SEQ ID NO: 1248596 - RNA, 19 nt, Homo sapiens
ugguuuggcugauguggua

SEQ ID NO: 1248597 - RNA, 19 nt, Homo sapiens
ucacuaaaccacagccauu

SEQ ID NO: 1248598 - RNA, 19 nt, Homo sapiens
gggugaauguuccugaaau

SEQ ID NO: 1248599 - RNA, 19 nt, Homo sapiens
caugaaguacuuugccaua

SEQ ID NO: 1248600 - RNA, 19 nt, Homo sapiens
ccagagaauugucaguaag

SEQ ID NO: 1248601 - RNA, 19 nt, Homo sapiens
ugaaauuccagaagaaaug

SEQ ID NO: 1248602 - RNA, 19 nt, Homo sapiens
gagaucaggugguuuuaga

SEQ ID NO: 1248603 - RNA, 19 nt, Homo sapiens
gaaacucggaacacuuaga

SEQ ID NO: 1248604 - RNA, 19 nt, Homo sapiens
ggaagcagugacccuauau

SEQ ID NO: 1248605 - RNA, 19 nt, Homo sapiens
aggaagcagugacccuaua

SEQ ID NO: 1248606 - RNA, 19 nt, Homo sapiens
gcagaucaaagccgauaug

SEQ ID NO: 1248607 - RNA, 19 nt, Homo sapiens
gagugaugaugaagaagau

SEQ ID NO: 1248608 - RNA, 19 nt, Homo sapiens
ugacagcagaugaaacaaa

SEQ ID NO: 1248609 - RNA, 19 nt, Homo sapiens
gcaaccagaacuccaacaa

SEQ ID NO: 1248610 - RNA, 19 nt, Homo sapiens
uuaagaacuuucgucauga

SEQ ID NO: 1248611 - RNA, 19 nt, Homo sapiens
uccagagaauugucaguaa

SEQ ID NO: 1248612 - RNA, 19 nt, Homo sapiens
caaggguugugcucgaguu

SEQ ID NO: 1248613 - RNA, 19 nt, Homo sapiens
uggccaguuuauugaauua

SEQ ID NO: 1248614 - RNA, 19 nt, Homo sapiens
ucacugauauagggaugaa

SEQ ID NO: 1248615 - RNA, 19 nt, Homo sapiens
cuugagaggcgaagaguaa

SEQ ID NO: 1248616 - RNA, 19 nt, Homo sapiens
gaagucuggauuccuaaga

SEQ ID NO: 1248617 - RNA, 19 nt, Homo sapiens
ugcaggauaucauguguau

SEQ ID NO: 1248618 - RNA, 19 nt, Homo sapiens
gaaguaugguuuggcugau

SEQ ID NO: 1248619 - RNA, 19 nt, Homo sapiens
agaaaugacagcagaugaa

SEQ ID NO: 1248620 - RNA, 19 nt, Homo sapiens
caggauaucauguguaugg

SEQ ID NO: 1248621 - RNA, 19 nt, Homo sapiens
ucacagccaggcaauuauu

SEQ ID NO: 1248622 - RNA, 19 nt, Homo sapiens
ggccgagaguggaaauaau

SEQ ID NO: 1248623 - RNA, 19 nt, Homo sapiens
gaggaaauguuaaaggaua

SEQ ID NO: 1248624 - RNA, 19 nt, Homo sapiens
ggaaaggucacauaucaua

SEQ ID NO: 1248625 - RNA, 19 nt, Homo sapiens
gccaugugcuuuaacguua

SEQ ID NO: 1248626 - RNA, 19 nt, Homo sapiens
cauaacaacuucggaaauu

SEQ ID NO: 1248627 - RNA, 19 nt, Homo sapiens
gacaugggcugacaaacuu

SEQ ID NO: 1248628 - RNA, 19 nt, Homo sapiens
gaagggacauugaagacau

SEQ ID NO: 1248629 - RNA, 19 nt, Homo sapiens
ggagcaaccuguccagaau

SEQ ID NO: 1248630 - RNA, 19 nt, Homo sapiens
guaaauauuucaggcuuug

SEQ ID NO: 1248631 - RNA, 19 nt, Homo sapiens
ggccagaaaguaaauauuu

SEQ ID NO: 1248632 - RNA, 19 nt, Homo sapiens
gcaaugcaguguucucagu

SEQ ID NO: 1248633 - RNA, 19 nt, Homo sapiens
ggacaugauaagagaauuu

SEQ ID NO: 1248634 - RNA, 19 nt, Homo sapiens
guucaucuguuacauggaa

SEQ ID NO: 1248635 - RNA, 19 nt, Homo sapiens
gagaugaggaaauguuaaa

SEQ ID NO: 1248636 - RNA, 19 nt, Homo sapiens
gaagacaagaaguuagaaa

SEQ ID NO: 1248637 - RNA, 19 nt, Homo sapiens
ggaaaucucgacauggaaa

SEQ ID NO: 1248638 - RNA, 19 nt, Homo sapiens
cgagagaaagccagaagua

SEQ ID NO: 1248639 - RNA, 19 nt, Homo sapiens
uggcuaaggugcaggauga

SEQ ID NO: 1248640 - RNA, 19 nt, Homo sapiens
gagagaaagccagaaguaa

SEQ ID NO: 1248641 - RNA, 19 nt, Homo sapiens
aggaaauguucaucuguua

SEQ ID NO: 1248642 - RNA, 19 nt, Homo sapiens
gcaaugaggacaugauaag

SEQ ID NO: 1248643 - RNA, 19 nt, Homo sapiens
gaauggaaaggucacauau

SEQ ID NO: 1248644 - RNA, 19 nt, Homo sapiens
cucauuaccucaaggagua

SEQ ID NO: 1248645 - RNA, 19 nt, Homo sapiens
gaucagagagagagggaaa

SEQ ID NO: 1248646 - RNA, 19 nt, Homo sapiens
uaggaaauguucaucuguu

SEQ ID NO: 1248647 - RNA, 19 nt, Homo sapiens
auaaagggccagaaaguaa

SEQ ID NO: 1248648 - RNA, 19 nt, Homo sapiens
gaaauguucaucuguuaca

SEQ ID NO: 1248649 - RNA, 19 nt, Homo sapiens
aaacaagggcugcaggaaa

SEQ ID NO: 1248650 - RNA, 19 nt, Homo sapiens
cauaaagggccagaaagua

SEQ ID NO: 1248651 - RNA, 19 nt, Homo sapiens
aggaauggcuucaaaccaa

SEQ ID NO: 1248652 - RNA, 19 nt, Homo sapiens
gcaguguucucaguaggaa

SEQ ID NO: 1248653 - RNA, 19 nt, Homo sapiens
ggagggaggaucagagaga

SEQ ID NO: 1248654 - RNA, 19 nt, Homo sapiens
ggagggagagucagagaug

SEQ ID NO: 1248655 - RNA, 19 nt, Homo sapiens
guuaaaggauaaaggaaag

SEQ ID NO: 1248656 - RNA, 19 nt, Homo sapiens
ggagaugaggaaauguuaa

SEQ ID NO: 1248657 - RNA, 19 nt, Homo sapiens
gagacaaaguccacaucug

SEQ ID NO: 1248658 - RNA, 19 nt, Homo sapiens
auaaggggcuggcucauua

SEQ ID NO: 1248659 - RNA, 19 nt, Homo sapiens
uaaagggccagaaaguaaa

SEQ ID NO: 1248660 - RNA, 19 nt, Homo sapiens
uaguauugcugcauaacaa

SEQ ID NO: 1248661 - RNA, 19 nt, Homo sapiens
gaaacaagggcugcaggaa

SEQ ID NO: 1248662 - RNA, 19 nt, Homo sapiens
ggagagccagggagugaaa

SEQ ID NO: 1248663 - RNA, 19 nt, Homo sapiens
uaacuuguacucuggaaga

SEQ ID NO: 1248664 - RNA, 19 nt, Homo sapiens
aaggaaagauggaaaauga

SEQ ID NO: 1248665 - RNA, 19 nt, Homo sapiens
gauggugcauuguaaaauu

SEQ ID NO: 1248666 - RNA, 19 nt, Homo sapiens
cagcaaugaggacaugaua

SEQ ID NO: 1248667 - RNA, 19 nt, Homo sapiens
aaccagagauagagggaaa

SEQ ID NO: 1248668 - RNA, 19 nt, Homo sapiens
gauaaaggaaagccagaga

SEQ ID NO: 1248669 - RNA, 19 nt, Homo sapiens
auggaaaggucacauauca

SEQ ID NO: 1248670 - RNA, 19 nt, Homo sapiens
aagaagaguucagcugcua

SEQ ID NO: 1248671 - RNA, 19 nt, Homo sapiens
caacuucggaaauuaaauc

SEQ ID NO: 1248672 - RNA, 19 nt, Homo sapiens
gagcgggacauaacaacuu

SEQ ID NO: 1248673 - RNA, 19 nt, Homo sapiens
gguuaguauugcugcauaa

SEQ ID NO: 1248674 - RNA, 19 nt, Homo sapiens
aaggaaagccagagaguga

SEQ ID NO: 1248675 - RNA, 19 nt, Homo sapiens
gagaaagccagaaguaacu

SEQ ID NO: 1248676 - RNA, 19 nt, Homo sapiens
agacaaaguccacaucugu

SEQ ID NO: 1248677 - RNA, 19 nt, Homo sapiens
gcugcuagguucuuauuuu

SEQ ID NO: 1248678 - RNA, 19 nt, Homo sapiens
ugugggauaucuauuuaug

SEQ ID NO: 1248679 - RNA, 19 nt, Homo sapiens
uaagacaugggcugacaaa

SEQ ID NO: 1248680 - RNA, 19 nt, Homo sapiens
gacauaacaacuucggaaa

SEQ ID NO: 1248681 - RNA, 19 nt, Homo sapiens
ggucugcgcgucuguuguu

SEQ ID NO: 1248682 - RNA, 19 nt, Homo sapiens
aacaagggcugcaggaaag

SEQ ID NO: 1248683 - RNA, 19 nt, Homo sapiens
agaauggaaaggucacaua

SEQ ID NO: 1248684 - RNA, 19 nt, Homo sapiens
uaccaggccaugugcuuua

SEQ ID NO: 1248685 - RNA, 19 nt, Homo sapiens
aacaggagaugaggaaaug

SEQ ID NO: 1248686 - RNA, 19 nt, Homo sapiens
ucaaugcgaagaauggaaa

SEQ ID NO: 1248687 - RNA, 19 nt, Homo sapiens
gaagagacaaaguccacau

SEQ ID NO: 1248688 - RNA, 19 nt, Homo sapiens
gcauuuaccaggccaugug

SEQ ID NO: 1248689 - RNA, 19 nt, Homo sapiens
guggaugcaaagaaauuua

SEQ ID NO: 1248690 - RNA, 19 nt, Homo sapiens
gcauaacaaauuacuccaa

SEQ ID NO: 1248691 - RNA, 19 nt, Homo sapiens
gaggacaugauaagagaau

SEQ ID NO: 1248692 - RNA, 19 nt, Homo sapiens
ggggaaaucucgacaugga

SEQ ID NO: 1248693 - RNA, 19 nt, Homo sapiens
gcccgaguguggacagaga

SEQ ID NO: 1248694 - RNA, 19 nt, Homo sapiens
ccauaaagggccagaaagu

SEQ ID NO: 1248695 - RNA, 19 nt, Homo sapiens
acauugaagacauuccuua

SEQ ID NO: 1248696 - RNA, 19 nt, Homo sapiens
ccgcagcucacgccuguaa

SEQ ID NO: 1248697 - RNA, 19 nt, Homo sapiens
gacaugauaagagaauuug

SEQ ID NO: 1248698 - RNA, 19 nt, Homo sapiens
augaggaaauguuaaagga

SEQ ID NO: 1248699 - RNA, 19 nt, Homo sapiens
cuucggaaauuaaaucucu

SEQ ID NO: 1248700 - RNA, 19 nt, Homo sapiens
caaugcaguguucucagua

SEQ ID NO: 1248701 - RNA, 19 nt, Homo sapiens
uuucaggcuuugugggaua

SEQ ID NO: 1248702 - RNA, 19 nt, Homo sapiens
uaaaggaaagccagagagu

SEQ ID NO: 1248703 - RNA, 19 nt, Homo sapiens
aaacaggagaugaggaaau

SEQ ID NO: 1248704 - RNA, 19 nt, Homo sapiens
ggaagacaagaaguuagaa

SEQ ID NO: 1248705 - RNA, 19 nt, Homo sapiens
ggccaugugcuuuaacguu

SEQ ID NO: 1248706 - RNA, 19 nt, Homo sapiens
gaugauguacccaggaaag

SEQ ID NO: 1248707 - RNA, 19 nt, Homo sapiens
augaggacaugauaagaga

SEQ ID NO: 1248708 - RNA, 19 nt, Homo sapiens
agggaaagccagagaguga

SEQ ID NO: 1248709 - RNA, 19 nt, Homo sapiens
uguugauggugcauuguaa

SEQ ID NO: 1248710 - RNA, 19 nt, Homo sapiens
ggaaauguucaucuguuac

SEQ ID NO: 1248711 - RNA, 19 nt, Homo sapiens
gcagcucacgccuguaauc

SEQ ID NO: 1248712 - RNA, 19 nt, Homo sapiens
caggaaagccaaaagaaaa

SEQ ID NO: 1248713 - RNA, 19 nt, Homo sapiens
caggagaugaggaaauguu

SEQ ID NO: 1248714 - RNA, 19 nt, Homo sapiens
gaggggaaaucucgacaug

SEQ ID NO: 1248715 - RNA, 19 nt, Homo sapiens
guaggaaauguucaucugu

SEQ ID NO: 1248716 - RNA, 19 nt, Homo sapiens
gcgcccagcugaggaugau

SEQ ID NO: 1248717 - RNA, 19 nt, Homo sapiens
ggaaagccagagagugaag

SEQ ID NO: 1248718 - RNA, 19 nt, Homo sapiens
aaagaaggaaagucagaga

SEQ ID NO: 1248719 - RNA, 19 nt, Homo sapiens
gaugaggaaauguuaaagg

SEQ ID NO: 1248720 - RNA, 19 nt, Homo sapiens
ucuggaagacaagaaguua

SEQ ID NO: 1248721 - RNA, 19 nt, Homo sapiens
aagggacauugaagacauu

SEQ ID NO: 1248722 - RNA, 19 nt, Homo sapiens
agacaugggcugacaaacu

SEQ ID NO: 1248723 - RNA, 19 nt, Homo sapiens
gcaaauguguguaugagaa

SEQ ID NO: 1248724 - RNA, 19 nt, Homo sapiens
gaaguugagggaaaguuua

SEQ ID NO: 1248725 - RNA, 19 nt, Homo sapiens
gcaccaggcccauguuuau

SEQ ID NO: 1248726 - RNA, 19 nt, Homo sapiens
ggcagaaacuggacacaau

SEQ ID NO: 1248727 - RNA, 19 nt, Homo sapiens
gagggaaaguuuagacauc

SEQ ID NO: 1248728 - RNA, 19 nt, Homo sapiens
gagcgcaggccucaucuuu

SEQ ID NO: 1248729 - RNA, 19 nt, Homo sapiens
ggaaguugagggaaaguuu

SEQ ID NO: 1248730 - RNA, 19 nt, Homo sapiens
ggacauggugauuuguuaa

SEQ ID NO: 1248731 - RNA, 19 nt, Homo sapiens
gcgcaggccucaucuuucu

SEQ ID NO: 1248732 - RNA, 19 nt, Homo sapiens
ggaacggccuacucuccuu

SEQ ID NO: 1248733 - RNA, 19 nt, Homo sapiens
gcagaaacuggacacaaug

SEQ ID NO: 1248734 - RNA, 19 nt, Homo sapiens
gaagcuguuuccuguugug

SEQ ID NO: 1248735 - RNA, 19 nt, Homo sapiens
ccaggcccauguuuauuga

SEQ ID NO: 1248736 - RNA, 19 nt, Homo sapiens
cugaugaccucaccggauu

SEQ ID NO: 1248737 - RNA, 19 nt, Homo sapiens
aguaggacauggugauuug

SEQ ID NO: 1248738 - RNA, 19 nt, Homo sapiens
gcuguuuccuguugugaug

SEQ ID NO: 1248739 - RNA, 19 nt, Homo sapiens
aggacauggugauuuguua

SEQ ID NO: 1248740 - RNA, 19 nt, Homo sapiens
ucacucagcacgugggaaa

SEQ ID NO: 1248741 - RNA, 19 nt, Homo sapiens
gaauucuucuucacuccau

SEQ ID NO: 1248742 - RNA, 19 nt, Homo sapiens
gacguguucuccacugaug

SEQ ID NO: 1248743 - RNA, 19 nt, Homo sapiens
ggcccugccuggaaguuga

SEQ ID NO: 1248744 - RNA, 19 nt, Homo sapiens
gcagccagaggaaggguuu

SEQ ID NO: 1248745 - RNA, 19 nt, Homo sapiens
uguuggaccuguaguagga

SEQ ID NO: 1248746 - RNA, 19 nt, Homo sapiens
gccuggaaguugagggaaa

SEQ ID NO: 1248747 - RNA, 19 nt, Homo sapiens
agaaagagaggcaaaauga

SEQ ID NO: 1248748 - RNA, 19 nt, Homo sapiens
guuuagacaucugcagaga

SEQ ID NO: 1248749 - RNA, 19 nt, Homo sapiens
gcauggagggaaucuguuc

SEQ ID NO: 1248750 - RNA, 19 nt, Homo sapiens
gggaaaguuuagacaucug

SEQ ID NO: 1248751 - RNA, 19 nt, Homo sapiens
gcaggccucaucuuucugu

SEQ ID NO: 1248752 - RNA, 19 nt, Homo sapiens
gcccugauguggaguagac

SEQ ID NO: 1248753 - RNA, 19 nt, Homo sapiens
caaauguguguaugagaau

SEQ ID NO: 1248754 - RNA, 19 nt, Homo sapiens
ccagagaaagagaggcaaa

SEQ ID NO: 1248755 - RNA, 19 nt, Homo sapiens
cugcaggaauucuucuuca

SEQ ID NO: 1248756 - RNA, 19 nt, Homo sapiens
gcaggaauucuucuucacu

SEQ ID NO: 1248757 - RNA, 19 nt, Homo sapiens
ggugauuuguuaauuucca

SEQ ID NO: 1248758 - RNA, 19 nt, Homo sapiens
gggacccguuccucuugaa

SEQ ID NO: 1248759 - RNA, 19 nt, Homo sapiens
ggccuagcauggagggaau

SEQ ID NO: 1248760 - RNA, 19 nt, Homo sapiens
gacauggugauuuguuaau

SEQ ID NO: 1248761 - RNA, 19 nt, Homo sapiens
guaguaggacauggugauu

SEQ ID NO: 1248762 - RNA, 19 nt, Homo sapiens
uagcauggagggaaucugu

SEQ ID NO: 1248763 - RNA, 19 nt, Homo sapiens
gauguuggaccuguaguag

SEQ ID NO: 1248764 - RNA, 19 nt, Homo sapiens
cuucuucacuccauuugca

SEQ ID NO: 1248765 - RNA, 19 nt, Homo sapiens
cagaaacuggacacaaugu

SEQ ID NO: 1248766 - RNA, 19 nt, Homo sapiens
ggacguguucuccacugau

SEQ ID NO: 1248767 - RNA, 19 nt, Homo sapiens
ucacuccaguagucagcaa

SEQ ID NO: 1248768 - RNA, 19 nt, Homo sapiens
cucuguggcugcaggaauu

SEQ ID NO: 1248769 - RNA, 19 nt, Homo sapiens
uggcaaauguguguaugag

SEQ ID NO: 1248770 - RNA, 19 nt, Homo sapiens
ggaggugauggacguguuc

SEQ ID NO: 1248771 - RNA, 19 nt, Homo sapiens
cuucaggcccagagaaaga

SEQ ID NO: 1248772 - RNA, 19 nt, Homo sapiens
ugauguuggaccuguagua

SEQ ID NO: 1248773 - RNA, 19 nt, Homo sapiens
gugcaccaggcccauguuu

SEQ ID NO: 1248774 - RNA, 19 nt, Homo sapiens
gagaaagagaggcaaaaug

SEQ ID NO: 1248775 - RNA, 19 nt, Homo sapiens
ggaaggccuuaauguaaua

SEQ ID NO: 1248776 - RNA, 19 nt, Homo sapiens
gaaucuaaccucaagaaua

SEQ ID NO: 1248777 - RNA, 19 nt, Homo sapiens
gguaaaggguuaagcugua

SEQ ID NO: 1248778 - RNA, 19 nt, Homo sapiens
ggaacagucccuucuauaa

SEQ ID NO: 1248779 - RNA, 19 nt, Homo sapiens
gaaauacaaguacgaauug

SEQ ID NO: 1248780 - RNA, 19 nt, Homo sapiens
gaagauguauucguauugu

SEQ ID NO: 1248781 - RNA, 19 nt, Homo sapiens
ugaugaagauguauucgua

SEQ ID NO: 1248782 - RNA, 19 nt, Homo sapiens
gcaauggugugacgcagaa

SEQ ID NO: 1248783 - RNA, 19 nt, Homo sapiens
gcuguaacauacuuaauug

SEQ ID NO: 1248784 - RNA, 19 nt, Homo sapiens
gcaggcaacucacuuuauc

SEQ ID NO: 1248785 - RNA, 19 nt, Homo sapiens
gugcuaaucuuuguagaaa

SEQ ID NO: 1248786 - RNA, 19 nt, Homo sapiens
guaaaggguuaagcuguaa

SEQ ID NO: 1248787 - RNA, 19 nt, Homo sapiens
gggaaggccuuaauguaau

SEQ ID NO: 1248788 - RNA, 19 nt, Homo sapiens
caaauucuccugccaguga

SEQ ID NO: 1248789 - RNA, 19 nt, Homo sapiens
cuauugagguaaaggguua

SEQ ID NO: 1248790 - RNA, 19 nt, Homo sapiens
ccauggaucugcuuauuca

SEQ ID NO: 1248791 - RNA, 19 nt, Homo sapiens
gaguaugguuggagccuaa

SEQ ID NO: 1248792 - RNA, 19 nt, Homo sapiens
ucuagagacuccaggauuu

SEQ ID NO: 1248793 - RNA, 19 nt, Homo sapiens
cacaaaccauggauuuauu

SEQ ID NO: 1248794 - RNA, 19 nt, Homo sapiens
uuggauaucuuuaggguuu

SEQ ID NO: 1248795 - RNA, 19 nt, Homo sapiens
gcuaaggacaacauugaua

SEQ ID NO: 1248796 - RNA, 19 nt, Homo sapiens
cccaauuucuugauacuuu

SEQ ID NO: 1248797 - RNA, 19 nt, Homo sapiens
uuaauaaccuuggcugcua

SEQ ID NO: 1248798 - RNA, 19 nt, Homo sapiens
caguccaccucuuaaauuu

SEQ ID NO: 1248799 - RNA, 19 nt, Homo sapiens
uguauuugcugcaucguaa

SEQ ID NO: 1248800 - RNA, 19 nt, Homo sapiens
aaccauggauuuauuccua

SEQ ID NO: 1248801 - RNA, 19 nt, Homo sapiens
guaaugacaugaguacuac

SEQ ID NO: 1248802 - RNA, 19 nt, Homo sapiens
uaauaaccuuggcugcuaa

SEQ ID NO: 1248803 - RNA, 19 nt, Homo sapiens
gaacagucccuucuauaac

SEQ ID NO: 1248804 - RNA, 19 nt, Homo sapiens
ggaacaaucaggccuggaa

SEQ ID NO: 1248805 - RNA, 19 nt, Homo sapiens
guguuucgaugaguaaaua

SEQ ID NO: 1248806 - RNA, 19 nt, Homo sapiens
ccacaaaccauggauuuau

SEQ ID NO: 1248807 - RNA, 19 nt, Homo sapiens
gcaugcaguuccagccaaa

SEQ ID NO: 1248808 - RNA, 19 nt, Homo sapiens
caacucacuuuaucccaau

SEQ ID NO: 1248809 - RNA, 19 nt, Homo sapiens
cagaaggccucagcaccua

SEQ ID NO: 1248810 - RNA, 19 nt, Homo sapiens
gaagacaaggucccaguca

SEQ ID NO: 1248811 - RNA, 19 nt, Homo sapiens
ucucuaacaucuuccagaa

SEQ ID NO: 1248812 - RNA, 19 nt, Homo sapiens
caugaugccuauccaguca

SEQ ID NO: 1248813 - RNA, 19 nt, Homo sapiens
cagcagaccacuagguauu

SEQ ID NO: 1248814 - RNA, 19 nt, Homo sapiens
gcaagaacucuccaacauc

SEQ ID NO: 1248815 - RNA, 19 nt, Homo sapiens
caaggucccagucaagaaa

SEQ ID NO: 1248816 - RNA, 19 nt, Homo sapiens
cguaaugacaugaguacua

SEQ ID NO: 1248817 - RNA, 19 nt, Homo sapiens
ccaguccaccucuuaaauu

SEQ ID NO: 1248818 - RNA, 19 nt, Homo sapiens
ugggaggcuuugcuuauuu

SEQ ID NO: 1248819 - RNA, 19 nt, Homo sapiens
cagaagaccagaacugugu

SEQ ID NO: 1248820 - RNA, 19 nt, Homo sapiens
ugaagcauccgacuguaaa

SEQ ID NO: 1248821 - RNA, 19 nt, Homo sapiens
ccuaacagcugggauuaca

SEQ ID NO: 1248822 - RNA, 19 nt, Homo sapiens
gaacccgacugggaaccuu

SEQ ID NO: 1248823 - RNA, 19 nt, Homo sapiens
gcauccgacuguaaagaau

SEQ ID NO: 1248824 - RNA, 19 nt, Homo sapiens
ggagguccuauuucucuaa

SEQ ID NO: 1248825 - RNA, 19 nt, Homo sapiens
gaacaugcaaccugaagac

SEQ ID NO: 1248826 - RNA, 19 nt, Homo sapiens
ugcaagaacucuccaacau

SEQ ID NO: 1248827 - RNA, 19 nt, Homo sapiens
gaucuaauacuaguuugga

SEQ ID NO: 1248828 - RNA, 19 nt, Homo sapiens
ggagcaaccagacccagaa

SEQ ID NO: 1248829 - RNA, 19 nt, Homo sapiens
ccgaguguuucgaugagua

SEQ ID NO: 1248830 - RNA, 19 nt, Homo sapiens
cuaaacuacuccaugaaca

SEQ ID NO: 1248831 - RNA, 19 nt, Homo sapiens
uaauacagcagaccacuag

SEQ ID NO: 1248832 - RNA, 19 nt, Homo sapiens
cuauaacuguggagaggaa

SEQ ID NO: 1248833 - RNA, 19 nt, Homo sapiens
gaguguggauccagcuugu

SEQ ID NO: 1248834 - RNA, 19 nt, Homo sapiens
gguccuauuucucuaacau

SEQ ID NO: 1248835 - RNA, 19 nt, Homo sapiens
cugguugccucauguuauu

SEQ ID NO: 1248836 - RNA, 19 nt, Homo sapiens
cauggaggguggaguaugg

SEQ ID NO: 1248837 - RNA, 19 nt, Homo sapiens
guaauacagcagaccacua

SEQ ID NO: 1248838 - RNA, 19 nt, Homo sapiens
ggggaaggccuuaauguaa

SEQ ID NO: 1248839 - RNA, 19 nt, Homo sapiens
ucuaagagguggcagaaaa

SEQ ID NO: 1248840 - RNA, 19 nt, Homo sapiens
accagagaaugaaaucuaa

SEQ ID NO: 1248841 - RNA, 19 nt, Homo sapiens
ggacacuggcugaauccuu

SEQ ID NO: 1248842 - RNA, 19 nt, Homo sapiens
cuauuucucuaacaucuuc

SEQ ID NO: 1248843 - RNA, 19 nt, Homo sapiens
cuuggaggcugcuuuggaa

SEQ ID NO: 1248844 - RNA, 19 nt, Homo sapiens
gcaaccagacccagaacau

SEQ ID NO: 1248845 - RNA, 19 nt, Homo sapiens
acaacuggccgaagaauag

SEQ ID NO: 1248846 - RNA, 19 nt, Homo sapiens
aaacagaagaccagaacug

SEQ ID NO: 1248847 - RNA, 19 nt, Homo sapiens
uauccauccuugcaaaugu

SEQ ID NO: 1248848 - RNA, 19 nt, Homo sapiens
gaauuggugaugaagaugu

SEQ ID NO: 1248849 - RNA, 19 nt, Homo sapiens
ucuaacaucuuccagaaaa

SEQ ID NO: 1248850 - RNA, 19 nt, Homo sapiens
uuccuaaacuacuccauga

SEQ ID NO: 1248851 - RNA, 19 nt, Homo sapiens
gacaaggucccagucaaga

SEQ ID NO: 1248852 - RNA, 19 nt, Homo sapiens
gauugggaggcuuugcuua

SEQ ID NO: 1248853 - RNA, 19 nt, Homo sapiens
gauguauucguauuguuug

SEQ ID NO: 1248854 - RNA, 19 nt, Homo sapiens
cagagaaugaaaucuaaga

SEQ ID NO: 1248855 - RNA, 19 nt, Homo sapiens
aaccagagaaugaaaucua

SEQ ID NO: 1248856 - RNA, 19 nt, Homo sapiens
ccagcuguguguacucaau

SEQ ID NO: 1248857 - RNA, 19 nt, Homo sapiens
ugaagacgugugaagauga

SEQ ID NO: 1248858 - RNA, 19 nt, Homo sapiens
gcagaccacuagguauuuu

SEQ ID NO: 1248859 - RNA, 19 nt, Homo sapiens
uggaacagucccuucuaua

SEQ ID NO: 1248860 - RNA, 19 nt, Homo sapiens
aagaauagcaaugguguga

SEQ ID NO: 1248861 - RNA, 19 nt, Homo sapiens
gaaccucagcuacaaacag

SEQ ID NO: 1248862 - RNA, 19 nt, Homo sapiens
cagagaauagugucgcaaa

SEQ ID NO: 1248863 - RNA, 19 nt, Homo sapiens
caaaugucuucugcugaga

SEQ ID NO: 1248864 - RNA, 19 nt, Homo sapiens
gaagaaaacuauccauccu

SEQ ID NO: 1248865 - RNA, 19 nt, Homo sapiens
acgaauuggugaugaagau

SEQ ID NO: 1248866 - RNA, 19 nt, Homo sapiens
uaacaugaguguggaucca

SEQ ID NO: 1248867 - RNA, 19 nt, Homo sapiens
ugaagauguauucguauug

SEQ ID NO: 1248868 - RNA, 19 nt, Homo sapiens
gaugaagauguauucguau

SEQ ID NO: 1248869 - RNA, 19 nt, Homo sapiens
aauuggugaugaagaugua

SEQ ID NO: 1248870 - RNA, 19 nt, Homo sapiens
cugaagacgugugaagaug

SEQ ID NO: 1248871 - RNA, 19 nt, Homo sapiens
caccuaugccugugauuug

SEQ ID NO: 1248872 - RNA, 19 nt, Homo sapiens
ucaccgaguguuucgauga

SEQ ID NO: 1248873 - RNA, 19 nt, Homo sapiens
ggauaucuuuaggguuuag

SEQ ID NO: 1248874 - RNA, 19 nt, Homo sapiens
cuaaggacaacauugauag

SEQ ID NO: 1248875 - RNA, 19 nt, Homo sapiens
gcacggcuuugcacacgua

SEQ ID NO: 1248876 - RNA, 19 nt, Homo sapiens
ccagagauguggagcagaa

SEQ ID NO: 1248877 - RNA, 19 nt, Homo sapiens
uaaacacccugaaauugug

SEQ ID NO: 1248878 - RNA, 19 nt, Homo sapiens
gagggugacuuaccaagag

SEQ ID NO: 1248879 - RNA, 19 nt, Homo sapiens
cuaaacacccugaaauugu

SEQ ID NO: 1248880 - RNA, 19 nt, Homo sapiens
caagugacagcaagaacaa

SEQ ID NO: 1248881 - RNA, 19 nt, Homo sapiens
ccuaaacacccugaaauug

SEQ ID NO: 1248882 - RNA, 19 nt, Homo sapiens
gccuaaacacccugaaauu

SEQ ID NO: 1248883 - RNA, 19 nt, Homo sapiens
gagccuaaacacccugaaa

SEQ ID NO: 1248884 - RNA, 19 nt, Homo sapiens
agaccgagguggccaugga

SEQ ID NO: 1248885 - RNA, 19 nt, Homo sapiens
ccaagugacagcaagaaca

SEQ ID NO: 1248886 - RNA, 19 nt, Homo sapiens
ggcagagggugacuuacca

SEQ ID NO: 1248887 - RNA, 19 nt, Homo sapiens
agacccaccucaccugaag

SEQ ID NO: 1248888 - RNA, 19 nt, Homo sapiens
guaaaccuaggcuggucua

SEQ ID NO: 1248889 - RNA, 19 nt, Homo sapiens
gcagagggugacuuaccaa

SEQ ID NO: 1248890 - RNA, 19 nt, Homo sapiens
gcagaagcugggcccugaa

SEQ ID NO: 1248891 - RNA, 19 nt, Homo sapiens
gcagugcugguacgucaag

SEQ ID NO: 1248892 - RNA, 19 nt, Homo sapiens
ggaaauugcugaaaucaaa

SEQ ID NO: 1248893 - RNA, 19 nt, Homo sapiens
acaaacaacuuuccuagua

SEQ ID NO: 1248894 - RNA, 19 nt, Homo sapiens
uaacaaaggugguugaugu

SEQ ID NO: 1248895 - RNA, 19 nt, Homo sapiens
gcacaggacuccaauagau

SEQ ID NO: 1248896 - RNA, 19 nt, Homo sapiens
ggagagagaucaccuucaa

SEQ ID NO: 1248897 - RNA, 19 nt, Homo sapiens
acacacagaugcugcuuua

SEQ ID NO: 1248898 - RNA, 19 nt, Homo sapiens
cgagaucaguucuuagaua

SEQ ID NO: 1248899 - RNA, 19 nt, Homo sapiens
caaagagacuccuucaaga

SEQ ID NO: 1248900 - RNA, 19 nt, Homo sapiens
caaacaacuuuccuaguaa

SEQ ID NO: 1248901 - RNA, 19 nt, Homo sapiens
ccaaaggagugaacaugua

SEQ ID NO: 1248902 - RNA, 19 nt, Homo sapiens
gacuauaaguuuccugaua

SEQ ID NO: 1248903 - RNA, 19 nt, Homo sapiens
caaaggugguugauguaua

SEQ ID NO: 1248904 - RNA, 19 nt, Homo sapiens
ugaagucgcuguucucuug

SEQ ID NO: 1248905 - RNA, 19 nt, Homo sapiens
gaaaagauguccauggaaa

SEQ ID NO: 1248906 - RNA, 19 nt, Homo sapiens
gaacucaugucuuccaaca

SEQ ID NO: 1248907 - RNA, 19 nt, Homo sapiens
agaagcaacuccugucaua

SEQ ID NO: 1248908 - RNA, 19 nt, Homo sapiens
uacaggagaugaagauaua

SEQ ID NO: 1248909 - RNA, 19 nt, Homo sapiens
gagaucaguucuuagauau

SEQ ID NO: 1248910 - RNA, 19 nt, Homo sapiens
ggaaacaguuacacccaaa

SEQ ID NO: 1248911 - RNA, 19 nt, Homo sapiens
gaaauggccaguacagaaa

SEQ ID NO: 1248912 - RNA, 19 nt, Homo sapiens
gaaaagaccuccucaacug

SEQ ID NO: 1248913 - RNA, 19 nt, Homo sapiens
ucagaugggugcaaauaaa

SEQ ID NO: 1248914 - RNA, 19 nt, Homo sapiens
caugguggcugcugaaauu

SEQ ID NO: 1248915 - RNA, 19 nt, Homo sapiens
aggcagagcugaaccguuu

SEQ ID NO: 1248916 - RNA, 19 nt, Homo sapiens
gaacugagggucaaaauaa

SEQ ID NO: 1248917 - RNA, 19 nt, Homo sapiens
ggugagagguauuugaaug

SEQ ID NO: 1248918 - RNA, 19 nt, Homo sapiens
gaaauucaucagaggcuua

SEQ ID NO: 1248919 - RNA, 19 nt, Homo sapiens
ccaagaaccuggagccaau

SEQ ID NO: 1248920 - RNA, 19 nt, Homo sapiens
gcaggcuucuuuagcagua

SEQ ID NO: 1248921 - RNA, 19 nt, Homo sapiens
gaggacaacaagagauuua

SEQ ID NO: 1248922 - RNA, 19 nt, Homo sapiens
gcagcaggcuucuuuagca

SEQ ID NO: 1248923 - RNA, 19 nt, Homo sapiens
agagacuccuucaagauua

SEQ ID NO: 1248924 - RNA, 19 nt, Homo sapiens
ggaaaaugcugcaagagaa

SEQ ID NO: 1248925 - RNA, 19 nt, Homo sapiens
aaaggugguugauguauau

SEQ ID NO: 1248926 - RNA, 19 nt, Homo sapiens
aacaagagauuuacucgaa

SEQ ID NO: 1248927 - RNA, 19 nt, Homo sapiens
gaacagaaggaugaagaaa

SEQ ID NO: 1248928 - RNA, 19 nt, Homo sapiens
gagaucaccuucaagacau

SEQ ID NO: 1248929 - RNA, 19 nt, Homo sapiens
cagaggaaauugcugaaau

SEQ ID NO: 1248930 - RNA, 19 nt, Homo sapiens
gagugaacauguacaagga

SEQ ID NO: 1248931 - RNA, 19 nt, Homo sapiens
acagaaggaugaagaaauc

SEQ ID NO: 1248932 - RNA, 19 nt, Homo sapiens
gaucaguucuuagauaugg

SEQ ID NO: 1248933 - RNA, 19 nt, Homo sapiens
ggugguugauguauauaaa

SEQ ID NO: 1248934 - RNA, 19 nt, Homo sapiens
gagagguauuugaaugaaa

SEQ ID NO: 1248935 - RNA, 19 nt, Homo sapiens
uucaagaccugauuucaaa

SEQ ID NO: 1248936 - RNA, 19 nt, Homo sapiens
gaagaaauagccacgcaau

SEQ ID NO: 1248937 - RNA, 19 nt, Homo sapiens
gcaggagcaucuuauagag

SEQ ID NO: 1248938 - RNA, 19 nt, Homo sapiens
cuaaaggcauaauaggaaa

SEQ ID NO: 1248939 - RNA, 19 nt, Homo sapiens
gcuaucacauugaaacauc

SEQ ID NO: 1248940 - RNA, 19 nt, Homo sapiens
ugaaauggccaguacagaa

SEQ ID NO: 1248941 - RNA, 19 nt, Homo sapiens
ugaaugaaauggccaguac

SEQ ID NO: 1248942 - RNA, 19 nt, Homo sapiens
gaaccuggagccaauugaa

SEQ ID NO: 1248943 - RNA, 19 nt, Homo sapiens
ucaaggcuguggauaagga

SEQ ID NO: 1248944 - RNA, 19 nt, Homo sapiens
gcaccuaaaggcauaauag

SEQ ID NO: 1248945 - RNA, 19 nt, Homo sapiens
cgacuugaacugauaaaga

SEQ ID NO: 1248946 - RNA, 19 nt, Homo sapiens
gagacuccuucaagauuau

SEQ ID NO: 1248947 - RNA, 19 nt, Homo sapiens
gaagaaaucccugaaaaug

SEQ ID NO: 1248948 - RNA, 19 nt, Homo sapiens
caacuuuccuaguaauugg

SEQ ID NO: 1248949 - RNA, 19 nt, Homo sapiens
gcugaaccguuuccaagau

SEQ ID NO: 1248950 - RNA, 19 nt, Homo sapiens
uaaagacaauucugaaagc

SEQ ID NO: 1248951 - RNA, 19 nt, Homo sapiens
guaaagacaauucugaaag

SEQ ID NO: 1248952 - RNA, 19 nt, Homo sapiens
cagcuugacuacacacaga

SEQ ID NO: 1248953 - RNA, 19 nt, Homo sapiens
auggauaacucccuagaaa

SEQ ID NO: 1248954 - RNA, 19 nt, Homo sapiens
gaacauguacaaggaagug

SEQ ID NO: 1248955 - RNA, 19 nt, Homo sapiens
aaagggaacagaaggauga

SEQ ID NO: 1248956 - RNA, 19 nt, Homo sapiens
gcuauuugcugacuaugag

SEQ ID NO: 1248957 - RNA, 19 nt, Homo sapiens
gaugaagaaaucccugaaa

SEQ ID NO: 1248958 - RNA, 19 nt, Homo sapiens
cacagaugcugcuuuacuu

SEQ ID NO: 1248959 - RNA, 19 nt, Homo sapiens
cugaaccguuuccaagaua

SEQ ID NO: 1248960 - RNA, 19 nt, Homo sapiens
ggcaggagcaucuuauaga

SEQ ID NO: 1248961 - RNA, 19 nt, Homo sapiens
guucaaggcuguggauaag

SEQ ID NO: 1248962 - RNA, 19 nt, Homo sapiens
cauggaaacacuacucaaa

SEQ ID NO: 1248963 - RNA, 19 nt, Homo sapiens
ggaacagaaggaugaagaa

SEQ ID NO: 1248964 - RNA, 19 nt, Homo sapiens
ugagagguauuugaaugaa

SEQ ID NO: 1248965 - RNA, 19 nt, Homo sapiens
acaaagagacuccuucaag

SEQ ID NO: 1248966 - RNA, 19 nt, Homo sapiens
gggaacagaaggaugaaga

SEQ ID NO: 1248967 - RNA, 19 nt, Homo sapiens
caagagaagaaaggaaauu

SEQ ID NO: 1248968 - RNA, 19 nt, Homo sapiens
gacuugaacugauaaagac

SEQ ID NO: 1248969 - RNA, 19 nt, Homo sapiens
uggaaacacuacucaaagu

SEQ ID NO: 1248970 - RNA, 19 nt, Homo sapiens
aggagcaucuuauagaguu

SEQ ID NO: 1248971 - RNA, 19 nt, Homo sapiens
gcaacuccugucauaguaa

SEQ ID NO: 1248972 - RNA, 19 nt, Homo sapiens
gaagcacaggacuccaaua

SEQ ID NO: 1248973 - RNA, 19 nt, Homo sapiens
ggagcaucuuauagaguuu

SEQ ID NO: 1248974 - RNA, 19 nt, Homo sapiens
uuacugacauucugaucga

SEQ ID NO: 1248975 - RNA, 19 nt, Homo sapiens
gaacagcuugacagucuuc

SEQ ID NO: 1248976 - RNA, 19 nt, Homo sapiens
agaggaaauugcugaaauc

SEQ ID NO: 1248977 - RNA, 19 nt, Homo sapiens
agagagaucaccuucaaga

SEQ ID NO: 1248978 - RNA, 19 nt, Homo sapiens
caauugaagucgcuguucu

SEQ ID NO: 1248979 - RNA, 19 nt, Homo sapiens
caagucaacgcuuccauuc

SEQ ID NO: 1248980 - RNA, 19 nt, Homo sapiens
ccagccaccuaaagauaga

SEQ ID NO: 1248981 - RNA, 19 nt, Homo sapiens
uugaacagcuugacagucu

SEQ ID NO: 1248982 - RNA, 19 nt, Homo sapiens
gaagauuuaguaacaaagg

SEQ ID NO: 1248983 - RNA, 19 nt, Homo sapiens
gcagaagcaacuccuguca

SEQ ID NO: 1248984 - RNA, 19 nt, Homo sapiens
ucuucgagaucaguucuua

SEQ ID NO: 1248985 - RNA, 19 nt, Homo sapiens
agcauuggcucuucuugaa

SEQ ID NO: 1248986 - RNA, 19 nt, Homo sapiens
ccucagaugggugcaaaua

SEQ ID NO: 1248987 - RNA, 19 nt, Homo sapiens
ugaagggcaagauggauaa

SEQ ID NO: 1248988 - RNA, 19 nt, Homo sapiens
gaagugauggagagagauc

SEQ ID NO: 1248989 - RNA, 19 nt, Homo sapiens
acucaugucuuccaacaag

SEQ ID NO: 1248990 - RNA, 19 nt, Homo sapiens
uguuggaacucaugucuuc

SEQ ID NO: 1248991 - RNA, 19 nt, Homo sapiens
gcaggcuggucugugguuu

SEQ ID NO: 1248992 - RNA, 19 nt, Homo sapiens
ggaauuauaucaacacuga

SEQ ID NO: 1248993 - RNA, 19 nt, Homo sapiens
cagaagagcugacguaaug

SEQ ID NO: 1248994 - RNA, 19 nt, Homo sapiens
agacagaggugacguggua

SEQ ID NO: 1248995 - RNA, 19 nt, Homo sapiens
gaagggagcuguguaagca

SEQ ID NO: 1248996 - RNA, 19 nt, Homo sapiens
guggaacaaugguauauuu

SEQ ID NO: 1248997 - RNA, 19 nt, Homo sapiens
gguccuaucuaaugcauga

SEQ ID NO: 1248998 - RNA, 19 nt, Homo sapiens
uaaagccucuagaugcuaa

SEQ ID NO: 1248999 - RNA, 19 nt, Homo sapiens
ccagugggcuuuccauuag

SEQ ID NO: 1249000 - RNA, 19 nt, Homo sapiens
guaaagagcagcacauugg

SEQ ID NO: 1249001 - RNA, 19 nt, Homo sapiens
ggaaagagauuuuaauucg

SEQ ID NO: 1249002 - RNA, 19 nt, Homo sapiens
gagaaagccagguggguuu

SEQ ID NO: 1249003 - RNA, 19 nt, Homo sapiens
auaaguagcugguguuucu

SEQ ID NO: 1249004 - RNA, 19 nt, Homo sapiens
ggaagccaaucucacuuuc

SEQ ID NO: 1249005 - RNA, 19 nt, Homo sapiens
gccucuagaugcuaacaua

SEQ ID NO: 1249006 - RNA, 19 nt, Homo sapiens
guacaaggaugggaagaag

SEQ ID NO: 1249007 - RNA, 19 nt, Homo sapiens
acacaguuaucauuugcua

SEQ ID NO: 1249008 - RNA, 19 nt, Homo sapiens
gguuagaggccacagagua

SEQ ID NO: 1249009 - RNA, 19 nt, Homo sapiens
ucagggaacggaaagauuu

SEQ ID NO: 1249010 - RNA, 19 nt, Homo sapiens
ggaaagcgaaacugagaug

SEQ ID NO: 1249011 - RNA, 19 nt, Homo sapiens
ggaauaaguagcugguguu

SEQ ID NO: 1249012 - RNA, 19 nt, Homo sapiens
gcacggaggguuugucaca

SEQ ID NO: 1249013 - RNA, 19 nt, Homo sapiens
ugagugagcccuguuugua

SEQ ID NO: 1249014 - RNA, 19 nt, Homo sapiens
gaauaaguagcugguguuu

SEQ ID NO: 1249015 - RNA, 19 nt, Homo sapiens
guaacuuauuucacacuga

SEQ ID NO: 1249016 - RNA, 19 nt, Homo sapiens
ggccagaagugguggaaag

SEQ ID NO: 1249017 - RNA, 19 nt, Homo sapiens
gccaaucucacuuuccuuu

SEQ ID NO: 1249018 - RNA, 19 nt, Homo sapiens
cacacagucuuauuuggaa

SEQ ID NO: 1249019 - RNA, 19 nt, Homo sapiens
ucaaggacauggguaagau

SEQ ID NO: 1249020 - RNA, 19 nt, Homo sapiens
gaggcaggcccuuccauga

SEQ ID NO: 1249021 - RNA, 19 nt, Homo sapiens
ggauggagaaacugugauu

SEQ ID NO: 1249022 - RNA, 19 nt, Homo sapiens
gaauaucuuguucuguuug

SEQ ID NO: 1249023 - RNA, 19 nt, Homo sapiens
cauaaagccucuagaugcu

SEQ ID NO: 1249024 - RNA, 19 nt, Homo sapiens
ccacacagucuuauuugga

SEQ ID NO: 1249025 - RNA, 19 nt, Homo sapiens
gaaauuccagccacacagu

SEQ ID NO: 1249026 - RNA, 19 nt, Homo sapiens
agaaaaggcuacugaaaau

SEQ ID NO: 1249027 - RNA, 19 nt, Homo sapiens
guuaucauuugcuagcauu

SEQ ID NO: 1249028 - RNA, 19 nt, Homo sapiens
cagccacacagucuuauuu

SEQ ID NO: 1249029 - RNA, 19 nt, Homo sapiens
gguggcaggucagugcuuu

SEQ ID NO: 1249030 - RNA, 19 nt, Homo sapiens
aauguucugugucugaauu

SEQ ID NO: 1249031 - RNA, 19 nt, Homo sapiens
ggauguagaagcccuguca

SEQ ID NO: 1249032 - RNA, 19 nt, Homo sapiens
gaccugggcaguaucuuug

SEQ ID NO: 1249033 - RNA, 19 nt, Homo sapiens
ccucauuuguugcauuguu

SEQ ID NO: 1249034 - RNA, 19 nt, Homo sapiens
acuaaacaguggaacaaug

SEQ ID NO: 1249035 - RNA, 19 nt, Homo sapiens
aaacuaaacaguggaacaa

SEQ ID NO: 1249036 - RNA, 19 nt, Homo sapiens
gaguaaagagcagcacauu

SEQ ID NO: 1249037 - RNA, 19 nt, Homo sapiens
gacaugcugggucacauuu

SEQ ID NO: 1249038 - RNA, 19 nt, Homo sapiens
cagaaaaggcuacugaaaa

SEQ ID NO: 1249039 - RNA, 19 nt, Homo sapiens
guuagaggccacagaguau

SEQ ID NO: 1249040 - RNA, 19 nt, Homo sapiens
ggaaggaaaagacagaaaa

SEQ ID NO: 1249041 - RNA, 19 nt, Homo sapiens
ggacuggaggccuucucua

SEQ ID NO: 1249042 - RNA, 19 nt, Homo sapiens
aaacaguggaacaauggua

SEQ ID NO: 1249043 - RNA, 19 nt, Homo sapiens
cuuggaauuuggauagauu

SEQ ID NO: 1249044 - RNA, 19 nt, Homo sapiens
cauguugggugguguuucu

SEQ ID NO: 1249045 - RNA, 19 nt, Homo sapiens
ggagcugggcugcuuagug

SEQ ID NO: 1249046 - RNA, 19 nt, Homo sapiens
ccacagaguauaaaaggua

SEQ ID NO: 1249047 - RNA, 19 nt, Homo sapiens
gcuaacauagauugcuaaa

SEQ ID NO: 1249048 - RNA, 19 nt, Homo sapiens
uagaggccacagaguauaa

SEQ ID NO: 1249049 - RNA, 19 nt, Homo sapiens
ugaccugggcaguaucuuu

SEQ ID NO: 1249050 - RNA, 19 nt, Homo sapiens
cacaguggauggagaaacu

SEQ ID NO: 1249051 - RNA, 19 nt, Homo sapiens
gcucgugcacggaggguuu

SEQ ID NO: 1249052 - RNA, 19 nt, Homo sapiens
cggaagccaaucucacuuu

SEQ ID NO: 1249053 - RNA, 19 nt, Homo sapiens
acccagauccacagcguua

SEQ ID NO: 1249054 - RNA, 19 nt, Homo sapiens
cgaaaaggccggucaagga

SEQ ID NO: 1249055 - RNA, 19 nt, Homo sapiens
gaagguucuguuucuccua

SEQ ID NO: 1249056 - RNA, 19 nt, Homo sapiens
ccggaaagcgaaacugaga

SEQ ID NO: 1249057 - RNA, 19 nt, Homo sapiens
caaucucacuuuccuuuug

SEQ ID NO: 1249058 - RNA, 19 nt, Homo sapiens
cccaguaccuucuccaaac

SEQ ID NO: 1249059 - RNA, 19 nt, Homo sapiens
gagugagcccuguuuguag

SEQ ID NO: 1249060 - RNA, 19 nt, Homo sapiens
gaagguuagaggccacaga

SEQ ID NO: 1249061 - RNA, 19 nt, Homo sapiens
gggagacccuagcauaucc

SEQ ID NO: 1249062 - RNA, 19 nt, Homo sapiens
aaacuucagggaacggaaa

SEQ ID NO: 1249063 - RNA, 19 nt, Homo sapiens
gggagcuguguaagcauua

SEQ ID NO: 1249064 - RNA, 19 nt, Homo sapiens
cucauuuguugcauuguuu

SEQ ID NO: 1249065 - RNA, 19 nt, Homo sapiens
uagaugcuaacauagauug

SEQ ID NO: 1249066 - RNA, 19 nt, Homo sapiens
cccauccucucaccuccua

SEQ ID NO: 1249067 - RNA, 19 nt, Homo sapiens
gguacaaggaugggaagaa

SEQ ID NO: 1249068 - RNA, 19 nt, Homo sapiens
gaaaaggcuacugaaaauu

SEQ ID NO: 1249069 - RNA, 19 nt, Homo sapiens
augcuaacauagauugcua

SEQ ID NO: 1249070 - RNA, 19 nt, Homo sapiens
cuaaacaguggaacaaugg

SEQ ID NO: 1249071 - RNA, 19 nt, Homo sapiens
acucugguccuaucuaaug

SEQ ID NO: 1249072 - RNA, 19 nt, Homo sapiens
ccaguaccuucuccaaacu

SEQ ID NO: 1249073 - RNA, 19 nt, Homo sapiens
ccagaagagcugacguaau

SEQ ID NO: 1249074 - RNA, 19 nt, Homo sapiens
gaugggaagaagcugaguu

SEQ ID NO: 1249075 - RNA, 19 nt, Homo sapiens
ggagcuguguaagcauuag

SEQ ID NO: 1249076 - RNA, 19 nt, Homo sapiens
agggagcuguguaagcauu

SEQ ID NO: 1249077 - RNA, 19 nt, Homo sapiens
gacuggaggccuucucuag

SEQ ID NO: 1249078 - RNA, 19 nt, Homo sapiens
ucacuuuccuuuugcauuc

SEQ ID NO: 1249079 - RNA, 19 nt, Homo sapiens
gcagacaugcugggucaca

SEQ ID NO: 1249080 - RNA, 19 nt, Homo sapiens
gaagagcgacaccccagaa

SEQ ID NO: 1249081 - RNA, 19 nt, Homo sapiens
aaaaggcuacugaaaauug

SEQ ID NO: 1249082 - RNA, 19 nt, Homo sapiens
gccacacagucuuauuugg

SEQ ID NO: 1249083 - RNA, 19 nt, Homo sapiens
gacguaauggccagaagug

SEQ ID NO: 1249084 - RNA, 19 nt, Homo sapiens
acaguggaacaaugguaua

SEQ ID NO: 1249085 - RNA, 19 nt, Homo sapiens
aaaggccggucaaggacau

SEQ ID NO: 1249086 - RNA, 19 nt, Homo sapiens
ucuccuacuuucucgucua

SEQ ID NO: 1249087 - RNA, 19 nt, Homo sapiens
guggauggagaaacuguga

SEQ ID NO: 1249088 - RNA, 19 nt, Homo sapiens
auacacaguuaucauuugc

SEQ ID NO: 1249089 - RNA, 19 nt, Homo sapiens
cagcguuagugugugcaaa

SEQ ID NO: 1249090 - RNA, 19 nt, Homo sapiens
agacaugcugggucacauu

SEQ ID NO: 1249091 - RNA, 19 nt, Homo sapiens
ugcugugacuggaguagaa

SEQ ID NO: 1249092 - RNA, 19 nt, Homo sapiens
gcaaagugcccagcauaua

SEQ ID NO: 1249093 - RNA, 19 nt, Homo sapiens
gaccagcucugcuaagaug

SEQ ID NO: 1249094 - RNA, 19 nt, Homo sapiens
caaaccugcugaauaaagu

SEQ ID NO: 1249095 - RNA, 19 nt, Homo sapiens
caaagugcccagcauauag

SEQ ID NO: 1249096 - RNA, 19 nt, Homo sapiens
gcaaaccugcugaauaaag

SEQ ID NO: 1249097 - RNA, 19 nt, Homo sapiens
agaaagugcucaauaaacg

SEQ ID NO: 1249098 - RNA, 19 nt, Homo sapiens
cugauucccucaucuucua

SEQ ID NO: 1249099 - RNA, 19 nt, Homo sapiens
gggauagaaguauuucaaa

SEQ ID NO: 1249100 - RNA, 19 nt, Homo sapiens
gaaagugcucaauaaacga

SEQ ID NO: 1249101 - RNA, 19 nt, Homo sapiens
ccaaggaccccugcaauua

SEQ ID NO: 1249102 - RNA, 19 nt, Homo sapiens
aggcuucggugaacaaaga

SEQ ID NO: 1249103 - RNA, 19 nt, Homo sapiens
gcaaggcuucggugaacaa

SEQ ID NO: 1249104 - RNA, 19 nt, Homo sapiens
gauaacugcugugacuucu

SEQ ID NO: 1249105 - RNA, 19 nt, Homo sapiens
gaaaaggacaccccucuuc

SEQ ID NO: 1249106 - RNA, 19 nt, Homo sapiens
cagcaaggcuucggugaac

SEQ ID NO: 1249107 - RNA, 19 nt, Homo sapiens
gcugggugccuuugcguaa

SEQ ID NO: 1249108 - RNA, 19 nt, Homo sapiens
gcauauagaaagugcucaa

SEQ ID NO: 1249109 - RNA, 19 nt, Homo sapiens
guaaugcgcauggcaaagu

SEQ ID NO: 1249110 - RNA, 19 nt, Homo sapiens
aaggagcgcuucuucaacu

SEQ ID NO: 1249111 - RNA, 19 nt, Homo sapiens
ccccguggcuggcuacuua

SEQ ID NO: 1249112 - RNA, 19 nt, Homo sapiens
ugagagcccaagccaauug

SEQ ID NO: 1249113 - RNA, 19 nt, Homo sapiens
uaaacgauaacugcuguga

SEQ ID NO: 1249114 - RNA, 19 nt, Homo sapiens
aaagugcccagcauauaga

SEQ ID NO: 1249115 - RNA, 19 nt, Homo sapiens
uaaugcgcauggcaaagug

SEQ ID NO: 1249116 - RNA, 19 nt, Homo sapiens
caauuaggccucccaugca

SEQ ID NO: 1249117 - RNA, 19 nt, Homo sapiens
aacgauaacugcugugacu

SEQ ID NO: 1249118 - RNA, 19 nt, Homo sapiens
cgauaacugcugugacuuc

SEQ ID NO: 1249119 - RNA, 19 nt, Homo sapiens
cggcaccccucgguuauua

SEQ ID NO: 1249120 - RNA, 19 nt, Homo sapiens
gucuggaccugcccaagga

SEQ ID NO: 1249121 - RNA, 19 nt, Homo sapiens
cugaccagcucugcuaaga

SEQ ID NO: 1249122 - RNA, 19 nt, Homo sapiens
uagaaagugcucaauaaac

SEQ ID NO: 1249123 - RNA, 19 nt, Homo sapiens
gagcugaggaaggagcaaa

SEQ ID NO: 1249124 - RNA, 19 nt, Homo sapiens
ccagcaaggcuucggugaa

SEQ ID NO: 1249125 - RNA, 19 nt, Homo sapiens
uauuaaggagggaggagua

SEQ ID NO: 1249126 - RNA, 19 nt, Homo sapiens
ccugcugaauaaaguuaaa

SEQ ID NO: 1249127 - RNA, 19 nt, Homo sapiens
gagcgcuucuucaacuacu

SEQ ID NO: 1249128 - RNA, 19 nt, Homo sapiens
guccugaccagcucugcua

SEQ ID NO: 1249129 - RNA, 19 nt, Homo sapiens
agugagagcccaagccaau

SEQ ID NO: 1249130 - RNA, 19 nt, Homo sapiens
ggaguaggggauagaagua

SEQ ID NO: 1249131 - RNA, 19 nt, Homo sapiens
ccgacaaagccaaguaugu

SEQ ID NO: 1249132 - RNA, 19 nt, Homo sapiens
gcucaauaaacgauaacug

SEQ ID NO: 1249133 - RNA, 19 nt, Homo sapiens
caaagccaaguaugucaag

SEQ ID NO: 1249134 - RNA, 19 nt, Homo sapiens
agugcucaauaaacgauaa

SEQ ID NO: 1249135 - RNA, 19 nt, Homo sapiens
ggaagaaguucacuccuaa

SEQ ID NO: 1249136 - RNA, 19 nt, Homo sapiens
gcaaagcucucuccuaacu

SEQ ID NO: 1249137 - RNA, 19 nt, Homo sapiens
caaaggaaaugcucuugau

SEQ ID NO: 1249138 - RNA, 19 nt, Homo sapiens
uugcaaagcucucuccuaa

SEQ ID NO: 1249139 - RNA, 19 nt, Homo sapiens
gcugagaacuggaacuguu

SEQ ID NO: 1249140 - RNA, 19 nt, Homo sapiens
cgugagcacuugauuaauu

SEQ ID NO: 1249141 - RNA, 19 nt, Homo sapiens
guaaggaaauuuguggauu

SEQ ID NO: 1249142 - RNA, 19 nt, Homo sapiens
acaaguggcucuagugaga

SEQ ID NO: 1249143 - RNA, 19 nt, Homo sapiens
gaagguggcauuugucuca

SEQ ID NO: 1249144 - RNA, 19 nt, Homo sapiens
gugagcacuugauuaauuu

SEQ ID NO: 1249145 - RNA, 19 nt, Homo sapiens
gaugagaggcucgcuuuaa

SEQ ID NO: 1249146 - RNA, 19 nt, Homo sapiens
cuucacggcuugcauguuu

SEQ ID NO: 1249147 - RNA, 19 nt, Homo sapiens
ucaggacagucuucaguaa

SEQ ID NO: 1249148 - RNA, 19 nt, Homo sapiens
aaacaguucuugggauuga

SEQ ID NO: 1249149 - RNA, 19 nt, Homo sapiens
cauggaagcugaggaaugu

SEQ ID NO: 1249150 - RNA, 19 nt, Homo sapiens
gcaaaggaaaugcucuuga

SEQ ID NO: 1249151 - RNA, 19 nt, Homo sapiens
gcuagguucuaaagauuga

SEQ ID NO: 1249152 - RNA, 19 nt, Homo sapiens
cggcuugcauguuugauuu

SEQ ID NO: 1249153 - RNA, 19 nt, Homo sapiens
gugcuagguucuaaagauu

SEQ ID NO: 1249154 - RNA, 19 nt, Homo sapiens
gaggcucgcuuuaaagaag

SEQ ID NO: 1249155 - RNA, 19 nt, Homo sapiens
gagaggcucgcuuuaaaga

SEQ ID NO: 1249156 - RNA, 19 nt, Homo sapiens
cuagugagacgagcauuua

SEQ ID NO: 1249157 - RNA, 19 nt, Homo sapiens
cauacacacuggcugagaa

SEQ ID NO: 1249158 - RNA, 19 nt, Homo sapiens
gagcagggcacuaucauac

SEQ ID NO: 1249159 - RNA, 19 nt, Homo sapiens
caaaacaguucuugggauu

SEQ ID NO: 1249160 - RNA, 19 nt, Homo sapiens
caagauccacaaagacaaa

SEQ ID NO: 1249161 - RNA, 19 nt, Homo sapiens
aaagcucucuccuaacuuc

SEQ ID NO: 1249162 - RNA, 19 nt, Homo sapiens
gcuaacauaaggaugauga

SEQ ID NO: 1249163 - RNA, 19 nt, Homo sapiens
ggagugaagcccucaagau

SEQ ID NO: 1249164 - RNA, 19 nt, Homo sapiens
gguacaagcucaggacagu

SEQ ID NO: 1249165 - RNA, 19 nt, Homo sapiens
ggauuucccuuuggaucuu

SEQ ID NO: 1249166 - RNA, 19 nt, Homo sapiens
ggacagucuucaguaagga

SEQ ID NO: 1249167 - RNA, 19 nt, Homo sapiens
ugacucacauuuaccuugu

SEQ ID NO: 1249168 - RNA, 19 nt, Homo sapiens
gagugaagcccucaagauc

SEQ ID NO: 1249169 - RNA, 19 nt, Homo sapiens
augagaggcucgcuuuaaa

SEQ ID NO: 1249170 - RNA, 19 nt, Homo sapiens
cgucuacccugcucacaug

SEQ ID NO: 1249171 - RNA, 19 nt, Homo sapiens
gaagaaacagaccgucagu

SEQ ID NO: 1249172 - RNA, 19 nt, Homo sapiens
ggaaaugcucuugaugaga

SEQ ID NO: 1249173 - RNA, 19 nt, Homo sapiens
uaacuuccuccguaaauuc

SEQ ID NO: 1249174 - RNA, 19 nt, Homo sapiens
ugaaagaaccaguuauguc

SEQ ID NO: 1249175 - RNA, 19 nt, Homo sapiens
agaaacagaccgucaguca

SEQ ID NO: 1249176 - RNA, 19 nt, Homo sapiens
caccaacccuuccgucuac

SEQ ID NO: 1249177 - RNA, 19 nt, Homo sapiens
gggauugaaugacucacau

SEQ ID NO: 1249178 - RNA, 19 nt, Homo sapiens
aaggaaaugcucuugauga

SEQ ID NO: 1249179 - RNA, 19 nt, Homo sapiens
cuaacuuccuccguaaauu

SEQ ID NO: 1249180 - RNA, 19 nt, Homo sapiens
ccuuggcucuuccuacaaa

SEQ ID NO: 1249181 - RNA, 19 nt, Homo sapiens
aaccaguuauguccacuuu

SEQ ID NO: 1249182 - RNA, 19 nt, Homo sapiens
ucccagaggugaggaagaa

SEQ ID NO: 1249183 - RNA, 19 nt, Homo sapiens
gcagggcacuaucauacac

SEQ ID NO: 1249184 - RNA, 19 nt, Homo sapiens
ugaagcuguuggaaucuug

SEQ ID NO: 1249185 - RNA, 19 nt, Homo sapiens
ccaguuauguccacuuuug

SEQ ID NO: 1249186 - RNA, 19 nt, Homo sapiens
cagcagugaccacgucgua

SEQ ID NO: 1249187 - RNA, 19 nt, Homo sapiens
gguggcauuugucucauuc

SEQ ID NO: 1249188 - RNA, 19 nt, Homo sapiens
gaugagcagggcacuauca

SEQ ID NO: 1249189 - RNA, 19 nt, Homo sapiens
gugaagcccucaagaucca

SEQ ID NO: 1249190 - RNA, 19 nt, Homo sapiens
gcagugaccacgucguaca

SEQ ID NO: 1249191 - RNA, 19 nt, Homo sapiens
gaacucaccaccuuuugaa

SEQ ID NO: 1249192 - RNA, 19 nt, Homo sapiens
ugugcuagguucuaaagau

SEQ ID NO: 1249193 - RNA, 19 nt, Homo sapiens
ucauggugaugcugaguau

SEQ ID NO: 1249194 - RNA, 19 nt, Homo sapiens
aguugaagcuguuggaauc

SEQ ID NO: 1249195 - RNA, 19 nt, Homo sapiens
gugagacccuuggcucuuc

SEQ ID NO: 1249196 - RNA, 19 nt, Homo sapiens
caggaugcgugagcacuug

SEQ ID NO: 1249197 - RNA, 19 nt, Homo sapiens
ugucucauucccugaaaua

SEQ ID NO: 1249198 - RNA, 19 nt, Homo sapiens
gcucaggacagucuucagu

SEQ ID NO: 1249199 - RNA, 19 nt, Homo sapiens
ugcgugagcacuugauuaa

SEQ ID NO: 1249200 - RNA, 19 nt, Homo sapiens
cugaggagccugaggauca

SEQ ID NO: 1249201 - RNA, 19 nt, Homo sapiens
cuaaugauuuucccgcuaa

SEQ ID NO: 1249202 - RNA, 19 nt, Homo sapiens
gauuucccuuuggaucuuu

SEQ ID NO: 1249203 - RNA, 19 nt, Homo sapiens
acaccaacccuuccgucua

SEQ ID NO: 1249204 - RNA, 19 nt, Homo sapiens
ccacuucacagaccuccuu

SEQ ID NO: 1249205 - RNA, 19 nt, Homo sapiens
ugagcagggcacuaucaua

SEQ ID NO: 1249206 - RNA, 19 nt, Homo sapiens
gucacgggcuuccacuuca

SEQ ID NO: 1249207 - RNA, 19 nt, Homo sapiens
uucauaaccuacagugaga

SEQ ID NO: 1249208 - RNA, 19 nt, Homo sapiens
gaaccaguuauguccacuu

SEQ ID NO: 1249209 - RNA, 19 nt, Homo sapiens
ugaggagccugaggaucaa

SEQ ID NO: 1249210 - RNA, 19 nt, Homo sapiens
aggaaaugcucuugaugag

SEQ ID NO: 1249211 - RNA, 19 nt, Homo sapiens
ccucaugccagcaaaggaa

SEQ ID NO: 1249212 - RNA, 19 nt, Homo sapiens
uugggaagguggcauuugu

SEQ ID NO: 1249213 - RNA, 19 nt, Homo sapiens
cccucaagauccacaaaga

SEQ ID NO: 1249214 - RNA, 19 nt, Homo sapiens
cuccuaacuuccuccguaa

SEQ ID NO: 1249215 - RNA, 19 nt, Homo sapiens
gagcacuugauuaauuuca

SEQ ID NO: 1249216 - RNA, 19 nt, Homo sapiens
gaggugaggaagaaguuca

SEQ ID NO: 1249217 - RNA, 19 nt, Homo sapiens
ccauggaagcugaggaaug

SEQ ID NO: 1249218 - RNA, 19 nt, Homo sapiens
gaguauccaggaggaaauu

SEQ ID NO: 1249219 - RNA, 19 nt, Homo sapiens
ucaguugggaaccgaauug

SEQ ID NO: 1249220 - RNA, 19 nt, Homo sapiens
cagcgggacuucggcuugu

SEQ ID NO: 1249221 - RNA, 19 nt, Homo sapiens
gaagaggcaguucauuuuc

SEQ ID NO: 1249222 - RNA, 19 nt, Homo sapiens
cuucacagaccuccuuaug

SEQ ID NO: 1249223 - RNA, 19 nt, Homo sapiens
aaaggaaaugcucuugaug

SEQ ID NO: 1249224 - RNA, 19 nt, Homo sapiens
gcaguugaagcuguuggaa

SEQ ID NO: 1249225 - RNA, 19 nt, Homo sapiens
cuugaaagaaccaguuaug

SEQ ID NO: 1249226 - RNA, 19 nt, Homo sapiens
auuauaagcacgagucuuc

SEQ ID NO: 1249227 - RNA, 19 nt, Homo sapiens
acgugccgcucacucagua

SEQ ID NO: 1249228 - RNA, 19 nt, Homo sapiens
agucuucaguaaggaaauu

SEQ ID NO: 1249229 - RNA, 19 nt, Homo sapiens
cagaggugaggaagaaguu

SEQ ID NO: 1249230 - RNA, 19 nt, Homo sapiens
ugaugagaggcucgcuuua

SEQ ID NO: 1249231 - RNA, 19 nt, Homo sapiens
ccuaacuuccuccguaaau

SEQ ID NO: 1249232 - RNA, 19 nt, Homo sapiens
cuguggaaaugagauuaaa

SEQ ID NO: 1249233 - RNA, 19 nt, Homo sapiens
ucacggcuugcauguuuga

SEQ ID NO: 1249234 - RNA, 19 nt, Homo sapiens
acacccagcucagccucaa

SEQ ID NO: 1249235 - RNA, 19 nt, Homo sapiens
gcaaugagcaccucuauga

SEQ ID NO: 1249236 - RNA, 19 nt, Homo sapiens
gcaggaagugggcgaguuu

SEQ ID NO: 1249237 - RNA, 19 nt, Homo sapiens
ugaauagugugcagacuca

SEQ ID NO: 1249238 - RNA, 19 nt, Homo sapiens
ccagcagcaugucaaguuu

SEQ ID NO: 1249239 - RNA, 19 nt, Homo sapiens
ggugugggcucugcuguau

SEQ ID NO: 1249240 - RNA, 19 nt, Homo sapiens
gcagacucacagauaauaa

SEQ ID NO: 1249241 - RNA, 19 nt, Homo sapiens
gcccugcccuccucaugaa

SEQ ID NO: 1249242 - RNA, 19 nt, Homo sapiens
gagccagacugcgaucaga

SEQ ID NO: 1249243 - RNA, 19 nt, Homo sapiens
ccacaacggccaggacuug

SEQ ID NO: 1249244 - RNA, 19 nt, Homo sapiens
ccacaaccagucccaucua

SEQ ID NO: 1249245 - RNA, 19 nt, Homo sapiens
ccggagagcuucgggagau

SEQ ID NO: 1249246 - RNA, 19 nt, Homo sapiens
cagacucacagauaauaaa

SEQ ID NO: 1249247 - RNA, 19 nt, Homo sapiens
gacgggaaguggccagaag

SEQ ID NO: 1249248 - RNA, 19 nt, Homo sapiens
gagccugccgcuacugcua

SEQ ID NO: 1249249 - RNA, 19 nt, Homo sapiens
ggcaggaagugggcgaguu

SEQ ID NO: 1249250 - RNA, 19 nt, Homo sapiens
ccagucccaucuaccacaa

SEQ ID NO: 1249251 - RNA, 19 nt, Homo sapiens
augagcaccucuaugagaa

SEQ ID NO: 1249252 - RNA, 19 nt, Homo sapiens
aaugagcaccucuaugaga

SEQ ID NO: 1249253 - RNA, 19 nt, Homo sapiens
cagcuggcccuaccacuuc

SEQ ID NO: 1249254 - RNA, 19 nt, Homo sapiens
gaggaaaacuccaucuacu

SEQ ID NO: 1249255 - RNA, 19 nt, Homo sapiens
caaccagucccaucuacca

SEQ ID NO: 1249256 - RNA, 19 nt, Homo sapiens
gaugcccagucucccaaga

SEQ ID NO: 1249257 - RNA, 19 nt, Homo sapiens
caugucaaguuuggcaaga

SEQ ID NO: 1249258 - RNA, 19 nt, Homo sapiens
gggcuggugggcaaacauu

SEQ ID NO: 1249259 - RNA, 19 nt, Homo sapiens
ugucaaguuuggcaagaag

SEQ ID NO: 1249260 - RNA, 19 nt, Homo sapiens
acucacagauaauaaagcu

SEQ ID NO: 1249261 - RNA, 19 nt, Homo sapiens
ucuaugagaaccugugugu

SEQ ID NO: 1249262 - RNA, 19 nt, Homo sapiens
ggacgggaaguggccagaa

SEQ ID NO: 1249263 - RNA, 19 nt, Homo sapiens
cacaaccagucccaucuac

SEQ ID NO: 1249264 - RNA, 19 nt, Homo sapiens
gugcagacucacagauaau

SEQ ID NO: 1249265 - RNA, 19 nt, Homo sapiens
gaucagcaauuuagaagua

SEQ ID NO: 1249266 - RNA, 19 nt, Homo sapiens
gaaagaacuugaugaauuc

SEQ ID NO: 1249267 - RNA, 19 nt, Homo sapiens
gcaaugggaucagcaauuu

SEQ ID NO: 1249268 - RNA, 19 nt, Homo sapiens
gcagggauauuguauguug

SEQ ID NO: 1249269 - RNA, 19 nt, Homo sapiens
gaaaaucucuucagcauau

SEQ ID NO: 1249270 - RNA, 19 nt, Homo sapiens
gagagagacuuaaucaaga

SEQ ID NO: 1249271 - RNA, 19 nt, Homo sapiens
uagcagagcugaagacgaa

SEQ ID NO: 1249272 - RNA, 19 nt, Homo sapiens
gaaaagagcuccuggaagu

SEQ ID NO: 1249273 - RNA, 19 nt, Homo sapiens
ggaaauagagugagcaaga

SEQ ID NO: 1249274 - RNA, 19 nt, Homo sapiens
gauaaaagcuugucagaug

SEQ ID NO: 1249275 - RNA, 19 nt, Homo sapiens
uaacauugcucccauucuu

SEQ ID NO: 1249276 - RNA, 19 nt, Homo sapiens
gggcacaucuagaaugauu

SEQ ID NO: 1249277 - RNA, 19 nt, Homo sapiens
gaggaagucucgaguggaa

SEQ ID NO: 1249278 - RNA, 19 nt, Homo sapiens
gaugaauucucuugaacaa

SEQ ID NO: 1249279 - RNA, 19 nt, Homo sapiens
caauaaggcucuucaggau

SEQ ID NO: 1249280 - RNA, 19 nt, Homo sapiens
guacagggcacaucuagaa

SEQ ID NO: 1249281 - RNA, 19 nt, Homo sapiens
gaaauaaaacgccucaaua

SEQ ID NO: 1249282 - RNA, 19 nt, Homo sapiens
ggaggagccaguuauuaua

SEQ ID NO: 1249283 - RNA, 19 nt, Homo sapiens
gaggagcuacagcaaauua

SEQ ID NO: 1249284 - RNA, 19 nt, Homo sapiens
caggaugccuugaauauca

SEQ ID NO: 1249285 - RNA, 19 nt, Homo sapiens
cacaucaucuacccuguua

SEQ ID NO: 1249286 - RNA, 19 nt, Homo sapiens
acgccuaaaugaagaauua

SEQ ID NO: 1249287 - RNA, 19 nt, Homo sapiens
gcugaaccaucaacaagaa

SEQ ID NO: 1249288 - RNA, 19 nt, Homo sapiens
aagauaagguguuuggaaa

SEQ ID NO: 1249289 - RNA, 19 nt, Homo sapiens
gaauugaagagguguauau

SEQ ID NO: 1249290 - RNA, 19 nt, Homo sapiens
gauccuaaacguagaauug

SEQ ID NO: 1249291 - RNA, 19 nt, Homo sapiens
gaugagaacagaaauggaa

SEQ ID NO: 1249292 - RNA, 19 nt, Homo sapiens
ggccuuaguucuuuagcua

SEQ ID NO: 1249293 - RNA, 19 nt, Homo sapiens
caucuacccuguuauuugu

SEQ ID NO: 1249294 - RNA, 19 nt, Homo sapiens
gcaaauauacgaagaagac

SEQ ID NO: 1249295 - RNA, 19 nt, Homo sapiens
cagcuuccauggcacauuu

SEQ ID NO: 1249296 - RNA, 19 nt, Homo sapiens
gaaaugagacuuggcagau

SEQ ID NO: 1249297 - RNA, 19 nt, Homo sapiens
acacaaggcaaaugguuua

SEQ ID NO: 1249298 - RNA, 19 nt, Homo sapiens
aaagagcuccuggaaguua

SEQ ID NO: 1249299 - RNA, 19 nt, Homo sapiens
aauaagugguucaaucuga

SEQ ID NO: 1249300 - RNA, 19 nt, Homo sapiens
gauuuaaagugcauaugug

SEQ ID NO: 1249301 - RNA, 19 nt, Homo sapiens
gaaaguccauccguagaag

SEQ ID NO: 1249302 - RNA, 19 nt, Homo sapiens
gaaagaggagcuacagcaa

SEQ ID NO: 1249303 - RNA, 19 nt, Homo sapiens
gagacuuaaucaagagaaa

SEQ ID NO: 1249304 - RNA, 19 nt, Homo sapiens
ccacagggccuuaguucuu

SEQ ID NO: 1249305 - RNA, 19 nt, Homo sapiens
gcuauuugacuacauauug

SEQ ID NO: 1249306 - RNA, 19 nt, Homo sapiens
gaggagaugagaacagaaa

SEQ ID NO: 1249307 - RNA, 19 nt, Homo sapiens
ggaugaugauggcuauaug

SEQ ID NO: 1249308 - RNA, 19 nt, Homo sapiens
gcagguggauugcuuugag

SEQ ID NO: 1249309 - RNA, 19 nt, Homo sapiens
gaaaaccuauugcuguuau

SEQ ID NO: 1249310 - RNA, 19 nt, Homo sapiens
aagaggagcuacagcaaau

SEQ ID NO: 1249311 - RNA, 19 nt, Homo sapiens
cagggcacaucuagaauga

SEQ ID NO: 1249312 - RNA, 19 nt, Homo sapiens
gaaauagagugagcaagac

SEQ ID NO: 1249313 - RNA, 19 nt, Homo sapiens
ggaagucucgaguggaauu

SEQ ID NO: 1249314 - RNA, 19 nt, Homo sapiens
guccauauauacuuacaga

SEQ ID NO: 1249315 - RNA, 19 nt, Homo sapiens
ggacccucuucuuuguuua

SEQ ID NO: 1249316 - RNA, 19 nt, Homo sapiens
gcauaaagagugugcugaa

SEQ ID NO: 1249317 - RNA, 19 nt, Homo sapiens
ggagccaguuauuauacaa

SEQ ID NO: 1249318 - RNA, 19 nt, Homo sapiens
cgagagagacuuaaucaag

SEQ ID NO: 1249319 - RNA, 19 nt, Homo sapiens
caacacaaggcaaaugguu

SEQ ID NO: 1249320 - RNA, 19 nt, Homo sapiens
agagguugcuguaaguuga

SEQ ID NO: 1249321 - RNA, 19 nt, Homo sapiens
uaaugaaacuucccaaucc

SEQ ID NO: 1249322 - RNA, 19 nt, Homo sapiens
gaaaaggaacgccuaaaug

SEQ ID NO: 1249323 - RNA, 19 nt, Homo sapiens
cacagggccuuaguucuuu

SEQ ID NO: 1249324 - RNA, 19 nt, Homo sapiens
caucaucuacccuguuauu

SEQ ID NO: 1249325 - RNA, 19 nt, Homo sapiens
ugacuccucaagccaauua

SEQ ID NO: 1249326 - RNA, 19 nt, Homo sapiens
ccguagaaguacacacuaa

SEQ ID NO: 1249327 - RNA, 19 nt, Homo sapiens
caggcugaauucccagaua

SEQ ID NO: 1249328 - RNA, 19 nt, Homo sapiens
uaaagagugugcugaacca

SEQ ID NO: 1249329 - RNA, 19 nt, Homo sapiens
gcacaucaucuacccuguu

SEQ ID NO: 1249330 - RNA, 19 nt, Homo sapiens
caagauccauggguaccaa

SEQ ID NO: 1249331 - RNA, 19 nt, Homo sapiens
gagcuacagcaaauuaaug

SEQ ID NO: 1249332 - RNA, 19 nt, Homo sapiens
aaagauaagguguuuggaa

SEQ ID NO: 1249333 - RNA, 19 nt, Homo sapiens
aaaguucuacggagcauaa

SEQ ID NO: 1249334 - RNA, 19 nt, Homo sapiens
ggaagacaaaguccugaug

SEQ ID NO: 1249335 - RNA, 19 nt, Homo sapiens
ggaggcagagguugcugua

SEQ ID NO: 1249336 - RNA, 19 nt, Homo sapiens
uuaagauggugagaaauug

SEQ ID NO: 1249337 - RNA, 19 nt, Homo sapiens
agacuuggcagauggauga

SEQ ID NO: 1249338 - RNA, 19 nt, Homo sapiens
aaaggcuucugacagcuaa

SEQ ID NO: 1249339 - RNA, 19 nt, Homo sapiens
aggcugaauucccagauaa

SEQ ID NO: 1249340 - RNA, 19 nt, Homo sapiens
agcagcaggugcaaauaua

SEQ ID NO: 1249341 - RNA, 19 nt, Homo sapiens
gaagcagcaggugcaaaua

SEQ ID NO: 1249342 - RNA, 19 nt, Homo sapiens
ccuauaaucccagcacuuu

SEQ ID NO: 1249343 - RNA, 19 nt, Homo sapiens
uagaaugauugccgcagaa

SEQ ID NO: 1249344 - RNA, 19 nt, Homo sapiens
ugaccucagugauccuaaa

SEQ ID NO: 1249345 - RNA, 19 nt, Homo sapiens
cacaaaggcacaucaucua

SEQ ID NO: 1249346 - RNA, 19 nt, Homo sapiens
ccacaaaggcacaucaucu

SEQ ID NO: 1249347 - RNA, 19 nt, Homo sapiens
ggagaugagaacagaaaug

SEQ ID NO: 1249348 - RNA, 19 nt, Homo sapiens
gaaccaucaacaagaaaga

SEQ ID NO: 1249349 - RNA, 19 nt, Homo sapiens
agagugugcugaaccauca

SEQ ID NO: 1249350 - RNA, 19 nt, Homo sapiens
caaaugguuuauccucagu

SEQ ID NO: 1249351 - RNA, 19 nt, Homo sapiens
aaauggaaguucugaagca

SEQ ID NO: 1249352 - RNA, 19 nt, Homo sapiens
aaaauacucuugcgaacaa

SEQ ID NO: 1249353 - RNA, 19 nt, Homo sapiens
ugaggcagguggauugcuu

SEQ ID NO: 1249354 - RNA, 19 nt, Homo sapiens
cugcagggauauuguaugu

SEQ ID NO: 1249355 - RNA, 19 nt, Homo sapiens
caaggcaaaugguuuaucc

SEQ ID NO: 1249356 - RNA, 19 nt, Homo sapiens
aaaggaacgccuaaaugaa

SEQ ID NO: 1249357 - RNA, 19 nt, Homo sapiens
gagaaggauccgcaucaga

SEQ ID NO: 1249358 - RNA, 19 nt, Homo sapiens
guguauauaccucguuaaa

SEQ ID NO: 1249359 - RNA, 19 nt, Homo sapiens
cuugucagauggagaaaga

SEQ ID NO: 1249360 - RNA, 19 nt, Homo sapiens
gagaacagaaauggaaguu

SEQ ID NO: 1249361 - RNA, 19 nt, Homo sapiens
gagaugagaacagaaaugg

SEQ ID NO: 1249362 - RNA, 19 nt, Homo sapiens
gaguggaauucugccauga

SEQ ID NO: 1249363 - RNA, 19 nt, Homo sapiens
gacagaucauuucuuuaag

SEQ ID NO: 1249364 - RNA, 19 nt, Homo sapiens
gaugguuaauuggaagcua

SEQ ID NO: 1249365 - RNA, 19 nt, Homo sapiens
gaacaaagcuguggauuac

SEQ ID NO: 1249366 - RNA, 19 nt, Homo sapiens
gaagauacagccauauuaa

SEQ ID NO: 1249367 - RNA, 19 nt, Homo sapiens
caacgaagcugugaaugaa

SEQ ID NO: 1249368 - RNA, 19 nt, Homo sapiens
gagcucagaugaucagaaa

SEQ ID NO: 1249369 - RNA, 19 nt, Homo sapiens
gaaugacuccaacgaauua

SEQ ID NO: 1249370 - RNA, 19 nt, Homo sapiens
gaagauuucugaagauaca

SEQ ID NO: 1249371 - RNA, 19 nt, Homo sapiens
gcccagcacucaacaagua

SEQ ID NO: 1249372 - RNA, 19 nt, Homo sapiens
gagcaggcaucaaacagaa

SEQ ID NO: 1249373 - RNA, 19 nt, Homo sapiens
ggagagaguguccagauaa

SEQ ID NO: 1249374 - RNA, 19 nt, Homo sapiens
caagauaacugggaaugug

SEQ ID NO: 1249375 - RNA, 19 nt, Homo sapiens
uaaaggaacuggugguauc

SEQ ID NO: 1249376 - RNA, 19 nt, Homo sapiens
ugacguaguuacaccuaua

SEQ ID NO: 1249377 - RNA, 19 nt, Homo sapiens
ggaccuauguguucaccuu

SEQ ID NO: 1249378 - RNA, 19 nt, Homo sapiens
ucaaagcacugaugaugau

SEQ ID NO: 1249379 - RNA, 19 nt, Homo sapiens
gaugguagcauagaaauga

SEQ ID NO: 1249380 - RNA, 19 nt, Homo sapiens
ggacugugaucuguuguug

SEQ ID NO: 1249381 - RNA, 19 nt, Homo sapiens
gaaagugaccgaugcaaag

SEQ ID NO: 1249382 - RNA, 19 nt, Homo sapiens
ugaacaaagcuguggauua

SEQ ID NO: 1249383 - RNA, 19 nt, Homo sapiens
cagcgaugcucaagaguga

SEQ ID NO: 1249384 - RNA, 19 nt, Homo sapiens
ugaagauacagccauauua

SEQ ID NO: 1249385 - RNA, 19 nt, Homo sapiens
gaccaucacccuauccuuu

SEQ ID NO: 1249386 - RNA, 19 nt, Homo sapiens
ggaaagugguggagaugca

SEQ ID NO: 1249387 - RNA, 19 nt, Homo sapiens
acaaggcgauuacaauuuc

SEQ ID NO: 1249388 - RNA, 19 nt, Homo sapiens
guaguuacaccuauaguga

SEQ ID NO: 1249389 - RNA, 19 nt, Homo sapiens
gaagacacaauuuggaguu

SEQ ID NO: 1249390 - RNA, 19 nt, Homo sapiens
ccacaaggcgauuacaauu

SEQ ID NO: 1249391 - RNA, 19 nt, Homo sapiens
cgaauuagguggucugacu

SEQ ID NO: 1249392 - RNA, 19 nt, Homo sapiens
acacagcauucuaaaguga

SEQ ID NO: 1249393 - RNA, 19 nt, Homo sapiens
gcagaugcaggcccagaua

SEQ ID NO: 1249394 - RNA, 19 nt, Homo sapiens
cagauaacccugccuaaga

SEQ ID NO: 1249395 - RNA, 19 nt, Homo sapiens
acugugaucuguuguugua

SEQ ID NO: 1249396 - RNA, 19 nt, Homo sapiens
agauaacccugccuaagaa

SEQ ID NO: 1249397 - RNA, 19 nt, Homo sapiens
gugaaugacuccaacgaau

SEQ ID NO: 1249398 - RNA, 19 nt, Homo sapiens
ggacacacuccuccaauuc

SEQ ID NO: 1249399 - RNA, 19 nt, Homo sapiens
ugagaagccuguaccuguu

SEQ ID NO: 1249400 - RNA, 19 nt, Homo sapiens
gcucuaaguccucagauga

SEQ ID NO: 1249401 - RNA, 19 nt, Homo sapiens
agacuacaguggagaaaug

SEQ ID NO: 1249402 - RNA, 19 nt, Homo sapiens
uggagcguguuauauguua

SEQ ID NO: 1249403 - RNA, 19 nt, Homo sapiens
ugacacagcauucuaaagu

SEQ ID NO: 1249404 - RNA, 19 nt, Homo sapiens
caccacagaugcugagaug

SEQ ID NO: 1249405 - RNA, 19 nt, Homo sapiens
gcagcaagagcucagauga

SEQ ID NO: 1249406 - RNA, 19 nt, Homo sapiens
cugcaaaccugacagugaa

SEQ ID NO: 1249407 - RNA, 19 nt, Homo sapiens
ccaagaaccaccuaaagga

SEQ ID NO: 1249408 - RNA, 19 nt, Homo sapiens
gcaccauacccaguuauaa

SEQ ID NO: 1249409 - RNA, 19 nt, Homo sapiens
gcugauuacucauccuaga

SEQ ID NO: 1249410 - RNA, 19 nt, Homo sapiens
ccaauuccaugcugguguu

SEQ ID NO: 1249411 - RNA, 19 nt, Homo sapiens
ggaaccagagcacugauga

SEQ ID NO: 1249412 - RNA, 19 nt, Homo sapiens
ggaacuacacuuucagcuu

SEQ ID NO: 1249413 - RNA, 19 nt, Homo sapiens
caccauacccaguuauaaa

SEQ ID NO: 1249414 - RNA, 19 nt, Homo sapiens
gcacuaccuucuuccucuu

SEQ ID NO: 1249415 - RNA, 19 nt, Homo sapiens
gagaagaggcugggaguca

SEQ ID NO: 1249416 - RNA, 19 nt, Homo sapiens
acucagaccugcuguaucu

SEQ ID NO: 1249417 - RNA, 19 nt, Homo sapiens
acccagagcugcacucaga

SEQ ID NO: 1249418 - RNA, 19 nt, Homo sapiens
ucaacgaagcugugaauga

SEQ ID NO: 1249419 - RNA, 19 nt, Homo sapiens
gcuaccaacucuacuacug

SEQ ID NO: 1249420 - RNA, 19 nt, Homo sapiens
uaagagaagagaagauuuc

SEQ ID NO: 1249421 - RNA, 19 nt, Homo sapiens
gcacucagaccugcuguau

SEQ ID NO: 1249422 - RNA, 19 nt, Homo sapiens
gaaaccccaucucuacuaa

SEQ ID NO: 1249423 - RNA, 19 nt, Homo sapiens
ccaccuauagccaagauaa

SEQ ID NO: 1249424 - RNA, 19 nt, Homo sapiens
ggagcuaccaacucuacua

SEQ ID NO: 1249425 - RNA, 19 nt, Homo sapiens
gaacuuaaggggccucuaa

SEQ ID NO: 1249426 - RNA, 19 nt, Homo sapiens
gagaagccuguaccuguuu

SEQ ID NO: 1249427 - RNA, 19 nt, Homo sapiens
gaguggagcguguuauaug

SEQ ID NO: 1249428 - RNA, 19 nt, Homo sapiens
ucagcaccauacccaguua

SEQ ID NO: 1249429 - RNA, 19 nt, Homo sapiens
agucaacacugucacaugu

SEQ ID NO: 1249430 - RNA, 19 nt, Homo sapiens
ggagggccauggagaagag

SEQ ID NO: 1249431 - RNA, 19 nt, Homo sapiens
cagagggucuugcuacuac

SEQ ID NO: 1249432 - RNA, 19 nt, Homo sapiens
gacacagcauucuaaagug

SEQ ID NO: 1249433 - RNA, 19 nt, Homo sapiens
ggaguuggccugagaucug

SEQ ID NO: 1249434 - RNA, 19 nt, Homo sapiens
gaugagaggaaccugcaaa

SEQ ID NO: 1249435 - RNA, 19 nt, Homo sapiens
aagaaggagacuacacuua

SEQ ID NO: 1249436 - RNA, 19 nt, Homo sapiens
gcaagaaggagacuacacu

SEQ ID NO: 1249437 - RNA, 19 nt, Homo sapiens
aagcacugaugaugauaaa

SEQ ID NO: 1249438 - RNA, 19 nt, Homo sapiens
gcuauugugucaccucagu

SEQ ID NO: 1249439 - RNA, 19 nt, Homo sapiens
uaacccugccuaagaauga

SEQ ID NO: 1249440 - RNA, 19 nt, Homo sapiens
gagagaguguccagauaac

SEQ ID NO: 1249441 - RNA, 19 nt, Homo sapiens
ugaaugacuccaacgaauu

SEQ ID NO: 1249442 - RNA, 19 nt, Homo sapiens
uagaagggaugugcauuca

SEQ ID NO: 1249443 - RNA, 19 nt, Homo sapiens
cuccaggccuguaugaauu

SEQ ID NO: 1249444 - RNA, 19 nt, Homo sapiens
cacagaugcugagauggua

SEQ ID NO: 1249445 - RNA, 19 nt, Homo sapiens
ucaacacugucacauguca

SEQ ID NO: 1249446 - RNA, 19 nt, Homo sapiens
ggagaugcaggguguuaga

SEQ ID NO: 1249447 - RNA, 19 nt, Homo sapiens
cacaaggcgauuacaauuu

SEQ ID NO: 1249448 - RNA, 19 nt, Homo sapiens
gaauuagguggucugacua

SEQ ID NO: 1249449 - RNA, 19 nt, Homo sapiens
gcagaugauuugggcuuuc

SEQ ID NO: 1249450 - RNA, 19 nt, Homo sapiens
gugaguggagcguguuaua

SEQ ID NO: 1249451 - RNA, 19 nt, Homo sapiens
acaagggaauagucagcua

SEQ ID NO: 1249452 - RNA, 19 nt, Homo sapiens
cagcuugacuguaguagac

SEQ ID NO: 1249453 - RNA, 19 nt, Homo sapiens
gaauucaaagugauuguag

SEQ ID NO: 1249454 - RNA, 19 nt, Homo sapiens
ugaaagugaccgaugcaaa

SEQ ID NO: 1249455 - RNA, 19 nt, Homo sapiens
gaaggagacuacacuuacc

SEQ ID NO: 1249456 - RNA, 19 nt, Homo sapiens
ugauggagcuaccaacucu

SEQ ID NO: 1249457 - RNA, 19 nt, Homo sapiens
ccugggaacuacacuuuca

SEQ ID NO: 1249458 - RNA, 19 nt, Homo sapiens
augcauauguucuccaaga

SEQ ID NO: 1249459 - RNA, 19 nt, Homo sapiens
agugcaaccugaaauauca

SEQ ID NO: 1249460 - RNA, 19 nt, Homo sapiens
ugacuguaguagacucuga

SEQ ID NO: 1249461 - RNA, 19 nt, Homo sapiens
aaucaccuguggcuucuug

SEQ ID NO: 1249462 - RNA, 19 nt, Homo sapiens
agaaccaccuaaaggagaa

SEQ ID NO: 1249463 - RNA, 19 nt, Homo sapiens
gguaucugcuggagagagu

SEQ ID NO: 1249464 - RNA, 19 nt, Homo sapiens
acgaagcugugaaugaaga

SEQ ID NO: 1249465 - RNA, 19 nt, Homo sapiens
gagaauaacuccuuagaga

SEQ ID NO: 1249466 - RNA, 19 nt, Homo sapiens
caucagcccuaucaacuua

SEQ ID NO: 1249467 - RNA, 19 nt, Homo sapiens
ccacagaucucucuuccuu

SEQ ID NO: 1249468 - RNA, 19 nt, Homo sapiens
gaaagagauucacuagaga

SEQ ID NO: 1249469 - RNA, 19 nt, Homo sapiens
gaaaggaggagacgaagaa

SEQ ID NO: 1249470 - RNA, 19 nt, Homo sapiens
gcagagagccuccaagaga

SEQ ID NO: 1249471 - RNA, 19 nt, Homo sapiens
ucacgcaucuggaagcuaa

SEQ ID NO: 1249472 - RNA, 19 nt, Homo sapiens
agaaagagauucacuagag

SEQ ID NO: 1249473 - RNA, 19 nt, Homo sapiens
guacagaaccuggaugaaa

SEQ ID NO: 1249474 - RNA, 19 nt, Homo sapiens
ggacagguaugugguggaa

SEQ ID NO: 1249475 - RNA, 19 nt, Homo sapiens
caucaaggcucuagauuuu

SEQ ID NO: 1249476 - RNA, 19 nt, Homo sapiens
ugaaaguuauggagcauga

SEQ ID NO: 1249477 - RNA, 19 nt, Homo sapiens
gcaucaaggcucuagauuu

SEQ ID NO: 1249478 - RNA, 19 nt, Homo sapiens
aaauaaagacccaaucuga

SEQ ID NO: 1249479 - RNA, 19 nt, Homo sapiens
acagaucucucuuccuuga

SEQ ID NO: 1249480 - RNA, 19 nt, Homo sapiens
gagaugguuuccaaguuga

SEQ ID NO: 1249481 - RNA, 19 nt, Homo sapiens
cagagagccuccaagagaa

SEQ ID NO: 1249482 - RNA, 19 nt, Homo sapiens
ccaacuaccaccucgguua

SEQ ID NO: 1249483 - RNA, 19 nt, Homo sapiens
ggagaaagagauucacuag

SEQ ID NO: 1249484 - RNA, 19 nt, Homo sapiens
agagaugguuuccaaguug

SEQ ID NO: 1249485 - RNA, 19 nt, Homo sapiens
cagagaugguuuccaaguu

SEQ ID NO: 1249486 - RNA, 19 nt, Homo sapiens
gaggggaggucaaaauaaa

SEQ ID NO: 1249487 - RNA, 19 nt, Homo sapiens
aaguaugucugcuuuggua

SEQ ID NO: 1249488 - RNA, 19 nt, Homo sapiens
cuggaucucugucuuuauu

SEQ ID NO: 1249489 - RNA, 19 nt, Homo sapiens
gaaauauucacccaacauc

SEQ ID NO: 1249490 - RNA, 19 nt, Homo sapiens
cagcaucuugugaaaguua

SEQ ID NO: 1249491 - RNA, 19 nt, Homo sapiens
ugugugcucuuccgucuaa

SEQ ID NO: 1249492 - RNA, 19 nt, Homo sapiens
ggaucucugucuuuauuuc

SEQ ID NO: 1249493 - RNA, 19 nt, Homo sapiens
gacccaaucugagucuuau

SEQ ID NO: 1249494 - RNA, 19 nt, Homo sapiens
guaaacagagcagaaguga

SEQ ID NO: 1249495 - RNA, 19 nt, Homo sapiens
ggaaauauucacccaacau

SEQ ID NO: 1249496 - RNA, 19 nt, Homo sapiens
gcagagagccaagaaguac

SEQ ID NO: 1249497 - RNA, 19 nt, Homo sapiens
aaccaaguaugucugcuuu

SEQ ID NO: 1249498 - RNA, 19 nt, Homo sapiens
gggugcagcucuuugaaca

SEQ ID NO: 1249499 - RNA, 19 nt, Homo sapiens
gaacgaagaauucuauacc

SEQ ID NO: 1249500 - RNA, 19 nt, Homo sapiens
gcaggagaauggcaugaac

SEQ ID NO: 1249501 - RNA, 19 nt, Homo sapiens
aagcuugacuggcauauac

SEQ ID NO: 1249502 - RNA, 19 nt, Homo sapiens
gaaguaaacagagcagaag

SEQ ID NO: 1249503 - RNA, 19 nt, Homo sapiens
ugaagggccaggacaguuu

SEQ ID NO: 1249504 - RNA, 19 nt, Homo sapiens
uacagcaucuugugaaagu

SEQ ID NO: 1249505 - RNA, 19 nt, Homo sapiens
acuagagaauaacuccuua

SEQ ID NO: 1249506 - RNA, 19 nt, Homo sapiens
gggagaaagagauucacua

SEQ ID NO: 1249507 - RNA, 19 nt, Homo sapiens
caaucugagucuuaucguu

SEQ ID NO: 1249508 - RNA, 19 nt, Homo sapiens
ccaggcuucuccacccaua

SEQ ID NO: 1249509 - RNA, 19 nt, Homo sapiens
ugccagagaugguuuccaa

SEQ ID NO: 1249510 - RNA, 19 nt, Homo sapiens
gagaaagagauucacuaga

SEQ ID NO: 1249511 - RNA, 19 nt, Homo sapiens
ugucugcuuugguaucuuu

SEQ ID NO: 1249512 - RNA, 19 nt, Homo sapiens
caacuaccaccucgguuau

SEQ ID NO: 1249513 - RNA, 19 nt, Homo sapiens
gcaucuggaagcuaaauug

SEQ ID NO: 1249514 - RNA, 19 nt, Homo sapiens
ccaggagauucgccgguuu

SEQ ID NO: 1249515 - RNA, 19 nt, Homo sapiens
ccacugcucucucccuuuu

SEQ ID NO: 1249516 - RNA, 19 nt, Homo sapiens
agaaucugguccugaagaa

SEQ ID NO: 1249517 - RNA, 19 nt, Homo sapiens
ggaaaggaggagacgaaga

SEQ ID NO: 1249518 - RNA, 19 nt, Homo sapiens
aggaauagaacgaagaauu

SEQ ID NO: 1249519 - RNA, 19 nt, Homo sapiens
ucagugagaaguaaacaga

SEQ ID NO: 1249520 - RNA, 19 nt, Homo sapiens
gagcccaucuggagaacag

SEQ ID NO: 1249521 - RNA, 19 nt, Homo sapiens
guggggagcuguuugcuaa

SEQ ID NO: 1249522 - RNA, 19 nt, Homo sapiens
gaagggccaggacaguuug

SEQ ID NO: 1249523 - RNA, 19 nt, Homo sapiens
gcagguguacagcaucuug

SEQ ID NO: 1249524 - RNA, 19 nt, Homo sapiens
ggucagauauccccacaug

SEQ ID NO: 1249525 - RNA, 19 nt, Homo sapiens
ccauauuccuccacagauc

SEQ ID NO: 1249526 - RNA, 19 nt, Homo sapiens
caagggcagcggccaacua

SEQ ID NO: 1249527 - RNA, 19 nt, Homo sapiens
ggcagagagccaagaagua

SEQ ID NO: 1249528 - RNA, 19 nt, Homo sapiens
gugcagagagccuccaaga

SEQ ID NO: 1249529 - RNA, 19 nt, Homo sapiens
uugcaugggcugaguuaua

SEQ ID NO: 1249530 - RNA, 19 nt, Homo sapiens
cgacggagcgagacucugu

SEQ ID NO: 1249531 - RNA, 19 nt, Homo sapiens
ggaguugagugggagaaag

SEQ ID NO: 1249532 - RNA, 19 nt, Homo sapiens
ucgagaccauccuggcuaa

SEQ ID NO: 1249533 - RNA, 19 nt, Homo sapiens
gaccaaaugcaggacaauu

SEQ ID NO: 1249534 - RNA, 19 nt, Homo sapiens
ucuaaggcaugaauaagag

SEQ ID NO: 1249535 - RNA, 19 nt, Homo sapiens
ccaaagggguacuuauguu

SEQ ID NO: 1249536 - RNA, 19 nt, Homo sapiens
gacccugccucacgugaca

SEQ ID NO: 1249537 - RNA, 19 nt, Homo sapiens
gcuucuaucuuccuaucug

SEQ ID NO: 1249538 - RNA, 19 nt, Homo sapiens
uguacagcaucuugugaaa

SEQ ID NO: 1249539 - RNA, 19 nt, Homo sapiens
ccaagccagcuaugacaaa

SEQ ID NO: 1249540 - RNA, 19 nt, Homo sapiens
aauguucagugagaaguaa

SEQ ID NO: 1249541 - RNA, 19 nt, Homo sapiens
gcaucagcccuaucaacuu

SEQ ID NO: 1249542 - RNA, 19 nt, Homo sapiens
uugaugggcucgugaaugg

SEQ ID NO: 1249543 - RNA, 19 nt, Homo sapiens
gcgagcagcgcaucucugu

SEQ ID NO: 1249544 - RNA, 19 nt, Homo sapiens
acuaccaccucgguuauuu

SEQ ID NO: 1249545 - RNA, 19 nt, Homo sapiens
aaagagauucacuagagaa

SEQ ID NO: 1249546 - RNA, 19 nt, Homo sapiens
gaguugagugggagaaaga

SEQ ID NO: 1249547 - RNA, 19 nt, Homo sapiens
ccaccaggcacacagcaaa

SEQ ID NO: 1249548 - RNA, 19 nt, Homo sapiens
ggaccaaggagagguggaa

SEQ ID NO: 1249549 - RNA, 19 nt, Homo sapiens
ucagcccuaucaacuuaaa

SEQ ID NO: 1249550 - RNA, 19 nt, Homo sapiens
uacagaaccuggaugaaaa

SEQ ID NO: 1249551 - RNA, 19 nt, Homo sapiens
aaaguuauggagcaugaaa

SEQ ID NO: 1249552 - RNA, 19 nt, Homo sapiens
gcuccaagacucguucuau

SEQ ID NO: 1249553 - RNA, 19 nt, Homo sapiens
caaccaaguaugucugcuu

SEQ ID NO: 1249554 - RNA, 19 nt, Homo sapiens
uaaaagaggccaagaccaa

SEQ ID NO: 1249555 - RNA, 19 nt, Homo sapiens
ugcuaucgcugguacagaa

SEQ ID NO: 1249556 - RNA, 19 nt, Homo sapiens
cuccaccgcuucuaucuuc

SEQ ID NO: 1249557 - RNA, 19 nt, Homo sapiens
caagccagcuaugacaaag

SEQ ID NO: 1249558 - RNA, 19 nt, Homo sapiens
ccaggaauagaacgaagaa

SEQ ID NO: 1249559 - RNA, 19 nt, Homo sapiens
ugauagaagggucagauau

SEQ ID NO: 1249560 - RNA, 19 nt, Homo sapiens
gucaggagaucgagaccau

SEQ ID NO: 1249561 - RNA, 19 nt, Homo sapiens
gguaaucccagcacuuugg

SEQ ID NO: 1249562 - RNA, 19 nt, Homo sapiens
agaaguaaacagagcagaa

SEQ ID NO: 1249563 - RNA, 19 nt, Homo sapiens
caccagaacaggauugcaa

SEQ ID NO: 1249564 - RNA, 19 nt, Homo sapiens
ucaaggcucuagauuuuau

SEQ ID NO: 1249565 - RNA, 19 nt, Homo sapiens
ccagggcccuuacgacuuu

SEQ ID NO: 1249566 - RNA, 19 nt, Homo sapiens
uaacuuaucuuugccaaca

SEQ ID NO: 1249567 - RNA, 19 nt, Homo sapiens
cagggaagcgguuaacuua

SEQ ID NO: 1249568 - RNA, 19 nt, Homo sapiens
gggaagcgguuaacuuauc

SEQ ID NO: 1249569 - RNA, 19 nt, Homo sapiens
gaaaguggguauccgaaaa

SEQ ID NO: 1249570 - RNA, 19 nt, Homo sapiens
gggccaacuuccuguauga

SEQ ID NO: 1249571 - RNA, 19 nt, Homo sapiens
gugcagaccuuauguacag

SEQ ID NO: 1249572 - RNA, 19 nt, Homo sapiens
gcgguuaacuuaucuuugc

SEQ ID NO: 1249573 - RNA, 19 nt, Homo sapiens
ggugaaggcugcagcugau

SEQ ID NO: 1249574 - RNA, 19 nt, Homo sapiens
ccucaagccucccguggaa

SEQ ID NO: 1249575 - RNA, 19 nt, Homo sapiens
gagacuguguccugcagaa

SEQ ID NO: 1249576 - RNA, 19 nt, Homo sapiens
ggaagcgguuaacuuaucu

SEQ ID NO: 1249577 - RNA, 19 nt, Homo sapiens
ccagagcgccgacuucaug

SEQ ID NO: 1249578 - RNA, 19 nt, Homo sapiens
ggagcuggcuugggagugu

SEQ ID NO: 1249579 - RNA, 19 nt, Homo sapiens
ucacaggcuuugaaaccaa

SEQ ID NO: 1249580 - RNA, 19 nt, Homo sapiens
uggccgagauggcuaagaa

SEQ ID NO: 1249581 - RNA, 19 nt, Homo sapiens
gaccuuauguacaguucga

SEQ ID NO: 1249582 - RNA, 19 nt, Homo sapiens
ucaguguguuggagaggua

SEQ ID NO: 1249583 - RNA, 19 nt, Homo sapiens
ucacagaccauuacaucga

SEQ ID NO: 1249584 - RNA, 19 nt, Homo sapiens
ugcgggagcuguuugaguu

SEQ ID NO: 1249585 - RNA, 19 nt, Homo sapiens
ccucaagguuggccagaug

SEQ ID NO: 1249586 - RNA, 19 nt, Homo sapiens
ucagagcgauguccagaac

SEQ ID NO: 1249587 - RNA, 19 nt, Homo sapiens
gcuggcagaugcugagagu

SEQ ID NO: 1249588 - RNA, 19 nt, Homo sapiens
gccguacccugcuguagug

SEQ ID NO: 1249589 - RNA, 19 nt, Homo sapiens
cggcauagcccagagcauu

SEQ ID NO: 1249590 - RNA, 19 nt, Homo sapiens
gcccucagcugcagcacau

SEQ ID NO: 1249591 - RNA, 19 nt, Homo sapiens
caaauuccucacaggcuuu

SEQ ID NO: 1249592 - RNA, 19 nt, Homo sapiens
guucacagaccauuacauc

SEQ ID NO: 1249593 - RNA, 19 nt, Homo sapiens
ccgcuacccugagcaaaug

SEQ ID NO: 1249594 - RNA, 19 nt, Homo sapiens
ccagggaagcgguuaacuu

SEQ ID NO: 1249595 - RNA, 19 nt, Homo sapiens
cgaaaguggguauccgaaa

SEQ ID NO: 1249596 - RNA, 19 nt, Homo sapiens
cggcuugugcccagaauuu

SEQ ID NO: 1249597 - RNA, 19 nt, Homo sapiens
uaucuuugccaacauuuga

SEQ ID NO: 1249598 - RNA, 19 nt, Homo sapiens
ggagguggccgugaagauc

SEQ ID NO: 1249599 - RNA, 19 nt, Homo sapiens
acccugagcaaaugacuua

SEQ ID NO: 1249600 - RNA, 19 nt, Homo sapiens
ccagggaccucaaauuccu

SEQ ID NO: 1249601 - RNA, 19 nt, Homo sapiens
gguguggguucgagaccuu

SEQ ID NO: 1249602 - RNA, 19 nt, Homo sapiens
cagaguucacagaccauua

SEQ ID NO: 1249603 - RNA, 19 nt, Homo sapiens
gaccugcggaaccagauuu

SEQ ID NO: 1249604 - RNA, 19 nt, Homo sapiens
ggauugugcagaccuuaug

SEQ ID NO: 1249605 - RNA, 19 nt, Homo sapiens
cuggguggaucccucauga

SEQ ID NO: 1249606 - RNA, 19 nt, Homo sapiens
ccacguggaggcagugaug

SEQ ID NO: 1249607 - RNA, 19 nt, Homo sapiens
gcuuugaaaccaaggcauu

SEQ ID NO: 1249608 - RNA, 19 nt, Homo sapiens
gaaggcugcagcugaugga

SEQ ID NO: 1249609 - RNA, 19 nt, Homo sapiens
caggacaacagcuucauca

SEQ ID NO: 1249610 - RNA, 19 nt, Homo sapiens
caacuucgugcccuagauc

SEQ ID NO: 1249611 - RNA, 19 nt, Homo sapiens
ccaacuucgugcccuagau

SEQ ID NO: 1249612 - RNA, 19 nt, Homo sapiens
uggcagaugcugagaguuc

SEQ ID NO: 1249613 - RNA, 19 nt, Homo sapiens
gcagaccuuauguacaguu

SEQ ID NO: 1249614 - RNA, 19 nt, Homo sapiens
caaaugacuuacgcuccau

SEQ ID NO: 1249615 - RNA, 19 nt, Homo sapiens
gaaucuucaaucggaauaa

SEQ ID NO: 1249616 - RNA, 19 nt, Homo sapiens
ggaccucaaauuccucaca

SEQ ID NO: 1249617 - RNA, 19 nt, Homo sapiens
uaggaguacuggccgagau

SEQ ID NO: 1249618 - RNA, 19 nt, Homo sapiens
gcauagcccagagcauuca

SEQ ID NO: 1249619 - RNA, 19 nt, Homo sapiens
ggaccugcggaaccagauu

SEQ ID NO: 1249620 - RNA, 19 nt, Homo sapiens
ucccagccgugguuaagga

SEQ ID NO: 1249621 - RNA, 19 nt, Homo sapiens
uggaggaggugcccuuugc

SEQ ID NO: 1249622 - RNA, 19 nt, Homo sapiens
guggguauccgaaaacuaa

SEQ ID NO: 1249623 - RNA, 19 nt, Homo sapiens
ggguggaucccucaugaca

SEQ ID NO: 1249624 - RNA, 19 nt, Homo sapiens
gccgggaguuugggacaga

SEQ ID NO: 1249625 - RNA, 19 nt, Homo sapiens
ggugcaagccgggaguuug

SEQ ID NO: 1249626 - RNA, 19 nt, Homo sapiens
gaccagugccagggccuaa

SEQ ID NO: 1249627 - RNA, 19 nt, Homo sapiens
cuuugccgcugccucaauu

SEQ ID NO: 1249628 - RNA, 19 nt, Homo sapiens
acuuaucuuugccaacauu

SEQ ID NO: 1249629 - RNA, 19 nt, Homo sapiens
ugacccugcuggacuuugg

SEQ ID NO: 1249630 - RNA, 19 nt, Homo sapiens
gccaacuuccuguaugaug

SEQ ID NO: 1249631 - RNA, 19 nt, Homo sapiens
uuucaaagacuuggaguuc

SEQ ID NO: 1249632 - RNA, 19 nt, Homo sapiens
ggaguuugggacagaguuc

SEQ ID NO: 1249633 - RNA, 19 nt, Homo sapiens
gcagucagagggugguucu

SEQ ID NO: 1249634 - RNA, 19 nt, Homo sapiens
gggcguggcuugccuguuu

SEQ ID NO: 1249635 - RNA, 19 nt, Homo sapiens
ggagaaugagagacaauua

SEQ ID NO: 1249636 - RNA, 19 nt, Homo sapiens
guaaagagcccggauccaa

SEQ ID NO: 1249637 - RNA, 19 nt, Homo sapiens
aaacugagguccggaacuu

SEQ ID NO: 1249638 - RNA, 19 nt, Homo sapiens
gagaaugagagacaauuau

SEQ ID NO: 1249639 - RNA, 19 nt, Homo sapiens
ccuagucacuccaguugaa

SEQ ID NO: 1249640 - RNA, 19 nt, Homo sapiens
ggucaucuccaaccacuug

SEQ ID NO: 1249641 - RNA, 19 nt, Homo sapiens
cccagaagaugcuccuauu

SEQ ID NO: 1249642 - RNA, 19 nt, Homo sapiens
gcgguucaccugcuugauu

SEQ ID NO: 1249643 - RNA, 19 nt, Homo sapiens
guccgucucucaucucaau

SEQ ID NO: 1249644 - RNA, 19 nt, Homo sapiens
ccgcagucuuccucaagua

SEQ ID NO: 1249645 - RNA, 19 nt, Homo sapiens
ucgccgaagucauggagua

SEQ ID NO: 1249646 - RNA, 19 nt, Homo sapiens
ugauguuacuugccaccua

SEQ ID NO: 1249647 - RNA, 19 nt, Homo sapiens
gcagggagaacgcgaguac

SEQ ID NO: 1249648 - RNA, 19 nt, Homo sapiens
ccagaagaugcuccuauug

SEQ ID NO: 1249649 - RNA, 19 nt, Homo sapiens
aaagagcccggauccaaga

SEQ ID NO: 1249650 - RNA, 19 nt, Homo sapiens
ccacaucgacgcuucuucu

SEQ ID NO: 1249651 - RNA, 19 nt, Homo sapiens
gagcgcggacuccuucuca

SEQ ID NO: 1249652 - RNA, 19 nt, Homo sapiens
cacuuuaucuggcgguuca

SEQ ID NO: 1249653 - RNA, 19 nt, Homo sapiens
gucugagccucccugagua

SEQ ID NO: 1249654 - RNA, 19 nt, Homo sapiens
ccacuugcccugccucagu

SEQ ID NO: 1249655 - RNA, 19 nt, Homo sapiens
cgucucucaucucaauaaa

SEQ ID NO: 1249656 - RNA, 19 nt, Homo sapiens
cagaagaugcuccuauugc

SEQ ID NO: 1249657 - RNA, 19 nt, Homo sapiens
gggucuggcuggugacaca

SEQ ID NO: 1249658 - RNA, 19 nt, Homo sapiens
cgguucaccugcuugauuc

SEQ ID NO: 1249659 - RNA, 19 nt, Homo sapiens
uggaugggguguuccuuua

SEQ ID NO: 1249660 - RNA, 19 nt, Homo sapiens
gcccagaagaugcuccuau

SEQ ID NO: 1249661 - RNA, 19 nt, Homo sapiens
cggcucgggccuaucguua

SEQ ID NO: 1249662 - RNA, 19 nt, Homo sapiens
gcagucuuccucaaguaug

SEQ ID NO: 1249663 - RNA, 19 nt, Homo sapiens
cacuugcccugccucaguu

SEQ ID NO: 1249664 - RNA, 19 nt, Homo sapiens
uuccagggcugagaacgaa

SEQ ID NO: 1249665 - RNA, 19 nt, Homo sapiens
cgaguccuccaucucugua

SEQ ID NO: 1249666 - RNA, 19 nt, Homo sapiens
agucugagccucccugagu

SEQ ID NO: 1249667 - RNA, 19 nt, Homo sapiens
gccgcagucuuccucaagu

SEQ ID NO: 1249668 - RNA, 19 nt, Homo sapiens
gcuggugacacacuuuauc

SEQ ID NO: 1249669 - RNA, 19 nt, Homo sapiens
uggcuggugacacacuuua

SEQ ID NO: 1249670 - RNA, 19 nt, Homo sapiens
gaaacugagguccggaacu

SEQ ID NO: 1249671 - RNA, 19 nt, Homo sapiens
gaacagcccucuaccuaaa

SEQ ID NO: 1249672 - RNA, 19 nt, Homo sapiens
gaaauguucugauugaugu

SEQ ID NO: 1249673 - RNA, 19 nt, Homo sapiens
ccaauuaguuguaagcuuu

SEQ ID NO: 1249674 - RNA, 19 nt, Homo sapiens
guacggaugugcauauaaa

SEQ ID NO: 1249675 - RNA, 19 nt, Homo sapiens
ucacauuacucuggaauua

SEQ ID NO: 1249676 - RNA, 19 nt, Homo sapiens
aaucugaggugguuuauuu

SEQ ID NO: 1249677 - RNA, 19 nt, Homo sapiens
gaauacaucacuuagguua

SEQ ID NO: 1249678 - RNA, 19 nt, Homo sapiens
gcagagcaauggaauucua

SEQ ID NO: 1249679 - RNA, 19 nt, Homo sapiens
caacauggaaaucacauua

SEQ ID NO: 1249680 - RNA, 19 nt, Homo sapiens
uggagaaacugacauuuaa

SEQ ID NO: 1249681 - RNA, 19 nt, Homo sapiens
caagaagccugaccuaaca

SEQ ID NO: 1249682 - RNA, 19 nt, Homo sapiens
gagaugcguuacucagaua

SEQ ID NO: 1249683 - RNA, 19 nt, Homo sapiens
caaacacacucaucauuuc

SEQ ID NO: 1249684 - RNA, 19 nt, Homo sapiens
uaaaguauguugggacaaa

SEQ ID NO: 1249685 - RNA, 19 nt, Homo sapiens
ccaagaagguaaaggagaa

SEQ ID NO: 1249686 - RNA, 19 nt, Homo sapiens
gcaauggaauucuacuuca

SEQ ID NO: 1249687 - RNA, 19 nt, Homo sapiens
gaaauccaccugacuguga

SEQ ID NO: 1249688 - RNA, 19 nt, Homo sapiens
gcaggcagcuacccaccua

SEQ ID NO: 1249689 - RNA, 19 nt, Homo sapiens
gaucagcgccaauuaguug

SEQ ID NO: 1249690 - RNA, 19 nt, Homo sapiens
ccacuugugucaaauaaau

SEQ ID NO: 1249691 - RNA, 19 nt, Homo sapiens
augaugaggucaagaaaua

SEQ ID NO: 1249692 - RNA, 19 nt, Homo sapiens
caaagagacaagacuauuu

SEQ ID NO: 1249693 - RNA, 19 nt, Homo sapiens
gaguggauguuaccgaauu

SEQ ID NO: 1249694 - RNA, 19 nt, Homo sapiens
ccaguaacuuggaucuuaa

SEQ ID NO: 1249695 - RNA, 19 nt, Homo sapiens
gcaaagggagauuccagua

SEQ ID NO: 1249696 - RNA, 19 nt, Homo sapiens
ggacaucauccucaagaaa

SEQ ID NO: 1249697 - RNA, 19 nt, Homo sapiens
ccuaacacguucugaauau

SEQ ID NO: 1249698 - RNA, 19 nt, Homo sapiens
ggagaugcguuacucagau

SEQ ID NO: 1249699 - RNA, 19 nt, Homo sapiens
gaugaggucaagaaauaua

SEQ ID NO: 1249700 - RNA, 19 nt, Homo sapiens
gaaaaucaguugccagaau

SEQ ID NO: 1249701 - RNA, 19 nt, Homo sapiens
gcacccugcugagaucaua

SEQ ID NO: 1249702 - RNA, 19 nt, Homo sapiens
cccaugaacuuuccaagaa

SEQ ID NO: 1249703 - RNA, 19 nt, Homo sapiens
gaagcaguaucgccgagaa

SEQ ID NO: 1249704 - RNA, 19 nt, Homo sapiens
ggaacagcccucuaccuaa

SEQ ID NO: 1249705 - RNA, 19 nt, Homo sapiens
gaauucuacuucacagaga

SEQ ID NO: 1249706 - RNA, 19 nt, Homo sapiens
caagaaauauacagcugau

SEQ ID NO: 1249707 - RNA, 19 nt, Homo sapiens
uaaaguuucuguccaugga

SEQ ID NO: 1249708 - RNA, 19 nt, Homo sapiens
uaaaugaugaggucaagaa

SEQ ID NO: 1249709 - RNA, 19 nt, Homo sapiens
caaauugugcauauggaua

SEQ ID NO: 1249710 - RNA, 19 nt, Homo sapiens
agacacagguuuucauaua

SEQ ID NO: 1249711 - RNA, 19 nt, Homo sapiens
ccagcuaccuccugauguu

SEQ ID NO: 1249712 - RNA, 19 nt, Homo sapiens
gaacuuuccaagaagguaa

SEQ ID NO: 1249713 - RNA, 19 nt, Homo sapiens
acaaacacacucaucauuu

SEQ ID NO: 1249714 - RNA, 19 nt, Homo sapiens
gacaaacacacucaucauu

SEQ ID NO: 1249715 - RNA, 19 nt, Homo sapiens
ggaucagugugguucuuaa

SEQ ID NO: 1249716 - RNA, 19 nt, Homo sapiens
gcacuccucuguggcaaga

SEQ ID NO: 1249717 - RNA, 19 nt, Homo sapiens
auaaggagaaccacaguua

SEQ ID NO: 1249718 - RNA, 19 nt, Homo sapiens
caaagggagauuccaguaa

SEQ ID NO: 1249719 - RNA, 19 nt, Homo sapiens
aaagugcucugcuguauac

SEQ ID NO: 1249720 - RNA, 19 nt, Homo sapiens
ggaugcggaucgaagugua

SEQ ID NO: 1249721 - RNA, 19 nt, Homo sapiens
gcaguuuccuuugacaaga

SEQ ID NO: 1249722 - RNA, 19 nt, Homo sapiens
uaagcugccuuccacuauu

SEQ ID NO: 1249723 - RNA, 19 nt, Homo sapiens
uaagagcccuucuggugau

SEQ ID NO: 1249724 - RNA, 19 nt, Homo sapiens
guucacugauggaauuauu

SEQ ID NO: 1249725 - RNA, 19 nt, Homo sapiens
acaaagugcucugcuguau

SEQ ID NO: 1249726 - RNA, 19 nt, Homo sapiens
gcucugcuguauacacuug

SEQ ID NO: 1249727 - RNA, 19 nt, Homo sapiens
ccauuuagcagaauuacaa

SEQ ID NO: 1249728 - RNA, 19 nt, Homo sapiens
ggacaauagacacagguuu

SEQ ID NO: 1249729 - RNA, 19 nt, Homo sapiens
ccagaccacacaaugaaua

SEQ ID NO: 1249730 - RNA, 19 nt, Homo sapiens
gaccaaaaccugaaaauau

SEQ ID NO: 1249731 - RNA, 19 nt, Homo sapiens
caacuucaccguggacaaa

SEQ ID NO: 1249732 - RNA, 19 nt, Homo sapiens
caaagugcucugcuguaua

SEQ ID NO: 1249733 - RNA, 19 nt, Homo sapiens
gcagcuacccaccuaaaug

SEQ ID NO: 1249734 - RNA, 19 nt, Homo sapiens
aaagagacaagacuauuug

SEQ ID NO: 1249735 - RNA, 19 nt, Homo sapiens
ccaaagggaagagugauaa

SEQ ID NO: 1249736 - RNA, 19 nt, Homo sapiens
uauaauggaguggauguua

SEQ ID NO: 1249737 - RNA, 19 nt, Homo sapiens
cuacccaccuaaaugauga

SEQ ID NO: 1249738 - RNA, 19 nt, Homo sapiens
cugauggaauuauugagua

SEQ ID NO: 1249739 - RNA, 19 nt, Homo sapiens
guauacaguuagaaugugu

SEQ ID NO: 1249740 - RNA, 19 nt, Homo sapiens
caguuaagcuggugucucu

SEQ ID NO: 1249741 - RNA, 19 nt, Homo sapiens
gagaaacugacauuuaagu

SEQ ID NO: 1249742 - RNA, 19 nt, Homo sapiens
gagaaggacaacauggaaa

SEQ ID NO: 1249743 - RNA, 19 nt, Homo sapiens
caaauugaccuuggagaga

SEQ ID NO: 1249744 - RNA, 19 nt, Homo sapiens
gagagccacuacccuagau

SEQ ID NO: 1249745 - RNA, 19 nt, Homo sapiens
gggcauccgugucaagaag

SEQ ID NO: 1249746 - RNA, 19 nt, Homo sapiens
ggacaaacacacucaucau

SEQ ID NO: 1249747 - RNA, 19 nt, Homo sapiens
gaaaagaggaaggagauaa

SEQ ID NO: 1249748 - RNA, 19 nt, Homo sapiens
gacaaagugcucugcugua

SEQ ID NO: 1249749 - RNA, 19 nt, Homo sapiens
cagcuacccaccuaaauga

SEQ ID NO: 1249750 - RNA, 19 nt, Homo sapiens
uaaggagaaccacaguuaa

SEQ ID NO: 1249751 - RNA, 19 nt, Homo sapiens
uggguucacugauggaauu

SEQ ID NO: 1249752 - RNA, 19 nt, Homo sapiens
acacaaagagacaagacua

SEQ ID NO: 1249753 - RNA, 19 nt, Homo sapiens
gauaacaaggcuccacaga

SEQ ID NO: 1249754 - RNA, 19 nt, Homo sapiens
gcuaagcugccuuccacua

SEQ ID NO: 1249755 - RNA, 19 nt, Homo sapiens
uuaaagccaugcagagcaa

SEQ ID NO: 1249756 - RNA, 19 nt, Homo sapiens
ugauucgacuguuuagcua

SEQ ID NO: 1249757 - RNA, 19 nt, Homo sapiens
gaucagugugguucuuaaa

SEQ ID NO: 1249758 - RNA, 19 nt, Homo sapiens
guuguaagcuuuugguauu

SEQ ID NO: 1249759 - RNA, 19 nt, Homo sapiens
gaagugaggaagagugagu

SEQ ID NO: 1249760 - RNA, 19 nt, Homo sapiens
acagagcgcaguuuccuuu

SEQ ID NO: 1249761 - RNA, 19 nt, Homo sapiens
gaccuaacacguucugaau

SEQ ID NO: 1249762 - RNA, 19 nt, Homo sapiens
ccaaugggcauccguguca

SEQ ID NO: 1249763 - RNA, 19 nt, Homo sapiens
agauacagauacaaagaug

SEQ ID NO: 1249764 - RNA, 19 nt, Homo sapiens
uggaacagcccucuaccua

SEQ ID NO: 1249765 - RNA, 19 nt, Homo sapiens
aaagggagauuccaguaac

SEQ ID NO: 1249766 - RNA, 19 nt, Homo sapiens
gaucgaaguguacggaugu

SEQ ID NO: 1249767 - RNA, 19 nt, Homo sapiens
ggagugagagcgggaguga

SEQ ID NO: 1249768 - RNA, 19 nt, Homo sapiens
ucacuuagguuagcaugag

SEQ ID NO: 1249769 - RNA, 19 nt, Homo sapiens
ucacagagaaggacaacau

SEQ ID NO: 1249770 - RNA, 19 nt, Homo sapiens
cagcgccaauuaguuguaa

SEQ ID NO: 1249771 - RNA, 19 nt, Homo sapiens
gaacagagcaggacauuug

SEQ ID NO: 1249772 - RNA, 19 nt, Homo sapiens
gcaacuggcuccucaauga

SEQ ID NO: 1249773 - RNA, 19 nt, Homo sapiens
gaaacaucauccuaacuua

SEQ ID NO: 1249774 - RNA, 19 nt, Homo sapiens
ccaaugagauuuccgcaua

SEQ ID NO: 1249775 - RNA, 19 nt, Homo sapiens
ggacagcucuaaacaguga

SEQ ID NO: 1249776 - RNA, 19 nt, Homo sapiens
cgucaaaucucucauauug

SEQ ID NO: 1249777 - RNA, 19 nt, Homo sapiens
guacggaugugcauauaaa

SEQ ID NO: 1249778 - RNA, 19 nt, Homo sapiens
ucacauuacucuggaauua

SEQ ID NO: 1249779 - RNA, 19 nt, Homo sapiens
aaucugaggugguuuauuu

SEQ ID NO: 1249780 - RNA, 19 nt, Homo sapiens
gaagaaagagccacaguga

SEQ ID NO: 1249781 - RNA, 19 nt, Homo sapiens
ggagggagaugcagagaga

SEQ ID NO: 1249782 - RNA, 19 nt, Homo sapiens
gcagagcaauggaauucua

SEQ ID NO: 1249783 - RNA, 19 nt, Homo sapiens
caacauggaaaucacauua

SEQ ID NO: 1249784 - RNA, 19 nt, Homo sapiens
gcauugauucucaguauua

SEQ ID NO: 1249785 - RNA, 19 nt, Homo sapiens
ggagagcccuugguuaaug

SEQ ID NO: 1249786 - RNA, 19 nt, Homo sapiens
gaggaauaccuuucaguua

SEQ ID NO: 1249787 - RNA, 19 nt, Homo sapiens
ggaaacacuaccauuauuu

SEQ ID NO: 1249788 - RNA, 19 nt, Homo sapiens
caaacacacucaucauuuc

SEQ ID NO: 1249789 - RNA, 19 nt, Homo sapiens
gcaauggaauucuacuuca

SEQ ID NO: 1249790 - RNA, 19 nt, Homo sapiens
gaaauccaccugacuguga

SEQ ID NO: 1249791 - RNA, 19 nt, Homo sapiens
ccacaucaauuuccaaaca

SEQ ID NO: 1249792 - RNA, 19 nt, Homo sapiens
gaaguuugcagauuaggua

SEQ ID NO: 1249793 - RNA, 19 nt, Homo sapiens
aauggaaguuugcagauua

SEQ ID NO: 1249794 - RNA, 19 nt, Homo sapiens
gaauucagcuuccuucaac

SEQ ID NO: 1249795 - RNA, 19 nt, Homo sapiens
ccaaugaaacacacacuua

SEQ ID NO: 1249796 - RNA, 19 nt, Homo sapiens
ccacuugugucaaauaaau

SEQ ID NO: 1249797 - RNA, 19 nt, Homo sapiens
gaacauugguagguaacaa

SEQ ID NO: 1249798 - RNA, 19 nt, Homo sapiens
gcaguggugauauuuauuu

SEQ ID NO: 1249799 - RNA, 19 nt, Homo sapiens
agagagaaauguuaaagga

SEQ ID NO: 1249800 - RNA, 19 nt, Homo sapiens
ggaacugcauugauucuca

SEQ ID NO: 1249801 - RNA, 19 nt, Homo sapiens
caaagggagauuccaguua

SEQ ID NO: 1249802 - RNA, 19 nt, Homo sapiens
acacagaguuauccuuuau

SEQ ID NO: 1249803 - RNA, 19 nt, Homo sapiens
gaguggauguuaccgaauu

SEQ ID NO: 1249804 - RNA, 19 nt, Homo sapiens
ccaguuacuuggaucuuaa

SEQ ID NO: 1249805 - RNA, 19 nt, Homo sapiens
ggaauaccuuucaguuauc

SEQ ID NO: 1249806 - RNA, 19 nt, Homo sapiens
uaugugagcucuuucuaug

SEQ ID NO: 1249807 - RNA, 19 nt, Homo sapiens
aaagugcucugcuguauag

SEQ ID NO: 1249808 - RNA, 19 nt, Homo sapiens
gaacagaacauugguaggu

SEQ ID NO: 1249809 - RNA, 19 nt, Homo sapiens
gagcgagucuucugauugg

SEQ ID NO: 1249810 - RNA, 19 nt, Homo sapiens
agaagaagcuguggucaug

SEQ ID NO: 1249811 - RNA, 19 nt, Homo sapiens
aggaauaccuuucaguuau

SEQ ID NO: 1249812 - RNA, 19 nt, Homo sapiens
gaagcaguaucgccgagaa

SEQ ID NO: 1249813 - RNA, 19 nt, Homo sapiens
gguacaagcuagauagaca

SEQ ID NO: 1249814 - RNA, 19 nt, Homo sapiens
ggaaauguguccuucucau

SEQ ID NO: 1249815 - RNA, 19 nt, Homo sapiens
gaauucuacuucacagaga

SEQ ID NO: 1249816 - RNA, 19 nt, Homo sapiens
cagagaggcuuucuaggau

SEQ ID NO: 1249817 - RNA, 19 nt, Homo sapiens
uaaaggagcgucucuucaa

SEQ ID NO: 1249818 - RNA, 19 nt, Homo sapiens
ggaaugaauggacuaguga

SEQ ID NO: 1249819 - RNA, 19 nt, Homo sapiens
caaaggcucucuuccaaaa

SEQ ID NO: 1249820 - RNA, 19 nt, Homo sapiens
uagcaguggugauauuuau

SEQ ID NO: 1249821 - RNA, 19 nt, Homo sapiens
acacugagcuuccgaacca

SEQ ID NO: 1249822 - RNA, 19 nt, Homo sapiens
ccagcuaccuccugauguu

SEQ ID NO: 1249823 - RNA, 19 nt, Homo sapiens
uggaaacacuaccauuauu

SEQ ID NO: 1249824 - RNA, 19 nt, Homo sapiens
gaaaaugagucaaaagucu

SEQ ID NO: 1249825 - RNA, 19 nt, Homo sapiens
gaagauuaacagagaagaa

SEQ ID NO: 1249826 - RNA, 19 nt, Homo sapiens
caagcuagauagacaucaa

SEQ ID NO: 1249827 - RNA, 19 nt, Homo sapiens
caauggaaguuugcagauu

SEQ ID NO: 1249828 - RNA, 19 nt, Homo sapiens
ucacagauuucaucaggau

SEQ ID NO: 1249829 - RNA, 19 nt, Homo sapiens
acaaacacacucaucauuu

SEQ ID NO: 1249830 - RNA, 19 nt, Homo sapiens
gacaaacacacucaucauu

SEQ ID NO: 1249831 - RNA, 19 nt, Homo sapiens
gggcagagagaaauguuaa

SEQ ID NO: 1249832 - RNA, 19 nt, Homo sapiens
ccgcggagaucagucauuu

SEQ ID NO: 1249833 - RNA, 19 nt, Homo sapiens
ggaugcggaucgaagugua

SEQ ID NO: 1249834 - RNA, 19 nt, Homo sapiens
gaaacacaguccuccacau

SEQ ID NO: 1249835 - RNA, 19 nt, Homo sapiens
uaggacagcucuaaacagu

SEQ ID NO: 1249836 - RNA, 19 nt, Homo sapiens
uaagcugccuuccacuauu

SEQ ID NO: 1249837 - RNA, 19 nt, Homo sapiens
ugagaggucauaucuguuu

SEQ ID NO: 1249838 - RNA, 19 nt, Homo sapiens
gcugucaccuggcugaaga

SEQ ID NO: 1249839 - RNA, 19 nt, Homo sapiens
caacagccagcucuucauu

SEQ ID NO: 1249840 - RNA, 19 nt, Homo sapiens
gaaauguguccuucucaug

SEQ ID NO: 1249841 - RNA, 19 nt, Homo sapiens
gcaaagggagauuccaguu

SEQ ID NO: 1249842 - RNA, 19 nt, Homo sapiens
acaaagugcucugcuguau

SEQ ID NO: 1249843 - RNA, 19 nt, Homo sapiens
ccuggaaacacuaccauua

SEQ ID NO: 1249844 - RNA, 19 nt, Homo sapiens
gguccucugcugauauuua

SEQ ID NO: 1249845 - RNA, 19 nt, Homo sapiens
ugaauuagguauggccauu

SEQ ID NO: 1249846 - RNA, 19 nt, Homo sapiens
ugauagcaguggugauauu

SEQ ID NO: 1249847 - RNA, 19 nt, Homo sapiens
ccagagaaaugaucacacu

SEQ ID NO: 1249848 - RNA, 19 nt, Homo sapiens
gaggggaacugcauugauu

SEQ ID NO: 1249849 - RNA, 19 nt, Homo sapiens
gcucugcuguauagacuug

SEQ ID NO: 1249850 - RNA, 19 nt, Homo sapiens
cagagaaaguuacgcaaag

SEQ ID NO: 1249851 - RNA, 19 nt, Homo sapiens
gaagaaccaaugaaacaca

SEQ ID NO: 1249852 - RNA, 19 nt, Homo sapiens
caacuucaccguggacaaa

SEQ ID NO: 1249853 - RNA, 19 nt, Homo sapiens
caaagugcucugcuguaua

SEQ ID NO: 1249854 - RNA, 19 nt, Homo sapiens
ugaaacaucauccuaacuu

SEQ ID NO: 1249855 - RNA, 19 nt, Homo sapiens
agacgugaaugaaacauca

SEQ ID NO: 1249856 - RNA, 19 nt, Homo sapiens
cuaaauuuaccaccagaua

SEQ ID NO: 1249857 - RNA, 19 nt, Homo sapiens
acagaacauugguagguaa

SEQ ID NO: 1249858 - RNA, 19 nt, Homo sapiens
cacacgaacuccgagcuua

SEQ ID NO: 1249859 - RNA, 19 nt, Homo sapiens
cagcaccuauggacacuug

SEQ ID NO: 1249860 - RNA, 19 nt, Homo sapiens
uauaauggaguggauguua

SEQ ID NO: 1249861 - RNA, 19 nt, Homo sapiens
aaagggagauuccaguuac

SEQ ID NO: 1249862 - RNA, 19 nt, Homo sapiens
gagacguuauuucuuugaa

SEQ ID NO: 1249863 - RNA, 19 nt, Homo sapiens
gcaaagaaaaugagucaaa

SEQ ID NO: 1249864 - RNA, 19 nt, Homo sapiens
ccagcucucucguuucuuc

SEQ ID NO: 1249865 - RNA, 19 nt, Homo sapiens
caaugagauuuccgcauau

SEQ ID NO: 1249866 - RNA, 19 nt, Homo sapiens
gcagucacccacucccuuu

SEQ ID NO: 1249867 - RNA, 19 nt, Homo sapiens
cggaaugaauggacuagug

SEQ ID NO: 1249868 - RNA, 19 nt, Homo sapiens
gagaaggacaacauggaaa

SEQ ID NO: 1249869 - RNA, 19 nt, Homo sapiens
caaauugaccuuggagaga

SEQ ID NO: 1249870 - RNA, 19 nt, Homo sapiens
uacacagaguuauccuuua

SEQ ID NO: 1249871 - RNA, 19 nt, Homo sapiens
gaacagacaugaagauaug

SEQ ID NO: 1249872 - RNA, 19 nt, Homo sapiens
gaaaugagccauguucuau

SEQ ID NO: 1249873 - RNA, 19 nt, Homo sapiens
gcacgagucuccauacauc

SEQ ID NO: 1249874 - RNA, 19 nt, Homo sapiens
ggaggaaucuuuuaccuuu

SEQ ID NO: 1249875 - RNA, 19 nt, Homo sapiens
ccaaggagaaugauuguuu

SEQ ID NO: 1249876 - RNA, 19 nt, Homo sapiens
gcccagaaguuucagacua

SEQ ID NO: 1249877 - RNA, 19 nt, Homo sapiens
agagagagauagagagaaa

SEQ ID NO: 1249878 - RNA, 19 nt, Homo sapiens
gaagauaugguaccgauuc

SEQ ID NO: 1249879 - RNA, 19 nt, Homo sapiens
gauggaaucuuagcucaga

SEQ ID NO: 1249880 - RNA, 19 nt, Homo sapiens
gguguuaagugccaaguga

SEQ ID NO: 1249881 - RNA, 19 nt, Homo sapiens
uagaauguuugcuggguua

SEQ ID NO: 1249882 - RNA, 19 nt, Homo sapiens
gcagugagcugugauugca

SEQ ID NO: 1249883 - RNA, 19 nt, Homo sapiens
caacuaugcuguucauguc

SEQ ID NO: 1249884 - RNA, 19 nt, Homo sapiens
aaugagccauguucuauuu

SEQ ID NO: 1249885 - RNA, 19 nt, Homo sapiens
uaacugacuucuuucacuu

SEQ ID NO: 1249886 - RNA, 19 nt, Homo sapiens
caagcaaucuguuguuucu

SEQ ID NO: 1249887 - RNA, 19 nt, Homo sapiens
ucauaggccuagcacaaua

SEQ ID NO: 1249888 - RNA, 19 nt, Homo sapiens
gcaggugucuuuccagucu

SEQ ID NO: 1249889 - RNA, 19 nt, Homo sapiens
gcaagcagaggguuaaaug

SEQ ID NO: 1249890 - RNA, 19 nt, Homo sapiens
cauguucuauuuaguggua

SEQ ID NO: 1249891 - RNA, 19 nt, Homo sapiens
guucuugccucgaucugua

SEQ ID NO: 1249892 - RNA, 19 nt, Homo sapiens
gcaggucacuaucaaugug

SEQ ID NO: 1249893 - RNA, 19 nt, Homo sapiens
gagauagagagaaacauaa

SEQ ID NO: 1249894 - RNA, 19 nt, Homo sapiens
gcacugggccugagaccuu

SEQ ID NO: 1249895 - RNA, 19 nt, Homo sapiens
aagagaagcuugagagucu

SEQ ID NO: 1249896 - RNA, 19 nt, Homo sapiens
ccaccacgcccgacuaauu

SEQ ID NO: 1249897 - RNA, 19 nt, Homo sapiens
caauagagacccugucaau

SEQ ID NO: 1249898 - RNA, 19 nt, Homo sapiens
gcaacuaugcuguucaugu

SEQ ID NO: 1249899 - RNA, 19 nt, Homo sapiens
gcucauaggccuagcacaa

SEQ ID NO: 1249900 - RNA, 19 nt, Homo sapiens
agagauagagagaaacaua

SEQ ID NO: 1249901 - RNA, 19 nt, Homo sapiens
cagcaguacucuccaagga

SEQ ID NO: 1249902 - RNA, 19 nt, Homo sapiens
gacuguggaugcuggagua

SEQ ID NO: 1249903 - RNA, 19 nt, Homo sapiens
gcccaggacuucagaugga

SEQ ID NO: 1249904 - RNA, 19 nt, Homo sapiens
ccaaagugcugggauuaca

SEQ ID NO: 1249905 - RNA, 19 nt, Homo sapiens
gaagacagaauguagaaac

SEQ ID NO: 1249906 - RNA, 19 nt, Homo sapiens
ggaaguggacccuaguuag

SEQ ID NO: 1249907 - RNA, 19 nt, Homo sapiens
gcagcagccuguagggaau

SEQ ID NO: 1249908 - RNA, 19 nt, Homo sapiens
guaacugacuucuuucacu

SEQ ID NO: 1249909 - RNA, 19 nt, Homo sapiens
caugaucaccaaaguguuu

SEQ ID NO: 1249910 - RNA, 19 nt, Homo sapiens
gaguagaaaugagccaugu

SEQ ID NO: 1249911 - RNA, 19 nt, Homo sapiens
caagaagacagaauguaga

SEQ ID NO: 1249912 - RNA, 19 nt, Homo sapiens
agacuaggcugggcaacaa

SEQ ID NO: 1249913 - RNA, 19 nt, Homo sapiens
ccaccucacuucucaagca

SEQ ID NO: 1249914 - RNA, 19 nt, Homo sapiens
guguagaucuccugaccuu

SEQ ID NO: 1249915 - RNA, 19 nt, Homo sapiens
gcacucagacauccugugu

SEQ ID NO: 1249916 - RNA, 19 nt, Homo sapiens
guagaaaugagccauguuc

SEQ ID NO: 1249917 - RNA, 19 nt, Homo sapiens
agaccgggcuucaccaugu

SEQ ID NO: 1249918 - RNA, 19 nt, Homo sapiens
uagagacccugucaaugga

SEQ ID NO: 1249919 - RNA, 19 nt, Homo sapiens
uagggaauguuaucagugu

SEQ ID NO: 1249920 - RNA, 19 nt, Homo sapiens
ccauacaucaugauuguga

SEQ ID NO: 1249921 - RNA, 19 nt, Homo sapiens
gacucgggcuguuguguau

SEQ ID NO: 1249922 - RNA, 19 nt, Homo sapiens
ucaggcaggucacuaucaa

SEQ ID NO: 1249923 - RNA, 19 nt, Homo sapiens
cagaacagacaugaagaua

SEQ ID NO: 1249924 - RNA, 19 nt, Homo sapiens
guagaucuccugaccuugu

SEQ ID NO: 1249925 - RNA, 19 nt, Homo sapiens
caccacgcccgacuaauuu

SEQ ID NO: 1249926 - RNA, 19 nt, Homo sapiens
gugguggugugcuccuaua

SEQ ID NO: 1249927 - RNA, 19 nt, Homo sapiens
gggcuguuguguauugguu

SEQ ID NO: 1249928 - RNA, 19 nt, Homo sapiens
ccaaucaguugcuuuuaaa

SEQ ID NO: 1249929 - RNA, 19 nt, Homo sapiens
caaggagaaugauuguuuu

SEQ ID NO: 1249930 - RNA, 19 nt, Homo sapiens
gccaaucaguugcuuuuaa

SEQ ID NO: 1249931 - RNA, 19 nt, Homo sapiens
ccgauucccuuggugcuaa

SEQ ID NO: 1249932 - RNA, 19 nt, Homo sapiens
gaauucauaagcucuguuc

SEQ ID NO: 1249933 - RNA, 19 nt, Homo sapiens
uaaaggugaucggcacuca

SEQ ID NO: 1249934 - RNA, 19 nt, Homo sapiens
uaaauucagguguuaagug

SEQ ID NO: 1249935 - RNA, 19 nt, Homo sapiens
gcaagcaaucuguuguuuc

SEQ ID NO: 1249936 - RNA, 19 nt, Homo sapiens
ggugggaucucgccucacu

SEQ ID NO: 1249937 - RNA, 19 nt, Homo sapiens
ugacuucuuucacuuagca

SEQ ID NO: 1249938 - RNA, 19 nt, Homo sapiens
cuccauacaucaugauugu

SEQ ID NO: 1249939 - RNA, 19 nt, Homo sapiens
ccgcuuugcuacaagaaga

SEQ ID NO: 1249940 - RNA, 19 nt, Homo sapiens
uggaguaaguggaauugug

SEQ ID NO: 1249941 - RNA, 19 nt, Homo sapiens
gcuacaagaagacagaaug

SEQ ID NO: 1249942 - RNA, 19 nt, Homo sapiens
ggaggacaugggagaguuu

SEQ ID NO: 1249943 - RNA, 19 nt, Homo sapiens
acucugaaagccuaaauuu

SEQ ID NO: 1249944 - RNA, 19 nt, Homo sapiens
ccagagaaagaaauguuga

SEQ ID NO: 1249945 - RNA, 19 nt, Homo sapiens
ucaagcaggugucuuucca

SEQ ID NO: 1249946 - RNA, 19 nt, Homo sapiens
agacagagagagagauaga

SEQ ID NO: 1249947 - RNA, 19 nt, Homo sapiens
agcaaucuguuguuucuug

SEQ ID NO: 1249948 - RNA, 19 nt, Homo sapiens
ccaaagggagggauuacug

SEQ ID NO: 1249949 - RNA, 19 nt, Homo sapiens
acaagaagacagaauguag

SEQ ID NO: 1249950 - RNA, 19 nt, Homo sapiens
cccagaaguuucagacuag

SEQ ID NO: 1249951 - RNA, 19 nt, Homo sapiens
agagaaacauaaaggugau

SEQ ID NO: 1249952 - RNA, 19 nt, Homo sapiens
agagacagagagagagaua

SEQ ID NO: 1249953 - RNA, 19 nt, Homo sapiens
ggccagccauguguaccua

SEQ ID NO: 1249954 - RNA, 19 nt, Homo sapiens
aguggaauaugagaaguuu

SEQ ID NO: 1249955 - RNA, 19 nt, Homo sapiens
gaccgggcuucaccauguu

SEQ ID NO: 1249956 - RNA, 19 nt, Homo sapiens
gacuucagauggagugcuu

SEQ ID NO: 1249957 - RNA, 19 nt, Homo sapiens
ucaggagggaggaaucuuu

SEQ ID NO: 1249958 - RNA, 19 nt, Homo sapiens
ccuugugacugcuguguug

SEQ ID NO: 1249959 - RNA, 19 nt, Homo sapiens
agagagagacagagagaga

SEQ ID NO: 1249960 - RNA, 19 nt, Homo sapiens
gagucuccauacaucauga

SEQ ID NO: 1249961 - RNA, 19 nt, Homo sapiens
gagccauguucuauuuagu

SEQ ID NO: 1249962 - RNA, 19 nt, Homo sapiens
cugaguagcugggauuaca

SEQ ID NO: 1249963 - RNA, 19 nt, Homo sapiens
uagccaggaugguguagau

SEQ ID NO: 1249964 - RNA, 19 nt, Homo sapiens
gggaauguuaucaguguug

SEQ ID NO: 1249965 - RNA, 19 nt, Homo sapiens
ugagccauguucuauuuag

SEQ ID NO: 1249966 - RNA, 19 nt, Homo sapiens
uuacaggcgugagccacua

SEQ ID NO: 1249967 - RNA, 19 nt, Homo sapiens
caauggagggacacuauca

SEQ ID NO: 1249968 - RNA, 19 nt, Homo sapiens
cagccuguagggaauguua

SEQ ID NO: 1249969 - RNA, 19 nt, Homo sapiens
ugagagagagagagagaga

SEQ ID NO: 1249970 - RNA, 19 nt, Homo sapiens
uggaaguggacccuaguua

SEQ ID NO: 1249971 - RNA, 19 nt, Homo sapiens
uaacagaccacuuccaaua

SEQ ID NO: 1249972 - RNA, 19 nt, Homo sapiens
gagagaagcuucaaaauug

SEQ ID NO: 1249973 - RNA, 19 nt, Homo sapiens
gcaacaacaucuuaacaga

SEQ ID NO: 1249974 - RNA, 19 nt, Homo sapiens
gaacacugcacuaagauuu

SEQ ID NO: 1249975 - RNA, 19 nt, Homo sapiens
gcauaacucuccaucagaa

SEQ ID NO: 1249976 - RNA, 19 nt, Homo sapiens
gggcaaaccuaaacagaga

SEQ ID NO: 1249977 - RNA, 19 nt, Homo sapiens
gcucaugccuguaaucuca

SEQ ID NO: 1249978 - RNA, 19 nt, Homo sapiens
guagagagaucuugauuuu

SEQ ID NO: 1249979 - RNA, 19 nt, Homo sapiens
guuaggaucugaaucaugu

SEQ ID NO: 1249980 - RNA, 19 nt, Homo sapiens
gagaaaucguguucaguau

SEQ ID NO: 1249981 - RNA, 19 nt, Homo sapiens
gaaccgcuaugauguguag

SEQ ID NO: 1249982 - RNA, 19 nt, Homo sapiens
cgagaaaucguguucagua

SEQ ID NO: 1249983 - RNA, 19 nt, Homo sapiens
cagacuggcuaguuuaauu

SEQ ID NO: 1249984 - RNA, 19 nt, Homo sapiens
ugaaucauguucuggguaa

SEQ ID NO: 1249985 - RNA, 19 nt, Homo sapiens
gcacuaagauuugguuugc

SEQ ID NO: 1249986 - RNA, 19 nt, Homo sapiens
aaacuucucucuucuccuu

SEQ ID NO: 1249987 - RNA, 19 nt, Homo sapiens
guggaucacuggaguuuga

SEQ ID NO: 1249988 - RNA, 19 nt, Homo sapiens
gagcagggcgcuucucuug

SEQ ID NO: 1249989 - RNA, 19 nt, Homo sapiens
gcaaauguuccaaagcaaa

SEQ ID NO: 1249990 - RNA, 19 nt, Homo sapiens
aguaggaaaugaaguguuu

SEQ ID NO: 1249991 - RNA, 19 nt, Homo sapiens
ggaaggugcccguguccua

SEQ ID NO: 1249992 - RNA, 19 nt, Homo sapiens
ccuguaaucucagcacuuu

SEQ ID NO: 1249993 - RNA, 19 nt, Homo sapiens
gugaugacuugguauguug

SEQ ID NO: 1249994 - RNA, 19 nt, Homo sapiens
gacaaucagugaauguaca

SEQ ID NO: 1249995 - RNA, 19 nt, Homo sapiens
agacaagaccacaguguuu

SEQ ID NO: 1249996 - RNA, 19 nt, Homo sapiens
cagaaugaaucgugaacau

SEQ ID NO: 1249997 - RNA, 19 nt, Homo sapiens
aagggaaacuucucucuuc

SEQ ID NO: 1249998 - RNA, 19 nt, Homo sapiens
ccagggcggugcuugagaa

SEQ ID NO: 1249999 - RNA, 19 nt, Homo sapiens
cagcagaccugagcagcaa

SEQ ID NO: 1250000 - RNA, 19 nt, Homo sapiens
acaaguuccuggcaaaugu

SEQ ID NO: 1250001 - RNA, 19 nt, Homo sapiens
gagcacuugugucugcauu

SEQ ID NO: 1250002 - RNA, 19 nt, Homo sapiens
gugcauaacucuccaucag

SEQ ID NO: 1250003 - RNA, 19 nt, Homo sapiens
cggcagagcuacccaaacu

SEQ ID NO: 1250004 - RNA, 19 nt, Homo sapiens
gaaaccccaucucuacuaa

SEQ ID NO: 1250005 - RNA, 19 nt, Homo sapiens
gaaaccccaucucuacuaa

SEQ ID NO: 1250006 - RNA, 19 nt, Homo sapiens
cuugguauguuguuuggua

SEQ ID NO: 1250007 - RNA, 19 nt, Homo sapiens
ccuggagucugucaucuga

SEQ ID NO: 1250008 - RNA, 19 nt, Homo sapiens
guacuucgcguccguguca

SEQ ID NO: 1250009 - RNA, 19 nt, Homo sapiens
cgugaacauuaucucaaua

SEQ ID NO: 1250010 - RNA, 19 nt, Homo sapiens
ccucuucugugaugacuug

SEQ ID NO: 1250011 - RNA, 19 nt, Homo sapiens
ccacaacggccuccucuuc

SEQ ID NO: 1250012 - RNA, 19 nt, Homo sapiens
gguagagagaucuugauuu

SEQ ID NO: 1250013 - RNA, 19 nt, Homo sapiens
uggcaaauguuccaaagca

SEQ ID NO: 1250014 - RNA, 19 nt, Homo sapiens
ggagcgaacacugcacuaa

SEQ ID NO: 1250015 - RNA, 19 nt, Homo sapiens
gccgugagcucugggcaaa

SEQ ID NO: 1250016 - RNA, 19 nt, Homo sapiens
caucuuaacagaccacuuc

SEQ ID NO: 1250017 - RNA, 19 nt, Homo sapiens
uaacagagcgagacuccau

SEQ ID NO: 1250018 - RNA, 19 nt, Homo sapiens
ccaacagggucaccaagca

SEQ ID NO: 1250019 - RNA, 19 nt, Homo sapiens
gaagcagagcaccaaggua

SEQ ID NO: 1250020 - RNA, 19 nt, Homo sapiens
gaaggugcccguguccuau

SEQ ID NO: 1250021 - RNA, 19 nt, Homo sapiens
aagcagagcaccaagguau

SEQ ID NO: 1250022 - RNA, 19 nt, Homo sapiens
ggacuggccuaugcaucga

SEQ ID NO: 1250023 - RNA, 19 nt, Homo sapiens
uuaauucccuggcgcagau

SEQ ID NO: 1250024 - RNA, 19 nt, Homo sapiens
ucuauaacaagaccaagua

SEQ ID NO: 1250025 - RNA, 19 nt, Homo sapiens
cuucugugaugacuuggua

SEQ ID NO: 1250026 - RNA, 19 nt, Homo sapiens
acagaccacuuccaauaca

SEQ ID NO: 1250027 - RNA, 19 nt, Homo sapiens
ggucgccaaugccaccaaa

SEQ ID NO: 1250028 - RNA, 19 nt, Homo sapiens
ccuuagcaguucacaaguu

SEQ ID NO: 1250029 - RNA, 19 nt, Homo sapiens
cgucagacuggcuaguuua

SEQ ID NO: 1250030 - RNA, 19 nt, Homo sapiens
ccacagcaguaucagaaac

SEQ ID NO: 1250031 - RNA, 19 nt, Homo sapiens
uaacuuugcccagaauguu

SEQ ID NO: 1250032 - RNA, 19 nt, Homo sapiens
uauguuaggaucugaauca

SEQ ID NO: 1250033 - RNA, 19 nt, Homo sapiens
uugguucccugaccuguuu

SEQ ID NO: 1250034 - RNA, 19 nt, Homo sapiens
ggcaaauguuccaaagcaa

SEQ ID NO: 1250035 - RNA, 19 nt, Homo sapiens
cgagagaagcuucaaaauu

SEQ ID NO: 1250036 - RNA, 19 nt, Homo sapiens
gggcggugcuugagaacgu

SEQ ID NO: 1250037 - RNA, 19 nt, Homo sapiens
cgacuugaccuacgucuac

SEQ ID NO: 1250038 - RNA, 19 nt, Homo sapiens
ugguggaccucucggcuuu

SEQ ID NO: 1250039 - RNA, 19 nt, Homo sapiens
gaaccugggaggcagaagu

SEQ ID NO: 1250040 - RNA, 19 nt, Homo sapiens
guaguuguguguguguguu

SEQ ID NO: 1250041 - RNA, 19 nt, Homo sapiens
cguuguaccuuuccaugug

SEQ ID NO: 1250042 - RNA, 19 nt, Homo sapiens
caaaccagcaagccaggaa

SEQ ID NO: 1250043 - RNA, 19 nt, Homo sapiens
agcgaacacugcacuaaga

SEQ ID NO: 1250044 - RNA, 19 nt, Homo sapiens
gcaggcgaauugcuugaac

SEQ ID NO: 1250045 - RNA, 19 nt, Homo sapiens
ugugaugacuugguauguu

SEQ ID NO: 1250046 - RNA, 19 nt, Homo sapiens
gcuacucggucgccaaugc

SEQ ID NO: 1250047 - RNA, 19 nt, Homo sapiens
cacgccgucuucuuuauga

SEQ ID NO: 1250048 - RNA, 19 nt, Homo sapiens
gagcgaacacugcacuaag

SEQ ID NO: 1250049 - RNA, 19 nt, Homo sapiens
ggaucugaaucauguucug

SEQ ID NO: 1250050 - RNA, 19 nt, Homo sapiens
gccacgccgucuucuuuau

SEQ ID NO: 1250051 - RNA, 19 nt, Homo sapiens
agaaaucguguucaguauu

SEQ ID NO: 1250052 - RNA, 19 nt, Homo sapiens
acagagauggauccaguuu

SEQ ID NO: 1250053 - RNA, 19 nt, Homo sapiens
gcagagcaccaagguauac

SEQ ID NO: 1250054 - RNA, 19 nt, Homo sapiens
cccaggagguggagguuuc

SEQ ID NO: 1250055 - RNA, 19 nt, Homo sapiens
ccuguaaucccagcacuuu

SEQ ID NO: 1250056 - RNA, 19 nt, Homo sapiens
gggaauauuuuguaguugu

SEQ ID NO: 1250057 - RNA, 19 nt, Homo sapiens
cagcggcuucuguaacuuu

SEQ ID NO: 1250058 - RNA, 19 nt, Homo sapiens
gcagcgacuugaccuacgu

SEQ ID NO: 1250059 - RNA, 19 nt, Homo sapiens
auuaugggaugcauuagga

SEQ ID NO: 1250060 - RNA, 19 nt, Homo sapiens
cuuagcaguucacaaguuc

SEQ ID NO: 1250061 - RNA, 19 nt, Homo sapiens
cacaauugcugaaaacaga

SEQ ID NO: 1250062 - RNA, 19 nt, Homo sapiens
gaucacgaggucaggaguu

SEQ ID NO: 1250063 - RNA, 19 nt, Homo sapiens
ucaccgaguugucuuuuga

SEQ ID NO: 1250064 - RNA, 19 nt, Homo sapiens
aagguauacuugucacuca

SEQ ID NO: 1250065 - RNA, 19 nt, Homo sapiens
uaugauguguagaguccaa

SEQ ID NO: 1250066 - RNA, 19 nt, Homo sapiens
uaacaagaccaaguacgau

SEQ ID NO: 1250067 - RNA, 19 nt, Homo sapiens
gagcuacucggucgccaau

SEQ ID NO: 1250068 - RNA, 19 nt, Homo sapiens
ucgugaacauuaucucaau

SEQ ID NO: 1250069 - RNA, 19 nt, Homo sapiens
gcacuugugucugcauucc

SEQ ID NO: 1250070 - RNA, 19 nt, Homo sapiens
agagcuacccaaacucgua

SEQ ID NO: 1250071 - RNA, 19 nt, Homo sapiens
gcaagaguuuccuuuauuu

SEQ ID NO: 1250072 - RNA, 19 nt, Homo sapiens
gagaguugcuguagaagaa

SEQ ID NO: 1250073 - RNA, 19 nt, Homo sapiens
gguaauaacuuugaucaug

SEQ ID NO: 1250074 - RNA, 19 nt, Homo sapiens
ugaagcaccucaagucuuu

SEQ ID NO: 1250075 - RNA, 19 nt, Homo sapiens
gaagaaagcacuggacuga

SEQ ID NO: 1250076 - RNA, 19 nt, Homo sapiens
ugaccaggcuuaagaauau

SEQ ID NO: 1250077 - RNA, 19 nt, Homo sapiens
gaauuaagaggugcuguua

SEQ ID NO: 1250078 - RNA, 19 nt, Homo sapiens
gguagagguuugaauuaaa

SEQ ID NO: 1250079 - RNA, 19 nt, Homo sapiens
ccagaucauuagcuucuua

SEQ ID NO: 1250080 - RNA, 19 nt, Homo sapiens
cauauugcuucccucauua

SEQ ID NO: 1250081 - RNA, 19 nt, Homo sapiens
auuaagaggugcuguuaua

SEQ ID NO: 1250082 - RNA, 19 nt, Homo sapiens
acaaauacuuucucuccua

SEQ ID NO: 1250083 - RNA, 19 nt, Homo sapiens
ggagacauguuguaauucu

SEQ ID NO: 1250084 - RNA, 19 nt, Homo sapiens
ggaaguucauucuguuaau

SEQ ID NO: 1250085 - RNA, 19 nt, Homo sapiens
gaggugcuguuauacauug

SEQ ID NO: 1250086 - RNA, 19 nt, Homo sapiens
ccauauugcuucccucauu

SEQ ID NO: 1250087 - RNA, 19 nt, Homo sapiens
ggacacaauggaaguagua

SEQ ID NO: 1250088 - RNA, 19 nt, Homo sapiens
cuucaggacuuguucuaua

SEQ ID NO: 1250089 - RNA, 19 nt, Homo sapiens
uaauugaccuuuggaaguu

SEQ ID NO: 1250090 - RNA, 19 nt, Homo sapiens
uaggguaggugauacauga

SEQ ID NO: 1250091 - RNA, 19 nt, Homo sapiens
caaauacuuucucuccuau

SEQ ID NO: 1250092 - RNA, 19 nt, Homo sapiens
gagcagagggaaagggaua

SEQ ID NO: 1250093 - RNA, 19 nt, Homo sapiens
uagcaagaguuuccuuuau

SEQ ID NO: 1250094 - RNA, 19 nt, Homo sapiens
ggauggaaaugucaguaau

SEQ ID NO: 1250095 - RNA, 19 nt, Homo sapiens
uugaagaucuuacugaguu

SEQ ID NO: 1250096 - RNA, 19 nt, Homo sapiens
ccuaucagcucacuuguuc

SEQ ID NO: 1250097 - RNA, 19 nt, Homo sapiens
uagcauuacugaucuauag

SEQ ID NO: 1250098 - RNA, 19 nt, Homo sapiens
uggauaguguuacauagua

SEQ ID NO: 1250099 - RNA, 19 nt, Homo sapiens
cccguuauuuggacaauua

SEQ ID NO: 1250100 - RNA, 19 nt, Homo sapiens
caucacaucagguuucuaa

SEQ ID NO: 1250101 - RNA, 19 nt, Homo sapiens
gaaguucauucuguuaauc

SEQ ID NO: 1250102 - RNA, 19 nt, Homo sapiens
uuaccucucuggaucuaua

SEQ ID NO: 1250103 - RNA, 19 nt, Homo sapiens
aggaauagauccacaguuc

SEQ ID NO: 1250104 - RNA, 19 nt, Homo sapiens
ucaaagugcuaaagcuaug

SEQ ID NO: 1250105 - RNA, 19 nt, Homo sapiens
gcacuggacugaguuuuaa

SEQ ID NO: 1250106 - RNA, 19 nt, Homo sapiens
aaagacagaauccuaguuu

SEQ ID NO: 1250107 - RNA, 19 nt, Homo sapiens
gaauauggcaggcucaaca

SEQ ID NO: 1250108 - RNA, 19 nt, Homo sapiens
cauguuaugccuaaacuaa

SEQ ID NO: 1250109 - RNA, 19 nt, Homo sapiens
agaaagcacuggacugagu

SEQ ID NO: 1250110 - RNA, 19 nt, Homo sapiens
uuggagacauguuguaauu

SEQ ID NO: 1250111 - RNA, 19 nt, Homo sapiens
gggaugggauugaagaucu

SEQ ID NO: 1250112 - RNA, 19 nt, Homo sapiens
augcuaaacuuggcaauuu

SEQ ID NO: 1250113 - RNA, 19 nt, Homo sapiens
ggauugaagaucuuacuga

SEQ ID NO: 1250114 - RNA, 19 nt, Homo sapiens
gggcauuuauucuugacaa

SEQ ID NO: 1250115 - RNA, 19 nt, Homo sapiens
ugguagagguuugaauuaa

SEQ ID NO: 1250116 - RNA, 19 nt, Homo sapiens
gacauuuaauugaccuuug

SEQ ID NO: 1250117 - RNA, 19 nt, Homo sapiens
gagccuuuccagaucauua

SEQ ID NO: 1250118 - RNA, 19 nt, Homo sapiens
agcaagaguuuccuuuauu

SEQ ID NO: 1250119 - RNA, 19 nt, Homo sapiens
agaagugugugucaccaaa

SEQ ID NO: 1250120 - RNA, 19 nt, Homo sapiens
uguggacaauauagcauua

SEQ ID NO: 1250121 - RNA, 19 nt, Homo sapiens
ccucaagucuuucucucuu

SEQ ID NO: 1250122 - RNA, 19 nt, Homo sapiens
guacauuuaucccaugcau

SEQ ID NO: 1250123 - RNA, 19 nt, Homo sapiens
gagacaauugggucagaua

SEQ ID NO: 1250124 - RNA, 19 nt, Homo sapiens
uuaaaguccuaaugggaaa

SEQ ID NO: 1250125 - RNA, 19 nt, Homo sapiens
acaauuauguccuggucuu

SEQ ID NO: 1250126 - RNA, 19 nt, Homo sapiens
ggaucuagcuuuugcaaau

SEQ ID NO: 1250127 - RNA, 19 nt, Homo sapiens
gugcugcagugccagguaa

SEQ ID NO: 1250128 - RNA, 19 nt, Homo sapiens
cuggagaguugcuguagaa

SEQ ID NO: 1250129 - RNA, 19 nt, Homo sapiens
gugguagagguuugaauua

SEQ ID NO: 1250130 - RNA, 19 nt, Homo sapiens
uuuaaagugugucgacauu

SEQ ID NO: 1250131 - RNA, 19 nt, Homo sapiens
gguaggugauacaugaguu

SEQ ID NO: 1250132 - RNA, 19 nt, Homo sapiens
acaauugggucagauaauc

SEQ ID NO: 1250133 - RNA, 19 nt, Homo sapiens
gaaagcacuggacugaguu

SEQ ID NO: 1250134 - RNA, 19 nt, Homo sapiens
aaacauugucucuguaguu

SEQ ID NO: 1250135 - RNA, 19 nt, Homo sapiens
ucuaaacauugucucugua

SEQ ID NO: 1250136 - RNA, 19 nt, Homo sapiens
gcgagagacacacaaagaa

SEQ ID NO: 1250137 - RNA, 19 nt, Homo sapiens
ccucaaagacagaauccua

SEQ ID NO: 1250138 - RNA, 19 nt, Homo sapiens
uguacuaccuuauuuagca

SEQ ID NO: 1250139 - RNA, 19 nt, Homo sapiens
gaaagggauaggagaagga

SEQ ID NO: 1250140 - RNA, 19 nt, Homo sapiens
ggauaccccugaauuaaga

SEQ ID NO: 1250141 - RNA, 19 nt, Homo sapiens
gacauguuguaauucugua

SEQ ID NO: 1250142 - RNA, 19 nt, Homo sapiens
uugcuucccucauuaguga

SEQ ID NO: 1250143 - RNA, 19 nt, Homo sapiens
ucucuguaguucaggaaua

SEQ ID NO: 1250144 - RNA, 19 nt, Homo sapiens
caauggagauacggucaga

SEQ ID NO: 1250145 - RNA, 19 nt, Homo sapiens
caauggaaguaguaguugu

SEQ ID NO: 1250146 - RNA, 19 nt, Homo sapiens
cacaguuccucuccagauu

SEQ ID NO: 1250147 - RNA, 19 nt, Homo sapiens
cuacucuccuccuuacuug

SEQ ID NO: 1250148 - RNA, 19 nt, Homo sapiens
ggagaguugcuguagaaga

SEQ ID NO: 1250149 - RNA, 19 nt, Homo sapiens
caucuucauuggauagugu

SEQ ID NO: 1250150 - RNA, 19 nt, Homo sapiens
caggacuuguucuauacua

SEQ ID NO: 1250151 - RNA, 19 nt, Homo sapiens
ugucaguaaugggcacuua

SEQ ID NO: 1250152 - RNA, 19 nt, Homo sapiens
guucuuggauggaaauguc

SEQ ID NO: 1250153 - RNA, 19 nt, Homo sapiens
aaucccagcuuucucugaa

SEQ ID NO: 1250154 - RNA, 19 nt, Homo sapiens
gaucuagcuuuugcaaaua

SEQ ID NO: 1250155 - RNA, 19 nt, Homo sapiens
caagaguuuccuuuauuug

SEQ ID NO: 1250156 - RNA, 19 nt, Homo sapiens
guugacugcucugguguuu

SEQ ID NO: 1250157 - RNA, 19 nt, Homo sapiens
gauggaaaugucaguaaug

SEQ ID NO: 1250158 - RNA, 19 nt, Homo sapiens
ggaugggauugaagaucuu

SEQ ID NO: 1250159 - RNA, 19 nt, Homo sapiens
gggcugcggauuucaggua

SEQ ID NO: 1250160 - RNA, 19 nt, Homo sapiens
ugagacacacugauuaugu

SEQ ID NO: 1250161 - RNA, 19 nt, Homo sapiens
ggaaguaguaguuguugag

SEQ ID NO: 1250162 - RNA, 19 nt, Homo sapiens
uuagcaagaguuuccuuua

SEQ ID NO: 1250163 - RNA, 19 nt, Homo sapiens
uguuaugccuaaacuaaga

SEQ ID NO: 1250164 - RNA, 19 nt, Homo sapiens
ggugauacaugaguuucug

SEQ ID NO: 1250165 - RNA, 19 nt, Homo sapiens
cauuucaucuucauuggau

SEQ ID NO: 1250166 - RNA, 19 nt, Homo sapiens
gauaaucuugguggucuuu

SEQ ID NO: 1250167 - RNA, 19 nt, Homo sapiens
ggagacaauugggucagau

SEQ ID NO: 1250168 - RNA, 19 nt, Homo sapiens
ggcauuuauucuugacaaa

SEQ ID NO: 1250169 - RNA, 19 nt, Homo sapiens
caaagacagaauccuaguu

SEQ ID NO: 1250170 - RNA, 19 nt, Homo sapiens
aaugugaguugugcuugua

SEQ ID NO: 1250171 - RNA, 19 nt, Homo sapiens
gaacgucucucuuccuuaa

SEQ ID NO: 1250172 - RNA, 19 nt, Homo sapiens
ggaaaucucuguuguuguu

SEQ ID NO: 1250173 - RNA, 19 nt, Homo sapiens
ccaccucucuguacaauug

SEQ ID NO: 1250174 - RNA, 19 nt, Homo sapiens
ccacugagaugauaauucu

SEQ ID NO: 1250175 - RNA, 19 nt, Homo sapiens
gguuaaacguuccaccuuu

SEQ ID NO: 1250176 - RNA, 19 nt, Homo sapiens
cagcagguuucucuuugua

SEQ ID NO: 1250177 - RNA, 19 nt, Homo sapiens
gucaacagcacaacuauuu

SEQ ID NO: 1250178 - RNA, 19 nt, Homo sapiens
ucaaaggaauaacaccaaa

SEQ ID NO: 1250179 - RNA, 19 nt, Homo sapiens
uagauacgacugccuauaa

SEQ ID NO: 1250180 - RNA, 19 nt, Homo sapiens
ggacuggaaaucucuguug

SEQ ID NO: 1250181 - RNA, 19 nt, Homo sapiens
caugaacuccuuucucuga

SEQ ID NO: 1250182 - RNA, 19 nt, Homo sapiens
gcagguuucucuuuguagu

SEQ ID NO: 1250183 - RNA, 19 nt, Homo sapiens
gcgagggcaugguuugguu

SEQ ID NO: 1250184 - RNA, 19 nt, Homo sapiens
guucugagcugugcuaugc

SEQ ID NO: 1250185 - RNA, 19 nt, Homo sapiens
gaugauaauucuguucucu

SEQ ID NO: 1250186 - RNA, 19 nt, Homo sapiens
cuggaaaucucuguuguug

SEQ ID NO: 1250187 - RNA, 19 nt, Homo sapiens
gagcugugcuaugcaaaca

SEQ ID NO: 1250188 - RNA, 19 nt, Homo sapiens
gaccaccucucuguacaau

SEQ ID NO: 1250189 - RNA, 19 nt, Homo sapiens
ucagagcaauguccaacug

SEQ ID NO: 1250190 - RNA, 19 nt, Homo sapiens
gaaaugggcaaaaugugua

SEQ ID NO: 1250191 - RNA, 19 nt, Homo sapiens
ccaaaagaaucaacacaga

SEQ ID NO: 1250192 - RNA, 19 nt, Homo sapiens
ggcaugguuugguuccuuu

SEQ ID NO: 1250193 - RNA, 19 nt, Homo sapiens
guagauacgacugccuaua

SEQ ID NO: 1250194 - RNA, 19 nt, Homo sapiens
ugucagugcucaaaggaau

SEQ ID NO: 1250195 - RNA, 19 nt, Homo sapiens
ggacaguaccucacaacag

SEQ ID NO: 1250196 - RNA, 19 nt, Homo sapiens
ggaauaacaccaaaagaau

SEQ ID NO: 1250197 - RNA, 19 nt, Homo sapiens
gagcaauguccaacuguca

SEQ ID NO: 1250198 - RNA, 19 nt, Homo sapiens
gggcaugguuugguuccuu

SEQ ID NO: 1250199 - RNA, 19 nt, Homo sapiens
caacgugucagagcaaugu

SEQ ID NO: 1250200 - RNA, 19 nt, Homo sapiens
gcccaucccugcuccaaac

SEQ ID NO: 1250201 - RNA, 19 nt, Homo sapiens
gacuggaaaucucuguugu

SEQ ID NO: 1250202 - RNA, 19 nt, Homo sapiens
cauggccguuggagguaua

SEQ ID NO: 1250203 - RNA, 19 nt, Homo sapiens
auaauucuguucucuccaa

SEQ ID NO: 1250204 - RNA, 19 nt, Homo sapiens
gcugugcuaugcaaacaag

SEQ ID NO: 1250205 - RNA, 19 nt, Homo sapiens
agauacgacugccuauaau

SEQ ID NO: 1250206 - RNA, 19 nt, Homo sapiens
ccagcagguuucucuuugu

SEQ ID NO: 1250207 - RNA, 19 nt, Homo sapiens
cccagcagguuucucuuug

SEQ ID NO: 1250208 - RNA, 19 nt, Homo sapiens
gcccagcagguuucucuuu

SEQ ID NO: 1250209 - RNA, 19 nt, Homo sapiens
gggaccaccucucuguaca

SEQ ID NO: 1250210 - RNA, 19 nt, Homo sapiens
gagaugauaauucuguucu

SEQ ID NO: 1250211 - RNA, 19 nt, Homo sapiens
ucagagaugccucaguuuc

SEQ ID NO: 1250212 - RNA, 19 nt, Homo sapiens
ggaaggacuggaaaucucu

SEQ ID NO: 1250213 - RNA, 19 nt, Homo sapiens
ucgaacgucucucuuccuu

SEQ ID NO: 1250214 - RNA, 19 nt, Homo sapiens
guuaaacguuccaccuuuu

SEQ ID NO: 1250215 - RNA, 19 nt, Homo sapiens
gguaguggaaggacuggaa

SEQ ID NO: 1250216 - RNA, 19 nt, Homo sapiens
aaaucucuguuguuguuug

SEQ ID NO: 1250217 - RNA, 19 nt, Homo sapiens
gaaauuucgaggccuccuu

SEQ ID NO: 1250218 - RNA, 19 nt, Homo sapiens
ucuguucucuccaaagcaa

SEQ ID NO: 1250219 - RNA, 19 nt, Homo sapiens
acucacaccugcaaaucug

SEQ ID NO: 1250220 - RNA, 19 nt, Homo sapiens
gauguacucacaccugcaa

SEQ ID NO: 1250221 - RNA, 19 nt, Homo sapiens
ggaccaccucucuguacaa

SEQ ID NO: 1250222 - RNA, 19 nt, Homo sapiens
gcauggccguuggagguau

SEQ ID NO: 1250223 - RNA, 19 nt, Homo sapiens
gaaaucucuguuguuguuu

SEQ ID NO: 1250224 - RNA, 19 nt, Homo sapiens
uggaaggacuggaaaucuc

SEQ ID NO: 1250225 - RNA, 19 nt, Homo sapiens
uccuuaagcuuguagauac

SEQ ID NO: 1250226 - RNA, 19 nt, Homo sapiens
caacagcacaacuauuuug

SEQ ID NO: 1250227 - RNA, 19 nt, Homo sapiens
uaauucuguucucuccaaa

SEQ ID NO: 1250228 - RNA, 19 nt, Homo sapiens
gauacgacugccuauaauc

SEQ ID NO: 1250229 - RNA, 19 nt, Homo sapiens
gcauacaaucagugucgaa

SEQ ID NO: 1250230 - RNA, 19 nt, Homo sapiens
agcaugaacuccuuucucu

SEQ ID NO: 1250231 - RNA, 19 nt, Homo sapiens
guacucacaccugcaaauc

SEQ ID NO: 1250232 - RNA, 19 nt, Homo sapiens
ucagugcucaaaggaauaa

SEQ ID NO: 1250233 - RNA, 19 nt, Homo sapiens
guaguggaaggacuggaaa

SEQ ID NO: 1250234 - RNA, 19 nt, Homo sapiens
gcuucaguccuucggagua

SEQ ID NO: 1250235 - RNA, 19 nt, Homo sapiens
ugcaugagcacaguuguuu

SEQ ID NO: 1250236 - RNA, 19 nt, Homo sapiens
acacagaaucucccagaca

SEQ ID NO: 1250237 - RNA, 19 nt, Homo sapiens
ucugagcugugcuaugcaa

SEQ ID NO: 1250238 - RNA, 19 nt, Homo sapiens
gcaugguuugguuccuuua

SEQ ID NO: 1250239 - RNA, 19 nt, Homo sapiens
gacagccaguccaggagau

SEQ ID NO: 1250240 - RNA, 19 nt, Homo sapiens
gagcaucgcgagguuaaac

SEQ ID NO: 1250241 - RNA, 19 nt, Homo sapiens
caaaagaaucaacacagaa

SEQ ID NO: 1250242 - RNA, 19 nt, Homo sapiens
auacgacugccuauaauca

SEQ ID NO: 1250243 - RNA, 19 nt, Homo sapiens
cgaacgucucucuuccuua

SEQ ID NO: 1250244 - RNA, 19 nt, Homo sapiens
cagcuccaccucugaacuu

SEQ ID NO: 1250245 - RNA, 19 nt, Homo sapiens
gaauaacaccaaaagaauc

SEQ ID NO: 1250246 - RNA, 19 nt, Homo sapiens
cuucaguccuucggaguau

SEQ ID NO: 1250247 - RNA, 19 nt, Homo sapiens
gagcaccagccgacacaca

SEQ ID NO: 1250248 - RNA, 19 nt, Homo sapiens
caacugucaggcucucaga

SEQ ID NO: 1250249 - RNA, 19 nt, Homo sapiens
uacaaucagugucgaacgu

SEQ ID NO: 1250250 - RNA, 19 nt, Homo sapiens
uagcuaagcauacaaucag

SEQ ID NO: 1250251 - RNA, 19 nt, Homo sapiens
cgaguucugagcugugcua

SEQ ID NO: 1250252 - RNA, 19 nt, Homo sapiens
guaaucgucaacagcacaa

SEQ ID NO: 1250253 - RNA, 19 nt, Homo sapiens
gcuggagggauguucauag

SEQ ID NO: 1250254 - RNA, 19 nt, Homo sapiens
gggaaaggcuuacacacau

SEQ ID NO: 1250255 - RNA, 19 nt, Homo sapiens
ggaaaggcuuacacacaug

SEQ ID NO: 1250256 - RNA, 19 nt, Homo sapiens
caaccaggccuccaucaaa

SEQ ID NO: 1250257 - RNA, 19 nt, Homo sapiens
gaaucgaguuaaauuguag

SEQ ID NO: 1250258 - RNA, 19 nt, Homo sapiens
gacagaaucgaguuaaauu

SEQ ID NO: 1250259 - RNA, 19 nt, Homo sapiens
gaucugggcacuguacuuu

SEQ ID NO: 1250260 - RNA, 19 nt, Homo sapiens
guucauccauguauuucaa

SEQ ID NO: 1250261 - RNA, 19 nt, Homo sapiens
gcggagaucugggcacugu

SEQ ID NO: 1250262 - RNA, 19 nt, Homo sapiens
gcaggagaaucacuugaac

SEQ ID NO: 1250263 - RNA, 19 nt, Homo sapiens
gucaagagaucaagaccau

SEQ ID NO: 1250264 - RNA, 19 nt, Homo sapiens
gugacagaaucgaguuaaa

SEQ ID NO: 1250265 - RNA, 19 nt, Homo sapiens
gcccacaggugcuaaagag

SEQ ID NO: 1250266 - RNA, 19 nt, Homo sapiens
gaaaggcuuacacacaugu

SEQ ID NO: 1250267 - RNA, 19 nt, Homo sapiens
gcucccgccuguaauccua

SEQ ID NO: 1250268 - RNA, 19 nt, Homo sapiens
cgacuucugugugcuuaga

SEQ ID NO: 1250269 - RNA, 19 nt, Homo sapiens
ggcaguggccggugauuga

SEQ ID NO: 1250270 - RNA, 19 nt, Homo sapiens
ucucuuggccuuugugaaa

SEQ ID NO: 1250271 - RNA, 19 nt, Homo sapiens
cuucaggccuuuguaaguu

SEQ ID NO: 1250272 - RNA, 19 nt, Homo sapiens
cagaaucgaguuaaauugu

SEQ ID NO: 1250273 - RNA, 19 nt, Homo sapiens
ggcaauuggugacagaauc

SEQ ID NO: 1250274 - RNA, 19 nt, Homo sapiens
agaguggccucgagucaga

SEQ ID NO: 1250275 - RNA, 19 nt, Homo sapiens
ccuguaaucucagcuacuu

SEQ ID NO: 1250276 - RNA, 19 nt, Homo sapiens
gaggaaucguuuucucuuu

SEQ ID NO: 1250277 - RNA, 19 nt, Homo sapiens
gcaaccaggccuccaucaa

SEQ ID NO: 1250278 - RNA, 19 nt, Homo sapiens
gaagcguucuguggguaga

SEQ ID NO: 1250279 - RNA, 19 nt, Homo sapiens
agacuguuaugaguaugua

SEQ ID NO: 1250280 - RNA, 19 nt, Homo sapiens
gaguuaaauuguaggacau

SEQ ID NO: 1250281 - RNA, 19 nt, Homo sapiens
ugacagaaucgaguuaaau

SEQ ID NO: 1250282 - RNA, 19 nt, Homo sapiens
ggaaucguuuucucuuuga

SEQ ID NO: 1250283 - RNA, 19 nt, Homo sapiens
ggagggaaaggcuuacaca

SEQ ID NO: 1250284 - RNA, 19 nt, Homo sapiens
uuucacagccgguucauau

SEQ ID NO: 1250285 - RNA, 19 nt, Homo sapiens
ggugguucauccauguauu

SEQ ID NO: 1250286 - RNA, 19 nt, Homo sapiens
ggagcaaucaggagagaca

SEQ ID NO: 1250287 - RNA, 19 nt, Homo sapiens
ggagagcccacaggugcua

SEQ ID NO: 1250288 - RNA, 19 nt, Homo sapiens
ggcaggagaaucacuugaa

SEQ ID NO: 1250289 - RNA, 19 nt, Homo sapiens
ccuguaauccuagcacuuu

SEQ ID NO: 1250290 - RNA, 19 nt, Homo sapiens
guggguagaggaaucguuu

SEQ ID NO: 1250291 - RNA, 19 nt, Homo sapiens
uugagacuguuaugaguau

SEQ ID NO: 1250292 - RNA, 19 nt, Homo sapiens
gaucacacggucaagagau

SEQ ID NO: 1250293 - RNA, 19 nt, Homo sapiens
gugguucauccauguauuu

SEQ ID NO: 1250294 - RNA, 19 nt, Homo sapiens
ucaaaacccugcaugagau

SEQ ID NO: 1250295 - RNA, 19 nt, Homo sapiens
ggugacagaaucgaguuaa

SEQ ID NO: 1250296 - RNA, 19 nt, Homo sapiens
ucugggcacuguacuuuag

SEQ ID NO: 1250297 - RNA, 19 nt, Homo sapiens
agagagcaguacccugaug

SEQ ID NO: 1250298 - RNA, 19 nt, Homo sapiens
gcacuagcuccgggcaauu

SEQ ID NO: 1250299 - RNA, 19 nt, Homo sapiens
gcgugcgccuguaaucuca

SEQ ID NO: 1250300 - RNA, 19 nt, Homo sapiens
ggagaucugggcacuguac

SEQ ID NO: 1250301 - RNA, 19 nt, Homo sapiens
gcaguggccggugauugaa

SEQ ID NO: 1250302 - RNA, 19 nt, Homo sapiens
guucauauggucccgacuu

SEQ ID NO: 1250303 - RNA, 19 nt, Homo sapiens
cugcugguguucugcaaga

SEQ ID NO: 1250304 - RNA, 19 nt, Homo sapiens
acagaaucgaguuaaauug

SEQ ID NO: 1250305 - RNA, 19 nt, Homo sapiens
cgucuucaggccuuuguaa

SEQ ID NO: 1250306 - RNA, 19 nt, Homo sapiens
ggaucacacggucaagaga

SEQ ID NO: 1250307 - RNA, 19 nt, Homo sapiens
ggucauuccuccgcaacca

SEQ ID NO: 1250308 - RNA, 19 nt, Homo sapiens
gggcggaucacacggucaa

SEQ ID NO: 1250309 - RNA, 19 nt, Homo sapiens
ucacagccgguucauaugg

SEQ ID NO: 1250310 - RNA, 19 nt, Homo sapiens
gagacuguuaugaguaugu

SEQ ID NO: 1250311 - RNA, 19 nt, Homo sapiens
cgugcgcggugaggaagua

SEQ ID NO: 1250312 - RNA, 19 nt, Homo sapiens
gcaauuggugacagaaucg

SEQ ID NO: 1250313 - RNA, 19 nt, Homo sapiens
guguggagggaaaggcuua

SEQ ID NO: 1250314 - RNA, 19 nt, Homo sapiens
uguaggacaucgcguuggu

SEQ ID NO: 1250315 - RNA, 19 nt, Homo sapiens
gggcaggagaaucacuuga

SEQ ID NO: 1250316 - RNA, 19 nt, Homo sapiens
cauauggucccgacuucug

SEQ ID NO: 1250317 - RNA, 19 nt, Homo sapiens
acaucgcguuggugucuga

SEQ ID NO: 1250318 - RNA, 19 nt, Homo sapiens
ggagaaagauuuagcuguu

SEQ ID NO: 1250319 - RNA, 19 nt, Homo sapiens
gaaauucgaugucaguaug

SEQ ID NO: 1250320 - RNA, 19 nt, Homo sapiens
ccacagauguuauggauau

SEQ ID NO: 1250321 - RNA, 19 nt, Homo sapiens
gcagguggcuuugucauuu

SEQ ID NO: 1250322 - RNA, 19 nt, Homo sapiens
gcagugagcuuauguucau

SEQ ID NO: 1250323 - RNA, 19 nt, Homo sapiens
uaaagaaaguccuucaaga

SEQ ID NO: 1250324 - RNA, 19 nt, Homo sapiens
ggaaaucgcauucuucaug

SEQ ID NO: 1250325 - RNA, 19 nt, Homo sapiens
caaauuauguguacaaggu

SEQ ID NO: 1250326 - RNA, 19 nt, Homo sapiens
gaaaucgcauucuucaugu

SEQ ID NO: 1250327 - RNA, 19 nt, Homo sapiens
ugaaauggcuaaagaaagu

SEQ ID NO: 1250328 - RNA, 19 nt, Homo sapiens
gaaaggagcuagguaugca

SEQ ID NO: 1250329 - RNA, 19 nt, Homo sapiens
cgacauccaucacuuucua

SEQ ID NO: 1250330 - RNA, 19 nt, Homo sapiens
gugcagcccuccucuauga

SEQ ID NO: 1250331 - RNA, 19 nt, Homo sapiens
gcgcaugccuguaaucuca

SEQ ID NO: 1250332 - RNA, 19 nt, Homo sapiens
ggaguucacuucacaccaa

SEQ ID NO: 1250333 - RNA, 19 nt, Homo sapiens
guauugaaauggcuaaaga

SEQ ID NO: 1250334 - RNA, 19 nt, Homo sapiens
gguaugcacuguaaucuuc

SEQ ID NO: 1250335 - RNA, 19 nt, Homo sapiens
gcuauugauuguccacaua

SEQ ID NO: 1250336 - RNA, 19 nt, Homo sapiens
gagaaaggccuccagaaug

SEQ ID NO: 1250337 - RNA, 19 nt, Homo sapiens
gcagguggcucugucuuga

SEQ ID NO: 1250338 - RNA, 19 nt, Homo sapiens
gugcaggacuuuacucaga

SEQ ID NO: 1250339 - RNA, 19 nt, Homo sapiens
gggcccagcuggaguaaga

SEQ ID NO: 1250340 - RNA, 19 nt, Homo sapiens
gagaggaaauucgauguca

SEQ ID NO: 1250341 - RNA, 19 nt, Homo sapiens
gauugcagaugaaguacaa

SEQ ID NO: 1250342 - RNA, 19 nt, Homo sapiens
gagauuaccugcuuuugaa

SEQ ID NO: 1250343 - RNA, 19 nt, Homo sapiens
aaagaaaguccuucaagaa

SEQ ID NO: 1250344 - RNA, 19 nt, Homo sapiens
gcagaugaaguacaacaaa

SEQ ID NO: 1250345 - RNA, 19 nt, Homo sapiens
ccagauagccgguuuccuu

SEQ ID NO: 1250346 - RNA, 19 nt, Homo sapiens
uaacaguggugucauacau

SEQ ID NO: 1250347 - RNA, 19 nt, Homo sapiens
aaagauaaccacugcauug

SEQ ID NO: 1250348 - RNA, 19 nt, Homo sapiens
agaaaggccuccagaaugg

SEQ ID NO: 1250349 - RNA, 19 nt, Homo sapiens
acauaacaguggugucaua

SEQ ID NO: 1250350 - RNA, 19 nt, Homo sapiens
gcucugucuugaccaauuu

SEQ ID NO: 1250351 - RNA, 19 nt, Homo sapiens
ucuaauggcuauugauugu

SEQ ID NO: 1250352 - RNA, 19 nt, Homo sapiens
gaaagccaaauuaugugua

SEQ ID NO: 1250353 - RNA, 19 nt, Homo sapiens
ugucauacauaguggaauu

SEQ ID NO: 1250354 - RNA, 19 nt, Homo sapiens
gauuguagcccaggaguuu

SEQ ID NO: 1250355 - RNA, 19 nt, Homo sapiens
caagaaguauagauggaau

SEQ ID NO: 1250356 - RNA, 19 nt, Homo sapiens
ggaaaaggagaaagauuua

SEQ ID NO: 1250357 - RNA, 19 nt, Homo sapiens
caaggcagguagauuguag

SEQ ID NO: 1250358 - RNA, 19 nt, Homo sapiens
uaaugcaguucuugccuuu

SEQ ID NO: 1250359 - RNA, 19 nt, Homo sapiens
gagaaagauuuagcuguuc

SEQ ID NO: 1250360 - RNA, 19 nt, Homo sapiens
gaugauagagcaagaucuu

SEQ ID NO: 1250361 - RNA, 19 nt, Homo sapiens
gcugagagcugagauugca

SEQ ID NO: 1250362 - RNA, 19 nt, Homo sapiens
ugccagcgcugcguuauuu

SEQ ID NO: 1250363 - RNA, 19 nt, Homo sapiens
aauaguggcuugauuaaac

SEQ ID NO: 1250364 - RNA, 19 nt, Homo sapiens
uuacagacccuuugacuuc

SEQ ID NO: 1250365 - RNA, 19 nt, Homo sapiens
gcacucauccugcgacauc

SEQ ID NO: 1250366 - RNA, 19 nt, Homo sapiens
gcaacaagaauguacuaau

SEQ ID NO: 1250367 - RNA, 19 nt, Homo sapiens
gcaggagaaucaauugaac

SEQ ID NO: 1250368 - RNA, 19 nt, Homo sapiens
caccagcucauuugauaua

SEQ ID NO: 1250369 - RNA, 19 nt, Homo sapiens
guauagauggaaugcaaua

SEQ ID NO: 1250370 - RNA, 19 nt, Homo sapiens
ugacagagcaagaaaauaa

SEQ ID NO: 1250371 - RNA, 19 nt, Homo sapiens
gcacuguaaucuucauguc

SEQ ID NO: 1250372 - RNA, 19 nt, Homo sapiens
ggaaauucgaugucaguau

SEQ ID NO: 1250373 - RNA, 19 nt, Homo sapiens
ggucuaauggcuauugauu

SEQ ID NO: 1250374 - RNA, 19 nt, Homo sapiens
gugcaacagugaaguaucu

SEQ ID NO: 1250375 - RNA, 19 nt, Homo sapiens
caucguugguggcggaauu

SEQ ID NO: 1250376 - RNA, 19 nt, Homo sapiens
ggaguuacugaaauguaua

SEQ ID NO: 1250377 - RNA, 19 nt, Homo sapiens
gaauacaaagggagaggaa

SEQ ID NO: 1250378 - RNA, 19 nt, Homo sapiens
gaacagccugggcaacaug

SEQ ID NO: 1250379 - RNA, 19 nt, Homo sapiens
agcaccagcucauuugaua

SEQ ID NO: 1250380 - RNA, 19 nt, Homo sapiens
aaguauagauggaaugcaa

SEQ ID NO: 1250381 - RNA, 19 nt, Homo sapiens
ugagaaaggccuccagaau

SEQ ID NO: 1250382 - RNA, 19 nt, Homo sapiens
uaugaguacugucagcaaa

SEQ ID NO: 1250383 - RNA, 19 nt, Homo sapiens
aaggauggauggcaguauu

SEQ ID NO: 1250384 - RNA, 19 nt, Homo sapiens
agaaggagccauauuguag

SEQ ID NO: 1250385 - RNA, 19 nt, Homo sapiens
ucugaaagccaaauuaugu

SEQ ID NO: 1250386 - RNA, 19 nt, Homo sapiens
agacggaggugagcugaga

SEQ ID NO: 1250387 - RNA, 19 nt, Homo sapiens
ugcaauuucuggaaugauu

SEQ ID NO: 1250388 - RNA, 19 nt, Homo sapiens
gcugcuacuucuuccauug

SEQ ID NO: 1250389 - RNA, 19 nt, Homo sapiens
uaaacgagaggguuacaga

SEQ ID NO: 1250390 - RNA, 19 nt, Homo sapiens
ggucccagauagccgguuu

SEQ ID NO: 1250391 - RNA, 19 nt, Homo sapiens
agaagaaauucccagacuu

SEQ ID NO: 1250392 - RNA, 19 nt, Homo sapiens
agaaagauuuagcuguuca

SEQ ID NO: 1250393 - RNA, 19 nt, Homo sapiens
gagaacagccugggcaaca

SEQ ID NO: 1250394 - RNA, 19 nt, Homo sapiens
ggagcuagguaugcacugu

SEQ ID NO: 1250395 - RNA, 19 nt, Homo sapiens
cagaugaaguacaacaaag

SEQ ID NO: 1250396 - RNA, 19 nt, Homo sapiens
auggaaaucugguagaaga

SEQ ID NO: 1250397 - RNA, 19 nt, Homo sapiens
uggaguuacugaaauguau

SEQ ID NO: 1250398 - RNA, 19 nt, Homo sapiens
gaccguauuucagaguuga

SEQ ID NO: 1250399 - RNA, 19 nt, Homo sapiens
ccuauggaguuacugaaau

SEQ ID NO: 1250400 - RNA, 19 nt, Homo sapiens
augcaguucuugccuuuaa

SEQ ID NO: 1250401 - RNA, 19 nt, Homo sapiens
ccuaggaguucacuucaca

SEQ ID NO: 1250402 - RNA, 19 nt, Homo sapiens
caaagauaaccacugcauu

SEQ ID NO: 1250403 - RNA, 19 nt, Homo sapiens
aaugauugcagaugaagua

SEQ ID NO: 1250404 - RNA, 19 nt, Homo sapiens
cuauggaguuacugaaaug

SEQ ID NO: 1250405 - RNA, 19 nt, Homo sapiens
ugacuucagugccacagau

SEQ ID NO: 1250406 - RNA, 19 nt, Homo sapiens
auacuggcauuguggacua

SEQ ID NO: 1250407 - RNA, 19 nt, Homo sapiens
gauauuggaaaucgcauuc

SEQ ID NO: 1250408 - RNA, 19 nt, Homo sapiens
aagaaggagccauauugua

SEQ ID NO: 1250409 - RNA, 19 nt, Homo sapiens
aagaagaaauucccagacu

SEQ ID NO: 1250410 - RNA, 19 nt, Homo sapiens
ggcaggagaaucaauugaa

SEQ ID NO: 1250411 - RNA, 19 nt, Homo sapiens
gagcuagguaugcacugua

SEQ ID NO: 1250412 - RNA, 19 nt, Homo sapiens
gaugaaguacaacaaagau

SEQ ID NO: 1250413 - RNA, 19 nt, Homo sapiens
cagauagccgguuuccuuu

SEQ ID NO: 1250414 - RNA, 19 nt, Homo sapiens
gacuucaggcccuauauga

SEQ ID NO: 1250415 - RNA, 19 nt, Homo sapiens
gguuccagcuccucaguag

SEQ ID NO: 1250416 - RNA, 19 nt, Homo sapiens
cagcucauuugauauaguc

SEQ ID NO: 1250417 - RNA, 19 nt, Homo sapiens
uggaaugauugcagaugaa

SEQ ID NO: 1250418 - RNA, 19 nt, Homo sapiens
caacuuucccuuccucuuu

SEQ ID NO: 1250419 - RNA, 19 nt, Homo sapiens
gagaagggcaagugcaaga

SEQ ID NO: 1250420 - RNA, 19 nt, Homo sapiens
gcaagggccugagcugaag

SEQ ID NO: 1250421 - RNA, 19 nt, Homo sapiens
gagcaacgcagcuacaaag

SEQ ID NO: 1250422 - RNA, 19 nt, Homo sapiens
ccaguuuccugcacuuguu

SEQ ID NO: 1250423 - RNA, 19 nt, Homo sapiens
ggccgaccauguaugugua

SEQ ID NO: 1250424 - RNA, 19 nt, Homo sapiens
gcgcugcucaccugucuuu

SEQ ID NO: 1250425 - RNA, 19 nt, Homo sapiens
gcuuggcucuuuccugugu

SEQ ID NO: 1250426 - RNA, 19 nt, Homo sapiens
gggaauaccaccgcuucua

SEQ ID NO: 1250427 - RNA, 19 nt, Homo sapiens
ggaauaccaccgcuucuac

SEQ ID NO: 1250428 - RNA, 19 nt, Homo sapiens
gcaacgcagcuacaaagug

SEQ ID NO: 1250429 - RNA, 19 nt, Homo sapiens
ggagcaacgcagcuacaaa

SEQ ID NO: 1250430 - RNA, 19 nt, Homo sapiens
ggagauccccagcuuagua

SEQ ID NO: 1250431 - RNA, 19 nt, Homo sapiens
ggagcuugcccugcaguaa

SEQ ID NO: 1250432 - RNA, 19 nt, Homo sapiens
gcacgcgcuuggcucuuuc

SEQ ID NO: 1250433 - RNA, 19 nt, Homo sapiens
gcaguaagccccaacuuuc

SEQ ID NO: 1250434 - RNA, 19 nt, Homo sapiens
gagcggagcaacgcagcua

SEQ ID NO: 1250435 - RNA, 19 nt, Homo sapiens
gcaagugcaagacggaauc

SEQ ID NO: 1250436 - RNA, 19 nt, Homo sapiens
gggagaagggcaagugcaa

SEQ ID NO: 1250437 - RNA, 19 nt, Homo sapiens
gagcuugcccugcaguaag

SEQ ID NO: 1250438 - RNA, 19 nt, Homo sapiens
ggcgaaacccugucucuac

SEQ ID NO: 1250439 - RNA, 19 nt, Homo sapiens
cgacggagauccccagcuu

SEQ ID NO: 1250440 - RNA, 19 nt, Homo sapiens
acuuguuucucucgcuuua

SEQ ID NO: 1250441 - RNA, 19 nt, Homo sapiens
uuguuucucucgcuuuauu

SEQ ID NO: 1250442 - RNA, 19 nt, Homo sapiens
gggccgaccauguaugugu

SEQ ID NO: 1250443 - RNA, 19 nt, Homo sapiens
gagaccagccuaggcaaca

SEQ ID NO: 1250444 - RNA, 19 nt, Homo sapiens
ugcacgcgcuuggcucuuu

SEQ ID NO: 1250445 - RNA, 19 nt, Homo sapiens
gagcccaggagaccagguu

SEQ ID NO: 1250446 - RNA, 19 nt, Homo sapiens
ggacgugggauggaagaag

SEQ ID NO: 1250447 - RNA, 19 nt, Homo sapiens
uggaggacgugggauggaa

SEQ ID NO: 1250448 - RNA, 19 nt, Homo sapiens
gaaacacauugcauucaua

SEQ ID NO: 1250449 - RNA, 19 nt, Homo sapiens
ggugaaaucuugcaaguug

SEQ ID NO: 1250450 - RNA, 19 nt, Homo sapiens
ggucugacuuuccguaaua

SEQ ID NO: 1250451 - RNA, 19 nt, Homo sapiens
ggacaucuaucguauucuu

SEQ ID NO: 1250452 - RNA, 19 nt, Homo sapiens
ugaccuggcucccuaagua

SEQ ID NO: 1250453 - RNA, 19 nt, Homo sapiens
gaggacaucuaucguauuc

SEQ ID NO: 1250454 - RNA, 19 nt, Homo sapiens
gaaaucagaugggaccaau

SEQ ID NO: 1250455 - RNA, 19 nt, Homo sapiens
caaaugcuacucucuuuaa

SEQ ID NO: 1250456 - RNA, 19 nt, Homo sapiens
augcagagcccuacaauua

SEQ ID NO: 1250457 - RNA, 19 nt, Homo sapiens
gcaccuccuuuccugauaa

SEQ ID NO: 1250458 - RNA, 19 nt, Homo sapiens
ggccugagguucuguauuc

SEQ ID NO: 1250459 - RNA, 19 nt, Homo sapiens
gaaggagagcugucacuuu

SEQ ID NO: 1250460 - RNA, 19 nt, Homo sapiens
cagauuaccuggcuagugu

SEQ ID NO: 1250461 - RNA, 19 nt, Homo sapiens
gcagaaggcccgagacaug

SEQ ID NO: 1250462 - RNA, 19 nt, Homo sapiens
aaggagagcugucacuuug

SEQ ID NO: 1250463 - RNA, 19 nt, Homo sapiens
aaacacuucuuccaacuga

SEQ ID NO: 1250464 - RNA, 19 nt, Homo sapiens
gcacauccuucaacacaca

SEQ ID NO: 1250465 - RNA, 19 nt, Homo sapiens
gcagagcccuacaauuaag

SEQ ID NO: 1250466 - RNA, 19 nt, Homo sapiens
ggcccuagaugauuuauuc

SEQ ID NO: 1250467 - RNA, 19 nt, Homo sapiens
gagcagaaccaaacacuuc

SEQ ID NO: 1250468 - RNA, 19 nt, Homo sapiens
gccaaucagugaacccuuu

SEQ ID NO: 1250469 - RNA, 19 nt, Homo sapiens
gaaagucucccacgaguac

SEQ ID NO: 1250470 - RNA, 19 nt, Homo sapiens
gcauacacaucccgucaug

SEQ ID NO: 1250471 - RNA, 19 nt, Homo sapiens
ggaccaggcuacagugaca

SEQ ID NO: 1250472 - RNA, 19 nt, Homo sapiens
gaggugaaaucuugcaagu

SEQ ID NO: 1250473 - RNA, 19 nt, Homo sapiens
gcggcugagugacuucuua

SEQ ID NO: 1250474 - RNA, 19 nt, Homo sapiens
caguagaggugauuaaugg

SEQ ID NO: 1250475 - RNA, 19 nt, Homo sapiens
ccaaaacccuagcucuuua

SEQ ID NO: 1250476 - RNA, 19 nt, Homo sapiens
cugagucucugcuugauaa

SEQ ID NO: 1250477 - RNA, 19 nt, Homo sapiens
cgagguuucucucagcuuu

SEQ ID NO: 1250478 - RNA, 19 nt, Homo sapiens
gcaguuauuuggguaagga

SEQ ID NO: 1250479 - RNA, 19 nt, Homo sapiens
ggacugagcagaaccaaac

SEQ ID NO: 1250480 - RNA, 19 nt, Homo sapiens
cuugauaagugccucuaua

SEQ ID NO: 1250481 - RNA, 19 nt, Homo sapiens
gaagaacuacaacaagugu

SEQ ID NO: 1250482 - RNA, 19 nt, Homo sapiens
gagaagugcggcugaguga

SEQ ID NO: 1250483 - RNA, 19 nt, Homo sapiens
cgaaacacauugcauucau

SEQ ID NO: 1250484 - RNA, 19 nt, Homo sapiens
ccuagaugauuuauucuug

SEQ ID NO: 1250485 - RNA, 19 nt, Homo sapiens
aacggaaucugcccuauga

SEQ ID NO: 1250486 - RNA, 19 nt, Homo sapiens
ccaaaugcuacucucuuua

SEQ ID NO: 1250487 - RNA, 19 nt, Homo sapiens
caacaccaaccaaaugcua

SEQ ID NO: 1250488 - RNA, 19 nt, Homo sapiens
ccacgaagaacuacaacaa

SEQ ID NO: 1250489 - RNA, 19 nt, Homo sapiens
aaagaacuaugucauggau

SEQ ID NO: 1250490 - RNA, 19 nt, Homo sapiens
aaucagaugggaccaauuu

SEQ ID NO: 1250491 - RNA, 19 nt, Homo sapiens
ccaaagugcugggauuaca

SEQ ID NO: 1250492 - RNA, 19 nt, Homo sapiens
gaggauuagugcccuugaa

SEQ ID NO: 1250493 - RNA, 19 nt, Homo sapiens
caacaggacugagcagaac

SEQ ID NO: 1250494 - RNA, 19 nt, Homo sapiens
gcucuuuacccuuccauuu

SEQ ID NO: 1250495 - RNA, 19 nt, Homo sapiens
gaaguucagccgcuugaug

SEQ ID NO: 1250496 - RNA, 19 nt, Homo sapiens
agaacuaugucauggauca

SEQ ID NO: 1250497 - RNA, 19 nt, Homo sapiens
uggaucugcuaguaaauaa

SEQ ID NO: 1250498 - RNA, 19 nt, Homo sapiens
gggcuggcaucucucuuug

SEQ ID NO: 1250499 - RNA, 19 nt, Homo sapiens
guacaguagaggugauuaa

SEQ ID NO: 1250500 - RNA, 19 nt, Homo sapiens
gaugaaccauagcaugcuu

SEQ ID NO: 1250501 - RNA, 19 nt, Homo sapiens
cugagugacuucuuacuau

SEQ ID NO: 1250502 - RNA, 19 nt, Homo sapiens
gcaaugcugugagagagau

SEQ ID NO: 1250503 - RNA, 19 nt, Homo sapiens
ggggagaggugaaaucuug

SEQ ID NO: 1250504 - RNA, 19 nt, Homo sapiens
gaaggacacgcuugcacaa

SEQ ID NO: 1250505 - RNA, 19 nt, Homo sapiens
gauaagugccucuauacca

SEQ ID NO: 1250506 - RNA, 19 nt, Homo sapiens
caccugggauuugcuauug

SEQ ID NO: 1250507 - RNA, 19 nt, Homo sapiens
ccuuggaucugcuaguaaa

SEQ ID NO: 1250508 - RNA, 19 nt, Homo sapiens
uaccuuggaucugcuagua

SEQ ID NO: 1250509 - RNA, 19 nt, Homo sapiens
ggacacgcuugcacaaacu

SEQ ID NO: 1250510 - RNA, 19 nt, Homo sapiens
gcugagugacuucuuacua

SEQ ID NO: 1250511 - RNA, 19 nt, Homo sapiens
gaaccaaacacuucuucca

SEQ ID NO: 1250512 - RNA, 19 nt, Homo sapiens
ucucuuagaugcacuuucu

SEQ ID NO: 1250513 - RNA, 19 nt, Homo sapiens
gcaaagggccacaacucau

SEQ ID NO: 1250514 - RNA, 19 nt, Homo sapiens
cagguuugcuggccauaga

SEQ ID NO: 1250515 - RNA, 19 nt, Homo sapiens
aaugaaugguguucccuuu

SEQ ID NO: 1250516 - RNA, 19 nt, Homo sapiens
auaagugccucuauaccaa

SEQ ID NO: 1250517 - RNA, 19 nt, Homo sapiens
cauaaaggcaggcccaaug

SEQ ID NO: 1250518 - RNA, 19 nt, Homo sapiens
acaaguguuuccuguaugu

SEQ ID NO: 1250519 - RNA, 19 nt, Homo sapiens
cagcaacaccaaccaaaug

SEQ ID NO: 1250520 - RNA, 19 nt, Homo sapiens
gagcaaagggccacaacuc

SEQ ID NO: 1250521 - RNA, 19 nt, Homo sapiens
ugagugacuucuuacuaug

SEQ ID NO: 1250522 - RNA, 19 nt, Homo sapiens
guucugugccaacaucaua

SEQ ID NO: 1250523 - RNA, 19 nt, Homo sapiens
ugaaaucuugcaaguugua

SEQ ID NO: 1250524 - RNA, 19 nt, Homo sapiens
accaaaugcuacucucuuu

SEQ ID NO: 1250525 - RNA, 19 nt, Homo sapiens
ccacccagcuuccacaaaa

SEQ ID NO: 1250526 - RNA, 19 nt, Homo sapiens
acgaagaacuacaacaagu

SEQ ID NO: 1250527 - RNA, 19 nt, Homo sapiens
ggaaggagagcugucacuu

SEQ ID NO: 1250528 - RNA, 19 nt, Homo sapiens
ccaaacacuucuuccaacu

SEQ ID NO: 1250529 - RNA, 19 nt, Homo sapiens
gacuuuccguaauaugauu

SEQ ID NO: 1250530 - RNA, 19 nt, Homo sapiens
gcaagcuguuucccuagca

SEQ ID NO: 1250531 - RNA, 19 nt, Homo sapiens
gagccaccaugccagacuu

SEQ ID NO: 1250532 - RNA, 19 nt, Homo sapiens
cagcacauccuucaacaca

SEQ ID NO: 1250533 - RNA, 19 nt, Homo sapiens
aggagaaacugcagaagca

SEQ ID NO: 1250534 - RNA, 19 nt, Homo sapiens
acucugcggugguguuuga

SEQ ID NO: 1250535 - RNA, 19 nt, Homo sapiens
caaacggaaucugcccuau

SEQ ID NO: 1250536 - RNA, 19 nt, Homo sapiens
aggcuccacucccaaauga

SEQ ID NO: 1250537 - RNA, 19 nt, Homo sapiens
gaagaguucuccccaaaac

SEQ ID NO: 1250538 - RNA, 19 nt, Homo sapiens
gaauuucagggaagaguuc

SEQ ID NO: 1250539 - RNA, 19 nt, Homo sapiens
caaagggccacaacucauc

SEQ ID NO: 1250540 - RNA, 19 nt, Homo sapiens
gcugauugcacaagcugua

SEQ ID NO: 1250541 - RNA, 19 nt, Homo sapiens
uagacgggcuuauggaucu

SEQ ID NO: 1250542 - RNA, 19 nt, Homo sapiens
gaugggaccaauuuagugu

SEQ ID NO: 1250543 - RNA, 19 nt, Homo sapiens
caugaauuaugcggcuaua

SEQ ID NO: 1250544 - RNA, 19 nt, Homo sapiens
uguccuggcuggucucgaa

SEQ ID NO: 1250545 - RNA, 19 nt, Homo sapiens
ggaaaagaacuaugucaug

SEQ ID NO: 1250546 - RNA, 19 nt, Homo sapiens
cuaauaggcaggcaguuau

SEQ ID NO: 1250547 - RNA, 19 nt, Homo sapiens
acuaauaggcaggcaguua

SEQ ID NO: 1250548 - RNA, 19 nt, Homo sapiens
ucacgcagaucacgcagua

SEQ ID NO: 1250549 - RNA, 19 nt, Homo sapiens
agaacaagaucccgaagga

SEQ ID NO: 1250550 - RNA, 19 nt, Homo sapiens
gcaccaugaucuccaccaa

SEQ ID NO: 1250551 - RNA, 19 nt, Homo sapiens
ggaggaggacgaagaggaa

SEQ ID NO: 1250552 - RNA, 19 nt, Homo sapiens
ccaaggagaagaacaagau

SEQ ID NO: 1250553 - RNA, 19 nt, Homo sapiens
uuaccacacucccuucuuc

SEQ ID NO: 1250554 - RNA, 19 nt, Homo sapiens
gagggcuacuuccgcaaga

SEQ ID NO: 1250555 - RNA, 19 nt, Homo sapiens
ccaccaaggagaagaacaa

SEQ ID NO: 1250556 - RNA, 19 nt, Homo sapiens
caucguauccuuguacuuc

SEQ ID NO: 1250557 - RNA, 19 nt, Homo sapiens
ggagcugaccgaccucuuc

SEQ ID NO: 1250558 - RNA, 19 nt, Homo sapiens
ggaagaggaggaggaggaa

SEQ ID NO: 1250559 - RNA, 19 nt, Homo sapiens
ggaagaggaggaggacgaa

SEQ ID NO: 1250560 - RNA, 19 nt, Homo sapiens
gagaacauggugaccuuca

SEQ ID NO: 1250561 - RNA, 19 nt, Homo sapiens
gagcugaccgaccucuuca

SEQ ID NO: 1250562 - RNA, 19 nt, Homo sapiens
gcugcaacuucaacuccuu

SEQ ID NO: 1250563 - RNA, 19 nt, Homo sapiens
aggagaacauggugaccuu

SEQ ID NO: 1250564 - RNA, 19 nt, Homo sapiens
gcuccgacuccucgcagua

SEQ ID NO: 1250565 - RNA, 19 nt, Homo sapiens
ucguggagcugcccauagu

SEQ ID NO: 1250566 - RNA, 19 nt, Homo sapiens
ugacgcuucugcccugcuu

SEQ ID NO: 1250567 - RNA, 19 nt, Homo sapiens
ccgagggcauguuguacug

SEQ ID NO: 1250568 - RNA, 19 nt, Homo sapiens
ggccacgacucgguuuauc

SEQ ID NO: 1250569 - RNA, 19 nt, Homo sapiens
cuucuuccaucguauccuu

SEQ ID NO: 1250570 - RNA, 19 nt, Homo sapiens
aagaggaggaggaggaaga

SEQ ID NO: 1250571 - RNA, 19 nt, Homo sapiens
aagaggaggaggacgaaga

SEQ ID NO: 1250572 - RNA, 19 nt, Homo sapiens
ugaagcccauccuggucuu

SEQ ID NO: 1250573 - RNA, 19 nt, Homo sapiens
ggccacggguuaccacacu

SEQ ID NO: 1250574 - RNA, 19 nt, Homo sapiens
cauccuggucuucgccuuu

SEQ ID NO: 1250575 - RNA, 19 nt, Homo sapiens
guacuucaacucggucauc

SEQ ID NO: 1250576 - RNA, 19 nt, Homo sapiens
gaacaaggcucaggaauug

SEQ ID NO: 1250577 - RNA, 19 nt, Homo sapiens
gcagagagcuaaagcacua

SEQ ID NO: 1250578 - RNA, 19 nt, Homo sapiens
gaagagacauucaaauaca

SEQ ID NO: 1250579 - RNA, 19 nt, Homo sapiens
gaucuacuguuucuacuuu

SEQ ID NO: 1250580 - RNA, 19 nt, Homo sapiens
ggaaacaaauguccagaug

SEQ ID NO: 1250581 - RNA, 19 nt, Homo sapiens
ggaauugauuggugucuuu

SEQ ID NO: 1250582 - RNA, 19 nt, Homo sapiens
cgugagaucugguuguuua

SEQ ID NO: 1250583 - RNA, 19 nt, Homo sapiens
gcaguacuguuuguaauaa

SEQ ID NO: 1250584 - RNA, 19 nt, Homo sapiens
gaaaauaccuucagcacuu

SEQ ID NO: 1250585 - RNA, 19 nt, Homo sapiens
gcaauaacagaacuacuua

SEQ ID NO: 1250586 - RNA, 19 nt, Homo sapiens
ggacauacaguugcaaaua

SEQ ID NO: 1250587 - RNA, 19 nt, Homo sapiens
gaaaggagccagggaguaa

SEQ ID NO: 1250588 - RNA, 19 nt, Homo sapiens
gaaacccugucucuacuaa

SEQ ID NO: 1250589 - RNA, 19 nt, Homo sapiens
gauaacaucaucccacuuu

SEQ ID NO: 1250590 - RNA, 19 nt, Homo sapiens
gagccaagaucaugccauu

SEQ ID NO: 1250591 - RNA, 19 nt, Homo sapiens
gaauuggaaggccuuauua

SEQ ID NO: 1250592 - RNA, 19 nt, Homo sapiens
cugcagaaauacacaaaua

SEQ ID NO: 1250593 - RNA, 19 nt, Homo sapiens
ggguauugcuuaauucuga

SEQ ID NO: 1250594 - RNA, 19 nt, Homo sapiens
gaaggaagagaaucauuau

SEQ ID NO: 1250595 - RNA, 19 nt, Homo sapiens
ugaaggaagagaaucauua

SEQ ID NO: 1250596 - RNA, 19 nt, Homo sapiens
gugaauccauugaaacuga

SEQ ID NO: 1250597 - RNA, 19 nt, Homo sapiens
cuaaagcacuaaucaaauc

SEQ ID NO: 1250598 - RNA, 19 nt, Homo sapiens
gcagaacuguggaccaauc

SEQ ID NO: 1250599 - RNA, 19 nt, Homo sapiens
gaaaguucuucacuaaugg

SEQ ID NO: 1250600 - RNA, 19 nt, Homo sapiens
ggaccaaucaaaccucuuu

SEQ ID NO: 1250601 - RNA, 19 nt, Homo sapiens
ggaauuggaaggccuuauu

SEQ ID NO: 1250602 - RNA, 19 nt, Homo sapiens
gaacuguggaccaaucaaa

SEQ ID NO: 1250603 - RNA, 19 nt, Homo sapiens
ccaaacaccugccucucuu

SEQ ID NO: 1250604 - RNA, 19 nt, Homo sapiens
ccacacaauuccuucuuug

SEQ ID NO: 1250605 - RNA, 19 nt, Homo sapiens
ucaaagagacaucccauga

SEQ ID NO: 1250606 - RNA, 19 nt, Homo sapiens
gaagaauugagugucauua

SEQ ID NO: 1250607 - RNA, 19 nt, Homo sapiens
aaacaaaggcagagagcua

SEQ ID NO: 1250608 - RNA, 19 nt, Homo sapiens
gaaggucgcagcaguuuua

SEQ ID NO: 1250609 - RNA, 19 nt, Homo sapiens
cuuauuaucucagcuauug

SEQ ID NO: 1250610 - RNA, 19 nt, Homo sapiens
gcaaauacucacugcaaga

SEQ ID NO: 1250611 - RNA, 19 nt, Homo sapiens
ggaaggccuuauuaucuca

SEQ ID NO: 1250612 - RNA, 19 nt, Homo sapiens
aaagagacaucccaugagu

SEQ ID NO: 1250613 - RNA, 19 nt, Homo sapiens
gagaacaaccugaccaaca

SEQ ID NO: 1250614 - RNA, 19 nt, Homo sapiens
gacauacaguugcaaauac

SEQ ID NO: 1250615 - RNA, 19 nt, Homo sapiens
gcagaaauacacaaauaca

SEQ ID NO: 1250616 - RNA, 19 nt, Homo sapiens
gucaguccuucauguaaua

SEQ ID NO: 1250617 - RNA, 19 nt, Homo sapiens
ggucaguccuucauguaau

SEQ ID NO: 1250618 - RNA, 19 nt, Homo sapiens
gcacuuagaagagacauuc

SEQ ID NO: 1250619 - RNA, 19 nt, Homo sapiens
agaauugagugucauuaug

SEQ ID NO: 1250620 - RNA, 19 nt, Homo sapiens
ccagauuguucggaaagua

SEQ ID NO: 1250621 - RNA, 19 nt, Homo sapiens
ggcagugaaugaccugaaa

SEQ ID NO: 1250622 - RNA, 19 nt, Homo sapiens
gaaugaaagaaucaaguug

SEQ ID NO: 1250623 - RNA, 19 nt, Homo sapiens
cgaaggaguuagcaucauc

SEQ ID NO: 1250624 - RNA, 19 nt, Homo sapiens
gcagaaccaagaaucuaaa

SEQ ID NO: 1250625 - RNA, 19 nt, Homo sapiens
gaaguguucuuuuagaguu

SEQ ID NO: 1250626 - RNA, 19 nt, Homo sapiens
caacaccgccuucccaaca

SEQ ID NO: 1250627 - RNA, 19 nt, Homo sapiens
gaugccagccucauaguug

SEQ ID NO: 1250628 - RNA, 19 nt, Homo sapiens
aagcacagaccacaaauga

SEQ ID NO: 1250629 - RNA, 19 nt, Homo sapiens
gcagugagccaagaucaug

SEQ ID NO: 1250630 - RNA, 19 nt, Homo sapiens
gcuaaagcacuaaucaaau

SEQ ID NO: 1250631 - RNA, 19 nt, Homo sapiens
gaggucucccuguuucuua

SEQ ID NO: 1250632 - RNA, 19 nt, Homo sapiens
ggaagaauugagugucauu

SEQ ID NO: 1250633 - RNA, 19 nt, Homo sapiens
gcaggagaaucacuagaac

SEQ ID NO: 1250634 - RNA, 19 nt, Homo sapiens
agaacaaccugaccaacau

SEQ ID NO: 1250635 - RNA, 19 nt, Homo sapiens
uaaagacucagcaacgauu

SEQ ID NO: 1250636 - RNA, 19 nt, Homo sapiens
aaacaccucuuucccaaac

SEQ ID NO: 1250637 - RNA, 19 nt, Homo sapiens
caaauacucacugcaagaa

SEQ ID NO: 1250638 - RNA, 19 nt, Homo sapiens
gaucccaaauucagagaca

SEQ ID NO: 1250639 - RNA, 19 nt, Homo sapiens
gagaaucauuaucuuacuc

SEQ ID NO: 1250640 - RNA, 19 nt, Homo sapiens
ggauaagccuagacugaac

SEQ ID NO: 1250641 - RNA, 19 nt, Homo sapiens
gaaggagaaauuaaagcuu

SEQ ID NO: 1250642 - RNA, 19 nt, Homo sapiens
gucugaagcucgagaacaa

SEQ ID NO: 1250643 - RNA, 19 nt, Homo sapiens
aaaacaggcuucagaaaga

SEQ ID NO: 1250644 - RNA, 19 nt, Homo sapiens
caagaggaguccggccauu

SEQ ID NO: 1250645 - RNA, 19 nt, Homo sapiens
ucauguggguauugcuuaa

SEQ ID NO: 1250646 - RNA, 19 nt, Homo sapiens
ggaucugugucccuaacaa

SEQ ID NO: 1250647 - RNA, 19 nt, Homo sapiens
uuucauaaccguucaguug

SEQ ID NO: 1250648 - RNA, 19 nt, Homo sapiens
agagaugaaaggcauauuu

SEQ ID NO: 1250649 - RNA, 19 nt, Homo sapiens
ucucagcuauugucccaaa

SEQ ID NO: 1250650 - RNA, 19 nt, Homo sapiens
ggaaaacccagucucaaaa

SEQ ID NO: 1250651 - RNA, 19 nt, Homo sapiens
uuaccacgcuucacaugga

SEQ ID NO: 1250652 - RNA, 19 nt, Homo sapiens
caauaaguaucuuguucuc

SEQ ID NO: 1250653 - RNA, 19 nt, Homo sapiens
caagggagaugugauagcu

SEQ ID NO: 1250654 - RNA, 19 nt, Homo sapiens
agaacaaggcucaggaauu

SEQ ID NO: 1250655 - RNA, 19 nt, Homo sapiens
ggcaggagaaucacuagaa

SEQ ID NO: 1250656 - RNA, 19 nt, Homo sapiens
gaacaaccugaccaacaug

SEQ ID NO: 1250657 - RNA, 19 nt, Homo sapiens
gagcuaaagcacuaaucaa

SEQ ID NO: 1250658 - RNA, 19 nt, Homo sapiens
gaacuacuuagcacuucaa

SEQ ID NO: 1250659 - RNA, 19 nt, Homo sapiens
aagaucagcuugcucuaca

SEQ ID NO: 1250660 - RNA, 19 nt, Homo sapiens
gagaucugguuguuuaaaa

SEQ ID NO: 1250661 - RNA, 19 nt, Homo sapiens
gaucugugucccuaacaaa

SEQ ID NO: 1250662 - RNA, 19 nt, Homo sapiens
cuacuuagcacuucaaggu

SEQ ID NO: 1250663 - RNA, 19 nt, Homo sapiens
guuaagggacauacaguug

SEQ ID NO: 1250664 - RNA, 19 nt, Homo sapiens
uacaugcuguguucuguga

SEQ ID NO: 1250665 - RNA, 19 nt, Homo sapiens
guggaguucucacgaagga

SEQ ID NO: 1250666 - RNA, 19 nt, Homo sapiens
cucaagaugugaaggaaga

SEQ ID NO: 1250667 - RNA, 19 nt, Homo sapiens
ccucugaauuucuguaucu

SEQ ID NO: 1250668 - RNA, 19 nt, Homo sapiens
gaagcacagaccacaaaug

SEQ ID NO: 1250669 - RNA, 19 nt, Homo sapiens
caagaacaaggcucaggaa

SEQ ID NO: 1250670 - RNA, 19 nt, Homo sapiens
aaacaucuccuucccaaac

SEQ ID NO: 1250671 - RNA, 19 nt, Homo sapiens
uaagggacauacaguugca

SEQ ID NO: 1250672 - RNA, 19 nt, Homo sapiens
guaucugcaucuuaacaau

SEQ ID NO: 1250673 - RNA, 19 nt, Homo sapiens
agaggaguccggccauuaa

SEQ ID NO: 1250674 - RNA, 19 nt, Homo sapiens
ucuggugaauccauugaaa

SEQ ID NO: 1250675 - RNA, 19 nt, Homo sapiens
agacacagauugggucagu

SEQ ID NO: 1250676 - RNA, 19 nt, Homo sapiens
gaacggaguugcuucuaua

SEQ ID NO: 1250677 - RNA, 19 nt, Homo sapiens
ggagugcucuugauugaaa

SEQ ID NO: 1250678 - RNA, 19 nt, Homo sapiens
gcaaaguuauuccuuagaa

SEQ ID NO: 1250679 - RNA, 19 nt, Homo sapiens
caagcaaaguuauuccuua

SEQ ID NO: 1250680 - RNA, 19 nt, Homo sapiens
caacacagaucccauguag

SEQ ID NO: 1250681 - RNA, 19 nt, Homo sapiens
ggaaagauccugggaagaa

SEQ ID NO: 1250682 - RNA, 19 nt, Homo sapiens
gcauggaguuggugcuuaa

SEQ ID NO: 1250683 - RNA, 19 nt, Homo sapiens
aaacagaaagggaaagaua

SEQ ID NO: 1250684 - RNA, 19 nt, Homo sapiens
gaaguugaguucagguuca

SEQ ID NO: 1250685 - RNA, 19 nt, Homo sapiens
ggacaguuauacuuuagug

SEQ ID NO: 1250686 - RNA, 19 nt, Homo sapiens
acacagaucccauguaguu

SEQ ID NO: 1250687 - RNA, 19 nt, Homo sapiens
ggaguugcuucuauaaaca

SEQ ID NO: 1250688 - RNA, 19 nt, Homo sapiens
gaagggaaguugaguucag

SEQ ID NO: 1250689 - RNA, 19 nt, Homo sapiens
ccaaaggccacauacauga

SEQ ID NO: 1250690 - RNA, 19 nt, Homo sapiens
ccaguggcguugcgcauuu

SEQ ID NO: 1250691 - RNA, 19 nt, Homo sapiens
gcuuaaaugugaguugauu

SEQ ID NO: 1250692 - RNA, 19 nt, Homo sapiens
gaaagauccugggaagaag

SEQ ID NO: 1250693 - RNA, 19 nt, Homo sapiens
uaagggacaguuauacuuu

SEQ ID NO: 1250694 - RNA, 19 nt, Homo sapiens
gcagucagcaggguuguuu

SEQ ID NO: 1250695 - RNA, 19 nt, Homo sapiens
gcucuugauugaaacagaa

SEQ ID NO: 1250696 - RNA, 19 nt, Homo sapiens
aagggacaguuauacuuua

SEQ ID NO: 1250697 - RNA, 19 nt, Homo sapiens
gagaaccaaaggccacaua

SEQ ID NO: 1250698 - RNA, 19 nt, Homo sapiens
gagcaaggaggacaugaug

SEQ ID NO: 1250699 - RNA, 19 nt, Homo sapiens
ggauuaucaagcaaaguua

SEQ ID NO: 1250700 - RNA, 19 nt, Homo sapiens
gugcuuaaaugugaguuga

SEQ ID NO: 1250701 - RNA, 19 nt, Homo sapiens
gcguguuccuugcuaugua

SEQ ID NO: 1250702 - RNA, 19 nt, Homo sapiens
gauaacaaccagccguuuc

SEQ ID NO: 1250703 - RNA, 19 nt, Homo sapiens
aaggaaaguugcccaagga

SEQ ID NO: 1250704 - RNA, 19 nt, Homo sapiens
ucucgucauuucauuauug

SEQ ID NO: 1250705 - RNA, 19 nt, Homo sapiens
gaaccaaaggccacauaca

SEQ ID NO: 1250706 - RNA, 19 nt, Homo sapiens
ggaguuggugcuuaaaugu

SEQ ID NO: 1250707 - RNA, 19 nt, Homo sapiens
ugguugcuguagauuauua

SEQ ID NO: 1250708 - RNA, 19 nt, Homo sapiens
cuggagugcucuugauuga

SEQ ID NO: 1250709 - RNA, 19 nt, Homo sapiens
gcaggguuguuugagacua

SEQ ID NO: 1250710 - RNA, 19 nt, Homo sapiens
ucagcaggguuguuugaga

SEQ ID NO: 1250711 - RNA, 19 nt, Homo sapiens
acaacaacccgccuucuga

SEQ ID NO: 1250712 - RNA, 19 nt, Homo sapiens
ccgcaccccuuuagauuua

SEQ ID NO: 1250713 - RNA, 19 nt, Homo sapiens
gaaagggaaagauaacaac

SEQ ID NO: 1250714 - RNA, 19 nt, Homo sapiens
aagcaaaguuauuccuuag

SEQ ID NO: 1250715 - RNA, 19 nt, Homo sapiens
gcucuggagugcucuugau

SEQ ID NO: 1250716 - RNA, 19 nt, Homo sapiens
gguugucucugauucuugu

SEQ ID NO: 1250717 - RNA, 19 nt, Homo sapiens
cggaguugcuucuauaaac

SEQ ID NO: 1250718 - RNA, 19 nt, Homo sapiens
uggaguuggugcuuaaaug

SEQ ID NO: 1250719 - RNA, 19 nt, Homo sapiens
gaccugaucccgccacauc

SEQ ID NO: 1250720 - RNA, 19 nt, Homo sapiens
uuucacagauuaccucauc

SEQ ID NO: 1250721 - RNA, 19 nt, Homo sapiens
cccuuuagauuuacggaaa

SEQ ID NO: 1250722 - RNA, 19 nt, Homo sapiens
ccauguaguuggagaacca

SEQ ID NO: 1250723 - RNA, 19 nt, Homo sapiens
caggguuguuugagacuau

SEQ ID NO: 1250724 - RNA, 19 nt, Homo sapiens
gaugcuaggaggaggaaga

SEQ ID NO: 1250725 - RNA, 19 nt, Homo sapiens
gacaacaacccgccuucug

SEQ ID NO: 1250726 - RNA, 19 nt, Homo sapiens
agaaagggaaagauaacaa

SEQ ID NO: 1250727 - RNA, 19 nt, Homo sapiens
cagaucccauguaguugga

SEQ ID NO: 1250728 - RNA, 19 nt, Homo sapiens
aaaggauuaucaagcaaag

SEQ ID NO: 1250729 - RNA, 19 nt, Homo sapiens
aguuggugcuuaaauguga

SEQ ID NO: 1250730 - RNA, 19 nt, Homo sapiens
aacagaaagggaaagauaa

SEQ ID NO: 1250731 - RNA, 19 nt, Homo sapiens
gaaacagaaagggaaagau

SEQ ID NO: 1250732 - RNA, 19 nt, Homo sapiens
gcgcauuuguuuuccauug

SEQ ID NO: 1250733 - RNA, 19 nt, Homo sapiens
gcaccuugcuuucgaaaac

SEQ ID NO: 1250734 - RNA, 19 nt, Homo sapiens
gcccuucucuucucgucau

SEQ ID NO: 1250735 - RNA, 19 nt, Homo sapiens
gguuguuugagacuauuua

SEQ ID NO: 1250736 - RNA, 19 nt, Homo sapiens
ugaaacagaaagggaaaga

SEQ ID NO: 1250737 - RNA, 19 nt, Homo sapiens
ccuccucccuuucacagau

SEQ ID NO: 1250738 - RNA, 19 nt, Homo sapiens
ugcauggaguuggugcuua

SEQ ID NO: 1250739 - RNA, 19 nt, Homo sapiens
auugguugcuguagauuau

SEQ ID NO: 1250740 - RNA, 19 nt, Homo sapiens
uuuauugguugcuguagau

SEQ ID NO: 1250741 - RNA, 19 nt, Homo sapiens
uggcguugcgcauuuguuu

SEQ ID NO: 1250742 - RNA, 19 nt, Homo sapiens
gugaguugauuuugcuuuu

SEQ ID NO: 1250743 - RNA, 19 nt, Homo sapiens
uuacuugcauggaguuggu

SEQ ID NO: 1250744 - RNA, 19 nt, Homo sapiens
guuugagacuauuuauugg

SEQ ID NO: 1250745 - RNA, 19 nt, Homo sapiens
ucaagcaaaguuauuccuu

SEQ ID NO: 1250746 - RNA, 19 nt, Homo sapiens
aaccaaaggccacauacau

SEQ ID NO: 1250747 - RNA, 19 nt, Homo sapiens
uauugguugcuguagauua

SEQ ID NO: 1250748 - RNA, 19 nt, Homo sapiens
aggauuaucaagcaaaguu

SEQ ID NO: 1250749 - RNA, 19 nt, Homo sapiens
ugguggcggugguugcuuu

SEQ ID NO: 1250750 - RNA, 19 nt, Homo sapiens
ugccguuggugcacacaaa

SEQ ID NO: 1250751 - RNA, 19 nt, Homo sapiens
ggaagggaaguugaguuca

SEQ ID NO: 1250752 - RNA, 19 nt, Homo sapiens
gaguagauaagggacaguu

SEQ ID NO: 1250753 - RNA, 19 nt, Homo sapiens
uaagcuaacaacacagauc

SEQ ID NO: 1250754 - RNA, 19 nt, Homo sapiens
gggaaguugaguucagguu

SEQ ID NO: 1250755 - RNA, 19 nt, Homo sapiens
gggugaggagaguagauaa

SEQ ID NO: 1250756 - RNA, 19 nt, Homo sapiens
gaguuggugcuuaaaugug

SEQ ID NO: 1250757 - RNA, 19 nt, Homo sapiens
ggacagagcugguaguaga

SEQ ID NO: 1250758 - RNA, 19 nt, Homo sapiens
gaagauggcaugcggcuuu

SEQ ID NO: 1250759 - RNA, 19 nt, Homo sapiens
caaaggagguggagcacaa

SEQ ID NO: 1250760 - RNA, 19 nt, Homo sapiens
gcaggagaauugcuugaaa

SEQ ID NO: 1250761 - RNA, 19 nt, Homo sapiens
gcucggcucuuguguuuga

SEQ ID NO: 1250762 - RNA, 19 nt, Homo sapiens
gaagaaaagucgauauugu

SEQ ID NO: 1250763 - RNA, 19 nt, Homo sapiens
cagaugggcuuggcuauug

SEQ ID NO: 1250764 - RNA, 19 nt, Homo sapiens
cuacagagauggagagaag

SEQ ID NO: 1250765 - RNA, 19 nt, Homo sapiens
gagggcagaucacuugaga

SEQ ID NO: 1250766 - RNA, 19 nt, Homo sapiens
gggcuuggcuauugucaug

SEQ ID NO: 1250767 - RNA, 19 nt, Homo sapiens
gaacaagauucugucucaa

SEQ ID NO: 1250768 - RNA, 19 nt, Homo sapiens
gggaagggcuggagcuaca

SEQ ID NO: 1250769 - RNA, 19 nt, Homo sapiens
caaaggagaggaagaggaa

SEQ ID NO: 1250770 - RNA, 19 nt, Homo sapiens
ccagucagauggugaagga

SEQ ID NO: 1250771 - RNA, 19 nt, Homo sapiens
ucagauugauugcguucua

SEQ ID NO: 1250772 - RNA, 19 nt, Homo sapiens
gaggagggcagaucacuug

SEQ ID NO: 1250773 - RNA, 19 nt, Homo sapiens
gucaagaggugcuagacuu

SEQ ID NO: 1250774 - RNA, 19 nt, Homo sapiens
ggaaacagcaggaaugacu

SEQ ID NO: 1250775 - RNA, 19 nt, Homo sapiens
gaaggaacuuaaaccacau

SEQ ID NO: 1250776 - RNA, 19 nt, Homo sapiens
gugcucgaauacaccauua

SEQ ID NO: 1250777 - RNA, 19 nt, Homo sapiens
caggugauauggcaaagug

SEQ ID NO: 1250778 - RNA, 19 nt, Homo sapiens
cuacaaaccagaccagaug

SEQ ID NO: 1250779 - RNA, 19 nt, Homo sapiens
gagcugagccaccaaggau

SEQ ID NO: 1250780 - RNA, 19 nt, Homo sapiens
aggcucggcucuuguguuu

SEQ ID NO: 1250781 - RNA, 19 nt, Homo sapiens
cgaauacaccauuaaggaa

SEQ ID NO: 1250782 - RNA, 19 nt, Homo sapiens
ggugcucuguguccacuuu

SEQ ID NO: 1250783 - RNA, 19 nt, Homo sapiens
gagccaagaucacacuacu

SEQ ID NO: 1250784 - RNA, 19 nt, Homo sapiens
gaggacagagcugguagua

SEQ ID NO: 1250785 - RNA, 19 nt, Homo sapiens
ggugguggcugggauguuc

SEQ ID NO: 1250786 - RNA, 19 nt, Homo sapiens
gcaucagcauccuggagaa

SEQ ID NO: 1250787 - RNA, 19 nt, Homo sapiens
ggcuggagcuacagagaug

SEQ ID NO: 1250788 - RNA, 19 nt, Homo sapiens
gugcuagacuuggaguuug

SEQ ID NO: 1250789 - RNA, 19 nt, Homo sapiens
caccauggguccuguuaag

SEQ ID NO: 1250790 - RNA, 19 nt, Homo sapiens
ggaaggcucggcucuugug

SEQ ID NO: 1250791 - RNA, 19 nt, Homo sapiens
gauggugaaggaacuuaaa

SEQ ID NO: 1250792 - RNA, 19 nt, Homo sapiens
gaaacagcaggaaugacuu

SEQ ID NO: 1250793 - RNA, 19 nt, Homo sapiens
ccacuuuccuucucugaac

SEQ ID NO: 1250794 - RNA, 19 nt, Homo sapiens
ccacagcucagagagguuu

SEQ ID NO: 1250795 - RNA, 19 nt, Homo sapiens
gcuauugucaugcccaaga

SEQ ID NO: 1250796 - RNA, 19 nt, Homo sapiens
ucgaauacaccauuaagga

SEQ ID NO: 1250797 - RNA, 19 nt, Homo sapiens
ggaacuuaaaccacauaaa

SEQ ID NO: 1250798 - RNA, 19 nt, Homo sapiens
gcccagcccuuuccaugag

SEQ ID NO: 1250799 - RNA, 19 nt, Homo sapiens
gaaguggagguugcaguga

SEQ ID NO: 1250800 - RNA, 19 nt, Homo sapiens
ggugcuagacuuggaguuu

SEQ ID NO: 1250801 - RNA, 19 nt, Homo sapiens
ggaagaggaagaggaagau

SEQ ID NO: 1250802 - RNA, 19 nt, Homo sapiens
caggagaauugcuugaaac

SEQ ID NO: 1250803 - RNA, 19 nt, Homo sapiens
aggcagagguggccaggau

SEQ ID NO: 1250804 - RNA, 19 nt, Homo sapiens
aauacaccauuaaggaaga

SEQ ID NO: 1250805 - RNA, 19 nt, Homo sapiens
ccuguaaucccagcacuuu

SEQ ID NO: 1250806 - RNA, 19 nt, Homo sapiens
ccauguguguggccaguca

SEQ ID NO: 1250807 - RNA, 19 nt, Homo sapiens
caagaagccacagcucaga

SEQ ID NO: 1250808 - RNA, 19 nt, Homo sapiens
ugauugcguucuacugugu

SEQ ID NO: 1250809 - RNA, 19 nt, Homo sapiens
cuggaaggcucggcucuug

SEQ ID NO: 1250810 - RNA, 19 nt, Homo sapiens
ggugguggguaccuguaau

SEQ ID NO: 1250811 - RNA, 19 nt, Homo sapiens
aacaagauucugucucaaa

SEQ ID NO: 1250812 - RNA, 19 nt, Homo sapiens
gaagggcuggagcuacaga

SEQ ID NO: 1250813 - RNA, 19 nt, Homo sapiens
ggaagaaaagucgauauug

SEQ ID NO: 1250814 - RNA, 19 nt, Homo sapiens
acaagauucugucucaaaa

SEQ ID NO: 1250815 - RNA, 19 nt, Homo sapiens
agaggaagaggaagaggaa

SEQ ID NO: 1250816 - RNA, 19 nt, Homo sapiens
gaagaggaagaggaagaug

SEQ ID NO: 1250817 - RNA, 19 nt, Homo sapiens
ccagaugggcuuggcuauu

SEQ ID NO: 1250818 - RNA, 19 nt, Homo sapiens
ggaacagggucagcaucca

SEQ ID NO: 1250819 - RNA, 19 nt, Homo sapiens
uccaagcucugcccaugug

SEQ ID NO: 1250820 - RNA, 19 nt, Homo sapiens
guaccuguaaucccagcua

SEQ ID NO: 1250821 - RNA, 19 nt, Homo sapiens
cugugucaguagagacuua

SEQ ID NO: 1250822 - RNA, 19 nt, Homo sapiens
gguuccaguuguuggcaaa

SEQ ID NO: 1250823 - RNA, 19 nt, Homo sapiens
gcucgaauacaccauuaag

SEQ ID NO: 1250824 - RNA, 19 nt, Homo sapiens
gagaucaggaguucaagac

SEQ ID NO: 1250825 - RNA, 19 nt, Homo sapiens
cuauugucaugcccaagaa

SEQ ID NO: 1250826 - RNA, 19 nt, Homo sapiens
aagaggugcuagacuugga

SEQ ID NO: 1250827 - RNA, 19 nt, Homo sapiens
aaacagcaggaaugacuuc

SEQ ID NO: 1250828 - RNA, 19 nt, Homo sapiens
ggcugaggcaggagaauug

SEQ ID NO: 1250829 - RNA, 19 nt, Homo sapiens
ucacuugagaucaggaguu

SEQ ID NO: 1250830 - RNA, 19 nt, Homo sapiens
gggcaacagaacaagauuc

SEQ ID NO: 1250831 - RNA, 19 nt, Homo sapiens
cacuugagaucaggaguuc

SEQ ID NO: 1250832 - RNA, 19 nt, Homo sapiens
caugaggacagagcuggua

SEQ ID NO: 1250833 - RNA, 19 nt, Homo sapiens
uggagaagcucaucaaaac

SEQ ID NO: 1250834 - RNA, 19 nt, Homo sapiens
ggugaaggaacuuaaacca

SEQ ID NO: 1250835 - RNA, 19 nt, Homo sapiens
cagcuucacgggccauuca

SEQ ID NO: 1250836 - RNA, 19 nt, Homo sapiens
cagauggugaaggaacuua

SEQ ID NO: 1250837 - RNA, 19 nt, Homo sapiens
ggcaggagaauugcuugaa

SEQ ID NO: 1250838 - RNA, 19 nt, Homo sapiens
cacaccauggguccuguua

SEQ ID NO: 1250839 - RNA, 19 nt, Homo sapiens
acacaggcggugaaaguca

SEQ ID NO: 1250840 - RNA, 19 nt, Homo sapiens
caagaggaaugguuuaauu

SEQ ID NO: 1250841 - RNA, 19 nt, Homo sapiens
gaugaaugcugagaaauaa

SEQ ID NO: 1250842 - RNA, 19 nt, Homo sapiens
ggaccucgcugaucuagga

SEQ ID NO: 1250843 - RNA, 19 nt, Homo sapiens
ccucucagcugaugacaua

SEQ ID NO: 1250844 - RNA, 19 nt, Homo sapiens
gaaaugagaugggccuuac

SEQ ID NO: 1250845 - RNA, 19 nt, Homo sapiens
ccagaugaaugcugagaaa

SEQ ID NO: 1250846 - RNA, 19 nt, Homo sapiens
gagauggucuggugucugu

SEQ ID NO: 1250847 - RNA, 19 nt, Homo sapiens
acaaaugauugccaaauga

SEQ ID NO: 1250848 - RNA, 19 nt, Homo sapiens
gaaguucauugaccucuca

SEQ ID NO: 1250849 - RNA, 19 nt, Homo sapiens
caagacuccucaagaaaga

SEQ ID NO: 1250850 - RNA, 19 nt, Homo sapiens
gauggauucugguggauga

SEQ ID NO: 1250851 - RNA, 19 nt, Homo sapiens
ccacgaagcccugggauuu

SEQ ID NO: 1250852 - RNA, 19 nt, Homo sapiens
ggacacaucacucuucugu

SEQ ID NO: 1250853 - RNA, 19 nt, Homo sapiens
aaggaaagcuccaaagauc

SEQ ID NO: 1250854 - RNA, 19 nt, Homo sapiens
caaaggaaagcuccaaaga

SEQ ID NO: 1250855 - RNA, 19 nt, Homo sapiens
gagaugggccuuacucugu

SEQ ID NO: 1250856 - RNA, 19 nt, Homo sapiens
ggaaaugagaugggccuua

SEQ ID NO: 1250857 - RNA, 19 nt, Homo sapiens
ccaaagacagccucgagua

SEQ ID NO: 1250858 - RNA, 19 nt, Homo sapiens
gcugagaaauaaguaauca

SEQ ID NO: 1250859 - RNA, 19 nt, Homo sapiens
acacaucacucuucugucu

SEQ ID NO: 1250860 - RNA, 19 nt, Homo sapiens
ccagagugccaccgcauua

SEQ ID NO: 1250861 - RNA, 19 nt, Homo sapiens
caagaacaaccaccuguga

SEQ ID NO: 1250862 - RNA, 19 nt, Homo sapiens
caucgcagccuucuacuug

SEQ ID NO: 1250863 - RNA, 19 nt, Homo sapiens
gcaugcuggugcacaguaa

SEQ ID NO: 1250864 - RNA, 19 nt, Homo sapiens
gccuuacucugucgacuaa

SEQ ID NO: 1250865 - RNA, 19 nt, Homo sapiens
ccacacgccuucccugcaa

SEQ ID NO: 1250866 - RNA, 19 nt, Homo sapiens
uacaaaugauugccaaaug

SEQ ID NO: 1250867 - RNA, 19 nt, Homo sapiens
gaggaaugguuuaauuaac

SEQ ID NO: 1250868 - RNA, 19 nt, Homo sapiens
agaugaaugcugagaaaua

SEQ ID NO: 1250869 - RNA, 19 nt, Homo sapiens
gcagcaauacgcacucuug

SEQ ID NO: 1250870 - RNA, 19 nt, Homo sapiens
caacaucauccucuauuca

SEQ ID NO: 1250871 - RNA, 19 nt, Homo sapiens
ucccaagacuccucaagaa

SEQ ID NO: 1250872 - RNA, 19 nt, Homo sapiens
gaaacuagugauccuggaa

SEQ ID NO: 1250873 - RNA, 19 nt, Homo sapiens
ugucuacacuccacagcua

SEQ ID NO: 1250874 - RNA, 19 nt, Homo sapiens
ccaccgcauuagcaauaua

SEQ ID NO: 1250875 - RNA, 19 nt, Homo sapiens
ucgccuaccucuccaagaa

SEQ ID NO: 1250876 - RNA, 19 nt, Homo sapiens
uauggaauacggugcaaua

SEQ ID NO: 1250877 - RNA, 19 nt, Homo sapiens
ucgacuaaaugaauagcua

SEQ ID NO: 1250878 - RNA, 19 nt, Homo sapiens
ccaacaucauccucuauuc

SEQ ID NO: 1250879 - RNA, 19 nt, Homo sapiens
gcuucaugcugcuuaaguu

SEQ ID NO: 1250880 - RNA, 19 nt, Homo sapiens
cuagugauccuggaaauga

SEQ ID NO: 1250881 - RNA, 19 nt, Homo sapiens
ggacaauuuccucaugaug

SEQ ID NO: 1250882 - RNA, 19 nt, Homo sapiens
gaauggggcugggaagaaa

SEQ ID NO: 1250883 - RNA, 19 nt, Homo sapiens
guacaaaugauugccaaau

SEQ ID NO: 1250884 - RNA, 19 nt, Homo sapiens
cugcuuaaguuaccagaug

SEQ ID NO: 1250885 - RNA, 19 nt, Homo sapiens
ucugucgacuaaaugaaua

SEQ ID NO: 1250886 - RNA, 19 nt, Homo sapiens
cagagagugaggacaauuu

SEQ ID NO: 1250887 - RNA, 19 nt, Homo sapiens
gagaagcagagccagcaaa

SEQ ID NO: 1250888 - RNA, 19 nt, Homo sapiens
gcacuugccgggucaccuu

SEQ ID NO: 1250889 - RNA, 19 nt, Homo sapiens
cauugggacuggcgucuau

SEQ ID NO: 1250890 - RNA, 19 nt, Homo sapiens
gauggucuggugucuguuu

SEQ ID NO: 1250891 - RNA, 19 nt, Homo sapiens
gcaagaggaaugguuuaau

SEQ ID NO: 1250892 - RNA, 19 nt, Homo sapiens
uaaguuaccagaugaaugc

SEQ ID NO: 1250893 - RNA, 19 nt, Homo sapiens
ccaagacuccucaagaaag

SEQ ID NO: 1250894 - RNA, 19 nt, Homo sapiens
ggacaagggacacaucacu

SEQ ID NO: 1250895 - RNA, 19 nt, Homo sapiens
gcaggcauaccgcaugaug

SEQ ID NO: 1250896 - RNA, 19 nt, Homo sapiens
gaaugcugagaaauaagua

SEQ ID NO: 1250897 - RNA, 19 nt, Homo sapiens
gcacugcuaauccuuccaa

SEQ ID NO: 1250898 - RNA, 19 nt, Homo sapiens
acacagagagugaggacaa

SEQ ID NO: 1250899 - RNA, 19 nt, Homo sapiens
ggcccaacaucauccucua

SEQ ID NO: 1250900 - RNA, 19 nt, Homo sapiens
ggaaugguuuaauuaacac

SEQ ID NO: 1250901 - RNA, 19 nt, Homo sapiens
gcaauaggcagaggacaag

SEQ ID NO: 1250902 - RNA, 19 nt, Homo sapiens
cgcauuagcaauauacaaa

SEQ ID NO: 1250903 - RNA, 19 nt, Homo sapiens
aaaggaaagcuccaaagau

SEQ ID NO: 1250904 - RNA, 19 nt, Homo sapiens
caaaugauugccaaaugau

SEQ ID NO: 1250905 - RNA, 19 nt, Homo sapiens
aagcaggcauaccgcauga

SEQ ID NO: 1250906 - RNA, 19 nt, Homo sapiens
gacagacgggcacugcuaa

SEQ ID NO: 1250907 - RNA, 19 nt, Homo sapiens
gggcaucgcagccuucuac

SEQ ID NO: 1250908 - RNA, 19 nt, Homo sapiens
ggcaagaggaaugguuuaa

SEQ ID NO: 1250909 - RNA, 19 nt, Homo sapiens
ggcugucucuggauggauu

SEQ ID NO: 1250910 - RNA, 19 nt, Homo sapiens
gggauuuccuacccaugga

SEQ ID NO: 1250911 - RNA, 19 nt, Homo sapiens
agacagacgggcacugcua

SEQ ID NO: 1250912 - RNA, 19 nt, Homo sapiens
guguagagcaccagacaga

SEQ ID NO: 1250913 - RNA, 19 nt, Homo sapiens
caagcgacacagagaguga

SEQ ID NO: 1250914 - RNA, 19 nt, Homo sapiens
caaagacagccucgaguac

SEQ ID NO: 1250915 - RNA, 19 nt, Homo sapiens
aaacuagugauccuggaaa

SEQ ID NO: 1250916 - RNA, 19 nt, Homo sapiens
gggagagaguaccauggau

SEQ ID NO: 1250917 - RNA, 19 nt, Homo sapiens
cauaagcagaaacuaguga

SEQ ID NO: 1250918 - RNA, 19 nt, Homo sapiens
gaggacaagggacacauca

SEQ ID NO: 1250919 - RNA, 19 nt, Homo sapiens
cuucaugcugcuuaaguua

SEQ ID NO: 1250920 - RNA, 19 nt, Homo sapiens
ucgaggcacugcagcuaug

SEQ ID NO: 1250921 - RNA, 19 nt, Homo sapiens
caauauacaaacaguccaa

SEQ ID NO: 1250922 - RNA, 19 nt, Homo sapiens
guacccggaugggaaguuc

SEQ ID NO: 1250923 - RNA, 19 nt, Homo sapiens
ggccugacccugagaagca

SEQ ID NO: 1250924 - RNA, 19 nt, Homo sapiens
ugccaccgcauuagcaaua

SEQ ID NO: 1250925 - RNA, 19 nt, Homo sapiens
cgucauaagcagaaacuag

SEQ ID NO: 1250926 - RNA, 19 nt, Homo sapiens
ugaaugcugagaaauaagu

SEQ ID NO: 1250927 - RNA, 19 nt, Homo sapiens
cgacuaaaugaauagcuau

SEQ ID NO: 1250928 - RNA, 19 nt, Homo sapiens
ggccuuacucugucgacua

SEQ ID NO: 1250929 - RNA, 19 nt, Homo sapiens
acaucacucuucugucugu

SEQ ID NO: 1250930 - RNA, 19 nt, Homo sapiens
ccaaaggaaagcuccaaag

SEQ ID NO: 1250931 - RNA, 19 nt, Homo sapiens
cggaugggaaguucauuga

SEQ ID NO: 1250932 - RNA, 19 nt, Homo sapiens
cuuacucugucgacuaaau

SEQ ID NO: 1250933 - RNA, 19 nt, Homo sapiens
cccaagacuccucaagaaa

SEQ ID NO: 1250934 - RNA, 19 nt, Homo sapiens
gaagcccugggauuuccua

SEQ ID NO: 1250935 - RNA, 19 nt, Homo sapiens
gcugcgcccuccuucucuu

SEQ ID NO: 1250936 - RNA, 19 nt, Homo sapiens
gucauaagcagaaacuagu

SEQ ID NO: 1250937 - RNA, 19 nt, Homo sapiens
gcacugccucagccuaaag

SEQ ID NO: 1250938 - RNA, 19 nt, Homo sapiens
gaccugccccucuuucuuu

SEQ ID NO: 1250939 - RNA, 19 nt, Homo sapiens
caagggacacaucacucuu

SEQ ID NO: 1250940 - RNA, 19 nt, Homo sapiens
ucaaugaggugaagauuua

SEQ ID NO: 1250941 - RNA, 19 nt, Homo sapiens
caacuugaccgaagaauua

SEQ ID NO: 1250942 - RNA, 19 nt, Homo sapiens
acaaagagcuggcacuuaa

SEQ ID NO: 1250943 - RNA, 19 nt, Homo sapiens
gaagaaagauguagauguc

SEQ ID NO: 1250944 - RNA, 19 nt, Homo sapiens
gcagaaaucuacauggaaa

SEQ ID NO: 1250945 - RNA, 19 nt, Homo sapiens
gaucaaagcaggagaagaa

SEQ ID NO: 1250946 - RNA, 19 nt, Homo sapiens
gcacagagaguccaguuaa

SEQ ID NO: 1250947 - RNA, 19 nt, Homo sapiens
gcacugcuauaaagaacua

SEQ ID NO: 1250948 - RNA, 19 nt, Homo sapiens
ugaagagagugaagaauuu

SEQ ID NO: 1250949 - RNA, 19 nt, Homo sapiens
acacagagguaaagauuug

SEQ ID NO: 1250950 - RNA, 19 nt, Homo sapiens
gaucaucguuaggguguua

SEQ ID NO: 1250951 - RNA, 19 nt, Homo sapiens
caauugacauucacguuaa

SEQ ID NO: 1250952 - RNA, 19 nt, Homo sapiens
gaagaucguuugaaaauug

SEQ ID NO: 1250953 - RNA, 19 nt, Homo sapiens
caaagcaggagaagaauuu

SEQ ID NO: 1250954 - RNA, 19 nt, Homo sapiens
gaagagagugaagaauuua

SEQ ID NO: 1250955 - RNA, 19 nt, Homo sapiens
ccaagagaguauaaucuaa

SEQ ID NO: 1250956 - RNA, 19 nt, Homo sapiens
gaagagagcgcuacagaag

SEQ ID NO: 1250957 - RNA, 19 nt, Homo sapiens
gaagugguccuaccuguga

SEQ ID NO: 1250958 - RNA, 19 nt, Homo sapiens
ccaaguagaugaagagagu

SEQ ID NO: 1250959 - RNA, 19 nt, Homo sapiens
caccgaagauuacaauuug

SEQ ID NO: 1250960 - RNA, 19 nt, Homo sapiens
gcagaaaguucggagaguu

SEQ ID NO: 1250961 - RNA, 19 nt, Homo sapiens
gaaguugucaccuuugaaa

SEQ ID NO: 1250962 - RNA, 19 nt, Homo sapiens
caacaagaacuucgugaaa

SEQ ID NO: 1250963 - RNA, 19 nt, Homo sapiens
cacagcagauucagagaua

SEQ ID NO: 1250964 - RNA, 19 nt, Homo sapiens
gagcaugaccuuaaugaug

SEQ ID NO: 1250965 - RNA, 19 nt, Homo sapiens
agaaauaccaucccuguuu

SEQ ID NO: 1250966 - RNA, 19 nt, Homo sapiens
ccaacaaucucugcuuuga

SEQ ID NO: 1250967 - RNA, 19 nt, Homo sapiens
gaugacuacucaaagauug

SEQ ID NO: 1250968 - RNA, 19 nt, Homo sapiens
cuaccgccauucaugauua

SEQ ID NO: 1250969 - RNA, 19 nt, Homo sapiens
guacacagagguaaagauu

SEQ ID NO: 1250970 - RNA, 19 nt, Homo sapiens
gaaaggacccgggacuuga

SEQ ID NO: 1250971 - RNA, 19 nt, Homo sapiens
gaaaagagguuuaauugac

SEQ ID NO: 1250972 - RNA, 19 nt, Homo sapiens
gaaauaccaucccuguuuu

SEQ ID NO: 1250973 - RNA, 19 nt, Homo sapiens
gaacaaaacccuugaagau

SEQ ID NO: 1250974 - RNA, 19 nt, Homo sapiens
guucugaaguuuauagguu

SEQ ID NO: 1250975 - RNA, 19 nt, Homo sapiens
gaauuuaggcuucugaauc

SEQ ID NO: 1250976 - RNA, 19 nt, Homo sapiens
gcacagucuaugaugauua

SEQ ID NO: 1250977 - RNA, 19 nt, Homo sapiens
agagagcgcuacagaagaa

SEQ ID NO: 1250978 - RNA, 19 nt, Homo sapiens
ugacauaaauucagugcau

SEQ ID NO: 1250979 - RNA, 19 nt, Homo sapiens
guugucaccuuugaaauuu

SEQ ID NO: 1250980 - RNA, 19 nt, Homo sapiens
gagaagaauuuagaagcuu

SEQ ID NO: 1250981 - RNA, 19 nt, Homo sapiens
ggagaagaauuuagaagcu

SEQ ID NO: 1250982 - RNA, 19 nt, Homo sapiens
cuaauauucucaccgauga

SEQ ID NO: 1250983 - RNA, 19 nt, Homo sapiens
aacaaucucugcuuugaaa

SEQ ID NO: 1250984 - RNA, 19 nt, Homo sapiens
cccaagaacucgaaacaga

SEQ ID NO: 1250985 - RNA, 19 nt, Homo sapiens
guguuuagauucagaaguu

SEQ ID NO: 1250986 - RNA, 19 nt, Homo sapiens
ugaaaugccuacugugugu

SEQ ID NO: 1250987 - RNA, 19 nt, Homo sapiens
guauuuaucuguucuugca

SEQ ID NO: 1250988 - RNA, 19 nt, Homo sapiens
gaagaaacacgugcacaga

SEQ ID NO: 1250989 - RNA, 19 nt, Homo sapiens
guaggagaauugaacuuau

SEQ ID NO: 1250990 - RNA, 19 nt, Homo sapiens
gcacuguauuuaucuguuc

SEQ ID NO: 1250991 - RNA, 19 nt, Homo sapiens
caaagauucugccacaaag

SEQ ID NO: 1250992 - RNA, 19 nt, Homo sapiens
aguagaggcuguugguuaa

SEQ ID NO: 1250993 - RNA, 19 nt, Homo sapiens
ggaaaggacccgggacuug

SEQ ID NO: 1250994 - RNA, 19 nt, Homo sapiens
gaaagcacagucuaugaug

SEQ ID NO: 1250995 - RNA, 19 nt, Homo sapiens
caguagaggcuguugguua

SEQ ID NO: 1250996 - RNA, 19 nt, Homo sapiens
ugaauccucuacaaacuga

SEQ ID NO: 1250997 - RNA, 19 nt, Homo sapiens
caauuauccuugaaguuug

SEQ ID NO: 1250998 - RNA, 19 nt, Homo sapiens
acaauugacauucacguua

SEQ ID NO: 1250999 - RNA, 19 nt, Homo sapiens
agagcuggcacuuaaauua

SEQ ID NO: 1251000 - RNA, 19 nt, Homo sapiens
guagauguccguaggagaa

SEQ ID NO: 1251001 - RNA, 19 nt, Homo sapiens
aaagauggacaguacauuu

SEQ ID NO: 1251002 - RNA, 19 nt, Homo sapiens
uacccaaccuguaauaaug

SEQ ID NO: 1251003 - RNA, 19 nt, Homo sapiens
gauuugggauacuugacua

SEQ ID NO: 1251004 - RNA, 19 nt, Homo sapiens
gacggucguuucauugauu

SEQ ID NO: 1251005 - RNA, 19 nt, Homo sapiens
ccuugaagaucguuugaaa

SEQ ID NO: 1251006 - RNA, 19 nt, Homo sapiens
ccacaaagcagaaacugau

SEQ ID NO: 1251007 - RNA, 19 nt, Homo sapiens
ucaaagauucugccacaaa

SEQ ID NO: 1251008 - RNA, 19 nt, Homo sapiens
agaaacacgugcacagaga

SEQ ID NO: 1251009 - RNA, 19 nt, Homo sapiens
cagaaguugucaccuuuga

SEQ ID NO: 1251010 - RNA, 19 nt, Homo sapiens
gaauuuagaagcuucaaag

SEQ ID NO: 1251011 - RNA, 19 nt, Homo sapiens
gaacccugaccuccaagua

SEQ ID NO: 1251012 - RNA, 19 nt, Homo sapiens
ugagaacccugaccuccaa

SEQ ID NO: 1251013 - RNA, 19 nt, Homo sapiens
aagcagaaaucuacaugga

SEQ ID NO: 1251014 - RNA, 19 nt, Homo sapiens
agaggacggucguuucauu

SEQ ID NO: 1251015 - RNA, 19 nt, Homo sapiens
cgagcacgcuggugggaaa

SEQ ID NO: 1251016 - RNA, 19 nt, Homo sapiens
uaccaacaaucucugcuuu

SEQ ID NO: 1251017 - RNA, 19 nt, Homo sapiens
ggauacccaaccuguaaua

SEQ ID NO: 1251018 - RNA, 19 nt, Homo sapiens
ucccaagcauuucagauaa

SEQ ID NO: 1251019 - RNA, 19 nt, Homo sapiens
gauuaaaccauccagaaau

SEQ ID NO: 1251020 - RNA, 19 nt, Homo sapiens
gcaacaagaacuucgugaa

SEQ ID NO: 1251021 - RNA, 19 nt, Homo sapiens
ggacggucguuucauugau

SEQ ID NO: 1251022 - RNA, 19 nt, Homo sapiens
gcagcaaacaauugacauu

SEQ ID NO: 1251023 - RNA, 19 nt, Homo sapiens
gaggagaagcagaaaucua

SEQ ID NO: 1251024 - RNA, 19 nt, Homo sapiens
caaggacgauaccugaauc

SEQ ID NO: 1251025 - RNA, 19 nt, Homo sapiens
agauuucucuuaccacuau

SEQ ID NO: 1251026 - RNA, 19 nt, Homo sapiens
guuaugacaccuaucaauu

SEQ ID NO: 1251027 - RNA, 19 nt, Homo sapiens
caagguuuaucaugcucua

SEQ ID NO: 1251028 - RNA, 19 nt, Homo sapiens
guucauguacguucuugua

SEQ ID NO: 1251029 - RNA, 19 nt, Homo sapiens
gcaacaggaggcugagaaa

SEQ ID NO: 1251030 - RNA, 19 nt, Homo sapiens
gagaguccaguuaaagaaa

SEQ ID NO: 1251031 - RNA, 19 nt, Homo sapiens
cacagucuaugaugauuau

SEQ ID NO: 1251032 - RNA, 19 nt, Homo sapiens
aaagcacagucuaugauga

SEQ ID NO: 1251033 - RNA, 19 nt, Homo sapiens
ucggugguguuccuucuua

SEQ ID NO: 1251034 - RNA, 19 nt, Homo sapiens
ggugcaaguucugaaguuu

SEQ ID NO: 1251035 - RNA, 19 nt, Homo sapiens
caccagaucuccaagaacu

SEQ ID NO: 1251036 - RNA, 19 nt, Homo sapiens
aaaccagaauaccaaaguu

SEQ ID NO: 1251037 - RNA, 19 nt, Homo sapiens
gauguuaugacaccuauca

SEQ ID NO: 1251038 - RNA, 19 nt, Homo sapiens
caacaccgaagauuacaau

SEQ ID NO: 1251039 - RNA, 19 nt, Homo sapiens
gcaaacaauugacauucac

SEQ ID NO: 1251040 - RNA, 19 nt, Homo sapiens
acaaggagaugguuucuga

SEQ ID NO: 1251041 - RNA, 19 nt, Homo sapiens
gaaagugacaucauccauu

SEQ ID NO: 1251042 - RNA, 19 nt, Homo sapiens
gcaacgcgauaccugcuaa

SEQ ID NO: 1251043 - RNA, 19 nt, Homo sapiens
ggacauagagaaagagaug

SEQ ID NO: 1251044 - RNA, 19 nt, Homo sapiens
gacccugucucuaaagaaa

SEQ ID NO: 1251045 - RNA, 19 nt, Homo sapiens
ggagaugguuucugaguac

SEQ ID NO: 1251046 - RNA, 19 nt, Homo sapiens
aaagugacaucauccauuc

SEQ ID NO: 1251047 - RNA, 19 nt, Homo sapiens
gcaucaaguucuccaagga

SEQ ID NO: 1251048 - RNA, 19 nt, Homo sapiens
gcaucuauguguccaaagu

SEQ ID NO: 1251049 - RNA, 19 nt, Homo sapiens
ggagaauggcaucaaggua

SEQ ID NO: 1251050 - RNA, 19 nt, Homo sapiens
ucaaauuccuggacugaag

SEQ ID NO: 1251051 - RNA, 19 nt, Homo sapiens
gggcaucuauguguccaaa

SEQ ID NO: 1251052 - RNA, 19 nt, Homo sapiens
ccaagacgcugaugaaccu

SEQ ID NO: 1251053 - RNA, 19 nt, Homo sapiens
cgcgauaccugcuaaggaa

SEQ ID NO: 1251054 - RNA, 19 nt, Homo sapiens
uaagcugggucuaaacauc

SEQ ID NO: 1251055 - RNA, 19 nt, Homo sapiens
gacaccagcucagaagaug

SEQ ID NO: 1251056 - RNA, 19 nt, Homo sapiens
ggacugaagcuaucuaucc

SEQ ID NO: 1251057 - RNA, 19 nt, Homo sapiens
ccaaagugcuaggauuaca

SEQ ID NO: 1251058 - RNA, 19 nt, Homo sapiens
cuccagagcuagcagauuc

SEQ ID NO: 1251059 - RNA, 19 nt, Homo sapiens
ggagaagugcgguucaaca

SEQ ID NO: 1251060 - RNA, 19 nt, Homo sapiens
gcuccaagacgcugaugaa

SEQ ID NO: 1251061 - RNA, 19 nt, Homo sapiens
gaagccaacagugaugaaa

SEQ ID NO: 1251062 - RNA, 19 nt, Homo sapiens
ucccaaagugcuaggauua

SEQ ID NO: 1251063 - RNA, 19 nt, Homo sapiens
agagcuaucugaccuugug

SEQ ID NO: 1251064 - RNA, 19 nt, Homo sapiens
gcgagggccuucacguuac

SEQ ID NO: 1251065 - RNA, 19 nt, Homo sapiens
ggacgcgucauccucauca

SEQ ID NO: 1251066 - RNA, 19 nt, Homo sapiens
aggagaugguuucugagua

SEQ ID NO: 1251067 - RNA, 19 nt, Homo sapiens
ccaacggugucagguuuga

SEQ ID NO: 1251068 - RNA, 19 nt, Homo sapiens
agccaacggugucagguuu

SEQ ID NO: 1251069 - RNA, 19 nt, Homo sapiens
gagaagcagcagcggaaga

SEQ ID NO: 1251070 - RNA, 19 nt, Homo sapiens
cgaggagaauggcaucaag

SEQ ID NO: 1251071 - RNA, 19 nt, Homo sapiens
gagcauggccugggcaucu

SEQ ID NO: 1251072 - RNA, 19 nt, Homo sapiens
gcugaugaaccucuucuuc

SEQ ID NO: 1251073 - RNA, 19 nt, Homo sapiens
gccuuagucucccaaagug

SEQ ID NO: 1251074 - RNA, 19 nt, Homo sapiens
ccaggcuagucucaaauuc

SEQ ID NO: 1251075 - RNA, 19 nt, Homo sapiens
gccuggacauagagaaaga

SEQ ID NO: 1251076 - RNA, 19 nt, Homo sapiens
gcgcaucguccaccuauac

SEQ ID NO: 1251077 - RNA, 19 nt, Homo sapiens
gccgguauccugccuacaa

SEQ ID NO: 1251078 - RNA, 19 nt, Homo sapiens
gggccaaacgcacaucaug

SEQ ID NO: 1251079 - RNA, 19 nt, Homo sapiens
gggcaucuucgucagcaaa

SEQ ID NO: 1251080 - RNA, 19 nt, Homo sapiens
gccuggagcucacacuucu

SEQ ID NO: 1251081 - RNA, 19 nt, Homo sapiens
caucgaagccaacagugau

SEQ ID NO: 1251082 - RNA, 19 nt, Homo sapiens
gcagagaggccuggacacu

SEQ ID NO: 1251083 - RNA, 19 nt, Homo sapiens
ccaacagugaugaaaguga

SEQ ID NO: 1251084 - RNA, 19 nt, Homo sapiens
ugauuuaagcugggucuaa

SEQ ID NO: 1251085 - RNA, 19 nt, Homo sapiens
aaucccaacuacucuggaa

SEQ ID NO: 1251086 - RNA, 19 nt, Homo sapiens
agcgagggccuucacguua

SEQ ID NO: 1251087 - RNA, 19 nt, Homo sapiens
cgacaccagcucagaagau

SEQ ID NO: 1251088 - RNA, 19 nt, Homo sapiens
guggagaagugcgguucaa

SEQ ID NO: 1251089 - RNA, 19 nt, Homo sapiens
ucacuugagcccaggaguu

SEQ ID NO: 1251090 - RNA, 19 nt, Homo sapiens
ugaagcagcaagaucacuu

SEQ ID NO: 1251091 - RNA, 19 nt, Homo sapiens
ggguggauguggugaaucg

SEQ ID NO: 1251092 - RNA, 19 nt, Homo sapiens
gauuccuucuggaccugua

SEQ ID NO: 1251093 - RNA, 19 nt, Homo sapiens
ccaccuaggcagcgacuca

SEQ ID NO: 1251094 - RNA, 19 nt, Homo sapiens
ggccugggcaucuaugugu

SEQ ID NO: 1251095 - RNA, 19 nt, Homo sapiens
cacuugagcccaggaguuu

SEQ ID NO: 1251096 - RNA, 19 nt, Homo sapiens
ugcccaggcuagucucaaa

SEQ ID NO: 1251097 - RNA, 19 nt, Homo sapiens
agaagcagcagcggaagaa

SEQ ID NO: 1251098 - RNA, 19 nt, Homo sapiens
ggccuucacguuacugaga

SEQ ID NO: 1251099 - RNA, 19 nt, Homo sapiens
ccaucgaagccaacaguga

SEQ ID NO: 1251100 - RNA, 19 nt, Homo sapiens
cuugagcccaggaguuuaa

SEQ ID NO: 1251101 - RNA, 19 nt, Homo sapiens
uaccacaccuggccaaucc

SEQ ID NO: 1251102 - RNA, 19 nt, Homo sapiens
gagaagugcgguucaacac

SEQ ID NO: 1251103 - RNA, 19 nt, Homo sapiens
agccaacagugaugaaagu

SEQ ID NO: 1251104 - RNA, 19 nt, Homo sapiens
guggguggauguggugaau

SEQ ID NO: 1251105 - RNA, 19 nt, Homo sapiens
cacaaccuccgacgacuuc

SEQ ID NO: 1251106 - RNA, 19 nt, Homo sapiens
gaacaaggcagguacaaau

SEQ ID NO: 1251107 - RNA, 19 nt, Homo sapiens
gaagaacuaacacgacuaa

SEQ ID NO: 1251108 - RNA, 19 nt, Homo sapiens
gcugggaaccuacucauua

SEQ ID NO: 1251109 - RNA, 19 nt, Homo sapiens
caaggcagguacaaauaaa

SEQ ID NO: 1251110 - RNA, 19 nt, Homo sapiens
gcacagggaagaacuaaca

SEQ ID NO: 1251111 - RNA, 19 nt, Homo sapiens
ccugaaugcuucuugcuaa

SEQ ID NO: 1251112 - RNA, 19 nt, Homo sapiens
gcaccaggacgcuuugauu

SEQ ID NO: 1251113 - RNA, 19 nt, Homo sapiens
cagcagcuauuugccuaua

SEQ ID NO: 1251114 - RNA, 19 nt, Homo sapiens
caccaggacgcuuugauua

SEQ ID NO: 1251115 - RNA, 19 nt, Homo sapiens
gggaaccuacucauuauug

SEQ ID NO: 1251116 - RNA, 19 nt, Homo sapiens
gaacuaacacgacuaaccu

SEQ ID NO: 1251117 - RNA, 19 nt, Homo sapiens
cgacaaccucccacucuuu

SEQ ID NO: 1251118 - RNA, 19 nt, Homo sapiens
ccaggacgcuuugauuaca

SEQ ID NO: 1251119 - RNA, 19 nt, Homo sapiens
ggaacaaggcagguacaaa

SEQ ID NO: 1251120 - RNA, 19 nt, Homo sapiens
gggccuaucugggugcauu

SEQ ID NO: 1251121 - RNA, 19 nt, Homo sapiens
ggagagagggcagagaaga

SEQ ID NO: 1251122 - RNA, 19 nt, Homo sapiens
acaaggcagguacaaauaa

SEQ ID NO: 1251123 - RNA, 19 nt, Homo sapiens
cauuauugcugcuuucaca

SEQ ID NO: 1251124 - RNA, 19 nt, Homo sapiens
ggaagaacuaacacgacua

SEQ ID NO: 1251125 - RNA, 19 nt, Homo sapiens
ugacgaggagcccagauuu

SEQ ID NO: 1251126 - RNA, 19 nt, Homo sapiens
aggcagugcuggcugauau

SEQ ID NO: 1251127 - RNA, 19 nt, Homo sapiens
ccaccaagcucuggguaag

SEQ ID NO: 1251128 - RNA, 19 nt, Homo sapiens
gggccacagccaccaguua

SEQ ID NO: 1251129 - RNA, 19 nt, Homo sapiens
gaaugcuucuugcuaacca

SEQ ID NO: 1251130 - RNA, 19 nt, Homo sapiens
cacaggagccuucgccuau

SEQ ID NO: 1251131 - RNA, 19 nt, Homo sapiens
caacgagacggucaacauc

SEQ ID NO: 1251132 - RNA, 19 nt, Homo sapiens
ggaaccuacucauuauugc

SEQ ID NO: 1251133 - RNA, 19 nt, Homo sapiens
cugggaaccuacucauuau

SEQ ID NO: 1251134 - RNA, 19 nt, Homo sapiens
caacaucuggacucacuuc

SEQ ID NO: 1251135 - RNA, 19 nt, Homo sapiens
gcucggcuuuggacugugu

SEQ ID NO: 1251136 - RNA, 19 nt, Homo sapiens
ccacagccaccaguuauuc

SEQ ID NO: 1251137 - RNA, 19 nt, Homo sapiens
aacaaggcagguacaaaua

SEQ ID NO: 1251138 - RNA, 19 nt, Homo sapiens
ggugcauuauggaugguuu

SEQ ID NO: 1251139 - RNA, 19 nt, Homo sapiens
ccuauauucugucaaaggu

SEQ ID NO: 1251140 - RNA, 19 nt, Homo sapiens
gaugggaguggaagaagug

SEQ ID NO: 1251141 - RNA, 19 nt, Homo sapiens
caggagagagggcagagaa

SEQ ID NO: 1251142 - RNA, 19 nt, Homo sapiens
cagcucggcuuuggacugu

SEQ ID NO: 1251143 - RNA, 19 nt, Homo sapiens
gacgaggagcccagauuug

SEQ ID NO: 1251144 - RNA, 19 nt, Homo sapiens
ggccacagccaccaguuau

SEQ ID NO: 1251145 - RNA, 19 nt, Homo sapiens
gucaacaucuggacucacu

SEQ ID NO: 1251146 - RNA, 19 nt, Homo sapiens
ccaacgagacggucaacau

SEQ ID NO: 1251147 - RNA, 19 nt, Homo sapiens
ccucagcuccuuccagaug

SEQ ID NO: 1251148 - RNA, 19 nt, Homo sapiens
gaagaugccccuauauucu

SEQ ID NO: 1251149 - RNA, 19 nt, Homo sapiens
ggagguaccaggccaccau

SEQ ID NO: 1251150 - RNA, 19 nt, Homo sapiens
ccaguuauuccacaucugu

SEQ ID NO: 1251151 - RNA, 19 nt, Homo sapiens
uggaugguuugguggauug

SEQ ID NO: 1251152 - RNA, 19 nt, Homo sapiens
cucaagguguccaggcuuu

SEQ ID NO: 1251153 - RNA, 19 nt, Homo sapiens
ggacuggcagagugugaga

SEQ ID NO: 1251154 - RNA, 19 nt, Homo sapiens
guacccaggccaaacaaca

SEQ ID NO: 1251155 - RNA, 19 nt, Homo sapiens
ccgagaggccacacacuug

SEQ ID NO: 1251156 - RNA, 19 nt, Homo sapiens
gccgagaggccacacacuu

SEQ ID NO: 1251157 - RNA, 19 nt, Homo sapiens
cagcacagggaagaacuaa

SEQ ID NO: 1251158 - RNA, 19 nt, Homo sapiens
ggcugcagcugggaaccua

SEQ ID NO: 1251159 - RNA, 19 nt, Homo sapiens
ggguaucccuaguuagacu

SEQ ID NO: 1251160 - RNA, 19 nt, Homo sapiens
gagucuguccuggucauaa

SEQ ID NO: 1251161 - RNA, 19 nt, Homo sapiens
gagagagggcagagaagag

SEQ ID NO: 1251162 - RNA, 19 nt, Homo sapiens
ucgacaaccucccacucuu

SEQ ID NO: 1251163 - RNA, 19 nt, Homo sapiens
ccaccaugcucagucucaa

SEQ ID NO: 1251164 - RNA, 19 nt, Homo sapiens
caucucagccuggaaccaa

SEQ ID NO: 1251165 - RNA, 19 nt, Homo sapiens
gcaugcgccacaucugcua

SEQ ID NO: 1251166 - RNA, 19 nt, Homo sapiens
cuaucugggugcauuaugg

SEQ ID NO: 1251167 - RNA, 19 nt, Homo sapiens
gccccuauauucugucaaa

SEQ ID NO: 1251168 - RNA, 19 nt, Homo sapiens
caccaguuauuccacaucu

SEQ ID NO: 1251169 - RNA, 19 nt, Homo sapiens
gcucacuggcuuccucuuc

SEQ ID NO: 1251170 - RNA, 19 nt, Homo sapiens
ccaccugcaccaguucuuu

SEQ ID NO: 1251171 - RNA, 19 nt, Homo sapiens
ccaguuugccagcagcuau

SEQ ID NO: 1251172 - RNA, 19 nt, Homo sapiens
gggcucuucugggaaaaua

SEQ ID NO: 1251173 - RNA, 19 nt, Homo sapiens
ggcugaagaugccccuaua

SEQ ID NO: 1251174 - RNA, 19 nt, Homo sapiens
ugaugggaguggaagaagu

SEQ ID NO: 1251175 - RNA, 19 nt, Homo sapiens
gaaccuacucauuauugcu

SEQ ID NO: 1251176 - RNA, 19 nt, Homo sapiens
gaggcagugcuggcugaua

SEQ ID NO: 1251177 - RNA, 19 nt, Homo sapiens
ccagagcacagaaugaacu

SEQ ID NO: 1251178 - RNA, 19 nt, Homo sapiens
ccucccaccugccugaaag

SEQ ID NO: 1251179 - RNA, 19 nt, Homo sapiens
gagaagaacuggauuuguu

SEQ ID NO: 1251180 - RNA, 19 nt, Homo sapiens
gcagagccuucuaauguau

SEQ ID NO: 1251181 - RNA, 19 nt, Homo sapiens
gcaguucccuccagacuuc

SEQ ID NO: 1251182 - RNA, 19 nt, Homo sapiens
gugcagagccuucuaaugu

SEQ ID NO: 1251183 - RNA, 19 nt, Homo sapiens
gcagaggaacuucuucaaa

SEQ ID NO: 1251184 - RNA, 19 nt, Homo sapiens
caaggcagcugaagauuuu

SEQ ID NO: 1251185 - RNA, 19 nt, Homo sapiens
gcaaccagacgauaagaaa

SEQ ID NO: 1251186 - RNA, 19 nt, Homo sapiens
ucacuuccaucucagcuaa

SEQ ID NO: 1251187 - RNA, 19 nt, Homo sapiens
gaagugcuuugaggguuaa

SEQ ID NO: 1251188 - RNA, 19 nt, Homo sapiens
agaagugcuuugaggguua

SEQ ID NO: 1251189 - RNA, 19 nt, Homo sapiens
ucgcugaucuuaagaagug

SEQ ID NO: 1251190 - RNA, 19 nt, Homo sapiens
cagagucgcugaucuuaag

SEQ ID NO: 1251191 - RNA, 19 nt, Homo sapiens
gcucaaacacaccaauaaa

SEQ ID NO: 1251192 - RNA, 19 nt, Homo sapiens
cagcaacgccucccaauca

SEQ ID NO: 1251193 - RNA, 19 nt, Homo sapiens
ggccgacaaucuaaagaaa

SEQ ID NO: 1251194 - RNA, 19 nt, Homo sapiens
gagauucuggacagucuua

SEQ ID NO: 1251195 - RNA, 19 nt, Homo sapiens
gcucugggccgacaaucua

SEQ ID NO: 1251196 - RNA, 19 nt, Homo sapiens
ccaggaagcuaugcagaug

SEQ ID NO: 1251197 - RNA, 19 nt, Homo sapiens
gagcccagcccuccagaaa

SEQ ID NO: 1251198 - RNA, 19 nt, Homo sapiens
cagaggaacuucuucaaaa

SEQ ID NO: 1251199 - RNA, 19 nt, Homo sapiens
gcagauggugccuaaauuc

SEQ ID NO: 1251200 - RNA, 19 nt, Homo sapiens
ccacaaggcagcugaagau

SEQ ID NO: 1251201 - RNA, 19 nt, Homo sapiens
gauggcaaccagacgauaa

SEQ ID NO: 1251202 - RNA, 19 nt, Homo sapiens
gaagaacuggauuuguuga

SEQ ID NO: 1251203 - RNA, 19 nt, Homo sapiens
cccaaucacucagcacuuu

SEQ ID NO: 1251204 - RNA, 19 nt, Homo sapiens
ucacucagcacuuuggaaa

SEQ ID NO: 1251205 - RNA, 19 nt, Homo sapiens
ugcagagccuucuaaugua

SEQ ID NO: 1251206 - RNA, 19 nt, Homo sapiens
caaacccucuccucucaca

SEQ ID NO: 1251207 - RNA, 19 nt, Homo sapiens
cuaugcagauggugccuaa

SEQ ID NO: 1251208 - RNA, 19 nt, Homo sapiens
gcccaugcccuaccucauu

SEQ ID NO: 1251209 - RNA, 19 nt, Homo sapiens
gggcuucucagaucaauuc

SEQ ID NO: 1251210 - RNA, 19 nt, Homo sapiens
acaaggcagcugaagauuu

SEQ ID NO: 1251211 - RNA, 19 nt, Homo sapiens
cccaaacccucuccucuca

SEQ ID NO: 1251212 - RNA, 19 nt, Homo sapiens
guucaaacaguucaucgaa

SEQ ID NO: 1251213 - RNA, 19 nt, Homo sapiens
caauuccucucggcauuug

SEQ ID NO: 1251214 - RNA, 19 nt, Homo sapiens
uacaauuccucucggcauu

SEQ ID NO: 1251215 - RNA, 19 nt, Homo sapiens
gaucuuaagaagugcuuug

SEQ ID NO: 1251216 - RNA, 19 nt, Homo sapiens
gccgagagaguacgagaaa

SEQ ID NO: 1251217 - RNA, 19 nt, Homo sapiens
cagcucaaacacaccaaua

SEQ ID NO: 1251218 - RNA, 19 nt, Homo sapiens
cuagaauccuggcaaccuu

SEQ ID NO: 1251219 - RNA, 19 nt, Homo sapiens
ccaagggcagccucucuaa

SEQ ID NO: 1251220 - RNA, 19 nt, Homo sapiens
gccaccagcucuucaaagg

SEQ ID NO: 1251221 - RNA, 19 nt, Homo sapiens
gcgagauucuggacagucu

SEQ ID NO: 1251222 - RNA, 19 nt, Homo sapiens
ggagaagaacuggauuugu

SEQ ID NO: 1251223 - RNA, 19 nt, Homo sapiens
gggagggcuucucagauca

SEQ ID NO: 1251224 - RNA, 19 nt, Homo sapiens
gcacccaccagcucaaaca

SEQ ID NO: 1251225 - RNA, 19 nt, Homo sapiens
ggagacgccagcuggaaga

SEQ ID NO: 1251226 - RNA, 19 nt, Homo sapiens
ucagccaccugccuugguu

SEQ ID NO: 1251227 - RNA, 19 nt, Homo sapiens
aaacacaccaauaaagcuu

SEQ ID NO: 1251228 - RNA, 19 nt, Homo sapiens
ugcagauggugccuaaauu

SEQ ID NO: 1251229 - RNA, 19 nt, Homo sapiens
agagccuucuaauguauaa

SEQ ID NO: 1251230 - RNA, 19 nt, Homo sapiens
ccuuggagacgaccuuuaa

SEQ ID NO: 1251231 - RNA, 19 nt, Homo sapiens
uagaauccuggcaaccuua

SEQ ID NO: 1251232 - RNA, 19 nt, Homo sapiens
ccagagucgcugaucuuaa

SEQ ID NO: 1251233 - RNA, 19 nt, Homo sapiens
ccucagaguccgaccaaga

SEQ ID NO: 1251234 - RNA, 19 nt, Homo sapiens
ccgacaaucuaaagaaagg

SEQ ID NO: 1251235 - RNA, 19 nt, Homo sapiens
gggccgacaaucuaaagaa

SEQ ID NO: 1251236 - RNA, 19 nt, Homo sapiens
ugagaccgagccagaguuu

SEQ ID NO: 1251237 - RNA, 19 nt, Homo sapiens
caagaagucacgucuccau

SEQ ID NO: 1251238 - RNA, 19 nt, Homo sapiens
agaagaacuggauuuguug

SEQ ID NO: 1251239 - RNA, 19 nt, Homo sapiens
gaacguggacgccaauacc

SEQ ID NO: 1251240 - RNA, 19 nt, Homo sapiens
cccaugcccuaccucauug

SEQ ID NO: 1251241 - RNA, 19 nt, Homo sapiens
cuuugaggguuaagaauca

SEQ ID NO: 1251242 - RNA, 19 nt, Homo sapiens
aagcccaacuuugauauag

SEQ ID NO: 1251243 - RNA, 19 nt, Homo sapiens
ccuggcaaccuuacaauuc

SEQ ID NO: 1251244 - RNA, 19 nt, Homo sapiens
gcccagagucgcugaucuu

SEQ ID NO: 1251245 - RNA, 19 nt, Homo sapiens
ucagggaccaggaagcuau

SEQ ID NO: 1251246 - RNA, 19 nt, Homo sapiens
gcagcaacgccucccaauc

SEQ ID NO: 1251247 - RNA, 19 nt, Homo sapiens
gggcuccccugcuguguuu

SEQ ID NO: 1251248 - RNA, 19 nt, Homo sapiens
ggccgugacugacgagaac

SEQ ID NO: 1251249 - RNA, 19 nt, Homo sapiens
ucaaacacaccaauaaagc

SEQ ID NO: 1251250 - RNA, 19 nt, Homo sapiens
gcauuugucacuuccaucu

SEQ ID NO: 1251251 - RNA, 19 nt, Homo sapiens
agaccgagccagaguuuag

SEQ ID NO: 1251252 - RNA, 19 nt, Homo sapiens
caaccagccgucaagaaca

SEQ ID NO: 1251253 - RNA, 19 nt, Homo sapiens
ggggagggcuucucagauc

SEQ ID NO: 1251254 - RNA, 19 nt, Homo sapiens
ugccauccaucccugagaa

SEQ ID NO: 1251255 - RNA, 19 nt, Homo sapiens
ucacagagccccuaauucu

SEQ ID NO: 1251256 - RNA, 19 nt, Homo sapiens
cagccugcccaacauacua

SEQ ID NO: 1251257 - RNA, 19 nt, Homo sapiens
gagcgagauucuggacagu

SEQ ID NO: 1251258 - RNA, 19 nt, Homo sapiens
ggagggcuucucagaucaa

SEQ ID NO: 1251259 - RNA, 19 nt, Homo sapiens
gccggcaaccgcagauuug

SEQ ID NO: 1251260 - RNA, 19 nt, Homo sapiens
cagagccuucuaauguaua

SEQ ID NO: 1251261 - RNA, 19 nt, Homo sapiens
ccaaccagccgucaagaac

SEQ ID NO: 1251262 - RNA, 19 nt, Homo sapiens
gagggcuucucagaucaau

SEQ ID NO: 1251263 - RNA, 19 nt, Homo sapiens
gcaccugcagcuguucaaa

SEQ ID NO: 1251264 - RNA, 19 nt, Homo sapiens
caaacacaccaauaaagcu

SEQ ID NO: 1251265 - RNA, 19 nt, Homo sapiens
uaaauucugcuucccuuuu

SEQ ID NO: 1251266 - RNA, 19 nt, Homo sapiens
gcuuugaggguuaagaauc

SEQ ID NO: 1251267 - RNA, 19 nt, Homo sapiens
ucucggcauuugucacuuc

SEQ ID NO: 1251268 - RNA, 19 nt, Homo sapiens
gugcuuugaggguuaagaa

SEQ ID NO: 1251269 - RNA, 19 nt, Homo sapiens
gagaccgagccagaguuua

SEQ ID NO: 1251270 - RNA, 19 nt, Homo sapiens
gcuccuggccgagagaaga

SEQ ID NO: 1251271 - RNA, 19 nt, Homo sapiens
cuccuggucuucuagaauc

SEQ ID NO: 1251272 - RNA, 19 nt, Homo sapiens
ggcaaccagacgauaagaa

SEQ ID NO: 1251273 - RNA, 19 nt, Homo sapiens
gaccuggacagcugcuuca

SEQ ID NO: 1251274 - RNA, 19 nt, Homo sapiens
aaccagccgucaagaacau

SEQ ID NO: 1251275 - RNA, 19 nt, Homo sapiens
gaaggggugucccgucucu

SEQ ID NO: 1251276 - RNA, 19 nt, Homo sapiens
gcaagaaccugagccuuua

SEQ ID NO: 1251277 - RNA, 19 nt, Homo sapiens
ggacacagguacauccaua

SEQ ID NO: 1251278 - RNA, 19 nt, Homo sapiens
gauagacaaucgacauuaa

SEQ ID NO: 1251279 - RNA, 19 nt, Homo sapiens
guagaaaccuguguauuug

SEQ ID NO: 1251280 - RNA, 19 nt, Homo sapiens
ccaaaccacuguacccaua

SEQ ID NO: 1251281 - RNA, 19 nt, Homo sapiens
gaccagcucuccuaccuuu

SEQ ID NO: 1251282 - RNA, 19 nt, Homo sapiens
ggauguccaugguagaaua

SEQ ID NO: 1251283 - RNA, 19 nt, Homo sapiens
gcagcaagauuuguuaaug

SEQ ID NO: 1251284 - RNA, 19 nt, Homo sapiens
caaguuuguucaacguuua

SEQ ID NO: 1251285 - RNA, 19 nt, Homo sapiens
gaucauguuugcuuguaaa

SEQ ID NO: 1251286 - RNA, 19 nt, Homo sapiens
gaaacaagggugacuguga

SEQ ID NO: 1251287 - RNA, 19 nt, Homo sapiens
guauauacuugacugguaa

SEQ ID NO: 1251288 - RNA, 19 nt, Homo sapiens
guauaaaucucccuggaau

SEQ ID NO: 1251289 - RNA, 19 nt, Homo sapiens
acaaacagguaaucaaaga

SEQ ID NO: 1251290 - RNA, 19 nt, Homo sapiens
gugaagaaauaaucuguug

SEQ ID NO: 1251291 - RNA, 19 nt, Homo sapiens
aaacaagggugacugugaa

SEQ ID NO: 1251292 - RNA, 19 nt, Homo sapiens
acacacagcuugcuuugga

SEQ ID NO: 1251293 - RNA, 19 nt, Homo sapiens
aaauuaaccucaugacaga

SEQ ID NO: 1251294 - RNA, 19 nt, Homo sapiens
gcuacuuuguuuacaguua

SEQ ID NO: 1251295 - RNA, 19 nt, Homo sapiens
caacacggagguaucuuua

SEQ ID NO: 1251296 - RNA, 19 nt, Homo sapiens
gaaauugucaacccucuga

SEQ ID NO: 1251297 - RNA, 19 nt, Homo sapiens
agagaaagagcgauuauuu

SEQ ID NO: 1251298 - RNA, 19 nt, Homo sapiens
gagacuguccagaaauuua

SEQ ID NO: 1251299 - RNA, 19 nt, Homo sapiens
guacccauaucgaacaauu

SEQ ID NO: 1251300 - RNA, 19 nt, Homo sapiens
aacguuaucucaagaagua

SEQ ID NO: 1251301 - RNA, 19 nt, Homo sapiens
gagcgauuauuucuuguau

SEQ ID NO: 1251302 - RNA, 19 nt, Homo sapiens
gaacacacagcuugcuuug

SEQ ID NO: 1251303 - RNA, 19 nt, Homo sapiens
caccagcuuuggcuucuua

SEQ ID NO: 1251304 - RNA, 19 nt, Homo sapiens
agagaaagcuugggugaug

SEQ ID NO: 1251305 - RNA, 19 nt, Homo sapiens
gagcguacaacaaguauau

SEQ ID NO: 1251306 - RNA, 19 nt, Homo sapiens
guucaacguuuacuuuaug

SEQ ID NO: 1251307 - RNA, 19 nt, Homo sapiens
ccucaugacagauuuauuu

SEQ ID NO: 1251308 - RNA, 19 nt, Homo sapiens
cagcaagauuuguuaaugu

SEQ ID NO: 1251309 - RNA, 19 nt, Homo sapiens
cgacuuuaguagcaucaua

SEQ ID NO: 1251310 - RNA, 19 nt, Homo sapiens
caacagaagauuugaucaa

SEQ ID NO: 1251311 - RNA, 19 nt, Homo sapiens
aguagaaaccuguguauuu

SEQ ID NO: 1251312 - RNA, 19 nt, Homo sapiens
gcaagcagcaagauuuguu

SEQ ID NO: 1251313 - RNA, 19 nt, Homo sapiens
gaaucugcaugugcuguuu

SEQ ID NO: 1251314 - RNA, 19 nt, Homo sapiens
gcagccuucuucuuggaua

SEQ ID NO: 1251315 - RNA, 19 nt, Homo sapiens
ccagucuguuccuauguua

SEQ ID NO: 1251316 - RNA, 19 nt, Homo sapiens
ucagaaaacugcagagaaa

SEQ ID NO: 1251317 - RNA, 19 nt, Homo sapiens
gaauggcauacuucaauuu

SEQ ID NO: 1251318 - RNA, 19 nt, Homo sapiens
gggaagaccagcucuccua

SEQ ID NO: 1251319 - RNA, 19 nt, Homo sapiens
gaucuuggccucacuacug

SEQ ID NO: 1251320 - RNA, 19 nt, Homo sapiens
gccuuuaccuggacaaguu

SEQ ID NO: 1251321 - RNA, 19 nt, Homo sapiens
caacagcauuuaucaacag

SEQ ID NO: 1251322 - RNA, 19 nt, Homo sapiens
gauaaauugugaucuugca

SEQ ID NO: 1251323 - RNA, 19 nt, Homo sapiens
auacuugacugguaauguu

SEQ ID NO: 1251324 - RNA, 19 nt, Homo sapiens
ggaucauguuugcuuguaa

SEQ ID NO: 1251325 - RNA, 19 nt, Homo sapiens
gaacacaggaaggaucuug

SEQ ID NO: 1251326 - RNA, 19 nt, Homo sapiens
ucaacccucugaugcagua

SEQ ID NO: 1251327 - RNA, 19 nt, Homo sapiens
gaacucccuuccucuccaa

SEQ ID NO: 1251328 - RNA, 19 nt, Homo sapiens
acacaaacagguaaucaaa

SEQ ID NO: 1251329 - RNA, 19 nt, Homo sapiens
ucccuggaauuuaguauaa

SEQ ID NO: 1251330 - RNA, 19 nt, Homo sapiens
uguauauacuugacuggua

SEQ ID NO: 1251331 - RNA, 19 nt, Homo sapiens
gcacucugcuggccuuucu

SEQ ID NO: 1251332 - RNA, 19 nt, Homo sapiens
aaucaaacguuaucucaag

SEQ ID NO: 1251333 - RNA, 19 nt, Homo sapiens
gcuggacggcuucuugaua

SEQ ID NO: 1251334 - RNA, 19 nt, Homo sapiens
gcagagaaagagcgauuau

SEQ ID NO: 1251335 - RNA, 19 nt, Homo sapiens
gaggaaucauugacgaugu

SEQ ID NO: 1251336 - RNA, 19 nt, Homo sapiens
ggagaaauuaaccucauga

SEQ ID NO: 1251337 - RNA, 19 nt, Homo sapiens
gaauuugagcguacaacaa

SEQ ID NO: 1251338 - RNA, 19 nt, Homo sapiens
gaacgaugaauccaaaugg

SEQ ID NO: 1251339 - RNA, 19 nt, Homo sapiens
gauuagaagccuuuguuug

SEQ ID NO: 1251340 - RNA, 19 nt, Homo sapiens
caagcagcaagauuuguua

SEQ ID NO: 1251341 - RNA, 19 nt, Homo sapiens
ggaacuagaauggcugauu

SEQ ID NO: 1251342 - RNA, 19 nt, Homo sapiens
gcuauuuagagguuuguua

SEQ ID NO: 1251343 - RNA, 19 nt, Homo sapiens
guucguguccgaguauuua

SEQ ID NO: 1251344 - RNA, 19 nt, Homo sapiens
uuaauguccuugguuauga

SEQ ID NO: 1251345 - RNA, 19 nt, Homo sapiens
caaauucgacccucacaca

SEQ ID NO: 1251346 - RNA, 19 nt, Homo sapiens
ggauuagaagccuuuguuu

SEQ ID NO: 1251347 - RNA, 19 nt, Homo sapiens
caugguagaauaagagaaa

SEQ ID NO: 1251348 - RNA, 19 nt, Homo sapiens
ugagacgacuuuaguagca

SEQ ID NO: 1251349 - RNA, 19 nt, Homo sapiens
aagaagggcuguaccugau

SEQ ID NO: 1251350 - RNA, 19 nt, Homo sapiens
caauucauauggugcuaau

SEQ ID NO: 1251351 - RNA, 19 nt, Homo sapiens
gaugugaugaaagaacuua

SEQ ID NO: 1251352 - RNA, 19 nt, Homo sapiens
uuaaaggguucccaauaca

SEQ ID NO: 1251353 - RNA, 19 nt, Homo sapiens
gaucaacagcauuuaucaa

SEQ ID NO: 1251354 - RNA, 19 nt, Homo sapiens
gguaaucaaagagauguuu

SEQ ID NO: 1251355 - RNA, 19 nt, Homo sapiens
aaacagguaaucaaagaga

SEQ ID NO: 1251356 - RNA, 19 nt, Homo sapiens
cagcuuuggcuucuuauga

SEQ ID NO: 1251357 - RNA, 19 nt, Homo sapiens
ugagugaggaagcaauuaa

SEQ ID NO: 1251358 - RNA, 19 nt, Homo sapiens
gcaguagaaaccuguguau

SEQ ID NO: 1251359 - RNA, 19 nt, Homo sapiens
augcauggguuaugacuug

SEQ ID NO: 1251360 - RNA, 19 nt, Homo sapiens
uagaagccuuuguuugugu

SEQ ID NO: 1251361 - RNA, 19 nt, Homo sapiens
gcauuuaucaacagaagau

SEQ ID NO: 1251362 - RNA, 19 nt, Homo sapiens
ucacgacugguuaagauuu

SEQ ID NO: 1251363 - RNA, 19 nt, Homo sapiens
gaaauguauccaccacuca

SEQ ID NO: 1251364 - RNA, 19 nt, Homo sapiens
ugacaguguugagcaagaa

SEQ ID NO: 1251365 - RNA, 19 nt, Homo sapiens
agcaggcaaugaagaauuu

SEQ ID NO: 1251366 - RNA, 19 nt, Homo sapiens
ucaacagcauuuaucaaca

SEQ ID NO: 1251367 - RNA, 19 nt, Homo sapiens
gagcuggacggcuucuuga

SEQ ID NO: 1251368 - RNA, 19 nt, Homo sapiens
gacuauacgggaagaauug

SEQ ID NO: 1251369 - RNA, 19 nt, Homo sapiens
ccaacacggagguaucuuu

SEQ ID NO: 1251370 - RNA, 19 nt, Homo sapiens
ugauagacaaucgacauua

SEQ ID NO: 1251371 - RNA, 19 nt, Homo sapiens
aaagagauguuugucuaag

SEQ ID NO: 1251372 - RNA, 19 nt, Homo sapiens
uuuaaaggguucccaauac

SEQ ID NO: 1251373 - RNA, 19 nt, Homo sapiens
ucacuacuguuugggaaga

SEQ ID NO: 1251374 - RNA, 19 nt, Homo sapiens
aggaagcaauuaaaucugu

SEQ ID NO: 1251375 - RNA, 19 nt, Homo sapiens
agaaaccuguguauuugau

SEQ ID NO: 1251376 - RNA, 19 nt, Homo sapiens
gaacggauuucauuucuaa

SEQ ID NO: 1251377 - RNA, 19 nt, Homo sapiens
gaagagaaaucccucaugu

SEQ ID NO: 1251378 - RNA, 19 nt, Homo sapiens
ggagcaggaugucuuauuu

SEQ ID NO: 1251379 - RNA, 19 nt, Homo sapiens
gaacaaugccaacgaugua

SEQ ID NO: 1251380 - RNA, 19 nt, Homo sapiens
gcagugaggugcuaaguca

SEQ ID NO: 1251381 - RNA, 19 nt, Homo sapiens
gaagaaggguggagcuaug

SEQ ID NO: 1251382 - RNA, 19 nt, Homo sapiens
gcaaugagaugguguucug

SEQ ID NO: 1251383 - RNA, 19 nt, Homo sapiens
gaucgaauaugaugaagau

SEQ ID NO: 1251384 - RNA, 19 nt, Homo sapiens
gauugacacugacaccuua

SEQ ID NO: 1251385 - RNA, 19 nt, Homo sapiens
guacuuaaguuacucagau

SEQ ID NO: 1251386 - RNA, 19 nt, Homo sapiens
gggaaugccugaacuagau

SEQ ID NO: 1251387 - RNA, 19 nt, Homo sapiens
acacugagauugcugaaug

SEQ ID NO: 1251388 - RNA, 19 nt, Homo sapiens
cuacagauguguuguuugu

SEQ ID NO: 1251389 - RNA, 19 nt, Homo sapiens
caggaugucuuauuuagga

SEQ ID NO: 1251390 - RNA, 19 nt, Homo sapiens
ccaaagcacagcucacaua

SEQ ID NO: 1251391 - RNA, 19 nt, Homo sapiens
gugaugggcuuaugaagga

SEQ ID NO: 1251392 - RNA, 19 nt, Homo sapiens
gcacagcucacauaggaaa

SEQ ID NO: 1251393 - RNA, 19 nt, Homo sapiens
gagcaggaugucuuauuua

SEQ ID NO: 1251394 - RNA, 19 nt, Homo sapiens
aagcacagcucacauagga

SEQ ID NO: 1251395 - RNA, 19 nt, Homo sapiens
uaacaugcacuucuaauuc

SEQ ID NO: 1251396 - RNA, 19 nt, Homo sapiens
caagaagucuauuguuugg

SEQ ID NO: 1251397 - RNA, 19 nt, Homo sapiens
cgaauaugaugaagauguu

SEQ ID NO: 1251398 - RNA, 19 nt, Homo sapiens
gcuaugaccucaaugacau

SEQ ID NO: 1251399 - RNA, 19 nt, Homo sapiens
ggaaagaccugggaaacac

SEQ ID NO: 1251400 - RNA, 19 nt, Homo sapiens
cacugucgcuguuuaagua

SEQ ID NO: 1251401 - RNA, 19 nt, Homo sapiens
ccgauuaaauucauuagug

SEQ ID NO: 1251402 - RNA, 19 nt, Homo sapiens
ggcuggaacugaccaauga

SEQ ID NO: 1251403 - RNA, 19 nt, Homo sapiens
gguaaacucauuguacaua

SEQ ID NO: 1251404 - RNA, 19 nt, Homo sapiens
gguugugucugaagagaaa

SEQ ID NO: 1251405 - RNA, 19 nt, Homo sapiens
ugagaaggauaaacuggaa

SEQ ID NO: 1251406 - RNA, 19 nt, Homo sapiens
gaaacaguguagggaaaga

SEQ ID NO: 1251407 - RNA, 19 nt, Homo sapiens
gcugcuggcuaccgauuaa

SEQ ID NO: 1251408 - RNA, 19 nt, Homo sapiens
ggcugaggcuugcuaauug

SEQ ID NO: 1251409 - RNA, 19 nt, Homo sapiens
ugccugaacuagaugaaua

SEQ ID NO: 1251410 - RNA, 19 nt, Homo sapiens
guacccaaguggccugaaa

SEQ ID NO: 1251411 - RNA, 19 nt, Homo sapiens
guagaacaaugccaacgau

SEQ ID NO: 1251412 - RNA, 19 nt, Homo sapiens
ggugcuaagucaucacuga

SEQ ID NO: 1251413 - RNA, 19 nt, Homo sapiens
ggaauucccaguacuguca

SEQ ID NO: 1251414 - RNA, 19 nt, Homo sapiens
caccaggccuguuauggaa

SEQ ID NO: 1251415 - RNA, 19 nt, Homo sapiens
gagaugguguucugugaca

SEQ ID NO: 1251416 - RNA, 19 nt, Homo sapiens
ugaugaagauguugucugu

SEQ ID NO: 1251417 - RNA, 19 nt, Homo sapiens
ggaacugaccaaugaagaa

SEQ ID NO: 1251418 - RNA, 19 nt, Homo sapiens
uagagcaucuuccacauca

SEQ ID NO: 1251419 - RNA, 19 nt, Homo sapiens
gaaaaugacccaaggaguu

SEQ ID NO: 1251420 - RNA, 19 nt, Homo sapiens
gcauggcccuguuagagau

SEQ ID NO: 1251421 - RNA, 19 nt, Homo sapiens
ggguaaugauugacacuga

SEQ ID NO: 1251422 - RNA, 19 nt, Homo sapiens
gcacuucuaauucuaaaca

SEQ ID NO: 1251423 - RNA, 19 nt, Homo sapiens
gaagugaaagucuuaaagg

SEQ ID NO: 1251424 - RNA, 19 nt, Homo sapiens
uguuagagauggcguagaa

SEQ ID NO: 1251425 - RNA, 19 nt, Homo sapiens
gcaccaggccuguuaugga

SEQ ID NO: 1251426 - RNA, 19 nt, Homo sapiens
gaacugaccaaugaagaau

SEQ ID NO: 1251427 - RNA, 19 nt, Homo sapiens
agaaaucccucauguucau

SEQ ID NO: 1251428 - RNA, 19 nt, Homo sapiens
gggaaacacuggaccaaaa

SEQ ID NO: 1251429 - RNA, 19 nt, Homo sapiens
agaaguacaucgugucauc

SEQ ID NO: 1251430 - RNA, 19 nt, Homo sapiens
cccgacaccugcuguaauu

SEQ ID NO: 1251431 - RNA, 19 nt, Homo sapiens
acagauguguuguuuguca

SEQ ID NO: 1251432 - RNA, 19 nt, Homo sapiens
agagaaaucccucauguuc

SEQ ID NO: 1251433 - RNA, 19 nt, Homo sapiens
gagaaacagggaauaaauc

SEQ ID NO: 1251434 - RNA, 19 nt, Homo sapiens
agauuaacaugcacuucua

SEQ ID NO: 1251435 - RNA, 19 nt, Homo sapiens
caugagcuauggagucaga

SEQ ID NO: 1251436 - RNA, 19 nt, Homo sapiens
guacauaugugcaaaacug

SEQ ID NO: 1251437 - RNA, 19 nt, Homo sapiens
cagcgaugcuacgacaaua

SEQ ID NO: 1251438 - RNA, 19 nt, Homo sapiens
gcauuuccuucugcuguuu

SEQ ID NO: 1251439 - RNA, 19 nt, Homo sapiens
ccaugucucuguugugugu

SEQ ID NO: 1251440 - RNA, 19 nt, Homo sapiens
uauagugacuuagagaaga

SEQ ID NO: 1251441 - RNA, 19 nt, Homo sapiens
gaagauguugucugugaug

SEQ ID NO: 1251442 - RNA, 19 nt, Homo sapiens
augaagauguugucuguga

SEQ ID NO: 1251443 - RNA, 19 nt, Homo sapiens
gagauggcguagaagugaa

SEQ ID NO: 1251444 - RNA, 19 nt, Homo sapiens
aagaagacuuugccucuca

SEQ ID NO: 1251445 - RNA, 19 nt, Homo sapiens
ccaaguggccugaaacagu

SEQ ID NO: 1251446 - RNA, 19 nt, Homo sapiens
gagaagaagaugcaaagag

SEQ ID NO: 1251447 - RNA, 19 nt, Homo sapiens
uggauuuccuguaccagua

SEQ ID NO: 1251448 - RNA, 19 nt, Homo sapiens
gagaaaucccucauguuca

SEQ ID NO: 1251449 - RNA, 19 nt, Homo sapiens
ggaugaguacuauguguug

SEQ ID NO: 1251450 - RNA, 19 nt, Homo sapiens
ugagaaacagggaauaaau

SEQ ID NO: 1251451 - RNA, 19 nt, Homo sapiens
ucacugaggcugugugugu

SEQ ID NO: 1251452 - RNA, 19 nt, Homo sapiens
acacaugcauauaucuguu

SEQ ID NO: 1251453 - RNA, 19 nt, Homo sapiens
cugaggaaguaguggauuu

SEQ ID NO: 1251454 - RNA, 19 nt, Homo sapiens
acugaccaaugaagaauuu

SEQ ID NO: 1251455 - RNA, 19 nt, Homo sapiens
ugccaacgauguaugagaa

SEQ ID NO: 1251456 - RNA, 19 nt, Homo sapiens
uaaacuggaauccugguaa

SEQ ID NO: 1251457 - RNA, 19 nt, Homo sapiens
gcguagaagugaaagucuu

SEQ ID NO: 1251458 - RNA, 19 nt, Homo sapiens
ccagucauauacucucaga

SEQ ID NO: 1251459 - RNA, 19 nt, Homo sapiens
gcaguuggaggaugaguuc

SEQ ID NO: 1251460 - RNA, 19 nt, Homo sapiens
gaauccggaugaguacuau

SEQ ID NO: 1251461 - RNA, 19 nt, Homo sapiens
ucaucacugucgcuguuua

SEQ ID NO: 1251462 - RNA, 19 nt, Homo sapiens
uuacucagauuaacaugca

SEQ ID NO: 1251463 - RNA, 19 nt, Homo sapiens
aaagggagcauuagagauc

SEQ ID NO: 1251464 - RNA, 19 nt, Homo sapiens
cguagaagugaaagucuua

SEQ ID NO: 1251465 - RNA, 19 nt, Homo sapiens
ugacaaaugcaacaucugu

SEQ ID NO: 1251466 - RNA, 19 nt, Homo sapiens
gauguugucugugaugucu

SEQ ID NO: 1251467 - RNA, 19 nt, Homo sapiens
ugaaugagccccaagaaaa

SEQ ID NO: 1251468 - RNA, 19 nt, Homo sapiens
gauagccagucauauacuc

SEQ ID NO: 1251469 - RNA, 19 nt, Homo sapiens
uggagaggguaaugauuga

SEQ ID NO: 1251470 - RNA, 19 nt, Homo sapiens
uuaggaggcugcagcuguu

SEQ ID NO: 1251471 - RNA, 19 nt, Homo sapiens
gcggcugccugaggaagua

SEQ ID NO: 1251472 - RNA, 19 nt, Homo sapiens
ccucugcaaugagaaguuu

SEQ ID NO: 1251473 - RNA, 19 nt, Homo sapiens
agaaaaugcuuguggugua

SEQ ID NO: 1251474 - RNA, 19 nt, Homo sapiens
gaggacaagaagucuauug

SEQ ID NO: 1251475 - RNA, 19 nt, Homo sapiens
ucucacaacuacauguaug

SEQ ID NO: 1251476 - RNA, 19 nt, Homo sapiens
uaagagcuguggugaauaa

SEQ ID NO: 1251477 - RNA, 19 nt, Homo sapiens
acacagcucuucucacuuu

SEQ ID NO: 1251478 - RNA, 19 nt, Homo sapiens
gcagaaagauuggauacug

SEQ ID NO: 1251479 - RNA, 19 nt, Homo sapiens
caccgaagcuucaggauga

SEQ ID NO: 1251480 - RNA, 19 nt, Homo sapiens
caacugcccucucccauca

SEQ ID NO: 1251481 - RNA, 19 nt, Homo sapiens
gagcuguggugaauaagaa

SEQ ID NO: 1251482 - RNA, 19 nt, Homo sapiens
gggcagcacuucuuugaau

SEQ ID NO: 1251483 - RNA, 19 nt, Homo sapiens
guuaaagacugcagaacaa

SEQ ID NO: 1251484 - RNA, 19 nt, Homo sapiens
gaacagaagaaacagaaga

SEQ ID NO: 1251485 - RNA, 19 nt, Homo sapiens
gcacugaguucauuucacu

SEQ ID NO: 1251486 - RNA, 19 nt, Homo sapiens
caaggccacuuccaagaaa

SEQ ID NO: 1251487 - RNA, 19 nt, Homo sapiens
ggacgagaguaaagaggaa

SEQ ID NO: 1251488 - RNA, 19 nt, Homo sapiens
ugaagucuguggacaugua

SEQ ID NO: 1251489 - RNA, 19 nt, Homo sapiens
ucacagaacugggcucaga

SEQ ID NO: 1251490 - RNA, 19 nt, Homo sapiens
guaaggcucugaccuccaa

SEQ ID NO: 1251491 - RNA, 19 nt, Homo sapiens
gaugggagcagaaagauug

SEQ ID NO: 1251492 - RNA, 19 nt, Homo sapiens
gcacuucuuugaauaccuu

SEQ ID NO: 1251493 - RNA, 19 nt, Homo sapiens
aauaagagcuguggugaau

SEQ ID NO: 1251494 - RNA, 19 nt, Homo sapiens
ggaagacugucacucucaa

SEQ ID NO: 1251495 - RNA, 19 nt, Homo sapiens
caaaucaacgagcauguuu

SEQ ID NO: 1251496 - RNA, 19 nt, Homo sapiens
caacacagaacacacuuug

SEQ ID NO: 1251497 - RNA, 19 nt, Homo sapiens
aaacuggugucugagauuu

SEQ ID NO: 1251498 - RNA, 19 nt, Homo sapiens
gcaaggccacuuccaagaa

SEQ ID NO: 1251499 - RNA, 19 nt, Homo sapiens
gauggaaggacaaguggua

SEQ ID NO: 1251500 - RNA, 19 nt, Homo sapiens
gcuucaaacuggugucuga

SEQ ID NO: 1251501 - RNA, 19 nt, Homo sapiens
gaagaaguuugugaagaca

SEQ ID NO: 1251502 - RNA, 19 nt, Homo sapiens
ggcagcacuucuuugaaua

SEQ ID NO: 1251503 - RNA, 19 nt, Homo sapiens
guuagaagcugcugcaacu

SEQ ID NO: 1251504 - RNA, 19 nt, Homo sapiens
gugaagaaguuugugaaga

SEQ ID NO: 1251505 - RNA, 19 nt, Homo sapiens
agacacagcucuucucacu

SEQ ID NO: 1251506 - RNA, 19 nt, Homo sapiens
ucaagauugugggccauua

SEQ ID NO: 1251507 - RNA, 19 nt, Homo sapiens
ggacagcccuauggaagag

SEQ ID NO: 1251508 - RNA, 19 nt, Homo sapiens
gagaagagacaucagaucu

SEQ ID NO: 1251509 - RNA, 19 nt, Homo sapiens
cagaagaaaccaagggaaa

SEQ ID NO: 1251510 - RNA, 19 nt, Homo sapiens
gccauuaugcuuccuauau

SEQ ID NO: 1251511 - RNA, 19 nt, Homo sapiens
gaugauuacgagccuauaa

SEQ ID NO: 1251512 - RNA, 19 nt, Homo sapiens
ugaagaaguuugugaagac

SEQ ID NO: 1251513 - RNA, 19 nt, Homo sapiens
ggaaacaguaguacaugug

SEQ ID NO: 1251514 - RNA, 19 nt, Homo sapiens
aaaguguacugcaucauca

SEQ ID NO: 1251515 - RNA, 19 nt, Homo sapiens
cauguaaggacgagaguaa

SEQ ID NO: 1251516 - RNA, 19 nt, Homo sapiens
ugaauaccuucuugugguu

SEQ ID NO: 1251517 - RNA, 19 nt, Homo sapiens
gaaacaguaguacaugugu

SEQ ID NO: 1251518 - RNA, 19 nt, Homo sapiens
caagaccaaccgccgauuu

SEQ ID NO: 1251519 - RNA, 19 nt, Homo sapiens
aaacuucuauucccucucu

SEQ ID NO: 1251520 - RNA, 19 nt, Homo sapiens
uaaugucgguuggugauga

SEQ ID NO: 1251521 - RNA, 19 nt, Homo sapiens
guagacacuugguuagaag

SEQ ID NO: 1251522 - RNA, 19 nt, Homo sapiens
gacuagagcuacacaccau

SEQ ID NO: 1251523 - RNA, 19 nt, Homo sapiens
ccauuaugcuuccuauauc

SEQ ID NO: 1251524 - RNA, 19 nt, Homo sapiens
ggucaaucuuugugaagga

SEQ ID NO: 1251525 - RNA, 19 nt, Homo sapiens
aaagaagcguucagaggau

SEQ ID NO: 1251526 - RNA, 19 nt, Homo sapiens
ucaccagucugucuguguu

SEQ ID NO: 1251527 - RNA, 19 nt, Homo sapiens
gcuggucaaucuuugugaa

SEQ ID NO: 1251528 - RNA, 19 nt, Homo sapiens
uguagacacuugguuagaa

SEQ ID NO: 1251529 - RNA, 19 nt, Homo sapiens
gagauuuggaucccuggua

SEQ ID NO: 1251530 - RNA, 19 nt, Homo sapiens
cauuaugcuuccuauauca

SEQ ID NO: 1251531 - RNA, 19 nt, Homo sapiens
caaaguguacugcaucauc

SEQ ID NO: 1251532 - RNA, 19 nt, Homo sapiens
auaaucaccuaccaauuuc

SEQ ID NO: 1251533 - RNA, 19 nt, Homo sapiens
guaggaaacaguaguacau

SEQ ID NO: 1251534 - RNA, 19 nt, Homo sapiens
gccgauuugugaagaaguu

SEQ ID NO: 1251535 - RNA, 19 nt, Homo sapiens
gaagucuguggacauguaa

SEQ ID NO: 1251536 - RNA, 19 nt, Homo sapiens
ugaauaagaaugacuagag

SEQ ID NO: 1251537 - RNA, 19 nt, Homo sapiens
gaauaugaggaacagaaga

SEQ ID NO: 1251538 - RNA, 19 nt, Homo sapiens
ggagcagaaagauuggaua

SEQ ID NO: 1251539 - RNA, 19 nt, Homo sapiens
guaaggacgagaguaaaga

SEQ ID NO: 1251540 - RNA, 19 nt, Homo sapiens
gcucagccucucuacauga

SEQ ID NO: 1251541 - RNA, 19 nt, Homo sapiens
acacagguaggaaacagua

SEQ ID NO: 1251542 - RNA, 19 nt, Homo sapiens
cuucaugguuggaguacaa

SEQ ID NO: 1251543 - RNA, 19 nt, Homo sapiens
guucagaggaugauuacga

SEQ ID NO: 1251544 - RNA, 19 nt, Homo sapiens
uggcuuggcuucacagagu

SEQ ID NO: 1251545 - RNA, 19 nt, Homo sapiens
ucacauccuucuugcucaa

SEQ ID NO: 1251546 - RNA, 19 nt, Homo sapiens
uaacaucuucaacacagaa

SEQ ID NO: 1251547 - RNA, 19 nt, Homo sapiens
ucaaacuggugucugagau

SEQ ID NO: 1251548 - RNA, 19 nt, Homo sapiens
caaacuggugucugagauu

SEQ ID NO: 1251549 - RNA, 19 nt, Homo sapiens
ggagaagagacaucagauc

SEQ ID NO: 1251550 - RNA, 19 nt, Homo sapiens
gaacauguggauuuuaguu

SEQ ID NO: 1251551 - RNA, 19 nt, Homo sapiens
gcugucaucuacccguuca

SEQ ID NO: 1251552 - RNA, 19 nt, Homo sapiens
gagcagaaagauuggauac

SEQ ID NO: 1251553 - RNA, 19 nt, Homo sapiens
agauuuggaucccugguau

SEQ ID NO: 1251554 - RNA, 19 nt, Homo sapiens
gaauccuccugcaggcuau

SEQ ID NO: 1251555 - RNA, 19 nt, Homo sapiens
aagaaugacuagagcuaca

SEQ ID NO: 1251556 - RNA, 19 nt, Homo sapiens
caggcuauuuccaacagaa

SEQ ID NO: 1251557 - RNA, 19 nt, Homo sapiens
gcaggcuauuuccaacaga

SEQ ID NO: 1251558 - RNA, 19 nt, Homo sapiens
uaaagacugcagaacaaau

SEQ ID NO: 1251559 - RNA, 19 nt, Homo sapiens
acaccuacaucccuguugu

SEQ ID NO: 1251560 - RNA, 19 nt, Homo sapiens
ggauuuuaguucucuauug

SEQ ID NO: 1251561 - RNA, 19 nt, Homo sapiens
cuagagcuacacaccauuu

SEQ ID NO: 1251562 - RNA, 19 nt, Homo sapiens
caucuuagacucucuuggu

SEQ ID NO: 1251563 - RNA, 19 nt, Homo sapiens
cuccauggcugucaucuac

SEQ ID NO: 1251564 - RNA, 19 nt, Homo sapiens
gagucuugguauccaggua

SEQ ID NO: 1251565 - RNA, 19 nt, Homo sapiens
gggaagacugucacucuca

SEQ ID NO: 1251566 - RNA, 19 nt, Homo sapiens
uggaugaaguggagaagag

SEQ ID NO: 1251567 - RNA, 19 nt, Homo sapiens
gcccucgccuucccaaagu

SEQ ID NO: 1251568 - RNA, 19 nt, Homo sapiens
gaucccugguauugauuuc

SEQ ID NO: 1251569 - RNA, 19 nt, Homo sapiens
gagcuacacaccauuucug

SEQ ID NO: 1251570 - RNA, 19 nt, Homo sapiens
aauaugaggaacagaagaa

SEQ ID NO: 1251571 - RNA, 19 nt, Homo sapiens
caagauugugggccauuau

SEQ ID NO: 1251572 - RNA, 19 nt, Homo sapiens
gcacaccuacaucccuguu

SEQ ID NO: 1251573 - RNA, 19 nt, Homo sapiens
ugaguucauuucacugaca

SEQ ID NO: 1251574 - RNA, 19 nt, Homo sapiens
ggaugggagcagaaagauu

SEQ ID NO: 1251575 - RNA, 19 nt, Homo sapiens
gaauaccuucuugugguuu

SEQ ID NO: 1251576 - RNA, 19 nt, Homo sapiens
ggcaacaaaugaagaaaua

SEQ ID NO: 1251577 - RNA, 19 nt, Homo sapiens
gggcgaagcucuaugaguu

SEQ ID NO: 1251578 - RNA, 19 nt, Homo sapiens
gaaacuucgucucuacuaa

SEQ ID NO: 1251579 - RNA, 19 nt, Homo sapiens
gaagaaauacaucggaguu

SEQ ID NO: 1251580 - RNA, 19 nt, Homo sapiens
ggacagagcagcccuggau

SEQ ID NO: 1251581 - RNA, 19 nt, Homo sapiens
uagcagagcugggcaacuu

SEQ ID NO: 1251582 - RNA, 19 nt, Homo sapiens
caaccagaccucagacuuu

SEQ ID NO: 1251583 - RNA, 19 nt, Homo sapiens
aaccagaccucagacuuua

SEQ ID NO: 1251584 - RNA, 19 nt, Homo sapiens
caacuugucccaaaucuag

SEQ ID NO: 1251585 - RNA, 19 nt, Homo sapiens
gcuugagggucuaaggaua

SEQ ID NO: 1251586 - RNA, 19 nt, Homo sapiens
gaggacagcuuggguugga

SEQ ID NO: 1251587 - RNA, 19 nt, Homo sapiens
cgaauggcaucccaacaga

SEQ ID NO: 1251588 - RNA, 19 nt, Homo sapiens
gauccaggcugcguaugaa

SEQ ID NO: 1251589 - RNA, 19 nt, Homo sapiens
gaagcucuaugaguuuguu

SEQ ID NO: 1251590 - RNA, 19 nt, Homo sapiens
ggucagcauuucucacuuc

SEQ ID NO: 1251591 - RNA, 19 nt, Homo sapiens
gcgaguaaccggacuuguu

SEQ ID NO: 1251592 - RNA, 19 nt, Homo sapiens
ggaugucucugccuuaagg

SEQ ID NO: 1251593 - RNA, 19 nt, Homo sapiens
ucacuucaccuaucuucua

SEQ ID NO: 1251594 - RNA, 19 nt, Homo sapiens
gcgaagcucuaugaguuug

SEQ ID NO: 1251595 - RNA, 19 nt, Homo sapiens
cguaugaaguccugaguca

SEQ ID NO: 1251596 - RNA, 19 nt, Homo sapiens
guggaugucucugccuuaa

SEQ ID NO: 1251597 - RNA, 19 nt, Homo sapiens
ggugaaacuucgucucuac

SEQ ID NO: 1251598 - RNA, 19 nt, Homo sapiens
ucacaggcccacuggcaua

SEQ ID NO: 1251599 - RNA, 19 nt, Homo sapiens
gcauuucucacuucaccua

SEQ ID NO: 1251600 - RNA, 19 nt, Homo sapiens
ggaaccauccagucuugaa

SEQ ID NO: 1251601 - RNA, 19 nt, Homo sapiens
ggacugacucuuccuagca

SEQ ID NO: 1251602 - RNA, 19 nt, Homo sapiens
aaacuucgucucuacuaaa

SEQ ID NO: 1251603 - RNA, 19 nt, Homo sapiens
gggcuuggcuuaccuugcu

SEQ ID NO: 1251604 - RNA, 19 nt, Homo sapiens
gcaaccagaccucagacuu

SEQ ID NO: 1251605 - RNA, 19 nt, Homo sapiens
auggucaacuucuauauug

SEQ ID NO: 1251606 - RNA, 19 nt, Homo sapiens
gcacugauuagccuuucuu

SEQ ID NO: 1251607 - RNA, 19 nt, Homo sapiens
cgaguaaccggacuuguuc

SEQ ID NO: 1251608 - RNA, 19 nt, Homo sapiens
gccaauauggugaaacuuc

SEQ ID NO: 1251609 - RNA, 19 nt, Homo sapiens
ggccuuguggcacugauua

SEQ ID NO: 1251610 - RNA, 19 nt, Homo sapiens
uggcaucccaacagaguua

SEQ ID NO: 1251611 - RNA, 19 nt, Homo sapiens
gcaacuugucccaaaucua

SEQ ID NO: 1251612 - RNA, 19 nt, Homo sapiens
ggaguuaccaggagcuagu

SEQ ID NO: 1251613 - RNA, 19 nt, Homo sapiens
agaaauacaucggaguuac

SEQ ID NO: 1251614 - RNA, 19 nt, Homo sapiens
caucgccgcuacaaagcuu

SEQ ID NO: 1251615 - RNA, 19 nt, Homo sapiens
ggacuuguucugagaccuu

SEQ ID NO: 1251616 - RNA, 19 nt, Homo sapiens
ugaaacuucgucucuacua

SEQ ID NO: 1251617 - RNA, 19 nt, Homo sapiens
ccaacagaguuaaagaaac

SEQ ID NO: 1251618 - RNA, 19 nt, Homo sapiens
ggagauccaggcugcguau

SEQ ID NO: 1251619 - RNA, 19 nt, Homo sapiens
gggcaacaaaugaagaaau

SEQ ID NO: 1251620 - RNA, 19 nt, Homo sapiens
cauggucaacuucuauauu

SEQ ID NO: 1251621 - RNA, 19 nt, Homo sapiens
gcaccuguagucccagcua

SEQ ID NO: 1251622 - RNA, 19 nt, Homo sapiens
ggucaacuucuauauugug

SEQ ID NO: 1251623 - RNA, 19 nt, Homo sapiens
cccaacagaguuaaagaaa

SEQ ID NO: 1251624 - RNA, 19 nt, Homo sapiens
aagaaauacaucggaguua

SEQ ID NO: 1251625 - RNA, 19 nt, Homo sapiens
gaucuggaggcuacugaug

SEQ ID NO: 1251626 - RNA, 19 nt, Homo sapiens
aagcuuugguggcaucaga

SEQ ID NO: 1251627 - RNA, 19 nt, Homo sapiens
ugauuagccuuucuuccau

SEQ ID NO: 1251628 - RNA, 19 nt, Homo sapiens
gaaccauccagucuugaag

SEQ ID NO: 1251629 - RNA, 19 nt, Homo sapiens
ccucagcuauguggcagaa

SEQ ID NO: 1251630 - RNA, 19 nt, Homo sapiens
agaggagcgugcagcuuga

SEQ ID NO: 1251631 - RNA, 19 nt, Homo sapiens
gaucacgaggucaggaguu

SEQ ID NO: 1251632 - RNA, 19 nt, Homo sapiens
ggagugggcgaagcucuau

SEQ ID NO: 1251633 - RNA, 19 nt, Homo sapiens
cuauguggcagaaaccuuu

SEQ ID NO: 1251634 - RNA, 19 nt, Homo sapiens
gcagagccccuaacuggaa

SEQ ID NO: 1251635 - RNA, 19 nt, Homo sapiens
ccuguaaucccggcacuuu

SEQ ID NO: 1251636 - RNA, 19 nt, Homo sapiens
gcagagcugggcaacuugu

SEQ ID NO: 1251637 - RNA, 19 nt, Homo sapiens
ggcgaagcucuaugaguuu

SEQ ID NO: 1251638 - RNA, 19 nt, Homo sapiens
cacuucaccuaucuucuau

SEQ ID NO: 1251639 - RNA, 19 nt, Homo sapiens
gacuuguucugagaccuuu

SEQ ID NO: 1251640 - RNA, 19 nt, Homo sapiens
gaccucagacuuuaagaac

SEQ ID NO: 1251641 - RNA, 19 nt, Homo sapiens
gaccuuugcccuagaggau

SEQ ID NO: 1251642 - RNA, 19 nt, Homo sapiens
gaauugguucagcuucuuc

SEQ ID NO: 1251643 - RNA, 19 nt, Homo sapiens
ccucagacuuuaagaacac

SEQ ID NO: 1251644 - RNA, 19 nt, Homo sapiens
acagagcagcccuggauug

SEQ ID NO: 1251645 - RNA, 19 nt, Homo sapiens
gcuccuucuugaauugguu

SEQ ID NO: 1251646 - RNA, 19 nt, Homo sapiens
cuucaccuaucuucuaugg

SEQ ID NO: 1251647 - RNA, 19 nt, Homo sapiens
cuugagggucuaaggauaa

SEQ ID NO: 1251648 - RNA, 19 nt, Homo sapiens
uuucuuccauggucaacuu

SEQ ID NO: 1251649 - RNA, 19 nt, Homo sapiens
aaccggacuuguucugaga

SEQ ID NO: 1251650 - RNA, 19 nt, Homo sapiens
augaguuuguucacaguuu

SEQ ID NO: 1251651 - RNA, 19 nt, Homo sapiens
cagaaaccuuuggcuccuu

SEQ ID NO: 1251652 - RNA, 19 nt, Homo sapiens
ucagcuauguggcagaaac

SEQ ID NO: 1251653 - RNA, 19 nt, Homo sapiens
uagccauacugcccauuag

SEQ ID NO: 1251654 - RNA, 19 nt, Homo sapiens
guaaccggacuuguucuga

SEQ ID NO: 1251655 - RNA, 19 nt, Homo sapiens
ggcaacuugucccaaaucu

SEQ ID NO: 1251656 - RNA, 19 nt, Homo sapiens
ggucaacggagcgugaaga

SEQ ID NO: 1251657 - RNA, 19 nt, Homo sapiens
gugaaacuccgucucaaaa

SEQ ID NO: 1251658 - RNA, 19 nt, Homo sapiens
uagcuuugcccacgaaugg

SEQ ID NO: 1251659 - RNA, 19 nt, Homo sapiens
accaggagcuagugaaggu

SEQ ID NO: 1251660 - RNA, 19 nt, Homo sapiens
auagccauacugcccauua

SEQ ID NO: 1251661 - RNA, 19 nt, Homo sapiens
uggccaauauggugaaacu

SEQ ID NO: 1251662 - RNA, 19 nt, Homo sapiens
gggcaacuugucccaaauc

SEQ ID NO: 1251663 - RNA, 19 nt, Homo sapiens
ggaauuggagguggaacca

SEQ ID NO: 1251664 - RNA, 19 nt, Homo sapiens
gaaauacaucggaguuacc

SEQ ID NO: 1251665 - RNA, 19 nt, Homo sapiens
uggcuuaccuugcuuucac

SEQ ID NO: 1251666 - RNA, 19 nt, Homo sapiens
uggugaaacuucgucucua

SEQ ID NO: 1251667 - RNA, 19 nt, Homo sapiens
aggcucaggugcagaagca

SEQ ID NO: 1251668 - RNA, 19 nt, Homo sapiens
cuuccauggucaacuucua

SEQ ID NO: 1251669 - RNA, 19 nt, Homo sapiens
cgaagaaccuccuaacauu

SEQ ID NO: 1251670 - RNA, 19 nt, Homo sapiens
gaagaaagcagccaucaga

SEQ ID NO: 1251671 - RNA, 19 nt, Homo sapiens
gaaaugaaguauggaaaug

SEQ ID NO: 1251672 - RNA, 19 nt, Homo sapiens
gaaagagcauuuggaguug

SEQ ID NO: 1251673 - RNA, 19 nt, Homo sapiens
cuacaagaauguuuccuuu

SEQ ID NO: 1251674 - RNA, 19 nt, Homo sapiens
gaaagcagccaucagaaau

SEQ ID NO: 1251675 - RNA, 19 nt, Homo sapiens
guauagagaugugauguug

SEQ ID NO: 1251676 - RNA, 19 nt, Homo sapiens
caaggaauauuaugagaca

SEQ ID NO: 1251677 - RNA, 19 nt, Homo sapiens
ugaaagagcauuuggaguu

SEQ ID NO: 1251678 - RNA, 19 nt, Homo sapiens
gggaaauguugaugauaaa

SEQ ID NO: 1251679 - RNA, 19 nt, Homo sapiens
ugggaaauguugaugauaa

SEQ ID NO: 1251680 - RNA, 19 nt, Homo sapiens
caacagagcaucaguaagg

SEQ ID NO: 1251681 - RNA, 19 nt, Homo sapiens
caaauuaaaggcagugaaa

SEQ ID NO: 1251682 - RNA, 19 nt, Homo sapiens
gagaugugauguuggagaa

SEQ ID NO: 1251683 - RNA, 19 nt, Homo sapiens
ugaaaggacugggcaaaga

SEQ ID NO: 1251684 - RNA, 19 nt, Homo sapiens
ggaauaaagagaaagcuau

SEQ ID NO: 1251685 - RNA, 19 nt, Homo sapiens
ggaaauauagggaaaagua

SEQ ID NO: 1251686 - RNA, 19 nt, Homo sapiens
gaaggaaacaaggaaauau

SEQ ID NO: 1251687 - RNA, 19 nt, Homo sapiens
ggaggaggaaccagucaua

SEQ ID NO: 1251688 - RNA, 19 nt, Homo sapiens
uauaacaguucgauggaaa

SEQ ID NO: 1251689 - RNA, 19 nt, Homo sapiens
ggaaaugaaguauggaaau

SEQ ID NO: 1251690 - RNA, 19 nt, Homo sapiens
cagaaucucuccacgaagu

SEQ ID NO: 1251691 - RNA, 19 nt, Homo sapiens
gaaauggaacccuuaacau

SEQ ID NO: 1251692 - RNA, 19 nt, Homo sapiens
gaagaaccuccuaacauuc

SEQ ID NO: 1251693 - RNA, 19 nt, Homo sapiens
cagcaaauguggcagauac

SEQ ID NO: 1251694 - RNA, 19 nt, Homo sapiens
caacaugggucuauuuugu

SEQ ID NO: 1251695 - RNA, 19 nt, Homo sapiens
acaaggaaauauagggaaa

SEQ ID NO: 1251696 - RNA, 19 nt, Homo sapiens
gaauaaagagaaagcuaug

SEQ ID NO: 1251697 - RNA, 19 nt, Homo sapiens
gaauuuguauagagaugug

SEQ ID NO: 1251698 - RNA, 19 nt, Homo sapiens
gcaaaaguacuuccauuaa

SEQ ID NO: 1251699 - RNA, 19 nt, Homo sapiens
gcagccaucagaaauguuu

SEQ ID NO: 1251700 - RNA, 19 nt, Homo sapiens
guuuaaacaugcaacaaug

SEQ ID NO: 1251701 - RNA, 19 nt, Homo sapiens
cuaggugucuggaaaugaa

SEQ ID NO: 1251702 - RNA, 19 nt, Homo sapiens
cagcagaauuuguauagag

SEQ ID NO: 1251703 - RNA, 19 nt, Homo sapiens
ccuacugcauuauuaguuu

SEQ ID NO: 1251704 - RNA, 19 nt, Homo sapiens
uuuaaguccuacugcauua

SEQ ID NO: 1251705 - RNA, 19 nt, Homo sapiens
ggauguggccauagaauuc

SEQ ID NO: 1251706 - RNA, 19 nt, Homo sapiens
uaaguuaccuguggaggau

SEQ ID NO: 1251707 - RNA, 19 nt, Homo sapiens
cagagggaauaaagagaaa

SEQ ID NO: 1251708 - RNA, 19 nt, Homo sapiens
gaaaggacugggcaaagau

SEQ ID NO: 1251709 - RNA, 19 nt, Homo sapiens
gucccaaacuuacaaugaa

SEQ ID NO: 1251710 - RNA, 19 nt, Homo sapiens
ugaaggaaacaaggaaaua

SEQ ID NO: 1251711 - RNA, 19 nt, Homo sapiens
ccuucaaccuggaggaaua

SEQ ID NO: 1251712 - RNA, 19 nt, Homo sapiens
gaccacccauuacauguca

SEQ ID NO: 1251713 - RNA, 19 nt, Homo sapiens
ucagggauguggccauaga

SEQ ID NO: 1251714 - RNA, 19 nt, Homo sapiens
gcugggaaauguugaugau

SEQ ID NO: 1251715 - RNA, 19 nt, Homo sapiens
acgcuaagguguauugguu

SEQ ID NO: 1251716 - RNA, 19 nt, Homo sapiens
ggcaacagagcaucaguaa

SEQ ID NO: 1251717 - RNA, 19 nt, Homo sapiens
ccucuuuaauggcauguaa

SEQ ID NO: 1251718 - RNA, 19 nt, Homo sapiens
ggaacgcuaagguguauug

SEQ ID NO: 1251719 - RNA, 19 nt, Homo sapiens
gcaaaugcacucacuacuc

SEQ ID NO: 1251720 - RNA, 19 nt, Homo sapiens
caggaacgcuaagguguau

SEQ ID NO: 1251721 - RNA, 19 nt, Homo sapiens
caucaguggugcuucuaga

SEQ ID NO: 1251722 - RNA, 19 nt, Homo sapiens
ucacugugucccaaacuua

SEQ ID NO: 1251723 - RNA, 19 nt, Homo sapiens
gauauaacaguucgaugga

SEQ ID NO: 1251724 - RNA, 19 nt, Homo sapiens
gggaauaaagagaaagcua

SEQ ID NO: 1251725 - RNA, 19 nt, Homo sapiens
gaacucacugugucccaaa

SEQ ID NO: 1251726 - RNA, 19 nt, Homo sapiens
ggaauauuaugagacaaag

SEQ ID NO: 1251727 - RNA, 19 nt, Homo sapiens
cacaaggaauauuaugaga

SEQ ID NO: 1251728 - RNA, 19 nt, Homo sapiens
gaauaaagacccaguuuuc

SEQ ID NO: 1251729 - RNA, 19 nt, Homo sapiens
ggaggaaccagucauaacu

SEQ ID NO: 1251730 - RNA, 19 nt, Homo sapiens
acuuaaggcucccgugaaa

SEQ ID NO: 1251731 - RNA, 19 nt, Homo sapiens
caauggagcuggcaaaagu

SEQ ID NO: 1251732 - RNA, 19 nt, Homo sapiens
agaaagcagccaucagaaa

SEQ ID NO: 1251733 - RNA, 19 nt, Homo sapiens
gaggaggaaccagucauaa

SEQ ID NO: 1251734 - RNA, 19 nt, Homo sapiens
auagagaugugauguugga

SEQ ID NO: 1251735 - RNA, 19 nt, Homo sapiens
uuaacaaacucagacaugu

SEQ ID NO: 1251736 - RNA, 19 nt, Homo sapiens
gacaacagccucaaguucu

SEQ ID NO: 1251737 - RNA, 19 nt, Homo sapiens
gaaagaguccaagcagcaa

SEQ ID NO: 1251738 - RNA, 19 nt, Homo sapiens
cagaauuuguauagagaug

SEQ ID NO: 1251739 - RNA, 19 nt, Homo sapiens
caaacucagacauguuauu

SEQ ID NO: 1251740 - RNA, 19 nt, Homo sapiens
uggagcagguguucuuaga

SEQ ID NO: 1251741 - RNA, 19 nt, Homo sapiens
gcaaauguggcagauacuu

SEQ ID NO: 1251742 - RNA, 19 nt, Homo sapiens
gaugcugcucuuaguauuu

SEQ ID NO: 1251743 - RNA, 19 nt, Homo sapiens
aagagcauuuggaguugua

SEQ ID NO: 1251744 - RNA, 19 nt, Homo sapiens
gaugaaggaaacaaggaaa

SEQ ID NO: 1251745 - RNA, 19 nt, Homo sapiens
acaacagccucaaguucuu

SEQ ID NO: 1251746 - RNA, 19 nt, Homo sapiens
gcuguuuacacaaggaaua

SEQ ID NO: 1251747 - RNA, 19 nt, Homo sapiens
ggaugaaggaaacaaggaa

SEQ ID NO: 1251748 - RNA, 19 nt, Homo sapiens
agauauuccucuuuaaugg

SEQ ID NO: 1251749 - RNA, 19 nt, Homo sapiens
gggccucacuucccugcuu

SEQ ID NO: 1251750 - RNA, 19 nt, Homo sapiens
ugacaacagccucaaguuc

SEQ ID NO: 1251751 - RNA, 19 nt, Homo sapiens
gaaguauggaaaugaaauc

SEQ ID NO: 1251752 - RNA, 19 nt, Homo sapiens
ucagagggaauaaagagaa

SEQ ID NO: 1251753 - RNA, 19 nt, Homo sapiens
gagcaucaguaaggcaaca

SEQ ID NO: 1251754 - RNA, 19 nt, Homo sapiens
gggauguggccauagaauu

SEQ ID NO: 1251755 - RNA, 19 nt, Homo sapiens
cauaacugcaagcuguuua

SEQ ID NO: 1251756 - RNA, 19 nt, Homo sapiens
agaaauggaacccuuaaca

SEQ ID NO: 1251757 - RNA, 19 nt, Homo sapiens
ucaggaacgcuaaggugua

SEQ ID NO: 1251758 - RNA, 19 nt, Homo sapiens
ucccaaacuuacaaugaaa

SEQ ID NO: 1251759 - RNA, 19 nt, Homo sapiens
auacuucaggcuaccauua

SEQ ID NO: 1251760 - RNA, 19 nt, Homo sapiens
caaauguggcagauacuuc

SEQ ID NO: 1251761 - RNA, 19 nt, Homo sapiens
ugagaaauggaacccuuaa

SEQ ID NO: 1251762 - RNA, 19 nt, Homo sapiens
uucagaaucucuccacgaa

SEQ ID NO: 1251763 - RNA, 19 nt, Homo sapiens
acucagacauguuauucau

SEQ ID NO: 1251764 - RNA, 19 nt, Homo sapiens
uaaguccuacugcauuauu

SEQ ID NO: 1251765 - RNA, 19 nt, Homo sapiens
guacugcccucaggagaac

SEQ ID NO: 1251766 - RNA, 19 nt, Homo sapiens
cagccuccaucgcucugua

SEQ ID NO: 1251767 - RNA, 19 nt, Homo sapiens
aaguccuacugcauuauua

SEQ ID NO: 1251768 - RNA, 19 nt, Homo sapiens
gagcaggcgcugggaaaug

SEQ ID NO: 1251769 - RNA, 19 nt, Homo sapiens
gaagagcucucaaucaaga

SEQ ID NO: 1251770 - RNA, 19 nt, Homo sapiens
gaggagaugugcaauaaau

SEQ ID NO: 1251771 - RNA, 19 nt, Homo sapiens
gaagagagauauacaacag

SEQ ID NO: 1251772 - RNA, 19 nt, Homo sapiens
gggcauauauugaaaguca

SEQ ID NO: 1251773 - RNA, 19 nt, Homo sapiens
gaacuugcuuuaugaaucu

SEQ ID NO: 1251774 - RNA, 19 nt, Homo sapiens
ggugauaacguauagaaua

SEQ ID NO: 1251775 - RNA, 19 nt, Homo sapiens
cuaagaacuugcuuuauga

SEQ ID NO: 1251776 - RNA, 19 nt, Homo sapiens
ucuaagaacuugcuuuaug

SEQ ID NO: 1251777 - RNA, 19 nt, Homo sapiens
gcauacauauuuaggauag

SEQ ID NO: 1251778 - RNA, 19 nt, Homo sapiens
guugaucugucuaauauug

SEQ ID NO: 1251779 - RNA, 19 nt, Homo sapiens
uaagaggaguuuaagcuau

SEQ ID NO: 1251780 - RNA, 19 nt, Homo sapiens
cagcgaggcuuggugauaa

SEQ ID NO: 1251781 - RNA, 19 nt, Homo sapiens
guauuaaagucucccacua

SEQ ID NO: 1251782 - RNA, 19 nt, Homo sapiens
ucugggugcuccuguauua

SEQ ID NO: 1251783 - RNA, 19 nt, Homo sapiens
gaaucugggugcuccugua

SEQ ID NO: 1251784 - RNA, 19 nt, Homo sapiens
uaaagucucccacuauuau

SEQ ID NO: 1251785 - RNA, 19 nt, Homo sapiens
gcuaucauuuccagaugua

SEQ ID NO: 1251786 - RNA, 19 nt, Homo sapiens
ggagaugugcaauaaauau

SEQ ID NO: 1251787 - RNA, 19 nt, Homo sapiens
gagauucuauuuccacauc

SEQ ID NO: 1251788 - RNA, 19 nt, Homo sapiens
uggaggagaugugcaauaa

SEQ ID NO: 1251789 - RNA, 19 nt, Homo sapiens
aggaagagcucucaaucaa

SEQ ID NO: 1251790 - RNA, 19 nt, Homo sapiens
gagucuaagucuccuugua

SEQ ID NO: 1251791 - RNA, 19 nt, Homo sapiens
gaaggaagagcucucaauc

SEQ ID NO: 1251792 - RNA, 19 nt, Homo sapiens
cauauuggguggcuguuug

SEQ ID NO: 1251793 - RNA, 19 nt, Homo sapiens
gagcaggguaauaaugaua

SEQ ID NO: 1251794 - RNA, 19 nt, Homo sapiens
aaugauaccuaccuuacaa

SEQ ID NO: 1251795 - RNA, 19 nt, Homo sapiens
gaaggucagaagagagaua

SEQ ID NO: 1251796 - RNA, 19 nt, Homo sapiens
gagcugcagucugugcuaa

SEQ ID NO: 1251797 - RNA, 19 nt, Homo sapiens
gaggcuuggugauaacgua

SEQ ID NO: 1251798 - RNA, 19 nt, Homo sapiens
gcaucaagggcauauauug

SEQ ID NO: 1251799 - RNA, 19 nt, Homo sapiens
gagccuauaugugucuuug

SEQ ID NO: 1251800 - RNA, 19 nt, Homo sapiens
acacauacagcacucuaua

SEQ ID NO: 1251801 - RNA, 19 nt, Homo sapiens
gggagaauacauuaguuaa

SEQ ID NO: 1251802 - RNA, 19 nt, Homo sapiens
gguaaaauaugguccuaaa

SEQ ID NO: 1251803 - RNA, 19 nt, Homo sapiens
gugcauacauauuuaggau

SEQ ID NO: 1251804 - RNA, 19 nt, Homo sapiens
guaggucucuaagaacuug

SEQ ID NO: 1251805 - RNA, 19 nt, Homo sapiens
ccuuguaggucucuaagaa

SEQ ID NO: 1251806 - RNA, 19 nt, Homo sapiens
gaggugggucuccugaaua

SEQ ID NO: 1251807 - RNA, 19 nt, Homo sapiens
ucucuaagaacuugcuuua

SEQ ID NO: 1251808 - RNA, 19 nt, Homo sapiens
ggacuggacgugcggagaa

SEQ ID NO: 1251809 - RNA, 19 nt, Homo sapiens
guccggauccagagaaaua

SEQ ID NO: 1251810 - RNA, 19 nt, Homo sapiens
ggaguuuaagcuaucauuu

SEQ ID NO: 1251811 - RNA, 19 nt, Homo sapiens
gauucuauuuccacaucua

SEQ ID NO: 1251812 - RNA, 19 nt, Homo sapiens
uuaaagucucccacuauua

SEQ ID NO: 1251813 - RNA, 19 nt, Homo sapiens
cuguacacguugauuauuu

SEQ ID NO: 1251814 - RNA, 19 nt, Homo sapiens
gaacaucgucuggaggaau

SEQ ID NO: 1251815 - RNA, 19 nt, Homo sapiens
ugaggugggucuccugaau

SEQ ID NO: 1251816 - RNA, 19 nt, Homo sapiens
agaacuugcuuuaugaauc

SEQ ID NO: 1251817 - RNA, 19 nt, Homo sapiens
guccagagcugaguucaag

SEQ ID NO: 1251818 - RNA, 19 nt, Homo sapiens
gugaaaguauggaggagau

SEQ ID NO: 1251819 - RNA, 19 nt, Homo sapiens
gcacauccagaaagaagga

SEQ ID NO: 1251820 - RNA, 19 nt, Homo sapiens
ccauggcuuuccagaauga

SEQ ID NO: 1251821 - RNA, 19 nt, Homo sapiens
cacagcacauccagaaaga

SEQ ID NO: 1251822 - RNA, 19 nt, Homo sapiens
gaaauacacagcacaucca

SEQ ID NO: 1251823 - RNA, 19 nt, Homo sapiens
gaguuuaagcuaucauuuc

SEQ ID NO: 1251824 - RNA, 19 nt, Homo sapiens
gcauugaucccauuaccau

SEQ ID NO: 1251825 - RNA, 19 nt, Homo sapiens
auuaaagucucccacuauu

SEQ ID NO: 1251826 - RNA, 19 nt, Homo sapiens
cuccauggcuuuccagaau

SEQ ID NO: 1251827 - RNA, 19 nt, Homo sapiens
uagagcaggguaauaauga

SEQ ID NO: 1251828 - RNA, 19 nt, Homo sapiens
gcagucugugcuaacauua

SEQ ID NO: 1251829 - RNA, 19 nt, Homo sapiens
gagaaagcuugacgucacu

SEQ ID NO: 1251830 - RNA, 19 nt, Homo sapiens
uauauaaugcccuucuuug

SEQ ID NO: 1251831 - RNA, 19 nt, Homo sapiens
gggauacgccagcaacaga

SEQ ID NO: 1251832 - RNA, 19 nt, Homo sapiens
ggaaugucguccugaugag

SEQ ID NO: 1251833 - RNA, 19 nt, Homo sapiens
gcacaccgauggguuuuga

SEQ ID NO: 1251834 - RNA, 19 nt, Homo sapiens
gaaaguauggaggagaugu

SEQ ID NO: 1251835 - RNA, 19 nt, Homo sapiens
auaaugcccuucuuugucu

SEQ ID NO: 1251836 - RNA, 19 nt, Homo sapiens
ugggagaauacauuaguua

SEQ ID NO: 1251837 - RNA, 19 nt, Homo sapiens
gaaagcuugacgucacuga

SEQ ID NO: 1251838 - RNA, 19 nt, Homo sapiens
ggaggagaugugcaauaaa

SEQ ID NO: 1251839 - RNA, 19 nt, Homo sapiens
auacacagcacauccagaa

SEQ ID NO: 1251840 - RNA, 19 nt, Homo sapiens
guccugaauauccuuguua

SEQ ID NO: 1251841 - RNA, 19 nt, Homo sapiens
ccauagaugucuguuaggu

SEQ ID NO: 1251842 - RNA, 19 nt, Homo sapiens
aagaggaguuuaagcuauc

SEQ ID NO: 1251843 - RNA, 19 nt, Homo sapiens
caccacaaguacucagaga

SEQ ID NO: 1251844 - RNA, 19 nt, Homo sapiens
agucacccuucccggauua

SEQ ID NO: 1251845 - RNA, 19 nt, Homo sapiens
auaguuagcucuucuugcu

SEQ ID NO: 1251846 - RNA, 19 nt, Homo sapiens
uuccauagaugucuguuag

SEQ ID NO: 1251847 - RNA, 19 nt, Homo sapiens
ggaagagcucucaaucaag

SEQ ID NO: 1251848 - RNA, 19 nt, Homo sapiens
gaucccauuaccauuauau

SEQ ID NO: 1251849 - RNA, 19 nt, Homo sapiens
ggauaguuagcucuucuug

SEQ ID NO: 1251850 - RNA, 19 nt, Homo sapiens
uauuaaagucucccacuau

SEQ ID NO: 1251851 - RNA, 19 nt, Homo sapiens
cuucccggauuacacauuu

SEQ ID NO: 1251852 - RNA, 19 nt, Homo sapiens
caagaggcagcgugugaga

SEQ ID NO: 1251853 - RNA, 19 nt, Homo sapiens
gccuauaugugucuuugca

SEQ ID NO: 1251854 - RNA, 19 nt, Homo sapiens
uauaaugcccuucuuuguc

SEQ ID NO: 1251855 - RNA, 19 nt, Homo sapiens
uagcucuucuugcugcauu

SEQ ID NO: 1251856 - RNA, 19 nt, Homo sapiens
uaagcuaucauuuccagau

SEQ ID NO: 1251857 - RNA, 19 nt, Homo sapiens
auugaucccauuaccauua

SEQ ID NO: 1251858 - RNA, 19 nt, Homo sapiens
ugcagucugugcuaacauu

SEQ ID NO: 1251859 - RNA, 19 nt, Homo sapiens
ucagaagagagauauacaa

SEQ ID NO: 1251860 - RNA, 19 nt, Homo sapiens
uccugaauauccuuguuaa

SEQ ID NO: 1251861 - RNA, 19 nt, Homo sapiens
caucuagagcaggguaaua

SEQ ID NO: 1251862 - RNA, 19 nt, Homo sapiens
uuaacggugugaagcauag

SEQ ID NO: 1251863 - RNA, 19 nt, Homo sapiens
gcuuggugauaacguauag

SEQ ID NO: 1251864 - RNA, 19 nt, Homo sapiens
ggucagaagagagauauac

SEQ ID NO: 1251865 - RNA, 19 nt, Homo sapiens
aagucucccacuauuauua

SEQ ID NO: 1251866 - RNA, 19 nt, Homo sapiens
ggagaguuccauagauguc

SEQ ID NO: 1251867 - RNA, 19 nt, Homo sapiens
aagcuaucauuuccagaug

SEQ ID NO: 1251868 - RNA, 19 nt, Homo sapiens
guauggaggagaugugcaa

SEQ ID NO: 1251869 - RNA, 19 nt, Homo sapiens
gaagaugccuccacuuuaa

SEQ ID NO: 1251870 - RNA, 19 nt, Homo sapiens
gaaagaagccuaagagaga

SEQ ID NO: 1251871 - RNA, 19 nt, Homo sapiens
gaaagagggugcauucguu

SEQ ID NO: 1251872 - RNA, 19 nt, Homo sapiens
guagaaaucuuccaugaga

SEQ ID NO: 1251873 - RNA, 19 nt, Homo sapiens
gaagauggaguuuauguuu

SEQ ID NO: 1251874 - RNA, 19 nt, Homo sapiens
gacaguauguugagaaauu

SEQ ID NO: 1251875 - RNA, 19 nt, Homo sapiens
gaagagguguauagaaaug

SEQ ID NO: 1251876 - RNA, 19 nt, Homo sapiens
ggaaugagcaagccaagua

SEQ ID NO: 1251877 - RNA, 19 nt, Homo sapiens
gggauuaucuagcauuaaa

SEQ ID NO: 1251878 - RNA, 19 nt, Homo sapiens
agaugaaacuccuuuguua

SEQ ID NO: 1251879 - RNA, 19 nt, Homo sapiens
gauuauaccuccaaagaug

SEQ ID NO: 1251880 - RNA, 19 nt, Homo sapiens
caucagaacuuguaaucaa

SEQ ID NO: 1251881 - RNA, 19 nt, Homo sapiens
gagcuaugauggcacguua

SEQ ID NO: 1251882 - RNA, 19 nt, Homo sapiens
gaagucagccuuugauuuc

SEQ ID NO: 1251883 - RNA, 19 nt, Homo sapiens
ggaagagacugaagaacau

SEQ ID NO: 1251884 - RNA, 19 nt, Homo sapiens
gagaagggauuaucuagca

SEQ ID NO: 1251885 - RNA, 19 nt, Homo sapiens
agacaacaaugaacgauuu

SEQ ID NO: 1251886 - RNA, 19 nt, Homo sapiens
gaacauacaaagagcauug

SEQ ID NO: 1251887 - RNA, 19 nt, Homo sapiens
gaaguggcguguaagaaga

SEQ ID NO: 1251888 - RNA, 19 nt, Homo sapiens
acaaugaaguggcguguaa

SEQ ID NO: 1251889 - RNA, 19 nt, Homo sapiens
gaagauaccguuuacaaag

SEQ ID NO: 1251890 - RNA, 19 nt, Homo sapiens
caaauugaccacugucuaa

SEQ ID NO: 1251891 - RNA, 19 nt, Homo sapiens
acaagaagacugugucaua

SEQ ID NO: 1251892 - RNA, 19 nt, Homo sapiens
gaaaggaagagacugaaga

SEQ ID NO: 1251893 - RNA, 19 nt, Homo sapiens
ggguagaaaucuuccauga

SEQ ID NO: 1251894 - RNA, 19 nt, Homo sapiens
gcacccaacucgguauauu

SEQ ID NO: 1251895 - RNA, 19 nt, Homo sapiens
gcagcuguauaucuucuaa

SEQ ID NO: 1251896 - RNA, 19 nt, Homo sapiens
gagggauacucauauuuau

SEQ ID NO: 1251897 - RNA, 19 nt, Homo sapiens
uugaagagguguauagaaa

SEQ ID NO: 1251898 - RNA, 19 nt, Homo sapiens
gcaagacuccgugaaauga

SEQ ID NO: 1251899 - RNA, 19 nt, Homo sapiens
ccacaugugcugauuguaa

SEQ ID NO: 1251900 - RNA, 19 nt, Homo sapiens
gaagagacagccuccuaaa

SEQ ID NO: 1251901 - RNA, 19 nt, Homo sapiens
caagaagacugugucauag

SEQ ID NO: 1251902 - RNA, 19 nt, Homo sapiens
ccaguuagcugucuuuacu

SEQ ID NO: 1251903 - RNA, 19 nt, Homo sapiens
gagaagagacagccuccua

SEQ ID NO: 1251904 - RNA, 19 nt, Homo sapiens
gcaaggcgauugaauucca

SEQ ID NO: 1251905 - RNA, 19 nt, Homo sapiens
cagaagaugccuccacuuu

SEQ ID NO: 1251906 - RNA, 19 nt, Homo sapiens
cuaagaagccgaaagaugu

SEQ ID NO: 1251907 - RNA, 19 nt, Homo sapiens
ggacaccuggaacuucuua

SEQ ID NO: 1251908 - RNA, 19 nt, Homo sapiens
gaaggauuauaccuccaaa

SEQ ID NO: 1251909 - RNA, 19 nt, Homo sapiens
cuaaguagcugggauuaca

SEQ ID NO: 1251910 - RNA, 19 nt, Homo sapiens
agaagacugugucauaguu

SEQ ID NO: 1251911 - RNA, 19 nt, Homo sapiens
gaccacaugugcugauugu

SEQ ID NO: 1251912 - RNA, 19 nt, Homo sapiens
gauaccguuuacaaaguua

SEQ ID NO: 1251913 - RNA, 19 nt, Homo sapiens
ggcgauggcugaccagguu

SEQ ID NO: 1251914 - RNA, 19 nt, Homo sapiens
acacugggauggaaauaug

SEQ ID NO: 1251915 - RNA, 19 nt, Homo sapiens
caucagaaacuagaacuuu

SEQ ID NO: 1251916 - RNA, 19 nt, Homo sapiens
cgacauuaguagcagauga

SEQ ID NO: 1251917 - RNA, 19 nt, Homo sapiens
gaugcaaggcgauugaauu

SEQ ID NO: 1251918 - RNA, 19 nt, Homo sapiens
agaagaugccuccacuuua

SEQ ID NO: 1251919 - RNA, 19 nt, Homo sapiens
gcuaagaagccgaaagaug

SEQ ID NO: 1251920 - RNA, 19 nt, Homo sapiens
gggauuggauguagaaggu

SEQ ID NO: 1251921 - RNA, 19 nt, Homo sapiens
gaagagacugaagaacaua

SEQ ID NO: 1251922 - RNA, 19 nt, Homo sapiens
gaaaguaacaagcuacaac

SEQ ID NO: 1251923 - RNA, 19 nt, Homo sapiens
caugugggauccuaaacaa

SEQ ID NO: 1251924 - RNA, 19 nt, Homo sapiens
gaagggauuaucuagcauu

SEQ ID NO: 1251925 - RNA, 19 nt, Homo sapiens
gaacacugagaagggauua

SEQ ID NO: 1251926 - RNA, 19 nt, Homo sapiens
guaguaagaacacugagaa

SEQ ID NO: 1251927 - RNA, 19 nt, Homo sapiens
gcuacaaagccaauuuaaa

SEQ ID NO: 1251928 - RNA, 19 nt, Homo sapiens
caacaccgccgacauuagu

SEQ ID NO: 1251929 - RNA, 19 nt, Homo sapiens
cgaugaaucucaguguuga

SEQ ID NO: 1251930 - RNA, 19 nt, Homo sapiens
ccagcaaccuaaagaagau

SEQ ID NO: 1251931 - RNA, 19 nt, Homo sapiens
ucaagaagacaacaaugaa

SEQ ID NO: 1251932 - RNA, 19 nt, Homo sapiens
ccaaaucccuaucagaaaa

SEQ ID NO: 1251933 - RNA, 19 nt, Homo sapiens
gaacggcagaugcgaugaa

SEQ ID NO: 1251934 - RNA, 19 nt, Homo sapiens
caaaagugcuggaauuaca

SEQ ID NO: 1251935 - RNA, 19 nt, Homo sapiens
guaggacacugggauggaa

SEQ ID NO: 1251936 - RNA, 19 nt, Homo sapiens
gugaagauaccguuuacaa

SEQ ID NO: 1251937 - RNA, 19 nt, Homo sapiens
ggaaaguagucaggaugga

SEQ ID NO: 1251938 - RNA, 19 nt, Homo sapiens
gaaucucaguguugaugug

SEQ ID NO: 1251939 - RNA, 19 nt, Homo sapiens
ccaccacgccuggcuauuu

SEQ ID NO: 1251940 - RNA, 19 nt, Homo sapiens
gaggugccgucaggacuuu

SEQ ID NO: 1251941 - RNA, 19 nt, Homo sapiens
aagggauuaucuagcauua

SEQ ID NO: 1251942 - RNA, 19 nt, Homo sapiens
gcacacaugggcaggaaug

SEQ ID NO: 1251943 - RNA, 19 nt, Homo sapiens
aagacuccgugaaaugaua

SEQ ID NO: 1251944 - RNA, 19 nt, Homo sapiens
ugccuccacuuuaauagua

SEQ ID NO: 1251945 - RNA, 19 nt, Homo sapiens
ugaagauaccguuuacaaa

SEQ ID NO: 1251946 - RNA, 19 nt, Homo sapiens
gacaacaaugaacgauuua

SEQ ID NO: 1251947 - RNA, 19 nt, Homo sapiens
aaagaagccuaagagagaa

SEQ ID NO: 1251948 - RNA, 19 nt, Homo sapiens
gguuuaggaacaucaauuu

SEQ ID NO: 1251949 - RNA, 19 nt, Homo sapiens
ggaaagagggugcauucgu

SEQ ID NO: 1251950 - RNA, 19 nt, Homo sapiens
gcauugcuuccgccuauuu

SEQ ID NO: 1251951 - RNA, 19 nt, Homo sapiens
gaaaugacuucugaaaauc

SEQ ID NO: 1251952 - RNA, 19 nt, Homo sapiens
caagacaguauguugagaa

SEQ ID NO: 1251953 - RNA, 19 nt, Homo sapiens
agaagucagccuuugauuu

SEQ ID NO: 1251954 - RNA, 19 nt, Homo sapiens
ggagaagucagccuuugau

SEQ ID NO: 1251955 - RNA, 19 nt, Homo sapiens
cgauugaauuccaggagaa

SEQ ID NO: 1251956 - RNA, 19 nt, Homo sapiens
agagacagccuccuaaauc

SEQ ID NO: 1251957 - RNA, 19 nt, Homo sapiens
ggauggagacagugaugaa

SEQ ID NO: 1251958 - RNA, 19 nt, Homo sapiens
gugcauagacaguauuuua

SEQ ID NO: 1251959 - RNA, 19 nt, Homo sapiens
caaguaguaagaacacuga

SEQ ID NO: 1251960 - RNA, 19 nt, Homo sapiens
uaaaggauuucugcacaca

SEQ ID NO: 1251961 - RNA, 19 nt, Homo sapiens
cagaugaaacuccuuuguu

SEQ ID NO: 1251962 - RNA, 19 nt, Homo sapiens
gcagaugaaacuccuuugu

SEQ ID NO: 1251963 - RNA, 19 nt, Homo sapiens
gcgaugaaucucaguguug

SEQ ID NO: 1251964 - RNA, 19 nt, Homo sapiens
gcgauucuccugccucaga

SEQ ID NO: 1251965 - RNA, 19 nt, Homo sapiens
gaagacugugucauaguug

SEQ ID NO: 1251966 - RNA, 19 nt, Homo sapiens
gauagacggacaccuggaa

SEQ ID NO: 1251967 - RNA, 19 nt, Homo sapiens
gaaaugaaagaaguagcuu

SEQ ID NO: 1251968 - RNA, 19 nt, Homo sapiens
ggcccaauauucucuaugg

SEQ ID NO: 1251969 - RNA, 19 nt, Homo sapiens
gaacagagccuucuaagau

SEQ ID NO: 1251970 - RNA, 19 nt, Homo sapiens
ucagagagauggaucaaua

SEQ ID NO: 1251971 - RNA, 19 nt, Homo sapiens
uuagauggcucauacauuu

SEQ ID NO: 1251972 - RNA, 19 nt, Homo sapiens
cgagaacucuuccaguaua

SEQ ID NO: 1251973 - RNA, 19 nt, Homo sapiens
guagcuaggucccgauaua

SEQ ID NO: 1251974 - RNA, 19 nt, Homo sapiens
gagaguagauccagagugu

SEQ ID NO: 1251975 - RNA, 19 nt, Homo sapiens
gcucauacauuuaucuaga

SEQ ID NO: 1251976 - RNA, 19 nt, Homo sapiens
ggagugggcauuuccuuua

SEQ ID NO: 1251977 - RNA, 19 nt, Homo sapiens
ggcgagaacucuuccagua

SEQ ID NO: 1251978 - RNA, 19 nt, Homo sapiens
aaucuucgcuuaauacuug

SEQ ID NO: 1251979 - RNA, 19 nt, Homo sapiens
gacccuggcuuuaauguga

SEQ ID NO: 1251980 - RNA, 19 nt, Homo sapiens
ugacagagcccauaggauu

SEQ ID NO: 1251981 - RNA, 19 nt, Homo sapiens
gaucuacagcagcaaauua

SEQ ID NO: 1251982 - RNA, 19 nt, Homo sapiens
cuucagagcagucuaguua

SEQ ID NO: 1251983 - RNA, 19 nt, Homo sapiens
caggaagucugaucuguug

SEQ ID NO: 1251984 - RNA, 19 nt, Homo sapiens
agaguuauguggaauggua

SEQ ID NO: 1251985 - RNA, 19 nt, Homo sapiens
gaauaggaccuuauaugga

SEQ ID NO: 1251986 - RNA, 19 nt, Homo sapiens
ggaaaaucuucgcuuaaua

SEQ ID NO: 1251987 - RNA, 19 nt, Homo sapiens
caucaaaguuggauacaag

SEQ ID NO: 1251988 - RNA, 19 nt, Homo sapiens
cagcaaauuaugaccauua

SEQ ID NO: 1251989 - RNA, 19 nt, Homo sapiens
ugaggagagucgauacuaa

SEQ ID NO: 1251990 - RNA, 19 nt, Homo sapiens
uaaaggagauuggcugaca

SEQ ID NO: 1251991 - RNA, 19 nt, Homo sapiens
agagauggaucaauaagau

SEQ ID NO: 1251992 - RNA, 19 nt, Homo sapiens
uaaggagccucacagcuau

SEQ ID NO: 1251993 - RNA, 19 nt, Homo sapiens
cuaaggagccucacagcua

SEQ ID NO: 1251994 - RNA, 19 nt, Homo sapiens
ucaaacugccuaacacuuu

SEQ ID NO: 1251995 - RNA, 19 nt, Homo sapiens
uaaccgccauguuguuuau

SEQ ID NO: 1251996 - RNA, 19 nt, Homo sapiens
ugaauaagcacuacaaucu

SEQ ID NO: 1251997 - RNA, 19 nt, Homo sapiens
gcagugaaggagcagaaua

SEQ ID NO: 1251998 - RNA, 19 nt, Homo sapiens
gagaacucuuccaguauau

SEQ ID NO: 1251999 - RNA, 19 nt, Homo sapiens
cagaguaaccgccauguug

SEQ ID NO: 1252000 - RNA, 19 nt, Homo sapiens
ccuaacacuuuguagcuuu

SEQ ID NO: 1252001 - RNA, 19 nt, Homo sapiens
gugggcauuuccuuuauuu

SEQ ID NO: 1252002 - RNA, 19 nt, Homo sapiens
cagaauaggaccuuauaug

SEQ ID NO: 1252003 - RNA, 19 nt, Homo sapiens
gauauacuccugucuugug

SEQ ID NO: 1252004 - RNA, 19 nt, Homo sapiens
ggaacagagccuucuaaga

SEQ ID NO: 1252005 - RNA, 19 nt, Homo sapiens
cauauucccucuagugucu

SEQ ID NO: 1252006 - RNA, 19 nt, Homo sapiens
gagugggcauuuccuuuau

SEQ ID NO: 1252007 - RNA, 19 nt, Homo sapiens
gcagaaggagcgaguggaa

SEQ ID NO: 1252008 - RNA, 19 nt, Homo sapiens
gaacucuuccaguauaugu

SEQ ID NO: 1252009 - RNA, 19 nt, Homo sapiens
ggagcagaauaggaccuua

SEQ ID NO: 1252010 - RNA, 19 nt, Homo sapiens
gcaauuugaauccaucaga

SEQ ID NO: 1252011 - RNA, 19 nt, Homo sapiens
ggaaaaggagccauuauug

SEQ ID NO: 1252012 - RNA, 19 nt, Homo sapiens
ccuacucacucuucccuuu

SEQ ID NO: 1252013 - RNA, 19 nt, Homo sapiens
cuugggcucugaauacuuu

SEQ ID NO: 1252014 - RNA, 19 nt, Homo sapiens
uaacuugggcucugaauac

SEQ ID NO: 1252015 - RNA, 19 nt, Homo sapiens
gaaccugacagagcccaua

SEQ ID NO: 1252016 - RNA, 19 nt, Homo sapiens
aacagagccuucuaagauu

SEQ ID NO: 1252017 - RNA, 19 nt, Homo sapiens
agggagacaucaagccaua

SEQ ID NO: 1252018 - RNA, 19 nt, Homo sapiens
gagggcaacucgacacucu

SEQ ID NO: 1252019 - RNA, 19 nt, Homo sapiens
aaggagccauuauugguuu

SEQ ID NO: 1252020 - RNA, 19 nt, Homo sapiens
gaagcucuuuguacuggau

SEQ ID NO: 1252021 - RNA, 19 nt, Homo sapiens
ccgauauacuccugucuug

SEQ ID NO: 1252022 - RNA, 19 nt, Homo sapiens
acagagccuucuaagauug

SEQ ID NO: 1252023 - RNA, 19 nt, Homo sapiens
cuacagcagcaaauuauga

SEQ ID NO: 1252024 - RNA, 19 nt, Homo sapiens
gagugucaaggaucuguua

SEQ ID NO: 1252025 - RNA, 19 nt, Homo sapiens
guaaccgccauguuguuua

SEQ ID NO: 1252026 - RNA, 19 nt, Homo sapiens
gccaaacucuucauuucca

SEQ ID NO: 1252027 - RNA, 19 nt, Homo sapiens
gccaaggcccagaaucuuu

SEQ ID NO: 1252028 - RNA, 19 nt, Homo sapiens
gagagauggaucaauaaga

SEQ ID NO: 1252029 - RNA, 19 nt, Homo sapiens
gaguagauccagaguguca

SEQ ID NO: 1252030 - RNA, 19 nt, Homo sapiens
gggagguuguuucuugaga

SEQ ID NO: 1252031 - RNA, 19 nt, Homo sapiens
uugccagacuucuugguua

SEQ ID NO: 1252032 - RNA, 19 nt, Homo sapiens
gaauaagcacuacaaucug

SEQ ID NO: 1252033 - RNA, 19 nt, Homo sapiens
cagacccucucuuccauug

SEQ ID NO: 1252034 - RNA, 19 nt, Homo sapiens
gcauuuccuuuauuucucu

SEQ ID NO: 1252035 - RNA, 19 nt, Homo sapiens
gagcagaauaggaccuuau

SEQ ID NO: 1252036 - RNA, 19 nt, Homo sapiens
gagcagagggagacaucaa

SEQ ID NO: 1252037 - RNA, 19 nt, Homo sapiens
aaagggaucuacucaccau

SEQ ID NO: 1252038 - RNA, 19 nt, Homo sapiens
agagcagucuaguuaggua

SEQ ID NO: 1252039 - RNA, 19 nt, Homo sapiens
gcucuaauacugcuuugug

SEQ ID NO: 1252040 - RNA, 19 nt, Homo sapiens
gaagaacaccgagauccau

SEQ ID NO: 1252041 - RNA, 19 nt, Homo sapiens
gggaaaaucuucgcuuaau

SEQ ID NO: 1252042 - RNA, 19 nt, Homo sapiens
gaagcugccacccaagaga

SEQ ID NO: 1252043 - RNA, 19 nt, Homo sapiens
ucuguuagauccuggaauc

SEQ ID NO: 1252044 - RNA, 19 nt, Homo sapiens
acucuucauuuccacauuu

SEQ ID NO: 1252045 - RNA, 19 nt, Homo sapiens
gaacaccauggaaggucua

SEQ ID NO: 1252046 - RNA, 19 nt, Homo sapiens
aggauucccucuucuacuu

SEQ ID NO: 1252047 - RNA, 19 nt, Homo sapiens
uccaguauauguugcagaa

SEQ ID NO: 1252048 - RNA, 19 nt, Homo sapiens
gcgagaacucuuccaguau

SEQ ID NO: 1252049 - RNA, 19 nt, Homo sapiens
cugaaugugugcuagauca

SEQ ID NO: 1252050 - RNA, 19 nt, Homo sapiens
gagguuguuucuugagagu

SEQ ID NO: 1252051 - RNA, 19 nt, Homo sapiens
acauuuaucuagagaagca

SEQ ID NO: 1252052 - RNA, 19 nt, Homo sapiens
gggagugggcauuuccuuu

SEQ ID NO: 1252053 - RNA, 19 nt, Homo sapiens
ggaagaacaccgagaucca

SEQ ID NO: 1252054 - RNA, 19 nt, Homo sapiens
gcagaauaggaccuuauau

SEQ ID NO: 1252055 - RNA, 19 nt, Homo sapiens
ucccacaggugaacaacuu

SEQ ID NO: 1252056 - RNA, 19 nt, Homo sapiens
uugccaaacucuucauuuc

SEQ ID NO: 1252057 - RNA, 19 nt, Homo sapiens
gcagaguaaccgccauguu

SEQ ID NO: 1252058 - RNA, 19 nt, Homo sapiens
gcagcaaauuaugaccauu

SEQ ID NO: 1252059 - RNA, 19 nt, Homo sapiens
gcuuuaaugugagaguuau

SEQ ID NO: 1252060 - RNA, 19 nt, Homo sapiens
agaauaggaccuuauaugg

SEQ ID NO: 1252061 - RNA, 19 nt, Homo sapiens
cagagagauggaucaauaa

SEQ ID NO: 1252062 - RNA, 19 nt, Homo sapiens
gaaauggcaaagggcaauu

SEQ ID NO: 1252063 - RNA, 19 nt, Homo sapiens
acuccugucuugugagauu

SEQ ID NO: 1252064 - RNA, 19 nt, Homo sapiens
cagaaucuuuccgcuccua

SEQ ID NO: 1252065 - RNA, 19 nt, Homo sapiens
gaccucagacccucucuuc

SEQ ID NO: 1252066 - RNA, 19 nt, Homo sapiens
gggaaacucaccagaacga

SEQ ID NO: 1252067 - RNA, 19 nt, Homo sapiens
gguuguuucuugagaguag

SEQ ID NO: 1252068 - RNA, 19 nt, Homo sapiens
cauaggauucccucuucua

SEQ ID NO: 1252069 - RNA, 19 nt, Homo sapiens
ggucauaccuggucuggaa

SEQ ID NO: 1252070 - RNA, 19 nt, Homo sapiens
agaagaagcuggcugauug

SEQ ID NO: 1252071 - RNA, 19 nt, Homo sapiens
gaauaaagcuguuguugcu

SEQ ID NO: 1252072 - RNA, 19 nt, Homo sapiens
gaagggaauugaauagaug

SEQ ID NO: 1252073 - RNA, 19 nt, Homo sapiens
cagaauaacuagagaaugu

SEQ ID NO: 1252074 - RNA, 19 nt, Homo sapiens
gcaccucgauuucuucuug

SEQ ID NO: 1252075 - RNA, 19 nt, Homo sapiens
gagccugccucuuggaaua

SEQ ID NO: 1252076 - RNA, 19 nt, Homo sapiens
gaggauugcuggcugguuu

SEQ ID NO: 1252077 - RNA, 19 nt, Homo sapiens
gcacaaagaauggccauaa

SEQ ID NO: 1252078 - RNA, 19 nt, Homo sapiens
ccucaccgcucuuccuuua

SEQ ID NO: 1252079 - RNA, 19 nt, Homo sapiens
uaacaaagcccgcaagcaa

SEQ ID NO: 1252080 - RNA, 19 nt, Homo sapiens
ggaaagacaucagcuugga

SEQ ID NO: 1252081 - RNA, 19 nt, Homo sapiens
uuacagcuguuucugauaa

SEQ ID NO: 1252082 - RNA, 19 nt, Homo sapiens
gcacaucugguguuuauga

SEQ ID NO: 1252083 - RNA, 19 nt, Homo sapiens
ggaguguuguccugagaua

SEQ ID NO: 1252084 - RNA, 19 nt, Homo sapiens
gcucuccucuuuccucuaa

SEQ ID NO: 1252085 - RNA, 19 nt, Homo sapiens
gcagagauugaguaacuua

SEQ ID NO: 1252086 - RNA, 19 nt, Homo sapiens
gaaaggaauucagaugaca

SEQ ID NO: 1252087 - RNA, 19 nt, Homo sapiens
gagaaaggaauucagauga

SEQ ID NO: 1252088 - RNA, 19 nt, Homo sapiens
ggaggcacauggauuugaa

SEQ ID NO: 1252089 - RNA, 19 nt, Homo sapiens
cagcagagauugaguaacu

SEQ ID NO: 1252090 - RNA, 19 nt, Homo sapiens
gaagauuccaguauaauag

SEQ ID NO: 1252091 - RNA, 19 nt, Homo sapiens
gcucugaggauaaggguua

SEQ ID NO: 1252092 - RNA, 19 nt, Homo sapiens
gaacacgugaucuucguaa

SEQ ID NO: 1252093 - RNA, 19 nt, Homo sapiens
gaagacagccguggaguuc

SEQ ID NO: 1252094 - RNA, 19 nt, Homo sapiens
ucaaauccaucaucaucaa

SEQ ID NO: 1252095 - RNA, 19 nt, Homo sapiens
ggaauucagaugacauaaa

SEQ ID NO: 1252096 - RNA, 19 nt, Homo sapiens
gaaagccaacguuauccua

SEQ ID NO: 1252097 - RNA, 19 nt, Homo sapiens
agacugagagggucaauuu

SEQ ID NO: 1252098 - RNA, 19 nt, Homo sapiens
gagggucaauuucuagguu

SEQ ID NO: 1252099 - RNA, 19 nt, Homo sapiens
cacaaagaauggccauaaa

SEQ ID NO: 1252100 - RNA, 19 nt, Homo sapiens
gcaaggaacacgugaucuu

SEQ ID NO: 1252101 - RNA, 19 nt, Homo sapiens
gggucuggcuucucacuuu

SEQ ID NO: 1252102 - RNA, 19 nt, Homo sapiens
gcaaagcucuaugcugucu

SEQ ID NO: 1252103 - RNA, 19 nt, Homo sapiens
ccauaaacaucaguucuau

SEQ ID NO: 1252104 - RNA, 19 nt, Homo sapiens
guaaggaugugguuuuauu

SEQ ID NO: 1252105 - RNA, 19 nt, Homo sapiens
gggaaaccacugccucuuu

SEQ ID NO: 1252106 - RNA, 19 nt, Homo sapiens
gagaagaagcuggcugauu

SEQ ID NO: 1252107 - RNA, 19 nt, Homo sapiens
ggaaggagcccugcaacug

SEQ ID NO: 1252108 - RNA, 19 nt, Homo sapiens
ggcaaaugcuguaccuuca

SEQ ID NO: 1252109 - RNA, 19 nt, Homo sapiens
uuccaugucuugaauguuu

SEQ ID NO: 1252110 - RNA, 19 nt, Homo sapiens
cacaggaacucugagguuu

SEQ ID NO: 1252111 - RNA, 19 nt, Homo sapiens
gggucaauuucuagguuua

SEQ ID NO: 1252112 - RNA, 19 nt, Homo sapiens
acgcacaucugguguuuau

SEQ ID NO: 1252113 - RNA, 19 nt, Homo sapiens
uaacagacaccaagaaagg

SEQ ID NO: 1252114 - RNA, 19 nt, Homo sapiens
ccagugaccugcaguucug

SEQ ID NO: 1252115 - RNA, 19 nt, Homo sapiens
ggacauucuuuccaucucu

SEQ ID NO: 1252116 - RNA, 19 nt, Homo sapiens
uuucaaggcucugaggaua

SEQ ID NO: 1252117 - RNA, 19 nt, Homo sapiens
uagcagggaagaaauguaa

SEQ ID NO: 1252118 - RNA, 19 nt, Homo sapiens
agaagggaauugaauagau

SEQ ID NO: 1252119 - RNA, 19 nt, Homo sapiens
gcagaagggaauugaauag

SEQ ID NO: 1252120 - RNA, 19 nt, Homo sapiens
cagcagcggcgacgacuuu

SEQ ID NO: 1252121 - RNA, 19 nt, Homo sapiens
caaaugcuguaccuucagu

SEQ ID NO: 1252122 - RNA, 19 nt, Homo sapiens
guggggaucugguaaauuu

SEQ ID NO: 1252123 - RNA, 19 nt, Homo sapiens
guggucaccuggagaauca

SEQ ID NO: 1252124 - RNA, 19 nt, Homo sapiens
cauaacagacaccaagaaa

SEQ ID NO: 1252125 - RNA, 19 nt, Homo sapiens
gagauugaguaacuuaugc

SEQ ID NO: 1252126 - RNA, 19 nt, Homo sapiens
gaaagacaucagcuuggaa

SEQ ID NO: 1252127 - RNA, 19 nt, Homo sapiens
uaauagacccgaggugaaa

SEQ ID NO: 1252128 - RNA, 19 nt, Homo sapiens
aaaccgggauggccgagaa

SEQ ID NO: 1252129 - RNA, 19 nt, Homo sapiens
gcccacacaggguuaauaa

SEQ ID NO: 1252130 - RNA, 19 nt, Homo sapiens
gcuuggcaccucuucaaua

SEQ ID NO: 1252131 - RNA, 19 nt, Homo sapiens
cacgugaucuucguaauuc

SEQ ID NO: 1252132 - RNA, 19 nt, Homo sapiens
ucccucagcugcaguguga

SEQ ID NO: 1252133 - RNA, 19 nt, Homo sapiens
uggagaaccugcugcacaa

SEQ ID NO: 1252134 - RNA, 19 nt, Homo sapiens
gaugcugccacaaggaaua

SEQ ID NO: 1252135 - RNA, 19 nt, Homo sapiens
gaauguacugggaguguug

SEQ ID NO: 1252136 - RNA, 19 nt, Homo sapiens
aaagcucuaugcugucuau

SEQ ID NO: 1252137 - RNA, 19 nt, Homo sapiens
cugagagggucaauuucua

SEQ ID NO: 1252138 - RNA, 19 nt, Homo sapiens
gaaaguugcaaggcuguug

SEQ ID NO: 1252139 - RNA, 19 nt, Homo sapiens
ccacaggaacucugagguu

SEQ ID NO: 1252140 - RNA, 19 nt, Homo sapiens
ggaauagaaaucagacauc

SEQ ID NO: 1252141 - RNA, 19 nt, Homo sapiens
aaagacaucagcuuggaaa

SEQ ID NO: 1252142 - RNA, 19 nt, Homo sapiens
ccacaggccuacagcuucu

SEQ ID NO: 1252143 - RNA, 19 nt, Homo sapiens
uaccuggucuggaagauuc

SEQ ID NO: 1252144 - RNA, 19 nt, Homo sapiens
gaaaagacgcacaaagaau

SEQ ID NO: 1252145 - RNA, 19 nt, Homo sapiens
gcaacgcuuuagcccaaug

SEQ ID NO: 1252146 - RNA, 19 nt, Homo sapiens
agagucgccuggagaaguu

SEQ ID NO: 1252147 - RNA, 19 nt, Homo sapiens
ucaguucuaugggacaauu

SEQ ID NO: 1252148 - RNA, 19 nt, Homo sapiens
ucaccgcucuuccuuuagu

SEQ ID NO: 1252149 - RNA, 19 nt, Homo sapiens
gagcacucauucagacaca

SEQ ID NO: 1252150 - RNA, 19 nt, Homo sapiens
ggaaugcuaauaugcaagu

SEQ ID NO: 1252151 - RNA, 19 nt, Homo sapiens
uucaauaggugacauucaa

SEQ ID NO: 1252152 - RNA, 19 nt, Homo sapiens
ggacucuguucccaucaca

SEQ ID NO: 1252153 - RNA, 19 nt, Homo sapiens
cccaucaucucgaauaaag

SEQ ID NO: 1252154 - RNA, 19 nt, Homo sapiens
gaaccagugaccugcaguu

SEQ ID NO: 1252155 - RNA, 19 nt, Homo sapiens
ccauggagaggaagauuga

SEQ ID NO: 1252156 - RNA, 19 nt, Homo sapiens
ucaccugcuuucccuagaa

SEQ ID NO: 1252157 - RNA, 19 nt, Homo sapiens
caauugggcccauuucaag

SEQ ID NO: 1252158 - RNA, 19 nt, Homo sapiens
gugggaggcacauggauuu

SEQ ID NO: 1252159 - RNA, 19 nt, Homo sapiens
uauccucucuucucuccuu

SEQ ID NO: 1252160 - RNA, 19 nt, Homo sapiens
ggacaauugggcccauuuc

SEQ ID NO: 1252161 - RNA, 19 nt, Homo sapiens
ugagaaaggaauucagaug

SEQ ID NO: 1252162 - RNA, 19 nt, Homo sapiens
gcuucucacuuuccagaug

SEQ ID NO: 1252163 - RNA, 19 nt, Homo sapiens
cuacagacagggugaacaa

SEQ ID NO: 1252164 - RNA, 19 nt, Homo sapiens
ucaaggcucugaggauaag

SEQ ID NO: 1252165 - RNA, 19 nt, Homo sapiens
gauaccgucugggaggauu

SEQ ID NO: 1252166 - RNA, 19 nt, Homo sapiens
ucugguaaauuucaguuuc

SEQ ID NO: 1252167 - RNA, 19 nt, Homo sapiens
ggaacacgugaucuucgua

SEQ ID NO: 1252168 - RNA, 19 nt, Homo sapiens
gcaggcaaaugcuguaccu

SEQ ID NO: 1252169 - RNA, 19 nt, Homo sapiens
ccacugagaucuacaaguu

SEQ ID NO: 1252170 - RNA, 19 nt, Homo sapiens
caagggaaauugaagcuaa

SEQ ID NO: 1252171 - RNA, 19 nt, Homo sapiens
gcaaggaggcccaggagua

SEQ ID NO: 1252172 - RNA, 19 nt, Homo sapiens
gacauugccuucaagcuaa

SEQ ID NO: 1252173 - RNA, 19 nt, Homo sapiens
ggacauugccuucaagcua

SEQ ID NO: 1252174 - RNA, 19 nt, Homo sapiens
uguagcagcugguuaguaa

SEQ ID NO: 1252175 - RNA, 19 nt, Homo sapiens
uccaugaccuuuaucaaua

SEQ ID NO: 1252176 - RNA, 19 nt, Homo sapiens
ccaagaagcugugcauugu

SEQ ID NO: 1252177 - RNA, 19 nt, Homo sapiens
cccagcaucuucaucauua

SEQ ID NO: 1252178 - RNA, 19 nt, Homo sapiens
ccaaaucuguguaucuaau

SEQ ID NO: 1252179 - RNA, 19 nt, Homo sapiens
aagguaggcuggugucaua

SEQ ID NO: 1252180 - RNA, 19 nt, Homo sapiens
agagagagcucaauguaca

SEQ ID NO: 1252181 - RNA, 19 nt, Homo sapiens
ggauuuccaugaccuuuau

SEQ ID NO: 1252182 - RNA, 19 nt, Homo sapiens
gaaaggaggcgaggaagga

SEQ ID NO: 1252183 - RNA, 19 nt, Homo sapiens
gcucugauguucuuguaug

SEQ ID NO: 1252184 - RNA, 19 nt, Homo sapiens
ccagagagagcucaaugua

SEQ ID NO: 1252185 - RNA, 19 nt, Homo sapiens
acgaaucccuucuacagua

SEQ ID NO: 1252186 - RNA, 19 nt, Homo sapiens
gaaaaucaaugugggaauu

SEQ ID NO: 1252187 - RNA, 19 nt, Homo sapiens
cuauuuauaucaccaggua

SEQ ID NO: 1252188 - RNA, 19 nt, Homo sapiens
ggaccuggaugcugcuguu

SEQ ID NO: 1252189 - RNA, 19 nt, Homo sapiens
guguagauccaaucauuua

SEQ ID NO: 1252190 - RNA, 19 nt, Homo sapiens
acuaaugcauuguguauga

SEQ ID NO: 1252191 - RNA, 19 nt, Homo sapiens
gagaagaccaguccaaugg

SEQ ID NO: 1252192 - RNA, 19 nt, Homo sapiens
guagcccacugaguuaaua

SEQ ID NO: 1252193 - RNA, 19 nt, Homo sapiens
ggaaggagggaguguguga

SEQ ID NO: 1252194 - RNA, 19 nt, Homo sapiens
uaagaaccaucacaagaca

SEQ ID NO: 1252195 - RNA, 19 nt, Homo sapiens
uugcuaaacuacccaagua

SEQ ID NO: 1252196 - RNA, 19 nt, Homo sapiens
gacaagauccgagacauug

SEQ ID NO: 1252197 - RNA, 19 nt, Homo sapiens
ccagguagcccacugaguu

SEQ ID NO: 1252198 - RNA, 19 nt, Homo sapiens
cuacagacauuggaacaga

SEQ ID NO: 1252199 - RNA, 19 nt, Homo sapiens
gaaauugaagcuaaugaca

SEQ ID NO: 1252200 - RNA, 19 nt, Homo sapiens
aagaagcugugcauuguug

SEQ ID NO: 1252201 - RNA, 19 nt, Homo sapiens
aaccaaaucuguguaucua

SEQ ID NO: 1252202 - RNA, 19 nt, Homo sapiens
cccacugaguuaauauuua

SEQ ID NO: 1252203 - RNA, 19 nt, Homo sapiens
ggagaagaccaguccaaug

SEQ ID NO: 1252204 - RNA, 19 nt, Homo sapiens
ucaaguuccucaugcuuau

SEQ ID NO: 1252205 - RNA, 19 nt, Homo sapiens
caacggcaguguccuacau

SEQ ID NO: 1252206 - RNA, 19 nt, Homo sapiens
aaguguagauccaaucauu

SEQ ID NO: 1252207 - RNA, 19 nt, Homo sapiens
gcucuuagcugugguuacu

SEQ ID NO: 1252208 - RNA, 19 nt, Homo sapiens
gaagcaagucggacccauu

SEQ ID NO: 1252209 - RNA, 19 nt, Homo sapiens
aaacucaaaugcaccuuca

SEQ ID NO: 1252210 - RNA, 19 nt, Homo sapiens
gcuaaacaaccaaaucaga

SEQ ID NO: 1252211 - RNA, 19 nt, Homo sapiens
caaauagccuccaaaagug

SEQ ID NO: 1252212 - RNA, 19 nt, Homo sapiens
aaugugauguccuuccuuu

SEQ ID NO: 1252213 - RNA, 19 nt, Homo sapiens
gaaaccaaaucuguguauc

SEQ ID NO: 1252214 - RNA, 19 nt, Homo sapiens
ggacggacccacugagauc

SEQ ID NO: 1252215 - RNA, 19 nt, Homo sapiens
ccaugaccuuuaucaauau

SEQ ID NO: 1252216 - RNA, 19 nt, Homo sapiens
caaaugcaccuucacaucu

SEQ ID NO: 1252217 - RNA, 19 nt, Homo sapiens
ccacuaaugcauuguguau

SEQ ID NO: 1252218 - RNA, 19 nt, Homo sapiens
cgacagggcaucuucuaug

SEQ ID NO: 1252219 - RNA, 19 nt, Homo sapiens
gagcucaauguacaaauga

SEQ ID NO: 1252220 - RNA, 19 nt, Homo sapiens
gucaucuucuucaucguua

SEQ ID NO: 1252221 - RNA, 19 nt, Homo sapiens
acucugguaugacacauuu

SEQ ID NO: 1252222 - RNA, 19 nt, Homo sapiens
gaaugccucauggcucuua

SEQ ID NO: 1252223 - RNA, 19 nt, Homo sapiens
aaucacagcuccgggcauu

SEQ ID NO: 1252224 - RNA, 19 nt, Homo sapiens
caugguauuucagguguuu

SEQ ID NO: 1252225 - RNA, 19 nt, Homo sapiens
gggauuuccaugaccuuua

SEQ ID NO: 1252226 - RNA, 19 nt, Homo sapiens
gcccauaaguuuuaccuuu

SEQ ID NO: 1252227 - RNA, 19 nt, Homo sapiens
ccuaauccaugaccacugu

SEQ ID NO: 1252228 - RNA, 19 nt, Homo sapiens
acugagaucuacaaguuga

SEQ ID NO: 1252229 - RNA, 19 nt, Homo sapiens
cgaaucccuucuacaguau

SEQ ID NO: 1252230 - RNA, 19 nt, Homo sapiens
gcaugagggccguuacuau

SEQ ID NO: 1252231 - RNA, 19 nt, Homo sapiens
ccaagacuccagagcauga

SEQ ID NO: 1252232 - RNA, 19 nt, Homo sapiens
gaaagaguaccacggaaac

SEQ ID NO: 1252233 - RNA, 19 nt, Homo sapiens
ugaaagaguaccacggaaa

SEQ ID NO: 1252234 - RNA, 19 nt, Homo sapiens
ggaguggaauauuugacau

SEQ ID NO: 1252235 - RNA, 19 nt, Homo sapiens
ugacauaguaacaucugua

SEQ ID NO: 1252236 - RNA, 19 nt, Homo sapiens
gaaucugccucugccucua

SEQ ID NO: 1252237 - RNA, 19 nt, Homo sapiens
cuucauauuugacaugugu

SEQ ID NO: 1252238 - RNA, 19 nt, Homo sapiens
ccagaaaggaggcgaggaa

SEQ ID NO: 1252239 - RNA, 19 nt, Homo sapiens
cguaagaaccaucacaaga

SEQ ID NO: 1252240 - RNA, 19 nt, Homo sapiens
ccacaacggcaguguccua

SEQ ID NO: 1252241 - RNA, 19 nt, Homo sapiens
uagauaagugucccuguuu

SEQ ID NO: 1252242 - RNA, 19 nt, Homo sapiens
auagauaagugucccuguu

SEQ ID NO: 1252243 - RNA, 19 nt, Homo sapiens
cagguagcccacugaguua

SEQ ID NO: 1252244 - RNA, 19 nt, Homo sapiens
uaugggauguggaaucugu

SEQ ID NO: 1252245 - RNA, 19 nt, Homo sapiens
uaacggaaggccauuggaa

SEQ ID NO: 1252246 - RNA, 19 nt, Homo sapiens
ugagggccguuacuaugaa

SEQ ID NO: 1252247 - RNA, 19 nt, Homo sapiens
ucaaauagccuccaaaagu

SEQ ID NO: 1252248 - RNA, 19 nt, Homo sapiens
ccaccacuaucacccaugu

SEQ ID NO: 1252249 - RNA, 19 nt, Homo sapiens
ggauguggaaucuguaugu

SEQ ID NO: 1252250 - RNA, 19 nt, Homo sapiens
uaaacaaccaaaucagaga

SEQ ID NO: 1252251 - RNA, 19 nt, Homo sapiens
aaacuacccaaguaagauu

SEQ ID NO: 1252252 - RNA, 19 nt, Homo sapiens
cuucaucguuagucaggua

SEQ ID NO: 1252253 - RNA, 19 nt, Homo sapiens
uaaaggauauccgguuggu

SEQ ID NO: 1252254 - RNA, 19 nt, Homo sapiens
caagauccgagacauugaa

SEQ ID NO: 1252255 - RNA, 19 nt, Homo sapiens
guaagaaccaucacaagac

SEQ ID NO: 1252256 - RNA, 19 nt, Homo sapiens
ccagcggcauggacauuug

SEQ ID NO: 1252257 - RNA, 19 nt, Homo sapiens
gugcauuguuggugggauu

SEQ ID NO: 1252258 - RNA, 19 nt, Homo sapiens
ugacaagauccgagacauu

SEQ ID NO: 1252259 - RNA, 19 nt, Homo sapiens
cauaguaacaucuguagca

SEQ ID NO: 1252260 - RNA, 19 nt, Homo sapiens
agagcucaauguacaaaug

SEQ ID NO: 1252261 - RNA, 19 nt, Homo sapiens
caugagggccguuacuaug

SEQ ID NO: 1252262 - RNA, 19 nt, Homo sapiens
aauugaagcuaaugacauc

SEQ ID NO: 1252263 - RNA, 19 nt, Homo sapiens
cuaaacuacccaaguaaga

SEQ ID NO: 1252264 - RNA, 19 nt, Homo sapiens
gcccacugaguuaauauuu

SEQ ID NO: 1252265 - RNA, 19 nt, Homo sapiens
guaugucuuugcucugaug

SEQ ID NO: 1252266 - RNA, 19 nt, Homo sapiens
uguggaaucuguaugucuu

SEQ ID NO: 1252267 - RNA, 19 nt, Homo sapiens
uacaguaucuggacuacag

SEQ ID NO: 1252268 - RNA, 19 nt, Homo sapiens
cuaugaaugugauguccuu

SEQ ID NO: 1252269 - RNA, 19 nt, Homo sapiens
ggaagaaacuguacagaaa

SEQ ID NO: 1252270 - RNA, 19 nt, Homo sapiens
gaaauagccucuugcacua

SEQ ID NO: 1252271 - RNA, 19 nt, Homo sapiens
ggacaagucugagaaauga

SEQ ID NO: 1252272 - RNA, 19 nt, Homo sapiens
gagaauaucuguagugaca

SEQ ID NO: 1252273 - RNA, 19 nt, Homo sapiens
gugcuuaaauuaccucuua

SEQ ID NO: 1252274 - RNA, 19 nt, Homo sapiens
gcacuuaacuuucauucau

SEQ ID NO: 1252275 - RNA, 19 nt, Homo sapiens
caaaucccguugagucuua

SEQ ID NO: 1252276 - RNA, 19 nt, Homo sapiens
aaagugagaugcuuaaaug

SEQ ID NO: 1252277 - RNA, 19 nt, Homo sapiens
uaauggagcuggcaucuga

SEQ ID NO: 1252278 - RNA, 19 nt, Homo sapiens
ggaggagaguggaaacuuu

SEQ ID NO: 1252279 - RNA, 19 nt, Homo sapiens
caacagagcuagacuccau

SEQ ID NO: 1252280 - RNA, 19 nt, Homo sapiens
cguaguaggugcuugauaa

SEQ ID NO: 1252281 - RNA, 19 nt, Homo sapiens
gcucacaucuguaaucuca

SEQ ID NO: 1252282 - RNA, 19 nt, Homo sapiens
gauccuggcuucucuugaa

SEQ ID NO: 1252283 - RNA, 19 nt, Homo sapiens
agacacaccuccaugauug

SEQ ID NO: 1252284 - RNA, 19 nt, Homo sapiens
cauaaucgcccuccucuaa

SEQ ID NO: 1252285 - RNA, 19 nt, Homo sapiens
caaccagccucgccauaaa

SEQ ID NO: 1252286 - RNA, 19 nt, Homo sapiens
gagguuggauuacaugaga

SEQ ID NO: 1252287 - RNA, 19 nt, Homo sapiens
ggaagggugucucggaaga

SEQ ID NO: 1252288 - RNA, 19 nt, Homo sapiens
ggaagccucucccuugaug

SEQ ID NO: 1252289 - RNA, 19 nt, Homo sapiens
ugaaucaacuguggacuuu

SEQ ID NO: 1252290 - RNA, 19 nt, Homo sapiens
aguaggugcuugauaaaua

SEQ ID NO: 1252291 - RNA, 19 nt, Homo sapiens
aaacugaggcgcagaauga

SEQ ID NO: 1252292 - RNA, 19 nt, Homo sapiens
ggaaucagccuaacagauc

SEQ ID NO: 1252293 - RNA, 19 nt, Homo sapiens
cggaagaguugcaucauga

SEQ ID NO: 1252294 - RNA, 19 nt, Homo sapiens
ucucuugaauucaguguua

SEQ ID NO: 1252295 - RNA, 19 nt, Homo sapiens
gagcaccuguuguguauca

SEQ ID NO: 1252296 - RNA, 19 nt, Homo sapiens
ucucaucucugucuacaaa

SEQ ID NO: 1252297 - RNA, 19 nt, Homo sapiens
gaagaaggcaucuguagca

SEQ ID NO: 1252298 - RNA, 19 nt, Homo sapiens
acacuaaugucagauguaa

SEQ ID NO: 1252299 - RNA, 19 nt, Homo sapiens
gaaccuggcuuggcugcuu

SEQ ID NO: 1252300 - RNA, 19 nt, Homo sapiens
gaaagugggagcaucagaa

SEQ ID NO: 1252301 - RNA, 19 nt, Homo sapiens
guggaucugugcuuaaauu

SEQ ID NO: 1252302 - RNA, 19 nt, Homo sapiens
gaagcacacucgcggugaa

SEQ ID NO: 1252303 - RNA, 19 nt, Homo sapiens
caaauucaccacacuaaug

SEQ ID NO: 1252304 - RNA, 19 nt, Homo sapiens
gcagagguuuaaauaagau

SEQ ID NO: 1252305 - RNA, 19 nt, Homo sapiens
guugacaauugaaggguua

SEQ ID NO: 1252306 - RNA, 19 nt, Homo sapiens
gagagagaaauguagauaa

SEQ ID NO: 1252307 - RNA, 19 nt, Homo sapiens
gcaguggugugugccuaua

SEQ ID NO: 1252308 - RNA, 19 nt, Homo sapiens
gaggaacucugaaucaacu

SEQ ID NO: 1252309 - RNA, 19 nt, Homo sapiens
ugagugcacuuaacuuuca

SEQ ID NO: 1252310 - RNA, 19 nt, Homo sapiens
ugugguaggugcugucuaa

SEQ ID NO: 1252311 - RNA, 19 nt, Homo sapiens
gcaaccagccucgccauaa

SEQ ID NO: 1252312 - RNA, 19 nt, Homo sapiens
gaucucaucucuaccaaaa

SEQ ID NO: 1252313 - RNA, 19 nt, Homo sapiens
gcagaaugaugaaaugacu

SEQ ID NO: 1252314 - RNA, 19 nt, Homo sapiens
gaaucagccuaacagauca

SEQ ID NO: 1252315 - RNA, 19 nt, Homo sapiens
caggagaaauagccucuug

SEQ ID NO: 1252316 - RNA, 19 nt, Homo sapiens
gagcagggaucacgucacu

SEQ ID NO: 1252317 - RNA, 19 nt, Homo sapiens
ucgcagagguuuaaauaag

SEQ ID NO: 1252318 - RNA, 19 nt, Homo sapiens
ucaaauaucagcaaguuuc

SEQ ID NO: 1252319 - RNA, 19 nt, Homo sapiens
guaggugcuugauaaauag

SEQ ID NO: 1252320 - RNA, 19 nt, Homo sapiens
guaaauagucggaaaauga

SEQ ID NO: 1252321 - RNA, 19 nt, Homo sapiens
caauugaaggguuaaauga

SEQ ID NO: 1252322 - RNA, 19 nt, Homo sapiens
acuguggacuuuagcaaua

SEQ ID NO: 1252323 - RNA, 19 nt, Homo sapiens
guucuuuccugcagucauu

SEQ ID NO: 1252324 - RNA, 19 nt, Homo sapiens
gggaucacgucacugcauu

SEQ ID NO: 1252325 - RNA, 19 nt, Homo sapiens
uaacaaauucaccacacua

SEQ ID NO: 1252326 - RNA, 19 nt, Homo sapiens
gcggacacgugaugaugaa

SEQ ID NO: 1252327 - RNA, 19 nt, Homo sapiens
guuguugacuugacuuguu

SEQ ID NO: 1252328 - RNA, 19 nt, Homo sapiens
gcaaggagagcuggaguug

SEQ ID NO: 1252329 - RNA, 19 nt, Homo sapiens
ccucaaaccuuggcucguu

SEQ ID NO: 1252330 - RNA, 19 nt, Homo sapiens
gagggugagucaagagaau

SEQ ID NO: 1252331 - RNA, 19 nt, Homo sapiens
ugacuuugaugucguguuc

SEQ ID NO: 1252332 - RNA, 19 nt, Homo sapiens
ucuguucacugcuguauau

SEQ ID NO: 1252333 - RNA, 19 nt, Homo sapiens
gcacccuuaugaaugcuuu

SEQ ID NO: 1252334 - RNA, 19 nt, Homo sapiens
gaagcuggaagaaacugua

SEQ ID NO: 1252335 - RNA, 19 nt, Homo sapiens
ggguggaucugugcuuaaa

SEQ ID NO: 1252336 - RNA, 19 nt, Homo sapiens
gagaggcggcagcaacuuu

SEQ ID NO: 1252337 - RNA, 19 nt, Homo sapiens
gagcuggcaucugaaccua

SEQ ID NO: 1252338 - RNA, 19 nt, Homo sapiens
gcaaagaacaaaagagaaa

SEQ ID NO: 1252339 - RNA, 19 nt, Homo sapiens
cgaaguagcugugaaucag

SEQ ID NO: 1252340 - RNA, 19 nt, Homo sapiens
gacacgugaugaugaaaug

SEQ ID NO: 1252341 - RNA, 19 nt, Homo sapiens
gaaaagaugggcacaguug

SEQ ID NO: 1252342 - RNA, 19 nt, Homo sapiens
caaagugagaugcuuaaau

SEQ ID NO: 1252343 - RNA, 19 nt, Homo sapiens
cuucaaauaucagcaaguu

SEQ ID NO: 1252344 - RNA, 19 nt, Homo sapiens
cuguaaaucugaagcuauu

SEQ ID NO: 1252345 - RNA, 19 nt, Homo sapiens
augcuuaaaugcagaguuu

SEQ ID NO: 1252346 - RNA, 19 nt, Homo sapiens
gcccguuucuacuguguaa

SEQ ID NO: 1252347 - RNA, 19 nt, Homo sapiens
caguuugagugcagaauga

SEQ ID NO: 1252348 - RNA, 19 nt, Homo sapiens
gugagacccuaugucauuu

SEQ ID NO: 1252349 - RNA, 19 nt, Homo sapiens
ccaccaaggccaccaguga

SEQ ID NO: 1252350 - RNA, 19 nt, Homo sapiens
uaaucgcccuccucuaaau

SEQ ID NO: 1252351 - RNA, 19 nt, Homo sapiens
ggagaacucgcagagguuu

SEQ ID NO: 1252352 - RNA, 19 nt, Homo sapiens
gccauaaaccagucugaaa

SEQ ID NO: 1252353 - RNA, 19 nt, Homo sapiens
cgaggcagguggaacacuu

SEQ ID NO: 1252354 - RNA, 19 nt, Homo sapiens
agagagaaauguagauaac

SEQ ID NO: 1252355 - RNA, 19 nt, Homo sapiens
ucaccacacuaaugucaga

SEQ ID NO: 1252356 - RNA, 19 nt, Homo sapiens
gaaaagggacauuagagaa

SEQ ID NO: 1252357 - RNA, 19 nt, Homo sapiens
ugaagaagccgagguggaa

SEQ ID NO: 1252358 - RNA, 19 nt, Homo sapiens
gaaaccccgucucuacuaa

SEQ ID NO: 1252359 - RNA, 19 nt, Homo sapiens
ugucagagccauaauagug

SEQ ID NO: 1252360 - RNA, 19 nt, Homo sapiens
gagaccagcuugggcaaca

SEQ ID NO: 1252361 - RNA, 19 nt, Homo sapiens
aaucaacuguggacuuuag

SEQ ID NO: 1252362 - RNA, 19 nt, Homo sapiens
guuaacaugugcugaaagg

SEQ ID NO: 1252363 - RNA, 19 nt, Homo sapiens
cuguaucccuugagaauau

SEQ ID NO: 1252364 - RNA, 19 nt, Homo sapiens
guagcacccuuaugaaugc

SEQ ID NO: 1252365 - RNA, 19 nt, Homo sapiens
gaagacagaaaccacaaag

SEQ ID NO: 1252366 - RNA, 19 nt, Homo sapiens
gagccgagaucgcgucacu

SEQ ID NO: 1252367 - RNA, 19 nt, Homo sapiens
gcagguggaacacuugaga

SEQ ID NO: 1252368 - RNA, 19 nt, Homo sapiens
ugagagagaaauguagaua

SEQ ID NO: 1252369 - RNA, 19 nt, Homo sapiens
gguaaagccuuccguauuu

SEQ ID NO: 1252370 - RNA, 19 nt, Homo sapiens
gagaaacccuauaaaugua

SEQ ID NO: 1252371 - RNA, 19 nt, Homo sapiens
gaaagaaacgcuaugauug

SEQ ID NO: 1252372 - RNA, 19 nt, Homo sapiens
gaaagucgccagccagaua

SEQ ID NO: 1252373 - RNA, 19 nt, Homo sapiens
gagagaagaugcaugaaug

SEQ ID NO: 1252374 - RNA, 19 nt, Homo sapiens
ggaaagaaacgcuaugauu

SEQ ID NO: 1252375 - RNA, 19 nt, Homo sapiens
ccuaagaugucauaucaua

SEQ ID NO: 1252376 - RNA, 19 nt, Homo sapiens
ccaaagccuucccugauua

SEQ ID NO: 1252377 - RNA, 19 nt, Homo sapiens
gaaaucacauaggagauaa

SEQ ID NO: 1252378 - RNA, 19 nt, Homo sapiens
ggacagccuucaauuauca

SEQ ID NO: 1252379 - RNA, 19 nt, Homo sapiens
gguaaagccuuaagauguu

SEQ ID NO: 1252380 - RNA, 19 nt, Homo sapiens
ugaaagaaaucacauagga

SEQ ID NO: 1252381 - RNA, 19 nt, Homo sapiens
ucacauaccuuucucaaca

SEQ ID NO: 1252382 - RNA, 19 nt, Homo sapiens
gagauaagccucaugaaug

SEQ ID NO: 1252383 - RNA, 19 nt, Homo sapiens
ggaaagcauucaguuguuu

SEQ ID NO: 1252384 - RNA, 19 nt, Homo sapiens
gagagaaacccuauaaaug

SEQ ID NO: 1252385 - RNA, 19 nt, Homo sapiens
uguaaagccuucccuauuu

SEQ ID NO: 1252386 - RNA, 19 nt, Homo sapiens
gguaaagccuucacucguu

SEQ ID NO: 1252387 - RNA, 19 nt, Homo sapiens
gagaaacccuaugaaugua

SEQ ID NO: 1252388 - RNA, 19 nt, Homo sapiens
ggaaagcguuaucucauca

SEQ ID NO: 1252389 - RNA, 19 nt, Homo sapiens
ggagagaaacccuauaaau

SEQ ID NO: 1252390 - RNA, 19 nt, Homo sapiens
acacaaacauugaagauca

SEQ ID NO: 1252391 - RNA, 19 nt, Homo sapiens
gaagaugcaugaauguaag

SEQ ID NO: 1252392 - RNA, 19 nt, Homo sapiens
gaaacccuaugaauguaaa

SEQ ID NO: 1252393 - RNA, 19 nt, Homo sapiens
gggaaagccuucauuuauc

SEQ ID NO: 1252394 - RNA, 19 nt, Homo sapiens
gagagaaacccuaugaaug

SEQ ID NO: 1252395 - RNA, 19 nt, Homo sapiens
ggagauggaccucauaaau

SEQ ID NO: 1252396 - RNA, 19 nt, Homo sapiens
gagagaaacccuaugaaug

SEQ ID NO: 1252397 - RNA, 19 nt, Homo sapiens
gagagaaaccguaugaaug

SEQ ID NO: 1252398 - RNA, 19 nt, Homo sapiens
gagagaagccauaugaaug

SEQ ID NO: 1252399 - RNA, 19 nt, Homo sapiens
gaagucauaugauaaugca

SEQ ID NO: 1252400 - RNA, 19 nt, Homo sapiens
ucagaaacgugaaagaaau

SEQ ID NO: 1252401 - RNA, 19 nt, Homo sapiens
gagauacucuauaaaugug

SEQ ID NO: 1252402 - RNA, 19 nt, Homo sapiens
aagaaagccuucagucauu

SEQ ID NO: 1252403 - RNA, 19 nt, Homo sapiens
gggaaagcauucaguuguu

SEQ ID NO: 1252404 - RNA, 19 nt, Homo sapiens
gaagacacauaauaguaca

SEQ ID NO: 1252405 - RNA, 19 nt, Homo sapiens
gaagccacauacacauaaa

SEQ ID NO: 1252406 - RNA, 19 nt, Homo sapiens
gagauggaccucauaaaug

SEQ ID NO: 1252407 - RNA, 19 nt, Homo sapiens
guucauuccuuaauugcua

SEQ ID NO: 1252408 - RNA, 19 nt, Homo sapiens
ggaaugaaaugggaagaca

SEQ ID NO: 1252409 - RNA, 19 nt, Homo sapiens
ggagauaagccucaugaau

SEQ ID NO: 1252410 - RNA, 19 nt, Homo sapiens
gagaagccauaugaaugua

SEQ ID NO: 1252411 - RNA, 19 nt, Homo sapiens
ggagagaagccauaugaau

SEQ ID NO: 1252412 - RNA, 19 nt, Homo sapiens
ggagagaaacccuaugaau

SEQ ID NO: 1252413 - RNA, 19 nt, Homo sapiens
ggagagaaacccuaugaau

SEQ ID NO: 1252414 - RNA, 19 nt, Homo sapiens
gagaaaccguaugaaugua

SEQ ID NO: 1252415 - RNA, 19 nt, Homo sapiens
ggagagaaaccguaugaau

SEQ ID NO: 1252416 - RNA, 19 nt, Homo sapiens
uaucaccacuccuuucaaa

SEQ ID NO: 1252417 - RNA, 19 nt, Homo sapiens
ugagaaacccuaugaaugu

SEQ ID NO: 1252418 - RNA, 19 nt, Homo sapiens
gagaagccacauacacaua

SEQ ID NO: 1252419 - RNA, 19 nt, Homo sapiens
gaaccuggacuguauagga

SEQ ID NO: 1252420 - RNA, 19 nt, Homo sapiens
gagauggaccucacaaaug

SEQ ID NO: 1252421 - RNA, 19 nt, Homo sapiens
gaaagaauucacacuggaa

SEQ ID NO: 1252422 - RNA, 19 nt, Homo sapiens
caacauagaaggacucaca

SEQ ID NO: 1252423 - RNA, 19 nt, Homo sapiens
gaauguaagcaguguugua

SEQ ID NO: 1252424 - RNA, 19 nt, Homo sapiens
gaaacgcuaugauuguaag

SEQ ID NO: 1252425 - RNA, 19 nt, Homo sapiens
guaaagccuuaagauguuu

SEQ ID NO: 1252426 - RNA, 19 nt, Homo sapiens
agagaaacccuauaaaugu

SEQ ID NO: 1252427 - RNA, 19 nt, Homo sapiens
ggagauggaccucacaaau

SEQ ID NO: 1252428 - RNA, 19 nt, Homo sapiens
ggagaaaccauaugaaugc

SEQ ID NO: 1252429 - RNA, 19 nt, Homo sapiens
uuaggaaccuggacuguau

SEQ ID NO: 1252430 - RNA, 19 nt, Homo sapiens
aagaaacgcuaugauugua

SEQ ID NO: 1252431 - RNA, 19 nt, Homo sapiens
aaucauggguuguucauuc

SEQ ID NO: 1252432 - RNA, 19 nt, Homo sapiens
ccaguugaaugauuguauu

SEQ ID NO: 1252433 - RNA, 19 nt, Homo sapiens
agauggaccucauaaaugu

SEQ ID NO: 1252434 - RNA, 19 nt, Homo sapiens
gaauguaaagaauguggua

SEQ ID NO: 1252435 - RNA, 19 nt, Homo sapiens
ggaaagccuucauuuaucc

SEQ ID NO: 1252436 - RNA, 19 nt, Homo sapiens
gggaaagcguuaucucauc

SEQ ID NO: 1252437 - RNA, 19 nt, Homo sapiens
gcaaagucaugaaagaacu

SEQ ID NO: 1252438 - RNA, 19 nt, Homo sapiens
gagagaagccacauacaca

SEQ ID NO: 1252439 - RNA, 19 nt, Homo sapiens
ggaaggcacugaguucucu

SEQ ID NO: 1252440 - RNA, 19 nt, Homo sapiens
guaagaaagccuucaguca

SEQ ID NO: 1252441 - RNA, 19 nt, Homo sapiens
gagaagaugcaugaaugua

SEQ ID NO: 1252442 - RNA, 19 nt, Homo sapiens
gaaagaacuugggcaacuc

SEQ ID NO: 1252443 - RNA, 19 nt, Homo sapiens
ggagagaagaugcaugaau

SEQ ID NO: 1252444 - RNA, 19 nt, Homo sapiens
gagaagccauaugagugua

SEQ ID NO: 1252445 - RNA, 19 nt, Homo sapiens
ggagagaagccauaugagu

SEQ ID NO: 1252446 - RNA, 19 nt, Homo sapiens
ggagaaaucauggguuguu

SEQ ID NO: 1252447 - RNA, 19 nt, Homo sapiens
gaagaucagcacagaaauc

SEQ ID NO: 1252448 - RNA, 19 nt, Homo sapiens
gggaagacacaaacauuga

SEQ ID NO: 1252449 - RNA, 19 nt, Homo sapiens
gcaggaaagcauucucuug

SEQ ID NO: 1252450 - RNA, 19 nt, Homo sapiens
gugggaaagccuucauuua

SEQ ID NO: 1252451 - RNA, 19 nt, Homo sapiens
gauaguacugugaaugaaa

SEQ ID NO: 1252452 - RNA, 19 nt, Homo sapiens
gaagccauaugaauguaag

SEQ ID NO: 1252453 - RNA, 19 nt, Homo sapiens
uaagaaagccuucagucau

SEQ ID NO: 1252454 - RNA, 19 nt, Homo sapiens
ugggaaagccuucauuuau

SEQ ID NO: 1252455 - RNA, 19 nt, Homo sapiens
cuaguucacugcaaaguca

SEQ ID NO: 1252456 - RNA, 19 nt, Homo sapiens
ucuaagacaugaaagaaca

SEQ ID NO: 1252457 - RNA, 19 nt, Homo sapiens
ccacauacacauaaacaau

SEQ ID NO: 1252458 - RNA, 19 nt, Homo sapiens
ggaagacacaaacauugaa

SEQ ID NO: 1252459 - RNA, 19 nt, Homo sapiens
gaaugucaacaauguggua

SEQ ID NO: 1252460 - RNA, 19 nt, Homo sapiens
cagaugagugucaggaaua

SEQ ID NO: 1252461 - RNA, 19 nt, Homo sapiens
gaauucaagaucugagaaa

SEQ ID NO: 1252462 - RNA, 19 nt, Homo sapiens
gcaugaauguaaggaaugu

SEQ ID NO: 1252463 - RNA, 19 nt, Homo sapiens
ggacucacauggcugaaaa

SEQ ID NO: 1252464 - RNA, 19 nt, Homo sapiens
gggagaaaccauaugaaug

SEQ ID NO: 1252465 - RNA, 19 nt, Homo sapiens
gaaaccguaugaauguaag

SEQ ID NO: 1252466 - RNA, 19 nt, Homo sapiens
uggccuaguuuauuucgua

SEQ ID NO: 1252467 - RNA, 19 nt, Homo sapiens
agaaagccuucagucauuu

SEQ ID NO: 1252468 - RNA, 19 nt, Homo sapiens
guaaagccuuccguauuuc

SEQ ID NO: 1252469 - RNA, 19 nt, Homo sapiens
gcaaacagauuaccagaaa

SEQ ID NO: 1252470 - RNA, 19 nt, Homo sapiens
gaagacagauuaguacuuu

SEQ ID NO: 1252471 - RNA, 19 nt, Homo sapiens
gaaaguacauggcacuaaa

SEQ ID NO: 1252472 - RNA, 19 nt, Homo sapiens
gaaagaagacagauuagua

SEQ ID NO: 1252473 - RNA, 19 nt, Homo sapiens
ggaagacuuugaucaguua

SEQ ID NO: 1252474 - RNA, 19 nt, Homo sapiens
ggagaaagaagacagauua

SEQ ID NO: 1252475 - RNA, 19 nt, Homo sapiens
ggaacuaaauccugacuuu

SEQ ID NO: 1252476 - RNA, 19 nt, Homo sapiens
guacagaacuuauggaaag

SEQ ID NO: 1252477 - RNA, 19 nt, Homo sapiens
gauaagcccuucauugaga

SEQ ID NO: 1252478 - RNA, 19 nt, Homo sapiens
ccaaagaccuuccauagau

SEQ ID NO: 1252479 - RNA, 19 nt, Homo sapiens
uggaagagcuccuauuaaa

SEQ ID NO: 1252480 - RNA, 19 nt, Homo sapiens
gaagauauuucagcaauca

SEQ ID NO: 1252481 - RNA, 19 nt, Homo sapiens
gaaggaagauucuguucau

SEQ ID NO: 1252482 - RNA, 19 nt, Homo sapiens
caacugcucuucccaucua

SEQ ID NO: 1252483 - RNA, 19 nt, Homo sapiens
ucucuucgcugcugaaaua

SEQ ID NO: 1252484 - RNA, 19 nt, Homo sapiens
guacauuucuuaacacaga

SEQ ID NO: 1252485 - RNA, 19 nt, Homo sapiens
gaaauacauugcagugaug

SEQ ID NO: 1252486 - RNA, 19 nt, Homo sapiens
ggaaggauuaugucaaaua

SEQ ID NO: 1252487 - RNA, 19 nt, Homo sapiens
ccaaucaccugcaaauuau

SEQ ID NO: 1252488 - RNA, 19 nt, Homo sapiens
gcacuaaauucuaucacaa

SEQ ID NO: 1252489 - RNA, 19 nt, Homo sapiens
ggaagcaauuggcaaacua

SEQ ID NO: 1252490 - RNA, 19 nt, Homo sapiens
gaaggaacacccuguauau

SEQ ID NO: 1252491 - RNA, 19 nt, Homo sapiens
gggaucauguacuaucuua

SEQ ID NO: 1252492 - RNA, 19 nt, Homo sapiens
ggauaaugcucuuucaugu

SEQ ID NO: 1252493 - RNA, 19 nt, Homo sapiens
gcucuuucauguugucuua

SEQ ID NO: 1252494 - RNA, 19 nt, Homo sapiens
guacacacacaguuaaaua

SEQ ID NO: 1252495 - RNA, 19 nt, Homo sapiens
guugacacauucacuauaa

SEQ ID NO: 1252496 - RNA, 19 nt, Homo sapiens
gaaggauuaugucaaauag

SEQ ID NO: 1252497 - RNA, 19 nt, Homo sapiens
ccagaaaggucaaagaauc

SEQ ID NO: 1252498 - RNA, 19 nt, Homo sapiens
ccacacacauccacugaaa

SEQ ID NO: 1252499 - RNA, 19 nt, Homo sapiens
uugcauauguccacaaaua

SEQ ID NO: 1252500 - RNA, 19 nt, Homo sapiens
aaacguuacuugaagcaua

SEQ ID NO: 1252501 - RNA, 19 nt, Homo sapiens
uaacacuucuuacagcuuu

SEQ ID NO: 1252502 - RNA, 19 nt, Homo sapiens
gcaagcagaugcaagaaag

SEQ ID NO: 1252503 - RNA, 19 nt, Homo sapiens
gaauauccaccuccuuuaa

SEQ ID NO: 1252504 - RNA, 19 nt, Homo sapiens
uguaguuccucauguauua

SEQ ID NO: 1252505 - RNA, 19 nt, Homo sapiens
gaucaguuauuccuacuau

SEQ ID NO: 1252506 - RNA, 19 nt, Homo sapiens
gaucagggaaugcaauuaa

SEQ ID NO: 1252507 - RNA, 19 nt, Homo sapiens
gcuuucaacuucuaacuuu

SEQ ID NO: 1252508 - RNA, 19 nt, Homo sapiens
ugaaagauauaccuagaga

SEQ ID NO: 1252509 - RNA, 19 nt, Homo sapiens
gggaagauauuucagcaau

SEQ ID NO: 1252510 - RNA, 19 nt, Homo sapiens
gaaggaagcaauuggcaaa

SEQ ID NO: 1252511 - RNA, 19 nt, Homo sapiens
ugucagagguccaauaaau

SEQ ID NO: 1252512 - RNA, 19 nt, Homo sapiens
gcuagcggcugaaguauuc

SEQ ID NO: 1252513 - RNA, 19 nt, Homo sapiens
gaaauacagcagccacuuu

SEQ ID NO: 1252514 - RNA, 19 nt, Homo sapiens
ccaguuagguuuacaucaa

SEQ ID NO: 1252515 - RNA, 19 nt, Homo sapiens
ugagaggguuaauucaaua

SEQ ID NO: 1252516 - RNA, 19 nt, Homo sapiens
uaacugcagucugaauuaa

SEQ ID NO: 1252517 - RNA, 19 nt, Homo sapiens
gaagagauucugugagaga

SEQ ID NO: 1252518 - RNA, 19 nt, Homo sapiens
ugaaguaguugacacauuc

SEQ ID NO: 1252519 - RNA, 19 nt, Homo sapiens
ggauggaguacauuucuua

SEQ ID NO: 1252520 - RNA, 19 nt, Homo sapiens
gggaagacuuugaucaguu

SEQ ID NO: 1252521 - RNA, 19 nt, Homo sapiens
acagagggaucauguacua

SEQ ID NO: 1252522 - RNA, 19 nt, Homo sapiens
aacauucccucuugucuua

SEQ ID NO: 1252523 - RNA, 19 nt, Homo sapiens
ggaagauucuguucauugg

SEQ ID NO: 1252524 - RNA, 19 nt, Homo sapiens
cauggaagagcuccuauua

SEQ ID NO: 1252525 - RNA, 19 nt, Homo sapiens
aaauguaguuccucaugua

SEQ ID NO: 1252526 - RNA, 19 nt, Homo sapiens
ucauaaacauucccucuug

SEQ ID NO: 1252527 - RNA, 19 nt, Homo sapiens
ucauuugccugucuucuaa

SEQ ID NO: 1252528 - RNA, 19 nt, Homo sapiens
gaucaguucuuuuguauga

SEQ ID NO: 1252529 - RNA, 19 nt, Homo sapiens
gcaacuguaucaaauccaa

SEQ ID NO: 1252530 - RNA, 19 nt, Homo sapiens
gaaaacacaccaugucaua

SEQ ID NO: 1252531 - RNA, 19 nt, Homo sapiens
gguguucaguggcuuaauu

SEQ ID NO: 1252532 - RNA, 19 nt, Homo sapiens
guaacugcagucugaauua

SEQ ID NO: 1252533 - RNA, 19 nt, Homo sapiens
auaaugcucuuucauguug

SEQ ID NO: 1252534 - RNA, 19 nt, Homo sapiens
caauauuuguuguggauga

SEQ ID NO: 1252535 - RNA, 19 nt, Homo sapiens
gcaaguagaaguuguccuu

SEQ ID NO: 1252536 - RNA, 19 nt, Homo sapiens
caggaugugugcaaauaaa

SEQ ID NO: 1252537 - RNA, 19 nt, Homo sapiens
gguagugaaaucaaaguua

SEQ ID NO: 1252538 - RNA, 19 nt, Homo sapiens
aaacauggcuaugaaguag

SEQ ID NO: 1252539 - RNA, 19 nt, Homo sapiens
caucagcaauccauuagga

SEQ ID NO: 1252540 - RNA, 19 nt, Homo sapiens
aagcagaucuucacacauc

SEQ ID NO: 1252541 - RNA, 19 nt, Homo sapiens
ucagagacuuuauagauca

SEQ ID NO: 1252542 - RNA, 19 nt, Homo sapiens
caaagaccuuccauagaug

SEQ ID NO: 1252543 - RNA, 19 nt, Homo sapiens
aaggaaggauuaugucaaa

SEQ ID NO: 1252544 - RNA, 19 nt, Homo sapiens
aaacagugcuuccuucucu

SEQ ID NO: 1252545 - RNA, 19 nt, Homo sapiens
aaaggacuaugcauucuga

SEQ ID NO: 1252546 - RNA, 19 nt, Homo sapiens
guacuauguuucauugaug

SEQ ID NO: 1252547 - RNA, 19 nt, Homo sapiens
uccaaucaccugcaaauua

SEQ ID NO: 1252548 - RNA, 19 nt, Homo sapiens
ggaaugaacagaaucucaa

SEQ ID NO: 1252549 - RNA, 19 nt, Homo sapiens
gaaaggaaggauuauguca

SEQ ID NO: 1252550 - RNA, 19 nt, Homo sapiens
uaagaaagcagaaggaaca

SEQ ID NO: 1252551 - RNA, 19 nt, Homo sapiens
ggaugaagcaaacuugauu

SEQ ID NO: 1252552 - RNA, 19 nt, Homo sapiens
gcaaaggacuaugcauucu

SEQ ID NO: 1252553 - RNA, 19 nt, Homo sapiens
gaaguuguccuuucauucu

SEQ ID NO: 1252554 - RNA, 19 nt, Homo sapiens
caauaaaucagguuuguuc

SEQ ID NO: 1252555 - RNA, 19 nt, Homo sapiens
acaaggcacuguaacaaau

SEQ ID NO: 1252556 - RNA, 19 nt, Homo sapiens
aauaugguguccuaacuaa

SEQ ID NO: 1252557 - RNA, 19 nt, Homo sapiens
gaccaaagaccuuccauag

SEQ ID NO: 1252558 - RNA, 19 nt, Homo sapiens
gugaacagcugaaugaaac

SEQ ID NO: 1252559 - RNA, 19 nt, Homo sapiens
ggaagucaugcgccaguua

SEQ ID NO: 1252560 - RNA, 19 nt, Homo sapiens
acacuuaaaugcaaacauc

SEQ ID NO: 1252561 - RNA, 19 nt, Homo sapiens
cguacaaacucaccaucua

SEQ ID NO: 1252562 - RNA, 19 nt, Homo sapiens
ccucugggcuuaggaauga

SEQ ID NO: 1252563 - RNA, 19 nt, Homo sapiens
cagcuacccucugggcuua

SEQ ID NO: 1252564 - RNA, 19 nt, Homo sapiens
ggacaaacagugcuuccuu

SEQ ID NO: 1252565 - RNA, 19 nt, Homo sapiens
cuucgcugcugaaauaaua

SEQ ID NO: 1252566 - RNA, 19 nt, Homo sapiens
ccaccaagcauuugcauau

SEQ ID NO: 1252567 - RNA, 19 nt, Homo sapiens
uugaagagauucugugaga

SEQ ID NO: 1252568 - RNA, 19 nt, Homo sapiens
gaacuaaaucagugucugu

SEQ ID NO: 1252569 - RNA, 19 nt, Homo sapiens
gaauuucgauguuccauau

SEQ ID NO: 1252570 - RNA, 19 nt, Homo sapiens
gcaagugaauuucgauguu

SEQ ID NO: 1252571 - RNA, 19 nt, Homo sapiens
gagugcauguugacaguua

SEQ ID NO: 1252572 - RNA, 19 nt, Homo sapiens
gcagaagacccaacaaaga

SEQ ID NO: 1252573 - RNA, 19 nt, Homo sapiens
auaaggagauacugcuuua

SEQ ID NO: 1252574 - RNA, 19 nt, Homo sapiens
agaauuggauagccuagua

SEQ ID NO: 1252575 - RNA, 19 nt, Homo sapiens
ccacugaaucguucuauaa

SEQ ID NO: 1252576 - RNA, 19 nt, Homo sapiens
guucgggucuguuucguuu

SEQ ID NO: 1252577 - RNA, 19 nt, Homo sapiens
gaccagggauccucuccaa

SEQ ID NO: 1252578 - RNA, 19 nt, Homo sapiens
uuggauagccuaguaaaua

SEQ ID NO: 1252579 - RNA, 19 nt, Homo sapiens
caagugaauuucgauguuc

SEQ ID NO: 1252580 - RNA, 19 nt, Homo sapiens
cagggauccucuccaaauu

SEQ ID NO: 1252581 - RNA, 19 nt, Homo sapiens
ggaucucggugcgaacuuu

SEQ ID NO: 1252582 - RNA, 19 nt, Homo sapiens
caacuuuucucuuggcuaa

SEQ ID NO: 1252583 - RNA, 19 nt, Homo sapiens
guacguacccagaauugga

SEQ ID NO: 1252584 - RNA, 19 nt, Homo sapiens
ucucuuggcuaacucuuga

SEQ ID NO: 1252585 - RNA, 19 nt, Homo sapiens
uaccugaucugcauagaca

SEQ ID NO: 1252586 - RNA, 19 nt, Homo sapiens
guaaauacugcacgugguu

SEQ ID NO: 1252587 - RNA, 19 nt, Homo sapiens
gaauuggauagccuaguaa

SEQ ID NO: 1252588 - RNA, 19 nt, Homo sapiens
ccagggauccucuccaaau

SEQ ID NO: 1252589 - RNA, 19 nt, Homo sapiens
cagcagaagacccaacaaa

SEQ ID NO: 1252590 - RNA, 19 nt, Homo sapiens
uccauuaucugcaagugaa

SEQ ID NO: 1252591 - RNA, 19 nt, Homo sapiens
cucacucacucuccaauaa

SEQ ID NO: 1252592 - RNA, 19 nt, Homo sapiens
uccaauuucuacagucuuu

SEQ ID NO: 1252593 - RNA, 19 nt, Homo sapiens
aaacguggagugcauguug

SEQ ID NO: 1252594 - RNA, 19 nt, Homo sapiens
cauaaggagauacugcuuu

SEQ ID NO: 1252595 - RNA, 19 nt, Homo sapiens
uaaauacugcacgugguua

SEQ ID NO: 1252596 - RNA, 19 nt, Homo sapiens
aggagauacugcuuuagaa

SEQ ID NO: 1252597 - RNA, 19 nt, Homo sapiens
uaaccuuguugcuccaaau

SEQ ID NO: 1252598 - RNA, 19 nt, Homo sapiens
cacucacucuccaauaauu

SEQ ID NO: 1252599 - RNA, 19 nt, Homo sapiens
ggcaugccauaaggagaua

SEQ ID NO: 1252600 - RNA, 19 nt, Homo sapiens
uuaccuaccugaucugcau

SEQ ID NO: 1252601 - RNA, 19 nt, Homo sapiens
gguccaauuucuacagucu

SEQ ID NO: 1252602 - RNA, 19 nt, Homo sapiens
gcuuuagaacuccacauuu

SEQ ID NO: 1252603 - RNA, 19 nt, Homo sapiens
gaagcugcauaaaaucuug

SEQ ID NO: 1252604 - RNA, 19 nt, Homo sapiens
ugagucaacagaugcguuu

SEQ ID NO: 1252605 - RNA, 19 nt, Homo sapiens
uggauagccuaguaaauac

SEQ ID NO: 1252606 - RNA, 19 nt, Homo sapiens
cauguugacaguuaccuuu

SEQ ID NO: 1252607 - RNA, 19 nt, Homo sapiens
caacagaugcguuuugugu

SEQ ID NO: 1252608 - RNA, 19 nt, Homo sapiens
guaaccuuguugcuccaaa

SEQ ID NO: 1252609 - RNA, 19 nt, Homo sapiens
ggagauacugcuuuagaac

SEQ ID NO: 1252610 - RNA, 19 nt, Homo sapiens
cuauaaacguggagugcau

SEQ ID NO: 1252611 - RNA, 19 nt, Homo sapiens
cccacugaaucguucuaua

SEQ ID NO: 1252612 - RNA, 19 nt, Homo sapiens
gaggaauaaauuucacaug

SEQ ID NO: 1252613 - RNA, 19 nt, Homo sapiens
aauguugaguuacguuuag

SEQ ID NO: 1252614 - RNA, 19 nt, Homo sapiens
gaucugcauagacauugaa

SEQ ID NO: 1252615 - RNA, 19 nt, Homo sapiens
aaggagauacugcuuuaga

SEQ ID NO: 1252616 - RNA, 19 nt, Homo sapiens
cagaagacccaacaaagac

SEQ ID NO: 1252617 - RNA, 19 nt, Homo sapiens
cuuuagaacuccacauuuu

SEQ ID NO: 1252618 - RNA, 19 nt, Homo sapiens
gagauacugcuuuagaacu

SEQ ID NO: 1252619 - RNA, 19 nt, Homo sapiens
ccuuguugcuccaaauaau

SEQ ID NO: 1252620 - RNA, 19 nt, Homo sapiens
uacaaacccugagucaaca

SEQ ID NO: 1252621 - RNA, 19 nt, Homo sapiens
ggugcgaacuuuccuugac

SEQ ID NO: 1252622 - RNA, 19 nt, Homo sapiens
ugaauuucgauguuccaua

SEQ ID NO: 1252623 - RNA, 19 nt, Homo sapiens
ccuggagccuggauugauc

SEQ ID NO: 1252624 - RNA, 19 nt, Homo sapiens
caacucaggauccagugau

SEQ ID NO: 1252625 - RNA, 19 nt, Homo sapiens
auacaaacccugagucaac

SEQ ID NO: 1252626 - RNA, 19 nt, Homo sapiens
gacgcggcaugaagggaaa

SEQ ID NO: 1252627 - RNA, 19 nt, Homo sapiens
guugaguuacguuuagaaa

SEQ ID NO: 1252628 - RNA, 19 nt, Homo sapiens
acucuuaccuaccugaucu

SEQ ID NO: 1252629 - RNA, 19 nt, Homo sapiens
ccagugauucgaguaggua

SEQ ID NO: 1252630 - RNA, 19 nt, Homo sapiens
cacugaaucguucuauaaa

SEQ ID NO: 1252631 - RNA, 19 nt, Homo sapiens
ucgauguuccauauguuua

SEQ ID NO: 1252632 - RNA, 19 nt, Homo sapiens
cuuaguccauuaucugcaa

SEQ ID NO: 1252633 - RNA, 19 nt, Homo sapiens
gaagacgugguagcagguu

SEQ ID NO: 1252634 - RNA, 19 nt, Homo sapiens
gcgagaagacgugguagca

SEQ ID NO: 1252635 - RNA, 19 nt, Homo sapiens
gggauccucuccaaauucc

SEQ ID NO: 1252636 - RNA, 19 nt, Homo sapiens
ucuugaagcugcauaaaau

SEQ ID NO: 1252637 - RNA, 19 nt, Homo sapiens
ugaucugcauagacauuga

SEQ ID NO: 1252638 - RNA, 19 nt, Homo sapiens
guucgguucgggucuguuu

SEQ ID NO: 1252639 - RNA, 19 nt, Homo sapiens
agauacugcuuuagaacuc

SEQ ID NO: 1252640 - RNA, 19 nt, Homo sapiens
ucacucacucuccaauaau

SEQ ID NO: 1252641 - RNA, 19 nt, Homo sapiens
ccucacucacucuccaaua

SEQ ID NO: 1252642 - RNA, 19 nt, Homo sapiens
guugacaguuaccuuucga

SEQ ID NO: 1252643 - RNA, 19 nt, Homo sapiens
uggagugcauguugacagu

SEQ ID NO: 1252644 - RNA, 19 nt, Homo sapiens
gauccagugauucgaguag

SEQ ID NO: 1252645 - RNA, 19 nt, Homo sapiens
cgauguuccauauguuuau

SEQ ID NO: 1252646 - RNA, 19 nt, Homo sapiens
gaaagaaugugccaagaua

SEQ ID NO: 1252647 - RNA, 19 nt, Homo sapiens
uagcaaagcuuuacaagaa

SEQ ID NO: 1252648 - RNA, 19 nt, Homo sapiens
gaucaaacaugucacaaga

SEQ ID NO: 1252649 - RNA, 19 nt, Homo sapiens
caacagaaauagaggguuu

SEQ ID NO: 1252650 - RNA, 19 nt, Homo sapiens
gagaugaacagcucaaaua

SEQ ID NO: 1252651 - RNA, 19 nt, Homo sapiens
caagggagauugauauaug

SEQ ID NO: 1252652 - RNA, 19 nt, Homo sapiens
caaagcagaugaaagaaga

SEQ ID NO: 1252653 - RNA, 19 nt, Homo sapiens
guucugagauggacaaauu

SEQ ID NO: 1252654 - RNA, 19 nt, Homo sapiens
gaaaggucauucugucuga

SEQ ID NO: 1252655 - RNA, 19 nt, Homo sapiens
uauguuagcugaacuuuga

SEQ ID NO: 1252656 - RNA, 19 nt, Homo sapiens
gcaauaaacccauucauag

SEQ ID NO: 1252657 - RNA, 19 nt, Homo sapiens
ccucauacaucuccaaauu

SEQ ID NO: 1252658 - RNA, 19 nt, Homo sapiens
gaaacacuccaaagagaua

SEQ ID NO: 1252659 - RNA, 19 nt, Homo sapiens
acaauuugcucucauguuu

SEQ ID NO: 1252660 - RNA, 19 nt, Homo sapiens
gcgaaacacuccaaagaga

SEQ ID NO: 1252661 - RNA, 19 nt, Homo sapiens
gaaggagacugacgaugug

SEQ ID NO: 1252662 - RNA, 19 nt, Homo sapiens
ggaaggcugucuugcuaaa

SEQ ID NO: 1252663 - RNA, 19 nt, Homo sapiens
ggaccggacagguguauua

SEQ ID NO: 1252664 - RNA, 19 nt, Homo sapiens
caaauucaguguuggaaau

SEQ ID NO: 1252665 - RNA, 19 nt, Homo sapiens
ccacagcgccuaucucaaa

SEQ ID NO: 1252666 - RNA, 19 nt, Homo sapiens
gaagauuucacaccaguuu

SEQ ID NO: 1252667 - RNA, 19 nt, Homo sapiens
ccuguuggauuccuauuua

SEQ ID NO: 1252668 - RNA, 19 nt, Homo sapiens
gaagagauugcauauaaug

SEQ ID NO: 1252669 - RNA, 19 nt, Homo sapiens
ggaagugagugagaaagaa

SEQ ID NO: 1252670 - RNA, 19 nt, Homo sapiens
gacaucaaguggcacauuu

SEQ ID NO: 1252671 - RNA, 19 nt, Homo sapiens
ugauucagauugacacaua

SEQ ID NO: 1252672 - RNA, 19 nt, Homo sapiens
guacauguaugaucagaca

SEQ ID NO: 1252673 - RNA, 19 nt, Homo sapiens
gcaugucccugcccagaaa

SEQ ID NO: 1252674 - RNA, 19 nt, Homo sapiens
gagaagauagcaaagcuuu

SEQ ID NO: 1252675 - RNA, 19 nt, Homo sapiens
ggaaggagacugacgaugu

SEQ ID NO: 1252676 - RNA, 19 nt, Homo sapiens
caacacggaugaugaacga

SEQ ID NO: 1252677 - RNA, 19 nt, Homo sapiens
ggacuuccuuugaugauuc

SEQ ID NO: 1252678 - RNA, 19 nt, Homo sapiens
ggagaauccuggacacugu

SEQ ID NO: 1252679 - RNA, 19 nt, Homo sapiens
caaagcgagugcucuugua

SEQ ID NO: 1252680 - RNA, 19 nt, Homo sapiens
gaagagcaacgagugguua

SEQ ID NO: 1252681 - RNA, 19 nt, Homo sapiens
caucucaaguggcccuuua

SEQ ID NO: 1252682 - RNA, 19 nt, Homo sapiens
ucacaagagucggacaaua

SEQ ID NO: 1252683 - RNA, 19 nt, Homo sapiens
aaggagagcuuuaauacga

SEQ ID NO: 1252684 - RNA, 19 nt, Homo sapiens
ggacgcagccacagagaaa

SEQ ID NO: 1252685 - RNA, 19 nt, Homo sapiens
ugacaucaccuacuucaaa

SEQ ID NO: 1252686 - RNA, 19 nt, Homo sapiens
ccaaaucucuccgucagaa

SEQ ID NO: 1252687 - RNA, 19 nt, Homo sapiens
gagcgaaacacuccaaaga

SEQ ID NO: 1252688 - RNA, 19 nt, Homo sapiens
gcaacgagugguuaucuuu

SEQ ID NO: 1252689 - RNA, 19 nt, Homo sapiens
uaacaaagucugaacugaa

SEQ ID NO: 1252690 - RNA, 19 nt, Homo sapiens
gagaaagaaugugccaaga

SEQ ID NO: 1252691 - RNA, 19 nt, Homo sapiens
gaagcgauaucugagaaau

SEQ ID NO: 1252692 - RNA, 19 nt, Homo sapiens
gaacugaacagaacaagac

SEQ ID NO: 1252693 - RNA, 19 nt, Homo sapiens
cacaagagucggacaauaa

SEQ ID NO: 1252694 - RNA, 19 nt, Homo sapiens
gcccagauuuguuuguaaa

SEQ ID NO: 1252695 - RNA, 19 nt, Homo sapiens
ugacaaaggagcagaaaga

SEQ ID NO: 1252696 - RNA, 19 nt, Homo sapiens
ggagagcuuuaauacgauu

SEQ ID NO: 1252697 - RNA, 19 nt, Homo sapiens
caacaaaggacaguucuau

SEQ ID NO: 1252698 - RNA, 19 nt, Homo sapiens
ccagugaaccuuucccuaa

SEQ ID NO: 1252699 - RNA, 19 nt, Homo sapiens
ggaauugguuucuaaaaga

SEQ ID NO: 1252700 - RNA, 19 nt, Homo sapiens
acaagaggcugcugucugu

SEQ ID NO: 1252701 - RNA, 19 nt, Homo sapiens
uaugaacggcccuuucuua

SEQ ID NO: 1252702 - RNA, 19 nt, Homo sapiens
caaagguucucuacaaagg

SEQ ID NO: 1252703 - RNA, 19 nt, Homo sapiens
ucauacaucuccaaauugu

SEQ ID NO: 1252704 - RNA, 19 nt, Homo sapiens
ggcagaagaugaauugaag

SEQ ID NO: 1252705 - RNA, 19 nt, Homo sapiens
ccugggagcuggaagagaa

SEQ ID NO: 1252706 - RNA, 19 nt, Homo sapiens
gacauucagucaccgugua

SEQ ID NO: 1252707 - RNA, 19 nt, Homo sapiens
aaggcugucuugcuaaaua

SEQ ID NO: 1252708 - RNA, 19 nt, Homo sapiens
ggacaaagcgagugcucuu

SEQ ID NO: 1252709 - RNA, 19 nt, Homo sapiens
caauaaacccauucauaga

SEQ ID NO: 1252710 - RNA, 19 nt, Homo sapiens
gcagaggguccuugacauu

SEQ ID NO: 1252711 - RNA, 19 nt, Homo sapiens
caagauggacucugcaaug

SEQ ID NO: 1252712 - RNA, 19 nt, Homo sapiens
ggucuucugugacaaagga

SEQ ID NO: 1252713 - RNA, 19 nt, Homo sapiens
cgagagcucugccaucauc

SEQ ID NO: 1252714 - RNA, 19 nt, Homo sapiens
gaaguucggaccaacagaa

SEQ ID NO: 1252715 - RNA, 19 nt, Homo sapiens
gggcaugacucuccuucga

SEQ ID NO: 1252716 - RNA, 19 nt, Homo sapiens
ucaaacaugucacaagagu

SEQ ID NO: 1252717 - RNA, 19 nt, Homo sapiens
aagaucaccuggagaauuc

SEQ ID NO: 1252718 - RNA, 19 nt, Homo sapiens
ggagauugauauauguaca

SEQ ID NO: 1252719 - RNA, 19 nt, Homo sapiens
gaagauagcaaagcuuuac

SEQ ID NO: 1252720 - RNA, 19 nt, Homo sapiens
gcacauacagcgagagcuu

SEQ ID NO: 1252721 - RNA, 19 nt, Homo sapiens
cagugaaccuuucccuaaa

SEQ ID NO: 1252722 - RNA, 19 nt, Homo sapiens
gaacaggaagaacgggaaa

SEQ ID NO: 1252723 - RNA, 19 nt, Homo sapiens
gggcugaggaguacaugua

SEQ ID NO: 1252724 - RNA, 19 nt, Homo sapiens
caagaucaccuggagaauu

SEQ ID NO: 1252725 - RNA, 19 nt, Homo sapiens
ugaccuaccucaacaaagg

SEQ ID NO: 1252726 - RNA, 19 nt, Homo sapiens
ccagugaagcccagaguaa

SEQ ID NO: 1252727 - RNA, 19 nt, Homo sapiens
uaaggcagaagaugaauug

SEQ ID NO: 1252728 - RNA, 19 nt, Homo sapiens
gguuaggaauaguuucaaa

SEQ ID NO: 1252729 - RNA, 19 nt, Homo sapiens
auaccuggcuccugugaaa

SEQ ID NO: 1252730 - RNA, 19 nt, Homo sapiens
gaacgaggacaccuucauc

SEQ ID NO: 1252731 - RNA, 19 nt, Homo sapiens
gaaagaagaagggacaaag

SEQ ID NO: 1252732 - RNA, 19 nt, Homo sapiens
caaaggagcagaaagaaaa

SEQ ID NO: 1252733 - RNA, 19 nt, Homo sapiens
ccaagaagaccaggagaaa

SEQ ID NO: 1252734 - RNA, 19 nt, Homo sapiens
caagcaagggagauugaua

SEQ ID NO: 1252735 - RNA, 19 nt, Homo sapiens
aaacuuaggaagcaugaaa

SEQ ID NO: 1252736 - RNA, 19 nt, Homo sapiens
gacauaacaacggcaaaua

SEQ ID NO: 1252737 - RNA, 19 nt, Homo sapiens
ggacaaauucaguguugga

SEQ ID NO: 1252738 - RNA, 19 nt, Homo sapiens
gauggagggucugcuucua

SEQ ID NO: 1252739 - RNA, 19 nt, Homo sapiens
gaaugaagaggcgaagauu

SEQ ID NO: 1252740 - RNA, 19 nt, Homo sapiens
gugguuaucuuugaacaga

SEQ ID NO: 1252741 - RNA, 19 nt, Homo sapiens
gaaccuuucccuaaaucaa

SEQ ID NO: 1252742 - RNA, 19 nt, Homo sapiens
ggaagcaugaaauaaauca

SEQ ID NO: 1252743 - RNA, 19 nt, Homo sapiens
ccacaucccuuccgaucca

SEQ ID NO: 1252744 - RNA, 19 nt, Homo sapiens
gggccacuguucucuuuga

SEQ ID NO: 1252745 - RNA, 19 nt, Homo sapiens
ccacguuuaucucacaaug

SEQ ID NO: 1252746 - RNA, 19 nt, Homo sapiens
ggagagagguggaaugaag

SEQ ID NO: 1252747 - RNA, 19 nt, Homo sapiens
acaaauggauuaccaaaga

SEQ ID NO: 1252748 - RNA, 19 nt, Homo sapiens
gaaagagacagacaacaaa

SEQ ID NO: 1252749 - RNA, 19 nt, Homo sapiens
gcucuagccuaacagaaua

SEQ ID NO: 1252750 - RNA, 19 nt, Homo sapiens
gagccucugugcauaauaa

SEQ ID NO: 1252751 - RNA, 19 nt, Homo sapiens
caaccugggugacgaguga

SEQ ID NO: 1252752 - RNA, 19 nt, Homo sapiens
gcucacgccuguaauccua

SEQ ID NO: 1252753 - RNA, 19 nt, Homo sapiens
aaagaaguauggacaaugu

SEQ ID NO: 1252754 - RNA, 19 nt, Homo sapiens
caaauggauuaccaaagaa

SEQ ID NO: 1252755 - RNA, 19 nt, Homo sapiens
gagggaaacuccaucucaa

SEQ ID NO: 1252756 - RNA, 19 nt, Homo sapiens
cugcaacccugcuaaguuu

SEQ ID NO: 1252757 - RNA, 19 nt, Homo sapiens
ccagcucccuccagaaauu

SEQ ID NO: 1252758 - RNA, 19 nt, Homo sapiens
gauuaaugguguagauaga

SEQ ID NO: 1252759 - RNA, 19 nt, Homo sapiens
gagcaugagccaagacauu

SEQ ID NO: 1252760 - RNA, 19 nt, Homo sapiens
gaaacccugucucuacuag

SEQ ID NO: 1252761 - RNA, 19 nt, Homo sapiens
gcauucaacaagcaaguua

SEQ ID NO: 1252762 - RNA, 19 nt, Homo sapiens
caacaaauggauuaccaaa

SEQ ID NO: 1252763 - RNA, 19 nt, Homo sapiens
aagauuugcucuagccuaa

SEQ ID NO: 1252764 - RNA, 19 nt, Homo sapiens
gcucacgccugucaucuca

SEQ ID NO: 1252765 - RNA, 19 nt, Homo sapiens
guagauagaguuuacugaa

SEQ ID NO: 1252766 - RNA, 19 nt, Homo sapiens
ccaaagaaauacagagcau

SEQ ID NO: 1252767 - RNA, 19 nt, Homo sapiens
ugaaagagacagacaacaa

SEQ ID NO: 1252768 - RNA, 19 nt, Homo sapiens
ugaccugcuugcugaauuu

SEQ ID NO: 1252769 - RNA, 19 nt, Homo sapiens
gcaggaggaucacuugaac

SEQ ID NO: 1252770 - RNA, 19 nt, Homo sapiens
ccaaagaaguauggacaau

SEQ ID NO: 1252771 - RNA, 19 nt, Homo sapiens
ggccaaggcaggagaauga

SEQ ID NO: 1252772 - RNA, 19 nt, Homo sapiens
ggaacggagucuaguccuu

SEQ ID NO: 1252773 - RNA, 19 nt, Homo sapiens
gacaacaaauggauuacca

SEQ ID NO: 1252774 - RNA, 19 nt, Homo sapiens
uuaaaguccugcaauaaag

SEQ ID NO: 1252775 - RNA, 19 nt, Homo sapiens
agaguuuacugaaagguuu

SEQ ID NO: 1252776 - RNA, 19 nt, Homo sapiens
ugauauguguguuaggaaa

SEQ ID NO: 1252777 - RNA, 19 nt, Homo sapiens
aaagaaauacagagcauga

SEQ ID NO: 1252778 - RNA, 19 nt, Homo sapiens
acagacaacaaauggauua

SEQ ID NO: 1252779 - RNA, 19 nt, Homo sapiens
gaggaggucuggacagcau

SEQ ID NO: 1252780 - RNA, 19 nt, Homo sapiens
gaaguauggacaauguauu

SEQ ID NO: 1252781 - RNA, 19 nt, Homo sapiens
gagauuaaugguguagaua

SEQ ID NO: 1252782 - RNA, 19 nt, Homo sapiens
gagaguaggguagguuauu

SEQ ID NO: 1252783 - RNA, 19 nt, Homo sapiens
gcaggagaaugacaugaac

SEQ ID NO: 1252784 - RNA, 19 nt, Homo sapiens
gaaaccccaucucuaguaa

SEQ ID NO: 1252785 - RNA, 19 nt, Homo sapiens
gguagugauauguguguua

SEQ ID NO: 1252786 - RNA, 19 nt, Homo sapiens
gugccucauucauucaaua

SEQ ID NO: 1252787 - RNA, 19 nt, Homo sapiens
gauuugcucuagccuaaca

SEQ ID NO: 1252788 - RNA, 19 nt, Homo sapiens
ggaugcagaugggaaguuc

SEQ ID NO: 1252789 - RNA, 19 nt, Homo sapiens
guagugauauguguguuag

SEQ ID NO: 1252790 - RNA, 19 nt, Homo sapiens
agccagcgcugcagugaaa

SEQ ID NO: 1252791 - RNA, 19 nt, Homo sapiens
ugacaugaauuggggauua

SEQ ID NO: 1252792 - RNA, 19 nt, Homo sapiens
cacaacaacaacaacaaua

SEQ ID NO: 1252793 - RNA, 19 nt, Homo sapiens
caacacaacaacaacaaca

SEQ ID NO: 1252794 - RNA, 19 nt, Homo sapiens
caacaacacaacaacaaca

SEQ ID NO: 1252795 - RNA, 19 nt, Homo sapiens
gcgaaacccugucucuacu

SEQ ID NO: 1252796 - RNA, 19 nt, Homo sapiens
agauagaguuuacugaaag

SEQ ID NO: 1252797 - RNA, 19 nt, Homo sapiens
uaauaacugcugucccuaa

SEQ ID NO: 1252798 - RNA, 19 nt, Homo sapiens
gacauuagaaucuggaaca

SEQ ID NO: 1252799 - RNA, 19 nt, Homo sapiens
ccugucaucucagcacuuu

SEQ ID NO: 1252800 - RNA, 19 nt, Homo sapiens
uauuguagguagugauaug

SEQ ID NO: 1252801 - RNA, 19 nt, Homo sapiens
gauagaguuuacugaaagg

SEQ ID NO: 1252802 - RNA, 19 nt, Homo sapiens
caaagaaguauggacaaug

SEQ ID NO: 1252803 - RNA, 19 nt, Homo sapiens
gagccaagacauuagaauc

SEQ ID NO: 1252804 - RNA, 19 nt, Homo sapiens
gaacgugaagcgugagucu

SEQ ID NO: 1252805 - RNA, 19 nt, Homo sapiens
gguauccgauccaauugca

SEQ ID NO: 1252806 - RNA, 19 nt, Homo sapiens
uaaaguccugcaauaaaga

SEQ ID NO: 1252807 - RNA, 19 nt, Homo sapiens
ucccauggccaaagaagua

SEQ ID NO: 1252808 - RNA, 19 nt, Homo sapiens
ucgagaccauccuggcuaa

SEQ ID NO: 1252809 - RNA, 19 nt, Homo sapiens
gccaagacauuagaaucug

SEQ ID NO: 1252810 - RNA, 19 nt, Homo sapiens
agaguaggguagguuauug

SEQ ID NO: 1252811 - RNA, 19 nt, Homo sapiens
agagauuaaugguguagau

SEQ ID NO: 1252812 - RNA, 19 nt, Homo sapiens
uagaucccauggccaaaga

SEQ ID NO: 1252813 - RNA, 19 nt, Homo sapiens
caacaacaacaauaacaac

SEQ ID NO: 1252814 - RNA, 19 nt, Homo sapiens
ggcaggagaaugacaugaa

SEQ ID NO: 1252815 - RNA, 19 nt, Homo sapiens
ccuguaauccuagcacuuu

SEQ ID NO: 1252816 - RNA, 19 nt, Homo sapiens
auuagaaucuggaacaaag

SEQ ID NO: 1252817 - RNA, 19 nt, Homo sapiens
ggaagggcaaggucugugu

SEQ ID NO: 1252818 - RNA, 19 nt, Homo sapiens
caacaacaacaacaauaac

SEQ ID NO: 1252819 - RNA, 19 nt, Homo sapiens
gcaccuguaaucccagcua

SEQ ID NO: 1252820 - RNA, 19 nt, Homo sapiens
uuacggaacagcaguuaug

SEQ ID NO: 1252821 - RNA, 19 nt, Homo sapiens
uuaaggggauuucaaagaa

SEQ ID NO: 1252822 - RNA, 19 nt, Homo sapiens
gaucacaaggucaggagau

SEQ ID NO: 1252823 - RNA, 19 nt, Homo sapiens
gcagugagcaaaacucuug

SEQ ID NO: 1252824 - RNA, 19 nt, Homo sapiens
gaccaucaagucugucuuc

SEQ ID NO: 1252825 - RNA, 19 nt, Homo sapiens
gucaggagaucgagaccau

SEQ ID NO: 1252826 - RNA, 19 nt, Homo sapiens
aaacaacaacacaacaaca

SEQ ID NO: 1252827 - RNA, 19 nt, Homo sapiens
ggcaggaggaucacuugaa

SEQ ID NO: 1252828 - RNA, 19 nt, Homo sapiens
uaacugcugucccuaaccu

SEQ ID NO: 1252829 - RNA, 19 nt, Homo sapiens
gggaagacacgcggaaaca

SEQ ID NO: 1252830 - RNA, 19 nt, Homo sapiens
cugaauuucuccugcuaug

SEQ ID NO: 1252831 - RNA, 19 nt, Homo sapiens
gcugagucuucugagagua

SEQ ID NO: 1252832 - RNA, 19 nt, Homo sapiens
agcaugagccaagacauua

SEQ ID NO: 1252833 - RNA, 19 nt, Homo sapiens
agacagacaacaaauggau

SEQ ID NO: 1252834 - RNA, 19 nt, Homo sapiens
aaagagacagacaacaaau

SEQ ID NO: 1252835 - RNA, 19 nt, Homo sapiens
caaagcaggacuggagaga

SEQ ID NO: 1252836 - RNA, 19 nt, Homo sapiens
ggcgaaacccugucucuac

SEQ ID NO: 1252837 - RNA, 19 nt, Homo sapiens
ucaacaagcaaguuauuac

SEQ ID NO: 1252838 - RNA, 19 nt, Homo sapiens
ucgcaccacugcacuccaa

SEQ ID NO: 1252839 - RNA, 19 nt, Homo sapiens
agugauauguguguuagga

SEQ ID NO: 1252840 - RNA, 19 nt, Homo sapiens
gaaucuggaacaaagcaau

SEQ ID NO: 1252841 - RNA, 19 nt, Homo sapiens
gacagacaacaaauggauu

SEQ ID NO: 1252842 - RNA, 19 nt, Homo sapiens
gcagugaaagagacagaca

SEQ ID NO: 1252843 - RNA, 19 nt, Homo sapiens
cggugcagcugaacgugaa

SEQ ID NO: 1252844 - RNA, 19 nt, Homo sapiens
cgaaacccugucucuacua

SEQ ID NO: 1252845 - RNA, 19 nt, Homo sapiens
agaaguauggacaauguau

SEQ ID NO: 1252846 - RNA, 19 nt, Homo sapiens
gcucagagaugcuacaauu

SEQ ID NO: 1252847 - RNA, 19 nt, Homo sapiens
gaagauggacagucaauug

SEQ ID NO: 1252848 - RNA, 19 nt, Homo sapiens
ucaaagugcugggauuaua

SEQ ID NO: 1252849 - RNA, 19 nt, Homo sapiens
uaaggaaggucuccauaga

SEQ ID NO: 1252850 - RNA, 19 nt, Homo sapiens
gaaggagauuguaaaggaa

SEQ ID NO: 1252851 - RNA, 19 nt, Homo sapiens
agaaggagauuguaaagga

SEQ ID NO: 1252852 - RNA, 19 nt, Homo sapiens
gacaacggcuguacccaaa

SEQ ID NO: 1252853 - RNA, 19 nt, Homo sapiens
gcagugagcugagguugug

SEQ ID NO: 1252854 - RNA, 19 nt, Homo sapiens
caauggcuaucaucacuuu

SEQ ID NO: 1252855 - RNA, 19 nt, Homo sapiens
aaaggaagauggacaguca

SEQ ID NO: 1252856 - RNA, 19 nt, Homo sapiens
gauggacagucaauuguug

SEQ ID NO: 1252857 - RNA, 19 nt, Homo sapiens
uuaagcagcugguaauaau

SEQ ID NO: 1252858 - RNA, 19 nt, Homo sapiens
gguaagccaugaagugaau

SEQ ID NO: 1252859 - RNA, 19 nt, Homo sapiens
ugacuuaaccuuagauuuc

SEQ ID NO: 1252860 - RNA, 19 nt, Homo sapiens
cgaaauaaguccaccuucu

SEQ ID NO: 1252861 - RNA, 19 nt, Homo sapiens
aagaacagcucaaggugaa

SEQ ID NO: 1252862 - RNA, 19 nt, Homo sapiens
ggauuucaguguguucuuu

SEQ ID NO: 1252863 - RNA, 19 nt, Homo sapiens
gauaagcagccuccuagaa

SEQ ID NO: 1252864 - RNA, 19 nt, Homo sapiens
gauuucagauucccuuuca

SEQ ID NO: 1252865 - RNA, 19 nt, Homo sapiens
gaagacugcaggcuauuug

SEQ ID NO: 1252866 - RNA, 19 nt, Homo sapiens
gacuggagccugugcauuu

SEQ ID NO: 1252867 - RNA, 19 nt, Homo sapiens
gugcagagaugcuguaucg

SEQ ID NO: 1252868 - RNA, 19 nt, Homo sapiens
gcagucuaaucaucugaaa

SEQ ID NO: 1252869 - RNA, 19 nt, Homo sapiens
cagccuugguucuaguuua

SEQ ID NO: 1252870 - RNA, 19 nt, Homo sapiens
cuagaagacugcaggcuau

SEQ ID NO: 1252871 - RNA, 19 nt, Homo sapiens
caucaaugguuaccgaaau

SEQ ID NO: 1252872 - RNA, 19 nt, Homo sapiens
gaaauaaguccaccuucuc

SEQ ID NO: 1252873 - RNA, 19 nt, Homo sapiens
gaaauuugcagcucagaag

SEQ ID NO: 1252874 - RNA, 19 nt, Homo sapiens
aaccuuagauuucagauuc

SEQ ID NO: 1252875 - RNA, 19 nt, Homo sapiens
uaagcagccuccuagaaga

SEQ ID NO: 1252876 - RNA, 19 nt, Homo sapiens
gcauuacaguggaaaccaa

SEQ ID NO: 1252877 - RNA, 19 nt, Homo sapiens
gacugcaggcuauuuguua

SEQ ID NO: 1252878 - RNA, 19 nt, Homo sapiens
caaggugauucaagccauu

SEQ ID NO: 1252879 - RNA, 19 nt, Homo sapiens
caucaccaacucugaauuu

SEQ ID NO: 1252880 - RNA, 19 nt, Homo sapiens
caacggcuguacccaaauc

SEQ ID NO: 1252881 - RNA, 19 nt, Homo sapiens
ucagaaaacucccuacuau

SEQ ID NO: 1252882 - RNA, 19 nt, Homo sapiens
ugucuucuccauccuauua

SEQ ID NO: 1252883 - RNA, 19 nt, Homo sapiens
agacaggguuucaccaugu

SEQ ID NO: 1252884 - RNA, 19 nt, Homo sapiens
gcauacaucucggguccuu

SEQ ID NO: 1252885 - RNA, 19 nt, Homo sapiens
ccuaucagcuucuguuugg

SEQ ID NO: 1252886 - RNA, 19 nt, Homo sapiens
gacuuaaccuuagauuuca

SEQ ID NO: 1252887 - RNA, 19 nt, Homo sapiens
aggaaaggcuggcugaugu

SEQ ID NO: 1252888 - RNA, 19 nt, Homo sapiens
ccagauggcaauccaaaga

SEQ ID NO: 1252889 - RNA, 19 nt, Homo sapiens
gaacagcucaaggugaaau

SEQ ID NO: 1252890 - RNA, 19 nt, Homo sapiens
gagguugagcuaugaagaa

SEQ ID NO: 1252891 - RNA, 19 nt, Homo sapiens
agucuugucuccuccguuu

SEQ ID NO: 1252892 - RNA, 19 nt, Homo sapiens
cccaguagcuaggauuaaa

SEQ ID NO: 1252893 - RNA, 19 nt, Homo sapiens
gcagacccugggagcauua

SEQ ID NO: 1252894 - RNA, 19 nt, Homo sapiens
ggacugcagccuucaaugg

SEQ ID NO: 1252895 - RNA, 19 nt, Homo sapiens
guucagaaggagauuguaa

SEQ ID NO: 1252896 - RNA, 19 nt, Homo sapiens
gaaggucuccauagaaggu

SEQ ID NO: 1252897 - RNA, 19 nt, Homo sapiens
acagucaaguggcgcagua

SEQ ID NO: 1252898 - RNA, 19 nt, Homo sapiens
aagcagcugguaauaauuu

SEQ ID NO: 1252899 - RNA, 19 nt, Homo sapiens
acaccacucuggagguuga

SEQ ID NO: 1252900 - RNA, 19 nt, Homo sapiens
gaaaggcuggcugauguug

SEQ ID NO: 1252901 - RNA, 19 nt, Homo sapiens
gaauacagggugacugagu

SEQ ID NO: 1252902 - RNA, 19 nt, Homo sapiens
gugaauacagggugacuga

SEQ ID NO: 1252903 - RNA, 19 nt, Homo sapiens
uugagguaguuaaggauua

SEQ ID NO: 1252904 - RNA, 19 nt, Homo sapiens
gacaggguuucaccauguu

SEQ ID NO: 1252905 - RNA, 19 nt, Homo sapiens
gcuccucuuuacucgauaa

SEQ ID NO: 1252906 - RNA, 19 nt, Homo sapiens
ggagcugacuggagugaac

SEQ ID NO: 1252907 - RNA, 19 nt, Homo sapiens
ggagagaugggaacguugu

SEQ ID NO: 1252908 - RNA, 19 nt, Homo sapiens
ugacaccacucuggagguu

SEQ ID NO: 1252909 - RNA, 19 nt, Homo sapiens
gauggcaggccuuaagaga

SEQ ID NO: 1252910 - RNA, 19 nt, Homo sapiens
gugccggacugcauuacaa

SEQ ID NO: 1252911 - RNA, 19 nt, Homo sapiens
ggucaagcagagaagauuu

SEQ ID NO: 1252912 - RNA, 19 nt, Homo sapiens
ggagcuccauguucagaag

SEQ ID NO: 1252913 - RNA, 19 nt, Homo sapiens
ggagcccugccuuguauuu

SEQ ID NO: 1252914 - RNA, 19 nt, Homo sapiens
ucuccuccguuucugcuua

SEQ ID NO: 1252915 - RNA, 19 nt, Homo sapiens
guucuaguuuauagucuug

SEQ ID NO: 1252916 - RNA, 19 nt, Homo sapiens
cauggugaauccacuagga

SEQ ID NO: 1252917 - RNA, 19 nt, Homo sapiens
cuugacaucugcuguggaa

SEQ ID NO: 1252918 - RNA, 19 nt, Homo sapiens
ggaaaggcuggcugauguu

SEQ ID NO: 1252919 - RNA, 19 nt, Homo sapiens
gaaugccccuugaaaaugu

SEQ ID NO: 1252920 - RNA, 19 nt, Homo sapiens
ggacuguuucuuccuguug

SEQ ID NO: 1252921 - RNA, 19 nt, Homo sapiens
uuucagguuuggcauauug

SEQ ID NO: 1252922 - RNA, 19 nt, Homo sapiens
cacaauggcuaucaucacu

SEQ ID NO: 1252923 - RNA, 19 nt, Homo sapiens
gcacagccucagauacuuc

SEQ ID NO: 1252924 - RNA, 19 nt, Homo sapiens
uccuggaucuggacuguuu

SEQ ID NO: 1252925 - RNA, 19 nt, Homo sapiens
gcaagguggauuucagugu

SEQ ID NO: 1252926 - RNA, 19 nt, Homo sapiens
caucagcagucucccuauc

SEQ ID NO: 1252927 - RNA, 19 nt, Homo sapiens
uggcaggccuuaagagaag

SEQ ID NO: 1252928 - RNA, 19 nt, Homo sapiens
cuuaugguguggacaaaug

SEQ ID NO: 1252929 - RNA, 19 nt, Homo sapiens
ucaaacuccugaccucaag

SEQ ID NO: 1252930 - RNA, 19 nt, Homo sapiens
ugccagggcugcuaaaguc

SEQ ID NO: 1252931 - RNA, 19 nt, Homo sapiens
cuguggaacuggugugauu

SEQ ID NO: 1252932 - RNA, 19 nt, Homo sapiens
gcacacaauggcuaucauc

SEQ ID NO: 1252933 - RNA, 19 nt, Homo sapiens
acuagagucuuacauccaa

SEQ ID NO: 1252934 - RNA, 19 nt, Homo sapiens
cacgaaaugucagaaagga

SEQ ID NO: 1252935 - RNA, 19 nt, Homo sapiens
ucucaaagugcugggauua

SEQ ID NO: 1252936 - RNA, 19 nt, Homo sapiens
ggaagauggacagucaauu

SEQ ID NO: 1252937 - RNA, 19 nt, Homo sapiens
ucaauggcaucaccaacuc

SEQ ID NO: 1252938 - RNA, 19 nt, Homo sapiens
ggagauuguaaaggaauuu

SEQ ID NO: 1252939 - RNA, 19 nt, Homo sapiens
aaacaucccugagaaacac

SEQ ID NO: 1252940 - RNA, 19 nt, Homo sapiens
aggaaggucuccauagaag

SEQ ID NO: 1252941 - RNA, 19 nt, Homo sapiens
gcaccuguaaucccagcua

SEQ ID NO: 1252942 - RNA, 19 nt, Homo sapiens
caaagugcugggauuauag

SEQ ID NO: 1252943 - RNA, 19 nt, Homo sapiens
uauuaggccucuggucuga

SEQ ID NO: 1252944 - RNA, 19 nt, Homo sapiens
aucaaugguuaccgaaaua

SEQ ID NO: 1252945 - RNA, 19 nt, Homo sapiens
ggagguugagcuaugaaga

SEQ ID NO: 1252946 - RNA, 19 nt, Homo sapiens
gcaggaggcuaaagagaua

SEQ ID NO: 1252947 - RNA, 19 nt, Homo sapiens
gugaaacccugucuacaaa

SEQ ID NO: 1252948 - RNA, 19 nt, Homo sapiens
uggcugagaugaaggaaua

SEQ ID NO: 1252949 - RNA, 19 nt, Homo sapiens
gagaagcaugcaacaauua

SEQ ID NO: 1252950 - RNA, 19 nt, Homo sapiens
ugacauaucuugggucuuc

SEQ ID NO: 1252951 - RNA, 19 nt, Homo sapiens
gaacccaccugccauacau

SEQ ID NO: 1252952 - RNA, 19 nt, Homo sapiens
ggaaacugauggaacucua

SEQ ID NO: 1252953 - RNA, 19 nt, Homo sapiens
caaguuggauuccgauugu

SEQ ID NO: 1252954 - RNA, 19 nt, Homo sapiens
gcucacgccuguaauccua

SEQ ID NO: 1252955 - RNA, 19 nt, Homo sapiens
gcaaaaugcuugaaaguuc

SEQ ID NO: 1252956 - RNA, 19 nt, Homo sapiens
gggaucagcucuugcuuca

SEQ ID NO: 1252957 - RNA, 19 nt, Homo sapiens
gaucagcucuugcuucacu

SEQ ID NO: 1252958 - RNA, 19 nt, Homo sapiens
gagcucagccggucuauca

SEQ ID NO: 1252959 - RNA, 19 nt, Homo sapiens
acuaagggcuucagucuug

SEQ ID NO: 1252960 - RNA, 19 nt, Homo sapiens
gagcaaguaugaaagaaac

SEQ ID NO: 1252961 - RNA, 19 nt, Homo sapiens
gagaugaaggaauacauaa

SEQ ID NO: 1252962 - RNA, 19 nt, Homo sapiens
gcaaacggcuuggcugucu

SEQ ID NO: 1252963 - RNA, 19 nt, Homo sapiens
gaucaucaauuggaaucaa

SEQ ID NO: 1252964 - RNA, 19 nt, Homo sapiens
ggauuccgauuguaaagga

SEQ ID NO: 1252965 - RNA, 19 nt, Homo sapiens
ggugauggaugaacugcaa

SEQ ID NO: 1252966 - RNA, 19 nt, Homo sapiens
agaacaaucugccaguuau

SEQ ID NO: 1252967 - RNA, 19 nt, Homo sapiens
ggugaaacccugucuacaa

SEQ ID NO: 1252968 - RNA, 19 nt, Homo sapiens
agagaagcaugcaacaauu

SEQ ID NO: 1252969 - RNA, 19 nt, Homo sapiens
ucauuugucuccucaagaa

SEQ ID NO: 1252970 - RNA, 19 nt, Homo sapiens
gaauucaccuuggcucuag

SEQ ID NO: 1252971 - RNA, 19 nt, Homo sapiens
agaccagccugagaaauaa

SEQ ID NO: 1252972 - RNA, 19 nt, Homo sapiens
guacagcucggaaagagaa

SEQ ID NO: 1252973 - RNA, 19 nt, Homo sapiens
caagaacaaucugccaguu

SEQ ID NO: 1252974 - RNA, 19 nt, Homo sapiens
uaucuugggucuucucaga

SEQ ID NO: 1252975 - RNA, 19 nt, Homo sapiens
cagacggacuggaaacuga

SEQ ID NO: 1252976 - RNA, 19 nt, Homo sapiens
gaaggaauacauaacaaag

SEQ ID NO: 1252977 - RNA, 19 nt, Homo sapiens
gucuaucagugucgauuua

SEQ ID NO: 1252978 - RNA, 19 nt, Homo sapiens
caauuggaaucaagucuca

SEQ ID NO: 1252979 - RNA, 19 nt, Homo sapiens
aagaccagccugagaaaua

SEQ ID NO: 1252980 - RNA, 19 nt, Homo sapiens
gaucucagccaccaggaaa

SEQ ID NO: 1252981 - RNA, 19 nt, Homo sapiens
ucaaggcguuucagaggaa

SEQ ID NO: 1252982 - RNA, 19 nt, Homo sapiens
gaugaaggaauacauaaca

SEQ ID NO: 1252983 - RNA, 19 nt, Homo sapiens
aaacuugaaccuuuccuaa

SEQ ID NO: 1252984 - RNA, 19 nt, Homo sapiens
ugagaugaaggaauacaua

SEQ ID NO: 1252985 - RNA, 19 nt, Homo sapiens
gaccaagucuaaggaaaca

SEQ ID NO: 1252986 - RNA, 19 nt, Homo sapiens
gaaagagaagcaugcaaca

SEQ ID NO: 1252987 - RNA, 19 nt, Homo sapiens
cgauuuagcagaaagcaaa

SEQ ID NO: 1252988 - RNA, 19 nt, Homo sapiens
guauggaguuggugaugga

SEQ ID NO: 1252989 - RNA, 19 nt, Homo sapiens
gauauuguccagaggauca

SEQ ID NO: 1252990 - RNA, 19 nt, Homo sapiens
ugacuucagugacuagauc

SEQ ID NO: 1252991 - RNA, 19 nt, Homo sapiens
gcgugugccuguagugcua

SEQ ID NO: 1252992 - RNA, 19 nt, Homo sapiens
gcauggcucugaaggugau

SEQ ID NO: 1252993 - RNA, 19 nt, Homo sapiens
uguagaacacuuugacuuu

SEQ ID NO: 1252994 - RNA, 19 nt, Homo sapiens
ggagaggaaugggaagagu

SEQ ID NO: 1252995 - RNA, 19 nt, Homo sapiens
caaaauuacugaggucaaa

SEQ ID NO: 1252996 - RNA, 19 nt, Homo sapiens
aagaacaaucugccaguua

SEQ ID NO: 1252997 - RNA, 19 nt, Homo sapiens
guagaacacuuugacuuuu

SEQ ID NO: 1252998 - RNA, 19 nt, Homo sapiens
gagauauuguccagaggau

SEQ ID NO: 1252999 - RNA, 19 nt, Homo sapiens
uggcaggacugacuguaga

SEQ ID NO: 1253000 - RNA, 19 nt, Homo sapiens
cagugucgauuuagcagaa

SEQ ID NO: 1253001 - RNA, 19 nt, Homo sapiens
caauggcucacgccuguaa

SEQ ID NO: 1253002 - RNA, 19 nt, Homo sapiens
ccaagucuaaggaaacauu

SEQ ID NO: 1253003 - RNA, 19 nt, Homo sapiens
ggaccagugaugucuaaga

SEQ ID NO: 1253004 - RNA, 19 nt, Homo sapiens
caaaguggaaccuaugaca

SEQ ID NO: 1253005 - RNA, 19 nt, Homo sapiens
aaggaccagugaugucuaa

SEQ ID NO: 1253006 - RNA, 19 nt, Homo sapiens
gguugaggcugcagugagu

SEQ ID NO: 1253007 - RNA, 19 nt, Homo sapiens
gcgagcaaguaugaaagaa

SEQ ID NO: 1253008 - RNA, 19 nt, Homo sapiens
gcucguugccuuugaagau

SEQ ID NO: 1253009 - RNA, 19 nt, Homo sapiens
ucagugacuuuaugagagu

SEQ ID NO: 1253010 - RNA, 19 nt, Homo sapiens
ccugagaaauaaggugaaa

SEQ ID NO: 1253011 - RNA, 19 nt, Homo sapiens
cguggugacugcgugauuu

SEQ ID NO: 1253012 - RNA, 19 nt, Homo sapiens
gaagcaugcaacaauuaga

SEQ ID NO: 1253013 - RNA, 19 nt, Homo sapiens
aagagaagcaugcaacaau

SEQ ID NO: 1253014 - RNA, 19 nt, Homo sapiens
ggucaaaguggaaccuaug

SEQ ID NO: 1253015 - RNA, 19 nt, Homo sapiens
gcaaggcguccaggaguga

SEQ ID NO: 1253016 - RNA, 19 nt, Homo sapiens
uggaguuggugauggauga

SEQ ID NO: 1253017 - RNA, 19 nt, Homo sapiens
ugaggugggaggauuguuu

SEQ ID NO: 1253018 - RNA, 19 nt, Homo sapiens
ggaccaagucuaaggaaac

SEQ ID NO: 1253019 - RNA, 19 nt, Homo sapiens
caccuaggaugacuucagu

SEQ ID NO: 1253020 - RNA, 19 nt, Homo sapiens
acagaacccaccugccaua

SEQ ID NO: 1253021 - RNA, 19 nt, Homo sapiens
uaggaugacuucagugacu

SEQ ID NO: 1253022 - RNA, 19 nt, Homo sapiens
ccaguucccaguucucuau

SEQ ID NO: 1253023 - RNA, 19 nt, Homo sapiens
gaacaaucugccaguuauc

SEQ ID NO: 1253024 - RNA, 19 nt, Homo sapiens
gccacaaggugcccaagag

SEQ ID NO: 1253025 - RNA, 19 nt, Homo sapiens
aaacagcugcaggccuuua

SEQ ID NO: 1253026 - RNA, 19 nt, Homo sapiens
gcaaggaucagugaaacag

SEQ ID NO: 1253027 - RNA, 19 nt, Homo sapiens
guucccaguucucuauuca

SEQ ID NO: 1253028 - RNA, 19 nt, Homo sapiens
cgagcaaguaugaaagaaa

SEQ ID NO: 1253029 - RNA, 19 nt, Homo sapiens
gaggugggaggauuguuug

SEQ ID NO: 1253030 - RNA, 19 nt, Homo sapiens
gaagaccagccugagaaau

SEQ ID NO: 1253031 - RNA, 19 nt, Homo sapiens
gaaggugauuuuagguaga

SEQ ID NO: 1253032 - RNA, 19 nt, Homo sapiens
gacuugggaucagcucuug

SEQ ID NO: 1253033 - RNA, 19 nt, Homo sapiens
ucccaguucucuauucaga

SEQ ID NO: 1253034 - RNA, 19 nt, Homo sapiens
ucccggaguuuaccaccua

SEQ ID NO: 1253035 - RNA, 19 nt, Homo sapiens
gauuuuagguagaagaguu

SEQ ID NO: 1253036 - RNA, 19 nt, Homo sapiens
uuacagaaccagagcaaag

SEQ ID NO: 1253037 - RNA, 19 nt, Homo sapiens
gcggcgagcaaguaugaaa

SEQ ID NO: 1253038 - RNA, 19 nt, Homo sapiens
cagauccaguggcccauuc

SEQ ID NO: 1253039 - RNA, 19 nt, Homo sapiens
cuguggaaguguuugcuaa

SEQ ID NO: 1253040 - RNA, 19 nt, Homo sapiens
ggacuggaaacugauggaa

SEQ ID NO: 1253041 - RNA, 19 nt, Homo sapiens
ggucuaucagugucgauuu

SEQ ID NO: 1253042 - RNA, 19 nt, Homo sapiens
ugaagaccagccugagaaa

SEQ ID NO: 1253043 - RNA, 19 nt, Homo sapiens
ugacugaggcggguggauu

SEQ ID NO: 1253044 - RNA, 19 nt, Homo sapiens
caagucuaaggaaacauuu

SEQ ID NO: 1253045 - RNA, 19 nt, Homo sapiens
gagaugaaucaaggcguuu

SEQ ID NO: 1253046 - RNA, 19 nt, Homo sapiens
cacagaagcugguuuacua

SEQ ID NO: 1253047 - RNA, 19 nt, Homo sapiens
ggacaaacccugacacguu

SEQ ID NO: 1253048 - RNA, 19 nt, Homo sapiens
gaaagggaaucgugugugu

SEQ ID NO: 1253049 - RNA, 19 nt, Homo sapiens
gcacaaggauaagaaggaa

SEQ ID NO: 1253050 - RNA, 19 nt, Homo sapiens
gaaaugaaggaaaugagaa

SEQ ID NO: 1253051 - RNA, 19 nt, Homo sapiens
gaaagaaagaaaugaagga

SEQ ID NO: 1253052 - RNA, 19 nt, Homo sapiens
gcacagccauggccuggau

SEQ ID NO: 1253053 - RNA, 19 nt, Homo sapiens
gcucacagguggcuuccuu

SEQ ID NO: 1253054 - RNA, 19 nt, Homo sapiens
gggcgaagcuuuggugaca

SEQ ID NO: 1253055 - RNA, 19 nt, Homo sapiens
gcaaguacuucucaaaaga

SEQ ID NO: 1253056 - RNA, 19 nt, Homo sapiens
ggaagaaagaaagaaauga

SEQ ID NO: 1253057 - RNA, 19 nt, Homo sapiens
ggucagaaacaaugaguau

SEQ ID NO: 1253058 - RNA, 19 nt, Homo sapiens
gcacugagaggccacaauc

SEQ ID NO: 1253059 - RNA, 19 nt, Homo sapiens
gcgaagcuuuggugacaga

SEQ ID NO: 1253060 - RNA, 19 nt, Homo sapiens
ccagcacgcuccacagguu

SEQ ID NO: 1253061 - RNA, 19 nt, Homo sapiens
cagaagagaagcagcacua

SEQ ID NO: 1253062 - RNA, 19 nt, Homo sapiens
gcaguucuuuggccucugu

SEQ ID NO: 1253063 - RNA, 19 nt, Homo sapiens
cgacucugcucccaucuca

SEQ ID NO: 1253064 - RNA, 19 nt, Homo sapiens
aagccggaguucacaguua

SEQ ID NO: 1253065 - RNA, 19 nt, Homo sapiens
ccaggcacguguaauaaag

SEQ ID NO: 1253066 - RNA, 19 nt, Homo sapiens
ccagagagccaugguguug

SEQ ID NO: 1253067 - RNA, 19 nt, Homo sapiens
gggcacggcaccuguacua

SEQ ID NO: 1253068 - RNA, 19 nt, Homo sapiens
gaaagaaaugaaggaaaug

SEQ ID NO: 1253069 - RNA, 19 nt, Homo sapiens
gcugucaaguguccagaga

SEQ ID NO: 1253070 - RNA, 19 nt, Homo sapiens
gcucccaucucagccauga

SEQ ID NO: 1253071 - RNA, 19 nt, Homo sapiens
ggaguucacaguuaucauc

SEQ ID NO: 1253072 - RNA, 19 nt, Homo sapiens
caacguggcgagcaucaga

SEQ ID NO: 1253073 - RNA, 19 nt, Homo sapiens
caagagguccagcaacugu

SEQ ID NO: 1253074 - RNA, 19 nt, Homo sapiens
ggaggaggcagaagagaag

SEQ ID NO: 1253075 - RNA, 19 nt, Homo sapiens
cacaguggaucaucaccaa

SEQ ID NO: 1253076 - RNA, 19 nt, Homo sapiens
gacccucuccuuucuguga

SEQ ID NO: 1253077 - RNA, 19 nt, Homo sapiens
gggaggaggcagaagagaa

SEQ ID NO: 1253078 - RNA, 19 nt, Homo sapiens
gcuguccucugcauuuaca

SEQ ID NO: 1253079 - RNA, 19 nt, Homo sapiens
ucacagguggcuuccuuaa

SEQ ID NO: 1253080 - RNA, 19 nt, Homo sapiens
cauggcaccugcucugauc

SEQ ID NO: 1253081 - RNA, 19 nt, Homo sapiens
ccaagagacaguccugaug

SEQ ID NO: 1253082 - RNA, 19 nt, Homo sapiens
caccagauccaggaaauga

SEQ ID NO: 1253083 - RNA, 19 nt, Homo sapiens
gcacagaagcugguuuacu

SEQ ID NO: 1253084 - RNA, 19 nt, Homo sapiens
auaaagaacccgagcagau

SEQ ID NO: 1253085 - RNA, 19 nt, Homo sapiens
gggacccucuccuuucugu

SEQ ID NO: 1253086 - RNA, 19 nt, Homo sapiens
cugcuguccucugcauuua

SEQ ID NO: 1253087 - RNA, 19 nt, Homo sapiens
cagagacgcgcaguucuuu

SEQ ID NO: 1253088 - RNA, 19 nt, Homo sapiens
caucagagacgcgcaguuc

SEQ ID NO: 1253089 - RNA, 19 nt, Homo sapiens
uaccgggaguccuauauca

SEQ ID NO: 1253090 - RNA, 19 nt, Homo sapiens
agaaaugaaggaaaugaga

SEQ ID NO: 1253091 - RNA, 19 nt, Homo sapiens
ccagcucugucaccugaga

SEQ ID NO: 1253092 - RNA, 19 nt, Homo sapiens
agacagcucugcaguuucc

SEQ ID NO: 1253093 - RNA, 19 nt, Homo sapiens
gcgauggccucggaacaca

SEQ ID NO: 1253094 - RNA, 19 nt, Homo sapiens
gcacaucuaccagggaaag

SEQ ID NO: 1253095 - RNA, 19 nt, Homo sapiens
gcucagcaaguacuucuca

SEQ ID NO: 1253096 - RNA, 19 nt, Homo sapiens
caaaagauuggaagaaaga

SEQ ID NO: 1253097 - RNA, 19 nt, Homo sapiens
gccauggccuggaugacau

SEQ ID NO: 1253098 - RNA, 19 nt, Homo sapiens
guacuacugccacuugaag

SEQ ID NO: 1253099 - RNA, 19 nt, Homo sapiens
gcacggcaccuguacuacu

SEQ ID NO: 1253100 - RNA, 19 nt, Homo sapiens
gaaaacggaagggucauaa

SEQ ID NO: 1253101 - RNA, 19 nt, Homo sapiens
ucacuggagacaagcauga

SEQ ID NO: 1253102 - RNA, 19 nt, Homo sapiens
ucagagacgcgcaguucuu

SEQ ID NO: 1253103 - RNA, 19 nt, Homo sapiens
agcaaaagcucagcaagua

SEQ ID NO: 1253104 - RNA, 19 nt, Homo sapiens
gcugugcuuucccuuccaa

SEQ ID NO: 1253105 - RNA, 19 nt, Homo sapiens
guucacaguuaucaucacu

SEQ ID NO: 1253106 - RNA, 19 nt, Homo sapiens
ccaccucacucagccauac

SEQ ID NO: 1253107 - RNA, 19 nt, Homo sapiens
cagggaauccagagagaug

SEQ ID NO: 1253108 - RNA, 19 nt, Homo sapiens
gagacgcgcaguucuuugg

SEQ ID NO: 1253109 - RNA, 19 nt, Homo sapiens
uggaagaaagaaagaaaug

SEQ ID NO: 1253110 - RNA, 19 nt, Homo sapiens
aggcacguguaauaaagaa

SEQ ID NO: 1253111 - RNA, 19 nt, Homo sapiens
ucagcaaguacuucucaaa

SEQ ID NO: 1253112 - RNA, 19 nt, Homo sapiens
uccacgggcuccaugagaa

SEQ ID NO: 1253113 - RNA, 19 nt, Homo sapiens
cacggcaccuguacuacug

SEQ ID NO: 1253114 - RNA, 19 nt, Homo sapiens
ccugagauccagccagaga

SEQ ID NO: 1253115 - RNA, 19 nt, Homo sapiens
gcaagagguccagcaacug

SEQ ID NO: 1253116 - RNA, 19 nt, Homo sapiens
ccugacacguucccuccuu

SEQ ID NO: 1253117 - RNA, 19 nt, Homo sapiens
ucaggcugcacaaggauaa

SEQ ID NO: 1253118 - RNA, 19 nt, Homo sapiens
ggaacacagggauguccuu

SEQ ID NO: 1253119 - RNA, 19 nt, Homo sapiens
ggaaaacggaagggucaua

SEQ ID NO: 1253120 - RNA, 19 nt, Homo sapiens
ccucugcauuuacaggaau

SEQ ID NO: 1253121 - RNA, 19 nt, Homo sapiens
ccugcuguccucugcauuu

SEQ ID NO: 1253122 - RNA, 19 nt, Homo sapiens
gcauggcaccugcucugau

SEQ ID NO: 1253123 - RNA, 19 nt, Homo sapiens
gcaccagauccaggaaaug

SEQ ID NO: 1253124 - RNA, 19 nt, Homo sapiens
aguccuauaucagcgauga

SEQ ID NO: 1253125 - RNA, 19 nt, Homo sapiens
caguggaucaucaccaaga

SEQ ID NO: 1253126 - RNA, 19 nt, Homo sapiens
gagaggccacaaucguuca

SEQ ID NO: 1253127 - RNA, 19 nt, Homo sapiens
ccuccaccauccacaguca

SEQ ID NO: 1253128 - RNA, 19 nt, Homo sapiens
gaaucccucucugcaacuc

SEQ ID NO: 1253129 - RNA, 19 nt, Homo sapiens
gaguucacaguuaucauca

SEQ ID NO: 1253130 - RNA, 19 nt, Homo sapiens
agccggaguucacaguuau

SEQ ID NO: 1253131 - RNA, 19 nt, Homo sapiens
ccagauccaggaaaugaca

SEQ ID NO: 1253132 - RNA, 19 nt, Homo sapiens
gcacuaccgggaguccuau

SEQ ID NO: 1253133 - RNA, 19 nt, Homo sapiens
ucuucaggcugcacaagga

SEQ ID NO: 1253134 - RNA, 19 nt, Homo sapiens
ggugcaagcccagcucugu

SEQ ID NO: 1253135 - RNA, 19 nt, Homo sapiens
agcaagagguccagcaacu

SEQ ID NO: 1253136 - RNA, 19 nt, Homo sapiens
gucagaaacaaugaguaua

SEQ ID NO: 1253137 - RNA, 19 nt, Homo sapiens
ggacaacuguaaagaauua

SEQ ID NO: 1253138 - RNA, 19 nt, Homo sapiens
gaaacuagcuaaccaagaa

SEQ ID NO: 1253139 - RNA, 19 nt, Homo sapiens
ccagaagacuuguuuaaua

SEQ ID NO: 1253140 - RNA, 19 nt, Homo sapiens
ggaaguggcuauaaauauu

SEQ ID NO: 1253141 - RNA, 19 nt, Homo sapiens
uaaaugaacugguguagaa

SEQ ID NO: 1253142 - RNA, 19 nt, Homo sapiens
gaaaugaaaugcuauacug

SEQ ID NO: 1253143 - RNA, 19 nt, Homo sapiens
caacauauauggugaacaa

SEQ ID NO: 1253144 - RNA, 19 nt, Homo sapiens
gaaagaugcuggugaugaa

SEQ ID NO: 1253145 - RNA, 19 nt, Homo sapiens
ggaauaagcuccuuguaag

SEQ ID NO: 1253146 - RNA, 19 nt, Homo sapiens
gcaaagaucuaggagguaa

SEQ ID NO: 1253147 - RNA, 19 nt, Homo sapiens
gaugauaggucacuuugaa

SEQ ID NO: 1253148 - RNA, 19 nt, Homo sapiens
gaacugguguagaauauca

SEQ ID NO: 1253149 - RNA, 19 nt, Homo sapiens
gaacugggcaaacuauuaa

SEQ ID NO: 1253150 - RNA, 19 nt, Homo sapiens
gcaauuuacuuaaccauuc

SEQ ID NO: 1253151 - RNA, 19 nt, Homo sapiens
cgaaauaacugcuggaaag

SEQ ID NO: 1253152 - RNA, 19 nt, Homo sapiens
uuucagagcuuuauggaua

SEQ ID NO: 1253153 - RNA, 19 nt, Homo sapiens
agaaaugccugauugaauu

SEQ ID NO: 1253154 - RNA, 19 nt, Homo sapiens
uaacuaaagugucaugaga

SEQ ID NO: 1253155 - RNA, 19 nt, Homo sapiens
gaaagcagcagauuguaaa

SEQ ID NO: 1253156 - RNA, 19 nt, Homo sapiens
cauaaucccugccuucaaa

SEQ ID NO: 1253157 - RNA, 19 nt, Homo sapiens
ggaacugggcaaacuauua

SEQ ID NO: 1253158 - RNA, 19 nt, Homo sapiens
guguaaagguuguauguaa

SEQ ID NO: 1253159 - RNA, 19 nt, Homo sapiens
gggaagauguguaaagguu

SEQ ID NO: 1253160 - RNA, 19 nt, Homo sapiens
caaagaaucugugaucuag

SEQ ID NO: 1253161 - RNA, 19 nt, Homo sapiens
ggguauauuuggagcauua

SEQ ID NO: 1253162 - RNA, 19 nt, Homo sapiens
gaaaugccugauugaauua

SEQ ID NO: 1253163 - RNA, 19 nt, Homo sapiens
gaaguuucauccagacaaa

SEQ ID NO: 1253164 - RNA, 19 nt, Homo sapiens
gaacaacaguaugaaugaa

SEQ ID NO: 1253165 - RNA, 19 nt, Homo sapiens
uauggcaucuguugaauaa

SEQ ID NO: 1253166 - RNA, 19 nt, Homo sapiens
uaucacaccuguagcaauu

SEQ ID NO: 1253167 - RNA, 19 nt, Homo sapiens
caucugaaauugugccuaa

SEQ ID NO: 1253168 - RNA, 19 nt, Homo sapiens
caagucagauaaacagauu

SEQ ID NO: 1253169 - RNA, 19 nt, Homo sapiens
gguagugucugccauauuc

SEQ ID NO: 1253170 - RNA, 19 nt, Homo sapiens
gcaagugugagcagaaaua

SEQ ID NO: 1253171 - RNA, 19 nt, Homo sapiens
gaaagaaauaggaagauga

SEQ ID NO: 1253172 - RNA, 19 nt, Homo sapiens
gagcauuacuucaaauaca

SEQ ID NO: 1253173 - RNA, 19 nt, Homo sapiens
gaaauugugccuaacagaa

SEQ ID NO: 1253174 - RNA, 19 nt, Homo sapiens
guaguacacuucgguaauu

SEQ ID NO: 1253175 - RNA, 19 nt, Homo sapiens
ggaggaagauuaugugacu

SEQ ID NO: 1253176 - RNA, 19 nt, Homo sapiens
gugaggccuuccuuuauua

SEQ ID NO: 1253177 - RNA, 19 nt, Homo sapiens
aguaauggcuuuaggauug

SEQ ID NO: 1253178 - RNA, 19 nt, Homo sapiens
ggcuuaaucuggaacauaa

SEQ ID NO: 1253179 - RNA, 19 nt, Homo sapiens
aaacagauaugcaguaugc

SEQ ID NO: 1253180 - RNA, 19 nt, Homo sapiens
ggaaaugcuuaugcuguuu

SEQ ID NO: 1253181 - RNA, 19 nt, Homo sapiens
gaagauguguaaagguugu

SEQ ID NO: 1253182 - RNA, 19 nt, Homo sapiens
ccauagaaauuugcaguuu

SEQ ID NO: 1253183 - RNA, 19 nt, Homo sapiens
ggccuuccuuuauuacuua

SEQ ID NO: 1253184 - RNA, 19 nt, Homo sapiens
gaggaaguggcuauaaaua

SEQ ID NO: 1253185 - RNA, 19 nt, Homo sapiens
aaacacauguagcugauga

SEQ ID NO: 1253186 - RNA, 19 nt, Homo sapiens
guaaguaaguuugguuuca

SEQ ID NO: 1253187 - RNA, 19 nt, Homo sapiens
caacaucagcaucgacaua

SEQ ID NO: 1253188 - RNA, 19 nt, Homo sapiens
guaccuaacacacacauaa

SEQ ID NO: 1253189 - RNA, 19 nt, Homo sapiens
gaauuaaucccauaggaau

SEQ ID NO: 1253190 - RNA, 19 nt, Homo sapiens
gaagaggacucacauuuuc

SEQ ID NO: 1253191 - RNA, 19 nt, Homo sapiens
guaguagcuucacaucuuu

SEQ ID NO: 1253192 - RNA, 19 nt, Homo sapiens
uaaagaggcaacuguagua

SEQ ID NO: 1253193 - RNA, 19 nt, Homo sapiens
ccaggugaaucaauagaaa

SEQ ID NO: 1253194 - RNA, 19 nt, Homo sapiens
gcagucaaauuaguuauag

SEQ ID NO: 1253195 - RNA, 19 nt, Homo sapiens
caaccaauauaguguaaca

SEQ ID NO: 1253196 - RNA, 19 nt, Homo sapiens
gaagaugauaggucacuuu

SEQ ID NO: 1253197 - RNA, 19 nt, Homo sapiens
ggauaaggcuaaguucaga

SEQ ID NO: 1253198 - RNA, 19 nt, Homo sapiens
gugcaguuaugucauuuaa

SEQ ID NO: 1253199 - RNA, 19 nt, Homo sapiens
caugagacacuucaguuua

SEQ ID NO: 1253200 - RNA, 19 nt, Homo sapiens
aagcuuacaugauuccuaa

SEQ ID NO: 1253201 - RNA, 19 nt, Homo sapiens
gauccucgugucauuauua

SEQ ID NO: 1253202 - RNA, 19 nt, Homo sapiens
ugacagcauucaucacauu

SEQ ID NO: 1253203 - RNA, 19 nt, Homo sapiens
uguaguagcuucacaucuu

SEQ ID NO: 1253204 - RNA, 19 nt, Homo sapiens
uaaaguacaugggaagaug

SEQ ID NO: 1253205 - RNA, 19 nt, Homo sapiens
caccauaugauguacauua

SEQ ID NO: 1253206 - RNA, 19 nt, Homo sapiens
gaugaugacuguaacuucu

SEQ ID NO: 1253207 - RNA, 19 nt, Homo sapiens
guguuuagcaguuguaaua

SEQ ID NO: 1253208 - RNA, 19 nt, Homo sapiens
aaagugcaguuaugucauu

SEQ ID NO: 1253209 - RNA, 19 nt, Homo sapiens
gggcagcaguccauaacaa

SEQ ID NO: 1253210 - RNA, 19 nt, Homo sapiens
ucaaagauugguuuccuua

SEQ ID NO: 1253211 - RNA, 19 nt, Homo sapiens
ugucaaauauguggacuuu

SEQ ID NO: 1253212 - RNA, 19 nt, Homo sapiens
ggaaaagauuugauacuga

SEQ ID NO: 1253213 - RNA, 19 nt, Homo sapiens
cgacauaguggacaugaaa

SEQ ID NO: 1253214 - RNA, 19 nt, Homo sapiens
caauacugaugguaagaaa

SEQ ID NO: 1253215 - RNA, 19 nt, Homo sapiens
aagaaucugugaucuagaa

SEQ ID NO: 1253216 - RNA, 19 nt, Homo sapiens
gcaauucuuagcuuuauga

SEQ ID NO: 1253217 - RNA, 19 nt, Homo sapiens
ccaacuugcucuuagaaau

SEQ ID NO: 1253218 - RNA, 19 nt, Homo sapiens
aaaggaggaugaacuggaa

SEQ ID NO: 1253219 - RNA, 19 nt, Homo sapiens
acacacacauaaacaaaug

SEQ ID NO: 1253220 - RNA, 19 nt, Homo sapiens
uuacguagcauuuacauug

SEQ ID NO: 1253221 - RNA, 19 nt, Homo sapiens
gaagagaggcagagaaggu

SEQ ID NO: 1253222 - RNA, 19 nt, Homo sapiens
acauacagguuacugcuuu

SEQ ID NO: 1253223 - RNA, 19 nt, Homo sapiens
uaaguuugguuucaucaug

SEQ ID NO: 1253224 - RNA, 19 nt, Homo sapiens
aauaacugcuggaaagaaa

SEQ ID NO: 1253225 - RNA, 19 nt, Homo sapiens
aagauugguuuccuuauug

SEQ ID NO: 1253226 - RNA, 19 nt, Homo sapiens
cagcauucaucacauuuga

SEQ ID NO: 1253227 - RNA, 19 nt, Homo sapiens
uaaccaacuugcucuuaga

SEQ ID NO: 1253228 - RNA, 19 nt, Homo sapiens
guuaacgcuucuacaagua

SEQ ID NO: 1253229 - RNA, 19 nt, Homo sapiens
gccaguugauggucucuaa

SEQ ID NO: 1253230 - RNA, 19 nt, Homo sapiens
cagcaguccauaacaaaua

SEQ ID NO: 1253231 - RNA, 19 nt, Homo sapiens
ggauuuaaccaacuuugaa

SEQ ID NO: 1253232 - RNA, 19 nt, Homo sapiens
ucucuucuauuccaaauga

SEQ ID NO: 1253233 - RNA, 19 nt, Homo sapiens
caacauacugucauaggaa

SEQ ID NO: 1253234 - RNA, 19 nt, Homo sapiens
uaggguggcuuuguucuuu

SEQ ID NO: 1253235 - RNA, 19 nt, Homo sapiens
uuucuagucuucuguguuu

SEQ ID NO: 1253236 - RNA, 19 nt, Homo sapiens
gcacguagaauaguaacuu

SEQ ID NO: 1253237 - RNA, 19 nt, Homo sapiens
gaacauaacugaacacaag

SEQ ID NO: 1253238 - RNA, 19 nt, Homo sapiens
gcagggaaguggaauaaua

SEQ ID NO: 1253239 - RNA, 19 nt, Homo sapiens
gcaaaucuguucuuucaaa

SEQ ID NO: 1253240 - RNA, 19 nt, Homo sapiens
gaucugagccguaagaaua

SEQ ID NO: 1253241 - RNA, 19 nt, Homo sapiens
ggacuacuauuaccacuaa

SEQ ID NO: 1253242 - RNA, 19 nt, Homo sapiens
caaauacacuuguccauga

SEQ ID NO: 1253243 - RNA, 19 nt, Homo sapiens
gaaaugaacugugccauag

SEQ ID NO: 1253244 - RNA, 19 nt, Homo sapiens
caagaaaucuaauggaaug

SEQ ID NO: 1253245 - RNA, 19 nt, Homo sapiens
uaagguaacuccuagauau

SEQ ID NO: 1253246 - RNA, 19 nt, Homo sapiens
caauugaacucauggauau

SEQ ID NO: 1253247 - RNA, 19 nt, Homo sapiens
agacugaggucccaauuaa

SEQ ID NO: 1253248 - RNA, 19 nt, Homo sapiens
gauaugacaucacuggaaa

SEQ ID NO: 1253249 - RNA, 19 nt, Homo sapiens
caaaugagccuaccuacuu

SEQ ID NO: 1253250 - RNA, 19 nt, Homo sapiens
gagaaggauucccucauaa

SEQ ID NO: 1253251 - RNA, 19 nt, Homo sapiens
ggaucuauaucacugcuua

SEQ ID NO: 1253252 - RNA, 19 nt, Homo sapiens
agagggaccugauuguuua

SEQ ID NO: 1253253 - RNA, 19 nt, Homo sapiens
ggagaaagauagagagauc

SEQ ID NO: 1253254 - RNA, 19 nt, Homo sapiens
ggaaugaauuaguucugua

SEQ ID NO: 1253255 - RNA, 19 nt, Homo sapiens
guagugacuuccaauuuaa

SEQ ID NO: 1253256 - RNA, 19 nt, Homo sapiens
ggaagacauugaaucauug

SEQ ID NO: 1253257 - RNA, 19 nt, Homo sapiens
cagugaaacuuacuacaua

SEQ ID NO: 1253258 - RNA, 19 nt, Homo sapiens
agucaaaggugaugauuaa

SEQ ID NO: 1253259 - RNA, 19 nt, Homo sapiens
uguagugacuuccaauuua

SEQ ID NO: 1253260 - RNA, 19 nt, Homo sapiens
ggaaaugaacugugccaua

SEQ ID NO: 1253261 - RNA, 19 nt, Homo sapiens
gagaguagaaggaugguua

SEQ ID NO: 1253262 - RNA, 19 nt, Homo sapiens
gagccuaccuacuucuuaa

SEQ ID NO: 1253263 - RNA, 19 nt, Homo sapiens
agagaaggauucccucaua

SEQ ID NO: 1253264 - RNA, 19 nt, Homo sapiens
agagagaucugcagacuga

SEQ ID NO: 1253265 - RNA, 19 nt, Homo sapiens
gcaaggacuucaagacuca

SEQ ID NO: 1253266 - RNA, 19 nt, Homo sapiens
guaagaauacggaucuaua

SEQ ID NO: 1253267 - RNA, 19 nt, Homo sapiens
guagaaggaugguuacuag

SEQ ID NO: 1253268 - RNA, 19 nt, Homo sapiens
ccauaacacucauguauuc

SEQ ID NO: 1253269 - RNA, 19 nt, Homo sapiens
gguggaaggacuacuauua

SEQ ID NO: 1253270 - RNA, 19 nt, Homo sapiens
uuaaugaccuuacaaagug

SEQ ID NO: 1253271 - RNA, 19 nt, Homo sapiens
cggaagacauugaaucauu

SEQ ID NO: 1253272 - RNA, 19 nt, Homo sapiens
gaacuagaggucacuauau

SEQ ID NO: 1253273 - RNA, 19 nt, Homo sapiens
gaacuggaauauuguaaac

SEQ ID NO: 1253274 - RNA, 19 nt, Homo sapiens
ccaaguacucuacauauaa

SEQ ID NO: 1253275 - RNA, 19 nt, Homo sapiens
ggaacuagaggucacuaua

SEQ ID NO: 1253276 - RNA, 19 nt, Homo sapiens
gcaguucaguuacaagaug

SEQ ID NO: 1253277 - RNA, 19 nt, Homo sapiens
gcuauacaguccuuacauu

SEQ ID NO: 1253278 - RNA, 19 nt, Homo sapiens
gaaggaaguuguagugacu

SEQ ID NO: 1253279 - RNA, 19 nt, Homo sapiens
gaacauuugcagagaauug

SEQ ID NO: 1253280 - RNA, 19 nt, Homo sapiens
uggagaagcuaaauacuga

SEQ ID NO: 1253281 - RNA, 19 nt, Homo sapiens
uggcaaaucuguucuuuca

SEQ ID NO: 1253282 - RNA, 19 nt, Homo sapiens
gacaauuucuucacccauu

SEQ ID NO: 1253283 - RNA, 19 nt, Homo sapiens
ccauaaagauguuucaaag

SEQ ID NO: 1253284 - RNA, 19 nt, Homo sapiens
cuagugcuguccacauuua

SEQ ID NO: 1253285 - RNA, 19 nt, Homo sapiens
gaucaagccagauuuguga

SEQ ID NO: 1253286 - RNA, 19 nt, Homo sapiens
ggacugaaauaucuuugca

SEQ ID NO: 1253287 - RNA, 19 nt, Homo sapiens
cuacacauauuggaaauga

SEQ ID NO: 1253288 - RNA, 19 nt, Homo sapiens
gaacuccauucuccaacuu

SEQ ID NO: 1253289 - RNA, 19 nt, Homo sapiens
gcacuacacuaaaucaaac

SEQ ID NO: 1253290 - RNA, 19 nt, Homo sapiens
caacccaucuggcuaaagu

SEQ ID NO: 1253291 - RNA, 19 nt, Homo sapiens
caguaggccugaugacuaa

SEQ ID NO: 1253292 - RNA, 19 nt, Homo sapiens
gacacaauauccaauccua

SEQ ID NO: 1253293 - RNA, 19 nt, Homo sapiens
gacauggaauacagacuaa

SEQ ID NO: 1253294 - RNA, 19 nt, Homo sapiens
aaacauauuugggugugua

SEQ ID NO: 1253295 - RNA, 19 nt, Homo sapiens
gauuaaggcaacaaacaua

SEQ ID NO: 1253296 - RNA, 19 nt, Homo sapiens
gcaaauacgcuacauucug

SEQ ID NO: 1253297 - RNA, 19 nt, Homo sapiens
gagcgaccauucucaggaa

SEQ ID NO: 1253298 - RNA, 19 nt, Homo sapiens
caauuaaaccaguaccaua

SEQ ID NO: 1253299 - RNA, 19 nt, Homo sapiens
ugacaucacuggaaaauga

SEQ ID NO: 1253300 - RNA, 19 nt, Homo sapiens
ccacagaccacuauuagga

SEQ ID NO: 1253301 - RNA, 19 nt, Homo sapiens
uaaaggccaaucagaauuu

SEQ ID NO: 1253302 - RNA, 19 nt, Homo sapiens
gagaguugcuugcugaucu

SEQ ID NO: 1253303 - RNA, 19 nt, Homo sapiens
cccaaguacucuacauaua

SEQ ID NO: 1253304 - RNA, 19 nt, Homo sapiens
gacauaagccagaaacaga

SEQ ID NO: 1253305 - RNA, 19 nt, Homo sapiens
gaaagagggaccugauugu

SEQ ID NO: 1253306 - RNA, 19 nt, Homo sapiens
ggguaugucugauaaguca

SEQ ID NO: 1253307 - RNA, 19 nt, Homo sapiens
gaacuucauucuccaacag

SEQ ID NO: 1253308 - RNA, 19 nt, Homo sapiens
gaacaacggaggaguuucu

SEQ ID NO: 1253309 - RNA, 19 nt, Homo sapiens
gaaauaacuaaguccacua

SEQ ID NO: 1253310 - RNA, 19 nt, Homo sapiens
gugugucucugcauuagua

SEQ ID NO: 1253311 - RNA, 19 nt, Homo sapiens
gaauggauccacuuuaaag

SEQ ID NO: 1253312 - RNA, 19 nt, Homo sapiens
caagcuugcuggaagagaa

SEQ ID NO: 1253313 - RNA, 19 nt, Homo sapiens
gacuagugcuguccacauu

SEQ ID NO: 1253314 - RNA, 19 nt, Homo sapiens
caaauaggucuugauauga

SEQ ID NO: 1253315 - RNA, 19 nt, Homo sapiens
cuacuugggagaaauauuu

SEQ ID NO: 1253316 - RNA, 19 nt, Homo sapiens
ggaccugauuguuuaaagu

SEQ ID NO: 1253317 - RNA, 19 nt, Homo sapiens
ugaauuaguucuguagaug

SEQ ID NO: 1253318 - RNA, 19 nt, Homo sapiens
ggaaguggaauaauaucuu

SEQ ID NO: 1253319 - RNA, 19 nt, Homo sapiens
cccaagaaaucuaauggaa

SEQ ID NO: 1253320 - RNA, 19 nt, Homo sapiens
augaauggauccacuuuaa

SEQ ID NO: 1253321 - RNA, 19 nt, Homo sapiens
ggagaaauauuuuguagca

SEQ ID NO: 1253322 - RNA, 19 nt, Homo sapiens
cagcaacaaauacuugaua

SEQ ID NO: 1253323 - RNA, 19 nt, Homo sapiens
uauaugugcaguucaguua

SEQ ID NO: 1253324 - RNA, 19 nt, Homo sapiens
gcugaccacuggaagaaga

SEQ ID NO: 1253325 - RNA, 19 nt, Homo sapiens
gugagcaggugauaauuca

SEQ ID NO: 1253326 - RNA, 19 nt, Homo sapiens
gggugaguauagucaauaa

SEQ ID NO: 1253327 - RNA, 19 nt, Homo sapiens
caacauacuaacugaaaga

SEQ ID NO: 1253328 - RNA, 19 nt, Homo sapiens
gagcuuggacaucuucaaa

SEQ ID NO: 1253329 - RNA, 19 nt, Homo sapiens
gggaggagcuuggacaucu

SEQ ID NO: 1253330 - RNA, 19 nt, Homo sapiens
ccuaaaggauuaucagagu

SEQ ID NO: 1253331 - RNA, 19 nt, Homo sapiens
cuauaucacugcuuauuag

SEQ ID NO: 1253332 - RNA, 19 nt, Homo sapiens
cacaggaaauaauccaauu

SEQ ID NO: 1253333 - RNA, 19 nt, Homo sapiens
cuagaggucacuauauuaa

SEQ ID NO: 1253334 - RNA, 19 nt, Homo sapiens
gaauuaguucuguagauga

SEQ ID NO: 1253335 - RNA, 19 nt, Homo sapiens
gaaggauucccucauaaag

SEQ ID NO: 1253336 - RNA, 19 nt, Homo sapiens
cgacauacacuaucagaca

SEQ ID NO: 1253337 - RNA, 19 nt, Homo sapiens
caagauaccuucgagauuc

SEQ ID NO: 1253338 - RNA, 19 nt, Homo sapiens
gcuaagggauuguaaauac

SEQ ID NO: 1253339 - RNA, 19 nt, Homo sapiens
gcauagaacuucccacaag

SEQ ID NO: 1253340 - RNA, 19 nt, Homo sapiens
ccacuugacucucuguaaa

SEQ ID NO: 1253341 - RNA, 19 nt, Homo sapiens
gaagugccuuuccugcuuu

SEQ ID NO: 1253342 - RNA, 19 nt, Homo sapiens
gaaccuuuaugucuagcua

SEQ ID NO: 1253343 - RNA, 19 nt, Homo sapiens
guaucuagcucaagguuug

SEQ ID NO: 1253344 - RNA, 19 nt, Homo sapiens
cguggaagcuuuguucuuu

SEQ ID NO: 1253345 - RNA, 19 nt, Homo sapiens
ggagaaccuuuaugucuag

SEQ ID NO: 1253346 - RNA, 19 nt, Homo sapiens
cagcuaagccucaccauga

SEQ ID NO: 1253347 - RNA, 19 nt, Homo sapiens
ggagaaccuuugugucuag

SEQ ID NO: 1253348 - RNA, 19 nt, Homo sapiens
gaacuucccacaagagugu

SEQ ID NO: 1253349 - RNA, 19 nt, Homo sapiens
gaccugacccucaccaauu

SEQ ID NO: 1253350 - RNA, 19 nt, Homo sapiens
caaccaggcggaacaauau

SEQ ID NO: 1253351 - RNA, 19 nt, Homo sapiens
uggagaaccuuuaugucua

SEQ ID NO: 1253352 - RNA, 19 nt, Homo sapiens
gaugggcacucuguaucua

SEQ ID NO: 1253353 - RNA, 19 nt, Homo sapiens
ugacuaaggccucagacua

SEQ ID NO: 1253354 - RNA, 19 nt, Homo sapiens
ugaagugccuuuccugcuu

SEQ ID NO: 1253355 - RNA, 19 nt, Homo sapiens
ccucccagcuuccugagua

SEQ ID NO: 1253356 - RNA, 19 nt, Homo sapiens
cauagaacuucccacaaga

SEQ ID NO: 1253357 - RNA, 19 nt, Homo sapiens
ggaccaaucagcaggaugu

SEQ ID NO: 1253358 - RNA, 19 nt, Homo sapiens
ggacuuggagaaccuuuau

SEQ ID NO: 1253359 - RNA, 19 nt, Homo sapiens
gaggagcucucucaaaaug

SEQ ID NO: 1253360 - RNA, 19 nt, Homo sapiens
gcaccaauccacacucugu

SEQ ID NO: 1253361 - RNA, 19 nt, Homo sapiens
gggcgagacaagagaauaa

SEQ ID NO: 1253362 - RNA, 19 nt, Homo sapiens
ucaaccaggcggaacaaua

SEQ ID NO: 1253363 - RNA, 19 nt, Homo sapiens
ggugacguauucaucaaug

SEQ ID NO: 1253364 - RNA, 19 nt, Homo sapiens
ggaauucaugggugacgua

SEQ ID NO: 1253365 - RNA, 19 nt, Homo sapiens
ccgagcaucuuguuucugu

SEQ ID NO: 1253366 - RNA, 19 nt, Homo sapiens
gaucguaaacgcaccaauc

SEQ ID NO: 1253367 - RNA, 19 nt, Homo sapiens
ccagagcaauugacuaaaa

SEQ ID NO: 1253368 - RNA, 19 nt, Homo sapiens
cagcugggcuccugagucu

SEQ ID NO: 1253369 - RNA, 19 nt, Homo sapiens
guucuucccucucccugaa

SEQ ID NO: 1253370 - RNA, 19 nt, Homo sapiens
aaacagaccacuugacucu

SEQ ID NO: 1253371 - RNA, 19 nt, Homo sapiens
gcaucuuguuucugucauu

SEQ ID NO: 1253372 - RNA, 19 nt, Homo sapiens
gggcuauugucacagagaa

SEQ ID NO: 1253373 - RNA, 19 nt, Homo sapiens
gaagggugcaugccaaugg

SEQ ID NO: 1253374 - RNA, 19 nt, Homo sapiens
gguagguucuagcacauuc

SEQ ID NO: 1253375 - RNA, 19 nt, Homo sapiens
gggcaaaccacucuucaag

SEQ ID NO: 1253376 - RNA, 19 nt, Homo sapiens
ccacagaggaggagaagca

SEQ ID NO: 1253377 - RNA, 19 nt, Homo sapiens
ucaagauaccuucgagauu

SEQ ID NO: 1253378 - RNA, 19 nt, Homo sapiens
caucuucacagcaaucauu

SEQ ID NO: 1253379 - RNA, 19 nt, Homo sapiens
ugagugaaacacagaauau

SEQ ID NO: 1253380 - RNA, 19 nt, Homo sapiens
auucaugggugacguauuc

SEQ ID NO: 1253381 - RNA, 19 nt, Homo sapiens
cuacccaucuucacagcaa

SEQ ID NO: 1253382 - RNA, 19 nt, Homo sapiens
ggacuuggagaaccuuugu

SEQ ID NO: 1253383 - RNA, 19 nt, Homo sapiens
gcucaguguuugugaaugc

SEQ ID NO: 1253384 - RNA, 19 nt, Homo sapiens
aaacacagaauaugggaau

SEQ ID NO: 1253385 - RNA, 19 nt, Homo sapiens
gagccaagucccuuccauu

SEQ ID NO: 1253386 - RNA, 19 nt, Homo sapiens
uaagacaaagcaauccauu

SEQ ID NO: 1253387 - RNA, 19 nt, Homo sapiens
ugccagagcaauugacuaa

SEQ ID NO: 1253388 - RNA, 19 nt, Homo sapiens
uggagaaccuuugugucua

SEQ ID NO: 1253389 - RNA, 19 nt, Homo sapiens
guuaugcucuuuugaaaug

SEQ ID NO: 1253390 - RNA, 19 nt, Homo sapiens
ugacuggaguuaugcucuu

SEQ ID NO: 1253391 - RNA, 19 nt, Homo sapiens
gggcauccgucgggcuauu

SEQ ID NO: 1253392 - RNA, 19 nt, Homo sapiens
gugagugaaacacagaaua

SEQ ID NO: 1253393 - RNA, 19 nt, Homo sapiens
gaguuaugcucuuuugaaa

SEQ ID NO: 1253394 - RNA, 19 nt, Homo sapiens
gacuaaggccucagacuag

SEQ ID NO: 1253395 - RNA, 19 nt, Homo sapiens
gaaaagcaccaagagguuu

SEQ ID NO: 1253396 - RNA, 19 nt, Homo sapiens
gacuggaguuaugcucuuu

SEQ ID NO: 1253397 - RNA, 19 nt, Homo sapiens
gauacaauggagcagauga

SEQ ID NO: 1253398 - RNA, 19 nt, Homo sapiens
gcagcgccaucaugacucu

SEQ ID NO: 1253399 - RNA, 19 nt, Homo sapiens
gagcaucuuguuucuguca

SEQ ID NO: 1253400 - RNA, 19 nt, Homo sapiens
agacaaagcaauccauuuu

SEQ ID NO: 1253401 - RNA, 19 nt, Homo sapiens
gcaaucauuuucuucacuu

SEQ ID NO: 1253402 - RNA, 19 nt, Homo sapiens
caagagcacccaccaagac

SEQ ID NO: 1253403 - RNA, 19 nt, Homo sapiens
gcacaagacaacagaaucc

SEQ ID NO: 1253404 - RNA, 19 nt, Homo sapiens
cagcaucgacccaguucuu

SEQ ID NO: 1253405 - RNA, 19 nt, Homo sapiens
caucucaacacccgucuug

SEQ ID NO: 1253406 - RNA, 19 nt, Homo sapiens
acagaccacuugacucucu

SEQ ID NO: 1253407 - RNA, 19 nt, Homo sapiens
ccaaucagcacccugucaa

SEQ ID NO: 1253408 - RNA, 19 nt, Homo sapiens
guggagaaccuuugugucu

SEQ ID NO: 1253409 - RNA, 19 nt, Homo sapiens
uagcuaagggauuguaaau

SEQ ID NO: 1253410 - RNA, 19 nt, Homo sapiens
ccaagagcacccaccaaga

SEQ ID NO: 1253411 - RNA, 19 nt, Homo sapiens
caagggauccagccuagag

SEQ ID NO: 1253412 - RNA, 19 nt, Homo sapiens
ccaccagcccuuaaagugu

SEQ ID NO: 1253413 - RNA, 19 nt, Homo sapiens
auagaugaauaccuaggaa

SEQ ID NO: 1253414 - RNA, 19 nt, Homo sapiens
ccaagucccuuccauuccu

SEQ ID NO: 1253415 - RNA, 19 nt, Homo sapiens
gugucuagcucaguguuug

SEQ ID NO: 1253416 - RNA, 19 nt, Homo sapiens
caagucccuuccauuccuu

SEQ ID NO: 1253417 - RNA, 19 nt, Homo sapiens
ggaagugagaggugacagu

SEQ ID NO: 1253418 - RNA, 19 nt, Homo sapiens
gaccugggaugggagaagu

SEQ ID NO: 1253419 - RNA, 19 nt, Homo sapiens
gcugagugagugagugaaa

SEQ ID NO: 1253420 - RNA, 19 nt, Homo sapiens
ggaguuaugcucuuuugaa

SEQ ID NO: 1253421 - RNA, 19 nt, Homo sapiens
uugcacacccuaagacaaa

SEQ ID NO: 1253422 - RNA, 19 nt, Homo sapiens
guggaagcuuuguucuuuc

SEQ ID NO: 1253423 - RNA, 19 nt, Homo sapiens
gggacuuggagaaccuuua

SEQ ID NO: 1253424 - RNA, 19 nt, Homo sapiens
caucuuguuucugucauuc

SEQ ID NO: 1253425 - RNA, 19 nt, Homo sapiens
cagccuagagcagaccuua

SEQ ID NO: 1253426 - RNA, 19 nt, Homo sapiens
ugacguauucaucaauguu

SEQ ID NO: 1253427 - RNA, 19 nt, Homo sapiens
gcuagcaccgugucugugu

SEQ ID NO: 1253428 - RNA, 19 nt, Homo sapiens
agaagcagaagaacaggaa

SEQ ID NO: 1253429 - RNA, 19 nt, Homo sapiens
gaggaggagaagcagcuaa

SEQ ID NO: 1253430 - RNA, 19 nt, Homo sapiens
ucacagcaaucauuuucuu

SEQ ID NO: 1253431 - RNA, 19 nt, Homo sapiens
agacagagccucgauccau

SEQ ID NO: 1253432 - RNA, 19 nt, Homo sapiens
gagugaaacacagaauaug

SEQ ID NO: 1253433 - RNA, 19 nt, Homo sapiens
ggacgcacaagccaaaugc

SEQ ID NO: 1253434 - RNA, 19 nt, Homo sapiens
cgagcaauccucccagcuu

SEQ ID NO: 1253435 - RNA, 19 nt, Homo sapiens
gcaauccauuuucguuguu

SEQ ID NO: 1253436 - RNA, 19 nt, Homo sapiens
gagcacccaccaagacaca

SEQ ID NO: 1253437 - RNA, 19 nt, Homo sapiens
aaacacaggugaauucaua

SEQ ID NO: 1253438 - RNA, 19 nt, Homo sapiens
guucauaccuugcaguuua

SEQ ID NO: 1253439 - RNA, 19 nt, Homo sapiens
cuacaaccauugcaaauua

SEQ ID NO: 1253440 - RNA, 19 nt, Homo sapiens
ggcaagaucuuuagucuga

SEQ ID NO: 1253441 - RNA, 19 nt, Homo sapiens
gagaaaccauagaaaugua

SEQ ID NO: 1253442 - RNA, 19 nt, Homo sapiens
ggagagaaauguuacaagu

SEQ ID NO: 1253443 - RNA, 19 nt, Homo sapiens
gcuaggacuuccaguauuu

SEQ ID NO: 1253444 - RNA, 19 nt, Homo sapiens
agagaaaccuuacaaaugu

SEQ ID NO: 1253445 - RNA, 19 nt, Homo sapiens
agagaaaccuuacaaaugu

SEQ ID NO: 1253446 - RNA, 19 nt, Homo sapiens
caaaucuacugauguguuu

SEQ ID NO: 1253447 - RNA, 19 nt, Homo sapiens
gagagaaaccuuacaaaug

SEQ ID NO: 1253448 - RNA, 19 nt, Homo sapiens
gagagaaaccuuacaaaug

SEQ ID NO: 1253449 - RNA, 19 nt, Homo sapiens
ugaagaaugugacaaaguu

SEQ ID NO: 1253450 - RNA, 19 nt, Homo sapiens
ugaagaaugugacaaaguu

SEQ ID NO: 1253451 - RNA, 19 nt, Homo sapiens
ugagaaaccuuacaagugu

SEQ ID NO: 1253452 - RNA, 19 nt, Homo sapiens
ccauagaaauguaagguuu

SEQ ID NO: 1253453 - RNA, 19 nt, Homo sapiens
gagagaaaccguacaaaug

SEQ ID NO: 1253454 - RNA, 19 nt, Homo sapiens
guaaauggcacuugcauau

SEQ ID NO: 1253455 - RNA, 19 nt, Homo sapiens
ugaguugacuuaacauuga

SEQ ID NO: 1253456 - RNA, 19 nt, Homo sapiens
agacauaggagaauucaua

SEQ ID NO: 1253457 - RNA, 19 nt, Homo sapiens
uagggaaacuuuacuaaug

SEQ ID NO: 1253458 - RNA, 19 nt, Homo sapiens
agagaaaccuuacaagugu

SEQ ID NO: 1253459 - RNA, 19 nt, Homo sapiens
aaucaaaccuugcauguca

SEQ ID NO: 1253460 - RNA, 19 nt, Homo sapiens
agagaaaccuuacaagugu

SEQ ID NO: 1253461 - RNA, 19 nt, Homo sapiens
gagagaaaccuuacaagug

SEQ ID NO: 1253462 - RNA, 19 nt, Homo sapiens
gagagaaaccuuacaagug

SEQ ID NO: 1253463 - RNA, 19 nt, Homo sapiens
ggcaaggucuuuaaucaga

SEQ ID NO: 1253464 - RNA, 19 nt, Homo sapiens
gagaaugcauaaugaagug

SEQ ID NO: 1253465 - RNA, 19 nt, Homo sapiens
gagagaaaccauagaaaug

SEQ ID NO: 1253466 - RNA, 19 nt, Homo sapiens
ggagagaaaccuuacaaau

SEQ ID NO: 1253467 - RNA, 19 nt, Homo sapiens
ggagagaaaccauagaaau

SEQ ID NO: 1253468 - RNA, 19 nt, Homo sapiens
ggagagaaaccuuacaaau

SEQ ID NO: 1253469 - RNA, 19 nt, Homo sapiens
agagaaaccucacaagugu

SEQ ID NO: 1253470 - RNA, 19 nt, Homo sapiens
gcacuugcauaucuacaau

SEQ ID NO: 1253471 - RNA, 19 nt, Homo sapiens
ggacuuccaguauuuauug

SEQ ID NO: 1253472 - RNA, 19 nt, Homo sapiens
gagagaaaccucacaagug

SEQ ID NO: 1253473 - RNA, 19 nt, Homo sapiens
ggcaagaccuucaguuaca

SEQ ID NO: 1253474 - RNA, 19 nt, Homo sapiens
ucaagaagcucauggaaaa

SEQ ID NO: 1253475 - RNA, 19 nt, Homo sapiens
caucagagaauccauacua

SEQ ID NO: 1253476 - RNA, 19 nt, Homo sapiens
gggaaacuuuacuaaugua

SEQ ID NO: 1253477 - RNA, 19 nt, Homo sapiens
aauuguagcucacuguuaa

SEQ ID NO: 1253478 - RNA, 19 nt, Homo sapiens
ggagagaaaccguacaaau

SEQ ID NO: 1253479 - RNA, 19 nt, Homo sapiens
cuacugauguguuuauuag

SEQ ID NO: 1253480 - RNA, 19 nt, Homo sapiens
ucucacuucuuuccauuua

SEQ ID NO: 1253481 - RNA, 19 nt, Homo sapiens
caagugguauaucacauug

SEQ ID NO: 1253482 - RNA, 19 nt, Homo sapiens
caucaauggucuuucuauu

SEQ ID NO: 1253483 - RNA, 19 nt, Homo sapiens
gcaaaucuacugauguguu

SEQ ID NO: 1253484 - RNA, 19 nt, Homo sapiens
caagacagguagaucacuu

SEQ ID NO: 1253485 - RNA, 19 nt, Homo sapiens
agagaaauguuacaagugu

SEQ ID NO: 1253486 - RNA, 19 nt, Homo sapiens
ucacaaguguaaugaaugu

SEQ ID NO: 1253487 - RNA, 19 nt, Homo sapiens
gaacguucuugcaucaugu

SEQ ID NO: 1253488 - RNA, 19 nt, Homo sapiens
acagguagaucacuugaga

SEQ ID NO: 1253489 - RNA, 19 nt, Homo sapiens
ugaaagacauaggagaauu

SEQ ID NO: 1253490 - RNA, 19 nt, Homo sapiens
gcaccaaaauaaacugaua

SEQ ID NO: 1253491 - RNA, 19 nt, Homo sapiens
gcaaggucuuuaaucagaa

SEQ ID NO: 1253492 - RNA, 19 nt, Homo sapiens
ccacauuggucauuucauc

SEQ ID NO: 1253493 - RNA, 19 nt, Homo sapiens
gugcaaaucuacugaugug

SEQ ID NO: 1253494 - RNA, 19 nt, Homo sapiens
agacagagaucuuacaaaa

SEQ ID NO: 1253495 - RNA, 19 nt, Homo sapiens
guucaugccucauuacaca

SEQ ID NO: 1253496 - RNA, 19 nt, Homo sapiens
ucagguucaugccucauua

SEQ ID NO: 1253497 - RNA, 19 nt, Homo sapiens
caacacuuauucaccauca

SEQ ID NO: 1253498 - RNA, 19 nt, Homo sapiens
uaaugaauguggcaagguu

SEQ ID NO: 1253499 - RNA, 19 nt, Homo sapiens
ggagagaaaccuuacaagu

SEQ ID NO: 1253500 - RNA, 19 nt, Homo sapiens
uaaugaauguggcaagguu

SEQ ID NO: 1253501 - RNA, 19 nt, Homo sapiens
ggagagaaaccuuacaagu

SEQ ID NO: 1253502 - RNA, 19 nt, Homo sapiens
uaaugaauguggcaagguu

SEQ ID NO: 1253503 - RNA, 19 nt, Homo sapiens
ugaggcauuucauuucuuu

SEQ ID NO: 1253504 - RNA, 19 nt, Homo sapiens
gcacaauugauguuagauu

SEQ ID NO: 1253505 - RNA, 19 nt, Homo sapiens
ggacaucaggaaauucauu

SEQ ID NO: 1253506 - RNA, 19 nt, Homo sapiens
gcaaauuauuggagaaugc

SEQ ID NO: 1253507 - RNA, 19 nt, Homo sapiens
gcacaacauacuagaauuc

SEQ ID NO: 1253508 - RNA, 19 nt, Homo sapiens
gaagcacacaugagagaaa

SEQ ID NO: 1253509 - RNA, 19 nt, Homo sapiens
gaaagacauaggagaauuc

SEQ ID NO: 1253510 - RNA, 19 nt, Homo sapiens
uaaauuuccuucuccaucu

SEQ ID NO: 1253511 - RNA, 19 nt, Homo sapiens
uaaguucucuagcaaaugg

SEQ ID NO: 1253512 - RNA, 19 nt, Homo sapiens
caucauagacuucauacug

SEQ ID NO: 1253513 - RNA, 19 nt, Homo sapiens
gaccuucaguuacaaguca

SEQ ID NO: 1253514 - RNA, 19 nt, Homo sapiens
ucagucaagcuucaucuua

SEQ ID NO: 1253515 - RNA, 19 nt, Homo sapiens
ugaaauacauaggagaguu

SEQ ID NO: 1253516 - RNA, 19 nt, Homo sapiens
gaagaaugugacaaaguuu

SEQ ID NO: 1253517 - RNA, 19 nt, Homo sapiens
gaagaaugugacaaaguuu

SEQ ID NO: 1253518 - RNA, 19 nt, Homo sapiens
ggagagaaaccucacaagu

SEQ ID NO: 1253519 - RNA, 19 nt, Homo sapiens
cacagaagaucaugucauc

SEQ ID NO: 1253520 - RNA, 19 nt, Homo sapiens
gguugacucuuugugauuu

SEQ ID NO: 1253521 - RNA, 19 nt, Homo sapiens
gcaagaccuucaguuacaa

SEQ ID NO: 1253522 - RNA, 19 nt, Homo sapiens
gugcugauauuguauugug

SEQ ID NO: 1253523 - RNA, 19 nt, Homo sapiens
gcaagugugaugaguguga

SEQ ID NO: 1253524 - RNA, 19 nt, Homo sapiens
guggcaaggucuuuaauca

SEQ ID NO: 1253525 - RNA, 19 nt, Homo sapiens
cacaauugauguuagauuc

SEQ ID NO: 1253526 - RNA, 19 nt, Homo sapiens
cagucaagcuucaucuuau

SEQ ID NO: 1253527 - RNA, 19 nt, Homo sapiens
gaacucauacuggagagaa

SEQ ID NO: 1253528 - RNA, 19 nt, Homo sapiens
aaucacaccuugaaagaca

SEQ ID NO: 1253529 - RNA, 19 nt, Homo sapiens
ucacauugauuugcuugaa

SEQ ID NO: 1253530 - RNA, 19 nt, Homo sapiens
ggcaaggucuucagucaag

SEQ ID NO: 1253531 - RNA, 19 nt, Homo sapiens
gagaaaccuuacaaaugug

SEQ ID NO: 1253532 - RNA, 19 nt, Homo sapiens
gucacaaaguccucaguaa

SEQ ID NO: 1253533 - RNA, 19 nt, Homo sapiens
ggagagaaaccgugcaagu

SEQ ID NO: 1253534 - RNA, 19 nt, Homo sapiens
gagaaaccuuacaaaugug

SEQ ID NO: 1253535 - RNA, 19 nt, Homo sapiens
ccaggaagcacacaugaga

SEQ ID NO: 1253536 - RNA, 19 nt, Homo sapiens
gaaauacauaggagaguuc

SEQ ID NO: 1253537 - RNA, 19 nt, Homo sapiens
ggaaaggucugcaguauga

SEQ ID NO: 1253538 - RNA, 19 nt, Homo sapiens
gcaauaagcuuguucuauc

SEQ ID NO: 1253539 - RNA, 19 nt, Homo sapiens
ggagucaacuguacauuaa

SEQ ID NO: 1253540 - RNA, 19 nt, Homo sapiens
ggauacaucuauagaagua

SEQ ID NO: 1253541 - RNA, 19 nt, Homo sapiens
gaucuuggcuugucuucua

SEQ ID NO: 1253542 - RNA, 19 nt, Homo sapiens
caagaaacaucucugauug

SEQ ID NO: 1253543 - RNA, 19 nt, Homo sapiens
acacagaucugaugaagaa

SEQ ID NO: 1253544 - RNA, 19 nt, Homo sapiens
gaaaauggcuuugcaauug

SEQ ID NO: 1253545 - RNA, 19 nt, Homo sapiens
gaaaucagcagucagguuu

SEQ ID NO: 1253546 - RNA, 19 nt, Homo sapiens
gaaaaggacucucaacaaa

SEQ ID NO: 1253547 - RNA, 19 nt, Homo sapiens
gaaauccucugacgacaug

SEQ ID NO: 1253548 - RNA, 19 nt, Homo sapiens
gaaacugacuaauacauuc

SEQ ID NO: 1253549 - RNA, 19 nt, Homo sapiens
ucaaacccaugcuuaaaua

SEQ ID NO: 1253550 - RNA, 19 nt, Homo sapiens
gaaaacaccucaacuguga

SEQ ID NO: 1253551 - RNA, 19 nt, Homo sapiens
caaaggaggagcacuguua

SEQ ID NO: 1253552 - RNA, 19 nt, Homo sapiens
aaacagaagucaaugaaug

SEQ ID NO: 1253553 - RNA, 19 nt, Homo sapiens
gcaguggacuugagacuug

SEQ ID NO: 1253554 - RNA, 19 nt, Homo sapiens
caagaagcaugcugaacua

SEQ ID NO: 1253555 - RNA, 19 nt, Homo sapiens
gugauaagcuuacuuguca

SEQ ID NO: 1253556 - RNA, 19 nt, Homo sapiens
gaaaugauacccuugaaug

SEQ ID NO: 1253557 - RNA, 19 nt, Homo sapiens
uaaaagaagugccccauua

SEQ ID NO: 1253558 - RNA, 19 nt, Homo sapiens
gaaguaaguuguaugaaac

SEQ ID NO: 1253559 - RNA, 19 nt, Homo sapiens
ucaaagaaaugcugagaug

SEQ ID NO: 1253560 - RNA, 19 nt, Homo sapiens
gcaagauucugccaauguu

SEQ ID NO: 1253561 - RNA, 19 nt, Homo sapiens
gccaaguccucacggauua

SEQ ID NO: 1253562 - RNA, 19 nt, Homo sapiens
gcaagcagccagccaaauu

SEQ ID NO: 1253563 - RNA, 19 nt, Homo sapiens
cuauaucgaugggaaauua

SEQ ID NO: 1253564 - RNA, 19 nt, Homo sapiens
caacauauaccacugaaug

SEQ ID NO: 1253565 - RNA, 19 nt, Homo sapiens
gaagcccuaucucuacuaa

SEQ ID NO: 1253566 - RNA, 19 nt, Homo sapiens
cgacagcaauucauuagga

SEQ ID NO: 1253567 - RNA, 19 nt, Homo sapiens
caaaucaacuguccuaagg

SEQ ID NO: 1253568 - RNA, 19 nt, Homo sapiens
gaacaccaaucuccuaugc

SEQ ID NO: 1253569 - RNA, 19 nt, Homo sapiens
agaaacaucucugauugua

SEQ ID NO: 1253570 - RNA, 19 nt, Homo sapiens
aaaggacucucaacaaaga

SEQ ID NO: 1253571 - RNA, 19 nt, Homo sapiens
caaagcagcucguugugau

SEQ ID NO: 1253572 - RNA, 19 nt, Homo sapiens
cuaaggagauuaauuacug

SEQ ID NO: 1253573 - RNA, 19 nt, Homo sapiens
guaagaacauguccucauc

SEQ ID NO: 1253574 - RNA, 19 nt, Homo sapiens
ggagauuaauuacugguau

SEQ ID NO: 1253575 - RNA, 19 nt, Homo sapiens
acagcuaucucucucauuu

SEQ ID NO: 1253576 - RNA, 19 nt, Homo sapiens
gcaauaacaggacauguga

SEQ ID NO: 1253577 - RNA, 19 nt, Homo sapiens
ggacugcugugaccgaaug

SEQ ID NO: 1253578 - RNA, 19 nt, Homo sapiens
uugcuaaacugucuucuaa

SEQ ID NO: 1253579 - RNA, 19 nt, Homo sapiens
gaaaugccuuugaagaucu

SEQ ID NO: 1253580 - RNA, 19 nt, Homo sapiens
gaguguagcuccaguccuu

SEQ ID NO: 1253581 - RNA, 19 nt, Homo sapiens
gaagcagcaucaucuuaug

SEQ ID NO: 1253582 - RNA, 19 nt, Homo sapiens
gaaacuaggauacguauac

SEQ ID NO: 1253583 - RNA, 19 nt, Homo sapiens
gaaguuuucugaagcauuu

SEQ ID NO: 1253584 - RNA, 19 nt, Homo sapiens
ggaagcagcaucaucuuau

SEQ ID NO: 1253585 - RNA, 19 nt, Homo sapiens
ugaagaauuugaggcuuua

SEQ ID NO: 1253586 - RNA, 19 nt, Homo sapiens
aaagacaacucuggugaaa

SEQ ID NO: 1253587 - RNA, 19 nt, Homo sapiens
aaagaaaugcugagaugua

SEQ ID NO: 1253588 - RNA, 19 nt, Homo sapiens
gagaaaugccuuugaagau

SEQ ID NO: 1253589 - RNA, 19 nt, Homo sapiens
ggucagcggugugaagaaa

SEQ ID NO: 1253590 - RNA, 19 nt, Homo sapiens
uauaacggcuggguucuuu

SEQ ID NO: 1253591 - RNA, 19 nt, Homo sapiens
aaauggagcuaccuguaaa

SEQ ID NO: 1253592 - RNA, 19 nt, Homo sapiens
ggauguacacggaauauau

SEQ ID NO: 1253593 - RNA, 19 nt, Homo sapiens
gaucuucacuuuuggcaua

SEQ ID NO: 1253594 - RNA, 19 nt, Homo sapiens
cacaucagcuguucuacaa

SEQ ID NO: 1253595 - RNA, 19 nt, Homo sapiens
ggccagaccugugaacuug

SEQ ID NO: 1253596 - RNA, 19 nt, Homo sapiens
gcaaaugcccaccuggauu

SEQ ID NO: 1253597 - RNA, 19 nt, Homo sapiens
gggagacccuagaccaauu

SEQ ID NO: 1253598 - RNA, 19 nt, Homo sapiens
ugaaguuucuggcaucuau

SEQ ID NO: 1253599 - RNA, 19 nt, Homo sapiens
gcagcuggcuucacaggau

SEQ ID NO: 1253600 - RNA, 19 nt, Homo sapiens
gaggagccgugaacauuuc

SEQ ID NO: 1253601 - RNA, 19 nt, Homo sapiens
ucaagaaacaucucugauu

SEQ ID NO: 1253602 - RNA, 19 nt, Homo sapiens
gggagacuauaguacagua

SEQ ID NO: 1253603 - RNA, 19 nt, Homo sapiens
gaugaaggguacagacuag

SEQ ID NO: 1253604 - RNA, 19 nt, Homo sapiens
aaaggaaucuguguugaug

SEQ ID NO: 1253605 - RNA, 19 nt, Homo sapiens
ccagauccaucacagaaug

SEQ ID NO: 1253606 - RNA, 19 nt, Homo sapiens
cuaaggacauagaggcuaa

SEQ ID NO: 1253607 - RNA, 19 nt, Homo sapiens
gggaagcagcaucaucuua

SEQ ID NO: 1253608 - RNA, 19 nt, Homo sapiens
gcucuaaccuguaccuucu

SEQ ID NO: 1253609 - RNA, 19 nt, Homo sapiens
uaaauaaugcagucuguga

SEQ ID NO: 1253610 - RNA, 19 nt, Homo sapiens
gggcguaugugugucaauu

SEQ ID NO: 1253611 - RNA, 19 nt, Homo sapiens
ggagggcuaugauuucaca

SEQ ID NO: 1253612 - RNA, 19 nt, Homo sapiens
gcagugauaagcuuacuug

SEQ ID NO: 1253613 - RNA, 19 nt, Homo sapiens
gaaggcagugauaagcuua

SEQ ID NO: 1253614 - RNA, 19 nt, Homo sapiens
gcuaaacugucuucuaagg

SEQ ID NO: 1253615 - RNA, 19 nt, Homo sapiens
gcauuguuguucuugguuu

SEQ ID NO: 1253616 - RNA, 19 nt, Homo sapiens
gauaacggcagcgacaaua

SEQ ID NO: 1253617 - RNA, 19 nt, Homo sapiens
ggauaugucaugcuaguug

SEQ ID NO: 1253618 - RNA, 19 nt, Homo sapiens
guaaaugucagccaggauu

SEQ ID NO: 1253619 - RNA, 19 nt, Homo sapiens
guaaagacggugccaauag

SEQ ID NO: 1253620 - RNA, 19 nt, Homo sapiens
gcaauucauuaggaacaaa

SEQ ID NO: 1253621 - RNA, 19 nt, Homo sapiens
gggcuaugauuucacagaa

SEQ ID NO: 1253622 - RNA, 19 nt, Homo sapiens
uauaugcacuccagauaau

SEQ ID NO: 1253623 - RNA, 19 nt, Homo sapiens
guccacugcucauaucuuu

SEQ ID NO: 1253624 - RNA, 19 nt, Homo sapiens
ggugguagaugccuguaau

SEQ ID NO: 1253625 - RNA, 19 nt, Homo sapiens
ucacagaauguucaaguuu

SEQ ID NO: 1253626 - RNA, 19 nt, Homo sapiens
guagaugccuguaauucca

SEQ ID NO: 1253627 - RNA, 19 nt, Homo sapiens
gcucauuuguuucagguau

SEQ ID NO: 1253628 - RNA, 19 nt, Homo sapiens
gcacuuaucagccaaaauu

SEQ ID NO: 1253629 - RNA, 19 nt, Homo sapiens
gaaacaucucugauuguaa

SEQ ID NO: 1253630 - RNA, 19 nt, Homo sapiens
gccauuacccgaugaaaga

SEQ ID NO: 1253631 - RNA, 19 nt, Homo sapiens
gaagauggcgucuggaaac

SEQ ID NO: 1253632 - RNA, 19 nt, Homo sapiens
ggacauagaggcuaagacu

SEQ ID NO: 1253633 - RNA, 19 nt, Homo sapiens
caucuuaugucuacccaau

SEQ ID NO: 1253634 - RNA, 19 nt, Homo sapiens
agaccgcccuggacaauau

SEQ ID NO: 1253635 - RNA, 19 nt, Homo sapiens
auaaauaucccaggaguuu

SEQ ID NO: 1253636 - RNA, 19 nt, Homo sapiens
gaaugucagucuaauccau

SEQ ID NO: 1253637 - RNA, 19 nt, Homo sapiens
ggacuuaucuggugccuuu

SEQ ID NO: 1253638 - RNA, 19 nt, Homo sapiens
gggaauaccuugcccuuaa

SEQ ID NO: 1253639 - RNA, 19 nt, Homo sapiens
gaucauagcugggagagaa

SEQ ID NO: 1253640 - RNA, 19 nt, Homo sapiens
gaagaaagguaggaagauu

SEQ ID NO: 1253641 - RNA, 19 nt, Homo sapiens
ggaaccagcuucuacuuug

SEQ ID NO: 1253642 - RNA, 19 nt, Homo sapiens
ugaagcagcuggauuuaaa

SEQ ID NO: 1253643 - RNA, 19 nt, Homo sapiens
gcuaaugucugcuacaaga

SEQ ID NO: 1253644 - RNA, 19 nt, Homo sapiens
gaagaaaugggccaaagaa

SEQ ID NO: 1253645 - RNA, 19 nt, Homo sapiens
uagaggagcuacuuucaaa

SEQ ID NO: 1253646 - RNA, 19 nt, Homo sapiens
gaaccagcuucuacuuuga

SEQ ID NO: 1253647 - RNA, 19 nt, Homo sapiens
gcaauuuacugacuuuaag

SEQ ID NO: 1253648 - RNA, 19 nt, Homo sapiens
gcucggugcuauauuauga

SEQ ID NO: 1253649 - RNA, 19 nt, Homo sapiens
gauacuaauuuguggauug

SEQ ID NO: 1253650 - RNA, 19 nt, Homo sapiens
ugauuuaccucaacucauu

SEQ ID NO: 1253651 - RNA, 19 nt, Homo sapiens
gcucacaaguuuaaugaug

SEQ ID NO: 1253652 - RNA, 19 nt, Homo sapiens
gauuggauauugugccuuu

SEQ ID NO: 1253653 - RNA, 19 nt, Homo sapiens
gaagugcuccauuuacuga

SEQ ID NO: 1253654 - RNA, 19 nt, Homo sapiens
ccugggaacuuuaucuuaa

SEQ ID NO: 1253655 - RNA, 19 nt, Homo sapiens
caaguuggauuacuaugau

SEQ ID NO: 1253656 - RNA, 19 nt, Homo sapiens
gaagaagaggauacuaauu

SEQ ID NO: 1253657 - RNA, 19 nt, Homo sapiens
gcaauaagauuuuggacuu

SEQ ID NO: 1253658 - RNA, 19 nt, Homo sapiens
aaacagaguguccaucuaa

SEQ ID NO: 1253659 - RNA, 19 nt, Homo sapiens
ucaagaugauguacaagaa

SEQ ID NO: 1253660 - RNA, 19 nt, Homo sapiens
gagaagugcuccauuuacu

SEQ ID NO: 1253661 - RNA, 19 nt, Homo sapiens
gugcauggcuuccuguuuc

SEQ ID NO: 1253662 - RNA, 19 nt, Homo sapiens
ggaauaccuugcccuuaau

SEQ ID NO: 1253663 - RNA, 19 nt, Homo sapiens
gaacagagugccauagucu

SEQ ID NO: 1253664 - RNA, 19 nt, Homo sapiens
caaagagacccuucgagaa

SEQ ID NO: 1253665 - RNA, 19 nt, Homo sapiens
agaagaggauacuaauuug

SEQ ID NO: 1253666 - RNA, 19 nt, Homo sapiens
uaccucaacucauuuaaga

SEQ ID NO: 1253667 - RNA, 19 nt, Homo sapiens
ucuuacagcucauugcuaa

SEQ ID NO: 1253668 - RNA, 19 nt, Homo sapiens
gaacucaucaggcacaauc

SEQ ID NO: 1253669 - RNA, 19 nt, Homo sapiens
gcuacuacaaguuggauua

SEQ ID NO: 1253670 - RNA, 19 nt, Homo sapiens
gaauaagaaaccaagacua

SEQ ID NO: 1253671 - RNA, 19 nt, Homo sapiens
ugaugugucucaagaaguu

SEQ ID NO: 1253672 - RNA, 19 nt, Homo sapiens
agacuagccugggaacuuu

SEQ ID NO: 1253673 - RNA, 19 nt, Homo sapiens
gcaauuugaugauguuuug

SEQ ID NO: 1253674 - RNA, 19 nt, Homo sapiens
gaucagcuagugaauguga

SEQ ID NO: 1253675 - RNA, 19 nt, Homo sapiens
gaaagaagaaagguaggaa

SEQ ID NO: 1253676 - RNA, 19 nt, Homo sapiens
ccuaguagcaauaagauuu

SEQ ID NO: 1253677 - RNA, 19 nt, Homo sapiens
caacaggcaauaccaguga

SEQ ID NO: 1253678 - RNA, 19 nt, Homo sapiens
cuuaaagccuguaaccauu

SEQ ID NO: 1253679 - RNA, 19 nt, Homo sapiens
aggcuaaacuuggugauuu

SEQ ID NO: 1253680 - RNA, 19 nt, Homo sapiens
cauagucugugacccugua

SEQ ID NO: 1253681 - RNA, 19 nt, Homo sapiens
cagcuucuacuuugacaua

SEQ ID NO: 1253682 - RNA, 19 nt, Homo sapiens
gauccuaacccugaauauu

SEQ ID NO: 1253683 - RNA, 19 nt, Homo sapiens
gauccaaagugagaagaug

SEQ ID NO: 1253684 - RNA, 19 nt, Homo sapiens
ggaguauauucucaaagga

SEQ ID NO: 1253685 - RNA, 19 nt, Homo sapiens
ccaucgcacucaaucuuaa

SEQ ID NO: 1253686 - RNA, 19 nt, Homo sapiens
uugagaggcuggauccuaa

SEQ ID NO: 1253687 - RNA, 19 nt, Homo sapiens
caaugcuucuucauccuuu

SEQ ID NO: 1253688 - RNA, 19 nt, Homo sapiens
gauggacaaugcuucuuca

SEQ ID NO: 1253689 - RNA, 19 nt, Homo sapiens
cacagaagaucaacucagu

SEQ ID NO: 1253690 - RNA, 19 nt, Homo sapiens
ucaaaggaguggucaaugc

SEQ ID NO: 1253691 - RNA, 19 nt, Homo sapiens
ucaggaguauauucucaaa

SEQ ID NO: 1253692 - RNA, 19 nt, Homo sapiens
cagagcagcugaggcagaa

SEQ ID NO: 1253693 - RNA, 19 nt, Homo sapiens
ggauuacuaugaugugucu

SEQ ID NO: 1253694 - RNA, 19 nt, Homo sapiens
aagcgaauacugcuagaua

SEQ ID NO: 1253695 - RNA, 19 nt, Homo sapiens
gaagaggauacuaauuugu

SEQ ID NO: 1253696 - RNA, 19 nt, Homo sapiens
gauccuaguagcaauaaga

SEQ ID NO: 1253697 - RNA, 19 nt, Homo sapiens
ccaaguagaauacaugauc

SEQ ID NO: 1253698 - RNA, 19 nt, Homo sapiens
guaacacccaaguagaaua

SEQ ID NO: 1253699 - RNA, 19 nt, Homo sapiens
gaauacugcuagauaacag

SEQ ID NO: 1253700 - RNA, 19 nt, Homo sapiens
aagaagaagaggauacuaa

SEQ ID NO: 1253701 - RNA, 19 nt, Homo sapiens
gcuacaagaugggccaguu

SEQ ID NO: 1253702 - RNA, 19 nt, Homo sapiens
gcuagugaaugugauacaa

SEQ ID NO: 1253703 - RNA, 19 nt, Homo sapiens
cagcaaauuccugauagua

SEQ ID NO: 1253704 - RNA, 19 nt, Homo sapiens
acuacaaguuggauuacua

SEQ ID NO: 1253705 - RNA, 19 nt, Homo sapiens
gaagaagaagaggauacua

SEQ ID NO: 1253706 - RNA, 19 nt, Homo sapiens
uuacugagaagcacaggua

SEQ ID NO: 1253707 - RNA, 19 nt, Homo sapiens
ucaagaugaugcuuucaag

SEQ ID NO: 1253708 - RNA, 19 nt, Homo sapiens
ucacuccaguuuaaucugu

SEQ ID NO: 1253709 - RNA, 19 nt, Homo sapiens
ugaauuugcuaaagaacuc

SEQ ID NO: 1253710 - RNA, 19 nt, Homo sapiens
acuaugaugugucucaaga

SEQ ID NO: 1253711 - RNA, 19 nt, Homo sapiens
caagaccgacgucaagaug

SEQ ID NO: 1253712 - RNA, 19 nt, Homo sapiens
cuauuacccuguuggaguu

SEQ ID NO: 1253713 - RNA, 19 nt, Homo sapiens
gcuucuacuuugacauaaa

SEQ ID NO: 1253714 - RNA, 19 nt, Homo sapiens
agauuucacuggagcuauu

SEQ ID NO: 1253715 - RNA, 19 nt, Homo sapiens
aggaucagcuagugaaugu

SEQ ID NO: 1253716 - RNA, 19 nt, Homo sapiens
ucgagaagugcuccauuua

SEQ ID NO: 1253717 - RNA, 19 nt, Homo sapiens
uaccuugcccuuaauguuu

SEQ ID NO: 1253718 - RNA, 19 nt, Homo sapiens
ucuccuggcugcaauaaca

SEQ ID NO: 1253719 - RNA, 19 nt, Homo sapiens
gauaguaccaucgcacuca

SEQ ID NO: 1253720 - RNA, 19 nt, Homo sapiens
uaugcgaucucacuaccaa

SEQ ID NO: 1253721 - RNA, 19 nt, Homo sapiens
gcacagguaacacccaagu

SEQ ID NO: 1253722 - RNA, 19 nt, Homo sapiens
aauaagaaaccaagacuag

SEQ ID NO: 1253723 - RNA, 19 nt, Homo sapiens
ccucaggaguauauucuca

SEQ ID NO: 1253724 - RNA, 19 nt, Homo sapiens
gcguuccucuugauccaaa

SEQ ID NO: 1253725 - RNA, 19 nt, Homo sapiens
gggaggaucagcuagugaa

SEQ ID NO: 1253726 - RNA, 19 nt, Homo sapiens
guacaagaagcuuauaacu

SEQ ID NO: 1253727 - RNA, 19 nt, Homo sapiens
ggaguucaaacgucauguu

SEQ ID NO: 1253728 - RNA, 19 nt, Homo sapiens
ucacuaccaagaagcuaua

SEQ ID NO: 1253729 - RNA, 19 nt, Homo sapiens
ucacaagaccgacgucaag

SEQ ID NO: 1253730 - RNA, 19 nt, Homo sapiens
uucgagaagugcuccauuu

SEQ ID NO: 1253731 - RNA, 19 nt, Homo sapiens
gaaggggcuuugcagguuu

SEQ ID NO: 1253732 - RNA, 19 nt, Homo sapiens
uaccaagaagcuauagaua

SEQ ID NO: 1253733 - RNA, 19 nt, Homo sapiens
acauuuaccucagcugguu

SEQ ID NO: 1253734 - RNA, 19 nt, Homo sapiens
uaauuaugcccaagccaaa

SEQ ID NO: 1253735 - RNA, 19 nt, Homo sapiens
uaugaugugucucaagaag

SEQ ID NO: 1253736 - RNA, 19 nt, Homo sapiens
acaaguuggauuacuauga

SEQ ID NO: 1253737 - RNA, 19 nt, Homo sapiens
ggacugcucugagauuuga

SEQ ID NO: 1253738 - RNA, 19 nt, Homo sapiens
gaacugccuuuccucuuug

SEQ ID NO: 1253739 - RNA, 19 nt, Homo sapiens
cgaacugccuuuccucuuu

SEQ ID NO: 1253740 - RNA, 19 nt, Homo sapiens
gccaagaggucacgacuuc

SEQ ID NO: 1253741 - RNA, 19 nt, Homo sapiens
ggacugagccugccaagag

SEQ ID NO: 1253742 - RNA, 19 nt, Homo sapiens
acucggaacuggcggaaua

SEQ ID NO: 1253743 - RNA, 19 nt, Homo sapiens
ggacaucguugugaaaggu

SEQ ID NO: 1253744 - RNA, 19 nt, Homo sapiens
caauggguguggguaauuu

SEQ ID NO: 1253745 - RNA, 19 nt, Homo sapiens
ggccaggacugcucugaga

SEQ ID NO: 1253746 - RNA, 19 nt, Homo sapiens
ggacuaugguggcuucucu

SEQ ID NO: 1253747 - RNA, 19 nt, Homo sapiens
cgucgaggcuucacucuuc

SEQ ID NO: 1253748 - RNA, 19 nt, Homo sapiens
gcaacgcauucgcgcugua

SEQ ID NO: 1253749 - RNA, 19 nt, Homo sapiens
gcuggugaaugccuacuug

SEQ ID NO: 1253750 - RNA, 19 nt, Homo sapiens
ggaacccgauucugagaca

SEQ ID NO: 1253751 - RNA, 19 nt, Homo sapiens
gcuccgggaugaacucuuc

SEQ ID NO: 1253752 - RNA, 19 nt, Homo sapiens
gggaagugaucgccuccaa

SEQ ID NO: 1253753 - RNA, 19 nt, Homo sapiens
caggacugcucugagauuu

SEQ ID NO: 1253754 - RNA, 19 nt, Homo sapiens
ggaauaugcgcgcuucauc

SEQ ID NO: 1253755 - RNA, 19 nt, Homo sapiens
caacuccucaccugcauga

SEQ ID NO: 1253756 - RNA, 19 nt, Homo sapiens
gacugugucuggucggaaa

SEQ ID NO: 1253757 - RNA, 19 nt, Homo sapiens
ucaccagguuugagaacuu

SEQ ID NO: 1253758 - RNA, 19 nt, Homo sapiens
gcucagggacauacaggaa

SEQ ID NO: 1253759 - RNA, 19 nt, Homo sapiens
ucaugcagcuggugaaugc

SEQ ID NO: 1253760 - RNA, 19 nt, Homo sapiens
gagauuugagggaaacaug

SEQ ID NO: 1253761 - RNA, 19 nt, Homo sapiens
cugaggaacccgauucuga

SEQ ID NO: 1253762 - RNA, 19 nt, Homo sapiens
cgaggacgaggaaaccuuu

SEQ ID NO: 1253763 - RNA, 19 nt, Homo sapiens
cauccacagugucagcuau

SEQ ID NO: 1253764 - RNA, 19 nt, Homo sapiens
gaggaacccgauucugaga

SEQ ID NO: 1253765 - RNA, 19 nt, Homo sapiens
ccaggacugcucugagauu

SEQ ID NO: 1253766 - RNA, 19 nt, Homo sapiens
cuacaauggguguggguaa

SEQ ID NO: 1253767 - RNA, 19 nt, Homo sapiens
ucagggacauacaggaaag

SEQ ID NO: 1253768 - RNA, 19 nt, Homo sapiens
gacuaugucugcgucuuca

SEQ ID NO: 1253769 - RNA, 19 nt, Homo sapiens
ugucagcuauggccaugug

SEQ ID NO: 1253770 - RNA, 19 nt, Homo sapiens
gagccugcaucgggacuuc

SEQ ID NO: 1253771 - RNA, 19 nt, Homo sapiens
caccagguuugagaacuug

SEQ ID NO: 1253772 - RNA, 19 nt, Homo sapiens
guggguaauuuucuaguuu

SEQ ID NO: 1253773 - RNA, 19 nt, Homo sapiens
ccgacgugcucaccagguu

SEQ ID NO: 1253774 - RNA, 19 nt, Homo sapiens
gagcccauccacaguguca

SEQ ID NO: 1253775 - RNA, 19 nt, Homo sapiens
gaugcagggugugcuccaa

SEQ ID NO: 1253776 - RNA, 19 nt, Homo sapiens
ugugaaagguuggcuguac

SEQ ID NO: 1253777 - RNA, 19 nt, Homo sapiens
uacaauggguguggguaau

SEQ ID NO: 1253778 - RNA, 19 nt, Homo sapiens
gaucaugcagcuggugaau

SEQ ID NO: 1253779 - RNA, 19 nt, Homo sapiens
ggagccucaucccggagaa

SEQ ID NO: 1253780 - RNA, 19 nt, Homo sapiens
gauuugagggaaacaugga

SEQ ID NO: 1253781 - RNA, 19 nt, Homo sapiens
ggacgaggaaaccuuugag

SEQ ID NO: 1253782 - RNA, 19 nt, Homo sapiens
cgaggacgaggacgaggaa

SEQ ID NO: 1253783 - RNA, 19 nt, Homo sapiens
cccagacggucacgaacug

SEQ ID NO: 1253784 - RNA, 19 nt, Homo sapiens
gggacauacaggaaaguug

SEQ ID NO: 1253785 - RNA, 19 nt, Homo sapiens
gacgugcucaccagguuug

SEQ ID NO: 1253786 - RNA, 19 nt, Homo sapiens
gcgcaggcguaaggagaca

SEQ ID NO: 1253787 - RNA, 19 nt, Homo sapiens
gcaguuaccucauaauaaa

SEQ ID NO: 1253788 - RNA, 19 nt, Homo sapiens
gcagaaccuuucagaguua

SEQ ID NO: 1253789 - RNA, 19 nt, Homo sapiens
ugacagcacuggaguuaua

SEQ ID NO: 1253790 - RNA, 19 nt, Homo sapiens
acaaagaccugcacagaaa

SEQ ID NO: 1253791 - RNA, 19 nt, Homo sapiens
gagaugcuuucuacaguua

SEQ ID NO: 1253792 - RNA, 19 nt, Homo sapiens
ccacagcccugccucuuga

SEQ ID NO: 1253793 - RNA, 19 nt, Homo sapiens
caaggcaauucauaguaua

SEQ ID NO: 1253794 - RNA, 19 nt, Homo sapiens
gcucagcccuagagaaaga

SEQ ID NO: 1253795 - RNA, 19 nt, Homo sapiens
ccaaggcaauucauaguau

SEQ ID NO: 1253796 - RNA, 19 nt, Homo sapiens
gaacagagugcagagcuuu

SEQ ID NO: 1253797 - RNA, 19 nt, Homo sapiens
gaugacagcacuggaguua

SEQ ID NO: 1253798 - RNA, 19 nt, Homo sapiens
ccaaagaauuccucaugga

SEQ ID NO: 1253799 - RNA, 19 nt, Homo sapiens
gagaagagcgagagauuca

SEQ ID NO: 1253800 - RNA, 19 nt, Homo sapiens
gcacaauggagcacuacua

SEQ ID NO: 1253801 - RNA, 19 nt, Homo sapiens
ccagaaagaugaugguuuu

SEQ ID NO: 1253802 - RNA, 19 nt, Homo sapiens
uaagaaugcuauacaacug

SEQ ID NO: 1253803 - RNA, 19 nt, Homo sapiens
ggguuuggauccuguguuu

SEQ ID NO: 1253804 - RNA, 19 nt, Homo sapiens
gaaagaagaggcacuaagc

SEQ ID NO: 1253805 - RNA, 19 nt, Homo sapiens
gaagaggcacuaagcaauc

SEQ ID NO: 1253806 - RNA, 19 nt, Homo sapiens
gacaaagaccugcacagaa

SEQ ID NO: 1253807 - RNA, 19 nt, Homo sapiens
uggaaaugguggagucuuu

SEQ ID NO: 1253808 - RNA, 19 nt, Homo sapiens
gggauauccuggacaugaa

SEQ ID NO: 1253809 - RNA, 19 nt, Homo sapiens
cagcucagcccuagagaaa

SEQ ID NO: 1253810 - RNA, 19 nt, Homo sapiens
gaagagcgagagauucaug

SEQ ID NO: 1253811 - RNA, 19 nt, Homo sapiens
cagcuuaaccucacaacuu

SEQ ID NO: 1253812 - RNA, 19 nt, Homo sapiens
guagaugucuugggaacug

SEQ ID NO: 1253813 - RNA, 19 nt, Homo sapiens
ggcaguuaccucauaauaa

SEQ ID NO: 1253814 - RNA, 19 nt, Homo sapiens
ugccaccgcuuacuauaaa

SEQ ID NO: 1253815 - RNA, 19 nt, Homo sapiens
agcuuaaccucacaacuua

SEQ ID NO: 1253816 - RNA, 19 nt, Homo sapiens
aagaauuccucauggagaa

SEQ ID NO: 1253817 - RNA, 19 nt, Homo sapiens
ccaggugccagguguauuu

SEQ ID NO: 1253818 - RNA, 19 nt, Homo sapiens
gcuccgaccaagugaauuu

SEQ ID NO: 1253819 - RNA, 19 nt, Homo sapiens
ugcagaaccuuucagaguu

SEQ ID NO: 1253820 - RNA, 19 nt, Homo sapiens
ggagugagagaaagagaug

SEQ ID NO: 1253821 - RNA, 19 nt, Homo sapiens
gaaagaugaugguuuugau

SEQ ID NO: 1253822 - RNA, 19 nt, Homo sapiens
cagagaagagcgagagauu

SEQ ID NO: 1253823 - RNA, 19 nt, Homo sapiens
gaggcaguauccgcacaua

SEQ ID NO: 1253824 - RNA, 19 nt, Homo sapiens
ccagaaaccaaaucacaug

SEQ ID NO: 1253825 - RNA, 19 nt, Homo sapiens
cagcugaggaggacaaaga

SEQ ID NO: 1253826 - RNA, 19 nt, Homo sapiens
uacaaaugcuugacucagu

SEQ ID NO: 1253827 - RNA, 19 nt, Homo sapiens
ccucacaacuuaagaagcu

SEQ ID NO: 1253828 - RNA, 19 nt, Homo sapiens
agagaugcuuucuacaguu

SEQ ID NO: 1253829 - RNA, 19 nt, Homo sapiens
ggagaccccuucccucuug

SEQ ID NO: 1253830 - RNA, 19 nt, Homo sapiens
acaaagauaagguggcauu

SEQ ID NO: 1253831 - RNA, 19 nt, Homo sapiens
uauacuauguaaccagaga

SEQ ID NO: 1253832 - RNA, 19 nt, Homo sapiens
agacaaagaccugcacaga

SEQ ID NO: 1253833 - RNA, 19 nt, Homo sapiens
ggaaaugguggagucuuug

SEQ ID NO: 1253834 - RNA, 19 nt, Homo sapiens
gacccaguguggaacauuc

SEQ ID NO: 1253835 - RNA, 19 nt, Homo sapiens
ggaacugucauuggaguga

SEQ ID NO: 1253836 - RNA, 19 nt, Homo sapiens
aagagaccauugagcagaa

SEQ ID NO: 1253837 - RNA, 19 nt, Homo sapiens
guugaauacugagucugua

SEQ ID NO: 1253838 - RNA, 19 nt, Homo sapiens
uaaacugcaucugcuggaa

SEQ ID NO: 1253839 - RNA, 19 nt, Homo sapiens
gaugcuuucuacaguuaug

SEQ ID NO: 1253840 - RNA, 19 nt, Homo sapiens
aagagaugcuuucuacagu

SEQ ID NO: 1253841 - RNA, 19 nt, Homo sapiens
guguggaacauucaaauug

SEQ ID NO: 1253842 - RNA, 19 nt, Homo sapiens
ggacacgauccgagucaga

SEQ ID NO: 1253843 - RNA, 19 nt, Homo sapiens
uaaccucacaacuuaagaa

SEQ ID NO: 1253844 - RNA, 19 nt, Homo sapiens
cugaggaggacaaagauaa

SEQ ID NO: 1253845 - RNA, 19 nt, Homo sapiens
ucagcacaauggagcacua

SEQ ID NO: 1253846 - RNA, 19 nt, Homo sapiens
gagaaagaagaggcacuaa

SEQ ID NO: 1253847 - RNA, 19 nt, Homo sapiens
uguaucagcugcuccuagu

SEQ ID NO: 1253848 - RNA, 19 nt, Homo sapiens
cuacaguuauggaguggau

SEQ ID NO: 1253849 - RNA, 19 nt, Homo sapiens
cuugggaacugucauugga

SEQ ID NO: 1253850 - RNA, 19 nt, Homo sapiens
gcugaggaggacaaagaua

SEQ ID NO: 1253851 - RNA, 19 nt, Homo sapiens
ugcuugagcugcccacuau

SEQ ID NO: 1253852 - RNA, 19 nt, Homo sapiens
cuuaagaagcuacaagaga

SEQ ID NO: 1253853 - RNA, 19 nt, Homo sapiens
ucagugaugcagaaccuuu

SEQ ID NO: 1253854 - RNA, 19 nt, Homo sapiens
gaagcuacaagagaccauu

SEQ ID NO: 1253855 - RNA, 19 nt, Homo sapiens
caacuuaagaagcuacaag

SEQ ID NO: 1253856 - RNA, 19 nt, Homo sapiens
aggcaguuaccucauaaua

SEQ ID NO: 1253857 - RNA, 19 nt, Homo sapiens
aaccaaaucacauggagaa

SEQ ID NO: 1253858 - RNA, 19 nt, Homo sapiens
ggacugccagaaaccaaau

SEQ ID NO: 1253859 - RNA, 19 nt, Homo sapiens
aaaguugaauacugagucu

SEQ ID NO: 1253860 - RNA, 19 nt, Homo sapiens
ggaggaccagagugacauu

SEQ ID NO: 1253861 - RNA, 19 nt, Homo sapiens
caaaugcuugacucaguga

SEQ ID NO: 1253862 - RNA, 19 nt, Homo sapiens
uaaaacagguagaugucuu

SEQ ID NO: 1253863 - RNA, 19 nt, Homo sapiens
aaacucuacaucagggaua

SEQ ID NO: 1253864 - RNA, 19 nt, Homo sapiens
agaagaggcacuaagcaau

SEQ ID NO: 1253865 - RNA, 19 nt, Homo sapiens
aagaagaggcacuaagcaa

SEQ ID NO: 1253866 - RNA, 19 nt, Homo sapiens
agagaaagaagaggcacua

SEQ ID NO: 1253867 - RNA, 19 nt, Homo sapiens
aaacugcaucugcuggaaa

SEQ ID NO: 1253868 - RNA, 19 nt, Homo sapiens
ccacuuccaaggcaauuca

SEQ ID NO: 1253869 - RNA, 19 nt, Homo sapiens
agaacagagugcagagcuu

SEQ ID NO: 1253870 - RNA, 19 nt, Homo sapiens
cuaucuacaggaaaguuua

SEQ ID NO: 1253871 - RNA, 19 nt, Homo sapiens
gagcugcccacuaucuaca

SEQ ID NO: 1253872 - RNA, 19 nt, Homo sapiens
ggauccagccggugugaag

SEQ ID NO: 1253873 - RNA, 19 nt, Homo sapiens
ccaagugaauuuuaagaag

SEQ ID NO: 1253874 - RNA, 19 nt, Homo sapiens
gaaaugguggagucuuugc

SEQ ID NO: 1253875 - RNA, 19 nt, Homo sapiens
agcaggagcuggaaauggu

SEQ ID NO: 1253876 - RNA, 19 nt, Homo sapiens
aagauaagguggcauucac

SEQ ID NO: 1253877 - RNA, 19 nt, Homo sapiens
aaagauaagguggcauuca

SEQ ID NO: 1253878 - RNA, 19 nt, Homo sapiens
caauggagcacuacuacac

SEQ ID NO: 1253879 - RNA, 19 nt, Homo sapiens
uccaaggcaauucauagua

SEQ ID NO: 1253880 - RNA, 19 nt, Homo sapiens
ucacagcucagcccuagag

SEQ ID NO: 1253881 - RNA, 19 nt, Homo sapiens
acauucaaauugcaaggau

SEQ ID NO: 1253882 - RNA, 19 nt, Homo sapiens
guggaacauucaaauugca

SEQ ID NO: 1253883 - RNA, 19 nt, Homo sapiens
agauucaugccaccgcuua

SEQ ID NO: 1253884 - RNA, 19 nt, Homo sapiens
gagcagaaaacaaagauag

SEQ ID NO: 1253885 - RNA, 19 nt, Homo sapiens
gacagcacuggaguuauaa

SEQ ID NO: 1253886 - RNA, 19 nt, Homo sapiens
gucauuggagugagagaaa

SEQ ID NO: 1253887 - RNA, 19 nt, Homo sapiens
gaagagaaguuagaaguuu

SEQ ID NO: 1253888 - RNA, 19 nt, Homo sapiens
gcaagcaccuauuaucuau

SEQ ID NO: 1253889 - RNA, 19 nt, Homo sapiens
agucugaggugaauucuua

SEQ ID NO: 1253890 - RNA, 19 nt, Homo sapiens
agagagugcuuucauuuaa

SEQ ID NO: 1253891 - RNA, 19 nt, Homo sapiens
gagcuccucucccaucuuu

SEQ ID NO: 1253892 - RNA, 19 nt, Homo sapiens
ugacaacgauagcaauuga

SEQ ID NO: 1253893 - RNA, 19 nt, Homo sapiens
gauaaagucucuaauucca

SEQ ID NO: 1253894 - RNA, 19 nt, Homo sapiens
agaaaggaaugcaauguga

SEQ ID NO: 1253895 - RNA, 19 nt, Homo sapiens
guuagaaguuuccagauau

SEQ ID NO: 1253896 - RNA, 19 nt, Homo sapiens
caaaauacguguccaguga

SEQ ID NO: 1253897 - RNA, 19 nt, Homo sapiens
gcccugugcugccucuuua

SEQ ID NO: 1253898 - RNA, 19 nt, Homo sapiens
uggcaagaauggagucuaa

SEQ ID NO: 1253899 - RNA, 19 nt, Homo sapiens
gagagugcuuucauuuaau

SEQ ID NO: 1253900 - RNA, 19 nt, Homo sapiens
uggauaaagucucuaauuc

SEQ ID NO: 1253901 - RNA, 19 nt, Homo sapiens
gcugggaucuggaaucaca

SEQ ID NO: 1253902 - RNA, 19 nt, Homo sapiens
gaucuggaaucacauggau

SEQ ID NO: 1253903 - RNA, 19 nt, Homo sapiens
guugaaaccucgucuguac

SEQ ID NO: 1253904 - RNA, 19 nt, Homo sapiens
gcagaaagcaagagaaagg

SEQ ID NO: 1253905 - RNA, 19 nt, Homo sapiens
uagagagugcuuucauuua

SEQ ID NO: 1253906 - RNA, 19 nt, Homo sapiens
ggaggagaguggcauuauc

SEQ ID NO: 1253907 - RNA, 19 nt, Homo sapiens
gccaaucgcuccuauuacu

SEQ ID NO: 1253908 - RNA, 19 nt, Homo sapiens
aguuagaaguuuccagaua

SEQ ID NO: 1253909 - RNA, 19 nt, Homo sapiens
gaaaccucgucuguacuaa

SEQ ID NO: 1253910 - RNA, 19 nt, Homo sapiens
cagcauacauuuuguuuug

SEQ ID NO: 1253911 - RNA, 19 nt, Homo sapiens
gcauuucuuugcacagaga

SEQ ID NO: 1253912 - RNA, 19 nt, Homo sapiens
cugcagcugugacuaauug

SEQ ID NO: 1253913 - RNA, 19 nt, Homo sapiens
ugaggugaauucuuagaga

SEQ ID NO: 1253914 - RNA, 19 nt, Homo sapiens
gaaagcaagagaaaggaau

SEQ ID NO: 1253915 - RNA, 19 nt, Homo sapiens
caaucgcuccuauuacuuu

SEQ ID NO: 1253916 - RNA, 19 nt, Homo sapiens
gcaagaauggagucuaauc

SEQ ID NO: 1253917 - RNA, 19 nt, Homo sapiens
gagaaaggaaugcaaugug

SEQ ID NO: 1253918 - RNA, 19 nt, Homo sapiens
guggauaaagucucuaauu

SEQ ID NO: 1253919 - RNA, 19 nt, Homo sapiens
gcuguacaccgacuuggua

SEQ ID NO: 1253920 - RNA, 19 nt, Homo sapiens
ugaaaccucgucuguacua

SEQ ID NO: 1253921 - RNA, 19 nt, Homo sapiens
caagggcucuuuggcugaa

SEQ ID NO: 1253922 - RNA, 19 nt, Homo sapiens
caagagaaaggaaugcaau

SEQ ID NO: 1253923 - RNA, 19 nt, Homo sapiens
gaaggcagaaagcaagaga

SEQ ID NO: 1253924 - RNA, 19 nt, Homo sapiens
uuagagagugcuuucauuu

SEQ ID NO: 1253925 - RNA, 19 nt, Homo sapiens
ccacguggauaaagucucu

SEQ ID NO: 1253926 - RNA, 19 nt, Homo sapiens
ugucaaacccagaauaguu

SEQ ID NO: 1253927 - RNA, 19 nt, Homo sapiens
caaagcagagccaguagug

SEQ ID NO: 1253928 - RNA, 19 nt, Homo sapiens
ccucaaagcagagccagua

SEQ ID NO: 1253929 - RNA, 19 nt, Homo sapiens
acaacgauagcaauugaua

SEQ ID NO: 1253930 - RNA, 19 nt, Homo sapiens
guuuagcaagcaccuauua

SEQ ID NO: 1253931 - RNA, 19 nt, Homo sapiens
agaccaaccuggccaacau

SEQ ID NO: 1253932 - RNA, 19 nt, Homo sapiens
gaggaggagaguggcauua

SEQ ID NO: 1253933 - RNA, 19 nt, Homo sapiens
gcaagagaaaggaaugcaa

SEQ ID NO: 1253934 - RNA, 19 nt, Homo sapiens
cuuagagagugcuuucauu

SEQ ID NO: 1253935 - RNA, 19 nt, Homo sapiens
aggccaaucgcuccuauua

SEQ ID NO: 1253936 - RNA, 19 nt, Homo sapiens
guacaccgacuugguauca

SEQ ID NO: 1253937 - RNA, 19 nt, Homo sapiens
gugcugggaucuggaauca

SEQ ID NO: 1253938 - RNA, 19 nt, Homo sapiens
caacacagcauuauuucac

SEQ ID NO: 1253939 - RNA, 19 nt, Homo sapiens
cuacugcaguuggcaagaa

SEQ ID NO: 1253940 - RNA, 19 nt, Homo sapiens
uuagaaguuuccagauaug

SEQ ID NO: 1253941 - RNA, 19 nt, Homo sapiens
ugaagagaaguuagaaguu

SEQ ID NO: 1253942 - RNA, 19 nt, Homo sapiens
uagcagcauugcauuucuu

SEQ ID NO: 1253943 - RNA, 19 nt, Homo sapiens
gcaacacagcauuauuuca

SEQ ID NO: 1253944 - RNA, 19 nt, Homo sapiens
gauagcaauugauauaccu

SEQ ID NO: 1253945 - RNA, 19 nt, Homo sapiens
caucagagaaggcagaaag

SEQ ID NO: 1253946 - RNA, 19 nt, Homo sapiens
gagccaguagugaucagua

SEQ ID NO: 1253947 - RNA, 19 nt, Homo sapiens
caacgauagcaauugauau

SEQ ID NO: 1253948 - RNA, 19 nt, Homo sapiens
gugcgcagcccucagcaaa

SEQ ID NO: 1253949 - RNA, 19 nt, Homo sapiens
aagagaaguuagaaguuuc

SEQ ID NO: 1253950 - RNA, 19 nt, Homo sapiens
gaaggauuuucgaucauga

SEQ ID NO: 1253951 - RNA, 19 nt, Homo sapiens
gaugaggaacccgauaaug

SEQ ID NO: 1253952 - RNA, 19 nt, Homo sapiens
gauugugugugguuucucu

SEQ ID NO: 1253953 - RNA, 19 nt, Homo sapiens
gagaaggcagaaagcaaga

SEQ ID NO: 1253954 - RNA, 19 nt, Homo sapiens
caugacaacgauagcaauu

SEQ ID NO: 1253955 - RNA, 19 nt, Homo sapiens
ggauaaagucucuaauucc

SEQ ID NO: 1253956 - RNA, 19 nt, Homo sapiens
ucaguauccugcugcuuca

SEQ ID NO: 1253957 - RNA, 19 nt, Homo sapiens
gucaggaauuugagaccaa

SEQ ID NO: 1253958 - RNA, 19 nt, Homo sapiens
cagagaaggcagaaagcaa

SEQ ID NO: 1253959 - RNA, 19 nt, Homo sapiens
cauaaagccaggguuguug

SEQ ID NO: 1253960 - RNA, 19 nt, Homo sapiens
agucuaaucccagcacuuu

SEQ ID NO: 1253961 - RNA, 19 nt, Homo sapiens
cgaggccaaucgcuccuau

SEQ ID NO: 1253962 - RNA, 19 nt, Homo sapiens
ccaggguuguugaaagcuu

SEQ ID NO: 1253963 - RNA, 19 nt, Homo sapiens
ggaugaggaacccgauaau

SEQ ID NO: 1253964 - RNA, 19 nt, Homo sapiens
aaaccucgucuguacuaaa

SEQ ID NO: 1253965 - RNA, 19 nt, Homo sapiens
cagugaguguugauugugu

SEQ ID NO: 1253966 - RNA, 19 nt, Homo sapiens
gcuccucucccaucuuugu

SEQ ID NO: 1253967 - RNA, 19 nt, Homo sapiens
caagcaccuauuaucuaua

SEQ ID NO: 1253968 - RNA, 19 nt, Homo sapiens
uagcaagcaccuauuaucu

SEQ ID NO: 1253969 - RNA, 19 nt, Homo sapiens
ucauaaagccaggguuguu

SEQ ID NO: 1253970 - RNA, 19 nt, Homo sapiens
gaucccaccgcucauaaag

SEQ ID NO: 1253971 - RNA, 19 nt, Homo sapiens
ucauacacaugcacuuguc

SEQ ID NO: 1253972 - RNA, 19 nt, Homo sapiens
acaccgacuugguaucauc

SEQ ID NO: 1253973 - RNA, 19 nt, Homo sapiens
ucuggaaucacauggauga

SEQ ID NO: 1253974 - RNA, 19 nt, Homo sapiens
ggcaucaccugagccuaug

SEQ ID NO: 1253975 - RNA, 19 nt, Homo sapiens
aggcagaaagcaagagaaa

SEQ ID NO: 1253976 - RNA, 19 nt, Homo sapiens
gguaaacagagggaaguug

SEQ ID NO: 1253977 - RNA, 19 nt, Homo sapiens
gcagagccaguagugauca

SEQ ID NO: 1253978 - RNA, 19 nt, Homo sapiens
cgagguagcaggcgaacca

SEQ ID NO: 1253979 - RNA, 19 nt, Homo sapiens
ugaggaacccgauaauggu

SEQ ID NO: 1253980 - RNA, 19 nt, Homo sapiens
uggaugaggaacccgauaa

SEQ ID NO: 1253981 - RNA, 19 nt, Homo sapiens
gccaccaugugaauucauc

SEQ ID NO: 1253982 - RNA, 19 nt, Homo sapiens
uguggaacagcauacauuu

SEQ ID NO: 1253983 - RNA, 19 nt, Homo sapiens
cuaauuguggaacagcaua

SEQ ID NO: 1253984 - RNA, 19 nt, Homo sapiens
aagcagagccaguagugau

SEQ ID NO: 1253985 - RNA, 19 nt, Homo sapiens
ggagaccguguucaugcaa

SEQ ID NO: 1253986 - RNA, 19 nt, Homo sapiens
gcagcucacgggacuaugg

SEQ ID NO: 1253987 - RNA, 19 nt, Homo sapiens
ggguagaucuuccuaauuu

SEQ ID NO: 1253988 - RNA, 19 nt, Homo sapiens
gaauccacaugguguaaua

SEQ ID NO: 1253989 - RNA, 19 nt, Homo sapiens
gguaaggucuugaguguug

SEQ ID NO: 1253990 - RNA, 19 nt, Homo sapiens
gcaaauccaugcaggacaa

SEQ ID NO: 1253991 - RNA, 19 nt, Homo sapiens
gaacacacacugguuaauu

SEQ ID NO: 1253992 - RNA, 19 nt, Homo sapiens
gaacaaagucuccuugaag

SEQ ID NO: 1253993 - RNA, 19 nt, Homo sapiens
gaugaacacacacugguua

SEQ ID NO: 1253994 - RNA, 19 nt, Homo sapiens
gaaaggcgcagaccucaau

SEQ ID NO: 1253995 - RNA, 19 nt, Homo sapiens
gguagaucuuccuaauuua

SEQ ID NO: 1253996 - RNA, 19 nt, Homo sapiens
aacacacacugguuaauua

SEQ ID NO: 1253997 - RNA, 19 nt, Homo sapiens
ggaagaaagugaagguaac

SEQ ID NO: 1253998 - RNA, 19 nt, Homo sapiens
ccuauaaucccaacacuuu

SEQ ID NO: 1253999 - RNA, 19 nt, Homo sapiens
cgaacaaagucuccuugaa

SEQ ID NO: 1254000 - RNA, 19 nt, Homo sapiens
gggaagaaagugaagguaa

SEQ ID NO: 1254001 - RNA, 19 nt, Homo sapiens
gagaagagauauccuuuuc

SEQ ID NO: 1254002 - RNA, 19 nt, Homo sapiens
gguagaggaguacaaguuu

SEQ ID NO: 1254003 - RNA, 19 nt, Homo sapiens
gaagguaaccccaauaaau

SEQ ID NO: 1254004 - RNA, 19 nt, Homo sapiens
gaagagauauccuuuucug

SEQ ID NO: 1254005 - RNA, 19 nt, Homo sapiens
ccacaugguguaauaaaga

SEQ ID NO: 1254006 - RNA, 19 nt, Homo sapiens
gcaggagaauugcuugaac

SEQ ID NO: 1254007 - RNA, 19 nt, Homo sapiens
guagaggaguacaaguuuc

SEQ ID NO: 1254008 - RNA, 19 nt, Homo sapiens
uggcugcgauucugucuga

SEQ ID NO: 1254009 - RNA, 19 nt, Homo sapiens
gcaaaagggugugagcauu

SEQ ID NO: 1254010 - RNA, 19 nt, Homo sapiens
aagguaaggucuugagugu

SEQ ID NO: 1254011 - RNA, 19 nt, Homo sapiens
ucuacuaccugcuggagaa

SEQ ID NO: 1254012 - RNA, 19 nt, Homo sapiens
gaccaacaauagccagaca

SEQ ID NO: 1254013 - RNA, 19 nt, Homo sapiens
gaccugcugaccaacaaua

SEQ ID NO: 1254014 - RNA, 19 nt, Homo sapiens
gaagcuggcacucagaaag

SEQ ID NO: 1254015 - RNA, 19 nt, Homo sapiens
aaccagagccucagggaaa

SEQ ID NO: 1254016 - RNA, 19 nt, Homo sapiens
gagguugggugggcugaug

SEQ ID NO: 1254017 - RNA, 19 nt, Homo sapiens
ggaguggucacccggagaa

SEQ ID NO: 1254018 - RNA, 19 nt, Homo sapiens
acacacugguuaauuagca

SEQ ID NO: 1254019 - RNA, 19 nt, Homo sapiens
gcgaacaaagucuccuuga

SEQ ID NO: 1254020 - RNA, 19 nt, Homo sapiens
gaguucaacaccagcauga

SEQ ID NO: 1254021 - RNA, 19 nt, Homo sapiens
ggacacagggaagaaagug

SEQ ID NO: 1254022 - RNA, 19 nt, Homo sapiens
agacggcgaucgggagcua

SEQ ID NO: 1254023 - RNA, 19 nt, Homo sapiens
ggaagcuggcacucagaaa

SEQ ID NO: 1254024 - RNA, 19 nt, Homo sapiens
gcagucaggaauccacaug

SEQ ID NO: 1254025 - RNA, 19 nt, Homo sapiens
acauaaagcagucaggaau

SEQ ID NO: 1254026 - RNA, 19 nt, Homo sapiens
cuggguagaucuuccuaau

SEQ ID NO: 1254027 - RNA, 19 nt, Homo sapiens
cggagaagagauauccuuu

SEQ ID NO: 1254028 - RNA, 19 nt, Homo sapiens
acacagggaagaaagugaa

SEQ ID NO: 1254029 - RNA, 19 nt, Homo sapiens
ccguggaccugcugaccaa

SEQ ID NO: 1254030 - RNA, 19 nt, Homo sapiens
gguaaccccaauaaauuua

SEQ ID NO: 1254031 - RNA, 19 nt, Homo sapiens
ggagaagagauauccuuuu

SEQ ID NO: 1254032 - RNA, 19 nt, Homo sapiens
ggcugaggcaggagaauug

SEQ ID NO: 1254033 - RNA, 19 nt, Homo sapiens
ccuguaaucccagcuauuc

SEQ ID NO: 1254034 - RNA, 19 nt, Homo sapiens
ccaugcagcaggcgaacaa

SEQ ID NO: 1254035 - RNA, 19 nt, Homo sapiens
cauaaagcagucaggaauc

SEQ ID NO: 1254036 - RNA, 19 nt, Homo sapiens
gcagcaggcgaacaaaguc

SEQ ID NO: 1254037 - RNA, 19 nt, Homo sapiens
acaccagcaugaccaacau

SEQ ID NO: 1254038 - RNA, 19 nt, Homo sapiens
cacaugguguaauaaagag

SEQ ID NO: 1254039 - RNA, 19 nt, Homo sapiens
ggaauccacaugguguaau

SEQ ID NO: 1254040 - RNA, 19 nt, Homo sapiens
caggaauccacauggugua

SEQ ID NO: 1254041 - RNA, 19 nt, Homo sapiens
cacauaaagcagucaggaa

SEQ ID NO: 1254042 - RNA, 19 nt, Homo sapiens
ugguagaggaguacaaguu

SEQ ID NO: 1254043 - RNA, 19 nt, Homo sapiens
ggcaggagaauugcuugaa

SEQ ID NO: 1254044 - RNA, 19 nt, Homo sapiens
gacacagggaagaaaguga

SEQ ID NO: 1254045 - RNA, 19 nt, Homo sapiens
cuuccuaauuuaacucauc

SEQ ID NO: 1254046 - RNA, 19 nt, Homo sapiens
gagaagggcugcuauaagg

SEQ ID NO: 1254047 - RNA, 19 nt, Homo sapiens
gauggugccuuccuaguug

SEQ ID NO: 1254048 - RNA, 19 nt, Homo sapiens
ggcaauaagcaaagaaaua

SEQ ID NO: 1254049 - RNA, 19 nt, Homo sapiens
gaagguuccugcccucaug

SEQ ID NO: 1254050 - RNA, 19 nt, Homo sapiens
ggaagugcuuggugagguu

SEQ ID NO: 1254051 - RNA, 19 nt, Homo sapiens
ugagcuggcugguaaauuc

SEQ ID NO: 1254052 - RNA, 19 nt, Homo sapiens
gcgcaucucugugccauuc

SEQ ID NO: 1254053 - RNA, 19 nt, Homo sapiens
gcucaucucuggugaacag

SEQ ID NO: 1254054 - RNA, 19 nt, Homo sapiens
gaggagaagggcugcuaua

SEQ ID NO: 1254055 - RNA, 19 nt, Homo sapiens
uuugugagcuggcugguaa

SEQ ID NO: 1254056 - RNA, 19 nt, Homo sapiens
caacaagacagaugaaggu

SEQ ID NO: 1254057 - RNA, 19 nt, Homo sapiens
ggagaagggcugcuauaag

SEQ ID NO: 1254058 - RNA, 19 nt, Homo sapiens
aaacugccaucuacuaguc

SEQ ID NO: 1254059 - RNA, 19 nt, Homo sapiens
guccugaacucuaccaauc

SEQ ID NO: 1254060 - RNA, 19 nt, Homo sapiens
ggugggugcugcuguuaug

SEQ ID NO: 1254061 - RNA, 19 nt, Homo sapiens
uuugagaccugcuuauuca

SEQ ID NO: 1254062 - RNA, 19 nt, Homo sapiens
ggagggaggcaauaagcaa

SEQ ID NO: 1254063 - RNA, 19 nt, Homo sapiens
uaaugauggugccuuccua

SEQ ID NO: 1254064 - RNA, 19 nt, Homo sapiens
ucaguuucuucaucaguaa

SEQ ID NO: 1254065 - RNA, 19 nt, Homo sapiens
ucucccagcugaaauggaa

SEQ ID NO: 1254066 - RNA, 19 nt, Homo sapiens
ggccucaguuucuucauca

SEQ ID NO: 1254067 - RNA, 19 nt, Homo sapiens
ccaggugggugcugcuguu

SEQ ID NO: 1254068 - RNA, 19 nt, Homo sapiens
auacaggagucgaccuuug

SEQ ID NO: 1254069 - RNA, 19 nt, Homo sapiens
cuaguuggguuguggugaa

SEQ ID NO: 1254070 - RNA, 19 nt, Homo sapiens
auucaucucuccauugguu

SEQ ID NO: 1254071 - RNA, 19 nt, Homo sapiens
ccauucaucucuccauugg

SEQ ID NO: 1254072 - RNA, 19 nt, Homo sapiens
gggugcugcuguuaugauu

SEQ ID NO: 1254073 - RNA, 19 nt, Homo sapiens
ggugaagguuaaaugagau

SEQ ID NO: 1254074 - RNA, 19 nt, Homo sapiens
uggugaagguuaaaugaga

SEQ ID NO: 1254075 - RNA, 19 nt, Homo sapiens
ggguuguggugaagguuaa

SEQ ID NO: 1254076 - RNA, 19 nt, Homo sapiens
cacaaacugccaucuacua

SEQ ID NO: 1254077 - RNA, 19 nt, Homo sapiens
gaggcaauaagcaaagaaa

SEQ ID NO: 1254078 - RNA, 19 nt, Homo sapiens
guacggaugcgacuuggau

SEQ ID NO: 1254079 - RNA, 19 nt, Homo sapiens
gccaucuacuaguccauuu

SEQ ID NO: 1254080 - RNA, 19 nt, Homo sapiens
ugcaugauguaaugucaaa

SEQ ID NO: 1254081 - RNA, 19 nt, Homo sapiens
gggaggcaauaagcaaaga

SEQ ID NO: 1254082 - RNA, 19 nt, Homo sapiens
gagggaggcaauaagcaaa

SEQ ID NO: 1254083 - RNA, 19 nt, Homo sapiens
gggaugcuacugucaacaa

SEQ ID NO: 1254084 - RNA, 19 nt, Homo sapiens
cucaguuucuucaucagua

SEQ ID NO: 1254085 - RNA, 19 nt, Homo sapiens
gaugggaggucagggaacu

SEQ ID NO: 1254086 - RNA, 19 nt, Homo sapiens
gggccucaguuucuucauc

SEQ ID NO: 1254087 - RNA, 19 nt, Homo sapiens
ggaugcuacugucaacaag

SEQ ID NO: 1254088 - RNA, 19 nt, Homo sapiens
gcacaugccccucauaugg

SEQ ID NO: 1254089 - RNA, 19 nt, Homo sapiens
gcauacaggagucgaccuu

SEQ ID NO: 1254090 - RNA, 19 nt, Homo sapiens
gugcugcuguuaugauugg

SEQ ID NO: 1254091 - RNA, 19 nt, Homo sapiens
ccucugggcucuguuacug

SEQ ID NO: 1254092 - RNA, 19 nt, Homo sapiens
gaccuuugagaccugcuua

SEQ ID NO: 1254093 - RNA, 19 nt, Homo sapiens
gaagugcuuggugagguuu

SEQ ID NO: 1254094 - RNA, 19 nt, Homo sapiens
gggcucaucucuggugaac

SEQ ID NO: 1254095 - RNA, 19 nt, Homo sapiens
uuucacggaugucgaagug

SEQ ID NO: 1254096 - RNA, 19 nt, Homo sapiens
gcuuauucauggcuguuuc

SEQ ID NO: 1254097 - RNA, 19 nt, Homo sapiens
uacaggagucgaccuuuga

SEQ ID NO: 1254098 - RNA, 19 nt, Homo sapiens
ggaggcaauaagcaaagaa

SEQ ID NO: 1254099 - RNA, 19 nt, Homo sapiens
ucuacuaguccauuuguga

SEQ ID NO: 1254100 - RNA, 19 nt, Homo sapiens
cccuguggguggacacuuu

SEQ ID NO: 1254101 - RNA, 19 nt, Homo sapiens
ugauggugccuuccuaguu

SEQ ID NO: 1254102 - RNA, 19 nt, Homo sapiens
gcaucucugugccauucau

SEQ ID NO: 1254103 - RNA, 19 nt, Homo sapiens
caaacugccaucuacuagu

SEQ ID NO: 1254104 - RNA, 19 nt, Homo sapiens
gagcuggcugguaaauuca

SEQ ID NO: 1254105 - RNA, 19 nt, Homo sapiens
ugagaccugcuuauucaug

SEQ ID NO: 1254106 - RNA, 19 nt, Homo sapiens
aggagaagggcugcuauaa

SEQ ID NO: 1254107 - RNA, 19 nt, Homo sapiens
gccauucaucucuccauug

SEQ ID NO: 1254108 - RNA, 19 nt, Homo sapiens
ucaguaaaaugggauaaug

SEQ ID NO: 1254109 - RNA, 19 nt, Homo sapiens
gccgaagagcagccaauga

SEQ ID NO: 1254110 - RNA, 19 nt, Homo sapiens
uccacaaacugccaucuac

SEQ ID NO: 1254111 - RNA, 19 nt, Homo sapiens
caucuacuaguccauuugu

SEQ ID NO: 1254112 - RNA, 19 nt, Homo sapiens
gaugcuacugucaacaaga

SEQ ID NO: 1254113 - RNA, 19 nt, Homo sapiens
gccuggaggucugcgaguu

SEQ ID NO: 1254114 - RNA, 19 nt, Homo sapiens
cagaggagaagggcugcua

SEQ ID NO: 1254115 - RNA, 19 nt, Homo sapiens
aaugcaugauguaauguca

SEQ ID NO: 1254116 - RNA, 19 nt, Homo sapiens
acaaacugccaucuacuag

SEQ ID NO: 1254117 - RNA, 19 nt, Homo sapiens
guucuagggaugcuacugu

SEQ ID NO: 1254118 - RNA, 19 nt, Homo sapiens
ugccauucaucucuccauu

SEQ ID NO: 1254119 - RNA, 19 nt, Homo sapiens
gagaagagguucagcuaua

SEQ ID NO: 1254120 - RNA, 19 nt, Homo sapiens
gauauuaacuggcaaagau

SEQ ID NO: 1254121 - RNA, 19 nt, Homo sapiens
ggagagagcugcugucagu

SEQ ID NO: 1254122 - RNA, 19 nt, Homo sapiens
ccauaaugcugaccaaaua

SEQ ID NO: 1254123 - RNA, 19 nt, Homo sapiens
ggagugagcucuuccaaca

SEQ ID NO: 1254124 - RNA, 19 nt, Homo sapiens
ggacauaugcucauuauca

SEQ ID NO: 1254125 - RNA, 19 nt, Homo sapiens
gaaagacgggcuccuauuu

SEQ ID NO: 1254126 - RNA, 19 nt, Homo sapiens
gcaaugagguucacuggau

SEQ ID NO: 1254127 - RNA, 19 nt, Homo sapiens
gagaggaaaugaaccagaa

SEQ ID NO: 1254128 - RNA, 19 nt, Homo sapiens
caacaccgaucacaaugaa

SEQ ID NO: 1254129 - RNA, 19 nt, Homo sapiens
ccagaaacacucagcauua

SEQ ID NO: 1254130 - RNA, 19 nt, Homo sapiens
ccaaauaugcagccuauaa

SEQ ID NO: 1254131 - RNA, 19 nt, Homo sapiens
gaccaaauaugcagccuau

SEQ ID NO: 1254132 - RNA, 19 nt, Homo sapiens
gaucggagguguugguuca

SEQ ID NO: 1254133 - RNA, 19 nt, Homo sapiens
ggacauaccaagauuuaga

SEQ ID NO: 1254134 - RNA, 19 nt, Homo sapiens
ggucaaacaagaagugaua

SEQ ID NO: 1254135 - RNA, 19 nt, Homo sapiens
gcugauagagucauuaauu

SEQ ID NO: 1254136 - RNA, 19 nt, Homo sapiens
gaaacuguauccauaaugc

SEQ ID NO: 1254137 - RNA, 19 nt, Homo sapiens
gauaaaggaauccaaaguu

SEQ ID NO: 1254138 - RNA, 19 nt, Homo sapiens
ggaggcugcugcuaugauu

SEQ ID NO: 1254139 - RNA, 19 nt, Homo sapiens
uuaaagaguuggagaggaa

SEQ ID NO: 1254140 - RNA, 19 nt, Homo sapiens
caaugagguucacuggaua

SEQ ID NO: 1254141 - RNA, 19 nt, Homo sapiens
gcaagcaccuggagagcau

SEQ ID NO: 1254142 - RNA, 19 nt, Homo sapiens
cagaaacacucagcauuau

SEQ ID NO: 1254143 - RNA, 19 nt, Homo sapiens
ggaaagacgggcuccuauu

SEQ ID NO: 1254144 - RNA, 19 nt, Homo sapiens
aaagacgggcuccuauuua

SEQ ID NO: 1254145 - RNA, 19 nt, Homo sapiens
ggucaaagaguaugagaug

SEQ ID NO: 1254146 - RNA, 19 nt, Homo sapiens
auaaaggaauccaaaguug

SEQ ID NO: 1254147 - RNA, 19 nt, Homo sapiens
gaacagugccgccaguaca

SEQ ID NO: 1254148 - RNA, 19 nt, Homo sapiens
ggucuaccuuguauuguga

SEQ ID NO: 1254149 - RNA, 19 nt, Homo sapiens
gaccacagcacaccagaaa

SEQ ID NO: 1254150 - RNA, 19 nt, Homo sapiens
gcagucaagagcccuauuu

SEQ ID NO: 1254151 - RNA, 19 nt, Homo sapiens
guacugugaccuccgguua

SEQ ID NO: 1254152 - RNA, 19 nt, Homo sapiens
gaagagguucagcuauauu

SEQ ID NO: 1254153 - RNA, 19 nt, Homo sapiens
gggaaacuguauccauaau

SEQ ID NO: 1254154 - RNA, 19 nt, Homo sapiens
acgggaaacuguauccaua

SEQ ID NO: 1254155 - RNA, 19 nt, Homo sapiens
gaaacacucagcauuaugg

SEQ ID NO: 1254156 - RNA, 19 nt, Homo sapiens
gaggagaagcuguacuuug

SEQ ID NO: 1254157 - RNA, 19 nt, Homo sapiens
ccaggaggcugcugcuaug

SEQ ID NO: 1254158 - RNA, 19 nt, Homo sapiens
aguaugagaugccucugua

SEQ ID NO: 1254159 - RNA, 19 nt, Homo sapiens
aacaagaagugauaaagga

SEQ ID NO: 1254160 - RNA, 19 nt, Homo sapiens
gcaccacgcugacuauagc

SEQ ID NO: 1254161 - RNA, 19 nt, Homo sapiens
uaaaggaauccaaaguuga

SEQ ID NO: 1254162 - RNA, 19 nt, Homo sapiens
cugauagagucauuaauug

SEQ ID NO: 1254163 - RNA, 19 nt, Homo sapiens
guucagcuauauuucauca

SEQ ID NO: 1254164 - RNA, 19 nt, Homo sapiens
acaaggacaugagcaguga

SEQ ID NO: 1254165 - RNA, 19 nt, Homo sapiens
gauggagaccuuaaugaau

SEQ ID NO: 1254166 - RNA, 19 nt, Homo sapiens
gggagaagagguucagcua

SEQ ID NO: 1254167 - RNA, 19 nt, Homo sapiens
cacauucucuucuucuaug

SEQ ID NO: 1254168 - RNA, 19 nt, Homo sapiens
uaacaccuuucaccacugu

SEQ ID NO: 1254169 - RNA, 19 nt, Homo sapiens
gagcugcugucagugagaa

SEQ ID NO: 1254170 - RNA, 19 nt, Homo sapiens
ucacaggaaaggucaguuu

SEQ ID NO: 1254171 - RNA, 19 nt, Homo sapiens
aggagaagcuguacuuugg

SEQ ID NO: 1254172 - RNA, 19 nt, Homo sapiens
augaaaccuuccacauuua

SEQ ID NO: 1254173 - RNA, 19 nt, Homo sapiens
ggauuuagauaaugaaacc

SEQ ID NO: 1254174 - RNA, 19 nt, Homo sapiens
gcuaugauucccacacaaa

SEQ ID NO: 1254175 - RNA, 19 nt, Homo sapiens
gauaaacugagcuccauuc

SEQ ID NO: 1254176 - RNA, 19 nt, Homo sapiens
agaagagguucagcuauau

SEQ ID NO: 1254177 - RNA, 19 nt, Homo sapiens
aaaggaauccaaaguugaa

SEQ ID NO: 1254178 - RNA, 19 nt, Homo sapiens
gaccucggguuccaucaug

SEQ ID NO: 1254179 - RNA, 19 nt, Homo sapiens
caacaaagaagaggagaca

SEQ ID NO: 1254180 - RNA, 19 nt, Homo sapiens
ccucggacauaccaagauu

SEQ ID NO: 1254181 - RNA, 19 nt, Homo sapiens
acccaacagucccgcauua

SEQ ID NO: 1254182 - RNA, 19 nt, Homo sapiens
gcacggacuccuaaaccuu

SEQ ID NO: 1254183 - RNA, 19 nt, Homo sapiens
gggcuccuauuuacaguuc

SEQ ID NO: 1254184 - RNA, 19 nt, Homo sapiens
gcgaugaccuagacaagcu

SEQ ID NO: 1254185 - RNA, 19 nt, Homo sapiens
ccacagcacaccagaaaca

SEQ ID NO: 1254186 - RNA, 19 nt, Homo sapiens
ggagaagagguucagcuau

SEQ ID NO: 1254187 - RNA, 19 nt, Homo sapiens
cgauggagaccuuaaugaa

SEQ ID NO: 1254188 - RNA, 19 nt, Homo sapiens
ggaaacuguauccauaaug

SEQ ID NO: 1254189 - RNA, 19 nt, Homo sapiens
auggagaccuuaaugaaug

SEQ ID NO: 1254190 - RNA, 19 nt, Homo sapiens
ucggacauaccaagauuua

SEQ ID NO: 1254191 - RNA, 19 nt, Homo sapiens
gacauaugcucauuaucag

SEQ ID NO: 1254192 - RNA, 19 nt, Homo sapiens
cacaaaaccuggauuuaga

SEQ ID NO: 1254193 - RNA, 19 nt, Homo sapiens
ggccugacaucgagagcuu

SEQ ID NO: 1254194 - RNA, 19 nt, Homo sapiens
ggucuggcaugcugcuaug

SEQ ID NO: 1254195 - RNA, 19 nt, Homo sapiens
ggucugcaguaucgguuug

SEQ ID NO: 1254196 - RNA, 19 nt, Homo sapiens
gcgaggagaagcuguacuu

SEQ ID NO: 1254197 - RNA, 19 nt, Homo sapiens
uagacaagcugcuggaaaa

SEQ ID NO: 1254198 - RNA, 19 nt, Homo sapiens
ggaaaugaaccagaagagu

SEQ ID NO: 1254199 - RNA, 19 nt, Homo sapiens
gcuagcugauagagucauu

SEQ ID NO: 1254200 - RNA, 19 nt, Homo sapiens
gagguucagcuauauuuca

SEQ ID NO: 1254201 - RNA, 19 nt, Homo sapiens
ugaugagccugguguauac

SEQ ID NO: 1254202 - RNA, 19 nt, Homo sapiens
gauagagucauuaauugca

SEQ ID NO: 1254203 - RNA, 19 nt, Homo sapiens
gagaauggagugagcucuu

SEQ ID NO: 1254204 - RNA, 19 nt, Homo sapiens
gacggucuaccuuguauug

SEQ ID NO: 1254205 - RNA, 19 nt, Homo sapiens
gaggaaaugaaccagaaga

SEQ ID NO: 1254206 - RNA, 19 nt, Homo sapiens
ugagaugugacgagacuuu

SEQ ID NO: 1254207 - RNA, 19 nt, Homo sapiens
ggucagcuccuucccauac

SEQ ID NO: 1254208 - RNA, 19 nt, Homo sapiens
cuucaugccuucacauucu

SEQ ID NO: 1254209 - RNA, 19 nt, Homo sapiens
ccaggaaacgggaaacugu

SEQ ID NO: 1254210 - RNA, 19 nt, Homo sapiens
caaacaagaagugauaaag

SEQ ID NO: 1254211 - RNA, 19 nt, Homo sapiens
gggaaagacgggcuccuau

SEQ ID NO: 1254212 - RNA, 19 nt, Homo sapiens
ccaaagcggccuacagucu

SEQ ID NO: 1254213 - RNA, 19 nt, Homo sapiens
gucaugggcuagcugauag

SEQ ID NO: 1254214 - RNA, 19 nt, Homo sapiens
caugagcacggacuccuaa

SEQ ID NO: 1254215 - RNA, 19 nt, Homo sapiens
caagaagugauaaaggaau

SEQ ID NO: 1254216 - RNA, 19 nt, Homo sapiens
aaugaaagcagugaaguga

SEQ ID NO: 1254217 - RNA, 19 nt, Homo sapiens
gacucaagcuauuuaacuc

SEQ ID NO: 1254218 - RNA, 19 nt, Homo sapiens
cagcuauauuucaucauuc

SEQ ID NO: 1254219 - RNA, 19 nt, Homo sapiens
aaacauggcugcuuuauuu

SEQ ID NO: 1254220 - RNA, 19 nt, Homo sapiens
ggaaagagcccaucaauau

SEQ ID NO: 1254221 - RNA, 19 nt, Homo sapiens
caaaggcacuguuuagaua

SEQ ID NO: 1254222 - RNA, 19 nt, Homo sapiens
uaacaaagcugucagaaag

SEQ ID NO: 1254223 - RNA, 19 nt, Homo sapiens
gaagauagcuuuugccauu

SEQ ID NO: 1254224 - RNA, 19 nt, Homo sapiens
caggauaguuugguaauua

SEQ ID NO: 1254225 - RNA, 19 nt, Homo sapiens
cugaguagcuggaauuaua

SEQ ID NO: 1254226 - RNA, 19 nt, Homo sapiens
gcucuuaaauguccaguga

SEQ ID NO: 1254227 - RNA, 19 nt, Homo sapiens
gaaagcagaagcaaagaaa

SEQ ID NO: 1254228 - RNA, 19 nt, Homo sapiens
guggugaacuggaucauaa

SEQ ID NO: 1254229 - RNA, 19 nt, Homo sapiens
uaucuuggcucuuaaaugu

SEQ ID NO: 1254230 - RNA, 19 nt, Homo sapiens
ucacuuaaaugcuuguuga

SEQ ID NO: 1254231 - RNA, 19 nt, Homo sapiens
gcagaagccaggauaguuu

SEQ ID NO: 1254232 - RNA, 19 nt, Homo sapiens
gaagaaggguacagauuuu

SEQ ID NO: 1254233 - RNA, 19 nt, Homo sapiens
gaucauaaacgcaguacuu

SEQ ID NO: 1254234 - RNA, 19 nt, Homo sapiens
ggucuagaaucacuuaaau

SEQ ID NO: 1254235 - RNA, 19 nt, Homo sapiens
caccacgacuggcuaauuu

SEQ ID NO: 1254236 - RNA, 19 nt, Homo sapiens
cagaagaugucagaagaaa

SEQ ID NO: 1254237 - RNA, 19 nt, Homo sapiens
gaaaggacaauccaugaau

SEQ ID NO: 1254238 - RNA, 19 nt, Homo sapiens
gcuauuacauucaagaagu

SEQ ID NO: 1254239 - RNA, 19 nt, Homo sapiens
agacugaauuugaagauga

SEQ ID NO: 1254240 - RNA, 19 nt, Homo sapiens
aagcaauucuccugccuua

SEQ ID NO: 1254241 - RNA, 19 nt, Homo sapiens
ugaagaaggguacagauuu

SEQ ID NO: 1254242 - RNA, 19 nt, Homo sapiens
gggaaagagcccaucaaua

SEQ ID NO: 1254243 - RNA, 19 nt, Homo sapiens
aaauaauccuuccuacuga

SEQ ID NO: 1254244 - RNA, 19 nt, Homo sapiens
gaaagagcccaucaauauc

SEQ ID NO: 1254245 - RNA, 19 nt, Homo sapiens
cccgguuucuucauuauua

SEQ ID NO: 1254246 - RNA, 19 nt, Homo sapiens
uaacauugcuacaucuaag

SEQ ID NO: 1254247 - RNA, 19 nt, Homo sapiens
agugagauguuuagaacua

SEQ ID NO: 1254248 - RNA, 19 nt, Homo sapiens
ucacaaagaacuacccauu

SEQ ID NO: 1254249 - RNA, 19 nt, Homo sapiens
ccagucacauuguucuauu

SEQ ID NO: 1254250 - RNA, 19 nt, Homo sapiens
gguggcauuugcugguuua

SEQ ID NO: 1254251 - RNA, 19 nt, Homo sapiens
gauuuaugguccaaccuuu

SEQ ID NO: 1254252 - RNA, 19 nt, Homo sapiens
acaaagaacuacccauuuu

SEQ ID NO: 1254253 - RNA, 19 nt, Homo sapiens
aaacuaaacuccucauucc

SEQ ID NO: 1254254 - RNA, 19 nt, Homo sapiens
uaauuaaacgcccaaacua

SEQ ID NO: 1254255 - RNA, 19 nt, Homo sapiens
gaacuacgacuugcucugu

SEQ ID NO: 1254256 - RNA, 19 nt, Homo sapiens
cuuaaaugcuuguugaaug

SEQ ID NO: 1254257 - RNA, 19 nt, Homo sapiens
ucacauuauucuagccuuu

SEQ ID NO: 1254258 - RNA, 19 nt, Homo sapiens
gaagauaaaggcgaaggaa

SEQ ID NO: 1254259 - RNA, 19 nt, Homo sapiens
aucaauaucuuggcucuua

SEQ ID NO: 1254260 - RNA, 19 nt, Homo sapiens
caaacuaaacuccucauuc

SEQ ID NO: 1254261 - RNA, 19 nt, Homo sapiens
caacauuccgcccaacaaa

SEQ ID NO: 1254262 - RNA, 19 nt, Homo sapiens
cagcuccggucacauuauu

SEQ ID NO: 1254263 - RNA, 19 nt, Homo sapiens
uaaaggcgaaggaaucauu

SEQ ID NO: 1254264 - RNA, 19 nt, Homo sapiens
uggaaagacugcccuugaa

SEQ ID NO: 1254265 - RNA, 19 nt, Homo sapiens
aaagacugcccuugaagua

SEQ ID NO: 1254266 - RNA, 19 nt, Homo sapiens
gaaagacugcccuugaagu

SEQ ID NO: 1254267 - RNA, 19 nt, Homo sapiens
ugagugagauguuuagaac

SEQ ID NO: 1254268 - RNA, 19 nt, Homo sapiens
ccaaagugcugggauuaca

SEQ ID NO: 1254269 - RNA, 19 nt, Homo sapiens
gugccacacuggacuuaaa

SEQ ID NO: 1254270 - RNA, 19 nt, Homo sapiens
aaccauugcuuucucugua

SEQ ID NO: 1254271 - RNA, 19 nt, Homo sapiens
ugaaugagugagauguuua

SEQ ID NO: 1254272 - RNA, 19 nt, Homo sapiens
gcaguuuguuuaccgugaa

SEQ ID NO: 1254273 - RNA, 19 nt, Homo sapiens
gcgaaggaaucauuauggu

SEQ ID NO: 1254274 - RNA, 19 nt, Homo sapiens
agacugcccuugaaguaug

SEQ ID NO: 1254275 - RNA, 19 nt, Homo sapiens
ucacugugcuguuccagau

SEQ ID NO: 1254276 - RNA, 19 nt, Homo sapiens
gauaaaggcgaaggaauca

SEQ ID NO: 1254277 - RNA, 19 nt, Homo sapiens
aaucauacaucugcuacaa

SEQ ID NO: 1254278 - RNA, 19 nt, Homo sapiens
gcagaagaugucagaagaa

SEQ ID NO: 1254279 - RNA, 19 nt, Homo sapiens
guaauuaaacgcccaaacu

SEQ ID NO: 1254280 - RNA, 19 nt, Homo sapiens
ugcagaagaugucagaaga

SEQ ID NO: 1254281 - RNA, 19 nt, Homo sapiens
guuaauugcuauguggaaa

SEQ ID NO: 1254282 - RNA, 19 nt, Homo sapiens
ucaauaucuuggcucuuaa

SEQ ID NO: 1254283 - RNA, 19 nt, Homo sapiens
ucagaaagcagaagcaaag

SEQ ID NO: 1254284 - RNA, 19 nt, Homo sapiens
cacaaagaacuacccauuu

SEQ ID NO: 1254285 - RNA, 19 nt, Homo sapiens
uaaccuaugcaguaagauu

SEQ ID NO: 1254286 - RNA, 19 nt, Homo sapiens
gaagaugucagaagaaaau

SEQ ID NO: 1254287 - RNA, 19 nt, Homo sapiens
gaaggucaaagccaagaug

SEQ ID NO: 1254288 - RNA, 19 nt, Homo sapiens
caaacauggcugcuuuauu

SEQ ID NO: 1254289 - RNA, 19 nt, Homo sapiens
gagaauaacagcuauaccu

SEQ ID NO: 1254290 - RNA, 19 nt, Homo sapiens
gcaccuuucugagcuagau

SEQ ID NO: 1254291 - RNA, 19 nt, Homo sapiens
aaaggacaauccaugaauc

SEQ ID NO: 1254292 - RNA, 19 nt, Homo sapiens
ucaacgguauguuucucua

SEQ ID NO: 1254293 - RNA, 19 nt, Homo sapiens
uaauugcuauguggaaaga

SEQ ID NO: 1254294 - RNA, 19 nt, Homo sapiens
ccaggauaguuugguaauu

SEQ ID NO: 1254295 - RNA, 19 nt, Homo sapiens
ucauuccagugucguuuaa

SEQ ID NO: 1254296 - RNA, 19 nt, Homo sapiens
aaggcacuguuuagauaua

SEQ ID NO: 1254297 - RNA, 19 nt, Homo sapiens
ugccuuagccuccugagua

SEQ ID NO: 1254298 - RNA, 19 nt, Homo sapiens
cgaaaggacaauccaugaa

SEQ ID NO: 1254299 - RNA, 19 nt, Homo sapiens
ggaaagacugcccuugaag

SEQ ID NO: 1254300 - RNA, 19 nt, Homo sapiens
ugugagcacuguaauucuu

SEQ ID NO: 1254301 - RNA, 19 nt, Homo sapiens
cuaacaaagcugucagaaa

SEQ ID NO: 1254302 - RNA, 19 nt, Homo sapiens
uuacaaaggcacuguuuag

SEQ ID NO: 1254303 - RNA, 19 nt, Homo sapiens
guccuaacauugcuacauc

SEQ ID NO: 1254304 - RNA, 19 nt, Homo sapiens
guacuuguccuaacauugc

SEQ ID NO: 1254305 - RNA, 19 nt, Homo sapiens
gaaccauugcuuucucugu

SEQ ID NO: 1254306 - RNA, 19 nt, Homo sapiens
aauuaaacgcccaaacuaa

SEQ ID NO: 1254307 - RNA, 19 nt, Homo sapiens
cguuuaaccuaugcaguaa

SEQ ID NO: 1254308 - RNA, 19 nt, Homo sapiens
cagucacauuguucuauuu

SEQ ID NO: 1254309 - RNA, 19 nt, Homo sapiens
uaacaggcagguggcauuu

SEQ ID NO: 1254310 - RNA, 19 nt, Homo sapiens
gacuggagaauaagaaaga

SEQ ID NO: 1254311 - RNA, 19 nt, Homo sapiens
aagccaggauaguuuggua

SEQ ID NO: 1254312 - RNA, 19 nt, Homo sapiens
ccagugucguuuaaccuau

SEQ ID NO: 1254313 - RNA, 19 nt, Homo sapiens
uugaaugagugagauguuu

SEQ ID NO: 1254314 - RNA, 19 nt, Homo sapiens
gaacuccuggccucaagug

SEQ ID NO: 1254315 - RNA, 19 nt, Homo sapiens
gcaauucuccugccuuagc

SEQ ID NO: 1254316 - RNA, 19 nt, Homo sapiens
ccaguuuacuaguucuuuc

SEQ ID NO: 1254317 - RNA, 19 nt, Homo sapiens
acacuggacuuaaauucag

SEQ ID NO: 1254318 - RNA, 19 nt, Homo sapiens
uagagaaucaacacuguga

SEQ ID NO: 1254319 - RNA, 19 nt, Homo sapiens
ccaaauagcucccaauauc

SEQ ID NO: 1254320 - RNA, 19 nt, Homo sapiens
ugaaacaucuguacaagaa

SEQ ID NO: 1254321 - RNA, 19 nt, Homo sapiens
ggacacaaccaaaucauaa

SEQ ID NO: 1254322 - RNA, 19 nt, Homo sapiens
gcucuucucuccaguguuu

SEQ ID NO: 1254323 - RNA, 19 nt, Homo sapiens
ggaggaacuucuaaucauu

SEQ ID NO: 1254324 - RNA, 19 nt, Homo sapiens
gcauggaccuccuuguuga

SEQ ID NO: 1254325 - RNA, 19 nt, Homo sapiens
ggauuaaagucugguauga

SEQ ID NO: 1254326 - RNA, 19 nt, Homo sapiens
gaacugaagacaucaagga

SEQ ID NO: 1254327 - RNA, 19 nt, Homo sapiens
caggucagcuccuccagua

SEQ ID NO: 1254328 - RNA, 19 nt, Homo sapiens
gcuagggacuacuuaauag

SEQ ID NO: 1254329 - RNA, 19 nt, Homo sapiens
aaacaucuguacaagaaga

SEQ ID NO: 1254330 - RNA, 19 nt, Homo sapiens
caggguaacuucccaacaa

SEQ ID NO: 1254331 - RNA, 19 nt, Homo sapiens
ggaauuggcagauauagca

SEQ ID NO: 1254332 - RNA, 19 nt, Homo sapiens
gggaugacuuucugguauu

SEQ ID NO: 1254333 - RNA, 19 nt, Homo sapiens
ggaugacuuucugguauuu

SEQ ID NO: 1254334 - RNA, 19 nt, Homo sapiens
gguaacauaacaagcauuu

SEQ ID NO: 1254335 - RNA, 19 nt, Homo sapiens
ccaguuacguuguguaugg

SEQ ID NO: 1254336 - RNA, 19 nt, Homo sapiens
ccaggcacccucccaguua

SEQ ID NO: 1254337 - RNA, 19 nt, Homo sapiens
gagacagccucauuuacug

SEQ ID NO: 1254338 - RNA, 19 nt, Homo sapiens
gaggaacuucuaaucauuu

SEQ ID NO: 1254339 - RNA, 19 nt, Homo sapiens
gauccggaauuggcagaua

SEQ ID NO: 1254340 - RNA, 19 nt, Homo sapiens
cugaaguccugguaacaua

SEQ ID NO: 1254341 - RNA, 19 nt, Homo sapiens
gagaauguacuggcgauuu

SEQ ID NO: 1254342 - RNA, 19 nt, Homo sapiens
gagagcaguuuuacaaauu

SEQ ID NO: 1254343 - RNA, 19 nt, Homo sapiens
caauagacaaagacagaua

SEQ ID NO: 1254344 - RNA, 19 nt, Homo sapiens
gauaaggaggaacuucuaa

SEQ ID NO: 1254345 - RNA, 19 nt, Homo sapiens
cagaauaucucuuuauccu

SEQ ID NO: 1254346 - RNA, 19 nt, Homo sapiens
guucuucauucucagagua

SEQ ID NO: 1254347 - RNA, 19 nt, Homo sapiens
ccucuaccaucaaauaaug

SEQ ID NO: 1254348 - RNA, 19 nt, Homo sapiens
cugaagacaucaaggagaa

SEQ ID NO: 1254349 - RNA, 19 nt, Homo sapiens
ggauaaggaggaacuucua

SEQ ID NO: 1254350 - RNA, 19 nt, Homo sapiens
ccaauucuuuccauuucuu

SEQ ID NO: 1254351 - RNA, 19 nt, Homo sapiens
uaacauaacaagcauuugg

SEQ ID NO: 1254352 - RNA, 19 nt, Homo sapiens
gcauuuggaaaggcaauua

SEQ ID NO: 1254353 - RNA, 19 nt, Homo sapiens
ugcacuggcuaauguauuu

SEQ ID NO: 1254354 - RNA, 19 nt, Homo sapiens
gcacucagccugccaagac

SEQ ID NO: 1254355 - RNA, 19 nt, Homo sapiens
acauacacauacagcauuu

SEQ ID NO: 1254356 - RNA, 19 nt, Homo sapiens
ggcaauagacaaagacaga

SEQ ID NO: 1254357 - RNA, 19 nt, Homo sapiens
ggcuuugccuuucauauca

SEQ ID NO: 1254358 - RNA, 19 nt, Homo sapiens
ggaaauuagauccuguuau

SEQ ID NO: 1254359 - RNA, 19 nt, Homo sapiens
cuucucaguuuguuugaaa

SEQ ID NO: 1254360 - RNA, 19 nt, Homo sapiens
ucauaucauuccauaccua

SEQ ID NO: 1254361 - RNA, 19 nt, Homo sapiens
uaccaaauagcucccaaua

SEQ ID NO: 1254362 - RNA, 19 nt, Homo sapiens
cagccucuaccaucaaaua

SEQ ID NO: 1254363 - RNA, 19 nt, Homo sapiens
guaacuucccaacaagaua

SEQ ID NO: 1254364 - RNA, 19 nt, Homo sapiens
gggaaauuagauccuguua

SEQ ID NO: 1254365 - RNA, 19 nt, Homo sapiens
acacauacagcauuuggaa

SEQ ID NO: 1254366 - RNA, 19 nt, Homo sapiens
uaguuucacuuggucauaa

SEQ ID NO: 1254367 - RNA, 19 nt, Homo sapiens
ucagggcaauagacaaaga

SEQ ID NO: 1254368 - RNA, 19 nt, Homo sapiens
gaagacaucaaggagaaug

SEQ ID NO: 1254369 - RNA, 19 nt, Homo sapiens
ucagugcccuucagcaaca

SEQ ID NO: 1254370 - RNA, 19 nt, Homo sapiens
uaccacaacuucugagagu

SEQ ID NO: 1254371 - RNA, 19 nt, Homo sapiens
ccuuucauaucauuccaua

SEQ ID NO: 1254372 - RNA, 19 nt, Homo sapiens
cuaugcaugucuucauuga

SEQ ID NO: 1254373 - RNA, 19 nt, Homo sapiens
gcucuucucaguuuguuug

SEQ ID NO: 1254374 - RNA, 19 nt, Homo sapiens
gacuuucugguauuucuua

SEQ ID NO: 1254375 - RNA, 19 nt, Homo sapiens
gcaauuucaagugucauuu

SEQ ID NO: 1254376 - RNA, 19 nt, Homo sapiens
augcaugucuucauugaug

SEQ ID NO: 1254377 - RNA, 19 nt, Homo sapiens
acacauggacucccucuuc

SEQ ID NO: 1254378 - RNA, 19 nt, Homo sapiens
ugaucgaacugaagacauc

SEQ ID NO: 1254379 - RNA, 19 nt, Homo sapiens
gauauagcauagcacaaaa

SEQ ID NO: 1254380 - RNA, 19 nt, Homo sapiens
agauauagcauagcacaaa

SEQ ID NO: 1254381 - RNA, 19 nt, Homo sapiens
ucagcaauuucaaguguca

SEQ ID NO: 1254382 - RNA, 19 nt, Homo sapiens
caaauagcucccaauaucu

SEQ ID NO: 1254383 - RNA, 19 nt, Homo sapiens
guuccaauucuuuccauuu

SEQ ID NO: 1254384 - RNA, 19 nt, Homo sapiens
agggaugacuuucugguau

SEQ ID NO: 1254385 - RNA, 19 nt, Homo sapiens
gugcauggaccuccuuguu

SEQ ID NO: 1254386 - RNA, 19 nt, Homo sapiens
acugcaaccugacagauga

SEQ ID NO: 1254387 - RNA, 19 nt, Homo sapiens
agauaucuguggaugcuau

SEQ ID NO: 1254388 - RNA, 19 nt, Homo sapiens
uaaggaggaacuucuaauc

SEQ ID NO: 1254389 - RNA, 19 nt, Homo sapiens
acauauagcagaccaaucu

SEQ ID NO: 1254390 - RNA, 19 nt, Homo sapiens
auuaaagucugguaugauc

SEQ ID NO: 1254391 - RNA, 19 nt, Homo sapiens
ccacaacuucugagaguca

SEQ ID NO: 1254392 - RNA, 19 nt, Homo sapiens
uggcagauauagcauagca

SEQ ID NO: 1254393 - RNA, 19 nt, Homo sapiens
uuucagcaauuucaagugu

SEQ ID NO: 1254394 - RNA, 19 nt, Homo sapiens
cuggaagccucgucauguu

SEQ ID NO: 1254395 - RNA, 19 nt, Homo sapiens
aggaggaacuucuaaucau

SEQ ID NO: 1254396 - RNA, 19 nt, Homo sapiens
uaacuucccaacaagauag

SEQ ID NO: 1254397 - RNA, 19 nt, Homo sapiens
ugaaguccugguaacauaa

SEQ ID NO: 1254398 - RNA, 19 nt, Homo sapiens
uaacauauagcagaccaau

SEQ ID NO: 1254399 - RNA, 19 nt, Homo sapiens
ugccaguacucccugcuaa

SEQ ID NO: 1254400 - RNA, 19 nt, Homo sapiens
caucaaauaaugacugucu

SEQ ID NO: 1254401 - RNA, 19 nt, Homo sapiens
cuuccuguauuguuucauu

SEQ ID NO: 1254402 - RNA, 19 nt, Homo sapiens
agauaguucugucuugcaa

SEQ ID NO: 1254403 - RNA, 19 nt, Homo sapiens
uaucuggcuuugccuuuca

SEQ ID NO: 1254404 - RNA, 19 nt, Homo sapiens
ggacuacuuaauagggaaa

SEQ ID NO: 1254405 - RNA, 19 nt, Homo sapiens
gaagccucgucauguucuu

SEQ ID NO: 1254406 - RNA, 19 nt, Homo sapiens
gaacauggggaaauuagau

SEQ ID NO: 1254407 - RNA, 19 nt, Homo sapiens
gguaacuucccaacaagau

SEQ ID NO: 1254408 - RNA, 19 nt, Homo sapiens
agaauguacuggcgauuuu

SEQ ID NO: 1254409 - RNA, 19 nt, Homo sapiens
gguaugaucgacugaccuu

SEQ ID NO: 1254410 - RNA, 19 nt, Homo sapiens
uacagccucuaccaucaaa

SEQ ID NO: 1254411 - RNA, 19 nt, Homo sapiens
ccaccuccacgacauuuau

SEQ ID NO: 1254412 - RNA, 19 nt, Homo sapiens
caaccugacagaugagaca

SEQ ID NO: 1254413 - RNA, 19 nt, Homo sapiens
acaaucagcuagggacuac

SEQ ID NO: 1254414 - RNA, 19 nt, Homo sapiens
caacaagauaguucugucu

SEQ ID NO: 1254415 - RNA, 19 nt, Homo sapiens
cggacacaaccaaaucaua

SEQ ID NO: 1254416 - RNA, 19 nt, Homo sapiens
cugcuguucuuccuguauu

SEQ ID NO: 1254417 - RNA, 19 nt, Homo sapiens
uguauggccugaagcucuu

SEQ ID NO: 1254418 - RNA, 19 nt, Homo sapiens
ggcauuacuugaucgaacu

SEQ ID NO: 1254419 - RNA, 19 nt, Homo sapiens
gaacaugucucuccugagu

SEQ ID NO: 1254420 - RNA, 19 nt, Homo sapiens
gaucuucucuuccuuaaau

SEQ ID NO: 1254421 - RNA, 19 nt, Homo sapiens
ggacguggcucgcuucuuc

SEQ ID NO: 1254422 - RNA, 19 nt, Homo sapiens
ggagagcccuuaagucugu

SEQ ID NO: 1254423 - RNA, 19 nt, Homo sapiens
gaguaaagaucccaauguu

SEQ ID NO: 1254424 - RNA, 19 nt, Homo sapiens
ggaacacucagacagauua

SEQ ID NO: 1254425 - RNA, 19 nt, Homo sapiens
caucugagccucugaguaa

SEQ ID NO: 1254426 - RNA, 19 nt, Homo sapiens
gaagagaauuccauaugca

SEQ ID NO: 1254427 - RNA, 19 nt, Homo sapiens
ggaacucgaucuucucuuc

SEQ ID NO: 1254428 - RNA, 19 nt, Homo sapiens
ucaaagcucucagaaggua

SEQ ID NO: 1254429 - RNA, 19 nt, Homo sapiens
ggaggaguuuguaaagauu

SEQ ID NO: 1254430 - RNA, 19 nt, Homo sapiens
gcacugcacucccauaaaa

SEQ ID NO: 1254431 - RNA, 19 nt, Homo sapiens
gguaagagccagcugauau

SEQ ID NO: 1254432 - RNA, 19 nt, Homo sapiens
gcucagcguugccauaaga

SEQ ID NO: 1254433 - RNA, 19 nt, Homo sapiens
gaagacauccugagcuuuc

SEQ ID NO: 1254434 - RNA, 19 nt, Homo sapiens
gcccagcagucaauuguuu

SEQ ID NO: 1254435 - RNA, 19 nt, Homo sapiens
gggaggaguuuguaaagau

SEQ ID NO: 1254436 - RNA, 19 nt, Homo sapiens
ccacucaacucuaccugaa

SEQ ID NO: 1254437 - RNA, 19 nt, Homo sapiens
gaaagccaguugcccugaa

SEQ ID NO: 1254438 - RNA, 19 nt, Homo sapiens
acacaggacccuuaacuuu

SEQ ID NO: 1254439 - RNA, 19 nt, Homo sapiens
ggacgagaccgacuuaauc

SEQ ID NO: 1254440 - RNA, 19 nt, Homo sapiens
agagguggcucguuucuug

SEQ ID NO: 1254441 - RNA, 19 nt, Homo sapiens
auaagaaggugaugaagga

SEQ ID NO: 1254442 - RNA, 19 nt, Homo sapiens
guaaagaucccaauguucu

SEQ ID NO: 1254443 - RNA, 19 nt, Homo sapiens
gaccugucacuguuuauua

SEQ ID NO: 1254444 - RNA, 19 nt, Homo sapiens
ucagacagauuaaggauac

SEQ ID NO: 1254445 - RNA, 19 nt, Homo sapiens
ccacuuauucugccuguuu

SEQ ID NO: 1254446 - RNA, 19 nt, Homo sapiens
gacuuaauccuccuaguuu

SEQ ID NO: 1254447 - RNA, 19 nt, Homo sapiens
ucugguaccuucaauguau

SEQ ID NO: 1254448 - RNA, 19 nt, Homo sapiens
ggaggaacacucagacaga

SEQ ID NO: 1254449 - RNA, 19 nt, Homo sapiens
gaacuacacagccuacuac

SEQ ID NO: 1254450 - RNA, 19 nt, Homo sapiens
ggcgaugccuucauucaga

SEQ ID NO: 1254451 - RNA, 19 nt, Homo sapiens
guacaagaacacacaauuc

SEQ ID NO: 1254452 - RNA, 19 nt, Homo sapiens
gaaucaaggguccaucuga

SEQ ID NO: 1254453 - RNA, 19 nt, Homo sapiens
gagcacugcacucccauaa

SEQ ID NO: 1254454 - RNA, 19 nt, Homo sapiens
ucaaagagcccagcaguca

SEQ ID NO: 1254455 - RNA, 19 nt, Homo sapiens
cacuagagguggcucguuu

SEQ ID NO: 1254456 - RNA, 19 nt, Homo sapiens
cgaagagaauuccauaugc

SEQ ID NO: 1254457 - RNA, 19 nt, Homo sapiens
gaggaacacucagacagau

SEQ ID NO: 1254458 - RNA, 19 nt, Homo sapiens
gcaaaaccacaaacuauuu

SEQ ID NO: 1254459 - RNA, 19 nt, Homo sapiens
acaagggcaugcuggguaa

SEQ ID NO: 1254460 - RNA, 19 nt, Homo sapiens
ggaagucaagacaauggua

SEQ ID NO: 1254461 - RNA, 19 nt, Homo sapiens
caagaacacacaauuccaa

SEQ ID NO: 1254462 - RNA, 19 nt, Homo sapiens
cgacuuaauccuccuaguu

SEQ ID NO: 1254463 - RNA, 19 nt, Homo sapiens
gaacacucagacagauuaa

SEQ ID NO: 1254464 - RNA, 19 nt, Homo sapiens
cggcaggcuugcuuucuuu

SEQ ID NO: 1254465 - RNA, 19 nt, Homo sapiens
gcuccauccuccacuuauu

SEQ ID NO: 1254466 - RNA, 19 nt, Homo sapiens
gcgauacauugaacucuuc

SEQ ID NO: 1254467 - RNA, 19 nt, Homo sapiens
gcauaaggaguaacagaug

SEQ ID NO: 1254468 - RNA, 19 nt, Homo sapiens
gagagaaagccaggaggua

SEQ ID NO: 1254469 - RNA, 19 nt, Homo sapiens
gguaagcgauacauugaac

SEQ ID NO: 1254470 - RNA, 19 nt, Homo sapiens
ugauaaagcagaaauacga

SEQ ID NO: 1254471 - RNA, 19 nt, Homo sapiens
guuuaggacuggagacaga

SEQ ID NO: 1254472 - RNA, 19 nt, Homo sapiens
ccaaggaauggguguguuu

SEQ ID NO: 1254473 - RNA, 19 nt, Homo sapiens
ggagacggcagcucuauac

SEQ ID NO: 1254474 - RNA, 19 nt, Homo sapiens
cagcagacaccauggaaug

SEQ ID NO: 1254475 - RNA, 19 nt, Homo sapiens
ccacaugggcguccgcuau

SEQ ID NO: 1254476 - RNA, 19 nt, Homo sapiens
ggaccuagcgcugcagaga

SEQ ID NO: 1254477 - RNA, 19 nt, Homo sapiens
uauccuccaucuacucaaa

SEQ ID NO: 1254478 - RNA, 19 nt, Homo sapiens
ccacagaggaugacuuugg

SEQ ID NO: 1254479 - RNA, 19 nt, Homo sapiens
ggaauggguguguuuguag

SEQ ID NO: 1254480 - RNA, 19 nt, Homo sapiens
aggaauggguguguuugua

SEQ ID NO: 1254481 - RNA, 19 nt, Homo sapiens
ggacugggagggacugugu

SEQ ID NO: 1254482 - RNA, 19 nt, Homo sapiens
gcaugcagggugucccaua

SEQ ID NO: 1254483 - RNA, 19 nt, Homo sapiens
uacaugcucugcacugaug

SEQ ID NO: 1254484 - RNA, 19 nt, Homo sapiens
agacaaugguagcuguuau

SEQ ID NO: 1254485 - RNA, 19 nt, Homo sapiens
uaaagaucccaauguucua

SEQ ID NO: 1254486 - RNA, 19 nt, Homo sapiens
gaucacuggucguccucuu

SEQ ID NO: 1254487 - RNA, 19 nt, Homo sapiens
ucuaugaccuccgaagaga

SEQ ID NO: 1254488 - RNA, 19 nt, Homo sapiens
ccgaagagaauuccauaug

SEQ ID NO: 1254489 - RNA, 19 nt, Homo sapiens
cacaggacccuuaacuuug

SEQ ID NO: 1254490 - RNA, 19 nt, Homo sapiens
caggugggcauaaggagua

SEQ ID NO: 1254491 - RNA, 19 nt, Homo sapiens
ggauagggaggcagagaga

SEQ ID NO: 1254492 - RNA, 19 nt, Homo sapiens
agagaaagccaggagguaa

SEQ ID NO: 1254493 - RNA, 19 nt, Homo sapiens
gaacggggauguggcuuug

SEQ ID NO: 1254494 - RNA, 19 nt, Homo sapiens
gcucugguaccuucaaugu

SEQ ID NO: 1254495 - RNA, 19 nt, Homo sapiens
cagagccgcuggacaaggu

SEQ ID NO: 1254496 - RNA, 19 nt, Homo sapiens
gcuacccgcugaugacuac

SEQ ID NO: 1254497 - RNA, 19 nt, Homo sapiens
gccauaagaaggugaugaa

SEQ ID NO: 1254498 - RNA, 19 nt, Homo sapiens
gcuguuauccuccaucuac

SEQ ID NO: 1254499 - RNA, 19 nt, Homo sapiens
cuucuucccuuuguauuug

SEQ ID NO: 1254500 - RNA, 19 nt, Homo sapiens
ccucagagaccauguugug

SEQ ID NO: 1254501 - RNA, 19 nt, Homo sapiens
caccauggcacaggguuua

SEQ ID NO: 1254502 - RNA, 19 nt, Homo sapiens
gagcccagcagucaauugu

SEQ ID NO: 1254503 - RNA, 19 nt, Homo sapiens
gggcauaaggaguaacaga

SEQ ID NO: 1254504 - RNA, 19 nt, Homo sapiens
guaagagccagcugauauc

SEQ ID NO: 1254505 - RNA, 19 nt, Homo sapiens
caacugcuggcucuucuuc

SEQ ID NO: 1254506 - RNA, 19 nt, Homo sapiens
aaagacacaggacccuuaa

SEQ ID NO: 1254507 - RNA, 19 nt, Homo sapiens
gacauguucuucuccuucu

SEQ ID NO: 1254508 - RNA, 19 nt, Homo sapiens
gcaccuggagagcccuuaa

SEQ ID NO: 1254509 - RNA, 19 nt, Homo sapiens
gcgaugccuucauucagau

SEQ ID NO: 1254510 - RNA, 19 nt, Homo sapiens
uugaagacauccugagcuu

SEQ ID NO: 1254511 - RNA, 19 nt, Homo sapiens
ucgaucuucucuuccuuaa

SEQ ID NO: 1254512 - RNA, 19 nt, Homo sapiens
uaaaauggaagcucuggua

SEQ ID NO: 1254513 - RNA, 19 nt, Homo sapiens
ugaacuacacagccuacua

SEQ ID NO: 1254514 - RNA, 19 nt, Homo sapiens
cacaugggcguccgcuaua

SEQ ID NO: 1254515 - RNA, 19 nt, Homo sapiens
gauuaaggauacuguugac

SEQ ID NO: 1254516 - RNA, 19 nt, Homo sapiens
cagauuaaggauacuguug

SEQ ID NO: 1254517 - RNA, 19 nt, Homo sapiens
ugaguaaagaucccaaugu

SEQ ID NO: 1254518 - RNA, 19 nt, Homo sapiens
gcacaaaucgcugguucgu

SEQ ID NO: 1254519 - RNA, 19 nt, Homo sapiens
gcacaagccuggacaaguu

SEQ ID NO: 1254520 - RNA, 19 nt, Homo sapiens
gaaagagcauggacucaaa

SEQ ID NO: 1254521 - RNA, 19 nt, Homo sapiens
gcaaaucacuggcuacaag

SEQ ID NO: 1254522 - RNA, 19 nt, Homo sapiens
gagauugccuucaccauug

SEQ ID NO: 1254523 - RNA, 19 nt, Homo sapiens
gacaaguucuuccauauug

SEQ ID NO: 1254524 - RNA, 19 nt, Homo sapiens
gaagaucugucccuuagag

SEQ ID NO: 1254525 - RNA, 19 nt, Homo sapiens
ccaccacacuccugacuaa

SEQ ID NO: 1254526 - RNA, 19 nt, Homo sapiens
caaagagucuccaguugau

SEQ ID NO: 1254527 - RNA, 19 nt, Homo sapiens
gaaaagcacuaugggguua

SEQ ID NO: 1254528 - RNA, 19 nt, Homo sapiens
ggacaaguucuuccauauu

SEQ ID NO: 1254529 - RNA, 19 nt, Homo sapiens
gaucugggaugauguuuac

SEQ ID NO: 1254530 - RNA, 19 nt, Homo sapiens
ggagaagguugagcugcua

SEQ ID NO: 1254531 - RNA, 19 nt, Homo sapiens
ucagcaaguuuaagagaaa

SEQ ID NO: 1254532 - RNA, 19 nt, Homo sapiens
uaaagcgacuaauagcauu

SEQ ID NO: 1254533 - RNA, 19 nt, Homo sapiens
acacugaucccaucccaua

SEQ ID NO: 1254534 - RNA, 19 nt, Homo sapiens
ccaaagagucuccaguuga

SEQ ID NO: 1254535 - RNA, 19 nt, Homo sapiens
guaugugugucuaucauug

SEQ ID NO: 1254536 - RNA, 19 nt, Homo sapiens
caucccauauugcaucuuu

SEQ ID NO: 1254537 - RNA, 19 nt, Homo sapiens
gccaaagagucuccaguug

SEQ ID NO: 1254538 - RNA, 19 nt, Homo sapiens
gagcauggacucaaacauc

SEQ ID NO: 1254539 - RNA, 19 nt, Homo sapiens
ccagucauguucuuccaaa

SEQ ID NO: 1254540 - RNA, 19 nt, Homo sapiens
ccucuugauuguggaauua

SEQ ID NO: 1254541 - RNA, 19 nt, Homo sapiens
ccacccaacucccaucuuc

SEQ ID NO: 1254542 - RNA, 19 nt, Homo sapiens
uuugguagcugaaauaauc

SEQ ID NO: 1254543 - RNA, 19 nt, Homo sapiens
gagcaagucccaggucauu

SEQ ID NO: 1254544 - RNA, 19 nt, Homo sapiens
gaucagcaaguuuaagaga

SEQ ID NO: 1254545 - RNA, 19 nt, Homo sapiens
gaagagauggauaucaagu

SEQ ID NO: 1254546 - RNA, 19 nt, Homo sapiens
ccacacuccugacuaaugg

SEQ ID NO: 1254547 - RNA, 19 nt, Homo sapiens
caacucccaucuucuugug

SEQ ID NO: 1254548 - RNA, 19 nt, Homo sapiens
ucuauuguaucuccuuuga

SEQ ID NO: 1254549 - RNA, 19 nt, Homo sapiens
caugagcgguugucuucuu

SEQ ID NO: 1254550 - RNA, 19 nt, Homo sapiens
ccaggucauugcagagaaa

SEQ ID NO: 1254551 - RNA, 19 nt, Homo sapiens
gugcaauauuucucuuuga

SEQ ID NO: 1254552 - RNA, 19 nt, Homo sapiens
gcugcuaaagcgacuaaua

SEQ ID NO: 1254553 - RNA, 19 nt, Homo sapiens
gaaccggaucagcaaguuu

SEQ ID NO: 1254554 - RNA, 19 nt, Homo sapiens
ggagaauacagugcaauau

SEQ ID NO: 1254555 - RNA, 19 nt, Homo sapiens
uugaagaucugucccuuag

SEQ ID NO: 1254556 - RNA, 19 nt, Homo sapiens
gaacucaaggagaaaguag

SEQ ID NO: 1254557 - RNA, 19 nt, Homo sapiens
caacaccgagugccuuaga

SEQ ID NO: 1254558 - RNA, 19 nt, Homo sapiens
uaauggagauuggcugcuu

SEQ ID NO: 1254559 - RNA, 19 nt, Homo sapiens
ggccaaagagucuccaguu

SEQ ID NO: 1254560 - RNA, 19 nt, Homo sapiens
ggaacucaaggagaaagua

SEQ ID NO: 1254561 - RNA, 19 nt, Homo sapiens
gaucugauggcucaaucuu

SEQ ID NO: 1254562 - RNA, 19 nt, Homo sapiens
cugcggagguuguccauca

SEQ ID NO: 1254563 - RNA, 19 nt, Homo sapiens
agagauggauaucaaguac

SEQ ID NO: 1254564 - RNA, 19 nt, Homo sapiens
acaaguucuuccauauuga

SEQ ID NO: 1254565 - RNA, 19 nt, Homo sapiens
auaaucggcuaucaccauu

SEQ ID NO: 1254566 - RNA, 19 nt, Homo sapiens
ccagaacccgauuugauga

SEQ ID NO: 1254567 - RNA, 19 nt, Homo sapiens
gaaggcagccagaggaacu

SEQ ID NO: 1254568 - RNA, 19 nt, Homo sapiens
gagcugcuaaagcgacuaa

SEQ ID NO: 1254569 - RNA, 19 nt, Homo sapiens
aaccggaucagcaaguuua

SEQ ID NO: 1254570 - RNA, 19 nt, Homo sapiens
gagaggagaacagcgagaa

SEQ ID NO: 1254571 - RNA, 19 nt, Homo sapiens
uggagaauacagugcaaua

SEQ ID NO: 1254572 - RNA, 19 nt, Homo sapiens
ugaaagagcauggacucaa

SEQ ID NO: 1254573 - RNA, 19 nt, Homo sapiens
gauuggcugcuuucaggua

SEQ ID NO: 1254574 - RNA, 19 nt, Homo sapiens
ucugaugucuauuguaucu

SEQ ID NO: 1254575 - RNA, 19 nt, Homo sapiens
agagauugccuucaccauu

SEQ ID NO: 1254576 - RNA, 19 nt, Homo sapiens
gcucccugcugacugcauu

SEQ ID NO: 1254577 - RNA, 19 nt, Homo sapiens
aaucggcuaucaccauuuc

SEQ ID NO: 1254578 - RNA, 19 nt, Homo sapiens
caccagaacccgauuugau

SEQ ID NO: 1254579 - RNA, 19 nt, Homo sapiens
gcgagaaccggaucagcaa

SEQ ID NO: 1254580 - RNA, 19 nt, Homo sapiens
guugaagaucugucccuua

SEQ ID NO: 1254581 - RNA, 19 nt, Homo sapiens
gcuugagacuuagguacuu

SEQ ID NO: 1254582 - RNA, 19 nt, Homo sapiens
gagcaaccccuguaaucua

SEQ ID NO: 1254583 - RNA, 19 nt, Homo sapiens
gagcccaccuccacucacu

SEQ ID NO: 1254584 - RNA, 19 nt, Homo sapiens
gcagagaaagcaccagaac

SEQ ID NO: 1254585 - RNA, 19 nt, Homo sapiens
aagccucucuuugauagaa

SEQ ID NO: 1254586 - RNA, 19 nt, Homo sapiens
uaacacugccacccaacuu

SEQ ID NO: 1254587 - RNA, 19 nt, Homo sapiens
cuaaagcgacuaauagcau

SEQ ID NO: 1254588 - RNA, 19 nt, Homo sapiens
acacuuugguagcugaaau

SEQ ID NO: 1254589 - RNA, 19 nt, Homo sapiens
uccgggaacucaaggagaa

SEQ ID NO: 1254590 - RNA, 19 nt, Homo sapiens
uugaugagcccaaccagaa

SEQ ID NO: 1254591 - RNA, 19 nt, Homo sapiens
gcaccagaacccgauuuga

SEQ ID NO: 1254592 - RNA, 19 nt, Homo sapiens
ugacugcauuuccugaucu

SEQ ID NO: 1254593 - RNA, 19 nt, Homo sapiens
gagaagguugagcugcuaa

SEQ ID NO: 1254594 - RNA, 19 nt, Homo sapiens
ccgcaucugcuaccugauu

SEQ ID NO: 1254595 - RNA, 19 nt, Homo sapiens
cugaucccaucccauauug

SEQ ID NO: 1254596 - RNA, 19 nt, Homo sapiens
caaaaccagucauguucuu

SEQ ID NO: 1254597 - RNA, 19 nt, Homo sapiens
cggaucagcaaguuuaaga

SEQ ID NO: 1254598 - RNA, 19 nt, Homo sapiens
gggaucugauggcucaauc

SEQ ID NO: 1254599 - RNA, 19 nt, Homo sapiens
cgcaucugcuaccugauuu

SEQ ID NO: 1254600 - RNA, 19 nt, Homo sapiens
aaacucgucugacaaugcu

SEQ ID NO: 1254601 - RNA, 19 nt, Homo sapiens
ugacggagaggaagcaaag

SEQ ID NO: 1254602 - RNA, 19 nt, Homo sapiens
agcauggacucaaacauca

SEQ ID NO: 1254603 - RNA, 19 nt, Homo sapiens
gguagcugaaauaaucaua

SEQ ID NO: 1254604 - RNA, 19 nt, Homo sapiens
aagagauggauaucaagua

SEQ ID NO: 1254605 - RNA, 19 nt, Homo sapiens
gaucccaucccauauugca

SEQ ID NO: 1254606 - RNA, 19 nt, Homo sapiens
gaaaguagaaaagcacuau

SEQ ID NO: 1254607 - RNA, 19 nt, Homo sapiens
gauuuuauccuggagaaua

SEQ ID NO: 1254608 - RNA, 19 nt, Homo sapiens
ggauucagcaguuucuuuu

SEQ ID NO: 1254609 - RNA, 19 nt, Homo sapiens
cagucuggauucagcaguu

SEQ ID NO: 1254610 - RNA, 19 nt, Homo sapiens
uguaaucuacuccuuggaa

SEQ ID NO: 1254611 - RNA, 19 nt, Homo sapiens
uguuaaaugucagccugua

SEQ ID NO: 1254612 - RNA, 19 nt, Homo sapiens
gagaaccggaucagcaagu

SEQ ID NO: 1254613 - RNA, 19 nt, Homo sapiens
agugcaauauuucucuuug

SEQ ID NO: 1254614 - RNA, 19 nt, Homo sapiens
gguaugugugucuaucauu

SEQ ID NO: 1254615 - RNA, 19 nt, Homo sapiens
ucagguaugugugucuauc

SEQ ID NO: 1254616 - RNA, 19 nt, Homo sapiens
aauggagauuggcugcuuu

SEQ ID NO: 1254617 - RNA, 19 nt, Homo sapiens
caaguucuuccauauugau

SEQ ID NO: 1254618 - RNA, 19 nt, Homo sapiens
ccgaagagaagccaaagca

SEQ ID NO: 1254619 - RNA, 19 nt, Homo sapiens
aaacaacuuugcagcauua

SEQ ID NO: 1254620 - RNA, 19 nt, Homo sapiens
gaacacacaucuugguaug

SEQ ID NO: 1254621 - RNA, 19 nt, Homo sapiens
gaacacaucagaauugguu

SEQ ID NO: 1254622 - RNA, 19 nt, Homo sapiens
gaugagagaugauccuuca

SEQ ID NO: 1254623 - RNA, 19 nt, Homo sapiens
gcaaagcagugagaaaguu

SEQ ID NO: 1254624 - RNA, 19 nt, Homo sapiens
ugacuaagccuacuuuauu

SEQ ID NO: 1254625 - RNA, 19 nt, Homo sapiens
gaugauccuucaaccguua

SEQ ID NO: 1254626 - RNA, 19 nt, Homo sapiens
gagaaugugugucuacguu

SEQ ID NO: 1254627 - RNA, 19 nt, Homo sapiens
aguauaagcuuucuaguug

SEQ ID NO: 1254628 - RNA, 19 nt, Homo sapiens
gaagagaucugauuuuauc

SEQ ID NO: 1254629 - RNA, 19 nt, Homo sapiens
ugagaaaguugaggugaua

SEQ ID NO: 1254630 - RNA, 19 nt, Homo sapiens
gagcauauuugcaaccaau

SEQ ID NO: 1254631 - RNA, 19 nt, Homo sapiens
aagcuuaggcuguuaaaua

SEQ ID NO: 1254632 - RNA, 19 nt, Homo sapiens
gauguuagguugucuuugg

SEQ ID NO: 1254633 - RNA, 19 nt, Homo sapiens
gaaaugugcaauaccaauu

SEQ ID NO: 1254634 - RNA, 19 nt, Homo sapiens
gaaugugugucuacguuug

SEQ ID NO: 1254635 - RNA, 19 nt, Homo sapiens
gacaaguucucagcguuua

SEQ ID NO: 1254636 - RNA, 19 nt, Homo sapiens
ucacuggagccaucuauua

SEQ ID NO: 1254637 - RNA, 19 nt, Homo sapiens
ggagagaccuuuuccaguu

SEQ ID NO: 1254638 - RNA, 19 nt, Homo sapiens
caacaacgaaguaaauaug

SEQ ID NO: 1254639 - RNA, 19 nt, Homo sapiens
gaacuuaaaccggauuguu

SEQ ID NO: 1254640 - RNA, 19 nt, Homo sapiens
ucucagcguuuaaaucuuu

SEQ ID NO: 1254641 - RNA, 19 nt, Homo sapiens
aagaauggcuccagguuau

SEQ ID NO: 1254642 - RNA, 19 nt, Homo sapiens
gaaaacaaaucuaggugaa

SEQ ID NO: 1254643 - RNA, 19 nt, Homo sapiens
ugggauaaaugcugacuuu

SEQ ID NO: 1254644 - RNA, 19 nt, Homo sapiens
aggcagagguugcaguuaa

SEQ ID NO: 1254645 - RNA, 19 nt, Homo sapiens
auaacaaacugcagugaaa

SEQ ID NO: 1254646 - RNA, 19 nt, Homo sapiens
uaaacaacuuugcagcauu

SEQ ID NO: 1254647 - RNA, 19 nt, Homo sapiens
gcaaucaaguuguaaaaga

SEQ ID NO: 1254648 - RNA, 19 nt, Homo sapiens
caacuuugcagcauuaaug

SEQ ID NO: 1254649 - RNA, 19 nt, Homo sapiens
ggaaagcugcauccaaguu

SEQ ID NO: 1254650 - RNA, 19 nt, Homo sapiens
uaauucccaucuucugaua

SEQ ID NO: 1254651 - RNA, 19 nt, Homo sapiens
gcuauucggucagcagaaa

SEQ ID NO: 1254652 - RNA, 19 nt, Homo sapiens
guggaaagcugaaggaaac

SEQ ID NO: 1254653 - RNA, 19 nt, Homo sapiens
aaacaaaucuaggugaaag

SEQ ID NO: 1254654 - RNA, 19 nt, Homo sapiens
guuugugucuguauuugua

SEQ ID NO: 1254655 - RNA, 19 nt, Homo sapiens
gacuaagccuacuuuauuc

SEQ ID NO: 1254656 - RNA, 19 nt, Homo sapiens
gguaucuucugccauuaaa

SEQ ID NO: 1254657 - RNA, 19 nt, Homo sapiens
caaccucaccuauguuuau

SEQ ID NO: 1254658 - RNA, 19 nt, Homo sapiens
gaaauuggaacacacaucu
